United States Patent 7,655,785 (BIOINFORMATICALLY DETECTABLE GROUP OF NOVEL REGULATORY OLIGONUCLEOTIDES AND USES THEREOF) - sequence listing, part 13

SEQ ID NO: 493053 - RNA, 18 nt, Homo sapiens
ugcaucccagcauucugu

SEQ ID NO: 493054 - RNA, 17 nt, Homo sapiens
ugcaucccugcagcuca

SEQ ID NO: 493055 - RNA, 15 nt, Homo sapiens
ugcauguguguauaa

SEQ ID NO: 493056 - RNA, 18 nt, Homo sapiens
ugccaggaaaagaaaaau

SEQ ID NO: 493057 - RNA, 17 nt, Homo sapiens
ugccccacuacaggccc

SEQ ID NO: 493058 - RNA, 18 nt, Homo sapiens
ugccccgucuacagcucc

SEQ ID NO: 493059 - RNA, 13 nt, Homo sapiens
ugcccguggugag

SEQ ID NO: 493060 - RNA, 15 nt, Homo sapiens
ugcccuucacuguca

SEQ ID NO: 493061 - RNA, 17 nt, Homo sapiens
ugccguggcaacugugg

SEQ ID NO: 493062 - RNA, 19 nt, Homo sapiens
ugccugggguguaaugagc

SEQ ID NO: 493063 - RNA, 16 nt, Homo sapiens
ugcgcaaaacugaaag

SEQ ID NO: 493064 - RNA, 16 nt, Homo sapiens
ugcggaguugugcacg

SEQ ID NO: 493065 - RNA, 19 nt, Homo sapiens
ugcuaaccuuuucaccucc

SEQ ID NO: 493066 - RNA, 19 nt, Homo sapiens
ugcuaauccaggacagcau

SEQ ID NO: 493067 - RNA, 18 nt, Homo sapiens
ugcuaccacagcaacuau

SEQ ID NO: 493068 - RNA, 22 nt, Homo sapiens
ugcucaagccggaaacucggca

SEQ ID NO: 493069 - RNA, 13 nt, Homo sapiens
ugcucacacaauc

SEQ ID NO: 493070 - RNA, 19 nt, Homo sapiens
ugcuccuccuccuguauuc

SEQ ID NO: 493071 - RNA, 13 nt, Homo sapiens
ugcugcacugccc

SEQ ID NO: 493072 - RNA, 18 nt, Homo sapiens
ugcugucuucgaggacag

SEQ ID NO: 493073 - RNA, 19 nt, Homo sapiens
ugcuuaccucucagccuua

SEQ ID NO: 493074 - RNA, 14 nt, Homo sapiens
ugcuuccugucuua

SEQ ID NO: 493075 - RNA, 20 nt, Homo sapiens
ugcuuccugucuuauccucc

SEQ ID NO: 493076 - RNA, 17 nt, Homo sapiens
cugaauaaaauauugau

SEQ ID NO: 493077 - RNA, 13 nt, Homo sapiens
cugaauugcacau

SEQ ID NO: 493078 - RNA, 14 nt, Homo sapiens
cugacuuccugaac

SEQ ID NO: 493079 - RNA, 22 nt, Homo sapiens
cugagacgcaaggaucacuuga

SEQ ID NO: 493080 - RNA, 22 nt, Homo sapiens
cugaggcaugaaaauuguguua

SEQ ID NO: 493081 - RNA, 21 nt, Homo sapiens
cugaguagucauuuugcccau

SEQ ID NO: 493082 - RNA, 13 nt, Homo sapiens
cugagugagcuga

SEQ ID NO: 493083 - RNA, 14 nt, Homo sapiens
cugauaauauugau

SEQ ID NO: 493084 - RNA, 11 nt, Homo sapiens
cugaucugcag

SEQ ID NO: 493085 - RNA, 20 nt, Homo sapiens
cugaucugcaguuuuugccu

SEQ ID NO: 493086 - RNA, 19 nt, Homo sapiens
cugaugugacgcacuguau

SEQ ID NO: 493087 - RNA, 14 nt, Homo sapiens
cugauuguuuucau

SEQ ID NO: 493088 - RNA, 22 nt, Homo sapiens
cugauuuaaacuucuuaacugg

SEQ ID NO: 493089 - RNA, 15 nt, Homo sapiens
cugcaaugagccaug

SEQ ID NO: 493090 - RNA, 23 nt, Homo sapiens
cugcaccaccgaccaacuccaga

SEQ ID NO: 493091 - RNA, 14 nt, Homo sapiens
cugcaccuuugcac

SEQ ID NO: 493092 - RNA, 12 nt, Homo sapiens
cugcagauuccu

SEQ ID NO: 493093 - RNA, 15 nt, Homo sapiens
cugcaggaacaugac

SEQ ID NO: 493094 - RNA, 14 nt, Homo sapiens
cugcaggaaucaaa

SEQ ID NO: 493095 - RNA, 14 nt, Homo sapiens
cugcagucaucucc

SEQ ID NO: 493096 - RNA, 15 nt, Homo sapiens
cugccaagaguccaa

SEQ ID NO: 493097 - RNA, 17 nt, Homo sapiens
cugccaagaguccaagc

SEQ ID NO: 493098 - RNA, 20 nt, Homo sapiens
cugccuguggugagguccug

SEQ ID NO: 493099 - RNA, 18 nt, Homo sapiens
cugcuccuccaguacaau

SEQ ID NO: 493100 - RNA, 14 nt, Homo sapiens
cugcugcuggucac

SEQ ID NO: 493101 - RNA, 20 nt, Homo sapiens
cugcuuaaauuucuccagug

SEQ ID NO: 493102 - RNA, 21 nt, Homo sapiens
cuggaaaaaaaaaaauaugag

SEQ ID NO: 493103 - RNA, 23 nt, Homo sapiens
cuggaauaagaagcaaauaaaua

SEQ ID NO: 493104 - RNA, 20 nt, Homo sapiens
cuggaccugagcuauucuca

SEQ ID NO: 493105 - RNA, 20 nt, Homo sapiens
cuggaggaaauccuaccuuu

SEQ ID NO: 493106 - RNA, 23 nt, Homo sapiens
cuggcagggcaggcagagcucag

SEQ ID NO: 493107 - RNA, 15 nt, Homo sapiens
cuggcauuugcugca

SEQ ID NO: 493108 - RNA, 16 nt, Homo sapiens
cuggcccuugcuuacc

SEQ ID NO: 493109 - RNA, 13 nt, Homo sapiens
cuggcucuaggac

SEQ ID NO: 493110 - RNA, 18 nt, Homo sapiens
cugggacuucuuacccaa

SEQ ID NO: 493111 - RNA, 13 nt, Homo sapiens
cugggcucugggu

SEQ ID NO: 493112 - RNA, 13 nt, Homo sapiens
cuggguccuuaaa

SEQ ID NO: 493113 - RNA, 17 nt, Homo sapiens
cugguccugcacugucc

SEQ ID NO: 493114 - RNA, 22 nt, Homo sapiens
cuggugucguauuuugccuguu

SEQ ID NO: 493115 - RNA, 21 nt, Homo sapiens
cuggugucuaauaaacacaga

SEQ ID NO: 493116 - RNA, 12 nt, Homo sapiens
cuguacuuugau

SEQ ID NO: 493117 - RNA, 21 nt, Homo sapiens
cuguagaucaaccugaugauu

SEQ ID NO: 493118 - RNA, 15 nt, Homo sapiens
cugucaaguuuuuau

SEQ ID NO: 493119 - RNA, 23 nt, Homo sapiens
cugucaguucuaaccuccuaagc

SEQ ID NO: 493120 - RNA, 23 nt, Homo sapiens
cugucaugugcgaacacagugac

SEQ ID NO: 493121 - RNA, 18 nt, Homo sapiens
cugucauucaaaugggug

SEQ ID NO: 493122 - RNA, 20 nt, Homo sapiens
cuguccccgagccgagcucu

SEQ ID NO: 493123 - RNA, 19 nt, Homo sapiens
cugucuggaggggagcucu

SEQ ID NO: 493124 - RNA, 20 nt, Homo sapiens
cugugcaacaaacucaaaau

SEQ ID NO: 493125 - RNA, 16 nt, Homo sapiens
cuguggccugccaguc

SEQ ID NO: 493126 - RNA, 21 nt, Homo sapiens
cuguggucuucaaauugucuu

SEQ ID NO: 493127 - RNA, 13 nt, Homo sapiens
cuguguccccgcg

SEQ ID NO: 493128 - RNA, 17 nt, Homo sapiens
cugugugugauuugcua

SEQ ID NO: 493129 - RNA, 20 nt, Homo sapiens
cuguuaaaucguaacaagca

SEQ ID NO: 493130 - RNA, 19 nt, Homo sapiens
cuguuaaauggggagacaa

SEQ ID NO: 493131 - RNA, 13 nt, Homo sapiens
cuguugacaucca

SEQ ID NO: 493132 - RNA, 16 nt, Homo sapiens
cuuaaaugaucaagga

SEQ ID NO: 493133 - RNA, 23 nt, Homo sapiens
cuuaaugucucuucauaauacuu

SEQ ID NO: 493134 - RNA, 19 nt, Homo sapiens
cuuacagaaccaauucacu

SEQ ID NO: 493135 - RNA, 22 nt, Homo sapiens
cuuagaaaauaaauacaaguuu

SEQ ID NO: 493136 - RNA, 15 nt, Homo sapiens
cuuagaauacuguau

SEQ ID NO: 493137 - RNA, 16 nt, Homo sapiens
cuuagaauacuguauu

SEQ ID NO: 493138 - RNA, 20 nt, Homo sapiens
cuuagcguucuguuucacca

SEQ ID NO: 493139 - RNA, 15 nt, Homo sapiens
cuucaaacgaaaugg

SEQ ID NO: 493140 - RNA, 16 nt, Homo sapiens
cuucacucacugucaa

SEQ ID NO: 493141 - RNA, 16 nt, Homo sapiens
cuucagcauguucuca

SEQ ID NO: 493142 - RNA, 13 nt, Homo sapiens
cuucagccauagu

SEQ ID NO: 493143 - RNA, 16 nt, Homo sapiens
cuucaggaauaugcau

SEQ ID NO: 493144 - RNA, 11 nt, Homo sapiens
cuucagggugg

SEQ ID NO: 493145 - RNA, 13 nt, Homo sapiens
cuucauaauacuu

SEQ ID NO: 493146 - RNA, 16 nt, Homo sapiens
cuucauuuuuccuaac

SEQ ID NO: 493147 - RNA, 22 nt, Homo sapiens
cuuccagaugauccuugcacag

SEQ ID NO: 493148 - RNA, 15 nt, Homo sapiens
cuucccccaccacca

SEQ ID NO: 493149 - RNA, 23 nt, Homo sapiens
cuuccccggggucuucuaccuca

SEQ ID NO: 493150 - RNA, 14 nt, Homo sapiens
cuucccuaguucuu

SEQ ID NO: 493151 - RNA, 13 nt, Homo sapiens
cuuccuacucuuc

SEQ ID NO: 493152 - RNA, 20 nt, Homo sapiens
cuuccugaacucccagucau

SEQ ID NO: 493153 - RNA, 14 nt, Homo sapiens
cuucuaguauauua

SEQ ID NO: 493154 - RNA, 18 nt, Homo sapiens
cuucuaguggguuuaaug

SEQ ID NO: 493155 - RNA, 17 nt, Homo sapiens
cuucuccacaaccuccu

SEQ ID NO: 493156 - RNA, 23 nt, Homo sapiens
cuucuccacagggacacagucug

SEQ ID NO: 493157 - RNA, 13 nt, Homo sapiens
cuucucuagacau

SEQ ID NO: 493158 - RNA, 21 nt, Homo sapiens
cuucuuaauauaacugccuua

SEQ ID NO: 493159 - RNA, 14 nt, Homo sapiens
cuucuuaaucugaa

SEQ ID NO: 493160 - RNA, 15 nt, Homo sapiens
cuucuuacccaaagc

SEQ ID NO: 493161 - RNA, 18 nt, Homo sapiens
cuugauucuugugauuga

SEQ ID NO: 493162 - RNA, 14 nt, Homo sapiens
cuugcccaugcaca

SEQ ID NO: 493163 - RNA, 22 nt, Homo sapiens
cuugccccuguuaccuaauuag

SEQ ID NO: 493164 - RNA, 17 nt, Homo sapiens
cuugccugaacuccugc

SEQ ID NO: 493165 - RNA, 20 nt, Homo sapiens
cuugcuuuauuuuucauuac

SEQ ID NO: 493166 - RNA, 16 nt, Homo sapiens
cuuggcucagacaccu

SEQ ID NO: 493167 - RNA, 15 nt, Homo sapiens
cuuggguaauuaaaa

SEQ ID NO: 493168 - RNA, 22 nt, Homo sapiens
cuuguggcuccacacacacaaa

SEQ ID NO: 493169 - RNA, 16 nt, Homo sapiens
cuuguuguuucuugcc

SEQ ID NO: 493170 - RNA, 21 nt, Homo sapiens
cuuuaaugauaaaaucccauu

SEQ ID NO: 493171 - RNA, 21 nt, Homo sapiens
cuuuacuuuguacaaauguaa

SEQ ID NO: 493172 - RNA, 18 nt, Homo sapiens
cuuuauaggauaacugau

SEQ ID NO: 493173 - RNA, 21 nt, Homo sapiens
cuuucccuccuuuucccaaag

SEQ ID NO: 493174 - RNA, 20 nt, Homo sapiens
cuuuccucuuaaugucucaa

SEQ ID NO: 493175 - RNA, 14 nt, Homo sapiens
cuuuccugggucug

SEQ ID NO: 493176 - RNA, 15 nt, Homo sapiens
cuuucugauacuuau

SEQ ID NO: 493177 - RNA, 18 nt, Homo sapiens
cuuucugccaacuuuguu

SEQ ID NO: 493178 - RNA, 14 nt, Homo sapiens
cuuugaaaacucau

SEQ ID NO: 493179 - RNA, 22 nt, Homo sapiens
cuuugaggugucucaaucugau

SEQ ID NO: 493180 - RNA, 13 nt, Homo sapiens
cuuugauuuccaa

SEQ ID NO: 493181 - RNA, 22 nt, Homo sapiens
cuuugcuauggggacauuccaa

SEQ ID NO: 493182 - RNA, 14 nt, Homo sapiens
cuuuggaaggugac

SEQ ID NO: 493183 - RNA, 21 nt, Homo sapiens
cuuuguaagagcaaaagccuc

SEQ ID NO: 493184 - RNA, 13 nt, Homo sapiens
cuuuguguagaaa

SEQ ID NO: 493185 - RNA, 20 nt, Homo sapiens
cuuuguguagaaagccaaau

SEQ ID NO: 493186 - RNA, 13 nt, Homo sapiens
cuuuguuaauuua

SEQ ID NO: 493187 - RNA, 12 nt, Homo sapiens
cuuuuacauucu

SEQ ID NO: 493188 - RNA, 17 nt, Homo sapiens
cuuuuauaauacauuaa

SEQ ID NO: 493189 - RNA, 20 nt, Homo sapiens
cuuuuauucauuagcuguga

SEQ ID NO: 493190 - RNA, 23 nt, Homo sapiens
cuuuuccaacauacaauuuacuu

SEQ ID NO: 493191 - RNA, 20 nt, Homo sapiens
cuuuugcuggucacugccau

SEQ ID NO: 493192 - RNA, 17 nt, Homo sapiens
cuuuuuuuaaguguucu

SEQ ID NO: 493193 - RNA, 20 nt, Homo sapiens
gaaaaaaugcagggugauuu

SEQ ID NO: 493194 - RNA, 15 nt, Homo sapiens
gaaaaagcccucuuc

SEQ ID NO: 493195 - RNA, 13 nt, Homo sapiens
gaaaaaggcuucu

SEQ ID NO: 493196 - RNA, 13 nt, Homo sapiens
gaaaaccucuuuc

SEQ ID NO: 493197 - RNA, 23 nt, Homo sapiens
gaaaacgauuuaauuuauucuaa

SEQ ID NO: 493198 - RNA, 17 nt, Homo sapiens
gaaaacuaaguucucua

SEQ ID NO: 493199 - RNA, 13 nt, Homo sapiens
gaaaagcaugaaa

SEQ ID NO: 493200 - RNA, 12 nt, Homo sapiens
gaaaauaaguga

SEQ ID NO: 493201 - RNA, 18 nt, Homo sapiens
gaaaauaguucccuuugc

SEQ ID NO: 493202 - RNA, 20 nt, Homo sapiens
gaaaaugcaccucauuccag

SEQ ID NO: 493203 - RNA, 22 nt, Homo sapiens
gaaacagauuuaagcaagacca

SEQ ID NO: 493204 - RNA, 12 nt, Homo sapiens
gaaacauuggaa

SEQ ID NO: 493205 - RNA, 14 nt, Homo sapiens
gaaacuacaaagga

SEQ ID NO: 493206 - RNA, 22 nt, Homo sapiens
gaaaguguuacauauucuuuca

SEQ ID NO: 493207 - RNA, 15 nt, Homo sapiens
gaaauacaacagaag

SEQ ID NO: 493208 - RNA, 13 nt, Homo sapiens
gaaauacauauga

SEQ ID NO: 493209 - RNA, 13 nt, Homo sapiens
gaaauaccuauuc

SEQ ID NO: 493210 - RNA, 15 nt, Homo sapiens
gaaauacuugacaac

SEQ ID NO: 493211 - RNA, 13 nt, Homo sapiens
gaaauauucacaa

SEQ ID NO: 493212 - RNA, 19 nt, Homo sapiens
gaaauccgggucaagugaa

SEQ ID NO: 493213 - RNA, 21 nt, Homo sapiens
gggucaugaugcucuuuccca

SEQ ID NO: 493214 - RNA, 13 nt, Homo sapiens
gguacacacuuga

SEQ ID NO: 493215 - RNA, 18 nt, Homo sapiens
gguacgaguagagguuua

SEQ ID NO: 493216 - RNA, 17 nt, Homo sapiens
gguaucugaugauguuc

SEQ ID NO: 493217 - RNA, 16 nt, Homo sapiens
ggucaucccggggcca

SEQ ID NO: 493218 - RNA, 14 nt, Homo sapiens
gguccugcacuguc

SEQ ID NO: 493219 - RNA, 12 nt, Homo sapiens
ggucgccaguga

SEQ ID NO: 493220 - RNA, 14 nt, Homo sapiens
ggucuucaggcauu

SEQ ID NO: 493221 - RNA, 19 nt, Homo sapiens
ggucuucuaccucagacac

SEQ ID NO: 493222 - RNA, 13 nt, Homo sapiens
ggugagguccugu

SEQ ID NO: 493223 - RNA, 17 nt, Homo sapiens
ggugccccucucuccau

SEQ ID NO: 493224 - RNA, 11 nt, Homo sapiens
gguuaccucug

SEQ ID NO: 493225 - RNA, 14 nt, Homo sapiens
gguuguuucuucca

SEQ ID NO: 493226 - RNA, 17 nt, Homo sapiens
guaaagagauuguucua

SEQ ID NO: 493227 - RNA, 19 nt, Homo sapiens
guaaaucaagaccaaagag

SEQ ID NO: 493228 - RNA, 16 nt, Homo sapiens
guaauccuagcacuuu

SEQ ID NO: 493229 - RNA, 15 nt, Homo sapiens
guacaggucaucugc

SEQ ID NO: 493230 - RNA, 14 nt, Homo sapiens
guacuaaacauuuc

SEQ ID NO: 493231 - RNA, 14 nt, Homo sapiens
guagaaagccaaau

SEQ ID NO: 493232 - RNA, 15 nt, Homo sapiens
guagucauuuugccc

SEQ ID NO: 493233 - RNA, 12 nt, Homo sapiens
guauaaacauua

SEQ ID NO: 493234 - RNA, 17 nt, Homo sapiens
guauagccccacagauu

SEQ ID NO: 493235 - RNA, 23 nt, Homo sapiens
guaugccucauuuuauucuguca

SEQ ID NO: 493236 - RNA, 20 nt, Homo sapiens
guaugcugaaauccggguca

SEQ ID NO: 493237 - RNA, 18 nt, Homo sapiens
guauggaagccaccggga

SEQ ID NO: 493238 - RNA, 21 nt, Homo sapiens
guauuauccugugugugucua

SEQ ID NO: 493239 - RNA, 18 nt, Homo sapiens
guauucauuacuagauaa

SEQ ID NO: 493240 - RNA, 16 nt, Homo sapiens
guauuccagcugguga

SEQ ID NO: 493241 - RNA, 15 nt, Homo sapiens
guauuuucagcucaa

SEQ ID NO: 493242 - RNA, 17 nt, Homo sapiens
gucaagugaaggagcug

SEQ ID NO: 493243 - RNA, 14 nt, Homo sapiens
gucacaucuuggca

SEQ ID NO: 493244 - RNA, 14 nt, Homo sapiens
gucauauguucuca

SEQ ID NO: 493245 - RNA, 15 nt, Homo sapiens
gucaucccggggcca

SEQ ID NO: 493246 - RNA, 16 nt, Homo sapiens
gucaucccggggccau

SEQ ID NO: 493247 - RNA, 12 nt, Homo sapiens
gucaugccaaaa

SEQ ID NO: 493248 - RNA, 17 nt, Homo sapiens
gucccaguuaacuguua

SEQ ID NO: 493249 - RNA, 12 nt, Homo sapiens
guccugcacugu

SEQ ID NO: 493250 - RNA, 14 nt, Homo sapiens
guccugcacugucc

SEQ ID NO: 493251 - RNA, 19 nt, Homo sapiens
guccuuguuguuucuugcc

SEQ ID NO: 493252 - RNA, 18 nt, Homo sapiens
gucguccccagaccagua

SEQ ID NO: 493253 - RNA, 16 nt, Homo sapiens
gucuaauaaacacaga

SEQ ID NO: 493254 - RNA, 17 nt, Homo sapiens
gucucuucauaauacuu

SEQ ID NO: 493255 - RNA, 21 nt, Homo sapiens
gucuuaacauuucuaacucug

SEQ ID NO: 493256 - RNA, 15 nt, Homo sapiens
gucuugguacuugcu

SEQ ID NO: 493257 - RNA, 16 nt, Homo sapiens
gucuuuugaaaacuca

SEQ ID NO: 493258 - RNA, 17 nt, Homo sapiens
gugaaaauccaucucau

SEQ ID NO: 493259 - RNA, 15 nt, Homo sapiens
gugacagugaggucc

SEQ ID NO: 493260 - RNA, 20 nt, Homo sapiens
gugacauuugucauuuucau

SEQ ID NO: 493261 - RNA, 14 nt, Homo sapiens
gugaccgggguccu

SEQ ID NO: 493262 - RNA, 18 nt, Homo sapiens
gugacugcgcacugagua

SEQ ID NO: 493263 - RNA, 17 nt, Homo sapiens
gugagcccccagagcug

SEQ ID NO: 493264 - RNA, 22 nt, Homo sapiens
gugaucaguguugcaacauaau

SEQ ID NO: 493265 - RNA, 20 nt, Homo sapiens
gugauucaccucuucuuucc

SEQ ID NO: 493266 - RNA, 16 nt, Homo sapiens
gugcagcuuuccaguu

SEQ ID NO: 493267 - RNA, 18 nt, Homo sapiens
gugccagggaggguggga

SEQ ID NO: 493268 - RNA, 16 nt, Homo sapiens
gugccuaauguuccau

SEQ ID NO: 493269 - RNA, 14 nt, Homo sapiens
gugcuuguucuucc

SEQ ID NO: 493270 - RNA, 15 nt, Homo sapiens
gugcuuguucuuccu

SEQ ID NO: 493271 - RNA, 14 nt, Homo sapiens
guggcaucaggaaa

SEQ ID NO: 493272 - RNA, 14 nt, Homo sapiens
guggcugacccccc

SEQ ID NO: 493273 - RNA, 23 nt, Homo sapiens
guggcugauuuacuaacaguaac

SEQ ID NO: 493274 - RNA, 14 nt, Homo sapiens
gugguaaacaaaga

SEQ ID NO: 493275 - RNA, 17 nt, Homo sapiens
gugucuaauaaacacag

SEQ ID NO: 493276 - RNA, 15 nt, Homo sapiens
gugugaagaucacgu

SEQ ID NO: 493277 - RNA, 20 nt, Homo sapiens
guguguauauauguguauau

SEQ ID NO: 493278 - RNA, 20 nt, Homo sapiens
guguugagaacuaccuggau

SEQ ID NO: 493279 - RNA, 21 nt, Homo sapiens
guguuuacuuuaaauccuuaa

SEQ ID NO: 493280 - RNA, 23 nt, Homo sapiens
guguuugaauugauuuuuaaaca

SEQ ID NO: 493281 - RNA, 19 nt, Homo sapiens
guuaaacccacagccaaac

SEQ ID NO: 493282 - RNA, 20 nt, Homo sapiens
guuaauaaagugcacugcca

SEQ ID NO: 493283 - RNA, 16 nt, Homo sapiens
guuacauaacaagaaa

SEQ ID NO: 493284 - RNA, 17 nt, Homo sapiens
guuaucuuagcuggaua

SEQ ID NO: 493285 - RNA, 16 nt, Homo sapiens
guuauggucaauccca

SEQ ID NO: 493286 - RNA, 16 nt, Homo sapiens
guuauguuguaauauu

SEQ ID NO: 493287 - RNA, 16 nt, Homo sapiens
guuauucaauaacuau

SEQ ID NO: 493288 - RNA, 15 nt, Homo sapiens
guuauucagaaccua

SEQ ID NO: 493289 - RNA, 17 nt, Homo sapiens
guucacgcaacuugaaa

SEQ ID NO: 493290 - RNA, 23 nt, Homo sapiens
guuccacuucaacaaguaccuga

SEQ ID NO: 493291 - RNA, 17 nt, Homo sapiens
guuccaugaagacaaau

SEQ ID NO: 493292 - RNA, 15 nt, Homo sapiens
guucgggcuuuucac

SEQ ID NO: 493293 - RNA, 17 nt, Homo sapiens
guucuuccucuuaccug

SEQ ID NO: 493294 - RNA, 14 nt, Homo sapiens
guugaaucagccau

SEQ ID NO: 493295 - RNA, 19 nt, Homo sapiens
guugagugcaucccagcau

SEQ ID NO: 493296 - RNA, 13 nt, Homo sapiens
guuguuucuugcc

SEQ ID NO: 493297 - RNA, 18 nt, Homo sapiens
guuuaaaagucacauaaa

SEQ ID NO: 493298 - RNA, 18 nt, Homo sapiens
guuuaacugaguuagaau

SEQ ID NO: 493299 - RNA, 15 nt, Homo sapiens
guuuaauguuuaguc

SEQ ID NO: 493300 - RNA, 21 nt, Homo sapiens
guuuagcguuguuuuguggau

SEQ ID NO: 493301 - RNA, 19 nt, Homo sapiens
guuuauccuguauguaaua

SEQ ID NO: 493302 - RNA, 19 nt, Homo sapiens
guuuauuuuuauacuuuca

SEQ ID NO: 493303 - RNA, 14 nt, Homo sapiens
guuucacuguucau

SEQ ID NO: 493304 - RNA, 15 nt, Homo sapiens
guuucauauucucag

SEQ ID NO: 493305 - RNA, 24 nt, Homo sapiens
guuucuugccugaacuccugccau

SEQ ID NO: 493306 - RNA, 21 nt, Homo sapiens
guuugguuuuaaaauacugua

SEQ ID NO: 493307 - RNA, 11 nt, Homo sapiens
guuuucauuaa

SEQ ID NO: 493308 - RNA, 12 nt, Homo sapiens
guuuucauuugu

SEQ ID NO: 493309 - RNA, 11 nt, Homo sapiens
guuuugcaaau

SEQ ID NO: 493310 - RNA, 21 nt, Homo sapiens
guuuugugcggugugucucca

SEQ ID NO: 493311 - RNA, 17 nt, Homo sapiens
uaaaaaguuaaucuuca

SEQ ID NO: 493312 - RNA, 22 nt, Homo sapiens
uaaaaauauauauagugcuaua

SEQ ID NO: 493313 - RNA, 19 nt, Homo sapiens
uaaaagacaugaaauugag

SEQ ID NO: 493314 - RNA, 17 nt, Homo sapiens
uaaaagccauauuaagu

SEQ ID NO: 493315 - RNA, 16 nt, Homo sapiens
uaaaagcccuuuccaa

SEQ ID NO: 493316 - RNA, 15 nt, Homo sapiens
uaaaaguauuauuca

SEQ ID NO: 493317 - RNA, 16 nt, Homo sapiens
uaaaagucacauaaaa

SEQ ID NO: 493318 - RNA, 12 nt, Homo sapiens
uaaaaucaggaa

SEQ ID NO: 493319 - RNA, 23 nt, Homo sapiens
uaaaauuggauuauuacuacaaa

SEQ ID NO: 493320 - RNA, 15 nt, Homo sapiens
uaaaccagacucacu

SEQ ID NO: 493321 - RNA, 15 nt, Homo sapiens
uaaaccugaacaaac

SEQ ID NO: 493322 - RNA, 16 nt, Homo sapiens
uaaacugguacaauuu

SEQ ID NO: 493323 - RNA, 16 nt, Homo sapiens
uaaagccacgcugugu

SEQ ID NO: 493324 - RNA, 17 nt, Homo sapiens
uaaagccuacccuauuc

SEQ ID NO: 493325 - RNA, 22 nt, Homo sapiens
uaaagcuuuugcauagaauaau

SEQ ID NO: 493326 - RNA, 22 nt, Homo sapiens
uaaaggcuucucauccacugug

SEQ ID NO: 493327 - RNA, 16 nt, Homo sapiens
uaaaguuccaugaaga

SEQ ID NO: 493328 - RNA, 14 nt, Homo sapiens
uaaauaaaacugug

SEQ ID NO: 493329 - RNA, 19 nt, Homo sapiens
uaaauacuauuauuugcua

SEQ ID NO: 493330 - RNA, 19 nt, Homo sapiens
uaaauauacucaaguuuca

SEQ ID NO: 493331 - RNA, 18 nt, Homo sapiens
uaaaucaagaccaaagag

SEQ ID NO: 493332 - RNA, 15 nt, Homo sapiens
uaaauggggagacaa

SEQ ID NO: 493333 - RNA, 23 nt, Homo sapiens
uaaaugucuucauguugaugugu

SEQ ID NO: 493334 - RNA, 16 nt, Homo sapiens
uaaaugugauucaccu

SEQ ID NO: 493335 - RNA, 17 nt, Homo sapiens
uaacaaagugagaccuc

SEQ ID NO: 493336 - RNA, 18 nt, Homo sapiens
uaacaccuucauccagau

SEQ ID NO: 493337 - RNA, 16 nt, Homo sapiens
uaacagaaaaaugaaa

SEQ ID NO: 493338 - RNA, 13 nt, Homo sapiens
uaaccacagcucc

SEQ ID NO: 493339 - RNA, 23 nt, Homo sapiens
uaaccuuuucaccuccaacugga

SEQ ID NO: 493340 - RNA, 19 nt, Homo sapiens
uaacuauauguacagcucu

SEQ ID NO: 493341 - RNA, 18 nt, Homo sapiens
uaacuucuaaaacuguac

SEQ ID NO: 493342 - RNA, 20 nt, Homo sapiens
uaagaagcaaauaaauauca

SEQ ID NO: 493343 - RNA, 14 nt, Homo sapiens
uaagauuuugccug

SEQ ID NO: 493344 - RNA, 18 nt, Homo sapiens
uaaggcauguggccuuua

SEQ ID NO: 493345 - RNA, 13 nt, Homo sapiens
uaagguaacaugg

SEQ ID NO: 493346 - RNA, 12 nt, Homo sapiens
uaaguacucuaa

SEQ ID NO: 493347 - RNA, 16 nt, Homo sapiens
uaaguccagcucuccc

SEQ ID NO: 493348 - RNA, 22 nt, Homo sapiens
uaauacauuaagccucuugucu

SEQ ID NO: 493349 - RNA, 15 nt, Homo sapiens
uaauauaacugccuu

SEQ ID NO: 493350 - RNA, 20 nt, Homo sapiens
uaauauuuguuccucuaggu

SEQ ID NO: 493351 - RNA, 22 nt, Homo sapiens
ugcuucucuaaaacagcacuau

SEQ ID NO: 493352 - RNA, 17 nt, Homo sapiens
ugcuuggcuggagucac

SEQ ID NO: 493353 - RNA, 23 nt, Homo sapiens
ugcuuguuaaauucuaguuuuau

SEQ ID NO: 493354 - RNA, 17 nt, Homo sapiens
ugcuuuagguaaaaagc

SEQ ID NO: 493355 - RNA, 16 nt, Homo sapiens
ugcuuucagauccauc

SEQ ID NO: 493356 - RNA, 16 nt, Homo sapiens
ugcuuugacacugaau

SEQ ID NO: 493357 - RNA, 17 nt, Homo sapiens
ugcuuugagaaaucuca

SEQ ID NO: 493358 - RNA, 19 nt, Homo sapiens
ugcuuuuugcuuguguaca

SEQ ID NO: 493359 - RNA, 17 nt, Homo sapiens
uggaacagcagauuuca

SEQ ID NO: 493360 - RNA, 17 nt, Homo sapiens
uggaacugcaccaccga

SEQ ID NO: 493361 - RNA, 20 nt, Homo sapiens
uggaacuuagcaucugaagu

SEQ ID NO: 493362 - RNA, 14 nt, Homo sapiens
uggaaugcccuuca

SEQ ID NO: 493363 - RNA, 18 nt, Homo sapiens
uggacucuguggggccac

SEQ ID NO: 493364 - RNA, 13 nt, Homo sapiens
uggaggugaugaa

SEQ ID NO: 493365 - RNA, 21 nt, Homo sapiens
uggaucacucaccauucccag

SEQ ID NO: 493366 - RNA, 19 nt, Homo sapiens
uggcaacaaacugcacaug

SEQ ID NO: 493367 - RNA, 12 nt, Homo sapiens
uggcacccugca

SEQ ID NO: 493368 - RNA, 23 nt, Homo sapiens
uggcaucuuugcuauggggacau

SEQ ID NO: 493369 - RNA, 14 nt, Homo sapiens
uggcccuggggccu

SEQ ID NO: 493370 - RNA, 12 nt, Homo sapiens
uggccucaggag

SEQ ID NO: 493371 - RNA, 16 nt, Homo sapiens
uggcuaaggacaggca

SEQ ID NO: 493372 - RNA, 16 nt, Homo sapiens
uggcucccaggguccu

SEQ ID NO: 493373 - RNA, 21 nt, Homo sapiens
uggcucuaggacccccagugc

SEQ ID NO: 493374 - RNA, 19 nt, Homo sapiens
uggcugugggcucccuucc

SEQ ID NO: 493375 - RNA, 22 nt, Homo sapiens
ugggaacaguaaagaaagcaga

SEQ ID NO: 493376 - RNA, 23 nt, Homo sapiens
ugggaacaguaaagaaagcagaa

SEQ ID NO: 493377 - RNA, 16 nt, Homo sapiens
ugggacacagagaccc

SEQ ID NO: 493378 - RNA, 14 nt, Homo sapiens
ugggagcuuuaaag

SEQ ID NO: 493379 - RNA, 16 nt, Homo sapiens
ugggaggaucacuuga

SEQ ID NO: 493380 - RNA, 20 nt, Homo sapiens
ugggcucuggguucgggaag

SEQ ID NO: 493381 - RNA, 12 nt, Homo sapiens
uggggaaagugc

SEQ ID NO: 493382 - RNA, 21 nt, Homo sapiens
uggggacauuccaauuugcac

SEQ ID NO: 493383 - RNA, 16 nt, Homo sapiens
uggggacgcagaugag

SEQ ID NO: 493384 - RNA, 21 nt, Homo sapiens
ugggggcauccuugaggaccu

SEQ ID NO: 493385 - RNA, 23 nt, Homo sapiens
ugggggccucuuuaccauagcuu

SEQ ID NO: 493386 - RNA, 16 nt, Homo sapiens
ugggggcuucucugcu

SEQ ID NO: 493387 - RNA, 18 nt, Homo sapiens
ugggugccagcauacauu

SEQ ID NO: 493388 - RNA, 15 nt, Homo sapiens
ugggugggacacaga

SEQ ID NO: 493389 - RNA, 20 nt, Homo sapiens
uggguuauucagaaccuaaa

SEQ ID NO: 493390 - RNA, 19 nt, Homo sapiens
uggguuuugccucugcccu

SEQ ID NO: 493391 - RNA, 20 nt, Homo sapiens
ugguacacacuugaccuucu

SEQ ID NO: 493392 - RNA, 12 nt, Homo sapiens
ugguaucucuuu

SEQ ID NO: 493393 - RNA, 23 nt, Homo sapiens
uggucuaaaaauaaaccaaagga

SEQ ID NO: 493394 - RNA, 21 nt, Homo sapiens
uggugaagaguaguuuacuag

SEQ ID NO: 493395 - RNA, 14 nt, Homo sapiens
uggugcuggguccu

SEQ ID NO: 493396 - RNA, 15 nt, Homo sapiens
ugguuuaaaagucac

SEQ ID NO: 493397 - RNA, 19 nt, Homo sapiens
ugguuuugcaugucugcau

SEQ ID NO: 493398 - RNA, 14 nt, Homo sapiens
uguaaauuccaaag

SEQ ID NO: 493399 - RNA, 14 nt, Homo sapiens
uguaauauuuugcu

SEQ ID NO: 493400 - RNA, 13 nt, Homo sapiens
uguaaugagcucc

SEQ ID NO: 493401 - RNA, 14 nt, Homo sapiens
uguacaaaauaucc

SEQ ID NO: 493402 - RNA, 16 nt, Homo sapiens
uguacacacacagaca

SEQ ID NO: 493403 - RNA, 14 nt, Homo sapiens
uguaccaggcucuc

SEQ ID NO: 493404 - RNA, 18 nt, Homo sapiens
uguauaagaugcugcuga

SEQ ID NO: 493405 - RNA, 14 nt, Homo sapiens
uguaucugacauau

SEQ ID NO: 493406 - RNA, 15 nt, Homo sapiens
uguauuuucagcuca

SEQ ID NO: 493407 - RNA, 16 nt, Homo sapiens
uguauuuucagcucaa

SEQ ID NO: 493408 - RNA, 12 nt, Homo sapiens
ugucacugcugu

SEQ ID NO: 493409 - RNA, 16 nt, Homo sapiens
ugucaggaggcagaag

SEQ ID NO: 493410 - RNA, 14 nt, Homo sapiens
uguccaacugagaa

SEQ ID NO: 493411 - RNA, 17 nt, Homo sapiens
ugucuacuggacuguaa

SEQ ID NO: 493412 - RNA, 18 nt, Homo sapiens
ugucucaaaauaaaacca

SEQ ID NO: 493413 - RNA, 21 nt, Homo sapiens
ugucucaaaauaaaaccagaa

SEQ ID NO: 493414 - RNA, 20 nt, Homo sapiens
ugucucaaaggagcuuucuc

SEQ ID NO: 493415 - RNA, 13 nt, Homo sapiens
ugucucucuuuug

SEQ ID NO: 493416 - RNA, 16 nt, Homo sapiens
ugucuguccuuuauga

SEQ ID NO: 493417 - RNA, 13 nt, Homo sapiens
ugucuuucuccaa

SEQ ID NO: 493418 - RNA, 13 nt, Homo sapiens
ugugaaagugcac

SEQ ID NO: 493419 - RNA, 23 nt, Homo sapiens
ugugaacuuucucagcauauaua

SEQ ID NO: 493420 - RNA, 21 nt, Homo sapiens
ugugaauagcaguggcaaaau

SEQ ID NO: 493421 - RNA, 20 nt, Homo sapiens
ugugagggcagugcaaggag

SEQ ID NO: 493422 - RNA, 15 nt, Homo sapiens
ugugcagcuuuccag

SEQ ID NO: 493423 - RNA, 18 nt, Homo sapiens
ugugccccuuccccaugc

SEQ ID NO: 493424 - RNA, 19 nt, Homo sapiens
ugugcuaaguugucuuaca

SEQ ID NO: 493425 - RNA, 20 nt, Homo sapiens
ugugcucuacaucucguaug

SEQ ID NO: 493426 - RNA, 23 nt, Homo sapiens
ugugcugccuguggugagguccu

SEQ ID NO: 493427 - RNA, 17 nt, Homo sapiens
ugugcuuugccacugaa

SEQ ID NO: 493428 - RNA, 16 nt, Homo sapiens
uguggaccaguucccu

SEQ ID NO: 493429 - RNA, 15 nt, Homo sapiens
uguggccugccaguc

SEQ ID NO: 493430 - RNA, 20 nt, Homo sapiens
uguggucugcugccucagga

SEQ ID NO: 493431 - RNA, 17 nt, Homo sapiens
uguguacaaacccagau

SEQ ID NO: 493432 - RNA, 21 nt, Homo sapiens
uguguauggaagacaaauaca

SEQ ID NO: 493433 - RNA, 21 nt, Homo sapiens
uguguccgugaaaguugugau

SEQ ID NO: 493434 - RNA, 14 nt, Homo sapiens
ugugucuagguaga

SEQ ID NO: 493435 - RNA, 13 nt, Homo sapiens
ugugucuuguauu

SEQ ID NO: 493436 - RNA, 13 nt, Homo sapiens
ugugugaagauca

SEQ ID NO: 493437 - RNA, 15 nt, Homo sapiens
ugugugaagcaaauu

SEQ ID NO: 493438 - RNA, 18 nt, Homo sapiens
uguuaaauggggagacaa

SEQ ID NO: 493439 - RNA, 19 nt, Homo sapiens
uguuaggguacauacgcua

SEQ ID NO: 493440 - RNA, 15 nt, Homo sapiens
uguuauuuauugcua

SEQ ID NO: 493441 - RNA, 14 nt, Homo sapiens
uguucagaaaagca

SEQ ID NO: 493442 - RNA, 23 nt, Homo sapiens
uguucucaucggcggagccuucu

SEQ ID NO: 493443 - RNA, 19 nt, Homo sapiens
uguugaagaacucauguga

SEQ ID NO: 493444 - RNA, 17 nt, Homo sapiens
uguugacauccaagcuu

SEQ ID NO: 493445 - RNA, 16 nt, Homo sapiens
uguugacuggccaaaa

SEQ ID NO: 493446 - RNA, 14 nt, Homo sapiens
uguugcacacucac

SEQ ID NO: 493447 - RNA, 19 nt, Homo sapiens
uguugcacugaaguuugau

SEQ ID NO: 493448 - RNA, 21 nt, Homo sapiens
uguuuauuauaaacaaaaagc

SEQ ID NO: 493449 - RNA, 23 nt, Homo sapiens
uguuuauucaacaacuacuacuu

SEQ ID NO: 493450 - RNA, 16 nt, Homo sapiens
uguuuuaaguuuacug

SEQ ID NO: 493451 - RNA, 21 nt, Homo sapiens
uguuuuccccaauuauccucc

SEQ ID NO: 493452 - RNA, 18 nt, Homo sapiens
uguuuucuucguggauug

SEQ ID NO: 493453 - RNA, 23 nt, Homo sapiens
uuaaaaaguauugccaaacauua

SEQ ID NO: 493454 - RNA, 20 nt, Homo sapiens
uuaaaacuuacuaugguaua

SEQ ID NO: 493455 - RNA, 15 nt, Homo sapiens
uuaaaagucacauaa

SEQ ID NO: 493456 - RNA, 22 nt, Homo sapiens
uuaaaaugugcuauuugcaaac

SEQ ID NO: 493457 - RNA, 13 nt, Homo sapiens
uuaaauacuauua

SEQ ID NO: 493458 - RNA, 19 nt, Homo sapiens
uuaacaauugccagggaaa

SEQ ID NO: 493459 - RNA, 12 nt, Homo sapiens
uuaacuacagac

SEQ ID NO: 493460 - RNA, 22 nt, Homo sapiens
uuaauaaagcgaaaaacucaac

SEQ ID NO: 493461 - RNA, 20 nt, Homo sapiens
uuaauaccugaccucacaga

SEQ ID NO: 493462 - RNA, 23 nt, Homo sapiens
uuaaucuuugaaaacucauacag

SEQ ID NO: 493463 - RNA, 12 nt, Homo sapiens
uuaaugugaugg

SEQ ID NO: 493464 - RNA, 15 nt, Homo sapiens
uuaauuacaauggaa

SEQ ID NO: 493465 - RNA, 23 nt, Homo sapiens
uuacaacuugaaauugcuuugcu

SEQ ID NO: 493466 - RNA, 20 nt, Homo sapiens
uuacaagacuguaaauucca

SEQ ID NO: 493467 - RNA, 19 nt, Homo sapiens
uuacaauguaucaacauau

SEQ ID NO: 493468 - RNA, 22 nt, Homo sapiens
uuaccaaguuggucuuacuuug

SEQ ID NO: 493469 - RNA, 15 nt, Homo sapiens
uuaccagauucacuu

SEQ ID NO: 493470 - RNA, 15 nt, Homo sapiens
uuacuauaaugccuu

SEQ ID NO: 493471 - RNA, 12 nt, Homo sapiens
uuagaaacacca

SEQ ID NO: 493472 - RNA, 19 nt, Homo sapiens
uuagaauccgaagggaauu

SEQ ID NO: 493473 - RNA, 19 nt, Homo sapiens
uuagacaagucuaguggaa

SEQ ID NO: 493474 - RNA, 23 nt, Homo sapiens
uuagacagucaaggaguggcuua

SEQ ID NO: 493475 - RNA, 19 nt, Homo sapiens
uuagauuuuaaaacuucau

SEQ ID NO: 493476 - RNA, 22 nt, Homo sapiens
uuaggcaauggugaacugucau

SEQ ID NO: 493477 - RNA, 12 nt, Homo sapiens
uuaguaagcaaa

SEQ ID NO: 493478 - RNA, 14 nt, Homo sapiens
uuaguacaucuuaa

SEQ ID NO: 493479 - RNA, 19 nt, Homo sapiens
uuaguaguaaacugaaggu

SEQ ID NO: 493480 - RNA, 13 nt, Homo sapiens
uuaguaucucauc

SEQ ID NO: 493481 - RNA, 19 nt, Homo sapiens
uuagucaguguacucugag

SEQ ID NO: 493482 - RNA, 18 nt, Homo sapiens
uuagugcacaagcacuau

SEQ ID NO: 493483 - RNA, 18 nt, Homo sapiens
uuaguggauggaauauca

SEQ ID NO: 493484 - RNA, 16 nt, Homo sapiens
uuagugugauugugaa

SEQ ID NO: 493485 - RNA, 17 nt, Homo sapiens
uuauaccuguacacaca

SEQ ID NO: 493486 - RNA, 22 nt, Homo sapiens
uuauacucaccugcguuuucau

SEQ ID NO: 493487 - RNA, 18 nt, Homo sapiens
uuauaggacgaaugccaa

SEQ ID NO: 493488 - RNA, 14 nt, Homo sapiens
aaaaagugucucaa

SEQ ID NO: 493489 - RNA, 21 nt, Homo sapiens
aaaaaucagaaagacauucuu

SEQ ID NO: 493490 - RNA, 19 nt, Homo sapiens
aaaaaucccauuuaugcaa

SEQ ID NO: 493491 - RNA, 20 nt, Homo sapiens
aaaaaucccauuuaugcaau

SEQ ID NO: 493492 - RNA, 21 nt, Homo sapiens
aaaaauguauagacucagugc

SEQ ID NO: 493493 - RNA, 21 nt, Homo sapiens
aaaaauguaucugugugugau

SEQ ID NO: 493494 - RNA, 22 nt, Homo sapiens
aaaacagaaauugguaccuugc

SEQ ID NO: 493495 - RNA, 23 nt, Homo sapiens
aaaacagcugcauggcacauacc

SEQ ID NO: 493496 - RNA, 21 nt, Homo sapiens
aaaacucaaccaaaugguaca

SEQ ID NO: 493497 - RNA, 13 nt, Homo sapiens
aaaagaaacugug

SEQ ID NO: 493498 - RNA, 14 nt, Homo sapiens
aaaagcaccucuug

SEQ ID NO: 493499 - RNA, 19 nt, Homo sapiens
aaaaguuaauaacagcucc

SEQ ID NO: 493500 - RNA, 19 nt, Homo sapiens
aaaauaaaaggauuaugua

SEQ ID NO: 493501 - RNA, 22 nt, Homo sapiens
aaaauaaagucugucaugccaa

SEQ ID NO: 493502 - RNA, 12 nt, Homo sapiens
aaaauacaugau

SEQ ID NO: 493503 - RNA, 13 nt, Homo sapiens
aagauaguuguaa

SEQ ID NO: 493504 - RNA, 22 nt, Homo sapiens
aagaucaaaauaaaaagugaca

SEQ ID NO: 493505 - RNA, 20 nt, Homo sapiens
aagaucaagcuccaucuuau

SEQ ID NO: 493506 - RNA, 17 nt, Homo sapiens
aagaucauuaucuucau

SEQ ID NO: 493507 - RNA, 13 nt, Homo sapiens
aagaugaaagcuu

SEQ ID NO: 493508 - RNA, 15 nt, Homo sapiens
aagcaacagcuggac

SEQ ID NO: 493509 - RNA, 15 nt, Homo sapiens
aagcaacuuuuccaa

SEQ ID NO: 493510 - RNA, 12 nt, Homo sapiens
aagcaagcucac

SEQ ID NO: 493511 - RNA, 21 nt, Homo sapiens
aagcacuccucccugauguac

SEQ ID NO: 493512 - RNA, 19 nt, Homo sapiens
aagcagauuuauuuuugaa

SEQ ID NO: 493513 - RNA, 15 nt, Homo sapiens
aagcaugaaaacuga

SEQ ID NO: 493514 - RNA, 15 nt, Homo sapiens
aagccagucuuaaca

SEQ ID NO: 493515 - RNA, 13 nt, Homo sapiens
aagccucuugucu

SEQ ID NO: 493516 - RNA, 22 nt, Homo sapiens
aagcugaugaaguuaagcacaa

SEQ ID NO: 493517 - RNA, 18 nt, Homo sapiens
aagcugggcaacaugccu

SEQ ID NO: 493518 - RNA, 20 nt, Homo sapiens
aagcuuaaacauugccuuau

SEQ ID NO: 493519 - RNA, 22 nt, Homo sapiens
aaggaauauguacacuggaacu

SEQ ID NO: 493520 - RNA, 15 nt, Homo sapiens
acuuucuucuuccca

SEQ ID NO: 493521 - RNA, 19 nt, Homo sapiens
acuuuuaugcgcaaauaca

SEQ ID NO: 493522 - RNA, 12 nt, Homo sapiens
agaaaacuucag

SEQ ID NO: 493523 - RNA, 17 nt, Homo sapiens
agaaaacuucagagaaa

SEQ ID NO: 493524 - RNA, 22 nt, Homo sapiens
agaaaaguucuuaaaacacuaa

SEQ ID NO: 493525 - RNA, 18 nt, Homo sapiens
agaaaauauauuugcaua

SEQ ID NO: 493526 - RNA, 20 nt, Homo sapiens
agaaacagauaccauacuca

SEQ ID NO: 493527 - RNA, 16 nt, Homo sapiens
agaaagccagucuuaa

SEQ ID NO: 493528 - RNA, 13 nt, Homo sapiens
agaaaugcacaau

SEQ ID NO: 493529 - RNA, 22 nt, Homo sapiens
agaaauuccauacuucucucag

SEQ ID NO: 493530 - RNA, 21 nt, Homo sapiens
agaaauuuuaucucuucuucc

SEQ ID NO: 493531 - RNA, 15 nt, Homo sapiens
agaaccaauucacuu

SEQ ID NO: 493532 - RNA, 12 nt, Homo sapiens
agaaccuacugu

SEQ ID NO: 493533 - RNA, 16 nt, Homo sapiens
agaacucaugugauuu

SEQ ID NO: 493534 - RNA, 23 nt, Homo sapiens
agaagacccagacggucugugug

SEQ ID NO: 493535 - RNA, 21 nt, Homo sapiens
agaagcccuguccuccacuca

SEQ ID NO: 493536 - RNA, 21 nt, Homo sapiens
agaauaaaauuccuaucucau

SEQ ID NO: 493537 - RNA, 16 nt, Homo sapiens
agaauccgaagggaau

SEQ ID NO: 493538 - RNA, 14 nt, Homo sapiens
agacaaaauuacuu

SEQ ID NO: 493539 - RNA, 22 nt, Homo sapiens
agacaaggugcaccgguuucau

SEQ ID NO: 493540 - RNA, 19 nt, Homo sapiens
agacacaaacaaacaagcu

SEQ ID NO: 493541 - RNA, 20 nt, Homo sapiens
agacacacacauauauacau

SEQ ID NO: 493542 - RNA, 20 nt, Homo sapiens
agacaccaauggauccuugu

SEQ ID NO: 493543 - RNA, 14 nt, Homo sapiens
agacacugugcuau

SEQ ID NO: 493544 - RNA, 23 nt, Homo sapiens
agacagaacuccugcauggcuca

SEQ ID NO: 493545 - RNA, 23 nt, Homo sapiens
aggcuucaauuuauugcacaaaa

SEQ ID NO: 493546 - RNA, 17 nt, Homo sapiens
agggagacccugggaga

SEQ ID NO: 493547 - RNA, 20 nt, Homo sapiens
agggccuucuccacagggac

SEQ ID NO: 493548 - RNA, 22 nt, Homo sapiens
agggucucuugcccaucucucc

SEQ ID NO: 493549 - RNA, 16 nt, Homo sapiens
agggugaguccuccag

SEQ ID NO: 493550 - RNA, 15 nt, Homo sapiens
agggugucuguaauc

SEQ ID NO: 493551 - RNA, 12 nt, Homo sapiens
agguaucugaug

SEQ ID NO: 493552 - RNA, 14 nt, Homo sapiens
agguaucugaugau

SEQ ID NO: 493553 - RNA, 15 nt, Homo sapiens
aggucaucccggggc

SEQ ID NO: 493554 - RNA, 21 nt, Homo sapiens
agguccuuguuguuucuugcc

SEQ ID NO: 493555 - RNA, 20 nt, Homo sapiens
aggucuaccugaaaauucaa

SEQ ID NO: 493556 - RNA, 19 nt, Homo sapiens
aggugaaaauccaucucau

SEQ ID NO: 493557 - RNA, 13 nt, Homo sapiens
aggugacagugag

SEQ ID NO: 493558 - RNA, 23 nt, Homo sapiens
aggugacuuuccuaugacacuca

SEQ ID NO: 493559 - RNA, 16 nt, Homo sapiens
agguggaguaggugaa

SEQ ID NO: 493560 - RNA, 19 nt, Homo sapiens
agguuacuaaaacagggug

SEQ ID NO: 493561 - RNA, 21 nt, Homo sapiens
agguuggagugcauucauuca

SEQ ID NO: 493562 - RNA, 14 nt, Homo sapiens
aguaagacuugauu

SEQ ID NO: 493563 - RNA, 22 nt, Homo sapiens
aguaccacacugaguucuauca

SEQ ID NO: 493564 - RNA, 17 nt, Homo sapiens
aguacucuaauauacag

SEQ ID NO: 493565 - RNA, 22 nt, Homo sapiens
aguagaggguccagucuucuag

SEQ ID NO: 493566 - RNA, 12 nt, Homo sapiens
aguagcauauau

SEQ ID NO: 493567 - RNA, 14 nt, Homo sapiens
aguagcuuugcacu

SEQ ID NO: 493568 - RNA, 12 nt, Homo sapiens
aguaugaucuca

SEQ ID NO: 493569 - RNA, 15 nt, Homo sapiens
agucaagcugaugaa

SEQ ID NO: 493570 - RNA, 21 nt, Homo sapiens
agucaccacuccauucccaac

SEQ ID NO: 493571 - RNA, 16 nt, Homo sapiens
agucagaagaagacag

SEQ ID NO: 493572 - RNA, 20 nt, Homo sapiens
aguccagaaaucauacugca

SEQ ID NO: 493573 - RNA, 15 nt, Homo sapiens
aguccaggagcucag

SEQ ID NO: 493574 - RNA, 15 nt, Homo sapiens
agucucacugacaca

SEQ ID NO: 493575 - RNA, 18 nt, Homo sapiens
agucucuuuuuuacaaag

SEQ ID NO: 493576 - RNA, 17 nt, Homo sapiens
auccccuuuguguagaa

SEQ ID NO: 493577 - RNA, 17 nt, Homo sapiens
auccgggucaagugaag

SEQ ID NO: 493578 - RNA, 17 nt, Homo sapiens
auccguaccaucgguca

SEQ ID NO: 493579 - RNA, 13 nt, Homo sapiens
auccuagcacuuu

SEQ ID NO: 493580 - RNA, 20 nt, Homo sapiens
auccuaucuggggagcuccu

SEQ ID NO: 493581 - RNA, 17 nt, Homo sapiens
auccucagaaccauuca

SEQ ID NO: 493582 - RNA, 16 nt, Homo sapiens
auccuguuuuugcaaa

SEQ ID NO: 493583 - RNA, 12 nt, Homo sapiens
auccuuacaaau

SEQ ID NO: 493584 - RNA, 16 nt, Homo sapiens
auccuugcacagacaa

SEQ ID NO: 493585 - RNA, 19 nt, Homo sapiens
aucgggaguagcaaggaag

SEQ ID NO: 493586 - RNA, 15 nt, Homo sapiens
aucuagguucaggaa

SEQ ID NO: 493587 - RNA, 13 nt, Homo sapiens
aucuauacauacc

SEQ ID NO: 493588 - RNA, 20 nt, Homo sapiens
aucuaucagaguauccacug

SEQ ID NO: 493589 - RNA, 15 nt, Homo sapiens
aucuauggcaagcaa

SEQ ID NO: 493590 - RNA, 22 nt, Homo sapiens
aucugcaguguucugugaauag

SEQ ID NO: 493591 - RNA, 15 nt, Homo sapiens
aucugcauaaccgca

SEQ ID NO: 493592 - RNA, 20 nt, Homo sapiens
aucugcauaaccgcacagac

SEQ ID NO: 493593 - RNA, 13 nt, Homo sapiens
aucuuuagggaau

SEQ ID NO: 493594 - RNA, 15 nt, Homo sapiens
aucuuuagggaauga

SEQ ID NO: 493595 - RNA, 17 nt, Homo sapiens
aucuuuccuuccucuca

SEQ ID NO: 493596 - RNA, 21 nt, Homo sapiens
aucuuugcuauggggacauuc

SEQ ID NO: 493597 - RNA, 21 nt, Homo sapiens
aucuuuguuuuuuguuuucau

SEQ ID NO: 493598 - RNA, 22 nt, Homo sapiens
augaaagcacuccucccugaug

SEQ ID NO: 493599 - RNA, 14 nt, Homo sapiens
augaagacaaauag

SEQ ID NO: 493600 - RNA, 13 nt, Homo sapiens
augagacuguguu

SEQ ID NO: 493601 - RNA, 17 nt, Homo sapiens
augagaguuccuucuca

SEQ ID NO: 493602 - RNA, 14 nt, Homo sapiens
augagauuggaaaa

SEQ ID NO: 493603 - RNA, 20 nt, Homo sapiens
augagcaugcucccucaugc

SEQ ID NO: 493604 - RNA, 21 nt, Homo sapiens
augaggcacgccugccuucuc

SEQ ID NO: 493605 - RNA, 19 nt, Homo sapiens
augagucacuuacuucaua

SEQ ID NO: 493606 - RNA, 19 nt, Homo sapiens
augauaaauuugacuguua

SEQ ID NO: 493607 - RNA, 15 nt, Homo sapiens
augauaacaacccaa

SEQ ID NO: 493608 - RNA, 20 nt, Homo sapiens
augauaacaacccaaggcaa

SEQ ID NO: 493609 - RNA, 18 nt, Homo sapiens
augauacuugguccuuaa

SEQ ID NO: 493610 - RNA, 16 nt, Homo sapiens
augauagaagauauau

SEQ ID NO: 493611 - RNA, 16 nt, Homo sapiens
augauccuugcacaga

SEQ ID NO: 493612 - RNA, 13 nt, Homo sapiens
augauuucagaaa

SEQ ID NO: 493613 - RNA, 21 nt, Homo sapiens
augcacacacacacaucucau

SEQ ID NO: 493614 - RNA, 21 nt, Homo sapiens
gacccugggagagugagguca

SEQ ID NO: 493615 - RNA, 20 nt, Homo sapiens
gacuacaguagcucacguua

SEQ ID NO: 493616 - RNA, 21 nt, Homo sapiens
gacugguggaaggaaaacaaa

SEQ ID NO: 493617 - RNA, 15 nt, Homo sapiens
gacuguaaauuccaa

SEQ ID NO: 493618 - RNA, 15 nt, Homo sapiens
gacuucuguuuucaa

SEQ ID NO: 493619 - RNA, 23 nt, Homo sapiens
gagaaauacuuucaggcacuaag

SEQ ID NO: 493620 - RNA, 20 nt, Homo sapiens
gagaagagaguauggugcug

SEQ ID NO: 493621 - RNA, 12 nt, Homo sapiens
gagaagccucau

SEQ ID NO: 493622 - RNA, 15 nt, Homo sapiens
gagaaguacagguca

SEQ ID NO: 493623 - RNA, 20 nt, Homo sapiens
gagaauaaaauuccuaucuc

SEQ ID NO: 493624 - RNA, 18 nt, Homo sapiens
gagaauucacagaaccua

SEQ ID NO: 493625 - RNA, 15 nt, Homo sapiens
gagacagucaggaag

SEQ ID NO: 493626 - RNA, 14 nt, Homo sapiens
gagagaacagggau

SEQ ID NO: 493627 - RNA, 19 nt, Homo sapiens
gagagauaggaaggucauu

SEQ ID NO: 493628 - RNA, 12 nt, Homo sapiens
gagagggggcca

SEQ ID NO: 493629 - RNA, 20 nt, Homo sapiens
gagaucgcgccacugcacuc

SEQ ID NO: 493630 - RNA, 21 nt, Homo sapiens
gagaucgcgccacugcacucu

SEQ ID NO: 493631 - RNA, 23 nt, Homo sapiens
gagcaaaagccucagaaagggau

SEQ ID NO: 493632 - RNA, 15 nt, Homo sapiens
gagcacaucucuuca

SEQ ID NO: 493633 - RNA, 14 nt, Homo sapiens
gagcagccucuuga

SEQ ID NO: 493634 - RNA, 19 nt, Homo sapiens
gagcaugcucccucaugca

SEQ ID NO: 493635 - RNA, 22 nt, Homo sapiens
gagcauuuccaacaccacagac

SEQ ID NO: 493636 - RNA, 22 nt, Homo sapiens
gagcauuugguacacacuugac

SEQ ID NO: 493637 - RNA, 21 nt, Homo sapiens
gagccaaguucacaccacugc

SEQ ID NO: 493638 - RNA, 19 nt, Homo sapiens
gagcccagaagcucaaggc

SEQ ID NO: 493639 - RNA, 16 nt, Homo sapiens
gagcccggcagugcac

SEQ ID NO: 493640 - RNA, 13 nt, Homo sapiens
gagcugagugagc

SEQ ID NO: 493641 - RNA, 12 nt, Homo sapiens
gagcugccagug

SEQ ID NO: 493642 - RNA, 15 nt, Homo sapiens
gagcugcugcaugag

SEQ ID NO: 493643 - RNA, 21 nt, Homo sapiens
gagcugggaccaguaccuggg

SEQ ID NO: 493644 - RNA, 17 nt, Homo sapiens
gaggaaaauaguggcag

SEQ ID NO: 493645 - RNA, 23 nt, Homo sapiens
gaggaaaauaguggcaggacugu

SEQ ID NO: 493646 - RNA, 17 nt, Homo sapiens
gaggaaauccuaccuuu

SEQ ID NO: 493647 - RNA, 14 nt, Homo sapiens
gaggaauccucaga

SEQ ID NO: 493648 - RNA, 18 nt, Homo sapiens
gaggcugagacgcaagga

SEQ ID NO: 493649 - RNA, 14 nt, Homo sapiens
gagggggaggggug

SEQ ID NO: 493650 - RNA, 17 nt, Homo sapiens
gagguagccgaccugag

SEQ ID NO: 493651 - RNA, 13 nt, Homo sapiens
gaguauggugcug

SEQ ID NO: 493652 - RNA, 15 nt, Homo sapiens
gagucagccccacuc

SEQ ID NO: 493653 - RNA, 12 nt, Homo sapiens
gaguucauccca

SEQ ID NO: 493654 - RNA, 9 nt, Homo sapiens
gaguucucu

SEQ ID NO: 493655 - RNA, 21 nt, Homo sapiens
gauaaauuugacuguuauuug

SEQ ID NO: 493656 - RNA, 15 nt, Homo sapiens
gauacgcuccaguac

SEQ ID NO: 493657 - RNA, 23 nt, Homo sapiens
gauauauuuuccagggcaaucaa

SEQ ID NO: 493658 - RNA, 23 nt, Homo sapiens
gauaucaggaaauaucugugaag

SEQ ID NO: 493659 - RNA, 21 nt, Homo sapiens
gaucaaguccuaguuguucag

SEQ ID NO: 493660 - RNA, 18 nt, Homo sapiens
gaucauugguaucugaua

SEQ ID NO: 493661 - RNA, 23 nt, Homo sapiens
gauccaccugcacaaacauagac

SEQ ID NO: 493662 - RNA, 18 nt, Homo sapiens
gaucugcaguuuuugccu

SEQ ID NO: 493663 - RNA, 12 nt, Homo sapiens
gaucugcauaac

SEQ ID NO: 493664 - RNA, 19 nt, Homo sapiens
gaucuggcccuugcuuacc

SEQ ID NO: 493665 - RNA, 16 nt, Homo sapiens
gaucuguuguaauauc

SEQ ID NO: 493666 - RNA, 17 nt, Homo sapiens
gaugaaagcuguuucau

SEQ ID NO: 493667 - RNA, 23 nt, Homo sapiens
gaugaccccuccccuaaugccug

SEQ ID NO: 493668 - RNA, 23 nt, Homo sapiens
gaugacguggguuugauuucuaa

SEQ ID NO: 493669 - RNA, 16 nt, Homo sapiens
gaugauccuugcacag

SEQ ID NO: 493670 - RNA, 16 nt, Homo sapiens
gaugcaauuacugcug

SEQ ID NO: 493671 - RNA, 12 nt, Homo sapiens
gauggaauauca

SEQ ID NO: 493672 - RNA, 16 nt, Homo sapiens
gaugucauuaaugugu

SEQ ID NO: 493673 - RNA, 15 nt, Homo sapiens
gaugugccuagacac

SEQ ID NO: 493674 - RNA, 17 nt, Homo sapiens
gauucacauguuuucaa

SEQ ID NO: 493675 - RNA, 17 nt, Homo sapiens
gauucccagaaauacaa

SEQ ID NO: 493676 - RNA, 21 nt, Homo sapiens
gauucugcaggaacaugaccc

SEQ ID NO: 493677 - RNA, 15 nt, Homo sapiens
gauugaacuucaaua

SEQ ID NO: 493678 - RNA, 18 nt, Homo sapiens
gauuggguaucaaaauga

SEQ ID NO: 493679 - RNA, 23 nt, Homo sapiens
gauuuacuaacaguaacugccau

SEQ ID NO: 493680 - RNA, 11 nt, Homo sapiens
gggaaccagag

SEQ ID NO: 493681 - RNA, 17 nt, Homo sapiens
gggacauuccaauuugc

SEQ ID NO: 493682 - RNA, 20 nt, Homo sapiens
gggacauuccaauuugcacu

SEQ ID NO: 493683 - RNA, 23 nt, Homo sapiens
gggagaccgaguguggagcugcu

SEQ ID NO: 493684 - RNA, 21 nt, Homo sapiens
gggagauccgcccugggcucu

SEQ ID NO: 493685 - RNA, 17 nt, Homo sapiens
gggauugcuuugcauua

SEQ ID NO: 493686 - RNA, 16 nt, Homo sapiens
gggauuugccagaugc

SEQ ID NO: 493687 - RNA, 18 nt, Homo sapiens
gggcccagaccacugucu

SEQ ID NO: 493688 - RNA, 23 nt, Homo sapiens
gggccccucucuccacauuccaa

SEQ ID NO: 493689 - RNA, 15 nt, Homo sapiens
ggggaacaaugagca

SEQ ID NO: 493690 - RNA, 13 nt, Homo sapiens
ggggcagcacaga

SEQ ID NO: 493691 - RNA, 13 nt, Homo sapiens
ggguagaucucaa

SEQ ID NO: 493692 - RNA, 14 nt, Homo sapiens
gggucucuugccca

SEQ ID NO: 493693 - RNA, 12 nt, Homo sapiens
gggucugugaug

SEQ ID NO: 493694 - RNA, 18 nt, Homo sapiens
gggucuucuaccucagac

SEQ ID NO: 493695 - RNA, 17 nt, Homo sapiens
gguaagggacuccagaa

SEQ ID NO: 493696 - RNA, 18 nt, Homo sapiens
gguagagagaaacagcuu

SEQ ID NO: 493697 - RNA, 21 nt, Homo sapiens
gguccugggggcugcugcacu

SEQ ID NO: 493698 - RNA, 13 nt, Homo sapiens
ggucuaugauguc

SEQ ID NO: 493699 - RNA, 21 nt, Homo sapiens
ggucucgucaggaggugccug

SEQ ID NO: 493700 - RNA, 20 nt, Homo sapiens
ggucucucuggcucuaggac

SEQ ID NO: 493701 - RNA, 20 nt, Homo sapiens
ggucucugccaugaacugga

SEQ ID NO: 493702 - RNA, 15 nt, Homo sapiens
gguuaacaccuucau

SEQ ID NO: 493703 - RNA, 21 nt, Homo sapiens
gguuugauuucuaaguguuuc

SEQ ID NO: 493704 - RNA, 17 nt, Homo sapiens
guaaaauuggauuauua

SEQ ID NO: 493705 - RNA, 15 nt, Homo sapiens
guaaauuccaaagau

SEQ ID NO: 493706 - RNA, 11 nt, Homo sapiens
guaacuacuuu

SEQ ID NO: 493707 - RNA, 11 nt, Homo sapiens
guaacuguccu

SEQ ID NO: 493708 - RNA, 15 nt, Homo sapiens
guaacuuuuguaguc

SEQ ID NO: 493709 - RNA, 18 nt, Homo sapiens
guaacuuuuguagucuua

SEQ ID NO: 493710 - RNA, 19 nt, Homo sapiens
guacaaucaugaacagcuc

SEQ ID NO: 493711 - RNA, 19 nt, Homo sapiens
guacauguggaaaacucac

SEQ ID NO: 493712 - RNA, 23 nt, Homo sapiens
guacuuugcugaaugucauuuua

SEQ ID NO: 493713 - RNA, 18 nt, Homo sapiens
guagaaucucagcacuuu

SEQ ID NO: 493714 - RNA, 13 nt, Homo sapiens
guagaaugaccuu

SEQ ID NO: 493715 - RNA, 14 nt, Homo sapiens
guagcaucauguau

SEQ ID NO: 493716 - RNA, 20 nt, Homo sapiens
guagcuuucaguauuguaaa

SEQ ID NO: 493717 - RNA, 21 nt, Homo sapiens
guaguagaaucucagcacuuu

SEQ ID NO: 493718 - RNA, 23 nt, Homo sapiens
guagucaccuaugucugugccuc

SEQ ID NO: 493719 - RNA, 16 nt, Homo sapiens
guagucauuuugccca

SEQ ID NO: 493720 - RNA, 18 nt, Homo sapiens
guauauuaaagugcuauc

SEQ ID NO: 493721 - RNA, 13 nt, Homo sapiens
guauauuauaugu

SEQ ID NO: 493722 - RNA, 10 nt, Homo sapiens
guauccucca

SEQ ID NO: 493723 - RNA, 16 nt, Homo sapiens
guauguuuacacuguc

SEQ ID NO: 493724 - RNA, 14 nt, Homo sapiens
guauuacaucccug

SEQ ID NO: 493725 - RNA, 12 nt, Homo sapiens
guauuauucaaa

SEQ ID NO: 493726 - RNA, 21 nt, Homo sapiens
gucacaauaaaagaaacugug

SEQ ID NO: 493727 - RNA, 22 nt, Homo sapiens
gucacccaacgacccaugaccg

SEQ ID NO: 493728 - RNA, 16 nt, Homo sapiens
gucacuuacuucauau

SEQ ID NO: 493729 - RNA, 19 nt, Homo sapiens
gucaggaggugccugagag

SEQ ID NO: 493730 - RNA, 19 nt, Homo sapiens
guccaaacuuaacagauca

SEQ ID NO: 493731 - RNA, 19 nt, Homo sapiens
guccccagaccaguaguga

SEQ ID NO: 493732 - RNA, 23 nt, Homo sapiens
gucccucaauuacagaggguagg

SEQ ID NO: 493733 - RNA, 12 nt, Homo sapiens
gucccuuaccug

SEQ ID NO: 493734 - RNA, 13 nt, Homo sapiens
gucccuuaccugg

SEQ ID NO: 493735 - RNA, 15 nt, Homo sapiens
guccucauuguucag

SEQ ID NO: 493736 - RNA, 20 nt, Homo sapiens
guccuuuaaaaaaaucccau

SEQ ID NO: 493737 - RNA, 14 nt, Homo sapiens
gucuaaaauuacau

SEQ ID NO: 493738 - RNA, 15 nt, Homo sapiens
gucuaguggaaccaa

SEQ ID NO: 493739 - RNA, 19 nt, Homo sapiens
gucuaugcucauaacugug

SEQ ID NO: 493740 - RNA, 20 nt, Homo sapiens
gucugcuuaguaucucauca

SEQ ID NO: 493741 - RNA, 16 nt, Homo sapiens
gucuguaaugugaauu

SEQ ID NO: 493742 - RNA, 14 nt, Homo sapiens
gucugucucucuuu

SEQ ID NO: 493743 - RNA, 22 nt, Homo sapiens
gucuucaacaugguuaccucug

SEQ ID NO: 493744 - RNA, 22 nt, Homo sapiens
gucuucaucuguccgacaaguu

SEQ ID NO: 493745 - RNA, 19 nt, Homo sapiens
gucuucaugugucuugcaa

SEQ ID NO: 493746 - RNA, 20 nt, Homo sapiens
gucuucaugugucuugcaau

SEQ ID NO: 493747 - RNA, 19 nt, Homo sapiens
uaaaguaugaauauuucau

SEQ ID NO: 493748 - RNA, 20 nt, Homo sapiens
uaaaguccuuucuagauccu

SEQ ID NO: 493749 - RNA, 22 nt, Homo sapiens
uaaauauuagcaaagcaugcca

SEQ ID NO: 493750 - RNA, 18 nt, Homo sapiens
uaaaucaauucauugugu

SEQ ID NO: 493751 - RNA, 15 nt, Homo sapiens
uaaaucuuccaaagu

SEQ ID NO: 493752 - RNA, 22 nt, Homo sapiens
uaaaugaaguaacuugucuuaa

SEQ ID NO: 493753 - RNA, 15 nt, Homo sapiens
uaaaugccccaaagc

SEQ ID NO: 493754 - RNA, 13 nt, Homo sapiens
uaaaugccuaaua

SEQ ID NO: 493755 - RNA, 21 nt, Homo sapiens
uaaauguuaaagauguagcaa

SEQ ID NO: 493756 - RNA, 16 nt, Homo sapiens
uaaauucaaaccuaag

SEQ ID NO: 493757 - RNA, 14 nt, Homo sapiens
uaaauuccaaagau

SEQ ID NO: 493758 - RNA, 20 nt, Homo sapiens
uaaauuuaauuaauuaauuc

SEQ ID NO: 493759 - RNA, 21 nt, Homo sapiens
uaacaagaucauuaucuucau

SEQ ID NO: 493760 - RNA, 19 nt, Homo sapiens
uaacagaaaaaugaaauuu

SEQ ID NO: 493761 - RNA, 10 nt, Homo sapiens
uaacaucccu

SEQ ID NO: 493762 - RNA, 23 nt, Homo sapiens
uaaccuucaaguaugugcuacuu

SEQ ID NO: 493763 - RNA, 15 nt, Homo sapiens
uaacuauugcugcuu

SEQ ID NO: 493764 - RNA, 12 nt, Homo sapiens
uaagaaacauug

SEQ ID NO: 493765 - RNA, 23 nt, Homo sapiens
uaagaugcuuugacacugaauaa

SEQ ID NO: 493766 - RNA, 20 nt, Homo sapiens
uaagauguuuuaauauguau

SEQ ID NO: 493767 - RNA, 19 nt, Homo sapiens
uaagcacaaccauguucuu

SEQ ID NO: 493768 - RNA, 14 nt, Homo sapiens
uaagcacagacaau

SEQ ID NO: 493769 - RNA, 20 nt, Homo sapiens
uaagcacagacaauucuaau

SEQ ID NO: 493770 - RNA, 13 nt, Homo sapiens
uaaggaaagccaa

SEQ ID NO: 493771 - RNA, 14 nt, Homo sapiens
uaaguaaacuaaug

SEQ ID NO: 493772 - RNA, 22 nt, Homo sapiens
uaaguacugaaauacauaugau

SEQ ID NO: 493773 - RNA, 15 nt, Homo sapiens
uaagucuuucccaau

SEQ ID NO: 493774 - RNA, 18 nt, Homo sapiens
uaauaauacaaguuuuca

SEQ ID NO: 493775 - RNA, 19 nt, Homo sapiens
uaauagaaaaauuguaaua

SEQ ID NO: 493776 - RNA, 12 nt, Homo sapiens
uaauauaaccau

SEQ ID NO: 493777 - RNA, 18 nt, Homo sapiens
uaauauauuugcagauaa

SEQ ID NO: 493778 - RNA, 13 nt, Homo sapiens
uaauaucagugaa

SEQ ID NO: 493779 - RNA, 18 nt, Homo sapiens
uaauccaggacagcauua

SEQ ID NO: 493780 - RNA, 14 nt, Homo sapiens
uaauccuagcacuu

SEQ ID NO: 493781 - RNA, 22 nt, Homo sapiens
uaauccugcaaaguacagguac

SEQ ID NO: 493782 - RNA, 18 nt, Homo sapiens
uaauguuccaugucugaa

SEQ ID NO: 493783 - RNA, 21 nt, Homo sapiens
uaauguugacuuuaauacucu

SEQ ID NO: 493784 - RNA, 21 nt, Homo sapiens
uaauuaaaaaguuaaucuuca

SEQ ID NO: 493785 - RNA, 18 nt, Homo sapiens
uaauuaaguaaacuaaug

SEQ ID NO: 493786 - RNA, 18 nt, Homo sapiens
uaauuuuauguucacuug

SEQ ID NO: 493787 - RNA, 17 nt, Homo sapiens
uacaaaauauccaagcc

SEQ ID NO: 493788 - RNA, 19 nt, Homo sapiens
uacaaaguuggcuuagaua

SEQ ID NO: 493789 - RNA, 22 nt, Homo sapiens
uacaacacauugaaacuguauu

SEQ ID NO: 493790 - RNA, 20 nt, Homo sapiens
uacaacaccagcaacauuau

SEQ ID NO: 493791 - RNA, 15 nt, Homo sapiens
uacaaguuugaacag

SEQ ID NO: 493792 - RNA, 15 nt, Homo sapiens
uacaaguuuucauaa

SEQ ID NO: 493793 - RNA, 18 nt, Homo sapiens
uacaauacaacacauuga

SEQ ID NO: 493794 - RNA, 13 nt, Homo sapiens
uacaauauucuca

SEQ ID NO: 493795 - RNA, 20 nt, Homo sapiens
uacaauauucucauuauuaa

SEQ ID NO: 493796 - RNA, 23 nt, Homo sapiens
uacaaucaugaacagcucugaga

SEQ ID NO: 493797 - RNA, 12 nt, Homo sapiens
uacaauguauca

SEQ ID NO: 493798 - RNA, 18 nt, Homo sapiens
uacaauguaucaacauau

SEQ ID NO: 493799 - RNA, 20 nt, Homo sapiens
uacacaauuaauucaucccu

SEQ ID NO: 493800 - RNA, 12 nt, Homo sapiens
uacacacuugac

SEQ ID NO: 493801 - RNA, 13 nt, Homo sapiens
uacacauauaccu

SEQ ID NO: 493802 - RNA, 15 nt, Homo sapiens
uacacauauaccuau

SEQ ID NO: 493803 - RNA, 13 nt, Homo sapiens
uacagcucucccc

SEQ ID NO: 493804 - RNA, 16 nt, Homo sapiens
uacagugguauugcua

SEQ ID NO: 493805 - RNA, 20 nt, Homo sapiens
uacauacgcaauuguauaua

SEQ ID NO: 493806 - RNA, 18 nt, Homo sapiens
uacauaguuauguaaaaa

SEQ ID NO: 493807 - RNA, 13 nt, Homo sapiens
uacauauuuggag

SEQ ID NO: 493808 - RNA, 15 nt, Homo sapiens
uacaugccuuuccag

SEQ ID NO: 493809 - RNA, 20 nt, Homo sapiens
uacaugccuuuccagugcug

SEQ ID NO: 493810 - RNA, 20 nt, Homo sapiens
ucucuagacaucuagucuca

SEQ ID NO: 493811 - RNA, 16 nt, Homo sapiens
ucucuccacauuccaa

SEQ ID NO: 493812 - RNA, 11 nt, Homo sapiens
ucucucuccag

SEQ ID NO: 493813 - RNA, 13 nt, Homo sapiens
ucucugccaugaa

SEQ ID NO: 493814 - RNA, 20 nt, Homo sapiens
ucucuggcuaaggacaggca

SEQ ID NO: 493815 - RNA, 21 nt, Homo sapiens
ucucuucaugcgcagucccca

SEQ ID NO: 493816 - RNA, 13 nt, Homo sapiens
ucucuucuuccuu

SEQ ID NO: 493817 - RNA, 14 nt, Homo sapiens
ucucuuucaaaaag

SEQ ID NO: 493818 - RNA, 12 nt, Homo sapiens
ucugaauuccaa

SEQ ID NO: 493819 - RNA, 23 nt, Homo sapiens
ucugacauauuucauaagcacau

SEQ ID NO: 493820 - RNA, 13 nt, Homo sapiens
ucugacuaccucc

SEQ ID NO: 493821 - RNA, 24 nt, Homo sapiens
ucugauccacagccucaucaguau

SEQ ID NO: 493822 - RNA, 21 nt, Homo sapiens
ucugaugaaguuguacaacac

SEQ ID NO: 493823 - RNA, 17 nt, Homo sapiens
ucugauguaaaugaagu

SEQ ID NO: 493824 - RNA, 15 nt, Homo sapiens
ucugcaaugagccau

SEQ ID NO: 493825 - RNA, 18 nt, Homo sapiens
ucugcaggaacaugaccc

SEQ ID NO: 493826 - RNA, 19 nt, Homo sapiens
ucugcauaaccgcacagac

SEQ ID NO: 493827 - RNA, 20 nt, Homo sapiens
ucugccucuguucacgggga

SEQ ID NO: 493828 - RNA, 12 nt, Homo sapiens
ucugccuuccag

SEQ ID NO: 493829 - RNA, 13 nt, Homo sapiens
ucugcugagcucu

SEQ ID NO: 493830 - RNA, 14 nt, Homo sapiens
ucuggaugguggug

SEQ ID NO: 493831 - RNA, 13 nt, Homo sapiens
ucuguacagauca

SEQ ID NO: 493832 - RNA, 21 nt, Homo sapiens
ucuguccccgagccgagcucu

SEQ ID NO: 493833 - RNA, 14 nt, Homo sapiens
ucugugcaacaaac

SEQ ID NO: 493834 - RNA, 23 nt, Homo sapiens
ucuuaaaaugugcuauuugcaaa

SEQ ID NO: 493835 - RNA, 23 nt, Homo sapiens
ucuuaauuaaguaaacuaaugag

SEQ ID NO: 493836 - RNA, 17 nt, Homo sapiens
ucuuagaagaaauauga

SEQ ID NO: 493837 - RNA, 14 nt, Homo sapiens
ucuucauggccaua

SEQ ID NO: 493838 - RNA, 21 nt, Homo sapiens
ucuucgcccugcguuccuucc

SEQ ID NO: 493839 - RNA, 21 nt, Homo sapiens
ucuugaaugcuuaaaugauca

SEQ ID NO: 493840 - RNA, 24 nt, Homo sapiens
ucuugcacagucacugcucuucag

SEQ ID NO: 493841 - RNA, 17 nt, Homo sapiens
ucuugcagucaucagaa

SEQ ID NO: 493842 - RNA, 17 nt, Homo sapiens
ucuuggugaacacacau

SEQ ID NO: 493843 - RNA, 14 nt, Homo sapiens
ucuuuaccuugcau

SEQ ID NO: 493844 - RNA, 13 nt, Homo sapiens
ucuuuccauuuac

SEQ ID NO: 493845 - RNA, 16 nt, Homo sapiens
ucuuugaaaacucaua

SEQ ID NO: 493846 - RNA, 21 nt, Homo sapiens
ucuuuggggguuagaccacuu

SEQ ID NO: 493847 - RNA, 18 nt, Homo sapiens
ucuuuucugaucugcagu

SEQ ID NO: 493848 - RNA, 21 nt, Homo sapiens
ucuuuugcucucucauuccca

SEQ ID NO: 493849 - RNA, 12 nt, Homo sapiens
ucuuuuuacaau

SEQ ID NO: 493850 - RNA, 16 nt, Homo sapiens
ugaaaauccaucucau

SEQ ID NO: 493851 - RNA, 15 nt, Homo sapiens
ugaaaauuaaggaaa

SEQ ID NO: 493852 - RNA, 12 nt, Homo sapiens
ugaaacaaacau

SEQ ID NO: 493853 - RNA, 18 nt, Homo sapiens
ugaaacacaauaucaucc

SEQ ID NO: 493854 - RNA, 13 nt, Homo sapiens
ugaaagaaagcuu

SEQ ID NO: 493855 - RNA, 14 nt, Homo sapiens
ugaaagcaacagcu

SEQ ID NO: 493856 - RNA, 18 nt, Homo sapiens
ugaaaggcaugugaaggg

SEQ ID NO: 493857 - RNA, 19 nt, Homo sapiens
ugaaagggacaaguaucau

SEQ ID NO: 493858 - RNA, 14 nt, Homo sapiens
ugaaagugccaaaa

SEQ ID NO: 493859 - RNA, 17 nt, Homo sapiens
ugaaauaaaauuaguuc

SEQ ID NO: 493860 - RNA, 14 nt, Homo sapiens
ugaaauacauauga

SEQ ID NO: 493861 - RNA, 15 nt, Homo sapiens
ugaaauuauaucugu

SEQ ID NO: 493862 - RNA, 13 nt, Homo sapiens
ugaaauucacaaa

SEQ ID NO: 493863 - RNA, 13 nt, Homo sapiens
ugaaauugaguca

SEQ ID NO: 493864 - RNA, 20 nt, Homo sapiens
ugaagaacucaugugauuua

SEQ ID NO: 493865 - RNA, 23 nt, Homo sapiens
ugaagagagagcugagugagcug

SEQ ID NO: 493866 - RNA, 13 nt, Homo sapiens
ugaagagcauuug

SEQ ID NO: 493867 - RNA, 21 nt, Homo sapiens
uggauauguuuucacuguauu

SEQ ID NO: 493868 - RNA, 17 nt, Homo sapiens
uggaucaggaacccuua

SEQ ID NO: 493869 - RNA, 20 nt, Homo sapiens
uggauucccagggacuucag

SEQ ID NO: 493870 - RNA, 20 nt, Homo sapiens
uggauuucauuaucauauga

SEQ ID NO: 493871 - RNA, 12 nt, Homo sapiens
uggccaagcaga

SEQ ID NO: 493872 - RNA, 19 nt, Homo sapiens
uggcccuugcuuaccucuc

SEQ ID NO: 493873 - RNA, 21 nt, Homo sapiens
uggccuauuuuggacguguga

SEQ ID NO: 493874 - RNA, 16 nt, Homo sapiens
uggccuggccagacca

SEQ ID NO: 493875 - RNA, 13 nt, Homo sapiens
uggcucauuagcu

SEQ ID NO: 493876 - RNA, 19 nt, Homo sapiens
uggcugggcuacaauuugu

SEQ ID NO: 493877 - RNA, 13 nt, Homo sapiens
ugggagcacagcu

SEQ ID NO: 493878 - RNA, 22 nt, Homo sapiens
ugggcaacagagugagacccua

SEQ ID NO: 493879 - RNA, 16 nt, Homo sapiens
ugggcagauuugcaac

SEQ ID NO: 493880 - RNA, 18 nt, Homo sapiens
ugggcagauuugcaacag

SEQ ID NO: 493881 - RNA, 21 nt, Homo sapiens
ugggcagcuguuagaguccaa

SEQ ID NO: 493882 - RNA, 22 nt, Homo sapiens
ugggcuggaacagcagauuuca

SEQ ID NO: 493883 - RNA, 22 nt, Homo sapiens
uggggccacacguuugccaaau

SEQ ID NO: 493884 - RNA, 17 nt, Homo sapiens
ugggggaacaaugagca

SEQ ID NO: 493885 - RNA, 16 nt, Homo sapiens
ugguaacuuugcaaau

SEQ ID NO: 493886 - RNA, 23 nt, Homo sapiens
ugguaagaaaaagcaaaaggcau

SEQ ID NO: 493887 - RNA, 14 nt, Homo sapiens
ugguagacugugac

SEQ ID NO: 493888 - RNA, 17 nt, Homo sapiens
ugguaguucgaagaauu

SEQ ID NO: 493889 - RNA, 16 nt, Homo sapiens
ugguccacauucugcu

SEQ ID NO: 493890 - RNA, 16 nt, Homo sapiens
ugguccugcacugucc

SEQ ID NO: 493891 - RNA, 13 nt, Homo sapiens
uggucucugccau

SEQ ID NO: 493892 - RNA, 14 nt, Homo sapiens
ugguguuaaugagu

SEQ ID NO: 493893 - RNA, 15 nt, Homo sapiens
ugguucauauaugca

SEQ ID NO: 493894 - RNA, 17 nt, Homo sapiens
ugguucauauaugcaaa

SEQ ID NO: 493895 - RNA, 16 nt, Homo sapiens
ugguuguuucuuccaa

SEQ ID NO: 493896 - RNA, 16 nt, Homo sapiens
ugguuuccaucaaagc

SEQ ID NO: 493897 - RNA, 14 nt, Homo sapiens
uguaaaaagagauu

SEQ ID NO: 493898 - RNA, 16 nt, Homo sapiens
uguaaauuccaaagau

SEQ ID NO: 493899 - RNA, 13 nt, Homo sapiens
uguaaguuacuga

SEQ ID NO: 493900 - RNA, 19 nt, Homo sapiens
uguacaaaaacacaaauac

SEQ ID NO: 493901 - RNA, 12 nt, Homo sapiens
uguacaaaaggg

SEQ ID NO: 493902 - RNA, 18 nt, Homo sapiens
uguacaaaauauccaagc

SEQ ID NO: 493903 - RNA, 14 nt, Homo sapiens
uguagucuuaugaa

SEQ ID NO: 493904 - RNA, 17 nt, Homo sapiens
uguauagacucagugca

SEQ ID NO: 493905 - RNA, 21 nt, Homo sapiens
uguauauugauguaacugugu

SEQ ID NO: 493906 - RNA, 11 nt, Homo sapiens
uguauccucca

SEQ ID NO: 493907 - RNA, 14 nt, Homo sapiens
uguauggaagacaa

SEQ ID NO: 493908 - RNA, 19 nt, Homo sapiens
uguauucucuucuacaaua

SEQ ID NO: 493909 - RNA, 17 nt, Homo sapiens
ugucagucguguugcuu

SEQ ID NO: 493910 - RNA, 16 nt, Homo sapiens
ugucauggugcaauuu

SEQ ID NO: 493911 - RNA, 16 nt, Homo sapiens
ugucauuaauguguug

SEQ ID NO: 493912 - RNA, 14 nt, Homo sapiens
uguccuaagagauu

SEQ ID NO: 493913 - RNA, 15 nt, Homo sapiens
uguccuuggggacau

SEQ ID NO: 493914 - RNA, 12 nt, Homo sapiens
uguccuuuauga

SEQ ID NO: 493915 - RNA, 15 nt, Homo sapiens
uguccuuuaugaucc

SEQ ID NO: 493916 - RNA, 21 nt, Homo sapiens
ugucucaaaggagcuuucuca

SEQ ID NO: 493917 - RNA, 15 nt, Homo sapiens
ugucucuaaaagccc

SEQ ID NO: 493918 - RNA, 17 nt, Homo sapiens
ugucucuauuuaugaga

SEQ ID NO: 493919 - RNA, 22 nt, Homo sapiens
ugucugcaugaaggucuaccug

SEQ ID NO: 493920 - RNA, 17 nt, Homo sapiens
uccuuucacuucuuucc

SEQ ID NO: 493921 - RNA, 22 nt, Homo sapiens
uccuuuucccaaagcaucccuc

SEQ ID NO: 493922 - RNA, 17 nt, Homo sapiens
uccuuuugguuccucac

SEQ ID NO: 493923 - RNA, 16 nt, Homo sapiens
uccuuuuguauccucc

SEQ ID NO: 493924 - RNA, 23 nt, Homo sapiens
ucgaaaauucauuucacauuaau

SEQ ID NO: 493925 - RNA, 11 nt, Homo sapiens
ucggccuucac

SEQ ID NO: 493926 - RNA, 13 nt, Homo sapiens
ucgggcuuuucac

SEQ ID NO: 493927 - RNA, 18 nt, Homo sapiens
ucuaaaauuacagacaaa

SEQ ID NO: 493928 - RNA, 14 nt, Homo sapiens
ucuaauccaugugc

SEQ ID NO: 493929 - RNA, 16 nt, Homo sapiens
ucuaauccaugugcug

SEQ ID NO: 493930 - RNA, 15 nt, Homo sapiens
ucuacaauacaacac

SEQ ID NO: 493931 - RNA, 18 nt, Homo sapiens
ucuacuuuaaauugugga

SEQ ID NO: 493932 - RNA, 18 nt, Homo sapiens
ucuagauccuaugugaaa

SEQ ID NO: 493933 - RNA, 18 nt, Homo sapiens
ucuagugucuuuugccuu

SEQ ID NO: 493934 - RNA, 23 nt, Homo sapiens
ucucaaaauaaaaccagaaagag

SEQ ID NO: 493935 - RNA, 23 nt, Homo sapiens
ucucaucaacaaagaaauauuau

SEQ ID NO: 493936 - RNA, 16 nt, Homo sapiens
ucucauucccaggcac

SEQ ID NO: 493937 - RNA, 20 nt, Homo sapiens
ucucauuccucuguccccga

SEQ ID NO: 493938 - RNA, 20 nt, Homo sapiens
ucuccagucuuccaccugga

SEQ ID NO: 493939 - RNA, 18 nt, Homo sapiens
ucucccagcuuucaggga

SEQ ID NO: 493940 - RNA, 17 nt, Homo sapiens
ucucuagugucuuuugc

SEQ ID NO: 493941 - RNA, 13 nt, Homo sapiens
ucugaaaacauca

SEQ ID NO: 493942 - RNA, 17 nt, Homo sapiens
ucugaaacuaaugaaag

SEQ ID NO: 493943 - RNA, 15 nt, Homo sapiens
ucugaaggcugaguc

SEQ ID NO: 493944 - RNA, 16 nt, Homo sapiens
ucugagaguuccagau

SEQ ID NO: 493945 - RNA, 22 nt, Homo sapiens
ucugaucugcaguuuuugccug

SEQ ID NO: 493946 - RNA, 13 nt, Homo sapiens
ucugaucuggguu

SEQ ID NO: 493947 - RNA, 22 nt, Homo sapiens
ucugcgucccacugagucucau

SEQ ID NO: 493948 - RNA, 21 nt, Homo sapiens
ucuguaaaucaagaccaaaga

SEQ ID NO: 493949 - RNA, 20 nt, Homo sapiens
ucuguacguauauaaauaua

SEQ ID NO: 493950 - RNA, 20 nt, Homo sapiens
ucugucccaguuaacuguua

SEQ ID NO: 493951 - RNA, 13 nt, Homo sapiens
ucuguccuaccuu

SEQ ID NO: 493952 - RNA, 20 nt, Homo sapiens
ucugucuggaggggagcucu

SEQ ID NO: 493953 - RNA, 18 nt, Homo sapiens
ucugugcaacaaacucaa

SEQ ID NO: 493954 - RNA, 23 nt, Homo sapiens
ucuuaaaggcuucucauccacug

SEQ ID NO: 493955 - RNA, 15 nt, Homo sapiens
ucuuaaugucucaaa

SEQ ID NO: 493956 - RNA, 14 nt, Homo sapiens
ucuuacccaaagca

SEQ ID NO: 493957 - RNA, 22 nt, Homo sapiens
ucuuauggaggagaguguuuaa

SEQ ID NO: 493958 - RNA, 13 nt, Homo sapiens
ucuucagccauag

SEQ ID NO: 493959 - RNA, 15 nt, Homo sapiens
ucuucagggggccag

SEQ ID NO: 493960 - RNA, 17 nt, Homo sapiens
ucuuccaacaugugaug

SEQ ID NO: 493961 - RNA, 18 nt, Homo sapiens
ucuuccaacaugugaugu

SEQ ID NO: 493962 - RNA, 16 nt, Homo sapiens
ucuuccuuucuaaucc

SEQ ID NO: 493963 - RNA, 15 nt, Homo sapiens
ucuucuaccucagac

SEQ ID NO: 493964 - RNA, 18 nt, Homo sapiens
ucuucuucccauggugcu

SEQ ID NO: 493965 - RNA, 13 nt, Homo sapiens
ucuugaauguuga

SEQ ID NO: 493966 - RNA, 17 nt, Homo sapiens
ucuugguuuccaucaaa

SEQ ID NO: 493967 - RNA, 12 nt, Homo sapiens
ucuugugauuga

SEQ ID NO: 493968 - RNA, 13 nt, Homo sapiens
ucuugugcccuua

SEQ ID NO: 493969 - RNA, 11 nt, Homo sapiens
ucuuguuguuc

SEQ ID NO: 493970 - RNA, 16 nt, Homo sapiens
ucuuucccaaaggcau

SEQ ID NO: 493971 - RNA, 18 nt, Homo sapiens
ucuuucggaaaugauuga

SEQ ID NO: 493972 - RNA, 15 nt, Homo sapiens
ucuuucugccaacuu

SEQ ID NO: 493973 - RNA, 23 nt, Homo sapiens
ucuuuguuuuuuguuuucauuaa

SEQ ID NO: 493974 - RNA, 20 nt, Homo sapiens
uucauucauauuacaauauu

SEQ ID NO: 493975 - RNA, 21 nt, Homo sapiens
uuccaaagguuucaacuguaa

SEQ ID NO: 493976 - RNA, 14 nt, Homo sapiens
uuccaacaugugau

SEQ ID NO: 493977 - RNA, 16 nt, Homo sapiens
uuccaaguuuauugcc

SEQ ID NO: 493978 - RNA, 16 nt, Homo sapiens
uuccauacuucucuca

SEQ ID NO: 493979 - RNA, 17 nt, Homo sapiens
uuccauuuacagucucu

SEQ ID NO: 493980 - RNA, 17 nt, Homo sapiens
uucccaaaucucaaaag

SEQ ID NO: 493981 - RNA, 18 nt, Homo sapiens
uucccacacugugaacua

SEQ ID NO: 493982 - RNA, 19 nt, Homo sapiens
uuccccacaauaggcuuag

SEQ ID NO: 493983 - RNA, 15 nt, Homo sapiens
uucccccgcaaugug

SEQ ID NO: 493984 - RNA, 23 nt, Homo sapiens
uuccccggggucuucuaccucag

SEQ ID NO: 493985 - RNA, 21 nt, Homo sapiens
uucccguggcuuugugcuuau

SEQ ID NO: 493986 - RNA, 19 nt, Homo sapiens
uucccugaaaccguuaaaa

SEQ ID NO: 493987 - RNA, 22 nt, Homo sapiens
uuccuaacaggauuagacaguc

SEQ ID NO: 493988 - RNA, 12 nt, Homo sapiens
uuccucccaaaa

SEQ ID NO: 493989 - RNA, 18 nt, Homo sapiens
uuccucuuucacuucuua

SEQ ID NO: 493990 - RNA, 16 nt, Homo sapiens
uuccugaacucccagu

SEQ ID NO: 493991 - RNA, 14 nt, Homo sapiens
uuccugccuggucu

SEQ ID NO: 493992 - RNA, 17 nt, Homo sapiens
uuccuuccacaguuauc

SEQ ID NO: 493993 - RNA, 15 nt, Homo sapiens
uucggcuaugucuca

SEQ ID NO: 493994 - RNA, 20 nt, Homo sapiens
uucguccuuagaauacugua

SEQ ID NO: 493995 - RNA, 15 nt, Homo sapiens
uucuaaguagaguau

SEQ ID NO: 493996 - RNA, 22 nt, Homo sapiens
uucuaguggguuuaauguuuag

SEQ ID NO: 493997 - RNA, 20 nt, Homo sapiens
uucucucaccuccuaaagua

SEQ ID NO: 493998 - RNA, 20 nt, Homo sapiens
uucucucuccagucuuccac

SEQ ID NO: 493999 - RNA, 17 nt, Homo sapiens
uucucuuggacauugua

SEQ ID NO: 494000 - RNA, 13 nt, Homo sapiens
uucugaguagcau

SEQ ID NO: 494001 - RNA, 15 nt, Homo sapiens
uucuguccuaccuuu

SEQ ID NO: 494002 - RNA, 23 nt, Homo sapiens
uucuuaaaaugugcuauuugcaa

SEQ ID NO: 494003 - RNA, 13 nt, Homo sapiens
uucuuacuguauu

SEQ ID NO: 494004 - RNA, 15 nt, Homo sapiens
uucuucugucaucua

SEQ ID NO: 494005 - RNA, 16 nt, Homo sapiens
uucuugagcagcugaa

SEQ ID NO: 494006 - RNA, 12 nt, Homo sapiens
uucuugcaauuu

SEQ ID NO: 494007 - RNA, 13 nt, Homo sapiens
uucuugcaauuug

SEQ ID NO: 494008 - RNA, 16 nt, Homo sapiens
uucuuuuauacugaca

SEQ ID NO: 494009 - RNA, 18 nt, Homo sapiens
uugaaaagaaaaagaaga

SEQ ID NO: 494010 - RNA, 20 nt, Homo sapiens
uugaaagggacaaguaucau

SEQ ID NO: 494011 - RNA, 13 nt, Homo sapiens
uugaacugaaguc

SEQ ID NO: 494012 - RNA, 16 nt, Homo sapiens
uugaccugcugaaguc

SEQ ID NO: 494013 - RNA, 14 nt, Homo sapiens
uugaccuucugucg

SEQ ID NO: 494014 - RNA, 16 nt, Homo sapiens
uugacuggccaaaaau

SEQ ID NO: 494015 - RNA, 18 nt, Homo sapiens
uugaucuuccucugcuaa

SEQ ID NO: 494016 - RNA, 20 nt, Homo sapiens
uugauucaaauaacccugaa

SEQ ID NO: 494017 - RNA, 22 nt, Homo sapiens
uugauugguuuaaaagucacau

SEQ ID NO: 494018 - RNA, 18 nt, Homo sapiens
uugcaucaaucuuaaugu

SEQ ID NO: 494019 - RNA, 14 nt, Homo sapiens
uugcgugaaagugu

SEQ ID NO: 494020 - RNA, 12 nt, Homo sapiens
uugcuaccaaaa

SEQ ID NO: 494021 - RNA, 14 nt, Homo sapiens
aggagcuuucucaa

SEQ ID NO: 494022 - RNA, 23 nt, Homo sapiens
aggagcuuucucaaugucuuccc

SEQ ID NO: 494023 - RNA, 15 nt, Homo sapiens
aggaggugccugaga

SEQ ID NO: 494024 - RNA, 15 nt, Homo sapiens
aggauuagacaguca

SEQ ID NO: 494025 - RNA, 22 nt, Homo sapiens
aggauucucaccagcugugucc

SEQ ID NO: 494026 - RNA, 17 nt, Homo sapiens
aggcaaugauauggcau

SEQ ID NO: 494027 - RNA, 20 nt, Homo sapiens
aggcaaugauauggcauguc

SEQ ID NO: 494028 - RNA, 22 nt, Homo sapiens
aggcaauggugaacugucauua

SEQ ID NO: 494029 - RNA, 22 nt, Homo sapiens
aggcaggugccccucucuccau

SEQ ID NO: 494030 - RNA, 14 nt, Homo sapiens
aggcucucugugaa

SEQ ID NO: 494031 - RNA, 18 nt, Homo sapiens
aggcuuacuaaugcugcc

SEQ ID NO: 494032 - RNA, 15 nt, Homo sapiens
aggcuuagugcuugg

SEQ ID NO: 494033 - RNA, 22 nt, Homo sapiens
aggcuucaauuuauugcacaaa

SEQ ID NO: 494034 - RNA, 21 nt, Homo sapiens
aggcuucucauccacugugcu

SEQ ID NO: 494035 - RNA, 23 nt, Homo sapiens
agggaaugagaguuccuucucac

SEQ ID NO: 494036 - RNA, 18 nt, Homo sapiens
agggacuccagaagcagc

SEQ ID NO: 494037 - RNA, 20 nt, Homo sapiens
agggagaauaaaauuccuau

SEQ ID NO: 494038 - RNA, 20 nt, Homo sapiens
agggcccugccaaaaaaaga

SEQ ID NO: 494039 - RNA, 16 nt, Homo sapiens
agggcgugaaacacaa

SEQ ID NO: 494040 - RNA, 23 nt, Homo sapiens
aggggacgggugguggugucugu

SEQ ID NO: 494041 - RNA, 19 nt, Homo sapiens
agggggccaggugcacaga

SEQ ID NO: 494042 - RNA, 15 nt, Homo sapiens
aggguacauacgcua

SEQ ID NO: 494043 - RNA, 14 nt, Homo sapiens
agggugaaccaagc

SEQ ID NO: 494044 - RNA, 14 nt, Homo sapiens
agguaaauaaucau

SEQ ID NO: 494045 - RNA, 22 nt, Homo sapiens
agguaaauaaucauacacagaa

SEQ ID NO: 494046 - RNA, 19 nt, Homo sapiens
agguacucuggacuuucuc

SEQ ID NO: 494047 - RNA, 17 nt, Homo sapiens
agguaguagaaucucag

SEQ ID NO: 494048 - RNA, 12 nt, Homo sapiens
agguccacuucc

SEQ ID NO: 494049 - RNA, 20 nt, Homo sapiens
agguccuuguuguuucuugc

SEQ ID NO: 494050 - RNA, 18 nt, Homo sapiens
aggugaaaauccaucuca

SEQ ID NO: 494051 - RNA, 21 nt, Homo sapiens
aggugacuuuccuaugacacu

SEQ ID NO: 494052 - RNA, 17 nt, Homo sapiens
agguucaggaagaccac

SEQ ID NO: 494053 - RNA, 19 nt, Homo sapiens
aguaaaccugaacaaaccc

SEQ ID NO: 494054 - RNA, 15 nt, Homo sapiens
aguaacuugucuuaa

SEQ ID NO: 494055 - RNA, 12 nt, Homo sapiens
aguacaaaaagg

SEQ ID NO: 494056 - RNA, 17 nt, Homo sapiens
aguacaggucaucugcu

SEQ ID NO: 494057 - RNA, 14 nt, Homo sapiens
aguaccacacugag

SEQ ID NO: 494058 - RNA, 14 nt, Homo sapiens
aguagaaucucagc

SEQ ID NO: 494059 - RNA, 17 nt, Homo sapiens
aguagaaucucagcacu

SEQ ID NO: 494060 - RNA, 20 nt, Homo sapiens
aguagaauugauuucccuuc

SEQ ID NO: 494061 - RNA, 21 nt, Homo sapiens
aguagacuucauuuuuccuaa

SEQ ID NO: 494062 - RNA, 19 nt, Homo sapiens
aguagcuguggggagcugg

SEQ ID NO: 494063 - RNA, 14 nt, Homo sapiens
aguauacacaucau

SEQ ID NO: 494064 - RNA, 12 nt, Homo sapiens
aguauauguaac

SEQ ID NO: 494065 - RNA, 23 nt, Homo sapiens
aguauggauugaaggauugugaa

SEQ ID NO: 494066 - RNA, 18 nt, Homo sapiens
aguauuauggaaauccac

SEQ ID NO: 494067 - RNA, 23 nt, Homo sapiens
aguauuguaaagagauuguucua

SEQ ID NO: 494068 - RNA, 20 nt, Homo sapiens
agucacugcucuucagccau

SEQ ID NO: 494069 - RNA, 15 nt, Homo sapiens
agucauauguucuca

SEQ ID NO: 494070 - RNA, 23 nt, Homo sapiens
agucaugauguuuuuaaaaucuu

SEQ ID NO: 494071 - RNA, 12 nt, Homo sapiens
agucuuucccaa

SEQ ID NO: 494072 - RNA, 16 nt, Homo sapiens
agugacuccaagaaca

SEQ ID NO: 494073 - RNA, 16 nt, Homo sapiens
agugaggcaggugaca

SEQ ID NO: 494074 - RNA, 23 nt, Homo sapiens
agugauuucggaccgaaggugac

SEQ ID NO: 494075 - RNA, 17 nt, Homo sapiens
agugcauuuggccaaau

SEQ ID NO: 494076 - RNA, 21 nt, Homo sapiens
aguggacgucagaagaaucuc

SEQ ID NO: 494077 - RNA, 22 nt, Homo sapiens
aguggauauagauaacugcaua

SEQ ID NO: 494078 - RNA, 13 nt, Homo sapiens
aguggauucccag

SEQ ID NO: 494079 - RNA, 17 nt, Homo sapiens
aguguagaucaacucau

SEQ ID NO: 494080 - RNA, 15 nt, Homo sapiens
agugucccuuaccug

SEQ ID NO: 494081 - RNA, 14 nt, Homo sapiens
aguguuacauauuc

SEQ ID NO: 494082 - RNA, 16 nt, Homo sapiens
aguuaaauuggcuugu

SEQ ID NO: 494083 - RNA, 16 nt, Homo sapiens
aguuaauaacagcucc

SEQ ID NO: 494084 - RNA, 14 nt, Homo sapiens
aguugcauuuucau

SEQ ID NO: 494085 - RNA, 17 nt, Homo sapiens
aguugcugcagauuccu

SEQ ID NO: 494086 - RNA, 15 nt, Homo sapiens
aguuggcacauuuca

SEQ ID NO: 494087 - RNA, 23 nt, Homo sapiens
aguugugaucuguuguaauauca

SEQ ID NO: 494088 - RNA, 23 nt, Homo sapiens
aguuuauuuuuuaaaauucuaag

SEQ ID NO: 494089 - RNA, 21 nt, Homo sapiens
aguuuccaaguuuauugcccu

SEQ ID NO: 494090 - RNA, 22 nt, Homo sapiens
aguuuccagcuaagccugauga

SEQ ID NO: 494091 - RNA, 23 nt, Homo sapiens
aguuuccagcuaagccugaugau

SEQ ID NO: 494092 - RNA, 14 nt, Homo sapiens
aguuuuaaucaaga

SEQ ID NO: 494093 - RNA, 19 nt, Homo sapiens
auaaaagaaagaugcugau

SEQ ID NO: 494094 - RNA, 18 nt, Homo sapiens
auaaaauguuuucacugu

SEQ ID NO: 494095 - RNA, 14 nt, Homo sapiens
auaaacucagucaa

SEQ ID NO: 494096 - RNA, 19 nt, Homo sapiens
auaaacucagucaaaugua

SEQ ID NO: 494097 - RNA, 16 nt, Homo sapiens
auaaagauacgaguuu

SEQ ID NO: 494098 - RNA, 14 nt, Homo sapiens
auaaagcuuuugca

SEQ ID NO: 494099 - RNA, 14 nt, Homo sapiens
auaaauauacucaa

SEQ ID NO: 494100 - RNA, 15 nt, Homo sapiens
auaaauauuagcaaa

SEQ ID NO: 494101 - RNA, 14 nt, Homo sapiens
auaaaucaauucau

SEQ ID NO: 494102 - RNA, 21 nt, Homo sapiens
auaaaucaauucauuguguau

SEQ ID NO: 494103 - RNA, 11 nt, Homo sapiens
auaaauccaac

SEQ ID NO: 494104 - RNA, 16 nt, Homo sapiens
auaaaucuuccaaagu

SEQ ID NO: 494105 - RNA, 19 nt, Homo sapiens
auaacagccgcuccagagu

SEQ ID NO: 494106 - RNA, 12 nt, Homo sapiens
auaacugcauaa

SEQ ID NO: 494107 - RNA, 17 nt, Homo sapiens
auaaguaaaugucuuca

SEQ ID NO: 494108 - RNA, 23 nt, Homo sapiens
auaauacauuaagccucuugucu

SEQ ID NO: 494109 - RNA, 15 nt, Homo sapiens
auaaucaaagcucau

SEQ ID NO: 494110 - RNA, 14 nt, Homo sapiens
auaaucauacacag

SEQ ID NO: 494111 - RNA, 11 nt, Homo sapiens
auaaugcuucu

SEQ ID NO: 494112 - RNA, 18 nt, Homo sapiens
auucugcaggaacaugac

SEQ ID NO: 494113 - RNA, 19 nt, Homo sapiens
auucugcaggaacaugacc

SEQ ID NO: 494114 - RNA, 23 nt, Homo sapiens
auucugcuugguuccacaaucau

SEQ ID NO: 494115 - RNA, 14 nt, Homo sapiens
auucuggugucuaa

SEQ ID NO: 494116 - RNA, 9 nt, Homo sapiens
auucugucc

SEQ ID NO: 494117 - RNA, 17 nt, Homo sapiens
auugaaggauugugaac

SEQ ID NO: 494118 - RNA, 20 nt, Homo sapiens
auugauuuuuaaacagcagg

SEQ ID NO: 494119 - RNA, 14 nt, Homo sapiens
auugcuaccaaaaa

SEQ ID NO: 494120 - RNA, 18 nt, Homo sapiens
auuggauuauuacuacaa

SEQ ID NO: 494121 - RNA, 23 nt, Homo sapiens
auugggugccagcauacauuuuc

SEQ ID NO: 494122 - RNA, 16 nt, Homo sapiens
auuguauagccccaca

SEQ ID NO: 494123 - RNA, 16 nt, Homo sapiens
auuguuauagacagcu

SEQ ID NO: 494124 - RNA, 22 nt, Homo sapiens
auuuaaagucuugaauguugaa

SEQ ID NO: 494125 - RNA, 13 nt, Homo sapiens
auuuaacacugag

SEQ ID NO: 494126 - RNA, 15 nt, Homo sapiens
auuuacagucucuuu

SEQ ID NO: 494127 - RNA, 20 nt, Homo sapiens
auuuaccacaggaugcauau

SEQ ID NO: 494128 - RNA, 16 nt, Homo sapiens
auuuacuaacaguaac

SEQ ID NO: 494129 - RNA, 17 nt, Homo sapiens
auuucacgucauaggaa

SEQ ID NO: 494130 - RNA, 13 nt, Homo sapiens
auuucauuaucau

SEQ ID NO: 494131 - RNA, 22 nt, Homo sapiens
auuucauuaucauaugaacuug

SEQ ID NO: 494132 - RNA, 14 nt, Homo sapiens
auuuccaacaccac

SEQ ID NO: 494133 - RNA, 15 nt, Homo sapiens
auuuccaacaccaca

SEQ ID NO: 494134 - RNA, 16 nt, Homo sapiens
auuuccaacaccacag

SEQ ID NO: 494135 - RNA, 11 nt, Homo sapiens
auuuccaugga

SEQ ID NO: 494136 - RNA, 16 nt, Homo sapiens
auuuccuaaggcaugu

SEQ ID NO: 494137 - RNA, 15 nt, Homo sapiens
auuuccuguacaauc

SEQ ID NO: 494138 - RNA, 15 nt, Homo sapiens
auuuccuuaaagcaa

SEQ ID NO: 494139 - RNA, 20 nt, Homo sapiens
auuucggaccgaaggugaca

SEQ ID NO: 494140 - RNA, 19 nt, Homo sapiens
auuucuaacauaaguaaga

SEQ ID NO: 494141 - RNA, 15 nt, Homo sapiens
auuucugaacaaaga

SEQ ID NO: 494142 - RNA, 15 nt, Homo sapiens
auuucuugcaauuug

SEQ ID NO: 494143 - RNA, 18 nt, Homo sapiens
auuugcaacagcaaauua

SEQ ID NO: 494144 - RNA, 15 nt, Homo sapiens
auuugcacagaagag

SEQ ID NO: 494145 - RNA, 13 nt, Homo sapiens
auuugcucauaag

SEQ ID NO: 494146 - RNA, 19 nt, Homo sapiens
auuuguaggaggaugugau

SEQ ID NO: 494147 - RNA, 14 nt, Homo sapiens
auuuuaaguacuuu

SEQ ID NO: 494148 - RNA, 17 nt, Homo sapiens
auuuuaucucuucuucc

SEQ ID NO: 494149 - RNA, 22 nt, Homo sapiens
auuuucauguucuugcagucau

SEQ ID NO: 494150 - RNA, 19 nt, Homo sapiens
auuuucuaauguugacuuu

SEQ ID NO: 494151 - RNA, 22 nt, Homo sapiens
auuuucuaauguugacuuuaau

SEQ ID NO: 494152 - RNA, 13 nt, Homo sapiens
auuuuguaacuuu

SEQ ID NO: 494153 - RNA, 16 nt, Homo sapiens
auuuugucacugcugu

SEQ ID NO: 494154 - RNA, 23 nt, Homo sapiens
auuuugucugcuuaguaucucau

SEQ ID NO: 494155 - RNA, 14 nt, Homo sapiens
auuuuuauuacaac

SEQ ID NO: 494156 - RNA, 18 nt, Homo sapiens
auuuuuugucugugauaa

SEQ ID NO: 494157 - RNA, 16 nt, Homo sapiens
auuuuuuuaagcaaca

SEQ ID NO: 494158 - RNA, 23 nt, Homo sapiens
auuuuuuuucuuccaacauguga

SEQ ID NO: 494159 - RNA, 20 nt, Homo sapiens
caaaaauuauugauugcuuu

SEQ ID NO: 494160 - RNA, 22 nt, Homo sapiens
caaaaauugaagagagauauau

SEQ ID NO: 494161 - RNA, 18 nt, Homo sapiens
caaaagaugccauucaua

SEQ ID NO: 494162 - RNA, 20 nt, Homo sapiens
caaaauaaaaagugacacag

SEQ ID NO: 494163 - RNA, 14 nt, Homo sapiens
caaaaugugugcuu

SEQ ID NO: 494164 - RNA, 22 nt, Homo sapiens
caaagcaucccucuuagucuag

SEQ ID NO: 494165 - RNA, 17 nt, Homo sapiens
accugcuucucugccca

SEQ ID NO: 494166 - RNA, 16 nt, Homo sapiens
accuguaauagccuca

SEQ ID NO: 494167 - RNA, 19 nt, Homo sapiens
accuguaggucuaugaugu

SEQ ID NO: 494168 - RNA, 16 nt, Homo sapiens
accuucgugcaacugu

SEQ ID NO: 494169 - RNA, 23 nt, Homo sapiens
accuucugucguccccagaccag

SEQ ID NO: 494170 - RNA, 12 nt, Homo sapiens
accuugaugaaa

SEQ ID NO: 494171 - RNA, 23 nt, Homo sapiens
accuuuugggaaaugcugauuua

SEQ ID NO: 494172 - RNA, 22 nt, Homo sapiens
acgaaagcugggcaacaugccu

SEQ ID NO: 494173 - RNA, 13 nt, Homo sapiens
acgaaaucuaggu

SEQ ID NO: 494174 - RNA, 16 nt, Homo sapiens
acgcaaauacaugccu

SEQ ID NO: 494175 - RNA, 18 nt, Homo sapiens
acgcugacggaggagcua

SEQ ID NO: 494176 - RNA, 17 nt, Homo sapiens
acgugaucaguguugca

SEQ ID NO: 494177 - RNA, 22 nt, Homo sapiens
acguuacagggaaggaggguag

SEQ ID NO: 494178 - RNA, 16 nt, Homo sapiens
acguuuaacauacaau

SEQ ID NO: 494179 - RNA, 16 nt, Homo sapiens
acuaaugacaagugac

SEQ ID NO: 494180 - RNA, 16 nt, Homo sapiens
acuaaugccucuucau

SEQ ID NO: 494181 - RNA, 16 nt, Homo sapiens
acuaauuaaacugaug

SEQ ID NO: 494182 - RNA, 17 nt, Homo sapiens
acuaccucccacugagg

SEQ ID NO: 494183 - RNA, 18 nt, Homo sapiens
acuagaacacaaauccaa

SEQ ID NO: 494184 - RNA, 22 nt, Homo sapiens
acuagaaccuucuaauccaugu

SEQ ID NO: 494185 - RNA, 13 nt, Homo sapiens
acuaggacacucc

SEQ ID NO: 494186 - RNA, 14 nt, Homo sapiens
acuauggaagccac

SEQ ID NO: 494187 - RNA, 22 nt, Homo sapiens
acuaugguguguuguaucuuug

SEQ ID NO: 494188 - RNA, 20 nt, Homo sapiens
acuauguuuagugugauugu

SEQ ID NO: 494189 - RNA, 13 nt, Homo sapiens
acuauugcugcuu

SEQ ID NO: 494190 - RNA, 18 nt, Homo sapiens
acucacccuuugagcuac

SEQ ID NO: 494191 - RNA, 16 nt, Homo sapiens
acucaugugauuuacc

SEQ ID NO: 494192 - RNA, 19 nt, Homo sapiens
acuccauuggaucugcaag

SEQ ID NO: 494193 - RNA, 15 nt, Homo sapiens
acuccucccugaugu

SEQ ID NO: 494194 - RNA, 18 nt, Homo sapiens
acuccuucaauauuucua

SEQ ID NO: 494195 - RNA, 14 nt, Homo sapiens
acucuaaaacuauc

SEQ ID NO: 494196 - RNA, 18 nt, Homo sapiens
acucugacuguaaaauac

SEQ ID NO: 494197 - RNA, 15 nt, Homo sapiens
acucugaguccucau

SEQ ID NO: 494198 - RNA, 21 nt, Homo sapiens
acucugauguaaaugaaguaa

SEQ ID NO: 494199 - RNA, 16 nt, Homo sapiens
acucuucccucucuca

SEQ ID NO: 494200 - RNA, 17 nt, Homo sapiens
acucuucccucucucac

SEQ ID NO: 494201 - RNA, 21 nt, Homo sapiens
acucuucccucucucacuccc

SEQ ID NO: 494202 - RNA, 17 nt, Homo sapiens
acugaagcagagucaag

SEQ ID NO: 494203 - RNA, 22 nt, Homo sapiens
acugcacaugauuucacaaaua

SEQ ID NO: 494204 - RNA, 18 nt, Homo sapiens
acugccauggaggcacac

SEQ ID NO: 494205 - RNA, 22 nt, Homo sapiens
acugccauggaggcacacagcu

SEQ ID NO: 494206 - RNA, 19 nt, Homo sapiens
acugccuggaaagcccuuc

SEQ ID NO: 494207 - RNA, 14 nt, Homo sapiens
ccaauuucucuuaa

SEQ ID NO: 494208 - RNA, 12 nt, Homo sapiens
ccacaacuccag

SEQ ID NO: 494209 - RNA, 21 nt, Homo sapiens
ccacaauaagccacugguauc

SEQ ID NO: 494210 - RNA, 13 nt, Homo sapiens
ccacacaauggau

SEQ ID NO: 494211 - RNA, 13 nt, Homo sapiens
ccacacacacaaa

SEQ ID NO: 494212 - RNA, 15 nt, Homo sapiens
ccacacguuugccaa

SEQ ID NO: 494213 - RNA, 15 nt, Homo sapiens
ccaccaaaacugcuc

SEQ ID NO: 494214 - RNA, 14 nt, Homo sapiens
ccacccuagcuuua

SEQ ID NO: 494215 - RNA, 16 nt, Homo sapiens
ccaccugccugcaucu

SEQ ID NO: 494216 - RNA, 20 nt, Homo sapiens
ccacugccccugcaccugcu

SEQ ID NO: 494217 - RNA, 13 nt, Homo sapiens
ccacuucacaguu

SEQ ID NO: 494218 - RNA, 13 nt, Homo sapiens
ccagaacucuucc

SEQ ID NO: 494219 - RNA, 15 nt, Homo sapiens
ccagaagcagcagcu

SEQ ID NO: 494220 - RNA, 12 nt, Homo sapiens
ccagaccaguag

SEQ ID NO: 494221 - RNA, 20 nt, Homo sapiens
ccagacuugggagcuuuaaa

SEQ ID NO: 494222 - RNA, 20 nt, Homo sapiens
ccagagcuggaccugagcua

SEQ ID NO: 494223 - RNA, 22 nt, Homo sapiens
ccagauccaggaacacaugcac

SEQ ID NO: 494224 - RNA, 20 nt, Homo sapiens
ccagcaagccgaauagcuga

SEQ ID NO: 494225 - RNA, 16 nt, Homo sapiens
ccagccccugguggug

SEQ ID NO: 494226 - RNA, 19 nt, Homo sapiens
ccagcgagucuggagacca

SEQ ID NO: 494227 - RNA, 18 nt, Homo sapiens
ccaggagcgcagcugcau

SEQ ID NO: 494228 - RNA, 18 nt, Homo sapiens
ccaggcuaauacaggaaa

SEQ ID NO: 494229 - RNA, 13 nt, Homo sapiens
ccaggcuggaacu

SEQ ID NO: 494230 - RNA, 15 nt, Homo sapiens
ccaguagugaccaau

SEQ ID NO: 494231 - RNA, 22 nt, Homo sapiens
ccagucaggcucucugggcuga

SEQ ID NO: 494232 - RNA, 16 nt, Homo sapiens
ccagucauauguucuc

SEQ ID NO: 494233 - RNA, 20 nt, Homo sapiens
ccaguguccccaggggcaca

SEQ ID NO: 494234 - RNA, 13 nt, Homo sapiens
ccaguguuuacaa

SEQ ID NO: 494235 - RNA, 12 nt, Homo sapiens
ccaguuaacugu

SEQ ID NO: 494236 - RNA, 23 nt, Homo sapiens
ccaguuaccacugguguaugaaa

SEQ ID NO: 494237 - RNA, 23 nt, Homo sapiens
ccaguuucagagaaauacuuuca

SEQ ID NO: 494238 - RNA, 13 nt, Homo sapiens
ccauacuucucuc

SEQ ID NO: 494239 - RNA, 13 nt, Homo sapiens
ccaucaugcaaaa

SEQ ID NO: 494240 - RNA, 18 nt, Homo sapiens
ccaucgucucggccuuca

SEQ ID NO: 494241 - RNA, 18 nt, Homo sapiens
ccaugcccucccugcugc

SEQ ID NO: 494242 - RNA, 20 nt, Homo sapiens
ccaugcccucccugcugcca

SEQ ID NO: 494243 - RNA, 14 nt, Homo sapiens
ccauggugaacuga

SEQ ID NO: 494244 - RNA, 20 nt, Homo sapiens
ccauguguauggaagacaaa

SEQ ID NO: 494245 - RNA, 19 nt, Homo sapiens
ccauguucuugagcagcug

SEQ ID NO: 494246 - RNA, 21 nt, Homo sapiens
ccauguuuaaguguacuggau

SEQ ID NO: 494247 - RNA, 17 nt, Homo sapiens
ccauuagcccacugccu

SEQ ID NO: 494248 - RNA, 11 nt, Homo sapiens
ccauugcauca

SEQ ID NO: 494249 - RNA, 21 nt, Homo sapiens
ccauuuauuauuuuguaacuu

SEQ ID NO: 494250 - RNA, 13 nt, Homo sapiens
ccauuuucuuuac

SEQ ID NO: 494251 - RNA, 23 nt, Homo sapiens
cccaaagcacaugcuuagcuuau

SEQ ID NO: 494252 - RNA, 17 nt, Homo sapiens
cccaaaggccaacagca

SEQ ID NO: 494253 - RNA, 18 nt, Homo sapiens
cccaauuaagaaauucca

SEQ ID NO: 494254 - RNA, 23 nt, Homo sapiens
cccagaagcucaaggcugcagug

SEQ ID NO: 494255 - RNA, 21 nt, Homo sapiens
cccagaggcuuccagucucac

SEQ ID NO: 494256 - RNA, 20 nt, Homo sapiens
cccagauccaggaacacaug

SEQ ID NO: 494257 - RNA, 22 nt, Homo sapiens
cccagauccaggaacacaugca

SEQ ID NO: 494258 - RNA, 18 nt, Homo sapiens
cccaggaaggaaacagau

SEQ ID NO: 494259 - RNA, 17 nt, Homo sapiens
cccaggcuaauacagga

SEQ ID NO: 494260 - RNA, 18 nt, Homo sapiens
cccagggugaagccuuca

SEQ ID NO: 494261 - RNA, 20 nt, Homo sapiens
cccaucgucucggccuucac

SEQ ID NO: 494262 - RNA, 22 nt, Homo sapiens
cccaugaccguucucugaggca

SEQ ID NO: 494263 - RNA, 18 nt, Homo sapiens
cccaugguagacugugac

SEQ ID NO: 494264 - RNA, 21 nt, Homo sapiens
ccccagguaucugaugauguu

SEQ ID NO: 494265 - RNA, 15 nt, Homo sapiens
gacgugugaggaugu

SEQ ID NO: 494266 - RNA, 21 nt, Homo sapiens
gacuauauacauguguguaua

SEQ ID NO: 494267 - RNA, 21 nt, Homo sapiens
gacucucacgauaugcaaguu

SEQ ID NO: 494268 - RNA, 22 nt, Homo sapiens
gacugugaaggguguacucccu

SEQ ID NO: 494269 - RNA, 17 nt, Homo sapiens
gacuucauuuuuccuaa

SEQ ID NO: 494270 - RNA, 16 nt, Homo sapiens
gagaacagggaugcua

SEQ ID NO: 494271 - RNA, 17 nt, Homo sapiens
gagaaguacacauuucu

SEQ ID NO: 494272 - RNA, 21 nt, Homo sapiens
gagaaguccagcucuucgccc

SEQ ID NO: 494273 - RNA, 17 nt, Homo sapiens
gagaauuguuaccuuaa

SEQ ID NO: 494274 - RNA, 18 nt, Homo sapiens
gagacaguugguuuugca

SEQ ID NO: 494275 - RNA, 21 nt, Homo sapiens
gagaccaacuacgacuggcau

SEQ ID NO: 494276 - RNA, 13 nt, Homo sapiens
gagacgaugcuuu

SEQ ID NO: 494277 - RNA, 21 nt, Homo sapiens
gagagaacagggaugcuaucu

SEQ ID NO: 494278 - RNA, 22 nt, Homo sapiens
gagagaucuccaacucucucug

SEQ ID NO: 494279 - RNA, 16 nt, Homo sapiens
gagagcaacacaggau

SEQ ID NO: 494280 - RNA, 22 nt, Homo sapiens
gagagguccacuucccuuagaa

SEQ ID NO: 494281 - RNA, 17 nt, Homo sapiens
gagaugaggcuggauag

SEQ ID NO: 494282 - RNA, 17 nt, Homo sapiens
gagauuuaccagggaug

SEQ ID NO: 494283 - RNA, 13 nt, Homo sapiens
gagcaaaagccuc

SEQ ID NO: 494284 - RNA, 22 nt, Homo sapiens
gagcagccucuugaaugcuuaa

SEQ ID NO: 494285 - RNA, 20 nt, Homo sapiens
gagcaugaagauaaauccaa

SEQ ID NO: 494286 - RNA, 20 nt, Homo sapiens
gagcauuugguacacacuug

SEQ ID NO: 494287 - RNA, 21 nt, Homo sapiens
gagcauuugguacacacuuga

SEQ ID NO: 494288 - RNA, 19 nt, Homo sapiens
gagccauucuggcacuuua

SEQ ID NO: 494289 - RNA, 13 nt, Homo sapiens
gagcccuugccca

SEQ ID NO: 494290 - RNA, 12 nt, Homo sapiens
gagccuuuucaa

SEQ ID NO: 494291 - RNA, 22 nt, Homo sapiens
gagcuacagaacacuuugcuag

SEQ ID NO: 494292 - RNA, 14 nt, Homo sapiens
gagcuggaccugag

SEQ ID NO: 494293 - RNA, 13 nt, Homo sapiens
gagcuuucugaua

SEQ ID NO: 494294 - RNA, 12 nt, Homo sapiens
gaggaucacuug

SEQ ID NO: 494295 - RNA, 13 nt, Homo sapiens
gaggcacacagcu

SEQ ID NO: 494296 - RNA, 20 nt, Homo sapiens
gaggcagagguugcagugag

SEQ ID NO: 494297 - RNA, 20 nt, Homo sapiens
gaggcaggagaaucgcuuga

SEQ ID NO: 494298 - RNA, 22 nt, Homo sapiens
gagguauuugguaacuugcugu

SEQ ID NO: 494299 - RNA, 15 nt, Homo sapiens
gagguccacuucccu

SEQ ID NO: 494300 - RNA, 19 nt, Homo sapiens
gagguuguuuuaaagucag

SEQ ID NO: 494301 - RNA, 23 nt, Homo sapiens
gaguauggauugaaggauuguga

SEQ ID NO: 494302 - RNA, 22 nt, Homo sapiens
gaguauggugcuggguccuuaa

SEQ ID NO: 494303 - RNA, 15 nt, Homo sapiens
gaguggacgucagaa

SEQ ID NO: 494304 - RNA, 22 nt, Homo sapiens
gaguuuagcuguaacaguucuu

SEQ ID NO: 494305 - RNA, 20 nt, Homo sapiens
gaguuuccagcuaagccuga

SEQ ID NO: 494306 - RNA, 16 nt, Homo sapiens
gaguuuucugugcaaa

SEQ ID NO: 494307 - RNA, 14 nt, Homo sapiens
gauaacugcauaaa

SEQ ID NO: 494308 - RNA, 16 nt, Homo sapiens
gauaucaggaaauauc

SEQ ID NO: 494309 - RNA, 22 nt, Homo sapiens
gauaucaggaaauaucugugaa

SEQ ID NO: 494310 - RNA, 20 nt, Homo sapiens
gauauccaacagaaagcaua

SEQ ID NO: 494311 - RNA, 11 nt, Homo sapiens
gauauggcaug

SEQ ID NO: 494312 - RNA, 18 nt, Homo sapiens
gauauguuuucacuguau

SEQ ID NO: 494313 - RNA, 21 nt, Homo sapiens
gaucaaaauaaaaagugacac

SEQ ID NO: 494314 - RNA, 15 nt, Homo sapiens
gaucaacucauguua

SEQ ID NO: 494315 - RNA, 14 nt, Homo sapiens
gaucaagcuccauc

SEQ ID NO: 494316 - RNA, 17 nt, Homo sapiens
gauccaccugcacaaac

SEQ ID NO: 494317 - RNA, 18 nt, Homo sapiens
gauccaccugcacaaaca

SEQ ID NO: 494318 - RNA, 13 nt, Homo sapiens
gauccuugcacag

SEQ ID NO: 494319 - RNA, 15 nt, Homo sapiens
gaucguuucuuccag

SEQ ID NO: 494320 - RNA, 20 nt, Homo sapiens
gaucucaauuugcaguauuc

SEQ ID NO: 494321 - RNA, 19 nt, Homo sapiens
gaugaaaaccacccuauca

SEQ ID NO: 494322 - RNA, 14 nt, Homo sapiens
gaugaggcuggaua

SEQ ID NO: 494323 - RNA, 18 nt, Homo sapiens
gaugauccuugcacagac

SEQ ID NO: 494324 - RNA, 22 nt, Homo sapiens
gaugcuaucucgcuagccauau

SEQ ID NO: 494325 - RNA, 18 nt, Homo sapiens
gaugcuuggcuggaguca

SEQ ID NO: 494326 - RNA, 20 nt, Homo sapiens
gaugcuuggcuggagucacc

SEQ ID NO: 494327 - RNA, 18 nt, Homo sapiens
gauggcuacugugccuug

SEQ ID NO: 494328 - RNA, 19 nt, Homo sapiens
gauguaccaggcucucgca

SEQ ID NO: 494329 - RNA, 18 nt, Homo sapiens
gauguccccaaaguacca

SEQ ID NO: 494330 - RNA, 16 nt, Homo sapiens
gaugugccuagacacg

SEQ ID NO: 494331 - RNA, 21 nt, Homo sapiens
gauguggauggaggugaugaa

SEQ ID NO: 494332 - RNA, 19 nt, Homo sapiens
gauguggugggagcacagc

SEQ ID NO: 494333 - RNA, 22 nt, Homo sapiens
ggcugcagagccugcaggguga

SEQ ID NO: 494334 - RNA, 20 nt, Homo sapiens
ggcugccgugcacggggcca

SEQ ID NO: 494335 - RNA, 22 nt, Homo sapiens
ggcugccgugcacggggccagc

SEQ ID NO: 494336 - RNA, 13 nt, Homo sapiens
ggcugcugcacug

SEQ ID NO: 494337 - RNA, 16 nt, Homo sapiens
ggcugcugcacugccc

SEQ ID NO: 494338 - RNA, 18 nt, Homo sapiens
ggcuggucuuggugaaca

SEQ ID NO: 494339 - RNA, 20 nt, Homo sapiens
ggcugucagucguguugcuu

SEQ ID NO: 494340 - RNA, 13 nt, Homo sapiens
ggcuucagccagu

SEQ ID NO: 494341 - RNA, 14 nt, Homo sapiens
ggcuucccaugucu

SEQ ID NO: 494342 - RNA, 14 nt, Homo sapiens
ggcuuccugugcua

SEQ ID NO: 494343 - RNA, 21 nt, Homo sapiens
gggaaugagaguuccuucuca

SEQ ID NO: 494344 - RNA, 11 nt, Homo sapiens
gggacauucca

SEQ ID NO: 494345 - RNA, 14 nt, Homo sapiens
gggacggguggugg

SEQ ID NO: 494346 - RNA, 23 nt, Homo sapiens
gggaggguggugggcccagacca

SEQ ID NO: 494347 - RNA, 14 nt, Homo sapiens
gggagucagggagc

SEQ ID NO: 494348 - RNA, 21 nt, Homo sapiens
gggcagagcacagcgggguga

SEQ ID NO: 494349 - RNA, 20 nt, Homo sapiens
gggcugacugggccagggga

SEQ ID NO: 494350 - RNA, 12 nt, Homo sapiens
ggggacaucuca

SEQ ID NO: 494351 - RNA, 12 nt, Homo sapiens
ggggacauucca

SEQ ID NO: 494352 - RNA, 12 nt, Homo sapiens
ggggcagcacag

SEQ ID NO: 494353 - RNA, 14 nt, Homo sapiens
ggguuauucagaac

SEQ ID NO: 494354 - RNA, 20 nt, Homo sapiens
gguaaaccgaggacccauga

SEQ ID NO: 494355 - RNA, 14 nt, Homo sapiens
gguagacugugaca

SEQ ID NO: 494356 - RNA, 18 nt, Homo sapiens
ggucagaagagaggguga

SEQ ID NO: 494357 - RNA, 18 nt, Homo sapiens
ggucccgaauggagucca

SEQ ID NO: 494358 - RNA, 21 nt, Homo sapiens
ggucccgaauggaguccagac

SEQ ID NO: 494359 - RNA, 21 nt, Homo sapiens
ggucuuaggaugucuguaaua

SEQ ID NO: 494360 - RNA, 20 nt, Homo sapiens
ggucuuucugaauugcacau

SEQ ID NO: 494361 - RNA, 17 nt, Homo sapiens
ggugaaaauccaucuca

SEQ ID NO: 494362 - RNA, 17 nt, Homo sapiens
ggugaacugaagcagag

SEQ ID NO: 494363 - RNA, 18 nt, Homo sapiens
ggugaaggcccagccugu

SEQ ID NO: 494364 - RNA, 18 nt, Homo sapiens
ggugacuuuccuaugaca

SEQ ID NO: 494365 - RNA, 17 nt, Homo sapiens
ggugcuaauccaggaca

SEQ ID NO: 494366 - RNA, 14 nt, Homo sapiens
gguucccccaggac

SEQ ID NO: 494367 - RNA, 15 nt, Homo sapiens
gguuccggaauccug

SEQ ID NO: 494368 - RNA, 14 nt, Homo sapiens
gguuuaaaagucac

SEQ ID NO: 494369 - RNA, 13 nt, Homo sapiens
guaaaauacuucu

SEQ ID NO: 494370 - RNA, 15 nt, Homo sapiens
guaaaccugaacaaa

SEQ ID NO: 494371 - RNA, 17 nt, Homo sapiens
guaaaugaaguaacuug

SEQ ID NO: 494372 - RNA, 14 nt, Homo sapiens
guaaaugucuucau

SEQ ID NO: 494373 - RNA, 23 nt, Homo sapiens
guaaguacucuaauauacagugu

SEQ ID NO: 494374 - RNA, 14 nt, Homo sapiens
guaaguuacugaca

SEQ ID NO: 494375 - RNA, 13 nt, Homo sapiens
guaauauaaugga

SEQ ID NO: 494376 - RNA, 14 nt, Homo sapiens
guacaaaagggaca

SEQ ID NO: 494377 - RNA, 18 nt, Homo sapiens
guacaaaugugugacugc

SEQ ID NO: 494378 - RNA, 12 nt, Homo sapiens
guacacauuucu

SEQ ID NO: 494379 - RNA, 17 nt, Homo sapiens
guacuaaacauuuccuu

SEQ ID NO: 494380 - RNA, 21 nt, Homo sapiens
guacuggagagcaacacagga

SEQ ID NO: 494381 - RNA, 20 nt, Homo sapiens
guagaucaacucauguuaau

SEQ ID NO: 494382 - RNA, 17 nt, Homo sapiens
guaguagcucgugugcu

SEQ ID NO: 494383 - RNA, 24 nt, Homo sapiens
guagugaccaaucgggaguagcaa

SEQ ID NO: 494384 - RNA, 15 nt, Homo sapiens
guauauauacauaca

SEQ ID NO: 494385 - RNA, 19 nt, Homo sapiens
guaucaugcuucuacucca

SEQ ID NO: 494386 - RNA, 11 nt, Homo sapiens
guauggugcug

SEQ ID NO: 494387 - RNA, 13 nt, Homo sapiens
guauuugggauau

SEQ ID NO: 494388 - RNA, 18 nt, Homo sapiens
guauuuuuccucuuucac

SEQ ID NO: 494389 - RNA, 20 nt, Homo sapiens
gucaaucccaaaagucacca

SEQ ID NO: 494390 - RNA, 18 nt, Homo sapiens
gucaaugagauuuugccc

SEQ ID NO: 494391 - RNA, 19 nt, Homo sapiens
gucagaagaagacagcaaa

SEQ ID NO: 494392 - RNA, 19 nt, Homo sapiens
gucagcagggccacugagu

SEQ ID NO: 494393 - RNA, 17 nt, Homo sapiens
gucaguucuaaccuccu

SEQ ID NO: 494394 - RNA, 14 nt, Homo sapiens
guccagaccugggc

SEQ ID NO: 494395 - RNA, 17 nt, Homo sapiens
gucccaguacaaaaagg

SEQ ID NO: 494396 - RNA, 21 nt, Homo sapiens
gucccugagaagccucauggg

SEQ ID NO: 494397 - RNA, 18 nt, Homo sapiens
guccuccugcugccagua

SEQ ID NO: 494398 - RNA, 21 nt, Homo sapiens
uacaacacauugaaacuguau

SEQ ID NO: 494399 - RNA, 23 nt, Homo sapiens
uacaaguagguuuacauuacuga

SEQ ID NO: 494400 - RNA, 16 nt, Homo sapiens
uacacaauucaguuaa

SEQ ID NO: 494401 - RNA, 15 nt, Homo sapiens
uacacugucaaacau

SEQ ID NO: 494402 - RNA, 23 nt, Homo sapiens
uacacuuuauuaauauaaccaua

SEQ ID NO: 494403 - RNA, 14 nt, Homo sapiens
uacaggucaucugc

SEQ ID NO: 494404 - RNA, 19 nt, Homo sapiens
uacagucucuuucuuccuu

SEQ ID NO: 494405 - RNA, 20 nt, Homo sapiens
uacaguugggaaaauauguc

SEQ ID NO: 494406 - RNA, 15 nt, Homo sapiens
uacauauguagacua

SEQ ID NO: 494407 - RNA, 22 nt, Homo sapiens
uaccacacugaguucuaucagu

SEQ ID NO: 494408 - RNA, 22 nt, Homo sapiens
uaccauaagcuuuuucucugaa

SEQ ID NO: 494409 - RNA, 17 nt, Homo sapiens
uacccagccuaccagag

SEQ ID NO: 494410 - RNA, 20 nt, Homo sapiens
uaccuaaguggauauagaua

SEQ ID NO: 494411 - RNA, 22 nt, Homo sapiens
uaccuagauuuuaaauagacaa

SEQ ID NO: 494412 - RNA, 22 nt, Homo sapiens
uaccuauaauguguguaugugu

SEQ ID NO: 494413 - RNA, 23 nt, Homo sapiens
uaccuaugugugugcuuugccac

SEQ ID NO: 494414 - RNA, 15 nt, Homo sapiens
uaccugaaaauucaa

SEQ ID NO: 494415 - RNA, 19 nt, Homo sapiens
uaccuguacacacacagac

SEQ ID NO: 494416 - RNA, 21 nt, Homo sapiens
uacgaauugaaaauuaaggaa

SEQ ID NO: 494417 - RNA, 13 nt, Homo sapiens
uacucaaguuuca

SEQ ID NO: 494418 - RNA, 18 nt, Homo sapiens
uacuccuuaaaaauguau

SEQ ID NO: 494419 - RNA, 14 nt, Homo sapiens
uacuggacuguaaa

SEQ ID NO: 494420 - RNA, 13 nt, Homo sapiens
uacuuacacccaa

SEQ ID NO: 494421 - RNA, 21 nt, Homo sapiens
uacuucuguguugugauuccc

SEQ ID NO: 494422 - RNA, 17 nt, Homo sapiens
uacuuuguccuaagaga

SEQ ID NO: 494423 - RNA, 19 nt, Homo sapiens
uagaaaucacaagaacaaa

SEQ ID NO: 494424 - RNA, 22 nt, Homo sapiens
uagaacacuguuaggguacaua

SEQ ID NO: 494425 - RNA, 18 nt, Homo sapiens
uagaauaacaacugcugg

SEQ ID NO: 494426 - RNA, 21 nt, Homo sapiens
uagagguagguaggaucaucc

SEQ ID NO: 494427 - RNA, 22 nt, Homo sapiens
uagaguuuuuauuaauuacuua

SEQ ID NO: 494428 - RNA, 15 nt, Homo sapiens
uagauaacugcauaa

SEQ ID NO: 494429 - RNA, 23 nt, Homo sapiens
uagccuuuaucuaccaacuuuca

SEQ ID NO: 494430 - RNA, 14 nt, Homo sapiens
uagcugaauugagc

SEQ ID NO: 494431 - RNA, 16 nt, Homo sapiens
uagcuuacugauuaac

SEQ ID NO: 494432 - RNA, 20 nt, Homo sapiens
uagcuugcacaacauccuca

SEQ ID NO: 494433 - RNA, 14 nt, Homo sapiens
uagcuuuuauucau

SEQ ID NO: 494434 - RNA, 12 nt, Homo sapiens
uaggaguacaag

SEQ ID NO: 494435 - RNA, 18 nt, Homo sapiens
uaggcuuguguaauuucc

SEQ ID NO: 494436 - RNA, 16 nt, Homo sapiens
uaggggagagaucucc

SEQ ID NO: 494437 - RNA, 23 nt, Homo sapiens
uagguccuuguuguuucuugccu

SEQ ID NO: 494438 - RNA, 19 nt, Homo sapiens
uagucuuaacuggucuccu

SEQ ID NO: 494439 - RNA, 18 nt, Homo sapiens
uaguuaaauuggcuuguu

SEQ ID NO: 494440 - RNA, 20 nt, Homo sapiens
uaguucccuuugccaacaga

SEQ ID NO: 494441 - RNA, 15 nt, Homo sapiens
uauaauuucuguuca

SEQ ID NO: 494442 - RNA, 20 nt, Homo sapiens
uauaauuuuauugcuggaau

SEQ ID NO: 494443 - RNA, 17 nt, Homo sapiens
uauacauguguguauau

SEQ ID NO: 494444 - RNA, 23 nt, Homo sapiens
uauacauguguguauauaugugu

SEQ ID NO: 494445 - RNA, 19 nt, Homo sapiens
uauagauaacugcauaaau

SEQ ID NO: 494446 - RNA, 22 nt, Homo sapiens
uauauauacauacacuuguaua

SEQ ID NO: 494447 - RNA, 17 nt, Homo sapiens
uauauaugaaaacuaag

SEQ ID NO: 494448 - RNA, 16 nt, Homo sapiens
uauauauguguauaua

SEQ ID NO: 494449 - RNA, 17 nt, Homo sapiens
uauaucuguacagauca

SEQ ID NO: 494450 - RNA, 12 nt, Homo sapiens
uauaucuugucu

SEQ ID NO: 494451 - RNA, 16 nt, Homo sapiens
uauauguacagcucuc

SEQ ID NO: 494452 - RNA, 20 nt, Homo sapiens
uauauguguauauauacaua

SEQ ID NO: 494453 - RNA, 13 nt, Homo sapiens
uauauuuaccaag

SEQ ID NO: 494454 - RNA, 13 nt, Homo sapiens
uauauuugcauaa

SEQ ID NO: 494455 - RNA, 22 nt, Homo sapiens
uauauuugcauaauaugcauau

SEQ ID NO: 494456 - RNA, 23 nt, Homo sapiens
uaucaguuacaguggcaguauug

SEQ ID NO: 494457 - RNA, 14 nt, Homo sapiens
uaucauaugaacuu

SEQ ID NO: 494458 - RNA, 22 nt, Homo sapiens
uaucauguguuucuguguagua

SEQ ID NO: 494459 - RNA, 22 nt, Homo sapiens
uaucauuaaccuuaucauaaau

SEQ ID NO: 494460 - RNA, 14 nt, Homo sapiens
uauccuauguuaaa

SEQ ID NO: 494461 - RNA, 19 nt, Homo sapiens
uauccugugcuaugcugga

SEQ ID NO: 494462 - RNA, 15 nt, Homo sapiens
uauccuuuugcuaca

SEQ ID NO: 494463 - RNA, 14 nt, Homo sapiens
uaucuaaucagauc

SEQ ID NO: 494464 - RNA, 15 nt, Homo sapiens
uaucucccacaaaua

SEQ ID NO: 494465 - RNA, 16 nt, Homo sapiens
uaucugagaguuccag

SEQ ID NO: 494466 - RNA, 16 nt, Homo sapiens
uaugcuuauaaguuug

SEQ ID NO: 494467 - RNA, 16 nt, Homo sapiens
uauggggacauuccaa

SEQ ID NO: 494468 - RNA, 23 nt, Homo sapiens
uauguccauaucuaaccagugau

SEQ ID NO: 494469 - RNA, 15 nt, Homo sapiens
uauguuuacacuguc

SEQ ID NO: 494470 - RNA, 20 nt, Homo sapiens
uauguuuagugugauuguga

SEQ ID NO: 494471 - RNA, 14 nt, Homo sapiens
uauguuuauacaca

SEQ ID NO: 494472 - RNA, 17 nt, Homo sapiens
uauguuuauacacacag

SEQ ID NO: 494473 - RNA, 16 nt, Homo sapiens
uauuaaguauuuugcu

SEQ ID NO: 494474 - RNA, 18 nt, Homo sapiens
uauuaauauaaccauaaa

SEQ ID NO: 494475 - RNA, 22 nt, Homo sapiens
uauuauauuuggaugcagaguu

SEQ ID NO: 494476 - RNA, 15 nt, Homo sapiens
aucuuggcaggggug

SEQ ID NO: 494477 - RNA, 20 nt, Homo sapiens
augaaaaccacccuaucauc

SEQ ID NO: 494478 - RNA, 19 nt, Homo sapiens
augaaaauaagugaauaau

SEQ ID NO: 494479 - RNA, 14 nt, Homo sapiens
augaaacagcagcu

SEQ ID NO: 494480 - RNA, 16 nt, Homo sapiens
augaaacagcagcuga

SEQ ID NO: 494481 - RNA, 16 nt, Homo sapiens
augaaauacuugacaa

SEQ ID NO: 494482 - RNA, 20 nt, Homo sapiens
augaaaugcuaugucauuuc

SEQ ID NO: 494483 - RNA, 17 nt, Homo sapiens
augaacuguuucaguag

SEQ ID NO: 494484 - RNA, 16 nt, Homo sapiens
augaaguaacuugucu

SEQ ID NO: 494485 - RNA, 22 nt, Homo sapiens
augaccccuccccuaaugccug

SEQ ID NO: 494486 - RNA, 19 nt, Homo sapiens
augacuuuuauaacauuuu

SEQ ID NO: 494487 - RNA, 16 nt, Homo sapiens
augagaguuccuucuc

SEQ ID NO: 494488 - RNA, 15 nt, Homo sapiens
augauaaauuugacu

SEQ ID NO: 494489 - RNA, 20 nt, Homo sapiens
augauaaauuugacuguuau

SEQ ID NO: 494490 - RNA, 19 nt, Homo sapiens
augcaaaaggguaagauga

SEQ ID NO: 494491 - RNA, 19 nt, Homo sapiens
augcacccgcauguacaaa

SEQ ID NO: 494492 - RNA, 16 nt, Homo sapiens
augcaccucauuccag

SEQ ID NO: 494493 - RNA, 15 nt, Homo sapiens
augcagagagggcau

SEQ ID NO: 494494 - RNA, 18 nt, Homo sapiens
augcaucacuauucagaa

SEQ ID NO: 494495 - RNA, 10 nt, Homo sapiens
augcccuccc

SEQ ID NO: 494496 - RNA, 17 nt, Homo sapiens
augcccuucacugucac

SEQ ID NO: 494497 - RNA, 14 nt, Homo sapiens
augcuaugucauuu

SEQ ID NO: 494498 - RNA, 20 nt, Homo sapiens
augcugaaauccgggucaag

SEQ ID NO: 494499 - RNA, 14 nt, Homo sapiens
augcuuaaaugauc

SEQ ID NO: 494500 - RNA, 15 nt, Homo sapiens
augcuugacccugaa

SEQ ID NO: 494501 - RNA, 14 nt, Homo sapiens
auggaaauccacaa

SEQ ID NO: 494502 - RNA, 16 nt, Homo sapiens
auggaagggccuucuc

SEQ ID NO: 494503 - RNA, 16 nt, Homo sapiens
auggaauaucagaagu

SEQ ID NO: 494504 - RNA, 14 nt, Homo sapiens
auggaggcacacag

SEQ ID NO: 494505 - RNA, 21 nt, Homo sapiens
auggauauguuuucacuguau

SEQ ID NO: 494506 - RNA, 21 nt, Homo sapiens
auggauuucuaggccugauau

SEQ ID NO: 494507 - RNA, 21 nt, Homo sapiens
auggcacauaccaaagcugcu

SEQ ID NO: 494508 - RNA, 14 nt, Homo sapiens
auggcauccaagac

SEQ ID NO: 494509 - RNA, 22 nt, Homo sapiens
auggccauagcuuuuauucauu

SEQ ID NO: 494510 - RNA, 21 nt, Homo sapiens
auggcccccagaggcuuccag

SEQ ID NO: 494511 - RNA, 14 nt, Homo sapiens
auggggacauucca

SEQ ID NO: 494512 - RNA, 16 nt, Homo sapiens
auggggacauuccaau

SEQ ID NO: 494513 - RNA, 18 nt, Homo sapiens
augguaccuccuaggagu

SEQ ID NO: 494514 - RNA, 15 nt, Homo sapiens
auggugaacugucau

SEQ ID NO: 494515 - RNA, 14 nt, Homo sapiens
auguaacaguuuaa

SEQ ID NO: 494516 - RNA, 15 nt, Homo sapiens
auguaacuuguugca

SEQ ID NO: 494517 - RNA, 15 nt, Homo sapiens
auguacaaaaacaca

SEQ ID NO: 494518 - RNA, 21 nt, Homo sapiens
auguauacgcacgcacccaca

SEQ ID NO: 494519 - RNA, 17 nt, Homo sapiens
agaaauacuuucaggca

SEQ ID NO: 494520 - RNA, 24 nt, Homo sapiens
agaaauaugagcaugcucccucau

SEQ ID NO: 494521 - RNA, 21 nt, Homo sapiens
agaaauuccauacuucucuca

SEQ ID NO: 494522 - RNA, 18 nt, Homo sapiens
agaagaaagaacuaucuu

SEQ ID NO: 494523 - RNA, 20 nt, Homo sapiens
agaagagaugcacuauaugu

SEQ ID NO: 494524 - RNA, 13 nt, Homo sapiens
agaagcagcagcu

SEQ ID NO: 494525 - RNA, 20 nt, Homo sapiens
agaagccuaaaaaaagcuaa

SEQ ID NO: 494526 - RNA, 22 nt, Homo sapiens
agaagggugguaaauauuuuca

SEQ ID NO: 494527 - RNA, 20 nt, Homo sapiens
agaaguacaggucaucugcu

SEQ ID NO: 494528 - RNA, 15 nt, Homo sapiens
agaaguccagcucuu

SEQ ID NO: 494529 - RNA, 20 nt, Homo sapiens
agaauaaagccuugugauca

SEQ ID NO: 494530 - RNA, 15 nt, Homo sapiens
agaaucaagucugug

SEQ ID NO: 494531 - RNA, 16 nt, Homo sapiens
agacaaauacacauac

SEQ ID NO: 494532 - RNA, 16 nt, Homo sapiens
agacaaugcuuuccau

SEQ ID NO: 494533 - RNA, 14 nt, Homo sapiens
agacacacacacac

SEQ ID NO: 494534 - RNA, 14 nt, Homo sapiens
agacaccuagacuc

SEQ ID NO: 494535 - RNA, 15 nt, Homo sapiens
agacacugugcuaua

SEQ ID NO: 494536 - RNA, 21 nt, Homo sapiens
agacagacgccugcuuuugca

SEQ ID NO: 494537 - RNA, 16 nt, Homo sapiens
agacaucuagucucag

SEQ ID NO: 494538 - RNA, 16 nt, Homo sapiens
agacauugacaagcac

SEQ ID NO: 494539 - RNA, 20 nt, Homo sapiens
agaccaagacuuuugucuga

SEQ ID NO: 494540 - RNA, 16 nt, Homo sapiens
agaccaguagugacca

SEQ ID NO: 494541 - RNA, 13 nt, Homo sapiens
agaccucaagaaa

SEQ ID NO: 494542 - RNA, 20 nt, Homo sapiens
agaccucaagaaaaauucac

SEQ ID NO: 494543 - RNA, 17 nt, Homo sapiens
agaccuguucuuuccau

SEQ ID NO: 494544 - RNA, 15 nt, Homo sapiens
agacgcagauuucag

SEQ ID NO: 494545 - RNA, 19 nt, Homo sapiens
agacgccugcuuuugcaaa

SEQ ID NO: 494546 - RNA, 21 nt, Homo sapiens
agagaaaaaaaauuaagacaa

SEQ ID NO: 494547 - RNA, 18 nt, Homo sapiens
agagaagaccucugugag

SEQ ID NO: 494548 - RNA, 16 nt, Homo sapiens
agagacccccgugcca

SEQ ID NO: 494549 - RNA, 19 nt, Homo sapiens
agagacuuuguaaaaaaga

SEQ ID NO: 494550 - RNA, 17 nt, Homo sapiens
agagagauauaucugaa

SEQ ID NO: 494551 - RNA, 15 nt, Homo sapiens
agagaguauggugcu

SEQ ID NO: 494552 - RNA, 12 nt, Homo sapiens
agagaucuccaa

SEQ ID NO: 494553 - RNA, 22 nt, Homo sapiens
agagcauuugguacacacuuga

SEQ ID NO: 494554 - RNA, 22 nt, Homo sapiens
agagccugcagggugaccugcu

SEQ ID NO: 494555 - RNA, 17 nt, Homo sapiens
agaggaagagugcaaaa

SEQ ID NO: 494556 - RNA, 16 nt, Homo sapiens
agaggggcggggccag

SEQ ID NO: 494557 - RNA, 21 nt, Homo sapiens
agagggugccuggacucagca

SEQ ID NO: 494558 - RNA, 20 nt, Homo sapiens
agaguaagacucugucucaa

SEQ ID NO: 494559 - RNA, 13 nt, Homo sapiens
agaguauggauug

SEQ ID NO: 494560 - RNA, 22 nt, Homo sapiens
agaguuauuuuguguccuuuaa

SEQ ID NO: 494561 - RNA, 18 nt, Homo sapiens
agaguucuauuagaagcu

SEQ ID NO: 494562 - RNA, 12 nt, Homo sapiens
agauaaauccaa

SEQ ID NO: 494563 - RNA, 19 nt, Homo sapiens
agauaccuuaaaauuugaa

SEQ ID NO: 494564 - RNA, 12 nt, Homo sapiens
agauccaggaac

SEQ ID NO: 494565 - RNA, 18 nt, Homo sapiens
agaugauccuugcacaga

SEQ ID NO: 494566 - RNA, 18 nt, Homo sapiens
agaugggaggaucacuug

SEQ ID NO: 494567 - RNA, 21 nt, Homo sapiens
agaugggaggaucacuugagg

SEQ ID NO: 494568 - RNA, 15 nt, Homo sapiens
agaugugccuagaca

SEQ ID NO: 494569 - RNA, 16 nt, Homo sapiens
agaugugccuagacac

SEQ ID NO: 494570 - RNA, 17 nt, Homo sapiens
agauguggacaugcacc

SEQ ID NO: 494571 - RNA, 11 nt, Homo sapiens
agauucacuuc

SEQ ID NO: 494572 - RNA, 17 nt, Homo sapiens
agauucccagcuuccag

SEQ ID NO: 494573 - RNA, 20 nt, Homo sapiens
agauugaagcuaaaacacuu

SEQ ID NO: 494574 - RNA, 18 nt, Homo sapiens
agauugcuucaugagcua

SEQ ID NO: 494575 - RNA, 20 nt, Homo sapiens
agauuuucauguucuugcag

SEQ ID NO: 494576 - RNA, 23 nt, Homo sapiens
agauuuucauguucuugcaguca

SEQ ID NO: 494577 - RNA, 21 nt, Homo sapiens
agcaaacccugucaaacauua

SEQ ID NO: 494578 - RNA, 18 nt, Homo sapiens
agcacaacugauaauauu

SEQ ID NO: 494579 - RNA, 13 nt, Homo sapiens
agcacagccucac

SEQ ID NO: 494580 - RNA, 17 nt, Homo sapiens
agcaccacgugccaagg

SEQ ID NO: 494581 - RNA, 19 nt, Homo sapiens
agcacccagguuuugcacu

SEQ ID NO: 494582 - RNA, 22 nt, Homo sapiens
agcacuuuguuucauauucuca

SEQ ID NO: 494583 - RNA, 21 nt, Homo sapiens
agcagaggaaaauaguggcag

SEQ ID NO: 494584 - RNA, 15 nt, Homo sapiens
agcagcugaagccag

SEQ ID NO: 494585 - RNA, 19 nt, Homo sapiens
agcaguuggccaagcagaa

SEQ ID NO: 494586 - RNA, 19 nt, Homo sapiens
agcaugaagauaaauccaa

SEQ ID NO: 494587 - RNA, 12 nt, Homo sapiens
agcauguucuca

SEQ ID NO: 494588 - RNA, 13 nt, Homo sapiens
agcauugccagua

SEQ ID NO: 494589 - RNA, 18 nt, Homo sapiens
agcauuuccaacaccaca

SEQ ID NO: 494590 - RNA, 19 nt, Homo sapiens
agcauuugguacacacuug

SEQ ID NO: 494591 - RNA, 21 nt, Homo sapiens
agcauuugguacacacuugac

SEQ ID NO: 494592 - RNA, 16 nt, Homo sapiens
agccaaauaaaaucua

SEQ ID NO: 494593 - RNA, 17 nt, Homo sapiens
agccacaauaagccacu

SEQ ID NO: 494594 - RNA, 19 nt, Homo sapiens
agccacuuauuuccaugga

SEQ ID NO: 494595 - RNA, 17 nt, Homo sapiens
agccauauuaaguauuu

SEQ ID NO: 494596 - RNA, 19 nt, Homo sapiens
agcccacugccuggaaagc

SEQ ID NO: 494597 - RNA, 14 nt, Homo sapiens
agcccccucuuccu

SEQ ID NO: 494598 - RNA, 17 nt, Homo sapiens
agcccugggguuuccac

SEQ ID NO: 494599 - RNA, 18 nt, Homo sapiens
agccugcagggugaccug

SEQ ID NO: 494600 - RNA, 14 nt, Homo sapiens
agccuggcaacaca

SEQ ID NO: 494601 - RNA, 14 nt, Homo sapiens
agccuuaacauaua

SEQ ID NO: 494602 - RNA, 15 nt, Homo sapiens
agcuaagccugauga

SEQ ID NO: 494603 - RNA, 21 nt, Homo sapiens
agcuaaugguucauauaugca

SEQ ID NO: 494604 - RNA, 21 nt, Homo sapiens
agcuauuuaaguggacuguau

SEQ ID NO: 494605 - RNA, 20 nt, Homo sapiens
agcuccuccuugucuuggca

SEQ ID NO: 494606 - RNA, 18 nt, Homo sapiens
agcuccugcucauugugg

SEQ ID NO: 494607 - RNA, 22 nt, Homo sapiens
agcuccuggccaggauaauaua

SEQ ID NO: 494608 - RNA, 21 nt, Homo sapiens
agcucuggcccuuugaauaug

SEQ ID NO: 494609 - RNA, 16 nt, Homo sapiens
agcugaauugagcuag

SEQ ID NO: 494610 - RNA, 15 nt, Homo sapiens
agcuuaaacauugcc

SEQ ID NO: 494611 - RNA, 13 nt, Homo sapiens
agcuuacugauua

SEQ ID NO: 494612 - RNA, 19 nt, Homo sapiens
agcuuaucuuucuuuccau

SEQ ID NO: 494613 - RNA, 14 nt, Homo sapiens
agcuucaccagagc

SEQ ID NO: 494614 - RNA, 20 nt, Homo sapiens
agcuucacugucaugugcga

SEQ ID NO: 494615 - RNA, 21 nt, Homo sapiens
agcuucuuaauauaacugccu

SEQ ID NO: 494616 - RNA, 22 nt, Homo sapiens
agcuucuuaauauaacugccuu

SEQ ID NO: 494617 - RNA, 22 nt, Homo sapiens
agcuuuuacaggggauuaugau

SEQ ID NO: 494618 - RNA, 15 nt, Homo sapiens
aggaaaaggcuugag

SEQ ID NO: 494619 - RNA, 20 nt, Homo sapiens
aggaaaauauugacaaguuu

SEQ ID NO: 494620 - RNA, 21 nt, Homo sapiens
aggaaagccucacugauauau

SEQ ID NO: 494621 - RNA, 19 nt, Homo sapiens
aggaacacucugaauucca

SEQ ID NO: 494622 - RNA, 20 nt, Homo sapiens
aggaacacucugaauuccaa

SEQ ID NO: 494623 - RNA, 13 nt, Homo sapiens
aggaacaugaccc

SEQ ID NO: 494624 - RNA, 17 nt, Homo sapiens
aggaauaugcaucccac

SEQ ID NO: 494625 - RNA, 17 nt, Homo sapiens
aggaaucaaaaauugaa

SEQ ID NO: 494626 - RNA, 22 nt, Homo sapiens
aggacaguacacacuuggguaa

SEQ ID NO: 494627 - RNA, 13 nt, Homo sapiens
aggaccugugucc

SEQ ID NO: 494628 - RNA, 17 nt, Homo sapiens
aggacuguugacaucca

SEQ ID NO: 494629 - RNA, 14 nt, Homo sapiens
aggagccuuuucaa

SEQ ID NO: 494630 - RNA, 14 nt, Homo sapiens
aggaguuuugagaa

SEQ ID NO: 494631 - RNA, 12 nt, Homo sapiens
aggaucacuuga

SEQ ID NO: 494632 - RNA, 16 nt, Homo sapiens
aggauggucucugcca

SEQ ID NO: 494633 - RNA, 14 nt, Homo sapiens
aggauguaugugua

SEQ ID NO: 494634 - RNA, 19 nt, Homo sapiens
aggcaagauugauguuucc

SEQ ID NO: 494635 - RNA, 12 nt, Homo sapiens
aggcaaugauau

SEQ ID NO: 494636 - RNA, 22 nt, Homo sapiens
aggcacgugaucaguguugcaa

SEQ ID NO: 494637 - RNA, 13 nt, Homo sapiens
aggcagagcucag

SEQ ID NO: 494638 - RNA, 21 nt, Homo sapiens
aggcagagguugcagugagcu

SEQ ID NO: 494639 - RNA, 23 nt, Homo sapiens
aggcagagguugcagugagcuga

SEQ ID NO: 494640 - RNA, 12 nt, Homo sapiens
aggcaguggcuu

SEQ ID NO: 494641 - RNA, 21 nt, Homo sapiens
aggcauguggccuuuaucuca

SEQ ID NO: 494642 - RNA, 22 nt, Homo sapiens
aggcauguggccuuuaucucaa

SEQ ID NO: 494643 - RNA, 16 nt, Homo sapiens
aggcauuuauugccau

SEQ ID NO: 494644 - RNA, 13 nt, Homo sapiens
aggccaacagcau

SEQ ID NO: 494645 - RNA, 20 nt, Homo sapiens
aggcccaugcccuccguccu

SEQ ID NO: 494646 - RNA, 23 nt, Homo sapiens
aggccuccagccacuuauuucca

SEQ ID NO: 494647 - RNA, 23 nt, Homo sapiens
aggcugagucagccccacuccac

SEQ ID NO: 494648 - RNA, 15 nt, Homo sapiens
aggcuuacuaaugcu

SEQ ID NO: 494649 - RNA, 18 nt, Homo sapiens
aggcuucaauuuauugca

SEQ ID NO: 494650 - RNA, 18 nt, Homo sapiens
agggagaaauuggaaugu

SEQ ID NO: 494651 - RNA, 22 nt, Homo sapiens
agggccccucucuccacauucc

SEQ ID NO: 494652 - RNA, 19 nt, Homo sapiens
agggcugggcuccacuuca

SEQ ID NO: 494653 - RNA, 22 nt, Homo sapiens
agggguauuaaaacagaacugu

SEQ ID NO: 494654 - RNA, 18 nt, Homo sapiens
aggggugguacuuggcac

SEQ ID NO: 494655 - RNA, 17 nt, Homo sapiens
agguaggaucaucccac

SEQ ID NO: 494656 - RNA, 23 nt, Homo sapiens
agguaguagaaucucagcacuuu

SEQ ID NO: 494657 - RNA, 21 nt, Homo sapiens
agguccugggggccugaccuc

SEQ ID NO: 494658 - RNA, 16 nt, Homo sapiens
aggucgccagugacuu

SEQ ID NO: 494659 - RNA, 18 nt, Homo sapiens
aggucucagaugagcuua

SEQ ID NO: 494660 - RNA, 14 nt, Homo sapiens
agguuggagugcau

SEQ ID NO: 494661 - RNA, 19 nt, Homo sapiens
agguuguuaauguacaaaa

SEQ ID NO: 494662 - RNA, 22 nt, Homo sapiens
aguaaaauagaugaguguuaaa

SEQ ID NO: 494663 - RNA, 12 nt, Homo sapiens
aguaaagaccau

SEQ ID NO: 494664 - RNA, 22 nt, Homo sapiens
aguaagacuugauugguuuaaa

SEQ ID NO: 494665 - RNA, 16 nt, Homo sapiens
aguacaggucaucugc

SEQ ID NO: 494666 - RNA, 17 nt, Homo sapiens
aguacugaaauacauau

SEQ ID NO: 494667 - RNA, 20 nt, Homo sapiens
aguauauagccuuaagucuu

SEQ ID NO: 494668 - RNA, 21 nt, Homo sapiens
aguauccacuguuuauucaac

SEQ ID NO: 494669 - RNA, 20 nt, Homo sapiens
aguauggugcuggguccuua

SEQ ID NO: 494670 - RNA, 12 nt, Homo sapiens
aguaugugcuac

SEQ ID NO: 494671 - RNA, 11 nt, Homo sapiens
agucaucuccc

SEQ ID NO: 494672 - RNA, 17 nt, Homo sapiens
agucucacauuucucaa

SEQ ID NO: 494673 - RNA, 14 nt, Homo sapiens
agugaagagcauuu

SEQ ID NO: 494674 - RNA, 20 nt, Homo sapiens
agugaccucuagaaaaaaga

SEQ ID NO: 494675 - RNA, 15 nt, Homo sapiens
agugaggcaggugac

SEQ ID NO: 494676 - RNA, 20 nt, Homo sapiens
agugcuaagagccucuggaa

SEQ ID NO: 494677 - RNA, 19 nt, Homo sapiens
agugggugggacacagaga

SEQ ID NO: 494678 - RNA, 22 nt, Homo sapiens
agugguagcuuucaguauugua

SEQ ID NO: 494679 - RNA, 14 nt, Homo sapiens
aguguccaggagau

SEQ ID NO: 494680 - RNA, 14 nt, Homo sapiens
agugugaugcaauu

SEQ ID NO: 494681 - RNA, 14 nt, Homo sapiens
agugugauugugaa

SEQ ID NO: 494682 - RNA, 13 nt, Homo sapiens
aguguuaaacuag

SEQ ID NO: 494683 - RNA, 13 nt, Homo sapiens
aguguuacauauu

SEQ ID NO: 494684 - RNA, 22 nt, Homo sapiens
aguuaagaugcuuugacacuga

SEQ ID NO: 494685 - RNA, 15 nt, Homo sapiens
aguuaauaacagcuc

SEQ ID NO: 494686 - RNA, 12 nt, Homo sapiens
aguuaguaggau

SEQ ID NO: 494687 - RNA, 15 nt, Homo sapiens
aguucacuguagaaa

SEQ ID NO: 494688 - RNA, 16 nt, Homo sapiens
aguuccagauucccag

SEQ ID NO: 494689 - RNA, 19 nt, Homo sapiens
aguucuagggagauguauu

SEQ ID NO: 494690 - RNA, 16 nt, Homo sapiens
aguugacucugcucuu

SEQ ID NO: 494691 - RNA, 21 nt, Homo sapiens
acagacgucccuccacguuca

SEQ ID NO: 494692 - RNA, 17 nt, Homo sapiens
acagaugugggcuuuga

SEQ ID NO: 494693 - RNA, 18 nt, Homo sapiens
acagcaaaaaaagcaacu

SEQ ID NO: 494694 - RNA, 23 nt, Homo sapiens
acagcuaaacccuucaacuaugc

SEQ ID NO: 494695 - RNA, 15 nt, Homo sapiens
acagcuacacgcuga

SEQ ID NO: 494696 - RNA, 17 nt, Homo sapiens
acagcugcauggcacau

SEQ ID NO: 494697 - RNA, 19 nt, Homo sapiens
acagcuggccaccauggca

SEQ ID NO: 494698 - RNA, 22 nt, Homo sapiens
acaggauggucucugccaugaa

SEQ ID NO: 494699 - RNA, 16 nt, Homo sapiens
acaguguguaguuugu

SEQ ID NO: 494700 - RNA, 22 nt, Homo sapiens
acaguuuauuuuuauacuuuca

SEQ ID NO: 494701 - RNA, 15 nt, Homo sapiens
acaguuugaugucau

SEQ ID NO: 494702 - RNA, 14 nt, Homo sapiens
acauaauucauuaa

SEQ ID NO: 494703 - RNA, 23 nt, Homo sapiens
acauaguuauguaaaaagagauu

SEQ ID NO: 494704 - RNA, 23 nt, Homo sapiens
acauauucccaugguagacugug

SEQ ID NO: 494705 - RNA, 22 nt, Homo sapiens
acaucauaaacaaagaguagaa

SEQ ID NO: 494706 - RNA, 19 nt, Homo sapiens
acauccauguccuaugugu

SEQ ID NO: 494707 - RNA, 20 nt, Homo sapiens
acauccccuuuguguagaaa

SEQ ID NO: 494708 - RNA, 17 nt, Homo sapiens
acauccuguuuugcaaa

SEQ ID NO: 494709 - RNA, 23 nt, Homo sapiens
acaucucauccaucaaguugcac

SEQ ID NO: 494710 - RNA, 12 nt, Homo sapiens
acaucucuucau

SEQ ID NO: 494711 - RNA, 11 nt, Homo sapiens
acaucuuccac

SEQ ID NO: 494712 - RNA, 21 nt, Homo sapiens
acaugcacacacacacaucuc

SEQ ID NO: 494713 - RNA, 18 nt, Homo sapiens
acauguuguaaauggcau

SEQ ID NO: 494714 - RNA, 15 nt, Homo sapiens
acauuccaauuugca

SEQ ID NO: 494715 - RNA, 13 nt, Homo sapiens
acauugcuuuuaa

SEQ ID NO: 494716 - RNA, 13 nt, Homo sapiens
acauuugucauuu

SEQ ID NO: 494717 - RNA, 23 nt, Homo sapiens
acauuuguuugguuauagugcaa

SEQ ID NO: 494718 - RNA, 20 nt, Homo sapiens
acauuuuucauagauaccau

SEQ ID NO: 494719 - RNA, 19 nt, Homo sapiens
accaaagcugcugcacagc

SEQ ID NO: 494720 - RNA, 21 nt, Homo sapiens
accaaaggacauuaugugugc

SEQ ID NO: 494721 - RNA, 22 nt, Homo sapiens
accaaaugccuuucuagcaauu

SEQ ID NO: 494722 - RNA, 14 nt, Homo sapiens
aagaaaaugagaca

SEQ ID NO: 494723 - RNA, 20 nt, Homo sapiens
aagaaauuagggcucuaauu

SEQ ID NO: 494724 - RNA, 14 nt, Homo sapiens
aagaagacagcaaa

SEQ ID NO: 494725 - RNA, 20 nt, Homo sapiens
aagagauuuaucuuuauaca

SEQ ID NO: 494726 - RNA, 21 nt, Homo sapiens
aagaguagaaaaggauugcuu

SEQ ID NO: 494727 - RNA, 18 nt, Homo sapiens
aagaguugcuucccauuu

SEQ ID NO: 494728 - RNA, 15 nt, Homo sapiens
aagauaauucacucu

SEQ ID NO: 494729 - RNA, 17 nt, Homo sapiens
aagcaaaaacgaaagcu

SEQ ID NO: 494730 - RNA, 14 nt, Homo sapiens
aagcagacacacac

SEQ ID NO: 494731 - RNA, 16 nt, Homo sapiens
aagcagagugaaauuc

SEQ ID NO: 494732 - RNA, 20 nt, Homo sapiens
aagcagcucacggaacugga

SEQ ID NO: 494733 - RNA, 17 nt, Homo sapiens
aagcaucuaaacuuuaa

SEQ ID NO: 494734 - RNA, 14 nt, Homo sapiens
aagccaaauuuuau

SEQ ID NO: 494735 - RNA, 19 nt, Homo sapiens
aagccagcugcaggaauca

SEQ ID NO: 494736 - RNA, 17 nt, Homo sapiens
aagcccacucacccuuu

SEQ ID NO: 494737 - RNA, 21 nt, Homo sapiens
aagcccagccuaucucucuuc

SEQ ID NO: 494738 - RNA, 20 nt, Homo sapiens
aagcccgauccacauugcau

SEQ ID NO: 494739 - RNA, 16 nt, Homo sapiens
aagccucagaaaggga

SEQ ID NO: 494740 - RNA, 15 nt, Homo sapiens
aagccuccugcugag

SEQ ID NO: 494741 - RNA, 21 nt, Homo sapiens
aagcuccaucuuauuugucag

SEQ ID NO: 494742 - RNA, 17 nt, Homo sapiens
aaggaaacauaguagca

SEQ ID NO: 494743 - RNA, 22 nt, Homo sapiens
aaggaaacauaguagcaaugga

SEQ ID NO: 494744 - RNA, 16 nt, Homo sapiens
aaggaaauguuaguaa

SEQ ID NO: 494745 - RNA, 21 nt, Homo sapiens
aaggagaaaugacuuuuauaa

SEQ ID NO: 494746 - RNA, 13 nt, Homo sapiens
aaggaucacuuga

SEQ ID NO: 494747 - RNA, 14 nt, Homo sapiens
aaggauugugaacu

SEQ ID NO: 494748 - RNA, 12 nt, Homo sapiens
aaggcaaguccu

SEQ ID NO: 494749 - RNA, 24 nt, Homo sapiens
aaggcauccacuucacaguucuga

SEQ ID NO: 494750 - RNA, 12 nt, Homo sapiens
aaggcuguguca

SEQ ID NO: 494751 - RNA, 22 nt, Homo sapiens
aaggcuucaauuuauugcacaa

SEQ ID NO: 494752 - RNA, 19 nt, Homo sapiens
uauccaacagaaagcauag

SEQ ID NO: 494753 - RNA, 19 nt, Homo sapiens
uauccagaggguugugauu

SEQ ID NO: 494754 - RNA, 17 nt, Homo sapiens
uauccuguuuuugcaaa

SEQ ID NO: 494755 - RNA, 22 nt, Homo sapiens
uauccuuugugagccuaugaua

SEQ ID NO: 494756 - RNA, 20 nt, Homo sapiens
uaucugugugugauuugcua

SEQ ID NO: 494757 - RNA, 16 nt, Homo sapiens
uaucuguuugcuucua

SEQ ID NO: 494758 - RNA, 23 nt, Homo sapiens
uaugaccauaaaauuagacauac

SEQ ID NO: 494759 - RNA, 16 nt, Homo sapiens
uaugagaaaaaauaua

SEQ ID NO: 494760 - RNA, 15 nt, Homo sapiens
uaugagaucacugaa

SEQ ID NO: 494761 - RNA, 23 nt, Homo sapiens
uaugagaucacugaacuuuucaa

SEQ ID NO: 494762 - RNA, 20 nt, Homo sapiens
uaugauaaauuugacuguua

SEQ ID NO: 494763 - RNA, 22 nt, Homo sapiens
uaugcaaaaggguaagaugaaa

SEQ ID NO: 494764 - RNA, 19 nt, Homo sapiens
uaugcucauaacuguguca

SEQ ID NO: 494765 - RNA, 18 nt, Homo sapiens
uaugcuguucauugauga

SEQ ID NO: 494766 - RNA, 17 nt, Homo sapiens
uauggauugaaggauug

SEQ ID NO: 494767 - RNA, 15 nt, Homo sapiens
uauggggacauucca

SEQ ID NO: 494768 - RNA, 16 nt, Homo sapiens
uauguauuuuuaacua

SEQ ID NO: 494769 - RNA, 15 nt, Homo sapiens
uaugugaacuuucuc

SEQ ID NO: 494770 - RNA, 14 nt, Homo sapiens
uaugugauuuucaa

SEQ ID NO: 494771 - RNA, 21 nt, Homo sapiens
uaugugugcauguguguauaa

SEQ ID NO: 494772 - RNA, 16 nt, Homo sapiens
uauguuuacacuguca

SEQ ID NO: 494773 - RNA, 19 nt, Homo sapiens
uauuagaagcuaucaauca

SEQ ID NO: 494774 - RNA, 20 nt, Homo sapiens
uauuagacuucuguuuucaa

SEQ ID NO: 494775 - RNA, 18 nt, Homo sapiens
uauuauuuugcaguuuug

SEQ ID NO: 494776 - RNA, 18 nt, Homo sapiens
uauucauuagcugugauu

SEQ ID NO: 494777 - RNA, 16 nt, Homo sapiens
uauucccaaaucucaa

SEQ ID NO: 494778 - RNA, 14 nt, Homo sapiens
uauuccccauuucc

SEQ ID NO: 494779 - RNA, 13 nt, Homo sapiens
uauucgugaauag

SEQ ID NO: 494780 - RNA, 15 nt, Homo sapiens
uauucguuacucuaa

SEQ ID NO: 494781 - RNA, 13 nt, Homo sapiens
uauucuacuaugc

SEQ ID NO: 494782 - RNA, 19 nt, Homo sapiens
uauuuaugagaucacugaa

SEQ ID NO: 494783 - RNA, 21 nt, Homo sapiens
uauuuccauagcuuuuggcug

SEQ ID NO: 494784 - RNA, 19 nt, Homo sapiens
uauuuccuauaccauuucc

SEQ ID NO: 494785 - RNA, 16 nt, Homo sapiens
uauuucugucauucaa

SEQ ID NO: 494786 - RNA, 11 nt, Homo sapiens
uauuugcacag

SEQ ID NO: 494787 - RNA, 22 nt, Homo sapiens
uauuugcuaccacagcaacuau

SEQ ID NO: 494788 - RNA, 13 nt, Homo sapiens
uauuuuaauuuca

SEQ ID NO: 494789 - RNA, 11 nt, Homo sapiens
ucaaaaaucug

SEQ ID NO: 494790 - RNA, 18 nt, Homo sapiens
ucaaaauaaaaagugaca

SEQ ID NO: 494791 - RNA, 17 nt, Homo sapiens
ucaaacuauagugauau

SEQ ID NO: 494792 - RNA, 18 nt, Homo sapiens
ucaaagaaucaccuaauu

SEQ ID NO: 494793 - RNA, 18 nt, Homo sapiens
ucaaaggagccuuuucaa

SEQ ID NO: 494794 - RNA, 17 nt, Homo sapiens
ucaaaggagcuuucuca

SEQ ID NO: 494795 - RNA, 23 nt, Homo sapiens
ucaaauugucuuuugucaugugg

SEQ ID NO: 494796 - RNA, 15 nt, Homo sapiens
ucaacaaguaccuga

SEQ ID NO: 494797 - RNA, 17 nt, Homo sapiens
ucaacaugugugacugc

SEQ ID NO: 494798 - RNA, 20 nt, Homo sapiens
ucaacaugugugacugcgca

SEQ ID NO: 494799 - RNA, 23 nt, Homo sapiens
ucaacuucaggaaagcagcaguu

SEQ ID NO: 494800 - RNA, 13 nt, Homo sapiens
ucaagaaagccag

SEQ ID NO: 494801 - RNA, 21 nt, Homo sapiens
ucaagcagaaaaacaggcaca

SEQ ID NO: 494802 - RNA, 16 nt, Homo sapiens
ucaaguaugugcuacu

SEQ ID NO: 494803 - RNA, 18 nt, Homo sapiens
ucaaguuugaacucugua

SEQ ID NO: 494804 - RNA, 16 nt, Homo sapiens
ucaauaacuauugcug

SEQ ID NO: 494805 - RNA, 18 nt, Homo sapiens
ucaauaacuauugcugcu

SEQ ID NO: 494806 - RNA, 19 nt, Homo sapiens
ucaauaacuauugcugcuu

SEQ ID NO: 494807 - RNA, 17 nt, Homo sapiens
ucaauaccaccaagagg

SEQ ID NO: 494808 - RNA, 12 nt, Homo sapiens
ucaaugucuucc

SEQ ID NO: 494809 - RNA, 21 nt, Homo sapiens
ucaauuucagaaacuaagaau

SEQ ID NO: 494810 - RNA, 13 nt, Homo sapiens
ucacaaagcuauu

SEQ ID NO: 494811 - RNA, 19 nt, Homo sapiens
ucacaauaaaagaaacugu

SEQ ID NO: 494812 - RNA, 15 nt, Homo sapiens
ucacacacaccucau

SEQ ID NO: 494813 - RNA, 17 nt, Homo sapiens
ucugaguagcauauaua

SEQ ID NO: 494814 - RNA, 13 nt, Homo sapiens
ucugcaggccacu

SEQ ID NO: 494815 - RNA, 22 nt, Homo sapiens
ucugcauuuucugaaacuaaug

SEQ ID NO: 494816 - RNA, 20 nt, Homo sapiens
ucuggcccuugcuuaccucu

SEQ ID NO: 494817 - RNA, 15 nt, Homo sapiens
ucuggggucugugau

SEQ ID NO: 494818 - RNA, 22 nt, Homo sapiens
ucuguaaaucaagaccaaagag

SEQ ID NO: 494819 - RNA, 15 nt, Homo sapiens
ucuguaaugugaauu

SEQ ID NO: 494820 - RNA, 22 nt, Homo sapiens
ucugugaaaagggaucugcucc

SEQ ID NO: 494821 - RNA, 23 nt, Homo sapiens
ucugugaaagucuccuguaucau

SEQ ID NO: 494822 - RNA, 22 nt, Homo sapiens
ucuguguaguagcucgugugcu

SEQ ID NO: 494823 - RNA, 12 nt, Homo sapiens
ucuguuaucuag

SEQ ID NO: 494824 - RNA, 23 nt, Homo sapiens
ucuuaacauuucuaacucugaug

SEQ ID NO: 494825 - RNA, 21 nt, Homo sapiens
ucuuaacuggucuccuugcuu

SEQ ID NO: 494826 - RNA, 13 nt, Homo sapiens
ucuuaaugucuca

SEQ ID NO: 494827 - RNA, 14 nt, Homo sapiens
ucuuaaugucucaa

SEQ ID NO: 494828 - RNA, 20 nt, Homo sapiens
ucuuaauuaaguaaacuaau

SEQ ID NO: 494829 - RNA, 15 nt, Homo sapiens
ucuuacgcuugcuau

SEQ ID NO: 494830 - RNA, 14 nt, Homo sapiens
ucuucaacaugguu

SEQ ID NO: 494831 - RNA, 14 nt, Homo sapiens
ucuucauguugaug

SEQ ID NO: 494832 - RNA, 19 nt, Homo sapiens
ucuuccucccugggggccc

SEQ ID NO: 494833 - RNA, 15 nt, Homo sapiens
ucuuccucuuaccug

SEQ ID NO: 494834 - RNA, 16 nt, Homo sapiens
ucuucuguguauguga

SEQ ID NO: 494835 - RNA, 13 nt, Homo sapiens
ucuucuuacugua

SEQ ID NO: 494836 - RNA, 14 nt, Homo sapiens
ucuucuuacuguau

SEQ ID NO: 494837 - RNA, 22 nt, Homo sapiens
ucuugaauguugaagaacucau

SEQ ID NO: 494838 - RNA, 21 nt, Homo sapiens
ucuugggaaacggaaugaccu

SEQ ID NO: 494839 - RNA, 16 nt, Homo sapiens
ucuugguuuccaucaa

SEQ ID NO: 494840 - RNA, 23 nt, Homo sapiens
ucuugucuacuggacuguaaaau

SEQ ID NO: 494841 - RNA, 18 nt, Homo sapiens
ucuuuagaaacaucaguu

SEQ ID NO: 494842 - RNA, 12 nt, Homo sapiens
ucuuuaugaucu

SEQ ID NO: 494843 - RNA, 23 nt, Homo sapiens
ucuuucaggauuauuuuaauuaa

SEQ ID NO: 494844 - RNA, 19 nt, Homo sapiens
ucuuucugaauugcacaug

SEQ ID NO: 494845 - RNA, 17 nt, Homo sapiens
ucuuuugugucugucau

SEQ ID NO: 494846 - RNA, 15 nt, Homo sapiens
ugaaaaagauggcua

SEQ ID NO: 494847 - RNA, 17 nt, Homo sapiens
ugaaaaagauggcuacu

SEQ ID NO: 494848 - RNA, 21 nt, Homo sapiens
ugaaaaauaguguguccaugc

SEQ ID NO: 494849 - RNA, 14 nt, Homo sapiens
ugaaaacaguguga

SEQ ID NO: 494850 - RNA, 19 nt, Homo sapiens
ugaaaacagugugaugcaa

SEQ ID NO: 494851 - RNA, 20 nt, Homo sapiens
ugaaaacccucgauguucau

SEQ ID NO: 494852 - RNA, 17 nt, Homo sapiens
ugaaaaugucacuguua

SEQ ID NO: 494853 - RNA, 15 nt, Homo sapiens
ugaaacaaacaugga

SEQ ID NO: 494854 - RNA, 12 nt, Homo sapiens
ugaaacagcagc

SEQ ID NO: 494855 - RNA, 16 nt, Homo sapiens
ugaaacguuuaugcuu

SEQ ID NO: 494856 - RNA, 14 nt, Homo sapiens
ugaaacugacuugc

SEQ ID NO: 494857 - RNA, 21 nt, Homo sapiens
ugaaacugacuugcugugacu

SEQ ID NO: 494858 - RNA, 15 nt, Homo sapiens
ugaaagagcuuuuag

SEQ ID NO: 494859 - RNA, 16 nt, Homo sapiens
ugaaagcaacagcugg

SEQ ID NO: 494860 - RNA, 22 nt, Homo sapiens
ugaaagggaccuucgugcaacu

SEQ ID NO: 494861 - RNA, 12 nt, Homo sapiens
ugaaagugcacu

SEQ ID NO: 494862 - RNA, 19 nt, Homo sapiens
ugaaauaaaugccccaaag

SEQ ID NO: 494863 - RNA, 16 nt, Homo sapiens
ugaaauuuaagcacaa

SEQ ID NO: 494864 - RNA, 17 nt, Homo sapiens
ugaacaaagagagcuca

SEQ ID NO: 494865 - RNA, 21 nt, Homo sapiens
ugaacaugggggaacaaugag

SEQ ID NO: 494866 - RNA, 13 nt, Homo sapiens
ugaacuaaugaca

SEQ ID NO: 494867 - RNA, 17 nt, Homo sapiens
ugaagaacucaugugau

SEQ ID NO: 494868 - RNA, 19 nt, Homo sapiens
ugaagagugaagagcauuu

SEQ ID NO: 494869 - RNA, 15 nt, Homo sapiens
ugaagagugaggaua

SEQ ID NO: 494870 - RNA, 22 nt, Homo sapiens
ugaagccagcugcaggaaucaa

SEQ ID NO: 494871 - RNA, 23 nt, Homo sapiens
ugaagcuuaaccgaagaacuaau

SEQ ID NO: 494872 - RNA, 20 nt, Homo sapiens
ugaagcuucacucacuguca

SEQ ID NO: 494873 - RNA, 18 nt, Homo sapiens
ugaaggaaaggaagaccu

SEQ ID NO: 494874 - RNA, 14 nt, Homo sapiens
ugaaggauugugaa

SEQ ID NO: 494875 - RNA, 16 nt, Homo sapiens
ugaaggauugugaacu

SEQ ID NO: 494876 - RNA, 13 nt, Homo sapiens
ugaaucugaccac

SEQ ID NO: 494877 - RNA, 22 nt, Homo sapiens
ugaaucuucagcauguucucau

SEQ ID NO: 494878 - RNA, 18 nt, Homo sapiens
ugaaugaaacuauuacuc

SEQ ID NO: 494879 - RNA, 15 nt, Homo sapiens
ugaauuccaguauuu

SEQ ID NO: 494880 - RNA, 16 nt, Homo sapiens
ugaauugagcuagaaa

SEQ ID NO: 494881 - RNA, 12 nt, Homo sapiens
ugaauugcacau

SEQ ID NO: 494882 - RNA, 14 nt, Homo sapiens
ugacacugucugcu

SEQ ID NO: 494883 - RNA, 22 nt, Homo sapiens
ugacagccgucccaacccugcc

SEQ ID NO: 494884 - RNA, 21 nt, Homo sapiens
ugacauauuucauaagcacau

SEQ ID NO: 494885 - RNA, 22 nt, Homo sapiens
ugacauauuucauaagcacauc

SEQ ID NO: 494886 - RNA, 14 nt, Homo sapiens
ugacauccaagcuu

SEQ ID NO: 494887 - RNA, 20 nt, Homo sapiens
ugaccauaaaauuagacaua

SEQ ID NO: 494888 - RNA, 17 nt, Homo sapiens
ugaccuccgccauccac

SEQ ID NO: 494889 - RNA, 20 nt, Homo sapiens
ugaccuggaaaugaaugaaa

SEQ ID NO: 494890 - RNA, 23 nt, Homo sapiens
ugacgugaguggggaggagacuc

SEQ ID NO: 494891 - RNA, 22 nt, Homo sapiens
ugacucugcucuugcauaguaa

SEQ ID NO: 494892 - RNA, 15 nt, Homo sapiens
ugagaaaucucaucc

SEQ ID NO: 494893 - RNA, 22 nt, Homo sapiens
ugagacuguuuauuaccagauu

SEQ ID NO: 494894 - RNA, 15 nt, Homo sapiens
ugagaguuccagauu

SEQ ID NO: 494895 - RNA, 13 nt, Homo sapiens
uaaaagaaaugca

SEQ ID NO: 494896 - RNA, 14 nt, Homo sapiens
uaaaagaauauuca

SEQ ID NO: 494897 - RNA, 14 nt, Homo sapiens
uaaaauaaaccaga

SEQ ID NO: 494898 - RNA, 18 nt, Homo sapiens
uaaaaucccaagucauuu

SEQ ID NO: 494899 - RNA, 22 nt, Homo sapiens
uaaaaucuguauugcuaagaua

SEQ ID NO: 494900 - RNA, 22 nt, Homo sapiens
uaaaauggcaacaaacugcaca

SEQ ID NO: 494901 - RNA, 21 nt, Homo sapiens
uaaaaugugcuauuugcaaac

SEQ ID NO: 494902 - RNA, 18 nt, Homo sapiens
uaaaauuaauuugugcau

SEQ ID NO: 494903 - RNA, 17 nt, Homo sapiens
uaaaauuccuaucucau

SEQ ID NO: 494904 - RNA, 13 nt, Homo sapiens
uaaacacagauua

SEQ ID NO: 494905 - RNA, 15 nt, Homo sapiens
uaaacccaaucagau

SEQ ID NO: 494906 - RNA, 22 nt, Homo sapiens
uaaacccaaucagaugccucag

SEQ ID NO: 494907 - RNA, 16 nt, Homo sapiens
uaaacgugaugugcuc

SEQ ID NO: 494908 - RNA, 17 nt, Homo sapiens
uaaacgugaugugcuca

SEQ ID NO: 494909 - RNA, 18 nt, Homo sapiens
uaaacucagucaaaugua

SEQ ID NO: 494910 - RNA, 14 nt, Homo sapiens
uaaagaaagaugga

SEQ ID NO: 494911 - RNA, 24 nt, Homo sapiens
uaaagccacgcugugucccucaau

SEQ ID NO: 494912 - RNA, 16 nt, Homo sapiens
uaaagccuugugauca

SEQ ID NO: 494913 - RNA, 21 nt, Homo sapiens
uaaaguaacauaauacauuaa

SEQ ID NO: 494914 - RNA, 15 nt, Homo sapiens
uaaauccaacucuga

SEQ ID NO: 494915 - RNA, 21 nt, Homo sapiens
uaaauccaacucugacuguaa

SEQ ID NO: 494916 - RNA, 18 nt, Homo sapiens
uaaaugaaguaacuuguc

SEQ ID NO: 494917 - RNA, 14 nt, Homo sapiens
uaaaugccccaaag

SEQ ID NO: 494918 - RNA, 13 nt, Homo sapiens
uaaauguauauac

SEQ ID NO: 494919 - RNA, 17 nt, Homo sapiens
uaaauucaaaccuaagu

SEQ ID NO: 494920 - RNA, 16 nt, Homo sapiens
uaaauuugacuguuau

SEQ ID NO: 494921 - RNA, 16 nt, Homo sapiens
uaacaggauuagacag

SEQ ID NO: 494922 - RNA, 18 nt, Homo sapiens
uaaccauaaaucaauuca

SEQ ID NO: 494923 - RNA, 16 nt, Homo sapiens
uaacuuuaacuuuuga

SEQ ID NO: 494924 - RNA, 22 nt, Homo sapiens
uaagaaacccccucauggaucu

SEQ ID NO: 494925 - RNA, 12 nt, Homo sapiens
uaagaaauucca

SEQ ID NO: 494926 - RNA, 22 nt, Homo sapiens
uaagcacauccaacuacuccua

SEQ ID NO: 494927 - RNA, 22 nt, Homo sapiens
uaaggcauccacuucacaguuc

SEQ ID NO: 494928 - RNA, 21 nt, Homo sapiens
uaaggcuuaggccuauagauu

SEQ ID NO: 494929 - RNA, 20 nt, Homo sapiens
uaagguaaaaccaucuagga

SEQ ID NO: 494930 - RNA, 13 nt, Homo sapiens
uaaguugucuuac

SEQ ID NO: 494931 - RNA, 22 nt, Homo sapiens
uaauaaaguaugaauauuucau

SEQ ID NO: 494932 - RNA, 13 nt, Homo sapiens
uaauaaagugcac

SEQ ID NO: 494933 - RNA, 20 nt, Homo sapiens
uaauaagcagagagaucuau

SEQ ID NO: 494934 - RNA, 17 nt, Homo sapiens
uaauacauuaauacuuc

SEQ ID NO: 494935 - RNA, 14 nt, Homo sapiens
uaauauaacugccu

SEQ ID NO: 494936 - RNA, 17 nt, Homo sapiens
uaauaucagugaacaca

SEQ ID NO: 494937 - RNA, 22 nt, Homo sapiens
uaauauugaaaaugucacuguu

SEQ ID NO: 494938 - RNA, 14 nt, Homo sapiens
uaaucagaucuucu

SEQ ID NO: 494939 - RNA, 17 nt, Homo sapiens
uaauccaggacagcauu

SEQ ID NO: 494940 - RNA, 13 nt, Homo sapiens
uaauccuaucugg

SEQ ID NO: 494941 - RNA, 12 nt, Homo sapiens
uaaugaaagcac

SEQ ID NO: 494942 - RNA, 11 nt, Homo sapiens
uaaugagcucc

SEQ ID NO: 494943 - RNA, 11 nt, Homo sapiens
uaaugcuucuu

SEQ ID NO: 494944 - RNA, 18 nt, Homo sapiens
uaauggaaacaugcugua

SEQ ID NO: 494945 - RNA, 21 nt, Homo sapiens
uaauggcccuguagcucugaa

SEQ ID NO: 494946 - RNA, 12 nt, Homo sapiens
uaauguacaaaa

SEQ ID NO: 494947 - RNA, 14 nt, Homo sapiens
uaauuaauucucag

SEQ ID NO: 494948 - RNA, 16 nt, Homo sapiens
uaauuucuugcaauuu

SEQ ID NO: 494949 - RNA, 21 nt, Homo sapiens
uacaaggguauccugugcuau

SEQ ID NO: 494950 - RNA, 22 nt, Homo sapiens
uacaaguuuucauaagcacacu

SEQ ID NO: 494951 - RNA, 17 nt, Homo sapiens
uacaauauaucuugucu

SEQ ID NO: 494952 - RNA, 18 nt, Homo sapiens
uacaaucaugaacagcuc

SEQ ID NO: 494953 - RNA, 20 nt, Homo sapiens
uacaauuuuauaggugaaag

SEQ ID NO: 494954 - RNA, 14 nt, Homo sapiens
uacacacacagaca

SEQ ID NO: 494955 - RNA, 13 nt, Homo sapiens
uacacacuugacc

SEQ ID NO: 494956 - RNA, 15 nt, Homo sapiens
uacacauacauauau

SEQ ID NO: 494957 - RNA, 21 nt, Homo sapiens
uacacguuggaguauaccuau

SEQ ID NO: 494958 - RNA, 23 nt, Homo sapiens
uacacucaaacuauagugauaua

SEQ ID NO: 494959 - RNA, 13 nt, Homo sapiens
uacacuuguauaa

SEQ ID NO: 494960 - RNA, 16 nt, Homo sapiens
cauaguagcaauggau

SEQ ID NO: 494961 - RNA, 15 nt, Homo sapiens
cauaguuauguaaaa

SEQ ID NO: 494962 - RNA, 18 nt, Homo sapiens
cauauauauaaaauacac

SEQ ID NO: 494963 - RNA, 13 nt, Homo sapiens
cauauaugcaaaa

SEQ ID NO: 494964 - RNA, 19 nt, Homo sapiens
cauauguagacuauauaca

SEQ ID NO: 494965 - RNA, 12 nt, Homo sapiens
cauauguucuca

SEQ ID NO: 494966 - RNA, 19 nt, Homo sapiens
cauauuaaagaaagucaua

SEQ ID NO: 494967 - RNA, 21 nt, Homo sapiens
cauauucuuucacuuguaugu

SEQ ID NO: 494968 - RNA, 20 nt, Homo sapiens
cauauuuggagagaauauga

SEQ ID NO: 494969 - RNA, 21 nt, Homo sapiens
cauauuuuccuuuaugugaug

SEQ ID NO: 494970 - RNA, 21 nt, Homo sapiens
caucaacaaagaaauauuauu

SEQ ID NO: 494971 - RNA, 16 nt, Homo sapiens
caucaguuaggauuag

SEQ ID NO: 494972 - RNA, 13 nt, Homo sapiens
caucauguauaua

SEQ ID NO: 494973 - RNA, 16 nt, Homo sapiens
cauccaucaugcaaaa

SEQ ID NO: 494974 - RNA, 14 nt, Homo sapiens
caucccggggccau

SEQ ID NO: 494975 - RNA, 15 nt, Homo sapiens
cauccuguuuugcaa

SEQ ID NO: 494976 - RNA, 21 nt, Homo sapiens
cauccuguuuugcaaauugga

SEQ ID NO: 494977 - RNA, 16 nt, Homo sapiens
caucgguuuauacuau

SEQ ID NO: 494978 - RNA, 16 nt, Homo sapiens
caucugcugagcucug

SEQ ID NO: 494979 - RNA, 18 nt, Homo sapiens
caucugucugucccaguu

SEQ ID NO: 494980 - RNA, 16 nt, Homo sapiens
caucuuccgagcccuu

SEQ ID NO: 494981 - RNA, 15 nt, Homo sapiens
caugauuguuuacag

SEQ ID NO: 494982 - RNA, 14 nt, Homo sapiens
caugcaacuugauu

SEQ ID NO: 494983 - RNA, 14 nt, Homo sapiens
caugcacacacaca

SEQ ID NO: 494984 - RNA, 22 nt, Homo sapiens
caugcacacacacacaucucau

SEQ ID NO: 494985 - RNA, 19 nt, Homo sapiens
caugcacccgcauguacaa

SEQ ID NO: 494986 - RNA, 23 nt, Homo sapiens
caugccagaaggaaucuucucau

SEQ ID NO: 494987 - RNA, 16 nt, Homo sapiens
caugccuuuccagugc

SEQ ID NO: 494988 - RNA, 13 nt, Homo sapiens
caugcucccucau

SEQ ID NO: 494989 - RNA, 14 nt, Homo sapiens
caugcuuuccauau

SEQ ID NO: 494990 - RNA, 19 nt, Homo sapiens
cauggcuccucaccaccga

SEQ ID NO: 494991 - RNA, 12 nt, Homo sapiens
caugguacaaac

SEQ ID NO: 494992 - RNA, 17 nt, Homo sapiens
caugguagacugugaca

SEQ ID NO: 494993 - RNA, 14 nt, Homo sapiens
cauggugcaauuug

SEQ ID NO: 494994 - RNA, 11 nt, Homo sapiens
cauguacaaaa

SEQ ID NO: 494995 - RNA, 17 nt, Homo sapiens
caugugaaagugcacuu

SEQ ID NO: 494996 - RNA, 17 nt, Homo sapiens
caugugagcaugucacu

SEQ ID NO: 494997 - RNA, 16 nt, Homo sapiens
caugugcgaacacagu

SEQ ID NO: 494998 - RNA, 20 nt, Homo sapiens
cauguggaaaacucacagau

SEQ ID NO: 494999 - RNA, 17 nt, Homo sapiens
cauguggcuaaaugccu

SEQ ID NO: 495000 - RNA, 22 nt, Homo sapiens
cauguggcuaaaugccuaauaa

SEQ ID NO: 495001 - RNA, 16 nt, Homo sapiens
cauguuguaaauggca

SEQ ID NO: 495002 - RNA, 18 nt, Homo sapiens
cauuaaaauaugcacuaa

SEQ ID NO: 495003 - RNA, 18 nt, Homo sapiens
cauucaugcaacuugauu

SEQ ID NO: 495004 - RNA, 16 nt, Homo sapiens
cauuccaauuugcacu

SEQ ID NO: 495005 - RNA, 18 nt, Homo sapiens
cauucugcaaugagccau

SEQ ID NO: 495006 - RNA, 15 nt, Homo sapiens
cauucuggcacuuua

SEQ ID NO: 495007 - RNA, 23 nt, Homo sapiens
cauugaugacaugggauugaguu

SEQ ID NO: 495008 - RNA, 14 nt, Homo sapiens
cauugguaucugau

SEQ ID NO: 495009 - RNA, 19 nt, Homo sapiens
cauuguaucuucauacaaa

SEQ ID NO: 495010 - RNA, 23 nt, Homo sapiens
cauuuacagucucuuucuuccuu

SEQ ID NO: 495011 - RNA, 18 nt, Homo sapiens
cauuuccaacaccacaga

SEQ ID NO: 495012 - RNA, 20 nt, Homo sapiens
cauuuccaacaccacagaca

SEQ ID NO: 495013 - RNA, 15 nt, Homo sapiens
cauuucuaacucuga

SEQ ID NO: 495014 - RNA, 15 nt, Homo sapiens
cauuucucucuccag

SEQ ID NO: 495015 - RNA, 22 nt, Homo sapiens
cauuucuucucucugugcuggu

SEQ ID NO: 495016 - RNA, 17 nt, Homo sapiens
cauuugacuuucugucu

SEQ ID NO: 495017 - RNA, 13 nt, Homo sapiens
cauuugauuguca

SEQ ID NO: 495018 - RNA, 16 nt, Homo sapiens
cauuugcugcauuuca

SEQ ID NO: 495019 - RNA, 19 nt, Homo sapiens
cauuugugucagcaugucu

SEQ ID NO: 495020 - RNA, 18 nt, Homo sapiens
cauuuucugaaacuaaug

SEQ ID NO: 495021 - RNA, 18 nt, Homo sapiens
cauuuuucuacugcucuu

SEQ ID NO: 495022 - RNA, 14 nt, Homo sapiens
cauuuuuugucugu

SEQ ID NO: 495023 - RNA, 14 nt, Homo sapiens
ccaaaguuauccag

SEQ ID NO: 495024 - RNA, 14 nt, Homo sapiens
ccaaauugcagcuu

SEQ ID NO: 495025 - RNA, 22 nt, Homo sapiens
ccaaauuuuauuaaaagaguag

SEQ ID NO: 495026 - RNA, 13 nt, Homo sapiens
ccaacaccacaga

SEQ ID NO: 495027 - RNA, 20 nt, Homo sapiens
ccaacauacaauuuacuuuu

SEQ ID NO: 495028 - RNA, 17 nt, Homo sapiens
ccaacccaugagugcua

SEQ ID NO: 495029 - RNA, 14 nt, Homo sapiens
ccaacucuugcaca

SEQ ID NO: 495030 - RNA, 20 nt, Homo sapiens
ccaagacuuuugucugauca

SEQ ID NO: 495031 - RNA, 20 nt, Homo sapiens
ccaagaggaaaauauugaca

SEQ ID NO: 495032 - RNA, 19 nt, Homo sapiens
ccaaggcaaugauauggca

SEQ ID NO: 495033 - RNA, 22 nt, Homo sapiens
ccaauucacuuuagagugacua

SEQ ID NO: 495034 - RNA, 15 nt, Homo sapiens
ccacaggaugcauau

SEQ ID NO: 495035 - RNA, 24 nt, Homo sapiens
ccaccuagagguagguaggaucau

SEQ ID NO: 495036 - RNA, 13 nt, Homo sapiens
ccaccugcacaaa

SEQ ID NO: 495037 - RNA, 23 nt, Homo sapiens
ccacgccauccaucaugcaaaau

SEQ ID NO: 495038 - RNA, 16 nt, Homo sapiens
ccacuccugcucugcu

SEQ ID NO: 495039 - RNA, 14 nt, Homo sapiens
ccacugaagaguau

SEQ ID NO: 495040 - RNA, 14 nt, Homo sapiens
ccacuuucccacac

SEQ ID NO: 495041 - RNA, 15 nt, Homo sapiens
ccagaccaguaguga

SEQ ID NO: 495042 - RNA, 21 nt, Homo sapiens
ccagagcauuuccaacaccac

SEQ ID NO: 495043 - RNA, 15 nt, Homo sapiens
ccagagcugccagug

SEQ ID NO: 495044 - RNA, 23 nt, Homo sapiens
ccaggaggggaugugugugugca

SEQ ID NO: 495045 - RNA, 19 nt, Homo sapiens
ccaggcuaauacaggaaac

SEQ ID NO: 495046 - RNA, 22 nt, Homo sapiens
ccaggcucccucccucccagau

SEQ ID NO: 495047 - RNA, 15 nt, Homo sapiens
ccagguuuugcacuc

SEQ ID NO: 495048 - RNA, 17 nt, Homo sapiens
ccaguacauaaggaguu

SEQ ID NO: 495049 - RNA, 15 nt, Homo sapiens
ccagucccaaugcac

SEQ ID NO: 495050 - RNA, 16 nt, Homo sapiens
ccauaaaucaauucau

SEQ ID NO: 495051 - RNA, 19 nt, Homo sapiens
ccauauuagaaaacuuugu

SEQ ID NO: 495052 - RNA, 23 nt, Homo sapiens
caaaggagccuuuucaaauccau

SEQ ID NO: 495053 - RNA, 15 nt, Homo sapiens
caaauaaauaucauc

SEQ ID NO: 495054 - RNA, 14 nt, Homo sapiens
caaauacacuuuau

SEQ ID NO: 495055 - RNA, 23 nt, Homo sapiens
caaauacggaaguaaaccugaac

SEQ ID NO: 495056 - RNA, 17 nt, Homo sapiens
caaauauuuugucacug

SEQ ID NO: 495057 - RNA, 15 nt, Homo sapiens
caaaugugugacugc

SEQ ID NO: 495058 - RNA, 23 nt, Homo sapiens
caaauguuacuucuaaaauuaca

SEQ ID NO: 495059 - RNA, 21 nt, Homo sapiens
caaauguuauucaauaacuau

SEQ ID NO: 495060 - RNA, 15 nt, Homo sapiens
caaauuaagaaucua

SEQ ID NO: 495061 - RNA, 16 nt, Homo sapiens
caaauugucaccugcu

SEQ ID NO: 495062 - RNA, 18 nt, Homo sapiens
caacaacauccauguccu

SEQ ID NO: 495063 - RNA, 19 nt, Homo sapiens
caacaacauccauguccua

SEQ ID NO: 495064 - RNA, 16 nt, Homo sapiens
caacacaccuugccca

SEQ ID NO: 495065 - RNA, 22 nt, Homo sapiens
caaccuccccugguccugcacu

SEQ ID NO: 495066 - RNA, 21 nt, Homo sapiens
caaccuguucacgugacuccu

SEQ ID NO: 495067 - RNA, 20 nt, Homo sapiens
caacguacuauggaagccac

SEQ ID NO: 495068 - RNA, 21 nt, Homo sapiens
caacuugaaauuauaucugug

SEQ ID NO: 495069 - RNA, 23 nt, Homo sapiens
caacuuguaacucuaugaacuua

SEQ ID NO: 495070 - RNA, 15 nt, Homo sapiens
caacuuuguuuucca

SEQ ID NO: 495071 - RNA, 16 nt, Homo sapiens
caagaaaaaaagggag

SEQ ID NO: 495072 - RNA, 14 nt, Homo sapiens
caagaacaaauaca

SEQ ID NO: 495073 - RNA, 12 nt, Homo sapiens
caagaccaaaga

SEQ ID NO: 495074 - RNA, 13 nt, Homo sapiens
caagacuguaaau

SEQ ID NO: 495075 - RNA, 21 nt, Homo sapiens
caagacuuuugucugaucaag

SEQ ID NO: 495076 - RNA, 22 nt, Homo sapiens
caagcacgcacacacacgcaaa

SEQ ID NO: 495077 - RNA, 13 nt, Homo sapiens
caagcagaaaaac

SEQ ID NO: 495078 - RNA, 21 nt, Homo sapiens
caagcuauagcuaaugugcug

SEQ ID NO: 495079 - RNA, 14 nt, Homo sapiens
caaggcugcaguga

SEQ ID NO: 495080 - RNA, 17 nt, Homo sapiens
caaggcugcagugagcc

SEQ ID NO: 495081 - RNA, 12 nt, Homo sapiens
caaggugacaaa

SEQ ID NO: 495082 - RNA, 13 nt, Homo sapiens
caaguaugugcua

SEQ ID NO: 495083 - RNA, 13 nt, Homo sapiens
caagucacagaaa

SEQ ID NO: 495084 - RNA, 13 nt, Homo sapiens
caagucugugaaa

SEQ ID NO: 495085 - RNA, 15 nt, Homo sapiens
caagugaaggagcug

SEQ ID NO: 495086 - RNA, 18 nt, Homo sapiens
caaguuggucuuacuuug

SEQ ID NO: 495087 - RNA, 22 nt, Homo sapiens
caaguuuucauaagcacacuuc

SEQ ID NO: 495088 - RNA, 20 nt, Homo sapiens
caauaaaagaaacugugguc

SEQ ID NO: 495089 - RNA, 15 nt, Homo sapiens
caauaaacucaguca

SEQ ID NO: 495090 - RNA, 15 nt, Homo sapiens
caauauaucuugucu

SEQ ID NO: 495091 - RNA, 18 nt, Homo sapiens
caauauaucuugucuacu

SEQ ID NO: 495092 - RNA, 13 nt, Homo sapiens
caaucuauggcaa

SEQ ID NO: 495093 - RNA, 22 nt, Homo sapiens
caaucuuaaugucucuucauaa

SEQ ID NO: 495094 - RNA, 23 nt, Homo sapiens
caaugaacuguuucaguagccaa

SEQ ID NO: 495095 - RNA, 18 nt, Homo sapiens
caaugagcagagauggca

SEQ ID NO: 495096 - RNA, 18 nt, Homo sapiens
caaugcacauccauuccc

SEQ ID NO: 495097 - RNA, 17 nt, Homo sapiens
caauggugaacugucau

SEQ ID NO: 495098 - RNA, 13 nt, Homo sapiens
caauguuuugcuu

SEQ ID NO: 495099 - RNA, 12 nt, Homo sapiens
gaaaugcacaau

SEQ ID NO: 495100 - RNA, 16 nt, Homo sapiens
gaaaugcuaugucauu

SEQ ID NO: 495101 - RNA, 20 nt, Homo sapiens
gaaaugcuaugucauuucau

SEQ ID NO: 495102 - RNA, 12 nt, Homo sapiens
gaaaugcugauu

SEQ ID NO: 495103 - RNA, 13 nt, Homo sapiens
gaaauguuuccag

SEQ ID NO: 495104 - RNA, 16 nt, Homo sapiens
gaaauucacaaaguua

SEQ ID NO: 495105 - RNA, 20 nt, Homo sapiens
gaaauuccauacuucucuca

SEQ ID NO: 495106 - RNA, 15 nt, Homo sapiens
gaaauugguaccuug

SEQ ID NO: 495107 - RNA, 21 nt, Homo sapiens
gaaauuuuaucucuucuuccu

SEQ ID NO: 495108 - RNA, 19 nt, Homo sapiens
gaacaaaguccacaguuua

SEQ ID NO: 495109 - RNA, 12 nt, Homo sapiens
gaacaaauacac

SEQ ID NO: 495110 - RNA, 22 nt, Homo sapiens
gaacagggaugcuaucucgcua

SEQ ID NO: 495111 - RNA, 15 nt, Homo sapiens
gaaccaauucacuuu

SEQ ID NO: 495112 - RNA, 18 nt, Homo sapiens
gaaccauaguugacaguu

SEQ ID NO: 495113 - RNA, 20 nt, Homo sapiens
gaacccaggaggcagagguu

SEQ ID NO: 495114 - RNA, 13 nt, Homo sapiens
gaacucuguaaaa

SEQ ID NO: 495115 - RNA, 18 nt, Homo sapiens
gaacucuguaaaaccuca

SEQ ID NO: 495116 - RNA, 16 nt, Homo sapiens
gaagaaauuuaugaag

SEQ ID NO: 495117 - RNA, 20 nt, Homo sapiens
gaagaaauuuaugaagcaga

SEQ ID NO: 495118 - RNA, 23 nt, Homo sapiens
gaagaauuggcagaagcaguugc

SEQ ID NO: 495119 - RNA, 15 nt, Homo sapiens
gaagacagcaaaaaa

SEQ ID NO: 495120 - RNA, 17 nt, Homo sapiens
gaagaccacacuuggug

SEQ ID NO: 495121 - RNA, 16 nt, Homo sapiens
gaagagagauauaucu

SEQ ID NO: 495122 - RNA, 22 nt, Homo sapiens
gaagagcauuugguacacacuu

SEQ ID NO: 495123 - RNA, 19 nt, Homo sapiens
gaagagugaagagcauuug

SEQ ID NO: 495124 - RNA, 14 nt, Homo sapiens
gaagauaccauaag

SEQ ID NO: 495125 - RNA, 21 nt, Homo sapiens
gaagaugaauggucuggcaau

SEQ ID NO: 495126 - RNA, 18 nt, Homo sapiens
gaagauguaagaagcuaa

SEQ ID NO: 495127 - RNA, 17 nt, Homo sapiens
gaagcaaauaaauauca

SEQ ID NO: 495128 - RNA, 13 nt, Homo sapiens
gaagccacaucac

SEQ ID NO: 495129 - RNA, 17 nt, Homo sapiens
gaagccagcucccugaa

SEQ ID NO: 495130 - RNA, 19 nt, Homo sapiens
gaagcccccucuuccuccc

SEQ ID NO: 495131 - RNA, 16 nt, Homo sapiens
gaagcccucucuggcu

SEQ ID NO: 495132 - RNA, 23 nt, Homo sapiens
gaaggcugccaggggauuucgaa

SEQ ID NO: 495133 - RNA, 23 nt, Homo sapiens
gaagggccuucuccacagggaca

SEQ ID NO: 495134 - RNA, 15 nt, Homo sapiens
gaaggugacacugcu

SEQ ID NO: 495135 - RNA, 20 nt, Homo sapiens
gaagguuauggucaauccca

SEQ ID NO: 495136 - RNA, 21 nt, Homo sapiens
gaaguuagccuuuaucuacca

SEQ ID NO: 495137 - RNA, 17 nt, Homo sapiens
gaaguuggcacauuuca

SEQ ID NO: 495138 - RNA, 19 nt, Homo sapiens
gaauaaaauauugauuuca

SEQ ID NO: 495139 - RNA, 20 nt, Homo sapiens
gaauaacuuuagcuuuuaca

SEQ ID NO: 495140 - RNA, 13 nt, Homo sapiens
gaauaagaagcaa

SEQ ID NO: 495141 - RNA, 24 nt, Homo sapiens
gaauagucuuuugcaugucgcaca

SEQ ID NO: 495142 - RNA, 15 nt, Homo sapiens
gaauaugcaucccac

SEQ ID NO: 495143 - RNA, 16 nt, Homo sapiens
gaaucaaaaauugaag

SEQ ID NO: 495144 - RNA, 19 nt, Homo sapiens
gaaucuccugaccacuugu

SEQ ID NO: 495145 - RNA, 16 nt, Homo sapiens
gaaucuuuccuuccuc

SEQ ID NO: 495146 - RNA, 17 nt, Homo sapiens
gaaugaguuuccagcua

SEQ ID NO: 495147 - RNA, 22 nt, Homo sapiens
gaaugaguuuccagcuaagccu

SEQ ID NO: 495148 - RNA, 16 nt, Homo sapiens
gaaugcaugcuuucca

SEQ ID NO: 495149 - RNA, 17 nt, Homo sapiens
gaauguuuuccuucuac

SEQ ID NO: 495150 - RNA, 15 nt, Homo sapiens
gaauugagcuagaaa

SEQ ID NO: 495151 - RNA, 16 nt, Homo sapiens
gacaaauacacauaca

SEQ ID NO: 495152 - RNA, 18 nt, Homo sapiens
gacaaguucacucgccuc

SEQ ID NO: 495153 - RNA, 22 nt, Homo sapiens
gacaaguuuaaaggcuguguca

SEQ ID NO: 495154 - RNA, 10 nt, Homo sapiens
gacacugucu

SEQ ID NO: 495155 - RNA, 16 nt, Homo sapiens
gacagcauugccagua

SEQ ID NO: 495156 - RNA, 15 nt, Homo sapiens
gacagcugcucuuua

SEQ ID NO: 495157 - RNA, 15 nt, Homo sapiens
gacaguaaagaccau

SEQ ID NO: 495158 - RNA, 15 nt, Homo sapiens
gacagugccuaacuc

SEQ ID NO: 495159 - RNA, 19 nt, Homo sapiens
gacauaaaucuuccaaagu

SEQ ID NO: 495160 - RNA, 12 nt, Homo sapiens
gacauaccucuc

SEQ ID NO: 495161 - RNA, 21 nt, Homo sapiens
gacaugaaauugagucauuuu

SEQ ID NO: 495162 - RNA, 22 nt, Homo sapiens
gacaugcacccgcauguacaaa

SEQ ID NO: 495163 - RNA, 13 nt, Homo sapiens
gacauuaugugug

SEQ ID NO: 495164 - RNA, 16 nt, Homo sapiens
gacauucuuaguuaau

SEQ ID NO: 495165 - RNA, 11 nt, Homo sapiens
gaccacugucu

SEQ ID NO: 495166 - RNA, 13 nt, Homo sapiens
gaccacugucucc

SEQ ID NO: 495167 - RNA, 15 nt, Homo sapiens
gaccagccuggccaa

SEQ ID NO: 495168 - RNA, 20 nt, Homo sapiens
gaccagguugucacugagaa

SEQ ID NO: 495169 - RNA, 20 nt, Homo sapiens
gaccccaaauuaagaaucua

SEQ ID NO: 495170 - RNA, 19 nt, Homo sapiens
gaccccauccagccagggg

SEQ ID NO: 495171 - RNA, 18 nt, Homo sapiens
gacccuagggauuugcac

SEQ ID NO: 495172 - RNA, 15 nt, Homo sapiens
gaccuccugaugucu

SEQ ID NO: 495173 - RNA, 17 nt, Homo sapiens
gaccuggggaaacggcc

SEQ ID NO: 495174 - RNA, 16 nt, Homo sapiens
gaccuggucaggguga

SEQ ID NO: 495175 - RNA, 18 nt, Homo sapiens
gacggauguaaggugcac

SEQ ID NO: 495176 - RNA, 20 nt, Homo sapiens
gacgguagagagaaacagcu

SEQ ID NO: 495177 - RNA, 19 nt, Homo sapiens
gacuagaacacaaauccaa

SEQ ID NO: 495178 - RNA, 17 nt, Homo sapiens
gacuauauacaugugug

SEQ ID NO: 495179 - RNA, 12 nt, Homo sapiens
gacuccaagaac

SEQ ID NO: 495180 - RNA, 16 nt, Homo sapiens
gacucuguggggccac

SEQ ID NO: 495181 - RNA, 14 nt, Homo sapiens
gacuggccaaaaau

SEQ ID NO: 495182 - RNA, 20 nt, Homo sapiens
gacuucauuuuuccuaacag

SEQ ID NO: 495183 - RNA, 14 nt, Homo sapiens
gacuuccugaacuc

SEQ ID NO: 495184 - RNA, 21 nt, Homo sapiens
gacuucuguuuucaaucucgu

SEQ ID NO: 495185 - RNA, 16 nt, Homo sapiens
gagaagccucauggga

SEQ ID NO: 495186 - RNA, 21 nt, Homo sapiens
gagaaucgcuugaacccagga

SEQ ID NO: 495187 - RNA, 15 nt, Homo sapiens
gagacacugugcuau

SEQ ID NO: 495188 - RNA, 14 nt, Homo sapiens
gagagcagccucuu

SEQ ID NO: 495189 - RNA, 18 nt, Homo sapiens
gagauacucuucugccuc

SEQ ID NO: 495190 - RNA, 17 nt, Homo sapiens
gagaucacugaacuuuu

SEQ ID NO: 495191 - RNA, 11 nt, Homo sapiens
gagauggacca

SEQ ID NO: 495192 - RNA, 13 nt, Homo sapiens
gagauggggagaa

SEQ ID NO: 495193 - RNA, 13 nt, Homo sapiens
gagauuguucuau

SEQ ID NO: 495194 - RNA, 14 nt, Homo sapiens
gagcaacacaggau

SEQ ID NO: 495195 - RNA, 17 nt, Homo sapiens
gagcacaaacuucagaa

SEQ ID NO: 495196 - RNA, 16 nt, Homo sapiens
gagcaugaagauaaau

SEQ ID NO: 495197 - RNA, 13 nt, Homo sapiens
gagccucuggaag

SEQ ID NO: 495198 - RNA, 18 nt, Homo sapiens
gagcggggcccacccggu

SEQ ID NO: 495199 - RNA, 18 nt, Homo sapiens
gagcucuccugggccagg

SEQ ID NO: 495200 - RNA, 16 nt, Homo sapiens
gaggacagcaaugcag

SEQ ID NO: 495201 - RNA, 19 nt, Homo sapiens
gaggacuguugacauccaa

SEQ ID NO: 495202 - RNA, 24 nt, Homo sapiens
gaggcagagguugcagugagcuga

SEQ ID NO: 495203 - RNA, 23 nt, Homo sapiens
gaggccugaaauguuuccaggca

SEQ ID NO: 495204 - RNA, 24 nt, Homo sapiens
gaggcuaugaagaaaacagcugca

SEQ ID NO: 495205 - RNA, 15 nt, Homo sapiens
gaggggcggggccag

SEQ ID NO: 495206 - RNA, 16 nt, Homo sapiens
gaggggcggggccagg

SEQ ID NO: 495207 - RNA, 12 nt, Homo sapiens
gaggguuuccac

SEQ ID NO: 495208 - RNA, 15 nt, Homo sapiens
gagguugugcugccu

SEQ ID NO: 495209 - RNA, 17 nt, Homo sapiens
gaguauguuauuucucu

SEQ ID NO: 495210 - RNA, 19 nt, Homo sapiens
gagucaaugagauuuugcc

SEQ ID NO: 495211 - RNA, 23 nt, Homo sapiens
gagucaggcuuacuaaugcugcc

SEQ ID NO: 495212 - RNA, 17 nt, Homo sapiens
gagucugccucuguuca

SEQ ID NO: 495213 - RNA, 22 nt, Homo sapiens
gagucuggauaauuuguauaag

SEQ ID NO: 495214 - RNA, 16 nt, Homo sapiens
gagugaagagcauuug

SEQ ID NO: 495215 - RNA, 17 nt, Homo sapiens
gagugauaugauccaga

SEQ ID NO: 495216 - RNA, 15 nt, Homo sapiens
gaguuauuuuguguc

SEQ ID NO: 495217 - RNA, 22 nt, Homo sapiens
gaguucuauuagaagcuaucaa

SEQ ID NO: 495218 - RNA, 23 nt, Homo sapiens
gaguuuccagcuaagccugauga

SEQ ID NO: 495219 - RNA, 17 nt, Homo sapiens
gauaaauuugacuguua

SEQ ID NO: 495220 - RNA, 22 nt, Homo sapiens
gauaacaacccaaggcaaugau

SEQ ID NO: 495221 - RNA, 20 nt, Homo sapiens
gauagaucuuggcccuguua

SEQ ID NO: 495222 - RNA, 17 nt, Homo sapiens
gaucaaaagugauuuua

SEQ ID NO: 495223 - RNA, 22 nt, Homo sapiens
gaucaaaauaaaaagugacaca

SEQ ID NO: 495224 - RNA, 18 nt, Homo sapiens
gaucaagaaaaaaaggga

SEQ ID NO: 495225 - RNA, 19 nt, Homo sapiens
gaucacucaccauucccag

SEQ ID NO: 495226 - RNA, 23 nt, Homo sapiens
gauccaggaacacaugcacacac

SEQ ID NO: 495227 - RNA, 23 nt, Homo sapiens
gaucgcgccacugcacucuagcc

SEQ ID NO: 495228 - RNA, 14 nt, Homo sapiens
gaucugcaguuuuu

SEQ ID NO: 495229 - RNA, 21 nt, Homo sapiens
gaugaaguuguacaacaccag

SEQ ID NO: 495230 - RNA, 19 nt, Homo sapiens
gaugguggugcauccguga

SEQ ID NO: 495231 - RNA, 22 nt, Homo sapiens
gauguaccaggcucucgcacac

SEQ ID NO: 495232 - RNA, 13 nt, Homo sapiens
gauguauguguau

SEQ ID NO: 495233 - RNA, 17 nt, Homo sapiens
gaugucacaucuuggca

SEQ ID NO: 495234 - RNA, 16 nt, Homo sapiens
gauuaaggugauguga

SEQ ID NO: 495235 - RNA, 15 nt, Homo sapiens
gauucaccucuucuu

SEQ ID NO: 495236 - RNA, 18 nt, Homo sapiens
ucacaaaguuaaacguga

SEQ ID NO: 495237 - RNA, 17 nt, Homo sapiens
ucacagugucuguaaau

SEQ ID NO: 495238 - RNA, 22 nt, Homo sapiens
ucacauauuauuggucaagaaa

SEQ ID NO: 495239 - RNA, 18 nt, Homo sapiens
ucacaugccccucuuaga

SEQ ID NO: 495240 - RNA, 18 nt, Homo sapiens
ucaccaaacggugaauau

SEQ ID NO: 495241 - RNA, 15 nt, Homo sapiens
ucaccacccugcuca

SEQ ID NO: 495242 - RNA, 20 nt, Homo sapiens
ucacgaggucaggaguucaa

SEQ ID NO: 495243 - RNA, 14 nt, Homo sapiens
ucacugcucuucag

SEQ ID NO: 495244 - RNA, 20 nt, Homo sapiens
ucacuuuuuguggauuugug

SEQ ID NO: 495245 - RNA, 15 nt, Homo sapiens
ucagaaacaaagcau

SEQ ID NO: 495246 - RNA, 14 nt, Homo sapiens
ucagaaccauucac

SEQ ID NO: 495247 - RNA, 18 nt, Homo sapiens
ucagaggguagccuugau

SEQ ID NO: 495248 - RNA, 17 nt, Homo sapiens
ucagcaaacccaaagau

SEQ ID NO: 495249 - RNA, 15 nt, Homo sapiens
ucagcacagccucac

SEQ ID NO: 495250 - RNA, 13 nt, Homo sapiens
ucagcauggcauc

SEQ ID NO: 495251 - RNA, 15 nt, Homo sapiens
ucagccuuagcucuc

SEQ ID NO: 495252 - RNA, 17 nt, Homo sapiens
ucagcggucuucaggca

SEQ ID NO: 495253 - RNA, 17 nt, Homo sapiens
ucagcuucuuaauauaa

SEQ ID NO: 495254 - RNA, 21 nt, Homo sapiens
ucaggaacacucugaauucca

SEQ ID NO: 495255 - RNA, 16 nt, Homo sapiens
ucaggaagaagagaug

SEQ ID NO: 495256 - RNA, 21 nt, Homo sapiens
ucaggauugaggaugaacuca

SEQ ID NO: 495257 - RNA, 14 nt, Homo sapiens
ucaguaaaccuguc

SEQ ID NO: 495258 - RNA, 17 nt, Homo sapiens
ucagugcccauguguau

SEQ ID NO: 495259 - RNA, 15 nt, Homo sapiens
ucaguguacucugag

SEQ ID NO: 495260 - RNA, 21 nt, Homo sapiens
ucaguguacucugaguccuca

SEQ ID NO: 495261 - RNA, 20 nt, Homo sapiens
ucaguuaagaugcuuugaca

SEQ ID NO: 495262 - RNA, 21 nt, Homo sapiens
ucaguuacaguggcaguauug

SEQ ID NO: 495263 - RNA, 23 nt, Homo sapiens
ucaguuguaacauucuauuucaa

SEQ ID NO: 495264 - RNA, 20 nt, Homo sapiens
ucauaaccacccuagcuuua

SEQ ID NO: 495265 - RNA, 13 nt, Homo sapiens
ucauauaugcaaa

SEQ ID NO: 495266 - RNA, 12 nt, Homo sapiens
ucauauguucuc

SEQ ID NO: 495267 - RNA, 22 nt, Homo sapiens
ucauauugcuaccaaaaacuag

SEQ ID NO: 495268 - RNA, 21 nt, Homo sapiens
ucaucaacaaagaaauauuau

SEQ ID NO: 495269 - RNA, 15 nt, Homo sapiens
ucaucagaaacaauu

SEQ ID NO: 495270 - RNA, 15 nt, Homo sapiens
ucaucaucagucuua

SEQ ID NO: 495271 - RNA, 18 nt, Homo sapiens
ucaucccuucucuuccag

SEQ ID NO: 495272 - RNA, 15 nt, Homo sapiens
ucauccuccacugaa

SEQ ID NO: 495273 - RNA, 19 nt, Homo sapiens
ucauccucuuauaugugcc

SEQ ID NO: 495274 - RNA, 21 nt, Homo sapiens
ucaucgaaaauucauuucaca

SEQ ID NO: 495275 - RNA, 13 nt, Homo sapiens
ucaugaacagcuc

SEQ ID NO: 495276 - RNA, 13 nt, Homo sapiens
ucauuagcuguga

SEQ ID NO: 495277 - RNA, 22 nt, Homo sapiens
ucauucuuuuauacucagcuuu

SEQ ID NO: 495278 - RNA, 17 nt, Homo sapiens
ucauuguggccaguuua

SEQ ID NO: 495279 - RNA, 19 nt, Homo sapiens
uccaaagguuucaacugua

SEQ ID NO: 495280 - RNA, 14 nt, Homo sapiens
uccaaaguuaucca

SEQ ID NO: 495281 - RNA, 19 nt, Homo sapiens
uccaacccaugagugcuaa

SEQ ID NO: 495282 - RNA, 20 nt, Homo sapiens
uccaacguggggcagcacag

SEQ ID NO: 495283 - RNA, 17 nt, Homo sapiens
uccaacuacuccuagac

SEQ ID NO: 495284 - RNA, 22 nt, Homo sapiens
uccaagugaaugaguuuccagc

SEQ ID NO: 495285 - RNA, 14 nt, Homo sapiens
uccaauuugcacuu

SEQ ID NO: 495286 - RNA, 22 nt, Homo sapiens
uccacaauaacaaucuauggca

SEQ ID NO: 495287 - RNA, 20 nt, Homo sapiens
uccacucuacuaaugccucu

SEQ ID NO: 495288 - RNA, 13 nt, Homo sapiens
uccacuucaucca

SEQ ID NO: 495289 - RNA, 20 nt, Homo sapiens
uccagaaaucauacugcaua

SEQ ID NO: 495290 - RNA, 22 nt, Homo sapiens
uccagaaccgccgaaugaagca

SEQ ID NO: 495291 - RNA, 16 nt, Homo sapiens
uccagaggguugugau

SEQ ID NO: 495292 - RNA, 16 nt, Homo sapiens
uccagaggugagggag

SEQ ID NO: 495293 - RNA, 21 nt, Homo sapiens
uccagaugauccuugcacaga

SEQ ID NO: 495294 - RNA, 16 nt, Homo sapiens
uccagcuucacuguca

SEQ ID NO: 495295 - RNA, 18 nt, Homo sapiens
uccagucuuccaccugga

SEQ ID NO: 495296 - RNA, 22 nt, Homo sapiens
uccaguuagagucuucaucugu

SEQ ID NO: 495297 - RNA, 14 nt, Homo sapiens
uccaguucugauga

SEQ ID NO: 495298 - RNA, 15 nt, Homo sapiens
uccauacuucucuca

SEQ ID NO: 495299 - RNA, 22 nt, Homo sapiens
ucccaacaacauccauguccua

SEQ ID NO: 495300 - RNA, 14 nt, Homo sapiens
ucccaacucuugca

SEQ ID NO: 495301 - RNA, 21 nt, Homo sapiens
ucccacugccccugcaccugc

SEQ ID NO: 495302 - RNA, 12 nt, Homo sapiens
ucccagauccag

SEQ ID NO: 495303 - RNA, 15 nt, Homo sapiens
ucccagauccaggaa

SEQ ID NO: 495304 - RNA, 13 nt, Homo sapiens
ucccaggcacucu

SEQ ID NO: 495305 - RNA, 17 nt, Homo sapiens
ucccaugguagacugug

SEQ ID NO: 495306 - RNA, 22 nt, Homo sapiens
uccccaaaggccaacagcauug

SEQ ID NO: 495307 - RNA, 14 nt, Homo sapiens
uccccagaccagua

SEQ ID NO: 495308 - RNA, 21 nt, Homo sapiens
uccccuuuguguagaaagcca

SEQ ID NO: 495309 - RNA, 22 nt, Homo sapiens
ucccguuguguggguuuacucu

SEQ ID NO: 495310 - RNA, 14 nt, Homo sapiens
ucccugacacuguc

SEQ ID NO: 495311 - RNA, 22 nt, Homo sapiens
ucccugagaagccucaugggag

SEQ ID NO: 495312 - RNA, 19 nt, Homo sapiens
ucccugcuuaaauuucucc

SEQ ID NO: 495313 - RNA, 16 nt, Homo sapiens
ucccuuccccacaaua

SEQ ID NO: 495314 - RNA, 21 nt, Homo sapiens
ucccuuccccacaauaggcuu

SEQ ID NO: 495315 - RNA, 18 nt, Homo sapiens
ucccuuccucccaaaagu

SEQ ID NO: 495316 - RNA, 14 nt, Homo sapiens
ucccuuguccuuga

SEQ ID NO: 495317 - RNA, 17 nt, Homo sapiens
uccggaggcugaggcag

SEQ ID NO: 495318 - RNA, 12 nt, Homo sapiens
uccguguaaaau

SEQ ID NO: 495319 - RNA, 17 nt, Homo sapiens
uccuaagcaacuaggcc

SEQ ID NO: 495320 - RNA, 13 nt, Homo sapiens
uccucacugaaaa

SEQ ID NO: 495321 - RNA, 11 nt, Homo sapiens
uccucuuucac

SEQ ID NO: 495322 - RNA, 16 nt, Homo sapiens
uccugccauagucuua

SEQ ID NO: 495323 - RNA, 13 nt, Homo sapiens
uccuggagugaua

SEQ ID NO: 495324 - RNA, 18 nt, Homo sapiens
uccuggggggccugaaag

SEQ ID NO: 495325 - RNA, 22 nt, Homo sapiens
uccuguaaaauaugaaauuaua

SEQ ID NO: 495326 - RNA, 16 nt, Homo sapiens
uccuguauuccugacc

SEQ ID NO: 495327 - RNA, 14 nt, Homo sapiens
uccuguuuugcaaa

SEQ ID NO: 495328 - RNA, 15 nt, Homo sapiens
uccuguuuugcaaau

SEQ ID NO: 495329 - RNA, 16 nt, Homo sapiens
uccuguuuuugcaaaa

SEQ ID NO: 495330 - RNA, 19 nt, Homo sapiens
uccuucacucccugucaua

SEQ ID NO: 495331 - RNA, 24 nt, Homo sapiens
uccuuccaaccuguucacgugacu

SEQ ID NO: 495332 - RNA, 12 nt, Homo sapiens
uccuuggggaca

SEQ ID NO: 495333 - RNA, 17 nt, Homo sapiens
uccuuggggacaucuca

SEQ ID NO: 495334 - RNA, 14 nt, Homo sapiens
uccuuuaugugaug

SEQ ID NO: 495335 - RNA, 21 nt, Homo sapiens
uccuuuauuauaaucaaagcu

SEQ ID NO: 495336 - RNA, 16 nt, Homo sapiens
uccuuuucccaaagca

SEQ ID NO: 495337 - RNA, 15 nt, Homo sapiens
ucgcacuacaucuga

SEQ ID NO: 495338 - RNA, 14 nt, Homo sapiens
ucgccguggcugcg

SEQ ID NO: 495339 - RNA, 23 nt, Homo sapiens
ucgguaaaccgaggacccaugaa

SEQ ID NO: 495340 - RNA, 17 nt, Homo sapiens
ucguccccagaccagua

SEQ ID NO: 495341 - RNA, 19 nt, Homo sapiens
ucguccuuagaauacugua

SEQ ID NO: 495342 - RNA, 14 nt, Homo sapiens
ucgugcaacuguag

SEQ ID NO: 495343 - RNA, 12 nt, Homo sapiens
ucguuacucuaa

SEQ ID NO: 495344 - RNA, 23 nt, Homo sapiens
ucuaacucugauguaaaugaagu

SEQ ID NO: 495345 - RNA, 20 nt, Homo sapiens
ucuaauaaacacagauuauu

SEQ ID NO: 495346 - RNA, 13 nt, Homo sapiens
ucuaauccuaucu

SEQ ID NO: 495347 - RNA, 18 nt, Homo sapiens
ucuacuggacuguaaaau

SEQ ID NO: 495348 - RNA, 17 nt, Homo sapiens
ucuacuguucaauuuca

SEQ ID NO: 495349 - RNA, 16 nt, Homo sapiens
ucuacuucuugugcuu

SEQ ID NO: 495350 - RNA, 21 nt, Homo sapiens
ucuagcacuuccuugccaguc

SEQ ID NO: 495351 - RNA, 13 nt, Homo sapiens
ucuauggcaagca

SEQ ID NO: 495352 - RNA, 15 nt, Homo sapiens
ucuauuucaacuuca

SEQ ID NO: 495353 - RNA, 16 nt, Homo sapiens
ucuauuucaacuucag

SEQ ID NO: 495354 - RNA, 16 nt, Homo sapiens
ucucaacuuacauaug

SEQ ID NO: 495355 - RNA, 16 nt, Homo sapiens
ucucacgauaugcaag

SEQ ID NO: 495356 - RNA, 13 nt, Homo sapiens
ucucagcacuuug

SEQ ID NO: 495357 - RNA, 18 nt, Homo sapiens
ucucagcgcaacagcugu

SEQ ID NO: 495358 - RNA, 22 nt, Homo sapiens
ucucauccacugugcuucuuaa

SEQ ID NO: 495359 - RNA, 13 nt, Homo sapiens
ucuccacagggac

SEQ ID NO: 495360 - RNA, 13 nt, Homo sapiens
ucuccaguggauu

SEQ ID NO: 495361 - RNA, 22 nt, Homo sapiens
ucuccaucagaggacaccugua

SEQ ID NO: 495362 - RNA, 16 nt, Homo sapiens
ucuccccuccaaguga

SEQ ID NO: 495363 - RNA, 18 nt, Homo sapiens
ucuccugugcaccugacu

SEQ ID NO: 495364 - RNA, 14 nt, Homo sapiens
ucucuagacaucua

SEQ ID NO: 495365 - RNA, 15 nt, Homo sapiens
ucucuccagucuucc

SEQ ID NO: 495366 - RNA, 13 nt, Homo sapiens
ucucuccaucaga

SEQ ID NO: 495367 - RNA, 12 nt, Homo sapiens
ucucugugcugg

SEQ ID NO: 495368 - RNA, 14 nt, Homo sapiens
ucucuuagugguua

SEQ ID NO: 495369 - RNA, 22 nt, Homo sapiens
ucucuuggaacugcaccaccga

SEQ ID NO: 495370 - RNA, 13 nt, Homo sapiens
ucugaaacuaaug

SEQ ID NO: 495371 - RNA, 15 nt, Homo sapiens
ucugaaacuaaugaa

SEQ ID NO: 495372 - RNA, 20 nt, Homo sapiens
ucugaacaaagagagcucau

SEQ ID NO: 495373 - RNA, 21 nt, Homo sapiens
ucugaauggggcuuuccugau

SEQ ID NO: 495374 - RNA, 23 nt, Homo sapiens
uuuuuaaaauucuaaguagagua

SEQ ID NO: 495375 - RNA, 15 nt, Homo sapiens
uuuuuaagccuuuga

SEQ ID NO: 495376 - RNA, 13 nt, Homo sapiens
uuuuuucccccac

SEQ ID NO: 495377 - RNA, 13 nt, Homo sapiens
aaaaaaaaugaga

SEQ ID NO: 495378 - RNA, 12 nt, Homo sapiens
aaaaaaagggag

SEQ ID NO: 495379 - RNA, 12 nt, Homo sapiens
aaaaaauaugcu

SEQ ID NO: 495380 - RNA, 18 nt, Homo sapiens
aaaaaccucuuagcuuuu

SEQ ID NO: 495381 - RNA, 17 nt, Homo sapiens
aaaaaguuaaucuucau

SEQ ID NO: 495382 - RNA, 20 nt, Homo sapiens
aaaaauaguguguccaugca

SEQ ID NO: 495383 - RNA, 18 nt, Homo sapiens
aaaacaugauuguuuaca

SEQ ID NO: 495384 - RNA, 14 nt, Homo sapiens
aaaacugucccuuu

SEQ ID NO: 495385 - RNA, 19 nt, Homo sapiens
aaaacuguggcacuuuuca

SEQ ID NO: 495386 - RNA, 18 nt, Homo sapiens
aaaacuuuaaucccacuu

SEQ ID NO: 495387 - RNA, 21 nt, Homo sapiens
aaaacuuuuugauuugaacca

SEQ ID NO: 495388 - RNA, 12 nt, Homo sapiens
aaaagaaaaaga

SEQ ID NO: 495389 - RNA, 18 nt, Homo sapiens
aaaagcccuuuccaaagg

SEQ ID NO: 495390 - RNA, 16 nt, Homo sapiens
aaaaggaugucuuuca

SEQ ID NO: 495391 - RNA, 13 nt, Homo sapiens
aaaaggauuaugu

SEQ ID NO: 495392 - RNA, 13 nt, Homo sapiens
aaaagugucucaa

SEQ ID NO: 495393 - RNA, 14 nt, Homo sapiens
aaaaucuugagaau

SEQ ID NO: 495394 - RNA, 12 nt, Homo sapiens
aaaaugagacaa

SEQ ID NO: 495395 - RNA, 19 nt, Homo sapiens
aaaaugcaccucauuccag

SEQ ID NO: 495396 - RNA, 22 nt, Homo sapiens
aaaauguucugacagcauuuca

SEQ ID NO: 495397 - RNA, 15 nt, Homo sapiens
aaacaaagaguagaa

SEQ ID NO: 495398 - RNA, 11 nt, Homo sapiens
aaacaaauggc

SEQ ID NO: 495399 - RNA, 18 nt, Homo sapiens
aaacagauuuaagcaaga

SEQ ID NO: 495400 - RNA, 13 nt, Homo sapiens
aaacagcugcaug

SEQ ID NO: 495401 - RNA, 15 nt, Homo sapiens
aaacagggugggcaa

SEQ ID NO: 495402 - RNA, 17 nt, Homo sapiens
aaacaugauuguuuaca

SEQ ID NO: 495403 - RNA, 13 nt, Homo sapiens
aaacauugccuua

SEQ ID NO: 495404 - RNA, 14 nt, Homo sapiens
aaaccagacucacu

SEQ ID NO: 495405 - RNA, 21 nt, Homo sapiens
aaacccagauugaagcuaaaa

SEQ ID NO: 495406 - RNA, 13 nt, Homo sapiens
aaaccccaucucu

SEQ ID NO: 495407 - RNA, 16 nt, Homo sapiens
aaacccuuauacucac

SEQ ID NO: 495408 - RNA, 11 nt, Homo sapiens
aaacucaaaau

SEQ ID NO: 495409 - RNA, 19 nt, Homo sapiens
aaacuuuucagcagcauuu

SEQ ID NO: 495410 - RNA, 17 nt, Homo sapiens
aaagagaaaaagcccuc

SEQ ID NO: 495411 - RNA, 16 nt, Homo sapiens
aaagauauuguaucuc

SEQ ID NO: 495412 - RNA, 23 nt, Homo sapiens
aaagccuacccuauucuauccau

SEQ ID NO: 495413 - RNA, 19 nt, Homo sapiens
aaagccuugugaucacuuu

SEQ ID NO: 495414 - RNA, 20 nt, Homo sapiens
aaagcuuaaacauugccuua

SEQ ID NO: 495415 - RNA, 15 nt, Homo sapiens
aaaggagcuuucuca

SEQ ID NO: 495416 - RNA, 21 nt, Homo sapiens
aaagggaccuucgugcaacug

SEQ ID NO: 495417 - RNA, 20 nt, Homo sapiens
aaagggagaauaaaauuccu

SEQ ID NO: 495418 - RNA, 18 nt, Homo sapiens
aaaguacagguacuuugu

SEQ ID NO: 495419 - RNA, 13 nt, Homo sapiens
aaaguauuauuca

SEQ ID NO: 495420 - RNA, 13 nt, Homo sapiens
aaagucacauaaa

SEQ ID NO: 495421 - RNA, 21 nt, Homo sapiens
aaagucaccacuccauuccca

SEQ ID NO: 495422 - RNA, 22 nt, Homo sapiens
aaagucaccacuccauucccaa

SEQ ID NO: 495423 - RNA, 19 nt, Homo sapiens
aaagucugucaugccaaaa

SEQ ID NO: 495424 - RNA, 14 nt, Homo sapiens
aaagugacacagca

SEQ ID NO: 495425 - RNA, 13 nt, Homo sapiens
aaagugccaaaau

SEQ ID NO: 495426 - RNA, 19 nt, Homo sapiens
aaaguggaguguauuuaca

SEQ ID NO: 495427 - RNA, 15 nt, Homo sapiens
aaaguuaaacgugau

SEQ ID NO: 495428 - RNA, 16 nt, Homo sapiens
aaaguuuugaguguua

SEQ ID NO: 495429 - RNA, 14 nt, Homo sapiens
aaaguuuugccuau

SEQ ID NO: 495430 - RNA, 17 nt, Homo sapiens
aaauaaaaauagcuaua

SEQ ID NO: 495431 - RNA, 18 nt, Homo sapiens
aaauaaaaggucuaugcu

SEQ ID NO: 495432 - RNA, 23 nt, Homo sapiens
aaauaaggccucauccuccacug

SEQ ID NO: 495433 - RNA, 15 nt, Homo sapiens
aaauagcugccuuuu

SEQ ID NO: 495434 - RNA, 15 nt, Homo sapiens
aaauaguuguccaua

SEQ ID NO: 495435 - RNA, 19 nt, Homo sapiens
aaauauauauagugcuaua

SEQ ID NO: 495436 - RNA, 19 nt, Homo sapiens
aaauauauauauauauaca

SEQ ID NO: 495437 - RNA, 21 nt, Homo sapiens
aaauauguccauaucuaacca

SEQ ID NO: 495438 - RNA, 16 nt, Homo sapiens
aaauauugacaaguuu

SEQ ID NO: 495439 - RNA, 21 nt, Homo sapiens
aaauauuugugaaagugccaa

SEQ ID NO: 495440 - RNA, 18 nt, Homo sapiens
aaaucaauucauugugua

SEQ ID NO: 495441 - RNA, 17 nt, Homo sapiens
aaaucauacugcauaca

SEQ ID NO: 495442 - RNA, 16 nt, Homo sapiens
aaaucauucagaucau

SEQ ID NO: 495443 - RNA, 18 nt, Homo sapiens
aaauccgggucaagugaa

SEQ ID NO: 495444 - RNA, 21 nt, Homo sapiens
aaaugauaucuuauuucuaca

SEQ ID NO: 495445 - RNA, 21 nt, Homo sapiens
aaaugcaccucauuccaguca

SEQ ID NO: 495446 - RNA, 19 nt, Homo sapiens
aaauguauauacacauaua

SEQ ID NO: 495447 - RNA, 18 nt, Homo sapiens
aaaugucuucauguugau

SEQ ID NO: 495448 - RNA, 13 nt, Homo sapiens
aaaugugugacug

SEQ ID NO: 495449 - RNA, 21 nt, Homo sapiens
aaauuagggcucuaauuuccu

SEQ ID NO: 495450 - RNA, 19 nt, Homo sapiens
aaauuauaucaaggucuca

SEQ ID NO: 495451 - RNA, 23 nt, Homo sapiens
aaauuauguuuucauccauuaaa

SEQ ID NO: 495452 - RNA, 15 nt, Homo sapiens
aaauuccuaucucau

SEQ ID NO: 495453 - RNA, 22 nt, Homo sapiens
aaauuguacaagauaaguucca

SEQ ID NO: 495454 - RNA, 15 nt, Homo sapiens
aaauuuaauuaauua

SEQ ID NO: 495455 - RNA, 13 nt, Homo sapiens
aacaaacauggau

SEQ ID NO: 495456 - RNA, 20 nt, Homo sapiens
aacaaacauggauacuuccu

SEQ ID NO: 495457 - RNA, 14 nt, Homo sapiens
aacaaacugcacau

SEQ ID NO: 495458 - RNA, 21 nt, Homo sapiens
aacaaagagagcucaucauca

SEQ ID NO: 495459 - RNA, 17 nt, Homo sapiens
aacaaaucauuucuaaa

SEQ ID NO: 495460 - RNA, 20 nt, Homo sapiens
aacaacauccauguccuaug

SEQ ID NO: 495461 - RNA, 16 nt, Homo sapiens
aacaagaucauuaucu

SEQ ID NO: 495462 - RNA, 15 nt, Homo sapiens
aacaagcaguacgau

SEQ ID NO: 495463 - RNA, 14 nt, Homo sapiens
aacaauucaaguga

SEQ ID NO: 495464 - RNA, 22 nt, Homo sapiens
aacaauuuucagauuugcacaa

SEQ ID NO: 495465 - RNA, 22 nt, Homo sapiens
aacacacaccaauuggaugaua

SEQ ID NO: 495466 - RNA, 14 nt, Homo sapiens
aacacacaugcaca

SEQ ID NO: 495467 - RNA, 11 nt, Homo sapiens
aacacagugac

SEQ ID NO: 495468 - RNA, 14 nt, Homo sapiens
aacaccuucaucca

SEQ ID NO: 495469 - RNA, 15 nt, Homo sapiens
aacagaaacaugcca

SEQ ID NO: 495470 - RNA, 17 nt, Homo sapiens
aacagaauuaaguggau

SEQ ID NO: 495471 - RNA, 16 nt, Homo sapiens
aacagauuuaagcaag

SEQ ID NO: 495472 - RNA, 20 nt, Homo sapiens
aauggugguuguuucuucca

SEQ ID NO: 495473 - RNA, 21 nt, Homo sapiens
aauggugguuguuucuuccaa

SEQ ID NO: 495474 - RNA, 17 nt, Homo sapiens
aauguaguucauacuug

SEQ ID NO: 495475 - RNA, 15 nt, Homo sapiens
aauguauauacacau

SEQ ID NO: 495476 - RNA, 23 nt, Homo sapiens
aauguauauugauguaacugugu

SEQ ID NO: 495477 - RNA, 17 nt, Homo sapiens
aauguccuuucauuugu

SEQ ID NO: 495478 - RNA, 13 nt, Homo sapiens
aaugucucaaaau

SEQ ID NO: 495479 - RNA, 20 nt, Homo sapiens
aauguguauuuuucaaggca

SEQ ID NO: 495480 - RNA, 15 nt, Homo sapiens
aauguuuucacugua

SEQ ID NO: 495481 - RNA, 17 nt, Homo sapiens
aauguuuuguaaacuuu

SEQ ID NO: 495482 - RNA, 19 nt, Homo sapiens
aauuaaaaaguuaaucuuc

SEQ ID NO: 495483 - RNA, 23 nt, Homo sapiens
aauuaacuccuucaauauuucua

SEQ ID NO: 495484 - RNA, 19 nt, Homo sapiens
aauuaaguaaacuaaugag

SEQ ID NO: 495485 - RNA, 22 nt, Homo sapiens
aauuaauucucagauuccugcc

SEQ ID NO: 495486 - RNA, 19 nt, Homo sapiens
aauuagacauaccucucaa

SEQ ID NO: 495487 - RNA, 12 nt, Homo sapiens
aauuauccuccu

SEQ ID NO: 495488 - RNA, 21 nt, Homo sapiens
aauucaaagaaucaccuaauu

SEQ ID NO: 495489 - RNA, 21 nt, Homo sapiens
aauuuccuuaaagcaagcuca

SEQ ID NO: 495490 - RNA, 12 nt, Homo sapiens
aauuucucuuaa

SEQ ID NO: 495491 - RNA, 16 nt, Homo sapiens
aauuugcuuagccuuu

SEQ ID NO: 495492 - RNA, 18 nt, Homo sapiens
aauuugugcaucagaaaa

SEQ ID NO: 495493 - RNA, 16 nt, Homo sapiens
aauuuguucugugcaa

SEQ ID NO: 495494 - RNA, 18 nt, Homo sapiens
aauuuuaaguacuuugcu

SEQ ID NO: 495495 - RNA, 16 nt, Homo sapiens
aauuuuauguucacuu

SEQ ID NO: 495496 - RNA, 16 nt, Homo sapiens
aauuuucagauuugca

SEQ ID NO: 495497 - RNA, 20 nt, Homo sapiens
aauuuucagauuugcacaaa

SEQ ID NO: 495498 - RNA, 14 nt, Homo sapiens
aauuuuggaacaaa

SEQ ID NO: 495499 - RNA, 16 nt, Homo sapiens
aauuuuuuccuaccau

SEQ ID NO: 495500 - RNA, 19 nt, Homo sapiens
acaaacauagacagaugug

SEQ ID NO: 495501 - RNA, 20 nt, Homo sapiens
acaaacauggauacuuccug

SEQ ID NO: 495502 - RNA, 19 nt, Homo sapiens
acaaagcauuugacuuucu

SEQ ID NO: 495503 - RNA, 23 nt, Homo sapiens
acaaauaccuuuaaauugauaaa

SEQ ID NO: 495504 - RNA, 20 nt, Homo sapiens
acaaauggcuuguucaguca

SEQ ID NO: 495505 - RNA, 15 nt, Homo sapiens
acaaaugugugacug

SEQ ID NO: 495506 - RNA, 14 nt, Homo sapiens
acaacacacaccaa

SEQ ID NO: 495507 - RNA, 14 nt, Homo sapiens
acaaccauguucuu

SEQ ID NO: 495508 - RNA, 18 nt, Homo sapiens
acaacuaaaaaaaaugca

SEQ ID NO: 495509 - RNA, 16 nt, Homo sapiens
acaagaaaaaaagcuu

SEQ ID NO: 495510 - RNA, 20 nt, Homo sapiens
acaagaaaaaaagcuuuuau

SEQ ID NO: 495511 - RNA, 16 nt, Homo sapiens
acaagaauggucuuuc

SEQ ID NO: 495512 - RNA, 19 nt, Homo sapiens
acaagacuguaaauuccaa

SEQ ID NO: 495513 - RNA, 22 nt, Homo sapiens
acaagacuguaaauuccaaaga

SEQ ID NO: 495514 - RNA, 17 nt, Homo sapiens
acaagcuaggugcuaau

SEQ ID NO: 495515 - RNA, 18 nt, Homo sapiens
acaauacaacacauugaa

SEQ ID NO: 495516 - RNA, 16 nt, Homo sapiens
acaauauaucuugucu

SEQ ID NO: 495517 - RNA, 13 nt, Homo sapiens
acaaucagaccaa

SEQ ID NO: 495518 - RNA, 20 nt, Homo sapiens
acaaucaugaacagcucuga

SEQ ID NO: 495519 - RNA, 13 nt, Homo sapiens
acaaugcuuucca

SEQ ID NO: 495520 - RNA, 17 nt, Homo sapiens
acaauuaacugagcaua

SEQ ID NO: 495521 - RNA, 23 nt, Homo sapiens
acaauuauaaacucauuuugcuu

SEQ ID NO: 495522 - RNA, 12 nt, Homo sapiens
acaauuuacuuu

SEQ ID NO: 495523 - RNA, 13 nt, Homo sapiens
acaauuuacuuuu

SEQ ID NO: 495524 - RNA, 15 nt, Homo sapiens
acaauuuacuuuuaa

SEQ ID NO: 495525 - RNA, 13 nt, Homo sapiens
acacaaauccaac

SEQ ID NO: 495526 - RNA, 16 nt, Homo sapiens
acacacaagcagacac

SEQ ID NO: 495527 - RNA, 14 nt, Homo sapiens
acacaccuugccca

SEQ ID NO: 495528 - RNA, 19 nt, Homo sapiens
acacacgcaaauacaugcc

SEQ ID NO: 495529 - RNA, 22 nt, Homo sapiens
acacagcugcagagacagagag

SEQ ID NO: 495530 - RNA, 18 nt, Homo sapiens
acacaggcccaugcccuc

SEQ ID NO: 495531 - RNA, 13 nt, Homo sapiens
acaccuagacucu

SEQ ID NO: 495532 - RNA, 22 nt, Homo sapiens
acaccuguacuggagagcaaca

SEQ ID NO: 495533 - RNA, 21 nt, Homo sapiens
acacgcugcaccuaaagccua

SEQ ID NO: 495534 - RNA, 15 nt, Homo sapiens
acacguuugccaaau

SEQ ID NO: 495535 - RNA, 13 nt, Homo sapiens
acacucacuggca

SEQ ID NO: 495536 - RNA, 19 nt, Homo sapiens
acacugaauaaaauauuga

SEQ ID NO: 495537 - RNA, 11 nt, Homo sapiens
acacugugaac

SEQ ID NO: 495538 - RNA, 13 nt, Homo sapiens
acacuugcuuuau

SEQ ID NO: 495539 - RNA, 14 nt, Homo sapiens
acacuuguauaaau

SEQ ID NO: 495540 - RNA, 23 nt, Homo sapiens
acagaaauugguaccuugcacac

SEQ ID NO: 495541 - RNA, 19 nt, Homo sapiens
acagaacuguguacuguau

SEQ ID NO: 495542 - RNA, 20 nt, Homo sapiens
acagagagggggccaccucc

SEQ ID NO: 495543 - RNA, 20 nt, Homo sapiens
acagaguaagacucugucuc

SEQ ID NO: 495544 - RNA, 21 nt, Homo sapiens
acagauccugaaagaaagcuu

SEQ ID NO: 495545 - RNA, 13 nt, Homo sapiens
acagcaaugcaga

SEQ ID NO: 495546 - RNA, 23 nt, Homo sapiens
acagcagcuucaccagagcauuu

SEQ ID NO: 495547 - RNA, 11 nt, Homo sapiens
acagcauuuca

SEQ ID NO: 495548 - RNA, 17 nt, Homo sapiens
acagcccaggcaucucc

SEQ ID NO: 495549 - RNA, 14 nt, Homo sapiens
acagcucugagauc

SEQ ID NO: 495550 - RNA, 14 nt, Homo sapiens
acagcugcagagac

SEQ ID NO: 495551 - RNA, 14 nt, Homo sapiens
acagcuggacaccc

SEQ ID NO: 495552 - RNA, 16 nt, Homo sapiens
acaggacaacuuuaca

SEQ ID NO: 495553 - RNA, 20 nt, Homo sapiens
acaggacaggaaaguggcac

SEQ ID NO: 495554 - RNA, 20 nt, Homo sapiens
acagucaggaagccuccugc

SEQ ID NO: 495555 - RNA, 16 nt, Homo sapiens
acagucucuuucuucc

SEQ ID NO: 495556 - RNA, 16 nt, Homo sapiens
acaguguuuacuuuaa

SEQ ID NO: 495557 - RNA, 16 nt, Homo sapiens
acaguugguuuugcau

SEQ ID NO: 495558 - RNA, 23 nt, Homo sapiens
acaguugguuuugcaugucugca

SEQ ID NO: 495559 - RNA, 23 nt, Homo sapiens
acaguuuauuuuuauacuuucag

SEQ ID NO: 495560 - RNA, 19 nt, Homo sapiens
acauaauacauuaauacuu

SEQ ID NO: 495561 - RNA, 23 nt, Homo sapiens
acauaccaaagcugcugcacagc

SEQ ID NO: 495562 - RNA, 23 nt, Homo sapiens
acauaccucucaacuuacauaug

SEQ ID NO: 495563 - RNA, 15 nt, Homo sapiens
acauaguuauguaaa

SEQ ID NO: 495564 - RNA, 13 nt, Homo sapiens
acauccauuccca

SEQ ID NO: 495565 - RNA, 14 nt, Homo sapiens
acaugaaaacagaa

SEQ ID NO: 495566 - RNA, 18 nt, Homo sapiens
acaugacccguacacacc

SEQ ID NO: 495567 - RNA, 18 nt, Homo sapiens
acaugcuuagcuuaucuu

SEQ ID NO: 495568 - RNA, 18 nt, Homo sapiens
acaugguaucucuuucuc

SEQ ID NO: 495569 - RNA, 15 nt, Homo sapiens
acaugguuaccucug

SEQ ID NO: 495570 - RNA, 16 nt, Homo sapiens
acauuccaauuugcac

SEQ ID NO: 495571 - RNA, 23 nt, Homo sapiens
acauucuuggucacaaagcuauu

SEQ ID NO: 495572 - RNA, 14 nt, Homo sapiens
acauuguaaaugau

SEQ ID NO: 495573 - RNA, 21 nt, Homo sapiens
accaaaaaagaaaguuuauuu

SEQ ID NO: 495574 - RNA, 19 nt, Homo sapiens
accaaaacagugaagauga

SEQ ID NO: 495575 - RNA, 21 nt, Homo sapiens
accaaugccaagauaauucac

SEQ ID NO: 495576 - RNA, 15 nt, Homo sapiens
accacuauucaauuu

SEQ ID NO: 495577 - RNA, 17 nt, Homo sapiens
accacuccauucccaac

SEQ ID NO: 495578 - RNA, 22 nt, Homo sapiens
accacuuucccacacugugaac

SEQ ID NO: 495579 - RNA, 19 nt, Homo sapiens
accagaauggggacaucuu

SEQ ID NO: 495580 - RNA, 13 nt, Homo sapiens
accagagcauuuc

SEQ ID NO: 495581 - RNA, 15 nt, Homo sapiens
accagagcauuucca

SEQ ID NO: 495582 - RNA, 22 nt, Homo sapiens
accauuauggcuuugugcuugu

SEQ ID NO: 495583 - RNA, 23 nt, Homo sapiens
acccaacgcggugcgcaccaacu

SEQ ID NO: 495584 - RNA, 17 nt, Homo sapiens
acccaaguuaugcaucc

SEQ ID NO: 495585 - RNA, 22 nt, Homo sapiens
acccaaguuuauuauaucauua

SEQ ID NO: 495586 - RNA, 16 nt, Homo sapiens
acccaaucagaugccu

SEQ ID NO: 495587 - RNA, 18 nt, Homo sapiens
acccaugaaacagcagcu

SEQ ID NO: 495588 - RNA, 16 nt, Homo sapiens
acccccagugcucaca

SEQ ID NO: 495589 - RNA, 18 nt, Homo sapiens
accccuccaugauuccaa

SEQ ID NO: 495590 - RNA, 22 nt, Homo sapiens
acccgccgcugccaccaucucc

SEQ ID NO: 495591 - RNA, 19 nt, Homo sapiens
acccuaggcagacaccagg

SEQ ID NO: 495592 - RNA, 19 nt, Homo sapiens
acccucccaaaacagggaa

SEQ ID NO: 495593 - RNA, 23 nt, Homo sapiens
acccugaaauauuuucuacuuua

SEQ ID NO: 495594 - RNA, 14 nt, Homo sapiens
acccugaaucagag

SEQ ID NO: 495595 - RNA, 16 nt, Homo sapiens
acccugaggguuucca

SEQ ID NO: 495596 - RNA, 23 nt, Homo sapiens
accgaaggugacagccgucccaa

SEQ ID NO: 495597 - RNA, 15 nt, Homo sapiens
accuauaauaccagc

SEQ ID NO: 495598 - RNA, 22 nt, Homo sapiens
accuccuccuccaguucugaug

SEQ ID NO: 495599 - RNA, 18 nt, Homo sapiens
accucgagaauuguuacc

SEQ ID NO: 495600 - RNA, 14 nt, Homo sapiens
accucuuagcuuuu

SEQ ID NO: 495601 - RNA, 19 nt, Homo sapiens
accugacagcaaacacagu

SEQ ID NO: 495602 - RNA, 17 nt, Homo sapiens
accugcacaaacauaga

SEQ ID NO: 495603 - RNA, 18 nt, Homo sapiens
accugcguuuucauuugu

SEQ ID NO: 495604 - RNA, 14 nt, Homo sapiens
accugcucugcuga

SEQ ID NO: 495605 - RNA, 13 nt, Homo sapiens
accuguacacaca

SEQ ID NO: 495606 - RNA, 13 nt, Homo sapiens
accuguacacacu

SEQ ID NO: 495607 - RNA, 13 nt, Homo sapiens
accugucugcucc

SEQ ID NO: 495608 - RNA, 13 nt, Homo sapiens
accuucugaugaa

SEQ ID NO: 495609 - RNA, 23 nt, Homo sapiens
agcauuuccaacaccacagacac

SEQ ID NO: 495610 - RNA, 17 nt, Homo sapiens
agcauuugguacacacu

SEQ ID NO: 495611 - RNA, 19 nt, Homo sapiens
agccaugagugugggccau

SEQ ID NO: 495612 - RNA, 20 nt, Homo sapiens
agcccagucauauguucuca

SEQ ID NO: 495613 - RNA, 14 nt, Homo sapiens
agccccacuccaca

SEQ ID NO: 495614 - RNA, 15 nt, Homo sapiens
agcccucagaacuuu

SEQ ID NO: 495615 - RNA, 18 nt, Homo sapiens
agcccugauugcgcaaaa

SEQ ID NO: 495616 - RNA, 17 nt, Homo sapiens
agcccugcagagcacaa

SEQ ID NO: 495617 - RNA, 23 nt, Homo sapiens
agccuacuagggaccuggggaag

SEQ ID NO: 495618 - RNA, 16 nt, Homo sapiens
agccucagaaagggau

SEQ ID NO: 495619 - RNA, 20 nt, Homo sapiens
agccucaugggagucaggga

SEQ ID NO: 495620 - RNA, 19 nt, Homo sapiens
agccucuucugccaagaga

SEQ ID NO: 495621 - RNA, 19 nt, Homo sapiens
agccugcguggccuggggc

SEQ ID NO: 495622 - RNA, 19 nt, Homo sapiens
agccuuaagucuuacuguu

SEQ ID NO: 495623 - RNA, 18 nt, Homo sapiens
agccuuuaauaggcuugu

SEQ ID NO: 495624 - RNA, 17 nt, Homo sapiens
agccuuuagaacacugu

SEQ ID NO: 495625 - RNA, 23 nt, Homo sapiens
agccuuuaucuaccaacuuucaa

SEQ ID NO: 495626 - RNA, 15 nt, Homo sapiens
agcgcagcugcauuu

SEQ ID NO: 495627 - RNA, 21 nt, Homo sapiens
agcuacauauaugaacaaauc

SEQ ID NO: 495628 - RNA, 13 nt, Homo sapiens
agcuagcugagua

SEQ ID NO: 495629 - RNA, 20 nt, Homo sapiens
agcucaauuguuaaugugau

SEQ ID NO: 495630 - RNA, 17 nt, Homo sapiens
agcucacggaacuggag

SEQ ID NO: 495631 - RNA, 19 nt, Homo sapiens
agcucagaaacgaaaucua

SEQ ID NO: 495632 - RNA, 20 nt, Homo sapiens
agcucagcauuguguacaaa

SEQ ID NO: 495633 - RNA, 14 nt, Homo sapiens
agcugcauggcaca

SEQ ID NO: 495634 - RNA, 16 nt, Homo sapiens
agcuggaccugagcua

SEQ ID NO: 495635 - RNA, 17 nt, Homo sapiens
agcuggauauaauguau

SEQ ID NO: 495636 - RNA, 18 nt, Homo sapiens
agcuggccaccauggcac

SEQ ID NO: 495637 - RNA, 11 nt, Homo sapiens
agcugugauuu

SEQ ID NO: 495638 - RNA, 20 nt, Homo sapiens
agcuucaccagagcauuucc

SEQ ID NO: 495639 - RNA, 17 nt, Homo sapiens
agcuuccagaugauccu

SEQ ID NO: 495640 - RNA, 12 nt, Homo sapiens
agcuuuucugca

SEQ ID NO: 495641 - RNA, 17 nt, Homo sapiens
aggaaaaauaugugaag

SEQ ID NO: 495642 - RNA, 14 nt, Homo sapiens
aggaaaagaaucuc

SEQ ID NO: 495643 - RNA, 13 nt, Homo sapiens
aggaaacauagua

SEQ ID NO: 495644 - RNA, 17 nt, Homo sapiens
aggaaauaucugugaag

SEQ ID NO: 495645 - RNA, 15 nt, Homo sapiens
aggaacacaugcaca

SEQ ID NO: 495646 - RNA, 13 nt, Homo sapiens
aggaagagugcaa

SEQ ID NO: 495647 - RNA, 15 nt, Homo sapiens
aggaaguuaugccaa

SEQ ID NO: 495648 - RNA, 12 nt, Homo sapiens
aggacagcauua

SEQ ID NO: 495649 - RNA, 13 nt, Homo sapiens
aggacccaugaaa

SEQ ID NO: 495650 - RNA, 18 nt, Homo sapiens
aggacuguugacauccaa

SEQ ID NO: 495651 - RNA, 16 nt, Homo sapiens
aggagagaacagggau

SEQ ID NO: 495652 - RNA, 15 nt, Homo sapiens
aggagagguccacuu

SEQ ID NO: 495653 - RNA, 15 nt, Homo sapiens
aggaucugaggacaa

SEQ ID NO: 495654 - RNA, 21 nt, Homo sapiens
aggauggcguguccccugccu

SEQ ID NO: 495655 - RNA, 15 nt, Homo sapiens
aggauguauguguau

SEQ ID NO: 495656 - RNA, 20 nt, Homo sapiens
aggcaauggugaacugucau

SEQ ID NO: 495657 - RNA, 15 nt, Homo sapiens
aggcacaggcucagu

SEQ ID NO: 495658 - RNA, 17 nt, Homo sapiens
aggcaggugacagugag

SEQ ID NO: 495659 - RNA, 18 nt, Homo sapiens
aggcauuuuuguaaugag

SEQ ID NO: 495660 - RNA, 23 nt, Homo sapiens
aggcauuuuuguaaugagccauu

SEQ ID NO: 495661 - RNA, 17 nt, Homo sapiens
aggccaggcuugagaga

SEQ ID NO: 495662 - RNA, 19 nt, Homo sapiens
aggcccgaaggucucucug

SEQ ID NO: 495663 - RNA, 20 nt, Homo sapiens
aggccgaggaauccucagag

SEQ ID NO: 495664 - RNA, 14 nt, Homo sapiens
aggccguggcugcc

SEQ ID NO: 495665 - RNA, 19 nt, Homo sapiens
aggccugaaauguuuccag

SEQ ID NO: 495666 - RNA, 15 nt, Homo sapiens
aggcguagggccagg

SEQ ID NO: 495667 - RNA, 21 nt, Homo sapiens
aggcuaugaagaaaacagcug

SEQ ID NO: 495668 - RNA, 15 nt, Homo sapiens
aggcucccacugccc

SEQ ID NO: 495669 - RNA, 18 nt, Homo sapiens
aggcucucgcacaccucu

SEQ ID NO: 495670 - RNA, 19 nt, Homo sapiens
aggcucucgcacaccucug

SEQ ID NO: 495671 - RNA, 16 nt, Homo sapiens
aggcuuccagucucac

SEQ ID NO: 495672 - RNA, 22 nt, Homo sapiens
agggaaugagaguuccuucuca

SEQ ID NO: 495673 - RNA, 17 nt, Homo sapiens
agggcagagcacauggc

SEQ ID NO: 495674 - RNA, 17 nt, Homo sapiens
agggcaggaaaugauaa

SEQ ID NO: 495675 - RNA, 15 nt, Homo sapiens
aggggagagaucucc

SEQ ID NO: 495676 - RNA, 23 nt, Homo sapiens
aggggagagaucuccaacucucu

SEQ ID NO: 495677 - RNA, 21 nt, Homo sapiens
agggggaggggugguacuugg

SEQ ID NO: 495678 - RNA, 17 nt, Homo sapiens
aggguauccugugcuau

SEQ ID NO: 495679 - RNA, 15 nt, Homo sapiens
agguaaacuagcaaa

SEQ ID NO: 495680 - RNA, 22 nt, Homo sapiens
agguaguagaaucucagcacuu

SEQ ID NO: 495681 - RNA, 18 nt, Homo sapiens
aggugccccucucuccau

SEQ ID NO: 495682 - RNA, 20 nt, Homo sapiens
agguugugcugccuguggug

SEQ ID NO: 495683 - RNA, 19 nt, Homo sapiens
agguuucacuguucaugaa

SEQ ID NO: 495684 - RNA, 14 nt, Homo sapiens
aguaaaaacaauuc

SEQ ID NO: 495685 - RNA, 14 nt, Homo sapiens
aguaaaccugaaca

SEQ ID NO: 495686 - RNA, 16 nt, Homo sapiens
aguaaaccugaacaaa

SEQ ID NO: 495687 - RNA, 14 nt, Homo sapiens
aguaacauaauaca

SEQ ID NO: 495688 - RNA, 19 nt, Homo sapiens
aguaacuugucuuaaauaa

SEQ ID NO: 495689 - RNA, 21 nt, Homo sapiens
aguacauaaggaguugccgca

SEQ ID NO: 495690 - RNA, 17 nt, Homo sapiens
aguagaauugauuuccc

SEQ ID NO: 495691 - RNA, 17 nt, Homo sapiens
aguagcucgugugcuua

SEQ ID NO: 495692 - RNA, 17 nt, Homo sapiens
aguagggagaaacaaaa

SEQ ID NO: 495693 - RNA, 14 nt, Homo sapiens
aguauauagccuua

SEQ ID NO: 495694 - RNA, 17 nt, Homo sapiens
aguauauuaaagugcua

SEQ ID NO: 495695 - RNA, 16 nt, Homo sapiens
agucacugcucuucag

SEQ ID NO: 495696 - RNA, 22 nt, Homo sapiens
agucaggcuuacuaaugcugcc

SEQ ID NO: 495697 - RNA, 17 nt, Homo sapiens
aguccagaugugccuag

SEQ ID NO: 495698 - RNA, 23 nt, Homo sapiens
agucccuccgacuucucuagaca

SEQ ID NO: 495699 - RNA, 22 nt, Homo sapiens
aguccugguuuccucagccuca

SEQ ID NO: 495700 - RNA, 14 nt, Homo sapiens
agucuauugcaguu

SEQ ID NO: 495701 - RNA, 16 nt, Homo sapiens
agucuuaauauucaga

SEQ ID NO: 495702 - RNA, 16 nt, Homo sapiens
agucuucaucuguccg

SEQ ID NO: 495703 - RNA, 16 nt, Homo sapiens
agugaagagcauuugg

SEQ ID NO: 495704 - RNA, 14 nt, Homo sapiens
agugacacagcagc

SEQ ID NO: 495705 - RNA, 15 nt, Homo sapiens
agugaugugguggga

SEQ ID NO: 495706 - RNA, 14 nt, Homo sapiens
agugccuggggugu

SEQ ID NO: 495707 - RNA, 16 nt, Homo sapiens
agugcuaagagccucu

SEQ ID NO: 495708 - RNA, 15 nt, Homo sapiens
agugcucacacaauc

SEQ ID NO: 495709 - RNA, 13 nt, Homo sapiens
aguggacuguauu

SEQ ID NO: 495710 - RNA, 14 nt, Homo sapiens
aguggauggaauau

SEQ ID NO: 495711 - RNA, 13 nt, Homo sapiens
aguggcaguauug

SEQ ID NO: 495712 - RNA, 17 nt, Homo sapiens
aguguacuggauuuaac

SEQ ID NO: 495713 - RNA, 21 nt, Homo sapiens
aguguccaggagaugggaugg

SEQ ID NO: 495714 - RNA, 16 nt, Homo sapiens
agugugauugugaacu

SEQ ID NO: 495715 - RNA, 15 nt, Homo sapiens
aguguuugagaguga

SEQ ID NO: 495716 - RNA, 13 nt, Homo sapiens
aguuaaucuucau

SEQ ID NO: 495717 - RNA, 19 nt, Homo sapiens
aguuaguaggauaugccug

SEQ ID NO: 495718 - RNA, 14 nt, Homo sapiens
aguuaugaggguac

SEQ ID NO: 495719 - RNA, 14 nt, Homo sapiens
aguucaagaccagc

SEQ ID NO: 495720 - RNA, 19 nt, Homo sapiens
aguugacucugcucuugca

SEQ ID NO: 495721 - RNA, 12 nt, Homo sapiens
aguugcaauaaa

SEQ ID NO: 495722 - RNA, 20 nt, Homo sapiens
aguugcaauaaacucaguca

SEQ ID NO: 495723 - RNA, 20 nt, Homo sapiens
aguugccguggcaacugugg

SEQ ID NO: 495724 - RNA, 16 nt, Homo sapiens
aguuggccaagcagaa

SEQ ID NO: 495725 - RNA, 13 nt, Homo sapiens
aguuguucagcau

SEQ ID NO: 495726 - RNA, 15 nt, Homo sapiens
aguuuacuggggaaa

SEQ ID NO: 495727 - RNA, 20 nt, Homo sapiens
aguuuauuuuuauacuuuca

SEQ ID NO: 495728 - RNA, 21 nt, Homo sapiens
aguuuauuuuuauacuuucag

SEQ ID NO: 495729 - RNA, 21 nt, Homo sapiens
aguuucagagaaauacuuuca

SEQ ID NO: 495730 - RNA, 22 nt, Homo sapiens
aguuucagagaaauacuuucag

SEQ ID NO: 495731 - RNA, 18 nt, Homo sapiens
aguuucuuuuauuuucau

SEQ ID NO: 495732 - RNA, 23 nt, Homo sapiens
aguuugaacucuguaaaaccuca

SEQ ID NO: 495733 - RNA, 21 nt, Homo sapiens
aguuugugaucuguccuucca

SEQ ID NO: 495734 - RNA, 18 nt, Homo sapiens
auaaaaaauaauaauaca

SEQ ID NO: 495735 - RNA, 15 nt, Homo sapiens
auaaaaagugacaca

SEQ ID NO: 495736 - RNA, 19 nt, Homo sapiens
auaaaacaugggaaucucc

SEQ ID NO: 495737 - RNA, 13 nt, Homo sapiens
auaaaacauuaug

SEQ ID NO: 495738 - RNA, 18 nt, Homo sapiens
auaaaagaaaugcacaau

SEQ ID NO: 495739 - RNA, 14 nt, Homo sapiens
auaaacaacuuuca

SEQ ID NO: 495740 - RNA, 20 nt, Homo sapiens
auaaacauuaaaugucuuau

SEQ ID NO: 495741 - RNA, 14 nt, Homo sapiens
auaaaccagacuca

SEQ ID NO: 495742 - RNA, 15 nt, Homo sapiens
auaaauauacucaag

SEQ ID NO: 495743 - RNA, 18 nt, Homo sapiens
auaaauauacucaaguuu

SEQ ID NO: 495744 - RNA, 15 nt, Homo sapiens
auaaaugccccaaag

SEQ ID NO: 495745 - RNA, 14 nt, Homo sapiens
auaaccauaaauca

SEQ ID NO: 495746 - RNA, 14 nt, Homo sapiens
auaacccugaauca

SEQ ID NO: 495747 - RNA, 20 nt, Homo sapiens
caccccuuccccuuguaaaa

SEQ ID NO: 495748 - RNA, 15 nt, Homo sapiens
cacccuaucaucagu

SEQ ID NO: 495749 - RNA, 12 nt, Homo sapiens
caccgucuuucu

SEQ ID NO: 495750 - RNA, 14 nt, Homo sapiens
caccuauaauacca

SEQ ID NO: 495751 - RNA, 15 nt, Homo sapiens
cacgcaaauacaugc

SEQ ID NO: 495752 - RNA, 12 nt, Homo sapiens
cacgcacgcaca

SEQ ID NO: 495753 - RNA, 16 nt, Homo sapiens
cacgccuguaauccca

SEQ ID NO: 495754 - RNA, 20 nt, Homo sapiens
cacgcugcaccuaaagccua

SEQ ID NO: 495755 - RNA, 19 nt, Homo sapiens
cacggaacuggagaaggag

SEQ ID NO: 495756 - RNA, 23 nt, Homo sapiens
cacgucauaggaaguuagccuuu

SEQ ID NO: 495757 - RNA, 18 nt, Homo sapiens
cacguuuggccagugaca

SEQ ID NO: 495758 - RNA, 18 nt, Homo sapiens
cacuaaauccuuuccaau

SEQ ID NO: 495759 - RNA, 23 nt, Homo sapiens
cacuagaggggcacccaccaguu

SEQ ID NO: 495760 - RNA, 15 nt, Homo sapiens
cacuauauguuuaca

SEQ ID NO: 495761 - RNA, 13 nt, Homo sapiens
cacuaucacuuua

SEQ ID NO: 495762 - RNA, 18 nt, Homo sapiens
cacucaucagguaaacug

SEQ ID NO: 495763 - RNA, 20 nt, Homo sapiens
cacucuacuaaugccucuuc

SEQ ID NO: 495764 - RNA, 14 nt, Homo sapiens
cacucugaauucca

SEQ ID NO: 495765 - RNA, 21 nt, Homo sapiens
cacucuuuugagcaguaaaug

SEQ ID NO: 495766 - RNA, 15 nt, Homo sapiens
cacugaguucuauca

SEQ ID NO: 495767 - RNA, 24 nt, Homo sapiens
cacugccccugcaccugcuucuca

SEQ ID NO: 495768 - RNA, 17 nt, Homo sapiens
cacugcuguaaagcaaa

SEQ ID NO: 495769 - RNA, 18 nt, Homo sapiens
cacuggcaucuuugcuau

SEQ ID NO: 495770 - RNA, 19 nt, Homo sapiens
cacuuacagaaccaauuca

SEQ ID NO: 495771 - RNA, 16 nt, Homo sapiens
cacuugaaaagugugu

SEQ ID NO: 495772 - RNA, 20 nt, Homo sapiens
cacuugccccuguuaccuaa

SEQ ID NO: 495773 - RNA, 21 nt, Homo sapiens
cacuugccccuguuaccuaau

SEQ ID NO: 495774 - RNA, 16 nt, Homo sapiens
cacuuucugaaauuca

SEQ ID NO: 495775 - RNA, 19 nt, Homo sapiens
cagaacuccugcauggcuc

SEQ ID NO: 495776 - RNA, 23 nt, Homo sapiens
cagaacucugccugcccuuuguc

SEQ ID NO: 495777 - RNA, 15 nt, Homo sapiens
cagaagcagcagcua

SEQ ID NO: 495778 - RNA, 18 nt, Homo sapiens
cagaccaguagugaccaa

SEQ ID NO: 495779 - RNA, 22 nt, Homo sapiens
cagaccaguuucagagaaauac

SEQ ID NO: 495780 - RNA, 20 nt, Homo sapiens
cagaccauuguuucuaauaa

SEQ ID NO: 495781 - RNA, 20 nt, Homo sapiens
cagacgcacgugggucuuca

SEQ ID NO: 495782 - RNA, 19 nt, Homo sapiens
cagacucaaggccuccagc

SEQ ID NO: 495783 - RNA, 16 nt, Homo sapiens
cagagaaauacuuuca

SEQ ID NO: 495784 - RNA, 17 nt, Homo sapiens
cagagaaauacuuucag

SEQ ID NO: 495785 - RNA, 19 nt, Homo sapiens
cagagaaauacuuucaggc

SEQ ID NO: 495786 - RNA, 21 nt, Homo sapiens
cagagcacagccaaucuccag

SEQ ID NO: 495787 - RNA, 20 nt, Homo sapiens
cagagccugcagggugaccu

SEQ ID NO: 495788 - RNA, 21 nt, Homo sapiens
cagagcucagcacagccucac

SEQ ID NO: 495789 - RNA, 15 nt, Homo sapiens
cagagcuggaccuga

SEQ ID NO: 495790 - RNA, 18 nt, Homo sapiens
cagaggcuuccagucuca

SEQ ID NO: 495791 - RNA, 19 nt, Homo sapiens
cagagggcagagcacaugg

SEQ ID NO: 495792 - RNA, 17 nt, Homo sapiens
cagaggggcggggccag

SEQ ID NO: 495793 - RNA, 14 nt, Homo sapiens
cagaggguugugau

SEQ ID NO: 495794 - RNA, 16 nt, Homo sapiens
cagaguaugaucucag

SEQ ID NO: 495795 - RNA, 20 nt, Homo sapiens
cagauccaccugcacaaaca

SEQ ID NO: 495796 - RNA, 17 nt, Homo sapiens
cagaugauccuugcaca

SEQ ID NO: 495797 - RNA, 22 nt, Homo sapiens
cagauguggacaugcacccgca

SEQ ID NO: 495798 - RNA, 20 nt, Homo sapiens
cagauucuaggaccuguguc

SEQ ID NO: 495799 - RNA, 12 nt, Homo sapiens
cagauuugcaac

SEQ ID NO: 495800 - RNA, 15 nt, Homo sapiens
cagcaaacccaaaga

SEQ ID NO: 495801 - RNA, 16 nt, Homo sapiens
cagcacuuuguuucau

SEQ ID NO: 495802 - RNA, 20 nt, Homo sapiens
cagcagauccaccugcacaa

SEQ ID NO: 495803 - RNA, 14 nt, Homo sapiens
cagcagcagcaguu

SEQ ID NO: 495804 - RNA, 17 nt, Homo sapiens
cagcagcuucaccagag

SEQ ID NO: 495805 - RNA, 20 nt, Homo sapiens
cagcauacauuuucuggugg

SEQ ID NO: 495806 - RNA, 22 nt, Homo sapiens
cagcauuacacgccacaacucc

SEQ ID NO: 495807 - RNA, 19 nt, Homo sapiens
cagccccacuccacaguua

SEQ ID NO: 495808 - RNA, 23 nt, Homo sapiens
cagccccccaguguccccagggg

SEQ ID NO: 495809 - RNA, 14 nt, Homo sapiens
cagccuaccagaga

SEQ ID NO: 495810 - RNA, 24 nt, Homo sapiens
cagcuacuccggaggcugaggcag

SEQ ID NO: 495811 - RNA, 23 nt, Homo sapiens
cagcuagaaagagaaaaagcccu

SEQ ID NO: 495812 - RNA, 12 nt, Homo sapiens
cagcugcauggc

SEQ ID NO: 495813 - RNA, 18 nt, Homo sapiens
cagcuggccaccauggca

SEQ ID NO: 495814 - RNA, 24 nt, Homo sapiens
caggaaagcauggcucauucugca

SEQ ID NO: 495815 - RNA, 18 nt, Homo sapiens
caggaaaguggcaccugu

SEQ ID NO: 495816 - RNA, 20 nt, Homo sapiens
caggaaucuccucacugaaa

SEQ ID NO: 495817 - RNA, 22 nt, Homo sapiens
caggagcucaggaagaagagau

SEQ ID NO: 495818 - RNA, 22 nt, Homo sapiens
caggaggcugggacgcucugcu

SEQ ID NO: 495819 - RNA, 19 nt, Homo sapiens
caggagggcugggcuccac

SEQ ID NO: 495820 - RNA, 23 nt, Homo sapiens
caggagucagugcccauguguau

SEQ ID NO: 495821 - RNA, 19 nt, Homo sapiens
caggaguucaagaccagcc

SEQ ID NO: 495822 - RNA, 17 nt, Homo sapiens
caggauggucucugcca

SEQ ID NO: 495823 - RNA, 19 nt, Homo sapiens
caggauggucucugccaug

SEQ ID NO: 495824 - RNA, 17 nt, Homo sapiens
caggauucucaccagcu

SEQ ID NO: 495825 - RNA, 20 nt, Homo sapiens
caggauugaggaugaacuca

SEQ ID NO: 495826 - RNA, 16 nt, Homo sapiens
caggcacuaagacuaa

SEQ ID NO: 495827 - RNA, 15 nt, Homo sapiens
caggcauuucaggaa

SEQ ID NO: 495828 - RNA, 22 nt, Homo sapiens
caggcauuuuuguaaugagcca

SEQ ID NO: 495829 - RNA, 23 nt, Homo sapiens
caggcauuuuuguaaugagccau

SEQ ID NO: 495830 - RNA, 17 nt, Homo sapiens
caggcucccacugcccc

SEQ ID NO: 495831 - RNA, 21 nt, Homo sapiens
cagggugaagccuucaaagcu

SEQ ID NO: 495832 - RNA, 22 nt, Homo sapiens
cagguaucugaugauguucuga

SEQ ID NO: 495833 - RNA, 13 nt, Homo sapiens
caggugacaguga

SEQ ID NO: 495834 - RNA, 14 nt, Homo sapiens
caggugacagugag

SEQ ID NO: 495835 - RNA, 23 nt, Homo sapiens
caguaagaucaagcuccaucuua

SEQ ID NO: 495836 - RNA, 19 nt, Homo sapiens
caguacaauaaauaaaaga

SEQ ID NO: 495837 - RNA, 17 nt, Homo sapiens
caguagaggguccaguc

SEQ ID NO: 495838 - RNA, 17 nt, Homo sapiens
caguaugguaacuuugc

SEQ ID NO: 495839 - RNA, 21 nt, Homo sapiens
cagucacuuguuuguguuuga

SEQ ID NO: 495840 - RNA, 20 nt, Homo sapiens
cagucuggugcccagacuca

SEQ ID NO: 495841 - RNA, 15 nt, Homo sapiens
cagucuuaauauuca

SEQ ID NO: 495842 - RNA, 17 nt, Homo sapiens
cagucuuccaccuggaa

SEQ ID NO: 495843 - RNA, 16 nt, Homo sapiens
cagugcccauguguau

SEQ ID NO: 495844 - RNA, 23 nt, Homo sapiens
cagugcucacacaaucagaccaa

SEQ ID NO: 495845 - RNA, 14 nt, Homo sapiens
caguguguccaguu

SEQ ID NO: 495846 - RNA, 12 nt, Homo sapiens
caguguuuacaa

SEQ ID NO: 495847 - RNA, 14 nt, Homo sapiens
caguugguuuugca

SEQ ID NO: 495848 - RNA, 16 nt, Homo sapiens
cauaaaaacuacugaa

SEQ ID NO: 495849 - RNA, 19 nt, Homo sapiens
cauaaccacccuagcuuua

SEQ ID NO: 495850 - RNA, 14 nt, Homo sapiens
cauaaccgcacaga

SEQ ID NO: 495851 - RNA, 20 nt, Homo sapiens
cauaagcuuuuucucugaac

SEQ ID NO: 495852 - RNA, 18 nt, Homo sapiens
cauaauacauuaauacuu

SEQ ID NO: 495853 - RNA, 22 nt, Homo sapiens
cauaaugcuaaauaaaacugug

SEQ ID NO: 495854 - RNA, 16 nt, Homo sapiens
cauaccuucugaugaa

SEQ ID NO: 495855 - RNA, 18 nt, Homo sapiens
cauacgcaauuguauaua

SEQ ID NO: 495856 - RNA, 15 nt, Homo sapiens
cauagcuacccaaaa

SEQ ID NO: 495857 - RNA, 11 nt, Homo sapiens
cauaguagcaa

SEQ ID NO: 495858 - RNA, 18 nt, Homo sapiens
cauaguggaucacucacc

SEQ ID NO: 495859 - RNA, 23 nt, Homo sapiens
cauauacauuuuuagccuguguc

SEQ ID NO: 495860 - RNA, 15 nt, Homo sapiens
cauauaccuauaaug

SEQ ID NO: 495861 - RNA, 15 nt, Homo sapiens
cauauauacauacgc

SEQ ID NO: 495862 - RNA, 16 nt, Homo sapiens
cauauauacauacgca

SEQ ID NO: 495863 - RNA, 14 nt, Homo sapiens
cauauaugcaaaag

SEQ ID NO: 495864 - RNA, 15 nt, Homo sapiens
cauaugaacuuguca

SEQ ID NO: 495865 - RNA, 23 nt, Homo sapiens
cauaugauaaauuugacuguuau

SEQ ID NO: 495866 - RNA, 13 nt, Homo sapiens
cauauucuuucac

SEQ ID NO: 495867 - RNA, 21 nt, Homo sapiens
cauauuucauaagcacaucca

SEQ ID NO: 495868 - RNA, 20 nt, Homo sapiens
cauauuuuuuuuacugucag

SEQ ID NO: 495869 - RNA, 13 nt, Homo sapiens
caucaaguugcac

SEQ ID NO: 495870 - RNA, 20 nt, Homo sapiens
caucacuauucagaagacac

SEQ ID NO: 495871 - RNA, 18 nt, Homo sapiens
caucagcaccacgugcca

SEQ ID NO: 495872 - RNA, 18 nt, Homo sapiens
caucagucuuaauauuca

SEQ ID NO: 495873 - RNA, 13 nt, Homo sapiens
caucaugcaaaau

SEQ ID NO: 495874 - RNA, 20 nt, Homo sapiens
caucucauuuuuaagaacaa

SEQ ID NO: 495875 - RNA, 13 nt, Homo sapiens
caucucuauuuag

SEQ ID NO: 495876 - RNA, 15 nt, Homo sapiens
caucucuguaaaaag

SEQ ID NO: 495877 - RNA, 22 nt, Homo sapiens
caucugucuggaggggagcucu

SEQ ID NO: 495878 - RNA, 22 nt, Homo sapiens
caugaaacagcagcugaagcca

SEQ ID NO: 495879 - RNA, 18 nt, Homo sapiens
caugagcaaccagugcca

SEQ ID NO: 495880 - RNA, 17 nt, Homo sapiens
caugagcuaaugguuca

SEQ ID NO: 495881 - RNA, 21 nt, Homo sapiens
caugcacacacacacaucuca

SEQ ID NO: 495882 - RNA, 16 nt, Homo sapiens
aaacagcuugaugcug

SEQ ID NO: 495883 - RNA, 19 nt, Homo sapiens
aaacauuaaaugucuuaua

SEQ ID NO: 495884 - RNA, 21 nt, Homo sapiens
aaacccaaucagaugccucag

SEQ ID NO: 495885 - RNA, 22 nt, Homo sapiens
aaaccucuuucggaaaugauug

SEQ ID NO: 495886 - RNA, 14 nt, Homo sapiens
aaacgaaagcuggg

SEQ ID NO: 495887 - RNA, 13 nt, Homo sapiens
aaacugaagccca

SEQ ID NO: 495888 - RNA, 17 nt, Homo sapiens
aaacuugaagucuugaa

SEQ ID NO: 495889 - RNA, 12 nt, Homo sapiens
aaagacauguug

SEQ ID NO: 495890 - RNA, 20 nt, Homo sapiens
aaagacuucauuuaacacug

SEQ ID NO: 495891 - RNA, 22 nt, Homo sapiens
aaagacuucauuuaacacugag

SEQ ID NO: 495892 - RNA, 23 nt, Homo sapiens
aaagacuucauuuaacacugagu

SEQ ID NO: 495893 - RNA, 14 nt, Homo sapiens
aaagaugaaagcug

SEQ ID NO: 495894 - RNA, 17 nt, Homo sapiens
aaagauguuaacaguau

SEQ ID NO: 495895 - RNA, 12 nt, Homo sapiens
aaagcaaaauau

SEQ ID NO: 495896 - RNA, 14 nt, Homo sapiens
aaagcaugccaauu

SEQ ID NO: 495897 - RNA, 17 nt, Homo sapiens
aaagggaagccauuccg

SEQ ID NO: 495898 - RNA, 22 nt, Homo sapiens
aaaggucuaugcucauaacugu

SEQ ID NO: 495899 - RNA, 19 nt, Homo sapiens
aaaguaauuguuccagaga

SEQ ID NO: 495900 - RNA, 18 nt, Homo sapiens
aaaguaccacacugaguu

SEQ ID NO: 495901 - RNA, 21 nt, Homo sapiens
aaaguagcaaaaaaguacaaa

SEQ ID NO: 495902 - RNA, 17 nt, Homo sapiens
aaagucagauuuguaua

SEQ ID NO: 495903 - RNA, 12 nt, Homo sapiens
aaaguugugauc

SEQ ID NO: 495904 - RNA, 20 nt, Homo sapiens
aaaguugugaucuguuguaa

SEQ ID NO: 495905 - RNA, 22 nt, Homo sapiens
aaauaaaaagugacacagcagc

SEQ ID NO: 495906 - RNA, 22 nt, Homo sapiens
aaauaacuuacaagacuguaaa

SEQ ID NO: 495907 - RNA, 17 nt, Homo sapiens
aaauaaucauacacaga

SEQ ID NO: 495908 - RNA, 22 nt, Homo sapiens
aaauacacauacauauauacau

SEQ ID NO: 495909 - RNA, 13 nt, Homo sapiens
aaauacacuuuau

SEQ ID NO: 495910 - RNA, 21 nt, Homo sapiens
aaauacaugccuuuccagugc

SEQ ID NO: 495911 - RNA, 23 nt, Homo sapiens
aaauacggaaguaaaccugaaca

SEQ ID NO: 495912 - RNA, 18 nt, Homo sapiens
aaauaggcucucugugaa

SEQ ID NO: 495913 - RNA, 12 nt, Homo sapiens
aaauaugcucuc

SEQ ID NO: 495914 - RNA, 16 nt, Homo sapiens
aaauauuauuaucuca

SEQ ID NO: 495915 - RNA, 15 nt, Homo sapiens
aaauauuauuugcua

SEQ ID NO: 495916 - RNA, 15 nt, Homo sapiens
aaauauugauuucau

SEQ ID NO: 495917 - RNA, 18 nt, Homo sapiens
aaauauuuugucacugcu

SEQ ID NO: 495918 - RNA, 17 nt, Homo sapiens
aaaucaauucauugugu

SEQ ID NO: 495919 - RNA, 18 nt, Homo sapiens
aaaucacaagaacaaaua

SEQ ID NO: 495920 - RNA, 13 nt, Homo sapiens
aaaucauuguuaa

SEQ ID NO: 495921 - RNA, 20 nt, Homo sapiens
aaaucuugagaaucaaucaa

SEQ ID NO: 495922 - RNA, 15 nt, Homo sapiens
aaaucuuuagggaau

SEQ ID NO: 495923 - RNA, 18 nt, Homo sapiens
aaaugauuaagugcuuga

SEQ ID NO: 495924 - RNA, 15 nt, Homo sapiens
aaaugcagccuuaaa

SEQ ID NO: 495925 - RNA, 13 nt, Homo sapiens
aaaugcuacucag

SEQ ID NO: 495926 - RNA, 13 nt, Homo sapiens
aaaugcuaucaga

SEQ ID NO: 495927 - RNA, 17 nt, Homo sapiens
aaauggcuuguucaguc

SEQ ID NO: 495928 - RNA, 19 nt, Homo sapiens
aaauggcuuguucagucac

SEQ ID NO: 495929 - RNA, 12 nt, Homo sapiens
aaauggucccaa

SEQ ID NO: 495930 - RNA, 21 nt, Homo sapiens
aaauggugguuguuucuucca

SEQ ID NO: 495931 - RNA, 13 nt, Homo sapiens
aaauguauauaca

SEQ ID NO: 495932 - RNA, 11 nt, Homo sapiens
aaaugugaacu

SEQ ID NO: 495933 - RNA, 21 nt, Homo sapiens
aaaugugagaaguacacauuu

SEQ ID NO: 495934 - RNA, 22 nt, Homo sapiens
aaauguguauuuuucaaggcau

SEQ ID NO: 495935 - RNA, 23 nt, Homo sapiens
aaauguguauuuuucaaggcauu

SEQ ID NO: 495936 - RNA, 19 nt, Homo sapiens
aaaugugugugaugugaca

SEQ ID NO: 495937 - RNA, 23 nt, Homo sapiens
aaauuaauugaaauaccuauuca

SEQ ID NO: 495938 - RNA, 20 nt, Homo sapiens
aaauuagaaagcaacuuauc

SEQ ID NO: 495939 - RNA, 16 nt, Homo sapiens
aaauuaucugauccuu

SEQ ID NO: 495940 - RNA, 22 nt, Homo sapiens
aaauucaggugaaaauguucau

SEQ ID NO: 495941 - RNA, 19 nt, Homo sapiens
aaauuccauacuucucuca

SEQ ID NO: 495942 - RNA, 23 nt, Homo sapiens
aaauucccucauuuaaacccaau

SEQ ID NO: 495943 - RNA, 21 nt, Homo sapiens
aaauuuaugaagcagauuuau

SEQ ID NO: 495944 - RNA, 21 nt, Homo sapiens
aaauuugugcuggguuauuca

SEQ ID NO: 495945 - RNA, 15 nt, Homo sapiens
aacaaagcauuugac

SEQ ID NO: 495946 - RNA, 18 nt, Homo sapiens
aacaacguacuauggaag

SEQ ID NO: 495947 - RNA, 23 nt, Homo sapiens
aacaacguacuauggaagccaca

SEQ ID NO: 495948 - RNA, 13 nt, Homo sapiens
aacacaccuugcc

SEQ ID NO: 495949 - RNA, 14 nt, Homo sapiens
aacacaugcacaca

SEQ ID NO: 495950 - RNA, 18 nt, Homo sapiens
aacacucugaauuccaag

SEQ ID NO: 495951 - RNA, 20 nt, Homo sapiens
aacacuuugcuaggagauac

SEQ ID NO: 495952 - RNA, 16 nt, Homo sapiens
aacagaaaaaugaaau

SEQ ID NO: 495953 - RNA, 16 nt, Homo sapiens
aacagaacuacucucc

SEQ ID NO: 495954 - RNA, 17 nt, Homo sapiens
aacagauuuaagcaaga

SEQ ID NO: 495955 - RNA, 18 nt, Homo sapiens
aacagcaaauuaaugugu

SEQ ID NO: 495956 - RNA, 14 nt, Homo sapiens
aacagcucugagau

SEQ ID NO: 495957 - RNA, 19 nt, Homo sapiens
aacaggauuagacagucaa

SEQ ID NO: 495958 - RNA, 16 nt, Homo sapiens
aacaggcacaggcuca

SEQ ID NO: 495959 - RNA, 16 nt, Homo sapiens
aacagugugaugcaau

SEQ ID NO: 495960 - RNA, 19 nt, Homo sapiens
aacauaaguaagacuugau

SEQ ID NO: 495961 - RNA, 21 nt, Homo sapiens
aacauccucagaaccauucac

SEQ ID NO: 495962 - RNA, 16 nt, Homo sapiens
aacauggauacuuccu

SEQ ID NO: 495963 - RNA, 13 nt, Homo sapiens
aacaugguacaaa

SEQ ID NO: 495964 - RNA, 15 nt, Homo sapiens
aacauuaauguugau

SEQ ID NO: 495965 - RNA, 14 nt, Homo sapiens
aacauuaguacuuu

SEQ ID NO: 495966 - RNA, 16 nt, Homo sapiens
aacauuaguacuuuau

SEQ ID NO: 495967 - RNA, 20 nt, Homo sapiens
aacauuucuaacucugaugu

SEQ ID NO: 495968 - RNA, 21 nt, Homo sapiens
aacauuucuaacucugaugua

SEQ ID NO: 495969 - RNA, 20 nt, Homo sapiens
aaccaauuuguucugugcaa

SEQ ID NO: 495970 - RNA, 12 nt, Homo sapiens
aaccauucugcu

SEQ ID NO: 495971 - RNA, 23 nt, Homo sapiens
aaccauucugcuugguuccacaa

SEQ ID NO: 495972 - RNA, 19 nt, Homo sapiens
aacccuucaacuaugcaau

SEQ ID NO: 495973 - RNA, 17 nt, Homo sapiens
aaccgaggacccaugaa

SEQ ID NO: 495974 - RNA, 20 nt, Homo sapiens
aaccuacagaauacuagcca

SEQ ID NO: 495975 - RNA, 12 nt, Homo sapiens
aaccuugcugcu

SEQ ID NO: 495976 - RNA, 16 nt, Homo sapiens
aacuaaugacaaguga

SEQ ID NO: 495977 - RNA, 18 nt, Homo sapiens
aacuauguuuagugugau

SEQ ID NO: 495978 - RNA, 12 nt, Homo sapiens
aacucauuugau

SEQ ID NO: 495979 - RNA, 13 nt, Homo sapiens
aacuccagacuug

SEQ ID NO: 495980 - RNA, 15 nt, Homo sapiens
aacucuaugaacuua

SEQ ID NO: 495981 - RNA, 16 nt, Homo sapiens
aacucuguaaaaccuc

SEQ ID NO: 495982 - RNA, 13 nt, Homo sapiens
aacugauuacugu

SEQ ID NO: 495983 - RNA, 18 nt, Homo sapiens
aacuguaaaauacuucuu

SEQ ID NO: 495984 - RNA, 23 nt, Homo sapiens
aacuuaauuaccuaagagccaca

SEQ ID NO: 495985 - RNA, 15 nt, Homo sapiens
aacuuacauaugucu

SEQ ID NO: 495986 - RNA, 13 nt, Homo sapiens
aacuuagagcuuu

SEQ ID NO: 495987 - RNA, 20 nt, Homo sapiens
aacuucacuaccaagcagcu

SEQ ID NO: 495988 - RNA, 22 nt, Homo sapiens
aacuucaggaaagcagcaguuu

SEQ ID NO: 495989 - RNA, 14 nt, Homo sapiens
aacuucaucugucu

SEQ ID NO: 495990 - RNA, 15 nt, Homo sapiens
aacuucuauuuucaa

SEQ ID NO: 495991 - RNA, 15 nt, Homo sapiens
aacuuucaagaacuu

SEQ ID NO: 495992 - RNA, 15 nt, Homo sapiens
aagaaaaaaagggag

SEQ ID NO: 495993 - RNA, 17 nt, Homo sapiens
aagaaagccagucuuaa

SEQ ID NO: 495994 - RNA, 22 nt, Homo sapiens
aagaaauuccauacuucucuca

SEQ ID NO: 495995 - RNA, 13 nt, Homo sapiens
aagaauggcuuuc

SEQ ID NO: 495996 - RNA, 15 nt, Homo sapiens
aagaauggcuuucaa

SEQ ID NO: 495997 - RNA, 15 nt, Homo sapiens
aagacccccaggaag

SEQ ID NO: 495998 - RNA, 14 nt, Homo sapiens
aagacucuuuauga

SEQ ID NO: 495999 - RNA, 19 nt, Homo sapiens
aagacugaugaagaaauuu

SEQ ID NO: 496000 - RNA, 18 nt, Homo sapiens
aagagaaccgagcaaaga

SEQ ID NO: 496001 - RNA, 17 nt, Homo sapiens
aagagaugcacuauaug

SEQ ID NO: 496002 - RNA, 22 nt, Homo sapiens
aagagaugggccuuuucuugaa

SEQ ID NO: 496003 - RNA, 23 nt, Homo sapiens
aagagcauuugguacacacuuga

SEQ ID NO: 496004 - RNA, 13 nt, Homo sapiens
aagauaaauccaa

SEQ ID NO: 496005 - RNA, 21 nt, Homo sapiens
gauuuguauaaggaaagccaa

SEQ ID NO: 496006 - RNA, 18 nt, Homo sapiens
gcaacuaggccuucagua

SEQ ID NO: 496007 - RNA, 14 nt, Homo sapiens
gcaagucacagaaa

SEQ ID NO: 496008 - RNA, 17 nt, Homo sapiens
gcaauaaacucagucaa

SEQ ID NO: 496009 - RNA, 20 nt, Homo sapiens
gcaauauucuguaacuauug

SEQ ID NO: 496010 - RNA, 17 nt, Homo sapiens
gcaauggugaacuguca

SEQ ID NO: 496011 - RNA, 20 nt, Homo sapiens
gcaaugugcccccagacgca

SEQ ID NO: 496012 - RNA, 23 nt, Homo sapiens
gcaaugugcccccagacgcacgu

SEQ ID NO: 496013 - RNA, 14 nt, Homo sapiens
gcaauuacugcugu

SEQ ID NO: 496014 - RNA, 13 nt, Homo sapiens
gcaauugcuucuc

SEQ ID NO: 496015 - RNA, 19 nt, Homo sapiens
gcacaacugauaauauuga

SEQ ID NO: 496016 - RNA, 22 nt, Homo sapiens
gcacacgugaagcaacauuucu

SEQ ID NO: 496017 - RNA, 18 nt, Homo sapiens
gcacagagagggggccac

SEQ ID NO: 496018 - RNA, 19 nt, Homo sapiens
gcacagggcaugaaaugaa

SEQ ID NO: 496019 - RNA, 15 nt, Homo sapiens
gcacagucacugcuc

SEQ ID NO: 496020 - RNA, 20 nt, Homo sapiens
gcacauccauucccaagaaa

SEQ ID NO: 496021 - RNA, 22 nt, Homo sapiens
gcaccaccgaccaacuccagac

SEQ ID NO: 496022 - RNA, 24 nt, Homo sapiens
gcaccaccgaccaacuccagacuu

SEQ ID NO: 496023 - RNA, 13 nt, Homo sapiens
gcaccucuugaag

SEQ ID NO: 496024 - RNA, 13 nt, Homo sapiens
gcaccuuugcacg

SEQ ID NO: 496025 - RNA, 16 nt, Homo sapiens
gcagagugaaauucaa

SEQ ID NO: 496026 - RNA, 15 nt, Homo sapiens
gcagcuaaaaaugca

SEQ ID NO: 496027 - RNA, 16 nt, Homo sapiens
gcaggaagucccugag

SEQ ID NO: 496028 - RNA, 17 nt, Homo sapiens
gcaggagaaucgcuuga

SEQ ID NO: 496029 - RNA, 16 nt, Homo sapiens
gcaguguucugugaau

SEQ ID NO: 496030 - RNA, 19 nt, Homo sapiens
gcaguuggccaagcagaaa

SEQ ID NO: 496031 - RNA, 15 nt, Homo sapiens
gcauaaccgcacaga

SEQ ID NO: 496032 - RNA, 11 nt, Homo sapiens
gcauguucuca

SEQ ID NO: 496033 - RNA, 20 nt, Homo sapiens
gcauuacacgccacaacucc

SEQ ID NO: 496034 - RNA, 18 nt, Homo sapiens
gcauucauucauccucuu

SEQ ID NO: 496035 - RNA, 20 nt, Homo sapiens
gcauuugguacacacuugac

SEQ ID NO: 496036 - RNA, 20 nt, Homo sapiens
gcauuuuuguaaugagccau

SEQ ID NO: 496037 - RNA, 18 nt, Homo sapiens
gccacacguuugccaaau

SEQ ID NO: 496038 - RNA, 18 nt, Homo sapiens
gccaggcucccacugccc

SEQ ID NO: 496039 - RNA, 20 nt, Homo sapiens
gccauaguggaucacucacc

SEQ ID NO: 496040 - RNA, 18 nt, Homo sapiens
gccauccaucaugcaaaa

SEQ ID NO: 496041 - RNA, 20 nt, Homo sapiens
gccaucgcaagucacagaaa

SEQ ID NO: 496042 - RNA, 22 nt, Homo sapiens
gccaucgcaagucacagaaaau

SEQ ID NO: 496043 - RNA, 19 nt, Homo sapiens
gcccagaccacugucucca

SEQ ID NO: 496044 - RNA, 19 nt, Homo sapiens
gcccagccuaucucucuuc

SEQ ID NO: 496045 - RNA, 21 nt, Homo sapiens
gcccaggagcgcagcugcauu

SEQ ID NO: 496046 - RNA, 22 nt, Homo sapiens
gcccaggagcgcagcugcauuu

SEQ ID NO: 496047 - RNA, 18 nt, Homo sapiens
gccccagcgagucuggag

SEQ ID NO: 496048 - RNA, 16 nt, Homo sapiens
gccccucuuagaagaa

SEQ ID NO: 496049 - RNA, 15 nt, Homo sapiens
gcccuccgcccuucc

SEQ ID NO: 496050 - RNA, 15 nt, Homo sapiens
gcccucuucaauccc

SEQ ID NO: 496051 - RNA, 17 nt, Homo sapiens
gcccuuccaaacucuuc

SEQ ID NO: 496052 - RNA, 21 nt, Homo sapiens
gccuccuguggccugccaguc

SEQ ID NO: 496053 - RNA, 12 nt, Homo sapiens
gccugaccuccc

SEQ ID NO: 496054 - RNA, 21 nt, Homo sapiens
gccuggaaagcccuucggaga

SEQ ID NO: 496055 - RNA, 19 nt, Homo sapiens
gccuggccagaccagguga

SEQ ID NO: 496056 - RNA, 15 nt, Homo sapiens
gccuucuaccugcag

SEQ ID NO: 496057 - RNA, 23 nt, Homo sapiens
gccuucuccacagggacacaguc

SEQ ID NO: 496058 - RNA, 13 nt, Homo sapiens
gccuugugaucac

SEQ ID NO: 496059 - RNA, 18 nt, Homo sapiens
gccuuuuguagcugucau

SEQ ID NO: 496060 - RNA, 15 nt, Homo sapiens
gcgcagcugcauuug

SEQ ID NO: 496061 - RNA, 16 nt, Homo sapiens
gcgcuuacgugauaug

SEQ ID NO: 496062 - RNA, 13 nt, Homo sapiens
gcgguauccagag

SEQ ID NO: 496063 - RNA, 12 nt, Homo sapiens
gcgguggcucac

SEQ ID NO: 496064 - RNA, 13 nt, Homo sapiens
gcguagggccagg

SEQ ID NO: 496065 - RNA, 19 nt, Homo sapiens
gcgucaggcuugugacauu

SEQ ID NO: 496066 - RNA, 20 nt, Homo sapiens
gcgucccugagggcccuucc

SEQ ID NO: 496067 - RNA, 22 nt, Homo sapiens
gcgugggaguauguuauuucuc

SEQ ID NO: 496068 - RNA, 16 nt, Homo sapiens
gcuaaaauaaaccaga

SEQ ID NO: 496069 - RNA, 21 nt, Homo sapiens
gcuaacuugcuuaaaugugaa

SEQ ID NO: 496070 - RNA, 23 nt, Homo sapiens
gcuacacguuggaguauaccuau

SEQ ID NO: 496071 - RNA, 20 nt, Homo sapiens
gcucacgccuguaaucccag

SEQ ID NO: 496072 - RNA, 19 nt, Homo sapiens
gcuccaaaugucuacugaa

SEQ ID NO: 496073 - RNA, 17 nt, Homo sapiens
gcuccagcccuugucag

SEQ ID NO: 496074 - RNA, 22 nt, Homo sapiens
gcuccagcccuugucagauuca

SEQ ID NO: 496075 - RNA, 16 nt, Homo sapiens
gucuucuuaaucugaa

SEQ ID NO: 496076 - RNA, 17 nt, Homo sapiens
gucuuguguauuugucu

SEQ ID NO: 496077 - RNA, 13 nt, Homo sapiens
gugaagagcauuu

SEQ ID NO: 496078 - RNA, 15 nt, Homo sapiens
gugaagagcauuugg

SEQ ID NO: 496079 - RNA, 14 nt, Homo sapiens
gugauucaccucuu

SEQ ID NO: 496080 - RNA, 14 nt, Homo sapiens
gugcaacaaacuca

SEQ ID NO: 496081 - RNA, 14 nt, Homo sapiens
gugcacggggccag

SEQ ID NO: 496082 - RNA, 15 nt, Homo sapiens
gugcagugauguggu

SEQ ID NO: 496083 - RNA, 20 nt, Homo sapiens
gugcauucauucauccucuu

SEQ ID NO: 496084 - RNA, 20 nt, Homo sapiens
gugcccccagacgcacgugg

SEQ ID NO: 496085 - RNA, 15 nt, Homo sapiens
gugccuaacuccuua

SEQ ID NO: 496086 - RNA, 17 nt, Homo sapiens
guggcuaaaugccuaau

SEQ ID NO: 496087 - RNA, 22 nt, Homo sapiens
guggcugcugaaacucauuuga

SEQ ID NO: 496088 - RNA, 16 nt, Homo sapiens
guggggcagcacagag

SEQ ID NO: 496089 - RNA, 19 nt, Homo sapiens
gugggggccucuuuaccau

SEQ ID NO: 496090 - RNA, 19 nt, Homo sapiens
gugguaggaaagccucacu

SEQ ID NO: 496091 - RNA, 22 nt, Homo sapiens
guguaauguaaacugugccaug

SEQ ID NO: 496092 - RNA, 20 nt, Homo sapiens
gugucuguccuuuaugaucc

SEQ ID NO: 496093 - RNA, 14 nt, Homo sapiens
gugucuugcaauga

SEQ ID NO: 496094 - RNA, 12 nt, Homo sapiens
gugugauuugcu

SEQ ID NO: 496095 - RNA, 17 nt, Homo sapiens
gugugcauguguguaua

SEQ ID NO: 496096 - RNA, 13 nt, Homo sapiens
guguguccaugca

SEQ ID NO: 496097 - RNA, 19 nt, Homo sapiens
guguuacauauucuuucac

SEQ ID NO: 496098 - RNA, 18 nt, Homo sapiens
guuauaaauuuuguacau

SEQ ID NO: 496099 - RNA, 14 nt, Homo sapiens
guuccaugucugaa

SEQ ID NO: 496100 - RNA, 22 nt, Homo sapiens
guuccucuagguaaacuagcaa

SEQ ID NO: 496101 - RNA, 19 nt, Homo sapiens
guuccuguuaagugaauaa

SEQ ID NO: 496102 - RNA, 17 nt, Homo sapiens
guugauguguccgugaa

SEQ ID NO: 496103 - RNA, 15 nt, Homo sapiens
guuguaaauggcauu

SEQ ID NO: 496104 - RNA, 16 nt, Homo sapiens
guuguuuuaaagucag

SEQ ID NO: 496105 - RNA, 20 nt, Homo sapiens
guuuaaaaagaaaaaaugca

SEQ ID NO: 496106 - RNA, 14 nt, Homo sapiens
guuuaaacauuucu

SEQ ID NO: 496107 - RNA, 17 nt, Homo sapiens
guuuagauuucaagaaa

SEQ ID NO: 496108 - RNA, 17 nt, Homo sapiens
guuuagugugauuguga

SEQ ID NO: 496109 - RNA, 14 nt, Homo sapiens
guuuauuacugcuu

SEQ ID NO: 496110 - RNA, 17 nt, Homo sapiens
guuuauuauuugcacag

SEQ ID NO: 496111 - RNA, 19 nt, Homo sapiens
guuuauucaacaacuacua

SEQ ID NO: 496112 - RNA, 22 nt, Homo sapiens
guuucaacuguaaaauacuucu

SEQ ID NO: 496113 - RNA, 22 nt, Homo sapiens
guuuccagcuaagccugaugau

SEQ ID NO: 496114 - RNA, 14 nt, Homo sapiens
guuucucagucuca

SEQ ID NO: 496115 - RNA, 21 nt, Homo sapiens
guuugaagucuuguguauuug

SEQ ID NO: 496116 - RNA, 15 nt, Homo sapiens
guuugacauuugucu

SEQ ID NO: 496117 - RNA, 22 nt, Homo sapiens
guuugauguccccaaaguacca

SEQ ID NO: 496118 - RNA, 13 nt, Homo sapiens
guuuguguuugaa

SEQ ID NO: 496119 - RNA, 23 nt, Homo sapiens
guuuguuuauuauaaacaaaaag

SEQ ID NO: 496120 - RNA, 13 nt, Homo sapiens
guuuucacuguau

SEQ ID NO: 496121 - RNA, 13 nt, Homo sapiens
guuuuguugcacu

SEQ ID NO: 496122 - RNA, 15 nt, Homo sapiens
uaaaaaaugugaacu

SEQ ID NO: 496123 - RNA, 17 nt, Homo sapiens
uaaaaagagauugcuuc

SEQ ID NO: 496124 - RNA, 18 nt, Homo sapiens
uaaaaaguuaaucuucau

SEQ ID NO: 496125 - RNA, 13 nt, Homo sapiens
uaaaacauuucau

SEQ ID NO: 496126 - RNA, 17 nt, Homo sapiens
uaaaacuaucagcagcg

SEQ ID NO: 496127 - RNA, 22 nt, Homo sapiens
uaaaacuguacuuugauucaca

SEQ ID NO: 496128 - RNA, 17 nt, Homo sapiens
uaaaacuuacuauggua

SEQ ID NO: 496129 - RNA, 16 nt, Homo sapiens
uaaaagaaacuguggu

SEQ ID NO: 496130 - RNA, 17 nt, Homo sapiens
uaaaaggucuaugcuca

SEQ ID NO: 496131 - RNA, 18 nt, Homo sapiens
uaaaauaaaaggauuaug

SEQ ID NO: 496132 - RNA, 18 nt, Homo sapiens
uaaaauaaaccagacuca

SEQ ID NO: 496133 - RNA, 14 nt, Homo sapiens
uaaaauaugcacua

SEQ ID NO: 496134 - RNA, 17 nt, Homo sapiens
uaaaauauugauuucau

SEQ ID NO: 496135 - RNA, 19 nt, Homo sapiens
uaaaaugagucacuuacuu

SEQ ID NO: 496136 - RNA, 21 nt, Homo sapiens
uaaaauggcaacaaacugcac

SEQ ID NO: 496137 - RNA, 16 nt, Homo sapiens
uaaaauggcauuuagc

SEQ ID NO: 496138 - RNA, 17 nt, Homo sapiens
uaaaaugugcuauuugc

SEQ ID NO: 496139 - RNA, 19 nt, Homo sapiens
uaaaauuaauuugugcauc

SEQ ID NO: 496140 - RNA, 16 nt, Homo sapiens
uaaaauuacagacaaa

SEQ ID NO: 496141 - RNA, 15 nt, Homo sapiens
uaaaauuaguuccau

SEQ ID NO: 496142 - RNA, 16 nt, Homo sapiens
uaaaauuccuaucuca

SEQ ID NO: 496143 - RNA, 14 nt, Homo sapiens
uaaaauuugugcug

SEQ ID NO: 496144 - RNA, 22 nt, Homo sapiens
uaaaccaaaggacauuaugugu

SEQ ID NO: 496145 - RNA, 16 nt, Homo sapiens
uaaaccugaacaaacc

SEQ ID NO: 496146 - RNA, 13 nt, Homo sapiens
uaaacuuuaacuu

SEQ ID NO: 496147 - RNA, 14 nt, Homo sapiens
uaaagcuuuugcau

SEQ ID NO: 496148 - RNA, 16 nt, Homo sapiens
uaaagcuuuugcauag

SEQ ID NO: 496149 - RNA, 14 nt, Homo sapiens
uacauguguguaua

SEQ ID NO: 496150 - RNA, 12 nt, Homo sapiens
uaccaaagccca

SEQ ID NO: 496151 - RNA, 20 nt, Homo sapiens
uaccaaaugccuuucuagca

SEQ ID NO: 496152 - RNA, 15 nt, Homo sapiens
uaccaagcagcucac

SEQ ID NO: 496153 - RNA, 13 nt, Homo sapiens
uaccacacugagu

SEQ ID NO: 496154 - RNA, 17 nt, Homo sapiens
uaccagggauguagauu

SEQ ID NO: 496155 - RNA, 17 nt, Homo sapiens
uaccuguaauagccuca

SEQ ID NO: 496156 - RNA, 14 nt, Homo sapiens
uaccuuuaaauuga

SEQ ID NO: 496157 - RNA, 14 nt, Homo sapiens
uaccuuuggaauug

SEQ ID NO: 496158 - RNA, 15 nt, Homo sapiens
uacggaccuuuuugc

SEQ ID NO: 496159 - RNA, 13 nt, Homo sapiens
uacggcuaccugg

SEQ ID NO: 496160 - RNA, 20 nt, Homo sapiens
uacuggauuuaacuaccuuu

SEQ ID NO: 496161 - RNA, 17 nt, Homo sapiens
uacuggggaaagugcau

SEQ ID NO: 496162 - RNA, 19 nt, Homo sapiens
uacuggggaaagugcauuu

SEQ ID NO: 496163 - RNA, 15 nt, Homo sapiens
uacuguauuguuaca

SEQ ID NO: 496164 - RNA, 22 nt, Homo sapiens
uacuuuagguaguagaaucuca

SEQ ID NO: 496165 - RNA, 19 nt, Homo sapiens
uacuuuguccuaagagauu

SEQ ID NO: 496166 - RNA, 18 nt, Homo sapiens
uagaaagcaacuuaucag

SEQ ID NO: 496167 - RNA, 22 nt, Homo sapiens
uagaaauguuuagguuacuaaa

SEQ ID NO: 496168 - RNA, 17 nt, Homo sapiens
uagaacaccugagcugc

SEQ ID NO: 496169 - RNA, 19 nt, Homo sapiens
uagaaucaagucugugaaa

SEQ ID NO: 496170 - RNA, 16 nt, Homo sapiens
uagaauccgaagggaa

SEQ ID NO: 496171 - RNA, 14 nt, Homo sapiens
uagacauaccucuc

SEQ ID NO: 496172 - RNA, 19 nt, Homo sapiens
uagacuauauacaugugug

SEQ ID NO: 496173 - RNA, 15 nt, Homo sapiens
uagagagaaacagcu

SEQ ID NO: 496174 - RNA, 19 nt, Homo sapiens
uagaggguccagucuucua

SEQ ID NO: 496175 - RNA, 21 nt, Homo sapiens
uagaguuuacuauuuuagcag

SEQ ID NO: 496176 - RNA, 22 nt, Homo sapiens
uagauugauuuaccuuuggaau

SEQ ID NO: 496177 - RNA, 13 nt, Homo sapiens
uagcucgugugcu

SEQ ID NO: 496178 - RNA, 16 nt, Homo sapiens
uagcucgugugcuuag

SEQ ID NO: 496179 - RNA, 20 nt, Homo sapiens
uagcugucauggugcaauuu

SEQ ID NO: 496180 - RNA, 18 nt, Homo sapiens
uagcuuucaguauuguaa

SEQ ID NO: 496181 - RNA, 17 nt, Homo sapiens
uaggauugaacuucaau

SEQ ID NO: 496182 - RNA, 16 nt, Homo sapiens
uagggcucuaauuucc

SEQ ID NO: 496183 - RNA, 23 nt, Homo sapiens
uagugaccaaucgggaguagcaa

SEQ ID NO: 496184 - RNA, 16 nt, Homo sapiens
uagugucccuuaccug

SEQ ID NO: 496185 - RNA, 15 nt, Homo sapiens
uaguuccauuugguc

SEQ ID NO: 496186 - RNA, 20 nt, Homo sapiens
uaguugccguggcaacugug

SEQ ID NO: 496187 - RNA, 21 nt, Homo sapiens
uaguugccguggcaacugugg

SEQ ID NO: 496188 - RNA, 23 nt, Homo sapiens
uaguugccguggcaacuguggaa

SEQ ID NO: 496189 - RNA, 11 nt, Homo sapiens
uaguuuugcuu

SEQ ID NO: 496190 - RNA, 14 nt, Homo sapiens
uauaaagauuuucu

SEQ ID NO: 496191 - RNA, 22 nt, Homo sapiens
uauaaagcaucuaaacuuuaau

SEQ ID NO: 496192 - RNA, 20 nt, Homo sapiens
uauaaauguauauacacaua

SEQ ID NO: 496193 - RNA, 22 nt, Homo sapiens
uauaagcacagacaauucuaau

SEQ ID NO: 496194 - RNA, 16 nt, Homo sapiens
uauaaguuugcauuau

SEQ ID NO: 496195 - RNA, 14 nt, Homo sapiens
uauaaugcaauaaa

SEQ ID NO: 496196 - RNA, 14 nt, Homo sapiens
uauacagauuuucu

SEQ ID NO: 496197 - RNA, 16 nt, Homo sapiens
uauacauguguguaua

SEQ ID NO: 496198 - RNA, 17 nt, Homo sapiens
uauacgcacgcacccac

SEQ ID NO: 496199 - RNA, 21 nt, Homo sapiens
uauagauugauuuaccuuugg

SEQ ID NO: 496200 - RNA, 23 nt, Homo sapiens
uauagcguucccaacaacaucca

SEQ ID NO: 496201 - RNA, 18 nt, Homo sapiens
uauauaauuuuauugcug

SEQ ID NO: 496202 - RNA, 23 nt, Homo sapiens
uauauauaaaauacacguguaua

SEQ ID NO: 496203 - RNA, 15 nt, Homo sapiens
uauaucuguauauau

SEQ ID NO: 496204 - RNA, 12 nt, Homo sapiens
uauauucccaaa

SEQ ID NO: 496205 - RNA, 21 nt, Homo sapiens
uauauuuucugaguagcauau

SEQ ID NO: 496206 - RNA, 15 nt, Homo sapiens
uaucagugaacacag

SEQ ID NO: 496207 - RNA, 14 nt, Homo sapiens
uauccuguauguaa

SEQ ID NO: 496208 - RNA, 17 nt, Homo sapiens
uaucuaccaacuuucaa

SEQ ID NO: 496209 - RNA, 19 nt, Homo sapiens
uaucugugugugauuugcu

SEQ ID NO: 496210 - RNA, 15 nt, Homo sapiens
uaucuuagcuggaua

SEQ ID NO: 496211 - RNA, 16 nt, Homo sapiens
uaugaggguacugugg

SEQ ID NO: 496212 - RNA, 19 nt, Homo sapiens
uaugaucuggcccuugcuu

SEQ ID NO: 496213 - RNA, 16 nt, Homo sapiens
uaugcucauaacugug

SEQ ID NO: 496214 - RNA, 13 nt, Homo sapiens
uauguaacaguuu

SEQ ID NO: 496215 - RNA, 17 nt, Homo sapiens
uaugugcagcuuuccag

SEQ ID NO: 496216 - RNA, 17 nt, Homo sapiens
uauguguauauauacau

SEQ ID NO: 496217 - RNA, 18 nt, Homo sapiens
uauguuuacacugucaaa

SEQ ID NO: 496218 - RNA, 17 nt, Homo sapiens
uauuaccagauucacuu

SEQ ID NO: 496219 - RNA, 20 nt, Homo sapiens
uauuacccuucuuuccauuu

SEQ ID NO: 496220 - RNA, 18 nt, Homo sapiens
uauuauuugcacagaaga

SEQ ID NO: 496221 - RNA, 15 nt, Homo sapiens
uauuuaaaacauuuc

SEQ ID NO: 496222 - RNA, 21 nt, Homo sapiens
uauuucauuuugagaacauuc

SEQ ID NO: 496223 - RNA, 15 nt, Homo sapiens
uauuuucagcucaau

SEQ ID NO: 496224 - RNA, 21 nt, Homo sapiens
uauuuugcuuguuaaauucua

SEQ ID NO: 496225 - RNA, 23 nt, Homo sapiens
uauuuuguaugcaagcaguuuca

SEQ ID NO: 496226 - RNA, 17 nt, Homo sapiens
uauuuugucacugcugu

SEQ ID NO: 496227 - RNA, 22 nt, Homo sapiens
ucaaaauguggaccaguucccu

SEQ ID NO: 496228 - RNA, 15 nt, Homo sapiens
ucaaacagaaaagaa

SEQ ID NO: 496229 - RNA, 16 nt, Homo sapiens
ucaaagcuuuuugcua

SEQ ID NO: 496230 - RNA, 17 nt, Homo sapiens
ucaaaugcuacucagua

SEQ ID NO: 496231 - RNA, 16 nt, Homo sapiens
ucaaauguacaucucc

SEQ ID NO: 496232 - RNA, 18 nt, Homo sapiens
ucaacaugguuaccucug

SEQ ID NO: 496233 - RNA, 16 nt, Homo sapiens
ucaacuaugcaaugaa

SEQ ID NO: 496234 - RNA, 14 nt, Homo sapiens
ucaacuucaggaaa

SEQ ID NO: 496235 - RNA, 22 nt, Homo sapiens
ucaagcagaaaaacaggcacag

SEQ ID NO: 496236 - RNA, 15 nt, Homo sapiens
ucaaggcugcaguga

SEQ ID NO: 496237 - RNA, 15 nt, Homo sapiens
ucaauaaaguuugau

SEQ ID NO: 496238 - RNA, 15 nt, Homo sapiens
ucaauauuucuagua

SEQ ID NO: 496239 - RNA, 15 nt, Homo sapiens
ucaauuuauugcaca

SEQ ID NO: 496240 - RNA, 23 nt, Homo sapiens
ucacagaguaugaucucagggca

SEQ ID NO: 496241 - RNA, 13 nt, Homo sapiens
ucacagaugggca

SEQ ID NO: 496242 - RNA, 14 nt, Homo sapiens
ucaccagagcauuu

SEQ ID NO: 496243 - RNA, 15 nt, Homo sapiens
ucaccagagcauuuc

SEQ ID NO: 496244 - RNA, 18 nt, Homo sapiens
ucaccagagcauuuccaa

SEQ ID NO: 496245 - RNA, 19 nt, Homo sapiens
ucacuaccaagcagcucac

SEQ ID NO: 496246 - RNA, 18 nt, Homo sapiens
ucacugauauauuuucca

SEQ ID NO: 496247 - RNA, 14 nt, Homo sapiens
ucacugcaaaacca

SEQ ID NO: 496248 - RNA, 17 nt, Homo sapiens
ucacuucugacucuucc

SEQ ID NO: 496249 - RNA, 18 nt, Homo sapiens
ucagaaaaugcagccuua

SEQ ID NO: 496250 - RNA, 12 nt, Homo sapiens
ucagaaagggau

SEQ ID NO: 496251 - RNA, 15 nt, Homo sapiens
ucagaagacacagag

SEQ ID NO: 496252 - RNA, 17 nt, Homo sapiens
ucagacacaaacaaaca

SEQ ID NO: 496253 - RNA, 17 nt, Homo sapiens
ucagagaaauacuuuca

SEQ ID NO: 496254 - RNA, 18 nt, Homo sapiens
ucagagaaauacuuucag

SEQ ID NO: 496255 - RNA, 22 nt, Homo sapiens
ucagagcacagccaaucuccag

SEQ ID NO: 496256 - RNA, 16 nt, Homo sapiens
ucagauuuugugaacu

SEQ ID NO: 496257 - RNA, 18 nt, Homo sapiens
ucagauuuugugaacucc

SEQ ID NO: 496258 - RNA, 19 nt, Homo sapiens
ucagauuuuuaaaagcccu

SEQ ID NO: 496259 - RNA, 18 nt, Homo sapiens
ucagcacuuuguuucaua

SEQ ID NO: 496260 - RNA, 17 nt, Homo sapiens
ucagcaugucucagauu

SEQ ID NO: 496261 - RNA, 14 nt, Homo sapiens
ucagcauguucuca

SEQ ID NO: 496262 - RNA, 21 nt, Homo sapiens
ucagccaaggacacuugauau

SEQ ID NO: 496263 - RNA, 20 nt, Homo sapiens
ucaggaagccuccugcugag

SEQ ID NO: 496264 - RNA, 21 nt, Homo sapiens
ucaggaagccuccugcugagu

SEQ ID NO: 496265 - RNA, 17 nt, Homo sapiens
ucaggagaaaccccuga

SEQ ID NO: 496266 - RNA, 14 nt, Homo sapiens
ucaggaggagacag

SEQ ID NO: 496267 - RNA, 23 nt, Homo sapiens
ucagugggaaacaaacugucuaa

SEQ ID NO: 496268 - RNA, 20 nt, Homo sapiens
ucaguguuauaaaaucugua

SEQ ID NO: 496269 - RNA, 23 nt, Homo sapiens
ucaguuuuuguauggaagccacc

SEQ ID NO: 496270 - RNA, 18 nt, Homo sapiens
ucauaauggaaaaaaaga

SEQ ID NO: 496271 - RNA, 15 nt, Homo sapiens
ucauaccuguacaca

SEQ ID NO: 496272 - RNA, 17 nt, Homo sapiens
ucauaccuucugaugaa

SEQ ID NO: 496273 - RNA, 13 nt, Homo sapiens
ucauccaacguga

SEQ ID NO: 496274 - RNA, 19 nt, Homo sapiens
ucauccugccuucauggaa

SEQ ID NO: 496275 - RNA, 11 nt, Homo sapiens
ucaugaaggag

SEQ ID NO: 496276 - RNA, 16 nt, Homo sapiens
ucaugcuucuacucca

SEQ ID NO: 496277 - RNA, 12 nt, Homo sapiens
ucauggaacuca

SEQ ID NO: 496278 - RNA, 15 nt, Homo sapiens
ucauggaauugguuu

SEQ ID NO: 496279 - RNA, 14 nt, Homo sapiens
ucauggugcaauuu

SEQ ID NO: 496280 - RNA, 21 nt, Homo sapiens
ucauucccaggcacucucuuu

SEQ ID NO: 496281 - RNA, 14 nt, Homo sapiens
ucauucuuauaaca

SEQ ID NO: 496282 - RNA, 21 nt, Homo sapiens
ucauuguucagaaaagcaccu

SEQ ID NO: 496283 - RNA, 15 nt, Homo sapiens
uccaaacucuucccu

SEQ ID NO: 496284 - RNA, 18 nt, Homo sapiens
uccaacagaaagcauaga

SEQ ID NO: 496285 - RNA, 23 nt, Homo sapiens
ugucugucccaguuaacuguuaa

SEQ ID NO: 496286 - RNA, 22 nt, Homo sapiens
ugucuucagccucuccaggcac

SEQ ID NO: 496287 - RNA, 15 nt, Homo sapiens
ugucuucgaggacag

SEQ ID NO: 496288 - RNA, 15 nt, Homo sapiens
ugugaagagcaagag

SEQ ID NO: 496289 - RNA, 20 nt, Homo sapiens
ugugagcuuucugauacuua

SEQ ID NO: 496290 - RNA, 17 nt, Homo sapiens
ugugcagugauguggug

SEQ ID NO: 496291 - RNA, 16 nt, Homo sapiens
ugugccacacaaugga

SEQ ID NO: 496292 - RNA, 15 nt, Homo sapiens
ugugccuuggugauu

SEQ ID NO: 496293 - RNA, 17 nt, Homo sapiens
ugugcgaacacagugac

SEQ ID NO: 496294 - RNA, 14 nt, Homo sapiens
ugugcuaagucuuu

SEQ ID NO: 496295 - RNA, 15 nt, Homo sapiens
ugugcucuacaucuc

SEQ ID NO: 496296 - RNA, 15 nt, Homo sapiens
uguggaaaacucaca

SEQ ID NO: 496297 - RNA, 17 nt, Homo sapiens
uguggaaaacucacaga

SEQ ID NO: 496298 - RNA, 14 nt, Homo sapiens
uguggacaugcacc

SEQ ID NO: 496299 - RNA, 18 nt, Homo sapiens
uguggcuucccaugucuu

SEQ ID NO: 496300 - RNA, 19 nt, Homo sapiens
uguguaauguaaacugugc

SEQ ID NO: 496301 - RNA, 17 nt, Homo sapiens
uguguauauauguguau

SEQ ID NO: 496302 - RNA, 20 nt, Homo sapiens
uguguaugagacuguguuuc

SEQ ID NO: 496303 - RNA, 17 nt, Homo sapiens
uguguuuauuacugcuu

SEQ ID NO: 496304 - RNA, 15 nt, Homo sapiens
uguuaauuucuugca

SEQ ID NO: 496305 - RNA, 21 nt, Homo sapiens
uguuauccuguuuuugcaaaa

SEQ ID NO: 496306 - RNA, 22 nt, Homo sapiens
uguuauuuguugagacuaucaa

SEQ ID NO: 496307 - RNA, 14 nt, Homo sapiens
uguuuacacuguca

SEQ ID NO: 496308 - RNA, 18 nt, Homo sapiens
uguuuauuauuugcacag

SEQ ID NO: 496309 - RNA, 20 nt, Homo sapiens
uguuuccaacgucauggaag

SEQ ID NO: 496310 - RNA, 20 nt, Homo sapiens
uguuucuugccugaacuccu

SEQ ID NO: 496311 - RNA, 15 nt, Homo sapiens
uguuuucacuguaau

SEQ ID NO: 496312 - RNA, 15 nt, Homo sapiens
uguuuuccaguauua

SEQ ID NO: 496313 - RNA, 21 nt, Homo sapiens
uuaaacauuucuuucugugcc

SEQ ID NO: 496314 - RNA, 18 nt, Homo sapiens
uuaaauguccguguaaaa

SEQ ID NO: 496315 - RNA, 19 nt, Homo sapiens
uuaacaccuucauccagau

SEQ ID NO: 496316 - RNA, 19 nt, Homo sapiens
uuaaggguuaaaucacuuu

SEQ ID NO: 496317 - RNA, 15 nt, Homo sapiens
uuaauaacagcuccu

SEQ ID NO: 496318 - RNA, 13 nt, Homo sapiens
uuaauauacuaga

SEQ ID NO: 496319 - RNA, 14 nt, Homo sapiens
uuaaugauuugcuu

SEQ ID NO: 496320 - RNA, 23 nt, Homo sapiens
uuacaaaacaugauuguuuacag

SEQ ID NO: 496321 - RNA, 16 nt, Homo sapiens
uuacaagacuguaaau

SEQ ID NO: 496322 - RNA, 22 nt, Homo sapiens
uuacagaaccaauucacuuuag

SEQ ID NO: 496323 - RNA, 17 nt, Homo sapiens
uuacaguggcaguauug

SEQ ID NO: 496324 - RNA, 19 nt, Homo sapiens
uuacauuacugauuuccag

SEQ ID NO: 496325 - RNA, 22 nt, Homo sapiens
uuacauugccauuugguagcau

SEQ ID NO: 496326 - RNA, 20 nt, Homo sapiens
uuacauuguauagccccaca

SEQ ID NO: 496327 - RNA, 16 nt, Homo sapiens
uuacccuucuuuccau

SEQ ID NO: 496328 - RNA, 15 nt, Homo sapiens
uuaccuauugcugua

SEQ ID NO: 496329 - RNA, 16 nt, Homo sapiens
uuacuggggaaagugc

SEQ ID NO: 496330 - RNA, 12 nt, Homo sapiens
uuacugucuuaa

SEQ ID NO: 496331 - RNA, 19 nt, Homo sapiens
uuagaauguugaaacugac

SEQ ID NO: 496332 - RNA, 15 nt, Homo sapiens
uuagacauaccucuc

SEQ ID NO: 496333 - RNA, 18 nt, Homo sapiens
uuagcaaagcaugccaau

SEQ ID NO: 496334 - RNA, 16 nt, Homo sapiens
uuagcuuuucugcaau

SEQ ID NO: 496335 - RNA, 15 nt, Homo sapiens
uuaggugucuguccu

SEQ ID NO: 496336 - RNA, 21 nt, Homo sapiens
uuaggugucuguccuuuauga

SEQ ID NO: 496337 - RNA, 15 nt, Homo sapiens
uuaguaucucaucaa

SEQ ID NO: 496338 - RNA, 20 nt, Homo sapiens
uuaguuccauuuggucuucu

SEQ ID NO: 496339 - RNA, 15 nt, Homo sapiens
uuaguuuuucugucc

SEQ ID NO: 496340 - RNA, 21 nt, Homo sapiens
uuauaccuguacacacacaga

SEQ ID NO: 496341 - RNA, 12 nt, Homo sapiens
uuauacuuucag

SEQ ID NO: 496342 - RNA, 17 nt, Homo sapiens
uuauaucagacugcuuu

SEQ ID NO: 496343 - RNA, 20 nt, Homo sapiens
uuauaucuaaaucuguccaa

SEQ ID NO: 496344 - RNA, 23 nt, Homo sapiens
uuauauuuuucuuaaaaaguaac

SEQ ID NO: 496345 - RNA, 15 nt, Homo sapiens
uuaucauaaauucaa

SEQ ID NO: 496346 - RNA, 19 nt, Homo sapiens
uuauuacccuucuuuccau

SEQ ID NO: 496347 - RNA, 16 nt, Homo sapiens
uuauuauuugcacaga

SEQ ID NO: 496348 - RNA, 21 nt, Homo sapiens
uuauucaauaacuauugcugc

SEQ ID NO: 496349 - RNA, 16 nt, Homo sapiens
uuauucguuacucuaa

SEQ ID NO: 496350 - RNA, 13 nt, Homo sapiens
uuauuuccaugga

SEQ ID NO: 496351 - RNA, 23 nt, Homo sapiens
uuauuugcuaccacagcaacuau

SEQ ID NO: 496352 - RNA, 20 nt, Homo sapiens
uucaauccccauaaugcuuc

SEQ ID NO: 496353 - RNA, 15 nt, Homo sapiens
uucacagugucugua

SEQ ID NO: 496354 - RNA, 20 nt, Homo sapiens
uucacaguugagugcauccc

SEQ ID NO: 496355 - RNA, 15 nt, Homo sapiens
uucaccagagcauuu

SEQ ID NO: 496356 - RNA, 22 nt, Homo sapiens
uucaccaguuuccaaguuuauu

SEQ ID NO: 496357 - RNA, 16 nt, Homo sapiens
uucaccuccaacugga

SEQ ID NO: 496358 - RNA, 15 nt, Homo sapiens
uucacugucaccacc

SEQ ID NO: 496359 - RNA, 13 nt, Homo sapiens
uucauaccuguac

SEQ ID NO: 496360 - RNA, 22 nt, Homo sapiens
uucauagaauaacaacugcugg

SEQ ID NO: 496361 - RNA, 14 nt, Homo sapiens
uucauauaugcaaa

SEQ ID NO: 496362 - RNA, 15 nt, Homo sapiens
uucauauaugcaaaa

SEQ ID NO: 496363 - RNA, 20 nt, Homo sapiens
uucauuaccuguagcuuugg

SEQ ID NO: 496364 - RNA, 10 nt, Homo sapiens
uucauugugu

SEQ ID NO: 496365 - RNA, 13 nt, Homo sapiens
uuccaaaguuuug

SEQ ID NO: 496366 - RNA, 21 nt, Homo sapiens
uuccaacaccacagacacaca

SEQ ID NO: 496367 - RNA, 17 nt, Homo sapiens
uuccaaguuuauugccc

SEQ ID NO: 496368 - RNA, 18 nt, Homo sapiens
uuccaaguuuauugcccu

SEQ ID NO: 496369 - RNA, 22 nt, Homo sapiens
uuccaauaauugacugguggaa

SEQ ID NO: 496370 - RNA, 14 nt, Homo sapiens
uuccagaaacaccc

SEQ ID NO: 496371 - RNA, 15 nt, Homo sapiens
uucccugacacuguc

SEQ ID NO: 496372 - RNA, 24 nt, Homo sapiens
uuccuaugaaguuggcacauuuca

SEQ ID NO: 496373 - RNA, 23 nt, Homo sapiens
caguaacacaggccacccugugc

SEQ ID NO: 496374 - RNA, 18 nt, Homo sapiens
cagucaaggaguggcuua

SEQ ID NO: 496375 - RNA, 15 nt, Homo sapiens
cagucauauguucuc

SEQ ID NO: 496376 - RNA, 16 nt, Homo sapiens
cagucauauguucuca

SEQ ID NO: 496377 - RNA, 11 nt, Homo sapiens
cagucaucucc

SEQ ID NO: 496378 - RNA, 23 nt, Homo sapiens
cagugacuucacacacaccucau

SEQ ID NO: 496379 - RNA, 17 nt, Homo sapiens
caguguagaucaacuca

SEQ ID NO: 496380 - RNA, 23 nt, Homo sapiens
caguuacaguggcaguauugaca

SEQ ID NO: 496381 - RNA, 17 nt, Homo sapiens
caguugcaauaaacuca

SEQ ID NO: 496382 - RNA, 15 nt, Homo sapiens
caguugguuuugcau

SEQ ID NO: 496383 - RNA, 22 nt, Homo sapiens
caguuguaacauucuauuucaa

SEQ ID NO: 496384 - RNA, 16 nt, Homo sapiens
caguuuauuccagagc

SEQ ID NO: 496385 - RNA, 20 nt, Homo sapiens
caguuucaauaaaguuugau

SEQ ID NO: 496386 - RNA, 22 nt, Homo sapiens
caguuugugaucuguccuucca

SEQ ID NO: 496387 - RNA, 18 nt, Homo sapiens
cauaaaaacuacugaaua

SEQ ID NO: 496388 - RNA, 16 nt, Homo sapiens
cauaaaucaauucauu

SEQ ID NO: 496389 - RNA, 14 nt, Homo sapiens
cauaaaucuuccaa

SEQ ID NO: 496390 - RNA, 16 nt, Homo sapiens
cauacauauauacauu

SEQ ID NO: 496391 - RNA, 15 nt, Homo sapiens
cauacugcauacaug

SEQ ID NO: 496392 - RNA, 17 nt, Homo sapiens
cauaguuauguaaaaag

SEQ ID NO: 496393 - RNA, 23 nt, Homo sapiens
cauauauaaaaguuuaaagaaga

SEQ ID NO: 496394 - RNA, 24 nt, Homo sapiens
cauauauaauuuuauugcuggaau

SEQ ID NO: 496395 - RNA, 17 nt, Homo sapiens
cauaucuguaugccuca

SEQ ID NO: 496396 - RNA, 13 nt, Homo sapiens
cauaugucuucaa

SEQ ID NO: 496397 - RNA, 20 nt, Homo sapiens
cauauuauaucagacugcuu

SEQ ID NO: 496398 - RNA, 19 nt, Homo sapiens
cauauugcuaccaaaaacu

SEQ ID NO: 496399 - RNA, 16 nt, Homo sapiens
cauauuuaaagucuug

SEQ ID NO: 496400 - RNA, 15 nt, Homo sapiens
caucaaguugcacac

SEQ ID NO: 496401 - RNA, 17 nt, Homo sapiens
caucaauucccauugca

SEQ ID NO: 496402 - RNA, 18 nt, Homo sapiens
caucagaggacaccugua

SEQ ID NO: 496403 - RNA, 19 nt, Homo sapiens
caucaucagucuuaauauu

SEQ ID NO: 496404 - RNA, 14 nt, Homo sapiens
cauccaagcuuccu

SEQ ID NO: 496405 - RNA, 22 nt, Homo sapiens
cauccaccuucccuucuacaag

SEQ ID NO: 496406 - RNA, 19 nt, Homo sapiens
cauccccuuuguguagaaa

SEQ ID NO: 496407 - RNA, 19 nt, Homo sapiens
caucuaaauauuaugccuu

SEQ ID NO: 496408 - RNA, 22 nt, Homo sapiens
caucugcaguguucugugaaua

SEQ ID NO: 496409 - RNA, 24 nt, Homo sapiens
caucuuauuugucaguguagauca

SEQ ID NO: 496410 - RNA, 14 nt, Homo sapiens
caugaaaacagaaa

SEQ ID NO: 496411 - RNA, 12 nt, Homo sapiens
caugaacuggag

SEQ ID NO: 496412 - RNA, 17 nt, Homo sapiens
caugaagauaaauccaa

SEQ ID NO: 496413 - RNA, 22 nt, Homo sapiens
caugcagauaguauacacauca

SEQ ID NO: 496414 - RNA, 16 nt, Homo sapiens
caugcaucacuauuca

SEQ ID NO: 496415 - RNA, 20 nt, Homo sapiens
caugccuuuccagugcugcu

SEQ ID NO: 496416 - RNA, 15 nt, Homo sapiens
caugcgcagucccca

SEQ ID NO: 496417 - RNA, 21 nt, Homo sapiens
cauggcagcaugcgaugucau

SEQ ID NO: 496418 - RNA, 14 nt, Homo sapiens
caugguagacugug

SEQ ID NO: 496419 - RNA, 22 nt, Homo sapiens
caugguagacugugacacagcu

SEQ ID NO: 496420 - RNA, 20 nt, Homo sapiens
cauguacaaaaacacaaaua

SEQ ID NO: 496421 - RNA, 14 nt, Homo sapiens
caugucgcacaaug

SEQ ID NO: 496422 - RNA, 17 nt, Homo sapiens
caugugauguguugcuc

SEQ ID NO: 496423 - RNA, 15 nt, Homo sapiens
cauguggaaaacuca

SEQ ID NO: 496424 - RNA, 15 nt, Homo sapiens
caugugucuugcaau

SEQ ID NO: 496425 - RNA, 13 nt, Homo sapiens
caugugugacugc

SEQ ID NO: 496426 - RNA, 16 nt, Homo sapiens
cauguguguauauaug

SEQ ID NO: 496427 - RNA, 19 nt, Homo sapiens
cauguguuucuguguagua

SEQ ID NO: 496428 - RNA, 16 nt, Homo sapiens
cauuaacaagaucauu

SEQ ID NO: 496429 - RNA, 18 nt, Homo sapiens
cauuaagccucuugucua

SEQ ID NO: 496430 - RNA, 20 nt, Homo sapiens
cauuaagccucuugucuaca

SEQ ID NO: 496431 - RNA, 17 nt, Homo sapiens
cauuaauguugauuucu

SEQ ID NO: 496432 - RNA, 15 nt, Homo sapiens
cauuccaauuugcac

SEQ ID NO: 496433 - RNA, 12 nt, Homo sapiens
cauugauuggua

SEQ ID NO: 496434 - RNA, 21 nt, Homo sapiens
cauugcuuuuaaaacuacuua

SEQ ID NO: 496435 - RNA, 19 nt, Homo sapiens
cauuguguacaaaauaucc

SEQ ID NO: 496436 - RNA, 16 nt, Homo sapiens
cauuuccauguaugca

SEQ ID NO: 496437 - RNA, 23 nt, Homo sapiens
cauuucuaacauaaguaagacuu

SEQ ID NO: 496438 - RNA, 17 nt, Homo sapiens
cauuugauugucauuuu

SEQ ID NO: 496439 - RNA, 17 nt, Homo sapiens
cauuugguacacacuug

SEQ ID NO: 496440 - RNA, 13 nt, Homo sapiens
cauuugucauuuu

SEQ ID NO: 496441 - RNA, 19 nt, Homo sapiens
cauuuuuaagaacaagcag

SEQ ID NO: 496442 - RNA, 22 nt, Homo sapiens
cauuuuuauuacccuucuuucc

SEQ ID NO: 496443 - RNA, 15 nt, Homo sapiens
cauuuuucuacugcu

SEQ ID NO: 496444 - RNA, 16 nt, Homo sapiens
cauuuuuugucuguga

SEQ ID NO: 496445 - RNA, 20 nt, Homo sapiens
ccaaacucuucccucucuca

SEQ ID NO: 496446 - RNA, 20 nt, Homo sapiens
ccaaagugaccuacccagag

SEQ ID NO: 496447 - RNA, 14 nt, Homo sapiens
ccaaaucucaaaag

SEQ ID NO: 496448 - RNA, 12 nt, Homo sapiens
ccaacaccacag

SEQ ID NO: 496449 - RNA, 16 nt, Homo sapiens
ccaacaugugaugugu

SEQ ID NO: 496450 - RNA, 12 nt, Homo sapiens
ccaacccaugag

SEQ ID NO: 496451 - RNA, 18 nt, Homo sapiens
ccaacccaugagugcuaa

SEQ ID NO: 496452 - RNA, 21 nt, Homo sapiens
ccaagcugaggaggugcugca

SEQ ID NO: 496453 - RNA, 18 nt, Homo sapiens
ccaaugcacauccauucc

SEQ ID NO: 496454 - RNA, 18 nt, Homo sapiens
cucuuaaugucucaaaau

SEQ ID NO: 496455 - RNA, 20 nt, Homo sapiens
cucuucagccauaguggauc

SEQ ID NO: 496456 - RNA, 15 nt, Homo sapiens
cucuucuuacuguau

SEQ ID NO: 496457 - RNA, 22 nt, Homo sapiens
cucuuggaacugcaccaccgac

SEQ ID NO: 496458 - RNA, 22 nt, Homo sapiens
cucuugggaaacggaaugaccu

SEQ ID NO: 496459 - RNA, 15 nt, Homo sapiens
cugaaaacuggaaua

SEQ ID NO: 496460 - RNA, 13 nt, Homo sapiens
cugaaaauucaac

SEQ ID NO: 496461 - RNA, 15 nt, Homo sapiens
cugaaauacauauga

SEQ ID NO: 496462 - RNA, 20 nt, Homo sapiens
cugaaauauuuucuacuuua

SEQ ID NO: 496463 - RNA, 15 nt, Homo sapiens
cugaaauguuuccag

SEQ ID NO: 496464 - RNA, 14 nt, Homo sapiens
cugaacucccaguc

SEQ ID NO: 496465 - RNA, 20 nt, Homo sapiens
cugaacuccugccauagucu

SEQ ID NO: 496466 - RNA, 21 nt, Homo sapiens
cugaaucuucagcauguucuc

SEQ ID NO: 496467 - RNA, 22 nt, Homo sapiens
cugaaucuucagcauguucuca

SEQ ID NO: 496468 - RNA, 18 nt, Homo sapiens
cugacacaagaauggucu

SEQ ID NO: 496469 - RNA, 11 nt, Homo sapiens
cugacacuguc

SEQ ID NO: 496470 - RNA, 14 nt, Homo sapiens
cugagaagccucau

SEQ ID NO: 496471 - RNA, 23 nt, Homo sapiens
cugaggcuggggcuuuugugcca

SEQ ID NO: 496472 - RNA, 20 nt, Homo sapiens
cugaguagcauauauaauuu

SEQ ID NO: 496473 - RNA, 17 nt, Homo sapiens
cugagucugccucuguu

SEQ ID NO: 496474 - RNA, 20 nt, Homo sapiens
cugagugaaauauuacucug

SEQ ID NO: 496475 - RNA, 14 nt, Homo sapiens
cugagugguccaca

SEQ ID NO: 496476 - RNA, 16 nt, Homo sapiens
cugauccuaacugaag

SEQ ID NO: 496477 - RNA, 23 nt, Homo sapiens
cugaugaagaaauuuaugaagca

SEQ ID NO: 496478 - RNA, 17 nt, Homo sapiens
cugauuguuuuaacuga

SEQ ID NO: 496479 - RNA, 15 nt, Homo sapiens
cugcaagcaauguau

SEQ ID NO: 496480 - RNA, 21 nt, Homo sapiens
cugcaccaccgaccaacucca

SEQ ID NO: 496481 - RNA, 17 nt, Homo sapiens
cugcauagcuugcacaa

SEQ ID NO: 496482 - RNA, 10 nt, Homo sapiens
cugcauuuca

SEQ ID NO: 496483 - RNA, 21 nt, Homo sapiens
cugcauuuucugaaacuaaug

SEQ ID NO: 496484 - RNA, 16 nt, Homo sapiens
cugccaagaguccaag

SEQ ID NO: 496485 - RNA, 17 nt, Homo sapiens
cugccaugaacuggagg

SEQ ID NO: 496486 - RNA, 13 nt, Homo sapiens
cugccugugguga

SEQ ID NO: 496487 - RNA, 22 nt, Homo sapiens
cugccuucuccccuccaaguga

SEQ ID NO: 496488 - RNA, 20 nt, Homo sapiens
cugcggcacccuugcgcuuu

SEQ ID NO: 496489 - RNA, 22 nt, Homo sapiens
cugcguaggagagaacagggau

SEQ ID NO: 496490 - RNA, 23 nt, Homo sapiens
cugcucuuuaggauggggaguau

SEQ ID NO: 496491 - RNA, 23 nt, Homo sapiens
cugcugaauuuggggcuacuuau

SEQ ID NO: 496492 - RNA, 12 nt, Homo sapiens
cugcugccagua

SEQ ID NO: 496493 - RNA, 21 nt, Homo sapiens
cugcuuagugucccuuaccug

SEQ ID NO: 496494 - RNA, 22 nt, Homo sapiens
cugcuuagugucccuuaccugg

SEQ ID NO: 496495 - RNA, 23 nt, Homo sapiens
cuggaacuguagugguagcuuuc

SEQ ID NO: 496496 - RNA, 22 nt, Homo sapiens
cuggaagagcuaggcagggugu

SEQ ID NO: 496497 - RNA, 20 nt, Homo sapiens
cuggagaagaauggcuuuca

SEQ ID NO: 496498 - RNA, 15 nt, Homo sapiens
cuggaugguggugca

SEQ ID NO: 496499 - RNA, 20 nt, Homo sapiens
cuggcaggagacacuggucu

SEQ ID NO: 496500 - RNA, 23 nt, Homo sapiens
cuggccaggauaauauauuugca

SEQ ID NO: 496501 - RNA, 17 nt, Homo sapiens
cugggaggagaggucca

SEQ ID NO: 496502 - RNA, 22 nt, Homo sapiens
cugggguguaaugagcuccugc

SEQ ID NO: 496503 - RNA, 15 nt, Homo sapiens
cuggucgccuuccac

SEQ ID NO: 496504 - RNA, 13 nt, Homo sapiens
cuggucuccuugc

SEQ ID NO: 496505 - RNA, 19 nt, Homo sapiens
cuggugucuaauaaacaca

SEQ ID NO: 496506 - RNA, 17 nt, Homo sapiens
cugguucuguacaugug

SEQ ID NO: 496507 - RNA, 20 nt, Homo sapiens
cugguucuguacauguggaa

SEQ ID NO: 496508 - RNA, 15 nt, Homo sapiens
cuguaaaauacaugg

SEQ ID NO: 496509 - RNA, 17 nt, Homo sapiens
cuguaaaauacuucuuu

SEQ ID NO: 496510 - RNA, 16 nt, Homo sapiens
cugucuguaaugugaa

SEQ ID NO: 496511 - RNA, 22 nt, Homo sapiens
cugucuucgaggacagcaaugc

SEQ ID NO: 496512 - RNA, 23 nt, Homo sapiens
cugucuucgaggacagcaaugca

SEQ ID NO: 496513 - RNA, 19 nt, Homo sapiens
cugugaccgggguccugag

SEQ ID NO: 496514 - RNA, 20 nt, Homo sapiens
cugugcagcgaaaucuguac

SEQ ID NO: 496515 - RNA, 18 nt, Homo sapiens
cugugccacacaauggau

SEQ ID NO: 496516 - RNA, 19 nt, Homo sapiens
cuguggcuucccaugucuu

SEQ ID NO: 496517 - RNA, 19 nt, Homo sapiens
cugugugugcccgugguga

SEQ ID NO: 496518 - RNA, 21 nt, Homo sapiens
cuguguugugauuccccggag

SEQ ID NO: 496519 - RNA, 21 nt, Homo sapiens
cuguuccuuucagaugaccuu

SEQ ID NO: 496520 - RNA, 19 nt, Homo sapiens
cuguucuuggaacaacgca

SEQ ID NO: 496521 - RNA, 14 nt, Homo sapiens
cuuaaaaugugcua

SEQ ID NO: 496522 - RNA, 15 nt, Homo sapiens
cuuacacaucuucca

SEQ ID NO: 496523 - RNA, 18 nt, Homo sapiens
cuuacagaaccaauucac

SEQ ID NO: 496524 - RNA, 21 nt, Homo sapiens
cuuagcuuaucuuucuuucca

SEQ ID NO: 496525 - RNA, 13 nt, Homo sapiens
cuuaguaucucau

SEQ ID NO: 496526 - RNA, 22 nt, Homo sapiens
cuuaguaucucaucaacaaaga

SEQ ID NO: 496527 - RNA, 15 nt, Homo sapiens
cuucacaaucuguca

SEQ ID NO: 496528 - RNA, 18 nt, Homo sapiens
gauuaaggugaugugauu

SEQ ID NO: 496529 - RNA, 23 nt, Homo sapiens
gauucaccucuucuuucccuccu

SEQ ID NO: 496530 - RNA, 19 nt, Homo sapiens
gauuccuuuggccacugua

SEQ ID NO: 496531 - RNA, 18 nt, Homo sapiens
gauugaaguggcuggaaa

SEQ ID NO: 496532 - RNA, 16 nt, Homo sapiens
gauuuuauguugacau

SEQ ID NO: 496533 - RNA, 14 nt, Homo sapiens
gcaaaaaaguacaa

SEQ ID NO: 496534 - RNA, 17 nt, Homo sapiens
gcaaaauauuugugaaa

SEQ ID NO: 496535 - RNA, 17 nt, Homo sapiens
gcaaauauuuugucacu

SEQ ID NO: 496536 - RNA, 22 nt, Homo sapiens
gcaaauauuuugucacugcugu

SEQ ID NO: 496537 - RNA, 23 nt, Homo sapiens
gcaaauauuuugucacugcugua

SEQ ID NO: 496538 - RNA, 15 nt, Homo sapiens
gcaaauuaaugugua

SEQ ID NO: 496539 - RNA, 23 nt, Homo sapiens
gcaacaaacugcacaugauuuca

SEQ ID NO: 496540 - RNA, 23 nt, Homo sapiens
gcaacacaggauggucucugcca

SEQ ID NO: 496541 - RNA, 19 nt, Homo sapiens
gcaauauucucuguacaua

SEQ ID NO: 496542 - RNA, 14 nt, Homo sapiens
gcacacaacugugg

SEQ ID NO: 496543 - RNA, 22 nt, Homo sapiens
gcacacucacuggcaucuuugc

SEQ ID NO: 496544 - RNA, 16 nt, Homo sapiens
gcacagaccaguuuca

SEQ ID NO: 496545 - RNA, 13 nt, Homo sapiens
gcacauaccaaag

SEQ ID NO: 496546 - RNA, 17 nt, Homo sapiens
gcacauccauucccaag

SEQ ID NO: 496547 - RNA, 14 nt, Homo sapiens
gcaccuaaagccua

SEQ ID NO: 496548 - RNA, 14 nt, Homo sapiens
gcaccuuugcacgu

SEQ ID NO: 496549 - RNA, 14 nt, Homo sapiens
gcacuuuaaugaua

SEQ ID NO: 496550 - RNA, 14 nt, Homo sapiens
gcacuuuguuucau

SEQ ID NO: 496551 - RNA, 18 nt, Homo sapiens
gcagagccugcaggguga

SEQ ID NO: 496552 - RNA, 15 nt, Homo sapiens
gcagcagcagcagca

SEQ ID NO: 496553 - RNA, 12 nt, Homo sapiens
gcagcuagacac

SEQ ID NO: 496554 - RNA, 14 nt, Homo sapiens
gcagcucaacgaga

SEQ ID NO: 496555 - RNA, 21 nt, Homo sapiens
gcagcucacggaacuggagaa

SEQ ID NO: 496556 - RNA, 11 nt, Homo sapiens
gcaggcauuuc

SEQ ID NO: 496557 - RNA, 21 nt, Homo sapiens
gcaggcccuccgcgggggaca

SEQ ID NO: 496558 - RNA, 13 nt, Homo sapiens
gcaguauugacaa

SEQ ID NO: 496559 - RNA, 17 nt, Homo sapiens
gcauaaauauuagcaaa

SEQ ID NO: 496560 - RNA, 15 nt, Homo sapiens
gcauaauaugcauau

SEQ ID NO: 496561 - RNA, 16 nt, Homo sapiens
gcauaauaugcauaua

SEQ ID NO: 496562 - RNA, 15 nt, Homo sapiens
gcaugaaaacugaga

SEQ ID NO: 496563 - RNA, 15 nt, Homo sapiens
gcaugucgcacaaug

SEQ ID NO: 496564 - RNA, 19 nt, Homo sapiens
gcaugugaaagugcacuua

SEQ ID NO: 496565 - RNA, 15 nt, Homo sapiens
gcauuugguacacac

SEQ ID NO: 496566 - RNA, 12 nt, Homo sapiens
gccaaucuccag

SEQ ID NO: 496567 - RNA, 19 nt, Homo sapiens
gccacaauaagccacuggu

SEQ ID NO: 496568 - RNA, 18 nt, Homo sapiens
gccagggucucgucagga

SEQ ID NO: 496569 - RNA, 19 nt, Homo sapiens
gccauagucuuaacugguc

SEQ ID NO: 496570 - RNA, 19 nt, Homo sapiens
gccauuuuuugucugugau

SEQ ID NO: 496571 - RNA, 22 nt, Homo sapiens
gcccaccucuuguuuuccccuu

SEQ ID NO: 496572 - RNA, 20 nt, Homo sapiens
gcccagaggggcggggccag

SEQ ID NO: 496573 - RNA, 14 nt, Homo sapiens
gcccagucauaugu

SEQ ID NO: 496574 - RNA, 13 nt, Homo sapiens
gcccccaaagagu

SEQ ID NO: 496575 - RNA, 20 nt, Homo sapiens
gccccucccugccagcaccc

SEQ ID NO: 496576 - RNA, 20 nt, Homo sapiens
gcccuggggccuguacaaaa

SEQ ID NO: 496577 - RNA, 17 nt, Homo sapiens
gcccuugcuuaccucuc

SEQ ID NO: 496578 - RNA, 17 nt, Homo sapiens
gcccuugucagauucac

SEQ ID NO: 496579 - RNA, 22 nt, Homo sapiens
gccuaauauugaaaaugucacu

SEQ ID NO: 496580 - RNA, 22 nt, Homo sapiens
gccuaugauauuccccauuucc

SEQ ID NO: 496581 - RNA, 17 nt, Homo sapiens
gccuauugcaacaaagu

SEQ ID NO: 496582 - RNA, 15 nt, Homo sapiens
gccucccugccagua

SEQ ID NO: 496583 - RNA, 20 nt, Homo sapiens
gccuccugcugaguggucca

SEQ ID NO: 496584 - RNA, 14 nt, Homo sapiens
gccucuugucuaca

SEQ ID NO: 496585 - RNA, 15 nt, Homo sapiens
gccugcaucugugaa

SEQ ID NO: 496586 - RNA, 16 nt, Homo sapiens
gccugcaucugugaaa

SEQ ID NO: 496587 - RNA, 23 nt, Homo sapiens
gccugggucccacucaggugaaa

SEQ ID NO: 496588 - RNA, 23 nt, Homo sapiens
gccuucauggaacucagcugucu

SEQ ID NO: 496589 - RNA, 20 nt, Homo sapiens
gccuucuccccuccaaguga

SEQ ID NO: 496590 - RNA, 22 nt, Homo sapiens
gccuuuauuucuguaucugaca

SEQ ID NO: 496591 - RNA, 23 nt, Homo sapiens
gcgaaaaacucaaccaaauggua

SEQ ID NO: 496592 - RNA, 17 nt, Homo sapiens
gcgaguucucuuuggaa

SEQ ID NO: 496593 - RNA, 14 nt, Homo sapiens
gcggaguugugcac

SEQ ID NO: 496594 - RNA, 14 nt, Homo sapiens
gcguuuucauuugu

SEQ ID NO: 496595 - RNA, 15 nt, Homo sapiens
uaaaagccacauaga

SEQ ID NO: 496596 - RNA, 22 nt, Homo sapiens
uaaaaggucuaugcucauaacu

SEQ ID NO: 496597 - RNA, 12 nt, Homo sapiens
uaaaaugauuaa

SEQ ID NO: 496598 - RNA, 21 nt, Homo sapiens
uaaaaugcggcacuauuucug

SEQ ID NO: 496599 - RNA, 15 nt, Homo sapiens
uaaaauguuuucacu

SEQ ID NO: 496600 - RNA, 15 nt, Homo sapiens
uaaaauuaauuugug

SEQ ID NO: 496601 - RNA, 24 nt, Homo sapiens
uaaaauuaauuugugcaucagaaa

SEQ ID NO: 496602 - RNA, 18 nt, Homo sapiens
uaaaauuagaaagcaacu

SEQ ID NO: 496603 - RNA, 22 nt, Homo sapiens
uaaaauuggauuauuacuacaa

SEQ ID NO: 496604 - RNA, 15 nt, Homo sapiens
uaaaauuugugcugg

SEQ ID NO: 496605 - RNA, 13 nt, Homo sapiens
uaaacugaugcuu

SEQ ID NO: 496606 - RNA, 13 nt, Homo sapiens
uaaacugugccau

SEQ ID NO: 496607 - RNA, 15 nt, Homo sapiens
uaaagaauguauuua

SEQ ID NO: 496608 - RNA, 18 nt, Homo sapiens
uaaagccuacccuauucu

SEQ ID NO: 496609 - RNA, 16 nt, Homo sapiens
uaaagcuguguuccca

SEQ ID NO: 496610 - RNA, 14 nt, Homo sapiens
uaaaggcuguguca

SEQ ID NO: 496611 - RNA, 19 nt, Homo sapiens
uaaagguuucacuguucau

SEQ ID NO: 496612 - RNA, 15 nt, Homo sapiens
uaaagugcacugcca

SEQ ID NO: 496613 - RNA, 20 nt, Homo sapiens
uaaauaucauccugccuuca

SEQ ID NO: 496614 - RNA, 19 nt, Homo sapiens
uaaauugauguugaugcaa

SEQ ID NO: 496615 - RNA, 21 nt, Homo sapiens
uaaauuuuaaguacuuugcug

SEQ ID NO: 496616 - RNA, 18 nt, Homo sapiens
uaacaguaacugccauuu

SEQ ID NO: 496617 - RNA, 20 nt, Homo sapiens
uaaccagacacaaacugcca

SEQ ID NO: 496618 - RNA, 19 nt, Homo sapiens
uaaccuccuuuacccucau

SEQ ID NO: 496619 - RNA, 16 nt, Homo sapiens
uaacggccgucugcuc

SEQ ID NO: 496620 - RNA, 13 nt, Homo sapiens
uaacuacuuucug

SEQ ID NO: 496621 - RNA, 14 nt, Homo sapiens
uaacugauuacugu

SEQ ID NO: 496622 - RNA, 15 nt, Homo sapiens
uaacuuccacuuugu

SEQ ID NO: 496623 - RNA, 19 nt, Homo sapiens
uaacuuccucuauuucaca

SEQ ID NO: 496624 - RNA, 23 nt, Homo sapiens
uaagaaauuccauacuucucuca

SEQ ID NO: 496625 - RNA, 22 nt, Homo sapiens
uaagaaguugcugcagauuccu

SEQ ID NO: 496626 - RNA, 17 nt, Homo sapiens
uaagacucugucucaaa

SEQ ID NO: 496627 - RNA, 23 nt, Homo sapiens
uaagauugaagcuaaaacacuuc

SEQ ID NO: 496628 - RNA, 23 nt, Homo sapiens
uaagcacauccaacuacuccuag

SEQ ID NO: 496629 - RNA, 14 nt, Homo sapiens
uaagccucuugucu

SEQ ID NO: 496630 - RNA, 13 nt, Homo sapiens
uaagccugaugau

SEQ ID NO: 496631 - RNA, 19 nt, Homo sapiens
uaaggaaguccagaaauca

SEQ ID NO: 496632 - RNA, 23 nt, Homo sapiens
uaaggcauguggccuuuaucuca

SEQ ID NO: 496633 - RNA, 18 nt, Homo sapiens
uaaggggaauuaacaauu

SEQ ID NO: 496634 - RNA, 21 nt, Homo sapiens
uaagguaaaaccaucuaggau

SEQ ID NO: 496635 - RNA, 14 nt, Homo sapiens
uaaguacuuugcug

SEQ ID NO: 496636 - RNA, 19 nt, Homo sapiens
uaaguauucaagaaagcca

SEQ ID NO: 496637 - RNA, 23 nt, Homo sapiens
uaagucacuuugaggugucucaa

SEQ ID NO: 496638 - RNA, 15 nt, Homo sapiens
uaaguggacuguauu

SEQ ID NO: 496639 - RNA, 18 nt, Homo sapiens
uaagugucagacuaucca

SEQ ID NO: 496640 - RNA, 15 nt, Homo sapiens
uaauaaacacagauu

SEQ ID NO: 496641 - RNA, 13 nt, Homo sapiens
uaauaacagcucc

SEQ ID NO: 496642 - RNA, 14 nt, Homo sapiens
uaauaacagcuccu

SEQ ID NO: 496643 - RNA, 15 nt, Homo sapiens
uaauauacagugugu

SEQ ID NO: 496644 - RNA, 12 nt, Homo sapiens
uaauccaugugc

SEQ ID NO: 496645 - RNA, 13 nt, Homo sapiens
uaaucccagcacu

SEQ ID NO: 496646 - RNA, 14 nt, Homo sapiens
uaaucccagcacuu

SEQ ID NO: 496647 - RNA, 15 nt, Homo sapiens
uaaucuucauggcca

SEQ ID NO: 496648 - RNA, 14 nt, Homo sapiens
uaaugacaagugac

SEQ ID NO: 496649 - RNA, 12 nt, Homo sapiens
uaaugagccauu

SEQ ID NO: 496650 - RNA, 14 nt, Homo sapiens
uaaugccucuucau

SEQ ID NO: 496651 - RNA, 19 nt, Homo sapiens
uaauuaaagugaggagaaa

SEQ ID NO: 496652 - RNA, 20 nt, Homo sapiens
uaauuaaaugaaauacuuga

SEQ ID NO: 496653 - RNA, 16 nt, Homo sapiens
uaauucaaaacauguu

SEQ ID NO: 496654 - RNA, 13 nt, Homo sapiens
uaauuccuaugaa

SEQ ID NO: 496655 - RNA, 22 nt, Homo sapiens
uaauuucuuuuauugcauuaua

SEQ ID NO: 496656 - RNA, 17 nt, Homo sapiens
ucauaauuuuauguuca

SEQ ID NO: 496657 - RNA, 24 nt, Homo sapiens
ucauacaaaggacaguacacacuu

SEQ ID NO: 496658 - RNA, 21 nt, Homo sapiens
ucauagaauaacaacugcugg

SEQ ID NO: 496659 - RNA, 22 nt, Homo sapiens
ucauccagaugaaggaaaggaa

SEQ ID NO: 496660 - RNA, 15 nt, Homo sapiens
ucauccugauacugu

SEQ ID NO: 496661 - RNA, 22 nt, Homo sapiens
ucauccuuuucuccuaucuuca

SEQ ID NO: 496662 - RNA, 18 nt, Homo sapiens
ucaucuguccgacaaguu

SEQ ID NO: 496663 - RNA, 23 nt, Homo sapiens
ucauggccauagcuuuuauucau

SEQ ID NO: 496664 - RNA, 14 nt, Homo sapiens
ucauguacuaugga

SEQ ID NO: 496665 - RNA, 17 nt, Homo sapiens
ucaugugauuuacccuu

SEQ ID NO: 496666 - RNA, 17 nt, Homo sapiens
ucaugugcgaacacagu

SEQ ID NO: 496667 - RNA, 22 nt, Homo sapiens
ucaugugcgaacacagugacac

SEQ ID NO: 496668 - RNA, 13 nt, Homo sapiens
ucauguucuugca

SEQ ID NO: 496669 - RNA, 20 nt, Homo sapiens
ucauguucuugcagucauca

SEQ ID NO: 496670 - RNA, 14 nt, Homo sapiens
ucauuagcugugau

SEQ ID NO: 496671 - RNA, 16 nt, Homo sapiens
ucauuagcugugauuu

SEQ ID NO: 496672 - RNA, 19 nt, Homo sapiens
ucauucugcaaugagccau

SEQ ID NO: 496673 - RNA, 21 nt, Homo sapiens
ucauuucuucucucugugcug

SEQ ID NO: 496674 - RNA, 14 nt, Homo sapiens
uccaacaccacaga

SEQ ID NO: 496675 - RNA, 17 nt, Homo sapiens
uccaacaccacagacac

SEQ ID NO: 496676 - RNA, 17 nt, Homo sapiens
uccaacucagagcacag

SEQ ID NO: 496677 - RNA, 18 nt, Homo sapiens
uccaacucugacuguaaa

SEQ ID NO: 496678 - RNA, 22 nt, Homo sapiens
uccacaggucucagaaucuuuc

SEQ ID NO: 496679 - RNA, 17 nt, Homo sapiens
uccacaguuaggccaag

SEQ ID NO: 496680 - RNA, 14 nt, Homo sapiens
uccaccugcacaaa

SEQ ID NO: 496681 - RNA, 18 nt, Homo sapiens
uccaccuggaagcccucu

SEQ ID NO: 496682 - RNA, 16 nt, Homo sapiens
uccagagcugccagug

SEQ ID NO: 496683 - RNA, 19 nt, Homo sapiens
uccagaugaaggaaaggaa

SEQ ID NO: 496684 - RNA, 20 nt, Homo sapiens
uccagaugauccuugcacag

SEQ ID NO: 496685 - RNA, 22 nt, Homo sapiens
uccagaugugccuagacacgaa

SEQ ID NO: 496686 - RNA, 20 nt, Homo sapiens
uccagauugggugccagcau

SEQ ID NO: 496687 - RNA, 20 nt, Homo sapiens
uccagccccagacaacagcc

SEQ ID NO: 496688 - RNA, 13 nt, Homo sapiens
uccaggagcucag

SEQ ID NO: 496689 - RNA, 14 nt, Homo sapiens
uccaggcaccaucu

SEQ ID NO: 496690 - RNA, 13 nt, Homo sapiens
uccagucuuccac

SEQ ID NO: 496691 - RNA, 19 nt, Homo sapiens
uccagucuuccaccuggaa

SEQ ID NO: 496692 - RNA, 13 nt, Homo sapiens
uccaguguuuaca

SEQ ID NO: 496693 - RNA, 21 nt, Homo sapiens
uccaguuacuuuccaauucuc

SEQ ID NO: 496694 - RNA, 20 nt, Homo sapiens
uccaucagaggacaccugua

SEQ ID NO: 496695 - RNA, 14 nt, Homo sapiens
uccaucaugcaaaa

SEQ ID NO: 496696 - RNA, 12 nt, Homo sapiens
uccaugauucca

SEQ ID NO: 496697 - RNA, 15 nt, Homo sapiens
uccaugucugaaguu

SEQ ID NO: 496698 - RNA, 17 nt, Homo sapiens
ucccaaaagucaccacu

SEQ ID NO: 496699 - RNA, 16 nt, Homo sapiens
ucccaaaucucaaaag

SEQ ID NO: 496700 - RNA, 17 nt, Homo sapiens
ucccaacucuugcacag

SEQ ID NO: 496701 - RNA, 21 nt, Homo sapiens
ucccaacucuugcacagucac

SEQ ID NO: 496702 - RNA, 21 nt, Homo sapiens
ucccaaugcacauccauuccc

SEQ ID NO: 496703 - RNA, 20 nt, Homo sapiens
ucccaauuaagaaauuccau

SEQ ID NO: 496704 - RNA, 14 nt, Homo sapiens
ucccacacugugaa

SEQ ID NO: 496705 - RNA, 16 nt, Homo sapiens
ucccagauccaggaac

SEQ ID NO: 496706 - RNA, 14 nt, Homo sapiens
ucccagcuacaggg

SEQ ID NO: 496707 - RNA, 17 nt, Homo sapiens
ucccagcuuccagauga

SEQ ID NO: 496708 - RNA, 17 nt, Homo sapiens
ucccaggacgcagggag

SEQ ID NO: 496709 - RNA, 17 nt, Homo sapiens
ucccaguuaacuguuaa

SEQ ID NO: 496710 - RNA, 18 nt, Homo sapiens
ucccauugcaucaccucu

SEQ ID NO: 496711 - RNA, 23 nt, Homo sapiens
ucccauuguauuuaaaacauuuc

SEQ ID NO: 496712 - RNA, 14 nt, Homo sapiens
uccccacaucccau

SEQ ID NO: 496713 - RNA, 14 nt, Homo sapiens
uccccuggacauau

SEQ ID NO: 496714 - RNA, 20 nt, Homo sapiens
uccccugguccugcacuguc

SEQ ID NO: 496715 - RNA, 14 nt, Homo sapiens
uccccuuguaaaaa

SEQ ID NO: 496716 - RNA, 18 nt, Homo sapiens
uccccuuuguguagaaag

SEQ ID NO: 496717 - RNA, 23 nt, Homo sapiens
ucccugucugucugucucucuuu

SEQ ID NO: 496718 - RNA, 14 nt, Homo sapiens
ucccuugauucaaa

SEQ ID NO: 496719 - RNA, 17 nt, Homo sapiens
ucccuuuaucauguguu

SEQ ID NO: 496720 - RNA, 19 nt, Homo sapiens
ucccuuuguugcacacuca

SEQ ID NO: 496721 - RNA, 20 nt, Homo sapiens
ucccuuuuuaaacaaauggc

SEQ ID NO: 496722 - RNA, 18 nt, Homo sapiens
uccggaauccuguccuca

SEQ ID NO: 496723 - RNA, 22 nt, Homo sapiens
uccuaacaggauuagacaguca

SEQ ID NO: 496724 - RNA, 21 nt, Homo sapiens
uccuaugagagaagagaguau

SEQ ID NO: 496725 - RNA, 16 nt, Homo sapiens
uccucaauuccaggga

SEQ ID NO: 496726 - RNA, 22 nt, Homo sapiens
uccucagaaccauucacuggca

SEQ ID NO: 496727 - RNA, 14 nt, Homo sapiens
uccucccaaaagua

SEQ ID NO: 496728 - RNA, 17 nt, Homo sapiens
uccuccuugucuuggca

SEQ ID NO: 496729 - RNA, 12 nt, Homo sapiens
uccucuuaccug

SEQ ID NO: 496730 - RNA, 23 nt, Homo sapiens
uccucuuaccuguaauagccuca

SEQ ID NO: 496731 - RNA, 17 nt, Homo sapiens
uccugaacucccaguca

SEQ ID NO: 496732 - RNA, 15 nt, Homo sapiens
uccugccuucaugga

SEQ ID NO: 496733 - RNA, 20 nt, Homo sapiens
uccugggggcugcugcacug

SEQ ID NO: 496734 - RNA, 21 nt, Homo sapiens
uccugggggcugcugcacugc

SEQ ID NO: 496735 - RNA, 17 nt, Homo sapiens
uccuguuaagugaauaa

SEQ ID NO: 496736 - RNA, 18 nt, Homo sapiens
uccuuagaauacuguauu

SEQ ID NO: 496737 - RNA, 13 nt, Homo sapiens
uccuuuaugaucc

SEQ ID NO: 496738 - RNA, 22 nt, Homo sapiens
ugucugucagacacacacaggu

SEQ ID NO: 496739 - RNA, 22 nt, Homo sapiens
ugucuuggcagccuacuaggga

SEQ ID NO: 496740 - RNA, 22 nt, Homo sapiens
ugucuuucuccucuggagagua

SEQ ID NO: 496741 - RNA, 11 nt, Homo sapiens
ugugaaagugc

SEQ ID NO: 496742 - RNA, 17 nt, Homo sapiens
ugugaaagugccaaaau

SEQ ID NO: 496743 - RNA, 15 nt, Homo sapiens
ugugcgaacacagug

SEQ ID NO: 496744 - RNA, 15 nt, Homo sapiens
ugugcugccuguggu

SEQ ID NO: 496745 - RNA, 18 nt, Homo sapiens
uguggcacacaacugugg

SEQ ID NO: 496746 - RNA, 16 nt, Homo sapiens
uguggcuaaaugccua

SEQ ID NO: 496747 - RNA, 23 nt, Homo sapiens
ugugggcucccuuccucccaaaa

SEQ ID NO: 496748 - RNA, 16 nt, Homo sapiens
uguguacaaaauaucc

SEQ ID NO: 496749 - RNA, 14 nt, Homo sapiens
uguguauauauaca

SEQ ID NO: 496750 - RNA, 14 nt, Homo sapiens
ugugugcagugaug

SEQ ID NO: 496751 - RNA, 20 nt, Homo sapiens
uguuaaauaaggccucaucc

SEQ ID NO: 496752 - RNA, 18 nt, Homo sapiens
uguuauuaaaaaauguga

SEQ ID NO: 496753 - RNA, 16 nt, Homo sapiens
uguucauggacuauuc

SEQ ID NO: 496754 - RNA, 18 nt, Homo sapiens
uguucugcagucaucucc

SEQ ID NO: 496755 - RNA, 15 nt, Homo sapiens
uguucuguuacaaaa

SEQ ID NO: 496756 - RNA, 18 nt, Homo sapiens
uguucuguuacaaaaugu

SEQ ID NO: 496757 - RNA, 20 nt, Homo sapiens
uguucuuaaaaaugcauuua

SEQ ID NO: 496758 - RNA, 18 nt, Homo sapiens
uguucuuccucuuaccug

SEQ ID NO: 496759 - RNA, 19 nt, Homo sapiens
uguucuugcagucaucaga

SEQ ID NO: 496760 - RNA, 13 nt, Homo sapiens
uguugacauccaa

SEQ ID NO: 496761 - RNA, 18 nt, Homo sapiens
uguugacuggccaaaaau

SEQ ID NO: 496762 - RNA, 22 nt, Homo sapiens
uguugacuggccaaaaauaucu

SEQ ID NO: 496763 - RNA, 21 nt, Homo sapiens
uguugaugcaauccuuacaaa

SEQ ID NO: 496764 - RNA, 17 nt, Homo sapiens
uguuuacaaggugacaa

SEQ ID NO: 496765 - RNA, 15 nt, Homo sapiens
uguuuuaaacuguga

SEQ ID NO: 496766 - RNA, 22 nt, Homo sapiens
uguuuuccccaauuauccuccu

SEQ ID NO: 496767 - RNA, 12 nt, Homo sapiens
uguuuuguggau

SEQ ID NO: 496768 - RNA, 17 nt, Homo sapiens
uuaaaaaucagaaagac

SEQ ID NO: 496769 - RNA, 16 nt, Homo sapiens
uuaaaaauguauguug

SEQ ID NO: 496770 - RNA, 13 nt, Homo sapiens
uuaaaacauuuca

SEQ ID NO: 496771 - RNA, 16 nt, Homo sapiens
uuaaaacuuacuaugg

SEQ ID NO: 496772 - RNA, 15 nt, Homo sapiens
uuaaaagaguagaaa

SEQ ID NO: 496773 - RNA, 13 nt, Homo sapiens
uuaaacauugccu

SEQ ID NO: 496774 - RNA, 18 nt, Homo sapiens
uuaaacccacagccaaac

SEQ ID NO: 496775 - RNA, 19 nt, Homo sapiens
uuaaacuucuuaacuggca

SEQ ID NO: 496776 - RNA, 22 nt, Homo sapiens
uuaaaggaaaaaucauaaccac

SEQ ID NO: 496777 - RNA, 20 nt, Homo sapiens
uuaaaguaaaaacaauucaa

SEQ ID NO: 496778 - RNA, 17 nt, Homo sapiens
uuaaaguguaauaauau

SEQ ID NO: 496779 - RNA, 21 nt, Homo sapiens
uuaaauuucuccaguggauuc

SEQ ID NO: 496780 - RNA, 14 nt, Homo sapiens
uuaacaauugccag

SEQ ID NO: 496781 - RNA, 19 nt, Homo sapiens
uuaacuggucuccuugcuu

SEQ ID NO: 496782 - RNA, 13 nt, Homo sapiens
uuaagaaauucca

SEQ ID NO: 496783 - RNA, 19 nt, Homo sapiens
uuaagcuaggaaaagaaau

SEQ ID NO: 496784 - RNA, 20 nt, Homo sapiens
uuaaguacugaaauacauau

SEQ ID NO: 496785 - RNA, 21 nt, Homo sapiens
uuucaguauuguaaagagauu

SEQ ID NO: 496786 - RNA, 16 nt, Homo sapiens
uuucaucucuauuuag

SEQ ID NO: 496787 - RNA, 18 nt, Homo sapiens
uuucauguauuucuuuag

SEQ ID NO: 496788 - RNA, 14 nt, Homo sapiens
uuuccagugcugcu

SEQ ID NO: 496789 - RNA, 16 nt, Homo sapiens
uuuccaguguuuacaa

SEQ ID NO: 496790 - RNA, 15 nt, Homo sapiens
uuuccccuuuccuag

SEQ ID NO: 496791 - RNA, 22 nt, Homo sapiens
uuuccccuuuuaaaaacucaga

SEQ ID NO: 496792 - RNA, 18 nt, Homo sapiens
uuuccuaugacacucauc

SEQ ID NO: 496793 - RNA, 22 nt, Homo sapiens
uuuccucuuaaugucucaaaau

SEQ ID NO: 496794 - RNA, 17 nt, Homo sapiens
uuuccugcuccuccagu

SEQ ID NO: 496795 - RNA, 13 nt, Homo sapiens
uuucuaaagccac

SEQ ID NO: 496796 - RNA, 19 nt, Homo sapiens
uuucuagauccuaugugaa

SEQ ID NO: 496797 - RNA, 20 nt, Homo sapiens
uuucuccuuuuguguuccaa

SEQ ID NO: 496798 - RNA, 16 nt, Homo sapiens
uuucugaauugcacau

SEQ ID NO: 496799 - RNA, 13 nt, Homo sapiens
uuucuuaaaaagu

SEQ ID NO: 496800 - RNA, 13 nt, Homo sapiens
uuucuuccaacau

SEQ ID NO: 496801 - RNA, 13 nt, Homo sapiens
uuucuucuuccca

SEQ ID NO: 496802 - RNA, 15 nt, Homo sapiens
uuucuugcaauuuga

SEQ ID NO: 496803 - RNA, 13 nt, Homo sapiens
uuucuuucugcca

SEQ ID NO: 496804 - RNA, 16 nt, Homo sapiens
uuugacacugaauaaa

SEQ ID NO: 496805 - RNA, 20 nt, Homo sapiens
uuugacuuucugucugugga

SEQ ID NO: 496806 - RNA, 23 nt, Homo sapiens
uuugacuuugguuguguuuaaau

SEQ ID NO: 496807 - RNA, 20 nt, Homo sapiens
uuugaucaaauguacaucuc

SEQ ID NO: 496808 - RNA, 22 nt, Homo sapiens
uuugcacuuucaggaacacucu

SEQ ID NO: 496809 - RNA, 12 nt, Homo sapiens
uuugccacugaa

SEQ ID NO: 496810 - RNA, 23 nt, Homo sapiens
uuugcgugaaaguguuacauauu

SEQ ID NO: 496811 - RNA, 23 nt, Homo sapiens
uuugggggugcuaauccaggaca

SEQ ID NO: 496812 - RNA, 23 nt, Homo sapiens
uuugucaguguagaucaacucau

SEQ ID NO: 496813 - RNA, 20 nt, Homo sapiens
uuuguccuuggggacaucuc

SEQ ID NO: 496814 - RNA, 16 nt, Homo sapiens
uuuguuuuuacaaaau

SEQ ID NO: 496815 - RNA, 23 nt, Homo sapiens
uuuuauaucuuggcagguaggaa

SEQ ID NO: 496816 - RNA, 22 nt, Homo sapiens
uuuucagauuugcacaaaaaga

SEQ ID NO: 496817 - RNA, 22 nt, Homo sapiens
uuuucuacuuuaaauuguggau

SEQ ID NO: 496818 - RNA, 11 nt, Homo sapiens
uuuugcaaaaa

SEQ ID NO: 496819 - RNA, 19 nt, Homo sapiens
uuuugguuccucacauauu

SEQ ID NO: 496820 - RNA, 22 nt, Homo sapiens
uuuugucugcuuaguaucucau

SEQ ID NO: 496821 - RNA, 20 nt, Homo sapiens
uuuuuaaaagcccuuuccaa

SEQ ID NO: 496822 - RNA, 20 nt, Homo sapiens
uuuuuauaucuuggcaggua

SEQ ID NO: 496823 - RNA, 17 nt, Homo sapiens
uuuuucccccacugcga

SEQ ID NO: 496824 - RNA, 21 nt, Homo sapiens
uuuuuguuuucauuaaagagc

SEQ ID NO: 496825 - RNA, 22 nt, Homo sapiens
ucccuuucugugugaagaucac

SEQ ID NO: 496826 - RNA, 21 nt, Homo sapiens
ucccuuuguugcacacucacu

SEQ ID NO: 496827 - RNA, 12 nt, Homo sapiens
uccuaaggcaug

SEQ ID NO: 496828 - RNA, 20 nt, Homo sapiens
uccucacauauuauugguca

SEQ ID NO: 496829 - RNA, 18 nt, Homo sapiens
uccuccaguucugaugag

SEQ ID NO: 496830 - RNA, 14 nt, Homo sapiens
uccucuauuucaca

SEQ ID NO: 496831 - RNA, 18 nt, Homo sapiens
uccucuuucacuucuuau

SEQ ID NO: 496832 - RNA, 21 nt, Homo sapiens
uccugagucugccucuguuca

SEQ ID NO: 496833 - RNA, 17 nt, Homo sapiens
uccugauguugguaucu

SEQ ID NO: 496834 - RNA, 11 nt, Homo sapiens
uccugcacugu

SEQ ID NO: 496835 - RNA, 13 nt, Homo sapiens
uccugcacugucc

SEQ ID NO: 496836 - RNA, 17 nt, Homo sapiens
uccugccauagucuuaa

SEQ ID NO: 496837 - RNA, 18 nt, Homo sapiens
uccuggagugauaugauc

SEQ ID NO: 496838 - RNA, 15 nt, Homo sapiens
uccuguuuuugcaaa

SEQ ID NO: 496839 - RNA, 16 nt, Homo sapiens
uccuuaaaaauguaug

SEQ ID NO: 496840 - RNA, 17 nt, Homo sapiens
uccuugaaaguaggaua

SEQ ID NO: 496841 - RNA, 20 nt, Homo sapiens
uccuugaggaccuccaccug

SEQ ID NO: 496842 - RNA, 15 nt, Homo sapiens
uccuugcuuccuguc

SEQ ID NO: 496843 - RNA, 18 nt, Homo sapiens
uccuugcuuccugucuua

SEQ ID NO: 496844 - RNA, 23 nt, Homo sapiens
uccuuuguuuuuuuuuccugucc

SEQ ID NO: 496845 - RNA, 13 nt, Homo sapiens
uccuuuugguucc

SEQ ID NO: 496846 - RNA, 18 nt, Homo sapiens
ucgaaugaacaaagucca

SEQ ID NO: 496847 - RNA, 17 nt, Homo sapiens
ucgaggacagcaaugca

SEQ ID NO: 496848 - RNA, 19 nt, Homo sapiens
ucgaggacagcaaugcaga

SEQ ID NO: 496849 - RNA, 19 nt, Homo sapiens
ucgccagcaaaacuuagau

SEQ ID NO: 496850 - RNA, 12 nt, Homo sapiens
ucgccagugacu

SEQ ID NO: 496851 - RNA, 15 nt, Homo sapiens
ucgcuugaacccagg

SEQ ID NO: 496852 - RNA, 13 nt, Homo sapiens
ucguaacaagcaa

SEQ ID NO: 496853 - RNA, 16 nt, Homo sapiens
ucguagaaacaagaca

SEQ ID NO: 496854 - RNA, 19 nt, Homo sapiens
ucguauggauuucuaggcc

SEQ ID NO: 496855 - RNA, 20 nt, Homo sapiens
ucguccuuagaauacuguau

SEQ ID NO: 496856 - RNA, 12 nt, Homo sapiens
ucuaaacuuuaa

SEQ ID NO: 496857 - RNA, 22 nt, Homo sapiens
ucuaagguaaaaccaucuagga

SEQ ID NO: 496858 - RNA, 17 nt, Homo sapiens
ucuaauaaacacagauu

SEQ ID NO: 496859 - RNA, 22 nt, Homo sapiens
ucuacuagaaccuucuaaucca

SEQ ID NO: 496860 - RNA, 23 nt, Homo sapiens
ucuacuuacacaucuuccacagg

SEQ ID NO: 496861 - RNA, 20 nt, Homo sapiens
ucuagugucuuuugccuuua

SEQ ID NO: 496862 - RNA, 20 nt, Homo sapiens
ucuaugaacuuagaguuuac

SEQ ID NO: 496863 - RNA, 17 nt, Homo sapiens
ucucaacuuacauaugu

SEQ ID NO: 496864 - RNA, 14 nt, Homo sapiens
ucucaauuugcagu

SEQ ID NO: 496865 - RNA, 16 nt, Homo sapiens
ucucagauugaccuua

SEQ ID NO: 496866 - RNA, 12 nt, Homo sapiens
ucucagcacuuu

SEQ ID NO: 496867 - RNA, 13 nt, Homo sapiens
ucucagcauauau

SEQ ID NO: 496868 - RNA, 22 nt, Homo sapiens
ucucauccaucaaguugcacac

SEQ ID NO: 496869 - RNA, 11 nt, Homo sapiens
ucucauuccca

SEQ ID NO: 496870 - RNA, 20 nt, Homo sapiens
ucucccaacucuugcacagu

SEQ ID NO: 496871 - RNA, 17 nt, Homo sapiens
ucuccuuagaaaagcca

SEQ ID NO: 496872 - RNA, 22 nt, Homo sapiens
ucuccuuuaauauacuccuuaa

SEQ ID NO: 496873 - RNA, 13 nt, Homo sapiens
ucucggccuucac

SEQ ID NO: 496874 - RNA, 18 nt, Homo sapiens
ucucuaaaacagcacuau

SEQ ID NO: 496875 - RNA, 12 nt, Homo sapiens
ucucuaucuuag

SEQ ID NO: 496876 - RNA, 16 nt, Homo sapiens
ucucugaaccagagaa

SEQ ID NO: 496877 - RNA, 12 nt, Homo sapiens
ucugaaccuguc

SEQ ID NO: 496878 - RNA, 13 nt, Homo sapiens
ucugaauuccaag

SEQ ID NO: 496879 - RNA, 14 nt, Homo sapiens
ucugaauugcacau

SEQ ID NO: 496880 - RNA, 16 nt, Homo sapiens
ucugacccugugaaau

SEQ ID NO: 496881 - RNA, 23 nt, Homo sapiens
ucugacuguaaaauacaugguau

SEQ ID NO: 496882 - RNA, 14 nt, Homo sapiens
ucugaggacaagga

SEQ ID NO: 496883 - RNA, 13 nt, Homo sapiens
gcuaaaacacuuc

SEQ ID NO: 496884 - RNA, 15 nt, Homo sapiens
gcuaagccugaugau

SEQ ID NO: 496885 - RNA, 22 nt, Homo sapiens
gcuaccaaaaacuagacauuau

SEQ ID NO: 496886 - RNA, 17 nt, Homo sapiens
gcuaucucgcuagccau

SEQ ID NO: 496887 - RNA, 12 nt, Homo sapiens
gcuaugucucau

SEQ ID NO: 496888 - RNA, 19 nt, Homo sapiens
gcucacacaaucagaccaa

SEQ ID NO: 496889 - RNA, 19 nt, Homo sapiens
gcuccucccgaaacccaag

SEQ ID NO: 496890 - RNA, 16 nt, Homo sapiens
gcucgugugcuuagaa

SEQ ID NO: 496891 - RNA, 19 nt, Homo sapiens
gcucucccaacucuugcac

SEQ ID NO: 496892 - RNA, 19 nt, Homo sapiens
gcucuggcccuuugaauau

SEQ ID NO: 496893 - RNA, 15 nt, Homo sapiens
gcugaaugucauuuu

SEQ ID NO: 496894 - RNA, 20 nt, Homo sapiens
gcugagaucgcgccacugca

SEQ ID NO: 496895 - RNA, 16 nt, Homo sapiens
gcugcccucacugccu

SEQ ID NO: 496896 - RNA, 15 nt, Homo sapiens
gcugccuguggugag

SEQ ID NO: 496897 - RNA, 21 nt, Homo sapiens
gcugcuauuuuacugucuuaa

SEQ ID NO: 496898 - RNA, 13 nt, Homo sapiens
gcugcugcacugc

SEQ ID NO: 496899 - RNA, 14 nt, Homo sapiens
gcugcugcacugcc

SEQ ID NO: 496900 - RNA, 15 nt, Homo sapiens
gcuggcaggagacac

SEQ ID NO: 496901 - RNA, 19 nt, Homo sapiens
gcugggacuucuuacccaa

SEQ ID NO: 496902 - RNA, 16 nt, Homo sapiens
gcugggcuccacuuca

SEQ ID NO: 496903 - RNA, 22 nt, Homo sapiens
gcuggucuuggugaacacacau

SEQ ID NO: 496904 - RNA, 16 nt, Homo sapiens
gcuuagugcacaagca

SEQ ID NO: 496905 - RNA, 18 nt, Homo sapiens
gcuucaccagagcauuuc

SEQ ID NO: 496906 - RNA, 14 nt, Homo sapiens
gcuucucaucccca

SEQ ID NO: 496907 - RNA, 21 nt, Homo sapiens
gcuucuggggguagaucucaa

SEQ ID NO: 496908 - RNA, 19 nt, Homo sapiens
gcuuguguacaaacccaga

SEQ ID NO: 496909 - RNA, 21 nt, Homo sapiens
gcuuguucuuccucuuaccug

SEQ ID NO: 496910 - RNA, 22 nt, Homo sapiens
gcuuguucuuccucuuaccugu

SEQ ID NO: 496911 - RNA, 20 nt, Homo sapiens
gcuuguuuaagguucuugcu

SEQ ID NO: 496912 - RNA, 17 nt, Homo sapiens
gcuuugccacugaagua

SEQ ID NO: 496913 - RNA, 19 nt, Homo sapiens
ggaaaaaaagacugaugaa

SEQ ID NO: 496914 - RNA, 18 nt, Homo sapiens
ggaaaaaggcuucuccac

SEQ ID NO: 496915 - RNA, 17 nt, Homo sapiens
ggaaaaaucauaaccac

SEQ ID NO: 496916 - RNA, 22 nt, Homo sapiens
ggaaacagauuuaagcaagacc

SEQ ID NO: 496917 - RNA, 15 nt, Homo sapiens
ggaaagaaaaggaaa

SEQ ID NO: 496918 - RNA, 15 nt, Homo sapiens
ggaaagccucacuga

SEQ ID NO: 496919 - RNA, 15 nt, Homo sapiens
ggaaauuccucagca

SEQ ID NO: 496920 - RNA, 16 nt, Homo sapiens
ggaacaguguuuacuu

SEQ ID NO: 496921 - RNA, 17 nt, Homo sapiens
ggaagccuccugcugag

SEQ ID NO: 496922 - RNA, 18 nt, Homo sapiens
ggaaguaaaccugaacaa

SEQ ID NO: 496923 - RNA, 23 nt, Homo sapiens
ggaauugugcuccaaaugucuac

SEQ ID NO: 496924 - RNA, 19 nt, Homo sapiens
ggacaauuuaccacaggau

SEQ ID NO: 496925 - RNA, 17 nt, Homo sapiens
ggacaccuguacuggag

SEQ ID NO: 496926 - RNA, 13 nt, Homo sapiens
ggacagugccuaa

SEQ ID NO: 496927 - RNA, 23 nt, Homo sapiens
ggacaugcacccgcauguacaaa

SEQ ID NO: 496928 - RNA, 18 nt, Homo sapiens
ggacauuccaauuugcac

SEQ ID NO: 496929 - RNA, 18 nt, Homo sapiens
ggaccuggggaagcaaaa

SEQ ID NO: 496930 - RNA, 17 nt, Homo sapiens
ggagaaaccuacagaau

SEQ ID NO: 496931 - RNA, 19 nt, Homo sapiens
ggagcauuggggauguuuu

SEQ ID NO: 496932 - RNA, 22 nt, Homo sapiens
ggagcccugggguuuccacaca

SEQ ID NO: 496933 - RNA, 20 nt, Homo sapiens
ggagcuuuugguaugugaca

SEQ ID NO: 496934 - RNA, 22 nt, Homo sapiens
ggaggcagagguugcagugagc

SEQ ID NO: 496935 - RNA, 15 nt, Homo sapiens
ggagugaaaaccucu

SEQ ID NO: 496936 - RNA, 15 nt, Homo sapiens
ggaucaggaacccuu

SEQ ID NO: 496937 - RNA, 19 nt, Homo sapiens
ggauuuuauguugacauuu

SEQ ID NO: 496938 - RNA, 22 nt, Homo sapiens
ggcaaaggagggcaaccugaca

SEQ ID NO: 496939 - RNA, 13 nt, Homo sapiens
ggcaaggccuuug

SEQ ID NO: 496940 - RNA, 18 nt, Homo sapiens
ggcaauggugaacuguca

SEQ ID NO: 496941 - RNA, 14 nt, Homo sapiens
ggcacucucuuuug

SEQ ID NO: 496942 - RNA, 18 nt, Homo sapiens
ggcagcaugcgaugucau

SEQ ID NO: 496943 - RNA, 21 nt, Homo sapiens
ggcagcaugcgaugucauauu

SEQ ID NO: 496944 - RNA, 19 nt, Homo sapiens
ggcagggguggaggagagc

SEQ ID NO: 496945 - RNA, 21 nt, Homo sapiens
ggcaggugccccucucuccau

SEQ ID NO: 496946 - RNA, 21 nt, Homo sapiens
ggcauguggccuuuaucucaa

SEQ ID NO: 496947 - RNA, 19 nt, Homo sapiens
ggcauuuuuguaaugagcc

SEQ ID NO: 496948 - RNA, 15 nt, Homo sapiens
ggccaaagacaaaua

SEQ ID NO: 496949 - RNA, 15 nt, Homo sapiens
ggccagaccagguga

SEQ ID NO: 496950 - RNA, 18 nt, Homo sapiens
ggccagagcucccaggac

SEQ ID NO: 496951 - RNA, 22 nt, Homo sapiens
ggcccuguuaaggcauccacuu

SEQ ID NO: 496952 - RNA, 13 nt, Homo sapiens
ggccuaguggcuu

SEQ ID NO: 496953 - RNA, 18 nt, Homo sapiens
ggccuucuccacagggac

SEQ ID NO: 496954 - RNA, 19 nt, Homo sapiens
ggccuuuggcuuggcgaga

SEQ ID NO: 496955 - RNA, 18 nt, Homo sapiens
ggcugcccacacacccca

SEQ ID NO: 496956 - RNA, 19 nt, Homo sapiens
ggcuggaaagagugaugcc

SEQ ID NO: 496957 - RNA, 11 nt, Homo sapiens
ggcugggcuac

SEQ ID NO: 496958 - RNA, 20 nt, Homo sapiens
ggcugugggcucccuuccuc

SEQ ID NO: 496959 - RNA, 17 nt, Homo sapiens
gggagacccugggagag

SEQ ID NO: 496960 - RNA, 13 nt, Homo sapiens
gggcagcacagag

SEQ ID NO: 496961 - RNA, 23 nt, Homo sapiens
gggccuguacaaaagggacauga

SEQ ID NO: 496962 - RNA, 21 nt, Homo sapiens
ggggacauuccaauuugcacu

SEQ ID NO: 496963 - RNA, 16 nt, Homo sapiens
ggggccaggugcacag

SEQ ID NO: 496964 - RNA, 20 nt, Homo sapiens
ggggccugaaagcaacagcu

SEQ ID NO: 496965 - RNA, 14 nt, Homo sapiens
gggggaacaaugag

SEQ ID NO: 496966 - RNA, 23 nt, Homo sapiens
gggugaccugcuuccccaaaggc

SEQ ID NO: 496967 - RNA, 22 nt, Homo sapiens
gggugcuaauccaggacagcau

SEQ ID NO: 496968 - RNA, 24 nt, Homo sapiens
gggugggauuugccagaugccaaa

SEQ ID NO: 496969 - RNA, 12 nt, Homo sapiens
ggguugggcucu

SEQ ID NO: 496970 - RNA, 21 nt, Homo sapiens
gguaaauaaucauacacagaa

SEQ ID NO: 496971 - RNA, 15 nt, Homo sapiens
gguaacuuugcaaau

SEQ ID NO: 496972 - RNA, 17 nt, Homo sapiens
gguagaguccuaggaca

SEQ ID NO: 496973 - RNA, 23 nt, Homo sapiens
gguaguagaaucucagcacuuug

SEQ ID NO: 496974 - RNA, 21 nt, Homo sapiens
ggucaccaaacggugaauauu

SEQ ID NO: 496975 - RNA, 15 nt, Homo sapiens
ggucccaauuaagaa

SEQ ID NO: 496976 - RNA, 12 nt, Homo sapiens
gguccugcacug

SEQ ID NO: 496977 - RNA, 15 nt, Homo sapiens
gguccugcacugucc

SEQ ID NO: 496978 - RNA, 14 nt, Homo sapiens
gguccugggggccu

SEQ ID NO: 496979 - RNA, 20 nt, Homo sapiens
gguccugggggccugaccuc

SEQ ID NO: 496980 - RNA, 20 nt, Homo sapiens
ggucuccugcccccacaccu

SEQ ID NO: 496981 - RNA, 17 nt, Homo sapiens
ggugacagccgucccaa

SEQ ID NO: 496982 - RNA, 21 nt, Homo sapiens
ggugccugugaccgggguccu

SEQ ID NO: 496983 - RNA, 16 nt, Homo sapiens
gguggccagggcucca

SEQ ID NO: 496984 - RNA, 13 nt, Homo sapiens
ggugucuguaauc

SEQ ID NO: 496985 - RNA, 20 nt, Homo sapiens
gguuaaacccacagccaaac

SEQ ID NO: 496986 - RNA, 18 nt, Homo sapiens
gguuauucagaaccuaaa

SEQ ID NO: 496987 - RNA, 12 nt, Homo sapiens
gguucugugcaa

SEQ ID NO: 496988 - RNA, 21 nt, Homo sapiens
gguugcggaccuaggaccauu

SEQ ID NO: 496989 - RNA, 15 nt, Homo sapiens
gguuguuucuuccaa

SEQ ID NO: 496990 - RNA, 13 nt, Homo sapiens
gguuuagaaucaa

SEQ ID NO: 496991 - RNA, 19 nt, Homo sapiens
guaaaauagaugaguguua

SEQ ID NO: 496992 - RNA, 11 nt, Homo sapiens
guaaacuaaug

SEQ ID NO: 496993 - RNA, 16 nt, Homo sapiens
guaacucuaugaacuu

SEQ ID NO: 496994 - RNA, 20 nt, Homo sapiens
guaauaucaguuacaguggc

SEQ ID NO: 496995 - RNA, 12 nt, Homo sapiens
guaaugagcucc

SEQ ID NO: 496996 - RNA, 17 nt, Homo sapiens
guaauuugggaacauaa

SEQ ID NO: 496997 - RNA, 11 nt, Homo sapiens
guacaaaaaca

SEQ ID NO: 496998 - RNA, 13 nt, Homo sapiens
guacaaaaacaca

SEQ ID NO: 496999 - RNA, 18 nt, Homo sapiens
guacaaaaacacaaauac

SEQ ID NO: 497000 - RNA, 13 nt, Homo sapiens
guacacacuugac

SEQ ID NO: 497001 - RNA, 19 nt, Homo sapiens
guacaccacuuucccacac

SEQ ID NO: 497002 - RNA, 22 nt, Homo sapiens
guacagcacuuucuucuuccca

SEQ ID NO: 497003 - RNA, 13 nt, Homo sapiens
guacucugagucc

SEQ ID NO: 497004 - RNA, 20 nt, Homo sapiens
guacuguuuuguuuguuaau

SEQ ID NO: 497005 - RNA, 12 nt, Homo sapiens
guagaaucucag

SEQ ID NO: 497006 - RNA, 18 nt, Homo sapiens
guagguuuacauuacuga

SEQ ID NO: 497007 - RNA, 17 nt, Homo sapiens
guauauacacauauacc

SEQ ID NO: 497008 - RNA, 20 nt, Homo sapiens
guauauugauguaacugugu

SEQ ID NO: 497009 - RNA, 21 nt, Homo sapiens
guaucaaaaugaaugccaguc

SEQ ID NO: 497010 - RNA, 20 nt, Homo sapiens
guaucaugcuucuacuccau

SEQ ID NO: 497011 - RNA, 16 nt, Homo sapiens
guauccagaggugagg

SEQ ID NO: 497012 - RNA, 15 nt, Homo sapiens
guauuccagcuggug

SEQ ID NO: 497013 - RNA, 22 nt, Homo sapiens
guauuuaacauucuuggucaca

SEQ ID NO: 497014 - RNA, 19 nt, Homo sapiens
guauuucuuuagaacaaca

SEQ ID NO: 497015 - RNA, 19 nt, Homo sapiens
gucaccaaacggugaauau

SEQ ID NO: 497016 - RNA, 15 nt, Homo sapiens
gucagcaugucucag

SEQ ID NO: 497017 - RNA, 13 nt, Homo sapiens
gucaugccaaaag

SEQ ID NO: 497018 - RNA, 23 nt, Homo sapiens
gucaugugcgaacacagugacac

SEQ ID NO: 497019 - RNA, 14 nt, Homo sapiens
uacagcagauccac

SEQ ID NO: 497020 - RNA, 17 nt, Homo sapiens
uacagguaccaguucuu

SEQ ID NO: 497021 - RNA, 20 nt, Homo sapiens
uacaguggcaguauugacaa

SEQ ID NO: 497022 - RNA, 22 nt, Homo sapiens
uacauauguagacuauauacau

SEQ ID NO: 497023 - RNA, 20 nt, Homo sapiens
uacaugaugauuucagaaac

SEQ ID NO: 497024 - RNA, 23 nt, Homo sapiens
uacaugcuacaaaaaaguagcaa

SEQ ID NO: 497025 - RNA, 14 nt, Homo sapiens
uaccaaagcugcug

SEQ ID NO: 497026 - RNA, 13 nt, Homo sapiens
uaccaaaugccuu

SEQ ID NO: 497027 - RNA, 21 nt, Homo sapiens
uaccaaguuggucuuacuuug

SEQ ID NO: 497028 - RNA, 17 nt, Homo sapiens
uaccacaggaugcauau

SEQ ID NO: 497029 - RNA, 18 nt, Homo sapiens
uaccacaggaugcauauu

SEQ ID NO: 497030 - RNA, 13 nt, Homo sapiens
uaccggcaauuuc

SEQ ID NO: 497031 - RNA, 16 nt, Homo sapiens
uaccuuuaaauugaua

SEQ ID NO: 497032 - RNA, 21 nt, Homo sapiens
uacggaaguaaaccugaacaa

SEQ ID NO: 497033 - RNA, 12 nt, Homo sapiens
uacuaaacauuu

SEQ ID NO: 497034 - RNA, 18 nt, Homo sapiens
uacuaaugccucuucauu

SEQ ID NO: 497035 - RNA, 20 nt, Homo sapiens
uacuauggaagccacaucac

SEQ ID NO: 497036 - RNA, 15 nt, Homo sapiens
uacugaaauacauau

SEQ ID NO: 497037 - RNA, 17 nt, Homo sapiens
uacugaaauacauauga

SEQ ID NO: 497038 - RNA, 19 nt, Homo sapiens
uacuuacacaauucaguua

SEQ ID NO: 497039 - RNA, 16 nt, Homo sapiens
uacuuacacaucuucc

SEQ ID NO: 497040 - RNA, 16 nt, Homo sapiens
uacuucuaaaauuaca

SEQ ID NO: 497041 - RNA, 15 nt, Homo sapiens
uacuuggaauuugcu

SEQ ID NO: 497042 - RNA, 13 nt, Homo sapiens
uagaaacaagaca

SEQ ID NO: 497043 - RNA, 23 nt, Homo sapiens
uagaacaccugagcugcugcaug

SEQ ID NO: 497044 - RNA, 18 nt, Homo sapiens
uagaauggggcaauaaca

SEQ ID NO: 497045 - RNA, 16 nt, Homo sapiens
uagaccuguucuuucc

SEQ ID NO: 497046 - RNA, 16 nt, Homo sapiens
uagacucagugcacau

SEQ ID NO: 497047 - RNA, 24 nt, Homo sapiens
uagacugacuaggauucugcagga

SEQ ID NO: 497048 - RNA, 16 nt, Homo sapiens
uagagagaaacagcuu

SEQ ID NO: 497049 - RNA, 22 nt, Homo sapiens
uagaguccaacguggggcagca

SEQ ID NO: 497050 - RNA, 16 nt, Homo sapiens
uagauauccuuggcac

SEQ ID NO: 497051 - RNA, 15 nt, Homo sapiens
uagcacaacugauaa

SEQ ID NO: 497052 - RNA, 20 nt, Homo sapiens
uagcacaacugauaauauug

SEQ ID NO: 497053 - RNA, 15 nt, Homo sapiens
uagcacaguauuuaa

SEQ ID NO: 497054 - RNA, 16 nt, Homo sapiens
uagcaucauguauaua

SEQ ID NO: 497055 - RNA, 13 nt, Homo sapiens
uagcccacugccu

SEQ ID NO: 497056 - RNA, 14 nt, Homo sapiens
uagccucaccuucc

SEQ ID NO: 497057 - RNA, 17 nt, Homo sapiens
uagcuaauuuaggaguu

SEQ ID NO: 497058 - RNA, 14 nt, Homo sapiens
uagcucgugugcuu

SEQ ID NO: 497059 - RNA, 16 nt, Homo sapiens
uagcucugaaugcuau

SEQ ID NO: 497060 - RNA, 19 nt, Homo sapiens
uagcuggauauaauguauu

SEQ ID NO: 497061 - RNA, 14 nt, Homo sapiens
uaggaacccggcau

SEQ ID NO: 497062 - RNA, 19 nt, Homo sapiens
uaggaccauuucucugcag

SEQ ID NO: 497063 - RNA, 20 nt, Homo sapiens
uaggcaauggugaacuguca

SEQ ID NO: 497064 - RNA, 23 nt, Homo sapiens
uagguaguagaaucucagcacuu

SEQ ID NO: 497065 - RNA, 19 nt, Homo sapiens
uaguauauuaaagugcuau

SEQ ID NO: 497066 - RNA, 21 nt, Homo sapiens
uagucaguguacucugagucc

SEQ ID NO: 497067 - RNA, 22 nt, Homo sapiens
uagucauaucuaucuaaucaga

SEQ ID NO: 497068 - RNA, 18 nt, Homo sapiens
uaguuuccccuuuccuag

SEQ ID NO: 497069 - RNA, 18 nt, Homo sapiens
uauaaauguauauacaca

SEQ ID NO: 497070 - RNA, 16 nt, Homo sapiens
uauaacgagggauaaa

SEQ ID NO: 497071 - RNA, 13 nt, Homo sapiens
uauaauacauuaa

SEQ ID NO: 497072 - RNA, 22 nt, Homo sapiens
uauaaucaaagcucauaaugga

SEQ ID NO: 497073 - RNA, 20 nt, Homo sapiens
uauaauguauuuucagcuca

SEQ ID NO: 497074 - RNA, 23 nt, Homo sapiens
uauacauacgcaauuguauauau

SEQ ID NO: 497075 - RNA, 14 nt, Homo sapiens
uauacgcacgcacc

SEQ ID NO: 497076 - RNA, 15 nt, Homo sapiens
uauacucaaguuuca

SEQ ID NO: 497077 - RNA, 11 nt, Homo sapiens
uauacuuucag

SEQ ID NO: 497078 - RNA, 16 nt, Homo sapiens
uauagauaacugcaua

SEQ ID NO: 497079 - RNA, 20 nt, Homo sapiens
uauauaaaauacacguguau

SEQ ID NO: 497080 - RNA, 12 nt, Homo sapiens
uauauacauacg

SEQ ID NO: 497081 - RNA, 16 nt, Homo sapiens
uauauacauacgcaau

SEQ ID NO: 497082 - RNA, 22 nt, Homo sapiens
uauauauaaaauacacguguau

SEQ ID NO: 497083 - RNA, 12 nt, Homo sapiens
uauaucuguaua

SEQ ID NO: 497084 - RNA, 17 nt, Homo sapiens
uauaucuguggucuuca

SEQ ID NO: 497085 - RNA, 15 nt, Homo sapiens
uauaucuugucuacu

SEQ ID NO: 497086 - RNA, 16 nt, Homo sapiens
uauaugaaaacuaagu

SEQ ID NO: 497087 - RNA, 21 nt, Homo sapiens
uauauguguauauauacauac

SEQ ID NO: 497088 - RNA, 18 nt, Homo sapiens
uaucaaaaugaaugccag

SEQ ID NO: 497089 - RNA, 21 nt, Homo sapiens
uaucaaucaccuugcauuuca

SEQ ID NO: 497090 - RNA, 20 nt, Homo sapiens
uaucaggaaauaucugugaa

SEQ ID NO: 497091 - RNA, 19 nt, Homo sapiens
uaucauccccaaauguguc

SEQ ID NO: 497092 - RNA, 20 nt, Homo sapiens
uaucauccugccuucaugga

SEQ ID NO: 497093 - RNA, 19 nt, Homo sapiens
uaucaugcuucuacuccau

SEQ ID NO: 497094 - RNA, 14 nt, Homo sapiens
auguauguuuacac

SEQ ID NO: 497095 - RNA, 20 nt, Homo sapiens
auguauuggauacgcuccag

SEQ ID NO: 497096 - RNA, 13 nt, Homo sapiens
auguccauaucua

SEQ ID NO: 497097 - RNA, 16 nt, Homo sapiens
auguccuuucauuugu

SEQ ID NO: 497098 - RNA, 12 nt, Homo sapiens
augucuucccac

SEQ ID NO: 497099 - RNA, 14 nt, Homo sapiens
augucuuuaaaaug

SEQ ID NO: 497100 - RNA, 21 nt, Homo sapiens
augugaacuuucucagcauau

SEQ ID NO: 497101 - RNA, 15 nt, Homo sapiens
augugagcaugucac

SEQ ID NO: 497102 - RNA, 21 nt, Homo sapiens
auguguauauguuuauacaca

SEQ ID NO: 497103 - RNA, 17 nt, Homo sapiens
auguguauggaagacaa

SEQ ID NO: 497104 - RNA, 22 nt, Homo sapiens
augugugaagcaaauuucuaga

SEQ ID NO: 497105 - RNA, 15 nt, Homo sapiens
auguucugacagcau

SEQ ID NO: 497106 - RNA, 18 nt, Homo sapiens
auguuuuccuucuacuua

SEQ ID NO: 497107 - RNA, 17 nt, Homo sapiens
auguuuuuaugauaucc

SEQ ID NO: 497108 - RNA, 22 nt, Homo sapiens
auuaaaagaauggacugugcag

SEQ ID NO: 497109 - RNA, 14 nt, Homo sapiens
auuaacccuauuaa

SEQ ID NO: 497110 - RNA, 21 nt, Homo sapiens
auuaagaaacccccucaugga

SEQ ID NO: 497111 - RNA, 16 nt, Homo sapiens
auuaagccucuugucu

SEQ ID NO: 497112 - RNA, 17 nt, Homo sapiens
auuaauaccugaccuca

SEQ ID NO: 497113 - RNA, 14 nt, Homo sapiens
auuaauauaaccau

SEQ ID NO: 497114 - RNA, 16 nt, Homo sapiens
auuaccagauucacuu

SEQ ID NO: 497115 - RNA, 17 nt, Homo sapiens
auuacccuucuuuccau

SEQ ID NO: 497116 - RNA, 16 nt, Homo sapiens
auuagacauaccucuc

SEQ ID NO: 497117 - RNA, 21 nt, Homo sapiens
auuagcccacugccuggaaag

SEQ ID NO: 497118 - RNA, 12 nt, Homo sapiens
auuagcugugau

SEQ ID NO: 497119 - RNA, 16 nt, Homo sapiens
auuauaaacaaaaagc

SEQ ID NO: 497120 - RNA, 23 nt, Homo sapiens
auuauauucccaaaucucaaaag

SEQ ID NO: 497121 - RNA, 17 nt, Homo sapiens
auucaaagaaucaccua

SEQ ID NO: 497122 - RNA, 14 nt, Homo sapiens
auucaacauuugcu

SEQ ID NO: 497123 - RNA, 20 nt, Homo sapiens
auucacagaaccuacuguuc

SEQ ID NO: 497124 - RNA, 18 nt, Homo sapiens
auucacaguugagugcau

SEQ ID NO: 497125 - RNA, 14 nt, Homo sapiens
auucaggugaaaau

SEQ ID NO: 497126 - RNA, 18 nt, Homo sapiens
auucauaccuucugauga

SEQ ID NO: 497127 - RNA, 23 nt, Homo sapiens
auucauagaauaacaacugcugg

SEQ ID NO: 497128 - RNA, 16 nt, Homo sapiens
auucaugcaacuugau

SEQ ID NO: 497129 - RNA, 14 nt, Homo sapiens
auucauuacuagau

SEQ ID NO: 497130 - RNA, 22 nt, Homo sapiens
auuccaaucauuguuaaaguaa

SEQ ID NO: 497131 - RNA, 18 nt, Homo sapiens
auuccccauuuccuguac

SEQ ID NO: 497132 - RNA, 13 nt, Homo sapiens
auuccuaucucau

SEQ ID NO: 497133 - RNA, 22 nt, Homo sapiens
auuccugaccuccgccauccac

SEQ ID NO: 497134 - RNA, 15 nt, Homo sapiens
auucuauccaucucc

SEQ ID NO: 497135 - RNA, 16 nt, Homo sapiens
auugaaggauugugaa

SEQ ID NO: 497136 - RNA, 20 nt, Homo sapiens
auugacaagcacgcacacac

SEQ ID NO: 497137 - RNA, 16 nt, Homo sapiens
auugauguaacugugu

SEQ ID NO: 497138 - RNA, 18 nt, Homo sapiens
auugccauuugguagcau

SEQ ID NO: 497139 - RNA, 15 nt, Homo sapiens
auugcuaccaaaaac

SEQ ID NO: 497140 - RNA, 17 nt, Homo sapiens
auugcuucaugagcuaa

SEQ ID NO: 497141 - RNA, 22 nt, Homo sapiens
auuggaucaggaacccuuacag

SEQ ID NO: 497142 - RNA, 22 nt, Homo sapiens
auuggcaggaaaaaugcagcuu

SEQ ID NO: 497143 - RNA, 15 nt, Homo sapiens
auuguguuacuauaa

SEQ ID NO: 497144 - RNA, 13 nt, Homo sapiens
auuguuaccuuaa

SEQ ID NO: 497145 - RNA, 19 nt, Homo sapiens
auuguuguaagagugauuu

SEQ ID NO: 497146 - RNA, 14 nt, Homo sapiens
auuuaaacuucuua

SEQ ID NO: 497147 - RNA, 23 nt, Homo sapiens
auuuaugggaucaaacauaugau

SEQ ID NO: 497148 - RNA, 14 nt, Homo sapiens
auuuauguuuauua

SEQ ID NO: 497149 - RNA, 19 nt, Homo sapiens
auuuauuuuuucaucucau

SEQ ID NO: 497150 - RNA, 16 nt, Homo sapiens
auuucagcuacauaua

SEQ ID NO: 497151 - RNA, 18 nt, Homo sapiens
auuucauaagcacaucca

SEQ ID NO: 497152 - RNA, 18 nt, Homo sapiens
auuuccaacaccacagac

SEQ ID NO: 497153 - RNA, 14 nt, Homo sapiens
auuucuaacauaag

SEQ ID NO: 497154 - RNA, 23 nt, Homo sapiens
auuucuaggccugauauccaaca

SEQ ID NO: 497155 - RNA, 14 nt, Homo sapiens
auuucuugcaauuu

SEQ ID NO: 497156 - RNA, 21 nt, Homo sapiens
auuugauguaaguuacugaca

SEQ ID NO: 497157 - RNA, 18 nt, Homo sapiens
auuugcaaacuuacuuaa

SEQ ID NO: 497158 - RNA, 19 nt, Homo sapiens
auuugcaaacuuacuuaau

SEQ ID NO: 497159 - RNA, 16 nt, Homo sapiens
auuugcacagaagagu

SEQ ID NO: 497160 - RNA, 14 nt, Homo sapiens
auuugcaguauuca

SEQ ID NO: 497161 - RNA, 13 nt, Homo sapiens
auuugcuauuuau

SEQ ID NO: 497162 - RNA, 18 nt, Homo sapiens
auuugcuauuuauuaaau

SEQ ID NO: 497163 - RNA, 20 nt, Homo sapiens
auuugcuuuugaaacuugaa

SEQ ID NO: 497164 - RNA, 19 nt, Homo sapiens
auuugguacacacuugacc

SEQ ID NO: 497165 - RNA, 23 nt, Homo sapiens
auuuguuaauuucuugcaauuug

SEQ ID NO: 497166 - RNA, 15 nt, Homo sapiens
auuuuauaagcacag

SEQ ID NO: 497167 - RNA, 18 nt, Homo sapiens
auuuuauaagcacagaca

SEQ ID NO: 497168 - RNA, 19 nt, Homo sapiens
auuuuauugcuggaaucua

SEQ ID NO: 497169 - RNA, 20 nt, Homo sapiens
auuuucaaguggaaaccuug

SEQ ID NO: 497170 - RNA, 22 nt, Homo sapiens
auuuucacaggugugguguaau

SEQ ID NO: 497171 - RNA, 14 nt, Homo sapiens
auuuucagcucaau

SEQ ID NO: 497172 - RNA, 14 nt, Homo sapiens
auuuucuacuuuaa

SEQ ID NO: 497173 - RNA, 16 nt, Homo sapiens
auuuuuauacuuucag

SEQ ID NO: 497174 - RNA, 18 nt, Homo sapiens
auuuuucaaagacuucau

SEQ ID NO: 497175 - RNA, 22 nt, Homo sapiens
auuuuuccucuuucacuucuua

SEQ ID NO: 497176 - RNA, 14 nt, Homo sapiens
caaaaaaguacaaa

SEQ ID NO: 497177 - RNA, 14 nt, Homo sapiens
caaaaagauaccuu

SEQ ID NO: 497178 - RNA, 23 nt, Homo sapiens
caaaaaggcuguaagauagucaa

SEQ ID NO: 497179 - RNA, 16 nt, Homo sapiens
caaaagaugccauuca

SEQ ID NO: 497180 - RNA, 20 nt, Homo sapiens
caaaaugaaugccaguccag

SEQ ID NO: 497181 - RNA, 14 nt, Homo sapiens
caaacacagucacu

SEQ ID NO: 497182 - RNA, 13 nt, Homo sapiens
caaacccaaagau

SEQ ID NO: 497183 - RNA, 19 nt, Homo sapiens
caaacucuucccucucuca

SEQ ID NO: 497184 - RNA, 21 nt, Homo sapiens
caaagcagagugaaauucaau

SEQ ID NO: 497185 - RNA, 13 nt, Homo sapiens
caaaggacaguac

SEQ ID NO: 497186 - RNA, 17 nt, Homo sapiens
caaaggagccuuuucaa

SEQ ID NO: 497187 - RNA, 15 nt, Homo sapiens
cagccuuagcucucc

SEQ ID NO: 497188 - RNA, 15 nt, Homo sapiens
cagcggucuucaggc

SEQ ID NO: 497189 - RNA, 19 nt, Homo sapiens
cagcggucuucaggcauuu

SEQ ID NO: 497190 - RNA, 17 nt, Homo sapiens
cagcuaagccugaugau

SEQ ID NO: 497191 - RNA, 20 nt, Homo sapiens
cagcuccuuuauuauaauca

SEQ ID NO: 497192 - RNA, 13 nt, Homo sapiens
cagcucugagauc

SEQ ID NO: 497193 - RNA, 20 nt, Homo sapiens
cagcugaagccagcucccug

SEQ ID NO: 497194 - RNA, 16 nt, Homo sapiens
cagcuguuagagucca

SEQ ID NO: 497195 - RNA, 22 nt, Homo sapiens
cagcuuagaauuauuugcacua

SEQ ID NO: 497196 - RNA, 18 nt, Homo sapiens
caggaaauaucugugaag

SEQ ID NO: 497197 - RNA, 19 nt, Homo sapiens
caggaagaagagaugcacu

SEQ ID NO: 497198 - RNA, 12 nt, Homo sapiens
caggaaucuccu

SEQ ID NO: 497199 - RNA, 17 nt, Homo sapiens
caggacuuauccaugca

SEQ ID NO: 497200 - RNA, 19 nt, Homo sapiens
caggagcaagaacgaggaa

SEQ ID NO: 497201 - RNA, 19 nt, Homo sapiens
caggagcgcagcugcauuu

SEQ ID NO: 497202 - RNA, 20 nt, Homo sapiens
caggaggcagagguugcagu

SEQ ID NO: 497203 - RNA, 21 nt, Homo sapiens
caggagggcugggcuccacuu

SEQ ID NO: 497204 - RNA, 12 nt, Homo sapiens
caggaugcauau

SEQ ID NO: 497205 - RNA, 14 nt, Homo sapiens
caggcucucgcaca

SEQ ID NO: 497206 - RNA, 18 nt, Homo sapiens
caggcucucgcacaccuc

SEQ ID NO: 497207 - RNA, 22 nt, Homo sapiens
cagggagcccugggguuuccac

SEQ ID NO: 497208 - RNA, 14 nt, Homo sapiens
caggugaaaaucca

SEQ ID NO: 497209 - RNA, 19 nt, Homo sapiens
caggugaaaauccaucuca

SEQ ID NO: 497210 - RNA, 19 nt, Homo sapiens
cagguuaggcaguauaaag

SEQ ID NO: 497211 - RNA, 23 nt, Homo sapiens
cagguugugugugugugcaguga

SEQ ID NO: 497212 - RNA, 21 nt, Homo sapiens
caguaaagaccauuuaguccu

SEQ ID NO: 497213 - RNA, 22 nt, Homo sapiens
caguaaagaccauuuaguccuc

SEQ ID NO: 497214 - RNA, 20 nt, Homo sapiens
caguaaaugugauucaccuc

SEQ ID NO: 497215 - RNA, 19 nt, Homo sapiens
caguaaucaguuugcuaac

SEQ ID NO: 497216 - RNA, 21 nt, Homo sapiens
cagucacuguugguuccuucu

SEQ ID NO: 497217 - RNA, 21 nt, Homo sapiens
caguccccagguaucugauga

SEQ ID NO: 497218 - RNA, 11 nt, Homo sapiens
cagucuuccac

SEQ ID NO: 497219 - RNA, 16 nt, Homo sapiens
cagucuuccaccugga

SEQ ID NO: 497220 - RNA, 14 nt, Homo sapiens
cagugauauucuuu

SEQ ID NO: 497221 - RNA, 18 nt, Homo sapiens
cagugauauucuuuguua

SEQ ID NO: 497222 - RNA, 17 nt, Homo sapiens
cagugcccauguguaug

SEQ ID NO: 497223 - RNA, 14 nt, Homo sapiens
cagugugaugcaau

SEQ ID NO: 497224 - RNA, 11 nt, Homo sapiens
caguguuuaca

SEQ ID NO: 497225 - RNA, 20 nt, Homo sapiens
caguuagagucuucaucugu

SEQ ID NO: 497226 - RNA, 13 nt, Homo sapiens
caguucuaaccuc

SEQ ID NO: 497227 - RNA, 12 nt, Homo sapiens
caguucugauga

SEQ ID NO: 497228 - RNA, 18 nt, Homo sapiens
caguuguauggagccucu

SEQ ID NO: 497229 - RNA, 12 nt, Homo sapiens
caguuuuugccu

SEQ ID NO: 497230 - RNA, 21 nt, Homo sapiens
cauaagcacauccaacuacuc

SEQ ID NO: 497231 - RNA, 14 nt, Homo sapiens
cauacuucucucag

SEQ ID NO: 497232 - RNA, 23 nt, Homo sapiens
cauagacagauguggacaugcac

SEQ ID NO: 497233 - RNA, 22 nt, Homo sapiens
cauaggaucugaggacaaggaa

SEQ ID NO: 497234 - RNA, 19 nt, Homo sapiens
acugcgcacugaguacaaa

SEQ ID NO: 497235 - RNA, 16 nt, Homo sapiens
acuggcaacaguugga

SEQ ID NO: 497236 - RNA, 17 nt, Homo sapiens
acuguaaauuccaaaga

SEQ ID NO: 497237 - RNA, 18 nt, Homo sapiens
acuguaaauuccaaagau

SEQ ID NO: 497238 - RNA, 16 nt, Homo sapiens
acuguccccuugauau

SEQ ID NO: 497239 - RNA, 14 nt, Homo sapiens
acugugacacagcu

SEQ ID NO: 497240 - RNA, 17 nt, Homo sapiens
acuuacacaucuuccac

SEQ ID NO: 497241 - RNA, 21 nt, Homo sapiens
acuucacuaccaagcagcuca

SEQ ID NO: 497242 - RNA, 19 nt, Homo sapiens
acuucuaaaauuacagaca

SEQ ID NO: 497243 - RNA, 14 nt, Homo sapiens
acuucucuagacau

SEQ ID NO: 497244 - RNA, 15 nt, Homo sapiens
acuucugacucuucc

SEQ ID NO: 497245 - RNA, 20 nt, Homo sapiens
acuucuuacccaaagcacau

SEQ ID NO: 497246 - RNA, 20 nt, Homo sapiens
acuuggugauuaccugaaag

SEQ ID NO: 497247 - RNA, 14 nt, Homo sapiens
acuuuagcuuuuac

SEQ ID NO: 497248 - RNA, 17 nt, Homo sapiens
acuuucccacacuguga

SEQ ID NO: 497249 - RNA, 17 nt, Homo sapiens
acuuucucagcauauau

SEQ ID NO: 497250 - RNA, 21 nt, Homo sapiens
acuuucuguacuaaacauuuc

SEQ ID NO: 497251 - RNA, 15 nt, Homo sapiens
acuuuggaucaggaa

SEQ ID NO: 497252 - RNA, 19 nt, Homo sapiens
acuuuuauaauacauuaag

SEQ ID NO: 497253 - RNA, 18 nt, Homo sapiens
agaaaaaaaagugucuca

SEQ ID NO: 497254 - RNA, 16 nt, Homo sapiens
agaaaaugcaccucau

SEQ ID NO: 497255 - RNA, 20 nt, Homo sapiens
agaaacccccucauggaucu

SEQ ID NO: 497256 - RNA, 19 nt, Homo sapiens
agaaacccggcuuccugug

SEQ ID NO: 497257 - RNA, 22 nt, Homo sapiens
agaaaccuacagaauacuagcc

SEQ ID NO: 497258 - RNA, 11 nt, Homo sapiens
agaaaccucac

SEQ ID NO: 497259 - RNA, 20 nt, Homo sapiens
agaaaggggcuagcacugga

SEQ ID NO: 497260 - RNA, 22 nt, Homo sapiens
agaaauacaauauaucuugucu

SEQ ID NO: 497261 - RNA, 15 nt, Homo sapiens
agaaauauauauaca

SEQ ID NO: 497262 - RNA, 16 nt, Homo sapiens
agaaauauauauacau

SEQ ID NO: 497263 - RNA, 20 nt, Homo sapiens
agaaauuauguuuucaucca

SEQ ID NO: 497264 - RNA, 15 nt, Homo sapiens
agaacaaauacacuu

SEQ ID NO: 497265 - RNA, 19 nt, Homo sapiens
agaacagggaugcuaucuc

SEQ ID NO: 497266 - RNA, 23 nt, Homo sapiens
agaacauucccuggaauugccac

SEQ ID NO: 497267 - RNA, 16 nt, Homo sapiens
agaaccgagcaaagau

SEQ ID NO: 497268 - RNA, 18 nt, Homo sapiens
agaaccgagcaaagauca

SEQ ID NO: 497269 - RNA, 16 nt, Homo sapiens
agaagcaguugcaaua

SEQ ID NO: 497270 - RNA, 16 nt, Homo sapiens
agaaggaaucuucuca

SEQ ID NO: 497271 - RNA, 20 nt, Homo sapiens
agaauaaaauuccuaucuca

SEQ ID NO: 497272 - RNA, 22 nt, Homo sapiens
agaauauuaaaacugcuuugca

SEQ ID NO: 497273 - RNA, 12 nt, Homo sapiens
agaaucaagucu

SEQ ID NO: 497274 - RNA, 15 nt, Homo sapiens
agaaucucagcacuu

SEQ ID NO: 497275 - RNA, 16 nt, Homo sapiens
agaaucucagcacuuu

SEQ ID NO: 497276 - RNA, 15 nt, Homo sapiens
agaauuauuugcacu

SEQ ID NO: 497277 - RNA, 19 nt, Homo sapiens
agaauucacagaaccuacu

SEQ ID NO: 497278 - RNA, 14 nt, Homo sapiens
agaauugauuuccc

SEQ ID NO: 497279 - RNA, 23 nt, Homo sapiens
agacaacagcccaggcaucuccu

SEQ ID NO: 497280 - RNA, 14 nt, Homo sapiens
agacacgaaauugg

SEQ ID NO: 497281 - RNA, 15 nt, Homo sapiens
agacacuggucucag

SEQ ID NO: 497282 - RNA, 13 nt, Homo sapiens
agacauaccucuc

SEQ ID NO: 497283 - RNA, 19 nt, Homo sapiens
agacauaccucucaacuua

SEQ ID NO: 497284 - RNA, 13 nt, Homo sapiens
agaccaguaguga

SEQ ID NO: 497285 - RNA, 18 nt, Homo sapiens
agacgcaaggaucacuug

SEQ ID NO: 497286 - RNA, 21 nt, Homo sapiens
agacgcaaggaucacuugagc

SEQ ID NO: 497287 - RNA, 14 nt, Homo sapiens
agacucagugcaca

SEQ ID NO: 497288 - RNA, 16 nt, Homo sapiens
agacucuuuaugaucu

SEQ ID NO: 497289 - RNA, 16 nt, Homo sapiens
agacuugauugguuua

SEQ ID NO: 497290 - RNA, 14 nt, Homo sapiens
agagaaauacuuuc

SEQ ID NO: 497291 - RNA, 16 nt, Homo sapiens
agagaaauacuuucag

SEQ ID NO: 497292 - RNA, 13 nt, Homo sapiens
agagaacagggau

SEQ ID NO: 497293 - RNA, 17 nt, Homo sapiens
agagaaccgagcaaaga

SEQ ID NO: 497294 - RNA, 21 nt, Homo sapiens
agagacaugcacacacaaaga

SEQ ID NO: 497295 - RNA, 19 nt, Homo sapiens
agagacccccgugccaaau

SEQ ID NO: 497296 - RNA, 17 nt, Homo sapiens
agagaccuccugauguc

SEQ ID NO: 497297 - RNA, 15 nt, Homo sapiens
agagaggacuguuga

SEQ ID NO: 497298 - RNA, 15 nt, Homo sapiens
agagauauaucugaa

SEQ ID NO: 497299 - RNA, 18 nt, Homo sapiens
agagaucuccaacucucu

SEQ ID NO: 497300 - RNA, 15 nt, Homo sapiens
agagcagaguuuacg

SEQ ID NO: 497301 - RNA, 17 nt, Homo sapiens
agagcaggauagcucuu

SEQ ID NO: 497302 - RNA, 15 nt, Homo sapiens
agagcaguuggccaa

SEQ ID NO: 497303 - RNA, 17 nt, Homo sapiens
agagcugagugagcuga

SEQ ID NO: 497304 - RNA, 20 nt, Homo sapiens
agagcuggaccugagcuauu

SEQ ID NO: 497305 - RNA, 15 nt, Homo sapiens
agaggaaaaggcuug

SEQ ID NO: 497306 - RNA, 14 nt, Homo sapiens
agaggcuuccaguc

SEQ ID NO: 497307 - RNA, 20 nt, Homo sapiens
agagguggaacuuaauuacc

SEQ ID NO: 497308 - RNA, 22 nt, Homo sapiens
agaguauccacuguuuauucaa

SEQ ID NO: 497309 - RNA, 17 nt, Homo sapiens
agagugaagagcauuug

SEQ ID NO: 497310 - RNA, 18 nt, Homo sapiens
agagugaagagcauuugg

SEQ ID NO: 497311 - RNA, 15 nt, Homo sapiens
agagugaagagugaa

SEQ ID NO: 497312 - RNA, 22 nt, Homo sapiens
agagugaccucuagaaaaaaga

SEQ ID NO: 497313 - RNA, 15 nt, Homo sapiens
agaguguuuaacuga

SEQ ID NO: 497314 - RNA, 16 nt, Homo sapiens
agaguuuucugugcaa

SEQ ID NO: 497315 - RNA, 19 nt, Homo sapiens
agauccaccugcacaaaca

SEQ ID NO: 497316 - RNA, 20 nt, Homo sapiens
agauccaggaacacaugcac

SEQ ID NO: 497317 - RNA, 15 nt, Homo sapiens
agaucuccugugcac

SEQ ID NO: 497318 - RNA, 18 nt, Homo sapiens
agaugaauggucuggcaa

SEQ ID NO: 497319 - RNA, 21 nt, Homo sapiens
agaugaauggucuggcaauau

SEQ ID NO: 497320 - RNA, 20 nt, Homo sapiens
agaugacaacacacaccaau

SEQ ID NO: 497321 - RNA, 20 nt, Homo sapiens
agauguucagggguauuaaa

SEQ ID NO: 497322 - RNA, 20 nt, Homo sapiens
agcaaagcaugccaauuucu

SEQ ID NO: 497323 - RNA, 17 nt, Homo sapiens
agcaaauaaauaucauc

SEQ ID NO: 497324 - RNA, 14 nt, Homo sapiens
agcaaccacaaaua

SEQ ID NO: 497325 - RNA, 23 nt, Homo sapiens
agcaacucagaccugggcuuuuc

SEQ ID NO: 497326 - RNA, 14 nt, Homo sapiens
agcaagaccauggg

SEQ ID NO: 497327 - RNA, 16 nt, Homo sapiens
agcacagccaaucucc

SEQ ID NO: 497328 - RNA, 14 nt, Homo sapiens
agcacaguauuuaa

SEQ ID NO: 497329 - RNA, 15 nt, Homo sapiens
aucccaagucauuuc

SEQ ID NO: 497330 - RNA, 15 nt, Homo sapiens
aucccagcacuuugg

SEQ ID NO: 497331 - RNA, 20 nt, Homo sapiens
auccccaugcccucaucccg

SEQ ID NO: 497332 - RNA, 18 nt, Homo sapiens
aucccuagucuauugcag

SEQ ID NO: 497333 - RNA, 14 nt, Homo sapiens
aucccugcagcuca

SEQ ID NO: 497334 - RNA, 16 nt, Homo sapiens
auccgggucaagugaa

SEQ ID NO: 497335 - RNA, 14 nt, Homo sapiens
auccuguauguaau

SEQ ID NO: 497336 - RNA, 16 nt, Homo sapiens
aucuaacuauauguac

SEQ ID NO: 497337 - RNA, 20 nt, Homo sapiens
aucuauggauuggguaucaa

SEQ ID NO: 497338 - RNA, 12 nt, Homo sapiens
aucugacauauu

SEQ ID NO: 497339 - RNA, 17 nt, Homo sapiens
aucugacguuguuaucc

SEQ ID NO: 497340 - RNA, 14 nt, Homo sapiens
aucugaggacaagg

SEQ ID NO: 497341 - RNA, 14 nt, Homo sapiens
aucugauaucuguu

SEQ ID NO: 497342 - RNA, 15 nt, Homo sapiens
aucugaucugaguga

SEQ ID NO: 497343 - RNA, 17 nt, Homo sapiens
aucugauguaacaaggu

SEQ ID NO: 497344 - RNA, 16 nt, Homo sapiens
aucuguggucuucaaa

SEQ ID NO: 497345 - RNA, 24 nt, Homo sapiens
aucuuauuugucaguguagaucaa

SEQ ID NO: 497346 - RNA, 18 nt, Homo sapiens
aucuucagcauguucuca

SEQ ID NO: 497347 - RNA, 22 nt, Homo sapiens
aucuuguggucugcugccucag

SEQ ID NO: 497348 - RNA, 15 nt, Homo sapiens
aucuuugaaaacuca

SEQ ID NO: 497349 - RNA, 20 nt, Homo sapiens
aucuuuguuuuuuguuuuca

SEQ ID NO: 497350 - RNA, 13 nt, Homo sapiens
augaaacagcagc

SEQ ID NO: 497351 - RNA, 23 nt, Homo sapiens
augaagaaauuuaugaagcagau

SEQ ID NO: 497352 - RNA, 16 nt, Homo sapiens
augaagacccuaucuc

SEQ ID NO: 497353 - RNA, 15 nt, Homo sapiens
augaaggucuaccug

SEQ ID NO: 497354 - RNA, 15 nt, Homo sapiens
augacaggcuguuca

SEQ ID NO: 497355 - RNA, 13 nt, Homo sapiens
augagacuguuua

SEQ ID NO: 497356 - RNA, 21 nt, Homo sapiens
augagcuccugcucauugugg

SEQ ID NO: 497357 - RNA, 18 nt, Homo sapiens
augagucacuuacuucau

SEQ ID NO: 497358 - RNA, 17 nt, Homo sapiens
augauacuugguccuua

SEQ ID NO: 497359 - RNA, 15 nt, Homo sapiens
augauccuugcacag

SEQ ID NO: 497360 - RNA, 14 nt, Homo sapiens
augauuaagugcuu

SEQ ID NO: 497361 - RNA, 16 nt, Homo sapiens
augauuaagugcuuga

SEQ ID NO: 497362 - RNA, 21 nt, Homo sapiens
augcaaaauucuuucagauga

SEQ ID NO: 497363 - RNA, 13 nt, Homo sapiens
augcaacuugauu

SEQ ID NO: 497364 - RNA, 19 nt, Homo sapiens
augcaccucauuccaguca

SEQ ID NO: 497365 - RNA, 21 nt, Homo sapiens
augcacuauauguuuacacaa

SEQ ID NO: 497366 - RNA, 12 nt, Homo sapiens
augccuuuccag

SEQ ID NO: 497367 - RNA, 18 nt, Homo sapiens
augcgggcugggcagcug

SEQ ID NO: 497368 - RNA, 15 nt, Homo sapiens
augcuaugucauuuc

SEQ ID NO: 497369 - RNA, 21 nt, Homo sapiens
augcuuuccauauugugauaa

SEQ ID NO: 497370 - RNA, 17 nt, Homo sapiens
auggaagacaaauacac

SEQ ID NO: 497371 - RNA, 18 nt, Homo sapiens
auggaagggccuucucca

SEQ ID NO: 497372 - RNA, 19 nt, Homo sapiens
auggacagcauugccagua

SEQ ID NO: 497373 - RNA, 22 nt, Homo sapiens
auggauauguuuucacuguauu

SEQ ID NO: 497374 - RNA, 16 nt, Homo sapiens
auggccuuaauuaauu

SEQ ID NO: 497375 - RNA, 16 nt, Homo sapiens
auggcucggccaggca

SEQ ID NO: 497376 - RNA, 13 nt, Homo sapiens
augguaacuuuac

SEQ ID NO: 497377 - RNA, 18 nt, Homo sapiens
auggucaaucccaaaagu

SEQ ID NO: 497378 - RNA, 13 nt, Homo sapiens
auguaaacuuuaa

SEQ ID NO: 497379 - RNA, 12 nt, Homo sapiens
auguaccauaau

SEQ ID NO: 497380 - RNA, 21 nt, Homo sapiens
auguauguuuacacugucaaa

SEQ ID NO: 497381 - RNA, 19 nt, Homo sapiens
augucacuucccugcuuaa

SEQ ID NO: 497382 - RNA, 20 nt, Homo sapiens
auguccccaaaguaccacac

SEQ ID NO: 497383 - RNA, 20 nt, Homo sapiens
augucugaaguuugccccag

SEQ ID NO: 497384 - RNA, 20 nt, Homo sapiens
augugauggauggcacaaug

SEQ ID NO: 497385 - RNA, 22 nt, Homo sapiens
augugauucaccucuucuuucc

SEQ ID NO: 497386 - RNA, 18 nt, Homo sapiens
auguggugggagcacagc

SEQ ID NO: 497387 - RNA, 21 nt, Homo sapiens
auguguauuuuucaaggcauu

SEQ ID NO: 497388 - RNA, 13 nt, Homo sapiens
augugucuugcaa

SEQ ID NO: 497389 - RNA, 23 nt, Homo sapiens
auguugaagaacucaugugauuu

SEQ ID NO: 497390 - RNA, 23 nt, Homo sapiens
auguugguacccuggacagugcc

SEQ ID NO: 497391 - RNA, 12 nt, Homo sapiens
auguuguaauau

SEQ ID NO: 497392 - RNA, 13 nt, Homo sapiens
auguuuacacugu

SEQ ID NO: 497393 - RNA, 16 nt, Homo sapiens
auguuuagugugauug

SEQ ID NO: 497394 - RNA, 16 nt, Homo sapiens
auuaaaauaugcacua

SEQ ID NO: 497395 - RNA, 16 nt, Homo sapiens
auuaacuuccucuauu

SEQ ID NO: 497396 - RNA, 15 nt, Homo sapiens
auuaauacuucuuaa

SEQ ID NO: 497397 - RNA, 18 nt, Homo sapiens
auuaauucucagauuccu

SEQ ID NO: 497398 - RNA, 13 nt, Homo sapiens
auuagacagucaa

SEQ ID NO: 497399 - RNA, 19 nt, Homo sapiens
auuaguuccauuuggucuu

SEQ ID NO: 497400 - RNA, 17 nt, Homo sapiens
auucaaaugggugauau

SEQ ID NO: 497401 - RNA, 20 nt, Homo sapiens
auucaacaacuacuacuuga

SEQ ID NO: 497402 - RNA, 14 nt, Homo sapiens
auucacagaaccua

SEQ ID NO: 497403 - RNA, 23 nt, Homo sapiens
auucacaguugagugcaucccag

SEQ ID NO: 497404 - RNA, 11 nt, Homo sapiens
auucagaagac

SEQ ID NO: 497405 - RNA, 21 nt, Homo sapiens
auucaugcaacuugauucuug

SEQ ID NO: 497406 - RNA, 18 nt, Homo sapiens
auucauuagcugugauuu

SEQ ID NO: 497407 - RNA, 14 nt, Homo sapiens
auuccaauuugcac

SEQ ID NO: 497408 - RNA, 17 nt, Homo sapiens
auuccaauuugcacuuu

SEQ ID NO: 497409 - RNA, 18 nt, Homo sapiens
auuccaauuugcacuuuc

SEQ ID NO: 497410 - RNA, 17 nt, Homo sapiens
auuccauacuucucuca

SEQ ID NO: 497411 - RNA, 15 nt, Homo sapiens
auucccagcuuccag

SEQ ID NO: 497412 - RNA, 19 nt, Homo sapiens
auucuacuaugcauuaaau

SEQ ID NO: 497413 - RNA, 13 nt, Homo sapiens
auucucacucgga

SEQ ID NO: 497414 - RNA, 13 nt, Homo sapiens
auucucagauucc

SEQ ID NO: 497415 - RNA, 14 nt, Homo sapiens
auucucuguacaua

SEQ ID NO: 497416 - RNA, 21 nt, Homo sapiens
auucugaaguuauauuuccua

SEQ ID NO: 497417 - RNA, 14 nt, Homo sapiens
uugcuaccaaaaac

SEQ ID NO: 497418 - RNA, 21 nt, Homo sapiens
uugcuauggggacauuccaau

SEQ ID NO: 497419 - RNA, 14 nt, Homo sapiens
uugcugcagauucc

SEQ ID NO: 497420 - RNA, 17 nt, Homo sapiens
uugcugugcguggaaug

SEQ ID NO: 497421 - RNA, 18 nt, Homo sapiens
uugcuguuuauccuguau

SEQ ID NO: 497422 - RNA, 15 nt, Homo sapiens
uugcuuguguuuauu

SEQ ID NO: 497423 - RNA, 17 nt, Homo sapiens
uuggcagaagcaguugc

SEQ ID NO: 497424 - RNA, 18 nt, Homo sapiens
uuggcauggauuucuguc

SEQ ID NO: 497425 - RNA, 21 nt, Homo sapiens
uugggaaaaaggccucugucc

SEQ ID NO: 497426 - RNA, 19 nt, Homo sapiens
uuggguaagggacuccaga

SEQ ID NO: 497427 - RNA, 16 nt, Homo sapiens
uugguacuauggugug

SEQ ID NO: 497428 - RNA, 14 nt, Homo sapiens
uugguaugugacau

SEQ ID NO: 497429 - RNA, 14 nt, Homo sapiens
uuguaaugagccau

SEQ ID NO: 497430 - RNA, 16 nt, Homo sapiens
uuguaauuugggaaca

SEQ ID NO: 497431 - RNA, 19 nt, Homo sapiens
uuguaccuaaguggauaua

SEQ ID NO: 497432 - RNA, 19 nt, Homo sapiens
uuguauaaggaaagccaaa

SEQ ID NO: 497433 - RNA, 21 nt, Homo sapiens
uuguauggagccucuucugcc

SEQ ID NO: 497434 - RNA, 22 nt, Homo sapiens
uugugauugacuuuuuggcuca

SEQ ID NO: 497435 - RNA, 17 nt, Homo sapiens
uugugcugccuguggug

SEQ ID NO: 497436 - RNA, 19 nt, Homo sapiens
uuguuaauuuggaccauuu

SEQ ID NO: 497437 - RNA, 17 nt, Homo sapiens
uuguuauguaccauaau

SEQ ID NO: 497438 - RNA, 13 nt, Homo sapiens
uuguuucuuccaa

SEQ ID NO: 497439 - RNA, 14 nt, Homo sapiens
uuguuucuugccug

SEQ ID NO: 497440 - RNA, 21 nt, Homo sapiens
uuguuuuaacugauuacugua

SEQ ID NO: 497441 - RNA, 12 nt, Homo sapiens
uuuaaaagucac

SEQ ID NO: 497442 - RNA, 11 nt, Homo sapiens
uuuaacaucug

SEQ ID NO: 497443 - RNA, 14 nt, Homo sapiens
uuuaagaaguugcu

SEQ ID NO: 497444 - RNA, 13 nt, Homo sapiens
uuuaaguacuuug

SEQ ID NO: 497445 - RNA, 21 nt, Homo sapiens
uuuacacaauuaauucauccc

SEQ ID NO: 497446 - RNA, 22 nt, Homo sapiens
uuuagguaguagaaucucagca

SEQ ID NO: 497447 - RNA, 13 nt, Homo sapiens
uuuaguaagcaaa

SEQ ID NO: 497448 - RNA, 17 nt, Homo sapiens
uuuauaaaagacaugaa

SEQ ID NO: 497449 - RNA, 13 nt, Homo sapiens
uuuauacacacag

SEQ ID NO: 497450 - RNA, 12 nt, Homo sapiens
uuuauauaugaa

SEQ ID NO: 497451 - RNA, 19 nt, Homo sapiens
uuuauucauuagcugugau

SEQ ID NO: 497452 - RNA, 21 nt, Homo sapiens
uuuauucauuagcugugauuu

SEQ ID NO: 497453 - RNA, 13 nt, Homo sapiens
uuuauugcacaaa

SEQ ID NO: 497454 - RNA, 13 nt, Homo sapiens
uuuauuucuguca

SEQ ID NO: 497455 - RNA, 15 nt, Homo sapiens
uuucacuguauucaa

SEQ ID NO: 497456 - RNA, 15 nt, Homo sapiens
uuucacuguucauga

SEQ ID NO: 497457 - RNA, 21 nt, Homo sapiens
uuucagaaacaaagcauuuga

SEQ ID NO: 497458 - RNA, 23 nt, Homo sapiens
uuucagaaacaaagcauuugacu

SEQ ID NO: 497459 - RNA, 14 nt, Homo sapiens
uuucagcuacauau

SEQ ID NO: 497460 - RNA, 21 nt, Homo sapiens
uuuccaaagguuucaacugua

SEQ ID NO: 497461 - RNA, 13 nt, Homo sapiens
uuuccaacauaca

SEQ ID NO: 497462 - RNA, 17 nt, Homo sapiens
uuucccacacugugaac

SEQ ID NO: 497463 - RNA, 22 nt, Homo sapiens
uuucuaguagcacaacugauaa

SEQ ID NO: 497464 - RNA, 15 nt, Homo sapiens
uuucucagcauauau

SEQ ID NO: 497465 - RNA, 19 nt, Homo sapiens
uuucuccuaucuucauauc

SEQ ID NO: 497466 - RNA, 18 nt, Homo sapiens
uuucuuccaagacuccag

SEQ ID NO: 497467 - RNA, 17 nt, Homo sapiens
uuugcaugucugcauga

SEQ ID NO: 497468 - RNA, 20 nt, Homo sapiens
uuugcuauggggacauucca

SEQ ID NO: 497469 - RNA, 16 nt, Homo sapiens
uuugcuggucacugcc

SEQ ID NO: 497470 - RNA, 22 nt, Homo sapiens
uuugcuuguguacaaacccaga

SEQ ID NO: 497471 - RNA, 16 nt, Homo sapiens
uuugguaugugacaug

SEQ ID NO: 497472 - RNA, 19 nt, Homo sapiens
uuuguacauuuuugaucaa

SEQ ID NO: 497473 - RNA, 17 nt, Homo sapiens
uuugucaguguagauca

SEQ ID NO: 497474 - RNA, 12 nt, Homo sapiens
uuugugaucugu

SEQ ID NO: 497475 - RNA, 17 nt, Homo sapiens
uuuguuauguaccauaa

SEQ ID NO: 497476 - RNA, 22 nt, Homo sapiens
uuuguucuuaaaaaugcauuua

SEQ ID NO: 497477 - RNA, 16 nt, Homo sapiens
uuuuaaacaaauggcu

SEQ ID NO: 497478 - RNA, 14 nt, Homo sapiens
uuuuaaggcuucaa

SEQ ID NO: 497479 - RNA, 17 nt, Homo sapiens
uuuuaauuuuggaacaa

SEQ ID NO: 497480 - RNA, 14 nt, Homo sapiens
uuuuauacuuucag

SEQ ID NO: 497481 - RNA, 13 nt, Homo sapiens
uuuuauuacccuu

SEQ ID NO: 497482 - RNA, 13 nt, Homo sapiens
uuuucaaggcauu

SEQ ID NO: 497483 - RNA, 13 nt, Homo sapiens
uuuucaccauaau

SEQ ID NO: 497484 - RNA, 19 nt, Homo sapiens
uuuugcuggucacugccau

SEQ ID NO: 497485 - RNA, 18 nt, Homo sapiens
gauggguaucaugcuucu

SEQ ID NO: 497486 - RNA, 23 nt, Homo sapiens
gauguccaaacuuaacagaucac

SEQ ID NO: 497487 - RNA, 20 nt, Homo sapiens
gauguccccaaaguaccaca

SEQ ID NO: 497488 - RNA, 20 nt, Homo sapiens
gaugucuugguuuccaucaa

SEQ ID NO: 497489 - RNA, 17 nt, Homo sapiens
gaugugacgcacuguau

SEQ ID NO: 497490 - RNA, 15 nt, Homo sapiens
gauguggacaugcac

SEQ ID NO: 497491 - RNA, 15 nt, Homo sapiens
gauguuuuaguuuaa

SEQ ID NO: 497492 - RNA, 20 nt, Homo sapiens
gauuaacccuauuaaucuau

SEQ ID NO: 497493 - RNA, 14 nt, Homo sapiens
gauuagacagucaa

SEQ ID NO: 497494 - RNA, 22 nt, Homo sapiens
gauucaaauaacccugaaucag

SEQ ID NO: 497495 - RNA, 15 nt, Homo sapiens
gauuccccuggacau

SEQ ID NO: 497496 - RNA, 17 nt, Homo sapiens
gauuccccuggacauau

SEQ ID NO: 497497 - RNA, 20 nt, Homo sapiens
gauucucaccagcugugucc

SEQ ID NO: 497498 - RNA, 23 nt, Homo sapiens
gauugaagcuaaaauaaaccaga

SEQ ID NO: 497499 - RNA, 17 nt, Homo sapiens
gauugaaggauugugaa

SEQ ID NO: 497500 - RNA, 18 nt, Homo sapiens
gauugagagcagccucuu

SEQ ID NO: 497501 - RNA, 23 nt, Homo sapiens
gcaaaaggguaagaugaaagcuu

SEQ ID NO: 497502 - RNA, 14 nt, Homo sapiens
gcaaauaaauauca

SEQ ID NO: 497503 - RNA, 15 nt, Homo sapiens
gcaacuaggccuuca

SEQ ID NO: 497504 - RNA, 16 nt, Homo sapiens
gcaauuuacuuggaau

SEQ ID NO: 497505 - RNA, 18 nt, Homo sapiens
gcaauuuccggccaacag

SEQ ID NO: 497506 - RNA, 17 nt, Homo sapiens
gcacaacauccucagaa

SEQ ID NO: 497507 - RNA, 19 nt, Homo sapiens
gcacacacacacaucucau

SEQ ID NO: 497508 - RNA, 23 nt, Homo sapiens
gcacagagagggggccaccuccc

SEQ ID NO: 497509 - RNA, 15 nt, Homo sapiens
gcacauccauuccca

SEQ ID NO: 497510 - RNA, 15 nt, Homo sapiens
gcaccacgugccaag

SEQ ID NO: 497511 - RNA, 23 nt, Homo sapiens
gcacccacacccuacagcagauc

SEQ ID NO: 497512 - RNA, 17 nt, Homo sapiens
gcacccgcauguacaaa

SEQ ID NO: 497513 - RNA, 11 nt, Homo sapiens
gcacucucuuu

SEQ ID NO: 497514 - RNA, 13 nt, Homo sapiens
gcacugcccuccg

SEQ ID NO: 497515 - RNA, 20 nt, Homo sapiens
gcagaaaaacaggcacaggc

SEQ ID NO: 497516 - RNA, 15 nt, Homo sapiens
gcagaaaauuacauu

SEQ ID NO: 497517 - RNA, 19 nt, Homo sapiens
gcagauccaccugcacaaa

SEQ ID NO: 497518 - RNA, 19 nt, Homo sapiens
gcagauuugcaacagcaaa

SEQ ID NO: 497519 - RNA, 18 nt, Homo sapiens
gcagcucacggaacugga

SEQ ID NO: 497520 - RNA, 19 nt, Homo sapiens
gcagcucacggaacuggag

SEQ ID NO: 497521 - RNA, 15 nt, Homo sapiens
gcagcuucaccagag

SEQ ID NO: 497522 - RNA, 20 nt, Homo sapiens
gcagcuucaccagagcauuu

SEQ ID NO: 497523 - RNA, 15 nt, Homo sapiens
gcaggugacagugag

SEQ ID NO: 497524 - RNA, 20 nt, Homo sapiens
gcaguaaaguuccaugaaga

SEQ ID NO: 497525 - RNA, 19 nt, Homo sapiens
gcauaaaugaauaaauuca

SEQ ID NO: 497526 - RNA, 15 nt, Homo sapiens
gcauagaauaaugaa

SEQ ID NO: 497527 - RNA, 15 nt, Homo sapiens
gcauagcuugcacaa

SEQ ID NO: 497528 - RNA, 16 nt, Homo sapiens
gcauagcuugcacaac

SEQ ID NO: 497529 - RNA, 18 nt, Homo sapiens
gcauggcguaucaggaaa

SEQ ID NO: 497530 - RNA, 21 nt, Homo sapiens
gcaugucacuucccugcuuaa

SEQ ID NO: 497531 - RNA, 21 nt, Homo sapiens
gcauuauaaaauaaaaggauu

SEQ ID NO: 497532 - RNA, 12 nt, Homo sapiens
gcauucuguucc

SEQ ID NO: 497533 - RNA, 18 nt, Homo sapiens
gcauuugcugcauuucaa

SEQ ID NO: 497534 - RNA, 18 nt, Homo sapiens
gcauuuucauauugcuac

SEQ ID NO: 497535 - RNA, 18 nt, Homo sapiens
gcauuuuucuacugcucu

SEQ ID NO: 497536 - RNA, 19 nt, Homo sapiens
gccaccuccccaggccgug

SEQ ID NO: 497537 - RNA, 17 nt, Homo sapiens
gccaccuccucuguucu

SEQ ID NO: 497538 - RNA, 13 nt, Homo sapiens
gccacggcagccu

SEQ ID NO: 497539 - RNA, 22 nt, Homo sapiens
gccagaggaaaucugaauguau

SEQ ID NO: 497540 - RNA, 19 nt, Homo sapiens
gccagcucccugaaucuga

SEQ ID NO: 497541 - RNA, 19 nt, Homo sapiens
gccaggcucccacugcccc

SEQ ID NO: 497542 - RNA, 20 nt, Homo sapiens
gcccagacucaaggccucca

SEQ ID NO: 497543 - RNA, 19 nt, Homo sapiens
gcccagucauauguucuca

SEQ ID NO: 497544 - RNA, 16 nt, Homo sapiens
gcccugggguuuccac

SEQ ID NO: 497545 - RNA, 16 nt, Homo sapiens
gcccuucccugacacu

SEQ ID NO: 497546 - RNA, 20 nt, Homo sapiens
gcccuucccugacacugucu

SEQ ID NO: 497547 - RNA, 14 nt, Homo sapiens
gccggagugacaga

SEQ ID NO: 497548 - RNA, 18 nt, Homo sapiens
gccucauccuccacugaa

SEQ ID NO: 497549 - RNA, 23 nt, Homo sapiens
gccuccuagaccuguucuuucca

SEQ ID NO: 497550 - RNA, 17 nt, Homo sapiens
gccugaaagcaacagcu

SEQ ID NO: 497551 - RNA, 16 nt, Homo sapiens
gccuucuccacaggga

SEQ ID NO: 497552 - RNA, 22 nt, Homo sapiens
gccuucuccacagggacacagu

SEQ ID NO: 497553 - RNA, 12 nt, Homo sapiens
gccuuuaucuca

SEQ ID NO: 497554 - RNA, 14 nt, Homo sapiens
gccuuuuguagcug

SEQ ID NO: 497555 - RNA, 16 nt, Homo sapiens
gcgagucuggagacca

SEQ ID NO: 497556 - RNA, 11 nt, Homo sapiens
gcgaguucucu

SEQ ID NO: 497557 - RNA, 16 nt, Homo sapiens
gcgcagcugcauuugg

SEQ ID NO: 497558 - RNA, 16 nt, Homo sapiens
gcggggagcaugaaga

SEQ ID NO: 497559 - RNA, 13 nt, Homo sapiens
cuuucccuuccag

SEQ ID NO: 497560 - RNA, 21 nt, Homo sapiens
cuuuccucuuaaugucucaaa

SEQ ID NO: 497561 - RNA, 15 nt, Homo sapiens
cuuucuuuccauuua

SEQ ID NO: 497562 - RNA, 13 nt, Homo sapiens
cuuugccacugaa

SEQ ID NO: 497563 - RNA, 20 nt, Homo sapiens
cuuugcugaaugucauuuua

SEQ ID NO: 497564 - RNA, 17 nt, Homo sapiens
cuuuggaaaauucagau

SEQ ID NO: 497565 - RNA, 15 nt, Homo sapiens
cuuuggaucaggaaa

SEQ ID NO: 497566 - RNA, 16 nt, Homo sapiens
cuuuggcuuaauucca

SEQ ID NO: 497567 - RNA, 19 nt, Homo sapiens
cuuuguaccuguaggucua

SEQ ID NO: 497568 - RNA, 17 nt, Homo sapiens
cuuuuaaggaaaggcaa

SEQ ID NO: 497569 - RNA, 19 nt, Homo sapiens
cuuuuauacucagcuuucu

SEQ ID NO: 497570 - RNA, 17 nt, Homo sapiens
cuuuuauucauuagcug

SEQ ID NO: 497571 - RNA, 17 nt, Homo sapiens
cuuuucuccuaucuuca

SEQ ID NO: 497572 - RNA, 16 nt, Homo sapiens
cuuuucugaucugcag

SEQ ID NO: 497573 - RNA, 15 nt, Homo sapiens
cuuuugguaugugac

SEQ ID NO: 497574 - RNA, 16 nt, Homo sapiens
cuuuugguaugugaca

SEQ ID NO: 497575 - RNA, 17 nt, Homo sapiens
gaaaaaaaagugucuca

SEQ ID NO: 497576 - RNA, 16 nt, Homo sapiens
gaaaaaaagcuuuuau

SEQ ID NO: 497577 - RNA, 17 nt, Homo sapiens
gaaaaaggccucugucc

SEQ ID NO: 497578 - RNA, 22 nt, Homo sapiens
gaaaaaucaguuuuuguucuua

SEQ ID NO: 497579 - RNA, 21 nt, Homo sapiens
gaaaagaaaaauuucuggcaa

SEQ ID NO: 497580 - RNA, 16 nt, Homo sapiens
gaaaagcaccucuuga

SEQ ID NO: 497581 - RNA, 16 nt, Homo sapiens
gaaaaggauugcuuaa

SEQ ID NO: 497582 - RNA, 15 nt, Homo sapiens
gaaaaggcuugaguc

SEQ ID NO: 497583 - RNA, 12 nt, Homo sapiens
gaaaauguucau

SEQ ID NO: 497584 - RNA, 15 nt, Homo sapiens
gaaacaaagcauuug

SEQ ID NO: 497585 - RNA, 17 nt, Homo sapiens
gaaacaauuucuguguc

SEQ ID NO: 497586 - RNA, 22 nt, Homo sapiens
gaaacagcagcugaagccagcu

SEQ ID NO: 497587 - RNA, 19 nt, Homo sapiens
gaaaccagccaacccaagu

SEQ ID NO: 497588 - RNA, 18 nt, Homo sapiens
gaaaccccugacaccuuu

SEQ ID NO: 497589 - RNA, 19 nt, Homo sapiens
gaaagacaguaaagaccau

SEQ ID NO: 497590 - RNA, 14 nt, Homo sapiens
gaaagcauggcuca

SEQ ID NO: 497591 - RNA, 23 nt, Homo sapiens
gaaaggaagaccucaagaaaaau

SEQ ID NO: 497592 - RNA, 17 nt, Homo sapiens
gaaaguguucuguuaca

SEQ ID NO: 497593 - RNA, 21 nt, Homo sapiens
gaaauacaauauaucuugucu

SEQ ID NO: 497594 - RNA, 14 nt, Homo sapiens
gaaauacuugacaa

SEQ ID NO: 497595 - RNA, 15 nt, Homo sapiens
gaaaucacaagaaca

SEQ ID NO: 497596 - RNA, 15 nt, Homo sapiens
gaaaugcacaauguc

SEQ ID NO: 497597 - RNA, 23 nt, Homo sapiens
gaaaugugugugaugugacauuu

SEQ ID NO: 497598 - RNA, 19 nt, Homo sapiens
gaaauuauaaugcaauaaa

SEQ ID NO: 497599 - RNA, 14 nt, Homo sapiens
gaaauucacaaagu

SEQ ID NO: 497600 - RNA, 20 nt, Homo sapiens
gaaauugguaccuugcacac

SEQ ID NO: 497601 - RNA, 14 nt, Homo sapiens
gaacaaaucuuccu

SEQ ID NO: 497602 - RNA, 18 nt, Homo sapiens
gaacacucugaauuccaa

SEQ ID NO: 497603 - RNA, 21 nt, Homo sapiens
gaacaguaaagaaagcagaau

SEQ ID NO: 497604 - RNA, 17 nt, Homo sapiens
gaacaguguuuacuuua

SEQ ID NO: 497605 - RNA, 17 nt, Homo sapiens
gaacaugggggaacaau

SEQ ID NO: 497606 - RNA, 14 nt, Homo sapiens
gaaccaauucacuu

SEQ ID NO: 497607 - RNA, 24 nt, Homo sapiens
gaacuauauuuaagagacuuugua

SEQ ID NO: 497608 - RNA, 22 nt, Homo sapiens
gaacugcaccaccgaccaacuc

SEQ ID NO: 497609 - RNA, 23 nt, Homo sapiens
gaacuuaauuaccuaagagccac

SEQ ID NO: 497610 - RNA, 22 nt, Homo sapiens
gaagacaaauaguguggaguga

SEQ ID NO: 497611 - RNA, 17 nt, Homo sapiens
gaagagaguauggugcu

SEQ ID NO: 497612 - RNA, 18 nt, Homo sapiens
gaagagugaagagcauuu

SEQ ID NO: 497613 - RNA, 12 nt, Homo sapiens
gaagcagcagcu

SEQ ID NO: 497614 - RNA, 22 nt, Homo sapiens
gaagcaguugcaauaaacucag

SEQ ID NO: 497615 - RNA, 19 nt, Homo sapiens
gaagccaccgggagauuuc

SEQ ID NO: 497616 - RNA, 20 nt, Homo sapiens
gaagccaccgggagauuucu

SEQ ID NO: 497617 - RNA, 16 nt, Homo sapiens
gaaggcagcuagacac

SEQ ID NO: 497618 - RNA, 20 nt, Homo sapiens
gaagggaauuaaaaagaaga

SEQ ID NO: 497619 - RNA, 21 nt, Homo sapiens
gaaggucccgaauggagucca

SEQ ID NO: 497620 - RNA, 13 nt, Homo sapiens
gaaggucucucug

SEQ ID NO: 497621 - RNA, 15 nt, Homo sapiens
gaaguacacauuucu

SEQ ID NO: 497622 - RNA, 20 nt, Homo sapiens
gaauaaaauuccuaucucau

SEQ ID NO: 497623 - RNA, 11 nt, Homo sapiens
gaauacuguau

SEQ ID NO: 497624 - RNA, 20 nt, Homo sapiens
gaauaucagaaguauaucug

SEQ ID NO: 497625 - RNA, 16 nt, Homo sapiens
gaaucaagucugugaa

SEQ ID NO: 497626 - RNA, 14 nt, Homo sapiens
gaaucucagcacuu

SEQ ID NO: 497627 - RNA, 22 nt, Homo sapiens
gaaucuccuuuggaaggugaca

SEQ ID NO: 497628 - RNA, 20 nt, Homo sapiens
gaaucugaccacagacacuc

SEQ ID NO: 497629 - RNA, 20 nt, Homo sapiens
gaaucuucagcauguucuca

SEQ ID NO: 497630 - RNA, 23 nt, Homo sapiens
gaaugcgcugaucguuucuucca

SEQ ID NO: 497631 - RNA, 20 nt, Homo sapiens
gaauggucuggcaauauucu

SEQ ID NO: 497632 - RNA, 20 nt, Homo sapiens
gacaacauuuuucauagaua

SEQ ID NO: 497633 - RNA, 21 nt, Homo sapiens
gacacagcagcuucaccagag

SEQ ID NO: 497634 - RNA, 18 nt, Homo sapiens
gacaccuagacucuaaaa

SEQ ID NO: 497635 - RNA, 21 nt, Homo sapiens
gacacguuuggccagugacau

SEQ ID NO: 497636 - RNA, 14 nt, Homo sapiens
gacacugugcuaua

SEQ ID NO: 497637 - RNA, 20 nt, Homo sapiens
gacagcuuuguccugagucu

SEQ ID NO: 497638 - RNA, 19 nt, Homo sapiens
gacaguguguccaguuacc

SEQ ID NO: 497639 - RNA, 21 nt, Homo sapiens
gacauaaauuguaauuuggga

SEQ ID NO: 497640 - RNA, 22 nt, Homo sapiens
auggaggccagugccagcaccu

SEQ ID NO: 497641 - RNA, 15 nt, Homo sapiens
auggguugcauuugg

SEQ ID NO: 497642 - RNA, 16 nt, Homo sapiens
augguaauaagcacug

SEQ ID NO: 497643 - RNA, 20 nt, Homo sapiens
auguaacaacaauuauuuga

SEQ ID NO: 497644 - RNA, 19 nt, Homo sapiens
auguagccuggcccuggaa

SEQ ID NO: 497645 - RNA, 17 nt, Homo sapiens
auguauaaagacaccuu

SEQ ID NO: 497646 - RNA, 21 nt, Homo sapiens
auguuagaauuuggagggaau

SEQ ID NO: 497647 - RNA, 17 nt, Homo sapiens
auguuuagcagauuuaa

SEQ ID NO: 497648 - RNA, 14 nt, Homo sapiens
auucuacacugagg

SEQ ID NO: 497649 - RNA, 23 nt, Homo sapiens
auugaccauuuuuuaauuuacuu

SEQ ID NO: 497650 - RNA, 13 nt, Homo sapiens
auugcccugugag

SEQ ID NO: 497651 - RNA, 17 nt, Homo sapiens
auugggaaaacauuugc

SEQ ID NO: 497652 - RNA, 21 nt, Homo sapiens
auuguguugggaccugugauc

SEQ ID NO: 497653 - RNA, 13 nt, Homo sapiens
auuuaagauaugu

SEQ ID NO: 497654 - RNA, 14 nt, Homo sapiens
auuuaaguuucaca

SEQ ID NO: 497655 - RNA, 22 nt, Homo sapiens
auuugauugggaugaaugccau

SEQ ID NO: 497656 - RNA, 16 nt, Homo sapiens
auuuucacucugggcu

SEQ ID NO: 497657 - RNA, 17 nt, Homo sapiens
caaaauauagcuuucau

SEQ ID NO: 497658 - RNA, 15 nt, Homo sapiens
caaacacacuguaaa

SEQ ID NO: 497659 - RNA, 21 nt, Homo sapiens
caaagcaggguucugaggcaa

SEQ ID NO: 497660 - RNA, 15 nt, Homo sapiens
caaauacacauuugc

SEQ ID NO: 497661 - RNA, 16 nt, Homo sapiens
caaauacacauuugcu

SEQ ID NO: 497662 - RNA, 20 nt, Homo sapiens
caacuccugguucagccauu

SEQ ID NO: 497663 - RNA, 19 nt, Homo sapiens
caagagauaagucuuucau

SEQ ID NO: 497664 - RNA, 18 nt, Homo sapiens
caagcaagggcugugcug

SEQ ID NO: 497665 - RNA, 15 nt, Homo sapiens
caagcauuuguucca

SEQ ID NO: 497666 - RNA, 18 nt, Homo sapiens
caaguguugaggggacca

SEQ ID NO: 497667 - RNA, 14 nt, Homo sapiens
caaugauaaugcua

SEQ ID NO: 497668 - RNA, 15 nt, Homo sapiens
caaugauaaugcuaa

SEQ ID NO: 497669 - RNA, 16 nt, Homo sapiens
caaugguagcaaaaca

SEQ ID NO: 497670 - RNA, 19 nt, Homo sapiens
caauuauuugaagauuuaa

SEQ ID NO: 497671 - RNA, 14 nt, Homo sapiens
cacagagcaauggu

SEQ ID NO: 497672 - RNA, 22 nt, Homo sapiens
cacagaugccuggguugcugcu

SEQ ID NO: 497673 - RNA, 18 nt, Homo sapiens
cacagcauguguauuucc

SEQ ID NO: 497674 - RNA, 20 nt, Homo sapiens
caccgagaauguuguauuca

SEQ ID NO: 497675 - RNA, 19 nt, Homo sapiens
caccucagacaauccacuc

SEQ ID NO: 497676 - RNA, 16 nt, Homo sapiens
caccucuggaucccug

SEQ ID NO: 497677 - RNA, 23 nt, Homo sapiens
caccuuggggccuugaugacugc

SEQ ID NO: 497678 - RNA, 21 nt, Homo sapiens
cacgcugaaggcuuacuucag

SEQ ID NO: 497679 - RNA, 21 nt, Homo sapiens
cacuccugcuuaaucuucaaa

SEQ ID NO: 497680 - RNA, 17 nt, Homo sapiens
cacucggcuuccaggga

SEQ ID NO: 497681 - RNA, 16 nt, Homo sapiens
cacugugagcaccuga

SEQ ID NO: 497682 - RNA, 12 nt, Homo sapiens
cacuuacaauuu

SEQ ID NO: 497683 - RNA, 24 nt, Homo sapiens
cagagcaagagauaagucuuucau

SEQ ID NO: 497684 - RNA, 19 nt, Homo sapiens
cagaguaacaugccagcuu

SEQ ID NO: 497685 - RNA, 13 nt, Homo sapiens
cagauucuuucag

SEQ ID NO: 497686 - RNA, 17 nt, Homo sapiens
cagcaccggccucggga

SEQ ID NO: 497687 - RNA, 15 nt, Homo sapiens
cagcacuuacaauuu

SEQ ID NO: 497688 - RNA, 20 nt, Homo sapiens
cagcauaccuuggacugacu

SEQ ID NO: 497689 - RNA, 22 nt, Homo sapiens
cagccuucugacaagcaagggc

SEQ ID NO: 497690 - RNA, 14 nt, Homo sapiens
cagcgauccacgga

SEQ ID NO: 497691 - RNA, 20 nt, Homo sapiens
cagcggucauucuacacuga

SEQ ID NO: 497692 - RNA, 19 nt, Homo sapiens
cagcuaacuccagucuccu

SEQ ID NO: 497693 - RNA, 15 nt, Homo sapiens
cagcuacaauuguaa

SEQ ID NO: 497694 - RNA, 20 nt, Homo sapiens
cagcugaggccuugccuuga

SEQ ID NO: 497695 - RNA, 16 nt, Homo sapiens
cagcuuggcccuuucc

SEQ ID NO: 497696 - RNA, 14 nt, Homo sapiens
caggcucggagcca

SEQ ID NO: 497697 - RNA, 14 nt, Homo sapiens
caggcuggagccca

SEQ ID NO: 497698 - RNA, 15 nt, Homo sapiens
cagggagcagggcag

SEQ ID NO: 497699 - RNA, 13 nt, Homo sapiens
cagggagcccuuu

SEQ ID NO: 497700 - RNA, 18 nt, Homo sapiens
cagggccucugggagccu

SEQ ID NO: 497701 - RNA, 16 nt, Homo sapiens
cagucuuggcucacua

SEQ ID NO: 497702 - RNA, 15 nt, Homo sapiens
cagugccagcaccug

SEQ ID NO: 497703 - RNA, 11 nt, Homo sapiens
cauagcacugc

SEQ ID NO: 497704 - RNA, 17 nt, Homo sapiens
cauaggcgcaggugcac

SEQ ID NO: 497705 - RNA, 19 nt, Homo sapiens
cauaggcgcaggugcacag

SEQ ID NO: 497706 - RNA, 23 nt, Homo sapiens
cauauuuaacaaaauuugaauag

SEQ ID NO: 497707 - RNA, 12 nt, Homo sapiens
cauccaacacug

SEQ ID NO: 497708 - RNA, 22 nt, Homo sapiens
caucccacaugaucuugagauu

SEQ ID NO: 497709 - RNA, 15 nt, Homo sapiens
caugaaaauaccauu

SEQ ID NO: 497710 - RNA, 14 nt, Homo sapiens
caugcaaaugagcu

SEQ ID NO: 497711 - RNA, 14 nt, Homo sapiens
caugcacucaggca

SEQ ID NO: 497712 - RNA, 21 nt, Homo sapiens
caugcauggauggguccucac

SEQ ID NO: 497713 - RNA, 14 nt, Homo sapiens
cauggaggccagug

SEQ ID NO: 497714 - RNA, 15 nt, Homo sapiens
cauggcagaagucaa

SEQ ID NO: 497715 - RNA, 20 nt, Homo sapiens
cauggcagaagucaacgccu

SEQ ID NO: 497716 - RNA, 19 nt, Homo sapiens
cauuaaggggaagaaugaa

SEQ ID NO: 497717 - RNA, 12 nt, Homo sapiens
cauuccuaacac

SEQ ID NO: 497718 - RNA, 21 nt, Homo sapiens
ccaaacacuguuucuaacuca

SEQ ID NO: 497719 - RNA, 22 nt, Homo sapiens
ccaaagccaccaagacaggcuc

SEQ ID NO: 497720 - RNA, 14 nt, Homo sapiens
ccaauggcuguaaa

SEQ ID NO: 497721 - RNA, 14 nt, Homo sapiens
ccacacagggugca

SEQ ID NO: 497722 - RNA, 18 nt, Homo sapiens
ccacacccacuuugucca

SEQ ID NO: 497723 - RNA, 23 nt, Homo sapiens
ccacagccaagguagggucacua

SEQ ID NO: 497724 - RNA, 16 nt, Homo sapiens
ccacgaugucaaggac

SEQ ID NO: 497725 - RNA, 19 nt, Homo sapiens
ccagaaagaggcagugauu

SEQ ID NO: 497726 - RNA, 13 nt, Homo sapiens
ccagacaaaugga

SEQ ID NO: 497727 - RNA, 12 nt, Homo sapiens
ccagcaccugcc

SEQ ID NO: 497728 - RNA, 23 nt, Homo sapiens
ccagcaugaagguggggccagug

SEQ ID NO: 497729 - RNA, 14 nt, Homo sapiens
ccaggcuuuguaca

SEQ ID NO: 497730 - RNA, 18 nt, Homo sapiens
ccaggggaaccugccaug

SEQ ID NO: 497731 - RNA, 22 nt, Homo sapiens
ccaggggaaccugccaugccag

SEQ ID NO: 497732 - RNA, 22 nt, Homo sapiens
ccagguguucuacacucaucuu

SEQ ID NO: 497733 - RNA, 14 nt, Homo sapiens
ccaguucugaaggu

SEQ ID NO: 497734 - RNA, 15 nt, Homo sapiens
ccauacuacccucau

SEQ ID NO: 497735 - RNA, 19 nt, Homo sapiens
ccauacuuucccacagcac

SEQ ID NO: 497736 - RNA, 15 nt, Homo sapiens
ccauccaacacugga

SEQ ID NO: 497737 - RNA, 17 nt, Homo sapiens
ccaugaggacaaagugu

SEQ ID NO: 497738 - RNA, 21 nt, Homo sapiens
ccaugccaggaaccuguccua

SEQ ID NO: 497739 - RNA, 21 nt, Homo sapiens
ccauggaggccagugccagca

SEQ ID NO: 497740 - RNA, 23 nt, Homo sapiens
ccauuguguugggaccugugauc

SEQ ID NO: 497741 - RNA, 12 nt, Homo sapiens
cccacagcacua

SEQ ID NO: 497742 - RNA, 14 nt, Homo sapiens
cccagaaagaggca

SEQ ID NO: 497743 - RNA, 14 nt, Homo sapiens
cccagugaccugac

SEQ ID NO: 497744 - RNA, 17 nt, Homo sapiens
ccccauccaacacugga

SEQ ID NO: 497745 - RNA, 19 nt, Homo sapiens
cccgagcuagagugcagug

SEQ ID NO: 497746 - RNA, 17 nt, Homo sapiens
cccuaagaggcagugag

SEQ ID NO: 497747 - RNA, 10 nt, Homo sapiens
cccuaaggga

SEQ ID NO: 497748 - RNA, 16 nt, Homo sapiens
cccucauuaugacucu

SEQ ID NO: 497749 - RNA, 15 nt, Homo sapiens
cccugcccaaugaga

SEQ ID NO: 497750 - RNA, 23 nt, Homo sapiens
cccuuuagggaaauucaaagcag

SEQ ID NO: 497751 - RNA, 16 nt, Homo sapiens
ccgagcuagagugcag

SEQ ID NO: 497752 - RNA, 16 nt, Homo sapiens
ccgcaacagccaagug

SEQ ID NO: 497753 - RNA, 21 nt, Homo sapiens
ccgcugcuuccuggcugggaa

SEQ ID NO: 497754 - RNA, 15 nt, Homo sapiens
ccuaagaaaccccag

SEQ ID NO: 497755 - RNA, 11 nt, Homo sapiens
ccuaggcaaag

SEQ ID NO: 497756 - RNA, 22 nt, Homo sapiens
ccuauuuccugaacucagcuga

SEQ ID NO: 497757 - RNA, 16 nt, Homo sapiens
ccuccgaccacuucca

SEQ ID NO: 497758 - RNA, 15 nt, Homo sapiens
ccucugggagccuga

SEQ ID NO: 497759 - RNA, 21 nt, Homo sapiens
ccugacauuaagacacaccuc

SEQ ID NO: 497760 - RNA, 15 nt, Homo sapiens
ccugcccucugggag

SEQ ID NO: 497761 - RNA, 16 nt, Homo sapiens
ccugcuggcaccucag

SEQ ID NO: 497762 - RNA, 19 nt, Homo sapiens
ccuggggcgagcacuguga

SEQ ID NO: 497763 - RNA, 23 nt, Homo sapiens
ccugucuuagccucccaaagugc

SEQ ID NO: 497764 - RNA, 12 nt, Homo sapiens
ccugugaucucc

SEQ ID NO: 497765 - RNA, 22 nt, Homo sapiens
ccugugcacgcgcgcgugcaca

SEQ ID NO: 497766 - RNA, 19 nt, Homo sapiens
cgaacaaacugaugcgaaa

SEQ ID NO: 497767 - RNA, 14 nt, Homo sapiens
cggcuucaccugcg

SEQ ID NO: 497768 - RNA, 20 nt, Homo sapiens
cgggggaaagcacaccucau

SEQ ID NO: 497769 - RNA, 22 nt, Homo sapiens
cgggggaaagcacaccucaugc

SEQ ID NO: 497770 - RNA, 15 nt, Homo sapiens
cguccaucucccuua

SEQ ID NO: 497771 - RNA, 17 nt, Homo sapiens
cuaaacauguauguaaa

SEQ ID NO: 497772 - RNA, 15 nt, Homo sapiens
cuaagaggcagugag

SEQ ID NO: 497773 - RNA, 13 nt, Homo sapiens
cuaaggaaccuuc

SEQ ID NO: 497774 - RNA, 19 nt, Homo sapiens
cuacaaaauauagcuuuca

SEQ ID NO: 497775 - RNA, 22 nt, Homo sapiens
cuaccucaagacucaccucauc

SEQ ID NO: 497776 - RNA, 22 nt, Homo sapiens
cuagaggcuugcauaauaagcu

SEQ ID NO: 497777 - RNA, 13 nt, Homo sapiens
cuagccugugcac

SEQ ID NO: 497778 - RNA, 14 nt, Homo sapiens
cuaggcuaccucaa

SEQ ID NO: 497779 - RNA, 19 nt, Homo sapiens
cuauaaaacucugcaugua

SEQ ID NO: 497780 - RNA, 14 nt, Homo sapiens
cuauugaacugagc

SEQ ID NO: 497781 - RNA, 22 nt, Homo sapiens
cucaaugcaguuagcugaagaa

SEQ ID NO: 497782 - RNA, 15 nt, Homo sapiens
cucacucggcuucca

SEQ ID NO: 497783 - RNA, 19 nt, Homo sapiens
cucagccgugcacucccua

SEQ ID NO: 497784 - RNA, 16 nt, Homo sapiens
cucagggagcagggaa

SEQ ID NO: 497785 - RNA, 17 nt, Homo sapiens
cuccaucaugcuugauu

SEQ ID NO: 497786 - RNA, 15 nt, Homo sapiens
cucccauagcacugc

SEQ ID NO: 497787 - RNA, 19 nt, Homo sapiens
cucccuguguggcugcuga

SEQ ID NO: 497788 - RNA, 21 nt, Homo sapiens
cuccgaccacuuccaggggaa

SEQ ID NO: 497789 - RNA, 15 nt, Homo sapiens
cuccgcaacagccaa

SEQ ID NO: 497790 - RNA, 18 nt, Homo sapiens
cucucugguuuacuucaa

SEQ ID NO: 497791 - RNA, 14 nt, Homo sapiens
cucugacuggaguc

SEQ ID NO: 497792 - RNA, 21 nt, Homo sapiens
cucuucccaccucagugccca

SEQ ID NO: 497793 - RNA, 16 nt, Homo sapiens
cugagcaguaccagug

SEQ ID NO: 497794 - RNA, 22 nt, Homo sapiens
cugagccaaacacacuguaaau

SEQ ID NO: 497795 - RNA, 17 nt, Homo sapiens
cugaggcaaauggcaca

SEQ ID NO: 497796 - RNA, 18 nt, Homo sapiens
cugauguguccucaggga

SEQ ID NO: 497797 - RNA, 21 nt, Homo sapiens
cugauucuggcuuuaagccuu

SEQ ID NO: 497798 - RNA, 16 nt, Homo sapiens
cugcagagauuucuca

SEQ ID NO: 497799 - RNA, 19 nt, Homo sapiens
cugcccccaucccacauga

SEQ ID NO: 497800 - RNA, 15 nt, Homo sapiens
cuggaagccaaacaa

SEQ ID NO: 497801 - RNA, 23 nt, Homo sapiens
cuggguugcugcuguccagugcc

SEQ ID NO: 497802 - RNA, 18 nt, Homo sapiens
cugucaggauucuucaag

SEQ ID NO: 497803 - RNA, 11 nt, Homo sapiens
cuguccagugc

SEQ ID NO: 497804 - RNA, 22 nt, Homo sapiens
cugugggcuuuggguuugucag

SEQ ID NO: 497805 - RNA, 18 nt, Homo sapiens
cuguugcuuaaaccacuu

SEQ ID NO: 497806 - RNA, 22 nt, Homo sapiens
cuuaaacgaagaguucccuuga

SEQ ID NO: 497807 - RNA, 17 nt, Homo sapiens
cuuagccucccaaagug

SEQ ID NO: 497808 - RNA, 20 nt, Homo sapiens
cuucaaagccuucucccuag

SEQ ID NO: 497809 - RNA, 11 nt, Homo sapiens
cuucaccugcg

SEQ ID NO: 497810 - RNA, 20 nt, Homo sapiens
cuucaucgaacaaacugaug

SEQ ID NO: 497811 - RNA, 15 nt, Homo sapiens
cuuccacacagggug

SEQ ID NO: 497812 - RNA, 13 nt, Homo sapiens
cuuccagauccug

SEQ ID NO: 497813 - RNA, 15 nt, Homo sapiens
cuuccauuaaaacaa

SEQ ID NO: 497814 - RNA, 13 nt, Homo sapiens
cuucccaccucag

SEQ ID NO: 497815 - RNA, 19 nt, Homo sapiens
cuuccugaacaaccagcug

SEQ ID NO: 497816 - RNA, 15 nt, Homo sapiens
cuucucuuucucuga

SEQ ID NO: 497817 - RNA, 14 nt, Homo sapiens
cuucugacaagcaa

SEQ ID NO: 497818 - RNA, 21 nt, Homo sapiens
cuugaugacugccuugccucc

SEQ ID NO: 497819 - RNA, 15 nt, Homo sapiens
cuugcagaacuguag

SEQ ID NO: 497820 - RNA, 14 nt, Homo sapiens
cuugucuucuggua

SEQ ID NO: 497821 - RNA, 22 nt, Homo sapiens
cuuuaagccuucaaaacuauag

SEQ ID NO: 497822 - RNA, 15 nt, Homo sapiens
cuuuuugugucucca

SEQ ID NO: 497823 - RNA, 16 nt, Homo sapiens
gaaaaggaagacuaga

SEQ ID NO: 497824 - RNA, 23 nt, Homo sapiens
gaaaaguguguauauauuuugug

SEQ ID NO: 497825 - RNA, 16 nt, Homo sapiens
gaaaguaacugugaga

SEQ ID NO: 497826 - RNA, 18 nt, Homo sapiens
gaaauugcauacuuugua

SEQ ID NO: 497827 - RNA, 19 nt, Homo sapiens
gaacagcaauggugucagu

SEQ ID NO: 497828 - RNA, 22 nt, Homo sapiens
gaaccuguccuaaggaaccuuc

SEQ ID NO: 497829 - RNA, 15 nt, Homo sapiens
gaacuucccuuaaga

SEQ ID NO: 497830 - RNA, 14 nt, Homo sapiens
gaagaggaagcaag

SEQ ID NO: 497831 - RNA, 16 nt, Homo sapiens
gaagcuggccugagag

SEQ ID NO: 497832 - RNA, 15 nt, Homo sapiens
gaagcugggagcuac

SEQ ID NO: 497833 - RNA, 22 nt, Homo sapiens
gaaggaacagcaauggugucag

SEQ ID NO: 497834 - RNA, 17 nt, Homo sapiens
gaaggacacuagccugu

SEQ ID NO: 497835 - RNA, 19 nt, Homo sapiens
gaaggagaaguaagaggcu

SEQ ID NO: 497836 - RNA, 16 nt, Homo sapiens
gaaugaauacugggaa

SEQ ID NO: 497837 - RNA, 24 nt, Homo sapiens
gaaugcuuaccaaguccugggaau

SEQ ID NO: 497838 - RNA, 20 nt, Homo sapiens
gaauggguguuguaugggga

SEQ ID NO: 497839 - RNA, 20 nt, Homo sapiens
gacaagcaagggcugugcug

SEQ ID NO: 497840 - RNA, 21 nt, Homo sapiens
gacaagcaagggcugugcuga

SEQ ID NO: 497841 - RNA, 18 nt, Homo sapiens
gacacuagccugugcacg

SEQ ID NO: 497842 - RNA, 18 nt, Homo sapiens
gaccaaagccaccaagac

SEQ ID NO: 497843 - RNA, 15 nt, Homo sapiens
gaccacuuccagggg

SEQ ID NO: 497844 - RNA, 16 nt, Homo sapiens
gaccugaccggcaccu

SEQ ID NO: 497845 - RNA, 18 nt, Homo sapiens
gacucagcggucauucua

SEQ ID NO: 497846 - RNA, 20 nt, Homo sapiens
gacuccugucuguccuggag

SEQ ID NO: 497847 - RNA, 19 nt, Homo sapiens
gacuuccgagcuaugucag

SEQ ID NO: 497848 - RNA, 16 nt, Homo sapiens
gagacucuagggucca

SEQ ID NO: 497849 - RNA, 19 nt, Homo sapiens
gagagaggcucagccacac

SEQ ID NO: 497850 - RNA, 23 nt, Homo sapiens
gagcaacaguuaugggacacuga

SEQ ID NO: 497851 - RNA, 19 nt, Homo sapiens
gagccaaacacacuguaaa

SEQ ID NO: 497852 - RNA, 14 nt, Homo sapiens
gagcucagccgugc

SEQ ID NO: 497853 - RNA, 18 nt, Homo sapiens
gagcucagccgugcacuc

SEQ ID NO: 497854 - RNA, 15 nt, Homo sapiens
gagcugaagcuggga

SEQ ID NO: 497855 - RNA, 21 nt, Homo sapiens
gaggcgcagcccgaagcccag

SEQ ID NO: 497856 - RNA, 20 nt, Homo sapiens
gagggaauuugaagaaagga

SEQ ID NO: 497857 - RNA, 15 nt, Homo sapiens
gagggagaagcauga

SEQ ID NO: 497858 - RNA, 20 nt, Homo sapiens
gagggcucacucggcuucca

SEQ ID NO: 497859 - RNA, 13 nt, Homo sapiens
gagucaugcacuc

SEQ ID NO: 497860 - RNA, 21 nt, Homo sapiens
gauaacccauacuacccucau

SEQ ID NO: 497861 - RNA, 13 nt, Homo sapiens
gauaagucuuuca

SEQ ID NO: 497862 - RNA, 18 nt, Homo sapiens
gaucucacacaccagggc

SEQ ID NO: 497863 - RNA, 22 nt, Homo sapiens
gaucuccacaccaaagucaggg

SEQ ID NO: 497864 - RNA, 14 nt, Homo sapiens
gaugacugccuugc

SEQ ID NO: 497865 - RNA, 18 nt, Homo sapiens
gaugacugccuugccucc

SEQ ID NO: 497866 - RNA, 23 nt, Homo sapiens
gaugucaaggacuccugucuguc

SEQ ID NO: 497867 - RNA, 14 nt, Homo sapiens
gauucuuuguuaca

SEQ ID NO: 497868 - RNA, 21 nt, Homo sapiens
gauugagugcuccugugugcu

SEQ ID NO: 497869 - RNA, 23 nt, Homo sapiens
gcaaaacaaggacuagagcucag

SEQ ID NO: 497870 - RNA, 13 nt, Homo sapiens
gcaaauguuaaaa

SEQ ID NO: 497871 - RNA, 16 nt, Homo sapiens
gcaacccucacugugu

SEQ ID NO: 497872 - RNA, 17 nt, Homo sapiens
gcaacccucacuguguu

SEQ ID NO: 497873 - RNA, 22 nt, Homo sapiens
gcaagggcugugcugaggucac

SEQ ID NO: 497874 - RNA, 23 nt, Homo sapiens
gcaauggugucaguauccaggcu

SEQ ID NO: 497875 - RNA, 11 nt, Homo sapiens
gcacaccucau

SEQ ID NO: 497876 - RNA, 21 nt, Homo sapiens
gcacauuuaaggcgccauugc

SEQ ID NO: 497877 - RNA, 16 nt, Homo sapiens
gcacugugagcaccug

SEQ ID NO: 497878 - RNA, 12 nt, Homo sapiens
gcagaagcccug

SEQ ID NO: 497879 - RNA, 16 nt, Homo sapiens
gcagaagcccugaugu

SEQ ID NO: 497880 - RNA, 12 nt, Homo sapiens
gcagacagcagg

SEQ ID NO: 497881 - RNA, 21 nt, Homo sapiens
gcagauugaaaaggacaccuu

SEQ ID NO: 497882 - RNA, 14 nt, Homo sapiens
gcagccuucugaca

SEQ ID NO: 497883 - RNA, 22 nt, Homo sapiens
gcagcugucauggaaaagccca

SEQ ID NO: 497884 - RNA, 21 nt, Homo sapiens
gcaggcaaacgggucgugaug

SEQ ID NO: 497885 - RNA, 19 nt, Homo sapiens
gcaguauugccacaaugcc

SEQ ID NO: 497886 - RNA, 20 nt, Homo sapiens
gcagucuuggcucacuacag

SEQ ID NO: 497887 - RNA, 17 nt, Homo sapiens
gcauccugugugcugac

SEQ ID NO: 497888 - RNA, 18 nt, Homo sapiens
gcauccugugugcugaca

SEQ ID NO: 497889 - RNA, 18 nt, Homo sapiens
gcauggauggguccucac

SEQ ID NO: 497890 - RNA, 18 nt, Homo sapiens
gcauuuguuccaugccug

SEQ ID NO: 497891 - RNA, 21 nt, Homo sapiens
gccaaacaaaggcccagcagc

SEQ ID NO: 497892 - RNA, 17 nt, Homo sapiens
gccaaacacacuguaaa

SEQ ID NO: 497893 - RNA, 17 nt, Homo sapiens
gccagugccagcaccug

SEQ ID NO: 497894 - RNA, 12 nt, Homo sapiens
gcccacagccaa

SEQ ID NO: 497895 - RNA, 20 nt, Homo sapiens
gcccagaaagaggcagugau

SEQ ID NO: 497896 - RNA, 15 nt, Homo sapiens
gcccagugaccugac

SEQ ID NO: 497897 - RNA, 20 nt, Homo sapiens
gccccauccaacacuggaug

SEQ ID NO: 497898 - RNA, 11 nt, Homo sapiens
gcccucuggga

SEQ ID NO: 497899 - RNA, 20 nt, Homo sapiens
gcccugauguguccucaggg

SEQ ID NO: 497900 - RNA, 16 nt, Homo sapiens
gcccuuuccuuccaga

SEQ ID NO: 497901 - RNA, 14 nt, Homo sapiens
gccgcauggcacuc

SEQ ID NO: 497902 - RNA, 15 nt, Homo sapiens
gccguacugucuaug

SEQ ID NO: 497903 - RNA, 15 nt, Homo sapiens
gccuggaagccaaac

SEQ ID NO: 497904 - RNA, 15 nt, Homo sapiens
gccuggcccuggaac

SEQ ID NO: 497905 - RNA, 21 nt, Homo sapiens
gccuggggcgagcacugugag

SEQ ID NO: 497906 - RNA, 21 nt, Homo sapiens
gccuggguugcugcuguccag

SEQ ID NO: 497907 - RNA, 23 nt, Homo sapiens
gccuuuggggacggccacucugu

SEQ ID NO: 497908 - RNA, 21 nt, Homo sapiens
gcgcaacaacaaggacccugu

SEQ ID NO: 497909 - RNA, 20 nt, Homo sapiens
gcgcagcccgaagcccaguu

SEQ ID NO: 497910 - RNA, 14 nt, Homo sapiens
gcgcgugcacacac

SEQ ID NO: 497911 - RNA, 19 nt, Homo sapiens
gcguccugcccucugggag

SEQ ID NO: 497912 - RNA, 19 nt, Homo sapiens
gcuaaacaagggcagugag

SEQ ID NO: 497913 - RNA, 16 nt, Homo sapiens
gcuaacuccagucucc

SEQ ID NO: 497914 - RNA, 14 nt, Homo sapiens
gcuacgaccugguc

SEQ ID NO: 497915 - RNA, 20 nt, Homo sapiens
gcuagugccugagaugcacg

SEQ ID NO: 497916 - RNA, 20 nt, Homo sapiens
gcuauugaacugagccaaac

SEQ ID NO: 497917 - RNA, 22 nt, Homo sapiens
gcucuugcucagugaagaggaa

SEQ ID NO: 497918 - RNA, 16 nt, Homo sapiens
gcuggagcccagcauu

SEQ ID NO: 497919 - RNA, 20 nt, Homo sapiens
gcuggcaccucagacaaucc

SEQ ID NO: 497920 - RNA, 13 nt, Homo sapiens
gcuggcacugagc

SEQ ID NO: 497921 - RNA, 15 nt, Homo sapiens
gcuggcaucaagagg

SEQ ID NO: 497922 - RNA, 14 nt, Homo sapiens
gcuggccgcggugg

SEQ ID NO: 497923 - RNA, 13 nt, Homo sapiens
gcuggguggugua

SEQ ID NO: 497924 - RNA, 22 nt, Homo sapiens
gcugucagcccaugugcaccug

SEQ ID NO: 497925 - RNA, 16 nt, Homo sapiens
gcugugcuagugccug

SEQ ID NO: 497926 - RNA, 17 nt, Homo sapiens
gcuguuugauagcagaa

SEQ ID NO: 497927 - RNA, 18 nt, Homo sapiens
gcuuccagggagcccuuu

SEQ ID NO: 497928 - RNA, 21 nt, Homo sapiens
gcuuccgugugucaucagggu

SEQ ID NO: 497929 - RNA, 14 nt, Homo sapiens
gcuucugcacacaa

SEQ ID NO: 497930 - RNA, 19 nt, Homo sapiens
gcuuuaauuuucacucugg

SEQ ID NO: 497931 - RNA, 22 nt, Homo sapiens
ggaaaaaacaccaggauuuaag

SEQ ID NO: 497932 - RNA, 14 nt, Homo sapiens
ggaaaauucuuaaa

SEQ ID NO: 497933 - RNA, 21 nt, Homo sapiens
ggaagaggaacagcacugggg

SEQ ID NO: 497934 - RNA, 13 nt, Homo sapiens
ggacuccugucug

SEQ ID NO: 497935 - RNA, 12 nt, Homo sapiens
ggagacuggaaa

SEQ ID NO: 497936 - RNA, 20 nt, Homo sapiens
ggagagaggcucagccacac

SEQ ID NO: 497937 - RNA, 19 nt, Homo sapiens
ggaugccacagcccagcuu

SEQ ID NO: 497938 - RNA, 21 nt, Homo sapiens
ggauggaauccuacagccucc

SEQ ID NO: 497939 - RNA, 17 nt, Homo sapiens
ggauggguccucacgca

SEQ ID NO: 497940 - RNA, 16 nt, Homo sapiens
ggcaacccucacugug

SEQ ID NO: 497941 - RNA, 18 nt, Homo sapiens
ggcaacccucacuguguu

SEQ ID NO: 497942 - RNA, 17 nt, Homo sapiens
ggcacauggcuggcacu

SEQ ID NO: 497943 - RNA, 14 nt, Homo sapiens
ggcagcaucuucac

SEQ ID NO: 497944 - RNA, 17 nt, Homo sapiens
ggcauacagacugggga

SEQ ID NO: 497945 - RNA, 13 nt, Homo sapiens
ggcauccugugug

SEQ ID NO: 497946 - RNA, 18 nt, Homo sapiens
ggccauaaagaucaaaca

SEQ ID NO: 497947 - RNA, 16 nt, Homo sapiens
ggccuugcuaccucaa

SEQ ID NO: 497948 - RNA, 21 nt, Homo sapiens
ggcgagcacugugagcaccug

SEQ ID NO: 497949 - RNA, 15 nt, Homo sapiens
ggcgcaggugcacag

SEQ ID NO: 497950 - RNA, 19 nt, Homo sapiens
ggcuaaacaagggcaguga

SEQ ID NO: 497951 - RNA, 20 nt, Homo sapiens
ggcuaaacaagggcagugag

SEQ ID NO: 497952 - RNA, 22 nt, Homo sapiens
ggcuaccucaagacucaccuca

SEQ ID NO: 497953 - RNA, 13 nt, Homo sapiens
ggcugcugacuca

SEQ ID NO: 497954 - RNA, 13 nt, Homo sapiens
ggcugucagccca

SEQ ID NO: 497955 - RNA, 14 nt, Homo sapiens
ggcuucucuuucuc

SEQ ID NO: 497956 - RNA, 14 nt, Homo sapiens
gggagcuacagggg

SEQ ID NO: 497957 - RNA, 15 nt, Homo sapiens
ggggacugucuuuca

SEQ ID NO: 497958 - RNA, 18 nt, Homo sapiens
ggggcgagcacugugagc

SEQ ID NO: 497959 - RNA, 14 nt, Homo sapiens
ggggcuacugugac

SEQ ID NO: 497960 - RNA, 16 nt, Homo sapiens
gggucuguguggugcc

SEQ ID NO: 497961 - RNA, 15 nt, Homo sapiens
ggucagucacuugaa

SEQ ID NO: 497962 - RNA, 14 nt, Homo sapiens
gguccuucauucuu

SEQ ID NO: 497963 - RNA, 13 nt, Homo sapiens
ggucuucuuacau

SEQ ID NO: 497964 - RNA, 22 nt, Homo sapiens
ggugaaacuaacagauaagcaa

SEQ ID NO: 497965 - RNA, 18 nt, Homo sapiens
gguggcauacagacuggg

SEQ ID NO: 497966 - RNA, 21 nt, Homo sapiens
ggugucaguauccaggcuuug

SEQ ID NO: 497967 - RNA, 18 nt, Homo sapiens
guaaaaggauaguaagca

SEQ ID NO: 497968 - RNA, 18 nt, Homo sapiens
guaagguuauaacugugg

SEQ ID NO: 497969 - RNA, 16 nt, Homo sapiens
guaauuaagugcaauu

SEQ ID NO: 497970 - RNA, 15 nt, Homo sapiens
guacagauucuuuca

SEQ ID NO: 497971 - RNA, 19 nt, Homo sapiens
guacaucaaugauaaugcu

SEQ ID NO: 497972 - RNA, 18 nt, Homo sapiens
guacugaaagccuuaggg

SEQ ID NO: 497973 - RNA, 16 nt, Homo sapiens
guauaaauauacagua

SEQ ID NO: 497974 - RNA, 13 nt, Homo sapiens
guauugccacaau

SEQ ID NO: 497975 - RNA, 17 nt, Homo sapiens
guauuuaggcagauuga

SEQ ID NO: 497976 - RNA, 15 nt, Homo sapiens
gucaaggacuccugu

SEQ ID NO: 497977 - RNA, 19 nt, Homo sapiens
gucacuaaccaagccagaa

SEQ ID NO: 497978 - RNA, 21 nt, Homo sapiens
gucacuaaccaagccagaaac

SEQ ID NO: 497979 - RNA, 21 nt, Homo sapiens
aaaaacacccgacgucaugua

SEQ ID NO: 497980 - RNA, 13 nt, Homo sapiens
aaaacauguuaau

SEQ ID NO: 497981 - RNA, 13 nt, Homo sapiens
aaaacauuugcug

SEQ ID NO: 497982 - RNA, 21 nt, Homo sapiens
aaaacucucugguuuacuuca

SEQ ID NO: 497983 - RNA, 16 nt, Homo sapiens
aaaaugccuccauggc

SEQ ID NO: 497984 - RNA, 18 nt, Homo sapiens
aaaauuuuguauguuaaa

SEQ ID NO: 497985 - RNA, 14 nt, Homo sapiens
aaacacacuguaaa

SEQ ID NO: 497986 - RNA, 16 nt, Homo sapiens
aaacacagccugugua

SEQ ID NO: 497987 - RNA, 21 nt, Homo sapiens
aaacacccgacgucauguauu

SEQ ID NO: 497988 - RNA, 20 nt, Homo sapiens
aaacucucugguuuacuuca

SEQ ID NO: 497989 - RNA, 14 nt, Homo sapiens
aaaggaagacuaga

SEQ ID NO: 497990 - RNA, 21 nt, Homo sapiens
aaaggacaccuuuuaacucac

SEQ ID NO: 497991 - RNA, 13 nt, Homo sapiens
aaaggagugaaug

SEQ ID NO: 497992 - RNA, 21 nt, Homo sapiens
aaagggaaggugacugaaggc

SEQ ID NO: 497993 - RNA, 19 nt, Homo sapiens
aaauaaaauuuuuauguaa

SEQ ID NO: 497994 - RNA, 19 nt, Homo sapiens
aaauauccacagacucccu

SEQ ID NO: 497995 - RNA, 14 nt, Homo sapiens
aaauuuguccaaug

SEQ ID NO: 497996 - RNA, 19 nt, Homo sapiens
aacaaaagcgacccauuca

SEQ ID NO: 497997 - RNA, 15 nt, Homo sapiens
aacagauaagcaaga

SEQ ID NO: 497998 - RNA, 22 nt, Homo sapiens
aacauccuaagugggaagugaa

SEQ ID NO: 497999 - RNA, 23 nt, Homo sapiens
aacauguaauaaaaaguauaugu

SEQ ID NO: 498000 - RNA, 21 nt, Homo sapiens
acaauauuccagaucuuucag

SEQ ID NO: 498001 - RNA, 12 nt, Homo sapiens
acaaugccucuc

SEQ ID NO: 498002 - RNA, 15 nt, Homo sapiens
acacagagcaauggu

SEQ ID NO: 498003 - RNA, 20 nt, Homo sapiens
acaccaggauuuaaguuuca

SEQ ID NO: 498004 - RNA, 23 nt, Homo sapiens
acacggccuggggcgagcacugu

SEQ ID NO: 498005 - RNA, 19 nt, Homo sapiens
acacucaucuuagugccug

SEQ ID NO: 498006 - RNA, 14 nt, Homo sapiens
acagauucuuucag

SEQ ID NO: 498007 - RNA, 16 nt, Homo sapiens
acagcacuggggaguc

SEQ ID NO: 498008 - RNA, 24 nt, Homo sapiens
acagggcucccgagucaugcacuc

SEQ ID NO: 498009 - RNA, 20 nt, Homo sapiens
acagggucuaccucugucac

SEQ ID NO: 498010 - RNA, 13 nt, Homo sapiens
acaguugugagau

SEQ ID NO: 498011 - RNA, 20 nt, Homo sapiens
acaguugugagauugugccc

SEQ ID NO: 498012 - RNA, 15 nt, Homo sapiens
acaugccagcuuccu

SEQ ID NO: 498013 - RNA, 21 nt, Homo sapiens
acauguuaaugacaauauucc

SEQ ID NO: 498014 - RNA, 16 nt, Homo sapiens
acauuucuucuaguga

SEQ ID NO: 498015 - RNA, 17 nt, Homo sapiens
acauuuuuuugcaugca

SEQ ID NO: 498016 - RNA, 14 nt, Homo sapiens
accaaguccuggga

SEQ ID NO: 498017 - RNA, 23 nt, Homo sapiens
accacuagaaagugggcuuaaug

SEQ ID NO: 498018 - RNA, 21 nt, Homo sapiens
accauuuuuuaauuuacuugu

SEQ ID NO: 498019 - RNA, 21 nt, Homo sapiens
accuaauguuuaugagccaga

SEQ ID NO: 498020 - RNA, 21 nt, Homo sapiens
accucaugcugagcgcugugu

SEQ ID NO: 498021 - RNA, 13 nt, Homo sapiens
accuccucauggc

SEQ ID NO: 498022 - RNA, 13 nt, Homo sapiens
accugccaugcca

SEQ ID NO: 498023 - RNA, 16 nt, Homo sapiens
acgcgcgcgugcacac

SEQ ID NO: 498024 - RNA, 18 nt, Homo sapiens
acgcugaaggcuuacuuc

SEQ ID NO: 498025 - RNA, 21 nt, Homo sapiens
acggagcugaagcugggagcu

SEQ ID NO: 498026 - RNA, 17 nt, Homo sapiens
acuaaacauguauguaa

SEQ ID NO: 498027 - RNA, 17 nt, Homo sapiens
acuaacagauaagcaag

SEQ ID NO: 498028 - RNA, 16 nt, Homo sapiens
acuagccugugcacgc

SEQ ID NO: 498029 - RNA, 17 nt, Homo sapiens
acuauaaacuacuguaa

SEQ ID NO: 498030 - RNA, 18 nt, Homo sapiens
acuauaaacuacuguaau

SEQ ID NO: 498031 - RNA, 13 nt, Homo sapiens
acuauaccuuauc

SEQ ID NO: 498032 - RNA, 15 nt, Homo sapiens
acucaagucuggauc

SEQ ID NO: 498033 - RNA, 19 nt, Homo sapiens
acuccggccaccuccucca

SEQ ID NO: 498034 - RNA, 13 nt, Homo sapiens
acuccucugacug

SEQ ID NO: 498035 - RNA, 15 nt, Homo sapiens
acucuaggguccagu

SEQ ID NO: 498036 - RNA, 18 nt, Homo sapiens
acucuaggguccagugga

SEQ ID NO: 498037 - RNA, 18 nt, Homo sapiens
acucucugguuuacuuca

SEQ ID NO: 498038 - RNA, 16 nt, Homo sapiens
acucuucccaccucag

SEQ ID NO: 498039 - RNA, 21 nt, Homo sapiens
acugagccaaacacacuguaa

SEQ ID NO: 498040 - RNA, 19 nt, Homo sapiens
acugaugcgaaaacuugaa

SEQ ID NO: 498041 - RNA, 20 nt, Homo sapiens
acugaugcgaaaacuugaau

SEQ ID NO: 498042 - RNA, 13 nt, Homo sapiens
acuggcagcaucu

SEQ ID NO: 498043 - RNA, 16 nt, Homo sapiens
acuguaaacuucugca

SEQ ID NO: 498044 - RNA, 12 nt, Homo sapiens
acugucgagucc

SEQ ID NO: 498045 - RNA, 15 nt, Homo sapiens
acugucgagucccca

SEQ ID NO: 498046 - RNA, 18 nt, Homo sapiens
acugucuauguugugauc

SEQ ID NO: 498047 - RNA, 19 nt, Homo sapiens
acuucaugaaauccugggu

SEQ ID NO: 498048 - RNA, 15 nt, Homo sapiens
acuucccuuaagagu

SEQ ID NO: 498049 - RNA, 12 nt, Homo sapiens
acuucucugagu

SEQ ID NO: 498050 - RNA, 23 nt, Homo sapiens
acuucugcaacaagcaugcagcu

SEQ ID NO: 498051 - RNA, 19 nt, Homo sapiens
agaaaaaguugcagucuca

SEQ ID NO: 498052 - RNA, 17 nt, Homo sapiens
agaaaacacagccugug

SEQ ID NO: 498053 - RNA, 21 nt, Homo sapiens
agaaugccucugcugugggcu

SEQ ID NO: 498054 - RNA, 16 nt, Homo sapiens
agacaauccacucuca

SEQ ID NO: 498055 - RNA, 14 nt, Homo sapiens
agacaugaaccaag

SEQ ID NO: 498056 - RNA, 18 nt, Homo sapiens
agacgugcgcgaugugac

SEQ ID NO: 498057 - RNA, 12 nt, Homo sapiens
agacucaccuca

SEQ ID NO: 498058 - RNA, 18 nt, Homo sapiens
agacucugggcugucagc

SEQ ID NO: 498059 - RNA, 17 nt, Homo sapiens
agacuggggacccugga

SEQ ID NO: 498060 - RNA, 21 nt, Homo sapiens
agacuuguguccccaccucag

SEQ ID NO: 498061 - RNA, 17 nt, Homo sapiens
agagaauaaaaaaugua

SEQ ID NO: 498062 - RNA, 18 nt, Homo sapiens
agagcaaugguagcaaaa

SEQ ID NO: 498063 - RNA, 14 nt, Homo sapiens
agaggaaaaugccu

SEQ ID NO: 498064 - RNA, 13 nt, Homo sapiens
agaggaacagcac

SEQ ID NO: 498065 - RNA, 16 nt, Homo sapiens
agaggaacagcacugg

SEQ ID NO: 498066 - RNA, 16 nt, Homo sapiens
agaggagagaggcuca

SEQ ID NO: 498067 - RNA, 17 nt, Homo sapiens
agaggagagaggcucag

SEQ ID NO: 498068 - RNA, 11 nt, Homo sapiens
agaggcucagc

SEQ ID NO: 498069 - RNA, 21 nt, Homo sapiens
agauauguauucuuuucucag

SEQ ID NO: 498070 - RNA, 16 nt, Homo sapiens
agauccuggguacuga

SEQ ID NO: 498071 - RNA, 13 nt, Homo sapiens
agauugugcccag

SEQ ID NO: 498072 - RNA, 19 nt, Homo sapiens
agcaaaaugcuucugcaca

SEQ ID NO: 498073 - RNA, 15 nt, Homo sapiens
agcaccggccucggg

SEQ ID NO: 498074 - RNA, 11 nt, Homo sapiens
agcacugugag

SEQ ID NO: 498075 - RNA, 18 nt, Homo sapiens
agcagccaguucaaaaac

SEQ ID NO: 498076 - RNA, 15 nt, Homo sapiens
agcauagaaaccacu

SEQ ID NO: 498077 - RNA, 14 nt, Homo sapiens
agccaaacacuguu

SEQ ID NO: 498078 - RNA, 19 nt, Homo sapiens
aaaaaacaccaggauuuaa

SEQ ID NO: 498079 - RNA, 15 nt, Homo sapiens
aaaacucugcaugua

SEQ ID NO: 498080 - RNA, 16 nt, Homo sapiens
aaaagcgacccauuca

SEQ ID NO: 498081 - RNA, 20 nt, Homo sapiens
aaaagcgacccauucagaga

SEQ ID NO: 498082 - RNA, 18 nt, Homo sapiens
aaaaugcuucugcacaca

SEQ ID NO: 498083 - RNA, 22 nt, Homo sapiens
aaacacuguuucuaacucaggg

SEQ ID NO: 498084 - RNA, 19 nt, Homo sapiens
aaacauguuaaugacaaua

SEQ ID NO: 498085 - RNA, 22 nt, Homo sapiens
aaagcacuccugcuuaaucuuc

SEQ ID NO: 498086 - RNA, 18 nt, Homo sapiens
aaagguauuauacaugug

SEQ ID NO: 498087 - RNA, 20 nt, Homo sapiens
aaaugcauauccugagccau

SEQ ID NO: 498088 - RNA, 16 nt, Homo sapiens
aaaugccuccauggca

SEQ ID NO: 498089 - RNA, 15 nt, Homo sapiens
aaaugcuucugcaca

SEQ ID NO: 498090 - RNA, 17 nt, Homo sapiens
aaaugcuucugcacaca

SEQ ID NO: 498091 - RNA, 23 nt, Homo sapiens
aaauggagaaauaggaccuucca

SEQ ID NO: 498092 - RNA, 16 nt, Homo sapiens
aaauggaggaauauga

SEQ ID NO: 498093 - RNA, 18 nt, Homo sapiens
aaauguauaaauauacag

SEQ ID NO: 498094 - RNA, 22 nt, Homo sapiens
aaauuuguccaauggcuguaaa

SEQ ID NO: 498095 - RNA, 14 nt, Homo sapiens
aacaagggcaguga

SEQ ID NO: 498096 - RNA, 16 nt, Homo sapiens
aacaagggcagugaga

SEQ ID NO: 498097 - RNA, 12 nt, Homo sapiens
aacacacuguaa

SEQ ID NO: 498098 - RNA, 21 nt, Homo sapiens
aacacagcauguguauuucca

SEQ ID NO: 498099 - RNA, 21 nt, Homo sapiens
aacaccaggauuuaaguuuca

SEQ ID NO: 498100 - RNA, 16 nt, Homo sapiens
aacauuugcugccauu

SEQ ID NO: 498101 - RNA, 18 nt, Homo sapiens
aacauuugcugccauuac

SEQ ID NO: 498102 - RNA, 14 nt, Homo sapiens
aaccacacuugaaa

SEQ ID NO: 498103 - RNA, 23 nt, Homo sapiens
aaccuaguacugccccccaugag

SEQ ID NO: 498104 - RNA, 18 nt, Homo sapiens
aaccugccaugccaggaa

SEQ ID NO: 498105 - RNA, 23 nt, Homo sapiens
aaccuguccuaaggaaccuuccu

SEQ ID NO: 498106 - RNA, 20 nt, Homo sapiens
aacucaaauacacauuugcu

SEQ ID NO: 498107 - RNA, 20 nt, Homo sapiens
aacucucugguuuacuucaa

SEQ ID NO: 498108 - RNA, 20 nt, Homo sapiens
aacuucaguccaacugucaa

SEQ ID NO: 498109 - RNA, 20 nt, Homo sapiens
aagaaaaaguugcagucuca

SEQ ID NO: 498110 - RNA, 14 nt, Homo sapiens
aagacuauaccuua

SEQ ID NO: 498111 - RNA, 22 nt, Homo sapiens
aagacuuguguccccaccucag

SEQ ID NO: 498112 - RNA, 14 nt, Homo sapiens
aagaggaacagcac

SEQ ID NO: 498113 - RNA, 13 nt, Homo sapiens
aagcaguccuccu

SEQ ID NO: 498114 - RNA, 20 nt, Homo sapiens
aaggacaccuuuuaacucac

SEQ ID NO: 498115 - RNA, 16 nt, Homo sapiens
aaggacuagagcucag

SEQ ID NO: 498116 - RNA, 18 nt, Homo sapiens
aagugaagccccuugucc

SEQ ID NO: 498117 - RNA, 13 nt, Homo sapiens
aagugaucugucc

SEQ ID NO: 498118 - RNA, 24 nt, Homo sapiens
aagugcaauuuccccucugugucc

SEQ ID NO: 498119 - RNA, 23 nt, Homo sapiens
aagugcugggauuacaguuguga

SEQ ID NO: 498120 - RNA, 22 nt, Homo sapiens
aaguugcagucucagaaagccu

SEQ ID NO: 498121 - RNA, 14 nt, Homo sapiens
aaguuuuacugucu

SEQ ID NO: 498122 - RNA, 18 nt, Homo sapiens
aauauggguugcauuugg

SEQ ID NO: 498123 - RNA, 15 nt, Homo sapiens
aaugcuucugcacac

SEQ ID NO: 498124 - RNA, 18 nt, Homo sapiens
aauggaugugcucacugg

SEQ ID NO: 498125 - RNA, 16 nt, Homo sapiens
acucuaauagugcuua

SEQ ID NO: 498126 - RNA, 22 nt, Homo sapiens
acugaauauuaucaguggcugc

SEQ ID NO: 498127 - RNA, 17 nt, Homo sapiens
acugcuacaaucaaggc

SEQ ID NO: 498128 - RNA, 20 nt, Homo sapiens
acugcuucccuuacuuugcu

SEQ ID NO: 498129 - RNA, 22 nt, Homo sapiens
acuggcuucucuuucucugagu

SEQ ID NO: 498130 - RNA, 14 nt, Homo sapiens
acugggaaucaaga

SEQ ID NO: 498131 - RNA, 20 nt, Homo sapiens
acuggggagucuuuguggau

SEQ ID NO: 498132 - RNA, 20 nt, Homo sapiens
acuggggucuguguggugcc

SEQ ID NO: 498133 - RNA, 17 nt, Homo sapiens
acuguaaauauccacag

SEQ ID NO: 498134 - RNA, 20 nt, Homo sapiens
acuuccaggggaaccugcca

SEQ ID NO: 498135 - RNA, 16 nt, Homo sapiens
acuucugcuggcauca

SEQ ID NO: 498136 - RNA, 12 nt, Homo sapiens
agaaaacacagc

SEQ ID NO: 498137 - RNA, 16 nt, Homo sapiens
agaaacguaacugugu

SEQ ID NO: 498138 - RNA, 14 nt, Homo sapiens
agaaagaggcagug

SEQ ID NO: 498139 - RNA, 17 nt, Homo sapiens
agaaagaggcagugauu

SEQ ID NO: 498140 - RNA, 13 nt, Homo sapiens
agaaaggccugag

SEQ ID NO: 498141 - RNA, 22 nt, Homo sapiens
agaaauaggaccuuccacacag

SEQ ID NO: 498142 - RNA, 21 nt, Homo sapiens
agaagaaaaaguugcagucuc

SEQ ID NO: 498143 - RNA, 17 nt, Homo sapiens
agaagccccuaggcaaa

SEQ ID NO: 498144 - RNA, 22 nt, Homo sapiens
agaaggacacuagccugugcac

SEQ ID NO: 498145 - RNA, 14 nt, Homo sapiens
agaagucaacgccu

SEQ ID NO: 498146 - RNA, 15 nt, Homo sapiens
agaagucaacgccuc

SEQ ID NO: 498147 - RNA, 16 nt, Homo sapiens
agaauggaugugcuca

SEQ ID NO: 498148 - RNA, 19 nt, Homo sapiens
agacaauccacucucagga

SEQ ID NO: 498149 - RNA, 12 nt, Homo sapiens
agacaauggcca

SEQ ID NO: 498150 - RNA, 20 nt, Homo sapiens
agacuggggacccuggacau

SEQ ID NO: 498151 - RNA, 19 nt, Homo sapiens
agacugucccugaaaccua

SEQ ID NO: 498152 - RNA, 12 nt, Homo sapiens
agagacaggguc

SEQ ID NO: 498153 - RNA, 16 nt, Homo sapiens
agagacugucccugaa

SEQ ID NO: 498154 - RNA, 15 nt, Homo sapiens
agagccgcauggcac

SEQ ID NO: 498155 - RNA, 13 nt, Homo sapiens
agaggcagugauu

SEQ ID NO: 498156 - RNA, 13 nt, Homo sapiens
agagguggcugcu

SEQ ID NO: 498157 - RNA, 20 nt, Homo sapiens
agagguggcugcugugcuag

SEQ ID NO: 498158 - RNA, 16 nt, Homo sapiens
agagugcaguggugca

SEQ ID NO: 498159 - RNA, 21 nt, Homo sapiens
agauacaugguugugaccuga

SEQ ID NO: 498160 - RNA, 19 nt, Homo sapiens
agauguuuuggggacucau

SEQ ID NO: 498161 - RNA, 20 nt, Homo sapiens
agauugacuaacucaaauac

SEQ ID NO: 498162 - RNA, 22 nt, Homo sapiens
agauuuugaaugcuuccugaca

SEQ ID NO: 498163 - RNA, 17 nt, Homo sapiens
agcaaaaugcuucugca

SEQ ID NO: 498164 - RNA, 12 nt, Homo sapiens
agcacaccucau

SEQ ID NO: 498165 - RNA, 17 nt, Homo sapiens
agcacuggggagucuuu

SEQ ID NO: 498166 - RNA, 18 nt, Homo sapiens
agcauaccuuggacugac

SEQ ID NO: 498167 - RNA, 20 nt, Homo sapiens
agcauagaaaccacuagaaa

SEQ ID NO: 498168 - RNA, 15 nt, Homo sapiens
agcauguguauuucc

SEQ ID NO: 498169 - RNA, 14 nt, Homo sapiens
agcccaugugcacc

SEQ ID NO: 498170 - RNA, 14 nt, Homo sapiens
agcccgaagcccag

SEQ ID NO: 498171 - RNA, 15 nt, Homo sapiens
agcccugaacgugag

SEQ ID NO: 498172 - RNA, 16 nt, Homo sapiens
agccgcauggcacucu

SEQ ID NO: 498173 - RNA, 23 nt, Homo sapiens
agccuuccagggauuugccucac

SEQ ID NO: 498174 - RNA, 12 nt, Homo sapiens
agcgcuguguua

SEQ ID NO: 498175 - RNA, 22 nt, Homo sapiens
agcggcccuaagggagugucua

SEQ ID NO: 498176 - RNA, 22 nt, Homo sapiens
agcggucauucuacacugagga

SEQ ID NO: 498177 - RNA, 15 nt, Homo sapiens
agcuaaagaggcuga

SEQ ID NO: 498178 - RNA, 14 nt, Homo sapiens
agcuaagauauaau

SEQ ID NO: 498179 - RNA, 14 nt, Homo sapiens
agcuaccagguguu

SEQ ID NO: 498180 - RNA, 16 nt, Homo sapiens
agcuacuaaugauguu

SEQ ID NO: 498181 - RNA, 16 nt, Homo sapiens
agcugaagaauugaaa

SEQ ID NO: 498182 - RNA, 15 nt, Homo sapiens
aggaaagccaaacac

SEQ ID NO: 498183 - RNA, 16 nt, Homo sapiens
aggaaagccaaacacu

SEQ ID NO: 498184 - RNA, 21 nt, Homo sapiens
aggaaagccaaacacuguuuc

SEQ ID NO: 498185 - RNA, 16 nt, Homo sapiens
aggaacagcaauggug

SEQ ID NO: 498186 - RNA, 13 nt, Homo sapiens
aggaacagcacug

SEQ ID NO: 498187 - RNA, 15 nt, Homo sapiens
aggaacagcacuggg

SEQ ID NO: 498188 - RNA, 23 nt, Homo sapiens
aggagagaggcucagccacacag

SEQ ID NO: 498189 - RNA, 14 nt, Homo sapiens
aggcaaauggcaca

SEQ ID NO: 498190 - RNA, 14 nt, Homo sapiens
aggcagugagaugu

SEQ ID NO: 498191 - RNA, 18 nt, Homo sapiens
aggcauccugugugcuga

SEQ ID NO: 498192 - RNA, 19 nt, Homo sapiens
aggccagugccagcaccug

SEQ ID NO: 498193 - RNA, 22 nt, Homo sapiens
aggcccagaaagaggcagugau

SEQ ID NO: 498194 - RNA, 14 nt, Homo sapiens
aggccugagggcug

SEQ ID NO: 498195 - RNA, 16 nt, Homo sapiens
aggcgcaggugcacag

SEQ ID NO: 498196 - RNA, 19 nt, Homo sapiens
aggcugggauggagcacuu

SEQ ID NO: 498197 - RNA, 19 nt, Homo sapiens
aggcuuguuuaccuuucuc

SEQ ID NO: 498198 - RNA, 13 nt, Homo sapiens
agggagccuggaa

SEQ ID NO: 498199 - RNA, 20 nt, Homo sapiens
agggauauuuuuuucuauua

SEQ ID NO: 498200 - RNA, 14 nt, Homo sapiens
agggccucugggag

SEQ ID NO: 498201 - RNA, 20 nt, Homo sapiens
agggcucccgagucaugcac

SEQ ID NO: 498202 - RNA, 19 nt, Homo sapiens
agggcuggagggacaggga

SEQ ID NO: 498203 - RNA, 14 nt, Homo sapiens
aggggcuacuguga

SEQ ID NO: 498204 - RNA, 15 nt, Homo sapiens
agggggagaaugggu

SEQ ID NO: 498205 - RNA, 18 nt, Homo sapiens
agggggagaauggguguu

SEQ ID NO: 498206 - RNA, 14 nt, Homo sapiens
agggguccagccuc

SEQ ID NO: 498207 - RNA, 23 nt, Homo sapiens
agggucacuaaccaagccagaaa

SEQ ID NO: 498208 - RNA, 13 nt, Homo sapiens
aggguccagugga

SEQ ID NO: 498209 - RNA, 19 nt, Homo sapiens
agggucuucuuacaugcau

SEQ ID NO: 498210 - RNA, 23 nt, Homo sapiens
agggucuucuuacaugcauuuga

SEQ ID NO: 498211 - RNA, 21 nt, Homo sapiens
aggguucaagccuuccaggga

SEQ ID NO: 498212 - RNA, 18 nt, Homo sapiens
agguagaagugagcaaaa

SEQ ID NO: 498213 - RNA, 18 nt, Homo sapiens
aggucccugcuuaccuga

SEQ ID NO: 498214 - RNA, 11 nt, Homo sapiens
aggugcacagg

SEQ ID NO: 498215 - RNA, 19 nt, Homo sapiens
aggugggccuugcuaccuc

SEQ ID NO: 498216 - RNA, 13 nt, Homo sapiens
aguaccagugugc

SEQ ID NO: 498217 - RNA, 15 nt, Homo sapiens
aguagauccauuucc

SEQ ID NO: 498218 - RNA, 15 nt, Homo sapiens
aguauccaggcuuug

SEQ ID NO: 498219 - RNA, 16 nt, Homo sapiens
agucaacgccucggug

SEQ ID NO: 498220 - RNA, 24 nt, Homo sapiens
aguccugggaauaugcuagugaug

SEQ ID NO: 498221 - RNA, 16 nt, Homo sapiens
agugcuccugugugcu

SEQ ID NO: 498222 - RNA, 22 nt, Homo sapiens
agugggauuuccagaaccacac

SEQ ID NO: 498223 - RNA, 20 nt, Homo sapiens
aguggugcagucuuggcuca

SEQ ID NO: 498224 - RNA, 18 nt, Homo sapiens
auaaaacucugcauguag

SEQ ID NO: 498225 - RNA, 14 nt, Homo sapiens
auaaauauacagua

SEQ ID NO: 498226 - RNA, 11 nt, Homo sapiens
auaagcaagag

SEQ ID NO: 498227 - RNA, 19 nt, Homo sapiens
auaggaccuuccacacagg

SEQ ID NO: 498228 - RNA, 13 nt, Homo sapiens
auauauacuauau

SEQ ID NO: 498229 - RNA, 12 nt, Homo sapiens
auauccacagac

SEQ ID NO: 498230 - RNA, 13 nt, Homo sapiens
auccaacacugga

SEQ ID NO: 498231 - RNA, 16 nt, Homo sapiens
auccaggcuuuguaca

SEQ ID NO: 498232 - RNA, 22 nt, Homo sapiens
auccauaggcgcaggugcacag

SEQ ID NO: 498233 - RNA, 21 nt, Homo sapiens
auccuggguacugaaagccuu

SEQ ID NO: 498234 - RNA, 13 nt, Homo sapiens
auccugugugcug

SEQ ID NO: 498235 - RNA, 16 nt, Homo sapiens
aucuggcucaccgggu

SEQ ID NO: 498236 - RNA, 14 nt, Homo sapiens
aucuuagugccuga

SEQ ID NO: 498237 - RNA, 14 nt, Homo sapiens
aucuucaaagccuu

SEQ ID NO: 498238 - RNA, 22 nt, Homo sapiens
augaggaaggaacagcaauggu

SEQ ID NO: 498239 - RNA, 18 nt, Homo sapiens
auggagaaauaggaccuu

SEQ ID NO: 498240 - RNA, 15 nt, Homo sapiens
ggccauaaagaucaa

SEQ ID NO: 498241 - RNA, 19 nt, Homo sapiens
ggcccuaaguuaagcaaaa

SEQ ID NO: 498242 - RNA, 24 nt, Homo sapiens
ggccuaggcuaccucaagacucac

SEQ ID NO: 498243 - RNA, 15 nt, Homo sapiens
ggcgagcacugugag

SEQ ID NO: 498244 - RNA, 14 nt, Homo sapiens
ggcggccucuugcu

SEQ ID NO: 498245 - RNA, 17 nt, Homo sapiens
ggcugccaggauggcgu

SEQ ID NO: 498246 - RNA, 22 nt, Homo sapiens
ggcugucaggauucuucaagga

SEQ ID NO: 498247 - RNA, 14 nt, Homo sapiens
gggacagcauaccu

SEQ ID NO: 498248 - RNA, 13 nt, Homo sapiens
gggaccugugauc

SEQ ID NO: 498249 - RNA, 13 nt, Homo sapiens
gggccagugcugg

SEQ ID NO: 498250 - RNA, 11 nt, Homo sapiens
gggccucagug

SEQ ID NO: 498251 - RNA, 17 nt, Homo sapiens
gggcuacugugaccaug

SEQ ID NO: 498252 - RNA, 14 nt, Homo sapiens
ggggcgagcacugu

SEQ ID NO: 498253 - RNA, 17 nt, Homo sapiens
ggggcgagcacugugag

SEQ ID NO: 498254 - RNA, 17 nt, Homo sapiens
guaacaugccagcuucc

SEQ ID NO: 498255 - RNA, 10 nt, Homo sapiens
guaacugugu

SEQ ID NO: 498256 - RNA, 23 nt, Homo sapiens
guauauaauacuaaagugucuau

SEQ ID NO: 498257 - RNA, 14 nt, Homo sapiens
guaugacuaaagag

SEQ ID NO: 498258 - RNA, 20 nt, Homo sapiens
gucagcccaugugcaccugc

SEQ ID NO: 498259 - RNA, 21 nt, Homo sapiens
gucagcuacuaaugauguuuu

SEQ ID NO: 498260 - RNA, 14 nt, Homo sapiens
gucaguacuauuca

SEQ ID NO: 498261 - RNA, 19 nt, Homo sapiens
gucaugcacucaggcagac

SEQ ID NO: 498262 - RNA, 20 nt, Homo sapiens
guccaacugucaaccuagaa

SEQ ID NO: 498263 - RNA, 22 nt, Homo sapiens
guccaauggcuguaaacuauaa

SEQ ID NO: 498264 - RNA, 22 nt, Homo sapiens
gucccugaaaccuaguacugcc

SEQ ID NO: 498265 - RNA, 15 nt, Homo sapiens
guccugcuggcaccu

SEQ ID NO: 498266 - RNA, 13 nt, Homo sapiens
guccuucauucuu

SEQ ID NO: 498267 - RNA, 20 nt, Homo sapiens
gucuguagcuccucaacuca

SEQ ID NO: 498268 - RNA, 13 nt, Homo sapiens
gugaaacuaacag

SEQ ID NO: 498269 - RNA, 17 nt, Homo sapiens
gugagcaccugagcaug

SEQ ID NO: 498270 - RNA, 19 nt, Homo sapiens
gugaucuccacaccaaagu

SEQ ID NO: 498271 - RNA, 19 nt, Homo sapiens
gugcacagggggaggccau

SEQ ID NO: 498272 - RNA, 17 nt, Homo sapiens
gugcagucuuggcucac

SEQ ID NO: 498273 - RNA, 19 nt, Homo sapiens
ugaaauugcauacuuugua

SEQ ID NO: 498274 - RNA, 18 nt, Homo sapiens
ugaagccccuuguccucu

SEQ ID NO: 498275 - RNA, 17 nt, Homo sapiens
ugaaggcuuacuucaga

SEQ ID NO: 498276 - RNA, 13 nt, Homo sapiens
ugaauacugggaa

SEQ ID NO: 498277 - RNA, 22 nt, Homo sapiens
ugaauguagugugucagaguaa

SEQ ID NO: 498278 - RNA, 21 nt, Homo sapiens
ugacaagcaagggcugugcug

SEQ ID NO: 498279 - RNA, 18 nt, Homo sapiens
ugacaaucaacucuaaua

SEQ ID NO: 498280 - RNA, 16 nt, Homo sapiens
ugacggacguccugcu

SEQ ID NO: 498281 - RNA, 12 nt, Homo sapiens
ugacuaccagcu

SEQ ID NO: 498282 - RNA, 13 nt, Homo sapiens
ugacuaccagcua

SEQ ID NO: 498283 - RNA, 22 nt, Homo sapiens
ugacuuccugaacaaccagcug

SEQ ID NO: 498284 - RNA, 15 nt, Homo sapiens
ugagauugugcccag

SEQ ID NO: 498285 - RNA, 22 nt, Homo sapiens
ugaggcaaauggcacauggcug

SEQ ID NO: 498286 - RNA, 19 nt, Homo sapiens
ugaguugggaaaaacugac

SEQ ID NO: 498287 - RNA, 22 nt, Homo sapiens
ugauggcccuaaguuaagcaaa

SEQ ID NO: 498288 - RNA, 19 nt, Homo sapiens
ugcagcaccggccucggga

SEQ ID NO: 498289 - RNA, 22 nt, Homo sapiens
ugcaguaggggcuacugugacc

SEQ ID NO: 498290 - RNA, 18 nt, Homo sapiens
ugcccaaugagacucuag

SEQ ID NO: 498291 - RNA, 20 nt, Homo sapiens
ugccccauucucacugcuau

SEQ ID NO: 498292 - RNA, 14 nt, Homo sapiens
ugccccccaugagg

SEQ ID NO: 498293 - RNA, 20 nt, Homo sapiens
ugcccugugagggcucacuc

SEQ ID NO: 498294 - RNA, 21 nt, Homo sapiens
ugcuagugccugagaugcacg

SEQ ID NO: 498295 - RNA, 16 nt, Homo sapiens
ugcuccugugugcugg

SEQ ID NO: 498296 - RNA, 13 nt, Homo sapiens
ugcuucugcacac

SEQ ID NO: 498297 - RNA, 20 nt, Homo sapiens
ugcuuuaauuuucacucugg

SEQ ID NO: 498298 - RNA, 14 nt, Homo sapiens
uggaaaaggaagac

SEQ ID NO: 498299 - RNA, 16 nt, Homo sapiens
uggaaaguaacuguga

SEQ ID NO: 498300 - RNA, 21 nt, Homo sapiens
uggaaauuccuguacuguguc

SEQ ID NO: 498301 - RNA, 14 nt, Homo sapiens
uggagggaauuuga

SEQ ID NO: 498302 - RNA, 21 nt, Homo sapiens
uggauucaauuuuaaggcaua

SEQ ID NO: 498303 - RNA, 21 nt, Homo sapiens
uggcaccucagacaauccacu

SEQ ID NO: 498304 - RNA, 22 nt, Homo sapiens
uggcccuuuccuuccagauccu

SEQ ID NO: 498305 - RNA, 18 nt, Homo sapiens
cuuaucuuacaauauuga

SEQ ID NO: 498306 - RNA, 12 nt, Homo sapiens
cuucacugacag

SEQ ID NO: 498307 - RNA, 21 nt, Homo sapiens
cuuccagggauuugccucacc

SEQ ID NO: 498308 - RNA, 14 nt, Homo sapiens
cuucugcacacaaa

SEQ ID NO: 498309 - RNA, 19 nt, Homo sapiens
cuugaaucuguuacugaaa

SEQ ID NO: 498310 - RNA, 10 nt, Homo sapiens
cuugcauaau

SEQ ID NO: 498311 - RNA, 20 nt, Homo sapiens
cuugguuacuuaagaggcag

SEQ ID NO: 498312 - RNA, 20 nt, Homo sapiens
cuuguguccccaccucaggc

SEQ ID NO: 498313 - RNA, 14 nt, Homo sapiens
cuuugcagcaauga

SEQ ID NO: 498314 - RNA, 22 nt, Homo sapiens
cuuuguaaaggucagagucaaa

SEQ ID NO: 498315 - RNA, 16 nt, Homo sapiens
cuuuuauaaagcaugu

SEQ ID NO: 498316 - RNA, 13 nt, Homo sapiens
cuuuuugaucuca

SEQ ID NO: 498317 - RNA, 14 nt, Homo sapiens
gaaaacauguuaau

SEQ ID NO: 498318 - RNA, 14 nt, Homo sapiens
gaaaagcccaguga

SEQ ID NO: 498319 - RNA, 23 nt, Homo sapiens
gaaacagagguggcugcugugcu

SEQ ID NO: 498320 - RNA, 14 nt, Homo sapiens
gaaagaggcaguga

SEQ ID NO: 498321 - RNA, 15 nt, Homo sapiens
gaaagcacaccucau

SEQ ID NO: 498322 - RNA, 14 nt, Homo sapiens
gaaagccuuaggga

SEQ ID NO: 498323 - RNA, 16 nt, Homo sapiens
gaaauuccuguacugu

SEQ ID NO: 498324 - RNA, 16 nt, Homo sapiens
gaaccuguccuaagga

SEQ ID NO: 498325 - RNA, 19 nt, Homo sapiens
gaacucagcugaggccuug

SEQ ID NO: 498326 - RNA, 13 nt, Homo sapiens
gaagaacauagaa

SEQ ID NO: 498327 - RNA, 20 nt, Homo sapiens
gaagagggagaagcaugaaa

SEQ ID NO: 498328 - RNA, 18 nt, Homo sapiens
gaagccaaacaaaggccc

SEQ ID NO: 498329 - RNA, 19 nt, Homo sapiens
gaagcccugauguguccuc

SEQ ID NO: 498330 - RNA, 23 nt, Homo sapiens
gaagcccugauguguccucaggg

SEQ ID NO: 498331 - RNA, 16 nt, Homo sapiens
gaaggacaugugcuau

SEQ ID NO: 498332 - RNA, 15 nt, Homo sapiens
gaaucaagacaagac

SEQ ID NO: 498333 - RNA, 14 nt, Homo sapiens
gaauccuacagccu

SEQ ID NO: 498334 - RNA, 15 nt, Homo sapiens
gacacuagccugugc

SEQ ID NO: 498335 - RNA, 23 nt, Homo sapiens
gaccacuuccaggggaaccugcc

SEQ ID NO: 498336 - RNA, 23 nt, Homo sapiens
gacccaaguguugaggggaccaa

SEQ ID NO: 498337 - RNA, 17 nt, Homo sapiens
gaccuuccacacagggu

SEQ ID NO: 498338 - RNA, 14 nt, Homo sapiens
gacggccacucugu

SEQ ID NO: 498339 - RNA, 20 nt, Homo sapiens
gacuaccagcuaacuccagu

SEQ ID NO: 498340 - RNA, 20 nt, Homo sapiens
gacuacccauagacaugaaa

SEQ ID NO: 498341 - RNA, 19 nt, Homo sapiens
gacucaccucauccuuacc

SEQ ID NO: 498342 - RNA, 22 nt, Homo sapiens
gacucugggcugucagcccaug

SEQ ID NO: 498343 - RNA, 21 nt, Homo sapiens
gacugccuugccuccucagua

SEQ ID NO: 498344 - RNA, 14 nt, Homo sapiens
gacugucuuucaga

SEQ ID NO: 498345 - RNA, 19 nt, Homo sapiens
gagacccagagagcuaggg

SEQ ID NO: 498346 - RNA, 12 nt, Homo sapiens
gagacucuaggg

SEQ ID NO: 498347 - RNA, 16 nt, Homo sapiens
gagacugucccugaaa

SEQ ID NO: 498348 - RNA, 16 nt, Homo sapiens
gagauaagucuuucau

SEQ ID NO: 498349 - RNA, 19 nt, Homo sapiens
gagccuggaagccaaacaa

SEQ ID NO: 498350 - RNA, 15 nt, Homo sapiens
gaggcucagccacac

SEQ ID NO: 498351 - RNA, 22 nt, Homo sapiens
gagggcccuccgaccacuucca

SEQ ID NO: 498352 - RNA, 12 nt, Homo sapiens
gagguggcugcu

SEQ ID NO: 498353 - RNA, 20 nt, Homo sapiens
gaguaacaugccagcuuccu

SEQ ID NO: 498354 - RNA, 19 nt, Homo sapiens
gagucauccagcucuugcu

SEQ ID NO: 498355 - RNA, 17 nt, Homo sapiens
gagucaugcacucaggc

SEQ ID NO: 498356 - RNA, 14 nt, Homo sapiens
gagugaggagccca

SEQ ID NO: 498357 - RNA, 19 nt, Homo sapiens
gauggcuggaaggggucca

SEQ ID NO: 498358 - RNA, 16 nt, Homo sapiens
gauguacgagcugcgc

SEQ ID NO: 498359 - RNA, 15 nt, Homo sapiens
gauucugcagcaccg

SEQ ID NO: 498360 - RNA, 18 nt, Homo sapiens
gauucuuuccauuaugau

SEQ ID NO: 498361 - RNA, 22 nt, Homo sapiens
gcaagaaagccguacugucuau

SEQ ID NO: 498362 - RNA, 19 nt, Homo sapiens
gcaaggggcauuacuggga

SEQ ID NO: 498363 - RNA, 19 nt, Homo sapiens
gcaaugguagcaaaacaag

SEQ ID NO: 498364 - RNA, 18 nt, Homo sapiens
gcacaccucaugcugagc

SEQ ID NO: 498365 - RNA, 14 nt, Homo sapiens
gcacagaugccugg

SEQ ID NO: 498366 - RNA, 15 nt, Homo sapiens
gcacaggcugggaug

SEQ ID NO: 498367 - RNA, 18 nt, Homo sapiens
gcacauuuaaggcgccau

SEQ ID NO: 498368 - RNA, 15 nt, Homo sapiens
gcaccggccucggga

SEQ ID NO: 498369 - RNA, 15 nt, Homo sapiens
gcagcccgaagccca

SEQ ID NO: 498370 - RNA, 22 nt, Homo sapiens
gcagcuaccagguguucuacac

SEQ ID NO: 498371 - RNA, 21 nt, Homo sapiens
gcagcugucauggaaaagccc

SEQ ID NO: 498372 - RNA, 20 nt, Homo sapiens
gcaguaggggcuacugugac

SEQ ID NO: 498373 - RNA, 17 nt, Homo sapiens
gcagucucagaaagccu

SEQ ID NO: 498374 - RNA, 23 nt, Homo sapiens
gcauacagacuggggacccugga

SEQ ID NO: 498375 - RNA, 13 nt, Homo sapiens
gcauuacugggaa

SEQ ID NO: 498376 - RNA, 19 nt, Homo sapiens
gcauuuguuccaugccugc

SEQ ID NO: 498377 - RNA, 18 nt, Homo sapiens
gccaaagugacacagagc

SEQ ID NO: 498378 - RNA, 23 nt, Homo sapiens
gccaggauggcgugugugccgug

SEQ ID NO: 498379 - RNA, 20 nt, Homo sapiens
gccaucggugaaacuaacag

SEQ ID NO: 498380 - RNA, 14 nt, Homo sapiens
gcccagugaccuga

SEQ ID NO: 498381 - RNA, 17 nt, Homo sapiens
gcccaugugcaccugcc

SEQ ID NO: 498382 - RNA, 21 nt, Homo sapiens
gcccugauguguccucaggga

SEQ ID NO: 498383 - RNA, 20 nt, Homo sapiens
gcccugugagggcucacucg

SEQ ID NO: 498384 - RNA, 22 nt, Homo sapiens
gcccuucugaugagaaaggccu

SEQ ID NO: 498385 - RNA, 21 nt, Homo sapiens
ucugcccuguauauaauacua

SEQ ID NO: 498386 - RNA, 13 nt, Homo sapiens
ucuuacaugcauu

SEQ ID NO: 498387 - RNA, 16 nt, Homo sapiens
ucuuacaugcauuuga

SEQ ID NO: 498388 - RNA, 22 nt, Homo sapiens
ucuucacuucuaaaugcauauc

SEQ ID NO: 498389 - RNA, 14 nt, Homo sapiens
ucuucucccugugu

SEQ ID NO: 498390 - RNA, 15 nt, Homo sapiens
ucuugcucagugaag

SEQ ID NO: 498391 - RNA, 18 nt, Homo sapiens
ugaagagggagaagcaug

SEQ ID NO: 498392 - RNA, 20 nt, Homo sapiens
ugaagccccuuguccucucc

SEQ ID NO: 498393 - RNA, 15 nt, Homo sapiens
ugaaggcuuacuuca

SEQ ID NO: 498394 - RNA, 14 nt, Homo sapiens
ugaaguacauauua

SEQ ID NO: 498395 - RNA, 14 nt, Homo sapiens
ugaaguuuuacugu

SEQ ID NO: 498396 - RNA, 18 nt, Homo sapiens
ugacaagcaagggcugug

SEQ ID NO: 498397 - RNA, 14 nt, Homo sapiens
ugacaaucaacucu

SEQ ID NO: 498398 - RNA, 21 nt, Homo sapiens
ugacagcccugaacgugagca

SEQ ID NO: 498399 - RNA, 13 nt, Homo sapiens
ugacauuaagaca

SEQ ID NO: 498400 - RNA, 21 nt, Homo sapiens
ugacuuccugaacaaccagcu

SEQ ID NO: 498401 - RNA, 23 nt, Homo sapiens
ugagacucuaggguccaguggau

SEQ ID NO: 498402 - RNA, 12 nt, Homo sapiens
ugagaguauuua

SEQ ID NO: 498403 - RNA, 17 nt, Homo sapiens
ugagccaaacacacugu

SEQ ID NO: 498404 - RNA, 18 nt, Homo sapiens
ugagccaaacacacugua

SEQ ID NO: 498405 - RNA, 20 nt, Homo sapiens
ugagccaaacacacuguaaa

SEQ ID NO: 498406 - RNA, 13 nt, Homo sapiens
ugagcgcuguguu

SEQ ID NO: 498407 - RNA, 19 nt, Homo sapiens
ugaggagagaaggacaugu

SEQ ID NO: 498408 - RNA, 13 nt, Homo sapiens
ugaggagcccagg

SEQ ID NO: 498409 - RNA, 13 nt, Homo sapiens
ugaggcccagaaa

SEQ ID NO: 498410 - RNA, 16 nt, Homo sapiens
ugaggcccugcccaau

SEQ ID NO: 498411 - RNA, 20 nt, Homo sapiens
ugaggcccugcccaaugaga

SEQ ID NO: 498412 - RNA, 18 nt, Homo sapiens
ugaggggaccaaagccac

SEQ ID NO: 498413 - RNA, 16 nt, Homo sapiens
ugagugcuccugugug

SEQ ID NO: 498414 - RNA, 20 nt, Homo sapiens
ugauugggaaaacauuugcu

SEQ ID NO: 498415 - RNA, 19 nt, Homo sapiens
ugcacagggggaggccaua

SEQ ID NO: 498416 - RNA, 23 nt, Homo sapiens
ugcacagggggaggccauaaaga

SEQ ID NO: 498417 - RNA, 16 nt, Homo sapiens
ugcacucccuaagaaa

SEQ ID NO: 498418 - RNA, 19 nt, Homo sapiens
aaaauuucaaaagugaucu

SEQ ID NO: 498419 - RNA, 14 nt, Homo sapiens
aaacauguauguaa

SEQ ID NO: 498420 - RNA, 22 nt, Homo sapiens
aaacauguauguaaauagcuaa

SEQ ID NO: 498421 - RNA, 13 nt, Homo sapiens
aaaccuguuggcu

SEQ ID NO: 498422 - RNA, 16 nt, Homo sapiens
aaacuaguuacuaaac

SEQ ID NO: 498423 - RNA, 14 nt, Homo sapiens
aaagacuggccuga

SEQ ID NO: 498424 - RNA, 13 nt, Homo sapiens
aaagccuuaggga

SEQ ID NO: 498425 - RNA, 24 nt, Homo sapiens
aaagcuguuccuugguccuaguaa

SEQ ID NO: 498426 - RNA, 19 nt, Homo sapiens
aaagucagggagccuggaa

SEQ ID NO: 498427 - RNA, 15 nt, Homo sapiens
aaaguugcagucuca

SEQ ID NO: 498428 - RNA, 19 nt, Homo sapiens
aaaguugcagucucagaaa

SEQ ID NO: 498429 - RNA, 18 nt, Homo sapiens
aaauauauuuuggaaaac

SEQ ID NO: 498430 - RNA, 15 nt, Homo sapiens
aaauucaacuuugua

SEQ ID NO: 498431 - RNA, 14 nt, Homo sapiens
aaauuuaauaccag

SEQ ID NO: 498432 - RNA, 21 nt, Homo sapiens
aaauuuguccaauggcuguaa

SEQ ID NO: 498433 - RNA, 15 nt, Homo sapiens
aacaacuucagucca

SEQ ID NO: 498434 - RNA, 21 nt, Homo sapiens
aacaaggacccuguuuuccac

SEQ ID NO: 498435 - RNA, 14 nt, Homo sapiens
aacacagccugugu

SEQ ID NO: 498436 - RNA, 17 nt, Homo sapiens
aacagcaauggugucag

SEQ ID NO: 498437 - RNA, 15 nt, Homo sapiens
aacccauacuacccu

SEQ ID NO: 498438 - RNA, 14 nt, Homo sapiens
aaccuaguacugcc

SEQ ID NO: 498439 - RNA, 19 nt, Homo sapiens
aaccuuccuuccugcuuga

SEQ ID NO: 498440 - RNA, 17 nt, Homo sapiens
aacgaaucgauucugca

SEQ ID NO: 498441 - RNA, 13 nt, Homo sapiens
aacuccagucucc

SEQ ID NO: 498442 - RNA, 15 nt, Homo sapiens
aacugagccaaacac

SEQ ID NO: 498443 - RNA, 11 nt, Homo sapiens
aacuggcuguu

SEQ ID NO: 498444 - RNA, 13 nt, Homo sapiens
aacugucaaccua

SEQ ID NO: 498445 - RNA, 12 nt, Homo sapiens
aacuucucugag

SEQ ID NO: 498446 - RNA, 16 nt, Homo sapiens
aagaaaggaacugagg

SEQ ID NO: 498447 - RNA, 12 nt, Homo sapiens
aagaagacauga

SEQ ID NO: 498448 - RNA, 18 nt, Homo sapiens
aagacuagaggcuugcau

SEQ ID NO: 498449 - RNA, 13 nt, Homo sapiens
aagacucaccuca

SEQ ID NO: 498450 - RNA, 20 nt, Homo sapiens
aagauauguaacaacaauua

SEQ ID NO: 498451 - RNA, 19 nt, Homo sapiens
aagauuuugaaugcuuccu

SEQ ID NO: 498452 - RNA, 16 nt, Homo sapiens
aagcccagugaccuga

SEQ ID NO: 498453 - RNA, 23 nt, Homo sapiens
aagcccugauguguccucaggga

SEQ ID NO: 498454 - RNA, 22 nt, Homo sapiens
aagcgacccauucagagacugu

SEQ ID NO: 498455 - RNA, 12 nt, Homo sapiens
aaggaaagccaa

SEQ ID NO: 498456 - RNA, 17 nt, Homo sapiens
aaggaaccuuccuuccu

SEQ ID NO: 498457 - RNA, 21 nt, Homo sapiens
aaggacacuagccugugcacg

SEQ ID NO: 498458 - RNA, 21 nt, Homo sapiens
aaggccugacuucugcuggca

SEQ ID NO: 498459 - RNA, 18 nt, Homo sapiens
aaggggcauuacugggaa

SEQ ID NO: 498460 - RNA, 22 nt, Homo sapiens
aaggugggccuugcuaccucaa

SEQ ID NO: 498461 - RNA, 22 nt, Homo sapiens
aaguaaauuuguccaauggcug

SEQ ID NO: 498462 - RNA, 21 nt, Homo sapiens
aaguaacugugagaacccagu

SEQ ID NO: 498463 - RNA, 11 nt, Homo sapiens
aagucuuucau

SEQ ID NO: 498464 - RNA, 14 nt, Homo sapiens
aagugaucuguccc

SEQ ID NO: 498465 - RNA, 23 nt, Homo sapiens
aauauagcuuucauaacaucgaa

SEQ ID NO: 498466 - RNA, 23 nt, Homo sapiens
aaucgauucugcagcaccggccu

SEQ ID NO: 498467 - RNA, 14 nt, Homo sapiens
aaugauguuuuccu

SEQ ID NO: 498468 - RNA, 16 nt, Homo sapiens
aauguuaaagggauau

SEQ ID NO: 498469 - RNA, 18 nt, Homo sapiens
aauguuuagcagauuuaa

SEQ ID NO: 498470 - RNA, 19 nt, Homo sapiens
aauguuuucaaaagguauu

SEQ ID NO: 498471 - RNA, 14 nt, Homo sapiens
aauuaagugcaauu

SEQ ID NO: 498472 - RNA, 21 nt, Homo sapiens
aauucacauaacuucucugag

SEQ ID NO: 498473 - RNA, 16 nt, Homo sapiens
aauuccuguacugugu

SEQ ID NO: 498474 - RNA, 14 nt, Homo sapiens
aauuuuaguuguca

SEQ ID NO: 498475 - RNA, 13 nt, Homo sapiens
acaaaauauagcu

SEQ ID NO: 498476 - RNA, 21 nt, Homo sapiens
acaaggacuagagcucaggcc

SEQ ID NO: 498477 - RNA, 23 nt, Homo sapiens
acaaucaacucuaauagugcuua

SEQ ID NO: 498478 - RNA, 15 nt, Homo sapiens
acacaaaacucucug

SEQ ID NO: 498479 - RNA, 19 nt, Homo sapiens
acacugaggaggcugccuu

SEQ ID NO: 498480 - RNA, 24 nt, Homo sapiens
acagagguggcugcugugcuagug

SEQ ID NO: 498481 - RNA, 17 nt, Homo sapiens
acagcaauggugucagu

SEQ ID NO: 498482 - RNA, 17 nt, Homo sapiens
acaggagacccagagag

SEQ ID NO: 498483 - RNA, 21 nt, Homo sapiens
acagggucuaccucugucacc

SEQ ID NO: 498484 - RNA, 20 nt, Homo sapiens
acagugaaguuuuacugucu

SEQ ID NO: 498485 - RNA, 16 nt, Homo sapiens
acagugcccagcauga

SEQ ID NO: 498486 - RNA, 18 nt, Homo sapiens
acaguuaugggacacuga

SEQ ID NO: 498487 - RNA, 22 nt, Homo sapiens
acauggcuggcacugagcagua

SEQ ID NO: 498488 - RNA, 16 nt, Homo sapiens
acaugugcuauugaac

SEQ ID NO: 498489 - RNA, 10 nt, Homo sapiens
acauguuaau

SEQ ID NO: 498490 - RNA, 23 nt, Homo sapiens
acauguuaaugacaauauuccag

SEQ ID NO: 498491 - RNA, 16 nt, Homo sapiens
acauuaagacacaccu

SEQ ID NO: 498492 - RNA, 15 nt, Homo sapiens
acauuugcuacuguu

SEQ ID NO: 498493 - RNA, 17 nt, Homo sapiens
acccauucagagacugu

SEQ ID NO: 498494 - RNA, 17 nt, Homo sapiens
accucagacaauccacu

SEQ ID NO: 498495 - RNA, 18 nt, Homo sapiens
accugaccggcaccugcg

SEQ ID NO: 498496 - RNA, 18 nt, Homo sapiens
acgaugucaaggacuccu

SEQ ID NO: 498497 - RNA, 22 nt, Homo sapiens
acgccucgguggcauacagacu

SEQ ID NO: 498498 - RNA, 14 nt, Homo sapiens
acuaaacaguaaga

SEQ ID NO: 498499 - RNA, 16 nt, Homo sapiens
acuaaugauguuuucc

SEQ ID NO: 498500 - RNA, 15 nt, Homo sapiens
acuagagcucaggcc

SEQ ID NO: 498501 - RNA, 16 nt, Homo sapiens
acuauaaacuacugua

SEQ ID NO: 498502 - RNA, 18 nt, Homo sapiens
acucaucuuagugccuga

SEQ ID NO: 498503 - RNA, 20 nt, Homo sapiens
acucaucuuagugccugaga

SEQ ID NO: 498504 - RNA, 22 nt, Homo sapiens
acucccacagaggagagaggcu

SEQ ID NO: 498505 - RNA, 14 nt, Homo sapiens
acuccugcuuaauc

SEQ ID NO: 498506 - RNA, 15 nt, Homo sapiens
acuccugucuguccu

SEQ ID NO: 498507 - RNA, 22 nt, Homo sapiens
acucuacaaaauauagcuuuca

SEQ ID NO: 498508 - RNA, 17 nt, Homo sapiens
acucugggcuccucaac

SEQ ID NO: 498509 - RNA, 15 nt, Homo sapiens
acugacuaccagcua

SEQ ID NO: 498510 - RNA, 17 nt, Homo sapiens
acuggauggucaucucg

SEQ ID NO: 498511 - RNA, 16 nt, Homo sapiens
acuggcagcaucuuca

SEQ ID NO: 498512 - RNA, 20 nt, Homo sapiens
acuggccugauugcagagua

SEQ ID NO: 498513 - RNA, 23 nt, Homo sapiens
acuggcuucucuuucucugagug

SEQ ID NO: 498514 - RNA, 18 nt, Homo sapiens
acuggggagucuuugugg

SEQ ID NO: 498515 - RNA, 19 nt, Homo sapiens
acuggggucuguguggugc

SEQ ID NO: 498516 - RNA, 12 nt, Homo sapiens
acugucuuucag

SEQ ID NO: 498517 - RNA, 21 nt, Homo sapiens
acugucuuucagauacauggu

SEQ ID NO: 498518 - RNA, 15 nt, Homo sapiens
acugugucucaugga

SEQ ID NO: 498519 - RNA, 13 nt, Homo sapiens
acuuaagaggcag

SEQ ID NO: 498520 - RNA, 15 nt, Homo sapiens
acuucuaaaugcaua

SEQ ID NO: 498521 - RNA, 18 nt, Homo sapiens
acuucuucugguccuuca

SEQ ID NO: 498522 - RNA, 17 nt, Homo sapiens
acuuucccacagcacua

SEQ ID NO: 498523 - RNA, 17 nt, Homo sapiens
acuuugggauucuuucc

SEQ ID NO: 498524 - RNA, 15 nt, Homo sapiens
agaaaccacuagaaa

SEQ ID NO: 498525 - RNA, 17 nt, Homo sapiens
agaaacguaacugugug

SEQ ID NO: 498526 - RNA, 18 nt, Homo sapiens
agaaagccguacugucua

SEQ ID NO: 498527 - RNA, 16 nt, Homo sapiens
agaaccacacuugaaa

SEQ ID NO: 498528 - RNA, 20 nt, Homo sapiens
agaaccacacuugaaaccuu

SEQ ID NO: 498529 - RNA, 22 nt, Homo sapiens
agaagaaaaaguugcagucuca

SEQ ID NO: 498530 - RNA, 19 nt, Homo sapiens
ggcaagugugggggguccu

SEQ ID NO: 498531 - RNA, 14 nt, Homo sapiens
ggcagauugaaaag

SEQ ID NO: 498532 - RNA, 21 nt, Homo sapiens
ggccuggggcgagcacuguga

SEQ ID NO: 498533 - RNA, 22 nt, Homo sapiens
ggcugggaacaacuucagucca

SEQ ID NO: 498534 - RNA, 13 nt, Homo sapiens
ggcugugcugagg

SEQ ID NO: 498535 - RNA, 19 nt, Homo sapiens
gggaagcggcccuaaggga

SEQ ID NO: 498536 - RNA, 12 nt, Homo sapiens
gggagacuggaa

SEQ ID NO: 498537 - RNA, 23 nt, Homo sapiens
gggaggcaagugugggggguccu

SEQ ID NO: 498538 - RNA, 12 nt, Homo sapiens
gggagugucuaa

SEQ ID NO: 498539 - RNA, 16 nt, Homo sapiens
ggggcgagcacuguga

SEQ ID NO: 498540 - RNA, 17 nt, Homo sapiens
ggggucuguguggugcc

SEQ ID NO: 498541 - RNA, 14 nt, Homo sapiens
ggucagucacuuga

SEQ ID NO: 498542 - RNA, 19 nt, Homo sapiens
guaaacuauaaacuacugu

SEQ ID NO: 498543 - RNA, 20 nt, Homo sapiens
guaaacuucugcaacaagca

SEQ ID NO: 498544 - RNA, 16 nt, Homo sapiens
guaaauagcuaagaua

SEQ ID NO: 498545 - RNA, 19 nt, Homo sapiens
guaaauagcuaagauauaa

SEQ ID NO: 498546 - RNA, 12 nt, Homo sapiens
guaaauguuucu

SEQ ID NO: 498547 - RNA, 12 nt, Homo sapiens
guacaagcauuu

SEQ ID NO: 498548 - RNA, 17 nt, Homo sapiens
guacugugucucaugga

SEQ ID NO: 498549 - RNA, 15 nt, Homo sapiens
guagcguacaucaau

SEQ ID NO: 498550 - RNA, 21 nt, Homo sapiens
guauauaauacuaaagugucu

SEQ ID NO: 498551 - RNA, 11 nt, Homo sapiens
guauguuaaag

SEQ ID NO: 498552 - RNA, 14 nt, Homo sapiens
guauuauacaugug

SEQ ID NO: 498553 - RNA, 19 nt, Homo sapiens
guauuuccagugcaauugu

SEQ ID NO: 498554 - RNA, 21 nt, Homo sapiens
guauuuucaugaaaauaccau

SEQ ID NO: 498555 - RNA, 14 nt, Homo sapiens
gucagcccaugugc

SEQ ID NO: 498556 - RNA, 22 nt, Homo sapiens
gucaggauucuucaaggagaau

SEQ ID NO: 498557 - RNA, 15 nt, Homo sapiens
gucauucuacacuga

SEQ ID NO: 498558 - RNA, 13 nt, Homo sapiens
guccaacugucaa

SEQ ID NO: 498559 - RNA, 17 nt, Homo sapiens
guccugcccucugggag

SEQ ID NO: 498560 - RNA, 16 nt, Homo sapiens
gucuauuaauauucag

SEQ ID NO: 498561 - RNA, 20 nt, Homo sapiens
gucuuagccucccaaagugc

SEQ ID NO: 498562 - RNA, 19 nt, Homo sapiens
gugaagaggaaaaugccuc

SEQ ID NO: 498563 - RNA, 23 nt, Homo sapiens
gugaccauggaggccagugccag

SEQ ID NO: 498564 - RNA, 23 nt, Homo sapiens
gugauccuucaucgaacaaacug

SEQ ID NO: 498565 - RNA, 15 nt, Homo sapiens
gugccagcaccugcc

SEQ ID NO: 498566 - RNA, 17 nt, Homo sapiens
gugcccucccauagcac

SEQ ID NO: 498567 - RNA, 14 nt, Homo sapiens
guggcaacccucac

SEQ ID NO: 498568 - RNA, 17 nt, Homo sapiens
guggcaacccucacugu

SEQ ID NO: 498569 - RNA, 14 nt, Homo sapiens
gugugggggguccu

SEQ ID NO: 498570 - RNA, 21 nt, Homo sapiens
guguugaggggaccaaagcca

SEQ ID NO: 498571 - RNA, 13 nt, Homo sapiens
guuauaacugugg

SEQ ID NO: 498572 - RNA, 21 nt, Homo sapiens
guuccaguaccgcccucgggg

SEQ ID NO: 498573 - RNA, 14 nt, Homo sapiens
guucuaacagugaa

SEQ ID NO: 498574 - RNA, 12 nt, Homo sapiens
guugcagucuca

SEQ ID NO: 498575 - RNA, 23 nt, Homo sapiens
guugcagucucagaaagccuucc

SEQ ID NO: 498576 - RNA, 16 nt, Homo sapiens
guuggaaaguaacugu

SEQ ID NO: 498577 - RNA, 10 nt, Homo sapiens
guuggaagag

SEQ ID NO: 498578 - RNA, 22 nt, Homo sapiens
guuuacaauaggaguggugauu

SEQ ID NO: 498579 - RNA, 14 nt, Homo sapiens
guuuaugagccaga

SEQ ID NO: 498580 - RNA, 22 nt, Homo sapiens
guuuguggggcacagaugccug

SEQ ID NO: 498581 - RNA, 19 nt, Homo sapiens
uaaaaaucauugauuguca

SEQ ID NO: 498582 - RNA, 22 nt, Homo sapiens
uaaaauaacaguaugugggaua

SEQ ID NO: 498583 - RNA, 19 nt, Homo sapiens
uaaacaagggcagugagaa

SEQ ID NO: 498584 - RNA, 20 nt, Homo sapiens
uaaagaaguaaauuugucca

SEQ ID NO: 498585 - RNA, 20 nt, Homo sapiens
uaaagagagaauguagauau

SEQ ID NO: 498586 - RNA, 17 nt, Homo sapiens
uaaauaggaaucauuca

SEQ ID NO: 498587 - RNA, 12 nt, Homo sapiens
uaaauugcauca

SEQ ID NO: 498588 - RNA, 20 nt, Homo sapiens
uaacaaaauuugaauagccc

SEQ ID NO: 498589 - RNA, 21 nt, Homo sapiens
uaacacauuuuuuugcaugca

SEQ ID NO: 498590 - RNA, 21 nt, Homo sapiens
uaacuguggcuaauucacaua

SEQ ID NO: 498591 - RNA, 13 nt, Homo sapiens
uaacuucucugag

SEQ ID NO: 498592 - RNA, 13 nt, Homo sapiens
uaagaauaccaca

SEQ ID NO: 498593 - RNA, 16 nt, Homo sapiens
uaagaggcagugagau

SEQ ID NO: 498594 - RNA, 17 nt, Homo sapiens
uaagagucauccagcuc

SEQ ID NO: 498595 - RNA, 15 nt, Homo sapiens
uaagcaaauguuaaa

SEQ ID NO: 498596 - RNA, 18 nt, Homo sapiens
uaagggguaucauguaug

SEQ ID NO: 498597 - RNA, 15 nt, Homo sapiens
uaauuuucacucugg

SEQ ID NO: 498598 - RNA, 13 nt, Homo sapiens
uacagacugggga

SEQ ID NO: 498599 - RNA, 17 nt, Homo sapiens
uacaucccgggccucag

SEQ ID NO: 498600 - RNA, 17 nt, Homo sapiens
uacaucucccagacucu

SEQ ID NO: 498601 - RNA, 14 nt, Homo sapiens
uacuaaagugucua

SEQ ID NO: 498602 - RNA, 17 nt, Homo sapiens
uacuccucugacuggag

SEQ ID NO: 498603 - RNA, 15 nt, Homo sapiens
uacugugaccaugga

SEQ ID NO: 498604 - RNA, 18 nt, Homo sapiens
uacuuucccacagcacua

SEQ ID NO: 498605 - RNA, 18 nt, Homo sapiens
uagagcucaggccugcug

SEQ ID NO: 498606 - RNA, 21 nt, Homo sapiens
uagauauugugaaguacauau

SEQ ID NO: 498607 - RNA, 23 nt, Homo sapiens
uagccucccaaagugcugggauu

SEQ ID NO: 498608 - RNA, 13 nt, Homo sapiens
uagccugugcacg

SEQ ID NO: 498609 - RNA, 13 nt, Homo sapiens
uagcuaagauaua

SEQ ID NO: 498610 - RNA, 21 nt, Homo sapiens
uaggaaaauauggguugcauu

SEQ ID NO: 498611 - RNA, 16 nt, Homo sapiens
uaggcgcaggugcaca

SEQ ID NO: 498612 - RNA, 17 nt, Homo sapiens
uagggaaauucaaagca

SEQ ID NO: 498613 - RNA, 14 nt, Homo sapiens
uagugccugagaug

SEQ ID NO: 498614 - RNA, 17 nt, Homo sapiens
uauaauuuaaacgugau

SEQ ID NO: 498615 - RNA, 22 nt, Homo sapiens
uaugacuaaagagagaauguag

SEQ ID NO: 498616 - RNA, 16 nt, Homo sapiens
uauuaucaguggcugc

SEQ ID NO: 498617 - RNA, 22 nt, Homo sapiens
ucaaaagguauuauacauguga

SEQ ID NO: 498618 - RNA, 13 nt, Homo sapiens
ucaaagccuucuc

SEQ ID NO: 498619 - RNA, 21 nt, Homo sapiens
ucaaauacacauuugcuacug

SEQ ID NO: 498620 - RNA, 16 nt, Homo sapiens
ucaagccuuccaggga

SEQ ID NO: 498621 - RNA, 21 nt, Homo sapiens
ucaaggacuccugucuguccu

SEQ ID NO: 498622 - RNA, 14 nt, Homo sapiens
ucaccucucaaggu

SEQ ID NO: 498623 - RNA, 13 nt, Homo sapiens
ucacuacagccuc

SEQ ID NO: 498624 - RNA, 16 nt, Homo sapiens
ucacuacagccucgaa

SEQ ID NO: 498625 - RNA, 18 nt, Homo sapiens
ucagacaauccacucuca

SEQ ID NO: 498626 - RNA, 21 nt, Homo sapiens
ucagcggucauucuacacuga

SEQ ID NO: 498627 - RNA, 16 nt, Homo sapiens
ucagggagccuggaag

SEQ ID NO: 498628 - RNA, 13 nt, Homo sapiens
ucagucacuugaa

SEQ ID NO: 498629 - RNA, 16 nt, Homo sapiens
ucagugccccauucuc

SEQ ID NO: 498630 - RNA, 23 nt, Homo sapiens
ucaucuuagugccugagaguauu

SEQ ID NO: 498631 - RNA, 15 nt, Homo sapiens
ucaugcacucaggca

SEQ ID NO: 498632 - RNA, 17 nt, Homo sapiens
ucauggaaaagcccagu

SEQ ID NO: 498633 - RNA, 18 nt, Homo sapiens
ucauggagaaacauccua

SEQ ID NO: 498634 - RNA, 18 nt, Homo sapiens
uccaaaccgcaggcaaac

SEQ ID NO: 498635 - RNA, 16 nt, Homo sapiens
uccaacuccugguuca

SEQ ID NO: 498636 - RNA, 13 nt, Homo sapiens
uccaauggcugua

SEQ ID NO: 498637 - RNA, 19 nt, Homo sapiens
uccacaccaaagucaggga

SEQ ID NO: 498638 - RNA, 22 nt, Homo sapiens
uccauaggcgcaggugcacagg

SEQ ID NO: 498639 - RNA, 18 nt, Homo sapiens
ucccacaugaucuugaga

SEQ ID NO: 498640 - RNA, 14 nt, Homo sapiens
ucccauagcacugc

SEQ ID NO: 498641 - RNA, 16 nt, Homo sapiens
ucccugcuuaccugac

SEQ ID NO: 498642 - RNA, 16 nt, Homo sapiens
ucccuguguggcugcu

SEQ ID NO: 498643 - RNA, 19 nt, Homo sapiens
ucccuuaagagucauccag

SEQ ID NO: 498644 - RNA, 23 nt, Homo sapiens
uccgcagaagcccugaugugucc

SEQ ID NO: 498645 - RNA, 17 nt, Homo sapiens
uggcucacuacagccuc

SEQ ID NO: 498646 - RNA, 15 nt, Homo sapiens
uggcuggcacugagc

SEQ ID NO: 498647 - RNA, 16 nt, Homo sapiens
ugggaaaacauuugcu

SEQ ID NO: 498648 - RNA, 12 nt, Homo sapiens
ugggacacugaa

SEQ ID NO: 498649 - RNA, 13 nt, Homo sapiens
ugggagacuggaa

SEQ ID NO: 498650 - RNA, 17 nt, Homo sapiens
uggggcacagaugccug

SEQ ID NO: 498651 - RNA, 12 nt, Homo sapiens
uggggccagugc

SEQ ID NO: 498652 - RNA, 18 nt, Homo sapiens
uggggcgagcacugugag

SEQ ID NO: 498653 - RNA, 21 nt, Homo sapiens
uggucaagauuuugaaugcuu

SEQ ID NO: 498654 - RNA, 20 nt, Homo sapiens
uggucucaagcaguccuccu

SEQ ID NO: 498655 - RNA, 13 nt, Homo sapiens
ugguuuacuucaa

SEQ ID NO: 498656 - RNA, 11 nt, Homo sapiens
uguauguuaaa

SEQ ID NO: 498657 - RNA, 17 nt, Homo sapiens
ugucagcccaugugcac

SEQ ID NO: 498658 - RNA, 16 nt, Homo sapiens
ugucaggauucuucaa

SEQ ID NO: 498659 - RNA, 14 nt, Homo sapiens
ugugaaguacauau

SEQ ID NO: 498660 - RNA, 20 nt, Homo sapiens
ugugaggaugaaaggaguga

SEQ ID NO: 498661 - RNA, 14 nt, Homo sapiens
ugugcucacugggg

SEQ ID NO: 498662 - RNA, 13 nt, Homo sapiens
ugugggggguccu

SEQ ID NO: 498663 - RNA, 18 nt, Homo sapiens
uguguauuuccagugcaa

SEQ ID NO: 498664 - RNA, 16 nt, Homo sapiens
uguguccccaccucag

SEQ ID NO: 498665 - RNA, 12 nt, Homo sapiens
uguguggcugcu

SEQ ID NO: 498666 - RNA, 21 nt, Homo sapiens
uguuguacuuaaaugguaaua

SEQ ID NO: 498667 - RNA, 14 nt, Homo sapiens
uguuuaugagccag

SEQ ID NO: 498668 - RNA, 15 nt, Homo sapiens
uuaaaauuuuguaug

SEQ ID NO: 498669 - RNA, 23 nt, Homo sapiens
uuaaauaaaauuuuuauguaauu

SEQ ID NO: 498670 - RNA, 13 nt, Homo sapiens
uuaaaugguaaua

SEQ ID NO: 498671 - RNA, 19 nt, Homo sapiens
uuaacucaccucucaaggu

SEQ ID NO: 498672 - RNA, 15 nt, Homo sapiens
uuaccuccucauggc

SEQ ID NO: 498673 - RNA, 21 nt, Homo sapiens
uucaaugguuuaacauauaau

SEQ ID NO: 498674 - RNA, 19 nt, Homo sapiens
uucacauaacuucucugag

SEQ ID NO: 498675 - RNA, 18 nt, Homo sapiens
uuccccucuguguccucu

SEQ ID NO: 498676 - RNA, 19 nt, Homo sapiens
uuccuuccagauccugggu

SEQ ID NO: 498677 - RNA, 14 nt, Homo sapiens
uucuaaaugcauau

SEQ ID NO: 498678 - RNA, 12 nt, Homo sapiens
uucucccugugu

SEQ ID NO: 498679 - RNA, 12 nt, Homo sapiens
uucugucuguag

SEQ ID NO: 498680 - RNA, 14 nt, Homo sapiens
uucuuacaugcauu

SEQ ID NO: 498681 - RNA, 22 nt, Homo sapiens
uucuuauaccacguuccacgga

SEQ ID NO: 498682 - RNA, 16 nt, Homo sapiens
uucuuguacucuacaa

SEQ ID NO: 498683 - RNA, 12 nt, Homo sapiens
uugauagcagaa

SEQ ID NO: 498684 - RNA, 19 nt, Homo sapiens
uugauugucagcuacuaau

SEQ ID NO: 498685 - RNA, 12 nt, Homo sapiens
uugcaugcaugc

SEQ ID NO: 498686 - RNA, 11 nt, Homo sapiens
uugcccuguga

SEQ ID NO: 498687 - RNA, 21 nt, Homo sapiens
uuggaagaggaacagcacugg

SEQ ID NO: 498688 - RNA, 18 nt, Homo sapiens
uuggacugacuaccagcu

SEQ ID NO: 498689 - RNA, 17 nt, Homo sapiens
uugggaaaacauuugcu

SEQ ID NO: 498690 - RNA, 18 nt, Homo sapiens
uugguuuuccuguggcau

SEQ ID NO: 498691 - RNA, 23 nt, Homo sapiens
uuucuuuguaaaggucagaguca

SEQ ID NO: 498692 - RNA, 17 nt, Homo sapiens
uuuggggacucauuuca

SEQ ID NO: 498693 - RNA, 20 nt, Homo sapiens
uuuggguuugucaggaugga

SEQ ID NO: 498694 - RNA, 23 nt, Homo sapiens
uuugugaaaugaaaacauguaau

SEQ ID NO: 498695 - RNA, 17 nt, Homo sapiens
uuuuaacucaccucuca

SEQ ID NO: 498696 - RNA, 13 nt, Homo sapiens
uuuuaguugucaa

SEQ ID NO: 498697 - RNA, 16 nt, Homo sapiens
uuuugagagacagggu

SEQ ID NO: 498698 - RNA, 14 nt, Homo sapiens
uuuugcaugcaugc

SEQ ID NO: 498699 - RNA, 21 nt, Homo sapiens
cugccauuacagagguauuaa

SEQ ID NO: 498700 - RNA, 13 nt, Homo sapiens
cugcccaaugaga

SEQ ID NO: 498701 - RNA, 21 nt, Homo sapiens
cugcugugcccucccauagca

SEQ ID NO: 498702 - RNA, 13 nt, Homo sapiens
cugcuucccuuac

SEQ ID NO: 498703 - RNA, 20 nt, Homo sapiens
cuggacacuuauggggacag

SEQ ID NO: 498704 - RNA, 20 nt, Homo sapiens
cuggcugggaacaacuucag

SEQ ID NO: 498705 - RNA, 14 nt, Homo sapiens
cuggcuuccuagaa

SEQ ID NO: 498706 - RNA, 21 nt, Homo sapiens
cugggaacaacuucaguccaa

SEQ ID NO: 498707 - RNA, 16 nt, Homo sapiens
cugggaaucaagacaa

SEQ ID NO: 498708 - RNA, 19 nt, Homo sapiens
cuggggucuguguggugcc

SEQ ID NO: 498709 - RNA, 19 nt, Homo sapiens
cugggugguguacaagcau

SEQ ID NO: 498710 - RNA, 23 nt, Homo sapiens
cuguaaacuauaaacuacuguaa

SEQ ID NO: 498711 - RNA, 17 nt, Homo sapiens
cuguauauaauacuaaa

SEQ ID NO: 498712 - RNA, 14 nt, Homo sapiens
cugucauugcacau

SEQ ID NO: 498713 - RNA, 22 nt, Homo sapiens
cugucuauuaauauucagggua

SEQ ID NO: 498714 - RNA, 14 nt, Homo sapiens
cugugucucaugga

SEQ ID NO: 498715 - RNA, 18 nt, Homo sapiens
cuuaaugcuacaugugag

SEQ ID NO: 498716 - RNA, 18 nt, Homo sapiens
cuuagccucccaaagugc

SEQ ID NO: 498717 - RNA, 16 nt, Homo sapiens
cuucccaccucagugc

SEQ ID NO: 498718 - RNA, 13 nt, Homo sapiens
cuucccaugcauu

SEQ ID NO: 498719 - RNA, 22 nt, Homo sapiens
cuuccgugugucaucaggguug

SEQ ID NO: 498720 - RNA, 13 nt, Homo sapiens
cuucucccugugu

SEQ ID NO: 498721 - RNA, 13 nt, Homo sapiens
cuucugcacacaa

SEQ ID NO: 498722 - RNA, 12 nt, Homo sapiens
cuucugguccuu

SEQ ID NO: 498723 - RNA, 19 nt, Homo sapiens
cuucuuacaugcauuugag

SEQ ID NO: 498724 - RNA, 18 nt, Homo sapiens
cuuguguccccaccucag

SEQ ID NO: 498725 - RNA, 14 nt, Homo sapiens
cuuucucucucuaa

SEQ ID NO: 498726 - RNA, 17 nt, Homo sapiens
cuuugaguagauccauu

SEQ ID NO: 498727 - RNA, 15 nt, Homo sapiens
gaaaaaguugcaguc

SEQ ID NO: 498728 - RNA, 18 nt, Homo sapiens
gaaaaaguugcagucuca

SEQ ID NO: 498729 - RNA, 15 nt, Homo sapiens
gaaagaggcagugau

SEQ ID NO: 498730 - RNA, 18 nt, Homo sapiens
gaaagccguacugucuau

SEQ ID NO: 498731 - RNA, 13 nt, Homo sapiens
gaaagccuuccau

SEQ ID NO: 498732 - RNA, 23 nt, Homo sapiens
gaaaggaaagccaaacacuguuu

SEQ ID NO: 498733 - RNA, 16 nt, Homo sapiens
gguacugaaagccuua

SEQ ID NO: 498734 - RNA, 16 nt, Homo sapiens
ggucaaguaagaagac

SEQ ID NO: 498735 - RNA, 18 nt, Homo sapiens
ggucacuaaccaagccag

SEQ ID NO: 498736 - RNA, 20 nt, Homo sapiens
gguccuugucccaagcccag

SEQ ID NO: 498737 - RNA, 20 nt, Homo sapiens
ggugcagucuuggcucacua

SEQ ID NO: 498738 - RNA, 18 nt, Homo sapiens
gguggggggcauugagua

SEQ ID NO: 498739 - RNA, 22 nt, Homo sapiens
guaaacuauaaacuacuguaau

SEQ ID NO: 498740 - RNA, 18 nt, Homo sapiens
guaaauauccacagacuc

SEQ ID NO: 498741 - RNA, 16 nt, Homo sapiens
guaggggcuacuguga

SEQ ID NO: 498742 - RNA, 14 nt, Homo sapiens
guauauaauacuaa

SEQ ID NO: 498743 - RNA, 18 nt, Homo sapiens
guaucauguauggugaua

SEQ ID NO: 498744 - RNA, 21 nt, Homo sapiens
guauggggaggcaaguguggg

SEQ ID NO: 498745 - RNA, 22 nt, Homo sapiens
gucacccgagcuagagugcagu

SEQ ID NO: 498746 - RNA, 17 nt, Homo sapiens
gucagcccaugugcacc

SEQ ID NO: 498747 - RNA, 17 nt, Homo sapiens
gucccaagcccagggac

SEQ ID NO: 498748 - RNA, 23 nt, Homo sapiens
guccugggaauaugcuagugaug

SEQ ID NO: 498749 - RNA, 21 nt, Homo sapiens
gugagaagacuggcaggcagc

SEQ ID NO: 498750 - RNA, 14 nt, Homo sapiens
guggcuucugucug

SEQ ID NO: 498751 - RNA, 21 nt, Homo sapiens
gugggauauugaauguuaaag

SEQ ID NO: 498752 - RNA, 14 nt, Homo sapiens
guguccucagggag

SEQ ID NO: 498753 - RNA, 19 nt, Homo sapiens
guguucuacacucaucuua

SEQ ID NO: 498754 - RNA, 18 nt, Homo sapiens
guuaaguaucagcuacaa

SEQ ID NO: 498755 - RNA, 17 nt, Homo sapiens
guucuacacucaucuua

SEQ ID NO: 498756 - RNA, 18 nt, Homo sapiens
guugcugcuguccagugc

SEQ ID NO: 498757 - RNA, 16 nt, Homo sapiens
guuggaggauggcacu

SEQ ID NO: 498758 - RNA, 16 nt, Homo sapiens
guugggaccugugauc

SEQ ID NO: 498759 - RNA, 21 nt, Homo sapiens
guuggugggggucagucacuu

SEQ ID NO: 498760 - RNA, 21 nt, Homo sapiens
guuuacuucaaauuaacucua

SEQ ID NO: 498761 - RNA, 16 nt, Homo sapiens
guuucuaacucagggg

SEQ ID NO: 498762 - RNA, 22 nt, Homo sapiens
guuuguuggaaaguaacuguga

SEQ ID NO: 498763 - RNA, 19 nt, Homo sapiens
guuuuggggacucauuuca

SEQ ID NO: 498764 - RNA, 17 nt, Homo sapiens
uaaacaagggcagugag

SEQ ID NO: 498765 - RNA, 19 nt, Homo sapiens
uaaacuauaaacuacugua

SEQ ID NO: 498766 - RNA, 16 nt, Homo sapiens
uaaauugcaucacugu

SEQ ID NO: 498767 - RNA, 14 nt, Homo sapiens
uaacaucugaccug

SEQ ID NO: 498768 - RNA, 19 nt, Homo sapiens
uaaccaauccuacuaauaa

SEQ ID NO: 498769 - RNA, 21 nt, Homo sapiens
uaacucaggggugauucugaa

SEQ ID NO: 498770 - RNA, 14 nt, Homo sapiens
uaacuccagucucc

SEQ ID NO: 498771 - RNA, 14 nt, Homo sapiens
uaagaggcagugag

SEQ ID NO: 498772 - RNA, 12 nt, Homo sapiens
uaagucuuucau

SEQ ID NO: 498773 - RNA, 16 nt, Homo sapiens
uaauacuaaagugucu

SEQ ID NO: 498774 - RNA, 18 nt, Homo sapiens
uacaaaauauagcuuuca

SEQ ID NO: 498775 - RNA, 21 nt, Homo sapiens
uacaaaauauagcuuucauaa

SEQ ID NO: 498776 - RNA, 23 nt, Homo sapiens
uacaagcauuuguuccaugccug

SEQ ID NO: 498777 - RNA, 13 nt, Homo sapiens
uaccagugugcuu

SEQ ID NO: 498778 - RNA, 19 nt, Homo sapiens
uagccuuuggggacggcca

SEQ ID NO: 498779 - RNA, 17 nt, Homo sapiens
uaguuacuaaacaugua

SEQ ID NO: 498780 - RNA, 17 nt, Homo sapiens
uaucauguauggugaua

SEQ ID NO: 498781 - RNA, 20 nt, Homo sapiens
uauccugagccaucggugaa

SEQ ID NO: 498782 - RNA, 13 nt, Homo sapiens
uaucgggucacug

SEQ ID NO: 498783 - RNA, 12 nt, Homo sapiens
uaugcuagugau

SEQ ID NO: 498784 - RNA, 14 nt, Homo sapiens
uaugggacacugaa

SEQ ID NO: 498785 - RNA, 16 nt, Homo sapiens
uauggguugcauuugg

SEQ ID NO: 498786 - RNA, 21 nt, Homo sapiens
uauguaucuggguucuaacca

SEQ ID NO: 498787 - RNA, 23 nt, Homo sapiens
uauuuaaauaaagucucucugac

SEQ ID NO: 498788 - RNA, 17 nt, Homo sapiens
ucaaauacacauuugcu

SEQ ID NO: 498789 - RNA, 23 nt, Homo sapiens
ucaaggugggccuugcuaccuca

SEQ ID NO: 498790 - RNA, 19 nt, Homo sapiens
ucacauaacuucucugagu

SEQ ID NO: 498791 - RNA, 20 nt, Homo sapiens
ucacauaacuucucugaguc

SEQ ID NO: 498792 - RNA, 22 nt, Homo sapiens
ucaccaucaauuuuaguuguca

SEQ ID NO: 498793 - RNA, 15 nt, Homo sapiens
ucaccuuggggccuu

SEQ ID NO: 498794 - RNA, 18 nt, Homo sapiens
ucacuaaccaagccagaa

SEQ ID NO: 498795 - RNA, 18 nt, Homo sapiens
ucagccauugcccuguga

SEQ ID NO: 498796 - RNA, 16 nt, Homo sapiens
ucauuaugacucuuaa

SEQ ID NO: 498797 - RNA, 21 nt, Homo sapiens
ucauugacuuccugaacaacc

SEQ ID NO: 498798 - RNA, 12 nt, Homo sapiens
uccaucucuggc

SEQ ID NO: 498799 - RNA, 20 nt, Homo sapiens
ucccccuaagaggcagugag

SEQ ID NO: 498800 - RNA, 15 nt, Homo sapiens
uccccuaaaauaaca

SEQ ID NO: 498801 - RNA, 17 nt, Homo sapiens
ucccgagucaugcacuc

SEQ ID NO: 498802 - RNA, 21 nt, Homo sapiens
ucccgagucaugcacucaggc

SEQ ID NO: 498803 - RNA, 17 nt, Homo sapiens
ucccugaaaccuaguac

SEQ ID NO: 498804 - RNA, 22 nt, Homo sapiens
uccucacgcagacacacccaca

SEQ ID NO: 498805 - RNA, 15 nt, Homo sapiens
uccugcccucuggga

SEQ ID NO: 498806 - RNA, 16 nt, Homo sapiens
uccuggaggugggaga

SEQ ID NO: 498807 - RNA, 22 nt, Homo sapiens
uccuggguacugaaagccuuag

SEQ ID NO: 498808 - RNA, 23 nt, Homo sapiens
uccuuccugcuugaguucccaga

SEQ ID NO: 498809 - RNA, 12 nt, Homo sapiens
ucggcaucuucu

SEQ ID NO: 498810 - RNA, 23 nt, Homo sapiens
ucuaaaugcauauccugagccau

SEQ ID NO: 498811 - RNA, 16 nt, Homo sapiens
ucuauuuaaauaaagu

SEQ ID NO: 498812 - RNA, 18 nt, Homo sapiens
ucuccacacccacuuugu

SEQ ID NO: 498813 - RNA, 22 nt, Homo sapiens
ucuccgcaacagccaaguggaa

SEQ ID NO: 498814 - RNA, 20 nt, Homo sapiens
ugcaguaggggcuacuguga

SEQ ID NO: 498815 - RNA, 16 nt, Homo sapiens
ugcagucuuggcucac

SEQ ID NO: 498816 - RNA, 14 nt, Homo sapiens
ugcauuuaauuaga

SEQ ID NO: 498817 - RNA, 17 nt, Homo sapiens
ugccccccaugaggaag

SEQ ID NO: 498818 - RNA, 21 nt, Homo sapiens
ugccccucgcucgguccggcu

SEQ ID NO: 498819 - RNA, 18 nt, Homo sapiens
ugccuggguugcugcugu

SEQ ID NO: 498820 - RNA, 22 nt, Homo sapiens
ugcgcaacaacaaggacccugu

SEQ ID NO: 498821 - RNA, 22 nt, Homo sapiens
ugcuggcaccucagacaaucca

SEQ ID NO: 498822 - RNA, 18 nt, Homo sapiens
ugcuguccagugccuaca

SEQ ID NO: 498823 - RNA, 20 nt, Homo sapiens
ugcugugcuagugccugaga

SEQ ID NO: 498824 - RNA, 19 nt, Homo sapiens
ugcuuuugggagacuggaa

SEQ ID NO: 498825 - RNA, 16 nt, Homo sapiens
uggaagaggaacagca

SEQ ID NO: 498826 - RNA, 13 nt, Homo sapiens
uggaaggggucca

SEQ ID NO: 498827 - RNA, 22 nt, Homo sapiens
uggacacuuauggggacagcau

SEQ ID NO: 498828 - RNA, 21 nt, Homo sapiens
uggagcccagcauucaggggu

SEQ ID NO: 498829 - RNA, 20 nt, Homo sapiens
uggcacauggcuggcacuga

SEQ ID NO: 498830 - RNA, 19 nt, Homo sapiens
uggcaccucagacaaucca

SEQ ID NO: 498831 - RNA, 13 nt, Homo sapiens
uggcagaagucaa

SEQ ID NO: 498832 - RNA, 11 nt, Homo sapiens
uggcuguaaac

SEQ ID NO: 498833 - RNA, 22 nt, Homo sapiens
uggcuguaaacuauaaacuacu

SEQ ID NO: 498834 - RNA, 14 nt, Homo sapiens
ugggaccugugauc

SEQ ID NO: 498835 - RNA, 18 nt, Homo sapiens
ugggcccuggccuggauu

SEQ ID NO: 498836 - RNA, 14 nt, Homo sapiens
uggggucaaagacu

SEQ ID NO: 498837 - RNA, 21 nt, Homo sapiens
uguaaacuaguuacuaaacau

SEQ ID NO: 498838 - RNA, 16 nt, Homo sapiens
uguaaauagcuaagau

SEQ ID NO: 498839 - RNA, 17 nt, Homo sapiens
uguagauauugugaagu

SEQ ID NO: 498840 - RNA, 13 nt, Homo sapiens
uguagaugugcau

SEQ ID NO: 498841 - RNA, 16 nt, Homo sapiens
ugucagcuacuaauga

SEQ ID NO: 498842 - RNA, 20 nt, Homo sapiens
ugucauggaaaagcccagug

SEQ ID NO: 498843 - RNA, 20 nt, Homo sapiens
ugucuauguugugauccuuc

SEQ ID NO: 498844 - RNA, 12 nt, Homo sapiens
ugugagcaccug

SEQ ID NO: 498845 - RNA, 16 nt, Homo sapiens
ugugccgugacagggc

SEQ ID NO: 498846 - RNA, 12 nt, Homo sapiens
ugugcuauugaa

SEQ ID NO: 498847 - RNA, 22 nt, Homo sapiens
uguggcauaaauugcaucacug

SEQ ID NO: 498848 - RNA, 9 nt, Homo sapiens
uguguauga

SEQ ID NO: 498849 - RNA, 24 nt, Homo sapiens
uguguauuuccagugcaauuguag

SEQ ID NO: 498850 - RNA, 15 nt, Homo sapiens
uguguccucagggag

SEQ ID NO: 498851 - RNA, 17 nt, Homo sapiens
uguguugggaccuguga

SEQ ID NO: 498852 - RNA, 19 nt, Homo sapiens
uguguugggaccugugauc

SEQ ID NO: 498853 - RNA, 13 nt, Homo sapiens
uguuguaugggga

SEQ ID NO: 498854 - RNA, 14 nt, Homo sapiens
uguuuuccuauaau

SEQ ID NO: 498855 - RNA, 14 nt, Homo sapiens
uuacaugcauuuga

SEQ ID NO: 498856 - RNA, 16 nt, Homo sapiens
uuaguaugugcauuua

SEQ ID NO: 498857 - RNA, 17 nt, Homo sapiens
uuauguagguaagacug

SEQ ID NO: 498858 - RNA, 20 nt, Homo sapiens
uucaaaguuuuguuguacuu

SEQ ID NO: 498859 - RNA, 19 nt, Homo sapiens
uucagccauugcccuguga

SEQ ID NO: 498860 - RNA, 23 nt, Homo sapiens
uucauuccuaacacagcaugugu

SEQ ID NO: 498861 - RNA, 21 nt, Homo sapiens
uuccacacagggugcauguga

SEQ ID NO: 498862 - RNA, 22 nt, Homo sapiens
uucuaacagugaaguuuuacug

SEQ ID NO: 498863 - RNA, 13 nt, Homo sapiens
uucugaggcaaau

SEQ ID NO: 498864 - RNA, 19 nt, Homo sapiens
uucugaugagaaaggccug

SEQ ID NO: 498865 - RNA, 13 nt, Homo sapiens
uucuuaaccaucu

SEQ ID NO: 498866 - RNA, 14 nt, Homo sapiens
uucuuaaccaucuu

SEQ ID NO: 498867 - RNA, 21 nt, Homo sapiens
uucuucucccuguguggcugc

SEQ ID NO: 498868 - RNA, 19 nt, Homo sapiens
uugacuuuuauaaagcaug

SEQ ID NO: 498869 - RNA, 23 nt, Homo sapiens
uugaggucaaguaagaagacaug

SEQ ID NO: 498870 - RNA, 22 nt, Homo sapiens
uugauugggaaaacauuugcug

SEQ ID NO: 498871 - RNA, 10 nt, Homo sapiens
uugcauuugg

SEQ ID NO: 498872 - RNA, 12 nt, Homo sapiens
uugccaaaguga

SEQ ID NO: 498873 - RNA, 14 nt, Homo sapiens
uugcccaccacagc

SEQ ID NO: 498874 - RNA, 15 nt, Homo sapiens
uugcuaccucaaggg

SEQ ID NO: 498875 - RNA, 18 nt, Homo sapiens
uuggauucuaaauacaug

SEQ ID NO: 498876 - RNA, 17 nt, Homo sapiens
uuguguccccaccucag

SEQ ID NO: 498877 - RNA, 17 nt, Homo sapiens
uuuaagcuucaguugcu

SEQ ID NO: 498878 - RNA, 14 nt, Homo sapiens
uuuauaaacagaaa

SEQ ID NO: 498879 - RNA, 12 nt, Homo sapiens
uuuccuuccaga

SEQ ID NO: 498880 - RNA, 21 nt, Homo sapiens
uuugaucucacacaccagggc

SEQ ID NO: 498881 - RNA, 13 nt, Homo sapiens
uuugccaaaguga

SEQ ID NO: 498882 - RNA, 13 nt, Homo sapiens
uuuguaaagguca

SEQ ID NO: 498883 - RNA, 17 nt, Homo sapiens
uuuguaaaggucagagu

SEQ ID NO: 498884 - RNA, 13 nt, Homo sapiens
uuuucacucuggg

SEQ ID NO: 498885 - RNA, 16 nt, Homo sapiens
uuuucuucuugggaua

SEQ ID NO: 498886 - RNA, 18 nt, Homo sapiens
uuuugguugggaaugagg

SEQ ID NO: 498887 - RNA, 18 nt, Homo sapiens
cagacacacccacagaag

SEQ ID NO: 498888 - RNA, 18 nt, Homo sapiens
cagagaagccccuaggca

SEQ ID NO: 498889 - RNA, 11 nt, Homo sapiens
cagcauaccuu

SEQ ID NO: 498890 - RNA, 17 nt, Homo sapiens
cagccuucugacaagca

SEQ ID NO: 498891 - RNA, 21 nt, Homo sapiens
cagcugggugguguacaagca

SEQ ID NO: 498892 - RNA, 16 nt, Homo sapiens
caggauuuaaguuuca

SEQ ID NO: 498893 - RNA, 17 nt, Homo sapiens
caggcugggauggagca

SEQ ID NO: 498894 - RNA, 23 nt, Homo sapiens
cagggagcagggcagaaaacaca

SEQ ID NO: 498895 - RNA, 19 nt, Homo sapiens
cagggucuaccucugucac

SEQ ID NO: 498896 - RNA, 21 nt, Homo sapiens
caggguucugaggcaaauggc

SEQ ID NO: 498897 - RNA, 20 nt, Homo sapiens
caguaugugggggcuucauc

SEQ ID NO: 498898 - RNA, 22 nt, Homo sapiens
cagucuuggcucacuacagccu

SEQ ID NO: 498899 - RNA, 18 nt, Homo sapiens
cagugauuugccaaagug

SEQ ID NO: 498900 - RNA, 19 nt, Homo sapiens
cagugauuugccaaaguga

SEQ ID NO: 498901 - RNA, 17 nt, Homo sapiens
cagugccagcaccugcc

SEQ ID NO: 498902 - RNA, 21 nt, Homo sapiens
cagugcuggggguuucuguag

SEQ ID NO: 498903 - RNA, 12 nt, Homo sapiens
cauaaagaucaa

SEQ ID NO: 498904 - RNA, 21 nt, Homo sapiens
cauaacuucucugagucugaa

SEQ ID NO: 498905 - RNA, 18 nt, Homo sapiens
cauagaaaccacuagaaa

SEQ ID NO: 498906 - RNA, 18 nt, Homo sapiens
cauaggcgcaggugcaca

SEQ ID NO: 498907 - RNA, 17 nt, Homo sapiens
cauauaauuucuuuaaa

SEQ ID NO: 498908 - RNA, 22 nt, Homo sapiens
cauggcacucuucccaccucag

SEQ ID NO: 498909 - RNA, 13 nt, Homo sapiens
caugugcaccugc

SEQ ID NO: 498910 - RNA, 14 nt, Homo sapiens
caugugcaccugcc

SEQ ID NO: 498911 - RNA, 15 nt, Homo sapiens
cauugcacauaagcu

SEQ ID NO: 498912 - RNA, 14 nt, Homo sapiens
ccaaacacacugua

SEQ ID NO: 498913 - RNA, 17 nt, Homo sapiens
ccaaacacacuguaaau

SEQ ID NO: 498914 - RNA, 14 nt, Homo sapiens
ccaaaccgcaggca

SEQ ID NO: 498915 - RNA, 22 nt, Homo sapiens
ccaaaccgcaggcaaacggguc

SEQ ID NO: 498916 - RNA, 21 nt, Homo sapiens
ccaaagugacacagagcaaug

SEQ ID NO: 498917 - RNA, 24 nt, Homo sapiens
ccaaguccugggaauaugcuagug

SEQ ID NO: 498918 - RNA, 15 nt, Homo sapiens
ccaauggcuguaaac

SEQ ID NO: 498919 - RNA, 14 nt, Homo sapiens
ccacaaugccucuc

SEQ ID NO: 498920 - RNA, 13 nt, Homo sapiens
ccacacagggugc

SEQ ID NO: 498921 - RNA, 15 nt, Homo sapiens
ccacacccacuuugu

SEQ ID NO: 498922 - RNA, 14 nt, Homo sapiens
ccacagacucccuc

SEQ ID NO: 498923 - RNA, 21 nt, Homo sapiens
ccagaaacguaacugugugca

SEQ ID NO: 498924 - RNA, 16 nt, Homo sapiens
ccagaaagaggcagug

SEQ ID NO: 498925 - RNA, 16 nt, Homo sapiens
ccagaaccacacuuga

SEQ ID NO: 498926 - RNA, 20 nt, Homo sapiens
ccagagcggcuucaccugcg

SEQ ID NO: 498927 - RNA, 23 nt, Homo sapiens
ccagugugcuugcccaccacagc

SEQ ID NO: 498928 - RNA, 17 nt, Homo sapiens
ccaucaugcuugauuga

SEQ ID NO: 498929 - RNA, 19 nt, Homo sapiens
ccaucggugaaacuaacag

SEQ ID NO: 498930 - RNA, 20 nt, Homo sapiens
ccaugaggaaggaacagcaa

SEQ ID NO: 498931 - RNA, 23 nt, Homo sapiens
ccauuuuaauuuuaaagugcaaa

SEQ ID NO: 498932 - RNA, 15 nt, Homo sapiens
cccagccuucacuga

SEQ ID NO: 498933 - RNA, 12 nt, Homo sapiens
cccagggggaga

SEQ ID NO: 498934 - RNA, 13 nt, Homo sapiens
cccagugaccuga

SEQ ID NO: 498935 - RNA, 19 nt, Homo sapiens
cccccuaagaggcagugag

SEQ ID NO: 498936 - RNA, 23 nt, Homo sapiens
cccgggagacugaacugcagggu

SEQ ID NO: 498937 - RNA, 14 nt, Homo sapiens
cccucccauagcac

SEQ ID NO: 498938 - RNA, 14 nt, Homo sapiens
cccuccgaccacuu

SEQ ID NO: 498939 - RNA, 20 nt, Homo sapiens
cccucugggcagcugucaug

SEQ ID NO: 498940 - RNA, 14 nt, Homo sapiens
cccugcuuaccuga

SEQ ID NO: 498941 - RNA, 14 nt, Homo sapiens
ccgaccacuuccag

SEQ ID NO: 498942 - RNA, 12 nt, Homo sapiens
ccgggagacuga

SEQ ID NO: 498943 - RNA, 14 nt, Homo sapiens
ccgugcacucccua

SEQ ID NO: 498944 - RNA, 15 nt, Homo sapiens
ccuaaaagcacuccu

SEQ ID NO: 498945 - RNA, 22 nt, Homo sapiens
ccuaggcuaccucaagacucac

SEQ ID NO: 498946 - RNA, 22 nt, Homo sapiens
ccuaguacugccccccaugagg

SEQ ID NO: 498947 - RNA, 19 nt, Homo sapiens
ccuauuacuguuucuggag

SEQ ID NO: 498948 - RNA, 17 nt, Homo sapiens
ccucaagacucaccuca

SEQ ID NO: 498949 - RNA, 14 nt, Homo sapiens
ccucacuguguugg

SEQ ID NO: 498950 - RNA, 19 nt, Homo sapiens
ccucagacaauccacucuc

SEQ ID NO: 498951 - RNA, 19 nt, Homo sapiens
ccucaggcugccaggaugg

SEQ ID NO: 498952 - RNA, 20 nt, Homo sapiens
ccucagugccccauucucac

SEQ ID NO: 498953 - RNA, 19 nt, Homo sapiens
ccuccauggcagaagucaa

SEQ ID NO: 498954 - RNA, 16 nt, Homo sapiens
ccucccauagcacugc

SEQ ID NO: 498955 - RNA, 20 nt, Homo sapiens
ccucgggaagccccauccaa

SEQ ID NO: 498956 - RNA, 23 nt, Homo sapiens
ccucgggggaaagcacaccucau

SEQ ID NO: 498957 - RNA, 13 nt, Homo sapiens
ccucuccccucau

SEQ ID NO: 498958 - RNA, 18 nt, Homo sapiens
ccugacggacguccugcu

SEQ ID NO: 498959 - RNA, 19 nt, Homo sapiens
ccugcgagaggucccugcu

SEQ ID NO: 498960 - RNA, 21 nt, Homo sapiens
ccugcguguccccgugcagua

SEQ ID NO: 498961 - RNA, 19 nt, Homo sapiens
ccugcuccaucaugcuuga

SEQ ID NO: 498962 - RNA, 14 nt, Homo sapiens
ccugcugugcccuc

SEQ ID NO: 498963 - RNA, 14 nt, Homo sapiens
ccugcuuaccugac

SEQ ID NO: 498964 - RNA, 21 nt, Homo sapiens
ccugugaucuccacaccaaag

SEQ ID NO: 498965 - RNA, 18 nt, Homo sapiens
ccuuaagggguaucaugu

SEQ ID NO: 498966 - RNA, 22 nt, Homo sapiens
ccuuacuggcuuaccuccucau

SEQ ID NO: 498967 - RNA, 17 nt, Homo sapiens
ccuucccucuucuucuc

SEQ ID NO: 498968 - RNA, 18 nt, Homo sapiens
ccuucuccacacccacuu

SEQ ID NO: 498969 - RNA, 14 nt, Homo sapiens
cgaacaaacugaug

SEQ ID NO: 498970 - RNA, 19 nt, Homo sapiens
cgaccacuuccaggggaac

SEQ ID NO: 498971 - RNA, 14 nt, Homo sapiens
cgagcacugugagc

SEQ ID NO: 498972 - RNA, 23 nt, Homo sapiens
cggccuggggcgagcacugugag

SEQ ID NO: 498973 - RNA, 15 nt, Homo sapiens
cggcugccucaggag

SEQ ID NO: 498974 - RNA, 13 nt, Homo sapiens
cggcuuccaggga

SEQ ID NO: 498975 - RNA, 13 nt, Homo sapiens
cuacaauuguaaa

SEQ ID NO: 498976 - RNA, 12 nt, Homo sapiens
cuaccucaaggg

SEQ ID NO: 498977 - RNA, 21 nt, Homo sapiens
cuaggcaaagacuggccugau

SEQ ID NO: 498978 - RNA, 17 nt, Homo sapiens
cuauaccuuauccauag

SEQ ID NO: 498979 - RNA, 15 nt, Homo sapiens
cuaucccucuccuaa

SEQ ID NO: 498980 - RNA, 13 nt, Homo sapiens
cuauuaauauuca

SEQ ID NO: 498981 - RNA, 13 nt, Homo sapiens
cucaagacucacc

SEQ ID NO: 498982 - RNA, 21 nt, Homo sapiens
cucaauguuuagcagauuuaa

SEQ ID NO: 498983 - RNA, 14 nt, Homo sapiens
cucacgcagacaca

SEQ ID NO: 498984 - RNA, 20 nt, Homo sapiens
cucacucggcuuccagggag

SEQ ID NO: 498985 - RNA, 18 nt, Homo sapiens
cucacuggggucugugug

SEQ ID NO: 498986 - RNA, 15 nt, Homo sapiens
cucagccgugcacuc

SEQ ID NO: 498987 - RNA, 17 nt, Homo sapiens
cucaggggugauucuga

SEQ ID NO: 498988 - RNA, 17 nt, Homo sapiens
cucauccuuaccgcaca

SEQ ID NO: 498989 - RNA, 17 nt, Homo sapiens
cucaugcugagcgcugu

SEQ ID NO: 498990 - RNA, 14 nt, Homo sapiens
cuccccucauggag

SEQ ID NO: 498991 - RNA, 19 nt, Homo sapiens
cuccccucugcccuguaua

SEQ ID NO: 498992 - RNA, 13 nt, Homo sapiens
cuccgcaacagcc

SEQ ID NO: 498993 - RNA, 18 nt, Homo sapiens
cuccuccaucucuggcca

SEQ ID NO: 498994 - RNA, 20 nt, Homo sapiens
cucgggaagccccauccaac

SEQ ID NO: 498995 - RNA, 16 nt, Homo sapiens
cucugggcagcuguca

SEQ ID NO: 498996 - RNA, 21 nt, Homo sapiens
cucugggcagcugucauggaa

SEQ ID NO: 498997 - RNA, 18 nt, Homo sapiens
cucuuuagagaaguccaa

SEQ ID NO: 498998 - RNA, 16 nt, Homo sapiens
cugaaagccuuaggga

SEQ ID NO: 498999 - RNA, 14 nt, Homo sapiens
cugacagugcccag

SEQ ID NO: 499000 - RNA, 22 nt, Homo sapiens
cugacauuaagacacaccucug

SEQ ID NO: 499001 - RNA, 21 nt, Homo sapiens
cugacauuucuucuagugaug

SEQ ID NO: 499002 - RNA, 12 nt, Homo sapiens
agaagcccugau

SEQ ID NO: 499003 - RNA, 16 nt, Homo sapiens
agaaggacaugugcua

SEQ ID NO: 499004 - RNA, 19 nt, Homo sapiens
agaauaccacaucaaauaa

SEQ ID NO: 499005 - RNA, 17 nt, Homo sapiens
agacaauccacucucag

SEQ ID NO: 499006 - RNA, 20 nt, Homo sapiens
agacccuccuauucuauaaa

SEQ ID NO: 499007 - RNA, 11 nt, Homo sapiens
agagacagggu

SEQ ID NO: 499008 - RNA, 17 nt, Homo sapiens
agagauaagucuuucau

SEQ ID NO: 499009 - RNA, 13 nt, Homo sapiens
agagcuagggcug

SEQ ID NO: 499010 - RNA, 21 nt, Homo sapiens
agcaaauguuaaaaguuuuau

SEQ ID NO: 499011 - RNA, 22 nt, Homo sapiens
agcaacaguuaugggacacuga

SEQ ID NO: 499012 - RNA, 15 nt, Homo sapiens
agcaagggcugugcu

SEQ ID NO: 499013 - RNA, 22 nt, Homo sapiens
agcaucuucacuucuaaaugca

SEQ ID NO: 499014 - RNA, 20 nt, Homo sapiens
agcaugaagguggggccagu

SEQ ID NO: 499015 - RNA, 22 nt, Homo sapiens
agcauguguauuuccagugcaa

SEQ ID NO: 499016 - RNA, 14 nt, Homo sapiens
agccaaacaaaggc

SEQ ID NO: 499017 - RNA, 23 nt, Homo sapiens
agccaaacacuguuucuaacuca

SEQ ID NO: 499018 - RNA, 23 nt, Homo sapiens
agccaagguagggucacuaacca

SEQ ID NO: 499019 - RNA, 13 nt, Homo sapiens
agccaccaagaca

SEQ ID NO: 499020 - RNA, 18 nt, Homo sapiens
agccuggaagccaaacaa

SEQ ID NO: 499021 - RNA, 15 nt, Homo sapiens
agcugaggccuugcc

SEQ ID NO: 499022 - RNA, 13 nt, Homo sapiens
agcuggccugaga

SEQ ID NO: 499023 - RNA, 19 nt, Homo sapiens
agcuuaaugcuacauguga

SEQ ID NO: 499024 - RNA, 15 nt, Homo sapiens
aggaaggaacagcaa

SEQ ID NO: 499025 - RNA, 18 nt, Homo sapiens
aggacaccuuuuaacuca

SEQ ID NO: 499026 - RNA, 20 nt, Homo sapiens
aggagaaugaauacugggaa

SEQ ID NO: 499027 - RNA, 18 nt, Homo sapiens
aggauggcgugugugccg

SEQ ID NO: 499028 - RNA, 15 nt, Homo sapiens
aggauuuaaguuuca

SEQ ID NO: 499029 - RNA, 22 nt, Homo sapiens
aggccagugccagcaccugccc

SEQ ID NO: 499030 - RNA, 15 nt, Homo sapiens
aggcccagcagccuu

SEQ ID NO: 499031 - RNA, 13 nt, Homo sapiens
aggcuaccucaag

SEQ ID NO: 499032 - RNA, 12 nt, Homo sapiens
aggcuuacuuca

SEQ ID NO: 499033 - RNA, 21 nt, Homo sapiens
aggcuuuguacagagugcuuu

SEQ ID NO: 499034 - RNA, 17 nt, Homo sapiens
agggcccuccgaccacu

SEQ ID NO: 499035 - RNA, 13 nt, Homo sapiens
agggccucuggga

SEQ ID NO: 499036 - RNA, 18 nt, Homo sapiens
aggggugauucugaaacc

SEQ ID NO: 499037 - RNA, 21 nt, Homo sapiens
aggguaaauaggaaucauuca

SEQ ID NO: 499038 - RNA, 22 nt, Homo sapiens
agggucacuaaccaagccagaa

SEQ ID NO: 499039 - RNA, 14 nt, Homo sapiens
aggucaaguaagaa

SEQ ID NO: 499040 - RNA, 16 nt, Homo sapiens
aggucccugcuuaccu

SEQ ID NO: 499041 - RNA, 21 nt, Homo sapiens
aggugacugaaggcugucagg

SEQ ID NO: 499042 - RNA, 23 nt, Homo sapiens
aguaacugugagaacccaguuuc

SEQ ID NO: 499043 - RNA, 15 nt, Homo sapiens
aguaagaagacauga

SEQ ID NO: 499044 - RNA, 21 nt, Homo sapiens
aguaagguuauaacuguggcu

SEQ ID NO: 499045 - RNA, 14 nt, Homo sapiens
aguaccagugugcu

SEQ ID NO: 499046 - RNA, 20 nt, Homo sapiens
aguaccgcccucggggcccg

SEQ ID NO: 499047 - RNA, 22 nt, Homo sapiens
aguauugccacaaugccucucc

SEQ ID NO: 499048 - RNA, 14 nt, Homo sapiens
aguccaacugucaa

SEQ ID NO: 499049 - RNA, 23 nt, Homo sapiens
aguccuugauuucaaaguuuugu

SEQ ID NO: 499050 - RNA, 14 nt, Homo sapiens
agucuuggcucacu

SEQ ID NO: 499051 - RNA, 20 nt, Homo sapiens
agugcaauuuccccucugug

SEQ ID NO: 499052 - RNA, 15 nt, Homo sapiens
agugcccagcaugaa

SEQ ID NO: 499053 - RNA, 14 nt, Homo sapiens
agugccugagaugc

SEQ ID NO: 499054 - RNA, 16 nt, Homo sapiens
agugugggggguccuu

SEQ ID NO: 499055 - RNA, 14 nt, Homo sapiens
auaaagcauguuca

SEQ ID NO: 499056 - RNA, 15 nt, Homo sapiens
auaaagucucucuga

SEQ ID NO: 499057 - RNA, 16 nt, Homo sapiens
auaauaagcuaaagag

SEQ ID NO: 499058 - RNA, 20 nt, Homo sapiens
auagaacucugggcugccau

SEQ ID NO: 499059 - RNA, 15 nt, Homo sapiens
auauccacagacucc

SEQ ID NO: 499060 - RNA, 15 nt, Homo sapiens
auauugaauguuaaa

SEQ ID NO: 499061 - RNA, 23 nt, Homo sapiens
aucaaacaugcauggaugggucc

SEQ ID NO: 499062 - RNA, 19 nt, Homo sapiens
auccaacacuggaugguca

SEQ ID NO: 499063 - RNA, 16 nt, Homo sapiens
auccacggagcugaag

SEQ ID NO: 499064 - RNA, 22 nt, Homo sapiens
auccagcucuugcucagugaag

SEQ ID NO: 499065 - RNA, 23 nt, Homo sapiens
auccauaggcgcaggugcacagg

SEQ ID NO: 499066 - RNA, 20 nt, Homo sapiens
aucucuggccauauccugcc

SEQ ID NO: 499067 - RNA, 22 nt, Homo sapiens
aucuguuacugaaaugaggaga

SEQ ID NO: 499068 - RNA, 17 nt, Homo sapiens
aucuucuuuggggcccu

SEQ ID NO: 499069 - RNA, 23 nt, Homo sapiens
augacuaaagagagaauguagau

SEQ ID NO: 499070 - RNA, 18 nt, Homo sapiens
augacugccuugccuccu

SEQ ID NO: 499071 - RNA, 15 nt, Homo sapiens
augcuuccugacaau

SEQ ID NO: 499072 - RNA, 15 nt, Homo sapiens
augcuucugcacaca

SEQ ID NO: 499073 - RNA, 21 nt, Homo sapiens
auggcacauggcuggcacuga

SEQ ID NO: 499074 - RNA, 21 nt, Homo sapiens
auggcacucuucccaccucag

SEQ ID NO: 499075 - RNA, 16 nt, Homo sapiens
auggcuggcacugagc

SEQ ID NO: 499076 - RNA, 14 nt, Homo sapiens
augguuuaacauau

SEQ ID NO: 499077 - RNA, 22 nt, Homo sapiens
auguagugugucagaguaacau

SEQ ID NO: 499078 - RNA, 18 nt, Homo sapiens
augucuguagcuccucaa

SEQ ID NO: 499079 - RNA, 19 nt, Homo sapiens
augugagcucuuccuaucc

SEQ ID NO: 499080 - RNA, 23 nt, Homo sapiens
augugcuauugaacugagccaaa

SEQ ID NO: 499081 - RNA, 13 nt, Homo sapiens
auguuaaagggau

SEQ ID NO: 499082 - RNA, 17 nt, Homo sapiens
auuaagcaaauguuaaa

SEQ ID NO: 499083 - RNA, 13 nt, Homo sapiens
auuaagugcaauu

SEQ ID NO: 499084 - RNA, 21 nt, Homo sapiens
auuagagagggcuaaacaagg

SEQ ID NO: 499085 - RNA, 16 nt, Homo sapiens
auucagguaacacuag

SEQ ID NO: 499086 - RNA, 16 nt, Homo sapiens
auuccagaucuuucag

SEQ ID NO: 499087 - RNA, 14 nt, Homo sapiens
auucuuuguuacag

SEQ ID NO: 499088 - RNA, 20 nt, Homo sapiens
auugagugcuccugugugcu

SEQ ID NO: 499089 - RNA, 21 nt, Homo sapiens
auugagugcuccugugugcug

SEQ ID NO: 499090 - RNA, 14 nt, Homo sapiens
auugcauacuuugu

SEQ ID NO: 499091 - RNA, 21 nt, Homo sapiens
auuguuugguaaauguuucuu

SEQ ID NO: 499092 - RNA, 22 nt, Homo sapiens
auuucaaaguuuuguuguacuu

SEQ ID NO: 499093 - RNA, 20 nt, Homo sapiens
auuuccauugcuuauuaugu

SEQ ID NO: 499094 - RNA, 19 nt, Homo sapiens
auuugaggucaaguaagaa

SEQ ID NO: 499095 - RNA, 17 nt, Homo sapiens
auuuuaaggcauauuua

SEQ ID NO: 499096 - RNA, 15 nt, Homo sapiens
auuuuguauguuaaa

SEQ ID NO: 499097 - RNA, 18 nt, Homo sapiens
auuuuuuugcaugcaugc

SEQ ID NO: 499098 - RNA, 23 nt, Homo sapiens
caaaacucucugguuuacuucaa

SEQ ID NO: 499099 - RNA, 23 nt, Homo sapiens
caaaaugcuucugcacacaaaac

SEQ ID NO: 499100 - RNA, 22 nt, Homo sapiens
caaaauuucaaaagugaucugu

SEQ ID NO: 499101 - RNA, 14 nt, Homo sapiens
caaaccgcaggcaa

SEQ ID NO: 499102 - RNA, 17 nt, Homo sapiens
caagacuauaccuuauc

SEQ ID NO: 499103 - RNA, 16 nt, Homo sapiens
caagacucaccucauc

SEQ ID NO: 499104 - RNA, 19 nt, Homo sapiens
caagggggacugucuuuca

SEQ ID NO: 499105 - RNA, 17 nt, Homo sapiens
caaguaagaagacauga

SEQ ID NO: 499106 - RNA, 16 nt, Homo sapiens
caauuauuugaagauu

SEQ ID NO: 499107 - RNA, 18 nt, Homo sapiens
cacaccaaagucagggag

SEQ ID NO: 499108 - RNA, 19 nt, Homo sapiens
cacacccacagaaggacac

SEQ ID NO: 499109 - RNA, 22 nt, Homo sapiens
caccugcguguccccgugcagu

SEQ ID NO: 499110 - RNA, 15 nt, Homo sapiens
cacgaugucaaggac

SEQ ID NO: 499111 - RNA, 15 nt, Homo sapiens
cacgcugaaggcuua

SEQ ID NO: 499112 - RNA, 22 nt, Homo sapiens
cacggagcugaagcugggagcu

SEQ ID NO: 499113 - RNA, 16 nt, Homo sapiens
cacuucuaaaugcaua

SEQ ID NO: 499114 - RNA, 18 nt, Homo sapiens
cacuucuaaaugcauauc

SEQ ID NO: 499115 - RNA, 20 nt, Homo sapiens
cacuugguucuuguacucua

SEQ ID NO: 499116 - RNA, 19 nt, Homo sapiens
aauggaugugcucacuggg

SEQ ID NO: 499117 - RNA, 12 nt, Homo sapiens
aauuaagugcaa

SEQ ID NO: 499118 - RNA, 17 nt, Homo sapiens
aauuauauauacuauau

SEQ ID NO: 499119 - RNA, 18 nt, Homo sapiens
aauucugauugauuugau

SEQ ID NO: 499120 - RNA, 15 nt, Homo sapiens
aauuucaaaagugau

SEQ ID NO: 499121 - RNA, 20 nt, Homo sapiens
aauuucuuuaaauaaaaccc

SEQ ID NO: 499122 - RNA, 16 nt, Homo sapiens
acaaucaaggccacug

SEQ ID NO: 499123 - RNA, 13 nt, Homo sapiens
acaauccacucuc

SEQ ID NO: 499124 - RNA, 14 nt, Homo sapiens
acacagggugcaug

SEQ ID NO: 499125 - RNA, 18 nt, Homo sapiens
acacagggugcaugugag

SEQ ID NO: 499126 - RNA, 15 nt, Homo sapiens
acacccacagaagga

SEQ ID NO: 499127 - RNA, 17 nt, Homo sapiens
acacuagccugugcacg

SEQ ID NO: 499128 - RNA, 15 nt, Homo sapiens
acacuggauggucau

SEQ ID NO: 499129 - RNA, 21 nt, Homo sapiens
acagagcaaugguagcaaaac

SEQ ID NO: 499130 - RNA, 15 nt, Homo sapiens
acagagguggcugcu

SEQ ID NO: 499131 - RNA, 21 nt, Homo sapiens
acagcacuggggagucuuugu

SEQ ID NO: 499132 - RNA, 12 nt, Homo sapiens
acagggugcaug

SEQ ID NO: 499133 - RNA, 17 nt, Homo sapiens
acauauuaggaaaauau

SEQ ID NO: 499134 - RNA, 22 nt, Homo sapiens
acauauuaggaaaauauggguu

SEQ ID NO: 499135 - RNA, 16 nt, Homo sapiens
acauguauguaaauag

SEQ ID NO: 499136 - RNA, 19 nt, Homo sapiens
accaaagccaccaagacag

SEQ ID NO: 499137 - RNA, 20 nt, Homo sapiens
accagcuaacuccagucucc

SEQ ID NO: 499138 - RNA, 19 nt, Homo sapiens
accucagacaauccacucu

SEQ ID NO: 499139 - RNA, 19 nt, Homo sapiens
accugccccccagccuuca

SEQ ID NO: 499140 - RNA, 15 nt, Homo sapiens
acuaaagugucuauu

SEQ ID NO: 499141 - RNA, 15 nt, Homo sapiens
acuaacagauaagca

SEQ ID NO: 499142 - RNA, 23 nt, Homo sapiens
acuaacucaaauacacauuugcu

SEQ ID NO: 499143 - RNA, 14 nt, Homo sapiens
acuagaaacagagg

SEQ ID NO: 499144 - RNA, 17 nt, Homo sapiens
acucagcggucauucua

SEQ ID NO: 499145 - RNA, 17 nt, Homo sapiens
acucaucuuagugccug

SEQ ID NO: 499146 - RNA, 22 nt, Homo sapiens
acucauuucauuccuaacacag

SEQ ID NO: 499147 - RNA, 18 nt, Homo sapiens
auaagcuaaagaggcuga

SEQ ID NO: 499148 - RNA, 13 nt, Homo sapiens
auaagucuuucau

SEQ ID NO: 499149 - RNA, 19 nt, Homo sapiens
auacuuucccacagcacua

SEQ ID NO: 499150 - RNA, 18 nt, Homo sapiens
auaggcgcaggugcacag

SEQ ID NO: 499151 - RNA, 21 nt, Homo sapiens
auauaauacuaaagugucuau

SEQ ID NO: 499152 - RNA, 16 nt, Homo sapiens
auaucgggucacuguc

SEQ ID NO: 499153 - RNA, 17 nt, Homo sapiens
auauuacugacauuucu

SEQ ID NO: 499154 - RNA, 23 nt, Homo sapiens
auauugauugggaaaacauuugc

SEQ ID NO: 499155 - RNA, 14 nt, Homo sapiens
auauuuauguagau

SEQ ID NO: 499156 - RNA, 13 nt, Homo sapiens
aucaguggcugcc

SEQ ID NO: 499157 - RNA, 15 nt, Homo sapiens
aucaguggcugccuu

SEQ ID NO: 499158 - RNA, 22 nt, Homo sapiens
aucccgggccucagugccccau

SEQ ID NO: 499159 - RNA, 22 nt, Homo sapiens
auccuggguacugaaagccuua

SEQ ID NO: 499160 - RNA, 17 nt, Homo sapiens
aucucaaugaaccauaa

SEQ ID NO: 499161 - RNA, 22 nt, Homo sapiens
aucucaaugaaccauaaauuca

SEQ ID NO: 499162 - RNA, 19 nt, Homo sapiens
aucucacacaccagggcau

SEQ ID NO: 499163 - RNA, 17 nt, Homo sapiens
aucuccacaccaaaguc

SEQ ID NO: 499164 - RNA, 23 nt, Homo sapiens
aucuucacuucuaaaugcauauc

SEQ ID NO: 499165 - RNA, 11 nt, Homo sapiens
augacugccuu

SEQ ID NO: 499166 - RNA, 16 nt, Homo sapiens
augacugccuugccuc

SEQ ID NO: 499167 - RNA, 21 nt, Homo sapiens
augauucuuuguuacaggcac

SEQ ID NO: 499168 - RNA, 13 nt, Homo sapiens
augcagcuuugca

SEQ ID NO: 499169 - RNA, 20 nt, Homo sapiens
augcaucuggcucaccgggu

SEQ ID NO: 499170 - RNA, 23 nt, Homo sapiens
auggaaaagcccagugaccugac

SEQ ID NO: 499171 - RNA, 17 nt, Homo sapiens
auggaugugcucacugg

SEQ ID NO: 499172 - RNA, 17 nt, Homo sapiens
auggcacauggcuggca

SEQ ID NO: 499173 - RNA, 14 nt, Homo sapiens
auggcagccuacuc

SEQ ID NO: 499174 - RNA, 18 nt, Homo sapiens
auggcgugugugccguga

SEQ ID NO: 499175 - RNA, 15 nt, Homo sapiens
augguagcaaaacaa

SEQ ID NO: 499176 - RNA, 21 nt, Homo sapiens
augguccuugucccaagccca

SEQ ID NO: 499177 - RNA, 16 nt, Homo sapiens
auguauguaaauagcu

SEQ ID NO: 499178 - RNA, 21 nt, Homo sapiens
augucaguacuauucagguaa

SEQ ID NO: 499179 - RNA, 23 nt, Homo sapiens
augugaagagggagaagcaugaa

SEQ ID NO: 499180 - RNA, 16 nt, Homo sapiens
augugcuauugaacug

SEQ ID NO: 499181 - RNA, 15 nt, Homo sapiens
auguguccucaggga

SEQ ID NO: 499182 - RNA, 18 nt, Homo sapiens
auguuaaagagaaugagu

SEQ ID NO: 499183 - RNA, 16 nt, Homo sapiens
auuauauauacuauau

SEQ ID NO: 499184 - RNA, 14 nt, Homo sapiens
auucaaagcagggu

SEQ ID NO: 499185 - RNA, 21 nt, Homo sapiens
auucacauaacuucucugagu

SEQ ID NO: 499186 - RNA, 13 nt, Homo sapiens
auugccucugaaa

SEQ ID NO: 499187 - RNA, 16 nt, Homo sapiens
auugugaaguacauau

SEQ ID NO: 499188 - RNA, 16 nt, Homo sapiens
auugugcccagcccuu

SEQ ID NO: 499189 - RNA, 22 nt, Homo sapiens
auuuccagaaccacacuugaaa

SEQ ID NO: 499190 - RNA, 19 nt, Homo sapiens
auuucucauugacuuuuau

SEQ ID NO: 499191 - RNA, 14 nt, Homo sapiens
auuugaagauuuaa

SEQ ID NO: 499192 - RNA, 15 nt, Homo sapiens
auuuucacucugggc

SEQ ID NO: 499193 - RNA, 17 nt, Homo sapiens
caaaaugcuucugcaca

SEQ ID NO: 499194 - RNA, 19 nt, Homo sapiens
caaaaugcuucugcacaca

SEQ ID NO: 499195 - RNA, 21 nt, Homo sapiens
caaaauuaagcaaauguuaaa

SEQ ID NO: 499196 - RNA, 22 nt, Homo sapiens
caaagugacacagagcaauggu

SEQ ID NO: 499197 - RNA, 20 nt, Homo sapiens
caagacaagacuauaccuua

SEQ ID NO: 499198 - RNA, 19 nt, Homo sapiens
caagcaagggcugugcuga

SEQ ID NO: 499199 - RNA, 17 nt, Homo sapiens
caaggacuagagcucag

SEQ ID NO: 499200 - RNA, 22 nt, Homo sapiens
caaggagaaugaauacugggaa

SEQ ID NO: 499201 - RNA, 20 nt, Homo sapiens
caagggggacugucuuucag

SEQ ID NO: 499202 - RNA, 23 nt, Homo sapiens
caaggugggccuugcuaccucaa

SEQ ID NO: 499203 - RNA, 24 nt, Homo sapiens
caaguccugggaauaugcuaguga

SEQ ID NO: 499204 - RNA, 17 nt, Homo sapiens
caaucaaggccacugcu

SEQ ID NO: 499205 - RNA, 23 nt, Homo sapiens
caauggugucaguauccaggcuu

SEQ ID NO: 499206 - RNA, 19 nt, Homo sapiens
caauguuuagcagauuuaa

SEQ ID NO: 499207 - RNA, 20 nt, Homo sapiens
cacacagggugcaugugagg

SEQ ID NO: 499208 - RNA, 11 nt, Homo sapiens
cacacuguaaa

SEQ ID NO: 499209 - RNA, 20 nt, Homo sapiens
cacacuguaaauauccacag

SEQ ID NO: 499210 - RNA, 13 nt, Homo sapiens
cacagacucccuc

SEQ ID NO: 499211 - RNA, 19 nt, Homo sapiens
cacauaacuucucugaguc

SEQ ID NO: 499212 - RNA, 15 nt, Homo sapiens
caccaaagucaggga

SEQ ID NO: 499213 - RNA, 15 nt, Homo sapiens
cacccacuuugucca

SEQ ID NO: 499214 - RNA, 21 nt, Homo sapiens
caccuaauguuuaugagccag

SEQ ID NO: 499215 - RNA, 22 nt, Homo sapiens
caccuaauguuuaugagccaga

SEQ ID NO: 499216 - RNA, 13 nt, Homo sapiens
caccugagcauga

SEQ ID NO: 499217 - RNA, 13 nt, Homo sapiens
cacgcugaaggcu

SEQ ID NO: 499218 - RNA, 12 nt, Homo sapiens
cacuagccugug

SEQ ID NO: 499219 - RNA, 16 nt, Homo sapiens
cacuagccugugcacg

SEQ ID NO: 499220 - RNA, 14 nt, Homo sapiens
cacugccucuucca

SEQ ID NO: 499221 - RNA, 18 nt, Homo sapiens
cacuguaaauauccacag

SEQ ID NO: 499222 - RNA, 22 nt, Homo sapiens
cacuguguuggaggauggcacu

SEQ ID NO: 499223 - RNA, 15 nt, Homo sapiens
cacuuuguccauuug

SEQ ID NO: 499224 - RNA, 23 nt, Homo sapiens
cagaaggacacuagccugugcac

SEQ ID NO: 499225 - RNA, 22 nt, Homo sapiens
gaacagcacuggggagucuuug

SEQ ID NO: 499226 - RNA, 23 nt, Homo sapiens
gaacugagccaaacacacuguaa

SEQ ID NO: 499227 - RNA, 18 nt, Homo sapiens
gaauaugcuagugaugua

SEQ ID NO: 499228 - RNA, 17 nt, Homo sapiens
gaaugaauacugggaau

SEQ ID NO: 499229 - RNA, 22 nt, Homo sapiens
gacaagcaagggcugugcugag

SEQ ID NO: 499230 - RNA, 21 nt, Homo sapiens
gacacuagccugugcacgcgc

SEQ ID NO: 499231 - RNA, 17 nt, Homo sapiens
gaccacuuccaggggaa

SEQ ID NO: 499232 - RNA, 15 nt, Homo sapiens
gaccauggaggccag

SEQ ID NO: 499233 - RNA, 18 nt, Homo sapiens
gacccagagagcuagggc

SEQ ID NO: 499234 - RNA, 17 nt, Homo sapiens
gacuagaggcuugcaua

SEQ ID NO: 499235 - RNA, 16 nt, Homo sapiens
gagaauguuguauuca

SEQ ID NO: 499236 - RNA, 12 nt, Homo sapiens
gagcacugugag

SEQ ID NO: 499237 - RNA, 16 nt, Homo sapiens
gagccaaacacacugu

SEQ ID NO: 499238 - RNA, 19 nt, Homo sapiens
gaggaaggaacagcaaugg

SEQ ID NO: 499239 - RNA, 13 nt, Homo sapiens
gaggacaaagugu

SEQ ID NO: 499240 - RNA, 21 nt, Homo sapiens
gaggcaagugugggggguccu

SEQ ID NO: 499241 - RNA, 18 nt, Homo sapiens
gaggcccugcccaaugag

SEQ ID NO: 499242 - RNA, 21 nt, Homo sapiens
gaguccccagaaccagcugca

SEQ ID NO: 499243 - RNA, 20 nt, Homo sapiens
gagucuguacuaaacaguaa

SEQ ID NO: 499244 - RNA, 20 nt, Homo sapiens
gauacaugguugugaccuga

SEQ ID NO: 499245 - RNA, 14 nt, Homo sapiens
gauggguccucacg

SEQ ID NO: 499246 - RNA, 16 nt, Homo sapiens
gaugugacagcccuga

SEQ ID NO: 499247 - RNA, 16 nt, Homo sapiens
gauguguccucaggga

SEQ ID NO: 499248 - RNA, 14 nt, Homo sapiens
gauuagaaugccuc

SEQ ID NO: 499249 - RNA, 17 nt, Homo sapiens
gauugugcccagcccuu

SEQ ID NO: 499250 - RNA, 16 nt, Homo sapiens
gauuuaauccaguuau

SEQ ID NO: 499251 - RNA, 15 nt, Homo sapiens
gauuugccaaaguga

SEQ ID NO: 499252 - RNA, 16 nt, Homo sapiens
gcaaagcuggcuuccu

SEQ ID NO: 499253 - RNA, 17 nt, Homo sapiens
gcaacagccaaguggaa

SEQ ID NO: 499254 - RNA, 16 nt, Homo sapiens
gcaagggcugugcuga

SEQ ID NO: 499255 - RNA, 18 nt, Homo sapiens
gcacagggggaggccaua

SEQ ID NO: 499256 - RNA, 18 nt, Homo sapiens
gcacucuucccaccucag

SEQ ID NO: 499257 - RNA, 17 nt, Homo sapiens
gcacugugagcaccuga

SEQ ID NO: 499258 - RNA, 14 nt, Homo sapiens
gcagaaaacacagc

SEQ ID NO: 499259 - RNA, 11 nt, Homo sapiens
gcagcaaugag

SEQ ID NO: 499260 - RNA, 20 nt, Homo sapiens
gcagccuucugacaagcaag

SEQ ID NO: 499261 - RNA, 23 nt, Homo sapiens
gcagcugucauggaaaagcccag

SEQ ID NO: 499262 - RNA, 20 nt, Homo sapiens
gcaggguucaagccuuccag

SEQ ID NO: 499263 - RNA, 19 nt, Homo sapiens
gcaguaggggcuacuguga

SEQ ID NO: 499264 - RNA, 18 nt, Homo sapiens
gcauaauaagcuaaagag

SEQ ID NO: 499265 - RNA, 16 nt, Homo sapiens
gcauccugugugcuga

SEQ ID NO: 499266 - RNA, 22 nt, Homo sapiens
gcaugcagcuuugcaaacccau

SEQ ID NO: 499267 - RNA, 23 nt, Homo sapiens
gcauucccccuaagaggcaguga

SEQ ID NO: 499268 - RNA, 14 nt, Homo sapiens
gccaaacacacugu

SEQ ID NO: 499269 - RNA, 19 nt, Homo sapiens
gccaaugccccacuggcag

SEQ ID NO: 499270 - RNA, 22 nt, Homo sapiens
gccagaaacguaacugugugca

SEQ ID NO: 499271 - RNA, 15 nt, Homo sapiens
gcccuucugaugaga

SEQ ID NO: 499272 - RNA, 15 nt, Homo sapiens
gcccuuuccuuccag

SEQ ID NO: 499273 - RNA, 13 nt, Homo sapiens
gccguacugucua

SEQ ID NO: 499274 - RNA, 22 nt, Homo sapiens
gccuccucgggggaaagcacac

SEQ ID NO: 499275 - RNA, 13 nt, Homo sapiens
gccucugcuuguu

SEQ ID NO: 499276 - RNA, 14 nt, Homo sapiens
gccucuuccagggc

SEQ ID NO: 499277 - RNA, 14 nt, Homo sapiens
gccuucacugacag

SEQ ID NO: 499278 - RNA, 17 nt, Homo sapiens
gccuugaugacugccuu

SEQ ID NO: 499279 - RNA, 20 nt, Homo sapiens
gcgagcacugugagcaccug

SEQ ID NO: 499280 - RNA, 23 nt, Homo sapiens
gcuaccagguguucuacacucau

SEQ ID NO: 499281 - RNA, 14 nt, Homo sapiens
gcuagagugcagug

SEQ ID NO: 499282 - RNA, 15 nt, Homo sapiens
gcuagagugcagugg

SEQ ID NO: 499283 - RNA, 18 nt, Homo sapiens
gcugaaggcuuacuucag

SEQ ID NO: 499284 - RNA, 22 nt, Homo sapiens
gcugacccaaguguugagggga

SEQ ID NO: 499285 - RNA, 12 nt, Homo sapiens
gcugcagcugug

SEQ ID NO: 499286 - RNA, 15 nt, Homo sapiens
gcuggaaggggucca

SEQ ID NO: 499287 - RNA, 14 nt, Homo sapiens
gcuggcacugagca

SEQ ID NO: 499288 - RNA, 22 nt, Homo sapiens
gcugugcccucccauagcacug

SEQ ID NO: 499289 - RNA, 15 nt, Homo sapiens
gcuuaccaaguccug

SEQ ID NO: 499290 - RNA, 17 nt, Homo sapiens
gcuuaccuccucauggc

SEQ ID NO: 499291 - RNA, 16 nt, Homo sapiens
ggaaagcacaccucau

SEQ ID NO: 499292 - RNA, 12 nt, Homo sapiens
ggaaagccaaac

SEQ ID NO: 499293 - RNA, 13 nt, Homo sapiens
ggaagccaaacaa

SEQ ID NO: 499294 - RNA, 22 nt, Homo sapiens
ggaagccccauccaacacugga

SEQ ID NO: 499295 - RNA, 15 nt, Homo sapiens
ggaauaugcuaguga

SEQ ID NO: 499296 - RNA, 18 nt, Homo sapiens
ggacaccuuuuaacucac

SEQ ID NO: 499297 - RNA, 19 nt, Homo sapiens
ggagaaugaauacugggaa

SEQ ID NO: 499298 - RNA, 16 nt, Homo sapiens
ggaggauggcacuccg

SEQ ID NO: 499299 - RNA, 11 nt, Homo sapiens
ggauggcacuc

SEQ ID NO: 499300 - RNA, 23 nt, Homo sapiens
ggauggcacuccggccaccuccu

SEQ ID NO: 499301 - RNA, 19 nt, Homo sapiens
ggcacucuucccaccucag

SEQ ID NO: 499302 - RNA, 18 nt, Homo sapiens
ggcagaaaacacagccug

SEQ ID NO: 499303 - RNA, 16 nt, Homo sapiens
ggcagcugucauggaa

SEQ ID NO: 499304 - RNA, 16 nt, Homo sapiens
ggccacucuguuggug

SEQ ID NO: 499305 - RNA, 20 nt, Homo sapiens
ggccacucuguugguggccu

SEQ ID NO: 499306 - RNA, 12 nt, Homo sapiens
aaaacauuugcu

SEQ ID NO: 499307 - RNA, 11 nt, Homo sapiens
aaaacucucug

SEQ ID NO: 499308 - RNA, 14 nt, Homo sapiens
aaaagcagcuacca

SEQ ID NO: 499309 - RNA, 16 nt, Homo sapiens
aaaaggauaguaagca

SEQ ID NO: 499310 - RNA, 22 nt, Homo sapiens
aaaagugaucuguccccucucc

SEQ ID NO: 499311 - RNA, 16 nt, Homo sapiens
aaaaguugcagucuca

SEQ ID NO: 499312 - RNA, 11 nt, Homo sapiens
aaacacagccu

SEQ ID NO: 499313 - RNA, 16 nt, Homo sapiens
aaacaccaggauuuaa

SEQ ID NO: 499314 - RNA, 11 nt, Homo sapiens
aaacauuugcu

SEQ ID NO: 499315 - RNA, 15 nt, Homo sapiens
aaaccuaguacugcc

SEQ ID NO: 499316 - RNA, 23 nt, Homo sapiens
aaacugcuucccuuacuuugcug

SEQ ID NO: 499317 - RNA, 17 nt, Homo sapiens
aaacuggcuguuugaua

SEQ ID NO: 499318 - RNA, 23 nt, Homo sapiens
aaagacuuguguccccaccucag

SEQ ID NO: 499319 - RNA, 16 nt, Homo sapiens
aauuauauauacuaua

SEQ ID NO: 499320 - RNA, 12 nt, Homo sapiens
aauuauuugaag

SEQ ID NO: 499321 - RNA, 18 nt, Homo sapiens
aauuauuugaagauuuaa

SEQ ID NO: 499322 - RNA, 15 nt, Homo sapiens
aauugcauacuuugu

SEQ ID NO: 499323 - RNA, 19 nt, Homo sapiens
aauuguacaaaauuaagca

SEQ ID NO: 499324 - RNA, 13 nt, Homo sapiens
aauuuaauaccag

SEQ ID NO: 499325 - RNA, 17 nt, Homo sapiens
aauuuucccucuucacu

SEQ ID NO: 499326 - RNA, 20 nt, Homo sapiens
acaagcaagggcugugcuga

SEQ ID NO: 499327 - RNA, 16 nt, Homo sapiens
acaagcauuuguucca

SEQ ID NO: 499328 - RNA, 14 nt, Homo sapiens
acaauccacucuca

SEQ ID NO: 499329 - RNA, 20 nt, Homo sapiens
acaauuauuugaagauuuaa

SEQ ID NO: 499330 - RNA, 12 nt, Homo sapiens
acacacuguaaa

SEQ ID NO: 499331 - RNA, 17 nt, Homo sapiens
acacagggugcauguga

SEQ ID NO: 499332 - RNA, 19 nt, Homo sapiens
acaccaucacccucugggc

SEQ ID NO: 499333 - RNA, 22 nt, Homo sapiens
acagaggagagaggcucagcca

SEQ ID NO: 499334 - RNA, 20 nt, Homo sapiens
acagagguggcugcugugcu

SEQ ID NO: 499335 - RNA, 13 nt, Homo sapiens
acagcauguguau

SEQ ID NO: 499336 - RNA, 14 nt, Homo sapiens
acagcauguguauu

SEQ ID NO: 499337 - RNA, 16 nt, Homo sapiens
acaggagacccagaga

SEQ ID NO: 499338 - RNA, 17 nt, Homo sapiens
acagggcucccgaguca

SEQ ID NO: 499339 - RNA, 16 nt, Homo sapiens
acauggcuggcacuga

SEQ ID NO: 499340 - RNA, 18 nt, Homo sapiens
acauggcuggcacugagc

SEQ ID NO: 499341 - RNA, 20 nt, Homo sapiens
accaccgaagaggaagcaag

SEQ ID NO: 499342 - RNA, 12 nt, Homo sapiens
accacuuccagg

SEQ ID NO: 499343 - RNA, 23 nt, Homo sapiens
accagugugcuugcccaccacag

SEQ ID NO: 499344 - RNA, 20 nt, Homo sapiens
accaucaauuuuaguuguca

SEQ ID NO: 499345 - RNA, 14 nt, Homo sapiens
acccacuuugucca

SEQ ID NO: 499346 - RNA, 20 nt, Homo sapiens
acccgagcuagagugcagug

SEQ ID NO: 499347 - RNA, 15 nt, Homo sapiens
acccucacuguguug

SEQ ID NO: 499348 - RNA, 23 nt, Homo sapiens
accuaguacugccccccaugagg

SEQ ID NO: 499349 - RNA, 12 nt, Homo sapiens
accugagcauga

SEQ ID NO: 499350 - RNA, 23 nt, Homo sapiens
accuuauccauaggcgcaggugc

SEQ ID NO: 499351 - RNA, 15 nt, Homo sapiens
accuuccacacaggg

SEQ ID NO: 499352 - RNA, 18 nt, Homo sapiens
accuuggacugacuacca

SEQ ID NO: 499353 - RNA, 19 nt, Homo sapiens
acgaagaguucccuugaaa

SEQ ID NO: 499354 - RNA, 16 nt, Homo sapiens
acgugcgcgaugugac

SEQ ID NO: 499355 - RNA, 22 nt, Homo sapiens
acguuuauaaacagaaauggaa

SEQ ID NO: 499356 - RNA, 18 nt, Homo sapiens
acuagaggcuugcauaau

SEQ ID NO: 499357 - RNA, 14 nt, Homo sapiens
acuauaaacuacug

SEQ ID NO: 499358 - RNA, 18 nt, Homo sapiens
acucaaauacacauuugc

SEQ ID NO: 499359 - RNA, 16 nt, Homo sapiens
acucuaggguccagug

SEQ ID NO: 499360 - RNA, 20 nt, Homo sapiens
acucuaggguccaguggaug

SEQ ID NO: 499361 - RNA, 20 nt, Homo sapiens
acucucugguuuacuucaaa

SEQ ID NO: 499362 - RNA, 19 nt, Homo sapiens
acucugggcugccauguga

SEQ ID NO: 499363 - RNA, 20 nt, Homo sapiens
acugagcaguaccagugugc

SEQ ID NO: 499364 - RNA, 16 nt, Homo sapiens
acuggcaggcagcaga

SEQ ID NO: 499365 - RNA, 21 nt, Homo sapiens
acuggcuuaccuccucauggc

SEQ ID NO: 499366 - RNA, 19 nt, Homo sapiens
acuuaaaugguaauaagca

SEQ ID NO: 499367 - RNA, 19 nt, Homo sapiens
acuuccaggggaaccugcc

SEQ ID NO: 499368 - RNA, 15 nt, Homo sapiens
acuuccgagcuaugu

SEQ ID NO: 499369 - RNA, 21 nt, Homo sapiens
acuucuuaguaugugcauuua

SEQ ID NO: 499370 - RNA, 22 nt, Homo sapiens
acuuguguccccaccucaggcu

SEQ ID NO: 499371 - RNA, 15 nt, Homo sapiens
acuuuguauuuugau

SEQ ID NO: 499372 - RNA, 22 nt, Homo sapiens
agaaacagagguggcugcugug

SEQ ID NO: 499373 - RNA, 20 nt, Homo sapiens
agaacaaaagcgacccauuc

SEQ ID NO: 499374 - RNA, 22 nt, Homo sapiens
agaagcccugauguguccucag

SEQ ID NO: 499375 - RNA, 21 nt, Homo sapiens
agaaugaauacugggaaucaa

SEQ ID NO: 499376 - RNA, 22 nt, Homo sapiens
agaauggaugugcucacugggg

SEQ ID NO: 499377 - RNA, 19 nt, Homo sapiens
agacgugcgcgaugugaca

SEQ ID NO: 499378 - RNA, 22 nt, Homo sapiens
agacucaccucauccuuaccgc

SEQ ID NO: 499379 - RNA, 19 nt, Homo sapiens
agagaaggacaugugcuau

SEQ ID NO: 499380 - RNA, 13 nt, Homo sapiens
agaggcagugaga

SEQ ID NO: 499381 - RNA, 21 nt, Homo sapiens
agagguggcugcugugcuagu

SEQ ID NO: 499382 - RNA, 13 nt, Homo sapiens
agauaagcaagag

SEQ ID NO: 499383 - RNA, 19 nt, Homo sapiens
agauauugugaaguacaua

SEQ ID NO: 499384 - RNA, 20 nt, Homo sapiens
agaucaaacaugcauggaug

SEQ ID NO: 499385 - RNA, 17 nt, Homo sapiens
agauugugcccagcccu

SEQ ID NO: 499386 - RNA, 13 nt, Homo sapiens
agcaaaacaagga

SEQ ID NO: 499387 - RNA, 18 nt, Homo sapiens
agcaagggcugugcugag

SEQ ID NO: 499388 - RNA, 14 nt, Homo sapiens
agcacgcugaaggc

SEQ ID NO: 499389 - RNA, 20 nt, Homo sapiens
agcacugccucuuccagggc

SEQ ID NO: 499390 - RNA, 17 nt, Homo sapiens
agcacugugagcaccug

SEQ ID NO: 499391 - RNA, 21 nt, Homo sapiens
agcagauuuaagauauguaac

SEQ ID NO: 499392 - RNA, 22 nt, Homo sapiens
agcaggcuggagcccagcauuc

SEQ ID NO: 499393 - RNA, 19 nt, Homo sapiens
agcaggguucugaggcaaa

SEQ ID NO: 499394 - RNA, 17 nt, Homo sapiens
agcaguaccagugugcu

SEQ ID NO: 499395 - RNA, 15 nt, Homo sapiens
agcaugcagcuuugc

SEQ ID NO: 499396 - RNA, 16 nt, Homo sapiens
agccacacaggaagaa

SEQ ID NO: 499397 - RNA, 20 nt, Homo sapiens
agccagaaacguaacugugu

SEQ ID NO: 499398 - RNA, 22 nt, Homo sapiens
agcccagcuuggcccuuuccuu

SEQ ID NO: 499399 - RNA, 18 nt, Homo sapiens
agcccugauguguccuca

SEQ ID NO: 499400 - RNA, 17 nt, Homo sapiens
agccuucugacaagcaa

SEQ ID NO: 499401 - RNA, 23 nt, Homo sapiens
agcgcuguguuaggcacaggcug

SEQ ID NO: 499402 - RNA, 17 nt, Homo sapiens
agcuaacuccagucucc

SEQ ID NO: 499403 - RNA, 23 nt, Homo sapiens
agcuaccagguguucuacacuca

SEQ ID NO: 499404 - RNA, 13 nt, Homo sapiens
agcuacuaaugau

SEQ ID NO: 499405 - RNA, 19 nt, Homo sapiens
agcuagagugcaguggugc

SEQ ID NO: 499406 - RNA, 17 nt, Homo sapiens
agcucagccgugcacuc

SEQ ID NO: 499407 - RNA, 18 nt, Homo sapiens
agcucagccgugcacucc

SEQ ID NO: 499408 - RNA, 13 nt, Homo sapiens
agcuggguggugu

SEQ ID NO: 499409 - RNA, 13 nt, Homo sapiens
aggaaaaugccuc

SEQ ID NO: 499410 - RNA, 13 nt, Homo sapiens
aggaaccuuccuu

SEQ ID NO: 499411 - RNA, 17 nt, Homo sapiens
aggaagcaagaaagccg

SEQ ID NO: 499412 - RNA, 20 nt, Homo sapiens
aggcagcagaaaucauuuuc

SEQ ID NO: 499413 - RNA, 21 nt, Homo sapiens
aggcagugauuugccaaagug

SEQ ID NO: 499414 - RNA, 16 nt, Homo sapiens
aggcauccugugugcu

SEQ ID NO: 499415 - RNA, 18 nt, Homo sapiens
aggcccagaaagaggcag

SEQ ID NO: 499416 - RNA, 18 nt, Homo sapiens
aggcuggagcccagcauu

SEQ ID NO: 499417 - RNA, 23 nt, Homo sapiens
aggcugucaggauucuucaagga

SEQ ID NO: 499418 - RNA, 20 nt, Homo sapiens
aggcuuuguacagagugcuu

SEQ ID NO: 499419 - RNA, 15 nt, Homo sapiens
agggagaagcaugaa

SEQ ID NO: 499420 - RNA, 14 nt, Homo sapiens
aggguccaguggau

SEQ ID NO: 499421 - RNA, 21 nt, Homo sapiens
aggugggccuugcuaccucaa

SEQ ID NO: 499422 - RNA, 14 nt, Homo sapiens
aguaagaauaccac

SEQ ID NO: 499423 - RNA, 15 nt, Homo sapiens
aguaagauaucucaa

SEQ ID NO: 499424 - RNA, 20 nt, Homo sapiens
aguaagguuauaacuguggc

SEQ ID NO: 499425 - RNA, 17 nt, Homo sapiens
aguaggggcuacuguga

SEQ ID NO: 499426 - RNA, 18 nt, Homo sapiens
aguaggggcuacugugac

SEQ ID NO: 499427 - RNA, 15 nt, Homo sapiens
aguaugugcauuuaa

SEQ ID NO: 499428 - RNA, 13 nt, Homo sapiens
agucaugcacuca

SEQ ID NO: 499429 - RNA, 14 nt, Homo sapiens
agucaugcacucag

SEQ ID NO: 499430 - RNA, 22 nt, Homo sapiens
agugaaguuuuacugucuauua

SEQ ID NO: 499431 - RNA, 22 nt, Homo sapiens
agugagggucuucuuacaugca

SEQ ID NO: 499432 - RNA, 16 nt, Homo sapiens
agugauguacgagcug

SEQ ID NO: 499433 - RNA, 13 nt, Homo sapiens
aguugcagucuca

SEQ ID NO: 499434 - RNA, 10 nt, Homo sapiens
aguuuuuacu

SEQ ID NO: 499435 - RNA, 17 nt, Homo sapiens
auaaaauuuuuauguaa

SEQ ID NO: 499436 - RNA, 22 nt, Homo sapiens
auaaagaucaaacaugcaugga

SEQ ID NO: 499437 - RNA, 14 nt, Homo sapiens
auaaagucucucug

SEQ ID NO: 499438 - RNA, 15 nt, Homo sapiens
auaacuucucugagu

SEQ ID NO: 499439 - RNA, 21 nt, Homo sapiens
auaagaagaaguucaugucca

SEQ ID NO: 499440 - RNA, 12 nt, Homo sapiens
auaccuuaucca

SEQ ID NO: 499441 - RNA, 17 nt, Homo sapiens
auacugggaaucaagac

SEQ ID NO: 499442 - RNA, 21 nt, Homo sapiens
auacuucaugaaauccugggu

SEQ ID NO: 499443 - RNA, 20 nt, Homo sapiens
auagauccuauuacuguuuc

SEQ ID NO: 499444 - RNA, 14 nt, Homo sapiens
aucaacucuaauag

SEQ ID NO: 499445 - RNA, 23 nt, Homo sapiens
aucaccaucaauuuuaguuguca

SEQ ID NO: 499446 - RNA, 23 nt, Homo sapiens
aucauguauggugauagguaucu

SEQ ID NO: 499447 - RNA, 20 nt, Homo sapiens
auccagcucuugcucaguga

SEQ ID NO: 499448 - RNA, 14 nt, Homo sapiens
auccaggcuuugua

SEQ ID NO: 499449 - RNA, 15 nt, Homo sapiens
aucuagagcuuaaug

SEQ ID NO: 499450 - RNA, 20 nt, Homo sapiens
aucucuuuagagaaguccaa

SEQ ID NO: 499451 - RNA, 18 nt, Homo sapiens
augaaagaaaauugaguu

SEQ ID NO: 499452 - RNA, 12 nt, Homo sapiens
augacuaaagag

SEQ ID NO: 499453 - RNA, 19 nt, Homo sapiens
augcaaaugagcucugaaa

SEQ ID NO: 499454 - RNA, 18 nt, Homo sapiens
augcauauccugagccau

SEQ ID NO: 499455 - RNA, 16 nt, Homo sapiens
augccaggaaccuguc

SEQ ID NO: 499456 - RNA, 17 nt, Homo sapiens
augcuaauuuuauuaua

SEQ ID NO: 499457 - RNA, 17 nt, Homo sapiens
augcugagcgcuguguu

SEQ ID NO: 499458 - RNA, 22 nt, Homo sapiens
augcuuaccaaguccugggaau

SEQ ID NO: 499459 - RNA, 22 nt, Homo sapiens
auggcuggaagggguccagccu

SEQ ID NO: 499460 - RNA, 17 nt, Homo sapiens
auguaauuauauauacu

SEQ ID NO: 499461 - RNA, 20 nt, Homo sapiens
auguagaggcuuguuuaccu

SEQ ID NO: 499462 - RNA, 14 nt, Homo sapiens
augucaguacuauu

SEQ ID NO: 499463 - RNA, 22 nt, Homo sapiens
augucuguagcuccucaacuca

SEQ ID NO: 499464 - RNA, 21 nt, Homo sapiens
augugagcucuuccuaucccu

SEQ ID NO: 499465 - RNA, 16 nt, Homo sapiens
auguuuagcagauuua

SEQ ID NO: 499466 - RNA, 15 nt, Homo sapiens
auguuuaugagccag

SEQ ID NO: 499467 - RNA, 12 nt, Homo sapiens
auuaagugcaau

SEQ ID NO: 499468 - RNA, 14 nt, Homo sapiens
auuaauguuuucaa

SEQ ID NO: 499469 - RNA, 23 nt, Homo sapiens
auucagugagggucuucuuacau

SEQ ID NO: 499470 - RNA, 18 nt, Homo sapiens
auucccccuaagaggcag

SEQ ID NO: 499471 - RNA, 16 nt, Homo sapiens
auucuuuucucagugu

SEQ ID NO: 499472 - RNA, 15 nt, Homo sapiens
auugcauacuuugua

SEQ ID NO: 499473 - RNA, 19 nt, Homo sapiens
auugucagcuacuaaugau

SEQ ID NO: 499474 - RNA, 20 nt, Homo sapiens
auuguguugggaccugugau

SEQ ID NO: 499475 - RNA, 15 nt, Homo sapiens
auuuaagauauguaa

SEQ ID NO: 499476 - RNA, 22 nt, Homo sapiens
auuuaauuacuucuuaguaugu

SEQ ID NO: 499477 - RNA, 13 nt, Homo sapiens
auuugccaaagug

SEQ ID NO: 499478 - RNA, 14 nt, Homo sapiens
caaaagugaucugu

SEQ ID NO: 499479 - RNA, 13 nt, Homo sapiens
caaacacacugua

SEQ ID NO: 499480 - RNA, 16 nt, Homo sapiens
caaacacacuguaaau

SEQ ID NO: 499481 - RNA, 15 nt, Homo sapiens
caaacugcuucccuu

SEQ ID NO: 499482 - RNA, 17 nt, Homo sapiens
caaauacacauuugcua

SEQ ID NO: 499483 - RNA, 16 nt, Homo sapiens
caaauauauuuuggaa

SEQ ID NO: 499484 - RNA, 13 nt, Homo sapiens
caacaacaaggac

SEQ ID NO: 499485 - RNA, 22 nt, Homo sapiens
caacaauuauuugaagauuuaa

SEQ ID NO: 499486 - RNA, 19 nt, Homo sapiens
caacaugguccuuguccca

SEQ ID NO: 499487 - RNA, 14 nt, Homo sapiens
caacccucacugug

SEQ ID NO: 499488 - RNA, 17 nt, Homo sapiens
caacccucacuguguug

SEQ ID NO: 499489 - RNA, 16 nt, Homo sapiens
caagacuauaccuuau

SEQ ID NO: 499490 - RNA, 18 nt, Homo sapiens
caagagauaagucuuuca

SEQ ID NO: 499491 - RNA, 13 nt, Homo sapiens
caagggcagugag

SEQ ID NO: 499492 - RNA, 19 nt, Homo sapiens
caaggugggccuugcuacc

SEQ ID NO: 499493 - RNA, 18 nt, Homo sapiens
caauuauuugaagauuua

SEQ ID NO: 499494 - RNA, 10 nt, Homo sapiens
cacaccucau

SEQ ID NO: 499495 - RNA, 22 nt, Homo sapiens
cacacuguaaauauccacagac

SEQ ID NO: 499496 - RNA, 23 nt, Homo sapiens
cacaggcugggauggagcacuuc

SEQ ID NO: 499497 - RNA, 20 nt, Homo sapiens
cacccgagcuagagugcagu

SEQ ID NO: 499498 - RNA, 15 nt, Homo sapiens
caccucagugcccac

SEQ ID NO: 499499 - RNA, 13 nt, Homo sapiens
caccucauccuua

SEQ ID NO: 499500 - RNA, 13 nt, Homo sapiens
caccucuggaucc

SEQ ID NO: 499501 - RNA, 14 nt, Homo sapiens
caccuuuuaacuca

SEQ ID NO: 499502 - RNA, 17 nt, Homo sapiens
cacucuucccaccucag

SEQ ID NO: 499503 - RNA, 18 nt, Homo sapiens
cacuggcagcaucuucac

SEQ ID NO: 499504 - RNA, 15 nt, Homo sapiens
cacugugagcaccug

SEQ ID NO: 499505 - RNA, 12 nt, Homo sapiens
cacuuccagggg

SEQ ID NO: 499506 - RNA, 16 nt, Homo sapiens
cagaaaacacagccug

SEQ ID NO: 499507 - RNA, 20 nt, Homo sapiens
cagaaaacacagccugugua

SEQ ID NO: 499508 - RNA, 20 nt, Homo sapiens
cagaagaaaaaguugcaguc

SEQ ID NO: 499509 - RNA, 23 nt, Homo sapiens
cagaagaaaaaguugcagucuca

SEQ ID NO: 499510 - RNA, 12 nt, Homo sapiens
cagaagcccuga

SEQ ID NO: 499511 - RNA, 21 nt, Homo sapiens
ugcaguaggggcuacugugac

SEQ ID NO: 499512 - RNA, 12 nt, Homo sapiens
ugccacaaugcc

SEQ ID NO: 499513 - RNA, 14 nt, Homo sapiens
ugccacaaugccuc

SEQ ID NO: 499514 - RNA, 20 nt, Homo sapiens
ugccaugccaggaaccuguc

SEQ ID NO: 499515 - RNA, 13 nt, Homo sapiens
ugccaugugaaga

SEQ ID NO: 499516 - RNA, 15 nt, Homo sapiens
ugcccaccacagcga

SEQ ID NO: 499517 - RNA, 18 nt, Homo sapiens
ugcccugugagggcucac

SEQ ID NO: 499518 - RNA, 14 nt, Homo sapiens
ugccgugacagggc

SEQ ID NO: 499519 - RNA, 15 nt, Homo sapiens
ugccugagaugcacg

SEQ ID NO: 499520 - RNA, 16 nt, Homo sapiens
ugccugcuccaagaaa

SEQ ID NO: 499521 - RNA, 16 nt, Homo sapiens
ugccuugccuccucag

SEQ ID NO: 499522 - RNA, 20 nt, Homo sapiens
ugcugggcccuggccuggau

SEQ ID NO: 499523 - RNA, 18 nt, Homo sapiens
ugcuggggguuucuguag

SEQ ID NO: 499524 - RNA, 16 nt, Homo sapiens
ugcuuccugacaauca

SEQ ID NO: 499525 - RNA, 15 nt, Homo sapiens
ugcuucugcacacaa

SEQ ID NO: 499526 - RNA, 18 nt, Homo sapiens
ugcuucugcacacaaaac

SEQ ID NO: 499527 - RNA, 18 nt, Homo sapiens
ugcuugauugagugcucc

SEQ ID NO: 499528 - RNA, 19 nt, Homo sapiens
uggaaaaggaagacuagag

SEQ ID NO: 499529 - RNA, 23 nt, Homo sapiens
uggaagaggaacagcacugggga

SEQ ID NO: 499530 - RNA, 15 nt, Homo sapiens
uggcaccucagacaa

SEQ ID NO: 499531 - RNA, 21 nt, Homo sapiens
uggcagcaucuucacuucuaa

SEQ ID NO: 499532 - RNA, 20 nt, Homo sapiens
uggccuaggcuaccucaaga

SEQ ID NO: 499533 - RNA, 16 nt, Homo sapiens
uggcugggaacaacuu

SEQ ID NO: 499534 - RNA, 24 nt, Homo sapiens
uggcugggaacaacuucaguccaa

SEQ ID NO: 499535 - RNA, 16 nt, Homo sapiens
uggcuguaaacuauaa

SEQ ID NO: 499536 - RNA, 15 nt, Homo sapiens
ugggagacuggaaaa

SEQ ID NO: 499537 - RNA, 20 nt, Homo sapiens
ugggagacuggaaaagggaa

SEQ ID NO: 499538 - RNA, 18 nt, Homo sapiens
ugggcagcugucauggaa

SEQ ID NO: 499539 - RNA, 21 nt, Homo sapiens
ugggcugucagcccaugugca

SEQ ID NO: 499540 - RNA, 17 nt, Homo sapiens
uggggccuugaugacug

SEQ ID NO: 499541 - RNA, 19 nt, Homo sapiens
ugggggucagucacuugaa

SEQ ID NO: 499542 - RNA, 21 nt, Homo sapiens
uggguacugaaagccuuaggg

SEQ ID NO: 499543 - RNA, 14 nt, Homo sapiens
uggugucaguaucc

SEQ ID NO: 499544 - RNA, 19 nt, Homo sapiens
uguaaacuauaaacuacug

SEQ ID NO: 499545 - RNA, 23 nt, Homo sapiens
uguaaacuauaaacuacuguaau

SEQ ID NO: 499546 - RNA, 15 nt, Homo sapiens
uguacagagugcuuu

SEQ ID NO: 499547 - RNA, 17 nt, Homo sapiens
uguacagauucuuucag

SEQ ID NO: 499548 - RNA, 17 nt, Homo sapiens
uguagcuccucaacuca

SEQ ID NO: 499549 - RNA, 16 nt, Homo sapiens
uguagugugucagagu

SEQ ID NO: 499550 - RNA, 14 nt, Homo sapiens
uguaugacuaaaga

SEQ ID NO: 499551 - RNA, 21 nt, Homo sapiens
uguauguaaauagcuaagaua

SEQ ID NO: 499552 - RNA, 17 nt, Homo sapiens
uguauuuccagugcaau

SEQ ID NO: 499553 - RNA, 20 nt, Homo sapiens
uguauuuccagugcaauugu

SEQ ID NO: 499554 - RNA, 14 nt, Homo sapiens
uguccccaccucag

SEQ ID NO: 499555 - RNA, 22 nt, Homo sapiens
uguccccucuccccucauggag

SEQ ID NO: 499556 - RNA, 16 nt, Homo sapiens
ugucccugaaaccuag

SEQ ID NO: 499557 - RNA, 16 nt, Homo sapiens
uguccuucuccaucua

SEQ ID NO: 499558 - RNA, 17 nt, Homo sapiens
ugugauccuucaucgaa

SEQ ID NO: 499559 - RNA, 23 nt, Homo sapiens
ugugcacgcgcgcgugcacacac

SEQ ID NO: 499560 - RNA, 17 nt, Homo sapiens
ugugcuauugaacugag

SEQ ID NO: 499561 - RNA, 18 nt, Homo sapiens
ugugcuugcccaccacag

SEQ ID NO: 499562 - RNA, 16 nt, Homo sapiens
uguggugcccaugagg

SEQ ID NO: 499563 - RNA, 19 nt, Homo sapiens
uguguauuuccagugcaau

SEQ ID NO: 499564 - RNA, 19 nt, Homo sapiens
uguugguggccucugcuug

SEQ ID NO: 499565 - RNA, 13 nt, Homo sapiens
uguuucuaacuca

SEQ ID NO: 499566 - RNA, 23 nt, Homo sapiens
uguuugccaggacaugcaauaaa

SEQ ID NO: 499567 - RNA, 21 nt, Homo sapiens
uuaaagaaguaaauuugucca

SEQ ID NO: 499568 - RNA, 16 nt, Homo sapiens
uuaaauaaagucucuc

SEQ ID NO: 499569 - RNA, 15 nt, Homo sapiens
uuaaggggaagaaug

SEQ ID NO: 499570 - RNA, 20 nt, Homo sapiens
uuacaauaggaguggugauu

SEQ ID NO: 499571 - RNA, 12 nt, Homo sapiens
uuagaaugccuc

SEQ ID NO: 499572 - RNA, 14 nt, Homo sapiens
uuauacaugugaua

SEQ ID NO: 499573 - RNA, 20 nt, Homo sapiens
uuauggggacagcauaccuu

SEQ ID NO: 499574 - RNA, 15 nt, Homo sapiens
uucaaagcaggguuc

SEQ ID NO: 499575 - RNA, 16 nt, Homo sapiens
uucacagcacuuacaa

SEQ ID NO: 499576 - RNA, 17 nt, Homo sapiens
uucauacuucaugaaau

SEQ ID NO: 499577 - RNA, 21 nt, Homo sapiens
uucauuccuaacacagcaugu

SEQ ID NO: 499578 - RNA, 15 nt, Homo sapiens
uuccagaucuuucag

SEQ ID NO: 499579 - RNA, 19 nt, Homo sapiens
uuccagcccaucuccgggg

SEQ ID NO: 499580 - RNA, 16 nt, Homo sapiens
uuccauuaugauucuu

SEQ ID NO: 499581 - RNA, 19 nt, Homo sapiens
uucuccgcaacagccaagu

SEQ ID NO: 499582 - RNA, 17 nt, Homo sapiens
uucuuacaugcauuuga

SEQ ID NO: 499583 - RNA, 19 nt, Homo sapiens
uucuuuaaauaaaacccuu

SEQ ID NO: 499584 - RNA, 21 nt, Homo sapiens
uugaaacuuugggaaaacaug

SEQ ID NO: 499585 - RNA, 17 nt, Homo sapiens
uugccaggacaugcaau

SEQ ID NO: 499586 - RNA, 10 nt, Homo sapiens
uuggggacuc

SEQ ID NO: 499587 - RNA, 20 nt, Homo sapiens
uuuagcagauuuaagauaug

SEQ ID NO: 499588 - RNA, 22 nt, Homo sapiens
uuucaaaagguauuauacaugu

SEQ ID NO: 499589 - RNA, 22 nt, Homo sapiens
uuucauuccuaacacagcaugu

SEQ ID NO: 499590 - RNA, 12 nt, Homo sapiens
uuuccacaccau

SEQ ID NO: 499591 - RNA, 17 nt, Homo sapiens
uuucuaacucaggggug

SEQ ID NO: 499592 - RNA, 17 nt, Homo sapiens
uuugcaugcaugcaaau

SEQ ID NO: 499593 - RNA, 21 nt, Homo sapiens
uuugccaaagugacacagagc

SEQ ID NO: 499594 - RNA, 18 nt, Homo sapiens
uuugccaggacaugcaau

SEQ ID NO: 499595 - RNA, 22 nt, Homo sapiens
uuuggauucuaaauacaugcca

SEQ ID NO: 499596 - RNA, 17 nt, Homo sapiens
uuuguagcguacaucaa

SEQ ID NO: 499597 - RNA, 17 nt, Homo sapiens
uuuguuugccaggacau

SEQ ID NO: 499598 - RNA, 12 nt, Homo sapiens
uuuuccuauaau

SEQ ID NO: 499599 - RNA, 19 nt, Homo sapiens
uuuucucaguguugguaua

SEQ ID NO: 499600 - RNA, 15 nt, Homo sapiens
cugagccaaacacac

SEQ ID NO: 499601 - RNA, 21 nt, Homo sapiens
cugaggcccagaaagaggcag

SEQ ID NO: 499602 - RNA, 18 nt, Homo sapiens
cugccuacaaaauggaga

SEQ ID NO: 499603 - RNA, 13 nt, Homo sapiens
cugcuuguuggcu

SEQ ID NO: 499604 - RNA, 18 nt, Homo sapiens
cuggaagggguccagccu

SEQ ID NO: 499605 - RNA, 15 nt, Homo sapiens
cuggagggacaggga

SEQ ID NO: 499606 - RNA, 12 nt, Homo sapiens
cugggaagacaa

SEQ ID NO: 499607 - RNA, 21 nt, Homo sapiens
cugggugguguacaagcauuu

SEQ ID NO: 499608 - RNA, 23 nt, Homo sapiens
cugguaggaaggauaucggguca

SEQ ID NO: 499609 - RNA, 17 nt, Homo sapiens
cuguaaacuauaaacua

SEQ ID NO: 499610 - RNA, 20 nt, Homo sapiens
cuguagagccgcauggcacu

SEQ ID NO: 499611 - RNA, 14 nt, Homo sapiens
cuguccagugccua

SEQ ID NO: 499612 - RNA, 23 nt, Homo sapiens
cuguccccucuccccucauggag

SEQ ID NO: 499613 - RNA, 19 nt, Homo sapiens
cuguccuaaggaaccuucc

SEQ ID NO: 499614 - RNA, 21 nt, Homo sapiens
cugucuguagagccgcauggc

SEQ ID NO: 499615 - RNA, 22 nt, Homo sapiens
cugugcccucccauagcacugc

SEQ ID NO: 499616 - RNA, 12 nt, Homo sapiens
cugugugcugac

SEQ ID NO: 499617 - RNA, 17 nt, Homo sapiens
cuguuucuaacucaggg

SEQ ID NO: 499618 - RNA, 10 nt, Homo sapiens
cuucacugac

SEQ ID NO: 499619 - RNA, 11 nt, Homo sapiens
cuucacugaca

SEQ ID NO: 499620 - RNA, 18 nt, Homo sapiens
cuucaguccaacugucaa

SEQ ID NO: 499621 - RNA, 19 nt, Homo sapiens
cuuccagggauuugccuca

SEQ ID NO: 499622 - RNA, 18 nt, Homo sapiens
cuuccaggggaaccugcc

SEQ ID NO: 499623 - RNA, 14 nt, Homo sapiens
cuucggcaucuucu

SEQ ID NO: 499624 - RNA, 13 nt, Homo sapiens
cuugaaucuguua

SEQ ID NO: 499625 - RNA, 14 nt, Homo sapiens
cuugaguucccaga

SEQ ID NO: 499626 - RNA, 20 nt, Homo sapiens
cuugauugagugcuccugug

SEQ ID NO: 499627 - RNA, 18 nt, Homo sapiens
cuuugggauucuuuccau

SEQ ID NO: 499628 - RNA, 13 nt, Homo sapiens
gaaaacauuugcu

SEQ ID NO: 499629 - RNA, 16 nt, Homo sapiens
gaaaauauggguugca

SEQ ID NO: 499630 - RNA, 16 nt, Homo sapiens
gaaaggaaagccaaac

SEQ ID NO: 499631 - RNA, 15 nt, Homo sapiens
gaacagcacugggga

SEQ ID NO: 499632 - RNA, 16 nt, Homo sapiens
gaacauagaacucugg

SEQ ID NO: 499633 - RNA, 15 nt, Homo sapiens
gaagccccauccaac

SEQ ID NO: 499634 - RNA, 19 nt, Homo sapiens
gaagcugggagcuacaggg

SEQ ID NO: 499635 - RNA, 21 nt, Homo sapiens
gaaggacacuagccugugcac

SEQ ID NO: 499636 - RNA, 21 nt, Homo sapiens
gaauacugggaaucaagacaa

SEQ ID NO: 499637 - RNA, 20 nt, Homo sapiens
gaauauuaucaguggcugcc

SEQ ID NO: 499638 - RNA, 19 nt, Homo sapiens
gacaagcaagggcugugcu

SEQ ID NO: 499639 - RNA, 21 nt, Homo sapiens
gacaauauuccagaucuuuca

SEQ ID NO: 499640 - RNA, 18 nt, Homo sapiens
gacaggagacccagagag

SEQ ID NO: 499641 - RNA, 18 nt, Homo sapiens
gaccugaccggcaccugc

SEQ ID NO: 499642 - RNA, 16 nt, Homo sapiens
gaccuuccacacaggg

SEQ ID NO: 499643 - RNA, 16 nt, Homo sapiens
gacggccacucuguug

SEQ ID NO: 499644 - RNA, 15 nt, Homo sapiens
gacuagagcucaggc

SEQ ID NO: 499645 - RNA, 18 nt, Homo sapiens
gacuagaggcuugcauaa

SEQ ID NO: 499646 - RNA, 17 nt, Homo sapiens
gacucuuaacauuagag

SEQ ID NO: 499647 - RNA, 13 nt, Homo sapiens
gagacucuagggu

SEQ ID NO: 499648 - RNA, 18 nt, Homo sapiens
gagacucuaggguccagu

SEQ ID NO: 499649 - RNA, 12 nt, Homo sapiens
gagagauguuuu

SEQ ID NO: 499650 - RNA, 11 nt, Homo sapiens
gagcacuguga

SEQ ID NO: 499651 - RNA, 18 nt, Homo sapiens
gagcccagcauucagggg

SEQ ID NO: 499652 - RNA, 16 nt, Homo sapiens
gagccuggaagccaaa

SEQ ID NO: 499653 - RNA, 17 nt, Homo sapiens
gaggcucagccacacag

SEQ ID NO: 499654 - RNA, 20 nt, Homo sapiens
gaggcucagccacacaggaa

SEQ ID NO: 499655 - RNA, 19 nt, Homo sapiens
gagggcugggggcugaccc

SEQ ID NO: 499656 - RNA, 14 nt, Homo sapiens
gaggggaccaaagc

SEQ ID NO: 499657 - RNA, 15 nt, Homo sapiens
gagggucuucuuaca

SEQ ID NO: 499658 - RNA, 17 nt, Homo sapiens
gaguaacaugccagcuu

SEQ ID NO: 499659 - RNA, 19 nt, Homo sapiens
gaguaacaugccagcuucc

SEQ ID NO: 499660 - RNA, 16 nt, Homo sapiens
gauauugaauguuaaa

SEQ ID NO: 499661 - RNA, 16 nt, Homo sapiens
gaugagaaaggccuga

SEQ ID NO: 499662 - RNA, 12 nt, Homo sapiens
gauugagugcuc

SEQ ID NO: 499663 - RNA, 22 nt, Homo sapiens
gauuugauugggaugaaugcca

SEQ ID NO: 499664 - RNA, 11 nt, Homo sapiens
gauuugccuca

SEQ ID NO: 499665 - RNA, 15 nt, Homo sapiens
gcaagggcugugcug

SEQ ID NO: 499666 - RNA, 18 nt, Homo sapiens
gcacauggcuggcacuga

SEQ ID NO: 499667 - RNA, 17 nt, Homo sapiens
gcaccucagacaaucca

SEQ ID NO: 499668 - RNA, 22 nt, Homo sapiens
gcagaagucaacgccucggugg

SEQ ID NO: 499669 - RNA, 14 nt, Homo sapiens
gcagauuuaagaua

SEQ ID NO: 499670 - RNA, 23 nt, Homo sapiens
gcagcccgaagcccaguuucccu

SEQ ID NO: 499671 - RNA, 14 nt, Homo sapiens
gcauaccuuggacu

SEQ ID NO: 499672 - RNA, 16 nt, Homo sapiens
gcauguguauuuccag

SEQ ID NO: 499673 - RNA, 19 nt, Homo sapiens
gcauuacugggaagacaau

SEQ ID NO: 499674 - RNA, 14 nt, Homo sapiens
gccacaaugccucu

SEQ ID NO: 499675 - RNA, 13 nt, Homo sapiens
gccaccaagacag

SEQ ID NO: 499676 - RNA, 19 nt, Homo sapiens
gccagcaccugcccagugg

SEQ ID NO: 499677 - RNA, 18 nt, Homo sapiens
gccagugccagcaccugc

SEQ ID NO: 499678 - RNA, 13 nt, Homo sapiens
gccaugccaggaa

SEQ ID NO: 499679 - RNA, 18 nt, Homo sapiens
gcccagaaagaggcagug

SEQ ID NO: 499680 - RNA, 16 nt, Homo sapiens
gcccaugugcaccugc

SEQ ID NO: 499681 - RNA, 22 nt, Homo sapiens
gccccccagccuucacugacag

SEQ ID NO: 499682 - RNA, 19 nt, Homo sapiens
gccuacaucccgggccuca

SEQ ID NO: 499683 - RNA, 20 nt, Homo sapiens
gccuccauggcagaagucaa

SEQ ID NO: 499684 - RNA, 17 nt, Homo sapiens
gccucccaaagugcugg

SEQ ID NO: 499685 - RNA, 20 nt, Homo sapiens
gccuggaagccaaacaaagg

SEQ ID NO: 499686 - RNA, 13 nt, Homo sapiens
gccuucacugaca

SEQ ID NO: 499687 - RNA, 19 nt, Homo sapiens
gccuuucuccgcaacagcc

SEQ ID NO: 499688 - RNA, 17 nt, Homo sapiens
gcgaaaggaaagccaaa

SEQ ID NO: 499689 - RNA, 13 nt, Homo sapiens
gcgagcacuguga

SEQ ID NO: 499690 - RNA, 21 nt, Homo sapiens
gcgagcacugugagcaccuga

SEQ ID NO: 499691 - RNA, 20 nt, Homo sapiens
gcggucauucuacacugagg

SEQ ID NO: 499692 - RNA, 23 nt, Homo sapiens
gcguggcaacccucacuguguug

SEQ ID NO: 499693 - RNA, 16 nt, Homo sapiens
gcucacucggcuucca

SEQ ID NO: 499694 - RNA, 14 nt, Homo sapiens
gcucaguagccuuu

SEQ ID NO: 499695 - RNA, 13 nt, Homo sapiens
gcuccggggccag

SEQ ID NO: 499696 - RNA, 22 nt, Homo sapiens
gcuccuccccuuccucuugucu

SEQ ID NO: 499697 - RNA, 11 nt, Homo sapiens
gcugugcugag

SEQ ID NO: 499698 - RNA, 17 nt, Homo sapiens
gcuucucuuucucugag

SEQ ID NO: 499699 - RNA, 19 nt, Homo sapiens
gcuuggcccuuuccuucca

SEQ ID NO: 499700 - RNA, 15 nt, Homo sapiens
gcuuguuggcuuccg

SEQ ID NO: 499701 - RNA, 14 nt, Homo sapiens
ggaaaagcccagug

SEQ ID NO: 499702 - RNA, 19 nt, Homo sapiens
ggaaaaugccuccauggca

SEQ ID NO: 499703 - RNA, 17 nt, Homo sapiens
ggaaccuguccuaagga

SEQ ID NO: 499704 - RNA, 21 nt, Homo sapiens
ggaagacgugcgcgaugugac

SEQ ID NO: 499705 - RNA, 18 nt, Homo sapiens
ggaagcggcccuaaggga

SEQ ID NO: 499706 - RNA, 21 nt, Homo sapiens
ggaaggaacagcaaugguguc

SEQ ID NO: 499707 - RNA, 14 nt, Homo sapiens
ggacaugugcuauu

SEQ ID NO: 499708 - RNA, 18 nt, Homo sapiens
ggaccuuccacacagggu

SEQ ID NO: 499709 - RNA, 23 nt, Homo sapiens
ggacuggcuucucuuucucugag

SEQ ID NO: 499710 - RNA, 18 nt, Homo sapiens
ggagccaucagcugggug

SEQ ID NO: 499711 - RNA, 20 nt, Homo sapiens
ggaggccagugccagcaccu

SEQ ID NO: 499712 - RNA, 15 nt, Homo sapiens
ggauggguccucacg

SEQ ID NO: 499713 - RNA, 15 nt, Homo sapiens
ggauucaauuuuaag

SEQ ID NO: 499714 - RNA, 19 nt, Homo sapiens
ggcaacccucacuguguug

SEQ ID NO: 499715 - RNA, 12 nt, Homo sapiens
uccggcugccuc

SEQ ID NO: 499716 - RNA, 17 nt, Homo sapiens
uccuagaauggaugugc

SEQ ID NO: 499717 - RNA, 22 nt, Homo sapiens
uccucugacuggagucuaggaa

SEQ ID NO: 499718 - RNA, 18 nt, Homo sapiens
uccugcuuaaucuucaaa

SEQ ID NO: 499719 - RNA, 14 nt, Homo sapiens
uccuggcugggaac

SEQ ID NO: 499720 - RNA, 17 nt, Homo sapiens
uccugggaauaugcuag

SEQ ID NO: 499721 - RNA, 13 nt, Homo sapiens
uccugugugcuga

SEQ ID NO: 499722 - RNA, 17 nt, Homo sapiens
ucuaaauacaugccaca

SEQ ID NO: 499723 - RNA, 14 nt, Homo sapiens
ucuaacucaggggu

SEQ ID NO: 499724 - RNA, 13 nt, Homo sapiens
ucuaggguccagu

SEQ ID NO: 499725 - RNA, 22 nt, Homo sapiens
ucucaauguuuagcagauuuaa

SEQ ID NO: 499726 - RNA, 16 nt, Homo sapiens
ucugcacacaaaacuc

SEQ ID NO: 499727 - RNA, 23 nt, Homo sapiens
ucugggagguuacugucugguag

SEQ ID NO: 499728 - RNA, 14 nt, Homo sapiens
ucugggcugucagc

SEQ ID NO: 499729 - RNA, 22 nt, Homo sapiens
ucugggcugucagcccaugugc

SEQ ID NO: 499730 - RNA, 16 nt, Homo sapiens
ucugguuuacuucaaa

SEQ ID NO: 499731 - RNA, 22 nt, Homo sapiens
ucugucuguagagccgcauggc

SEQ ID NO: 499732 - RNA, 18 nt, Homo sapiens
ucuucacuucuaaaugca

SEQ ID NO: 499733 - RNA, 13 nt, Homo sapiens
ucuucacuugguu

SEQ ID NO: 499734 - RNA, 13 nt, Homo sapiens
ucuuccagcccau

SEQ ID NO: 499735 - RNA, 19 nt, Homo sapiens
ucuuccagggccucuggga

SEQ ID NO: 499736 - RNA, 20 nt, Homo sapiens
ucuuccagggccucugggag

SEQ ID NO: 499737 - RNA, 14 nt, Homo sapiens
ucuucccaccucag

SEQ ID NO: 499738 - RNA, 21 nt, Homo sapiens
ucuucccaccucagugcccac

SEQ ID NO: 499739 - RNA, 19 nt, Homo sapiens
ucuucuuacaugcauuuga

SEQ ID NO: 499740 - RNA, 17 nt, Homo sapiens
ucuugguaauccccuaa

SEQ ID NO: 499741 - RNA, 20 nt, Homo sapiens
ugaacugagccaaacacacu

SEQ ID NO: 499742 - RNA, 17 nt, Homo sapiens
ugaagaaaggaacugag

SEQ ID NO: 499743 - RNA, 16 nt, Homo sapiens
ugaaggcuuacuucag

SEQ ID NO: 499744 - RNA, 17 nt, Homo sapiens
ugaagguggggccagug

SEQ ID NO: 499745 - RNA, 12 nt, Homo sapiens
ugaaugcuuccu

SEQ ID NO: 499746 - RNA, 17 nt, Homo sapiens
ugaauguauaaagacac

SEQ ID NO: 499747 - RNA, 23 nt, Homo sapiens
ugacaagcaagggcugugcugag

SEQ ID NO: 499748 - RNA, 18 nt, Homo sapiens
ugacauuaagacacaccu

SEQ ID NO: 499749 - RNA, 16 nt, Homo sapiens
ugaccgaguaccugcu

SEQ ID NO: 499750 - RNA, 16 nt, Homo sapiens
ugacuaccagcuaacu

SEQ ID NO: 499751 - RNA, 18 nt, Homo sapiens
ugacugaaggcugucagg

SEQ ID NO: 499752 - RNA, 17 nt, Homo sapiens
ugagacucuagggucca

SEQ ID NO: 499753 - RNA, 23 nt, Homo sapiens
ugagauguagccuggcccuggaa

SEQ ID NO: 499754 - RNA, 14 nt, Homo sapiens
ugagcgcuguguua

SEQ ID NO: 499755 - RNA, 16 nt, Homo sapiens
ugaggaaggaacagca

SEQ ID NO: 499756 - RNA, 20 nt, Homo sapiens
ugaggagagaaggacaugug

SEQ ID NO: 499757 - RNA, 21 nt, Homo sapiens
ugauugggaaaacauuugcug

SEQ ID NO: 499758 - RNA, 19 nt, Homo sapiens
ugcacgcgcgcgugcacac

SEQ ID NO: 499759 - RNA, 14 nt, Homo sapiens
ugcauaauaagcua

SEQ ID NO: 499760 - RNA, 18 nt, Homo sapiens
ugcauaauaagcuaaaga

SEQ ID NO: 499761 - RNA, 16 nt, Homo sapiens
ugcauuuuugugaaau

SEQ ID NO: 499762 - RNA, 13 nt, Homo sapiens
ugccacaaugccu

SEQ ID NO: 499763 - RNA, 20 nt, Homo sapiens
ugcccuguauauaauacuaa

SEQ ID NO: 499764 - RNA, 21 nt, Homo sapiens
ugccuugaaggggcagcugug

SEQ ID NO: 499765 - RNA, 13 nt, Homo sapiens
ugcgcguccugcc

SEQ ID NO: 499766 - RNA, 15 nt, Homo sapiens
ugcuauugaacugag

SEQ ID NO: 499767 - RNA, 19 nt, Homo sapiens
ugcuccaucaugcuugauu

SEQ ID NO: 499768 - RNA, 23 nt, Homo sapiens
ugcugugcccucccauagcacug

SEQ ID NO: 499769 - RNA, 17 nt, Homo sapiens
uggaagaggaacagcac

SEQ ID NO: 499770 - RNA, 15 nt, Homo sapiens
uggaagggguccagc

SEQ ID NO: 499771 - RNA, 17 nt, Homo sapiens
uggaauccuacagccuc

SEQ ID NO: 499772 - RNA, 14 nt, Homo sapiens
uggagggacaggga

SEQ ID NO: 499773 - RNA, 14 nt, Homo sapiens
uggaugugcucacu

SEQ ID NO: 499774 - RNA, 15 nt, Homo sapiens
uggccauuguguugg

SEQ ID NO: 499775 - RNA, 14 nt, Homo sapiens
uggcugcugugcua

SEQ ID NO: 499776 - RNA, 23 nt, Homo sapiens
uggcugcuguugcuuaaaccacu

SEQ ID NO: 499777 - RNA, 17 nt, Homo sapiens
uggcuggaaggggucca

SEQ ID NO: 499778 - RNA, 14 nt, Homo sapiens
uggcuggcacugag

SEQ ID NO: 499779 - RNA, 21 nt, Homo sapiens
ugggagccugacagugcccag

SEQ ID NO: 499780 - RNA, 18 nt, Homo sapiens
uggggacagcauaccuug

SEQ ID NO: 499781 - RNA, 19 nt, Homo sapiens
uggguacugaaagccuuag

SEQ ID NO: 499782 - RNA, 23 nt, Homo sapiens
uggguacugaaagccuuagggaa

SEQ ID NO: 499783 - RNA, 23 nt, Homo sapiens
uggucaagggcugucauugcaca

SEQ ID NO: 499784 - RNA, 13 nt, Homo sapiens
uguacuccucuga

SEQ ID NO: 499785 - RNA, 18 nt, Homo sapiens
uguacugugucucaugga

SEQ ID NO: 499786 - RNA, 12 nt, Homo sapiens
uguagauauugu

SEQ ID NO: 499787 - RNA, 20 nt, Homo sapiens
ugucagcuacuaaugauguu

SEQ ID NO: 499788 - RNA, 15 nt, Homo sapiens
uguccagugccuaca

SEQ ID NO: 499789 - RNA, 15 nt, Homo sapiens
uguccauuugcaaau

SEQ ID NO: 499790 - RNA, 17 nt, Homo sapiens
ugucuauguugugaucc

SEQ ID NO: 499791 - RNA, 20 nt, Homo sapiens
ugugucagaguaacaugcca

SEQ ID NO: 499792 - RNA, 19 nt, Homo sapiens
uguguccccaccucaggcu

SEQ ID NO: 499793 - RNA, 18 nt, Homo sapiens
ugugugccgugacagggc

SEQ ID NO: 499794 - RNA, 13 nt, Homo sapiens
uguguugggaccu

SEQ ID NO: 499795 - RNA, 15 nt, Homo sapiens
uguuccaugccugcu

SEQ ID NO: 499796 - RNA, 13 nt, Homo sapiens
uguucuacacuca

SEQ ID NO: 499797 - RNA, 21 nt, Homo sapiens
uuaaauaaagucucucugacu

SEQ ID NO: 499798 - RNA, 17 nt, Homo sapiens
uuaaauuuaauaccaga

SEQ ID NO: 499799 - RNA, 16 nt, Homo sapiens
uuaacaaaauuugaau

SEQ ID NO: 499800 - RNA, 14 nt, Homo sapiens
uuaagacacaccuc

SEQ ID NO: 499801 - RNA, 20 nt, Homo sapiens
uuaauuacuucuuaguaugu

SEQ ID NO: 499802 - RNA, 15 nt, Homo sapiens
uuaccaaguccuggg

SEQ ID NO: 499803 - RNA, 21 nt, Homo sapiens
uuacuaaacauguauguaaau

SEQ ID NO: 499804 - RNA, 16 nt, Homo sapiens
uuauaguaaugugacu

SEQ ID NO: 499805 - RNA, 14 nt, Homo sapiens
uucauaacaucgaa

SEQ ID NO: 499806 - RNA, 19 nt, Homo sapiens
uuccagggauuugccucac

SEQ ID NO: 499807 - RNA, 12 nt, Homo sapiens
uucccaccucag

SEQ ID NO: 499808 - RNA, 23 nt, Homo sapiens
uucugaggcccugcccaaugaga

SEQ ID NO: 499809 - RNA, 19 nt, Homo sapiens
uucugggguugcuccgggg

SEQ ID NO: 499810 - RNA, 20 nt, Homo sapiens
uugaagaaaggaacugaggc

SEQ ID NO: 499811 - RNA, 14 nt, Homo sapiens
uugagagacagggu

SEQ ID NO: 499812 - RNA, 19 nt, Homo sapiens
uuguacaaaauuaagcaaa

SEQ ID NO: 499813 - RNA, 17 nt, Homo sapiens
uuguuggaaaguaacug

SEQ ID NO: 499814 - RNA, 17 nt, Homo sapiens
uuguuugccaggacaug

SEQ ID NO: 499815 - RNA, 14 nt, Homo sapiens
uuuaauaccagaua

SEQ ID NO: 499816 - RNA, 16 nt, Homo sapiens
uuuccccucugugucc

SEQ ID NO: 499817 - RNA, 15 nt, Homo sapiens
uuugcaugcaugcaa

SEQ ID NO: 499818 - RNA, 21 nt, Homo sapiens
uuuguuugccaggacaugcaa

SEQ ID NO: 499819 - RNA, 15 nt, Homo sapiens
uuuuaauuuacuugu

SEQ ID NO: 499820 - RNA, 15 nt, Homo sapiens
uuuucccucuucacu

SEQ ID NO: 499821 - RNA, 19 nt, Homo sapiens
gccucaccuuggggccuug

SEQ ID NO: 499822 - RNA, 20 nt, Homo sapiens
gccucaccuuggggccuuga

SEQ ID NO: 499823 - RNA, 12 nt, Homo sapiens
gccugcugugcc

SEQ ID NO: 499824 - RNA, 17 nt, Homo sapiens
gcgacccauucagagac

SEQ ID NO: 499825 - RNA, 14 nt, Homo sapiens
gcgcgcgugcacac

SEQ ID NO: 499826 - RNA, 13 nt, Homo sapiens
gcggccucuugcu

SEQ ID NO: 499827 - RNA, 17 nt, Homo sapiens
gcggcuucaccugcgug

SEQ ID NO: 499828 - RNA, 17 nt, Homo sapiens
gcuaacuccagucuccu

SEQ ID NO: 499829 - RNA, 19 nt, Homo sapiens
gcuagagugcaguggugca

SEQ ID NO: 499830 - RNA, 12 nt, Homo sapiens
gcuagugccuga

SEQ ID NO: 499831 - RNA, 22 nt, Homo sapiens
gcugcuuccuggcugggaacaa

SEQ ID NO: 499832 - RNA, 23 nt, Homo sapiens
gcuguaaacuauaaacuacugua

SEQ ID NO: 499833 - RNA, 17 nt, Homo sapiens
gcuuaaugcuacaugug

SEQ ID NO: 499834 - RNA, 23 nt, Homo sapiens
ggaacagcacuggggagucuuug

SEQ ID NO: 499835 - RNA, 19 nt, Homo sapiens
ggaagacuagaggcuugca

SEQ ID NO: 499836 - RNA, 18 nt, Homo sapiens
ggaagcaagaaagccgua

SEQ ID NO: 499837 - RNA, 21 nt, Homo sapiens
ggacaaaguguagcagccucc

SEQ ID NO: 499838 - RNA, 22 nt, Homo sapiens
ggacguccugcuggcaccucag

SEQ ID NO: 499839 - RNA, 17 nt, Homo sapiens
ggagaagcaugaaaaag

SEQ ID NO: 499840 - RNA, 21 nt, Homo sapiens
ggagggcccuccgaccacuuc

SEQ ID NO: 499841 - RNA, 16 nt, Homo sapiens
ggaggugggagacaag

SEQ ID NO: 499842 - RNA, 13 nt, Homo sapiens
ggauggagcacuu

SEQ ID NO: 499843 - RNA, 20 nt, Homo sapiens
ggcaagugugggggguccuu

SEQ ID NO: 499844 - RNA, 16 nt, Homo sapiens
ggcacauggcuggcac

SEQ ID NO: 499845 - RNA, 22 nt, Homo sapiens
ggcagaaaacacagccugugua

SEQ ID NO: 499846 - RNA, 21 nt, Homo sapiens
ggcagagaagccccuaggcaa

SEQ ID NO: 499847 - RNA, 16 nt, Homo sapiens
ggcauacagacugggg

SEQ ID NO: 499848 - RNA, 18 nt, Homo sapiens
ggccagugccagcaccug

SEQ ID NO: 499849 - RNA, 14 nt, Homo sapiens
ggcgagcacuguga

SEQ ID NO: 499850 - RNA, 16 nt, Homo sapiens
ggcuggaaggggucca

SEQ ID NO: 499851 - RNA, 20 nt, Homo sapiens
ggggaagcggcccuaaggga

SEQ ID NO: 499852 - RNA, 18 nt, Homo sapiens
gggugggccagauccaaa

SEQ ID NO: 499853 - RNA, 13 nt, Homo sapiens
gguaaauguuucu

SEQ ID NO: 499854 - RNA, 12 nt, Homo sapiens
cagaucuuucag

SEQ ID NO: 499855 - RNA, 14 nt, Homo sapiens
cagcauucaggggu

SEQ ID NO: 499856 - RNA, 14 nt, Homo sapiens
cagcccaugugcac

SEQ ID NO: 499857 - RNA, 20 nt, Homo sapiens
cagcccaugugcaccugccc

SEQ ID NO: 499858 - RNA, 19 nt, Homo sapiens
cagcccccuaaaagcacuc

SEQ ID NO: 499859 - RNA, 18 nt, Homo sapiens
cagcuaacuccagucucc

SEQ ID NO: 499860 - RNA, 17 nt, Homo sapiens
caggauuuaaguuucac

SEQ ID NO: 499861 - RNA, 20 nt, Homo sapiens
caggcugggauggagcacuu

SEQ ID NO: 499862 - RNA, 13 nt, Homo sapiens
cagggcagggaaa

SEQ ID NO: 499863 - RNA, 20 nt, Homo sapiens
cagggccucugggagccuga

SEQ ID NO: 499864 - RNA, 14 nt, Homo sapiens
cagggugcauguga

SEQ ID NO: 499865 - RNA, 15 nt, Homo sapiens
caggguucugaggca

SEQ ID NO: 499866 - RNA, 22 nt, Homo sapiens
cagguguucuacacucaucuua

SEQ ID NO: 499867 - RNA, 20 nt, Homo sapiens
caguauccaggcuuuguaca

SEQ ID NO: 499868 - RNA, 18 nt, Homo sapiens
cagugagaagacuggcag

SEQ ID NO: 499869 - RNA, 16 nt, Homo sapiens
cagugccagcaccugc

SEQ ID NO: 499870 - RNA, 15 nt, Homo sapiens
cagugcccacagcca

SEQ ID NO: 499871 - RNA, 22 nt, Homo sapiens
cagugccccauucucacugcua

SEQ ID NO: 499872 - RNA, 22 nt, Homo sapiens
caguggaugccacagcccagcu

SEQ ID NO: 499873 - RNA, 14 nt, Homo sapiens
cauaacuucucuga

SEQ ID NO: 499874 - RNA, 12 nt, Homo sapiens
cauacagacugg

SEQ ID NO: 499875 - RNA, 15 nt, Homo sapiens
cauacuuucccacag

SEQ ID NO: 499876 - RNA, 19 nt, Homo sapiens
cauacuuucccacagcacu

SEQ ID NO: 499877 - RNA, 15 nt, Homo sapiens
cauauccugagccau

SEQ ID NO: 499878 - RNA, 13 nt, Homo sapiens
cauccaacacugg

SEQ ID NO: 499879 - RNA, 15 nt, Homo sapiens
cauccaacacuggau

SEQ ID NO: 499880 - RNA, 15 nt, Homo sapiens
cauccugugugcuga

SEQ ID NO: 499881 - RNA, 15 nt, Homo sapiens
caugcacucaggcag

SEQ ID NO: 499882 - RNA, 11 nt, Homo sapiens
caugcauuuga

SEQ ID NO: 499883 - RNA, 17 nt, Homo sapiens
cauggaaaagcccagug

SEQ ID NO: 499884 - RNA, 15 nt, Homo sapiens
cauggagaaacaucc

SEQ ID NO: 499885 - RNA, 21 nt, Homo sapiens
cauguuaaugacaauauucca

SEQ ID NO: 499886 - RNA, 13 nt, Homo sapiens
cauucuacacuga

SEQ ID NO: 499887 - RNA, 18 nt, Homo sapiens
cauugcacauaagcuucc

SEQ ID NO: 499888 - RNA, 22 nt, Homo sapiens
cauugcuuuugggagacuggaa

SEQ ID NO: 499889 - RNA, 23 nt, Homo sapiens
cauugcuuuugggagacuggaaa

SEQ ID NO: 499890 - RNA, 16 nt, Homo sapiens
ccaaacacacuguaaa

SEQ ID NO: 499891 - RNA, 15 nt, Homo sapiens
ccaaagccaccaaga

SEQ ID NO: 499892 - RNA, 15 nt, Homo sapiens
ccaaagugacacaga

SEQ ID NO: 499893 - RNA, 16 nt, Homo sapiens
ccaaagugacacagag

SEQ ID NO: 499894 - RNA, 22 nt, Homo sapiens
ccacagcacuacgauguguuga

SEQ ID NO: 499895 - RNA, 12 nt, Homo sapiens
ccacggagcuga

SEQ ID NO: 499896 - RNA, 18 nt, Homo sapiens
ccagaaagaggcagugau

SEQ ID NO: 499897 - RNA, 17 nt, Homo sapiens
ccagggauuugccucac

SEQ ID NO: 499898 - RNA, 15 nt, Homo sapiens
ccagugccagcaccu

SEQ ID NO: 499899 - RNA, 14 nt, Homo sapiens
ccagugccuacauc

SEQ ID NO: 499900 - RNA, 14 nt, Homo sapiens
ccaguggaugccac

SEQ ID NO: 499901 - RNA, 19 nt, Homo sapiens
ccaugaggaaggaacagca

SEQ ID NO: 499902 - RNA, 15 nt, Homo sapiens
ccaugugcaccugcc

SEQ ID NO: 499903 - RNA, 15 nt, Homo sapiens
ccauucagagacugu

SEQ ID NO: 499904 - RNA, 14 nt, Homo sapiens
cccaccucaggcug

SEQ ID NO: 499905 - RNA, 24 nt, Homo sapiens
ccccagaaccagcugcagauggag

SEQ ID NO: 499906 - RNA, 16 nt, Homo sapiens
ccccauucucacugcu

SEQ ID NO: 499907 - RNA, 16 nt, Homo sapiens
ccccuaagaggcagug

SEQ ID NO: 499908 - RNA, 18 nt, Homo sapiens
cccgagcuagagugcagu

SEQ ID NO: 499909 - RNA, 18 nt, Homo sapiens
cccucuccccucauggag

SEQ ID NO: 499910 - RNA, 12 nt, Homo sapiens
ccgaagcccagu

SEQ ID NO: 499911 - RNA, 23 nt, Homo sapiens
ccgcagaagcccugauguguccu

SEQ ID NO: 499912 - RNA, 12 nt, Homo sapiens
ccgugacagggc

SEQ ID NO: 499913 - RNA, 16 nt, Homo sapiens
ccuaagaggcagugag

SEQ ID NO: 499914 - RNA, 16 nt, Homo sapiens
ccuaaggaaccuuccu

SEQ ID NO: 499915 - RNA, 15 nt, Homo sapiens
ccuaggcuaccucaa

SEQ ID NO: 499916 - RNA, 22 nt, Homo sapiens
ccuccugucuuagccucccaaa

SEQ ID NO: 499917 - RNA, 23 nt, Homo sapiens
ccucgaacuccuggucucaagca

SEQ ID NO: 499918 - RNA, 22 nt, Homo sapiens
ccucuuccagggccucugggag

SEQ ID NO: 499919 - RNA, 22 nt, Homo sapiens
ccugacauuaagacacaccucu

SEQ ID NO: 499920 - RNA, 14 nt, Homo sapiens
ccugauguguccuc

SEQ ID NO: 499921 - RNA, 23 nt, Homo sapiens
ccuggaacuagaaacagaggugg

SEQ ID NO: 499922 - RNA, 18 nt, Homo sapiens
ccuggaagccaaacaaag

SEQ ID NO: 499923 - RNA, 17 nt, Homo sapiens
ccuggggcgagcacugu

SEQ ID NO: 499924 - RNA, 20 nt, Homo sapiens
ccuggggcgagcacugugag

SEQ ID NO: 499925 - RNA, 16 nt, Homo sapiens
ccuggguuuucuuaac

SEQ ID NO: 499926 - RNA, 16 nt, Homo sapiens
ccuguauauaauacua

SEQ ID NO: 499927 - RNA, 22 nt, Homo sapiens
ccugugugcugacaggagaccc

SEQ ID NO: 499928 - RNA, 19 nt, Homo sapiens
ccuuaagagucauccagcu

SEQ ID NO: 499929 - RNA, 19 nt, Homo sapiens
ccuuaagggguaucaugua

SEQ ID NO: 499930 - RNA, 21 nt, Homo sapiens
ccuuaucagcuucauacuuca

SEQ ID NO: 499931 - RNA, 16 nt, Homo sapiens
ccuuccacacagggug

SEQ ID NO: 499932 - RNA, 12 nt, Homo sapiens
cgaagcccaguu

SEQ ID NO: 499933 - RNA, 15 nt, Homo sapiens
cgagcacugugagca

SEQ ID NO: 499934 - RNA, 23 nt, Homo sapiens
cgaugauguacagauucuuucag

SEQ ID NO: 499935 - RNA, 20 nt, Homo sapiens
cgcagacacacccacagaag

SEQ ID NO: 499936 - RNA, 22 nt, Homo sapiens
cgcugcagcuguguguccuucu

SEQ ID NO: 499937 - RNA, 22 nt, Homo sapiens
cggccuggggcgagcacuguga

SEQ ID NO: 499938 - RNA, 13 nt, Homo sapiens
cgggccucagugc

SEQ ID NO: 499939 - RNA, 14 nt, Homo sapiens
cgggggaaagcaca

SEQ ID NO: 499940 - RNA, 13 nt, Homo sapiens
cgugcacucccua

SEQ ID NO: 499941 - RNA, 23 nt, Homo sapiens
cgugcaguaggggcuacugugac

SEQ ID NO: 499942 - RNA, 18 nt, Homo sapiens
cuaaacaagggcagugag

SEQ ID NO: 499943 - RNA, 15 nt, Homo sapiens
cuaacuccagucucc

SEQ ID NO: 499944 - RNA, 19 nt, Homo sapiens
cuacaauuguaaacuaguu

SEQ ID NO: 499945 - RNA, 17 nt, Homo sapiens
cuacaucccgggccuca

SEQ ID NO: 499946 - RNA, 16 nt, Homo sapiens
cuaccucaagacucac

SEQ ID NO: 499947 - RNA, 18 nt, Homo sapiens
cuagagugcaguggugca

SEQ ID NO: 499948 - RNA, 20 nt, Homo sapiens
cuaggcuaccucaagacuca

SEQ ID NO: 499949 - RNA, 21 nt, Homo sapiens
cuagggcuggagggacaggga

SEQ ID NO: 499950 - RNA, 21 nt, Homo sapiens
cuagugccugagaugcacgau

SEQ ID NO: 499951 - RNA, 18 nt, Homo sapiens
cuauuaguuuucuuugua

SEQ ID NO: 499952 - RNA, 16 nt, Homo sapiens
cucaagacucaccuca

SEQ ID NO: 499953 - RNA, 14 nt, Homo sapiens
cucacuacagccuc

SEQ ID NO: 499954 - RNA, 19 nt, Homo sapiens
cucacuggggucugugugg

SEQ ID NO: 499955 - RNA, 22 nt, Homo sapiens
cucagccgugcacucccuaaga

SEQ ID NO: 499956 - RNA, 23 nt, Homo sapiens
cucagccgugcacucccuaagaa

SEQ ID NO: 499957 - RNA, 17 nt, Homo sapiens
cucagggagcagggaag

SEQ ID NO: 499958 - RNA, 22 nt, Homo sapiens
cucagggagcagggaaggccug

SEQ ID NO: 499959 - RNA, 22 nt, Homo sapiens
cuccagucuccugacauuaaga

SEQ ID NO: 499960 - RNA, 19 nt, Homo sapiens
cucccaaagugcugggauu

SEQ ID NO: 499961 - RNA, 14 nt, Homo sapiens
cucccacagaggag

SEQ ID NO: 499962 - RNA, 18 nt, Homo sapiens
cucccuguguggcugcug

SEQ ID NO: 499963 - RNA, 14 nt, Homo sapiens
cuccgcaacagcca

SEQ ID NO: 499964 - RNA, 23 nt, Homo sapiens
cuccugacauuaagacacaccuc

SEQ ID NO: 499965 - RNA, 14 nt, Homo sapiens
cuccugugugcugg

SEQ ID NO: 499966 - RNA, 22 nt, Homo sapiens
cucgggggaaagcacaccucau

SEQ ID NO: 499967 - RNA, 24 nt, Homo sapiens
cucgguggcauacagacuggggac

SEQ ID NO: 499968 - RNA, 20 nt, Homo sapiens
cucugacuggagucuaggaa

SEQ ID NO: 499969 - RNA, 15 nt, Homo sapiens
cucuucccaccucag

SEQ ID NO: 499970 - RNA, 14 nt, Homo sapiens
cucuugcucaguga

SEQ ID NO: 499971 - RNA, 13 nt, Homo sapiens
cugacuaccagcu

SEQ ID NO: 499972 - RNA, 14 nt, Homo sapiens
cugagcaguaccag

SEQ ID NO: 499973 - RNA, 15 nt, Homo sapiens
cugagcgcuguguua

SEQ ID NO: 499974 - RNA, 22 nt, Homo sapiens
cugauuucuuaggggaaggaga

SEQ ID NO: 499975 - RNA, 15 nt, Homo sapiens
cugccccccaugagg

SEQ ID NO: 499976 - RNA, 16 nt, Homo sapiens
cugccugcuccaagaa

SEQ ID NO: 499977 - RNA, 22 nt, Homo sapiens
cugcugugcccucccauagcac

SEQ ID NO: 499978 - RNA, 19 nt, Homo sapiens
cugcugugcuagugccuga

SEQ ID NO: 499979 - RNA, 14 nt, Homo sapiens
cuggaaaagggaag

SEQ ID NO: 499980 - RNA, 17 nt, Homo sapiens
cuggaggugggagacaa

SEQ ID NO: 499981 - RNA, 16 nt, Homo sapiens
cuggauggucaucucg

SEQ ID NO: 499982 - RNA, 11 nt, Homo sapiens
cuggcacugag

SEQ ID NO: 499983 - RNA, 20 nt, Homo sapiens
cuggcagcaucuucacuucu

SEQ ID NO: 499984 - RNA, 17 nt, Homo sapiens
cuggccugauugcagag

SEQ ID NO: 499985 - RNA, 21 nt, Homo sapiens
cuggcuucucuuucucugagu

SEQ ID NO: 499986 - RNA, 22 nt, Homo sapiens
cugggaacaacuucaguccaac

SEQ ID NO: 499987 - RNA, 15 nt, Homo sapiens
cugggaaucaagaca

SEQ ID NO: 499988 - RNA, 20 nt, Homo sapiens
cugggcagcugucauggaaa

SEQ ID NO: 499989 - RNA, 17 nt, Homo sapiens
cugggcggccucuugcu

SEQ ID NO: 499990 - RNA, 23 nt, Homo sapiens
cuggguacugaaagccuuaggga

SEQ ID NO: 499991 - RNA, 22 nt, Homo sapiens
cuggguugcugcuguccagugc

SEQ ID NO: 499992 - RNA, 14 nt, Homo sapiens
cugguuuacuucaa

SEQ ID NO: 499993 - RNA, 23 nt, Homo sapiens
cugguuuguggggcacagaugcc

SEQ ID NO: 499994 - RNA, 16 nt, Homo sapiens
cuguaauuaagugcaa

SEQ ID NO: 499995 - RNA, 18 nt, Homo sapiens
cugucauggaaaagccca

SEQ ID NO: 499996 - RNA, 19 nt, Homo sapiens
cugucauggaaaagcccag

SEQ ID NO: 499997 - RNA, 22 nt, Homo sapiens
cugugcacgcgcgcgugcacac

SEQ ID NO: 499998 - RNA, 15 nt, Homo sapiens
cuguguggugcccau

SEQ ID NO: 499999 - RNA, 20 nt, Homo sapiens
cuuaagggguaucauguaug

SEQ ID NO: 500000 - RNA, 20 nt, Homo sapiens
cuuacuucgugcgcaacaac

SEQ ID NO: 500001 - RNA, 18 nt, Homo sapiens
cuuaguaugugcauuuaa

SEQ ID NO: 500002 - RNA, 23 nt, Homo sapiens
cuuauccauaggcgcaggugcac

SEQ ID NO: 500003 - RNA, 14 nt, Homo sapiens
aaagcacaccucau

SEQ ID NO: 500004 - RNA, 15 nt, Homo sapiens
aaauacacauuugcu

SEQ ID NO: 500005 - RNA, 19 nt, Homo sapiens
aaaucuucccaugcauucu

SEQ ID NO: 500006 - RNA, 14 nt, Homo sapiens
aaaugcuucugcac

SEQ ID NO: 500007 - RNA, 18 nt, Homo sapiens
aaauuuaauaccagauac

SEQ ID NO: 500008 - RNA, 15 nt, Homo sapiens
aaauuuuuauguaau

SEQ ID NO: 500009 - RNA, 15 nt, Homo sapiens
aacacccgacgucau

SEQ ID NO: 500010 - RNA, 14 nt, Homo sapiens
aacauguauguaaa

SEQ ID NO: 500011 - RNA, 14 nt, Homo sapiens
aacccucacugugu

SEQ ID NO: 500012 - RNA, 18 nt, Homo sapiens
aacuccugguucagccau

SEQ ID NO: 500013 - RNA, 22 nt, Homo sapiens
aacugaugcgaaaacuugaauc

SEQ ID NO: 500014 - RNA, 16 nt, Homo sapiens
aacuguagcugccaug

SEQ ID NO: 500015 - RNA, 17 nt, Homo sapiens
aagacacaccucuggau

SEQ ID NO: 500016 - RNA, 22 nt, Homo sapiens
aagacacaccucuggaucccug

SEQ ID NO: 500017 - RNA, 13 nt, Homo sapiens
aagacaugaacca

SEQ ID NO: 500018 - RNA, 13 nt, Homo sapiens
aagaggcagugag

SEQ ID NO: 500019 - RNA, 22 nt, Homo sapiens
aagaguucccuugaaacuuugg

SEQ ID NO: 500020 - RNA, 14 nt, Homo sapiens
aagcaaaaugcuuc

SEQ ID NO: 500021 - RNA, 13 nt, Homo sapiens
aagcacaccucau

SEQ ID NO: 500022 - RNA, 10 nt, Homo sapiens
aagcccaguu

SEQ ID NO: 500023 - RNA, 20 nt, Homo sapiens
aagccccauccaacacugga

SEQ ID NO: 500024 - RNA, 12 nt, Homo sapiens
aagccuuaggga

SEQ ID NO: 500025 - RNA, 22 nt, Homo sapiens
aagccuuccagggauuugccuc

SEQ ID NO: 500026 - RNA, 13 nt, Homo sapiens
aagcuggcuuccu

SEQ ID NO: 500027 - RNA, 14 nt, Homo sapiens
aaggacaugugcua

SEQ ID NO: 500028 - RNA, 19 nt, Homo sapiens
aaggccacugcuacaucuc

SEQ ID NO: 500029 - RNA, 13 nt, Homo sapiens
aagggcagugaga

SEQ ID NO: 500030 - RNA, 13 nt, Homo sapiens
aagggcugugcug

SEQ ID NO: 500031 - RNA, 15 nt, Homo sapiens
aagguuauaacugug

SEQ ID NO: 500032 - RNA, 18 nt, Homo sapiens
aaguaaauuuguccaaug

SEQ ID NO: 500033 - RNA, 17 nt, Homo sapiens
aauaccauuuaguaaga

SEQ ID NO: 500034 - RNA, 12 nt, Homo sapiens
aaucaacucuaa

SEQ ID NO: 500035 - RNA, 16 nt, Homo sapiens
aaugaauacugggaau

SEQ ID NO: 500036 - RNA, 19 nt, Homo sapiens
aaugagcucugaaaucuuc

SEQ ID NO: 500037 - RNA, 19 nt, Homo sapiens
aaugccucugcugugggcu

SEQ ID NO: 500038 - RNA, 13 nt, Homo sapiens
aaugcuacaugug

SEQ ID NO: 500039 - RNA, 19 nt, Homo sapiens
aauggccauuguguuggga

SEQ ID NO: 500040 - RNA, 23 nt, Homo sapiens
aauggcuguaaacuauaaacuac

SEQ ID NO: 500041 - RNA, 12 nt, Homo sapiens
cagacaaaugga

SEQ ID NO: 500042 - RNA, 14 nt, Homo sapiens
cagacaauccacuc

SEQ ID NO: 500043 - RNA, 14 nt, Homo sapiens
cagacacacccaca

SEQ ID NO: 500044 - RNA, 18 nt, Homo sapiens
cagacagcaggcuggagc

SEQ ID NO: 500045 - RNA, 16 nt, Homo sapiens
cagagacugucccuga

SEQ ID NO: 500046 - RNA, 12 nt, Homo sapiens
cagagcaauggu

SEQ ID NO: 500047 - RNA, 15 nt, Homo sapiens
cagagguggcugcug

SEQ ID NO: 500048 - RNA, 20 nt, Homo sapiens
cagagguggcugcugugcua

SEQ ID NO: 500049 - RNA, 23 nt, Homo sapiens
cagagguggcugcugugcuagug

SEQ ID NO: 500050 - RNA, 12 nt, Homo sapiens
cagaguuuucau

SEQ ID NO: 500051 - RNA, 21 nt, Homo sapiens
cagcaauggugucaguaucca

SEQ ID NO: 500052 - RNA, 15 nt, Homo sapiens
cagcccaugugcacc

SEQ ID NO: 500053 - RNA, 22 nt, Homo sapiens
cagcucaaugcaguuagcugaa

SEQ ID NO: 500054 - RNA, 23 nt, Homo sapiens
cagcuguggccuaggcuaccuca

SEQ ID NO: 500055 - RNA, 22 nt, Homo sapiens
caggagaagcucaguagccuuu

SEQ ID NO: 500056 - RNA, 13 nt, Homo sapiens
caggagacccaga

SEQ ID NO: 500057 - RNA, 22 nt, Homo sapiens
caggauggaauccuacagccuc

SEQ ID NO: 500058 - RNA, 13 nt, Homo sapiens
caggcuuuguaca

SEQ ID NO: 500059 - RNA, 16 nt, Homo sapiens
cagggcagaaaacaca

SEQ ID NO: 500060 - RNA, 19 nt, Homo sapiens
caguaggggcuacugugac

SEQ ID NO: 500061 - RNA, 16 nt, Homo sapiens
cagucucagaaagccu

SEQ ID NO: 500062 - RNA, 18 nt, Homo sapiens
cagugccagcaccugccc

SEQ ID NO: 500063 - RNA, 17 nt, Homo sapiens
cauaauaagcuaaagag

SEQ ID NO: 500064 - RNA, 21 nt, Homo sapiens
caucaaugauaaugcuaauuu

SEQ ID NO: 500065 - RNA, 21 nt, Homo sapiens
cauccuaagugggaagugaag

SEQ ID NO: 500066 - RNA, 14 nt, Homo sapiens
cauccugugugcug

SEQ ID NO: 500067 - RNA, 19 nt, Homo sapiens
caucuuuuccucauuuuca

SEQ ID NO: 500068 - RNA, 15 nt, Homo sapiens
caugaaccaagugga

SEQ ID NO: 500069 - RNA, 16 nt, Homo sapiens
caugaggacaaagugu

SEQ ID NO: 500070 - RNA, 13 nt, Homo sapiens
cauguguauuucc

SEQ ID NO: 500071 - RNA, 23 nt, Homo sapiens
cauuaaggggaagaaugaaagcu

SEQ ID NO: 500072 - RNA, 14 nt, Homo sapiens
cauuugcugccauu

SEQ ID NO: 500073 - RNA, 18 nt, Homo sapiens
cauuuuuuugcaugcaug

SEQ ID NO: 500074 - RNA, 18 nt, Homo sapiens
ccaaugagacucuagggu

SEQ ID NO: 500075 - RNA, 16 nt, Homo sapiens
ccacacagggugcaug

SEQ ID NO: 500076 - RNA, 13 nt, Homo sapiens
ccacaccaaaguc

SEQ ID NO: 500077 - RNA, 22 nt, Homo sapiens
ccacagcgauccacggagcuga

SEQ ID NO: 500078 - RNA, 12 nt, Homo sapiens
ccaccucaggcu

SEQ ID NO: 500079 - RNA, 16 nt, Homo sapiens
ccaccucaggcugcca

SEQ ID NO: 500080 - RNA, 13 nt, Homo sapiens
ccagaucuuucag

SEQ ID NO: 500081 - RNA, 22 nt, Homo sapiens
ccaggauggcgugugugccgug

SEQ ID NO: 500082 - RNA, 14 nt, Homo sapiens
ccagguguucuaca

SEQ ID NO: 500083 - RNA, 19 nt, Homo sapiens
ccagguguucuacacucau

SEQ ID NO: 500084 - RNA, 24 nt, Homo sapiens
ccaguaagguuauaacuguggcua

SEQ ID NO: 500085 - RNA, 21 nt, Homo sapiens
ccauacuuucccacagcacua

SEQ ID NO: 500086 - RNA, 19 nt, Homo sapiens
ccaucagcuggguggugua

SEQ ID NO: 500087 - RNA, 16 nt, Homo sapiens
ccauuacagagguauu

SEQ ID NO: 500088 - RNA, 16 nt, Homo sapiens
ccauugcccugugagg

SEQ ID NO: 500089 - RNA, 23 nt, Homo sapiens
cccaaguguugaggggaccaaag

SEQ ID NO: 500090 - RNA, 20 nt, Homo sapiens
cccacagcacuacgaugugu

SEQ ID NO: 500091 - RNA, 15 nt, Homo sapiens
cccacaugaucuuga

SEQ ID NO: 500092 - RNA, 17 nt, Homo sapiens
cccagaaagaggcagug

SEQ ID NO: 500093 - RNA, 18 nt, Homo sapiens
cccaugaggacaaagugu

SEQ ID NO: 500094 - RNA, 11 nt, Homo sapiens
ccccaccucag

SEQ ID NO: 500095 - RNA, 19 nt, Homo sapiens
ccccuaagaggcagugaga

SEQ ID NO: 500096 - RNA, 22 nt, Homo sapiens
cccucuucuucucccugugugg

SEQ ID NO: 500097 - RNA, 17 nt, Homo sapiens
cccuuaagagucaucca

SEQ ID NO: 500098 - RNA, 16 nt, Homo sapiens
ccgaaaccaaagaaga

SEQ ID NO: 500099 - RNA, 13 nt, Homo sapiens
ccgaagcccaguu

SEQ ID NO: 500100 - RNA, 18 nt, Homo sapiens
ccgagcuagagugcagug

SEQ ID NO: 500101 - RNA, 14 nt, Homo sapiens
ccuaagaggcagug

SEQ ID NO: 500102 - RNA, 15 nt, Homo sapiens
ccuaagggagugucu

SEQ ID NO: 500103 - RNA, 12 nt, Homo sapiens
ccuagaacuucc

SEQ ID NO: 500104 - RNA, 16 nt, Homo sapiens
ccucaacaugguccuu

SEQ ID NO: 500105 - RNA, 20 nt, Homo sapiens
ccucagacaauccacucuca

SEQ ID NO: 500106 - RNA, 17 nt, Homo sapiens
ccucagcucaaugcagu

SEQ ID NO: 500107 - RNA, 18 nt, Homo sapiens
ccucagggagcagggaag

SEQ ID NO: 500108 - RNA, 12 nt, Homo sapiens
ccucccaaagug

SEQ ID NO: 500109 - RNA, 15 nt, Homo sapiens
ccuccucaguaugug

SEQ ID NO: 500110 - RNA, 13 nt, Homo sapiens
ccuccucauggca

SEQ ID NO: 500111 - RNA, 22 nt, Homo sapiens
ccucguuggaagaggaacagca

SEQ ID NO: 500112 - RNA, 21 nt, Homo sapiens
ccucucccgcgggccuggaca

SEQ ID NO: 500113 - RNA, 14 nt, Homo sapiens
ccugacagugccca

SEQ ID NO: 500114 - RNA, 14 nt, Homo sapiens
ccugcccaaugaga

SEQ ID NO: 500115 - RNA, 22 nt, Homo sapiens
ccugcugugcccucccauagca

SEQ ID NO: 500116 - RNA, 22 nt, Homo sapiens
ccuggaggugggagacaaggaa

SEQ ID NO: 500117 - RNA, 18 nt, Homo sapiens
ccuguuuuccacaccauc

SEQ ID NO: 500118 - RNA, 13 nt, Homo sapiens
ccuuaagagucau

SEQ ID NO: 500119 - RNA, 13 nt, Homo sapiens
ccuugaugacugc

SEQ ID NO: 500120 - RNA, 13 nt, Homo sapiens
ccuuuccuuccag

SEQ ID NO: 500121 - RNA, 15 nt, Homo sapiens
ccuuuuaacucaccu

SEQ ID NO: 500122 - RNA, 11 nt, Homo sapiens
cgacccauuca

SEQ ID NO: 500123 - RNA, 13 nt, Homo sapiens
cgagcacugugag

SEQ ID NO: 500124 - RNA, 14 nt, Homo sapiens
cgagucaugcacuc

SEQ ID NO: 500125 - RNA, 16 nt, Homo sapiens
cgagucaugcacucag

SEQ ID NO: 500126 - RNA, 19 nt, Homo sapiens
cgaugcuggggucaaagac

SEQ ID NO: 500127 - RNA, 15 nt, Homo sapiens
cgcaacaacaaggac

SEQ ID NO: 500128 - RNA, 17 nt, Homo sapiens
cgcagcccgaagcccag

SEQ ID NO: 500129 - RNA, 12 nt, Homo sapiens
cgcccucggggc

SEQ ID NO: 500130 - RNA, 13 nt, Homo sapiens
cuaaagugucuau

SEQ ID NO: 500131 - RNA, 19 nt, Homo sapiens
cuacagccuccucggggga

SEQ ID NO: 500132 - RNA, 21 nt, Homo sapiens
cuaccagguguucuacacuca

SEQ ID NO: 500133 - RNA, 14 nt, Homo sapiens
cuagagcucaggcc

SEQ ID NO: 500134 - RNA, 14 nt, Homo sapiens
cuagagugcagugg

SEQ ID NO: 500135 - RNA, 18 nt, Homo sapiens
cuaggcaaagacuggccu

SEQ ID NO: 500136 - RNA, 22 nt, Homo sapiens
cuagggcuggagggacagggag

SEQ ID NO: 500137 - RNA, 19 nt, Homo sapiens
cuaguacugccccccauga

SEQ ID NO: 500138 - RNA, 15 nt, Homo sapiens
cuauaaacuacugua

SEQ ID NO: 500139 - RNA, 22 nt, Homo sapiens
cuaugucaguacuauucaggua

SEQ ID NO: 500140 - RNA, 23 nt, Homo sapiens
cuauucuauaaaacucugcaugu

SEQ ID NO: 500141 - RNA, 22 nt, Homo sapiens
cuauugaacugagccaaacaca

SEQ ID NO: 500142 - RNA, 23 nt, Homo sapiens
cucacgcagacacacccacagaa

SEQ ID NO: 500143 - RNA, 14 nt, Homo sapiens
cucacugcuaucug

SEQ ID NO: 500144 - RNA, 21 nt, Homo sapiens
cuccacaccaaagucagggag

SEQ ID NO: 500145 - RNA, 21 nt, Homo sapiens
cuccauacuuucccacagcac

SEQ ID NO: 500146 - RNA, 15 nt, Homo sapiens
cuccaucaugcuuga

SEQ ID NO: 500147 - RNA, 16 nt, Homo sapiens
cuccgcaacagccaag

SEQ ID NO: 500148 - RNA, 13 nt, Homo sapiens
cuccugugugcug

SEQ ID NO: 500149 - RNA, 19 nt, Homo sapiens
cucugggagccugacagug

SEQ ID NO: 500150 - RNA, 17 nt, Homo sapiens
cugaaagccuuagggaa

SEQ ID NO: 500151 - RNA, 15 nt, Homo sapiens
cugaccgaguaccug

SEQ ID NO: 500152 - RNA, 14 nt, Homo sapiens
cugacuaccagcua

SEQ ID NO: 500153 - RNA, 19 nt, Homo sapiens
cugagaugcacgaugcugg

SEQ ID NO: 500154 - RNA, 19 nt, Homo sapiens
cugagccaaacacacugua

SEQ ID NO: 500155 - RNA, 20 nt, Homo sapiens
cugagccaaacacacuguaa

SEQ ID NO: 500156 - RNA, 18 nt, Homo sapiens
cugaugagaaaggccuga

SEQ ID NO: 500157 - RNA, 18 nt, Homo sapiens
gugcuuaaaaaucauuga

SEQ ID NO: 500158 - RNA, 19 nt, Homo sapiens
guggccuaggcuaccucaa

SEQ ID NO: 500159 - RNA, 20 nt, Homo sapiens
guggugcccaugaggacaaa

SEQ ID NO: 500160 - RNA, 11 nt, Homo sapiens
guguggcugcu

SEQ ID NO: 500161 - RNA, 13 nt, Homo sapiens
guguuaggcacag

SEQ ID NO: 500162 - RNA, 23 nt, Homo sapiens
guuaagcaaaaugcuucugcaca

SEQ ID NO: 500163 - RNA, 22 nt, Homo sapiens
guuaggcacaggcugggaugga

SEQ ID NO: 500164 - RNA, 15 nt, Homo sapiens
guuuagcagauuuaa

SEQ ID NO: 500165 - RNA, 18 nt, Homo sapiens
guuuaggcauccugugug

SEQ ID NO: 500166 - RNA, 21 nt, Homo sapiens
guuugucaggauggaauccua

SEQ ID NO: 500167 - RNA, 14 nt, Homo sapiens
uaaacuacuguaau

SEQ ID NO: 500168 - RNA, 12 nt, Homo sapiens
uaaauagcuaag

SEQ ID NO: 500169 - RNA, 16 nt, Homo sapiens
uaaauucaacuuugua

SEQ ID NO: 500170 - RNA, 18 nt, Homo sapiens
uaacucaccucucaaggu

SEQ ID NO: 500171 - RNA, 20 nt, Homo sapiens
uaacuccagucuccugacau

SEQ ID NO: 500172 - RNA, 19 nt, Homo sapiens
uaacuucucugagucugaa

SEQ ID NO: 500173 - RNA, 21 nt, Homo sapiens
uaagcaaaaugcuucugcaca

SEQ ID NO: 500174 - RNA, 16 nt, Homo sapiens
uaaguaucagcuacaa

SEQ ID NO: 500175 - RNA, 19 nt, Homo sapiens
uaaguuucacagcacuuac

SEQ ID NO: 500176 - RNA, 16 nt, Homo sapiens
uaauaaaccaguucug

SEQ ID NO: 500177 - RNA, 14 nt, Homo sapiens
uaaugugacuugga

SEQ ID NO: 500178 - RNA, 15 nt, Homo sapiens
uaauuuuauuauagu

SEQ ID NO: 500179 - RNA, 13 nt, Homo sapiens
uacaugcauuuga

SEQ ID NO: 500180 - RNA, 18 nt, Homo sapiens
uacaugugagugacgaug

SEQ ID NO: 500181 - RNA, 15 nt, Homo sapiens
uaccagcuaacucca

SEQ ID NO: 500182 - RNA, 18 nt, Homo sapiens
uaccauuuaguaagaaua

SEQ ID NO: 500183 - RNA, 11 nt, Homo sapiens
uaccucaaggg

SEQ ID NO: 500184 - RNA, 14 nt, Homo sapiens
uacugggaagacaa

SEQ ID NO: 500185 - RNA, 23 nt, Homo sapiens
uagaacucugggcugccauguga

SEQ ID NO: 500186 - RNA, 17 nt, Homo sapiens
uagagugcaguggugca

SEQ ID NO: 500187 - RNA, 18 nt, Homo sapiens
uagcagauuuaagauaug

SEQ ID NO: 500188 - RNA, 17 nt, Homo sapiens
uaggcgcaggugcacag

SEQ ID NO: 500189 - RNA, 17 nt, Homo sapiens
uaggcuaccucaagacu

SEQ ID NO: 500190 - RNA, 20 nt, Homo sapiens
uagggcuggagggacaggga

SEQ ID NO: 500191 - RNA, 16 nt, Homo sapiens
uaguaugugcauuuaa

SEQ ID NO: 500192 - RNA, 16 nt, Homo sapiens
uauaauacuaaagugu

SEQ ID NO: 500193 - RNA, 19 nt, Homo sapiens
uauaauacuaaagugucua

SEQ ID NO: 500194 - RNA, 14 nt, Homo sapiens
uauguaaauagcua

SEQ ID NO: 500195 - RNA, 16 nt, Homo sapiens
uauguagaugugcauu

SEQ ID NO: 500196 - RNA, 17 nt, Homo sapiens
uauugugaaguacauau

SEQ ID NO: 500197 - RNA, 18 nt, Homo sapiens
ucaaaagugaucuguccc

SEQ ID NO: 500198 - RNA, 18 nt, Homo sapiens
ucaaauacacauuugcua

SEQ ID NO: 500199 - RNA, 15 nt, Homo sapiens
ucaagacucaccuca

SEQ ID NO: 500200 - RNA, 13 nt, Homo sapiens
ucaagucuggauc

SEQ ID NO: 500201 - RNA, 17 nt, Homo sapiens
ucaauguuuagcagauu

SEQ ID NO: 500202 - RNA, 22 nt, Homo sapiens
ucagacaauccacucucaggag

SEQ ID NO: 500203 - RNA, 19 nt, Homo sapiens
ucagccauugcccugugag

SEQ ID NO: 500204 - RNA, 14 nt, Homo sapiens
ucaggauucuucaa

SEQ ID NO: 500205 - RNA, 18 nt, Homo sapiens
ucagugccccauucucac

SEQ ID NO: 500206 - RNA, 23 nt, Homo sapiens
ucauaauguggugauggcccuaa

SEQ ID NO: 500207 - RNA, 15 nt, Homo sapiens
ucauccuuaccgcac

SEQ ID NO: 500208 - RNA, 16 nt, Homo sapiens
ucaucucggaguucca

SEQ ID NO: 500209 - RNA, 15 nt, Homo sapiens
ucauucuucuggcaa

SEQ ID NO: 500210 - RNA, 16 nt, Homo sapiens
uccaauggcuguaaac

SEQ ID NO: 500211 - RNA, 20 nt, Homo sapiens
uccacaccaaagucagggag

SEQ ID NO: 500212 - RNA, 15 nt, Homo sapiens
uccacagacucccuc

SEQ ID NO: 500213 - RNA, 19 nt, Homo sapiens
uccagcccaucuccgggga

SEQ ID NO: 500214 - RNA, 14 nt, Homo sapiens
uccaucucccuuag

SEQ ID NO: 500215 - RNA, 17 nt, Homo sapiens
ucccagauggcuggaag

SEQ ID NO: 500216 - RNA, 12 nt, Homo sapiens
uccccaccucag

SEQ ID NO: 500217 - RNA, 21 nt, Homo sapiens
uccuagaauggaugugcucac

SEQ ID NO: 500218 - RNA, 23 nt, Homo sapiens
uccuagaauggaugugcucacug

SEQ ID NO: 500219 - RNA, 17 nt, Homo sapiens
uccucgggggaaagcac

SEQ ID NO: 500220 - RNA, 18 nt, Homo sapiens
uccucgggggaaagcaca

SEQ ID NO: 500221 - RNA, 16 nt, Homo sapiens
uccugaacucagcuga

SEQ ID NO: 500222 - RNA, 16 nt, Homo sapiens
uccuggguacugaaag

SEQ ID NO: 500223 - RNA, 23 nt, Homo sapiens
uccuugucccaagcccagggacu

SEQ ID NO: 500224 - RNA, 15 nt, Homo sapiens
ucgaguccccagaac

SEQ ID NO: 500225 - RNA, 16 nt, Homo sapiens
ucuacaaaauauagcu

SEQ ID NO: 500226 - RNA, 13 nt, Homo sapiens
ucuacacugagga

SEQ ID NO: 500227 - RNA, 19 nt, Homo sapiens
ucuauacuccuucccuuaa

SEQ ID NO: 500228 - RNA, 17 nt, Homo sapiens
ucucaaugaaccauaaa

SEQ ID NO: 500229 - RNA, 14 nt, Homo sapiens
ucugggagccugac

SEQ ID NO: 500230 - RNA, 22 nt, Homo sapiens
ucuguaggucccacucccacag

SEQ ID NO: 500231 - RNA, 13 nt, Homo sapiens
ucuguguggugcc

SEQ ID NO: 500232 - RNA, 14 nt, Homo sapiens
ucuuacaugcauuu

SEQ ID NO: 500233 - RNA, 15 nt, Homo sapiens
ucuuagccucccaaa

SEQ ID NO: 500234 - RNA, 19 nt, Homo sapiens
ucuuaguaugugcauuuaa

SEQ ID NO: 500235 - RNA, 18 nt, Homo sapiens
ucuucaaggagaaugaau

SEQ ID NO: 500236 - RNA, 21 nt, Homo sapiens
ucuucacuucuaaaugcauau

SEQ ID NO: 500237 - RNA, 17 nt, Homo sapiens
ucuuuccauuaugauuc

SEQ ID NO: 500238 - RNA, 13 nt, Homo sapiens
ugaaaagugugua

SEQ ID NO: 500239 - RNA, 15 nt, Homo sapiens
ugaaaugaaaacaug

SEQ ID NO: 500240 - RNA, 19 nt, Homo sapiens
agcccaugugcaccugccc

SEQ ID NO: 500241 - RNA, 16 nt, Homo sapiens
agccccauccaacacu

SEQ ID NO: 500242 - RNA, 13 nt, Homo sapiens
agccgugcacucc

SEQ ID NO: 500243 - RNA, 14 nt, Homo sapiens
agccucccaaagug

SEQ ID NO: 500244 - RNA, 21 nt, Homo sapiens
agccuggcccuggaacuagaa

SEQ ID NO: 500245 - RNA, 16 nt, Homo sapiens
agccuucugacaagca

SEQ ID NO: 500246 - RNA, 21 nt, Homo sapiens
agcggucauucuacacugagg

SEQ ID NO: 500247 - RNA, 13 nt, Homo sapiens
agcuaccaggugu

SEQ ID NO: 500248 - RNA, 20 nt, Homo sapiens
agcuagagugcaguggugca

SEQ ID NO: 500249 - RNA, 14 nt, Homo sapiens
agcucuuccuaucc

SEQ ID NO: 500250 - RNA, 14 nt, Homo sapiens
agcuggguggugua

SEQ ID NO: 500251 - RNA, 21 nt, Homo sapiens
agcuguggccuaggcuaccuc

SEQ ID NO: 500252 - RNA, 22 nt, Homo sapiens
agcuguggccuaggcuaccuca

SEQ ID NO: 500253 - RNA, 21 nt, Homo sapiens
aggaaggaacagcaauggugu

SEQ ID NO: 500254 - RNA, 22 nt, Homo sapiens
aggaagggcgugucccauggga

SEQ ID NO: 500255 - RNA, 22 nt, Homo sapiens
aggacaccuuuuaacucaccuc

SEQ ID NO: 500256 - RNA, 23 nt, Homo sapiens
aggaggcgcagcccgaagcccag

SEQ ID NO: 500257 - RNA, 16 nt, Homo sapiens
aggauaucgggucacu

SEQ ID NO: 500258 - RNA, 19 nt, Homo sapiens
aggcauccugugugcugac

SEQ ID NO: 500259 - RNA, 14 nt, Homo sapiens
aggccagugccagc

SEQ ID NO: 500260 - RNA, 17 nt, Homo sapiens
aggcccugcccaaugag

SEQ ID NO: 500261 - RNA, 15 nt, Homo sapiens
aggcuaccucaagac

SEQ ID NO: 500262 - RNA, 19 nt, Homo sapiens
aggcucagccacacaggaa

SEQ ID NO: 500263 - RNA, 13 nt, Homo sapiens
agggcugugcuga

SEQ ID NO: 500264 - RNA, 15 nt, Homo sapiens
aggggcuacugugac

SEQ ID NO: 500265 - RNA, 15 nt, Homo sapiens
aggugacugaaggcu

SEQ ID NO: 500266 - RNA, 16 nt, Homo sapiens
aguaagaauaccacau

SEQ ID NO: 500267 - RNA, 14 nt, Homo sapiens
aguaagauaucuca

SEQ ID NO: 500268 - RNA, 16 nt, Homo sapiens
aguauccaggcuuugu

SEQ ID NO: 500269 - RNA, 15 nt, Homo sapiens
agucaugcacucagg

SEQ ID NO: 500270 - RNA, 17 nt, Homo sapiens
aguccgcagaagcccug

SEQ ID NO: 500271 - RNA, 14 nt, Homo sapiens
agugcaguggugca

SEQ ID NO: 500272 - RNA, 16 nt, Homo sapiens
agugcccagcaugaag

SEQ ID NO: 500273 - RNA, 16 nt, Homo sapiens
aguucauaauguggug

SEQ ID NO: 500274 - RNA, 13 nt, Homo sapiens
aguuucaguuugu

SEQ ID NO: 500275 - RNA, 17 nt, Homo sapiens
aguuucccguccaucuc

SEQ ID NO: 500276 - RNA, 14 nt, Homo sapiens
auaaacuacuguaa

SEQ ID NO: 500277 - RNA, 15 nt, Homo sapiens
gucaggauucuucaa

SEQ ID NO: 500278 - RNA, 23 nt, Homo sapiens
gucagggagccuggaagccaaac

SEQ ID NO: 500279 - RNA, 17 nt, Homo sapiens
gucauucuacacugagg

SEQ ID NO: 500280 - RNA, 16 nt, Homo sapiens
gucccaagcccaggga

SEQ ID NO: 500281 - RNA, 19 nt, Homo sapiens
gucccacucccacagagga

SEQ ID NO: 500282 - RNA, 13 nt, Homo sapiens
guccccaccucag

SEQ ID NO: 500283 - RNA, 18 nt, Homo sapiens
guccucacgcagacacac

SEQ ID NO: 500284 - RNA, 19 nt, Homo sapiens
guccucacgcagacacacc

SEQ ID NO: 500285 - RNA, 22 nt, Homo sapiens
gucuguagagccgcauggcacu

SEQ ID NO: 500286 - RNA, 14 nt, Homo sapiens
gucuguguggugcc

SEQ ID NO: 500287 - RNA, 20 nt, Homo sapiens
gugaagagggagaagcauga

SEQ ID NO: 500288 - RNA, 13 nt, Homo sapiens
gugagcacgcuga

SEQ ID NO: 500289 - RNA, 15 nt, Homo sapiens
gugccgugacagggc

SEQ ID NO: 500290 - RNA, 16 nt, Homo sapiens
gugcgcgaugugacag

SEQ ID NO: 500291 - RNA, 15 nt, Homo sapiens
gugcugggauuacag

SEQ ID NO: 500292 - RNA, 20 nt, Homo sapiens
guggcaacccucacuguguu

SEQ ID NO: 500293 - RNA, 22 nt, Homo sapiens
guggcauaaauugcaucacugu

SEQ ID NO: 500294 - RNA, 19 nt, Homo sapiens
guggugcccaugaggacaa

SEQ ID NO: 500295 - RNA, 15 nt, Homo sapiens
guguccccaccucag

SEQ ID NO: 500296 - RNA, 21 nt, Homo sapiens
guuacuuaagaggcagagaag

SEQ ID NO: 500297 - RNA, 14 nt, Homo sapiens
guuccaguaccgcc

SEQ ID NO: 500298 - RNA, 17 nt, Homo sapiens
uaaagacccuccuauuc

SEQ ID NO: 500299 - RNA, 19 nt, Homo sapiens
uaaagagagaauguagaua

SEQ ID NO: 500300 - RNA, 16 nt, Homo sapiens
uaaagucucucugacu

SEQ ID NO: 500301 - RNA, 18 nt, Homo sapiens
uaaauauuuauguagaug

SEQ ID NO: 500302 - RNA, 15 nt, Homo sapiens
uaagacacaccucug

SEQ ID NO: 500303 - RNA, 15 nt, Homo sapiens
uaauaagcuaaagag

SEQ ID NO: 500304 - RNA, 19 nt, Homo sapiens
uacaaucaaggccacugcu

SEQ ID NO: 500305 - RNA, 16 nt, Homo sapiens
uaccaaguccugggaa

SEQ ID NO: 500306 - RNA, 21 nt, Homo sapiens
uaccagcuaacuccagucucc

SEQ ID NO: 500307 - RNA, 15 nt, Homo sapiens
uaccgcccucggggc

SEQ ID NO: 500308 - RNA, 15 nt, Homo sapiens
uaccucaagacucac

SEQ ID NO: 500309 - RNA, 17 nt, Homo sapiens
uaccucaagggggacug

SEQ ID NO: 500310 - RNA, 21 nt, Homo sapiens
uaccugacggacguccugcug

SEQ ID NO: 500311 - RNA, 18 nt, Homo sapiens
uacugggaaucaagacaa

SEQ ID NO: 500312 - RNA, 16 nt, Homo sapiens
uagaauggaugugcuc

SEQ ID NO: 500313 - RNA, 18 nt, Homo sapiens
uagaauggaugugcucac

SEQ ID NO: 500314 - RNA, 23 nt, Homo sapiens
uagagaaguccaagcaacagccu

SEQ ID NO: 500315 - RNA, 12 nt, Homo sapiens
uagaugugcauu

SEQ ID NO: 500316 - RNA, 12 nt, Homo sapiens
uaggcaaagacu

SEQ ID NO: 500317 - RNA, 19 nt, Homo sapiens
uaggcauccugugugcuga

SEQ ID NO: 500318 - RNA, 18 nt, Homo sapiens
uaguuacuaaacauguau

SEQ ID NO: 500319 - RNA, 22 nt, Homo sapiens
uaguuacuaaacauguauguaa

SEQ ID NO: 500320 - RNA, 19 nt, Homo sapiens
uauaacuguggcuaauuca

SEQ ID NO: 500321 - RNA, 12 nt, Homo sapiens
uauauaauacua

SEQ ID NO: 500322 - RNA, 21 nt, Homo sapiens
uauauuuugugugaaauugca

SEQ ID NO: 500323 - RNA, 15 nt, Homo sapiens
uaucagcuacaauug

SEQ ID NO: 500324 - RNA, 19 nt, Homo sapiens
uaugcaguauugccacaau

SEQ ID NO: 500325 - RNA, 21 nt, Homo sapiens
uauguaaauagcuaagauaua

SEQ ID NO: 500326 - RNA, 15 nt, Homo sapiens
uaugugggauauuga

SEQ ID NO: 500327 - RNA, 20 nt, Homo sapiens
uauucuauaaaacucugcau

SEQ ID NO: 500328 - RNA, 14 nt, Homo sapiens
uauugaauguuaaa

SEQ ID NO: 500329 - RNA, 22 nt, Homo sapiens
ucaaauacacauuugcuacugu

SEQ ID NO: 500330 - RNA, 13 nt, Homo sapiens
ucaaggugggccu

SEQ ID NO: 500331 - RNA, 20 nt, Homo sapiens
ucaauguuuagcagauuuaa

SEQ ID NO: 500332 - RNA, 19 nt, Homo sapiens
ucacccgagcuagagugca

SEQ ID NO: 500333 - RNA, 21 nt, Homo sapiens
ucagauacaugguugugaccu

SEQ ID NO: 500334 - RNA, 22 nt, Homo sapiens
ucagcggucauucuacacugag

SEQ ID NO: 500335 - RNA, 20 nt, Homo sapiens
ucagggagccuggaagccaa

SEQ ID NO: 500336 - RNA, 16 nt, Homo sapiens
ucauggaaaagcccag

SEQ ID NO: 500337 - RNA, 15 nt, Homo sapiens
ucauuccuaacacag

SEQ ID NO: 500338 - RNA, 20 nt, Homo sapiens
ucauuccuaacacagcaugu

SEQ ID NO: 500339 - RNA, 22 nt, Homo sapiens
uccacacccacuuuguccauuu

SEQ ID NO: 500340 - RNA, 14 nt, Homo sapiens
uccagugcaauugu

SEQ ID NO: 500341 - RNA, 21 nt, Homo sapiens
uccauaggcgcaggugcacag

SEQ ID NO: 500342 - RNA, 16 nt, Homo sapiens
uccauuugcaaauaua

SEQ ID NO: 500343 - RNA, 18 nt, Homo sapiens
ucccacgaugucaaggac

SEQ ID NO: 500344 - RNA, 22 nt, Homo sapiens
ucccucuucuucucccugugug

SEQ ID NO: 500345 - RNA, 12 nt, Homo sapiens
uccuacagccuc

SEQ ID NO: 500346 - RNA, 11 nt, Homo sapiens
uccucagggag

SEQ ID NO: 500347 - RNA, 20 nt, Homo sapiens
uccucaguaugugggggcuu

SEQ ID NO: 500348 - RNA, 22 nt, Homo sapiens
uccucucccgcgggccuggaca

SEQ ID NO: 500349 - RNA, 23 nt, Homo sapiens
uccuggaggugggagacaaggaa

SEQ ID NO: 500350 - RNA, 13 nt, Homo sapiens
uccuuaccgcaca

SEQ ID NO: 500351 - RNA, 20 nt, Homo sapiens
ucuaccucugucacccgagc

SEQ ID NO: 500352 - RNA, 20 nt, Homo sapiens
ucuagagcuuaaugcuacau

SEQ ID NO: 500353 - RNA, 16 nt, Homo sapiens
ucucauugacuuuuau

SEQ ID NO: 500354 - RNA, 16 nt, Homo sapiens
ucucugguuuacuuca

SEQ ID NO: 500355 - RNA, 20 nt, Homo sapiens
ucugaggcccugcccaauga

SEQ ID NO: 500356 - RNA, 19 nt, Homo sapiens
ucugaucaguuuccuccaa

SEQ ID NO: 500357 - RNA, 14 nt, Homo sapiens
ucugcccuguauau

SEQ ID NO: 500358 - RNA, 15 nt, Homo sapiens
ucugggcagcuguca

SEQ ID NO: 500359 - RNA, 18 nt, Homo sapiens
ucugggcugccaugugaa

SEQ ID NO: 500360 - RNA, 19 nt, Homo sapiens
ucuuagccucccaaagugc

SEQ ID NO: 500361 - RNA, 22 nt, Homo sapiens
ucuuccagcccaucuccgggga

SEQ ID NO: 500362 - RNA, 14 nt, Homo sapiens
ucuucccaugcauu

SEQ ID NO: 500363 - RNA, 14 nt, Homo sapiens
ucuucuuacaugca

SEQ ID NO: 500364 - RNA, 20 nt, Homo sapiens
ucuuggcucacuacagccuc

SEQ ID NO: 500365 - RNA, 14 nt, Homo sapiens
ugaaacuaacagau

SEQ ID NO: 500366 - RNA, 23 nt, Homo sapiens
ugaaacuaacagauaagcaagag

SEQ ID NO: 500367 - RNA, 20 nt, Homo sapiens
ugaaaucuuugcagcaauga

SEQ ID NO: 500368 - RNA, 16 nt, Homo sapiens
ugaagaaaggaacuga

SEQ ID NO: 500369 - RNA, 16 nt, Homo sapiens
ugaagccccuuguccu

SEQ ID NO: 500370 - RNA, 23 nt, Homo sapiens
ugaaggcugucaggauucuucaa

SEQ ID NO: 500371 - RNA, 17 nt, Homo sapiens
ugaaguuuuacugucua

SEQ ID NO: 500372 - RNA, 17 nt, Homo sapiens
ugaauacugggaaucaa

SEQ ID NO: 500373 - RNA, 17 nt, Homo sapiens
ugaaucuguuacugaaa

SEQ ID NO: 500374 - RNA, 18 nt, Homo sapiens
ugaauguauaaagacacc

SEQ ID NO: 500375 - RNA, 16 nt, Homo sapiens
ugacaaucaacucuaa

SEQ ID NO: 500376 - RNA, 23 nt, Homo sapiens
ugacaaucaacucuaauagugcu

SEQ ID NO: 500377 - RNA, 18 nt, Homo sapiens
ugacagugcccagcauga

SEQ ID NO: 500378 - RNA, 22 nt, Homo sapiens
ugaccauggaggccagugccag

SEQ ID NO: 500379 - RNA, 11 nt, Homo sapiens
ugacuaaagag

SEQ ID NO: 500380 - RNA, 16 nt, Homo sapiens
ugaggaaaauucuuaa

SEQ ID NO: 500381 - RNA, 12 nt, Homo sapiens
ugagggcucacu

SEQ ID NO: 500382 - RNA, 22 nt, Homo sapiens
ugaguugcacuuauugaccauu

SEQ ID NO: 500383 - RNA, 17 nt, Homo sapiens
ugaugcgaaaacuugaa

SEQ ID NO: 500384 - RNA, 18 nt, Homo sapiens
ugauggcguggcaacccu

SEQ ID NO: 500385 - RNA, 20 nt, Homo sapiens
ugauguacagauucuuucag

SEQ ID NO: 500386 - RNA, 16 nt, Homo sapiens
ugauguguccucaggg

SEQ ID NO: 500387 - RNA, 18 nt, Homo sapiens
ugauguguccucagggag

SEQ ID NO: 500388 - RNA, 17 nt, Homo sapiens
ugauugucagcuacuaa

SEQ ID NO: 500389 - RNA, 23 nt, Homo sapiens
ugcaauuuccccucuguguccuc

SEQ ID NO: 500390 - RNA, 18 nt, Homo sapiens
ugcacagggggaggccau

SEQ ID NO: 500391 - RNA, 22 nt, Homo sapiens
aaccaguaagguuauaacugug

SEQ ID NO: 500392 - RNA, 13 nt, Homo sapiens
aacccucacugug

SEQ ID NO: 500393 - RNA, 18 nt, Homo sapiens
aacccucacuguguugga

SEQ ID NO: 500394 - RNA, 20 nt, Homo sapiens
aacgaagaguucccuugaaa

SEQ ID NO: 500395 - RNA, 21 nt, Homo sapiens
aacucucugguuuacuucaaa

SEQ ID NO: 500396 - RNA, 17 nt, Homo sapiens
aacucugggcugccaug

SEQ ID NO: 500397 - RNA, 18 nt, Homo sapiens
aacucugggcugccaugu

SEQ ID NO: 500398 - RNA, 21 nt, Homo sapiens
aacugcuucccuuacuuugcu

SEQ ID NO: 500399 - RNA, 22 nt, Homo sapiens
aacuucccuuaagagucaucca

SEQ ID NO: 500400 - RNA, 14 nt, Homo sapiens
aacuucucugaguc

SEQ ID NO: 500401 - RNA, 17 nt, Homo sapiens
aagaaaaaguugcaguc

SEQ ID NO: 500402 - RNA, 19 nt, Homo sapiens
aagacaauggccauugugu

SEQ ID NO: 500403 - RNA, 21 nt, Homo sapiens
aagacucaccucauccuuacc

SEQ ID NO: 500404 - RNA, 14 nt, Homo sapiens
aagaggcagugaga

SEQ ID NO: 500405 - RNA, 13 nt, Homo sapiens
aagaggcagugau

SEQ ID NO: 500406 - RNA, 12 nt, Homo sapiens
aagagucaucca

SEQ ID NO: 500407 - RNA, 15 nt, Homo sapiens
aagcaugaaaaagca

SEQ ID NO: 500408 - RNA, 20 nt, Homo sapiens
aagccagaaacguaacugug

SEQ ID NO: 500409 - RNA, 21 nt, Homo sapiens
aaggaacugaggcccagaaag

SEQ ID NO: 500410 - RNA, 19 nt, Homo sapiens
aaggacuccugucuguccu

SEQ ID NO: 500411 - RNA, 20 nt, Homo sapiens
aaggauaucgggucacuguc

SEQ ID NO: 500412 - RNA, 19 nt, Homo sapiens
aagggauggaaaaggaaga

SEQ ID NO: 500413 - RNA, 14 nt, Homo sapiens
aagggcagugagaa

SEQ ID NO: 500414 - RNA, 15 nt, Homo sapiens
aaggucagagucaaa

SEQ ID NO: 500415 - RNA, 14 nt, Homo sapiens
aaguugcagucuca

SEQ ID NO: 500416 - RNA, 14 nt, Homo sapiens
aauacacauuugcu

SEQ ID NO: 500417 - RNA, 20 nt, Homo sapiens
aauaugacggaagaacauag

SEQ ID NO: 500418 - RNA, 23 nt, Homo sapiens
aaucauugauugucagcuacuaa

SEQ ID NO: 500419 - RNA, 19 nt, Homo sapiens
aaucgauucugcagcaccg

SEQ ID NO: 500420 - RNA, 18 nt, Homo sapiens
aaucuucaaagccuucuc

SEQ ID NO: 500421 - RNA, 13 nt, Homo sapiens
aauuaagugcaau

SEQ ID NO: 500422 - RNA, 13 nt, Homo sapiens
aauucaacuuugu

SEQ ID NO: 500423 - RNA, 23 nt, Homo sapiens
aauugaguugcacuuauugacca

SEQ ID NO: 500424 - RNA, 13 nt, Homo sapiens
acaaaauuaagca

SEQ ID NO: 500425 - RNA, 15 nt, Homo sapiens
acaaaggcccagcag

SEQ ID NO: 500426 - RNA, 21 nt, Homo sapiens
acaacuucaguccaacuguca

SEQ ID NO: 500427 - RNA, 14 nt, Homo sapiens
acaaggaaccaccg

SEQ ID NO: 500428 - RNA, 13 nt, Homo sapiens
ucauccaucacag

SEQ ID NO: 500429 - RNA, 17 nt, Homo sapiens
ucaugaggccggaugaa

SEQ ID NO: 500430 - RNA, 22 nt, Homo sapiens
ucauucugcauucucuagucag

SEQ ID NO: 500431 - RNA, 16 nt, Homo sapiens
ucauuuacacagugcu

SEQ ID NO: 500432 - RNA, 18 nt, Homo sapiens
ucauuuucauauuguaau

SEQ ID NO: 500433 - RNA, 17 nt, Homo sapiens
uccaaguauauaugaau

SEQ ID NO: 500434 - RNA, 17 nt, Homo sapiens
uccccaacugaguucaa

SEQ ID NO: 500435 - RNA, 13 nt, Homo sapiens
uccccagccugcu

SEQ ID NO: 500436 - RNA, 18 nt, Homo sapiens
uccccagccugcucccua

SEQ ID NO: 500437 - RNA, 15 nt, Homo sapiens
uccccuaaaauaaca

SEQ ID NO: 500438 - RNA, 12 nt, Homo sapiens
uccccuccgcca

SEQ ID NO: 500439 - RNA, 12 nt, Homo sapiens
uccccucuagga

SEQ ID NO: 500440 - RNA, 14 nt, Homo sapiens
uccccuuuguccug

SEQ ID NO: 500441 - RNA, 14 nt, Homo sapiens
ucccucuucucucc

SEQ ID NO: 500442 - RNA, 21 nt, Homo sapiens
uccuaccccuuccuguccugc

SEQ ID NO: 500443 - RNA, 18 nt, Homo sapiens
uccucaaaccacuugccu

SEQ ID NO: 500444 - RNA, 16 nt, Homo sapiens
uccugauuaggaauau

SEQ ID NO: 500445 - RNA, 22 nt, Homo sapiens
uccugcaaagucuccagaagaa

SEQ ID NO: 500446 - RNA, 19 nt, Homo sapiens
uccuggaggugacacuuga

SEQ ID NO: 500447 - RNA, 23 nt, Homo sapiens
ucggccaguuuucggaaacacug

SEQ ID NO: 500448 - RNA, 14 nt, Homo sapiens
ucggcuccugaugg

SEQ ID NO: 500449 - RNA, 17 nt, Homo sapiens
ucuaacauaccuuguca

SEQ ID NO: 500450 - RNA, 22 nt, Homo sapiens
ucuaaggcugugccaucagcuc

SEQ ID NO: 500451 - RNA, 13 nt, Homo sapiens
ucuaauguacaau

SEQ ID NO: 500452 - RNA, 21 nt, Homo sapiens
ucuaauguacaauaaagcaau

SEQ ID NO: 500453 - RNA, 19 nt, Homo sapiens
ucuauacuccuucccuuaa

SEQ ID NO: 500454 - RNA, 17 nt, Homo sapiens
ucucaaugaaccauaaa

SEQ ID NO: 500455 - RNA, 19 nt, Homo sapiens
ucucuaacauaccuuguca

SEQ ID NO: 500456 - RNA, 23 nt, Homo sapiens
ucucucccacuuccuccuaccug

SEQ ID NO: 500457 - RNA, 16 nt, Homo sapiens
ucugcauucucuaguc

SEQ ID NO: 500458 - RNA, 13 nt, Homo sapiens
ucuguauguguau

SEQ ID NO: 500459 - RNA, 22 nt, Homo sapiens
ucuuaaacuaaaugugcaauag

SEQ ID NO: 500460 - RNA, 12 nt, Homo sapiens
ucuucuuccuca

SEQ ID NO: 500461 - RNA, 17 nt, Homo sapiens
ucuugccauccugaugg

SEQ ID NO: 500462 - RNA, 17 nt, Homo sapiens
ucuugguaauccccuaa

SEQ ID NO: 500463 - RNA, 15 nt, Homo sapiens
ucuuuaacaaccucu

SEQ ID NO: 500464 - RNA, 16 nt, Homo sapiens
ugaaaaaaaacagugg

SEQ ID NO: 500465 - RNA, 15 nt, Homo sapiens
ugaaaugaacuuugu

SEQ ID NO: 500466 - RNA, 19 nt, Homo sapiens
ugaaauugcauacuuugua

SEQ ID NO: 500467 - RNA, 17 nt, Homo sapiens
ugaacuaggcugagcaa

SEQ ID NO: 500468 - RNA, 20 nt, Homo sapiens
ugaagacugggugaggauaa

SEQ ID NO: 500469 - RNA, 15 nt, Homo sapiens
ugaaugaauaaagca

SEQ ID NO: 500470 - RNA, 15 nt, Homo sapiens
ugaaugaauaaagua

SEQ ID NO: 500471 - RNA, 22 nt, Homo sapiens
ugacagguuuuccaaaaguaaa

SEQ ID NO: 500472 - RNA, 11 nt, Homo sapiens
ugacaguuccc

SEQ ID NO: 500473 - RNA, 14 nt, Homo sapiens
ugaccuaaauuauu

SEQ ID NO: 500474 - RNA, 14 nt, Homo sapiens
ugacucagugacca

SEQ ID NO: 500475 - RNA, 18 nt, Homo sapiens
ugacugagcagcauccac

SEQ ID NO: 500476 - RNA, 16 nt, Homo sapiens
ugacuguaucuugaua

SEQ ID NO: 500477 - RNA, 16 nt, Homo sapiens
ugagacagcacagcca

SEQ ID NO: 500478 - RNA, 16 nt, Homo sapiens
ugagacugaacugugu

SEQ ID NO: 500479 - RNA, 15 nt, Homo sapiens
ugagcauggggccag

SEQ ID NO: 500480 - RNA, 23 nt, Homo sapiens
ugagcauggggccaggaaagucu

SEQ ID NO: 500481 - RNA, 12 nt, Homo sapiens
ugagggugcuga

SEQ ID NO: 500482 - RNA, 17 nt, Homo sapiens
ugauaccauaugaauga

SEQ ID NO: 500483 - RNA, 17 nt, Homo sapiens
ugauacuuugacagugu

SEQ ID NO: 500484 - RNA, 20 nt, Homo sapiens
ugaugucagcugcuguugaa

SEQ ID NO: 500485 - RNA, 17 nt, Homo sapiens
ugaugugugagcuaugc

SEQ ID NO: 500486 - RNA, 14 nt, Homo sapiens
ugcaaauacuguau

SEQ ID NO: 500487 - RNA, 15 nt, Homo sapiens
ugcaaggugugaugg

SEQ ID NO: 500488 - RNA, 14 nt, Homo sapiens
ugcaauacugcuua

SEQ ID NO: 500489 - RNA, 14 nt, Homo sapiens
ugcacuaacagagu

SEQ ID NO: 500490 - RNA, 16 nt, Homo sapiens
ugcacuauuuccacau

SEQ ID NO: 500491 - RNA, 21 nt, Homo sapiens
ugcagacuguucuuacuguaa

SEQ ID NO: 500492 - RNA, 20 nt, Homo sapiens
ugcagcggcuccugcaaaag

SEQ ID NO: 500493 - RNA, 17 nt, Homo sapiens
ugcaggcaagugggaua

SEQ ID NO: 500494 - RNA, 18 nt, Homo sapiens
ugcaucaucucuuccuca

SEQ ID NO: 500495 - RNA, 21 nt, Homo sapiens
ugcauggauucagcaugucca

SEQ ID NO: 500496 - RNA, 16 nt, Homo sapiens
ugcauucucuagucag

SEQ ID NO: 500497 - RNA, 23 nt, Homo sapiens
ugccaauugaauaggaucaaauu

SEQ ID NO: 500498 - RNA, 19 nt, Homo sapiens
ugccccggaccuaccuccc

SEQ ID NO: 500499 - RNA, 23 nt, Homo sapiens
ugccuaacuuauccaucuuugaa

SEQ ID NO: 500500 - RNA, 15 nt, Homo sapiens
ugcuaccccuuugau

SEQ ID NO: 500501 - RNA, 13 nt, Homo sapiens
ugcuaugacugua

SEQ ID NO: 500502 - RNA, 22 nt, Homo sapiens
ugcucacgucaaaugcauacaa

SEQ ID NO: 500503 - RNA, 14 nt, Homo sapiens
ugcucccacagggg

SEQ ID NO: 500504 - RNA, 15 nt, Homo sapiens
ugcucccuagccaga

SEQ ID NO: 500505 - RNA, 16 nt, Homo sapiens
ugcucccuagccagag

SEQ ID NO: 500506 - RNA, 13 nt, Homo sapiens
ugcucuugccaaa

SEQ ID NO: 500507 - RNA, 12 nt, Homo sapiens
ugcuuacaggac

SEQ ID NO: 500508 - RNA, 21 nt, Homo sapiens
ugcuuaggcacucauggguaa

SEQ ID NO: 500509 - RNA, 21 nt, Homo sapiens
uggaaauuccuguacuguguc

SEQ ID NO: 500510 - RNA, 15 nt, Homo sapiens
uggaacuguugaaag

SEQ ID NO: 500511 - RNA, 20 nt, Homo sapiens
uggaagaugcagaagcaaua

SEQ ID NO: 500512 - RNA, 20 nt, Homo sapiens
uggaagugugugccaagagc

SEQ ID NO: 500513 - RNA, 21 nt, Homo sapiens
uggaagugugugccaagagcu

SEQ ID NO: 500514 - RNA, 23 nt, Homo sapiens
uggacuaaaugaucucugaaagu

SEQ ID NO: 500515 - RNA, 22 nt, Homo sapiens
uggauaggcacauagagaggga

SEQ ID NO: 500516 - RNA, 20 nt, Homo sapiens
uggcaaaugccugacucagu

SEQ ID NO: 500517 - RNA, 19 nt, Homo sapiens
uggcaacggaagaaugaga

SEQ ID NO: 500518 - RNA, 17 nt, Homo sapiens
uggcacuaccccaaacc

SEQ ID NO: 500519 - RNA, 16 nt, Homo sapiens
uggcaggacagcuccu

SEQ ID NO: 500520 - RNA, 15 nt, Homo sapiens
uggcagucucagucc

SEQ ID NO: 500521 - RNA, 21 nt, Homo sapiens
uggcauucuuugcaauacugc

SEQ ID NO: 500522 - RNA, 12 nt, Homo sapiens
uggccaaaaccu

SEQ ID NO: 500523 - RNA, 14 nt, Homo sapiens
uggccuuguaagac

SEQ ID NO: 500524 - RNA, 19 nt, Homo sapiens
uggcugccaacaugauccc

SEQ ID NO: 500525 - RNA, 22 nt, Homo sapiens
uggcuucuuuacuuaguucaag

SEQ ID NO: 500526 - RNA, 22 nt, Homo sapiens
ugggacacuccgucugcuccaa

SEQ ID NO: 500527 - RNA, 19 nt, Homo sapiens
ugggcugugggcaagccua

SEQ ID NO: 500528 - RNA, 22 nt, Homo sapiens
uggggacacagcaucagcucaa

SEQ ID NO: 500529 - RNA, 11 nt, Homo sapiens
uggggccauaa

SEQ ID NO: 500530 - RNA, 13 nt, Homo sapiens
uggggccucaggc

SEQ ID NO: 500531 - RNA, 18 nt, Homo sapiens
ugggguaguuguguuuca

SEQ ID NO: 500532 - RNA, 18 nt, Homo sapiens
uggucuguuugcauuuga

SEQ ID NO: 500533 - RNA, 17 nt, Homo sapiens
uggugaaugugugagaa

SEQ ID NO: 500534 - RNA, 19 nt, Homo sapiens
uggugauauuguguggucu

SEQ ID NO: 500535 - RNA, 23 nt, Homo sapiens
ugguguacagaccaccuuucaca

SEQ ID NO: 500536 - RNA, 15 nt, Homo sapiens
uguaaaauuauuuca

SEQ ID NO: 500537 - RNA, 19 nt, Homo sapiens
uguaaagauguuuauuuca

SEQ ID NO: 500538 - RNA, 19 nt, Homo sapiens
uguaaauaauuugcacuga

SEQ ID NO: 500539 - RNA, 20 nt, Homo sapiens
uguacaauaaagcaaugugg

SEQ ID NO: 500540 - RNA, 17 nt, Homo sapiens
uguacagaccaccuuuc

SEQ ID NO: 500541 - RNA, 17 nt, Homo sapiens
uguacagauucuuucag

SEQ ID NO: 500542 - RNA, 19 nt, Homo sapiens
uguauauucaggacuugaa

SEQ ID NO: 500543 - RNA, 15 nt, Homo sapiens
uguauuuacaguuuc

SEQ ID NO: 500544 - RNA, 16 nt, Homo sapiens
ugucagcugcuguuga

SEQ ID NO: 500545 - RNA, 16 nt, Homo sapiens
uguccugccuccucau

SEQ ID NO: 500546 - RNA, 16 nt, Homo sapiens
ugugaagcaaacucua

SEQ ID NO: 500547 - RNA, 15 nt, Homo sapiens
ugugacucagcauca

SEQ ID NO: 500548 - RNA, 14 nt, Homo sapiens
ugugagcuaugcaa

SEQ ID NO: 500549 - RNA, 18 nt, Homo sapiens
ugugagcuaugcaaacaa

SEQ ID NO: 500550 - RNA, 22 nt, Homo sapiens
uguggcauaaauugcaucacug

SEQ ID NO: 500551 - RNA, 20 nt, Homo sapiens
uguguaaauaauuugcacug

SEQ ID NO: 500552 - RNA, 18 nt, Homo sapiens
ugugugagcuaugcaaac

SEQ ID NO: 500553 - RNA, 16 nt, Homo sapiens
uguuauacugaaccag

SEQ ID NO: 500554 - RNA, 15 nt, Homo sapiens
uguucacuguggcau

SEQ ID NO: 500555 - RNA, 20 nt, Homo sapiens
uguucugguuacuguucuaa

SEQ ID NO: 500556 - RNA, 12 nt, Homo sapiens
uguugcacugcc

SEQ ID NO: 500557 - RNA, 23 nt, Homo sapiens
uguuuauuucaggcauuggauau

SEQ ID NO: 500558 - RNA, 23 nt, Homo sapiens
uguuugccaggacaugcaauaaa

SEQ ID NO: 500559 - RNA, 14 nt, Homo sapiens
uuaaagacguaaaa

SEQ ID NO: 500560 - RNA, 13 nt, Homo sapiens
uuaaaugguaaua

SEQ ID NO: 500561 - RNA, 17 nt, Homo sapiens
uuaaauuuaauaccaga

SEQ ID NO: 500562 - RNA, 15 nt, Homo sapiens
uuaaggggaagaaug

SEQ ID NO: 500563 - RNA, 18 nt, Homo sapiens
uuaauaggaaaaacggaa

SEQ ID NO: 500564 - RNA, 17 nt, Homo sapiens
uuagaccuguguuacua

SEQ ID NO: 500565 - RNA, 19 nt, Homo sapiens
uuagagaaagaacuaugaa

SEQ ID NO: 500566 - RNA, 17 nt, Homo sapiens
uuagaucucauaaugcu

SEQ ID NO: 500567 - RNA, 16 nt, Homo sapiens
uuauuccucagaacaa

SEQ ID NO: 500568 - RNA, 12 nt, Homo sapiens
uuauugcaaugc

SEQ ID NO: 500569 - RNA, 20 nt, Homo sapiens
uuauugguuguuguauugau

SEQ ID NO: 500570 - RNA, 13 nt, Homo sapiens
uuauuuuguugaa

SEQ ID NO: 500571 - RNA, 23 nt, Homo sapiens
uucaacuguauaguuuuauuuac

SEQ ID NO: 500572 - RNA, 17 nt, Homo sapiens
uucagguuagugacauu

SEQ ID NO: 500573 - RNA, 22 nt, Homo sapiens
uucagucaaagauacacaaucu

SEQ ID NO: 500574 - RNA, 19 nt, Homo sapiens
uucauacgcaucccaucuc

SEQ ID NO: 500575 - RNA, 18 nt, Homo sapiens
uuccauagccuccaaaca

SEQ ID NO: 500576 - RNA, 22 nt, Homo sapiens
uucccagcuucugccacauaaa

SEQ ID NO: 500577 - RNA, 16 nt, Homo sapiens
uucccauuaaagaagu

SEQ ID NO: 500578 - RNA, 16 nt, Homo sapiens
uuccuccccuguucau

SEQ ID NO: 500579 - RNA, 16 nt, Homo sapiens
uuccuggugacuccug

SEQ ID NO: 500580 - RNA, 10 nt, Homo sapiens
uucggcucua

SEQ ID NO: 500581 - RNA, 18 nt, Homo sapiens
uucuauucuagccugcau

SEQ ID NO: 500582 - RNA, 16 nt, Homo sapiens
uucugacuacuuguug

SEQ ID NO: 500583 - RNA, 18 nt, Homo sapiens
uucugcauucucuaguca

SEQ ID NO: 500584 - RNA, 20 nt, Homo sapiens
uucuggauuucauacuguaa

SEQ ID NO: 500585 - RNA, 21 nt, Homo sapiens
uugaaacuuugggaaaacaug

SEQ ID NO: 500586 - RNA, 15 nt, Homo sapiens
uugaaagaaauggug

SEQ ID NO: 500587 - RNA, 19 nt, Homo sapiens
uugaacuucugacuacuug

SEQ ID NO: 500588 - RNA, 13 nt, Homo sapiens
uugaaucuaugaa

SEQ ID NO: 500589 - RNA, 19 nt, Homo sapiens
uugacacuauucacuaaaa

SEQ ID NO: 500590 - RNA, 20 nt, Homo sapiens
uugacacuauucacuaaaau

SEQ ID NO: 500591 - RNA, 16 nt, Homo sapiens
uugacuguucaaugau

SEQ ID NO: 500592 - RNA, 19 nt, Homo sapiens
uugacuuuuauaaagcaug

SEQ ID NO: 500593 - RNA, 22 nt, Homo sapiens
uugauugggaaaacauuugcug

SEQ ID NO: 500594 - RNA, 23 nt, Homo sapiens
uugccauccugauggaccugccc

SEQ ID NO: 500595 - RNA, 15 nt, Homo sapiens
uuggagaaaaugggu

SEQ ID NO: 500596 - RNA, 18 nt, Homo sapiens
uuggcauucuuugcaaua

SEQ ID NO: 500597 - RNA, 17 nt, Homo sapiens
uuguaaaauuauuucau

SEQ ID NO: 500598 - RNA, 18 nt, Homo sapiens
uugucaguuccaaacaga

SEQ ID NO: 500599 - RNA, 12 nt, Homo sapiens
uuguugcacugc

SEQ ID NO: 500600 - RNA, 17 nt, Homo sapiens
uuguuugccaggacaug

SEQ ID NO: 500601 - RNA, 17 nt, Homo sapiens
uuuaagcuucaguugcu

SEQ ID NO: 500602 - RNA, 19 nt, Homo sapiens
uuuaaggcaggacagagaa

SEQ ID NO: 500603 - RNA, 21 nt, Homo sapiens
uuuagaccuguguuacuaaaa

SEQ ID NO: 500604 - RNA, 22 nt, Homo sapiens
uuucaaaagguauuauacaugu

SEQ ID NO: 500605 - RNA, 13 nt, Homo sapiens
uuuccaaaaaagu

SEQ ID NO: 500606 - RNA, 20 nt, Homo sapiens
uuuccagaguuugucauuau

SEQ ID NO: 500607 - RNA, 18 nt, Homo sapiens
uuucuauuuuuaugauga

SEQ ID NO: 500608 - RNA, 15 nt, Homo sapiens
uuucucccugcagcc

SEQ ID NO: 500609 - RNA, 12 nt, Homo sapiens
uuugcucuugcc

SEQ ID NO: 500610 - RNA, 15 nt, Homo sapiens
uuugcucuugccaaa

SEQ ID NO: 500611 - RNA, 17 nt, Homo sapiens
uuugcucuugccaaaaa

SEQ ID NO: 500612 - RNA, 18 nt, Homo sapiens
uuuggagauagauggaua

SEQ ID NO: 500613 - RNA, 19 nt, Homo sapiens
uuugguuuugacagguuuu

SEQ ID NO: 500614 - RNA, 21 nt, Homo sapiens
uuuuaauaacuuaucuauaaa

SEQ ID NO: 500615 - RNA, 14 nt, Homo sapiens
uuuugcaugcaugc

SEQ ID NO: 500616 - RNA, 20 nt, Homo sapiens
uuuuucuucaugccugauga

SEQ ID NO: 500617 - RNA, 18 nt, Homo sapiens
cuaaccaaggcuguguuu

SEQ ID NO: 500618 - RNA, 15 nt, Homo sapiens
cuaacuagcauugua

SEQ ID NO: 500619 - RNA, 22 nt, Homo sapiens
cuaagucccuuccuauucuccu

SEQ ID NO: 500620 - RNA, 19 nt, Homo sapiens
cuacacucaccugcacuaa

SEQ ID NO: 500621 - RNA, 17 nt, Homo sapiens
cuacaguuuuaacugug

SEQ ID NO: 500622 - RNA, 21 nt, Homo sapiens
cuaccaauuucuuuuauguua

SEQ ID NO: 500623 - RNA, 21 nt, Homo sapiens
cuacuguuaucaguaaugcua

SEQ ID NO: 500624 - RNA, 22 nt, Homo sapiens
cuagaguucauggauauguuau

SEQ ID NO: 500625 - RNA, 19 nt, Homo sapiens
cuagccagaggcucuaaug

SEQ ID NO: 500626 - RNA, 13 nt, Homo sapiens
cuauauagacuug

SEQ ID NO: 500627 - RNA, 19 nt, Homo sapiens
cuaucugggcugugggcaa

SEQ ID NO: 500628 - RNA, 16 nt, Homo sapiens
cuaucuucuuuggacu

SEQ ID NO: 500629 - RNA, 15 nt, Homo sapiens
cuaugaaccugaaaa

SEQ ID NO: 500630 - RNA, 12 nt, Homo sapiens
cucaaaccacuu

SEQ ID NO: 500631 - RNA, 15 nt, Homo sapiens
cucaaaccacuugcc

SEQ ID NO: 500632 - RNA, 21 nt, Homo sapiens
cucaaagcagcaggacugugg

SEQ ID NO: 500633 - RNA, 20 nt, Homo sapiens
cucaauccauccauguacuu

SEQ ID NO: 500634 - RNA, 14 nt, Homo sapiens
cucacgccuguaau

SEQ ID NO: 500635 - RNA, 22 nt, Homo sapiens
cucacugcugcaaauacuguau

SEQ ID NO: 500636 - RNA, 14 nt, Homo sapiens
cucagaacaaugaa

SEQ ID NO: 500637 - RNA, 15 nt, Homo sapiens
cucagaacaaugaaa

SEQ ID NO: 500638 - RNA, 23 nt, Homo sapiens
cucagccugcuuuccugcagcag

SEQ ID NO: 500639 - RNA, 16 nt, Homo sapiens
cucaggagaagggaua

SEQ ID NO: 500640 - RNA, 14 nt, Homo sapiens
cucagugaccagug

SEQ ID NO: 500641 - RNA, 20 nt, Homo sapiens
cuccaccccacaacccaaaa

SEQ ID NO: 500642 - RNA, 14 nt, Homo sapiens
cuccacucuucucu

SEQ ID NO: 500643 - RNA, 22 nt, Homo sapiens
cuccaguuuacccuucagguug

SEQ ID NO: 500644 - RNA, 21 nt, Homo sapiens
cucccagucucugucguggag

SEQ ID NO: 500645 - RNA, 17 nt, Homo sapiens
cucccuagccagaggcu

SEQ ID NO: 500646 - RNA, 20 nt, Homo sapiens
gaggcagagguugcagugag

SEQ ID NO: 500647 - RNA, 18 nt, Homo sapiens
gaggcaggagaauugcuu

SEQ ID NO: 500648 - RNA, 12 nt, Homo sapiens
gaggcugagaaa

SEQ ID NO: 500649 - RNA, 17 nt, Homo sapiens
gaggucaucacuuugac

SEQ ID NO: 500650 - RNA, 20 nt, Homo sapiens
gagucuguacuaaacaguaa

SEQ ID NO: 500651 - RNA, 20 nt, Homo sapiens
gagugacuacacacaguacg

SEQ ID NO: 500652 - RNA, 20 nt, Homo sapiens
gaguucauggauauguuaua

SEQ ID NO: 500653 - RNA, 15 nt, Homo sapiens
gaguuugucauuaua

SEQ ID NO: 500654 - RNA, 16 nt, Homo sapiens
gauacuuugacagugu

SEQ ID NO: 500655 - RNA, 14 nt, Homo sapiens
gauaggccuguggg

SEQ ID NO: 500656 - RNA, 20 nt, Homo sapiens
gauccccaaaacaggccagg

SEQ ID NO: 500657 - RNA, 21 nt, Homo sapiens
gaucccguucagaaaaccacu

SEQ ID NO: 500658 - RNA, 22 nt, Homo sapiens
gaugaauugucacaucuaucca

SEQ ID NO: 500659 - RNA, 13 nt, Homo sapiens
gaugaguuugaca

SEQ ID NO: 500660 - RNA, 13 nt, Homo sapiens
gaugauucaggag

SEQ ID NO: 500661 - RNA, 18 nt, Homo sapiens
gaugugugagcuaugcaa

SEQ ID NO: 500662 - RNA, 11 nt, Homo sapiens
gauuauaccug

SEQ ID NO: 500663 - RNA, 14 nt, Homo sapiens
gauuauaccuggau

SEQ ID NO: 500664 - RNA, 19 nt, Homo sapiens
gauuaugcagacaaccuca

SEQ ID NO: 500665 - RNA, 13 nt, Homo sapiens
gauuauuccucag

SEQ ID NO: 500666 - RNA, 22 nt, Homo sapiens
gauucaggagaguguauaugaa

SEQ ID NO: 500667 - RNA, 22 nt, Homo sapiens
gauuccagcugucuugucuuuu

SEQ ID NO: 500668 - RNA, 16 nt, Homo sapiens
gcaaaacucauuuaca

SEQ ID NO: 500669 - RNA, 13 nt, Homo sapiens
gcaaauguuaaaa

SEQ ID NO: 500670 - RNA, 15 nt, Homo sapiens
gcaagaaagcuuccu

SEQ ID NO: 500671 - RNA, 20 nt, Homo sapiens
gcaaguuagaacuagccaaa

SEQ ID NO: 500672 - RNA, 10 nt, Homo sapiens
gcacagauua

SEQ ID NO: 500673 - RNA, 22 nt, Homo sapiens
gcacauauccaggcaccaggac

SEQ ID NO: 500674 - RNA, 23 nt, Homo sapiens
gcacauauccaggcaccaggacu

SEQ ID NO: 500675 - RNA, 19 nt, Homo sapiens
gcaccuacacucaccugca

SEQ ID NO: 500676 - RNA, 13 nt, Homo sapiens
gcacuauuuccac

SEQ ID NO: 500677 - RNA, 20 nt, Homo sapiens
gcacucagaaaauggcacuu

SEQ ID NO: 500678 - RNA, 19 nt, Homo sapiens
gcagcggcuccugcaaaag

SEQ ID NO: 500679 - RNA, 12 nt, Homo sapiens
gcagcugugaug

SEQ ID NO: 500680 - RNA, 15 nt, Homo sapiens
gcaggacagcuccug

SEQ ID NO: 500681 - RNA, 17 nt, Homo sapiens
gcagugagcuguguucu

SEQ ID NO: 500682 - RNA, 18 nt, Homo sapiens
gcaucaucucuuccucac

SEQ ID NO: 500683 - RNA, 19 nt, Homo sapiens
gcaucccaucucucccacu

SEQ ID NO: 500684 - RNA, 22 nt, Homo sapiens
gcaugcagcuuugcaaacccau

SEQ ID NO: 500685 - RNA, 22 nt, Homo sapiens
gcauguccaacaugguaauuca

SEQ ID NO: 500686 - RNA, 14 nt, Homo sapiens
gccaaaacauuuau

SEQ ID NO: 500687 - RNA, 14 nt, Homo sapiens
gccagcucucagga

SEQ ID NO: 500688 - RNA, 15 nt, Homo sapiens
gccaguuacauaaaa

SEQ ID NO: 500689 - RNA, 17 nt, Homo sapiens
gcccaaauggcagggau

SEQ ID NO: 500690 - RNA, 16 nt, Homo sapiens
gccccuacccuggacu

SEQ ID NO: 500691 - RNA, 15 nt, Homo sapiens
gccgcuucagaugac

SEQ ID NO: 500692 - RNA, 20 nt, Homo sapiens
gccgcuucagaugacagaug

SEQ ID NO: 500693 - RNA, 14 nt, Homo sapiens
gccuccugcaaagu

SEQ ID NO: 500694 - RNA, 13 nt, Homo sapiens
gccucuugcaaug

SEQ ID NO: 500695 - RNA, 16 nt, Homo sapiens
gccugcucccuagcca

SEQ ID NO: 500696 - RNA, 23 nt, Homo sapiens
gccugcucccuagccagaggcuc

SEQ ID NO: 500697 - RNA, 13 nt, Homo sapiens
gcgggagaccccu

SEQ ID NO: 500698 - RNA, 17 nt, Homo sapiens
gcuauacuggauacucu

SEQ ID NO: 500699 - RNA, 13 nt, Homo sapiens
gcucccuagccag

SEQ ID NO: 500700 - RNA, 20 nt, Homo sapiens
gcucccuagccagaggcucu

SEQ ID NO: 500701 - RNA, 22 nt, Homo sapiens
gcuccucgcccccaccagugua

SEQ ID NO: 500702 - RNA, 11 nt, Homo sapiens
gcuccugaugg

SEQ ID NO: 500703 - RNA, 22 nt, Homo sapiens
gcuccugauggugucauucugc

SEQ ID NO: 500704 - RNA, 23 nt, Homo sapiens
gcucuaauguacaauaaagcaau

SEQ ID NO: 500705 - RNA, 12 nt, Homo sapiens
gcucuagggccu

SEQ ID NO: 500706 - RNA, 16 nt, Homo sapiens
gcucuucuuccucacc

SEQ ID NO: 500707 - RNA, 16 nt, Homo sapiens
gcugagcaaucugacc

SEQ ID NO: 500708 - RNA, 14 nt, Homo sapiens
gcugaggcugagaa

SEQ ID NO: 500709 - RNA, 17 nt, Homo sapiens
gcuucaaggacauuggu

SEQ ID NO: 500710 - RNA, 13 nt, Homo sapiens
gcuucacaguacc

SEQ ID NO: 500711 - RNA, 16 nt, Homo sapiens
gcuucagaugacagau

SEQ ID NO: 500712 - RNA, 15 nt, Homo sapiens
gcuugcaugcuugca

SEQ ID NO: 500713 - RNA, 17 nt, Homo sapiens
gcuuuucuaacuaagag

SEQ ID NO: 500714 - RNA, 14 nt, Homo sapiens
ggaaaauucuuaaa

SEQ ID NO: 500715 - RNA, 17 nt, Homo sapiens
ggaaagugauaugcauu

SEQ ID NO: 500716 - RNA, 12 nt, Homo sapiens
ggaacugcauca

SEQ ID NO: 500717 - RNA, 15 nt, Homo sapiens
ggaauaugaccauuu

SEQ ID NO: 500718 - RNA, 14 nt, Homo sapiens
ggacccuguccaau

SEQ ID NO: 500719 - RNA, 21 nt, Homo sapiens
ggacccuucuggguccaggga

SEQ ID NO: 500720 - RNA, 11 nt, Homo sapiens
ggacuugccuc

SEQ ID NO: 500721 - RNA, 21 nt, Homo sapiens
ggagaccccuuguugcacugc

SEQ ID NO: 500722 - RNA, 15 nt, Homo sapiens
ggagauugaacuuuc

SEQ ID NO: 500723 - RNA, 19 nt, Homo sapiens
ggagguuguggggccucag

SEQ ID NO: 500724 - RNA, 17 nt, Homo sapiens
ggaguaccauguggcaa

SEQ ID NO: 500725 - RNA, 22 nt, Homo sapiens
ggauauuuugaaaugaacuuug

SEQ ID NO: 500726 - RNA, 16 nt, Homo sapiens
ggauccucaguucuca

SEQ ID NO: 500727 - RNA, 17 nt, Homo sapiens
ggaucucucuagugaug

SEQ ID NO: 500728 - RNA, 18 nt, Homo sapiens
ugacauuagcauuguggu

SEQ ID NO: 500729 - RNA, 23 nt, Homo sapiens
ugaccuaaauuauuuacugcaaa

SEQ ID NO: 500730 - RNA, 21 nt, Homo sapiens
ugagacuuacuucucugcuau

SEQ ID NO: 500731 - RNA, 16 nt, Homo sapiens
ugaggaaaauucuuaa

SEQ ID NO: 500732 - RNA, 22 nt, Homo sapiens
ugaguugcacuuauugaccauu

SEQ ID NO: 500733 - RNA, 19 nt, Homo sapiens
ugauacauuuuuguacuaa

SEQ ID NO: 500734 - RNA, 20 nt, Homo sapiens
ugauguacagauucuuucag

SEQ ID NO: 500735 - RNA, 20 nt, Homo sapiens
ugauguugucuuagcauggu

SEQ ID NO: 500736 - RNA, 20 nt, Homo sapiens
ugauugggaaaacauuugcu

SEQ ID NO: 500737 - RNA, 13 nt, Homo sapiens
ugauuguagcuau

SEQ ID NO: 500738 - RNA, 19 nt, Homo sapiens
ugcaaauacuguauauuca

SEQ ID NO: 500739 - RNA, 14 nt, Homo sapiens
ugcaugcuugcaua

SEQ ID NO: 500740 - RNA, 15 nt, Homo sapiens
ugcauguggcacuua

SEQ ID NO: 500741 - RNA, 18 nt, Homo sapiens
ugcauguuacccauucaa

SEQ ID NO: 500742 - RNA, 23 nt, Homo sapiens
ugccaaaguuuugcugucucuua

SEQ ID NO: 500743 - RNA, 16 nt, Homo sapiens
ugccccggaccuaccu

SEQ ID NO: 500744 - RNA, 22 nt, Homo sapiens
ugccuggggcggcaugaacccu

SEQ ID NO: 500745 - RNA, 19 nt, Homo sapiens
ugcuauacuggauacucug

SEQ ID NO: 500746 - RNA, 18 nt, Homo sapiens
ugcuaucuuuuuuagugu

SEQ ID NO: 500747 - RNA, 20 nt, Homo sapiens
ugcucccuagccagaggcuc

SEQ ID NO: 500748 - RNA, 21 nt, Homo sapiens
ugcucccuagccagaggcucu

SEQ ID NO: 500749 - RNA, 20 nt, Homo sapiens
ugcuccggaaagaugagcuu

SEQ ID NO: 500750 - RNA, 17 nt, Homo sapiens
ugcugauaccauaugaa

SEQ ID NO: 500751 - RNA, 15 nt, Homo sapiens
uggaaaccguguaaa

SEQ ID NO: 500752 - RNA, 16 nt, Homo sapiens
uggaaaguaacuguga

SEQ ID NO: 500753 - RNA, 23 nt, Homo sapiens
uggaaguuaaagggcauuuccaa

SEQ ID NO: 500754 - RNA, 18 nt, Homo sapiens
uggauauuuuuuacuuua

SEQ ID NO: 500755 - RNA, 17 nt, Homo sapiens
uggauuucauacuguaa

SEQ ID NO: 500756 - RNA, 18 nt, Homo sapiens
uggauuuuucuuuaacug

SEQ ID NO: 500757 - RNA, 18 nt, Homo sapiens
uggcaaaugccugacuca

SEQ ID NO: 500758 - RNA, 22 nt, Homo sapiens
uggcaaccugcuuucaagaccc

SEQ ID NO: 500759 - RNA, 17 nt, Homo sapiens
uggcagucucaguccaa

SEQ ID NO: 500760 - RNA, 21 nt, Homo sapiens
uggcauugucuguaaugacaa

SEQ ID NO: 500761 - RNA, 16 nt, Homo sapiens
uggccaacaugaugaa

SEQ ID NO: 500762 - RNA, 15 nt, Homo sapiens
uggcuucuuuacuua

SEQ ID NO: 500763 - RNA, 19 nt, Homo sapiens
uggcuuuuccuugaaucca

SEQ ID NO: 500764 - RNA, 13 nt, Homo sapiens
ugggcauccucuc

SEQ ID NO: 500765 - RNA, 20 nt, Homo sapiens
uggggacacagcaucagcuc

SEQ ID NO: 500766 - RNA, 21 nt, Homo sapiens
uggggacacagcaucagcuca

SEQ ID NO: 500767 - RNA, 21 nt, Homo sapiens
ugguaauaaaugugacucagc

SEQ ID NO: 500768 - RNA, 21 nt, Homo sapiens
uggucccucuucucuccucag

SEQ ID NO: 500769 - RNA, 18 nt, Homo sapiens
uggugaauaacuaugcca

SEQ ID NO: 500770 - RNA, 19 nt, Homo sapiens
uguaagaacaacuaccuga

SEQ ID NO: 500771 - RNA, 19 nt, Homo sapiens
uguaaggaauuaucaauua

SEQ ID NO: 500772 - RNA, 15 nt, Homo sapiens
uguacacaacaaucc

SEQ ID NO: 500773 - RNA, 21 nt, Homo sapiens
ugucaguuccaaacagacaaa

SEQ ID NO: 500774 - RNA, 21 nt, Homo sapiens
ugucauagaggaaaagcacag

SEQ ID NO: 500775 - RNA, 21 nt, Homo sapiens
ugucuguaaugacaaauaagu

SEQ ID NO: 500776 - RNA, 15 nt, Homo sapiens
ugugagcauggggcc

SEQ ID NO: 500777 - RNA, 18 nt, Homo sapiens
ugugugaacuaacaugca

SEQ ID NO: 500778 - RNA, 20 nt, Homo sapiens
uguguuucuagaaucacagc

SEQ ID NO: 500779 - RNA, 22 nt, Homo sapiens
uguuacccauucaaccauuuua

SEQ ID NO: 500780 - RNA, 18 nt, Homo sapiens
uguucuccuauauccucc

SEQ ID NO: 500781 - RNA, 21 nt, Homo sapiens
uguuguacuuaaaugguaaua

SEQ ID NO: 500782 - RNA, 14 nt, Homo sapiens
uguuguauugauca

SEQ ID NO: 500783 - RNA, 15 nt, Homo sapiens
uuaaaauuuuguaug

SEQ ID NO: 500784 - RNA, 12 nt, Homo sapiens
uuaagaaauuca

SEQ ID NO: 500785 - RNA, 21 nt, Homo sapiens
uuaagcuaggauguugcucag

SEQ ID NO: 500786 - RNA, 23 nt, Homo sapiens
uuaauaaagaugaguugguucuc

SEQ ID NO: 500787 - RNA, 21 nt, Homo sapiens
uuauauguauaucacauuccc

SEQ ID NO: 500788 - RNA, 15 nt, Homo sapiens
uuauuacucuauaca

SEQ ID NO: 500789 - RNA, 22 nt, Homo sapiens
uuauuuuguugaaauugucaaa

SEQ ID NO: 500790 - RNA, 22 nt, Homo sapiens
uucaaagagacauauacuaaga

SEQ ID NO: 500791 - RNA, 16 nt, Homo sapiens
uucaaaggauaugcag

SEQ ID NO: 500792 - RNA, 15 nt, Homo sapiens
uucaacagagacuga

SEQ ID NO: 500793 - RNA, 13 nt, Homo sapiens
uucaacuguauag

SEQ ID NO: 500794 - RNA, 21 nt, Homo sapiens
uucaaggcucuucuuccucac

SEQ ID NO: 500795 - RNA, 22 nt, Homo sapiens
uucaaugauuauuuguauuuac

SEQ ID NO: 500796 - RNA, 22 nt, Homo sapiens
uucaguacacccaguugccaaa

SEQ ID NO: 500797 - RNA, 17 nt, Homo sapiens
uucaguuuaaugucucc

SEQ ID NO: 500798 - RNA, 23 nt, Homo sapiens
uucauggauauguuauacugaac

SEQ ID NO: 500799 - RNA, 22 nt, Homo sapiens
uucauucucccuuucacuaaaa

SEQ ID NO: 500800 - RNA, 17 nt, Homo sapiens
uuccccuuuguccugcg

SEQ ID NO: 500801 - RNA, 22 nt, Homo sapiens
uuccuaaggcacccacaaauaa

SEQ ID NO: 500802 - RNA, 23 nt, Homo sapiens
uuccugauuaggaauaugaccau

SEQ ID NO: 500803 - RNA, 11 nt, Homo sapiens
uuccuggugac

SEQ ID NO: 500804 - RNA, 16 nt, Homo sapiens
uucuaaauaugaauga

SEQ ID NO: 500805 - RNA, 23 nt, Homo sapiens
uucuaaauaugaaugaaugggau

SEQ ID NO: 500806 - RNA, 14 nt, Homo sapiens
uucuacuacuugga

SEQ ID NO: 500807 - RNA, 16 nt, Homo sapiens
uucuguaaaacagguu

SEQ ID NO: 500808 - RNA, 17 nt, Homo sapiens
uucuuagucacaaaaua

SEQ ID NO: 500809 - RNA, 14 nt, Homo sapiens
uucuuauugacaau

SEQ ID NO: 500810 - RNA, 15 nt, Homo sapiens
uucuuuucuuuacaa

SEQ ID NO: 500811 - RNA, 20 nt, Homo sapiens
uugaaaaaaaacaguggauc

SEQ ID NO: 500812 - RNA, 16 nt, Homo sapiens
uugaaaccugauguca

SEQ ID NO: 500813 - RNA, 17 nt, Homo sapiens
uugaaaugaacuuuguc

SEQ ID NO: 500814 - RNA, 22 nt, Homo sapiens
uugaacuucugacuacuuguug

SEQ ID NO: 500815 - RNA, 21 nt, Homo sapiens
uugaauccagaacacaaccuu

SEQ ID NO: 500816 - RNA, 21 nt, Homo sapiens
uugaggucucuaacauaccuu

SEQ ID NO: 500817 - RNA, 20 nt, Homo sapiens
uugauaucucgaacuuucaa

SEQ ID NO: 500818 - RNA, 16 nt, Homo sapiens
uugcaaagaccaccuc

SEQ ID NO: 500819 - RNA, 14 nt, Homo sapiens
uugcacagccaaau

SEQ ID NO: 500820 - RNA, 20 nt, Homo sapiens
uugcagcggcuccugcaaaa

SEQ ID NO: 500821 - RNA, 18 nt, Homo sapiens
uugcauuuugauauugcu

SEQ ID NO: 500822 - RNA, 15 nt, Homo sapiens
uugcucuugccaaaa

SEQ ID NO: 500823 - RNA, 15 nt, Homo sapiens
uuggaagaugcagaa

SEQ ID NO: 500824 - RNA, 18 nt, Homo sapiens
uuggauucuaaauacaug

SEQ ID NO: 500825 - RNA, 17 nt, Homo sapiens
uugggaaaacauuugcu

SEQ ID NO: 500826 - RNA, 14 nt, Homo sapiens
uugggagcugccaa

SEQ ID NO: 500827 - RNA, 23 nt, Homo sapiens
uugggagggugguucaacaaaga

SEQ ID NO: 500828 - RNA, 18 nt, Homo sapiens
uugguuuuccuguggcau

SEQ ID NO: 500829 - RNA, 19 nt, Homo sapiens
uuguacaaaauuaagcaaa

SEQ ID NO: 500830 - RNA, 17 nt, Homo sapiens
uuguuggaaaguaacug

SEQ ID NO: 500831 - RNA, 16 nt, Homo sapiens
uuguuuguggucuaua

SEQ ID NO: 500832 - RNA, 17 nt, Homo sapiens
uuuaaagaagugcauga

SEQ ID NO: 500833 - RNA, 15 nt, Homo sapiens
uuuaagcaugugaug

SEQ ID NO: 500834 - RNA, 14 nt, Homo sapiens
uuuaauaccagaua

SEQ ID NO: 500835 - RNA, 14 nt, Homo sapiens
uuuauaaacagaaa

SEQ ID NO: 500836 - RNA, 15 nt, Homo sapiens
acauucuuauugaca

SEQ ID NO: 500837 - RNA, 15 nt, Homo sapiens
acauuugcuacuguu

SEQ ID NO: 500838 - RNA, 11 nt, Homo sapiens
accaccuccaa

SEQ ID NO: 500839 - RNA, 15 nt, Homo sapiens
accaccuuucacaaa

SEQ ID NO: 500840 - RNA, 19 nt, Homo sapiens
accagaaagcuucauccac

SEQ ID NO: 500841 - RNA, 15 nt, Homo sapiens
accagccugggcaac

SEQ ID NO: 500842 - RNA, 19 nt, Homo sapiens
accaggucucauaaugcau

SEQ ID NO: 500843 - RNA, 20 nt, Homo sapiens
accaguguagcaucuuccuc

SEQ ID NO: 500844 - RNA, 21 nt, Homo sapiens
accauuuuguuauugacuaac

SEQ ID NO: 500845 - RNA, 21 nt, Homo sapiens
accauuuuuuaauuuacuugu

SEQ ID NO: 500846 - RNA, 17 nt, Homo sapiens
acccaacccaaucccuc

SEQ ID NO: 500847 - RNA, 14 nt, Homo sapiens
accccaaacccauc

SEQ ID NO: 500848 - RNA, 19 nt, Homo sapiens
accccugucucccaaaaau

SEQ ID NO: 500849 - RNA, 15 nt, Homo sapiens
acccgaguaccucca

SEQ ID NO: 500850 - RNA, 13 nt, Homo sapiens
accuccucauggc

SEQ ID NO: 500851 - RNA, 22 nt, Homo sapiens
accugccccggaccuaccuccc

SEQ ID NO: 500852 - RNA, 19 nt, Homo sapiens
accuggcugccaacaugau

SEQ ID NO: 500853 - RNA, 19 nt, Homo sapiens
accuuaauuuaacuuucca

SEQ ID NO: 500854 - RNA, 16 nt, Homo sapiens
accuuucaaaggauau

SEQ ID NO: 500855 - RNA, 14 nt, Homo sapiens
acgaugacaguguu

SEQ ID NO: 500856 - RNA, 13 nt, Homo sapiens
acgaugcauuuaa

SEQ ID NO: 500857 - RNA, 22 nt, Homo sapiens
acguuuauaaacagaaauggaa

SEQ ID NO: 500858 - RNA, 17 nt, Homo sapiens
acuaaaacacacaggug

SEQ ID NO: 500859 - RNA, 16 nt, Homo sapiens
acuaacaggccaaaga

SEQ ID NO: 500860 - RNA, 17 nt, Homo sapiens
acuaccaauuucuuuua

SEQ ID NO: 500861 - RNA, 19 nt, Homo sapiens
acuaccuacugguguaauc

SEQ ID NO: 500862 - RNA, 18 nt, Homo sapiens
acuagaaugcuuuuguua

SEQ ID NO: 500863 - RNA, 18 nt, Homo sapiens
acuagccaaaccaggacc

SEQ ID NO: 500864 - RNA, 17 nt, Homo sapiens
acuauuuccacauggaa

SEQ ID NO: 500865 - RNA, 16 nt, Homo sapiens
acuccccaacugaguu

SEQ ID NO: 500866 - RNA, 22 nt, Homo sapiens
acugaauagauaugaaagcuga

SEQ ID NO: 500867 - RNA, 15 nt, Homo sapiens
acugacuccugugga

SEQ ID NO: 500868 - RNA, 16 nt, Homo sapiens
acugacuccuguggag

SEQ ID NO: 500869 - RNA, 18 nt, Homo sapiens
acuggcaaccugcuuuca

SEQ ID NO: 500870 - RNA, 19 nt, Homo sapiens
acuguaacuacuuccugau

SEQ ID NO: 500871 - RNA, 22 nt, Homo sapiens
acuguauauucaggacuugaaa

SEQ ID NO: 500872 - RNA, 15 nt, Homo sapiens
acuguucaaugauua

SEQ ID NO: 500873 - RNA, 19 nt, Homo sapiens
acuuaaaugguaauaagca

SEQ ID NO: 500874 - RNA, 17 nt, Homo sapiens
acuuacuucucugcuau

SEQ ID NO: 500875 - RNA, 17 nt, Homo sapiens
acuuauccaucuuugaa

SEQ ID NO: 500876 - RNA, 19 nt, Homo sapiens
acuucaguuuaaugucucc

SEQ ID NO: 500877 - RNA, 15 nt, Homo sapiens
acuuccuccuaccug

SEQ ID NO: 500878 - RNA, 16 nt, Homo sapiens
acuucuguauguguau

SEQ ID NO: 500879 - RNA, 19 nt, Homo sapiens
acuugaaugcuaguuauac

SEQ ID NO: 500880 - RNA, 16 nt, Homo sapiens
acuugccucugcacac

SEQ ID NO: 500881 - RNA, 18 nt, Homo sapiens
acuuucaagaaucagaca

SEQ ID NO: 500882 - RNA, 14 nt, Homo sapiens
acuuugacaguguu

SEQ ID NO: 500883 - RNA, 13 nt, Homo sapiens
acuuugaccuaaa

SEQ ID NO: 500884 - RNA, 20 nt, Homo sapiens
acuuuggccaaaaccuuuca

SEQ ID NO: 500885 - RNA, 21 nt, Homo sapiens
acuuuuuaaaauaauaacaau

SEQ ID NO: 500886 - RNA, 21 nt, Homo sapiens
agaaacacauucuuauugaca

SEQ ID NO: 500887 - RNA, 19 nt, Homo sapiens
agaaacacuauuugugacu

SEQ ID NO: 500888 - RNA, 21 nt, Homo sapiens
agaaacacugacuccugugga

SEQ ID NO: 500889 - RNA, 15 nt, Homo sapiens
agaaaccacuagaaa

SEQ ID NO: 500890 - RNA, 14 nt, Homo sapiens
agaaauagaauuau

SEQ ID NO: 500891 - RNA, 13 nt, Homo sapiens
agaaaugccccca

SEQ ID NO: 500892 - RNA, 16 nt, Homo sapiens
agaaccacacuugaaa

SEQ ID NO: 500893 - RNA, 20 nt, Homo sapiens
agaaccacacuugaaaccuu

SEQ ID NO: 500894 - RNA, 20 nt, Homo sapiens
agaaggggcuuugugaccag

SEQ ID NO: 500895 - RNA, 23 nt, Homo sapiens
agaagguugagggcaauggacaa

SEQ ID NO: 500896 - RNA, 19 nt, Homo sapiens
agaauaccacaucaaauaa

SEQ ID NO: 500897 - RNA, 21 nt, Homo sapiens
agaaugaucuauugcucauca

SEQ ID NO: 500898 - RNA, 15 nt, Homo sapiens
agaaugugcucaugc

SEQ ID NO: 500899 - RNA, 16 nt, Homo sapiens
agacucgcuagcacuc

SEQ ID NO: 500900 - RNA, 18 nt, Homo sapiens
agacuguucuuacuguaa

SEQ ID NO: 500901 - RNA, 17 nt, Homo sapiens
agagaaagaguuugaaa

SEQ ID NO: 500902 - RNA, 17 nt, Homo sapiens
agagaaagcacaauuua

SEQ ID NO: 500903 - RNA, 23 nt, Homo sapiens
agagaggagguaguuaagggaug

SEQ ID NO: 500904 - RNA, 20 nt, Homo sapiens
agagccaauuagacuugaaa

SEQ ID NO: 500905 - RNA, 15 nt, Homo sapiens
agagggaaaacagaa

SEQ ID NO: 500906 - RNA, 16 nt, Homo sapiens
agaguggguacuagaa

SEQ ID NO: 500907 - RNA, 20 nt, Homo sapiens
agauaaagaauaauaauuaa

SEQ ID NO: 500908 - RNA, 19 nt, Homo sapiens
agauaagguggcuucucac

SEQ ID NO: 500909 - RNA, 20 nt, Homo sapiens
agaugcaucaucucuuccuc

SEQ ID NO: 500910 - RNA, 21 nt, Homo sapiens
agaugcuacuucccacuguau

SEQ ID NO: 500911 - RNA, 15 nt, Homo sapiens
agauugaacuuuccc

SEQ ID NO: 500912 - RNA, 21 nt, Homo sapiens
agcaaauguuaaaaguuuuau

SEQ ID NO: 500913 - RNA, 21 nt, Homo sapiens
agcaaccuuguaagcuaucug

SEQ ID NO: 500914 - RNA, 15 nt, Homo sapiens
agcaaguuagaacua

SEQ ID NO: 500915 - RNA, 16 nt, Homo sapiens
agcagcauccacccca

SEQ ID NO: 500916 - RNA, 19 nt, Homo sapiens
agcagggauuagguguuca

SEQ ID NO: 500917 - RNA, 15 nt, Homo sapiens
agcauagaaaccacu

SEQ ID NO: 500918 - RNA, 20 nt, Homo sapiens
agcauagaaaccacuagaaa

SEQ ID NO: 500919 - RNA, 15 nt, Homo sapiens
agcauccaaguauau

SEQ ID NO: 500920 - RNA, 22 nt, Homo sapiens
agcaucugcuccaucggggcag

SEQ ID NO: 500921 - RNA, 18 nt, Homo sapiens
agccagaggcucuaaugu

SEQ ID NO: 500922 - RNA, 14 nt, Homo sapiens
agccaguuacauaa

SEQ ID NO: 500923 - RNA, 15 nt, Homo sapiens
agccggccugagaaa

SEQ ID NO: 500924 - RNA, 15 nt, Homo sapiens
agccuaacaucucca

SEQ ID NO: 500925 - RNA, 17 nt, Homo sapiens
auugggaaaacauuugc

SEQ ID NO: 500926 - RNA, 21 nt, Homo sapiens
auuguuugguaaauguuucuu

SEQ ID NO: 500927 - RNA, 13 nt, Homo sapiens
auuuaacuuucca

SEQ ID NO: 500928 - RNA, 15 nt, Homo sapiens
auuuaauaaagauga

SEQ ID NO: 500929 - RNA, 15 nt, Homo sapiens
auuuacaguuuccag

SEQ ID NO: 500930 - RNA, 15 nt, Homo sapiens
auuuagaucucauaa

SEQ ID NO: 500931 - RNA, 18 nt, Homo sapiens
auuuaguucaacuguaua

SEQ ID NO: 500932 - RNA, 14 nt, Homo sapiens
auuucauacuguaa

SEQ ID NO: 500933 - RNA, 22 nt, Homo sapiens
auuuccagaaccacacuugaaa

SEQ ID NO: 500934 - RNA, 19 nt, Homo sapiens
auuucucauugacuuuuau

SEQ ID NO: 500935 - RNA, 21 nt, Homo sapiens
auuucucuugcuggaacuguu

SEQ ID NO: 500936 - RNA, 15 nt, Homo sapiens
auuucuuuuauguua

SEQ ID NO: 500937 - RNA, 21 nt, Homo sapiens
auuugauacauuuuuguacua

SEQ ID NO: 500938 - RNA, 16 nt, Homo sapiens
auuuguauaugacugc

SEQ ID NO: 500939 - RNA, 20 nt, Homo sapiens
auuugugcuaccccuuugau

SEQ ID NO: 500940 - RNA, 21 nt, Homo sapiens
auuuguucauuauuugugcua

SEQ ID NO: 500941 - RNA, 17 nt, Homo sapiens
auuuuauagacuaccaa

SEQ ID NO: 500942 - RNA, 12 nt, Homo sapiens
cugccuccucau

SEQ ID NO: 500943 - RNA, 14 nt, Homo sapiens
cugccucucuucuu

SEQ ID NO: 500944 - RNA, 12 nt, Homo sapiens
cugccuguggag

SEQ ID NO: 500945 - RNA, 21 nt, Homo sapiens
cugcugcacacacucaccucu

SEQ ID NO: 500946 - RNA, 15 nt, Homo sapiens
cuggagucugucaau

SEQ ID NO: 500947 - RNA, 18 nt, Homo sapiens
cuggauccucaguucuca

SEQ ID NO: 500948 - RNA, 18 nt, Homo sapiens
cuggauuucauacuguaa

SEQ ID NO: 500949 - RNA, 19 nt, Homo sapiens
cuggcaaaugccugacuca

SEQ ID NO: 500950 - RNA, 15 nt, Homo sapiens
cuggcagucucaguc

SEQ ID NO: 500951 - RNA, 23 nt, Homo sapiens
cugggcccaguaccuagcuggcu

SEQ ID NO: 500952 - RNA, 16 nt, Homo sapiens
cuggguggaagugugu

SEQ ID NO: 500953 - RNA, 20 nt, Homo sapiens
cugguaauaaaugugacuca

SEQ ID NO: 500954 - RNA, 23 nt, Homo sapiens
cuggugggcuagccaauagaguu

SEQ ID NO: 500955 - RNA, 16 nt, Homo sapiens
cuguaaaacagguuau

SEQ ID NO: 500956 - RNA, 17 nt, Homo sapiens
cuguaucuugauaucuc

SEQ ID NO: 500957 - RNA, 19 nt, Homo sapiens
cugucaauacuauggagua

SEQ ID NO: 500958 - RNA, 17 nt, Homo sapiens
cugugagccuugcauga

SEQ ID NO: 500959 - RNA, 19 nt, Homo sapiens
cuguguacacaugggaguu

SEQ ID NO: 500960 - RNA, 21 nt, Homo sapiens
cugugugaacuaacaugcaaa

SEQ ID NO: 500961 - RNA, 16 nt, Homo sapiens
cuguuuccuagcugug

SEQ ID NO: 500962 - RNA, 23 nt, Homo sapiens
cuuagagcuuuaccuaaauauga

SEQ ID NO: 500963 - RNA, 18 nt, Homo sapiens
cuuagguccaaggucucc

SEQ ID NO: 500964 - RNA, 22 nt, Homo sapiens
cuucaaggcucuucuuccucac

SEQ ID NO: 500965 - RNA, 12 nt, Homo sapiens
cuucacaguacc

SEQ ID NO: 500966 - RNA, 17 nt, Homo sapiens
cuucacaguacccaaac

SEQ ID NO: 500967 - RNA, 13 nt, Homo sapiens
cuucccaugcauu

SEQ ID NO: 500968 - RNA, 19 nt, Homo sapiens
cuucuccuguuccauuuca

SEQ ID NO: 500969 - RNA, 14 nt, Homo sapiens
caauugcucaugca

SEQ ID NO: 500970 - RNA, 14 nt, Homo sapiens
cacaacccaaaagg

SEQ ID NO: 500971 - RNA, 14 nt, Homo sapiens
cacaaucugaaaca

SEQ ID NO: 500972 - RNA, 21 nt, Homo sapiens
cacaaucugaaacagcuucau

SEQ ID NO: 500973 - RNA, 13 nt, Homo sapiens
cacacacgaugca

SEQ ID NO: 500974 - RNA, 14 nt, Homo sapiens
cacacgaugcauuu

SEQ ID NO: 500975 - RNA, 17 nt, Homo sapiens
cacacgaugcauuuaau

SEQ ID NO: 500976 - RNA, 22 nt, Homo sapiens
cacagcuguaguaccccaagaa

SEQ ID NO: 500977 - RNA, 17 nt, Homo sapiens
cacagggagugcacaua

SEQ ID NO: 500978 - RNA, 20 nt, Homo sapiens
cacauaaaagacacagaaca

SEQ ID NO: 500979 - RNA, 16 nt, Homo sapiens
cacccuccauucugca

SEQ ID NO: 500980 - RNA, 15 nt, Homo sapiens
caccuccuaccccuu

SEQ ID NO: 500981 - RNA, 11 nt, Homo sapiens
cacgaugcauu

SEQ ID NO: 500982 - RNA, 14 nt, Homo sapiens
cacuauuuccacau

SEQ ID NO: 500983 - RNA, 13 nt, Homo sapiens
cacucaauccauc

SEQ ID NO: 500984 - RNA, 13 nt, Homo sapiens
cacucagaaaaug

SEQ ID NO: 500985 - RNA, 17 nt, Homo sapiens
cacuccgucugcuccaa

SEQ ID NO: 500986 - RNA, 21 nt, Homo sapiens
cacucucccuuguacagccuu

SEQ ID NO: 500987 - RNA, 14 nt, Homo sapiens
cacucuuguaauaa

SEQ ID NO: 500988 - RNA, 16 nt, Homo sapiens
cacugacuccugugga

SEQ ID NO: 500989 - RNA, 18 nt, Homo sapiens
cacuucaguuuaaugucu

SEQ ID NO: 500990 - RNA, 16 nt, Homo sapiens
cacuuccuccuaccug

SEQ ID NO: 500991 - RNA, 19 nt, Homo sapiens
cagaaagcuucauccacag

SEQ ID NO: 500992 - RNA, 16 nt, Homo sapiens
cagaauaaaaucucua

SEQ ID NO: 500993 - RNA, 15 nt, Homo sapiens
cagacccugaaccca

SEQ ID NO: 500994 - RNA, 17 nt, Homo sapiens
cagacucgcuagcacuc

SEQ ID NO: 500995 - RNA, 24 nt, Homo sapiens
cagagcaagagauaagucuuucau

SEQ ID NO: 500996 - RNA, 18 nt, Homo sapiens
cagaggcucuaauguaca

SEQ ID NO: 500997 - RNA, 13 nt, Homo sapiens
cagauucuuucag

SEQ ID NO: 500998 - RNA, 22 nt, Homo sapiens
cagcaaacaggugcuaauuugu

SEQ ID NO: 500999 - RNA, 12 nt, Homo sapiens
cagcaguuucca

SEQ ID NO: 501000 - RNA, 19 nt, Homo sapiens
cagcccccuaaaagcacuc

SEQ ID NO: 501001 - RNA, 15 nt, Homo sapiens
cagccuuuggugcuu

SEQ ID NO: 501002 - RNA, 22 nt, Homo sapiens
cagcuacccaggaggcugaggu

SEQ ID NO: 501003 - RNA, 14 nt, Homo sapiens
cagcuccuggacca

SEQ ID NO: 501004 - RNA, 15 nt, Homo sapiens
cagcugugagccaug

SEQ ID NO: 501005 - RNA, 13 nt, Homo sapiens
caggaacaaacag

SEQ ID NO: 501006 - RNA, 19 nt, Homo sapiens
caggaaggaaugcaaaacu

SEQ ID NO: 501007 - RNA, 22 nt, Homo sapiens
caggaccgcgcuguuccggcuu

SEQ ID NO: 501008 - RNA, 11 nt, Homo sapiens
caggacugugg

SEQ ID NO: 501009 - RNA, 14 nt, Homo sapiens
caggagaagggaua

SEQ ID NO: 501010 - RNA, 22 nt, Homo sapiens
caggauacuggcacagagguag

SEQ ID NO: 501011 - RNA, 21 nt, Homo sapiens
cagggaggggucccugcaaaa

SEQ ID NO: 501012 - RNA, 18 nt, Homo sapiens
caggggccaaccucaggc

SEQ ID NO: 501013 - RNA, 23 nt, Homo sapiens
caggggccaaccucaggcuccua

SEQ ID NO: 501014 - RNA, 15 nt, Homo sapiens
caggggccauguccu

SEQ ID NO: 501015 - RNA, 15 nt, Homo sapiens
cagguaaaacagggc

SEQ ID NO: 501016 - RNA, 19 nt, Homo sapiens
caggugcaacagacuugaa

SEQ ID NO: 501017 - RNA, 20 nt, Homo sapiens
caguacacccaguugccaaa

SEQ ID NO: 501018 - RNA, 15 nt, Homo sapiens
caguaucuugggcau

SEQ ID NO: 501019 - RNA, 15 nt, Homo sapiens
cagucccaugcacaa

SEQ ID NO: 501020 - RNA, 20 nt, Homo sapiens
cagugagcuguguucuugcc

SEQ ID NO: 501021 - RNA, 15 nt, Homo sapiens
cagugccugugagca

SEQ ID NO: 501022 - RNA, 23 nt, Homo sapiens
caguguguaaauaauuugcacug

SEQ ID NO: 501023 - RNA, 22 nt, Homo sapiens
caguuuucggaaacacugacuu

SEQ ID NO: 501024 - RNA, 19 nt, Homo sapiens
cauaaugcauguggcacuu

SEQ ID NO: 501025 - RNA, 14 nt, Homo sapiens
cauaaugcuuuguu

SEQ ID NO: 501026 - RNA, 18 nt, Homo sapiens
cauagaaaccacuagaaa

SEQ ID NO: 501027 - RNA, 22 nt, Homo sapiens
cauaggacaggaaggaaugcaa

SEQ ID NO: 501028 - RNA, 15 nt, Homo sapiens
caugaaaauaccauu

SEQ ID NO: 501029 - RNA, 21 nt, Homo sapiens
caugaacccucuugccauccu

SEQ ID NO: 501030 - RNA, 13 nt, Homo sapiens
caugccugaugaa

SEQ ID NO: 501031 - RNA, 23 nt, Homo sapiens
caugcuugcauaagagcuuaaga

SEQ ID NO: 501032 - RNA, 20 nt, Homo sapiens
cauggagacagcaguuucca

SEQ ID NO: 501033 - RNA, 21 nt, Homo sapiens
cauguacaaaaauuaugcaau

SEQ ID NO: 501034 - RNA, 15 nt, Homo sapiens
cauuaaacaugacau

SEQ ID NO: 501035 - RNA, 23 nt, Homo sapiens
cauuaaggggaagaaugaaagcu

SEQ ID NO: 501036 - RNA, 14 nt, Homo sapiens
cauucuuauugaca

SEQ ID NO: 501037 - RNA, 15 nt, Homo sapiens
cauugcacauaagcu

SEQ ID NO: 501038 - RNA, 14 nt, Homo sapiens
cauuuaugacaagc

SEQ ID NO: 501039 - RNA, 14 nt, Homo sapiens
cauuugcugccauu

SEQ ID NO: 501040 - RNA, 18 nt, Homo sapiens
cauuuuuuugcaugcaug

SEQ ID NO: 501041 - RNA, 15 nt, Homo sapiens
ccaagagugaaggga

SEQ ID NO: 501042 - RNA, 15 nt, Homo sapiens
ccaaucuguacaaaa

SEQ ID NO: 501043 - RNA, 14 nt, Homo sapiens
ccaaucuuuccuac

SEQ ID NO: 501044 - RNA, 22 nt, Homo sapiens
ccaauggaaaauauaaugauca

SEQ ID NO: 501045 - RNA, 13 nt, Homo sapiens
ccaauuagacuug

SEQ ID NO: 501046 - RNA, 17 nt, Homo sapiens
ccacaggagagacuggu

SEQ ID NO: 501047 - RNA, 15 nt, Homo sapiens
ccaccuggcugccaa

SEQ ID NO: 501048 - RNA, 19 nt, Homo sapiens
ccagaaagcuucauccaca

SEQ ID NO: 501049 - RNA, 16 nt, Homo sapiens
ccagaaccacacuuga

SEQ ID NO: 501050 - RNA, 22 nt, Homo sapiens
ccagagccuggggauuccagcu

SEQ ID NO: 501051 - RNA, 19 nt, Homo sapiens
ccagcgaccucucugccuc

SEQ ID NO: 501052 - RNA, 18 nt, Homo sapiens
gccaagagugaagggaag

SEQ ID NO: 501053 - RNA, 16 nt, Homo sapiens
gccagagcaaacagaa

SEQ ID NO: 501054 - RNA, 18 nt, Homo sapiens
gccagaggcucuaaugua

SEQ ID NO: 501055 - RNA, 20 nt, Homo sapiens
gccagaggcucuaauguaca

SEQ ID NO: 501056 - RNA, 23 nt, Homo sapiens
gccagaggcucuaauguacaaua

SEQ ID NO: 501057 - RNA, 20 nt, Homo sapiens
gccauugaacagcugugagc

SEQ ID NO: 501058 - RNA, 17 nt, Homo sapiens
gccccggaccuaccucc

SEQ ID NO: 501059 - RNA, 21 nt, Homo sapiens
gcccucccccaaacagacucg

SEQ ID NO: 501060 - RNA, 17 nt, Homo sapiens
gcccugaggccuagacu

SEQ ID NO: 501061 - RNA, 21 nt, Homo sapiens
gccgagaucacgccacugcac

SEQ ID NO: 501062 - RNA, 14 nt, Homo sapiens
gccgaggagagcaa

SEQ ID NO: 501063 - RNA, 17 nt, Homo sapiens
gccuaugucuggcagau

SEQ ID NO: 501064 - RNA, 17 nt, Homo sapiens
gccucaguagcaucuca

SEQ ID NO: 501065 - RNA, 14 nt, Homo sapiens
gccucuugcaaugc

SEQ ID NO: 501066 - RNA, 17 nt, Homo sapiens
gccugacucagugacca

SEQ ID NO: 501067 - RNA, 21 nt, Homo sapiens
gccugcagagcaggaccuggg

SEQ ID NO: 501068 - RNA, 19 nt, Homo sapiens
gccugcucccuagccagag

SEQ ID NO: 501069 - RNA, 17 nt, Homo sapiens
gccuggugcugagugca

SEQ ID NO: 501070 - RNA, 15 nt, Homo sapiens
gccugguuggcagca

SEQ ID NO: 501071 - RNA, 21 nt, Homo sapiens
gccuucccaaguugugcuuga

SEQ ID NO: 501072 - RNA, 22 nt, Homo sapiens
gcgcaguuggucuuuaaccacu

SEQ ID NO: 501073 - RNA, 13 nt, Homo sapiens
gcuaaaagggaaa

SEQ ID NO: 501074 - RNA, 13 nt, Homo sapiens
gcuaccccuuuga

SEQ ID NO: 501075 - RNA, 13 nt, Homo sapiens
gcuaucugugcag

SEQ ID NO: 501076 - RNA, 12 nt, Homo sapiens
gcuaugacugua

SEQ ID NO: 501077 - RNA, 20 nt, Homo sapiens
gcucagacugggcacugggg

SEQ ID NO: 501078 - RNA, 22 nt, Homo sapiens
gcuccuccccuuccucuugucu

SEQ ID NO: 501079 - RNA, 15 nt, Homo sapiens
gcucuaauguacaau

SEQ ID NO: 501080 - RNA, 17 nt, Homo sapiens
gcucuaauguacaauaa

SEQ ID NO: 501081 - RNA, 16 nt, Homo sapiens
gcucugccuguggagu

SEQ ID NO: 501082 - RNA, 17 nt, Homo sapiens
gcucuuuucaaugaaua

SEQ ID NO: 501083 - RNA, 20 nt, Homo sapiens
gcugagcaaucugacccuau

SEQ ID NO: 501084 - RNA, 19 nt, Homo sapiens
gcugauaccauaugaauga

SEQ ID NO: 501085 - RNA, 17 nt, Homo sapiens
gcugcacacacucaccu

SEQ ID NO: 501086 - RNA, 19 nt, Homo sapiens
gcugcacacacucaccucu

SEQ ID NO: 501087 - RNA, 22 nt, Homo sapiens
gcugugggcaagccuaagggau

SEQ ID NO: 501088 - RNA, 13 nt, Homo sapiens
gcuucuuuacuua

SEQ ID NO: 501089 - RNA, 22 nt, Homo sapiens
gcuuugguggccagggaggcag

SEQ ID NO: 501090 - RNA, 16 nt, Homo sapiens
ggaauuccucuaugaa

SEQ ID NO: 501091 - RNA, 24 nt, Homo sapiens
ggacagcuccuggaccaggcccau

SEQ ID NO: 501092 - RNA, 15 nt, Homo sapiens
ggacaggaaggaaug

SEQ ID NO: 501093 - RNA, 22 nt, Homo sapiens
ggaccugccccggaccuaccuc

SEQ ID NO: 501094 - RNA, 17 nt, Homo sapiens
ggacuaaaugaucucug

SEQ ID NO: 501095 - RNA, 19 nt, Homo sapiens
ggagaauacugccaaaaca

SEQ ID NO: 501096 - RNA, 12 nt, Homo sapiens
ggagaguguaua

SEQ ID NO: 501097 - RNA, 22 nt, Homo sapiens
ggagcguucuaaauaugaauga

SEQ ID NO: 501098 - RNA, 13 nt, Homo sapiens
ggaggacaugggg

SEQ ID NO: 501099 - RNA, 16 nt, Homo sapiens
ggagucccuuuggcaa

SEQ ID NO: 501100 - RNA, 22 nt, Homo sapiens
ggagucuuagagcuuuaccuaa

SEQ ID NO: 501101 - RNA, 17 nt, Homo sapiens
ggauauuuuuuacuuua

SEQ ID NO: 501102 - RNA, 22 nt, Homo sapiens
ggauuagguguucaggccagua

SEQ ID NO: 501103 - RNA, 17 nt, Homo sapiens
ggcaaaugccugacuca

SEQ ID NO: 501104 - RNA, 19 nt, Homo sapiens
ggcaaaugccugacucagu

SEQ ID NO: 501105 - RNA, 12 nt, Homo sapiens
ggcagcugugau

SEQ ID NO: 501106 - RNA, 20 nt, Homo sapiens
ggcauucuuugcaauacugc

SEQ ID NO: 501107 - RNA, 16 nt, Homo sapiens
ggccaaaaccuuucaa

SEQ ID NO: 501108 - RNA, 21 nt, Homo sapiens
ggccacagaaggugaacuuug

SEQ ID NO: 501109 - RNA, 17 nt, Homo sapiens
ggccauaaacgguuccu

SEQ ID NO: 501110 - RNA, 14 nt, Homo sapiens
ggccccaucuccac

SEQ ID NO: 501111 - RNA, 16 nt, Homo sapiens
ggccucugagaagcuc

SEQ ID NO: 501112 - RNA, 21 nt, Homo sapiens
ggcuccgggcaccaggggcca

SEQ ID NO: 501113 - RNA, 23 nt, Homo sapiens
ggcuccucgcccccaccagugua

SEQ ID NO: 501114 - RNA, 15 nt, Homo sapiens
ggcuccugauggugu

SEQ ID NO: 501115 - RNA, 17 nt, Homo sapiens
ggcucuaauguacaaua

SEQ ID NO: 501116 - RNA, 22 nt, Homo sapiens
gggaaagagccuaacaucucca

SEQ ID NO: 501117 - RNA, 20 nt, Homo sapiens
gggaaucucauccaucacag

SEQ ID NO: 501118 - RNA, 21 nt, Homo sapiens
gggagaccccuuguugcacug

SEQ ID NO: 501119 - RNA, 13 nt, Homo sapiens
gggagcugccaag

SEQ ID NO: 501120 - RNA, 17 nt, Homo sapiens
gggcaguuccuuaccuc

SEQ ID NO: 501121 - RNA, 15 nt, Homo sapiens
gggccaaccucaggc

SEQ ID NO: 501122 - RNA, 17 nt, Homo sapiens
ggggccauguccucucu

SEQ ID NO: 501123 - RNA, 19 nt, Homo sapiens
ggggcggcaugaacccucu

SEQ ID NO: 501124 - RNA, 13 nt, Homo sapiens
gguaaaacagggc

SEQ ID NO: 501125 - RNA, 20 nt, Homo sapiens
gguaauaaaugugacucagc

SEQ ID NO: 501126 - RNA, 15 nt, Homo sapiens
gguccaaggucucca

SEQ ID NO: 501127 - RNA, 22 nt, Homo sapiens
ggucccugcaaaacuccaggca

SEQ ID NO: 501128 - RNA, 15 nt, Homo sapiens
ggucuaggacacagu

SEQ ID NO: 501129 - RNA, 12 nt, Homo sapiens
ggucugccaauc

SEQ ID NO: 501130 - RNA, 16 nt, Homo sapiens
ggugacaguucccaga

SEQ ID NO: 501131 - RNA, 14 nt, Homo sapiens
ggugccaaccucuu

SEQ ID NO: 501132 - RNA, 14 nt, Homo sapiens
gguggggccauaaa

SEQ ID NO: 501133 - RNA, 18 nt, Homo sapiens
gguggggggcauugagua

SEQ ID NO: 501134 - RNA, 22 nt, Homo sapiens
gguguacagaccaccuuucaca

SEQ ID NO: 501135 - RNA, 14 nt, Homo sapiens
guaaaauuauuuca

SEQ ID NO: 501136 - RNA, 16 nt, Homo sapiens
guaaauaccugucaau

SEQ ID NO: 501137 - RNA, 14 nt, Homo sapiens
guaagcuaucugug

SEQ ID NO: 501138 - RNA, 21 nt, Homo sapiens
guaaugacaaauaaguggaaa

SEQ ID NO: 501139 - RNA, 21 nt, Homo sapiens
guacaauaaagcaauguggua

SEQ ID NO: 501140 - RNA, 12 nt, Homo sapiens
guacacaacaau

SEQ ID NO: 501141 - RNA, 15 nt, Homo sapiens
guacagauucuuuca

SEQ ID NO: 501142 - RNA, 15 nt, Homo sapiens
guaccugcugggugu

SEQ ID NO: 501143 - RNA, 21 nt, Homo sapiens
guauaaaggcuaaaagggaaa

SEQ ID NO: 501144 - RNA, 16 nt, Homo sapiens
guauaaauauacagua

SEQ ID NO: 501145 - RNA, 14 nt, Homo sapiens
guauauaugaauga

SEQ ID NO: 501146 - RNA, 18 nt, Homo sapiens
guauauaugaaugaauaa

SEQ ID NO: 501147 - RNA, 14 nt, Homo sapiens
guauaugacugcau

SEQ ID NO: 501148 - RNA, 11 nt, Homo sapiens
guauguuaaag

SEQ ID NO: 501149 - RNA, 22 nt, Homo sapiens
guauucccaaaaauuacuuugg

SEQ ID NO: 501150 - RNA, 21 nt, Homo sapiens
guauuuccuuccacuguagcu

SEQ ID NO: 501151 - RNA, 21 nt, Homo sapiens
guauuuucaugaaaauaccau

SEQ ID NO: 501152 - RNA, 14 nt, Homo sapiens
gucaucacuuugac

SEQ ID NO: 501153 - RNA, 18 nt, Homo sapiens
gucauuaaacaugacauu

SEQ ID NO: 501154 - RNA, 12 nt, Homo sapiens
gucccugcaaaa

SEQ ID NO: 501155 - RNA, 21 nt, Homo sapiens
gucccuuccuauucuccugcc

SEQ ID NO: 501156 - RNA, 21 nt, Homo sapiens
guccuaaaaguucucaaugua

SEQ ID NO: 501157 - RNA, 23 nt, Homo sapiens
guccuuugucuaaguagggccag

SEQ ID NO: 501158 - RNA, 14 nt, Homo sapiens
gucuccauaggaca

SEQ ID NO: 501159 - RNA, 15 nt, Homo sapiens
gucuccauaggacag

SEQ ID NO: 501160 - RNA, 19 nt, Homo sapiens
gucuccuuugcucuugcca

SEQ ID NO: 501161 - RNA, 13 nt, Homo sapiens
aacaacuaccuga

SEQ ID NO: 501162 - RNA, 14 nt, Homo sapiens
aacaagaacuuuaa

SEQ ID NO: 501163 - RNA, 13 nt, Homo sapiens
aacaaucacaaag

SEQ ID NO: 501164 - RNA, 17 nt, Homo sapiens
aacaaucuuugcuguau

SEQ ID NO: 501165 - RNA, 20 nt, Homo sapiens
aacagacucgcuagcacuca

SEQ ID NO: 501166 - RNA, 12 nt, Homo sapiens
aacagacuugaa

SEQ ID NO: 501167 - RNA, 21 nt, Homo sapiens
aacagggcugccuucuggccu

SEQ ID NO: 501168 - RNA, 17 nt, Homo sapiens
aacagguaaaacagggc

SEQ ID NO: 501169 - RNA, 18 nt, Homo sapiens
aacagguuauaacagugu

SEQ ID NO: 501170 - RNA, 23 nt, Homo sapiens
aacaguaguugcaauguuuuaga

SEQ ID NO: 501171 - RNA, 14 nt, Homo sapiens
aacaucauuucaau

SEQ ID NO: 501172 - RNA, 13 nt, Homo sapiens
aacaucuccaugg

SEQ ID NO: 501173 - RNA, 14 nt, Homo sapiens
aacaugcaaagauc

SEQ ID NO: 501174 - RNA, 22 nt, Homo sapiens
aacccucuugccauccugaugg

SEQ ID NO: 501175 - RNA, 21 nt, Homo sapiens
aaccugaauuaucuauuucau

SEQ ID NO: 501176 - RNA, 13 nt, Homo sapiens
aaccugugcugaa

SEQ ID NO: 501177 - RNA, 12 nt, Homo sapiens
aacuaacuugau

SEQ ID NO: 501178 - RNA, 21 nt, Homo sapiens
aacugcuucccuuacuuugcu

SEQ ID NO: 501179 - RNA, 13 nt, Homo sapiens
aacuguacugaau

SEQ ID NO: 501180 - RNA, 16 nt, Homo sapiens
aacuguagcugccaug

SEQ ID NO: 501181 - RNA, 21 nt, Homo sapiens
aagaaaauguuacuucucuca

SEQ ID NO: 501182 - RNA, 17 nt, Homo sapiens
aagaaagcuuccuucaa

SEQ ID NO: 501183 - RNA, 12 nt, Homo sapiens
aagaacuaugaa

SEQ ID NO: 501184 - RNA, 14 nt, Homo sapiens
aagaacucucugga

SEQ ID NO: 501185 - RNA, 20 nt, Homo sapiens
aagaugaaacaucauuucaa

SEQ ID NO: 501186 - RNA, 16 nt, Homo sapiens
aagaugcaucaucucu

SEQ ID NO: 501187 - RNA, 18 nt, Homo sapiens
aagcuguaucacugccuu

SEQ ID NO: 501188 - RNA, 17 nt, Homo sapiens
aaggcucuucuuccuca

SEQ ID NO: 501189 - RNA, 18 nt, Homo sapiens
aaggcucuucuuccucac

SEQ ID NO: 501190 - RNA, 12 nt, Homo sapiens
aagggcauuucc

SEQ ID NO: 501191 - RNA, 16 nt, Homo sapiens
aagguugagggcaaug

SEQ ID NO: 501192 - RNA, 16 nt, Homo sapiens
aaguauguaaguauca

SEQ ID NO: 501193 - RNA, 17 nt, Homo sapiens
aaguauguaaguaucac

SEQ ID NO: 501194 - RNA, 22 nt, Homo sapiens
aagucccuuccuauucuccugc

SEQ ID NO: 501195 - RNA, 20 nt, Homo sapiens
aaguuaaaauaaaaccaagg

SEQ ID NO: 501196 - RNA, 14 nt, Homo sapiens
aaguuuugcugucu

SEQ ID NO: 501197 - RNA, 12 nt, Homo sapiens
aauaaaugacaa

SEQ ID NO: 501198 - RNA, 18 nt, Homo sapiens
aauaaaugugacucagca

SEQ ID NO: 501199 - RNA, 18 nt, Homo sapiens
aauaauaacaaucacaaa

SEQ ID NO: 501200 - RNA, 14 nt, Homo sapiens
aauacacauuugcu

SEQ ID NO: 501201 - RNA, 20 nt, Homo sapiens
aauaccuucaaggcucuucu

SEQ ID NO: 501202 - RNA, 19 nt, Homo sapiens
aauacucugcuauuucucu

SEQ ID NO: 501203 - RNA, 20 nt, Homo sapiens
aauacugccaaaacauuuau

SEQ ID NO: 501204 - RNA, 20 nt, Homo sapiens
aauagauuugggucauuuag

SEQ ID NO: 501205 - RNA, 11 nt, Homo sapiens
aauaugaauga

SEQ ID NO: 501206 - RNA, 21 nt, Homo sapiens
aaucccucuccacucuucucu

SEQ ID NO: 501207 - RNA, 19 nt, Homo sapiens
aauccuucuauucuagccu

SEQ ID NO: 501208 - RNA, 13 nt, Homo sapiens
aaugaacuuuguc

SEQ ID NO: 501209 - RNA, 22 nt, Homo sapiens
aaugagguugggggaaccagca

SEQ ID NO: 501210 - RNA, 19 nt, Homo sapiens
aaugccccuguucauguuu

SEQ ID NO: 501211 - RNA, 14 nt, Homo sapiens
aaugccugacucag

SEQ ID NO: 501212 - RNA, 13 nt, Homo sapiens
aaugcuacaugug

SEQ ID NO: 501213 - RNA, 20 nt, Homo sapiens
aaugcuauacuggauacucu

SEQ ID NO: 501214 - RNA, 17 nt, Homo sapiens
aaugcucccaccugaau

SEQ ID NO: 501215 - RNA, 13 nt, Homo sapiens
aauggcagggaua

SEQ ID NO: 501216 - RNA, 22 nt, Homo sapiens
aauggcagggauacccagugau

SEQ ID NO: 501217 - RNA, 17 nt, Homo sapiens
aauguacaauaaagcaa

SEQ ID NO: 501218 - RNA, 19 nt, Homo sapiens
aauguacaauaaagcaaug

SEQ ID NO: 501219 - RNA, 19 nt, Homo sapiens
aauguuuucaaaagguauu

SEQ ID NO: 501220 - RNA, 15 nt, Homo sapiens
aauuacaacagugag

SEQ ID NO: 501221 - RNA, 14 nt, Homo sapiens
aauuaccuguggau

SEQ ID NO: 501222 - RNA, 23 nt, Homo sapiens
aauugaguugcacuuauugacca

SEQ ID NO: 501223 - RNA, 12 nt, Homo sapiens
aauuugaacuuu

SEQ ID NO: 501224 - RNA, 13 nt, Homo sapiens
aauuugcacugaa

SEQ ID NO: 501225 - RNA, 21 nt, Homo sapiens
acaaaacgaaaugcuaugacu

SEQ ID NO: 501226 - RNA, 16 nt, Homo sapiens
acaaaauauauuuugu

SEQ ID NO: 501227 - RNA, 17 nt, Homo sapiens
acaaaauccaugaacaa

SEQ ID NO: 501228 - RNA, 13 nt, Homo sapiens
acaaaauuaagca

SEQ ID NO: 501229 - RNA, 11 nt, Homo sapiens
acaaacagggc

SEQ ID NO: 501230 - RNA, 18 nt, Homo sapiens
acaaguaaaacuguggua

SEQ ID NO: 501231 - RNA, 16 nt, Homo sapiens
acaauaaagcaaugug

SEQ ID NO: 501232 - RNA, 23 nt, Homo sapiens
acaauccuucuauucuagccugc

SEQ ID NO: 501233 - RNA, 16 nt, Homo sapiens
acaaucuuugcuguau

SEQ ID NO: 501234 - RNA, 20 nt, Homo sapiens
acaauuguguauaacuggau

SEQ ID NO: 501235 - RNA, 21 nt, Homo sapiens
acacaaagcuguugaaauauu

SEQ ID NO: 501236 - RNA, 15 nt, Homo sapiens
acacaaucugaaaca

SEQ ID NO: 501237 - RNA, 16 nt, Homo sapiens
acacaaucugaaacag

SEQ ID NO: 501238 - RNA, 16 nt, Homo sapiens
acacacgaugcauuua

SEQ ID NO: 501239 - RNA, 17 nt, Homo sapiens
acacacgaugcauuuaa

SEQ ID NO: 501240 - RNA, 23 nt, Homo sapiens
aggcauguacaaaaauuaugcaa

SEQ ID NO: 501241 - RNA, 13 nt, Homo sapiens
aggccucugagaa

SEQ ID NO: 501242 - RNA, 23 nt, Homo sapiens
aggcuccgggcaccaggggccaa

SEQ ID NO: 501243 - RNA, 19 nt, Homo sapiens
aggcugugccaucagcucc

SEQ ID NO: 501244 - RNA, 17 nt, Homo sapiens
agggauuagguguucag

SEQ ID NO: 501245 - RNA, 18 nt, Homo sapiens
agggcaauggacaaggaa

SEQ ID NO: 501246 - RNA, 19 nt, Homo sapiens
agggcaccguauuccucuc

SEQ ID NO: 501247 - RNA, 14 nt, Homo sapiens
agggcagcugugau

SEQ ID NO: 501248 - RNA, 16 nt, Homo sapiens
agggcagcugugauga

SEQ ID NO: 501249 - RNA, 23 nt, Homo sapiens
agggccacauagaugcugaugga

SEQ ID NO: 501250 - RNA, 21 nt, Homo sapiens
aggguaaauaggaaucauuca

SEQ ID NO: 501251 - RNA, 16 nt, Homo sapiens
agguaguuaagggaug

SEQ ID NO: 501252 - RNA, 21 nt, Homo sapiens
agguccuuaggccucugagaa

SEQ ID NO: 501253 - RNA, 19 nt, Homo sapiens
aggucucuaacauaccuug

SEQ ID NO: 501254 - RNA, 15 nt, Homo sapiens
aggugggaggaucac

SEQ ID NO: 501255 - RNA, 17 nt, Homo sapiens
agguuagugacauuuaa

SEQ ID NO: 501256 - RNA, 15 nt, Homo sapiens
aguaaaacuguggua

SEQ ID NO: 501257 - RNA, 20 nt, Homo sapiens
aguacuugacuaccuacugg

SEQ ID NO: 501258 - RNA, 11 nt, Homo sapiens
aguagggccag

SEQ ID NO: 501259 - RNA, 17 nt, Homo sapiens
aguauauugauaaccuu

SEQ ID NO: 501260 - RNA, 17 nt, Homo sapiens
aguccuaaaaguucuca

SEQ ID NO: 501261 - RNA, 20 nt, Homo sapiens
agucugaauagucuucagag

SEQ ID NO: 501262 - RNA, 23 nt, Homo sapiens
agucuggagugggauaggagcag

SEQ ID NO: 501263 - RNA, 17 nt, Homo sapiens
agugagugacaaagccu

SEQ ID NO: 501264 - RNA, 22 nt, Homo sapiens
agugggauuuccagaaccacac

SEQ ID NO: 501265 - RNA, 24 nt, Homo sapiens
agugugugccaagagcuacuccca

SEQ ID NO: 501266 - RNA, 17 nt, Homo sapiens
aguuagaacuagccaaa

SEQ ID NO: 501267 - RNA, 15 nt, Homo sapiens
aguucaacuguauag

SEQ ID NO: 501268 - RNA, 22 nt, Homo sapiens
aguucggaaaccguccugugua

SEQ ID NO: 501269 - RNA, 20 nt, Homo sapiens
uggucuaagguucagccuga

SEQ ID NO: 501270 - RNA, 14 nt, Homo sapiens
uggugcuuacagga

SEQ ID NO: 501271 - RNA, 16 nt, Homo sapiens
ugguuguuguauugau

SEQ ID NO: 501272 - RNA, 12 nt, Homo sapiens
ugguuuugacag

SEQ ID NO: 501273 - RNA, 12 nt, Homo sapiens
uguaagaacaac

SEQ ID NO: 501274 - RNA, 14 nt, Homo sapiens
uguacaauaaagca

SEQ ID NO: 501275 - RNA, 18 nt, Homo sapiens
uguacaauaaagcaaugu

SEQ ID NO: 501276 - RNA, 20 nt, Homo sapiens
uguacagaccaccuuucaca

SEQ ID NO: 501277 - RNA, 22 nt, Homo sapiens
uguagagccaauuagacuugaa

SEQ ID NO: 501278 - RNA, 14 nt, Homo sapiens
uguagcaucuuccu

SEQ ID NO: 501279 - RNA, 18 nt, Homo sapiens
uguauaacuggauugcag

SEQ ID NO: 501280 - RNA, 22 nt, Homo sapiens
uguauaguuuuauuuacuucug

SEQ ID NO: 501281 - RNA, 11 nt, Homo sapiens
uguauguuaaa

SEQ ID NO: 501282 - RNA, 14 nt, Homo sapiens
ugucaaagacugua

SEQ ID NO: 501283 - RNA, 22 nt, Homo sapiens
ugucaauguccuacugagacag

SEQ ID NO: 501284 - RNA, 17 nt, Homo sapiens
ugucagcugcuguugaa

SEQ ID NO: 501285 - RNA, 11 nt, Homo sapiens
ugucuaccugg

SEQ ID NO: 501286 - RNA, 21 nt, Homo sapiens
ugugccaagagcuacucccac

SEQ ID NO: 501287 - RNA, 14 nt, Homo sapiens
ugugccaucagcuc

SEQ ID NO: 501288 - RNA, 23 nt, Homo sapiens
ugugcuaccccuuugauuaugca

SEQ ID NO: 501289 - RNA, 17 nt, Homo sapiens
ugugcuauacacacaca

SEQ ID NO: 501290 - RNA, 21 nt, Homo sapiens
uguguaaauaauuugcacuga

SEQ ID NO: 501291 - RNA, 14 nt, Homo sapiens
uguucaaugauuau

SEQ ID NO: 501292 - RNA, 18 nt, Homo sapiens
uguucugcauggauucag

SEQ ID NO: 501293 - RNA, 15 nt, Homo sapiens
uguugaaauugucaa

SEQ ID NO: 501294 - RNA, 21 nt, Homo sapiens
uuaaaaaauacucugcuauuu

SEQ ID NO: 501295 - RNA, 21 nt, Homo sapiens
aaaaacacccgacgucaugua

SEQ ID NO: 501296 - RNA, 13 nt, Homo sapiens
aaaacaggccagg

SEQ ID NO: 501297 - RNA, 13 nt, Homo sapiens
aaaacauuugcug

SEQ ID NO: 501298 - RNA, 16 nt, Homo sapiens
aaaaggauaguaagca

SEQ ID NO: 501299 - RNA, 23 nt, Homo sapiens
aaaaguaaagaugcuacuuccca

SEQ ID NO: 501300 - RNA, 11 nt, Homo sapiens
aaaaguucuca

SEQ ID NO: 501301 - RNA, 22 nt, Homo sapiens
aaaauaaaaaagaucuccaagc

SEQ ID NO: 501302 - RNA, 19 nt, Homo sapiens
aaaauggacaaaauccaug

SEQ ID NO: 501303 - RNA, 18 nt, Homo sapiens
aaacaaaauccaagauuc

SEQ ID NO: 501304 - RNA, 13 nt, Homo sapiens
acacgaugcauuu

SEQ ID NO: 501305 - RNA, 14 nt, Homo sapiens
acacgaugcauuua

SEQ ID NO: 501306 - RNA, 23 nt, Homo sapiens
acacucaccugcacuaacagagu

SEQ ID NO: 501307 - RNA, 14 nt, Homo sapiens
acagacacaauuua

SEQ ID NO: 501308 - RNA, 14 nt, Homo sapiens
acagauucuuucag

SEQ ID NO: 501309 - RNA, 14 nt, Homo sapiens
acagcaucagcuca

SEQ ID NO: 501310 - RNA, 11 nt, Homo sapiens
acagcugugag

SEQ ID NO: 501311 - RNA, 20 nt, Homo sapiens
acaggcacauuaacuguugc

SEQ ID NO: 501312 - RNA, 18 nt, Homo sapiens
acaguacccaaacugcuu

SEQ ID NO: 501313 - RNA, 20 nt, Homo sapiens
acagugaaguuuuacugucu

SEQ ID NO: 501314 - RNA, 16 nt, Homo sapiens
acagugagaaaccaua

SEQ ID NO: 501315 - RNA, 18 nt, Homo sapiens
acaguuuuaacuguggau

SEQ ID NO: 501316 - RNA, 14 nt, Homo sapiens
acauaccuugucau

SEQ ID NO: 501317 - RNA, 12 nt, Homo sapiens
acauagugagac

SEQ ID NO: 501318 - RNA, 20 nt, Homo sapiens
acauccuccagauaguguag

SEQ ID NO: 501319 - RNA, 20 nt, Homo sapiens
acaugcaaagauccccaaaa

SEQ ID NO: 501320 - RNA, 23 nt, Homo sapiens
acaugggcugugauuacugcaau

SEQ ID NO: 501321 - RNA, 21 nt, Homo sapiens
acauguuaaugacaauauucc

SEQ ID NO: 501322 - RNA, 17 nt, Homo sapiens
acauuuuuuugcaugca

SEQ ID NO: 501323 - RNA, 15 nt, Homo sapiens
accagaaagcuucau

SEQ ID NO: 501324 - RNA, 16 nt, Homo sapiens
accaggacuagggcug

SEQ ID NO: 501325 - RNA, 14 nt, Homo sapiens
accauaugaaugaa

SEQ ID NO: 501326 - RNA, 17 nt, Homo sapiens
accauuugacuguucaa

SEQ ID NO: 501327 - RNA, 21 nt, Homo sapiens
accauuuuauagacuaccaau

SEQ ID NO: 501328 - RNA, 20 nt, Homo sapiens
acccacaaauaaaugacaag

SEQ ID NO: 501329 - RNA, 19 nt, Homo sapiens
acccccugugagcagggau

SEQ ID NO: 501330 - RNA, 16 nt, Homo sapiens
accccuuguugcacug

SEQ ID NO: 501331 - RNA, 18 nt, Homo sapiens
acccgaguaccuccaguc

SEQ ID NO: 501332 - RNA, 22 nt, Homo sapiens
acccuccagagacaacagguaa

SEQ ID NO: 501333 - RNA, 18 nt, Homo sapiens
accuaaauaugagcccag

SEQ ID NO: 501334 - RNA, 17 nt, Homo sapiens
accucaucagcugccua

SEQ ID NO: 501335 - RNA, 18 nt, Homo sapiens
accucaucagcugccuaa

SEQ ID NO: 501336 - RNA, 22 nt, Homo sapiens
accucaucagcugccuaacuua

SEQ ID NO: 501337 - RNA, 20 nt, Homo sapiens
accugccccggaccuaccuc

SEQ ID NO: 501338 - RNA, 23 nt, Homo sapiens
accuggggacuccucaaaccacu

SEQ ID NO: 501339 - RNA, 11 nt, Homo sapiens
accuguagcug

SEQ ID NO: 501340 - RNA, 16 nt, Homo sapiens
accuuccauagccucc

SEQ ID NO: 501341 - RNA, 20 nt, Homo sapiens
acgaaaugcuaugacuguau

SEQ ID NO: 501342 - RNA, 15 nt, Homo sapiens
acgccuguaauccca

SEQ ID NO: 501343 - RNA, 16 nt, Homo sapiens
acuaaaaaaaagauga

SEQ ID NO: 501344 - RNA, 14 nt, Homo sapiens
acuaaacaguaaga

SEQ ID NO: 501345 - RNA, 14 nt, Homo sapiens
acuauucacuaaaa

SEQ ID NO: 501346 - RNA, 15 nt, Homo sapiens
acucaccugcacuaa

SEQ ID NO: 501347 - RNA, 16 nt, Homo sapiens
acucaccugcacuaac

SEQ ID NO: 501348 - RNA, 17 nt, Homo sapiens
acucaccugcacuaaca

SEQ ID NO: 501349 - RNA, 16 nt, Homo sapiens
acucgcuagcacucaa

SEQ ID NO: 501350 - RNA, 20 nt, Homo sapiens
acucuaacaguaguugcaau

SEQ ID NO: 501351 - RNA, 15 nt, Homo sapiens
acucugucucaaaaa

SEQ ID NO: 501352 - RNA, 19 nt, Homo sapiens
acugcugcaaauacuguau

SEQ ID NO: 501353 - RNA, 20 nt, Homo sapiens
acuggauugcagacuguucu

SEQ ID NO: 501354 - RNA, 21 nt, Homo sapiens
acuggcacagagguagucuca

SEQ ID NO: 501355 - RNA, 21 nt, Homo sapiens
acuggcuuaccuccucauggc

SEQ ID NO: 501356 - RNA, 11 nt, Homo sapiens
acuuuuccaca

SEQ ID NO: 501357 - RNA, 16 nt, Homo sapiens
acuuuuccacauucca

SEQ ID NO: 501358 - RNA, 12 nt, Homo sapiens
agaagccaagga

SEQ ID NO: 501359 - RNA, 14 nt, Homo sapiens
agaaugagacugaa

SEQ ID NO: 501360 - RNA, 15 nt, Homo sapiens
agaauuauaacugua

SEQ ID NO: 501361 - RNA, 22 nt, Homo sapiens
agacagcacagccaaccuagcu

SEQ ID NO: 501362 - RNA, 11 nt, Homo sapiens
agacagcaguu

SEQ ID NO: 501363 - RNA, 21 nt, Homo sapiens
agacagcccuggcaaaugccu

SEQ ID NO: 501364 - RNA, 22 nt, Homo sapiens
agacccuuauugcuguccugga

SEQ ID NO: 501365 - RNA, 16 nt, Homo sapiens
agagaaagaacuauga

SEQ ID NO: 501366 - RNA, 15 nt, Homo sapiens
agagaggaaccaaua

SEQ ID NO: 501367 - RNA, 20 nt, Homo sapiens
agaggcucuaauguacaaua

SEQ ID NO: 501368 - RNA, 23 nt, Homo sapiens
agaggcugaggugagaggaucag

SEQ ID NO: 501369 - RNA, 18 nt, Homo sapiens
agagggaaggucucagga

SEQ ID NO: 501370 - RNA, 21 nt, Homo sapiens
agagguagucucacugcuuga

SEQ ID NO: 501371 - RNA, 15 nt, Homo sapiens
agagucuccaguuua

SEQ ID NO: 501372 - RNA, 14 nt, Homo sapiens
agaguuugucauua

SEQ ID NO: 501373 - RNA, 18 nt, Homo sapiens
agauaagguggcuucuca

SEQ ID NO: 501374 - RNA, 14 nt, Homo sapiens
agaugaaacaucau

SEQ ID NO: 501375 - RNA, 14 nt, Homo sapiens
agaugcaucaucuc

SEQ ID NO: 501376 - RNA, 17 nt, Homo sapiens
agauguucacuguggca

SEQ ID NO: 501377 - RNA, 14 nt, Homo sapiens
agauguuuauuuca

SEQ ID NO: 501378 - RNA, 17 nt, Homo sapiens
agauucccaccuuccau

SEQ ID NO: 501379 - RNA, 12 nt, Homo sapiens
agauugaacuuu

SEQ ID NO: 501380 - RNA, 16 nt, Homo sapiens
agcaaaaagacuggau

SEQ ID NO: 501381 - RNA, 13 nt, Homo sapiens
agcacacuuuucc

SEQ ID NO: 501382 - RNA, 12 nt, Homo sapiens
agcacucaagac

SEQ ID NO: 501383 - RNA, 12 nt, Homo sapiens
agcagcauccac

SEQ ID NO: 501384 - RNA, 18 nt, Homo sapiens
agcagccaguucaaaaac

SEQ ID NO: 501385 - RNA, 15 nt, Homo sapiens
agcaugcagcuuugc

SEQ ID NO: 501386 - RNA, 21 nt, Homo sapiens
agcauuguaaaauuauuucau

SEQ ID NO: 501387 - RNA, 20 nt, Homo sapiens
agccaaauuuaaaacuguug

SEQ ID NO: 501388 - RNA, 21 nt, Homo sapiens
agccaaccuagcuagcaacau

SEQ ID NO: 501389 - RNA, 16 nt, Homo sapiens
agccacgaguuuggau

SEQ ID NO: 501390 - RNA, 15 nt, Homo sapiens
agccagaggcucuaa

SEQ ID NO: 501391 - RNA, 18 nt, Homo sapiens
agccaggaggccugcuag

SEQ ID NO: 501392 - RNA, 21 nt, Homo sapiens
agccauugaacagcugugagc

SEQ ID NO: 501393 - RNA, 19 nt, Homo sapiens
agcccaggauacuggcaca

SEQ ID NO: 501394 - RNA, 23 nt, Homo sapiens
agccugaaacucauagacacuga

SEQ ID NO: 501395 - RNA, 14 nt, Homo sapiens
agccugcucccuag

SEQ ID NO: 501396 - RNA, 18 nt, Homo sapiens
agccugcucccuagccag

SEQ ID NO: 501397 - RNA, 20 nt, Homo sapiens
agccugcucccuagccagag

SEQ ID NO: 501398 - RNA, 18 nt, Homo sapiens
agccuggggauuccagcu

SEQ ID NO: 501399 - RNA, 14 nt, Homo sapiens
agccugguuugcaa

SEQ ID NO: 501400 - RNA, 22 nt, Homo sapiens
agccugguuugcaaagaccacc

SEQ ID NO: 501401 - RNA, 14 nt, Homo sapiens
agcgaccucucugc

SEQ ID NO: 501402 - RNA, 16 nt, Homo sapiens
agcugaagaauugaaa

SEQ ID NO: 501403 - RNA, 17 nt, Homo sapiens
agcugcuguugaacuuu

SEQ ID NO: 501404 - RNA, 14 nt, Homo sapiens
agcuuaagaaccau

SEQ ID NO: 501405 - RNA, 18 nt, Homo sapiens
agcuuaagaaccauugau

SEQ ID NO: 501406 - RNA, 14 nt, Homo sapiens
aggaaaaggaauuc

SEQ ID NO: 501407 - RNA, 23 nt, Homo sapiens
aggaacuauguucacaagaacaa

SEQ ID NO: 501408 - RNA, 17 nt, Homo sapiens
aggaauuccucuaugaa

SEQ ID NO: 501409 - RNA, 10 nt, Homo sapiens
aggacugugg

SEQ ID NO: 501410 - RNA, 18 nt, Homo sapiens
aggagcugauacuuugac

SEQ ID NO: 501411 - RNA, 13 nt, Homo sapiens
aggcacucauggg

SEQ ID NO: 501412 - RNA, 16 nt, Homo sapiens
aggcaggacuucucac

SEQ ID NO: 501413 - RNA, 14 nt, Homo sapiens
aggcauguacaaaa

SEQ ID NO: 501414 - RNA, 13 nt, Homo sapiens
auugccucugaaa

SEQ ID NO: 501415 - RNA, 15 nt, Homo sapiens
auugcucaucagcuu

SEQ ID NO: 501416 - RNA, 14 nt, Homo sapiens
auugucacaucuau

SEQ ID NO: 501417 - RNA, 12 nt, Homo sapiens
auuuaacuuucc

SEQ ID NO: 501418 - RNA, 17 nt, Homo sapiens
auuuaguucaacuguau

SEQ ID NO: 501419 - RNA, 15 nt, Homo sapiens
auuucauacuguaac

SEQ ID NO: 501420 - RNA, 15 nt, Homo sapiens
auuuccuuccacugu

SEQ ID NO: 501421 - RNA, 20 nt, Homo sapiens
auuuccuuccacuguagcua

SEQ ID NO: 501422 - RNA, 18 nt, Homo sapiens
auuucuuuuauguuaacu

SEQ ID NO: 501423 - RNA, 18 nt, Homo sapiens
auuugacuguucaaugau

SEQ ID NO: 501424 - RNA, 22 nt, Homo sapiens
auuugauugggaugaaugccau

SEQ ID NO: 501425 - RNA, 16 nt, Homo sapiens
auuuuauagacuacca

SEQ ID NO: 501426 - RNA, 17 nt, Homo sapiens
auuuugaaaugaacuuu

SEQ ID NO: 501427 - RNA, 20 nt, Homo sapiens
caaaaauguguaagaacaac

SEQ ID NO: 501428 - RNA, 13 nt, Homo sapiens
caaaacuuaggca

SEQ ID NO: 501429 - RNA, 21 nt, Homo sapiens
caaaaggaggugaaaucccug

SEQ ID NO: 501430 - RNA, 14 nt, Homo sapiens
caaaccacuugccu

SEQ ID NO: 501431 - RNA, 21 nt, Homo sapiens
caaacuuaagaaacacugacu

SEQ ID NO: 501432 - RNA, 11 nt, Homo sapiens
caaagacugua

SEQ ID NO: 501433 - RNA, 12 nt, Homo sapiens
caaagacuguau

SEQ ID NO: 501434 - RNA, 13 nt, Homo sapiens
caaagacuguauu

SEQ ID NO: 501435 - RNA, 17 nt, Homo sapiens
caaagauccccaaaaca

SEQ ID NO: 501436 - RNA, 19 nt, Homo sapiens
caaagcagcaggacugugg

SEQ ID NO: 501437 - RNA, 14 nt, Homo sapiens
caaauaaaugacaa

SEQ ID NO: 501438 - RNA, 13 nt, Homo sapiens
caaauaaguggaa

SEQ ID NO: 501439 - RNA, 21 nt, Homo sapiens
caaauaauuugaacuuuggaa

SEQ ID NO: 501440 - RNA, 16 nt, Homo sapiens
caaauacacauuugcu

SEQ ID NO: 501441 - RNA, 15 nt, Homo sapiens
caacauuaaacacaa

SEQ ID NO: 501442 - RNA, 19 nt, Homo sapiens
caacugccauguuuugcca

SEQ ID NO: 501443 - RNA, 18 nt, Homo sapiens
caagcuguaucacugccu

SEQ ID NO: 501444 - RNA, 19 nt, Homo sapiens
caaggcucuucuuccucac

SEQ ID NO: 501445 - RNA, 20 nt, Homo sapiens
caaggcuuaggaaagugaua

SEQ ID NO: 501446 - RNA, 17 nt, Homo sapiens
caaguaaaacuguggua

SEQ ID NO: 501447 - RNA, 17 nt, Homo sapiens
caagugagacaaaaagc

SEQ ID NO: 501448 - RNA, 20 nt, Homo sapiens
caaguuccugaacaugauga

SEQ ID NO: 501449 - RNA, 19 nt, Homo sapiens
caauaaagcaaugugguag

SEQ ID NO: 501450 - RNA, 18 nt, Homo sapiens
caauagaguugggacaau

SEQ ID NO: 501451 - RNA, 14 nt, Homo sapiens
caaucacugugcua

SEQ ID NO: 501452 - RNA, 22 nt, Homo sapiens
caaucccucuccacucuucucu

SEQ ID NO: 501453 - RNA, 15 nt, Homo sapiens
caaucugaaacagcu

SEQ ID NO: 501454 - RNA, 19 nt, Homo sapiens
caaucuuuccuacuuucua

SEQ ID NO: 501455 - RNA, 23 nt, Homo sapiens
caaucuuugcuguauacuuuuaa

SEQ ID NO: 501456 - RNA, 11 nt, Homo sapiens
caauuaacugc

SEQ ID NO: 501457 - RNA, 14 nt, Homo sapiens
caauuaacugcccu

SEQ ID NO: 501458 - RNA, 18 nt, Homo sapiens
caauuacaacagugagaa

SEQ ID NO: 501459 - RNA, 15 nt, Homo sapiens
caauuagacuugaaa

SEQ ID NO: 501460 - RNA, 19 nt, Homo sapiens
caauuguguauaacuggau

SEQ ID NO: 501461 - RNA, 14 nt, Homo sapiens
caauuuaaaacaau

SEQ ID NO: 501462 - RNA, 18 nt, Homo sapiens
caauuucuuuuauguuaa

SEQ ID NO: 501463 - RNA, 11 nt, Homo sapiens
cacaacaaucc

SEQ ID NO: 501464 - RNA, 18 nt, Homo sapiens
cacaauguuaaguuauau

SEQ ID NO: 501465 - RNA, 14 nt, Homo sapiens
cacacacgaugcau

SEQ ID NO: 501466 - RNA, 19 nt, Homo sapiens
cacacacgaugcauuuaau

SEQ ID NO: 501467 - RNA, 15 nt, Homo sapiens
cacacgaugcauuua

SEQ ID NO: 501468 - RNA, 19 nt, Homo sapiens
cacacuuuuccacauucca

SEQ ID NO: 501469 - RNA, 18 nt, Homo sapiens
cacaggcacauuaacugu

SEQ ID NO: 501470 - RNA, 23 nt, Homo sapiens
cacccaguugccaaaguuuugcu

SEQ ID NO: 501471 - RNA, 20 nt, Homo sapiens
caccccagggacagggcccu

SEQ ID NO: 501472 - RNA, 19 nt, Homo sapiens
caccuucagaggcugaggu

SEQ ID NO: 501473 - RNA, 12 nt, Homo sapiens
cacgaugcauuu

SEQ ID NO: 501474 - RNA, 20 nt, Homo sapiens
cacgaugcauuuaauaaaga

SEQ ID NO: 501475 - RNA, 16 nt, Homo sapiens
cacuccgucugcucca

SEQ ID NO: 501476 - RNA, 21 nt, Homo sapiens
cacuguggcauugucuguaau

SEQ ID NO: 501477 - RNA, 19 nt, Homo sapiens
cacuuagguccaaggucuc

SEQ ID NO: 501478 - RNA, 20 nt, Homo sapiens
cacuuucaagaaucagacag

SEQ ID NO: 501479 - RNA, 13 nt, Homo sapiens
cacuuuucaaugu

SEQ ID NO: 501480 - RNA, 18 nt, Homo sapiens
cagaaaugcccccauucu

SEQ ID NO: 501481 - RNA, 19 nt, Homo sapiens
cagaacuucagcauuguaa

SEQ ID NO: 501482 - RNA, 19 nt, Homo sapiens
cagaauuuuuaacuguacu

SEQ ID NO: 501483 - RNA, 12 nt, Homo sapiens
cagacuccaugg

SEQ ID NO: 501484 - RNA, 20 nt, Homo sapiens
cagacuggugggcuagccaa

SEQ ID NO: 501485 - RNA, 19 nt, Homo sapiens
cagaggcucuaauguacaa

SEQ ID NO: 501486 - RNA, 20 nt, Homo sapiens
cagagguugcagugagccga

SEQ ID NO: 501487 - RNA, 14 nt, Homo sapiens
cagcaauuccaugc

SEQ ID NO: 501488 - RNA, 16 nt, Homo sapiens
cagcagccccaggaga

SEQ ID NO: 501489 - RNA, 18 nt, Homo sapiens
cagcaggaagccauagau

SEQ ID NO: 501490 - RNA, 14 nt, Homo sapiens
cagcaggacugugg

SEQ ID NO: 501491 - RNA, 15 nt, Homo sapiens
cagccaggcaagaaa

SEQ ID NO: 501492 - RNA, 20 nt, Homo sapiens
cagcccuggcaaaugccuga

SEQ ID NO: 501493 - RNA, 23 nt, Homo sapiens
cagccugcucccuagccagaggc

SEQ ID NO: 501494 - RNA, 15 nt, Homo sapiens
cagccugguuugcaa

SEQ ID NO: 501495 - RNA, 16 nt, Homo sapiens
caggaaggaaugcaaa

SEQ ID NO: 501496 - RNA, 17 nt, Homo sapiens
caggacagcuccuggac

SEQ ID NO: 501497 - RNA, 23 nt, Homo sapiens
cagggcaaaagggcagcugugau

SEQ ID NO: 501498 - RNA, 20 nt, Homo sapiens
cagggcaccguauuccucuc

SEQ ID NO: 501499 - RNA, 19 nt, Homo sapiens
caggggccaaccucaggcu

SEQ ID NO: 501500 - RNA, 18 nt, Homo sapiens
caguacacccaguugcca

SEQ ID NO: 501501 - RNA, 14 nt, Homo sapiens
caguaguugcaaug

SEQ ID NO: 501502 - RNA, 12 nt, Homo sapiens
cagucucagucc

SEQ ID NO: 501503 - RNA, 21 nt, Homo sapiens
caguguguaaauaauuugcac

SEQ ID NO: 501504 - RNA, 23 nt, Homo sapiens
caguuggcuaagaagugacucuu

SEQ ID NO: 501505 - RNA, 21 nt, Homo sapiens
cauaaacgguuccuggugacu

SEQ ID NO: 501506 - RNA, 15 nt, Homo sapiens
cauaccuugucauag

SEQ ID NO: 501507 - RNA, 17 nt, Homo sapiens
cauacuagaguucaugg

SEQ ID NO: 501508 - RNA, 16 nt, Homo sapiens
caucacguuagcuguc

SEQ ID NO: 501509 - RNA, 20 nt, Homo sapiens
caucagggccuuucuccucc

SEQ ID NO: 501510 - RNA, 12 nt, Homo sapiens
cauccaucacag

SEQ ID NO: 501511 - RNA, 19 nt, Homo sapiens
cauccugauggaccugccc

SEQ ID NO: 501512 - RNA, 13 nt, Homo sapiens
caucuccacagga

SEQ ID NO: 501513 - RNA, 15 nt, Homo sapiens
caucucuuccucaca

SEQ ID NO: 501514 - RNA, 23 nt, Homo sapiens
caucugggcaaaacccacagaag

SEQ ID NO: 501515 - RNA, 16 nt, Homo sapiens
caucuuccucugcaga

SEQ ID NO: 501516 - RNA, 14 nt, Homo sapiens
caucuuugaacuuc

SEQ ID NO: 501517 - RNA, 13 nt, Homo sapiens
caugaaaaaccau

SEQ ID NO: 501518 - RNA, 23 nt, Homo sapiens
caugccucccugggccaccuccu

SEQ ID NO: 501519 - RNA, 23 nt, Homo sapiens
cauggauauguuauacugaacca

SEQ ID NO: 501520 - RNA, 19 nt, Homo sapiens
cauggauucagcaugucca

SEQ ID NO: 501521 - RNA, 21 nt, Homo sapiens
cauguuaaugacaauauucca

SEQ ID NO: 501522 - RNA, 15 nt, Homo sapiens
cauguuacccauuca

SEQ ID NO: 501523 - RNA, 15 nt, Homo sapiens
cauucugcacucaga

SEQ ID NO: 501524 - RNA, 15 nt, Homo sapiens
cucuaauguacaaua

SEQ ID NO: 501525 - RNA, 22 nt, Homo sapiens
cucuagguacgaugacaguguu

SEQ ID NO: 501526 - RNA, 21 nt, Homo sapiens
cucucuggucuuuuggauuau

SEQ ID NO: 501527 - RNA, 20 nt, Homo sapiens
cucugaaagaugcaucaucu

SEQ ID NO: 501528 - RNA, 17 nt, Homo sapiens
cucugagccuuggugua

SEQ ID NO: 501529 - RNA, 14 nt, Homo sapiens
cucugucucaaaaa

SEQ ID NO: 501530 - RNA, 23 nt, Homo sapiens
cucugugagggugcugacuggcu

SEQ ID NO: 501531 - RNA, 21 nt, Homo sapiens
cucuuagagaaagaacuauga

SEQ ID NO: 501532 - RNA, 20 nt, Homo sapiens
cugaacaauauauacuuaua

SEQ ID NO: 501533 - RNA, 21 nt, Homo sapiens
cugaugcuggggacacagcau

SEQ ID NO: 501534 - RNA, 17 nt, Homo sapiens
cugcaaaacuccaggca

SEQ ID NO: 501535 - RNA, 16 nt, Homo sapiens
cugcaaucacugugcu

SEQ ID NO: 501536 - RNA, 18 nt, Homo sapiens
cugccaaaacauuuauga

SEQ ID NO: 501537 - RNA, 18 nt, Homo sapiens
cugccccggaccuaccuc

SEQ ID NO: 501538 - RNA, 18 nt, Homo sapiens
cugccucaggccaaggga

SEQ ID NO: 501539 - RNA, 14 nt, Homo sapiens
cugcuaccaaaaca

SEQ ID NO: 501540 - RNA, 19 nt, Homo sapiens
cugcucccacaggggccau

SEQ ID NO: 501541 - RNA, 14 nt, Homo sapiens
cugcucccuagcca

SEQ ID NO: 501542 - RNA, 15 nt, Homo sapiens
cugcuguugaacuuu

SEQ ID NO: 501543 - RNA, 13 nt, Homo sapiens
cugcuucccuuac

SEQ ID NO: 501544 - RNA, 18 nt, Homo sapiens
cuggaaggaccugcuccc

SEQ ID NO: 501545 - RNA, 15 nt, Homo sapiens
cuggauauuuaguuc

SEQ ID NO: 501546 - RNA, 14 nt, Homo sapiens
cuggaugauucagg

SEQ ID NO: 501547 - RNA, 18 nt, Homo sapiens
cuggauugcagacuguuc

SEQ ID NO: 501548 - RNA, 17 nt, Homo sapiens
cuggauuucauacugua

SEQ ID NO: 501549 - RNA, 22 nt, Homo sapiens
cugggacacuccgucugcucca

SEQ ID NO: 501550 - RNA, 16 nt, Homo sapiens
cuggucccucuucucu

SEQ ID NO: 501551 - RNA, 12 nt, Homo sapiens
cuggugacuccu

SEQ ID NO: 501552 - RNA, 12 nt, Homo sapiens
cuguaaugacaa

SEQ ID NO: 501553 - RNA, 20 nt, Homo sapiens
cugucaauguccuacugaga

SEQ ID NO: 501554 - RNA, 22 nt, Homo sapiens
cugucuauuaauauucagggua

SEQ ID NO: 501555 - RNA, 16 nt, Homo sapiens
cugugccaucagcucc

SEQ ID NO: 501556 - RNA, 16 nt, Homo sapiens
cugugggcaagccuaa

SEQ ID NO: 501557 - RNA, 19 nt, Homo sapiens
cugugguacugauggacuu

SEQ ID NO: 501558 - RNA, 17 nt, Homo sapiens
cuuaaaagguacuggua

SEQ ID NO: 501559 - RNA, 20 nt, Homo sapiens
cuuaagggguaucauguaug

SEQ ID NO: 501560 - RNA, 14 nt, Homo sapiens
cuuacugcaggcaa

SEQ ID NO: 501561 - RNA, 14 nt, Homo sapiens
cuuagaaagucuga

SEQ ID NO: 501562 - RNA, 15 nt, Homo sapiens
cuuaggcaugcacag

SEQ ID NO: 501563 - RNA, 16 nt, Homo sapiens
cuuauccaucuuugaa

SEQ ID NO: 501564 - RNA, 18 nt, Homo sapiens
cuuaucuuacaauauuga

SEQ ID NO: 501565 - RNA, 15 nt, Homo sapiens
cuucacggcugacau

SEQ ID NO: 501566 - RNA, 13 nt, Homo sapiens
cuucagcaaguua

SEQ ID NO: 501567 - RNA, 19 nt, Homo sapiens
cuuccauagccuccaaaca

SEQ ID NO: 501568 - RNA, 23 nt, Homo sapiens
cuucccuaggaucccgucuucca

SEQ ID NO: 501569 - RNA, 21 nt, Homo sapiens
cuuccucugcagaauaaaauc

SEQ ID NO: 501570 - RNA, 14 nt, Homo sapiens
cuucuccuguucca

SEQ ID NO: 501571 - RNA, 19 nt, Homo sapiens
cuucugacuacuuguugua

SEQ ID NO: 501572 - RNA, 18 nt, Homo sapiens
cuucuuuacuuaguucaa

SEQ ID NO: 501573 - RNA, 15 nt, Homo sapiens
cuugcagaacuguag

SEQ ID NO: 501574 - RNA, 21 nt, Homo sapiens
cuugcagcggcuccugcaaaa

SEQ ID NO: 501575 - RNA, 22 nt, Homo sapiens
cuugcagcggcuccugcaaaag

SEQ ID NO: 501576 - RNA, 22 nt, Homo sapiens
cuuggagaaaauggguuuauuc

SEQ ID NO: 501577 - RNA, 18 nt, Homo sapiens
cuuggagaauacugccaa

SEQ ID NO: 501578 - RNA, 24 nt, Homo sapiens
cuugucauagaggaaaagcacaga

SEQ ID NO: 501579 - RNA, 12 nt, Homo sapiens
cuuuaagugugc

SEQ ID NO: 501580 - RNA, 21 nt, Homo sapiens
cuuuauaaauguaccagagag

SEQ ID NO: 501581 - RNA, 14 nt, Homo sapiens
cuuuauugcaaugc

SEQ ID NO: 501582 - RNA, 16 nt, Homo sapiens
cuuuccugcagcaguc

SEQ ID NO: 501583 - RNA, 12 nt, Homo sapiens
cuuugcugccag

SEQ ID NO: 501584 - RNA, 20 nt, Homo sapiens
cuuuggcaaaacuuaggcau

SEQ ID NO: 501585 - RNA, 14 nt, Homo sapiens
cuuugucaguguug

SEQ ID NO: 501586 - RNA, 11 nt, Homo sapiens
cuuugugacca

SEQ ID NO: 501587 - RNA, 22 nt, Homo sapiens
cuuuuuaaagaagugcaugaaa

SEQ ID NO: 501588 - RNA, 22 nt, Homo sapiens
gaaaaagaagguugagggcaau

SEQ ID NO: 501589 - RNA, 11 nt, Homo sapiens
gaaaacagaaa

SEQ ID NO: 501590 - RNA, 13 nt, Homo sapiens
gaaaacauuugcu

SEQ ID NO: 501591 - RNA, 16 nt, Homo sapiens
gaaaaggaauuccucu

SEQ ID NO: 501592 - RNA, 22 nt, Homo sapiens
gaaacaaauaauuugaacuuug

SEQ ID NO: 501593 - RNA, 20 nt, Homo sapiens
gaaacacuauuugugacuuu

SEQ ID NO: 501594 - RNA, 13 nt, Homo sapiens
gaaacagcuucau

SEQ ID NO: 501595 - RNA, 15 nt, Homo sapiens
gaaagaacuaugaaa

SEQ ID NO: 501596 - RNA, 20 nt, Homo sapiens
gaaagaauagaacacaguuu

SEQ ID NO: 501597 - RNA, 20 nt, Homo sapiens
gaaagagccuaacaucucca

SEQ ID NO: 501598 - RNA, 16 nt, Homo sapiens
gaaaguaacugugaga

SEQ ID NO: 501599 - RNA, 14 nt, Homo sapiens
gaaauauagccaaa

SEQ ID NO: 501600 - RNA, 16 nt, Homo sapiens
gaaaucaaaaagggaa

SEQ ID NO: 501601 - RNA, 11 nt, Homo sapiens
gaaaugaacuu

SEQ ID NO: 501602 - RNA, 18 nt, Homo sapiens
gaacaaucuuugcuguau

SEQ ID NO: 501603 - RNA, 13 nt, Homo sapiens
gaacagcugugag

SEQ ID NO: 501604 - RNA, 17 nt, Homo sapiens
gaacagcugugagccau

SEQ ID NO: 501605 - RNA, 19 nt, Homo sapiens
gaaccagcagaaaugcccc

SEQ ID NO: 501606 - RNA, 15 nt, Homo sapiens
gaacccucuugccau

SEQ ID NO: 501607 - RNA, 18 nt, Homo sapiens
gaacuagccaaaccagga

SEQ ID NO: 501608 - RNA, 21 nt, Homo sapiens
gaacuguugaaagaaaauaua

SEQ ID NO: 501609 - RNA, 22 nt, Homo sapiens
gaaggaaaaggaauuccucuau

SEQ ID NO: 501610 - RNA, 13 nt, Homo sapiens
gaauaaaguaugu

SEQ ID NO: 501611 - RNA, 16 nt, Homo sapiens
gaauacugccaaaaca

SEQ ID NO: 501612 - RNA, 22 nt, Homo sapiens
gaauaugaccauuugacuguuc

SEQ ID NO: 501613 - RNA, 20 nt, Homo sapiens
gaaugagacugaacugugug

SEQ ID NO: 501614 - RNA, 15 nt, Homo sapiens
gaauuaucuauuuca

SEQ ID NO: 501615 - RNA, 21 nt, Homo sapiens
gaauucagucaaagauacaca

SEQ ID NO: 501616 - RNA, 15 nt, Homo sapiens
gaauuuaaggcccaa

SEQ ID NO: 501617 - RNA, 21 nt, Homo sapiens
gacaaaaagcacuaguauaaa

SEQ ID NO: 501618 - RNA, 16 nt, Homo sapiens
gaccagccugggcaac

SEQ ID NO: 501619 - RNA, 17 nt, Homo sapiens
gaccccaauauauguau

SEQ ID NO: 501620 - RNA, 19 nt, Homo sapiens
gaccgcgcuguuccggcuu

SEQ ID NO: 501621 - RNA, 22 nt, Homo sapiens
gaccuaaauuauuuacugcaaa

SEQ ID NO: 501622 - RNA, 20 nt, Homo sapiens
gacuacccauagacaugaaa

SEQ ID NO: 501623 - RNA, 14 nt, Homo sapiens
gacucgcuagcacu

SEQ ID NO: 501624 - RNA, 12 nt, Homo sapiens
gacugauuucag

SEQ ID NO: 501625 - RNA, 17 nt, Homo sapiens
gagaccccuuguugcac

SEQ ID NO: 501626 - RNA, 22 nt, Homo sapiens
gagaccccuuguugcacugccc

SEQ ID NO: 501627 - RNA, 16 nt, Homo sapiens
gagauaagucuuucau

SEQ ID NO: 501628 - RNA, 21 nt, Homo sapiens
gagcugauacuuugacagugu

SEQ ID NO: 501629 - RNA, 22 nt, Homo sapiens
gagcugccaagagugaagggaa

SEQ ID NO: 501630 - RNA, 17 nt, Homo sapiens
gagcuguguucuugcca

SEQ ID NO: 501631 - RNA, 20 nt, Homo sapiens
gaggcaggagaauugcuuga

SEQ ID NO: 501632 - RNA, 21 nt, Homo sapiens
gaggcucuaauguacaauaaa

SEQ ID NO: 501633 - RNA, 22 nt, Homo sapiens
gaguaccuccagucacacuccc

SEQ ID NO: 501634 - RNA, 22 nt, Homo sapiens
ugcaggcaggaacaaacagggc

SEQ ID NO: 501635 - RNA, 22 nt, Homo sapiens
ugcauaauguuucuggauuuca

SEQ ID NO: 501636 - RNA, 19 nt, Homo sapiens
ugcaucaucucuuccucac

SEQ ID NO: 501637 - RNA, 16 nt, Homo sapiens
ugccauguuuugccac

SEQ ID NO: 501638 - RNA, 17 nt, Homo sapiens
ugccccggaccuaccuc

SEQ ID NO: 501639 - RNA, 21 nt, Homo sapiens
ugcccucugaaauaaugggau

SEQ ID NO: 501640 - RNA, 20 nt, Homo sapiens
ugccucaggccaagggacca

SEQ ID NO: 501641 - RNA, 15 nt, Homo sapiens
ugccuccucaucagu

SEQ ID NO: 501642 - RNA, 14 nt, Homo sapiens
ugcuaccccuuuga

SEQ ID NO: 501643 - RNA, 18 nt, Homo sapiens
ugcucaaucccugaggac

SEQ ID NO: 501644 - RNA, 13 nt, Homo sapiens
ugcuggaacuguu

SEQ ID NO: 501645 - RNA, 18 nt, Homo sapiens
ugcugggccccaucucca

SEQ ID NO: 501646 - RNA, 22 nt, Homo sapiens
ugcuuuccagccuuuggugcuu

SEQ ID NO: 501647 - RNA, 19 nt, Homo sapiens
uggaagaugcagaagcaau

SEQ ID NO: 501648 - RNA, 17 nt, Homo sapiens
uggaaggaaaaggaauu

SEQ ID NO: 501649 - RNA, 15 nt, Homo sapiens
uggagaauacugcca

SEQ ID NO: 501650 - RNA, 20 nt, Homo sapiens
uggagaauacugccaaaaca

SEQ ID NO: 501651 - RNA, 21 nt, Homo sapiens
uggagccauugaacagcugug

SEQ ID NO: 501652 - RNA, 23 nt, Homo sapiens
uggagccauugaacagcugugag

SEQ ID NO: 501653 - RNA, 20 nt, Homo sapiens
uggaguagccauucuuuauu

SEQ ID NO: 501654 - RNA, 13 nt, Homo sapiens
uggagucugucaa

SEQ ID NO: 501655 - RNA, 22 nt, Homo sapiens
uggauauuuaguucaacuguau

SEQ ID NO: 501656 - RNA, 15 nt, Homo sapiens
uggauucagcauguc

SEQ ID NO: 501657 - RNA, 20 nt, Homo sapiens
uggauucuuuaaacgcucua

SEQ ID NO: 501658 - RNA, 19 nt, Homo sapiens
uggcaaaugccugacucag

SEQ ID NO: 501659 - RNA, 21 nt, Homo sapiens
uggcaaggcuuaggaaaguga

SEQ ID NO: 501660 - RNA, 20 nt, Homo sapiens
uggcauugucuguaaugaca

SEQ ID NO: 501661 - RNA, 20 nt, Homo sapiens
uggccgcuucagaugacaga

SEQ ID NO: 501662 - RNA, 23 nt, Homo sapiens
uggcugcuguugcuuaaaccacu

SEQ ID NO: 501663 - RNA, 20 nt, Homo sapiens
ugggaaacaaauaauuugaa

SEQ ID NO: 501664 - RNA, 21 nt, Homo sapiens
ugggcaaaacccacagaagac

SEQ ID NO: 501665 - RNA, 17 nt, Homo sapiens
ugggcaacauagugaga

SEQ ID NO: 501666 - RNA, 15 nt, Homo sapiens
uggggacacagcauc

SEQ ID NO: 501667 - RNA, 22 nt, Homo sapiens
uggggagaagaaauacagucaa

SEQ ID NO: 501668 - RNA, 17 nt, Homo sapiens
ugggucuaggacacagu

SEQ ID NO: 501669 - RNA, 23 nt, Homo sapiens
uggucaagggcugucauugcaca

SEQ ID NO: 501670 - RNA, 15 nt, Homo sapiens
ugguuauauguauau

SEQ ID NO: 501671 - RNA, 23 nt, Homo sapiens
uguaaaauuuaaaucauauccua

SEQ ID NO: 501672 - RNA, 17 nt, Homo sapiens
uguaaucucaaugcaag

SEQ ID NO: 501673 - RNA, 13 nt, Homo sapiens
uguacaauaaagc

SEQ ID NO: 501674 - RNA, 23 nt, Homo sapiens
uguacaauaaagcaaugugguag

SEQ ID NO: 501675 - RNA, 18 nt, Homo sapiens
uguacugugucucaugga

SEQ ID NO: 501676 - RNA, 17 nt, Homo sapiens
uguauaugaaugaauaa

SEQ ID NO: 501677 - RNA, 23 nt, Homo sapiens
uguauuuuugugaaguauucaca

SEQ ID NO: 501678 - RNA, 14 nt, Homo sapiens
ugucucccaaaaau

SEQ ID NO: 501679 - RNA, 19 nt, Homo sapiens
ugucuguaaugacaaauaa

SEQ ID NO: 501680 - RNA, 14 nt, Homo sapiens
ugugagcagggauu

SEQ ID NO: 501681 - RNA, 23 nt, Homo sapiens
ugugauuacugcaaucacugugc

SEQ ID NO: 501682 - RNA, 14 nt, Homo sapiens
ugugcuggguccca

SEQ ID NO: 501683 - RNA, 22 nt, Homo sapiens
ugugcuucaaggacauugguga

SEQ ID NO: 501684 - RNA, 23 nt, Homo sapiens
uguggggccucaggcuccgggca

SEQ ID NO: 501685 - RNA, 13 nt, Homo sapiens
ugugguugcucac

SEQ ID NO: 501686 - RNA, 21 nt, Homo sapiens
ugugugagcuaugcaaacaaa

SEQ ID NO: 501687 - RNA, 15 nt, Homo sapiens
uguguuuucagcaaa

SEQ ID NO: 501688 - RNA, 18 nt, Homo sapiens
uguucuuacuguaacuac

SEQ ID NO: 501689 - RNA, 16 nt, Homo sapiens
uguugaaauugucaaa

SEQ ID NO: 501690 - RNA, 12 nt, Homo sapiens
uguugacugugu

SEQ ID NO: 501691 - RNA, 19 nt, Homo sapiens
uuaaaaguuauuuguucau

SEQ ID NO: 501692 - RNA, 16 nt, Homo sapiens
uuaaacauacgacuua

SEQ ID NO: 501693 - RNA, 18 nt, Homo sapiens
uuaaaccuuaagauacua

SEQ ID NO: 501694 - RNA, 19 nt, Homo sapiens
uuaaacgauuagugauguc

SEQ ID NO: 501695 - RNA, 17 nt, Homo sapiens
uuaaguuuuacugauaa

SEQ ID NO: 501696 - RNA, 20 nt, Homo sapiens
uuacaauaggaguggugauu

SEQ ID NO: 501697 - RNA, 12 nt, Homo sapiens
uuacaguuucca

SEQ ID NO: 501698 - RNA, 23 nt, Homo sapiens
uuacuguucuaaggcugugccau

SEQ ID NO: 501699 - RNA, 21 nt, Homo sapiens
uuagagaaagaacuaugaaau

SEQ ID NO: 501700 - RNA, 18 nt, Homo sapiens
uuagaugggaggaugaau

SEQ ID NO: 501701 - RNA, 22 nt, Homo sapiens
uuagcugugcgcaauugcucau

SEQ ID NO: 501702 - RNA, 13 nt, Homo sapiens
uuauaacuguaaa

SEQ ID NO: 501703 - RNA, 14 nt, Homo sapiens
uuauacaugugaua

SEQ ID NO: 501704 - RNA, 17 nt, Homo sapiens
uuauguagguaagacug

SEQ ID NO: 501705 - RNA, 16 nt, Homo sapiens
uuauucuacuacuugg

SEQ ID NO: 501706 - RNA, 17 nt, Homo sapiens
uucaaagagacauauac

SEQ ID NO: 501707 - RNA, 20 nt, Homo sapiens
uucaaaguuuuguuguacuu

SEQ ID NO: 501708 - RNA, 16 nt, Homo sapiens
uucagaugacagaugu

SEQ ID NO: 501709 - RNA, 13 nt, Homo sapiens
uucaggagagugu

SEQ ID NO: 501710 - RNA, 21 nt, Homo sapiens
uucaggagaguguauaugaau

SEQ ID NO: 501711 - RNA, 23 nt, Homo sapiens
uucagucaaagauacacaaucug

SEQ ID NO: 501712 - RNA, 18 nt, Homo sapiens
uuccagccuuuggugcuu

SEQ ID NO: 501713 - RNA, 12 nt, Homo sapiens
uuccuagcugug

SEQ ID NO: 501714 - RNA, 13 nt, Homo sapiens
uuccucuaugaag

SEQ ID NO: 501715 - RNA, 20 nt, Homo sapiens
uuccuggcagucucagucca

SEQ ID NO: 501716 - RNA, 13 nt, Homo sapiens
uucuccuguucca

SEQ ID NO: 501717 - RNA, 22 nt, Homo sapiens
uucugccugcuccaucgcgcca

SEQ ID NO: 501718 - RNA, 18 nt, Homo sapiens
uugaacuaggcugagcaa

SEQ ID NO: 501719 - RNA, 15 nt, Homo sapiens
uugagggcaauggac

SEQ ID NO: 501720 - RNA, 14 nt, Homo sapiens
uugcaaggugugau

SEQ ID NO: 501721 - RNA, 20 nt, Homo sapiens
uugcagugagccgagaucac

SEQ ID NO: 501722 - RNA, 12 nt, Homo sapiens
uugcaugcaugc

SEQ ID NO: 501723 - RNA, 17 nt, Homo sapiens
uugcucuugccaaaaaa

SEQ ID NO: 501724 - RNA, 21 nt, Homo sapiens
uugcugauaccauaugaauga

SEQ ID NO: 501725 - RNA, 19 nt, Homo sapiens
uuggaacaggguuggcauu

SEQ ID NO: 501726 - RNA, 15 nt, Homo sapiens
uugguuguacuuugg

SEQ ID NO: 501727 - RNA, 16 nt, Homo sapiens
uuguugaaauugucaa

SEQ ID NO: 501728 - RNA, 17 nt, Homo sapiens
uuguuguauugaucaau

SEQ ID NO: 501729 - RNA, 19 nt, Homo sapiens
uuuaauguaauagggaaaa

SEQ ID NO: 501730 - RNA, 23 nt, Homo sapiens
uuuagaaaagaaagcaaacuuaa

SEQ ID NO: 501731 - RNA, 21 nt, Homo sapiens
uuuauauuuuuuuaacuguga

SEQ ID NO: 501732 - RNA, 23 nt, Homo sapiens
uuucagagugacuacacacagua

SEQ ID NO: 501733 - RNA, 15 nt, Homo sapiens
uuucagcggugccaa

SEQ ID NO: 501734 - RNA, 20 nt, Homo sapiens
uuucauacuguaacauucag

SEQ ID NO: 501735 - RNA, 17 nt, Homo sapiens
uuuccaaaaaaguguua

SEQ ID NO: 501736 - RNA, 11 nt, Homo sapiens
uuuccagagag

SEQ ID NO: 501737 - RNA, 16 nt, Homo sapiens
uuuccuggcagucuca

SEQ ID NO: 501738 - RNA, 20 nt, Homo sapiens
uuucuauuuuuaugaugaca

SEQ ID NO: 501739 - RNA, 19 nt, Homo sapiens
uuugaagcugcagugagcu

SEQ ID NO: 501740 - RNA, 20 nt, Homo sapiens
uuugacuguucaaugauuau

SEQ ID NO: 501741 - RNA, 15 nt, Homo sapiens
uuugcaugcaugcaa

SEQ ID NO: 501742 - RNA, 18 nt, Homo sapiens
uuugcuguauacuuuuaa

SEQ ID NO: 501743 - RNA, 22 nt, Homo sapiens
uggguaauaaccaagauggagu

SEQ ID NO: 501744 - RNA, 20 nt, Homo sapiens
ugguaauaaaugugacucag

SEQ ID NO: 501745 - RNA, 22 nt, Homo sapiens
uggucuaagguucagccugaaa

SEQ ID NO: 501746 - RNA, 17 nt, Homo sapiens
caucaucucuuccucac

SEQ ID NO: 501747 - RNA, 22 nt, Homo sapiens
caucccaucucucccacuuccu

SEQ ID NO: 501748 - RNA, 16 nt, Homo sapiens
caugccugaugaaagc

SEQ ID NO: 501749 - RNA, 18 nt, Homo sapiens
cauucaacagagacugaa

SEQ ID NO: 501750 - RNA, 23 nt, Homo sapiens
cauucugcacucagaaaauggca

SEQ ID NO: 501751 - RNA, 19 nt, Homo sapiens
cauuguuucguaacacagc

SEQ ID NO: 501752 - RNA, 17 nt, Homo sapiens
cauuuaauaaagaugag

SEQ ID NO: 501753 - RNA, 20 nt, Homo sapiens
cauuuacacagugcuuucca

SEQ ID NO: 501754 - RNA, 16 nt, Homo sapiens
ccaaaaauuacuuugg

SEQ ID NO: 501755 - RNA, 14 nt, Homo sapiens
ccaaaacaguuaau

SEQ ID NO: 501756 - RNA, 15 nt, Homo sapiens
ccaaacauguuccca

SEQ ID NO: 501757 - RNA, 22 nt, Homo sapiens
ccaaacccaucuuuuguucucc

SEQ ID NO: 501758 - RNA, 19 nt, Homo sapiens
ccaaacugauccaguauaa

SEQ ID NO: 501759 - RNA, 14 nt, Homo sapiens
ccaagagcuacucc

SEQ ID NO: 501760 - RNA, 21 nt, Homo sapiens
ccaaggaaaggcauguacaaa

SEQ ID NO: 501761 - RNA, 17 nt, Homo sapiens
ccaaggccccacuuuca

SEQ ID NO: 501762 - RNA, 23 nt, Homo sapiens
ccaaucccucuccacucuucucu

SEQ ID NO: 501763 - RNA, 16 nt, Homo sapiens
ccacuuuauugcaaug

SEQ ID NO: 501764 - RNA, 23 nt, Homo sapiens
ccagagccuggggauuccagcug

SEQ ID NO: 501765 - RNA, 14 nt, Homo sapiens
ccagaggcucuaau

SEQ ID NO: 501766 - RNA, 21 nt, Homo sapiens
ccagaggcucuaauguacaau

SEQ ID NO: 501767 - RNA, 22 nt, Homo sapiens
ccagaggcucuaauguacaaua

SEQ ID NO: 501768 - RNA, 23 nt, Homo sapiens
ccagaggcucuaauguacaauaa

SEQ ID NO: 501769 - RNA, 22 nt, Homo sapiens
ccagccucgccgaggagagcaa

SEQ ID NO: 501770 - RNA, 12 nt, Homo sapiens
ccagcugucuug

SEQ ID NO: 501771 - RNA, 17 nt, Homo sapiens
ccagggaggcagccuag

SEQ ID NO: 501772 - RNA, 18 nt, Homo sapiens
ccagugaugugugagcua

SEQ ID NO: 501773 - RNA, 12 nt, Homo sapiens
ccaguuacauaa

SEQ ID NO: 501774 - RNA, 20 nt, Homo sapiens
ccauaaacgguuccugguga

SEQ ID NO: 501775 - RNA, 20 nt, Homo sapiens
ccaucguauuaaaaaacaau

SEQ ID NO: 501776 - RNA, 18 nt, Homo sapiens
ccaucucucccacuuccu

SEQ ID NO: 501777 - RNA, 15 nt, Homo sapiens
ccaucuuugcugcca

SEQ ID NO: 501778 - RNA, 22 nt, Homo sapiens
ccaucuuugcugccagcucuca

SEQ ID NO: 501779 - RNA, 16 nt, Homo sapiens
ccauuacagagguauu

SEQ ID NO: 501780 - RNA, 16 nt, Homo sapiens
ccauugaacagcugug

SEQ ID NO: 501781 - RNA, 17 nt, Homo sapiens
cccaaauggcagggaua

SEQ ID NO: 501782 - RNA, 18 nt, Homo sapiens
cccacccgaguaccucca

SEQ ID NO: 501783 - RNA, 16 nt, Homo sapiens
cccacuugacacuauu

SEQ ID NO: 501784 - RNA, 17 nt, Homo sapiens
cccagccugguuugcaa

SEQ ID NO: 501785 - RNA, 15 nt, Homo sapiens
cccaggauacuggca

SEQ ID NO: 501786 - RNA, 22 nt, Homo sapiens
ccccaccccaucuuugcugcca

SEQ ID NO: 501787 - RNA, 11 nt, Homo sapiens
cccccuagugg

SEQ ID NO: 501788 - RNA, 21 nt, Homo sapiens
ccccuccccucgcugcugggc

SEQ ID NO: 501789 - RNA, 16 nt, Homo sapiens
cccuccauucugcacu

SEQ ID NO: 501790 - RNA, 22 nt, Homo sapiens
cccuggcaaaugccugacucag

SEQ ID NO: 501791 - RNA, 13 nt, Homo sapiens
ccggguccuccua

SEQ ID NO: 501792 - RNA, 16 nt, Homo sapiens
ccguucagaaaaccac

SEQ ID NO: 501793 - RNA, 15 nt, Homo sapiens
ccuaaaagcacuccu

SEQ ID NO: 501794 - RNA, 14 nt, Homo sapiens
ccuaaaaguucuca

SEQ ID NO: 501795 - RNA, 13 nt, Homo sapiens
ccuacugagacag

SEQ ID NO: 501796 - RNA, 16 nt, Homo sapiens
ccuagccagaggcucu

SEQ ID NO: 501797 - RNA, 21 nt, Homo sapiens
ccuagcuggcucugugagggu

SEQ ID NO: 501798 - RNA, 19 nt, Homo sapiens
ccuaggaucccgucuucca

SEQ ID NO: 501799 - RNA, 20 nt, Homo sapiens
ccuaugggucuaggacacag

SEQ ID NO: 501800 - RNA, 9 nt, Homo sapiens
ccucaggcu

SEQ ID NO: 501801 - RNA, 10 nt, Homo sapiens
ccucuucucu

SEQ ID NO: 501802 - RNA, 13 nt, Homo sapiens
ccugagagugggu

SEQ ID NO: 501803 - RNA, 10 nt, Homo sapiens
ccugcaaaac

SEQ ID NO: 501804 - RNA, 19 nt, Homo sapiens
ccuggauccucaguucuca

SEQ ID NO: 501805 - RNA, 21 nt, Homo sapiens
ccuggcaaaugccugacucag

SEQ ID NO: 501806 - RNA, 20 nt, Homo sapiens
ccuggccaacaugaugaaac

SEQ ID NO: 501807 - RNA, 21 nt, Homo sapiens
ccuggggacuccucaaaccac

SEQ ID NO: 501808 - RNA, 15 nt, Homo sapiens
ccuggggauuccagc

SEQ ID NO: 501809 - RNA, 12 nt, Homo sapiens
ccugugugaccc

SEQ ID NO: 501810 - RNA, 22 nt, Homo sapiens
ccuuaaaauguggucugccaau

SEQ ID NO: 501811 - RNA, 14 nt, Homo sapiens
ccuuuccuggcagu

SEQ ID NO: 501812 - RNA, 17 nt, Homo sapiens
ccuuuguccugcguuuu

SEQ ID NO: 501813 - RNA, 21 nt, Homo sapiens
ccuuugucuaaguagggccag

SEQ ID NO: 501814 - RNA, 19 nt, Homo sapiens
ccuuuuggccuccugcaaa

SEQ ID NO: 501815 - RNA, 23 nt, Homo sapiens
cgaugauguacagauucuuucag

SEQ ID NO: 501816 - RNA, 12 nt, Homo sapiens
cgaugcauuuaa

SEQ ID NO: 501817 - RNA, 18 nt, Homo sapiens
cgcaauggccgcuucaga

SEQ ID NO: 501818 - RNA, 16 nt, Homo sapiens
cgcaucccaucucucc

SEQ ID NO: 501819 - RNA, 20 nt, Homo sapiens
cgcccacccgaguaccucca

SEQ ID NO: 501820 - RNA, 21 nt, Homo sapiens
cgcugcccagagccuggggau

SEQ ID NO: 501821 - RNA, 17 nt, Homo sapiens
cggguggggccauaaac

SEQ ID NO: 501822 - RNA, 22 nt, Homo sapiens
cguuguuuugguuguacuuugg

SEQ ID NO: 501823 - RNA, 13 nt, Homo sapiens
cuaaaaguucuca

SEQ ID NO: 501824 - RNA, 18 nt, Homo sapiens
cuaaaaguucucaaugua

SEQ ID NO: 501825 - RNA, 15 nt, Homo sapiens
cuaacaguaguugca

SEQ ID NO: 501826 - RNA, 22 nt, Homo sapiens
gaagcugccguagcuucagcca

SEQ ID NO: 501827 - RNA, 22 nt, Homo sapiens
gaaggucucaggagaagggaua

SEQ ID NO: 501828 - RNA, 20 nt, Homo sapiens
gaauaaagcauccaaguaua

SEQ ID NO: 501829 - RNA, 16 nt, Homo sapiens
gaauuauaacuguaaa

SEQ ID NO: 501830 - RNA, 21 nt, Homo sapiens
gacaauauuccagaucuuuca

SEQ ID NO: 501831 - RNA, 21 nt, Homo sapiens
gacagcacagccaaccuagcu

SEQ ID NO: 501832 - RNA, 19 nt, Homo sapiens
gacagcaggaagccauaga

SEQ ID NO: 501833 - RNA, 17 nt, Homo sapiens
gacaguuuuugacauuu

SEQ ID NO: 501834 - RNA, 19 nt, Homo sapiens
gacaguuuuugacauuuau

SEQ ID NO: 501835 - RNA, 16 nt, Homo sapiens
gaccaccuuucacaaa

SEQ ID NO: 501836 - RNA, 15 nt, Homo sapiens
gaccacucaauccau

SEQ ID NO: 501837 - RNA, 12 nt, Homo sapiens
gaccaggucuca

SEQ ID NO: 501838 - RNA, 15 nt, Homo sapiens
gaccauuugacuguu

SEQ ID NO: 501839 - RNA, 22 nt, Homo sapiens
gacccuuuuaagcaugugaugu

SEQ ID NO: 501840 - RNA, 22 nt, Homo sapiens
gaccugccccggaccuaccucc

SEQ ID NO: 501841 - RNA, 15 nt, Homo sapiens
gacuaccaauuucuu

SEQ ID NO: 501842 - RNA, 10 nt, Homo sapiens
gacuccucaa

SEQ ID NO: 501843 - RNA, 15 nt, Homo sapiens
gacucgcuagcacuc

SEQ ID NO: 501844 - RNA, 19 nt, Homo sapiens
gacuuccgagcuaugucag

SEQ ID NO: 501845 - RNA, 14 nt, Homo sapiens
gagacaacagguaa

SEQ ID NO: 501846 - RNA, 13 nt, Homo sapiens
gagauaaagaaua

SEQ ID NO: 501847 - RNA, 21 nt, Homo sapiens
gagauaggccugugggccaga

SEQ ID NO: 501848 - RNA, 13 nt, Homo sapiens
gagcaaacagaaa

SEQ ID NO: 501849 - RNA, 11 nt, Homo sapiens
gagcagggauu

SEQ ID NO: 501850 - RNA, 20 nt, Homo sapiens
gagcauggagacagcaguuu

SEQ ID NO: 501851 - RNA, 16 nt, Homo sapiens
gagcugauacuuugac

SEQ ID NO: 501852 - RNA, 20 nt, Homo sapiens
gagcugcagucccaugcaca

SEQ ID NO: 501853 - RNA, 22 nt, Homo sapiens
gaggagaaauuugauaaugaca

SEQ ID NO: 501854 - RNA, 13 nt, Homo sapiens
uaccauguggcaa

SEQ ID NO: 501855 - RNA, 15 nt, Homo sapiens
uacgaugacaguguu

SEQ ID NO: 501856 - RNA, 20 nt, Homo sapiens
uacucauuaaaaauaauaga

SEQ ID NO: 501857 - RNA, 16 nt, Homo sapiens
uacugcaaucacugug

SEQ ID NO: 501858 - RNA, 21 nt, Homo sapiens
uacuuacauguucccaaaaca

SEQ ID NO: 501859 - RNA, 14 nt, Homo sapiens
uacuucucugcuau

SEQ ID NO: 501860 - RNA, 17 nt, Homo sapiens
uagcauuuugcuaucuu

SEQ ID NO: 501861 - RNA, 20 nt, Homo sapiens
uagccaaaccaggacccugu

SEQ ID NO: 501862 - RNA, 19 nt, Homo sapiens
uagccagaggcucuaaugu

SEQ ID NO: 501863 - RNA, 16 nt, Homo sapiens
uagccuaugucuggca

SEQ ID NO: 501864 - RNA, 13 nt, Homo sapiens
uagcuucagccag

SEQ ID NO: 501865 - RNA, 13 nt, Homo sapiens
uaggaauaugacc

SEQ ID NO: 501866 - RNA, 21 nt, Homo sapiens
uagugauguccuuaaaaugug

SEQ ID NO: 501867 - RNA, 17 nt, Homo sapiens
uauaaauguaccagaga

SEQ ID NO: 501868 - RNA, 17 nt, Homo sapiens
uauaacuggauugcaga

SEQ ID NO: 501869 - RNA, 17 nt, Homo sapiens
uauaauacuacuacugu

SEQ ID NO: 501870 - RNA, 20 nt, Homo sapiens
uauaauaggaacaaucuuug

SEQ ID NO: 501871 - RNA, 18 nt, Homo sapiens
uauagcauuuugcuaucu

SEQ ID NO: 501872 - RNA, 17 nt, Homo sapiens
uauaguauaagcagugu

SEQ ID NO: 501873 - RNA, 16 nt, Homo sapiens
uauauagaaugaucua

SEQ ID NO: 501874 - RNA, 21 nt, Homo sapiens
uauccuccccuuuuaccacuc

SEQ ID NO: 501875 - RNA, 20 nt, Homo sapiens
uauggaguaccauguggcaa

SEQ ID NO: 501876 - RNA, 21 nt, Homo sapiens
uaugggggagauugaacuuuc

SEQ ID NO: 501877 - RNA, 24 nt, Homo sapiens
uauuauugguuguuguauugauca

SEQ ID NO: 501878 - RNA, 21 nt, Homo sapiens
uauucccaaaaauuacuuugg

SEQ ID NO: 501879 - RNA, 20 nt, Homo sapiens
uauucuauaaaacucugcau

SEQ ID NO: 501880 - RNA, 13 nt, Homo sapiens
uauuucucuugcu

SEQ ID NO: 501881 - RNA, 17 nt, Homo sapiens
uauuucucuugcuggaa

SEQ ID NO: 501882 - RNA, 18 nt, Homo sapiens
ccaguauaagacuacuga

SEQ ID NO: 501883 - RNA, 23 nt, Homo sapiens
ccagucucugucguggagccauu

SEQ ID NO: 501884 - RNA, 22 nt, Homo sapiens
ccauaaacgguuccuggugacu

SEQ ID NO: 501885 - RNA, 21 nt, Homo sapiens
ccauguacuucccucuugaaa

SEQ ID NO: 501886 - RNA, 12 nt, Homo sapiens
ccauucucccag

SEQ ID NO: 501887 - RNA, 13 nt, Homo sapiens
ccauugaacagcu

SEQ ID NO: 501888 - RNA, 19 nt, Homo sapiens
ccauuucaguucaguuuca

SEQ ID NO: 501889 - RNA, 23 nt, Homo sapiens
ccauuuuaauuuuaaagugcaaa

SEQ ID NO: 501890 - RNA, 17 nt, Homo sapiens
cccaaaaauuacuuugg

SEQ ID NO: 501891 - RNA, 21 nt, Homo sapiens
ccccagccugcucccuagcca

SEQ ID NO: 501892 - RNA, 22 nt, Homo sapiens
ccccagccugcucccuagccag

SEQ ID NO: 501893 - RNA, 16 nt, Homo sapiens
ccccuuguugcacugc

SEQ ID NO: 501894 - RNA, 17 nt, Homo sapiens
cccuagccagaggcucu

SEQ ID NO: 501895 - RNA, 19 nt, Homo sapiens
cccuguucauucugcauuc

SEQ ID NO: 501896 - RNA, 23 nt, Homo sapiens
cccuuccuauucuccugccaugg

SEQ ID NO: 501897 - RNA, 13 nt, Homo sapiens
ccgaguaccucca

SEQ ID NO: 501898 - RNA, 15 nt, Homo sapiens
ccggaccuaccuccc

SEQ ID NO: 501899 - RNA, 17 nt, Homo sapiens
ccggaugaaacuucuca

SEQ ID NO: 501900 - RNA, 21 nt, Homo sapiens
ccgucuuccagagaaccugug

SEQ ID NO: 501901 - RNA, 19 nt, Homo sapiens
ccuaacucuugaggucucu

SEQ ID NO: 501902 - RNA, 20 nt, Homo sapiens
ccuagacucugucuaccugg

SEQ ID NO: 501903 - RNA, 13 nt, Homo sapiens
ccuagccuauguc

SEQ ID NO: 501904 - RNA, 23 nt, Homo sapiens
ccuaggaaagccaguuacauaaa

SEQ ID NO: 501905 - RNA, 17 nt, Homo sapiens
ccucagcucaaugcagu

SEQ ID NO: 501906 - RNA, 12 nt, Homo sapiens
ccucaguucuca

SEQ ID NO: 501907 - RNA, 19 nt, Homo sapiens
ccucccugggccaccuccu

SEQ ID NO: 501908 - RNA, 16 nt, Homo sapiens
ccucuucucuccucag

SEQ ID NO: 501909 - RNA, 21 nt, Homo sapiens
ccugaugcuggggacacagca

SEQ ID NO: 501910 - RNA, 13 nt, Homo sapiens
ccugccucaggcc

SEQ ID NO: 501911 - RNA, 16 nt, Homo sapiens
ccugcucccuagccag

SEQ ID NO: 501912 - RNA, 20 nt, Homo sapiens
ccugcuuuccugcagcaguc

SEQ ID NO: 501913 - RNA, 16 nt, Homo sapiens
ccuggaccaggucuca

SEQ ID NO: 501914 - RNA, 15 nt, Homo sapiens
ccugguuugcaaaga

SEQ ID NO: 501915 - RNA, 19 nt, Homo sapiens
ccugucaauacuauggagu

SEQ ID NO: 501916 - RNA, 16 nt, Homo sapiens
ccugugagcagggauu

SEQ ID NO: 501917 - RNA, 22 nt, Homo sapiens
ccuuacuggcuuaccuccucau

SEQ ID NO: 501918 - RNA, 13 nt, Homo sapiens
ccuuccacuguag

SEQ ID NO: 501919 - RNA, 22 nt, Homo sapiens
ccuuccuguccugccuccucau

SEQ ID NO: 501920 - RNA, 13 nt, Homo sapiens
ccuuguugcacug

SEQ ID NO: 501921 - RNA, 17 nt, Homo sapiens
ccuuucacuaaaacaca

SEQ ID NO: 501922 - RNA, 19 nt, Homo sapiens
ccuuuuaagcaugugaugu

SEQ ID NO: 501923 - RNA, 17 nt, Homo sapiens
ccuuuuaccacucccag

SEQ ID NO: 501924 - RNA, 19 nt, Homo sapiens
cgaaaugcuaugacuguau

SEQ ID NO: 501925 - RNA, 21 nt, Homo sapiens
cgagaucacgccacugcacuc

SEQ ID NO: 501926 - RNA, 16 nt, Homo sapiens
cgagcgccuggugcug

SEQ ID NO: 501927 - RNA, 13 nt, Homo sapiens
cgaugacaguguu

SEQ ID NO: 501928 - RNA, 14 nt, Homo sapiens
cgaugacaguguuc

SEQ ID NO: 501929 - RNA, 19 nt, Homo sapiens
cgcccacccgaguaccucc

SEQ ID NO: 501930 - RNA, 15 nt, Homo sapiens
cgccgaggagagcaa

SEQ ID NO: 501931 - RNA, 12 nt, Homo sapiens
cgccuggugcug

SEQ ID NO: 501932 - RNA, 18 nt, Homo sapiens
cgccuggugcugagugca

SEQ ID NO: 501933 - RNA, 19 nt, Homo sapiens
cgccuggugcugagugcac

SEQ ID NO: 501934 - RNA, 14 nt, Homo sapiens
cggcuccugcaaaa

SEQ ID NO: 501935 - RNA, 15 nt, Homo sapiens
cggcuuuaagugugc

SEQ ID NO: 501936 - RNA, 21 nt, Homo sapiens
cgggagaccccuuguugcacu

SEQ ID NO: 501937 - RNA, 17 nt, Homo sapiens
cgggcaccaggggccaa

SEQ ID NO: 501938 - RNA, 13 nt, Homo sapiens
cgguggaggcaga

SEQ ID NO: 501939 - RNA, 19 nt, Homo sapiens
cuaaaaguucucaauguag

SEQ ID NO: 501940 - RNA, 14 nt, Homo sapiens
cuaacauaccuugu

SEQ ID NO: 501941 - RNA, 20 nt, Homo sapiens
cuaacgagggauuacuuugg

SEQ ID NO: 501942 - RNA, 14 nt, Homo sapiens
cuaacuuauccauc

SEQ ID NO: 501943 - RNA, 20 nt, Homo sapiens
cuaacuuauccaucuuugaa

SEQ ID NO: 501944 - RNA, 21 nt, Homo sapiens
cuaagagaaugugcucaugca

SEQ ID NO: 501945 - RNA, 21 nt, Homo sapiens
cuaaggagcugauacuuugac

SEQ ID NO: 501946 - RNA, 15 nt, Homo sapiens
cuaauguacaauaaa

SEQ ID NO: 501947 - RNA, 19 nt, Homo sapiens
cuaauguacaauaaagcaa

SEQ ID NO: 501948 - RNA, 22 nt, Homo sapiens
cuaauguacaauaaagcaaugu

SEQ ID NO: 501949 - RNA, 14 nt, Homo sapiens
cuacacacaguacg

SEQ ID NO: 501950 - RNA, 14 nt, Homo sapiens
cuaccaaaacaguu

SEQ ID NO: 501951 - RNA, 19 nt, Homo sapiens
cuacucaggaggcugaggc

SEQ ID NO: 501952 - RNA, 17 nt, Homo sapiens
cuagccagaggcucuaa

SEQ ID NO: 501953 - RNA, 14 nt, Homo sapiens
cuagucaguuggcu

SEQ ID NO: 501954 - RNA, 15 nt, Homo sapiens
cuagucaguuggcua

SEQ ID NO: 501955 - RNA, 22 nt, Homo sapiens
cuaguccccagccugcucccua

SEQ ID NO: 501956 - RNA, 23 nt, Homo sapiens
cuaguccccagccugcucccuag

SEQ ID NO: 501957 - RNA, 16 nt, Homo sapiens
cuagugguauggggcu

SEQ ID NO: 501958 - RNA, 15 nt, Homo sapiens
cuaucccucuccuaa

SEQ ID NO: 501959 - RNA, 22 nt, Homo sapiens
cuaugcaaacaaaauccaagau

SEQ ID NO: 501960 - RNA, 14 nt, Homo sapiens
cuaugucuggcaga

SEQ ID NO: 501961 - RNA, 13 nt, Homo sapiens
cuauuaauauuca

SEQ ID NO: 501962 - RNA, 15 nt, Homo sapiens
cuauucuccugccau

SEQ ID NO: 501963 - RNA, 19 nt, Homo sapiens
cucaaagaugcguuugccu

SEQ ID NO: 501964 - RNA, 20 nt, Homo sapiens
cucaaagaugcguuugccuc

SEQ ID NO: 501965 - RNA, 20 nt, Homo sapiens
cucaaagcagcaggacugug

SEQ ID NO: 501966 - RNA, 21 nt, Homo sapiens
cucagugaccagugccuguga

SEQ ID NO: 501967 - RNA, 20 nt, Homo sapiens
cuccaaugacugagcagcau

SEQ ID NO: 501968 - RNA, 18 nt, Homo sapiens
cuccacaggagagacugg

SEQ ID NO: 501969 - RNA, 20 nt, Homo sapiens
cucccacaggggccaugucc

SEQ ID NO: 501970 - RNA, 14 nt, Homo sapiens
cucccuagccagag

SEQ ID NO: 501971 - RNA, 22 nt, Homo sapiens
cucccuagccagaggcucuaau

SEQ ID NO: 501972 - RNA, 19 nt, Homo sapiens
cuccgcgggagaccccuug

SEQ ID NO: 501973 - RNA, 13 nt, Homo sapiens
cuccuaccccuuc

SEQ ID NO: 501974 - RNA, 12 nt, Homo sapiens
cuccuguuccau

SEQ ID NO: 501975 - RNA, 22 nt, Homo sapiens
cuccuuggcuucuuuacuuagu

SEQ ID NO: 501976 - RNA, 18 nt, Homo sapiens
cucuaacaguaguugcaa

SEQ ID NO: 501977 - RNA, 18 nt, Homo sapiens
cugaauuaucuauuucau

SEQ ID NO: 501978 - RNA, 21 nt, Homo sapiens
cugacauuucuucuagugaug

SEQ ID NO: 501979 - RNA, 13 nt, Homo sapiens
cugagcagcaucc

SEQ ID NO: 501980 - RNA, 19 nt, Homo sapiens
cugauacuuugacaguguu

SEQ ID NO: 501981 - RNA, 21 nt, Homo sapiens
cugauucuggcuuuaagccuu

SEQ ID NO: 501982 - RNA, 22 nt, Homo sapiens
cugauuucuuaggggaaggaga

SEQ ID NO: 501983 - RNA, 14 nt, Homo sapiens
cugcaaauacugua

SEQ ID NO: 501984 - RNA, 15 nt, Homo sapiens
cugcaaauacuguau

SEQ ID NO: 501985 - RNA, 20 nt, Homo sapiens
cugcagaauaaaaucucuau

SEQ ID NO: 501986 - RNA, 16 nt, Homo sapiens
cugcagagauuucuca

SEQ ID NO: 501987 - RNA, 18 nt, Homo sapiens
cugcagucccaugcacaa

SEQ ID NO: 501988 - RNA, 11 nt, Homo sapiens
cugccaagagu

SEQ ID NO: 501989 - RNA, 20 nt, Homo sapiens
cugccccggaccuaccuccc

SEQ ID NO: 501990 - RNA, 16 nt, Homo sapiens
cugccccuacccugga

SEQ ID NO: 501991 - RNA, 18 nt, Homo sapiens
cuugacuaccuacuggug

SEQ ID NO: 501992 - RNA, 22 nt, Homo sapiens
cuugagggguuguugcgcaaug

SEQ ID NO: 501993 - RNA, 20 nt, Homo sapiens
cuugcaugcuugcauaagag

SEQ ID NO: 501994 - RNA, 16 nt, Homo sapiens
cuugccauccugaugg

SEQ ID NO: 501995 - RNA, 14 nt, Homo sapiens
cuugucuucuggua

SEQ ID NO: 501996 - RNA, 13 nt, Homo sapiens
cuuuaagugugcu

SEQ ID NO: 501997 - RNA, 13 nt, Homo sapiens
cuuugacaguguu

SEQ ID NO: 501998 - RNA, 14 nt, Homo sapiens
cuuugacaguguuu

SEQ ID NO: 501999 - RNA, 16 nt, Homo sapiens
cuuugauuaugcagac

SEQ ID NO: 502000 - RNA, 16 nt, Homo sapiens
cuuugcucuugccaaa

SEQ ID NO: 502001 - RNA, 14 nt, Homo sapiens
cuuuggccaaaacc

SEQ ID NO: 502002 - RNA, 20 nt, Homo sapiens
cuuuggccaaaaccuuucaa

SEQ ID NO: 502003 - RNA, 16 nt, Homo sapiens
cuuuuauaaagcaugu

SEQ ID NO: 502004 - RNA, 14 nt, Homo sapiens
gaaaacauguuaau

SEQ ID NO: 502005 - RNA, 14 nt, Homo sapiens
gaaagaacuaugaa

SEQ ID NO: 502006 - RNA, 16 nt, Homo sapiens
gaaaucuuaaaccuua

SEQ ID NO: 502007 - RNA, 16 nt, Homo sapiens
gaaauuccuguacugu

SEQ ID NO: 502008 - RNA, 18 nt, Homo sapiens
gaaauugcauacuuugua

SEQ ID NO: 502009 - RNA, 14 nt, Homo sapiens
gaacaacuaccuga

SEQ ID NO: 502010 - RNA, 21 nt, Homo sapiens
gaacggaggaggacaugggga

SEQ ID NO: 502011 - RNA, 15 nt, Homo sapiens
gaacuaugaaaucaa

SEQ ID NO: 502012 - RNA, 19 nt, Homo sapiens
gaacuucugacuacuuguu

SEQ ID NO: 502013 - RNA, 21 nt, Homo sapiens
gaaggaccugcucccacaggg

SEQ ID NO: 502014 - RNA, 15 nt, Homo sapiens
gaaggugaacuuugu

SEQ ID NO: 502015 - RNA, 15 nt, Homo sapiens
gaagucugagggaaa

SEQ ID NO: 502016 - RNA, 14 nt, Homo sapiens
gaaguuaaagggca

SEQ ID NO: 502017 - RNA, 14 nt, Homo sapiens
gaauaaagcaucca

SEQ ID NO: 502018 - RNA, 14 nt, Homo sapiens
gaauaguacagaca

SEQ ID NO: 502019 - RNA, 17 nt, Homo sapiens
gaaucucauccaucaca

SEQ ID NO: 502020 - RNA, 21 nt, Homo sapiens
gaaugcauuauuuauugcugu

SEQ ID NO: 502021 - RNA, 21 nt, Homo sapiens
gaaugugcucaugcauugcuu

SEQ ID NO: 502022 - RNA, 18 nt, Homo sapiens
gacaaaauccaugaacaa

SEQ ID NO: 502023 - RNA, 19 nt, Homo sapiens
gacaagaaacacauucuua

SEQ ID NO: 502024 - RNA, 16 nt, Homo sapiens
gacacagcaucagcuc

SEQ ID NO: 502025 - RNA, 22 nt, Homo sapiens
gacagcccuggcaaaugccuga

SEQ ID NO: 502026 - RNA, 17 nt, Homo sapiens
gacaggaaggaaugcaa

SEQ ID NO: 502027 - RNA, 15 nt, Homo sapiens
gacauauacuaagau

SEQ ID NO: 502028 - RNA, 22 nt, Homo sapiens
gacauauacuaagauguucacu

SEQ ID NO: 502029 - RNA, 18 nt, Homo sapiens
gaccccugucucccaaaa

SEQ ID NO: 502030 - RNA, 17 nt, Homo sapiens
gaccccuuguugcacug

SEQ ID NO: 502031 - RNA, 22 nt, Homo sapiens
gaccugcucccacaggggccau

SEQ ID NO: 502032 - RNA, 13 nt, Homo sapiens
gacucuaacagua

SEQ ID NO: 502033 - RNA, 16 nt, Homo sapiens
gacucugucuaccugg

SEQ ID NO: 502034 - RNA, 17 nt, Homo sapiens
gacuuggagaauacugc

SEQ ID NO: 502035 - RNA, 14 nt, Homo sapiens
gagaaauugaggau

SEQ ID NO: 502036 - RNA, 20 nt, Homo sapiens
gagaagcucugaagaacucu

SEQ ID NO: 502037 - RNA, 23 nt, Homo sapiens
gagacagcacagccaaccuagcu

SEQ ID NO: 502038 - RNA, 20 nt, Homo sapiens
gagaccccuuguugcacugc

SEQ ID NO: 502039 - RNA, 12 nt, Homo sapiens
gagauucccacc

SEQ ID NO: 502040 - RNA, 20 nt, Homo sapiens
gagccauugaacagcuguga

SEQ ID NO: 502041 - RNA, 13 nt, Homo sapiens
gagcgcacaggga

SEQ ID NO: 502042 - RNA, 14 nt, Homo sapiens
gagcgguaugcucu

SEQ ID NO: 502043 - RNA, 20 nt, Homo sapiens
gaggagauaagguggcuucu

SEQ ID NO: 502044 - RNA, 23 nt, Homo sapiens
gagucugaauagucuucagagau

SEQ ID NO: 502045 - RNA, 18 nt, Homo sapiens
gaguugggacaauugcuu

SEQ ID NO: 502046 - RNA, 13 nt, Homo sapiens
gauaaacaaacaa

SEQ ID NO: 502047 - RNA, 14 nt, Homo sapiens
gauaaacaaacaag

SEQ ID NO: 502048 - RNA, 23 nt, Homo sapiens
gauaacacaaguaaaacuguggu

SEQ ID NO: 502049 - RNA, 21 nt, Homo sapiens
gauacacaaucugaaacagcu

SEQ ID NO: 502050 - RNA, 23 nt, Homo sapiens
gauacuuacauguucccaaaaca

SEQ ID NO: 502051 - RNA, 15 nt, Homo sapiens
gaucccgucuuccag

SEQ ID NO: 502052 - RNA, 11 nt, Homo sapiens
gaugcauuuaa

SEQ ID NO: 502053 - RNA, 14 nt, Homo sapiens
gauuguauuaacua

SEQ ID NO: 502054 - RNA, 18 nt, Homo sapiens
gcaaagauccccaaaaca

SEQ ID NO: 502055 - RNA, 18 nt, Homo sapiens
gcaacagcaaacaggugc

SEQ ID NO: 502056 - RNA, 14 nt, Homo sapiens
gcaaguuagaacua

SEQ ID NO: 502057 - RNA, 17 nt, Homo sapiens
gcaauaauaaaguacuu

SEQ ID NO: 502058 - RNA, 21 nt, Homo sapiens
gcaauugcgaccuuaauuuaa

SEQ ID NO: 502059 - RNA, 17 nt, Homo sapiens
gcacacccuccagagac

SEQ ID NO: 502060 - RNA, 22 nt, Homo sapiens
gcacacccuccagagacaacag

SEQ ID NO: 502061 - RNA, 14 nt, Homo sapiens
gcaccaggggccaa

SEQ ID NO: 502062 - RNA, 15 nt, Homo sapiens
gcacucauggguaau

SEQ ID NO: 502063 - RNA, 20 nt, Homo sapiens
gcagagcuuguuuuguuuca

SEQ ID NO: 502064 - RNA, 18 nt, Homo sapiens
gcaggaagccuacuauuu

SEQ ID NO: 502065 - RNA, 17 nt, Homo sapiens
gcaggagguuacagggc

SEQ ID NO: 502066 - RNA, 14 nt, Homo sapiens
gcagucucagucca

SEQ ID NO: 502067 - RNA, 20 nt, Homo sapiens
gcauaagagcuuaagaacca

SEQ ID NO: 502068 - RNA, 19 nt, Homo sapiens
gcaucaucucuuccucaca

SEQ ID NO: 502069 - RNA, 19 nt, Homo sapiens
gcauccucucuggucuuuu

SEQ ID NO: 502070 - RNA, 20 nt, Homo sapiens
gcaugaacccucuugccauc

SEQ ID NO: 502071 - RNA, 13 nt, Homo sapiens
gcauucucuaguc

SEQ ID NO: 502072 - RNA, 21 nt, Homo sapiens
gcauucuuugcaauacugcuu

SEQ ID NO: 502073 - RNA, 13 nt, Homo sapiens
gccaaaccaggac

SEQ ID NO: 502074 - RNA, 14 nt, Homo sapiens
gucugaacaauaua

SEQ ID NO: 502075 - RNA, 19 nt, Homo sapiens
gucugaacaauauauacuu

SEQ ID NO: 502076 - RNA, 20 nt, Homo sapiens
gucugucaauguccuacuga

SEQ ID NO: 502077 - RNA, 21 nt, Homo sapiens
gucuuaaacuaaaugugcaau

SEQ ID NO: 502078 - RNA, 16 nt, Homo sapiens
gugaaaucccugccuc

SEQ ID NO: 502079 - RNA, 16 nt, Homo sapiens
gugagcauggggccag

SEQ ID NO: 502080 - RNA, 13 nt, Homo sapiens
gugagcuaugcaa

SEQ ID NO: 502081 - RNA, 12 nt, Homo sapiens
gugagugacaaa

SEQ ID NO: 502082 - RNA, 21 nt, Homo sapiens
gugaugugugagcuaugcaaa

SEQ ID NO: 502083 - RNA, 21 nt, Homo sapiens
gugauuacugcaaucacugug

SEQ ID NO: 502084 - RNA, 19 nt, Homo sapiens
gugcaggauauuugcacua

SEQ ID NO: 502085 - RNA, 13 nt, Homo sapiens
gugcugagugcac

SEQ ID NO: 502086 - RNA, 13 nt, Homo sapiens
gugcuuacaggac

SEQ ID NO: 502087 - RNA, 20 nt, Homo sapiens
guggaaaugagguuggggga

SEQ ID NO: 502088 - RNA, 21 nt, Homo sapiens
gugggauauugaauguuaaag

SEQ ID NO: 502089 - RNA, 19 nt, Homo sapiens
guguccagcugaguuucuc

SEQ ID NO: 502090 - RNA, 15 nt, Homo sapiens
gugugacccugggca

SEQ ID NO: 502091 - RNA, 18 nt, Homo sapiens
guguugccucuugcaaug

SEQ ID NO: 502092 - RNA, 19 nt, Homo sapiens
guguugccucuugcaaugc

SEQ ID NO: 502093 - RNA, 16 nt, Homo sapiens
guuagaacuagccaaa

SEQ ID NO: 502094 - RNA, 16 nt, Homo sapiens
guuauacaucaauaug

SEQ ID NO: 502095 - RNA, 19 nt, Homo sapiens
guuauacuuauuuguauau

SEQ ID NO: 502096 - RNA, 22 nt, Homo sapiens
guucauggauauguuauacuga

SEQ ID NO: 502097 - RNA, 23 nt, Homo sapiens
guucauggauauguuauacugaa

SEQ ID NO: 502098 - RNA, 12 nt, Homo sapiens
guucauucugca

SEQ ID NO: 502099 - RNA, 14 nt, Homo sapiens
guucuaacagugaa

SEQ ID NO: 502100 - RNA, 14 nt, Homo sapiens
cugcaaaaggaggu

SEQ ID NO: 502101 - RNA, 18 nt, Homo sapiens
cugcacacccuccagaga

SEQ ID NO: 502102 - RNA, 22 nt, Homo sapiens
cugcagcagucgcccaagcaga

SEQ ID NO: 502103 - RNA, 16 nt, Homo sapiens
cugccagcucucagga

SEQ ID NO: 502104 - RNA, 21 nt, Homo sapiens
cugccauuacagagguauuaa

SEQ ID NO: 502105 - RNA, 15 nt, Homo sapiens
cugccucucuucuuc

SEQ ID NO: 502106 - RNA, 17 nt, Homo sapiens
cugcucugccuguggag

SEQ ID NO: 502107 - RNA, 20 nt, Homo sapiens
cugcugggccccaucuccac

SEQ ID NO: 502108 - RNA, 13 nt, Homo sapiens
cugcuggugaaua

SEQ ID NO: 502109 - RNA, 15 nt, Homo sapiens
cuggaccaggucuca

SEQ ID NO: 502110 - RNA, 17 nt, Homo sapiens
cuggaucccguucagaa

SEQ ID NO: 502111 - RNA, 18 nt, Homo sapiens
cuggccuauguggucuaa

SEQ ID NO: 502112 - RNA, 21 nt, Homo sapiens
cugggaugugaagucucuggg

SEQ ID NO: 502113 - RNA, 13 nt, Homo sapiens
cugggccccaucu

SEQ ID NO: 502114 - RNA, 21 nt, Homo sapiens
cuggguggaagugugugccaa

SEQ ID NO: 502115 - RNA, 18 nt, Homo sapiens
cugguaauaaaugugacu

SEQ ID NO: 502116 - RNA, 21 nt, Homo sapiens
cugguaauaaaugugacucag

SEQ ID NO: 502117 - RNA, 18 nt, Homo sapiens
cuggugaauaacuaugcc

SEQ ID NO: 502118 - RNA, 20 nt, Homo sapiens
cugguguaaucucaaugcaa

SEQ ID NO: 502119 - RNA, 21 nt, Homo sapiens
cuguaaagauguuuauuucag

SEQ ID NO: 502120 - RNA, 13 nt, Homo sapiens
cuguaacuacuuc

SEQ ID NO: 502121 - RNA, 18 nt, Homo sapiens
cuguagguucaugcccaa

SEQ ID NO: 502122 - RNA, 15 nt, Homo sapiens
cuguauuuagaucuc

SEQ ID NO: 502123 - RNA, 15 nt, Homo sapiens
cugugagcagggauu

SEQ ID NO: 502124 - RNA, 18 nt, Homo sapiens
cugugagcauggggccag

SEQ ID NO: 502125 - RNA, 21 nt, Homo sapiens
cugugagccuugcaugacauc

SEQ ID NO: 502126 - RNA, 22 nt, Homo sapiens
cugugcugaacauaacuucuca

SEQ ID NO: 502127 - RNA, 15 nt, Homo sapiens
cuguucuuacuguaa

SEQ ID NO: 502128 - RNA, 18 nt, Homo sapiens
cuguugcuuaaaccacuu

SEQ ID NO: 502129 - RNA, 20 nt, Homo sapiens
cuuaaaccuuaagauacuaa

SEQ ID NO: 502130 - RNA, 22 nt, Homo sapiens
cuuaauuuaacuuuccagucuu

SEQ ID NO: 502131 - RNA, 16 nt, Homo sapiens
cuuacaucauguguug

SEQ ID NO: 502132 - RNA, 20 nt, Homo sapiens
cuucaaagccuucucccuag

SEQ ID NO: 502133 - RNA, 11 nt, Homo sapiens
cuucagaugac

SEQ ID NO: 502134 - RNA, 15 nt, Homo sapiens
cuuccacuguagcua

SEQ ID NO: 502135 - RNA, 17 nt, Homo sapiens
cuuccuccuaccugggg

SEQ ID NO: 502136 - RNA, 17 nt, Homo sapiens
cuuccuguccugccucc

SEQ ID NO: 502137 - RNA, 18 nt, Homo sapiens
cuugaaaaaaaacagugg

SEQ ID NO: 502138 - RNA, 14 nt, Homo sapiens
cuugccacugcacu

SEQ ID NO: 502139 - RNA, 19 nt, Homo sapiens
cuuggagaauacugccaaa

SEQ ID NO: 502140 - RNA, 16 nt, Homo sapiens
cuuggcuucagguuag

SEQ ID NO: 502141 - RNA, 12 nt, Homo sapiens
cuuguugcacug

SEQ ID NO: 502142 - RNA, 13 nt, Homo sapiens
cuuguugcacugc

SEQ ID NO: 502143 - RNA, 19 nt, Homo sapiens
cuuuaccuaaauaugagcc

SEQ ID NO: 502144 - RNA, 21 nt, Homo sapiens
cuuucaaaggauaugcagaaa

SEQ ID NO: 502145 - RNA, 14 nt, Homo sapiens
cuuucucucucuaa

SEQ ID NO: 502146 - RNA, 15 nt, Homo sapiens
cuuugacaguguuuu

SEQ ID NO: 502147 - RNA, 20 nt, Homo sapiens
cuuugaccuaaauuauuuac

SEQ ID NO: 502148 - RNA, 18 nt, Homo sapiens
cuuuuggauuauuccuca

SEQ ID NO: 502149 - RNA, 10 nt, Homo sapiens
gaaaacagaa

SEQ ID NO: 502150 - RNA, 20 nt, Homo sapiens
gaaacaaauaauuugaacuu

SEQ ID NO: 502151 - RNA, 18 nt, Homo sapiens
gaaacaugggcugugauu

SEQ ID NO: 502152 - RNA, 21 nt, Homo sapiens
gaaacguggauacagagccac

SEQ ID NO: 502153 - RNA, 20 nt, Homo sapiens
gaaagaugguagggagcauu

SEQ ID NO: 502154 - RNA, 15 nt, Homo sapiens
gaaaugaacuuuguc

SEQ ID NO: 502155 - RNA, 18 nt, Homo sapiens
gaaaugcuaugacuguau

SEQ ID NO: 502156 - RNA, 21 nt, Homo sapiens
gaaauucacuuccccucuagg

SEQ ID NO: 502157 - RNA, 15 nt, Homo sapiens
gaaauugucaaagac

SEQ ID NO: 502158 - RNA, 20 nt, Homo sapiens
gaaauugucaaagacuguau

SEQ ID NO: 502159 - RNA, 15 nt, Homo sapiens
gaacauaacuucuca

SEQ ID NO: 502160 - RNA, 14 nt, Homo sapiens
gaacaucacauucc

SEQ ID NO: 502161 - RNA, 16 nt, Homo sapiens
gaaccaauaccuucaa

SEQ ID NO: 502162 - RNA, 12 nt, Homo sapiens
gaaccaggccag

SEQ ID NO: 502163 - RNA, 13 nt, Homo sapiens
gaacuaacaugca

SEQ ID NO: 502164 - RNA, 15 nt, Homo sapiens
gaacuaacaugcaaa

SEQ ID NO: 502165 - RNA, 17 nt, Homo sapiens
gaacuucugacuacuug

SEQ ID NO: 502166 - RNA, 19 nt, Homo sapiens
gaaggagaaguaagaggcu

SEQ ID NO: 502167 - RNA, 16 nt, Homo sapiens
gaaggugaacuuugug

SEQ ID NO: 502168 - RNA, 17 nt, Homo sapiens
gaaguugccaugggaaa

SEQ ID NO: 502169 - RNA, 21 nt, Homo sapiens
gaauaaagcauccaaguauau

SEQ ID NO: 502170 - RNA, 14 nt, Homo sapiens
gaauaacuaugcca

SEQ ID NO: 502171 - RNA, 22 nt, Homo sapiens
gaaucaaucuuuaacaaccucu

SEQ ID NO: 502172 - RNA, 15 nt, Homo sapiens
gaaugagacuuacuu

SEQ ID NO: 502173 - RNA, 24 nt, Homo sapiens
gacaacucauuuucauauuguaau

SEQ ID NO: 502174 - RNA, 20 nt, Homo sapiens
gacagcuccuggaccaggcc

SEQ ID NO: 502175 - RNA, 20 nt, Homo sapiens
gacagggcccuggagcucag

SEQ ID NO: 502176 - RNA, 20 nt, Homo sapiens
gacaguucccagagugggcu

SEQ ID NO: 502177 - RNA, 22 nt, Homo sapiens
gaccauuugacuguucaaugau

SEQ ID NO: 502178 - RNA, 12 nt, Homo sapiens
gaccuaccuccc

SEQ ID NO: 502179 - RNA, 20 nt, Homo sapiens
gaccuaccucccucccucuc

SEQ ID NO: 502180 - RNA, 21 nt, Homo sapiens
gacgucacccuccauucugca

SEQ ID NO: 502181 - RNA, 18 nt, Homo sapiens
gacuacuuguuguaucug

SEQ ID NO: 502182 - RNA, 20 nt, Homo sapiens
gacucuaacaguaguugcaa

SEQ ID NO: 502183 - RNA, 15 nt, Homo sapiens
gacugggcacugggg

SEQ ID NO: 502184 - RNA, 14 nt, Homo sapiens
gagaaacacuauuu

SEQ ID NO: 502185 - RNA, 13 nt, Homo sapiens
gagaaggaugggu

SEQ ID NO: 502186 - RNA, 21 nt, Homo sapiens
gagaagguuuaugggcauccu

SEQ ID NO: 502187 - RNA, 19 nt, Homo sapiens
gagaccccuuguugcacug

SEQ ID NO: 502188 - RNA, 21 nt, Homo sapiens
gagauaagguggcuucucacg

SEQ ID NO: 502189 - RNA, 21 nt, Homo sapiens
gagauucccaccuuccauagc

SEQ ID NO: 502190 - RNA, 12 nt, Homo sapiens
gagcaaacagaa

SEQ ID NO: 502191 - RNA, 20 nt, Homo sapiens
gagccuggggauuccagcug

SEQ ID NO: 502192 - RNA, 16 nt, Homo sapiens
gagccuugguguacag

SEQ ID NO: 502193 - RNA, 16 nt, Homo sapiens
gagccuuuggccagaa

SEQ ID NO: 502194 - RNA, 15 nt, Homo sapiens
gagcgccuggugcug

SEQ ID NO: 502195 - RNA, 19 nt, Homo sapiens
gagcuugcaugcuugcaua

SEQ ID NO: 502196 - RNA, 20 nt, Homo sapiens
gaggagauucccaccuucca

SEQ ID NO: 502197 - RNA, 22 nt, Homo sapiens
gaggauggacuaaaugaucucu

SEQ ID NO: 502198 - RNA, 23 nt, Homo sapiens
aaagauccccaaaacaggccagg

SEQ ID NO: 502199 - RNA, 14 nt, Homo sapiens
aaagaugagcuuuu

SEQ ID NO: 502200 - RNA, 12 nt, Homo sapiens
aaagcuuccuuc

SEQ ID NO: 502201 - RNA, 16 nt, Homo sapiens
aaaggcuaaaagggaa

SEQ ID NO: 502202 - RNA, 19 nt, Homo sapiens
aaauaaguggaaaccgugu

SEQ ID NO: 502203 - RNA, 19 nt, Homo sapiens
aaauaauaacaaucacaaa

SEQ ID NO: 502204 - RNA, 19 nt, Homo sapiens
aaauagcacacuuuuccac

SEQ ID NO: 502205 - RNA, 17 nt, Homo sapiens
aaauauauagaaugauc

SEQ ID NO: 502206 - RNA, 19 nt, Homo sapiens
aaaugacaagugagacaaa

SEQ ID NO: 502207 - RNA, 17 nt, Homo sapiens
aaaugcccccauucucc

SEQ ID NO: 502208 - RNA, 15 nt, Homo sapiens
aaauggguuuauuca

SEQ ID NO: 502209 - RNA, 18 nt, Homo sapiens
aaauguauaaauauacag

SEQ ID NO: 502210 - RNA, 13 nt, Homo sapiens
aaaugucaucuca

SEQ ID NO: 502211 - RNA, 16 nt, Homo sapiens
aaauguguaagaacaa

SEQ ID NO: 502212 - RNA, 12 nt, Homo sapiens
aaauguguaaua

SEQ ID NO: 502213 - RNA, 21 nt, Homo sapiens
aaauuaagaaauucacuuccc

SEQ ID NO: 502214 - RNA, 15 nt, Homo sapiens
aaauuagcugggcau

SEQ ID NO: 502215 - RNA, 11 nt, Homo sapiens
aaauugucaaa

SEQ ID NO: 502216 - RNA, 18 nt, Homo sapiens
aaauuuaaaacuguugga

SEQ ID NO: 502217 - RNA, 18 nt, Homo sapiens
aaauuuaauaccagauac

SEQ ID NO: 502218 - RNA, 13 nt, Homo sapiens
aacaaacagggcu

SEQ ID NO: 502219 - RNA, 21 nt, Homo sapiens
aacacacaggugcaacagacu

SEQ ID NO: 502220 - RNA, 14 nt, Homo sapiens
aacagagacugaau

SEQ ID NO: 502221 - RNA, 16 nt, Homo sapiens
aacagugagaaaccau

SEQ ID NO: 502222 - RNA, 18 nt, Homo sapiens
aacauuugcugccauuac

SEQ ID NO: 502223 - RNA, 14 nt, Homo sapiens
aaccacacuugaaa

SEQ ID NO: 502224 - RNA, 13 nt, Homo sapiens
aaccuacaguuuu

SEQ ID NO: 502225 - RNA, 20 nt, Homo sapiens
aacucaaauacacauuugcu

SEQ ID NO: 502226 - RNA, 19 nt, Homo sapiens
aacuggauugcagacuguu

SEQ ID NO: 502227 - RNA, 14 nt, Homo sapiens
aacuuauccaucuu

SEQ ID NO: 502228 - RNA, 21 nt, Homo sapiens
aacuuucaaaauauauuuuca

SEQ ID NO: 502229 - RNA, 23 nt, Homo sapiens
aacuuuuuaaagaagugcaugaa

SEQ ID NO: 502230 - RNA, 18 nt, Homo sapiens
aagaaaauuugccaaucu

SEQ ID NO: 502231 - RNA, 15 nt, Homo sapiens
aagaaccauugauuu

SEQ ID NO: 502232 - RNA, 17 nt, Homo sapiens
aagaaugagacugaacu

SEQ ID NO: 502233 - RNA, 18 nt, Homo sapiens
aagaccuauaaaucauua

SEQ ID NO: 502234 - RNA, 18 nt, Homo sapiens
aagagacauauacuaaga

SEQ ID NO: 502235 - RNA, 17 nt, Homo sapiens
aagagccuaacaucucc

SEQ ID NO: 502236 - RNA, 20 nt, Homo sapiens
aagaugcaucaucucuuccu

SEQ ID NO: 502237 - RNA, 18 nt, Homo sapiens
aagcauccaaguauauau

SEQ ID NO: 502238 - RNA, 17 nt, Homo sapiens
aagcuggagucugucaa

SEQ ID NO: 502239 - RNA, 14 nt, Homo sapiens
aaggaacugcauca

SEQ ID NO: 502240 - RNA, 13 nt, Homo sapiens
aaggaauuccucu

SEQ ID NO: 502241 - RNA, 15 nt, Homo sapiens
aaggaauuccucuau

SEQ ID NO: 502242 - RNA, 17 nt, Homo sapiens
aaggaauuccucuauga

SEQ ID NO: 502243 - RNA, 15 nt, Homo sapiens
aaggagcugauacuu

SEQ ID NO: 502244 - RNA, 16 nt, Homo sapiens
aaggcaggacagagaa

SEQ ID NO: 502245 - RNA, 14 nt, Homo sapiens
aaggcaguauuuca

SEQ ID NO: 502246 - RNA, 12 nt, Homo sapiens
aaggcucagacu

SEQ ID NO: 502247 - RNA, 20 nt, Homo sapiens
aaggcugugccaucagcucc

SEQ ID NO: 502248 - RNA, 14 nt, Homo sapiens
aagggcagcuguga

SEQ ID NO: 502249 - RNA, 15 nt, Homo sapiens
aagggcagcugugau

SEQ ID NO: 502250 - RNA, 17 nt, Homo sapiens
aagguacugguacuaua

SEQ ID NO: 502251 - RNA, 12 nt, Homo sapiens
aaggugaacuuu

SEQ ID NO: 502252 - RNA, 13 nt, Homo sapiens
aaguauauaugaa

SEQ ID NO: 502253 - RNA, 11 nt, Homo sapiens
aagucuuucau

SEQ ID NO: 502254 - RNA, 17 nt, Homo sapiens
aagugauaugcauuucc

SEQ ID NO: 502255 - RNA, 13 nt, Homo sapiens
aaguugugcuuga

SEQ ID NO: 502256 - RNA, 18 nt, Homo sapiens
aauaaagcaaugugguag

SEQ ID NO: 502257 - RNA, 22 nt, Homo sapiens
aauaaaugacaagugagacaaa

SEQ ID NO: 502258 - RNA, 14 nt, Homo sapiens
aauaacaaucacaa

SEQ ID NO: 502259 - RNA, 22 nt, Homo sapiens
aauaacuaugccagcaaccuug

SEQ ID NO: 502260 - RNA, 17 nt, Homo sapiens
aauaccauuuaguaaga

SEQ ID NO: 502261 - RNA, 17 nt, Homo sapiens
aauacuacuacuguuau

SEQ ID NO: 502262 - RNA, 21 nt, Homo sapiens
aauacucugcuauuucucuug

SEQ ID NO: 502263 - RNA, 22 nt, Homo sapiens
aauaguacagacagaaggugcu

SEQ ID NO: 502264 - RNA, 13 nt, Homo sapiens
aauaugaccauuu

SEQ ID NO: 502265 - RNA, 17 nt, Homo sapiens
aauaugaccauuugacu

SEQ ID NO: 502266 - RNA, 13 nt, Homo sapiens
aaucaaucuuuaa

SEQ ID NO: 502267 - RNA, 23 nt, Homo sapiens
aauccaucguauuaaaaaacaau

SEQ ID NO: 502268 - RNA, 21 nt, Homo sapiens
aauccccacaggcacauuaac

SEQ ID NO: 502269 - RNA, 18 nt, Homo sapiens
aaugaaaaaagucuccau

SEQ ID NO: 502270 - RNA, 14 nt, Homo sapiens
aaugaauaaaguau

SEQ ID NO: 502271 - RNA, 16 nt, Homo sapiens
aaugcuaugacuguau

SEQ ID NO: 502272 - RNA, 16 nt, Homo sapiens
aauggacaaaauccau

SEQ ID NO: 502273 - RNA, 19 nt, Homo sapiens
aauggacaaaauccaugaa

SEQ ID NO: 502274 - RNA, 19 nt, Homo sapiens
aaugucauuaaacaugaca

SEQ ID NO: 502275 - RNA, 12 nt, Homo sapiens
aaugugacucag

SEQ ID NO: 502276 - RNA, 13 nt, Homo sapiens
aaugugacucagc

SEQ ID NO: 502277 - RNA, 15 nt, Homo sapiens
aaugugcucaugcau

SEQ ID NO: 502278 - RNA, 21 nt, Homo sapiens
aauguuuuagaaugagacuua

SEQ ID NO: 502279 - RNA, 11 nt, Homo sapiens
aauuaccaugc

SEQ ID NO: 502280 - RNA, 17 nt, Homo sapiens
aauucuuagucacaaaa

SEQ ID NO: 502281 - RNA, 15 nt, Homo sapiens
aauugcauacuuugu

SEQ ID NO: 502282 - RNA, 20 nt, Homo sapiens
aauuuguauaugacugcauu

SEQ ID NO: 502283 - RNA, 20 nt, Homo sapiens
acaacagguaaaacagggcc

SEQ ID NO: 502284 - RNA, 19 nt, Homo sapiens
acaagcuguaucacugccu

SEQ ID NO: 502285 - RNA, 16 nt, Homo sapiens
acaaguaaaacugugg

SEQ ID NO: 502286 - RNA, 17 nt, Homo sapiens
acaauaaagcaaugugg

SEQ ID NO: 502287 - RNA, 21 nt, Homo sapiens
acaauauuccagaucuuucag

SEQ ID NO: 502288 - RNA, 17 nt, Homo sapiens
acaaucuuugcuguaua

SEQ ID NO: 502289 - RNA, 23 nt, Homo sapiens
acaaucuuugcuguauacuuuua

SEQ ID NO: 502290 - RNA, 15 nt, Homo sapiens
acaauuaacugcccu

SEQ ID NO: 502291 - RNA, 16 nt, Homo sapiens
acacacacgaugcauu

SEQ ID NO: 502292 - RNA, 19 nt, Homo sapiens
acacacacgaugcauuuaa

SEQ ID NO: 502293 - RNA, 12 nt, Homo sapiens
acacacaguacg

SEQ ID NO: 502294 - RNA, 14 nt, Homo sapiens
acacugaucuggcu

SEQ ID NO: 502295 - RNA, 18 nt, Homo sapiens
acacuuuuccacauucca

SEQ ID NO: 502296 - RNA, 18 nt, Homo sapiens
acagauguuguaagagaa

SEQ ID NO: 502297 - RNA, 14 nt, Homo sapiens
acagcaaacaggug

SEQ ID NO: 502298 - RNA, 15 nt, Homo sapiens
acagcuguaauaaca

SEQ ID NO: 502299 - RNA, 20 nt, Homo sapiens
acagggcgagacucugucuc

SEQ ID NO: 502300 - RNA, 16 nt, Homo sapiens
acagguaaaacagggc

SEQ ID NO: 502301 - RNA, 15 nt, Homo sapiens
acaguaguugcaaug

SEQ ID NO: 502302 - RNA, 15 nt, Homo sapiens
acagugagaaaccau

SEQ ID NO: 502303 - RNA, 18 nt, Homo sapiens
acaguuuuugacauuuau

SEQ ID NO: 502304 - RNA, 17 nt, Homo sapiens
acauaaaaguuggcuca

SEQ ID NO: 502305 - RNA, 23 nt, Homo sapiens
acaugcaaagauccccaaaacag

SEQ ID NO: 502306 - RNA, 14 nt, Homo sapiens
acauuaaacacaaa

SEQ ID NO: 502307 - RNA, 22 nt, Homo sapiens
ucagccugcuuuccugcagcag

SEQ ID NO: 502308 - RNA, 11 nt, Homo sapiens
ucagcuuuauu

SEQ ID NO: 502309 - RNA, 20 nt, Homo sapiens
ucaguguugccucuugcaau

SEQ ID NO: 502310 - RNA, 21 nt, Homo sapiens
ucaguguugccucuugcaaug

SEQ ID NO: 502311 - RNA, 23 nt, Homo sapiens
ucaguuccaaacagacaaaacag

SEQ ID NO: 502312 - RNA, 13 nt, Homo sapiens
ucaucacuuugac

SEQ ID NO: 502313 - RNA, 16 nt, Homo sapiens
gagggaaaacagaaaa

SEQ ID NO: 502314 - RNA, 16 nt, Homo sapiens
gaguguauaugaauga

SEQ ID NO: 502315 - RNA, 21 nt, Homo sapiens
gaguucauggauauguuauac

SEQ ID NO: 502316 - RNA, 14 nt, Homo sapiens
gauaccauaugaau

SEQ ID NO: 502317 - RNA, 20 nt, Homo sapiens
gaucaaugcauguuacccau

SEQ ID NO: 502318 - RNA, 17 nt, Homo sapiens
gaucaguugaggccagg

SEQ ID NO: 502319 - RNA, 18 nt, Homo sapiens
gaugaaacaucauuucaa

SEQ ID NO: 502320 - RNA, 14 nt, Homo sapiens
gaugaaacuucuca

SEQ ID NO: 502321 - RNA, 22 nt, Homo sapiens
gaugcaucaucucuuccucaca

SEQ ID NO: 502322 - RNA, 17 nt, Homo sapiens
gaugcuggggacacagc

SEQ ID NO: 502323 - RNA, 16 nt, Homo sapiens
acacagcaucagcuca

SEQ ID NO: 502324 - RNA, 18 nt, Homo sapiens
acacauucuuauugacaa

SEQ ID NO: 502325 - RNA, 20 nt, Homo sapiens
acacgaugcauuuaauaaag

SEQ ID NO: 502326 - RNA, 14 nt, Homo sapiens
acacuuuuccacau

SEQ ID NO: 502327 - RNA, 18 nt, Homo sapiens
acagaccaccuuucacaa

SEQ ID NO: 502328 - RNA, 22 nt, Homo sapiens
acagcuguaguaccccaagaag

SEQ ID NO: 502329 - RNA, 15 nt, Homo sapiens
acagggagugcacau

SEQ ID NO: 502330 - RNA, 18 nt, Homo sapiens
acagguuauaacaguguu

SEQ ID NO: 502331 - RNA, 14 nt, Homo sapiens
acaguuuuaacugu

SEQ ID NO: 502332 - RNA, 17 nt, Homo sapiens
acaguuuuaacugugga

SEQ ID NO: 502333 - RNA, 12 nt, Homo sapiens
acaucuccaugg

SEQ ID NO: 502334 - RNA, 10 nt, Homo sapiens
acauguuaau

SEQ ID NO: 502335 - RNA, 23 nt, Homo sapiens
acauguuaaugacaauauuccag

SEQ ID NO: 502336 - RNA, 23 nt, Homo sapiens
acauuaaacacaaagcuguugaa

SEQ ID NO: 502337 - RNA, 16 nt, Homo sapiens
acauuucuucuaguga

SEQ ID NO: 502338 - RNA, 18 nt, Homo sapiens
acauuuguuuguggucua

SEQ ID NO: 502339 - RNA, 16 nt, Homo sapiens
acauuuuuguacuaac

SEQ ID NO: 502340 - RNA, 18 nt, Homo sapiens
accaggggccaaccucag

SEQ ID NO: 502341 - RNA, 13 nt, Homo sapiens
accaggucucaua

SEQ ID NO: 502342 - RNA, 16 nt, Homo sapiens
accagguuugcaggag

SEQ ID NO: 502343 - RNA, 13 nt, Homo sapiens
accauaugaauga

SEQ ID NO: 502344 - RNA, 14 nt, Homo sapiens
accaugcuucacaa

SEQ ID NO: 502345 - RNA, 12 nt, Homo sapiens
accauguggcaa

SEQ ID NO: 502346 - RNA, 15 nt, Homo sapiens
accauuugacuguuc

SEQ ID NO: 502347 - RNA, 21 nt, Homo sapiens
acccaauggaaaauauaauga

SEQ ID NO: 502348 - RNA, 18 nt, Homo sapiens
accccuuguugcacugcc

SEQ ID NO: 502349 - RNA, 21 nt, Homo sapiens
accuaaauaugagcccagaaa

SEQ ID NO: 502350 - RNA, 13 nt, Homo sapiens
accuauaaaucau

SEQ ID NO: 502351 - RNA, 17 nt, Homo sapiens
accuggggacuccucaa

SEQ ID NO: 502352 - RNA, 19 nt, Homo sapiens
accuggucugguugggcag

SEQ ID NO: 502353 - RNA, 16 nt, Homo sapiens
accugugcugaacaua

SEQ ID NO: 502354 - RNA, 22 nt, Homo sapiens
accuugucccuugucaguucca

SEQ ID NO: 502355 - RNA, 21 nt, Homo sapiens
acgaaaugcuaugacuguauc

SEQ ID NO: 502356 - RNA, 19 nt, Homo sapiens
acgaagaguucccuugaaa

SEQ ID NO: 502357 - RNA, 19 nt, Homo sapiens
acgcggcuuuaagugugcu

SEQ ID NO: 502358 - RNA, 21 nt, Homo sapiens
acgcucuccucgagcccuccc

SEQ ID NO: 502359 - RNA, 23 nt, Homo sapiens
acuaacucaaauacacauuugcu

SEQ ID NO: 502360 - RNA, 18 nt, Homo sapiens
acuaagagaaugugcuca

SEQ ID NO: 502361 - RNA, 13 nt, Homo sapiens
acuaagauguuca

SEQ ID NO: 502362 - RNA, 18 nt, Homo sapiens
acucaaauacacauuugc

SEQ ID NO: 502363 - RNA, 23 nt, Homo sapiens
acucacugcugcaaauacuguau

SEQ ID NO: 502364 - RNA, 12 nt, Homo sapiens
acucagcaucac

SEQ ID NO: 502365 - RNA, 23 nt, Homo sapiens
acucauagcgggggccuaaaaaa

SEQ ID NO: 502366 - RNA, 15 nt, Homo sapiens
acucauuuacacagu

SEQ ID NO: 502367 - RNA, 14 nt, Homo sapiens
acuccugcuuaauc

SEQ ID NO: 502368 - RNA, 18 nt, Homo sapiens
acuccugggacacuccgu

SEQ ID NO: 502369 - RNA, 14 nt, Homo sapiens
acucgcuagcacuc

SEQ ID NO: 502370 - RNA, 20 nt, Homo sapiens
acucucccuuguacagccuu

SEQ ID NO: 502371 - RNA, 16 nt, Homo sapiens
acugaaccaggccaga

SEQ ID NO: 502372 - RNA, 20 nt, Homo sapiens
acugcacuccaaucugggug

SEQ ID NO: 502373 - RNA, 19 nt, Homo sapiens
acugggcgcaguuggucuu

SEQ ID NO: 502374 - RNA, 13 nt, Homo sapiens
acuggggccucag

SEQ ID NO: 502375 - RNA, 14 nt, Homo sapiens
acuguaacuacuuc

SEQ ID NO: 502376 - RNA, 15 nt, Homo sapiens
acugugucucaugga

SEQ ID NO: 502377 - RNA, 10 nt, Homo sapiens
acuguugaaa

SEQ ID NO: 502378 - RNA, 20 nt, Homo sapiens
acuucucucaucugggcaaa

SEQ ID NO: 502379 - RNA, 15 nt, Homo sapiens
acuucugacuacuug

SEQ ID NO: 502380 - RNA, 23 nt, Homo sapiens
acuucugcaacaagcaugcagcu

SEQ ID NO: 502381 - RNA, 21 nt, Homo sapiens
acuugaaagaaauggugaaug

SEQ ID NO: 502382 - RNA, 15 nt, Homo sapiens
acuuuggaggacaau

SEQ ID NO: 502383 - RNA, 15 nt, Homo sapiens
acuuuguauuuugau

SEQ ID NO: 502384 - RNA, 14 nt, Homo sapiens
agaaagcaaacuua

SEQ ID NO: 502385 - RNA, 17 nt, Homo sapiens
agaaauuaccuguggau

SEQ ID NO: 502386 - RNA, 20 nt, Homo sapiens
agaacuagccaaaccaggac

SEQ ID NO: 502387 - RNA, 19 nt, Homo sapiens
agaacuucagcauuguaau

SEQ ID NO: 502388 - RNA, 16 nt, Homo sapiens
agaagaaaauuugcca

SEQ ID NO: 502389 - RNA, 17 nt, Homo sapiens
agaagaaaauuugccaa

SEQ ID NO: 502390 - RNA, 18 nt, Homo sapiens
agaagguugagggcaaug

SEQ ID NO: 502391 - RNA, 20 nt, Homo sapiens
agacccuccuauucuauaaa

SEQ ID NO: 502392 - RNA, 18 nt, Homo sapiens
agaccuguguuacuaaaa

SEQ ID NO: 502393 - RNA, 17 nt, Homo sapiens
agacucugucuaccugg

SEQ ID NO: 502394 - RNA, 18 nt, Homo sapiens
agacucugucuaccuggu

SEQ ID NO: 502395 - RNA, 16 nt, Homo sapiens
agagaaccugugggcu

SEQ ID NO: 502396 - RNA, 17 nt, Homo sapiens
agagauaagucuuucau

SEQ ID NO: 502397 - RNA, 18 nt, Homo sapiens
agagccccacuugacacu

SEQ ID NO: 502398 - RNA, 18 nt, Homo sapiens
agagccuaacaucuccau

SEQ ID NO: 502399 - RNA, 13 nt, Homo sapiens
agagcuuuaccua

SEQ ID NO: 502400 - RNA, 20 nt, Homo sapiens
agaggaaccaauaccuucaa

SEQ ID NO: 502401 - RNA, 18 nt, Homo sapiens
agaggcucuaauguacaa

SEQ ID NO: 502402 - RNA, 19 nt, Homo sapiens
agaggcucuaauguacaau

SEQ ID NO: 502403 - RNA, 17 nt, Homo sapiens
agaguguauaugaauga

SEQ ID NO: 502404 - RNA, 22 nt, Homo sapiens
agauacacaaucugaaacagcu

SEQ ID NO: 502405 - RNA, 21 nt, Homo sapiens
agauauguauucuuuucucag

SEQ ID NO: 502406 - RNA, 19 nt, Homo sapiens
agaugaaacaucauuucaa

SEQ ID NO: 502407 - RNA, 23 nt, Homo sapiens
agauguuguaagagaagguuuau

SEQ ID NO: 502408 - RNA, 12 nt, Homo sapiens
agauguuuauuu

SEQ ID NO: 502409 - RNA, 20 nt, Homo sapiens
agauugacuaacucaaauac

SEQ ID NO: 502410 - RNA, 13 nt, Homo sapiens
agcaaugugguag

SEQ ID NO: 502411 - RNA, 15 nt, Homo sapiens
agcacacuuuuccac

SEQ ID NO: 502412 - RNA, 16 nt, Homo sapiens
agcacacuuuuccaca

SEQ ID NO: 502413 - RNA, 20 nt, Homo sapiens
agcauccaaguauauaugaa

SEQ ID NO: 502414 - RNA, 22 nt, Homo sapiens
agccaauagaguugggacaauu

SEQ ID NO: 502415 - RNA, 16 nt, Homo sapiens
agccagaggcucuaau

SEQ ID NO: 502416 - RNA, 17 nt, Homo sapiens
agccccagccuaggaaa

SEQ ID NO: 502417 - RNA, 12 nt, Homo sapiens
agccugcucccu

SEQ ID NO: 502418 - RNA, 16 nt, Homo sapiens
agccuggggauuccag

SEQ ID NO: 502419 - RNA, 13 nt, Homo sapiens
agcgcacagggag

SEQ ID NO: 502420 - RNA, 14 nt, Homo sapiens
agcuggagucuguc

SEQ ID NO: 502421 - RNA, 22 nt, Homo sapiens
agcuggagucugucaauguccu

SEQ ID NO: 502422 - RNA, 14 nt, Homo sapiens
agcuggcucuguga

SEQ ID NO: 502423 - RNA, 19 nt, Homo sapiens
agcugugcgcaauugcuca

SEQ ID NO: 502424 - RNA, 14 nt, Homo sapiens
agcuucacaguacc

SEQ ID NO: 502425 - RNA, 22 nt, Homo sapiens
agcuuuagugaauuaaauuuag

SEQ ID NO: 502426 - RNA, 24 nt, Homo sapiens
agcuuuuuauucuacuacuuggaa

SEQ ID NO: 502427 - RNA, 15 nt, Homo sapiens
aggaacaaacagggc

SEQ ID NO: 502428 - RNA, 16 nt, Homo sapiens
aggagaguguauauga

SEQ ID NO: 502429 - RNA, 23 nt, Homo sapiens
aggagguccuuaggccucugaga

SEQ ID NO: 502430 - RNA, 12 nt, Homo sapiens
aggauaacacaa

SEQ ID NO: 502431 - RNA, 17 nt, Homo sapiens
aggauauuugcacuauu

SEQ ID NO: 502432 - RNA, 21 nt, Homo sapiens
aggcaggaacaaacagggcug

SEQ ID NO: 502433 - RNA, 16 nt, Homo sapiens
aguugcaauguuuuag

SEQ ID NO: 502434 - RNA, 15 nt, Homo sapiens
aguuuggauguugua

SEQ ID NO: 502435 - RNA, 16 nt, Homo sapiens
aguuuucggaaacacu

SEQ ID NO: 502436 - RNA, 14 nt, Homo sapiens
auaaagcaaugugg

SEQ ID NO: 502437 - RNA, 19 nt, Homo sapiens
auaaaucagccuaaauguc

SEQ ID NO: 502438 - RNA, 19 nt, Homo sapiens
auaaaugacaagugagaca

SEQ ID NO: 502439 - RNA, 16 nt, Homo sapiens
auaaauguaccagaga

SEQ ID NO: 502440 - RNA, 14 nt, Homo sapiens
auaaaugugacuca

SEQ ID NO: 502441 - RNA, 14 nt, Homo sapiens
auaaauucuacucu

SEQ ID NO: 502442 - RNA, 13 nt, Homo sapiens
auaacaaucacaa

SEQ ID NO: 502443 - RNA, 21 nt, Homo sapiens
auaacuggauugcagacuguu

SEQ ID NO: 502444 - RNA, 21 nt, Homo sapiens
auaagacuacugaaucugcua

SEQ ID NO: 502445 - RNA, 21 nt, Homo sapiens
auaaugucauuaaacaugaca

SEQ ID NO: 502446 - RNA, 14 nt, Homo sapiens
auacccagugaugu

SEQ ID NO: 502447 - RNA, 20 nt, Homo sapiens
auacuuauagaauucaguca

SEQ ID NO: 502448 - RNA, 15 nt, Homo sapiens
auagaacacaguuug

SEQ ID NO: 502449 - RNA, 15 nt, Homo sapiens
auagaauucagucaa

SEQ ID NO: 502450 - RNA, 18 nt, Homo sapiens
auagucccagcuacccag

SEQ ID NO: 502451 - RNA, 17 nt, Homo sapiens
auaguguagcugaggag

SEQ ID NO: 502452 - RNA, 16 nt, Homo sapiens
auaguuugaauucagu

SEQ ID NO: 502453 - RNA, 14 nt, Homo sapiens
auaucacauuccca

SEQ ID NO: 502454 - RNA, 13 nt, Homo sapiens
auaugaaugaaua

SEQ ID NO: 502455 - RNA, 19 nt, Homo sapiens
auauuuugaaaugaacuuu

SEQ ID NO: 502456 - RNA, 19 nt, Homo sapiens
auauuuuuuuaacugugau

SEQ ID NO: 502457 - RNA, 14 nt, Homo sapiens
aucaaucuuuaaca

SEQ ID NO: 502458 - RNA, 16 nt, Homo sapiens
auccaccccaccccau

SEQ ID NO: 502459 - RNA, 14 nt, Homo sapiens
aucccgucuuccag

SEQ ID NO: 502460 - RNA, 21 nt, Homo sapiens
auccuccuucuccuguuccau

SEQ ID NO: 502461 - RNA, 23 nt, Homo sapiens
aucgcugcgauacuggcauuucc

SEQ ID NO: 502462 - RNA, 15 nt, Homo sapiens
aucuauugcucauca

SEQ ID NO: 502463 - RNA, 17 nt, Homo sapiens
aucucaaugaaccauaa

SEQ ID NO: 502464 - RNA, 16 nt, Homo sapiens
aucucucccacuuccu

SEQ ID NO: 502465 - RNA, 13 nt, Homo sapiens
aucugaacuccuu

SEQ ID NO: 502466 - RNA, 17 nt, Homo sapiens
aucugaaugcuauacug

SEQ ID NO: 502467 - RNA, 13 nt, Homo sapiens
aucugcuggauau

SEQ ID NO: 502468 - RNA, 17 nt, Homo sapiens
aucugggugacugagca

SEQ ID NO: 502469 - RNA, 22 nt, Homo sapiens
aucuugauaucucgaacuuuca

SEQ ID NO: 502470 - RNA, 21 nt, Homo sapiens
augaagaucuuuauauuucaa

SEQ ID NO: 502471 - RNA, 17 nt, Homo sapiens
augacuguaucuugaua

SEQ ID NO: 502472 - RNA, 13 nt, Homo sapiens
augaguugguucu

SEQ ID NO: 502473 - RNA, 12 nt, Homo sapiens
augaguuugaca

SEQ ID NO: 502474 - RNA, 16 nt, Homo sapiens
augcaaacaaaaucca

SEQ ID NO: 502475 - RNA, 13 nt, Homo sapiens
augcagcuuugca

SEQ ID NO: 502476 - RNA, 20 nt, Homo sapiens
augccucccugggccaccuc

SEQ ID NO: 502477 - RNA, 13 nt, Homo sapiens
augcuauacugga

SEQ ID NO: 502478 - RNA, 20 nt, Homo sapiens
augcuauacuggauacucug

SEQ ID NO: 502479 - RNA, 18 nt, Homo sapiens
augcuggggacacagcau

SEQ ID NO: 502480 - RNA, 20 nt, Homo sapiens
augcuggggacacagcauca

SEQ ID NO: 502481 - RNA, 16 nt, Homo sapiens
auggaccagaagccaa

SEQ ID NO: 502482 - RNA, 23 nt, Homo sapiens
auggaccugccccggaccuaccu

SEQ ID NO: 502483 - RNA, 20 nt, Homo sapiens
auggauuuuucuuuaacugc

SEQ ID NO: 502484 - RNA, 12 nt, Homo sapiens
auggcagggaua

SEQ ID NO: 502485 - RNA, 16 nt, Homo sapiens
augggauauuuugaaa

SEQ ID NO: 502486 - RNA, 15 nt, Homo sapiens
augggugcagacccu

SEQ ID NO: 502487 - RNA, 17 nt, Homo sapiens
augguagggagcauuug

SEQ ID NO: 502488 - RNA, 17 nt, Homo sapiens
auguacaauaaagcaau

SEQ ID NO: 502489 - RNA, 20 nt, Homo sapiens
auguagaggcuuguuuaccu

SEQ ID NO: 502490 - RNA, 13 nt, Homo sapiens
augugcucaugca

SEQ ID NO: 502491 - RNA, 16 nt, Homo sapiens
augugcucaugcauug

SEQ ID NO: 502492 - RNA, 21 nt, Homo sapiens
auguggucuaagguucagccu

SEQ ID NO: 502493 - RNA, 22 nt, Homo sapiens
auguguaagaacaacuaccuga

SEQ ID NO: 502494 - RNA, 14 nt, Homo sapiens
auuaauguuuucaa

SEQ ID NO: 502495 - RNA, 12 nt, Homo sapiens
auuaccuucuau

SEQ ID NO: 502496 - RNA, 14 nt, Homo sapiens
auuauaacuguaaa

SEQ ID NO: 502497 - RNA, 20 nt, Homo sapiens
auuauaccuggaugauucag

SEQ ID NO: 502498 - RNA, 16 nt, Homo sapiens
auuaugcagacaaccu

SEQ ID NO: 502499 - RNA, 17 nt, Homo sapiens
auucaaagagacauaua

SEQ ID NO: 502500 - RNA, 22 nt, Homo sapiens
auucaacugccauguuuugcca

SEQ ID NO: 502501 - RNA, 14 nt, Homo sapiens
auucagcaugucca

SEQ ID NO: 502502 - RNA, 15 nt, Homo sapiens
auucccaccuuccau

SEQ ID NO: 502503 - RNA, 15 nt, Homo sapiens
auucuacuacuugga

SEQ ID NO: 502504 - RNA, 17 nt, Homo sapiens
auucucccuuucacuaa

SEQ ID NO: 502505 - RNA, 15 nt, Homo sapiens
auucucuagucaguu

SEQ ID NO: 502506 - RNA, 15 nt, Homo sapiens
auugaacagcuguga

SEQ ID NO: 502507 - RNA, 12 nt, Homo sapiens
auugaacuuucc

SEQ ID NO: 502508 - RNA, 14 nt, Homo sapiens
auugaauaggauca

SEQ ID NO: 502509 - RNA, 14 nt, Homo sapiens
auugcauacuuugu

SEQ ID NO: 502510 - RNA, 21 nt, Homo sapiens
auugcuguccuggaggggcug

SEQ ID NO: 502511 - RNA, 22 nt, Homo sapiens
auuuacacagugcuuuccagcc

SEQ ID NO: 502512 - RNA, 14 nt, Homo sapiens
auuuacaguuucca

SEQ ID NO: 502513 - RNA, 22 nt, Homo sapiens
auuucaaaguuuuguuguacuu

SEQ ID NO: 502514 - RNA, 20 nt, Homo sapiens
auuuccauugcuuauuaugu

SEQ ID NO: 502515 - RNA, 15 nt, Homo sapiens
auuuuguauguuaaa

SEQ ID NO: 502516 - RNA, 18 nt, Homo sapiens
auuuuugugaaguauuca

SEQ ID NO: 502517 - RNA, 18 nt, Homo sapiens
auuuuuuugcaugcaugc

SEQ ID NO: 502518 - RNA, 23 nt, Homo sapiens
caaaacgaaaugcuaugacugua

SEQ ID NO: 502519 - RNA, 14 nt, Homo sapiens
caaaacuccaggca

SEQ ID NO: 502520 - RNA, 18 nt, Homo sapiens
caaaagggcagcugugau

SEQ ID NO: 502521 - RNA, 18 nt, Homo sapiens
caaaaguguugacugugu

SEQ ID NO: 502522 - RNA, 13 nt, Homo sapiens
caaaccacuugcc

SEQ ID NO: 502523 - RNA, 23 nt, Homo sapiens
caaacugcuuuuuccaacucaga

SEQ ID NO: 502524 - RNA, 13 nt, Homo sapiens
caaagaccaccuc

SEQ ID NO: 502525 - RNA, 14 nt, Homo sapiens
caaagaccaccucc

SEQ ID NO: 502526 - RNA, 15 nt, Homo sapiens
caaagaccaccucca

SEQ ID NO: 502527 - RNA, 20 nt, Homo sapiens
caaaugcauacaaguuucau

SEQ ID NO: 502528 - RNA, 16 nt, Homo sapiens
caaaugccugacucag

SEQ ID NO: 502529 - RNA, 21 nt, Homo sapiens
caaaugccugacucagugacc

SEQ ID NO: 502530 - RNA, 23 nt, Homo sapiens
caacaauccuucuauucuagccu

SEQ ID NO: 502531 - RNA, 13 nt, Homo sapiens
caacagacuugaa

SEQ ID NO: 502532 - RNA, 17 nt, Homo sapiens
caacauuaaacacaaag

SEQ ID NO: 502533 - RNA, 22 nt, Homo sapiens
caagacagugccuauacugccu

SEQ ID NO: 502534 - RNA, 15 nt, Homo sapiens
caagcauucuguuua

SEQ ID NO: 502535 - RNA, 19 nt, Homo sapiens
caauauauacuuauagaau

SEQ ID NO: 502536 - RNA, 22 nt, Homo sapiens
caauauauacuuauagaauuca

SEQ ID NO: 502537 - RNA, 17 nt, Homo sapiens
caaucccucuccacucu

SEQ ID NO: 502538 - RNA, 21 nt, Homo sapiens
caaucugaaacagcuucaugg

SEQ ID NO: 502539 - RNA, 23 nt, Homo sapiens
caaugaaaaaagucuccauagga

SEQ ID NO: 502540 - RNA, 14 nt, Homo sapiens
caaugucuaaaaac

SEQ ID NO: 502541 - RNA, 17 nt, Homo sapiens
guucuaaggcugugcca

SEQ ID NO: 502542 - RNA, 16 nt, Homo sapiens
guucuguagagccaau

SEQ ID NO: 502543 - RNA, 18 nt, Homo sapiens
guugagggcaauggacaa

SEQ ID NO: 502544 - RNA, 18 nt, Homo sapiens
guuguaagagaagguuua

SEQ ID NO: 502545 - RNA, 13 nt, Homo sapiens
guuuaaagucuca

SEQ ID NO: 502546 - RNA, 22 nt, Homo sapiens
guuuacaaguaaauaguuugaa

SEQ ID NO: 502547 - RNA, 22 nt, Homo sapiens
guuuauuucaggcauuggauau

SEQ ID NO: 502548 - RNA, 19 nt, Homo sapiens
guuucuaaaguguuggcaa

SEQ ID NO: 502549 - RNA, 20 nt, Homo sapiens
guuucucaaagaugcguuug

SEQ ID NO: 502550 - RNA, 20 nt, Homo sapiens
guuugaaucugaaugcuaua

SEQ ID NO: 502551 - RNA, 15 nt, Homo sapiens
guuuugcuuaggcac

SEQ ID NO: 502552 - RNA, 16 nt, Homo sapiens
uaaaaaugucaucuca

SEQ ID NO: 502553 - RNA, 22 nt, Homo sapiens
uaaaacagguuauaacaguguu

SEQ ID NO: 502554 - RNA, 21 nt, Homo sapiens
uaaaacuauuuauugugcugg

SEQ ID NO: 502555 - RNA, 12 nt, Homo sapiens
uaaaaguucuca

SEQ ID NO: 502556 - RNA, 23 nt, Homo sapiens
uaaaaguuggcucaggagucuua

SEQ ID NO: 502557 - RNA, 14 nt, Homo sapiens
uaaaauaauaacaa

SEQ ID NO: 502558 - RNA, 13 nt, Homo sapiens
uaaaauuauuuca

SEQ ID NO: 502559 - RNA, 17 nt, Homo sapiens
uaaagaagugcaugaaa

SEQ ID NO: 502560 - RNA, 17 nt, Homo sapiens
uaaagacccuccuauuc

SEQ ID NO: 502561 - RNA, 16 nt, Homo sapiens
uaaagagaaguuccca

SEQ ID NO: 502562 - RNA, 13 nt, Homo sapiens
uaaauaguuugaa

SEQ ID NO: 502563 - RNA, 14 nt, Homo sapiens
uaaaugugacucag

SEQ ID NO: 502564 - RNA, 16 nt, Homo sapiens
uaaauucaacuuugua

SEQ ID NO: 502565 - RNA, 12 nt, Homo sapiens
uaaauugcauca

SEQ ID NO: 502566 - RNA, 21 nt, Homo sapiens
uaacacauuuuuuugcaugca

SEQ ID NO: 502567 - RNA, 17 nt, Homo sapiens
uaacacuguuaagagag

SEQ ID NO: 502568 - RNA, 15 nt, Homo sapiens
uaacuguacugaaua

SEQ ID NO: 502569 - RNA, 17 nt, Homo sapiens
uaagaagugacucuugc

SEQ ID NO: 502570 - RNA, 22 nt, Homo sapiens
uaauaaagaugaguugguucuc

SEQ ID NO: 502571 - RNA, 14 nt, Homo sapiens
uaauaacuuaucua

SEQ ID NO: 502572 - RNA, 21 nt, Homo sapiens
uaauguacaauaaagcaaugu

SEQ ID NO: 502573 - RNA, 15 nt, Homo sapiens
uaauuuaacuuucca

SEQ ID NO: 502574 - RNA, 17 nt, Homo sapiens
uaauuuccauaguguga

SEQ ID NO: 502575 - RNA, 12 nt, Homo sapiens
uaauuugcacug

SEQ ID NO: 502576 - RNA, 16 nt, Homo sapiens
uacaauaaagcaaugu

SEQ ID NO: 502577 - RNA, 21 nt, Homo sapiens
uacaauaaagcaaugugguag

SEQ ID NO: 502578 - RNA, 20 nt, Homo sapiens
uacacagugcuuuccagccu

SEQ ID NO: 502579 - RNA, 23 nt, Homo sapiens
uacagggcaaaagggcagcugug

SEQ ID NO: 502580 - RNA, 15 nt, Homo sapiens
uacauucaacagaga

SEQ ID NO: 502581 - RNA, 15 nt, Homo sapiens
uaccccaaacccauc

SEQ ID NO: 502582 - RNA, 16 nt, Homo sapiens
uaccuggaugauucag

SEQ ID NO: 502583 - RNA, 23 nt, Homo sapiens
uacuaagauguucacuguggcau

SEQ ID NO: 502584 - RNA, 18 nt, Homo sapiens
uacugccaaaacauuuau

SEQ ID NO: 502585 - RNA, 22 nt, Homo sapiens
uacuggauacucugcuccggaa

SEQ ID NO: 502586 - RNA, 14 nt, Homo sapiens
uacuuaguucaagc

SEQ ID NO: 502587 - RNA, 19 nt, Homo sapiens
uagaaauauagccaaaaau

SEQ ID NO: 502588 - RNA, 20 nt, Homo sapiens
uagaaugaucuauugcucau

SEQ ID NO: 502589 - RNA, 19 nt, Homo sapiens
uagagagggaaggucucag

SEQ ID NO: 502590 - RNA, 20 nt, Homo sapiens
uaguccccagccugcucccu

SEQ ID NO: 502591 - RNA, 13 nt, Homo sapiens
uagugacauuuaa

SEQ ID NO: 502592 - RNA, 23 nt, Homo sapiens
uauaaacuauaaccucuccuuca

SEQ ID NO: 502593 - RNA, 13 nt, Homo sapiens
uauaacaguguuu

SEQ ID NO: 502594 - RNA, 20 nt, Homo sapiens
uauaauuuccauagugugag

SEQ ID NO: 502595 - RNA, 19 nt, Homo sapiens
uauagaaugaucuauugcu

SEQ ID NO: 502596 - RNA, 18 nt, Homo sapiens
uaucaauuacaacaguga

SEQ ID NO: 502597 - RNA, 17 nt, Homo sapiens
uaugacuguaucuugau

SEQ ID NO: 502598 - RNA, 22 nt, Homo sapiens
uaugauuguccguaggcccaua

SEQ ID NO: 502599 - RNA, 22 nt, Homo sapiens
uauucuacuacuuggaaggaaa

SEQ ID NO: 502600 - RNA, 17 nt, Homo sapiens
uauuuacaguuuccaga

SEQ ID NO: 502601 - RNA, 13 nt, Homo sapiens
uauuuagaucuca

SEQ ID NO: 502602 - RNA, 20 nt, Homo sapiens
uauuuuuugaaucuaugaac

SEQ ID NO: 502603 - RNA, 12 nt, Homo sapiens
ucaaaaagggaa

SEQ ID NO: 502604 - RNA, 15 nt, Homo sapiens
ucaaaccacuugccu

SEQ ID NO: 502605 - RNA, 17 nt, Homo sapiens
ucaaagacuguauuuag

SEQ ID NO: 502606 - RNA, 20 nt, Homo sapiens
ucaaagcagcaggacugugg

SEQ ID NO: 502607 - RNA, 21 nt, Homo sapiens
ucaaauacacauuugcuacug

SEQ ID NO: 502608 - RNA, 22 nt, Homo sapiens
ucaaauacacauuugcuacugu

SEQ ID NO: 502609 - RNA, 10 nt, Homo sapiens
ucacaaagug

SEQ ID NO: 502610 - RNA, 13 nt, Homo sapiens
ucacacccauuua

SEQ ID NO: 502611 - RNA, 18 nt, Homo sapiens
ucacauuccucugcccuu

SEQ ID NO: 502612 - RNA, 23 nt, Homo sapiens
ucagaaaaccacuuuauugcaau

SEQ ID NO: 502613 - RNA, 16 nt, Homo sapiens
ucagaugacagauguu

SEQ ID NO: 502614 - RNA, 21 nt, Homo sapiens
ucaguacacccaguugccaaa

SEQ ID NO: 502615 - RNA, 23 nt, Homo sapiens
ucauaguaagugcgaagacugag

SEQ ID NO: 502616 - RNA, 13 nt, Homo sapiens
ucaucagugugua

SEQ ID NO: 502617 - RNA, 16 nt, Homo sapiens
ucauccaucacagauc

SEQ ID NO: 502618 - RNA, 13 nt, Homo sapiens
ucaucugggcaaa

SEQ ID NO: 502619 - RNA, 15 nt, Homo sapiens
ucauggauauguuau

SEQ ID NO: 502620 - RNA, 20 nt, Homo sapiens
ucauuggcauucuuugcaau

SEQ ID NO: 502621 - RNA, 21 nt, Homo sapiens
uccaaugacugagcagcaucc

SEQ ID NO: 502622 - RNA, 21 nt, Homo sapiens
uccacauggaaucaaucuuua

SEQ ID NO: 502623 - RNA, 19 nt, Homo sapiens
uccagccuggcuacagggc

SEQ ID NO: 502624 - RNA, 23 nt, Homo sapiens
uccagugaugugugagcuaugca

SEQ ID NO: 502625 - RNA, 18 nt, Homo sapiens
uccaucacguuagcuguc

SEQ ID NO: 502626 - RNA, 13 nt, Homo sapiens
uccauccauguac

SEQ ID NO: 502627 - RNA, 14 nt, Homo sapiens
uccaucucccuuag

SEQ ID NO: 502628 - RNA, 18 nt, Homo sapiens
uccaucuuugaacuucug

SEQ ID NO: 502629 - RNA, 19 nt, Homo sapiens
ucccacuuccuccuaccug

SEQ ID NO: 502630 - RNA, 23 nt, Homo sapiens
ucccuagccagaggcucuaaugu

SEQ ID NO: 502631 - RNA, 21 nt, Homo sapiens
ucccucuccacucuucucucc

SEQ ID NO: 502632 - RNA, 13 nt, Homo sapiens
ucccuuccuauuc

SEQ ID NO: 502633 - RNA, 21 nt, Homo sapiens
uccuaccuggggacuccucaa

SEQ ID NO: 502634 - RNA, 17 nt, Homo sapiens
uccucaaaccacuugcc

SEQ ID NO: 502635 - RNA, 19 nt, Homo sapiens
uccucaaaccacuugccug

SEQ ID NO: 502636 - RNA, 16 nt, Homo sapiens
uccucagaacaaugaa

SEQ ID NO: 502637 - RNA, 15 nt, Homo sapiens
uccuccccuguucau

SEQ ID NO: 502638 - RNA, 13 nt, Homo sapiens
uccucuuagcuca

SEQ ID NO: 502639 - RNA, 17 nt, Homo sapiens
uccuggaaucaguauuu

SEQ ID NO: 502640 - RNA, 19 nt, Homo sapiens
uccuggcagucucagucca

SEQ ID NO: 502641 - RNA, 17 nt, Homo sapiens
uccuucuccuguuccau

SEQ ID NO: 502642 - RNA, 20 nt, Homo sapiens
uccuuggcuucuuuacuuag

SEQ ID NO: 502643 - RNA, 16 nt, Homo sapiens
ucuaaauaugaaugaa

SEQ ID NO: 502644 - RNA, 14 nt, Homo sapiens
ucuaacauaccuug

SEQ ID NO: 502645 - RNA, 21 nt, Homo sapiens
ucuaaggcugugccaucagcu

SEQ ID NO: 502646 - RNA, 14 nt, Homo sapiens
ucuaauguacaaua

SEQ ID NO: 502647 - RNA, 18 nt, Homo sapiens
ucuacuacuuggaaggaa

SEQ ID NO: 502648 - RNA, 15 nt, Homo sapiens
ucuauccacacuguc

SEQ ID NO: 502649 - RNA, 17 nt, Homo sapiens
ucucauaaugcuuuguu

SEQ ID NO: 502650 - RNA, 13 nt, Homo sapiens
ucucauccaucac

SEQ ID NO: 502651 - RNA, 19 nt, Homo sapiens
ucucccacuuccuccuacc

SEQ ID NO: 502652 - RNA, 14 nt, Homo sapiens
ucucugcuaucuag

SEQ ID NO: 502653 - RNA, 21 nt, Homo sapiens
ucugaacaauauauacuuaua

SEQ ID NO: 502654 - RNA, 15 nt, Homo sapiens
ucugcuggugaauaa

SEQ ID NO: 502655 - RNA, 12 nt, Homo sapiens
ucuggauuucau

SEQ ID NO: 502656 - RNA, 20 nt, Homo sapiens
ucuggauuucauacuguaac

SEQ ID NO: 502657 - RNA, 22 nt, Homo sapiens
ucugguaauaaaugugacucag

SEQ ID NO: 502658 - RNA, 13 nt, Homo sapiens
ucugucuaccugg

SEQ ID NO: 502659 - RNA, 21 nt, Homo sapiens
ucuuaaacuaaaugugcaaua

SEQ ID NO: 502660 - RNA, 14 nt, Homo sapiens
ucuugccacugcac

SEQ ID NO: 502661 - RNA, 17 nt, Homo sapiens
ucuugucuuuuuccaaa

SEQ ID NO: 502662 - RNA, 13 nt, Homo sapiens
ugaaaagugugua

SEQ ID NO: 502663 - RNA, 14 nt, Homo sapiens
ugaaacaucauuuc

SEQ ID NO: 502664 - RNA, 13 nt, Homo sapiens
ugaaacguggaua

SEQ ID NO: 502665 - RNA, 20 nt, Homo sapiens
ugaaaucccugccucaggcc

SEQ ID NO: 502666 - RNA, 14 nt, Homo sapiens
ugaaaugaacuuug

SEQ ID NO: 502667 - RNA, 18 nt, Homo sapiens
ugaagccuaacucuugag

SEQ ID NO: 502668 - RNA, 15 nt, Homo sapiens
ugaauaacuaugcca

SEQ ID NO: 502669 - RNA, 12 nt, Homo sapiens
ugaaucuaugaa

SEQ ID NO: 502670 - RNA, 19 nt, Homo sapiens
ugaaugccuaugguggauc

SEQ ID NO: 502671 - RNA, 13 nt, Homo sapiens
ugacaagugagac

SEQ ID NO: 502672 - RNA, 15 nt, Homo sapiens
ugacaagugagacaa

SEQ ID NO: 502673 - RNA, 19 nt, Homo sapiens
ugacaauugggagcugcca

SEQ ID NO: 502674 - RNA, 21 nt, Homo sapiens
ugacccuaugggucuaggaca

SEQ ID NO: 502675 - RNA, 15 nt, Homo sapiens
ugacucagugaccag

SEQ ID NO: 502676 - RNA, 19 nt, Homo sapiens
ugagcagcauccaccccac

SEQ ID NO: 502677 - RNA, 13 nt, Homo sapiens
ugaggcaggagaa

SEQ ID NO: 502678 - RNA, 17 nt, Homo sapiens
ugaggccuagacucugu

SEQ ID NO: 502679 - RNA, 12 nt, Homo sapiens
ugauacuuugac

SEQ ID NO: 502680 - RNA, 18 nt, Homo sapiens
ugauacuuugacaguguu

SEQ ID NO: 502681 - RNA, 21 nt, Homo sapiens
ugaugcuggggacacagcauc

SEQ ID NO: 502682 - RNA, 23 nt, Homo sapiens
ugauuaggaauaugaccauuuga

SEQ ID NO: 502683 - RNA, 18 nt, Homo sapiens
ugauuauuuguauuuaca

SEQ ID NO: 502684 - RNA, 17 nt, Homo sapiens
ugcaaaacucauuuaca

SEQ ID NO: 502685 - RNA, 16 nt, Homo sapiens
ugcaaaacuccaggca

SEQ ID NO: 502686 - RNA, 15 nt, Homo sapiens
ugcaaagaccaccuc

SEQ ID NO: 502687 - RNA, 15 nt, Homo sapiens
ugcaacagacuugaa

SEQ ID NO: 502688 - RNA, 14 nt, Homo sapiens
ugcaauguuuuaga

SEQ ID NO: 502689 - RNA, 20 nt, Homo sapiens
ugcagacuguucuuacugua

SEQ ID NO: 502690 - RNA, 13 nt, Homo sapiens
ugcagcagucgcc

SEQ ID NO: 502691 - RNA, 15 nt, Homo sapiens
ugcagugagcugugu

SEQ ID NO: 502692 - RNA, 17 nt, Homo sapiens
ugccaaucuguacaaaa

SEQ ID NO: 502693 - RNA, 16 nt, Homo sapiens
ugcccccauucuccca

SEQ ID NO: 502694 - RNA, 18 nt, Homo sapiens
ugcccccauucucccagu

SEQ ID NO: 502695 - RNA, 15 nt, Homo sapiens
ugcccuuuccuggca

SEQ ID NO: 502696 - RNA, 17 nt, Homo sapiens
ugccugacucagugacc

SEQ ID NO: 502697 - RNA, 17 nt, Homo sapiens
ugccugugagcaugggg

SEQ ID NO: 502698 - RNA, 14 nt, Homo sapiens
ugccuucuggccuu

SEQ ID NO: 502699 - RNA, 17 nt, Homo sapiens
ugcuaccaaaacaguua

SEQ ID NO: 502700 - RNA, 17 nt, Homo sapiens
ugcuauacacacacaca

SEQ ID NO: 502701 - RNA, 13 nt, Homo sapiens
ugcuauacuggau

SEQ ID NO: 502702 - RNA, 12 nt, Homo sapiens
ugcuaucugggc

SEQ ID NO: 502703 - RNA, 14 nt, Homo sapiens
ugcuaugacuguau

SEQ ID NO: 502704 - RNA, 15 nt, Homo sapiens
ugcuccaucgcgcca

SEQ ID NO: 502705 - RNA, 14 nt, Homo sapiens
ugcucuugccaaaa

SEQ ID NO: 502706 - RNA, 17 nt, Homo sapiens
ugcugcaaauacuguau

SEQ ID NO: 502707 - RNA, 15 nt, Homo sapiens
ugcugccagcucuca

SEQ ID NO: 502708 - RNA, 19 nt, Homo sapiens
ugcugggccccaucuccac

SEQ ID NO: 502709 - RNA, 20 nt, Homo sapiens
ugcuggugaauaacuaugcc

SEQ ID NO: 502710 - RNA, 14 nt, Homo sapiens
ugcuuaauugcuga

SEQ ID NO: 502711 - RNA, 15 nt, Homo sapiens
ugcuugaacuaggcu

SEQ ID NO: 502712 - RNA, 23 nt, Homo sapiens
uggaccugccccggaccuaccuc

SEQ ID NO: 502713 - RNA, 22 nt, Homo sapiens
uggagaaaauggguuuauucac

SEQ ID NO: 502714 - RNA, 18 nt, Homo sapiens
uggagccauugaacagcu

SEQ ID NO: 502715 - RNA, 19 nt, Homo sapiens
uggaggcuggaugugcauu

SEQ ID NO: 502716 - RNA, 17 nt, Homo sapiens
uggauaagggaauaaua

SEQ ID NO: 502717 - RNA, 22 nt, Homo sapiens
uggaugauucaggagaguguau

SEQ ID NO: 502718 - RNA, 16 nt, Homo sapiens
uggauuauuccucaga

SEQ ID NO: 502719 - RNA, 17 nt, Homo sapiens
uggauugcagacuguuc

SEQ ID NO: 502720 - RNA, 22 nt, Homo sapiens
uggauuuaaaagccugcucaau

SEQ ID NO: 502721 - RNA, 11 nt, Homo sapiens
uggcagggaua

SEQ ID NO: 502722 - RNA, 23 nt, Homo sapiens
uggcuucagguuagugacauuua

SEQ ID NO: 502723 - RNA, 13 nt, Homo sapiens
uggcuucucacgg

SEQ ID NO: 502724 - RNA, 16 nt, Homo sapiens
ugggaaaacauuugcu

SEQ ID NO: 502725 - RNA, 14 nt, Homo sapiens
ugggagcugccaag

SEQ ID NO: 502726 - RNA, 19 nt, Homo sapiens
ugggaguuuagugugauaa

SEQ ID NO: 502727 - RNA, 12 nt, Homo sapiens
ugggcacugggg

SEQ ID NO: 502728 - RNA, 23 nt, Homo sapiens
ugggcugcccaccuggcugccaa

SEQ ID NO: 502729 - RNA, 22 nt, Homo sapiens
ugggcugugauuacugcaauca

SEQ ID NO: 502730 - RNA, 14 nt, Homo sapiens
uggggacuccucaa

SEQ ID NO: 502731 - RNA, 13 nt, Homo sapiens
uggggccauaaac

SEQ ID NO: 502732 - RNA, 14 nt, Homo sapiens
uggggccucaggcu

SEQ ID NO: 502733 - RNA, 20 nt, Homo sapiens
uggggcggguggggccauaa

SEQ ID NO: 502734 - RNA, 22 nt, Homo sapiens
uggguauaaaggcuaaaaggga

SEQ ID NO: 502735 - RNA, 18 nt, Homo sapiens
uuaaaacguguaaaugaa

SEQ ID NO: 502736 - RNA, 18 nt, Homo sapiens
uuaagaaauucacuuccc

SEQ ID NO: 502737 - RNA, 15 nt, Homo sapiens
uuaagcaugugaugu

SEQ ID NO: 502738 - RNA, 15 nt, Homo sapiens
uuacaacagugagaa

SEQ ID NO: 502739 - RNA, 15 nt, Homo sapiens
uuaccuccucauggc

SEQ ID NO: 502740 - RNA, 23 nt, Homo sapiens
uuacucuauacauucaacagaga

SEQ ID NO: 502741 - RNA, 16 nt, Homo sapiens
uuagagcuuuaccuaa

SEQ ID NO: 502742 - RNA, 13 nt, Homo sapiens
uuauaacaguguu

SEQ ID NO: 502743 - RNA, 15 nt, Homo sapiens
uuauaccuggaugau

SEQ ID NO: 502744 - RNA, 13 nt, Homo sapiens
uuauugacuaaca

SEQ ID NO: 502745 - RNA, 19 nt, Homo sapiens
uucaacaaagaaacaaaga

SEQ ID NO: 502746 - RNA, 22 nt, Homo sapiens
uucaacugccauguuuugccac

SEQ ID NO: 502747 - RNA, 17 nt, Homo sapiens
uucagagugacuacaca

SEQ ID NO: 502748 - RNA, 13 nt, Homo sapiens
uucagcaugucca

SEQ ID NO: 502749 - RNA, 20 nt, Homo sapiens
uucagguuagugacauuuaa

SEQ ID NO: 502750 - RNA, 12 nt, Homo sapiens
uucauacuguaa

SEQ ID NO: 502751 - RNA, 15 nt, Homo sapiens
uuccagaucuuucag

SEQ ID NO: 502752 - RNA, 23 nt, Homo sapiens
uuccucagaacaaugaaaaaagu

SEQ ID NO: 502753 - RNA, 13 nt, Homo sapiens
uuccuccuaccug

SEQ ID NO: 502754 - RNA, 13 nt, Homo sapiens
uuccugggaacau

SEQ ID NO: 502755 - RNA, 22 nt, Homo sapiens
uucuaacagugaaguuuuacug

SEQ ID NO: 502756 - RNA, 18 nt, Homo sapiens
uucugcuggugaauaacu

SEQ ID NO: 502757 - RNA, 18 nt, Homo sapiens
uugacaauugggagcugc

SEQ ID NO: 502758 - RNA, 21 nt, Homo sapiens
uugacaguuuuugacauuuau

SEQ ID NO: 502759 - RNA, 20 nt, Homo sapiens
uugagauucugaaguaugaa

SEQ ID NO: 502760 - RNA, 13 nt, Homo sapiens
uugcaauacugcu

SEQ ID NO: 502761 - RNA, 16 nt, Homo sapiens
uugcacuauuuccaca

SEQ ID NO: 502762 - RNA, 14 nt, Homo sapiens
uugcaugcuugcau

SEQ ID NO: 502763 - RNA, 17 nt, Homo sapiens
uugccaggacaugcaau

SEQ ID NO: 502764 - RNA, 16 nt, Homo sapiens
uugccucuugcaaugc

SEQ ID NO: 502765 - RNA, 14 nt, Homo sapiens
uugcucuugccaaa

SEQ ID NO: 502766 - RNA, 18 nt, Homo sapiens
uugcugauaccauaugaa

SEQ ID NO: 502767 - RNA, 23 nt, Homo sapiens
uuggaaggaaaaggaauuccucu

SEQ ID NO: 502768 - RNA, 20 nt, Homo sapiens
uuggggcuaauuuaacaaga

SEQ ID NO: 502769 - RNA, 15 nt, Homo sapiens
uugggggaaccagca

SEQ ID NO: 502770 - RNA, 22 nt, Homo sapiens
uugguguggguucauuggcauu

SEQ ID NO: 502771 - RNA, 18 nt, Homo sapiens
uugucuuuuuccaaaaaa

SEQ ID NO: 502772 - RNA, 13 nt, Homo sapiens
uuuaccacuccca

SEQ ID NO: 502773 - RNA, 16 nt, Homo sapiens
uuuauaaaaguguuca

SEQ ID NO: 502774 - RNA, 21 nt, Homo sapiens
uuuauaauacuacuacuguua

SEQ ID NO: 502775 - RNA, 13 nt, Homo sapiens
uuuauugcaaugc

SEQ ID NO: 502776 - RNA, 18 nt, Homo sapiens
uuuauuuacuucuguaug

SEQ ID NO: 502777 - RNA, 12 nt, Homo sapiens
uuucaaaggaua

SEQ ID NO: 502778 - RNA, 22 nt, Homo sapiens
uuucuacuaaaaauacaaaaau

SEQ ID NO: 502779 - RNA, 17 nt, Homo sapiens
uuugauaaugacacugu

SEQ ID NO: 502780 - RNA, 17 nt, Homo sapiens
uuugcaaagaccaccuc

SEQ ID NO: 502781 - RNA, 11 nt, Homo sapiens
uuugcugucuc

SEQ ID NO: 502782 - RNA, 18 nt, Homo sapiens
uuuggccaaaaccuuuca

SEQ ID NO: 502783 - RNA, 18 nt, Homo sapiens
uuugugaaguauucacaa

SEQ ID NO: 502784 - RNA, 19 nt, Homo sapiens
uuugugaaguauucacaaa

SEQ ID NO: 502785 - RNA, 16 nt, Homo sapiens
uuuuauucuacuacuu

SEQ ID NO: 502786 - RNA, 18 nt, Homo sapiens
uuuugguugggaaugagg

SEQ ID NO: 502787 - RNA, 13 nt, Homo sapiens
uuuuugacauuua

SEQ ID NO: 502788 - RNA, 18 nt, Homo sapiens
guaaauaauuugcacuga

SEQ ID NO: 502789 - RNA, 16 nt, Homo sapiens
guacaauaaagcaaug

SEQ ID NO: 502790 - RNA, 19 nt, Homo sapiens
guaccuccagucacacucc

SEQ ID NO: 502791 - RNA, 16 nt, Homo sapiens
guacugauggacuuaa

SEQ ID NO: 502792 - RNA, 15 nt, Homo sapiens
guauauaugaaugaa

SEQ ID NO: 502793 - RNA, 21 nt, Homo sapiens
guauuaaaaaacaauuaacug

SEQ ID NO: 502794 - RNA, 14 nt, Homo sapiens
guauuauacaugug

SEQ ID NO: 502795 - RNA, 19 nt, Homo sapiens
guauugaucaaugcauguu

SEQ ID NO: 502796 - RNA, 13 nt, Homo sapiens
guauuuagaucuc

SEQ ID NO: 502797 - RNA, 13 nt, Homo sapiens
gucaaagacugua

SEQ ID NO: 502798 - RNA, 23 nt, Homo sapiens
gucaauguccuacugagacagca

SEQ ID NO: 502799 - RNA, 14 nt, Homo sapiens
gucaguacuauuca

SEQ ID NO: 502800 - RNA, 14 nt, Homo sapiens
guccccagccugcu

SEQ ID NO: 502801 - RNA, 20 nt, Homo sapiens
gucccucuucucuccucagu

SEQ ID NO: 502802 - RNA, 19 nt, Homo sapiens
gucuccauaggacaggaag

SEQ ID NO: 502803 - RNA, 21 nt, Homo sapiens
gucucuaacauaccuugucau

SEQ ID NO: 502804 - RNA, 16 nt, Homo sapiens
gucuugucuuuuucca

SEQ ID NO: 502805 - RNA, 15 nt, Homo sapiens
gugaagucucugggu

SEQ ID NO: 502806 - RNA, 22 nt, Homo sapiens
gugaccagaaagcuucauccac

SEQ ID NO: 502807 - RNA, 20 nt, Homo sapiens
gugagugacaaagccucuga

SEQ ID NO: 502808 - RNA, 13 nt, Homo sapiens
gugccaucagcuc

SEQ ID NO: 502809 - RNA, 19 nt, Homo sapiens
gugcgaagacugagccaga

SEQ ID NO: 502810 - RNA, 21 nt, Homo sapiens
gugcuaauuuguuuuggauau

SEQ ID NO: 502811 - RNA, 15 nt, Homo sapiens
gugcuauacacacac

SEQ ID NO: 502812 - RNA, 14 nt, Homo sapiens
gugcuuacaggacc

SEQ ID NO: 502813 - RNA, 15 nt, Homo sapiens
gugcuugagccagga

SEQ ID NO: 502814 - RNA, 23 nt, Homo sapiens
gugcuuuccagccuuuggugcuu

SEQ ID NO: 502815 - RNA, 22 nt, Homo sapiens
guggaaguuaaagggcauuucc

SEQ ID NO: 502816 - RNA, 23 nt, Homo sapiens
guggacucuaacaguaguugcaa

SEQ ID NO: 502817 - RNA, 23 nt, Homo sapiens
guggagccauugaacagcuguga

SEQ ID NO: 502818 - RNA, 13 nt, Homo sapiens
gugguauggggcu

SEQ ID NO: 502819 - RNA, 20 nt, Homo sapiens
guguaaauaauuugcacuga

SEQ ID NO: 502820 - RNA, 17 nt, Homo sapiens
guguauaugaaugaaua

SEQ ID NO: 502821 - RNA, 18 nt, Homo sapiens
guguauaugaaugaauaa

SEQ ID NO: 502822 - RNA, 14 nt, Homo sapiens
gugugagcuaugca

SEQ ID NO: 502823 - RNA, 21 nt, Homo sapiens
guguguaaauaauuugcacug

SEQ ID NO: 502824 - RNA, 22 nt, Homo sapiens
guguguuaaaugggacuggagu

SEQ ID NO: 502825 - RNA, 15 nt, Homo sapiens
guuaaauaggcuuga

SEQ ID NO: 502826 - RNA, 13 nt, Homo sapiens
guuacccauucaa

SEQ ID NO: 502827 - RNA, 22 nt, Homo sapiens
guuaucaguaaugcuaaaugug

SEQ ID NO: 502828 - RNA, 18 nt, Homo sapiens
guuccugaacaugaugac

SEQ ID NO: 502829 - RNA, 21 nt, Homo sapiens
guuccugugugacccugggca

SEQ ID NO: 502830 - RNA, 19 nt, Homo sapiens
guucugcauggauucagca

SEQ ID NO: 502831 - RNA, 17 nt, Homo sapiens
guucugguuacuguucu

SEQ ID NO: 502832 - RNA, 11 nt, Homo sapiens
guugacugugu

SEQ ID NO: 502833 - RNA, 17 nt, Homo sapiens
guugccucuugcaaugc

SEQ ID NO: 502834 - RNA, 19 nt, Homo sapiens
guugcucacagcuguaaua

SEQ ID NO: 502835 - RNA, 16 nt, Homo sapiens
guuggaaaguaacugu

SEQ ID NO: 502836 - RNA, 13 nt, Homo sapiens
guuggcucaggag

SEQ ID NO: 502837 - RNA, 19 nt, Homo sapiens
guuuccuagcugugugaau

SEQ ID NO: 502838 - RNA, 23 nt, Homo sapiens
guuucuggauuucauacuguaac

SEQ ID NO: 502839 - RNA, 16 nt, Homo sapiens
guuugaaucugaaugc

SEQ ID NO: 502840 - RNA, 16 nt, Homo sapiens
uaaaaaagaucuccaa

SEQ ID NO: 502841 - RNA, 23 nt, Homo sapiens
uaaaaauggcaggggguggaauu

SEQ ID NO: 502842 - RNA, 21 nt, Homo sapiens
uaaaacagguuauaacagugu

SEQ ID NO: 502843 - RNA, 21 nt, Homo sapiens
uaaaagauguuuaugauguaa

SEQ ID NO: 502844 - RNA, 22 nt, Homo sapiens
uaaaauaacaguaugugggaua

SEQ ID NO: 502845 - RNA, 16 nt, Homo sapiens
uaaaauaauaacaauc

SEQ ID NO: 502846 - RNA, 12 nt, Homo sapiens
uaaaaugauguu

SEQ ID NO: 502847 - RNA, 23 nt, Homo sapiens
uaaaauguggucugccaaucugu

SEQ ID NO: 502848 - RNA, 15 nt, Homo sapiens
uaaaggaacugcauc

SEQ ID NO: 502849 - RNA, 17 nt, Homo sapiens
uaaaggcuaaaagggaa

SEQ ID NO: 502850 - RNA, 17 nt, Homo sapiens
uaaauaauuugcacuga

SEQ ID NO: 502851 - RNA, 17 nt, Homo sapiens
uaaauaggaaucauuca

SEQ ID NO: 502852 - RNA, 16 nt, Homo sapiens
uaaaucauuaagacaa

SEQ ID NO: 502853 - RNA, 17 nt, Homo sapiens
uaaaugggacuggaguc

SEQ ID NO: 502854 - RNA, 19 nt, Homo sapiens
uaaaugugacucagcauca

SEQ ID NO: 502855 - RNA, 16 nt, Homo sapiens
uaaauugcaucacugu

SEQ ID NO: 502856 - RNA, 20 nt, Homo sapiens
uaaauuuuuuauaaaagugu

SEQ ID NO: 502857 - RNA, 17 nt, Homo sapiens
uaacaaucacaaaggaa

SEQ ID NO: 502858 - RNA, 14 nt, Homo sapiens
uaacauaccuuguc

SEQ ID NO: 502859 - RNA, 14 nt, Homo sapiens
uaacaucugaccug

SEQ ID NO: 502860 - RNA, 15 nt, Homo sapiens
uaacaugcaaagauc

SEQ ID NO: 502861 - RNA, 16 nt, Homo sapiens
uaagaaacacugacuc

SEQ ID NO: 502862 - RNA, 13 nt, Homo sapiens
uaagaauaccaca

SEQ ID NO: 502863 - RNA, 18 nt, Homo sapiens
uaagagcuuaagaaccau

SEQ ID NO: 502864 - RNA, 12 nt, Homo sapiens
uaagaugaaaca

SEQ ID NO: 502865 - RNA, 20 nt, Homo sapiens
uaagaugaaacaucauuuca

SEQ ID NO: 502866 - RNA, 17 nt, Homo sapiens
uaagauguucacugugg

SEQ ID NO: 502867 - RNA, 12 nt, Homo sapiens
uaagucuuucau

SEQ ID NO: 502868 - RNA, 16 nt, Homo sapiens
uaauaaaugugacuca

SEQ ID NO: 502869 - RNA, 12 nt, Homo sapiens
uaauaacuuauc

SEQ ID NO: 502870 - RNA, 16 nt, Homo sapiens
uaauacuacuacuguu

SEQ ID NO: 502871 - RNA, 13 nt, Homo sapiens
uaauuagcugugc

SEQ ID NO: 502872 - RNA, 15 nt, Homo sapiens
uacaauaaagcaaug

SEQ ID NO: 502873 - RNA, 20 nt, Homo sapiens
uacacaaucugaaacagcuu

SEQ ID NO: 502874 - RNA, 18 nt, Homo sapiens
uacagaccaccuuucaca

SEQ ID NO: 502875 - RNA, 18 nt, Homo sapiens
uaccauuuaguaagaaua

SEQ ID NO: 502876 - RNA, 19 nt, Homo sapiens
uaccccuuccuguccugcc

SEQ ID NO: 502877 - RNA, 12 nt, Homo sapiens
uaccuacuggug

SEQ ID NO: 502878 - RNA, 11 nt, Homo sapiens
uaccugucaau

SEQ ID NO: 502879 - RNA, 21 nt, Homo sapiens
uacgacuuauuuuguugaaau

SEQ ID NO: 502880 - RNA, 22 nt, Homo sapiens
uacuacuuggaaggaaaaggaa

SEQ ID NO: 502881 - RNA, 20 nt, Homo sapiens
uacucaggaggcugaggcag

SEQ ID NO: 502882 - RNA, 17 nt, Homo sapiens
uacuccccaacugaguu

SEQ ID NO: 502883 - RNA, 20 nt, Homo sapiens
uacugaaucugcuaccaaaa

SEQ ID NO: 502884 - RNA, 15 nt, Homo sapiens
uacuucccacuguau

SEQ ID NO: 502885 - RNA, 14 nt, Homo sapiens
uacuuugacagugu

SEQ ID NO: 502886 - RNA, 15 nt, Homo sapiens
uagaaauauagccaa

SEQ ID NO: 502887 - RNA, 14 nt, Homo sapiens
uagaaugagacuua

SEQ ID NO: 502888 - RNA, 18 nt, Homo sapiens
uagaaugagacuuacuuc

SEQ ID NO: 502889 - RNA, 19 nt, Homo sapiens
uagaaugaucuauugcuca

SEQ ID NO: 502890 - RNA, 18 nt, Homo sapiens
uagaaugcuuuuguuaaa

SEQ ID NO: 502891 - RNA, 14 nt, Homo sapiens
uagaauucagucaa

SEQ ID NO: 502892 - RNA, 18 nt, Homo sapiens
uagagaaagaacuaugaa

SEQ ID NO: 502893 - RNA, 16 nt, Homo sapiens
uagaucugaacuccuu

SEQ ID NO: 502894 - RNA, 18 nt, Homo sapiens
uagcacacuuuuccacau

SEQ ID NO: 502895 - RNA, 14 nt, Homo sapiens
uagccuccaaacau

SEQ ID NO: 502896 - RNA, 23 nt, Homo sapiens
uaggaacaaucuuugcuguauac

SEQ ID NO: 502897 - RNA, 21 nt, Homo sapiens
uagugacauuuaaugccaucu

SEQ ID NO: 502898 - RNA, 15 nt, Homo sapiens
uaguucaacuguaua

SEQ ID NO: 502899 - RNA, 12 nt, Homo sapiens
uauaacaguguu

SEQ ID NO: 502900 - RNA, 23 nt, Homo sapiens
uauaacuggauugcagacuguuc

SEQ ID NO: 502901 - RNA, 14 nt, Homo sapiens
uauagcauuuugcu

SEQ ID NO: 502902 - RNA, 23 nt, Homo sapiens
uauauagaaugaucuauugcuca

SEQ ID NO: 502903 - RNA, 20 nt, Homo sapiens
uauauugcaaggugugaugg

SEQ ID NO: 502904 - RNA, 21 nt, Homo sapiens
uauauuuugugugaaauugca

SEQ ID NO: 502905 - RNA, 17 nt, Homo sapiens
uaucauguauggugaua

SEQ ID NO: 502906 - RNA, 20 nt, Homo sapiens
uauccuccccuuuuaccacu

SEQ ID NO: 502907 - RNA, 16 nt, Homo sapiens
uaugcagacaaccuca

SEQ ID NO: 502908 - RNA, 21 nt, Homo sapiens
uaugccauugggguaguugug

SEQ ID NO: 502909 - RNA, 16 nt, Homo sapiens
uaugugcuauacacac

SEQ ID NO: 502910 - RNA, 15 nt, Homo sapiens
uaugugggauauuga

SEQ ID NO: 502911 - RNA, 22 nt, Homo sapiens
uauuauugguuguuguauugau

SEQ ID NO: 502912 - RNA, 17 nt, Homo sapiens
uauugcaaggugugaug

SEQ ID NO: 502913 - RNA, 23 nt, Homo sapiens
uauuuauugcuguguaacacugu

SEQ ID NO: 502914 - RNA, 16 nt, Homo sapiens
uauuuuuuaaacauac

SEQ ID NO: 502915 - RNA, 18 nt, Homo sapiens
ucaaaaagggaaugcauu

SEQ ID NO: 502916 - RNA, 14 nt, Homo sapiens
ucaaagacuguauu

SEQ ID NO: 502917 - RNA, 13 nt, Homo sapiens
ucaaagccuucuc

SEQ ID NO: 502918 - RNA, 21 nt, Homo sapiens
ucaagacgucacccuccauuc

SEQ ID NO: 502919 - RNA, 17 nt, Homo sapiens
ucaaucuuuaacaaccu

SEQ ID NO: 502920 - RNA, 21 nt, Homo sapiens
ucacaucuauccacacuguca

SEQ ID NO: 502921 - RNA, 14 nt, Homo sapiens
ucacgccacugcac

SEQ ID NO: 502922 - RNA, 22 nt, Homo sapiens
ucacugugcuaucggcagauga

SEQ ID NO: 502923 - RNA, 20 nt, Homo sapiens
ucagugaccagugccuguga

SEQ ID NO: 502924 - RNA, 16 nt, Homo sapiens
ucaguucucaaaugug

SEQ ID NO: 502925 - RNA, 14 nt, Homo sapiens
ucauaacagucuua

SEQ ID NO: 502926 - RNA, 12 nt, Homo sapiens
ucauacuguaac

SEQ ID NO: 502927 - RNA, 14 nt, Homo sapiens
ucaugccugaugaa

SEQ ID NO: 502928 - RNA, 21 nt, Homo sapiens
ucaugggguggacucuaacag

SEQ ID NO: 502929 - RNA, 22 nt, Homo sapiens
ucauuaguccuuugucuaagua

SEQ ID NO: 502930 - RNA, 17 nt, Homo sapiens
ucauucugccugcucca

SEQ ID NO: 502931 - RNA, 19 nt, Homo sapiens
ucauucugccugcuccauc

SEQ ID NO: 502932 - RNA, 21 nt, Homo sapiens
ucauuuacacagugcuuucca

SEQ ID NO: 502933 - RNA, 18 nt, Homo sapiens
uccaaaaauguguaagaa

SEQ ID NO: 502934 - RNA, 20 nt, Homo sapiens
uccaaaaguguugacugugu

SEQ ID NO: 502935 - RNA, 23 nt, Homo sapiens
uccaaguauauaugaaugaauaa

SEQ ID NO: 502936 - RNA, 16 nt, Homo sapiens
uccagaacacaaccuu

SEQ ID NO: 502937 - RNA, 15 nt, Homo sapiens
uccagucacacuccc

SEQ ID NO: 502938 - RNA, 16 nt, Homo sapiens
uccagucacacucccc

SEQ ID NO: 502939 - RNA, 22 nt, Homo sapiens
uccaucgcgccagcgaccucuc

SEQ ID NO: 502940 - RNA, 18 nt, Homo sapiens
ucccacuuccuccuaccu

SEQ ID NO: 502941 - RNA, 15 nt, Homo sapiens
ucccaugcacaagau

SEQ ID NO: 502942 - RNA, 21 nt, Homo sapiens
uccccucacacacaaauugac

SEQ ID NO: 502943 - RNA, 15 nt, Homo sapiens
ucccuuucacuaaaa

SEQ ID NO: 502944 - RNA, 13 nt, Homo sapiens
uccuaaagagaca

SEQ ID NO: 502945 - RNA, 17 nt, Homo sapiens
uccuagcugugugaaua

SEQ ID NO: 502946 - RNA, 16 nt, Homo sapiens
uccucacacccauuua

SEQ ID NO: 502947 - RNA, 19 nt, Homo sapiens
uccuccccaccuguagcug

SEQ ID NO: 502948 - RNA, 12 nt, Homo sapiens
uccuccuaccug

SEQ ID NO: 502949 - RNA, 18 nt, Homo sapiens
uccugggacacuccgucu

SEQ ID NO: 502950 - RNA, 17 nt, Homo sapiens
uccuuaggccucugaga

SEQ ID NO: 502951 - RNA, 18 nt, Homo sapiens
uccuucuauucuagccug

SEQ ID NO: 502952 - RNA, 17 nt, Homo sapiens
uccuuugcucuugccaa

SEQ ID NO: 502953 - RNA, 16 nt, Homo sapiens
ucgccgaggagagcaa

SEQ ID NO: 502954 - RNA, 23 nt, Homo sapiens
ucggggagcguucuaaauaugaa

SEQ ID NO: 502955 - RNA, 15 nt, Homo sapiens
ucuaaaaacauuugu

SEQ ID NO: 502956 - RNA, 17 nt, Homo sapiens
ucuaaauacaugccaca

SEQ ID NO: 502957 - RNA, 20 nt, Homo sapiens
ucuagagcuuaaugcuacau

SEQ ID NO: 502958 - RNA, 12 nt, Homo sapiens
ucuauucuagcc

SEQ ID NO: 502959 - RNA, 21 nt, Homo sapiens
ucuauugcucaucagcuuuau

SEQ ID NO: 502960 - RNA, 16 nt, Homo sapiens
ucuccauaggacagga

SEQ ID NO: 502961 - RNA, 18 nt, Homo sapiens
ucuccauaggacaggaag

SEQ ID NO: 502962 - RNA, 20 nt, Homo sapiens
ucuccucgagcccuccccca

SEQ ID NO: 502963 - RNA, 17 nt, Homo sapiens
ucuccuguuccauuuca

SEQ ID NO: 502964 - RNA, 20 nt, Homo sapiens
ucuccuuugcucuugccaaa

SEQ ID NO: 502965 - RNA, 15 nt, Homo sapiens
ucucuccucaguuuc

SEQ ID NO: 502966 - RNA, 13 nt, Homo sapiens
ucugaaacagcuu

SEQ ID NO: 502967 - RNA, 18 nt, Homo sapiens
ucugacuacuuguuguau

SEQ ID NO: 502968 - RNA, 21 nt, Homo sapiens
ucugacuacuuguuguaucug

SEQ ID NO: 502969 - RNA, 20 nt, Homo sapiens
ucugccuguggaguagccau

SEQ ID NO: 502970 - RNA, 22 nt, Homo sapiens
ucuucagagauaggccuguggg

SEQ ID NO: 502971 - RNA, 17 nt, Homo sapiens
ucuucaugccugaugaa

SEQ ID NO: 502972 - RNA, 17 nt, Homo sapiens
ucuucuuccccuuuguc

SEQ ID NO: 502973 - RNA, 13 nt, Homo sapiens
ucuugaggucucu

SEQ ID NO: 502974 - RNA, 20 nt, Homo sapiens
ucuugauaucucgaacuuuc

SEQ ID NO: 502975 - RNA, 12 nt, Homo sapiens
ugaaacaucauu

SEQ ID NO: 502976 - RNA, 19 nt, Homo sapiens
ugaaacucauagacacuga

SEQ ID NO: 502977 - RNA, 21 nt, Homo sapiens
ugaaacucauagacacugauc

SEQ ID NO: 502978 - RNA, 19 nt, Homo sapiens
ugaaagaugcaucaucucu

SEQ ID NO: 502979 - RNA, 15 nt, Homo sapiens
ugaaaucaacugaca

SEQ ID NO: 502980 - RNA, 14 nt, Homo sapiens
ugaacagcugugag

SEQ ID NO: 502981 - RNA, 17 nt, Homo sapiens
ugaaguuuuacugucua

SEQ ID NO: 502982 - RNA, 22 nt, Homo sapiens
ugaauaaagcauccaaguauau

SEQ ID NO: 502983 - RNA, 22 nt, Homo sapiens
ugaauagguuccccaauccauc

SEQ ID NO: 502984 - RNA, 14 nt, Homo sapiens
ugaaugcuauacug

SEQ ID NO: 502985 - RNA, 19 nt, Homo sapiens
ugacaaccugaauuaucua

SEQ ID NO: 502986 - RNA, 19 nt, Homo sapiens
ugaccagaaaucaaaaagg

SEQ ID NO: 502987 - RNA, 19 nt, Homo sapiens
ugaccaucccaacuuuggu

SEQ ID NO: 502988 - RNA, 16 nt, Homo sapiens
ugaccauuugacuguu

SEQ ID NO: 502989 - RNA, 17 nt, Homo sapiens
ugaccauuugacuguuc

SEQ ID NO: 502990 - RNA, 14 nt, Homo sapiens
ugacuguaucuuga

SEQ ID NO: 502991 - RNA, 20 nt, Homo sapiens
ugagagaaggaugggucccc

SEQ ID NO: 502992 - RNA, 22 nt, Homo sapiens
ugagcauagagaacaaaguaaa

SEQ ID NO: 502993 - RNA, 16 nt, Homo sapiens
ugagcuaugcaaacaa

SEQ ID NO: 502994 - RNA, 15 nt, Homo sapiens
ugaggacugauuuca

SEQ ID NO: 502995 - RNA, 22 nt, Homo sapiens
ugaggagauucccaccuuccau

SEQ ID NO: 502996 - RNA, 18 nt, Homo sapiens
ugaggccuagacucuguc

SEQ ID NO: 502997 - RNA, 18 nt, Homo sapiens
ugagggugcugacuggcu

SEQ ID NO: 502998 - RNA, 19 nt, Homo sapiens
ugauaccauaugaaugaaa

SEQ ID NO: 502999 - RNA, 19 nt, Homo sapiens
ugaugugugagcuaugcaa

SEQ ID NO: 503000 - RNA, 24 nt, Homo sapiens
ugauuagaaauuaccuguggauau

SEQ ID NO: 503001 - RNA, 21 nt, Homo sapiens
ugauugggaaaacauuugcug

SEQ ID NO: 503002 - RNA, 14 nt, Homo sapiens
ugcaaacaaaaucc

SEQ ID NO: 503003 - RNA, 17 nt, Homo sapiens
ugcaaagaccaccucca

SEQ ID NO: 503004 - RNA, 13 nt, Homo sapiens
ugcaauguuuuag

SEQ ID NO: 503005 - RNA, 21 nt, Homo sapiens
ugcagacaaccucaucagcug

SEQ ID NO: 503006 - RNA, 12 nt, Homo sapiens
ugcagacuguuc

SEQ ID NO: 503007 - RNA, 12 nt, Homo sapiens
aaaaaacagugg

SEQ ID NO: 503008 - RNA, 21 nt, Homo sapiens
aaaaauggacaaaauccauga

SEQ ID NO: 503009 - RNA, 12 nt, Homo sapiens
aaaacauuugcu

SEQ ID NO: 503010 - RNA, 19 nt, Homo sapiens
aaaaccuuucaaaggauau

SEQ ID NO: 503011 - RNA, 22 nt, Homo sapiens
aaaaccuuucaaaggauaugca

SEQ ID NO: 503012 - RNA, 21 nt, Homo sapiens
aaaagaaagcaaacuuaagaa

SEQ ID NO: 503013 - RNA, 11 nt, Homo sapiens
aaaagcacaga

SEQ ID NO: 503014 - RNA, 23 nt, Homo sapiens
aaaauggacaaaauccaugaaca

SEQ ID NO: 503015 - RNA, 19 nt, Homo sapiens
aaaauggcacuugggggac

SEQ ID NO: 503016 - RNA, 17 nt, Homo sapiens
agaaacaaagauguuau

SEQ ID NO: 503017 - RNA, 16 nt, Homo sapiens
agaaagcuuccuucaa

SEQ ID NO: 503018 - RNA, 15 nt, Homo sapiens
agaacaacuaccuga

SEQ ID NO: 503019 - RNA, 18 nt, Homo sapiens
agaauacugccaaaacau

SEQ ID NO: 503020 - RNA, 15 nt, Homo sapiens
agacacugaucuggc

SEQ ID NO: 503021 - RNA, 18 nt, Homo sapiens
agacagcaggaagccaua

SEQ ID NO: 503022 - RNA, 18 nt, Homo sapiens
agaccccuuguugcacug

SEQ ID NO: 503023 - RNA, 19 nt, Homo sapiens
agaccccuuguugcacugc

SEQ ID NO: 503024 - RNA, 20 nt, Homo sapiens
agaccuguguuacuaaaaaa

SEQ ID NO: 503025 - RNA, 23 nt, Homo sapiens
agacuugcuuuucuaacuaagag

SEQ ID NO: 503026 - RNA, 15 nt, Homo sapiens
agagaaugugcucau

SEQ ID NO: 503027 - RNA, 18 nt, Homo sapiens
agagaggaaccaauaccu

SEQ ID NO: 503028 - RNA, 16 nt, Homo sapiens
agagccuaacaucucc

SEQ ID NO: 503029 - RNA, 16 nt, Homo sapiens
agaggaaccaauaccu

SEQ ID NO: 503030 - RNA, 20 nt, Homo sapiens
agauaaaaugauguuauaca

SEQ ID NO: 503031 - RNA, 17 nt, Homo sapiens
agauaaacaaacaagcc

SEQ ID NO: 503032 - RNA, 17 nt, Homo sapiens
agaucacgccacugcac

SEQ ID NO: 503033 - RNA, 21 nt, Homo sapiens
agaucgaugauaugaccagaa

SEQ ID NO: 503034 - RNA, 15 nt, Homo sapiens
agaugcguuugccuc

SEQ ID NO: 503035 - RNA, 17 nt, Homo sapiens
agauguuuaugauguaa

SEQ ID NO: 503036 - RNA, 20 nt, Homo sapiens
agcaacauuuguuuuagucu

SEQ ID NO: 503037 - RNA, 12 nt, Homo sapiens
agcaucagcuca

SEQ ID NO: 503038 - RNA, 21 nt, Homo sapiens
agcauccaaguauauaugaau

SEQ ID NO: 503039 - RNA, 14 nt, Homo sapiens
agcaucucaguggu

SEQ ID NO: 503040 - RNA, 15 nt, Homo sapiens
agcaucugcuccauc

SEQ ID NO: 503041 - RNA, 12 nt, Homo sapiens
agcaugugaugu

SEQ ID NO: 503042 - RNA, 19 nt, Homo sapiens
agccagaggcucuaaugua

SEQ ID NO: 503043 - RNA, 23 nt, Homo sapiens
agccagaggcucuaauguacaau

SEQ ID NO: 503044 - RNA, 18 nt, Homo sapiens
agccauugaacagcugug

SEQ ID NO: 503045 - RNA, 22 nt, Homo sapiens
agccccugggcccaguaccuag

SEQ ID NO: 503046 - RNA, 16 nt, Homo sapiens
aaaaauaaaaaagauc

SEQ ID NO: 503047 - RNA, 15 nt, Homo sapiens
aaaaaugucaucuca

SEQ ID NO: 503048 - RNA, 21 nt, Homo sapiens
aaaacaaugguguggugaaug

SEQ ID NO: 503049 - RNA, 13 nt, Homo sapiens
aaaacauguuaau

SEQ ID NO: 503050 - RNA, 14 nt, Homo sapiens
aaaacccacagaag

SEQ ID NO: 503051 - RNA, 14 nt, Homo sapiens
aaaacguguaaaug

SEQ ID NO: 503052 - RNA, 15 nt, Homo sapiens
aaaacucugcaugua

SEQ ID NO: 503053 - RNA, 15 nt, Homo sapiens
aaaagacacagaaca

SEQ ID NO: 503054 - RNA, 17 nt, Homo sapiens
aaaaguguugacugugu

SEQ ID NO: 503055 - RNA, 18 nt, Homo sapiens
aaaauuuuguauguuaaa

SEQ ID NO: 503056 - RNA, 21 nt, Homo sapiens
aaacacccgacgucauguauu

SEQ ID NO: 503057 - RNA, 21 nt, Homo sapiens
aaacagggcugccuucuggcc

SEQ ID NO: 503058 - RNA, 17 nt, Homo sapiens
aaacauucaaagagaca

SEQ ID NO: 503059 - RNA, 20 nt, Homo sapiens
aaacccaucuuuuguucucc

SEQ ID NO: 503060 - RNA, 18 nt, Homo sapiens
aaaccugaugcuggggac

SEQ ID NO: 503061 - RNA, 21 nt, Homo sapiens
aaacgauuagugauguccuua

SEQ ID NO: 503062 - RNA, 19 nt, Homo sapiens
aaagagacauauacuaaga

SEQ ID NO: 503063 - RNA, 17 nt, Homo sapiens
aaagagaggaaccaaua

SEQ ID NO: 503064 - RNA, 16 nt, Homo sapiens
aaagcaaugugguagu

SEQ ID NO: 503065 - RNA, 24 nt, Homo sapiens
aaagcuguuccuugguccuaguaa

SEQ ID NO: 503066 - RNA, 18 nt, Homo sapiens
aaagguauuauacaugug

SEQ ID NO: 503067 - RNA, 17 nt, Homo sapiens
aaauaaagauauuguuc

SEQ ID NO: 503068 - RNA, 15 nt, Homo sapiens
aaaugccugacucag

SEQ ID NO: 503069 - RNA, 13 nt, Homo sapiens
aaaugguccuauu

SEQ ID NO: 503070 - RNA, 17 nt, Homo sapiens
aaauguuacuucucuca

SEQ ID NO: 503071 - RNA, 14 nt, Homo sapiens
aaauuaccugugga

SEQ ID NO: 503072 - RNA, 22 nt, Homo sapiens
aaauuaguauagcuacuuugga

SEQ ID NO: 503073 - RNA, 15 nt, Homo sapiens
aacacccgacgucau

SEQ ID NO: 503074 - RNA, 12 nt, Homo sapiens
aacagcugugag

SEQ ID NO: 503075 - RNA, 18 nt, Homo sapiens
aacagguaaaacagggcc

SEQ ID NO: 503076 - RNA, 14 nt, Homo sapiens
aacauaacuucuca

SEQ ID NO: 503077 - RNA, 15 nt, Homo sapiens
aacaugggcugugau

SEQ ID NO: 503078 - RNA, 12 nt, Homo sapiens
aacauucaggaa

SEQ ID NO: 503079 - RNA, 16 nt, Homo sapiens
aacauuugcugccauu

SEQ ID NO: 503080 - RNA, 22 nt, Homo sapiens
aacauuuguuuuagucugaaca

SEQ ID NO: 503081 - RNA, 20 nt, Homo sapiens
aacccaaucccucuccacuc

SEQ ID NO: 503082 - RNA, 13 nt, Homo sapiens
aacccucuugcca

SEQ ID NO: 503083 - RNA, 23 nt, Homo sapiens
aaccuacaguuuuaacuguggau

SEQ ID NO: 503084 - RNA, 14 nt, Homo sapiens
aaccuagcuagcaa

SEQ ID NO: 503085 - RNA, 23 nt, Homo sapiens
aaccuuucaaaggauaugcagaa

SEQ ID NO: 503086 - RNA, 19 nt, Homo sapiens
aacgguuccuggugacucc

SEQ ID NO: 503087 - RNA, 12 nt, Homo sapiens
aacuagccaaac

SEQ ID NO: 503088 - RNA, 22 nt, Homo sapiens
aacuaugaaaucaacugacaag

SEQ ID NO: 503089 - RNA, 16 nt, Homo sapiens
aacuuaggcaugcaca

SEQ ID NO: 503090 - RNA, 15 nt, Homo sapiens
aagaauaauaauuaa

SEQ ID NO: 503091 - RNA, 22 nt, Homo sapiens
aagacagugccuauacugccuc

SEQ ID NO: 503092 - RNA, 13 nt, Homo sapiens
aagacuacugaau

SEQ ID NO: 503093 - RNA, 14 nt, Homo sapiens
aagagaagguuuau

SEQ ID NO: 503094 - RNA, 16 nt, Homo sapiens
aagagcuuaagaacca

SEQ ID NO: 503095 - RNA, 15 nt, Homo sapiens
aagaugcaucaucuc

SEQ ID NO: 503096 - RNA, 14 nt, Homo sapiens
aagaugcguuugcc

SEQ ID NO: 503097 - RNA, 13 nt, Homo sapiens
aagcaugugaugu

SEQ ID NO: 503098 - RNA, 14 nt, Homo sapiens
aagcuuccuucaac

SEQ ID NO: 503099 - RNA, 19 nt, Homo sapiens
aagucccuuccuauucucc

SEQ ID NO: 503100 - RNA, 18 nt, Homo sapiens
aaguccuaaaaguucuca

SEQ ID NO: 503101 - RNA, 22 nt, Homo sapiens
aagucugguaauaaaugugacu

SEQ ID NO: 503102 - RNA, 14 nt, Homo sapiens
aaguuuuacugucu

SEQ ID NO: 503103 - RNA, 12 nt, Homo sapiens
aauaaagcaucc

SEQ ID NO: 503104 - RNA, 12 nt, Homo sapiens
aauaacauguuu

SEQ ID NO: 503105 - RNA, 20 nt, Homo sapiens
aauaacauguuucucuauaa

SEQ ID NO: 503106 - RNA, 17 nt, Homo sapiens
aauaauaacaaucacaa

SEQ ID NO: 503107 - RNA, 16 nt, Homo sapiens
aauaauuugcacugaa

SEQ ID NO: 503108 - RNA, 12 nt, Homo sapiens
aauagauaugaa

SEQ ID NO: 503109 - RNA, 23 nt, Homo sapiens
aauagcacacuuuuccacauucc

SEQ ID NO: 503110 - RNA, 18 nt, Homo sapiens
aaucuucaaagccuucuc

SEQ ID NO: 503111 - RNA, 14 nt, Homo sapiens
aaugcaaaacucau

SEQ ID NO: 503112 - RNA, 18 nt, Homo sapiens
aauguacaauaaagcaau

SEQ ID NO: 503113 - RNA, 20 nt, Homo sapiens
aauguacaauaaagcaaugu

SEQ ID NO: 503114 - RNA, 19 nt, Homo sapiens
aaugucuccuuugcucuug

SEQ ID NO: 503115 - RNA, 16 nt, Homo sapiens
aauguuaaagggauau

SEQ ID NO: 503116 - RNA, 13 nt, Homo sapiens
aauucaacuuugu

SEQ ID NO: 503117 - RNA, 18 nt, Homo sapiens
aauucugauugauuugau

SEQ ID NO: 503118 - RNA, 19 nt, Homo sapiens
aauugggggagcugcaguc

SEQ ID NO: 503119 - RNA, 20 nt, Homo sapiens
aauuguaaaauuuaaaucau

SEQ ID NO: 503120 - RNA, 19 nt, Homo sapiens
aauuguacaaaauuaagca

SEQ ID NO: 503121 - RNA, 13 nt, Homo sapiens
aauuuaauaccag

SEQ ID NO: 503122 - RNA, 14 nt, Homo sapiens
acaaaccauuuugu

SEQ ID NO: 503123 - RNA, 15 nt, Homo sapiens
acaaagaaacaaaga

SEQ ID NO: 503124 - RNA, 15 nt, Homo sapiens
acaaccucaucagcu

SEQ ID NO: 503125 - RNA, 20 nt, Homo sapiens
acaagaacuuuaaauugugu

SEQ ID NO: 503126 - RNA, 17 nt, Homo sapiens
acaaguaaaacuguggu

SEQ ID NO: 503127 - RNA, 14 nt, Homo sapiens
acaauaaagcaaug

SEQ ID NO: 503128 - RNA, 21 nt, Homo sapiens
acaaucuuugcuguauacuuu

SEQ ID NO: 503129 - RNA, 18 nt, Homo sapiens
acacaaucugaaacagcu

SEQ ID NO: 503130 - RNA, 15 nt, Homo sapiens
acacacgaugcauuu

SEQ ID NO: 503131 - RNA, 14 nt, Homo sapiens
acacagcauuguau

SEQ ID NO: 503132 - RNA, 16 nt, Homo sapiens
acacccaguugccaaa

SEQ ID NO: 503133 - RNA, 15 nt, Homo sapiens
acacgaugcauuuaa

SEQ ID NO: 503134 - RNA, 16 nt, Homo sapiens
acacgaugcauuuaau

SEQ ID NO: 503135 - RNA, 20 nt, Homo sapiens
acacuuuuccacauuccagu

SEQ ID NO: 503136 - RNA, 19 nt, Homo sapiens
acagaaggugaacuuugug

SEQ ID NO: 503137 - RNA, 16 nt, Homo sapiens
acagacuugaaugcua

SEQ ID NO: 503138 - RNA, 20 nt, Homo sapiens
acagagccacgaguuuggau

SEQ ID NO: 503139 - RNA, 15 nt, Homo sapiens
acagcaucagcucaa

SEQ ID NO: 503140 - RNA, 21 nt, Homo sapiens
acagcccaggauacuggcaca

SEQ ID NO: 503141 - RNA, 16 nt, Homo sapiens
acagcugugagccaug

SEQ ID NO: 503142 - RNA, 22 nt, Homo sapiens
acagcugugagccaugccuccc

SEQ ID NO: 503143 - RNA, 18 nt, Homo sapiens
acaggaaggaaugcaaaa

SEQ ID NO: 503144 - RNA, 19 nt, Homo sapiens
acaggggccauguccucuc

SEQ ID NO: 503145 - RNA, 20 nt, Homo sapiens
acaggugcaacagacuugaa

SEQ ID NO: 503146 - RNA, 20 nt, Homo sapiens
acagugcuuuccagccuuug

SEQ ID NO: 503147 - RNA, 14 nt, Homo sapiens
acauaaaagacaca

SEQ ID NO: 503148 - RNA, 22 nt, Homo sapiens
acauuuguuuuagucugaacaa

SEQ ID NO: 503149 - RNA, 23 nt, Homo sapiens
accacuagaaagugggcuuaaug

SEQ ID NO: 503150 - RNA, 18 nt, Homo sapiens
accauuugacuguucaau

SEQ ID NO: 503151 - RNA, 14 nt, Homo sapiens
acccaguugccaaa

SEQ ID NO: 503152 - RNA, 17 nt, Homo sapiens
accuaaauaugagccca

SEQ ID NO: 503153 - RNA, 19 nt, Homo sapiens
accuaguccccagccugcu

SEQ ID NO: 503154 - RNA, 22 nt, Homo sapiens
accucuccuucaugacagccuc

SEQ ID NO: 503155 - RNA, 17 nt, Homo sapiens
acgagggauuacuuugg

SEQ ID NO: 503156 - RNA, 11 nt, Homo sapiens
acgaugcauuu

SEQ ID NO: 503157 - RNA, 21 nt, Homo sapiens
acguaaaaagaaaaaaaccau

SEQ ID NO: 503158 - RNA, 23 nt, Homo sapiens
acguuguuuugguuguacuuugg

SEQ ID NO: 503159 - RNA, 13 nt, Homo sapiens
acuauuuccacau

SEQ ID NO: 503160 - RNA, 17 nt, Homo sapiens
acuccucaaaccacuug

SEQ ID NO: 503161 - RNA, 15 nt, Homo sapiens
acucugucuaccugg

SEQ ID NO: 503162 - RNA, 19 nt, Homo sapiens
acugaaucugcuaccaaaa

SEQ ID NO: 503163 - RNA, 20 nt, Homo sapiens
acugauccaguauaagacua

SEQ ID NO: 503164 - RNA, 17 nt, Homo sapiens
acugccaaaacauuuau

SEQ ID NO: 503165 - RNA, 20 nt, Homo sapiens
acugcuucccuuacuuugcu

SEQ ID NO: 503166 - RNA, 19 nt, Homo sapiens
acugggugaggauaacaca

SEQ ID NO: 503167 - RNA, 16 nt, Homo sapiens
acuguaaacuucugca

SEQ ID NO: 503168 - RNA, 17 nt, Homo sapiens
acugugguacugaugga

SEQ ID NO: 503169 - RNA, 15 nt, Homo sapiens
acuuacaucaugugu

SEQ ID NO: 503170 - RNA, 12 nt, Homo sapiens
acuuaguucaag

SEQ ID NO: 503171 - RNA, 22 nt, Homo sapiens
acuuauagaauucagucaaaga

SEQ ID NO: 503172 - RNA, 15 nt, Homo sapiens
acuuccgagcuaugu

SEQ ID NO: 503173 - RNA, 17 nt, Homo sapiens
acuucucaccagcaguc

SEQ ID NO: 503174 - RNA, 22 nt, Homo sapiens
acuucugaagagaccacucaau

SEQ ID NO: 503175 - RNA, 17 nt, Homo sapiens
acuucugacuacuuguu

SEQ ID NO: 503176 - RNA, 14 nt, Homo sapiens
acuugccucugcac

SEQ ID NO: 503177 - RNA, 19 nt, Homo sapiens
acuuggagaauacugccaa

SEQ ID NO: 503178 - RNA, 15 nt, Homo sapiens
acuuuggccaaaacc

SEQ ID NO: 503179 - RNA, 18 nt, Homo sapiens
acuuuggccaaaaccuuu

SEQ ID NO: 503180 - RNA, 19 nt, Homo sapiens
acuuuuaaaaaauacucug

SEQ ID NO: 503181 - RNA, 19 nt, Homo sapiens
acuuuuuaaaauaauaaca

SEQ ID NO: 503182 - RNA, 18 nt, Homo sapiens
agaaaauggguuuauuca

SEQ ID NO: 503183 - RNA, 21 nt, Homo sapiens
agaaaauguuacuucucucau

SEQ ID NO: 503184 - RNA, 24 nt, Homo sapiens
cagagcugcugcacacacucaccu

SEQ ID NO: 503185 - RNA, 20 nt, Homo sapiens
cagaggcucuaauguacaau

SEQ ID NO: 503186 - RNA, 12 nt, Homo sapiens
cagaguuuucau

SEQ ID NO: 503187 - RNA, 16 nt, Homo sapiens
cagauuggccaauuaa

SEQ ID NO: 503188 - RNA, 13 nt, Homo sapiens
cagcaguuuccag

SEQ ID NO: 503189 - RNA, 16 nt, Homo sapiens
cagcaguuuccagaga

SEQ ID NO: 503190 - RNA, 13 nt, Homo sapiens
cagcaucagcuca

SEQ ID NO: 503191 - RNA, 16 nt, Homo sapiens
cagcaucugcuccauc

SEQ ID NO: 503192 - RNA, 14 nt, Homo sapiens
cagccugcucccua

SEQ ID NO: 503193 - RNA, 22 nt, Homo sapiens
cagcucaaugcaguuagcugaa

SEQ ID NO: 503194 - RNA, 12 nt, Homo sapiens
cagcugugauga

SEQ ID NO: 503195 - RNA, 15 nt, Homo sapiens
caggaaggaaugcaa

SEQ ID NO: 503196 - RNA, 18 nt, Homo sapiens
caggaaggaaugcaaaac

SEQ ID NO: 503197 - RNA, 19 nt, Homo sapiens
cagggagugcacauaucca

SEQ ID NO: 503198 - RNA, 17 nt, Homo sapiens
cagggauacccagugau

SEQ ID NO: 503199 - RNA, 22 nt, Homo sapiens
cagggcaccguauuccucuccc

SEQ ID NO: 503200 - RNA, 17 nt, Homo sapiens
caggugugguugcucac

SEQ ID NO: 503201 - RNA, 17 nt, Homo sapiens
cagguuauaacaguguu

SEQ ID NO: 503202 - RNA, 16 nt, Homo sapiens
caguaccuagcuggcu

SEQ ID NO: 503203 - RNA, 13 nt, Homo sapiens
caguaguugcaau

SEQ ID NO: 503204 - RNA, 23 nt, Homo sapiens
cagucaaagauacacaaucugaa

SEQ ID NO: 503205 - RNA, 15 nt, Homo sapiens
cagugcuuuccagcc

SEQ ID NO: 503206 - RNA, 16 nt, Homo sapiens
cagugcuuuccagccu

SEQ ID NO: 503207 - RNA, 13 nt, Homo sapiens
caguuuaaugucu

SEQ ID NO: 503208 - RNA, 21 nt, Homo sapiens
caguuuucggaaacacugacu

SEQ ID NO: 503209 - RNA, 16 nt, Homo sapiens
cauaaaaguuggcuca

SEQ ID NO: 503210 - RNA, 20 nt, Homo sapiens
cauaaaaguuggcucaggag

SEQ ID NO: 503211 - RNA, 22 nt, Homo sapiens
cauaacagucuuacugcaggca

SEQ ID NO: 503212 - RNA, 15 nt, Homo sapiens
cauaacuucucaugu

SEQ ID NO: 503213 - RNA, 20 nt, Homo sapiens
cauaagagcuuaagaaccau

SEQ ID NO: 503214 - RNA, 23 nt, Homo sapiens
auauugauugggaaaacauuugc

SEQ ID NO: 503215 - RNA, 15 nt, Homo sapiens
aucaaugcauguuac

SEQ ID NO: 503216 - RNA, 17 nt, Homo sapiens
aucacauuccucugccc

SEQ ID NO: 503217 - RNA, 11 nt, Homo sapiens
aucacuuugac

SEQ ID NO: 503218 - RNA, 21 nt, Homo sapiens
aucauauccuaugacccagca

SEQ ID NO: 503219 - RNA, 17 nt, Homo sapiens
auccaaguauauaugaa

SEQ ID NO: 503220 - RNA, 24 nt, Homo sapiens
auccaucuuugaacuucugacuac

SEQ ID NO: 503221 - RNA, 14 nt, Homo sapiens
auccucaguucuca

SEQ ID NO: 503222 - RNA, 15 nt, Homo sapiens
aucuagagcuuaaug

SEQ ID NO: 503223 - RNA, 16 nt, Homo sapiens
aucucucuagugaugg

SEQ ID NO: 503224 - RNA, 18 nt, Homo sapiens
aucugaaacagcuucaug

SEQ ID NO: 503225 - RNA, 17 nt, Homo sapiens
aucugcuggauauuuag

SEQ ID NO: 503226 - RNA, 20 nt, Homo sapiens
aucugugcaggauauuugca

SEQ ID NO: 503227 - RNA, 14 nt, Homo sapiens
aucuuugcuguaua

SEQ ID NO: 503228 - RNA, 15 nt, Homo sapiens
aucuuuuguucuccu

SEQ ID NO: 503229 - RNA, 23 nt, Homo sapiens
augaaaaaagucuccauaggaca

SEQ ID NO: 503230 - RNA, 20 nt, Homo sapiens
augaaaccccguuucuacua

SEQ ID NO: 503231 - RNA, 17 nt, Homo sapiens
augaccauuugacuguu

SEQ ID NO: 503232 - RNA, 19 nt, Homo sapiens
augcaaaugagcucugaaa

SEQ ID NO: 503233 - RNA, 19 nt, Homo sapiens
augcaagccccaacuuucu

SEQ ID NO: 503234 - RNA, 22 nt, Homo sapiens
augcagacaaccucaucagcug

SEQ ID NO: 503235 - RNA, 14 nt, Homo sapiens
augccugacucagu

SEQ ID NO: 503236 - RNA, 16 nt, Homo sapiens
auggcaggacagcucc

SEQ ID NO: 503237 - RNA, 15 nt, Homo sapiens
auggggaggccucac

SEQ ID NO: 503238 - RNA, 17 nt, Homo sapiens
augggucuaggacacag

SEQ ID NO: 503239 - RNA, 19 nt, Homo sapiens
augguaauagcuuuaguga

SEQ ID NO: 503240 - RNA, 20 nt, Homo sapiens
auguacaauaaagcaaugug

SEQ ID NO: 503241 - RNA, 21 nt, Homo sapiens
augucaguacuauucagguaa

SEQ ID NO: 503242 - RNA, 21 nt, Homo sapiens
auguccuacugagacagcaca

SEQ ID NO: 503243 - RNA, 23 nt, Homo sapiens
gugaagucucuggguggaagugu

SEQ ID NO: 503244 - RNA, 19 nt, Homo sapiens
gugacucagcaucacccac

SEQ ID NO: 503245 - RNA, 20 nt, Homo sapiens
gugaugugugagcuaugcaa

SEQ ID NO: 503246 - RNA, 14 nt, Homo sapiens
gugauuacugcaau

SEQ ID NO: 503247 - RNA, 16 nt, Homo sapiens
gugcgcaauugcucau

SEQ ID NO: 503248 - RNA, 18 nt, Homo sapiens
guggaaaaaacauuuuaa

SEQ ID NO: 503249 - RNA, 22 nt, Homo sapiens
guggcauaaauugcaucacugu

SEQ ID NO: 503250 - RNA, 22 nt, Homo sapiens
guggucuaagguucagccugaa

SEQ ID NO: 503251 - RNA, 14 nt, Homo sapiens
guguauaugaauga

SEQ ID NO: 503252 - RNA, 22 nt, Homo sapiens
gugugguugcucacagcuguaa

SEQ ID NO: 503253 - RNA, 14 nt, Homo sapiens
guguuuucagcaaa

SEQ ID NO: 503254 - RNA, 15 nt, Homo sapiens
guuaaauguuuacaa

SEQ ID NO: 503255 - RNA, 15 nt, Homo sapiens
guuagugacauuuaa

SEQ ID NO: 503256 - RNA, 12 nt, Homo sapiens
guucaggccagu

SEQ ID NO: 503257 - RNA, 18 nt, Homo sapiens
guuccccgauaccaugcu

SEQ ID NO: 503258 - RNA, 12 nt, Homo sapiens
guuccuggugac

SEQ ID NO: 503259 - RNA, 15 nt, Homo sapiens
guuccuggugacucc

SEQ ID NO: 503260 - RNA, 19 nt, Homo sapiens
guugaggccaggaguuuaa

SEQ ID NO: 503261 - RNA, 16 nt, Homo sapiens
guuguuaaaaauguca

SEQ ID NO: 503262 - RNA, 22 nt, Homo sapiens
guuuacaauaggaguggugauu

SEQ ID NO: 503263 - RNA, 21 nt, Homo sapiens
guuucguaacacagcauugua

SEQ ID NO: 503264 - RNA, 23 nt, Homo sapiens
guuucucaaagaugcguuugccu

SEQ ID NO: 503265 - RNA, 23 nt, Homo sapiens
guuucucuuggguauaaaggcua

SEQ ID NO: 503266 - RNA, 18 nt, Homo sapiens
guuuuagcacccccaugg

SEQ ID NO: 503267 - RNA, 23 nt, Homo sapiens
uaaaaaacaauuaacugcccucu

SEQ ID NO: 503268 - RNA, 19 nt, Homo sapiens
uaaaaaguuucuaaagugu

SEQ ID NO: 503269 - RNA, 15 nt, Homo sapiens
uaaaagacacagaac

SEQ ID NO: 503270 - RNA, 21 nt, Homo sapiens
uaaaauguggucugccaaucu

SEQ ID NO: 503271 - RNA, 18 nt, Homo sapiens
uaaacgguuccuggugac

SEQ ID NO: 503272 - RNA, 15 nt, Homo sapiens
uaaagcaauguggua

SEQ ID NO: 503273 - RNA, 17 nt, Homo sapiens
uaaagcaaugugguagu

SEQ ID NO: 503274 - RNA, 19 nt, Homo sapiens
uaaagcauccaaguauaua

SEQ ID NO: 503275 - RNA, 16 nt, Homo sapiens
uaaauaauuugcacug

SEQ ID NO: 503276 - RNA, 12 nt, Homo sapiens
uaaaugaucucu

SEQ ID NO: 503277 - RNA, 15 nt, Homo sapiens
uaaaugggacuggag

SEQ ID NO: 503278 - RNA, 12 nt, Homo sapiens
uaacaucuccau

SEQ ID NO: 503279 - RNA, 17 nt, Homo sapiens
uaaccagcucaguguuu

SEQ ID NO: 503280 - RNA, 22 nt, Homo sapiens
uaaccuugaaaaaaaacagugg

SEQ ID NO: 503281 - RNA, 15 nt, Homo sapiens
uaagaaauucacuuc

SEQ ID NO: 503282 - RNA, 18 nt, Homo sapiens
uaagauguucacuguggc

SEQ ID NO: 503283 - RNA, 18 nt, Homo sapiens
uaagggguaucauguaug

SEQ ID NO: 503284 - RNA, 18 nt, Homo sapiens
uaaugcauguggcacuua

SEQ ID NO: 503285 - RNA, 16 nt, Homo sapiens
uaaugcuuuguuaaau

SEQ ID NO: 503286 - RNA, 20 nt, Homo sapiens
uaauguacaauaaagcaaug

SEQ ID NO: 503287 - RNA, 23 nt, Homo sapiens
uaauguacaauaaagcaaugugg

SEQ ID NO: 503288 - RNA, 23 nt, Homo sapiens
uaaugucuccuuugcucuugcca

SEQ ID NO: 503289 - RNA, 23 nt, Homo sapiens
uacaaaccauuuuguuauugacu

SEQ ID NO: 503290 - RNA, 17 nt, Homo sapiens
uacacccaguugccaaa

SEQ ID NO: 503291 - RNA, 20 nt, Homo sapiens
uacagacagaaggugcuaag

SEQ ID NO: 503292 - RNA, 19 nt, Homo sapiens
uaccuagcuggcucuguga

SEQ ID NO: 503293 - RNA, 20 nt, Homo sapiens
uaccuggaugauucaggaga

SEQ ID NO: 503294 - RNA, 14 nt, Homo sapiens
uaccuugucauaga

SEQ ID NO: 503295 - RNA, 18 nt, Homo sapiens
uacuuauagaauucaguc

SEQ ID NO: 503296 - RNA, 14 nt, Homo sapiens
uacuuccugauuag

SEQ ID NO: 503297 - RNA, 16 nt, Homo sapiens
uagaaaagaaagcaaa

SEQ ID NO: 503298 - RNA, 15 nt, Homo sapiens
uagaacacaguuugu

SEQ ID NO: 503299 - RNA, 18 nt, Homo sapiens
uagaacuagccaaaccag

SEQ ID NO: 503300 - RNA, 18 nt, Homo sapiens
uagaauuauaacuguaaa

SEQ ID NO: 503301 - RNA, 19 nt, Homo sapiens
uagacuuggagaauacugc

SEQ ID NO: 503302 - RNA, 18 nt, Homo sapiens
uagaggcauaaaccugug

SEQ ID NO: 503303 - RNA, 14 nt, Homo sapiens
uagaguugggacaa

SEQ ID NO: 503304 - RNA, 17 nt, Homo sapiens
uagauggauaagggaau

SEQ ID NO: 503305 - RNA, 17 nt, Homo sapiens
uagcacacuuuuccaca

SEQ ID NO: 503306 - RNA, 22 nt, Homo sapiens
uagcacacuuuuccacauucca

SEQ ID NO: 503307 - RNA, 17 nt, Homo sapiens
uagccagaggcucuaau

SEQ ID NO: 503308 - RNA, 23 nt, Homo sapiens
uagccagaggcucuaauguacaa

SEQ ID NO: 503309 - RNA, 17 nt, Homo sapiens
uagcugaggcugagaaa

SEQ ID NO: 503310 - RNA, 14 nt, Homo sapiens
uaggaauaugacca

SEQ ID NO: 503311 - RNA, 15 nt, Homo sapiens
uaggauguugcucag

SEQ ID NO: 503312 - RNA, 23 nt, Homo sapiens
uaggccacagaaggugaacuuug

SEQ ID NO: 503313 - RNA, 21 nt, Homo sapiens
uagggagcauuuggguuugaa

SEQ ID NO: 503314 - RNA, 22 nt, Homo sapiens
uagucugaacaauauauacuua

SEQ ID NO: 503315 - RNA, 19 nt, Homo sapiens
uagugacauuuaaugccau

SEQ ID NO: 503316 - RNA, 16 nt, Homo sapiens
uauaaagaccuauaaa

SEQ ID NO: 503317 - RNA, 11 nt, Homo sapiens
uauaacagugu

SEQ ID NO: 503318 - RNA, 12 nt, Homo sapiens
uauaacuguaaa

SEQ ID NO: 503319 - RNA, 11 nt, Homo sapiens
uauaugaauga

SEQ ID NO: 503320 - RNA, 19 nt, Homo sapiens
uauauguauaucacauucc

SEQ ID NO: 503321 - RNA, 13 nt, Homo sapiens
uauauugcaaggu

SEQ ID NO: 503322 - RNA, 19 nt, Homo sapiens
uaugaccauuugacuguuc

SEQ ID NO: 503323 - RNA, 19 nt, Homo sapiens
uaugacuguaucuugauau

SEQ ID NO: 503324 - RNA, 17 nt, Homo sapiens
uaugcaauucaguguuc

SEQ ID NO: 503325 - RNA, 20 nt, Homo sapiens
uaugggcauccucucugguc

SEQ ID NO: 503326 - RNA, 15 nt, Homo sapiens
uauucuagccugcau

SEQ ID NO: 503327 - RNA, 14 nt, Homo sapiens
uauugaauguuaaa

SEQ ID NO: 503328 - RNA, 17 nt, Homo sapiens
uauuuaguucaacugua

SEQ ID NO: 503329 - RNA, 14 nt, Homo sapiens
uauuugcacuauuu

SEQ ID NO: 503330 - RNA, 18 nt, Homo sapiens
ucaaagaugcguuugccu

SEQ ID NO: 503331 - RNA, 17 nt, Homo sapiens
ucaaauacacauuugcu

SEQ ID NO: 503332 - RNA, 15 nt, Homo sapiens
ucaacuguauaguuu

SEQ ID NO: 503333 - RNA, 12 nt, Homo sapiens
ucaauacuaugg

SEQ ID NO: 503334 - RNA, 20 nt, Homo sapiens
ucaauacuauggaguaccau

SEQ ID NO: 503335 - RNA, 16 nt, Homo sapiens
ucaauuacaacaguga

SEQ ID NO: 503336 - RNA, 21 nt, Homo sapiens
ucacaaaacgaaaugcuauga

SEQ ID NO: 503337 - RNA, 18 nt, Homo sapiens
ucacagcuguaauaacaa

SEQ ID NO: 503338 - RNA, 17 nt, Homo sapiens
ucacuaaaauuaaucug

SEQ ID NO: 503339 - RNA, 20 nt, Homo sapiens
ucacugcugcaaauacugua

SEQ ID NO: 503340 - RNA, 21 nt, Homo sapiens
ucacugcugcaaauacuguau

SEQ ID NO: 503341 - RNA, 21 nt, Homo sapiens
ucagaacaaugaaaaaagucu

SEQ ID NO: 503342 - RNA, 23 nt, Homo sapiens
ucagagugacuacacacaguacg

SEQ ID NO: 503343 - RNA, 21 nt, Homo sapiens
ucagcaaguuagaacuagcca

SEQ ID NO: 503344 - RNA, 18 nt, Homo sapiens
cucuaacauaccuuguca

SEQ ID NO: 503345 - RNA, 17 nt, Homo sapiens
cucuaaccaaggcugug

SEQ ID NO: 503346 - RNA, 11 nt, Homo sapiens
cucuuccucac

SEQ ID NO: 503347 - RNA, 15 nt, Homo sapiens
cucuucuuccucacc

SEQ ID NO: 503348 - RNA, 22 nt, Homo sapiens
cucuugccaaaaaauagcacac

SEQ ID NO: 503349 - RNA, 18 nt, Homo sapiens
cugaacccacaccugggc

SEQ ID NO: 503350 - RNA, 16 nt, Homo sapiens
cugaaucugcuaccaa

SEQ ID NO: 503351 - RNA, 13 nt, Homo sapiens
cugagaaacacua

SEQ ID NO: 503352 - RNA, 22 nt, Homo sapiens
cugaggcaggagaauugcuuga

SEQ ID NO: 503353 - RNA, 18 nt, Homo sapiens
cugauacuuugacagugu

SEQ ID NO: 503354 - RNA, 16 nt, Homo sapiens
cugauuaggaauauga

SEQ ID NO: 503355 - RNA, 12 nt, Homo sapiens
gauguugcucag

SEQ ID NO: 503356 - RNA, 20 nt, Homo sapiens
gauuagguguucaggccagu

SEQ ID NO: 503357 - RNA, 13 nt, Homo sapiens
gauugaacuuucc

SEQ ID NO: 503358 - RNA, 16 nt, Homo sapiens
gauuuaauccaguuau

SEQ ID NO: 503359 - RNA, 22 nt, Homo sapiens
gauuugauugggaugaaugcca

SEQ ID NO: 503360 - RNA, 15 nt, Homo sapiens
gcaaaacuuaggcau

SEQ ID NO: 503361 - RNA, 18 nt, Homo sapiens
gcaaacagaaaaagaagg

SEQ ID NO: 503362 - RNA, 13 nt, Homo sapiens
gcaaauacuguau

SEQ ID NO: 503363 - RNA, 16 nt, Homo sapiens
gcaaaugccugacuca

SEQ ID NO: 503364 - RNA, 14 nt, Homo sapiens
gcaacagacuugaa

SEQ ID NO: 503365 - RNA, 23 nt, Homo sapiens
gcaauacugcuuaauugcugaua

SEQ ID NO: 503366 - RNA, 15 nt, Homo sapiens
gcaaucugacccuau

SEQ ID NO: 503367 - RNA, 20 nt, Homo sapiens
gcacaauuuaaaacaauccu

SEQ ID NO: 503368 - RNA, 19 nt, Homo sapiens
gcacacuuuuccacauucc

SEQ ID NO: 503369 - RNA, 21 nt, Homo sapiens
gcacauauccaggcaccagga

SEQ ID NO: 503370 - RNA, 13 nt, Homo sapiens
gcagacaaccuca

SEQ ID NO: 503371 - RNA, 15 nt, Homo sapiens
gcagcaucugcucca

SEQ ID NO: 503372 - RNA, 17 nt, Homo sapiens
gcaggagaauugcuuga

SEQ ID NO: 503373 - RNA, 20 nt, Homo sapiens
gcaggauauuugcacuauuu

SEQ ID NO: 503374 - RNA, 23 nt, Homo sapiens
gcaggcaagugggauaaaggccc

SEQ ID NO: 503375 - RNA, 21 nt, Homo sapiens
gcagugagcuguguucuugcc

SEQ ID NO: 503376 - RNA, 21 nt, Homo sapiens
gcauaauguuucuggauuuca

SEQ ID NO: 503377 - RNA, 18 nt, Homo sapiens
gcauugucuguaaugaca

SEQ ID NO: 503378 - RNA, 14 nt, Homo sapiens
gccaaaaccuuuca

SEQ ID NO: 503379 - RNA, 16 nt, Homo sapiens
gccaaucuguacaaaa

SEQ ID NO: 503380 - RNA, 18 nt, Homo sapiens
gccagagcaaacagaaaa

SEQ ID NO: 503381 - RNA, 21 nt, Homo sapiens
gccauaaacgguuccugguga

SEQ ID NO: 503382 - RNA, 15 nt, Homo sapiens
gccccagccuaggaa

SEQ ID NO: 503383 - RNA, 19 nt, Homo sapiens
gccuccuggaaucaguauu

SEQ ID NO: 503384 - RNA, 13 nt, Homo sapiens
gccugacaacuca

SEQ ID NO: 503385 - RNA, 23 nt, Homo sapiens
gccuuccuggaggugacacuuga

SEQ ID NO: 503386 - RNA, 23 nt, Homo sapiens
gccuuuucuggucccucuucucu

SEQ ID NO: 503387 - RNA, 13 nt, Homo sapiens
gcgccuggugcug

SEQ ID NO: 503388 - RNA, 20 nt, Homo sapiens
gcgguucauacgcaucccau

SEQ ID NO: 503389 - RNA, 23 nt, Homo sapiens
gcuccugauggugucauucugcc

SEQ ID NO: 503390 - RNA, 22 nt, Homo sapiens
gcugaguuucucuuggguauaa

SEQ ID NO: 503391 - RNA, 17 nt, Homo sapiens
gcuuaaugcuacaugug

SEQ ID NO: 503392 - RNA, 22 nt, Homo sapiens
gcuucagguuagugacauuuaa

SEQ ID NO: 503393 - RNA, 22 nt, Homo sapiens
ggaaagagccuaacaucuccau

SEQ ID NO: 503394 - RNA, 16 nt, Homo sapiens
ggaaagccaguuacau

SEQ ID NO: 503395 - RNA, 20 nt, Homo sapiens
ggaagccccugggcccagua

SEQ ID NO: 503396 - RNA, 22 nt, Homo sapiens
ggaaggucucaggagaagggau

SEQ ID NO: 503397 - RNA, 16 nt, Homo sapiens
ggaaguuaaagggcau

SEQ ID NO: 503398 - RNA, 22 nt, Homo sapiens
ggaauaugaccauuugacuguu

SEQ ID NO: 503399 - RNA, 16 nt, Homo sapiens
ggaaucucauccauca

SEQ ID NO: 503400 - RNA, 15 nt, Homo sapiens
ggaauuccucuauga

SEQ ID NO: 503401 - RNA, 13 nt, Homo sapiens
ggaccuaccuccc

SEQ ID NO: 503402 - RNA, 19 nt, Homo sapiens
ggaggggucccugcaaaac

SEQ ID NO: 503403 - RNA, 17 nt, Homo sapiens
ggagguaguuaagggau

SEQ ID NO: 503404 - RNA, 22 nt, Homo sapiens
ggaggugaaaucccugccucag

SEQ ID NO: 503405 - RNA, 13 nt, Homo sapiens
ggauacuggcaca

SEQ ID NO: 503406 - RNA, 15 nt, Homo sapiens
ggauauuuaguucaa

SEQ ID NO: 503407 - RNA, 20 nt, Homo sapiens
ggauauuuugaaaugaacuu

SEQ ID NO: 503408 - RNA, 16 nt, Homo sapiens
ggauuucauacuguaa

SEQ ID NO: 503409 - RNA, 18 nt, Homo sapiens
ggcaaaugccugacucag

SEQ ID NO: 503410 - RNA, 22 nt, Homo sapiens
ggcacccacaaauaaaugacaa

SEQ ID NO: 503411 - RNA, 18 nt, Homo sapiens
ggcaccguauuccucucc

SEQ ID NO: 503412 - RNA, 17 nt, Homo sapiens
ggccacauagaugcuga

SEQ ID NO: 503413 - RNA, 21 nt, Homo sapiens
ggccacauagaugcugaugga

SEQ ID NO: 503414 - RNA, 19 nt, Homo sapiens
ggccauaaacgguuccugg

SEQ ID NO: 503415 - RNA, 13 nt, Homo sapiens
ggccccaucucca

SEQ ID NO: 503416 - RNA, 23 nt, Homo sapiens
ggcuaauuuaacaagaacuuuaa

SEQ ID NO: 503417 - RNA, 15 nt, Homo sapiens
ggcucuaauguacaa

SEQ ID NO: 503418 - RNA, 13 nt, Homo sapiens
ggcucuagggccu

SEQ ID NO: 503419 - RNA, 23 nt, Homo sapiens
ggcugcccaccuggcugccaaca

SEQ ID NO: 503420 - RNA, 21 nt, Homo sapiens
ggcuucagguuagugacauuu

SEQ ID NO: 503421 - RNA, 19 nt, Homo sapiens
gggaaacaaauaauuugaa

SEQ ID NO: 503422 - RNA, 18 nt, Homo sapiens
gggaagagacagcccagg

SEQ ID NO: 503423 - RNA, 12 nt, Homo sapiens
gggcaucagggc

SEQ ID NO: 503424 - RNA, 12 nt, Homo sapiens
gggccaccuccu

SEQ ID NO: 503425 - RNA, 24 nt, Homo sapiens
gggccuuucuccuccccaccugua

SEQ ID NO: 503426 - RNA, 22 nt, Homo sapiens
gggggagcugcagucccaugca

SEQ ID NO: 503427 - RNA, 23 nt, Homo sapiens
ggguaccuaguccccagccugcu

SEQ ID NO: 503428 - RNA, 18 nt, Homo sapiens
gguccagggagggguccc

SEQ ID NO: 503429 - RNA, 16 nt, Homo sapiens
ggucuaagguucagcc

SEQ ID NO: 503430 - RNA, 21 nt, Homo sapiens
gguggaggcagaggugacagu

SEQ ID NO: 503431 - RNA, 13 nt, Homo sapiens
gguuauauguaua

SEQ ID NO: 503432 - RNA, 24 nt, Homo sapiens
gguucuguagagccaauuagacuu

SEQ ID NO: 503433 - RNA, 12 nt, Homo sapiens
guaaaacagggc

SEQ ID NO: 503434 - RNA, 18 nt, Homo sapiens
guaaaaggauaguaagca

SEQ ID NO: 503435 - RNA, 11 nt, Homo sapiens
guaacuacuuc

SEQ ID NO: 503436 - RNA, 17 nt, Homo sapiens
guaagcuaucugugcag

SEQ ID NO: 503437 - RNA, 18 nt, Homo sapiens
guaauaaaugugacucag

SEQ ID NO: 503438 - RNA, 19 nt, Homo sapiens
guacaaaaauuaugcaauu

SEQ ID NO: 503439 - RNA, 18 nt, Homo sapiens
guacaauaaagcaaugug

SEQ ID NO: 503440 - RNA, 19 nt, Homo sapiens
guacaauaaagcaaugugg

SEQ ID NO: 503441 - RNA, 15 nt, Homo sapiens
guacgaugacagugu

SEQ ID NO: 503442 - RNA, 17 nt, Homo sapiens
guacugugucucaugga

SEQ ID NO: 503443 - RNA, 15 nt, Homo sapiens
guagugccacuguug

SEQ ID NO: 503444 - RNA, 18 nt, Homo sapiens
guauaguuuuauuuacuu

SEQ ID NO: 503445 - RNA, 19 nt, Homo sapiens
guauauuacccaauggaaa

SEQ ID NO: 503446 - RNA, 18 nt, Homo sapiens
guaucauguauggugaua

SEQ ID NO: 503447 - RNA, 15 nt, Homo sapiens
guaucuugauaucuc

SEQ ID NO: 503448 - RNA, 14 nt, Homo sapiens
guauugaucaaugc

SEQ ID NO: 503449 - RNA, 15 nt, Homo sapiens
guauuuccuuccacu

SEQ ID NO: 503450 - RNA, 20 nt, Homo sapiens
gucaaagauacacaaucuga

SEQ ID NO: 503451 - RNA, 19 nt, Homo sapiens
gucagcugcuguugaacuu

SEQ ID NO: 503452 - RNA, 20 nt, Homo sapiens
guccaacagacacaauuuau

SEQ ID NO: 503453 - RNA, 15 nt, Homo sapiens
guccugccuccucau

SEQ ID NO: 503454 - RNA, 18 nt, Homo sapiens
ccaaaaguguugacugug

SEQ ID NO: 503455 - RNA, 16 nt, Homo sapiens
ccaaacauguucccaa

SEQ ID NO: 503456 - RNA, 18 nt, Homo sapiens
ccaaacucauaacagucu

SEQ ID NO: 503457 - RNA, 15 nt, Homo sapiens
ccaacuuuuucauag

SEQ ID NO: 503458 - RNA, 22 nt, Homo sapiens
ccaaggaaaggcauguacaaaa

SEQ ID NO: 503459 - RNA, 11 nt, Homo sapiens
ccaaggucucc

SEQ ID NO: 503460 - RNA, 18 nt, Homo sapiens
ccaaguauauaugaauga

SEQ ID NO: 503461 - RNA, 20 nt, Homo sapiens
ccaauuaaaaacgaaaaccu

SEQ ID NO: 503462 - RNA, 21 nt, Homo sapiens
ccacagaaggugaacuuugug

SEQ ID NO: 503463 - RNA, 14 nt, Homo sapiens
ccacaggggccaug

SEQ ID NO: 503464 - RNA, 18 nt, Homo sapiens
ccacccgaguaccuccag

SEQ ID NO: 503465 - RNA, 18 nt, Homo sapiens
ccaccuguagcugaagca

SEQ ID NO: 503466 - RNA, 14 nt, Homo sapiens
ccagaagagguaua

SEQ ID NO: 503467 - RNA, 15 nt, Homo sapiens
ccagagcaaacagaa

SEQ ID NO: 503468 - RNA, 18 nt, Homo sapiens
ccagaggcucuaauguac

SEQ ID NO: 503469 - RNA, 20 nt, Homo sapiens
ccagggcaccguauuccucu

SEQ ID NO: 503470 - RNA, 16 nt, Homo sapiens
ccagugccugugagca

SEQ ID NO: 503471 - RNA, 13 nt, Homo sapiens
ccaguguucugca

SEQ ID NO: 503472 - RNA, 22 nt, Homo sapiens
ccauacuagaguucauggauau

SEQ ID NO: 503473 - RNA, 12 nt, Homo sapiens
ccauccugaugg

SEQ ID NO: 503474 - RNA, 23 nt, Homo sapiens
ccaucguauuaaaaaacaauuaa

SEQ ID NO: 503475 - RNA, 14 nt, Homo sapiens
ccauuugacuguuc

SEQ ID NO: 503476 - RNA, 22 nt, Homo sapiens
ccauuugcuuagaaagucugau

SEQ ID NO: 503477 - RNA, 13 nt, Homo sapiens
cccaaucccucuc

SEQ ID NO: 503478 - RNA, 11 nt, Homo sapiens
cccaucuccac

SEQ ID NO: 503479 - RNA, 22 nt, Homo sapiens
cccauucucccagucucugucg

SEQ ID NO: 503480 - RNA, 23 nt, Homo sapiens
ccccagccugcucccuagccaga

SEQ ID NO: 503481 - RNA, 23 nt, Homo sapiens
ccccauggguuuugcuuaggcac

SEQ ID NO: 503482 - RNA, 13 nt, Homo sapiens
cccuccgccaugg

SEQ ID NO: 503483 - RNA, 11 nt, Homo sapiens
cccugcaaaac

SEQ ID NO: 503484 - RNA, 15 nt, Homo sapiens
cccuuguugcacugc

SEQ ID NO: 503485 - RNA, 20 nt, Homo sapiens
cccuuuuaagcaugugaugu

SEQ ID NO: 503486 - RNA, 18 nt, Homo sapiens
ccgaagagaguucuggau

SEQ ID NO: 503487 - RNA, 13 nt, Homo sapiens
ccguuuucugggc

SEQ ID NO: 503488 - RNA, 18 nt, Homo sapiens
ccuaaaaguucucaaugu

SEQ ID NO: 503489 - RNA, 17 nt, Homo sapiens
ccuaaggcacccacaaa

SEQ ID NO: 503490 - RNA, 18 nt, Homo sapiens
ccuacugguguaaucuca

SEQ ID NO: 503491 - RNA, 22 nt, Homo sapiens
ccuaguccccagccugcucccu

SEQ ID NO: 503492 - RNA, 15 nt, Homo sapiens
ccucagaacaaugaa

SEQ ID NO: 503493 - RNA, 17 nt, Homo sapiens
ccucagaacaaugaaaa

SEQ ID NO: 503494 - RNA, 15 nt, Homo sapiens
ccuccccaccuguag

SEQ ID NO: 503495 - RNA, 16 nt, Homo sapiens
ccuccucaucagugug

SEQ ID NO: 503496 - RNA, 13 nt, Homo sapiens
ccuccucauggca

SEQ ID NO: 503497 - RNA, 11 nt, Homo sapiens
ccucuaugaag

SEQ ID NO: 503498 - RNA, 17 nt, Homo sapiens
ccucuugcaaugccuca

SEQ ID NO: 503499 - RNA, 13 nt, Homo sapiens
ccugagcuaaaua

SEQ ID NO: 503500 - RNA, 17 nt, Homo sapiens
ccugcucccuagccaga

SEQ ID NO: 503501 - RNA, 17 nt, Homo sapiens
ccugcuuuccugcagca

SEQ ID NO: 503502 - RNA, 19 nt, Homo sapiens
ccuggcagucucaguccaa

SEQ ID NO: 503503 - RNA, 14 nt, Homo sapiens
ccuggggauuccag

SEQ ID NO: 503504 - RNA, 17 nt, Homo sapiens
ccugucaauacuaugga

SEQ ID NO: 503505 - RNA, 18 nt, Homo sapiens
ccuguccugccuccucau

SEQ ID NO: 503506 - RNA, 15 nt, Homo sapiens
ccugucucccaaaaa

SEQ ID NO: 503507 - RNA, 13 nt, Homo sapiens
ccuuccuauucuc

SEQ ID NO: 503508 - RNA, 19 nt, Homo sapiens
ccuucucuacacucuugua

SEQ ID NO: 503509 - RNA, 17 nt, Homo sapiens
ccuuugcucuugccaaa

SEQ ID NO: 503510 - RNA, 12 nt, Homo sapiens
cgaacuuucaaa

SEQ ID NO: 503511 - RNA, 18 nt, Homo sapiens
cgacuuauuuuguugaaa

SEQ ID NO: 503512 - RNA, 20 nt, Homo sapiens
cgagaucacgccacugcacu

SEQ ID NO: 503513 - RNA, 22 nt, Homo sapiens
cggacccuucuggguccaggga

SEQ ID NO: 503514 - RNA, 13 nt, Homo sapiens
cggcuccugaugg

SEQ ID NO: 503515 - RNA, 15 nt, Homo sapiens
cggcuccugcaaaag

SEQ ID NO: 503516 - RNA, 20 nt, Homo sapiens
cgggagaccccuuguugcac

SEQ ID NO: 503517 - RNA, 19 nt, Homo sapiens
cguauuaaaaaacaauuaa

SEQ ID NO: 503518 - RNA, 15 nt, Homo sapiens
cguccaucucccuua

SEQ ID NO: 503519 - RNA, 13 nt, Homo sapiens
cuaaauaugagcc

SEQ ID NO: 503520 - RNA, 16 nt, Homo sapiens
cuaaauaugagcccag

SEQ ID NO: 503521 - RNA, 20 nt, Homo sapiens
cuaaauguguaauaauguaa

SEQ ID NO: 503522 - RNA, 23 nt, Homo sapiens
cuaaauuauuuacugcaaaaaga

SEQ ID NO: 503523 - RNA, 15 nt, Homo sapiens
cuaacaggccaaaga

SEQ ID NO: 503524 - RNA, 13 nt, Homo sapiens
cuaacaucuccau

SEQ ID NO: 503525 - RNA, 17 nt, Homo sapiens
cuaacuagcauuguaaa

SEQ ID NO: 503526 - RNA, 20 nt, Homo sapiens
cuaauguacaauaaagcaau

SEQ ID NO: 503527 - RNA, 21 nt, Homo sapiens
cuaauguacaauaaagcaaug

SEQ ID NO: 503528 - RNA, 17 nt, Homo sapiens
cuagaguucauggauau

SEQ ID NO: 503529 - RNA, 19 nt, Homo sapiens
cuagcaacauuuguuuuag

SEQ ID NO: 503530 - RNA, 12 nt, Homo sapiens
cuagcauuguaa

SEQ ID NO: 503531 - RNA, 14 nt, Homo sapiens
cuaggcugagcaau

SEQ ID NO: 503532 - RNA, 15 nt, Homo sapiens
cuaugacuguaucuu

SEQ ID NO: 503533 - RNA, 21 nt, Homo sapiens
cuaugauuguccguaggccca

SEQ ID NO: 503534 - RNA, 24 nt, Homo sapiens
cuaugccagcaaccuuguaagcua

SEQ ID NO: 503535 - RNA, 16 nt, Homo sapiens
cuauucuccugccaug

SEQ ID NO: 503536 - RNA, 16 nt, Homo sapiens
cucaaaccacuugccu

SEQ ID NO: 503537 - RNA, 19 nt, Homo sapiens
cucaaucccugaggacuga

SEQ ID NO: 503538 - RNA, 12 nt, Homo sapiens
cucacacacaaa

SEQ ID NO: 503539 - RNA, 23 nt, Homo sapiens
cucacugcugcaaauacuguaua

SEQ ID NO: 503540 - RNA, 15 nt, Homo sapiens
cucaggagaagggau

SEQ ID NO: 503541 - RNA, 19 nt, Homo sapiens
cucaggccaagggaccagg

SEQ ID NO: 503542 - RNA, 20 nt, Homo sapiens
cuccagauaguguagcugag

SEQ ID NO: 503543 - RNA, 20 nt, Homo sapiens
cuccccuguucauucugcau

SEQ ID NO: 503544 - RNA, 21 nt, Homo sapiens
cucccugggccaccuccuacc

SEQ ID NO: 503545 - RNA, 18 nt, Homo sapiens
cuccgcgggagaccccuu

SEQ ID NO: 503546 - RNA, 17 nt, Homo sapiens
cuccucaguuucucaaa

SEQ ID NO: 503547 - RNA, 17 nt, Homo sapiens
cuccuggaccaggucuc

SEQ ID NO: 503548 - RNA, 16 nt, Homo sapiens
cuccuguuccauuuca

SEQ ID NO: 503549 - RNA, 16 nt, Homo sapiens
cuccuguuuugcacag

SEQ ID NO: 503550 - RNA, 19 nt, Homo sapiens
auuuuguuauugacuaaca

SEQ ID NO: 503551 - RNA, 18 nt, Homo sapiens
caaaaaauagcacacuuu

SEQ ID NO: 503552 - RNA, 15 nt, Homo sapiens
caaaacccacagaag

SEQ ID NO: 503553 - RNA, 16 nt, Homo sapiens
caaaacccacagaaga

SEQ ID NO: 503554 - RNA, 17 nt, Homo sapiens
caaauaauuugaacuuu

SEQ ID NO: 503555 - RNA, 15 nt, Homo sapiens
caaauacacauuugc

SEQ ID NO: 503556 - RNA, 17 nt, Homo sapiens
caaauacacauuugcua

SEQ ID NO: 503557 - RNA, 21 nt, Homo sapiens
caaauacuguauauucaggac

SEQ ID NO: 503558 - RNA, 16 nt, Homo sapiens
caacauuuguuuuagu

SEQ ID NO: 503559 - RNA, 16 nt, Homo sapiens
caaccucaggcuccua

SEQ ID NO: 503560 - RNA, 11 nt, Homo sapiens
caacuaccuga

SEQ ID NO: 503561 - RNA, 16 nt, Homo sapiens
caacucauuuucauau

SEQ ID NO: 503562 - RNA, 15 nt, Homo sapiens
caagaaacacauucu

SEQ ID NO: 503563 - RNA, 18 nt, Homo sapiens
caagagauaagucuuuca

SEQ ID NO: 503564 - RNA, 19 nt, Homo sapiens
caagagauaagucuuucau

SEQ ID NO: 503565 - RNA, 13 nt, Homo sapiens
caaggugugaugg

SEQ ID NO: 503566 - RNA, 17 nt, Homo sapiens
caaguauauaugaauga

SEQ ID NO: 503567 - RNA, 13 nt, Homo sapiens
caauaaagcaaug

SEQ ID NO: 503568 - RNA, 14 nt, Homo sapiens
caauaaagcaaugu

SEQ ID NO: 503569 - RNA, 17 nt, Homo sapiens
caauaaagcaauguggu

SEQ ID NO: 503570 - RNA, 18 nt, Homo sapiens
caauaaagcaauguggua

SEQ ID NO: 503571 - RNA, 20 nt, Homo sapiens
caauaauaaaguacuugacu

SEQ ID NO: 503572 - RNA, 19 nt, Homo sapiens
caaucccucuccacucuuc

SEQ ID NO: 503573 - RNA, 13 nt, Homo sapiens
caaucguaaaauu

SEQ ID NO: 503574 - RNA, 18 nt, Homo sapiens
caaucugaaacagcuuca

SEQ ID NO: 503575 - RNA, 14 nt, Homo sapiens
caaucuuugacaau

SEQ ID NO: 503576 - RNA, 16 nt, Homo sapiens
caaugacugagcagca

SEQ ID NO: 503577 - RNA, 19 nt, Homo sapiens
caaugacugagcagcaucc

SEQ ID NO: 503578 - RNA, 14 nt, Homo sapiens
caauguuuuagaau

SEQ ID NO: 503579 - RNA, 20 nt, Homo sapiens
caauuaacugcccucugaaa

SEQ ID NO: 503580 - RNA, 16 nt, Homo sapiens
cacaaagguuaaguua

SEQ ID NO: 503581 - RNA, 13 nt, Homo sapiens
cacacacacacga

SEQ ID NO: 503582 - RNA, 17 nt, Homo sapiens
cacacacgaugcauuua

SEQ ID NO: 503583 - RNA, 18 nt, Homo sapiens
cacacuuuuccacauucc

SEQ ID NO: 503584 - RNA, 15 nt, Homo sapiens
cacagcaucagcuca

SEQ ID NO: 503585 - RNA, 19 nt, Homo sapiens
cacagcaucagcucaagac

SEQ ID NO: 503586 - RNA, 16 nt, Homo sapiens
cacagccaaccuagcu

SEQ ID NO: 503587 - RNA, 23 nt, Homo sapiens
cacagccaaccuagcuagcaaca

SEQ ID NO: 503588 - RNA, 20 nt, Homo sapiens
cacauggaaucaaucuuuaa

SEQ ID NO: 503589 - RNA, 23 nt, Homo sapiens
cacauggaaucaaucuuuaacaa

SEQ ID NO: 503590 - RNA, 17 nt, Homo sapiens
caccuguagcugaagca

SEQ ID NO: 503591 - RNA, 20 nt, Homo sapiens
cacgaguuuggauguuguaa

SEQ ID NO: 503592 - RNA, 14 nt, Homo sapiens
cacgaugcauuuaa

SEQ ID NO: 503593 - RNA, 11 nt, Homo sapiens
cacuguagcua

SEQ ID NO: 503594 - RNA, 19 nt, Homo sapiens
cacuuugggaggcugaggu

SEQ ID NO: 503595 - RNA, 13 nt, Homo sapiens
cagaaaaagaagg

SEQ ID NO: 503596 - RNA, 23 nt, Homo sapiens
cagaaagaugguagggagcauuu

SEQ ID NO: 503597 - RNA, 22 nt, Homo sapiens
cagaaagcuucauccacagccu

SEQ ID NO: 503598 - RNA, 21 nt, Homo sapiens
cagaaaugcccccauucuccc

SEQ ID NO: 503599 - RNA, 20 nt, Homo sapiens
cagaagaaaauuugccaauc

SEQ ID NO: 503600 - RNA, 16 nt, Homo sapiens
cagaauuuuuaacugu

SEQ ID NO: 503601 - RNA, 16 nt, Homo sapiens
cagacagaaggugcua

SEQ ID NO: 503602 - RNA, 14 nt, Homo sapiens
cagacccugaaccc

SEQ ID NO: 503603 - RNA, 16 nt, Homo sapiens
cagagcgcacagggag

SEQ ID NO: 503604 - RNA, 21 nt, Homo sapiens
cagagcugcugcacacacuca

SEQ ID NO: 503605 - RNA, 14 nt, Homo sapiens
cagaggcucuaaug

SEQ ID NO: 503606 - RNA, 17 nt, Homo sapiens
cagaggcucuaauguac

SEQ ID NO: 503607 - RNA, 22 nt, Homo sapiens
cagaggcucuaauguacaauaa

SEQ ID NO: 503608 - RNA, 12 nt, Homo sapiens
cagaucuuucag

SEQ ID NO: 503609 - RNA, 17 nt, Homo sapiens
cagaugaugcuuuggaa

SEQ ID NO: 503610 - RNA, 14 nt, Homo sapiens
cagauuauaccugg

SEQ ID NO: 503611 - RNA, 23 nt, Homo sapiens
cagcagccccaggagaaggggcu

SEQ ID NO: 503612 - RNA, 16 nt, Homo sapiens
cagcaggaagccauag

SEQ ID NO: 503613 - RNA, 15 nt, Homo sapiens
cagcauguccaacau

SEQ ID NO: 503614 - RNA, 12 nt, Homo sapiens
cagccuagccua

SEQ ID NO: 503615 - RNA, 17 nt, Homo sapiens
caggaacaaacagggcu

SEQ ID NO: 503616 - RNA, 21 nt, Homo sapiens
caggacuucucaccagcaguc

SEQ ID NO: 503617 - RNA, 17 nt, Homo sapiens
caggagaguguauauga

SEQ ID NO: 503618 - RNA, 18 nt, Homo sapiens
caggagaguguauaugaa

SEQ ID NO: 503619 - RNA, 22 nt, Homo sapiens
caggauauuugcacuauuucca

SEQ ID NO: 503620 - RNA, 21 nt, Homo sapiens
cagggcaaaagggcagcugug

SEQ ID NO: 503621 - RNA, 15 nt, Homo sapiens
cagggccacauagau

SEQ ID NO: 503622 - RNA, 16 nt, Homo sapiens
cagguaaaacagggcc

SEQ ID NO: 503623 - RNA, 21 nt, Homo sapiens
caguacacccaguugccaaag

SEQ ID NO: 503624 - RNA, 22 nt, Homo sapiens
cagucucugucguggagccauu

SEQ ID NO: 503625 - RNA, 19 nt, Homo sapiens
cagugaccagugccuguga

SEQ ID NO: 503626 - RNA, 23 nt, Homo sapiens
caguggugugugaaguuuggaga

SEQ ID NO: 503627 - RNA, 20 nt, Homo sapiens
caguguugccucuugcaaug

SEQ ID NO: 503628 - RNA, 14 nt, Homo sapiens
cauaaaccugugcu

SEQ ID NO: 503629 - RNA, 20 nt, Homo sapiens
cauaaacgguuccuggugac

SEQ ID NO: 503630 - RNA, 21 nt, Homo sapiens
cauaaagauauucuuuagugg

SEQ ID NO: 503631 - RNA, 21 nt, Homo sapiens
cauaauguuucuggauuucau

SEQ ID NO: 503632 - RNA, 14 nt, Homo sapiens
cauacaaguuucau

SEQ ID NO: 503633 - RNA, 19 nt, Homo sapiens
cauauccaggcaccaggac

SEQ ID NO: 503634 - RNA, 12 nt, Homo sapiens
caucacuuugac

SEQ ID NO: 503635 - RNA, 13 nt, Homo sapiens
caucagcuuuauu

SEQ ID NO: 503636 - RNA, 14 nt, Homo sapiens
caucauuucaaucg

SEQ ID NO: 503637 - RNA, 18 nt, Homo sapiens
cauccuccagauagugua

SEQ ID NO: 503638 - RNA, 14 nt, Homo sapiens
caucucucccacuu

SEQ ID NO: 503639 - RNA, 12 nt, Homo sapiens
caucugcuccau

SEQ ID NO: 503640 - RNA, 15 nt, Homo sapiens
caucuuccucugcag

SEQ ID NO: 503641 - RNA, 18 nt, Homo sapiens
caugaacccucuugccau

SEQ ID NO: 503642 - RNA, 14 nt, Homo sapiens
caugcaaaugagcu

SEQ ID NO: 503643 - RNA, 13 nt, Homo sapiens
agggaaugcauua

SEQ ID NO: 503644 - RNA, 15 nt, Homo sapiens
agggagaagagggaa

SEQ ID NO: 503645 - RNA, 13 nt, Homo sapiens
agggcagcuguga

SEQ ID NO: 503646 - RNA, 14 nt, Homo sapiens
agggccucagucug

SEQ ID NO: 503647 - RNA, 20 nt, Homo sapiens
agggcgagacucugucucaa

SEQ ID NO: 503648 - RNA, 22 nt, Homo sapiens
aggggcuuugugaccagaaagc

SEQ ID NO: 503649 - RNA, 14 nt, Homo sapiens
agguaaaacagggc

SEQ ID NO: 503650 - RNA, 17 nt, Homo sapiens
agguacgaugacagugu

SEQ ID NO: 503651 - RNA, 18 nt, Homo sapiens
agguagaagugagcaaaa

SEQ ID NO: 503652 - RNA, 14 nt, Homo sapiens
agguucagccugaa

SEQ ID NO: 503653 - RNA, 13 nt, Homo sapiens
agguugagggcaa

SEQ ID NO: 503654 - RNA, 20 nt, Homo sapiens
agguuguggggccucaggcu

SEQ ID NO: 503655 - RNA, 14 nt, Homo sapiens
aguaagauaucuca

SEQ ID NO: 503656 - RNA, 15 nt, Homo sapiens
aguaagauaucucaa

SEQ ID NO: 503657 - RNA, 18 nt, Homo sapiens
aguacacccaguugccaa

SEQ ID NO: 503658 - RNA, 15 nt, Homo sapiens
aguagauccauuucc

SEQ ID NO: 503659 - RNA, 15 nt, Homo sapiens
aguauauaugaauga

SEQ ID NO: 503660 - RNA, 14 nt, Homo sapiens
aguauguaaguauc

SEQ ID NO: 503661 - RNA, 16 nt, Homo sapiens
aguauguaaguaucac

SEQ ID NO: 503662 - RNA, 14 nt, Homo sapiens
agucccaugcacaa

SEQ ID NO: 503663 - RNA, 17 nt, Homo sapiens
aguccuuugucuaagua

SEQ ID NO: 503664 - RNA, 16 nt, Homo sapiens
agucugauuguagcua

SEQ ID NO: 503665 - RNA, 23 nt, Homo sapiens
agucugguaauaaaugugacuca

SEQ ID NO: 503666 - RNA, 22 nt, Homo sapiens
agugagacaaaaagcacuagua

SEQ ID NO: 503667 - RNA, 16 nt, Homo sapiens
agugauaugcauuucc

SEQ ID NO: 503668 - RNA, 14 nt, Homo sapiens
agugauggucagag

SEQ ID NO: 503669 - RNA, 16 nt, Homo sapiens
agugaugugugagcua

SEQ ID NO: 503670 - RNA, 23 nt, Homo sapiens
aguguguaaauaauuugcacuga

SEQ ID NO: 503671 - RNA, 19 nt, Homo sapiens
aguuauuuguucauuauuu

SEQ ID NO: 503672 - RNA, 14 nt, Homo sapiens
aguucaacuguaua

SEQ ID NO: 503673 - RNA, 14 nt, Homo sapiens
aguuuagugugaua

SEQ ID NO: 503674 - RNA, 16 nt, Homo sapiens
auaaaaguuggcucag

SEQ ID NO: 503675 - RNA, 22 nt, Homo sapiens
auaaaggcccagacuccauggu

SEQ ID NO: 503676 - RNA, 17 nt, Homo sapiens
auaaaucauuaagacaa

SEQ ID NO: 503677 - RNA, 11 nt, Homo sapiens
auaacaguguu

SEQ ID NO: 503678 - RNA, 22 nt, Homo sapiens
auaacuauugauauaauuucca

SEQ ID NO: 503679 - RNA, 15 nt, Homo sapiens
auaaugaucagcaaa

SEQ ID NO: 503680 - RNA, 13 nt, Homo sapiens
auaauuugcacug

SEQ ID NO: 503681 - RNA, 14 nt, Homo sapiens
auaauuugcacuga

SEQ ID NO: 503682 - RNA, 18 nt, Homo sapiens
auacugaaccaggccaga

SEQ ID NO: 503683 - RNA, 18 nt, Homo sapiens
auacuguauauucaggac

SEQ ID NO: 503684 - RNA, 22 nt, Homo sapiens
auagccuccaaacauguuccca

SEQ ID NO: 503685 - RNA, 17 nt, Homo sapiens
auagucccagcuacuca

SEQ ID NO: 503686 - RNA, 21 nt, Homo sapiens
auauaauuuccauagugugag

SEQ ID NO: 503687 - RNA, 22 nt, Homo sapiens
auauacuuauagaauucaguca

SEQ ID NO: 503688 - RNA, 22 nt, Homo sapiens
auauagaaugaucuauugcuca

SEQ ID NO: 503689 - RNA, 12 nt, Homo sapiens
auaugacugcau

SEQ ID NO: 503690 - RNA, 17 nt, Homo sapiens
auauguauuucuauaua

SEQ ID NO: 503691 - RNA, 17 nt, Homo sapiens
auauuacugacauuucu

SEQ ID NO: 503692 - RNA, 16 nt, Homo sapiens
auauuuuuuuaacugu

SEQ ID NO: 503693 - RNA, 19 nt, Homo sapiens
aucaaugcauguuacccau

SEQ ID NO: 503694 - RNA, 18 nt, Homo sapiens
aucacauucccauuugcu

SEQ ID NO: 503695 - RNA, 19 nt, Homo sapiens
aucagggccuuucuccucc

SEQ ID NO: 503696 - RNA, 16 nt, Homo sapiens
aucaguugaggccagg

SEQ ID NO: 503697 - RNA, 16 nt, Homo sapiens
aucaucucuuccucac

SEQ ID NO: 503698 - RNA, 23 nt, Homo sapiens
aucauguauggugauagguaucu

SEQ ID NO: 503699 - RNA, 23 nt, Homo sapiens
auccaaaaauguguaagaacaac

SEQ ID NO: 503700 - RNA, 18 nt, Homo sapiens
aucuauugcucaucagcu

SEQ ID NO: 503701 - RNA, 22 nt, Homo sapiens
aucucaaugaaccauaaauuca

SEQ ID NO: 503702 - RNA, 16 nt, Homo sapiens
aucucauccaucacag

SEQ ID NO: 503703 - RNA, 15 nt, Homo sapiens
aucucucccacuucc

SEQ ID NO: 503704 - RNA, 14 nt, Homo sapiens
aucucuuccucaca

SEQ ID NO: 503705 - RNA, 14 nt, Homo sapiens
aucugaaugcuaua

SEQ ID NO: 503706 - RNA, 19 nt, Homo sapiens
aucuucuuuggacuucuga

SEQ ID NO: 503707 - RNA, 21 nt, Homo sapiens
aucuuugcuguauacuuuuaa

SEQ ID NO: 503708 - RNA, 16 nt, Homo sapiens
augaaaaaagucucca

SEQ ID NO: 503709 - RNA, 13 nt, Homo sapiens
augaaacaucauu

SEQ ID NO: 503710 - RNA, 18 nt, Homo sapiens
augaaagaaaauugaguu

SEQ ID NO: 503711 - RNA, 16 nt, Homo sapiens
augaauaaagcaucca

SEQ ID NO: 503712 - RNA, 14 nt, Homo sapiens
augacuguaucuug

SEQ ID NO: 503713 - RNA, 21 nt, Homo sapiens
augagcuuuuuauucuacuac

SEQ ID NO: 503714 - RNA, 13 nt, Homo sapiens
augauaugaccag

SEQ ID NO: 503715 - RNA, 17 nt, Homo sapiens
augcaaacaaaauccaa

SEQ ID NO: 503716 - RNA, 20 nt, Homo sapiens
augcaaacaaaauccaagau

SEQ ID NO: 503717 - RNA, 17 nt, Homo sapiens
augcauacaaguuucau

SEQ ID NO: 503718 - RNA, 14 nt, Homo sapiens
augggucuaggaca

SEQ ID NO: 503719 - RNA, 16 nt, Homo sapiens
augguaauaagcacug

SEQ ID NO: 503720 - RNA, 22 nt, Homo sapiens
augucuccuuugcucuugccaa

SEQ ID NO: 503721 - RNA, 13 nt, Homo sapiens
augucuggcucaa

SEQ ID NO: 503722 - RNA, 13 nt, Homo sapiens
augugaagucucu

SEQ ID NO: 503723 - RNA, 12 nt, Homo sapiens
augugacucagc

SEQ ID NO: 503724 - RNA, 18 nt, Homo sapiens
augugcuauacacacaca

SEQ ID NO: 503725 - RNA, 13 nt, Homo sapiens
auguuaaagggau

SEQ ID NO: 503726 - RNA, 17 nt, Homo sapiens
auuaagcaaauguuaaa

SEQ ID NO: 503727 - RNA, 19 nt, Homo sapiens
auucacaaagguuaaguua

SEQ ID NO: 503728 - RNA, 18 nt, Homo sapiens
auuccagcugucuugucu

SEQ ID NO: 503729 - RNA, 20 nt, Homo sapiens
auuccucagaacaaugaaaa

SEQ ID NO: 503730 - RNA, 22 nt, Homo sapiens
auucuaacccagguauccaaaa

SEQ ID NO: 503731 - RNA, 21 nt, Homo sapiens
auucucuagucaguuggcuaa

SEQ ID NO: 503732 - RNA, 20 nt, Homo sapiens
auugacuaacaggccaaaga

SEQ ID NO: 503733 - RNA, 15 nt, Homo sapiens
auugauauaauuucc

SEQ ID NO: 503734 - RNA, 14 nt, Homo sapiens
ggucaucacuuuga

SEQ ID NO: 503735 - RNA, 22 nt, Homo sapiens
ggucccagccugguuugcaaag

SEQ ID NO: 503736 - RNA, 20 nt, Homo sapiens
ggucccucuucucuccucag

SEQ ID NO: 503737 - RNA, 14 nt, Homo sapiens
ggugaaaucccugc

SEQ ID NO: 503738 - RNA, 12 nt, Homo sapiens
gguuaaguuaaa

SEQ ID NO: 503739 - RNA, 15 nt, Homo sapiens
gguuccccaauccau

SEQ ID NO: 503740 - RNA, 15 nt, Homo sapiens
gguugggcagccaga

SEQ ID NO: 503741 - RNA, 18 nt, Homo sapiens
guaaaauuuaaaucauau

SEQ ID NO: 503742 - RNA, 12 nt, Homo sapiens
guaaauguuucu

SEQ ID NO: 503743 - RNA, 21 nt, Homo sapiens
guaagacccuuauugcugucc

SEQ ID NO: 503744 - RNA, 17 nt, Homo sapiens
guacaauaaagcaaugu

SEQ ID NO: 503745 - RNA, 17 nt, Homo sapiens
guacacccaguugccaa

SEQ ID NO: 503746 - RNA, 19 nt, Homo sapiens
guacagaccaccuuucaca

SEQ ID NO: 503747 - RNA, 17 nt, Homo sapiens
guaccugcuggguguuu

SEQ ID NO: 503748 - RNA, 20 nt, Homo sapiens
guacuaacuagcauuguaaa

SEQ ID NO: 503749 - RNA, 15 nt, Homo sapiens
guagcaucuuccucu

SEQ ID NO: 503750 - RNA, 20 nt, Homo sapiens
guagggaaucucauccauca

SEQ ID NO: 503751 - RNA, 15 nt, Homo sapiens
guaguaccccaagaa

SEQ ID NO: 503752 - RNA, 22 nt, Homo sapiens
guauaacuggauugcagacugu

SEQ ID NO: 503753 - RNA, 23 nt, Homo sapiens
guauaacuggauugcagacuguu

SEQ ID NO: 503754 - RNA, 17 nt, Homo sapiens
gucaauguccuacugag

SEQ ID NO: 503755 - RNA, 22 nt, Homo sapiens
gucaguguugccucuugcaaug

SEQ ID NO: 503756 - RNA, 13 nt, Homo sapiens
guccaaggucucc

SEQ ID NO: 503757 - RNA, 20 nt, Homo sapiens
guccccagccugcucccuag

SEQ ID NO: 503758 - RNA, 22 nt, Homo sapiens
guccccagccugcucccuagcc

SEQ ID NO: 503759 - RNA, 19 nt, Homo sapiens
gucccucuucucuccucag

SEQ ID NO: 503760 - RNA, 22 nt, Homo sapiens
gucccucuucucuccucaguuu

SEQ ID NO: 503761 - RNA, 16 nt, Homo sapiens
gucuauuaauauucag

SEQ ID NO: 503762 - RNA, 20 nt, Homo sapiens
gucuccuuugcucuugccaa

SEQ ID NO: 503763 - RNA, 18 nt, Homo sapiens
gucugauuguagcuauga

SEQ ID NO: 503764 - RNA, 13 nt, Homo sapiens
gucuguuugcauu

SEQ ID NO: 503765 - RNA, 17 nt, Homo sapiens
gugaauaacuaugccag

SEQ ID NO: 503766 - RNA, 16 nt, Homo sapiens
gugagcuaugcaaaca

SEQ ID NO: 503767 - RNA, 15 nt, Homo sapiens
gugagggugcugacu

SEQ ID NO: 503768 - RNA, 22 nt, Homo sapiens
gugauauuguguggucugguuc

SEQ ID NO: 503769 - RNA, 21 nt, Homo sapiens
gugcaggauauuugcacuauu

SEQ ID NO: 503770 - RNA, 16 nt, Homo sapiens
gugccaucagcuccuu

SEQ ID NO: 503771 - RNA, 20 nt, Homo sapiens
gugggcagaucacgagguca

SEQ ID NO: 503772 - RNA, 20 nt, Homo sapiens
guguaagaacaacuaccuga

SEQ ID NO: 503773 - RNA, 15 nt, Homo sapiens
guguauaugaaugaa

SEQ ID NO: 503774 - RNA, 14 nt, Homo sapiens
gugugguugcucac

SEQ ID NO: 503775 - RNA, 14 nt, Homo sapiens
guucccaaaacaau

SEQ ID NO: 503776 - RNA, 16 nt, Homo sapiens
guuccuggugacuccu

SEQ ID NO: 503777 - RNA, 20 nt, Homo sapiens
guuccuuaccucccuggucc

SEQ ID NO: 503778 - RNA, 17 nt, Homo sapiens
guucuaaauaugaauga

SEQ ID NO: 503779 - RNA, 15 nt, Homo sapiens
guuguggggccucag

SEQ ID NO: 503780 - RNA, 22 nt, Homo sapiens
guuuaaagucucaguuucuugc

SEQ ID NO: 503781 - RNA, 22 nt, Homo sapiens
guuuguuggaaaguaacuguga

SEQ ID NO: 503782 - RNA, 17 nt, Homo sapiens
guuuuaacuguggauau

SEQ ID NO: 503783 - RNA, 13 nt, Homo sapiens
guuuuguuucauc

SEQ ID NO: 503784 - RNA, 19 nt, Homo sapiens
uaaaaaaauaaaaaagauc

SEQ ID NO: 503785 - RNA, 15 nt, Homo sapiens
uaaaaauacaaaaau

SEQ ID NO: 503786 - RNA, 15 nt, Homo sapiens
uaaaagguacuggua

SEQ ID NO: 503787 - RNA, 12 nt, Homo sapiens
uaaaaguuggcu

SEQ ID NO: 503788 - RNA, 20 nt, Homo sapiens
uaaacacaaagcuguugaaa

SEQ ID NO: 503789 - RNA, 16 nt, Homo sapiens
uaaacgguuccuggug

SEQ ID NO: 503790 - RNA, 17 nt, Homo sapiens
uaaacgguuccugguga

SEQ ID NO: 503791 - RNA, 16 nt, Homo sapiens
uaaacuauaaccucuc

SEQ ID NO: 503792 - RNA, 17 nt, Homo sapiens
uaaagauguuuauuuca

SEQ ID NO: 503793 - RNA, 13 nt, Homo sapiens
uaaauaacauguu

SEQ ID NO: 503794 - RNA, 23 nt, Homo sapiens
uaaaucauuaagacaacugaguu

SEQ ID NO: 503795 - RNA, 16 nt, Homo sapiens
uaaauuauuuacugca

SEQ ID NO: 503796 - RNA, 15 nt, Homo sapiens
uaacuacuuccugau

SEQ ID NO: 503797 - RNA, 18 nt, Homo sapiens
uaacugcccucugaaaua

SEQ ID NO: 503798 - RNA, 15 nt, Homo sapiens
uaagcaaauguuaaa

SEQ ID NO: 503799 - RNA, 14 nt, Homo sapiens
uaagcaugugaugu

SEQ ID NO: 503800 - RNA, 20 nt, Homo sapiens
uaauaaaggaacugcaucag

SEQ ID NO: 503801 - RNA, 14 nt, Homo sapiens
uaaugcuaaaugug

SEQ ID NO: 503802 - RNA, 15 nt, Homo sapiens
uaaugcuuuguuaaa

SEQ ID NO: 503803 - RNA, 16 nt, Homo sapiens
uaaugguuauauguau

SEQ ID NO: 503804 - RNA, 14 nt, Homo sapiens
uaauguacaauaaa

SEQ ID NO: 503805 - RNA, 18 nt, Homo sapiens
uaaugucuccuuugcucu

SEQ ID NO: 503806 - RNA, 12 nt, Homo sapiens
uaauuaccaugc

SEQ ID NO: 503807 - RNA, 15 nt, Homo sapiens
uaauuguguggauuc

SEQ ID NO: 503808 - RNA, 14 nt, Homo sapiens
uaauuugaacuuug

SEQ ID NO: 503809 - RNA, 20 nt, Homo sapiens
uacaaaaauuagcugggcau

SEQ ID NO: 503810 - RNA, 15 nt, Homo sapiens
uacaacagugagaaa

SEQ ID NO: 503811 - RNA, 18 nt, Homo sapiens
uacaauaaagcaaugugg

SEQ ID NO: 503812 - RNA, 18 nt, Homo sapiens
uacacccaguugccaaag

SEQ ID NO: 503813 - RNA, 16 nt, Homo sapiens
uacagaccaccuuuca

SEQ ID NO: 503814 - RNA, 18 nt, Homo sapiens
uacaugugagugacgaug

SEQ ID NO: 503815 - RNA, 11 nt, Homo sapiens
uaccacuccca

SEQ ID NO: 503816 - RNA, 19 nt, Homo sapiens
uuuggauuauuccucagaa

SEQ ID NO: 503817 - RNA, 22 nt, Homo sapiens
uuuggauucuaaauacaugcca

SEQ ID NO: 503818 - RNA, 17 nt, Homo sapiens
uuuguauaaaaguguga

SEQ ID NO: 503819 - RNA, 19 nt, Homo sapiens
uuugucuaaguagggccag

SEQ ID NO: 503820 - RNA, 17 nt, Homo sapiens
uuuguuugccaggacau

SEQ ID NO: 503821 - RNA, 21 nt, Homo sapiens
uuuguuugccaggacaugcaa

SEQ ID NO: 503822 - RNA, 15 nt, Homo sapiens
uuuuaauuuacuugu

SEQ ID NO: 503823 - RNA, 12 nt, Homo sapiens
uuuuccacauuc

SEQ ID NO: 503824 - RNA, 18 nt, Homo sapiens
uuuucuccggguccuccu

SEQ ID NO: 503825 - RNA, 16 nt, Homo sapiens
uuuucuucuugggaua

SEQ ID NO: 503826 - RNA, 21 nt, Homo sapiens
uuuuguugaaauugucaaaga

SEQ ID NO: 503827 - RNA, 21 nt, Homo sapiens
uuuuuauucuacuacuuggaa

SEQ ID NO: 503828 - RNA, 15 nt, Homo sapiens
uuuuugaaucuauga

SEQ ID NO: 503829 - RNA, 21 nt, Homo sapiens
aaaauuaagaaauucacuucc

SEQ ID NO: 503830 - RNA, 15 nt, Homo sapiens
aaaauuuaaaucaua

SEQ ID NO: 503831 - RNA, 16 nt, Homo sapiens
aaacagaaaaccugau

SEQ ID NO: 503832 - RNA, 16 nt, Homo sapiens
aaacauacgacuuauu

SEQ ID NO: 503833 - RNA, 14 nt, Homo sapiens
aaacaucauuucaa

SEQ ID NO: 503834 - RNA, 12 nt, Homo sapiens
aaaccacuugcc

SEQ ID NO: 503835 - RNA, 15 nt, Homo sapiens
aaacucauaacaguc

SEQ ID NO: 503836 - RNA, 23 nt, Homo sapiens
aaacugcuucccuuacuuugcug

SEQ ID NO: 503837 - RNA, 10 nt, Homo sapiens
aaacuucuca

SEQ ID NO: 503838 - RNA, 19 nt, Homo sapiens
aaagagccuaacaucucca

SEQ ID NO: 503839 - RNA, 16 nt, Homo sapiens
aaagaugaaaaguaua

SEQ ID NO: 503840 - RNA, 17 nt, Homo sapiens
aaagaugcaucaucucu

SEQ ID NO: 503841 - RNA, 19 nt, Homo sapiens
aaagcaaacuuaagaaaca

SEQ ID NO: 503842 - RNA, 17 nt, Homo sapiens
aaagcauccaaguauau

SEQ ID NO: 503843 - RNA, 16 nt, Homo sapiens
aaagcuucacaguacc

SEQ ID NO: 503844 - RNA, 16 nt, Homo sapiens
aaaggaaagauuugcc

SEQ ID NO: 503845 - RNA, 12 nt, Homo sapiens
aaaggaacugca

SEQ ID NO: 503846 - RNA, 16 nt, Homo sapiens
aaagggagaagaggga

SEQ ID NO: 503847 - RNA, 12 nt, Homo sapiens
aaaguauguaag

SEQ ID NO: 503848 - RNA, 16 nt, Homo sapiens
aaaguguucauuguuu

SEQ ID NO: 503849 - RNA, 16 nt, Homo sapiens
aaaguuauuuguucau

SEQ ID NO: 503850 - RNA, 13 nt, Homo sapiens
aaauaaaugacaa

SEQ ID NO: 503851 - RNA, 14 nt, Homo sapiens
aaauaauaacaauc

SEQ ID NO: 503852 - RNA, 15 nt, Homo sapiens
aaauaauuugcacug

SEQ ID NO: 503853 - RNA, 13 nt, Homo sapiens
aaauauagccaaa

SEQ ID NO: 503854 - RNA, 12 nt, Homo sapiens
aaaucaaaaagg

SEQ ID NO: 503855 - RNA, 22 nt, Homo sapiens
aaaucaaaaagggaaugcauua

SEQ ID NO: 503856 - RNA, 15 nt, Homo sapiens
aaaucauuaagacaa

SEQ ID NO: 503857 - RNA, 14 nt, Homo sapiens
aaaugccugacuca

SEQ ID NO: 503858 - RNA, 21 nt, Homo sapiens
aaauggcagggauacccagug

SEQ ID NO: 503859 - RNA, 14 nt, Homo sapiens
aaauucacuucccc

SEQ ID NO: 503860 - RNA, 21 nt, Homo sapiens
aaauuucuguaaaacagguua

SEQ ID NO: 503861 - RNA, 22 nt, Homo sapiens
aaacacauucuuauugacaauu

SEQ ID NO: 503862 - RNA, 22 nt, Homo sapiens
aaacaccaaacucauaacaguc

SEQ ID NO: 503863 - RNA, 13 nt, Homo sapiens
aaacacuauuugu

SEQ ID NO: 503864 - RNA, 12 nt, Homo sapiens
aaacaggccagg

SEQ ID NO: 503865 - RNA, 22 nt, Homo sapiens
aaacagggcugccuucuggccu

SEQ ID NO: 503866 - RNA, 14 nt, Homo sapiens
aaacauacgacuua

SEQ ID NO: 503867 - RNA, 13 nt, Homo sapiens
aaacaucauuuca

SEQ ID NO: 503868 - RNA, 22 nt, Homo sapiens
aaacauuuguuuguggucuaua

SEQ ID NO: 503869 - RNA, 17 nt, Homo sapiens
aaacucuuaaguccuaa

SEQ ID NO: 503870 - RNA, 15 nt, Homo sapiens
aaagagaaguuccca

SEQ ID NO: 503871 - RNA, 23 nt, Homo sapiens
aaagaugcaucaucucuuccuca

SEQ ID NO: 503872 - RNA, 22 nt, Homo sapiens
aaagcacuccugcuuaaucuuc

SEQ ID NO: 503873 - RNA, 20 nt, Homo sapiens
aaagcuggagucugucaaug

SEQ ID NO: 503874 - RNA, 12 nt, Homo sapiens
aaagcuucacag

SEQ ID NO: 503875 - RNA, 19 nt, Homo sapiens
aaaggaaagauuugccaau

SEQ ID NO: 503876 - RNA, 22 nt, Homo sapiens
aaaggaaagauuugccaauuga

SEQ ID NO: 503877 - RNA, 22 nt, Homo sapiens
aaaggaacuauguucacaagaa

SEQ ID NO: 503878 - RNA, 13 nt, Homo sapiens
aaaguacuugacu

SEQ ID NO: 503879 - RNA, 16 nt, Homo sapiens
aaagugauaugcauuu

SEQ ID NO: 503880 - RNA, 15 nt, Homo sapiens
aaauacacauuugcu

SEQ ID NO: 503881 - RNA, 21 nt, Homo sapiens
aaauaccugucaauacuaugg

SEQ ID NO: 503882 - RNA, 14 nt, Homo sapiens
aaauacucugcuau

SEQ ID NO: 503883 - RNA, 20 nt, Homo sapiens
aaauagcacacuuuuccaca

SEQ ID NO: 503884 - RNA, 21 nt, Homo sapiens
aaaucauauccuaugacccag

SEQ ID NO: 503885 - RNA, 19 nt, Homo sapiens
aaaucuucccaugcauucu

SEQ ID NO: 503886 - RNA, 22 nt, Homo sapiens
aaaugacaaccugaauuaucua

SEQ ID NO: 503887 - RNA, 18 nt, Homo sapiens
aaaugcuaugacuguauc

SEQ ID NO: 503888 - RNA, 13 nt, Homo sapiens
aaaugugacucag

SEQ ID NO: 503889 - RNA, 18 nt, Homo sapiens
aaaugugacucagcauca

SEQ ID NO: 503890 - RNA, 15 nt, Homo sapiens
aaauucaacuuugua

SEQ ID NO: 503891 - RNA, 15 nt, Homo sapiens
aaauucuacaacuuu

SEQ ID NO: 503892 - RNA, 14 nt, Homo sapiens
aaauuuaauaccag

SEQ ID NO: 503893 - RNA, 17 nt, Homo sapiens
aaauuugauaaugacac

SEQ ID NO: 503894 - RNA, 12 nt, Homo sapiens
aacaaacagggc

SEQ ID NO: 503895 - RNA, 20 nt, Homo sapiens
aacacauucuuauugacaau

SEQ ID NO: 503896 - RNA, 18 nt, Homo sapiens
aacacugacuccugugga

SEQ ID NO: 503897 - RNA, 13 nt, Homo sapiens
aacagacuugaau

SEQ ID NO: 503898 - RNA, 12 nt, Homo sapiens
aacaugaugaaa

SEQ ID NO: 503899 - RNA, 14 nt, Homo sapiens
aacauguucccaag

SEQ ID NO: 503900 - RNA, 17 nt, Homo sapiens
aaccaggacccugucca

SEQ ID NO: 503901 - RNA, 22 nt, Homo sapiens
aaccuugaaaaaaaacagugga

SEQ ID NO: 503902 - RNA, 20 nt, Homo sapiens
aacgaagaguucccuugaaa

SEQ ID NO: 503903 - RNA, 18 nt, Homo sapiens
aacuagccaaaccaggac

SEQ ID NO: 503904 - RNA, 19 nt, Homo sapiens
aacuauguucacaagaaca

SEQ ID NO: 503905 - RNA, 20 nt, Homo sapiens
aacuggauugcagacuguuc

SEQ ID NO: 503906 - RNA, 16 nt, Homo sapiens
aacuuuggaacagggu

SEQ ID NO: 503907 - RNA, 15 nt, Homo sapiens
aagaaaaaaaccaua

SEQ ID NO: 503908 - RNA, 22 nt, Homo sapiens
aagaagagcgagagaucaaaga

SEQ ID NO: 503909 - RNA, 23 nt, Homo sapiens
aagaaugagacugaacuguguga

SEQ ID NO: 503910 - RNA, 23 nt, Homo sapiens
aagacgucacccuccauucugca

SEQ ID NO: 503911 - RNA, 18 nt, Homo sapiens
aagacuggauuugcagaa

SEQ ID NO: 503912 - RNA, 18 nt, Homo sapiens
aagacugggugaggauaa

SEQ ID NO: 503913 - RNA, 14 nt, Homo sapiens
aagagcuacuccca

SEQ ID NO: 503914 - RNA, 15 nt, Homo sapiens
aagagcuacucccac

SEQ ID NO: 503915 - RNA, 22 nt, Homo sapiens
aagaguucccuugaaacuuugg

SEQ ID NO: 503916 - RNA, 18 nt, Homo sapiens
aagauaaaaugauguuau

SEQ ID NO: 503917 - RNA, 16 nt, Homo sapiens
aagaugcguuugccuc

SEQ ID NO: 503918 - RNA, 17 nt, Homo sapiens
aagauguucacuguggc

SEQ ID NO: 503919 - RNA, 11 nt, Homo sapiens
aagcaaugugg

SEQ ID NO: 503920 - RNA, 12 nt, Homo sapiens
aagcaauguggu

SEQ ID NO: 503921 - RNA, 16 nt, Homo sapiens
aagccggccugagaaa

SEQ ID NO: 503922 - RNA, 20 nt, Homo sapiens
aagccuaagggauccugccu

SEQ ID NO: 503923 - RNA, 21 nt, Homo sapiens
aagcgcggacccuucuggguc

SEQ ID NO: 503924 - RNA, 13 nt, Homo sapiens
aagcuaucugugc

SEQ ID NO: 503925 - RNA, 19 nt, Homo sapiens
aaggaauuaucaauuacaa

SEQ ID NO: 503926 - RNA, 20 nt, Homo sapiens
aaggaccugcucccacaggg

SEQ ID NO: 503927 - RNA, 23 nt, Homo sapiens
aaggauauguggagaaucaucaa

SEQ ID NO: 503928 - RNA, 14 nt, Homo sapiens
aaggcauguacaaa

SEQ ID NO: 503929 - RNA, 23 nt, Homo sapiens
aaggcucagacugggcacugggg

SEQ ID NO: 503930 - RNA, 19 nt, Homo sapiens
aagguuuaugggcauccuc

SEQ ID NO: 503931 - RNA, 21 nt, Homo sapiens
aaguaacugugagaacccagu

SEQ ID NO: 503932 - RNA, 15 nt, Homo sapiens
aaguguugacugugu

SEQ ID NO: 503933 - RNA, 15 nt, Homo sapiens
aauaaagcaaugugg

SEQ ID NO: 503934 - RNA, 16 nt, Homo sapiens
aauaaaugugacucag

SEQ ID NO: 503935 - RNA, 14 nt, Homo sapiens
aauaauuugcacug

SEQ ID NO: 503936 - RNA, 13 nt, Homo sapiens
aauagaacacagu

SEQ ID NO: 503937 - RNA, 17 nt, Homo sapiens
aauaggaacaaucuuug

SEQ ID NO: 503938 - RNA, 22 nt, Homo sapiens
aaucaaucuuuaacaaccucug

SEQ ID NO: 503939 - RNA, 17 nt, Homo sapiens
aauccaagauucugcug

SEQ ID NO: 503940 - RNA, 12 nt, Homo sapiens
aaucuguacaaa

SEQ ID NO: 503941 - RNA, 21 nt, Homo sapiens
aaucuuugcuguauacuuuua

SEQ ID NO: 503942 - RNA, 14 nt, Homo sapiens
aaugaauaaagcau

SEQ ID NO: 503943 - RNA, 21 nt, Homo sapiens
aaugagacugaacugugugaa

SEQ ID NO: 503944 - RNA, 14 nt, Homo sapiens
aaugagacuuacuu

SEQ ID NO: 503945 - RNA, 19 nt, Homo sapiens
aaugagcucugaaaucuuc

SEQ ID NO: 503946 - RNA, 21 nt, Homo sapiens
aaugcuaugacuguaucuuga

SEQ ID NO: 503947 - RNA, 21 nt, Homo sapiens
aauggcagggauacccaguga

SEQ ID NO: 503948 - RNA, 16 nt, Homo sapiens
aauguacaauaaagca

SEQ ID NO: 503949 - RNA, 18 nt, Homo sapiens
aauguccuacugagacag

SEQ ID NO: 503950 - RNA, 18 nt, Homo sapiens
aauuaccaugcuucacaa

SEQ ID NO: 503951 - RNA, 16 nt, Homo sapiens
aauuccuguacugugu

SEQ ID NO: 503952 - RNA, 23 nt, Homo sapiens
aauucuaacccagguauccaaaa

SEQ ID NO: 503953 - RNA, 14 nt, Homo sapiens
aauugcucaugcau

SEQ ID NO: 503954 - RNA, 18 nt, Homo sapiens
aauugucaaagacuguau

SEQ ID NO: 503955 - RNA, 12 nt, Homo sapiens
aauuuaacaaga

SEQ ID NO: 503956 - RNA, 21 nt, Homo sapiens
acaaauaaguggaaaccgugu

SEQ ID NO: 503957 - RNA, 16 nt, Homo sapiens
acaacaauccuucuau

SEQ ID NO: 503958 - RNA, 14 nt, Homo sapiens
acaacagugagaaa

SEQ ID NO: 503959 - RNA, 12 nt, Homo sapiens
acaacuaccuga

SEQ ID NO: 503960 - RNA, 14 nt, Homo sapiens
acaagugagacaaa

SEQ ID NO: 503961 - RNA, 17 nt, Homo sapiens
acaagugagacaaaaag

SEQ ID NO: 503962 - RNA, 13 nt, Homo sapiens
acaauaaagcaau

SEQ ID NO: 503963 - RNA, 14 nt, Homo sapiens
acaaucugaaacag

SEQ ID NO: 503964 - RNA, 22 nt, Homo sapiens
acaauuguaaaauuuaaaucau

SEQ ID NO: 503965 - RNA, 22 nt, Homo sapiens
acacaaucugaaacagcuucau

SEQ ID NO: 503966 - RNA, 14 nt, Homo sapiens
acacacacgaugca

SEQ ID NO: 503967 - RNA, 12 nt, Homo sapiens
acacagcaucag

SEQ ID NO: 503968 - RNA, 14 nt, Homo sapiens
acacagcaucagcu

SEQ ID NO: 503969 - RNA, 15 nt, Homo sapiens
acacagcaucagcuc

SEQ ID NO: 503970 - RNA, 17 nt, Homo sapiens
acacagugcuuuccagc

SEQ ID NO: 503971 - RNA, 12 nt, Homo sapiens
aggccagagcaa

SEQ ID NO: 503972 - RNA, 23 nt, Homo sapiens
aggccuagacucugucuaccugg

SEQ ID NO: 503973 - RNA, 12 nt, Homo sapiens
aggcucuaaugu

SEQ ID NO: 503974 - RNA, 16 nt, Homo sapiens
aggcucuaauguacaa

SEQ ID NO: 503975 - RNA, 19 nt, Homo sapiens
aggcuuguuuaccuuucuc

SEQ ID NO: 503976 - RNA, 19 nt, Homo sapiens
agggaaggucucaggagaa

SEQ ID NO: 503977 - RNA, 18 nt, Homo sapiens
agggaaucucauccauca

SEQ ID NO: 503978 - RNA, 14 nt, Homo sapiens
agggagguggugau

SEQ ID NO: 503979 - RNA, 18 nt, Homo sapiens
agggagugcacauaucca

SEQ ID NO: 503980 - RNA, 13 nt, Homo sapiens
agggccucagucu

SEQ ID NO: 503981 - RNA, 23 nt, Homo sapiens
agguauccaaaaauguguaagaa

SEQ ID NO: 503982 - RNA, 18 nt, Homo sapiens
aggucucuaacauaccuu

SEQ ID NO: 503983 - RNA, 16 nt, Homo sapiens
agguuauggggagaag

SEQ ID NO: 503984 - RNA, 15 nt, Homo sapiens
agguucagccugaaa

SEQ ID NO: 503985 - RNA, 17 nt, Homo sapiens
agguugagggcaaugga

SEQ ID NO: 503986 - RNA, 14 nt, Homo sapiens
aguaagaauaccac

SEQ ID NO: 503987 - RNA, 16 nt, Homo sapiens
aguaagaauaccacau

SEQ ID NO: 503988 - RNA, 19 nt, Homo sapiens
aguacacccaguugccaaa

SEQ ID NO: 503989 - RNA, 23 nt, Homo sapiens
aguauuuccuuccacuguagcua

SEQ ID NO: 503990 - RNA, 12 nt, Homo sapiens
agucccugugaa

SEQ ID NO: 503991 - RNA, 15 nt, Homo sapiens
agucugaacaauaua

SEQ ID NO: 503992 - RNA, 17 nt, Homo sapiens
agucugucaauguccua

SEQ ID NO: 503993 - RNA, 22 nt, Homo sapiens
agugaaguuuuacugucuauua

SEQ ID NO: 503994 - RNA, 14 nt, Homo sapiens
agugaccagugccu

SEQ ID NO: 503995 - RNA, 19 nt, Homo sapiens
agugagaaaccauauuucc

SEQ ID NO: 503996 - RNA, 19 nt, Homo sapiens
agugagcuguguucuugcc

SEQ ID NO: 503997 - RNA, 14 nt, Homo sapiens
agugauaugcauuu

SEQ ID NO: 503998 - RNA, 12 nt, Homo sapiens
agugaugucagg

SEQ ID NO: 503999 - RNA, 15 nt, Homo sapiens
aguguauaugaauga

SEQ ID NO: 504000 - RNA, 13 nt, Homo sapiens
agugugcugggca

SEQ ID NO: 504001 - RNA, 20 nt, Homo sapiens
aguguuccccgauaccaugc

SEQ ID NO: 504002 - RNA, 12 nt, Homo sapiens
aguuaagggaug

SEQ ID NO: 504003 - RNA, 13 nt, Homo sapiens
aguucaacuguau

SEQ ID NO: 504004 - RNA, 14 nt, Homo sapiens
aguugaggccagga

SEQ ID NO: 504005 - RNA, 22 nt, Homo sapiens
aguuguuuuaauaacuuaucua

SEQ ID NO: 504006 - RNA, 13 nt, Homo sapiens
aguuucaguuugu

SEQ ID NO: 504007 - RNA, 17 nt, Homo sapiens
aguuucccguccaucuc

SEQ ID NO: 504008 - RNA, 17 nt, Homo sapiens
aguuuuauuuacuucug

SEQ ID NO: 504009 - RNA, 18 nt, Homo sapiens
auaaaaguguucauuguu

SEQ ID NO: 504010 - RNA, 20 nt, Homo sapiens
auaaacgguuccuggugacu

SEQ ID NO: 504011 - RNA, 23 nt, Homo sapiens
auaaacgguuccuggugacuccu

SEQ ID NO: 504012 - RNA, 14 nt, Homo sapiens
auaaagcauguuca

SEQ ID NO: 504013 - RNA, 14 nt, Homo sapiens
auaaauauacagua

SEQ ID NO: 504014 - RNA, 21 nt, Homo sapiens
auaagaagaaguucaugucca

SEQ ID NO: 504015 - RNA, 14 nt, Homo sapiens
auaagacuacugaa

SEQ ID NO: 504016 - RNA, 13 nt, Homo sapiens
auaagucuuucau

SEQ ID NO: 504017 - RNA, 16 nt, Homo sapiens
auaaugcuuuguuaaa

SEQ ID NO: 504018 - RNA, 16 nt, Homo sapiens
auacuacuacuguuau

SEQ ID NO: 504019 - RNA, 15 nt, Homo sapiens
auacuagaguucaug

SEQ ID NO: 504020 - RNA, 20 nt, Homo sapiens
auacuagaguucauggauau

SEQ ID NO: 504021 - RNA, 19 nt, Homo sapiens
auacugccaaaacauuuau

SEQ ID NO: 504022 - RNA, 18 nt, Homo sapiens
auacuggauacucugcuc

SEQ ID NO: 504023 - RNA, 14 nt, Homo sapiens
auagaauucaguca

SEQ ID NO: 504024 - RNA, 19 nt, Homo sapiens
auagcacacuuuuccacau

SEQ ID NO: 504025 - RNA, 20 nt, Homo sapiens
auagcuacuuuggaggacaa

SEQ ID NO: 504026 - RNA, 21 nt, Homo sapiens
auaggaacaaucuuugcugua

SEQ ID NO: 504027 - RNA, 21 nt, Homo sapiens
auaggacaggaaggaaugcaa

SEQ ID NO: 504028 - RNA, 16 nt, Homo sapiens
auagguggcacuaccc

SEQ ID NO: 504029 - RNA, 17 nt, Homo sapiens
auaguacagacagaagg

SEQ ID NO: 504030 - RNA, 17 nt, Homo sapiens
auauagccaaaaauguc

SEQ ID NO: 504031 - RNA, 22 nt, Homo sapiens
auauccuccuucuccuguucca

SEQ ID NO: 504032 - RNA, 16 nt, Homo sapiens
auauguauauauguau

SEQ ID NO: 504033 - RNA, 18 nt, Homo sapiens
auauguauaucacauucc

SEQ ID NO: 504034 - RNA, 16 nt, Homo sapiens
auauucaggacuugaa

SEQ ID NO: 504035 - RNA, 15 nt, Homo sapiens
auauugaauguuaaa

SEQ ID NO: 504036 - RNA, 15 nt, Homo sapiens
auauuuuguuuacaa

SEQ ID NO: 504037 - RNA, 22 nt, Homo sapiens
aucacaaaggaaagauuugcca

SEQ ID NO: 504038 - RNA, 18 nt, Homo sapiens
aucagggccuuucuccuc

SEQ ID NO: 504039 - RNA, 15 nt, Homo sapiens
auccaagauucugcu

SEQ ID NO: 504040 - RNA, 17 nt, Homo sapiens
auccaggcaccaggacu

SEQ ID NO: 504041 - RNA, 12 nt, Homo sapiens
aucccaucucuc

SEQ ID NO: 504042 - RNA, 15 nt, Homo sapiens
aucccaucucuccca

SEQ ID NO: 504043 - RNA, 14 nt, Homo sapiens
auccucucuggucu

SEQ ID NO: 504044 - RNA, 12 nt, Homo sapiens
aucuauugcuca

SEQ ID NO: 504045 - RNA, 21 nt, Homo sapiens
aucuauugcucaucagcuuua

SEQ ID NO: 504046 - RNA, 17 nt, Homo sapiens
aucucauccaucacaga

SEQ ID NO: 504047 - RNA, 12 nt, Homo sapiens
aucuccacagga

SEQ ID NO: 504048 - RNA, 22 nt, Homo sapiens
aucugcuggauauuuaguucaa

SEQ ID NO: 504049 - RNA, 18 nt, Homo sapiens
aucugggcugugggcaag

SEQ ID NO: 504050 - RNA, 14 nt, Homo sapiens
aucuucaaagccuu

SEQ ID NO: 504051 - RNA, 15 nt, Homo sapiens
aucuuuaacaaccuc

SEQ ID NO: 504052 - RNA, 17 nt, Homo sapiens
aucuuuaacaaccucug

SEQ ID NO: 504053 - RNA, 14 nt, Homo sapiens
augaacccucuugc

SEQ ID NO: 504054 - RNA, 17 nt, Homo sapiens
augaauaaagcauccaa

SEQ ID NO: 504055 - RNA, 19 nt, Homo sapiens
augaccauuugacuguuca

SEQ ID NO: 504056 - RNA, 12 nt, Homo sapiens
augaucagcaaa

SEQ ID NO: 504057 - RNA, 23 nt, Homo sapiens
augcauuauuuauugcuguguaa

SEQ ID NO: 504058 - RNA, 15 nt, Homo sapiens
augcauuuaauaaag

SEQ ID NO: 504059 - RNA, 22 nt, Homo sapiens
augccucccugggccaccuccu

SEQ ID NO: 504060 - RNA, 14 nt, Homo sapiens
auggcagccuacuc

SEQ ID NO: 504061 - RNA, 18 nt, Homo sapiens
auguacaauaaagcaaug

SEQ ID NO: 504062 - RNA, 23 nt, Homo sapiens
auguacaauaaagcaauguggua

SEQ ID NO: 504063 - RNA, 14 nt, Homo sapiens
augucaguacuauu

SEQ ID NO: 504064 - RNA, 15 nt, Homo sapiens
auguccucucuuaau

SEQ ID NO: 504065 - RNA, 23 nt, Homo sapiens
augucuccuuugcucuugccaaa

SEQ ID NO: 504066 - RNA, 18 nt, Homo sapiens
augugaagucucugggug

SEQ ID NO: 504067 - RNA, 21 nt, Homo sapiens
augugagcucuuccuaucccu

SEQ ID NO: 504068 - RNA, 19 nt, Homo sapiens
augugcuauacacacacac

SEQ ID NO: 504069 - RNA, 18 nt, Homo sapiens
auguuaaagagaaugagu

SEQ ID NO: 504070 - RNA, 16 nt, Homo sapiens
auguucacuguggcau

SEQ ID NO: 504071 - RNA, 21 nt, Homo sapiens
auuauaccuggaugauucagg

SEQ ID NO: 504072 - RNA, 21 nt, Homo sapiens
auuaugcagacaaccucauca

SEQ ID NO: 504073 - RNA, 20 nt, Homo sapiens
auuauguaaauaacucuaac

SEQ ID NO: 504074 - RNA, 20 nt, Homo sapiens
auucaacagagacugaauag

SEQ ID NO: 504075 - RNA, 15 nt, Homo sapiens
auucagcauguccaa

SEQ ID NO: 504076 - RNA, 14 nt, Homo sapiens
auucaggacuugaa

SEQ ID NO: 504077 - RNA, 21 nt, Homo sapiens
auucaggagaguguauaugaa

SEQ ID NO: 504078 - RNA, 16 nt, Homo sapiens
auuccagaucuuucag

SEQ ID NO: 504079 - RNA, 23 nt, Homo sapiens
auucgcccacccgaguaccucca

SEQ ID NO: 504080 - RNA, 13 nt, Homo sapiens
auugaacuuuccc

SEQ ID NO: 504081 - RNA, 18 nt, Homo sapiens
cauuggugagaguccaac

SEQ ID NO: 504082 - RNA, 18 nt, Homo sapiens
cauuuguuuuagucugaa

SEQ ID NO: 504083 - RNA, 15 nt, Homo sapiens
ccaaaaauuacuuug

SEQ ID NO: 504084 - RNA, 13 nt, Homo sapiens
ccaaaaccuuuca

SEQ ID NO: 504085 - RNA, 16 nt, Homo sapiens
ccaaauggcagggaua

SEQ ID NO: 504086 - RNA, 13 nt, Homo sapiens
ccaaccucaggcu

SEQ ID NO: 504087 - RNA, 17 nt, Homo sapiens
ccacuuuauugcaaugc

SEQ ID NO: 504088 - RNA, 15 nt, Homo sapiens
ccagaaaucaaaaag

SEQ ID NO: 504089 - RNA, 13 nt, Homo sapiens
ccagaucuuucag

SEQ ID NO: 504090 - RNA, 13 nt, Homo sapiens
ccagcaauuccau

SEQ ID NO: 504091 - RNA, 15 nt, Homo sapiens
ccagccugcucccua

SEQ ID NO: 504092 - RNA, 20 nt, Homo sapiens
ccagccugcucccuagccag

SEQ ID NO: 504093 - RNA, 20 nt, Homo sapiens
ccagccugguuugcaaagac

SEQ ID NO: 504094 - RNA, 14 nt, Homo sapiens
ccaggauacuggca

SEQ ID NO: 504095 - RNA, 17 nt, Homo sapiens
ccagggacagggcccug

SEQ ID NO: 504096 - RNA, 23 nt, Homo sapiens
ccagggaggggucccugcaaaac

SEQ ID NO: 504097 - RNA, 19 nt, Homo sapiens
ccaucucucccacuuccuc

SEQ ID NO: 504098 - RNA, 20 nt, Homo sapiens
ccauugauuuaauguaauag

SEQ ID NO: 504099 - RNA, 17 nt, Homo sapiens
ccauuugacuguucaau

SEQ ID NO: 504100 - RNA, 23 nt, Homo sapiens
cccaaggccccacuuucaagaau

SEQ ID NO: 504101 - RNA, 15 nt, Homo sapiens
cccaccuuccauagc

SEQ ID NO: 504102 - RNA, 22 nt, Homo sapiens
cccagccugcucccuagccaga

SEQ ID NO: 504103 - RNA, 17 nt, Homo sapiens
cccaggauacuggcaca

SEQ ID NO: 504104 - RNA, 18 nt, Homo sapiens
cccaucuuuuguucuccu

SEQ ID NO: 504105 - RNA, 12 nt, Homo sapiens
ccccaauccauc

SEQ ID NO: 504106 - RNA, 14 nt, Homo sapiens
ccccaccaguguag

SEQ ID NO: 504107 - RNA, 14 nt, Homo sapiens
ccccagccugcucc

SEQ ID NO: 504108 - RNA, 23 nt, Homo sapiens
cccgccaaggaaaggcauguaca

SEQ ID NO: 504109 - RNA, 19 nt, Homo sapiens
cccucuaggaggugaugau

SEQ ID NO: 504110 - RNA, 16 nt, Homo sapiens
cccugucucccaaaaa

SEQ ID NO: 504111 - RNA, 16 nt, Homo sapiens
cccugucucuuaaaaa

SEQ ID NO: 504112 - RNA, 14 nt, Homo sapiens
cccuuguugcacug

SEQ ID NO: 504113 - RNA, 23 nt, Homo sapiens
cccuuuccuggcagucucagucc

SEQ ID NO: 504114 - RNA, 12 nt, Homo sapiens
ccgauaccaugc

SEQ ID NO: 504115 - RNA, 15 nt, Homo sapiens
ccuaacaaaugcucc

SEQ ID NO: 504116 - RNA, 14 nt, Homo sapiens
ccuaacaucuccau

SEQ ID NO: 504117 - RNA, 19 nt, Homo sapiens
ccuaaggcacccacaaaua

SEQ ID NO: 504118 - RNA, 16 nt, Homo sapiens
ccuaauguguuuagau

SEQ ID NO: 504119 - RNA, 18 nt, Homo sapiens
ccuagccagaggcucuaa

SEQ ID NO: 504120 - RNA, 20 nt, Homo sapiens
ccuauagucccagcuacuca

SEQ ID NO: 504121 - RNA, 17 nt, Homo sapiens
ccucaaaccacuugccu

SEQ ID NO: 504122 - RNA, 18 nt, Homo sapiens
ccucaguuucucaaagau

SEQ ID NO: 504123 - RNA, 19 nt, Homo sapiens
ccucaucaguguguaaaua

SEQ ID NO: 504124 - RNA, 17 nt, Homo sapiens
ccuccuggaaucaguau

SEQ ID NO: 504125 - RNA, 21 nt, Homo sapiens
ccucuaugaagccuaacucuu

SEQ ID NO: 504126 - RNA, 21 nt, Homo sapiens
ccucugaaagaugcaucaucu

SEQ ID NO: 504127 - RNA, 13 nt, Homo sapiens
ccucuuagcucag

SEQ ID NO: 504128 - RNA, 17 nt, Homo sapiens
ccucuugccauccugau

SEQ ID NO: 504129 - RNA, 19 nt, Homo sapiens
ccugaauuaucuauuucau

SEQ ID NO: 504130 - RNA, 18 nt, Homo sapiens
ccugaggacugauuucag

SEQ ID NO: 504131 - RNA, 17 nt, Homo sapiens
ccugcaggcaggaacaa

SEQ ID NO: 504132 - RNA, 22 nt, Homo sapiens
ccugcucccuagccagaggcuc

SEQ ID NO: 504133 - RNA, 13 nt, Homo sapiens
ccugggaacauca

SEQ ID NO: 504134 - RNA, 13 nt, Homo sapiens
ccuggugacuccu

SEQ ID NO: 504135 - RNA, 17 nt, Homo sapiens
ccuggugcugagugcac

SEQ ID NO: 504136 - RNA, 16 nt, Homo sapiens
ccugguuugcaaagac

SEQ ID NO: 504137 - RNA, 19 nt, Homo sapiens
ccugguuugcaaagaccac

SEQ ID NO: 504138 - RNA, 19 nt, Homo sapiens
ccuguccugccuccucauc

SEQ ID NO: 504139 - RNA, 18 nt, Homo sapiens
ccuuaagggguaucaugu

SEQ ID NO: 504140 - RNA, 19 nt, Homo sapiens
ccuuaagggguaucaugua

SEQ ID NO: 504141 - RNA, 14 nt, Homo sapiens
ccuucaaggcucuu

SEQ ID NO: 504142 - RNA, 12 nt, Homo sapiens
ccuuccacugua

SEQ ID NO: 504143 - RNA, 20 nt, Homo sapiens
ccuugaauccagaacacaac

SEQ ID NO: 504144 - RNA, 23 nt, Homo sapiens
ccuugcagcggcuccugcaaaag

SEQ ID NO: 504145 - RNA, 17 nt, Homo sapiens
ccuugucauagaggaaa

SEQ ID NO: 504146 - RNA, 22 nt, Homo sapiens
ccuuucuccuccccaccuguag

SEQ ID NO: 504147 - RNA, 17 nt, Homo sapiens
cgaaccuacaguuuuaa

SEQ ID NO: 504148 - RNA, 16 nt, Homo sapiens
cgagggauuacuuugg

SEQ ID NO: 504149 - RNA, 15 nt, Homo sapiens
cgcaauugcucaugc

SEQ ID NO: 504150 - RNA, 15 nt, Homo sapiens
cgccagcgaccucuc

SEQ ID NO: 504151 - RNA, 14 nt, Homo sapiens
cgccuuacuggcaa

SEQ ID NO: 504152 - RNA, 13 nt, Homo sapiens
cggaccuaccucc

SEQ ID NO: 504153 - RNA, 19 nt, Homo sapiens
cgucugcuccaaugacuga

SEQ ID NO: 504154 - RNA, 17 nt, Homo sapiens
cuaaaaguucucaaugu

SEQ ID NO: 504155 - RNA, 16 nt, Homo sapiens
cuaacaguaguugcaa

SEQ ID NO: 504156 - RNA, 19 nt, Homo sapiens
cuaacuuauccaucuuuga

SEQ ID NO: 504157 - RNA, 17 nt, Homo sapiens
cuaagguucagccugaa

SEQ ID NO: 504158 - RNA, 13 nt, Homo sapiens
cuaauguacaaua

SEQ ID NO: 504159 - RNA, 20 nt, Homo sapiens
cuacaacuuuuccuaaggca

SEQ ID NO: 504160 - RNA, 23 nt, Homo sapiens
cuacagggcgagacucugucuca

SEQ ID NO: 504161 - RNA, 16 nt, Homo sapiens
cuaccugagcuaaaua

SEQ ID NO: 504162 - RNA, 15 nt, Homo sapiens
cuagaguucauggau

SEQ ID NO: 504163 - RNA, 23 nt, Homo sapiens
cuagcauuguaaaauuauuucau

SEQ ID NO: 504164 - RNA, 16 nt, Homo sapiens
cuagccagaggcucua

SEQ ID NO: 504165 - RNA, 16 nt, Homo sapiens
cuagggccucagucug

SEQ ID NO: 504166 - RNA, 19 nt, Homo sapiens
cuauaaaacucugcaugua

SEQ ID NO: 504167 - RNA, 18 nt, Homo sapiens
cuauaagaugaaacauca

SEQ ID NO: 504168 - RNA, 20 nt, Homo sapiens
cuauaagaugaaacaucauu

SEQ ID NO: 504169 - RNA, 13 nt, Homo sapiens
cuauacacacaca

SEQ ID NO: 504170 - RNA, 15 nt, Homo sapiens
cuauacacacacaca

SEQ ID NO: 504171 - RNA, 16 nt, Homo sapiens
cuauacuggauacucu

SEQ ID NO: 504172 - RNA, 21 nt, Homo sapiens
cuauccuccccuuuuaccacu

SEQ ID NO: 504173 - RNA, 18 nt, Homo sapiens
cuaugaaaucaacugaca

SEQ ID NO: 504174 - RNA, 22 nt, Homo sapiens
cuaugucaguacuauucaggua

SEQ ID NO: 504175 - RNA, 23 nt, Homo sapiens
cuauucuauaaaacucugcaugu

SEQ ID NO: 504176 - RNA, 12 nt, Homo sapiens
cuauuggucucc

SEQ ID NO: 504177 - RNA, 19 nt, Homo sapiens
cucaauccauccauguacu

SEQ ID NO: 504178 - RNA, 22 nt, Homo sapiens
cucaaugcaguuagcugaagaa

SEQ ID NO: 504179 - RNA, 14 nt, Homo sapiens
cucacagcuguaau

SEQ ID NO: 504180 - RNA, 21 nt, Homo sapiens
cucacugcugcaaauacugua

SEQ ID NO: 504181 - RNA, 15 nt, Homo sapiens
cucaucagcuuuauu

SEQ ID NO: 504182 - RNA, 13 nt, Homo sapiens
cucauccaucaca

SEQ ID NO: 504183 - RNA, 13 nt, Homo sapiens
cucaucugggcaa

SEQ ID NO: 504184 - RNA, 21 nt, Homo sapiens
cuccagccuggcuacagggcg

SEQ ID NO: 504185 - RNA, 16 nt, Homo sapiens
cucccacaggggccau

SEQ ID NO: 504186 - RNA, 12 nt, Homo sapiens
cucccuagccag

SEQ ID NO: 504187 - RNA, 18 nt, Homo sapiens
cucccugggccaccuccu

SEQ ID NO: 504188 - RNA, 15 nt, Homo sapiens
cuccgucugcuccaa

SEQ ID NO: 504189 - RNA, 22 nt, Homo sapiens
cuccuaccuggggacuccucaa

SEQ ID NO: 504190 - RNA, 15 nt, Homo sapiens
cuccucaaaccacuu

SEQ ID NO: 504191 - RNA, 23 nt, Homo sapiens
gaguaccuccagucacacucccc

SEQ ID NO: 504192 - RNA, 14 nt, Homo sapiens
gagugcacccggag

SEQ ID NO: 504193 - RNA, 22 nt, Homo sapiens
gaguucuggaugucuggcucaa

SEQ ID NO: 504194 - RNA, 14 nt, Homo sapiens
gaguuuagugugau

SEQ ID NO: 504195 - RNA, 21 nt, Homo sapiens
gaguuuagugugauaaaggca

SEQ ID NO: 504196 - RNA, 13 nt, Homo sapiens
gauaagucuuuca

SEQ ID NO: 504197 - RNA, 11 nt, Homo sapiens
gauacuuugac

SEQ ID NO: 504198 - RNA, 21 nt, Homo sapiens
gauaggguuucuaaugguuau

SEQ ID NO: 504199 - RNA, 23 nt, Homo sapiens
gauauguuauacugaaccaggcc

SEQ ID NO: 504200 - RNA, 16 nt, Homo sapiens
gauauugaauguuaaa

SEQ ID NO: 504201 - RNA, 17 nt, Homo sapiens
gauauuuuuuacuuuag

SEQ ID NO: 504202 - RNA, 18 nt, Homo sapiens
gaucagagcgcacaggga

SEQ ID NO: 504203 - RNA, 22 nt, Homo sapiens
gaucucauaaugcuuuguuaaa

SEQ ID NO: 504204 - RNA, 18 nt, Homo sapiens
gaugaauugucacaucua

SEQ ID NO: 504205 - RNA, 12 nt, Homo sapiens
gaugcauuuaau

SEQ ID NO: 504206 - RNA, 15 nt, Homo sapiens
gauguucacuguggc

SEQ ID NO: 504207 - RNA, 17 nt, Homo sapiens
gauuacuuuggccaaaa

SEQ ID NO: 504208 - RNA, 15 nt, Homo sapiens
gauucccaccuucca

SEQ ID NO: 504209 - RNA, 14 nt, Homo sapiens
gauugcagacuguu

SEQ ID NO: 504210 - RNA, 22 nt, Homo sapiens
gauuuuuuuuaauuaccaugcu

SEQ ID NO: 504211 - RNA, 19 nt, Homo sapiens
gcaaaacuuaggcaugcac

SEQ ID NO: 504212 - RNA, 14 nt, Homo sapiens
gcaaggugugaugg

SEQ ID NO: 504213 - RNA, 17 nt, Homo sapiens
gcaauggacaaggaagg

SEQ ID NO: 504214 - RNA, 12 nt, Homo sapiens
gcaauugcucau

SEQ ID NO: 504215 - RNA, 17 nt, Homo sapiens
gcaauugcucaugcaua

SEQ ID NO: 504216 - RNA, 11 nt, Homo sapiens
gcacagauuau

SEQ ID NO: 504217 - RNA, 21 nt, Homo sapiens
gcacagggagugcacauaucc

SEQ ID NO: 504218 - RNA, 12 nt, Homo sapiens
gcacauuaacug

SEQ ID NO: 504219 - RNA, 12 nt, Homo sapiens
gcaggacugugg

SEQ ID NO: 504220 - RNA, 13 nt, Homo sapiens
gcaggacuguggg

SEQ ID NO: 504221 - RNA, 18 nt, Homo sapiens
gcagggauuagguguuca

SEQ ID NO: 504222 - RNA, 21 nt, Homo sapiens
gcaguuuugcuaucugggcug

SEQ ID NO: 504223 - RNA, 19 nt, Homo sapiens
gcauccaaguauauaugaa

SEQ ID NO: 504224 - RNA, 18 nt, Homo sapiens
gcauggagacagcaguuu

SEQ ID NO: 504225 - RNA, 15 nt, Homo sapiens
gcauucuuugcaaua

SEQ ID NO: 504226 - RNA, 18 nt, Homo sapiens
gccacagaaggugaacuu

SEQ ID NO: 504227 - RNA, 23 nt, Homo sapiens
gccagaccagcaggcuggccuau

SEQ ID NO: 504228 - RNA, 15 nt, Homo sapiens
gccagaggcucuaau

SEQ ID NO: 504229 - RNA, 21 nt, Homo sapiens
gccagaggcucuaauguacaa

SEQ ID NO: 504230 - RNA, 22 nt, Homo sapiens
gccagaggcucuaauguacaau

SEQ ID NO: 504231 - RNA, 17 nt, Homo sapiens
gccaggaggccugcuag

SEQ ID NO: 504232 - RNA, 21 nt, Homo sapiens
gccauccugauggaccugccc

SEQ ID NO: 504233 - RNA, 18 nt, Homo sapiens
gcccacccgaguaccucc

SEQ ID NO: 504234 - RNA, 19 nt, Homo sapiens
gcccacccgaguaccucca

SEQ ID NO: 504235 - RNA, 23 nt, Homo sapiens
gcccugggcuccucuuagcucag

SEQ ID NO: 504236 - RNA, 22 nt, Homo sapiens
gccuaggaaagccaguuacaua

SEQ ID NO: 504237 - RNA, 10 nt, Homo sapiens
gccuccucau

SEQ ID NO: 504238 - RNA, 13 nt, Homo sapiens
gccugguuugcaa

SEQ ID NO: 504239 - RNA, 18 nt, Homo sapiens
gccuuguaagacccuuau

SEQ ID NO: 504240 - RNA, 22 nt, Homo sapiens
gccuuuucuggucccucuucuc

SEQ ID NO: 504241 - RNA, 20 nt, Homo sapiens
gcgcaauugcucaugcauag

SEQ ID NO: 504242 - RNA, 17 nt, Homo sapiens
gcgccagcgaccucucu

SEQ ID NO: 504243 - RNA, 21 nt, Homo sapiens
gcgguucauacgcaucccauc

SEQ ID NO: 504244 - RNA, 20 nt, Homo sapiens
gcucacgccuguaaucccag

SEQ ID NO: 504245 - RNA, 17 nt, Homo sapiens
gcucccacaggggccau

SEQ ID NO: 504246 - RNA, 15 nt, Homo sapiens
gcuccucuuagcuca

SEQ ID NO: 504247 - RNA, 12 nt, Homo sapiens
gcuccugcaaaa

SEQ ID NO: 504248 - RNA, 14 nt, Homo sapiens
gcucuaauguacaa

SEQ ID NO: 504249 - RNA, 18 nt, Homo sapiens
gcugaacauaacuucuca

SEQ ID NO: 504250 - RNA, 15 nt, Homo sapiens
gcuggcuggguucca

SEQ ID NO: 504251 - RNA, 20 nt, Homo sapiens
gcuggugaauaacuaugcca

SEQ ID NO: 504252 - RNA, 21 nt, Homo sapiens
gcuggugaauaacuaugccag

SEQ ID NO: 504253 - RNA, 17 nt, Homo sapiens
gcuguaguaccccaaga

SEQ ID NO: 504254 - RNA, 22 nt, Homo sapiens
gcugucuugucuuuuuccaaaa

SEQ ID NO: 504255 - RNA, 17 nt, Homo sapiens
gcuuaccuccucauggc

SEQ ID NO: 504256 - RNA, 14 nt, Homo sapiens
gcuucagaugacag

SEQ ID NO: 504257 - RNA, 16 nt, Homo sapiens
ggaacaucacauuccu

SEQ ID NO: 504258 - RNA, 15 nt, Homo sapiens
ggaccaggucucaua

SEQ ID NO: 504259 - RNA, 12 nt, Homo sapiens
ggaccuaccucc

SEQ ID NO: 504260 - RNA, 11 nt, Homo sapiens
ggacuccucaa

SEQ ID NO: 504261 - RNA, 21 nt, Homo sapiens
ggacuccucaaaccacuugcc

SEQ ID NO: 504262 - RNA, 23 nt, Homo sapiens
ggacuccucaaaccacuugccug

SEQ ID NO: 504263 - RNA, 20 nt, Homo sapiens
ggagaccccuuguugcacug

SEQ ID NO: 504264 - RNA, 20 nt, Homo sapiens
ggaggcagagguugcaguga

SEQ ID NO: 504265 - RNA, 20 nt, Homo sapiens
ggagggugguucaacaaaga

SEQ ID NO: 504266 - RNA, 21 nt, Homo sapiens
ggauauuuaguucaacuguau

SEQ ID NO: 504267 - RNA, 13 nt, Homo sapiens
ggauauuugcacu

SEQ ID NO: 504268 - RNA, 13 nt, Homo sapiens
ggcagcugugaug

SEQ ID NO: 504269 - RNA, 18 nt, Homo sapiens
ggcaggaacaaacagggc

SEQ ID NO: 504270 - RNA, 15 nt, Homo sapiens
ggcaggaacggugga

SEQ ID NO: 504271 - RNA, 20 nt, Homo sapiens
ggcaggagaauugcuugaac

SEQ ID NO: 504272 - RNA, 20 nt, Homo sapiens
ggcauugucuguaaugacaa

SEQ ID NO: 504273 - RNA, 15 nt, Homo sapiens
ggccccaucuccaca

SEQ ID NO: 504274 - RNA, 20 nt, Homo sapiens
ggccgguucuaaggcucaga

SEQ ID NO: 504275 - RNA, 16 nt, Homo sapiens
ggcuaacgagggauua

SEQ ID NO: 504276 - RNA, 22 nt, Homo sapiens
ggcuccugauggugucauucug

SEQ ID NO: 504277 - RNA, 21 nt, Homo sapiens
ggcucuaauguacaauaaagc

SEQ ID NO: 504278 - RNA, 17 nt, Homo sapiens
ggcugugccaucagcuc

SEQ ID NO: 504279 - RNA, 23 nt, Homo sapiens
gggagcugcagucccaugcacaa

SEQ ID NO: 504280 - RNA, 20 nt, Homo sapiens
gggaggcagagguugcagug

SEQ ID NO: 504281 - RNA, 16 nt, Homo sapiens
gggauacccagugaug

SEQ ID NO: 504282 - RNA, 20 nt, Homo sapiens
gggcaccaggggccaaccuc

SEQ ID NO: 504283 - RNA, 23 nt, Homo sapiens
gggcccuggagcucaggguccuu

SEQ ID NO: 504284 - RNA, 20 nt, Homo sapiens
gggcugcccaccuggcugcc

SEQ ID NO: 504285 - RNA, 21 nt, Homo sapiens
gggcugugauuacugcaauca

SEQ ID NO: 504286 - RNA, 16 nt, Homo sapiens
ggggacacagcaucag

SEQ ID NO: 504287 - RNA, 14 nt, Homo sapiens
ggguggggccauaa

SEQ ID NO: 504288 - RNA, 13 nt, Homo sapiens
gguaaauguuucu

SEQ ID NO: 504289 - RNA, 16 nt, Homo sapiens
gguacgaugacagugu

SEQ ID NO: 504290 - RNA, 20 nt, Homo sapiens
ggucucaggagaagggauag

SEQ ID NO: 504291 - RNA, 20 nt, Homo sapiens
ggugucauucugccugcucc

SEQ ID NO: 504292 - RNA, 14 nt, Homo sapiens
gguguccccuaucc

SEQ ID NO: 504293 - RNA, 19 nt, Homo sapiens
gguguccccuauccucccc

SEQ ID NO: 504294 - RNA, 17 nt, Homo sapiens
gguuauaacaguguuua

SEQ ID NO: 504295 - RNA, 16 nt, Homo sapiens
gguuccuggugacucc

SEQ ID NO: 504296 - RNA, 18 nt, Homo sapiens
gguuccuggugacuccug

SEQ ID NO: 504297 - RNA, 21 nt, Homo sapiens
gguucggcucuagggccucag

SEQ ID NO: 504298 - RNA, 20 nt, Homo sapiens
guaaacuucugcaacaagca

SEQ ID NO: 504299 - RNA, 17 nt, Homo sapiens
guaaauaauuugcacug

SEQ ID NO: 504300 - RNA, 23 nt, Homo sapiens
agcccuggcaaaugccugacuca

SEQ ID NO: 504301 - RNA, 12 nt, Homo sapiens
agccugcauuga

SEQ ID NO: 504302 - RNA, 21 nt, Homo sapiens
agccuggauccucaguucuca

SEQ ID NO: 504303 - RNA, 14 nt, Homo sapiens
agccuuuggugcuu

SEQ ID NO: 504304 - RNA, 20 nt, Homo sapiens
agcguucuaaauaugaauga

SEQ ID NO: 504305 - RNA, 16 nt, Homo sapiens
agcuagcaacauuugu

SEQ ID NO: 504306 - RNA, 21 nt, Homo sapiens
agcuagcaacauuuguuuuag

SEQ ID NO: 504307 - RNA, 14 nt, Homo sapiens
agcucuuccuaucc

SEQ ID NO: 504308 - RNA, 14 nt, Homo sapiens
agcugauacuuuga

SEQ ID NO: 504309 - RNA, 16 nt, Homo sapiens
agcugccguagcuuca

SEQ ID NO: 504310 - RNA, 22 nt, Homo sapiens
agcugcugcacacacucaccuc

SEQ ID NO: 504311 - RNA, 16 nt, Homo sapiens
agcugucccacaucac

SEQ ID NO: 504312 - RNA, 16 nt, Homo sapiens
aggaaaaggaauuccu

SEQ ID NO: 504313 - RNA, 15 nt, Homo sapiens
aggaacaaucuuugc

SEQ ID NO: 504314 - RNA, 19 nt, Homo sapiens
aggaucaguugaggccagg

SEQ ID NO: 504315 - RNA, 17 nt, Homo sapiens
aggaucccgucuuccag

SEQ ID NO: 504316 - RNA, 16 nt, Homo sapiens
aggcagacuugcagag

SEQ ID NO: 504317 - RNA, 13 nt, Homo sapiens
aggcauguacaaa

SEQ ID NO: 504318 - RNA, 15 nt, Homo sapiens
aggccuagacucugu

SEQ ID NO: 504319 - RNA, 14 nt, Homo sapiens
aggcucuaauguac

SEQ ID NO: 504320 - RNA, 15 nt, Homo sapiens
aggcucuaauguaca

SEQ ID NO: 504321 - RNA, 18 nt, Homo sapiens
aggcucuaauguacaaua

SEQ ID NO: 504322 - RNA, 22 nt, Homo sapiens
aggcucuaauguacaauaaagc

SEQ ID NO: 504323 - RNA, 15 nt, Homo sapiens
aggcucuucuuccuc

SEQ ID NO: 504324 - RNA, 20 nt, Homo sapiens
agggauauuuuuuucuauua

SEQ ID NO: 504325 - RNA, 17 nt, Homo sapiens
agggcauuuccaaguua

SEQ ID NO: 504326 - RNA, 17 nt, Homo sapiens
aggggccauguccucuc

SEQ ID NO: 504327 - RNA, 20 nt, Homo sapiens
agguccuuaggccucugaga

SEQ ID NO: 504328 - RNA, 20 nt, Homo sapiens
aggucucaggagaagggaua

SEQ ID NO: 504329 - RNA, 21 nt, Homo sapiens
aggucuccagagggugaaagc

SEQ ID NO: 504330 - RNA, 14 nt, Homo sapiens
agguggcacuaccc

SEQ ID NO: 504331 - RNA, 11 nt, Homo sapiens
aggugugaugg

SEQ ID NO: 504332 - RNA, 16 nt, Homo sapiens
agguguuuguggggcu

SEQ ID NO: 504333 - RNA, 23 nt, Homo sapiens
aguaacugugagaacccaguuuc

SEQ ID NO: 504334 - RNA, 14 nt, Homo sapiens
aguacagacagaag

SEQ ID NO: 504335 - RNA, 21 nt, Homo sapiens
aguaccuagcuggcucuguga

SEQ ID NO: 504336 - RNA, 17 nt, Homo sapiens
aguacgaaccuacaguu

SEQ ID NO: 504337 - RNA, 12 nt, Homo sapiens
aguauucacaaa

SEQ ID NO: 504338 - RNA, 20 nt, Homo sapiens
agucacuggucuguuugcau

SEQ ID NO: 504339 - RNA, 20 nt, Homo sapiens
aguccccagccugcucccua

SEQ ID NO: 504340 - RNA, 23 nt, Homo sapiens
aguccuugauuucaaaguuuugu

SEQ ID NO: 504341 - RNA, 21 nt, Homo sapiens
agucucugucguggagccauu

SEQ ID NO: 504342 - RNA, 17 nt, Homo sapiens
agucuuagagcuuuacc

SEQ ID NO: 504343 - RNA, 19 nt, Homo sapiens
agucuuagagcuuuaccua

SEQ ID NO: 504344 - RNA, 21 nt, Homo sapiens
agugaugugugagcuaugcaa

SEQ ID NO: 504345 - RNA, 13 nt, Homo sapiens
agugcgguuuacu

SEQ ID NO: 504346 - RNA, 19 nt, Homo sapiens
aguguguaaauaauuugca

SEQ ID NO: 504347 - RNA, 19 nt, Homo sapiens
aguguuccaagucucugug

SEQ ID NO: 504348 - RNA, 15 nt, Homo sapiens
aguucauggauaugu

SEQ ID NO: 504349 - RNA, 12 nt, Homo sapiens
aguugccaaagu

SEQ ID NO: 504350 - RNA, 14 nt, Homo sapiens
aguuuaaugucucc

SEQ ID NO: 504351 - RNA, 14 nt, Homo sapiens
aguuucucaaagau

SEQ ID NO: 504352 - RNA, 14 nt, Homo sapiens
aguuuuaacugugg

SEQ ID NO: 504353 - RNA, 19 nt, Homo sapiens
auaaaaacucauccauggc

SEQ ID NO: 504354 - RNA, 20 nt, Homo sapiens
auaaaaccaagggauaucuu

SEQ ID NO: 504355 - RNA, 18 nt, Homo sapiens
auaaaacucugcauguag

SEQ ID NO: 504356 - RNA, 18 nt, Homo sapiens
auaaacgguuccugguga

SEQ ID NO: 504357 - RNA, 15 nt, Homo sapiens
auaaagcaauguggu

SEQ ID NO: 504358 - RNA, 17 nt, Homo sapiens
auaaagcaaugugguag

SEQ ID NO: 504359 - RNA, 21 nt, Homo sapiens
auaaaucauuaagacaacuga

SEQ ID NO: 504360 - RNA, 23 nt, Homo sapiens
auaaauguaccagagagaguugu

SEQ ID NO: 504361 - RNA, 13 nt, Homo sapiens
auaacuaugccag

SEQ ID NO: 504362 - RNA, 16 nt, Homo sapiens
auaacuggauugcaga

SEQ ID NO: 504363 - RNA, 17 nt, Homo sapiens
auaauaggaacaaucuu

SEQ ID NO: 504364 - RNA, 20 nt, Homo sapiens
auaaugucauuaaacaugac

SEQ ID NO: 504365 - RNA, 13 nt, Homo sapiens
auacacacacaca

SEQ ID NO: 504366 - RNA, 16 nt, Homo sapiens
auacaucaauauguau

SEQ ID NO: 504367 - RNA, 12 nt, Homo sapiens
auacucugcuau

SEQ ID NO: 504368 - RNA, 13 nt, Homo sapiens
auacucugcuauu

SEQ ID NO: 504369 - RNA, 19 nt, Homo sapiens
auacuguaacauucaggaa

SEQ ID NO: 504370 - RNA, 18 nt, Homo sapiens
auagacacugaucuggcu

SEQ ID NO: 504371 - RNA, 23 nt, Homo sapiens
auagcacacuuuuccacauucca

SEQ ID NO: 504372 - RNA, 12 nt, Homo sapiens
auagccaaaaau

SEQ ID NO: 504373 - RNA, 15 nt, Homo sapiens
auagccuccaaacau

SEQ ID NO: 504374 - RNA, 18 nt, Homo sapiens
auaguuuuauuuacuucu

SEQ ID NO: 504375 - RNA, 13 nt, Homo sapiens
auauacuuauaga

SEQ ID NO: 504376 - RNA, 23 nt, Homo sapiens
auauacuuauagaauucagucaa

SEQ ID NO: 504377 - RNA, 18 nt, Homo sapiens
auauccaggcaccaggac

SEQ ID NO: 504378 - RNA, 19 nt, Homo sapiens
auaugaccauuugacuguu

SEQ ID NO: 504379 - RNA, 21 nt, Homo sapiens
auaugaccauuugacuguuca

SEQ ID NO: 504380 - RNA, 19 nt, Homo sapiens
uauuugcacuauuuccaca

SEQ ID NO: 504381 - RNA, 20 nt, Homo sapiens
uauuugcacuauuuccacau

SEQ ID NO: 504382 - RNA, 19 nt, Homo sapiens
uauuuuugugaaguauuca

SEQ ID NO: 504383 - RNA, 18 nt, Homo sapiens
uauuuuuuaaacauacga

SEQ ID NO: 504384 - RNA, 21 nt, Homo sapiens
uauuuuuuaagaaaaaaagcu

SEQ ID NO: 504385 - RNA, 22 nt, Homo sapiens
ucaaaagguauuauacauguga

SEQ ID NO: 504386 - RNA, 18 nt, Homo sapiens
ucaaauacacauuugcua

SEQ ID NO: 504387 - RNA, 22 nt, Homo sapiens
ucaagacgucacccuccauucu

SEQ ID NO: 504388 - RNA, 16 nt, Homo sapiens
ucaauguccuacugag

SEQ ID NO: 504389 - RNA, 17 nt, Homo sapiens
ucaauguccuacugaga

SEQ ID NO: 504390 - RNA, 20 nt, Homo sapiens
ucacuaaaacacacaggugc

SEQ ID NO: 504391 - RNA, 22 nt, Homo sapiens
ucacugcugcaaauacuguaua

SEQ ID NO: 504392 - RNA, 18 nt, Homo sapiens
ucagaaaauggcacuugg

SEQ ID NO: 504393 - RNA, 19 nt, Homo sapiens
ucagacagcaggaagccau

SEQ ID NO: 504394 - RNA, 14 nt, Homo sapiens
ucagaugacagaug

SEQ ID NO: 504395 - RNA, 15 nt, Homo sapiens
ucagcauguccaaca

SEQ ID NO: 504396 - RNA, 21 nt, Homo sapiens
ucagccugcuuuccugcagca

SEQ ID NO: 504397 - RNA, 20 nt, Homo sapiens
ucagcugcuguugaacuuuu

SEQ ID NO: 504398 - RNA, 19 nt, Homo sapiens
ucaggagaguguauaugaa

SEQ ID NO: 504399 - RNA, 16 nt, Homo sapiens
ucaguuccaaacagac

SEQ ID NO: 504400 - RNA, 22 nt, Homo sapiens
ucauagaggaaaagcacagauu

SEQ ID NO: 504401 - RNA, 18 nt, Homo sapiens
ucauauuguaaucuaugu

SEQ ID NO: 504402 - RNA, 15 nt, Homo sapiens
ucauccaucacagau

SEQ ID NO: 504403 - RNA, 18 nt, Homo sapiens
ucaugaggccggaugaaa

SEQ ID NO: 504404 - RNA, 21 nt, Homo sapiens
ucauggauauguuauacugaa

SEQ ID NO: 504405 - RNA, 18 nt, Homo sapiens
ucauucugccugcuccau

SEQ ID NO: 504406 - RNA, 14 nt, Homo sapiens
uccaaacagacaaa

SEQ ID NO: 504407 - RNA, 18 nt, Homo sapiens
uccagagacaacagguaa

SEQ ID NO: 504408 - RNA, 15 nt, Homo sapiens
uccauaggacaggaa

SEQ ID NO: 504409 - RNA, 23 nt, Homo sapiens
uccaugguggaaguuaaagggca

SEQ ID NO: 504410 - RNA, 19 nt, Homo sapiens
ucccaaggccccacuuuca

SEQ ID NO: 504411 - RNA, 19 nt, Homo sapiens
ucccagccugguuugcaaa

SEQ ID NO: 504412 - RNA, 19 nt, Homo sapiens
uccccagccugcucccuag

SEQ ID NO: 504413 - RNA, 16 nt, Homo sapiens
uccccucacacacaaa

SEQ ID NO: 504414 - RNA, 13 nt, Homo sapiens
ucccuagccagag

SEQ ID NO: 504415 - RNA, 20 nt, Homo sapiens
ucccuagccagaggcucuaa

SEQ ID NO: 504416 - RNA, 11 nt, Homo sapiens
ucccugcaaaa

SEQ ID NO: 504417 - RNA, 15 nt, Homo sapiens
ucccugccucaggcc

SEQ ID NO: 504418 - RNA, 17 nt, Homo sapiens
uccgaugaguaaaaagu

SEQ ID NO: 504419 - RNA, 18 nt, Homo sapiens
uccggaaagaugagcuuu

SEQ ID NO: 504420 - RNA, 18 nt, Homo sapiens
uccuagcugugugaauac

SEQ ID NO: 504421 - RNA, 19 nt, Homo sapiens
uccucaguucucaaaugug

SEQ ID NO: 504422 - RNA, 16 nt, Homo sapiens
uccucaguuucucaaa

SEQ ID NO: 504423 - RNA, 18 nt, Homo sapiens
uccuccccuguucauucu

SEQ ID NO: 504424 - RNA, 14 nt, Homo sapiens
uccucuagacuuga

SEQ ID NO: 504425 - RNA, 18 nt, Homo sapiens
uccugcuuaaucuucaaa

SEQ ID NO: 504426 - RNA, 17 nt, Homo sapiens
uccuggcagucucaguc

SEQ ID NO: 504427 - RNA, 14 nt, Homo sapiens
uccuuaggccucug

SEQ ID NO: 504428 - RNA, 21 nt, Homo sapiens
ucgcccacccgaguaccucca

SEQ ID NO: 504429 - RNA, 15 nt, Homo sapiens
ucuacuacuuggaag

SEQ ID NO: 504430 - RNA, 18 nt, Homo sapiens
ucuauucuagccugcauu

SEQ ID NO: 504431 - RNA, 22 nt, Homo sapiens
ucucaggaccgugcccucguca

SEQ ID NO: 504432 - RNA, 21 nt, Homo sapiens
ucucauaaugcuuuguuaaau

SEQ ID NO: 504433 - RNA, 16 nt, Homo sapiens
ucucauugacuuuuau

SEQ ID NO: 504434 - RNA, 13 nt, Homo sapiens
ucucugaaagugu

SEQ ID NO: 504435 - RNA, 13 nt, Homo sapiens
ucugacuacuugu

SEQ ID NO: 504436 - RNA, 18 nt, Homo sapiens
ucugcauucucuagucag

SEQ ID NO: 504437 - RNA, 18 nt, Homo sapiens
ucugccaaucuguacaaa

SEQ ID NO: 504438 - RNA, 12 nt, Homo sapiens
ucugccugugga

SEQ ID NO: 504439 - RNA, 22 nt, Homo sapiens
ucuggguggaagugugugccaa

SEQ ID NO: 504440 - RNA, 21 nt, Homo sapiens
ucugguaauaaaugugacuca

SEQ ID NO: 504441 - RNA, 22 nt, Homo sapiens
ucuuacugcaggcaagugggau

SEQ ID NO: 504442 - RNA, 13 nt, Homo sapiens
ucuuauugacaau

SEQ ID NO: 504443 - RNA, 14 nt, Homo sapiens
ucuucccaugcauu

SEQ ID NO: 504444 - RNA, 22 nt, Homo sapiens
ucuuuaaccacuuuucaauguc

SEQ ID NO: 504445 - RNA, 13 nt, Homo sapiens
ucuuugcugccag

SEQ ID NO: 504446 - RNA, 19 nt, Homo sapiens
ucuuuuggauuauuccuca

SEQ ID NO: 504447 - RNA, 19 nt, Homo sapiens
ucuuuuguucuccuauauc

SEQ ID NO: 504448 - RNA, 20 nt, Homo sapiens
ugaaagcuggagucugucaa

SEQ ID NO: 504449 - RNA, 14 nt, Homo sapiens
ugaaauugucaaag

SEQ ID NO: 504450 - RNA, 16 nt, Homo sapiens
ugaacauaacuucuca

SEQ ID NO: 504451 - RNA, 15 nt, Homo sapiens
ugaacccucuugcca

SEQ ID NO: 504452 - RNA, 10 nt, Homo sapiens
ugaacuuugg

SEQ ID NO: 504453 - RNA, 12 nt, Homo sapiens
ugaagacugggu

SEQ ID NO: 504454 - RNA, 14 nt, Homo sapiens
ugaaguuuuacugu

SEQ ID NO: 504455 - RNA, 15 nt, Homo sapiens
ugaauaaaguaugua

SEQ ID NO: 504456 - RNA, 11 nt, Homo sapiens
ugaaugaauaa

SEQ ID NO: 504457 - RNA, 22 nt, Homo sapiens
ugacaacucauuuucauauugu

SEQ ID NO: 504458 - RNA, 20 nt, Homo sapiens
ugacaagugagacaaaaagc

SEQ ID NO: 504459 - RNA, 20 nt, Homo sapiens
ugacaguuuuugacauuuau

SEQ ID NO: 504460 - RNA, 22 nt, Homo sapiens
ugacaucaugaggccggaugaa

SEQ ID NO: 504461 - RNA, 19 nt, Homo sapiens
augugagcucuuccuaucc

SEQ ID NO: 504462 - RNA, 13 nt, Homo sapiens
auguuaacuagaa

SEQ ID NO: 504463 - RNA, 15 nt, Homo sapiens
auguucacuguggca

SEQ ID NO: 504464 - RNA, 19 nt, Homo sapiens
auguucccaaaacaauggu

SEQ ID NO: 504465 - RNA, 18 nt, Homo sapiens
auuaagaaauucacuucc

SEQ ID NO: 504466 - RNA, 17 nt, Homo sapiens
auuaagacaacugaguu

SEQ ID NO: 504467 - RNA, 19 nt, Homo sapiens
auuagguguucaggccagu

SEQ ID NO: 504468 - RNA, 19 nt, Homo sapiens
auuauaaaugacaaccuga

SEQ ID NO: 504469 - RNA, 21 nt, Homo sapiens
auuauuccucagaacaaugaa

SEQ ID NO: 504470 - RNA, 19 nt, Homo sapiens
auuauuuauugcuguguaa

SEQ ID NO: 504471 - RNA, 14 nt, Homo sapiens
auuauuugugcuac

SEQ ID NO: 504472 - RNA, 19 nt, Homo sapiens
auucaggagaguguauaug

SEQ ID NO: 504473 - RNA, 16 nt, Homo sapiens
auucagguaacacuag

SEQ ID NO: 504474 - RNA, 13 nt, Homo sapiens
auucugcacucag

SEQ ID NO: 504475 - RNA, 18 nt, Homo sapiens
auucuuuauucuuuuacu

SEQ ID NO: 504476 - RNA, 19 nt, Homo sapiens
auucuuugcaauacugcuu

SEQ ID NO: 504477 - RNA, 16 nt, Homo sapiens
auucuuuucucagugu

SEQ ID NO: 504478 - RNA, 17 nt, Homo sapiens
auugaacagcugugagc

SEQ ID NO: 504479 - RNA, 23 nt, Homo sapiens
auugaccauuuuuuaauuuacuu

SEQ ID NO: 504480 - RNA, 17 nt, Homo sapiens
auugaucaaugcauguu

SEQ ID NO: 504481 - RNA, 13 nt, Homo sapiens
auugcagacuguu

SEQ ID NO: 504482 - RNA, 15 nt, Homo sapiens
auugcauacuuugua

SEQ ID NO: 504483 - RNA, 14 nt, Homo sapiens
auuguagcuaugau

SEQ ID NO: 504484 - RNA, 16 nt, Homo sapiens
auugucuguaaugaca

SEQ ID NO: 504485 - RNA, 18 nt, Homo sapiens
auugucuguaaugacaaa

SEQ ID NO: 504486 - RNA, 18 nt, Homo sapiens
auuuauugcuguguaaca

SEQ ID NO: 504487 - RNA, 13 nt, Homo sapiens
auuucauacugua

SEQ ID NO: 504488 - RNA, 14 nt, Homo sapiens
auuugacuguucaa

SEQ ID NO: 504489 - RNA, 18 nt, Homo sapiens
auuugcacuauuuccaca

SEQ ID NO: 504490 - RNA, 20 nt, Homo sapiens
auuugcuuagaaagucugau

SEQ ID NO: 504491 - RNA, 21 nt, Homo sapiens
auuuuuaauguuuguacacaa

SEQ ID NO: 504492 - RNA, 13 nt, Homo sapiens
caaaaccuuucaa

SEQ ID NO: 504493 - RNA, 17 nt, Homo sapiens
caaaaccuuucaaagga

SEQ ID NO: 504494 - RNA, 14 nt, Homo sapiens
caaaacuuaggcau

SEQ ID NO: 504495 - RNA, 21 nt, Homo sapiens
caaaauauauuuuguuuacaa

SEQ ID NO: 504496 - RNA, 19 nt, Homo sapiens
caaaauccaagauucugcu

SEQ ID NO: 504497 - RNA, 21 nt, Homo sapiens
caaaauuaagcaaauguuaaa

SEQ ID NO: 504498 - RNA, 18 nt, Homo sapiens
caaacucuaaaauuauaa

SEQ ID NO: 504499 - RNA, 15 nt, Homo sapiens
caaacugcuucccuu

SEQ ID NO: 504500 - RNA, 21 nt, Homo sapiens
caaacugcuuuuuccaacuca

SEQ ID NO: 504501 - RNA, 22 nt, Homo sapiens
caaagauacacaaucugaaaca

SEQ ID NO: 504502 - RNA, 23 nt, Homo sapiens
caaagauguuaugguguuuagau

SEQ ID NO: 504503 - RNA, 18 nt, Homo sapiens
caacagguaaaacagggc

SEQ ID NO: 504504 - RNA, 12 nt, Homo sapiens
caacuaccugag

SEQ ID NO: 504505 - RNA, 18 nt, Homo sapiens
caaggcucuucuuccuca

SEQ ID NO: 504506 - RNA, 18 nt, Homo sapiens
caaggucuccagagggug

SEQ ID NO: 504507 - RNA, 14 nt, Homo sapiens
caaggugugauggu

SEQ ID NO: 504508 - RNA, 14 nt, Homo sapiens
caaguauauaugaa

SEQ ID NO: 504509 - RNA, 16 nt, Homo sapiens
caagugagacaaaaag

SEQ ID NO: 504510 - RNA, 15 nt, Homo sapiens
caauaaagcaaugug

SEQ ID NO: 504511 - RNA, 10 nt, Homo sapiens
caaucacaaa

SEQ ID NO: 504512 - RNA, 22 nt, Homo sapiens
caaucccugaggacugauuuca

SEQ ID NO: 504513 - RNA, 15 nt, Homo sapiens
caaugauuauuugua

SEQ ID NO: 504514 - RNA, 16 nt, Homo sapiens
caauugggagcugcca

SEQ ID NO: 504515 - RNA, 19 nt, Homo sapiens
caauuucuuuuauguuaac

SEQ ID NO: 504516 - RNA, 18 nt, Homo sapiens
cacacacgaugcauuuaa

SEQ ID NO: 504517 - RNA, 13 nt, Homo sapiens
cacacgaugcauu

SEQ ID NO: 504518 - RNA, 16 nt, Homo sapiens
cacacgaugcauuuaa

SEQ ID NO: 504519 - RNA, 17 nt, Homo sapiens
cacagaaggugaacuuu

SEQ ID NO: 504520 - RNA, 20 nt, Homo sapiens
cacagacgccuuacuggcaa

SEQ ID NO: 504521 - RNA, 21 nt, Homo sapiens
cacagauuauaccuggaugau

SEQ ID NO: 504522 - RNA, 13 nt, Homo sapiens
cacagcauuguau

SEQ ID NO: 504523 - RNA, 22 nt, Homo sapiens
cacaugggaguuuagugugaua

SEQ ID NO: 504524 - RNA, 19 nt, Homo sapiens
caccccaucuuugcugcca

SEQ ID NO: 504525 - RNA, 12 nt, Homo sapiens
caccuguagcug

SEQ ID NO: 504526 - RNA, 17 nt, Homo sapiens
caccuuccauagccucc

SEQ ID NO: 504527 - RNA, 21 nt, Homo sapiens
cacuccugcuuaaucuucaaa

SEQ ID NO: 504528 - RNA, 20 nt, Homo sapiens
cacuguggcauugucuguaa

SEQ ID NO: 504529 - RNA, 15 nt, Homo sapiens
cacuuuauugcaaug

SEQ ID NO: 504530 - RNA, 14 nt, Homo sapiens
cagaaaaccacuuu

SEQ ID NO: 504531 - RNA, 19 nt, Homo sapiens
cagaaaucaaaaagggaau

SEQ ID NO: 504532 - RNA, 22 nt, Homo sapiens
cagacagcccuggcaaaugccu

SEQ ID NO: 504533 - RNA, 16 nt, Homo sapiens
cagaccaccuuucaca

SEQ ID NO: 504534 - RNA, 19 nt, Homo sapiens
cagacucgcuagcacucaa

SEQ ID NO: 504535 - RNA, 19 nt, Homo sapiens
cagacuguucuuacuguaa

SEQ ID NO: 504536 - RNA, 21 nt, Homo sapiens
cagacuugaaugcuaguuaua

SEQ ID NO: 504537 - RNA, 16 nt, Homo sapiens
cagagacugaauagau

SEQ ID NO: 504538 - RNA, 13 nt, Homo sapiens
cagagcaaacaga

SEQ ID NO: 504539 - RNA, 16 nt, Homo sapiens
cagagcagagucugaa

SEQ ID NO: 504540 - RNA, 21 nt, Homo sapiens
cagagccuggggauuccagcu

SEQ ID NO: 504541 - RNA, 15 nt, Homo sapiens
uuuaugggcauccuc

SEQ ID NO: 504542 - RNA, 16 nt, Homo sapiens
uuucaaaggauaugca

SEQ ID NO: 504543 - RNA, 19 nt, Homo sapiens
uuucaaaggauaugcagaa

SEQ ID NO: 504544 - RNA, 22 nt, Homo sapiens
uuucaguacacccaguugccaa

SEQ ID NO: 504545 - RNA, 23 nt, Homo sapiens
uuucucuugcuggaacuguugaa

SEQ ID NO: 504546 - RNA, 17 nt, Homo sapiens
uuugcaugcaugcaaau

SEQ ID NO: 504547 - RNA, 21 nt, Homo sapiens
uuugcauuuugauauugcugu

SEQ ID NO: 504548 - RNA, 18 nt, Homo sapiens
uuugccaggacaugcaau

SEQ ID NO: 504549 - RNA, 15 nt, Homo sapiens
uuugcuaucugggcu

SEQ ID NO: 504550 - RNA, 20 nt, Homo sapiens
uuuggccaaaaccuuucaaa

SEQ ID NO: 504551 - RNA, 22 nt, Homo sapiens
uuuuaaacgauuagugaugucc

SEQ ID NO: 504552 - RNA, 15 nt, Homo sapiens
uuuucaaugucuaaa

SEQ ID NO: 504553 - RNA, 19 nt, Homo sapiens
uuuucucaguguugguaua

SEQ ID NO: 504554 - RNA, 16 nt, Homo sapiens
uuuuggauuauuccuc

SEQ ID NO: 504555 - RNA, 17 nt, Homo sapiens
uuuugugaaguauucac

SEQ ID NO: 504556 - RNA, 22 nt, Homo sapiens
agccuaggaaagccaguuacau

SEQ ID NO: 504557 - RNA, 20 nt, Homo sapiens
agccugcauugagcuugcau

SEQ ID NO: 504558 - RNA, 17 nt, Homo sapiens
agccugcucccuagcca

SEQ ID NO: 504559 - RNA, 17 nt, Homo sapiens
agccuggggauuccagc

SEQ ID NO: 504560 - RNA, 18 nt, Homo sapiens
agccugguuugcaaagac

SEQ ID NO: 504561 - RNA, 13 nt, Homo sapiens
agccuugcaugac

SEQ ID NO: 504562 - RNA, 20 nt, Homo sapiens
agcugcagucccaugcacaa

SEQ ID NO: 504563 - RNA, 18 nt, Homo sapiens
agcuggagucugucaaug

SEQ ID NO: 504564 - RNA, 16 nt, Homo sapiens
agcuggcucugugagg

SEQ ID NO: 504565 - RNA, 15 nt, Homo sapiens
agcuuaagaaccauu

SEQ ID NO: 504566 - RNA, 19 nt, Homo sapiens
agcuuaaugcuacauguga

SEQ ID NO: 504567 - RNA, 17 nt, Homo sapiens
agcuugugguggggcag

SEQ ID NO: 504568 - RNA, 18 nt, Homo sapiens
aggaaccaauaccuucaa

SEQ ID NO: 504569 - RNA, 23 nt, Homo sapiens
aggagcugauacuuugacagugu

SEQ ID NO: 504570 - RNA, 18 nt, Homo sapiens
aggaucacuugagcccag

SEQ ID NO: 504571 - RNA, 21 nt, Homo sapiens
aggcaagaaagcuuccuucaa

SEQ ID NO: 504572 - RNA, 14 nt, Homo sapiens
aggcccaacauuaa

SEQ ID NO: 504573 - RNA, 17 nt, Homo sapiens
aggcucuaauguacaau

SEQ ID NO: 504574 - RNA, 19 nt, Homo sapiens
aggcucuaauguacaauaa

SEQ ID NO: 504575 - RNA, 16 nt, Homo sapiens
gucuaaaaacauuugu

SEQ ID NO: 504576 - RNA, 19 nt, Homo sapiens
gucuaagguucagccugaa

SEQ ID NO: 504577 - RNA, 23 nt, Homo sapiens
gucucauaaugcauguggcacuu

SEQ ID NO: 504578 - RNA, 20 nt, Homo sapiens
gucugaacaauauauacuua

SEQ ID NO: 504579 - RNA, 22 nt, Homo sapiens
gucugguaauaaaugugacuca

SEQ ID NO: 504580 - RNA, 19 nt, Homo sapiens
gucugguugggcagccaga

SEQ ID NO: 504581 - RNA, 14 nt, Homo sapiens
gucuuuaaccacuu

SEQ ID NO: 504582 - RNA, 15 nt, Homo sapiens
gucuuuuuccaaaaa

SEQ ID NO: 504583 - RNA, 18 nt, Homo sapiens
cauggagacagcaguuuc

SEQ ID NO: 504584 - RNA, 19 nt, Homo sapiens
cauggauauguuauacuga

SEQ ID NO: 504585 - RNA, 23 nt, Homo sapiens
caugggugcagacccugaaccca

SEQ ID NO: 504586 - RNA, 17 nt, Homo sapiens
caugguaauucacuuca

SEQ ID NO: 504587 - RNA, 15 nt, Homo sapiens
cauguucccaaaaca

SEQ ID NO: 504588 - RNA, 17 nt, Homo sapiens
cauguucccaaaacaau

SEQ ID NO: 504589 - RNA, 23 nt, Homo sapiens
cauguuuugccacccccugugag

SEQ ID NO: 504590 - RNA, 19 nt, Homo sapiens
cauuaaggggaagaaugaa

SEQ ID NO: 504591 - RNA, 14 nt, Homo sapiens
cauucuuugcaaua

SEQ ID NO: 504592 - RNA, 20 nt, Homo sapiens
cauucuuugcaauacugcuu

SEQ ID NO: 504593 - RNA, 23 nt, Homo sapiens
cauugaacagcugugagccaugc

SEQ ID NO: 504594 - RNA, 17 nt, Homo sapiens
cauugauuuaauguaau

SEQ ID NO: 504595 - RNA, 18 nt, Homo sapiens
cauugcacauaagcuucc

SEQ ID NO: 504596 - RNA, 22 nt, Homo sapiens
cauuuggguuugaaucugaaug

SEQ ID NO: 504597 - RNA, 13 nt, Homo sapiens
ggauguugcucag

SEQ ID NO: 504598 - RNA, 15 nt, Homo sapiens
ggauuacuuuggcca

SEQ ID NO: 504599 - RNA, 16 nt, Homo sapiens
ggauucagcaugucca

SEQ ID NO: 504600 - RNA, 14 nt, Homo sapiens
ggauuuuucuuuaa

SEQ ID NO: 504601 - RNA, 13 nt, Homo sapiens
ggcaaaugccuga

SEQ ID NO: 504602 - RNA, 23 nt, Homo sapiens
ggcaccacucuccuuucacagag

SEQ ID NO: 504603 - RNA, 23 nt, Homo sapiens
ggcacccacaaauaaaugacaag

SEQ ID NO: 504604 - RNA, 13 nt, Homo sapiens
ggcaggacagcuc

SEQ ID NO: 504605 - RNA, 21 nt, Homo sapiens
ggccaaagagucuccaguuua

SEQ ID NO: 504606 - RNA, 23 nt, Homo sapiens
ggccauaaacgguuccuggugac

SEQ ID NO: 504607 - RNA, 18 nt, Homo sapiens
ggccccaucuccacagga

SEQ ID NO: 504608 - RNA, 16 nt, Homo sapiens
ggccucaccccaggga

SEQ ID NO: 504609 - RNA, 19 nt, Homo sapiens
ggccucugagaagcucuga

SEQ ID NO: 504610 - RNA, 13 nt, Homo sapiens
ggccuuguaagac

SEQ ID NO: 504611 - RNA, 22 nt, Homo sapiens
ggcuaagaagugacucuugcaa

SEQ ID NO: 504612 - RNA, 19 nt, Homo sapiens
ggcucuaauguacaauaaa

SEQ ID NO: 504613 - RNA, 18 nt, Homo sapiens
ggcugugggcaagccuaa

SEQ ID NO: 504614 - RNA, 18 nt, Homo sapiens
ggcuuaggaaagugauau

SEQ ID NO: 504615 - RNA, 13 nt, Homo sapiens
gggauagaaagga

SEQ ID NO: 504616 - RNA, 13 nt, Homo sapiens
gggauggguccuc

SEQ ID NO: 504617 - RNA, 16 nt, Homo sapiens
gggccaccuccuaccc

SEQ ID NO: 504618 - RNA, 14 nt, Homo sapiens
gggccccaucucca

SEQ ID NO: 504619 - RNA, 20 nt, Homo sapiens
gggcuggaaggaccugcucc

SEQ ID NO: 504620 - RNA, 21 nt, Homo sapiens
ggggacacagcaucagcucaa

SEQ ID NO: 504621 - RNA, 17 nt, Homo sapiens
ggggagauugaacuuuc

SEQ ID NO: 504622 - RNA, 17 nt, Homo sapiens
ggggaggccucacccca

SEQ ID NO: 504623 - RNA, 16 nt, Homo sapiens
gggucaucgcugccca

SEQ ID NO: 504624 - RNA, 22 nt, Homo sapiens
gggucccugcaaaacuccaggc

SEQ ID NO: 504625 - RNA, 18 nt, Homo sapiens
cuccucaaaccacuugcc

SEQ ID NO: 504626 - RNA, 14 nt, Homo sapiens
cucuaacauaccuu

SEQ ID NO: 504627 - RNA, 16 nt, Homo sapiens
cucuaauguacaauaa

SEQ ID NO: 504628 - RNA, 22 nt, Homo sapiens
cucuaauguacaauaaagcaau

SEQ ID NO: 504629 - RNA, 23 nt, Homo sapiens
cucuaauguacaauaaagcaaug

SEQ ID NO: 504630 - RNA, 12 nt, Homo sapiens
cucuagacuuga

SEQ ID NO: 504631 - RNA, 17 nt, Homo sapiens
cucuagggccucagucu

SEQ ID NO: 504632 - RNA, 21 nt, Homo sapiens
cucuagguacgaugacagugu

SEQ ID NO: 504633 - RNA, 17 nt, Homo sapiens
cucuauaaaguauggua

SEQ ID NO: 504634 - RNA, 14 nt, Homo sapiens
cucucccuuguaca

SEQ ID NO: 504635 - RNA, 23 nt, Homo sapiens
cucuuagagaaagaacuaugaaa

SEQ ID NO: 504636 - RNA, 12 nt, Homo sapiens
cucuuagcucag

SEQ ID NO: 504637 - RNA, 13 nt, Homo sapiens
cucuuagcucagc

SEQ ID NO: 504638 - RNA, 21 nt, Homo sapiens
cucuugcuggaacuguugaaa

SEQ ID NO: 504639 - RNA, 19 nt, Homo sapiens
cucuuguaauaaaaugucu

SEQ ID NO: 504640 - RNA, 21 nt, Homo sapiens
cugaaacucauagacacugau

SEQ ID NO: 504641 - RNA, 16 nt, Homo sapiens
cugagcagcauccacc

SEQ ID NO: 504642 - RNA, 15 nt, Homo sapiens
cugcauggauucagc

SEQ ID NO: 504643 - RNA, 23 nt, Homo sapiens
cugccaugggugcagacccugaa

SEQ ID NO: 504644 - RNA, 19 nt, Homo sapiens
cugcccaccuggcugccaa

SEQ ID NO: 504645 - RNA, 14 nt, Homo sapiens
cugcgacagaacuu

SEQ ID NO: 504646 - RNA, 15 nt, Homo sapiens
cugcucccuagccag

SEQ ID NO: 504647 - RNA, 16 nt, Homo sapiens
cugcugcacacacuca

SEQ ID NO: 504648 - RNA, 16 nt, Homo sapiens
cugcuguugaacuuuu

SEQ ID NO: 504649 - RNA, 14 nt, Homo sapiens
cuggauuugcagaa

SEQ ID NO: 504650 - RNA, 23 nt, Homo sapiens
cuggcaaaugccugacucaguga

SEQ ID NO: 504651 - RNA, 14 nt, Homo sapiens
cuggcacagaggua

SEQ ID NO: 504652 - RNA, 15 nt, Homo sapiens
cuggggacuccucaa

SEQ ID NO: 504653 - RNA, 15 nt, Homo sapiens
cuggggauuccagcu

SEQ ID NO: 504654 - RNA, 15 nt, Homo sapiens
cuggucaaguuguaa

SEQ ID NO: 504655 - RNA, 18 nt, Homo sapiens
cuggucccucuucucucc

SEQ ID NO: 504656 - RNA, 16 nt, Homo sapiens
cugguuggcagcaucu

SEQ ID NO: 504657 - RNA, 15 nt, Homo sapiens
cuguaaugacaaaua

SEQ ID NO: 504658 - RNA, 15 nt, Homo sapiens
cuguaucacugccuu

SEQ ID NO: 504659 - RNA, 23 nt, Homo sapiens
cuguaugggggagauugaacuuu

SEQ ID NO: 504660 - RNA, 22 nt, Homo sapiens
cugucaauguccuacugagaca

SEQ ID NO: 504661 - RNA, 14 nt, Homo sapiens
cugucauugcacau

SEQ ID NO: 504662 - RNA, 17 nt, Homo sapiens
cuguccugccuccucau

SEQ ID NO: 504663 - RNA, 14 nt, Homo sapiens
cugucuuugcugag

SEQ ID NO: 504664 - RNA, 16 nt, Homo sapiens
cugugagcauggggcc

SEQ ID NO: 504665 - RNA, 16 nt, Homo sapiens
cugugauuacugcaau

SEQ ID NO: 504666 - RNA, 18 nt, Homo sapiens
cugugcaggauauuugca

SEQ ID NO: 504667 - RNA, 14 nt, Homo sapiens
cugugucucaugga

SEQ ID NO: 504668 - RNA, 21 nt, Homo sapiens
cuguucaaugauuauuuguau

SEQ ID NO: 504669 - RNA, 20 nt, Homo sapiens
cuguucuaaggcugugccau

SEQ ID NO: 504670 - RNA, 23 nt, Homo sapiens
cuguugcacuuuugaauguccaa

SEQ ID NO: 504671 - RNA, 22 nt, Homo sapiens
cuuaaacgaagaguucccuuga

SEQ ID NO: 504672 - RNA, 18 nt, Homo sapiens
cuuaaugcuacaugugag

SEQ ID NO: 504673 - RNA, 18 nt, Homo sapiens
cuuagagcuuuaccuaaa

SEQ ID NO: 504674 - RNA, 18 nt, Homo sapiens
cuuauugacaauugugua

SEQ ID NO: 504675 - RNA, 23 nt, Homo sapiens
cuucaaggcucuucuuccucacc

SEQ ID NO: 504676 - RNA, 23 nt, Homo sapiens
cuuccuccccuguucauucugca

SEQ ID NO: 504677 - RNA, 15 nt, Homo sapiens
cuuccucugcagaau

SEQ ID NO: 504678 - RNA, 19 nt, Homo sapiens
cuuccuggaggugacacuu

SEQ ID NO: 504679 - RNA, 17 nt, Homo sapiens
cuucucuccuuucuccc

SEQ ID NO: 504680 - RNA, 23 nt, Homo sapiens
cuucucugcuaucuagaucugaa

SEQ ID NO: 504681 - RNA, 21 nt, Homo sapiens
cuucugccucccacuccauac

SEQ ID NO: 504682 - RNA, 20 nt, Homo sapiens
cuugggcaugggggagccuu

SEQ ID NO: 504683 - RNA, 22 nt, Homo sapiens
cuugugucugcggggaucagag

SEQ ID NO: 504684 - RNA, 22 nt, Homo sapiens
cuuuaagccuucaaaacuauag

SEQ ID NO: 504685 - RNA, 14 nt, Homo sapiens
cuuucuuauccaac

SEQ ID NO: 504686 - RNA, 17 nt, Homo sapiens
cuuugaguagauccauu

SEQ ID NO: 504687 - RNA, 20 nt, Homo sapiens
cuuugucuaaguagggccag

SEQ ID NO: 504688 - RNA, 20 nt, Homo sapiens
cuuuuaaaaaauacucugcu

SEQ ID NO: 504689 - RNA, 21 nt, Homo sapiens
cuuuuuaaagaagugcaugaa

SEQ ID NO: 504690 - RNA, 18 nt, Homo sapiens
cuuuuuauucuacuacuu

SEQ ID NO: 504691 - RNA, 14 nt, Homo sapiens
gaaaaccacuuuau

SEQ ID NO: 504692 - RNA, 21 nt, Homo sapiens
gaaaaccacuuuauugcaaug

SEQ ID NO: 504693 - RNA, 23 nt, Homo sapiens
gaaaaguguguauauauuuugug

SEQ ID NO: 504694 - RNA, 23 nt, Homo sapiens
gaaacacauucuuauugacaauu

SEQ ID NO: 504695 - RNA, 14 nt, Homo sapiens
gaaacaucauuuca

SEQ ID NO: 504696 - RNA, 14 nt, Homo sapiens
gaaagaugagcuuu

SEQ ID NO: 504697 - RNA, 17 nt, Homo sapiens
gaaaucaaaaagggaau

SEQ ID NO: 504698 - RNA, 13 nt, Homo sapiens
gaacaaacagggc

SEQ ID NO: 504699 - RNA, 21 nt, Homo sapiens
gaacaaugaaaaaagucucca

SEQ ID NO: 504700 - RNA, 14 nt, Homo sapiens
gaacagcugugagc

SEQ ID NO: 504701 - RNA, 18 nt, Homo sapiens
gaacagcugugagccaug

SEQ ID NO: 504702 - RNA, 18 nt, Homo sapiens
gaaccaggccagagcaaa

SEQ ID NO: 504703 - RNA, 17 nt, Homo sapiens
gaacuccuuggcuucuu

SEQ ID NO: 504704 - RNA, 16 nt, Homo sapiens
gaacuuucaaaauaua

SEQ ID NO: 504705 - RNA, 14 nt, Homo sapiens
aaaaaauacucugc

SEQ ID NO: 504706 - RNA, 13 nt, Homo sapiens
aaaaaauagcaca

SEQ ID NO: 504707 - RNA, 12 nt, Homo sapiens
aaaaacaauuaa

SEQ ID NO: 504708 - RNA, 18 nt, Homo sapiens
aaaaaccauaggcugcuc

SEQ ID NO: 504709 - RNA, 19 nt, Homo sapiens
aaaaauaaaaaagaucucc

SEQ ID NO: 504710 - RNA, 18 nt, Homo sapiens
aaaaauacucugcuauuu

SEQ ID NO: 504711 - RNA, 20 nt, Homo sapiens
aaaauagaaauauagccaaa

SEQ ID NO: 504712 - RNA, 19 nt, Homo sapiens
aaaauccaugaacaauuua

SEQ ID NO: 504713 - RNA, 14 nt, Homo sapiens
aaaaugucaucuca

SEQ ID NO: 504714 - RNA, 20 nt, Homo sapiens
aaacagacucgcuagcacuc

SEQ ID NO: 504715 - RNA, 18 nt, Homo sapiens
aaacaggugcuaauuugu

SEQ ID NO: 504716 - RNA, 21 nt, Homo sapiens
aaacagguuauaacaguguuu

SEQ ID NO: 504717 - RNA, 18 nt, Homo sapiens
aaacaugggcugugauua

SEQ ID NO: 504718 - RNA, 19 nt, Homo sapiens
aaacauguuaaugacaaua

SEQ ID NO: 504719 - RNA, 11 nt, Homo sapiens
aaacauuugcu

SEQ ID NO: 504720 - RNA, 13 nt, Homo sapiens
aaaccacuugccu

SEQ ID NO: 504721 - RNA, 22 nt, Homo sapiens
aaaccauuuuguuauugacuaa

SEQ ID NO: 504722 - RNA, 16 nt, Homo sapiens
aaacgaaaugcuauga

SEQ ID NO: 504723 - RNA, 13 nt, Homo sapiens
aaacgguuccugg

SEQ ID NO: 504724 - RNA, 13 nt, Homo sapiens
aaacuaacuugau

SEQ ID NO: 504725 - RNA, 17 nt, Homo sapiens
aaacuuaggcaugcaca

SEQ ID NO: 504726 - RNA, 17 nt, Homo sapiens
aaagacuggauuugcag

SEQ ID NO: 504727 - RNA, 22 nt, Homo sapiens
acaagcauucugucuugaaggg

SEQ ID NO: 504728 - RNA, 18 nt, Homo sapiens
acaauaauuuucuaccug

SEQ ID NO: 504729 - RNA, 15 nt, Homo sapiens
uggagcugaauuuga

SEQ ID NO: 504730 - RNA, 11 nt, Homo sapiens
ugggaugcuac

SEQ ID NO: 504731 - RNA, 20 nt, Homo sapiens
ugggugguguauuugagaag

SEQ ID NO: 504732 - RNA, 13 nt, Homo sapiens
uguaucuaugcau

SEQ ID NO: 504733 - RNA, 15 nt, Homo sapiens
uguaucuaugcauuu

SEQ ID NO: 504734 - RNA, 14 nt, Homo sapiens
uguccaaacugucg

SEQ ID NO: 504735 - RNA, 13 nt, Homo sapiens
ugucucucaugaa

SEQ ID NO: 504736 - RNA, 21 nt, Homo sapiens
ugugaguugcacagcuaugaa

SEQ ID NO: 504737 - RNA, 14 nt, Homo sapiens
uguuacuacaugca

SEQ ID NO: 504738 - RNA, 12 nt, Homo sapiens
uguucauuuccu

SEQ ID NO: 504739 - RNA, 14 nt, Homo sapiens
uuaauaaauguaua

SEQ ID NO: 504740 - RNA, 15 nt, Homo sapiens
uuaauggugccuuca

SEQ ID NO: 504741 - RNA, 20 nt, Homo sapiens
uuacaauaauucuaugagau

SEQ ID NO: 504742 - RNA, 22 nt, Homo sapiens
uuacacauguaucuaugcauuu

SEQ ID NO: 504743 - RNA, 19 nt, Homo sapiens
uuagaguguaggugaaaug

SEQ ID NO: 504744 - RNA, 12 nt, Homo sapiens
uuaggcauuaaa

SEQ ID NO: 504745 - RNA, 20 nt, Homo sapiens
uuaguauuauuguugcauua

SEQ ID NO: 504746 - RNA, 22 nt, Homo sapiens
uuaguauuauuguugcauuaaa

SEQ ID NO: 504747 - RNA, 18 nt, Homo sapiens
uucauuuuaacaucugag

SEQ ID NO: 504748 - RNA, 21 nt, Homo sapiens
uuccaucugauugugauguga

SEQ ID NO: 504749 - RNA, 21 nt, Homo sapiens
uucccuaaguccaacuacuaa

SEQ ID NO: 504750 - RNA, 14 nt, Homo sapiens
uucugcaagcaauc

SEQ ID NO: 504751 - RNA, 13 nt, Homo sapiens
uucugccuaauaa

SEQ ID NO: 504752 - RNA, 20 nt, Homo sapiens
uucuggacccguucaacuuu

SEQ ID NO: 504753 - RNA, 15 nt, Homo sapiens
uucuuacucugaaac

SEQ ID NO: 504754 - RNA, 20 nt, Homo sapiens
uugaaaacagaaucaguguu

SEQ ID NO: 504755 - RNA, 18 nt, Homo sapiens
uuggcaugaaggugucau

SEQ ID NO: 504756 - RNA, 15 nt, Homo sapiens
uuuucuuacucugaa

SEQ ID NO: 504757 - RNA, 21 nt, Homo sapiens
aaaauaauagacucgcuaguc

SEQ ID NO: 504758 - RNA, 20 nt, Homo sapiens
aaaauccgacaagccuucag

SEQ ID NO: 504759 - RNA, 16 nt, Homo sapiens
aaagagggagugcauu

SEQ ID NO: 504760 - RNA, 15 nt, Homo sapiens
aaauacagcuaugaa

SEQ ID NO: 504761 - RNA, 15 nt, Homo sapiens
aaauugccugacgaa

SEQ ID NO: 504762 - RNA, 13 nt, Homo sapiens
aacggacucagug

SEQ ID NO: 504763 - RNA, 22 nt, Homo sapiens
aacggacucaguggacacucag

SEQ ID NO: 504764 - RNA, 21 nt, Homo sapiens
aacugucgugcaaacccagug

SEQ ID NO: 504765 - RNA, 19 nt, Homo sapiens
aagccuucagccacaggga

SEQ ID NO: 504766 - RNA, 20 nt, Homo sapiens
aagccuuggggauucuucca

SEQ ID NO: 504767 - RNA, 12 nt, Homo sapiens
aagcuuugaacc

SEQ ID NO: 504768 - RNA, 19 nt, Homo sapiens
aaggagacaaaacuagaga

SEQ ID NO: 504769 - RNA, 16 nt, Homo sapiens
aagggcaggugcuuca

SEQ ID NO: 504770 - RNA, 15 nt, Homo sapiens
aaguccaacuacuaa

SEQ ID NO: 504771 - RNA, 16 nt, Homo sapiens
caauaaaccaaugaac

SEQ ID NO: 504772 - RNA, 19 nt, Homo sapiens
caauaauucuaugagauag

SEQ ID NO: 504773 - RNA, 15 nt, Homo sapiens
cacauguaucuaugc

SEQ ID NO: 504774 - RNA, 17 nt, Homo sapiens
caccuacuuacaugcau

SEQ ID NO: 504775 - RNA, 12 nt, Homo sapiens
cacgaauggacc

SEQ ID NO: 504776 - RNA, 14 nt, Homo sapiens
cagacucacugugg

SEQ ID NO: 504777 - RNA, 16 nt, Homo sapiens
cagacucacuguggga

SEQ ID NO: 504778 - RNA, 22 nt, Homo sapiens
cagagacauacaccuaugucau

SEQ ID NO: 504779 - RNA, 19 nt, Homo sapiens
caggauaccauauacagcu

SEQ ID NO: 504780 - RNA, 20 nt, Homo sapiens
cauaaaugugguacaagcau

SEQ ID NO: 504781 - RNA, 12 nt, Homo sapiens
cauauacuuuaa

SEQ ID NO: 504782 - RNA, 19 nt, Homo sapiens
caucuagaggcuuccuuca

SEQ ID NO: 504783 - RNA, 14 nt, Homo sapiens
caucugauugugau

SEQ ID NO: 504784 - RNA, 18 nt, Homo sapiens
caucuggauucugccuaa

SEQ ID NO: 504785 - RNA, 20 nt, Homo sapiens
caugcacuuggcugcauaaa

SEQ ID NO: 504786 - RNA, 15 nt, Homo sapiens
cauguaucuaugcau

SEQ ID NO: 504787 - RNA, 16 nt, Homo sapiens
cauguguuuacuuuau

SEQ ID NO: 504788 - RNA, 13 nt, Homo sapiens
cauuacugcaugc

SEQ ID NO: 504789 - RNA, 21 nt, Homo sapiens
cauuacugcaugcacuucuua

SEQ ID NO: 504790 - RNA, 18 nt, Homo sapiens
cauuuuaacaucugagaa

SEQ ID NO: 504791 - RNA, 22 nt, Homo sapiens
ccaaacugucgugcaaacccag

SEQ ID NO: 504792 - RNA, 15 nt, Homo sapiens
ccaauaaaccaauga

SEQ ID NO: 504793 - RNA, 17 nt, Homo sapiens
ccagauggcccuggaca

SEQ ID NO: 504794 - RNA, 19 nt, Homo sapiens
ccgucaaaagagucuuaau

SEQ ID NO: 504795 - RNA, 13 nt, Homo sapiens
ccguucaacuuuu

SEQ ID NO: 504796 - RNA, 16 nt, Homo sapiens
ccuagcugugaccucu

SEQ ID NO: 504797 - RNA, 21 nt, Homo sapiens
ccuggaacugucucucaugaa

SEQ ID NO: 504798 - RNA, 19 nt, Homo sapiens
cgacaagccuucagccaca

SEQ ID NO: 504799 - RNA, 16 nt, Homo sapiens
aaaaaugcauauacuu

SEQ ID NO: 504800 - RNA, 18 nt, Homo sapiens
aaaagaaugaugcuauga

SEQ ID NO: 504801 - RNA, 16 nt, Homo sapiens
aaaauacagcuaugaa

SEQ ID NO: 504802 - RNA, 18 nt, Homo sapiens
aaaaugcauauacuuuaa

SEQ ID NO: 504803 - RNA, 16 nt, Homo sapiens
aaacccagugagacag

SEQ ID NO: 504804 - RNA, 23 nt, Homo sapiens
aaacugucgugcaaacccaguga

SEQ ID NO: 504805 - RNA, 23 nt, Homo sapiens
aaauuuugaaccauucccuaguc

SEQ ID NO: 504806 - RNA, 18 nt, Homo sapiens
aacacggacccauagaca

SEQ ID NO: 504807 - RNA, 22 nt, Homo sapiens
aaccaauaauggucaguccuca

SEQ ID NO: 504808 - RNA, 21 nt, Homo sapiens
aacccagugagacagaccgcc

SEQ ID NO: 504809 - RNA, 14 nt, Homo sapiens
aaccuaaacauaga

SEQ ID NO: 504810 - RNA, 14 nt, Homo sapiens
aacggacucagugg

SEQ ID NO: 504811 - RNA, 15 nt, Homo sapiens
aacucaucugucacc

SEQ ID NO: 504812 - RNA, 23 nt, Homo sapiens
aacugucgugcaaacccagugag

SEQ ID NO: 504813 - RNA, 22 nt, Homo sapiens
aacugucucucaugaaccucaa

SEQ ID NO: 504814 - RNA, 14 nt, Homo sapiens
aagaaugaugcuau

SEQ ID NO: 504815 - RNA, 20 nt, Homo sapiens
aagauauuugaauauguauc

SEQ ID NO: 504816 - RNA, 12 nt, Homo sapiens
aauaaaccaaug

SEQ ID NO: 504817 - RNA, 20 nt, Homo sapiens
aauaauagacucgcuaguca

SEQ ID NO: 504818 - RNA, 23 nt, Homo sapiens
aauaauggucaguccucaucucu

SEQ ID NO: 504819 - RNA, 14 nt, Homo sapiens
aauacagcuaugaa

SEQ ID NO: 504820 - RNA, 20 nt, Homo sapiens
aaucccagcaugcugagauu

SEQ ID NO: 504821 - RNA, 15 nt, Homo sapiens
aaucuauucugcuaa

SEQ ID NO: 504822 - RNA, 16 nt, Homo sapiens
aaucuauucugcuaag

SEQ ID NO: 504823 - RNA, 15 nt, Homo sapiens
aaugaauacaauuaa

SEQ ID NO: 504824 - RNA, 15 nt, Homo sapiens
aaugaugcuaugaaa

SEQ ID NO: 504825 - RNA, 15 nt, Homo sapiens
aaugugguacaagca

SEQ ID NO: 504826 - RNA, 14 nt, Homo sapiens
aauucuaugagaua

SEQ ID NO: 504827 - RNA, 19 nt, Homo sapiens
acaagccuucagccacagg

SEQ ID NO: 504828 - RNA, 20 nt, Homo sapiens
acacauguaucuaugcauuu

SEQ ID NO: 504829 - RNA, 16 nt, Homo sapiens
acagaccgccaaauaa

SEQ ID NO: 504830 - RNA, 20 nt, Homo sapiens
acagcuaugaaggcuguaca

SEQ ID NO: 504831 - RNA, 17 nt, Homo sapiens
acaugcauuacugcaug

SEQ ID NO: 504832 - RNA, 21 nt, Homo sapiens
accagauuuuuacacauguau

SEQ ID NO: 504833 - RNA, 13 nt, Homo sapiens
accauauacagcu

SEQ ID NO: 504834 - RNA, 16 nt, Homo sapiens
accauucccuagucau

SEQ ID NO: 504835 - RNA, 13 nt, Homo sapiens
acccauagacagc

SEQ ID NO: 504836 - RNA, 22 nt, Homo sapiens
accuaaacauagaaauugccug

SEQ ID NO: 504837 - RNA, 14 nt, Homo sapiens
accuacuuacaugc

SEQ ID NO: 504838 - RNA, 15 nt, Homo sapiens
accuuaccagauuuu

SEQ ID NO: 504839 - RNA, 20 nt, Homo sapiens
acggaaaauccgacaagccu

SEQ ID NO: 504840 - RNA, 16 nt, Homo sapiens
acggacccauagacag

SEQ ID NO: 504841 - RNA, 11 nt, Homo sapiens
acuacaugcac

SEQ ID NO: 504842 - RNA, 13 nt, Homo sapiens
acuacaugcacuu

SEQ ID NO: 504843 - RNA, 11 nt, Homo sapiens
acucacugugg

SEQ ID NO: 504844 - RNA, 12 nt, Homo sapiens
acucacuguggg

SEQ ID NO: 504845 - RNA, 15 nt, Homo sapiens
acucaguggacacuc

SEQ ID NO: 504846 - RNA, 18 nt, Homo sapiens
acucaguggacacucaga

SEQ ID NO: 504847 - RNA, 21 nt, Homo sapiens
acucaucugucaccaagccuu

SEQ ID NO: 504848 - RNA, 14 nt, Homo sapiens
acucuaguauucca

SEQ ID NO: 504849 - RNA, 21 nt, Homo sapiens
acucuucugagcaccuacuua

SEQ ID NO: 504850 - RNA, 15 nt, Homo sapiens
agaaugaugcuauga

SEQ ID NO: 504851 - RNA, 15 nt, Homo sapiens
agacaaaacuagaga

SEQ ID NO: 504852 - RNA, 23 nt, Homo sapiens
agacucaaagagggagugcauuu

SEQ ID NO: 504853 - RNA, 16 nt, Homo sapiens
agaggcaccuguccca

SEQ ID NO: 504854 - RNA, 13 nt, Homo sapiens
agagggagugcau

SEQ ID NO: 504855 - RNA, 16 nt, Homo sapiens
agauccacccaaauau

SEQ ID NO: 504856 - RNA, 19 nt, Homo sapiens
agauuacuuuucuuacucu

SEQ ID NO: 504857 - RNA, 20 nt, Homo sapiens
agauuuuuacacauguaucu

SEQ ID NO: 504858 - RNA, 18 nt, Homo sapiens
agcaccuacuuacaugca

SEQ ID NO: 504859 - RNA, 16 nt, Homo sapiens
agcauucugucuugaa

SEQ ID NO: 504860 - RNA, 19 nt, Homo sapiens
agccacagggagccacaca

SEQ ID NO: 504861 - RNA, 21 nt, Homo sapiens
agccacagggagccacacaga

SEQ ID NO: 504862 - RNA, 22 nt, Homo sapiens
agccuucucuguucauuuccuc

SEQ ID NO: 504863 - RNA, 18 nt, Homo sapiens
agcuaugaaggcuguaca

SEQ ID NO: 504864 - RNA, 20 nt, Homo sapiens
aggacgugcagacaggcugg

SEQ ID NO: 504865 - RNA, 12 nt, Homo sapiens
aggacuccuuaa

SEQ ID NO: 504866 - RNA, 13 nt, Homo sapiens
aggacuccuuaaa

SEQ ID NO: 504867 - RNA, 20 nt, Homo sapiens
aggauaggcuuuauucugca

SEQ ID NO: 504868 - RNA, 22 nt, Homo sapiens
aggauaggcuuuauucugcaag

SEQ ID NO: 504869 - RNA, 17 nt, Homo sapiens
agggagccacacagaga

SEQ ID NO: 504870 - RNA, 23 nt, Homo sapiens
agugcacugagaacagcauauga

SEQ ID NO: 504871 - RNA, 20 nt, Homo sapiens
agugcgggauucaaaggugg

SEQ ID NO: 504872 - RNA, 13 nt, Homo sapiens
auaaaagcacuua

SEQ ID NO: 504873 - RNA, 17 nt, Homo sapiens
auaaaagcacuuacuuc

SEQ ID NO: 504874 - RNA, 20 nt, Homo sapiens
auaaacggacucaguggaca

SEQ ID NO: 504875 - RNA, 18 nt, Homo sapiens
auaaaugugguacaagca

SEQ ID NO: 504876 - RNA, 14 nt, Homo sapiens
auacaauuaaagcu

SEQ ID NO: 504877 - RNA, 19 nt, Homo sapiens
auaggcuuuauucugcaag

SEQ ID NO: 504878 - RNA, 17 nt, Homo sapiens
auauccagauggcaugu

SEQ ID NO: 504879 - RNA, 23 nt, Homo sapiens
auauccagauggcauguguuuac

SEQ ID NO: 504880 - RNA, 13 nt, Homo sapiens
auaucucaucucu

SEQ ID NO: 504881 - RNA, 19 nt, Homo sapiens
aucucuucuuuuaaaccau

SEQ ID NO: 504882 - RNA, 14 nt, Homo sapiens
augaaggcuguaca

SEQ ID NO: 504883 - RNA, 15 nt, Homo sapiens
augaggcuucccaga

SEQ ID NO: 504884 - RNA, 13 nt, Homo sapiens
augauaaaagcac

SEQ ID NO: 504885 - RNA, 22 nt, Homo sapiens
augauucauuuuaacaucugag

SEQ ID NO: 504886 - RNA, 20 nt, Homo sapiens
augcacuuggcugcauaaau

SEQ ID NO: 504887 - RNA, 21 nt, Homo sapiens
auggaagaggcaccuguccca

SEQ ID NO: 504888 - RNA, 16 nt, Homo sapiens
auggagcugaauuuga

SEQ ID NO: 504889 - RNA, 13 nt, Homo sapiens
auuaaagcuguua

SEQ ID NO: 504890 - RNA, 13 nt, Homo sapiens
auuacagguguga

SEQ ID NO: 504891 - RNA, 16 nt, Homo sapiens
auuacugcaugcacuu

SEQ ID NO: 504892 - RNA, 18 nt, Homo sapiens
auucagagcuuucaagga

SEQ ID NO: 504893 - RNA, 18 nt, Homo sapiens
auucauuuuaacaucuga

SEQ ID NO: 504894 - RNA, 17 nt, Homo sapiens
auuccagaccugaagaa

SEQ ID NO: 504895 - RNA, 18 nt, Homo sapiens
auuguagaaaagcuauaa

SEQ ID NO: 504896 - RNA, 21 nt, Homo sapiens
auuucuuuuuuaaaugaagaa

SEQ ID NO: 504897 - RNA, 20 nt, Homo sapiens
auuugggggacuuacaugau

SEQ ID NO: 504898 - RNA, 21 nt, Homo sapiens
auuuuagcaaagauaucucau

SEQ ID NO: 504899 - RNA, 16 nt, Homo sapiens
auuuuuacacauguau

SEQ ID NO: 504900 - RNA, 18 nt, Homo sapiens
caaaauacagcuaugaag

SEQ ID NO: 504901 - RNA, 16 nt, Homo sapiens
caaagauccacccaaa

SEQ ID NO: 504902 - RNA, 21 nt, Homo sapiens
cggccccucccccguccugga

SEQ ID NO: 504903 - RNA, 20 nt, Homo sapiens
cgugcaaacccagugagaca

SEQ ID NO: 504904 - RNA, 14 nt, Homo sapiens
cguguccgacucuu

SEQ ID NO: 504905 - RNA, 19 nt, Homo sapiens
cuaauuggcaugaaggugu

SEQ ID NO: 504906 - RNA, 18 nt, Homo sapiens
cuacugcaaauggcaguu

SEQ ID NO: 504907 - RNA, 15 nt, Homo sapiens
cuagcugugaccucu

SEQ ID NO: 504908 - RNA, 19 nt, Homo sapiens
cuaugucauuucauuuccu

SEQ ID NO: 504909 - RNA, 12 nt, Homo sapiens
cuauuaaagguu

SEQ ID NO: 504910 - RNA, 11 nt, Homo sapiens
cuauucugcua

SEQ ID NO: 504911 - RNA, 20 nt, Homo sapiens
cucacugcccaugauucaga

SEQ ID NO: 504912 - RNA, 15 nt, Homo sapiens
cucuguucauuuccu

SEQ ID NO: 504913 - RNA, 16 nt, Homo sapiens
cugaguuccugcaugc

SEQ ID NO: 504914 - RNA, 19 nt, Homo sapiens
cugauaaugaaaauuauga

SEQ ID NO: 504915 - RNA, 18 nt, Homo sapiens
cugcagacucacuguggg

SEQ ID NO: 504916 - RNA, 18 nt, Homo sapiens
cugcaugcacuucuuaca

SEQ ID NO: 504917 - RNA, 15 nt, Homo sapiens
cugcuaagagaucac

SEQ ID NO: 504918 - RNA, 16 nt, Homo sapiens
cuggaacugucucuca

SEQ ID NO: 504919 - RNA, 20 nt, Homo sapiens
cuggaacugucucucaugaa

SEQ ID NO: 504920 - RNA, 17 nt, Homo sapiens
cuggggaugggacaaga

SEQ ID NO: 504921 - RNA, 13 nt, Homo sapiens
cuguacacugcac

SEQ ID NO: 504922 - RNA, 15 nt, Homo sapiens
cugucaccaagccuu

SEQ ID NO: 504923 - RNA, 24 nt, Homo sapiens
cuguguuacccaguaacucaucug

SEQ ID NO: 504924 - RNA, 12 nt, Homo sapiens
cuguuaguauua

SEQ ID NO: 504925 - RNA, 22 nt, Homo sapiens
cuuacaauaauucuaugagaua

SEQ ID NO: 504926 - RNA, 18 nt, Homo sapiens
cuuccaucugauugugau

SEQ ID NO: 504927 - RNA, 18 nt, Homo sapiens
cuuggacucuccuaguga

SEQ ID NO: 504928 - RNA, 14 nt, Homo sapiens
cuuuaggcauuaaa

SEQ ID NO: 504929 - RNA, 14 nt, Homo sapiens
cuuuauucugcaag

SEQ ID NO: 504930 - RNA, 17 nt, Homo sapiens
cuuuuggcuucugcaga

SEQ ID NO: 504931 - RNA, 17 nt, Homo sapiens
gacagaccgccaaauaa

SEQ ID NO: 504932 - RNA, 15 nt, Homo sapiens
gagacauacaccuau

SEQ ID NO: 504933 - RNA, 19 nt, Homo sapiens
gagauguccaaacugucgu

SEQ ID NO: 504934 - RNA, 22 nt, Homo sapiens
gagcaccuacuuacaugcauua

SEQ ID NO: 504935 - RNA, 13 nt, Homo sapiens
gaggacuccuuaa

SEQ ID NO: 504936 - RNA, 16 nt, Homo sapiens
gaugcagagcuuucaa

SEQ ID NO: 504937 - RNA, 14 nt, Homo sapiens
gauggcccuggaca

SEQ ID NO: 504938 - RNA, 16 nt, Homo sapiens
gauucuuccaucugau

SEQ ID NO: 504939 - RNA, 13 nt, Homo sapiens
gcaaauaucuuga

SEQ ID NO: 504940 - RNA, 16 nt, Homo sapiens
gcaagcaaucaaauaa

SEQ ID NO: 504941 - RNA, 16 nt, Homo sapiens
gcacagcuaugaaggc

SEQ ID NO: 504942 - RNA, 15 nt, Homo sapiens
gcacgaauggaagag

SEQ ID NO: 504943 - RNA, 17 nt, Homo sapiens
gcagacucacuguggga

SEQ ID NO: 504944 - RNA, 17 nt, Homo sapiens
gcagccugcagacucac

SEQ ID NO: 504945 - RNA, 16 nt, Homo sapiens
gcaucuggauucugcc

SEQ ID NO: 504946 - RNA, 16 nt, Homo sapiens
gccaauaaaccaauga

SEQ ID NO: 504947 - RNA, 15 nt, Homo sapiens
gccccagagugcuuu

SEQ ID NO: 504948 - RNA, 17 nt, Homo sapiens
gcguucccaaagaucca

SEQ ID NO: 504949 - RNA, 18 nt, Homo sapiens
gcugccccuacugcaaau

SEQ ID NO: 504950 - RNA, 14 nt, Homo sapiens
gcuguacacugcac

SEQ ID NO: 504951 - RNA, 18 nt, Homo sapiens
gcuuccuucauuuccucc

SEQ ID NO: 504952 - RNA, 13 nt, Homo sapiens
ggaaauacuuugc

SEQ ID NO: 504953 - RNA, 19 nt, Homo sapiens
ggauaggcuuuauucugca

SEQ ID NO: 504954 - RNA, 19 nt, Homo sapiens
ggcaugaaggugucauaca

SEQ ID NO: 504955 - RNA, 15 nt, Homo sapiens
ggcuguacacugcac

SEQ ID NO: 504956 - RNA, 13 nt, Homo sapiens
gucaccucagaga

SEQ ID NO: 504957 - RNA, 17 nt, Homo sapiens
gucaccucagagacaua

SEQ ID NO: 504958 - RNA, 13 nt, Homo sapiens
guccaacuacuaa

SEQ ID NO: 504959 - RNA, 21 nt, Homo sapiens
gucucucaugaaccucaagcu

SEQ ID NO: 504960 - RNA, 17 nt, Homo sapiens
gugagacagaccgccaa

SEQ ID NO: 504961 - RNA, 18 nt, Homo sapiens
gugcauuuaugagcucuu

SEQ ID NO: 504962 - RNA, 14 nt, Homo sapiens
guuacuacaugcac

SEQ ID NO: 504963 - RNA, 19 nt, Homo sapiens
guucaacuuuuccuuugaa

SEQ ID NO: 504964 - RNA, 15 nt, Homo sapiens
guugcaauugauccu

SEQ ID NO: 504965 - RNA, 20 nt, Homo sapiens
guugcauuaaaaaugcauau

SEQ ID NO: 504966 - RNA, 22 nt, Homo sapiens
uaaaugugguacaagcauucug

SEQ ID NO: 504967 - RNA, 15 nt, Homo sapiens
uaaguccaacuacua

SEQ ID NO: 504968 - RNA, 22 nt, Homo sapiens
uaaguccaacuacuaaacuggg

SEQ ID NO: 504969 - RNA, 19 nt, Homo sapiens
uaauagacucgcuagucag

SEQ ID NO: 504970 - RNA, 16 nt, Homo sapiens
uaauuggcaugaaggu

SEQ ID NO: 504971 - RNA, 19 nt, Homo sapiens
uacaagcauucugucuuga

SEQ ID NO: 504972 - RNA, 19 nt, Homo sapiens
uacaauaauucuaugagau

SEQ ID NO: 504973 - RNA, 14 nt, Homo sapiens
uacacauguaucua

SEQ ID NO: 504974 - RNA, 18 nt, Homo sapiens
uacacauguaucuaugca

SEQ ID NO: 504975 - RNA, 13 nt, Homo sapiens
uacagcuaugaag

SEQ ID NO: 504976 - RNA, 14 nt, Homo sapiens
uacaugcauuacug

SEQ ID NO: 504977 - RNA, 17 nt, Homo sapiens
uacaugcauuacugcau

SEQ ID NO: 504978 - RNA, 17 nt, Homo sapiens
uaccauauacagcucag

SEQ ID NO: 504979 - RNA, 15 nt, Homo sapiens
uacugcaugcacuuc

SEQ ID NO: 504980 - RNA, 21 nt, Homo sapiens
uacuuuauguuacuacaugca

SEQ ID NO: 504981 - RNA, 19 nt, Homo sapiens
uagaaaaguuauguagaaa

SEQ ID NO: 504982 - RNA, 14 nt, Homo sapiens
uagagacucaaaga

SEQ ID NO: 504983 - RNA, 23 nt, Homo sapiens
uagaguguaggugaaaugaauga

SEQ ID NO: 504984 - RNA, 16 nt, Homo sapiens
uagcaaagauaucuca

SEQ ID NO: 504985 - RNA, 21 nt, Homo sapiens
uagcaaagauaucucaucucu

SEQ ID NO: 504986 - RNA, 16 nt, Homo sapiens
uagccagugaaaaacu

SEQ ID NO: 504987 - RNA, 22 nt, Homo sapiens
uaggcauuaaauuuuagcaaag

SEQ ID NO: 504988 - RNA, 20 nt, Homo sapiens
uaugauggguguuuuuagca

SEQ ID NO: 504989 - RNA, 18 nt, Homo sapiens
uauguuacuacaugcacu

SEQ ID NO: 504990 - RNA, 19 nt, Homo sapiens
uauguuacuacaugcacuu

SEQ ID NO: 504991 - RNA, 12 nt, Homo sapiens
uauuaacuguca

SEQ ID NO: 504992 - RNA, 15 nt, Homo sapiens
aauaauucuaugaga

SEQ ID NO: 504993 - RNA, 13 nt, Homo sapiens
aauacagcuauga

SEQ ID NO: 504994 - RNA, 16 nt, Homo sapiens
aauaucaaacacggac

SEQ ID NO: 504995 - RNA, 14 nt, Homo sapiens
aaugaauacaauua

SEQ ID NO: 504996 - RNA, 19 nt, Homo sapiens
aauggcaguuuuaaucuua

SEQ ID NO: 504997 - RNA, 15 nt, Homo sapiens
aauuaaagcuguuau

SEQ ID NO: 504998 - RNA, 21 nt, Homo sapiens
aauuagccagugaaaaacuau

SEQ ID NO: 504999 - RNA, 21 nt, Homo sapiens
aauuugggggacuuacaugau

SEQ ID NO: 505000 - RNA, 18 nt, Homo sapiens
acaacuugucuauuaccu

SEQ ID NO: 505001 - RNA, 22 nt, Homo sapiens
acaagccuucagccacagggag

SEQ ID NO: 505002 - RNA, 18 nt, Homo sapiens
acaccuaugucauuucau

SEQ ID NO: 505003 - RNA, 21 nt, Homo sapiens
acaugcacuuggcugcauaaa

SEQ ID NO: 505004 - RNA, 22 nt, Homo sapiens
acaugcauuacugcaugcacuu

SEQ ID NO: 505005 - RNA, 15 nt, Homo sapiens
accucaagcugcauc

SEQ ID NO: 505006 - RNA, 20 nt, Homo sapiens
acgcagccugcagacucacu

SEQ ID NO: 505007 - RNA, 22 nt, Homo sapiens
acgcagccugcagacucacugu

SEQ ID NO: 505008 - RNA, 23 nt, Homo sapiens
acggacgcgcgugacacaaugcu

SEQ ID NO: 505009 - RNA, 20 nt, Homo sapiens
acgguggcucacgccuguaa

SEQ ID NO: 505010 - RNA, 23 nt, Homo sapiens
acuauuaacaacuugucuauuac

SEQ ID NO: 505011 - RNA, 21 nt, Homo sapiens
acucaaagagggagugcauuu

SEQ ID NO: 505012 - RNA, 23 nt, Homo sapiens
acucaguggacacucagaccagc

SEQ ID NO: 505013 - RNA, 18 nt, Homo sapiens
acugagaacagcauauga

SEQ ID NO: 505014 - RNA, 15 nt, Homo sapiens
acugcaugcacuucu

SEQ ID NO: 505015 - RNA, 17 nt, Homo sapiens
acugcaugcacuucuua

SEQ ID NO: 505016 - RNA, 14 nt, Homo sapiens
acuggggaugggac

SEQ ID NO: 505017 - RNA, 15 nt, Homo sapiens
acugucucucaugaa

SEQ ID NO: 505018 - RNA, 11 nt, Homo sapiens
acuuacaugau

SEQ ID NO: 505019 - RNA, 14 nt, Homo sapiens
acuuacaugauuca

SEQ ID NO: 505020 - RNA, 19 nt, Homo sapiens
acuucguguccgacucuuc

SEQ ID NO: 505021 - RNA, 24 nt, Homo sapiens
acuucuuacaauaauucuaugaga

SEQ ID NO: 505022 - RNA, 23 nt, Homo sapiens
acuuuauguuacuacaugcacuu

SEQ ID NO: 505023 - RNA, 13 nt, Homo sapiens
agaccgccaaaua

SEQ ID NO: 505024 - RNA, 14 nt, Homo sapiens
agaccgccaaauaa

SEQ ID NO: 505025 - RNA, 15 nt, Homo sapiens
agacucacuguggga

SEQ ID NO: 505026 - RNA, 17 nt, Homo sapiens
agacucgcuagucagua

SEQ ID NO: 505027 - RNA, 21 nt, Homo sapiens
agauaaucauugcuuauguca

SEQ ID NO: 505028 - RNA, 16 nt, Homo sapiens
agauggcauguguuua

SEQ ID NO: 505029 - RNA, 19 nt, Homo sapiens
agcaccuacuuacaugcau

SEQ ID NO: 505030 - RNA, 20 nt, Homo sapiens
agcaccuacuuacaugcauu

SEQ ID NO: 505031 - RNA, 21 nt, Homo sapiens
agcaccuacuuacaugcauua

SEQ ID NO: 505032 - RNA, 12 nt, Homo sapiens
agcuuucaagga

SEQ ID NO: 505033 - RNA, 22 nt, Homo sapiens
agcuuucaaggauaggcuuuau

SEQ ID NO: 505034 - RNA, 15 nt, Homo sapiens
aggaaauacuuugca

SEQ ID NO: 505035 - RNA, 18 nt, Homo sapiens
aggaugauaaaagcacuu

SEQ ID NO: 505036 - RNA, 16 nt, Homo sapiens
aggcaaauaucuugaa

SEQ ID NO: 505037 - RNA, 22 nt, Homo sapiens
aggcauuaaauuuuagcaaaga

SEQ ID NO: 505038 - RNA, 16 nt, Homo sapiens
aggcuguacacugcac

SEQ ID NO: 505039 - RNA, 17 nt, Homo sapiens
agguggucccacggcug

SEQ ID NO: 505040 - RNA, 20 nt, Homo sapiens
aguauuauuguugcauuaaa

SEQ ID NO: 505041 - RNA, 20 nt, Homo sapiens
aguauuccagaccugaagaa

SEQ ID NO: 505042 - RNA, 21 nt, Homo sapiens
agugcauuuaugagcucuuca

SEQ ID NO: 505043 - RNA, 22 nt, Homo sapiens
aguuucuucuuuaggcauuaaa

SEQ ID NO: 505044 - RNA, 16 nt, Homo sapiens
auaaaagcacuuacuu

SEQ ID NO: 505045 - RNA, 18 nt, Homo sapiens
auaaaaugaauacaauua

SEQ ID NO: 505046 - RNA, 18 nt, Homo sapiens
auaaacggacucagugga

SEQ ID NO: 505047 - RNA, 21 nt, Homo sapiens
auaauuuucuaccuggucucu

SEQ ID NO: 505048 - RNA, 18 nt, Homo sapiens
auacaauuaaagcuguua

SEQ ID NO: 505049 - RNA, 14 nt, Homo sapiens
auacagcuaugaag

SEQ ID NO: 505050 - RNA, 17 nt, Homo sapiens
auaccauauacagcuca

SEQ ID NO: 505051 - RNA, 14 nt, Homo sapiens
auacuuugcauaaa

SEQ ID NO: 505052 - RNA, 22 nt, Homo sapiens
auauacagcucagaaguuucuu

SEQ ID NO: 505053 - RNA, 16 nt, Homo sapiens
auauccagauggcaug

SEQ ID NO: 505054 - RNA, 21 nt, Homo sapiens
aucaaacacggacccauagac

SEQ ID NO: 505055 - RNA, 22 nt, Homo sapiens
aucauugcuuaugucaaaugga

SEQ ID NO: 505056 - RNA, 23 nt, Homo sapiens
aucuagaggcuuccuucauuucc

SEQ ID NO: 505057 - RNA, 12 nt, Homo sapiens
aucuauucugcu

SEQ ID NO: 505058 - RNA, 20 nt, Homo sapiens
augaaggcuguacacugcac

SEQ ID NO: 505059 - RNA, 13 nt, Homo sapiens
augaauacaauua

SEQ ID NO: 505060 - RNA, 23 nt, Homo sapiens
augaauggcuuggagugcacuga

SEQ ID NO: 505061 - RNA, 14 nt, Homo sapiens
augcagagcuuuca

SEQ ID NO: 505062 - RNA, 15 nt, Homo sapiens
augccggugaucccu

SEQ ID NO: 505063 - RNA, 12 nt, Homo sapiens
auguguuuacuu

SEQ ID NO: 505064 - RNA, 17 nt, Homo sapiens
auuaaaaaugcauauac

SEQ ID NO: 505065 - RNA, 16 nt, Homo sapiens
auuaccuguuaguauu

SEQ ID NO: 505066 - RNA, 20 nt, Homo sapiens
auuacugcaugcacuucuua

SEQ ID NO: 505067 - RNA, 20 nt, Homo sapiens
auuacuuuucuuacucugaa

SEQ ID NO: 505068 - RNA, 18 nt, Homo sapiens
auucugcaagcaauacaa

SEQ ID NO: 505069 - RNA, 14 nt, Homo sapiens
auuguugcauuaaa

SEQ ID NO: 505070 - RNA, 15 nt, Homo sapiens
auuuaugagcucuuc

SEQ ID NO: 505071 - RNA, 13 nt, Homo sapiens
auuuuuggaagag

SEQ ID NO: 505072 - RNA, 17 nt, Homo sapiens
caaaauacagcuaugaa

SEQ ID NO: 505073 - RNA, 19 nt, Homo sapiens
caaagauccacccaaauau

SEQ ID NO: 505074 - RNA, 19 nt, Homo sapiens
caaauaaacggacucagug

SEQ ID NO: 505075 - RNA, 20 nt, Homo sapiens
caaauaaacggacucagugg

SEQ ID NO: 505076 - RNA, 21 nt, Homo sapiens
caaauaaacggacucagugga

SEQ ID NO: 505077 - RNA, 15 nt, Homo sapiens
caagcaaucaaauaa

SEQ ID NO: 505078 - RNA, 14 nt, Homo sapiens
ugcaaacccaguga

SEQ ID NO: 505079 - RNA, 18 nt, Homo sapiens
ugcagacaggcuggcauu

SEQ ID NO: 505080 - RNA, 18 nt, Homo sapiens
ugcagagcuuucaaggau

SEQ ID NO: 505081 - RNA, 18 nt, Homo sapiens
ugcauaaaugugguacaa

SEQ ID NO: 505082 - RNA, 15 nt, Homo sapiens
ugcauuaaaaaugca

SEQ ID NO: 505083 - RNA, 21 nt, Homo sapiens
ugcauuaaaaaugcauauacu

SEQ ID NO: 505084 - RNA, 17 nt, Homo sapiens
ugcauuacugcaugcac

SEQ ID NO: 505085 - RNA, 20 nt, Homo sapiens
ugcauuacugcaugcacuuc

SEQ ID NO: 505086 - RNA, 21 nt, Homo sapiens
ugcuaugaaauuggugggugg

SEQ ID NO: 505087 - RNA, 18 nt, Homo sapiens
ugcuucaggauaccauau

SEQ ID NO: 505088 - RNA, 15 nt, Homo sapiens
uggaacugucucuca

SEQ ID NO: 505089 - RNA, 17 nt, Homo sapiens
uggacacucagaccagc

SEQ ID NO: 505090 - RNA, 12 nt, Homo sapiens
uggcuagucaua

SEQ ID NO: 505091 - RNA, 16 nt, Homo sapiens
uggcuagucauaaccu

SEQ ID NO: 505092 - RNA, 22 nt, Homo sapiens
uguaaucccagcaugcugagau

SEQ ID NO: 505093 - RNA, 22 nt, Homo sapiens
ugucaaauggagcugaauuuga

SEQ ID NO: 505094 - RNA, 19 nt, Homo sapiens
uguccgacucuucugagca

SEQ ID NO: 505095 - RNA, 19 nt, Homo sapiens
ugucgugcaaacccaguga

SEQ ID NO: 505096 - RNA, 14 nt, Homo sapiens
ugugguuagaaaag

SEQ ID NO: 505097 - RNA, 18 nt, Homo sapiens
uuaauggugccuucauuu

SEQ ID NO: 505098 - RNA, 12 nt, Homo sapiens
uuacacauguau

SEQ ID NO: 505099 - RNA, 15 nt, Homo sapiens
uuacaugauucauuu

SEQ ID NO: 505100 - RNA, 14 nt, Homo sapiens
uuauuguugcauua

SEQ ID NO: 505101 - RNA, 20 nt, Homo sapiens
uuccuccgucaccucagaga

SEQ ID NO: 505102 - RNA, 23 nt, Homo sapiens
uucugagcaccuacuuacaugca

SEQ ID NO: 505103 - RNA, 14 nt, Homo sapiens
uucuuacucugaaa

SEQ ID NO: 505104 - RNA, 18 nt, Homo sapiens
uugcauuaaaaaugcaua

SEQ ID NO: 505105 - RNA, 22 nt, Homo sapiens
uugcauuaaaaaugcauauacu

SEQ ID NO: 505106 - RNA, 20 nt, Homo sapiens
uuggaagaggacuccuuaaa

SEQ ID NO: 505107 - RNA, 13 nt, Homo sapiens
uuggagugcacug

SEQ ID NO: 505108 - RNA, 15 nt, Homo sapiens
uuuaaaaaauucucu

SEQ ID NO: 505109 - RNA, 14 nt, Homo sapiens
uuuaaagaagggaa

SEQ ID NO: 505110 - RNA, 19 nt, Homo sapiens
uuucaaggauaggcuuuau

SEQ ID NO: 505111 - RNA, 18 nt, Homo sapiens
uuucuaauuggcaugaag

SEQ ID NO: 505112 - RNA, 19 nt, Homo sapiens
uuuggaagaggacuccuua

SEQ ID NO: 505113 - RNA, 21 nt, Homo sapiens
uuuuuacacauguaucuaugc

SEQ ID NO: 505114 - RNA, 22 nt, Homo sapiens
gucuuaauauauauauccagau

SEQ ID NO: 505115 - RNA, 15 nt, Homo sapiens
gugauuuacgcucau

SEQ ID NO: 505116 - RNA, 16 nt, Homo sapiens
gugcauuuaugagcuc

SEQ ID NO: 505117 - RNA, 17 nt, Homo sapiens
gugcauuuaugagcucu

SEQ ID NO: 505118 - RNA, 18 nt, Homo sapiens
guggcugauauuaacugu

SEQ ID NO: 505119 - RNA, 21 nt, Homo sapiens
guggcugauauuaacugucaa

SEQ ID NO: 505120 - RNA, 19 nt, Homo sapiens
guguuacccaguaacucau

SEQ ID NO: 505121 - RNA, 18 nt, Homo sapiens
uaaacugggggauauuau

SEQ ID NO: 505122 - RNA, 19 nt, Homo sapiens
uaaaucuauucugcuaaga

SEQ ID NO: 505123 - RNA, 11 nt, Homo sapiens
uaaaugugauu

SEQ ID NO: 505124 - RNA, 20 nt, Homo sapiens
uaaauuugggggacuuacau

SEQ ID NO: 505125 - RNA, 22 nt, Homo sapiens
uaaauuugggggacuuacauga

SEQ ID NO: 505126 - RNA, 23 nt, Homo sapiens
uaaauuugggggacuuacaugau

SEQ ID NO: 505127 - RNA, 16 nt, Homo sapiens
uaaguccaacuacuaa

SEQ ID NO: 505128 - RNA, 21 nt, Homo sapiens
uaauaaaucuauucugcuaag

SEQ ID NO: 505129 - RNA, 21 nt, Homo sapiens
uaauaaaucuauucugcugag

SEQ ID NO: 505130 - RNA, 19 nt, Homo sapiens
uacacauguaucuaugcau

SEQ ID NO: 505131 - RNA, 16 nt, Homo sapiens
uacaccuaugucauuu

SEQ ID NO: 505132 - RNA, 23 nt, Homo sapiens
uacaugcauuacugcaugcacuu

SEQ ID NO: 505133 - RNA, 23 nt, Homo sapiens
uaccuguuaguauuauuguugca

SEQ ID NO: 505134 - RNA, 14 nt, Homo sapiens
uacugcaugcacuu

SEQ ID NO: 505135 - RNA, 20 nt, Homo sapiens
uagaaaaguuauguagaaaa

SEQ ID NO: 505136 - RNA, 21 nt, Homo sapiens
uagccuucucuguucauuucc

SEQ ID NO: 505137 - RNA, 20 nt, Homo sapiens
uagucaguaaagauauuuga

SEQ ID NO: 505138 - RNA, 22 nt, Homo sapiens
uaugaaggcuguacacugcacg

SEQ ID NO: 505139 - RNA, 13 nt, Homo sapiens
uaugucaaaugga

SEQ ID NO: 505140 - RNA, 22 nt, Homo sapiens
ucaaagagggagugcauuuaug

SEQ ID NO: 505141 - RNA, 18 nt, Homo sapiens
ucaaggauaggcuuuauu

SEQ ID NO: 505142 - RNA, 23 nt, Homo sapiens
ucagagacauacaccuaugucau

SEQ ID NO: 505143 - RNA, 19 nt, Homo sapiens
ucagccacagggagccaca

SEQ ID NO: 505144 - RNA, 19 nt, Homo sapiens
ucaggagagaguugaaccu

SEQ ID NO: 505145 - RNA, 15 nt, Homo sapiens
ucaggauaccauaua

SEQ ID NO: 505146 - RNA, 22 nt, Homo sapiens
ucaucucuucuuuuaaaccauu

SEQ ID NO: 505147 - RNA, 17 nt, Homo sapiens
ucauuuccaaacuugaa

SEQ ID NO: 505148 - RNA, 18 nt, Homo sapiens
ucauuuccaaacuugaaa

SEQ ID NO: 505149 - RNA, 22 nt, Homo sapiens
ucauuuccuccgucaccucaga

SEQ ID NO: 505150 - RNA, 17 nt, Homo sapiens
ucauuuuaacaucugag

SEQ ID NO: 505151 - RNA, 19 nt, Homo sapiens
ucauuuuaacaucugagaa

SEQ ID NO: 505152 - RNA, 16 nt, Homo sapiens
uccagauggcaugugu

SEQ ID NO: 505153 - RNA, 18 nt, Homo sapiens
uccgggacccccaggaca

SEQ ID NO: 505154 - RNA, 23 nt, Homo sapiens
uccgucaccucagagacauacac

SEQ ID NO: 505155 - RNA, 15 nt, Homo sapiens
uccuccgucaccuca

SEQ ID NO: 505156 - RNA, 19 nt, Homo sapiens
uccuccgucaccucagaga

SEQ ID NO: 505157 - RNA, 12 nt, Homo sapiens
uccuucauuucc

SEQ ID NO: 505158 - RNA, 20 nt, Homo sapiens
ucgugcuucauaggugccac

SEQ ID NO: 505159 - RNA, 19 nt, Homo sapiens
ucucuguguuacccaguaa

SEQ ID NO: 505160 - RNA, 24 nt, Homo sapiens
ucugagcaccuacuuacaugcauu

SEQ ID NO: 505161 - RNA, 13 nt, Homo sapiens
ucugcaagcaaua

SEQ ID NO: 505162 - RNA, 16 nt, Homo sapiens
ucuggauucugccuaa

SEQ ID NO: 505163 - RNA, 16 nt, Homo sapiens
ucugucaccaagccuu

SEQ ID NO: 505164 - RNA, 19 nt, Homo sapiens
ucuguucauuuccucaaaa

SEQ ID NO: 505165 - RNA, 22 nt, Homo sapiens
ucuuacaauaauucuaugagau

SEQ ID NO: 505166 - RNA, 22 nt, Homo sapiens
ucuuacggaaaauccgacaagc

SEQ ID NO: 505167 - RNA, 13 nt, Homo sapiens
ucuuccaucugau

SEQ ID NO: 505168 - RNA, 21 nt, Homo sapiens
ugaaaaacuauuaacaacuug

SEQ ID NO: 505169 - RNA, 18 nt, Homo sapiens
ugaaccuaaacauagaaa

SEQ ID NO: 505170 - RNA, 20 nt, Homo sapiens
ugaaccucaagcugcaucua

SEQ ID NO: 505171 - RNA, 15 nt, Homo sapiens
ugacaugugccauuu

SEQ ID NO: 505172 - RNA, 23 nt, Homo sapiens
ugagcaccuacuuacaugcauua

SEQ ID NO: 505173 - RNA, 22 nt, Homo sapiens
ugauaaaaacccaaaauacagc

SEQ ID NO: 505174 - RNA, 15 nt, Homo sapiens
ugauaaaagcacuua

SEQ ID NO: 505175 - RNA, 14 nt, Homo sapiens
ugcaagcaaucaaa

SEQ ID NO: 505176 - RNA, 15 nt, Homo sapiens
ugcacagcuaugaag

SEQ ID NO: 505177 - RNA, 15 nt, Homo sapiens
ugcagacucacugug

SEQ ID NO: 505178 - RNA, 16 nt, Homo sapiens
ugcagacucacugugg

SEQ ID NO: 505179 - RNA, 18 nt, Homo sapiens
ugcagaugguugcaauug

SEQ ID NO: 505180 - RNA, 10 nt, Homo sapiens
ugcuguccaa

SEQ ID NO: 505181 - RNA, 17 nt, Homo sapiens
ugcuucaggauaccaua

SEQ ID NO: 505182 - RNA, 21 nt, Homo sapiens
uggacucgcguucccaaagau

SEQ ID NO: 505183 - RNA, 12 nt, Homo sapiens
ugguguauuuga

SEQ ID NO: 505184 - RNA, 15 nt, Homo sapiens
ugucgugcuucauag

SEQ ID NO: 505185 - RNA, 16 nt, Homo sapiens
ugugguacaagcauuc

SEQ ID NO: 505186 - RNA, 14 nt, Homo sapiens
uguuuacuuuaugu

SEQ ID NO: 505187 - RNA, 12 nt, Homo sapiens
uuaauggugccu

SEQ ID NO: 505188 - RNA, 12 nt, Homo sapiens
uuacaugauuca

SEQ ID NO: 505189 - RNA, 13 nt, Homo sapiens
uuacaugauucau

SEQ ID NO: 505190 - RNA, 14 nt, Homo sapiens
uuacaugauucauu

SEQ ID NO: 505191 - RNA, 12 nt, Homo sapiens
uuacaugcauua

SEQ ID NO: 505192 - RNA, 16 nt, Homo sapiens
uuacuuuauguuacua

SEQ ID NO: 505193 - RNA, 22 nt, Homo sapiens
uuaugagcucuucauguuucag

SEQ ID NO: 505194 - RNA, 19 nt, Homo sapiens
uuauucugcaagcaauaca

SEQ ID NO: 505195 - RNA, 16 nt, Homo sapiens
uuauuguugcauuaaa

SEQ ID NO: 505196 - RNA, 20 nt, Homo sapiens
uucauuuuaacaucugagaa

SEQ ID NO: 505197 - RNA, 23 nt, Homo sapiens
uucccaaagauccacccaaauau

SEQ ID NO: 505198 - RNA, 16 nt, Homo sapiens
uucuaauuggcaugaa

SEQ ID NO: 505199 - RNA, 17 nt, Homo sapiens
uucugcuaagagaucac

SEQ ID NO: 505200 - RNA, 23 nt, Homo sapiens
uucuuauuaaggaaauacuuugc

SEQ ID NO: 505201 - RNA, 14 nt, Homo sapiens
uucuuccaucugau

SEQ ID NO: 505202 - RNA, 16 nt, Homo sapiens
uucuuuuaaaccauuu

SEQ ID NO: 505203 - RNA, 14 nt, Homo sapiens
uugaaccuaaacau

SEQ ID NO: 505204 - RNA, 20 nt, Homo sapiens
uugaagggcaggugcuucag

SEQ ID NO: 505205 - RNA, 13 nt, Homo sapiens
uuggcaugaaggu

SEQ ID NO: 505206 - RNA, 22 nt, Homo sapiens
uuggcugcauaaaugugguaca

SEQ ID NO: 505207 - RNA, 12 nt, Homo sapiens
uuguucugauaa

SEQ ID NO: 505208 - RNA, 13 nt, Homo sapiens
uuuaggcauuaaa

SEQ ID NO: 505209 - RNA, 22 nt, Homo sapiens
uuugggggacuuacaugauuca

SEQ ID NO: 505210 - RNA, 13 nt, Homo sapiens
uuuuaacaucuga

SEQ ID NO: 505211 - RNA, 12 nt, Homo sapiens
uuuuggcuucug

SEQ ID NO: 505212 - RNA, 16 nt, Homo sapiens
caaauaucuugaaagg

SEQ ID NO: 505213 - RNA, 13 nt, Homo sapiens
cacagcuaugaag

SEQ ID NO: 505214 - RNA, 20 nt, Homo sapiens
caccucagagacauacaccu

SEQ ID NO: 505215 - RNA, 16 nt, Homo sapiens
cacgccuguaauccca

SEQ ID NO: 505216 - RNA, 19 nt, Homo sapiens
cacggacgcgcgugacaca

SEQ ID NO: 505217 - RNA, 20 nt, Homo sapiens
cacuucuuacaauaauucua

SEQ ID NO: 505218 - RNA, 21 nt, Homo sapiens
cacuucuuacaauaauucuau

SEQ ID NO: 505219 - RNA, 17 nt, Homo sapiens
cagaaucaguguuaaau

SEQ ID NO: 505220 - RNA, 19 nt, Homo sapiens
cagaccagcucccagaugg

SEQ ID NO: 505221 - RNA, 15 nt, Homo sapiens
cagaccgccaaauaa

SEQ ID NO: 505222 - RNA, 13 nt, Homo sapiens
cagacucacugug

SEQ ID NO: 505223 - RNA, 15 nt, Homo sapiens
cagaggacgugcaga

SEQ ID NO: 505224 - RNA, 19 nt, Homo sapiens
cagauuuuuacacauguau

SEQ ID NO: 505225 - RNA, 21 nt, Homo sapiens
cagccccagagugcuuuaaaa

SEQ ID NO: 505226 - RNA, 17 nt, Homo sapiens
cagccugcagacucacu

SEQ ID NO: 505227 - RNA, 18 nt, Homo sapiens
cagccugcagacucacug

SEQ ID NO: 505228 - RNA, 13 nt, Homo sapiens
cagcuaugaaggc

SEQ ID NO: 505229 - RNA, 13 nt, Homo sapiens
caggugcuucagg

SEQ ID NO: 505230 - RNA, 15 nt, Homo sapiens
caguggacacucaga

SEQ ID NO: 505231 - RNA, 21 nt, Homo sapiens
cauaaaugugguacaagcauu

SEQ ID NO: 505232 - RNA, 18 nt, Homo sapiens
caucauggcuaucugugg

SEQ ID NO: 505233 - RNA, 20 nt, Homo sapiens
caucuagaggcuuccuucau

SEQ ID NO: 505234 - RNA, 18 nt, Homo sapiens
caugauucagagcuuuca

SEQ ID NO: 505235 - RNA, 16 nt, Homo sapiens
caugcauuacugcaug

SEQ ID NO: 505236 - RNA, 21 nt, Homo sapiens
caugcauuacugcaugcacuu

SEQ ID NO: 505237 - RNA, 20 nt, Homo sapiens
cauugcuuaugucaaaugga

SEQ ID NO: 505238 - RNA, 17 nt, Homo sapiens
cauuuuaacaucugaga

SEQ ID NO: 505239 - RNA, 14 nt, Homo sapiens
ccaaaauacagcua

SEQ ID NO: 505240 - RNA, 20 nt, Homo sapiens
ccaaagauccacccaaauau

SEQ ID NO: 505241 - RNA, 20 nt, Homo sapiens
ccaagccuuggggauucuuc

SEQ ID NO: 505242 - RNA, 18 nt, Homo sapiens
ccagcaugcugagauuac

SEQ ID NO: 505243 - RNA, 18 nt, Homo sapiens
ccagugaaaaacuauuaa

SEQ ID NO: 505244 - RNA, 20 nt, Homo sapiens
cccaaaauacagcuaugaag

SEQ ID NO: 505245 - RNA, 19 nt, Homo sapiens
ccccucuggugucuuugau

SEQ ID NO: 505246 - RNA, 16 nt, Homo sapiens
ccgucaaaagagucuu

SEQ ID NO: 505247 - RNA, 15 nt, Homo sapiens
ccucaaaaagauuuc

SEQ ID NO: 505248 - RNA, 18 nt, Homo sapiens
ccugacgaacuccuugau

SEQ ID NO: 505249 - RNA, 16 nt, Homo sapiens
ccuuggggauucuucc

SEQ ID NO: 505250 - RNA, 18 nt, Homo sapiens
ccuuuagaguguagguga

SEQ ID NO: 505251 - RNA, 22 nt, Homo sapiens
cgaauggaagaggcaccugucc

SEQ ID NO: 505252 - RNA, 17 nt, Homo sapiens
cgccaauaaaccaauga

SEQ ID NO: 505253 - RNA, 19 nt, Homo sapiens
cggacgcgcgugacacaau

SEQ ID NO: 505254 - RNA, 18 nt, Homo sapiens
cuaaguccaacuacuaaa

SEQ ID NO: 505255 - RNA, 17 nt, Homo sapiens
cuaauuggcaugaaggu

SEQ ID NO: 505256 - RNA, 12 nt, Homo sapiens
cuacaugcacuu

SEQ ID NO: 505257 - RNA, 19 nt, Homo sapiens
cuaccuggucucuccuugu

SEQ ID NO: 505258 - RNA, 14 nt, Homo sapiens
cuacuaaacugggg

SEQ ID NO: 505259 - RNA, 14 nt, Homo sapiens
cuacugcaaauggc

SEQ ID NO: 505260 - RNA, 15 nt, Homo sapiens
cuagucauaaccuua

SEQ ID NO: 505261 - RNA, 19 nt, Homo sapiens
cuauuaccuguuaguauua

SEQ ID NO: 505262 - RNA, 14 nt, Homo sapiens
cucagagacauaca

SEQ ID NO: 505263 - RNA, 14 nt, Homo sapiens
cucaugaaccucaa

SEQ ID NO: 505264 - RNA, 14 nt, Homo sapiens
cucauuguagaaaa

SEQ ID NO: 505265 - RNA, 14 nt, Homo sapiens
cugacgaacuccuu

SEQ ID NO: 505266 - RNA, 14 nt, Homo sapiens
cugagaacagcaua

SEQ ID NO: 505267 - RNA, 17 nt, Homo sapiens
cugcaagcaaucaaaua

SEQ ID NO: 505268 - RNA, 19 nt, Homo sapiens
cugcagacucacuguggga

SEQ ID NO: 505269 - RNA, 15 nt, Homo sapiens
cugcauaaauguggu

SEQ ID NO: 505270 - RNA, 20 nt, Homo sapiens
cugucgugcaaacccaguga

SEQ ID NO: 505271 - RNA, 15 nt, Homo sapiens
cugucucucaugaac

SEQ ID NO: 505272 - RNA, 18 nt, Homo sapiens
cuguuauuuaauuagcca

SEQ ID NO: 505273 - RNA, 13 nt, Homo sapiens
cuuacaugcauua

SEQ ID NO: 505274 - RNA, 21 nt, Homo sapiens
cuucucuguucauuuccucaa

SEQ ID NO: 505275 - RNA, 21 nt, Homo sapiens
cuucugagcaccuacuuacau

SEQ ID NO: 505276 - RNA, 17 nt, Homo sapiens
cuucuuuaggcauuaaa

SEQ ID NO: 505277 - RNA, 14 nt, Homo sapiens
cuugauuuuagccu

SEQ ID NO: 505278 - RNA, 22 nt, Homo sapiens
cuuuauucugcaagcaaucaaa

SEQ ID NO: 505279 - RNA, 19 nt, Homo sapiens
cuuucuugcuguccaauuu

SEQ ID NO: 505280 - RNA, 22 nt, Homo sapiens
cuuuguucccuaaguccaacua

SEQ ID NO: 505281 - RNA, 12 nt, Homo sapiens
gaaaaacuauua

SEQ ID NO: 505282 - RNA, 21 nt, Homo sapiens
gaaaaagaaugaugcuaugaa

SEQ ID NO: 505283 - RNA, 17 nt, Homo sapiens
gaaccauucccuaguca

SEQ ID NO: 505284 - RNA, 17 nt, Homo sapiens
gaagaaucacaauaauu

SEQ ID NO: 505285 - RNA, 12 nt, Homo sapiens
gaaggugucaua

SEQ ID NO: 505286 - RNA, 18 nt, Homo sapiens
gacauacaccuaugucau

SEQ ID NO: 505287 - RNA, 12 nt, Homo sapiens
gacucacugugg

SEQ ID NO: 505288 - RNA, 16 nt, Homo sapiens
gacucaguggacacuc

SEQ ID NO: 505289 - RNA, 21 nt, Homo sapiens
gagacauacaccuaugucauu

SEQ ID NO: 505290 - RNA, 22 nt, Homo sapiens
gagucuuaauauauauauccag

SEQ ID NO: 505291 - RNA, 14 nt, Homo sapiens
gauauuaacuguca

SEQ ID NO: 505292 - RNA, 19 nt, Homo sapiens
gaucccuagcugugaccuc

SEQ ID NO: 505293 - RNA, 15 nt, Homo sapiens
gaugcagagcuuuca

SEQ ID NO: 505294 - RNA, 20 nt, Homo sapiens
gaugcagagcuuucaaggau

SEQ ID NO: 505295 - RNA, 14 nt, Homo sapiens
gauguccaaacugu

SEQ ID NO: 505296 - RNA, 15 nt, Homo sapiens
gaugugaguugcaca

SEQ ID NO: 505297 - RNA, 16 nt, Homo sapiens
gauucagagcuuucaa

SEQ ID NO: 505298 - RNA, 20 nt, Homo sapiens
gauucagagcuuucaaggau

SEQ ID NO: 505299 - RNA, 14 nt, Homo sapiens
gauucauuuuaaca

SEQ ID NO: 505300 - RNA, 21 nt, Homo sapiens
gauuuacgcucauuguagaaa

SEQ ID NO: 505301 - RNA, 12 nt, Homo sapiens
gauuuuuacaca

SEQ ID NO: 505302 - RNA, 13 nt, Homo sapiens
gauuuuuacacau

SEQ ID NO: 505303 - RNA, 20 nt, Homo sapiens
gcaccuacuuacaugcauua

SEQ ID NO: 505304 - RNA, 15 nt, Homo sapiens
gcacuuggacucucc

SEQ ID NO: 505305 - RNA, 14 nt, Homo sapiens
gcauuaaaaaugca

SEQ ID NO: 505306 - RNA, 18 nt, Homo sapiens
gcauuaaaaaugcauaua

SEQ ID NO: 505307 - RNA, 17 nt, Homo sapiens
gcauuaaauuuuagcaa

SEQ ID NO: 505308 - RNA, 15 nt, Homo sapiens
gccaauaaaccaaug

SEQ ID NO: 505309 - RNA, 21 nt, Homo sapiens
gcccaugaugcagagcuuuca

SEQ ID NO: 505310 - RNA, 22 nt, Homo sapiens
gcccaugaugcagagcuuucaa

SEQ ID NO: 505311 - RNA, 18 nt, Homo sapiens
gccugacgaacuccuuga

SEQ ID NO: 505312 - RNA, 14 nt, Homo sapiens
gccugcagacucac

SEQ ID NO: 505313 - RNA, 22 nt, Homo sapiens
gccuucucuguucauuuccuca

SEQ ID NO: 505314 - RNA, 22 nt, Homo sapiens
gccuuggggauucuuccaucug

SEQ ID NO: 505315 - RNA, 15 nt, Homo sapiens
gcuacucuaguauuc

SEQ ID NO: 505316 - RNA, 19 nt, Homo sapiens
gcugauauuaacugucaau

SEQ ID NO: 505317 - RNA, 19 nt, Homo sapiens
gcugccccuacugcaaaug

SEQ ID NO: 505318 - RNA, 20 nt, Homo sapiens
gcuuuauucugcaagcaaua

SEQ ID NO: 505319 - RNA, 17 nt, Homo sapiens
ggacccauagacagccc

SEQ ID NO: 505320 - RNA, 15 nt, Homo sapiens
ggacucaguggacac

SEQ ID NO: 505321 - RNA, 13 nt, Homo sapiens
ggagccacacaga

SEQ ID NO: 505322 - RNA, 14 nt, Homo sapiens
ggauaggcuuuauu

SEQ ID NO: 505323 - RNA, 17 nt, Homo sapiens
ggauucuuccaucugau

SEQ ID NO: 505324 - RNA, 20 nt, Homo sapiens
gggaaaaagaaugaugcuau

SEQ ID NO: 505325 - RNA, 11 nt, Homo sapiens
guaaaugugau

SEQ ID NO: 505326 - RNA, 16 nt, Homo sapiens
guaacucaucugucac

SEQ ID NO: 505327 - RNA, 20 nt, Homo sapiens
guacuauuauccccauuucu

SEQ ID NO: 505328 - RNA, 22 nt, Homo sapiens
guccgacucuucugagcaccua

SEQ ID NO: 505329 - RNA, 19 nt, Homo sapiens
aaaaacuauuaacaacuug

SEQ ID NO: 505330 - RNA, 16 nt, Homo sapiens
aaaaaguaaaugugau

SEQ ID NO: 505331 - RNA, 16 nt, Homo sapiens
aaaaguuauguagaaa

SEQ ID NO: 505332 - RNA, 15 nt, Homo sapiens
aaacccagugagaca

SEQ ID NO: 505333 - RNA, 18 nt, Homo sapiens
aaagaaugaugcuaugaa

SEQ ID NO: 505334 - RNA, 14 nt, Homo sapiens
aaagcuuugaaccc

SEQ ID NO: 505335 - RNA, 17 nt, Homo sapiens
aaaugccccucccagau

SEQ ID NO: 505336 - RNA, 15 nt, Homo sapiens
aaauuaugauaagga

SEQ ID NO: 505337 - RNA, 22 nt, Homo sapiens
aaauuugggggacuuacaugau

SEQ ID NO: 505338 - RNA, 21 nt, Homo sapiens
aacaacuugucuauuaccugu

SEQ ID NO: 505339 - RNA, 23 nt, Homo sapiens
aacaacuugucuauuaccuguua

SEQ ID NO: 505340 - RNA, 13 nt, Homo sapiens
aacccugggacgu

SEQ ID NO: 505341 - RNA, 15 nt, Homo sapiens
aaccucaagcugcau

SEQ ID NO: 505342 - RNA, 15 nt, Homo sapiens
aagaaugaugcuaug

SEQ ID NO: 505343 - RNA, 16 nt, Homo sapiens
aagauaaucauugcuu

SEQ ID NO: 505344 - RNA, 20 nt, Homo sapiens
aagauaaucauugcuuaugu

SEQ ID NO: 505345 - RNA, 12 nt, Homo sapiens
aaguuuacuuuu

SEQ ID NO: 505346 - RNA, 14 nt, Homo sapiens
aauaaaccaaugaa

SEQ ID NO: 505347 - RNA, 20 nt, Homo sapiens
aauaaaucuauucugcuaag

SEQ ID NO: 505348 - RNA, 22 nt, Homo sapiens
aaucccagcaugcugagauuac

SEQ ID NO: 505349 - RNA, 14 nt, Homo sapiens
aaugaugcuaugaa

SEQ ID NO: 505350 - RNA, 16 nt, Homo sapiens
aaugcauauacuuuaa

SEQ ID NO: 505351 - RNA, 14 nt, Homo sapiens
aaugguuauggguc

SEQ ID NO: 505352 - RNA, 18 nt, Homo sapiens
aauuugggggacuuacau

SEQ ID NO: 505353 - RNA, 19 nt, Homo sapiens
acaacuugucuauuaccug

SEQ ID NO: 505354 - RNA, 18 nt, Homo sapiens
acaagccuucagccacag

SEQ ID NO: 505355 - RNA, 21 nt, Homo sapiens
acaagccuucagccacaggga

SEQ ID NO: 505356 - RNA, 16 nt, Homo sapiens
acaauaauucuaugag

SEQ ID NO: 505357 - RNA, 16 nt, Homo sapiens
acacauguaucuaugc

SEQ ID NO: 505358 - RNA, 15 nt, Homo sapiens
acaccuaugucauuu

SEQ ID NO: 505359 - RNA, 14 nt, Homo sapiens
acacucagaccagc

SEQ ID NO: 505360 - RNA, 20 nt, Homo sapiens
acacugcacgaauggaagag

SEQ ID NO: 505361 - RNA, 21 nt, Homo sapiens
acagagauguccaaacugucg

SEQ ID NO: 505362 - RNA, 22 nt, Homo sapiens
cuaugaaggcuguacacugcac

SEQ ID NO: 505363 - RNA, 20 nt, Homo sapiens
cuauucugcuaagagaucac

SEQ ID NO: 505364 - RNA, 22 nt, Homo sapiens
cucauuguagaaaagcuauaaa

SEQ ID NO: 505365 - RNA, 14 nt, Homo sapiens
cuccgucaccucag

SEQ ID NO: 505366 - RNA, 14 nt, Homo sapiens
cucuguucauuucc

SEQ ID NO: 505367 - RNA, 14 nt, Homo sapiens
cucuucacacggac

SEQ ID NO: 505368 - RNA, 23 nt, Homo sapiens
cucuucugagcaccuacuuacau

SEQ ID NO: 505369 - RNA, 17 nt, Homo sapiens
cugagcaccuacuuaca

SEQ ID NO: 505370 - RNA, 23 nt, Homo sapiens
cugcaugcacuucuuacaauaau

SEQ ID NO: 505371 - RNA, 16 nt, Homo sapiens
cugucaccaagccuug

SEQ ID NO: 505372 - RNA, 17 nt, Homo sapiens
cugucucucaugaaccu

SEQ ID NO: 505373 - RNA, 18 nt, Homo sapiens
cugucucucaugaaccuc

SEQ ID NO: 505374 - RNA, 19 nt, Homo sapiens
cugucucucaugaaccuca

SEQ ID NO: 505375 - RNA, 12 nt, Homo sapiens
cuuacucugaaa

SEQ ID NO: 505376 - RNA, 15 nt, Homo sapiens
cuuaugucaaaugga

SEQ ID NO: 505377 - RNA, 15 nt, Homo sapiens
cuucagccacaggga

SEQ ID NO: 505378 - RNA, 21 nt, Homo sapiens
cuuggagugcacugagaacag

SEQ ID NO: 505379 - RNA, 16 nt, Homo sapiens
cuuuauguuacuacau

SEQ ID NO: 505380 - RNA, 20 nt, Homo sapiens
cuuuauguuacuacaugcac

SEQ ID NO: 505381 - RNA, 17 nt, Homo sapiens
cuuuuuuaaaugaagaa

SEQ ID NO: 505382 - RNA, 23 nt, Homo sapiens
gaacccugggacguggcuaguca

SEQ ID NO: 505383 - RNA, 15 nt, Homo sapiens
gaaugaugcuaugaa

SEQ ID NO: 505384 - RNA, 23 nt, Homo sapiens
gacauacaccuaugucauuucau

SEQ ID NO: 505385 - RNA, 17 nt, Homo sapiens
gagauagguacuauuau

SEQ ID NO: 505386 - RNA, 12 nt, Homo sapiens
gagauguccaaa

SEQ ID NO: 505387 - RNA, 13 nt, Homo sapiens
gauaggcuuuauu

SEQ ID NO: 505388 - RNA, 14 nt, Homo sapiens
gauaucucaucucu

SEQ ID NO: 505389 - RNA, 17 nt, Homo sapiens
ugcagacucacuguggg

SEQ ID NO: 505390 - RNA, 13 nt, Homo sapiens
ugcagagcuuuca

SEQ ID NO: 505391 - RNA, 21 nt, Homo sapiens
ugcauaaaugugguacaagca

SEQ ID NO: 505392 - RNA, 16 nt, Homo sapiens
ugcaugcacuucuuac

SEQ ID NO: 505393 - RNA, 17 nt, Homo sapiens
ugcaugcacuucuuaca

SEQ ID NO: 505394 - RNA, 16 nt, Homo sapiens
ugcccaugaugcagag

SEQ ID NO: 505395 - RNA, 16 nt, Homo sapiens
ugcuacucuaguauuc

SEQ ID NO: 505396 - RNA, 15 nt, Homo sapiens
ugcuucaggauacca

SEQ ID NO: 505397 - RNA, 19 nt, Homo sapiens
ugcuucaggauaccauaua

SEQ ID NO: 505398 - RNA, 18 nt, Homo sapiens
uggaacugucucucauga

SEQ ID NO: 505399 - RNA, 20 nt, Homo sapiens
uggaagaggcaccuguccca

SEQ ID NO: 505400 - RNA, 20 nt, Homo sapiens
uggacacucagaccagcucc

SEQ ID NO: 505401 - RNA, 13 nt, Homo sapiens
uguaaucccagca

SEQ ID NO: 505402 - RNA, 16 nt, Homo sapiens
ugucccagaaaaagca

SEQ ID NO: 505403 - RNA, 13 nt, Homo sapiens
ugugguacaagca

SEQ ID NO: 505404 - RNA, 16 nt, Homo sapiens
uguucccuaaguccaa

SEQ ID NO: 505405 - RNA, 13 nt, Homo sapiens
uuaaagcuguuau

SEQ ID NO: 505406 - RNA, 20 nt, Homo sapiens
uuaaauuugggggacuuaca

SEQ ID NO: 505407 - RNA, 13 nt, Homo sapiens
uuacaugcauuac

SEQ ID NO: 505408 - RNA, 22 nt, Homo sapiens
uuacaugcauuacugcaugcac

SEQ ID NO: 505409 - RNA, 12 nt, Homo sapiens
uuacuacaugca

SEQ ID NO: 505410 - RNA, 15 nt, Homo sapiens
uuacuacaugcacuu

SEQ ID NO: 505411 - RNA, 14 nt, Homo sapiens
uuaugucaaaugga

SEQ ID NO: 505412 - RNA, 18 nt, Homo sapiens
uucaaggauaggcuuuau

SEQ ID NO: 505413 - RNA, 20 nt, Homo sapiens
uucccaaagauccacccaaa

SEQ ID NO: 505414 - RNA, 21 nt, Homo sapiens
uucccaaagauccacccaaau

SEQ ID NO: 505415 - RNA, 14 nt, Homo sapiens
uucccuaaguccaa

SEQ ID NO: 505416 - RNA, 14 nt, Homo sapiens
cuauucugcugaga

SEQ ID NO: 505417 - RNA, 20 nt, Homo sapiens
cuauucugcugagagaucac

SEQ ID NO: 505418 - RNA, 22 nt, Homo sapiens
cucaaagagggagugcauuuau

SEQ ID NO: 505419 - RNA, 20 nt, Homo sapiens
cucacugcccaugaugcaga

SEQ ID NO: 505420 - RNA, 16 nt, Homo sapiens
cucagaccagcuccca

SEQ ID NO: 505421 - RNA, 19 nt, Homo sapiens
cucagaccagcucccagau

SEQ ID NO: 505422 - RNA, 13 nt, Homo sapiens
cucauuguagaaa

SEQ ID NO: 505423 - RNA, 16 nt, Homo sapiens
cucuccuuguucugau

SEQ ID NO: 505424 - RNA, 12 nt, Homo sapiens
cucucucugugu

SEQ ID NO: 505425 - RNA, 19 nt, Homo sapiens
cucugaaacauggccuguu

SEQ ID NO: 505426 - RNA, 23 nt, Homo sapiens
cucuguguuacccaguaacucau

SEQ ID NO: 505427 - RNA, 18 nt, Homo sapiens
cugaagaaucacaauaau

SEQ ID NO: 505428 - RNA, 16 nt, Homo sapiens
cugagcaccuacuuac

SEQ ID NO: 505429 - RNA, 21 nt, Homo sapiens
cugagcaccuacuuacaugca

SEQ ID NO: 505430 - RNA, 22 nt, Homo sapiens
cugagcaccuacuuacaugcau

SEQ ID NO: 505431 - RNA, 14 nt, Homo sapiens
cugcagacucacug

SEQ ID NO: 505432 - RNA, 17 nt, Homo sapiens
cuguaaucccagcaugc

SEQ ID NO: 505433 - RNA, 20 nt, Homo sapiens
cugucucucaugaaccucaa

SEQ ID NO: 505434 - RNA, 14 nt, Homo sapiens
cuuacaugauucau

SEQ ID NO: 505435 - RNA, 15 nt, Homo sapiens
cuuacaugcauuacu

SEQ ID NO: 505436 - RNA, 21 nt, Homo sapiens
cuucuuacaauaauucuauga

SEQ ID NO: 505437 - RNA, 16 nt, Homo sapiens
cuucuuuuaaaccauu

SEQ ID NO: 505438 - RNA, 19 nt, Homo sapiens
cuuuauguuacuacaugca

SEQ ID NO: 505439 - RNA, 17 nt, Homo sapiens
gaaaaguuauguagaaa

SEQ ID NO: 505440 - RNA, 20 nt, Homo sapiens
gacucaaagagggagugcau

SEQ ID NO: 505441 - RNA, 13 nt, Homo sapiens
gacucacuguggg

SEQ ID NO: 505442 - RNA, 14 nt, Homo sapiens
gacucgcuagucag

SEQ ID NO: 505443 - RNA, 20 nt, Homo sapiens
gagaacagcauaugauuucu

SEQ ID NO: 505444 - RNA, 19 nt, Homo sapiens
gagacauacaccuauguca

SEQ ID NO: 505445 - RNA, 22 nt, Homo sapiens
gaguguaggugaaaugaaugaa

SEQ ID NO: 505446 - RNA, 13 nt, Homo sapiens
gaucccuagcugu

SEQ ID NO: 505447 - RNA, 19 nt, Homo sapiens
gaugaggcuucccagagac

SEQ ID NO: 505448 - RNA, 19 nt, Homo sapiens
gaugcuacucuaguauucc

SEQ ID NO: 505449 - RNA, 16 nt, Homo sapiens
gauguccaaacugucg

SEQ ID NO: 505450 - RNA, 17 nt, Homo sapiens
gcaagcaaucaaauaau

SEQ ID NO: 505451 - RNA, 17 nt, Homo sapiens
gcaccuacuuacaugca

SEQ ID NO: 505452 - RNA, 18 nt, Homo sapiens
gcauucuagauuacuuuu

SEQ ID NO: 505453 - RNA, 17 nt, Homo sapiens
gcgccaauaaaccaaug

SEQ ID NO: 505454 - RNA, 22 nt, Homo sapiens
gcucacugcccaugaugcagag

SEQ ID NO: 505455 - RNA, 16 nt, Homo sapiens
gcuucaggauaccaua

SEQ ID NO: 505456 - RNA, 17 nt, Homo sapiens
gcuuccuucauuuccuc

SEQ ID NO: 505457 - RNA, 13 nt, Homo sapiens
gcuuuauucugca

SEQ ID NO: 505458 - RNA, 19 nt, Homo sapiens
ggaaaaagaaugaugcuau

SEQ ID NO: 505459 - RNA, 22 nt, Homo sapiens
ggaaaaagaaugaugcuaugaa

SEQ ID NO: 505460 - RNA, 19 nt, Homo sapiens
ggacccauagacagcccug

SEQ ID NO: 505461 - RNA, 15 nt, Homo sapiens
ggacgcgcgugacac

SEQ ID NO: 505462 - RNA, 20 nt, Homo sapiens
ggacucaguggacacucaga

SEQ ID NO: 505463 - RNA, 17 nt, Homo sapiens
ggagacaaaacuagaga

SEQ ID NO: 505464 - RNA, 15 nt, Homo sapiens
ggagccacacagaga

SEQ ID NO: 505465 - RNA, 17 nt, Homo sapiens
ggaugacaugugccauu

SEQ ID NO: 505466 - RNA, 17 nt, Homo sapiens
ggcuuccuucauuuccu

SEQ ID NO: 505467 - RNA, 21 nt, Homo sapiens
ggcuuuauucugcaagcaauc

SEQ ID NO: 505468 - RNA, 14 nt, Homo sapiens
guaaagauauuuga

SEQ ID NO: 505469 - RNA, 14 nt, Homo sapiens
gucauuucauuucc

SEQ ID NO: 505470 - RNA, 22 nt, Homo sapiens
gugaucccuagcugugaccucu

SEQ ID NO: 505471 - RNA, 14 nt, Homo sapiens
gugcagacaggcug

SEQ ID NO: 505472 - RNA, 19 nt, Homo sapiens
gugccuucauuugggaugc

SEQ ID NO: 505473 - RNA, 14 nt, Homo sapiens
guucugauaaugaa

SEQ ID NO: 505474 - RNA, 12 nt, Homo sapiens
uaaaaaugcaua

SEQ ID NO: 505475 - RNA, 21 nt, Homo sapiens
uaaucccagcaugcugagauu

SEQ ID NO: 505476 - RNA, 23 nt, Homo sapiens
uaauuggcaugaaggugucauac

SEQ ID NO: 505477 - RNA, 20 nt, Homo sapiens
uacaauaauucuaugagaua

SEQ ID NO: 505478 - RNA, 20 nt, Homo sapiens
uacacauguaucuaugcauu

SEQ ID NO: 505479 - RNA, 18 nt, Homo sapiens
uacaccuaugucauuuca

SEQ ID NO: 505480 - RNA, 21 nt, Homo sapiens
uacgcucauuguagaaaagcu

SEQ ID NO: 505481 - RNA, 13 nt, Homo sapiens
uacuuacaugcau

SEQ ID NO: 505482 - RNA, 18 nt, Homo sapiens
uacuuuucuuacucugaa

SEQ ID NO: 505483 - RNA, 20 nt, Homo sapiens
uauauccagauggcaugugu

SEQ ID NO: 505484 - RNA, 19 nt, Homo sapiens
uaugaaggcuguacacugc

SEQ ID NO: 505485 - RNA, 23 nt, Homo sapiens
uauuaaggaaauacuuugcauaa

SEQ ID NO: 505486 - RNA, 12 nt, Homo sapiens
uauucugcaagc

SEQ ID NO: 505487 - RNA, 16 nt, Homo sapiens
uauucugcaagcaaua

SEQ ID NO: 505488 - RNA, 15 nt, Homo sapiens
ucaaaagagucuuaa

SEQ ID NO: 505489 - RNA, 20 nt, Homo sapiens
ucaaacacggacccauagac

SEQ ID NO: 505490 - RNA, 19 nt, Homo sapiens
ucaaagagggagugcauuu

SEQ ID NO: 505491 - RNA, 21 nt, Homo sapiens
ucaaagagggagugcauuuau

SEQ ID NO: 505492 - RNA, 18 nt, Homo sapiens
ucaacuuuuccuuugaau

SEQ ID NO: 505493 - RNA, 18 nt, Homo sapiens
ucagaaguuucuucuuua

SEQ ID NO: 505494 - RNA, 13 nt, Homo sapiens
ucagagacauaca

SEQ ID NO: 505495 - RNA, 16 nt, Homo sapiens
ucauaaccuuaccaga

SEQ ID NO: 505496 - RNA, 15 nt, Homo sapiens
ucauacagauuugca

SEQ ID NO: 505497 - RNA, 15 nt, Homo sapiens
ucauuuuauucuuau

SEQ ID NO: 505498 - RNA, 13 nt, Homo sapiens
uccacccaaauau

SEQ ID NO: 505499 - RNA, 18 nt, Homo sapiens
ucccagcaugcugagauu

SEQ ID NO: 505500 - RNA, 19 nt, Homo sapiens
ucccagcaugcugagauua

SEQ ID NO: 505501 - RNA, 19 nt, Homo sapiens
uccgggacccccaggacag

SEQ ID NO: 505502 - RNA, 11 nt, Homo sapiens
ucgcuagucag

SEQ ID NO: 505503 - RNA, 22 nt, Homo sapiens
ucgugcaaacccagugagacag

SEQ ID NO: 505504 - RNA, 22 nt, Homo sapiens
ucuaugagauagguacuauuau

SEQ ID NO: 505505 - RNA, 15 nt, Homo sapiens
ucucaugaaccucaa

SEQ ID NO: 505506 - RNA, 18 nt, Homo sapiens
ucucuccuuguucugaua

SEQ ID NO: 505507 - RNA, 19 nt, Homo sapiens
ucugagaaaagcuuugaac

SEQ ID NO: 505508 - RNA, 19 nt, Homo sapiens
ucugagcaccuacuuacau

SEQ ID NO: 505509 - RNA, 20 nt, Homo sapiens
ucugauaaugaaaauuauga

SEQ ID NO: 505510 - RNA, 19 nt, Homo sapiens
ucuuacaauaauucuauga

SEQ ID NO: 505511 - RNA, 21 nt, Homo sapiens
ucuuacaauaauucuaugaga

SEQ ID NO: 505512 - RNA, 13 nt, Homo sapiens
ucuuacucugaaa

SEQ ID NO: 505513 - RNA, 23 nt, Homo sapiens
ucuuaucuuuuggcuucugcaga

SEQ ID NO: 505514 - RNA, 18 nt, Homo sapiens
ucuucauguuucaggaga

SEQ ID NO: 505515 - RNA, 16 nt, Homo sapiens
ugaaagggguugugaa

SEQ ID NO: 505516 - RNA, 13 nt, Homo sapiens
ugaagagguguuu

SEQ ID NO: 505517 - RNA, 21 nt, Homo sapiens
ugaauccucucucuguguuac

SEQ ID NO: 505518 - RNA, 19 nt, Homo sapiens
ugagaaaagcuuugaaccc

SEQ ID NO: 505519 - RNA, 14 nt, Homo sapiens
ugagaacagcauau

SEQ ID NO: 505520 - RNA, 18 nt, Homo sapiens
ugagacagaccgccaaau

SEQ ID NO: 505521 - RNA, 20 nt, Homo sapiens
ugagacagaccgccaaauaa

SEQ ID NO: 505522 - RNA, 13 nt, Homo sapiens
ugagauuacaggu

SEQ ID NO: 505523 - RNA, 19 nt, Homo sapiens
ugaguugcacagcuaugaa

SEQ ID NO: 505524 - RNA, 17 nt, Homo sapiens
ugaucccuagcugugac

SEQ ID NO: 505525 - RNA, 21 nt, Homo sapiens
ugcccccucuggugucuuuga

SEQ ID NO: 505526 - RNA, 17 nt, Homo sapiens
ugccccuacugcaaaug

SEQ ID NO: 505527 - RNA, 19 nt, Homo sapiens
ugccccuacugcaaauggc

SEQ ID NO: 505528 - RNA, 17 nt, Homo sapiens
uggaagaggcaccuguc

SEQ ID NO: 505529 - RNA, 18 nt, Homo sapiens
uggaagaggcaccugucc

SEQ ID NO: 505530 - RNA, 19 nt, Homo sapiens
uggacucgcguucccaaag

SEQ ID NO: 505531 - RNA, 16 nt, Homo sapiens
uggacucuccuaguga

SEQ ID NO: 505532 - RNA, 18 nt, Homo sapiens
gauccacccaaauaucaa

SEQ ID NO: 505533 - RNA, 12 nt, Homo sapiens
gaugcuaugaaa

SEQ ID NO: 505534 - RNA, 14 nt, Homo sapiens
gaugguugcaauug

SEQ ID NO: 505535 - RNA, 20 nt, Homo sapiens
gauucauuuuaacaucugag

SEQ ID NO: 505536 - RNA, 21 nt, Homo sapiens
gauuuuuacacauguaucuau

SEQ ID NO: 505537 - RNA, 13 nt, Homo sapiens
gcaaacccaguga

SEQ ID NO: 505538 - RNA, 14 nt, Homo sapiens
gcaaguuuacuuuu

SEQ ID NO: 505539 - RNA, 19 nt, Homo sapiens
gcaaucaaauaauaaaucu

SEQ ID NO: 505540 - RNA, 18 nt, Homo sapiens
gcaccuacuuacaugcau

SEQ ID NO: 505541 - RNA, 16 nt, Homo sapiens
gcagacucacuguggg

SEQ ID NO: 505542 - RNA, 19 nt, Homo sapiens
gcagagcuuucaaggauag

SEQ ID NO: 505543 - RNA, 21 nt, Homo sapiens
gcaggugcuucaggauaccau

SEQ ID NO: 505544 - RNA, 20 nt, Homo sapiens
gcauaaaugugguacaagca

SEQ ID NO: 505545 - RNA, 22 nt, Homo sapiens
gcaucuggauucugccuaauaa

SEQ ID NO: 505546 - RNA, 22 nt, Homo sapiens
gcaugcacuucuuacaauaauu

SEQ ID NO: 505547 - RNA, 21 nt, Homo sapiens
gcaugccggugaucccuagcu

SEQ ID NO: 505548 - RNA, 15 nt, Homo sapiens
gccugcagacucacu

SEQ ID NO: 505549 - RNA, 18 nt, Homo sapiens
gccuucucuguucauuuc

SEQ ID NO: 505550 - RNA, 23 nt, Homo sapiens
gcguaaugcgccaauaaaccaau

SEQ ID NO: 505551 - RNA, 18 nt, Homo sapiens
gcugauauuaacugucaa

SEQ ID NO: 505552 - RNA, 19 nt, Homo sapiens
gcuguuauuuaauuagcca

SEQ ID NO: 505553 - RNA, 22 nt, Homo sapiens
gcuuccuucauuuccuccguca

SEQ ID NO: 505554 - RNA, 20 nt, Homo sapiens
gcuuuauucugcaagcaauc

SEQ ID NO: 505555 - RNA, 20 nt, Homo sapiens
gcuuucaaggauaggcuuua

SEQ ID NO: 505556 - RNA, 20 nt, Homo sapiens
ggaaaaagaaugaugcuaug

SEQ ID NO: 505557 - RNA, 17 nt, Homo sapiens
ggaaaauccgacaagcc

SEQ ID NO: 505558 - RNA, 19 nt, Homo sapiens
ggaacugucucucaugaac

SEQ ID NO: 505559 - RNA, 16 nt, Homo sapiens
ggcaugaaggugucau

SEQ ID NO: 505560 - RNA, 12 nt, Homo sapiens
ggcuagucauaa

SEQ ID NO: 505561 - RNA, 13 nt, Homo sapiens
ggcuucccagaga

SEQ ID NO: 505562 - RNA, 15 nt, Homo sapiens
ggcuuccuucauuuc

SEQ ID NO: 505563 - RNA, 14 nt, Homo sapiens
gggacuuacaugau

SEQ ID NO: 505564 - RNA, 13 nt, Homo sapiens
ggugaaaugaaug

SEQ ID NO: 505565 - RNA, 12 nt, Homo sapiens
ggugcuucagga

SEQ ID NO: 505566 - RNA, 22 nt, Homo sapiens
ggugucauacagauuugcaaag

SEQ ID NO: 505567 - RNA, 17 nt, Homo sapiens
guaaugcgccaauaaac

SEQ ID NO: 505568 - RNA, 15 nt, Homo sapiens
guacaagcauucugu

SEQ ID NO: 505569 - RNA, 14 nt, Homo sapiens
guaucuaugcauuu

SEQ ID NO: 505570 - RNA, 22 nt, Homo sapiens
gucaguaaagauauuugaauau

SEQ ID NO: 505571 - RNA, 13 nt, Homo sapiens
gugacacaaugcu

SEQ ID NO: 505572 - RNA, 17 nt, Homo sapiens
gugaguugcacagcuau

SEQ ID NO: 505573 - RNA, 23 nt, Homo sapiens
guguuacccaguaacucaucugu

SEQ ID NO: 505574 - RNA, 14 nt, Homo sapiens
uaaaaaacauuuau

SEQ ID NO: 505575 - RNA, 16 nt, Homo sapiens
uaaacggacucagugg

SEQ ID NO: 505576 - RNA, 16 nt, Homo sapiens
uaaaucuauucugcua

SEQ ID NO: 505577 - RNA, 19 nt, Homo sapiens
uaaaugugauuuacgcuca

SEQ ID NO: 505578 - RNA, 17 nt, Homo sapiens
uaaaugugguacaagca

SEQ ID NO: 505579 - RNA, 16 nt, Homo sapiens
uaacucaucugucacc

SEQ ID NO: 505580 - RNA, 21 nt, Homo sapiens
uaaugcgccaauaaaccaaug

SEQ ID NO: 505581 - RNA, 15 nt, Homo sapiens
uaauucuaugagaua

SEQ ID NO: 505582 - RNA, 15 nt, Homo sapiens
uaauuggcaugaagg

SEQ ID NO: 505583 - RNA, 21 nt, Homo sapiens
uacacauguaucuaugcauuu

SEQ ID NO: 505584 - RNA, 15 nt, Homo sapiens
uacaccuaugucauu

SEQ ID NO: 505585 - RNA, 20 nt, Homo sapiens
uacaugcauuacugcaugca

SEQ ID NO: 505586 - RNA, 16 nt, Homo sapiens
uaccuguuaguauuau

SEQ ID NO: 505587 - RNA, 14 nt, Homo sapiens
uacuacaugcacuu

SEQ ID NO: 505588 - RNA, 16 nt, Homo sapiens
uacuuacaugcauuac

SEQ ID NO: 505589 - RNA, 20 nt, Homo sapiens
uaguauuccagaccugaaga

SEQ ID NO: 505590 - RNA, 12 nt, Homo sapiens
uaucuaugcauu

SEQ ID NO: 505591 - RNA, 13 nt, Homo sapiens
uaucuaugcauuu

SEQ ID NO: 505592 - RNA, 12 nt, Homo sapiens
uaucucaucucu

SEQ ID NO: 505593 - RNA, 14 nt, Homo sapiens
uaugaagggccuug

SEQ ID NO: 505594 - RNA, 17 nt, Homo sapiens
uauguuacuacaugcac

SEQ ID NO: 505595 - RNA, 18 nt, Homo sapiens
uauuauuguugcauuaaa

SEQ ID NO: 505596 - RNA, 16 nt, Homo sapiens
uauucugcaagcaauc

SEQ ID NO: 505597 - RNA, 18 nt, Homo sapiens
uauucugcaagcaaucaa

SEQ ID NO: 505598 - RNA, 14 nt, Homo sapiens
uauuuaauuagcca

SEQ ID NO: 505599 - RNA, 23 nt, Homo sapiens
ucaaacacggacccauagacagc

SEQ ID NO: 505600 - RNA, 23 nt, Homo sapiens
ucaaggauaggcuuuauucugca

SEQ ID NO: 505601 - RNA, 21 nt, Homo sapiens
ucaccucagagacauacaccu

SEQ ID NO: 505602 - RNA, 13 nt, Homo sapiens
ucaggauaccaua

SEQ ID NO: 505603 - RNA, 20 nt, Homo sapiens
ucaggaugacaugugccauu

SEQ ID NO: 505604 - RNA, 21 nt, Homo sapiens
ucauuuccuccgucaccucag

SEQ ID NO: 505605 - RNA, 18 nt, Homo sapiens
ucauuuuaacaucugaga

SEQ ID NO: 505606 - RNA, 14 nt, Homo sapiens
ucccccguccugga

SEQ ID NO: 505607 - RNA, 20 nt, Homo sapiens
uccccuggaacugucucuca

SEQ ID NO: 505608 - RNA, 14 nt, Homo sapiens
uccgucaccucaga

SEQ ID NO: 505609 - RNA, 16 nt, Homo sapiens
uccgucaccucagaga

SEQ ID NO: 505610 - RNA, 15 nt, Homo sapiens
ucuaauuggcaugaa

SEQ ID NO: 505611 - RNA, 18 nt, Homo sapiens
ucugaguuccugcaugcc

SEQ ID NO: 505612 - RNA, 14 nt, Homo sapiens
ucugcaagcaauac

SEQ ID NO: 505613 - RNA, 19 nt, Homo sapiens
ucuuccaucugauugugau

SEQ ID NO: 505614 - RNA, 15 nt, Homo sapiens
ucuucugagcaccua

SEQ ID NO: 505615 - RNA, 16 nt, Homo sapiens
ucuucuuuuaaaccau

SEQ ID NO: 505616 - RNA, 21 nt, Homo sapiens
ucuugaagggcaggugcuuca

SEQ ID NO: 505617 - RNA, 18 nt, Homo sapiens
ugaauccucucucugugu

SEQ ID NO: 505618 - RNA, 17 nt, Homo sapiens
ugagaaaagcuuugaac

SEQ ID NO: 505619 - RNA, 20 nt, Homo sapiens
ugagaagauaaucauugcuu

SEQ ID NO: 505620 - RNA, 14 nt, Homo sapiens
ugagcaccuacuua

SEQ ID NO: 505621 - RNA, 21 nt, Homo sapiens
ugauucagagcuuucaaggau

SEQ ID NO: 505622 - RNA, 17 nt, Homo sapiens
uucuaccuggucucucc

SEQ ID NO: 505623 - RNA, 17 nt, Homo sapiens
uucugcugagagaucac

SEQ ID NO: 505624 - RNA, 22 nt, Homo sapiens
uucuuacaauaauucuaugaga

SEQ ID NO: 505625 - RNA, 13 nt, Homo sapiens
uucuuccaucuga

SEQ ID NO: 505626 - RNA, 13 nt, Homo sapiens
uucuucuuuaggc

SEQ ID NO: 505627 - RNA, 15 nt, Homo sapiens
uucuuuuaaaccauu

SEQ ID NO: 505628 - RNA, 14 nt, Homo sapiens
uugagcaucuggau

SEQ ID NO: 505629 - RNA, 15 nt, Homo sapiens
uuuaacaucugagaa

SEQ ID NO: 505630 - RNA, 20 nt, Homo sapiens
uuuacacauguaucuaugca

SEQ ID NO: 505631 - RNA, 14 nt, Homo sapiens
uuuaugagcucuuc

SEQ ID NO: 505632 - RNA, 19 nt, Homo sapiens
acaugcacuuggcugcaua

SEQ ID NO: 505633 - RNA, 17 nt, Homo sapiens
accauauacagcucaga

SEQ ID NO: 505634 - RNA, 19 nt, Homo sapiens
acccaguaacucaucuguc

SEQ ID NO: 505635 - RNA, 22 nt, Homo sapiens
acccaguaacucaucugucacc

SEQ ID NO: 505636 - RNA, 17 nt, Homo sapiens
acccccaggacaggcug

SEQ ID NO: 505637 - RNA, 17 nt, Homo sapiens
acccguucaacuuuucc

SEQ ID NO: 505638 - RNA, 18 nt, Homo sapiens
accuacuuacaugcauua

SEQ ID NO: 505639 - RNA, 23 nt, Homo sapiens
acgcagccugcagacucacugug

SEQ ID NO: 505640 - RNA, 19 nt, Homo sapiens
acggaaaauccgacaagcc

SEQ ID NO: 505641 - RNA, 13 nt, Homo sapiens
acggacucagugg

SEQ ID NO: 505642 - RNA, 21 nt, Homo sapiens
acuacaugcacuuggcugcau

SEQ ID NO: 505643 - RNA, 14 nt, Homo sapiens
acucacugugggaa

SEQ ID NO: 505644 - RNA, 22 nt, Homo sapiens
acucuucugagcaccuacuuac

SEQ ID NO: 505645 - RNA, 14 nt, Homo sapiens
acugucucucauga

SEQ ID NO: 505646 - RNA, 14 nt, Homo sapiens
acuuacaugcauua

SEQ ID NO: 505647 - RNA, 19 nt, Homo sapiens
acuuggacucuccuaguga

SEQ ID NO: 505648 - RNA, 20 nt, Homo sapiens
acuuuauguuacuacaugca

SEQ ID NO: 505649 - RNA, 14 nt, Homo sapiens
acuuuuccuuugaa

SEQ ID NO: 505650 - RNA, 12 nt, Homo sapiens
agacucacugug

SEQ ID NO: 505651 - RNA, 14 nt, Homo sapiens
agaggacuccuuaa

SEQ ID NO: 505652 - RNA, 20 nt, Homo sapiens
agaggcuuccuucauuuccu

SEQ ID NO: 505653 - RNA, 16 nt, Homo sapiens
agagucuuaauauaua

SEQ ID NO: 505654 - RNA, 12 nt, Homo sapiens
agaguugaaccu

SEQ ID NO: 505655 - RNA, 17 nt, Homo sapiens
agcaccuacuuacaugc

SEQ ID NO: 505656 - RNA, 20 nt, Homo sapiens
agcaucuggauucugccuaa

SEQ ID NO: 505657 - RNA, 19 nt, Homo sapiens
agccacacagagaugucca

SEQ ID NO: 505658 - RNA, 18 nt, Homo sapiens
agccugcagacucacugu

SEQ ID NO: 505659 - RNA, 20 nt, Homo sapiens
agccuucucuguucauuucc

SEQ ID NO: 505660 - RNA, 19 nt, Homo sapiens
agccuuggggauucuucca

SEQ ID NO: 505661 - RNA, 12 nt, Homo sapiens
agcuaugaaggc

SEQ ID NO: 505662 - RNA, 22 nt, Homo sapiens
agcuaugaaggcuguacacugc

SEQ ID NO: 505663 - RNA, 18 nt, Homo sapiens
agcucccagauggcccug

SEQ ID NO: 505664 - RNA, 21 nt, Homo sapiens
aggaugauaaaagcacuuacu

SEQ ID NO: 505665 - RNA, 13 nt, Homo sapiens
aggcuuccuucau

SEQ ID NO: 505666 - RNA, 17 nt, Homo sapiens
aggcuuccuucauuucc

SEQ ID NO: 505667 - RNA, 18 nt, Homo sapiens
aguaacucaucugucacc

SEQ ID NO: 505668 - RNA, 14 nt, Homo sapiens
aguggacacucaga

SEQ ID NO: 505669 - RNA, 18 nt, Homo sapiens
auaaaucuauucugcuaa

SEQ ID NO: 505670 - RNA, 18 nt, Homo sapiens
auaaugaaaauuaugaua

SEQ ID NO: 505671 - RNA, 22 nt, Homo sapiens
auaauggucaguccucaucucu

SEQ ID NO: 505672 - RNA, 14 nt, Homo sapiens
auaauucuaugaga

SEQ ID NO: 505673 - RNA, 13 nt, Homo sapiens
auacagcuaugaa

SEQ ID NO: 505674 - RNA, 11 nt, Homo sapiens
auaggcuuuau

SEQ ID NO: 505675 - RNA, 17 nt, Homo sapiens
auaucuugaaagggguu

SEQ ID NO: 505676 - RNA, 15 nt, Homo sapiens
aucauggcuaucugu

SEQ ID NO: 505677 - RNA, 14 nt, Homo sapiens
auccacccaaauau

SEQ ID NO: 505678 - RNA, 13 nt, Homo sapiens
auccucucucugu

SEQ ID NO: 505679 - RNA, 18 nt, Homo sapiens
aucugagaaaagcuuuga

SEQ ID NO: 505680 - RNA, 17 nt, Homo sapiens
aucuggauucugccuaa

SEQ ID NO: 505681 - RNA, 23 nt, Homo sapiens
augaaggugucauacagauuugc

SEQ ID NO: 505682 - RNA, 15 nt, Homo sapiens
augaugcagagcuuu

SEQ ID NO: 505683 - RNA, 13 nt, Homo sapiens
augaugcuaugaa

SEQ ID NO: 505684 - RNA, 17 nt, Homo sapiens
augauucagagcuuuca

SEQ ID NO: 505685 - RNA, 19 nt, Homo sapiens
augcacuucuuacaauaau

SEQ ID NO: 505686 - RNA, 19 nt, Homo sapiens
augcacuuggcugcauaaa

SEQ ID NO: 505687 - RNA, 15 nt, Homo sapiens
augcauauacuuuaa

SEQ ID NO: 505688 - RNA, 14 nt, Homo sapiens
augcauuacugcau

SEQ ID NO: 505689 - RNA, 22 nt, Homo sapiens
augcugggugguuuucccacga

SEQ ID NO: 505690 - RNA, 16 nt, Homo sapiens
augggacaagaagccu

SEQ ID NO: 505691 - RNA, 17 nt, Homo sapiens
augucauuucauuuccu

SEQ ID NO: 505692 - RNA, 22 nt, Homo sapiens
augugaguugcacagcuaugaa

SEQ ID NO: 505693 - RNA, 21 nt, Homo sapiens
auguuucaggagagaguugaa

SEQ ID NO: 505694 - RNA, 12 nt, Homo sapiens
auuauuguugca

SEQ ID NO: 505695 - RNA, 17 nt, Homo sapiens
auuauuguugcauuaaa

SEQ ID NO: 505696 - RNA, 21 nt, Homo sapiens
auucauuuuaacaucugagaa

SEQ ID NO: 505697 - RNA, 15 nt, Homo sapiens
auucugcaagcaaua

SEQ ID NO: 505698 - RNA, 15 nt, Homo sapiens
auucugcaagcaauc

SEQ ID NO: 505699 - RNA, 20 nt, Homo sapiens
auucugcaagcaaucaaaua

SEQ ID NO: 505700 - RNA, 14 nt, Homo sapiens
auuggcaugaaggu

SEQ ID NO: 505701 - RNA, 17 nt, Homo sapiens
auuuuaacaucugagaa

SEQ ID NO: 505702 - RNA, 23 nt, Homo sapiens
auuuuuggaagaggacuccuuaa

SEQ ID NO: 505703 - RNA, 12 nt, Homo sapiens
caaacccaguga

SEQ ID NO: 505704 - RNA, 16 nt, Homo sapiens
caaacuugaaaacaga

SEQ ID NO: 505705 - RNA, 24 nt, Homo sapiens
caaauaaacggacucaguggacac

SEQ ID NO: 505706 - RNA, 14 nt, Homo sapiens
caauuucuauuaaa

SEQ ID NO: 505707 - RNA, 19 nt, Homo sapiens
cacaauaauuuucuaccug

SEQ ID NO: 505708 - RNA, 14 nt, Homo sapiens
cacagcuaugaagg

SEQ ID NO: 505709 - RNA, 15 nt, Homo sapiens
cacagcuaugaaggc

SEQ ID NO: 505710 - RNA, 21 nt, Homo sapiens
cacagcuaugaaggcuguaca

SEQ ID NO: 505711 - RNA, 24 nt, Homo sapiens
cacagcuaugaaggcuguacacug

SEQ ID NO: 505712 - RNA, 16 nt, Homo sapiens
caccuaugucauuuca

SEQ ID NO: 505713 - RNA, 19 nt, Homo sapiens
cagaaguuucuucuuuagg

SEQ ID NO: 505714 - RNA, 21 nt, Homo sapiens
cagauuugcaaaguuuaaugg

SEQ ID NO: 505715 - RNA, 15 nt, Homo sapiens
cagcauaugauuucu

SEQ ID NO: 505716 - RNA, 17 nt, Homo sapiens
cagcaugcugagauuac

SEQ ID NO: 505717 - RNA, 20 nt, Homo sapiens
caggugugagccacccugcc

SEQ ID NO: 505718 - RNA, 21 nt, Homo sapiens
cauacaccuaugucauuucau

SEQ ID NO: 505719 - RNA, 13 nt, Homo sapiens
caucugauuguga

SEQ ID NO: 505720 - RNA, 22 nt, Homo sapiens
caugaaccucaagcugcaucua

SEQ ID NO: 505721 - RNA, 13 nt, Homo sapiens
caugcacuucuua

SEQ ID NO: 505722 - RNA, 19 nt, Homo sapiens
caugcacuuggcugcauaa

SEQ ID NO: 505723 - RNA, 14 nt, Homo sapiens
cauguaucuaugca

SEQ ID NO: 505724 - RNA, 17 nt, Homo sapiens
cauguaucuaugcauuu

SEQ ID NO: 505725 - RNA, 17 nt, Homo sapiens
cauuaaaaaugcauaua

SEQ ID NO: 505726 - RNA, 23 nt, Homo sapiens
cauuaaaaaugcauauacuuuaa

SEQ ID NO: 505727 - RNA, 17 nt, Homo sapiens
cauucuagauuacuuuu

SEQ ID NO: 505728 - RNA, 16 nt, Homo sapiens
cauucugucuugaagg

SEQ ID NO: 505729 - RNA, 16 nt, Homo sapiens
ccaugaugcagagcuu

SEQ ID NO: 505730 - RNA, 15 nt, Homo sapiens
ccauucccuagucau

SEQ ID NO: 505731 - RNA, 18 nt, Homo sapiens
cccagcaugcugagauua

SEQ ID NO: 505732 - RNA, 15 nt, Homo sapiens
cccagccccacuuac

SEQ ID NO: 505733 - RNA, 19 nt, Homo sapiens
cccaguaacucaucuguca

SEQ ID NO: 505734 - RNA, 19 nt, Homo sapiens
ccccuggaacugucucuca

SEQ ID NO: 505735 - RNA, 16 nt, Homo sapiens
cccuacugcaaauggc

SEQ ID NO: 505736 - RNA, 21 nt, Homo sapiens
cccugggacguggcuagucau

SEQ ID NO: 505737 - RNA, 22 nt, Homo sapiens
ccgucaccucagagacauacac

SEQ ID NO: 505738 - RNA, 17 nt, Homo sapiens
ccuacuuacaugcauua

SEQ ID NO: 505739 - RNA, 14 nt, Homo sapiens
ccuaugucauuuca

SEQ ID NO: 505740 - RNA, 13 nt, Homo sapiens
ccucuccuggacu

SEQ ID NO: 505741 - RNA, 17 nt, Homo sapiens
ccugcagacucacugug

SEQ ID NO: 505742 - RNA, 17 nt, Homo sapiens
ccuggaacugucucuca

SEQ ID NO: 505743 - RNA, 23 nt, Homo sapiens
ccuucauuuccuccgucaccuca

SEQ ID NO: 505744 - RNA, 23 nt, Homo sapiens
cgacaagccuucagccacaggga

SEQ ID NO: 505745 - RNA, 15 nt, Homo sapiens
cgcguucccaaagau

SEQ ID NO: 505746 - RNA, 16 nt, Homo sapiens
cgugcaaacccaguga

SEQ ID NO: 505747 - RNA, 21 nt, Homo sapiens
cuagaggcuuccuucauuucc

SEQ ID NO: 505748 - RNA, 22 nt, Homo sapiens
cuagaggcuuccuucauuuccu

SEQ ID NO: 505749 - RNA, 16 nt, Homo sapiens
ucaaauaauaaaucua

SEQ ID NO: 505750 - RNA, 13 nt, Homo sapiens
ucaaggauaggcu

SEQ ID NO: 505751 - RNA, 22 nt, Homo sapiens
ucagagcuuucaaggauaggcu

SEQ ID NO: 505752 - RNA, 13 nt, Homo sapiens
ucaugaaccucaa

SEQ ID NO: 505753 - RNA, 20 nt, Homo sapiens
ucccagcaugcugagauuac

SEQ ID NO: 505754 - RNA, 13 nt, Homo sapiens
ucccuaaguccaa

SEQ ID NO: 505755 - RNA, 16 nt, Homo sapiens
ucgcguucccaaagau

SEQ ID NO: 505756 - RNA, 17 nt, Homo sapiens
ucgugcaaacccaguga

SEQ ID NO: 505757 - RNA, 16 nt, Homo sapiens
ucuaccuggucucucc

SEQ ID NO: 505758 - RNA, 20 nt, Homo sapiens
ucuaguauuccagaccugaa

SEQ ID NO: 505759 - RNA, 21 nt, Homo sapiens
ucuaugagauagguacuauua

SEQ ID NO: 505760 - RNA, 21 nt, Homo sapiens
ucuauuaccuguuaguauuau

SEQ ID NO: 505761 - RNA, 14 nt, Homo sapiens
ucucucaugaaccu

SEQ ID NO: 505762 - RNA, 12 nt, Homo sapiens
ucugagcaccua

SEQ ID NO: 505763 - RNA, 16 nt, Homo sapiens
ucuucugagcaccuac

SEQ ID NO: 505764 - RNA, 14 nt, Homo sapiens
ucuugcuguccaau

SEQ ID NO: 505765 - RNA, 14 nt, Homo sapiens
ucuuuuaaaccauu

SEQ ID NO: 505766 - RNA, 19 nt, Homo sapiens
ugaaccauucccuagucau

SEQ ID NO: 505767 - RNA, 21 nt, Homo sapiens
ugaaccauucccuagucauuu

SEQ ID NO: 505768 - RNA, 13 nt, Homo sapiens
ugaaggcuguaca

SEQ ID NO: 505769 - RNA, 16 nt, Homo sapiens
ugagaaaagcuuugaa

SEQ ID NO: 505770 - RNA, 21 nt, Homo sapiens
ugagcucuucauguuucagga

SEQ ID NO: 505771 - RNA, 22 nt, Homo sapiens
ugaguugcacagcuaugaaggc

SEQ ID NO: 505772 - RNA, 15 nt, Homo sapiens
ugauaaggaugauaa

SEQ ID NO: 505773 - RNA, 21 nt, Homo sapiens
ugaugcagagcuuucaaggau

SEQ ID NO: 505774 - RNA, 13 nt, Homo sapiens
ugaugcuaugaaa

SEQ ID NO: 505775 - RNA, 15 nt, Homo sapiens
ugaugugaguugcac

SEQ ID NO: 505776 - RNA, 13 nt, Homo sapiens
aaaaagcaucaug

SEQ ID NO: 505777 - RNA, 20 nt, Homo sapiens
aaaagaaugaugcuaugaaa

SEQ ID NO: 505778 - RNA, 17 nt, Homo sapiens
aaaaugaauacaauuaa

SEQ ID NO: 505779 - RNA, 20 nt, Homo sapiens
aaacacggacccauagacag

SEQ ID NO: 505780 - RNA, 15 nt, Homo sapiens
aaacggacucagugg

SEQ ID NO: 505781 - RNA, 23 nt, Homo sapiens
aaacugggggauauuaugaaggg

SEQ ID NO: 505782 - RNA, 18 nt, Homo sapiens
aaagauccacccaaauau

SEQ ID NO: 505783 - RNA, 16 nt, Homo sapiens
aaauucauuuuauucu

SEQ ID NO: 505784 - RNA, 21 nt, Homo sapiens
aaauuugggggacuuacauga

SEQ ID NO: 505785 - RNA, 17 nt, Homo sapiens
aaccucaagcugcaucu

SEQ ID NO: 505786 - RNA, 12 nt, Homo sapiens
aacugucucuca

SEQ ID NO: 505787 - RNA, 17 nt, Homo sapiens
aagaaugaugcuaugaa

SEQ ID NO: 505788 - RNA, 22 nt, Homo sapiens
aagagucuuaauauauauaucc

SEQ ID NO: 505789 - RNA, 15 nt, Homo sapiens
aagcuuuguaccuuu

SEQ ID NO: 505790 - RNA, 13 nt, Homo sapiens
aaggaaauacuuu

SEQ ID NO: 505791 - RNA, 16 nt, Homo sapiens
aaggugucauacagau

SEQ ID NO: 505792 - RNA, 23 nt, Homo sapiens
aaguuucuucuuuaggcauuaaa

SEQ ID NO: 505793 - RNA, 21 nt, Homo sapiens
aauaaacggacucaguggaca

SEQ ID NO: 505794 - RNA, 19 nt, Homo sapiens
aauacaauuaaagcuguua

SEQ ID NO: 505795 - RNA, 13 nt, Homo sapiens
aaugaugcuauga

SEQ ID NO: 505796 - RNA, 22 nt, Homo sapiens
aaugcgccaauaaaccaaugaa

SEQ ID NO: 505797 - RNA, 15 nt, Homo sapiens
aauucuaugagauag

SEQ ID NO: 505798 - RNA, 15 nt, Homo sapiens
acaaugcuggguggu

SEQ ID NO: 505799 - RNA, 17 nt, Homo sapiens
acaccuaugucauuuca

SEQ ID NO: 505800 - RNA, 17 nt, Homo sapiens
acagagauguccaaacu

SEQ ID NO: 505801 - RNA, 14 nt, Homo sapiens
acagcuaugaaggc

SEQ ID NO: 505802 - RNA, 21 nt, Homo sapiens
acauacaccuaugucauuuca

SEQ ID NO: 505803 - RNA, 22 nt, Homo sapiens
acauacaccuaugucauuucau

SEQ ID NO: 505804 - RNA, 19 nt, Homo sapiens
acccagugagacagaccgc

SEQ ID NO: 505805 - RNA, 15 nt, Homo sapiens
accuacuuacaugca

SEQ ID NO: 505806 - RNA, 21 nt, Homo sapiens
accucuccccuggaacugucu

SEQ ID NO: 505807 - RNA, 18 nt, Homo sapiens
acgcagccugcagacuca

SEQ ID NO: 505808 - RNA, 16 nt, Homo sapiens
acgcucauuguagaaa

SEQ ID NO: 505809 - RNA, 20 nt, Homo sapiens
acgugcagacaggcuggcau

SEQ ID NO: 505810 - RNA, 14 nt, Homo sapiens
acucaucugucacc

SEQ ID NO: 505811 - RNA, 18 nt, Homo sapiens
acucgcguucccaaagau

SEQ ID NO: 505812 - RNA, 13 nt, Homo sapiens
acucuccuaguga

SEQ ID NO: 505813 - RNA, 14 nt, Homo sapiens
acucuccuagugac

SEQ ID NO: 505814 - RNA, 18 nt, Homo sapiens
acugcaugcacuucuuac

SEQ ID NO: 505815 - RNA, 20 nt, Homo sapiens
acugucgugcaaacccagug

SEQ ID NO: 505816 - RNA, 21 nt, Homo sapiens
acugucgugcaaacccaguga

SEQ ID NO: 505817 - RNA, 12 nt, Homo sapiens
acuuggacucuc

SEQ ID NO: 505818 - RNA, 18 nt, Homo sapiens
acuuuauguuacuacaug

SEQ ID NO: 505819 - RNA, 18 nt, Homo sapiens
agaagccuguuugguggu

SEQ ID NO: 505820 - RNA, 16 nt, Homo sapiens
agaaugaugcuaugaa

SEQ ID NO: 505821 - RNA, 13 nt, Homo sapiens
agacucacugugg

SEQ ID NO: 505822 - RNA, 17 nt, Homo sapiens
agacucacugugggaag

SEQ ID NO: 505823 - RNA, 22 nt, Homo sapiens
agagcuuucaaggauaggcuuu

SEQ ID NO: 505824 - RNA, 15 nt, Homo sapiens
agaggcuuccuucau

SEQ ID NO: 505825 - RNA, 19 nt, Homo sapiens
agaggcuuccuucauuucc

SEQ ID NO: 505826 - RNA, 18 nt, Homo sapiens
agauagguacuauuaucc

SEQ ID NO: 505827 - RNA, 15 nt, Homo sapiens
agauaucucaucucu

SEQ ID NO: 505828 - RNA, 16 nt, Homo sapiens
agcagguaggaggcaa

SEQ ID NO: 505829 - RNA, 16 nt, Homo sapiens
agccugcagacucacu

SEQ ID NO: 505830 - RNA, 20 nt, Homo sapiens
agccugcagacucacugugg

SEQ ID NO: 505831 - RNA, 15 nt, Homo sapiens
aggauaggcuuuauu

SEQ ID NO: 505832 - RNA, 17 nt, Homo sapiens
aggaugacaugugccau

SEQ ID NO: 505833 - RNA, 20 nt, Homo sapiens
aggccgggcacgguggcuca

SEQ ID NO: 505834 - RNA, 22 nt, Homo sapiens
agggagccacacagagaugucc

SEQ ID NO: 505835 - RNA, 17 nt, Homo sapiens
aguaacucaucugucac

SEQ ID NO: 505836 - RNA, 14 nt, Homo sapiens
aguccaacuacuaa

SEQ ID NO: 505837 - RNA, 14 nt, Homo sapiens
agucuuaauauaua

SEQ ID NO: 505838 - RNA, 16 nt, Homo sapiens
agugaaaaacuauuaa

SEQ ID NO: 505839 - RNA, 22 nt, Homo sapiens
agugacuggggaugggacaaga

SEQ ID NO: 505840 - RNA, 19 nt, Homo sapiens
aguuucuucuuuaggcauu

SEQ ID NO: 505841 - RNA, 14 nt, Homo sapiens
auaaaccaaugaac

SEQ ID NO: 505842 - RNA, 17 nt, Homo sapiens
auaaacggacucagugg

SEQ ID NO: 505843 - RNA, 17 nt, Homo sapiens
auaaaucuauucugcua

SEQ ID NO: 505844 - RNA, 23 nt, Homo sapiens
auaauuuucuaccuggucucucc

SEQ ID NO: 505845 - RNA, 14 nt, Homo sapiens
auacaccuauguca

SEQ ID NO: 505846 - RNA, 20 nt, Homo sapiens
aucaaacacggacccauaga

SEQ ID NO: 505847 - RNA, 21 nt, Homo sapiens
aucccagcaugcugagauuac

SEQ ID NO: 505848 - RNA, 18 nt, Homo sapiens
aucuagaggcuuccuuca

SEQ ID NO: 505849 - RNA, 19 nt, Homo sapiens
aucugagaaaagcuuugaa

SEQ ID NO: 505850 - RNA, 15 nt, Homo sapiens
augauaaaagcacuu

SEQ ID NO: 505851 - RNA, 17 nt, Homo sapiens
augauaaaagcacuuac

SEQ ID NO: 505852 - RNA, 19 nt, Homo sapiens
augcgccaauaaaccaaug

SEQ ID NO: 505853 - RNA, 20 nt, Homo sapiens
augcgccaauaaaccaauga

SEQ ID NO: 505854 - RNA, 16 nt, Homo sapiens
augcuacucuaguauu

SEQ ID NO: 505855 - RNA, 16 nt, Homo sapiens
auguaucuaugcauuu

SEQ ID NO: 505856 - RNA, 16 nt, Homo sapiens
auguuacuacaugcac

SEQ ID NO: 505857 - RNA, 18 nt, Homo sapiens
auguuacuacaugcacuu

SEQ ID NO: 505858 - RNA, 13 nt, Homo sapiens
auuacugcaugca

SEQ ID NO: 505859 - RNA, 15 nt, Homo sapiens
auuacugcaugcacu

SEQ ID NO: 505860 - RNA, 18 nt, Homo sapiens
auuacugcaugcacuucu

SEQ ID NO: 505861 - RNA, 15 nt, Homo sapiens
auucugcuaagagau

SEQ ID NO: 505862 - RNA, 14 nt, Homo sapiens
auuuaugagcucuu

SEQ ID NO: 505863 - RNA, 16 nt, Homo sapiens
auuuccaaacuugaaa

SEQ ID NO: 505864 - RNA, 19 nt, Homo sapiens
auuuccuccgucaccucag

SEQ ID NO: 505865 - RNA, 19 nt, Homo sapiens
caaacacggacccauagac

SEQ ID NO: 505866 - RNA, 15 nt, Homo sapiens
caaacccagugagac

SEQ ID NO: 505867 - RNA, 16 nt, Homo sapiens
caaacccagugagaca

SEQ ID NO: 505868 - RNA, 23 nt, Homo sapiens
caaacugucgugcaaacccagug

SEQ ID NO: 505869 - RNA, 18 nt, Homo sapiens
caacuuuuccuuugaauc

SEQ ID NO: 505870 - RNA, 17 nt, Homo sapiens
caaggauaggcuuuauu

SEQ ID NO: 505871 - RNA, 13 nt, Homo sapiens
caaguuuacuuuu

SEQ ID NO: 505872 - RNA, 14 nt, Homo sapiens
caauaaaccaauga

SEQ ID NO: 505873 - RNA, 13 nt, Homo sapiens
caaucaaauaaua

SEQ ID NO: 505874 - RNA, 23 nt, Homo sapiens
caaucaaauaauaaaucuauucu

SEQ ID NO: 505875 - RNA, 19 nt, Homo sapiens
cacauguaucuaugcauuu

SEQ ID NO: 505876 - RNA, 18 nt, Homo sapiens
caccuacuuacaugcauu

SEQ ID NO: 505877 - RNA, 17 nt, Homo sapiens
caccuaugucauuucau

SEQ ID NO: 505878 - RNA, 15 nt, Homo sapiens
cagacucacuguggg

SEQ ID NO: 505879 - RNA, 20 nt, Homo sapiens
cagagacauacaccuauguc

SEQ ID NO: 505880 - RNA, 14 nt, Homo sapiens
cagagugcuuuaaa

SEQ ID NO: 505881 - RNA, 21 nt, Homo sapiens
cagaugguugcaauugauccu

SEQ ID NO: 505882 - RNA, 21 nt, Homo sapiens
cagccugcagacucacugugg

SEQ ID NO: 505883 - RNA, 14 nt, Homo sapiens
caggauaccauaua

SEQ ID NO: 505884 - RNA, 17 nt, Homo sapiens
cagggagccacacagag

SEQ ID NO: 505885 - RNA, 17 nt, Homo sapiens
caguaacucaucuguca

SEQ ID NO: 505886 - RNA, 20 nt, Homo sapiens
cauacaccuaugucauuuca

SEQ ID NO: 505887 - RNA, 15 nt, Homo sapiens
cauacagauuugcaa

SEQ ID NO: 505888 - RNA, 20 nt, Homo sapiens
caugaaccucaagcugcauc

SEQ ID NO: 505889 - RNA, 21 nt, Homo sapiens
caugaaggugucauacagauu

SEQ ID NO: 505890 - RNA, 23 nt, Homo sapiens
caugaugcagagcuuucaaggau

SEQ ID NO: 505891 - RNA, 18 nt, Homo sapiens
caugcauuacugcaugca

SEQ ID NO: 505892 - RNA, 14 nt, Homo sapiens
cauuaaaaaugcau

SEQ ID NO: 505893 - RNA, 15 nt, Homo sapiens
cauuacugcaugcac

SEQ ID NO: 505894 - RNA, 17 nt, Homo sapiens
cauuacugcaugcacuu

SEQ ID NO: 505895 - RNA, 18 nt, Homo sapiens
cauuguagaaaagcuaua

SEQ ID NO: 505896 - RNA, 23 nt, Homo sapiens
cauuuccuccgucaccucagaga

SEQ ID NO: 505897 - RNA, 19 nt, Homo sapiens
ccaaauaucaaacacggac

SEQ ID NO: 505898 - RNA, 14 nt, Homo sapiens
ccaauaaaccaaug

SEQ ID NO: 505899 - RNA, 14 nt, Homo sapiens
ccaaugaacgaagc

SEQ ID NO: 505900 - RNA, 10 nt, Homo sapiens
ccaucugauu

SEQ ID NO: 505901 - RNA, 15 nt, Homo sapiens
ccuacugcaaauggc

SEQ ID NO: 505902 - RNA, 16 nt, Homo sapiens
ccuauuuuuggaagag

SEQ ID NO: 505903 - RNA, 16 nt, Homo sapiens
ccugacgaacuccuug

SEQ ID NO: 505904 - RNA, 18 nt, Homo sapiens
ccuuguucugauaaugaa

SEQ ID NO: 505905 - RNA, 20 nt, Homo sapiens
ccuuuguucccuaaguccaa

SEQ ID NO: 505906 - RNA, 12 nt, Homo sapiens
cggacucagugg

SEQ ID NO: 505907 - RNA, 16 nt, Homo sapiens
cuacuuacaugcauua

SEQ ID NO: 505908 - RNA, 12 nt, Homo sapiens
cuagagacucaa

SEQ ID NO: 505909 - RNA, 13 nt, Homo sapiens
cuagauuacuuuu

SEQ ID NO: 505910 - RNA, 13 nt, Homo sapiens
cuagucauaaccu

SEQ ID NO: 505911 - RNA, 14 nt, Homo sapiens
cuauaaaaugaaua

SEQ ID NO: 505912 - RNA, 18 nt, Homo sapiens
cuaugucauuucauuucc

SEQ ID NO: 505913 - RNA, 13 nt, Homo sapiens
cgggccagggugg

SEQ ID NO: 505914 - RNA, 20 nt, Homo sapiens
cgggcuuggggcuggccaau

SEQ ID NO: 505915 - RNA, 22 nt, Homo sapiens
cgguguuuggaggcugcugccc

SEQ ID NO: 505916 - RNA, 13 nt, Homo sapiens
cgugcccccagcg

SEQ ID NO: 505917 - RNA, 15 nt, Homo sapiens
cgugccguggagcuu

SEQ ID NO: 505918 - RNA, 15 nt, Homo sapiens
cgugggauccagaga

SEQ ID NO: 505919 - RNA, 22 nt, Homo sapiens
cgugguguccucuguccgucug

SEQ ID NO: 505920 - RNA, 16 nt, Homo sapiens
cuaaaagugaugugau

SEQ ID NO: 505921 - RNA, 17 nt, Homo sapiens
cuaaagcuaaacaaaac

SEQ ID NO: 505922 - RNA, 16 nt, Homo sapiens
cuaaauauuaugccuu

SEQ ID NO: 505923 - RNA, 21 nt, Homo sapiens
cuaaccuggguuguugcagag

SEQ ID NO: 505924 - RNA, 21 nt, Homo sapiens
cuaagaaauggcuuuccacau

SEQ ID NO: 505925 - RNA, 22 nt, Homo sapiens
cuaagaaucauccucaugccuu

SEQ ID NO: 505926 - RNA, 21 nt, Homo sapiens
cuaagauaauuaaaugaaaua

SEQ ID NO: 505927 - RNA, 17 nt, Homo sapiens
cuaaggagcacuagaau

SEQ ID NO: 505928 - RNA, 22 nt, Homo sapiens
cuaauuaaaaaguuaaucuuca

SEQ ID NO: 505929 - RNA, 19 nt, Homo sapiens
cuacaauacaacacauuga

SEQ ID NO: 505930 - RNA, 15 nt, Homo sapiens
cuacaggugccccac

SEQ ID NO: 505931 - RNA, 18 nt, Homo sapiens
cuacaugggccagcccuu

SEQ ID NO: 505932 - RNA, 15 nt, Homo sapiens
cuaccaagcugugac

SEQ ID NO: 505933 - RNA, 13 nt, Homo sapiens
cuaccacauucac

SEQ ID NO: 505934 - RNA, 14 nt, Homo sapiens
cuaccacauucacu

SEQ ID NO: 505935 - RNA, 18 nt, Homo sapiens
caucugucugucccaguu

SEQ ID NO: 505936 - RNA, 22 nt, Homo sapiens
caucuuguaaauaaugcuuaac

SEQ ID NO: 505937 - RNA, 15 nt, Homo sapiens
caugaaaaguuuuca

SEQ ID NO: 505938 - RNA, 16 nt, Homo sapiens
caugaaaaguuuucaa

SEQ ID NO: 505939 - RNA, 17 nt, Homo sapiens
caugaagauaaauccaa

SEQ ID NO: 505940 - RNA, 16 nt, Homo sapiens
caugacccagccugaa

SEQ ID NO: 505941 - RNA, 18 nt, Homo sapiens
caugacccguacacacca

SEQ ID NO: 505942 - RNA, 18 nt, Homo sapiens
caugcagacccucagacc

SEQ ID NO: 505943 - RNA, 15 nt, Homo sapiens
caugcgcagucccca

SEQ ID NO: 505944 - RNA, 17 nt, Homo sapiens
cauggaguagagucagg

SEQ ID NO: 505945 - RNA, 23 nt, Homo sapiens
caugggccagcccuugcucuacc

SEQ ID NO: 505946 - RNA, 16 nt, Homo sapiens
caugguagacugugac

SEQ ID NO: 505947 - RNA, 13 nt, Homo sapiens
caugguaucucuu

SEQ ID NO: 505948 - RNA, 15 nt, Homo sapiens
cauggugcagugaag

SEQ ID NO: 505949 - RNA, 13 nt, Homo sapiens
cauguucauucag

SEQ ID NO: 505950 - RNA, 22 nt, Homo sapiens
cauguuuaauaauauguacaaa

SEQ ID NO: 505951 - RNA, 23 nt, Homo sapiens
cauuaaacuaauuaaacugaugg

SEQ ID NO: 505952 - RNA, 15 nt, Homo sapiens
cauuauuucuaccau

SEQ ID NO: 505953 - RNA, 17 nt, Homo sapiens
cauuauuucuaccauua

SEQ ID NO: 505954 - RNA, 15 nt, Homo sapiens
cauucaaaaagccaa

SEQ ID NO: 505955 - RNA, 13 nt, Homo sapiens
cauucacuacugc

SEQ ID NO: 505956 - RNA, 13 nt, Homo sapiens
cauucagugacau

SEQ ID NO: 505957 - RNA, 15 nt, Homo sapiens
cauucagugacaugu

SEQ ID NO: 505958 - RNA, 23 nt, Homo sapiens
cauucauugcagcaguagccuua

SEQ ID NO: 505959 - RNA, 22 nt, Homo sapiens
cauucguccuuagaauacugua

SEQ ID NO: 505960 - RNA, 17 nt, Homo sapiens
cauucuuugugguuaaa

SEQ ID NO: 505961 - RNA, 13 nt, Homo sapiens
cauugacccucac

SEQ ID NO: 505962 - RNA, 21 nt, Homo sapiens
cauugcuucauuaaaacaaga

SEQ ID NO: 505963 - RNA, 14 nt, Homo sapiens
cauugguaucugau

SEQ ID NO: 505964 - RNA, 13 nt, Homo sapiens
cauuuauguacaa

SEQ ID NO: 505965 - RNA, 18 nt, Homo sapiens
cauuuauguacaaaauga

SEQ ID NO: 505966 - RNA, 16 nt, Homo sapiens
cauuuauuugacauag

SEQ ID NO: 505967 - RNA, 14 nt, Homo sapiens
cauuucagcuguga

SEQ ID NO: 505968 - RNA, 16 nt, Homo sapiens
cauuuuagaagaguua

SEQ ID NO: 505969 - RNA, 13 nt, Homo sapiens
ccaaauugcugag

SEQ ID NO: 505970 - RNA, 20 nt, Homo sapiens
ccaacagcgaagccagucca

SEQ ID NO: 505971 - RNA, 16 nt, Homo sapiens
ccaacaugugaugugu

SEQ ID NO: 505972 - RNA, 15 nt, Homo sapiens
ccaagaguccaagcc

SEQ ID NO: 505973 - RNA, 17 nt, Homo sapiens
ccaagaguuugagacca

SEQ ID NO: 505974 - RNA, 14 nt, Homo sapiens
ccaagccaggguuc

SEQ ID NO: 505975 - RNA, 20 nt, Homo sapiens
ccaaggagaggucuugcuca

SEQ ID NO: 505976 - RNA, 19 nt, Homo sapiens
ccaagguauugagacauau

SEQ ID NO: 505977 - RNA, 23 nt, Homo sapiens
ccaagugaaugaguuuccagcua

SEQ ID NO: 505978 - RNA, 21 nt, Homo sapiens
ccaaguguacauuugauuuga

SEQ ID NO: 505979 - RNA, 11 nt, Homo sapiens
ccaauccagcc

SEQ ID NO: 505980 - RNA, 17 nt, Homo sapiens
ccacaggagcauguccu

SEQ ID NO: 505981 - RNA, 16 nt, Homo sapiens
ccacaggagcguguac

SEQ ID NO: 505982 - RNA, 16 nt, Homo sapiens
ccacauaaacacuucu

SEQ ID NO: 505983 - RNA, 12 nt, Homo sapiens
ccacccaugcca

SEQ ID NO: 505984 - RNA, 12 nt, Homo sapiens
ccacccuaucau

SEQ ID NO: 505985 - RNA, 14 nt, Homo sapiens
ccacgacauggcug

SEQ ID NO: 505986 - RNA, 21 nt, Homo sapiens
ccacgaggagcuuccagugca

SEQ ID NO: 505987 - RNA, 19 nt, Homo sapiens
ccacgcagagccccggagc

SEQ ID NO: 505988 - RNA, 15 nt, Homo sapiens
ccacgcucaaucuca

SEQ ID NO: 505989 - RNA, 16 nt, Homo sapiens
ccacgcucaaucucag

SEQ ID NO: 505990 - RNA, 22 nt, Homo sapiens
ccacgguguggggggugcccca

SEQ ID NO: 505991 - RNA, 13 nt, Homo sapiens
ccacuccacaguu

SEQ ID NO: 505992 - RNA, 13 nt, Homo sapiens
ccacuucacaguu

SEQ ID NO: 505993 - RNA, 17 nt, Homo sapiens
ccacuucgggagaagaa

SEQ ID NO: 505994 - RNA, 17 nt, Homo sapiens
ccagagccacuaccuuu

SEQ ID NO: 505995 - RNA, 12 nt, Homo sapiens
ccagaggggugc

SEQ ID NO: 505996 - RNA, 15 nt, Homo sapiens
ccagaggggugcgca

SEQ ID NO: 505997 - RNA, 23 nt, Homo sapiens
ccagaggggugcgcagagcugac

SEQ ID NO: 505998 - RNA, 12 nt, Homo sapiens
ccagaguuauuu

SEQ ID NO: 505999 - RNA, 22 nt, Homo sapiens
ccagcagacauugucagcaaau

SEQ ID NO: 506000 - RNA, 21 nt, Homo sapiens
ccagcagguagugggugaaug

SEQ ID NO: 506001 - RNA, 14 nt, Homo sapiens
ccagccugccaggc

SEQ ID NO: 506002 - RNA, 16 nt, Homo sapiens
ccagcgcagcgccagg

SEQ ID NO: 506003 - RNA, 16 nt, Homo sapiens
ccagcggggcuucugg

SEQ ID NO: 506004 - RNA, 20 nt, Homo sapiens
ccagcucaggcuacugccac

SEQ ID NO: 506005 - RNA, 19 nt, Homo sapiens
ccagcugcaggaaucaaaa

SEQ ID NO: 506006 - RNA, 13 nt, Homo sapiens
ccaggacacugcc

SEQ ID NO: 506007 - RNA, 12 nt, Homo sapiens
ccaggaugcaug

SEQ ID NO: 506008 - RNA, 16 nt, Homo sapiens
ccaggcagcugcaguu

SEQ ID NO: 506009 - RNA, 14 nt, Homo sapiens
ccaggccucaggga

SEQ ID NO: 506010 - RNA, 15 nt, Homo sapiens
ccaggguuccagaca

SEQ ID NO: 506011 - RNA, 20 nt, Homo sapiens
ccaguguuuagaagagccug

SEQ ID NO: 506012 - RNA, 12 nt, Homo sapiens
ccaguuaacugu

SEQ ID NO: 506013 - RNA, 11 nt, Homo sapiens
ccaucaagaaa

SEQ ID NO: 506014 - RNA, 20 nt, Homo sapiens
ccaugcaggcagccugcaga

SEQ ID NO: 506015 - RNA, 16 nt, Homo sapiens
ccaugcccucccugcu

SEQ ID NO: 506016 - RNA, 18 nt, Homo sapiens
ccaugcccucccugcugc

SEQ ID NO: 506017 - RNA, 20 nt, Homo sapiens
ccaugcccucccugcugcca

SEQ ID NO: 506018 - RNA, 19 nt, Homo sapiens
ccaugcucagcucagcauu

SEQ ID NO: 506019 - RNA, 15 nt, Homo sapiens
ccaugcugggcucac

SEQ ID NO: 506020 - RNA, 21 nt, Homo sapiens
ccaugguagacugugacacag

SEQ ID NO: 506021 - RNA, 13 nt, Homo sapiens
ccauggugcagug

SEQ ID NO: 506022 - RNA, 20 nt, Homo sapiens
ccauuauuucuaccauuaaa

SEQ ID NO: 506023 - RNA, 13 nt, Homo sapiens
ccauucauuuaca

SEQ ID NO: 506024 - RNA, 20 nt, Homo sapiens
ccauucuuuagucauuccaa

SEQ ID NO: 506025 - RNA, 14 nt, Homo sapiens
cccaaagugcacug

SEQ ID NO: 506026 - RNA, 17 nt, Homo sapiens
cccaaaucucaaaagau

SEQ ID NO: 506027 - RNA, 14 nt, Homo sapiens
cccacaacuugcca

SEQ ID NO: 506028 - RNA, 16 nt, Homo sapiens
cccacaaguauugccc

SEQ ID NO: 506029 - RNA, 13 nt, Homo sapiens
cccacacugugaa

SEQ ID NO: 506030 - RNA, 20 nt, Homo sapiens
cccacaggagcauguccuau

SEQ ID NO: 506031 - RNA, 23 nt, Homo sapiens
cccaccucccgguguaugcagug

SEQ ID NO: 506032 - RNA, 20 nt, Homo sapiens
cccacgugugcagacugugg

SEQ ID NO: 506033 - RNA, 18 nt, Homo sapiens
cccagagcccugcaguca

SEQ ID NO: 506034 - RNA, 20 nt, Homo sapiens
cccagagcuuuacagugcca

SEQ ID NO: 506035 - RNA, 15 nt, Homo sapiens
cccagcagacuugag

SEQ ID NO: 506036 - RNA, 15 nt, Homo sapiens
cccagccugaaagau

SEQ ID NO: 506037 - RNA, 16 nt, Homo sapiens
cccagcucuggaugaa

SEQ ID NO: 506038 - RNA, 12 nt, Homo sapiens
cccaggaugcau

SEQ ID NO: 506039 - RNA, 13 nt, Homo sapiens
cccaggaugcaug

SEQ ID NO: 506040 - RNA, 15 nt, Homo sapiens
cccagggaaugccag

SEQ ID NO: 506041 - RNA, 19 nt, Homo sapiens
cccaggggcacuguguucu

SEQ ID NO: 506042 - RNA, 12 nt, Homo sapiens
cccaguggugcg

SEQ ID NO: 506043 - RNA, 18 nt, Homo sapiens
ccccacuggagcguguac

SEQ ID NO: 506044 - RNA, 20 nt, Homo sapiens
ccccagagcuuuacagugcc

SEQ ID NO: 506045 - RNA, 16 nt, Homo sapiens
ccccagcugauuagug

SEQ ID NO: 506046 - RNA, 20 nt, Homo sapiens
cccccacaggagcguguccu

SEQ ID NO: 506047 - RNA, 15 nt, Homo sapiens
cccccauuuuuguaa

SEQ ID NO: 506048 - RNA, 18 nt, Homo sapiens
ccccugguccugcacugu

SEQ ID NO: 506049 - RNA, 13 nt, Homo sapiens
cccgccccagaga

SEQ ID NO: 506050 - RNA, 15 nt, Homo sapiens
cccggccccaucaga

SEQ ID NO: 506051 - RNA, 21 nt, Homo sapiens
cccuaaaauacuuauuaugua

SEQ ID NO: 506052 - RNA, 15 nt, Homo sapiens
cccuaucucccacaa

SEQ ID NO: 506053 - RNA, 14 nt, Homo sapiens
agaaaaaacuggaa

SEQ ID NO: 506054 - RNA, 15 nt, Homo sapiens
agaaaaaagugcaac

SEQ ID NO: 506055 - RNA, 14 nt, Homo sapiens
agaaaaagguuuaa

SEQ ID NO: 506056 - RNA, 21 nt, Homo sapiens
agaaaacauuguuccagauuc

SEQ ID NO: 506057 - RNA, 13 nt, Homo sapiens
agaaaaugcaauu

SEQ ID NO: 506058 - RNA, 20 nt, Homo sapiens
agaaacccccucauggaucu

SEQ ID NO: 506059 - RNA, 24 nt, Homo sapiens
agaaacuuuggaaguuuuacuuga

SEQ ID NO: 506060 - RNA, 15 nt, Homo sapiens
agaaaucuaaucucu

SEQ ID NO: 506061 - RNA, 16 nt, Homo sapiens
agaaauuuuaucucuu

SEQ ID NO: 506062 - RNA, 21 nt, Homo sapiens
agaaauuuuuuuccagaauug

SEQ ID NO: 506063 - RNA, 21 nt, Homo sapiens
agaacauggaaauaaccauug

SEQ ID NO: 506064 - RNA, 15 nt, Homo sapiens
agaacuacagcuuuu

SEQ ID NO: 506065 - RNA, 21 nt, Homo sapiens
agaacuucguacccuuugcac

SEQ ID NO: 506066 - RNA, 21 nt, Homo sapiens
agaacuuucuaggcugagucu

SEQ ID NO: 506067 - RNA, 14 nt, Homo sapiens
agaagaaacuaccc

SEQ ID NO: 506068 - RNA, 18 nt, Homo sapiens
agaagagaguauggugcu

SEQ ID NO: 506069 - RNA, 13 nt, Homo sapiens
agaaggcaaccca

SEQ ID NO: 506070 - RNA, 17 nt, Homo sapiens
agaauaaaaugcaguga

SEQ ID NO: 506071 - RNA, 19 nt, Homo sapiens
agaauaaaaugcagugaaa

SEQ ID NO: 506072 - RNA, 12 nt, Homo sapiens
agaauacuguau

SEQ ID NO: 506073 - RNA, 14 nt, Homo sapiens
agaaucaacaguga

SEQ ID NO: 506074 - RNA, 21 nt, Homo sapiens
agaaucaccuaauuaauuuca

SEQ ID NO: 506075 - RNA, 11 nt, Homo sapiens
agaaugcagua

SEQ ID NO: 506076 - RNA, 16 nt, Homo sapiens
agaauggugggcucca

SEQ ID NO: 506077 - RNA, 22 nt, Homo sapiens
agacaaggugcaccgguuucau

SEQ ID NO: 506078 - RNA, 20 nt, Homo sapiens
agacacacacauauauacau

SEQ ID NO: 506079 - RNA, 14 nt, Homo sapiens
agacacgaaauugg

SEQ ID NO: 506080 - RNA, 14 nt, Homo sapiens
agacacuauguagu

SEQ ID NO: 506081 - RNA, 14 nt, Homo sapiens
agacaguaaagacc

SEQ ID NO: 506082 - RNA, 13 nt, Homo sapiens
agacagugcagug

SEQ ID NO: 506083 - RNA, 23 nt, Homo sapiens
agacaugaaauugagucauuuua

SEQ ID NO: 506084 - RNA, 13 nt, Homo sapiens
agacauugucagc

SEQ ID NO: 506085 - RNA, 17 nt, Homo sapiens
agaccagccugccaggc

SEQ ID NO: 506086 - RNA, 16 nt, Homo sapiens
agaccagggaacggaa

SEQ ID NO: 506087 - RNA, 20 nt, Homo sapiens
agaccccuacccuuucccaa

SEQ ID NO: 506088 - RNA, 21 nt, Homo sapiens
agaccccuacccuuucccaaa

SEQ ID NO: 506089 - RNA, 12 nt, Homo sapiens
agacccucagac

SEQ ID NO: 506090 - RNA, 18 nt, Homo sapiens
agacuaacuuauuuugau

SEQ ID NO: 506091 - RNA, 15 nt, Homo sapiens
agacuguuagacaaa

SEQ ID NO: 506092 - RNA, 21 nt, Homo sapiens
agagaccuugcgaccaugugu

SEQ ID NO: 506093 - RNA, 23 nt, Homo sapiens
agagaccuugcgaccauguguag

SEQ ID NO: 506094 - RNA, 16 nt, Homo sapiens
agagagauauaucuga

SEQ ID NO: 506095 - RNA, 17 nt, Homo sapiens
agagagauauaucugaa

SEQ ID NO: 506096 - RNA, 15 nt, Homo sapiens
agagagcggcuuccc

SEQ ID NO: 506097 - RNA, 14 nt, Homo sapiens
agagaguggaagaa

SEQ ID NO: 506098 - RNA, 13 nt, Homo sapiens
agagauacccucu

SEQ ID NO: 506099 - RNA, 21 nt, Homo sapiens
agagcauucugggguggggcu

SEQ ID NO: 506100 - RNA, 23 nt, Homo sapiens
agagccaagcuaaugugguagug

SEQ ID NO: 506101 - RNA, 14 nt, Homo sapiens
agagccacuaccuu

SEQ ID NO: 506102 - RNA, 20 nt, Homo sapiens
agagccuauggaaagggugu

SEQ ID NO: 506103 - RNA, 18 nt, Homo sapiens
agagccuauuuuggugag

SEQ ID NO: 506104 - RNA, 15 nt, Homo sapiens
agaggacagcuuccc

SEQ ID NO: 506105 - RNA, 17 nt, Homo sapiens
agaggacaguuuaggac

SEQ ID NO: 506106 - RNA, 19 nt, Homo sapiens
agaggagcguguccuaucc

SEQ ID NO: 506107 - RNA, 20 nt, Homo sapiens
agaggagcguguccuauccc

SEQ ID NO: 506108 - RNA, 20 nt, Homo sapiens
agagguggaacuuaauuacc

SEQ ID NO: 506109 - RNA, 12 nt, Homo sapiens
agagucaucuca

SEQ ID NO: 506110 - RNA, 21 nt, Homo sapiens
agaguucuccuuguacuugaa

SEQ ID NO: 506111 - RNA, 19 nt, Homo sapiens
agaucaggagaaacucggg

SEQ ID NO: 506112 - RNA, 15 nt, Homo sapiens
agauccugucuugcu

SEQ ID NO: 506113 - RNA, 21 nt, Homo sapiens
agauccugucuugcugaggga

SEQ ID NO: 506114 - RNA, 19 nt, Homo sapiens
agaugacccccagguauug

SEQ ID NO: 506115 - RNA, 13 nt, Homo sapiens
agaugagauuccc

SEQ ID NO: 506116 - RNA, 13 nt, Homo sapiens
agaugcacugaag

SEQ ID NO: 506117 - RNA, 15 nt, Homo sapiens
agauggauuugacac

SEQ ID NO: 506118 - RNA, 18 nt, Homo sapiens
agaugggaggaucacuug

SEQ ID NO: 506119 - RNA, 21 nt, Homo sapiens
agaugggaggaucacuugagg

SEQ ID NO: 506120 - RNA, 17 nt, Homo sapiens
agauguaauacaccaaa

SEQ ID NO: 506121 - RNA, 20 nt, Homo sapiens
agauugaagcuaaaacacuu

SEQ ID NO: 506122 - RNA, 17 nt, Homo sapiens
agauuuuaaaacuucau

SEQ ID NO: 506123 - RNA, 20 nt, Homo sapiens
agcaauaauugacaaacuuu

SEQ ID NO: 506124 - RNA, 15 nt, Homo sapiens
agcacagcuuuccug

SEQ ID NO: 506125 - RNA, 14 nt, Homo sapiens
agcacaguauuuaa

SEQ ID NO: 506126 - RNA, 19 nt, Homo sapiens
agcacaugucucauuuuaa

SEQ ID NO: 506127 - RNA, 21 nt, Homo sapiens
agcacccaaacacauggcacu

SEQ ID NO: 506128 - RNA, 16 nt, Homo sapiens
agcacuagaaugagaa

SEQ ID NO: 506129 - RNA, 13 nt, Homo sapiens
agcagaaagccag

SEQ ID NO: 506130 - RNA, 13 nt, Homo sapiens
agcagaacccaga

SEQ ID NO: 506131 - RNA, 14 nt, Homo sapiens
agcagaacccagac

SEQ ID NO: 506132 - RNA, 21 nt, Homo sapiens
agcagaggaaaauaguggcag

SEQ ID NO: 506133 - RNA, 12 nt, Homo sapiens
agcagagucaag

SEQ ID NO: 506134 - RNA, 16 nt, Homo sapiens
agcagcagcagcagca

SEQ ID NO: 506135 - RNA, 17 nt, Homo sapiens
agcauaguucugcaaua

SEQ ID NO: 506136 - RNA, 15 nt, Homo sapiens
agcauauauaaucaa

SEQ ID NO: 506137 - RNA, 17 nt, Homo sapiens
agcaugaagauaaaucc

SEQ ID NO: 506138 - RNA, 20 nt, Homo sapiens
agcaugggacugugccuuug

SEQ ID NO: 506139 - RNA, 12 nt, Homo sapiens
agcauguaauau

SEQ ID NO: 506140 - RNA, 16 nt, Homo sapiens
agcauguacaguguuc

SEQ ID NO: 506141 - RNA, 23 nt, Homo sapiens
agcauuuaggaaagcagugcagu

SEQ ID NO: 506142 - RNA, 17 nt, Homo sapiens
agccacaauaagccacu

SEQ ID NO: 506143 - RNA, 19 nt, Homo sapiens
agccacuuauuuccaugga

SEQ ID NO: 506144 - RNA, 18 nt, Homo sapiens
agccagggcagaggaaug

SEQ ID NO: 506145 - RNA, 20 nt, Homo sapiens
agccaggguccugaguggcu

SEQ ID NO: 506146 - RNA, 12 nt, Homo sapiens
agccaguggcac

SEQ ID NO: 506147 - RNA, 22 nt, Homo sapiens
agcccacccgccccagagacug

SEQ ID NO: 506148 - RNA, 13 nt, Homo sapiens
agccccaugccau

SEQ ID NO: 506149 - RNA, 14 nt, Homo sapiens
agccccucagagaa

SEQ ID NO: 506150 - RNA, 21 nt, Homo sapiens
aguugagccagcagacauugu

SEQ ID NO: 506151 - RNA, 19 nt, Homo sapiens
aguugaugaaauaucaaga

SEQ ID NO: 506152 - RNA, 20 nt, Homo sapiens
aguugccguggcaacugugg

SEQ ID NO: 506153 - RNA, 23 nt, Homo sapiens
aguugugaucuguuguaauauca

SEQ ID NO: 506154 - RNA, 20 nt, Homo sapiens
aguuuaaaaaucaguuuguu

SEQ ID NO: 506155 - RNA, 21 nt, Homo sapiens
auaaaacaaaccagcaacuuu

SEQ ID NO: 506156 - RNA, 17 nt, Homo sapiens
auaaaauugaugugcau

SEQ ID NO: 506157 - RNA, 16 nt, Homo sapiens
auaaacugugagauaa

SEQ ID NO: 506158 - RNA, 23 nt, Homo sapiens
auaaagccuugugaucacuuucu

SEQ ID NO: 506159 - RNA, 22 nt, Homo sapiens
auaaauuauuuuugaggacugu

SEQ ID NO: 506160 - RNA, 15 nt, Homo sapiens
auaacaggcauugca

SEQ ID NO: 506161 - RNA, 14 nt, Homo sapiens
auaaccgcacagac

SEQ ID NO: 506162 - RNA, 18 nt, Homo sapiens
auaagaugcugcugagca

SEQ ID NO: 506163 - RNA, 19 nt, Homo sapiens
auaagccaauuuuucugca

SEQ ID NO: 506164 - RNA, 23 nt, Homo sapiens
auaaggccucauccuccacugaa

SEQ ID NO: 506165 - RNA, 15 nt, Homo sapiens
auaaguguguuugca

SEQ ID NO: 506166 - RNA, 16 nt, Homo sapiens
auaauauugccuugau

SEQ ID NO: 506167 - RNA, 19 nt, Homo sapiens
auggccaggccucagggac

SEQ ID NO: 506168 - RNA, 21 nt, Homo sapiens
augggccagcccuugcucuac

SEQ ID NO: 506169 - RNA, 16 nt, Homo sapiens
auggucacagagagac

SEQ ID NO: 506170 - RNA, 15 nt, Homo sapiens
auggugaacugucau

SEQ ID NO: 506171 - RNA, 18 nt, Homo sapiens
auggugcuggguccuuaa

SEQ ID NO: 506172 - RNA, 18 nt, Homo sapiens
auguaacuucagauguuu

SEQ ID NO: 506173 - RNA, 19 nt, Homo sapiens
auguaacuucagauguuuc

SEQ ID NO: 506174 - RNA, 20 nt, Homo sapiens
auguaccguugauguugaua

SEQ ID NO: 506175 - RNA, 13 nt, Homo sapiens
auguauacuucaa

SEQ ID NO: 506176 - RNA, 14 nt, Homo sapiens
auguauauuuacca

SEQ ID NO: 506177 - RNA, 15 nt, Homo sapiens
auguauguccauuca

SEQ ID NO: 506178 - RNA, 20 nt, Homo sapiens
auguauuggauacgcuccag

SEQ ID NO: 506179 - RNA, 19 nt, Homo sapiens
auguauugugucuuuugca

SEQ ID NO: 506180 - RNA, 21 nt, Homo sapiens
augugaacuuucucagcauau

SEQ ID NO: 506181 - RNA, 19 nt, Homo sapiens
augugccgucuuugguucc

SEQ ID NO: 506182 - RNA, 17 nt, Homo sapiens
augugcucuacaucucg

SEQ ID NO: 506183 - RNA, 21 nt, Homo sapiens
augugcuguugauucuuucaa

SEQ ID NO: 506184 - RNA, 18 nt, Homo sapiens
auguggugggagcacagc

SEQ ID NO: 506185 - RNA, 17 nt, Homo sapiens
auguguauggaagacaa

SEQ ID NO: 506186 - RNA, 15 nt, Homo sapiens
auguuagauacacaa

SEQ ID NO: 506187 - RNA, 19 nt, Homo sapiens
auguugauguguccgugaa

SEQ ID NO: 506188 - RNA, 18 nt, Homo sapiens
auguuuaagaaaugagaa

SEQ ID NO: 506189 - RNA, 18 nt, Homo sapiens
auguuuuuuauacuucaa

SEQ ID NO: 506190 - RNA, 21 nt, Homo sapiens
auuacaaaaucuuaaccuuca

SEQ ID NO: 506191 - RNA, 13 nt, Homo sapiens
auuagcugugauu

SEQ ID NO: 506192 - RNA, 17 nt, Homo sapiens
auuagcuuacugauuaa

SEQ ID NO: 506193 - RNA, 20 nt, Homo sapiens
auuaucuaguaggucugcac

SEQ ID NO: 506194 - RNA, 18 nt, Homo sapiens
auuauuacaacaagcaaa

SEQ ID NO: 506195 - RNA, 18 nt, Homo sapiens
auuauuucuaccauuaaa

SEQ ID NO: 506196 - RNA, 13 nt, Homo sapiens
auucaaaaagcca

SEQ ID NO: 506197 - RNA, 22 nt, Homo sapiens
auucaaauccauaagcagguua

SEQ ID NO: 506198 - RNA, 14 nt, Homo sapiens
auucaaggcauuau

SEQ ID NO: 506199 - RNA, 15 nt, Homo sapiens
auucaaucauuuugg

SEQ ID NO: 506200 - RNA, 19 nt, Homo sapiens
auucaguaaggcagugaag

SEQ ID NO: 506201 - RNA, 17 nt, Homo sapiens
auucauuuauuugacau

SEQ ID NO: 506202 - RNA, 22 nt, Homo sapiens
auuccaaucauuguuaaaguaa

SEQ ID NO: 506203 - RNA, 16 nt, Homo sapiens
auuccagggaaccaga

SEQ ID NO: 506204 - RNA, 22 nt, Homo sapiens
auuccucugacuugccaaagaa

SEQ ID NO: 506205 - RNA, 21 nt, Homo sapiens
auucuaaaagauaaguguguu

SEQ ID NO: 506206 - RNA, 14 nt, Homo sapiens
auucuaaaggggac

SEQ ID NO: 506207 - RNA, 15 nt, Homo sapiens
auucucaguuuaaaa

SEQ ID NO: 506208 - RNA, 13 nt, Homo sapiens
auucucccuuuau

SEQ ID NO: 506209 - RNA, 14 nt, Homo sapiens
auucucccuuuauu

SEQ ID NO: 506210 - RNA, 19 nt, Homo sapiens
auucugcaggaacaugacc

SEQ ID NO: 506211 - RNA, 23 nt, Homo sapiens
auucugcuugguuccacaaucau

SEQ ID NO: 506212 - RNA, 14 nt, Homo sapiens
auucuggugucuaa

SEQ ID NO: 506213 - RNA, 15 nt, Homo sapiens
auucuuaaaucugcc

SEQ ID NO: 506214 - RNA, 22 nt, Homo sapiens
auucuuacuguucugaaauuag

SEQ ID NO: 506215 - RNA, 22 nt, Homo sapiens
auucuuucaauccacaguauug

SEQ ID NO: 506216 - RNA, 20 nt, Homo sapiens
auugacaagcacgcacacac

SEQ ID NO: 506217 - RNA, 15 nt, Homo sapiens
auugagacacuguca

SEQ ID NO: 506218 - RNA, 19 nt, Homo sapiens
auugagacacugucaagau

SEQ ID NO: 506219 - RNA, 20 nt, Homo sapiens
auugagacauauuacuggaa

SEQ ID NO: 506220 - RNA, 16 nt, Homo sapiens
auugaggaugaacuca

SEQ ID NO: 506221 - RNA, 16 nt, Homo sapiens
auugauguaacugugu

SEQ ID NO: 506222 - RNA, 18 nt, Homo sapiens
auugauuuuuaaacagca

SEQ ID NO: 506223 - RNA, 17 nt, Homo sapiens
auugcacuucggauaau

SEQ ID NO: 506224 - RNA, 22 nt, Homo sapiens
auugcacuucggauaauuuuca

SEQ ID NO: 506225 - RNA, 19 nt, Homo sapiens
auugcagcaguagccuuaa

SEQ ID NO: 506226 - RNA, 18 nt, Homo sapiens
auugcaugccaucuccac

SEQ ID NO: 506227 - RNA, 17 nt, Homo sapiens
auugcccuuuaacaaga

SEQ ID NO: 506228 - RNA, 19 nt, Homo sapiens
auugcugagauguuuagua

SEQ ID NO: 506229 - RNA, 12 nt, Homo sapiens
auuggcagcaga

SEQ ID NO: 506230 - RNA, 13 nt, Homo sapiens
auuggcagugugu

SEQ ID NO: 506231 - RNA, 20 nt, Homo sapiens
auuggcccuguacaguuugc

SEQ ID NO: 506232 - RNA, 19 nt, Homo sapiens
auugugaugcauuuaucuu

SEQ ID NO: 506233 - RNA, 23 nt, Homo sapiens
auugugucuuuugcaugaugauc

SEQ ID NO: 506234 - RNA, 15 nt, Homo sapiens
auuguuuacagagcu

SEQ ID NO: 506235 - RNA, 16 nt, Homo sapiens
auuuaaucauuuccag

SEQ ID NO: 506236 - RNA, 15 nt, Homo sapiens
auuuaauuugauauc

SEQ ID NO: 506237 - RNA, 19 nt, Homo sapiens
auuuaauuugauaucacag

SEQ ID NO: 506238 - RNA, 11 nt, Homo sapiens
auuuaccacag

SEQ ID NO: 506239 - RNA, 23 nt, Homo sapiens
auuuacuuguuauguuguaauau

SEQ ID NO: 506240 - RNA, 16 nt, Homo sapiens
auuuagcacaguauuu

SEQ ID NO: 506241 - RNA, 15 nt, Homo sapiens
auuucacauuccuga

SEQ ID NO: 506242 - RNA, 15 nt, Homo sapiens
auuuccuccugggca

SEQ ID NO: 506243 - RNA, 15 nt, Homo sapiens
auuuccuuaaagcaa

SEQ ID NO: 506244 - RNA, 14 nt, Homo sapiens
auuucgcacuguau

SEQ ID NO: 506245 - RNA, 23 nt, Homo sapiens
auuucuaggccugauauccaaca

SEQ ID NO: 506246 - RNA, 20 nt, Homo sapiens
auuucuuggugcuuugucua

SEQ ID NO: 506247 - RNA, 14 nt, Homo sapiens
auuugauauacaga

SEQ ID NO: 506248 - RNA, 21 nt, Homo sapiens
auuuuaaaugacgcacaaacu

SEQ ID NO: 506249 - RNA, 15 nt, Homo sapiens
auuuuaaauggacag

SEQ ID NO: 506250 - RNA, 17 nt, Homo sapiens
auuuuaucucuucuucc

SEQ ID NO: 506251 - RNA, 17 nt, Homo sapiens
auuuucuggguuugaua

SEQ ID NO: 506252 - RNA, 22 nt, Homo sapiens
auuuuuccucuuucacuucuua

SEQ ID NO: 506253 - RNA, 13 nt, Homo sapiens
caaaaaacagaaa

SEQ ID NO: 506254 - RNA, 11 nt, Homo sapiens
caaaaacuggg

SEQ ID NO: 506255 - RNA, 17 nt, Homo sapiens
caaaaccaacucucuac

SEQ ID NO: 506256 - RNA, 20 nt, Homo sapiens
caaaaggcuggaugugcuuu

SEQ ID NO: 506257 - RNA, 23 nt, Homo sapiens
caaaaggcuggaugugcuuucau

SEQ ID NO: 506258 - RNA, 15 nt, Homo sapiens
caaaauaauacuuca

SEQ ID NO: 506259 - RNA, 14 nt, Homo sapiens
caaaaugugugcuu

SEQ ID NO: 506260 - RNA, 15 nt, Homo sapiens
caaacaaaaacuguu

SEQ ID NO: 506261 - RNA, 23 nt, Homo sapiens
caaacacugcuuaaggaaaagag

SEQ ID NO: 506262 - RNA, 21 nt, Homo sapiens
caaacaguguggcuuaaacau

SEQ ID NO: 506263 - RNA, 14 nt, Homo sapiens
caaacuccaagaca

SEQ ID NO: 506264 - RNA, 17 nt, Homo sapiens
caaagaaucaacaguga

SEQ ID NO: 506265 - RNA, 18 nt, Homo sapiens
caaagaaucaacagugaa

SEQ ID NO: 506266 - RNA, 18 nt, Homo sapiens
caaagaggccaguacuuu

SEQ ID NO: 506267 - RNA, 22 nt, Homo sapiens
caaagcaugccaauuucucuua

SEQ ID NO: 506268 - RNA, 15 nt, Homo sapiens
ugaaccgucaaugug

SEQ ID NO: 506269 - RNA, 22 nt, Homo sapiens
ugaacucuuuccccagcugauu

SEQ ID NO: 506270 - RNA, 16 nt, Homo sapiens
ugaacugcaacacugg

SEQ ID NO: 506271 - RNA, 17 nt, Homo sapiens
ugaagacccuaucuccc

SEQ ID NO: 506272 - RNA, 19 nt, Homo sapiens
ugaagcaaauuucuagaua

SEQ ID NO: 506273 - RNA, 14 nt, Homo sapiens
ugaaggauugugaa

SEQ ID NO: 506274 - RNA, 18 nt, Homo sapiens
ugaaguagacauggaauu

SEQ ID NO: 506275 - RNA, 16 nt, Homo sapiens
ugaauagcgcccucaa

SEQ ID NO: 506276 - RNA, 22 nt, Homo sapiens
ugaauccaucaggacuugggaa

SEQ ID NO: 506277 - RNA, 18 nt, Homo sapiens
ugacacacucaccauuua

SEQ ID NO: 506278 - RNA, 17 nt, Homo sapiens
ugacaugggugugccag

SEQ ID NO: 506279 - RNA, 20 nt, Homo sapiens
ugacauggucagucuacuaa

SEQ ID NO: 506280 - RNA, 20 nt, Homo sapiens
ugaccauaaaauuagacaua

SEQ ID NO: 506281 - RNA, 15 nt, Homo sapiens
ugacccagccugaaa

SEQ ID NO: 506282 - RNA, 17 nt, Homo sapiens
ugacccccugcugccau

SEQ ID NO: 506283 - RNA, 19 nt, Homo sapiens
ugacccccugcugccaucu

SEQ ID NO: 506284 - RNA, 18 nt, Homo sapiens
ugacucagugcagggaca

SEQ ID NO: 506285 - RNA, 21 nt, Homo sapiens
ugacuguguucagugccuugg

SEQ ID NO: 506286 - RNA, 14 nt, Homo sapiens
ugacuuaugugcag

SEQ ID NO: 506287 - RNA, 15 nt, Homo sapiens
ugacuucagaaacuu

SEQ ID NO: 506288 - RNA, 15 nt, Homo sapiens
ugacuugccaaagaa

SEQ ID NO: 506289 - RNA, 21 nt, Homo sapiens
ugacuuuccuaugacacucau

SEQ ID NO: 506290 - RNA, 18 nt, Homo sapiens
ugagaaauugugccaaag

SEQ ID NO: 506291 - RNA, 17 nt, Homo sapiens
ugagauguuauuacugu

SEQ ID NO: 506292 - RNA, 17 nt, Homo sapiens
ugagcugggcaccacag

SEQ ID NO: 506293 - RNA, 15 nt, Homo sapiens
ugaggaggaggacac

SEQ ID NO: 506294 - RNA, 13 nt, Homo sapiens
ugagggcccuucc

SEQ ID NO: 506295 - RNA, 15 nt, Homo sapiens
ugagguuaaggggau

SEQ ID NO: 506296 - RNA, 14 nt, Homo sapiens
ugaguaaacagaua

SEQ ID NO: 506297 - RNA, 17 nt, Homo sapiens
ugagugaaauauuacuc

SEQ ID NO: 506298 - RNA, 18 nt, Homo sapiens
ugaguucugcacauacag

SEQ ID NO: 506299 - RNA, 18 nt, Homo sapiens
ugaguuuaaucuuuucag

SEQ ID NO: 506300 - RNA, 22 nt, Homo sapiens
ugauaauagcucacagcacauu

SEQ ID NO: 506301 - RNA, 19 nt, Homo sapiens
ugauaauggaaacugucaa

SEQ ID NO: 506302 - RNA, 22 nt, Homo sapiens
ugauaauucuuacuguucugaa

SEQ ID NO: 506303 - RNA, 22 nt, Homo sapiens
ugauagaagaaggacugaagaa

SEQ ID NO: 506304 - RNA, 22 nt, Homo sapiens
ugauaguuuacaaacaagauac

SEQ ID NO: 506305 - RNA, 13 nt, Homo sapiens
ugaugauguucug

SEQ ID NO: 506306 - RNA, 14 nt, Homo sapiens
ugauguaacugugu

SEQ ID NO: 506307 - RNA, 15 nt, Homo sapiens
ugauuaacucagucc

SEQ ID NO: 506308 - RNA, 17 nt, Homo sapiens
ugauuacagauguacaa

SEQ ID NO: 506309 - RNA, 14 nt, Homo sapiens
ugauuccuguugaa

SEQ ID NO: 506310 - RNA, 15 nt, Homo sapiens
ugauugucaaauaca

SEQ ID NO: 506311 - RNA, 14 nt, Homo sapiens
ugcaaaucaacucu

SEQ ID NO: 506312 - RNA, 21 nt, Homo sapiens
ugcaaccucggggagugccac

SEQ ID NO: 506313 - RNA, 21 nt, Homo sapiens
ugcaauguuccguucaucuga

SEQ ID NO: 506314 - RNA, 14 nt, Homo sapiens
ugcacacauaacac

SEQ ID NO: 506315 - RNA, 20 nt, Homo sapiens
ugcacagugguccagggucc

SEQ ID NO: 506316 - RNA, 22 nt, Homo sapiens
ugcaccagugccgccugugccc

SEQ ID NO: 506317 - RNA, 18 nt, Homo sapiens
ugcaccgguuucauagac

SEQ ID NO: 506318 - RNA, 15 nt, Homo sapiens
ugcagaaaacauugu

SEQ ID NO: 506319 - RNA, 12 nt, Homo sapiens
ugcagacugugg

SEQ ID NO: 506320 - RNA, 16 nt, Homo sapiens
ugcagaugacuggaaa

SEQ ID NO: 506321 - RNA, 22 nt, Homo sapiens
ugcagcccagaacgggccuccc

SEQ ID NO: 506322 - RNA, 23 nt, Homo sapiens
ugcagcuucuaacugguaaaaag

SEQ ID NO: 506323 - RNA, 16 nt, Homo sapiens
ugcaggaacaugaccc

SEQ ID NO: 506324 - RNA, 17 nt, Homo sapiens
ugcaguacucaguaaua

SEQ ID NO: 506325 - RNA, 17 nt, Homo sapiens
ugcaguggugaugccua

SEQ ID NO: 506326 - RNA, 17 nt, Homo sapiens
ugcaguuuuuguuuaca

SEQ ID NO: 506327 - RNA, 16 nt, Homo sapiens
ugcauaauaugcauau

SEQ ID NO: 506328 - RNA, 22 nt, Homo sapiens
ugcauucauucauccucuuaua

SEQ ID NO: 506329 - RNA, 12 nt, Homo sapiens
ugccaggcagug

SEQ ID NO: 506330 - RNA, 16 nt, Homo sapiens
ugccaguacuuaccag

SEQ ID NO: 506331 - RNA, 18 nt, Homo sapiens
ugccauucccacuaagcu

SEQ ID NO: 506332 - RNA, 13 nt, Homo sapiens
ugcccaaagccau

SEQ ID NO: 506333 - RNA, 16 nt, Homo sapiens
ugcccacaacuugcca

SEQ ID NO: 506334 - RNA, 17 nt, Homo sapiens
ugcccacccguguucuc

SEQ ID NO: 506335 - RNA, 14 nt, Homo sapiens
ugccccagugcuac

SEQ ID NO: 506336 - RNA, 13 nt, Homo sapiens
ugccccugggaac

SEQ ID NO: 506337 - RNA, 14 nt, Homo sapiens
ugccucacugugac

SEQ ID NO: 506338 - RNA, 15 nt, Homo sapiens
ugccugaauccauca

SEQ ID NO: 506339 - RNA, 19 nt, Homo sapiens
ugccuggagggaauccaua

SEQ ID NO: 506340 - RNA, 22 nt, Homo sapiens
ugccuucagcccuaacauagug

SEQ ID NO: 506341 - RNA, 18 nt, Homo sapiens
ugccuugggcgggccauu

SEQ ID NO: 506342 - RNA, 19 nt, Homo sapiens
ugccuuggguggaccaggc

SEQ ID NO: 506343 - RNA, 22 nt, Homo sapiens
ugcgacgauccccauggaacag

SEQ ID NO: 506344 - RNA, 18 nt, Homo sapiens
ugcuaacaucucaucuua

SEQ ID NO: 506345 - RNA, 22 nt, Homo sapiens
ugcuaucucgcuagccauauau

SEQ ID NO: 506346 - RNA, 21 nt, Homo sapiens
uugcaaccuuguacuuuacaa

SEQ ID NO: 506347 - RNA, 17 nt, Homo sapiens
uugcaucaguauuuccu

SEQ ID NO: 506348 - RNA, 23 nt, Homo sapiens
uugcaugccaucuccacccugag

SEQ ID NO: 506349 - RNA, 16 nt, Homo sapiens
uugcgagaaacagaga

SEQ ID NO: 506350 - RNA, 23 nt, Homo sapiens
uugcuaacauauuuaaagucuug

SEQ ID NO: 506351 - RNA, 14 nt, Homo sapiens
uugcugaauaacaa

SEQ ID NO: 506352 - RNA, 17 nt, Homo sapiens
uugcuucauuaaaacaa

SEQ ID NO: 506353 - RNA, 19 nt, Homo sapiens
uuggacauuuauguacaaa

SEQ ID NO: 506354 - RNA, 22 nt, Homo sapiens
uuggagagagaggcugccucag

SEQ ID NO: 506355 - RNA, 21 nt, Homo sapiens
uuggagagcagcaggugcugu

SEQ ID NO: 506356 - RNA, 16 nt, Homo sapiens
uuggagcagaaagcca

SEQ ID NO: 506357 - RNA, 20 nt, Homo sapiens
uuggauuuguuuaaaaacca

SEQ ID NO: 506358 - RNA, 20 nt, Homo sapiens
uuggcaaaauuacaguucac

SEQ ID NO: 506359 - RNA, 21 nt, Homo sapiens
uuggcagugugucacacugag

SEQ ID NO: 506360 - RNA, 18 nt, Homo sapiens
uugggaaaugcugauuua

SEQ ID NO: 506361 - RNA, 14 nt, Homo sapiens
uuggguuccagaca

SEQ ID NO: 506362 - RNA, 17 nt, Homo sapiens
uuggucacaaagcuauu

SEQ ID NO: 506363 - RNA, 19 nt, Homo sapiens
uuggucucuuucuuuccaa

SEQ ID NO: 506364 - RNA, 23 nt, Homo sapiens
uuguaaaacugugacauuccaca

SEQ ID NO: 506365 - RNA, 23 nt, Homo sapiens
uuguagaugaaaaagcauguaca

SEQ ID NO: 506366 - RNA, 14 nt, Homo sapiens
uuguccuccuaaua

SEQ ID NO: 506367 - RNA, 17 nt, Homo sapiens
uuguggacuuuucccca

SEQ ID NO: 506368 - RNA, 19 nt, Homo sapiens
uuguggcacacaacugugg

SEQ ID NO: 506369 - RNA, 20 nt, Homo sapiens
uuguucuuguaaaacuguga

SEQ ID NO: 506370 - RNA, 17 nt, Homo sapiens
uuuacagucacauucag

SEQ ID NO: 506371 - RNA, 14 nt, Homo sapiens
uuuacagugccacg

SEQ ID NO: 506372 - RNA, 13 nt, Homo sapiens
uuuagaagagccu

SEQ ID NO: 506373 - RNA, 13 nt, Homo sapiens
uuuaguaagcaaa

SEQ ID NO: 506374 - RNA, 13 nt, Homo sapiens
uuuauacuucaaa

SEQ ID NO: 506375 - RNA, 12 nt, Homo sapiens
uuuauauaugaa

SEQ ID NO: 506376 - RNA, 20 nt, Homo sapiens
uuuauaugauuaaauuauca

SEQ ID NO: 506377 - RNA, 19 nt, Homo sapiens
uuuauucauuagcugugau

SEQ ID NO: 506378 - RNA, 23 nt, Homo sapiens
uuuauuuaaggggaauuaacaau

SEQ ID NO: 506379 - RNA, 15 nt, Homo sapiens
uuucacuguucauga

SEQ ID NO: 506380 - RNA, 23 nt, Homo sapiens
uuucagaaacaaagcauuugacu

SEQ ID NO: 506381 - RNA, 21 nt, Homo sapiens
uuucagcauucccaauuauca

SEQ ID NO: 506382 - RNA, 20 nt, Homo sapiens
uuucagguaaauaaaucuau

SEQ ID NO: 506383 - RNA, 21 nt, Homo sapiens
uuucaugauuagacaaugugg

SEQ ID NO: 506384 - RNA, 23 nt, Homo sapiens
uuucauggaaugcaauuugacuu

SEQ ID NO: 506385 - RNA, 21 nt, Homo sapiens
uuuccaaagguuucaacugua

SEQ ID NO: 506386 - RNA, 17 nt, Homo sapiens
uuucccacacugugaac

SEQ ID NO: 506387 - RNA, 22 nt, Homo sapiens
uuuccccugugguuuguuauca

SEQ ID NO: 506388 - RNA, 22 nt, Homo sapiens
uuuccccuuuuaaaaacucaga

SEQ ID NO: 506389 - RNA, 20 nt, Homo sapiens
uuuccgugagagucaucuca

SEQ ID NO: 506390 - RNA, 23 nt, Homo sapiens
ccucccuggggaccaggagcuag

SEQ ID NO: 506391 - RNA, 13 nt, Homo sapiens
ccucugagacaga

SEQ ID NO: 506392 - RNA, 17 nt, Homo sapiens
ccucugcauaaauauua

SEQ ID NO: 506393 - RNA, 13 nt, Homo sapiens
ccucuuaccugua

SEQ ID NO: 506394 - RNA, 19 nt, Homo sapiens
ccucuuagaagaaauauga

SEQ ID NO: 506395 - RNA, 13 nt, Homo sapiens
ccucuuaggcaga

SEQ ID NO: 506396 - RNA, 14 nt, Homo sapiens
ccucuuuaccauag

SEQ ID NO: 506397 - RNA, 16 nt, Homo sapiens
ccucuuucacuucuua

SEQ ID NO: 506398 - RNA, 16 nt, Homo sapiens
ccucuuucucucugug

SEQ ID NO: 506399 - RNA, 17 nt, Homo sapiens
ccugaaucagaggcaga

SEQ ID NO: 506400 - RNA, 15 nt, Homo sapiens
ccugacaaaagggac

SEQ ID NO: 506401 - RNA, 18 nt, Homo sapiens
ccugacagcaaacacagu

SEQ ID NO: 506402 - RNA, 11 nt, Homo sapiens
ccugacugugu

SEQ ID NO: 506403 - RNA, 15 nt, Homo sapiens
ccugacuguguucag

SEQ ID NO: 506404 - RNA, 20 nt, Homo sapiens
ccugaggaggaggacacagc

SEQ ID NO: 506405 - RNA, 14 nt, Homo sapiens
ccugccuacuggau

SEQ ID NO: 506406 - RNA, 20 nt, Homo sapiens
ccugcuaguguagcuucuga

SEQ ID NO: 506407 - RNA, 23 nt, Homo sapiens
ccugcuccugcccacgugcagca

SEQ ID NO: 506408 - RNA, 22 nt, Homo sapiens
ccugcuuagugucccuuaccug

SEQ ID NO: 506409 - RNA, 19 nt, Homo sapiens
ccugggcuguugugucugg

SEQ ID NO: 506410 - RNA, 23 nt, Homo sapiens
ccuggggcauccaccuuccugcc

SEQ ID NO: 506411 - RNA, 20 nt, Homo sapiens
ccugggggcugcugcacugc

SEQ ID NO: 506412 - RNA, 18 nt, Homo sapiens
ccugggugugugaagcug

SEQ ID NO: 506413 - RNA, 17 nt, Homo sapiens
ccuguacacacacagac

SEQ ID NO: 506414 - RNA, 20 nt, Homo sapiens
ccuguaggucuaugaugucc

SEQ ID NO: 506415 - RNA, 12 nt, Homo sapiens
ccugugaucgug

SEQ ID NO: 506416 - RNA, 23 nt, Homo sapiens
ccugugaucuauaccaccuucaa

SEQ ID NO: 506417 - RNA, 21 nt, Homo sapiens
ccugugcaguagagagccuuu

SEQ ID NO: 506418 - RNA, 19 nt, Homo sapiens
ccugugggggcggcugugg

SEQ ID NO: 506419 - RNA, 19 nt, Homo sapiens
ccuguucucuaguuuucca

SEQ ID NO: 506420 - RNA, 12 nt, Homo sapiens
ccuuagcagcuc

SEQ ID NO: 506421 - RNA, 20 nt, Homo sapiens
ccuuagcccaagacuuggag

SEQ ID NO: 506422 - RNA, 16 nt, Homo sapiens
ccuuaucauaaauuca

SEQ ID NO: 506423 - RNA, 16 nt, Homo sapiens
ccuucuaauccaugug

SEQ ID NO: 506424 - RNA, 18 nt, Homo sapiens
ccuucugugcaucuggcc

SEQ ID NO: 506425 - RNA, 17 nt, Homo sapiens
ccuucuuuccuuccuuu

SEQ ID NO: 506426 - RNA, 11 nt, Homo sapiens
ccuugcugcua

SEQ ID NO: 506427 - RNA, 22 nt, Homo sapiens
ccuugggcgggccauuucacau

SEQ ID NO: 506428 - RNA, 19 nt, Homo sapiens
ccuuucaauaggaaaaacu

SEQ ID NO: 506429 - RNA, 17 nt, Homo sapiens
ccuuucacauacugaca

SEQ ID NO: 506430 - RNA, 13 nt, Homo sapiens
ccuuugagggcag

SEQ ID NO: 506431 - RNA, 22 nt, Homo sapiens
ccuuugcaggcccagcagacuu

SEQ ID NO: 506432 - RNA, 20 nt, Homo sapiens
ccuuuuacagucacauucag

SEQ ID NO: 506433 - RNA, 20 nt, Homo sapiens
ccuuuugucuacggaagccu

SEQ ID NO: 506434 - RNA, 14 nt, Homo sapiens
cgaacacagugaca

SEQ ID NO: 506435 - RNA, 13 nt, Homo sapiens
cgaccccaucuca

SEQ ID NO: 506436 - RNA, 14 nt, Homo sapiens
cgaccccaucucau

SEQ ID NO: 506437 - RNA, 19 nt, Homo sapiens
cgccgugucuuguguugcu

SEQ ID NO: 506438 - RNA, 14 nt, Homo sapiens
cgcuugcuaucaug

SEQ ID NO: 506439 - RNA, 12 nt, Homo sapiens
cggaaagccuuc

SEQ ID NO: 506440 - RNA, 15 nt, Homo sapiens
cggaaguggccugag

SEQ ID NO: 506441 - RNA, 18 nt, Homo sapiens
cggagggucucccugggc

SEQ ID NO: 506442 - RNA, 19 nt, Homo sapiens
cggagggucucccugggca

SEQ ID NO: 506443 - RNA, 16 nt, Homo sapiens
cggcacauuggcagug

SEQ ID NO: 506444 - RNA, 17 nt, Homo sapiens
cggcaguggcuggggga

SEQ ID NO: 506445 - RNA, 17 nt, Homo sapiens
cggccgcucuccgcccc

SEQ ID NO: 506446 - RNA, 23 nt, Homo sapiens
cggccuccuagccucuccgccca

SEQ ID NO: 506447 - RNA, 14 nt, Homo sapiens
cggccugauggcca

SEQ ID NO: 506448 - RNA, 21 nt, Homo sapiens
cgggaagaggagaugacagga

SEQ ID NO: 506449 - RNA, 20 nt, Homo sapiens
cgggcacucccuaaguccac

SEQ ID NO: 506450 - RNA, 14 nt, Homo sapiens
cgggccuccccggg

SEQ ID NO: 506451 - RNA, 18 nt, Homo sapiens
cggugucuggaaaagcac

SEQ ID NO: 506452 - RNA, 22 nt, Homo sapiens
cggugucuggaaaagcacuuua

SEQ ID NO: 506453 - RNA, 22 nt, Homo sapiens
cgguuccacgugggguggaauu

SEQ ID NO: 506454 - RNA, 20 nt, Homo sapiens
cguacccuuugcacacaggg

SEQ ID NO: 506455 - RNA, 18 nt, Homo sapiens
cguccuuagaauacugua

SEQ ID NO: 506456 - RNA, 18 nt, Homo sapiens
cgugccguggagcuugga

SEQ ID NO: 506457 - RNA, 17 nt, Homo sapiens
cgugccuuccccgugcg

SEQ ID NO: 506458 - RNA, 22 nt, Homo sapiens
cguuccggagcuggguaucuca

SEQ ID NO: 506459 - RNA, 23 nt, Homo sapiens
cguuggagagcagcaggugcugu

SEQ ID NO: 506460 - RNA, 11 nt, Homo sapiens
cuaaaugucaa

SEQ ID NO: 506461 - RNA, 11 nt, Homo sapiens
cuaacacuggc

SEQ ID NO: 506462 - RNA, 14 nt, Homo sapiens
cuaagacaccugca

SEQ ID NO: 506463 - RNA, 23 nt, Homo sapiens
cuaagaccuccucccaagcacuu

SEQ ID NO: 506464 - RNA, 14 nt, Homo sapiens
cuaagccugaugau

SEQ ID NO: 506465 - RNA, 14 nt, Homo sapiens
cuaaggaaugaucc

SEQ ID NO: 506466 - RNA, 15 nt, Homo sapiens
cuaaggaaugaucca

SEQ ID NO: 506467 - RNA, 15 nt, Homo sapiens
cuaaguccacucuag

SEQ ID NO: 506468 - RNA, 14 nt, Homo sapiens
cuaaugacaaguga

SEQ ID NO: 506469 - RNA, 23 nt, Homo sapiens
cuaauuaaaaaguuaaucuucau

SEQ ID NO: 506470 - RNA, 22 nt, Homo sapiens
cuacaucucguauggauuucua

SEQ ID NO: 506471 - RNA, 22 nt, Homo sapiens
cuaccacauucacuacugcaaa

SEQ ID NO: 506472 - RNA, 18 nt, Homo sapiens
cuagcaauugcuucucua

SEQ ID NO: 506473 - RNA, 23 nt, Homo sapiens
cuaggcauuacuggccuuuucac

SEQ ID NO: 506474 - RNA, 16 nt, Homo sapiens
cuagucaugugccuug

SEQ ID NO: 506475 - RNA, 16 nt, Homo sapiens
cuaguuuugaugaauu

SEQ ID NO: 506476 - RNA, 23 nt, Homo sapiens
cuauauuauauaaauaguauuuc

SEQ ID NO: 506477 - RNA, 12 nt, Homo sapiens
cuauauuuacug

SEQ ID NO: 506478 - RNA, 12 nt, Homo sapiens
cuaucaguaaua

SEQ ID NO: 506479 - RNA, 21 nt, Homo sapiens
cuaucccuggacgcaugcagg

SEQ ID NO: 506480 - RNA, 15 nt, Homo sapiens
cuauuaucuggguuu

SEQ ID NO: 506481 - RNA, 23 nt, Homo sapiens
cuauuucugcugaauuuucacau

SEQ ID NO: 506482 - RNA, 17 nt, Homo sapiens
cuauuuuggacguguga

SEQ ID NO: 506483 - RNA, 17 nt, Homo sapiens
cuauuuuuaaccaaaua

SEQ ID NO: 506484 - RNA, 18 nt, Homo sapiens
cucaacccugugaucuau

SEQ ID NO: 506485 - RNA, 19 nt, Homo sapiens
cucaagauccugucuugcu

SEQ ID NO: 506486 - RNA, 20 nt, Homo sapiens
cucaaggcugcagugagcca

SEQ ID NO: 506487 - RNA, 19 nt, Homo sapiens
cucaaucucaggucuucac

SEQ ID NO: 506488 - RNA, 16 nt, Homo sapiens
cucaaugaaugaacaa

SEQ ID NO: 506489 - RNA, 18 nt, Homo sapiens
cucaaugugcuguugauu

SEQ ID NO: 506490 - RNA, 22 nt, Homo sapiens
cucaauucauauuuaugaaucu

SEQ ID NO: 506491 - RNA, 13 nt, Homo sapiens
cucacagcacauu

SEQ ID NO: 506492 - RNA, 18 nt, Homo sapiens
cucacagggacucuccau

SEQ ID NO: 506493 - RNA, 14 nt, Homo sapiens
cucacccaguucag

SEQ ID NO: 506494 - RNA, 20 nt, Homo sapiens
cucaccuucccuaguucuuu

SEQ ID NO: 506495 - RNA, 16 nt, Homo sapiens
cucacugugaccugcu

SEQ ID NO: 506496 - RNA, 18 nt, Homo sapiens
cucagcaaucacaagcca

SEQ ID NO: 506497 - RNA, 13 nt, Homo sapiens
cucagggaccaag

SEQ ID NO: 506498 - RNA, 15 nt, Homo sapiens
cucagggaccaagga

SEQ ID NO: 506499 - RNA, 20 nt, Homo sapiens
cucaguaaaucagugcagua

SEQ ID NO: 506500 - RNA, 22 nt, Homo sapiens
cucaguaacacaauacaguacu

SEQ ID NO: 506501 - RNA, 21 nt, Homo sapiens
cucaguaacacagugcaguac

SEQ ID NO: 506502 - RNA, 23 nt, Homo sapiens
cucaguaacacagugcaguacuc

SEQ ID NO: 506503 - RNA, 21 nt, Homo sapiens
cucaguaacagugcaguacuc

SEQ ID NO: 506504 - RNA, 20 nt, Homo sapiens
cucaguaaggcagugcagua

SEQ ID NO: 506505 - RNA, 22 nt, Homo sapiens
cucaguaauacaguacaguacu

SEQ ID NO: 506506 - RNA, 14 nt, Homo sapiens
cucagucaaaugua

SEQ ID NO: 506507 - RNA, 15 nt, Homo sapiens
cucagucaguauugu

SEQ ID NO: 506508 - RNA, 21 nt, Homo sapiens
cucauacagucucuauuugau

SEQ ID NO: 506509 - RNA, 14 nt, Homo sapiens
cucaucccaaaagc

SEQ ID NO: 506510 - RNA, 21 nt, Homo sapiens
cucaugcagauaguauacaca

SEQ ID NO: 506511 - RNA, 16 nt, Homo sapiens
cucauguauacuucaa

SEQ ID NO: 506512 - RNA, 15 nt, Homo sapiens
cucauguucauucag

SEQ ID NO: 506513 - RNA, 12 nt, Homo sapiens
cuccacuccucc

SEQ ID NO: 506514 - RNA, 14 nt, Homo sapiens
cuccagaauaugga

SEQ ID NO: 506515 - RNA, 19 nt, Homo sapiens
cucccaaauaaacuccuua

SEQ ID NO: 506516 - RNA, 14 nt, Homo sapiens
cucccaggguccug

SEQ ID NO: 506517 - RNA, 13 nt, Homo sapiens
cuccccacuccag

SEQ ID NO: 506518 - RNA, 14 nt, Homo sapiens
cucccccaccuuca

SEQ ID NO: 506519 - RNA, 15 nt, Homo sapiens
cucccuggggaccag

SEQ ID NO: 506520 - RNA, 19 nt, Homo sapiens
cuccucccaagcacuucaa

SEQ ID NO: 506521 - RNA, 15 nt, Homo sapiens
cuccuccugcauguc

SEQ ID NO: 506522 - RNA, 18 nt, Homo sapiens
cuccuuuuucuaccuuuu

SEQ ID NO: 506523 - RNA, 17 nt, Homo sapiens
cucgcgacaaugcaaac

SEQ ID NO: 506524 - RNA, 14 nt, Homo sapiens
cucggacaccaucu

SEQ ID NO: 506525 - RNA, 16 nt, Homo sapiens
cucggggagugccacu

SEQ ID NO: 506526 - RNA, 22 nt, Homo sapiens
cucguucaguuuaguaagcaaa

SEQ ID NO: 506527 - RNA, 18 nt, Homo sapiens
cucguuguaaguacucua

SEQ ID NO: 506528 - RNA, 16 nt, Homo sapiens
cucuaagaauucagua

SEQ ID NO: 506529 - RNA, 23 nt, Homo sapiens
cucuagacaucuagucucagugc

SEQ ID NO: 506530 - RNA, 18 nt, Homo sapiens
cucucagccccucagaga

SEQ ID NO: 506531 - RNA, 13 nt, Homo sapiens
cucucccaaauaa

SEQ ID NO: 506532 - RNA, 19 nt, Homo sapiens
cucugagacucgcgacaau

SEQ ID NO: 506533 - RNA, 21 nt, Homo sapiens
cucuggguuuugggauuuggg

SEQ ID NO: 506534 - RNA, 14 nt, Homo sapiens
cucuuaagaucuga

SEQ ID NO: 506535 - RNA, 13 nt, Homo sapiens
cugaaaaaguguu

SEQ ID NO: 506536 - RNA, 15 nt, Homo sapiens
cugaaaacuggaaua

SEQ ID NO: 506537 - RNA, 15 nt, Homo sapiens
cugaaauaaaagccu

SEQ ID NO: 506538 - RNA, 17 nt, Homo sapiens
cugaacugcaacacugg

SEQ ID NO: 506539 - RNA, 18 nt, Homo sapiens
cugaagcguuacuacagc

SEQ ID NO: 506540 - RNA, 22 nt, Homo sapiens
cugaauaaaauugaugugcaug

SEQ ID NO: 506541 - RNA, 20 nt, Homo sapiens
cugaaucugagaaaguacuu

SEQ ID NO: 506542 - RNA, 22 nt, Homo sapiens
cugaauucauugucucagugaa

SEQ ID NO: 506543 - RNA, 23 nt, Homo sapiens
cugacagaugguaucugccaguc

SEQ ID NO: 506544 - RNA, 21 nt, Homo sapiens
cugacauauuucauaagcaca

SEQ ID NO: 506545 - RNA, 21 nt, Homo sapiens
cugaccuuucugagugacaug

SEQ ID NO: 506546 - RNA, 22 nt, Homo sapiens
cugacuguguucagugccuugg

SEQ ID NO: 506547 - RNA, 22 nt, Homo sapiens
cugagacgcaaggaucacuuga

SEQ ID NO: 506548 - RNA, 19 nt, Homo sapiens
cugagaggagcguguccua

SEQ ID NO: 506549 - RNA, 13 nt, Homo sapiens
cugagcagugggg

SEQ ID NO: 506550 - RNA, 14 nt, Homo sapiens
cugauaacucugua

SEQ ID NO: 506551 - RNA, 23 nt, Homo sapiens
cugauagaagaaggacugaagaa

SEQ ID NO: 506552 - RNA, 22 nt, Homo sapiens
cugauggccaggccucagggac

SEQ ID NO: 506553 - RNA, 22 nt, Homo sapiens
cugcaaccucggggagugccac

SEQ ID NO: 506554 - RNA, 21 nt, Homo sapiens
cugcaagucuccuagaagccc

SEQ ID NO: 506555 - RNA, 14 nt, Homo sapiens
cugcaggaaucaaa

SEQ ID NO: 506556 - RNA, 16 nt, Homo sapiens
cugcagucagcacaga

SEQ ID NO: 506557 - RNA, 22 nt, Homo sapiens
cugcauggagaaggguucugcc

SEQ ID NO: 506558 - RNA, 10 nt, Homo sapiens
cugcauuuca

SEQ ID NO: 506559 - RNA, 16 nt, Homo sapiens
cugccacgguccuuug

SEQ ID NO: 506560 - RNA, 12 nt, Homo sapiens
cugccaguguuu

SEQ ID NO: 506561 - RNA, 14 nt, Homo sapiens
cugcccaaagccau

SEQ ID NO: 506562 - RNA, 20 nt, Homo sapiens
cugccucagccaguggcaca

SEQ ID NO: 506563 - RNA, 20 nt, Homo sapiens
cugccuguggugagguccug

SEQ ID NO: 506564 - RNA, 18 nt, Homo sapiens
cugcgcauguuugacuuu

SEQ ID NO: 506565 - RNA, 16 nt, Homo sapiens
cugcgggucauauuca

SEQ ID NO: 506566 - RNA, 22 nt, Homo sapiens
cugcguaggagagaacagggau

SEQ ID NO: 506567 - RNA, 22 nt, Homo sapiens
cugcuacaccuuagcagcucuu

SEQ ID NO: 506568 - RNA, 19 nt, Homo sapiens
cugcuaugucugugauguc

SEQ ID NO: 506569 - RNA, 21 nt, Homo sapiens
cugcugagggggcucuuuccc

SEQ ID NO: 506570 - RNA, 21 nt, Homo sapiens
cugcugccucccuggggacca

SEQ ID NO: 506571 - RNA, 17 nt, Homo sapiens
cugcuguggcaucagga

SEQ ID NO: 506572 - RNA, 22 nt, Homo sapiens
cugcuuagugucccuuaccugg

SEQ ID NO: 506573 - RNA, 16 nt, Homo sapiens
cugcuucucuuucaca

SEQ ID NO: 506574 - RNA, 14 nt, Homo sapiens
cugcuuucagugcc

SEQ ID NO: 506575 - RNA, 18 nt, Homo sapiens
cugcuuugagaaaucuca

SEQ ID NO: 506576 - RNA, 15 nt, Homo sapiens
cuggaaaagcacuuu

SEQ ID NO: 506577 - RNA, 20 nt, Homo sapiens
cuggaaguaagaaauauuac

SEQ ID NO: 506578 - RNA, 19 nt, Homo sapiens
cuggaauaagaagcaaaua

SEQ ID NO: 506579 - RNA, 18 nt, Homo sapiens
cuggaugcuuacagugac

SEQ ID NO: 506580 - RNA, 18 nt, Homo sapiens
cuggcagcgccucccgcc

SEQ ID NO: 506581 - RNA, 16 nt, Homo sapiens
cuggccaccugccagg

SEQ ID NO: 506582 - RNA, 22 nt, Homo sapiens
cuggccauuuaacuagcacuuu

SEQ ID NO: 506583 - RNA, 19 nt, Homo sapiens
cuggcugggcuuuggggcu

SEQ ID NO: 506584 - RNA, 16 nt, Homo sapiens
cugggaacacagugcc

SEQ ID NO: 506585 - RNA, 16 nt, Homo sapiens
cugggcucacuacaug

SEQ ID NO: 506586 - RNA, 13 nt, Homo sapiens
cuggguccuuaaa

SEQ ID NO: 506587 - RNA, 22 nt, Homo sapiens
cugggugggugggguacaggca

SEQ ID NO: 506588 - RNA, 16 nt, Homo sapiens
cuggguuaacaguaaa

SEQ ID NO: 506589 - RNA, 19 nt, Homo sapiens
cuggugucuaauaaacaca

SEQ ID NO: 506590 - RNA, 22 nt, Homo sapiens
cuguaguuuuuguucaccuucu

SEQ ID NO: 506591 - RNA, 22 nt, Homo sapiens
cugucccggagcucaggcccug

SEQ ID NO: 506592 - RNA, 13 nt, Homo sapiens
cuguccgucuguc

SEQ ID NO: 506593 - RNA, 16 nt, Homo sapiens
cugugaccugcuccug

SEQ ID NO: 506594 - RNA, 17 nt, Homo sapiens
cugugcgccuuguagaa

SEQ ID NO: 506595 - RNA, 19 nt, Homo sapiens
cuguggcuucccaugucuu

SEQ ID NO: 506596 - RNA, 19 nt, Homo sapiens
cugugggggaggucccugc

SEQ ID NO: 506597 - RNA, 21 nt, Homo sapiens
cuguggucuucaaauugucuu

SEQ ID NO: 506598 - RNA, 23 nt, Homo sapiens
cugugguuuguuaucaguacaau

SEQ ID NO: 506599 - RNA, 23 nt, Homo sapiens
cuguguagcucuguccacucuga

SEQ ID NO: 506600 - RNA, 16 nt, Homo sapiens
cugugucaucugucag

SEQ ID NO: 506601 - RNA, 19 nt, Homo sapiens
cugugugugcccgugguga

SEQ ID NO: 506602 - RNA, 15 nt, Homo sapiens
cuguuagacaaaagu

SEQ ID NO: 506603 - RNA, 16 nt, Homo sapiens
cuguuagacaaaagug

SEQ ID NO: 506604 - RNA, 15 nt, Homo sapiens
cuguucuucuaucca

SEQ ID NO: 506605 - RNA, 16 nt, Homo sapiens
cuguugauucuuucaa

SEQ ID NO: 506606 - RNA, 16 nt, Homo sapiens
cuguuuagccuaguca

SEQ ID NO: 506607 - RNA, 21 nt, Homo sapiens
cuguuuccagagugcuuauaa

SEQ ID NO: 506608 - RNA, 22 nt, Homo sapiens
cuuaaaaaggcuuuuguuuauu

SEQ ID NO: 506609 - RNA, 17 nt, Homo sapiens
cuuaaaccugugcuuuc

SEQ ID NO: 506610 - RNA, 14 nt, Homo sapiens
cuuaagaugcaaau

SEQ ID NO: 506611 - RNA, 22 nt, Homo sapiens
cuuacaguagaggguccagucu

SEQ ID NO: 506612 - RNA, 12 nt, Homo sapiens
cuuacagugacu

SEQ ID NO: 506613 - RNA, 13 nt, Homo sapiens
cuuaccuguucuc

SEQ ID NO: 506614 - RNA, 22 nt, Homo sapiens
cuuaccuguugucugaaacaua

SEQ ID NO: 506615 - RNA, 18 nt, Homo sapiens
ucaaugugaaauaaagag

SEQ ID NO: 506616 - RNA, 13 nt, Homo sapiens
ucaauuuaaagga

SEQ ID NO: 506617 - RNA, 19 nt, Homo sapiens
ucacaagucagcacuaccu

SEQ ID NO: 506618 - RNA, 23 nt, Homo sapiens
ucacacucucuucuuacuguauu

SEQ ID NO: 506619 - RNA, 15 nt, Homo sapiens
ucacauaugugcaua

SEQ ID NO: 506620 - RNA, 17 nt, Homo sapiens
ucacauucagagucgcu

SEQ ID NO: 506621 - RNA, 20 nt, Homo sapiens
ucacccaguucagguguaua

SEQ ID NO: 506622 - RNA, 16 nt, Homo sapiens
ucaccucugaggacag

SEQ ID NO: 506623 - RNA, 14 nt, Homo sapiens
ucacguggucaagg

SEQ ID NO: 506624 - RNA, 16 nt, Homo sapiens
ucacugugaccugcuc

SEQ ID NO: 506625 - RNA, 15 nt, Homo sapiens
ucagaaacaaagcau

SEQ ID NO: 506626 - RNA, 20 nt, Homo sapiens
ucagagaaugaucacccuga

SEQ ID NO: 506627 - RNA, 19 nt, Homo sapiens
ucagauuuuuaaaagcccu

SEQ ID NO: 506628 - RNA, 17 nt, Homo sapiens
ucagcaaucacaagcca

SEQ ID NO: 506629 - RNA, 22 nt, Homo sapiens
ucagcaaucacaagccaagguc

SEQ ID NO: 506630 - RNA, 20 nt, Homo sapiens
ucagccccacuccacaguua

SEQ ID NO: 506631 - RNA, 21 nt, Homo sapiens
ucaggaaugcagcacaguacu

SEQ ID NO: 506632 - RNA, 14 nt, Homo sapiens
ucaggcagugcagu

SEQ ID NO: 506633 - RNA, 16 nt, Homo sapiens
ucaggcagugcaguac

SEQ ID NO: 506634 - RNA, 16 nt, Homo sapiens
ucaggcuacaggugcc

SEQ ID NO: 506635 - RNA, 12 nt, Homo sapiens
ucaggcuuucua

SEQ ID NO: 506636 - RNA, 12 nt, Homo sapiens
ucagggaccaag

SEQ ID NO: 506637 - RNA, 14 nt, Homo sapiens
ucagggaccaagga

SEQ ID NO: 506638 - RNA, 17 nt, Homo sapiens
ucaguaacacagugcag

SEQ ID NO: 506639 - RNA, 19 nt, Homo sapiens
ucaguaacacagugcagug

SEQ ID NO: 506640 - RNA, 18 nt, Homo sapiens
ucaguaagacagugcagu

SEQ ID NO: 506641 - RNA, 14 nt, Homo sapiens
ucaguaagaucaag

SEQ ID NO: 506642 - RNA, 23 nt, Homo sapiens
ucaguaaggcagugaaguacuca

SEQ ID NO: 506643 - RNA, 23 nt, Homo sapiens
ucaguaaggcagugcaguacuca

SEQ ID NO: 506644 - RNA, 17 nt, Homo sapiens
ucagugaagcccaggag

SEQ ID NO: 506645 - RNA, 21 nt, Homo sapiens
ucagugccuuauggaacacuc

SEQ ID NO: 506646 - RNA, 15 nt, Homo sapiens
ucaguguacucugag

SEQ ID NO: 506647 - RNA, 12 nt, Homo sapiens
ucaguuugcuaa

SEQ ID NO: 506648 - RNA, 14 nt, Homo sapiens
ucauacucaaagag

SEQ ID NO: 506649 - RNA, 17 nt, Homo sapiens
ucauccagccacugccc

SEQ ID NO: 506650 - RNA, 12 nt, Homo sapiens
ucaucugucagc

SEQ ID NO: 506651 - RNA, 18 nt, Homo sapiens
ucaugacccuccugucca

SEQ ID NO: 506652 - RNA, 19 nt, Homo sapiens
ucaugacccuccuguccag

SEQ ID NO: 506653 - RNA, 15 nt, Homo sapiens
ucauguauacuucaa

SEQ ID NO: 506654 - RNA, 16 nt, Homo sapiens
ucaugugccuugaaca

SEQ ID NO: 506655 - RNA, 17 nt, Homo sapiens
ucaugugcgaacacagu

SEQ ID NO: 506656 - RNA, 20 nt, Homo sapiens
ucauguucuugcagucauca

SEQ ID NO: 506657 - RNA, 21 nt, Homo sapiens
ucauguugauguguccgugaa

SEQ ID NO: 506658 - RNA, 17 nt, Homo sapiens
ucauucauacucaaaga

SEQ ID NO: 506659 - RNA, 14 nt, Homo sapiens
ucauucuuauaaca

SEQ ID NO: 506660 - RNA, 15 nt, Homo sapiens
ucauugcacugcagu

SEQ ID NO: 506661 - RNA, 20 nt, Homo sapiens
ucauuucauacaaauuuucc

SEQ ID NO: 506662 - RNA, 21 nt, Homo sapiens
ucauuucuucucucugugcug

SEQ ID NO: 506663 - RNA, 19 nt, Homo sapiens
uccaaaauaucgagugaau

SEQ ID NO: 506664 - RNA, 18 nt, Homo sapiens
uccaagugugugugcaau

SEQ ID NO: 506665 - RNA, 21 nt, Homo sapiens
uccaauugcauuuauuuauca

SEQ ID NO: 506666 - RNA, 19 nt, Homo sapiens
uccacaguuaggccaagaa

SEQ ID NO: 506667 - RNA, 17 nt, Homo sapiens
uccacccugagccugac

SEQ ID NO: 506668 - RNA, 16 nt, Homo sapiens
uccacgcucaaucuca

SEQ ID NO: 506669 - RNA, 14 nt, Homo sapiens
uccagaaaaacauu

SEQ ID NO: 506670 - RNA, 18 nt, Homo sapiens
uccagaggggugcgcaga

SEQ ID NO: 506671 - RNA, 22 nt, Homo sapiens
uccagaugugccuagacacgaa

SEQ ID NO: 506672 - RNA, 22 nt, Homo sapiens
uccagcagugaaugcuagacag

SEQ ID NO: 506673 - RNA, 13 nt, Homo sapiens
uccauaucagcuc

SEQ ID NO: 506674 - RNA, 14 nt, Homo sapiens
uccauaucagcucu

SEQ ID NO: 506675 - RNA, 21 nt, Homo sapiens
uccaugacaguagcauacuga

SEQ ID NO: 506676 - RNA, 14 nt, Homo sapiens
ucccaagucaaaca

SEQ ID NO: 506677 - RNA, 15 nt, Homo sapiens
ucccacacugugaac

SEQ ID NO: 506678 - RNA, 20 nt, Homo sapiens
ucccacccccagcagcucac

SEQ ID NO: 506679 - RNA, 14 nt, Homo sapiens
ucccagcuacaggg

SEQ ID NO: 506680 - RNA, 22 nt, Homo sapiens
uccccagagcuuuacagugcca

SEQ ID NO: 506681 - RNA, 18 nt, Homo sapiens
uccccagcccccacccau

SEQ ID NO: 506682 - RNA, 12 nt, Homo sapiens
uccccagggugc

SEQ ID NO: 506683 - RNA, 20 nt, Homo sapiens
uccccaguuaaugugccaaa

SEQ ID NO: 506684 - RNA, 13 nt, Homo sapiens
uccccauggugca

SEQ ID NO: 506685 - RNA, 15 nt, Homo sapiens
uccccauucagugac

SEQ ID NO: 506686 - RNA, 17 nt, Homo sapiens
uccccauucagugacau

SEQ ID NO: 506687 - RNA, 16 nt, Homo sapiens
uccccauugacccuca

SEQ ID NO: 506688 - RNA, 22 nt, Homo sapiens
uccccggaccggacgcaugcag

SEQ ID NO: 506689 - RNA, 13 nt, Homo sapiens
uccccuccagacc

SEQ ID NO: 506690 - RNA, 15 nt, Homo sapiens
ucccggugugcagcg

SEQ ID NO: 506691 - RNA, 13 nt, Homo sapiens
ucccuaggccuga

SEQ ID NO: 506692 - RNA, 18 nt, Homo sapiens
ucccuauacuuaggcaua

SEQ ID NO: 506693 - RNA, 19 nt, Homo sapiens
ucccucagcccucauuaaa

SEQ ID NO: 506694 - RNA, 21 nt, Homo sapiens
ucccucgggcuggugucuuga

SEQ ID NO: 506695 - RNA, 11 nt, Homo sapiens
ucccugaacac

SEQ ID NO: 506696 - RNA, 16 nt, Homo sapiens
ucccugaacacucauc

SEQ ID NO: 506697 - RNA, 19 nt, Homo sapiens
ucccugaggaaugaaaaag

SEQ ID NO: 506698 - RNA, 23 nt, Homo sapiens
ucccuggaaauaacugagcacuu

SEQ ID NO: 506699 - RNA, 23 nt, Homo sapiens
ucccugucugucugucucucuuu

SEQ ID NO: 506700 - RNA, 15 nt, Homo sapiens
ucccuucacauaguu

SEQ ID NO: 506701 - RNA, 22 nt, Homo sapiens
uccgacaugccuugaaaccaga

SEQ ID NO: 506702 - RNA, 20 nt, Homo sapiens
uccuaucccuggacgcaugc

SEQ ID NO: 506703 - RNA, 21 nt, Homo sapiens
uccuaucccuggacgcaugca

SEQ ID NO: 506704 - RNA, 22 nt, Homo sapiens
uccuaucccuggacgcaugcag

SEQ ID NO: 506705 - RNA, 21 nt, Homo sapiens
uccuaugagagaagagaguau

SEQ ID NO: 506706 - RNA, 15 nt, Homo sapiens
uccucugacuugcca

SEQ ID NO: 506707 - RNA, 13 nt, Homo sapiens
aaauugugccaaa

SEQ ID NO: 506708 - RNA, 14 nt, Homo sapiens
aaauuuuuuuccag

SEQ ID NO: 506709 - RNA, 19 nt, Homo sapiens
aacaaaaacuguugcuauu

SEQ ID NO: 506710 - RNA, 23 nt, Homo sapiens
aacaaaauuuaugucauuuucag

SEQ ID NO: 506711 - RNA, 22 nt, Homo sapiens
aacaacaauuuaggaaugcuca

SEQ ID NO: 506712 - RNA, 21 nt, Homo sapiens
aacaauguuuuuuauacuuca

SEQ ID NO: 506713 - RNA, 13 nt, Homo sapiens
aacacaaauccaa

SEQ ID NO: 506714 - RNA, 16 nt, Homo sapiens
aacacaccucucuccu

SEQ ID NO: 506715 - RNA, 13 nt, Homo sapiens
aacacaccuugcc

SEQ ID NO: 506716 - RNA, 13 nt, Homo sapiens
aacacagugcagu

SEQ ID NO: 506717 - RNA, 18 nt, Homo sapiens
aacacagugcagugcuca

SEQ ID NO: 506718 - RNA, 12 nt, Homo sapiens
aacacaucacuu

SEQ ID NO: 506719 - RNA, 22 nt, Homo sapiens
aacacauugaaacuguauuuac

SEQ ID NO: 506720 - RNA, 18 nt, Homo sapiens
aacagcgaagccagucca

SEQ ID NO: 506721 - RNA, 19 nt, Homo sapiens
aacagcuguauuaucuuaa

SEQ ID NO: 506722 - RNA, 17 nt, Homo sapiens
aacaguuuaacagaaaa

SEQ ID NO: 506723 - RNA, 14 nt, Homo sapiens
aacauauacuucca

SEQ ID NO: 506724 - RNA, 20 nt, Homo sapiens
aacauauuuaaagucuugaa

SEQ ID NO: 506725 - RNA, 22 nt, Homo sapiens
aacauggacuacacacaauaca

SEQ ID NO: 506726 - RNA, 19 nt, Homo sapiens
aacauucuuauuucaguua

SEQ ID NO: 506727 - RNA, 12 nt, Homo sapiens
aaccaagcuaua

SEQ ID NO: 506728 - RNA, 20 nt, Homo sapiens
aaccaauuuguucugugcaa

SEQ ID NO: 506729 - RNA, 19 nt, Homo sapiens
aaccacccuaucaucaguu

SEQ ID NO: 506730 - RNA, 23 nt, Homo sapiens
aaccauucugcuugguuccacaa

SEQ ID NO: 506731 - RNA, 18 nt, Homo sapiens
aacccagacccugagucc

SEQ ID NO: 506732 - RNA, 15 nt, Homo sapiens
aacccauuuuagaga

SEQ ID NO: 506733 - RNA, 14 nt, Homo sapiens
aaccuaccacauuc

SEQ ID NO: 506734 - RNA, 18 nt, Homo sapiens
aaccuacugcccacauuu

SEQ ID NO: 506735 - RNA, 17 nt, Homo sapiens
aaccuccacaguagcau

SEQ ID NO: 506736 - RNA, 14 nt, Homo sapiens
aaccugaaagggca

SEQ ID NO: 506737 - RNA, 23 nt, Homo sapiens
aaccugacagcaaacacagucac

SEQ ID NO: 506738 - RNA, 17 nt, Homo sapiens
aaccugugcuuucaugu

SEQ ID NO: 506739 - RNA, 20 nt, Homo sapiens
aaccugugcuuucauguuua

SEQ ID NO: 506740 - RNA, 17 nt, Homo sapiens
aaccuucuaauccaugu

SEQ ID NO: 506741 - RNA, 12 nt, Homo sapiens
aaccuugcugcu

SEQ ID NO: 506742 - RNA, 15 nt, Homo sapiens
aacgagagguaugcc

SEQ ID NO: 506743 - RNA, 15 nt, Homo sapiens
aacuaaauagcaugu

SEQ ID NO: 506744 - RNA, 22 nt, Homo sapiens
aacuaagguacggugagacucu

SEQ ID NO: 506745 - RNA, 16 nt, Homo sapiens
aacuacccucuggaga

SEQ ID NO: 506746 - RNA, 11 nt, Homo sapiens
aacuacuuucu

SEQ ID NO: 506747 - RNA, 12 nt, Homo sapiens
aacuauauugcg

SEQ ID NO: 506748 - RNA, 16 nt, Homo sapiens
aacuaucaccaaaaga

SEQ ID NO: 506749 - RNA, 18 nt, Homo sapiens
aacuauguuuagugugau

SEQ ID NO: 506750 - RNA, 13 nt, Homo sapiens
aacuauugcugcu

SEQ ID NO: 506751 - RNA, 15 nt, Homo sapiens
aacucaguccugaca

SEQ ID NO: 506752 - RNA, 18 nt, Homo sapiens
aacuccaggguuugggcu

SEQ ID NO: 506753 - RNA, 17 nt, Homo sapiens
aacugaagcagagucaa

SEQ ID NO: 506754 - RNA, 16 nt, Homo sapiens
aacugagcacuuugaa

SEQ ID NO: 506755 - RNA, 15 nt, Homo sapiens
aacugcaacacugga

SEQ ID NO: 506756 - RNA, 17 nt, Homo sapiens
aacuguaaaauacuucu

SEQ ID NO: 506757 - RNA, 19 nt, Homo sapiens
aacuguaaaauacuucuuu

SEQ ID NO: 506758 - RNA, 22 nt, Homo sapiens
aacuguggaaggcacacugagc

SEQ ID NO: 506759 - RNA, 15 nt, Homo sapiens
aacuuaauuaccuaa

SEQ ID NO: 506760 - RNA, 13 nt, Homo sapiens
aacuuacauaugu

SEQ ID NO: 506761 - RNA, 15 nt, Homo sapiens
aacuuacauaugucu

SEQ ID NO: 506762 - RNA, 15 nt, Homo sapiens
aacuucuauuuucaa

SEQ ID NO: 506763 - RNA, 20 nt, Homo sapiens
aacuuuuccuggacacuuua

SEQ ID NO: 506764 - RNA, 15 nt, Homo sapiens
aagaaaaaagugcaa

SEQ ID NO: 506765 - RNA, 14 nt, Homo sapiens
aagaaacauucaga

SEQ ID NO: 506766 - RNA, 12 nt, Homo sapiens
aagaaacuaccc

SEQ ID NO: 506767 - RNA, 15 nt, Homo sapiens
aagaacucaugugau

SEQ ID NO: 506768 - RNA, 19 nt, Homo sapiens
aagaacugccccaucuccu

SEQ ID NO: 506769 - RNA, 14 nt, Homo sapiens
aagaaggcaaccca

SEQ ID NO: 506770 - RNA, 17 nt, Homo sapiens
aagaauucaugaugcua

SEQ ID NO: 506771 - RNA, 20 nt, Homo sapiens
aagaauuggcagaagcaguu

SEQ ID NO: 506772 - RNA, 17 nt, Homo sapiens
aagaauuuuaauauugc

SEQ ID NO: 506773 - RNA, 20 nt, Homo sapiens
aagaauuuuaauauugccau

SEQ ID NO: 506774 - RNA, 21 nt, Homo sapiens
aagaauuuuaauauugccaua

SEQ ID NO: 506775 - RNA, 20 nt, Homo sapiens
aagacaauuuuaauguuuac

SEQ ID NO: 506776 - RNA, 21 nt, Homo sapiens
aagacaauuuuaauguuuaca

SEQ ID NO: 506777 - RNA, 12 nt, Homo sapiens
aagacagugcag

SEQ ID NO: 506778 - RNA, 14 nt, Homo sapiens
aagacccacugaau

SEQ ID NO: 506779 - RNA, 15 nt, Homo sapiens
aagagaagaaauagc

SEQ ID NO: 506780 - RNA, 16 nt, Homo sapiens
aagagaagaaauagca

SEQ ID NO: 506781 - RNA, 22 nt, Homo sapiens
aagaggacuuaguuugugaugu

SEQ ID NO: 506782 - RNA, 13 nt, Homo sapiens
aagaucaagcucc

SEQ ID NO: 506783 - RNA, 12 nt, Homo sapiens
aagaugaagcug

SEQ ID NO: 506784 - RNA, 12 nt, Homo sapiens
aagcacccuguu

SEQ ID NO: 506785 - RNA, 23 nt, Homo sapiens
aagcaugcucaguauugagacac

SEQ ID NO: 506786 - RNA, 16 nt, Homo sapiens
aagccacguugcagaa

SEQ ID NO: 506787 - RNA, 22 nt, Homo sapiens
aagcccagccuaucucucuucu

SEQ ID NO: 506788 - RNA, 13 nt, Homo sapiens
aagcccucuucaa

SEQ ID NO: 506789 - RNA, 23 nt, Homo sapiens
aagccucuggcuaccucuguccc

SEQ ID NO: 506790 - RNA, 12 nt, Homo sapiens
aagccugaugau

SEQ ID NO: 506791 - RNA, 22 nt, Homo sapiens
aagcugagaugggacaggauca

SEQ ID NO: 506792 - RNA, 22 nt, Homo sapiens
aagcugaugaaguuaagcacaa

SEQ ID NO: 506793 - RNA, 23 nt, Homo sapiens
aagcuggggccccugcaaccucg

SEQ ID NO: 506794 - RNA, 13 nt, Homo sapiens
aaggacugaagaa

SEQ ID NO: 506795 - RNA, 20 nt, Homo sapiens
aaggauauagcaacaucuuu

SEQ ID NO: 506796 - RNA, 13 nt, Homo sapiens
aaggaucacuuga

SEQ ID NO: 506797 - RNA, 14 nt, Homo sapiens
aaggauugugaacu

SEQ ID NO: 506798 - RNA, 20 nt, Homo sapiens
aaggcagugaacacacucag

SEQ ID NO: 506799 - RNA, 12 nt, Homo sapiens
aaggcagugcaa

SEQ ID NO: 506800 - RNA, 13 nt, Homo sapiens
aaggcagugcagu

SEQ ID NO: 506801 - RNA, 14 nt, Homo sapiens
aaggcagugcagua

SEQ ID NO: 506802 - RNA, 18 nt, Homo sapiens
aagggaagcccugacaac

SEQ ID NO: 506803 - RNA, 22 nt, Homo sapiens
aagggacuuuggaauucugcuu

SEQ ID NO: 506804 - RNA, 12 nt, Homo sapiens
aaggugccucau

SEQ ID NO: 506805 - RNA, 16 nt, Homo sapiens
aaggugccucauagca

SEQ ID NO: 506806 - RNA, 18 nt, Homo sapiens
aagguuucacuguucaug

SEQ ID NO: 506807 - RNA, 20 nt, Homo sapiens
aagguuucacuguucaugaa

SEQ ID NO: 506808 - RNA, 21 nt, Homo sapiens
aaguaaaaaacuucccaacuc

SEQ ID NO: 506809 - RNA, 21 nt, Homo sapiens
aaguacucuaauauacagugu

SEQ ID NO: 506810 - RNA, 22 nt, Homo sapiens
aaguacucuaauauacagugug

SEQ ID NO: 506811 - RNA, 18 nt, Homo sapiens
aaguauugcccuuuaaca

SEQ ID NO: 506812 - RNA, 16 nt, Homo sapiens
aagucagcacuaccuc

SEQ ID NO: 506813 - RNA, 11 nt, Homo sapiens
aaguccacucu

SEQ ID NO: 506814 - RNA, 16 nt, Homo sapiens
aagucuccuguaucau

SEQ ID NO: 506815 - RNA, 12 nt, Homo sapiens
aagugaugugau

SEQ ID NO: 506816 - RNA, 11 nt, Homo sapiens
aagugcauguu

SEQ ID NO: 506817 - RNA, 18 nt, Homo sapiens
aagugguaggaaagccuc

SEQ ID NO: 506818 - RNA, 15 nt, Homo sapiens
aaguguagcacccug

SEQ ID NO: 506819 - RNA, 16 nt, Homo sapiens
aaguguccauugacau

SEQ ID NO: 506820 - RNA, 20 nt, Homo sapiens
aaguguguugggaauugcau

SEQ ID NO: 506821 - RNA, 21 nt, Homo sapiens
aaguguuggccaucauuucau

SEQ ID NO: 506822 - RNA, 15 nt, Homo sapiens
aaguguuuccauucu

SEQ ID NO: 506823 - RNA, 17 nt, Homo sapiens
aaguuacauuaugugua

SEQ ID NO: 506824 - RNA, 22 nt, Homo sapiens
aaguuauccagaggguugugau

SEQ ID NO: 506825 - RNA, 19 nt, Homo sapiens
aaguucauucauacucaaa

SEQ ID NO: 506826 - RNA, 16 nt, Homo sapiens
aauaaaagccucuggu

SEQ ID NO: 506827 - RNA, 20 nt, Homo sapiens
aauaacugagcacuuugaau

SEQ ID NO: 506828 - RNA, 19 nt, Homo sapiens
aauaaggccucauccucca

SEQ ID NO: 506829 - RNA, 21 nt, Homo sapiens
aauaauauugccuugauguuu

SEQ ID NO: 506830 - RNA, 22 nt, Homo sapiens
aauaauauugccuugauguuuc

SEQ ID NO: 506831 - RNA, 15 nt, Homo sapiens
aauacaacacauuga

SEQ ID NO: 506832 - RNA, 17 nt, Homo sapiens
aauacauaaaaaaggga

SEQ ID NO: 506833 - RNA, 18 nt, Homo sapiens
aauacauaaaaaagggac

SEQ ID NO: 506834 - RNA, 16 nt, Homo sapiens
aauacaugccuuucca

SEQ ID NO: 506835 - RNA, 23 nt, Homo sapiens
aauacccacugccagacaugcca

SEQ ID NO: 506836 - RNA, 17 nt, Homo sapiens
aauacuuauuauguaag

SEQ ID NO: 506837 - RNA, 21 nt, Homo sapiens
aauaguugagccagcagacau

SEQ ID NO: 506838 - RNA, 18 nt, Homo sapiens
aauaucaagagagguuaa

SEQ ID NO: 506839 - RNA, 17 nt, Homo sapiens
aauauggaaacagagca

SEQ ID NO: 506840 - RNA, 15 nt, Homo sapiens
aauauuauuugcuaa

SEQ ID NO: 506841 - RNA, 14 nt, Homo sapiens
aauauugcugaugg

SEQ ID NO: 506842 - RNA, 12 nt, Homo sapiens
aauauuuugcug

SEQ ID NO: 506843 - RNA, 17 nt, Homo sapiens
aaucaaaauaauacuuc

SEQ ID NO: 506844 - RNA, 19 nt, Homo sapiens
aaucaaaauaauacuucau

SEQ ID NO: 506845 - RNA, 18 nt, Homo sapiens
aaucacacucucuucuua

SEQ ID NO: 506846 - RNA, 23 nt, Homo sapiens
aaucacacucucuucuuacugua

SEQ ID NO: 506847 - RNA, 12 nt, Homo sapiens
aaucagacugaa

SEQ ID NO: 506848 - RNA, 11 nt, Homo sapiens
aaucaguuugc

SEQ ID NO: 506849 - RNA, 21 nt, Homo sapiens
aaucauuuugauguauuauua

SEQ ID NO: 506850 - RNA, 14 nt, Homo sapiens
aauccacaguauug

SEQ ID NO: 506851 - RNA, 12 nt, Homo sapiens
aauccauaucag

SEQ ID NO: 506852 - RNA, 16 nt, Homo sapiens
aauccauaucagcucu

SEQ ID NO: 506853 - RNA, 20 nt, Homo sapiens
aauccauaucagcucugcau

SEQ ID NO: 506854 - RNA, 19 nt, Homo sapiens
aaucccauuuaugcaauuu

SEQ ID NO: 506855 - RNA, 11 nt, Homo sapiens
aauccuuguag

SEQ ID NO: 506856 - RNA, 14 nt, Homo sapiens
aauccuuguagauc

SEQ ID NO: 506857 - RNA, 17 nt, Homo sapiens
aauccuuguagaucuuu

SEQ ID NO: 506858 - RNA, 19 nt, Homo sapiens
aaucuagagcuaugcacac

SEQ ID NO: 506859 - RNA, 16 nt, Homo sapiens
aaucucaggucuucac

SEQ ID NO: 506860 - RNA, 16 nt, Homo sapiens
aaugaaauacuugaca

SEQ ID NO: 506861 - RNA, 23 nt, Homo sapiens
aaugaaugaaauauaaacuguga

SEQ ID NO: 506862 - RNA, 19 nt, Homo sapiens
aaugaauuuuuuccuacca

SEQ ID NO: 506863 - RNA, 12 nt, Homo sapiens
aaugaggcacau

SEQ ID NO: 506864 - RNA, 15 nt, Homo sapiens
aaugauaauagcuca

SEQ ID NO: 506865 - RNA, 20 nt, Homo sapiens
aaugccagggacauuuucaa

SEQ ID NO: 506866 - RNA, 14 nt, Homo sapiens
aaugcucaaugugc

SEQ ID NO: 506867 - RNA, 19 nt, Homo sapiens
aauggauccuugucaguug

SEQ ID NO: 506868 - RNA, 22 nt, Homo sapiens
aauggcauuuagcacaguauuu

SEQ ID NO: 506869 - RNA, 16 nt, Homo sapiens
aauggcccuguagcuc

SEQ ID NO: 506870 - RNA, 20 nt, Homo sapiens
aauguaacuuauuuaaugaa

SEQ ID NO: 506871 - RNA, 18 nt, Homo sapiens
aauguacccagccuacca

SEQ ID NO: 506872 - RNA, 22 nt, Homo sapiens
aaugugaaauaaagaguucucc

SEQ ID NO: 506873 - RNA, 17 nt, Homo sapiens
aauguguuuuucaguua

SEQ ID NO: 506874 - RNA, 20 nt, Homo sapiens
aauguucugacagcauuuca

SEQ ID NO: 506875 - RNA, 22 nt, Homo sapiens
aauguugaagaacucaugugau

SEQ ID NO: 506876 - RNA, 20 nt, Homo sapiens
aauguuuuaaagaaguccau

SEQ ID NO: 506877 - RNA, 19 nt, Homo sapiens
aauuaaaaaguuaaucuuc

SEQ ID NO: 506878 - RNA, 19 nt, Homo sapiens
aauuaaacaaauuccuucc

SEQ ID NO: 506879 - RNA, 14 nt, Homo sapiens
aauuaaagcagcaa

SEQ ID NO: 506880 - RNA, 12 nt, Homo sapiens
aauuauccuccu

SEQ ID NO: 506881 - RNA, 18 nt, Homo sapiens
aauuaugucaaauggaug

SEQ ID NO: 506882 - RNA, 21 nt, Homo sapiens
aauucaaagaaucaccuaauu

SEQ ID NO: 506883 - RNA, 15 nt, Homo sapiens
aauuccaaucauugu

SEQ ID NO: 506884 - RNA, 22 nt, Homo sapiens
aauucugaaggggaaaaccuca

SEQ ID NO: 506885 - RNA, 14 nt, Homo sapiens
aauucugcuucucu

SEQ ID NO: 506886 - RNA, 17 nt, Homo sapiens
aauucuuaaaucugccu

SEQ ID NO: 506887 - RNA, 22 nt, Homo sapiens
aauugaaagggacaaguaucau

SEQ ID NO: 506888 - RNA, 16 nt, Homo sapiens
aauuggcagcagauuu

SEQ ID NO: 506889 - RNA, 20 nt, Homo sapiens
aauugucuuuugucaugugg

SEQ ID NO: 506890 - RNA, 12 nt, Homo sapiens
aauuucucuuaa

SEQ ID NO: 506891 - RNA, 20 nt, Homo sapiens
aauuuuaauguuuacaacaa

SEQ ID NO: 506892 - RNA, 17 nt, Homo sapiens
aauuuuaucucuucuuc

SEQ ID NO: 506893 - RNA, 17 nt, Homo sapiens
aauuuucacaugaacau

SEQ ID NO: 506894 - RNA, 23 nt, Homo sapiens
aauuuuucugcacugagcagagu

SEQ ID NO: 506895 - RNA, 19 nt, Homo sapiens
aauuuuugucuuucaugga

SEQ ID NO: 506896 - RNA, 23 nt, Homo sapiens
acaaaaggcuggaugugcuuuca

SEQ ID NO: 506897 - RNA, 17 nt, Homo sapiens
acaaacaggugcuaaca

SEQ ID NO: 506898 - RNA, 14 nt, Homo sapiens
acaaagaaauauua

SEQ ID NO: 506899 - RNA, 19 nt, Homo sapiens
acaaagcauuugacuuucu

SEQ ID NO: 506900 - RNA, 19 nt, Homo sapiens
acaaaucauuuugauguau

SEQ ID NO: 506901 - RNA, 13 nt, Homo sapiens
acaaauguaacac

SEQ ID NO: 506902 - RNA, 12 nt, Homo sapiens
acaaauucuaaa

SEQ ID NO: 506903 - RNA, 22 nt, Homo sapiens
acaacaaagcaugcucaguauu

SEQ ID NO: 506904 - RNA, 15 nt, Homo sapiens
acaagagaccacuuc

SEQ ID NO: 506905 - RNA, 20 nt, Homo sapiens
acaagagaccacuuccuuaa

SEQ ID NO: 506906 - RNA, 15 nt, Homo sapiens
acaagcuacauaugu

SEQ ID NO: 506907 - RNA, 13 nt, Homo sapiens
acaauaagccacu

SEQ ID NO: 506908 - RNA, 13 nt, Homo sapiens
acaaucaugccua

SEQ ID NO: 506909 - RNA, 17 nt, Homo sapiens
acaauguuuuuuauacu

SEQ ID NO: 506910 - RNA, 14 nt, Homo sapiens
acacaaagugaaau

SEQ ID NO: 506911 - RNA, 12 nt, Homo sapiens
acacaacugugg

SEQ ID NO: 506912 - RNA, 21 nt, Homo sapiens
acacaauacagugguauaaac

SEQ ID NO: 506913 - RNA, 21 nt, Homo sapiens
acacacaaaccuacugcccac

SEQ ID NO: 506914 - RNA, 16 nt, Homo sapiens
acacacaagcagacac

SEQ ID NO: 506915 - RNA, 12 nt, Homo sapiens
acacacaauuaa

SEQ ID NO: 506916 - RNA, 18 nt, Homo sapiens
ccaaguuggagugcagug

SEQ ID NO: 506917 - RNA, 14 nt, Homo sapiens
ccaauaaagcucac

SEQ ID NO: 506918 - RNA, 18 nt, Homo sapiens
ccaaugccaauucaucuc

SEQ ID NO: 506919 - RNA, 19 nt, Homo sapiens
ccaaugggguuguuagcuu

SEQ ID NO: 506920 - RNA, 21 nt, Homo sapiens
ccacaauaagccacugguauc

SEQ ID NO: 506921 - RNA, 19 nt, Homo sapiens
ccacagcugggcaggguga

SEQ ID NO: 506922 - RNA, 15 nt, Homo sapiens
ccacaggaugcauau

SEQ ID NO: 506923 - RNA, 14 nt, Homo sapiens
ccacaguagcauuu

SEQ ID NO: 506924 - RNA, 19 nt, Homo sapiens
ccacauugcuucauuaaaa

SEQ ID NO: 506925 - RNA, 13 nt, Homo sapiens
ccacgugugcaga

SEQ ID NO: 506926 - RNA, 21 nt, Homo sapiens
ccacguugcagaaaaagagcu

SEQ ID NO: 506927 - RNA, 21 nt, Homo sapiens
ccacucugaauaccaagugug

SEQ ID NO: 506928 - RNA, 12 nt, Homo sapiens
ccacugccagac

SEQ ID NO: 506929 - RNA, 18 nt, Homo sapiens
ccacugccagacaugcca

SEQ ID NO: 506930 - RNA, 20 nt, Homo sapiens
ccacugccccugcaccugcu

SEQ ID NO: 506931 - RNA, 17 nt, Homo sapiens
ccacuuauuuccaugga

SEQ ID NO: 506932 - RNA, 18 nt, Homo sapiens
ccagaaaucuaaucucug

SEQ ID NO: 506933 - RNA, 13 nt, Homo sapiens
ccagacaugccac

SEQ ID NO: 506934 - RNA, 20 nt, Homo sapiens
ccagagccuauggaaagggu

SEQ ID NO: 506935 - RNA, 13 nt, Homo sapiens
ccagagcuuuaca

SEQ ID NO: 506936 - RNA, 16 nt, Homo sapiens
ccagcaaaagugcagu

SEQ ID NO: 506937 - RNA, 22 nt, Homo sapiens
ccagcauucagcacacacaaac

SEQ ID NO: 506938 - RNA, 14 nt, Homo sapiens
ccagggaaacaaag

SEQ ID NO: 506939 - RNA, 20 nt, Homo sapiens
ccagggugcaggcgcgcacc

SEQ ID NO: 506940 - RNA, 20 nt, Homo sapiens
ccagggugggaagagaagaa

SEQ ID NO: 506941 - RNA, 13 nt, Homo sapiens
ccaguccagaaga

SEQ ID NO: 506942 - RNA, 20 nt, Homo sapiens
ccagugcauguugccaugag

SEQ ID NO: 506943 - RNA, 14 nt, Homo sapiens
ccaguucugaugag

SEQ ID NO: 506944 - RNA, 13 nt, Homo sapiens
ccaucccacugau

SEQ ID NO: 506945 - RNA, 14 nt, Homo sapiens
ccaucgauuuguau

SEQ ID NO: 506946 - RNA, 18 nt, Homo sapiens
ccaugguagacugugaca

SEQ ID NO: 506947 - RNA, 19 nt, Homo sapiens
ccauggugcagugaagaaa

SEQ ID NO: 506948 - RNA, 20 nt, Homo sapiens
ccauguguauggaagacaaa

SEQ ID NO: 506949 - RNA, 19 nt, Homo sapiens
ccauguucuugagcagcug

SEQ ID NO: 506950 - RNA, 13 nt, Homo sapiens
ccauucagugaca

SEQ ID NO: 506951 - RNA, 13 nt, Homo sapiens
ccauucauugcag

SEQ ID NO: 506952 - RNA, 14 nt, Homo sapiens
ccauucauugcagc

SEQ ID NO: 506953 - RNA, 12 nt, Homo sapiens
ccauugcaguug

SEQ ID NO: 506954 - RNA, 22 nt, Homo sapiens
cccaaccuccccugguccugca

SEQ ID NO: 506955 - RNA, 16 nt, Homo sapiens
cccaacgacccaugac

SEQ ID NO: 506956 - RNA, 19 nt, Homo sapiens
cccaaggaagaacaaauau

SEQ ID NO: 506957 - RNA, 20 nt, Homo sapiens
cccacaggagcguguccuau

SEQ ID NO: 506958 - RNA, 13 nt, Homo sapiens
cccacaguccuca

SEQ ID NO: 506959 - RNA, 22 nt, Homo sapiens
cccacauuugggcucaggguug

SEQ ID NO: 506960 - RNA, 13 nt, Homo sapiens
cccacuccagaag

SEQ ID NO: 506961 - RNA, 19 nt, Homo sapiens
cccacuggagcguguacua

SEQ ID NO: 506962 - RNA, 23 nt, Homo sapiens
cccacuggagcguguacuacccc

SEQ ID NO: 506963 - RNA, 19 nt, Homo sapiens
cccacuggaggcaugugau

SEQ ID NO: 506964 - RNA, 13 nt, Homo sapiens
cccagaacaugga

SEQ ID NO: 506965 - RNA, 17 nt, Homo sapiens
cccagaacgcaugcagg

SEQ ID NO: 506966 - RNA, 19 nt, Homo sapiens
cccagccucccccaggcug

SEQ ID NO: 506967 - RNA, 22 nt, Homo sapiens
cccaggaagucauccugcaaug

SEQ ID NO: 506968 - RNA, 17 nt, Homo sapiens
cccaggacgcaugcagg

SEQ ID NO: 506969 - RNA, 14 nt, Homo sapiens
cccaggaggaccug

SEQ ID NO: 506970 - RNA, 15 nt, Homo sapiens
cccaggaugaagggg

SEQ ID NO: 506971 - RNA, 14 nt, Homo sapiens
cccagggaaugcca

SEQ ID NO: 506972 - RNA, 13 nt, Homo sapiens
cccagguaucuga

SEQ ID NO: 506973 - RNA, 19 nt, Homo sapiens
cccaugguagacugugaca

SEQ ID NO: 506974 - RNA, 23 nt, Homo sapiens
cccauuagaagcacacagaauua

SEQ ID NO: 506975 - RNA, 13 nt, Homo sapiens
cccauuucuguaa

SEQ ID NO: 506976 - RNA, 20 nt, Homo sapiens
ccccacaacacaccuugccc

SEQ ID NO: 506977 - RNA, 15 nt, Homo sapiens
ccccagcccuuugca

SEQ ID NO: 506978 - RNA, 19 nt, Homo sapiens
ccccagcugauuagugucu

SEQ ID NO: 506979 - RNA, 21 nt, Homo sapiens
ccccagguaucugaugauguu

SEQ ID NO: 506980 - RNA, 20 nt, Homo sapiens
cccccacaggagcauguccu

SEQ ID NO: 506981 - RNA, 11 nt, Homo sapiens
ccccuccgggc

SEQ ID NO: 506982 - RNA, 22 nt, Homo sapiens
ccccugggaacacagugcccca

SEQ ID NO: 506983 - RNA, 18 nt, Homo sapiens
cccgugcccuguuuccaa

SEQ ID NO: 506984 - RNA, 16 nt, Homo sapiens
cccuauacuuaggcau

SEQ ID NO: 506985 - RNA, 15 nt, Homo sapiens
cccucccugcugcca

SEQ ID NO: 506986 - RNA, 15 nt, Homo sapiens
cccucuucucacuuu

SEQ ID NO: 506987 - RNA, 19 nt, Homo sapiens
cccugaauucauugucuca

SEQ ID NO: 506988 - RNA, 17 nt, Homo sapiens
cccugacuucuggagau

SEQ ID NO: 506989 - RNA, 18 nt, Homo sapiens
cccugaggaaugaaaaag

SEQ ID NO: 506990 - RNA, 24 nt, Homo sapiens
cccugcccgaccccaucucauuca

SEQ ID NO: 506991 - RNA, 15 nt, Homo sapiens
cccugccucacugug

SEQ ID NO: 506992 - RNA, 16 nt, Homo sapiens
cccugccucacuguga

SEQ ID NO: 506993 - RNA, 23 nt, Homo sapiens
cccuggaaauaacugagcacuuu

SEQ ID NO: 506994 - RNA, 18 nt, Homo sapiens
cccuggccaccugccagg

SEQ ID NO: 506995 - RNA, 18 nt, Homo sapiens
cccuggggucucugagca

SEQ ID NO: 506996 - RNA, 16 nt, Homo sapiens
cccuguagcucugaau

SEQ ID NO: 506997 - RNA, 16 nt, Homo sapiens
cccugugggcucacac

SEQ ID NO: 506998 - RNA, 19 nt, Homo sapiens
cccuuuaucauguguuucu

SEQ ID NO: 506999 - RNA, 12 nt, Homo sapiens
cccuuugcacac

SEQ ID NO: 507000 - RNA, 21 nt, Homo sapiens
cccuuuuacagucacauucag

SEQ ID NO: 507001 - RNA, 15 nt, Homo sapiens
ccgauauaagccaua

SEQ ID NO: 507002 - RNA, 18 nt, Homo sapiens
ccgcagggcgcuccggca

SEQ ID NO: 507003 - RNA, 21 nt, Homo sapiens
ccgcgcucugccccuccgucc

SEQ ID NO: 507004 - RNA, 21 nt, Homo sapiens
ccggaaagccuuccucaagau

SEQ ID NO: 507005 - RNA, 22 nt, Homo sapiens
ccggcugacucagugcagggac

SEQ ID NO: 507006 - RNA, 18 nt, Homo sapiens
ccgggguggagucagggc

SEQ ID NO: 507007 - RNA, 22 nt, Homo sapiens
ccggugucuggaaaagcacuuu

SEQ ID NO: 507008 - RNA, 23 nt, Homo sapiens
ccgugcccuguuuccaaugccaa

SEQ ID NO: 507009 - RNA, 21 nt, Homo sapiens
ccuaaaccauuuugcagaaau

SEQ ID NO: 507010 - RNA, 17 nt, Homo sapiens
ccuaaagaaaacaaaca

SEQ ID NO: 507011 - RNA, 14 nt, Homo sapiens
ccuaauuaauuuca

SEQ ID NO: 507012 - RNA, 15 nt, Homo sapiens
ccuagguuguguuga

SEQ ID NO: 507013 - RNA, 16 nt, Homo sapiens
ccuaguuuugaugaau

SEQ ID NO: 507014 - RNA, 16 nt, Homo sapiens
ccuauugcuguaaaua

SEQ ID NO: 507015 - RNA, 19 nt, Homo sapiens
ccucaacccugugaucuau

SEQ ID NO: 507016 - RNA, 16 nt, Homo sapiens
ccucagccaguggcac

SEQ ID NO: 507017 - RNA, 18 nt, Homo sapiens
ccucaggacccagggaau

SEQ ID NO: 507018 - RNA, 12 nt, Homo sapiens
ccucagggacca

SEQ ID NO: 507019 - RNA, 19 nt, Homo sapiens
ccucauccacuaggugccc

SEQ ID NO: 507020 - RNA, 17 nt, Homo sapiens
ccucauccuccacugaa

SEQ ID NO: 507021 - RNA, 19 nt, Homo sapiens
ccuccaagugaaugaguuu

SEQ ID NO: 507022 - RNA, 17 nt, Homo sapiens
ccuccagguuuaucuuu

SEQ ID NO: 507023 - RNA, 18 nt, Homo sapiens
ccuccaguuuuagguccu

SEQ ID NO: 507024 - RNA, 20 nt, Homo sapiens
ccuccccaaggaagaacaaa

SEQ ID NO: 507025 - RNA, 22 nt, Homo sapiens
uaucauguguuucuguguagua

SEQ ID NO: 507026 - RNA, 22 nt, Homo sapiens
uaucauuaaccuuaucauaaau

SEQ ID NO: 507027 - RNA, 18 nt, Homo sapiens
uaucauuauagcauguaa

SEQ ID NO: 507028 - RNA, 20 nt, Homo sapiens
uauccucugacacccuuuaa

SEQ ID NO: 507029 - RNA, 21 nt, Homo sapiens
uaucgaguuccggaaagccuu

SEQ ID NO: 507030 - RNA, 20 nt, Homo sapiens
uaucuaguaggucugcacac

SEQ ID NO: 507031 - RNA, 19 nt, Homo sapiens
uaucuggccauugcacuuc

SEQ ID NO: 507032 - RNA, 22 nt, Homo sapiens
uaucuggguuuuagaaauucua

SEQ ID NO: 507033 - RNA, 16 nt, Homo sapiens
uaucuguuugcuucua

SEQ ID NO: 507034 - RNA, 23 nt, Homo sapiens
uaucuuaaaauugguuaaugaaa

SEQ ID NO: 507035 - RNA, 22 nt, Homo sapiens
uaucuuaggauuuaccaaauag

SEQ ID NO: 507036 - RNA, 21 nt, Homo sapiens
uaugauucuccucucccaaau

SEQ ID NO: 507037 - RNA, 16 nt, Homo sapiens
uauguaaacaucauaa

SEQ ID NO: 507038 - RNA, 19 nt, Homo sapiens
uaugucccuucacauaguu

SEQ ID NO: 507039 - RNA, 15 nt, Homo sapiens
uaugugaacuuucuc

SEQ ID NO: 507040 - RNA, 20 nt, Homo sapiens
uauguuuagugugauuguga

SEQ ID NO: 507041 - RNA, 14 nt, Homo sapiens
uauguuuauacaca

SEQ ID NO: 507042 - RNA, 17 nt, Homo sapiens
uauguuuauacacacag

SEQ ID NO: 507043 - RNA, 22 nt, Homo sapiens
uauuaaauguaacuuauuuaau

SEQ ID NO: 507044 - RNA, 14 nt, Homo sapiens
uauuaaauuccucc

SEQ ID NO: 507045 - RNA, 20 nt, Homo sapiens
uauucaauuguaaugcaugc

SEQ ID NO: 507046 - RNA, 19 nt, Homo sapiens
uauuguaacagacauuguu

SEQ ID NO: 507047 - RNA, 21 nt, Homo sapiens
uauuugaggaaacucauacag

SEQ ID NO: 507048 - RNA, 20 nt, Homo sapiens
uauuuuaggaaacucuccau

SEQ ID NO: 507049 - RNA, 12 nt, Homo sapiens
ucaaaaagccaa

SEQ ID NO: 507050 - RNA, 17 nt, Homo sapiens
ucaaaugcuacucagua

SEQ ID NO: 507051 - RNA, 17 nt, Homo sapiens
ucaacagugaacagcuu

SEQ ID NO: 507052 - RNA, 17 nt, Homo sapiens
ucaacucucuccugguc

SEQ ID NO: 507053 - RNA, 14 nt, Homo sapiens
ucaagccaggagac

SEQ ID NO: 507054 - RNA, 15 nt, Homo sapiens
ucaaggcugcaguga

SEQ ID NO: 507055 - RNA, 16 nt, Homo sapiens
ucaauaacuauugcug

SEQ ID NO: 507056 - RNA, 18 nt, Homo sapiens
ucaauaaggcagugcagu

SEQ ID NO: 507057 - RNA, 18 nt, Homo sapiens
ucaauucaugcuaccuga

SEQ ID NO: 507058 - RNA, 21 nt, Homo sapiens
ucaauuucagaaacuaagaau

SEQ ID NO: 507059 - RNA, 13 nt, Homo sapiens
ucacaaagcuauu

SEQ ID NO: 507060 - RNA, 13 nt, Homo sapiens
ucacaacuuugcu

SEQ ID NO: 507061 - RNA, 18 nt, Homo sapiens
ucacaccuuacaaagcca

SEQ ID NO: 507062 - RNA, 22 nt, Homo sapiens
ucacagauuuccaaaaguacua

SEQ ID NO: 507063 - RNA, 21 nt, Homo sapiens
ucacagggacucuccauaugu

SEQ ID NO: 507064 - RNA, 21 nt, Homo sapiens
ucaccauuuaaucauuuccag

SEQ ID NO: 507065 - RNA, 14 nt, Homo sapiens
ucaccccaccccac

SEQ ID NO: 507066 - RNA, 13 nt, Homo sapiens
ucaccuaucugga

SEQ ID NO: 507067 - RNA, 14 nt, Homo sapiens
ucacucacaaaagg

SEQ ID NO: 507068 - RNA, 14 nt, Homo sapiens
ucacugcgcauguu

SEQ ID NO: 507069 - RNA, 20 nt, Homo sapiens
ucacuuaccacuugcacuau

SEQ ID NO: 507070 - RNA, 16 nt, Homo sapiens
ucagaaaauccugaca

SEQ ID NO: 507071 - RNA, 21 nt, Homo sapiens
ucagaaacaaagcauuugacu

SEQ ID NO: 507072 - RNA, 19 nt, Homo sapiens
ucagaagcaguagacagau

SEQ ID NO: 507073 - RNA, 20 nt, Homo sapiens
ucagagcacaggcauauuau

SEQ ID NO: 507074 - RNA, 23 nt, Homo sapiens
ucagauugaaccauucauugcag

SEQ ID NO: 507075 - RNA, 13 nt, Homo sapiens
ucagccugugaac

SEQ ID NO: 507076 - RNA, 13 nt, Homo sapiens
ucagcucugcaua

SEQ ID NO: 507077 - RNA, 19 nt, Homo sapiens
ucaggaaugcagcacagua

SEQ ID NO: 507078 - RNA, 13 nt, Homo sapiens
ucaggagaaggcc

SEQ ID NO: 507079 - RNA, 18 nt, Homo sapiens
ucaggagcacagccauag

SEQ ID NO: 507080 - RNA, 21 nt, Homo sapiens
ucaggauugaggaugaacuca

SEQ ID NO: 507081 - RNA, 18 nt, Homo sapiens
ucaggcucugaaucucuc

SEQ ID NO: 507082 - RNA, 23 nt, Homo sapiens
ucagguguauagggaauuuucau

SEQ ID NO: 507083 - RNA, 18 nt, Homo sapiens
ucagguuauucguuacuc

SEQ ID NO: 507084 - RNA, 23 nt, Homo sapiens
ucaguaacacaauacaguacuca

SEQ ID NO: 507085 - RNA, 18 nt, Homo sapiens
ucaguaacacagugcagu

SEQ ID NO: 507086 - RNA, 19 nt, Homo sapiens
ucaguaacacagugcagua

SEQ ID NO: 507087 - RNA, 23 nt, Homo sapiens
ucaguaacacagugcaguacuca

SEQ ID NO: 507088 - RNA, 15 nt, Homo sapiens
ucaguaacagugaag

SEQ ID NO: 507089 - RNA, 17 nt, Homo sapiens
ucaguaagacagugcag

SEQ ID NO: 507090 - RNA, 19 nt, Homo sapiens
ucaguaagacagugcagug

SEQ ID NO: 507091 - RNA, 13 nt, Homo sapiens
ucaguaaggcagu

SEQ ID NO: 507092 - RNA, 17 nt, Homo sapiens
ucaguaaggcagugcaa

SEQ ID NO: 507093 - RNA, 21 nt, Homo sapiens
ucaguaauacaguacaguacu

SEQ ID NO: 507094 - RNA, 23 nt, Homo sapiens
ucaguaauacaguacaguacuca

SEQ ID NO: 507095 - RNA, 21 nt, Homo sapiens
ucaguauugagacacugucaa

SEQ ID NO: 507096 - RNA, 21 nt, Homo sapiens
ucaguguacucugaguccuca

SEQ ID NO: 507097 - RNA, 20 nt, Homo sapiens
ucaguguuauaaaaucugua

SEQ ID NO: 507098 - RNA, 21 nt, Homo sapiens
ucaguuacaguggcaguauug

SEQ ID NO: 507099 - RNA, 18 nt, Homo sapiens
ucaguuaggcagugcagu

SEQ ID NO: 507100 - RNA, 24 nt, Homo sapiens
ucauacaaaggacaguacacacuu

SEQ ID NO: 507101 - RNA, 18 nt, Homo sapiens
ucauacaaauaaugagcc

SEQ ID NO: 507102 - RNA, 20 nt, Homo sapiens
ucauacagugguauugcuag

SEQ ID NO: 507103 - RNA, 12 nt, Homo sapiens
ucauagcacaug

SEQ ID NO: 507104 - RNA, 17 nt, Homo sapiens
ucauaucuguaugccuc

SEQ ID NO: 507105 - RNA, 21 nt, Homo sapiens
ucaucaacaaagaaauauuau

SEQ ID NO: 507106 - RNA, 19 nt, Homo sapiens
ucauccucuuauaugugcc

SEQ ID NO: 507107 - RNA, 20 nt, Homo sapiens
uagcagagaagccugucugu

SEQ ID NO: 507108 - RNA, 21 nt, Homo sapiens
uagcccucuuucucucugugu

SEQ ID NO: 507109 - RNA, 14 nt, Homo sapiens
uagccucuccgccc

SEQ ID NO: 507110 - RNA, 17 nt, Homo sapiens
uagcgcucccuuuucac

SEQ ID NO: 507111 - RNA, 17 nt, Homo sapiens
uagcuaauuuaggaguu

SEQ ID NO: 507112 - RNA, 16 nt, Homo sapiens
uagcuuacugauuaac

SEQ ID NO: 507113 - RNA, 16 nt, Homo sapiens
uaggaaagcagugcag

SEQ ID NO: 507114 - RNA, 17 nt, Homo sapiens
uaggaaagcagugcagu

SEQ ID NO: 507115 - RNA, 17 nt, Homo sapiens
uaggagagaacagggau

SEQ ID NO: 507116 - RNA, 13 nt, Homo sapiens
uaggagcuuccag

SEQ ID NO: 507117 - RNA, 14 nt, Homo sapiens
uaggcagugcagua

SEQ ID NO: 507118 - RNA, 15 nt, Homo sapiens
uaggcagugcaguac

SEQ ID NO: 507119 - RNA, 16 nt, Homo sapiens
uagggcucuaauuucc

SEQ ID NO: 507120 - RNA, 17 nt, Homo sapiens
uaggguccuggcccucu

SEQ ID NO: 507121 - RNA, 12 nt, Homo sapiens
uaguaguacuua

SEQ ID NO: 507122 - RNA, 13 nt, Homo sapiens
uaguauaguuuuc

SEQ ID NO: 507123 - RNA, 18 nt, Homo sapiens
uagucaaucaaacaggga

SEQ ID NO: 507124 - RNA, 21 nt, Homo sapiens
uagucaaucaaacagggacac

SEQ ID NO: 507125 - RNA, 15 nt, Homo sapiens
uaguggucauuuggu

SEQ ID NO: 507126 - RNA, 16 nt, Homo sapiens
uagugucccuuaccug

SEQ ID NO: 507127 - RNA, 23 nt, Homo sapiens
uaguugagccagcagacauuguc

SEQ ID NO: 507128 - RNA, 23 nt, Homo sapiens
uaguugccguggcaacuguggaa

SEQ ID NO: 507129 - RNA, 20 nt, Homo sapiens
uauaaacuuuuuauucucag

SEQ ID NO: 507130 - RNA, 19 nt, Homo sapiens
uauacaaagcugucacuca

SEQ ID NO: 507131 - RNA, 16 nt, Homo sapiens
uauacuuccaugcacu

SEQ ID NO: 507132 - RNA, 18 nt, Homo sapiens
uauacuuccaugcacucu

SEQ ID NO: 507133 - RNA, 20 nt, Homo sapiens
uauauaaaauacacguguau

SEQ ID NO: 507134 - RNA, 16 nt, Homo sapiens
uauaugaaaacuaagu

SEQ ID NO: 507135 - RNA, 21 nt, Homo sapiens
uauauuuucugaguagcauau

SEQ ID NO: 507136 - RNA, 20 nt, Homo sapiens
uaucauccugccuucaugga

SEQ ID NO: 507137 - RNA, 20 nt, Homo sapiens
gccuucuccccuccaaguga

SEQ ID NO: 507138 - RNA, 13 nt, Homo sapiens
gccuugugaucac

SEQ ID NO: 507139 - RNA, 22 nt, Homo sapiens
gccuuuauuucuguaucugaca

SEQ ID NO: 507140 - RNA, 17 nt, Homo sapiens
gcgcaaaggugccucau

SEQ ID NO: 507141 - RNA, 16 nt, Homo sapiens
gcgcagagcugacccc

SEQ ID NO: 507142 - RNA, 18 nt, Homo sapiens
gcgcccaagcucagcuua

SEQ ID NO: 507143 - RNA, 16 nt, Homo sapiens
gcggggagcaugaaga

SEQ ID NO: 507144 - RNA, 14 nt, Homo sapiens
gcgucuccccaugc

SEQ ID NO: 507145 - RNA, 22 nt, Homo sapiens
gcgugggaguauguuauuucuc

SEQ ID NO: 507146 - RNA, 16 nt, Homo sapiens
gcguguacuaccccag

SEQ ID NO: 507147 - RNA, 17 nt, Homo sapiens
gcuaaccucucugaacu

SEQ ID NO: 507148 - RNA, 14 nt, Homo sapiens
gcuaagccugauga

SEQ ID NO: 507149 - RNA, 20 nt, Homo sapiens
gcuagaaagagaaaaagccc

SEQ ID NO: 507150 - RNA, 16 nt, Homo sapiens
gcuagacagaaaccaa

SEQ ID NO: 507151 - RNA, 13 nt, Homo sapiens
gcuaggcagggag

SEQ ID NO: 507152 - RNA, 12 nt, Homo sapiens
gcucaaucucag

SEQ ID NO: 507153 - RNA, 15 nt, Homo sapiens
gcucacgucugugag

SEQ ID NO: 507154 - RNA, 14 nt, Homo sapiens
gcucacuacauggg

SEQ ID NO: 507155 - RNA, 21 nt, Homo sapiens
gcucaguaacacagugcagug

SEQ ID NO: 507156 - RNA, 13 nt, Homo sapiens
gcuccauuccuga

SEQ ID NO: 507157 - RNA, 14 nt, Homo sapiens
gcuccugcugaccu

SEQ ID NO: 507158 - RNA, 18 nt, Homo sapiens
gcucucccucacaccucc

SEQ ID NO: 507159 - RNA, 20 nt, Homo sapiens
gcucuccgccccccggccug

SEQ ID NO: 507160 - RNA, 15 nt, Homo sapiens
gcucuggcaccacua

SEQ ID NO: 507161 - RNA, 19 nt, Homo sapiens
gcugauuuacuaacaguaa

SEQ ID NO: 507162 - RNA, 14 nt, Homo sapiens
gcugcaggaaucaa

SEQ ID NO: 507163 - RNA, 14 nt, Homo sapiens
gcugccaucuccag

SEQ ID NO: 507164 - RNA, 18 nt, Homo sapiens
auuuucuggguuugauac

SEQ ID NO: 507165 - RNA, 18 nt, Homo sapiens
auuuuuugucugugauaa

SEQ ID NO: 507166 - RNA, 12 nt, Homo sapiens
caaaaacugggu

SEQ ID NO: 507167 - RNA, 22 nt, Homo sapiens
caaaaauugaagagagauauau

SEQ ID NO: 507168 - RNA, 16 nt, Homo sapiens
caaaaccaacucucua

SEQ ID NO: 507169 - RNA, 15 nt, Homo sapiens
caaaagggacacaua

SEQ ID NO: 507170 - RNA, 17 nt, Homo sapiens
caaaaguauucaagaga

SEQ ID NO: 507171 - RNA, 16 nt, Homo sapiens
caaaauauaaaucaca

SEQ ID NO: 507172 - RNA, 24 nt, Homo sapiens
caaaauauaaaucacagauuucca

SEQ ID NO: 507173 - RNA, 16 nt, Homo sapiens
caaaaugaauugccuu

SEQ ID NO: 507174 - RNA, 17 nt, Homo sapiens
caaaauuuaugucauuu

SEQ ID NO: 507175 - RNA, 18 nt, Homo sapiens
caaacaaaaacuguugcu

SEQ ID NO: 507176 - RNA, 14 nt, Homo sapiens
caaacacagucacu

SEQ ID NO: 507177 - RNA, 19 nt, Homo sapiens
caaacacugcuuaaggaaa

SEQ ID NO: 507178 - RNA, 20 nt, Homo sapiens
caaaccuacugcccacauuu

SEQ ID NO: 507179 - RNA, 18 nt, Homo sapiens
caaacguuuuuccagucu

SEQ ID NO: 507180 - RNA, 22 nt, Homo sapiens
caaacuuaacagaucacaugcc

SEQ ID NO: 507181 - RNA, 21 nt, Homo sapiens
caaagaacugccccaucuccu

SEQ ID NO: 507182 - RNA, 22 nt, Homo sapiens
caaagaagacucaguaugcuuu

SEQ ID NO: 507183 - RNA, 22 nt, Homo sapiens
caaagaggccaguacuuugcca

SEQ ID NO: 507184 - RNA, 18 nt, Homo sapiens
caaagccaucuuccugcc

SEQ ID NO: 507185 - RNA, 13 nt, Homo sapiens
caaaggacaguac

SEQ ID NO: 507186 - RNA, 16 nt, Homo sapiens
caaaggcuucuuggcu

SEQ ID NO: 507187 - RNA, 20 nt, Homo sapiens
caaagggaaggcugcugugu

SEQ ID NO: 507188 - RNA, 23 nt, Homo sapiens
caaaguuaaacgugaugugcuca

SEQ ID NO: 507189 - RNA, 22 nt, Homo sapiens
caaauaaaucauccucaugucc

SEQ ID NO: 507190 - RNA, 16 nt, Homo sapiens
caaauaacaguggcaa

SEQ ID NO: 507191 - RNA, 18 nt, Homo sapiens
caaauaagcaucugugua

SEQ ID NO: 507192 - RNA, 18 nt, Homo sapiens
caaauacacauacauaua

SEQ ID NO: 507193 - RNA, 14 nt, Homo sapiens
caaauacaugccuu

SEQ ID NO: 507194 - RNA, 17 nt, Homo sapiens
caaaucauuuugaugua

SEQ ID NO: 507195 - RNA, 21 nt, Homo sapiens
caaaucugcuuucauccagcc

SEQ ID NO: 507196 - RNA, 17 nt, Homo sapiens
caaaugcuacucaguau

SEQ ID NO: 507197 - RNA, 19 nt, Homo sapiens
caaauggcuuguucaguca

SEQ ID NO: 507198 - RNA, 16 nt, Homo sapiens
caaaugucauuucaua

SEQ ID NO: 507199 - RNA, 17 nt, Homo sapiens
caaaugucauuucauac

SEQ ID NO: 507200 - RNA, 21 nt, Homo sapiens
caaauguuauucaauaacuau

SEQ ID NO: 507201 - RNA, 15 nt, Homo sapiens
caacagcgaagccag

SEQ ID NO: 507202 - RNA, 17 nt, Homo sapiens
caaccagagcacuguau

SEQ ID NO: 507203 - RNA, 20 nt, Homo sapiens
caaccauuuaacugcagugu

SEQ ID NO: 507204 - RNA, 16 nt, Homo sapiens
caacccugugaucuau

SEQ ID NO: 507205 - RNA, 16 nt, Homo sapiens
caaccgugacugcaag

SEQ ID NO: 507206 - RNA, 23 nt, Homo sapiens
caaccuccccugguccugcacug

SEQ ID NO: 507207 - RNA, 16 nt, Homo sapiens
caaccuuaacuuacua

SEQ ID NO: 507208 - RNA, 22 nt, Homo sapiens
caacuugaaauuauaucugugg

SEQ ID NO: 507209 - RNA, 21 nt, Homo sapiens
caagaagugggauucaggaau

SEQ ID NO: 507210 - RNA, 23 nt, Homo sapiens
caagagcguucgugcagugcccu

SEQ ID NO: 507211 - RNA, 12 nt, Homo sapiens
caagauagcucc

SEQ ID NO: 507212 - RNA, 13 nt, Homo sapiens
caagcagacacac

SEQ ID NO: 507213 - RNA, 18 nt, Homo sapiens
caagccaggguuccagac

SEQ ID NO: 507214 - RNA, 15 nt, Homo sapiens
caaggcugcagugag

SEQ ID NO: 507215 - RNA, 16 nt, Homo sapiens
caagguauugagacau

SEQ ID NO: 507216 - RNA, 18 nt, Homo sapiens
caaggucugaacccuucc

SEQ ID NO: 507217 - RNA, 18 nt, Homo sapiens
caagucagcacuaccucc

SEQ ID NO: 507218 - RNA, 13 nt, Homo sapiens
caagucugugaaa

SEQ ID NO: 507219 - RNA, 19 nt, Homo sapiens
caaguucauucauacucaa

SEQ ID NO: 507220 - RNA, 16 nt, Homo sapiens
caaguuggagugcagu

SEQ ID NO: 507221 - RNA, 17 nt, Homo sapiens
caauaaggcagugcagu

SEQ ID NO: 507222 - RNA, 22 nt, Homo sapiens
caauaaggcagugcagugcuca

SEQ ID NO: 507223 - RNA, 13 nt, Homo sapiens
caauacccacugc

SEQ ID NO: 507224 - RNA, 16 nt, Homo sapiens
caaugaaugaacaaau

SEQ ID NO: 507225 - RNA, 17 nt, Homo sapiens
caauggugaacugucau

SEQ ID NO: 507226 - RNA, 22 nt, Homo sapiens
caauuaacuccguuuccaaaua

SEQ ID NO: 507227 - RNA, 16 nt, Homo sapiens
caauuaucaaaaaaca

SEQ ID NO: 507228 - RNA, 18 nt, Homo sapiens
caauuaucaaaaaacaga

SEQ ID NO: 507229 - RNA, 23 nt, Homo sapiens
caauucugaaggggaaaaccuca

SEQ ID NO: 507230 - RNA, 16 nt, Homo sapiens
caauucuuuguugcuu

SEQ ID NO: 507231 - RNA, 14 nt, Homo sapiens
caauuguaaugcau

SEQ ID NO: 507232 - RNA, 15 nt, Homo sapiens
cacaaagcuauuuaa

SEQ ID NO: 507233 - RNA, 17 nt, Homo sapiens
cacaaccuccuccucca

SEQ ID NO: 507234 - RNA, 16 nt, Homo sapiens
cacaacuuugcuuuua

SEQ ID NO: 507235 - RNA, 16 nt, Homo sapiens
cacaagggcaguggaa

SEQ ID NO: 507236 - RNA, 19 nt, Homo sapiens
cacaauaaaagacauccac

SEQ ID NO: 507237 - RNA, 23 nt, Homo sapiens
cacacaaagugaaauuaguauuu

SEQ ID NO: 507238 - RNA, 13 nt, Homo sapiens
cacaccucccuuc

SEQ ID NO: 507239 - RNA, 21 nt, Homo sapiens
cacacucucuucuuacuguau

SEQ ID NO: 507240 - RNA, 13 nt, Homo sapiens
cacacugagcaag

SEQ ID NO: 507241 - RNA, 21 nt, Homo sapiens
cacagaggauggcuuccccau

SEQ ID NO: 507242 - RNA, 13 nt, Homo sapiens
cacagauuuccaa

SEQ ID NO: 507243 - RNA, 15 nt, Homo sapiens
cacagcaugcauuua

SEQ ID NO: 507244 - RNA, 18 nt, Homo sapiens
cacagccaauaaacacca

SEQ ID NO: 507245 - RNA, 17 nt, Homo sapiens
cacaggagcguguccua

SEQ ID NO: 507246 - RNA, 17 nt, Homo sapiens
cacagggacucuccaua

SEQ ID NO: 507247 - RNA, 12 nt, Homo sapiens
cacagugcagua

SEQ ID NO: 507248 - RNA, 18 nt, Homo sapiens
cacauacauauauacauu

SEQ ID NO: 507249 - RNA, 16 nt, Homo sapiens
cacauaguguuuguaa

SEQ ID NO: 507250 - RNA, 20 nt, Homo sapiens
cacauauauaccaagccccu

SEQ ID NO: 507251 - RNA, 15 nt, Homo sapiens
cacaucacuuaccac

SEQ ID NO: 507252 - RNA, 19 nt, Homo sapiens
cacaugccccucuuagaag

SEQ ID NO: 507253 - RNA, 15 nt, Homo sapiens
cacauuggcagugug

SEQ ID NO: 507254 - RNA, 15 nt, Homo sapiens
cacauuucucugcaa

SEQ ID NO: 507255 - RNA, 21 nt, Homo sapiens
caccacuuucccacacuguga

SEQ ID NO: 507256 - RNA, 15 nt, Homo sapiens
caccagccugagcca

SEQ ID NO: 507257 - RNA, 21 nt, Homo sapiens
caccagugccgccugugccca

SEQ ID NO: 507258 - RNA, 15 nt, Homo sapiens
caccauggcuuuaaa

SEQ ID NO: 507259 - RNA, 22 nt, Homo sapiens
cacccuugaaaauauaugacuu

SEQ ID NO: 507260 - RNA, 16 nt, Homo sapiens
caccgagaggaaaaag

SEQ ID NO: 507261 - RNA, 22 nt, Homo sapiens
caccgagaggaaaaaggcuucu

SEQ ID NO: 507262 - RNA, 20 nt, Homo sapiens
cagaagaaaaacacugagaa

SEQ ID NO: 507263 - RNA, 20 nt, Homo sapiens
cagaagaaagauugcuauaa

SEQ ID NO: 507264 - RNA, 15 nt, Homo sapiens
cagaagcagcagcua

SEQ ID NO: 507265 - RNA, 20 nt, Homo sapiens
cagaagcaguagacagaugu

SEQ ID NO: 507266 - RNA, 15 nt, Homo sapiens
cagaagggagugaaa

SEQ ID NO: 507267 - RNA, 12 nt, Homo sapiens
cagaauagcuga

SEQ ID NO: 507268 - RNA, 12 nt, Homo sapiens
cagaaugagaug

SEQ ID NO: 507269 - RNA, 18 nt, Homo sapiens
cagaauggggacaucuug

SEQ ID NO: 507270 - RNA, 15 nt, Homo sapiens
cagacaaauguaaca

SEQ ID NO: 507271 - RNA, 20 nt, Homo sapiens
cagacacacaagcagacaca

SEQ ID NO: 507272 - RNA, 16 nt, Homo sapiens
cagacacacacauaua

SEQ ID NO: 507273 - RNA, 22 nt, Homo sapiens
cagagcugacccccugcugcca

SEQ ID NO: 507274 - RNA, 22 nt, Homo sapiens
cagagcuuuacagugccacgac

SEQ ID NO: 507275 - RNA, 16 nt, Homo sapiens
cagaggauggcuuccc

SEQ ID NO: 507276 - RNA, 20 nt, Homo sapiens
cagaggggugcgcagagcug

SEQ ID NO: 507277 - RNA, 18 nt, Homo sapiens
cagagucucuaguuccau

SEQ ID NO: 507278 - RNA, 15 nt, Homo sapiens
cagagucuugcuacc

SEQ ID NO: 507279 - RNA, 15 nt, Homo sapiens
cagaucccucuccag

SEQ ID NO: 507280 - RNA, 12 nt, Homo sapiens
cagaugcacuga

SEQ ID NO: 507281 - RNA, 21 nt, Homo sapiens
cagaugcccaguaucauacgu

SEQ ID NO: 507282 - RNA, 20 nt, Homo sapiens
cagauguacaauuuagcuua

SEQ ID NO: 507283 - RNA, 17 nt, Homo sapiens
cagauguuggugcaaua

SEQ ID NO: 507284 - RNA, 16 nt, Homo sapiens
cagauguuuccaagau

SEQ ID NO: 507285 - RNA, 15 nt, Homo sapiens
cagcaauggcagauu

SEQ ID NO: 507286 - RNA, 12 nt, Homo sapiens
cagcacaguacu

SEQ ID NO: 507287 - RNA, 14 nt, Homo sapiens
cagcaccugucacc

SEQ ID NO: 507288 - RNA, 21 nt, Homo sapiens
cagcacuucccaaagugcacu

SEQ ID NO: 507289 - RNA, 14 nt, Homo sapiens
cagcagcagcaguu

SEQ ID NO: 507290 - RNA, 19 nt, Homo sapiens
cagcagucaacuccagggu

SEQ ID NO: 507291 - RNA, 11 nt, Homo sapiens
cagcaguccaa

SEQ ID NO: 507292 - RNA, 18 nt, Homo sapiens
cagcaguuugugaucugu

SEQ ID NO: 507293 - RNA, 14 nt, Homo sapiens
cagcauauauauaa

SEQ ID NO: 507294 - RNA, 17 nt, Homo sapiens
cagcaugcauuuagcau

SEQ ID NO: 507295 - RNA, 17 nt, Homo sapiens
cagcauuucagcuguga

SEQ ID NO: 507296 - RNA, 21 nt, Homo sapiens
cagccccauccuucccgcagc

SEQ ID NO: 507297 - RNA, 13 nt, Homo sapiens
cagcccuugcucu

SEQ ID NO: 507298 - RNA, 14 nt, Homo sapiens
cagccuaccagaga

SEQ ID NO: 507299 - RNA, 16 nt, Homo sapiens
cagcuaagccugauga

SEQ ID NO: 507300 - RNA, 17 nt, Homo sapiens
cagcuaagccugaugau

SEQ ID NO: 507301 - RNA, 21 nt, Homo sapiens
cagcuaggcagggagggggcu

SEQ ID NO: 507302 - RNA, 20 nt, Homo sapiens
cagcucucccucacaccucc

SEQ ID NO: 507303 - RNA, 23 nt, Homo sapiens
cagcucuggaugaaggcaaaaac

SEQ ID NO: 507304 - RNA, 15 nt, Homo sapiens
cagcuucccugaaca

SEQ ID NO: 507305 - RNA, 20 nt, Homo sapiens
cagcuucccugaacacucau

SEQ ID NO: 507306 - RNA, 18 nt, Homo sapiens
caggaaauaucugugaag

SEQ ID NO: 507307 - RNA, 21 nt, Homo sapiens
caggaaggggugucaguacuu

SEQ ID NO: 507308 - RNA, 19 nt, Homo sapiens
caggagacuccaaggagcu

SEQ ID NO: 507309 - RNA, 19 nt, Homo sapiens
caggagcauguccuauccc

SEQ ID NO: 507310 - RNA, 21 nt, Homo sapiens
caggagcguguacuaccccag

SEQ ID NO: 507311 - RNA, 19 nt, Homo sapiens
caggagcguguccuauccc

SEQ ID NO: 507312 - RNA, 23 nt, Homo sapiens
caggagucagugcccauguguau

SEQ ID NO: 507313 - RNA, 12 nt, Homo sapiens
caggaugcauau

SEQ ID NO: 507314 - RNA, 12 nt, Homo sapiens
caggauucuccu

SEQ ID NO: 507315 - RNA, 16 nt, Homo sapiens
caggcagcuaggcagg

SEQ ID NO: 507316 - RNA, 17 nt, Homo sapiens
caggcaugcaccagugc

SEQ ID NO: 507317 - RNA, 16 nt, Homo sapiens
caggcccagccucuug

SEQ ID NO: 507318 - RNA, 14 nt, Homo sapiens
caggccucagggac

SEQ ID NO: 507319 - RNA, 21 nt, Homo sapiens
cagggacagccugcacagugg

SEQ ID NO: 507320 - RNA, 17 nt, Homo sapiens
cagggaucauagcugac

SEQ ID NO: 507321 - RNA, 21 nt, Homo sapiens
cagggaucauagcugacucag

SEQ ID NO: 507322 - RNA, 22 nt, Homo sapiens
cagguaucugaugauguucuga

SEQ ID NO: 507323 - RNA, 21 nt, Homo sapiens
cagguugugugugugugcagu

SEQ ID NO: 507324 - RNA, 22 nt, Homo sapiens
cagguugugugugugugcagug

SEQ ID NO: 507325 - RNA, 23 nt, Homo sapiens
cagguugugugugugugcaguga

SEQ ID NO: 507326 - RNA, 15 nt, Homo sapiens
caguaaagcaaugca

SEQ ID NO: 507327 - RNA, 15 nt, Homo sapiens
caguaaaucagugca

SEQ ID NO: 507328 - RNA, 17 nt, Homo sapiens
caguaacacagugcagu

SEQ ID NO: 507329 - RNA, 14 nt, Homo sapiens
caguaacagugcag

SEQ ID NO: 507330 - RNA, 16 nt, Homo sapiens
caguaacagugcagua

SEQ ID NO: 507331 - RNA, 22 nt, Homo sapiens
caguaagacagugcagugcuca

SEQ ID NO: 507332 - RNA, 14 nt, Homo sapiens
caguaagauagguu

SEQ ID NO: 507333 - RNA, 23 nt, Homo sapiens
caguaagaucaagcuccaucuua

SEQ ID NO: 507334 - RNA, 15 nt, Homo sapiens
caguaaggcagugaa

SEQ ID NO: 507335 - RNA, 18 nt, Homo sapiens
caguaaggcagugcagua

SEQ ID NO: 507336 - RNA, 19 nt, Homo sapiens
caguaaucaguuugcuaac

SEQ ID NO: 507337 - RNA, 22 nt, Homo sapiens
caguacuauaaguacugaguac

SEQ ID NO: 507338 - RNA, 19 nt, Homo sapiens
caguacucaggcagugcaa

SEQ ID NO: 507339 - RNA, 12 nt, Homo sapiens
caguagacagau

SEQ ID NO: 507340 - RNA, 23 nt, Homo sapiens
caguauuguuuugguuugcuacu

SEQ ID NO: 507341 - RNA, 13 nt, Homo sapiens
caguccaagguau

SEQ ID NO: 507342 - RNA, 16 nt, Homo sapiens
caguccaagguauuga

SEQ ID NO: 507343 - RNA, 15 nt, Homo sapiens
cagucuggugcccag

SEQ ID NO: 507344 - RNA, 14 nt, Homo sapiens
cagugaaguacuca

SEQ ID NO: 507345 - RNA, 14 nt, Homo sapiens
cagugcauguugcc

SEQ ID NO: 507346 - RNA, 16 nt, Homo sapiens
cagugugcugaucauu

SEQ ID NO: 507347 - RNA, 13 nt, Homo sapiens
cagugugucacac

SEQ ID NO: 507348 - RNA, 16 nt, Homo sapiens
cagugugucacacuga

SEQ ID NO: 507349 - RNA, 17 nt, Homo sapiens
caguuaggcagugcagu

SEQ ID NO: 507350 - RNA, 18 nt, Homo sapiens
caguuaggcagugcagua

SEQ ID NO: 507351 - RNA, 13 nt, Homo sapiens
caguuaggugcug

SEQ ID NO: 507352 - RNA, 22 nt, Homo sapiens
caguuguaacauucuauuucaa

SEQ ID NO: 507353 - RNA, 18 nt, Homo sapiens
caguuuauuccugugaac

SEQ ID NO: 507354 - RNA, 12 nt, Homo sapiens
cauaaacacuuc

SEQ ID NO: 507355 - RNA, 14 nt, Homo sapiens
cauaaacacuucuc

SEQ ID NO: 507356 - RNA, 15 nt, Homo sapiens
cauaaacacuucucc

SEQ ID NO: 507357 - RNA, 14 nt, Homo sapiens
cauaaaucuuccaa

SEQ ID NO: 507358 - RNA, 17 nt, Homo sapiens
cauaaauuauuucuaaa

SEQ ID NO: 507359 - RNA, 14 nt, Homo sapiens
cuuugaaaacucau

SEQ ID NO: 507360 - RNA, 21 nt, Homo sapiens
cuuugccaucaagaaacauuc

SEQ ID NO: 507361 - RNA, 17 nt, Homo sapiens
cuuugccauccuugcac

SEQ ID NO: 507362 - RNA, 19 nt, Homo sapiens
cuuuguaccuguaggucua

SEQ ID NO: 507363 - RNA, 14 nt, Homo sapiens
cuuuuaaaucaaaa

SEQ ID NO: 507364 - RNA, 20 nt, Homo sapiens
cuuuuauucauuagcuguga

SEQ ID NO: 507365 - RNA, 14 nt, Homo sapiens
cuuuuucuaccuuu

SEQ ID NO: 507366 - RNA, 19 nt, Homo sapiens
cuuuuuuaagacucaauca

SEQ ID NO: 507367 - RNA, 17 nt, Homo sapiens
cuuuuuuuaaguguucu

SEQ ID NO: 507368 - RNA, 13 nt, Homo sapiens
gaaaaaggcuucu

SEQ ID NO: 507369 - RNA, 19 nt, Homo sapiens
gaaaaccuaccacauucac

SEQ ID NO: 507370 - RNA, 22 nt, Homo sapiens
gaaaaccucuuucggaaaugau

SEQ ID NO: 507371 - RNA, 23 nt, Homo sapiens
gaaaacgauuuaauuuauucuaa

SEQ ID NO: 507372 - RNA, 17 nt, Homo sapiens
gaaaacuaaguucucua

SEQ ID NO: 507373 - RNA, 12 nt, Homo sapiens
gaaaagcacuuu

SEQ ID NO: 507374 - RNA, 15 nt, Homo sapiens
gaaaaggcuugaguc

SEQ ID NO: 507375 - RNA, 21 nt, Homo sapiens
gaaaaggcuugagucuggaua

SEQ ID NO: 507376 - RNA, 22 nt, Homo sapiens
gaaaaggcuugagucuggauaa

SEQ ID NO: 507377 - RNA, 13 nt, Homo sapiens
gaaaauaaauaca

SEQ ID NO: 507378 - RNA, 23 nt, Homo sapiens
gaaaauaguggcaggacuguccc

SEQ ID NO: 507379 - RNA, 22 nt, Homo sapiens
gaaaauccugacaaaagggaca

SEQ ID NO: 507380 - RNA, 22 nt, Homo sapiens
gaaaaugcuuucucaugcauag

SEQ ID NO: 507381 - RNA, 21 nt, Homo sapiens
gaaaauuggacuguaaucaua

SEQ ID NO: 507382 - RNA, 17 nt, Homo sapiens
gaaacaauuucuguguc

SEQ ID NO: 507383 - RNA, 14 nt, Homo sapiens
gaaaccccugacac

SEQ ID NO: 507384 - RNA, 18 nt, Homo sapiens
caguaacacagugcagua

SEQ ID NO: 507385 - RNA, 22 nt, Homo sapiens
caguaacacagugcaguacuca

SEQ ID NO: 507386 - RNA, 13 nt, Homo sapiens
caguaacagugaa

SEQ ID NO: 507387 - RNA, 15 nt, Homo sapiens
caguaacagugcagu

SEQ ID NO: 507388 - RNA, 20 nt, Homo sapiens
caguaacaguguaguacuca

SEQ ID NO: 507389 - RNA, 17 nt, Homo sapiens
caguaagacagugcagu

SEQ ID NO: 507390 - RNA, 18 nt, Homo sapiens
caguaagacagugcagug

SEQ ID NO: 507391 - RNA, 17 nt, Homo sapiens
caguaaggcagugcaau

SEQ ID NO: 507392 - RNA, 17 nt, Homo sapiens
caguaaggcagugcagu

SEQ ID NO: 507393 - RNA, 21 nt, Homo sapiens
caguaauacaguacaguacuc

SEQ ID NO: 507394 - RNA, 19 nt, Homo sapiens
caguacucaggcagugcag

SEQ ID NO: 507395 - RNA, 23 nt, Homo sapiens
caguagcauuuuaauaguuucua

SEQ ID NO: 507396 - RNA, 12 nt, Homo sapiens
caguaugacaua

SEQ ID NO: 507397 - RNA, 18 nt, Homo sapiens
caguaugguacucaguaa

SEQ ID NO: 507398 - RNA, 21 nt, Homo sapiens
cagucacuguugguuccuucu

SEQ ID NO: 507399 - RNA, 21 nt, Homo sapiens
cagucucuauuugauuugcaa

SEQ ID NO: 507400 - RNA, 18 nt, Homo sapiens
cagugaaguacucaguaa

SEQ ID NO: 507401 - RNA, 18 nt, Homo sapiens
cagugcauguugccauga

SEQ ID NO: 507402 - RNA, 18 nt, Homo sapiens
cagugccacgacauggcu

SEQ ID NO: 507403 - RNA, 13 nt, Homo sapiens
cagugccuaacuc

SEQ ID NO: 507404 - RNA, 18 nt, Homo sapiens
cagugcgguacucaguaa

SEQ ID NO: 507405 - RNA, 20 nt, Homo sapiens
caguggcugggggacugcuu

SEQ ID NO: 507406 - RNA, 18 nt, Homo sapiens
caguguaagaaaauugga

SEQ ID NO: 507407 - RNA, 20 nt, Homo sapiens
caguguacucugaguccuca

SEQ ID NO: 507408 - RNA, 12 nt, Homo sapiens
caguguuuagaa

SEQ ID NO: 507409 - RNA, 18 nt, Homo sapiens
caguguuuagaagagccu

SEQ ID NO: 507410 - RNA, 23 nt, Homo sapiens
caguguuuagaagagccugacug

SEQ ID NO: 507411 - RNA, 21 nt, Homo sapiens
caguuaauuuauuauuuuguu

SEQ ID NO: 507412 - RNA, 22 nt, Homo sapiens
caguuagcccggccaaggacac

SEQ ID NO: 507413 - RNA, 14 nt, Homo sapiens
caguuaggugcuga

SEQ ID NO: 507414 - RNA, 18 nt, Homo sapiens
caguucccucagcccuca

SEQ ID NO: 507415 - RNA, 19 nt, Homo sapiens
caguucccucagcccucau

SEQ ID NO: 507416 - RNA, 12 nt, Homo sapiens
caguucugauga

SEQ ID NO: 507417 - RNA, 20 nt, Homo sapiens
cauaaacacuucuccuuaac

SEQ ID NO: 507418 - RNA, 18 nt, Homo sapiens
cauaaauuauuucuaaaa

SEQ ID NO: 507419 - RNA, 14 nt, Homo sapiens
cauaaccgcacaga

SEQ ID NO: 507420 - RNA, 18 nt, Homo sapiens
cauaaccgcacagacauu

SEQ ID NO: 507421 - RNA, 16 nt, Homo sapiens
cauaagauuauauaca

SEQ ID NO: 507422 - RNA, 21 nt, Homo sapiens
cauaagcacauccaacuacuc

SEQ ID NO: 507423 - RNA, 20 nt, Homo sapiens
cauacaacauauacuuccau

SEQ ID NO: 507424 - RNA, 16 nt, Homo sapiens
cauacauauauacauu

SEQ ID NO: 507425 - RNA, 15 nt, Homo sapiens
cauagaaauacauca

SEQ ID NO: 507426 - RNA, 18 nt, Homo sapiens
cauagaaauacaucaaua

SEQ ID NO: 507427 - RNA, 20 nt, Homo sapiens
cauagaugacccccagguau

SEQ ID NO: 507428 - RNA, 17 nt, Homo sapiens
cauaguucugcaauaac

SEQ ID NO: 507429 - RNA, 17 nt, Homo sapiens
cauauaaacacaguaag

SEQ ID NO: 507430 - RNA, 15 nt, Homo sapiens
cauauauacauacgc

SEQ ID NO: 507431 - RNA, 16 nt, Homo sapiens
cauauauacauacgca

SEQ ID NO: 507432 - RNA, 12 nt, Homo sapiens
cauaucauucag

SEQ ID NO: 507433 - RNA, 13 nt, Homo sapiens
cauaugucuucaa

SEQ ID NO: 507434 - RNA, 19 nt, Homo sapiens
cauauuaaagaaagucaua

SEQ ID NO: 507435 - RNA, 20 nt, Homo sapiens
cauauuauaucagacugcuu

SEQ ID NO: 507436 - RNA, 17 nt, Homo sapiens
caucaagaaacauucag

SEQ ID NO: 507437 - RNA, 18 nt, Homo sapiens
caucaauuggguuuugau

SEQ ID NO: 507438 - RNA, 22 nt, Homo sapiens
caucauggagggagaagaaaga

SEQ ID NO: 507439 - RNA, 23 nt, Homo sapiens
caucauuccugucagagcuuuca

SEQ ID NO: 507440 - RNA, 16 nt, Homo sapiens
caucuagucucagugc

SEQ ID NO: 507441 - RNA, 23 nt, Homo sapiens
caucucagcaaucacaagccaag

SEQ ID NO: 507442 - RNA, 13 nt, Homo sapiens
caucucuguaaaa

SEQ ID NO: 507443 - RNA, 15 nt, Homo sapiens
caucucuguaaaaag

SEQ ID NO: 507444 - RNA, 15 nt, Homo sapiens
caucugaggagucca

SEQ ID NO: 507445 - RNA, 17 nt, Homo sapiens
caucugaggaguccaaa

SEQ ID NO: 507446 - RNA, 20 nt, Homo sapiens
caucuggagcugaagcguua

SEQ ID NO: 507447 - RNA, 22 nt, Homo sapiens
caucuguuccagaaaaacauuu

SEQ ID NO: 507448 - RNA, 21 nt, Homo sapiens
caugacccagccugaaagaua

SEQ ID NO: 507449 - RNA, 20 nt, Homo sapiens
caugcacucuuuugagcagu

SEQ ID NO: 507450 - RNA, 16 nt, Homo sapiens
caugcauuuagcauga

SEQ ID NO: 507451 - RNA, 20 nt, Homo sapiens
caugccaucuccacccugag

SEQ ID NO: 507452 - RNA, 14 nt, Homo sapiens
caugcucaguauug

SEQ ID NO: 507453 - RNA, 14 nt, Homo sapiens
cauggaaugcaauu

SEQ ID NO: 507454 - RNA, 21 nt, Homo sapiens
cauggcagcaugcgaugucau

SEQ ID NO: 507455 - RNA, 15 nt, Homo sapiens
cauggccuucccucc

SEQ ID NO: 507456 - RNA, 13 nt, Homo sapiens
caugggacugugc

SEQ ID NO: 507457 - RNA, 17 nt, Homo sapiens
caugguagacugugaca

SEQ ID NO: 507458 - RNA, 16 nt, Homo sapiens
caugugcgaacacagu

SEQ ID NO: 507459 - RNA, 18 nt, Homo sapiens
caugugcugcuguggcau

SEQ ID NO: 507460 - RNA, 22 nt, Homo sapiens
cauguggcuaaaugccuaauaa

SEQ ID NO: 507461 - RNA, 19 nt, Homo sapiens
cauguguuucuguguagua

SEQ ID NO: 507462 - RNA, 22 nt, Homo sapiens
cauguugccaugaggccuuucc

SEQ ID NO: 507463 - RNA, 21 nt, Homo sapiens
cauguuugacuuuagacugua

SEQ ID NO: 507464 - RNA, 12 nt, Homo sapiens
cauuaagcacac

SEQ ID NO: 507465 - RNA, 23 nt, Homo sapiens
cauuaaugagauguuauuacugu

SEQ ID NO: 507466 - RNA, 12 nt, Homo sapiens
cauucagugaca

SEQ ID NO: 507467 - RNA, 23 nt, Homo sapiens
cauucguccuuagaauacuguau

SEQ ID NO: 507468 - RNA, 19 nt, Homo sapiens
cauucuugggaggacacuu

SEQ ID NO: 507469 - RNA, 14 nt, Homo sapiens
cauugaaacuguau

SEQ ID NO: 507470 - RNA, 12 nt, Homo sapiens
cauugauuggua

SEQ ID NO: 507471 - RNA, 22 nt, Homo sapiens
cauugauugguaguucgaagaa

SEQ ID NO: 507472 - RNA, 20 nt, Homo sapiens
cauugcuucauuaaaacaag

SEQ ID NO: 507473 - RNA, 22 nt, Homo sapiens
cauuguucagaaaagcaccucu

SEQ ID NO: 507474 - RNA, 15 nt, Homo sapiens
cauuuacaacuucca

SEQ ID NO: 507475 - RNA, 22 nt, Homo sapiens
cauuuaggaaagcagugcagua

SEQ ID NO: 507476 - RNA, 15 nt, Homo sapiens
cauuuaugcaugaga

SEQ ID NO: 507477 - RNA, 15 nt, Homo sapiens
cauuuauguacaaaa

SEQ ID NO: 507478 - RNA, 17 nt, Homo sapiens
cauuuauuuaucaauaa

SEQ ID NO: 507479 - RNA, 13 nt, Homo sapiens
cauuucauacaaa

SEQ ID NO: 507480 - RNA, 21 nt, Homo sapiens
cauuuccccugugguuuguua

SEQ ID NO: 507481 - RNA, 16 nt, Homo sapiens
cauuucucugcaaaau

SEQ ID NO: 507482 - RNA, 15 nt, Homo sapiens
cauuucuggugugua

SEQ ID NO: 507483 - RNA, 18 nt, Homo sapiens
cauuucuugguaugauca

SEQ ID NO: 507484 - RNA, 17 nt, Homo sapiens
cauuugacuuucugucu

SEQ ID NO: 507485 - RNA, 11 nt, Homo sapiens
cauuugcugaa

SEQ ID NO: 507486 - RNA, 15 nt, Homo sapiens
cauuuuucuacugcu

SEQ ID NO: 507487 - RNA, 22 nt, Homo sapiens
cauuuuuguaauauaagacaag

SEQ ID NO: 507488 - RNA, 19 nt, Homo sapiens
agggacagccugcacagug

SEQ ID NO: 507489 - RNA, 15 nt, Homo sapiens
agggagaagaaagaa

SEQ ID NO: 507490 - RNA, 16 nt, Homo sapiens
agggcagaauagcuga

SEQ ID NO: 507491 - RNA, 17 nt, Homo sapiens
agggcaggguucuagaa

SEQ ID NO: 507492 - RNA, 20 nt, Homo sapiens
agggccuucuccacagggac

SEQ ID NO: 507493 - RNA, 15 nt, Homo sapiens
aggggccagaccacg

SEQ ID NO: 507494 - RNA, 14 nt, Homo sapiens
agggugaaccaagc

SEQ ID NO: 507495 - RNA, 17 nt, Homo sapiens
agggugccccugggaac

SEQ ID NO: 507496 - RNA, 15 nt, Homo sapiens
agggugucuguaauc

SEQ ID NO: 507497 - RNA, 22 nt, Homo sapiens
aggguguucgguugcgugcaug

SEQ ID NO: 507498 - RNA, 22 nt, Homo sapiens
agguaaauaaucauacacagaa

SEQ ID NO: 507499 - RNA, 12 nt, Homo sapiens
agguaucugaug

SEQ ID NO: 507500 - RNA, 23 nt, Homo sapiens
aggucuccaccccucaagccagg

SEQ ID NO: 507501 - RNA, 18 nt, Homo sapiens
aggucuggcgccaggggc

SEQ ID NO: 507502 - RNA, 11 nt, Homo sapiens
aggugccucau

SEQ ID NO: 507503 - RNA, 19 nt, Homo sapiens
agguggcagggaagggugc

SEQ ID NO: 507504 - RNA, 15 nt, Homo sapiens
guuucuuugcugcaa

SEQ ID NO: 507505 - RNA, 18 nt, Homo sapiens
guuugcuacuucccucac

SEQ ID NO: 507506 - RNA, 22 nt, Homo sapiens
uaaaaaacuucccaacucacuu

SEQ ID NO: 507507 - RNA, 16 nt, Homo sapiens
uaaaacacccuugaaa

SEQ ID NO: 507508 - RNA, 12 nt, Homo sapiens
uaaaacugugac

SEQ ID NO: 507509 - RNA, 14 nt, Homo sapiens
uaaaacugugacau

SEQ ID NO: 507510 - RNA, 15 nt, Homo sapiens
uaaaagccucuggug

SEQ ID NO: 507511 - RNA, 13 nt, Homo sapiens
uaaaauacuuauu

SEQ ID NO: 507512 - RNA, 19 nt, Homo sapiens
uaaaaugagucacuuacuu

SEQ ID NO: 507513 - RNA, 12 nt, Homo sapiens
uaaaaugauuaa

SEQ ID NO: 507514 - RNA, 18 nt, Homo sapiens
uaaaaugcuaaaugucaa

SEQ ID NO: 507515 - RNA, 16 nt, Homo sapiens
uaaaauggcauuuagc

SEQ ID NO: 507516 - RNA, 18 nt, Homo sapiens
uaaaaugugaaguaauag

SEQ ID NO: 507517 - RNA, 13 nt, Homo sapiens
uaaacacaguaag

SEQ ID NO: 507518 - RNA, 17 nt, Homo sapiens
uaaacacuucuccuuaa

SEQ ID NO: 507519 - RNA, 18 nt, Homo sapiens
uaaacucagucaaaugua

SEQ ID NO: 507520 - RNA, 22 nt, Homo sapiens
uaaacuuucccuauacuuaggc

SEQ ID NO: 507521 - RNA, 22 nt, Homo sapiens
uaaagagcacguuuuccauuau

SEQ ID NO: 507522 - RNA, 16 nt, Homo sapiens
uaaagccuugugauca

SEQ ID NO: 507523 - RNA, 16 nt, Homo sapiens
uaaaguuccaugaaga

SEQ ID NO: 507524 - RNA, 16 nt, Homo sapiens
uaaauauauauuuauc

SEQ ID NO: 507525 - RNA, 20 nt, Homo sapiens
uaaauaucauccugccuuca

SEQ ID NO: 507526 - RNA, 22 nt, Homo sapiens
uaaaucugccuaguuuugauga

SEQ ID NO: 507527 - RNA, 15 nt, Homo sapiens
uaaaucuuccaaagu

SEQ ID NO: 507528 - RNA, 14 nt, Homo sapiens
uaaauguacaguau

SEQ ID NO: 507529 - RNA, 23 nt, Homo sapiens
uaaaugucuucauguugaugugu

SEQ ID NO: 507530 - RNA, 15 nt, Homo sapiens
uaaauguguuccuuu

SEQ ID NO: 507531 - RNA, 17 nt, Homo sapiens
uaaauucaaaccuaagu

SEQ ID NO: 507532 - RNA, 20 nt, Homo sapiens
uuuaccacaggaugcauauu

SEQ ID NO: 507533 - RNA, 21 nt, Homo sapiens
uuuagaagagccugacugugu

SEQ ID NO: 507534 - RNA, 18 nt, Homo sapiens
uuuagaaucaagucugug

SEQ ID NO: 507535 - RNA, 20 nt, Homo sapiens
uuuagaaucaagucugugaa

SEQ ID NO: 507536 - RNA, 19 nt, Homo sapiens
uuuaggaaaguugugauuc

SEQ ID NO: 507537 - RNA, 23 nt, Homo sapiens
uuuaggaugaguuucuauguugu

SEQ ID NO: 507538 - RNA, 13 nt, Homo sapiens
uuuauaaauucau

SEQ ID NO: 507539 - RNA, 12 nt, Homo sapiens
uuuauacuucaa

SEQ ID NO: 507540 - RNA, 18 nt, Homo sapiens
uuuauacuucaaauguca

SEQ ID NO: 507541 - RNA, 23 nt, Homo sapiens
uuucaaguggaaaccuugcugcu

SEQ ID NO: 507542 - RNA, 21 nt, Homo sapiens
uuucagaaacaaagcauuuga

SEQ ID NO: 507543 - RNA, 11 nt, Homo sapiens
uuucagugccu

SEQ ID NO: 507544 - RNA, 17 nt, Homo sapiens
uuucaguuauaauuuca

SEQ ID NO: 507545 - RNA, 17 nt, Homo sapiens
uuucauauaauuugcca

SEQ ID NO: 507546 - RNA, 13 nt, Homo sapiens
uuuccaaugccaa

SEQ ID NO: 507547 - RNA, 22 nt, Homo sapiens
uuuccaaugccaauucaucuca

SEQ ID NO: 507548 - RNA, 12 nt, Homo sapiens
uuuccagucuuc

SEQ ID NO: 507549 - RNA, 18 nt, Homo sapiens
uuuccccauugacccuca

SEQ ID NO: 507550 - RNA, 22 nt, Homo sapiens
uuuccucuuaaugucucaaaau

SEQ ID NO: 507551 - RNA, 15 nt, Homo sapiens
uuucggaaaugauug

SEQ ID NO: 507552 - RNA, 15 nt, Homo sapiens
uuucucagcauauau

SEQ ID NO: 507553 - RNA, 15 nt, Homo sapiens
uuucugaacuaucag

SEQ ID NO: 507554 - RNA, 19 nt, Homo sapiens
uuucugcgggucauauuca

SEQ ID NO: 507555 - RNA, 16 nt, Homo sapiens
uuugacauugucagaa

SEQ ID NO: 507556 - RNA, 20 nt, Homo sapiens
uuugacuuucugucugugga

SEQ ID NO: 507557 - RNA, 12 nt, Homo sapiens
uuugccacugaa

SEQ ID NO: 507558 - RNA, 18 nt, Homo sapiens
uuugccaucaagaaacau

SEQ ID NO: 507559 - RNA, 11 nt, Homo sapiens
uuugggagacu

SEQ ID NO: 507560 - RNA, 12 nt, Homo sapiens
uuugugaucugu

SEQ ID NO: 507561 - RNA, 13 nt, Homo sapiens
uuuuagauuccua

SEQ ID NO: 507562 - RNA, 22 nt, Homo sapiens
uuuuauaccuguacacacacag

SEQ ID NO: 507563 - RNA, 13 nt, Homo sapiens
uuuuaugucuaaa

SEQ ID NO: 507564 - RNA, 15 nt, Homo sapiens
uuuucacaccuuaca

SEQ ID NO: 507565 - RNA, 15 nt, Homo sapiens
uuuuggaagaauuca

SEQ ID NO: 507566 - RNA, 14 nt, Homo sapiens
uuuuuaacuuaucu

SEQ ID NO: 507567 - RNA, 14 nt, Homo sapiens
uuuuuagcaacaca

SEQ ID NO: 507568 - RNA, 20 nt, Homo sapiens
uuuuuucuaaaacuaaauag

SEQ ID NO: 507569 - RNA, 23 nt, Homo sapiens
uggauaugcuagcauuuuagcug

SEQ ID NO: 507570 - RNA, 17 nt, Homo sapiens
uggaucaggaacccuua

SEQ ID NO: 507571 - RNA, 17 nt, Homo sapiens
uggaugcuuacagugac

SEQ ID NO: 507572 - RNA, 13 nt, Homo sapiens
uggcacaggagac

SEQ ID NO: 507573 - RNA, 14 nt, Homo sapiens
uggcagcgccuccc

SEQ ID NO: 507574 - RNA, 20 nt, Homo sapiens
uggcagugugucacacugag

SEQ ID NO: 507575 - RNA, 19 nt, Homo sapiens
uggccuaauccaccuggug

SEQ ID NO: 507576 - RNA, 11 nt, Homo sapiens
uggcugaagaa

SEQ ID NO: 507577 - RNA, 21 nt, Homo sapiens
uggcuggguuugggcagugga

SEQ ID NO: 507578 - RNA, 14 nt, Homo sapiens
uggcuuugugcuua

SEQ ID NO: 507579 - RNA, 15 nt, Homo sapiens
ugggaaauucuugca

SEQ ID NO: 507580 - RNA, 20 nt, Homo sapiens
ugggaaauucuugcacugua

SEQ ID NO: 507581 - RNA, 13 nt, Homo sapiens
ugggaauugcaug

SEQ ID NO: 507582 - RNA, 19 nt, Homo sapiens
ugggaauugcaugccaucu

SEQ ID NO: 507583 - RNA, 13 nt, Homo sapiens
ugggagcacagcu

SEQ ID NO: 507584 - RNA, 22 nt, Homo sapiens
ugggcaacagagugagacccua

SEQ ID NO: 507585 - RNA, 19 nt, Homo sapiens
ugggccgggguguggaauc

SEQ ID NO: 507586 - RNA, 14 nt, Homo sapiens
ugggccuccaugcc

SEQ ID NO: 507587 - RNA, 23 nt, Homo sapiens
ugggggccucuuuaccauagcuu

SEQ ID NO: 507588 - RNA, 14 nt, Homo sapiens
ugguaaaaagaucc

SEQ ID NO: 507589 - RNA, 15 nt, Homo sapiens
ugguaauuauccuca

SEQ ID NO: 507590 - RNA, 14 nt, Homo sapiens
ugguagacugugac

SEQ ID NO: 507591 - RNA, 15 nt, Homo sapiens
ugguagacugugaca

SEQ ID NO: 507592 - RNA, 22 nt, Homo sapiens
ugguaugaaacaaauauacuca

SEQ ID NO: 507593 - RNA, 15 nt, Homo sapiens
uggucacaaagcuau

SEQ ID NO: 507594 - RNA, 16 nt, Homo sapiens
ugguccugcacugucc

SEQ ID NO: 507595 - RNA, 16 nt, Homo sapiens
uggucgcuuugccauc

SEQ ID NO: 507596 - RNA, 16 nt, Homo sapiens
ugguggcagugcagca

SEQ ID NO: 507597 - RNA, 12 nt, Homo sapiens
ugguuaccucug

SEQ ID NO: 507598 - RNA, 15 nt, Homo sapiens
uguaaacaucauaaa

SEQ ID NO: 507599 - RNA, 21 nt, Homo sapiens
uguaaauaaugcuuaacauaa

SEQ ID NO: 507600 - RNA, 14 nt, Homo sapiens
uguaaguacucuaa

SEQ ID NO: 507601 - RNA, 14 nt, Homo sapiens
uguaauauaagaca

SEQ ID NO: 507602 - RNA, 20 nt, Homo sapiens
uguacaaaaugaauugccuu

SEQ ID NO: 507603 - RNA, 21 nt, Homo sapiens
uguacaaauaauauugccuug

SEQ ID NO: 507604 - RNA, 20 nt, Homo sapiens
uguacauaguggucauuugg

SEQ ID NO: 507605 - RNA, 18 nt, Homo sapiens
agcugucgccgcuagucu

SEQ ID NO: 507606 - RNA, 13 nt, Homo sapiens
agcuuacugauua

SEQ ID NO: 507607 - RNA, 20 nt, Homo sapiens
agcuucacugucaugugcga

SEQ ID NO: 507608 - RNA, 21 nt, Homo sapiens
agcuucacuuaaaaucaaauu

SEQ ID NO: 507609 - RNA, 21 nt, Homo sapiens
agcuuccagugcauguugcca

SEQ ID NO: 507610 - RNA, 19 nt, Homo sapiens
agcuucccugaacacucau

SEQ ID NO: 507611 - RNA, 23 nt, Homo sapiens
agcuucccugaacacucaucccc

SEQ ID NO: 507612 - RNA, 18 nt, Homo sapiens
agcuuuaaaaccacagcu

SEQ ID NO: 507613 - RNA, 19 nt, Homo sapiens
agcuuuagagaagccauaa

SEQ ID NO: 507614 - RNA, 14 nt, Homo sapiens
aggaaacucuccau

SEQ ID NO: 507615 - RNA, 18 nt, Homo sapiens
aggaaacucuccaugauu

SEQ ID NO: 507616 - RNA, 16 nt, Homo sapiens
aggaaagcagugcagu

SEQ ID NO: 507617 - RNA, 14 nt, Homo sapiens
aggaaaguacugca

SEQ ID NO: 507618 - RNA, 14 nt, Homo sapiens
aggacgcaugcagg

SEQ ID NO: 507619 - RNA, 16 nt, Homo sapiens
aggagagaacagggau

SEQ ID NO: 507620 - RNA, 13 nt, Homo sapiens
aggagaguggcag

SEQ ID NO: 507621 - RNA, 15 nt, Homo sapiens
aggagaugaggcugg

SEQ ID NO: 507622 - RNA, 13 nt, Homo sapiens
aggagcguguacu

SEQ ID NO: 507623 - RNA, 13 nt, Homo sapiens
aggagcguguccu

SEQ ID NO: 507624 - RNA, 13 nt, Homo sapiens
aggaggacaggga

SEQ ID NO: 507625 - RNA, 14 nt, Homo sapiens
aggaugcaugcagg

SEQ ID NO: 507626 - RNA, 15 nt, Homo sapiens
aggaugcaugcaggg

SEQ ID NO: 507627 - RNA, 14 nt, Homo sapiens
aggauguaugugua

SEQ ID NO: 507628 - RNA, 22 nt, Homo sapiens
aggcaauggugaacugucauua

SEQ ID NO: 507629 - RNA, 15 nt, Homo sapiens
aggcagaaugguggg

SEQ ID NO: 507630 - RNA, 16 nt, Homo sapiens
aggcagcuagacacca

SEQ ID NO: 507631 - RNA, 17 nt, Homo sapiens
aggcaguagaucauuuu

SEQ ID NO: 507632 - RNA, 15 nt, Homo sapiens
aggccgacugggcug

SEQ ID NO: 507633 - RNA, 20 nt, Homo sapiens
aggccucagggaccaaggag

SEQ ID NO: 507634 - RNA, 19 nt, Homo sapiens
aggcggcacauuggcagug

SEQ ID NO: 507635 - RNA, 23 nt, Homo sapiens
aggcugagucagccccacuccac

SEQ ID NO: 507636 - RNA, 17 nt, Homo sapiens
aggcuucccacacugcc

SEQ ID NO: 507637 - RNA, 16 nt, Homo sapiens
aggcuuuuguuuauuu

SEQ ID NO: 507638 - RNA, 16 nt, Homo sapiens
agggaagggugccugg

SEQ ID NO: 507639 - RNA, 14 nt, Homo sapiens
agggaauccauauc

SEQ ID NO: 507640 - RNA, 16 nt, Homo sapiens
agggacgacuuucuuu

SEQ ID NO: 507641 - RNA, 19 nt, Homo sapiens
agggauugaggaguugccu

SEQ ID NO: 507642 - RNA, 19 nt, Homo sapiens
agggcgcugagggcagggu

SEQ ID NO: 507643 - RNA, 16 nt, Homo sapiens
agggcgugaaacacaa

SEQ ID NO: 507644 - RNA, 19 nt, Homo sapiens
agggcugguguggcugcuc

SEQ ID NO: 507645 - RNA, 22 nt, Homo sapiens
aggggaucuaaaaggaggacag

SEQ ID NO: 507646 - RNA, 15 nt, Homo sapiens
aggggucagcagggg

SEQ ID NO: 507647 - RNA, 20 nt, Homo sapiens
aggguccugaguggcugaaa

SEQ ID NO: 507648 - RNA, 14 nt, Homo sapiens
agguaucugaugau

SEQ ID NO: 507649 - RNA, 17 nt, Homo sapiens
aggucuccaccccucaa

SEQ ID NO: 507650 - RNA, 21 nt, Homo sapiens
aggucuccaccccucaagcca

SEQ ID NO: 507651 - RNA, 21 nt, Homo sapiens
aggucuuaagaugcaaaucaa

SEQ ID NO: 507652 - RNA, 16 nt, Homo sapiens
aggucuugaguuucau

SEQ ID NO: 507653 - RNA, 11 nt, Homo sapiens
aggucuugccu

SEQ ID NO: 507654 - RNA, 21 nt, Homo sapiens
aggugacuuuccuaugacacu

SEQ ID NO: 507655 - RNA, 23 nt, Homo sapiens
agguuauuuauuuaaaugucuaa

SEQ ID NO: 507656 - RNA, 16 nt, Homo sapiens
agguugaaaauguuau

SEQ ID NO: 507657 - RNA, 19 nt, Homo sapiens
agguuucacuguucaugaa

SEQ ID NO: 507658 - RNA, 14 nt, Homo sapiens
aguaaaaacaauuc

SEQ ID NO: 507659 - RNA, 18 nt, Homo sapiens
aguaaaagagagcugccc

SEQ ID NO: 507660 - RNA, 19 nt, Homo sapiens
aguaaaguaugaaacauuc

SEQ ID NO: 507661 - RNA, 21 nt, Homo sapiens
aguaaaucagugcaguacuca

SEQ ID NO: 507662 - RNA, 21 nt, Homo sapiens
aguaacacaauacaguacuca

SEQ ID NO: 507663 - RNA, 13 nt, Homo sapiens
aguaacacagugc

SEQ ID NO: 507664 - RNA, 16 nt, Homo sapiens
aguaacacagugcagu

SEQ ID NO: 507665 - RNA, 21 nt, Homo sapiens
aguaacacagugcaguacuca

SEQ ID NO: 507666 - RNA, 13 nt, Homo sapiens
aguaacacagugu

SEQ ID NO: 507667 - RNA, 14 nt, Homo sapiens
aguaacagugcagu

SEQ ID NO: 507668 - RNA, 16 nt, Homo sapiens
aguaaggcagugcagu

SEQ ID NO: 507669 - RNA, 21 nt, Homo sapiens
aguaauacaauacaguacuca

SEQ ID NO: 507670 - RNA, 21 nt, Homo sapiens
aguacauaaggaguugccgca

SEQ ID NO: 507671 - RNA, 14 nt, Homo sapiens
aguacucaguaaau

SEQ ID NO: 507672 - RNA, 15 nt, Homo sapiens
aguagccaacagcga

SEQ ID NO: 507673 - RNA, 13 nt, Homo sapiens
aguaggugggucu

SEQ ID NO: 507674 - RNA, 14 nt, Homo sapiens
aguauacacaucau

SEQ ID NO: 507675 - RNA, 15 nt, Homo sapiens
aguauuacacaucag

SEQ ID NO: 507676 - RNA, 15 nt, Homo sapiens
agucacauucagagu

SEQ ID NO: 507677 - RNA, 12 nt, Homo sapiens
agucagcacaga

SEQ ID NO: 507678 - RNA, 11 nt, Homo sapiens
agucaguauug

SEQ ID NO: 507679 - RNA, 19 nt, Homo sapiens
agucaugugccuugaacau

SEQ ID NO: 507680 - RNA, 14 nt, Homo sapiens
aguccaagguauug

SEQ ID NO: 507681 - RNA, 16 nt, Homo sapiens
aguccacuuuccucuc

SEQ ID NO: 507682 - RNA, 14 nt, Homo sapiens
agucuauugcaguu

SEQ ID NO: 507683 - RNA, 23 nt, Homo sapiens
agucuucuuucuuagauucucuu

SEQ ID NO: 507684 - RNA, 22 nt, Homo sapiens
agugaaaaucgaggaagcaccu

SEQ ID NO: 507685 - RNA, 15 nt, Homo sapiens
agugaugugguggga

SEQ ID NO: 507686 - RNA, 22 nt, Homo sapiens
agugcagcaaccagagcacugu

SEQ ID NO: 507687 - RNA, 16 nt, Homo sapiens
agugcaguagugucac

SEQ ID NO: 507688 - RNA, 23 nt, Homo sapiens
agugccccuauuauuaacaauuc

SEQ ID NO: 507689 - RNA, 21 nt, Homo sapiens
aguggcaagcucuucauugca

SEQ ID NO: 507690 - RNA, 19 nt, Homo sapiens
aguggcacaggagacucca

SEQ ID NO: 507691 - RNA, 17 nt, Homo sapiens
agugggugaauguguga

SEQ ID NO: 507692 - RNA, 17 nt, Homo sapiens
aguguacuggauuuaac

SEQ ID NO: 507693 - RNA, 15 nt, Homo sapiens
aguguagugcucagu

SEQ ID NO: 507694 - RNA, 16 nt, Homo sapiens
agugugauugugaacu

SEQ ID NO: 507695 - RNA, 20 nt, Homo sapiens
aguguuuagaagagccugac

SEQ ID NO: 507696 - RNA, 15 nt, Homo sapiens
aguguuuuuacauau

SEQ ID NO: 507697 - RNA, 16 nt, Homo sapiens
aguuaaauuggcuugu

SEQ ID NO: 507698 - RNA, 23 nt, Homo sapiens
aguuagcccggccaaggacacug

SEQ ID NO: 507699 - RNA, 24 nt, Homo sapiens
aguuauuuucugagugugcagaca

SEQ ID NO: 507700 - RNA, 12 nt, Homo sapiens
aguucugaugag

SEQ ID NO: 507701 - RNA, 16 nt, Homo sapiens
aguugaaugauaauag

SEQ ID NO: 507702 - RNA, 12 nt, Homo sapiens
aguugcaauaaa

SEQ ID NO: 507703 - RNA, 20 nt, Homo sapiens
aguugcaauaaacucaguca

SEQ ID NO: 507704 - RNA, 11 nt, Homo sapiens
aguugccugac

SEQ ID NO: 507705 - RNA, 18 nt, Homo sapiens
aguuuaacaaccauuuaa

SEQ ID NO: 507706 - RNA, 13 nt, Homo sapiens
aguuuauuccugu

SEQ ID NO: 507707 - RNA, 19 nt, Homo sapiens
aguuuccaaguuuauugcc

SEQ ID NO: 507708 - RNA, 19 nt, Homo sapiens
auaaaagaaagaugcugau

SEQ ID NO: 507709 - RNA, 15 nt, Homo sapiens
auaaaagacaugaaa

SEQ ID NO: 507710 - RNA, 14 nt, Homo sapiens
auaaacucagucaa

SEQ ID NO: 507711 - RNA, 19 nt, Homo sapiens
auaaacucagucaaaugua

SEQ ID NO: 507712 - RNA, 17 nt, Homo sapiens
auaaacuuguacuuaca

SEQ ID NO: 507713 - RNA, 12 nt, Homo sapiens
auaaagauucca

SEQ ID NO: 507714 - RNA, 15 nt, Homo sapiens
auaaauauuagcaaa

SEQ ID NO: 507715 - RNA, 16 nt, Homo sapiens
auaaaucuuccaaagu

SEQ ID NO: 507716 - RNA, 11 nt, Homo sapiens
auaaauucuua

SEQ ID NO: 507717 - RNA, 13 nt, Homo sapiens
auaagaagcaaau

SEQ ID NO: 507718 - RNA, 21 nt, Homo sapiens
auaagcaucuguguaaccucc

SEQ ID NO: 507719 - RNA, 15 nt, Homo sapiens
auaaggcagugcagu

SEQ ID NO: 507720 - RNA, 21 nt, Homo sapiens
auaaggcagugcagugcucag

SEQ ID NO: 507721 - RNA, 17 nt, Homo sapiens
auaaguaaaugucuuca

SEQ ID NO: 507722 - RNA, 16 nt, Homo sapiens
auaaguguguuugcaa

SEQ ID NO: 507723 - RNA, 11 nt, Homo sapiens
gggaugugcac

SEQ ID NO: 507724 - RNA, 16 nt, Homo sapiens
gggcaaggaagcuuug

SEQ ID NO: 507725 - RNA, 15 nt, Homo sapiens
gggcccccacaggag

SEQ ID NO: 507726 - RNA, 13 nt, Homo sapiens
gggccuccaugcc

SEQ ID NO: 507727 - RNA, 22 nt, Homo sapiens
gggcuccccuucgcguauuuca

SEQ ID NO: 507728 - RNA, 22 nt, Homo sapiens
gggcucuucgccaugggggucu

SEQ ID NO: 507729 - RNA, 16 nt, Homo sapiens
gggcuuuggggcuggu

SEQ ID NO: 507730 - RNA, 13 nt, Homo sapiens
ggggagaauggcu

SEQ ID NO: 507731 - RNA, 15 nt, Homo sapiens
ggggagcaugggacu

SEQ ID NO: 507732 - RNA, 16 nt, Homo sapiens
ggggucagaugcacug

SEQ ID NO: 507733 - RNA, 18 nt, Homo sapiens
gggguuggguuccagaca

SEQ ID NO: 507734 - RNA, 18 nt, Homo sapiens
gggucucgcagccugaag

SEQ ID NO: 507735 - RNA, 12 nt, Homo sapiens
gggucugugaug

SEQ ID NO: 507736 - RNA, 20 nt, Homo sapiens
gguaaugaugauucaaucau

SEQ ID NO: 507737 - RNA, 23 nt, Homo sapiens
gguacucaguaacacagugcagu

SEQ ID NO: 507738 - RNA, 22 nt, Homo sapiens
gguagaaacuuuggaaguuuua

SEQ ID NO: 507739 - RNA, 16 nt, Homo sapiens
ggucccugccaguguu

SEQ ID NO: 507740 - RNA, 18 nt, Homo sapiens
gguccugaguggcugaaa

SEQ ID NO: 507741 - RNA, 14 nt, Homo sapiens
gguccugcacuguc

SEQ ID NO: 507742 - RNA, 15 nt, Homo sapiens
gguccugcacugucc

SEQ ID NO: 507743 - RNA, 22 nt, Homo sapiens
ggucuccaccccucaagccagg

SEQ ID NO: 507744 - RNA, 13 nt, Homo sapiens
ggugagguccugu

SEQ ID NO: 507745 - RNA, 18 nt, Homo sapiens
gguggcaugaguugaaga

SEQ ID NO: 507746 - RNA, 11 nt, Homo sapiens
gguggggccag

SEQ ID NO: 507747 - RNA, 14 nt, Homo sapiens
gguggucuuggaga

SEQ ID NO: 507748 - RNA, 15 nt, Homo sapiens
gguuccagacagggu

SEQ ID NO: 507749 - RNA, 14 nt, Homo sapiens
gguuggguuccaga

SEQ ID NO: 507750 - RNA, 18 nt, Homo sapiens
guaaaacuaaauguugcg

SEQ ID NO: 507751 - RNA, 13 nt, Homo sapiens
guaaaacugugac

SEQ ID NO: 507752 - RNA, 13 nt, Homo sapiens
guaaaauacuucu

SEQ ID NO: 507753 - RNA, 14 nt, Homo sapiens
guaaaccauucuug

SEQ ID NO: 507754 - RNA, 15 nt, Homo sapiens
guaaaucagugcagu

SEQ ID NO: 507755 - RNA, 14 nt, Homo sapiens
guaaaugucuucau

SEQ ID NO: 507756 - RNA, 15 nt, Homo sapiens
guaacagacauuguu

SEQ ID NO: 507757 - RNA, 16 nt, Homo sapiens
guaaggcagugcagua

SEQ ID NO: 507758 - RNA, 23 nt, Homo sapiens
guaaguacucuaauauacagugu

SEQ ID NO: 507759 - RNA, 15 nt, Homo sapiens
guaaguugaagggaa

SEQ ID NO: 507760 - RNA, 19 nt, Homo sapiens
guaauacaauacaguacuc

SEQ ID NO: 507761 - RNA, 20 nt, Homo sapiens
guacaaauaauauugccuug

SEQ ID NO: 507762 - RNA, 16 nt, Homo sapiens
guacaagcuacauaug

SEQ ID NO: 507763 - RNA, 14 nt, Homo sapiens
guacaggcaguuag

SEQ ID NO: 507764 - RNA, 12 nt, Homo sapiens
guacaguacuca

SEQ ID NO: 507765 - RNA, 15 nt, Homo sapiens
guacauaguggucau

SEQ ID NO: 507766 - RNA, 16 nt, Homo sapiens
guacgaggcuucucua

SEQ ID NO: 507767 - RNA, 18 nt, Homo sapiens
guacucaggcagugcagu

SEQ ID NO: 507768 - RNA, 22 nt, Homo sapiens
guacucaguaaaucagugcagu

SEQ ID NO: 507769 - RNA, 18 nt, Homo sapiens
guacucaguaacagugca

SEQ ID NO: 507770 - RNA, 20 nt, Homo sapiens
guacucaguaacagugcagu

SEQ ID NO: 507771 - RNA, 15 nt, Homo sapiens
guagaagaugaccuc

SEQ ID NO: 507772 - RNA, 14 nt, Homo sapiens
guagcucuguccac

SEQ ID NO: 507773 - RNA, 17 nt, Homo sapiens
guaguagcucgugugcu

SEQ ID NO: 507774 - RNA, 18 nt, Homo sapiens
guauauagugaugugcua

SEQ ID NO: 507775 - RNA, 18 nt, Homo sapiens
guauauuuuuaacugcuu

SEQ ID NO: 507776 - RNA, 21 nt, Homo sapiens
guaucaaaaugaaugccaguc

SEQ ID NO: 507777 - RNA, 14 nt, Homo sapiens
guaugaaacauucu

SEQ ID NO: 507778 - RNA, 14 nt, Homo sapiens
guaugguacucagu

SEQ ID NO: 507779 - RNA, 11 nt, Homo sapiens
guauggugcug

SEQ ID NO: 507780 - RNA, 18 nt, Homo sapiens
guauuuuuccucuuucac

SEQ ID NO: 507781 - RNA, 21 nt, Homo sapiens
gucaagagggggcaagucaca

SEQ ID NO: 507782 - RNA, 21 nt, Homo sapiens
gucacaauaaaagaaacugug

SEQ ID NO: 507783 - RNA, 14 nt, Homo sapiens
gucagcacuaccuc

SEQ ID NO: 507784 - RNA, 18 nt, Homo sapiens
gucaguagugccugugau

SEQ ID NO: 507785 - RNA, 21 nt, Homo sapiens
gucauuucauacaaauuuucc

SEQ ID NO: 507786 - RNA, 20 nt, Homo sapiens
guccaaaauaucgagugaau

SEQ ID NO: 507787 - RNA, 22 nt, Homo sapiens
guccaacauuccuuguuuguaa

SEQ ID NO: 507788 - RNA, 17 nt, Homo sapiens
guccaagguauugagac

SEQ ID NO: 507789 - RNA, 23 nt, Homo sapiens
guccaagguauugagacauauua

SEQ ID NO: 507790 - RNA, 22 nt, Homo sapiens
guccacccccauugugaauguu

SEQ ID NO: 507791 - RNA, 14 nt, Homo sapiens
guccacucugaaua

SEQ ID NO: 507792 - RNA, 15 nt, Homo sapiens
guccccagagcuuua

SEQ ID NO: 507793 - RNA, 22 nt, Homo sapiens
guccccggacgcuggcucggga

SEQ ID NO: 507794 - RNA, 13 nt, Homo sapiens
gucccugcagggc

SEQ ID NO: 507795 - RNA, 13 nt, Homo sapiens
gucccuuaccugg

SEQ ID NO: 507796 - RNA, 14 nt, Homo sapiens
guccugcacugucc

SEQ ID NO: 507797 - RNA, 20 nt, Homo sapiens
guccugggggcugcugcacu

SEQ ID NO: 507798 - RNA, 22 nt, Homo sapiens
guccugucuaaaaaugauucuc

SEQ ID NO: 507799 - RNA, 18 nt, Homo sapiens
guccugugucaucuguca

SEQ ID NO: 507800 - RNA, 19 nt, Homo sapiens
guccuuagaauacuguauu

SEQ ID NO: 507801 - RNA, 19 nt, Homo sapiens
gucgccacauuucucugca

SEQ ID NO: 507802 - RNA, 13 nt, Homo sapiens
gucgcuuugccau

SEQ ID NO: 507803 - RNA, 13 nt, Homo sapiens
gucuaaagcuaaa

SEQ ID NO: 507804 - RNA, 15 nt, Homo sapiens
gucucagugaaggaa

SEQ ID NO: 507805 - RNA, 23 nt, Homo sapiens
gucugccacaagggcaguggaag

SEQ ID NO: 507806 - RNA, 17 nt, Homo sapiens
gucugcuuaguaucuca

SEQ ID NO: 507807 - RNA, 17 nt, Homo sapiens
gucuggaaaagcacuuu

SEQ ID NO: 507808 - RNA, 14 nt, Homo sapiens
gucugucucucuuu

SEQ ID NO: 507809 - RNA, 13 nt, Homo sapiens
gucuuaucuacca

SEQ ID NO: 507810 - RNA, 16 nt, Homo sapiens
gucuuaucuaccaguu

SEQ ID NO: 507811 - RNA, 21 nt, Homo sapiens
gucuuggauugguaccagagc

SEQ ID NO: 507812 - RNA, 20 nt, Homo sapiens
gucuuuggcuucagaauugu

SEQ ID NO: 507813 - RNA, 16 nt, Homo sapiens
gucuuuugaaaacuca

SEQ ID NO: 507814 - RNA, 18 nt, Homo sapiens
gugaaauuaguauuuuga

SEQ ID NO: 507815 - RNA, 15 nt, Homo sapiens
gugaacugaagcaga

SEQ ID NO: 507816 - RNA, 20 nt, Homo sapiens
gugaauuuuaaaaugcaaau

SEQ ID NO: 507817 - RNA, 12 nt, Homo sapiens
gugacauuccac

SEQ ID NO: 507818 - RNA, 16 nt, Homo sapiens
gugacauuccacagag

SEQ ID NO: 507819 - RNA, 20 nt, Homo sapiens
gugaucuauaccaccuucaa

SEQ ID NO: 507820 - RNA, 23 nt, Homo sapiens
gugcagcaaccagagcacuguau

SEQ ID NO: 507821 - RNA, 16 nt, Homo sapiens
gugcagcuuuccaguu

SEQ ID NO: 507822 - RNA, 15 nt, Homo sapiens
gugcagugauguggu

SEQ ID NO: 507823 - RNA, 16 nt, Homo sapiens
gugcauguugccauga

SEQ ID NO: 507824 - RNA, 17 nt, Homo sapiens
gugccccacaaggccca

SEQ ID NO: 507825 - RNA, 12 nt, Homo sapiens
gugccugugauc

SEQ ID NO: 507826 - RNA, 20 nt, Homo sapiens
gugccuuauggaacacucug

SEQ ID NO: 507827 - RNA, 22 nt, Homo sapiens
gugcucaauaaggcagugcagu

SEQ ID NO: 507828 - RNA, 15 nt, Homo sapiens
gugcuuguucuuccu

SEQ ID NO: 507829 - RNA, 18 nt, Homo sapiens
gugcuuucuccauuuauu

SEQ ID NO: 507830 - RNA, 17 nt, Homo sapiens
guggaaggcagugaaca

SEQ ID NO: 507831 - RNA, 17 nt, Homo sapiens
guggaccaguucccuca

SEQ ID NO: 507832 - RNA, 20 nt, Homo sapiens
guggagaacagaaauccacg

SEQ ID NO: 507833 - RNA, 12 nt, Homo sapiens
guggagggguca

SEQ ID NO: 507834 - RNA, 23 nt, Homo sapiens
guggcugauuuacuaacaguaac

SEQ ID NO: 507835 - RNA, 19 nt, Homo sapiens
gugggagcacagcuuuccu

SEQ ID NO: 507836 - RNA, 13 nt, Homo sapiens
gugggcucacacc

SEQ ID NO: 507837 - RNA, 17 nt, Homo sapiens
gugucaucaaguaguag

SEQ ID NO: 507838 - RNA, 13 nt, Homo sapiens
gugucaucuguca

SEQ ID NO: 507839 - RNA, 16 nt, Homo sapiens
gugucuuuuguucucu

SEQ ID NO: 507840 - RNA, 15 nt, Homo sapiens
gugugcagacagcua

SEQ ID NO: 507841 - RNA, 17 nt, Homo sapiens
gccugucuguacuucau

SEQ ID NO: 507842 - RNA, 22 nt, Homo sapiens
gccuucuccacagggacacagu

SEQ ID NO: 507843 - RNA, 16 nt, Homo sapiens
gccuuuccccagugug

SEQ ID NO: 507844 - RNA, 20 nt, Homo sapiens
gcgcuccucugcagccugag

SEQ ID NO: 507845 - RNA, 13 nt, Homo sapiens
gcggaggggcuug

SEQ ID NO: 507846 - RNA, 17 nt, Homo sapiens
gcggcacauuggcagug

SEQ ID NO: 507847 - RNA, 17 nt, Homo sapiens
gcguguacuaccccaga

SEQ ID NO: 507848 - RNA, 18 nt, Homo sapiens
gcguguacuaccccagga

SEQ ID NO: 507849 - RNA, 22 nt, Homo sapiens
gcuaaaaugaaaaauagugugu

SEQ ID NO: 507850 - RNA, 14 nt, Homo sapiens
gcuaaaugucaauu

SEQ ID NO: 507851 - RNA, 23 nt, Homo sapiens
gcuacacguuggaguauaccuau

SEQ ID NO: 507852 - RNA, 19 nt, Homo sapiens
gcuacuggcaucuguuauc

SEQ ID NO: 507853 - RNA, 16 nt, Homo sapiens
gcuacuuugagccucu

SEQ ID NO: 507854 - RNA, 23 nt, Homo sapiens
gcuagacuaggagguuccggugu

SEQ ID NO: 507855 - RNA, 17 nt, Homo sapiens
gcuaguacucaguacua

SEQ ID NO: 507856 - RNA, 21 nt, Homo sapiens
gcuauaauguauaaugggaaa

SEQ ID NO: 507857 - RNA, 17 nt, Homo sapiens
gcuaucucgcuagccau

SEQ ID NO: 507858 - RNA, 18 nt, Homo sapiens
gcucaaugugcuguugau

SEQ ID NO: 507859 - RNA, 16 nt, Homo sapiens
gcucacuacaugggcc

SEQ ID NO: 507860 - RNA, 20 nt, Homo sapiens
gcucaguaacacagugcagu

SEQ ID NO: 507861 - RNA, 12 nt, Homo sapiens
gcuccacucuga

SEQ ID NO: 507862 - RNA, 17 nt, Homo sapiens
gcucugcauaagauuau

SEQ ID NO: 507863 - RNA, 22 nt, Homo sapiens
gcucuggcaccacuaggguccu

SEQ ID NO: 507864 - RNA, 17 nt, Homo sapiens
gcucuuucccucaugua

SEQ ID NO: 507865 - RNA, 15 nt, Homo sapiens
gcugaaagacaguaa

SEQ ID NO: 507866 - RNA, 18 nt, Homo sapiens
gcugaaauuaugucaaau

SEQ ID NO: 507867 - RNA, 13 nt, Homo sapiens
gcugcacugcccu

SEQ ID NO: 507868 - RNA, 13 nt, Homo sapiens
gcugccuguggug

SEQ ID NO: 507869 - RNA, 13 nt, Homo sapiens
gcugcugcacugc

SEQ ID NO: 507870 - RNA, 15 nt, Homo sapiens
gcugcugcacugccc

SEQ ID NO: 507871 - RNA, 13 nt, Homo sapiens
gcuggcgccuagg

SEQ ID NO: 507872 - RNA, 14 nt, Homo sapiens
gcugggcaggguga

SEQ ID NO: 507873 - RNA, 23 nt, Homo sapiens
gcugggcuuuggggcugguggga

SEQ ID NO: 507874 - RNA, 13 nt, Homo sapiens
gcugggggacugc

SEQ ID NO: 507875 - RNA, 15 nt, Homo sapiens
gcuguauacaaacag

SEQ ID NO: 507876 - RNA, 12 nt, Homo sapiens
gcuucacuuaaa

SEQ ID NO: 507877 - RNA, 24 nt, Homo sapiens
gcuucugggacaggcaccaugcug

SEQ ID NO: 507878 - RNA, 21 nt, Homo sapiens
gcuuguucuuccucuuaccug

SEQ ID NO: 507879 - RNA, 20 nt, Homo sapiens
gcuuguuuaagguucuugcu

SEQ ID NO: 507880 - RNA, 14 nt, Homo sapiens
gcuuuacagugcca

SEQ ID NO: 507881 - RNA, 15 nt, Homo sapiens
gcuuucagugccugc

SEQ ID NO: 507882 - RNA, 22 nt, Homo sapiens
ggaaaaaaaaaaauaugagauu

SEQ ID NO: 507883 - RNA, 18 nt, Homo sapiens
ggaaaaaggcuucuccac

SEQ ID NO: 507884 - RNA, 12 nt, Homo sapiens
ggaaacagagaa

SEQ ID NO: 507885 - RNA, 16 nt, Homo sapiens
ggaacacucugagacu

SEQ ID NO: 507886 - RNA, 22 nt, Homo sapiens
ggaacagcccugcacgcccagg

SEQ ID NO: 507887 - RNA, 23 nt, Homo sapiens
ggaagacaaauacacauacauau

SEQ ID NO: 507888 - RNA, 14 nt, Homo sapiens
ggaaggacauuucc

SEQ ID NO: 507889 - RNA, 18 nt, Homo sapiens
ggaagggaccccacugga

SEQ ID NO: 507890 - RNA, 21 nt, Homo sapiens
ggaaugauaauggaaacuguc

SEQ ID NO: 507891 - RNA, 18 nt, Homo sapiens
ggaaugauccaauacugu

SEQ ID NO: 507892 - RNA, 19 nt, Homo sapiens
ggaaugcagcacaguacuc

SEQ ID NO: 507893 - RNA, 15 nt, Homo sapiens
ggaauugcaugccau

SEQ ID NO: 507894 - RNA, 17 nt, Homo sapiens
ggaauuuucauuuucau

SEQ ID NO: 507895 - RNA, 13 nt, Homo sapiens
ggacaaguaucau

SEQ ID NO: 507896 - RNA, 19 nt, Homo sapiens
ggacacauaguguuuguaa

SEQ ID NO: 507897 - RNA, 13 nt, Homo sapiens
ggacacccuccug

SEQ ID NO: 507898 - RNA, 18 nt, Homo sapiens
ggacagccugcacagugg

SEQ ID NO: 507899 - RNA, 18 nt, Homo sapiens
ggaccggacgcaugcagg

SEQ ID NO: 507900 - RNA, 18 nt, Homo sapiens
ggagauaaaauaaaaaga

SEQ ID NO: 507901 - RNA, 13 nt, Homo sapiens
ggagcuuccagug

SEQ ID NO: 507902 - RNA, 16 nt, Homo sapiens
ggagcuuccagugcau

SEQ ID NO: 507903 - RNA, 22 nt, Homo sapiens
ggaggucccugccaguguuuag

SEQ ID NO: 507904 - RNA, 17 nt, Homo sapiens
ggagguuccggugucug

SEQ ID NO: 507905 - RNA, 19 nt, Homo sapiens
ggaguccacuuuccucucu

SEQ ID NO: 507906 - RNA, 15 nt, Homo sapiens
ggauuuaccaaauag

SEQ ID NO: 507907 - RNA, 22 nt, Homo sapiens
ggcaaaggagggcaaccugaca

SEQ ID NO: 507908 - RNA, 18 nt, Homo sapiens
ggcaauggugaacuguca

SEQ ID NO: 507909 - RNA, 20 nt, Homo sapiens
ggcacaugauaugagucacu

SEQ ID NO: 507910 - RNA, 15 nt, Homo sapiens
ggcacauuggcagug

SEQ ID NO: 507911 - RNA, 18 nt, Homo sapiens
ggcacauuggcagugugu

SEQ ID NO: 507912 - RNA, 20 nt, Homo sapiens
ggcacauuggcaguguguca

SEQ ID NO: 507913 - RNA, 20 nt, Homo sapiens
ggcaccacaggcugccucau

SEQ ID NO: 507914 - RNA, 14 nt, Homo sapiens
ggcacucucuuuug

SEQ ID NO: 507915 - RNA, 14 nt, Homo sapiens
ggcagaaccugaaa

SEQ ID NO: 507916 - RNA, 22 nt, Homo sapiens
ggcagcaccuccgggacugacc

SEQ ID NO: 507917 - RNA, 19 nt, Homo sapiens
ggcagcagauuuuaggaaa

SEQ ID NO: 507918 - RNA, 18 nt, Homo sapiens
ggcagcaucagggacaca

SEQ ID NO: 507919 - RNA, 18 nt, Homo sapiens
ggcagcaugcgaugucau

SEQ ID NO: 507920 - RNA, 15 nt, Homo sapiens
ggcauagccauucau

SEQ ID NO: 507921 - RNA, 12 nt, Homo sapiens
ggccaccugcca

SEQ ID NO: 507922 - RNA, 22 nt, Homo sapiens
ggccagggugggaagagaagaa

SEQ ID NO: 507923 - RNA, 12 nt, Homo sapiens
ggccagugacau

SEQ ID NO: 507924 - RNA, 16 nt, Homo sapiens
ggccagugacauuuca

SEQ ID NO: 507925 - RNA, 14 nt, Homo sapiens
ggcccccacaggag

SEQ ID NO: 507926 - RNA, 17 nt, Homo sapiens
ggcccugacuucuggag

SEQ ID NO: 507927 - RNA, 17 nt, Homo sapiens
ggccgucucugauucuc

SEQ ID NO: 507928 - RNA, 17 nt, Homo sapiens
ggccuucuccacaggga

SEQ ID NO: 507929 - RNA, 23 nt, Homo sapiens
ggcggcacauuggcaguguguca

SEQ ID NO: 507930 - RNA, 15 nt, Homo sapiens
ggcucagauggggcc

SEQ ID NO: 507931 - RNA, 19 nt, Homo sapiens
ggcucguguuucacagugg

SEQ ID NO: 507932 - RNA, 17 nt, Homo sapiens
ggcugccugcuguguua

SEQ ID NO: 507933 - RNA, 13 nt, Homo sapiens
ggcugcugcacug

SEQ ID NO: 507934 - RNA, 15 nt, Homo sapiens
ggcuggggccggggc

SEQ ID NO: 507935 - RNA, 16 nt, Homo sapiens
ggcuuagaauggggcu

SEQ ID NO: 507936 - RNA, 21 nt, Homo sapiens
ggcuuaucagaacuccuuucu

SEQ ID NO: 507937 - RNA, 14 nt, Homo sapiens
ggcuucccaugucu

SEQ ID NO: 507938 - RNA, 20 nt, Homo sapiens
gggaaauugcuccauuccug

SEQ ID NO: 507939 - RNA, 16 nt, Homo sapiens
gggaacaccugcugag

SEQ ID NO: 507940 - RNA, 16 nt, Homo sapiens
gggaaggccugaggga

SEQ ID NO: 507941 - RNA, 20 nt, Homo sapiens
gggacagaggauuucugcuu

SEQ ID NO: 507942 - RNA, 23 nt, Homo sapiens
gggacagaggauuucugcuuagg

SEQ ID NO: 507943 - RNA, 21 nt, Homo sapiens
gggagaagaaggcaacccaaa

SEQ ID NO: 507944 - RNA, 22 nt, Homo sapiens
gggaggcggcacauuggcagug

SEQ ID NO: 507945 - RNA, 11 nt, Homo sapiens
guuaggcagug

SEQ ID NO: 507946 - RNA, 15 nt, Homo sapiens
guuaggcagugcagu

SEQ ID NO: 507947 - RNA, 23 nt, Homo sapiens
guuauuucccaacccaggauuca

SEQ ID NO: 507948 - RNA, 22 nt, Homo sapiens
guucaaagaaccccccucccca

SEQ ID NO: 507949 - RNA, 16 nt, Homo sapiens
guucagaaaagcaccu

SEQ ID NO: 507950 - RNA, 22 nt, Homo sapiens
guucagaaaagcaccucuugaa

SEQ ID NO: 507951 - RNA, 16 nt, Homo sapiens
guucagaucucauaga

SEQ ID NO: 507952 - RNA, 17 nt, Homo sapiens
guuccaugaagacaaau

SEQ ID NO: 507953 - RNA, 18 nt, Homo sapiens
guucccuuuccccauuca

SEQ ID NO: 507954 - RNA, 22 nt, Homo sapiens
guuccucuagguaaacuagcaa

SEQ ID NO: 507955 - RNA, 17 nt, Homo sapiens
guuccuuggucuauuua

SEQ ID NO: 507956 - RNA, 23 nt, Homo sapiens
guucucaauacccacugccagac

SEQ ID NO: 507957 - RNA, 20 nt, Homo sapiens
guugaaugguuaaaauguag

SEQ ID NO: 507958 - RNA, 15 nt, Homo sapiens
guugauguugauaaa

SEQ ID NO: 507959 - RNA, 23 nt, Homo sapiens
guugcaguuuuuuaaauguguuc

SEQ ID NO: 507960 - RNA, 15 nt, Homo sapiens
guuggagagcagcag

SEQ ID NO: 507961 - RNA, 14 nt, Homo sapiens
guuggagugcagug

SEQ ID NO: 507962 - RNA, 15 nt, Homo sapiens
guuguccugugucau

SEQ ID NO: 507963 - RNA, 15 nt, Homo sapiens
guuuaaaaaccaaau

SEQ ID NO: 507964 - RNA, 12 nt, Homo sapiens
guuuaacuuaau

SEQ ID NO: 507965 - RNA, 15 nt, Homo sapiens
guuuaagguucuugc

SEQ ID NO: 507966 - RNA, 17 nt, Homo sapiens
guuuagaagagccugac

SEQ ID NO: 507967 - RNA, 20 nt, Homo sapiens
guuuagaaucaagucuguga

SEQ ID NO: 507968 - RNA, 17 nt, Homo sapiens
guuuagugugauuguga

SEQ ID NO: 507969 - RNA, 14 nt, Homo sapiens
guuucacuguucau

SEQ ID NO: 507970 - RNA, 22 nt, Homo sapiens
guuuccaagaugucccauugau

SEQ ID NO: 507971 - RNA, 14 nt, Homo sapiens
guuuccaaugccaa

SEQ ID NO: 507972 - RNA, 20 nt, Homo sapiens
guuucuuucugugcugguaa

SEQ ID NO: 507973 - RNA, 15 nt, Homo sapiens
guuuggucacugcua

SEQ ID NO: 507974 - RNA, 16 nt, Homo sapiens
guuuuaacccuuaaua

SEQ ID NO: 507975 - RNA, 16 nt, Homo sapiens
guuuucagauuguaaa

SEQ ID NO: 507976 - RNA, 17 nt, Homo sapiens
guuuucccauugcaguu

SEQ ID NO: 507977 - RNA, 14 nt, Homo sapiens
guuuucugcuguaa

SEQ ID NO: 507978 - RNA, 19 nt, Homo sapiens
guuuugccaacauugccua

SEQ ID NO: 507979 - RNA, 22 nt, Homo sapiens
uaaaaaccaaauaagcaucugu

SEQ ID NO: 507980 - RNA, 22 nt, Homo sapiens
uaaaaaucaguuuguuguucag

SEQ ID NO: 507981 - RNA, 16 nt, Homo sapiens
uaaaaucuuguuccau

SEQ ID NO: 507982 - RNA, 16 nt, Homo sapiens
uaaaauguguuuuuca

SEQ ID NO: 507983 - RNA, 12 nt, Homo sapiens
uaaaauugucag

SEQ ID NO: 507984 - RNA, 13 nt, Homo sapiens
uaaacaaauuccu

SEQ ID NO: 507985 - RNA, 13 nt, Homo sapiens
uaaacugaugcuu

SEQ ID NO: 507986 - RNA, 13 nt, Homo sapiens
uaaacugugagau

SEQ ID NO: 507987 - RNA, 15 nt, Homo sapiens
uaaagcuuauuuccc

SEQ ID NO: 507988 - RNA, 15 nt, Homo sapiens
uaaaguucagugugc

SEQ ID NO: 507989 - RNA, 13 nt, Homo sapiens
uaaauaaugcuua

SEQ ID NO: 507990 - RNA, 13 nt, Homo sapiens
uaaaucagugcag

SEQ ID NO: 507991 - RNA, 15 nt, Homo sapiens
uaaauccaacucuga

SEQ ID NO: 507992 - RNA, 16 nt, Homo sapiens
uaaauucaaaccuaag

SEQ ID NO: 507993 - RNA, 17 nt, Homo sapiens
uaaauuuggccaugaaa

SEQ ID NO: 507994 - RNA, 15 nt, Homo sapiens
uaacaagacuucaaa

SEQ ID NO: 507995 - RNA, 23 nt, Homo sapiens
uaacacucaagacuauguucucc

SEQ ID NO: 507996 - RNA, 16 nt, Homo sapiens
uaacagaaaaaugaaa

SEQ ID NO: 507997 - RNA, 17 nt, Homo sapiens
uaacagaaauacaucau

SEQ ID NO: 507998 - RNA, 18 nt, Homo sapiens
uaacaguaacugccauuu

SEQ ID NO: 507999 - RNA, 19 nt, Homo sapiens
uaacauaaacuuguacuua

SEQ ID NO: 508000 - RNA, 20 nt, Homo sapiens
uaacauaaacuuguacuuac

SEQ ID NO: 508001 - RNA, 19 nt, Homo sapiens
uaaccucucugaacugcaa

SEQ ID NO: 508002 - RNA, 13 nt, Homo sapiens
uaacuacuuucug

SEQ ID NO: 508003 - RNA, 17 nt, Homo sapiens
uaacucauguucauuca

SEQ ID NO: 508004 - RNA, 22 nt, Homo sapiens
uaacuucagauguuuccaagau

SEQ ID NO: 508005 - RNA, 22 nt, Homo sapiens
uaagaaaauuggacuguaauca

SEQ ID NO: 508006 - RNA, 13 nt, Homo sapiens
uaagacagugcag

SEQ ID NO: 508007 - RNA, 14 nt, Homo sapiens
uaagacagugcagu

SEQ ID NO: 508008 - RNA, 16 nt, Homo sapiens
uaagacagugcagugc

SEQ ID NO: 508009 - RNA, 22 nt, Homo sapiens
uaagaccuccucccaagcacuu

SEQ ID NO: 508010 - RNA, 14 nt, Homo sapiens
uaagauuuugccug

SEQ ID NO: 508011 - RNA, 19 nt, Homo sapiens
uaagcacaaccauguucuu

SEQ ID NO: 508012 - RNA, 22 nt, Homo sapiens
uaagcacauccaacuacuccua

SEQ ID NO: 508013 - RNA, 13 nt, Homo sapiens
uaagccugaugau

SEQ ID NO: 508014 - RNA, 22 nt, Homo sapiens
uaaggcauccacuucacaguuc

SEQ ID NO: 508015 - RNA, 18 nt, Homo sapiens
uaaggggaauuaacaauu

SEQ ID NO: 508016 - RNA, 21 nt, Homo sapiens
uaagguaaaaccaucuaggau

SEQ ID NO: 508017 - RNA, 19 nt, Homo sapiens
uaagugccauuaaauugaa

SEQ ID NO: 508018 - RNA, 16 nt, Homo sapiens
uaagugcucaguauug

SEQ ID NO: 508019 - RNA, 13 nt, Homo sapiens
uaaguugucuuac

SEQ ID NO: 508020 - RNA, 14 nt, Homo sapiens
uaauaggaggacag

SEQ ID NO: 508021 - RNA, 13 nt, Homo sapiens
uaauauguacaaa

SEQ ID NO: 508022 - RNA, 21 nt, Homo sapiens
uaauauugccuugauguuucu

SEQ ID NO: 508023 - RNA, 12 nt, Homo sapiens
uaauccaugugc

SEQ ID NO: 508024 - RNA, 15 nt, Homo sapiens
uaaucuucauggcca

SEQ ID NO: 508025 - RNA, 21 nt, Homo sapiens
uaauggcccuguagcucugaa

SEQ ID NO: 508026 - RNA, 14 nt, Homo sapiens
uaaugugccaaaau

SEQ ID NO: 508027 - RNA, 19 nt, Homo sapiens
uaauguuuacaacaauaaa

SEQ ID NO: 508028 - RNA, 20 nt, Homo sapiens
uaauuaaaugaaauacuuga

SEQ ID NO: 508029 - RNA, 18 nt, Homo sapiens
uaauucgagcaaacaacu

SEQ ID NO: 508030 - RNA, 15 nt, Homo sapiens
uaauuucaugcacac

SEQ ID NO: 508031 - RNA, 17 nt, Homo sapiens
uacaaaauauccaagcc

SEQ ID NO: 508032 - RNA, 13 nt, Homo sapiens
uacaaacaagaua

SEQ ID NO: 508033 - RNA, 18 nt, Homo sapiens
uacaaauauugugaugca

SEQ ID NO: 508034 - RNA, 20 nt, Homo sapiens
uacaaauauugugaugcauu

SEQ ID NO: 508035 - RNA, 16 nt, Homo sapiens
uacaaauuuuuacuca

SEQ ID NO: 508036 - RNA, 12 nt, Homo sapiens
uacaauguauca

SEQ ID NO: 508037 - RNA, 14 nt, Homo sapiens
uacacacacagaca

SEQ ID NO: 508038 - RNA, 11 nt, Homo sapiens
uacacauauaa

SEQ ID NO: 508039 - RNA, 14 nt, Homo sapiens
uacagagcugagca

SEQ ID NO: 508040 - RNA, 23 nt, Homo sapiens
uacagaugguguccugcauguau

SEQ ID NO: 508041 - RNA, 14 nt, Homo sapiens
uacagauguacaau

SEQ ID NO: 508042 - RNA, 20 nt, Homo sapiens
uacaggcaguuaggugcuga

SEQ ID NO: 508043 - RNA, 16 nt, Homo sapiens
uacagugccacgacau

SEQ ID NO: 508044 - RNA, 16 nt, Homo sapiens
uacauaaaaaagggac

SEQ ID NO: 508045 - RNA, 23 nt, Homo sapiens
uacauagcuuuagagaagccaua

SEQ ID NO: 508046 - RNA, 15 nt, Homo sapiens
uacaucaauaagcuc

SEQ ID NO: 508047 - RNA, 14 nt, Homo sapiens
uacaucuguuccag

SEQ ID NO: 508048 - RNA, 15 nt, Homo sapiens
uacaugccuuuccag

SEQ ID NO: 508049 - RNA, 21 nt, Homo sapiens
uacaugccuuuccagugcugc

SEQ ID NO: 508050 - RNA, 19 nt, Homo sapiens
uacauucuaaaucacuuua

SEQ ID NO: 508051 - RNA, 20 nt, Homo sapiens
uacauuugauuugauauaca

SEQ ID NO: 508052 - RNA, 20 nt, Homo sapiens
uaccauagcuuaagaaguau

SEQ ID NO: 508053 - RNA, 22 nt, Homo sapiens
uacuaccccaggaugcaugcag

SEQ ID NO: 508054 - RNA, 15 nt, Homo sapiens
uacuauaauugagaa

SEQ ID NO: 508055 - RNA, 21 nt, Homo sapiens
uacucaguaacacagugcagu

SEQ ID NO: 508056 - RNA, 22 nt, Homo sapiens
uacucaguaacacagugcagua

SEQ ID NO: 508057 - RNA, 22 nt, Homo sapiens
uacugacagaugguaucugcca

SEQ ID NO: 508058 - RNA, 14 nt, Homo sapiens
uacugauuaacuca

SEQ ID NO: 508059 - RNA, 18 nt, Homo sapiens
uacuggccuuuucacuga

SEQ ID NO: 508060 - RNA, 18 nt, Homo sapiens
uacugguuagauucauua

SEQ ID NO: 508061 - RNA, 15 nt, Homo sapiens
uacuguauuguuaca

SEQ ID NO: 508062 - RNA, 23 nt, Homo sapiens
uacuguuuugggccuccaugccc

SEQ ID NO: 508063 - RNA, 18 nt, Homo sapiens
uacuucauacaacauaua

SEQ ID NO: 508064 - RNA, 21 nt, Homo sapiens
uacuugauuaaggacuacaga

SEQ ID NO: 508065 - RNA, 15 nt, Homo sapiens
uacuuggaauuugcu

SEQ ID NO: 508066 - RNA, 14 nt, Homo sapiens
uagaagagccugac

SEQ ID NO: 508067 - RNA, 13 nt, Homo sapiens
uagaauacuguau

SEQ ID NO: 508068 - RNA, 17 nt, Homo sapiens
uagaaucaagucuguga

SEQ ID NO: 508069 - RNA, 16 nt, Homo sapiens
uagaauggggcuucca

SEQ ID NO: 508070 - RNA, 15 nt, Homo sapiens
uagacaaaugucuug

SEQ ID NO: 508071 - RNA, 14 nt, Homo sapiens
uagacauaccucuc

SEQ ID NO: 508072 - RNA, 14 nt, Homo sapiens
uagacgucucaggu

SEQ ID NO: 508073 - RNA, 18 nt, Homo sapiens
uagacuguuagacaaaag

SEQ ID NO: 508074 - RNA, 24 nt, Homo sapiens
uagagacuucuaaaucauaaucau

SEQ ID NO: 508075 - RNA, 14 nt, Homo sapiens
uagauaagugcuca

SEQ ID NO: 508076 - RNA, 20 nt, Homo sapiens
uagauaagugcucaguauug

SEQ ID NO: 508077 - RNA, 18 nt, Homo sapiens
uagaugaaaaagcaugua

SEQ ID NO: 508078 - RNA, 15 nt, Homo sapiens
uagcacaguauuuaa

SEQ ID NO: 508079 - RNA, 12 nt, Homo sapiens
uagcacuuuaua

SEQ ID NO: 508080 - RNA, 18 nt, Homo sapiens
uagcacuuuauaagccaa

SEQ ID NO: 508081 - RNA, 17 nt, Homo sapiens
uagcauacugaugagac

SEQ ID NO: 508082 - RNA, 13 nt, Homo sapiens
uagcauauauaau

SEQ ID NO: 508083 - RNA, 15 nt, Homo sapiens
uagcgcccaagcuca

SEQ ID NO: 508084 - RNA, 16 nt, Homo sapiens
uagcucacagcacauu

SEQ ID NO: 508085 - RNA, 13 nt, Homo sapiens
uagcucgugugcu

SEQ ID NO: 508086 - RNA, 16 nt, Homo sapiens
uagcucugaaugcuau

SEQ ID NO: 508087 - RNA, 17 nt, Homo sapiens
uagcuuuaaaaccacag

SEQ ID NO: 508088 - RNA, 20 nt, Homo sapiens
uagcuuuagagaagccauaa

SEQ ID NO: 508089 - RNA, 14 nt, Homo sapiens
uagcuuuuauucau

SEQ ID NO: 508090 - RNA, 19 nt, Homo sapiens
uaggaaagcagugcaguac

SEQ ID NO: 508091 - RNA, 22 nt, Homo sapiens
uaggcaaacuuuuaugcaggca

SEQ ID NO: 508092 - RNA, 23 nt, Homo sapiens
uaggcagggagggggcugggaaa

SEQ ID NO: 508093 - RNA, 18 nt, Homo sapiens
uaggcuuguguaauuucc

SEQ ID NO: 508094 - RNA, 15 nt, Homo sapiens
uagggagugugccuu

SEQ ID NO: 508095 - RNA, 23 nt, Homo sapiens
uaggugcugaaugaagcugccau

SEQ ID NO: 508096 - RNA, 23 nt, Homo sapiens
uagguugaaggcaaaaccaacuc

SEQ ID NO: 508097 - RNA, 23 nt, Homo sapiens
uaguaaauaaugauucaauguga

SEQ ID NO: 508098 - RNA, 18 nt, Homo sapiens
uaguaacaguauuuccau

SEQ ID NO: 508099 - RNA, 22 nt, Homo sapiens
uaguaccuuuuuuuagaaacag

SEQ ID NO: 508100 - RNA, 17 nt, Homo sapiens
uagugguggcagugcag

SEQ ID NO: 508101 - RNA, 18 nt, Homo sapiens
uaguuaaauuggcuuguu

SEQ ID NO: 508102 - RNA, 15 nt, Homo sapiens
uaguuuacaaacaag

SEQ ID NO: 508103 - RNA, 14 nt, Homo sapiens
uauaaauggauaau

SEQ ID NO: 508104 - RNA, 21 nt, Homo sapiens
uauaaguagaauucuuaccau

SEQ ID NO: 508105 - RNA, 13 nt, Homo sapiens
uauacaaacaggu

SEQ ID NO: 508106 - RNA, 13 nt, Homo sapiens
uauacacauaauu

SEQ ID NO: 508107 - RNA, 15 nt, Homo sapiens
uauacaguccuagag

SEQ ID NO: 508108 - RNA, 17 nt, Homo sapiens
uauacuuccaugcacuc

SEQ ID NO: 508109 - RNA, 18 nt, Homo sapiens
uauauaauuuuauugcug

SEQ ID NO: 508110 - RNA, 12 nt, Homo sapiens
uauauacauacg

SEQ ID NO: 508111 - RNA, 22 nt, Homo sapiens
uauauaggcaauguaguacuca

SEQ ID NO: 508112 - RNA, 22 nt, Homo sapiens
uauauauaaaauacacguguau

SEQ ID NO: 508113 - RNA, 16 nt, Homo sapiens
uauauguuuggcugaa

SEQ ID NO: 508114 - RNA, 13 nt, Homo sapiens
uauauuuaccaag

SEQ ID NO: 508115 - RNA, 13 nt, Homo sapiens
uauauuugcauaa

SEQ ID NO: 508116 - RNA, 18 nt, Homo sapiens
uaucaaaaugaaugccag

SEQ ID NO: 508117 - RNA, 18 nt, Homo sapiens
uaucaauaagugccauua

SEQ ID NO: 508118 - RNA, 19 nt, Homo sapiens
uaucaggaaauaucuguga

SEQ ID NO: 508119 - RNA, 20 nt, Homo sapiens
uaugaauaaauauuacaaau

SEQ ID NO: 508120 - RNA, 14 nt, Homo sapiens
uaugaccauaaaau

SEQ ID NO: 508121 - RNA, 20 nt, Homo sapiens
uaugauaaauuugacuguua

SEQ ID NO: 508122 - RNA, 18 nt, Homo sapiens
uauggaaacagagcaaaa

SEQ ID NO: 508123 - RNA, 22 nt, Homo sapiens
uauggacucgauuuuaccauau

SEQ ID NO: 508124 - RNA, 17 nt, Homo sapiens
uauggauugaaggauug

SEQ ID NO: 508125 - RNA, 19 nt, Homo sapiens
uauggcucuggcaccacua

SEQ ID NO: 508126 - RNA, 22 nt, Homo sapiens
uauguaccguugauguugauaa

SEQ ID NO: 508127 - RNA, 16 nt, Homo sapiens
uauguccauucacuuu

SEQ ID NO: 508128 - RNA, 14 nt, Homo sapiens
uaugugagcacuau

SEQ ID NO: 508129 - RNA, 12 nt, Homo sapiens
uauuacacauca

SEQ ID NO: 508130 - RNA, 13 nt, Homo sapiens
uauuacacugccu

SEQ ID NO: 508131 - RNA, 18 nt, Homo sapiens
uauucauuagcugugauu

SEQ ID NO: 508132 - RNA, 16 nt, Homo sapiens
uauucccaaaucucaa

SEQ ID NO: 508133 - RNA, 23 nt, Homo sapiens
uauuccgggugccauucccacua

SEQ ID NO: 508134 - RNA, 14 nt, Homo sapiens
uauucuggugucua

SEQ ID NO: 508135 - RNA, 22 nt, Homo sapiens
uauucuuuuguauaacuacuaa

SEQ ID NO: 508136 - RNA, 20 nt, Homo sapiens
uauugacgaccuacaucuga

SEQ ID NO: 508137 - RNA, 18 nt, Homo sapiens
uauugagacacugucaag

SEQ ID NO: 508138 - RNA, 20 nt, Homo sapiens
uauugagacauauuacugga

SEQ ID NO: 508139 - RNA, 23 nt, Homo sapiens
uauugugaugcauuuaucuuaau

SEQ ID NO: 508140 - RNA, 18 nt, Homo sapiens
uauuuaaggggaauuaac

SEQ ID NO: 508141 - RNA, 20 nt, Homo sapiens
uauuuaucuggccauugcac

SEQ ID NO: 508142 - RNA, 16 nt, Homo sapiens
uauuucagacacuaug

SEQ ID NO: 508143 - RNA, 23 nt, Homo sapiens
uauuucuaaaacauuaauugagg

SEQ ID NO: 508144 - RNA, 14 nt, Homo sapiens
uauuuguuucauua

SEQ ID NO: 508145 - RNA, 20 nt, Homo sapiens
uauuuguuuggucacugcua

SEQ ID NO: 508146 - RNA, 17 nt, Homo sapiens
uauuuuuccucuuucac

SEQ ID NO: 508147 - RNA, 13 nt, Homo sapiens
ucaaaaagccaaa

SEQ ID NO: 508148 - RNA, 22 nt, Homo sapiens
ucaaaauguggaccaguucccu

SEQ ID NO: 508149 - RNA, 13 nt, Homo sapiens
ucaaauggaugua

SEQ ID NO: 508150 - RNA, 15 nt, Homo sapiens
ucaacuuacauaugu

SEQ ID NO: 508151 - RNA, 16 nt, Homo sapiens
ucaagacacagacaaa

SEQ ID NO: 508152 - RNA, 19 nt, Homo sapiens
ucaagacacagacaaaguc

SEQ ID NO: 508153 - RNA, 14 nt, Homo sapiens
ucaagagacaguau

SEQ ID NO: 508154 - RNA, 18 nt, Homo sapiens
ucaagauccugucuugcu

SEQ ID NO: 508155 - RNA, 23 nt, Homo sapiens
ucaaguaagaucaagaaucuuuu

SEQ ID NO: 508156 - RNA, 18 nt, Homo sapiens
ucaaguguuaccuaacaa

SEQ ID NO: 508157 - RNA, 15 nt, Homo sapiens
ucaaguugugugcua

SEQ ID NO: 508158 - RNA, 19 nt, Homo sapiens
ucaauaacuauugcugcuu

SEQ ID NO: 508159 - RNA, 13 nt, Homo sapiens
ucaauaaggcagu

SEQ ID NO: 508160 - RNA, 17 nt, Homo sapiens
ucaauaaggcagugcag

SEQ ID NO: 508161 - RNA, 14 nt, Homo sapiens
ucaauaagugccau

SEQ ID NO: 508162 - RNA, 18 nt, Homo sapiens
auaauaaccacgauucca

SEQ ID NO: 508163 - RNA, 16 nt, Homo sapiens
auaauagcucacagca

SEQ ID NO: 508164 - RNA, 15 nt, Homo sapiens
auaauauguacaaau

SEQ ID NO: 508165 - RNA, 15 nt, Homo sapiens
auaauucuuacuguu

SEQ ID NO: 508166 - RNA, 14 nt, Homo sapiens
auaauugugcuuua

SEQ ID NO: 508167 - RNA, 19 nt, Homo sapiens
auacaaacaggugcuaaca

SEQ ID NO: 508168 - RNA, 16 nt, Homo sapiens
auacaaauauugugau

SEQ ID NO: 508169 - RNA, 14 nt, Homo sapiens
auacacacacacac

SEQ ID NO: 508170 - RNA, 13 nt, Homo sapiens
auacacacaggag

SEQ ID NO: 508171 - RNA, 13 nt, Homo sapiens
auacacaccugaa

SEQ ID NO: 508172 - RNA, 13 nt, Homo sapiens
auacagaccucca

SEQ ID NO: 508173 - RNA, 22 nt, Homo sapiens
auacauaaaaaagggacaagca

SEQ ID NO: 508174 - RNA, 19 nt, Homo sapiens
auacauucuaaaucacuuu

SEQ ID NO: 508175 - RNA, 18 nt, Homo sapiens
auacccacugccagacau

SEQ ID NO: 508176 - RNA, 23 nt, Homo sapiens
auacugacagaugguaucugcca

SEQ ID NO: 508177 - RNA, 21 nt, Homo sapiens
auagcaacaucuuuugauaau

SEQ ID NO: 508178 - RNA, 11 nt, Homo sapiens
auagcauguau

SEQ ID NO: 508179 - RNA, 22 nt, Homo sapiens
auagccgugugagcagucucag

SEQ ID NO: 508180 - RNA, 18 nt, Homo sapiens
auagcuccuucaugcuuu

SEQ ID NO: 508181 - RNA, 17 nt, Homo sapiens
auagcuuaagaaguauc

SEQ ID NO: 508182 - RNA, 18 nt, Homo sapiens
auaggaggacagaaccaa

SEQ ID NO: 508183 - RNA, 22 nt, Homo sapiens
auagucuucuuucuuagauucu

SEQ ID NO: 508184 - RNA, 16 nt, Homo sapiens
auagugagcauauaua

SEQ ID NO: 508185 - RNA, 22 nt, Homo sapiens
auggccauagcuuuuauucauu

SEQ ID NO: 508186 - RNA, 18 nt, Homo sapiens
auggcucuggcaccacua

SEQ ID NO: 508187 - RNA, 18 nt, Homo sapiens
auggcuuccccauugccu

SEQ ID NO: 508188 - RNA, 16 nt, Homo sapiens
augggaggaucacuug

SEQ ID NO: 508189 - RNA, 14 nt, Homo sapiens
auggggaacauuuu

SEQ ID NO: 508190 - RNA, 15 nt, Homo sapiens
augguagacugugac

SEQ ID NO: 508191 - RNA, 16 nt, Homo sapiens
augguagacugugaca

SEQ ID NO: 508192 - RNA, 18 nt, Homo sapiens
augguauauauuuugaaa

SEQ ID NO: 508193 - RNA, 20 nt, Homo sapiens
auguaaaugcuugauggaau

SEQ ID NO: 508194 - RNA, 16 nt, Homo sapiens
auguacaggcugagac

SEQ ID NO: 508195 - RNA, 19 nt, Homo sapiens
auguauaaugggaaauguu

SEQ ID NO: 508196 - RNA, 20 nt, Homo sapiens
auguauguccauucacuuuc

SEQ ID NO: 508197 - RNA, 12 nt, Homo sapiens
augucaaaugga

SEQ ID NO: 508198 - RNA, 17 nt, Homo sapiens
auguccaaacuuaacag

SEQ ID NO: 508199 - RNA, 18 nt, Homo sapiens
augucuaaaauugucagu

SEQ ID NO: 508200 - RNA, 20 nt, Homo sapiens
augugcaaagcaguauguac

SEQ ID NO: 508201 - RNA, 22 nt, Homo sapiens
augugugaagcaaauuucuaga

SEQ ID NO: 508202 - RNA, 17 nt, Homo sapiens
auguuauaggcacuugc

SEQ ID NO: 508203 - RNA, 16 nt, Homo sapiens
auguuccguucaucug

SEQ ID NO: 508204 - RNA, 13 nt, Homo sapiens
auguucugacagc

SEQ ID NO: 508205 - RNA, 16 nt, Homo sapiens
auguuuaauaauaugu

SEQ ID NO: 508206 - RNA, 19 nt, Homo sapiens
auguuuuuaauccaaagaa

SEQ ID NO: 508207 - RNA, 20 nt, Homo sapiens
auuaaacugggaaaugagau

SEQ ID NO: 508208 - RNA, 14 nt, Homo sapiens
aaaaaaaugauacu

SEQ ID NO: 508209 - RNA, 11 nt, Homo sapiens
aaaaaacugga

SEQ ID NO: 508210 - RNA, 12 nt, Homo sapiens
aaaaaauaugcu

SEQ ID NO: 508211 - RNA, 14 nt, Homo sapiens
aaaaacuguacugu

SEQ ID NO: 508212 - RNA, 15 nt, Homo sapiens
aaaaacuguacugug

SEQ ID NO: 508213 - RNA, 18 nt, Homo sapiens
aaaaacuucccaacucac

SEQ ID NO: 508214 - RNA, 22 nt, Homo sapiens
aaaaagaaagaaaaaagugcaa

SEQ ID NO: 508215 - RNA, 17 nt, Homo sapiens
aaaaaguuaaucuucau

SEQ ID NO: 508216 - RNA, 19 nt, Homo sapiens
aaaaauuugacauugucag

SEQ ID NO: 508217 - RNA, 19 nt, Homo sapiens
aaaacaagagaccacuucc

SEQ ID NO: 508218 - RNA, 23 nt, Homo sapiens
aaaacaagagaccacuuccuuaa

SEQ ID NO: 508219 - RNA, 24 nt, Homo sapiens
aaaacagaccagcauaguucugca

SEQ ID NO: 508220 - RNA, 18 nt, Homo sapiens
aaaaccacagcugggcag

SEQ ID NO: 508221 - RNA, 15 nt, Homo sapiens
aaaagaccaugcauu

SEQ ID NO: 508222 - RNA, 11 nt, Homo sapiens
aaaagcacuuu

SEQ ID NO: 508223 - RNA, 19 nt, Homo sapiens
aaaagcaggaaagauccca

SEQ ID NO: 508224 - RNA, 18 nt, Homo sapiens
aaaagcauguacaguguu

SEQ ID NO: 508225 - RNA, 18 nt, Homo sapiens
aaaagcccuuuccaaagg

SEQ ID NO: 508226 - RNA, 10 nt, Homo sapiens
aaaagugcaa

SEQ ID NO: 508227 - RNA, 12 nt, Homo sapiens
aaaauacaugau

SEQ ID NO: 508228 - RNA, 13 nt, Homo sapiens
aaaauacuucuuu

SEQ ID NO: 508229 - RNA, 20 nt, Homo sapiens
aaaaugagucacuuacuuca

SEQ ID NO: 508230 - RNA, 20 nt, Homo sapiens
aaaaugauggcgacuuguau

SEQ ID NO: 508231 - RNA, 19 nt, Homo sapiens
aaaauguaggccuccaguu

SEQ ID NO: 508232 - RNA, 21 nt, Homo sapiens
aaaauguucugacagcauuuc

SEQ ID NO: 508233 - RNA, 19 nt, Homo sapiens
aaacaaaacuugcaugcag

SEQ ID NO: 508234 - RNA, 23 nt, Homo sapiens
aaacaaaauuuaugucauuuuca

SEQ ID NO: 508235 - RNA, 19 nt, Homo sapiens
aaacaagagaccacuuccu

SEQ ID NO: 508236 - RNA, 18 nt, Homo sapiens
aaacacuucuacuguuca

SEQ ID NO: 508237 - RNA, 16 nt, Homo sapiens
aaacacuucuccuuaa

SEQ ID NO: 508238 - RNA, 17 nt, Homo sapiens
aaacagagaacccugug

SEQ ID NO: 508239 - RNA, 14 nt, Homo sapiens
aaacagauauacuc

SEQ ID NO: 508240 - RNA, 12 nt, Homo sapiens
aaacaggugcua

SEQ ID NO: 508241 - RNA, 17 nt, Homo sapiens
aaacaguguggauguaa

SEQ ID NO: 508242 - RNA, 20 nt, Homo sapiens
aaacauuuggcauuccugaa

SEQ ID NO: 508243 - RNA, 22 nt, Homo sapiens
aaaccacagcugggcaggguga

SEQ ID NO: 508244 - RNA, 23 nt, Homo sapiens
aaaccgaauacggucagcaguca

SEQ ID NO: 508245 - RNA, 14 nt, Homo sapiens
aaacuaagaaucau

SEQ ID NO: 508246 - RNA, 18 nt, Homo sapiens
aaacucgggcacucccua

SEQ ID NO: 508247 - RNA, 13 nt, Homo sapiens
aaacugaagccca

SEQ ID NO: 508248 - RNA, 21 nt, Homo sapiens
aaacugugagauaaauaucau

SEQ ID NO: 508249 - RNA, 20 nt, Homo sapiens
aaacuuguauuggaaguaua

SEQ ID NO: 508250 - RNA, 19 nt, Homo sapiens
aaagaaucaacagugaaca

SEQ ID NO: 508251 - RNA, 20 nt, Homo sapiens
aaagacuucauuuaacacug

SEQ ID NO: 508252 - RNA, 22 nt, Homo sapiens
aaagacuucauuuaacacugag

SEQ ID NO: 508253 - RNA, 23 nt, Homo sapiens
aaagacuucauuuaacacugagu

SEQ ID NO: 508254 - RNA, 19 nt, Homo sapiens
aaagaggaggagaguugaa

SEQ ID NO: 508255 - RNA, 16 nt, Homo sapiens
aaagauauuguaucuc

SEQ ID NO: 508256 - RNA, 12 nt, Homo sapiens
aaagcagugcag

SEQ ID NO: 508257 - RNA, 13 nt, Homo sapiens
aaagcagugcagu

SEQ ID NO: 508258 - RNA, 18 nt, Homo sapiens
aaagcagugcaguacuca

SEQ ID NO: 508259 - RNA, 14 nt, Homo sapiens
aaagccuuccucaa

SEQ ID NO: 508260 - RNA, 19 nt, Homo sapiens
aaagccuugugaucacuuu

SEQ ID NO: 508261 - RNA, 22 nt, Homo sapiens
aaagcuagaggagauugcucug

SEQ ID NO: 508262 - RNA, 13 nt, Homo sapiens
aaaggaagaugua

SEQ ID NO: 508263 - RNA, 15 nt, Homo sapiens
aaagugaaauuagua

SEQ ID NO: 508264 - RNA, 19 nt, Homo sapiens
aaagugcaguagugucacu

SEQ ID NO: 508265 - RNA, 22 nt, Homo sapiens
aaaguguccauugacauguaca

SEQ ID NO: 508266 - RNA, 14 nt, Homo sapiens
aaaguucagugugc

SEQ ID NO: 508267 - RNA, 20 nt, Homo sapiens
aaaguuuacauuguccugua

SEQ ID NO: 508268 - RNA, 18 nt, Homo sapiens
aaaguuuucugcuguaaa

SEQ ID NO: 508269 - RNA, 14 nt, Homo sapiens
aaaguuuugccuau

SEQ ID NO: 508270 - RNA, 12 nt, Homo sapiens
aaauaagccaaa

SEQ ID NO: 508271 - RNA, 23 nt, Homo sapiens
aaauaaggccucauccuccacug

SEQ ID NO: 508272 - RNA, 19 nt, Homo sapiens
aaauaaugauucaauguga

SEQ ID NO: 508273 - RNA, 12 nt, Homo sapiens
aaauacacgugu

SEQ ID NO: 508274 - RNA, 12 nt, Homo sapiens
aaauacauauga

SEQ ID NO: 508275 - RNA, 21 nt, Homo sapiens
aaauacaugccuuuccagugc

SEQ ID NO: 508276 - RNA, 20 nt, Homo sapiens
aaauacauucuaaaucacuu

SEQ ID NO: 508277 - RNA, 12 nt, Homo sapiens
aaauacuugaaa

SEQ ID NO: 508278 - RNA, 19 nt, Homo sapiens
aaauagcacccaaacacau

SEQ ID NO: 508279 - RNA, 14 nt, Homo sapiens
aaauauauauuaaa

SEQ ID NO: 508280 - RNA, 21 nt, Homo sapiens
aaauaucauuauagcauguaa

SEQ ID NO: 508281 - RNA, 22 nt, Homo sapiens
aaauaugauucuccucucccaa

SEQ ID NO: 508282 - RNA, 12 nt, Homo sapiens
aaauaugcucuc

SEQ ID NO: 508283 - RNA, 22 nt, Homo sapiens
aaauauuuuaggaaacucucca

SEQ ID NO: 508284 - RNA, 16 nt, Homo sapiens
aaauccuucagcaauc

SEQ ID NO: 508285 - RNA, 18 nt, Homo sapiens
aaaugaauugccuuugau

SEQ ID NO: 508286 - RNA, 14 nt, Homo sapiens
aaaugauucacuuu

SEQ ID NO: 508287 - RNA, 13 nt, Homo sapiens
aaaugcuacucag

SEQ ID NO: 508288 - RNA, 12 nt, Homo sapiens
aaaugcuuucuc

SEQ ID NO: 508289 - RNA, 12 nt, Homo sapiens
aacauagugucu

SEQ ID NO: 508290 - RNA, 15 nt, Homo sapiens
aacauauacuuccau

SEQ ID NO: 508291 - RNA, 22 nt, Homo sapiens
aacauuuggcauuccugaauaa

SEQ ID NO: 508292 - RNA, 13 nt, Homo sapiens
aacauuuucucaa

SEQ ID NO: 508293 - RNA, 16 nt, Homo sapiens
aaccaacgggucugug

SEQ ID NO: 508294 - RNA, 15 nt, Homo sapiens
aaccauuuugcagaa

SEQ ID NO: 508295 - RNA, 12 nt, Homo sapiens
aacccaagagag

SEQ ID NO: 508296 - RNA, 20 nt, Homo sapiens
aacccaguguucagcauaga

SEQ ID NO: 508297 - RNA, 18 nt, Homo sapiens
aacccggcugacucagug

SEQ ID NO: 508298 - RNA, 12 nt, Homo sapiens
aacccugugauc

SEQ ID NO: 508299 - RNA, 23 nt, Homo sapiens
aacccugugaucuauaccaccuu

SEQ ID NO: 508300 - RNA, 16 nt, Homo sapiens
aacccuuuuacaguca

SEQ ID NO: 508301 - RNA, 21 nt, Homo sapiens
aacccuuuuacagucacauuc

SEQ ID NO: 508302 - RNA, 23 nt, Homo sapiens
aacccuuuuacagucacauucag

SEQ ID NO: 508303 - RNA, 19 nt, Homo sapiens
aaccuggguuguugcagag

SEQ ID NO: 508304 - RNA, 23 nt, Homo sapiens
aaccuguucacgugacuccucaa

SEQ ID NO: 508305 - RNA, 13 nt, Homo sapiens
aacgcaugcaggg

SEQ ID NO: 508306 - RNA, 12 nt, Homo sapiens
aacguggcugcu

SEQ ID NO: 508307 - RNA, 22 nt, Homo sapiens
aacuaaaggaaacaaagcaaua

SEQ ID NO: 508308 - RNA, 13 nt, Homo sapiens
aacuaaauguugc

SEQ ID NO: 508309 - RNA, 13 nt, Homo sapiens
aacuaacacuauu

SEQ ID NO: 508310 - RNA, 15 nt, Homo sapiens
aacuagcaaaaggau

SEQ ID NO: 508311 - RNA, 12 nt, Homo sapiens
aacuagugcucu

SEQ ID NO: 508312 - RNA, 17 nt, Homo sapiens
aacuccaagacagccau

SEQ ID NO: 508313 - RNA, 13 nt, Homo sapiens
aacuccuuucuaa

SEQ ID NO: 508314 - RNA, 13 nt, Homo sapiens
aacucuccaugau

SEQ ID NO: 508315 - RNA, 14 nt, Homo sapiens
aacucugacuguaa

SEQ ID NO: 508316 - RNA, 12 nt, Homo sapiens
aacugaagccca

SEQ ID NO: 508317 - RNA, 13 nt, Homo sapiens
aacugagcacuuu

SEQ ID NO: 508318 - RNA, 20 nt, Homo sapiens
aacugaguuagaauguugaa

SEQ ID NO: 508319 - RNA, 16 nt, Homo sapiens
aacuggaaacaucuga

SEQ ID NO: 508320 - RNA, 16 nt, Homo sapiens
aacugugacauuccac

SEQ ID NO: 508321 - RNA, 21 nt, Homo sapiens
aacuguuccuuggucuauuua

SEQ ID NO: 508322 - RNA, 15 nt, Homo sapiens
aacuucaugcugucu

SEQ ID NO: 508323 - RNA, 17 nt, Homo sapiens
aacuucuuaacuggcaa

SEQ ID NO: 508324 - RNA, 16 nt, Homo sapiens
aacuuggugccuaaug

SEQ ID NO: 508325 - RNA, 21 nt, Homo sapiens
aacuuggugccuaauguucca

SEQ ID NO: 508326 - RNA, 15 nt, Homo sapiens
aacuuuuuauucuca

SEQ ID NO: 508327 - RNA, 16 nt, Homo sapiens
aacuuuuuauucucag

SEQ ID NO: 508328 - RNA, 21 nt, Homo sapiens
aagaaagcuguaauauauagu

SEQ ID NO: 508329 - RNA, 20 nt, Homo sapiens
aagaaauuagggcucuaauu

SEQ ID NO: 508330 - RNA, 12 nt, Homo sapiens
aagaacuuggaa

SEQ ID NO: 508331 - RNA, 14 nt, Homo sapiens
aagaagccaggaaa

SEQ ID NO: 508332 - RNA, 20 nt, Homo sapiens
aagaagggaaccacagugga

SEQ ID NO: 508333 - RNA, 14 nt, Homo sapiens
aagaauaaaaugca

SEQ ID NO: 508334 - RNA, 18 nt, Homo sapiens
aagaauaaaaugcaguga

SEQ ID NO: 508335 - RNA, 14 nt, Homo sapiens
aagaaucaccuaau

SEQ ID NO: 508336 - RNA, 15 nt, Homo sapiens
aagaauucaguagca

SEQ ID NO: 508337 - RNA, 13 nt, Homo sapiens
aagacagugcagu

SEQ ID NO: 508338 - RNA, 18 nt, Homo sapiens
aagacagugcagugcuca

SEQ ID NO: 508339 - RNA, 21 nt, Homo sapiens
aagagaaaaagcccucuucaa

SEQ ID NO: 508340 - RNA, 16 nt, Homo sapiens
aagagaccacuuccuu

SEQ ID NO: 508341 - RNA, 19 nt, Homo sapiens
aagagccugacuguguuca

SEQ ID NO: 508342 - RNA, 20 nt, Homo sapiens
aagauaaguguguuugcaaa

SEQ ID NO: 508343 - RNA, 20 nt, Homo sapiens
aagaucaagcuccaucuuau

SEQ ID NO: 508344 - RNA, 19 nt, Homo sapiens
aagauccugucuugcugag

SEQ ID NO: 508345 - RNA, 19 nt, Homo sapiens
aagcaaacacacagacucu

SEQ ID NO: 508346 - RNA, 12 nt, Homo sapiens
aagcaagcucac

SEQ ID NO: 508347 - RNA, 24 nt, Homo sapiens
aagcacaaccauguucuugagcag

SEQ ID NO: 508348 - RNA, 12 nt, Homo sapiens
aagcagcagcua

SEQ ID NO: 508349 - RNA, 16 nt, Homo sapiens
aagcauagacgucuca

SEQ ID NO: 508350 - RNA, 18 nt, Homo sapiens
aagcauccaggcacccaa

SEQ ID NO: 508351 - RNA, 13 nt, Homo sapiens
aagcaucugugua

SEQ ID NO: 508352 - RNA, 21 nt, Homo sapiens
aagcaucuguguaaccuccac

SEQ ID NO: 508353 - RNA, 14 nt, Homo sapiens
aagccaaguguccu

SEQ ID NO: 508354 - RNA, 19 nt, Homo sapiens
aagccagcugcaggaauca

SEQ ID NO: 508355 - RNA, 21 nt, Homo sapiens
aagcccagccuaucucucuuc

SEQ ID NO: 508356 - RNA, 13 nt, Homo sapiens
aagcccucugagc

SEQ ID NO: 508357 - RNA, 14 nt, Homo sapiens
aagcgaaauacuug

SEQ ID NO: 508358 - RNA, 23 nt, Homo sapiens
aagcuaaaaugaaaaauagugug

SEQ ID NO: 508359 - RNA, 13 nt, Homo sapiens
aagcucacacuug

SEQ ID NO: 508360 - RNA, 13 nt, Homo sapiens
aagcugucacuca

SEQ ID NO: 508361 - RNA, 13 nt, Homo sapiens
aagcuuauuuccc

SEQ ID NO: 508362 - RNA, 14 nt, Homo sapiens
aaggaaacaaagca

SEQ ID NO: 508363 - RNA, 19 nt, Homo sapiens
aaggaagauguaagaagcu

SEQ ID NO: 508364 - RNA, 12 nt, Homo sapiens
aaggaucacuug

SEQ ID NO: 508365 - RNA, 22 nt, Homo sapiens
aaggcaacccaaaugguggcca

SEQ ID NO: 508366 - RNA, 24 nt, Homo sapiens
aaggcauccacuucacaguucuga

SEQ ID NO: 508367 - RNA, 14 nt, Homo sapiens
aaggcugcugugua

SEQ ID NO: 508368 - RNA, 12 nt, Homo sapiens
aaggcuguguca

SEQ ID NO: 508369 - RNA, 21 nt, Homo sapiens
aaggcuucuccacaaccuccu

SEQ ID NO: 508370 - RNA, 20 nt, Homo sapiens
aagggaaggcugcuguguag

SEQ ID NO: 508371 - RNA, 16 nt, Homo sapiens
aagggugcccaccucu

SEQ ID NO: 508372 - RNA, 17 nt, Homo sapiens
aagggugcccaccucuu

SEQ ID NO: 508373 - RNA, 22 nt, Homo sapiens
aaggguguucgguugcgugcau

SEQ ID NO: 508374 - RNA, 21 nt, Homo sapiens
aaggguucugcccugccugag

SEQ ID NO: 508375 - RNA, 15 nt, Homo sapiens
aagguauugagacau

SEQ ID NO: 508376 - RNA, 15 nt, Homo sapiens
aagguucuugcugcc

SEQ ID NO: 508377 - RNA, 16 nt, Homo sapiens
aagguuuaaagcuuau

SEQ ID NO: 508378 - RNA, 18 nt, Homo sapiens
aaguacugcaugaucuua

SEQ ID NO: 508379 - RNA, 18 nt, Homo sapiens
aagucaaacaguguggcu

SEQ ID NO: 508380 - RNA, 13 nt, Homo sapiens
aagucaggccauu

SEQ ID NO: 508381 - RNA, 15 nt, Homo sapiens
aagugaugugauuua

SEQ ID NO: 508382 - RNA, 19 nt, Homo sapiens
aauauauguuuggcugaaa

SEQ ID NO: 508383 - RNA, 23 nt, Homo sapiens
aauaucugugaaggacuugguga

SEQ ID NO: 508384 - RNA, 12 nt, Homo sapiens
aauauguacaaa

SEQ ID NO: 508385 - RNA, 17 nt, Homo sapiens
aauauuacaaauucuaa

SEQ ID NO: 508386 - RNA, 17 nt, Homo sapiens
aauauuauuugcuaauu

SEQ ID NO: 508387 - RNA, 13 nt, Homo sapiens
aauauucugucau

SEQ ID NO: 508388 - RNA, 10 nt, Homo sapiens
aauauugcca

SEQ ID NO: 508389 - RNA, 19 nt, Homo sapiens
aauauugccauauucugua

SEQ ID NO: 508390 - RNA, 15 nt, Homo sapiens
aaucaagucugugaa

SEQ ID NO: 508391 - RNA, 20 nt, Homo sapiens
aaucaccuaauuaauuucag

SEQ ID NO: 508392 - RNA, 16 nt, Homo sapiens
aaucauccucaugccu

SEQ ID NO: 508393 - RNA, 18 nt, Homo sapiens
aaucauccucaugccuuu

SEQ ID NO: 508394 - RNA, 21 nt, Homo sapiens
aauccacgcucaaucucaggu

SEQ ID NO: 508395 - RNA, 20 nt, Homo sapiens
aauccaugugacucaagccu

SEQ ID NO: 508396 - RNA, 21 nt, Homo sapiens
aauccaugugcugcuguggca

SEQ ID NO: 508397 - RNA, 23 nt, Homo sapiens
aauccaugugcugcuguggcauc

SEQ ID NO: 508398 - RNA, 17 nt, Homo sapiens
aauccugacaaaaggga

SEQ ID NO: 508399 - RNA, 17 nt, Homo sapiens
aaucuacaaacuuuuau

SEQ ID NO: 508400 - RNA, 14 nt, Homo sapiens
aaucuacaacauaa

SEQ ID NO: 508401 - RNA, 13 nt, Homo sapiens
aaucugcuuucau

SEQ ID NO: 508402 - RNA, 23 nt, Homo sapiens
aaucuugcugugaaacagugugg

SEQ ID NO: 508403 - RNA, 20 nt, Homo sapiens
aaucuuugaaaacucauaca

SEQ ID NO: 508404 - RNA, 13 nt, Homo sapiens
aaugaagcugcca

SEQ ID NO: 508405 - RNA, 13 nt, Homo sapiens
aaugaauugccuu

SEQ ID NO: 508406 - RNA, 20 nt, Homo sapiens
aaugagggcgugaaacacaa

SEQ ID NO: 508407 - RNA, 18 nt, Homo sapiens
aaugauaauagcucacag

SEQ ID NO: 508408 - RNA, 19 nt, Homo sapiens
aaugauacugaauuguuau

SEQ ID NO: 508409 - RNA, 17 nt, Homo sapiens
aaugccaauucaucuca

SEQ ID NO: 508410 - RNA, 18 nt, Homo sapiens
aaugccaauucaucucag

SEQ ID NO: 508411 - RNA, 19 nt, Homo sapiens
aaugccagggacauuuuca

SEQ ID NO: 508412 - RNA, 16 nt, Homo sapiens
aaugcuaaaugucaau

SEQ ID NO: 508413 - RNA, 23 nt, Homo sapiens
aaugcucaguaacacagugcagu

SEQ ID NO: 508414 - RNA, 16 nt, Homo sapiens
aaugcugauucaaggc

SEQ ID NO: 508415 - RNA, 21 nt, Homo sapiens
aaugcugauuuaaacuucuua

SEQ ID NO: 508416 - RNA, 13 nt, Homo sapiens
aauggcugaagaa

SEQ ID NO: 508417 - RNA, 18 nt, Homo sapiens
aauggggggcgggccagg

SEQ ID NO: 508418 - RNA, 21 nt, Homo sapiens
aauguaaagauacugagaaua

SEQ ID NO: 508419 - RNA, 12 nt, Homo sapiens
aaugugccaaaa

SEQ ID NO: 508420 - RNA, 20 nt, Homo sapiens
aaugugugaaggucuugccu

SEQ ID NO: 508421 - RNA, 21 nt, Homo sapiens
aauguuccaugucugaaguuu

SEQ ID NO: 508422 - RNA, 18 nt, Homo sapiens
aauguuuuuuauacuuca

SEQ ID NO: 508423 - RNA, 22 nt, Homo sapiens
aauuaacaaauucaguggacau

SEQ ID NO: 508424 - RNA, 14 nt, Homo sapiens
aauuaacuaacuca

SEQ ID NO: 508425 - RNA, 22 nt, Homo sapiens
aauuaacuccguuuccaaauac

SEQ ID NO: 508426 - RNA, 20 nt, Homo sapiens
aauuaaugaguuuuauccaa

SEQ ID NO: 508427 - RNA, 17 nt, Homo sapiens
aauuagacauaccucuc

SEQ ID NO: 508428 - RNA, 18 nt, Homo sapiens
aauucauugucucaguga

SEQ ID NO: 508429 - RNA, 22 nt, Homo sapiens
aauucuguuuauguucuugcag

SEQ ID NO: 508430 - RNA, 14 nt, Homo sapiens
aauugauucaaggg

SEQ ID NO: 508431 - RNA, 16 nt, Homo sapiens
aauugcaguucaguuc

SEQ ID NO: 508432 - RNA, 15 nt, Homo sapiens
aauuuaccacaggau

SEQ ID NO: 508433 - RNA, 18 nt, Homo sapiens
aauuuaccaucaaacaaa

SEQ ID NO: 508434 - RNA, 19 nt, Homo sapiens
aauuuaugaagauaguuua

SEQ ID NO: 508435 - RNA, 16 nt, Homo sapiens
aauuugauaucacagu

SEQ ID NO: 508436 - RNA, 16 nt, Homo sapiens
aauuugcuuagccuuu

SEQ ID NO: 508437 - RNA, 16 nt, Homo sapiens
aauuuguucugugcaa

SEQ ID NO: 508438 - RNA, 18 nt, Homo sapiens
aauuuuauugcuggaauc

SEQ ID NO: 508439 - RNA, 16 nt, Homo sapiens
aauuuucccagugaau

SEQ ID NO: 508440 - RNA, 15 nt, Homo sapiens
acaaaaacuuuccau

SEQ ID NO: 508441 - RNA, 16 nt, Homo sapiens
acaaaaguaaaagaga

SEQ ID NO: 508442 - RNA, 18 nt, Homo sapiens
acaaaauauccaagccca

SEQ ID NO: 508443 - RNA, 18 nt, Homo sapiens
acaaagggaaggcugcug

SEQ ID NO: 508444 - RNA, 23 nt, Homo sapiens
acaaagggaaggcugcuguguag

SEQ ID NO: 508445 - RNA, 23 nt, Homo sapiens
acaaagugaaauuaguauuuuga

SEQ ID NO: 508446 - RNA, 19 nt, Homo sapiens
acaaauggcuuguucaguc

SEQ ID NO: 508447 - RNA, 13 nt, Homo sapiens
acaagucugagua

SEQ ID NO: 508448 - RNA, 18 nt, Homo sapiens
acaauacaacacauugaa

SEQ ID NO: 508449 - RNA, 20 nt, Homo sapiens
acaauggcuggguuugggca

SEQ ID NO: 508450 - RNA, 22 nt, Homo sapiens
acaauguggaauuacauaacag

SEQ ID NO: 508451 - RNA, 12 nt, Homo sapiens
acacaaagugaa

SEQ ID NO: 508452 - RNA, 13 nt, Homo sapiens
acacaaauccaac

SEQ ID NO: 508453 - RNA, 14 nt, Homo sapiens
acacaccuugccca

SEQ ID NO: 508454 - RNA, 22 nt, Homo sapiens
acacaggggcaaagaacugccc

SEQ ID NO: 508455 - RNA, 13 nt, Homo sapiens
acacagugcagua

SEQ ID NO: 508456 - RNA, 18 nt, Homo sapiens
acacauaguguuuguaac

SEQ ID NO: 508457 - RNA, 19 nt, Homo sapiens
acacauaguguuuguaaca

SEQ ID NO: 508458 - RNA, 16 nt, Homo sapiens
acacauauauacauac

SEQ ID NO: 508459 - RNA, 17 nt, Homo sapiens
acacauugaaacuguau

SEQ ID NO: 508460 - RNA, 13 nt, Homo sapiens
acacccuucccca

SEQ ID NO: 508461 - RNA, 18 nt, Homo sapiens
acacgaacaaaccaagga

SEQ ID NO: 508462 - RNA, 20 nt, Homo sapiens
acacucaucccccaucagau

SEQ ID NO: 508463 - RNA, 23 nt, Homo sapiens
acacugagcaaguuuucaccuau

SEQ ID NO: 508464 - RNA, 22 nt, Homo sapiens
acacugccuggaggauagcaga

SEQ ID NO: 508465 - RNA, 11 nt, Homo sapiens
acacugugaac

SEQ ID NO: 508466 - RNA, 21 nt, Homo sapiens
acagaacaacaacaaagcaug

SEQ ID NO: 508467 - RNA, 19 nt, Homo sapiens
acagaagaaaaacacugag

SEQ ID NO: 508468 - RNA, 14 nt, Homo sapiens
acagaccagcauag

SEQ ID NO: 508469 - RNA, 21 nt, Homo sapiens
acagaccagcauaguucugca

SEQ ID NO: 508470 - RNA, 19 nt, Homo sapiens
acagagaucagaauugaac

SEQ ID NO: 508471 - RNA, 23 nt, Homo sapiens
acagaugguguccugcauguaug

SEQ ID NO: 508472 - RNA, 23 nt, Homo sapiens
acagcaucugccaggacacugcc

SEQ ID NO: 508473 - RNA, 14 nt, Homo sapiens
cacaaguauuacac

SEQ ID NO: 508474 - RNA, 21 nt, Homo sapiens
cacaaguauugcccuuuaaca

SEQ ID NO: 508475 - RNA, 22 nt, Homo sapiens
cacaauaaaagaaacugugguc

SEQ ID NO: 508476 - RNA, 12 nt, Homo sapiens
cacacaacugug

SEQ ID NO: 508477 - RNA, 13 nt, Homo sapiens
cacacacauauau

SEQ ID NO: 508478 - RNA, 20 nt, Homo sapiens
cacaccuugcccaugcacaa

SEQ ID NO: 508479 - RNA, 13 nt, Homo sapiens
cacacugagcugg

SEQ ID NO: 508480 - RNA, 12 nt, Homo sapiens
cacagccauagc

SEQ ID NO: 508481 - RNA, 16 nt, Homo sapiens
cacaggagcguguacu

SEQ ID NO: 508482 - RNA, 17 nt, Homo sapiens
cacaggagcguguacua

SEQ ID NO: 508483 - RNA, 19 nt, Homo sapiens
cacaggagcguguacuacc

SEQ ID NO: 508484 - RNA, 23 nt, Homo sapiens
cacaggagcguguacuaccccag

SEQ ID NO: 508485 - RNA, 13 nt, Homo sapiens
cacagggacacag

SEQ ID NO: 508486 - RNA, 22 nt, Homo sapiens
cacagucuggugcccagacuca

SEQ ID NO: 508487 - RNA, 13 nt, Homo sapiens
cacagugcaguac

SEQ ID NO: 508488 - RNA, 12 nt, Homo sapiens
cacagugcagug

SEQ ID NO: 508489 - RNA, 13 nt, Homo sapiens
cacagugccccag

SEQ ID NO: 508490 - RNA, 12 nt, Homo sapiens
cacauacauaua

SEQ ID NO: 508491 - RNA, 14 nt, Homo sapiens
cacauauauacaua

SEQ ID NO: 508492 - RNA, 18 nt, Homo sapiens
cacauccaacuacuccua

SEQ ID NO: 508493 - RNA, 22 nt, Homo sapiens
cacaucuggagcugaagcguua

SEQ ID NO: 508494 - RNA, 21 nt, Homo sapiens
cacauguauguccauucacuu

SEQ ID NO: 508495 - RNA, 24 nt, Homo sapiens
cacauguauguccauucacuuuca

SEQ ID NO: 508496 - RNA, 15 nt, Homo sapiens
cacauguggggacag

SEQ ID NO: 508497 - RNA, 13 nt, Homo sapiens
caccaagccucug

SEQ ID NO: 508498 - RNA, 22 nt, Homo sapiens
caccacuuucccacacugugaa

SEQ ID NO: 508499 - RNA, 23 nt, Homo sapiens
cacccucugcuaugucugugaug

SEQ ID NO: 508500 - RNA, 14 nt, Homo sapiens
cacccugacugugg

SEQ ID NO: 508501 - RNA, 21 nt, Homo sapiens
caccuucccuaguucuuugca

SEQ ID NO: 508502 - RNA, 17 nt, Homo sapiens
caccuuguacagaacca

SEQ ID NO: 508503 - RNA, 20 nt, Homo sapiens
cacgccgauauaagccauag

SEQ ID NO: 508504 - RNA, 16 nt, Homo sapiens
cacuaagcuuucuccu

SEQ ID NO: 508505 - RNA, 17 nt, Homo sapiens
cacuacagguguugaau

SEQ ID NO: 508506 - RNA, 16 nt, Homo sapiens
cacuauuuuaugcaaa

SEQ ID NO: 508507 - RNA, 21 nt, Homo sapiens
cacucagaugcccaguaucau

SEQ ID NO: 508508 - RNA, 21 nt, Homo sapiens
cacucaggagcacagccauag

SEQ ID NO: 508509 - RNA, 20 nt, Homo sapiens
cacucucuucuuacuguauu

SEQ ID NO: 508510 - RNA, 16 nt, Homo sapiens
cacugaaguagccaac

SEQ ID NO: 508511 - RNA, 13 nt, Homo sapiens
cacugguuuucaa

SEQ ID NO: 508512 - RNA, 19 nt, Homo sapiens
cacuguauaccccgugaag

SEQ ID NO: 508513 - RNA, 17 nt, Homo sapiens
cacugugaccugcuccu

SEQ ID NO: 508514 - RNA, 18 nt, Homo sapiens
cacuuccuuaacagcugu

SEQ ID NO: 508515 - RNA, 22 nt, Homo sapiens
cacuuccuuaacagcuguauua

SEQ ID NO: 508516 - RNA, 17 nt, Homo sapiens
cacuuuuuuccugucaa

SEQ ID NO: 508517 - RNA, 13 nt, Homo sapiens
cagaaaagcaccu

SEQ ID NO: 508518 - RNA, 18 nt, Homo sapiens
cagaaacacggaguuucc

SEQ ID NO: 508519 - RNA, 20 nt, Homo sapiens
cagaaacacggaguuuccau

SEQ ID NO: 508520 - RNA, 20 nt, Homo sapiens
cagaaacccuuuuacaguca

SEQ ID NO: 508521 - RNA, 18 nt, Homo sapiens
cagaacccagacccugag

SEQ ID NO: 508522 - RNA, 16 nt, Homo sapiens
cagaacgcaugcaggg

SEQ ID NO: 508523 - RNA, 18 nt, Homo sapiens
cagaagcaguugcaauaa

SEQ ID NO: 508524 - RNA, 20 nt, Homo sapiens
cagacacuauguagucuguu

SEQ ID NO: 508525 - RNA, 16 nt, Homo sapiens
cagaccucggcugugu

SEQ ID NO: 508526 - RNA, 15 nt, Homo sapiens
cagacggacgggaca

SEQ ID NO: 508527 - RNA, 13 nt, Homo sapiens
cagagcaaaagaa

SEQ ID NO: 508528 - RNA, 14 nt, Homo sapiens
cagagcacuguaua

SEQ ID NO: 508529 - RNA, 15 nt, Homo sapiens
cagagcacuguauac

SEQ ID NO: 508530 - RNA, 13 nt, Homo sapiens
cagagcugagcau

SEQ ID NO: 508531 - RNA, 17 nt, Homo sapiens
cagagcuuuacagugcc

SEQ ID NO: 508532 - RNA, 17 nt, Homo sapiens
cagaucccucuccagug

SEQ ID NO: 508533 - RNA, 15 nt, Homo sapiens
cagcaaaagugcagu

SEQ ID NO: 508534 - RNA, 16 nt, Homo sapiens
cagcaauaauugacaa

SEQ ID NO: 508535 - RNA, 18 nt, Homo sapiens
cagcaaugccugccugaa

SEQ ID NO: 508536 - RNA, 20 nt, Homo sapiens
cagcaccuccgggacugacc

SEQ ID NO: 508537 - RNA, 16 nt, Homo sapiens
cagcaguccaagguau

SEQ ID NO: 508538 - RNA, 12 nt, Homo sapiens
cagcauagagcu

SEQ ID NO: 508539 - RNA, 24 nt, Homo sapiens
cagcccaguguagagauuggcacu

SEQ ID NO: 508540 - RNA, 16 nt, Homo sapiens
cagcccgacaggcaug

SEQ ID NO: 508541 - RNA, 16 nt, Homo sapiens
cagcgccagggcucag

SEQ ID NO: 508542 - RNA, 23 nt, Homo sapiens
cagcuagaaagagaaaaagcccu

SEQ ID NO: 508543 - RNA, 16 nt, Homo sapiens
caggaagggaccccac

SEQ ID NO: 508544 - RNA, 17 nt, Homo sapiens
caggagaaaaugcaauu

SEQ ID NO: 508545 - RNA, 19 nt, Homo sapiens
caggagcguguacuacccc

SEQ ID NO: 508546 - RNA, 15 nt, Homo sapiens
caggagcguguccua

SEQ ID NO: 508547 - RNA, 13 nt, Homo sapiens
caggaggcugcaa

SEQ ID NO: 508548 - RNA, 17 nt, Homo sapiens
caggaugaaggggccag

SEQ ID NO: 508549 - RNA, 14 nt, Homo sapiens
caggcaccaugcug

SEQ ID NO: 508550 - RNA, 16 nt, Homo sapiens
caggcagcugcaguua

SEQ ID NO: 508551 - RNA, 12 nt, Homo sapiens
caggcagugcag

SEQ ID NO: 508552 - RNA, 17 nt, Homo sapiens
caggcaguuaggugcug

SEQ ID NO: 508553 - RNA, 17 nt, Homo sapiens
caggccccuuaccugca

SEQ ID NO: 508554 - RNA, 14 nt, Homo sapiens
caggcccuggugag

SEQ ID NO: 508555 - RNA, 22 nt, Homo sapiens
cagggaacggaaagaagagaga

SEQ ID NO: 508556 - RNA, 13 nt, Homo sapiens
cagggaaugccag

SEQ ID NO: 508557 - RNA, 16 nt, Homo sapiens
cagggaccaaggagau

SEQ ID NO: 508558 - RNA, 15 nt, Homo sapiens
cagggaucauagcug

SEQ ID NO: 508559 - RNA, 18 nt, Homo sapiens
cagggcccccacaggagc

SEQ ID NO: 508560 - RNA, 17 nt, Homo sapiens
caggugcgugccacauc

SEQ ID NO: 508561 - RNA, 15 nt, Homo sapiens
cagguggcauuugca

SEQ ID NO: 508562 - RNA, 21 nt, Homo sapiens
caguaaagaccauuuaguccu

SEQ ID NO: 508563 - RNA, 22 nt, Homo sapiens
caguaaaucagugcaguacuca

SEQ ID NO: 508564 - RNA, 18 nt, Homo sapiens
caguaacacagugcagug

SEQ ID NO: 508565 - RNA, 13 nt, Homo sapiens
caguaacagugca

SEQ ID NO: 508566 - RNA, 15 nt, Homo sapiens
caguaagacagugca

SEQ ID NO: 508567 - RNA, 15 nt, Homo sapiens
caguaaggcagugca

SEQ ID NO: 508568 - RNA, 13 nt, Homo sapiens
caguucugaugag

SEQ ID NO: 508569 - RNA, 15 nt, Homo sapiens
caguuugugaucugu

SEQ ID NO: 508570 - RNA, 22 nt, Homo sapiens
caguuugugaucuguccuucca

SEQ ID NO: 508571 - RNA, 13 nt, Homo sapiens
cauaaacacuucu

SEQ ID NO: 508572 - RNA, 21 nt, Homo sapiens
cauaaagagcacguuuuccau

SEQ ID NO: 508573 - RNA, 22 nt, Homo sapiens
cauaacaggcauugcacuaaaa

SEQ ID NO: 508574 - RNA, 13 nt, Homo sapiens
cauaauaugcaua

SEQ ID NO: 508575 - RNA, 22 nt, Homo sapiens
cauaauugugaguuaauuugau

SEQ ID NO: 508576 - RNA, 16 nt, Homo sapiens
cauacaaauuuuccca

SEQ ID NO: 508577 - RNA, 18 nt, Homo sapiens
cauacgcaauuguauaua

SEQ ID NO: 508578 - RNA, 23 nt, Homo sapiens
cauacucuagauuuuguuuugcu

SEQ ID NO: 508579 - RNA, 14 nt, Homo sapiens
cauagcauagccag

SEQ ID NO: 508580 - RNA, 17 nt, Homo sapiens
cauagugguauuuuaac

SEQ ID NO: 508581 - RNA, 21 nt, Homo sapiens
cauaguuugaauucaugccuc

SEQ ID NO: 508582 - RNA, 14 nt, Homo sapiens
cauauaauuugcca

SEQ ID NO: 508583 - RNA, 24 nt, Homo sapiens
cauauaggggcaaaaauuugacau

SEQ ID NO: 508584 - RNA, 24 nt, Homo sapiens
cauauauaauuuuauugcuggaau

SEQ ID NO: 508585 - RNA, 18 nt, Homo sapiens
cauauauauaaaauacac

SEQ ID NO: 508586 - RNA, 12 nt, Homo sapiens
cauaucagcucu

SEQ ID NO: 508587 - RNA, 19 nt, Homo sapiens
cauaucagcucugcauaag

SEQ ID NO: 508588 - RNA, 17 nt, Homo sapiens
cauaucuguaugccuca

SEQ ID NO: 508589 - RNA, 13 nt, Homo sapiens
cauccagcagucc

SEQ ID NO: 508590 - RNA, 16 nt, Homo sapiens
cauccagccacugccc

SEQ ID NO: 508591 - RNA, 16 nt, Homo sapiens
cauccucugcuuguca

SEQ ID NO: 508592 - RNA, 22 nt, Homo sapiens
cauccuucccgcagcaccagcc

SEQ ID NO: 508593 - RNA, 14 nt, Homo sapiens
cauccuugcugcag

SEQ ID NO: 508594 - RNA, 16 nt, Homo sapiens
caucgguuuauacuau

SEQ ID NO: 508595 - RNA, 19 nt, Homo sapiens
caucuaaauauuaugccuu

SEQ ID NO: 508596 - RNA, 22 nt, Homo sapiens
caucucagcaaucacaagccaa

SEQ ID NO: 508597 - RNA, 22 nt, Homo sapiens
caucuggagcugaagcguuacu

SEQ ID NO: 508598 - RNA, 22 nt, Homo sapiens
caucugucagcuucccaacaau

SEQ ID NO: 508599 - RNA, 15 nt, Homo sapiens
caucugucagugagu

SEQ ID NO: 508600 - RNA, 14 nt, Homo sapiens
caucuguuccagaa

SEQ ID NO: 508601 - RNA, 13 nt, Homo sapiens
caucuuuugauaa

SEQ ID NO: 508602 - RNA, 23 nt, Homo sapiens
caugacugauguuggggaaaaag

SEQ ID NO: 508603 - RNA, 23 nt, Homo sapiens
caugacuucuuuacuaacacugg

SEQ ID NO: 508604 - RNA, 19 nt, Homo sapiens
caugaguucugcacauaca

SEQ ID NO: 508605 - RNA, 16 nt, Homo sapiens
caugccuuuccagugc

SEQ ID NO: 508606 - RNA, 20 nt, Homo sapiens
caugccuuuccagugcugcu

SEQ ID NO: 508607 - RNA, 13 nt, Homo sapiens
caugcucccucau

SEQ ID NO: 508608 - RNA, 21 nt, Homo sapiens
caugcugggcucacuacaugg

SEQ ID NO: 508609 - RNA, 11 nt, Homo sapiens
caugcuuucuc

SEQ ID NO: 508610 - RNA, 22 nt, Homo sapiens
cauggaacucagcugucugugg

SEQ ID NO: 508611 - RNA, 18 nt, Homo sapiens
cauggaaugcaauuugac

SEQ ID NO: 508612 - RNA, 21 nt, Homo sapiens
caugggccagcccuugcucua

SEQ ID NO: 508613 - RNA, 22 nt, Homo sapiens
caugguagacugugacacagcu

SEQ ID NO: 508614 - RNA, 16 nt, Homo sapiens
cauguaaucacauaug

SEQ ID NO: 508615 - RNA, 17 nt, Homo sapiens
caugugauguguugcuc

SEQ ID NO: 508616 - RNA, 17 nt, Homo sapiens
cauguggcuaaaugccu

SEQ ID NO: 508617 - RNA, 21 nt, Homo sapiens
cauguugccaugaggccuuuc

SEQ ID NO: 508618 - RNA, 23 nt, Homo sapiens
cauguuuaauaauauguacaaau

SEQ ID NO: 508619 - RNA, 22 nt, Homo sapiens
cauuaaaacaagagaccacuuc

SEQ ID NO: 508620 - RNA, 21 nt, Homo sapiens
cauuauagauuuucauguucu

SEQ ID NO: 508621 - RNA, 15 nt, Homo sapiens
cauucccaauuauca

SEQ ID NO: 508622 - RNA, 13 nt, Homo sapiens
cauuccugaauaa

SEQ ID NO: 508623 - RNA, 17 nt, Homo sapiens
cauucuugggaggacac

SEQ ID NO: 508624 - RNA, 17 nt, Homo sapiens
cauugacccucaccuga

SEQ ID NO: 508625 - RNA, 23 nt, Homo sapiens
cauugaugacaugggauugaguu

SEQ ID NO: 508626 - RNA, 17 nt, Homo sapiens
cauugcacuaaaaguga

SEQ ID NO: 508627 - RNA, 22 nt, Homo sapiens
cauugcacuaaaagugauguga

SEQ ID NO: 508628 - RNA, 21 nt, Homo sapiens
cauugcuaaagucaggccauu

SEQ ID NO: 508629 - RNA, 17 nt, Homo sapiens
cauuguccuguagcuuu

SEQ ID NO: 508630 - RNA, 15 nt, Homo sapiens
cauugucucagugaa

SEQ ID NO: 508631 - RNA, 19 nt, Homo sapiens
cauuguguacaaaauaucc

SEQ ID NO: 508632 - RNA, 22 nt, Homo sapiens
cauuuaaucauuuccagcaaaa

SEQ ID NO: 508633 - RNA, 21 nt, Homo sapiens
cauuuaggaaagcagugcagu

SEQ ID NO: 508634 - RNA, 23 nt, Homo sapiens
cauuuaggaaagcagugcaguac

SEQ ID NO: 508635 - RNA, 15 nt, Homo sapiens
cauuucacauuccug

SEQ ID NO: 508636 - RNA, 13 nt, Homo sapiens
cauuucuguaacc

SEQ ID NO: 508637 - RNA, 18 nt, Homo sapiens
cauuugauuugauauaca

SEQ ID NO: 508638 - RNA, 16 nt, Homo sapiens
cauuugcuaguucugc

SEQ ID NO: 508639 - RNA, 16 nt, Homo sapiens
cauuugcugcauuuca

SEQ ID NO: 508640 - RNA, 20 nt, Homo sapiens
cauuuggcauuccugaauaa

SEQ ID NO: 508641 - RNA, 16 nt, Homo sapiens
cauuuuuugucuguga

SEQ ID NO: 508642 - RNA, 18 nt, Homo sapiens
ccaaaccaccgacucuca

SEQ ID NO: 508643 - RNA, 19 nt, Homo sapiens
ccaaagguuucaacuguaa

SEQ ID NO: 508644 - RNA, 14 nt, Homo sapiens
ccaaaguuauccag

SEQ ID NO: 508645 - RNA, 14 nt, Homo sapiens
ccaaauacauucca

SEQ ID NO: 508646 - RNA, 15 nt, Homo sapiens
ccaacaauacuuugu

SEQ ID NO: 508647 - RNA, 12 nt, Homo sapiens
ccaagcugugac

SEQ ID NO: 508648 - RNA, 11 nt, Homo sapiens
ccaaguguccu

SEQ ID NO: 508649 - RNA, 17 nt, Homo sapiens
ccaaguuggagugcagu

SEQ ID NO: 508650 - RNA, 20 nt, Homo sapiens
ccaaugaagcaaacacacag

SEQ ID NO: 508651 - RNA, 14 nt, Homo sapiens
ccaauuucucuuaa

SEQ ID NO: 508652 - RNA, 18 nt, Homo sapiens
ccacaagggcaguggaag

SEQ ID NO: 508653 - RNA, 22 nt, Homo sapiens
ccacauaaacacuucuccuuaa

SEQ ID NO: 508654 - RNA, 18 nt, Homo sapiens
ccacauucacuacugcaa

SEQ ID NO: 508655 - RNA, 19 nt, Homo sapiens
ccacauucacuacugcaaa

SEQ ID NO: 508656 - RNA, 17 nt, Homo sapiens
ccacauugcuucauuaa

SEQ ID NO: 508657 - RNA, 22 nt, Homo sapiens
ccacauugcuucauuaaaacaa

SEQ ID NO: 508658 - RNA, 14 nt, Homo sapiens
ccacauuucucugc

SEQ ID NO: 508659 - RNA, 20 nt, Homo sapiens
ccaccauuuccccugugguu

SEQ ID NO: 508660 - RNA, 14 nt, Homo sapiens
ccacgacauaagcu

SEQ ID NO: 508661 - RNA, 22 nt, Homo sapiens
ccacgaggagcuuccagugcau

SEQ ID NO: 508662 - RNA, 17 nt, Homo sapiens
ccacgugggguggaauu

SEQ ID NO: 508663 - RNA, 19 nt, Homo sapiens
ccacgugugcagacugugg

SEQ ID NO: 508664 - RNA, 15 nt, Homo sapiens
ccacuccagaagcau

SEQ ID NO: 508665 - RNA, 14 nt, Homo sapiens
ccacugaagaguau

SEQ ID NO: 508666 - RNA, 15 nt, Homo sapiens
ccacugcccaaagcc

SEQ ID NO: 508667 - RNA, 17 nt, Homo sapiens
ccacugcccaaagccau

SEQ ID NO: 508668 - RNA, 15 nt, Homo sapiens
ccacuugaacucuuu

SEQ ID NO: 508669 - RNA, 16 nt, Homo sapiens
ccagaagcagcagcua

SEQ ID NO: 508670 - RNA, 22 nt, Homo sapiens
ccagaagcucaaggcugcagug

SEQ ID NO: 508671 - RNA, 18 nt, Homo sapiens
ccagagcccugcagucac

SEQ ID NO: 508672 - RNA, 19 nt, Homo sapiens
ccagagcuuuacagugcca

SEQ ID NO: 508673 - RNA, 23 nt, Homo sapiens
ccagagcuuuacagugccacgac

SEQ ID NO: 508674 - RNA, 22 nt, Homo sapiens
ccagaggggugcgcagagcuga

SEQ ID NO: 508675 - RNA, 15 nt, Homo sapiens
ccagagugcuuauaa

SEQ ID NO: 508676 - RNA, 22 nt, Homo sapiens
ccagauucaaucgacuggguuu

SEQ ID NO: 508677 - RNA, 18 nt, Homo sapiens
ccagcauucagcacacac

SEQ ID NO: 508678 - RNA, 21 nt, Homo sapiens
ccagccacugcccaaagccau

SEQ ID NO: 508679 - RNA, 20 nt, Homo sapiens
ccagcccccacccaugccag

SEQ ID NO: 508680 - RNA, 18 nt, Homo sapiens
ccagcggggcuucugggc

SEQ ID NO: 508681 - RNA, 14 nt, Homo sapiens
ccaggacacugccu

SEQ ID NO: 508682 - RNA, 14 nt, Homo sapiens
ccaggacgcaugca

SEQ ID NO: 508683 - RNA, 14 nt, Homo sapiens
ccaggaugcaugca

SEQ ID NO: 508684 - RNA, 15 nt, Homo sapiens
ccaggcuuccaagaa

SEQ ID NO: 508685 - RNA, 16 nt, Homo sapiens
ccagggagguggcagg

SEQ ID NO: 508686 - RNA, 22 nt, Homo sapiens
ccaggggcaggcagcuaggcag

SEQ ID NO: 508687 - RNA, 20 nt, Homo sapiens
ccaggguccugaguggcuga

SEQ ID NO: 508688 - RNA, 14 nt, Homo sapiens
ccaggguuccagac

SEQ ID NO: 508689 - RNA, 19 nt, Homo sapiens
ccaggguuccagacagggu

SEQ ID NO: 508690 - RNA, 12 nt, Homo sapiens
ccaguaucauac

SEQ ID NO: 508691 - RNA, 21 nt, Homo sapiens
ccaguaucauacguugauagu

SEQ ID NO: 508692 - RNA, 18 nt, Homo sapiens
ccaguggugcgggccagg

SEQ ID NO: 508693 - RNA, 19 nt, Homo sapiens
ccaguguagagauuggcac

SEQ ID NO: 508694 - RNA, 23 nt, Homo sapiens
ccaguguauuuucuguguuguuc

SEQ ID NO: 508695 - RNA, 20 nt, Homo sapiens
ccaguucauuuucaguuauu

SEQ ID NO: 508696 - RNA, 23 nt, Homo sapiens
ccauaaaauuagacauaccucuc

SEQ ID NO: 508697 - RNA, 12 nt, Homo sapiens
ccaucauuucau

SEQ ID NO: 508698 - RNA, 15 nt, Homo sapiens
ccauccuucccgcag

SEQ ID NO: 508699 - RNA, 15 nt, Homo sapiens
ccaucucauucaggu

SEQ ID NO: 508700 - RNA, 15 nt, Homo sapiens
ccauggccccagcug

SEQ ID NO: 508701 - RNA, 23 nt, Homo sapiens
ccauguauguugcaugaauccau

SEQ ID NO: 508702 - RNA, 16 nt, Homo sapiens
ccaugugcugcugugg

SEQ ID NO: 508703 - RNA, 21 nt, Homo sapiens
ccauguuuaaguguacuggau

SEQ ID NO: 508704 - RNA, 11 nt, Homo sapiens
ccauucugcuu

SEQ ID NO: 508705 - RNA, 14 nt, Homo sapiens
ccauuuaaucauuu

SEQ ID NO: 508706 - RNA, 18 nt, Homo sapiens
ccauuugcuaguucugcu

SEQ ID NO: 508707 - RNA, 23 nt, Homo sapiens
cccaaacccauuuuagagacaga

SEQ ID NO: 508708 - RNA, 17 nt, Homo sapiens
cccaaagccaucuuccu

SEQ ID NO: 508709 - RNA, 18 nt, Homo sapiens
cccaaguuggagugcagu

SEQ ID NO: 508710 - RNA, 23 nt, Homo sapiens
cccacaggagcguguacuacccc

SEQ ID NO: 508711 - RNA, 18 nt, Homo sapiens
cccacugccagacaugcc

SEQ ID NO: 508712 - RNA, 20 nt, Homo sapiens
cccacuggaggcaugugaug

SEQ ID NO: 508713 - RNA, 16 nt, Homo sapiens
cccaggacgcaugcag

SEQ ID NO: 508714 - RNA, 21 nt, Homo sapiens
cccaggcccuaggauuccucc

SEQ ID NO: 508715 - RNA, 13 nt, Homo sapiens
cccagggugcagg

SEQ ID NO: 508716 - RNA, 22 nt, Homo sapiens
cccaugaccguucucugaggca

SEQ ID NO: 508717 - RNA, 18 nt, Homo sapiens
cccaugguagacugugac

SEQ ID NO: 508718 - RNA, 14 nt, Homo sapiens
cccauugcaguuga

SEQ ID NO: 508719 - RNA, 15 nt, Homo sapiens
cccauuuuuguaaua

SEQ ID NO: 508720 - RNA, 17 nt, Homo sapiens
ccccacaggagcauguc

SEQ ID NO: 508721 - RNA, 18 nt, Homo sapiens
ccccacaggagcguguac

SEQ ID NO: 508722 - RNA, 24 nt, Homo sapiens
ccccagagccacuaccuuugucca

SEQ ID NO: 508723 - RNA, 22 nt, Homo sapiens
ccccagagcuuuacagugccac

SEQ ID NO: 508724 - RNA, 14 nt, Homo sapiens
ccccagcucuggau

SEQ ID NO: 508725 - RNA, 17 nt, Homo sapiens
ccccaucucauucaggu

SEQ ID NO: 508726 - RNA, 17 nt, Homo sapiens
cccccaaauugccuuca

SEQ ID NO: 508727 - RNA, 13 nt, Homo sapiens
ccccccauccuac

SEQ ID NO: 508728 - RNA, 14 nt, Homo sapiens
cccccugcugccau

SEQ ID NO: 508729 - RNA, 19 nt, Homo sapiens
ccccucagagaaugaucac

SEQ ID NO: 508730 - RNA, 17 nt, Homo sapiens
ccccucauggaucugca

SEQ ID NO: 508731 - RNA, 16 nt, Homo sapiens
ccccuccuccaugcug

SEQ ID NO: 508732 - RNA, 16 nt, Homo sapiens
cccgguguaugcagug

SEQ ID NO: 508733 - RNA, 15 nt, Homo sapiens
cccuccgacuucucu

SEQ ID NO: 508734 - RNA, 17 nt, Homo sapiens
cccucugcugcuuucca

SEQ ID NO: 508735 - RNA, 22 nt, Homo sapiens
cccugauuuauucuggugucua

SEQ ID NO: 508736 - RNA, 13 nt, Homo sapiens
cccugccaguguu

SEQ ID NO: 508737 - RNA, 11 nt, Homo sapiens
cccugccugag

SEQ ID NO: 508738 - RNA, 11 nt, Homo sapiens
cccugcugagu

SEQ ID NO: 508739 - RNA, 13 nt, Homo sapiens
cccugcuggacca

SEQ ID NO: 508740 - RNA, 16 nt, Homo sapiens
cccuggggcauccacc

SEQ ID NO: 508741 - RNA, 12 nt, Homo sapiens
cccuguuuccaa

SEQ ID NO: 508742 - RNA, 15 nt, Homo sapiens
cccuucgcguauuuc

SEQ ID NO: 508743 - RNA, 23 nt, Homo sapiens
cccuuggagagagaggcugccuc

SEQ ID NO: 508744 - RNA, 19 nt, Homo sapiens
cccuuuccccauucaguga

SEQ ID NO: 508745 - RNA, 23 nt, Homo sapiens
ccgaaaugaaaauggcugaagaa

SEQ ID NO: 508746 - RNA, 22 nt, Homo sapiens
ccgacacugcagcagaaucucu

SEQ ID NO: 508747 - RNA, 21 nt, Homo sapiens
ccgacaggcaugcaccagugc

SEQ ID NO: 508748 - RNA, 11 nt, Homo sapiens
ccgacaugccu

SEQ ID NO: 508749 - RNA, 14 nt, Homo sapiens
ccgaccccaucuca

SEQ ID NO: 508750 - RNA, 13 nt, Homo sapiens
ccggcacugugca

SEQ ID NO: 508751 - RNA, 15 nt, Homo sapiens
ccgggguguggaauc

SEQ ID NO: 508752 - RNA, 13 nt, Homo sapiens
ccgggugccauuc

SEQ ID NO: 508753 - RNA, 13 nt, Homo sapiens
ccgugacugcaag

SEQ ID NO: 508754 - RNA, 23 nt, Homo sapiens
ccguggugugaggcccccggagg

SEQ ID NO: 508755 - RNA, 23 nt, Homo sapiens
ccguuguguggguuuacucugug

SEQ ID NO: 508756 - RNA, 15 nt, Homo sapiens
ccuaaacauaguggu

SEQ ID NO: 508757 - RNA, 20 nt, Homo sapiens
ccuaaagggaagcccugaca

SEQ ID NO: 508758 - RNA, 14 nt, Homo sapiens
ccuaauaaacaauu

SEQ ID NO: 508759 - RNA, 13 nt, Homo sapiens
ccuacaucugaaa

SEQ ID NO: 508760 - RNA, 13 nt, Homo sapiens
ccuaccacauuca

SEQ ID NO: 508761 - RNA, 16 nt, Homo sapiens
ccuacccucuucucag

SEQ ID NO: 508762 - RNA, 14 nt, Homo sapiens
ccuacugcccacau

SEQ ID NO: 508763 - RNA, 14 nt, Homo sapiens
ccuauggaaagggu

SEQ ID NO: 508764 - RNA, 16 nt, Homo sapiens
ccuauggaaagggugu

SEQ ID NO: 508765 - RNA, 16 nt, Homo sapiens
ccucaauucauauuua

SEQ ID NO: 508766 - RNA, 17 nt, Homo sapiens
ccucagggaccaaggag

SEQ ID NO: 508767 - RNA, 17 nt, Homo sapiens
ccuccacaguagcauuu

SEQ ID NO: 508768 - RNA, 13 nt, Homo sapiens
ccuccagccacuu

SEQ ID NO: 508769 - RNA, 17 nt, Homo sapiens
ccuccccacaguccuca

SEQ ID NO: 508770 - RNA, 13 nt, Homo sapiens
ccucccccgcaga

SEQ ID NO: 508771 - RNA, 14 nt, Homo sapiens
ccuccuccaugcug

SEQ ID NO: 508772 - RNA, 13 nt, Homo sapiens
ccuccugaugucu

SEQ ID NO: 508773 - RNA, 21 nt, Homo sapiens
ccucuagguaaacuagcaaaa

SEQ ID NO: 508774 - RNA, 22 nt, Homo sapiens
ccucuauuuguucagaucucau

SEQ ID NO: 508775 - RNA, 19 nt, Homo sapiens
ccucucucucccuccacuc

SEQ ID NO: 508776 - RNA, 20 nt, Homo sapiens
ccucugagacagagagccaa

SEQ ID NO: 508777 - RNA, 23 nt, Homo sapiens
ccucuuaagaucugacugccaaa

SEQ ID NO: 508778 - RNA, 12 nt, Homo sapiens
ccucuuaggcag

SEQ ID NO: 508779 - RNA, 23 nt, Homo sapiens
ccucuuucuuucuuuuguguugg

SEQ ID NO: 508780 - RNA, 15 nt, Homo sapiens
ccugagaagagucga

SEQ ID NO: 508781 - RNA, 19 nt, Homo sapiens
ccugagaggagcguguccu

SEQ ID NO: 508782 - RNA, 16 nt, Homo sapiens
ccugagccugucucuc

SEQ ID NO: 508783 - RNA, 15 nt, Homo sapiens
ccugcccucccccac

SEQ ID NO: 508784 - RNA, 15 nt, Homo sapiens
ccugcuccuccagua

SEQ ID NO: 508785 - RNA, 18 nt, Homo sapiens
ccugcuguucgugacuca

SEQ ID NO: 508786 - RNA, 22 nt, Homo sapiens
ccuggaaauaacugagcacuuu

SEQ ID NO: 508787 - RNA, 16 nt, Homo sapiens
ccuggacauauuccca

SEQ ID NO: 508788 - RNA, 16 nt, Homo sapiens
ccuggagccagggcag

SEQ ID NO: 508789 - RNA, 23 nt, Homo sapiens
ccuggcuuagcguucuguuucac

SEQ ID NO: 508790 - RNA, 15 nt, Homo sapiens
ccuggcuucugggac

SEQ ID NO: 508791 - RNA, 18 nt, Homo sapiens
ccugggcaacagagugag

SEQ ID NO: 508792 - RNA, 17 nt, Homo sapiens
ccugggggaugugcacg

SEQ ID NO: 508793 - RNA, 15 nt, Homo sapiens
ccugucucuacaaaa

SEQ ID NO: 508794 - RNA, 20 nt, Homo sapiens
ccuguggcggccuuccgggu

SEQ ID NO: 508795 - RNA, 23 nt, Homo sapiens
ccuguuaaggcauccacuucaca

SEQ ID NO: 508796 - RNA, 16 nt, Homo sapiens
ccuuaaaaauguaugu

SEQ ID NO: 508797 - RNA, 16 nt, Homo sapiens
ccuuagaauacuguau

SEQ ID NO: 508798 - RNA, 18 nt, Homo sapiens
ccuucaaugcaaaauaca

SEQ ID NO: 508799 - RNA, 13 nt, Homo sapiens
ccugaacacucau

SEQ ID NO: 508800 - RNA, 20 nt, Homo sapiens
ccugagaggagcguguccua

SEQ ID NO: 508801 - RNA, 11 nt, Homo sapiens
ccugaggaaug

SEQ ID NO: 508802 - RNA, 19 nt, Homo sapiens
ccugaggaggaggacacag

SEQ ID NO: 508803 - RNA, 16 nt, Homo sapiens
ccugagggaagcccac

SEQ ID NO: 508804 - RNA, 12 nt, Homo sapiens
ccugauggccag

SEQ ID NO: 508805 - RNA, 22 nt, Homo sapiens
ccugcaaccucggggagugcca

SEQ ID NO: 508806 - RNA, 16 nt, Homo sapiens
ccugcaggcaggcaga

SEQ ID NO: 508807 - RNA, 17 nt, Homo sapiens
ccugcagggaucauagc

SEQ ID NO: 508808 - RNA, 14 nt, Homo sapiens
ccugcccuccccca

SEQ ID NO: 508809 - RNA, 12 nt, Homo sapiens
ccugcugccauc

SEQ ID NO: 508810 - RNA, 19 nt, Homo sapiens
ccuggccgguaggcugcug

SEQ ID NO: 508811 - RNA, 12 nt, Homo sapiens
ccuggcuucugg

SEQ ID NO: 508812 - RNA, 14 nt, Homo sapiens
ccuggcuucuggga

SEQ ID NO: 508813 - RNA, 17 nt, Homo sapiens
ccugggggcugcugcac

SEQ ID NO: 508814 - RNA, 18 nt, Homo sapiens
ccuggguaacaaagugag

SEQ ID NO: 508815 - RNA, 17 nt, Homo sapiens
ccugguccugcacuguc

SEQ ID NO: 508816 - RNA, 16 nt, Homo sapiens
ccuguacacacacaga

SEQ ID NO: 508817 - RNA, 18 nt, Homo sapiens
ccugugaucuauaccacc

SEQ ID NO: 508818 - RNA, 20 nt, Homo sapiens
ccugugcaguagagagccuu

SEQ ID NO: 508819 - RNA, 21 nt, Homo sapiens
ccugugggaguccacuuuccu

SEQ ID NO: 508820 - RNA, 23 nt, Homo sapiens
ccugugggggcggcuguggggga

SEQ ID NO: 508821 - RNA, 17 nt, Homo sapiens
ccugugucaucugucag

SEQ ID NO: 508822 - RNA, 15 nt, Homo sapiens
ccuguuaaggcaucc

SEQ ID NO: 508823 - RNA, 12 nt, Homo sapiens
ccuucaugcuuu

SEQ ID NO: 508824 - RNA, 22 nt, Homo sapiens
ccuucccgcagcaccagccuga

SEQ ID NO: 508825 - RNA, 23 nt, Homo sapiens
ccuuccucaagauccugucuugc

SEQ ID NO: 508826 - RNA, 17 nt, Homo sapiens
ccuucuccacagggaca

SEQ ID NO: 508827 - RNA, 21 nt, Homo sapiens
ccuucuggccgcugcagucag

SEQ ID NO: 508828 - RNA, 14 nt, Homo sapiens
ccuuguuguaacua

SEQ ID NO: 508829 - RNA, 18 nt, Homo sapiens
ccuuuaguuugcuucugu

SEQ ID NO: 508830 - RNA, 16 nt, Homo sapiens
cgaaaugguaccaagg

SEQ ID NO: 508831 - RNA, 18 nt, Homo sapiens
cgaacucgggauuacaga

SEQ ID NO: 508832 - RNA, 15 nt, Homo sapiens
cgaccaccccugugc

SEQ ID NO: 508833 - RNA, 20 nt, Homo sapiens
cgagcuaauuaacuaacuca

SEQ ID NO: 508834 - RNA, 17 nt, Homo sapiens
cgaguuccggaaagccu

SEQ ID NO: 508835 - RNA, 18 nt, Homo sapiens
cgaguuccggaaagccuu

SEQ ID NO: 508836 - RNA, 14 nt, Homo sapiens
cgauauaagccaua

SEQ ID NO: 508837 - RNA, 15 nt, Homo sapiens
cgauauaagccauag

SEQ ID NO: 508838 - RNA, 21 nt, Homo sapiens
cgcaaggaucacuugagccca

SEQ ID NO: 508839 - RNA, 15 nt, Homo sapiens
cgcagagcugacccc

SEQ ID NO: 508840 - RNA, 18 nt, Homo sapiens
cgcauuuucuaccugaaa

SEQ ID NO: 508841 - RNA, 13 nt, Homo sapiens
cgccagggcucag

SEQ ID NO: 508842 - RNA, 21 nt, Homo sapiens
cgcccaggaugaaggggccag

SEQ ID NO: 508843 - RNA, 15 nt, Homo sapiens
cgccccugccugaga

SEQ ID NO: 508844 - RNA, 17 nt, Homo sapiens
cgccuagguuguguuga

SEQ ID NO: 508845 - RNA, 17 nt, Homo sapiens
cgcugagggcaggguuc

SEQ ID NO: 508846 - RNA, 20 nt, Homo sapiens
cggaagccucugggugacaa

SEQ ID NO: 508847 - RNA, 16 nt, Homo sapiens
cggacaccaucuuggg

SEQ ID NO: 508848 - RNA, 19 nt, Homo sapiens
cggcagcuugagccuguca

SEQ ID NO: 508849 - RNA, 23 nt, Homo sapiens
cggccgaggccugcgcccugaca

SEQ ID NO: 508850 - RNA, 16 nt, Homo sapiens
cgggcauacguuuucu

SEQ ID NO: 508851 - RNA, 14 nt, Homo sapiens
cgggguguggaauc

SEQ ID NO: 508852 - RNA, 19 nt, Homo sapiens
cggugucuggaaaagcacu

SEQ ID NO: 508853 - RNA, 18 nt, Homo sapiens
cgguugguaccaugcuaa

SEQ ID NO: 508854 - RNA, 12 nt, Homo sapiens
cgugaaacacaa

SEQ ID NO: 508855 - RNA, 14 nt, Homo sapiens
cguggcaacugugg

SEQ ID NO: 508856 - RNA, 20 nt, Homo sapiens
cguggugagguugugcugcc

SEQ ID NO: 508857 - RNA, 15 nt, Homo sapiens
cgugugagcagucuc

SEQ ID NO: 508858 - RNA, 14 nt, Homo sapiens
cgugugaggaugug

SEQ ID NO: 508859 - RNA, 16 nt, Homo sapiens
cgugugcagacugugg

SEQ ID NO: 508860 - RNA, 15 nt, Homo sapiens
cguguuucacagugg

SEQ ID NO: 508861 - RNA, 17 nt, Homo sapiens
cuaaaagugaugugauu

SEQ ID NO: 508862 - RNA, 21 nt, Homo sapiens
cuaaagucaggccauucaguc

SEQ ID NO: 508863 - RNA, 15 nt, Homo sapiens
cuaacucccuaggcc

SEQ ID NO: 508864 - RNA, 12 nt, Homo sapiens
cuaagcuuucuc

SEQ ID NO: 508865 - RNA, 15 nt, Homo sapiens
cuaagguacggugag

SEQ ID NO: 508866 - RNA, 13 nt, Homo sapiens
cuaauccaugugc

SEQ ID NO: 508867 - RNA, 21 nt, Homo sapiens
cuacaauacaacacauugaaa

SEQ ID NO: 508868 - RNA, 22 nt, Homo sapiens
cuacaccuuagcagcucuuccc

SEQ ID NO: 508869 - RNA, 23 nt, Homo sapiens
cuacaggggaggcugagacgcaa

SEQ ID NO: 508870 - RNA, 19 nt, Homo sapiens
cuacauauuuuaauaauaa

SEQ ID NO: 508871 - RNA, 13 nt, Homo sapiens
cuaccucuguccc

SEQ ID NO: 508872 - RNA, 17 nt, Homo sapiens
cuaccuuuguccaggcc

SEQ ID NO: 508873 - RNA, 21 nt, Homo sapiens
cuacuggaugcuuacagugac

SEQ ID NO: 508874 - RNA, 19 nt, Homo sapiens
cuacuuuaaauuguggaug

SEQ ID NO: 508875 - RNA, 19 nt, Homo sapiens
cuagaaagagaaaaagccc

SEQ ID NO: 508876 - RNA, 17 nt, Homo sapiens
cuagaacacaaauccaa

SEQ ID NO: 508877 - RNA, 23 nt, Homo sapiens
cuagaaccuucuaauccaugugc

SEQ ID NO: 508878 - RNA, 20 nt, Homo sapiens
cuagguugaaaauguuauag

SEQ ID NO: 508879 - RNA, 23 nt, Homo sapiens
cuagugucuuuuuuuucuucacc

SEQ ID NO: 508880 - RNA, 19 nt, Homo sapiens
cuauacuuaggcauagucu

SEQ ID NO: 508881 - RNA, 21 nt, Homo sapiens
cuauauuuggauucacagccu

SEQ ID NO: 508882 - RNA, 21 nt, Homo sapiens
cuaucauggcagcaugcgaug

SEQ ID NO: 508883 - RNA, 22 nt, Homo sapiens
cuauccaaaccuuucaauucau

SEQ ID NO: 508884 - RNA, 16 nt, Homo sapiens
cuaugauuaaacuggg

SEQ ID NO: 508885 - RNA, 15 nt, Homo sapiens
cuaugcacaccaaau

SEQ ID NO: 508886 - RNA, 22 nt, Homo sapiens
cuaugcacaccaaauugcugag

SEQ ID NO: 508887 - RNA, 12 nt, Homo sapiens
cuauucauuaca

SEQ ID NO: 508888 - RNA, 17 nt, Homo sapiens
cuauuuaaguggacugu

SEQ ID NO: 508889 - RNA, 18 nt, Homo sapiens
cuauuuagagaaacauuu

SEQ ID NO: 508890 - RNA, 18 nt, Homo sapiens
cuauuuguucagaucuca

SEQ ID NO: 508891 - RNA, 18 nt, Homo sapiens
cucaaaugcuacucagua

SEQ ID NO: 508892 - RNA, 22 nt, Homo sapiens
cucaacuuacauaugucuucaa

SEQ ID NO: 508893 - RNA, 15 nt, Homo sapiens
cucaagauccugucu

SEQ ID NO: 508894 - RNA, 21 nt, Homo sapiens
cucaaggcugcagugagccaa

SEQ ID NO: 508895 - RNA, 15 nt, Homo sapiens
cucaaugugcuguug

SEQ ID NO: 508896 - RNA, 14 nt, Homo sapiens
cucacccagccugg

SEQ ID NO: 508897 - RNA, 15 nt, Homo sapiens
cucacugguuuucaa

SEQ ID NO: 508898 - RNA, 18 nt, Homo sapiens
cucagacaccuagacucu

SEQ ID NO: 508899 - RNA, 16 nt, Homo sapiens
cucagagaaugaucac

SEQ ID NO: 508900 - RNA, 15 nt, Homo sapiens
cucagcccauccccu

SEQ ID NO: 508901 - RNA, 22 nt, Homo sapiens
cucaggaaugcagcacaguacu

SEQ ID NO: 508902 - RNA, 22 nt, Homo sapiens
cucaggacccagggaaugccag

SEQ ID NO: 508903 - RNA, 22 nt, Homo sapiens
cucagguuauucguuacucuaa

SEQ ID NO: 508904 - RNA, 21 nt, Homo sapiens
cucaguaaaucagugcaguac

SEQ ID NO: 508905 - RNA, 20 nt, Homo sapiens
cucaguaacacagugcagug

SEQ ID NO: 508906 - RNA, 17 nt, Homo sapiens
cucaguaacagugcagu

SEQ ID NO: 508907 - RNA, 19 nt, Homo sapiens
cucaguaacagugcaguac

SEQ ID NO: 508908 - RNA, 17 nt, Homo sapiens
cucaguaagacagugca

SEQ ID NO: 508909 - RNA, 19 nt, Homo sapiens
cucaguaaggcagugcagu

SEQ ID NO: 508910 - RNA, 21 nt, Homo sapiens
cucaguaaggcagugcaguac

SEQ ID NO: 508911 - RNA, 11 nt, Homo sapiens
cucaguaauac

SEQ ID NO: 508912 - RNA, 22 nt, Homo sapiens
cucaguaauacaauacaguacu

SEQ ID NO: 508913 - RNA, 22 nt, Homo sapiens
cucaucaacaaagaaauauuau

SEQ ID NO: 508914 - RNA, 23 nt, Homo sapiens
cucaucccccaucagaugauggg

SEQ ID NO: 508915 - RNA, 22 nt, Homo sapiens
cucauggaucugcauaaccgca

SEQ ID NO: 508916 - RNA, 16 nt, Homo sapiens
cucauuguucagaaaa

SEQ ID NO: 508917 - RNA, 12 nt, Homo sapiens
cuccacccugag

SEQ ID NO: 508918 - RNA, 15 nt, Homo sapiens
cuccacucugaaguc

SEQ ID NO: 508919 - RNA, 22 nt, Homo sapiens
cuccagugacauuggaacaugc

SEQ ID NO: 508920 - RNA, 15 nt, Homo sapiens
cuccaguucugauga

SEQ ID NO: 508921 - RNA, 18 nt, Homo sapiens
cuccccacaguccucaca

SEQ ID NO: 508922 - RNA, 16 nt, Homo sapiens
cuccccacuccagaag

SEQ ID NO: 508923 - RNA, 14 nt, Homo sapiens
cuccccauggugca

SEQ ID NO: 508924 - RNA, 20 nt, Homo sapiens
cuccccauggugcagugaag

SEQ ID NO: 508925 - RNA, 18 nt, Homo sapiens
cuccccuccagaccccua

SEQ ID NO: 508926 - RNA, 17 nt, Homo sapiens
cuccgcccuucccugac

SEQ ID NO: 508927 - RNA, 20 nt, Homo sapiens
cuccuagaagcccucugagc

SEQ ID NO: 508928 - RNA, 13 nt, Homo sapiens
cuccuccaugcug

SEQ ID NO: 508929 - RNA, 20 nt, Homo sapiens
cuccucccaagcacuucaaa

SEQ ID NO: 508930 - RNA, 18 nt, Homo sapiens
cuccuggucgcuuugcca

SEQ ID NO: 508931 - RNA, 20 nt, Homo sapiens
cuccuggucgcuuugccauc

SEQ ID NO: 508932 - RNA, 20 nt, Homo sapiens
cuccugucuccucugucagu

SEQ ID NO: 508933 - RNA, 20 nt, Homo sapiens
cuccuucacucccugucaua

SEQ ID NO: 508934 - RNA, 17 nt, Homo sapiens
cuccuugaaaccagcuc

SEQ ID NO: 508935 - RNA, 16 nt, Homo sapiens
cucgcacuacaucuga

SEQ ID NO: 508936 - RNA, 12 nt, Homo sapiens
cucgcccugugc

SEQ ID NO: 508937 - RNA, 21 nt, Homo sapiens
cucgggcacucccuaagucca

SEQ ID NO: 508938 - RNA, 20 nt, Homo sapiens
cucuacaucucguauggauu

SEQ ID NO: 508939 - RNA, 14 nt, Homo sapiens
cucuacuacacagg

SEQ ID NO: 508940 - RNA, 12 nt, Homo sapiens
cucucaacuuac

SEQ ID NO: 508941 - RNA, 15 nt, Homo sapiens
cucucugaacugcaa

SEQ ID NO: 508942 - RNA, 16 nt, Homo sapiens
cucugaaccagagaaa

SEQ ID NO: 508943 - RNA, 19 nt, Homo sapiens
cucugaacugcaacacugg

SEQ ID NO: 508944 - RNA, 23 nt, Homo sapiens
cucugacuguaaaauacauggua

SEQ ID NO: 508945 - RNA, 19 nt, Homo sapiens
cucugcuaugucugugaug

SEQ ID NO: 508946 - RNA, 20 nt, Homo sapiens
cucuggaugaaggcaaaaac

SEQ ID NO: 508947 - RNA, 12 nt, Homo sapiens
cucuguacgagg

SEQ ID NO: 508948 - RNA, 10 nt, Homo sapiens
cucuguccac

SEQ ID NO: 508949 - RNA, 14 nt, Homo sapiens
cucuguuuacccuc

SEQ ID NO: 508950 - RNA, 15 nt, Homo sapiens
cucuuaccuguaaua

SEQ ID NO: 508951 - RNA, 20 nt, Homo sapiens
cucuucaacccucuucucac

SEQ ID NO: 508952 - RNA, 13 nt, Homo sapiens
cucuucuacuucu

SEQ ID NO: 508953 - RNA, 23 nt, Homo sapiens
cugaaaaaguguuuuuacauaua

SEQ ID NO: 508954 - RNA, 15 nt, Homo sapiens
cugaaauacauauga

SEQ ID NO: 508955 - RNA, 19 nt, Homo sapiens
cugaaauuaguguuuucau

SEQ ID NO: 508956 - RNA, 16 nt, Homo sapiens
cugaacauaguuuuca

SEQ ID NO: 508957 - RNA, 16 nt, Homo sapiens
cugaacugcaacacug

SEQ ID NO: 508958 - RNA, 16 nt, Homo sapiens
cugaagaaacacagca

SEQ ID NO: 508959 - RNA, 15 nt, Homo sapiens
cugaauaaaauugau

SEQ ID NO: 508960 - RNA, 19 nt, Homo sapiens
cugaauaccaaguguguug

SEQ ID NO: 508961 - RNA, 15 nt, Homo sapiens
cugacaaaagggaca

SEQ ID NO: 508962 - RNA, 11 nt, Homo sapiens
cugacacuguc

SEQ ID NO: 508963 - RNA, 15 nt, Homo sapiens
cugacagcaaacaca

SEQ ID NO: 508964 - RNA, 18 nt, Homo sapiens
cugacagcaaacacaguc

SEQ ID NO: 508965 - RNA, 19 nt, Homo sapiens
cugaggaggaggacacagc

SEQ ID NO: 508966 - RNA, 20 nt, Homo sapiens
cugaguagcauauauaauuu

SEQ ID NO: 508967 - RNA, 15 nt, Homo sapiens
cugauccuuguggca

SEQ ID NO: 508968 - RNA, 13 nt, Homo sapiens
cugauggugcaau

SEQ ID NO: 508969 - RNA, 18 nt, Homo sapiens
cugauuuaaacuucuuaa

SEQ ID NO: 508970 - RNA, 13 nt, Homo sapiens
cugcaacacugga

SEQ ID NO: 508971 - RNA, 14 nt, Homo sapiens
cugcacacauaaca

SEQ ID NO: 508972 - RNA, 16 nt, Homo sapiens
cugcaguuagcacaga

SEQ ID NO: 508973 - RNA, 15 nt, Homo sapiens
cugccaagaguccaa

SEQ ID NO: 508974 - RNA, 16 nt, Homo sapiens
cugccaagaguccaag

SEQ ID NO: 508975 - RNA, 19 nt, Homo sapiens
cugcccgaccccaucucau

SEQ ID NO: 508976 - RNA, 14 nt, Homo sapiens
cugcccugccugag

SEQ ID NO: 508977 - RNA, 16 nt, Homo sapiens
cugccgguggggccag

SEQ ID NO: 508978 - RNA, 15 nt, Homo sapiens
cugccugaacaaagg

SEQ ID NO: 508979 - RNA, 15 nt, Homo sapiens
cugccugcuguguua

SEQ ID NO: 508980 - RNA, 22 nt, Homo sapiens
cugccuucuccccuccaaguga

SEQ ID NO: 508981 - RNA, 18 nt, Homo sapiens
cugcucccggcucugagg

SEQ ID NO: 508982 - RNA, 18 nt, Homo sapiens
cugcuccuccaguacaau

SEQ ID NO: 508983 - RNA, 23 nt, Homo sapiens
cugcugaauuuggggcuacuuau

SEQ ID NO: 508984 - RNA, 16 nt, Homo sapiens
cugcugccaucuccag

SEQ ID NO: 508985 - RNA, 17 nt, Homo sapiens
cugcuguguagcucugu

SEQ ID NO: 508986 - RNA, 14 nt, Homo sapiens
cugcuuaguaucuc

SEQ ID NO: 508987 - RNA, 18 nt, Homo sapiens
cugcuuucugauacaucu

SEQ ID NO: 508988 - RNA, 22 nt, Homo sapiens
cugcuuuggggcuuaucagaac

SEQ ID NO: 508989 - RNA, 20 nt, Homo sapiens
cuggaaggcuuuauucuucc

SEQ ID NO: 508990 - RNA, 23 nt, Homo sapiens
cuggaauaagaagcaaauaaaua

SEQ ID NO: 508991 - RNA, 14 nt, Homo sapiens
cuggagccugggca

SEQ ID NO: 508992 - RNA, 21 nt, Homo sapiens
cuggagcguguacuaccccag

SEQ ID NO: 508993 - RNA, 21 nt, Homo sapiens
cuggccauuuaacuagcacuu

SEQ ID NO: 508994 - RNA, 23 nt, Homo sapiens
cuggccuauuuuggacgugugag

SEQ ID NO: 508995 - RNA, 15 nt, Homo sapiens
cugggaaaagcccaa

SEQ ID NO: 508996 - RNA, 18 nt, Homo sapiens
cugggaacaugacccagc

SEQ ID NO: 508997 - RNA, 15 nt, Homo sapiens
cuggguucuuuggaa

SEQ ID NO: 508998 - RNA, 19 nt, Homo sapiens
cuggguuugggcaguggag

SEQ ID NO: 508999 - RNA, 15 nt, Homo sapiens
cugguaaaaagaucc

SEQ ID NO: 509000 - RNA, 15 nt, Homo sapiens
cugguccugcacugu

SEQ ID NO: 509001 - RNA, 17 nt, Homo sapiens
cugguccugcacugucc

SEQ ID NO: 509002 - RNA, 16 nt, Homo sapiens
cugguuagauucauua

SEQ ID NO: 509003 - RNA, 17 nt, Homo sapiens
cuguaaaauacuucuuu

SEQ ID NO: 509004 - RNA, 18 nt, Homo sapiens
cuguaaccuuaucuaaga

SEQ ID NO: 509005 - RNA, 22 nt, Homo sapiens
cuguaauagccucaccuucccu

SEQ ID NO: 509006 - RNA, 17 nt, Homo sapiens
cuguacacacacagaca

SEQ ID NO: 509007 - RNA, 13 nt, Homo sapiens
cuguauccaaguu

SEQ ID NO: 509008 - RNA, 22 nt, Homo sapiens
cugucaugugcgaacacaguga

SEQ ID NO: 509009 - RNA, 18 nt, Homo sapiens
cugucgccgcuagucuua

SEQ ID NO: 509010 - RNA, 18 nt, Homo sapiens
cugucuaaaaaugauucu

SEQ ID NO: 509011 - RNA, 16 nt, Homo sapiens
cugucuccucugucag

SEQ ID NO: 509012 - RNA, 18 nt, Homo sapiens
cugugcaacaaacucaaa

SEQ ID NO: 509013 - RNA, 20 nt, Homo sapiens
cugugcaacaaacucaaaau

SEQ ID NO: 509014 - RNA, 13 nt, Homo sapiens
cugugcaucuggc

SEQ ID NO: 509015 - RNA, 14 nt, Homo sapiens
cugugggaguccac

SEQ ID NO: 509016 - RNA, 14 nt, Homo sapiens
cuguguaaccucca

SEQ ID NO: 509017 - RNA, 17 nt, Homo sapiens
cuguguaaccuccacag

SEQ ID NO: 509018 - RNA, 18 nt, Homo sapiens
cuguguagcucuguccac

SEQ ID NO: 509019 - RNA, 12 nt, Homo sapiens
cugugugcagag

SEQ ID NO: 509020 - RNA, 19 nt, Homo sapiens
cuguuaucuaguaugcauu

SEQ ID NO: 509021 - RNA, 12 nt, Homo sapiens
cuguuccaagug

SEQ ID NO: 509022 - RNA, 17 nt, Homo sapiens
cuguuuucccauugcag

SEQ ID NO: 509023 - RNA, 19 nt, Homo sapiens
cuuaaaaagaccaugcauu

SEQ ID NO: 509024 - RNA, 22 nt, Homo sapiens
cuuaaaagggugguaguuuucc

SEQ ID NO: 509025 - RNA, 18 nt, Homo sapiens
cuuaaacaaaaacuuucc

SEQ ID NO: 509026 - RNA, 19 nt, Homo sapiens
cuuaaaccugugcuuucau

SEQ ID NO: 509027 - RNA, 23 nt, Homo sapiens
cuuaaggggacccacaaguauug

SEQ ID NO: 509028 - RNA, 13 nt, Homo sapiens
cuuacccuucaau

SEQ ID NO: 509029 - RNA, 13 nt, Homo sapiens
cuuaguaucucau

SEQ ID NO: 509030 - RNA, 19 nt, Homo sapiens
cuuauacacaccugaauaa

SEQ ID NO: 509031 - RNA, 23 nt, Homo sapiens
cuuauuuugauuguuugaugaau

SEQ ID NO: 509032 - RNA, 14 nt, Homo sapiens
gacacacucaccau

SEQ ID NO: 509033 - RNA, 23 nt, Homo sapiens
gacacagaggacagcuuccccau

SEQ ID NO: 509034 - RNA, 21 nt, Homo sapiens
gacacagaggacggcuucccc

SEQ ID NO: 509035 - RNA, 23 nt, Homo sapiens
gacacagaggacggcuuccccau

SEQ ID NO: 509036 - RNA, 15 nt, Homo sapiens
gacacuauguagucu

SEQ ID NO: 509037 - RNA, 23 nt, Homo sapiens
gacagaaaccaagccauuaauga

SEQ ID NO: 509038 - RNA, 23 nt, Homo sapiens
gacagccauacuuccagcgaaau

SEQ ID NO: 509039 - RNA, 12 nt, Homo sapiens
gacagcuucccc

SEQ ID NO: 509040 - RNA, 12 nt, Homo sapiens
gacagugcagug

SEQ ID NO: 509041 - RNA, 12 nt, Homo sapiens
gacauaccucuc

SEQ ID NO: 509042 - RNA, 20 nt, Homo sapiens
gacauccagcaguccaaggu

SEQ ID NO: 509043 - RNA, 16 nt, Homo sapiens
gacaucuagucucagu

SEQ ID NO: 509044 - RNA, 21 nt, Homo sapiens
gacaugaaauugagucauuuu

SEQ ID NO: 509045 - RNA, 20 nt, Homo sapiens
gacaugcuaaccucucugaa

SEQ ID NO: 509046 - RNA, 16 nt, Homo sapiens
gacauucuuaguuaau

SEQ ID NO: 509047 - RNA, 16 nt, Homo sapiens
gacauuguuuugccaa

SEQ ID NO: 509048 - RNA, 23 nt, Homo sapiens
gacccacaaguauugcccuuuaa

SEQ ID NO: 509049 - RNA, 13 nt, Homo sapiens
gacccagccugaa

SEQ ID NO: 509050 - RNA, 15 nt, Homo sapiens
gacccucacuuuucu

SEQ ID NO: 509051 - RNA, 20 nt, Homo sapiens
gaccuccucccaagcacuuc

SEQ ID NO: 509052 - RNA, 18 nt, Homo sapiens
gaccuuucugagugacau

SEQ ID NO: 509053 - RNA, 14 nt, Homo sapiens
gacgcaugcagggc

SEQ ID NO: 509054 - RNA, 15 nt, Homo sapiens
gacgugugaggaugu

SEQ ID NO: 509055 - RNA, 19 nt, Homo sapiens
gacuagaacacaaauccaa

SEQ ID NO: 509056 - RNA, 15 nt, Homo sapiens
gacuucucuagacau

SEQ ID NO: 509057 - RNA, 15 nt, Homo sapiens
gagaaaguacuuucu

SEQ ID NO: 509058 - RNA, 19 nt, Homo sapiens
gagaaauugugccaaagau

SEQ ID NO: 509059 - RNA, 12 nt, Homo sapiens
gagaacagggau

SEQ ID NO: 509060 - RNA, 16 nt, Homo sapiens
gagaacagggaugcua

SEQ ID NO: 509061 - RNA, 11 nt, Homo sapiens
gagacacaucu

SEQ ID NO: 509062 - RNA, 14 nt, Homo sapiens
gagagaacagggau

SEQ ID NO: 509063 - RNA, 21 nt, Homo sapiens
gagagaacagggaugcuaucu

SEQ ID NO: 509064 - RNA, 17 nt, Homo sapiens
gagagaggcugccucag

SEQ ID NO: 509065 - RNA, 20 nt, Homo sapiens
gagagcaaucuugcugugaa

SEQ ID NO: 509066 - RNA, 22 nt, Homo sapiens
gagagcaaucuugcugugaaac

SEQ ID NO: 509067 - RNA, 23 nt, Homo sapiens
gagagcugcccacaacuugccaa

SEQ ID NO: 509068 - RNA, 18 nt, Homo sapiens
gagaggagcguguccuau

SEQ ID NO: 509069 - RNA, 22 nt, Homo sapiens
gagaguggcaggugggcugccu

SEQ ID NO: 509070 - RNA, 14 nt, Homo sapiens
gagcacagccauag

SEQ ID NO: 509071 - RNA, 22 nt, Homo sapiens
gagcagccucuugaaugcuuaa

SEQ ID NO: 509072 - RNA, 11 nt, Homo sapiens
gagcagugggg

SEQ ID NO: 509073 - RNA, 19 nt, Homo sapiens
gagcaugcucccucaugca

SEQ ID NO: 509074 - RNA, 21 nt, Homo sapiens
gagccaaguucacaccacugc

SEQ ID NO: 509075 - RNA, 19 nt, Homo sapiens
gagcccagaagcucaaggc

SEQ ID NO: 509076 - RNA, 20 nt, Homo sapiens
gagccccauuauucauucuc

SEQ ID NO: 509077 - RNA, 13 nt, Homo sapiens
gagcgggggcuaa

SEQ ID NO: 509078 - RNA, 14 nt, Homo sapiens
gagcguguacuacc

SEQ ID NO: 509079 - RNA, 14 nt, Homo sapiens
gagcuagcccaguc

SEQ ID NO: 509080 - RNA, 20 nt, Homo sapiens
gagcugcccacaacuugcca

SEQ ID NO: 509081 - RNA, 22 nt, Homo sapiens
gagcuuccagugcauguugcca

SEQ ID NO: 509082 - RNA, 18 nt, Homo sapiens
gagcuuuacagugccacg

SEQ ID NO: 509083 - RNA, 13 nt, Homo sapiens
gagcuuucugaua

SEQ ID NO: 509084 - RNA, 15 nt, Homo sapiens
gaggaauaaaaugau

SEQ ID NO: 509085 - RNA, 23 nt, Homo sapiens
gaggacucccugcuuagcucugu

SEQ ID NO: 509086 - RNA, 18 nt, Homo sapiens
gaggacucucacgauaug

SEQ ID NO: 509087 - RNA, 20 nt, Homo sapiens
gaggacuuaguuugugaugu

SEQ ID NO: 509088 - RNA, 12 nt, Homo sapiens
gaggaucacuug

SEQ ID NO: 509089 - RNA, 18 nt, Homo sapiens
gagggaagcccacccgcc

SEQ ID NO: 509090 - RNA, 18 nt, Homo sapiens
gagggaauccauaucagc

SEQ ID NO: 509091 - RNA, 22 nt, Homo sapiens
gagguuccggugucuggaaaag

SEQ ID NO: 509092 - RNA, 15 nt, Homo sapiens
gagucagaggcagaa

SEQ ID NO: 509093 - RNA, 17 nt, Homo sapiens
gagucagggcugugcuu

SEQ ID NO: 509094 - RNA, 18 nt, Homo sapiens
gagucgaccccaagcgac

SEQ ID NO: 509095 - RNA, 23 nt, Homo sapiens
gagugcuuauaauauacauaacu

SEQ ID NO: 509096 - RNA, 21 nt, Homo sapiens
gagugggcugggcccucuguc

SEQ ID NO: 509097 - RNA, 20 nt, Homo sapiens
gagugugcagacagcuauuu

SEQ ID NO: 509098 - RNA, 17 nt, Homo sapiens
gaguuccggaaagccuu

SEQ ID NO: 509099 - RNA, 18 nt, Homo sapiens
gaguuccggaaagccuuc

SEQ ID NO: 509100 - RNA, 20 nt, Homo sapiens
gaguuuccagcuaagccuga

SEQ ID NO: 509101 - RNA, 19 nt, Homo sapiens
gauaaaaagaaaguuuaua

SEQ ID NO: 509102 - RNA, 21 nt, Homo sapiens
gauaaauuugacuguuauuug

SEQ ID NO: 509103 - RNA, 16 nt, Homo sapiens
gauaauaguuguuauu

SEQ ID NO: 509104 - RNA, 17 nt, Homo sapiens
gauaauuaaaugaaaua

SEQ ID NO: 509105 - RNA, 21 nt, Homo sapiens
gauaauucgagcaaacaacuu

SEQ ID NO: 509106 - RNA, 22 nt, Homo sapiens
gauagaauaaagccuugugauc

SEQ ID NO: 509107 - RNA, 20 nt, Homo sapiens
gauagcuugauaucuucugu

SEQ ID NO: 509108 - RNA, 22 nt, Homo sapiens
gauaucaggaaauaucugugaa

SEQ ID NO: 509109 - RNA, 20 nt, Homo sapiens
gauauccaacagaaagcaua

SEQ ID NO: 509110 - RNA, 22 nt, Homo sapiens
gauauuuucgcccaccuaaagg

SEQ ID NO: 509111 - RNA, 16 nt, Homo sapiens
gaucaaaguugaugaa

SEQ ID NO: 509112 - RNA, 18 nt, Homo sapiens
gauccugucuugcugagg

SEQ ID NO: 509113 - RNA, 13 nt, Homo sapiens
gaucgcuccgccg

SEQ ID NO: 509114 - RNA, 18 nt, Homo sapiens
gaucuaaaaggaggacag

SEQ ID NO: 509115 - RNA, 14 nt, Homo sapiens
gaugaaggggccag

SEQ ID NO: 509116 - RNA, 14 nt, Homo sapiens
gaugaggcuggaua

SEQ ID NO: 509117 - RNA, 14 nt, Homo sapiens
gaugcaaaucaacu

SEQ ID NO: 509118 - RNA, 21 nt, Homo sapiens
gaugcacugaaguagccaaca

SEQ ID NO: 509119 - RNA, 14 nt, Homo sapiens
gaugcaugcagggc

SEQ ID NO: 509120 - RNA, 14 nt, Homo sapiens
gaugcugcugagca

SEQ ID NO: 509121 - RNA, 14 nt, Homo sapiens
gauggggaacauuu

SEQ ID NO: 509122 - RNA, 18 nt, Homo sapiens
gauggguaucaugcuucu

SEQ ID NO: 509123 - RNA, 17 nt, Homo sapiens
gauguacaauuuagcuu

SEQ ID NO: 509124 - RNA, 13 nt, Homo sapiens
gauguauguguau

SEQ ID NO: 509125 - RNA, 23 nt, Homo sapiens
gauguccaaacuuaacagaucac

SEQ ID NO: 509126 - RNA, 19 nt, Homo sapiens
gauguggugggagcacagc

SEQ ID NO: 509127 - RNA, 15 nt, Homo sapiens
gauguuuuaguuuaa

SEQ ID NO: 509128 - RNA, 20 nt, Homo sapiens
gauuaacccuauuaaucuau

SEQ ID NO: 509129 - RNA, 18 nt, Homo sapiens
gauucaggaaugggccaa

SEQ ID NO: 509130 - RNA, 18 nt, Homo sapiens
gauucuuuuuucaaugua

SEQ ID NO: 509131 - RNA, 17 nt, Homo sapiens
gauugaaggauugugaa

SEQ ID NO: 509132 - RNA, 23 nt, Homo sapiens
gauuuacuaacaguaacugccau

SEQ ID NO: 509133 - RNA, 18 nt, Homo sapiens
gauuuauucuggugucua

SEQ ID NO: 509134 - RNA, 12 nt, Homo sapiens
gcaaaaugucau

SEQ ID NO: 509135 - RNA, 15 nt, Homo sapiens
gcaaagaaucaacag

SEQ ID NO: 509136 - RNA, 19 nt, Homo sapiens
gcaaccucggggagugcca

SEQ ID NO: 509137 - RNA, 23 nt, Homo sapiens
gcaagaggaaugaggcucuguaa

SEQ ID NO: 509138 - RNA, 14 nt, Homo sapiens
gcaaggaucacuug

SEQ ID NO: 509139 - RNA, 19 nt, Homo sapiens
gcaaucacaagccaagguc

SEQ ID NO: 509140 - RNA, 15 nt, Homo sapiens
gcacacacaaaccua

SEQ ID NO: 509141 - RNA, 14 nt, Homo sapiens
gcacacagaauuau

SEQ ID NO: 509142 - RNA, 17 nt, Homo sapiens
gcacagugguccagggu

SEQ ID NO: 509143 - RNA, 22 nt, Homo sapiens
gcacauuggcagugugucacac

SEQ ID NO: 509144 - RNA, 22 nt, Homo sapiens
gcacucaggagcacagccauag

SEQ ID NO: 509145 - RNA, 18 nt, Homo sapiens
gcacuguauuaaauguaa

SEQ ID NO: 509146 - RNA, 14 nt, Homo sapiens
gcagccugagcucc

SEQ ID NO: 509147 - RNA, 20 nt, Homo sapiens
gcaggaaaaggcugcagcua

SEQ ID NO: 509148 - RNA, 21 nt, Homo sapiens
ggcaaaaacuguacuguguuu

SEQ ID NO: 509149 - RNA, 17 nt, Homo sapiens
ggcaauauuauguaacc

SEQ ID NO: 509150 - RNA, 16 nt, Homo sapiens
ggcacaggagacucca

SEQ ID NO: 509151 - RNA, 17 nt, Homo sapiens
ggcacauugcccauggc

SEQ ID NO: 509152 - RNA, 23 nt, Homo sapiens
ggcagaaaaccuaccacauucac

SEQ ID NO: 509153 - RNA, 19 nt, Homo sapiens
ggcagaauggugggcucca

SEQ ID NO: 509154 - RNA, 21 nt, Homo sapiens
ggcagcaugcgaugucauauu

SEQ ID NO: 509155 - RNA, 11 nt, Homo sapiens
ggcagugcagu

SEQ ID NO: 509156 - RNA, 21 nt, Homo sapiens
ggcauuuagcacaguauuuaa

SEQ ID NO: 509157 - RNA, 18 nt, Homo sapiens
ggccaaguguacauuuga

SEQ ID NO: 509158 - RNA, 11 nt, Homo sapiens
ggccagggugg

SEQ ID NO: 509159 - RNA, 17 nt, Homo sapiens
ggcccagcccugggcaa

SEQ ID NO: 509160 - RNA, 22 nt, Homo sapiens
ggcccuguuaaggcauccacuu

SEQ ID NO: 509161 - RNA, 22 nt, Homo sapiens
ggccggggcugccgcaucugcc

SEQ ID NO: 509162 - RNA, 15 nt, Homo sapiens
ggccucagggaccaa

SEQ ID NO: 509163 - RNA, 14 nt, Homo sapiens
ggcgugacuucaga

SEQ ID NO: 509164 - RNA, 17 nt, Homo sapiens
ggcucacuacaugggcc

SEQ ID NO: 509165 - RNA, 12 nt, Homo sapiens
ggcucaggguug

SEQ ID NO: 509166 - RNA, 15 nt, Homo sapiens
ggcugacucagugca

SEQ ID NO: 509167 - RNA, 19 nt, Homo sapiens
ggcugcgucccugcucagc

SEQ ID NO: 509168 - RNA, 12 nt, Homo sapiens
ggcuuccaagaa

SEQ ID NO: 509169 - RNA, 15 nt, Homo sapiens
ggcuuguucagucac

SEQ ID NO: 509170 - RNA, 13 nt, Homo sapiens
gggacagccugca

SEQ ID NO: 509171 - RNA, 20 nt, Homo sapiens
gggacuuuggaauucugcuu

SEQ ID NO: 509172 - RNA, 12 nt, Homo sapiens
gggagugccacu

SEQ ID NO: 509173 - RNA, 23 nt, Homo sapiens
gggcaaagaacugccccaucucc

SEQ ID NO: 509174 - RNA, 13 nt, Homo sapiens
gggcaggguucua

SEQ ID NO: 509175 - RNA, 23 nt, Homo sapiens
gggccaagccaggguuccagaca

SEQ ID NO: 509176 - RNA, 16 nt, Homo sapiens
gggcgggccagggugg

SEQ ID NO: 509177 - RNA, 20 nt, Homo sapiens
gggcugagccccuccucucc

SEQ ID NO: 509178 - RNA, 23 nt, Homo sapiens
ggggucuuugaacacaccucucu

SEQ ID NO: 509179 - RNA, 21 nt, Homo sapiens
gguaaauaaucauacacagaa

SEQ ID NO: 509180 - RNA, 17 nt, Homo sapiens
gguaagggacuccagaa

SEQ ID NO: 509181 - RNA, 17 nt, Homo sapiens
gguagaguccuaggaca

SEQ ID NO: 509182 - RNA, 17 nt, Homo sapiens
gguaucugaugauguuc

SEQ ID NO: 509183 - RNA, 12 nt, Homo sapiens
gguauuuacugc

SEQ ID NO: 509184 - RNA, 15 nt, Homo sapiens
ggucccugccagugu

SEQ ID NO: 509185 - RNA, 19 nt, Homo sapiens
gguccugaguggcugaaau

SEQ ID NO: 509186 - RNA, 17 nt, Homo sapiens
gguccuuugagugucag

SEQ ID NO: 509187 - RNA, 13 nt, Homo sapiens
ggucuaugauguc

SEQ ID NO: 509188 - RNA, 18 nt, Homo sapiens
ggugaaggcccagccugu

SEQ ID NO: 509189 - RNA, 18 nt, Homo sapiens
ggugaggcgugggaucca

SEQ ID NO: 509190 - RNA, 15 nt, Homo sapiens
gguggggcuuggaag

SEQ ID NO: 509191 - RNA, 14 nt, Homo sapiens
gguguggcuuggaa

SEQ ID NO: 509192 - RNA, 14 nt, Homo sapiens
ggugugugaagcug

SEQ ID NO: 509193 - RNA, 13 nt, Homo sapiens
gguuaacaguaaa

SEQ ID NO: 509194 - RNA, 18 nt, Homo sapiens
gguuccggugucuggaaa

SEQ ID NO: 509195 - RNA, 16 nt, Homo sapiens
guaaagaaagcuguaa

SEQ ID NO: 509196 - RNA, 16 nt, Homo sapiens
guaaaucagugcagua

SEQ ID NO: 509197 - RNA, 20 nt, Homo sapiens
guaaaucagugcaguacuca

SEQ ID NO: 509198 - RNA, 19 nt, Homo sapiens
guaaaugcuugauggaauu

SEQ ID NO: 509199 - RNA, 16 nt, Homo sapiens
guaacacagugcagua

SEQ ID NO: 509200 - RNA, 22 nt, Homo sapiens
guaaccuccacaguagcauuuc

SEQ ID NO: 509201 - RNA, 23 nt, Homo sapiens
guaaccuccacaguagcauuucu

SEQ ID NO: 509202 - RNA, 11 nt, Homo sapiens
guaacuacuuu

SEQ ID NO: 509203 - RNA, 17 nt, Homo sapiens
guaacuucagauguuuc

SEQ ID NO: 509204 - RNA, 18 nt, Homo sapiens
guaacuucagauguuucc

SEQ ID NO: 509205 - RNA, 19 nt, Homo sapiens
guaagaaauauuacuauaa

SEQ ID NO: 509206 - RNA, 21 nt, Homo sapiens
guaagaauuuuaauauugcca

SEQ ID NO: 509207 - RNA, 21 nt, Homo sapiens
guacaaaaugaauugccuuug

SEQ ID NO: 509208 - RNA, 19 nt, Homo sapiens
guacaaauaauauugccuu

SEQ ID NO: 509209 - RNA, 14 nt, Homo sapiens
guacaguauucaau

SEQ ID NO: 509210 - RNA, 12 nt, Homo sapiens
guacaguguucu

SEQ ID NO: 509211 - RNA, 19 nt, Homo sapiens
guaccuguucuucuaucca

SEQ ID NO: 509212 - RNA, 12 nt, Homo sapiens
guacuaccccag

SEQ ID NO: 509213 - RNA, 13 nt, Homo sapiens
guacuaccccagg

SEQ ID NO: 509214 - RNA, 23 nt, Homo sapiens
guacucaguaaaucagugcagua

SEQ ID NO: 509215 - RNA, 20 nt, Homo sapiens
guacucaguaagacagugca

SEQ ID NO: 509216 - RNA, 23 nt, Homo sapiens
guacucaguaaggcagugcagua

SEQ ID NO: 509217 - RNA, 15 nt, Homo sapiens
guacugcaugaucuu

SEQ ID NO: 509218 - RNA, 21 nt, Homo sapiens
guacuucauucaaaaagccaa

SEQ ID NO: 509219 - RNA, 15 nt, Homo sapiens
guagauaagugcuca

SEQ ID NO: 509220 - RNA, 20 nt, Homo sapiens
guagaucaacucauguuaau

SEQ ID NO: 509221 - RNA, 19 nt, Homo sapiens
guagcucuguccacucuga

SEQ ID NO: 509222 - RNA, 20 nt, Homo sapiens
guauauugauguaacugugu

SEQ ID NO: 509223 - RNA, 19 nt, Homo sapiens
guaucaugcuucuacucca

SEQ ID NO: 509224 - RNA, 20 nt, Homo sapiens
guaucucaaaucugcuuuca

SEQ ID NO: 509225 - RNA, 13 nt, Homo sapiens
guaucugccaguc

SEQ ID NO: 509226 - RNA, 23 nt, Homo sapiens
guaugccucauuuuauucuguca

SEQ ID NO: 509227 - RNA, 18 nt, Homo sapiens
guauuaauguaaagauac

SEQ ID NO: 509228 - RNA, 19 nt, Homo sapiens
guauucaagagacaguauu

SEQ ID NO: 509229 - RNA, 15 nt, Homo sapiens
guauugcuaacaucu

SEQ ID NO: 509230 - RNA, 18 nt, Homo sapiens
guauugugucuuuugcau

SEQ ID NO: 509231 - RNA, 22 nt, Homo sapiens
guauuuaacauucuuggucaca

SEQ ID NO: 509232 - RNA, 22 nt, Homo sapiens
gucaaggcccggccccaucaga

SEQ ID NO: 509233 - RNA, 22 nt, Homo sapiens
gucacccaaguuggagugcagu

SEQ ID NO: 509234 - RNA, 16 nt, Homo sapiens
gucacuuacuucauau

SEQ ID NO: 509235 - RNA, 23 nt, Homo sapiens
gucagcagggggguuggguucca

SEQ ID NO: 509236 - RNA, 21 nt, Homo sapiens
gucauguuucugcaguauucu

SEQ ID NO: 509237 - RNA, 16 nt, Homo sapiens
guccauucacuuucag

SEQ ID NO: 509238 - RNA, 16 nt, Homo sapiens
guccauugacauguac

SEQ ID NO: 509239 - RNA, 17 nt, Homo sapiens
gucccaguuaacuguua

SEQ ID NO: 509240 - RNA, 20 nt, Homo sapiens
guccuuuaaaaaaaucccau

SEQ ID NO: 509241 - RNA, 22 nt, Homo sapiens
gucugaaggagaggagugcgcu

SEQ ID NO: 509242 - RNA, 13 nt, Homo sapiens
gucuguacuucau

SEQ ID NO: 509243 - RNA, 22 nt, Homo sapiens
gucugugaaagucuccuguauc

SEQ ID NO: 509244 - RNA, 13 nt, Homo sapiens
gucuuaagaugca

SEQ ID NO: 509245 - RNA, 22 nt, Homo sapiens
gucuuagagauacccucugaga

SEQ ID NO: 509246 - RNA, 14 nt, Homo sapiens
gucuuaucuaccag

SEQ ID NO: 509247 - RNA, 16 nt, Homo sapiens
gugaacacacucagca

SEQ ID NO: 509248 - RNA, 19 nt, Homo sapiens
gugaacuuucucagcauau

SEQ ID NO: 509249 - RNA, 12 nt, Homo sapiens
gugaucuauacc

SEQ ID NO: 509250 - RNA, 20 nt, Homo sapiens
gugauguggugggagcacag

SEQ ID NO: 509251 - RNA, 22 nt, Homo sapiens
gugcaauguuccguucaucuga

SEQ ID NO: 509252 - RNA, 17 nt, Homo sapiens
gugcagaaaacauuguu

SEQ ID NO: 509253 - RNA, 19 nt, Homo sapiens
gugcaguagagagccuuuc

SEQ ID NO: 509254 - RNA, 20 nt, Homo sapiens
gugcauucauucauccucuu

SEQ ID NO: 509255 - RNA, 16 nt, Homo sapiens
gugccuaauguuccau

SEQ ID NO: 509256 - RNA, 21 nt, Homo sapiens
gugcugcuguggcaucaggaa

SEQ ID NO: 509257 - RNA, 19 nt, Homo sapiens
gugcugcuuccuucuaaga

SEQ ID NO: 509258 - RNA, 22 nt, Homo sapiens
gugcuuggaaaauguucugaca

SEQ ID NO: 509259 - RNA, 23 nt, Homo sapiens
gugcuuguucuuccucuuaccug

SEQ ID NO: 509260 - RNA, 21 nt, Homo sapiens
guggagacuaacuuauuuuga

SEQ ID NO: 509261 - RNA, 20 nt, Homo sapiens
guggauaaauuuuggaagaa

SEQ ID NO: 509262 - RNA, 14 nt, Homo sapiens
guggcaucaggaaa

SEQ ID NO: 509263 - RNA, 12 nt, Homo sapiens
gugggaguccac

SEQ ID NO: 509264 - RNA, 21 nt, Homo sapiens
uacagaccacaaaauguaaua

SEQ ID NO: 509265 - RNA, 22 nt, Homo sapiens
uacagcgcauuuucuaccugaa

SEQ ID NO: 509266 - RNA, 19 nt, Homo sapiens
uacaggugccccaccuccc

SEQ ID NO: 509267 - RNA, 14 nt, Homo sapiens
uacagucacauuca

SEQ ID NO: 509268 - RNA, 11 nt, Homo sapiens
uacagugccac

SEQ ID NO: 509269 - RNA, 13 nt, Homo sapiens
uacagugccacga

SEQ ID NO: 509270 - RNA, 16 nt, Homo sapiens
uacagugguauugcua

SEQ ID NO: 509271 - RNA, 20 nt, Homo sapiens
uacauaacaggcauugcacu

SEQ ID NO: 509272 - RNA, 20 nt, Homo sapiens
uacauacgcaauuguauaua

SEQ ID NO: 509273 - RNA, 12 nt, Homo sapiens
uacaucauaugu

SEQ ID NO: 509274 - RNA, 20 nt, Homo sapiens
uacaugaugauuucagaaac

SEQ ID NO: 509275 - RNA, 17 nt, Homo sapiens
uacauucuaaaucacuu

SEQ ID NO: 509276 - RNA, 13 nt, Homo sapiens
uaccaaaugccuu

SEQ ID NO: 509277 - RNA, 13 nt, Homo sapiens
uaccaagcuguga

SEQ ID NO: 509278 - RNA, 17 nt, Homo sapiens
uaccacaggaugcauau

SEQ ID NO: 509279 - RNA, 18 nt, Homo sapiens
uaccacaggaugcauauu

SEQ ID NO: 509280 - RNA, 12 nt, Homo sapiens
uaccacauucac

SEQ ID NO: 509281 - RNA, 22 nt, Homo sapiens
uaccaccaagaggaaaauauug

SEQ ID NO: 509282 - RNA, 22 nt, Homo sapiens
uaccauaagcuuuuucucugaa

SEQ ID NO: 509283 - RNA, 17 nt, Homo sapiens
uacccaaugcaguuugg

SEQ ID NO: 509284 - RNA, 18 nt, Homo sapiens
uaccccagaacgcaugca

SEQ ID NO: 509285 - RNA, 15 nt, Homo sapiens
uacccucuggagaua

SEQ ID NO: 509286 - RNA, 14 nt, Homo sapiens
uaccuauugcugua

SEQ ID NO: 509287 - RNA, 16 nt, Homo sapiens
uaccucagucaguauu

SEQ ID NO: 509288 - RNA, 17 nt, Homo sapiens
uaccuguaauagccuca

SEQ ID NO: 509289 - RNA, 21 nt, Homo sapiens
uacuaccccagaacgcaugca

SEQ ID NO: 509290 - RNA, 22 nt, Homo sapiens
uacuaccccagaacgcaugcag

SEQ ID NO: 509291 - RNA, 20 nt, Homo sapiens
uacuaccccaggacgcaugc

SEQ ID NO: 509292 - RNA, 16 nt, Homo sapiens
uacucaggcagugcaa

SEQ ID NO: 509293 - RNA, 17 nt, Homo sapiens
uacucaggcagugcaau

SEQ ID NO: 509294 - RNA, 17 nt, Homo sapiens
uacucaggcagugcagu

SEQ ID NO: 509295 - RNA, 20 nt, Homo sapiens
uacucaguaacagugcagua

SEQ ID NO: 509296 - RNA, 21 nt, Homo sapiens
uacucaguaaggcagugcagu

SEQ ID NO: 509297 - RNA, 21 nt, Homo sapiens
uacucaguuaggcagugcagu

SEQ ID NO: 509298 - RNA, 15 nt, Homo sapiens
uacugaaauacauau

SEQ ID NO: 509299 - RNA, 18 nt, Homo sapiens
uacuggcaucuguuaucu

SEQ ID NO: 509300 - RNA, 19 nt, Homo sapiens
uacuguucaauuucagaaa

SEQ ID NO: 509301 - RNA, 22 nt, Homo sapiens
uacuuacacugaaauccaaaau

SEQ ID NO: 509302 - RNA, 23 nt, Homo sapiens
uacuucuugugcuuuacucugaa

SEQ ID NO: 509303 - RNA, 19 nt, Homo sapiens
uacuuugagccucuuaggc

SEQ ID NO: 509304 - RNA, 14 nt, Homo sapiens
uacuuuuaucuuaa

SEQ ID NO: 509305 - RNA, 15 nt, Homo sapiens
uagaaacuuuggaag

SEQ ID NO: 509306 - RNA, 18 nt, Homo sapiens
uagaacauggacuacaca

SEQ ID NO: 509307 - RNA, 21 nt, Homo sapiens
uagaagagccugacuguguuc

SEQ ID NO: 509308 - RNA, 14 nt, Homo sapiens
uagaauacuguauu

SEQ ID NO: 509309 - RNA, 18 nt, Homo sapiens
uagaaucaagucugugaa

SEQ ID NO: 509310 - RNA, 19 nt, Homo sapiens
uagaauucuuaccaucuua

SEQ ID NO: 509311 - RNA, 24 nt, Homo sapiens
uagacugacuaggauucugcagga

SEQ ID NO: 509312 - RNA, 19 nt, Homo sapiens
uagacuguuagacaaaagu

SEQ ID NO: 509313 - RNA, 12 nt, Homo sapiens
uagagaggacag

SEQ ID NO: 509314 - RNA, 21 nt, Homo sapiens
uagagauacccucugagacag

SEQ ID NO: 509315 - RNA, 15 nt, Homo sapiens
uagagcuacuuugag

SEQ ID NO: 509316 - RNA, 19 nt, Homo sapiens
uagaggguccagucuucua

SEQ ID NO: 509317 - RNA, 19 nt, Homo sapiens
uagaucaggagaaacucgg

SEQ ID NO: 509318 - RNA, 19 nt, Homo sapiens
uagauccaauugcauuuau

SEQ ID NO: 509319 - RNA, 14 nt, Homo sapiens
uagauuaacccuau

SEQ ID NO: 509320 - RNA, 17 nt, Homo sapiens
uagcaacacaucuacca

SEQ ID NO: 509321 - RNA, 14 nt, Homo sapiens
uagccucaccuucc

SEQ ID NO: 509322 - RNA, 16 nt, Homo sapiens
uagcucgugugcuuag

SEQ ID NO: 509323 - RNA, 18 nt, Homo sapiens
uagcucuguccacucuga

SEQ ID NO: 509324 - RNA, 18 nt, Homo sapiens
uaggaaagcagugcagua

SEQ ID NO: 509325 - RNA, 14 nt, Homo sapiens
uaggaaugcucaau

SEQ ID NO: 509326 - RNA, 22 nt, Homo sapiens
uaggagguuccggugucuggaa

SEQ ID NO: 509327 - RNA, 17 nt, Homo sapiens
uaggauuuaccaaauag

SEQ ID NO: 509328 - RNA, 20 nt, Homo sapiens
uaggcaauggugaacuguca

SEQ ID NO: 509329 - RNA, 13 nt, Homo sapiens
uaggcagugcagu

SEQ ID NO: 509330 - RNA, 22 nt, Homo sapiens
uagggcaaagaaucaacaguga

SEQ ID NO: 509331 - RNA, 22 nt, Homo sapiens
uaggucuuaagaugcaaaucaa

SEQ ID NO: 509332 - RNA, 20 nt, Homo sapiens
uagguuaauaggaggacaga

SEQ ID NO: 509333 - RNA, 15 nt, Homo sapiens
uagguugaaggcaaa

SEQ ID NO: 509334 - RNA, 21 nt, Homo sapiens
uagucaguguacucugagucc

SEQ ID NO: 509335 - RNA, 18 nt, Homo sapiens
uagucuguuagauuuuau

SEQ ID NO: 509336 - RNA, 20 nt, Homo sapiens
uaguugccguggcaacugug

SEQ ID NO: 509337 - RNA, 13 nt, Homo sapiens
uauaaacacagua

SEQ ID NO: 509338 - RNA, 12 nt, Homo sapiens
uauaaacuguga

SEQ ID NO: 509339 - RNA, 20 nt, Homo sapiens
uauaaaucacagauuuccaa

SEQ ID NO: 509340 - RNA, 12 nt, Homo sapiens
uauaagccauag

SEQ ID NO: 509341 - RNA, 14 nt, Homo sapiens
uauacuucaaguaa

SEQ ID NO: 509342 - RNA, 16 nt, Homo sapiens
uauauacauacgcaau

SEQ ID NO: 509343 - RNA, 12 nt, Homo sapiens
uauauucccaaa

SEQ ID NO: 509344 - RNA, 20 nt, Homo sapiens
uauauugaaguaaguucauc

SEQ ID NO: 509345 - RNA, 22 nt, Homo sapiens
uauauuugcauaauaugcauau

SEQ ID NO: 509346 - RNA, 18 nt, Homo sapiens
uaucagaacuccuuucua

SEQ ID NO: 509347 - RNA, 20 nt, Homo sapiens
uaucaggaaauaucugugaa

SEQ ID NO: 509348 - RNA, 23 nt, Homo sapiens
uaucaguuacaguggcaguauug

SEQ ID NO: 509349 - RNA, 19 nt, Homo sapiens
uaucauccccaaauguguc

SEQ ID NO: 509350 - RNA, 19 nt, Homo sapiens
uaucaugcuucuacuccau

SEQ ID NO: 509351 - RNA, 20 nt, Homo sapiens
uaucauucagaaugugcaaa

SEQ ID NO: 509352 - RNA, 19 nt, Homo sapiens
uauccaacagaaagcauag

SEQ ID NO: 509353 - RNA, 19 nt, Homo sapiens
uauccagaggguugugauu

SEQ ID NO: 509354 - RNA, 21 nt, Homo sapiens
uauccccggacgcaugcaggg

SEQ ID NO: 509355 - RNA, 15 nt, Homo sapiens
uaucucccacaaaua

SEQ ID NO: 509356 - RNA, 19 nt, Homo sapiens
uaucucgcuagccauauau

SEQ ID NO: 509357 - RNA, 19 nt, Homo sapiens
uaucuuugucuuaucuacc

SEQ ID NO: 509358 - RNA, 20 nt, Homo sapiens
uaucuuugucuuaucuacca

SEQ ID NO: 509359 - RNA, 20 nt, Homo sapiens
uaugcacaccaaauugcuga

SEQ ID NO: 509360 - RNA, 20 nt, Homo sapiens
uaugcuuucccugaggaaug

SEQ ID NO: 509361 - RNA, 13 nt, Homo sapiens
uauggaaagggug

SEQ ID NO: 509362 - RNA, 22 nt, Homo sapiens
uauguacaaaaugaauugccuu

SEQ ID NO: 509363 - RNA, 20 nt, Homo sapiens
uauguacaaauaauauugcc

SEQ ID NO: 509364 - RNA, 17 nt, Homo sapiens
uaugugcagcuuuccag

SEQ ID NO: 509365 - RNA, 22 nt, Homo sapiens
uauuaucuuaaacccacauaaa

SEQ ID NO: 509366 - RNA, 23 nt, Homo sapiens
uauuauuuuucgucucaauggua

SEQ ID NO: 509367 - RNA, 19 nt, Homo sapiens
uauucaagagacaguauug

SEQ ID NO: 509368 - RNA, 15 nt, Homo sapiens
uauucguuacucuaa

SEQ ID NO: 509369 - RNA, 22 nt, Homo sapiens
uauucuuccaaguucauucaua

SEQ ID NO: 509370 - RNA, 19 nt, Homo sapiens
uauucuuuuguauaacuac

SEQ ID NO: 509371 - RNA, 11 nt, Homo sapiens
uauugagacau

SEQ ID NO: 509372 - RNA, 20 nt, Homo sapiens
uauugcccuuuaacaagacu

SEQ ID NO: 509373 - RNA, 21 nt, Homo sapiens
uauugcccuuuaacaagacuu

SEQ ID NO: 509374 - RNA, 17 nt, Homo sapiens
uauugcuaacaucucau

SEQ ID NO: 509375 - RNA, 18 nt, Homo sapiens
uauuguaacagacauugu

SEQ ID NO: 509376 - RNA, 20 nt, Homo sapiens
uauugucuuuugacauccag

SEQ ID NO: 509377 - RNA, 21 nt, Homo sapiens
uauugucuuuugacauccagc

SEQ ID NO: 509378 - RNA, 19 nt, Homo sapiens
uauuuguccaaacuguugg

SEQ ID NO: 509379 - RNA, 13 nt, Homo sapiens
aaacaguguggau

SEQ ID NO: 509380 - RNA, 22 nt, Homo sapiens
aaacaguguggcuuaaacauuu

SEQ ID NO: 509381 - RNA, 16 nt, Homo sapiens
aaacauucuuauuuca

SEQ ID NO: 509382 - RNA, 22 nt, Homo sapiens
aaaccucuuucggaaaugauug

SEQ ID NO: 509383 - RNA, 15 nt, Homo sapiens
aaaccuuucaauuca

SEQ ID NO: 509384 - RNA, 18 nt, Homo sapiens
aaacuacccucuggagau

SEQ ID NO: 509385 - RNA, 12 nt, Homo sapiens
aaacugugagau

SEQ ID NO: 509386 - RNA, 19 nt, Homo sapiens
aaacuuguacuuacacuga

SEQ ID NO: 509387 - RNA, 22 nt, Homo sapiens
aaacuuuccaugacaguagcau

SEQ ID NO: 509388 - RNA, 19 nt, Homo sapiens
aaagaaccccccuccccaa

SEQ ID NO: 509389 - RNA, 22 nt, Homo sapiens
aaagaguugcaguaaaguucca

SEQ ID NO: 509390 - RNA, 19 nt, Homo sapiens
aaagauugcuauaauguau

SEQ ID NO: 509391 - RNA, 14 nt, Homo sapiens
aaagcaugccaauu

SEQ ID NO: 509392 - RNA, 22 nt, Homo sapiens
aaagccaggguccugaguggcu

SEQ ID NO: 509393 - RNA, 21 nt, Homo sapiens
aaagcuaaacaaaacuugcau

SEQ ID NO: 509394 - RNA, 20 nt, Homo sapiens
aaagcuuaaacauugccuua

SEQ ID NO: 509395 - RNA, 13 nt, Homo sapiens
aaaggaacuggaa

SEQ ID NO: 509396 - RNA, 15 nt, Homo sapiens
aaaggcagcccucac

SEQ ID NO: 509397 - RNA, 21 nt, Homo sapiens
aaaggcuggaugugcuuucau

SEQ ID NO: 509398 - RNA, 23 nt, Homo sapiens
aaagguuguacauaguggucauu

SEQ ID NO: 509399 - RNA, 22 nt, Homo sapiens
aaaguaauuaaaaagacacuuu

SEQ ID NO: 509400 - RNA, 10 nt, Homo sapiens
aaagugcaac

SEQ ID NO: 509401 - RNA, 15 nt, Homo sapiens
aaaguuaaacgugau

SEQ ID NO: 509402 - RNA, 19 nt, Homo sapiens
aaaguuacauuauguguaa

SEQ ID NO: 509403 - RNA, 12 nt, Homo sapiens
aaaguugugauc

SEQ ID NO: 509404 - RNA, 17 nt, Homo sapiens
aaauaaaaauagcuaua

SEQ ID NO: 509405 - RNA, 18 nt, Homo sapiens
aaauaacugagcacuuug

SEQ ID NO: 509406 - RNA, 17 nt, Homo sapiens
aaauaaucauacacaga

SEQ ID NO: 509407 - RNA, 13 nt, Homo sapiens
aaauaaugcuuaa

SEQ ID NO: 509408 - RNA, 11 nt, Homo sapiens
aaauagcagua

SEQ ID NO: 509409 - RNA, 15 nt, Homo sapiens
aaauaguguguccau

SEQ ID NO: 509410 - RNA, 15 nt, Homo sapiens
aaauauaaacuguga

SEQ ID NO: 509411 - RNA, 12 nt, Homo sapiens
aaaucagugcag

SEQ ID NO: 509412 - RNA, 13 nt, Homo sapiens
aaaucagugcagu

SEQ ID NO: 509413 - RNA, 19 nt, Homo sapiens
aaaucgaggaagcaccucu

SEQ ID NO: 509414 - RNA, 16 nt, Homo sapiens
aaaugaaauacuugac

SEQ ID NO: 509415 - RNA, 14 nt, Homo sapiens
aaaugcaauuugau

SEQ ID NO: 509416 - RNA, 19 nt, Homo sapiens
aaauggcuuguucagucac

SEQ ID NO: 509417 - RNA, 18 nt, Homo sapiens
aaaugucuucauguugau

SEQ ID NO: 509418 - RNA, 16 nt, Homo sapiens
aaauuaaagcagcaaa

SEQ ID NO: 509419 - RNA, 23 nt, Homo sapiens
aaauuaacaaauucaguggacau

SEQ ID NO: 509420 - RNA, 23 nt, Homo sapiens
aaauuaauugaaauaccuauuca

SEQ ID NO: 509421 - RNA, 21 nt, Homo sapiens
aaauuagggcucuaauuuccu

SEQ ID NO: 509422 - RNA, 16 nt, Homo sapiens
aaauuaucugauccuu

SEQ ID NO: 509423 - RNA, 14 nt, Homo sapiens
aaauuuacuaugua

SEQ ID NO: 509424 - RNA, 23 nt, Homo sapiens
aacaaaaaaaaaaaaacaaaaga

SEQ ID NO: 509425 - RNA, 15 nt, Homo sapiens
aacaaagcauuugac

SEQ ID NO: 509426 - RNA, 20 nt, Homo sapiens
aacaaaucauuuugauguau

SEQ ID NO: 509427 - RNA, 14 nt, Homo sapiens
aacaauucaaguga

SEQ ID NO: 509428 - RNA, 11 nt, Homo sapiens
aacacagugac

SEQ ID NO: 509429 - RNA, 12 nt, Homo sapiens
aacacagugccc

SEQ ID NO: 509430 - RNA, 18 nt, Homo sapiens
aacacaguguagugcuca

SEQ ID NO: 509431 - RNA, 16 nt, Homo sapiens
aacacuaauggccaag

SEQ ID NO: 509432 - RNA, 21 nt, Homo sapiens
aacacugagaaaaagcauuaa

SEQ ID NO: 509433 - RNA, 16 nt, Homo sapiens
aacagaaaaaugaaau

SEQ ID NO: 509434 - RNA, 14 nt, Homo sapiens
aacagacauuguuu

SEQ ID NO: 509435 - RNA, 19 nt, Homo sapiens
aacaugguuaccucugcau

SEQ ID NO: 509436 - RNA, 21 nt, Homo sapiens
aacauucuauuucaacuucag

SEQ ID NO: 509437 - RNA, 19 nt, Homo sapiens
aacauuugggagacugagc

SEQ ID NO: 509438 - RNA, 16 nt, Homo sapiens
aaccaaauaagcaucu

SEQ ID NO: 509439 - RNA, 17 nt, Homo sapiens
aaccaccgacucucauu

SEQ ID NO: 509440 - RNA, 17 nt, Homo sapiens
aaccagaaaucuaaucu

SEQ ID NO: 509441 - RNA, 21 nt, Homo sapiens
aaccagaaaucuaaucucugu

SEQ ID NO: 509442 - RNA, 18 nt, Homo sapiens
aaccaucuaggaugauuu

SEQ ID NO: 509443 - RNA, 19 nt, Homo sapiens
aaccauuguuuacagagcu

SEQ ID NO: 509444 - RNA, 20 nt, Homo sapiens
aaccauuuaacugcagugua

SEQ ID NO: 509445 - RNA, 17 nt, Homo sapiens
aacccagacccugaguc

SEQ ID NO: 509446 - RNA, 15 nt, Homo sapiens
aaccccccuccccaa

SEQ ID NO: 509447 - RNA, 17 nt, Homo sapiens
aacccugcccugcaccu

SEQ ID NO: 509448 - RNA, 14 nt, Homo sapiens
aacccugugaucua

SEQ ID NO: 509449 - RNA, 15 nt, Homo sapiens
aacccugugaucuau

SEQ ID NO: 509450 - RNA, 14 nt, Homo sapiens
aacccuuccaccaa

SEQ ID NO: 509451 - RNA, 22 nt, Homo sapiens
aacccuuuuacagucacauuca

SEQ ID NO: 509452 - RNA, 15 nt, Homo sapiens
aaccuaccacauuca

SEQ ID NO: 509453 - RNA, 19 nt, Homo sapiens
aaccuccccugguccugca

SEQ ID NO: 509454 - RNA, 17 nt, Homo sapiens
aaccuccuccuccaguu

SEQ ID NO: 509455 - RNA, 18 nt, Homo sapiens
aaccuuaucuaagaacuu

SEQ ID NO: 509456 - RNA, 21 nt, Homo sapiens
aaccuuguacuuuacaaucau

SEQ ID NO: 509457 - RNA, 16 nt, Homo sapiens
aacgggaacaccugcu

SEQ ID NO: 509458 - RNA, 21 nt, Homo sapiens
aacgggucugugggacuggcc

SEQ ID NO: 509459 - RNA, 17 nt, Homo sapiens
aacuaaguucucuaucu

SEQ ID NO: 509460 - RNA, 17 nt, Homo sapiens
aacuacuuucuguuauc

SEQ ID NO: 509461 - RNA, 21 nt, Homo sapiens
aacuagcacuuuauaagccaa

SEQ ID NO: 509462 - RNA, 14 nt, Homo sapiens
aacuaucaccaaaa

SEQ ID NO: 509463 - RNA, 12 nt, Homo sapiens
aacuccuuacag

SEQ ID NO: 509464 - RNA, 19 nt, Homo sapiens
aacugaauugcuaucauuu

SEQ ID NO: 509465 - RNA, 19 nt, Homo sapiens
aacugauggguaucaugcu

SEQ ID NO: 509466 - RNA, 14 nt, Homo sapiens
aacuucaucugucu

SEQ ID NO: 509467 - RNA, 12 nt, Homo sapiens
aacuuuuuauuc

SEQ ID NO: 509468 - RNA, 15 nt, Homo sapiens
aagaaaaguaaaaaa

SEQ ID NO: 509469 - RNA, 22 nt, Homo sapiens
aagaaacacagcaugcauuuag

SEQ ID NO: 509470 - RNA, 13 nt, Homo sapiens
aagaaacuacccu

SEQ ID NO: 509471 - RNA, 22 nt, Homo sapiens
aagaaaugagaaauugugccaa

SEQ ID NO: 509472 - RNA, 18 nt, Homo sapiens
aagaacugccccaucucc

SEQ ID NO: 509473 - RNA, 17 nt, Homo sapiens
aagaaguccaugugaua

SEQ ID NO: 509474 - RNA, 20 nt, Homo sapiens
aagaauaaaaugcagugaaa

SEQ ID NO: 509475 - RNA, 12 nt, Homo sapiens
aagaauucauga

SEQ ID NO: 509476 - RNA, 17 nt, Homo sapiens
aagacaauuuuaauguu

SEQ ID NO: 509477 - RNA, 23 nt, Homo sapiens
aagacaauuuuaauguuuacaac

SEQ ID NO: 509478 - RNA, 14 nt, Homo sapiens
aagacacagacaaa

SEQ ID NO: 509479 - RNA, 16 nt, Homo sapiens
aagacacuuuuaccga

SEQ ID NO: 509480 - RNA, 18 nt, Homo sapiens
aagacaguaaagaccauu

SEQ ID NO: 509481 - RNA, 16 nt, Homo sapiens
aagaccaugcauucag

SEQ ID NO: 509482 - RNA, 19 nt, Homo sapiens
aagacggaaugaccagaaa

SEQ ID NO: 509483 - RNA, 19 nt, Homo sapiens
aagacucaguaugcuuucc

SEQ ID NO: 509484 - RNA, 18 nt, Homo sapiens
aagagcacguuuuccauu

SEQ ID NO: 509485 - RNA, 16 nt, Homo sapiens
aagagccugacugugu

SEQ ID NO: 509486 - RNA, 21 nt, Homo sapiens
aagaggccaguacuuugccau

SEQ ID NO: 509487 - RNA, 19 nt, Homo sapiens
aagagggggcaagucacau

SEQ ID NO: 509488 - RNA, 16 nt, Homo sapiens
aagaggugaccauaaa

SEQ ID NO: 509489 - RNA, 11 nt, Homo sapiens
aagaguucucc

SEQ ID NO: 509490 - RNA, 13 nt, Homo sapiens
aagauaaauccaa

SEQ ID NO: 509491 - RNA, 13 nt, Homo sapiens
aagauaguuguaa

SEQ ID NO: 509492 - RNA, 11 nt, Homo sapiens
aagauggauuu

SEQ ID NO: 509493 - RNA, 17 nt, Homo sapiens
aagaugucccauugaua

SEQ ID NO: 509494 - RNA, 12 nt, Homo sapiens
aagauugcuaua

SEQ ID NO: 509495 - RNA, 13 nt, Homo sapiens
aagcagccuccac

SEQ ID NO: 509496 - RNA, 12 nt, Homo sapiens
agcagaaagcca

SEQ ID NO: 509497 - RNA, 13 nt, Homo sapiens
agcagaaugagau

SEQ ID NO: 509498 - RNA, 15 nt, Homo sapiens
agcagucucagcuca

SEQ ID NO: 509499 - RNA, 22 nt, Homo sapiens
agcaucugccaggacacugccu

SEQ ID NO: 509500 - RNA, 16 nt, Homo sapiens
agcaucuguguaaccu

SEQ ID NO: 509501 - RNA, 19 nt, Homo sapiens
agcaugaagauaaauccaa

SEQ ID NO: 509502 - RNA, 23 nt, Homo sapiens
agcauguacaguguucuguuuaa

SEQ ID NO: 509503 - RNA, 14 nt, Homo sapiens
agcauguauugugu

SEQ ID NO: 509504 - RNA, 19 nt, Homo sapiens
agccaaaauagagaguaua

SEQ ID NO: 509505 - RNA, 23 nt, Homo sapiens
agccaaguucacaccacugccau

SEQ ID NO: 509506 - RNA, 13 nt, Homo sapiens
agccacagugggg

SEQ ID NO: 509507 - RNA, 18 nt, Homo sapiens
agccagcagacauuguca

SEQ ID NO: 509508 - RNA, 18 nt, Homo sapiens
agccaggguuccagacag

SEQ ID NO: 509509 - RNA, 15 nt, Homo sapiens
agccauacuuccagc

SEQ ID NO: 509510 - RNA, 15 nt, Homo sapiens
agccccaugccaugg

SEQ ID NO: 509511 - RNA, 23 nt, Homo sapiens
agccccauuauucauucucccuu

SEQ ID NO: 509512 - RNA, 22 nt, Homo sapiens
agcccuaacauagugucugcug

SEQ ID NO: 509513 - RNA, 16 nt, Homo sapiens
agcccucuuucucucu

SEQ ID NO: 509514 - RNA, 17 nt, Homo sapiens
agcccucuuucucucug

SEQ ID NO: 509515 - RNA, 22 nt, Homo sapiens
agcccucuuucucucugugugg

SEQ ID NO: 509516 - RNA, 15 nt, Homo sapiens
agcccuugcucuacc

SEQ ID NO: 509517 - RNA, 17 nt, Homo sapiens
agcccuugcucuaccug

SEQ ID NO: 509518 - RNA, 19 nt, Homo sapiens
agccuagucaugugccuug

SEQ ID NO: 509519 - RNA, 23 nt, Homo sapiens
agccuccacuuuggaucaggaaa

SEQ ID NO: 509520 - RNA, 15 nt, Homo sapiens
agccugacuguguuc

SEQ ID NO: 509521 - RNA, 16 nt, Homo sapiens
agccugacuguguuca

SEQ ID NO: 509522 - RNA, 15 nt, Homo sapiens
agccugaugauggaa

SEQ ID NO: 509523 - RNA, 23 nt, Homo sapiens
agccuuguaaaugggaaaauaua

SEQ ID NO: 509524 - RNA, 15 nt, Homo sapiens
agcuaagccugauga

SEQ ID NO: 509525 - RNA, 17 nt, Homo sapiens
agcuaauuaacuaacuc

SEQ ID NO: 509526 - RNA, 15 nt, Homo sapiens
agcucacagcacauu

SEQ ID NO: 509527 - RNA, 15 nt, Homo sapiens
agcucccagaacuuc

SEQ ID NO: 509528 - RNA, 15 nt, Homo sapiens
agcucuggaugaagg

SEQ ID NO: 509529 - RNA, 21 nt, Homo sapiens
agcugaagcguuacuacagca

SEQ ID NO: 509530 - RNA, 20 nt, Homo sapiens
agcugacccccugcugccau

SEQ ID NO: 509531 - RNA, 19 nt, Homo sapiens
agcugcccacaacuugcca

SEQ ID NO: 509532 - RNA, 22 nt, Homo sapiens
agcugcccacaacuugccaaaa

SEQ ID NO: 509533 - RNA, 20 nt, Homo sapiens
agcuguaauauauaguaaaa

SEQ ID NO: 509534 - RNA, 11 nt, Homo sapiens
agcugugauuu

SEQ ID NO: 509535 - RNA, 14 nt, Homo sapiens
agcuucacugucau

SEQ ID NO: 509536 - RNA, 14 nt, Homo sapiens
agcuuccagugcau

SEQ ID NO: 509537 - RNA, 15 nt, Homo sapiens
agcuuuacagugcca

SEQ ID NO: 509538 - RNA, 20 nt, Homo sapiens
aggaaacucuccaugauuau

SEQ ID NO: 509539 - RNA, 19 nt, Homo sapiens
aggaaacuuggacauuuau

SEQ ID NO: 509540 - RNA, 20 nt, Homo sapiens
aggaaaguacugcaugaucu

SEQ ID NO: 509541 - RNA, 22 nt, Homo sapiens
aggaaaugaaugugugugguuu

SEQ ID NO: 509542 - RNA, 14 nt, Homo sapiens
aggaaauguguauu

SEQ ID NO: 509543 - RNA, 17 nt, Homo sapiens
aggaaucaaaaauugaa

SEQ ID NO: 509544 - RNA, 18 nt, Homo sapiens
aggaaugaggcucuguaa

SEQ ID NO: 509545 - RNA, 13 nt, Homo sapiens
aggaauguagggc

SEQ ID NO: 509546 - RNA, 20 nt, Homo sapiens
aggacacagcacaagggcac

SEQ ID NO: 509547 - RNA, 22 nt, Homo sapiens
aggacaguacacacuuggguaa

SEQ ID NO: 509548 - RNA, 19 nt, Homo sapiens
aggacccagggaaugccag

SEQ ID NO: 509549 - RNA, 15 nt, Homo sapiens
aggacgcaugcaggg

SEQ ID NO: 509550 - RNA, 15 nt, Homo sapiens
aggacucccugcuua

SEQ ID NO: 509551 - RNA, 15 nt, Homo sapiens
aggagcuuccagugc

SEQ ID NO: 509552 - RNA, 16 nt, Homo sapiens
aggagcuuccagugca

SEQ ID NO: 509553 - RNA, 14 nt, Homo sapiens
aggaguuuugagaa

SEQ ID NO: 509554 - RNA, 13 nt, Homo sapiens
aggauaaugagau

SEQ ID NO: 509555 - RNA, 13 nt, Homo sapiens
aggaugcaugcag

SEQ ID NO: 509556 - RNA, 19 nt, Homo sapiens
aggcaaaaccaacucucua

SEQ ID NO: 509557 - RNA, 13 nt, Homo sapiens
aggcaauggugaa

SEQ ID NO: 509558 - RNA, 20 nt, Homo sapiens
aggcaauggugaacugucau

SEQ ID NO: 509559 - RNA, 17 nt, Homo sapiens
aggcagaauggugggcu

SEQ ID NO: 509560 - RNA, 12 nt, Homo sapiens
aggcagugcagu

SEQ ID NO: 509561 - RNA, 12 nt, Homo sapiens
aggccucaggga

SEQ ID NO: 509562 - RNA, 23 nt, Homo sapiens
aggccuccagccacuuauuucca

SEQ ID NO: 509563 - RNA, 21 nt, Homo sapiens
aggccuuuccccaguguggcc

SEQ ID NO: 509564 - RNA, 21 nt, Homo sapiens
aggcggagggucucccugggc

SEQ ID NO: 509565 - RNA, 19 nt, Homo sapiens
aggcggcaaagauccagcg

SEQ ID NO: 509566 - RNA, 15 nt, Homo sapiens
aggcucccacugccc

SEQ ID NO: 509567 - RNA, 19 nt, Homo sapiens
agggaaggcugcuguguag

SEQ ID NO: 509568 - RNA, 20 nt, Homo sapiens
agggaauccauaucagcucu

SEQ ID NO: 509569 - RNA, 22 nt, Homo sapiens
agggaaugccagggacauuuuc

SEQ ID NO: 509570 - RNA, 17 nt, Homo sapiens
agggacaagcauguuga

SEQ ID NO: 509571 - RNA, 11 nt, Homo sapiens
agggaccaagg

SEQ ID NO: 509572 - RNA, 18 nt, Homo sapiens
agggacuccagaagcagc

SEQ ID NO: 509573 - RNA, 13 nt, Homo sapiens
agggacucuccau

SEQ ID NO: 509574 - RNA, 19 nt, Homo sapiens
agggcaagcucauagcaca

SEQ ID NO: 509575 - RNA, 14 nt, Homo sapiens
agggcagaggaaug

SEQ ID NO: 509576 - RNA, 17 nt, Homo sapiens
aggggcaaagaacugcc

SEQ ID NO: 509577 - RNA, 14 nt, Homo sapiens
aggggguacagucc

SEQ ID NO: 509578 - RNA, 17 nt, Homo sapiens
aggguuccagacagggu

SEQ ID NO: 509579 - RNA, 19 nt, Homo sapiens
aggguucuauauuuacugu

SEQ ID NO: 509580 - RNA, 22 nt, Homo sapiens
aggguuugggcuugauuccugu

SEQ ID NO: 509581 - RNA, 15 nt, Homo sapiens
agguaaacuagcaaa

SEQ ID NO: 509582 - RNA, 19 nt, Homo sapiens
aggucuuaagaugcaaauc

SEQ ID NO: 509583 - RNA, 23 nt, Homo sapiens
aggugacuuuccuaugacacuca

SEQ ID NO: 509584 - RNA, 14 nt, Homo sapiens
agguuggagugcau

SEQ ID NO: 509585 - RNA, 12 nt, Homo sapiens
aguaaagaccau

SEQ ID NO: 509586 - RNA, 17 nt, Homo sapiens
aguaaaucagugcagua

SEQ ID NO: 509587 - RNA, 21 nt, Homo sapiens
aguaacacagugcagugcuca

SEQ ID NO: 509588 - RNA, 19 nt, Homo sapiens
aguaacaguguaguacuca

SEQ ID NO: 509589 - RNA, 16 nt, Homo sapiens
aguaagacagugcagu

SEQ ID NO: 509590 - RNA, 17 nt, Homo sapiens
aguaaggcagugcagua

SEQ ID NO: 509591 - RNA, 21 nt, Homo sapiens
aguaauacaguacaguacuca

SEQ ID NO: 509592 - RNA, 20 nt, Homo sapiens
aguacucaggcagugcagua

SEQ ID NO: 509593 - RNA, 24 nt, Homo sapiens
aguacucaguaaaucagugcagua

SEQ ID NO: 509594 - RNA, 24 nt, Homo sapiens
aguacucaguaaggcagugcagua

SEQ ID NO: 509595 - RNA, 17 nt, Homo sapiens
aguagcucgugugcuua

SEQ ID NO: 509596 - RNA, 16 nt, Homo sapiens
aguagugccugugauc

SEQ ID NO: 509597 - RNA, 20 nt, Homo sapiens
aguauauagccuuaagucuu

SEQ ID NO: 509598 - RNA, 23 nt, Homo sapiens
aguauggauugaaggauugugaa

SEQ ID NO: 509599 - RNA, 22 nt, Homo sapiens
aguauguacaggcugagacaca

SEQ ID NO: 509600 - RNA, 22 nt, Homo sapiens
aguauuguuuugguuugcuacu

SEQ ID NO: 509601 - RNA, 21 nt, Homo sapiens
agucaucucaaacacugcuua

SEQ ID NO: 509602 - RNA, 21 nt, Homo sapiens
agucauguuucugcaguauuc

SEQ ID NO: 509603 - RNA, 20 nt, Homo sapiens
aguccaagguauugagacau

SEQ ID NO: 509604 - RNA, 12 nt, Homo sapiens
aguccagaagag

SEQ ID NO: 509605 - RNA, 10 nt, Homo sapiens
aguccucaca

SEQ ID NO: 509606 - RNA, 22 nt, Homo sapiens
agucuaccugccuugccuguua

SEQ ID NO: 509607 - RNA, 20 nt, Homo sapiens
agucuguacuucaguucuca

SEQ ID NO: 509608 - RNA, 19 nt, Homo sapiens
agucuguagaaucuagcca

SEQ ID NO: 509609 - RNA, 14 nt, Homo sapiens
agugaacacacuca

SEQ ID NO: 509610 - RNA, 17 nt, Homo sapiens
agugaacacacucagca

SEQ ID NO: 509611 - RNA, 13 nt, Homo sapiens
agugaaggaagaa

SEQ ID NO: 509612 - RNA, 14 nt, Homo sapiens
cagcagugaaugcu

SEQ ID NO: 509613 - RNA, 17 nt, Homo sapiens
cagcaguuuucuuuuaa

SEQ ID NO: 509614 - RNA, 17 nt, Homo sapiens
cagcaucugccaggaca

SEQ ID NO: 509615 - RNA, 20 nt, Homo sapiens
cagcauucccaauuaucaaa

SEQ ID NO: 509616 - RNA, 15 nt, Homo sapiens
cagccaagccugacu

SEQ ID NO: 509617 - RNA, 20 nt, Homo sapiens
cagccacugcccaaagccau

SEQ ID NO: 509618 - RNA, 20 nt, Homo sapiens
cagccacuuauuuccaugga

SEQ ID NO: 509619 - RNA, 19 nt, Homo sapiens
cagccccuccccauggugc

SEQ ID NO: 509620 - RNA, 21 nt, Homo sapiens
cagcccugggcaaggaagcuu

SEQ ID NO: 509621 - RNA, 22 nt, Homo sapiens
cagccugaaagauacaggggau

SEQ ID NO: 509622 - RNA, 12 nt, Homo sapiens
cagccugcacag

SEQ ID NO: 509623 - RNA, 15 nt, Homo sapiens
cagccugcacagugg

SEQ ID NO: 509624 - RNA, 16 nt, Homo sapiens
cagccuguaacugucc

SEQ ID NO: 509625 - RNA, 14 nt, Homo sapiens
cagcuccacucuga

SEQ ID NO: 509626 - RNA, 23 nt, Homo sapiens
cagcucuuggcuaagaccaggag

SEQ ID NO: 509627 - RNA, 14 nt, Homo sapiens
cagcugggcagggu

SEQ ID NO: 509628 - RNA, 23 nt, Homo sapiens
cagcugugugugcccguggugag

SEQ ID NO: 509629 - RNA, 18 nt, Homo sapiens
caggaaagaucccaaguc

SEQ ID NO: 509630 - RNA, 15 nt, Homo sapiens
caggacccagggaau

SEQ ID NO: 509631 - RNA, 21 nt, Homo sapiens
caggagaaaccccugacaccu

SEQ ID NO: 509632 - RNA, 18 nt, Homo sapiens
caggagcauguccuaucc

SEQ ID NO: 509633 - RNA, 22 nt, Homo sapiens
caggauucuccuuuuuaccccu

SEQ ID NO: 509634 - RNA, 12 nt, Homo sapiens
caggcagugcaa

SEQ ID NO: 509635 - RNA, 13 nt, Homo sapiens
caggcagugcagu

SEQ ID NO: 509636 - RNA, 19 nt, Homo sapiens
caggcaguuaggugcugaa

SEQ ID NO: 509637 - RNA, 13 nt, Homo sapiens
caggccucaggga

SEQ ID NO: 509638 - RNA, 17 nt, Homo sapiens
caggcucccacugcccc

SEQ ID NO: 509639 - RNA, 15 nt, Homo sapiens
cagggacauuuucaa

SEQ ID NO: 509640 - RNA, 17 nt, Homo sapiens
cagggcgcuccggcaga

SEQ ID NO: 509641 - RNA, 13 nt, Homo sapiens
cagggcugugcuu

SEQ ID NO: 509642 - RNA, 22 nt, Homo sapiens
caggggcaaagaacugccccau

SEQ ID NO: 509643 - RNA, 21 nt, Homo sapiens
cagguagugggugaaugugug

SEQ ID NO: 509644 - RNA, 21 nt, Homo sapiens
caggugacuuuccuaugacac

SEQ ID NO: 509645 - RNA, 17 nt, Homo sapiens
caguaaaucagugcagu

SEQ ID NO: 509646 - RNA, 18 nt, Homo sapiens
caguaaaucagugcagua

SEQ ID NO: 509647 - RNA, 21 nt, Homo sapiens
caguaaauguauauugaugua

SEQ ID NO: 509648 - RNA, 15 nt, Homo sapiens
caguaacacagugca

SEQ ID NO: 509649 - RNA, 22 nt, Homo sapiens
caguaacacagugcagugcuca

SEQ ID NO: 509650 - RNA, 20 nt, Homo sapiens
caguaacagugcaguacuca

SEQ ID NO: 509651 - RNA, 16 nt, Homo sapiens
caguaaggcagugcag

SEQ ID NO: 509652 - RNA, 22 nt, Homo sapiens
caguaauacaguacaguacuca

SEQ ID NO: 509653 - RNA, 19 nt, Homo sapiens
caguacaauaaauaaaaga

SEQ ID NO: 509654 - RNA, 13 nt, Homo sapiens
caguacaguacuc

SEQ ID NO: 509655 - RNA, 21 nt, Homo sapiens
caguacucaggcagugcagua

SEQ ID NO: 509656 - RNA, 23 nt, Homo sapiens
caguacucaguaacagugcagua

SEQ ID NO: 509657 - RNA, 15 nt, Homo sapiens
caguacucaguaaua

SEQ ID NO: 509658 - RNA, 18 nt, Homo sapiens
caguagacagauguuggu

SEQ ID NO: 509659 - RNA, 17 nt, Homo sapiens
caguauugagacacugu

SEQ ID NO: 509660 - RNA, 23 nt, Homo sapiens
caguauuguucuuguaaaacugu

SEQ ID NO: 509661 - RNA, 12 nt, Homo sapiens
cagucacauuca

SEQ ID NO: 509662 - RNA, 23 nt, Homo sapiens
cagucacauucagagucgcugcu

SEQ ID NO: 509663 - RNA, 14 nt, Homo sapiens
cagucccuggagcu

SEQ ID NO: 509664 - RNA, 22 nt, Homo sapiens
cagucccuggagcuguccuuca

SEQ ID NO: 509665 - RNA, 17 nt, Homo sapiens
cagugaaggaagaaccu

SEQ ID NO: 509666 - RNA, 16 nt, Homo sapiens
cagugaaguacucagu

SEQ ID NO: 509667 - RNA, 20 nt, Homo sapiens
cagugaaguacucaguaaua

SEQ ID NO: 509668 - RNA, 18 nt, Homo sapiens
cagugcaauacucaguaa

SEQ ID NO: 509669 - RNA, 15 nt, Homo sapiens
cagugcauguugcca

SEQ ID NO: 509670 - RNA, 16 nt, Homo sapiens
cagugccacgacaugg

SEQ ID NO: 509671 - RNA, 16 nt, Homo sapiens
cagugcccauguguau

SEQ ID NO: 509672 - RNA, 17 nt, Homo sapiens
cagugcccauguguaug

SEQ ID NO: 509673 - RNA, 20 nt, Homo sapiens
caguggagaggggacuugga

SEQ ID NO: 509674 - RNA, 23 nt, Homo sapiens
caguuacaguggcaguauugaca

SEQ ID NO: 509675 - RNA, 16 nt, Homo sapiens
caguuaggcagugcag

SEQ ID NO: 509676 - RNA, 17 nt, Homo sapiens
caguugcaauaaacuca

SEQ ID NO: 509677 - RNA, 14 nt, Homo sapiens
cauaaaaaagggac

SEQ ID NO: 509678 - RNA, 22 nt, Homo sapiens
cauaaagagcacguuuuccauu

SEQ ID NO: 509679 - RNA, 15 nt, Homo sapiens
cauacaaauuuuccc

SEQ ID NO: 509680 - RNA, 13 nt, Homo sapiens
cauacaacauaua

SEQ ID NO: 509681 - RNA, 19 nt, Homo sapiens
cauagcauagccagcauuc

SEQ ID NO: 509682 - RNA, 18 nt, Homo sapiens
cauagccauucauuuaca

SEQ ID NO: 509683 - RNA, 22 nt, Homo sapiens
cauaucauucagaaugugcaaa

SEQ ID NO: 509684 - RNA, 13 nt, Homo sapiens
caucacuuaccac

SEQ ID NO: 509685 - RNA, 14 nt, Homo sapiens
caucaguauuuccu

SEQ ID NO: 509686 - RNA, 17 nt, Homo sapiens
cauccacuucacaguuc

SEQ ID NO: 509687 - RNA, 16 nt, Homo sapiens
caucuccacccugagc

SEQ ID NO: 509688 - RNA, 20 nt, Homo sapiens
caucucgcugccgucugucc

SEQ ID NO: 509689 - RNA, 15 nt, Homo sapiens
caucuuaaugucuuu

SEQ ID NO: 509690 - RNA, 24 nt, Homo sapiens
caucuuauuugucaguguagauca

SEQ ID NO: 509691 - RNA, 14 nt, Homo sapiens
caugaaaaguuuuc

SEQ ID NO: 509692 - RNA, 20 nt, Homo sapiens
caugacacgaauauugcuga

SEQ ID NO: 509693 - RNA, 22 nt, Homo sapiens
caugacagugguuauauuucaa

SEQ ID NO: 509694 - RNA, 21 nt, Homo sapiens
caugaggccuuuccccagugu

SEQ ID NO: 509695 - RNA, 16 nt, Homo sapiens
caugaguucugcacau

SEQ ID NO: 509696 - RNA, 24 nt, Homo sapiens
caugaugcuaguucuuacgcuuga

SEQ ID NO: 509697 - RNA, 22 nt, Homo sapiens
caugcagauaguauacacauca

SEQ ID NO: 509698 - RNA, 15 nt, Homo sapiens
cauggaucugcauaa

SEQ ID NO: 509699 - RNA, 22 nt, Homo sapiens
cauggcuuuaaaacaugcuguc

SEQ ID NO: 509700 - RNA, 14 nt, Homo sapiens
caugguagacugug

SEQ ID NO: 509701 - RNA, 17 nt, Homo sapiens
caugguauuaucuagua

SEQ ID NO: 509702 - RNA, 14 nt, Homo sapiens
cauggucagucuac

SEQ ID NO: 509703 - RNA, 12 nt, Homo sapiens
cauggugcagug

SEQ ID NO: 509704 - RNA, 14 nt, Homo sapiens
cauguauacuucaa

SEQ ID NO: 509705 - RNA, 13 nt, Homo sapiens
cauguaugccaug

SEQ ID NO: 509706 - RNA, 16 nt, Homo sapiens
cauguauugugucuuu

SEQ ID NO: 509707 - RNA, 18 nt, Homo sapiens
caugugccuugaacauau

SEQ ID NO: 509708 - RNA, 20 nt, Homo sapiens
caugugcgaacacagugaca

SEQ ID NO: 509709 - RNA, 19 nt, Homo sapiens
cauguggcuaaaugccuaa

SEQ ID NO: 509710 - RNA, 21 nt, Homo sapiens
cauguuuaauaauauguacaa

SEQ ID NO: 509711 - RNA, 16 nt, Homo sapiens
cauuauucauucuccc

SEQ ID NO: 509712 - RNA, 19 nt, Homo sapiens
cauucacaauacaguggau

SEQ ID NO: 509713 - RNA, 17 nt, Homo sapiens
cauucagugacaugucc

SEQ ID NO: 509714 - RNA, 20 nt, Homo sapiens
cauuccguuaggaauaacac

SEQ ID NO: 509715 - RNA, 17 nt, Homo sapiens
cauucuaaaucacuuua

SEQ ID NO: 509716 - RNA, 19 nt, Homo sapiens
cauucuaugacucuugucu

SEQ ID NO: 509717 - RNA, 15 nt, Homo sapiens
cauugaaacuguauu

SEQ ID NO: 509718 - RNA, 19 nt, Homo sapiens
cauuguaucuucauacaaa

SEQ ID NO: 509719 - RNA, 17 nt, Homo sapiens
cauuuaacugcagugua

SEQ ID NO: 509720 - RNA, 20 nt, Homo sapiens
cauuuaaugaguuuuaucuu

SEQ ID NO: 509721 - RNA, 14 nt, Homo sapiens
cauuuauguacaaa

SEQ ID NO: 509722 - RNA, 13 nt, Homo sapiens
cauuuauguguga

SEQ ID NO: 509723 - RNA, 22 nt, Homo sapiens
cauuucuucucucugugcuggu

SEQ ID NO: 509724 - RNA, 21 nt, Homo sapiens
cauuugcugaauaacaacaau

SEQ ID NO: 509725 - RNA, 11 nt, Homo sapiens
cauuugcugca

SEQ ID NO: 509726 - RNA, 21 nt, Homo sapiens
cauuuuacacuuucucaauga

SEQ ID NO: 509727 - RNA, 16 nt, Homo sapiens
cauuuucaagacacag

SEQ ID NO: 509728 - RNA, 15 nt, Homo sapiens
ugaaguaugucuuca

SEQ ID NO: 509729 - RNA, 14 nt, Homo sapiens
ugaauaauuuccaa

SEQ ID NO: 509730 - RNA, 13 nt, Homo sapiens
ugaaucucucaaa

SEQ ID NO: 509731 - RNA, 21 nt, Homo sapiens
ugaaucugagaaaguacuuuc

SEQ ID NO: 509732 - RNA, 21 nt, Homo sapiens
ugaaugccaguccagaugugc

SEQ ID NO: 509733 - RNA, 20 nt, Homo sapiens
ugaauuagagcuacuuugag

SEQ ID NO: 509734 - RNA, 16 nt, Homo sapiens
ugaauuuucacaugaa

SEQ ID NO: 509735 - RNA, 19 nt, Homo sapiens
ugacaaguuaccccugaaa

SEQ ID NO: 509736 - RNA, 11 nt, Homo sapiens
ugacacugucu

SEQ ID NO: 509737 - RNA, 14 nt, Homo sapiens
ugacagcaaacaca

SEQ ID NO: 509738 - RNA, 17 nt, Homo sapiens
ugacagcaaacacaguc

SEQ ID NO: 509739 - RNA, 17 nt, Homo sapiens
ugacaggaaaguggaug

SEQ ID NO: 509740 - RNA, 21 nt, Homo sapiens
ugacaggaagcgacgccucug

SEQ ID NO: 509741 - RNA, 21 nt, Homo sapiens
ugacauauuucauaagcacau

SEQ ID NO: 509742 - RNA, 22 nt, Homo sapiens
ugacauauuucauaagcacauc

SEQ ID NO: 509743 - RNA, 18 nt, Homo sapiens
ugacauccagcaguccaa

SEQ ID NO: 509744 - RNA, 16 nt, Homo sapiens
ugacaugggugugcca

SEQ ID NO: 509745 - RNA, 18 nt, Homo sapiens
ugacaugggugugccagg

SEQ ID NO: 509746 - RNA, 17 nt, Homo sapiens
ugaccaacuauauugcg

SEQ ID NO: 509747 - RNA, 16 nt, Homo sapiens
ugaccacuuguagucc

SEQ ID NO: 509748 - RNA, 19 nt, Homo sapiens
ugacccuccuguccagcag

SEQ ID NO: 509749 - RNA, 19 nt, Homo sapiens
ugaccuuucugagugacau

SEQ ID NO: 509750 - RNA, 23 nt, Homo sapiens
ugacugccagccccaugccaugg

SEQ ID NO: 509751 - RNA, 15 nt, Homo sapiens
ugagaaaucucaucc

SEQ ID NO: 509752 - RNA, 23 nt, Homo sapiens
ugagaaauuuuuuuccagaauug

SEQ ID NO: 509753 - RNA, 21 nt, Homo sapiens
ugagacuuccuauuaauuuau

SEQ ID NO: 509754 - RNA, 21 nt, Homo sapiens
ugagaugggaggaucacuuga

SEQ ID NO: 509755 - RNA, 11 nt, Homo sapiens
ugagcauauau

SEQ ID NO: 509756 - RNA, 19 nt, Homo sapiens
ugaggacauaaaucuucca

SEQ ID NO: 509757 - RNA, 18 nt, Homo sapiens
ugaggccccugugcagua

SEQ ID NO: 509758 - RNA, 16 nt, Homo sapiens
ugaggcgugggaucca

SEQ ID NO: 509759 - RNA, 21 nt, Homo sapiens
ugaggcucugcaguggcaaau

SEQ ID NO: 509760 - RNA, 19 nt, Homo sapiens
ugagugaaauauuacucug

SEQ ID NO: 509761 - RNA, 22 nt, Homo sapiens
ugaguuucauuuuucauuuucu

SEQ ID NO: 509762 - RNA, 20 nt, Homo sapiens
ugauaaauuugacuguuauu

SEQ ID NO: 509763 - RNA, 13 nt, Homo sapiens
ugauaacucugua

SEQ ID NO: 509764 - RNA, 20 nt, Homo sapiens
ugauaaucaguuuccacuac

SEQ ID NO: 509765 - RNA, 16 nt, Homo sapiens
ugauagaauaaagccu

SEQ ID NO: 509766 - RNA, 17 nt, Homo sapiens
ugauaguuuacaaacaa

SEQ ID NO: 509767 - RNA, 14 nt, Homo sapiens
ugauauauuuucca

SEQ ID NO: 509768 - RNA, 19 nt, Homo sapiens
ugauaugagucacugccuu

SEQ ID NO: 509769 - RNA, 23 nt, Homo sapiens
ugauggccaggccucagggacca

SEQ ID NO: 509770 - RNA, 23 nt, Homo sapiens
ugauguccaaacuuaacagauca

SEQ ID NO: 509771 - RNA, 15 nt, Homo sapiens
ugauuaaaacauuau

SEQ ID NO: 509772 - RNA, 16 nt, Homo sapiens
ugauuaaggacuacag

SEQ ID NO: 509773 - RNA, 12 nt, Homo sapiens
ugauugucaaau

SEQ ID NO: 509774 - RNA, 12 nt, Homo sapiens
ugauugugaacu

SEQ ID NO: 509775 - RNA, 14 nt, Homo sapiens
ugcaauuuacuugg

SEQ ID NO: 509776 - RNA, 21 nt, Homo sapiens
ugcacugcccuccgcccuucc

SEQ ID NO: 509777 - RNA, 12 nt, Homo sapiens
ugcagcaguacc

SEQ ID NO: 509778 - RNA, 14 nt, Homo sapiens
ugcagcaguaccau

SEQ ID NO: 509779 - RNA, 22 nt, Homo sapiens
ugcaggcagauuaauaacagaa

SEQ ID NO: 509780 - RNA, 18 nt, Homo sapiens
ugcagggcccccacugga

SEQ ID NO: 509781 - RNA, 22 nt, Homo sapiens
ugcaguacucaguaaggcagug

SEQ ID NO: 509782 - RNA, 16 nt, Homo sapiens
ugcaguugauuugaga

SEQ ID NO: 509783 - RNA, 17 nt, Homo sapiens
ugcauaaccgcacagac

SEQ ID NO: 509784 - RNA, 19 nt, Homo sapiens
ugcaucaugcaugcacucu

SEQ ID NO: 509785 - RNA, 17 nt, Homo sapiens
ugcauguaauccuagca

SEQ ID NO: 509786 - RNA, 20 nt, Homo sapiens
ugccaacauugccuauuuca

SEQ ID NO: 509787 - RNA, 19 nt, Homo sapiens
ugccacauugcuucauuaa

SEQ ID NO: 509788 - RNA, 16 nt, Homo sapiens
ugccaggacacugccu

SEQ ID NO: 509789 - RNA, 21 nt, Homo sapiens
ugccauaguuugaauucaugc

SEQ ID NO: 509790 - RNA, 20 nt, Homo sapiens
ugccaucaagaaacauucag

SEQ ID NO: 509791 - RNA, 20 nt, Homo sapiens
ugccauuuuuugucugugau

SEQ ID NO: 509792 - RNA, 14 nt, Homo sapiens
ugcccaaagccauc

SEQ ID NO: 509793 - RNA, 20 nt, Homo sapiens
ugcccagacucaaggccucc

SEQ ID NO: 509794 - RNA, 20 nt, Homo sapiens
ugcccaguaucauacguuga

SEQ ID NO: 509795 - RNA, 13 nt, Homo sapiens
ugcccguggugag

SEQ ID NO: 509796 - RNA, 20 nt, Homo sapiens
ugcccuguuuccaaugccaa

SEQ ID NO: 509797 - RNA, 13 nt, Homo sapiens
ugccgucuguccc

SEQ ID NO: 509798 - RNA, 17 nt, Homo sapiens
ugccguggcaacugugg

SEQ ID NO: 509799 - RNA, 20 nt, Homo sapiens
ugccucagccaguggcacag

SEQ ID NO: 509800 - RNA, 18 nt, Homo sapiens
ugccuuuccagugcugcu

SEQ ID NO: 509801 - RNA, 13 nt, Homo sapiens
ugcgcucuggguu

SEQ ID NO: 509802 - RNA, 15 nt, Homo sapiens
ugcggugugucucca

SEQ ID NO: 509803 - RNA, 21 nt, Homo sapiens
ugcguaggagagaacagggau

SEQ ID NO: 509804 - RNA, 19 nt, Homo sapiens
ugcuacaccuuagcagcuc

SEQ ID NO: 509805 - RNA, 22 nt, Homo sapiens
ugcuagcauuuuagcugugcaa

SEQ ID NO: 509806 - RNA, 21 nt, Homo sapiens
ugcuagcccauuagaagcaca

SEQ ID NO: 509807 - RNA, 15 nt, Homo sapiens
ugcuauaauguauaa

SEQ ID NO: 509808 - RNA, 21 nt, Homo sapiens
ugcucaauaaggcagugcagu

SEQ ID NO: 509809 - RNA, 17 nt, Homo sapiens
ugcucaguaaggcagug

SEQ ID NO: 509810 - RNA, 14 nt, Homo sapiens
ugcuccauuccuga

SEQ ID NO: 509811 - RNA, 21 nt, Homo sapiens
ugcuccucaccccuguaggga

SEQ ID NO: 509812 - RNA, 18 nt, Homo sapiens
ugcucuggggcuugcuau

SEQ ID NO: 509813 - RNA, 14 nt, Homo sapiens
ugcucuuuaccuug

SEQ ID NO: 509814 - RNA, 11 nt, Homo sapiens
ugcugcacugc

SEQ ID NO: 509815 - RNA, 13 nt, Homo sapiens
ugcugcacugccc

SEQ ID NO: 509816 - RNA, 21 nt, Homo sapiens
ugcugccaggcucccacugcc

SEQ ID NO: 509817 - RNA, 15 nt, Homo sapiens
ugcugccaucuccag

SEQ ID NO: 509818 - RNA, 22 nt, Homo sapiens
ugcuuaacauaaacuuguacuu

SEQ ID NO: 509819 - RNA, 18 nt, Homo sapiens
ugcuuaguaucucaucaa

SEQ ID NO: 509820 - RNA, 16 nt, Homo sapiens
ugcuuucagauccauc

SEQ ID NO: 509821 - RNA, 13 nt, Homo sapiens
uggaaaagcacuu

SEQ ID NO: 509822 - RNA, 22 nt, Homo sapiens
uggaaauaacugagcacuuuga

SEQ ID NO: 509823 - RNA, 18 nt, Homo sapiens
uggaacucagcugucugu

SEQ ID NO: 509824 - RNA, 15 nt, Homo sapiens
uggaagacaaauaca

SEQ ID NO: 509825 - RNA, 14 nt, Homo sapiens
uggaaguacauaaa

SEQ ID NO: 509826 - RNA, 18 nt, Homo sapiens
uggacauuuauguacaaa

SEQ ID NO: 509827 - RNA, 19 nt, Homo sapiens
uggacauuuauguacaaaa

SEQ ID NO: 509828 - RNA, 13 nt, Homo sapiens
uggacgcaugcag

SEQ ID NO: 509829 - RNA, 18 nt, Homo sapiens
uggagaggagaguggcag

SEQ ID NO: 509830 - RNA, 15 nt, Homo sapiens
uggagcagaaagcca

SEQ ID NO: 509831 - RNA, 16 nt, Homo sapiens
uggagccugggcagca

SEQ ID NO: 509832 - RNA, 20 nt, Homo sapiens
uggagcguguacuaccccag

SEQ ID NO: 509833 - RNA, 15 nt, Homo sapiens
uggaggaaaccacaa

SEQ ID NO: 509834 - RNA, 17 nt, Homo sapiens
uggauaaauuuuggaag

SEQ ID NO: 509835 - RNA, 16 nt, Homo sapiens
uggauaugcuagcauu

SEQ ID NO: 509836 - RNA, 12 nt, Homo sapiens
uggccaaugggg

SEQ ID NO: 509837 - RNA, 12 nt, Homo sapiens
uggccuuagccc

SEQ ID NO: 509838 - RNA, 13 nt, Homo sapiens
uggcggccuuccg

SEQ ID NO: 509839 - RNA, 16 nt, Homo sapiens
uggcucccaggguccu

SEQ ID NO: 509840 - RNA, 18 nt, Homo sapiens
uggcugauuuacuaacag

SEQ ID NO: 509841 - RNA, 20 nt, Homo sapiens
ugggaagaauaaaaugcagu

SEQ ID NO: 509842 - RNA, 21 nt, Homo sapiens
ugggaagaauaaaaugcagug

SEQ ID NO: 509843 - RNA, 21 nt, Homo sapiens
uggggacagaggauuucugcu

SEQ ID NO: 509844 - RNA, 20 nt, Homo sapiens
cauaagcuuuuucucugaac

SEQ ID NO: 509845 - RNA, 15 nt, Homo sapiens
cauaauaugcauaua

SEQ ID NO: 509846 - RNA, 21 nt, Homo sapiens
cauacaaauuuucccagugaa

SEQ ID NO: 509847 - RNA, 15 nt, Homo sapiens
cauacaacauauacu

SEQ ID NO: 509848 - RNA, 16 nt, Homo sapiens
cauaccuucugaugaa

SEQ ID NO: 509849 - RNA, 13 nt, Homo sapiens
cauauacuuccau

SEQ ID NO: 509850 - RNA, 23 nt, Homo sapiens
cauaugauaaauuugacuguuau

SEQ ID NO: 509851 - RNA, 16 nt, Homo sapiens
cauauuuaaagucuug

SEQ ID NO: 509852 - RNA, 21 nt, Homo sapiens
cauauuucauaagcacaucca

SEQ ID NO: 509853 - RNA, 21 nt, Homo sapiens
cauauuuuccuuuaugugaug

SEQ ID NO: 509854 - RNA, 12 nt, Homo sapiens
caucaaagcccu

SEQ ID NO: 509855 - RNA, 13 nt, Homo sapiens
caucaaagcccuc

SEQ ID NO: 509856 - RNA, 21 nt, Homo sapiens
caucaacaaagaaauauuauu

SEQ ID NO: 509857 - RNA, 13 nt, Homo sapiens
caucacaguucac

SEQ ID NO: 509858 - RNA, 16 nt, Homo sapiens
caucaguuaggauuag

SEQ ID NO: 509859 - RNA, 15 nt, Homo sapiens
cauccagcaguccaa

SEQ ID NO: 509860 - RNA, 19 nt, Homo sapiens
caucucaaacacugcuuaa

SEQ ID NO: 509861 - RNA, 21 nt, Homo sapiens
caucucagguggcauuugcag

SEQ ID NO: 509862 - RNA, 20 nt, Homo sapiens
caucucaucuuaaugucuuu

SEQ ID NO: 509863 - RNA, 12 nt, Homo sapiens
caucucgcugcc

SEQ ID NO: 509864 - RNA, 15 nt, Homo sapiens
ugggccuccaugccc

SEQ ID NO: 509865 - RNA, 15 nt, Homo sapiens
ugggcucuucgccau

SEQ ID NO: 509866 - RNA, 19 nt, Homo sapiens
ugggcugccugcuguguua

SEQ ID NO: 509867 - RNA, 22 nt, Homo sapiens
uggggacagaggauuucugcuu

SEQ ID NO: 509868 - RNA, 22 nt, Homo sapiens
uggggcuuccauggugguuuca

SEQ ID NO: 509869 - RNA, 18 nt, Homo sapiens
ugggggaggcggcacauu

SEQ ID NO: 509870 - RNA, 19 nt, Homo sapiens
ugggggaggcggcacauug

SEQ ID NO: 509871 - RNA, 12 nt, Homo sapiens
ugggguggaauu

SEQ ID NO: 509872 - RNA, 21 nt, Homo sapiens
uggguagcauauccucaauua

SEQ ID NO: 509873 - RNA, 15 nt, Homo sapiens
ugggugaauguguga

SEQ ID NO: 509874 - RNA, 12 nt, Homo sapiens
ugguacucagua

SEQ ID NO: 509875 - RNA, 20 nt, Homo sapiens
ugguaggaggcagagucucu

SEQ ID NO: 509876 - RNA, 17 nt, Homo sapiens
ugguaguucgaagaauu

SEQ ID NO: 509877 - RNA, 21 nt, Homo sapiens
uggucauuugguggcucuaac

SEQ ID NO: 509878 - RNA, 18 nt, Homo sapiens
uggucuauuuauguauaa

SEQ ID NO: 509879 - RNA, 16 nt, Homo sapiens
ugguguaaaccauucu

SEQ ID NO: 509880 - RNA, 19 nt, Homo sapiens
ugguuaaugaaaaaucuga

SEQ ID NO: 509881 - RNA, 23 nt, Homo sapiens
ugguuguugcaguucagacaaau

SEQ ID NO: 509882 - RNA, 16 nt, Homo sapiens
ugguuuccaucaaagc

SEQ ID NO: 509883 - RNA, 14 nt, Homo sapiens
ugguuucuuugcug

SEQ ID NO: 509884 - RNA, 13 nt, Homo sapiens
uguaaaacuguga

SEQ ID NO: 509885 - RNA, 21 nt, Homo sapiens
uguaaaacugugacauuccac

SEQ ID NO: 509886 - RNA, 12 nt, Homo sapiens
uguaaguagcca

SEQ ID NO: 509887 - RNA, 14 nt, Homo sapiens
uguaauauuuugcu

SEQ ID NO: 509888 - RNA, 15 nt, Homo sapiens
uguacacacacagac

SEQ ID NO: 509889 - RNA, 16 nt, Homo sapiens
uguacacacacagaca

SEQ ID NO: 509890 - RNA, 21 nt, Homo sapiens
uguacaggcugagacacagcc

SEQ ID NO: 509891 - RNA, 12 nt, Homo sapiens
uguacaguuugc

SEQ ID NO: 509892 - RNA, 11 nt, Homo sapiens
uguacuacccc

SEQ ID NO: 509893 - RNA, 13 nt, Homo sapiens
uguacuaccccag

SEQ ID NO: 509894 - RNA, 13 nt, Homo sapiens
uguagcuucugaa

SEQ ID NO: 509895 - RNA, 20 nt, Homo sapiens
uguagcuuuaaaaccacagc

SEQ ID NO: 509896 - RNA, 20 nt, Homo sapiens
uguagggccugcauggagaa

SEQ ID NO: 509897 - RNA, 17 nt, Homo sapiens
uguauacaaacaggugc

SEQ ID NO: 509898 - RNA, 12 nt, Homo sapiens
uguauacuucaa

SEQ ID NO: 509899 - RNA, 23 nt, Homo sapiens
uguauauauuuauuauuuucaua

SEQ ID NO: 509900 - RNA, 21 nt, Homo sapiens
uguauauugauguaacugugu

SEQ ID NO: 509901 - RNA, 14 nt, Homo sapiens
uguauggaagacaa

SEQ ID NO: 509902 - RNA, 17 nt, Homo sapiens
uguaugugccaguacuu

SEQ ID NO: 509903 - RNA, 16 nt, Homo sapiens
ugucauagcuuauaua

SEQ ID NO: 509904 - RNA, 18 nt, Homo sapiens
ugucauugguuacaaauu

SEQ ID NO: 509905 - RNA, 16 nt, Homo sapiens
uguccauucacuuuca

SEQ ID NO: 509906 - RNA, 13 nt, Homo sapiens
uguccguccugcu

SEQ ID NO: 509907 - RNA, 17 nt, Homo sapiens
uguccgucuguccugcg

SEQ ID NO: 509908 - RNA, 13 nt, Homo sapiens
uguccuaaaugca

SEQ ID NO: 509909 - RNA, 13 nt, Homo sapiens
ugucucucuuuug

SEQ ID NO: 509910 - RNA, 15 nt, Homo sapiens
ugucugugaugucag

SEQ ID NO: 509911 - RNA, 15 nt, Homo sapiens
ugucuucaaaauaua

SEQ ID NO: 509912 - RNA, 15 nt, Homo sapiens
ugucuuuggcuucag

SEQ ID NO: 509913 - RNA, 22 nt, Homo sapiens
ugugcacggcagcuugagccug

SEQ ID NO: 509914 - RNA, 13 nt, Homo sapiens
ugugcagacugug

SEQ ID NO: 509915 - RNA, 15 nt, Homo sapiens
ugugcagcuuuccag

SEQ ID NO: 509916 - RNA, 17 nt, Homo sapiens
ugugcagugauguggug

SEQ ID NO: 509917 - RNA, 17 nt, Homo sapiens
ugugcgaacacagugac

SEQ ID NO: 509918 - RNA, 15 nt, Homo sapiens
ugugcugccuguggu

SEQ ID NO: 509919 - RNA, 14 nt, Homo sapiens
ugugcuuaccuguu

SEQ ID NO: 509920 - RNA, 12 nt, Homo sapiens
ugugcuuucauc

SEQ ID NO: 509921 - RNA, 14 nt, Homo sapiens
ugugcuuucauguu

SEQ ID NO: 509922 - RNA, 15 nt, Homo sapiens
uguggauaugagcuu

SEQ ID NO: 509923 - RNA, 18 nt, Homo sapiens
uguggcacacaacugugg

SEQ ID NO: 509924 - RNA, 18 nt, Homo sapiens
uguggcuucccaugucuu

SEQ ID NO: 509925 - RNA, 20 nt, Homo sapiens
uguggucugcugccucagga

SEQ ID NO: 509926 - RNA, 22 nt, Homo sapiens
uguguagcucuguccacucuga

SEQ ID NO: 509927 - RNA, 21 nt, Homo sapiens
uguguauggaagacaaauaca

SEQ ID NO: 509928 - RNA, 13 nt, Homo sapiens
ugugucuuguauu

SEQ ID NO: 509929 - RNA, 20 nt, Homo sapiens
uguuaaauaaggccucaucc

SEQ ID NO: 509930 - RNA, 22 nt, Homo sapiens
uguucagaagaaagauugcuau

SEQ ID NO: 509931 - RNA, 15 nt, Homo sapiens
uguucagaucucaua

SEQ ID NO: 509932 - RNA, 18 nt, Homo sapiens
uguucauucucaucagug

SEQ ID NO: 509933 - RNA, 16 nt, Homo sapiens
uguugaaaguugcagu

SEQ ID NO: 509934 - RNA, 19 nt, Homo sapiens
uguugaagaacucauguga

SEQ ID NO: 509935 - RNA, 14 nt, Homo sapiens
uguugcuauuuccu

SEQ ID NO: 509936 - RNA, 14 nt, Homo sapiens
uguuguuauggcaa

SEQ ID NO: 509937 - RNA, 19 nt, Homo sapiens
uguuuacugacauggugcu

SEQ ID NO: 509938 - RNA, 16 nt, Homo sapiens
uguuuaucuagcauag

SEQ ID NO: 509939 - RNA, 13 nt, Homo sapiens
uguuucacagugg

SEQ ID NO: 509940 - RNA, 17 nt, Homo sapiens
uuuccucacuaccacuu

SEQ ID NO: 509941 - RNA, 17 nt, Homo sapiens
uuuccugcuccuccagu

SEQ ID NO: 509942 - RNA, 19 nt, Homo sapiens
uuucucucuguguggcaaa

SEQ ID NO: 509943 - RNA, 15 nt, Homo sapiens
uuucucuuaccacua

SEQ ID NO: 509944 - RNA, 14 nt, Homo sapiens
uuucugacuccagu

SEQ ID NO: 509945 - RNA, 22 nt, Homo sapiens
uuucugcaaugguuuaguggcu

SEQ ID NO: 509946 - RNA, 19 nt, Homo sapiens
uuucuuggugcuuugucua

SEQ ID NO: 509947 - RNA, 13 nt, Homo sapiens
uuugacacacuca

SEQ ID NO: 509948 - RNA, 13 nt, Homo sapiens
uuugacauccagc

SEQ ID NO: 509949 - RNA, 18 nt, Homo sapiens
uuugcauaauaugcauau

SEQ ID NO: 509950 - RNA, 18 nt, Homo sapiens
uuuggcauuccugaauaa

SEQ ID NO: 509951 - RNA, 13 nt, Homo sapiens
uuugggaaauucu

SEQ ID NO: 509952 - RNA, 17 nt, Homo sapiens
uuuguaccuguaggucu

SEQ ID NO: 509953 - RNA, 17 nt, Homo sapiens
uuuguauuuuuccucuu

SEQ ID NO: 509954 - RNA, 12 nt, Homo sapiens
uuugucugugau

SEQ ID NO: 509955 - RNA, 19 nt, Homo sapiens
uuuguuuaaaaaccaaaua

SEQ ID NO: 509956 - RNA, 23 nt, Homo sapiens
uuuuaaaaaagauggauuugaca

SEQ ID NO: 509957 - RNA, 14 nt, Homo sapiens
uuuuaacauagcag

SEQ ID NO: 509958 - RNA, 22 nt, Homo sapiens
uuuuauuguaacagacauuguu

SEQ ID NO: 509959 - RNA, 19 nt, Homo sapiens
uuuucaauguacuguauug

SEQ ID NO: 509960 - RNA, 13 nt, Homo sapiens
uuuugauggcuau

SEQ ID NO: 509961 - RNA, 21 nt, Homo sapiens
uuuugucugcuuaguaucuca

SEQ ID NO: 509962 - RNA, 15 nt, Homo sapiens
uuuuuaagacucaau

SEQ ID NO: 509963 - RNA, 13 nt, Homo sapiens
uuuuuucugauaa

SEQ ID NO: 509964 - RNA, 14 nt, Homo sapiens
cugcaaaaugucau

SEQ ID NO: 509965 - RNA, 20 nt, Homo sapiens
cugcaaaaugucauagcuua

SEQ ID NO: 509966 - RNA, 21 nt, Homo sapiens
cugcacagugguccagggucc

SEQ ID NO: 509967 - RNA, 20 nt, Homo sapiens
cugcauuucaaguuaauucu

SEQ ID NO: 509968 - RNA, 15 nt, Homo sapiens
cugccagacaugcca

SEQ ID NO: 509969 - RNA, 15 nt, Homo sapiens
cugccaggacacugc

SEQ ID NO: 509970 - RNA, 19 nt, Homo sapiens
cugcccacaacuugccaaa

SEQ ID NO: 509971 - RNA, 23 nt, Homo sapiens
cugcccacgugcagcaccuguca

SEQ ID NO: 509972 - RNA, 13 nt, Homo sapiens
cugccccaucucc

SEQ ID NO: 509973 - RNA, 21 nt, Homo sapiens
cugccccccuucccaccccua

SEQ ID NO: 509974 - RNA, 19 nt, Homo sapiens
cugcccccucccccgcaga

SEQ ID NO: 509975 - RNA, 15 nt, Homo sapiens
cugccugacugccag

SEQ ID NO: 509976 - RNA, 14 nt, Homo sapiens
cugccuguggugag

SEQ ID NO: 509977 - RNA, 21 nt, Homo sapiens
cugcgcuccucugcagccuga

SEQ ID NO: 509978 - RNA, 15 nt, Homo sapiens
cugcgucccugcuca

SEQ ID NO: 509979 - RNA, 17 nt, Homo sapiens
cugcucacgucugugag

SEQ ID NO: 509980 - RNA, 15 nt, Homo sapiens
cugcuccuccaguac

SEQ ID NO: 509981 - RNA, 17 nt, Homo sapiens
cugcugcagucagcaca

SEQ ID NO: 509982 - RNA, 18 nt, Homo sapiens
cugcuguauuugaggaaa

SEQ ID NO: 509983 - RNA, 12 nt, Homo sapiens
cugcuguguagc

SEQ ID NO: 509984 - RNA, 13 nt, Homo sapiens
cugcuucucagcg

SEQ ID NO: 509985 - RNA, 15 nt, Homo sapiens
cugcuucucuuucac

SEQ ID NO: 509986 - RNA, 16 nt, Homo sapiens
cuggaaaagcacuuua

SEQ ID NO: 509987 - RNA, 21 nt, Homo sapiens
cuggagaaagggaaguggaag

SEQ ID NO: 509988 - RNA, 23 nt, Homo sapiens
augcaugagaacuaaauagauuu

SEQ ID NO: 509989 - RNA, 15 nt, Homo sapiens
augcauuuagcauga

SEQ ID NO: 509990 - RNA, 18 nt, Homo sapiens
augccauguauguugcau

SEQ ID NO: 509991 - RNA, 16 nt, Homo sapiens
augccuugaaaccaga

SEQ ID NO: 509992 - RNA, 12 nt, Homo sapiens
augccuuuccag

SEQ ID NO: 509993 - RNA, 22 nt, Homo sapiens
augcuagacagaaaccaagcca

SEQ ID NO: 509994 - RNA, 20 nt, Homo sapiens
augcugauuuaaacuucuua

SEQ ID NO: 509995 - RNA, 23 nt, Homo sapiens
augcugggccgggguguggaauc

SEQ ID NO: 509996 - RNA, 13 nt, Homo sapiens
augcuuaacauaa

SEQ ID NO: 509997 - RNA, 15 nt, Homo sapiens
augcuugauggaauu

SEQ ID NO: 509998 - RNA, 20 nt, Homo sapiens
auggaagacaaauacacaua

SEQ ID NO: 509999 - RNA, 18 nt, Homo sapiens
auggaagggccuucucca

SEQ ID NO: 510000 - RNA, 14 nt, Homo sapiens
auggauccuuguca

SEQ ID NO: 510001 - RNA, 18 nt, Homo sapiens
auggcacaugauaugagu

SEQ ID NO: 510002 - RNA, 18 nt, Homo sapiens
auggccaggccucaggga

SEQ ID NO: 510003 - RNA, 15 nt, Homo sapiens
aaugcuuucucaugc

SEQ ID NO: 510004 - RNA, 16 nt, Homo sapiens
aaugcuuucucaugca

SEQ ID NO: 510005 - RNA, 21 nt, Homo sapiens
aauggccaaguguacauuuga

SEQ ID NO: 510006 - RNA, 19 nt, Homo sapiens
aaugggaaauguuuggcca

SEQ ID NO: 510007 - RNA, 14 nt, Homo sapiens
aauggggcuuccau

SEQ ID NO: 510008 - RNA, 22 nt, Homo sapiens
aauggggggcgggccagggugg

SEQ ID NO: 510009 - RNA, 23 nt, Homo sapiens
aauguaacacacacacacauaca

SEQ ID NO: 510010 - RNA, 17 nt, Homo sapiens
acauuucccugcugagu

SEQ ID NO: 510011 - RNA, 22 nt, Homo sapiens
acauuucucugcaaaaugucau

SEQ ID NO: 510012 - RNA, 13 nt, Homo sapiens
acauuuucuaccc

SEQ ID NO: 510013 - RNA, 21 nt, Homo sapiens
accacacacacccuuccccac

SEQ ID NO: 510014 - RNA, 21 nt, Homo sapiens
accacuuucccacacugugaa

SEQ ID NO: 510015 - RNA, 22 nt, Homo sapiens
accagaaugaggcacaugacag

SEQ ID NO: 510016 - RNA, 18 nt, Homo sapiens
accagagcacuguauacc

SEQ ID NO: 510017 - RNA, 15 nt, Homo sapiens
accagcaacauuaua

SEQ ID NO: 510018 - RNA, 16 nt, Homo sapiens
accaggcuuccaagaa

SEQ ID NO: 510019 - RNA, 21 nt, Homo sapiens
accauaagcuuuuucucugaa

SEQ ID NO: 510020 - RNA, 17 nt, Homo sapiens
acccaagagaguggaag

SEQ ID NO: 510021 - RNA, 20 nt, Homo sapiens
acccaaguuggagugcagug

SEQ ID NO: 510022 - RNA, 22 nt, Homo sapiens
acccaaguuuauuauaucauua

SEQ ID NO: 510023 - RNA, 21 nt, Homo sapiens
acccacaaguauugcccuuua

SEQ ID NO: 510024 - RNA, 23 nt, Homo sapiens
acccauaggucuuaagaugcaaa

SEQ ID NO: 510025 - RNA, 20 nt, Homo sapiens
accccaggacgcaugcaggg

SEQ ID NO: 510026 - RNA, 12 nt, Homo sapiens
accccaucucau

SEQ ID NO: 510027 - RNA, 15 nt, Homo sapiens
acccccagcagcuca

SEQ ID NO: 510028 - RNA, 20 nt, Homo sapiens
acccuauuuguuucauuaaa

SEQ ID NO: 510029 - RNA, 14 nt, Homo sapiens
acccucaauucaua

SEQ ID NO: 510030 - RNA, 19 nt, Homo sapiens
acccucugcuaugucugug

SEQ ID NO: 510031 - RNA, 22 nt, Homo sapiens
acccucugcuaugucugugaug

SEQ ID NO: 510032 - RNA, 15 nt, Homo sapiens
acccuggaccgagug

SEQ ID NO: 510033 - RNA, 15 nt, Homo sapiens
accuaccacauucac

SEQ ID NO: 510034 - RNA, 13 nt, Homo sapiens
accuauugcugua

SEQ ID NO: 510035 - RNA, 21 nt, Homo sapiens
accuccuccuccaguucugau

SEQ ID NO: 510036 - RNA, 22 nt, Homo sapiens
accuccuccuccaguucugaug

SEQ ID NO: 510037 - RNA, 20 nt, Homo sapiens
accucucagccccucagaga

SEQ ID NO: 510038 - RNA, 18 nt, Homo sapiens
accucuugaagaacugac

SEQ ID NO: 510039 - RNA, 23 nt, Homo sapiens
accucuuuggauguuuuccccaa

SEQ ID NO: 510040 - RNA, 20 nt, Homo sapiens
accucuuuucauggaguaga

SEQ ID NO: 510041 - RNA, 22 nt, Homo sapiens
accugacuuuggagacgaugcu

SEQ ID NO: 510042 - RNA, 13 nt, Homo sapiens
accuguacacaca

SEQ ID NO: 510043 - RNA, 17 nt, Homo sapiens
accuguacacacacaga

SEQ ID NO: 510044 - RNA, 22 nt, Homo sapiens
accuguacacacacagacacac

SEQ ID NO: 510045 - RNA, 23 nt, Homo sapiens
accuguucacgugacuccucaau

SEQ ID NO: 510046 - RNA, 17 nt, Homo sapiens
accuucaagcacccugu

SEQ ID NO: 510047 - RNA, 13 nt, Homo sapiens
accuucuaaucca

SEQ ID NO: 510048 - RNA, 23 nt, Homo sapiens
accuucuaauccaugugcugcug

SEQ ID NO: 510049 - RNA, 13 nt, Homo sapiens
accuucugaugaa

SEQ ID NO: 510050 - RNA, 20 nt, Homo sapiens
accuucugaugaaguuguac

SEQ ID NO: 510051 - RNA, 12 nt, Homo sapiens
accuugcugcua

SEQ ID NO: 510052 - RNA, 19 nt, Homo sapiens
acgaggagcuuccagugca

SEQ ID NO: 510053 - RNA, 17 nt, Homo sapiens
acgauaugcaaguucau

SEQ ID NO: 510054 - RNA, 14 nt, Homo sapiens
acgcuugcuaucau

SEQ ID NO: 510055 - RNA, 16 nt, Homo sapiens
acgguccaauccagcc

SEQ ID NO: 510056 - RNA, 12 nt, Homo sapiens
acgucugugagu

SEQ ID NO: 510057 - RNA, 14 nt, Homo sapiens
acgugacuccucaa

SEQ ID NO: 510058 - RNA, 12 nt, Homo sapiens
acgugugaggau

SEQ ID NO: 510059 - RNA, 12 nt, Homo sapiens
acuaacacuggc

SEQ ID NO: 510060 - RNA, 13 nt, Homo sapiens
acuaacacuggcu

SEQ ID NO: 510061 - RNA, 21 nt, Homo sapiens
acuacaaacauggggagccau

SEQ ID NO: 510062 - RNA, 23 nt, Homo sapiens
acuaccccaggaugcaugcaggg

SEQ ID NO: 510063 - RNA, 14 nt, Homo sapiens
acuacgacuggcau

SEQ ID NO: 510064 - RNA, 19 nt, Homo sapiens
acuauaauugagaacuaca

SEQ ID NO: 510065 - RNA, 23 nt, Homo sapiens
acuaucagggcaagcucauagca

SEQ ID NO: 510066 - RNA, 22 nt, Homo sapiens
acucaguaaaucagugcaguac

SEQ ID NO: 510067 - RNA, 20 nt, Homo sapiens
acucaguaaggcagugcagu

SEQ ID NO: 510068 - RNA, 22 nt, Homo sapiens
acucaguaaggcagugcaguac

SEQ ID NO: 510069 - RNA, 22 nt, Homo sapiens
acucaguuaggcagugcaguac

SEQ ID NO: 510070 - RNA, 22 nt, Homo sapiens
acucauacagucucuauuugau

SEQ ID NO: 510071 - RNA, 19 nt, Homo sapiens
acuccacuccccucaucca

SEQ ID NO: 510072 - RNA, 13 nt, Homo sapiens
acucccugcuuag

SEQ ID NO: 510073 - RNA, 14 nt, Homo sapiens
acuccuuacagaag

SEQ ID NO: 510074 - RNA, 22 nt, Homo sapiens
acuccuuacagaagggagugaa

SEQ ID NO: 510075 - RNA, 18 nt, Homo sapiens
acucucuucuuacuguau

SEQ ID NO: 510076 - RNA, 14 nt, Homo sapiens
acucugaauaccaa

SEQ ID NO: 510077 - RNA, 18 nt, Homo sapiens
acucugacuguaaaauac

SEQ ID NO: 510078 - RNA, 20 nt, Homo sapiens
acucuuuccccagcugauua

SEQ ID NO: 510079 - RNA, 15 nt, Homo sapiens
acugaagaaaauccu

SEQ ID NO: 510080 - RNA, 14 nt, Homo sapiens
acugacauggugcu

SEQ ID NO: 510081 - RNA, 22 nt, Homo sapiens
acugagugaaauauuacucugc

SEQ ID NO: 510082 - RNA, 20 nt, Homo sapiens
acugagugagcaucauggag

SEQ ID NO: 510083 - RNA, 15 nt, Homo sapiens
acugcaacacuggau

SEQ ID NO: 510084 - RNA, 17 nt, Homo sapiens
acugcaguuauuuacca

SEQ ID NO: 510085 - RNA, 21 nt, Homo sapiens
acuggagcguguacuacccca

SEQ ID NO: 510086 - RNA, 17 nt, Homo sapiens
acugguaaaaagaucca

SEQ ID NO: 510087 - RNA, 15 nt, Homo sapiens
acugguuuuuuccag

SEQ ID NO: 510088 - RNA, 20 nt, Homo sapiens
acuguauuaaauguaacuua

SEQ ID NO: 510089 - RNA, 17 nt, Homo sapiens
acuguauuuacuuguua

SEQ ID NO: 510090 - RNA, 22 nt, Homo sapiens
acuguauuucggcuaugucuca

SEQ ID NO: 510091 - RNA, 21 nt, Homo sapiens
acugucaugugcgaacacagu

SEQ ID NO: 510092 - RNA, 16 nt, Homo sapiens
acuguuuuguuuguua

SEQ ID NO: 510093 - RNA, 20 nt, Homo sapiens
acuucagauguuuccaagau

SEQ ID NO: 510094 - RNA, 16 nt, Homo sapiens
acuucaguucucaucu

SEQ ID NO: 510095 - RNA, 20 nt, Homo sapiens
acuucaguucucaucuugua

SEQ ID NO: 510096 - RNA, 21 nt, Homo sapiens
acuucuuaacuggcaacaguu

SEQ ID NO: 510097 - RNA, 20 nt, Homo sapiens
acuucuuuacuaacacuggc

SEQ ID NO: 510098 - RNA, 22 nt, Homo sapiens
acuugcaugcagcagcuuuuga

SEQ ID NO: 510099 - RNA, 19 nt, Homo sapiens
acuuucccacacugugaac

SEQ ID NO: 510100 - RNA, 21 nt, Homo sapiens
acuuugaauuuuuuuuauguc

SEQ ID NO: 510101 - RNA, 20 nt, Homo sapiens
acuuuuuauucucaguuuaa

SEQ ID NO: 510102 - RNA, 12 nt, Homo sapiens
agaaaaacauuu

SEQ ID NO: 510103 - RNA, 12 nt, Homo sapiens
agaaaacauugu

SEQ ID NO: 510104 - RNA, 17 nt, Homo sapiens
agaaaauaaauacauaa

SEQ ID NO: 510105 - RNA, 15 nt, Homo sapiens
agaaacagagaucau

SEQ ID NO: 510106 - RNA, 18 nt, Homo sapiens
agaaacucgggcacuccc

SEQ ID NO: 510107 - RNA, 18 nt, Homo sapiens
agaaagccaggguccuga

SEQ ID NO: 510108 - RNA, 15 nt, Homo sapiens
agaaagccucuccag

SEQ ID NO: 510109 - RNA, 14 nt, Homo sapiens
agaaauaugagcau

SEQ ID NO: 510110 - RNA, 24 nt, Homo sapiens
agaaauaugagcaugcucccucau

SEQ ID NO: 510111 - RNA, 21 nt, Homo sapiens
agaaauccacgcucaaucuca

SEQ ID NO: 510112 - RNA, 15 nt, Homo sapiens
agaaauggcuuucca

SEQ ID NO: 510113 - RNA, 18 nt, Homo sapiens
agaaauuuacuauguaaa

SEQ ID NO: 510114 - RNA, 21 nt, Homo sapiens
agaaauuuuaucucuucuucc

SEQ ID NO: 510115 - RNA, 19 nt, Homo sapiens
agaacagggaugcuaucuc

SEQ ID NO: 510116 - RNA, 13 nt, Homo sapiens
agaacgcaugcag

SEQ ID NO: 510117 - RNA, 16 nt, Homo sapiens
agaacucaugugauuu

SEQ ID NO: 510118 - RNA, 17 nt, Homo sapiens
agaacugccccaucucc

SEQ ID NO: 510119 - RNA, 15 nt, Homo sapiens
agaagaaauagcaga

SEQ ID NO: 510120 - RNA, 12 nt, Homo sapiens
agaagagccuga

SEQ ID NO: 510121 - RNA, 20 nt, Homo sapiens
agaagagccugacuguguuc

SEQ ID NO: 510122 - RNA, 16 nt, Homo sapiens
agaagcaguugcaaua

SEQ ID NO: 510123 - RNA, 20 nt, Homo sapiens
agaagccugucuguacuuca

SEQ ID NO: 510124 - RNA, 12 nt, Homo sapiens
agaaucaagucu

SEQ ID NO: 510125 - RNA, 14 nt, Homo sapiens
agaaucaagucugu

SEQ ID NO: 510126 - RNA, 21 nt, Homo sapiens
agaauggggcuuccauggugg

SEQ ID NO: 510127 - RNA, 15 nt, Homo sapiens
agacaagucugagua

SEQ ID NO: 510128 - RNA, 14 nt, Homo sapiens
agacaccuagacuc

SEQ ID NO: 510129 - RNA, 15 nt, Homo sapiens
agacaggguggggcu

SEQ ID NO: 510130 - RNA, 12 nt, Homo sapiens
agacagugcagu

SEQ ID NO: 510131 - RNA, 16 nt, Homo sapiens
agacaucuagucucag

SEQ ID NO: 510132 - RNA, 17 nt, Homo sapiens
agacccugaguccuugg

SEQ ID NO: 510133 - RNA, 17 nt, Homo sapiens
agacucgagagggcuga

SEQ ID NO: 510134 - RNA, 16 nt, Homo sapiens
agacuguuagacaaaa

SEQ ID NO: 510135 - RNA, 20 nt, Homo sapiens
agagaaaaagcccucuucaa

SEQ ID NO: 510136 - RNA, 17 nt, Homo sapiens
cuggagcugaagcguua

SEQ ID NO: 510137 - RNA, 15 nt, Homo sapiens
cuggcauuugcugca

SEQ ID NO: 510138 - RNA, 14 nt, Homo sapiens
cuggccauugcacu

SEQ ID NO: 510139 - RNA, 13 nt, Homo sapiens
cuggccccaggcg

SEQ ID NO: 510140 - RNA, 15 nt, Homo sapiens
cuggccgcugcaguc

SEQ ID NO: 510141 - RNA, 22 nt, Homo sapiens
cuggccuauuuuggacguguga

SEQ ID NO: 510142 - RNA, 22 nt, Homo sapiens
cuggcugcccuucuucuugacc

SEQ ID NO: 510143 - RNA, 15 nt, Homo sapiens
cuggcugcugcaguc

SEQ ID NO: 510144 - RNA, 12 nt, Homo sapiens
cuggcugggcuu

SEQ ID NO: 510145 - RNA, 20 nt, Homo sapiens
cugggccgggguguggaauc

SEQ ID NO: 510146 - RNA, 14 nt, Homo sapiens
cuggggucugugau

SEQ ID NO: 510147 - RNA, 21 nt, Homo sapiens
cugguaaaaagauccagggau

SEQ ID NO: 510148 - RNA, 17 nt, Homo sapiens
cuggucgcuuugccauc

SEQ ID NO: 510149 - RNA, 23 nt, Homo sapiens
cuggugaugggguuuguuuucau

SEQ ID NO: 510150 - RNA, 15 nt, Homo sapiens
cugguggaaccugca

SEQ ID NO: 510151 - RNA, 21 nt, Homo sapiens
cuggugucuaauaaacacaga

SEQ ID NO: 510152 - RNA, 15 nt, Homo sapiens
cuguaaaauacaugg

SEQ ID NO: 510153 - RNA, 18 nt, Homo sapiens
cuguacgaggcuucucua

SEQ ID NO: 510154 - RNA, 16 nt, Homo sapiens
cuguagaaucuagcca

SEQ ID NO: 510155 - RNA, 15 nt, Homo sapiens
cuguauacaaacagg

SEQ ID NO: 510156 - RNA, 15 nt, Homo sapiens
cuguauaucagcucu

SEQ ID NO: 510157 - RNA, 23 nt, Homo sapiens
cugucaugugcgaacacagugac

SEQ ID NO: 510158 - RNA, 17 nt, Homo sapiens
cugucuuagaucaggag

SEQ ID NO: 510159 - RNA, 17 nt, Homo sapiens
cugucuugcugagggag

SEQ ID NO: 510160 - RNA, 15 nt, Homo sapiens
cugugaaaugacugc

SEQ ID NO: 510161 - RNA, 23 nt, Homo sapiens
cugugaugucaguagugccugug

SEQ ID NO: 510162 - RNA, 21 nt, Homo sapiens
cugugcaguagagagccuuuc

SEQ ID NO: 510163 - RNA, 21 nt, Homo sapiens
cugugcaugacugauguuggg

SEQ ID NO: 510164 - RNA, 20 nt, Homo sapiens
cugugcccacgugugcagac

SEQ ID NO: 510165 - RNA, 18 nt, Homo sapiens
cuguggugagguccuguc

SEQ ID NO: 510166 - RNA, 16 nt, Homo sapiens
cuuaaacccacauaaa

SEQ ID NO: 510167 - RNA, 22 nt, Homo sapiens
cuuaaaucugccuaguuuugau

SEQ ID NO: 510168 - RNA, 16 nt, Homo sapiens
cuuaaaugaucaagga

SEQ ID NO: 510169 - RNA, 15 nt, Homo sapiens
cuuaacagcuguauu

SEQ ID NO: 510170 - RNA, 21 nt, Homo sapiens
cuuaaggggacccacaaguau

SEQ ID NO: 510171 - RNA, 22 nt, Homo sapiens
cuuaaguacugaaauacauaug

SEQ ID NO: 510172 - RNA, 21 nt, Homo sapiens
cuuaauaaaaugcuaaauguc

SEQ ID NO: 510173 - RNA, 20 nt, Homo sapiens
cuuaaucuagagcuaugcac

SEQ ID NO: 510174 - RNA, 19 nt, Homo sapiens
cuuaaugucuuuuguuauu

SEQ ID NO: 510175 - RNA, 11 nt, Homo sapiens
cuuaauuaccu

SEQ ID NO: 510176 - RNA, 23 nt, Homo sapiens
cuuaauuaugguaccucugucua

SEQ ID NO: 510177 - RNA, 15 nt, Homo sapiens
cuuagaauacuguau

SEQ ID NO: 510178 - RNA, 16 nt, Homo sapiens
cuuagaucaggagaaa

SEQ ID NO: 510179 - RNA, 20 nt, Homo sapiens
cuuagcguucuguuucacca

SEQ ID NO: 510180 - RNA, 20 nt, Homo sapiens
cuuaucuaccaguuuauucc

SEQ ID NO: 510181 - RNA, 22 nt, Homo sapiens
cuuauuaaaauauuuucuuaau

SEQ ID NO: 510182 - RNA, 20 nt, Homo sapiens
cuuauuauguaagggucauu

SEQ ID NO: 510183 - RNA, 16 nt, Homo sapiens
cuucaaaacaauauaa

SEQ ID NO: 510184 - RNA, 18 nt, Homo sapiens
cuucaaaguuuucugcug

SEQ ID NO: 510185 - RNA, 20 nt, Homo sapiens
cuucaacaugguuaccucug

SEQ ID NO: 510186 - RNA, 17 nt, Homo sapiens
cuucaagcacccuguuc

SEQ ID NO: 510187 - RNA, 22 nt, Homo sapiens
cuucaugcgcaguccccaggua

SEQ ID NO: 510188 - RNA, 14 nt, Homo sapiens
cuucauuaaaacaa

SEQ ID NO: 510189 - RNA, 17 nt, Homo sapiens
cuucauuuaacacugag

SEQ ID NO: 510190 - RNA, 16 nt, Homo sapiens
cuuccagugcauguug

SEQ ID NO: 510191 - RNA, 12 nt, Homo sapiens
cuuccauggugg

SEQ ID NO: 510192 - RNA, 17 nt, Homo sapiens
cuucccaacucacuuug

SEQ ID NO: 510193 - RNA, 21 nt, Homo sapiens
cuuccccauugccuucugggg

SEQ ID NO: 510194 - RNA, 15 nt, Homo sapiens
cuucccccagggucc

SEQ ID NO: 510195 - RNA, 14 nt, Homo sapiens
cuucccuaguucuu

SEQ ID NO: 510196 - RNA, 14 nt, Homo sapiens
cuuccucuuaccug

SEQ ID NO: 510197 - RNA, 19 nt, Homo sapiens
cuuccugaacucccaguca

SEQ ID NO: 510198 - RNA, 20 nt, Homo sapiens
cuuccugaacucccagucau

SEQ ID NO: 510199 - RNA, 18 nt, Homo sapiens
cuuccuuuuguauccucc

SEQ ID NO: 510200 - RNA, 18 nt, Homo sapiens
cuucuaguggguuuaaug

SEQ ID NO: 510201 - RNA, 21 nt, Homo sapiens
cuucucaagaccgaguguaca

SEQ ID NO: 510202 - RNA, 17 nt, Homo sapiens
cuucuccacaaccuccu

SEQ ID NO: 510203 - RNA, 12 nt, Homo sapiens
cuucuguuguca

SEQ ID NO: 510204 - RNA, 20 nt, Homo sapiens
cuucuuaaggacaguguuca

SEQ ID NO: 510205 - RNA, 13 nt, Homo sapiens
cuucuucuugacc

SEQ ID NO: 510206 - RNA, 20 nt, Homo sapiens
cuugaaugcuuaaaugauca

SEQ ID NO: 510207 - RNA, 19 nt, Homo sapiens
cuugacuauuacacugccu

SEQ ID NO: 510208 - RNA, 16 nt, Homo sapiens
cuugagcaaggcaaga

SEQ ID NO: 510209 - RNA, 16 nt, Homo sapiens
cuugaggccaaaugag

SEQ ID NO: 510210 - RNA, 14 nt, Homo sapiens
cuugagucugaggc

SEQ ID NO: 510211 - RNA, 16 nt, Homo sapiens
cuugcacuguauccaa

SEQ ID NO: 510212 - RNA, 17 nt, Homo sapiens
cuugcaguuauguuauc

SEQ ID NO: 510213 - RNA, 18 nt, Homo sapiens
cuugccugaauccaucag

SEQ ID NO: 510214 - RNA, 12 nt, Homo sapiens
cuugcugugaaa

SEQ ID NO: 510215 - RNA, 21 nt, Homo sapiens
cuuggauaggagcuuccagau

SEQ ID NO: 510216 - RNA, 16 nt, Homo sapiens
cuuggcucagacaccu

SEQ ID NO: 510217 - RNA, 22 nt, Homo sapiens
cuugucucaaaaaccauuacaa

SEQ ID NO: 510218 - RNA, 23 nt, Homo sapiens
cuuguuuguguuugaauugauuu

SEQ ID NO: 510219 - RNA, 17 nt, Homo sapiens
cuuuaacaagacuucaa

SEQ ID NO: 510220 - RNA, 20 nt, Homo sapiens
cuuucacaaggcauccauac

SEQ ID NO: 510221 - RNA, 12 nt, Homo sapiens
cuuucauccagc

SEQ ID NO: 510222 - RNA, 13 nt, Homo sapiens
cuuuccccauuca

SEQ ID NO: 510223 - RNA, 20 nt, Homo sapiens
cuuuccucuuaaugucucaa

SEQ ID NO: 510224 - RNA, 14 nt, Homo sapiens
cuuuccugggucug

SEQ ID NO: 510225 - RNA, 14 nt, Homo sapiens
cuuucucaaugaau

SEQ ID NO: 510226 - RNA, 21 nt, Homo sapiens
cuuucugauacaucugucagu

SEQ ID NO: 510227 - RNA, 15 nt, Homo sapiens
gagagcggcuucccc

SEQ ID NO: 510228 - RNA, 16 nt, Homo sapiens
gagaguauacaguccu

SEQ ID NO: 510229 - RNA, 12 nt, Homo sapiens
gagaugcugauu

SEQ ID NO: 510230 - RNA, 22 nt, Homo sapiens
gagauugcucuggggcuugcua

SEQ ID NO: 510231 - RNA, 16 nt, Homo sapiens
gagcaugaagauaaau

SEQ ID NO: 510232 - RNA, 21 nt, Homo sapiens
gagcaugggacugugccuuug

SEQ ID NO: 510233 - RNA, 17 nt, Homo sapiens
gagccugacuguguuca

SEQ ID NO: 510234 - RNA, 16 nt, Homo sapiens
gagcuuccagugcaug

SEQ ID NO: 510235 - RNA, 17 nt, Homo sapiens
gaggaaaauaguggcag

SEQ ID NO: 510236 - RNA, 15 nt, Homo sapiens
gaggacagcuucccc

SEQ ID NO: 510237 - RNA, 15 nt, Homo sapiens
gaggcagaauggugg

SEQ ID NO: 510238 - RNA, 20 nt, Homo sapiens
gaggccuuuccccagugugg

SEQ ID NO: 510239 - RNA, 22 nt, Homo sapiens
gagguauuugguaacuugcugu

SEQ ID NO: 510240 - RNA, 23 nt, Homo sapiens
gaguauggauugaaggauuguga

SEQ ID NO: 510241 - RNA, 15 nt, Homo sapiens
gagucagccccacuc

SEQ ID NO: 510242 - RNA, 22 nt, Homo sapiens
gagucuggauaauuuguauaag

SEQ ID NO: 510243 - RNA, 18 nt, Homo sapiens
gauaaauucuuucuuuga

SEQ ID NO: 510244 - RNA, 13 nt, Homo sapiens
gauauaagccaua

SEQ ID NO: 510245 - RNA, 16 nt, Homo sapiens
gauaucaggaaauauc

SEQ ID NO: 510246 - RNA, 23 nt, Homo sapiens
gauaucaggaaauaucugugaag

SEQ ID NO: 510247 - RNA, 14 nt, Homo sapiens
gaucaagcuccauc

SEQ ID NO: 510248 - RNA, 18 nt, Homo sapiens
gaucauugguaucugaua

SEQ ID NO: 510249 - RNA, 21 nt, Homo sapiens
gauccagcggggcuucugggc

SEQ ID NO: 510250 - RNA, 21 nt, Homo sapiens
gaucccuaaagaaaacaaaca

SEQ ID NO: 510251 - RNA, 17 nt, Homo sapiens
gaucccugagagucucu

SEQ ID NO: 510252 - RNA, 16 nt, Homo sapiens
gaucuguuguaauauc

SEQ ID NO: 510253 - RNA, 16 nt, Homo sapiens
gcugccaucuccaggc

SEQ ID NO: 510254 - RNA, 22 nt, Homo sapiens
gcugccucaggaaucuccugac

SEQ ID NO: 510255 - RNA, 19 nt, Homo sapiens
gcugccucccuggggacca

SEQ ID NO: 510256 - RNA, 12 nt, Homo sapiens
gcugcuguguag

SEQ ID NO: 510257 - RNA, 9 nt, Homo sapiens
gcuggccaa

SEQ ID NO: 510258 - RNA, 17 nt, Homo sapiens
gcugggucccgggugcc

SEQ ID NO: 510259 - RNA, 21 nt, Homo sapiens
gcuggguuugggcaguggaga

SEQ ID NO: 510260 - RNA, 20 nt, Homo sapiens
gcugucgccgcuagucuuau

SEQ ID NO: 510261 - RNA, 13 nt, Homo sapiens
gcuuaaacauuuu

SEQ ID NO: 510262 - RNA, 14 nt, Homo sapiens
gcuuacagugacug

SEQ ID NO: 510263 - RNA, 15 nt, Homo sapiens
gcuuagaauggggcu

SEQ ID NO: 510264 - RNA, 20 nt, Homo sapiens
gcuuauauaaauguacagua

SEQ ID NO: 510265 - RNA, 16 nt, Homo sapiens
gcuucaaaacaauaua

SEQ ID NO: 510266 - RNA, 12 nt, Homo sapiens
gcuucagaauug

SEQ ID NO: 510267 - RNA, 20 nt, Homo sapiens
gcuucccaugucuuucucca

SEQ ID NO: 510268 - RNA, 20 nt, Homo sapiens
gcuucucuaaaacagcacua

SEQ ID NO: 510269 - RNA, 15 nt, Homo sapiens
gcuugagccugucac

SEQ ID NO: 510270 - RNA, 16 nt, Homo sapiens
gcuugguguaaaccau

SEQ ID NO: 510271 - RNA, 14 nt, Homo sapiens
gcuuuaaaaccaca

SEQ ID NO: 510272 - RNA, 17 nt, Homo sapiens
gcuuuacaacuugaaug

SEQ ID NO: 510273 - RNA, 15 nt, Homo sapiens
gcuuuacagugccac

SEQ ID NO: 510274 - RNA, 19 nt, Homo sapiens
gcuuucagugccugcuguu

SEQ ID NO: 510275 - RNA, 16 nt, Homo sapiens
gcuuuccacaucccca

SEQ ID NO: 510276 - RNA, 17 nt, Homo sapiens
gcuuuggcgccccaugg

SEQ ID NO: 510277 - RNA, 17 nt, Homo sapiens
gcuuuucucaugguauu

SEQ ID NO: 510278 - RNA, 21 nt, Homo sapiens
ggaaacagagaacccuguggg

SEQ ID NO: 510279 - RNA, 15 nt, Homo sapiens
ggaaagcagugcagu

SEQ ID NO: 510280 - RNA, 19 nt, Homo sapiens
ggaaagcagugcaguacuc

SEQ ID NO: 510281 - RNA, 15 nt, Homo sapiens
ggaaauaucugugaa

SEQ ID NO: 510282 - RNA, 14 nt, Homo sapiens
ggaaccacagugga

SEQ ID NO: 510283 - RNA, 20 nt, Homo sapiens
ggaagagcugcuguauuuga

SEQ ID NO: 510284 - RNA, 17 nt, Homo sapiens
ggaagaggagaugacag

SEQ ID NO: 510285 - RNA, 18 nt, Homo sapiens
ggaagccagugggguccc

SEQ ID NO: 510286 - RNA, 16 nt, Homo sapiens
ggaaggcugcugugua

SEQ ID NO: 510287 - RNA, 15 nt, Homo sapiens
ggaaugccagggaca

SEQ ID NO: 510288 - RNA, 12 nt, Homo sapiens
ggacgcaugcag

SEQ ID NO: 510289 - RNA, 20 nt, Homo sapiens
ggagaagaaggcaacccaaa

SEQ ID NO: 510290 - RNA, 23 nt, Homo sapiens
ggagagagcaaucuugcugugaa

SEQ ID NO: 510291 - RNA, 23 nt, Homo sapiens
ggagccauaagggacaugucuuu

SEQ ID NO: 510292 - RNA, 17 nt, Homo sapiens
ggaggacagagugcccu

SEQ ID NO: 510293 - RNA, 13 nt, Homo sapiens
ggagugugccuug

SEQ ID NO: 510294 - RNA, 17 nt, Homo sapiens
ggauaggagcuuccaga

SEQ ID NO: 510295 - RNA, 15 nt, Homo sapiens
ggaucaggaacccuu

SEQ ID NO: 510296 - RNA, 20 nt, Homo sapiens
ggauccagcuucacugucau

SEQ ID NO: 510297 - RNA, 14 nt, Homo sapiens
ggcaagauagcucc

SEQ ID NO: 510298 - RNA, 17 nt, Homo sapiens
ggcagggugagaagcua

SEQ ID NO: 510299 - RNA, 14 nt, Homo sapiens
ggcaugcaccagug

SEQ ID NO: 510300 - RNA, 13 nt, Homo sapiens
ggcccccacagga

SEQ ID NO: 510301 - RNA, 14 nt, Homo sapiens
ggcccgccaccuug

SEQ ID NO: 510302 - RNA, 19 nt, Homo sapiens
ggcccucuguccacaugug

SEQ ID NO: 510303 - RNA, 13 nt, Homo sapiens
ggccucagggacc

SEQ ID NO: 510304 - RNA, 18 nt, Homo sapiens
ggccuucuccacagggac

SEQ ID NO: 510305 - RNA, 23 nt, Homo sapiens
ggcuacgugaauagcgcccucaa

SEQ ID NO: 510306 - RNA, 21 nt, Homo sapiens
ggcucaggguuggccauuugc

SEQ ID NO: 510307 - RNA, 22 nt, Homo sapiens
ggcucccacugccccugcaccu

SEQ ID NO: 510308 - RNA, 11 nt, Homo sapiens
ggcucucucac

SEQ ID NO: 510309 - RNA, 13 nt, Homo sapiens
ggcugauuuacua

SEQ ID NO: 510310 - RNA, 13 nt, Homo sapiens
ggcugcuggcgcc

SEQ ID NO: 510311 - RNA, 14 nt, Homo sapiens
ggcuucugggacag

SEQ ID NO: 510312 - RNA, 17 nt, Homo sapiens
ggcuuuaagcgaggcag

SEQ ID NO: 510313 - RNA, 11 nt, Homo sapiens
gggaaccagag

SEQ ID NO: 510314 - RNA, 17 nt, Homo sapiens
gggaaggcugcugugua

SEQ ID NO: 510315 - RNA, 13 nt, Homo sapiens
gggagacugagcu

SEQ ID NO: 510316 - RNA, 14 nt, Homo sapiens
gggaggucccugcc

SEQ ID NO: 510317 - RNA, 16 nt, Homo sapiens
gggccagcucuuggcu

SEQ ID NO: 510318 - RNA, 19 nt, Homo sapiens
gggccauuucacauuccug

SEQ ID NO: 510319 - RNA, 19 nt, Homo sapiens
gggccgccuccuccagacu

SEQ ID NO: 510320 - RNA, 20 nt, Homo sapiens
gggcucacuacaugggccag

SEQ ID NO: 510321 - RNA, 12 nt, Homo sapiens
ggggaugugcac

SEQ ID NO: 510322 - RNA, 14 nt, Homo sapiens
ggguuccagacagg

SEQ ID NO: 510323 - RNA, 14 nt, Homo sapiens
gguagacugugaca

SEQ ID NO: 510324 - RNA, 12 nt, Homo sapiens
gguaguggguga

SEQ ID NO: 510325 - RNA, 17 nt, Homo sapiens
gguauugucuuuugaca

SEQ ID NO: 510326 - RNA, 12 nt, Homo sapiens
gguccugcacug

SEQ ID NO: 510327 - RNA, 21 nt, Homo sapiens
gguccugggggcugcugcacu

SEQ ID NO: 510328 - RNA, 17 nt, Homo sapiens
ggucucgcagccugaag

SEQ ID NO: 510329 - RNA, 13 nt, Homo sapiens
ggucuugccugaa

SEQ ID NO: 510330 - RNA, 18 nt, Homo sapiens
ggugacuuuccuaugaca

SEQ ID NO: 510331 - RNA, 13 nt, Homo sapiens
ggugcaugccuuc

SEQ ID NO: 510332 - RNA, 19 nt, Homo sapiens
ggugucuggaaaagcacuu

SEQ ID NO: 510333 - RNA, 17 nt, Homo sapiens
gguuaaagaaaggcaga

SEQ ID NO: 510334 - RNA, 11 nt, Homo sapiens
gguuaccucug

SEQ ID NO: 510335 - RNA, 13 nt, Homo sapiens
gguuuagaaucaa

SEQ ID NO: 510336 - RNA, 15 nt, Homo sapiens
guaaaacugugacau

SEQ ID NO: 510337 - RNA, 19 nt, Homo sapiens
guaaaacuuguauuggaag

SEQ ID NO: 510338 - RNA, 19 nt, Homo sapiens
guaaaucagugcaguacuc

SEQ ID NO: 510339 - RNA, 20 nt, Homo sapiens
guaacacacacacacauaca

SEQ ID NO: 510340 - RNA, 15 nt, Homo sapiens
guaacacagugcagu

SEQ ID NO: 510341 - RNA, 20 nt, Homo sapiens
guaacacaguguagugcuca

SEQ ID NO: 510342 - RNA, 18 nt, Homo sapiens
guaacagugcaguacuca

SEQ ID NO: 510343 - RNA, 11 nt, Homo sapiens
guaacuguccu

SEQ ID NO: 510344 - RNA, 22 nt, Homo sapiens
guaagaauuuuaauauugccau

SEQ ID NO: 510345 - RNA, 22 nt, Homo sapiens
aggugggcugccugcuguguua

SEQ ID NO: 510346 - RNA, 14 nt, Homo sapiens
agguuagaaaggca

SEQ ID NO: 510347 - RNA, 20 nt, Homo sapiens
agguugugcugccuguggug

SEQ ID NO: 510348 - RNA, 14 nt, Homo sapiens
agguuuuaugagac

SEQ ID NO: 510349 - RNA, 16 nt, Homo sapiens
aguaaaucagugcagu

SEQ ID NO: 510350 - RNA, 23 nt, Homo sapiens
aguaacagugaaguacucaguaa

SEQ ID NO: 510351 - RNA, 23 nt, Homo sapiens
aguaacagugcaguacucaguaa

SEQ ID NO: 510352 - RNA, 17 nt, Homo sapiens
aguaagacagugcagug

SEQ ID NO: 510353 - RNA, 21 nt, Homo sapiens
aguaagacagugcagugcuca

SEQ ID NO: 510354 - RNA, 19 nt, Homo sapiens
aguaauagucccaguucca

SEQ ID NO: 510355 - RNA, 19 nt, Homo sapiens
aguacucaguaacacaggg

SEQ ID NO: 510356 - RNA, 19 nt, Homo sapiens
aguacucaguaacacagug

SEQ ID NO: 510357 - RNA, 24 nt, Homo sapiens
aguacucaguaacacagugcagua

SEQ ID NO: 510358 - RNA, 15 nt, Homo sapiens
aguacucaguacuau

SEQ ID NO: 510359 - RNA, 21 nt, Homo sapiens
aguagacauggaauuuaugaa

SEQ ID NO: 510360 - RNA, 12 nt, Homo sapiens
aguagcauauau

SEQ ID NO: 510361 - RNA, 14 nt, Homo sapiens
aguauacaguccua

SEQ ID NO: 510362 - RNA, 20 nt, Homo sapiens
aguauggugcuggguccuua

SEQ ID NO: 510363 - RNA, 16 nt, Homo sapiens
aguauuacacaucaga

SEQ ID NO: 510364 - RNA, 13 nt, Homo sapiens
aguccaagguauu

SEQ ID NO: 510365 - RNA, 19 nt, Homo sapiens
aguccacccccauugugaa

SEQ ID NO: 510366 - RNA, 20 nt, Homo sapiens
aguccacuuuccucucucuc

SEQ ID NO: 510367 - RNA, 14 nt, Homo sapiens
aguccuagagaauu

SEQ ID NO: 510368 - RNA, 21 nt, Homo sapiens
agucucuauuugauuugcaac

SEQ ID NO: 510369 - RNA, 20 nt, Homo sapiens
agucuguagaaucuagccac

SEQ ID NO: 510370 - RNA, 14 nt, Homo sapiens
agucuucuuuauca

SEQ ID NO: 510371 - RNA, 13 nt, Homo sapiens
agugaacacacuc

SEQ ID NO: 510372 - RNA, 19 nt, Homo sapiens
agugacaugggugugccag

SEQ ID NO: 510373 - RNA, 15 nt, Homo sapiens
agugagcaucaugga

SEQ ID NO: 510374 - RNA, 13 nt, Homo sapiens
aguggacuguauu

SEQ ID NO: 510375 - RNA, 22 nt, Homo sapiens
aguggaggaggggguacagucc

SEQ ID NO: 510376 - RNA, 18 nt, Homo sapiens
aguggcacaggagacucc

SEQ ID NO: 510377 - RNA, 22 nt, Homo sapiens
aguggcucguguuucacagugg

SEQ ID NO: 510378 - RNA, 21 nt, Homo sapiens
aguggcugaaauaaaagccuc

SEQ ID NO: 510379 - RNA, 14 nt, Homo sapiens
aguguagugcucag

SEQ ID NO: 510380 - RNA, 22 nt, Homo sapiens
agugucacuuuuuuccugucaa

SEQ ID NO: 510381 - RNA, 15 nt, Homo sapiens
agugucaucuauuua

SEQ ID NO: 510382 - RNA, 15 nt, Homo sapiens
agugucccuuaccug

SEQ ID NO: 510383 - RNA, 14 nt, Homo sapiens
agugugauugugaa

SEQ ID NO: 510384 - RNA, 16 nt, Homo sapiens
agugugucacacugag

SEQ ID NO: 510385 - RNA, 15 nt, Homo sapiens
aguuaaugugccaaa

SEQ ID NO: 510386 - RNA, 14 nt, Homo sapiens
aguuaauuugauaa

SEQ ID NO: 510387 - RNA, 21 nt, Homo sapiens
aguuagauggggaacauuuug

SEQ ID NO: 510388 - RNA, 13 nt, Homo sapiens
aguuaggugcuga

SEQ ID NO: 510389 - RNA, 16 nt, Homo sapiens
aguuccggaaagccuu

SEQ ID NO: 510390 - RNA, 18 nt, Homo sapiens
aguucuauuaucuggguu

SEQ ID NO: 510391 - RNA, 14 nt, Homo sapiens
aguuggagugcagu

SEQ ID NO: 510392 - RNA, 21 nt, Homo sapiens
aguugguuaccuauugcugua

SEQ ID NO: 510393 - RNA, 19 nt, Homo sapiens
aguuguauuuuaauaaaga

SEQ ID NO: 510394 - RNA, 19 nt, Homo sapiens
aguuuacauuguccuguag

SEQ ID NO: 510395 - RNA, 22 nt, Homo sapiens
aguuuaggacccaagguggucu

SEQ ID NO: 510396 - RNA, 21 nt, Homo sapiens
aguuuccaaguuuauugcccu

SEQ ID NO: 510397 - RNA, 22 nt, Homo sapiens
aguuuccagcuaagccugauga

SEQ ID NO: 510398 - RNA, 21 nt, Homo sapiens
aguuugugaucuguccuucca

SEQ ID NO: 510399 - RNA, 15 nt, Homo sapiens
aguuuguuguucaga

SEQ ID NO: 510400 - RNA, 22 nt, Homo sapiens
aguuuguuguucagaagaaaga

SEQ ID NO: 510401 - RNA, 15 nt, Homo sapiens
auaaacacagauuau

SEQ ID NO: 510402 - RNA, 12 nt, Homo sapiens
auaaacugugag

SEQ ID NO: 510403 - RNA, 19 nt, Homo sapiens
auaaacuuuuuauucucag

SEQ ID NO: 510404 - RNA, 14 nt, Homo sapiens
auaaagaguucucc

SEQ ID NO: 510405 - RNA, 16 nt, Homo sapiens
auaaauccaacucuga

SEQ ID NO: 510406 - RNA, 20 nt, Homo sapiens
auaagcacauccaacuacuc

SEQ ID NO: 510407 - RNA, 22 nt, Homo sapiens
auaaggaguugccgcauauuau

SEQ ID NO: 510408 - RNA, 13 nt, Homo sapiens
auaagugccauua

SEQ ID NO: 510409 - RNA, 17 nt, Homo sapiens
auaagugcucaguauug

SEQ ID NO: 510410 - RNA, 18 nt, Homo sapiens
auaagugcucaguauuga

SEQ ID NO: 510411 - RNA, 20 nt, Homo sapiens
auaauuaaaugaaauacuug

SEQ ID NO: 510412 - RNA, 15 nt, Homo sapiens
auaauugacaaacuu

SEQ ID NO: 510413 - RNA, 21 nt, Homo sapiens
auaauuguaaaggugaugaau

SEQ ID NO: 510414 - RNA, 14 nt, Homo sapiens
auacaaguguuucu

SEQ ID NO: 510415 - RNA, 13 nt, Homo sapiens
auacagcauuucu

SEQ ID NO: 510416 - RNA, 14 nt, Homo sapiens
auacaugaugauuu

SEQ ID NO: 510417 - RNA, 17 nt, Homo sapiens
auaccaccuucaauauc

SEQ ID NO: 510418 - RNA, 23 nt, Homo sapiens
auacucaaagaggccaguacuuu

SEQ ID NO: 510419 - RNA, 15 nt, Homo sapiens
auacugaugagacaa

SEQ ID NO: 510420 - RNA, 21 nt, Homo sapiens
auacuucaaaugucauuucau

SEQ ID NO: 510421 - RNA, 18 nt, Homo sapiens
auagauaccauuuugaaa

SEQ ID NO: 510422 - RNA, 18 nt, Homo sapiens
auagccucaccuucccua

SEQ ID NO: 510423 - RNA, 12 nt, Homo sapiens
auaggaggacag

SEQ ID NO: 510424 - RNA, 14 nt, Homo sapiens
auaguaaaacuaaa

SEQ ID NO: 510425 - RNA, 17 nt, Homo sapiens
auaguauacacaucaua

SEQ ID NO: 510426 - RNA, 17 nt, Homo sapiens
auagugucugcugcugc

SEQ ID NO: 510427 - RNA, 14 nt, Homo sapiens
auauaagccauagc

SEQ ID NO: 510428 - RNA, 11 nt, Homo sapiens
auaucagcucu

SEQ ID NO: 510429 - RNA, 17 nt, Homo sapiens
auaucagcucugcauaa

SEQ ID NO: 510430 - RNA, 17 nt, Homo sapiens
auaucaguuacaguggc

SEQ ID NO: 510431 - RNA, 21 nt, Homo sapiens
auaucauccugccuucaugga

SEQ ID NO: 510432 - RNA, 21 nt, Homo sapiens
auaugauaaauuugacuguua

SEQ ID NO: 510433 - RNA, 19 nt, Homo sapiens
auauggaaacagagcaaaa

SEQ ID NO: 510434 - RNA, 21 nt, Homo sapiens
auauguacaaauaauauugcc

SEQ ID NO: 510435 - RNA, 23 nt, Homo sapiens
auauuauauaaauaguauuucag

SEQ ID NO: 510436 - RNA, 22 nt, Homo sapiens
auauucccaugguagacuguga

SEQ ID NO: 510437 - RNA, 17 nt, Homo sapiens
auauucuguaguauuuu

SEQ ID NO: 510438 - RNA, 17 nt, Homo sapiens
auauugcugauggugca

SEQ ID NO: 510439 - RNA, 18 nt, Homo sapiens
auauugugaugcauuuau

SEQ ID NO: 510440 - RNA, 21 nt, Homo sapiens
auauuuauuauuuucauauaa

SEQ ID NO: 510441 - RNA, 15 nt, Homo sapiens
aucaacucauguuaa

SEQ ID NO: 510442 - RNA, 14 nt, Homo sapiens
aucaagucugugaa

SEQ ID NO: 510443 - RNA, 19 nt, Homo sapiens
aucacauaugugcauagau

SEQ ID NO: 510444 - RNA, 18 nt, Homo sapiens
auuguauaauuaugaagc

SEQ ID NO: 510445 - RNA, 13 nt, Homo sapiens
auuuaacacugag

SEQ ID NO: 510446 - RNA, 15 nt, Homo sapiens
auuuaacuagcacuu

SEQ ID NO: 510447 - RNA, 18 nt, Homo sapiens
auuuacaacuuccagauu

SEQ ID NO: 510448 - RNA, 13 nt, Homo sapiens
auuuaccaaauag

SEQ ID NO: 510449 - RNA, 13 nt, Homo sapiens
auuuauguacaaa

SEQ ID NO: 510450 - RNA, 13 nt, Homo sapiens
auuucaacuucag

SEQ ID NO: 510451 - RNA, 13 nt, Homo sapiens
auuugcucauaag

SEQ ID NO: 510452 - RNA, 15 nt, Homo sapiens
auuugcugcauuuca

SEQ ID NO: 510453 - RNA, 17 nt, Homo sapiens
auuuguguaacugaaag

SEQ ID NO: 510454 - RNA, 17 nt, Homo sapiens
auuuguuuggucacugc

SEQ ID NO: 510455 - RNA, 13 nt, Homo sapiens
auuuuaauaaaga

SEQ ID NO: 510456 - RNA, 22 nt, Homo sapiens
auuuuaggaaacucuccaugau

SEQ ID NO: 510457 - RNA, 22 nt, Homo sapiens
auuuucaagacacagacaaagu

SEQ ID NO: 510458 - RNA, 22 nt, Homo sapiens
auuuucacaugaacauacuggc

SEQ ID NO: 510459 - RNA, 21 nt, Homo sapiens
auuuuccuuuuuuauacacau

SEQ ID NO: 510460 - RNA, 22 nt, Homo sapiens
auuuucucuccucgguggcauu

SEQ ID NO: 510461 - RNA, 15 nt, Homo sapiens
agagaaacauuuuug

SEQ ID NO: 510462 - RNA, 12 nt, Homo sapiens
agagaaaggagg

SEQ ID NO: 510463 - RNA, 13 nt, Homo sapiens
agagaacagggau

SEQ ID NO: 510464 - RNA, 17 nt, Homo sapiens
agagaacuaacacuauu

SEQ ID NO: 510465 - RNA, 12 nt, Homo sapiens
agagaagccaua

SEQ ID NO: 510466 - RNA, 23 nt, Homo sapiens
agagaagccugucuguacuucau

SEQ ID NO: 510467 - RNA, 16 nt, Homo sapiens
agagaccacuuccuua

SEQ ID NO: 510468 - RNA, 17 nt, Homo sapiens
agagaccuccugauguc

SEQ ID NO: 510469 - RNA, 15 nt, Homo sapiens
agagaguauggugcu

SEQ ID NO: 510470 - RNA, 21 nt, Homo sapiens
agagauacccucugagacaga

SEQ ID NO: 510471 - RNA, 16 nt, Homo sapiens
agagaucagaauugaa

SEQ ID NO: 510472 - RNA, 17 nt, Homo sapiens
agagccuagaggcucac

SEQ ID NO: 510473 - RNA, 14 nt, Homo sapiens
agagcucaggagaa

SEQ ID NO: 510474 - RNA, 16 nt, Homo sapiens
agagcuuuacagugcc

SEQ ID NO: 510475 - RNA, 15 nt, Homo sapiens
agaggaaaaggcuug

SEQ ID NO: 510476 - RNA, 21 nt, Homo sapiens
agaggaaugaggcucuguaac

SEQ ID NO: 510477 - RNA, 20 nt, Homo sapiens
agagguuucagcauucccaa

SEQ ID NO: 510478 - RNA, 15 nt, Homo sapiens
agaguaaaucccacg

SEQ ID NO: 510479 - RNA, 15 nt, Homo sapiens
agaguauacaagugu

SEQ ID NO: 510480 - RNA, 13 nt, Homo sapiens
agagugaccagaa

SEQ ID NO: 510481 - RNA, 20 nt, Homo sapiens
agaguugguggagaacagaa

SEQ ID NO: 510482 - RNA, 15 nt, Homo sapiens
agaucuccugugcac

SEQ ID NO: 510483 - RNA, 15 nt, Homo sapiens
agaucugaaguagug

SEQ ID NO: 510484 - RNA, 13 nt, Homo sapiens
agaugacaggaag

SEQ ID NO: 510485 - RNA, 19 nt, Homo sapiens
agaugagauucccucuccu

SEQ ID NO: 510486 - RNA, 18 nt, Homo sapiens
agaugucccauugauaau

SEQ ID NO: 510487 - RNA, 16 nt, Homo sapiens
agauguuauuacuguu

SEQ ID NO: 510488 - RNA, 17 nt, Homo sapiens
agauguuuuaguuuaaa

SEQ ID NO: 510489 - RNA, 23 nt, Homo sapiens
agauugcguggaccccgacaaag

SEQ ID NO: 510490 - RNA, 23 nt, Homo sapiens
agauuuucauguucuugcaguca

SEQ ID NO: 510491 - RNA, 13 nt, Homo sapiens
agcaacaacaaca

SEQ ID NO: 510492 - RNA, 17 nt, Homo sapiens
agcaaccagagcacugu

SEQ ID NO: 510493 - RNA, 17 nt, Homo sapiens
agcaacugucuauuucu

SEQ ID NO: 510494 - RNA, 15 nt, Homo sapiens
agcaagcucacuugc

SEQ ID NO: 510495 - RNA, 19 nt, Homo sapiens
agcaagcucacuugcuuua

SEQ ID NO: 510496 - RNA, 14 nt, Homo sapiens
agcaauaaguugaa

SEQ ID NO: 510497 - RNA, 13 nt, Homo sapiens
agcacagccauag

SEQ ID NO: 510498 - RNA, 15 nt, Homo sapiens
agcacaucucuucau

SEQ ID NO: 510499 - RNA, 16 nt, Homo sapiens
agcacaucucuucaug

SEQ ID NO: 510500 - RNA, 23 nt, Homo sapiens
agcaccucucagccccucagaga

SEQ ID NO: 510501 - RNA, 15 nt, Homo sapiens
agcacuucaaaggaa

SEQ ID NO: 510502 - RNA, 12 nt, Homo sapiens
agcagaacccag

SEQ ID NO: 510503 - RNA, 13 nt, Homo sapiens
agcagacacacac

SEQ ID NO: 510504 - RNA, 17 nt, Homo sapiens
agcagcucaccauggcu

SEQ ID NO: 510505 - RNA, 21 nt, Homo sapiens
agcagcucuuccccuuuccug

SEQ ID NO: 510506 - RNA, 21 nt, Homo sapiens
agcaggaaagaucccaaguca

SEQ ID NO: 510507 - RNA, 12 nt, Homo sapiens
agcaggugcugu

SEQ ID NO: 510508 - RNA, 23 nt, Homo sapiens
agcaguguuggggguagcggcau

SEQ ID NO: 510509 - RNA, 21 nt, Homo sapiens
agcaucugccaggacacugcc

SEQ ID NO: 510510 - RNA, 14 nt, Homo sapiens
agcauguacagugu

SEQ ID NO: 510511 - RNA, 20 nt, Homo sapiens
agccaaguucacaccacugc

SEQ ID NO: 510512 - RNA, 21 nt, Homo sapiens
agccacaguggggcccauggc

SEQ ID NO: 510513 - RNA, 20 nt, Homo sapiens
agccagaucccucuccagug

SEQ ID NO: 510514 - RNA, 14 nt, Homo sapiens
agccccacuccaca

SEQ ID NO: 510515 - RNA, 17 nt, Homo sapiens
agcccccacccaugcca

SEQ ID NO: 510516 - RNA, 20 nt, Homo sapiens
agcccucugcugcuuuccaa

SEQ ID NO: 510517 - RNA, 17 nt, Homo sapiens
agccucugggugacaaa

SEQ ID NO: 510518 - RNA, 17 nt, Homo sapiens
agccuggauuccagcag

SEQ ID NO: 510519 - RNA, 15 nt, Homo sapiens
agccuuccucaagau

SEQ ID NO: 510520 - RNA, 16 nt, Homo sapiens
agcgccagggcucaga

SEQ ID NO: 510521 - RNA, 14 nt, Homo sapiens
agcggcuuccccau

SEQ ID NO: 510522 - RNA, 15 nt, Homo sapiens
agcguguacuacccc

SEQ ID NO: 510523 - RNA, 16 nt, Homo sapiens
agcguguacuacccca

SEQ ID NO: 510524 - RNA, 13 nt, Homo sapiens
agcuccacucuga

SEQ ID NO: 510525 - RNA, 15 nt, Homo sapiens
agcucugcauaagau

SEQ ID NO: 510526 - RNA, 14 nt, Homo sapiens
agcucuggaugaag

SEQ ID NO: 510527 - RNA, 17 nt, Homo sapiens
agcucuggaugaaggca

SEQ ID NO: 510528 - RNA, 17 nt, Homo sapiens
agcucugugggagacca

SEQ ID NO: 510529 - RNA, 13 nt, Homo sapiens
agcugaagcguua

SEQ ID NO: 510530 - RNA, 22 nt, Homo sapiens
agcuggggccccugcaaccucg

SEQ ID NO: 510531 - RNA, 15 nt, Homo sapiens
agcuuaaacauugcc

SEQ ID NO: 510532 - RNA, 23 nt, Homo sapiens
agcuuauuuguauuuuuccucuu

SEQ ID NO: 510533 - RNA, 17 nt, Homo sapiens
agcuuucugauacuuau

SEQ ID NO: 510534 - RNA, 15 nt, Homo sapiens
aggaaaaggcuugag

SEQ ID NO: 510535 - RNA, 17 nt, Homo sapiens
aggaaagcagugcagua

SEQ ID NO: 510536 - RNA, 21 nt, Homo sapiens
aggaaagccucacugauauau

SEQ ID NO: 510537 - RNA, 17 nt, Homo sapiens
aggaaauaucugugaag

SEQ ID NO: 510538 - RNA, 13 nt, Homo sapiens
aggaacaugaccc

SEQ ID NO: 510539 - RNA, 20 nt, Homo sapiens
aggaagggaccccacuggaa

SEQ ID NO: 510540 - RNA, 16 nt, Homo sapiens
aggacacuuuugccaa

SEQ ID NO: 510541 - RNA, 13 nt, Homo sapiens
aggagaguguuua

SEQ ID NO: 510542 - RNA, 15 nt, Homo sapiens
aggagaugacaggaa

SEQ ID NO: 510543 - RNA, 20 nt, Homo sapiens
aggagcguguacuaccccag

SEQ ID NO: 510544 - RNA, 17 nt, Homo sapiens
aggagcuuccagugcau

SEQ ID NO: 510545 - RNA, 22 nt, Homo sapiens
aggaggaccuggggggggcaag

SEQ ID NO: 510546 - RNA, 17 nt, Homo sapiens
aggaguugccugacucc

SEQ ID NO: 510547 - RNA, 14 nt, Homo sapiens
aggauaaugagaug

SEQ ID NO: 510548 - RNA, 12 nt, Homo sapiens
aggaucacuuga

SEQ ID NO: 510549 - RNA, 16 nt, Homo sapiens
aggaugaaggggccag

SEQ ID NO: 510550 - RNA, 15 nt, Homo sapiens
aggauuuaccaaaua

SEQ ID NO: 510551 - RNA, 16 nt, Homo sapiens
aggauuuaccaaauag

SEQ ID NO: 510552 - RNA, 13 nt, Homo sapiens
aggcaccaugcug

SEQ ID NO: 510553 - RNA, 20 nt, Homo sapiens
aggcacccaaaccccggggc

SEQ ID NO: 510554 - RNA, 12 nt, Homo sapiens
aggcacugucag

SEQ ID NO: 510555 - RNA, 11 nt, Homo sapiens
aggcagcacuu

SEQ ID NO: 510556 - RNA, 13 nt, Homo sapiens
aggcagugcagua

SEQ ID NO: 510557 - RNA, 16 nt, Homo sapiens
aggcagugcaguacuc

SEQ ID NO: 510558 - RNA, 15 nt, Homo sapiens
aggcauccacuucac

SEQ ID NO: 510559 - RNA, 14 nt, Homo sapiens
aggccccuuaccug

SEQ ID NO: 510560 - RNA, 19 nt, Homo sapiens
aggccuuuccccagugugg

SEQ ID NO: 510561 - RNA, 22 nt, Homo sapiens
aggcggcacauuggcagugugu

SEQ ID NO: 510562 - RNA, 15 nt, Homo sapiens
agggaaugccaggga

SEQ ID NO: 510563 - RNA, 16 nt, Homo sapiens
uaaauugucucaaaga

SEQ ID NO: 510564 - RNA, 12 nt, Homo sapiens
uaacacagugca

SEQ ID NO: 510565 - RNA, 16 nt, Homo sapiens
uaacacagugcagugc

SEQ ID NO: 510566 - RNA, 14 nt, Homo sapiens
uaacagugcaguac

SEQ ID NO: 510567 - RNA, 17 nt, Homo sapiens
uaaccccuagugucuuu

SEQ ID NO: 510568 - RNA, 16 nt, Homo sapiens
uaaccgggacuacaga

SEQ ID NO: 510569 - RNA, 20 nt, Homo sapiens
uaaccuccacaguagcauuu

SEQ ID NO: 510570 - RNA, 21 nt, Homo sapiens
uaaccucucugaacugcaaca

SEQ ID NO: 510571 - RNA, 15 nt, Homo sapiens
uaacuccguuuccaa

SEQ ID NO: 510572 - RNA, 17 nt, Homo sapiens
uaacuuauuuaaugaaa

SEQ ID NO: 510573 - RNA, 22 nt, Homo sapiens
uaagaaacccccucauggaucu

SEQ ID NO: 510574 - RNA, 17 nt, Homo sapiens
uaagaauucaguagcau

SEQ ID NO: 510575 - RNA, 20 nt, Homo sapiens
uaagacagugcagugcucag

SEQ ID NO: 510576 - RNA, 15 nt, Homo sapiens
uaagcaucuguguaa

SEQ ID NO: 510577 - RNA, 15 nt, Homo sapiens
uaaggcagugcagua

SEQ ID NO: 510578 - RNA, 23 nt, Homo sapiens
uaagggacuuuggaauucugcuu

SEQ ID NO: 510579 - RNA, 12 nt, Homo sapiens
uaaguacucuaa

SEQ ID NO: 510580 - RNA, 15 nt, Homo sapiens
uaaguggacuguauu

SEQ ID NO: 510581 - RNA, 22 nt, Homo sapiens
uaaguguuggccaucauuucau

SEQ ID NO: 510582 - RNA, 22 nt, Homo sapiens
uaaguguuguauguaccguuga

SEQ ID NO: 510583 - RNA, 22 nt, Homo sapiens
uaauaaaaugcuaaaugucaau

SEQ ID NO: 510584 - RNA, 15 nt, Homo sapiens
uaauaaacacagauu

SEQ ID NO: 510585 - RNA, 13 nt, Homo sapiens
uaauaaagugcac

SEQ ID NO: 510586 - RNA, 15 nt, Homo sapiens
uaauauguacaaaua

SEQ ID NO: 510587 - RNA, 21 nt, Homo sapiens
uaaucaguuuccacuacauuc

SEQ ID NO: 510588 - RNA, 20 nt, Homo sapiens
uaaucuagagcuaugcacac

SEQ ID NO: 510589 - RNA, 18 nt, Homo sapiens
uaaucuuggcccuauuca

SEQ ID NO: 510590 - RNA, 15 nt, Homo sapiens
uaaugauucaaugug

SEQ ID NO: 510591 - RNA, 21 nt, Homo sapiens
uaaugucuuuuguuauugaga

SEQ ID NO: 510592 - RNA, 21 nt, Homo sapiens
uaauuaaaaaguuaaucuuca

SEQ ID NO: 510593 - RNA, 17 nt, Homo sapiens
uaauucgagcaaacaac

SEQ ID NO: 510594 - RNA, 22 nt, Homo sapiens
uaauucgagcaaacaacuuucu

SEQ ID NO: 510595 - RNA, 19 nt, Homo sapiens
uacaaaaugaauugccuuu

SEQ ID NO: 510596 - RNA, 22 nt, Homo sapiens
uacaaauuuuuacucaggcuuu

SEQ ID NO: 510597 - RNA, 21 nt, Homo sapiens
uacaacacauugaaacuguau

SEQ ID NO: 510598 - RNA, 22 nt, Homo sapiens
uacaacacauugaaacuguauu

SEQ ID NO: 510599 - RNA, 20 nt, Homo sapiens
uacaacaccagcaacauuau

SEQ ID NO: 510600 - RNA, 15 nt, Homo sapiens
uacaauacaguacuc

SEQ ID NO: 510601 - RNA, 13 nt, Homo sapiens
uacacauacauau

SEQ ID NO: 510602 - RNA, 15 nt, Homo sapiens
uacacauacauauau

SEQ ID NO: 510603 - RNA, 21 nt, Homo sapiens
uacacguuggaguauaccuau

SEQ ID NO: 510604 - RNA, 22 nt, Homo sapiens
uacagauguacaauuuagcuua

SEQ ID NO: 510605 - RNA, 23 nt, Homo sapiens
uacagcuuuuaagauuguacuuu

SEQ ID NO: 510606 - RNA, 14 nt, Homo sapiens
uacaggcugagaca

SEQ ID NO: 510607 - RNA, 22 nt, Homo sapiens
uacaguacucaggcagugcagu

SEQ ID NO: 510608 - RNA, 15 nt, Homo sapiens
uacagucacauucag

SEQ ID NO: 510609 - RNA, 22 nt, Homo sapiens
uacaguccuagagaauuccucu

SEQ ID NO: 510610 - RNA, 20 nt, Homo sapiens
uacaguggcaguauugacaa

SEQ ID NO: 510611 - RNA, 20 nt, Homo sapiens
uacauaguggucauuuggug

SEQ ID NO: 510612 - RNA, 17 nt, Homo sapiens
uaccaacccugugcaug

SEQ ID NO: 510613 - RNA, 18 nt, Homo sapiens
uaccaacccugugcauga

SEQ ID NO: 510614 - RNA, 15 nt, Homo sapiens
uaccaagcugugacc

SEQ ID NO: 510615 - RNA, 23 nt, Homo sapiens
uaccaaugggguuguuagcuuuu

SEQ ID NO: 510616 - RNA, 13 nt, Homo sapiens
uaccacauucacu

SEQ ID NO: 510617 - RNA, 17 nt, Homo sapiens
uacccagccuaccagag

SEQ ID NO: 510618 - RNA, 18 nt, Homo sapiens
uaccccaggacgcaugca

SEQ ID NO: 510619 - RNA, 18 nt, Homo sapiens
uaccccaggaugcaugca

SEQ ID NO: 510620 - RNA, 12 nt, Homo sapiens
uaccuaacuccc

SEQ ID NO: 510621 - RNA, 23 nt, Homo sapiens
uaccuaacuguuccuuggucuau

SEQ ID NO: 510622 - RNA, 17 nt, Homo sapiens
uacgaggcuucucuaac

SEQ ID NO: 510623 - RNA, 13 nt, Homo sapiens
uacuaacacuggc

SEQ ID NO: 510624 - RNA, 20 nt, Homo sapiens
uacuaccccagaacgcaugc

SEQ ID NO: 510625 - RNA, 12 nt, Homo sapiens
uacuaccccagg

SEQ ID NO: 510626 - RNA, 21 nt, Homo sapiens
uacuaccccaggacgcaugca

SEQ ID NO: 510627 - RNA, 21 nt, Homo sapiens
uacuaccccaggaugcaugca

SEQ ID NO: 510628 - RNA, 21 nt, Homo sapiens
uacucaguaaaucagugcagu

SEQ ID NO: 510629 - RNA, 19 nt, Homo sapiens
uacucaguaacagugcagu

SEQ ID NO: 510630 - RNA, 22 nt, Homo sapiens
uacucaguuaggcagugcagua

SEQ ID NO: 510631 - RNA, 16 nt, Homo sapiens
uacucauccuuguaua

SEQ ID NO: 510632 - RNA, 18 nt, Homo sapiens
uacuccuuaaaaauguau

SEQ ID NO: 510633 - RNA, 14 nt, Homo sapiens
uacugaugagacaa

SEQ ID NO: 510634 - RNA, 15 nt, Homo sapiens
uacuggaugcuuaca

SEQ ID NO: 510635 - RNA, 20 nt, Homo sapiens
uacuggauuuaacuaccuuu

SEQ ID NO: 510636 - RNA, 16 nt, Homo sapiens
uacuucuugugcuuua

SEQ ID NO: 510637 - RNA, 22 nt, Homo sapiens
uacuuugugucuuuuguucucu

SEQ ID NO: 510638 - RNA, 13 nt, Homo sapiens
uagaaacaagaca

SEQ ID NO: 510639 - RNA, 19 nt, Homo sapiens
uagaagagccugacugugu

SEQ ID NO: 510640 - RNA, 23 nt, Homo sapiens
uagaagagccugacuguguucag

SEQ ID NO: 510641 - RNA, 19 nt, Homo sapiens
uagaaucaagucugugaaa

SEQ ID NO: 510642 - RNA, 17 nt, Homo sapiens
uagaauggggcuuccau

SEQ ID NO: 510643 - RNA, 19 nt, Homo sapiens
uagacaguaugacauauag

SEQ ID NO: 510644 - RNA, 13 nt, Homo sapiens
uagagaagccaua

SEQ ID NO: 510645 - RNA, 14 nt, Homo sapiens
uagagaagccauaa

SEQ ID NO: 510646 - RNA, 23 nt, Homo sapiens
uagauggggagaaaacacaguug

SEQ ID NO: 510647 - RNA, 15 nt, Homo sapiens
uagcaacacaucuac

SEQ ID NO: 510648 - RNA, 14 nt, Homo sapiens
uagcaacaucuuuu

SEQ ID NO: 510649 - RNA, 19 nt, Homo sapiens
ucaucucaaacacugcuua

SEQ ID NO: 510650 - RNA, 22 nt, Homo sapiens
ucaugugcgaacacagugacac

SEQ ID NO: 510651 - RNA, 15 nt, Homo sapiens
ucauguucaucucag

SEQ ID NO: 510652 - RNA, 13 nt, Homo sapiens
ucauguucuugca

SEQ ID NO: 510653 - RNA, 12 nt, Homo sapiens
ucauucugcuaa

SEQ ID NO: 510654 - RNA, 18 nt, Homo sapiens
ucauugggccauguuuaa

SEQ ID NO: 510655 - RNA, 15 nt, Homo sapiens
ucauugucucaguga

SEQ ID NO: 510656 - RNA, 16 nt, Homo sapiens
ucauugucucagugaa

SEQ ID NO: 510657 - RNA, 21 nt, Homo sapiens
ucauuguucagaaaagcaccu

SEQ ID NO: 510658 - RNA, 19 nt, Homo sapiens
uccaaagguuucaacugua

SEQ ID NO: 510659 - RNA, 12 nt, Homo sapiens
uccaacauguga

SEQ ID NO: 510660 - RNA, 17 nt, Homo sapiens
uccaacuacuccuagac

SEQ ID NO: 510661 - RNA, 19 nt, Homo sapiens
uccaagacagccauacuuc

SEQ ID NO: 510662 - RNA, 21 nt, Homo sapiens
uccaagacagccauacuucca

SEQ ID NO: 510663 - RNA, 17 nt, Homo sapiens
uccaagugugugugcaa

SEQ ID NO: 510664 - RNA, 19 nt, Homo sapiens
uccaaguugccacauugcu

SEQ ID NO: 510665 - RNA, 20 nt, Homo sapiens
uccaauugcauuuauuuauc

SEQ ID NO: 510666 - RNA, 22 nt, Homo sapiens
uccacaaccuccuccuccaguu

SEQ ID NO: 510667 - RNA, 20 nt, Homo sapiens
uccacucuaguuguggacuu

SEQ ID NO: 510668 - RNA, 19 nt, Homo sapiens
uccagaaaaacauuuggca

SEQ ID NO: 510669 - RNA, 14 nt, Homo sapiens
uccagagagaagca

SEQ ID NO: 510670 - RNA, 16 nt, Homo sapiens
uccagaggguugugau

SEQ ID NO: 510671 - RNA, 21 nt, Homo sapiens
uccagaguaggugggucuugg

SEQ ID NO: 510672 - RNA, 17 nt, Homo sapiens
uccagccacuuauuucc

SEQ ID NO: 510673 - RNA, 18 nt, Homo sapiens
uccagcggggcuucuggg

SEQ ID NO: 510674 - RNA, 16 nt, Homo sapiens
uccagcuucacuguca

SEQ ID NO: 510675 - RNA, 16 nt, Homo sapiens
uccagucuucuuuauc

SEQ ID NO: 510676 - RNA, 18 nt, Homo sapiens
uccagugcauguugccau

SEQ ID NO: 510677 - RNA, 15 nt, Homo sapiens
uccaguucugaugag

SEQ ID NO: 510678 - RNA, 15 nt, Homo sapiens
ucccaaacuccaaga

SEQ ID NO: 510679 - RNA, 18 nt, Homo sapiens
ucccagccucuugcucag

SEQ ID NO: 510680 - RNA, 16 nt, Homo sapiens
ucccaguuaacuguua

SEQ ID NO: 510681 - RNA, 17 nt, Homo sapiens
ucccaguuaacuguuaa

SEQ ID NO: 510682 - RNA, 13 nt, Homo sapiens
guauuugggauau

SEQ ID NO: 510683 - RNA, 20 nt, Homo sapiens
guauuuuauuguaacagaca

SEQ ID NO: 510684 - RNA, 14 nt, Homo sapiens
guauuuuucuuugu

SEQ ID NO: 510685 - RNA, 23 nt, Homo sapiens
gucaauuuuuaacuuaucuccag

SEQ ID NO: 510686 - RNA, 22 nt, Homo sapiens
gucacccaacgacccaugaccg

SEQ ID NO: 510687 - RNA, 19 nt, Homo sapiens
gucacuuuuuuccugucaa

SEQ ID NO: 510688 - RNA, 21 nt, Homo sapiens
gucaggcucugaaucucucaa

SEQ ID NO: 510689 - RNA, 16 nt, Homo sapiens
gucaucucaaacacug

SEQ ID NO: 510690 - RNA, 21 nt, Homo sapiens
gucaugugccuugaacauaua

SEQ ID NO: 510691 - RNA, 23 nt, Homo sapiens
gucaugugcgaacacagugacac

SEQ ID NO: 510692 - RNA, 23 nt, Homo sapiens
gucauuagacaaaugucuugaag

SEQ ID NO: 510693 - RNA, 18 nt, Homo sapiens
guccacucugaauaccaa

SEQ ID NO: 510694 - RNA, 20 nt, Homo sapiens
guccacucugaauaccaagu

SEQ ID NO: 510695 - RNA, 22 nt, Homo sapiens
guccaggagaugaggcuggaua

SEQ ID NO: 510696 - RNA, 14 nt, Homo sapiens
guccaugugauaau

SEQ ID NO: 510697 - RNA, 14 nt, Homo sapiens
gucccugccagugu

SEQ ID NO: 510698 - RNA, 15 nt, Homo sapiens
guccuagagaauucc

SEQ ID NO: 510699 - RNA, 12 nt, Homo sapiens
guccugcacugu

SEQ ID NO: 510700 - RNA, 21 nt, Homo sapiens
guccugggggcugcugcacug

SEQ ID NO: 510701 - RNA, 15 nt, Homo sapiens
guccuuucccaccca

SEQ ID NO: 510702 - RNA, 24 nt, Homo sapiens
guccuuuuucuucccuuaggcaau

SEQ ID NO: 510703 - RNA, 16 nt, Homo sapiens
gucuaauaaacacaga

SEQ ID NO: 510704 - RNA, 20 nt, Homo sapiens
gucucaaaauaaaaccagaa

SEQ ID NO: 510705 - RNA, 13 nt, Homo sapiens
gucuccucuguca

SEQ ID NO: 510706 - RNA, 15 nt, Homo sapiens
gucuccucugucagu

SEQ ID NO: 510707 - RNA, 15 nt, Homo sapiens
gucucgcagccugaa

SEQ ID NO: 510708 - RNA, 15 nt, Homo sapiens
gucucucccuacccu

SEQ ID NO: 510709 - RNA, 17 nt, Homo sapiens
gucugaaaaaguguuuu

SEQ ID NO: 510710 - RNA, 15 nt, Homo sapiens
gucuguccuuuccca

SEQ ID NO: 510711 - RNA, 15 nt, Homo sapiens
gucuugcuaccucag

SEQ ID NO: 510712 - RNA, 14 nt, Homo sapiens
gucuuugaacacac

SEQ ID NO: 510713 - RNA, 13 nt, Homo sapiens
gucuuuuguuauu

SEQ ID NO: 510714 - RNA, 21 nt, Homo sapiens
gucuuuuuuuucuucaccuca

SEQ ID NO: 510715 - RNA, 20 nt, Homo sapiens
gugaaagucuccuguaucau

SEQ ID NO: 510716 - RNA, 23 nt, Homo sapiens
gugaaauuauagaaauuuacuau

SEQ ID NO: 510717 - RNA, 17 nt, Homo sapiens
gugacaugggugugcca

SEQ ID NO: 510718 - RNA, 12 nt, Homo sapiens
gugagacucuga

SEQ ID NO: 510719 - RNA, 14 nt, Homo sapiens
gugauaauuguaaa

SEQ ID NO: 510720 - RNA, 23 nt, Homo sapiens
gugaucuguccuuccaaccuguu

SEQ ID NO: 510721 - RNA, 14 nt, Homo sapiens
gugauguaacuacu

SEQ ID NO: 510722 - RNA, 12 nt, Homo sapiens
gugcaguacuca

SEQ ID NO: 510723 - RNA, 13 nt, Homo sapiens
gugcauguuaaaa

SEQ ID NO: 510724 - RNA, 15 nt, Homo sapiens
gugccuaacuccuua

SEQ ID NO: 510725 - RNA, 21 nt, Homo sapiens
gugcuucacacaaagugaaau

SEQ ID NO: 510726 - RNA, 18 nt, Homo sapiens
guggaaaccuugcugcua

SEQ ID NO: 510727 - RNA, 20 nt, Homo sapiens
guggaugaagacccuaucuc

SEQ ID NO: 510728 - RNA, 17 nt, Homo sapiens
guggcuaaaugccuaau

SEQ ID NO: 510729 - RNA, 19 nt, Homo sapiens
gugguaggaaagccucacu

SEQ ID NO: 510730 - RNA, 21 nt, Homo sapiens
guguacauuugauuugauaua

SEQ ID NO: 510731 - RNA, 22 nt, Homo sapiens
guguacuaccccaggaugcaug

SEQ ID NO: 510732 - RNA, 14 nt, Homo sapiens
guguagauugcgug

SEQ ID NO: 510733 - RNA, 22 nt, Homo sapiens
guguagcucuguccacucugaa

SEQ ID NO: 510734 - RNA, 20 nt, Homo sapiens
guguccauugacauguacag

SEQ ID NO: 510735 - RNA, 21 nt, Homo sapiens
guguccuguuuuuauucccuu

SEQ ID NO: 510736 - RNA, 16 nt, Homo sapiens
gugugaaggucuugcc

SEQ ID NO: 510737 - RNA, 14 nt, Homo sapiens
gugugcuucacaca

SEQ ID NO: 510738 - RNA, 14 nt, Homo sapiens
guguggaguggagg

SEQ ID NO: 510739 - RNA, 18 nt, Homo sapiens
guguggccccagcccgac

SEQ ID NO: 510740 - RNA, 14 nt, Homo sapiens
guguggcuuggaac

SEQ ID NO: 510741 - RNA, 13 nt, Homo sapiens
guguguccaugca

SEQ ID NO: 510742 - RNA, 20 nt, Homo sapiens
guguucauugacaccaaaua

SEQ ID NO: 510743 - RNA, 22 nt, Homo sapiens
guguuucgcauuaagcacacac

SEQ ID NO: 510744 - RNA, 13 nt, Homo sapiens
guguuuuuacaua

SEQ ID NO: 510745 - RNA, 22 nt, Homo sapiens
guuaacuagugucaucuauuua

SEQ ID NO: 510746 - RNA, 16 nt, Homo sapiens
guuaaugugccaaaau

SEQ ID NO: 510747 - RNA, 22 nt, Homo sapiens
guuacucuaagguaaaaccauc

SEQ ID NO: 510748 - RNA, 16 nt, Homo sapiens
guuauguuguaauauu

SEQ ID NO: 510749 - RNA, 16 nt, Homo sapiens
guuauucaauaacuau

SEQ ID NO: 510750 - RNA, 16 nt, Homo sapiens
guuauucauacaaaua

SEQ ID NO: 510751 - RNA, 19 nt, Homo sapiens
guucacgugacuccucaau

SEQ ID NO: 510752 - RNA, 11 nt, Homo sapiens
guuccaagugu

SEQ ID NO: 510753 - RNA, 18 nt, Homo sapiens
guuccucauggcuguuau

SEQ ID NO: 510754 - RNA, 16 nt, Homo sapiens
guucugccacuuaggg

SEQ ID NO: 510755 - RNA, 13 nt, Homo sapiens
guucuucuaucca

SEQ ID NO: 510756 - RNA, 19 nt, Homo sapiens
guugauaaaaagaaaguuu

SEQ ID NO: 510757 - RNA, 16 nt, Homo sapiens
guugaugaaauaucaa

SEQ ID NO: 510758 - RNA, 13 nt, Homo sapiens
guuggagugcagu

SEQ ID NO: 510759 - RNA, 22 nt, Homo sapiens
guuggauuuguuuaaaaaccaa

SEQ ID NO: 510760 - RNA, 22 nt, Homo sapiens
guuguaaguacucuaauauaca

SEQ ID NO: 510761 - RNA, 16 nt, Homo sapiens
guuuaagaaaugagaa

SEQ ID NO: 510762 - RNA, 16 nt, Homo sapiens
guuuagaagagccuga

SEQ ID NO: 510763 - RNA, 22 nt, Homo sapiens
guuuagaagagccugacugugu

SEQ ID NO: 510764 - RNA, 21 nt, Homo sapiens
guuuagcguuguuuuguggau

SEQ ID NO: 510765 - RNA, 18 nt, Homo sapiens
guuuagugugauugugaa

SEQ ID NO: 510766 - RNA, 17 nt, Homo sapiens
guuuauacacacaggag

SEQ ID NO: 510767 - RNA, 22 nt, Homo sapiens
guuuaucuagcauagcacaaac

SEQ ID NO: 510768 - RNA, 22 nt, Homo sapiens
guuucaacuguaaaauacuucu

SEQ ID NO: 510769 - RNA, 13 nt, Homo sapiens
guuucagcauucc

SEQ ID NO: 510770 - RNA, 22 nt, Homo sapiens
guuuccagcuaagccugaugau

SEQ ID NO: 510771 - RNA, 22 nt, Homo sapiens
uguacuugauuuuucaaagacu

SEQ ID NO: 510772 - RNA, 22 nt, Homo sapiens
uguagaugaaaaagcauguaca

SEQ ID NO: 510773 - RNA, 14 nt, Homo sapiens
uguagcaacccagg

SEQ ID NO: 510774 - RNA, 18 nt, Homo sapiens
uguagcucugaaugcuau

SEQ ID NO: 510775 - RNA, 15 nt, Homo sapiens
uguagcucuguccac

SEQ ID NO: 510776 - RNA, 18 nt, Homo sapiens
uguauaagaugcugcuga

SEQ ID NO: 510777 - RNA, 16 nt, Homo sapiens
uguauacaaacaggug

SEQ ID NO: 510778 - RNA, 11 nt, Homo sapiens
uguauuaccaa

SEQ ID NO: 510779 - RNA, 18 nt, Homo sapiens
ugucaagauuaaguuaua

SEQ ID NO: 510780 - RNA, 14 nt, Homo sapiens
ugucacucacaaaa

SEQ ID NO: 510781 - RNA, 17 nt, Homo sapiens
ugucaguguagaucaac

SEQ ID NO: 510782 - RNA, 13 nt, Homo sapiens
ugucaucugucag

SEQ ID NO: 510783 - RNA, 23 nt, Homo sapiens
ugucaugugcgaacacagugaca

SEQ ID NO: 510784 - RNA, 17 nt, Homo sapiens
uguccauugacauguac

SEQ ID NO: 510785 - RNA, 23 nt, Homo sapiens
ugucccacccccagcagcucacc

SEQ ID NO: 510786 - RNA, 19 nt, Homo sapiens
ugucccaguuaacuguuaa

SEQ ID NO: 510787 - RNA, 15 nt, Homo sapiens
uguccuaaaugcaaa

SEQ ID NO: 510788 - RNA, 23 nt, Homo sapiens
uguccugucuaaaaaugauucuc

SEQ ID NO: 510789 - RNA, 19 nt, Homo sapiens
ugucuaauaaacacagauu

SEQ ID NO: 510790 - RNA, 12 nt, Homo sapiens
ugucucagugaa

SEQ ID NO: 510791 - RNA, 18 nt, Homo sapiens
ugucuggaaaagcacuuu

SEQ ID NO: 510792 - RNA, 23 nt, Homo sapiens
ugucugucccaguuaacuguuaa

SEQ ID NO: 510793 - RNA, 22 nt, Homo sapiens
ugugaaacuugaaagagaauag

SEQ ID NO: 510794 - RNA, 21 nt, Homo sapiens
ugugaaaugacugcaucaugc

SEQ ID NO: 510795 - RNA, 23 nt, Homo sapiens
ugugaacuuucucagcauauaua

SEQ ID NO: 510796 - RNA, 16 nt, Homo sapiens
ugugaagugauugaca

SEQ ID NO: 510797 - RNA, 15 nt, Homo sapiens
ugugagcagucucag

SEQ ID NO: 510798 - RNA, 16 nt, Homo sapiens
ugugaucuauaccacc

SEQ ID NO: 510799 - RNA, 18 nt, Homo sapiens
ugugaucuauaccaccuu

SEQ ID NO: 510800 - RNA, 16 nt, Homo sapiens
ugugccuugaacauau

SEQ ID NO: 510801 - RNA, 15 nt, Homo sapiens
ugugcgaacacagug

SEQ ID NO: 510802 - RNA, 15 nt, Homo sapiens
ugugcucuacaucuc

SEQ ID NO: 510803 - RNA, 12 nt, Homo sapiens
ugugcuuucaug

SEQ ID NO: 510804 - RNA, 18 nt, Homo sapiens
uguggaauuacauaacag

SEQ ID NO: 510805 - RNA, 16 nt, Homo sapiens
uguggaccaguucccu

SEQ ID NO: 510806 - RNA, 16 nt, Homo sapiens
uguggcuaaaugccua

SEQ ID NO: 510807 - RNA, 22 nt, Homo sapiens
uguguaucugaaaggaagacau

SEQ ID NO: 510808 - RNA, 15 nt, Homo sapiens
ugugucaucugucag

SEQ ID NO: 510809 - RNA, 17 nt, Homo sapiens
ugugugaaggucuugcc

SEQ ID NO: 510810 - RNA, 15 nt, Homo sapiens
ugugugugcaauguu

SEQ ID NO: 510811 - RNA, 23 nt, Homo sapiens
uguguugggaauugcaugccauc

SEQ ID NO: 510812 - RNA, 12 nt, Homo sapiens
uguguuugcaaa

SEQ ID NO: 510813 - RNA, 15 nt, Homo sapiens
uguuauccacuacag

SEQ ID NO: 510814 - RNA, 15 nt, Homo sapiens
uguuauguggaggaa

SEQ ID NO: 510815 - RNA, 22 nt, Homo sapiens
uguuauuuguugagacuaucaa

SEQ ID NO: 510816 - RNA, 18 nt, Homo sapiens
uguucuuccucuuaccug

SEQ ID NO: 510817 - RNA, 19 nt, Homo sapiens
uguucuuguaaaacuguga

SEQ ID NO: 510818 - RNA, 17 nt, Homo sapiens
uguugaaaguugcaguu

SEQ ID NO: 510819 - RNA, 19 nt, Homo sapiens
uguuguucauagucaauca

SEQ ID NO: 510820 - RNA, 23 nt, Homo sapiens
uguuuagaagagccugacugugu

SEQ ID NO: 510821 - RNA, 15 nt, Homo sapiens
uguuuagccuaguca

SEQ ID NO: 510822 - RNA, 14 nt, Homo sapiens
uguuuaggugccuc

SEQ ID NO: 510823 - RNA, 20 nt, Homo sapiens
uguuuccagagugcuuauaa

SEQ ID NO: 510824 - RNA, 21 nt, Homo sapiens
uguuuuccccaauuauccucc

SEQ ID NO: 510825 - RNA, 17 nt, Homo sapiens
uuaaaaauagcaguauu

SEQ ID NO: 510826 - RNA, 16 nt, Homo sapiens
uuaaaaauguauguug

SEQ ID NO: 510827 - RNA, 19 nt, Homo sapiens
uuaaacaaaaacuuuccau

SEQ ID NO: 510828 - RNA, 13 nt, Homo sapiens
uuaaacauugccu

SEQ ID NO: 510829 - RNA, 17 nt, Homo sapiens
uuaaacugggaaaugag

SEQ ID NO: 510830 - RNA, 20 nt, Homo sapiens
uuaaaguaaaaacaauucaa

SEQ ID NO: 510831 - RNA, 14 nt, Homo sapiens
uuaacaauugccag

SEQ ID NO: 510832 - RNA, 17 nt, Homo sapiens
uuaacauaucauucaga

SEQ ID NO: 510833 - RNA, 21 nt, Homo sapiens
uuaacugcuucaaguguuacc

SEQ ID NO: 510834 - RNA, 16 nt, Homo sapiens
uuaacuuaaucaauua

SEQ ID NO: 510835 - RNA, 23 nt, Homo sapiens
uuaagaucugacugccaaauaaa

SEQ ID NO: 510836 - RNA, 23 nt, Homo sapiens
uuaagcacaaccauguucuugag

SEQ ID NO: 510837 - RNA, 22 nt, Homo sapiens
uuaauaacagaaauacaucaua

SEQ ID NO: 510838 - RNA, 14 nt, Homo sapiens
uuaaucauuuccag

SEQ ID NO: 510839 - RNA, 12 nt, Homo sapiens
uuaauugcucaa

SEQ ID NO: 510840 - RNA, 18 nt, Homo sapiens
uuaauuggcccuguacag

SEQ ID NO: 510841 - RNA, 16 nt, Homo sapiens
uuacagucacauucag

SEQ ID NO: 510842 - RNA, 17 nt, Homo sapiens
uuacagucacauucaga

SEQ ID NO: 510843 - RNA, 17 nt, Homo sapiens
uuacaguggcaguauug

SEQ ID NO: 510844 - RNA, 21 nt, Homo sapiens
uuacauaacaggcauugcacu

SEQ ID NO: 510845 - RNA, 15 nt, Homo sapiens
uuaccacuugcacua

SEQ ID NO: 510846 - RNA, 15 nt, Homo sapiens
uuaccagucaaugca

SEQ ID NO: 510847 - RNA, 18 nt, Homo sapiens
uuaccauuaaccaaggau

SEQ ID NO: 510848 - RNA, 15 nt, Homo sapiens
uuaccuauugcugua

SEQ ID NO: 510849 - RNA, 15 nt, Homo sapiens
uuacugaauuggcaa

SEQ ID NO: 510850 - RNA, 15 nt, Homo sapiens
uuacugauuaacuca

SEQ ID NO: 510851 - RNA, 14 nt, Homo sapiens
guccuggggugguu

SEQ ID NO: 510852 - RNA, 14 nt, Homo sapiens
gucgcuuugccauc

SEQ ID NO: 510853 - RNA, 19 nt, Homo sapiens
gucuaaaaaugauucucua

SEQ ID NO: 510854 - RNA, 14 nt, Homo sapiens
gucuaaagcuaaac

SEQ ID NO: 510855 - RNA, 15 nt, Homo sapiens
gucuaguggaaccaa

SEQ ID NO: 510856 - RNA, 22 nt, Homo sapiens
gucucaaagaccacgugacuuu

SEQ ID NO: 510857 - RNA, 12 nt, Homo sapiens
gucucagugaag

SEQ ID NO: 510858 - RNA, 20 nt, Homo sapiens
gucugaacccuuccaccaaa

SEQ ID NO: 510859 - RNA, 17 nt, Homo sapiens
gucugagaaauuuacaa

SEQ ID NO: 510860 - RNA, 23 nt, Homo sapiens
gucugcacacauaacacacauca

SEQ ID NO: 510861 - RNA, 20 nt, Homo sapiens
gucugcuuaguaucucauca

SEQ ID NO: 510862 - RNA, 22 nt, Homo sapiens
gucugcuuuggggcuuaucaga

SEQ ID NO: 510863 - RNA, 17 nt, Homo sapiens
gucuguagaaucuagcc

SEQ ID NO: 510864 - RNA, 18 nt, Homo sapiens
gucuguagaaucuagcca

SEQ ID NO: 510865 - RNA, 16 nt, Homo sapiens
gucuguccuuucccac

SEQ ID NO: 510866 - RNA, 19 nt, Homo sapiens
gucuguguucucaacacac

SEQ ID NO: 510867 - RNA, 22 nt, Homo sapiens
gucuguugaagugcauguuaaa

SEQ ID NO: 510868 - RNA, 22 nt, Homo sapiens
gucuucaacaugguuaccucug

SEQ ID NO: 510869 - RNA, 22 nt, Homo sapiens
gucuuuuuuuucuucaccucac

SEQ ID NO: 510870 - RNA, 21 nt, Homo sapiens
gugaaaaucgaggaagcaccu

SEQ ID NO: 510871 - RNA, 19 nt, Homo sapiens
gugaacuucagauugaacc

SEQ ID NO: 510872 - RNA, 15 nt, Homo sapiens
gugaaugguugcaaa

SEQ ID NO: 510873 - RNA, 19 nt, Homo sapiens
gugacaugggugugccagg

SEQ ID NO: 510874 - RNA, 14 nt, Homo sapiens
gugagcacuaucuu

SEQ ID NO: 510875 - RNA, 14 nt, Homo sapiens
gugcaacaaacuca

SEQ ID NO: 510876 - RNA, 18 nt, Homo sapiens
gugcaacaaacucaaaau

SEQ ID NO: 510877 - RNA, 15 nt, Homo sapiens
gugcagcaaccagag

SEQ ID NO: 510878 - RNA, 19 nt, Homo sapiens
gugccauucccacuaagcu

SEQ ID NO: 510879 - RNA, 22 nt, Homo sapiens
gugcccuguuuccaaugccaau

SEQ ID NO: 510880 - RNA, 19 nt, Homo sapiens
gugcuccugcugaccuucu

SEQ ID NO: 510881 - RNA, 14 nt, Homo sapiens
gugcuuguucuucc

SEQ ID NO: 510882 - RNA, 20 nt, Homo sapiens
guggaggaaauguguauuac

SEQ ID NO: 510883 - RNA, 21 nt, Homo sapiens
gugggcgcaaaggugccucau

SEQ ID NO: 510884 - RNA, 11 nt, Homo sapiens
guggggccagc

SEQ ID NO: 510885 - RNA, 16 nt, Homo sapiens
gugucaucaaguagua

SEQ ID NO: 510886 - RNA, 15 nt, Homo sapiens
gugucaucugucagc

SEQ ID NO: 510887 - RNA, 19 nt, Homo sapiens
guguccauugacauguaca

SEQ ID NO: 510888 - RNA, 17 nt, Homo sapiens
gugucuaauaaacacag

SEQ ID NO: 510889 - RNA, 19 nt, Homo sapiens
gugucuggaaaagcacuuu

SEQ ID NO: 510890 - RNA, 17 nt, Homo sapiens
guguggcuuaaacauuu

SEQ ID NO: 510891 - RNA, 16 nt, Homo sapiens
gugugugugcaauguu

SEQ ID NO: 510892 - RNA, 13 nt, Homo sapiens
guguucagugccu

SEQ ID NO: 510893 - RNA, 22 nt, Homo sapiens
guguucucaacacacaguauag

SEQ ID NO: 510894 - RNA, 21 nt, Homo sapiens
guguugggaauugcaugccau

SEQ ID NO: 510895 - RNA, 12 nt, Homo sapiens
guguuguucaua

SEQ ID NO: 510896 - RNA, 23 nt, Homo sapiens
guuaaaagcaauccaugugacuc

SEQ ID NO: 510897 - RNA, 12 nt, Homo sapiens
guuaacaguaaa

SEQ ID NO: 510898 - RNA, 19 nt, Homo sapiens
guuaauaaaggaacauuaa

SEQ ID NO: 510899 - RNA, 20 nt, Homo sapiens
guuaauaaagugcacugcca

SEQ ID NO: 510900 - RNA, 19 nt, Homo sapiens
guuagauggggaacauuuu

SEQ ID NO: 510901 - RNA, 23 nt, Homo sapiens
guucagaagaaagauugcuauaa

SEQ ID NO: 510902 - RNA, 21 nt, Homo sapiens
guucagaucucauagaugacc

SEQ ID NO: 510903 - RNA, 21 nt, Homo sapiens
guucagugugcugaucauuca

SEQ ID NO: 510904 - RNA, 21 nt, Homo sapiens
guucccuuuccccauucagug

SEQ ID NO: 510905 - RNA, 23 nt, Homo sapiens
guucccuuuccccauucagugac

SEQ ID NO: 510906 - RNA, 17 nt, Homo sapiens
guuccuuuuucuucugu

SEQ ID NO: 510907 - RNA, 20 nt, Homo sapiens
guucucaauacccacugcca

SEQ ID NO: 510908 - RNA, 17 nt, Homo sapiens
guucuuccucuuaccug

SEQ ID NO: 510909 - RNA, 19 nt, Homo sapiens
guucuuguaaaacugugac

SEQ ID NO: 510910 - RNA, 12 nt, Homo sapiens
guugaguuugcu

SEQ ID NO: 510911 - RNA, 16 nt, Homo sapiens
guugaguuugcuguau

SEQ ID NO: 510912 - RNA, 23 nt, Homo sapiens
guugauaguuuacaaacaagaua

SEQ ID NO: 510913 - RNA, 13 nt, Homo sapiens
guugauguugaua

SEQ ID NO: 510914 - RNA, 14 nt, Homo sapiens
guugcagaaaaaga

SEQ ID NO: 510915 - RNA, 18 nt, Homo sapiens
guugccugacuccugggu

SEQ ID NO: 510916 - RNA, 15 nt, Homo sapiens
guuggguuccagaca

SEQ ID NO: 510917 - RNA, 21 nt, Homo sapiens
guugucuaaagcuaaacaaaa

SEQ ID NO: 510918 - RNA, 16 nt, Homo sapiens
guuuaagguucuugcu

SEQ ID NO: 510919 - RNA, 12 nt, Homo sapiens
guuuaucuagca

SEQ ID NO: 510920 - RNA, 13 nt, Homo sapiens
guuucacaguggg

SEQ ID NO: 510921 - RNA, 13 nt, Homo sapiens
guuuguguuugaa

SEQ ID NO: 510922 - RNA, 18 nt, Homo sapiens
guuuucccauugcaguug

SEQ ID NO: 510923 - RNA, 17 nt, Homo sapiens
uaaaaacacuacaggug

SEQ ID NO: 510924 - RNA, 16 nt, Homo sapiens
uaaaaagaccaugcau

SEQ ID NO: 510925 - RNA, 13 nt, Homo sapiens
uaaaacaagagac

SEQ ID NO: 510926 - RNA, 20 nt, Homo sapiens
uaaaacaagagaccacuucc

SEQ ID NO: 510927 - RNA, 23 nt, Homo sapiens
uaaaacauuauagauuuucaugu

SEQ ID NO: 510928 - RNA, 11 nt, Homo sapiens
uaaaacuguga

SEQ ID NO: 510929 - RNA, 16 nt, Homo sapiens
uaaaagaaacuguggu

SEQ ID NO: 510930 - RNA, 19 nt, Homo sapiens
uaaaagaaagaugcugaug

SEQ ID NO: 510931 - RNA, 19 nt, Homo sapiens
uaaaagacaugaaauugag

SEQ ID NO: 510932 - RNA, 22 nt, Homo sapiens
uaaaagauaaguguguuugcaa

SEQ ID NO: 510933 - RNA, 16 nt, Homo sapiens
uaaaagcccuuuccaa

SEQ ID NO: 510934 - RNA, 15 nt, Homo sapiens
uaaaaucuuguucca

SEQ ID NO: 510935 - RNA, 22 nt, Homo sapiens
uaaaccauucuugggaggacac

SEQ ID NO: 510936 - RNA, 17 nt, Homo sapiens
uaaacgugaugugcuca

SEQ ID NO: 510937 - RNA, 23 nt, Homo sapiens
uaaagaguucuccuuguacuuga

SEQ ID NO: 510938 - RNA, 15 nt, Homo sapiens
uaaaguguccauuga

SEQ ID NO: 510939 - RNA, 18 nt, Homo sapiens
uaaaguucagugugcuga

SEQ ID NO: 510940 - RNA, 13 nt, Homo sapiens
uaaauaaugauuc

SEQ ID NO: 510941 - RNA, 13 nt, Homo sapiens
uaaauauuacaaa

SEQ ID NO: 510942 - RNA, 22 nt, Homo sapiens
uaaauauuagcaaagcaugcca

SEQ ID NO: 510943 - RNA, 13 nt, Homo sapiens
uaaaugccuaaua

SEQ ID NO: 510944 - RNA, 20 nt, Homo sapiens
uaaaugcuugauggaauuuu

SEQ ID NO: 510945 - RNA, 15 nt, Homo sapiens
guauacaaguguuuc

SEQ ID NO: 510946 - RNA, 12 nt, Homo sapiens
guauaucagcuc

SEQ ID NO: 510947 - RNA, 21 nt, Homo sapiens
guauauuucuaguauggcaca

SEQ ID NO: 510948 - RNA, 18 nt, Homo sapiens
guauugagacacugucaa

SEQ ID NO: 510949 - RNA, 16 nt, Homo sapiens
guauugucuuuugaca

SEQ ID NO: 510950 - RNA, 17 nt, Homo sapiens
guauugucuuuugacau

SEQ ID NO: 510951 - RNA, 17 nt, Homo sapiens
guauugugucuuuugca

SEQ ID NO: 510952 - RNA, 22 nt, Homo sapiens
gucaagagggggcaagucacau

SEQ ID NO: 510953 - RNA, 18 nt, Homo sapiens
gucacagagagacacggg

SEQ ID NO: 510954 - RNA, 11 nt, Homo sapiens
gucacauucag

SEQ ID NO: 510955 - RNA, 13 nt, Homo sapiens
gucagcacagaga

SEQ ID NO: 510956 - RNA, 12 nt, Homo sapiens
gucaucugucag

SEQ ID NO: 510957 - RNA, 20 nt, Homo sapiens
gucauguuucugcaguauuc

SEQ ID NO: 510958 - RNA, 13 nt, Homo sapiens
gucauucugcuaa

SEQ ID NO: 510959 - RNA, 12 nt, Homo sapiens
guccaaacuguu

SEQ ID NO: 510960 - RNA, 19 nt, Homo sapiens
guccaaacuuaacagauca

SEQ ID NO: 510961 - RNA, 17 nt, Homo sapiens
guccacccccauuguga

SEQ ID NO: 510962 - RNA, 18 nt, Homo sapiens
guccagaagagggguccg

SEQ ID NO: 510963 - RNA, 17 nt, Homo sapiens
gucccugccaguguuua

SEQ ID NO: 510964 - RNA, 12 nt, Homo sapiens
gucccuuaccug

SEQ ID NO: 510965 - RNA, 15 nt, Homo sapiens
guccucauuguucag

SEQ ID NO: 510966 - RNA, 23 nt, Homo sapiens
guccucgccccccgcccggccuc

SEQ ID NO: 510967 - RNA, 15 nt, Homo sapiens
gacaguaaagaccau

SEQ ID NO: 510968 - RNA, 16 nt, Homo sapiens
gacagugcagugcuca

SEQ ID NO: 510969 - RNA, 20 nt, Homo sapiens
gacaugccuugaaaccagaa

SEQ ID NO: 510970 - RNA, 20 nt, Homo sapiens
gacaugggugugccaggcua

SEQ ID NO: 510971 - RNA, 13 nt, Homo sapiens
gacauugucagaa

SEQ ID NO: 510972 - RNA, 17 nt, Homo sapiens
gacccagggaaugccag

SEQ ID NO: 510973 - RNA, 18 nt, Homo sapiens
gacccagggaaugccagg

SEQ ID NO: 510974 - RNA, 17 nt, Homo sapiens
gaccuccaggaagggac

SEQ ID NO: 510975 - RNA, 21 nt, Homo sapiens
gaccuccucccaagcacuuca

SEQ ID NO: 510976 - RNA, 18 nt, Homo sapiens
gaccuggggggggcaaga

SEQ ID NO: 510977 - RNA, 17 nt, Homo sapiens
gaccuuucugagugaca

SEQ ID NO: 510978 - RNA, 13 nt, Homo sapiens
gacgcaugcaggg

SEQ ID NO: 510979 - RNA, 23 nt, Homo sapiens
gacucaagccuuucacauacuga

SEQ ID NO: 510980 - RNA, 14 nt, Homo sapiens
gacuuccugaacuc

SEQ ID NO: 510981 - RNA, 20 nt, Homo sapiens
gacuucuuuacuaacacugg

SEQ ID NO: 510982 - RNA, 18 nt, Homo sapiens
gagaaaaagcccucuuca

SEQ ID NO: 510983 - RNA, 12 nt, Homo sapiens
gagaaacauuuu

SEQ ID NO: 510984 - RNA, 11 nt, Homo sapiens
gagaagccaua

SEQ ID NO: 510985 - RNA, 17 nt, Homo sapiens
gagacauauuacuggaa

SEQ ID NO: 510986 - RNA, 16 nt, Homo sapiens
gagaccacuuccuuaa

SEQ ID NO: 510987 - RNA, 13 nt, Homo sapiens
gagacgaugcuuu

SEQ ID NO: 510988 - RNA, 16 nt, Homo sapiens
gagagaacagggaugc

SEQ ID NO: 510989 - RNA, 18 nt, Homo sapiens
gagagaggcugccucagc

SEQ ID NO: 510990 - RNA, 14 nt, Homo sapiens
gagagcagccucuu

SEQ ID NO: 510991 - RNA, 14 nt, Homo sapiens
gagagcggcuuccc

SEQ ID NO: 510992 - RNA, 22 nt, Homo sapiens
gagagggugugggugcccuguu

SEQ ID NO: 510993 - RNA, 21 nt, Homo sapiens
gagaucauaaagagcacguuu

SEQ ID NO: 510994 - RNA, 17 nt, Homo sapiens
gagaugaggcuggauag

SEQ ID NO: 510995 - RNA, 11 nt, Homo sapiens
gagauggacca

SEQ ID NO: 510996 - RNA, 23 nt, Homo sapiens
gagauugcucuggggcuugcuau

SEQ ID NO: 510997 - RNA, 21 nt, Homo sapiens
gagcacuaucuuucaggaaau

SEQ ID NO: 510998 - RNA, 15 nt, Homo sapiens
gagcagaacccagac

SEQ ID NO: 510999 - RNA, 13 nt, Homo sapiens
gagccacuaccuu

SEQ ID NO: 511000 - RNA, 18 nt, Homo sapiens
gagccagauuucacucuc

SEQ ID NO: 511001 - RNA, 15 nt, Homo sapiens
gagccugaccuuucu

SEQ ID NO: 511002 - RNA, 23 nt, Homo sapiens
gagccugacuguguucagugccu

SEQ ID NO: 511003 - RNA, 18 nt, Homo sapiens
gagccuugcugggccagg

SEQ ID NO: 511004 - RNA, 16 nt, Homo sapiens
gagcguguacuacccc

SEQ ID NO: 511005 - RNA, 21 nt, Homo sapiens
gagcugacccccugcugccau

SEQ ID NO: 511006 - RNA, 17 nt, Homo sapiens
gagcugaggacucucac

SEQ ID NO: 511007 - RNA, 23 nt, Homo sapiens
gaggaaaauaguggcaggacugu

SEQ ID NO: 511008 - RNA, 18 nt, Homo sapiens
gaggaagcaccucucagc

SEQ ID NO: 511009 - RNA, 15 nt, Homo sapiens
gaggacagaaccaac

SEQ ID NO: 511010 - RNA, 21 nt, Homo sapiens
gaggacagggagggaacagac

SEQ ID NO: 511011 - RNA, 19 nt, Homo sapiens
gaggagcuuccagugcaug

SEQ ID NO: 511012 - RNA, 14 nt, Homo sapiens
gaggauuucugcuu

SEQ ID NO: 511013 - RNA, 21 nt, Homo sapiens
gaggcagaauggugggcucca

SEQ ID NO: 511014 - RNA, 19 nt, Homo sapiens
gaggcagagucucuaguuc

SEQ ID NO: 511015 - RNA, 14 nt, Homo sapiens
gaggcaugugauga

SEQ ID NO: 511016 - RNA, 19 nt, Homo sapiens
gaggcgugggauccagaga

SEQ ID NO: 511017 - RNA, 21 nt, Homo sapiens
gaggcucuguaaccuuaucua

SEQ ID NO: 511018 - RNA, 17 nt, Homo sapiens
gagggcaggguucuaga

SEQ ID NO: 511019 - RNA, 16 nt, Homo sapiens
gaggucccugccagug

SEQ ID NO: 511020 - RNA, 18 nt, Homo sapiens
gaggucccugccaguguu

SEQ ID NO: 511021 - RNA, 13 nt, Homo sapiens
gaguauggugcug

SEQ ID NO: 511022 - RNA, 17 nt, Homo sapiens
gaguauguuauuucucu

SEQ ID NO: 511023 - RNA, 22 nt, Homo sapiens
gaguggaccacgaccucgucca

SEQ ID NO: 511024 - RNA, 22 nt, Homo sapiens
gaguggcucguguuucacagug

SEQ ID NO: 511025 - RNA, 21 nt, Homo sapiens
gaguggcugaaauaaaagccu

SEQ ID NO: 511026 - RNA, 22 nt, Homo sapiens
gaguuaaaagcaauccauguga

SEQ ID NO: 511027 - RNA, 19 nt, Homo sapiens
gaguuccggaaagccuucc

SEQ ID NO: 511028 - RNA, 23 nt, Homo sapiens
gauaaaauaaaaagaugaagcug

SEQ ID NO: 511029 - RNA, 19 nt, Homo sapiens
gauaacucuguacgaggcu

SEQ ID NO: 511030 - RNA, 20 nt, Homo sapiens
gauagaucuuggcccuguua

SEQ ID NO: 511031 - RNA, 14 nt, Homo sapiens
gauaggagcuucca

SEQ ID NO: 511032 - RNA, 16 nt, Homo sapiens
gauaggugagcaacuu

SEQ ID NO: 511033 - RNA, 23 nt, Homo sapiens
gauauauuuuccagggcaaucaa

SEQ ID NO: 511034 - RNA, 16 nt, Homo sapiens
gaucaauuaccuaacu

SEQ ID NO: 511035 - RNA, 16 nt, Homo sapiens
gaucauagcugacuca

SEQ ID NO: 511036 - RNA, 18 nt, Homo sapiens
gaucauagcugacucaga

SEQ ID NO: 511037 - RNA, 13 nt, Homo sapiens
gaucccucuccag

SEQ ID NO: 511038 - RNA, 17 nt, Homo sapiens
gaugaaaaagcauguac

SEQ ID NO: 511039 - RNA, 21 nt, Homo sapiens
gaugaaguuguacaacaccag

SEQ ID NO: 511040 - RNA, 14 nt, Homo sapiens
gaugacccccaggu

SEQ ID NO: 511041 - RNA, 12 nt, Homo sapiens
gaugcaaaucaa

SEQ ID NO: 511042 - RNA, 22 nt, Homo sapiens
gaugcuaucucgcuagccauau

SEQ ID NO: 511043 - RNA, 20 nt, Homo sapiens
gaugucuugguuuccaucaa

SEQ ID NO: 511044 - RNA, 15 nt, Homo sapiens
gaugugccuagacac

SEQ ID NO: 511045 - RNA, 13 nt, Homo sapiens
gaugugcuuucau

SEQ ID NO: 511046 - RNA, 23 nt, Homo sapiens
gauuaucgacaucuuugaagcug

SEQ ID NO: 511047 - RNA, 21 nt, Homo sapiens
gauucauuuauuugacauaga

SEQ ID NO: 511048 - RNA, 17 nt, Homo sapiens
gauuccccuggacauau

SEQ ID NO: 511049 - RNA, 18 nt, Homo sapiens
gauucuaaaggggacaga

SEQ ID NO: 511050 - RNA, 21 nt, Homo sapiens
gauucugcaggaacaugaccc

SEQ ID NO: 511051 - RNA, 21 nt, Homo sapiens
gauugagagcagccucuugaa

SEQ ID NO: 511052 - RNA, 15 nt, Homo sapiens
gauuguuugaugaau

SEQ ID NO: 511053 - RNA, 17 nt, Homo sapiens
gauuuucucagcacaaa

SEQ ID NO: 511054 - RNA, 18 nt, Homo sapiens
gcaaaaccaacucucuac

SEQ ID NO: 511055 - RNA, 20 nt, Homo sapiens
gcaaaaccaacucucuacua

SEQ ID NO: 511056 - RNA, 22 nt, Homo sapiens
gcaaaagugcaguagugucacu

SEQ ID NO: 511057 - RNA, 11 nt, Homo sapiens
gcaaacauuua

SEQ ID NO: 511058 - RNA, 20 nt, Homo sapiens
gcaaccucggggagugccac

SEQ ID NO: 511059 - RNA, 22 nt, Homo sapiens
gcaaggugggggucaggcuaca

SEQ ID NO: 511060 - RNA, 17 nt, Homo sapiens
gcaauaaacucagucaa

SEQ ID NO: 511061 - RNA, 17 nt, Homo sapiens
gcaauggugaacuguca

SEQ ID NO: 511062 - RNA, 13 nt, Homo sapiens
gcaauugcuucuc

SEQ ID NO: 511063 - RNA, 12 nt, Homo sapiens
gcacaaguauua

SEQ ID NO: 511064 - RNA, 20 nt, Homo sapiens
gcacagaggauggcuucccc

SEQ ID NO: 511065 - RNA, 22 nt, Homo sapiens
gcacauguauguccauucacuu

SEQ ID NO: 511066 - RNA, 19 nt, Homo sapiens
gcaccuugggcacgggaga

SEQ ID NO: 511067 - RNA, 22 nt, Homo sapiens
gcacucccuaaguccacucuag

SEQ ID NO: 511068 - RNA, 11 nt, Homo sapiens
gcacucucuuu

SEQ ID NO: 511069 - RNA, 18 nt, Homo sapiens
gcacugaaguagccaaca

SEQ ID NO: 511070 - RNA, 15 nt, Homo sapiens
gcacuugcuacuuca

SEQ ID NO: 511071 - RNA, 18 nt, Homo sapiens
gcacuuuacagaugagau

SEQ ID NO: 511072 - RNA, 22 nt, Homo sapiens
gcagaaaaccuaccacauucac

SEQ ID NO: 511073 - RNA, 21 nt, Homo sapiens
gcagagaccuugcgaccaugu

SEQ ID NO: 511074 - RNA, 20 nt, Homo sapiens
gcagagauugggggggcuug

SEQ ID NO: 511075 - RNA, 19 nt, Homo sapiens
gcagcaaccagagcacugu

SEQ ID NO: 511076 - RNA, 19 nt, Homo sapiens
gcagcagauuuuaggaaau

SEQ ID NO: 511077 - RNA, 14 nt, Homo sapiens
gcagcuuuccaguu

SEQ ID NO: 511078 - RNA, 20 nt, Homo sapiens
gcagggagggggcugggaaa

SEQ ID NO: 511079 - RNA, 19 nt, Homo sapiens
gcaguauguacaggcugag

SEQ ID NO: 511080 - RNA, 15 nt, Homo sapiens
gcagugaaguacuca

SEQ ID NO: 511081 - RNA, 20 nt, Homo sapiens
gcagugaaugcuagacagaa

SEQ ID NO: 511082 - RNA, 17 nt, Homo sapiens
gcagugcaguacucagg

SEQ ID NO: 511083 - RNA, 15 nt, Homo sapiens
gcagugcagugcuca

SEQ ID NO: 511084 - RNA, 14 nt, Homo sapiens
gcagugugucacac

SEQ ID NO: 511085 - RNA, 22 nt, Homo sapiens
gcauaaaacaaaccagcaacuu

SEQ ID NO: 511086 - RNA, 17 nt, Homo sapiens
gcauaaauauuagcaaa

SEQ ID NO: 511087 - RNA, 16 nt, Homo sapiens
gcauaauaugcauaua

SEQ ID NO: 511088 - RNA, 14 nt, Homo sapiens
gcauagacaagugu

SEQ ID NO: 511089 - RNA, 21 nt, Homo sapiens
gcaugugaugagaggaaauca

SEQ ID NO: 511090 - RNA, 15 nt, Homo sapiens
gcauucagcacacac

SEQ ID NO: 511091 - RNA, 16 nt, Homo sapiens
gcauuuagcacaguau

SEQ ID NO: 511092 - RNA, 22 nt, Homo sapiens
gcauuuaggaaagcagugcagu

SEQ ID NO: 511093 - RNA, 18 nt, Homo sapiens
gcauuucugguguguauc

SEQ ID NO: 511094 - RNA, 12 nt, Homo sapiens
gcauuucuuauu

SEQ ID NO: 511095 - RNA, 16 nt, Homo sapiens
gcauuugcugcauuuc

SEQ ID NO: 511096 - RNA, 18 nt, Homo sapiens
gcauuugcugcauuucaa

SEQ ID NO: 511097 - RNA, 18 nt, Homo sapiens
gcauuuuucuacugcucu

SEQ ID NO: 511098 - RNA, 15 nt, Homo sapiens
gccaaggacacugau

SEQ ID NO: 511099 - RNA, 15 nt, Homo sapiens
gccacauuucucugc

SEQ ID NO: 511100 - RNA, 21 nt, Homo sapiens
gccacgaggagcuuccagugc

SEQ ID NO: 511101 - RNA, 13 nt, Homo sapiens
gccacuaccuuug

SEQ ID NO: 511102 - RNA, 16 nt, Homo sapiens
gccacugcccaaagcc

SEQ ID NO: 511103 - RNA, 17 nt, Homo sapiens
gccagaucccucuccag

SEQ ID NO: 511104 - RNA, 17 nt, Homo sapiens
gccagcaauaauugaca

SEQ ID NO: 511105 - RNA, 23 nt, Homo sapiens
gccagcagacauugucagcaaau

SEQ ID NO: 511106 - RNA, 12 nt, Homo sapiens
gccagcccuguu

SEQ ID NO: 511107 - RNA, 17 nt, Homo sapiens
gccaggacacugccuug

SEQ ID NO: 511108 - RNA, 15 nt, Homo sapiens
gccaggcagugcagc

SEQ ID NO: 511109 - RNA, 18 nt, Homo sapiens
gccaggccucagggacca

SEQ ID NO: 511110 - RNA, 18 nt, Homo sapiens
gccaggcucccacugccc

SEQ ID NO: 511111 - RNA, 14 nt, Homo sapiens
gccagggaaacaaa

SEQ ID NO: 511112 - RNA, 18 nt, Homo sapiens
gccagggcucagaugggg

SEQ ID NO: 511113 - RNA, 15 nt, Homo sapiens
gccaguacuuaccag

SEQ ID NO: 511114 - RNA, 19 nt, Homo sapiens
gccaucaagaaacauucag

SEQ ID NO: 511115 - RNA, 22 nt, Homo sapiens
gccaucuuccugccuacuggau

SEQ ID NO: 511116 - RNA, 22 nt, Homo sapiens
gcccaccucuuguuuuccccuu

SEQ ID NO: 511117 - RNA, 20 nt, Homo sapiens
gcccagacucaaggccucca

SEQ ID NO: 511118 - RNA, 15 nt, Homo sapiens
gccccaguggugcgg

SEQ ID NO: 511119 - RNA, 20 nt, Homo sapiens
gccccucucuguuuacccuc

SEQ ID NO: 511120 - RNA, 14 nt, Homo sapiens
gccccugccugaga

SEQ ID NO: 511121 - RNA, 15 nt, Homo sapiens
gcccucacuccacuc

SEQ ID NO: 511122 - RNA, 15 nt, Homo sapiens
gcccuccgcccuucc

SEQ ID NO: 511123 - RNA, 13 nt, Homo sapiens
gcccugcaccuug

SEQ ID NO: 511124 - RNA, 19 nt, Homo sapiens
gcccuguuuccaaugccaa

SEQ ID NO: 511125 - RNA, 14 nt, Homo sapiens
gccgauauaagcca

SEQ ID NO: 511126 - RNA, 16 nt, Homo sapiens
gccgauauaagccaua

SEQ ID NO: 511127 - RNA, 22 nt, Homo sapiens
gccguuagggaaauccaacucc

SEQ ID NO: 511128 - RNA, 12 nt, Homo sapiens
gccuccaugccc

SEQ ID NO: 511129 - RNA, 15 nt, Homo sapiens
gccucccguccgucc

SEQ ID NO: 511130 - RNA, 16 nt, Homo sapiens
gccucccuggggacca

SEQ ID NO: 511131 - RNA, 22 nt, Homo sapiens
gccugaggaggaggacacagca

SEQ ID NO: 511132 - RNA, 16 nt, Homo sapiens
gccugcauggagaagg

SEQ ID NO: 511133 - RNA, 21 nt, Homo sapiens
gccugcgcccugacaugcuaa

SEQ ID NO: 511134 - RNA, 14 nt, Homo sapiens
gccuggcuucuggg

SEQ ID NO: 511135 - RNA, 16 nt, Homo sapiens
gccugucacgugguca

SEQ ID NO: 511136 - RNA, 16 nt, Homo sapiens
gccuucuccacaggga

SEQ ID NO: 511137 - RNA, 16 nt, Homo sapiens
gcgaacacagugacac

SEQ ID NO: 511138 - RNA, 23 nt, Homo sapiens
gcgacagagugaccagaaacccu

SEQ ID NO: 511139 - RNA, 12 nt, Homo sapiens
gcgccacccgcc

SEQ ID NO: 511140 - RNA, 20 nt, Homo sapiens
gcguaggagagaacagggau

SEQ ID NO: 511141 - RNA, 19 nt, Homo sapiens
gcguggaccccgacaaagg

SEQ ID NO: 511142 - RNA, 14 nt, Homo sapiens
gcguguacuacccc

SEQ ID NO: 511143 - RNA, 13 nt, Homo sapiens
gcuaaaacacuuc

SEQ ID NO: 511144 - RNA, 12 nt, Homo sapiens
gcuaaaugucaa

SEQ ID NO: 511145 - RNA, 15 nt, Homo sapiens
gcuaugucugugaug

SEQ ID NO: 511146 - RNA, 16 nt, Homo sapiens
gcuaugucugugaugu

SEQ ID NO: 511147 - RNA, 20 nt, Homo sapiens
gcucaauaaggcagugcagu

SEQ ID NO: 511148 - RNA, 21 nt, Homo sapiens
gcucaauaaggcagugcagug

SEQ ID NO: 511149 - RNA, 13 nt, Homo sapiens
gcucaaucucagg

SEQ ID NO: 511150 - RNA, 18 nt, Homo sapiens
gcucaguaacacagugca

SEQ ID NO: 511151 - RNA, 21 nt, Homo sapiens
gcucaguaaggcagugcaaua

SEQ ID NO: 511152 - RNA, 14 nt, Homo sapiens
gcucauagcacaug

SEQ ID NO: 511153 - RNA, 14 nt, Homo sapiens
gcuccgggugcgug

SEQ ID NO: 511154 - RNA, 18 nt, Homo sapiens
gcuccucugcagccugag

SEQ ID NO: 511155 - RNA, 16 nt, Homo sapiens
gcucucuaagaauuca

SEQ ID NO: 511156 - RNA, 16 nt, Homo sapiens
gcucuguccacucuga

SEQ ID NO: 511157 - RNA, 19 nt, Homo sapiens
gcugaauuuucacaugaac

SEQ ID NO: 511158 - RNA, 20 nt, Homo sapiens
gcugaugaaguuaagcacaa

SEQ ID NO: 511159 - RNA, 17 nt, Homo sapiens
gcugauggugcaaugac

SEQ ID NO: 511160 - RNA, 16 nt, Homo sapiens
gcugcaggaaucaaaa

SEQ ID NO: 511161 - RNA, 17 nt, Homo sapiens
gcugcagucagcacaga

SEQ ID NO: 511162 - RNA, 21 nt, Homo sapiens
gcugcccacaacuugccaaaa

SEQ ID NO: 511163 - RNA, 19 nt, Homo sapiens
gcugcccuucuucuugacc

SEQ ID NO: 511164 - RNA, 13 nt, Homo sapiens
gcugccucaugac

SEQ ID NO: 511165 - RNA, 22 nt, Homo sapiens
gcugcugcagucagcacagaga

SEQ ID NO: 511166 - RNA, 19 nt, Homo sapiens
gcuggaugugcuuucaucc

SEQ ID NO: 511167 - RNA, 21 nt, Homo sapiens
gcuggcauuugcugcauuuca

SEQ ID NO: 511168 - RNA, 23 nt, Homo sapiens
gcugggaacaugacccagccuga

SEQ ID NO: 511169 - RNA, 17 nt, Homo sapiens
gcugggcucacuacaug

SEQ ID NO: 511170 - RNA, 22 nt, Homo sapiens
gcuggugggauaggagggugcc

SEQ ID NO: 511171 - RNA, 19 nt, Homo sapiens
gcugucgccgcuagucuua

SEQ ID NO: 511172 - RNA, 21 nt, Homo sapiens
gcuuacaguaggagugagaaa

SEQ ID NO: 511173 - RNA, 14 nt, Homo sapiens
gcuuaguaucucau

SEQ ID NO: 511174 - RNA, 13 nt, Homo sapiens
gcuuccagugcau

SEQ ID NO: 511175 - RNA, 18 nt, Homo sapiens
gcuucuacuccaugguga

SEQ ID NO: 511176 - RNA, 17 nt, Homo sapiens
gcuugagccugucacgu

SEQ ID NO: 511177 - RNA, 10 nt, Homo sapiens
gcuugcuauc

SEQ ID NO: 511178 - RNA, 22 nt, Homo sapiens
gcuuguucuuccucuuaccugu

SEQ ID NO: 511179 - RNA, 17 nt, Homo sapiens
gcuuuagagaagccaua

SEQ ID NO: 511180 - RNA, 20 nt, Homo sapiens
gcuuuagguaaaaagcuuaa

SEQ ID NO: 511181 - RNA, 19 nt, Homo sapiens
gcuuucauccaacuggaag

SEQ ID NO: 511182 - RNA, 14 nt, Homo sapiens
gcuuugccacugaa

SEQ ID NO: 511183 - RNA, 23 nt, Homo sapiens
gcuuugugcuuguucuuccucuu

SEQ ID NO: 511184 - RNA, 15 nt, Homo sapiens
gcuuuuguacguuaa

SEQ ID NO: 511185 - RNA, 17 nt, Homo sapiens
ggaaaagagaaacacua

SEQ ID NO: 511186 - RNA, 15 nt, Homo sapiens
ggaaacaaagcaaua

SEQ ID NO: 511187 - RNA, 20 nt, Homo sapiens
ggaaacaaggaaggacauuu

SEQ ID NO: 511188 - RNA, 13 nt, Homo sapiens
ggaaacucuccau

SEQ ID NO: 511189 - RNA, 19 nt, Homo sapiens
ggaaaugauugagagcagc

SEQ ID NO: 511190 - RNA, 21 nt, Homo sapiens
ggaacaugacccagccugaaa

SEQ ID NO: 511191 - RNA, 23 nt, Homo sapiens
ggaagaaccuguagaagaugacc

SEQ ID NO: 511192 - RNA, 16 nt, Homo sapiens
ggaagaggagaugaca

SEQ ID NO: 511193 - RNA, 23 nt, Homo sapiens
ggaaugccagggacauuuucaag

SEQ ID NO: 511194 - RNA, 12 nt, Homo sapiens
ggaaugcucaau

SEQ ID NO: 511195 - RNA, 18 nt, Homo sapiens
ggaaugggccaagccagg

SEQ ID NO: 511196 - RNA, 14 nt, Homo sapiens
ggacacuuuugcca

SEQ ID NO: 511197 - RNA, 16 nt, Homo sapiens
ggacaggcaccaugcu

SEQ ID NO: 511198 - RNA, 13 nt, Homo sapiens
ggacagugccuaa

SEQ ID NO: 511199 - RNA, 18 nt, Homo sapiens
ggacccagggaaugccag

SEQ ID NO: 511200 - RNA, 23 nt, Homo sapiens
cuuaucuuaggauuuaccaaaua

SEQ ID NO: 511201 - RNA, 16 nt, Homo sapiens
cuuaugagcuaucuac

SEQ ID NO: 511202 - RNA, 14 nt, Homo sapiens
cuuauuuccaugga

SEQ ID NO: 511203 - RNA, 22 nt, Homo sapiens
cuucaaaacaauauaaauggau

SEQ ID NO: 511204 - RNA, 15 nt, Homo sapiens
cuucaaacgaaaugg

SEQ ID NO: 511205 - RNA, 17 nt, Homo sapiens
cuucaaugcaaaauaca

SEQ ID NO: 511206 - RNA, 14 nt, Homo sapiens
cuucauggaacuca

SEQ ID NO: 511207 - RNA, 18 nt, Homo sapiens
cuucauggaacucagcug

SEQ ID NO: 511208 - RNA, 14 nt, Homo sapiens
cuuccaacauguga

SEQ ID NO: 511209 - RNA, 16 nt, Homo sapiens
cuuccaacaugugaug

SEQ ID NO: 511210 - RNA, 23 nt, Homo sapiens
cuucccaaccuccccugguccug

SEQ ID NO: 511211 - RNA, 21 nt, Homo sapiens
cuucccaugucuuucuccaaa

SEQ ID NO: 511212 - RNA, 21 nt, Homo sapiens
cuuccccaucgccuucugggg

SEQ ID NO: 511213 - RNA, 15 nt, Homo sapiens
cuucuaguggguuua

SEQ ID NO: 511214 - RNA, 23 nt, Homo sapiens
cuucuccacaaccuccuccucca

SEQ ID NO: 511215 - RNA, 14 nt, Homo sapiens
cuucuccacaggga

SEQ ID NO: 511216 - RNA, 20 nt, Homo sapiens
cuucucccccucagcucucc

SEQ ID NO: 511217 - RNA, 18 nt, Homo sapiens
cuucucccgggucguguc

SEQ ID NO: 511218 - RNA, 13 nt, Homo sapiens
cuucucuagacau

SEQ ID NO: 511219 - RNA, 17 nt, Homo sapiens
cuucucuguuaaccuac

SEQ ID NO: 511220 - RNA, 13 nt, Homo sapiens
cuucucuuucaca

SEQ ID NO: 511221 - RNA, 16 nt, Homo sapiens
cuucucuuucacaacu

SEQ ID NO: 511222 - RNA, 13 nt, Homo sapiens
cuucuuacuguau

SEQ ID NO: 511223 - RNA, 18 nt, Homo sapiens
cuucuuuacuaacacugg

SEQ ID NO: 511224 - RNA, 19 nt, Homo sapiens
cuucuuuacuaacacuggc

SEQ ID NO: 511225 - RNA, 22 nt, Homo sapiens
cuugaaagcgaaauacuugaaa

SEQ ID NO: 511226 - RNA, 13 nt, Homo sapiens
cuugaacauauau

SEQ ID NO: 511227 - RNA, 17 nt, Homo sapiens
cuugacccauguucuca

SEQ ID NO: 511228 - RNA, 12 nt, Homo sapiens
cuugagcagcug

SEQ ID NO: 511229 - RNA, 12 nt, Homo sapiens
cuugauuccugu

SEQ ID NO: 511230 - RNA, 16 nt, Homo sapiens
cuugauucuaaagggg

SEQ ID NO: 511231 - RNA, 18 nt, Homo sapiens
cuugcacuauucuuaaua

SEQ ID NO: 511232 - RNA, 19 nt, Homo sapiens
cuugcugccccacaacaca

SEQ ID NO: 511233 - RNA, 20 nt, Homo sapiens
cuugcugugaaaugacugca

SEQ ID NO: 511234 - RNA, 21 nt, Homo sapiens
cuuggacauuuauguacaaaa

SEQ ID NO: 511235 - RNA, 14 nt, Homo sapiens
cuuguacuuuacaa

SEQ ID NO: 511236 - RNA, 16 nt, Homo sapiens
cuugucauucugcuaa

SEQ ID NO: 511237 - RNA, 15 nt, Homo sapiens
cuuuacagugccacg

SEQ ID NO: 511238 - RNA, 14 nt, Homo sapiens
cuuuagacuguaaa

SEQ ID NO: 511239 - RNA, 16 nt, Homo sapiens
cuuuagagaagccaua

SEQ ID NO: 511240 - RNA, 13 nt, Homo sapiens
cuuuaugauuuca

SEQ ID NO: 511241 - RNA, 14 nt, Homo sapiens
cuuucagugccugc

SEQ ID NO: 511242 - RNA, 18 nt, Homo sapiens
cuuucauccaacuggaag

SEQ ID NO: 511243 - RNA, 18 nt, Homo sapiens
cuuucccacacugugaac

SEQ ID NO: 511244 - RNA, 16 nt, Homo sapiens
cuuucucagcauauau

SEQ ID NO: 511245 - RNA, 17 nt, Homo sapiens
cuuucucaugcauagac

SEQ ID NO: 511246 - RNA, 14 nt, Homo sapiens
cuuucucuuaccac

SEQ ID NO: 511247 - RNA, 15 nt, Homo sapiens
cuuucugaaauucac

SEQ ID NO: 511248 - RNA, 18 nt, Homo sapiens
cuuucugugcugguaaca

SEQ ID NO: 511249 - RNA, 23 nt, Homo sapiens
cuuucuuauacacaccugaauaa

SEQ ID NO: 511250 - RNA, 19 nt, Homo sapiens
cuuugaacacaccucucuc

SEQ ID NO: 511251 - RNA, 13 nt, Homo sapiens
cuuugccacugaa

SEQ ID NO: 511252 - RNA, 23 nt, Homo sapiens
cuuugccaucaagaaacauucag

SEQ ID NO: 511253 - RNA, 17 nt, Homo sapiens
cuuuggcuucagaauug

SEQ ID NO: 511254 - RNA, 16 nt, Homo sapiens
cuuuugugaaacuuga

SEQ ID NO: 511255 - RNA, 23 nt, Homo sapiens
cuuuuuaauuggcccuguacagu

SEQ ID NO: 511256 - RNA, 19 nt, Homo sapiens
cuuuuuuuaaguguucugu

SEQ ID NO: 511257 - RNA, 13 nt, Homo sapiens
gaaaaaagugcaa

SEQ ID NO: 511258 - RNA, 14 nt, Homo sapiens
gaaaaagcauguac

SEQ ID NO: 511259 - RNA, 22 nt, Homo sapiens
gaaaaaguguuuuuacauauag

SEQ ID NO: 511260 - RNA, 18 nt, Homo sapiens
gaaaaauaguguguccau

SEQ ID NO: 511261 - RNA, 19 nt, Homo sapiens
gaaaaauccuuguagaucu

SEQ ID NO: 511262 - RNA, 15 nt, Homo sapiens
gaaaacaaacaaaca

SEQ ID NO: 511263 - RNA, 16 nt, Homo sapiens
gaaaagcaccucuuga

SEQ ID NO: 511264 - RNA, 12 nt, Homo sapiens
gaaaaguuuuca

SEQ ID NO: 511265 - RNA, 17 nt, Homo sapiens
gaaaauaaauacauaaa

SEQ ID NO: 511266 - RNA, 16 nt, Homo sapiens
gaaaaugcuuucucau

SEQ ID NO: 511267 - RNA, 16 nt, Homo sapiens
gaaacaaggaaggaca

SEQ ID NO: 511268 - RNA, 19 nt, Homo sapiens
gaaaccagccaacccaagu

SEQ ID NO: 511269 - RNA, 18 nt, Homo sapiens
gaaagaagagagaccgag

SEQ ID NO: 511270 - RNA, 20 nt, Homo sapiens
gaaagagaaaaugcuuucuc

SEQ ID NO: 511271 - RNA, 19 nt, Homo sapiens
gaaagagaauagacaguau

SEQ ID NO: 511272 - RNA, 15 nt, Homo sapiens
gaaagaguugcagua

SEQ ID NO: 511273 - RNA, 21 nt, Homo sapiens
gaaagaucccaagucaaacag

SEQ ID NO: 511274 - RNA, 14 nt, Homo sapiens
gaaagcagugcagu

SEQ ID NO: 511275 - RNA, 14 nt, Homo sapiens
gaaagccucacuga

SEQ ID NO: 511276 - RNA, 12 nt, Homo sapiens
gaaauaguucca

SEQ ID NO: 511277 - RNA, 14 nt, Homo sapiens
gaaauaucugugaa

SEQ ID NO: 511278 - RNA, 21 nt, Homo sapiens
gaaaugcugauuuaaacuucu

SEQ ID NO: 511279 - RNA, 17 nt, Homo sapiens
gaaauggcuuuccacau

SEQ ID NO: 511280 - RNA, 15 nt, Homo sapiens
gaaauuagggcucua

SEQ ID NO: 511281 - RNA, 14 nt, Homo sapiens
gaaauucacaaagu

SEQ ID NO: 511282 - RNA, 18 nt, Homo sapiens
gaaauuuacccacaguga

SEQ ID NO: 511283 - RNA, 22 nt, Homo sapiens
gaacagggaugcuaucucgcua

SEQ ID NO: 511284 - RNA, 19 nt, Homo sapiens
gaacucagcugucuguggc

SEQ ID NO: 511285 - RNA, 14 nt, Homo sapiens
gaacucaugugauu

SEQ ID NO: 511286 - RNA, 20 nt, Homo sapiens
gaacucuuuucuuguuuauc

SEQ ID NO: 511287 - RNA, 23 nt, Homo sapiens
gaacuuaauuaccuaagagccac

SEQ ID NO: 511288 - RNA, 15 nt, Homo sapiens
gaagaaggcaaccca

SEQ ID NO: 511289 - RNA, 22 nt, Homo sapiens
gaagacaaauaguguggaguga

SEQ ID NO: 511290 - RNA, 20 nt, Homo sapiens
gaagagccugacuguguuca

SEQ ID NO: 511291 - RNA, 22 nt, Homo sapiens
gaagauguuuaacuuaaucaau

SEQ ID NO: 511292 - RNA, 17 nt, Homo sapiens
gaagcaaauaaauauca

SEQ ID NO: 511293 - RNA, 16 nt, Homo sapiens
gaagcacacagaauua

SEQ ID NO: 511294 - RNA, 20 nt, Homo sapiens
gaagcagaaugagaugauuu

SEQ ID NO: 511295 - RNA, 15 nt, Homo sapiens
gaagccaguccagaa

SEQ ID NO: 511296 - RNA, 15 nt, Homo sapiens
gaaggcccagccugu

SEQ ID NO: 511297 - RNA, 13 nt, Homo sapiens
gaagggugccugg

SEQ ID NO: 511298 - RNA, 22 nt, Homo sapiens
gaaggucuugccugaauccauc

SEQ ID NO: 511299 - RNA, 21 nt, Homo sapiens
gaaguagugugaguguuagaa

SEQ ID NO: 511300 - RNA, 15 nt, Homo sapiens
gaagugcauguuaaa

SEQ ID NO: 511301 - RNA, 17 nt, Homo sapiens
gaauaaaaugcagugaa

SEQ ID NO: 511302 - RNA, 13 nt, Homo sapiens
gaauaagaagcaa

SEQ ID NO: 511303 - RNA, 11 nt, Homo sapiens
gaauacuguau

SEQ ID NO: 511304 - RNA, 19 nt, Homo sapiens
gaauagacaguaugacaua

SEQ ID NO: 511305 - RNA, 18 nt, Homo sapiens
gaauaggcaaacuuuuau

SEQ ID NO: 511306 - RNA, 13 nt, Homo sapiens
gaaucacagccaa

SEQ ID NO: 511307 - RNA, 22 nt, Homo sapiens
gaaugaaauauaaacugugaga

SEQ ID NO: 511308 - RNA, 19 nt, Homo sapiens
gaauguuguccugugucau

SEQ ID NO: 511309 - RNA, 17 nt, Homo sapiens
gaauucauugucucagu

SEQ ID NO: 511310 - RNA, 16 nt, Homo sapiens
gacaagcauguugauu

SEQ ID NO: 511311 - RNA, 16 nt, Homo sapiens
gacacagcccagagac

SEQ ID NO: 511312 - RNA, 18 nt, Homo sapiens
gacaccuagacucuaaaa

SEQ ID NO: 511313 - RNA, 17 nt, Homo sapiens
gacagaaaccaagccau

SEQ ID NO: 511314 - RNA, 13 nt, Homo sapiens
gacagccauacuu

SEQ ID NO: 511315 - RNA, 15 nt, Homo sapiens
gacaggcaccaugcu

SEQ ID NO: 511316 - RNA, 14 nt, Homo sapiens
gacaggcaugcacc

SEQ ID NO: 511317 - RNA, 20 nt, Homo sapiens
acauuccugacccucacuuu

SEQ ID NO: 511318 - RNA, 20 nt, Homo sapiens
acauuggcagugugucacac

SEQ ID NO: 511319 - RNA, 14 nt, Homo sapiens
acauuguaaaugau

SEQ ID NO: 511320 - RNA, 21 nt, Homo sapiens
acauuguccuguagcuuuaaa

SEQ ID NO: 511321 - RNA, 15 nt, Homo sapiens
acauuuauguacaaa

SEQ ID NO: 511322 - RNA, 23 nt, Homo sapiens
acauuuccgugagagucaucuca

SEQ ID NO: 511323 - RNA, 15 nt, Homo sapiens
acauuugggcucagg

SEQ ID NO: 511324 - RNA, 11 nt, Homo sapiens
accaagcuaua

SEQ ID NO: 511325 - RNA, 17 nt, Homo sapiens
accaaguguguugggaa

SEQ ID NO: 511326 - RNA, 17 nt, Homo sapiens
accacgugacuuucaac

SEQ ID NO: 511327 - RNA, 22 nt, Homo sapiens
accacuuucccacacugugaac

SEQ ID NO: 511328 - RNA, 13 nt, Homo sapiens
accagagcacugu

SEQ ID NO: 511329 - RNA, 17 nt, Homo sapiens
accaucaaacaaaucau

SEQ ID NO: 511330 - RNA, 22 nt, Homo sapiens
accaucaaacaaaucauuuuga

SEQ ID NO: 511331 - RNA, 18 nt, Homo sapiens
accauguuaauacaucau

SEQ ID NO: 511332 - RNA, 18 nt, Homo sapiens
accauuacaaaaucuuaa

SEQ ID NO: 511333 - RNA, 21 nt, Homo sapiens
accauuuugaaauauucacaa

SEQ ID NO: 511334 - RNA, 19 nt, Homo sapiens
acccaaguuggagugcagu

SEQ ID NO: 511335 - RNA, 20 nt, Homo sapiens
accccagaacgcaugcaggg

SEQ ID NO: 511336 - RNA, 20 nt, Homo sapiens
accccaggaugcaugcaggg

SEQ ID NO: 511337 - RNA, 11 nt, Homo sapiens
accccaucuca

SEQ ID NO: 511338 - RNA, 15 nt, Homo sapiens
accccuagugucuuu

SEQ ID NO: 511339 - RNA, 22 nt, Homo sapiens
acccuagauccaauugcauuua

SEQ ID NO: 511340 - RNA, 16 nt, Homo sapiens
acccucaccugaauaa

SEQ ID NO: 511341 - RNA, 15 nt, Homo sapiens
acccucuggagauaa

SEQ ID NO: 511342 - RNA, 21 nt, Homo sapiens
acccugaauucauugucucag

SEQ ID NO: 511343 - RNA, 15 nt, Homo sapiens
accggacgcaugcag

SEQ ID NO: 511344 - RNA, 13 nt, Homo sapiens
accgucaauguga

SEQ ID NO: 511345 - RNA, 15 nt, Homo sapiens
accguugauguugau

SEQ ID NO: 511346 - RNA, 14 nt, Homo sapiens
accuaccacauuca

SEQ ID NO: 511347 - RNA, 16 nt, Homo sapiens
accuaccacauucacu

SEQ ID NO: 511348 - RNA, 16 nt, Homo sapiens
accuccuccuccaguu

SEQ ID NO: 511349 - RNA, 23 nt, Homo sapiens
accucucugaacugcaacacugg

SEQ ID NO: 511350 - RNA, 22 nt, Homo sapiens
accucuuuggauguuuucccca

SEQ ID NO: 511351 - RNA, 19 nt, Homo sapiens
accugacagcaaacacagu

SEQ ID NO: 511352 - RNA, 15 nt, Homo sapiens
accuguaauagccuc

SEQ ID NO: 511353 - RNA, 16 nt, Homo sapiens
accuguaauagccuca

SEQ ID NO: 511354 - RNA, 19 nt, Homo sapiens
accuguagaagaugaccuc

SEQ ID NO: 511355 - RNA, 21 nt, Homo sapiens
accuguugucugaaacauaga

SEQ ID NO: 511356 - RNA, 22 nt, Homo sapiens
accuuggagaggagaguggcag

SEQ ID NO: 511357 - RNA, 21 nt, Homo sapiens
accuuguacagaaccagcacu

SEQ ID NO: 511358 - RNA, 14 nt, Homo sapiens
accuuucugaguga

SEQ ID NO: 511359 - RNA, 14 nt, Homo sapiens
acgaagaccccagg

SEQ ID NO: 511360 - RNA, 18 nt, Homo sapiens
acgagagguaugccugua

SEQ ID NO: 511361 - RNA, 21 nt, Homo sapiens
acgaggagcuuccagugcaug

SEQ ID NO: 511362 - RNA, 19 nt, Homo sapiens
acgaugacugacacucaga

SEQ ID NO: 511363 - RNA, 19 nt, Homo sapiens
acgcaaaaaauaacuacag

SEQ ID NO: 511364 - RNA, 16 nt, Homo sapiens
acgcaaauacaugccu

SEQ ID NO: 511365 - RNA, 19 nt, Homo sapiens
acgccccccggccugaugg

SEQ ID NO: 511366 - RNA, 14 nt, Homo sapiens
acgcuugacaguua

SEQ ID NO: 511367 - RNA, 13 nt, Homo sapiens
acggcuuccccau

SEQ ID NO: 511368 - RNA, 19 nt, Homo sapiens
acgugaauagcgcccucaa

SEQ ID NO: 511369 - RNA, 13 nt, Homo sapiens
acgugacuccuca

SEQ ID NO: 511370 - RNA, 21 nt, Homo sapiens
acgugaggccccugugcagua

SEQ ID NO: 511371 - RNA, 14 nt, Homo sapiens
acgugcagcaccug

SEQ ID NO: 511372 - RNA, 15 nt, Homo sapiens
acgugggguggaauu

SEQ ID NO: 511373 - RNA, 15 nt, Homo sapiens
acuaaugacaaguga

SEQ ID NO: 511374 - RNA, 16 nt, Homo sapiens
acuaaugacaagugac

SEQ ID NO: 511375 - RNA, 16 nt, Homo sapiens
acuaauuaaacugaug

SEQ ID NO: 511376 - RNA, 17 nt, Homo sapiens
acuacccaugcaauuaa

SEQ ID NO: 511377 - RNA, 20 nt, Homo sapiens
acuaccccaggacgcaugca

SEQ ID NO: 511378 - RNA, 23 nt, Homo sapiens
acuaccccaggacgcaugcaggg

SEQ ID NO: 511379 - RNA, 20 nt, Homo sapiens
acuaccccaggaugcaugca

SEQ ID NO: 511380 - RNA, 21 nt, Homo sapiens
acuaccuuuggcuuaauucca

SEQ ID NO: 511381 - RNA, 22 nt, Homo sapiens
acuagaaccuucuaauccaugu

SEQ ID NO: 511382 - RNA, 18 nt, Homo sapiens
acuagcccucuuucucuc

SEQ ID NO: 511383 - RNA, 24 nt, Homo sapiens
acuaguaaucuuggcccuauucau

SEQ ID NO: 511384 - RNA, 20 nt, Homo sapiens
acuauguuuagugugauugu

SEQ ID NO: 511385 - RNA, 20 nt, Homo sapiens
acuauugguaaacaccuaaa

SEQ ID NO: 511386 - RNA, 22 nt, Homo sapiens
acucaccauuuaaucauuucca

SEQ ID NO: 511387 - RNA, 20 nt, Homo sapiens
acucaggagcacagccauag

SEQ ID NO: 511388 - RNA, 18 nt, Homo sapiens
acucaggcagugcaguac

SEQ ID NO: 511389 - RNA, 21 nt, Homo sapiens
acucaguaacacagugcagua

SEQ ID NO: 511390 - RNA, 22 nt, Homo sapiens
acucaguaacacagugcaguac

SEQ ID NO: 511391 - RNA, 20 nt, Homo sapiens
acucaguaacagugcaguac

SEQ ID NO: 511392 - RNA, 19 nt, Homo sapiens
acucaucccccaucagaug

SEQ ID NO: 511393 - RNA, 17 nt, Homo sapiens
acucauguucauucagc

SEQ ID NO: 511394 - RNA, 19 nt, Homo sapiens
acuccccccauccuaccua

SEQ ID NO: 511395 - RNA, 13 nt, Homo sapiens
acucccuaagucc

SEQ ID NO: 511396 - RNA, 18 nt, Homo sapiens
acucccugucauaguuac

SEQ ID NO: 511397 - RNA, 18 nt, Homo sapiens
acuccuccugcuccucac

SEQ ID NO: 511398 - RNA, 16 nt, Homo sapiens
acucuaaaacuaucag

SEQ ID NO: 511399 - RNA, 17 nt, Homo sapiens
acucugaauaccaagug

SEQ ID NO: 511400 - RNA, 15 nt, Homo sapiens
acucugaguccucau

SEQ ID NO: 511401 - RNA, 20 nt, Homo sapiens
acucuuacuaaccaccauuu

SEQ ID NO: 511402 - RNA, 13 nt, Homo sapiens
acugacauggugc

SEQ ID NO: 511403 - RNA, 15 nt, Homo sapiens
acugacauggugcug

SEQ ID NO: 511404 - RNA, 13 nt, Homo sapiens
acugagcacuuug

SEQ ID NO: 511405 - RNA, 14 nt, Homo sapiens
acugagcacuuuga

SEQ ID NO: 511406 - RNA, 21 nt, Homo sapiens
acugcaguguaagaaaauugg

SEQ ID NO: 511407 - RNA, 23 nt, Homo sapiens
acugccauuuuuugucugugaua

SEQ ID NO: 511408 - RNA, 21 nt, Homo sapiens
auagugaugugcuagaacuuu

SEQ ID NO: 511409 - RNA, 14 nt, Homo sapiens
auauaaacugugag

SEQ ID NO: 511410 - RNA, 12 nt, Homo sapiens
auauacauaacu

SEQ ID NO: 511411 - RNA, 19 nt, Homo sapiens
auauccaacagaaagcaua

SEQ ID NO: 511412 - RNA, 15 nt, Homo sapiens
auaucuguggucuuc

SEQ ID NO: 511413 - RNA, 17 nt, Homo sapiens
auaugaaaacuaaguuc

SEQ ID NO: 511414 - RNA, 19 nt, Homo sapiens
auaugagcaugcucccuca

SEQ ID NO: 511415 - RNA, 21 nt, Homo sapiens
auaugugagcacuaucuuuca

SEQ ID NO: 511416 - RNA, 12 nt, Homo sapiens
auauucccaugg

SEQ ID NO: 511417 - RNA, 14 nt, Homo sapiens
auauuucaaccaca

SEQ ID NO: 511418 - RNA, 23 nt, Homo sapiens
aucaauguucacgcaacuugaaa

SEQ ID NO: 511419 - RNA, 22 nt, Homo sapiens
aucaauuuaaaggaaaguucua

SEQ ID NO: 511420 - RNA, 22 nt, Homo sapiens
aucacacucucuucuuacugua

SEQ ID NO: 511421 - RNA, 16 nt, Homo sapiens
aucacccugaauucau

SEQ ID NO: 511422 - RNA, 18 nt, Homo sapiens
aucacugaaaaugugcuc

SEQ ID NO: 511423 - RNA, 15 nt, Homo sapiens
aucacuuuaauuuag

SEQ ID NO: 511424 - RNA, 15 nt, Homo sapiens
aucagaaacaauuuc

SEQ ID NO: 511425 - RNA, 18 nt, Homo sapiens
aucagacugcuuugagaa

SEQ ID NO: 511426 - RNA, 23 nt, Homo sapiens
aucaggacuugggaaacagagaa

SEQ ID NO: 511427 - RNA, 20 nt, Homo sapiens
aucaguccacccccauugug

SEQ ID NO: 511428 - RNA, 22 nt, Homo sapiens
aucaguuacaguggcaguauug

SEQ ID NO: 511429 - RNA, 18 nt, Homo sapiens
aucauccugccuucaugg

SEQ ID NO: 511430 - RNA, 17 nt, Homo sapiens
aucaugcaugcacucuu

SEQ ID NO: 511431 - RNA, 18 nt, Homo sapiens
aucauguguuucugugua

SEQ ID NO: 511432 - RNA, 20 nt, Homo sapiens
aucauuucuugguaugauca

SEQ ID NO: 511433 - RNA, 12 nt, Homo sapiens
auccaacgugaa

SEQ ID NO: 511434 - RNA, 22 nt, Homo sapiens
auccaagcccagccuaucucuc

SEQ ID NO: 511435 - RNA, 15 nt, Homo sapiens
auccacuucacaguu

SEQ ID NO: 511436 - RNA, 16 nt, Homo sapiens
auccaggcacccaaac

SEQ ID NO: 511437 - RNA, 18 nt, Homo sapiens
auccauaucagcucugca

SEQ ID NO: 511438 - RNA, 20 nt, Homo sapiens
auccauaucagcucugcaua

SEQ ID NO: 511439 - RNA, 20 nt, Homo sapiens
auccaugugcugcuguggca

SEQ ID NO: 511440 - RNA, 21 nt, Homo sapiens
aucccacgacauaagcuggua

SEQ ID NO: 511441 - RNA, 18 nt, Homo sapiens
aucccuagucuauugcag

SEQ ID NO: 511442 - RNA, 12 nt, Homo sapiens
aucccucuccag

SEQ ID NO: 511443 - RNA, 15 nt, Homo sapiens
auccucaauuaucuu

SEQ ID NO: 511444 - RNA, 17 nt, Homo sapiens
auccugacaaaagggac

SEQ ID NO: 511445 - RNA, 18 nt, Homo sapiens
auccuucccgcagcacca

SEQ ID NO: 511446 - RNA, 23 nt, Homo sapiens
aucgcuacuggcaucuguuaucu

SEQ ID NO: 511447 - RNA, 16 nt, Homo sapiens
aucguuucacaucugu

SEQ ID NO: 511448 - RNA, 13 nt, Homo sapiens
aucuacaacauaa

SEQ ID NO: 511449 - RNA, 19 nt, Homo sapiens
aucuacaacauaaugauac

SEQ ID NO: 511450 - RNA, 21 nt, Homo sapiens
aucuacacauauaaacacagu

SEQ ID NO: 511451 - RNA, 21 nt, Homo sapiens
aucuacuagaaccuucuaauc

SEQ ID NO: 511452 - RNA, 16 nt, Homo sapiens
aucuagcauagcacaa

SEQ ID NO: 511453 - RNA, 14 nt, Homo sapiens
aucuaguaugcauu

SEQ ID NO: 511454 - RNA, 12 nt, Homo sapiens
aucuauaccacc

SEQ ID NO: 511455 - RNA, 14 nt, Homo sapiens
aucuauaccaccuu

SEQ ID NO: 511456 - RNA, 20 nt, Homo sapiens
aucuauuuagagaaacauuu

SEQ ID NO: 511457 - RNA, 18 nt, Homo sapiens
aucucaaaagaucuccug

SEQ ID NO: 511458 - RNA, 21 nt, Homo sapiens
aucucgcacuacaucugauau

SEQ ID NO: 511459 - RNA, 20 nt, Homo sapiens
aucucguuguaaguacucua

SEQ ID NO: 511460 - RNA, 15 nt, Homo sapiens
aucugaggaguccaa

SEQ ID NO: 511461 - RNA, 16 nt, Homo sapiens
aucugaggaguccaaa

SEQ ID NO: 511462 - RNA, 14 nt, Homo sapiens
aucugauaucuguu

SEQ ID NO: 511463 - RNA, 15 nt, Homo sapiens
aucugcauaaccgca

SEQ ID NO: 511464 - RNA, 22 nt, Homo sapiens
aucugccuaguuuugaugaauu

SEQ ID NO: 511465 - RNA, 12 nt, Homo sapiens
aucugccuggag

SEQ ID NO: 511466 - RNA, 18 nt, Homo sapiens
aucugcuuucauccagcc

SEQ ID NO: 511467 - RNA, 13 nt, Homo sapiens
aucuggugcgugu

SEQ ID NO: 511468 - RNA, 16 nt, Homo sapiens
aucuguggucuucaaa

SEQ ID NO: 511469 - RNA, 23 nt, Homo sapiens
aucuuaaccuucaaauacauucu

SEQ ID NO: 511470 - RNA, 15 nt, Homo sapiens
aucuuaggauuuacc

SEQ ID NO: 511471 - RNA, 19 nt, Homo sapiens
aucuuccugccuacuggau

SEQ ID NO: 511472 - RNA, 16 nt, Homo sapiens
aucuuguggggccagg

SEQ ID NO: 511473 - RNA, 20 nt, Homo sapiens
augaaaaccacccuaucauc

SEQ ID NO: 511474 - RNA, 21 nt, Homo sapiens
augaauaaauauuacaaauuc

SEQ ID NO: 511475 - RNA, 11 nt, Homo sapiens
augaauucuuu

SEQ ID NO: 511476 - RNA, 16 nt, Homo sapiens
augaccauaaaauuag

SEQ ID NO: 511477 - RNA, 18 nt, Homo sapiens
augagauguuauuacugu

SEQ ID NO: 511478 - RNA, 22 nt, Homo sapiens
augaggccuuuccccagugugg

SEQ ID NO: 511479 - RNA, 20 nt, Homo sapiens
augagucacuuacuucauau

SEQ ID NO: 511480 - RNA, 23 nt, Homo sapiens
augaguguaugugccaguacuua

SEQ ID NO: 511481 - RNA, 19 nt, Homo sapiens
augauaaauuugacuguua

SEQ ID NO: 511482 - RNA, 18 nt, Homo sapiens
augauacuugguccuuaa

SEQ ID NO: 511483 - RNA, 14 nt, Homo sapiens
augauuaagugcuu

SEQ ID NO: 511484 - RNA, 22 nt, Homo sapiens
augcaauuugacuuggcauaau

SEQ ID NO: 511485 - RNA, 18 nt, Homo sapiens
augcaauuugauaaucag

SEQ ID NO: 511486 - RNA, 16 nt, Homo sapiens
augccaauucaucuca

SEQ ID NO: 511487 - RNA, 12 nt, Homo sapiens
augccauguaug

SEQ ID NO: 511488 - RNA, 20 nt, Homo sapiens
augccauguauguugcauga

SEQ ID NO: 511489 - RNA, 22 nt, Homo sapiens
augcucaguaacacagugcagu

SEQ ID NO: 511490 - RNA, 19 nt, Homo sapiens
augcucaguauugagacac

SEQ ID NO: 511491 - RNA, 22 nt, Homo sapiens
augcugcugagcacaucucuuc

SEQ ID NO: 511492 - RNA, 11 nt, Homo sapiens
augcugggcuc

SEQ ID NO: 511493 - RNA, 17 nt, Homo sapiens
augcugucuuagaucag

SEQ ID NO: 511494 - RNA, 15 nt, Homo sapiens
augcuugacccugaa

SEQ ID NO: 511495 - RNA, 14 nt, Homo sapiens
augcuuucccugag

SEQ ID NO: 511496 - RNA, 17 nt, Homo sapiens
augcuuucccugaggaa

SEQ ID NO: 511497 - RNA, 18 nt, Homo sapiens
auggaagacaaauacaca

SEQ ID NO: 511498 - RNA, 23 nt, Homo sapiens
auggaauagggauccacuucucu

SEQ ID NO: 511499 - RNA, 20 nt, Homo sapiens
auggacucgauuuuaccaua

SEQ ID NO: 511500 - RNA, 21 nt, Homo sapiens
auggauuucuaggccugauau

SEQ ID NO: 511501 - RNA, 21 nt, Homo sapiens
acugcuuugagaaaucucauc

SEQ ID NO: 511502 - RNA, 14 nt, Homo sapiens
acuggcaucuguua

SEQ ID NO: 511503 - RNA, 18 nt, Homo sapiens
acugucuucaacccugcc

SEQ ID NO: 511504 - RNA, 17 nt, Homo sapiens
acugugacauuccacag

SEQ ID NO: 511505 - RNA, 14 nt, Homo sapiens
acuguguucagugc

SEQ ID NO: 511506 - RNA, 18 nt, Homo sapiens
acuguguuucgcauuaag

SEQ ID NO: 511507 - RNA, 21 nt, Homo sapiens
acuguuaaauaaggccucauc

SEQ ID NO: 511508 - RNA, 22 nt, Homo sapiens
acuguuaaauaaggccucaucc

SEQ ID NO: 511509 - RNA, 14 nt, Homo sapiens
acuguuagacaaaa

SEQ ID NO: 511510 - RNA, 20 nt, Homo sapiens
acuuaaaccugugcuuucau

SEQ ID NO: 511511 - RNA, 13 nt, Homo sapiens
acuuaauuaccua

SEQ ID NO: 511512 - RNA, 21 nt, Homo sapiens
acuuaauuaccuaagagccac

SEQ ID NO: 511513 - RNA, 22 nt, Homo sapiens
acuuaguuugugauguaaggca

SEQ ID NO: 511514 - RNA, 19 nt, Homo sapiens
acuucccaacucacuuugu

SEQ ID NO: 511515 - RNA, 12 nt, Homo sapiens
acuuccuuaaca

SEQ ID NO: 511516 - RNA, 15 nt, Homo sapiens
acuuccuuaacagcu

SEQ ID NO: 511517 - RNA, 14 nt, Homo sapiens
acuucucuagacau

SEQ ID NO: 511518 - RNA, 15 nt, Homo sapiens
acuugccaaaacaga

SEQ ID NO: 511519 - RNA, 18 nt, Homo sapiens
acuuggugauuaccugaa

SEQ ID NO: 511520 - RNA, 20 nt, Homo sapiens
acuuggugauuaccugaaag

SEQ ID NO: 511521 - RNA, 18 nt, Homo sapiens
acuuguacuuacacugaa

SEQ ID NO: 511522 - RNA, 19 nt, Homo sapiens
acuuguacuuacacugaaa

SEQ ID NO: 511523 - RNA, 17 nt, Homo sapiens
acuuucccacacuguga

SEQ ID NO: 511524 - RNA, 21 nt, Homo sapiens
acuuucccuauacuuaggcau

SEQ ID NO: 511525 - RNA, 17 nt, Homo sapiens
acuuucucagcauauau

SEQ ID NO: 511526 - RNA, 19 nt, Homo sapiens
acuuuuccuggacacuuua

SEQ ID NO: 511527 - RNA, 13 nt, Homo sapiens
agaaaacauuguu

SEQ ID NO: 511528 - RNA, 16 nt, Homo sapiens
agaaaaugcuuucuca

SEQ ID NO: 511529 - RNA, 20 nt, Homo sapiens
agaaaaugcuuucucaugca

SEQ ID NO: 511530 - RNA, 18 nt, Homo sapiens
agaaacacagcaugcauu

SEQ ID NO: 511531 - RNA, 13 nt, Homo sapiens
agaaaccaagcca

SEQ ID NO: 511532 - RNA, 13 nt, Homo sapiens
agaaacugugguc

SEQ ID NO: 511533 - RNA, 16 nt, Homo sapiens
agaacauggacuacac

SEQ ID NO: 511534 - RNA, 14 nt, Homo sapiens
agaacgcaugcagg

SEQ ID NO: 511535 - RNA, 18 nt, Homo sapiens
agaacugccccaucuccu

SEQ ID NO: 511536 - RNA, 21 nt, Homo sapiens
agaagaguagauaagugcuca

SEQ ID NO: 511537 - RNA, 13 nt, Homo sapiens
agaagcagcagcu

SEQ ID NO: 511538 - RNA, 15 nt, Homo sapiens
agaaucaagucugug

SEQ ID NO: 511539 - RNA, 22 nt, Homo sapiens
agaaugaucacccugaauucau

SEQ ID NO: 511540 - RNA, 13 nt, Homo sapiens
agaauggugggcu

SEQ ID NO: 511541 - RNA, 23 nt, Homo sapiens
agaauuagauuuuaaaacuucau

SEQ ID NO: 511542 - RNA, 18 nt, Homo sapiens
agaauuuuaauauugcca

SEQ ID NO: 511543 - RNA, 15 nt, Homo sapiens
agacaaaugucuuga

SEQ ID NO: 511544 - RNA, 22 nt, Homo sapiens
agacauaccucucaacuuacau

SEQ ID NO: 511545 - RNA, 16 nt, Homo sapiens
agacauugacaagcac

SEQ ID NO: 511546 - RNA, 23 nt, Homo sapiens
agacauuguuuugccaacauugc

SEQ ID NO: 511547 - RNA, 18 nt, Homo sapiens
agaccaggaggcugcaag

SEQ ID NO: 511548 - RNA, 13 nt, Homo sapiens
agacccucagacc

SEQ ID NO: 511549 - RNA, 22 nt, Homo sapiens
agacccugaguccuugggccag

SEQ ID NO: 511550 - RNA, 18 nt, Homo sapiens
agagaaauaaaacuccuu

SEQ ID NO: 511551 - RNA, 13 nt, Homo sapiens
agagaaugaucac

SEQ ID NO: 511552 - RNA, 13 nt, Homo sapiens
agagacagaagaa

SEQ ID NO: 511553 - RNA, 13 nt, Homo sapiens
agagaggcugccu

SEQ ID NO: 511554 - RNA, 15 nt, Homo sapiens
agagaggcugccuca

SEQ ID NO: 511555 - RNA, 21 nt, Homo sapiens
agagcaaucuugcugugaaac

SEQ ID NO: 511556 - RNA, 19 nt, Homo sapiens
agagcuuuacagugccacg

SEQ ID NO: 511557 - RNA, 23 nt, Homo sapiens
agagcuuuacagugccacgacau

SEQ ID NO: 511558 - RNA, 15 nt, Homo sapiens
agaggauggcuuccc

SEQ ID NO: 511559 - RNA, 17 nt, Homo sapiens
agagucaagcugaugaa

SEQ ID NO: 511560 - RNA, 14 nt, Homo sapiens
agagucuugcuacc

SEQ ID NO: 511561 - RNA, 15 nt, Homo sapiens
agaguguuuaacuga

SEQ ID NO: 511562 - RNA, 22 nt, Homo sapiens
agaguuauuuuguguccuuuaa

SEQ ID NO: 511563 - RNA, 12 nt, Homo sapiens
agauaaauccaa

SEQ ID NO: 511564 - RNA, 17 nt, Homo sapiens
agauacccucugagaca

SEQ ID NO: 511565 - RNA, 18 nt, Homo sapiens
agaucuuggcccuguuaa

SEQ ID NO: 511566 - RNA, 21 nt, Homo sapiens
agauggauuugacacacucac

SEQ ID NO: 511567 - RNA, 17 nt, Homo sapiens
agauggggccugggcug

SEQ ID NO: 511568 - RNA, 16 nt, Homo sapiens
agauugaaccauucau

SEQ ID NO: 511569 - RNA, 23 nt, Homo sapiens
agauugcucuggggcuugcuauu

SEQ ID NO: 511570 - RNA, 22 nt, Homo sapiens
agauuuuaggaaaugaaugugu

SEQ ID NO: 511571 - RNA, 19 nt, Homo sapiens
agauuuucauguucuugca

SEQ ID NO: 511572 - RNA, 20 nt, Homo sapiens
agauuuucauguucuugcag

SEQ ID NO: 511573 - RNA, 21 nt, Homo sapiens
agcaaaagugcaguaguguca

SEQ ID NO: 511574 - RNA, 20 nt, Homo sapiens
agcaaagcaugccaauuucu

SEQ ID NO: 511575 - RNA, 22 nt, Homo sapiens
agcaaaguuuucagauuguaaa

SEQ ID NO: 511576 - RNA, 11 nt, Homo sapiens
agcaaccagag

SEQ ID NO: 511577 - RNA, 19 nt, Homo sapiens
agcaaccagagcacuguau

SEQ ID NO: 511578 - RNA, 18 nt, Homo sapiens
agcaaggacaaccugccc

SEQ ID NO: 511579 - RNA, 23 nt, Homo sapiens
agcacagaggauggcuuccccau

SEQ ID NO: 511580 - RNA, 10 nt, Homo sapiens
agcacuucaa

SEQ ID NO: 511581 - RNA, 17 nt, Homo sapiens
agcagagucuugcuacc

SEQ ID NO: 511582 - RNA, 15 nt, Homo sapiens
agcagcagcagcagc

SEQ ID NO: 511583 - RNA, 19 nt, Homo sapiens
agcagguagugggugaaug

SEQ ID NO: 511584 - RNA, 18 nt, Homo sapiens
agcaguauguacaggcug

SEQ ID NO: 511585 - RNA, 12 nt, Homo sapiens
agcagugcagua

SEQ ID NO: 511586 - RNA, 16 nt, Homo sapiens
agcauagccagcauuc

SEQ ID NO: 511587 - RNA, 16 nt, Homo sapiens
agcauguugauucuag

SEQ ID NO: 511588 - RNA, 20 nt, Homo sapiens
agcauuaaaaauaagccaaa

SEQ ID NO: 511589 - RNA, 22 nt, Homo sapiens
agccaaaauagagaguauacag

SEQ ID NO: 511590 - RNA, 17 nt, Homo sapiens
agccaaggucugaaccc

SEQ ID NO: 511591 - RNA, 13 nt, Homo sapiens
agccaagucgcca

SEQ ID NO: 511592 - RNA, 19 nt, Homo sapiens
agccacugcccaaagccau

SEQ ID NO: 511593 - RNA, 20 nt, Homo sapiens
agccauaacguuagacugca

SEQ ID NO: 511594 - RNA, 19 nt, Homo sapiens
agccauacuuccagcgaaa

SEQ ID NO: 511595 - RNA, 20 nt, Homo sapiens
agccauauauuuucugagua

SEQ ID NO: 511596 - RNA, 23 nt, Homo sapiens
agccaucuuccugccuacuggau

SEQ ID NO: 511597 - RNA, 20 nt, Homo sapiens
agcccugggcaaggaagcuu

SEQ ID NO: 511598 - RNA, 17 nt, Homo sapiens
agccgucagccugugaa

SEQ ID NO: 511599 - RNA, 21 nt, Homo sapiens
agccucguuggagagcagcag

SEQ ID NO: 511600 - RNA, 19 nt, Homo sapiens
agccucuccagagaaguuu

SEQ ID NO: 511601 - RNA, 18 nt, Homo sapiens
agccucugggugacaaaa

SEQ ID NO: 511602 - RNA, 23 nt, Homo sapiens
agccugaccuuucugagugacau

SEQ ID NO: 511603 - RNA, 14 nt, Homo sapiens
agccugcacagugg

SEQ ID NO: 511604 - RNA, 15 nt, Homo sapiens
agccugcacaguggu

SEQ ID NO: 511605 - RNA, 16 nt, Homo sapiens
agccugucacgugguc

SEQ ID NO: 511606 - RNA, 17 nt, Homo sapiens
agccugucucucccuac

SEQ ID NO: 511607 - RNA, 13 nt, Homo sapiens
agccuugugauca

SEQ ID NO: 511608 - RNA, 17 nt, Homo sapiens
agcguguacuaccccag

SEQ ID NO: 511609 - RNA, 15 nt, Homo sapiens
agcuacugacauucc

SEQ ID NO: 511610 - RNA, 22 nt, Homo sapiens
agcucacagcacauuuguuaau

SEQ ID NO: 511611 - RNA, 18 nt, Homo sapiens
agcucaggcccuggugag

SEQ ID NO: 511612 - RNA, 15 nt, Homo sapiens
agcucauagcacaug

SEQ ID NO: 511613 - RNA, 19 nt, Homo sapiens
agcuccagaauauggaaac

SEQ ID NO: 511614 - RNA, 17 nt, Homo sapiens
agcucuaaagcagagau

SEQ ID NO: 511615 - RNA, 12 nt, Homo sapiens
agcucuguccac

SEQ ID NO: 511616 - RNA, 20 nt, Homo sapiens
agcuguaaaguugcagguug

SEQ ID NO: 511617 - RNA, 21 nt, Homo sapiens
gugugcccacccguguucucc

SEQ ID NO: 511618 - RNA, 15 nt, Homo sapiens
guguggcaaacauuu

SEQ ID NO: 511619 - RNA, 22 nt, Homo sapiens
guguggcuuggaacauuuggga

SEQ ID NO: 511620 - RNA, 13 nt, Homo sapiens
gugugugcaguga

SEQ ID NO: 511621 - RNA, 23 nt, Homo sapiens
guguugggaauugcaugccaucu

SEQ ID NO: 511622 - RNA, 10 nt, Homo sapiens
guuaaugugc

SEQ ID NO: 511623 - RNA, 14 nt, Homo sapiens
guuaaugugccaaa

SEQ ID NO: 511624 - RNA, 22 nt, Homo sapiens
guuagaauuagguaauggauau

SEQ ID NO: 511625 - RNA, 17 nt, Homo sapiens
guuagacaaaagugcuc

SEQ ID NO: 511626 - RNA, 22 nt, Homo sapiens
uaccauguuaauacaucauuuu

SEQ ID NO: 511627 - RNA, 19 nt, Homo sapiens
uacccucugagacagagag

SEQ ID NO: 511628 - RNA, 15 nt, Homo sapiens
uacccuuucccaaac

SEQ ID NO: 511629 - RNA, 23 nt, Homo sapiens
uaccuaugugugugcuuugccac

SEQ ID NO: 511630 - RNA, 19 nt, Homo sapiens
uaccuguacacacacagac

SEQ ID NO: 511631 - RNA, 12 nt, Homo sapiens
uacuaacacugg

SEQ ID NO: 511632 - RNA, 22 nt, Homo sapiens
uacuaccccaggacgcaugcag

SEQ ID NO: 511633 - RNA, 16 nt, Homo sapiens
ucaauacccacugcca

SEQ ID NO: 511634 - RNA, 19 nt, Homo sapiens
ucaaugugcuguugauucu

SEQ ID NO: 511635 - RNA, 23 nt, Homo sapiens
ucaauuggguuuugaucucagca

SEQ ID NO: 511636 - RNA, 16 nt, Homo sapiens
ucaauuuuuaaauuuc

SEQ ID NO: 511637 - RNA, 22 nt, Homo sapiens
ucacaacuuugcuuuuagguug

SEQ ID NO: 511638 - RNA, 15 nt, Homo sapiens
ucacaagccaagguc

SEQ ID NO: 511639 - RNA, 14 nt, Homo sapiens
aaauguauguuggu

SEQ ID NO: 511640 - RNA, 16 nt, Homo sapiens
aaauguguauuaccaa

SEQ ID NO: 511641 - RNA, 17 nt, Homo sapiens
aaauucaguggacauuu

SEQ ID NO: 511642 - RNA, 18 nt, Homo sapiens
aaauucuuaaaucugccu

SEQ ID NO: 511643 - RNA, 19 nt, Homo sapiens
aaauugaaauuauauuaca

SEQ ID NO: 511644 - RNA, 14 nt, Homo sapiens
aaauuugacuguua

SEQ ID NO: 511645 - RNA, 13 nt, Homo sapiens
aaauuuuuacuca

SEQ ID NO: 511646 - RNA, 15 nt, Homo sapiens
aacaaaaacuguugc

SEQ ID NO: 511647 - RNA, 16 nt, Homo sapiens
aacaaagcaugcucag

SEQ ID NO: 511648 - RNA, 16 nt, Homo sapiens
aacaaggaaggacauu

SEQ ID NO: 511649 - RNA, 19 nt, Homo sapiens
aacaauguuuuuuauacuu

SEQ ID NO: 511650 - RNA, 22 nt, Homo sapiens
aacaauguuuuuuauacuucaa

SEQ ID NO: 511651 - RNA, 16 nt, Homo sapiens
aacaauuucugugucc

SEQ ID NO: 511652 - RNA, 16 nt, Homo sapiens
aacacaauacaguacu

SEQ ID NO: 511653 - RNA, 17 nt, Homo sapiens
aacacagcaugcauuua

SEQ ID NO: 511654 - RNA, 20 nt, Homo sapiens
aacacagcaugcauuuagca

SEQ ID NO: 511655 - RNA, 12 nt, Homo sapiens
aacacagugcag

SEQ ID NO: 511656 - RNA, 14 nt, Homo sapiens
aacacaucuaccaa

SEQ ID NO: 511657 - RNA, 14 nt, Homo sapiens
aacacauggcacuu

SEQ ID NO: 511658 - RNA, 16 nt, Homo sapiens
aacacugcagcccucu

SEQ ID NO: 511659 - RNA, 20 nt, Homo sapiens
aacacugcagcccucuccac

SEQ ID NO: 511660 - RNA, 18 nt, Homo sapiens
aacagacauuguuuugcc

SEQ ID NO: 511661 - RNA, 16 nt, Homo sapiens
aacagagaacccugug

SEQ ID NO: 511662 - RNA, 12 nt, Homo sapiens
aacaguaaauau

SEQ ID NO: 511663 - RNA, 12 nt, Homo sapiens
aacagugcagua

SEQ ID NO: 511664 - RNA, 12 nt, Homo sapiens
acagcaugcauu

SEQ ID NO: 511665 - RNA, 18 nt, Homo sapiens
acaggaagcgacgccucu

SEQ ID NO: 511666 - RNA, 19 nt, Homo sapiens
acaggagaaaaugcaauuu

SEQ ID NO: 511667 - RNA, 16 nt, Homo sapiens
acaggagcguguccua

SEQ ID NO: 511668 - RNA, 15 nt, Homo sapiens
acaggaucaaaguug

SEQ ID NO: 511669 - RNA, 12 nt, Homo sapiens
acaggcaugcac

SEQ ID NO: 511670 - RNA, 17 nt, Homo sapiens
acaggcaugcaccagug

SEQ ID NO: 511671 - RNA, 17 nt, Homo sapiens
acagggcugguguggcu

SEQ ID NO: 511672 - RNA, 20 nt, Homo sapiens
acaguacucaggcagugcaa

SEQ ID NO: 511673 - RNA, 19 nt, Homo sapiens
acaguauagauaaauccaa

SEQ ID NO: 511674 - RNA, 14 nt, Homo sapiens
acaguaugacauau

SEQ ID NO: 511675 - RNA, 15 nt, Homo sapiens
acagugcaguacuca

SEQ ID NO: 511676 - RNA, 15 nt, Homo sapiens
acagugcagugcuca

SEQ ID NO: 511677 - RNA, 19 nt, Homo sapiens
acaguggauaugcuagcau

SEQ ID NO: 511678 - RNA, 16 nt, Homo sapiens
acaguguguaguuugu

SEQ ID NO: 511679 - RNA, 14 nt, Homo sapiens
acauaaacacuucu

SEQ ID NO: 511680 - RNA, 21 nt, Homo sapiens
acauaacacacaucaguccac

SEQ ID NO: 511681 - RNA, 14 nt, Homo sapiens
acauacacacacac

SEQ ID NO: 511682 - RNA, 23 nt, Homo sapiens
acauaccucucaacuuacauaug

SEQ ID NO: 511683 - RNA, 22 nt, Homo sapiens
acauaucauucagaaugugcaa

SEQ ID NO: 511684 - RNA, 23 nt, Homo sapiens
acauaucauucagaaugugcaaa

SEQ ID NO: 511685 - RNA, 23 nt, Homo sapiens
acauauucccaugguagacugug

SEQ ID NO: 511686 - RNA, 19 nt, Homo sapiens
acaucuagucucagugcua

SEQ ID NO: 511687 - RNA, 20 nt, Homo sapiens
acaugacccguacacaccac

SEQ ID NO: 511688 - RNA, 23 nt, Homo sapiens
acauuauagauuuucauguucuu

SEQ ID NO: 511689 - RNA, 21 nt, Homo sapiens
auuaagaaacccccucaugga

SEQ ID NO: 511690 - RNA, 19 nt, Homo sapiens
auuaauguagggcagaaua

SEQ ID NO: 511691 - RNA, 21 nt, Homo sapiens
auuacauccucugcuugucau

SEQ ID NO: 511692 - RNA, 16 nt, Homo sapiens
auuacccauaggucuu

SEQ ID NO: 511693 - RNA, 16 nt, Homo sapiens
auuacuggaaguaaga

SEQ ID NO: 511694 - RNA, 17 nt, Homo sapiens
auuagcaccagcuugcu

SEQ ID NO: 511695 - RNA, 16 nt, Homo sapiens
auuaggaaaguacugc

SEQ ID NO: 511696 - RNA, 19 nt, Homo sapiens
auuauagauuuucauguuc

SEQ ID NO: 511697 - RNA, 17 nt, Homo sapiens
auuauagcauguaauau

SEQ ID NO: 511698 - RNA, 19 nt, Homo sapiens
auuauggcuuugugcuugu

SEQ ID NO: 511699 - RNA, 14 nt, Homo sapiens
auucaaaaagccaa

SEQ ID NO: 511700 - RNA, 17 nt, Homo sapiens
auucaaagaaucaccua

SEQ ID NO: 511701 - RNA, 22 nt, Homo sapiens
auucaaagaaucaccuaauuaa

SEQ ID NO: 511702 - RNA, 23 nt, Homo sapiens
auucaaauaacccugaaucagag

SEQ ID NO: 511703 - RNA, 15 nt, Homo sapiens
auucacuacugcaaa

SEQ ID NO: 511704 - RNA, 15 nt, Homo sapiens
auucagaccagggaa

SEQ ID NO: 511705 - RNA, 15 nt, Homo sapiens
auucaguaaggcagu

SEQ ID NO: 511706 - RNA, 10 nt, Homo sapiens
auucagugac

SEQ ID NO: 511707 - RNA, 14 nt, Homo sapiens
auuccaaguguaua

SEQ ID NO: 511708 - RNA, 16 nt, Homo sapiens
auuccaaucauuguua

SEQ ID NO: 511709 - RNA, 17 nt, Homo sapiens
auuccagggaaccagag

SEQ ID NO: 511710 - RNA, 20 nt, Homo sapiens
auucccaugguagacuguga

SEQ ID NO: 511711 - RNA, 22 nt, Homo sapiens
auucccaugguagacugugaca

SEQ ID NO: 511712 - RNA, 19 nt, Homo sapiens
auuccugucagagcuuuca

SEQ ID NO: 511713 - RNA, 15 nt, Homo sapiens
auucuaaaagauaag

SEQ ID NO: 511714 - RNA, 14 nt, Homo sapiens
auucuauaagagac

SEQ ID NO: 511715 - RNA, 21 nt, Homo sapiens
auucugauuauuacaacaagc

SEQ ID NO: 511716 - RNA, 22 nt, Homo sapiens
auucugcuugguuccacaauca

SEQ ID NO: 511717 - RNA, 20 nt, Homo sapiens
auucuuaaaucugccuaguu

SEQ ID NO: 511718 - RNA, 15 nt, Homo sapiens
auugacauguacaga

SEQ ID NO: 511719 - RNA, 20 nt, Homo sapiens
auugauuuuuaaacagcagg

SEQ ID NO: 511720 - RNA, 18 nt, Homo sapiens
auugcacugcaguuauuu

SEQ ID NO: 511721 - RNA, 16 nt, Homo sapiens
auugccuugauguuuc

SEQ ID NO: 511722 - RNA, 14 nt, Homo sapiens
auugcuaguuuaaa

SEQ ID NO: 511723 - RNA, 20 nt, Homo sapiens
auugcuucauuaaaacaaga

SEQ ID NO: 511724 - RNA, 13 nt, Homo sapiens
auuggcagaagca

SEQ ID NO: 511725 - RNA, 22 nt, Homo sapiens
auuguccuguuucuucauauaa

SEQ ID NO: 511726 - RNA, 21 nt, Homo sapiens
auugugaugcauuuaucuuaa

SEQ ID NO: 511727 - RNA, 21 nt, Homo sapiens
auuguucuuguaaaacuguga

SEQ ID NO: 511728 - RNA, 22 nt, Homo sapiens
auuguuuaaagcaacugucuau

SEQ ID NO: 511729 - RNA, 22 nt, Homo sapiens
auuuaaagucuugaauguugaa

SEQ ID NO: 511730 - RNA, 21 nt, Homo sapiens
auuuaggaaagcagugcagua

SEQ ID NO: 511731 - RNA, 19 nt, Homo sapiens
auuuauuuaaaacuaccca

SEQ ID NO: 511732 - RNA, 22 nt, Homo sapiens
auuuccuauuggaaaauacauc

SEQ ID NO: 511733 - RNA, 12 nt, Homo sapiens
auuugaauuaga

SEQ ID NO: 511734 - RNA, 19 nt, Homo sapiens
auuugcauaauaugcauau

SEQ ID NO: 511735 - RNA, 16 nt, Homo sapiens
auuugcugaauaacaa

SEQ ID NO: 511736 - RNA, 15 nt, Homo sapiens
auuuggcauuccuga

SEQ ID NO: 511737 - RNA, 13 nt, Homo sapiens
auuuguuaaugau

SEQ ID NO: 511738 - RNA, 17 nt, Homo sapiens
auuuguucagaucucau

SEQ ID NO: 511739 - RNA, 20 nt, Homo sapiens
auuuuaaaugacgcacaaac

SEQ ID NO: 511740 - RNA, 19 nt, Homo sapiens
auuuuauugcuggaaucua

SEQ ID NO: 511741 - RNA, 15 nt, Homo sapiens
auuuucacaugaaca

SEQ ID NO: 511742 - RNA, 16 nt, Homo sapiens
auuuuggacgugugag

SEQ ID NO: 511743 - RNA, 19 nt, Homo sapiens
caaaaacuguacuguguuu

SEQ ID NO: 511744 - RNA, 19 nt, Homo sapiens
caaaaacuuuccaugacag

SEQ ID NO: 511745 - RNA, 11 nt, Homo sapiens
caaaaagccaa

SEQ ID NO: 511746 - RNA, 22 nt, Homo sapiens
caaaacagauauacucgaauca

SEQ ID NO: 511747 - RNA, 20 nt, Homo sapiens
caaaaugaaugccaguccag

SEQ ID NO: 511748 - RNA, 18 nt, Homo sapiens
caaaaugucauagcuuau

SEQ ID NO: 511749 - RNA, 12 nt, Homo sapiens
caaacaaacaaa

SEQ ID NO: 511750 - RNA, 15 nt, Homo sapiens
caaacaaacaaaaac

SEQ ID NO: 511751 - RNA, 16 nt, Homo sapiens
caaacaggugcuaaca

SEQ ID NO: 511752 - RNA, 15 nt, Homo sapiens
caaaccuacugccca

SEQ ID NO: 511753 - RNA, 13 nt, Homo sapiens
caaacuccaagac

SEQ ID NO: 511754 - RNA, 12 nt, Homo sapiens
caaacugaagau

SEQ ID NO: 511755 - RNA, 20 nt, Homo sapiens
caaagaacugccccaucucc

SEQ ID NO: 511756 - RNA, 13 nt, Homo sapiens
caaagauccagcg

SEQ ID NO: 511757 - RNA, 14 nt, Homo sapiens
caaagcauuugacu

SEQ ID NO: 511758 - RNA, 22 nt, Homo sapiens
caaagcccacuucacacauuua

SEQ ID NO: 511759 - RNA, 22 nt, Homo sapiens
caaaggccguuagggaaaucca

SEQ ID NO: 511760 - RNA, 16 nt, Homo sapiens
caaauaauauugccuu

SEQ ID NO: 511761 - RNA, 14 nt, Homo sapiens
caaauacacauaca

SEQ ID NO: 511762 - RNA, 15 nt, Homo sapiens
caaauacacauacau

SEQ ID NO: 511763 - RNA, 19 nt, Homo sapiens
caaaugccuuucuagcaau

SEQ ID NO: 511764 - RNA, 22 nt, Homo sapiens
caaaugccuuucuagcaauugc

SEQ ID NO: 511765 - RNA, 15 nt, Homo sapiens
caaauggauguaaua

SEQ ID NO: 511766 - RNA, 21 nt, Homo sapiens
caacaauuuaggaaugcucaa

SEQ ID NO: 511767 - RNA, 15 nt, Homo sapiens
caacacaccuugccc

SEQ ID NO: 511768 - RNA, 16 nt, Homo sapiens
caacacaccuugccca

SEQ ID NO: 511769 - RNA, 17 nt, Homo sapiens
caacagcugugugugcc

SEQ ID NO: 511770 - RNA, 15 nt, Homo sapiens
caaccagagcacugu

SEQ ID NO: 511771 - RNA, 16 nt, Homo sapiens
caaccagagcacugua

SEQ ID NO: 511772 - RNA, 20 nt, Homo sapiens
caacccaaaugguggccauu

SEQ ID NO: 511773 - RNA, 22 nt, Homo sapiens
caacccugugcaugacugaugu

SEQ ID NO: 511774 - RNA, 19 nt, Homo sapiens
caaccucggggagugccac

SEQ ID NO: 511775 - RNA, 14 nt, Homo sapiens
caacgggucugugg

SEQ ID NO: 511776 - RNA, 14 nt, Homo sapiens
caacuccaggguua

SEQ ID NO: 511777 - RNA, 22 nt, Homo sapiens
caacuccaggguuaaagaaagg

SEQ ID NO: 511778 - RNA, 15 nt, Homo sapiens
caagacuauguucuc

SEQ ID NO: 511779 - RNA, 12 nt, Homo sapiens
caagacuucaaa

SEQ ID NO: 511780 - RNA, 13 nt, Homo sapiens
caagagacaguau

SEQ ID NO: 511781 - RNA, 14 nt, Homo sapiens
caagcucuucauug

SEQ ID NO: 511782 - RNA, 17 nt, Homo sapiens
caagcugugacccucaa

SEQ ID NO: 511783 - RNA, 19 nt, Homo sapiens
aagugcucacgugcagcuc

SEQ ID NO: 511784 - RNA, 15 nt, Homo sapiens
aagugcucaguauug

SEQ ID NO: 511785 - RNA, 16 nt, Homo sapiens
aagugcuugaggccaa

SEQ ID NO: 511786 - RNA, 19 nt, Homo sapiens
aagugguaggaaagccuca

SEQ ID NO: 511787 - RNA, 14 nt, Homo sapiens
aaguguguuugcaa

SEQ ID NO: 511788 - RNA, 16 nt, Homo sapiens
aaguuaaucuucaugg

SEQ ID NO: 511789 - RNA, 19 nt, Homo sapiens
aaguuaccauuaaccaagg

SEQ ID NO: 511790 - RNA, 11 nt, Homo sapiens
aaguugcaguu

SEQ ID NO: 511791 - RNA, 19 nt, Homo sapiens
aaguuuauaucuugauuau

SEQ ID NO: 511792 - RNA, 15 nt, Homo sapiens
aaguuuucugcugua

SEQ ID NO: 511793 - RNA, 19 nt, Homo sapiens
aaguuuugccuauccuaag

SEQ ID NO: 511794 - RNA, 21 nt, Homo sapiens
aauaaaaauacgguggcaaua

SEQ ID NO: 511795 - RNA, 13 nt, Homo sapiens
aauaaaagccucu

SEQ ID NO: 511796 - RNA, 13 nt, Homo sapiens
aauaaaaugauua

SEQ ID NO: 511797 - RNA, 22 nt, Homo sapiens
aauaaagccuugugaucacuuu

SEQ ID NO: 511798 - RNA, 15 nt, Homo sapiens
aauaagcaucugugu

SEQ ID NO: 511799 - RNA, 16 nt, Homo sapiens
aauacaauacaguacu

SEQ ID NO: 511800 - RNA, 23 nt, Homo sapiens
aauacacauacauauauacauuu

SEQ ID NO: 511801 - RNA, 12 nt, Homo sapiens
aauacaugccuu

SEQ ID NO: 511802 - RNA, 21 nt, Homo sapiens
aauagcucacagcacauuugu

SEQ ID NO: 511803 - RNA, 13 nt, Homo sapiens
aauagcuuuucac

SEQ ID NO: 511804 - RNA, 23 nt, Homo sapiens
aauaguaaaggaaagcaguguug

SEQ ID NO: 511805 - RNA, 17 nt, Homo sapiens
aauaguguguccaugca

SEQ ID NO: 511806 - RNA, 12 nt, Homo sapiens
aauauaaacugu

SEQ ID NO: 511807 - RNA, 16 nt, Homo sapiens
aauauacucauuugga

SEQ ID NO: 511808 - RNA, 16 nt, Homo sapiens
caaggacaaccugccc

SEQ ID NO: 511809 - RNA, 14 nt, Homo sapiens
caaggcugcaguga

SEQ ID NO: 511810 - RNA, 17 nt, Homo sapiens
caaggcugcagugagcc

SEQ ID NO: 511811 - RNA, 12 nt, Homo sapiens
caaggugggggu

SEQ ID NO: 511812 - RNA, 12 nt, Homo sapiens
caaguaaaguau

SEQ ID NO: 511813 - RNA, 14 nt, Homo sapiens
caagucuaguggaa

SEQ ID NO: 511814 - RNA, 16 nt, Homo sapiens
caaguugccacauugc

SEQ ID NO: 511815 - RNA, 17 nt, Homo sapiens
caaguuggagugcagug

SEQ ID NO: 511816 - RNA, 16 nt, Homo sapiens
caaguuuuugguaaug

SEQ ID NO: 511817 - RNA, 17 nt, Homo sapiens
caauaaacucagucaaa

SEQ ID NO: 511818 - RNA, 15 nt, Homo sapiens
caauaagaaacaguu

SEQ ID NO: 511819 - RNA, 13 nt, Homo sapiens
caauacaguacuc

SEQ ID NO: 511820 - RNA, 13 nt, Homo sapiens
caauauaaaugga

SEQ ID NO: 511821 - RNA, 17 nt, Homo sapiens
caaucaucuauugagug

SEQ ID NO: 511822 - RNA, 14 nt, Homo sapiens
caaucuugcuguga

SEQ ID NO: 511823 - RNA, 16 nt, Homo sapiens
caaugaacucuuuccc

SEQ ID NO: 511824 - RNA, 18 nt, Homo sapiens
caaugccugccugaacaa

SEQ ID NO: 511825 - RNA, 22 nt, Homo sapiens
caaugcucaguaacacagugca

SEQ ID NO: 511826 - RNA, 23 nt, Homo sapiens
caaugugcuguugauucuuucaa

SEQ ID NO: 511827 - RNA, 19 nt, Homo sapiens
caauguuccguucaucuga

SEQ ID NO: 511828 - RNA, 18 nt, Homo sapiens
caauguuuuuuauacuuc

SEQ ID NO: 511829 - RNA, 20 nt, Homo sapiens
cacaaccuccuccuccaguu

SEQ ID NO: 511830 - RNA, 21 nt, Homo sapiens
cacaacuugccaaaacagaua

SEQ ID NO: 511831 - RNA, 22 nt, Homo sapiens
caguaaggcagugcaguacuca

SEQ ID NO: 511832 - RNA, 15 nt, Homo sapiens
caguaauacaguaca

SEQ ID NO: 511833 - RNA, 14 nt, Homo sapiens
caguacaguacuca

SEQ ID NO: 511834 - RNA, 13 nt, Homo sapiens
caguacucaguaa

SEQ ID NO: 511835 - RNA, 16 nt, Homo sapiens
caguacuuaccaguca

SEQ ID NO: 511836 - RNA, 17 nt, Homo sapiens
caguagaggguccaguc

SEQ ID NO: 511837 - RNA, 17 nt, Homo sapiens
caguagugccugugauc

SEQ ID NO: 511838 - RNA, 15 nt, Homo sapiens
cagucaauugcuuga

SEQ ID NO: 511839 - RNA, 21 nt, Homo sapiens
cagucacuuguuuguguuuga

SEQ ID NO: 511840 - RNA, 21 nt, Homo sapiens
cagucaguauuguuuugguuu

SEQ ID NO: 511841 - RNA, 21 nt, Homo sapiens
caguccccagguaucugauga

SEQ ID NO: 511842 - RNA, 18 nt, Homo sapiens
cagucccuggagcugucc

SEQ ID NO: 511843 - RNA, 20 nt, Homo sapiens
cagucuggugcccagacuca

SEQ ID NO: 511844 - RNA, 19 nt, Homo sapiens
cagugagucagaggcagaa

SEQ ID NO: 511845 - RNA, 13 nt, Homo sapiens
cagugcaguacuc

SEQ ID NO: 511846 - RNA, 18 nt, Homo sapiens
cagugcagugcucaguaa

SEQ ID NO: 511847 - RNA, 16 nt, Homo sapiens
cagugcauguugccau

SEQ ID NO: 511848 - RNA, 20 nt, Homo sapiens
cagugcauguugccaugagg

SEQ ID NO: 511849 - RNA, 17 nt, Homo sapiens
caguguagaucaacuca

SEQ ID NO: 511850 - RNA, 15 nt, Homo sapiens
caguuaaugugccaa

SEQ ID NO: 511851 - RNA, 20 nt, Homo sapiens
caguucacacugcagagcua

SEQ ID NO: 511852 - RNA, 16 nt, Homo sapiens
cuuuacuaacacuggc

SEQ ID NO: 511853 - RNA, 17 nt, Homo sapiens
cuuuagagaagccauaa

SEQ ID NO: 511854 - RNA, 14 nt, Homo sapiens
cuuuaucauuucuc

SEQ ID NO: 511855 - RNA, 14 nt, Homo sapiens
cuuucaacaauggg

SEQ ID NO: 511856 - RNA, 14 nt, Homo sapiens
cuuucaauccacag

SEQ ID NO: 511857 - RNA, 15 nt, Homo sapiens
cuuucccgaugcgug

SEQ ID NO: 511858 - RNA, 21 nt, Homo sapiens
cuuuccucuuaaugucucaaa

SEQ ID NO: 511859 - RNA, 13 nt, Homo sapiens
cuuucugagugac

SEQ ID NO: 511860 - RNA, 15 nt, Homo sapiens
cuuucugauacuuau

SEQ ID NO: 511861 - RNA, 21 nt, Homo sapiens
cuuucuuuaacauaucauuca

SEQ ID NO: 511862 - RNA, 16 nt, Homo sapiens
cuuugcaggcccagca

SEQ ID NO: 511863 - RNA, 14 nt, Homo sapiens
cuuugcugcaagag

SEQ ID NO: 511864 - RNA, 15 nt, Homo sapiens
cuuuggaucaggaaa

SEQ ID NO: 511865 - RNA, 19 nt, Homo sapiens
cuuugggaggcugagaugg

SEQ ID NO: 511866 - RNA, 17 nt, Homo sapiens
cuuugucuaauuaauua

SEQ ID NO: 511867 - RNA, 15 nt, Homo sapiens
cuuugucuuaucuac

SEQ ID NO: 511868 - RNA, 11 nt, Homo sapiens
cuuuguuaaaa

SEQ ID NO: 511869 - RNA, 15 nt, Homo sapiens
cuuuuaaaucaaaau

SEQ ID NO: 511870 - RNA, 19 nt, Homo sapiens
cuuuuacagucacauucag

SEQ ID NO: 511871 - RNA, 16 nt, Homo sapiens
cuuuucacuucuuaag

SEQ ID NO: 511872 - RNA, 14 nt, Homo sapiens
cuuuuccaaccuac

SEQ ID NO: 511873 - RNA, 16 nt, Homo sapiens
cuuuugucauguggcu

SEQ ID NO: 511874 - RNA, 21 nt, Homo sapiens
cuuuuuaauuggcccuguaca

SEQ ID NO: 511875 - RNA, 22 nt, Homo sapiens
cuuuuuauuagguuaagucuca

SEQ ID NO: 511876 - RNA, 16 nt, Homo sapiens
cuuuuuuccugucaau

SEQ ID NO: 511877 - RNA, 18 nt, Homo sapiens
cuuuuuuuucuucaccuc

SEQ ID NO: 511878 - RNA, 20 nt, Homo sapiens
cuuuuuuuucuucaccucac

SEQ ID NO: 511879 - RNA, 15 nt, Homo sapiens
gaaaaagcccucuuc

SEQ ID NO: 511880 - RNA, 13 nt, Homo sapiens
gaaaagcacuuua

SEQ ID NO: 511881 - RNA, 21 nt, Homo sapiens
gaaaagcacuuuacagaugag

SEQ ID NO: 511882 - RNA, 21 nt, Homo sapiens
gaaaauaguggcaggacuguc

SEQ ID NO: 511883 - RNA, 19 nt, Homo sapiens
gaaaauuuuugucuuucau

SEQ ID NO: 511884 - RNA, 15 nt, Homo sapiens
gaaacaaagcauuug

SEQ ID NO: 511885 - RNA, 19 nt, Homo sapiens
gaaacugacuugcugugac

SEQ ID NO: 511886 - RNA, 15 nt, Homo sapiens
gaaacuuggacauuu

SEQ ID NO: 511887 - RNA, 17 nt, Homo sapiens
gaaacuuggacauuuau

SEQ ID NO: 511888 - RNA, 19 nt, Homo sapiens
gaaagacaguaaagaccau

SEQ ID NO: 511889 - RNA, 13 nt, Homo sapiens
gaaagcccuucuc

SEQ ID NO: 511890 - RNA, 22 nt, Homo sapiens
gaaagucaagucuaccugccuu

SEQ ID NO: 511891 - RNA, 14 nt, Homo sapiens
gaaaguugcaguuu

SEQ ID NO: 511892 - RNA, 19 nt, Homo sapiens
gaaauaaaagccucuggug

SEQ ID NO: 511893 - RNA, 21 nt, Homo sapiens
gaaauaaaagccucuggugga

SEQ ID NO: 511894 - RNA, 17 nt, Homo sapiens
gaaauaaagaguucucc

SEQ ID NO: 511895 - RNA, 13 nt, Homo sapiens
gaaauacuugaaa

SEQ ID NO: 511896 - RNA, 15 nt, Homo sapiens
gaaauacuugacaac

SEQ ID NO: 511897 - RNA, 15 nt, Homo sapiens
gaaauaucugugaag

SEQ ID NO: 511898 - RNA, 13 nt, Homo sapiens
gaaauauucacaa

SEQ ID NO: 511899 - RNA, 18 nt, Homo sapiens
gaaauuauaucugugguc

SEQ ID NO: 511900 - RNA, 18 nt, Homo sapiens
gaaccaacgggucugugg

SEQ ID NO: 511901 - RNA, 15 nt, Homo sapiens
gaacugcaacacugg

SEQ ID NO: 511902 - RNA, 16 nt, Homo sapiens
gaacugcaacacugga

SEQ ID NO: 511903 - RNA, 17 nt, Homo sapiens
gaacugccccaucuccu

SEQ ID NO: 511904 - RNA, 14 nt, Homo sapiens
gaagacucaguaug

SEQ ID NO: 511905 - RNA, 19 nt, Homo sapiens
gaagagccugacuguguuc

SEQ ID NO: 511906 - RNA, 11 nt, Homo sapiens
gaagauguuua

SEQ ID NO: 511907 - RNA, 16 nt, Homo sapiens
gaagcagccuccacuu

SEQ ID NO: 511908 - RNA, 22 nt, Homo sapiens
gaagcaguugcaauaaacucag

SEQ ID NO: 511909 - RNA, 21 nt, Homo sapiens
gaagcccucugagcuccagag

SEQ ID NO: 511910 - RNA, 16 nt, Homo sapiens
gaaguagacauggaau

SEQ ID NO: 511911 - RNA, 18 nt, Homo sapiens
gaaguagccaacagcgaa

SEQ ID NO: 511912 - RNA, 18 nt, Homo sapiens
gaaguuugguuucuuugc

SEQ ID NO: 511913 - RNA, 15 nt, Homo sapiens
gaaguuuuaggugcu

SEQ ID NO: 511914 - RNA, 17 nt, Homo sapiens
gaauaagggacuuugga

SEQ ID NO: 511915 - RNA, 16 nt, Homo sapiens
gaaucaaaaauugaag

SEQ ID NO: 511916 - RNA, 12 nt, Homo sapiens
gaauccauauca

SEQ ID NO: 511917 - RNA, 21 nt, Homo sapiens
gaauccaucaggacuugggaa

SEQ ID NO: 511918 - RNA, 20 nt, Homo sapiens
gaauccccgugcucacagua

SEQ ID NO: 511919 - RNA, 21 nt, Homo sapiens
gaaugaaauauaaacugugag

SEQ ID NO: 511920 - RNA, 17 nt, Homo sapiens
gaaugaguuuccagcua

SEQ ID NO: 511921 - RNA, 19 nt, Homo sapiens
gaaugguuaaaauguaggc

SEQ ID NO: 511922 - RNA, 15 nt, Homo sapiens
gaauuagguaaugga

SEQ ID NO: 511923 - RNA, 16 nt, Homo sapiens
gaauuauuagcaccag

SEQ ID NO: 511924 - RNA, 14 nt, Homo sapiens
gaauugcaugccau

SEQ ID NO: 511925 - RNA, 15 nt, Homo sapiens
gaauugcaugccauc

SEQ ID NO: 511926 - RNA, 18 nt, Homo sapiens
gaauugcaugccaucucc

SEQ ID NO: 511927 - RNA, 20 nt, Homo sapiens
gacaacauuuuucauagaua

SEQ ID NO: 511928 - RNA, 22 nt, Homo sapiens
gacaagugacuuauuugcucau

SEQ ID NO: 511929 - RNA, 14 nt, Homo sapiens
gacacuacaaacau

SEQ ID NO: 511930 - RNA, 10 nt, Homo sapiens
gacacugucu

SEQ ID NO: 511931 - RNA, 18 nt, Homo sapiens
gacagaggauuucugcuu

SEQ ID NO: 511932 - RNA, 17 nt, Homo sapiens
gacagccugcacagugg

SEQ ID NO: 511933 - RNA, 20 nt, Homo sapiens
gacaguuagagaugcugauu

SEQ ID NO: 511934 - RNA, 16 nt, Homo sapiens
gacauauuacuggaag

SEQ ID NO: 511935 - RNA, 15 nt, Homo sapiens
gacauuguuuugcca

SEQ ID NO: 511936 - RNA, 17 nt, Homo sapiens
gacauuuauguacaaaa

SEQ ID NO: 511937 - RNA, 12 nt, Homo sapiens
gaccaugcauuc

SEQ ID NO: 511938 - RNA, 12 nt, Homo sapiens
gacccaugaccg

SEQ ID NO: 511939 - RNA, 17 nt, Homo sapiens
gacccauguucucaaua

SEQ ID NO: 511940 - RNA, 12 nt, Homo sapiens
gaccccaucuca

SEQ ID NO: 511941 - RNA, 13 nt, Homo sapiens
gaccccaucucau

SEQ ID NO: 511942 - RNA, 23 nt, Homo sapiens
gacccucaccugaauaagggacu

SEQ ID NO: 511943 - RNA, 14 nt, Homo sapiens
gacccuccugucca

SEQ ID NO: 511944 - RNA, 15 nt, Homo sapiens
gacccuccuguccag

SEQ ID NO: 511945 - RNA, 19 nt, Homo sapiens
gaccucccugucucuacaa

SEQ ID NO: 511946 - RNA, 14 nt, Homo sapiens
gacggaaguggccu

SEQ ID NO: 511947 - RNA, 21 nt, Homo sapiens
gacucucacgauaugcaaguu

SEQ ID NO: 511948 - RNA, 18 nt, Homo sapiens
gacugaccuucggcagug

SEQ ID NO: 511949 - RNA, 12 nt, Homo sapiens
gacugggcugcu

SEQ ID NO: 511950 - RNA, 11 nt, Homo sapiens
gacuguguuca

SEQ ID NO: 511951 - RNA, 17 nt, Homo sapiens
gacuguuagacaaaagu

SEQ ID NO: 511952 - RNA, 22 nt, Homo sapiens
gacuguuuccagagugcuuaua

SEQ ID NO: 511953 - RNA, 15 nt, Homo sapiens
gacuucuaaaucaua

SEQ ID NO: 511954 - RNA, 15 nt, Homo sapiens
gagccccuguuucuc

SEQ ID NO: 511955 - RNA, 14 nt, Homo sapiens
gagccugacugugu

SEQ ID NO: 511956 - RNA, 13 nt, Homo sapiens
gagcggcuucccc

SEQ ID NO: 511957 - RNA, 20 nt, Homo sapiens
gagcugggcaccacaggcug

SEQ ID NO: 511958 - RNA, 23 nt, Homo sapiens
gagcuuccagugcauguugccau

SEQ ID NO: 511959 - RNA, 15 nt, Homo sapiens
gaggacggcuucccc

SEQ ID NO: 511960 - RNA, 16 nt, Homo sapiens
gaggcaggaccaggca

SEQ ID NO: 511961 - RNA, 14 nt, Homo sapiens
gaggcggcacauug

SEQ ID NO: 511962 - RNA, 18 nt, Homo sapiens
gaggcugagacgcaagga

SEQ ID NO: 511963 - RNA, 15 nt, Homo sapiens
gagguugugcugccu

SEQ ID NO: 511964 - RNA, 22 nt, Homo sapiens
gaguauggugcuggguccuuaa

SEQ ID NO: 511965 - RNA, 13 nt, Homo sapiens
gaguggaucugga

SEQ ID NO: 511966 - RNA, 15 nt, Homo sapiens
gaguuauuuuguguc

SEQ ID NO: 511967 - RNA, 23 nt, Homo sapiens
gaguuuccagcuaagccugauga

SEQ ID NO: 511968 - RNA, 17 nt, Homo sapiens
gauaaauuugacuguua

SEQ ID NO: 511969 - RNA, 18 nt, Homo sapiens
gauaaauuugacuguuau

SEQ ID NO: 511970 - RNA, 15 nt, Homo sapiens
gauacgcuccaguac

SEQ ID NO: 511971 - RNA, 14 nt, Homo sapiens
gauauaagccauag

SEQ ID NO: 511972 - RNA, 18 nt, Homo sapiens
gauauacucgaaucagac

SEQ ID NO: 511973 - RNA, 15 nt, Homo sapiens
gaucaacucauguua

SEQ ID NO: 511974 - RNA, 18 nt, Homo sapiens
gaucaauuaccuaacugu

SEQ ID NO: 511975 - RNA, 21 nt, Homo sapiens
gaucuaaaaggaggacaggga

SEQ ID NO: 511976 - RNA, 19 nt, Homo sapiens
gaucuagugccauuauuuc

SEQ ID NO: 511977 - RNA, 15 nt, Homo sapiens
gaucuauaccaccuu

SEQ ID NO: 511978 - RNA, 12 nt, Homo sapiens
gaucugcauaac

SEQ ID NO: 511979 - RNA, 19 nt, Homo sapiens
gaugaaaaccacccuauca

SEQ ID NO: 511980 - RNA, 20 nt, Homo sapiens
gaugcugcugagcacaucuc

SEQ ID NO: 511981 - RNA, 20 nt, Homo sapiens
gauggguuuuguuaggggug

SEQ ID NO: 511982 - RNA, 22 nt, Homo sapiens
gaugugaguuuaaucuuuucag

SEQ ID NO: 511983 - RNA, 16 nt, Homo sapiens
gaugugccuagacacg

SEQ ID NO: 511984 - RNA, 21 nt, Homo sapiens
gauguggauggaggugaugaa

SEQ ID NO: 511985 - RNA, 15 nt, Homo sapiens
gauuccccuggacau

SEQ ID NO: 511986 - RNA, 17 nt, Homo sapiens
gauucuaaauguucaug

SEQ ID NO: 511987 - RNA, 23 nt, Homo sapiens
gauucuagguugaaaauguuaua

SEQ ID NO: 511988 - RNA, 18 nt, Homo sapiens
gauugagagcagccucuu

SEQ ID NO: 511989 - RNA, 22 nt, Homo sapiens
gauugguaccagagccuaugga

SEQ ID NO: 511990 - RNA, 12 nt, Homo sapiens
gauuuaugcauu

SEQ ID NO: 511991 - RNA, 18 nt, Homo sapiens
gauuuccaaaaguacuag

SEQ ID NO: 511992 - RNA, 12 nt, Homo sapiens
gauuuguuuaaa

SEQ ID NO: 511993 - RNA, 17 nt, Homo sapiens
gcaaaaccaacucucua

SEQ ID NO: 511994 - RNA, 14 nt, Homo sapiens
gcaaauaaauauca

SEQ ID NO: 511995 - RNA, 21 nt, Homo sapiens
gcaagagguuucagcauuccc

SEQ ID NO: 511996 - RNA, 13 nt, Homo sapiens
gcaauaacaguuu

SEQ ID NO: 511997 - RNA, 15 nt, Homo sapiens
gcaauaauugacaaa

SEQ ID NO: 511998 - RNA, 13 nt, Homo sapiens
gcaauuguauaua

SEQ ID NO: 511999 - RNA, 21 nt, Homo sapiens
gcaauuguauauauaugugaa

SEQ ID NO: 512000 - RNA, 12 nt, Homo sapiens
gcacacauaaca

SEQ ID NO: 512001 - RNA, 19 nt, Homo sapiens
gcacagagagcggcuuccc

SEQ ID NO: 512002 - RNA, 19 nt, Homo sapiens
gcacagaggauggcuuccc

SEQ ID NO: 512003 - RNA, 12 nt, Homo sapiens
gcacaguacuca

SEQ ID NO: 512004 - RNA, 11 nt, Homo sapiens
gcacaguauuu

SEQ ID NO: 512005 - RNA, 14 nt, Homo sapiens
gcacauuuguuaau

SEQ ID NO: 512006 - RNA, 13 nt, Homo sapiens
gcaccucuugaag

SEQ ID NO: 512007 - RNA, 22 nt, Homo sapiens
gcacuaaaagugaugugauuua

SEQ ID NO: 512008 - RNA, 13 nt, Homo sapiens
gcacugcccuccg

SEQ ID NO: 512009 - RNA, 21 nt, Homo sapiens
gcagaaaaccuaccacauuca

SEQ ID NO: 512010 - RNA, 12 nt, Homo sapiens
gcagaaagccag

SEQ ID NO: 512011 - RNA, 19 nt, Homo sapiens
gcagaaggugaaauggagg

SEQ ID NO: 512012 - RNA, 14 nt, Homo sapiens
gcagcuaguacuca

SEQ ID NO: 512013 - RNA, 13 nt, Homo sapiens
gcagcuauggaca

SEQ ID NO: 512014 - RNA, 15 nt, Homo sapiens
gcagggaagggugcc

SEQ ID NO: 512015 - RNA, 17 nt, Homo sapiens
gcagggcccccacagga

SEQ ID NO: 512016 - RNA, 15 nt, Homo sapiens
gcagucagcacagag

SEQ ID NO: 512017 - RNA, 18 nt, Homo sapiens
gcagugcagcaaccagag

SEQ ID NO: 512018 - RNA, 17 nt, Homo sapiens
gcagugcaguacucagu

SEQ ID NO: 512019 - RNA, 21 nt, Homo sapiens
gcaguggagaggggacuugga

SEQ ID NO: 512020 - RNA, 18 nt, Homo sapiens
gcagugugucacacugag

SEQ ID NO: 512021 - RNA, 14 nt, Homo sapiens
gcaguuaggugcug

SEQ ID NO: 512022 - RNA, 15 nt, Homo sapiens
gcauaauaugcauau

SEQ ID NO: 512023 - RNA, 13 nt, Homo sapiens
gcauagccauuca

SEQ ID NO: 512024 - RNA, 12 nt, Homo sapiens
gcauaguacuca

SEQ ID NO: 512025 - RNA, 21 nt, Homo sapiens
gcaucugccaggacacugccu

SEQ ID NO: 512026 - RNA, 21 nt, Homo sapiens
gcaugacacgaauauugcuga

SEQ ID NO: 512027 - RNA, 17 nt, Homo sapiens
gcaugacugauguuggg

SEQ ID NO: 512028 - RNA, 15 nt, Homo sapiens
gcauuuagcacagua

SEQ ID NO: 512029 - RNA, 22 nt, Homo sapiens
gccaaaauagagaguauacagu

SEQ ID NO: 512030 - RNA, 15 nt, Homo sapiens
gccaauucaucucag

SEQ ID NO: 512031 - RNA, 23 nt, Homo sapiens
gccacacucccaaacuccaagac

SEQ ID NO: 512032 - RNA, 15 nt, Homo sapiens
gccaggacacugccu

SEQ ID NO: 512033 - RNA, 15 nt, Homo sapiens
gccaggccucaggga

SEQ ID NO: 512034 - RNA, 19 nt, Homo sapiens
gccaggccucagggaccaa

SEQ ID NO: 512035 - RNA, 22 nt, Homo sapiens
gccaggccucagggaccaagga

SEQ ID NO: 512036 - RNA, 18 nt, Homo sapiens
gccaggggcaggcagcua

SEQ ID NO: 512037 - RNA, 22 nt, Homo sapiens
gccagggugggaagagaagaaa

SEQ ID NO: 512038 - RNA, 20 nt, Homo sapiens
gccauauucuguaguauuuu

SEQ ID NO: 512039 - RNA, 13 nt, Homo sapiens
gccaucauuucau

SEQ ID NO: 512040 - RNA, 22 nt, Homo sapiens
gccaugaggccuuuccccagug

SEQ ID NO: 512041 - RNA, 20 nt, Homo sapiens
gccauguauguugcaugaau

SEQ ID NO: 512042 - RNA, 16 nt, Homo sapiens
gccauugaacacugca

SEQ ID NO: 512043 - RNA, 18 nt, Homo sapiens
gcccacaacuugccaaaa

SEQ ID NO: 512044 - RNA, 19 nt, Homo sapiens
gcccagccuaucucucuuc

SEQ ID NO: 512045 - RNA, 21 nt, Homo sapiens
gcccagggagguggcagggaa

SEQ ID NO: 512046 - RNA, 17 nt, Homo sapiens
gcccagucccuggagcu

SEQ ID NO: 512047 - RNA, 17 nt, Homo sapiens
gcccaguuagcccggcc

SEQ ID NO: 512048 - RNA, 18 nt, Homo sapiens
gccccauuauucauucuc

SEQ ID NO: 512049 - RNA, 14 nt, Homo sapiens
gccccccuucccac

SEQ ID NO: 512050 - RNA, 20 nt, Homo sapiens
gcccccucgcgccccugucc

SEQ ID NO: 512051 - RNA, 17 nt, Homo sapiens
gcccccucucuuacccc

SEQ ID NO: 512052 - RNA, 14 nt, Homo sapiens
gccccuccucgggc

SEQ ID NO: 512053 - RNA, 16 nt, Homo sapiens
gccccucuuagaagaa

SEQ ID NO: 512054 - RNA, 18 nt, Homo sapiens
gcccgacaggcaugcacc

SEQ ID NO: 512055 - RNA, 17 nt, Homo sapiens
gcccgaccccaucucau

SEQ ID NO: 512056 - RNA, 16 nt, Homo sapiens
gcccucccucccucca

SEQ ID NO: 512057 - RNA, 23 nt, Homo sapiens
ugagcaugcucccucaugcagau

SEQ ID NO: 512058 - RNA, 20 nt, Homo sapiens
ugagccacuggcagugugcu

SEQ ID NO: 512059 - RNA, 18 nt, Homo sapiens
ugagccagcagacauugu

SEQ ID NO: 512060 - RNA, 17 nt, Homo sapiens
ugagccugucacguggu

SEQ ID NO: 512061 - RNA, 14 nt, Homo sapiens
ugagcuugauucua

SEQ ID NO: 512062 - RNA, 22 nt, Homo sapiens
ugaggccaagaguuugagacca

SEQ ID NO: 512063 - RNA, 20 nt, Homo sapiens
ugaggcggggagcaugaaga

SEQ ID NO: 512064 - RNA, 15 nt, Homo sapiens
ugaggucuuugcauu

SEQ ID NO: 512065 - RNA, 15 nt, Homo sapiens
ugagguugugcugcc

SEQ ID NO: 512066 - RNA, 21 nt, Homo sapiens
ugagugacaugggugugccag

SEQ ID NO: 512067 - RNA, 22 nt, Homo sapiens
ugaguggcugaaauaaaagccu

SEQ ID NO: 512068 - RNA, 16 nt, Homo sapiens
ugagugugcagacagc

SEQ ID NO: 512069 - RNA, 14 nt, Homo sapiens
ugauaaauuugacu

SEQ ID NO: 512070 - RNA, 14 nt, Homo sapiens
ugauaacagaguga

SEQ ID NO: 512071 - RNA, 12 nt, Homo sapiens
ugauacuugguc

SEQ ID NO: 512072 - RNA, 16 nt, Homo sapiens
ugaucuauaccaccuu

SEQ ID NO: 512073 - RNA, 15 nt, Homo sapiens
ugaugaaaaccaccc

SEQ ID NO: 512074 - RNA, 19 nt, Homo sapiens
ugaugaaguuguacaacac

SEQ ID NO: 512075 - RNA, 19 nt, Homo sapiens
ugaugagacaacacacaca

SEQ ID NO: 512076 - RNA, 12 nt, Homo sapiens
ugaugauguucu

SEQ ID NO: 512077 - RNA, 20 nt, Homo sapiens
ugauggccaggccucaggga

SEQ ID NO: 512078 - RNA, 21 nt, Homo sapiens
ugauggccaggccucagggac

SEQ ID NO: 512079 - RNA, 20 nt, Homo sapiens
ugauucaaauaacccugaau

SEQ ID NO: 512080 - RNA, 18 nt, Homo sapiens
ugauucauuuauuugaca

SEQ ID NO: 512081 - RNA, 13 nt, Homo sapiens
ugauucuaaaggg

SEQ ID NO: 512082 - RNA, 21 nt, Homo sapiens
ugauugagagcagccucuuga

SEQ ID NO: 512083 - RNA, 19 nt, Homo sapiens
ugauuuauucuggugucua

SEQ ID NO: 512084 - RNA, 17 nt, Homo sapiens
ugcaaccuuguacuuua

SEQ ID NO: 512085 - RNA, 18 nt, Homo sapiens
ugcaauaaacucagucaa

SEQ ID NO: 512086 - RNA, 14 nt, Homo sapiens
ugcaauacucagua

SEQ ID NO: 512087 - RNA, 18 nt, Homo sapiens
ugcacgcggacuccgggg

SEQ ID NO: 512088 - RNA, 14 nt, Homo sapiens
ugcacuaaaaguga

SEQ ID NO: 512089 - RNA, 15 nt, Homo sapiens
ugcagcaaccagagc

SEQ ID NO: 512090 - RNA, 20 nt, Homo sapiens
ugcagcaaccagagcacugu

SEQ ID NO: 512091 - RNA, 15 nt, Homo sapiens
ugcaggaacaugacc

SEQ ID NO: 512092 - RNA, 14 nt, Homo sapiens
ugcaguacucagua

SEQ ID NO: 512093 - RNA, 20 nt, Homo sapiens
ugcaguguaagaaaauugga

SEQ ID NO: 512094 - RNA, 22 nt, Homo sapiens
ugcauaaauauuagcaaagcau

SEQ ID NO: 512095 - RNA, 20 nt, Homo sapiens
ugcauaaccgcacagacauu

SEQ ID NO: 512096 - RNA, 23 nt, Homo sapiens
ugcaucacaauuuguugaaucuc

SEQ ID NO: 512097 - RNA, 18 nt, Homo sapiens
ugccaaacaucagucaau

SEQ ID NO: 512098 - RNA, 16 nt, Homo sapiens
ugccacgguccuuuga

SEQ ID NO: 512099 - RNA, 15 nt, Homo sapiens
ugccacugacaggaa

SEQ ID NO: 512100 - RNA, 17 nt, Homo sapiens
ugccaggacacugccuu

SEQ ID NO: 512101 - RNA, 23 nt, Homo sapiens
ugccaguguuuagaagagccuga

SEQ ID NO: 512102 - RNA, 23 nt, Homo sapiens
ugccaucuccacccugagccuga

SEQ ID NO: 512103 - RNA, 13 nt, Homo sapiens
ugccccuccgucc

SEQ ID NO: 512104 - RNA, 23 nt, Homo sapiens
ugccuauuuaugaauaaauauua

SEQ ID NO: 512105 - RNA, 15 nt, Homo sapiens
ugccucauagcauag

SEQ ID NO: 512106 - RNA, 22 nt, Homo sapiens
ugccuggagccugggcagcacc

SEQ ID NO: 512107 - RNA, 20 nt, Homo sapiens
ugccugucaggaccauuuua

SEQ ID NO: 512108 - RNA, 21 nt, Homo sapiens
ugccuguggugagguccuguc

SEQ ID NO: 512109 - RNA, 22 nt, Homo sapiens
ugccuuauggaacacucugaga

SEQ ID NO: 512110 - RNA, 21 nt, Homo sapiens
ugccuuugggaggcagcauca

SEQ ID NO: 512111 - RNA, 22 nt, Homo sapiens
ugcguaggagagaacagggaug

SEQ ID NO: 512112 - RNA, 24 nt, Homo sapiens
ugcuaauuaaaaaguuaaucuuca

SEQ ID NO: 512113 - RNA, 15 nt, Homo sapiens
ugcuacuucccucac

SEQ ID NO: 512114 - RNA, 20 nt, Homo sapiens
ugcuaucucgcuagccauau

SEQ ID NO: 512115 - RNA, 22 nt, Homo sapiens
ugcucaguaacacagugcagug

SEQ ID NO: 512116 - RNA, 20 nt, Homo sapiens
ugcucaguaaggcagugaau

SEQ ID NO: 512117 - RNA, 16 nt, Homo sapiens
ugcucaguauugagac

SEQ ID NO: 512118 - RNA, 17 nt, Homo sapiens
ugcugauucaaggcauu

SEQ ID NO: 512119 - RNA, 10 nt, Homo sapiens
ugcugcugaa

SEQ ID NO: 512120 - RNA, 16 nt, Homo sapiens
ugcugugaaacagugu

SEQ ID NO: 512121 - RNA, 14 nt, Homo sapiens
ugcuuacagugacu

SEQ ID NO: 512122 - RNA, 20 nt, Homo sapiens
ugcuuagugucccuuaccug

SEQ ID NO: 512123 - RNA, 22 nt, Homo sapiens
ugcuucucuaaaacagcacuau

SEQ ID NO: 512124 - RNA, 12 nt, Homo sapiens
ugcuucucuuua

SEQ ID NO: 512125 - RNA, 19 nt, Homo sapiens
ugcuucuuuccucuuaaug

SEQ ID NO: 512126 - RNA, 17 nt, Homo sapiens
ugcuuuagguaaaaagc

SEQ ID NO: 512127 - RNA, 17 nt, Homo sapiens
ugcuuucucaugcauag

SEQ ID NO: 512128 - RNA, 20 nt, Homo sapiens
ugcuuucucuucuacuucuu

SEQ ID NO: 512129 - RNA, 17 nt, Homo sapiens
ugcuuugagaaaucuca

SEQ ID NO: 512130 - RNA, 17 nt, Homo sapiens
uggaaaaaauuagacaa

SEQ ID NO: 512131 - RNA, 15 nt, Homo sapiens
uggaaaaacaggaua

SEQ ID NO: 512132 - RNA, 23 nt, Homo sapiens
uggaaaccuugcugcuaugcugu

SEQ ID NO: 512133 - RNA, 20 nt, Homo sapiens
uggaaauaacugagcacuuu

SEQ ID NO: 512134 - RNA, 23 nt, Homo sapiens
uggaaauuugugugcuucacaca

SEQ ID NO: 512135 - RNA, 15 nt, Homo sapiens
uggaacagcccugca

SEQ ID NO: 512136 - RNA, 18 nt, Homo sapiens
uggaagggccuucuccac

SEQ ID NO: 512137 - RNA, 20 nt, Homo sapiens
uggaaguaagaaauauuacu

SEQ ID NO: 512138 - RNA, 12 nt, Homo sapiens
uggaauucugcu

SEQ ID NO: 512139 - RNA, 13 nt, Homo sapiens
uggaauucugcuu

SEQ ID NO: 512140 - RNA, 19 nt, Homo sapiens
uggagaaagggaaguggaa

SEQ ID NO: 512141 - RNA, 17 nt, Homo sapiens
uggaggaaauguguauu

SEQ ID NO: 512142 - RNA, 13 nt, Homo sapiens
uggaggugaugaa

SEQ ID NO: 512143 - RNA, 16 nt, Homo sapiens
uggcacaggagacucc

SEQ ID NO: 512144 - RNA, 20 nt, Homo sapiens
uggcagggaagggugccugg

SEQ ID NO: 512145 - RNA, 20 nt, Homo sapiens
uggcagugcagcaaccagag

SEQ ID NO: 512146 - RNA, 16 nt, Homo sapiens
uggccaccugccaggc

SEQ ID NO: 512147 - RNA, 21 nt, Homo sapiens
uggccauuuaacuagcacuuu

SEQ ID NO: 512148 - RNA, 15 nt, Homo sapiens
uggcccuguacaguu

SEQ ID NO: 512149 - RNA, 16 nt, Homo sapiens
uggcuuugugcuuguu

SEQ ID NO: 512150 - RNA, 15 nt, Homo sapiens
ugggaacacagugcc

SEQ ID NO: 512151 - RNA, 12 nt, Homo sapiens
ugggaauugcau

SEQ ID NO: 512152 - RNA, 16 nt, Homo sapiens
ugggaggaucacuuga

SEQ ID NO: 512153 - RNA, 16 nt, Homo sapiens
ugggccaagccagggu

SEQ ID NO: 512154 - RNA, 18 nt, Homo sapiens
ugggccaagccaggguuc

SEQ ID NO: 512155 - RNA, 16 nt, Homo sapiens
uggggagggacacaga

SEQ ID NO: 512156 - RNA, 18 nt, Homo sapiens
ugggggcugcugcacugc

SEQ ID NO: 512157 - RNA, 17 nt, Homo sapiens
uggguaucaugcuucua

SEQ ID NO: 512158 - RNA, 12 nt, Homo sapiens
uggguguucaag

SEQ ID NO: 512159 - RNA, 17 nt, Homo sapiens
uggguuccagacagagu

SEQ ID NO: 512160 - RNA, 15 nt, Homo sapiens
uggguuuacucugug

SEQ ID NO: 512161 - RNA, 12 nt, Homo sapiens
ugguauuuacug

SEQ ID NO: 512162 - RNA, 23 nt, Homo sapiens
ugguccgccacgaggagcuucca

SEQ ID NO: 512163 - RNA, 14 nt, Homo sapiens
ugguccugcacugu

SEQ ID NO: 512164 - RNA, 22 nt, Homo sapiens
ugguccuuaaaaaauaugcucu

SEQ ID NO: 512165 - RNA, 10 nt, Homo sapiens
uggucucuuu

SEQ ID NO: 512166 - RNA, 19 nt, Homo sapiens
uggugagguugugcugccu

SEQ ID NO: 512167 - RNA, 21 nt, Homo sapiens
ugguguccugcauguaugcca

SEQ ID NO: 512168 - RNA, 22 nt, Homo sapiens
uguaaaacugugacauuccaca

SEQ ID NO: 512169 - RNA, 19 nt, Homo sapiens
ucgccccagccaagccuga

SEQ ID NO: 512170 - RNA, 17 nt, Homo sapiens
ucggacaccaucuuggg

SEQ ID NO: 512171 - RNA, 17 nt, Homo sapiens
ucgggcuggugucuuga

SEQ ID NO: 512172 - RNA, 15 nt, Homo sapiens
ucgguggcauuugcu

SEQ ID NO: 512173 - RNA, 16 nt, Homo sapiens
ucgguggcauuugcug

SEQ ID NO: 512174 - RNA, 16 nt, Homo sapiens
ucguaaguucugugca

SEQ ID NO: 512175 - RNA, 15 nt, Homo sapiens
ucguagaaacaagac

SEQ ID NO: 512176 - RNA, 12 nt, Homo sapiens
ucguuacucuaa

SEQ ID NO: 512177 - RNA, 18 nt, Homo sapiens
ucguuucacaucuguaua

SEQ ID NO: 512178 - RNA, 20 nt, Homo sapiens
ucuaagaaauggcuuuccac

SEQ ID NO: 512179 - RNA, 20 nt, Homo sapiens
ucuaauaaacacagauuauu

SEQ ID NO: 512180 - RNA, 14 nt, Homo sapiens
ucuaauccaugugc

SEQ ID NO: 512181 - RNA, 21 nt, Homo sapiens
ucuaauccaugugcugcugug

SEQ ID NO: 512182 - RNA, 18 nt, Homo sapiens
ucuacacauauaaacaca

SEQ ID NO: 512183 - RNA, 21 nt, Homo sapiens
ucuacacauauaaacacagua

SEQ ID NO: 512184 - RNA, 17 nt, Homo sapiens
ucuaccaagcugugacc

SEQ ID NO: 512185 - RNA, 16 nt, Homo sapiens
ucuacuucuugugcuu

SEQ ID NO: 512186 - RNA, 16 nt, Homo sapiens
ucuauaccaccuucaa

SEQ ID NO: 512187 - RNA, 15 nt, Homo sapiens
ucuauauguaacuuc

SEQ ID NO: 512188 - RNA, 18 nt, Homo sapiens
ucuauugaguguacauuu

SEQ ID NO: 512189 - RNA, 18 nt, Homo sapiens
ucuauuuagagaaacauu

SEQ ID NO: 512190 - RNA, 22 nt, Homo sapiens
ucucaaaaugugccgucuuugg

SEQ ID NO: 512191 - RNA, 17 nt, Homo sapiens
ucucaaacacugcuuaa

SEQ ID NO: 512192 - RNA, 17 nt, Homo sapiens
ucucaaaucugcuuuca

SEQ ID NO: 512193 - RNA, 15 nt, Homo sapiens
ucucagcaaucacaa

SEQ ID NO: 512194 - RNA, 13 nt, Homo sapiens
ucucagcauauau

SEQ ID NO: 512195 - RNA, 16 nt, Homo sapiens
ucucagccccucagag

SEQ ID NO: 512196 - RNA, 18 nt, Homo sapiens
ucucaggugcgugccaca

SEQ ID NO: 512197 - RNA, 23 nt, Homo sapiens
ucucaucaacaaagaaauauuau

SEQ ID NO: 512198 - RNA, 22 nt, Homo sapiens
ucucaucuguaaaaccaggcug

SEQ ID NO: 512199 - RNA, 11 nt, Homo sapiens
ucucauuccca

SEQ ID NO: 512200 - RNA, 16 nt, Homo sapiens
ucucauucccaggcac

SEQ ID NO: 512201 - RNA, 13 nt, Homo sapiens
ucuccacagggac

SEQ ID NO: 512202 - RNA, 20 nt, Homo sapiens
ucuccaccccucaagccagg

SEQ ID NO: 512203 - RNA, 21 nt, Homo sapiens
ucuccagccaauuucaaagaa

SEQ ID NO: 512204 - RNA, 14 nt, Homo sapiens
ucuccccaccuuac

SEQ ID NO: 512205 - RNA, 20 nt, Homo sapiens
ucuccccaugcugggcucac

SEQ ID NO: 512206 - RNA, 13 nt, Homo sapiens
ucuccucugucag

SEQ ID NO: 512207 - RNA, 19 nt, Homo sapiens
ucuccuggucgcuuugcca

SEQ ID NO: 512208 - RNA, 15 nt, Homo sapiens
ucucuacgcaaaaaa

SEQ ID NO: 512209 - RNA, 16 nt, Homo sapiens
ucucugaaccagagaa

SEQ ID NO: 512210 - RNA, 23 nt, Homo sapiens
ucugaaaggaagacauuuucuac

SEQ ID NO: 512211 - RNA, 18 nt, Homo sapiens
ucugaaaggugcuuucuc

SEQ ID NO: 512212 - RNA, 21 nt, Homo sapiens
ucugaaauuuacccacaguga

SEQ ID NO: 512213 - RNA, 18 nt, Homo sapiens
ucugaacugcaacacugg

SEQ ID NO: 512214 - RNA, 23 nt, Homo sapiens
ucugacauauuucauaagcacau

SEQ ID NO: 512215 - RNA, 23 nt, Homo sapiens
ucugagcccugcccucacuccac

SEQ ID NO: 512216 - RNA, 15 nt, Homo sapiens
ucugagcuuaaacau

SEQ ID NO: 512217 - RNA, 16 nt, Homo sapiens
ucugauacaucuguca

SEQ ID NO: 512218 - RNA, 22 nt, Homo sapiens
ucugauacaucugucagugagu

SEQ ID NO: 512219 - RNA, 15 nt, Homo sapiens
ucugcaaaaugucau

SEQ ID NO: 512220 - RNA, 21 nt, Homo sapiens
ucugcaaaaugucauagcuua

SEQ ID NO: 512221 - RNA, 16 nt, Homo sapiens
ucugccccuccguccc

SEQ ID NO: 512222 - RNA, 17 nt, Homo sapiens
ucugcuaugucugugau

SEQ ID NO: 512223 - RNA, 19 nt, Homo sapiens
ucugcuugguguaaaccau

SEQ ID NO: 512224 - RNA, 21 nt, Homo sapiens
ucugcuuucugauacaucugu

SEQ ID NO: 512225 - RNA, 16 nt, Homo sapiens
ucuggagucugaagga

SEQ ID NO: 512226 - RNA, 14 nt, Homo sapiens
ucuggaugaaggca

SEQ ID NO: 512227 - RNA, 15 nt, Homo sapiens
ucuguauaucagcuc

SEQ ID NO: 512228 - RNA, 17 nt, Homo sapiens
ucugucuauaggacuua

SEQ ID NO: 512229 - RNA, 18 nt, Homo sapiens
ucugugcaacaaacucaa

SEQ ID NO: 512230 - RNA, 22 nt, Homo sapiens
ucuguguaguagcucgugugcu

SEQ ID NO: 512231 - RNA, 22 nt, Homo sapiens
ucuguuccaagugugugugcaa

SEQ ID NO: 512232 - RNA, 19 nt, Homo sapiens
ucuguuuucccauugcagu

SEQ ID NO: 512233 - RNA, 18 nt, Homo sapiens
ucuuaauugcaucaguau

SEQ ID NO: 512234 - RNA, 15 nt, Homo sapiens
ucuuacgcuugcuau

SEQ ID NO: 512235 - RNA, 17 nt, Homo sapiens
ucuuccaacaugugaug

SEQ ID NO: 512236 - RNA, 20 nt, Homo sapiens
ucuucccuuaggcaauggug

SEQ ID NO: 512237 - RNA, 20 nt, Homo sapiens
ucuucucagcuccacucuga

SEQ ID NO: 512238 - RNA, 21 nt, Homo sapiens
ucuucuguuuucccauugcag

SEQ ID NO: 512239 - RNA, 17 nt, Homo sapiens
ucuucuuauucaugcuu

SEQ ID NO: 512240 - RNA, 21 nt, Homo sapiens
ucuugaaugcuuaaaugauca

SEQ ID NO: 512241 - RNA, 13 nt, Homo sapiens
ucuugaauguuga

SEQ ID NO: 512242 - RNA, 22 nt, Homo sapiens
ucuuguaaauaaugcuuaacau

SEQ ID NO: 512243 - RNA, 18 nt, Homo sapiens
ucuuuacuaacacuggcu

SEQ ID NO: 512244 - RNA, 14 nt, Homo sapiens
ucuuucucucugug

SEQ ID NO: 512245 - RNA, 18 nt, Homo sapiens
ucuuuggcuucagaauug

SEQ ID NO: 512246 - RNA, 21 nt, Homo sapiens
ucuuugguuccucauggcugu

SEQ ID NO: 512247 - RNA, 21 nt, Homo sapiens
ugaaaaauaguguguccaugc

SEQ ID NO: 512248 - RNA, 22 nt, Homo sapiens
ugaaaaauaguguguccaugca

SEQ ID NO: 512249 - RNA, 21 nt, Homo sapiens
ugaaaaugugcucuacaucuc

SEQ ID NO: 512250 - RNA, 15 nt, Homo sapiens
ugaaacaaauauacu

SEQ ID NO: 512251 - RNA, 14 nt, Homo sapiens
ugaaacugacuugc

SEQ ID NO: 512252 - RNA, 17 nt, Homo sapiens
ugaaauauaaacuguga

SEQ ID NO: 512253 - RNA, 20 nt, Homo sapiens
ugaaauauaaacugugagau

SEQ ID NO: 512254 - RNA, 21 nt, Homo sapiens
ugaaauaucaagagagguuaa

SEQ ID NO: 512255 - RNA, 15 nt, Homo sapiens
ugaaauuauaucugu

SEQ ID NO: 512256 - RNA, 18 nt, Homo sapiens
ugaaauuggaagacuugg

SEQ ID NO: 512257 - RNA, 13 nt, Homo sapiens
ugaacuaaugaca

SEQ ID NO: 512258 - RNA, 14 nt, Homo sapiens
ugaacuaaugacaa

SEQ ID NO: 512259 - RNA, 14 nt, Homo sapiens
ugaagagagauaua

SEQ ID NO: 512260 - RNA, 22 nt, Homo sapiens
ugaagccagcugcaggaaucaa

SEQ ID NO: 512261 - RNA, 16 nt, Homo sapiens
ugaaggauugugaacu

SEQ ID NO: 512262 - RNA, 21 nt, Homo sapiens
ugaaggcaaaaacuguacugu

SEQ ID NO: 512263 - RNA, 22 nt, Homo sapiens
ugaaggcaaaaccaacucucua

SEQ ID NO: 512264 - RNA, 12 nt, Homo sapiens
ugaaggggccag

SEQ ID NO: 512265 - RNA, 16 nt, Homo sapiens
ugaaguaaguucauca

SEQ ID NO: 512266 - RNA, 20 nt, Homo sapiens
ugaaguuugccccagugcua

SEQ ID NO: 512267 - RNA, 21 nt, Homo sapiens
ugaauagcgcccucaacccug

SEQ ID NO: 512268 - RNA, 14 nt, Homo sapiens
ugaauccaucagga

SEQ ID NO: 512269 - RNA, 22 nt, Homo sapiens
ugaaugaaauauaaacugugag

SEQ ID NO: 512270 - RNA, 14 nt, Homo sapiens
ugaaugccagucca

SEQ ID NO: 512271 - RNA, 22 nt, Homo sapiens
ugaaugccaguccagaugugcc

SEQ ID NO: 512272 - RNA, 18 nt, Homo sapiens
ugaauuuuaaaaugcaaa

SEQ ID NO: 512273 - RNA, 19 nt, Homo sapiens
ugacaacaacuaucaccaa

SEQ ID NO: 512274 - RNA, 20 nt, Homo sapiens
ugacaagugacuuauuugcu

SEQ ID NO: 512275 - RNA, 13 nt, Homo sapiens
ugacaauaagaaa

SEQ ID NO: 512276 - RNA, 21 nt, Homo sapiens
ugacacagcugagcuggccua

SEQ ID NO: 512277 - RNA, 14 nt, Homo sapiens
ugacacugucugcu

SEQ ID NO: 512278 - RNA, 16 nt, Homo sapiens
ugacagcaaacacagu

SEQ ID NO: 512279 - RNA, 12 nt, Homo sapiens
ugacuguuuaca

SEQ ID NO: 512280 - RNA, 23 nt, Homo sapiens
ugacuuccugaacucccagucau

SEQ ID NO: 512281 - RNA, 22 nt, Homo sapiens
ugacuucuuuacuaacacuggc

SEQ ID NO: 512282 - RNA, 23 nt, Homo sapiens
ugacuucuuuacuaacacuggcu

SEQ ID NO: 512283 - RNA, 18 nt, Homo sapiens
ugagaauaaaaccuucaa

SEQ ID NO: 512284 - RNA, 21 nt, Homo sapiens
ugagacgcaaggaucacuuga

SEQ ID NO: 512285 - RNA, 16 nt, Homo sapiens
uuccuggacacuuuac

SEQ ID NO: 512286 - RNA, 22 nt, Homo sapiens
acaaauggcuuguucagucacu

SEQ ID NO: 512287 - RNA, 19 nt, Homo sapiens
acaacaaagcaugcucagu

SEQ ID NO: 512288 - RNA, 22 nt, Homo sapiens
acaacaauuuaggaaugcucaa

SEQ ID NO: 512289 - RNA, 20 nt, Homo sapiens
acaacuugccaaaacagaua

SEQ ID NO: 512290 - RNA, 16 nt, Homo sapiens
acaaguauuacacauc

SEQ ID NO: 512291 - RNA, 19 nt, Homo sapiens
acaagugacuuauuugcuc

SEQ ID NO: 512292 - RNA, 17 nt, Homo sapiens
acaauacaguacucagg

SEQ ID NO: 512293 - RNA, 16 nt, Homo sapiens
acaauacagugguaua

SEQ ID NO: 512294 - RNA, 23 nt, Homo sapiens
acaauggcuggguuugggcagug

SEQ ID NO: 512295 - RNA, 21 nt, Homo sapiens
acaauuuagcuuaaucagaaa

SEQ ID NO: 512296 - RNA, 18 nt, Homo sapiens
acacaauacaguacucag

SEQ ID NO: 512297 - RNA, 17 nt, Homo sapiens
acacacagagacacauc

SEQ ID NO: 512298 - RNA, 19 nt, Homo sapiens
acacacgcaaauacaugcc

SEQ ID NO: 512299 - RNA, 22 nt, Homo sapiens
acacagaggacagcuuccccau

SEQ ID NO: 512300 - RNA, 22 nt, Homo sapiens
acacagaggacggcuuccccau

SEQ ID NO: 512301 - RNA, 12 nt, Homo sapiens
acacagcacaag

SEQ ID NO: 512302 - RNA, 16 nt, Homo sapiens
acacagcacaagggca

SEQ ID NO: 512303 - RNA, 12 nt, Homo sapiens
acacagugcagu

SEQ ID NO: 512304 - RNA, 20 nt, Homo sapiens
acacauaguguuuguaacac

SEQ ID NO: 512305 - RNA, 12 nt, Homo sapiens
acacaucacuua

SEQ ID NO: 512306 - RNA, 14 nt, Homo sapiens
acacaucaguccac

SEQ ID NO: 512307 - RNA, 18 nt, Homo sapiens
acacaugcucaucccaaa

SEQ ID NO: 512308 - RNA, 12 nt, Homo sapiens
acaccaauuuag

SEQ ID NO: 512309 - RNA, 22 nt, Homo sapiens
acaccacuuucccacacuguga

SEQ ID NO: 512310 - RNA, 23 nt, Homo sapiens
acaccacuuucccacacugugaa

SEQ ID NO: 512311 - RNA, 12 nt, Homo sapiens
acaccugaauaa

SEQ ID NO: 512312 - RNA, 18 nt, Homo sapiens
acacuacagguguugaau

SEQ ID NO: 512313 - RNA, 20 nt, Homo sapiens
acacucucuucuuacuguau

SEQ ID NO: 512314 - RNA, 20 nt, Homo sapiens
acacugccuuggguggacca

SEQ ID NO: 512315 - RNA, 21 nt, Homo sapiens
acacugugaacuaaugacaag

SEQ ID NO: 512316 - RNA, 16 nt, Homo sapiens
acagaaaccaagccau

SEQ ID NO: 512317 - RNA, 23 nt, Homo sapiens
acagaaauccacgcucaaucuca

SEQ ID NO: 512318 - RNA, 23 nt, Homo sapiens
acagaagaaacuacccucuggag

SEQ ID NO: 512319 - RNA, 18 nt, Homo sapiens
acagaccgggguggaguc

SEQ ID NO: 512320 - RNA, 15 nt, Homo sapiens
acagccauacuucca

SEQ ID NO: 512321 - RNA, 19 nt, Homo sapiens
acagcuauuucgcacugua

SEQ ID NO: 512322 - RNA, 15 nt, Homo sapiens
acaggaaaaugacuu

SEQ ID NO: 512323 - RNA, 23 nt, Homo sapiens
acaggcugccucaugacccuccu

SEQ ID NO: 512324 - RNA, 21 nt, Homo sapiens
acaguagcauacugaugagac

SEQ ID NO: 512325 - RNA, 14 nt, Homo sapiens
acagucacauucag

SEQ ID NO: 512326 - RNA, 18 nt, Homo sapiens
acaguccucacagccucu

SEQ ID NO: 512327 - RNA, 21 nt, Homo sapiens
acagucucuauuugauuugca

SEQ ID NO: 512328 - RNA, 11 nt, Homo sapiens
acagugcagua

SEQ ID NO: 512329 - RNA, 19 nt, Homo sapiens
acagugccacgacauggcu

SEQ ID NO: 512330 - RNA, 15 nt, Homo sapiens
acaguggcaguauug

SEQ ID NO: 512331 - RNA, 15 nt, Homo sapiens
acaguguaguacuca

SEQ ID NO: 512332 - RNA, 17 nt, Homo sapiens
acaguguaguacucagu

SEQ ID NO: 512333 - RNA, 15 nt, Homo sapiens
acaguguagugcuca

SEQ ID NO: 512334 - RNA, 23 nt, Homo sapiens
acaguguucuguuuaauacucau

SEQ ID NO: 512335 - RNA, 13 nt, Homo sapiens
acauaacacacau

SEQ ID NO: 512336 - RNA, 18 nt, Homo sapiens
acauaacacacaucaguc

SEQ ID NO: 512337 - RNA, 18 nt, Homo sapiens
acauaauuaaagugucca

SEQ ID NO: 512338 - RNA, 23 nt, Homo sapiens
acauagcuuuagagaagccauaa

SEQ ID NO: 512339 - RNA, 17 nt, Homo sapiens
acauauagcuuugcaac

SEQ ID NO: 512340 - RNA, 14 nt, Homo sapiens
acauaucauucaga

SEQ ID NO: 512341 - RNA, 22 nt, Homo sapiens
acauaugugcauagauacacaa

SEQ ID NO: 512342 - RNA, 22 nt, Homo sapiens
acaucauaaacaaagaguagaa

SEQ ID NO: 512343 - RNA, 15 nt, Homo sapiens
acaucuggcccugac

SEQ ID NO: 512344 - RNA, 16 nt, Homo sapiens
acauggacuacacaca

SEQ ID NO: 512345 - RNA, 20 nt, Homo sapiens
acaugggugugccaggcuag

SEQ ID NO: 512346 - RNA, 15 nt, Homo sapiens
acaugguuaccucug

SEQ ID NO: 512347 - RNA, 23 nt, Homo sapiens
acaugucuuuggcuucagaauug

SEQ ID NO: 512348 - RNA, 23 nt, Homo sapiens
acauucuuggucacaaagcuauu

SEQ ID NO: 512349 - RNA, 16 nt, Homo sapiens
acauugcuucauuaaa

SEQ ID NO: 512350 - RNA, 12 nt, Homo sapiens
acauuuauguac

SEQ ID NO: 512351 - RNA, 22 nt, Homo sapiens
accaaguguguugggaauugca

SEQ ID NO: 512352 - RNA, 17 nt, Homo sapiens
accacaggaugcauauu

SEQ ID NO: 512353 - RNA, 16 nt, Homo sapiens
accacaggcugccuca

SEQ ID NO: 512354 - RNA, 14 nt, Homo sapiens
accaccgacucuca

SEQ ID NO: 512355 - RNA, 13 nt, Homo sapiens
accaccuucaaua

SEQ ID NO: 512356 - RNA, 16 nt, Homo sapiens
accacggugugggggg

SEQ ID NO: 512357 - RNA, 14 nt, Homo sapiens
accacuaggguccu

SEQ ID NO: 512358 - RNA, 18 nt, Homo sapiens
accagaaaucuaaucucu

SEQ ID NO: 512359 - RNA, 20 nt, Homo sapiens
accagagaaaugaaagucag

SEQ ID NO: 512360 - RNA, 14 nt, Homo sapiens
accagagcacugua

SEQ ID NO: 512361 - RNA, 16 nt, Homo sapiens
accagagcgauguguu

SEQ ID NO: 512362 - RNA, 22 nt, Homo sapiens
accauagcgcccaagcucagcu

SEQ ID NO: 512363 - RNA, 19 nt, Homo sapiens
accaucaaacaaaucauuu

SEQ ID NO: 512364 - RNA, 13 nt, Homo sapiens
accauggcuuuaa

SEQ ID NO: 512365 - RNA, 15 nt, Homo sapiens
accauuaaaaucuug

SEQ ID NO: 512366 - RNA, 22 nt, Homo sapiens
accauuauggcuuugugcuugu

SEQ ID NO: 512367 - RNA, 19 nt, Homo sapiens
acccaaaugguggccauug

SEQ ID NO: 512368 - RNA, 16 nt, Homo sapiens
acccacugaaucugag

SEQ ID NO: 512369 - RNA, 13 nt, Homo sapiens
acccacugccaga

SEQ ID NO: 512370 - RNA, 19 nt, Homo sapiens
acccacugccagacaugcc

SEQ ID NO: 512371 - RNA, 11 nt, Homo sapiens
acccaugaccg

SEQ ID NO: 512372 - RNA, 21 nt, Homo sapiens
acccaugccagcgcagcgcca

SEQ ID NO: 512373 - RNA, 16 nt, Homo sapiens
accccguucccagcgc

SEQ ID NO: 512374 - RNA, 16 nt, Homo sapiens
accccugaaaucugag

SEQ ID NO: 512375 - RNA, 15 nt, Homo sapiens
acccuaggucuccac

SEQ ID NO: 512376 - RNA, 21 nt, Homo sapiens
acccuccuguccagcagguag

SEQ ID NO: 512377 - RNA, 23 nt, Homo sapiens
acccugaaauauuuucuacuuua

SEQ ID NO: 512378 - RNA, 15 nt, Homo sapiens
acccuugaaaauaua

SEQ ID NO: 512379 - RNA, 22 nt, Homo sapiens
acccuuuuacagucacauucag

SEQ ID NO: 512380 - RNA, 20 nt, Homo sapiens
accuaacucccuaggccuga

SEQ ID NO: 512381 - RNA, 17 nt, Homo sapiens
accuaugugugugcuuu

SEQ ID NO: 512382 - RNA, 12 nt, Homo sapiens
accuauugcugu

SEQ ID NO: 512383 - RNA, 18 nt, Homo sapiens
accucaccccauugauug

SEQ ID NO: 512384 - RNA, 24 nt, Homo sapiens
accuccccugguccugcacugucc

SEQ ID NO: 512385 - RNA, 14 nt, Homo sapiens
accuccgggacuga

SEQ ID NO: 512386 - RNA, 12 nt, Homo sapiens
accucggcugug

SEQ ID NO: 512387 - RNA, 17 nt, Homo sapiens
accucggggagugccac

SEQ ID NO: 512388 - RNA, 21 nt, Homo sapiens
accucucugaacugcaacacu

SEQ ID NO: 512389 - RNA, 12 nt, Homo sapiens
accucugaggac

SEQ ID NO: 512390 - RNA, 21 nt, Homo sapiens
accugaauaagggacuuugga

SEQ ID NO: 512391 - RNA, 13 nt, Homo sapiens
accugcuccugcc

SEQ ID NO: 512392 - RNA, 18 nt, Homo sapiens
accuguagaagaugaccu

SEQ ID NO: 512393 - RNA, 19 nt, Homo sapiens
accuguaggucuaugaugu

SEQ ID NO: 512394 - RNA, 19 nt, Homo sapiens
accuguuuagccuagucau

SEQ ID NO: 512395 - RNA, 14 nt, Homo sapiens
accuucugaugaag

SEQ ID NO: 512396 - RNA, 11 nt, Homo sapiens
accuugcccau

SEQ ID NO: 512397 - RNA, 23 nt, Homo sapiens
accuuuugggaaaugcugauuua

SEQ ID NO: 512398 - RNA, 20 nt, Homo sapiens
acgcacacacacgcaaauac

SEQ ID NO: 512399 - RNA, 23 nt, Homo sapiens
acgccccccggccugauggccag

SEQ ID NO: 512400 - RNA, 18 nt, Homo sapiens
acgcuuuucccaccucuu

SEQ ID NO: 512401 - RNA, 23 nt, Homo sapiens
acggccugagaggagcguguccu

SEQ ID NO: 512402 - RNA, 23 nt, Homo sapiens
augacuucuuuacuaacacuggc

SEQ ID NO: 512403 - RNA, 18 nt, Homo sapiens
augagcaaggacaaccug

SEQ ID NO: 512404 - RNA, 20 nt, Homo sapiens
augagcaaggacaaccugcc

SEQ ID NO: 512405 - RNA, 14 nt, Homo sapiens
augagcuaucuacu

SEQ ID NO: 512406 - RNA, 20 nt, Homo sapiens
augaggccuuuccccagugu

SEQ ID NO: 512407 - RNA, 16 nt, Homo sapiens
augaggcucuguaacc

SEQ ID NO: 512408 - RNA, 21 nt, Homo sapiens
augaguucugcacauacagau

SEQ ID NO: 512409 - RNA, 17 nt, Homo sapiens
augauacuugguccuua

SEQ ID NO: 512410 - RNA, 19 nt, Homo sapiens
augauucuccucucccaaa

SEQ ID NO: 512411 - RNA, 22 nt, Homo sapiens
augcauauuaaagaaagucaua

SEQ ID NO: 512412 - RNA, 17 nt, Homo sapiens
augccaauuucucuuaa

SEQ ID NO: 512413 - RNA, 22 nt, Homo sapiens
augccuaauaaacaauucaagu

SEQ ID NO: 512414 - RNA, 14 nt, Homo sapiens
augcuaaaugucaa

SEQ ID NO: 512415 - RNA, 12 nt, Homo sapiens
augcuaccugau

SEQ ID NO: 512416 - RNA, 14 nt, Homo sapiens
augcuuaaaugauc

SEQ ID NO: 512417 - RNA, 17 nt, Homo sapiens
auggaagacaaauacac

SEQ ID NO: 512418 - RNA, 16 nt, Homo sapiens
auggaagggccuucuc

SEQ ID NO: 512419 - RNA, 14 nt, Homo sapiens
auggaaugcaauuu

SEQ ID NO: 512420 - RNA, 15 nt, Homo sapiens
auggagggagaagaa

SEQ ID NO: 512421 - RNA, 14 nt, Homo sapiens
auggauccuuccau

SEQ ID NO: 512422 - RNA, 15 nt, Homo sapiens
auggccaggccucag

SEQ ID NO: 512423 - RNA, 22 nt, Homo sapiens
auggccaggccucagggaccaa

SEQ ID NO: 512424 - RNA, 12 nt, Homo sapiens
auggcugaagaa

SEQ ID NO: 512425 - RNA, 18 nt, Homo sapiens
auggcuuuccacaucccc

SEQ ID NO: 512426 - RNA, 13 nt, Homo sapiens
auggugggcucca

SEQ ID NO: 512427 - RNA, 12 nt, Homo sapiens
auguauacuuca

SEQ ID NO: 512428 - RNA, 21 nt, Homo sapiens
auguauguugcaugaauccau

SEQ ID NO: 512429 - RNA, 20 nt, Homo sapiens
augucaaauggauguaauau

SEQ ID NO: 512430 - RNA, 19 nt, Homo sapiens
augucaauuuuuaacuuau

SEQ ID NO: 512431 - RNA, 17 nt, Homo sapiens
auguccauucacuuuca

SEQ ID NO: 512432 - RNA, 20 nt, Homo sapiens
augucugaaguuugccccag

SEQ ID NO: 512433 - RNA, 11 nt, Homo sapiens
augucugugau

SEQ ID NO: 512434 - RNA, 21 nt, Homo sapiens
augugaguuuaaucuuuucag

SEQ ID NO: 512435 - RNA, 17 nt, Homo sapiens
augugauuuaugcauuu

SEQ ID NO: 512436 - RNA, 14 nt, Homo sapiens
augugccuagacac

SEQ ID NO: 512437 - RNA, 19 nt, Homo sapiens
auguggaauuacauaacag

SEQ ID NO: 512438 - RNA, 21 nt, Homo sapiens
auguguauauguuuauacaca

SEQ ID NO: 512439 - RNA, 14 nt, Homo sapiens
auguuaauacauca

SEQ ID NO: 512440 - RNA, 17 nt, Homo sapiens
auguuccguucaucuga

SEQ ID NO: 512441 - RNA, 15 nt, Homo sapiens
auguucugacagcau

SEQ ID NO: 512442 - RNA, 17 nt, Homo sapiens
auguucuugagcagcug

SEQ ID NO: 512443 - RNA, 23 nt, Homo sapiens
auguugaagaacucaugugauuu

SEQ ID NO: 512444 - RNA, 22 nt, Homo sapiens
auguugauucuagguugaaaau

SEQ ID NO: 512445 - RNA, 23 nt, Homo sapiens
auguugguacccuggacagugcc

SEQ ID NO: 512446 - RNA, 16 nt, Homo sapiens
auguuuagugugauug

SEQ ID NO: 512447 - RNA, 22 nt, Homo sapiens
auuaaaacaagagaccacuucc

SEQ ID NO: 512448 - RNA, 17 nt, Homo sapiens
auuaaacaaauuccuuc

SEQ ID NO: 512449 - RNA, 19 nt, Homo sapiens
auuaaugaguuuuauccaa

SEQ ID NO: 512450 - RNA, 13 nt, Homo sapiens
auuagaagcacac

SEQ ID NO: 512451 - RNA, 14 nt, Homo sapiens
auuagacaaugugg

SEQ ID NO: 512452 - RNA, 16 nt, Homo sapiens
auuagacauaccucuc

SEQ ID NO: 512453 - RNA, 12 nt, Homo sapiens
auuagcugugau

SEQ ID NO: 512454 - RNA, 17 nt, Homo sapiens
auuauauuacauuuuac

SEQ ID NO: 512455 - RNA, 14 nt, Homo sapiens
auuauccucaaguu

SEQ ID NO: 512456 - RNA, 18 nt, Homo sapiens
auuauggugauacuccaa

SEQ ID NO: 512457 - RNA, 16 nt, Homo sapiens
auucaaaaagccaaaa

SEQ ID NO: 512458 - RNA, 16 nt, Homo sapiens
auucagcacacacaaa

SEQ ID NO: 512459 - RNA, 18 nt, Homo sapiens
auucauaccuucugauga

SEQ ID NO: 512460 - RNA, 20 nt, Homo sapiens
auucaugcuaccugauucau

SEQ ID NO: 512461 - RNA, 18 nt, Homo sapiens
auucauuagcugugauuu

SEQ ID NO: 512462 - RNA, 18 nt, Homo sapiens
auucauuuacaacuucca

SEQ ID NO: 512463 - RNA, 16 nt, Homo sapiens
auucauuuauuugaca

SEQ ID NO: 512464 - RNA, 19 nt, Homo sapiens
auucccaauuaucaaaaaa

SEQ ID NO: 512465 - RNA, 23 nt, Homo sapiens
auuccuccugucuccucugucag

SEQ ID NO: 512466 - RNA, 17 nt, Homo sapiens
auuccucugacuugcca

SEQ ID NO: 512467 - RNA, 22 nt, Homo sapiens
auucguccuuagaauacuguau

SEQ ID NO: 512468 - RNA, 18 nt, Homo sapiens
auucuaauuagauuaacc

SEQ ID NO: 512469 - RNA, 18 nt, Homo sapiens
auucugcaggaacaugac

SEQ ID NO: 512470 - RNA, 18 nt, Homo sapiens
auucuguagccaacuuaa

SEQ ID NO: 512471 - RNA, 13 nt, Homo sapiens
auucuuaccaucu

SEQ ID NO: 512472 - RNA, 19 nt, Homo sapiens
auucuuccaaguucauuca

SEQ ID NO: 512473 - RNA, 20 nt, Homo sapiens
auucuugugucaucaaguag

SEQ ID NO: 512474 - RNA, 12 nt, Homo sapiens
auucuuugauau

SEQ ID NO: 512475 - RNA, 17 nt, Homo sapiens
auugaaggauugugaac

SEQ ID NO: 512476 - RNA, 14 nt, Homo sapiens
auugaggaugaacu

SEQ ID NO: 512477 - RNA, 17 nt, Homo sapiens
auuguaacagacauugu

SEQ ID NO: 512478 - RNA, 13 nt, Homo sapiens
auugucaaauaca

SEQ ID NO: 512479 - RNA, 14 nt, Homo sapiens
auugucucaaagac

SEQ ID NO: 512480 - RNA, 14 nt, Homo sapiens
auugucucagugaa

SEQ ID NO: 512481 - RNA, 21 nt, Homo sapiens
auugucuuuugacauccagca

SEQ ID NO: 512482 - RNA, 20 nt, Homo sapiens
auugugccaaagauagcaga

SEQ ID NO: 512483 - RNA, 21 nt, Homo sapiens
auuguucuuuuuuaagacuca

SEQ ID NO: 512484 - RNA, 18 nt, Homo sapiens
auuguuuugguuugcuac

SEQ ID NO: 512485 - RNA, 19 nt, Homo sapiens
auuguuuugguuugcuacu

SEQ ID NO: 512486 - RNA, 14 nt, Homo sapiens
auuuaaacuucuua

SEQ ID NO: 512487 - RNA, 15 nt, Homo sapiens
auuuaaacuucuuaa

SEQ ID NO: 512488 - RNA, 18 nt, Homo sapiens
auuuaaaggaaaguucua

SEQ ID NO: 512489 - RNA, 15 nt, Homo sapiens
auuuaagcacaaaaa

SEQ ID NO: 512490 - RNA, 20 nt, Homo sapiens
auuuaccacaggaugcauau

SEQ ID NO: 512491 - RNA, 16 nt, Homo sapiens
auuuacuaacaguaac

SEQ ID NO: 512492 - RNA, 14 nt, Homo sapiens
auuuagaugagauc

SEQ ID NO: 512493 - RNA, 21 nt, Homo sapiens
auuuaugaauaaauauuacaa

SEQ ID NO: 512494 - RNA, 18 nt, Homo sapiens
auuucauaagcacaucca

SEQ ID NO: 512495 - RNA, 23 nt, Homo sapiens
auuucaugauuagacaaugugga

SEQ ID NO: 512496 - RNA, 11 nt, Homo sapiens
auuuccaugga

SEQ ID NO: 512497 - RNA, 21 nt, Homo sapiens
auuuccgugagagucaucuca

SEQ ID NO: 512498 - RNA, 17 nt, Homo sapiens
auuucgcacuguauuaa

SEQ ID NO: 512499 - RNA, 16 nt, Homo sapiens
auuucuaaaacauuaa

SEQ ID NO: 512500 - RNA, 19 nt, Homo sapiens
auuucugcugaauuuucac

SEQ ID NO: 512501 - RNA, 18 nt, Homo sapiens
auuuuagagacagaagaa

SEQ ID NO: 512502 - RNA, 14 nt, Homo sapiens
auuuuauauaugaa

SEQ ID NO: 512503 - RNA, 16 nt, Homo sapiens
auuuuauuucucucag

SEQ ID NO: 512504 - RNA, 20 nt, Homo sapiens
auuuucaaguggaaaccuug

SEQ ID NO: 512505 - RNA, 22 nt, Homo sapiens
auuuucauguucuugcagucau

SEQ ID NO: 512506 - RNA, 19 nt, Homo sapiens
auuuucauuauuucaagga

SEQ ID NO: 512507 - RNA, 14 nt, Homo sapiens
auuuucuacuuuaa

SEQ ID NO: 512508 - RNA, 16 nt, Homo sapiens
auuuuggaagaauuca

SEQ ID NO: 512509 - RNA, 15 nt, Homo sapiens
auuuuggacguguga

SEQ ID NO: 512510 - RNA, 23 nt, Homo sapiens
auuuugucugcuuaguaucucau

SEQ ID NO: 512511 - RNA, 17 nt, Homo sapiens
auuuuuaacugcuucaa

SEQ ID NO: 512512 - RNA, 18 nt, Homo sapiens
auuuuucaaagacuucau

SEQ ID NO: 512513 - RNA, 12 nt, Homo sapiens
auuuuucugcac

SEQ ID NO: 512514 - RNA, 23 nt, Homo sapiens
auuuuuuuucuuccaacauguga

SEQ ID NO: 512515 - RNA, 21 nt, Homo sapiens
caaaaaaaaaaaaacaaaaga

SEQ ID NO: 512516 - RNA, 22 nt, Homo sapiens
caaaaaaaaaaaaacaaaagaa

SEQ ID NO: 512517 - RNA, 15 nt, Homo sapiens
caaaaacuguacugu

SEQ ID NO: 512518 - RNA, 22 nt, Homo sapiens
uauuuguucagaucucauagau

SEQ ID NO: 512519 - RNA, 21 nt, Homo sapiens
uauuuugauuguuugaugaau

SEQ ID NO: 512520 - RNA, 16 nt, Homo sapiens
uauuuuggacguguga

SEQ ID NO: 512521 - RNA, 13 nt, Homo sapiens
ucaaaauguggac

SEQ ID NO: 512522 - RNA, 20 nt, Homo sapiens
ucaaacagggacacuacaaa

SEQ ID NO: 512523 - RNA, 18 nt, Homo sapiens
ucaaagaaucaccuaauu

SEQ ID NO: 512524 - RNA, 23 nt, Homo sapiens
ucaaagacuucauuuaacacuga

SEQ ID NO: 512525 - RNA, 23 nt, Homo sapiens
ucaaauugucuuuugucaugugg

SEQ ID NO: 512526 - RNA, 18 nt, Homo sapiens
ucaacaugguuaccucug

SEQ ID NO: 512527 - RNA, 14 nt, Homo sapiens
ucaacccugugauc

SEQ ID NO: 512528 - RNA, 16 nt, Homo sapiens
ucaacccugugaucua

SEQ ID NO: 512529 - RNA, 20 nt, Homo sapiens
ucaacccugugaucuauacc

SEQ ID NO: 512530 - RNA, 14 nt, Homo sapiens
ucaacuucaggaaa

SEQ ID NO: 512531 - RNA, 23 nt, Homo sapiens
ucaacuucaggaaagcagcaguu

SEQ ID NO: 512532 - RNA, 18 nt, Homo sapiens
ucaagacuauguucucca

SEQ ID NO: 512533 - RNA, 19 nt, Homo sapiens
ucaagagacaguauugcua

SEQ ID NO: 512534 - RNA, 13 nt, Homo sapiens
ucaagauccuguc

SEQ ID NO: 512535 - RNA, 18 nt, Homo sapiens
ucaagcacccuguucccu

SEQ ID NO: 512536 - RNA, 14 nt, Homo sapiens
ucaagcauugcuaa

SEQ ID NO: 512537 - RNA, 12 nt, Homo sapiens
ucaagccaggag

SEQ ID NO: 512538 - RNA, 20 nt, Homo sapiens
ucaaggaauagaguuuuccu

SEQ ID NO: 512539 - RNA, 23 nt, Homo sapiens
ucaaggcccggccccaucagagg

SEQ ID NO: 512540 - RNA, 14 nt, Homo sapiens
ucaaguuaauucuc

SEQ ID NO: 512541 - RNA, 13 nt, Homo sapiens
ucaaucaaacagg

SEQ ID NO: 512542 - RNA, 14 nt, Homo sapiens
ucaaugaaugaaca

SEQ ID NO: 512543 - RNA, 20 nt, Homo sapiens
ucaauuuuuaacuuaucucc

SEQ ID NO: 512544 - RNA, 18 nt, Homo sapiens
ucacaaaguuaaacguga

SEQ ID NO: 512545 - RNA, 12 nt, Homo sapiens
ucacaagccaag

SEQ ID NO: 512546 - RNA, 17 nt, Homo sapiens
ucacaauacaguggaua

SEQ ID NO: 512547 - RNA, 23 nt, Homo sapiens
ucacaauacaguggauagcuuga

SEQ ID NO: 512548 - RNA, 20 nt, Homo sapiens
ucacaccggcacugugcacu

SEQ ID NO: 512549 - RNA, 16 nt, Homo sapiens
ucacagggacucucca

SEQ ID NO: 512550 - RNA, 19 nt, Homo sapiens
ucacagggacucuccauau

SEQ ID NO: 512551 - RNA, 18 nt, Homo sapiens
ucacaugccccucuuaga

SEQ ID NO: 512552 - RNA, 16 nt, Homo sapiens
ucacccugacuguggg

SEQ ID NO: 512553 - RNA, 19 nt, Homo sapiens
ucaccugaauaagggacuu

SEQ ID NO: 512554 - RNA, 19 nt, Homo sapiens
ucacgcaacuugaaauuau

SEQ ID NO: 512555 - RNA, 18 nt, Homo sapiens
ucacugauauauuuucca

SEQ ID NO: 512556 - RNA, 16 nt, Homo sapiens
ucacuguucaugaaua

SEQ ID NO: 512557 - RNA, 22 nt, Homo sapiens
ucagaauugaaccgucaaugug

SEQ ID NO: 512558 - RNA, 20 nt, Homo sapiens
ucagacaaauguaacacaca

SEQ ID NO: 512559 - RNA, 21 nt, Homo sapiens
ucagaucccucggucagcacc

SEQ ID NO: 512560 - RNA, 17 nt, Homo sapiens
ucagaucugaaguagug

SEQ ID NO: 512561 - RNA, 13 nt, Homo sapiens
ucagauguuucca

SEQ ID NO: 512562 - RNA, 15 nt, Homo sapiens
ucagauugaaccauu

SEQ ID NO: 512563 - RNA, 22 nt, Homo sapiens
ucagcauauauauaaaauacac

SEQ ID NO: 512564 - RNA, 14 nt, Homo sapiens
ucagcucuaaagca

SEQ ID NO: 512565 - RNA, 19 nt, Homo sapiens
ucaggaaauaucugugaag

SEQ ID NO: 512566 - RNA, 20 nt, Homo sapiens
ucaggaaugggccaagccag

SEQ ID NO: 512567 - RNA, 20 nt, Homo sapiens
ucaggacccagggaaugcca

SEQ ID NO: 512568 - RNA, 15 nt, Homo sapiens
ucaggagcacagcca

SEQ ID NO: 512569 - RNA, 20 nt, Homo sapiens
ucaggcucugaaucucucaa

SEQ ID NO: 512570 - RNA, 17 nt, Homo sapiens
ucaguaaaucagugcag

SEQ ID NO: 512571 - RNA, 18 nt, Homo sapiens
ucaguaaaucagugcagu

SEQ ID NO: 512572 - RNA, 15 nt, Homo sapiens
ucaguaacacagugc

SEQ ID NO: 512573 - RNA, 17 nt, Homo sapiens
ucaguaacagugcagua

SEQ ID NO: 512574 - RNA, 19 nt, Homo sapiens
ucaguaaggcagugcagua

SEQ ID NO: 512575 - RNA, 16 nt, Homo sapiens
ucaguagugccuguga

SEQ ID NO: 512576 - RNA, 21 nt, Homo sapiens
ucagugaagcccaggaggacc

SEQ ID NO: 512577 - RNA, 17 nt, Homo sapiens
ucagugcccauguguau

SEQ ID NO: 512578 - RNA, 20 nt, Homo sapiens
ucagugugcugaucauucac

SEQ ID NO: 512579 - RNA, 23 nt, Homo sapiens
ucaguuguaacauucuauuucaa

SEQ ID NO: 512580 - RNA, 17 nt, Homo sapiens
ucauaccuucugaugaa

SEQ ID NO: 512581 - RNA, 13 nt, Homo sapiens
ucaucaaguagua

SEQ ID NO: 512582 - RNA, 13 nt, Homo sapiens
ucauccaacguga

SEQ ID NO: 512583 - RNA, 15 nt, Homo sapiens
ucauccaacuggaag

SEQ ID NO: 512584 - RNA, 17 nt, Homo sapiens
ucaucucagcaaucaca

SEQ ID NO: 512585 - RNA, 17 nt, Homo sapiens
ucaucugaggaguccaa

SEQ ID NO: 512586 - RNA, 19 nt, Homo sapiens
ucaucugucugucccaguu

SEQ ID NO: 512587 - RNA, 12 nt, Homo sapiens
ucauggaacuca

SEQ ID NO: 512588 - RNA, 20 nt, Homo sapiens
ucauggagggagaagaaaga

SEQ ID NO: 512589 - RNA, 23 nt, Homo sapiens
ucauggccauagcuuuuauucau

SEQ ID NO: 512590 - RNA, 17 nt, Homo sapiens
ucaugugauuuacccuu

SEQ ID NO: 512591 - RNA, 18 nt, Homo sapiens
ucauguuuaauuugcauc

SEQ ID NO: 512592 - RNA, 16 nt, Homo sapiens
ucauuagcugugauuu

SEQ ID NO: 512593 - RNA, 17 nt, Homo sapiens
ucauucccaggcacucu

SEQ ID NO: 512594 - RNA, 21 nt, Homo sapiens
ucauucccaggcacucucuuu

SEQ ID NO: 512595 - RNA, 19 nt, Homo sapiens
ucauuuauuugacauagau

SEQ ID NO: 512596 - RNA, 23 nt, Homo sapiens
uccaaaauagucauguuucugca

SEQ ID NO: 512597 - RNA, 18 nt, Homo sapiens
uccaacagaaagcauaga

SEQ ID NO: 512598 - RNA, 19 nt, Homo sapiens
uccaacagaaagcauagac

SEQ ID NO: 512599 - RNA, 19 nt, Homo sapiens
uccaacuggaaggcuuuau

SEQ ID NO: 512600 - RNA, 20 nt, Homo sapiens
uccaagacagccauacuucc

SEQ ID NO: 512601 - RNA, 14 nt, Homo sapiens
uccaagguggcaua

SEQ ID NO: 512602 - RNA, 19 nt, Homo sapiens
uccaagugaaugaguuucc

SEQ ID NO: 512603 - RNA, 14 nt, Homo sapiens
uccaauacuguugc

SEQ ID NO: 512604 - RNA, 12 nt, Homo sapiens
uccaaugccaau

SEQ ID NO: 512605 - RNA, 16 nt, Homo sapiens
uccaaugccaauucau

SEQ ID NO: 512606 - RNA, 17 nt, Homo sapiens
uccaaugccaauucauc

SEQ ID NO: 512607 - RNA, 22 nt, Homo sapiens
uccacuaggugcccagucuuga

SEQ ID NO: 512608 - RNA, 16 nt, Homo sapiens
uccagaaaaacauuug

SEQ ID NO: 512609 - RNA, 16 nt, Homo sapiens
uccagaccccuacccu

SEQ ID NO: 512610 - RNA, 18 nt, Homo sapiens
uccagaggguugugauuu

SEQ ID NO: 512611 - RNA, 22 nt, Homo sapiens
uccagccacugcccaaagccau

SEQ ID NO: 512612 - RNA, 22 nt, Homo sapiens
uccagccacuuauuuccaugga

SEQ ID NO: 512613 - RNA, 22 nt, Homo sapiens
uccaggagaugaggcuggauag

SEQ ID NO: 512614 - RNA, 17 nt, Homo sapiens
uccagucuucuuuauca

SEQ ID NO: 512615 - RNA, 19 nt, Homo sapiens
uccauaucagcucugcaua

SEQ ID NO: 512616 - RNA, 23 nt, Homo sapiens
uccaucucgcugccgucuguccc

SEQ ID NO: 512617 - RNA, 15 nt, Homo sapiens
uccaugucugaaguu

SEQ ID NO: 512618 - RNA, 16 nt, Homo sapiens
uccauugacauguaca

SEQ ID NO: 512619 - RNA, 23 nt, Homo sapiens
ucccaaccuccccugguccugca

SEQ ID NO: 512620 - RNA, 20 nt, Homo sapiens
ucccaagcacuucaaaggaa

SEQ ID NO: 512621 - RNA, 18 nt, Homo sapiens
ucccacuaagcuuucucc

SEQ ID NO: 512622 - RNA, 21 nt, Homo sapiens
ucccacugccccugcaccugc

SEQ ID NO: 512623 - RNA, 13 nt, Homo sapiens
ucccaggcacucu

SEQ ID NO: 512624 - RNA, 17 nt, Homo sapiens
ucccaugguagacugug

SEQ ID NO: 512625 - RNA, 21 nt, Homo sapiens
ucccaugguagacugugacac

SEQ ID NO: 512626 - RNA, 23 nt, Homo sapiens
uccccagagcuuuacagugccac

SEQ ID NO: 512627 - RNA, 23 nt, Homo sapiens
uccccauucagugacauguccuc

SEQ ID NO: 512628 - RNA, 13 nt, Homo sapiens
uccccauugccuu

SEQ ID NO: 512629 - RNA, 21 nt, Homo sapiens
ucccccacggccgucccugac

SEQ ID NO: 512630 - RNA, 14 nt, Homo sapiens
uccccuccaaguga

SEQ ID NO: 512631 - RNA, 15 nt, Homo sapiens
uccccuggacauauu

SEQ ID NO: 512632 - RNA, 23 nt, Homo sapiens
ucccuaaguccacucuaguugug

SEQ ID NO: 512633 - RNA, 19 nt, Homo sapiens
uucaacaugguuaccucug

SEQ ID NO: 512634 - RNA, 18 nt, Homo sapiens
uucaaguguuaccuaaca

SEQ ID NO: 512635 - RNA, 19 nt, Homo sapiens
uucaaguguuaccuaacaa

SEQ ID NO: 512636 - RNA, 13 nt, Homo sapiens
uucacaucuguau

SEQ ID NO: 512637 - RNA, 22 nt, Homo sapiens
uucaccaguuuccaaguuuauu

SEQ ID NO: 512638 - RNA, 14 nt, Homo sapiens
uucacgcaacuuga

SEQ ID NO: 512639 - RNA, 17 nt, Homo sapiens
uucacucccugucauag

SEQ ID NO: 512640 - RNA, 15 nt, Homo sapiens
uucagaaaagcaccu

SEQ ID NO: 512641 - RNA, 14 nt, Homo sapiens
uucagacucucucc

SEQ ID NO: 512642 - RNA, 16 nt, Homo sapiens
uucagcccuaacauag

SEQ ID NO: 512643 - RNA, 18 nt, Homo sapiens
uucaggaaugggccaagc

SEQ ID NO: 512644 - RNA, 15 nt, Homo sapiens
uucauuaaaacaaga

SEQ ID NO: 512645 - RNA, 19 nt, Homo sapiens
uuccaaauguuuuuaaucc

SEQ ID NO: 512646 - RNA, 16 nt, Homo sapiens
uuccaaguuuauugcc

SEQ ID NO: 512647 - RNA, 13 nt, Homo sapiens
uuccaaugccaau

SEQ ID NO: 512648 - RNA, 20 nt, Homo sapiens
uuccagaaaaacauuuggca

SEQ ID NO: 512649 - RNA, 10 nt, Homo sapiens
uuccagacag

SEQ ID NO: 512650 - RNA, 17 nt, Homo sapiens
uuccagugcauguugcc

SEQ ID NO: 512651 - RNA, 13 nt, Homo sapiens
uuccagugcugcu

SEQ ID NO: 512652 - RNA, 17 nt, Homo sapiens
uuccauuaugaggaaac

SEQ ID NO: 512653 - RNA, 13 nt, Homo sapiens
uucccauugcagu

SEQ ID NO: 512654 - RNA, 13 nt, Homo sapiens
uuccccacucccg

SEQ ID NO: 512655 - RNA, 13 nt, Homo sapiens
uuccccagugugg

SEQ ID NO: 512656 - RNA, 20 nt, Homo sapiens
uucccccagaacauggaaau

SEQ ID NO: 512657 - RNA, 15 nt, Homo sapiens
uucccugacacuguc

SEQ ID NO: 512658 - RNA, 15 nt, Homo sapiens
uucccuucaaugcaa

SEQ ID NO: 512659 - RNA, 22 nt, Homo sapiens
uuccucaagauccugucuugcu

SEQ ID NO: 512660 - RNA, 21 nt, Homo sapiens
uucuaaaucauaaucauccuu

SEQ ID NO: 512661 - RNA, 15 nt, Homo sapiens
uucucaaugaaugaa

SEQ ID NO: 512662 - RNA, 18 nt, Homo sapiens
uucuccuuguacuugaau

SEQ ID NO: 512663 - RNA, 21 nt, Homo sapiens
uucucuagacaucuagucuca

SEQ ID NO: 512664 - RNA, 16 nt, Homo sapiens
uucucucugugcuggu

SEQ ID NO: 512665 - RNA, 13 nt, Homo sapiens
uucucuuaccacu

SEQ ID NO: 512666 - RNA, 17 nt, Homo sapiens
uucugaguagcauauau

SEQ ID NO: 512667 - RNA, 19 nt, Homo sapiens
uucugagugugcagacagc

SEQ ID NO: 512668 - RNA, 13 nt, Homo sapiens
uucuuauuucagu

SEQ ID NO: 512669 - RNA, 21 nt, Homo sapiens
uucuuccuuuuguauccucca

SEQ ID NO: 512670 - RNA, 18 nt, Homo sapiens
uucuuguaaaacugugac

SEQ ID NO: 512671 - RNA, 16 nt, Homo sapiens
uugaaacuguauuuac

SEQ ID NO: 512672 - RNA, 16 nt, Homo sapiens
uugaacacaccucucu

SEQ ID NO: 512673 - RNA, 13 nt, Homo sapiens
uugaaccauucau

SEQ ID NO: 512674 - RNA, 17 nt, Homo sapiens
uugacugcuucucugca

SEQ ID NO: 512675 - RNA, 19 nt, Homo sapiens
uugagaacuacagcuuuua

SEQ ID NO: 512676 - RNA, 20 nt, Homo sapiens
uugagaagaugaagguuuaa

SEQ ID NO: 512677 - RNA, 20 nt, Homo sapiens
uugauaauucgagcaaacaa

SEQ ID NO: 512678 - RNA, 17 nt, Homo sapiens
uugcacuaaaagugaug

SEQ ID NO: 512679 - RNA, 12 nt, Homo sapiens
uugcuaacauau

SEQ ID NO: 512680 - RNA, 18 nt, Homo sapiens
uugcugaauaacaacaau

SEQ ID NO: 512681 - RNA, 23 nt, Homo sapiens
uugcugcccuggcuauggucaca

SEQ ID NO: 512682 - RNA, 23 nt, Homo sapiens
uugcuuuuagguugaaggcaaaa

SEQ ID NO: 512683 - RNA, 13 nt, Homo sapiens
uuggagugcagug

SEQ ID NO: 512684 - RNA, 22 nt, Homo sapiens
uugggaaacagagaacccugug

SEQ ID NO: 512685 - RNA, 15 nt, Homo sapiens
uuggguuccagacag

SEQ ID NO: 512686 - RNA, 22 nt, Homo sapiens
uugguguaaaccauucuuggga

SEQ ID NO: 512687 - RNA, 18 nt, Homo sapiens
uugguuaccuauugcugu

SEQ ID NO: 512688 - RNA, 22 nt, Homo sapiens
uuguaacagacauuguuuugcc

SEQ ID NO: 512689 - RNA, 21 nt, Homo sapiens
uuguaauauuuugcugcugaa

SEQ ID NO: 512690 - RNA, 14 nt, Homo sapiens
uuguauauguaauu

SEQ ID NO: 512691 - RNA, 18 nt, Homo sapiens
uuguauccuccauuguau

SEQ ID NO: 512692 - RNA, 21 nt, Homo sapiens
uuguauuaauguagggcagaa

SEQ ID NO: 512693 - RNA, 22 nt, Homo sapiens
uugucaguguagaucaacucau

SEQ ID NO: 512694 - RNA, 22 nt, Homo sapiens
uugucauguggcuaaaugccua

SEQ ID NO: 512695 - RNA, 17 nt, Homo sapiens
uugugcugccuguggug

SEQ ID NO: 512696 - RNA, 19 nt, Homo sapiens
uugugugugugugcaguga

SEQ ID NO: 512697 - RNA, 16 nt, Homo sapiens
uuguuaucaguacaau

SEQ ID NO: 512698 - RNA, 15 nt, Homo sapiens
uuguuauggcaaguu

SEQ ID NO: 512699 - RNA, 14 nt, Homo sapiens
uuguugcaguucag

SEQ ID NO: 512700 - RNA, 19 nt, Homo sapiens
uuguugcaguucagacaaa

SEQ ID NO: 512701 - RNA, 12 nt, Homo sapiens
uuguugucuaaa

SEQ ID NO: 512702 - RNA, 12 nt, Homo sapiens
uuguuguucaga

SEQ ID NO: 512703 - RNA, 20 nt, Homo sapiens
uuguuucuuacgcuugcuau

SEQ ID NO: 512704 - RNA, 19 nt, Homo sapiens
uuuaaaaaaaauauucugu

SEQ ID NO: 512705 - RNA, 18 nt, Homo sapiens
uuuaaguaauuucaugca

SEQ ID NO: 512706 - RNA, 15 nt, Homo sapiens
uuuaaucauuuccag

SEQ ID NO: 512707 - RNA, 22 nt, Homo sapiens
uuuacaaaagggacucuaugga

SEQ ID NO: 512708 - RNA, 19 nt, Homo sapiens
uuuaccacaggaugcauau

SEQ ID NO: 512709 - RNA, 18 nt, Homo sapiens
uuuacccaaugcaguuug

SEQ ID NO: 512710 - RNA, 18 nt, Homo sapiens
uuuaccccucuaccaagc

SEQ ID NO: 512711 - RNA, 13 nt, Homo sapiens
uuuacuaacacug

SEQ ID NO: 512712 - RNA, 16 nt, Homo sapiens
uuuagagaagccauaa

SEQ ID NO: 512713 - RNA, 15 nt, Homo sapiens
uuuagcacaguauuu

SEQ ID NO: 512714 - RNA, 16 nt, Homo sapiens
uuuaggaaacucucca

SEQ ID NO: 512715 - RNA, 20 nt, Homo sapiens
uuuaggaaagcagugcagua

SEQ ID NO: 512716 - RNA, 12 nt, Homo sapiens
uuuaguccucac

SEQ ID NO: 512717 - RNA, 18 nt, Homo sapiens
uuucaauucaugcuaccu

SEQ ID NO: 512718 - RNA, 18 nt, Homo sapiens
uuucacaccuuacaaagc

SEQ ID NO: 512719 - RNA, 11 nt, Homo sapiens
uuucacagugg

SEQ ID NO: 512720 - RNA, 13 nt, Homo sapiens
uuucagugccugc

SEQ ID NO: 512721 - RNA, 18 nt, Homo sapiens
uuuccaaauacauuccag

SEQ ID NO: 512722 - RNA, 12 nt, Homo sapiens
uuuccagaauug

SEQ ID NO: 512723 - RNA, 19 nt, Homo sapiens
uuuccagucuucuuuauca

SEQ ID NO: 512724 - RNA, 14 nt, Homo sapiens
uuuccagugcugcu

SEQ ID NO: 512725 - RNA, 12 nt, Homo sapiens
uuuccccagugu

SEQ ID NO: 512726 - RNA, 17 nt, Homo sapiens
uuuccccauucagugac

SEQ ID NO: 512727 - RNA, 19 nt, Homo sapiens
uuuccugcuccuccaguac

SEQ ID NO: 512728 - RNA, 15 nt, Homo sapiens
uuuccuuugaccucu

SEQ ID NO: 512729 - RNA, 21 nt, Homo sapiens
uuucuacuuuaaauuguggau

SEQ ID NO: 512730 - RNA, 22 nt, Homo sapiens
uuucucaugguauuaucuagua

SEQ ID NO: 512731 - RNA, 18 nt, Homo sapiens
uuucugccuucuccugca

SEQ ID NO: 512732 - RNA, 15 nt, Homo sapiens
uuucuucaccucacu

SEQ ID NO: 512733 - RNA, 13 nt, Homo sapiens
uuucuuccaacau

SEQ ID NO: 512734 - RNA, 14 nt, Homo sapiens
uuugacuguuucca

SEQ ID NO: 512735 - RNA, 17 nt, Homo sapiens
uuuguaauauaagacaa

SEQ ID NO: 512736 - RNA, 17 nt, Homo sapiens
uuugucaguguagauca

SEQ ID NO: 512737 - RNA, 23 nt, Homo sapiens
uuugucaguguagaucaacucau

SEQ ID NO: 512738 - RNA, 16 nt, Homo sapiens
uuugugaagugauuga

SEQ ID NO: 512739 - RNA, 17 nt, Homo sapiens
uuuguugagacuaucaa

SEQ ID NO: 512740 - RNA, 14 nt, Homo sapiens
uuuuaauccaaaga

SEQ ID NO: 512741 - RNA, 19 nt, Homo sapiens
uuuuaauugaaagggacaa

SEQ ID NO: 512742 - RNA, 19 nt, Homo sapiens
uuuuacagucacauucaga

SEQ ID NO: 512743 - RNA, 13 nt, Homo sapiens
uuuuauacuucaa

SEQ ID NO: 512744 - RNA, 12 nt, Homo sapiens
uuuuccacguua

SEQ ID NO: 512745 - RNA, 22 nt, Homo sapiens
uuuucuacuuuaaauuguggau

SEQ ID NO: 512746 - RNA, 13 nt, Homo sapiens
uuuucugcuguaa

SEQ ID NO: 512747 - RNA, 16 nt, Homo sapiens
uuuucuguaauucuuc

SEQ ID NO: 512748 - RNA, 20 nt, Homo sapiens
uuuuuaaaagcccuuuccaa

SEQ ID NO: 512749 - RNA, 21 nt, Homo sapiens
uuuuuaaagcacaugucucau

SEQ ID NO: 512750 - RNA, 16 nt, Homo sapiens
aaaaacuguugcuauu

SEQ ID NO: 512751 - RNA, 18 nt, Homo sapiens
aaaacaagagaccacuuc

SEQ ID NO: 512752 - RNA, 11 nt, Homo sapiens
aaaaccaggcu

SEQ ID NO: 512753 - RNA, 18 nt, Homo sapiens
aaaacuggaaacaucuga

SEQ ID NO: 512754 - RNA, 13 nt, Homo sapiens
aaaagaaacugug

SEQ ID NO: 512755 - RNA, 17 nt, Homo sapiens
aaaagcaauccauguga

SEQ ID NO: 512756 - RNA, 22 nt, Homo sapiens
aaaagcauguacaguguucugu

SEQ ID NO: 512757 - RNA, 20 nt, Homo sapiens
aaaaucaguuuguuguucag

SEQ ID NO: 512758 - RNA, 19 nt, Homo sapiens
aaaaugaauugccuuugau

SEQ ID NO: 512759 - RNA, 20 nt, Homo sapiens
aaaaugaauugccuuugaua

SEQ ID NO: 512760 - RNA, 21 nt, Homo sapiens
aaaauguaggccuccaguuca

SEQ ID NO: 512761 - RNA, 22 nt, Homo sapiens
aaaauguucugacagcauuuca

SEQ ID NO: 512762 - RNA, 14 nt, Homo sapiens
aaacaaaaacuguu

SEQ ID NO: 512763 - RNA, 15 nt, Homo sapiens
aaacaaagaguagaa

SEQ ID NO: 512764 - RNA, 17 nt, Homo sapiens
aaacaaaucauuuugau

SEQ ID NO: 512765 - RNA, 14 nt, Homo sapiens
aaacaauucaaaga

SEQ ID NO: 512766 - RNA, 16 nt, Homo sapiens
aaacacagucacuguu

SEQ ID NO: 512767 - RNA, 14 nt, Homo sapiens
aaacagcagguugu

SEQ ID NO: 512768 - RNA, 15 nt, Homo sapiens
acgugcccauuucac

SEQ ID NO: 512769 - RNA, 16 nt, Homo sapiens
acguuuggccagugac

SEQ ID NO: 512770 - RNA, 15 nt, Homo sapiens
acuacagaaguggaa

SEQ ID NO: 512771 - RNA, 14 nt, Homo sapiens
acuacaucugauau

SEQ ID NO: 512772 - RNA, 18 nt, Homo sapiens
acuagaacacaaauccaa

SEQ ID NO: 512773 - RNA, 13 nt, Homo sapiens
acuauugcugcuu

SEQ ID NO: 512774 - RNA, 18 nt, Homo sapiens
acucaaggccuccagcca

SEQ ID NO: 512775 - RNA, 16 nt, Homo sapiens
acucaggcagugcagu

SEQ ID NO: 512776 - RNA, 20 nt, Homo sapiens
acucaguaacacagugcagu

SEQ ID NO: 512777 - RNA, 19 nt, Homo sapiens
acucaguaacagugcagua

SEQ ID NO: 512778 - RNA, 15 nt, Homo sapiens
acucaguaaggcagu

SEQ ID NO: 512779 - RNA, 20 nt, Homo sapiens
acucaguuaggcagugcagu

SEQ ID NO: 512780 - RNA, 21 nt, Homo sapiens
acucaguuaggcagugcagua

SEQ ID NO: 512781 - RNA, 16 nt, Homo sapiens
acucaugugauuuacc

SEQ ID NO: 512782 - RNA, 16 nt, Homo sapiens
acucauguucauucag

SEQ ID NO: 512783 - RNA, 18 nt, Homo sapiens
acucccaaacuccaagac

SEQ ID NO: 512784 - RNA, 14 nt, Homo sapiens
acucccuaagucca

SEQ ID NO: 512785 - RNA, 21 nt, Homo sapiens
acucgggcacucccuaagucc

SEQ ID NO: 512786 - RNA, 18 nt, Homo sapiens
acucuuacuaaccaccau

SEQ ID NO: 512787 - RNA, 16 nt, Homo sapiens
acugaaauuaguguuu

SEQ ID NO: 512788 - RNA, 17 nt, Homo sapiens
acugagcagagucuugc

SEQ ID NO: 512789 - RNA, 16 nt, Homo sapiens
acugauuaacucaguc

SEQ ID NO: 512790 - RNA, 14 nt, Homo sapiens
acugcaaaacaaga

SEQ ID NO: 512791 - RNA, 14 nt, Homo sapiens
acugcaacacugga

SEQ ID NO: 512792 - RNA, 15 nt, Homo sapiens
acugcccaaagccau

SEQ ID NO: 512793 - RNA, 13 nt, Homo sapiens
acugccccugcac

SEQ ID NO: 512794 - RNA, 23 nt, Homo sapiens
acugcguaggagagaacagggau

SEQ ID NO: 512795 - RNA, 14 nt, Homo sapiens
acuguaaaauacau

SEQ ID NO: 512796 - RNA, 12 nt, Homo sapiens
acuguacugugu

SEQ ID NO: 512797 - RNA, 14 nt, Homo sapiens
acugugacacagcu

SEQ ID NO: 512798 - RNA, 22 nt, Homo sapiens
acuguggucccagcuacagggg

SEQ ID NO: 512799 - RNA, 18 nt, Homo sapiens
acuguuuugggccuccau

SEQ ID NO: 512800 - RNA, 16 nt, Homo sapiens
acuuaaaccugugcuu

SEQ ID NO: 512801 - RNA, 19 nt, Homo sapiens
acuuaaaccugugcuuuca

SEQ ID NO: 512802 - RNA, 19 nt, Homo sapiens
acuuaacagaucacaugcc

SEQ ID NO: 512803 - RNA, 16 nt, Homo sapiens
acuuauuuccauggau

SEQ ID NO: 512804 - RNA, 17 nt, Homo sapiens
acuucaaauguuauuca

SEQ ID NO: 512805 - RNA, 14 nt, Homo sapiens
acuucagacucucu

SEQ ID NO: 512806 - RNA, 19 nt, Homo sapiens
acuucauucaaaaagccaa

SEQ ID NO: 512807 - RNA, 16 nt, Homo sapiens
acuucguacccuuugc

SEQ ID NO: 512808 - RNA, 23 nt, Homo sapiens
acuugagggacgacuuucuuuaa

SEQ ID NO: 512809 - RNA, 15 nt, Homo sapiens
acuugggcuggcacc

SEQ ID NO: 512810 - RNA, 20 nt, Homo sapiens
acuugggcuggcacccacug

SEQ ID NO: 512811 - RNA, 17 nt, Homo sapiens
acuuucuuuaacauauc

SEQ ID NO: 512812 - RNA, 20 nt, Homo sapiens
acuuugagccucuuaggcag

SEQ ID NO: 512813 - RNA, 15 nt, Homo sapiens
acuuuggaucaggaa

SEQ ID NO: 512814 - RNA, 22 nt, Homo sapiens
acuuuuccccauugacccucac

SEQ ID NO: 512815 - RNA, 16 nt, Homo sapiens
agaaaaaagugcaacu

SEQ ID NO: 512816 - RNA, 23 nt, Homo sapiens
agaaaaccuaccacauucacuac

SEQ ID NO: 512817 - RNA, 18 nt, Homo sapiens
agaaaauauauuugcaua

SEQ ID NO: 512818 - RNA, 13 nt, Homo sapiens
agaaaauuggacu

SEQ ID NO: 512819 - RNA, 11 nt, Homo sapiens
agaaaccucac

SEQ ID NO: 512820 - RNA, 23 nt, Homo sapiens
agaaauggcuuuccacaucccca

SEQ ID NO: 512821 - RNA, 20 nt, Homo sapiens
agaacauggacuacacacaa

SEQ ID NO: 512822 - RNA, 21 nt, Homo sapiens
agaaccugaaagggcauuuug

SEQ ID NO: 512823 - RNA, 19 nt, Homo sapiens
agaacuccuuucuaaggag

SEQ ID NO: 512824 - RNA, 20 nt, Homo sapiens
agaauaaagccuugugauca

SEQ ID NO: 512825 - RNA, 19 nt, Homo sapiens
agaauaggcaaacuuuuau

SEQ ID NO: 512826 - RNA, 22 nt, Homo sapiens
agaauauggaaacagagcaaaa

SEQ ID NO: 512827 - RNA, 17 nt, Homo sapiens
agaaucaacagugaaca

SEQ ID NO: 512828 - RNA, 12 nt, Homo sapiens
agaaugugcaaa

SEQ ID NO: 512829 - RNA, 16 nt, Homo sapiens
agacaaauacacauac

SEQ ID NO: 512830 - RNA, 19 nt, Homo sapiens
agacaaauguaacacacac

SEQ ID NO: 512831 - RNA, 13 nt, Homo sapiens
agacaacacacac

SEQ ID NO: 512832 - RNA, 16 nt, Homo sapiens
agacaagucugaguag

SEQ ID NO: 512833 - RNA, 20 nt, Homo sapiens
agacaccaauggauccuugu

SEQ ID NO: 512834 - RNA, 16 nt, Homo sapiens
agacacugucaagauu

SEQ ID NO: 512835 - RNA, 21 nt, Homo sapiens
agacagagguuucauuuucau

SEQ ID NO: 512836 - RNA, 20 nt, Homo sapiens
agacagauguuggugcaaua

SEQ ID NO: 512837 - RNA, 16 nt, Homo sapiens
agacagccauacuucc

SEQ ID NO: 512838 - RNA, 22 nt, Homo sapiens
agacagcuauuucgcacuguau

SEQ ID NO: 512839 - RNA, 13 nt, Homo sapiens
agacauaccucuc

SEQ ID NO: 512840 - RNA, 19 nt, Homo sapiens
agacauaccucucaacuua

SEQ ID NO: 512841 - RNA, 15 nt, Homo sapiens
agacaugaaauugag

SEQ ID NO: 512842 - RNA, 19 nt, Homo sapiens
agacauggaauuuaugaau

SEQ ID NO: 512843 - RNA, 24 nt, Homo sapiens
agacgcaagagguuucagcauucc

SEQ ID NO: 512844 - RNA, 18 nt, Homo sapiens
agacgcaaggaucacuug

SEQ ID NO: 512845 - RNA, 21 nt, Homo sapiens
agacgcaaggaucacuugagc

SEQ ID NO: 512846 - RNA, 18 nt, Homo sapiens
agacuguuagacaaaagu

SEQ ID NO: 512847 - RNA, 21 nt, Homo sapiens
agagaaaaagcccucuucaau

SEQ ID NO: 512848 - RNA, 17 nt, Homo sapiens
agagacgaagaccccag

SEQ ID NO: 512849 - RNA, 21 nt, Homo sapiens
agagagcaaucuugcugugaa

SEQ ID NO: 512850 - RNA, 15 nt, Homo sapiens
agagauauaucugaa

SEQ ID NO: 512851 - RNA, 19 nt, Homo sapiens
agagcaaucuugcugugaa

SEQ ID NO: 512852 - RNA, 23 nt, Homo sapiens
agagcaaucuugcugugaaacag

SEQ ID NO: 512853 - RNA, 21 nt, Homo sapiens
agagcggcuuccccauugccu

SEQ ID NO: 512854 - RNA, 14 nt, Homo sapiens
agagcuacuuugag

SEQ ID NO: 512855 - RNA, 14 nt, Homo sapiens
agagcuaugcacac

SEQ ID NO: 512856 - RNA, 22 nt, Homo sapiens
agagcugacccccugcugccau

SEQ ID NO: 512857 - RNA, 18 nt, Homo sapiens
agagcuuuacagugccac

SEQ ID NO: 512858 - RNA, 20 nt, Homo sapiens
agaggaaaaaggcuucucca

SEQ ID NO: 512859 - RNA, 20 nt, Homo sapiens
agaggaaugaggcucuguaa

SEQ ID NO: 512860 - RNA, 15 nt, Homo sapiens
agaggacggcuuccc

SEQ ID NO: 512861 - RNA, 15 nt, Homo sapiens
agaggauuucugcuu

SEQ ID NO: 512862 - RNA, 14 nt, Homo sapiens
agaggcugccucag

SEQ ID NO: 512863 - RNA, 13 nt, Homo sapiens
agaguauggauug

SEQ ID NO: 512864 - RNA, 19 nt, Homo sapiens
agauaagugcucaguauug

SEQ ID NO: 512865 - RNA, 20 nt, Homo sapiens
agauacaggggaucauguua

SEQ ID NO: 512866 - RNA, 15 nt, Homo sapiens
agauaguauacacau

SEQ ID NO: 512867 - RNA, 17 nt, Homo sapiens
agaucccagaguuauuu

SEQ ID NO: 512868 - RNA, 19 nt, Homo sapiens
agaugacuggaaacaagga

SEQ ID NO: 512869 - RNA, 20 nt, Homo sapiens
agaugcaaaucaacucucuc

SEQ ID NO: 512870 - RNA, 19 nt, Homo sapiens
agauguacaauuuagcuua

SEQ ID NO: 512871 - RNA, 15 nt, Homo sapiens
agaugugccuagaca

SEQ ID NO: 512872 - RNA, 16 nt, Homo sapiens
agaugugccuagacac

SEQ ID NO: 512873 - RNA, 13 nt, Homo sapiens
agauucccucucc

SEQ ID NO: 512874 - RNA, 19 nt, Homo sapiens
agauugguaguuaucugag

SEQ ID NO: 512875 - RNA, 15 nt, Homo sapiens
agauuguaaagguag

SEQ ID NO: 512876 - RNA, 17 nt, Homo sapiens
agcaaauaaauaucauc

SEQ ID NO: 512877 - RNA, 14 nt, Homo sapiens
agcaacacaucuac

SEQ ID NO: 512878 - RNA, 22 nt, Homo sapiens
agcaaggugggggucaggcuac

SEQ ID NO: 512879 - RNA, 14 nt, Homo sapiens
agcacaggcauauu

SEQ ID NO: 512880 - RNA, 18 nt, Homo sapiens
agcacaugucucauuuua

SEQ ID NO: 512881 - RNA, 14 nt, Homo sapiens
agcaccagccugag

SEQ ID NO: 512882 - RNA, 14 nt, Homo sapiens
agcaccucuugaag

SEQ ID NO: 512883 - RNA, 22 nt, Homo sapiens
agcacuucaaaggaacuggaau

SEQ ID NO: 512884 - RNA, 16 nt, Homo sapiens
agugcagcaaccagag

SEQ ID NO: 512885 - RNA, 16 nt, Homo sapiens
agugcagugcucagua

SEQ ID NO: 512886 - RNA, 14 nt, Homo sapiens
agugcauucauuca

SEQ ID NO: 512887 - RNA, 17 nt, Homo sapiens
agugccauuaaauugaa

SEQ ID NO: 512888 - RNA, 18 nt, Homo sapiens
agugccgccugugcccac

SEQ ID NO: 512889 - RNA, 23 nt, Homo sapiens
aguggaggaggggguacaguccu

SEQ ID NO: 512890 - RNA, 22 nt, Homo sapiens
aguggauaugcuagcauuuuag

SEQ ID NO: 512891 - RNA, 20 nt, Homo sapiens
aguggcaggugggcugccug

SEQ ID NO: 512892 - RNA, 13 nt, Homo sapiens
aguggcaguauug

SEQ ID NO: 512893 - RNA, 23 nt, Homo sapiens
agugggaagaauaaaaugcagug

SEQ ID NO: 512894 - RNA, 17 nt, Homo sapiens
aguguagaucaacucau

SEQ ID NO: 512895 - RNA, 21 nt, Homo sapiens
agugucuuuuuuuucuucacc

SEQ ID NO: 512896 - RNA, 15 nt, Homo sapiens
agugugucacacuga

SEQ ID NO: 512897 - RNA, 14 nt, Homo sapiens
agugugugugcaau

SEQ ID NO: 512898 - RNA, 19 nt, Homo sapiens
aguguguugggaauugcau

SEQ ID NO: 512899 - RNA, 16 nt, Homo sapiens
aguguuuuuacauaua

SEQ ID NO: 512900 - RNA, 13 nt, Homo sapiens
aguuaaucuucau

SEQ ID NO: 512901 - RNA, 12 nt, Homo sapiens
aguuaccauuaa

SEQ ID NO: 512902 - RNA, 17 nt, Homo sapiens
aguuaggcagugcagua

SEQ ID NO: 512903 - RNA, 17 nt, Homo sapiens
aguucauucauacucaa

SEQ ID NO: 512904 - RNA, 17 nt, Homo sapiens
aguuccggaaagccuuc

SEQ ID NO: 512905 - RNA, 19 nt, Homo sapiens
aguucuccuuguacuugaa

SEQ ID NO: 512906 - RNA, 20 nt, Homo sapiens
aguucuccuuguacuugaau

SEQ ID NO: 512907 - RNA, 11 nt, Homo sapiens
aguucugauga

SEQ ID NO: 512908 - RNA, 16 nt, Homo sapiens
aguuguggacuuuucc

SEQ ID NO: 512909 - RNA, 20 nt, Homo sapiens
aguuuaacaaccauuuaacu

SEQ ID NO: 512910 - RNA, 20 nt, Homo sapiens
aguuuaggacccaagguggu

SEQ ID NO: 512911 - RNA, 23 nt, Homo sapiens
aguuuccagcuaagccugaugau

SEQ ID NO: 512912 - RNA, 22 nt, Homo sapiens
auaaaagccucugguggaaccu

SEQ ID NO: 512913 - RNA, 11 nt, Homo sapiens
auaaacacaga

SEQ ID NO: 512914 - RNA, 13 nt, Homo sapiens
auaaacugugaga

SEQ ID NO: 512915 - RNA, 16 nt, Homo sapiens
auaaacuuguacuuac

SEQ ID NO: 512916 - RNA, 14 nt, Homo sapiens
auaaauaguauuuc

SEQ ID NO: 512917 - RNA, 11 nt, Homo sapiens
auaaauccaac

SEQ ID NO: 512918 - RNA, 14 nt, Homo sapiens
auaacccugaauca

SEQ ID NO: 512919 - RNA, 16 nt, Homo sapiens
auaacuauugcugcuu

SEQ ID NO: 512920 - RNA, 15 nt, Homo sapiens
auaacugagcacuuu

SEQ ID NO: 512921 - RNA, 17 nt, Homo sapiens
auaacugagcacuuuga

SEQ ID NO: 512922 - RNA, 16 nt, Homo sapiens
auaagcaucuguguaa

SEQ ID NO: 512923 - RNA, 20 nt, Homo sapiens
auaauaguuuugagcauucu

SEQ ID NO: 512924 - RNA, 14 nt, Homo sapiens
auacaacacauuga

SEQ ID NO: 512925 - RNA, 12 nt, Homo sapiens
auacacauacau

SEQ ID NO: 512926 - RNA, 16 nt, Homo sapiens
auacacauacauauau

SEQ ID NO: 512927 - RNA, 10 nt, Homo sapiens
auacaguacu

SEQ ID NO: 512928 - RNA, 21 nt, Homo sapiens
auacaguggauagcuugauau

SEQ ID NO: 512929 - RNA, 20 nt, Homo sapiens
auacaugccuuuccagugcu

SEQ ID NO: 512930 - RNA, 13 nt, Homo sapiens
auaccaccuucaa

SEQ ID NO: 512931 - RNA, 22 nt, Homo sapiens
auaccucucaacuuacauaugu

SEQ ID NO: 512932 - RNA, 16 nt, Homo sapiens
auaccuucugaugaag

SEQ ID NO: 512933 - RNA, 15 nt, Homo sapiens
auacucgaaucagac

SEQ ID NO: 512934 - RNA, 13 nt, Homo sapiens
auacuucuuuuua

SEQ ID NO: 512935 - RNA, 15 nt, Homo sapiens
auagcagagaagccu

SEQ ID NO: 512936 - RNA, 13 nt, Homo sapiens
auagcauguaaua

SEQ ID NO: 512937 - RNA, 23 nt, Homo sapiens
auagucauguuucugcaguauuc

SEQ ID NO: 512938 - RNA, 14 nt, Homo sapiens
auaguguguccaug

SEQ ID NO: 512939 - RNA, 20 nt, Homo sapiens
auaguguuguguuacaauaa

SEQ ID NO: 512940 - RNA, 13 nt, Homo sapiens
auauaagccauag

SEQ ID NO: 512941 - RNA, 19 nt, Homo sapiens
auauacagaccuccagauu

SEQ ID NO: 512942 - RNA, 16 nt, Homo sapiens
auauagugaugugcua

SEQ ID NO: 512943 - RNA, 17 nt, Homo sapiens
auaucuguggucuucaa

SEQ ID NO: 512944 - RNA, 13 nt, Homo sapiens
auaugagcuuucg

SEQ ID NO: 512945 - RNA, 13 nt, Homo sapiens
auaugagucacug

SEQ ID NO: 512946 - RNA, 11 nt, Homo sapiens
auaugcauaua

SEQ ID NO: 512947 - RNA, 15 nt, Homo sapiens
auaugcauauauaug

SEQ ID NO: 512948 - RNA, 24 nt, Homo sapiens
auaugcuagcauuuuagcugugca

SEQ ID NO: 512949 - RNA, 13 nt, Homo sapiens
auauuaaaguuac

SEQ ID NO: 512950 - RNA, 20 nt, Homo sapiens
auauuauaucagacugcuuu

SEQ ID NO: 512951 - RNA, 18 nt, Homo sapiens
auauuauuugcuaauuaa

SEQ ID NO: 512952 - RNA, 21 nt, Homo sapiens
auauuuaauaggauaaauuaa

SEQ ID NO: 512953 - RNA, 23 nt, Homo sapiens
auauuugcauaauaugcauauau

SEQ ID NO: 512954 - RNA, 21 nt, Homo sapiens
auauuuuaggaaacucuccau

SEQ ID NO: 512955 - RNA, 18 nt, Homo sapiens
auauuuucugaguagcau

SEQ ID NO: 512956 - RNA, 12 nt, Homo sapiens
aucaaacagaaa

SEQ ID NO: 512957 - RNA, 17 nt, Homo sapiens
aucaagaaacauucaga

SEQ ID NO: 512958 - RNA, 20 nt, Homo sapiens
aucaagaaacauucagacca

SEQ ID NO: 512959 - RNA, 22 nt, Homo sapiens
aucaagucugugaaagucuccu

SEQ ID NO: 512960 - RNA, 21 nt, Homo sapiens
aucacaagucagcacuaccuc

SEQ ID NO: 512961 - RNA, 16 nt, Homo sapiens
aucacauaugugcaua

SEQ ID NO: 512962 - RNA, 17 nt, Homo sapiens
aucagaaagccucucca

SEQ ID NO: 512963 - RNA, 16 nt, Homo sapiens
aucagcucuaaagcag

SEQ ID NO: 512964 - RNA, 21 nt, Homo sapiens
aucauauguuagauacacaaa

SEQ ID NO: 512965 - RNA, 14 nt, Homo sapiens
aucaugcaugcacu

SEQ ID NO: 512966 - RNA, 24 nt, Homo sapiens
aucaugcuucuacuccauggugaa

SEQ ID NO: 512967 - RNA, 23 nt, Homo sapiens
aucauucagaaugugcaaagcag

SEQ ID NO: 512968 - RNA, 22 nt, Homo sapiens
auccaagaccuuacaaccacau

SEQ ID NO: 512969 - RNA, 13 nt, Homo sapiens
auccaauacuguu

SEQ ID NO: 512970 - RNA, 14 nt, Homo sapiens
auccagcaguccaa

SEQ ID NO: 512971 - RNA, 14 nt, Homo sapiens
auccauaucagcuc

SEQ ID NO: 512972 - RNA, 14 nt, Homo sapiens
auccaugugcugcu

SEQ ID NO: 512973 - RNA, 14 nt, Homo sapiens
aucccaagucaaac

SEQ ID NO: 512974 - RNA, 13 nt, Homo sapiens
auccccugccucu

SEQ ID NO: 512975 - RNA, 17 nt, Homo sapiens
aucccuggccaccugcc

SEQ ID NO: 512976 - RNA, 13 nt, Homo sapiens
auccuaccuaacu

SEQ ID NO: 512977 - RNA, 16 nt, Homo sapiens
auccugcaaugggaga

SEQ ID NO: 512978 - RNA, 15 nt, Homo sapiens
aucgaggaagcaccu

SEQ ID NO: 512979 - RNA, 13 nt, Homo sapiens
aucuaagaacuug

SEQ ID NO: 512980 - RNA, 16 nt, Homo sapiens
aucuaccaguuuauuc

SEQ ID NO: 512981 - RNA, 20 nt, Homo sapiens
aucuaccaguuuauuccugu

SEQ ID NO: 512982 - RNA, 13 nt, Homo sapiens
aucuauaccaccu

SEQ ID NO: 512983 - RNA, 12 nt, Homo sapiens
aucuauggauug

SEQ ID NO: 512984 - RNA, 21 nt, Homo sapiens
aucuauuuagagaaacauuuu

SEQ ID NO: 512985 - RNA, 21 nt, Homo sapiens
aucucagcaaucacaagccaa

SEQ ID NO: 512986 - RNA, 22 nt, Homo sapiens
aucuccaggccccuuaccugca

SEQ ID NO: 512987 - RNA, 15 nt, Homo sapiens
aucucuucuuccuuu

SEQ ID NO: 512988 - RNA, 12 nt, Homo sapiens
aucugacauauu

SEQ ID NO: 512989 - RNA, 14 nt, Homo sapiens
aucuguauaucagc

SEQ ID NO: 512990 - RNA, 16 nt, Homo sapiens
aucuguuaucuaguau

SEQ ID NO: 512991 - RNA, 19 nt, Homo sapiens
aucuguuaucuaguaugca

SEQ ID NO: 512992 - RNA, 21 nt, Homo sapiens
aucuuaggauuuaccaaauag

SEQ ID NO: 512993 - RNA, 22 nt, Homo sapiens
aucuuguggucugcugccucag

SEQ ID NO: 512994 - RNA, 16 nt, Homo sapiens
aucuuguuccaugccu

SEQ ID NO: 512995 - RNA, 15 nt, Homo sapiens
aucuuugaaaacuca

SEQ ID NO: 512996 - RNA, 18 nt, Homo sapiens
aucuuugucuuaucuacc

SEQ ID NO: 512997 - RNA, 23 nt, Homo sapiens
augaaaaauaguguguccaugca

SEQ ID NO: 512998 - RNA, 16 nt, Homo sapiens
augaaauacuugacaa

SEQ ID NO: 512999 - RNA, 21 nt, Homo sapiens
augacuucuuuacuaacacug

SEQ ID NO: 513000 - RNA, 22 nt, Homo sapiens
augacuucuuuacuaacacugg

SEQ ID NO: 513001 - RNA, 19 nt, Homo sapiens
cauuuuucauagauaccau

SEQ ID NO: 513002 - RNA, 18 nt, Homo sapiens
cauuuuucuacugcucuu

SEQ ID NO: 513003 - RNA, 16 nt, Homo sapiens
ccaaauaagcaucugu

SEQ ID NO: 513004 - RNA, 17 nt, Homo sapiens
ccaacagcgaagccagu

SEQ ID NO: 513005 - RNA, 11 nt, Homo sapiens
ccaacauguga

SEQ ID NO: 513006 - RNA, 21 nt, Homo sapiens
ccaacaugugauguguugcuc

SEQ ID NO: 513007 - RNA, 15 nt, Homo sapiens
ccaacuccaggguua

SEQ ID NO: 513008 - RNA, 20 nt, Homo sapiens
ccaagaggaaaauauugaca

SEQ ID NO: 513009 - RNA, 21 nt, Homo sapiens
ccaagccaggguuccagacag

SEQ ID NO: 513010 - RNA, 15 nt, Homo sapiens
ccaagguauugagac

SEQ ID NO: 513011 - RNA, 21 nt, Homo sapiens
ccaagguauugagacauauua

SEQ ID NO: 513012 - RNA, 16 nt, Homo sapiens
ccaagugaaugaguuu

SEQ ID NO: 513013 - RNA, 23 nt, Homo sapiens
ccacaaguauugcccuuuaacaa

SEQ ID NO: 513014 - RNA, 17 nt, Homo sapiens
ccacaggagcguguccu

SEQ ID NO: 513015 - RNA, 18 nt, Homo sapiens
ccacaggagcguguccua

SEQ ID NO: 513016 - RNA, 22 nt, Homo sapiens
ccacauuucucugcaaaauguc

SEQ ID NO: 513017 - RNA, 16 nt, Homo sapiens
ccaccaaaaacugggu

SEQ ID NO: 513018 - RNA, 18 nt, Homo sapiens
ccacgugacuuucaacaa

SEQ ID NO: 513019 - RNA, 14 nt, Homo sapiens
ccacgugcagcacc

SEQ ID NO: 513020 - RNA, 21 nt, Homo sapiens
ccacguguccccagagcuuua

SEQ ID NO: 513021 - RNA, 14 nt, Homo sapiens
ccacugccagacau

SEQ ID NO: 513022 - RNA, 17 nt, Homo sapiens
ccacugccagacaugcc

SEQ ID NO: 513023 - RNA, 14 nt, Homo sapiens
ccacuuucccacac

SEQ ID NO: 513024 - RNA, 15 nt, Homo sapiens
ccagaaaaacauuug

SEQ ID NO: 513025 - RNA, 17 nt, Homo sapiens
ccagaaaucuaaucucu

SEQ ID NO: 513026 - RNA, 23 nt, Homo sapiens
ccagaagagggguccgcugggag

SEQ ID NO: 513027 - RNA, 15 nt, Homo sapiens
ccagaagcagcagcu

SEQ ID NO: 513028 - RNA, 23 nt, Homo sapiens
ccagagaaguuugguuucuuugc

SEQ ID NO: 513029 - RNA, 12 nt, Homo sapiens
ccagagcacugu

SEQ ID NO: 513030 - RNA, 17 nt, Homo sapiens
ccagaggguugugauuu

SEQ ID NO: 513031 - RNA, 18 nt, Homo sapiens
ccagcauaguucugcaau

SEQ ID NO: 513032 - RNA, 21 nt, Homo sapiens
ccagcccccacccaugccagc

SEQ ID NO: 513033 - RNA, 22 nt, Homo sapiens
ccagcccgacaggcaugcacca

SEQ ID NO: 513034 - RNA, 15 nt, Homo sapiens
ccagcccuugcucua

SEQ ID NO: 513035 - RNA, 16 nt, Homo sapiens
ccaggacgcaugcagg

SEQ ID NO: 513036 - RNA, 13 nt, Homo sapiens
ccaggaggcugca

SEQ ID NO: 513037 - RNA, 15 nt, Homo sapiens
ccaggccucagggac

SEQ ID NO: 513038 - RNA, 21 nt, Homo sapiens
ccaggguuccagacagggugg

SEQ ID NO: 513039 - RNA, 17 nt, Homo sapiens
ccaguacauaaggaguu

SEQ ID NO: 513040 - RNA, 22 nt, Homo sapiens
ccagugcuacacguuggaguau

SEQ ID NO: 513041 - RNA, 15 nt, Homo sapiens
ccaguuaacuguuaa

SEQ ID NO: 513042 - RNA, 13 nt, Homo sapiens
ccauaggucuuaa

SEQ ID NO: 513043 - RNA, 23 nt, Homo sapiens
ccauaugugagcacuaucuuuca

SEQ ID NO: 513044 - RNA, 19 nt, Homo sapiens
ccauccuucccgcagcacc

SEQ ID NO: 513045 - RNA, 20 nt, Homo sapiens
ccaucuaggaugauuuuccc

SEQ ID NO: 513046 - RNA, 22 nt, Homo sapiens
ccaucuccaggccccuuaccug

SEQ ID NO: 513047 - RNA, 23 nt, Homo sapiens
ccaugaggccuuuccccagugug

SEQ ID NO: 513048 - RNA, 15 nt, Homo sapiens
ccaugguagacugug

SEQ ID NO: 513049 - RNA, 14 nt, Homo sapiens
ccauggugaacuga

SEQ ID NO: 513050 - RNA, 16 nt, Homo sapiens
ccauggugguuucaga

SEQ ID NO: 513051 - RNA, 13 nt, Homo sapiens
ccauuuugaaaua

SEQ ID NO: 513052 - RNA, 18 nt, Homo sapiens
ccauuuuuugucugugau

SEQ ID NO: 513053 - RNA, 14 nt, Homo sapiens
cccaagacuuggag

SEQ ID NO: 513054 - RNA, 16 nt, Homo sapiens
cccaagguggucuugg

SEQ ID NO: 513055 - RNA, 19 nt, Homo sapiens
cccaaguuggagugcagug

SEQ ID NO: 513056 - RNA, 22 nt, Homo sapiens
cccacagagguggaacuuaauu

SEQ ID NO: 513057 - RNA, 19 nt, Homo sapiens
cccacaggagcguguacua

SEQ ID NO: 513058 - RNA, 22 nt, Homo sapiens
cccacaggagcguguacuaccc

SEQ ID NO: 513059 - RNA, 23 nt, Homo sapiens
cccacuaagcuuucuccuuugag

SEQ ID NO: 513060 - RNA, 16 nt, Homo sapiens
cccagaacgcaugcag

SEQ ID NO: 513061 - RNA, 20 nt, Homo sapiens
cccagaagcucaaggcugca

SEQ ID NO: 513062 - RNA, 23 nt, Homo sapiens
cccagaagcucaaggcugcagug

SEQ ID NO: 513063 - RNA, 21 nt, Homo sapiens
cccagguauugucuuuugaca

SEQ ID NO: 513064 - RNA, 23 nt, Homo sapiens
cccaguguggccccagcccgaca

SEQ ID NO: 513065 - RNA, 21 nt, Homo sapiens
cccaugguagacugugacaca

SEQ ID NO: 513066 - RNA, 18 nt, Homo sapiens
cccauugugaauguuguc

SEQ ID NO: 513067 - RNA, 24 nt, Homo sapiens
ccccagagcuuuacagugccacga

SEQ ID NO: 513068 - RNA, 17 nt, Homo sapiens
ccccaugcugggcucac

SEQ ID NO: 513069 - RNA, 12 nt, Homo sapiens
ccccauucagug

SEQ ID NO: 513070 - RNA, 21 nt, Homo sapiens
ccccauucagugacauguccu

SEQ ID NO: 513071 - RNA, 17 nt, Homo sapiens
ccccugcauggcugaga

SEQ ID NO: 513072 - RNA, 17 nt, Homo sapiens
ccccuggacauauuccc

SEQ ID NO: 513073 - RNA, 13 nt, Homo sapiens
ccccuuuuuggca

SEQ ID NO: 513074 - RNA, 22 nt, Homo sapiens
cccguggugagguugugcugcc

SEQ ID NO: 513075 - RNA, 22 nt, Homo sapiens
cccugaaauauuuucuacuuua

SEQ ID NO: 513076 - RNA, 12 nt, Homo sapiens
cccugacacugu

SEQ ID NO: 513077 - RNA, 20 nt, Homo sapiens
cccugcauggcugagagggu

SEQ ID NO: 513078 - RNA, 20 nt, Homo sapiens
cccugugaucuauaccaccu

SEQ ID NO: 513079 - RNA, 21 nt, Homo sapiens
cccugugaucuauaccaccuu

SEQ ID NO: 513080 - RNA, 13 nt, Homo sapiens
cccugugcaguag

SEQ ID NO: 513081 - RNA, 20 nt, Homo sapiens
cccuucaaugcaaaauacau

SEQ ID NO: 513082 - RNA, 11 nt, Homo sapiens
cccuuccccau

SEQ ID NO: 513083 - RNA, 14 nt, Homo sapiens
cccuuuuacaguca

SEQ ID NO: 513084 - RNA, 12 nt, Homo sapiens
ccgcuagucuua

SEQ ID NO: 513085 - RNA, 18 nt, Homo sapiens
ccggaaagccuuccucaa

SEQ ID NO: 513086 - RNA, 16 nt, Homo sapiens
ccggauggaaucacag

SEQ ID NO: 513087 - RNA, 18 nt, Homo sapiens
ccgucagccaagucgcca

SEQ ID NO: 513088 - RNA, 19 nt, Homo sapiens
ccgucuuuugaaaacucau

SEQ ID NO: 513089 - RNA, 17 nt, Homo sapiens
ccguggcuuugugcuua

SEQ ID NO: 513090 - RNA, 21 nt, Homo sapiens
ccguggugagguugugcugcc

SEQ ID NO: 513091 - RNA, 14 nt, Homo sapiens
ccuaaaauacuuau

SEQ ID NO: 513092 - RNA, 17 nt, Homo sapiens
ccuaaacauagugguau

SEQ ID NO: 513093 - RNA, 21 nt, Homo sapiens
ccuaaauuaacaaauucagug

SEQ ID NO: 513094 - RNA, 14 nt, Homo sapiens
ccuaaccuggguug

SEQ ID NO: 513095 - RNA, 12 nt, Homo sapiens
ccuaagagccac

SEQ ID NO: 513096 - RNA, 14 nt, Homo sapiens
ccuaccacauucac

SEQ ID NO: 513097 - RNA, 23 nt, Homo sapiens
ccuaccacauucacuacugcaaa

SEQ ID NO: 513098 - RNA, 22 nt, Homo sapiens
ccuacgguacaagcuacauaug

SEQ ID NO: 513099 - RNA, 20 nt, Homo sapiens
ccuagauccaauugcauuua

SEQ ID NO: 513100 - RNA, 14 nt, Homo sapiens
ccuaggauuccucc

SEQ ID NO: 513101 - RNA, 16 nt, Homo sapiens
ccucacccacuuuggc

SEQ ID NO: 513102 - RNA, 14 nt, Homo sapiens
ccucaccuucccua

SEQ ID NO: 513103 - RNA, 13 nt, Homo sapiens
ccucacuccacuc

SEQ ID NO: 513104 - RNA, 15 nt, Homo sapiens
ccucacugauauauu

SEQ ID NO: 513105 - RNA, 22 nt, Homo sapiens
ccucaggacccagggaaugcca

SEQ ID NO: 513106 - RNA, 15 nt, Homo sapiens
ccucccaagcacuuc

SEQ ID NO: 513107 - RNA, 22 nt, Homo sapiens
ccucccaagcacuucaaaggaa

SEQ ID NO: 513108 - RNA, 21 nt, Homo sapiens
ccucccuguccccugagguua

SEQ ID NO: 513109 - RNA, 14 nt, Homo sapiens
ccuccuguccagca

SEQ ID NO: 513110 - RNA, 12 nt, Homo sapiens
ccucuaucccug

SEQ ID NO: 513111 - RNA, 17 nt, Homo sapiens
ccucucuguuuacccuc

SEQ ID NO: 513112 - RNA, 17 nt, Homo sapiens
ccucugcgccccagcga

SEQ ID NO: 513113 - RNA, 19 nt, Homo sapiens
ccucuuaaugucucaaaau

SEQ ID NO: 513114 - RNA, 17 nt, Homo sapiens
ccucuucuugcggcacc

SEQ ID NO: 513115 - RNA, 19 nt, Homo sapiens
ccucuugaaugcuuaaaug

SEQ ID NO: 513116 - RNA, 14 nt, Homo sapiens
ccugaaagauacag

SEQ ID NO: 513117 - RNA, 20 nt, Homo sapiens
uggggagccauaagggacau

SEQ ID NO: 513118 - RNA, 19 nt, Homo sapiens
uggggccagcgcugaacag

SEQ ID NO: 513119 - RNA, 18 nt, Homo sapiens
uggggccaggaccauggc

SEQ ID NO: 513120 - RNA, 24 nt, Homo sapiens
ugggggaggcggcacauuggcagu

SEQ ID NO: 513121 - RNA, 15 nt, Homo sapiens
ugggggaugugcacg

SEQ ID NO: 513122 - RNA, 17 nt, Homo sapiens
ugggguagagaggacag

SEQ ID NO: 513123 - RNA, 14 nt, Homo sapiens
uggggucugugaug

SEQ ID NO: 513124 - RNA, 15 nt, Homo sapiens
uggguuccagacaga

SEQ ID NO: 513125 - RNA, 12 nt, Homo sapiens
ugguaucucuuu

SEQ ID NO: 513126 - RNA, 15 nt, Homo sapiens
ugguccgacaugccu

SEQ ID NO: 513127 - RNA, 12 nt, Homo sapiens
uggugcagugaa

SEQ ID NO: 513128 - RNA, 14 nt, Homo sapiens
uggugcuggguccu

SEQ ID NO: 513129 - RNA, 18 nt, Homo sapiens
ugguguaugacaguuaga

SEQ ID NO: 513130 - RNA, 11 nt, Homo sapiens
uggugucaaau

SEQ ID NO: 513131 - RNA, 19 nt, Homo sapiens
uggugugaggcccccggag

SEQ ID NO: 513132 - RNA, 14 nt, Homo sapiens
ugguguggcugcuc

SEQ ID NO: 513133 - RNA, 16 nt, Homo sapiens
ugguuaaaauguaggc

SEQ ID NO: 513134 - RNA, 17 nt, Homo sapiens
ugguuucuuugcugcaa

SEQ ID NO: 513135 - RNA, 14 nt, Homo sapiens
uguaaagauauugu

SEQ ID NO: 513136 - RNA, 19 nt, Homo sapiens
uguaauccuagcacuuugg

SEQ ID NO: 513137 - RNA, 13 nt, Homo sapiens
uguaaugcaugcc

SEQ ID NO: 513138 - RNA, 14 nt, Homo sapiens
uguacaaaauaucc

SEQ ID NO: 513139 - RNA, 18 nt, Homo sapiens
uguacaaaauauccaagc

SEQ ID NO: 513140 - RNA, 14 nt, Homo sapiens
uguacuaccccagg

SEQ ID NO: 513141 - RNA, 14 nt, Homo sapiens
uguacuuacacuga

SEQ ID NO: 513142 - RNA, 21 nt, Homo sapiens
uguagaugaaaaagcauguac

SEQ ID NO: 513143 - RNA, 13 nt, Homo sapiens
uguauccaaguua

SEQ ID NO: 513144 - RNA, 11 nt, Homo sapiens
uguauccucca

SEQ ID NO: 513145 - RNA, 14 nt, Homo sapiens
uguaucugacauau

SEQ ID NO: 513146 - RNA, 13 nt, Homo sapiens
uguauguguauau

SEQ ID NO: 513147 - RNA, 19 nt, Homo sapiens
uguauucucuucuacaaua

SEQ ID NO: 513148 - RNA, 19 nt, Homo sapiens
ugucaggauaguugcucca

SEQ ID NO: 513149 - RNA, 16 nt, Homo sapiens
ugucagugagucagag

SEQ ID NO: 513150 - RNA, 20 nt, Homo sapiens
ugucaguuugugaagugauu

SEQ ID NO: 513151 - RNA, 19 nt, Homo sapiens
ugucauauuuuccuuuaug

SEQ ID NO: 513152 - RNA, 13 nt, Homo sapiens
ugucccuucacau

SEQ ID NO: 513153 - RNA, 18 nt, Homo sapiens
ugucuacggaagccucug

SEQ ID NO: 513154 - RNA, 18 nt, Homo sapiens
ugucucaaaauaaaacca

SEQ ID NO: 513155 - RNA, 16 nt, Homo sapiens
ugucuccucugucagu

SEQ ID NO: 513156 - RNA, 14 nt, Homo sapiens
ugucuguacuucau

SEQ ID NO: 513157 - RNA, 12 nt, Homo sapiens
ugucuugcugag

SEQ ID NO: 513158 - RNA, 13 nt, Homo sapiens
ugucuuucuccaa

SEQ ID NO: 513159 - RNA, 23 nt, Homo sapiens
ugucuuuuuuuucuucaccucac

SEQ ID NO: 513160 - RNA, 19 nt, Homo sapiens
ugugacucaagccuuucac

SEQ ID NO: 513161 - RNA, 12 nt, Homo sapiens
ugugaucuauac

SEQ ID NO: 513162 - RNA, 20 nt, Homo sapiens
ugugaucuguuguaauauca

SEQ ID NO: 513163 - RNA, 18 nt, Homo sapiens
ugugcagaaaacauuguu

SEQ ID NO: 513164 - RNA, 14 nt, Homo sapiens
ugugcagacugugg

SEQ ID NO: 513165 - RNA, 15 nt, Homo sapiens
ugugcagacuguggc

SEQ ID NO: 513166 - RNA, 12 nt, Homo sapiens
ugugccaaagau

SEQ ID NO: 513167 - RNA, 18 nt, Homo sapiens
ugugccccuuccccaugc

SEQ ID NO: 513168 - RNA, 20 nt, Homo sapiens
ugugcucuacaucucguaug

SEQ ID NO: 513169 - RNA, 17 nt, Homo sapiens
ugugcuuugccacugaa

SEQ ID NO: 513170 - RNA, 20 nt, Homo sapiens
uguguagcucuguccacucu

SEQ ID NO: 513171 - RNA, 16 nt, Homo sapiens
ugugucaucugucagc

SEQ ID NO: 513172 - RNA, 22 nt, Homo sapiens
uguguccuaaaugcaaagcaca

SEQ ID NO: 513173 - RNA, 22 nt, Homo sapiens
ugugugcuuugccacugaagua

SEQ ID NO: 513174 - RNA, 20 nt, Homo sapiens
uguguucucaacacacagua

SEQ ID NO: 513175 - RNA, 21 nt, Homo sapiens
uguguugggaauugcaugcca

SEQ ID NO: 513176 - RNA, 15 nt, Homo sapiens
uguguuuuucaguua

SEQ ID NO: 513177 - RNA, 15 nt, Homo sapiens
uguucucuaguuuuc

SEQ ID NO: 513178 - RNA, 19 nt, Homo sapiens
uguucuugcagucaucaga

SEQ ID NO: 513179 - RNA, 20 nt, Homo sapiens
uguugauucuagguugaaaa

SEQ ID NO: 513180 - RNA, 21 nt, Homo sapiens
uguuucgcauuaagcacacac

SEQ ID NO: 513181 - RNA, 12 nt, Homo sapiens
uguuuuguggau

SEQ ID NO: 513182 - RNA, 23 nt, Homo sapiens
uuaaaaagaccaugcauucagau

SEQ ID NO: 513183 - RNA, 19 nt, Homo sapiens
uuaaaauaauuauaugaag

SEQ ID NO: 513184 - RNA, 22 nt, Homo sapiens
uuaaaauguaggccuccaguuc

SEQ ID NO: 513185 - RNA, 19 nt, Homo sapiens
uuaaacuucuuaacuggca

SEQ ID NO: 513186 - RNA, 16 nt, Homo sapiens
uuaaagcacaugucuc

SEQ ID NO: 513187 - RNA, 20 nt, Homo sapiens
uuaaaggaaaguucuauuau

SEQ ID NO: 513188 - RNA, 19 nt, Homo sapiens
uuaaaguuacauuaugugu

SEQ ID NO: 513189 - RNA, 20 nt, Homo sapiens
uuaaaguuacauuaugugua

SEQ ID NO: 513190 - RNA, 14 nt, Homo sapiens
uuaaauguguuccu

SEQ ID NO: 513191 - RNA, 20 nt, Homo sapiens
uuaacauaaacuuguacuua

SEQ ID NO: 513192 - RNA, 13 nt, Homo sapiens
uuaagcacacaca

SEQ ID NO: 513193 - RNA, 20 nt, Homo sapiens
uuaaguacugaaauacauau

SEQ ID NO: 513194 - RNA, 14 nt, Homo sapiens
uuaagucaaagaag

SEQ ID NO: 513195 - RNA, 13 nt, Homo sapiens
uuaauaaagauuc

SEQ ID NO: 513196 - RNA, 13 nt, Homo sapiens
uuaauccaaagaa

SEQ ID NO: 513197 - RNA, 23 nt, Homo sapiens
uuaaugagauguuauuacuguuu

SEQ ID NO: 513198 - RNA, 13 nt, Homo sapiens
uuaauguucuaua

SEQ ID NO: 513199 - RNA, 11 nt, Homo sapiens
uuaauugcuca

SEQ ID NO: 513200 - RNA, 21 nt, Homo sapiens
uuaauuggcccuguacaguuu

SEQ ID NO: 513201 - RNA, 22 nt, Homo sapiens
uuaauuggcccuguacaguuug

SEQ ID NO: 513202 - RNA, 19 nt, Homo sapiens
uuacaguggcaguauugac

SEQ ID NO: 513203 - RNA, 18 nt, Homo sapiens
uuaccacaggaugcauau

SEQ ID NO: 513204 - RNA, 14 nt, Homo sapiens
uuacccaaugcagu

SEQ ID NO: 513205 - RNA, 14 nt, Homo sapiens
uuaccuguucucua

SEQ ID NO: 513206 - RNA, 22 nt, Homo sapiens
uuacuauaauugagaacuacag

SEQ ID NO: 513207 - RNA, 16 nt, Homo sapiens
uuacuuacacaccuga

SEQ ID NO: 513208 - RNA, 17 nt, Homo sapiens
uuagaauggggcuucca

SEQ ID NO: 513209 - RNA, 19 nt, Homo sapiens
uuagaauguugaaacugac

SEQ ID NO: 513210 - RNA, 14 nt, Homo sapiens
uuagagaaacauuu

SEQ ID NO: 513211 - RNA, 15 nt, Homo sapiens
uuagcagcucuuccc

SEQ ID NO: 513212 - RNA, 23 nt, Homo sapiens
uuaggaaagcagugcaguacuca

SEQ ID NO: 513213 - RNA, 18 nt, Homo sapiens
uuaggauuuaccaaauag

SEQ ID NO: 513214 - RNA, 15 nt, Homo sapiens
uuaggcagugcagua

SEQ ID NO: 513215 - RNA, 13 nt, Homo sapiens
uuaguaucucauc

SEQ ID NO: 513216 - RNA, 19 nt, Homo sapiens
uuagucaguguacucugag

SEQ ID NO: 513217 - RNA, 21 nt, Homo sapiens
uuagucuguagaaucuagcca

SEQ ID NO: 513218 - RNA, 22 nt, Homo sapiens
uuaguugaccaacuauauugcg

SEQ ID NO: 513219 - RNA, 12 nt, Homo sapiens
uuauaccuguac

SEQ ID NO: 513220 - RNA, 16 nt, Homo sapiens
uuauagucuguacuuc

SEQ ID NO: 513221 - RNA, 20 nt, Homo sapiens
uuauaguuauucaaauccau

SEQ ID NO: 513222 - RNA, 15 nt, Homo sapiens
uuaucaaaaaacaga

SEQ ID NO: 513223 - RNA, 22 nt, Homo sapiens
uuaucaaaaaacagaaaaacaa

SEQ ID NO: 513224 - RNA, 22 nt, Homo sapiens
uuaucaauaagugccauuaaau

SEQ ID NO: 513225 - RNA, 11 nt, Homo sapiens
uuaucaugugu

SEQ ID NO: 513226 - RNA, 17 nt, Homo sapiens
uuauccuccuucacucc

SEQ ID NO: 513227 - RNA, 19 nt, Homo sapiens
uuaucugauccuuguggca

SEQ ID NO: 513228 - RNA, 11 nt, Homo sapiens
uuaugaaucuc

SEQ ID NO: 513229 - RNA, 19 nt, Homo sapiens
uuaugguaccucugucuau

SEQ ID NO: 513230 - RNA, 21 nt, Homo sapiens
uuauucaauaacuauugcugc

SEQ ID NO: 513231 - RNA, 23 nt, Homo sapiens
uuauucaauaacuauugcugcuu

SEQ ID NO: 513232 - RNA, 13 nt, Homo sapiens
uuauuugaucugg

SEQ ID NO: 513233 - RNA, 17 nt, Homo sapiens
uuauuuucuguaauucu

SEQ ID NO: 513234 - RNA, 15 nt, Homo sapiens
aaaaacaggauacga

SEQ ID NO: 513235 - RNA, 19 nt, Homo sapiens
aaaaacauuuggcauuccu

SEQ ID NO: 513236 - RNA, 14 nt, Homo sapiens
aaaaagauccaggg

SEQ ID NO: 513237 - RNA, 23 nt, Homo sapiens
aaaaagcaucuguauuaauguaa

SEQ ID NO: 513238 - RNA, 21 nt, Homo sapiens
aaaaaucagaaagacauucuu

SEQ ID NO: 513239 - RNA, 19 nt, Homo sapiens
aaaaaucccauuuaugcaa

SEQ ID NO: 513240 - RNA, 23 nt, Homo sapiens
aaaacaaauucaagaaugcagua

SEQ ID NO: 513241 - RNA, 17 nt, Homo sapiens
aaaaccuaccacauuca

SEQ ID NO: 513242 - RNA, 12 nt, Homo sapiens
aaaacugugaca

SEQ ID NO: 513243 - RNA, 24 nt, Homo sapiens
aaaacuugcaugcagcagcuuuug

SEQ ID NO: 513244 - RNA, 18 nt, Homo sapiens
aaaagaugaagcugagau

SEQ ID NO: 513245 - RNA, 14 nt, Homo sapiens
aaaagcaccucuug

SEQ ID NO: 513246 - RNA, 21 nt, Homo sapiens
aaaaggcuugagucuggauaa

SEQ ID NO: 513247 - RNA, 15 nt, Homo sapiens
aaaaguuuucaagca

SEQ ID NO: 513248 - RNA, 19 nt, Homo sapiens
aaaauacaugguaucucuu

SEQ ID NO: 513249 - RNA, 14 nt, Homo sapiens
aaaauagcuauaaa

SEQ ID NO: 513250 - RNA, 18 nt, Homo sapiens
aaaauaguguguccaugc

SEQ ID NO: 513251 - RNA, 21 nt, Homo sapiens
aaaauauaguguuguguuaca

SEQ ID NO: 513252 - RNA, 23 nt, Homo sapiens
aaaauauauuugcauaauaugca

SEQ ID NO: 513253 - RNA, 11 nt, Homo sapiens
aaaaugcuuuc

SEQ ID NO: 513254 - RNA, 13 nt, Homo sapiens
aaaauuaugucca

SEQ ID NO: 513255 - RNA, 14 nt, Homo sapiens
aaacaaaauccuug

SEQ ID NO: 513256 - RNA, 15 nt, Homo sapiens
aaacaaauauacuca

SEQ ID NO: 513257 - RNA, 22 nt, Homo sapiens
aaacaaauucaagaaugcagua

SEQ ID NO: 513258 - RNA, 13 nt, Homo sapiens
aaacaaauuccuu

SEQ ID NO: 513259 - RNA, 14 nt, Homo sapiens
aaacacaauaucau

SEQ ID NO: 513260 - RNA, 22 nt, Homo sapiens
aaacacggaguuuccauuugga

SEQ ID NO: 513261 - RNA, 14 nt, Homo sapiens
aaacauagugguau

SEQ ID NO: 513262 - RNA, 13 nt, Homo sapiens
aaacauugccuua

SEQ ID NO: 513263 - RNA, 11 nt, Homo sapiens
aaacauuguuc

SEQ ID NO: 513264 - RNA, 11 nt, Homo sapiens
aaacauuuccc

SEQ ID NO: 513265 - RNA, 23 nt, Homo sapiens
aaaccaauuuguucugugcaaca

SEQ ID NO: 513266 - RNA, 19 nt, Homo sapiens
aaacuacccucuggagaua

SEQ ID NO: 513267 - RNA, 23 nt, Homo sapiens
aaacuuggacauuuauguacaaa

SEQ ID NO: 513268 - RNA, 15 nt, Homo sapiens
aaacuuguacuuaca

SEQ ID NO: 513269 - RNA, 15 nt, Homo sapiens
aaacuuuggaaguuu

SEQ ID NO: 513270 - RNA, 17 nt, Homo sapiens
aaagagaaaaagcccuc

SEQ ID NO: 513271 - RNA, 14 nt, Homo sapiens
aaagauacagggga

SEQ ID NO: 513272 - RNA, 18 nt, Homo sapiens
aaagaugaagcugagaug

SEQ ID NO: 513273 - RNA, 21 nt, Homo sapiens
aaagauugcuauaauguauaa

SEQ ID NO: 513274 - RNA, 14 nt, Homo sapiens
aaagcaauccaugu

SEQ ID NO: 513275 - RNA, 19 nt, Homo sapiens
aaagcacuuuacagaugag

SEQ ID NO: 513276 - RNA, 14 nt, Homo sapiens
aaagcagugcagua

SEQ ID NO: 513277 - RNA, 23 nt, Homo sapiens
aaagcauagacgucucagguuau

SEQ ID NO: 513278 - RNA, 22 nt, Homo sapiens
aaagcaugcucaguauugagac

SEQ ID NO: 513279 - RNA, 17 nt, Homo sapiens
aaagcauguacaguguu

SEQ ID NO: 513280 - RNA, 14 nt, Homo sapiens
aaaggaaaguucua

SEQ ID NO: 513281 - RNA, 20 nt, Homo sapiens
aaaggcuggaugugcuuuca

SEQ ID NO: 513282 - RNA, 19 nt, Homo sapiens
aaaggggacagaucuugag

SEQ ID NO: 513283 - RNA, 13 nt, Homo sapiens
aaagguaggugca

SEQ ID NO: 513284 - RNA, 9 nt, Homo sapiens
aaagugcaa

SEQ ID NO: 513285 - RNA, 17 nt, Homo sapiens
aaaguguuuuuacauau

SEQ ID NO: 513286 - RNA, 20 nt, Homo sapiens
aaaguugugaucuguuguaa

SEQ ID NO: 513287 - RNA, 15 nt, Homo sapiens
aaauaauauugccuu

SEQ ID NO: 513288 - RNA, 15 nt, Homo sapiens
acacaggccugauaa

SEQ ID NO: 513289 - RNA, 18 nt, Homo sapiens
acacagugcaguacucag

SEQ ID NO: 513290 - RNA, 18 nt, Homo sapiens
acacaguguagugcucag

SEQ ID NO: 513291 - RNA, 13 nt, Homo sapiens
acacauacacaca

SEQ ID NO: 513292 - RNA, 13 nt, Homo sapiens
acaccuagacucu

SEQ ID NO: 513293 - RNA, 21 nt, Homo sapiens
acacucaucagguaaacugau

SEQ ID NO: 513294 - RNA, 14 nt, Homo sapiens
acacuucuccuuaa

SEQ ID NO: 513295 - RNA, 16 nt, Homo sapiens
acagaaaagaaauuag

SEQ ID NO: 513296 - RNA, 21 nt, Homo sapiens
acagaaccaacgggucugugg

SEQ ID NO: 513297 - RNA, 17 nt, Homo sapiens
acagaccucggcugugu

SEQ ID NO: 513298 - RNA, 14 nt, Homo sapiens
acagagaacccugu

SEQ ID NO: 513299 - RNA, 20 nt, Homo sapiens
acagagagcggcuuccccau

SEQ ID NO: 513300 - RNA, 14 nt, Homo sapiens
acagagaucagaau

SEQ ID NO: 513301 - RNA, 20 nt, Homo sapiens
acagaggacggcuuccccau

SEQ ID NO: 513302 - RNA, 12 nt, Homo sapiens
acagagugcccu

SEQ ID NO: 513303 - RNA, 22 nt, Homo sapiens
acagauguacaauuuagcuuaa

SEQ ID NO: 513304 - RNA, 11 nt, Homo sapiens
acagcauuuca

SEQ ID NO: 513305 - RNA, 17 nt, Homo sapiens
acagcgaagccagucca

SEQ ID NO: 513306 - RNA, 22 nt, Homo sapiens
acagcggcccggcccacgcaga

SEQ ID NO: 513307 - RNA, 13 nt, Homo sapiens
acagcuuccccau

SEQ ID NO: 513308 - RNA, 18 nt, Homo sapiens
acaggcaguuaggugcug

SEQ ID NO: 513309 - RNA, 15 nt, Homo sapiens
acagggcguccucuc

SEQ ID NO: 513310 - RNA, 22 nt, Homo sapiens
acaguaacugccauuuuuuguc

SEQ ID NO: 513311 - RNA, 16 nt, Homo sapiens
acagugcagugcucag

SEQ ID NO: 513312 - RNA, 14 nt, Homo sapiens
acaguuugcuuauu

SEQ ID NO: 513313 - RNA, 12 nt, Homo sapiens
acauaaacacuu

SEQ ID NO: 513314 - RNA, 19 nt, Homo sapiens
acauaguguuuguaacacc

SEQ ID NO: 513315 - RNA, 12 nt, Homo sapiens
acaucauauguu

SEQ ID NO: 513316 - RNA, 21 nt, Homo sapiens
acaucuaccaacccugugcau

SEQ ID NO: 513317 - RNA, 14 nt, Homo sapiens
acaucucuucaugc

SEQ ID NO: 513318 - RNA, 19 nt, Homo sapiens
acaucuguauaucagcucu

SEQ ID NO: 513319 - RNA, 18 nt, Homo sapiens
acaugacccguacacacc

SEQ ID NO: 513320 - RNA, 14 nt, Homo sapiens
acaugccuugaaac

SEQ ID NO: 513321 - RNA, 22 nt, Homo sapiens
acaugcucaucccaaaagcuag

SEQ ID NO: 513322 - RNA, 22 nt, Homo sapiens
acauggacuacacacaauacag

SEQ ID NO: 513323 - RNA, 15 nt, Homo sapiens
acauuggcagugugu

SEQ ID NO: 513324 - RNA, 14 nt, Homo sapiens
acauuuucuacccu

SEQ ID NO: 513325 - RNA, 20 nt, Homo sapiens
acauuuuucauagauaccau

SEQ ID NO: 513326 - RNA, 13 nt, Homo sapiens
accaaaaacuggg

SEQ ID NO: 513327 - RNA, 22 nt, Homo sapiens
accaaaugccuuucuagcaauu

SEQ ID NO: 513328 - RNA, 14 nt, Homo sapiens
accaagcugugacc

SEQ ID NO: 513329 - RNA, 21 nt, Homo sapiens
accaaggagaggucuugcuca

SEQ ID NO: 513330 - RNA, 21 nt, Homo sapiens
accaaugggguuguuagcuuu

SEQ ID NO: 513331 - RNA, 23 nt, Homo sapiens
accaauuuagaaugaauauuaaa

SEQ ID NO: 513332 - RNA, 19 nt, Homo sapiens
accacuuccuuaacagcug

SEQ ID NO: 513333 - RNA, 19 nt, Homo sapiens
accagaauggggacaucuu

SEQ ID NO: 513334 - RNA, 17 nt, Homo sapiens
accaggagcuagcccag

SEQ ID NO: 513335 - RNA, 19 nt, Homo sapiens
accauuauggcuuugugcu

SEQ ID NO: 513336 - RNA, 17 nt, Homo sapiens
accauuuccccuguggu

SEQ ID NO: 513337 - RNA, 18 nt, Homo sapiens
acccaacgacccaugacc

SEQ ID NO: 513338 - RNA, 15 nt, Homo sapiens
acccacugccagaca

SEQ ID NO: 513339 - RNA, 16 nt, Homo sapiens
acccagggaaugccag

SEQ ID NO: 513340 - RNA, 17 nt, Homo sapiens
acccaguguucagcaua

SEQ ID NO: 513341 - RNA, 19 nt, Homo sapiens
acccaugaccguucucuga

SEQ ID NO: 513342 - RNA, 21 nt, Homo sapiens
acccauguucucaauacccac

SEQ ID NO: 513343 - RNA, 17 nt, Homo sapiens
accccaagcgacagagu

SEQ ID NO: 513344 - RNA, 19 nt, Homo sapiens
accccgucugccccuugac

SEQ ID NO: 513345 - RNA, 18 nt, Homo sapiens
accccugaaaucugaguu

SEQ ID NO: 513346 - RNA, 15 nt, Homo sapiens
acccuaucaucaguu

SEQ ID NO: 513347 - RNA, 23 nt, Homo sapiens
acccuccggccagcgagugguca

SEQ ID NO: 513348 - RNA, 14 nt, Homo sapiens
acccuccuguccag

SEQ ID NO: 513349 - RNA, 19 nt, Homo sapiens
acccucuggagauaaaaua

SEQ ID NO: 513350 - RNA, 14 nt, Homo sapiens
acccugaaucagag

SEQ ID NO: 513351 - RNA, 13 nt, Homo sapiens
acccugcaggcag

SEQ ID NO: 513352 - RNA, 15 nt, Homo sapiens
acccuggacagugcc

SEQ ID NO: 513353 - RNA, 21 nt, Homo sapiens
acccuuuuacagucacauuca

SEQ ID NO: 513354 - RNA, 14 nt, Homo sapiens
accgugacugcaag

SEQ ID NO: 513355 - RNA, 23 nt, Homo sapiens
accuaugugugugcuuugccacu

SEQ ID NO: 513356 - RNA, 19 nt, Homo sapiens
accuccccugguccugcac

SEQ ID NO: 513357 - RNA, 20 nt, Homo sapiens
accuccucccaagcacuuca

SEQ ID NO: 513358 - RNA, 16 nt, Homo sapiens
accucucaacuuacau

SEQ ID NO: 513359 - RNA, 11 nt, Homo sapiens
accucuuguuu

SEQ ID NO: 513360 - RNA, 19 nt, Homo sapiens
accuggguaacaaagugag

SEQ ID NO: 513361 - RNA, 18 nt, Homo sapiens
accuguacacacacagac

SEQ ID NO: 513362 - RNA, 14 nt, Homo sapiens
accugugcuuucau

SEQ ID NO: 513363 - RNA, 22 nt, Homo sapiens
accuguucacgugacuccucaa

SEQ ID NO: 513364 - RNA, 14 nt, Homo sapiens
accuuaaaacauua

SEQ ID NO: 513365 - RNA, 12 nt, Homo sapiens
acgcaugcaggg

SEQ ID NO: 513366 - RNA, 19 nt, Homo sapiens
acgccgauauaagccauag

SEQ ID NO: 513367 - RNA, 20 nt, Homo sapiens
acggaaugaccagaaaauuu

SEQ ID NO: 513368 - RNA, 16 nt, Homo sapiens
acggccgucccugacu

SEQ ID NO: 513369 - RNA, 19 nt, Homo sapiens
acgguccuuugagugucag

SEQ ID NO: 513370 - RNA, 13 nt, Homo sapiens
acgugacuuucaa

SEQ ID NO: 513371 - RNA, 15 nt, Homo sapiens
acgugugcagacugu

SEQ ID NO: 513372 - RNA, 19 nt, Homo sapiens
acgugugcagacuguggcu

SEQ ID NO: 513373 - RNA, 16 nt, Homo sapiens
acuaaaagugauguga

SEQ ID NO: 513374 - RNA, 15 nt, Homo sapiens
acuaaauagcaugua

SEQ ID NO: 513375 - RNA, 16 nt, Homo sapiens
acuacagaaguggaag

SEQ ID NO: 513376 - RNA, 20 nt, Homo sapiens
acuaccccagaacgcaugca

SEQ ID NO: 513377 - RNA, 16 nt, Homo sapiens
acuacgacuggcaucu

SEQ ID NO: 513378 - RNA, 22 nt, Homo sapiens
acuagcaauaaguugaaugaua

SEQ ID NO: 513379 - RNA, 15 nt, Homo sapiens
acuaguugcuuacaa

SEQ ID NO: 513380 - RNA, 16 nt, Homo sapiens
acuauggagaaacuuu

SEQ ID NO: 513381 - RNA, 15 nt, Homo sapiens
acuauguagucuguu

SEQ ID NO: 513382 - RNA, 14 nt, Homo sapiens
acucaagccuuuca

SEQ ID NO: 513383 - RNA, 17 nt, Homo sapiens
acucaggcagugcagua

SEQ ID NO: 513384 - RNA, 20 nt, Homo sapiens
acucaguaaaucagugcagu

SEQ ID NO: 513385 - RNA, 21 nt, Homo sapiens
acucaguaaaucagugcagua

SEQ ID NO: 513386 - RNA, 18 nt, Homo sapiens
acucaguaacagugcagu

SEQ ID NO: 513387 - RNA, 21 nt, Homo sapiens
acucaguaaggcagugcagua

SEQ ID NO: 513388 - RNA, 17 nt, Homo sapiens
acucaguauauagccuu

SEQ ID NO: 513389 - RNA, 11 nt, Homo sapiens
acuccaaggag

SEQ ID NO: 513390 - RNA, 17 nt, Homo sapiens
acuccguuuccaaauac

SEQ ID NO: 513391 - RNA, 23 nt, Homo sapiens
acuccucccccuccuccaugcug

SEQ ID NO: 513392 - RNA, 23 nt, Homo sapiens
acucgauuuuaccauauggaaua

SEQ ID NO: 513393 - RNA, 19 nt, Homo sapiens
acucguuauucauacaaau

SEQ ID NO: 513394 - RNA, 14 nt, Homo sapiens
acucuaaaacuauc

SEQ ID NO: 513395 - RNA, 19 nt, Homo sapiens
acucuaaaacuaucagcag

SEQ ID NO: 513396 - RNA, 12 nt, Homo sapiens
acucuccaugau

SEQ ID NO: 513397 - RNA, 18 nt, Homo sapiens
acucucuacuacacaggc

SEQ ID NO: 513398 - RNA, 15 nt, Homo sapiens
acucugaauuuccag

SEQ ID NO: 513399 - RNA, 17 nt, Homo sapiens
acugaagcagagucaag

SEQ ID NO: 513400 - RNA, 19 nt, Homo sapiens
acugagcugggcaccacag

SEQ ID NO: 513401 - RNA, 18 nt, Homo sapiens
acugaguuagaauguuga

SEQ ID NO: 513402 - RNA, 13 nt, Homo sapiens
acugaugagacaa

SEQ ID NO: 513403 - RNA, 20 nt, Homo sapiens
acuggaaguaagaaauauua

SEQ ID NO: 513404 - RNA, 21 nt, Homo sapiens
acuggaauaagaagcaaauaa

SEQ ID NO: 513405 - RNA, 18 nt, Homo sapiens
ucccaugguagacuguga

SEQ ID NO: 513406 - RNA, 13 nt, Homo sapiens
ucccauugcaguu

SEQ ID NO: 513407 - RNA, 14 nt, Homo sapiens
ucccauuggccuua

SEQ ID NO: 513408 - RNA, 20 nt, Homo sapiens
ucccccaccuucaagcaccc

SEQ ID NO: 513409 - RNA, 14 nt, Homo sapiens
uccccuggacauau

SEQ ID NO: 513410 - RNA, 15 nt, Homo sapiens
uccccugguccugca

SEQ ID NO: 513411 - RNA, 20 nt, Homo sapiens
uccccugguccugcacuguc

SEQ ID NO: 513412 - RNA, 22 nt, Homo sapiens
ucccguuguguggguuuacucu

SEQ ID NO: 513413 - RNA, 16 nt, Homo sapiens
ucccuaaaauacuuau

SEQ ID NO: 513414 - RNA, 11 nt, Homo sapiens
ucccuccacuc

SEQ ID NO: 513415 - RNA, 19 nt, Homo sapiens
ucccugaacacucaucccc

SEQ ID NO: 513416 - RNA, 19 nt, Homo sapiens
ucccuggaaauaacugagc

SEQ ID NO: 513417 - RNA, 16 nt, Homo sapiens
ucccuuccccacaaua

SEQ ID NO: 513418 - RNA, 21 nt, Homo sapiens
ucccuuccccacaauaggcuu

SEQ ID NO: 513419 - RNA, 14 nt, Homo sapiens
ucccuugauucaaa

SEQ ID NO: 513420 - RNA, 13 nt, Homo sapiens
uccgcccgcccac

SEQ ID NO: 513421 - RNA, 19 nt, Homo sapiens
uccggaaagccuuccucaa

SEQ ID NO: 513422 - RNA, 23 nt, Homo sapiens
uccggauggaaucacagccaaua

SEQ ID NO: 513423 - RNA, 21 nt, Homo sapiens
uccuauccccggacgcaugca

SEQ ID NO: 513424 - RNA, 12 nt, Homo sapiens
uccuauuggcau

SEQ ID NO: 513425 - RNA, 18 nt, Homo sapiens
uccuccaguucugaugag

SEQ ID NO: 513426 - RNA, 18 nt, Homo sapiens
uccucuccucguccggcc

SEQ ID NO: 513427 - RNA, 12 nt, Homo sapiens
uccucuuaccug

SEQ ID NO: 513428 - RNA, 17 nt, Homo sapiens
uccugacaaaagggaca

SEQ ID NO: 513429 - RNA, 18 nt, Homo sapiens
uccugaguggcugaaaua

SEQ ID NO: 513430 - RNA, 23 nt, Homo sapiens
uccugcccccccaccccacuccc

SEQ ID NO: 513431 - RNA, 20 nt, Homo sapiens
uccugggggcugcugcacug

SEQ ID NO: 513432 - RNA, 21 nt, Homo sapiens
uccugggggcugcugcacugc

SEQ ID NO: 513433 - RNA, 17 nt, Homo sapiens
uccuuaacagcuguauu

SEQ ID NO: 513434 - RNA, 17 nt, Homo sapiens
uccuuagaauacuguau

SEQ ID NO: 513435 - RNA, 18 nt, Homo sapiens
uccuuagaauacuguauu

SEQ ID NO: 513436 - RNA, 15 nt, Homo sapiens
uccuugaaaccagcu

SEQ ID NO: 513437 - RNA, 22 nt, Homo sapiens
uccuugaggucuugaguuucau

SEQ ID NO: 513438 - RNA, 11 nt, Homo sapiens
uccuuguacuu

SEQ ID NO: 513439 - RNA, 18 nt, Homo sapiens
uccuuguagaucuuugug

SEQ ID NO: 513440 - RNA, 14 nt, Homo sapiens
uccuuuaugugaug

SEQ ID NO: 513441 - RNA, 15 nt, Homo sapiens
ucgcuaauagaauau

SEQ ID NO: 513442 - RNA, 21 nt, Homo sapiens
ucgcuacuggcaucuguuauc

SEQ ID NO: 513443 - RNA, 12 nt, Homo sapiens
ucgcuuugccau

SEQ ID NO: 513444 - RNA, 17 nt, Homo sapiens
ucggaauucccugaguc

SEQ ID NO: 513445 - RNA, 19 nt, Homo sapiens
ucguccuuagaauacugua

SEQ ID NO: 513446 - RNA, 16 nt, Homo sapiens
ucguguuucacagugg

SEQ ID NO: 513447 - RNA, 23 nt, Homo sapiens
ucuaaaacuaaauagcauguauu

SEQ ID NO: 513448 - RNA, 17 nt, Homo sapiens
ucuaaaggggacagauc

SEQ ID NO: 513449 - RNA, 17 nt, Homo sapiens
ucuaauaaacacagauu

SEQ ID NO: 513450 - RNA, 11 nt, Homo sapiens
ucuaccaagcu

SEQ ID NO: 513451 - RNA, 14 nt, Homo sapiens
ucuaccaguuuauu

SEQ ID NO: 513452 - RNA, 19 nt, Homo sapiens
ucuaccaguuuauuccugu

SEQ ID NO: 513453 - RNA, 22 nt, Homo sapiens
ucuacuagaaccuucuaaucca

SEQ ID NO: 513454 - RNA, 15 nt, Homo sapiens
ucuagcauagcacaa

SEQ ID NO: 513455 - RNA, 11 nt, Homo sapiens
ucuagugcagg

SEQ ID NO: 513456 - RNA, 18 nt, Homo sapiens
ucuauauuuggauucaca

SEQ ID NO: 513457 - RNA, 22 nt, Homo sapiens
ucuauggacucgauuuuaccau

SEQ ID NO: 513458 - RNA, 15 nt, Homo sapiens
ucuauuucaacuuca

SEQ ID NO: 513459 - RNA, 23 nt, Homo sapiens
ucucaaaauaaaaccagaaagag

SEQ ID NO: 513460 - RNA, 17 nt, Homo sapiens
ucucaacugagugagca

SEQ ID NO: 513461 - RNA, 17 nt, Homo sapiens
ucucagccccucagaga

SEQ ID NO: 513462 - RNA, 17 nt, Homo sapiens
ucucagugcuagcuuau

SEQ ID NO: 513463 - RNA, 21 nt, Homo sapiens
ucucaugguauuaucuaguag

SEQ ID NO: 513464 - RNA, 12 nt, Homo sapiens
ucucccuuuaug

SEQ ID NO: 513465 - RNA, 16 nt, Homo sapiens
ucuccucccauggccu

SEQ ID NO: 513466 - RNA, 18 nt, Homo sapiens
ucucgacaggugcccuuu

SEQ ID NO: 513467 - RNA, 17 nt, Homo sapiens
ucucgcuagccauauau

SEQ ID NO: 513468 - RNA, 18 nt, Homo sapiens
ucucuaaaacagcacuau

SEQ ID NO: 513469 - RNA, 14 nt, Homo sapiens
ucucuaauugauuc

SEQ ID NO: 513470 - RNA, 13 nt, Homo sapiens
ucucuacuacaca

SEQ ID NO: 513471 - RNA, 21 nt, Homo sapiens
ucucuccuggucgcuuugcca

SEQ ID NO: 513472 - RNA, 15 nt, Homo sapiens
ucucugaacugcaac

SEQ ID NO: 513473 - RNA, 20 nt, Homo sapiens
ucucugaacugcaacacugg

SEQ ID NO: 513474 - RNA, 17 nt, Homo sapiens
ucugaaaggaagacauu

SEQ ID NO: 513475 - RNA, 19 nt, Homo sapiens
ucugaaaucuacaacauaa

SEQ ID NO: 513476 - RNA, 17 nt, Homo sapiens
ucugacuugccaaagaa

SEQ ID NO: 513477 - RNA, 15 nt, Homo sapiens
ucugaggaguccaaa

SEQ ID NO: 513478 - RNA, 16 nt, Homo sapiens
ucugcacacauaacac

SEQ ID NO: 513479 - RNA, 13 nt, Homo sapiens
ucugcauaagauu

SEQ ID NO: 513480 - RNA, 17 nt, Homo sapiens
ucugcuucucuuucaca

SEQ ID NO: 513481 - RNA, 23 nt, Homo sapiens
ucugcuugguguaaaccauucuu

SEQ ID NO: 513482 - RNA, 21 nt, Homo sapiens
ucuggaaaagcacuuuacaga

SEQ ID NO: 513483 - RNA, 18 nt, Homo sapiens
ucuggcuacgacuuggga

SEQ ID NO: 513484 - RNA, 15 nt, Homo sapiens
ucuggggucugugau

SEQ ID NO: 513485 - RNA, 18 nt, Homo sapiens
ucuguguaaccuccacag

SEQ ID NO: 513486 - RNA, 16 nt, Homo sapiens
guaagacagugcagug

SEQ ID NO: 513487 - RNA, 15 nt, Homo sapiens
guaaggcagugcagu

SEQ ID NO: 513488 - RNA, 16 nt, Homo sapiens
guaauccuagcacuuu

SEQ ID NO: 513489 - RNA, 15 nt, Homo sapiens
guacaguauucaauu

SEQ ID NO: 513490 - RNA, 15 nt, Homo sapiens
guacuaccccagaac

SEQ ID NO: 513491 - RNA, 15 nt, Homo sapiens
guacuaccccaggac

SEQ ID NO: 513492 - RNA, 23 nt, Homo sapiens
guacucaggcagugcaguacuca

SEQ ID NO: 513493 - RNA, 20 nt, Homo sapiens
guacucaguaacacagugca

SEQ ID NO: 513494 - RNA, 22 nt, Homo sapiens
guacucaguaacacagugcagu

SEQ ID NO: 513495 - RNA, 23 nt, Homo sapiens
guacucaguaacacagugcagua

SEQ ID NO: 513496 - RNA, 11 nt, Homo sapiens
guacuguguuu

SEQ ID NO: 513497 - RNA, 20 nt, Homo sapiens
guacuguuuuguuuguuaau

SEQ ID NO: 513498 - RNA, 15 nt, Homo sapiens
guacuuacacugaaa

SEQ ID NO: 513499 - RNA, 15 nt, Homo sapiens
guacuucaguucuca

SEQ ID NO: 513500 - RNA, 22 nt, Homo sapiens
guacuucauucaaaaagccaaa

SEQ ID NO: 513501 - RNA, 16 nt, Homo sapiens
guagcaacccaggugu

SEQ ID NO: 513502 - RNA, 14 nt, Homo sapiens
guaggccuccaguu

SEQ ID NO: 513503 - RNA, 16 nt, Homo sapiens
guaggugggucuugga

SEQ ID NO: 513504 - RNA, 14 nt, Homo sapiens
guagugggugaaug

SEQ ID NO: 513505 - RNA, 12 nt, Homo sapiens
guauacaguccu

SEQ ID NO: 513506 - RNA, 15 nt, Homo sapiens
guauacuucaaguaa

SEQ ID NO: 513507 - RNA, 13 nt, Homo sapiens
guauaucagcucu

SEQ ID NO: 513508 - RNA, 20 nt, Homo sapiens
guaucaugcuucuacuccau

SEQ ID NO: 513509 - RNA, 10 nt, Homo sapiens
guauccucca

SEQ ID NO: 513510 - RNA, 21 nt, Homo sapiens
guaugugccaguacuuaccag

SEQ ID NO: 513511 - RNA, 17 nt, Homo sapiens
guauuauggugauacuc

SEQ ID NO: 513512 - RNA, 18 nt, Homo sapiens
guauucaguaaggcagug

SEQ ID NO: 513513 - RNA, 18 nt, Homo sapiens
uuccaaguuuauugcccu

SEQ ID NO: 513514 - RNA, 19 nt, Homo sapiens
uuccacgugggguggaauu

SEQ ID NO: 513515 - RNA, 20 nt, Homo sapiens
uuccagcuaagccugaugau

SEQ ID NO: 513516 - RNA, 16 nt, Homo sapiens
uuccagggaaccagag

SEQ ID NO: 513517 - RNA, 18 nt, Homo sapiens
uuccauggauuccccugg

SEQ ID NO: 513518 - RNA, 12 nt, Homo sapiens
uuccaugguggu

SEQ ID NO: 513519 - RNA, 18 nt, Homo sapiens
uuccaugucugaaguuug

SEQ ID NO: 513520 - RNA, 23 nt, Homo sapiens
uuccaugucugaaguuugcccca

SEQ ID NO: 513521 - RNA, 17 nt, Homo sapiens
uucccaaaucucaaaag

SEQ ID NO: 513522 - RNA, 18 nt, Homo sapiens
uucccacacugugaacua

SEQ ID NO: 513523 - RNA, 22 nt, Homo sapiens
uucccacacugugaacuaauga

SEQ ID NO: 513524 - RNA, 20 nt, Homo sapiens
uuccccaucgccuucugggg

SEQ ID NO: 513525 - RNA, 20 nt, Homo sapiens
uucccugaacacucaucccc

SEQ ID NO: 513526 - RNA, 21 nt, Homo sapiens
uucccugagucccaccauagc

SEQ ID NO: 513527 - RNA, 19 nt, Homo sapiens
uuccgugagagucaucuca

SEQ ID NO: 513528 - RNA, 14 nt, Homo sapiens
uuccguucaucuga

SEQ ID NO: 513529 - RNA, 20 nt, Homo sapiens
uuccucacuaccacuuguaa

SEQ ID NO: 513530 - RNA, 16 nt, Homo sapiens
uuccucuuaccuguaa

SEQ ID NO: 513531 - RNA, 15 nt, Homo sapiens
uuccugcuccuccag

SEQ ID NO: 513532 - RNA, 16 nt, Homo sapiens
uuccugucaauauaua

SEQ ID NO: 513533 - RNA, 18 nt, Homo sapiens
uuccuugacuauuacacu

SEQ ID NO: 513534 - RNA, 23 nt, Homo sapiens
uucgaagaauuggcagaagcagu

SEQ ID NO: 513535 - RNA, 15 nt, Homo sapiens
uucggcuaugucuca

SEQ ID NO: 513536 - RNA, 23 nt, Homo sapiens
uucuaaacuaaaggaaacaaagc

SEQ ID NO: 513537 - RNA, 21 nt, Homo sapiens
uucuauuagcuuacugauuaa

SEQ ID NO: 513538 - RNA, 22 nt, Homo sapiens
uucuauuucaacuucaggaaag

SEQ ID NO: 513539 - RNA, 16 nt, Homo sapiens
uucucaacacacagua

SEQ ID NO: 513540 - RNA, 20 nt, Homo sapiens
uucucagcgcaacagcugug

SEQ ID NO: 513541 - RNA, 15 nt, Homo sapiens
uucuccuuguacuug

SEQ ID NO: 513542 - RNA, 12 nt, Homo sapiens
uucucuagacau

SEQ ID NO: 513543 - RNA, 12 nt, Homo sapiens
uucucucugugu

SEQ ID NO: 513544 - RNA, 23 nt, Homo sapiens
uucucucuguguggcaaacauuu

SEQ ID NO: 513545 - RNA, 12 nt, Homo sapiens
uucucuuaccac

SEQ ID NO: 513546 - RNA, 13 nt, Homo sapiens
uucugaguagcau

SEQ ID NO: 513547 - RNA, 16 nt, Homo sapiens
uucuggaaaaacagga

SEQ ID NO: 513548 - RNA, 12 nt, Homo sapiens
uucuuacuguau

SEQ ID NO: 513549 - RNA, 13 nt, Homo sapiens
uucuuagauucuc

SEQ ID NO: 513550 - RNA, 13 nt, Homo sapiens
uucuucaccucac

SEQ ID NO: 513551 - RNA, 14 nt, Homo sapiens
uucuucaccucacu

SEQ ID NO: 513552 - RNA, 18 nt, Homo sapiens
uucuuccucuuaccugua

SEQ ID NO: 513553 - RNA, 21 nt, Homo sapiens
uucuugcucugcucaucuaca

SEQ ID NO: 513554 - RNA, 13 nt, Homo sapiens
uucuuuccuuccu

SEQ ID NO: 513555 - RNA, 17 nt, Homo sapiens
uucuuugcauucguccu

SEQ ID NO: 513556 - RNA, 20 nt, Homo sapiens
uucuuuggaaaccaccuuaa

SEQ ID NO: 513557 - RNA, 17 nt, Homo sapiens
uugaaauuauauuacau

SEQ ID NO: 513558 - RNA, 19 nt, Homo sapiens
uugaaccgucaaugugaaa

SEQ ID NO: 513559 - RNA, 17 nt, Homo sapiens
uugaauauaauggccuc

SEQ ID NO: 513560 - RNA, 20 nt, Homo sapiens
uugaaugauaauagcucaca

SEQ ID NO: 513561 - RNA, 13 nt, Homo sapiens
uugauaguuuaca

SEQ ID NO: 513562 - RNA, 17 nt, Homo sapiens
uugauaguuuacaaaca

SEQ ID NO: 513563 - RNA, 20 nt, Homo sapiens
uugauaguuuacaaacaaga

SEQ ID NO: 513564 - RNA, 21 nt, Homo sapiens
uugaucccuaaagaaaacaaa

SEQ ID NO: 513565 - RNA, 16 nt, Homo sapiens
uugauuaaaacauuau

SEQ ID NO: 513566 - RNA, 20 nt, Homo sapiens
uugauucaaauaacccugaa

SEQ ID NO: 513567 - RNA, 22 nt, Homo sapiens
uugcuauaauguauaaugggaa

SEQ ID NO: 513568 - RNA, 21 nt, Homo sapiens
uugcugugaaaugacugcauc

SEQ ID NO: 513569 - RNA, 13 nt, Homo sapiens
uuggaacaugcua

SEQ ID NO: 513570 - RNA, 14 nt, Homo sapiens
uuggauuuuaaaca

SEQ ID NO: 513571 - RNA, 17 nt, Homo sapiens
uuggcagaagcaguugc

SEQ ID NO: 513572 - RNA, 12 nt, Homo sapiens
uuggcagugugu

SEQ ID NO: 513573 - RNA, 15 nt, Homo sapiens
uuggcuuaauuccaa

SEQ ID NO: 513574 - RNA, 21 nt, Homo sapiens
uuggguaagggacuccagaag

SEQ ID NO: 513575 - RNA, 13 nt, Homo sapiens
uuggguuccagac

SEQ ID NO: 513576 - RNA, 13 nt, Homo sapiens
uuggucacugcua

SEQ ID NO: 513577 - RNA, 13 nt, Homo sapiens
uuggugcaauaca

SEQ ID NO: 513578 - RNA, 15 nt, Homo sapiens
uuguaaaacugugac

SEQ ID NO: 513579 - RNA, 16 nt, Homo sapiens
uuguaaauugucucaa

SEQ ID NO: 513580 - RNA, 15 nt, Homo sapiens
uuguaaguacucuaa

SEQ ID NO: 513581 - RNA, 16 nt, Homo sapiens
uugucagcaaauuaau

SEQ ID NO: 513582 - RNA, 20 nt, Homo sapiens
uugucuuaucuaccaguuua

SEQ ID NO: 513583 - RNA, 17 nt, Homo sapiens
uuguguacaaaauaucc

SEQ ID NO: 513584 - RNA, 18 nt, Homo sapiens
uugugucuuuugcaugau

SEQ ID NO: 513585 - RNA, 15 nt, Homo sapiens
uuguugcaguucaga

SEQ ID NO: 513586 - RNA, 20 nt, Homo sapiens
uuguuuguccuuuauguauu

SEQ ID NO: 513587 - RNA, 16 nt, Homo sapiens
uuuaaagcuuauuucc

SEQ ID NO: 513588 - RNA, 17 nt, Homo sapiens
uuuaauguuuacaacaa

SEQ ID NO: 513589 - RNA, 22 nt, Homo sapiens
uuuaauugaaagggacaaguau

SEQ ID NO: 513590 - RNA, 15 nt, Homo sapiens
uuuaauuugcaucac

SEQ ID NO: 513591 - RNA, 19 nt, Homo sapiens
uuuacaaagaaacaaaaua

SEQ ID NO: 513592 - RNA, 14 nt, Homo sapiens
ucuaaacuuucccu

SEQ ID NO: 513593 - RNA, 22 nt, Homo sapiens
ucuaaacuuucccuauacuuag

SEQ ID NO: 513594 - RNA, 21 nt, Homo sapiens
ucuaaagcagagauguauuau

SEQ ID NO: 513595 - RNA, 13 nt, Homo sapiens
ucuaaaggggaca

SEQ ID NO: 513596 - RNA, 16 nt, Homo sapiens
ucuaaaucauaaucau

SEQ ID NO: 513597 - RNA, 16 nt, Homo sapiens
ucuaauccaugugcug

SEQ ID NO: 513598 - RNA, 20 nt, Homo sapiens
ucuacaacauaaugauacug

SEQ ID NO: 513599 - RNA, 21 nt, Homo sapiens
ucuaccuuuuuuucucuccua

SEQ ID NO: 513600 - RNA, 22 nt, Homo sapiens
ucuacgcaaaaaauaacuacag

SEQ ID NO: 513601 - RNA, 17 nt, Homo sapiens
ucuacuguucaauuuca

SEQ ID NO: 513602 - RNA, 18 nt, Homo sapiens
ucuacuuuaaauugugga

SEQ ID NO: 513603 - RNA, 19 nt, Homo sapiens
ucuaguuguggacuuuucc

SEQ ID NO: 513604 - RNA, 13 nt, Homo sapiens
ucuauaccaccuu

SEQ ID NO: 513605 - RNA, 21 nt, Homo sapiens
ucuauauuauauaaauaguau

SEQ ID NO: 513606 - RNA, 15 nt, Homo sapiens
ucuaugguguaugac

SEQ ID NO: 513607 - RNA, 16 nt, Homo sapiens
ucuauuucaacuucag

SEQ ID NO: 513608 - RNA, 19 nt, Homo sapiens
ucuauuuuuaaccaaauaa

SEQ ID NO: 513609 - RNA, 21 nt, Homo sapiens
ucucaaaauaaaaccagaaag

SEQ ID NO: 513610 - RNA, 14 nt, Homo sapiens
ucucaaacacugcu

SEQ ID NO: 513611 - RNA, 16 nt, Homo sapiens
ucucaacuuacauaug

SEQ ID NO: 513612 - RNA, 17 nt, Homo sapiens
ucucaacuuacauaugu

SEQ ID NO: 513613 - RNA, 16 nt, Homo sapiens
ucucacgauaugcaag

SEQ ID NO: 513614 - RNA, 18 nt, Homo sapiens
ucucagccccucagagaa

SEQ ID NO: 513615 - RNA, 18 nt, Homo sapiens
ucucagcgcaacagcugu

SEQ ID NO: 513616 - RNA, 18 nt, Homo sapiens
ucuccugugcaccugacu

SEQ ID NO: 513617 - RNA, 13 nt, Homo sapiens
ucuccuuugaggg

SEQ ID NO: 513618 - RNA, 14 nt, Homo sapiens
ucucuagacaucua

SEQ ID NO: 513619 - RNA, 13 nt, Homo sapiens
ucucuagugcagg

SEQ ID NO: 513620 - RNA, 12 nt, Homo sapiens
ucucuaucuuag

SEQ ID NO: 513621 - RNA, 21 nt, Homo sapiens
ucucuccuuuccuuuugucua

SEQ ID NO: 513622 - RNA, 14 nt, Homo sapiens
ucucugaacugcaa

SEQ ID NO: 513623 - RNA, 15 nt, Homo sapiens
ucucuuucuuuccaa

SEQ ID NO: 513624 - RNA, 13 nt, Homo sapiens
ucugagugacaug

SEQ ID NO: 513625 - RNA, 22 nt, Homo sapiens
ucugcaaaaugucauagcuuau

SEQ ID NO: 513626 - RNA, 18 nt, Homo sapiens
ucugcaggaacaugaccc

SEQ ID NO: 513627 - RNA, 18 nt, Homo sapiens
ucugcccugccugaggag

SEQ ID NO: 513628 - RNA, 15 nt, Homo sapiens
ucugcugcuuuccaa

SEQ ID NO: 513629 - RNA, 18 nt, Homo sapiens
ucugcuucucuuucacaa

SEQ ID NO: 513630 - RNA, 18 nt, Homo sapiens
ucuggaaaaacaggauac

SEQ ID NO: 513631 - RNA, 15 nt, Homo sapiens
ucuggaaaagcacuu

SEQ ID NO: 513632 - RNA, 17 nt, Homo sapiens
ucuggaaaagcacuuua

SEQ ID NO: 513633 - RNA, 16 nt, Homo sapiens
ucugggaaaagcccaa

SEQ ID NO: 513634 - RNA, 14 nt, Homo sapiens
ucugggguggggcu

SEQ ID NO: 513635 - RNA, 12 nt, Homo sapiens
ucuguacuucau

SEQ ID NO: 513636 - RNA, 14 nt, Homo sapiens
ucuguccacucuga

SEQ ID NO: 513637 - RNA, 12 nt, Homo sapiens
ucuguuaucuag

SEQ ID NO: 513638 - RNA, 15 nt, Homo sapiens
ucuguuaucuaguau

SEQ ID NO: 513639 - RNA, 14 nt, Homo sapiens
ucuguuccaagugu

SEQ ID NO: 513640 - RNA, 15 nt, Homo sapiens
ucuguuuaggugccu

SEQ ID NO: 513641 - RNA, 16 nt, Homo sapiens
ucuguuuaggugccuc

SEQ ID NO: 513642 - RNA, 18 nt, Homo sapiens
ucuuaaaucugccuaguu

SEQ ID NO: 513643 - RNA, 13 nt, Homo sapiens
ucuuaaugucuca

SEQ ID NO: 513644 - RNA, 20 nt, Homo sapiens
ucuuacuaaccaccauuucc

SEQ ID NO: 513645 - RNA, 13 nt, Homo sapiens
ucuuagauucucu

SEQ ID NO: 513646 - RNA, 16 nt, Homo sapiens
ucuuauaacauuguau

SEQ ID NO: 513647 - RNA, 16 nt, Homo sapiens
ucuuauacacaccuga

SEQ ID NO: 513648 - RNA, 15 nt, Homo sapiens
ucuuaucuaccaguu

SEQ ID NO: 513649 - RNA, 22 nt, Homo sapiens
ucuuauggaggagaguguuuaa

SEQ ID NO: 513650 - RNA, 18 nt, Homo sapiens
ucuuauucaugcuuucuc

SEQ ID NO: 513651 - RNA, 14 nt, Homo sapiens
ucuucaacaugguu

SEQ ID NO: 513652 - RNA, 12 nt, Homo sapiens
ucuucaccucac

SEQ ID NO: 513653 - RNA, 11 nt, Homo sapiens
ucuucauggcc

SEQ ID NO: 513654 - RNA, 14 nt, Homo sapiens
ucuucauguugaug

SEQ ID NO: 513655 - RNA, 15 nt, Homo sapiens
ucuuccucuuaccug

SEQ ID NO: 513656 - RNA, 23 nt, Homo sapiens
ucuucuauauuccgggugccauu

SEQ ID NO: 513657 - RNA, 14 nt, Homo sapiens
ucuucuuacuguau

SEQ ID NO: 513658 - RNA, 23 nt, Homo sapiens
ucuuggagaggagguguggagug

SEQ ID NO: 513659 - RNA, 23 nt, Homo sapiens
ucuugggaggacacuuuugccaa

SEQ ID NO: 513660 - RNA, 17 nt, Homo sapiens
ucuugguuuccaucaaa

SEQ ID NO: 513661 - RNA, 23 nt, Homo sapiens
ucuuguaaaacugugacauucca

SEQ ID NO: 513662 - RNA, 14 nt, Homo sapiens
ucuuuaccuugcau

SEQ ID NO: 513663 - RNA, 16 nt, Homo sapiens
ucuuuacuaacacugg

SEQ ID NO: 513664 - RNA, 18 nt, Homo sapiens
ucuuucggaaaugauuga

SEQ ID NO: 513665 - RNA, 16 nt, Homo sapiens
ucuuugaaaacucaua

SEQ ID NO: 513666 - RNA, 20 nt, Homo sapiens
ucuuuguauauuucuaguau

SEQ ID NO: 513667 - RNA, 13 nt, Homo sapiens
ugaaaaagcaugu

SEQ ID NO: 513668 - RNA, 18 nt, Homo sapiens
ugaaaaaucugaauuucu

SEQ ID NO: 513669 - RNA, 21 nt, Homo sapiens
ugaaaaaucugaauuucuaaa

SEQ ID NO: 513670 - RNA, 17 nt, Homo sapiens
ugaaacacaauaucauc

SEQ ID NO: 513671 - RNA, 19 nt, Homo sapiens
ugaaaccagaaaucuaauc

SEQ ID NO: 513672 - RNA, 19 nt, Homo sapiens
ugaaagggacaaguaucau

SEQ ID NO: 513673 - RNA, 18 nt, Homo sapiens
ugaaagucuccuguauca

SEQ ID NO: 513674 - RNA, 18 nt, Homo sapiens
ugaaauaaaagccucugg

SEQ ID NO: 513675 - RNA, 13 nt, Homo sapiens
ugaaaucagaagc

SEQ ID NO: 513676 - RNA, 13 nt, Homo sapiens
ugaaauccaaaau

SEQ ID NO: 513677 - RNA, 13 nt, Homo sapiens
ugaaauucacaaa

SEQ ID NO: 513678 - RNA, 16 nt, Homo sapiens
ugaaauuuaagcacaa

SEQ ID NO: 513679 - RNA, 15 nt, Homo sapiens
ugaacacacucagca

SEQ ID NO: 513680 - RNA, 16 nt, Homo sapiens
ugaaccgucaauguga

SEQ ID NO: 513681 - RNA, 23 nt, Homo sapiens
ugaagcaaacacacagacucugu

SEQ ID NO: 513682 - RNA, 17 nt, Homo sapiens
ugaagcguuacuacagc

SEQ ID NO: 513683 - RNA, 13 nt, Homo sapiens
ugaagcugagaug

SEQ ID NO: 513684 - RNA, 21 nt, Homo sapiens
ugaaguagacauggaauuuau

SEQ ID NO: 513685 - RNA, 18 nt, Homo sapiens
ugaauaaaauugaugugc

SEQ ID NO: 513686 - RNA, 21 nt, Homo sapiens
ugaaugaaauauaaacuguga

SEQ ID NO: 513687 - RNA, 23 nt, Homo sapiens
ugaaugaaauauaaacugugaga

SEQ ID NO: 513688 - RNA, 21 nt, Homo sapiens
ugaauucauugucucagugaa

SEQ ID NO: 513689 - RNA, 18 nt, Homo sapiens
ugaauuuggggcuacuua

SEQ ID NO: 513690 - RNA, 23 nt, Homo sapiens
ugacaacaacuaucaccaaaaga

SEQ ID NO: 513691 - RNA, 20 nt, Homo sapiens
ugacacccuuuaauguucua

SEQ ID NO: 513692 - RNA, 20 nt, Homo sapiens
ugacaguagcauacugauga

SEQ ID NO: 513693 - RNA, 21 nt, Homo sapiens
ugacaguagcauacugaugag

SEQ ID NO: 513694 - RNA, 18 nt, Homo sapiens
ugacauuggaacaugcua

SEQ ID NO: 513695 - RNA, 15 nt, Homo sapiens
ugacccucaccugaa

SEQ ID NO: 513696 - RNA, 17 nt, Homo sapiens
ugacugauguuggggaa

SEQ ID NO: 513697 - RNA, 18 nt, Homo sapiens
ugacuguguucagugccu

SEQ ID NO: 513698 - RNA, 21 nt, Homo sapiens
ugacuucuuuacuaacacugg

SEQ ID NO: 513699 - RNA, 12 nt, Homo sapiens
ugagaaagacaa

SEQ ID NO: 513700 - RNA, 14 nt, Homo sapiens
ugagacacugucaa

SEQ ID NO: 513701 - RNA, 21 nt, Homo sapiens
ugagacagagagccaagcuaa

SEQ ID NO: 513702 - RNA, 18 nt, Homo sapiens
ugagcacuaucuuucagg

SEQ ID NO: 513703 - RNA, 21 nt, Homo sapiens
ugagcagaacccagacccuga

SEQ ID NO: 513704 - RNA, 22 nt, Homo sapiens
ugagcagaacccagacccugag

SEQ ID NO: 513705 - RNA, 19 nt, Homo sapiens
ugagccagcagacauuguc

SEQ ID NO: 513706 - RNA, 19 nt, Homo sapiens
ugaggaggaggacacagca

SEQ ID NO: 513707 - RNA, 17 nt, Homo sapiens
ugaggauguauguguau

SEQ ID NO: 513708 - RNA, 14 nt, Homo sapiens
ugagggcaggguuc

SEQ ID NO: 513709 - RNA, 20 nt, Homo sapiens
ugagggcgugaaacacaaua

SEQ ID NO: 513710 - RNA, 24 nt, Homo sapiens
ugagguuaaggggaucuaaaagga

SEQ ID NO: 513711 - RNA, 19 nt, Homo sapiens
ugaguucccuugauucaaa

SEQ ID NO: 513712 - RNA, 22 nt, Homo sapiens
ugaguuugcuguauacaaacag

SEQ ID NO: 513713 - RNA, 21 nt, Homo sapiens
ugaucccugaacauaguuuuc

SEQ ID NO: 513714 - RNA, 15 nt, Homo sapiens
ugaugcuaguucuua

SEQ ID NO: 513715 - RNA, 12 nt, Homo sapiens
ugaugugcucau

SEQ ID NO: 513716 - RNA, 18 nt, Homo sapiens
ugaugugcucaucagaaa

SEQ ID NO: 513717 - RNA, 15 nt, Homo sapiens
ugauucuaaagggga

SEQ ID NO: 513718 - RNA, 16 nt, Homo sapiens
ugauucuccucuccca

SEQ ID NO: 513719 - RNA, 15 nt, Homo sapiens
ugcaaccuuguacuu

SEQ ID NO: 513720 - RNA, 14 nt, Homo sapiens
ugcaauacucagug

SEQ ID NO: 513721 - RNA, 13 nt, Homo sapiens
ugcacggcagcuu

SEQ ID NO: 513722 - RNA, 16 nt, Homo sapiens
ugcagcacaguacuca

SEQ ID NO: 513723 - RNA, 23 nt, Homo sapiens
ugcagcacaguacucaggcagug

SEQ ID NO: 513724 - RNA, 15 nt, Homo sapiens
ugcagcagaaucucu

SEQ ID NO: 513725 - RNA, 17 nt, Homo sapiens
ugcaggcagaaccugaa

SEQ ID NO: 513726 - RNA, 23 nt, Homo sapiens
ugcagggacagccugcacagugg

SEQ ID NO: 513727 - RNA, 21 nt, Homo sapiens
ugcaguaaaguuccaugaaga

SEQ ID NO: 513728 - RNA, 11 nt, Homo sapiens
ugcaguacuca

SEQ ID NO: 513729 - RNA, 14 nt, Homo sapiens
ugcaguagugucac

SEQ ID NO: 513730 - RNA, 17 nt, Homo sapiens
ugcagugcccugagcca

SEQ ID NO: 513731 - RNA, 15 nt, Homo sapiens
ugcaguuauguuauc

SEQ ID NO: 513732 - RNA, 15 nt, Homo sapiens
ugcaguucaguucuu

SEQ ID NO: 513733 - RNA, 13 nt, Homo sapiens
ugcaguuuggccc

SEQ ID NO: 513734 - RNA, 18 nt, Homo sapiens
ugcauaaccgcacagaca

SEQ ID NO: 513735 - RNA, 18 nt, Homo sapiens
ugcauaauaugcauauau

SEQ ID NO: 513736 - RNA, 16 nt, Homo sapiens
ugcaugagaacuaaau

SEQ ID NO: 513737 - RNA, 15 nt, Homo sapiens
ugcauguugccauga

SEQ ID NO: 513738 - RNA, 15 nt, Homo sapiens
ugcauucguccuuag

SEQ ID NO: 513739 - RNA, 17 nt, Homo sapiens
ugccacauugcuucauu

SEQ ID NO: 513740 - RNA, 23 nt, Homo sapiens
ugccacgguccuuugagugucag

SEQ ID NO: 513741 - RNA, 16 nt, Homo sapiens
ugccaggcagugcagc

SEQ ID NO: 513742 - RNA, 17 nt, Homo sapiens
ugccauauucuguagua

SEQ ID NO: 513743 - RNA, 17 nt, Homo sapiens
ugccaucuccacccuga

SEQ ID NO: 513744 - RNA, 19 nt, Homo sapiens
ugcccaaagccaucuuccu

SEQ ID NO: 513745 - RNA, 17 nt, Homo sapiens
ugcccaguaucauacgu

SEQ ID NO: 513746 - RNA, 19 nt, Homo sapiens
ugcccauauuaaaaagcca

SEQ ID NO: 513747 - RNA, 17 nt, Homo sapiens
ugcccgaccccaucuca

SEQ ID NO: 513748 - RNA, 18 nt, Homo sapiens
ugcccgaccccaucucau

SEQ ID NO: 513749 - RNA, 20 nt, Homo sapiens
ugcccucucacugacuucuc

SEQ ID NO: 513750 - RNA, 21 nt, Homo sapiens
ugcccuuuaacaagacuucaa

SEQ ID NO: 513751 - RNA, 13 nt, Homo sapiens
ugccguggagcuu

SEQ ID NO: 513752 - RNA, 17 nt, Homo sapiens
ugccuaguuuugaugaa

SEQ ID NO: 513753 - RNA, 14 nt, Homo sapiens
ugccuauuuaugaa

SEQ ID NO: 513754 - RNA, 18 nt, Homo sapiens
ugccucagccaguggcac

SEQ ID NO: 513755 - RNA, 12 nt, Homo sapiens
ugccucaggaau

SEQ ID NO: 513756 - RNA, 17 nt, Homo sapiens
ugccugaauccaucagg

SEQ ID NO: 513757 - RNA, 13 nt, Homo sapiens
ugccuguggugag

SEQ ID NO: 513758 - RNA, 15 nt, Homo sapiens
ugccuugaacauaua

SEQ ID NO: 513759 - RNA, 16 nt, Homo sapiens
ugcgucccugcucagc

SEQ ID NO: 513760 - RNA, 13 nt, Homo sapiens
ugcuaaaugucaa

SEQ ID NO: 513761 - RNA, 13 nt, Homo sapiens
ugcuaacaucuca

SEQ ID NO: 513762 - RNA, 20 nt, Homo sapiens
ugcuaccugauucauuuauu

SEQ ID NO: 513763 - RNA, 22 nt, Homo sapiens
ugcuacuucaguaaugucuaua

SEQ ID NO: 513764 - RNA, 12 nt, Homo sapiens
ugcuaucauuug

SEQ ID NO: 513765 - RNA, 19 nt, Homo sapiens
ugcucacagggacucucca

SEQ ID NO: 513766 - RNA, 21 nt, Homo sapiens
ugcucaguaaggcagugcaau

SEQ ID NO: 513767 - RNA, 14 nt, Homo sapiens
ugcugccaucucca

SEQ ID NO: 513768 - RNA, 22 nt, Homo sapiens
ugcugggccgggguguggaauc

SEQ ID NO: 513769 - RNA, 16 nt, Homo sapiens
ugcuguguagcucugu

SEQ ID NO: 513770 - RNA, 14 nt, Homo sapiens
ugcuuaguaucuca

SEQ ID NO: 513771 - RNA, 15 nt, Homo sapiens
ugcuuaguaucucau

SEQ ID NO: 513772 - RNA, 23 nt, Homo sapiens
ugcuucucugccgguggggccag

SEQ ID NO: 513773 - RNA, 15 nt, Homo sapiens
ugcuucucuuucaca

SEQ ID NO: 513774 - RNA, 14 nt, Homo sapiens
ugcuugauggaauu

SEQ ID NO: 513775 - RNA, 17 nt, Homo sapiens
ugcuuuuuaaagcacau

SEQ ID NO: 513776 - RNA, 21 nt, Homo sapiens
uggaaaaacaggauacgauga

SEQ ID NO: 513777 - RNA, 22 nt, Homo sapiens
uggaaaagcacuuuacagauga

SEQ ID NO: 513778 - RNA, 16 nt, Homo sapiens
uggaaaauacaucugu

SEQ ID NO: 513779 - RNA, 20 nt, Homo sapiens
uggaaaauacaucuguucca

SEQ ID NO: 513780 - RNA, 13 nt, Homo sapiens
uggaaacaucuga

SEQ ID NO: 513781 - RNA, 13 nt, Homo sapiens
uggaaacugucaa

SEQ ID NO: 513782 - RNA, 22 nt, Homo sapiens
uggaaccaacgaucauaucugu

SEQ ID NO: 513783 - RNA, 21 nt, Homo sapiens
uggaagacaaauacacauaca

SEQ ID NO: 513784 - RNA, 15 nt, Homo sapiens
uggaauuacauaaca

SEQ ID NO: 513785 - RNA, 19 nt, Homo sapiens
uggaauuuuuuccugcuag

SEQ ID NO: 513786 - RNA, 18 nt, Homo sapiens
uggagaaggguucugccc

SEQ ID NO: 513787 - RNA, 16 nt, Homo sapiens
uggagacgaugcuuua

SEQ ID NO: 513788 - RNA, 21 nt, Homo sapiens
uggaggaggggguacaguccu

SEQ ID NO: 513789 - RNA, 17 nt, Homo sapiens
uggaggauagcagagaa

SEQ ID NO: 513790 - RNA, 11 nt, Homo sapiens
ggacucuccau

SEQ ID NO: 513791 - RNA, 20 nt, Homo sapiens
ggagagagaggcugccucag

SEQ ID NO: 513792 - RNA, 16 nt, Homo sapiens
ggagccauaagggaca

SEQ ID NO: 513793 - RNA, 14 nt, Homo sapiens
ggagcuacugacau

SEQ ID NO: 513794 - RNA, 21 nt, Homo sapiens
ggaggcggcacauuggcagug

SEQ ID NO: 513795 - RNA, 16 nt, Homo sapiens
ggagggagaagaaaga

SEQ ID NO: 513796 - RNA, 21 nt, Homo sapiens
ggaggucccugccaguguuua

SEQ ID NO: 513797 - RNA, 13 nt, Homo sapiens
ggaguugccugac

SEQ ID NO: 513798 - RNA, 16 nt, Homo sapiens
ggaugaaggggccaga

SEQ ID NO: 513799 - RNA, 16 nt, Homo sapiens
ggauucacagccuuug

SEQ ID NO: 513800 - RNA, 19 nt, Homo sapiens
ggauugagcagaacccaga

SEQ ID NO: 513801 - RNA, 18 nt, Homo sapiens
ggauuuguuuaaaaacca

SEQ ID NO: 513802 - RNA, 14 nt, Homo sapiens
ggcaaaaccaacuc

SEQ ID NO: 513803 - RNA, 22 nt, Homo sapiens
ggcaaagaacugccccaucucc

SEQ ID NO: 513804 - RNA, 18 nt, Homo sapiens
ggcacaugacagugguua

SEQ ID NO: 513805 - RNA, 16 nt, Homo sapiens
ggcagaauggugggcu

SEQ ID NO: 513806 - RNA, 22 nt, Homo sapiens
ggcagccccuccccauggugca

SEQ ID NO: 513807 - RNA, 18 nt, Homo sapiens
ggcagggugagaagcuag

SEQ ID NO: 513808 - RNA, 12 nt, Homo sapiens
ggcagugcagua

SEQ ID NO: 513809 - RNA, 15 nt, Homo sapiens
ggcaugcaccagugc

SEQ ID NO: 513810 - RNA, 11 nt, Homo sapiens
ggcauuccuga

SEQ ID NO: 513811 - RNA, 21 nt, Homo sapiens
ggcauuggguaagggacucca

SEQ ID NO: 513812 - RNA, 18 nt, Homo sapiens
ggccagcccuugcucuac

SEQ ID NO: 513813 - RNA, 20 nt, Homo sapiens
ggccauuucacauuccugac

SEQ ID NO: 513814 - RNA, 13 nt, Homo sapiens
ggccccugugcag

SEQ ID NO: 513815 - RNA, 15 nt, Homo sapiens
ggcccucuucuuauu

SEQ ID NO: 513816 - RNA, 13 nt, Homo sapiens
ggcccuuacaccc

SEQ ID NO: 513817 - RNA, 14 nt, Homo sapiens
ggcucccacugccc

SEQ ID NO: 513818 - RNA, 18 nt, Homo sapiens
ggcugaaauaaaagccuc

SEQ ID NO: 513819 - RNA, 17 nt, Homo sapiens
ggcugaagaaacacagc

SEQ ID NO: 513820 - RNA, 22 nt, Homo sapiens
ggcugcgucccugcucagccca

SEQ ID NO: 513821 - RNA, 16 nt, Homo sapiens
ggcugcugcacugccc

SEQ ID NO: 513822 - RNA, 18 nt, Homo sapiens
ggcuggaugugcuuucau

SEQ ID NO: 513823 - RNA, 14 nt, Homo sapiens
ggcuggugggauag

SEQ ID NO: 513824 - RNA, 16 nt, Homo sapiens
ggcuuggaagggcgcu

SEQ ID NO: 513825 - RNA, 21 nt, Homo sapiens
ggcuugggguagagaggacag

SEQ ID NO: 513826 - RNA, 20 nt, Homo sapiens
gggaacacagugccccagug

SEQ ID NO: 513827 - RNA, 15 nt, Homo sapiens
gggacacaggggcaa

SEQ ID NO: 513828 - RNA, 18 nt, Homo sapiens
gggacagccugcacagug

SEQ ID NO: 513829 - RNA, 12 nt, Homo sapiens
gggacucuccau

SEQ ID NO: 513830 - RNA, 13 nt, Homo sapiens
gggacuuggauag

SEQ ID NO: 513831 - RNA, 22 nt, Homo sapiens
gggagcaugggacugugccuuu

SEQ ID NO: 513832 - RNA, 16 nt, Homo sapiens
gggagggggcugggaa

SEQ ID NO: 513833 - RNA, 11 nt, Homo sapiens
gggagugccac

SEQ ID NO: 513834 - RNA, 14 nt, Homo sapiens
gggagugugccuug

SEQ ID NO: 513835 - RNA, 21 nt, Homo sapiens
gggaucuaaaaggaggacagg

SEQ ID NO: 513836 - RNA, 11 nt, Homo sapiens
gggcaggguga

SEQ ID NO: 513837 - RNA, 18 nt, Homo sapiens
gggcagggugagaagcua

SEQ ID NO: 513838 - RNA, 14 nt, Homo sapiens
gggccgccuccucc

SEQ ID NO: 513839 - RNA, 14 nt, Homo sapiens
gggccggggcugcc

SEQ ID NO: 513840 - RNA, 15 nt, Homo sapiens
gggccuucauugucu

SEQ ID NO: 513841 - RNA, 15 nt, Homo sapiens
ggggagaauggcucu

SEQ ID NO: 513842 - RNA, 13 nt, Homo sapiens
gggggcaagagcu

SEQ ID NO: 513843 - RNA, 19 nt, Homo sapiens
gggguccugguaugucuca

SEQ ID NO: 513844 - RNA, 11 nt, Homo sapiens
gggugccauuc

SEQ ID NO: 513845 - RNA, 18 nt, Homo sapiens
gguauugucuuuugacau

SEQ ID NO: 513846 - RNA, 14 nt, Homo sapiens
gguccgacaugccu

SEQ ID NO: 513847 - RNA, 20 nt, Homo sapiens
gguccugaguggcugaaaua

SEQ ID NO: 513848 - RNA, 17 nt, Homo sapiens
ggugaacugaagcagag

SEQ ID NO: 513849 - RNA, 22 nt, Homo sapiens
ggugagaagcuagaugccccug

SEQ ID NO: 513850 - RNA, 15 nt, Homo sapiens
ggugauggagguuuc

SEQ ID NO: 513851 - RNA, 15 nt, Homo sapiens
ggugcccagucuuga

SEQ ID NO: 513852 - RNA, 23 nt, Homo sapiens
gguggagucagggcugugcuuuc

SEQ ID NO: 513853 - RNA, 12 nt, Homo sapiens
gguggggccagc

SEQ ID NO: 513854 - RNA, 11 nt, Homo sapiens
gguggggcuua

SEQ ID NO: 513855 - RNA, 18 nt, Homo sapiens
ggugucuggaaaagcacu

SEQ ID NO: 513856 - RNA, 13 nt, Homo sapiens
ggugucuguaauc

SEQ ID NO: 513857 - RNA, 23 nt, Homo sapiens
gguucccuuuccccauucaguga

SEQ ID NO: 513858 - RNA, 12 nt, Homo sapiens
gguucugcccug

SEQ ID NO: 513859 - RNA, 17 nt, Homo sapiens
gguuguugcaguucaga

SEQ ID NO: 513860 - RNA, 14 nt, Homo sapiens
guaaaacugugaca

SEQ ID NO: 513861 - RNA, 15 nt, Homo sapiens
guaaaggugaugaau

SEQ ID NO: 513862 - RNA, 20 nt, Homo sapiens
guaacacagugcaguacuca

SEQ ID NO: 513863 - RNA, 13 nt, Homo sapiens
guaacagugcagu

SEQ ID NO: 513864 - RNA, 14 nt, Homo sapiens
guaacagugcagua

SEQ ID NO: 513865 - RNA, 18 nt, Homo sapiens
guaacaguguaguacuca

SEQ ID NO: 513866 - RNA, 15 nt, Homo sapiens
guaagacagugcagu

SEQ ID NO: 513867 - RNA, 11 nt, Homo sapiens
guaaggcagua

SEQ ID NO: 513868 - RNA, 18 nt, Homo sapiens
guaaguucugugcaguuu

SEQ ID NO: 513869 - RNA, 19 nt, Homo sapiens
guaauacaguacaguacuc

SEQ ID NO: 513870 - RNA, 20 nt, Homo sapiens
guaauaucaguuacaguggc

SEQ ID NO: 513871 - RNA, 14 nt, Homo sapiens
guacaaaaugaauu

SEQ ID NO: 513872 - RNA, 19 nt, Homo sapiens
guacaaaaugaauugccuu

SEQ ID NO: 513873 - RNA, 19 nt, Homo sapiens
guacaccacuuucccacac

SEQ ID NO: 513874 - RNA, 10 nt, Homo sapiens
guacaguacu

SEQ ID NO: 513875 - RNA, 20 nt, Homo sapiens
guacguuaauuaaacaaauu

SEQ ID NO: 513876 - RNA, 13 nt, Homo sapiens
guacuaccccaga

SEQ ID NO: 513877 - RNA, 19 nt, Homo sapiens
guacucaggcagugcagua

SEQ ID NO: 513878 - RNA, 10 nt, Homo sapiens
guacucagua

SEQ ID NO: 513879 - RNA, 21 nt, Homo sapiens
guacucaguaacagugcagua

SEQ ID NO: 513880 - RNA, 22 nt, Homo sapiens
guacucaguaaggcagugcagu

SEQ ID NO: 513881 - RNA, 22 nt, Homo sapiens
guacucaguuaggcagugcagu

SEQ ID NO: 513882 - RNA, 23 nt, Homo sapiens
guacucaguuaggcagugcagua

SEQ ID NO: 513883 - RNA, 13 nt, Homo sapiens
guacucugagucc

SEQ ID NO: 513884 - RNA, 22 nt, Homo sapiens
guagaugaaaaagcauguacag

SEQ ID NO: 513885 - RNA, 20 nt, Homo sapiens
guagcucuguccacucugaa

SEQ ID NO: 513886 - RNA, 15 nt, Homo sapiens
guagggugaggcgug

SEQ ID NO: 513887 - RNA, 16 nt, Homo sapiens
acuggcaacaguugga

SEQ ID NO: 513888 - RNA, 16 nt, Homo sapiens
acuggcccaccccucu

SEQ ID NO: 513889 - RNA, 21 nt, Homo sapiens
acugguaaaaagauccaggga

SEQ ID NO: 513890 - RNA, 14 nt, Homo sapiens
acugguuagauuca

SEQ ID NO: 513891 - RNA, 15 nt, Homo sapiens
acugugacauuccac

SEQ ID NO: 513892 - RNA, 19 nt, Homo sapiens
acuguguucagugccuugg

SEQ ID NO: 513893 - RNA, 13 nt, Homo sapiens
acuguucaugaau

SEQ ID NO: 513894 - RNA, 21 nt, Homo sapiens
acuuaaacaaaaacuuuccau

SEQ ID NO: 513895 - RNA, 22 nt, Homo sapiens
acuuauuuaaugaaaucagaag

SEQ ID NO: 513896 - RNA, 19 nt, Homo sapiens
acuucaaaggaacuggaau

SEQ ID NO: 513897 - RNA, 20 nt, Homo sapiens
acuucagauugaaccauuca

SEQ ID NO: 513898 - RNA, 19 nt, Homo sapiens
acuucuuuacuaacacugg

SEQ ID NO: 513899 - RNA, 17 nt, Homo sapiens
acuugcaugcagcagcu

SEQ ID NO: 513900 - RNA, 20 nt, Homo sapiens
acuuggauaggagcuuccag

SEQ ID NO: 513901 - RNA, 20 nt, Homo sapiens
acuugggacggaaguggccu

SEQ ID NO: 513902 - RNA, 13 nt, Homo sapiens
acuuuccucucuc

SEQ ID NO: 513903 - RNA, 22 nt, Homo sapiens
acuuugagccucuuaggcagaa

SEQ ID NO: 513904 - RNA, 13 nt, Homo sapiens
acuuugcuuuuag

SEQ ID NO: 513905 - RNA, 12 nt, Homo sapiens
acuuuuccccau

SEQ ID NO: 513906 - RNA, 19 nt, Homo sapiens
acuuuuuuccugucaauau

SEQ ID NO: 513907 - RNA, 21 nt, Homo sapiens
caaccuguucacgugacuccu

SEQ ID NO: 513908 - RNA, 18 nt, Homo sapiens
caacugucuauuucugcu

SEQ ID NO: 513909 - RNA, 19 nt, Homo sapiens
caacuuaaaccugugcuuu

SEQ ID NO: 513910 - RNA, 13 nt, Homo sapiens
caacuuacauaug

SEQ ID NO: 513911 - RNA, 19 nt, Homo sapiens
caacuugaaauuauaucug

SEQ ID NO: 513912 - RNA, 13 nt, Homo sapiens
caagaaugcagua

SEQ ID NO: 513913 - RNA, 19 nt, Homo sapiens
caagagaccacuuccuuaa

SEQ ID NO: 513914 - RNA, 20 nt, Homo sapiens
caagagaccacuuccuuaac

SEQ ID NO: 513915 - RNA, 22 nt, Homo sapiens
caagauccugucuugcugaggg

SEQ ID NO: 513916 - RNA, 22 nt, Homo sapiens
caagcacgcacacacacgcaaa

SEQ ID NO: 513917 - RNA, 13 nt, Homo sapiens
caagcacuucaaa

SEQ ID NO: 513918 - RNA, 13 nt, Homo sapiens
caagccaggguuc

SEQ ID NO: 513919 - RNA, 17 nt, Homo sapiens
caagcccagccuaucuc

SEQ ID NO: 513920 - RNA, 16 nt, Homo sapiens
caaggauccugagcca

SEQ ID NO: 513921 - RNA, 21 nt, Homo sapiens
caaggucugaacccuuccacc

SEQ ID NO: 513922 - RNA, 19 nt, Homo sapiens
caagucugaguaguuauga

SEQ ID NO: 513923 - RNA, 20 nt, Homo sapiens
caagugugugugcaauguuc

SEQ ID NO: 513924 - RNA, 21 nt, Homo sapiens
caaguguguugggaauugcau

SEQ ID NO: 513925 - RNA, 12 nt, Homo sapiens
caaguucauuca

SEQ ID NO: 513926 - RNA, 20 nt, Homo sapiens
caaguuuaaaggcuguguca

SEQ ID NO: 513927 - RNA, 14 nt, Homo sapiens
caauaagugccauu

SEQ ID NO: 513928 - RNA, 18 nt, Homo sapiens
caauacaaauauugugau

SEQ ID NO: 513929 - RNA, 16 nt, Homo sapiens
caauacccacugccag

SEQ ID NO: 513930 - RNA, 23 nt, Homo sapiens
caauacucagugcgguacucagu

SEQ ID NO: 513931 - RNA, 15 nt, Homo sapiens
caaucacaagccaag

SEQ ID NO: 513932 - RNA, 18 nt, Homo sapiens
caaugccaggcagugcag

SEQ ID NO: 513933 - RNA, 20 nt, Homo sapiens
caaugccugccugaacaaag

SEQ ID NO: 513934 - RNA, 14 nt, Homo sapiens
caauggcuggguuu

SEQ ID NO: 513935 - RNA, 16 nt, Homo sapiens
caauguaguacucagu

SEQ ID NO: 513936 - RNA, 23 nt, Homo sapiens
cacaaaaggcuggaugugcuuuc

SEQ ID NO: 513937 - RNA, 17 nt, Homo sapiens
cacaacuuugcuuuuag

SEQ ID NO: 513938 - RNA, 19 nt, Homo sapiens
cacaauaagccacugguau

SEQ ID NO: 513939 - RNA, 15 nt, Homo sapiens
cacaauacaguacuc

SEQ ID NO: 513940 - RNA, 21 nt, Homo sapiens
cacaauuaacuccguuuccaa

SEQ ID NO: 513941 - RNA, 13 nt, Homo sapiens
cacacaacugugg

SEQ ID NO: 513942 - RNA, 21 nt, Homo sapiens
cacacaggagaaaaugcaauu

SEQ ID NO: 513943 - RNA, 17 nt, Homo sapiens
cacagaguuacugccac

SEQ ID NO: 513944 - RNA, 11 nt, Homo sapiens
cacaguggaua

SEQ ID NO: 513945 - RNA, 16 nt, Homo sapiens
cacauacauauauaca

SEQ ID NO: 513946 - RNA, 12 nt, Homo sapiens
cacauuccugac

SEQ ID NO: 513947 - RNA, 13 nt, Homo sapiens
cacauuccugacc

SEQ ID NO: 513948 - RNA, 16 nt, Homo sapiens
cacauuggcagugugu

SEQ ID NO: 513949 - RNA, 13 nt, Homo sapiens
caccauggcuuua

SEQ ID NO: 513950 - RNA, 16 nt, Homo sapiens
cacccaagagcugucc

SEQ ID NO: 513951 - RNA, 14 nt, Homo sapiens
caccccucaagcca

SEQ ID NO: 513952 - RNA, 13 nt, Homo sapiens
cacccguguucuc

SEQ ID NO: 513953 - RNA, 19 nt, Homo sapiens
cacccuuuaauguucuaua

SEQ ID NO: 513954 - RNA, 16 nt, Homo sapiens
caccuguuacuacuuc

SEQ ID NO: 513955 - RNA, 18 nt, Homo sapiens
caccuucaagcacccugu

SEQ ID NO: 513956 - RNA, 16 nt, Homo sapiens
cacgaauauugcugau

SEQ ID NO: 513957 - RNA, 22 nt, Homo sapiens
cacgaggagcuuccagugcaug

SEQ ID NO: 513958 - RNA, 15 nt, Homo sapiens
cacgcaaauacaugc

SEQ ID NO: 513959 - RNA, 17 nt, Homo sapiens
cacgguccaauccagcc

SEQ ID NO: 513960 - RNA, 15 nt, Homo sapiens
cacgugugcagacug

SEQ ID NO: 513961 - RNA, 21 nt, Homo sapiens
cacucaaugccaggcagugca

SEQ ID NO: 513962 - RNA, 15 nt, Homo sapiens
cacuccccucaucca

SEQ ID NO: 513963 - RNA, 16 nt, Homo sapiens
cacugaaaaugugcuc

SEQ ID NO: 513964 - RNA, 23 nt, Homo sapiens
cacugugaccugcuccugcccac

SEQ ID NO: 513965 - RNA, 13 nt, Homo sapiens
cacuuuacauucu

SEQ ID NO: 513966 - RNA, 20 nt, Homo sapiens
cacuuucccacacugugaac

SEQ ID NO: 513967 - RNA, 16 nt, Homo sapiens
cacuuucugaaauuca

SEQ ID NO: 513968 - RNA, 17 nt, Homo sapiens
cacuuucugaaauucac

SEQ ID NO: 513969 - RNA, 11 nt, Homo sapiens
cacuuuugcca

SEQ ID NO: 513970 - RNA, 22 nt, Homo sapiens
cagaaaaccuaccacauucacu

SEQ ID NO: 513971 - RNA, 22 nt, Homo sapiens
cagaaacccuuuuacagucaca

SEQ ID NO: 513972 - RNA, 22 nt, Homo sapiens
cagaaauccacgcucaaucuca

SEQ ID NO: 513973 - RNA, 23 nt, Homo sapiens
cagaaccuagucuuguuguucau

SEQ ID NO: 513974 - RNA, 14 nt, Homo sapiens
cagaacuccuuucu

SEQ ID NO: 513975 - RNA, 19 nt, Homo sapiens
cagaacuucguacccuuug

SEQ ID NO: 513976 - RNA, 17 nt, Homo sapiens
cagaauggggacaucuu

SEQ ID NO: 513977 - RNA, 15 nt, Homo sapiens
cagacaccuagacuc

SEQ ID NO: 513978 - RNA, 13 nt, Homo sapiens
cagacagcuauuu

SEQ ID NO: 513979 - RNA, 23 nt, Homo sapiens
cagacagcuauuucgcacuguau

SEQ ID NO: 513980 - RNA, 16 nt, Homo sapiens
cagacuguggcugcag

SEQ ID NO: 513981 - RNA, 15 nt, Homo sapiens
cagagccacuaccuu

SEQ ID NO: 513982 - RNA, 16 nt, Homo sapiens
cagagccacuaccuuu

SEQ ID NO: 513983 - RNA, 19 nt, Homo sapiens
cagagcuuuacagugccac

SEQ ID NO: 513984 - RNA, 16 nt, Homo sapiens
cagaggacagcuuccc

SEQ ID NO: 513985 - RNA, 16 nt, Homo sapiens
cagcaaaagugcagua

SEQ ID NO: 513986 - RNA, 20 nt, Homo sapiens
cagcaaauuaauuggcagca

SEQ ID NO: 513987 - RNA, 17 nt, Homo sapiens
cagcacaagggcacauu

SEQ ID NO: 513988 - RNA, 14 nt, Homo sapiens
cagcaccuccggga

SEQ ID NO: 513989 - RNA, 23 nt, Homo sapiens
cagcacuacaacuuaauugcucu

SEQ ID NO: 513990 - RNA, 20 nt, Homo sapiens
cagcagguagugggugaaug

SEQ ID NO: 513991 - RNA, 22 nt, Homo sapiens
cagcagguugugugugugugca

SEQ ID NO: 513992 - RNA, 11 nt, Homo sapiens
cagcaucaggg

SEQ ID NO: 513993 - RNA, 18 nt, Homo sapiens
cagcaucugccaggacac

SEQ ID NO: 513994 - RNA, 23 nt, Homo sapiens
cagcaucugccaggacacugccu

SEQ ID NO: 513995 - RNA, 16 nt, Homo sapiens
cagccacuuauuucca

SEQ ID NO: 513996 - RNA, 19 nt, Homo sapiens
cagccccacuccacaguua

SEQ ID NO: 513997 - RNA, 11 nt, Homo sapiens
cagcuagacac

SEQ ID NO: 513998 - RNA, 16 nt, Homo sapiens
cagcugucuguggcuu

SEQ ID NO: 513999 - RNA, 18 nt, Homo sapiens
cagcuuugggcacaugua

SEQ ID NO: 514000 - RNA, 21 nt, Homo sapiens
caggaaagaucccaagucaaa

SEQ ID NO: 514001 - RNA, 17 nt, Homo sapiens
caggaaauaucugugaa

SEQ ID NO: 514002 - RNA, 14 nt, Homo sapiens
caggaaauucuguu

SEQ ID NO: 514003 - RNA, 21 nt, Homo sapiens
caggaaugcagcacaguacuc

SEQ ID NO: 514004 - RNA, 21 nt, Homo sapiens
caggacccagggaaugccagg

SEQ ID NO: 514005 - RNA, 14 nt, Homo sapiens
caggagagcccucu

SEQ ID NO: 514006 - RNA, 18 nt, Homo sapiens
caggagcguguccuaucc

SEQ ID NO: 514007 - RNA, 20 nt, Homo sapiens
caggauugaggaugaacuca

SEQ ID NO: 514008 - RNA, 19 nt, Homo sapiens
caggauuggccacauugcc

SEQ ID NO: 514009 - RNA, 14 nt, Homo sapiens
caggcagugcagua

SEQ ID NO: 514010 - RNA, 21 nt, Homo sapiens
uuagaaguucgaaaacucagc

SEQ ID NO: 514011 - RNA, 15 nt, Homo sapiens
uuagacaauguggaa

SEQ ID NO: 514012 - RNA, 22 nt, Homo sapiens
uuaggacaugcuaucaguaaua

SEQ ID NO: 514013 - RNA, 11 nt, Homo sapiens
uuaggugcuga

SEQ ID NO: 514014 - RNA, 12 nt, Homo sapiens
uuaguaagcaaa

SEQ ID NO: 514015 - RNA, 16 nt, Homo sapiens
uuagugugauugugaa

SEQ ID NO: 514016 - RNA, 21 nt, Homo sapiens
uuauaaagauugguaguuauc

SEQ ID NO: 514017 - RNA, 12 nt, Homo sapiens
uuauacacauaa

SEQ ID NO: 514018 - RNA, 14 nt, Homo sapiens
uuauaccagcaaaa

SEQ ID NO: 514019 - RNA, 22 nt, Homo sapiens
uuauaggcacuugcuacuucag

SEQ ID NO: 514020 - RNA, 22 nt, Homo sapiens
uuauauacaaagcugucacuca

SEQ ID NO: 514021 - RNA, 18 nt, Homo sapiens
uuauauaugaaaacuaag

SEQ ID NO: 514022 - RNA, 21 nt, Homo sapiens
uuauauauguauaucugugua

SEQ ID NO: 514023 - RNA, 19 nt, Homo sapiens
uuauaucagacugcuuuga

SEQ ID NO: 514024 - RNA, 19 nt, Homo sapiens
uuauauucccaaaucucaa

SEQ ID NO: 514025 - RNA, 21 nt, Homo sapiens
uuauccagaggguugugauuu

SEQ ID NO: 514026 - RNA, 16 nt, Homo sapiens
uuaugcaggcagauua

SEQ ID NO: 514027 - RNA, 16 nt, Homo sapiens
uuauucguuacucuaa

SEQ ID NO: 514028 - RNA, 19 nt, Homo sapiens
uuauugcuggaaucuacua

SEQ ID NO: 514029 - RNA, 13 nt, Homo sapiens
uuauuguauauau

SEQ ID NO: 514030 - RNA, 13 nt, Homo sapiens
uuauuuccaugga

SEQ ID NO: 514031 - RNA, 15 nt, Homo sapiens
uucaacuucaggaaa

SEQ ID NO: 514032 - RNA, 22 nt, Homo sapiens
uucaagagacaguauugcuaac

SEQ ID NO: 514033 - RNA, 16 nt, Homo sapiens
uucaaggcccuuacac

SEQ ID NO: 514034 - RNA, 22 nt, Homo sapiens
uucaaucacugaaaaugugcuc

SEQ ID NO: 514035 - RNA, 20 nt, Homo sapiens
uucaauccccauaaugcuuc

SEQ ID NO: 514036 - RNA, 15 nt, Homo sapiens
uucaauguacuguau

SEQ ID NO: 514037 - RNA, 16 nt, Homo sapiens
uucacaauacagugga

SEQ ID NO: 514038 - RNA, 19 nt, Homo sapiens
uucagaaacuaagaaucau

SEQ ID NO: 514039 - RNA, 15 nt, Homo sapiens
uucagcacacacaaa

SEQ ID NO: 514040 - RNA, 22 nt, Homo sapiens
uucauccaacgugaagauacca

SEQ ID NO: 514041 - RNA, 17 nt, Homo sapiens
uucauuaaaacaagaga

SEQ ID NO: 514042 - RNA, 14 nt, Homo sapiens
uucauucauacuca

SEQ ID NO: 514043 - RNA, 17 nt, Homo sapiens
uucauugucucagugaa

SEQ ID NO: 514044 - RNA, 21 nt, Homo sapiens
uuccaaagguuucaacuguaa

SEQ ID NO: 514045 - RNA, 21 nt, Homo sapiens
uuccaacccaggucugcuuug

SEQ ID NO: 514046 - RNA, 19 nt, Homo sapiens
uuccaagugugugugcaau

SEQ ID NO: 514047 - RNA, 20 nt, Homo sapiens
aggaaaauauugacaaguuu

SEQ ID NO: 514048 - RNA, 13 nt, Homo sapiens
aggaaacucucca

SEQ ID NO: 514049 - RNA, 13 nt, Homo sapiens
aggaaagauccca

SEQ ID NO: 514050 - RNA, 14 nt, Homo sapiens
aggaaagaucccaa

SEQ ID NO: 514051 - RNA, 19 nt, Homo sapiens
aggaaaguugugauucuuu

SEQ ID NO: 514052 - RNA, 17 nt, Homo sapiens
aggaagcagccuccacu

SEQ ID NO: 514053 - RNA, 12 nt, Homo sapiens
aggacacagcac

SEQ ID NO: 514054 - RNA, 15 nt, Homo sapiens
aggacacugaugggu

SEQ ID NO: 514055 - RNA, 13 nt, Homo sapiens
aggacgcaugcag

SEQ ID NO: 514056 - RNA, 10 nt, Homo sapiens
aggagaagac

SEQ ID NO: 514057 - RNA, 17 nt, Homo sapiens
aggagaugaggcuggau

SEQ ID NO: 514058 - RNA, 19 nt, Homo sapiens
aggagccuugcugggccag

SEQ ID NO: 514059 - RNA, 18 nt, Homo sapiens
aggagcguguacuacccc

SEQ ID NO: 514060 - RNA, 14 nt, Homo sapiens
aggagcuuccagug

SEQ ID NO: 514061 - RNA, 18 nt, Homo sapiens
aggagcuuccagugcaug

SEQ ID NO: 514062 - RNA, 13 nt, Homo sapiens
aggaggaggacac

SEQ ID NO: 514063 - RNA, 21 nt, Homo sapiens
aggaucaaaguugaugaaaua

SEQ ID NO: 514064 - RNA, 22 nt, Homo sapiens
aggauccugagccagauuucac

SEQ ID NO: 514065 - RNA, 15 nt, Homo sapiens
aggauguauguguau

SEQ ID NO: 514066 - RNA, 17 nt, Homo sapiens
aggcaaaggcuuguaaa

SEQ ID NO: 514067 - RNA, 22 nt, Homo sapiens
aggcagggagggggcugggaaa

SEQ ID NO: 514068 - RNA, 11 nt, Homo sapiens
aggcagugcag

SEQ ID NO: 514069 - RNA, 13 nt, Homo sapiens
aggcagugcagug

SEQ ID NO: 514070 - RNA, 17 nt, Homo sapiens
aggccccuuaccugcag

SEQ ID NO: 514071 - RNA, 13 nt, Homo sapiens
aggccucagggac

SEQ ID NO: 514072 - RNA, 18 nt, Homo sapiens
aggcucuguaaccuuauc

SEQ ID NO: 514073 - RNA, 22 nt, Homo sapiens
aggcugccucagccaguggcac

SEQ ID NO: 514074 - RNA, 16 nt, Homo sapiens
aggcugcuguguagcu

SEQ ID NO: 514075 - RNA, 15 nt, Homo sapiens
aggcuuagugcuugg

SEQ ID NO: 514076 - RNA, 15 nt, Homo sapiens
agggacaagcauguu

SEQ ID NO: 514077 - RNA, 12 nt, Homo sapiens
agggacucucca

SEQ ID NO: 514078 - RNA, 15 nt, Homo sapiens
agggcccccacagga

SEQ ID NO: 514079 - RNA, 19 nt, Homo sapiens
aggguuaaagaaaggcaga

SEQ ID NO: 514080 - RNA, 14 nt, Homo sapiens
agguaaauaaucau

SEQ ID NO: 514081 - RNA, 16 nt, Homo sapiens
agguaucccagcuuug

SEQ ID NO: 514082 - RNA, 19 nt, Homo sapiens
agguauugucuuuugacau

SEQ ID NO: 514083 - RNA, 22 nt, Homo sapiens
aggucuguugaagugcauguua

SEQ ID NO: 514084 - RNA, 15 nt, Homo sapiens
aggucuugccugaau

SEQ ID NO: 514085 - RNA, 21 nt, Homo sapiens
aggucuugccugaauccauca

SEQ ID NO: 514086 - RNA, 18 nt, Homo sapiens
aggugaccagaaugaggc

SEQ ID NO: 514087 - RNA, 19 nt, Homo sapiens
aggugccucauagcauagc

SEQ ID NO: 514088 - RNA, 17 nt, Homo sapiens
aggugcugaaugaagcu

SEQ ID NO: 514089 - RNA, 16 nt, Homo sapiens
agguggaguaggugaa

SEQ ID NO: 514090 - RNA, 14 nt, Homo sapiens
agguugaaaauguu

SEQ ID NO: 514091 - RNA, 21 nt, Homo sapiens
agguuggagugcauucauuca

SEQ ID NO: 514092 - RNA, 23 nt, Homo sapiens
aguaaaguaugaaacauucuuau

SEQ ID NO: 514093 - RNA, 22 nt, Homo sapiens
aguaacacagggcagcuaguac

SEQ ID NO: 514094 - RNA, 21 nt, Homo sapiens
aguaacacaguguagugcuca

SEQ ID NO: 514095 - RNA, 17 nt, Homo sapiens
aguaacaguauuuccau

SEQ ID NO: 514096 - RNA, 19 nt, Homo sapiens
aguaacagugcaguacuca

SEQ ID NO: 514097 - RNA, 23 nt, Homo sapiens
aguaagacagugcagugcucagu

SEQ ID NO: 514098 - RNA, 14 nt, Homo sapiens
aguaagaucaagaa

SEQ ID NO: 514099 - RNA, 15 nt, Homo sapiens
aguaauaacuguuag

SEQ ID NO: 514100 - RNA, 18 nt, Homo sapiens
aguacucaggcagugcaa

SEQ ID NO: 514101 - RNA, 23 nt, Homo sapiens
aguacucaguaaaucagugcagu

SEQ ID NO: 514102 - RNA, 22 nt, Homo sapiens
aguacucaguaacagugcagua

SEQ ID NO: 514103 - RNA, 15 nt, Homo sapiens
aguacucaguaauac

SEQ ID NO: 514104 - RNA, 24 nt, Homo sapiens
aguacucaguuaggcagugcagua

SEQ ID NO: 514105 - RNA, 17 nt, Homo sapiens
aguacucuaauauacag

SEQ ID NO: 514106 - RNA, 17 nt, Homo sapiens
aguacugaaauacauau

SEQ ID NO: 514107 - RNA, 16 nt, Homo sapiens
aguacugcaugaucuu

SEQ ID NO: 514108 - RNA, 23 nt, Homo sapiens
aguagacagauguuggugcaaua

SEQ ID NO: 514109 - RNA, 22 nt, Homo sapiens
aguagaggguccagucuucuag

SEQ ID NO: 514110 - RNA, 16 nt, Homo sapiens
aguagauaagugcuca

SEQ ID NO: 514111 - RNA, 21 nt, Homo sapiens
aguagccagaucccucuccag

SEQ ID NO: 514112 - RNA, 20 nt, Homo sapiens
aguaggucugcacacauaac

SEQ ID NO: 514113 - RNA, 14 nt, Homo sapiens
aguauauagccuua

SEQ ID NO: 514114 - RNA, 13 nt, Homo sapiens
aguauugagacac

SEQ ID NO: 514115 - RNA, 17 nt, Homo sapiens
aguauuguacagcacug

SEQ ID NO: 514116 - RNA, 15 nt, Homo sapiens
agucaaacagugugg

SEQ ID NO: 514117 - RNA, 15 nt, Homo sapiens
agucaagcugaugaa

SEQ ID NO: 514118 - RNA, 21 nt, Homo sapiens
agucaagucuaccugccuugc

SEQ ID NO: 514119 - RNA, 15 nt, Homo sapiens
agucagcacagagag

SEQ ID NO: 514120 - RNA, 21 nt, Homo sapiens
aguccaaaauaucgagugaau

SEQ ID NO: 514121 - RNA, 17 nt, Homo sapiens
aguccacccccauugug

SEQ ID NO: 514122 - RNA, 17 nt, Homo sapiens
aguccagaugugccuag

SEQ ID NO: 514123 - RNA, 23 nt, Homo sapiens
agucccuccgacuucucuagaca

SEQ ID NO: 514124 - RNA, 22 nt, Homo sapiens
agucgccacauuucucugcaaa

SEQ ID NO: 514125 - RNA, 20 nt, Homo sapiens
agugaaaauuuuauugaaua

SEQ ID NO: 514126 - RNA, 16 nt, Homo sapiens
agugacagaaggcccg

SEQ ID NO: 514127 - RNA, 17 nt, Homo sapiens
agugacauuucaaucac

SEQ ID NO: 514128 - RNA, 15 nt, Homo sapiens
agugcagugcucagu

SEQ ID NO: 514129 - RNA, 17 nt, Homo sapiens
agugcauguugccauga

SEQ ID NO: 514130 - RNA, 16 nt, Homo sapiens
agugccccaguggugc

SEQ ID NO: 514131 - RNA, 13 nt, Homo sapiens
agugccugugauc

SEQ ID NO: 514132 - RNA, 19 nt, Homo sapiens
aguggaaaccuugcugcua

SEQ ID NO: 514133 - RNA, 19 nt, Homo sapiens
aguggcaggugggcugccu

SEQ ID NO: 514134 - RNA, 14 nt, Homo sapiens
aguggccugagaag

SEQ ID NO: 514135 - RNA, 16 nt, Homo sapiens
aguguagugcucagua

SEQ ID NO: 514136 - RNA, 17 nt, Homo sapiens
aguguccauugacaugu

SEQ ID NO: 514137 - RNA, 20 nt, Homo sapiens
aguguguugggaauugcaug

SEQ ID NO: 514138 - RNA, 19 nt, Homo sapiens
aguguuagaaaaaacugga

SEQ ID NO: 514139 - RNA, 15 nt, Homo sapiens
aguguuguguuacaa

SEQ ID NO: 514140 - RNA, 16 nt, Homo sapiens
aguuaggcagugcagu

SEQ ID NO: 514141 - RNA, 22 nt, Homo sapiens
aguuaucugagcuuaaacauuu

SEQ ID NO: 514142 - RNA, 22 nt, Homo sapiens
aguuauuuucugagugugcaga

SEQ ID NO: 514143 - RNA, 21 nt, Homo sapiens
aguucagccugggugugugaa

SEQ ID NO: 514144 - RNA, 15 nt, Homo sapiens
aguugagccagcaga

SEQ ID NO: 514145 - RNA, 14 nt, Homo sapiens
auaaucauacacag

SEQ ID NO: 514146 - RNA, 11 nt, Homo sapiens
auaaugcuucu

SEQ ID NO: 514147 - RNA, 13 nt, Homo sapiens
auaauugacaaac

SEQ ID NO: 514148 - RNA, 18 nt, Homo sapiens
auacaauacaguacucag

SEQ ID NO: 514149 - RNA, 15 nt, Homo sapiens
auacacauacauaua

SEQ ID NO: 514150 - RNA, 23 nt, Homo sapiens
auacagaugguguccugcaugua

SEQ ID NO: 514151 - RNA, 22 nt, Homo sapiens
auacaguacucaggcagugcag

SEQ ID NO: 514152 - RNA, 23 nt, Homo sapiens
auacagucucuauuugauuugca

SEQ ID NO: 514153 - RNA, 22 nt, Homo sapiens
auacauucuaaaucacuuuaau

SEQ ID NO: 514154 - RNA, 14 nt, Homo sapiens
auacccacugccag

SEQ ID NO: 514155 - RNA, 16 nt, Homo sapiens
auacccucugagacag

SEQ ID NO: 514156 - RNA, 17 nt, Homo sapiens
auacgcaauuguauaua

SEQ ID NO: 514157 - RNA, 17 nt, Homo sapiens
auacucauuuggauaua

SEQ ID NO: 514158 - RNA, 22 nt, Homo sapiens
auacugacagaugguaucugcc

SEQ ID NO: 514159 - RNA, 17 nt, Homo sapiens
auacugauuacagaugu

SEQ ID NO: 514160 - RNA, 15 nt, Homo sapiens
auacuucaaguaaga

SEQ ID NO: 514161 - RNA, 16 nt, Homo sapiens
auacuucauacaacau

SEQ ID NO: 514162 - RNA, 22 nt, Homo sapiens
auagauuuucauguucuugcag

SEQ ID NO: 514163 - RNA, 15 nt, Homo sapiens
auagcuuaagaagua

SEQ ID NO: 514164 - RNA, 20 nt, Homo sapiens
auagcuuuagagaagccaua

SEQ ID NO: 514165 - RNA, 16 nt, Homo sapiens
auaggcuuagugcuug

SEQ ID NO: 514166 - RNA, 13 nt, Homo sapiens
auaguauuucaga

SEQ ID NO: 514167 - RNA, 14 nt, Homo sapiens
auagucaaucaaac

SEQ ID NO: 514168 - RNA, 22 nt, Homo sapiens
auagucuguacuucaguucuca

SEQ ID NO: 514169 - RNA, 15 nt, Homo sapiens
auagugagcauauau

SEQ ID NO: 514170 - RNA, 20 nt, Homo sapiens
auaguugagccagcagacau

SEQ ID NO: 514171 - RNA, 15 nt, Homo sapiens
auauaaacugugaga

SEQ ID NO: 514172 - RNA, 12 nt, Homo sapiens
auauaagccaua

SEQ ID NO: 514173 - RNA, 15 nt, Homo sapiens
auauacacuuuacau

SEQ ID NO: 514174 - RNA, 16 nt, Homo sapiens
auauacucauuuggau

SEQ ID NO: 514175 - RNA, 14 nt, Homo sapiens
auauacucgaauca

SEQ ID NO: 514176 - RNA, 19 nt, Homo sapiens
auauaguguuguguuacaa

SEQ ID NO: 514177 - RNA, 13 nt, Homo sapiens
auauauauuuauc

SEQ ID NO: 514178 - RNA, 15 nt, Homo sapiens
auauguaacuucaga

SEQ ID NO: 514179 - RNA, 16 nt, Homo sapiens
auauguuuauacacac

SEQ ID NO: 514180 - RNA, 17 nt, Homo sapiens
auauguuuauacacaca

SEQ ID NO: 514181 - RNA, 21 nt, Homo sapiens
auauuaaagucugagaaauuu

SEQ ID NO: 514182 - RNA, 21 nt, Homo sapiens
auauucauaccuucugaugaa

SEQ ID NO: 514183 - RNA, 20 nt, Homo sapiens
auauuccgggugccauuccc

SEQ ID NO: 514184 - RNA, 18 nt, Homo sapiens
auauuuaaagucuugaau

SEQ ID NO: 514185 - RNA, 20 nt, Homo sapiens
auauuuuaggaaacucucca

SEQ ID NO: 514186 - RNA, 20 nt, Homo sapiens
auauuuucgcccaccuaaag

SEQ ID NO: 514187 - RNA, 15 nt, Homo sapiens
auauuuuuuuguaga

SEQ ID NO: 514188 - RNA, 16 nt, Homo sapiens
aucaacacuaaugccu

SEQ ID NO: 514189 - RNA, 17 nt, Homo sapiens
aucaagcuccaucuuau

SEQ ID NO: 514190 - RNA, 14 nt, Homo sapiens
aucacaagucagca

SEQ ID NO: 514191 - RNA, 20 nt, Homo sapiens
aucacaagucagcacuaccu

SEQ ID NO: 514192 - RNA, 15 nt, Homo sapiens
aucacagauuuccaa

SEQ ID NO: 514193 - RNA, 12 nt, Homo sapiens
aucacuuaccac

SEQ ID NO: 514194 - RNA, 13 nt, Homo sapiens
aucacuuaccacu

SEQ ID NO: 514195 - RNA, 20 nt, Homo sapiens
aucaggaaauaucugugaag

SEQ ID NO: 514196 - RNA, 11 nt, Homo sapiens
aucagugcagu

SEQ ID NO: 514197 - RNA, 12 nt, Homo sapiens
aucagugcagua

SEQ ID NO: 514198 - RNA, 18 nt, Homo sapiens
aucaguuuguuguucaga

SEQ ID NO: 514199 - RNA, 15 nt, Homo sapiens
aucauagcugacuca

SEQ ID NO: 514200 - RNA, 17 nt, Homo sapiens
aucauagcugacucaga

SEQ ID NO: 514201 - RNA, 19 nt, Homo sapiens
aucauauuuaccugugaau

SEQ ID NO: 514202 - RNA, 20 nt, Homo sapiens
aucaugcuucuacuccaugg

SEQ ID NO: 514203 - RNA, 15 nt, Homo sapiens
auccaaaccuuucaa

SEQ ID NO: 514204 - RNA, 19 nt, Homo sapiens
auccagaggguugugauuu

SEQ ID NO: 514205 - RNA, 19 nt, Homo sapiens
auccaucaggacuugggaa

SEQ ID NO: 514206 - RNA, 21 nt, Homo sapiens
auccaugugcugcuguggcau

SEQ ID NO: 514207 - RNA, 18 nt, Homo sapiens
aucccuggccaccugcca

SEQ ID NO: 514208 - RNA, 13 nt, Homo sapiens
auccuagcacuuu

SEQ ID NO: 514209 - RNA, 20 nt, Homo sapiens
aucuauggauuggguaucaa

SEQ ID NO: 514210 - RNA, 16 nt, Homo sapiens
aucucaucccuagucu

SEQ ID NO: 514211 - RNA, 18 nt, Homo sapiens
aucucauucagguguucu

SEQ ID NO: 514212 - RNA, 23 nt, Homo sapiens
aucucgcacuacaucugauauca

SEQ ID NO: 514213 - RNA, 22 nt, Homo sapiens
aucucuguuuaggugccucuac

SEQ ID NO: 514214 - RNA, 23 nt, Homo sapiens
aucugacauauuucauaagcaca

SEQ ID NO: 514215 - RNA, 13 nt, Homo sapiens
aucugagcuuaaa

SEQ ID NO: 514216 - RNA, 14 nt, Homo sapiens
aucugagcuuaaac

SEQ ID NO: 514217 - RNA, 20 nt, Homo sapiens
aucugccaggacacugccuu

SEQ ID NO: 514218 - RNA, 16 nt, Homo sapiens
aucuguauaucagcuc

SEQ ID NO: 514219 - RNA, 17 nt, Homo sapiens
aucuguauaucagcucu

SEQ ID NO: 514220 - RNA, 15 nt, Homo sapiens
aucuguuccagaaaa

SEQ ID NO: 514221 - RNA, 19 nt, Homo sapiens
aucuuacacgaagaaauag

SEQ ID NO: 514222 - RNA, 15 nt, Homo sapiens
aucuuacccuucaau

SEQ ID NO: 514223 - RNA, 22 nt, Homo sapiens
aucuuacccuucaauguuaaau

SEQ ID NO: 514224 - RNA, 16 nt, Homo sapiens
augaaaaagcauguac

SEQ ID NO: 514225 - RNA, 14 nt, Homo sapiens
augaagacaaauag

SEQ ID NO: 514226 - RNA, 16 nt, Homo sapiens
augaagacccuaucuc

SEQ ID NO: 514227 - RNA, 17 nt, Homo sapiens
augaagcaaacacacag

SEQ ID NO: 514228 - RNA, 13 nt, Homo sapiens
augaaggggccag

SEQ ID NO: 514229 - RNA, 20 nt, Homo sapiens
augaaucgcagacgcaagag

SEQ ID NO: 514230 - RNA, 11 nt, Homo sapiens
augacacgaau

SEQ ID NO: 514231 - RNA, 22 nt, Homo sapiens
augacaguuagagaugcugauu

SEQ ID NO: 514232 - RNA, 17 nt, Homo sapiens
augacccuccuguccag

SEQ ID NO: 514233 - RNA, 14 nt, Homo sapiens
augagaacuaaaua

SEQ ID NO: 514234 - RNA, 17 nt, Homo sapiens
augagagaagagaguau

SEQ ID NO: 514235 - RNA, 20 nt, Homo sapiens
augagaggaaaucaccgaaa

SEQ ID NO: 514236 - RNA, 21 nt, Homo sapiens
augaggcacgccugccuucuc

SEQ ID NO: 514237 - RNA, 19 nt, Homo sapiens
augagucacuuacuucaua

SEQ ID NO: 514238 - RNA, 20 nt, Homo sapiens
augauaaauuugacuguuau

SEQ ID NO: 514239 - RNA, 16 nt, Homo sapiens
augauuaagugcuuga

SEQ ID NO: 514240 - RNA, 13 nt, Homo sapiens
augauuucagaaa

SEQ ID NO: 514241 - RNA, 21 nt, Homo sapiens
augcacaccaaauugcugaga

SEQ ID NO: 514242 - RNA, 21 nt, Homo sapiens
augcacucuucauguaaucac

SEQ ID NO: 514243 - RNA, 21 nt, Homo sapiens
augcagcagcuuuugacuguu

SEQ ID NO: 514244 - RNA, 19 nt, Homo sapiens
augcauauuuauagaguua

SEQ ID NO: 514245 - RNA, 15 nt, Homo sapiens
caaagcugucacuca

SEQ ID NO: 514246 - RNA, 15 nt, Homo sapiens
caaauaaauaucauc

SEQ ID NO: 514247 - RNA, 19 nt, Homo sapiens
caaaugucauuucauacaa

SEQ ID NO: 514248 - RNA, 21 nt, Homo sapiens
caaauguuuuuaauccaaaga

SEQ ID NO: 514249 - RNA, 17 nt, Homo sapiens
caaauucaguggacauu

SEQ ID NO: 514250 - RNA, 13 nt, Homo sapiens
caaauugcugaga

SEQ ID NO: 514251 - RNA, 17 nt, Homo sapiens
caacaaagcaugcucag

SEQ ID NO: 514252 - RNA, 15 nt, Homo sapiens
caacaagcaaacuga

SEQ ID NO: 514253 - RNA, 13 nt, Homo sapiens
caacacaucacuu

SEQ ID NO: 514254 - RNA, 18 nt, Homo sapiens
caacauuccuuguuugua

SEQ ID NO: 514255 - RNA, 14 nt, Homo sapiens
caacccugugaucu

SEQ ID NO: 514256 - RNA, 23 nt, Homo sapiens
caacccugugaucuauaccaccu

SEQ ID NO: 514257 - RNA, 23 nt, Homo sapiens
caacccugugcaugacugauguu

SEQ ID NO: 514258 - RNA, 19 nt, Homo sapiens
caaccuccccugguccugc

SEQ ID NO: 514259 - RNA, 15 nt, Homo sapiens
uuaguauaguuuucg

SEQ ID NO: 514260 - RNA, 14 nt, Homo sapiens
uuaguccucaccuu

SEQ ID NO: 514261 - RNA, 21 nt, Homo sapiens
uuauaccuguacacacacaga

SEQ ID NO: 514262 - RNA, 19 nt, Homo sapiens
uuauauaugaaaacuaagu

SEQ ID NO: 514263 - RNA, 18 nt, Homo sapiens
uuauaucuguggucuuca

SEQ ID NO: 514264 - RNA, 22 nt, Homo sapiens
uuauauucccaaaucucaaaag

SEQ ID NO: 514265 - RNA, 17 nt, Homo sapiens
uuaucaguacaauucuu

SEQ ID NO: 514266 - RNA, 15 nt, Homo sapiens
uuaucauaaauucaa

SEQ ID NO: 514267 - RNA, 21 nt, Homo sapiens
uuaucuuugucuuaucuacca

SEQ ID NO: 514268 - RNA, 16 nt, Homo sapiens
uuaugagcuaucuacu

SEQ ID NO: 514269 - RNA, 22 nt, Homo sapiens
uuaugauauaauaaauauauau

SEQ ID NO: 514270 - RNA, 14 nt, Homo sapiens
uuauguaaacauca

SEQ ID NO: 514271 - RNA, 19 nt, Homo sapiens
uuauguaagggucauuaga

SEQ ID NO: 514272 - RNA, 17 nt, Homo sapiens
uuauucauuagcuguga

SEQ ID NO: 514273 - RNA, 14 nt, Homo sapiens
uuauuuccauggau

SEQ ID NO: 514274 - RNA, 15 nt, Homo sapiens
uuauuuccauggauu

SEQ ID NO: 514275 - RNA, 16 nt, Homo sapiens
uucaaagaaaacagac

SEQ ID NO: 514276 - RNA, 22 nt, Homo sapiens
uucaaaugucauuucauacaaa

SEQ ID NO: 514277 - RNA, 16 nt, Homo sapiens
uucaagcauugcuaaa

SEQ ID NO: 514278 - RNA, 13 nt, Homo sapiens
uucaaugugaauu

SEQ ID NO: 514279 - RNA, 18 nt, Homo sapiens
uucaauguuaaaucuaca

SEQ ID NO: 514280 - RNA, 18 nt, Homo sapiens
uucacacaacuguggaua

SEQ ID NO: 514281 - RNA, 13 nt, Homo sapiens
uucacauuccuga

SEQ ID NO: 514282 - RNA, 16 nt, Homo sapiens
uucagaaacaaagcau

SEQ ID NO: 514283 - RNA, 14 nt, Homo sapiens
uucagaaagggcag

SEQ ID NO: 514284 - RNA, 22 nt, Homo sapiens
uucagucuaugcugugugcaga

SEQ ID NO: 514285 - RNA, 13 nt, Homo sapiens
uucauaugaguuc

SEQ ID NO: 514286 - RNA, 16 nt, Homo sapiens
uucauccaacuggaag

SEQ ID NO: 514287 - RNA, 17 nt, Homo sapiens
uucauuaaaaacacuac

SEQ ID NO: 514288 - RNA, 19 nt, Homo sapiens
uucauuauuucaaggaaua

SEQ ID NO: 514289 - RNA, 15 nt, Homo sapiens
uucauuuauuugaca

SEQ ID NO: 514290 - RNA, 14 nt, Homo sapiens
uuccaacaugugau

SEQ ID NO: 514291 - RNA, 18 nt, Homo sapiens
uuccaagugugugugcaa

SEQ ID NO: 514292 - RNA, 17 nt, Homo sapiens
uuccaaguuuauugccc

SEQ ID NO: 514293 - RNA, 20 nt, Homo sapiens
uuccccauugccuucugggg

SEQ ID NO: 514294 - RNA, 15 nt, Homo sapiens
uucccugaacacuca

SEQ ID NO: 514295 - RNA, 19 nt, Homo sapiens
uucccugaacacucauccc

SEQ ID NO: 514296 - RNA, 21 nt, Homo sapiens
uucccugaggaaugaaaaagg

SEQ ID NO: 514297 - RNA, 17 nt, Homo sapiens
uuccggaaagccuuccu

SEQ ID NO: 514298 - RNA, 15 nt, Homo sapiens
uuccucacuaccacu

SEQ ID NO: 514299 - RNA, 13 nt, Homo sapiens
uuccucuuaccug

SEQ ID NO: 514300 - RNA, 18 nt, Homo sapiens
uuccucuuucacuucuua

SEQ ID NO: 514301 - RNA, 16 nt, Homo sapiens
uuccugaacucccagu

SEQ ID NO: 514302 - RNA, 17 nt, Homo sapiens
uuccugaauaauuucca

SEQ ID NO: 514303 - RNA, 14 nt, Homo sapiens
uucgauaaaggaua

SEQ ID NO: 514304 - RNA, 17 nt, Homo sapiens
uucgcguauuucaggau

SEQ ID NO: 514305 - RNA, 20 nt, Homo sapiens
uucguccuuagaauacugua

SEQ ID NO: 514306 - RNA, 21 nt, Homo sapiens
uucguccuuagaauacuguau

SEQ ID NO: 514307 - RNA, 18 nt, Homo sapiens
uucuaaggagcacuagaa

SEQ ID NO: 514308 - RNA, 15 nt, Homo sapiens
uucuaauccaugugc

SEQ ID NO: 514309 - RNA, 14 nt, Homo sapiens
uucuauauuuacug

SEQ ID NO: 514310 - RNA, 12 nt, Homo sapiens
uucuccuuaacc

SEQ ID NO: 514311 - RNA, 19 nt, Homo sapiens
uucucuaaacuuucccuau

SEQ ID NO: 514312 - RNA, 22 nt, Homo sapiens
uucucucuuucuuuugugcaua

SEQ ID NO: 514313 - RNA, 20 nt, Homo sapiens
uucucugccgguggggccag

SEQ ID NO: 514314 - RNA, 16 nt, Homo sapiens
uucugacagcauuuca

SEQ ID NO: 514315 - RNA, 13 nt, Homo sapiens
uucugagugacau

SEQ ID NO: 514316 - RNA, 16 nt, Homo sapiens
uucugagugugcagac

SEQ ID NO: 514317 - RNA, 21 nt, Homo sapiens
uucugcugaauuuucacauga

SEQ ID NO: 514318 - RNA, 18 nt, Homo sapiens
uucugcuucucuuucaca

SEQ ID NO: 514319 - RNA, 21 nt, Homo sapiens
uucuucaccucacuuguggca

SEQ ID NO: 514320 - RNA, 16 nt, Homo sapiens
uucuucccuuaggcaa

SEQ ID NO: 514321 - RNA, 16 nt, Homo sapiens
uucuugagcagcugaa

SEQ ID NO: 514322 - RNA, 13 nt, Homo sapiens
uucuugcacugua

SEQ ID NO: 514323 - RNA, 17 nt, Homo sapiens
uucuuucacaaggcauc

SEQ ID NO: 514324 - RNA, 13 nt, Homo sapiens
uugaaaacucaua

SEQ ID NO: 514325 - RNA, 20 nt, Homo sapiens
uugaaagggacaaguaucau

SEQ ID NO: 514326 - RNA, 23 nt, Homo sapiens
uugaaggggcaacccaaggcauc

SEQ ID NO: 514327 - RNA, 18 nt, Homo sapiens
uugaaugcuuaaaugauc

SEQ ID NO: 514328 - RNA, 20 nt, Homo sapiens
uugaauuuugucauguaauu

SEQ ID NO: 514329 - RNA, 15 nt, Homo sapiens
uugaccuacccugga

SEQ ID NO: 514330 - RNA, 18 nt, Homo sapiens
uugauaguuuacaaacaa

SEQ ID NO: 514331 - RNA, 18 nt, Homo sapiens
cccucauguauacuucaa

SEQ ID NO: 514332 - RNA, 15 nt, Homo sapiens
cccuccuccaugcug

SEQ ID NO: 514333 - RNA, 20 nt, Homo sapiens
cccucugcuaugucugugau

SEQ ID NO: 514334 - RNA, 20 nt, Homo sapiens
cccugaauucauugucucag

SEQ ID NO: 514335 - RNA, 23 nt, Homo sapiens
cccugaauucauugucucaguga

SEQ ID NO: 514336 - RNA, 17 nt, Homo sapiens
cccugacuucccagcug

SEQ ID NO: 514337 - RNA, 13 nt, Homo sapiens
cccugcaaccucg

SEQ ID NO: 514338 - RNA, 16 nt, Homo sapiens
cccugcaggcaggcag

SEQ ID NO: 514339 - RNA, 19 nt, Homo sapiens
cccugggcaaggaagcuuu

SEQ ID NO: 514340 - RNA, 16 nt, Homo sapiens
cccugguccugcacug

SEQ ID NO: 514341 - RNA, 17 nt, Homo sapiens
cccugguccugcacugu

SEQ ID NO: 514342 - RNA, 19 nt, Homo sapiens
cccuguacaguuugcuuau

SEQ ID NO: 514343 - RNA, 14 nt, Homo sapiens
cccugugaucuaua

SEQ ID NO: 514344 - RNA, 15 nt, Homo sapiens
cccugugggagucca

SEQ ID NO: 514345 - RNA, 17 nt, Homo sapiens
cccuguuuccaaugcca

SEQ ID NO: 514346 - RNA, 18 nt, Homo sapiens
cccuguuuccaaugccaa

SEQ ID NO: 514347 - RNA, 19 nt, Homo sapiens
cccuucaaugcaaaauaca

SEQ ID NO: 514348 - RNA, 11 nt, Homo sapiens
cccuuccccac

SEQ ID NO: 514349 - RNA, 18 nt, Homo sapiens
cccuucuucuugacccau

SEQ ID NO: 514350 - RNA, 17 nt, Homo sapiens
cccuuuccccauucagu

SEQ ID NO: 514351 - RNA, 21 nt, Homo sapiens
cccuuuccugggggaugugca

SEQ ID NO: 514352 - RNA, 22 nt, Homo sapiens
cccuuuccugggggaugugcac

SEQ ID NO: 514353 - RNA, 13 nt, Homo sapiens
ccggaaagccuuc

SEQ ID NO: 514354 - RNA, 12 nt, Homo sapiens
ccggccugaugg

SEQ ID NO: 514355 - RNA, 21 nt, Homo sapiens
ccgucagccaagucgccacau

SEQ ID NO: 514356 - RNA, 14 nt, Homo sapiens
ccguuuccaaauac

SEQ ID NO: 514357 - RNA, 13 nt, Homo sapiens
ccuaaaauacuua

SEQ ID NO: 514358 - RNA, 13 nt, Homo sapiens
ccuaagaguggag

SEQ ID NO: 514359 - RNA, 21 nt, Homo sapiens
ccuagaagcccucugagcucc

SEQ ID NO: 514360 - RNA, 20 nt, Homo sapiens
ccuagacucuaaaacuauca

SEQ ID NO: 514361 - RNA, 14 nt, Homo sapiens
ccuaucaucaguua

SEQ ID NO: 514362 - RNA, 18 nt, Homo sapiens
ccuauuuuggacguguga

SEQ ID NO: 514363 - RNA, 18 nt, Homo sapiens
ccucaagccaggagaccc

SEQ ID NO: 514364 - RNA, 15 nt, Homo sapiens
ccucaggacccaggg

SEQ ID NO: 514365 - RNA, 13 nt, Homo sapiens
ccucagggaccaa

SEQ ID NO: 514366 - RNA, 18 nt, Homo sapiens
ccucauguauacuucaag

SEQ ID NO: 514367 - RNA, 20 nt, Homo sapiens
ccucauuguucagaaaagca

SEQ ID NO: 514368 - RNA, 10 nt, Homo sapiens
ccuccagacc

SEQ ID NO: 514369 - RNA, 19 nt, Homo sapiens
ccuccaguuuuagguccuu

SEQ ID NO: 514370 - RNA, 14 nt, Homo sapiens
ccuccccauggugc

SEQ ID NO: 514371 - RNA, 20 nt, Homo sapiens
ccucccccaccuucaagcac

SEQ ID NO: 514372 - RNA, 13 nt, Homo sapiens
ccuccgacuucuc

SEQ ID NO: 514373 - RNA, 22 nt, Homo sapiens
ccucgccccagccaagccugac

SEQ ID NO: 514374 - RNA, 14 nt, Homo sapiens
ccucuacuugggag

SEQ ID NO: 514375 - RNA, 17 nt, Homo sapiens
ccucuaucccuggccac

SEQ ID NO: 514376 - RNA, 22 nt, Homo sapiens
ccucucugaacugcaacacugg

SEQ ID NO: 514377 - RNA, 14 nt, Homo sapiens
ccucugcagccuga

SEQ ID NO: 514378 - RNA, 17 nt, Homo sapiens
ccucugcugcuuuccaa

SEQ ID NO: 514379 - RNA, 16 nt, Homo sapiens
ccucugggugacaaaa

SEQ ID NO: 514380 - RNA, 19 nt, Homo sapiens
ccucuucuuauucaugcuu

SEQ ID NO: 514381 - RNA, 23 nt, Homo sapiens
ccucuugaaugcuuaaaugauca

SEQ ID NO: 514382 - RNA, 18 nt, Homo sapiens
ccucuugcucagagcuag

SEQ ID NO: 514383 - RNA, 22 nt, Homo sapiens
ccucuuucuuucuuuuguguug

SEQ ID NO: 514384 - RNA, 16 nt, Homo sapiens
ccugacacugucugcu

SEQ ID NO: 514385 - RNA, 11 nt, Homo sapiens
ccugacugugg

SEQ ID NO: 514386 - RNA, 23 nt, Homo sapiens
ccugauggccaggccucagggac

SEQ ID NO: 514387 - RNA, 22 nt, Homo sapiens
ccugaugucuugguuuccauca

SEQ ID NO: 514388 - RNA, 15 nt, Homo sapiens
ccugccaguguuuag

SEQ ID NO: 514389 - RNA, 20 nt, Homo sapiens
ccugcucagcccauccccug

SEQ ID NO: 514390 - RNA, 14 nt, Homo sapiens
ccugcuccugccca

SEQ ID NO: 514391 - RNA, 21 nt, Homo sapiens
ccugcuguucgugacucagaa

SEQ ID NO: 514392 - RNA, 14 nt, Homo sapiens
ccuggaaggcagcu

SEQ ID NO: 514393 - RNA, 21 nt, Homo sapiens
ccuggcgggcagccccugcug

SEQ ID NO: 514394 - RNA, 18 nt, Homo sapiens
ccuguaggucuaugaugu

SEQ ID NO: 514395 - RNA, 15 nt, Homo sapiens
ccuguccagcaggua

SEQ ID NO: 514396 - RNA, 23 nt, Homo sapiens
ccuguccagcagguaguggguga

SEQ ID NO: 514397 - RNA, 17 nt, Homo sapiens
ccugucuccucugucag

SEQ ID NO: 514398 - RNA, 13 nt, Homo sapiens
ccugugacuaugg

SEQ ID NO: 514399 - RNA, 14 nt, Homo sapiens
ccuguucuucuauc

SEQ ID NO: 514400 - RNA, 12 nt, Homo sapiens
ccuguugaauaa

SEQ ID NO: 514401 - RNA, 17 nt, Homo sapiens
ccuuagaauacuguauu

SEQ ID NO: 514402 - RNA, 12 nt, Homo sapiens
ccuucaaauaca

SEQ ID NO: 514403 - RNA, 23 nt, Homo sapiens
ccuucaaugcaaaauacaugaug

SEQ ID NO: 514404 - RNA, 15 nt, Homo sapiens
ccuucacauaguuuu

SEQ ID NO: 514405 - RNA, 20 nt, Homo sapiens
ccuucccugacacugucugc

SEQ ID NO: 514406 - RNA, 20 nt, Homo sapiens
ccuucgguuguaaguagcca

SEQ ID NO: 514407 - RNA, 16 nt, Homo sapiens
ccuucuccacagggac

SEQ ID NO: 514408 - RNA, 21 nt, Homo sapiens
ccuucuggcugcugcagucag

SEQ ID NO: 514409 - RNA, 21 nt, Homo sapiens
ccuugcauuuuagcuaauuua

SEQ ID NO: 514410 - RNA, 21 nt, Homo sapiens
ccuuggagaggagaguggcag

SEQ ID NO: 514411 - RNA, 14 nt, Homo sapiens
ccuugucuaaagau

SEQ ID NO: 514412 - RNA, 20 nt, Homo sapiens
ccuuuaauaggcuuguguaa

SEQ ID NO: 514413 - RNA, 11 nt, Homo sapiens
ccuuuccccau

SEQ ID NO: 514414 - RNA, 18 nt, Homo sapiens
ccuuugcgcucuggguuu

SEQ ID NO: 514415 - RNA, 15 nt, Homo sapiens
ccuuuuucuaccuuu

SEQ ID NO: 514416 - RNA, 18 nt, Homo sapiens
ccuuuuucuucugugaau

SEQ ID NO: 514417 - RNA, 17 nt, Homo sapiens
cgaagccaguccagaag

SEQ ID NO: 514418 - RNA, 20 nt, Homo sapiens
cgacuuucuuuaacauauca

SEQ ID NO: 514419 - RNA, 20 nt, Homo sapiens
cgaggagcuuccagugcaug

SEQ ID NO: 514420 - RNA, 18 nt, Homo sapiens
cgauccuuguagacgcac

SEQ ID NO: 514421 - RNA, 19 nt, Homo sapiens
cgcacugggcauuggguaa

SEQ ID NO: 514422 - RNA, 15 nt, Homo sapiens
cgccccggacugccu

SEQ ID NO: 514423 - RNA, 22 nt, Homo sapiens
cgcgccccuguccauccgucuc

SEQ ID NO: 514424 - RNA, 17 nt, Homo sapiens
cggaaagccuuccucaa

SEQ ID NO: 514425 - RNA, 16 nt, Homo sapiens
cggacgccccccggcc

SEQ ID NO: 514426 - RNA, 20 nt, Homo sapiens
cuacuaaaacuauggagaaa

SEQ ID NO: 514427 - RNA, 16 nt, Homo sapiens
cuagagcuaugcacac

SEQ ID NO: 514428 - RNA, 21 nt, Homo sapiens
cuaggagguuccggugucugg

SEQ ID NO: 514429 - RNA, 15 nt, Homo sapiens
cuaggcugagucuag

SEQ ID NO: 514430 - RNA, 18 nt, Homo sapiens
cuaggugcccagucuuga

SEQ ID NO: 514431 - RNA, 17 nt, Homo sapiens
cuaguaacaguauuucc

SEQ ID NO: 514432 - RNA, 22 nt, Homo sapiens
cuaguaccuuuuuuuagaaaca

SEQ ID NO: 514433 - RNA, 22 nt, Homo sapiens
cuaguaggucugcacacauaac

SEQ ID NO: 514434 - RNA, 23 nt, Homo sapiens
cuaguaggucugcacacauaaca

SEQ ID NO: 514435 - RNA, 21 nt, Homo sapiens
cuagucaugugccuugaacau

SEQ ID NO: 514436 - RNA, 23 nt, Homo sapiens
cuaguugccguggcaacugugga

SEQ ID NO: 514437 - RNA, 12 nt, Homo sapiens
cuaguuuuccag

SEQ ID NO: 514438 - RNA, 18 nt, Homo sapiens
cuauaagagacaaaguuu

SEQ ID NO: 514439 - RNA, 13 nt, Homo sapiens
cuauaauugagaa

SEQ ID NO: 514440 - RNA, 15 nt, Homo sapiens
cuauaccaccuucaa

SEQ ID NO: 514441 - RNA, 19 nt, Homo sapiens
cuauaccaccuucaauauc

SEQ ID NO: 514442 - RNA, 21 nt, Homo sapiens
cuauccccggacgcaugcagg

SEQ ID NO: 514443 - RNA, 15 nt, Homo sapiens
cuaucuuaggaguaa

SEQ ID NO: 514444 - RNA, 23 nt, Homo sapiens
cuaugcugugugcagaguauaca

SEQ ID NO: 514445 - RNA, 16 nt, Homo sapiens
cuauggacaauuuacc

SEQ ID NO: 514446 - RNA, 12 nt, Homo sapiens
cuaugucuguga

SEQ ID NO: 514447 - RNA, 16 nt, Homo sapiens
cuauuuaaguggacug

SEQ ID NO: 514448 - RNA, 17 nt, Homo sapiens
cuauuuguuucauuaaa

SEQ ID NO: 514449 - RNA, 16 nt, Homo sapiens
cuauuuuggacgugug

SEQ ID NO: 514450 - RNA, 20 nt, Homo sapiens
cucaaaaugugccgucuuug

SEQ ID NO: 514451 - RNA, 23 nt, Homo sapiens
cucaaaucugcuuucauccagcc

SEQ ID NO: 514452 - RNA, 17 nt, Homo sapiens
cucaacccugugaucua

SEQ ID NO: 514453 - RNA, 16 nt, Homo sapiens
cucaacuuacauaugu

SEQ ID NO: 514454 - RNA, 12 nt, Homo sapiens
cucaagauccug

SEQ ID NO: 514455 - RNA, 14 nt, Homo sapiens
cucaauacccacug

SEQ ID NO: 514456 - RNA, 17 nt, Homo sapiens
cucacagggacucucca

SEQ ID NO: 514457 - RNA, 16 nt, Homo sapiens
cucaccugaauaaggg

SEQ ID NO: 514458 - RNA, 20 nt, Homo sapiens
cucacugguuuucaauacca

SEQ ID NO: 514459 - RNA, 21 nt, Homo sapiens
cucacuugcuuuaguuguuaa

SEQ ID NO: 514460 - RNA, 19 nt, Homo sapiens
cucagcaaucacaagccaa

SEQ ID NO: 514461 - RNA, 14 nt, Homo sapiens
cucagcaauggcag

SEQ ID NO: 514462 - RNA, 15 nt, Homo sapiens
cucagcauuguguac

SEQ ID NO: 514463 - RNA, 17 nt, Homo sapiens
cucagccccucagagaa

SEQ ID NO: 514464 - RNA, 17 nt, Homo sapiens
cucaggacccagggaau

SEQ ID NO: 514465 - RNA, 16 nt, Homo sapiens
cucaggcagugcaaua

SEQ ID NO: 514466 - RNA, 15 nt, Homo sapiens
cucaggcagugcagu

SEQ ID NO: 514467 - RNA, 16 nt, Homo sapiens
cucaggcagugcagua

SEQ ID NO: 514468 - RNA, 12 nt, Homo sapiens
cucagggaccaa

SEQ ID NO: 514469 - RNA, 19 nt, Homo sapiens
cucaguaaaucagugcagu

SEQ ID NO: 514470 - RNA, 23 nt, Homo sapiens
cucaguaaaucagugcaguacuc

SEQ ID NO: 514471 - RNA, 17 nt, Homo sapiens
cucaguaacacagugca

SEQ ID NO: 514472 - RNA, 15 nt, Homo sapiens
cucaguaacagugca

SEQ ID NO: 514473 - RNA, 20 nt, Homo sapiens
cucauacagugguauugcua

SEQ ID NO: 514474 - RNA, 13 nt, Homo sapiens
cucauagcacaug

SEQ ID NO: 514475 - RNA, 16 nt, Homo sapiens
cucauccuccacugaa

SEQ ID NO: 514476 - RNA, 18 nt, Homo sapiens
cucaugcauagacaagug

SEQ ID NO: 514477 - RNA, 16 nt, Homo sapiens
cucauggaucugcaua

SEQ ID NO: 514478 - RNA, 15 nt, Homo sapiens
cucauguauacuuca

SEQ ID NO: 514479 - RNA, 15 nt, Homo sapiens
cuccaagguggcaua

SEQ ID NO: 514480 - RNA, 13 nt, Homo sapiens
cuccauuccugag

SEQ ID NO: 514481 - RNA, 17 nt, Homo sapiens
cucccaaacuccaagac

SEQ ID NO: 514482 - RNA, 13 nt, Homo sapiens
cucccaagcacuu

SEQ ID NO: 514483 - RNA, 16 nt, Homo sapiens
cuccucccaagcacuu

SEQ ID NO: 514484 - RNA, 19 nt, Homo sapiens
cuccucgguggcauuugcu

SEQ ID NO: 514485 - RNA, 16 nt, Homo sapiens
cuccuugaggucuuga

SEQ ID NO: 514486 - RNA, 16 nt, Homo sapiens
cuccuuguacuugaau

SEQ ID NO: 514487 - RNA, 15 nt, Homo sapiens
cucuaaaacuaucag

SEQ ID NO: 514488 - RNA, 21 nt, Homo sapiens
cucuaagaaauggcuuuccac

SEQ ID NO: 514489 - RNA, 13 nt, Homo sapiens
cucuagacaucua

SEQ ID NO: 514490 - RNA, 12 nt, Homo sapiens
cucuaguuccau

SEQ ID NO: 514491 - RNA, 11 nt, Homo sapiens
cucuccaugau

SEQ ID NO: 514492 - RNA, 22 nt, Homo sapiens
cucucuuucuuuugugcauaug

SEQ ID NO: 514493 - RNA, 23 nt, Homo sapiens
cucucuuuugguuugugggucca

SEQ ID NO: 514494 - RNA, 18 nt, Homo sapiens
cucugagcagacagggcg

SEQ ID NO: 514495 - RNA, 16 nt, Homo sapiens
cucugcaaaaugucau

SEQ ID NO: 514496 - RNA, 17 nt, Homo sapiens
cucugcucaucuacaca

SEQ ID NO: 514497 - RNA, 17 nt, Homo sapiens
cucuguuuaggugccuc

SEQ ID NO: 514498 - RNA, 20 nt, Homo sapiens
cucuuaaguacugaaauaca

SEQ ID NO: 514499 - RNA, 18 nt, Homo sapiens
cucuuaaugucucaaaau

SEQ ID NO: 514500 - RNA, 20 nt, Homo sapiens
cucuucaugcgcagucccca

SEQ ID NO: 514501 - RNA, 17 nt, Homo sapiens
cucuugaagaacugacu

SEQ ID NO: 514502 - RNA, 11 nt, Homo sapiens
cucuuucacaa

SEQ ID NO: 514503 - RNA, 19 nt, Homo sapiens
cucuuuccccagcugauua

SEQ ID NO: 514504 - RNA, 21 nt, Homo sapiens
cugaaagacaguaaagaccau

SEQ ID NO: 514505 - RNA, 16 nt, Homo sapiens
cugaaagauacagggg

SEQ ID NO: 514506 - RNA, 16 nt, Homo sapiens
cugaaauaaaagccuc

SEQ ID NO: 514507 - RNA, 12 nt, Homo sapiens
cugaaccagaga

SEQ ID NO: 514508 - RNA, 15 nt, Homo sapiens
cugaagcagagucaa

SEQ ID NO: 514509 - RNA, 19 nt, Homo sapiens
cugaauuuggggcuacuua

SEQ ID NO: 514510 - RNA, 14 nt, Homo sapiens
cugacuuccugaac

SEQ ID NO: 514511 - RNA, 20 nt, Homo sapiens
cugagaugggacaggaucaa

SEQ ID NO: 514512 - RNA, 20 nt, Homo sapiens
cugaggaggaggacacagca

SEQ ID NO: 514513 - RNA, 20 nt, Homo sapiens
cugagugaaauauuacucug

SEQ ID NO: 514514 - RNA, 14 nt, Homo sapiens
cugaguggcugaaa

SEQ ID NO: 514515 - RNA, 13 nt, Homo sapiens
cugagugugcaga

SEQ ID NO: 514516 - RNA, 21 nt, Homo sapiens
cugauaacucuguacgaggcu

SEQ ID NO: 514517 - RNA, 12 nt, Homo sapiens
cugaucauucac

SEQ ID NO: 514518 - RNA, 16 nt, Homo sapiens
cugauggugcaaugac

SEQ ID NO: 514519 - RNA, 17 nt, Homo sapiens
ugcucaauaaggcagug

SEQ ID NO: 514520 - RNA, 21 nt, Homo sapiens
ugcucagccuuccaugcugug

SEQ ID NO: 514521 - RNA, 21 nt, Homo sapiens
ugcucaguaacacagugcagu

SEQ ID NO: 514522 - RNA, 14 nt, Homo sapiens
ugcucucugcucac

SEQ ID NO: 514523 - RNA, 14 nt, Homo sapiens
ugcugaaugaagcu

SEQ ID NO: 514524 - RNA, 23 nt, Homo sapiens
ugcugauuuuuuuucugauaaau

SEQ ID NO: 514525 - RNA, 14 nt, Homo sapiens
ugcuguugauucuu

SEQ ID NO: 514526 - RNA, 17 nt, Homo sapiens
ugcuucuuuccucuuaa

SEQ ID NO: 514527 - RNA, 19 nt, Homo sapiens
ugcuugguccgacaugccu

SEQ ID NO: 514528 - RNA, 12 nt, Homo sapiens
ugcuuuccaaca

SEQ ID NO: 514529 - RNA, 19 nt, Homo sapiens
ugcuuucugauacaucugu

SEQ ID NO: 514530 - RNA, 18 nt, Homo sapiens
ugcuuuggggcuuaucag

SEQ ID NO: 514531 - RNA, 14 nt, Homo sapiens
uggaagacaaauac

SEQ ID NO: 514532 - RNA, 21 nt, Homo sapiens
uggaagagcugcuguauuuga

SEQ ID NO: 514533 - RNA, 14 nt, Homo sapiens
uggaaucacagcca

SEQ ID NO: 514534 - RNA, 15 nt, Homo sapiens
uggaaucacagccaa

SEQ ID NO: 514535 - RNA, 15 nt, Homo sapiens
uggacgcaugcaggg

SEQ ID NO: 514536 - RNA, 13 nt, Homo sapiens
uggacuacacaca

SEQ ID NO: 514537 - RNA, 19 nt, Homo sapiens
uggagagagcaaucuugcu

SEQ ID NO: 514538 - RNA, 19 nt, Homo sapiens
uggagagcagcaggugcug

SEQ ID NO: 514539 - RNA, 22 nt, Homo sapiens
uggaggaaauguguauuaccaa

SEQ ID NO: 514540 - RNA, 13 nt, Homo sapiens
uggaggcugcugc

SEQ ID NO: 514541 - RNA, 19 nt, Homo sapiens
uggagucagggcugugcuu

SEQ ID NO: 514542 - RNA, 20 nt, Homo sapiens
uggagucagggcugugcuuu

SEQ ID NO: 514543 - RNA, 13 nt, Homo sapiens
uggagugcagugg

SEQ ID NO: 514544 - RNA, 13 nt, Homo sapiens
uggcaaacauuua

SEQ ID NO: 514545 - RNA, 22 nt, Homo sapiens
uggcaaaugaauuuaucauuuu

SEQ ID NO: 514546 - RNA, 19 nt, Homo sapiens
uggcacaugauaugaguca

SEQ ID NO: 514547 - RNA, 18 nt, Homo sapiens
uggcagcaugcgauguca

SEQ ID NO: 514548 - RNA, 14 nt, Homo sapiens
uggcauuugcugaa

SEQ ID NO: 514549 - RNA, 22 nt, Homo sapiens
uggccaggccucagggaccaag

SEQ ID NO: 514550 - RNA, 12 nt, Homo sapiens
uggcccuguuaa

SEQ ID NO: 514551 - RNA, 21 nt, Homo sapiens
uggccuauuuuggacguguga

SEQ ID NO: 514552 - RNA, 16 nt, Homo sapiens
uggccucaggcauuug

SEQ ID NO: 514553 - RNA, 19 nt, Homo sapiens
uggcgcugucgguguuugg

SEQ ID NO: 514554 - RNA, 16 nt, Homo sapiens
uggcuaccucuguccc

SEQ ID NO: 514555 - RNA, 22 nt, Homo sapiens
ugggaauugcaugccaucucca

SEQ ID NO: 514556 - RNA, 12 nt, Homo sapiens
ugggcaggguga

SEQ ID NO: 514557 - RNA, 20 nt, Homo sapiens
ugggccaagccaggguucca

SEQ ID NO: 514558 - RNA, 14 nt, Homo sapiens
cucguguuucacag

SEQ ID NO: 514559 - RNA, 17 nt, Homo sapiens
cucguguuucacagugg

SEQ ID NO: 514560 - RNA, 18 nt, Homo sapiens
cucuaaaacagcacuauc

SEQ ID NO: 514561 - RNA, 17 nt, Homo sapiens
cucuagacaucuagucu

SEQ ID NO: 514562 - RNA, 19 nt, Homo sapiens
cucuauuuguucagaucuc

SEQ ID NO: 514563 - RNA, 21 nt, Homo sapiens
cucuauuuguucagaucucau

SEQ ID NO: 514564 - RNA, 21 nt, Homo sapiens
cucugagacucgcgacaaugc

SEQ ID NO: 514565 - RNA, 21 nt, Homo sapiens
cucuggcuacgacuugggacg

SEQ ID NO: 514566 - RNA, 10 nt, Homo sapiens
cucuguaacc

SEQ ID NO: 514567 - RNA, 16 nt, Homo sapiens
cucuguccacucugaa

SEQ ID NO: 514568 - RNA, 18 nt, Homo sapiens
cucuguccacucugaaua

SEQ ID NO: 514569 - RNA, 15 nt, Homo sapiens
cucuucuuacuguau

SEQ ID NO: 514570 - RNA, 21 nt, Homo sapiens
cucuuuaccauagcuuaagaa

SEQ ID NO: 514571 - RNA, 20 nt, Homo sapiens
cugaaauauuuucuacuuua

SEQ ID NO: 514572 - RNA, 14 nt, Homo sapiens
cugaaauuaguguu

SEQ ID NO: 514573 - RNA, 17 nt, Homo sapiens
cugaaauuggaagacuu

SEQ ID NO: 514574 - RNA, 14 nt, Homo sapiens
cugaacacucaucc

SEQ ID NO: 514575 - RNA, 15 nt, Homo sapiens
cugaacauaguuuuc

SEQ ID NO: 514576 - RNA, 21 nt, Homo sapiens
gacuucuuuacuaacacuggc

SEQ ID NO: 514577 - RNA, 16 nt, Homo sapiens
gagaacagaaauccac

SEQ ID NO: 514578 - RNA, 20 nt, Homo sapiens
gagaagagaguauggugcug

SEQ ID NO: 514579 - RNA, 17 nt, Homo sapiens
gagaauagacaguauga

SEQ ID NO: 514580 - RNA, 16 nt, Homo sapiens
gagagcagccucuuga

SEQ ID NO: 514581 - RNA, 16 nt, Homo sapiens
gagagcgccacccgcc

SEQ ID NO: 514582 - RNA, 16 nt, Homo sapiens
gagauacccucugaga

SEQ ID NO: 514583 - RNA, 13 nt, Homo sapiens
gagaugacaggaa

SEQ ID NO: 514584 - RNA, 22 nt, Homo sapiens
gagauggguugaguuugcugua

SEQ ID NO: 514585 - RNA, 15 nt, Homo sapiens
gagcacaucucuuca

SEQ ID NO: 514586 - RNA, 14 nt, Homo sapiens
gagcagccucuuga

SEQ ID NO: 514587 - RNA, 20 nt, Homo sapiens
gagcaugaagauaaauccaa

SEQ ID NO: 514588 - RNA, 17 nt, Homo sapiens
gagccaagcuaaugugg

SEQ ID NO: 514589 - RNA, 18 nt, Homo sapiens
gagccagcagacauuguc

SEQ ID NO: 514590 - RNA, 19 nt, Homo sapiens
ucacaauaaaagaaacugu

SEQ ID NO: 514591 - RNA, 15 nt, Homo sapiens
ucacaauacagugga

SEQ ID NO: 514592 - RNA, 21 nt, Homo sapiens
ucacaauuuguugaaucucag

SEQ ID NO: 514593 - RNA, 19 nt, Homo sapiens
ucacauuccugacccucac

SEQ ID NO: 514594 - RNA, 17 nt, Homo sapiens
ucaccuaauuaauuuca

SEQ ID NO: 514595 - RNA, 21 nt, Homo sapiens
ucaccucacuuguggcagcuu

SEQ ID NO: 514596 - RNA, 23 nt, Homo sapiens
ucacucaaugccaggcagugcag

SEQ ID NO: 514597 - RNA, 14 nt, Homo sapiens
ucacuccacucccc

SEQ ID NO: 514598 - RNA, 18 nt, Homo sapiens
ucacuuguuuguguuuga

SEQ ID NO: 514599 - RNA, 18 nt, Homo sapiens
ucacuuuuuuccugucaa

SEQ ID NO: 514600 - RNA, 20 nt, Homo sapiens
ucagaacuccuuucuaagga

SEQ ID NO: 514601 - RNA, 12 nt, Homo sapiens
ucagauugaacc

SEQ ID NO: 514602 - RNA, 23 nt, Homo sapiens
ucagccccucagagaaugaucac

SEQ ID NO: 514603 - RNA, 19 nt, Homo sapiens
ucaggaaaggaagauguaa

SEQ ID NO: 514604 - RNA, 18 nt, Homo sapiens
ucaggaaauaucugugaa

SEQ ID NO: 514605 - RNA, 21 nt, Homo sapiens
ucaggacccagggaaugccag

SEQ ID NO: 514606 - RNA, 17 nt, Homo sapiens
ucaggagaaaccccuga

SEQ ID NO: 514607 - RNA, 15 nt, Homo sapiens
ucaggagaaacucgg

SEQ ID NO: 514608 - RNA, 17 nt, Homo sapiens
ucaggagcacagccaua

SEQ ID NO: 514609 - RNA, 15 nt, Homo sapiens
ucaggcagugcagua

SEQ ID NO: 514610 - RNA, 13 nt, Homo sapiens
ucaggccauucag

SEQ ID NO: 514611 - RNA, 16 nt, Homo sapiens
ucaggcucugaaucuc

SEQ ID NO: 514612 - RNA, 20 nt, Homo sapiens
ucagggcaagcucauagcac

SEQ ID NO: 514613 - RNA, 19 nt, Homo sapiens
ucaguaaaucagugcagua

SEQ ID NO: 514614 - RNA, 21 nt, Homo sapiens
ucaguaacacaauacaguacu

SEQ ID NO: 514615 - RNA, 15 nt, Homo sapiens
ucaguaacagugcag

SEQ ID NO: 514616 - RNA, 16 nt, Homo sapiens
ucaguaacagugcagu

SEQ ID NO: 514617 - RNA, 21 nt, Homo sapiens
ucaguaacagugcaguacuca

SEQ ID NO: 514618 - RNA, 21 nt, Homo sapiens
ucaguaacaguguaguacuca

SEQ ID NO: 514619 - RNA, 17 nt, Homo sapiens
ucaguaaggcagugcag

SEQ ID NO: 514620 - RNA, 18 nt, Homo sapiens
ucaguaaggcagugcagu

SEQ ID NO: 514621 - RNA, 21 nt, Homo sapiens
ucaguaauacaauacaguacu

SEQ ID NO: 514622 - RNA, 18 nt, Homo sapiens
ucaguagugccugugauc

SEQ ID NO: 514623 - RNA, 15 nt, Homo sapiens
ucaguauugagacac

SEQ ID NO: 514624 - RNA, 22 nt, Homo sapiens
ucaguccacccccauugugaau

SEQ ID NO: 514625 - RNA, 21 nt, Homo sapiens
ucagugaaggaagaaccugua

SEQ ID NO: 514626 - RNA, 12 nt, Homo sapiens
ucagugcaguac

SEQ ID NO: 514627 - RNA, 17 nt, Homo sapiens
ucaguuaggcagugcag

SEQ ID NO: 514628 - RNA, 13 nt, Homo sapiens
ucauaaacaaaga

SEQ ID NO: 514629 - RNA, 15 nt, Homo sapiens
ucaucagaaacaauu

SEQ ID NO: 514630 - RNA, 19 nt, Homo sapiens
ucaucccccaucagaugau

SEQ ID NO: 514631 - RNA, 15 nt, Homo sapiens
ucauccuccacugaa

SEQ ID NO: 514632 - RNA, 19 nt, Homo sapiens
ucauccugccuucauggaa

SEQ ID NO: 514633 - RNA, 18 nt, Homo sapiens
ucaucucagcaaucacaa

SEQ ID NO: 514634 - RNA, 22 nt, Homo sapiens
ucaucuuguaaauaaugcuuaa

SEQ ID NO: 514635 - RNA, 16 nt, Homo sapiens
ucaugcuucuacucca

SEQ ID NO: 514636 - RNA, 19 nt, Homo sapiens
ucaugugccuugaacauau

SEQ ID NO: 514637 - RNA, 13 nt, Homo sapiens
ucauguucauuca

SEQ ID NO: 514638 - RNA, 19 nt, Homo sapiens
ucauguuucugcaguauuc

SEQ ID NO: 514639 - RNA, 13 nt, Homo sapiens
ucauuagcuguga

SEQ ID NO: 514640 - RNA, 14 nt, Homo sapiens
ucauuagcugugau

SEQ ID NO: 514641 - RNA, 16 nt, Homo sapiens
ucauucaaaaagccaa

SEQ ID NO: 514642 - RNA, 17 nt, Homo sapiens
ucauucagaaugugcaa

SEQ ID NO: 514643 - RNA, 16 nt, Homo sapiens
ucauuccaaguguaua

SEQ ID NO: 514644 - RNA, 21 nt, Homo sapiens
ucauuucauacaaauuuuccc

SEQ ID NO: 514645 - RNA, 18 nt, Homo sapiens
uccaaaauaucgagugaa

SEQ ID NO: 514646 - RNA, 14 nt, Homo sapiens
uccaaaguuaucca

SEQ ID NO: 514647 - RNA, 16 nt, Homo sapiens
uccaacagaaagcaua

SEQ ID NO: 514648 - RNA, 18 nt, Homo sapiens
uccaacucugacuguaaa

SEQ ID NO: 514649 - RNA, 22 nt, Homo sapiens
uccaagugaaugaguuuccagc

SEQ ID NO: 514650 - RNA, 18 nt, Homo sapiens
uccaaugccaauucaucu

SEQ ID NO: 514651 - RNA, 17 nt, Homo sapiens
uccacaguuaggccaag

SEQ ID NO: 514652 - RNA, 21 nt, Homo sapiens
uccacaucaaaaaugcaucaa

SEQ ID NO: 514653 - RNA, 18 nt, Homo sapiens
uccacgugggguggaauu

SEQ ID NO: 514654 - RNA, 13 nt, Homo sapiens
uccacuccuccca

SEQ ID NO: 514655 - RNA, 19 nt, Homo sapiens
uccagaguaggugggucuu

SEQ ID NO: 514656 - RNA, 19 nt, Homo sapiens
uccagaugugccuagacac

SEQ ID NO: 514657 - RNA, 19 nt, Homo sapiens
uccagcggggcuucugggc

SEQ ID NO: 514658 - RNA, 18 nt, Homo sapiens
uccagcuaagccugauga

SEQ ID NO: 514659 - RNA, 18 nt, Homo sapiens
uccaggguuaaagaaagg

SEQ ID NO: 514660 - RNA, 21 nt, Homo sapiens
uccagugacauuggaacaugc

SEQ ID NO: 514661 - RNA, 14 nt, Homo sapiens
uccaguucugauga

SEQ ID NO: 514662 - RNA, 23 nt, Homo sapiens
uccaugacaguagcauacugaug

SEQ ID NO: 514663 - RNA, 20 nt, Homo sapiens
uccaugauuauuaguugacc

SEQ ID NO: 514664 - RNA, 16 nt, Homo sapiens
ucccaaaucucaaaag

SEQ ID NO: 514665 - RNA, 14 nt, Homo sapiens
ucccacacugugaa

SEQ ID NO: 514666 - RNA, 22 nt, Homo sapiens
ucccacuggaggcaugugauga

SEQ ID NO: 514667 - RNA, 14 nt, Homo sapiens
uccccaauuauccu

SEQ ID NO: 514668 - RNA, 23 nt, Homo sapiens
uccccaugcugggcucacuacau

SEQ ID NO: 514669 - RNA, 21 nt, Homo sapiens
uccccucauccacuaggugcc

SEQ ID NO: 514670 - RNA, 21 nt, Homo sapiens
ucccgguguaugcagugguga

SEQ ID NO: 514671 - RNA, 13 nt, Homo sapiens
ucccuaaguccac

SEQ ID NO: 514672 - RNA, 23 nt, Homo sapiens
ucccucgggcuggugucuugaga

SEQ ID NO: 514673 - RNA, 14 nt, Homo sapiens
ucccugaacacuca

SEQ ID NO: 514674 - RNA, 14 nt, Homo sapiens
ucccugacacuguc

SEQ ID NO: 514675 - RNA, 12 nt, Homo sapiens
ucccugcaguaa

SEQ ID NO: 514676 - RNA, 13 nt, Homo sapiens
ucccugcugccag

SEQ ID NO: 514677 - RNA, 17 nt, Homo sapiens
ucccuuuaucauguguu

SEQ ID NO: 514678 - RNA, 20 nt, Homo sapiens
ucccuuuaucauguguuucu

SEQ ID NO: 514679 - RNA, 20 nt, Homo sapiens
ucccuuuuuaaacaaauggc

SEQ ID NO: 514680 - RNA, 20 nt, Homo sapiens
uccggaaagccuuccucaag

SEQ ID NO: 514681 - RNA, 19 nt, Homo sapiens
uccuagccucuccgcccac

SEQ ID NO: 514682 - RNA, 22 nt, Homo sapiens
uccuauccccggacgcaugcag

SEQ ID NO: 514683 - RNA, 16 nt, Homo sapiens
uccucaauuccaggga

SEQ ID NO: 514684 - RNA, 22 nt, Homo sapiens
uccucccccaccuucaagcacc

SEQ ID NO: 514685 - RNA, 14 nt, Homo sapiens
uccuccuucacucc

SEQ ID NO: 514686 - RNA, 15 nt, Homo sapiens
uccucugcagccuga

SEQ ID NO: 514687 - RNA, 15 nt, Homo sapiens
uccucugcuugucau

SEQ ID NO: 514688 - RNA, 23 nt, Homo sapiens
uccucuuaccuguaauagccuca

SEQ ID NO: 514689 - RNA, 17 nt, Homo sapiens
uccugaacucccaguca

SEQ ID NO: 514690 - RNA, 13 nt, Homo sapiens
uccugcacugucc

SEQ ID NO: 514691 - RNA, 15 nt, Homo sapiens
uccugccuucaugga

SEQ ID NO: 514692 - RNA, 23 nt, Homo sapiens
uccugcugcucgggaaggccuga

SEQ ID NO: 514693 - RNA, 23 nt, Homo sapiens
uccugcuugguuuagcugugcag

SEQ ID NO: 514694 - RNA, 21 nt, Homo sapiens
uccuggcccucuucuuauuca

SEQ ID NO: 514695 - RNA, 17 nt, Homo sapiens
uccuuaaaaaauaugcu

SEQ ID NO: 514696 - RNA, 19 nt, Homo sapiens
uccuucaugcuuuucucau

SEQ ID NO: 514697 - RNA, 24 nt, Homo sapiens
uccuuccaaccuguucacgugacu

SEQ ID NO: 514698 - RNA, 23 nt, Homo sapiens
uccuucccgcagcaccagccuga

SEQ ID NO: 514699 - RNA, 12 nt, Homo sapiens
ucgagcaaacaa

SEQ ID NO: 514700 - RNA, 22 nt, Homo sapiens
uguaaauaaugcuuaacauaaa

SEQ ID NO: 514701 - RNA, 21 nt, Homo sapiens
uguaaauagagaucaguuugu

SEQ ID NO: 514702 - RNA, 13 nt, Homo sapiens
uucgagcaaacaa

SEQ ID NO: 514703 - RNA, 17 nt, Homo sapiens
uucgcauuaagcacaca

SEQ ID NO: 514704 - RNA, 17 nt, Homo sapiens
uucgugcagugcccuga

SEQ ID NO: 514705 - RNA, 23 nt, Homo sapiens
uucuaaaacuaaauagcauguau

SEQ ID NO: 514706 - RNA, 22 nt, Homo sapiens
uucuaaaggggacagaucuuga

SEQ ID NO: 514707 - RNA, 19 nt, Homo sapiens
uucuaaggagcacuagaau

SEQ ID NO: 514708 - RNA, 16 nt, Homo sapiens
uucuaauccaugugcu

SEQ ID NO: 514709 - RNA, 21 nt, Homo sapiens
uucuacuccauggugaacuga

SEQ ID NO: 514710 - RNA, 19 nt, Homo sapiens
uucuacucuucaaccucua

SEQ ID NO: 514711 - RNA, 22 nt, Homo sapiens
uucuaguggguuuaauguuuag

SEQ ID NO: 514712 - RNA, 20 nt, Homo sapiens
uucuauuagcuuacugauua

SEQ ID NO: 514713 - RNA, 16 nt, Homo sapiens
uucuccuuguacuuga

SEQ ID NO: 514714 - RNA, 19 nt, Homo sapiens
uucucucuguguggcaaac

SEQ ID NO: 514715 - RNA, 15 nt, Homo sapiens
uucugaaauucacaa

SEQ ID NO: 514716 - RNA, 22 nt, Homo sapiens
uucuggugucuaauaaacacag

SEQ ID NO: 514717 - RNA, 16 nt, Homo sapiens
uucuguuaucuagaaa

SEQ ID NO: 514718 - RNA, 13 nt, Homo sapiens
uucuuacuguauu

SEQ ID NO: 514719 - RNA, 18 nt, Homo sapiens
uucuuauaacauuguaug

SEQ ID NO: 514720 - RNA, 18 nt, Homo sapiens
uucuuccaacaugugaug

SEQ ID NO: 514721 - RNA, 12 nt, Homo sapiens
uucuuccuuccu

SEQ ID NO: 514722 - RNA, 17 nt, Homo sapiens
uucuugcagucaucaga

SEQ ID NO: 514723 - RNA, 16 nt, Homo sapiens
uucuuugcugcaagag

SEQ ID NO: 514724 - RNA, 23 nt, Homo sapiens
uugaaaauauaugacuuugaaua

SEQ ID NO: 514725 - RNA, 23 nt, Homo sapiens
uugaaaggagaaaaaaaaagcca

SEQ ID NO: 514726 - RNA, 23 nt, Homo sapiens
uugaaagggacaaguaucaucua

SEQ ID NO: 514727 - RNA, 19 nt, Homo sapiens
uugaaauuauaucuguggu

SEQ ID NO: 514728 - RNA, 13 nt, Homo sapiens
uugaagaacucau

SEQ ID NO: 514729 - RNA, 19 nt, Homo sapiens
uugagacauauuacuggaa

SEQ ID NO: 514730 - RNA, 23 nt, Homo sapiens
uugagcagaacccagacccugag

SEQ ID NO: 514731 - RNA, 13 nt, Homo sapiens
uugagucuggaua

SEQ ID NO: 514732 - RNA, 15 nt, Homo sapiens
uugauguaacugugu

SEQ ID NO: 514733 - RNA, 14 nt, Homo sapiens
uugauuaaaacauu

SEQ ID NO: 514734 - RNA, 21 nt, Homo sapiens
uugcacuaaaagugaugugau

SEQ ID NO: 514735 - RNA, 18 nt, Homo sapiens
uugcauguuuaauaauau

SEQ ID NO: 514736 - RNA, 12 nt, Homo sapiens
uugccaaaacag

SEQ ID NO: 514737 - RNA, 14 nt, Homo sapiens
uugccgcauauuau

SEQ ID NO: 514738 - RNA, 17 nt, Homo sapiens
uugcuacuucccucacc

SEQ ID NO: 514739 - RNA, 13 nt, Homo sapiens
uugcugcauuuca

SEQ ID NO: 514740 - RNA, 22 nt, Homo sapiens
uugcuuagccuuuaauaggcuu

SEQ ID NO: 514741 - RNA, 20 nt, Homo sapiens
uuggagaggagguguggagu

SEQ ID NO: 514742 - RNA, 12 nt, Homo sapiens
uuggagugcagu

SEQ ID NO: 514743 - RNA, 21 nt, Homo sapiens
uuggccuccguucaccccacc

SEQ ID NO: 514744 - RNA, 15 nt, Homo sapiens
uugggaauugcaugc

SEQ ID NO: 514745 - RNA, 17 nt, Homo sapiens
uugggaauugcaugcca

SEQ ID NO: 514746 - RNA, 19 nt, Homo sapiens
uuggguaagggacuccaga

SEQ ID NO: 514747 - RNA, 12 nt, Homo sapiens
uugguacccugg

SEQ ID NO: 514748 - RNA, 19 nt, Homo sapiens
uuggucacugcuacaccuu

SEQ ID NO: 514749 - RNA, 17 nt, Homo sapiens
uuggugacagggucuga

SEQ ID NO: 514750 - RNA, 15 nt, Homo sapiens
uugguguaaaccauu

SEQ ID NO: 514751 - RNA, 13 nt, Homo sapiens
uuguacuugaaua

SEQ ID NO: 514752 - RNA, 18 nt, Homo sapiens
uuguauuuuaauaaagau

SEQ ID NO: 514753 - RNA, 22 nt, Homo sapiens
uuguauuuuaauaaagauucca

SEQ ID NO: 514754 - RNA, 19 nt, Homo sapiens
uugucuaaagcuaaacaaa

SEQ ID NO: 514755 - RNA, 14 nt, Homo sapiens
uugucuggcugugg

SEQ ID NO: 514756 - RNA, 15 nt, Homo sapiens
uugugaugcauuuau

SEQ ID NO: 514757 - RNA, 16 nt, Homo sapiens
uuguguuacaauaagu

SEQ ID NO: 514758 - RNA, 12 nt, Homo sapiens
uuguugcaguuc

SEQ ID NO: 514759 - RNA, 14 nt, Homo sapiens
uuguuuaucuagca

SEQ ID NO: 514760 - RNA, 22 nt, Homo sapiens
uuguuucuuucugugcugguaa

SEQ ID NO: 514761 - RNA, 23 nt, Homo sapiens
uuguuuggucacugcuacaccuu

SEQ ID NO: 514762 - RNA, 13 nt, Homo sapiens
uuguuuuguggau

SEQ ID NO: 514763 - RNA, 15 nt, Homo sapiens
uuuaaaacaugcugu

SEQ ID NO: 514764 - RNA, 22 nt, Homo sapiens
uuuaaacaaaauuuaugucauu

SEQ ID NO: 514765 - RNA, 18 nt, Homo sapiens
uuuaaaugacgcacaaac

SEQ ID NO: 514766 - RNA, 14 nt, Homo sapiens
uuuaacugcuucaa

SEQ ID NO: 514767 - RNA, 15 nt, Homo sapiens
uuuaagugcuaugca

SEQ ID NO: 514768 - RNA, 17 nt, Homo sapiens
uuuaauauacuccuuaa

SEQ ID NO: 514769 - RNA, 13 nt, Homo sapiens
uuuaaucauuucc

SEQ ID NO: 514770 - RNA, 18 nt, Homo sapiens
uuuaauuggcccuguaca

SEQ ID NO: 514771 - RNA, 17 nt, Homo sapiens
uuuaauuuaugauauaa

SEQ ID NO: 514772 - RNA, 23 nt, Homo sapiens
uuuaauuugauaucacagucuaa

SEQ ID NO: 514773 - RNA, 13 nt, Homo sapiens
uuuacauucuugc

SEQ ID NO: 514774 - RNA, 16 nt, Homo sapiens
uuuaccuugcauuuua

SEQ ID NO: 514775 - RNA, 21 nt, Homo sapiens
uuuacuauguaaaugcuugau

SEQ ID NO: 514776 - RNA, 23 nt, Homo sapiens
uuuagaacauggacuacacacaa

SEQ ID NO: 514777 - RNA, 14 nt, Homo sapiens
uuuagaagagccug

SEQ ID NO: 514778 - RNA, 20 nt, Homo sapiens
uuuagcaacacaucuaccaa

SEQ ID NO: 514779 - RNA, 23 nt, Homo sapiens
uuuaggaaugcucaaugugcugu

SEQ ID NO: 514780 - RNA, 19 nt, Homo sapiens
uuuagguaaaaagcuuaaa

SEQ ID NO: 514781 - RNA, 20 nt, Homo sapiens
uuuaguuuaaaaaucagaaa

SEQ ID NO: 514782 - RNA, 17 nt, Homo sapiens
uuuauaaaagacaugaa

SEQ ID NO: 514783 - RNA, 13 nt, Homo sapiens
uuuauacacacag

SEQ ID NO: 514784 - RNA, 15 nt, Homo sapiens
uuuaucaacacuaau

SEQ ID NO: 514785 - RNA, 11 nt, Homo sapiens
uuuaugcauuu

SEQ ID NO: 514786 - RNA, 21 nt, Homo sapiens
uuuauucauuagcugugauuu

SEQ ID NO: 514787 - RNA, 16 nt, Homo sapiens
uuuauuuaaaugucua

SEQ ID NO: 514788 - RNA, 14 nt, Homo sapiens
uuucauaagcacau

SEQ ID NO: 514789 - RNA, 12 nt, Homo sapiens
uuuccaaaagua

SEQ ID NO: 514790 - RNA, 19 nt, Homo sapiens
uuuccaaaaguacuagcaa

SEQ ID NO: 514791 - RNA, 14 nt, Homo sapiens
uuuccaacacacaa

SEQ ID NO: 514792 - RNA, 12 nt, Homo sapiens
uuucccagugaa

SEQ ID NO: 514793 - RNA, 14 nt, Homo sapiens
uuuccccagugugg

SEQ ID NO: 514794 - RNA, 19 nt, Homo sapiens
uuuccccauucagugacau

SEQ ID NO: 514795 - RNA, 20 nt, Homo sapiens
uuuccccauugacccucacc

SEQ ID NO: 514796 - RNA, 18 nt, Homo sapiens
uuuccuaugacacucauc

SEQ ID NO: 514797 - RNA, 21 nt, Homo sapiens
uuucucaaugaaugaacaaau

SEQ ID NO: 514798 - RNA, 13 nt, Homo sapiens
uuucucagcauau

SEQ ID NO: 514799 - RNA, 19 nt, Homo sapiens
uuucucugcaaaaugucau

SEQ ID NO: 514800 - RNA, 18 nt, Homo sapiens
uuucugcuguaaagaaag

SEQ ID NO: 514801 - RNA, 16 nt, Homo sapiens
uuucuuuaacauauca

SEQ ID NO: 514802 - RNA, 19 nt, Homo sapiens
uuucuuuaacauaucauuc

SEQ ID NO: 514803 - RNA, 17 nt, Homo sapiens
uuugcucucucauuccc

SEQ ID NO: 514804 - RNA, 15 nt, Homo sapiens
uuuggccagugacau

SEQ ID NO: 514805 - RNA, 20 nt, Homo sapiens
uuuguaacaccguccaacau

SEQ ID NO: 514806 - RNA, 16 nt, Homo sapiens
uuuuaaacaaauggcu

SEQ ID NO: 514807 - RNA, 21 nt, Homo sapiens
uuuuaacugcuucaaguguua

SEQ ID NO: 514808 - RNA, 18 nt, Homo sapiens
uuuuauucauaagccaau

SEQ ID NO: 514809 - RNA, 16 nt, Homo sapiens
uuuucuaaaacuaaau

SEQ ID NO: 514810 - RNA, 23 nt, Homo sapiens
uuuucucuccuaagacaccugca

SEQ ID NO: 514811 - RNA, 14 nt, Homo sapiens
uuuucuucaccuca

SEQ ID NO: 514812 - RNA, 22 nt, Homo sapiens
uuuugucugcuuaguaucucau

SEQ ID NO: 514813 - RNA, 12 nt, Homo sapiens
uuuuuacauaua

SEQ ID NO: 514814 - RNA, 11 nt, Homo sapiens
uuuuucaauuu

SEQ ID NO: 514815 - RNA, 17 nt, Homo sapiens
aagcauagacgucucag

SEQ ID NO: 514816 - RNA, 18 nt, Homo sapiens
aagcauguacaguguucu

SEQ ID NO: 514817 - RNA, 20 nt, Homo sapiens
aagcauuaaaaauaagccaa

SEQ ID NO: 514818 - RNA, 18 nt, Homo sapiens
aagcauuacccauagguc

SEQ ID NO: 514819 - RNA, 22 nt, Homo sapiens
aagcauuacccauaggucuuaa

SEQ ID NO: 514820 - RNA, 21 nt, Homo sapiens
aagccaggguccugaguggcu

SEQ ID NO: 514821 - RNA, 18 nt, Homo sapiens
aagccaggguuccagaca

SEQ ID NO: 514822 - RNA, 20 nt, Homo sapiens
aagccucuccagagaaguuu

SEQ ID NO: 514823 - RNA, 22 nt, Homo sapiens
aagccucuggcuaccucugucc

SEQ ID NO: 514824 - RNA, 20 nt, Homo sapiens
aagccucugguggaaccugc

SEQ ID NO: 514825 - RNA, 11 nt, Homo sapiens
aagcuacauau

SEQ ID NO: 514826 - RNA, 19 nt, Homo sapiens
aagcuagaugccccugcag

SEQ ID NO: 514827 - RNA, 18 nt, Homo sapiens
aagcucauagcacauguu

SEQ ID NO: 514828 - RNA, 21 nt, Homo sapiens
aagcuccaucuuauuugucag

SEQ ID NO: 514829 - RNA, 15 nt, Homo sapiens
aagcugucacucaca

SEQ ID NO: 514830 - RNA, 16 nt, Homo sapiens
aagcugugacccucaa

SEQ ID NO: 514831 - RNA, 20 nt, Homo sapiens
aagcuuaaacauugccuuau

SEQ ID NO: 514832 - RNA, 14 nt, Homo sapiens
aaggaaagcagugu

SEQ ID NO: 514833 - RNA, 19 nt, Homo sapiens
aaggagcuacugacauucc

SEQ ID NO: 514834 - RNA, 15 nt, Homo sapiens
aaggcagcuagacac

SEQ ID NO: 514835 - RNA, 18 nt, Homo sapiens
aaggcagugcaguacuca

SEQ ID NO: 514836 - RNA, 18 nt, Homo sapiens
aaggcagugcagugcuca

SEQ ID NO: 514837 - RNA, 12 nt, Homo sapiens
aaggcauccacu

SEQ ID NO: 514838 - RNA, 22 nt, Homo sapiens
aaggcccagccuguaacugucc

SEQ ID NO: 514839 - RNA, 15 nt, Homo sapiens
aaggcccuuacaccc

SEQ ID NO: 514840 - RNA, 18 nt, Homo sapiens
aaggccucauccuccacu

SEQ ID NO: 514841 - RNA, 17 nt, Homo sapiens
aagggucauuagacaaa

SEQ ID NO: 514842 - RNA, 22 nt, Homo sapiens
aaggucuugccugaauccauca

SEQ ID NO: 514843 - RNA, 21 nt, Homo sapiens
aagguuguacauaguggucau

SEQ ID NO: 514844 - RNA, 19 nt, Homo sapiens
aaguacugaaauacauaug

SEQ ID NO: 514845 - RNA, 19 nt, Homo sapiens
aagucaaagaagacucagu

SEQ ID NO: 514846 - RNA, 15 nt, Homo sapiens
aagucuccuguauca

SEQ ID NO: 514847 - RNA, 17 nt, Homo sapiens
aagugacuuauuugcuc

SEQ ID NO: 514848 - RNA, 13 nt, Homo sapiens
aaguguacuggau

SEQ ID NO: 514849 - RNA, 15 nt, Homo sapiens
aaguguacuggauuu

SEQ ID NO: 514850 - RNA, 14 nt, Homo sapiens
aaguuaauucucag

SEQ ID NO: 514851 - RNA, 17 nt, Homo sapiens
aaguucauccaacguga

SEQ ID NO: 514852 - RNA, 18 nt, Homo sapiens
aaguuugccccagugcua

SEQ ID NO: 514853 - RNA, 22 nt, Homo sapiens
aaguuuucaccuaucuggaaaa

SEQ ID NO: 514854 - RNA, 14 nt, Homo sapiens
aauaaacucaguca

SEQ ID NO: 514855 - RNA, 17 nt, Homo sapiens
aauaacccugaaucaga

SEQ ID NO: 514856 - RNA, 17 nt, Homo sapiens
aauaauauaaaugaaug

SEQ ID NO: 514857 - RNA, 19 nt, Homo sapiens
aauacauaaaaaagggaca

SEQ ID NO: 514858 - RNA, 19 nt, Homo sapiens
aauacauucuaaaucacuu

SEQ ID NO: 514859 - RNA, 15 nt, Homo sapiens
aauacccuuuuccaa

SEQ ID NO: 514860 - RNA, 20 nt, Homo sapiens
aauacucauccuuguauaaa

SEQ ID NO: 514861 - RNA, 18 nt, Homo sapiens
aauacuuugugucuuuug

SEQ ID NO: 514862 - RNA, 14 nt, Homo sapiens
aauagacaguauga

SEQ ID NO: 514863 - RNA, 19 nt, Homo sapiens
aauagacaguaugacauau

SEQ ID NO: 514864 - RNA, 17 nt, Homo sapiens
aauagagaucaguuugu

SEQ ID NO: 514865 - RNA, 19 nt, Homo sapiens
aauagcgcucccuuuucac

SEQ ID NO: 514866 - RNA, 11 nt, Homo sapiens
aauaggcuugu

SEQ ID NO: 514867 - RNA, 16 nt, Homo sapiens
aauaguuccauucuau

SEQ ID NO: 514868 - RNA, 16 nt, Homo sapiens
aauauaaacugugaga

SEQ ID NO: 514869 - RNA, 21 nt, Homo sapiens
aauauaggguuuguuugcugc

SEQ ID NO: 514870 - RNA, 20 nt, Homo sapiens
aauauccaagcccagccuau

SEQ ID NO: 514871 - RNA, 13 nt, Homo sapiens
aauaucugugaag

SEQ ID NO: 514872 - RNA, 17 nt, Homo sapiens
aauauuuugcugcugaa

SEQ ID NO: 514873 - RNA, 15 nt, Homo sapiens
aaucaaacagggaca

SEQ ID NO: 514874 - RNA, 12 nt, Homo sapiens
aaucaacaguga

SEQ ID NO: 514875 - RNA, 12 nt, Homo sapiens
aaucaauguuca

SEQ ID NO: 514876 - RNA, 17 nt, Homo sapiens
aaucaauguucacgcaa

SEQ ID NO: 514877 - RNA, 17 nt, Homo sapiens
aaucacccugacugugg

SEQ ID NO: 514878 - RNA, 21 nt, Homo sapiens
aaucaguuuccacuacauucg

SEQ ID NO: 514879 - RNA, 20 nt, Homo sapiens
aauccacaguauuguucuug

SEQ ID NO: 514880 - RNA, 15 nt, Homo sapiens
aauccacgcucaauc

SEQ ID NO: 514881 - RNA, 17 nt, Homo sapiens
aaucuuguuccaugccu

SEQ ID NO: 514882 - RNA, 18 nt, Homo sapiens
aaucuuuagaauaguuaa

SEQ ID NO: 514883 - RNA, 20 nt, Homo sapiens
aaugagaaauugugccaaag

SEQ ID NO: 514884 - RNA, 19 nt, Homo sapiens
aaugagucacuuacuucau

SEQ ID NO: 514885 - RNA, 20 nt, Homo sapiens
aaugaguucccuugauucaa

SEQ ID NO: 514886 - RNA, 15 nt, Homo sapiens
aaugauucaauguga

SEQ ID NO: 514887 - RNA, 21 nt, Homo sapiens
aaugauucuugugucaucaag

SEQ ID NO: 514888 - RNA, 21 nt, Homo sapiens
aaugcaaaauacaugaugauu

SEQ ID NO: 514889 - RNA, 15 nt, Homo sapiens
aaugcaaugcucagu

SEQ ID NO: 514890 - RNA, 23 nt, Homo sapiens
aaugcuagacagaaaccaagcca

SEQ ID NO: 514891 - RNA, 15 nt, Homo sapiens
aaugcuauuugugua

SEQ ID NO: 514892 - RNA, 12 nt, Homo sapiens
aauggcaucucg

SEQ ID NO: 514893 - RNA, 17 nt, Homo sapiens
aauggcuuguucaguca

SEQ ID NO: 514894 - RNA, 18 nt, Homo sapiens
aaugggguuguuagcuuu

SEQ ID NO: 514895 - RNA, 18 nt, Homo sapiens
aauguaauauucuuuugu

SEQ ID NO: 514896 - RNA, 23 nt, Homo sapiens
aauguauauugauguaacugugu

SEQ ID NO: 514897 - RNA, 17 nt, Homo sapiens
aauguaucaacauauuu

SEQ ID NO: 514898 - RNA, 16 nt, Homo sapiens
aaugucaauuuaucac

SEQ ID NO: 514899 - RNA, 14 nt, Homo sapiens
aaugucuauauuau

SEQ ID NO: 514900 - RNA, 13 nt, Homo sapiens
aaugucucaaaau

SEQ ID NO: 514901 - RNA, 21 nt, Homo sapiens
aaugugccucucaguaucuua

SEQ ID NO: 514902 - RNA, 19 nt, Homo sapiens
aaugugugaaggucuugcc

SEQ ID NO: 514903 - RNA, 18 nt, Homo sapiens
aauguuccguucaucuga

SEQ ID NO: 514904 - RNA, 18 nt, Homo sapiens
aauguuguccugugucau

SEQ ID NO: 514905 - RNA, 21 nt, Homo sapiens
aauuaaaaaguuaaucuucau

SEQ ID NO: 514906 - RNA, 13 nt, Homo sapiens
aauuaacuaacuc

SEQ ID NO: 514907 - RNA, 19 nt, Homo sapiens
aauuagacauaccucucaa

SEQ ID NO: 514908 - RNA, 17 nt, Homo sapiens
aauuaucaaaaaacaga

SEQ ID NO: 514909 - RNA, 21 nt, Homo sapiens
aauucaugaugcuaguucuua

SEQ ID NO: 514910 - RNA, 19 nt, Homo sapiens
aauucugcuucucuuucac

SEQ ID NO: 514911 - RNA, 14 nt, Homo sapiens
aauucuuacuguuc

SEQ ID NO: 514912 - RNA, 22 nt, Homo sapiens
aauucuuacuguucugaaauua

SEQ ID NO: 514913 - RNA, 19 nt, Homo sapiens
aauugaaccgucaauguga

SEQ ID NO: 514914 - RNA, 22 nt, Homo sapiens
aauugauuuuuaaacagcaggu

SEQ ID NO: 514915 - RNA, 18 nt, Homo sapiens
aauugcucaaagcugucg

SEQ ID NO: 514916 - RNA, 16 nt, Homo sapiens
aauugcuccauuccug

SEQ ID NO: 514917 - RNA, 16 nt, Homo sapiens
aauugucuuuugucau

SEQ ID NO: 514918 - RNA, 12 nt, Homo sapiens
aauugugccaaa

SEQ ID NO: 514919 - RNA, 17 nt, Homo sapiens
aauuuaggaaugcucaa

SEQ ID NO: 514920 - RNA, 21 nt, Homo sapiens
aauuuccuuaaagcaagcuca

SEQ ID NO: 514921 - RNA, 13 nt, Homo sapiens
aauuuuaucucuu

SEQ ID NO: 514922 - RNA, 21 nt, Homo sapiens
aauuuuggaagaauucaugau

SEQ ID NO: 514923 - RNA, 18 nt, Homo sapiens
aauuuuuaacuuaucucc

SEQ ID NO: 514924 - RNA, 16 nt, Homo sapiens
aauuuuuuccuaccau

SEQ ID NO: 514925 - RNA, 14 nt, Homo sapiens
aauuuuuuccugcu

SEQ ID NO: 514926 - RNA, 21 nt, Homo sapiens
aauuuuuuuccagaauugaga

SEQ ID NO: 514927 - RNA, 12 nt, Homo sapiens
acaaauacacau

SEQ ID NO: 514928 - RNA, 22 nt, Homo sapiens
acaaauauugugaugcauuuau

SEQ ID NO: 514929 - RNA, 21 nt, Homo sapiens
acaaauccaacgcuuuuccca

SEQ ID NO: 514930 - RNA, 20 nt, Homo sapiens
acaaauggcuuguucaguca

SEQ ID NO: 514931 - RNA, 21 nt, Homo sapiens
caaaacaacagcaacaacaac

SEQ ID NO: 514932 - RNA, 14 nt, Homo sapiens
caaaauccuugccu

SEQ ID NO: 514933 - RNA, 17 nt, Homo sapiens
caaaaugaauugccuuu

SEQ ID NO: 514934 - RNA, 16 nt, Homo sapiens
caaacacacagacucu

SEQ ID NO: 514935 - RNA, 22 nt, Homo sapiens
caaacuuuuccuggacacuuua

SEQ ID NO: 514936 - RNA, 14 nt, Homo sapiens
caaagcaugcucag

SEQ ID NO: 514937 - RNA, 22 nt, Homo sapiens
caaaggugccucauagcauagc

SEQ ID NO: 514938 - RNA, 16 nt, Homo sapiens
caaaguuaaacgugau

SEQ ID NO: 514939 - RNA, 22 nt, Homo sapiens
caaauaagcaucuguguaaccu

SEQ ID NO: 514940 - RNA, 17 nt, Homo sapiens
caaauaauauugccuug

SEQ ID NO: 514941 - RNA, 22 nt, Homo sapiens
caaauagggcaaagaaucaaca

SEQ ID NO: 514942 - RNA, 16 nt, Homo sapiens
caaauauugcuauugu

SEQ ID NO: 514943 - RNA, 15 nt, Homo sapiens
caaaugucauuucau

SEQ ID NO: 514944 - RNA, 21 nt, Homo sapiens
caacaaagcagaagacuccuc

SEQ ID NO: 514945 - RNA, 16 nt, Homo sapiens
caacagugaacagcuu

SEQ ID NO: 514946 - RNA, 17 nt, Homo sapiens
caacaugguuaccucug

SEQ ID NO: 514947 - RNA, 22 nt, Homo sapiens
caacccugugaucuauaccacc

SEQ ID NO: 514948 - RNA, 22 nt, Homo sapiens
caaccuccccugguccugcacu

SEQ ID NO: 514949 - RNA, 21 nt, Homo sapiens
caaccucggggagugccacuu

SEQ ID NO: 514950 - RNA, 20 nt, Homo sapiens
caaccuggguaacaaaguga

SEQ ID NO: 514951 - RNA, 21 nt, Homo sapiens
caacuugaaauuauaucugug

SEQ ID NO: 514952 - RNA, 20 nt, Homo sapiens
caagaagugggauucaggaa

SEQ ID NO: 514953 - RNA, 15 nt, Homo sapiens
caagagaccacuucc

SEQ ID NO: 514954 - RNA, 19 nt, Homo sapiens
caagagguuucagcauucc

SEQ ID NO: 514955 - RNA, 17 nt, Homo sapiens
caagauccugucuugcu

SEQ ID NO: 514956 - RNA, 21 nt, Homo sapiens
caagauccugucuugcugagg

SEQ ID NO: 514957 - RNA, 17 nt, Homo sapiens
caagccacguugcagaa

SEQ ID NO: 514958 - RNA, 18 nt, Homo sapiens
caaggaauagaguuuucc

SEQ ID NO: 514959 - RNA, 17 nt, Homo sapiens
caaggaucacuugagcc

SEQ ID NO: 514960 - RNA, 21 nt, Homo sapiens
caagguauugagacauauuac

SEQ ID NO: 514961 - RNA, 23 nt, Homo sapiens
caaguucacaccacugccauuuc

SEQ ID NO: 514962 - RNA, 16 nt, Homo sapiens
caauaaaagaaacugu

SEQ ID NO: 514963 - RNA, 20 nt, Homo sapiens
caauaaaagaaacugugguc

SEQ ID NO: 514964 - RNA, 15 nt, Homo sapiens
caauaaacucaguca

SEQ ID NO: 514965 - RNA, 16 nt, Homo sapiens
caauaaggcagugcag

SEQ ID NO: 514966 - RNA, 18 nt, Homo sapiens
caauaaggcagugcagug

SEQ ID NO: 514967 - RNA, 15 nt, Homo sapiens
caaugccugccugaa

SEQ ID NO: 514968 - RNA, 23 nt, Homo sapiens
caaugcucaguaacacagugcag

SEQ ID NO: 514969 - RNA, 20 nt, Homo sapiens
caauguggaauuacauaaca

SEQ ID NO: 514970 - RNA, 21 nt, Homo sapiens
caauucaucucagcaaucaca

SEQ ID NO: 514971 - RNA, 22 nt, Homo sapiens
caauucugaaggggaaaaccuc

SEQ ID NO: 514972 - RNA, 18 nt, Homo sapiens
caauuuguugaaucucag

SEQ ID NO: 514973 - RNA, 21 nt, Homo sapiens
cacaagguugcuggcauuugc

SEQ ID NO: 514974 - RNA, 23 nt, Homo sapiens
cacaagguugcuggcauuugcug

SEQ ID NO: 514975 - RNA, 18 nt, Homo sapiens
cacaauacagugguauaa

SEQ ID NO: 514976 - RNA, 14 nt, Homo sapiens
cacacacacacaua

SEQ ID NO: 514977 - RNA, 20 nt, Homo sapiens
cacacucucuucuuacugua

SEQ ID NO: 514978 - RNA, 18 nt, Homo sapiens
cacacugcccucugccac

SEQ ID NO: 514979 - RNA, 22 nt, Homo sapiens
cacagacacacaagcagacaca

SEQ ID NO: 514980 - RNA, 18 nt, Homo sapiens
cacagcugggcaggguga

SEQ ID NO: 514981 - RNA, 14 nt, Homo sapiens
cacagggacacagu

SEQ ID NO: 514982 - RNA, 14 nt, Homo sapiens
cacaguagcauuuc

SEQ ID NO: 514983 - RNA, 11 nt, Homo sapiens
cacagugcagu

SEQ ID NO: 514984 - RNA, 23 nt, Homo sapiens
cacagugcaguacucaguaauac

SEQ ID NO: 514985 - RNA, 15 nt, Homo sapiens
cacauaguguuugua

SEQ ID NO: 514986 - RNA, 17 nt, Homo sapiens
cacauugaaacuguauu

SEQ ID NO: 514987 - RNA, 12 nt, Homo sapiens
cacauugcccau

SEQ ID NO: 514988 - RNA, 17 nt, Homo sapiens
cacauuggcaguguguc

SEQ ID NO: 514989 - RNA, 14 nt, Homo sapiens
caccaaauagcuuu

SEQ ID NO: 514990 - RNA, 19 nt, Homo sapiens
caccaauuuagaaugaaua

SEQ ID NO: 514991 - RNA, 15 nt, Homo sapiens
caccagcaacauuau

SEQ ID NO: 514992 - RNA, 18 nt, Homo sapiens
cacccaaagcccacuuca

SEQ ID NO: 514993 - RNA, 20 nt, Homo sapiens
cacccaaguuggagugcagu

SEQ ID NO: 514994 - RNA, 15 nt, Homo sapiens
cacccuaucaucagu

SEQ ID NO: 514995 - RNA, 15 nt, Homo sapiens
caccugaaaugccuu

SEQ ID NO: 514996 - RNA, 23 nt, Homo sapiens
caccuuaaaacauuagugcuaug

SEQ ID NO: 514997 - RNA, 22 nt, Homo sapiens
cacgaauauugcugauggugca

SEQ ID NO: 514998 - RNA, 22 nt, Homo sapiens
cacgauaugcaaguucauccaa

SEQ ID NO: 514999 - RNA, 22 nt, Homo sapiens
cacggccgucucugauucuccc

SEQ ID NO: 515000 - RNA, 22 nt, Homo sapiens
cacgguguggggggugccccac

SEQ ID NO: 515001 - RNA, 16 nt, Homo sapiens
cacgucaucuaguuuu

SEQ ID NO: 515002 - RNA, 15 nt, Homo sapiens
cacgugcagcaccug

SEQ ID NO: 515003 - RNA, 20 nt, Homo sapiens
cacguguccccagagcuuua

SEQ ID NO: 515004 - RNA, 18 nt, Homo sapiens
cacguuuggccagugaca

SEQ ID NO: 515005 - RNA, 17 nt, Homo sapiens
cacguuuuccauuauga

SEQ ID NO: 515006 - RNA, 18 nt, Homo sapiens
cacucaucagguaaacug

SEQ ID NO: 515007 - RNA, 22 nt, Homo sapiens
cacuccacaguuaggccaagaa

SEQ ID NO: 515008 - RNA, 16 nt, Homo sapiens
cacucccuaaguccac

SEQ ID NO: 515009 - RNA, 19 nt, Homo sapiens
cacugagcugggcaccaca

SEQ ID NO: 515010 - RNA, 16 nt, Homo sapiens
cacugcccaaagccau

SEQ ID NO: 515011 - RNA, 24 nt, Homo sapiens
cacugccccugcaccugcuucuca

SEQ ID NO: 515012 - RNA, 21 nt, Homo sapiens
cacugcgcauguuugacuuua

SEQ ID NO: 515013 - RNA, 16 nt, Homo sapiens
cacuggagcguguacu

SEQ ID NO: 515014 - RNA, 21 nt, Homo sapiens
cacugucccggagcucaggcc

SEQ ID NO: 515015 - RNA, 18 nt, Homo sapiens
cacugugaccugcuccug

SEQ ID NO: 515016 - RNA, 15 nt, Homo sapiens
cacuuauuuccaugg

SEQ ID NO: 515017 - RNA, 18 nt, Homo sapiens
cacuuucccacacuguga

SEQ ID NO: 515018 - RNA, 14 nt, Homo sapiens
cagaaaaccuacca

SEQ ID NO: 515019 - RNA, 20 nt, Homo sapiens
cagaaaaccuaccacauuca

SEQ ID NO: 515020 - RNA, 21 nt, Homo sapiens
cagaaaaccuaccacauucac

SEQ ID NO: 515021 - RNA, 19 nt, Homo sapiens
cagaaacacggaguuucca

SEQ ID NO: 515022 - RNA, 19 nt, Homo sapiens
cagaaagccaggguccuga

SEQ ID NO: 515023 - RNA, 18 nt, Homo sapiens
cagaaaucuaaucucugu

SEQ ID NO: 515024 - RNA, 15 nt, Homo sapiens
cagaagaaacuaccc

SEQ ID NO: 515025 - RNA, 23 nt, Homo sapiens
cagaaguggaaggauaaugagau

SEQ ID NO: 515026 - RNA, 21 nt, Homo sapiens
cagaauggugggcuccagagu

SEQ ID NO: 515027 - RNA, 13 nt, Homo sapiens
cagaaugugcaaa

SEQ ID NO: 515028 - RNA, 19 nt, Homo sapiens
cagaccacaaaauguaaua

SEQ ID NO: 515029 - RNA, 19 nt, Homo sapiens
cagacucaaggccuccagc

SEQ ID NO: 515030 - RNA, 14 nt, Homo sapiens
cagagaacccugug

SEQ ID NO: 515031 - RNA, 15 nt, Homo sapiens
cagagaacccugugg

SEQ ID NO: 515032 - RNA, 23 nt, Homo sapiens
cagagaagccugucuguacuuca

SEQ ID NO: 515033 - RNA, 16 nt, Homo sapiens
cagagcacuguauacc

SEQ ID NO: 515034 - RNA, 13 nt, Homo sapiens
cagagcugagucg

SEQ ID NO: 515035 - RNA, 23 nt, Homo sapiens
cagagcuuuacagugccacgaca

SEQ ID NO: 515036 - RNA, 16 nt, Homo sapiens
cagaggacggcuuccc

SEQ ID NO: 515037 - RNA, 14 nt, Homo sapiens
cagaggguugugau

SEQ ID NO: 515038 - RNA, 17 nt, Homo sapiens
cagagucaagcugauga

SEQ ID NO: 515039 - RNA, 22 nt, Homo sapiens
cagagugcccuggggcauccac

SEQ ID NO: 515040 - RNA, 16 nt, Homo sapiens
cagaguugguggagaa

SEQ ID NO: 515041 - RNA, 22 nt, Homo sapiens
cagaguugguggagaacagaaa

SEQ ID NO: 515042 - RNA, 21 nt, Homo sapiens
cagauguacaauuuagcuuaa

SEQ ID NO: 515043 - RNA, 22 nt, Homo sapiens
cagauugauuuucucagcacaa

SEQ ID NO: 515044 - RNA, 18 nt, Homo sapiens
cagcaaccagagcacugu

SEQ ID NO: 515045 - RNA, 15 nt, Homo sapiens
cagcaccagccugag

SEQ ID NO: 515046 - RNA, 15 nt, Homo sapiens
ucccugaacacucau

SEQ ID NO: 515047 - RNA, 19 nt, Homo sapiens
ucccugaacauaguuuuca

SEQ ID NO: 515048 - RNA, 13 nt, Homo sapiens
ucccugccagugu

SEQ ID NO: 515049 - RNA, 13 nt, Homo sapiens
ucccugcucagcc

SEQ ID NO: 515050 - RNA, 20 nt, Homo sapiens
uccgacuucucuagacaucu

SEQ ID NO: 515051 - RNA, 23 nt, Homo sapiens
uccggugucuggaaaagcacuuu

SEQ ID NO: 515052 - RNA, 19 nt, Homo sapiens
uccgugagagucaucucaa

SEQ ID NO: 515053 - RNA, 16 nt, Homo sapiens
uccguuuccaaauaca

SEQ ID NO: 515054 - RNA, 20 nt, Homo sapiens
uccuauccccggacgcaugc

SEQ ID NO: 515055 - RNA, 17 nt, Homo sapiens
uccucaagauccugucu

SEQ ID NO: 515056 - RNA, 22 nt, Homo sapiens
uccucaagauccugucuugcug

SEQ ID NO: 515057 - RNA, 14 nt, Homo sapiens
uccucauggcuguu

SEQ ID NO: 515058 - RNA, 22 nt, Homo sapiens
uccucuauuuguucagaucuca

SEQ ID NO: 515059 - RNA, 11 nt, Homo sapiens
uccucuuucac

SEQ ID NO: 515060 - RNA, 16 nt, Homo sapiens
uccugaauaauuucca

SEQ ID NO: 515061 - RNA, 11 nt, Homo sapiens
uccugcacugu

SEQ ID NO: 515062 - RNA, 18 nt, Homo sapiens
uccugggggaugugcacg

SEQ ID NO: 515063 - RNA, 20 nt, Homo sapiens
uccugggggaugugcacggc

SEQ ID NO: 515064 - RNA, 15 nt, Homo sapiens
uccugucuugcugag

SEQ ID NO: 515065 - RNA, 16 nt, Homo sapiens
uccuucugauccacag

SEQ ID NO: 515066 - RNA, 14 nt, Homo sapiens
uccuuucccaccca

SEQ ID NO: 515067 - RNA, 15 nt, Homo sapiens
uccuuucccacccac

SEQ ID NO: 515068 - RNA, 16 nt, Homo sapiens
uccuuuuguauccucc

SEQ ID NO: 515069 - RNA, 13 nt, Homo sapiens
uccuuuuuuauac

SEQ ID NO: 515070 - RNA, 18 nt, Homo sapiens
uccuuuuuuauacacaua

SEQ ID NO: 515071 - RNA, 15 nt, Homo sapiens
ucgcacuacaucuga

SEQ ID NO: 515072 - RNA, 12 nt, Homo sapiens
ucgcagccugaa

SEQ ID NO: 515073 - RNA, 19 nt, Homo sapiens
ucguauggauuucuaggcc

SEQ ID NO: 515074 - RNA, 15 nt, Homo sapiens
ucgugccguggagcu

SEQ ID NO: 515075 - RNA, 19 nt, Homo sapiens
ucguuuugaccacauauau

SEQ ID NO: 515076 - RNA, 17 nt, Homo sapiens
ucuaaaaaugauucucu

SEQ ID NO: 515077 - RNA, 16 nt, Homo sapiens
ucuaaggaaugaucca

SEQ ID NO: 515078 - RNA, 17 nt, Homo sapiens
ucuaagguaaaaccauc

SEQ ID NO: 515079 - RNA, 22 nt, Homo sapiens
ucuaagguaaaaccaucuagga

SEQ ID NO: 515080 - RNA, 15 nt, Homo sapiens
ucuacaauacaacac

SEQ ID NO: 515081 - RNA, 18 nt, Homo sapiens
ucuacccuagauccaauu

SEQ ID NO: 515082 - RNA, 19 nt, Homo sapiens
ucucaauacccacugccag

SEQ ID NO: 515083 - RNA, 21 nt, Homo sapiens
ucucacugacuucucccgggu

SEQ ID NO: 515084 - RNA, 14 nt, Homo sapiens
ucucaggucuucac

SEQ ID NO: 515085 - RNA, 16 nt, Homo sapiens
ucuccccuccaaguga

SEQ ID NO: 515086 - RNA, 22 nt, Homo sapiens
ucuccuuuaauauacuccuuaa

SEQ ID NO: 515087 - RNA, 20 nt, Homo sapiens
ucucuagacaucuagucuca

SEQ ID NO: 515088 - RNA, 14 nt, Homo sapiens
ucucucccuacccu

SEQ ID NO: 515089 - RNA, 23 nt, Homo sapiens
ucucuccuaagacaccugcaaua

SEQ ID NO: 515090 - RNA, 12 nt, Homo sapiens
ucucugugcugg

SEQ ID NO: 515091 - RNA, 16 nt, Homo sapiens
ucucuguuuacccucc

SEQ ID NO: 515092 - RNA, 21 nt, Homo sapiens
ucucuucaugcgcagucccca

SEQ ID NO: 515093 - RNA, 13 nt, Homo sapiens
ucucuucuuccuu

SEQ ID NO: 515094 - RNA, 16 nt, Homo sapiens
ucucuuuauagagcuc

SEQ ID NO: 515095 - RNA, 22 nt, Homo sapiens
ucugaaaaaguguuuuuacaua

SEQ ID NO: 515096 - RNA, 20 nt, Homo sapiens
ucugaacccuuccaccaaaa

SEQ ID NO: 515097 - RNA, 15 nt, Homo sapiens
ucugaaggcugaguc

SEQ ID NO: 515098 - RNA, 14 nt, Homo sapiens
ucugacuccagugg

SEQ ID NO: 515099 - RNA, 23 nt, Homo sapiens
ucugacuguaaaauacaugguau

SEQ ID NO: 515100 - RNA, 21 nt, Homo sapiens
ucugagacucgcgacaaugca

SEQ ID NO: 515101 - RNA, 17 nt, Homo sapiens
ucugaguagcauauaua

SEQ ID NO: 515102 - RNA, 24 nt, Homo sapiens
ucugauccacagccucaucaguau

SEQ ID NO: 515103 - RNA, 21 nt, Homo sapiens
ucugaugaaguuguacaacac

SEQ ID NO: 515104 - RNA, 13 nt, Homo sapiens
ucugcagccugag

SEQ ID NO: 515105 - RNA, 23 nt, Homo sapiens
ucugcauaaauauuagcaaagca

SEQ ID NO: 515106 - RNA, 19 nt, Homo sapiens
ucugcauaaccgcacagac

SEQ ID NO: 515107 - RNA, 14 nt, Homo sapiens
ucugccuggagccu

SEQ ID NO: 515108 - RNA, 21 nt, Homo sapiens
ucugcuucucuuucacaacuu

SEQ ID NO: 515109 - RNA, 20 nt, Homo sapiens
ucugcuugucauucugcuaa

SEQ ID NO: 515110 - RNA, 16 nt, Homo sapiens
ucugcuuucauccagc

SEQ ID NO: 515111 - RNA, 21 nt, Homo sapiens
ucuggagauaaaauaaaaaga

SEQ ID NO: 515112 - RNA, 14 nt, Homo sapiens
ucuggagcugaagc

SEQ ID NO: 515113 - RNA, 22 nt, Homo sapiens
ucuguccacucugaauaccaag

SEQ ID NO: 515114 - RNA, 20 nt, Homo sapiens
ucugucccaguuaacuguua

SEQ ID NO: 515115 - RNA, 23 nt, Homo sapiens
ucugugaaagucuccuguaucau

SEQ ID NO: 515116 - RNA, 14 nt, Homo sapiens
ucugugcaacaaac

SEQ ID NO: 515117 - RNA, 14 nt, Homo sapiens
ucugugcaucuggc

SEQ ID NO: 515118 - RNA, 13 nt, Homo sapiens
ucuguguaaccuc

SEQ ID NO: 515119 - RNA, 18 nt, Homo sapiens
ucuguuuucccauugcag

SEQ ID NO: 515120 - RNA, 14 nt, Homo sapiens
ucuuaaaucugccu

SEQ ID NO: 515121 - RNA, 23 nt, Homo sapiens
ucuuaaguacugaaauacauaug

SEQ ID NO: 515122 - RNA, 14 nt, Homo sapiens
ucuuaaugucucaa

SEQ ID NO: 515123 - RNA, 20 nt, Homo sapiens
ucuuaauugcaucaguauuu

SEQ ID NO: 515124 - RNA, 17 nt, Homo sapiens
ucuuagaagaaauauga

SEQ ID NO: 515125 - RNA, 20 nt, Homo sapiens
ucuuagagauacccucugag

SEQ ID NO: 515126 - RNA, 14 nt, Homo sapiens
ucuucauggccaua

SEQ ID NO: 515127 - RNA, 17 nt, Homo sapiens
ucuuccaaguucauuca

SEQ ID NO: 515128 - RNA, 18 nt, Homo sapiens
ucuuccugccuacuggau

SEQ ID NO: 515129 - RNA, 14 nt, Homo sapiens
ucuucucacuuuuu

SEQ ID NO: 515130 - RNA, 22 nt, Homo sapiens
ucuucucagcuccacucugaag

SEQ ID NO: 515131 - RNA, 13 nt, Homo sapiens
ucuucuuacugua

SEQ ID NO: 515132 - RNA, 21 nt, Homo sapiens
ucuugaaguagacauggaauu

SEQ ID NO: 515133 - RNA, 17 nt, Homo sapiens
ucuugcagucaucagaa

SEQ ID NO: 515134 - RNA, 22 nt, Homo sapiens
ucuugccugaauccaucaggac

SEQ ID NO: 515135 - RNA, 22 nt, Homo sapiens
ucuugcucacagggacucucca

SEQ ID NO: 515136 - RNA, 20 nt, Homo sapiens
ucuugcuguuuaccgcccac

SEQ ID NO: 515137 - RNA, 13 nt, Homo sapiens
ucuuggauuggua

SEQ ID NO: 515138 - RNA, 22 nt, Homo sapiens
ucuugggaggacacuuuugcca

SEQ ID NO: 515139 - RNA, 22 nt, Homo sapiens
ucuuguaaaacugugacauucc

SEQ ID NO: 515140 - RNA, 14 nt, Homo sapiens
ucuuguauuaucau

SEQ ID NO: 515141 - RNA, 16 nt, Homo sapiens
ucuuucccucauguau

SEQ ID NO: 515142 - RNA, 14 nt, Homo sapiens
ucuuucugugcugg

SEQ ID NO: 515143 - RNA, 12 nt, Homo sapiens
ucuuugcugcaa

SEQ ID NO: 515144 - RNA, 18 nt, Homo sapiens
ucuuuuuucaauguacug

SEQ ID NO: 515145 - RNA, 23 nt, Homo sapiens
ucuuuuuucaauguacuguauug

SEQ ID NO: 515146 - RNA, 20 nt, Homo sapiens
ugaaaaccacccuaucauca

SEQ ID NO: 515147 - RNA, 18 nt, Homo sapiens
ugaaacacaauaucaucc

SEQ ID NO: 515148 - RNA, 18 nt, Homo sapiens
ugaaacaguguggaugua

SEQ ID NO: 515149 - RNA, 14 nt, Homo sapiens
ugaaauaaaagccu

SEQ ID NO: 515150 - RNA, 14 nt, Homo sapiens
ugaaauacauauga

SEQ ID NO: 515151 - RNA, 18 nt, Homo sapiens
ugaaauauaaacugugag

SEQ ID NO: 515152 - RNA, 20 nt, Homo sapiens
ugaaauuauagaaauuuacu

SEQ ID NO: 515153 - RNA, 18 nt, Homo sapiens
ugaaccauucauugcagc

SEQ ID NO: 515154 - RNA, 15 nt, Homo sapiens
ugaacugcaacacug

SEQ ID NO: 515155 - RNA, 17 nt, Homo sapiens
ugaacugcaacacugga

SEQ ID NO: 515156 - RNA, 17 nt, Homo sapiens
ugaagaacucaugugau

SEQ ID NO: 515157 - RNA, 20 nt, Homo sapiens
ugaagaacucaugugauuua

SEQ ID NO: 515158 - RNA, 15 nt, Homo sapiens
ugaagcauccaggca

SEQ ID NO: 515159 - RNA, 17 nt, Homo sapiens
ugaagcuaaaacacuuc

SEQ ID NO: 515160 - RNA, 17 nt, Homo sapiens
ugaaggucuugccugaa

SEQ ID NO: 515161 - RNA, 17 nt, Homo sapiens
ugaaguacucaguaaua

SEQ ID NO: 515162 - RNA, 13 nt, Homo sapiens
uuuuuacauauag

SEQ ID NO: 515163 - RNA, 21 nt, Homo sapiens
uuuuuagacuguuagacaaaa

SEQ ID NO: 515164 - RNA, 16 nt, Homo sapiens
caggcaugcaccagug

SEQ ID NO: 515165 - RNA, 15 nt, Homo sapiens
caggcuacaggugcc

SEQ ID NO: 515166 - RNA, 13 nt, Homo sapiens
cagggaccaagga

SEQ ID NO: 515167 - RNA, 16 nt, Homo sapiens
cagggaucauagcuga

SEQ ID NO: 515168 - RNA, 13 nt, Homo sapiens
cagggauggagau

SEQ ID NO: 515169 - RNA, 14 nt, Homo sapiens
cagggcaaucaaug

SEQ ID NO: 515170 - RNA, 15 nt, Homo sapiens
caggggaucauguua

SEQ ID NO: 515171 - RNA, 23 nt, Homo sapiens
cagggggguuggguuccagacag

SEQ ID NO: 515172 - RNA, 22 nt, Homo sapiens
caguaaagaccauuuaguccuc

SEQ ID NO: 515173 - RNA, 15 nt, Homo sapiens
caguaaauauacacu

SEQ ID NO: 515174 - RNA, 22 nt, Homo sapiens
caguaacacaauacaguacuca

SEQ ID NO: 515175 - RNA, 16 nt, Homo sapiens
caguaacacagugcag

SEQ ID NO: 515176 - RNA, 22 nt, Homo sapiens
aaauacacauacauauauacau

SEQ ID NO: 515177 - RNA, 18 nt, Homo sapiens
aaauauaaacugugagau

SEQ ID NO: 515178 - RNA, 14 nt, Homo sapiens
aaauauaugacuuu

SEQ ID NO: 515179 - RNA, 22 nt, Homo sapiens
aaauauucugucauugguuaca

SEQ ID NO: 515180 - RNA, 16 nt, Homo sapiens
aaauauugacaaguuu

SEQ ID NO: 515181 - RNA, 12 nt, Homo sapiens
aaauauugcuau

SEQ ID NO: 515182 - RNA, 13 nt, Homo sapiens
aaaucacuuuaau

SEQ ID NO: 515183 - RNA, 17 nt, Homo sapiens
aaaucauccucaugucc

SEQ ID NO: 515184 - RNA, 20 nt, Homo sapiens
aaaucuccccacuccagaag

SEQ ID NO: 515185 - RNA, 20 nt, Homo sapiens
aaaucuguauugcuaagaua

SEQ ID NO: 515186 - RNA, 16 nt, Homo sapiens
aaaugaaagucaguuu

SEQ ID NO: 515187 - RNA, 17 nt, Homo sapiens
aaaugaauuuaucauuu

SEQ ID NO: 515188 - RNA, 17 nt, Homo sapiens
aaaugcaaagcacaccu

SEQ ID NO: 515189 - RNA, 23 nt, Homo sapiens
aaaugcaauuugauaaucaguuu

SEQ ID NO: 515190 - RNA, 13 nt, Homo sapiens
aaaugcagugaaa

SEQ ID NO: 515191 - RNA, 16 nt, Homo sapiens
aaauggauguaauaua

SEQ ID NO: 515192 - RNA, 17 nt, Homo sapiens
aaauggcuuguucaguc

SEQ ID NO: 515193 - RNA, 20 nt, Homo sapiens
aaauggcuuuccacaucccc

SEQ ID NO: 515194 - RNA, 21 nt, Homo sapiens
aaaugugucuuguauuaucau

SEQ ID NO: 515195 - RNA, 17 nt, Homo sapiens
aaauguuauaggcacuu

SEQ ID NO: 515196 - RNA, 18 nt, Homo sapiens
aaauguuuggccaugcuu

SEQ ID NO: 515197 - RNA, 13 nt, Homo sapiens
aaauucacaaagu

SEQ ID NO: 515198 - RNA, 23 nt, Homo sapiens
aaauucuguuuauguucuugcag

SEQ ID NO: 515199 - RNA, 23 nt, Homo sapiens
aaauugagucauuuuauauauga

SEQ ID NO: 515200 - RNA, 12 nt, Homo sapiens
aaauuggaagac

SEQ ID NO: 515201 - RNA, 16 nt, Homo sapiens
aaaaaccaaauaagca

SEQ ID NO: 515202 - RNA, 12 nt, Homo sapiens
aaaaagccaaaa

SEQ ID NO: 515203 - RNA, 22 nt, Homo sapiens
aaaaagggacaagcauguugau

SEQ ID NO: 515204 - RNA, 20 nt, Homo sapiens
aaaaauaguguguccaugca

SEQ ID NO: 515205 - RNA, 20 nt, Homo sapiens
aaaaaucccauuuaugcaau

SEQ ID NO: 515206 - RNA, 12 nt, Homo sapiens
aaaaaugauucu

SEQ ID NO: 515207 - RNA, 16 nt, Homo sapiens
aaaacaugcugucuua

SEQ ID NO: 515208 - RNA, 11 nt, Homo sapiens
aaaacugugac

SEQ ID NO: 515209 - RNA, 13 nt, Homo sapiens
aaaacuguugcua

SEQ ID NO: 515210 - RNA, 13 nt, Homo sapiens
aaaagcauguaca

SEQ ID NO: 515211 - RNA, 11 nt, Homo sapiens
aaaagugcaac

SEQ ID NO: 515212 - RNA, 19 nt, Homo sapiens
aaaaguguuuuuacauaua

SEQ ID NO: 515213 - RNA, 20 nt, Homo sapiens
aaaauaguugagccagcaga

SEQ ID NO: 515214 - RNA, 19 nt, Homo sapiens
aaaauauaugacuuugaau

SEQ ID NO: 515215 - RNA, 21 nt, Homo sapiens
aaacaaauauacucauuugga

SEQ ID NO: 515216 - RNA, 11 nt, Homo sapiens
aaacaaauggc

SEQ ID NO: 515217 - RNA, 13 nt, Homo sapiens
aaacacagauuau

SEQ ID NO: 515218 - RNA, 15 nt, Homo sapiens
aaacacuucuccuua

SEQ ID NO: 515219 - RNA, 18 nt, Homo sapiens
aaacagagaacccugugg

SEQ ID NO: 515220 - RNA, 16 nt, Homo sapiens
aaacagagcaaaagaa

SEQ ID NO: 515221 - RNA, 15 nt, Homo sapiens
aaacaggugcuaaca

SEQ ID NO: 515222 - RNA, 18 nt, Homo sapiens
aaacauucuuauuucagu

SEQ ID NO: 515223 - RNA, 15 nt, Homo sapiens
aaacauuucccugcu

SEQ ID NO: 515224 - RNA, 18 nt, Homo sapiens
aaaccagaaaucuaaucu

SEQ ID NO: 515225 - RNA, 19 nt, Homo sapiens
aaacccacauaaacacuuc

SEQ ID NO: 515226 - RNA, 23 nt, Homo sapiens
aaacccuuuuacagucacauuca

SEQ ID NO: 515227 - RNA, 17 nt, Homo sapiens
aaaccuaccacauucac

SEQ ID NO: 515228 - RNA, 19 nt, Homo sapiens
aaaccuaccacauucacua

SEQ ID NO: 515229 - RNA, 13 nt, Homo sapiens
aaaccucugagug

SEQ ID NO: 515230 - RNA, 15 nt, Homo sapiens
aaaccugugcuuuca

SEQ ID NO: 515231 - RNA, 11 nt, Homo sapiens
aaacucaaaau

SEQ ID NO: 515232 - RNA, 15 nt, Homo sapiens
aaacuguauuuacuu

SEQ ID NO: 515233 - RNA, 19 nt, Homo sapiens
aaagaacugccccaucucc

SEQ ID NO: 515234 - RNA, 17 nt, Homo sapiens
aaagacaguaaagacca

SEQ ID NO: 515235 - RNA, 12 nt, Homo sapiens
aaagauaagugu

SEQ ID NO: 515236 - RNA, 18 nt, Homo sapiens
aaagcaugcucaguauug

SEQ ID NO: 515237 - RNA, 15 nt, Homo sapiens
aaagccaaguguccu

SEQ ID NO: 515238 - RNA, 11 nt, Homo sapiens
aaagccuuccu

SEQ ID NO: 515239 - RNA, 15 nt, Homo sapiens
aaaggaggacaggga

SEQ ID NO: 515240 - RNA, 19 nt, Homo sapiens
aaaggugccucauagcaua

SEQ ID NO: 515241 - RNA, 12 nt, Homo sapiens
aaauaaaagccu

SEQ ID NO: 515242 - RNA, 16 nt, Homo sapiens
aaauaaagaguucucc

SEQ ID NO: 515243 - RNA, 18 nt, Homo sapiens
aaauaacccugaaucaga

SEQ ID NO: 515244 - RNA, 23 nt, Homo sapiens
aaauaguugagccagcagacauu

SEQ ID NO: 515245 - RNA, 16 nt, Homo sapiens
aaauauaaacugugag

SEQ ID NO: 515246 - RNA, 19 nt, Homo sapiens
aaauauaaacugugagaua

SEQ ID NO: 515247 - RNA, 18 nt, Homo sapiens
aaauaugauucuccucuc

SEQ ID NO: 515248 - RNA, 15 nt, Homo sapiens
aaauauuauuugcua

SEQ ID NO: 515249 - RNA, 19 nt, Homo sapiens
aaauauuuucuacuuuaaa

SEQ ID NO: 515250 - RNA, 16 nt, Homo sapiens
aaaucaacucucuccu

SEQ ID NO: 515251 - RNA, 17 nt, Homo sapiens
aaaucacccugacugug

SEQ ID NO: 515252 - RNA, 14 nt, Homo sapiens
aaaucagugcagua

SEQ ID NO: 515253 - RNA, 20 nt, Homo sapiens
aaaucauauuuaccugugaa

SEQ ID NO: 515254 - RNA, 19 nt, Homo sapiens
aaauccugacaaaagggac

SEQ ID NO: 515255 - RNA, 22 nt, Homo sapiens
aaaucuccccacuccagaagca

SEQ ID NO: 515256 - RNA, 20 nt, Homo sapiens
aaaucucgcacuacaucuga

SEQ ID NO: 515257 - RNA, 14 nt, Homo sapiens
aaaucugcuuucau

SEQ ID NO: 515258 - RNA, 16 nt, Homo sapiens
aaaugaguucccuuga

SEQ ID NO: 515259 - RNA, 18 nt, Homo sapiens
aaaugauuaagugcuuga

SEQ ID NO: 515260 - RNA, 14 nt, Homo sapiens
aaaugauucucuaa

SEQ ID NO: 515261 - RNA, 15 nt, Homo sapiens
aaaugcaaauauugc

SEQ ID NO: 515262 - RNA, 17 nt, Homo sapiens
aaaugcuugauggaauu

SEQ ID NO: 515263 - RNA, 13 nt, Homo sapiens
aaaugcuuucuca

SEQ ID NO: 515264 - RNA, 15 nt, Homo sapiens
aaaugguaccaagga

SEQ ID NO: 515265 - RNA, 17 nt, Homo sapiens
aaaugucauagcuuaua

SEQ ID NO: 515266 - RNA, 14 nt, Homo sapiens
aaauuaucuuuaaa

SEQ ID NO: 515267 - RNA, 22 nt, Homo sapiens
aaauuaugucaaauggauguaa

SEQ ID NO: 515268 - RNA, 19 nt, Homo sapiens
aaauucaguggacauuugu

SEQ ID NO: 515269 - RNA, 23 nt, Homo sapiens
aaauugauugucaaauacagcau

SEQ ID NO: 515270 - RNA, 16 nt, Homo sapiens
aaauugcuccauuccu

SEQ ID NO: 515271 - RNA, 24 nt, Homo sapiens
aaauugucuuuugucauguggcua

SEQ ID NO: 515272 - RNA, 17 nt, Homo sapiens
aaauuuacccaaugcag

SEQ ID NO: 515273 - RNA, 23 nt, Homo sapiens
aaauuuuuacucaggcuuucuau

SEQ ID NO: 515274 - RNA, 12 nt, Homo sapiens
aacaaaacuugc

SEQ ID NO: 515275 - RNA, 15 nt, Homo sapiens
aacaaagcaugcuca

SEQ ID NO: 515276 - RNA, 21 nt, Homo sapiens
aacaaauggcuuguucaguca

SEQ ID NO: 515277 - RNA, 18 nt, Homo sapiens
aacaacaaagcaugcuca

SEQ ID NO: 515278 - RNA, 18 nt, Homo sapiens
aacaagccacguugcaga

SEQ ID NO: 515279 - RNA, 20 nt, Homo sapiens
aacacacacacacacaaaac

SEQ ID NO: 515280 - RNA, 11 nt, Homo sapiens
aacacaguaag

SEQ ID NO: 515281 - RNA, 13 nt, Homo sapiens
aacacaucacuua

SEQ ID NO: 515282 - RNA, 17 nt, Homo sapiens
aacaccguccaacauuc

SEQ ID NO: 515283 - RNA, 16 nt, Homo sapiens
aacagaccagcauagu

SEQ ID NO: 515284 - RNA, 22 nt, Homo sapiens
aacagaccagcauaguucugca

SEQ ID NO: 515285 - RNA, 17 nt, Homo sapiens
aacagagugauuuguaa

SEQ ID NO: 515286 - RNA, 22 nt, Homo sapiens
aacagaucacaugccccucuua

SEQ ID NO: 515287 - RNA, 18 nt, Homo sapiens
aacagggaugcuaucucg

SEQ ID NO: 515288 - RNA, 14 nt, Homo sapiens
aacauaguuuucac

SEQ ID NO: 515289 - RNA, 20 nt, Homo sapiens
aacauauacuuccaugcacu

SEQ ID NO: 515290 - RNA, 19 nt, Homo sapiens
aacaucaauuggguuuuga

SEQ ID NO: 515291 - RNA, 16 nt, Homo sapiens
aacaucugauuucuga

SEQ ID NO: 515292 - RNA, 14 nt, Homo sapiens
aacaugcugucuua

SEQ ID NO: 515293 - RNA, 22 nt, Homo sapiens
aacaugcugucuuagaucagga

SEQ ID NO: 515294 - RNA, 16 nt, Homo sapiens
aacaugguuaccucug

SEQ ID NO: 515295 - RNA, 15 nt, Homo sapiens
aacauuagugcuaug

SEQ ID NO: 515296 - RNA, 16 nt, Homo sapiens
aacauuuggcauuccu

SEQ ID NO: 515297 - RNA, 14 nt, Homo sapiens
aaccauucauugca

SEQ ID NO: 515298 - RNA, 12 nt, Homo sapiens
aaccauucugcu

SEQ ID NO: 515299 - RNA, 20 nt, Homo sapiens
aacccugugaucuauaccac

SEQ ID NO: 515300 - RNA, 14 nt, Homo sapiens
aacccugugcauga

SEQ ID NO: 515301 - RNA, 18 nt, Homo sapiens
aaccucggggagugccac

SEQ ID NO: 515302 - RNA, 17 nt, Homo sapiens
aaccugaaagggcauuu

SEQ ID NO: 515303 - RNA, 23 nt, Homo sapiens
aaccuuggagaggagaguggcag

SEQ ID NO: 515304 - RNA, 14 nt, Homo sapiens
aacguuuuuccagu

SEQ ID NO: 515305 - RNA, 16 nt, Homo sapiens
aacuaaugacaaguga

SEQ ID NO: 515306 - RNA, 15 nt, Homo sapiens
aacuaauguaaauau

SEQ ID NO: 515307 - RNA, 19 nt, Homo sapiens
aacucagcaauggcagauu

SEQ ID NO: 515308 - RNA, 13 nt, Homo sapiens
aacucagcugucu

SEQ ID NO: 515309 - RNA, 14 nt, Homo sapiens
aacucauacagugg

SEQ ID NO: 515310 - RNA, 13 nt, Homo sapiens
aacuccaggguua

SEQ ID NO: 515311 - RNA, 16 nt, Homo sapiens
aacucgggcacucccu

SEQ ID NO: 515312 - RNA, 21 nt, Homo sapiens
aacucuguacgaggcuucucu

SEQ ID NO: 515313 - RNA, 14 nt, Homo sapiens
aacucuuuccccag

SEQ ID NO: 515314 - RNA, 14 nt, Homo sapiens
aacugaagcccaca

SEQ ID NO: 515315 - RNA, 15 nt, Homo sapiens
aacugccccaucucc

SEQ ID NO: 515316 - RNA, 18 nt, Homo sapiens
aacuguaaaauacuucuu

SEQ ID NO: 515317 - RNA, 15 nt, Homo sapiens
aacuguacuguguuu

SEQ ID NO: 515318 - RNA, 22 nt, Homo sapiens
aacugugacauuccacagaguu

SEQ ID NO: 515319 - RNA, 16 nt, Homo sapiens
aacuguuccuuggucu

SEQ ID NO: 515320 - RNA, 23 nt, Homo sapiens
aacuuaauuaccuaagagccaca

SEQ ID NO: 515321 - RNA, 22 nt, Homo sapiens
aacuucagauugaaccauucau

SEQ ID NO: 515322 - RNA, 22 nt, Homo sapiens
aacuucaggaaagcagcaguuu

SEQ ID NO: 515323 - RNA, 14 nt, Homo sapiens
aacuuggugccuaa

SEQ ID NO: 515324 - RNA, 19 nt, Homo sapiens
aacuuuuccuggacacuuu

SEQ ID NO: 515325 - RNA, 15 nt, Homo sapiens
aagaaaaagguuuaa

SEQ ID NO: 515326 - RNA, 15 nt, Homo sapiens
aagaaagauugcuau

SEQ ID NO: 515327 - RNA, 16 nt, Homo sapiens
aagaaagauugcuaua

SEQ ID NO: 515328 - RNA, 23 nt, Homo sapiens
aagaaauggcuuuccacaucccc

SEQ ID NO: 515329 - RNA, 18 nt, Homo sapiens
aagaagacucaguaugcu

SEQ ID NO: 515330 - RNA, 20 nt, Homo sapiens
aagacgaggcggcaaagauc

SEQ ID NO: 515331 - RNA, 21 nt, Homo sapiens
aagagaaacacuaauggccaa

SEQ ID NO: 515332 - RNA, 21 nt, Homo sapiens
aagagaguggaagaacugcaa

SEQ ID NO: 515333 - RNA, 23 nt, Homo sapiens
aagaguucuccuuguacuugaau

SEQ ID NO: 515334 - RNA, 21 nt, Homo sapiens
aagauagguucugcuuucuga

SEQ ID NO: 515335 - RNA, 16 nt, Homo sapiens
aagauccugucuugcu

SEQ ID NO: 515336 - RNA, 15 nt, Homo sapiens
aagaugaagguuuaa

SEQ ID NO: 515337 - RNA, 14 nt, Homo sapiens
aagcagacacacac

SEQ ID NO: 515338 - RNA, 18 nt, Homo sapiens
aagcaguauauauucuuu

SEQ ID NO: 515339 - RNA, 12 nt, Homo sapiens
aagcagugcagu

SEQ ID NO: 515340 - RNA, 20 nt, Homo sapiens
aagcauuugacuuucugucu

SEQ ID NO: 515341 - RNA, 17 nt, Homo sapiens
aagccaggguccugagu

SEQ ID NO: 515342 - RNA, 19 nt, Homo sapiens
aagccaggguccugagugg

SEQ ID NO: 515343 - RNA, 12 nt, Homo sapiens
aagccaggguuc

SEQ ID NO: 515344 - RNA, 15 nt, Homo sapiens
aagccaguccagaag

SEQ ID NO: 515345 - RNA, 15 nt, Homo sapiens
aagccuuccucaaga

SEQ ID NO: 515346 - RNA, 15 nt, Homo sapiens
aagcucagcuuagaa

SEQ ID NO: 515347 - RNA, 22 nt, Homo sapiens
aagcugucgccgcuagucuuau

SEQ ID NO: 515348 - RNA, 18 nt, Homo sapiens
aagcuuuggaagcagcaa

SEQ ID NO: 515349 - RNA, 15 nt, Homo sapiens
aaggcacacugagca

SEQ ID NO: 515350 - RNA, 12 nt, Homo sapiens
aaggcagugcag

SEQ ID NO: 515351 - RNA, 13 nt, Homo sapiens
aaggccauucuuu

SEQ ID NO: 515352 - RNA, 17 nt, Homo sapiens
aaggcugcuguguagcu

SEQ ID NO: 515353 - RNA, 20 nt, Homo sapiens
aagggaagcccugacaacaa

SEQ ID NO: 515354 - RNA, 23 nt, Homo sapiens
aagggacuuuggaauucugcuuc

SEQ ID NO: 515355 - RNA, 17 nt, Homo sapiens
aagggcauuuuggcucc

SEQ ID NO: 515356 - RNA, 22 nt, Homo sapiens
aagggcgcugagggcaggguuc

SEQ ID NO: 515357 - RNA, 20 nt, Homo sapiens
aagggugccuggcugggcuu

SEQ ID NO: 515358 - RNA, 16 nt, Homo sapiens
aagguauugagacaua

SEQ ID NO: 515359 - RNA, 21 nt, Homo sapiens
aaggucugaacccuuccacca

SEQ ID NO: 515360 - RNA, 14 nt, Homo sapiens
aaggucuugccuga

SEQ ID NO: 515361 - RNA, 20 nt, Homo sapiens
aaggucuugccugaauccau

SEQ ID NO: 515362 - RNA, 18 nt, Homo sapiens
aaggugaugaauuuacca

SEQ ID NO: 515363 - RNA, 16 nt, Homo sapiens
aagguuucacuguuca

SEQ ID NO: 515364 - RNA, 14 nt, Homo sapiens
aaguagaauucuua

SEQ ID NO: 515365 - RNA, 16 nt, Homo sapiens
aaguagacauggaauu

SEQ ID NO: 515366 - RNA, 15 nt, Homo sapiens
aaguagugucauuca

SEQ ID NO: 515367 - RNA, 13 nt, Homo sapiens
aagucuuacuguu

SEQ ID NO: 515368 - RNA, 14 nt, Homo sapiens
aagugaugugauuu

SEQ ID NO: 515369 - RNA, 14 nt, Homo sapiens
aaguggacuguauu

SEQ ID NO: 515370 - RNA, 16 nt, Homo sapiens
aaguguuuuuacauau

SEQ ID NO: 515371 - RNA, 13 nt, Homo sapiens
aaguugcaguuuu

SEQ ID NO: 515372 - RNA, 16 nt, Homo sapiens
aaguuggagugcagug

SEQ ID NO: 515373 - RNA, 19 nt, Homo sapiens
aaguugucuuacacuucuc

SEQ ID NO: 515374 - RNA, 14 nt, Homo sapiens
aaguuuuacuugau

SEQ ID NO: 515375 - RNA, 21 nt, Homo sapiens
aaguuuuauaaaagacaugaa

SEQ ID NO: 515376 - RNA, 13 nt, Homo sapiens
aauaaaaccagaa

SEQ ID NO: 515377 - RNA, 18 nt, Homo sapiens
aauaacccugaaucagag

SEQ ID NO: 515378 - RNA, 17 nt, Homo sapiens
aauaacugagcacuuug

SEQ ID NO: 515379 - RNA, 17 nt, Homo sapiens
aauaaugcuuaacauaa

SEQ ID NO: 515380 - RNA, 16 nt, Homo sapiens
aauacagcauuucuuu

SEQ ID NO: 515381 - RNA, 16 nt, Homo sapiens
aauacaguacaguacu

SEQ ID NO: 515382 - RNA, 16 nt, Homo sapiens
aauacaucauauguua

SEQ ID NO: 515383 - RNA, 18 nt, Homo sapiens
aauacaugaugauuucag

SEQ ID NO: 515384 - RNA, 13 nt, Homo sapiens
aauacccacugcc

SEQ ID NO: 515385 - RNA, 21 nt, Homo sapiens
aauaggcaaacuuuuaugcag

SEQ ID NO: 515386 - RNA, 18 nt, Homo sapiens
aauauacacuuuacauuc

SEQ ID NO: 515387 - RNA, 15 nt, Homo sapiens
aauaucgaguuccgg

SEQ ID NO: 515388 - RNA, 23 nt, Homo sapiens
aaucaagucugugaaagucuccu

SEQ ID NO: 515389 - RNA, 16 nt, Homo sapiens
aauccaucaggacuug

SEQ ID NO: 515390 - RNA, 15 nt, Homo sapiens
aauccaugugcugcu

SEQ ID NO: 515391 - RNA, 22 nt, Homo sapiens
aauccuaacauuauauucccaa

SEQ ID NO: 515392 - RNA, 22 nt, Homo sapiens
aaucuagagcuaugcacaccaa

SEQ ID NO: 515393 - RNA, 15 nt, Homo sapiens
aaugaaauacuugac

SEQ ID NO: 515394 - RNA, 19 nt, Homo sapiens
aaugaaauauaaacuguga

SEQ ID NO: 515395 - RNA, 21 nt, Homo sapiens
aaugaauugccuuugauaauu

SEQ ID NO: 515396 - RNA, 13 nt, Homo sapiens
aaugaggcacaug

SEQ ID NO: 515397 - RNA, 13 nt, Homo sapiens
aaugagugauaaa

SEQ ID NO: 515398 - RNA, 19 nt, Homo sapiens
aaugauacuugguccuuaa

SEQ ID NO: 515399 - RNA, 17 nt, Homo sapiens
aaugauaugucuuuaaa

SEQ ID NO: 515400 - RNA, 16 nt, Homo sapiens
aaugcaauuugauaau

SEQ ID NO: 515401 - RNA, 19 nt, Homo sapiens
gaucuugagcaaggcaaga

SEQ ID NO: 515402 - RNA, 15 nt, Homo sapiens
gaugaaggggccaga

SEQ ID NO: 515403 - RNA, 16 nt, Homo sapiens
gaugagaggaaaucac

SEQ ID NO: 515404 - RNA, 13 nt, Homo sapiens
gaugcaugcaggg

SEQ ID NO: 515405 - RNA, 15 nt, Homo sapiens
gaugcccaguaucau

SEQ ID NO: 515406 - RNA, 17 nt, Homo sapiens
gauuagugucuaaggaa

SEQ ID NO: 515407 - RNA, 22 nt, Homo sapiens
gauucaaauaacccugaaucag

SEQ ID NO: 515408 - RNA, 11 nt, Homo sapiens
gauucaaugug

SEQ ID NO: 515409 - RNA, 19 nt, Homo sapiens
gauuccagcagugaaugcu

SEQ ID NO: 515410 - RNA, 22 nt, Homo sapiens
gauucucccuuuaugaagcugc

SEQ ID NO: 515411 - RNA, 19 nt, Homo sapiens
gauugagcagaacccagac

SEQ ID NO: 515412 - RNA, 18 nt, Homo sapiens
gauuggguaucaaaauga

SEQ ID NO: 515413 - RNA, 15 nt, Homo sapiens
gauuugcaacacugc

SEQ ID NO: 515414 - RNA, 23 nt, Homo sapiens
gauuuuauguuuaaaauggcauu

SEQ ID NO: 515415 - RNA, 13 nt, Homo sapiens
gcaaagcaguaug

SEQ ID NO: 515416 - RNA, 15 nt, Homo sapiens
gcaaaggugccucau

SEQ ID NO: 515417 - RNA, 20 nt, Homo sapiens
gcaaauuaauuggcagcaga

SEQ ID NO: 515418 - RNA, 15 nt, Homo sapiens
gcaacaaacucaaaa

SEQ ID NO: 515419 - RNA, 16 nt, Homo sapiens
gcaaccagagcacugu

SEQ ID NO: 515420 - RNA, 18 nt, Homo sapiens
gcaaccagagcacuguau

SEQ ID NO: 515421 - RNA, 19 nt, Homo sapiens
gcaagaagugggauucagg

SEQ ID NO: 515422 - RNA, 18 nt, Homo sapiens
gcaagcucuucauugcac

SEQ ID NO: 515423 - RNA, 14 nt, Homo sapiens
gcaauaaguugaau

SEQ ID NO: 515424 - RNA, 20 nt, Homo sapiens
gcaauaaguugaaugauaau

SEQ ID NO: 515425 - RNA, 13 nt, Homo sapiens
gcaauaauugaca

SEQ ID NO: 515426 - RNA, 21 nt, Homo sapiens
gcaauagcgcucccuuuucac

SEQ ID NO: 515427 - RNA, 16 nt, Homo sapiens
gcaauuuacuuggaau

SEQ ID NO: 515428 - RNA, 14 nt, Homo sapiens
gcacacaacugugg

SEQ ID NO: 515429 - RNA, 21 nt, Homo sapiens
gcacagacaugguuucaggua

SEQ ID NO: 515430 - RNA, 17 nt, Homo sapiens
gcaccagccugagccac

SEQ ID NO: 515431 - RNA, 22 nt, Homo sapiens
gcacccucugcuaugucuguga

SEQ ID NO: 515432 - RNA, 16 nt, Homo sapiens
gcacccuguucccucu

SEQ ID NO: 515433 - RNA, 12 nt, Homo sapiens
gcacggcagcuu

SEQ ID NO: 515434 - RNA, 19 nt, Homo sapiens
gcacuaucuuucaggaaau

SEQ ID NO: 515435 - RNA, 20 nt, Homo sapiens
gcacucaggagcacagccau

SEQ ID NO: 515436 - RNA, 12 nt, Homo sapiens
gcacugcaguua

SEQ ID NO: 515437 - RNA, 17 nt, Homo sapiens
gcacuguauccaaguua

SEQ ID NO: 515438 - RNA, 21 nt, Homo sapiens
gcacuuuacagaugagauucc

SEQ ID NO: 515439 - RNA, 17 nt, Homo sapiens
gcagaaaacauuguucc

SEQ ID NO: 515440 - RNA, 23 nt, Homo sapiens
gcagagaccuugcgaccaugugu

SEQ ID NO: 515441 - RNA, 19 nt, Homo sapiens
gcagcaccuccgggacuga

SEQ ID NO: 515442 - RNA, 15 nt, Homo sapiens
gcagcagcagcagca

SEQ ID NO: 515443 - RNA, 19 nt, Homo sapiens
gcagcagcuuuugacuguu

SEQ ID NO: 515444 - RNA, 21 nt, Homo sapiens
gcagccccuccccauggugca

SEQ ID NO: 515445 - RNA, 22 nt, Homo sapiens
gcagccugcagaccacacucug

SEQ ID NO: 515446 - RNA, 12 nt, Homo sapiens
gcagcuagacac

SEQ ID NO: 515447 - RNA, 13 nt, Homo sapiens
gcagcuagacacc

SEQ ID NO: 515448 - RNA, 18 nt, Homo sapiens
gcagguagugggugaaug

SEQ ID NO: 515449 - RNA, 20 nt, Homo sapiens
gcaguaaaguuccaugaaga

SEQ ID NO: 515450 - RNA, 13 nt, Homo sapiens
gcaguagugucac

SEQ ID NO: 515451 - RNA, 17 nt, Homo sapiens
gcagugaaguacucagu

SEQ ID NO: 515452 - RNA, 17 nt, Homo sapiens
gcagugcaauacucagu

SEQ ID NO: 515453 - RNA, 20 nt, Homo sapiens
gcaguggggagcgggggcua

SEQ ID NO: 515454 - RNA, 12 nt, Homo sapiens
gcaucaguauuu

SEQ ID NO: 515455 - RNA, 12 nt, Homo sapiens
gcaucuguguaa

SEQ ID NO: 515456 - RNA, 15 nt, Homo sapiens
gcauguugccaugag

SEQ ID NO: 515457 - RNA, 18 nt, Homo sapiens
gcauucauucauccucuu

SEQ ID NO: 515458 - RNA, 20 nt, Homo sapiens
gcauucugggguggggcuug

SEQ ID NO: 515459 - RNA, 19 nt, Homo sapiens
gccacaagggcaguggaag

SEQ ID NO: 515460 - RNA, 14 nt, Homo sapiens
gccacgacauggcu

SEQ ID NO: 515461 - RNA, 13 nt, Homo sapiens
gccagacaugcca

SEQ ID NO: 515462 - RNA, 22 nt, Homo sapiens
gccagacgugcuccugcugacc

SEQ ID NO: 515463 - RNA, 14 nt, Homo sapiens
gccaggaccauggc

SEQ ID NO: 515464 - RNA, 19 nt, Homo sapiens
gccaggcucccacugcccc

SEQ ID NO: 515465 - RNA, 15 nt, Homo sapiens
gccagggcagaggaa

SEQ ID NO: 515466 - RNA, 14 nt, Homo sapiens
gccagggcucagau

SEQ ID NO: 515467 - RNA, 12 nt, Homo sapiens
gccaucaagaaa

SEQ ID NO: 515468 - RNA, 23 nt, Homo sapiens
gccaugaggccuuuccccagugu

SEQ ID NO: 515469 - RNA, 19 nt, Homo sapiens
gccauuuuuugucugugau

SEQ ID NO: 515470 - RNA, 22 nt, Homo sapiens
gccauuuuuugucugugauaac

SEQ ID NO: 515471 - RNA, 12 nt, Homo sapiens
gcccagaacggg

SEQ ID NO: 515472 - RNA, 18 nt, Homo sapiens
gccccaggggcacugugu

SEQ ID NO: 515473 - RNA, 12 nt, Homo sapiens
gccccaugggcc

SEQ ID NO: 515474 - RNA, 22 nt, Homo sapiens
gcccccacaggagcguguacua

SEQ ID NO: 515475 - RNA, 22 nt, Homo sapiens
gcccccacuggagcguguacua

SEQ ID NO: 515476 - RNA, 22 nt, Homo sapiens
gcccccaggacccccccagucc

SEQ ID NO: 515477 - RNA, 12 nt, Homo sapiens
gccccugccuga

SEQ ID NO: 515478 - RNA, 13 nt, Homo sapiens
gcccgccaccuug

SEQ ID NO: 515479 - RNA, 18 nt, Homo sapiens
gcccucaacccugugauc

SEQ ID NO: 515480 - RNA, 21 nt, Homo sapiens
gcccugcaccuugggcacggg

SEQ ID NO: 515481 - RNA, 22 nt, Homo sapiens
gcccuggggucucugagcagug

SEQ ID NO: 515482 - RNA, 17 nt, Homo sapiens
gccgauauaagccauag

SEQ ID NO: 515483 - RNA, 16 nt, Homo sapiens
gccgucucugauucuc

SEQ ID NO: 515484 - RNA, 23 nt, Homo sapiens
gccuacuggaugcuuacagugac

SEQ ID NO: 515485 - RNA, 22 nt, Homo sapiens
gccucccuggggaccaggagcu

SEQ ID NO: 515486 - RNA, 23 nt, Homo sapiens
gccugaugauggaagggccuucu

SEQ ID NO: 515487 - RNA, 13 nt, Homo sapiens
gccugauggccag

SEQ ID NO: 515488 - RNA, 19 nt, Homo sapiens
gccuggauuccagcaguga

SEQ ID NO: 515489 - RNA, 15 nt, Homo sapiens
gccuggcuucuggga

SEQ ID NO: 515490 - RNA, 23 nt, Homo sapiens
gccuucuccacagggacacaguc

SEQ ID NO: 515491 - RNA, 17 nt, Homo sapiens
aauguacaguauucaau

SEQ ID NO: 515492 - RNA, 15 nt, Homo sapiens
aauguauaaugggaa

SEQ ID NO: 515493 - RNA, 23 nt, Homo sapiens
aaugugaaaaaaaaaaguaauua

SEQ ID NO: 515494 - RNA, 11 nt, Homo sapiens
aaugugccaaa

SEQ ID NO: 515495 - RNA, 18 nt, Homo sapiens
aaugugcucuacaucucg

SEQ ID NO: 515496 - RNA, 17 nt, Homo sapiens
aauguugaaacugacuu

SEQ ID NO: 515497 - RNA, 15 nt, Homo sapiens
aauuaaagcagcaaa

SEQ ID NO: 515498 - RNA, 14 nt, Homo sapiens
aauuaucuuggaaa

SEQ ID NO: 515499 - RNA, 16 nt, Homo sapiens
aauuaugucaaaugga

SEQ ID NO: 515500 - RNA, 19 nt, Homo sapiens
aauucauugucucagugaa

SEQ ID NO: 515501 - RNA, 20 nt, Homo sapiens
aauucuaugauuaaacuggg

SEQ ID NO: 515502 - RNA, 20 nt, Homo sapiens
aauucugcuucucuuucaca

SEQ ID NO: 515503 - RNA, 23 nt, Homo sapiens
aauugaagagagauauaucugaa

SEQ ID NO: 515504 - RNA, 18 nt, Homo sapiens
aauugcauuuauuuauca

SEQ ID NO: 515505 - RNA, 19 nt, Homo sapiens
aauugcuccauuccugagu

SEQ ID NO: 515506 - RNA, 20 nt, Homo sapiens
aauuggcugccaagagucca

SEQ ID NO: 515507 - RNA, 13 nt, Homo sapiens
aauuguaaugcau

SEQ ID NO: 515508 - RNA, 22 nt, Homo sapiens
aauugugcuuuacaacuugaau

SEQ ID NO: 515509 - RNA, 22 nt, Homo sapiens
aauuuaccaucaaacaaaucau

SEQ ID NO: 515510 - RNA, 18 nt, Homo sapiens
aauuuagaaugaauauua

SEQ ID NO: 515511 - RNA, 22 nt, Homo sapiens
aauuuaggaaugcucaaugugc

SEQ ID NO: 515512 - RNA, 20 nt, Homo sapiens
aauuuaucacugcgcauguu

SEQ ID NO: 515513 - RNA, 16 nt, Homo sapiens
aauuuaugaagauagu

SEQ ID NO: 515514 - RNA, 20 nt, Homo sapiens
acaaaaggcuggaugugcuu

SEQ ID NO: 515515 - RNA, 18 nt, Homo sapiens
acaaaauauaaaucacag

SEQ ID NO: 515516 - RNA, 16 nt, Homo sapiens
acaaacaagauacgua

SEQ ID NO: 515517 - RNA, 18 nt, Homo sapiens
acaaaucauuuugaugua

SEQ ID NO: 515518 - RNA, 20 nt, Homo sapiens
acaaaugauuucgugacugu

SEQ ID NO: 515519 - RNA, 15 nt, Homo sapiens
acaaauguaacacac

SEQ ID NO: 515520 - RNA, 22 nt, Homo sapiens
acaaauuagucuguagaaucua

SEQ ID NO: 515521 - RNA, 21 nt, Homo sapiens
acaaccacauuucuggccauu

SEQ ID NO: 515522 - RNA, 14 nt, Homo sapiens
acaaccauguucuu

SEQ ID NO: 515523 - RNA, 23 nt, Homo sapiens
acaaccuccuccuccaguucuga

SEQ ID NO: 515524 - RNA, 14 nt, Homo sapiens
acaacuuccagauu

SEQ ID NO: 515525 - RNA, 13 nt, Homo sapiens
acaacuugccaaa

SEQ ID NO: 515526 - RNA, 13 nt, Homo sapiens
acaagacuucaaa

SEQ ID NO: 515527 - RNA, 23 nt, Homo sapiens
acaagaucacaagucagcacuac

SEQ ID NO: 515528 - RNA, 13 nt, Homo sapiens
acaagauuguaaa

SEQ ID NO: 515529 - RNA, 21 nt, Homo sapiens
acaauaaaagaaacugugguc

SEQ ID NO: 515530 - RNA, 18 nt, Homo sapiens
acaauaggcuuagugcuu

SEQ ID NO: 515531 - RNA, 18 nt, Homo sapiens
acaaucguauuacauaaa

SEQ ID NO: 515532 - RNA, 21 nt, Homo sapiens
acaauguuuuuuauacuucaa

SEQ ID NO: 515533 - RNA, 14 nt, Homo sapiens
acacacacauauau

SEQ ID NO: 515534 - RNA, 16 nt, Homo sapiens
acacaccacgcgucac

SEQ ID NO: 515535 - RNA, 14 nt, Homo sapiens
acacaccugaauaa

SEQ ID NO: 515536 - RNA, 19 nt, Homo sapiens
acacagacucugugagauu

SEQ ID NO: 515537 - RNA, 17 nt, Homo sapiens
acacagcaugcauuuag

SEQ ID NO: 515538 - RNA, 13 nt, Homo sapiens
acacagugcagug

SEQ ID NO: 515539 - RNA, 20 nt, Homo sapiens
acacauaauuaaagugucca

SEQ ID NO: 515540 - RNA, 15 nt, Homo sapiens
acacgggcucaagga

SEQ ID NO: 515541 - RNA, 13 nt, Homo sapiens
acacucaccauuu

SEQ ID NO: 515542 - RNA, 15 nt, Homo sapiens
acacucaccauuuaa

SEQ ID NO: 515543 - RNA, 21 nt, Homo sapiens
acacucaccauuuaaucauuu

SEQ ID NO: 515544 - RNA, 11 nt, Homo sapiens
acacugucaag

SEQ ID NO: 515545 - RNA, 22 nt, Homo sapiens
acagaaauccacgcucaaucuc

SEQ ID NO: 515546 - RNA, 15 nt, Homo sapiens
acagaccuccagauu

SEQ ID NO: 515547 - RNA, 15 nt, Homo sapiens
acagacucugugaga

SEQ ID NO: 515548 - RNA, 22 nt, Homo sapiens
acagagcugagcauuggugaca

SEQ ID NO: 515549 - RNA, 20 nt, Homo sapiens
acagaggauggcuuccccau

SEQ ID NO: 515550 - RNA, 20 nt, Homo sapiens
acagaggccgggguccaggc

SEQ ID NO: 515551 - RNA, 17 nt, Homo sapiens
acagaguggaucuggag

SEQ ID NO: 515552 - RNA, 15 nt, Homo sapiens
acagaguuacugcca

SEQ ID NO: 515553 - RNA, 20 nt, Homo sapiens
acagauauacucgaaucaga

SEQ ID NO: 515554 - RNA, 19 nt, Homo sapiens
acagaucuugagcaaggca

SEQ ID NO: 515555 - RNA, 21 nt, Homo sapiens
acagaugguguccugcaugua

SEQ ID NO: 515556 - RNA, 20 nt, Homo sapiens
acagauuuccaaaaguacua

SEQ ID NO: 515557 - RNA, 19 nt, Homo sapiens
acagcacauuuguuaauga

SEQ ID NO: 515558 - RNA, 16 nt, Homo sapiens
acagccugcacagugg

SEQ ID NO: 515559 - RNA, 18 nt, Homo sapiens
acagcuguauuaucuuaa

SEQ ID NO: 515560 - RNA, 22 nt, Homo sapiens
acagcuucacuuaaaaucaaau

SEQ ID NO: 515561 - RNA, 15 nt, Homo sapiens
acaggagcauguccu

SEQ ID NO: 515562 - RNA, 15 nt, Homo sapiens
acaggagcguguacu

SEQ ID NO: 515563 - RNA, 17 nt, Homo sapiens
acaggagcguguacuac

SEQ ID NO: 515564 - RNA, 21 nt, Homo sapiens
acaggagcguguacuacccca

SEQ ID NO: 515565 - RNA, 22 nt, Homo sapiens
acaggagcguguacuaccccag

SEQ ID NO: 515566 - RNA, 15 nt, Homo sapiens
acaggagcguguccu

SEQ ID NO: 515567 - RNA, 20 nt, Homo sapiens
acaggccugauaacucugua

SEQ ID NO: 515568 - RNA, 13 nt, Homo sapiens
acaggcugagaca

SEQ ID NO: 515569 - RNA, 16 nt, Homo sapiens
acagggacacagucug

SEQ ID NO: 515570 - RNA, 16 nt, Homo sapiens
acaggggaucauguua

SEQ ID NO: 515571 - RNA, 23 nt, Homo sapiens
acaggugcccuuucucuuaccac

SEQ ID NO: 515572 - RNA, 17 nt, Homo sapiens
acaguacaguacucagu

SEQ ID NO: 515573 - RNA, 19 nt, Homo sapiens
acaguacucaggcagugca

SEQ ID NO: 515574 - RNA, 23 nt, Homo sapiens
acaguacucaguuaggcagugca

SEQ ID NO: 515575 - RNA, 20 nt, Homo sapiens
acaguagcauacugaugaga

SEQ ID NO: 515576 - RNA, 12 nt, Homo sapiens
acaguauuucca

SEQ ID NO: 515577 - RNA, 23 nt, Homo sapiens
acaguauuuccauacgugcccau

SEQ ID NO: 515578 - RNA, 17 nt, Homo sapiens
acagugcaguacucagu

SEQ ID NO: 515579 - RNA, 11 nt, Homo sapiens
acagugcagug

SEQ ID NO: 515580 - RNA, 20 nt, Homo sapiens
acaguggcaguauugacaau

SEQ ID NO: 515581 - RNA, 21 nt, Homo sapiens
acagugguauugcuaguuuaa

SEQ ID NO: 515582 - RNA, 17 nt, Homo sapiens
acaguuggaacaguaau

SEQ ID NO: 515583 - RNA, 15 nt, Homo sapiens
acauaaaaaagggac

SEQ ID NO: 515584 - RNA, 16 nt, Homo sapiens
acauaaacuuguacuu

SEQ ID NO: 515585 - RNA, 18 nt, Homo sapiens
acauaacaggcauugcac

SEQ ID NO: 515586 - RNA, 17 nt, Homo sapiens
acauacgcacugggcau

SEQ ID NO: 515587 - RNA, 23 nt, Homo sapiens
acauauaugugucccauaaucug

SEQ ID NO: 515588 - RNA, 18 nt, Homo sapiens
acauauuacuggaaguaa

SEQ ID NO: 515589 - RNA, 23 nt, Homo sapiens
acaucaguccacccccauuguga

SEQ ID NO: 515590 - RNA, 12 nt, Homo sapiens
acaucucuucau

SEQ ID NO: 515591 - RNA, 19 nt, Homo sapiens
acaugccuugaaaccagaa

SEQ ID NO: 515592 - RNA, 18 nt, Homo sapiens
acaugguaucucuuucuc

SEQ ID NO: 515593 - RNA, 13 nt, Homo sapiens
acauguacagaga

SEQ ID NO: 515594 - RNA, 19 nt, Homo sapiens
acauuaauugaggcuuaca

SEQ ID NO: 515595 - RNA, 17 nt, Homo sapiens
acauucacuacugcaaa

SEQ ID NO: 515596 - RNA, 23 nt, Homo sapiens
acauuggcagugugucacacuga

SEQ ID NO: 515597 - RNA, 14 nt, Homo sapiens
aucacuuaccacuu

SEQ ID NO: 515598 - RNA, 20 nt, Homo sapiens
aucagaaaauccugacaaaa

SEQ ID NO: 515599 - RNA, 14 nt, Homo sapiens
aucagaaagacauu

SEQ ID NO: 515600 - RNA, 20 nt, Homo sapiens
aucaguuugcuaacauauuu

SEQ ID NO: 515601 - RNA, 22 nt, Homo sapiens
aucauaaagagcacguuuucca

SEQ ID NO: 515602 - RNA, 18 nt, Homo sapiens
auccaacuggaaggcuuu

SEQ ID NO: 515603 - RNA, 21 nt, Homo sapiens
auccaagaccuuacaaccaca

SEQ ID NO: 515604 - RNA, 17 nt, Homo sapiens
auccacaguauuguucu

SEQ ID NO: 515605 - RNA, 19 nt, Homo sapiens
auccacgcucaaucucagg

SEQ ID NO: 515606 - RNA, 16 nt, Homo sapiens
auccagagagaagcac

SEQ ID NO: 515607 - RNA, 18 nt, Homo sapiens
auccagaggguugugauu

SEQ ID NO: 515608 - RNA, 15 nt, Homo sapiens
auccauaucagcucu

SEQ ID NO: 515609 - RNA, 19 nt, Homo sapiens
auccaugugacucaagccu

SEQ ID NO: 515610 - RNA, 23 nt, Homo sapiens
auccaugugcugcuguggcauca

SEQ ID NO: 515611 - RNA, 20 nt, Homo sapiens
aucccaagucaaacagugug

SEQ ID NO: 515612 - RNA, 18 nt, Homo sapiens
aucccucggucagcaccg

SEQ ID NO: 515613 - RNA, 21 nt, Homo sapiens
aucccuggccaccugccaggc

SEQ ID NO: 515614 - RNA, 21 nt, Homo sapiens
auccuccuucacucccuguca

SEQ ID NO: 515615 - RNA, 18 nt, Homo sapiens
aucgcuacuggcaucugu

SEQ ID NO: 515616 - RNA, 21 nt, Homo sapiens
aucuaccaacccugugcauga

SEQ ID NO: 515617 - RNA, 18 nt, Homo sapiens
aucuagcauagcacaaac

SEQ ID NO: 515618 - RNA, 17 nt, Homo sapiens
aucuaguaugcauuucu

SEQ ID NO: 515619 - RNA, 21 nt, Homo sapiens
aucuauuuaucugucugagcc

SEQ ID NO: 515620 - RNA, 16 nt, Homo sapiens
aucucagcaaucacaa

SEQ ID NO: 515621 - RNA, 12 nt, Homo sapiens
aucucaggucuu

SEQ ID NO: 515622 - RNA, 19 nt, Homo sapiens
aucucagguggcauuugca

SEQ ID NO: 515623 - RNA, 19 nt, Homo sapiens
aucuccacccugagccuga

SEQ ID NO: 515624 - RNA, 20 nt, Homo sapiens
aucuccacccugagccugac

SEQ ID NO: 515625 - RNA, 21 nt, Homo sapiens
aucuccagccaauuucaaaga

SEQ ID NO: 515626 - RNA, 22 nt, Homo sapiens
aucugagcuuaaacauuuucuc

SEQ ID NO: 515627 - RNA, 20 nt, Homo sapiens
aucugcauaaccgcacagac

SEQ ID NO: 515628 - RNA, 17 nt, Homo sapiens
aucugucuuuaugauuu

SEQ ID NO: 515629 - RNA, 17 nt, Homo sapiens
aucuuaggauuuaccaa

SEQ ID NO: 515630 - RNA, 24 nt, Homo sapiens
aucuuauuugucaguguagaucaa

SEQ ID NO: 515631 - RNA, 17 nt, Homo sapiens
aucuuuugugaaauuau

SEQ ID NO: 515632 - RNA, 20 nt, Homo sapiens
augaaauugagucauuuuau

SEQ ID NO: 515633 - RNA, 12 nt, Homo sapiens
augaacauacug

SEQ ID NO: 515634 - RNA, 23 nt, Homo sapiens
augaaugaaauauaaacugugag

SEQ ID NO: 515635 - RNA, 14 nt, Homo sapiens
augagauuggaaaa

SEQ ID NO: 515636 - RNA, 20 nt, Homo sapiens
augagcaugcucccucaugc

SEQ ID NO: 515637 - RNA, 18 nt, Homo sapiens
augagucacuuacuucau

SEQ ID NO: 515638 - RNA, 15 nt, Homo sapiens
augauaaauuugacu

SEQ ID NO: 515639 - RNA, 19 nt, Homo sapiens
augauacuugguccuuaaa

SEQ ID NO: 515640 - RNA, 14 nt, Homo sapiens
augcaauuugauaa

SEQ ID NO: 515641 - RNA, 14 nt, Homo sapiens
augcaccagugccg

SEQ ID NO: 515642 - RNA, 19 nt, Homo sapiens
augcagggcccccacagga

SEQ ID NO: 515643 - RNA, 23 nt, Homo sapiens
augccaauuucucuuaaguacug

SEQ ID NO: 515644 - RNA, 21 nt, Homo sapiens
augccccuggcccugccucac

SEQ ID NO: 515645 - RNA, 10 nt, Homo sapiens
augcccuccc

SEQ ID NO: 515646 - RNA, 16 nt, Homo sapiens
augccuccagguuuau

SEQ ID NO: 515647 - RNA, 15 nt, Homo sapiens
augccuuuccagugc

SEQ ID NO: 515648 - RNA, 23 nt, Homo sapiens
augcuaucucgcuagccauauau

SEQ ID NO: 515649 - RNA, 13 nt, Homo sapiens
augcucaguauug

SEQ ID NO: 515650 - RNA, 16 nt, Homo sapiens
augcugugcagcacuu

SEQ ID NO: 515651 - RNA, 14 nt, Homo sapiens
augcuuacagugac

SEQ ID NO: 515652 - RNA, 17 nt, Homo sapiens
augcuugguuguugcag

SEQ ID NO: 515653 - RNA, 13 nt, Homo sapiens
auggaucugcaua

SEQ ID NO: 515654 - RNA, 16 nt, Homo sapiens
auggcucggccaggca

SEQ ID NO: 515655 - RNA, 17 nt, Homo sapiens
auggcugggaacaugac

SEQ ID NO: 515656 - RNA, 17 nt, Homo sapiens
auggcuuguucagucac

SEQ ID NO: 515657 - RNA, 15 nt, Homo sapiens
augggccaagccagg

SEQ ID NO: 515658 - RNA, 21 nt, Homo sapiens
augggccaagccaggguucca

SEQ ID NO: 515659 - RNA, 14 nt, Homo sapiens
augggccagcccuu

SEQ ID NO: 515660 - RNA, 18 nt, Homo sapiens
augggguuguuagcuuuu

SEQ ID NO: 515661 - RNA, 17 nt, Homo sapiens
augggugugccaggcua

SEQ ID NO: 515662 - RNA, 20 nt, Homo sapiens
auguaagggucauuagacaa

SEQ ID NO: 515663 - RNA, 17 nt, Homo sapiens
auguacaggcugagaca

SEQ ID NO: 515664 - RNA, 22 nt, Homo sapiens
auguacccagccuaccagagau

SEQ ID NO: 515665 - RNA, 23 nt, Homo sapiens
augucauuuucagauccuuccaa

SEQ ID NO: 515666 - RNA, 14 nt, Homo sapiens
augucuuuaaaaug

SEQ ID NO: 515667 - RNA, 19 nt, Homo sapiens
augucuuuaaaaugauuca

SEQ ID NO: 515668 - RNA, 14 nt, Homo sapiens
augugcauguuuua

SEQ ID NO: 515669 - RNA, 18 nt, Homo sapiens
augugcgaacacagugac

SEQ ID NO: 515670 - RNA, 21 nt, Homo sapiens
auguguccgugaaaguuguga

SEQ ID NO: 515671 - RNA, 19 nt, Homo sapiens
augugucuuguauuaucau

SEQ ID NO: 515672 - RNA, 19 nt, Homo sapiens
augugugaaggucuugccu

SEQ ID NO: 515673 - RNA, 16 nt, Homo sapiens
augugugcuuggaaaa

SEQ ID NO: 515674 - RNA, 14 nt, Homo sapiens
augugugugcuuug

SEQ ID NO: 515675 - RNA, 22 nt, Homo sapiens
auguucucaauacccacugcca

SEQ ID NO: 515676 - RNA, 12 nt, Homo sapiens
auguuguaauau

SEQ ID NO: 515677 - RNA, 14 nt, Homo sapiens
auguuucuauaugu

SEQ ID NO: 515678 - RNA, 14 nt, Homo sapiens
auuaaaguguccau

SEQ ID NO: 515679 - RNA, 14 nt, Homo sapiens
auuaacccuauuaa

SEQ ID NO: 515680 - RNA, 22 nt, Homo sapiens
auuaaccuuaucauaaauucaa

SEQ ID NO: 515681 - RNA, 12 nt, Homo sapiens
auuacauaacag

SEQ ID NO: 515682 - RNA, 21 nt, Homo sapiens
auuacaucccauaacuuguca

SEQ ID NO: 515683 - RNA, 21 nt, Homo sapiens
auuacuaggguuuugccauca

SEQ ID NO: 515684 - RNA, 21 nt, Homo sapiens
auuacuguuuugggccuccau

SEQ ID NO: 515685 - RNA, 23 nt, Homo sapiens
auuagacaauguggaauuacaua

SEQ ID NO: 515686 - RNA, 21 nt, Homo sapiens
auuagauuuuaaaacuucauc

SEQ ID NO: 515687 - RNA, 18 nt, Homo sapiens
auuaggaaaguacugcau

SEQ ID NO: 515688 - RNA, 14 nt, Homo sapiens
auuauagucuguac

SEQ ID NO: 515689 - RNA, 18 nt, Homo sapiens
auuauagucuguacuuca

SEQ ID NO: 515690 - RNA, 20 nt, Homo sapiens
auuauauucccaaaucucaa

SEQ ID NO: 515691 - RNA, 23 nt, Homo sapiens
auuauauucccaaaucucaaaag

SEQ ID NO: 515692 - RNA, 22 nt, Homo sapiens
auucaaaccuaaguugcuggac

SEQ ID NO: 515693 - RNA, 15 nt, Homo sapiens
auucagaaugugcaa

SEQ ID NO: 515694 - RNA, 16 nt, Homo sapiens
auucagaccagggaac

SEQ ID NO: 515695 - RNA, 12 nt, Homo sapiens
auucagugacau

SEQ ID NO: 515696 - RNA, 18 nt, Homo sapiens
auucauauuuaugaaucu

SEQ ID NO: 515697 - RNA, 21 nt, Homo sapiens
auucaucucagcaaucacaag

SEQ ID NO: 515698 - RNA, 16 nt, Homo sapiens
auucauuagcugugau

SEQ ID NO: 515699 - RNA, 15 nt, Homo sapiens
auucauugucucagu

SEQ ID NO: 515700 - RNA, 21 nt, Homo sapiens
auuccguuaggaauaacacug

SEQ ID NO: 515701 - RNA, 18 nt, Homo sapiens
auuccugaauaauuucca

SEQ ID NO: 515702 - RNA, 21 nt, Homo sapiens
auucuauuucaacuucaggaa

SEQ ID NO: 515703 - RNA, 15 nt, Homo sapiens
auucucccuuuauga

SEQ ID NO: 515704 - RNA, 20 nt, Homo sapiens
auucugcuaauuuaugaaga

SEQ ID NO: 515705 - RNA, 16 nt, Homo sapiens
auugaaggauugugaa

SEQ ID NO: 515706 - RNA, 16 nt, Homo sapiens
auugagacacugucaa

SEQ ID NO: 515707 - RNA, 15 nt, Homo sapiens
auugaggaguugccu

SEQ ID NO: 515708 - RNA, 18 nt, Homo sapiens
auugaggaguugccugac

SEQ ID NO: 515709 - RNA, 14 nt, Homo sapiens
auugcaugccaucu

SEQ ID NO: 515710 - RNA, 22 nt, Homo sapiens
auuggaucaggaacccuuacag

SEQ ID NO: 515711 - RNA, 20 nt, Homo sapiens
auuggcaaaauuacaguuca

SEQ ID NO: 515712 - RNA, 14 nt, Homo sapiens
auuguaacagacau

SEQ ID NO: 515713 - RNA, 15 nt, Homo sapiens
caccgccagcaauaa

SEQ ID NO: 515714 - RNA, 15 nt, Homo sapiens
caccuaucuggaaaa

SEQ ID NO: 515715 - RNA, 19 nt, Homo sapiens
caccuugcccaugcacaag

SEQ ID NO: 515716 - RNA, 18 nt, Homo sapiens
cacgugugcagacugugg

SEQ ID NO: 515717 - RNA, 23 nt, Homo sapiens
cacucaaugccaggcagugcagc

SEQ ID NO: 515718 - RNA, 20 nt, Homo sapiens
cacucugaauaccaagugug

SEQ ID NO: 515719 - RNA, 21 nt, Homo sapiens
cacucuuuugagcaguaaaug

SEQ ID NO: 515720 - RNA, 15 nt, Homo sapiens
cacugcacccuccac

SEQ ID NO: 515721 - RNA, 21 nt, Homo sapiens
cacugccaaacaucagucaau

SEQ ID NO: 515722 - RNA, 14 nt, Homo sapiens
cacuguauaccccg

SEQ ID NO: 515723 - RNA, 19 nt, Homo sapiens
cacugucaagauuaaguua

SEQ ID NO: 515724 - RNA, 17 nt, Homo sapiens
cacugugaacuaaugac

SEQ ID NO: 515725 - RNA, 16 nt, Homo sapiens
cacuuauuuccaugga

SEQ ID NO: 515726 - RNA, 9 nt, Homo sapiens
cacuucuua

SEQ ID NO: 515727 - RNA, 18 nt, Homo sapiens
cacuuuuuuccugucaau

SEQ ID NO: 515728 - RNA, 21 nt, Homo sapiens
cacuuuuuuccugucaauaua

SEQ ID NO: 515729 - RNA, 17 nt, Homo sapiens
cagaaacuaagaaucau

SEQ ID NO: 515730 - RNA, 15 nt, Homo sapiens
cagaaccuagucuug

SEQ ID NO: 515731 - RNA, 18 nt, Homo sapiens
gaaaccccugacaccuuu

SEQ ID NO: 515732 - RNA, 12 nt, Homo sapiens
gaaagacaguaa

SEQ ID NO: 515733 - RNA, 15 nt, Homo sapiens
gaaagauugcuauaa

SEQ ID NO: 515734 - RNA, 15 nt, Homo sapiens
gaaagucauaguuuu

SEQ ID NO: 515735 - RNA, 18 nt, Homo sapiens
gaaagucuccuguaucau

SEQ ID NO: 515736 - RNA, 18 nt, Homo sapiens
gaaaguuuauaucuugau

SEQ ID NO: 515737 - RNA, 13 nt, Homo sapiens
gaaauaaaagccu

SEQ ID NO: 515738 - RNA, 12 nt, Homo sapiens
gaaauacauaug

SEQ ID NO: 515739 - RNA, 15 nt, Homo sapiens
gaaauauuacuauaa

SEQ ID NO: 515740 - RNA, 19 nt, Homo sapiens
gaaauauuacuauaauuga

SEQ ID NO: 515741 - RNA, 19 nt, Homo sapiens
gaaaucaauuuaaaggaaa

SEQ ID NO: 515742 - RNA, 20 nt, Homo sapiens
gaaauccaacuccaggguua

SEQ ID NO: 515743 - RNA, 20 nt, Homo sapiens
gaaauccacgcucaaucuca

SEQ ID NO: 515744 - RNA, 14 nt, Homo sapiens
gaaaucuaaucucu

SEQ ID NO: 515745 - RNA, 12 nt, Homo sapiens
gaaaugcugauu

SEQ ID NO: 515746 - RNA, 16 nt, Homo sapiens
gaaauucacaaaguua

SEQ ID NO: 515747 - RNA, 19 nt, Homo sapiens
gaaauucuauaagagacaa

SEQ ID NO: 515748 - RNA, 16 nt, Homo sapiens
gaaauuuaagcacaaa

SEQ ID NO: 515749 - RNA, 16 nt, Homo sapiens
gaaauuuacuauguaa

SEQ ID NO: 515750 - RNA, 21 nt, Homo sapiens
gaaauuuuaucucuucuuccu

SEQ ID NO: 515751 - RNA, 20 nt, Homo sapiens
gaaauuuuuuuccagaauug

SEQ ID NO: 515752 - RNA, 17 nt, Homo sapiens
gaacaaauaugauucuc

SEQ ID NO: 515753 - RNA, 12 nt, Homo sapiens
gaacacaccucu

SEQ ID NO: 515754 - RNA, 15 nt, Homo sapiens
gaaccgucaauguga

SEQ ID NO: 515755 - RNA, 15 nt, Homo sapiens
gaacgcaugcagggc

SEQ ID NO: 515756 - RNA, 16 nt, Homo sapiens
gaagaaaaacacugag

SEQ ID NO: 515757 - RNA, 12 nt, Homo sapiens
gaagaccccagg

SEQ ID NO: 515758 - RNA, 16 nt, Homo sapiens
gaagagagauauaucu

SEQ ID NO: 515759 - RNA, 17 nt, Homo sapiens
gaagagaguauggugcu

SEQ ID NO: 515760 - RNA, 18 nt, Homo sapiens
gaagagaguauggugcug

SEQ ID NO: 515761 - RNA, 17 nt, Homo sapiens
gaagagccugacugugu

SEQ ID NO: 515762 - RNA, 14 nt, Homo sapiens
gaagauaccauaag

SEQ ID NO: 515763 - RNA, 18 nt, Homo sapiens
gaagauguaagaagcuaa

SEQ ID NO: 515764 - RNA, 12 nt, Homo sapiens
gaagcagcagcu

SEQ ID NO: 515765 - RNA, 22 nt, Homo sapiens
gaagcaguagacagauguuggu

SEQ ID NO: 515766 - RNA, 17 nt, Homo sapiens
gaagccagugggguccc

SEQ ID NO: 515767 - RNA, 14 nt, Homo sapiens
gaagcccacccgcc

SEQ ID NO: 515768 - RNA, 16 nt, Homo sapiens
gaaggcagcuagacac

SEQ ID NO: 515769 - RNA, 21 nt, Homo sapiens
gaaggcagcuagacaccaaug

SEQ ID NO: 515770 - RNA, 22 nt, Homo sapiens
gaagggccuucuccacagggac

SEQ ID NO: 515771 - RNA, 23 nt, Homo sapiens
gaagggccuucuccacagggaca

SEQ ID NO: 515772 - RNA, 16 nt, Homo sapiens
gaaggggaaaaccuca

SEQ ID NO: 515773 - RNA, 15 nt, Homo sapiens
gaaggucuugccuga

SEQ ID NO: 515774 - RNA, 21 nt, Homo sapiens
gaaggucuugccugaauccau

SEQ ID NO: 515775 - RNA, 18 nt, Homo sapiens
gaaguauagaugguagaa

SEQ ID NO: 515776 - RNA, 14 nt, Homo sapiens
gaauaaaaugauua

SEQ ID NO: 515777 - RNA, 18 nt, Homo sapiens
gaauaaaguucagugugc

SEQ ID NO: 515778 - RNA, 21 nt, Homo sapiens
gaauaccaaguguguugggaa

SEQ ID NO: 515779 - RNA, 16 nt, Homo sapiens
gaauccauaucagcuc

SEQ ID NO: 515780 - RNA, 20 nt, Homo sapiens
gaauccaucaggacuuggga

SEQ ID NO: 515781 - RNA, 13 nt, Homo sapiens
gaaugaacaaauu

SEQ ID NO: 515782 - RNA, 17 nt, Homo sapiens
gaaugcagcacaguacu

SEQ ID NO: 515783 - RNA, 14 nt, Homo sapiens
gaaugccagggaca

SEQ ID NO: 515784 - RNA, 19 nt, Homo sapiens
gaauggggggcgggccagg

SEQ ID NO: 515785 - RNA, 21 nt, Homo sapiens
gaaugugugaaggucuugccu

SEQ ID NO: 515786 - RNA, 15 nt, Homo sapiens
gaauucauugucuca

SEQ ID NO: 515787 - RNA, 13 nt, Homo sapiens
gaauucuuaccau

SEQ ID NO: 515788 - RNA, 20 nt, Homo sapiens
gaauuguuauguaaacauca

SEQ ID NO: 515789 - RNA, 17 nt, Homo sapiens
gaauuugcuuagccuuu

SEQ ID NO: 515790 - RNA, 21 nt, Homo sapiens
gaauuuuaaaaaagauggauu

SEQ ID NO: 515791 - RNA, 22 nt, Homo sapiens
gacaaguuuaaaggcuguguca

SEQ ID NO: 515792 - RNA, 20 nt, Homo sapiens
gacacagaggacggcuuccc

SEQ ID NO: 515793 - RNA, 15 nt, Homo sapiens
gacacauaguguuug

SEQ ID NO: 515794 - RNA, 22 nt, Homo sapiens
gacacgugcaacagacugccuu

SEQ ID NO: 515795 - RNA, 21 nt, Homo sapiens
gacacguuuggccagugacau

SEQ ID NO: 515796 - RNA, 19 nt, Homo sapiens
gacagaagaaacuacccuc

SEQ ID NO: 515797 - RNA, 15 nt, Homo sapiens
gacagagagccaagc

SEQ ID NO: 515798 - RNA, 22 nt, Homo sapiens
gacagauguuggugcaauacaa

SEQ ID NO: 515799 - RNA, 16 nt, Homo sapiens
gacaggcaccaugcug

SEQ ID NO: 515800 - RNA, 20 nt, Homo sapiens
gacaguauugcuaacaucuc

SEQ ID NO: 515801 - RNA, 11 nt, Homo sapiens
gacagugcagu

SEQ ID NO: 515802 - RNA, 15 nt, Homo sapiens
gacagugccuaacuc

SEQ ID NO: 515803 - RNA, 19 nt, Homo sapiens
gacauaaaucuuccaaagu

SEQ ID NO: 515804 - RNA, 15 nt, Homo sapiens
gacauauuacuggaa

SEQ ID NO: 515805 - RNA, 21 nt, Homo sapiens
gacauggaauuuaugaauggu

SEQ ID NO: 515806 - RNA, 16 nt, Homo sapiens
gacaugggugugccag

SEQ ID NO: 515807 - RNA, 15 nt, Homo sapiens
gaccuccugaugucu

SEQ ID NO: 515808 - RNA, 22 nt, Homo sapiens
gaccuuucugagugacaugggu

SEQ ID NO: 515809 - RNA, 17 nt, Homo sapiens
gacuacagaaguggaag

SEQ ID NO: 515810 - RNA, 13 nt, Homo sapiens
gacugagcuugau

SEQ ID NO: 515811 - RNA, 15 nt, Homo sapiens
gacugugacacagcu

SEQ ID NO: 515812 - RNA, 13 nt, Homo sapiens
gacuucagacucu

SEQ ID NO: 515813 - RNA, 21 nt, Homo sapiens
gacuucagacucucuccucuc

SEQ ID NO: 515814 - RNA, 19 nt, Homo sapiens
gacuucauuuaacacugag

SEQ ID NO: 515815 - RNA, 15 nt, Homo sapiens
gagaaauugugccaa

SEQ ID NO: 515816 - RNA, 21 nt, Homo sapiens
gagacagagagccaagcuaau

SEQ ID NO: 515817 - RNA, 12 nt, Homo sapiens
gagacaguauug

SEQ ID NO: 515818 - RNA, 21 nt, Homo sapiens
gagaccaacuacgacuggcau

SEQ ID NO: 515819 - RNA, 21 nt, Homo sapiens
gagagagcaaucuugcuguga

SEQ ID NO: 515820 - RNA, 17 nt, Homo sapiens
gagagcagcaggugcug

SEQ ID NO: 515821 - RNA, 18 nt, Homo sapiens
gagagcccucugcugcuu

SEQ ID NO: 515822 - RNA, 14 nt, Homo sapiens
cauuuuuugucugu

SEQ ID NO: 515823 - RNA, 14 nt, Homo sapiens
ccaaaucucaaaag

SEQ ID NO: 515824 - RNA, 23 nt, Homo sapiens
ccaaaugaguucccuugauucaa

SEQ ID NO: 515825 - RNA, 19 nt, Homo sapiens
ccaacacaucacuuaccac

SEQ ID NO: 515826 - RNA, 20 nt, Homo sapiens
ccaacauuccuuguuuguaa

SEQ ID NO: 515827 - RNA, 20 nt, Homo sapiens
ccaagaccuuacaaccacau

SEQ ID NO: 515828 - RNA, 17 nt, Homo sapiens
ccaagugugugugcaau

SEQ ID NO: 515829 - RNA, 18 nt, Homo sapiens
ccaagugugugugcaaug

SEQ ID NO: 515830 - RNA, 15 nt, Homo sapiens
uguuucuauauguaa

SEQ ID NO: 515831 - RNA, 17 nt, Homo sapiens
uguuugacuuuagacug

SEQ ID NO: 515832 - RNA, 22 nt, Homo sapiens
uguuuuccccaauuauccuccu

SEQ ID NO: 515833 - RNA, 18 nt, Homo sapiens
uguuuucuucguggauug

SEQ ID NO: 515834 - RNA, 16 nt, Homo sapiens
uuaaaaaucaguuugu

SEQ ID NO: 515835 - RNA, 16 nt, Homo sapiens
uuaaaacuuacuaugg

SEQ ID NO: 515836 - RNA, 18 nt, Homo sapiens
uuaaaaugagucacuuac

SEQ ID NO: 515837 - RNA, 20 nt, Homo sapiens
uuaaagaaguccaugugaua

SEQ ID NO: 515838 - RNA, 11 nt, Homo sapiens
uuaaagcacau

SEQ ID NO: 515839 - RNA, 21 nt, Homo sapiens
uuaaagcucguagaaacaaga

SEQ ID NO: 515840 - RNA, 15 nt, Homo sapiens
uuaacaagacuucaa

SEQ ID NO: 515841 - RNA, 19 nt, Homo sapiens
uuaacaauugccagggaaa

SEQ ID NO: 515842 - RNA, 15 nt, Homo sapiens
uuaacauaucauuca

SEQ ID NO: 515843 - RNA, 14 nt, Homo sapiens
uuaacugcagugua

SEQ ID NO: 515844 - RNA, 22 nt, Homo sapiens
uuaagaugcaaaucaacucucu

SEQ ID NO: 515845 - RNA, 17 nt, Homo sapiens
uuaauaauauguacaaa

SEQ ID NO: 515846 - RNA, 16 nt, Homo sapiens
uuaauaguuucuaaac

SEQ ID NO: 515847 - RNA, 23 nt, Homo sapiens
uuaaucuuugaaaacucauacag

SEQ ID NO: 515848 - RNA, 18 nt, Homo sapiens
uuaauuaaacaaauuccu

SEQ ID NO: 515849 - RNA, 20 nt, Homo sapiens
uuaauugaaauaccuauuca

SEQ ID NO: 515850 - RNA, 12 nt, Homo sapiens
uuaauugcucua

SEQ ID NO: 515851 - RNA, 23 nt, Homo sapiens
uuaauuuuucuguuggucuuaac

SEQ ID NO: 515852 - RNA, 19 nt, Homo sapiens
uuacaaacaagauacguau

SEQ ID NO: 515853 - RNA, 19 nt, Homo sapiens
uuacaacaagcaaacugaa

SEQ ID NO: 515854 - RNA, 19 nt, Homo sapiens
uuacaauguaucaacauau

SEQ ID NO: 515855 - RNA, 12 nt, Homo sapiens
uuacacuuucuc

SEQ ID NO: 515856 - RNA, 12 nt, Homo sapiens
uuacagugccac

SEQ ID NO: 515857 - RNA, 16 nt, Homo sapiens
uuaccacuugcacuau

SEQ ID NO: 515858 - RNA, 17 nt, Homo sapiens
uuacccauaggucuuaa

SEQ ID NO: 515859 - RNA, 17 nt, Homo sapiens
uuaccgcccacccagca

SEQ ID NO: 515860 - RNA, 18 nt, Homo sapiens
uuaccucugcauaaauau

SEQ ID NO: 515861 - RNA, 22 nt, Homo sapiens
uuaccuguaauagccucaccuu

SEQ ID NO: 515862 - RNA, 15 nt, Homo sapiens
uuacuauaauugaga

SEQ ID NO: 515863 - RNA, 14 nt, Homo sapiens
uuagacauaccucu

SEQ ID NO: 515864 - RNA, 12 nt, Homo sapiens
uuagcaaagcau

SEQ ID NO: 515865 - RNA, 23 nt, Homo sapiens
uuagcacagaggauggcuucccc

SEQ ID NO: 515866 - RNA, 18 nt, Homo sapiens
uuaggaaagcagugcagu

SEQ ID NO: 515867 - RNA, 19 nt, Homo sapiens
uuaggaaagcagugcagua

SEQ ID NO: 515868 - RNA, 23 nt, Homo sapiens
uuaggaugaguuucuauguugua

SEQ ID NO: 515869 - RNA, 21 nt, Homo sapiens
uuaggcaauggugaacuguca

SEQ ID NO: 515870 - RNA, 14 nt, Homo sapiens
uuaggcagugcagu

SEQ ID NO: 515871 - RNA, 17 nt, Homo sapiens
uuagguggggacagagg

SEQ ID NO: 515872 - RNA, 16 nt, Homo sapiens
ucuguuuacaucaguu

SEQ ID NO: 515873 - RNA, 15 nt, Homo sapiens
ucuuaaugucucaaa

SEQ ID NO: 515874 - RNA, 12 nt, Homo sapiens
ucuuaauugcau

SEQ ID NO: 515875 - RNA, 15 nt, Homo sapiens
ucuucaauccccaua

SEQ ID NO: 515876 - RNA, 18 nt, Homo sapiens
ucuuccaacaugugaugu

SEQ ID NO: 515877 - RNA, 14 nt, Homo sapiens
ucuuccucuuaccu

SEQ ID NO: 515878 - RNA, 22 nt, Homo sapiens
ucuucuuauucaugcuuucucc

SEQ ID NO: 515879 - RNA, 22 nt, Homo sapiens
ucuugaauguugaagaacucau

SEQ ID NO: 515880 - RNA, 22 nt, Homo sapiens
ucuugagaccagccugccaggc

SEQ ID NO: 515881 - RNA, 18 nt, Homo sapiens
ucuugcggcaccgcccac

SEQ ID NO: 515882 - RNA, 12 nt, Homo sapiens
ucuugguguugu

SEQ ID NO: 515883 - RNA, 16 nt, Homo sapiens
ucuugguuuccaucaa

SEQ ID NO: 515884 - RNA, 17 nt, Homo sapiens
ucuuguaaaacugugac

SEQ ID NO: 515885 - RNA, 24 nt, Homo sapiens
ucuuuaccuugcauuuuagcuaau

SEQ ID NO: 515886 - RNA, 20 nt, Homo sapiens
ucuuucaauccacaguauug

SEQ ID NO: 515887 - RNA, 17 nt, Homo sapiens
ucuuucggaaaugauug

SEQ ID NO: 515888 - RNA, 23 nt, Homo sapiens
ucuuucuuagauucucuuuguug

SEQ ID NO: 515889 - RNA, 14 nt, Homo sapiens
ucuuugguuccuca

SEQ ID NO: 515890 - RNA, 16 nt, Homo sapiens
ucuuuguauauuucua

SEQ ID NO: 515891 - RNA, 21 nt, Homo sapiens
ucuuuugcucucucauuccca

SEQ ID NO: 515892 - RNA, 12 nt, Homo sapiens
ucuuuuuacaau

SEQ ID NO: 515893 - RNA, 15 nt, Homo sapiens
ucuuuuuucaaugua

SEQ ID NO: 515894 - RNA, 12 nt, Homo sapiens
ugaaaacucauc

SEQ ID NO: 515895 - RNA, 13 nt, Homo sapiens
ugaaaaguuuuca

SEQ ID NO: 515896 - RNA, 22 nt, Homo sapiens
ugaaaauggcugaagaaacaca

SEQ ID NO: 515897 - RNA, 22 nt, Homo sapiens
ugaaaccagaaaucuaaucucu

SEQ ID NO: 515898 - RNA, 21 nt, Homo sapiens
ugaaacugacuugcugugacu

SEQ ID NO: 515899 - RNA, 20 nt, Homo sapiens
ugaaagagaauagacaguau

SEQ ID NO: 515900 - RNA, 14 nt, Homo sapiens
ugaaaguugcaguu

SEQ ID NO: 515901 - RNA, 19 nt, Homo sapiens
ugaaauauuuucuacuuua

SEQ ID NO: 515902 - RNA, 15 nt, Homo sapiens
ugaaauccaaaauag

SEQ ID NO: 515903 - RNA, 23 nt, Homo sapiens
ugaaaucuacaacauaaugauac

SEQ ID NO: 515904 - RNA, 17 nt, Homo sapiens
ugaaauuaguguuuuca

SEQ ID NO: 515905 - RNA, 15 nt, Homo sapiens
ugaaauuaugucaaa

SEQ ID NO: 515906 - RNA, 13 nt, Homo sapiens
ugaaauugaguca

SEQ ID NO: 515907 - RNA, 13 nt, Homo sapiens
ugaaccaagcuau

SEQ ID NO: 515908 - RNA, 16 nt, Homo sapiens
cuuagaagaaauauga

SEQ ID NO: 515909 - RNA, 22 nt, Homo sapiens
cuuaguaucucaucaacaaaga

SEQ ID NO: 515910 - RNA, 20 nt, Homo sapiens
cuuauacacaccugaauaaa

SEQ ID NO: 515911 - RNA, 18 nt, Homo sapiens
cuuauauaaauguacagu

SEQ ID NO: 515912 - RNA, 22 nt, Homo sapiens
cuuauauaaauguacaguauuc

SEQ ID NO: 515913 - RNA, 17 nt, Homo sapiens
cuuauauacuaauauca

SEQ ID NO: 515914 - RNA, 20 nt, Homo sapiens
cuuauauuauuuucuguaau

SEQ ID NO: 515915 - RNA, 13 nt, Homo sapiens
uaaauguacagua

SEQ ID NO: 515916 - RNA, 16 nt, Homo sapiens
uaaauuugacuguuau

SEQ ID NO: 515917 - RNA, 17 nt, Homo sapiens
uaacaaagugagaccuc

SEQ ID NO: 515918 - RNA, 22 nt, Homo sapiens
uaacaauguuuuuuauacuuca

SEQ ID NO: 515919 - RNA, 20 nt, Homo sapiens
uaacacacacacacauacac

SEQ ID NO: 515920 - RNA, 14 nt, Homo sapiens
uaacacagugcagu

SEQ ID NO: 515921 - RNA, 21 nt, Homo sapiens
uaacaggcauugcacuaaaag

SEQ ID NO: 515922 - RNA, 14 nt, Homo sapiens
uaacauaucauuca

SEQ ID NO: 515923 - RNA, 19 nt, Homo sapiens
uaaccuuaucuaagaacuu

SEQ ID NO: 515924 - RNA, 18 nt, Homo sapiens
uaaccuucaaauacauuc

SEQ ID NO: 515925 - RNA, 15 nt, Homo sapiens
uaacuauugcugcuu

SEQ ID NO: 515926 - RNA, 16 nt, Homo sapiens
uaacugagcacuuuga

SEQ ID NO: 515927 - RNA, 20 nt, Homo sapiens
uaagaagcaaauaaauauca

SEQ ID NO: 515928 - RNA, 13 nt, Homo sapiens
uaaggacuacaga

SEQ ID NO: 515929 - RNA, 14 nt, Homo sapiens
uaaggcagugcagu

SEQ ID NO: 515930 - RNA, 15 nt, Homo sapiens
uaaggcagugcagug

SEQ ID NO: 515931 - RNA, 20 nt, Homo sapiens
uaaggcagugcagugcucag

SEQ ID NO: 515932 - RNA, 22 nt, Homo sapiens
uaaguacugaaauacauaugau

SEQ ID NO: 515933 - RNA, 21 nt, Homo sapiens
uaaguccacucuaguugugga

SEQ ID NO: 515934 - RNA, 11 nt, Homo sapiens
uaagugcuaug

SEQ ID NO: 515935 - RNA, 19 nt, Homo sapiens
uaaguuauaccagcaaaag

SEQ ID NO: 515936 - RNA, 21 nt, Homo sapiens
uaauaaaaugcuaaaugucaa

SEQ ID NO: 515937 - RNA, 15 nt, Homo sapiens
uaauauacagugugu

SEQ ID NO: 515938 - RNA, 13 nt, Homo sapiens
uaauauacauaac

SEQ ID NO: 515939 - RNA, 13 nt, Homo sapiens
uaauauugccuug

SEQ ID NO: 515940 - RNA, 20 nt, Homo sapiens
uaaucagaaagccucuccag

SEQ ID NO: 515941 - RNA, 16 nt, Homo sapiens
uaaugauucaauguga

SEQ ID NO: 515942 - RNA, 11 nt, Homo sapiens
uaaugcuucuu

SEQ ID NO: 515943 - RNA, 16 nt, Homo sapiens
uaauggaaacugucaa

SEQ ID NO: 515944 - RNA, 16 nt, Homo sapiens
uaauguauaaugggaa

SEQ ID NO: 515945 - RNA, 13 nt, Homo sapiens
uaauuagauuaac

SEQ ID NO: 515946 - RNA, 20 nt, Homo sapiens
uaauuguaaaggugaugaau

SEQ ID NO: 515947 - RNA, 17 nt, Homo sapiens
uacaaauauugugaugc

SEQ ID NO: 515948 - RNA, 18 nt, Homo sapiens
uacaauacaacacauuga

SEQ ID NO: 515949 - RNA, 16 nt, Homo sapiens
uacaauacaguacuca

SEQ ID NO: 515950 - RNA, 18 nt, Homo sapiens
uacaauguaucaacauau

SEQ ID NO: 515951 - RNA, 21 nt, Homo sapiens
uacaauucuuuguugcuuaau

SEQ ID NO: 515952 - RNA, 14 nt, Homo sapiens
uacaauuuagcuua

SEQ ID NO: 515953 - RNA, 15 nt, Homo sapiens
uacaauuuagcuuaa

SEQ ID NO: 515954 - RNA, 12 nt, Homo sapiens
uacacacaggag

SEQ ID NO: 515955 - RNA, 11 nt, Homo sapiens
uacacaggccu

SEQ ID NO: 515956 - RNA, 22 nt, Homo sapiens
uacagaccacaaaauguaauau

SEQ ID NO: 515957 - RNA, 15 nt, Homo sapiens
uacaguuugcuuauu

SEQ ID NO: 515958 - RNA, 20 nt, Homo sapiens
uacaugccuuuccagugcug

SEQ ID NO: 515959 - RNA, 20 nt, Homo sapiens
uaccaaaugccuuucuagca

SEQ ID NO: 515960 - RNA, 15 nt, Homo sapiens
uaccaaguguguugg

SEQ ID NO: 515961 - RNA, 18 nt, Homo sapiens
uaccaaguguguugggaa

SEQ ID NO: 515962 - RNA, 15 nt, Homo sapiens
uaccacauucacuac

SEQ ID NO: 515963 - RNA, 12 nt, Homo sapiens
uacccucugaga

SEQ ID NO: 515964 - RNA, 16 nt, Homo sapiens
uaccuguucuucuauc

SEQ ID NO: 515965 - RNA, 16 nt, Homo sapiens
uaccuugguuaacuua

SEQ ID NO: 515966 - RNA, 19 nt, Homo sapiens
uacuaacaguaacugccau

SEQ ID NO: 515967 - RNA, 18 nt, Homo sapiens
uacuaaccaccauuuccc

SEQ ID NO: 515968 - RNA, 12 nt, Homo sapiens
uacuaccccaga

SEQ ID NO: 515969 - RNA, 13 nt, Homo sapiens
uacucaggcagug

SEQ ID NO: 515970 - RNA, 16 nt, Homo sapiens
uacucaggcagugcag

SEQ ID NO: 515971 - RNA, 18 nt, Homo sapiens
uacucaggcagugcagua

SEQ ID NO: 515972 - RNA, 22 nt, Homo sapiens
uacucaguaaaucagugcagua

SEQ ID NO: 515973 - RNA, 17 nt, Homo sapiens
uacugaaauacauauga

SEQ ID NO: 515974 - RNA, 22 nt, Homo sapiens
uacugcaugaucuuacacgaag

SEQ ID NO: 515975 - RNA, 15 nt, Homo sapiens
uacuggccuuuucac

SEQ ID NO: 515976 - RNA, 21 nt, Homo sapiens
uacuguguuucgcauuaagca

SEQ ID NO: 515977 - RNA, 20 nt, Homo sapiens
uacuucauucaaaaagccaa

SEQ ID NO: 515978 - RNA, 18 nt, Homo sapiens
uagaaauuuuaucucuuc

SEQ ID NO: 515979 - RNA, 14 nt, Homo sapiens
uagaauaggcaaac

SEQ ID NO: 515980 - RNA, 23 nt, Homo sapiens
uagaauggggcuuccaugguggu

SEQ ID NO: 515981 - RNA, 17 nt, Homo sapiens
uagacagaaaccaagcc

SEQ ID NO: 515982 - RNA, 20 nt, Homo sapiens
uagacuguuagacaaaagug

SEQ ID NO: 515983 - RNA, 20 nt, Homo sapiens
uagagaauuccucuauuugu

SEQ ID NO: 515984 - RNA, 20 nt, Homo sapiens
uagaguuauuauaguuauuc

SEQ ID NO: 515985 - RNA, 20 nt, Homo sapiens
uagauuuuuagauuccuacu

SEQ ID NO: 515986 - RNA, 19 nt, Homo sapiens
uagccaccuguuuagccua

SEQ ID NO: 515987 - RNA, 14 nt, Homo sapiens
uagcucgugugcuu

SEQ ID NO: 515988 - RNA, 13 nt, Homo sapiens
uagcucuguccac

SEQ ID NO: 515989 - RNA, 23 nt, Homo sapiens
uagcuguuuacugacauggugcu

SEQ ID NO: 515990 - RNA, 21 nt, Homo sapiens
uaggagggugccccugggaac

SEQ ID NO: 515991 - RNA, 18 nt, Homo sapiens
uaggcaauguaguacuca

SEQ ID NO: 515992 - RNA, 16 nt, Homo sapiens
uaguaacaguauuucc

SEQ ID NO: 515993 - RNA, 12 nt, Homo sapiens
uaguacucagua

SEQ ID NO: 515994 - RNA, 22 nt, Homo sapiens
uagugguauuuuaacauagcag

SEQ ID NO: 515995 - RNA, 23 nt, Homo sapiens
uagugucuuuuuuuucuucaccu

SEQ ID NO: 515996 - RNA, 21 nt, Homo sapiens
uaguugccguggcaacugugg

SEQ ID NO: 515997 - RNA, 17 nt, Homo sapiens
uaguuuacaaacaagau

SEQ ID NO: 515998 - RNA, 17 nt, Homo sapiens
uauaaacacaguaagau

SEQ ID NO: 515999 - RNA, 20 nt, Homo sapiens
uauaauuuuauugcuggaau

SEQ ID NO: 516000 - RNA, 17 nt, Homo sapiens
uauaauuuuuccuuuaa

SEQ ID NO: 516001 - RNA, 14 nt, Homo sapiens
uauacaaacaggug

SEQ ID NO: 516002 - RNA, 23 nt, Homo sapiens
uauacauacgcaauuguauauau

SEQ ID NO: 516003 - RNA, 15 nt, Homo sapiens
uauagcauguaauau

SEQ ID NO: 516004 - RNA, 22 nt, Homo sapiens
uauauaaaauacacguguauau

SEQ ID NO: 516005 - RNA, 23 nt, Homo sapiens
uauauaaauguacaguauucaau

SEQ ID NO: 516006 - RNA, 18 nt, Homo sapiens
uauauagugaugugcuag

SEQ ID NO: 516007 - RNA, 23 nt, Homo sapiens
uauauauaaaauacacguguaua

SEQ ID NO: 516008 - RNA, 17 nt, Homo sapiens
uauauaugaaaacuaag

SEQ ID NO: 516009 - RNA, 17 nt, Homo sapiens
uauaucuguggucuuca

SEQ ID NO: 516010 - RNA, 19 nt, Homo sapiens
uauauguauaucuguguaa

SEQ ID NO: 516011 - RNA, 17 nt, Homo sapiens
uaucaauaagugccauu

SEQ ID NO: 516012 - RNA, 15 nt, Homo sapiens
uaucauuaaccuuau

SEQ ID NO: 516013 - RNA, 22 nt, Homo sapiens
uauccaagaccuuacaaccaca

SEQ ID NO: 516014 - RNA, 18 nt, Homo sapiens
uaucuagcauagcacaaa

SEQ ID NO: 516015 - RNA, 15 nt, Homo sapiens
uaucucaaaucugcu

SEQ ID NO: 516016 - RNA, 15 nt, Homo sapiens
uaucugccagucucu

SEQ ID NO: 516017 - RNA, 23 nt, Homo sapiens
uaugaaagagaaaaugcuuucuc

SEQ ID NO: 516018 - RNA, 18 nt, Homo sapiens
uaugacauauagaauuaa

SEQ ID NO: 516019 - RNA, 23 nt, Homo sapiens
uaugaccauaaaauuagacauac

SEQ ID NO: 516020 - RNA, 11 nt, Homo sapiens
uaugcauuuau

SEQ ID NO: 516021 - RNA, 18 nt, Homo sapiens
uaugcuguucauugauga

SEQ ID NO: 516022 - RNA, 15 nt, Homo sapiens
uauggaaacagagca

SEQ ID NO: 516023 - RNA, 21 nt, Homo sapiens
uauggaaacagagcaaaagaa

SEQ ID NO: 516024 - RNA, 20 nt, Homo sapiens
uauggauugaaggauuguga

SEQ ID NO: 516025 - RNA, 10 nt, Homo sapiens
uauguacaaa

SEQ ID NO: 516026 - RNA, 22 nt, Homo sapiens
uauguacaaauaauauugccuu

SEQ ID NO: 516027 - RNA, 20 nt, Homo sapiens
uaugugagcacuaucuuuca

SEQ ID NO: 516028 - RNA, 18 nt, Homo sapiens
uauuauagucuguacuuc

SEQ ID NO: 516029 - RNA, 15 nt, Homo sapiens
uauuauaucauuaac

SEQ ID NO: 516030 - RNA, 21 nt, Homo sapiens
uauucccaugguagacuguga

SEQ ID NO: 516031 - RNA, 19 nt, Homo sapiens
uauucuguagccaacuuaa

SEQ ID NO: 516032 - RNA, 24 nt, Homo sapiens
uauuuagggcaaucgugucgcuaa

SEQ ID NO: 516033 - RNA, 14 nt, Homo sapiens
uauuuauaacauug

SEQ ID NO: 516034 - RNA, 21 nt, Homo sapiens
uauuucccaacccaggauuca

SEQ ID NO: 516035 - RNA, 20 nt, Homo sapiens
uauuugcauaauaugcauau

SEQ ID NO: 516036 - RNA, 22 nt, Homo sapiens
uauuugcauaauaugcauauau

SEQ ID NO: 516037 - RNA, 18 nt, Homo sapiens
uauuuuaggaaacucucc

SEQ ID NO: 516038 - RNA, 20 nt, Homo sapiens
ucaaaagaucuccugugcac

SEQ ID NO: 516039 - RNA, 15 nt, Homo sapiens
ucaaacagaaaagaa

SEQ ID NO: 516040 - RNA, 19 nt, Homo sapiens
ucaaacagggacacuacaa

SEQ ID NO: 516041 - RNA, 14 nt, Homo sapiens
ucaaagaagacuca

SEQ ID NO: 516042 - RNA, 21 nt, Homo sapiens
ucaaaucugcuuucauccagc

SEQ ID NO: 516043 - RNA, 23 nt, Homo sapiens
ucaaaugucauuucauacaaauu

SEQ ID NO: 516044 - RNA, 20 nt, Homo sapiens
ucaaauuuuuaaguaauuuc

SEQ ID NO: 516045 - RNA, 14 nt, Homo sapiens
ucaagaaugcagua

SEQ ID NO: 516046 - RNA, 20 nt, Homo sapiens
ucaagagacaguauugcuaa

SEQ ID NO: 516047 - RNA, 20 nt, Homo sapiens
ucaagagggggcaagucaca

SEQ ID NO: 516048 - RNA, 21 nt, Homo sapiens
ucaagauccugucuugcugag

SEQ ID NO: 516049 - RNA, 18 nt, Homo sapiens
ucaauaacuauugcugcu

SEQ ID NO: 516050 - RNA, 17 nt, Homo sapiens
ucaauaccaccaagagg

SEQ ID NO: 516051 - RNA, 15 nt, Homo sapiens
ucaaucaaacaggga

SEQ ID NO: 516052 - RNA, 19 nt, Homo sapiens
ucaaugccaggcagugcag

SEQ ID NO: 516053 - RNA, 23 nt, Homo sapiens
uccucugcuugucauucugcuaa

SEQ ID NO: 516054 - RNA, 18 nt, Homo sapiens
uccucuuucacuucuuau

SEQ ID NO: 516055 - RNA, 14 nt, Homo sapiens
uccugaacucccag

SEQ ID NO: 516056 - RNA, 16 nt, Homo sapiens
uccugacaaaagggac

SEQ ID NO: 516057 - RNA, 16 nt, Homo sapiens
uccugccuucauggaa

SEQ ID NO: 516058 - RNA, 19 nt, Homo sapiens
uccugcuccuccaguacaa

SEQ ID NO: 516059 - RNA, 21 nt, Homo sapiens
uccugucuaaaaaugauucuc

SEQ ID NO: 516060 - RNA, 19 nt, Homo sapiens
uccugucuccucugucagu

SEQ ID NO: 516061 - RNA, 16 nt, Homo sapiens
uccuuaaaaauguaug

SEQ ID NO: 516062 - RNA, 19 nt, Homo sapiens
uccuucacucccugucaua

SEQ ID NO: 516063 - RNA, 23 nt, Homo sapiens
uccuugaguuaauuccagugaag

SEQ ID NO: 516064 - RNA, 22 nt, Homo sapiens
uccuuguauaaaaaaaauaguu

SEQ ID NO: 516065 - RNA, 21 nt, Homo sapiens
uccuuuuuuauacacauaauu

SEQ ID NO: 516066 - RNA, 18 nt, Homo sapiens
ucgaggaagcaccucuca

SEQ ID NO: 516067 - RNA, 17 nt, Homo sapiens
ucgcauuaagcacacac

SEQ ID NO: 516068 - RNA, 22 nt, Homo sapiens
ucgccaugggggucuuugaaca

SEQ ID NO: 516069 - RNA, 13 nt, Homo sapiens
ucgcuuugccauc

SEQ ID NO: 516070 - RNA, 18 nt, Homo sapiens
ucgggcacucccuaaguc

SEQ ID NO: 516071 - RNA, 16 nt, Homo sapiens
ucggggagugccacuu

SEQ ID NO: 516072 - RNA, 16 nt, Homo sapiens
ucgguugcgugcaugu

SEQ ID NO: 516073 - RNA, 18 nt, Homo sapiens
ucguaaguucugugcagu

SEQ ID NO: 516074 - RNA, 16 nt, Homo sapiens
ucguagaaacaagaca

SEQ ID NO: 516075 - RNA, 17 nt, Homo sapiens
ucguagaaacaagacaa

SEQ ID NO: 516076 - RNA, 20 nt, Homo sapiens
ucguccuuagaauacuguau

SEQ ID NO: 516077 - RNA, 19 nt, Homo sapiens
agccuuaagucuuacuguu

SEQ ID NO: 516078 - RNA, 21 nt, Homo sapiens
agccuucuucccccagggucc

SEQ ID NO: 516079 - RNA, 17 nt, Homo sapiens
agccuugcugggccagg

SEQ ID NO: 516080 - RNA, 18 nt, Homo sapiens
agccuuuaauaggcuugu

SEQ ID NO: 516081 - RNA, 13 nt, Homo sapiens
agcguggggcuaa

SEQ ID NO: 516082 - RNA, 16 nt, Homo sapiens
agcuaagccugaugau

SEQ ID NO: 516083 - RNA, 21 nt, Homo sapiens
agcuaauuugugaaaguggca

SEQ ID NO: 516084 - RNA, 19 nt, Homo sapiens
agcuaccaacuaaguugua

SEQ ID NO: 516085 - RNA, 21 nt, Homo sapiens
agcuauuuaaguggacuguau

SEQ ID NO: 516086 - RNA, 18 nt, Homo sapiens
agcuauuucgcacuguau

SEQ ID NO: 516087 - RNA, 20 nt, Homo sapiens
agcucagcauuguguacaaa

SEQ ID NO: 516088 - RNA, 20 nt, Homo sapiens
agcugaagcguuacuacagc

SEQ ID NO: 516089 - RNA, 18 nt, Homo sapiens
agcugcaguuagcacaga

SEQ ID NO: 516090 - RNA, 15 nt, Homo sapiens
agcuggguaucucaa

SEQ ID NO: 516091 - RNA, 22 nt, Homo sapiens
agcugugugugcccguggugag

SEQ ID NO: 516092 - RNA, 13 nt, Homo sapiens
agcuugagccugu

SEQ ID NO: 516093 - RNA, 16 nt, Homo sapiens
agcuuuacagugccac

SEQ ID NO: 516094 - RNA, 18 nt, Homo sapiens
agcuuuagagaagccaua

SEQ ID NO: 516095 - RNA, 16 nt, Homo sapiens
aggaaaauauugacaa

SEQ ID NO: 516096 - RNA, 22 nt, Homo sapiens
cuucaaaguuuucugcuguaaa

SEQ ID NO: 516097 - RNA, 18 nt, Homo sapiens
cuucacugucaugugcga

SEQ ID NO: 516098 - RNA, 17 nt, Homo sapiens
cuucagaauuguuuuua

SEQ ID NO: 516099 - RNA, 21 nt, Homo sapiens
cuucauggaacucagcugucu

SEQ ID NO: 516100 - RNA, 16 nt, Homo sapiens
cuucccaacucacuuu

SEQ ID NO: 516101 - RNA, 23 nt, Homo sapiens
cuucccacuggaggcaugugaug

SEQ ID NO: 516102 - RNA, 16 nt, Homo sapiens
cuucccuaguucuuug

SEQ ID NO: 516103 - RNA, 16 nt, Homo sapiens
cuucccugacacuguc

SEQ ID NO: 516104 - RNA, 18 nt, Homo sapiens
cuuccuaaaccauuuugc

SEQ ID NO: 516105 - RNA, 17 nt, Homo sapiens
cuucuauccaaaccuuu

SEQ ID NO: 516106 - RNA, 18 nt, Homo sapiens
cuucuccccuccaaguga

SEQ ID NO: 516107 - RNA, 17 nt, Homo sapiens
cuucuccccuccagacc

SEQ ID NO: 516108 - RNA, 14 nt, Homo sapiens
cuucuucuuuagga

SEQ ID NO: 516109 - RNA, 16 nt, Homo sapiens
cuugaaauuauaucug

SEQ ID NO: 516110 - RNA, 22 nt, Homo sapiens
cuugaggccaaaugaguucccu

SEQ ID NO: 516111 - RNA, 22 nt, Homo sapiens
cuugagugaucccaaaccaaac

SEQ ID NO: 516112 - RNA, 17 nt, Homo sapiens
cuugauuccuguugaau

SEQ ID NO: 516113 - RNA, 14 nt, Homo sapiens
cuugcacuguaucc

SEQ ID NO: 516114 - RNA, 13 nt, Homo sapiens
cuugccaugcuaa

SEQ ID NO: 516115 - RNA, 21 nt, Homo sapiens
cuugccugaauccaucaggac

SEQ ID NO: 516116 - RNA, 19 nt, Homo sapiens
cuugcuaccucagucagua

SEQ ID NO: 516117 - RNA, 14 nt, Homo sapiens
cuugcucuaccugg

SEQ ID NO: 516118 - RNA, 15 nt, Homo sapiens
cuugggcgggccauu

SEQ ID NO: 516119 - RNA, 15 nt, Homo sapiens
cuuggguaauuaaaa

SEQ ID NO: 516120 - RNA, 19 nt, Homo sapiens
cuuggucuguguucucaac

SEQ ID NO: 516121 - RNA, 15 nt, Homo sapiens
cuugguguaaaccau

SEQ ID NO: 516122 - RNA, 20 nt, Homo sapiens
cuuggugucgggcaugacac

SEQ ID NO: 516123 - RNA, 18 nt, Homo sapiens
cuugguuuccaucaaagc

SEQ ID NO: 516124 - RNA, 15 nt, Homo sapiens
cuuguaaaacuguga

SEQ ID NO: 516125 - RNA, 15 nt, Homo sapiens
cuuguccuccuaaua

SEQ ID NO: 516126 - RNA, 22 nt, Homo sapiens
cuuguucuuccucuuaccugua

SEQ ID NO: 516127 - RNA, 14 nt, Homo sapiens
cuuuaaaacaugcu

SEQ ID NO: 516128 - RNA, 15 nt, Homo sapiens
cuuuaaaaugauuca

SEQ ID NO: 516129 - RNA, 22 nt, Homo sapiens
cuuuaacaagacuucaaaguuu

SEQ ID NO: 516130 - RNA, 15 nt, Homo sapiens
cuuuacuaacacugg

SEQ ID NO: 516131 - RNA, 14 nt, Homo sapiens
cuuuccccagugug

SEQ ID NO: 516132 - RNA, 18 nt, Homo sapiens
cuuuccccauucagugac

SEQ ID NO: 516133 - RNA, 23 nt, Homo sapiens
cuuuccucuuaaugucucaaaau

SEQ ID NO: 516134 - RNA, 20 nt, Homo sapiens
cuuuccugggggaugugcac

SEQ ID NO: 516135 - RNA, 22 nt, Homo sapiens
cuuuccugggggaugugcacgg

SEQ ID NO: 516136 - RNA, 18 nt, Homo sapiens
cuuucuauuggcauggau

SEQ ID NO: 516137 - RNA, 13 nt, Homo sapiens
cuuucuccauuua

SEQ ID NO: 516138 - RNA, 17 nt, Homo sapiens
cuuucuuagauucucuu

SEQ ID NO: 516139 - RNA, 20 nt, Homo sapiens
cuuucuuugagaaagacaau

SEQ ID NO: 516140 - RNA, 16 nt, Homo sapiens
cuuugaacacaccucu

SEQ ID NO: 516141 - RNA, 13 nt, Homo sapiens
cuuugagccucuu

SEQ ID NO: 516142 - RNA, 15 nt, Homo sapiens
cuuuggaaguuuuac

SEQ ID NO: 516143 - RNA, 16 nt, Homo sapiens
cuuuggcuuaauucca

SEQ ID NO: 516144 - RNA, 21 nt, Homo sapiens
cuuuggcuuaauuccaaucau

SEQ ID NO: 516145 - RNA, 19 nt, Homo sapiens
cuuuguaugugcacacaaa

SEQ ID NO: 516146 - RNA, 17 nt, Homo sapiens
cuuuuauucauuagcug

SEQ ID NO: 516147 - RNA, 18 nt, Homo sapiens
cuuuucacugacaaguua

SEQ ID NO: 516148 - RNA, 16 nt, Homo sapiens
cuuuuccuggacacuu

SEQ ID NO: 516149 - RNA, 19 nt, Homo sapiens
cuuuuccuggacacuuuac

SEQ ID NO: 516150 - RNA, 17 nt, Homo sapiens
cuuuuccuugacuauua

SEQ ID NO: 516151 - RNA, 13 nt, Homo sapiens
cuuuugacaucca

SEQ ID NO: 516152 - RNA, 15 nt, Homo sapiens
cuuuugacauccagc

SEQ ID NO: 516153 - RNA, 16 nt, Homo sapiens
cuuuugacauccagca

SEQ ID NO: 516154 - RNA, 17 nt, Homo sapiens
cuuuuguauaacuacua

SEQ ID NO: 516155 - RNA, 17 nt, Homo sapiens
cuuuuuacaauguauca

SEQ ID NO: 516156 - RNA, 19 nt, Homo sapiens
cuuuuuuuucuucaccuca

SEQ ID NO: 516157 - RNA, 12 nt, Homo sapiens
gaaaacauuguu

SEQ ID NO: 516158 - RNA, 13 nt, Homo sapiens
gaaaaccucuuuc

SEQ ID NO: 516159 - RNA, 17 nt, Homo sapiens
gaaaacucauacagugg

SEQ ID NO: 516160 - RNA, 18 nt, Homo sapiens
gaaacagagaacccugug

SEQ ID NO: 516161 - RNA, 19 nt, Homo sapiens
gaaacagagaacccugugg

SEQ ID NO: 516162 - RNA, 18 nt, Homo sapiens
gaaacccuuuuacaguca

SEQ ID NO: 516163 - RNA, 16 nt, Homo sapiens
gaaacuaagaaucauc

SEQ ID NO: 516164 - RNA, 14 nt, Homo sapiens
gaaagauugcuaua

SEQ ID NO: 516165 - RNA, 15 nt, Homo sapiens
gaaagcagugcagua

SEQ ID NO: 516166 - RNA, 17 nt, Homo sapiens
gaaagccaggguccuga

SEQ ID NO: 516167 - RNA, 14 nt, Homo sapiens
gaaagccucuccag

SEQ ID NO: 516168 - RNA, 15 nt, Homo sapiens
gaaagccuuccucaa

SEQ ID NO: 516169 - RNA, 13 nt, Homo sapiens
gaaauacauauga

SEQ ID NO: 516170 - RNA, 13 nt, Homo sapiens
gaaauaccuauuc

SEQ ID NO: 516171 - RNA, 14 nt, Homo sapiens
gaaauacuugacaa

SEQ ID NO: 516172 - RNA, 14 nt, Homo sapiens
gaaauauucacaag

SEQ ID NO: 516173 - RNA, 14 nt, Homo sapiens
gaaauuaguguuuu

SEQ ID NO: 516174 - RNA, 16 nt, Homo sapiens
gaaauuaguguuuuca

SEQ ID NO: 516175 - RNA, 17 nt, Homo sapiens
gaaauuauaucuguggu

SEQ ID NO: 516176 - RNA, 16 nt, Homo sapiens
gaaauuggaagacuug

SEQ ID NO: 516177 - RNA, 21 nt, Homo sapiens
gaaauuuuuuuccagaauuga

SEQ ID NO: 516178 - RNA, 19 nt, Homo sapiens
gaacaugacccagccugaa

SEQ ID NO: 516179 - RNA, 14 nt, Homo sapiens
gaacgcaugcaggg

SEQ ID NO: 516180 - RNA, 17 nt, Homo sapiens
gaacugaagcagaguca

SEQ ID NO: 516181 - RNA, 14 nt, Homo sapiens
gaacugcaacacug

SEQ ID NO: 516182 - RNA, 20 nt, Homo sapiens
gaacugccccaucuccuccc

SEQ ID NO: 516183 - RNA, 18 nt, Homo sapiens
gaagaaagauugcuauaa

SEQ ID NO: 516184 - RNA, 14 nt, Homo sapiens
gaagaacugcaaaa

SEQ ID NO: 516185 - RNA, 23 nt, Homo sapiens
gaagaauuggcagaagcaguugc

SEQ ID NO: 516186 - RNA, 20 nt, Homo sapiens
gaagacccuaucucccacaa

SEQ ID NO: 516187 - RNA, 16 nt, Homo sapiens
gaagacucaguaugcu

SEQ ID NO: 516188 - RNA, 23 nt, Homo sapiens
gaagcagaaugagaugauuuaau

SEQ ID NO: 516189 - RNA, 20 nt, Homo sapiens
gaagccugucuguacuucau

SEQ ID NO: 516190 - RNA, 18 nt, Homo sapiens
gaagugguaggaaagccu

SEQ ID NO: 516191 - RNA, 19 nt, Homo sapiens
gaaguuugguuucuuugcu

SEQ ID NO: 516192 - RNA, 19 nt, Homo sapiens
gaaguuuuacuugauuaag

SEQ ID NO: 516193 - RNA, 16 nt, Homo sapiens
gaauaauaguuuugag

SEQ ID NO: 516194 - RNA, 24 nt, Homo sapiens
gaauacuguauuguuacagcugaa

SEQ ID NO: 516195 - RNA, 13 nt, Homo sapiens
gaauagacaguau

SEQ ID NO: 516196 - RNA, 15 nt, Homo sapiens
gaauagacaguauga

SEQ ID NO: 516197 - RNA, 16 nt, Homo sapiens
gaaucaagucugugaa

SEQ ID NO: 516198 - RNA, 13 nt, Homo sapiens
gaaucagacugaa

SEQ ID NO: 516199 - RNA, 19 nt, Homo sapiens
gaaucuccugaccacuugu

SEQ ID NO: 516200 - RNA, 22 nt, Homo sapiens
gaaugaguuuccagcuaagccu

SEQ ID NO: 516201 - RNA, 20 nt, Homo sapiens
gaaugauaauggaaacuguc

SEQ ID NO: 516202 - RNA, 15 nt, Homo sapiens
gaaugcuuaaaugau

SEQ ID NO: 516203 - RNA, 19 nt, Homo sapiens
gaauuaauacaaaacaguu

SEQ ID NO: 516204 - RNA, 13 nt, Homo sapiens
gaauuacauaaca

SEQ ID NO: 516205 - RNA, 17 nt, Homo sapiens
gaauuacauaacaggca

SEQ ID NO: 516206 - RNA, 20 nt, Homo sapiens
gaauugaaccgucaauguga

SEQ ID NO: 516207 - RNA, 22 nt, Homo sapiens
gaauuguaaugauguuggugcu

SEQ ID NO: 516208 - RNA, 21 nt, Homo sapiens
gaauuuucacaugaacauacu

SEQ ID NO: 516209 - RNA, 16 nt, Homo sapiens
gacaaauacacauaca

SEQ ID NO: 516210 - RNA, 15 nt, Homo sapiens
gacaagcauguugau

SEQ ID NO: 516211 - RNA, 12 nt, Homo sapiens
gacaaguaucau

SEQ ID NO: 516212 - RNA, 19 nt, Homo sapiens
gacaagugacuuauuugcu

SEQ ID NO: 516213 - RNA, 13 nt, Homo sapiens
gcaggcaggcaga

SEQ ID NO: 516214 - RNA, 14 nt, Homo sapiens
gcaggguucuagaa

SEQ ID NO: 516215 - RNA, 23 nt, Homo sapiens
gcaguacucaguaacagugcagu

SEQ ID NO: 516216 - RNA, 13 nt, Homo sapiens
gcaguauugacaa

SEQ ID NO: 516217 - RNA, 16 nt, Homo sapiens
gcagugaacacacuca

SEQ ID NO: 516218 - RNA, 11 nt, Homo sapiens
gcagugcagca

SEQ ID NO: 516219 - RNA, 24 nt, Homo sapiens
gcaguggagaggggacuuggauag

SEQ ID NO: 516220 - RNA, 15 nt, Homo sapiens
gcaguuagcacagag

SEQ ID NO: 516221 - RNA, 15 nt, Homo sapiens
gcauaaccgcacaga

SEQ ID NO: 516222 - RNA, 21 nt, Homo sapiens
gcauauuauaucagacugcuu

SEQ ID NO: 516223 - RNA, 22 nt, Homo sapiens
gcauccacuucacaguucugaa

SEQ ID NO: 516224 - RNA, 18 nt, Homo sapiens
gcauccuggcuugccucc

SEQ ID NO: 516225 - RNA, 15 nt, Homo sapiens
gcaucugccaggaca

SEQ ID NO: 516226 - RNA, 21 nt, Homo sapiens
gcaugcagggcccccacagga

SEQ ID NO: 516227 - RNA, 14 nt, Homo sapiens
gcauguugccauga

SEQ ID NO: 516228 - RNA, 18 nt, Homo sapiens
gcauuaaaaauaagccaa

SEQ ID NO: 516229 - RNA, 23 nt, Homo sapiens
gcauuuaggaaagcagugcagua

SEQ ID NO: 516230 - RNA, 20 nt, Homo sapiens
gcauuugcugaauaacaaca

SEQ ID NO: 516231 - RNA, 19 nt, Homo sapiens
gccacaauaagccacuggu

SEQ ID NO: 516232 - RNA, 22 nt, Homo sapiens
gccaccuguuuagccuagucau

SEQ ID NO: 516233 - RNA, 14 nt, Homo sapiens
gccacgaggagcuu

SEQ ID NO: 516234 - RNA, 18 nt, Homo sapiens
gccacugcccaaagccau

SEQ ID NO: 516235 - RNA, 22 nt, Homo sapiens
gccagcagacauugucagcaaa

SEQ ID NO: 516236 - RNA, 13 nt, Homo sapiens
gccaggacacugc

SEQ ID NO: 516237 - RNA, 13 nt, Homo sapiens
gccagggaaacca

SEQ ID NO: 516238 - RNA, 23 nt, Homo sapiens
gccaguguuuagaagagccugac

SEQ ID NO: 516239 - RNA, 19 nt, Homo sapiens
gccauacuuccagcgaaau

SEQ ID NO: 516240 - RNA, 14 nt, Homo sapiens
gccaucaagaaaca

SEQ ID NO: 516241 - RNA, 16 nt, Homo sapiens
gccauuaaauugaaau

SEQ ID NO: 516242 - RNA, 17 nt, Homo sapiens
gccauucccacuaagcu

SEQ ID NO: 516243 - RNA, 19 nt, Homo sapiens
gcccacgugugcagacugu

SEQ ID NO: 516244 - RNA, 14 nt, Homo sapiens
gcccagagacugaa

SEQ ID NO: 516245 - RNA, 13 nt, Homo sapiens
gccccccggccug

SEQ ID NO: 516246 - RNA, 22 nt, Homo sapiens
gccccuccccauggugcaguga

SEQ ID NO: 516247 - RNA, 16 nt, Homo sapiens
gcccgaccccaucuca

SEQ ID NO: 516248 - RNA, 15 nt, Homo sapiens
gcccucuucaauccc

SEQ ID NO: 516249 - RNA, 18 nt, Homo sapiens
gcccugccucacugugac

SEQ ID NO: 516250 - RNA, 14 nt, Homo sapiens
gcccuguugaccua

SEQ ID NO: 516251 - RNA, 15 nt, Homo sapiens
gccucagggaccaag

SEQ ID NO: 516252 - RNA, 17 nt, Homo sapiens
gccucagggaccaagga

SEQ ID NO: 516253 - RNA, 18 nt, Homo sapiens
gccucauccuccacugaa

SEQ ID NO: 516254 - RNA, 23 nt, Homo sapiens
gccucuuaauugcaucaguauuu

SEQ ID NO: 516255 - RNA, 15 nt, Homo sapiens
gccugacuccugggu

SEQ ID NO: 516256 - RNA, 11 nt, Homo sapiens
gccugauggcc

SEQ ID NO: 516257 - RNA, 19 nt, Homo sapiens
gccugcuguucgugacuca

SEQ ID NO: 516258 - RNA, 20 nt, Homo sapiens
gccuggagccugggcagcac

SEQ ID NO: 516259 - RNA, 16 nt, Homo sapiens
gccuggaggauagcag

SEQ ID NO: 516260 - RNA, 15 nt, Homo sapiens
gccuggauuccagca

SEQ ID NO: 516261 - RNA, 19 nt, Homo sapiens
gccugugaucguguguugc

SEQ ID NO: 516262 - RNA, 19 nt, Homo sapiens
gccugugcccacgugugca

SEQ ID NO: 516263 - RNA, 23 nt, Homo sapiens
gccuucauggaacucagcugucu

SEQ ID NO: 516264 - RNA, 22 nt, Homo sapiens
gccuugaaaccagaaaucuaau

SEQ ID NO: 516265 - RNA, 20 nt, Homo sapiens
gcgucccugagggcccuucc

SEQ ID NO: 516266 - RNA, 18 nt, Homo sapiens
gcguuuggcccugugacu

SEQ ID NO: 516267 - RNA, 12 nt, Homo sapiens
gcuaaccucucu

SEQ ID NO: 516268 - RNA, 15 nt, Homo sapiens
gcuaagccugaugau

SEQ ID NO: 516269 - RNA, 17 nt, Homo sapiens
gcuaauuaacuaacuca

SEQ ID NO: 516270 - RNA, 15 nt, Homo sapiens
gcuaguguagcuucu

SEQ ID NO: 516271 - RNA, 12 nt, Homo sapiens
gcuaugucucau

SEQ ID NO: 516272 - RNA, 15 nt, Homo sapiens
gcucaaugugcuguu

SEQ ID NO: 516273 - RNA, 15 nt, Homo sapiens
gcucccggugugcag

SEQ ID NO: 516274 - RNA, 12 nt, Homo sapiens
gcucgggacugu

SEQ ID NO: 516275 - RNA, 16 nt, Homo sapiens
gcucgugugcuuagaa

SEQ ID NO: 516276 - RNA, 18 nt, Homo sapiens
gcucguguuucacagugg

SEQ ID NO: 516277 - RNA, 23 nt, Homo sapiens
gcucuaaagcagagauguauuau

SEQ ID NO: 516278 - RNA, 19 nt, Homo sapiens
gcugauuuuuuuucugaua

SEQ ID NO: 516279 - RNA, 18 nt, Homo sapiens
gcugcagaugacuggaaa

SEQ ID NO: 516280 - RNA, 19 nt, Homo sapiens
gcugccccccauuucugua

SEQ ID NO: 516281 - RNA, 18 nt, Homo sapiens
gcugccgccacccugcga

SEQ ID NO: 516282 - RNA, 14 nt, Homo sapiens
gcugccgucugucc

SEQ ID NO: 516283 - RNA, 15 nt, Homo sapiens
gcugccucaugaccc

SEQ ID NO: 516284 - RNA, 15 nt, Homo sapiens
gcugccuguggugag

SEQ ID NO: 516285 - RNA, 16 nt, Homo sapiens
gcugcucccuuuauca

SEQ ID NO: 516286 - RNA, 19 nt, Homo sapiens
gcugcucccuuuaucaugu

SEQ ID NO: 516287 - RNA, 14 nt, Homo sapiens
gcugcugcacugcc

SEQ ID NO: 516288 - RNA, 22 nt, Homo sapiens
gcuggauugagcagaacccaga

SEQ ID NO: 516289 - RNA, 15 nt, Homo sapiens
gcugggcaccacagg

SEQ ID NO: 516290 - RNA, 18 nt, Homo sapiens
gcuggguuugggcagugg

SEQ ID NO: 516291 - RNA, 13 nt, Homo sapiens
gcuggugggauag

SEQ ID NO: 516292 - RNA, 21 nt, Homo sapiens
gcuggugggauaggagggugc

SEQ ID NO: 516293 - RNA, 10 nt, Homo sapiens
gcuggugggg

SEQ ID NO: 516294 - RNA, 18 nt, Homo sapiens
gcugugagcuuucugaua

SEQ ID NO: 516295 - RNA, 14 nt, Homo sapiens
gcuuaaaugaucaa

SEQ ID NO: 516296 - RNA, 22 nt, Homo sapiens
gcuuaaucuagagcuaugcaca

SEQ ID NO: 516297 - RNA, 12 nt, Homo sapiens
gcuuauuucccu

SEQ ID NO: 516298 - RNA, 23 nt, Homo sapiens
gcuucucugccgguggggccagc

SEQ ID NO: 516299 - RNA, 18 nt, Homo sapiens
gcuugauuccuguugaau

SEQ ID NO: 516300 - RNA, 18 nt, Homo sapiens
gcuuuacagugccacgac

SEQ ID NO: 516301 - RNA, 17 nt, Homo sapiens
gcuuuacucugaauuuc

SEQ ID NO: 516302 - RNA, 21 nt, Homo sapiens
gcuuucauccagccacugccc

SEQ ID NO: 516303 - RNA, 17 nt, Homo sapiens
gcuuugccacugaagua

SEQ ID NO: 516304 - RNA, 17 nt, Homo sapiens
ggaaaaaauuagacaag

SEQ ID NO: 516305 - RNA, 15 nt, Homo sapiens
ggaaaaguguuucca

SEQ ID NO: 516306 - RNA, 23 nt, Homo sapiens
ggaaaauguucugacagcauuuc

SEQ ID NO: 516307 - RNA, 16 nt, Homo sapiens
ggaaagcagugcagua

SEQ ID NO: 516308 - RNA, 15 nt, Homo sapiens
ggaaagccucacuga

SEQ ID NO: 516309 - RNA, 19 nt, Homo sapiens
ggaaagccucacugauaua

SEQ ID NO: 516310 - RNA, 16 nt, Homo sapiens
ggaaagccuuccucaa

SEQ ID NO: 516311 - RNA, 16 nt, Homo sapiens
ggaaauaucugugaag

SEQ ID NO: 516312 - RNA, 20 nt, Homo sapiens
ggaagaagggccacccugag

SEQ ID NO: 516313 - RNA, 16 nt, Homo sapiens
ggaauaagaagcaaau

SEQ ID NO: 516314 - RNA, 14 nt, Homo sapiens
ggaauuacauaaca

SEQ ID NO: 516315 - RNA, 20 nt, Homo sapiens
ggaauuauuagcaccagcuu

SEQ ID NO: 516316 - RNA, 19 nt, Homo sapiens
ggacaauuuaccacaggau

SEQ ID NO: 516317 - RNA, 21 nt, Homo sapiens
ggacagagugcccuggggcau

SEQ ID NO: 516318 - RNA, 20 nt, Homo sapiens
ggagccccauuauucauucu

SEQ ID NO: 516319 - RNA, 17 nt, Homo sapiens
ggagcguguacuacccc

SEQ ID NO: 516320 - RNA, 15 nt, Homo sapiens
ggagugaaaaccucu

SEQ ID NO: 516321 - RNA, 15 nt, Homo sapiens
ggauaggagggugcc

SEQ ID NO: 516322 - RNA, 23 nt, Homo sapiens
ggauaggagggugccccugggaa

SEQ ID NO: 516323 - RNA, 20 nt, Homo sapiens
ggaucaaaguugaugaaaua

SEQ ID NO: 516324 - RNA, 21 nt, Homo sapiens
ggaugaaggcaaaaacuguac

SEQ ID NO: 516325 - RNA, 15 nt, Homo sapiens
ggaugcuuacaguga

SEQ ID NO: 516326 - RNA, 17 nt, Homo sapiens
ggaugggcucuucgcca

SEQ ID NO: 516327 - RNA, 22 nt, Homo sapiens
ggauguauguguauauguuuau

SEQ ID NO: 516328 - RNA, 23 nt, Homo sapiens
ggauuucugcuuaggccccucag

SEQ ID NO: 516329 - RNA, 18 nt, Homo sapiens
gugggaguccacuuuccu

SEQ ID NO: 516330 - RNA, 17 nt, Homo sapiens
guggggcaagauuuucc

SEQ ID NO: 516331 - RNA, 19 nt, Homo sapiens
gugggggccucuuuaccau

SEQ ID NO: 516332 - RNA, 14 nt, Homo sapiens
gugguauuuuaaca

SEQ ID NO: 516333 - RNA, 19 nt, Homo sapiens
gugguauuuuaacauagca

SEQ ID NO: 516334 - RNA, 18 nt, Homo sapiens
guggucugcugccucagg

SEQ ID NO: 516335 - RNA, 14 nt, Homo sapiens
gugguuuguuauca

SEQ ID NO: 516336 - RNA, 20 nt, Homo sapiens
guguccgugaaaguugugau

SEQ ID NO: 516337 - RNA, 14 nt, Homo sapiens
gugucgggcaugac

SEQ ID NO: 516338 - RNA, 15 nt, Homo sapiens
gugugcagacugugg

SEQ ID NO: 516339 - RNA, 23 nt, Homo sapiens
guguuugaauugauuuuuaaaca

SEQ ID NO: 516340 - RNA, 17 nt, Homo sapiens
guuacaguggcaguauu

SEQ ID NO: 516341 - RNA, 23 nt, Homo sapiens
guuagcacagaggauggcuuccc

SEQ ID NO: 516342 - RNA, 16 nt, Homo sapiens
guuaggcagugcagua

SEQ ID NO: 516343 - RNA, 21 nt, Homo sapiens
guuaucaaccgugacugcaag

SEQ ID NO: 516344 - RNA, 22 nt, Homo sapiens
guucaaguuugguuuuugaaua

SEQ ID NO: 516345 - RNA, 17 nt, Homo sapiens
guucacgcaacuugaaa

SEQ ID NO: 516346 - RNA, 14 nt, Homo sapiens
guucagugccuugg

SEQ ID NO: 516347 - RNA, 14 nt, Homo sapiens
guuccaugucugaa

SEQ ID NO: 516348 - RNA, 19 nt, Homo sapiens
guucccagcaaaguuuuca

SEQ ID NO: 516349 - RNA, 20 nt, Homo sapiens
guucccucuuucuuucuuuu

SEQ ID NO: 516350 - RNA, 20 nt, Homo sapiens
guuccucauggcuguuaucu

SEQ ID NO: 516351 - RNA, 15 nt, Homo sapiens
guugaagaaggcaaa

SEQ ID NO: 516352 - RNA, 17 nt, Homo sapiens
guugauguguccgugaa

SEQ ID NO: 516353 - RNA, 21 nt, Homo sapiens
guugcccuuuuccuugacuau

SEQ ID NO: 516354 - RNA, 13 nt, Homo sapiens
guugggaauugca

SEQ ID NO: 516355 - RNA, 16 nt, Homo sapiens
guugggaauugcaugc

SEQ ID NO: 516356 - RNA, 19 nt, Homo sapiens
guugguuaccuauugcugu

SEQ ID NO: 516357 - RNA, 10 nt, Homo sapiens
guuguucaua

SEQ ID NO: 516358 - RNA, 23 nt, Homo sapiens
guuuaaaaaccaaauaagcaucu

SEQ ID NO: 516359 - RNA, 22 nt, Homo sapiens
guuuaaaaaucaguuuguuguu

SEQ ID NO: 516360 - RNA, 19 nt, Homo sapiens
guuuaaagcaacugucuau

SEQ ID NO: 516361 - RNA, 18 nt, Homo sapiens
guuuaaaucuuuguuaaa

SEQ ID NO: 516362 - RNA, 18 nt, Homo sapiens
guuuaacugaguuagaau

SEQ ID NO: 516363 - RNA, 15 nt, Homo sapiens
guuuaauguuuaguc

SEQ ID NO: 516364 - RNA, 21 nt, Homo sapiens
guuuacugacauggugcugug

SEQ ID NO: 516365 - RNA, 18 nt, Homo sapiens
guuuagaaucaagucugu

SEQ ID NO: 516366 - RNA, 21 nt, Homo sapiens
guuuagaaucaagucugugaa

SEQ ID NO: 516367 - RNA, 20 nt, Homo sapiens
guuuagccuagucaugugcc

SEQ ID NO: 516368 - RNA, 12 nt, Homo sapiens
guuucacagugg

SEQ ID NO: 516369 - RNA, 15 nt, Homo sapiens
guuucagcauuccca

SEQ ID NO: 516370 - RNA, 21 nt, Homo sapiens
guuucauacucuagauuuugu

SEQ ID NO: 516371 - RNA, 18 nt, Homo sapiens
guuuccaaguuuauugcc

SEQ ID NO: 516372 - RNA, 23 nt, Homo sapiens
guuuccaaugccaauucaucuca

SEQ ID NO: 516373 - RNA, 19 nt, Homo sapiens
guuugacuuuagacuguaa

SEQ ID NO: 516374 - RNA, 17 nt, Homo sapiens
guuugcaaaaaaaaaga

SEQ ID NO: 516375 - RNA, 16 nt, Homo sapiens
guuuggccagugacau

SEQ ID NO: 516376 - RNA, 19 nt, Homo sapiens
guuugggcuugauuccugu

SEQ ID NO: 516377 - RNA, 14 nt, Homo sapiens
guuuugagcauucu

SEQ ID NO: 516378 - RNA, 21 nt, Homo sapiens
guuuugugcggugugucucca

SEQ ID NO: 516379 - RNA, 20 nt, Homo sapiens
uaaaaaacuucccaacucac

SEQ ID NO: 516380 - RNA, 14 nt, Homo sapiens
uaaaaacacuacag

SEQ ID NO: 516381 - RNA, 21 nt, Homo sapiens
uaaaaaccaaauaagcaucug

SEQ ID NO: 516382 - RNA, 17 nt, Homo sapiens
uaaaaaguuaaucuuca

SEQ ID NO: 516383 - RNA, 18 nt, Homo sapiens
uaaaaaguuaaucuucau

SEQ ID NO: 516384 - RNA, 15 nt, Homo sapiens
uaaaaauuaugucca

SEQ ID NO: 516385 - RNA, 21 nt, Homo sapiens
uaaaacaagagaccacuuccu

SEQ ID NO: 516386 - RNA, 18 nt, Homo sapiens
uaaaacuaaauagcaugu

SEQ ID NO: 516387 - RNA, 17 nt, Homo sapiens
uaaaacuaucagcagcg

SEQ ID NO: 516388 - RNA, 17 nt, Homo sapiens
uaaaacuuacuauggua

SEQ ID NO: 516389 - RNA, 18 nt, Homo sapiens
uaaaagcaauccauguga

SEQ ID NO: 516390 - RNA, 20 nt, Homo sapiens
uaaaaucacccugacugugg

SEQ ID NO: 516391 - RNA, 22 nt, Homo sapiens
uaaaaucuguauugcuaagaua

SEQ ID NO: 516392 - RNA, 14 nt, Homo sapiens
uaaacaaaauuuau

SEQ ID NO: 516393 - RNA, 13 nt, Homo sapiens
uaaacacagauua

SEQ ID NO: 516394 - RNA, 20 nt, Homo sapiens
uaaacccacauaaacacuuc

SEQ ID NO: 516395 - RNA, 16 nt, Homo sapiens
uaaacgugaugugcuc

SEQ ID NO: 516396 - RNA, 14 nt, Homo sapiens
uaaagaaaggcaga

SEQ ID NO: 516397 - RNA, 20 nt, Homo sapiens
uaaagaaguccaugugauaa

SEQ ID NO: 516398 - RNA, 14 nt, Homo sapiens
uaaaggcuguguca

SEQ ID NO: 516399 - RNA, 19 nt, Homo sapiens
uaaaggugaugaauuuacc

SEQ ID NO: 516400 - RNA, 19 nt, Homo sapiens
uaaagguuucacuguucau

SEQ ID NO: 516401 - RNA, 15 nt, Homo sapiens
uaaagugcacugcca

SEQ ID NO: 516402 - RNA, 14 nt, Homo sapiens
uaaaucagugcagu

SEQ ID NO: 516403 - RNA, 21 nt, Homo sapiens
uaaauccaacucugacuguaa

SEQ ID NO: 516404 - RNA, 15 nt, Homo sapiens
uaaauguaacuuauu

SEQ ID NO: 516405 - RNA, 19 nt, Homo sapiens
uaaauuaaugaguuuuauc

SEQ ID NO: 516406 - RNA, 20 nt, Homo sapiens
uaaauucauuaaaaacacua

SEQ ID NO: 516407 - RNA, 21 nt, Homo sapiens
uaaauuccucugacuugccaa

SEQ ID NO: 516408 - RNA, 23 nt, Homo sapiens
uaacaauguuuuuuauacuucaa

SEQ ID NO: 516409 - RNA, 13 nt, Homo sapiens
uaacacagugcag

SEQ ID NO: 516410 - RNA, 19 nt, Homo sapiens
uaacagaaaaaugaaauuu

SEQ ID NO: 516411 - RNA, 18 nt, Homo sapiens
uaacaggcauugcacuaa

SEQ ID NO: 516412 - RNA, 12 nt, Homo sapiens
uaacagugcagu

SEQ ID NO: 516413 - RNA, 17 nt, Homo sapiens
uaacuucagauguuucc

SEQ ID NO: 516414 - RNA, 18 nt, Homo sapiens
uaacuucagauguuucca

SEQ ID NO: 516415 - RNA, 12 nt, Homo sapiens
uaagacagugca

SEQ ID NO: 516416 - RNA, 23 nt, Homo sapiens
uaagauugaagcuaaaacacuuc

SEQ ID NO: 516417 - RNA, 23 nt, Homo sapiens
uaagcacauccaacuacuccuag

SEQ ID NO: 516418 - RNA, 17 nt, Homo sapiens
uaaggaaugauccaaua

SEQ ID NO: 516419 - RNA, 16 nt, Homo sapiens
uaaggcagugcaguac

SEQ ID NO: 516420 - RNA, 16 nt, Homo sapiens
uaaggcagugcagugc

SEQ ID NO: 516421 - RNA, 20 nt, Homo sapiens
uaagguaaaaccaucuagga

SEQ ID NO: 516422 - RNA, 17 nt, Homo sapiens
uaaguaauuucaugcac

SEQ ID NO: 516423 - RNA, 22 nt, Homo sapiens
uaaguugaaugauaauagcuca

SEQ ID NO: 516424 - RNA, 18 nt, Homo sapiens
uaauauaaaugaaugaaa

SEQ ID NO: 516425 - RNA, 21 nt, Homo sapiens
uaauauaggguuuguuugcug

SEQ ID NO: 516426 - RNA, 16 nt, Homo sapiens
uaauauugccuugaug

SEQ ID NO: 516427 - RNA, 20 nt, Homo sapiens
uaauauuuguuccucuaggu

SEQ ID NO: 516428 - RNA, 12 nt, Homo sapiens
uaauccaaagaa

SEQ ID NO: 516429 - RNA, 14 nt, Homo sapiens
uaauccuagcacuu

SEQ ID NO: 516430 - RNA, 17 nt, Homo sapiens
uaaucuagagcuaugca

SEQ ID NO: 516431 - RNA, 20 nt, Homo sapiens
uaaugaaaucagaagcagua

SEQ ID NO: 516432 - RNA, 14 nt, Homo sapiens
uaaugacaagugac

SEQ ID NO: 516433 - RNA, 14 nt, Homo sapiens
uaauggaaacuguc

SEQ ID NO: 516434 - RNA, 18 nt, Homo sapiens
uaauguuccaugucugaa

SEQ ID NO: 516435 - RNA, 14 nt, Homo sapiens
uaauuaaacugaug

SEQ ID NO: 516436 - RNA, 15 nt, Homo sapiens
uaauuaacuaacuca

SEQ ID NO: 516437 - RNA, 16 nt, Homo sapiens
uaauuggcagcagauu

SEQ ID NO: 516438 - RNA, 19 nt, Homo sapiens
uaauuggcccuguacaguu

SEQ ID NO: 516439 - RNA, 16 nt, Homo sapiens
uacaaaacguauuuau

SEQ ID NO: 516440 - RNA, 14 nt, Homo sapiens
uacaaaauauccaa

SEQ ID NO: 516441 - RNA, 22 nt, Homo sapiens
uacaaacaggugcuaacacugu

SEQ ID NO: 516442 - RNA, 15 nt, Homo sapiens
uacaagcuacauaug

SEQ ID NO: 516443 - RNA, 20 nt, Homo sapiens
uacaauucuuuguugcuuaa

SEQ ID NO: 516444 - RNA, 16 nt, Homo sapiens
uacaauuuagcuuaau

SEQ ID NO: 516445 - RNA, 14 nt, Homo sapiens
cugaacucccaguc

SEQ ID NO: 516446 - RNA, 18 nt, Homo sapiens
cugaacugcaacacugga

SEQ ID NO: 516447 - RNA, 17 nt, Homo sapiens
cugaagccuggauucca

SEQ ID NO: 516448 - RNA, 14 nt, Homo sapiens
cugaauccaucagg

SEQ ID NO: 516449 - RNA, 12 nt, Homo sapiens
cugacacugucu

SEQ ID NO: 516450 - RNA, 23 nt, Homo sapiens
cugacauauuucauaagcacauc

SEQ ID NO: 516451 - RNA, 22 nt, Homo sapiens
cugacauggugcugugugugag

SEQ ID NO: 516452 - RNA, 15 nt, Homo sapiens
cugacuguguucagu

SEQ ID NO: 516453 - RNA, 18 nt, Homo sapiens
cugagacacagcccagag

SEQ ID NO: 516454 - RNA, 11 nt, Homo sapiens
cugagaccacg

SEQ ID NO: 516455 - RNA, 11 nt, Homo sapiens
cugagccugac

SEQ ID NO: 516456 - RNA, 14 nt, Homo sapiens
cugaggaguccaaa

SEQ ID NO: 516457 - RNA, 15 nt, Homo sapiens
cugagggcaggguuc

SEQ ID NO: 516458 - RNA, 12 nt, Homo sapiens
cugagugacaug

SEQ ID NO: 516459 - RNA, 15 nt, Homo sapiens
cugauggugcaauga

SEQ ID NO: 516460 - RNA, 22 nt, Homo sapiens
cugauuuaaacuucuuaacugg

SEQ ID NO: 516461 - RNA, 16 nt, Homo sapiens
cugcaaugucuguccc

SEQ ID NO: 516462 - RNA, 11 nt, Homo sapiens
cugcacagugg

SEQ ID NO: 516463 - RNA, 20 nt, Homo sapiens
cugcagaaaauuaauugaaa

SEQ ID NO: 516464 - RNA, 17 nt, Homo sapiens
cugcagaugacuggaaa

SEQ ID NO: 516465 - RNA, 15 nt, Homo sapiens
cugcaggaacaugac

SEQ ID NO: 516466 - RNA, 15 nt, Homo sapiens
cugcaggaaucaaaa

SEQ ID NO: 516467 - RNA, 12 nt, Homo sapiens
cugcaguuauuu

SEQ ID NO: 516468 - RNA, 15 nt, Homo sapiens
cugcaugaucuuaca

SEQ ID NO: 516469 - RNA, 16 nt, Homo sapiens
cugcauggagaagggu

SEQ ID NO: 516470 - RNA, 17 nt, Homo sapiens
cugccaagaguccaagc

SEQ ID NO: 516471 - RNA, 17 nt, Homo sapiens
cugccagccccaugcca

SEQ ID NO: 516472 - RNA, 18 nt, Homo sapiens
cugccagccccaugccau

SEQ ID NO: 516473 - RNA, 21 nt, Homo sapiens
cugccauuuuuugucugugau

SEQ ID NO: 516474 - RNA, 20 nt, Homo sapiens
cugccuaguuuugaugaauu

SEQ ID NO: 516475 - RNA, 14 nt, Homo sapiens
cugccucacuguga

SEQ ID NO: 516476 - RNA, 13 nt, Homo sapiens
cugccugugguga

SEQ ID NO: 516477 - RNA, 18 nt, Homo sapiens
cugcucgggaaggccuga

SEQ ID NO: 516478 - RNA, 15 nt, Homo sapiens
cugcugcacugcccu

SEQ ID NO: 516479 - RNA, 21 nt, Homo sapiens
cugcuuagugucccuuaccug

SEQ ID NO: 516480 - RNA, 22 nt, Homo sapiens
cugcuugguguaaaccauucuu

SEQ ID NO: 516481 - RNA, 21 nt, Homo sapiens
cuggaaaaaaaaaaauaugag

SEQ ID NO: 516482 - RNA, 14 nt, Homo sapiens
cuggaaaagcacuu

SEQ ID NO: 516483 - RNA, 20 nt, Homo sapiens
cuggaaauaacugagcacuu

SEQ ID NO: 516484 - RNA, 21 nt, Homo sapiens
cuggaaauaacugagcacuuu

SEQ ID NO: 516485 - RNA, 18 nt, Homo sapiens
cuggagcugaagcguuac

SEQ ID NO: 516486 - RNA, 23 nt, Homo sapiens
cuggagggaauccauaucagcuc

SEQ ID NO: 516487 - RNA, 14 nt, Homo sapiens
cugggaaaugagau

SEQ ID NO: 516488 - RNA, 18 nt, Homo sapiens
cugggcaaggaagcuuug

SEQ ID NO: 516489 - RNA, 14 nt, Homo sapiens
cuggguaucucaaa

SEQ ID NO: 516490 - RNA, 12 nt, Homo sapiens
cugggugacaaa

SEQ ID NO: 516491 - RNA, 21 nt, Homo sapiens
cuggugggggccucuuuacca

SEQ ID NO: 516492 - RNA, 16 nt, Homo sapiens
cuguacuucauucaaa

SEQ ID NO: 516493 - RNA, 17 nt, Homo sapiens
cuguagaagaugaccuc

SEQ ID NO: 516494 - RNA, 15 nt, Homo sapiens
cuguauaccccguga

SEQ ID NO: 516495 - RNA, 21 nt, Homo sapiens
cuguauguuauccacuacagg

SEQ ID NO: 516496 - RNA, 15 nt, Homo sapiens
cugucaaguuuuuau

SEQ ID NO: 516497 - RNA, 20 nt, Homo sapiens
cuguccacauguggggacag

SEQ ID NO: 516498 - RNA, 16 nt, Homo sapiens
cuguccugcucacguc

SEQ ID NO: 516499 - RNA, 23 nt, Homo sapiens
cugucgguguuuggaggcugcug

SEQ ID NO: 516500 - RNA, 15 nt, Homo sapiens
cugucuguacuucau

SEQ ID NO: 516501 - RNA, 16 nt, Homo sapiens
cugucuugcugaggga

SEQ ID NO: 516502 - RNA, 17 nt, Homo sapiens
cugugauaacagaguga

SEQ ID NO: 516503 - RNA, 14 nt, Homo sapiens
cugugaucuauacc

SEQ ID NO: 516504 - RNA, 19 nt, Homo sapiens
cugugaucuauaccaccuu

SEQ ID NO: 516505 - RNA, 22 nt, Homo sapiens
cugugcaaagggagguagugug

SEQ ID NO: 516506 - RNA, 12 nt, Homo sapiens
cuguuguaauau

SEQ ID NO: 516507 - RNA, 16 nt, Homo sapiens
cuguuuccaaugccaa

SEQ ID NO: 516508 - RNA, 15 nt, Homo sapiens
cuuaagaugcaaauc

SEQ ID NO: 516509 - RNA, 22 nt, Homo sapiens
cuuaagaugcaaaucaacucuc

SEQ ID NO: 516510 - RNA, 15 nt, Homo sapiens
cuuaaggacaguguu

SEQ ID NO: 516511 - RNA, 20 nt, Homo sapiens
cuuaauuaccuaagagccac

SEQ ID NO: 516512 - RNA, 22 nt, Homo sapiens
cuuaccuguucucuaguuuucc

SEQ ID NO: 516513 - RNA, 14 nt, Homo sapiens
cuuagaauacugua

SEQ ID NO: 516514 - RNA, 16 nt, Homo sapiens
cuuagaauacuguauu

SEQ ID NO: 516515 - RNA, 22 nt, Homo sapiens
cuuagaucaggagaaacucggg

SEQ ID NO: 516516 - RNA, 19 nt, Homo sapiens
cuuaggauuuaccaaauag

SEQ ID NO: 516517 - RNA, 20 nt, Homo sapiens
cuuaguaaauuccuaauucu

SEQ ID NO: 516518 - RNA, 18 nt, Homo sapiens
cuuauaauauacauaacu

SEQ ID NO: 516519 - RNA, 17 nt, Homo sapiens
cuuauauaaauguacag

SEQ ID NO: 516520 - RNA, 16 nt, Homo sapiens
cuuaucauaaauucaa

SEQ ID NO: 516521 - RNA, 17 nt, Homo sapiens
cuuaucuaccaguuuau

SEQ ID NO: 516522 - RNA, 23 nt, Homo sapiens
cuucaaauugucuuuugucaugu

SEQ ID NO: 516523 - RNA, 19 nt, Homo sapiens
cuucaacaugguuaccucu

SEQ ID NO: 516524 - RNA, 13 nt, Homo sapiens
cuucaauguuaaa

SEQ ID NO: 516525 - RNA, 11 nt, Homo sapiens
cuucaccucac

SEQ ID NO: 516526 - RNA, 17 nt, Homo sapiens
cuucacuuaaaaucaaa

SEQ ID NO: 516527 - RNA, 14 nt, Homo sapiens
cuucagauguuucc

SEQ ID NO: 516528 - RNA, 12 nt, Homo sapiens
cuucagcccuaa

SEQ ID NO: 516529 - RNA, 14 nt, Homo sapiens
cuucauguugaugu

SEQ ID NO: 516530 - RNA, 18 nt, Homo sapiens
cuucauucaaaaagccaa

SEQ ID NO: 516531 - RNA, 22 nt, Homo sapiens
cuuccagugcauguugccauga

SEQ ID NO: 516532 - RNA, 13 nt, Homo sapiens
cuuccaugguggu

SEQ ID NO: 516533 - RNA, 15 nt, Homo sapiens
cuucccugacacugu

SEQ ID NO: 516534 - RNA, 16 nt, Homo sapiens
cuucuaauccaugugc

SEQ ID NO: 516535 - RNA, 15 nt, Homo sapiens
cuucuccacagggac

SEQ ID NO: 516536 - RNA, 23 nt, Homo sapiens
cuucuccacagggacacagucug

SEQ ID NO: 516537 - RNA, 17 nt, Homo sapiens
cuucuccccuccaagug

SEQ ID NO: 516538 - RNA, 23 nt, Homo sapiens
cuucuggagauggauccuuccau

SEQ ID NO: 516539 - RNA, 13 nt, Homo sapiens
cuucuguugucau

SEQ ID NO: 516540 - RNA, 17 nt, Homo sapiens
cuucuuuccucuuaaug

SEQ ID NO: 516541 - RNA, 18 nt, Homo sapiens
cuugaaguagacauggaa

SEQ ID NO: 516542 - RNA, 20 nt, Homo sapiens
cuugacccauguucucaaua

SEQ ID NO: 516543 - RNA, 12 nt, Homo sapiens
cuugacuauuac

SEQ ID NO: 516544 - RNA, 13 nt, Homo sapiens
cuugagaccagcc

SEQ ID NO: 516545 - RNA, 23 nt, Homo sapiens
ccuuccccacaauaggcuuagug

SEQ ID NO: 516546 - RNA, 19 nt, Homo sapiens
ccuucccuccccacagucc

SEQ ID NO: 516547 - RNA, 22 nt, Homo sapiens
ccuuccugcccaggggacgugg

SEQ ID NO: 516548 - RNA, 23 nt, Homo sapiens
ccuucgguuguaaguagccagau

SEQ ID NO: 516549 - RNA, 15 nt, Homo sapiens
ccuucuccugcauug

SEQ ID NO: 516550 - RNA, 13 nt, Homo sapiens
ccuugauguuucu

SEQ ID NO: 516551 - RNA, 18 nt, Homo sapiens
ccuugcugggccagggaa

SEQ ID NO: 516552 - RNA, 15 nt, Homo sapiens
ccuuuccccagugug

SEQ ID NO: 516553 - RNA, 13 nt, Homo sapiens
ccuuucuuccuuc

SEQ ID NO: 516554 - RNA, 23 nt, Homo sapiens
ccuuugagugucaggcucugaau

SEQ ID NO: 516555 - RNA, 22 nt, Homo sapiens
ccuuugggaggcagcaucaggg

SEQ ID NO: 516556 - RNA, 21 nt, Homo sapiens
cgaggagcuuccagugcaugu

SEQ ID NO: 516557 - RNA, 21 nt, Homo sapiens
cgaggcggcaaagauccagcg

SEQ ID NO: 516558 - RNA, 14 nt, Homo sapiens
cgagugacagaagg

SEQ ID NO: 516559 - RNA, 19 nt, Homo sapiens
cgaguuccggaaagccuuc

SEQ ID NO: 516560 - RNA, 13 nt, Homo sapiens
cgauccccaugga

SEQ ID NO: 516561 - RNA, 20 nt, Homo sapiens
cgcaaauacaugccuuucca

SEQ ID NO: 516562 - RNA, 14 nt, Homo sapiens
cgcagacgcaagag

SEQ ID NO: 516563 - RNA, 22 nt, Homo sapiens
cgccaugggggucuuugaacac

SEQ ID NO: 516564 - RNA, 18 nt, Homo sapiens
cgccccccggccugaugg

SEQ ID NO: 516565 - RNA, 13 nt, Homo sapiens
cgcgcaccgccca

SEQ ID NO: 516566 - RNA, 11 nt, Homo sapiens
cgcguauuuca

SEQ ID NO: 516567 - RNA, 16 nt, Homo sapiens
cgcugcagucagcaca

SEQ ID NO: 516568 - RNA, 16 nt, Homo sapiens
cgcugguaacuguuaa

SEQ ID NO: 516569 - RNA, 12 nt, Homo sapiens
cgcuuuuguacg

SEQ ID NO: 516570 - RNA, 11 nt, Homo sapiens
cggaaagccuu

SEQ ID NO: 516571 - RNA, 13 nt, Homo sapiens
cggaaaugauuga

SEQ ID NO: 516572 - RNA, 14 nt, Homo sapiens
cggccccaucagag

SEQ ID NO: 516573 - RNA, 14 nt, Homo sapiens
cguccguccgcccg

SEQ ID NO: 516574 - RNA, 19 nt, Homo sapiens
cguccuuagaauacuguau

SEQ ID NO: 516575 - RNA, 18 nt, Homo sapiens
cgugaaacacaauaucau

SEQ ID NO: 516576 - RNA, 19 nt, Homo sapiens
cgugaaaguugugaucugu

SEQ ID NO: 516577 - RNA, 20 nt, Homo sapiens
cgugaggccccugugcagua

SEQ ID NO: 516578 - RNA, 14 nt, Homo sapiens
cgugcccauuucac

SEQ ID NO: 516579 - RNA, 16 nt, Homo sapiens
cguuuggccagugaca

SEQ ID NO: 516580 - RNA, 14 nt, Homo sapiens
cuaacauagugucu

SEQ ID NO: 516581 - RNA, 14 nt, Homo sapiens
cuaacucccuaggc

SEQ ID NO: 516582 - RNA, 23 nt, Homo sapiens
cuaacucccuaggccugaguuag

SEQ ID NO: 516583 - RNA, 16 nt, Homo sapiens
cuaagguaaaaccauc

SEQ ID NO: 516584 - RNA, 17 nt, Homo sapiens
cuaaguccacucuaguu

SEQ ID NO: 516585 - RNA, 13 nt, Homo sapiens
cuaauaaacaauu

SEQ ID NO: 516586 - RNA, 20 nt, Homo sapiens
cuaaugccucuuaauugcau

SEQ ID NO: 516587 - RNA, 17 nt, Homo sapiens
cuaauucuaugauuaaa

SEQ ID NO: 516588 - RNA, 13 nt, Homo sapiens
cuaauuugugaaa

SEQ ID NO: 516589 - RNA, 17 nt, Homo sapiens
cuaccauuauggcuuug

SEQ ID NO: 516590 - RNA, 14 nt, Homo sapiens
cuacccaugcaauu

SEQ ID NO: 516591 - RNA, 16 nt, Homo sapiens
cuacuuaaacaaaaac

SEQ ID NO: 516592 - RNA, 20 nt, Homo sapiens
cuacuuaaacaaaaacuuuc

SEQ ID NO: 516593 - RNA, 18 nt, Homo sapiens
cuacuuuaaauuguggau

SEQ ID NO: 516594 - RNA, 20 nt, Homo sapiens
cuagagcuaugcacaccaaa

SEQ ID NO: 516595 - RNA, 16 nt, Homo sapiens
cuagauccaauugcau

SEQ ID NO: 516596 - RNA, 16 nt, Homo sapiens
cuaguacucaguacua

SEQ ID NO: 516597 - RNA, 22 nt, Homo sapiens
cuaucagggcaagcucauagca

SEQ ID NO: 516598 - RNA, 13 nt, Homo sapiens
cuaucaguaauag

SEQ ID NO: 516599 - RNA, 22 nt, Homo sapiens
cuauuggcauaaaacaaaccag

SEQ ID NO: 516600 - RNA, 16 nt, Homo sapiens
cuauuuagaugagauc

SEQ ID NO: 516601 - RNA, 16 nt, Homo sapiens
cuauuucgcacuguau

SEQ ID NO: 516602 - RNA, 15 nt, Homo sapiens
cucaaaauaaaacca

SEQ ID NO: 516603 - RNA, 21 nt, Homo sapiens
cucaaagaggccaguacuuug

SEQ ID NO: 516604 - RNA, 19 nt, Homo sapiens
cucaauaaggcagugcagu

SEQ ID NO: 516605 - RNA, 20 nt, Homo sapiens
cucaauaaggcagugcagug

SEQ ID NO: 516606 - RNA, 13 nt, Homo sapiens
cucaaucucaggu

SEQ ID NO: 516607 - RNA, 12 nt, Homo sapiens
cucaauucauau

SEQ ID NO: 516608 - RNA, 13 nt, Homo sapiens
cucaccugaauaa

SEQ ID NO: 516609 - RNA, 13 nt, Homo sapiens
cucacugauauau

SEQ ID NO: 516610 - RNA, 15 nt, Homo sapiens
cucagaaacagaaga

SEQ ID NO: 516611 - RNA, 17 nt, Homo sapiens
cucagagaaugaucacc

SEQ ID NO: 516612 - RNA, 17 nt, Homo sapiens
cucagcaaucacaagcc

SEQ ID NO: 516613 - RNA, 16 nt, Homo sapiens
cucaggagaaggccug

SEQ ID NO: 516614 - RNA, 19 nt, Homo sapiens
cucaggagcacagccauag

SEQ ID NO: 516615 - RNA, 17 nt, Homo sapiens
cucaggcagugcaguac

SEQ ID NO: 516616 - RNA, 13 nt, Homo sapiens
cucaggcuuucua

SEQ ID NO: 516617 - RNA, 16 nt, Homo sapiens
cucaggugcgugccac

SEQ ID NO: 516618 - RNA, 21 nt, Homo sapiens
cucagguuauucguuacucua

SEQ ID NO: 516619 - RNA, 19 nt, Homo sapiens
cucaguaacacagugcagu

SEQ ID NO: 516620 - RNA, 20 nt, Homo sapiens
cucaguaacacagugcagua

SEQ ID NO: 516621 - RNA, 18 nt, Homo sapiens
cucaguaacagugcagua

SEQ ID NO: 516622 - RNA, 20 nt, Homo sapiens
cucaguaagacagugcagug

SEQ ID NO: 516623 - RNA, 23 nt, Homo sapiens
cucaguaaggcagugcaguacuc

SEQ ID NO: 516624 - RNA, 19 nt, Homo sapiens
cucaguuaggcagugcagu

SEQ ID NO: 516625 - RNA, 20 nt, Homo sapiens
cucaguuaggcagugcagua

SEQ ID NO: 516626 - RNA, 21 nt, Homo sapiens
cucaguuaggcagugcaguac

SEQ ID NO: 516627 - RNA, 14 nt, Homo sapiens
cucaucaacaaaga

SEQ ID NO: 516628 - RNA, 12 nt, Homo sapiens
cucaucagaaac

SEQ ID NO: 516629 - RNA, 20 nt, Homo sapiens
cuccacaguuaggccaagaa

SEQ ID NO: 516630 - RNA, 18 nt, Homo sapiens
cuccagaauauggaaaca

SEQ ID NO: 516631 - RNA, 16 nt, Homo sapiens
cuccaguucugaugag

SEQ ID NO: 516632 - RNA, 23 nt, Homo sapiens
cuccaugauuauuaguugaccaa

SEQ ID NO: 516633 - RNA, 14 nt, Homo sapiens
cucccaagcacuuc

SEQ ID NO: 516634 - RNA, 16 nt, Homo sapiens
cucccaagcacuucaa

SEQ ID NO: 516635 - RNA, 21 nt, Homo sapiens
cuccccagcccuuugcaggcc

SEQ ID NO: 516636 - RNA, 16 nt, Homo sapiens
cuccccugguccugca

SEQ ID NO: 516637 - RNA, 17 nt, Homo sapiens
cucccuuuuuaaacaaa

SEQ ID NO: 516638 - RNA, 15 nt, Homo sapiens
cuccuaagacaccug

SEQ ID NO: 516639 - RNA, 16 nt, Homo sapiens
cuccuuuaauauacuc

SEQ ID NO: 516640 - RNA, 16 nt, Homo sapiens
cucgaaucagacugaa

SEQ ID NO: 516641 - RNA, 14 nt, Homo sapiens
cucgcagccugaag

SEQ ID NO: 516642 - RNA, 18 nt, Homo sapiens
cucguagaaacaagacaa

SEQ ID NO: 516643 - RNA, 20 nt, Homo sapiens
cuugagugaucccaaaccaa

SEQ ID NO: 516644 - RNA, 22 nt, Homo sapiens
cuugccaaaacagauauacucg

SEQ ID NO: 516645 - RNA, 14 nt, Homo sapiens
cuugcccaugcaca

SEQ ID NO: 516646 - RNA, 16 nt, Homo sapiens
cuugccugaauccauc

SEQ ID NO: 516647 - RNA, 13 nt, Homo sapiens
cuugcucuaccug

SEQ ID NO: 516648 - RNA, 15 nt, Homo sapiens
cuugcugugaaauga

SEQ ID NO: 516649 - RNA, 23 nt, Homo sapiens
cuuggagagagaggcugccucag

SEQ ID NO: 516650 - RNA, 19 nt, Homo sapiens
cuuggucucuuucuuucca

SEQ ID NO: 516651 - RNA, 19 nt, Homo sapiens
cuugguguuguuauggcaa

SEQ ID NO: 516652 - RNA, 18 nt, Homo sapiens
cuuguaaaacugugacau

SEQ ID NO: 516653 - RNA, 19 nt, Homo sapiens
cuugucaggauaguugcuc

SEQ ID NO: 516654 - RNA, 20 nt, Homo sapiens
cuugucucaaaaaccauuac

SEQ ID NO: 516655 - RNA, 21 nt, Homo sapiens
cuugucucaaaaaccauuaca

SEQ ID NO: 516656 - RNA, 19 nt, Homo sapiens
cuuguucuuagggcuugga

SEQ ID NO: 516657 - RNA, 14 nt, Homo sapiens
cuuuaacaagacuu

SEQ ID NO: 516658 - RNA, 14 nt, Homo sapiens
cuuuacagugccac

SEQ ID NO: 516659 - RNA, 14 nt, Homo sapiens
gcccucugcugcuu

SEQ ID NO: 516660 - RNA, 19 nt, Homo sapiens
gcccucugcugcuuuccaa

SEQ ID NO: 516661 - RNA, 16 nt, Homo sapiens
gcccuucccugacacu

SEQ ID NO: 516662 - RNA, 20 nt, Homo sapiens
gcccuucccugacacugucu

SEQ ID NO: 516663 - RNA, 21 nt, Homo sapiens
gcccuuuuccuugacuauuac

SEQ ID NO: 516664 - RNA, 14 nt, Homo sapiens
gccgcucuccgccc

SEQ ID NO: 516665 - RNA, 17 nt, Homo sapiens
gccgcuuaaacauuucc

SEQ ID NO: 516666 - RNA, 14 nt, Homo sapiens
gccucagggaccaa

SEQ ID NO: 516667 - RNA, 19 nt, Homo sapiens
gccucccgccgccucgggc

SEQ ID NO: 516668 - RNA, 20 nt, Homo sapiens
gccucuuaggcagaaaaccu

SEQ ID NO: 516669 - RNA, 18 nt, Homo sapiens
gccugacuguguucagug

SEQ ID NO: 516670 - RNA, 15 nt, Homo sapiens
gccugaugauggaag

SEQ ID NO: 516671 - RNA, 15 nt, Homo sapiens
gccugcauggagaag

SEQ ID NO: 516672 - RNA, 18 nt, Homo sapiens
ugagaggagcguguccua

SEQ ID NO: 516673 - RNA, 18 nt, Homo sapiens
ugagcaaacugaagccca

SEQ ID NO: 516674 - RNA, 17 nt, Homo sapiens
ugagcaaggacaaccug

SEQ ID NO: 516675 - RNA, 23 nt, Homo sapiens
ugagcaaguuuucaccuaucugg

SEQ ID NO: 516676 - RNA, 20 nt, Homo sapiens
uguaaaugcuugauggaauu

SEQ ID NO: 516677 - RNA, 21 nt, Homo sapiens
uguacaaaaugaauugccuuu

SEQ ID NO: 516678 - RNA, 18 nt, Homo sapiens
uguacaaauaauauugcc

SEQ ID NO: 516679 - RNA, 20 nt, Homo sapiens
uguacaaauaauauugccuu

SEQ ID NO: 516680 - RNA, 23 nt, Homo sapiens
uguacuggauuuaacuaccuuug

SEQ ID NO: 516681 - RNA, 15 nt, Homo sapiens
uguauuaaauguaac

SEQ ID NO: 516682 - RNA, 15 nt, Homo sapiens
ugucaaauggaugua

SEQ ID NO: 516683 - RNA, 23 nt, Homo sapiens
ugucacccaaguuggagugcagu

SEQ ID NO: 516684 - RNA, 13 nt, Homo sapiens
uguccauugacau

SEQ ID NO: 516685 - RNA, 18 nt, Homo sapiens
uguccauugacauguaca

SEQ ID NO: 516686 - RNA, 21 nt, Homo sapiens
ugucuaaggaaugauccaaua

SEQ ID NO: 516687 - RNA, 21 nt, Homo sapiens
ugucucaaaauaaaaccagaa

SEQ ID NO: 516688 - RNA, 12 nt, Homo sapiens
ugucuguacuuc

SEQ ID NO: 516689 - RNA, 16 nt, Homo sapiens
ugucuucauguugaug

SEQ ID NO: 516690 - RNA, 17 nt, Homo sapiens
ugugaaggucuugccug

SEQ ID NO: 516691 - RNA, 16 nt, Homo sapiens
ugugagcagucucagc

SEQ ID NO: 516692 - RNA, 20 nt, Homo sapiens
ugugagcuuucugauacuua

SEQ ID NO: 516693 - RNA, 21 nt, Homo sapiens
ugugaucuauaccaccuucaa

SEQ ID NO: 516694 - RNA, 19 nt, Homo sapiens
ugugccaaaaugucaauuu

SEQ ID NO: 516695 - RNA, 15 nt, Homo sapiens
ugugcccacgugugc

SEQ ID NO: 516696 - RNA, 19 nt, Homo sapiens
ugugcuaaguugucuuaca

SEQ ID NO: 516697 - RNA, 23 nt, Homo sapiens
ugugcugccuguggugagguccu

SEQ ID NO: 516698 - RNA, 17 nt, Homo sapiens
ugugcuggugggggccu

SEQ ID NO: 516699 - RNA, 18 nt, Homo sapiens
ugugcuguugauucuuuc

SEQ ID NO: 516700 - RNA, 20 nt, Homo sapiens
ugugguuaaauaaauucuua

SEQ ID NO: 516701 - RNA, 16 nt, Homo sapiens
uguguacaaaauaucc

SEQ ID NO: 516702 - RNA, 14 nt, Homo sapiens
uguguagauugcgu

SEQ ID NO: 516703 - RNA, 16 nt, Homo sapiens
uguguagcucugucca

SEQ ID NO: 516704 - RNA, 14 nt, Homo sapiens
ugugucacacugag

SEQ ID NO: 516705 - RNA, 21 nt, Homo sapiens
uguguccgugaaaguugugau

SEQ ID NO: 516706 - RNA, 15 nt, Homo sapiens
ugugugaagcaaauu

SEQ ID NO: 516707 - RNA, 14 nt, Homo sapiens
ugugugcaauguuc

SEQ ID NO: 516708 - RNA, 14 nt, Homo sapiens
ugugugcagugaug

SEQ ID NO: 516709 - RNA, 13 nt, Homo sapiens
uguguucagugcc

SEQ ID NO: 516710 - RNA, 16 nt, Homo sapiens
uguuaaugauucuugu

SEQ ID NO: 516711 - RNA, 15 nt, Homo sapiens
uguuagauacacaaa

SEQ ID NO: 516712 - RNA, 14 nt, Homo sapiens
uguucagaaaagca

SEQ ID NO: 516713 - RNA, 19 nt, Homo sapiens
uguucgguugcgugcaugu

SEQ ID NO: 516714 - RNA, 14 nt, Homo sapiens
uguucucuucuaua

SEQ ID NO: 516715 - RNA, 21 nt, Homo sapiens
uguucuguggcugauuuacua

SEQ ID NO: 516716 - RNA, 19 nt, Homo sapiens
uguuuaauaauauguacaa

SEQ ID NO: 516717 - RNA, 17 nt, Homo sapiens
uguuuaggugccucuac

SEQ ID NO: 516718 - RNA, 16 nt, Homo sapiens
uguuucugcaguauuc

SEQ ID NO: 516719 - RNA, 20 nt, Homo sapiens
uguuugacuuuagacuguaa

SEQ ID NO: 516720 - RNA, 16 nt, Homo sapiens
uguuuucccauugcag

SEQ ID NO: 516721 - RNA, 18 nt, Homo sapiens
uguuuuuaauccaaagaa

SEQ ID NO: 516722 - RNA, 17 nt, Homo sapiens
uuaaaaaucagaaagac

SEQ ID NO: 516723 - RNA, 20 nt, Homo sapiens
uuaaaacuuacuaugguaua

SEQ ID NO: 516724 - RNA, 15 nt, Homo sapiens
uuaaaauauaguguu

SEQ ID NO: 516725 - RNA, 12 nt, Homo sapiens
uuaacuaacuca

SEQ ID NO: 516726 - RNA, 14 nt, Homo sapiens
uuaacuagugucau

SEQ ID NO: 516727 - RNA, 20 nt, Homo sapiens
uuaacuccguuuccaaauac

SEQ ID NO: 516728 - RNA, 13 nt, Homo sapiens
uuaacugcuucaa

SEQ ID NO: 516729 - RNA, 14 nt, Homo sapiens
uuaagaugggcaua

SEQ ID NO: 516730 - RNA, 12 nt, Homo sapiens
uuaagugcuaug

SEQ ID NO: 516731 - RNA, 17 nt, Homo sapiens
uuaauugaggcuuacag

SEQ ID NO: 516732 - RNA, 16 nt, Homo sapiens
uuaauugcucuaugcc

SEQ ID NO: 516733 - RNA, 15 nt, Homo sapiens
uuacagucacauuca

SEQ ID NO: 516734 - RNA, 16 nt, Homo sapiens
uuacagugacugugga

SEQ ID NO: 516735 - RNA, 17 nt, Homo sapiens
uuaccacuaguugcuua

SEQ ID NO: 516736 - RNA, 16 nt, Homo sapiens
uuaccuaacuguuccu

SEQ ID NO: 516737 - RNA, 13 nt, Homo sapiens
uuaccuguucucu

SEQ ID NO: 516738 - RNA, 13 nt, Homo sapiens
uuacuaacacugg

SEQ ID NO: 516739 - RNA, 19 nt, Homo sapiens
uuacuguuuugggccucca

SEQ ID NO: 516740 - RNA, 19 nt, Homo sapiens
uuagacaagucuaguggaa

SEQ ID NO: 516741 - RNA, 15 nt, Homo sapiens
uuagacauaccucuc

SEQ ID NO: 516742 - RNA, 17 nt, Homo sapiens
uuagagauacccucuga

SEQ ID NO: 516743 - RNA, 22 nt, Homo sapiens
uuagauuaacccuauuaaucua

SEQ ID NO: 516744 - RNA, 12 nt, Homo sapiens
uuagauucucuu

SEQ ID NO: 516745 - RNA, 19 nt, Homo sapiens
uuagauuuuaaaacuucau

SEQ ID NO: 516746 - RNA, 18 nt, Homo sapiens
uuagcaaagcaugccaau

SEQ ID NO: 516747 - RNA, 21 nt, Homo sapiens
uuagccuagucaugugccuug

SEQ ID NO: 516748 - RNA, 16 nt, Homo sapiens
uuagcuuacugauuaa

SEQ ID NO: 516749 - RNA, 22 nt, Homo sapiens
uuaggcaauggugaacugucau

SEQ ID NO: 516750 - RNA, 15 nt, Homo sapiens
uuaguaucucaucaa

SEQ ID NO: 516751 - RNA, 17 nt, Homo sapiens
uuauaccuguacacaca

SEQ ID NO: 516752 - RNA, 17 nt, Homo sapiens
uuauaucagacugcuuu

SEQ ID NO: 516753 - RNA, 16 nt, Homo sapiens
uuauauuucaaccaca

SEQ ID NO: 516754 - RNA, 19 nt, Homo sapiens
uuaucuagcauagcacaaa

SEQ ID NO: 516755 - RNA, 13 nt, Homo sapiens
uuaucugucuuua

SEQ ID NO: 516756 - RNA, 11 nt, Homo sapiens
uuauguacaaa

SEQ ID NO: 516757 - RNA, 16 nt, Homo sapiens
uuauuagcaccagcuu

SEQ ID NO: 516758 - RNA, 18 nt, Homo sapiens
uuauucuuccaaguucau

SEQ ID NO: 516759 - RNA, 17 nt, Homo sapiens
uucaaacgaaauggcuc

SEQ ID NO: 516760 - RNA, 21 nt, Homo sapiens
uucaaaugucauuucauacaa

SEQ ID NO: 516761 - RNA, 15 nt, Homo sapiens
uucaagaaugcagua

SEQ ID NO: 516762 - RNA, 18 nt, Homo sapiens
uucaagcacccuguuccc

SEQ ID NO: 516763 - RNA, 18 nt, Homo sapiens
uucaaguuaauucucaga

SEQ ID NO: 516764 - RNA, 21 nt, Homo sapiens
uucaaucacugaaaaugugcu

SEQ ID NO: 516765 - RNA, 13 nt, Homo sapiens
uucacacaaagug

SEQ ID NO: 516766 - RNA, 21 nt, Homo sapiens
uucacaucuguauaucagcuc

SEQ ID NO: 516767 - RNA, 12 nt, Homo sapiens
uucagcacacac

SEQ ID NO: 516768 - RNA, 23 nt, Homo sapiens
uucaggaauaaaguucagugugc

SEQ ID NO: 516769 - RNA, 18 nt, Homo sapiens
uucauaccuucugaugaa

SEQ ID NO: 516770 - RNA, 18 nt, Homo sapiens
uucaucugaggaguccaa

SEQ ID NO: 516771 - RNA, 23 nt, Homo sapiens
uucauggaguagagucaggagaa

SEQ ID NO: 516772 - RNA, 23 nt, Homo sapiens
uuccaaaaguacuagcaauaagu

SEQ ID NO: 516773 - RNA, 13 nt, Homo sapiens
uuccaaaguuuug

SEQ ID NO: 516774 - RNA, 14 nt, Homo sapiens
uuccaacacacaau

SEQ ID NO: 516775 - RNA, 20 nt, Homo sapiens
uuccagacaggguggggcuu

SEQ ID NO: 516776 - RNA, 15 nt, Homo sapiens
uuccagcaaaauaua

SEQ ID NO: 516777 - RNA, 22 nt, Homo sapiens
uuccauacgugcccauuucaca

SEQ ID NO: 516778 - RNA, 15 nt, Homo sapiens
uucccaacaauacuu

SEQ ID NO: 516779 - RNA, 23 nt, Homo sapiens
uucccaauuaucaaaaaacagaa

SEQ ID NO: 516780 - RNA, 16 nt, Homo sapiens
uucccauugcaguuga

SEQ ID NO: 516781 - RNA, 22 nt, Homo sapiens
uucccauuuccuugucuaaaga

SEQ ID NO: 516782 - RNA, 19 nt, Homo sapiens
uuccccacaauaggcuuag

SEQ ID NO: 516783 - RNA, 21 nt, Homo sapiens
uucccgcagcaccagccugag

SEQ ID NO: 516784 - RNA, 21 nt, Homo sapiens
uucccguggcuuugugcuuau

SEQ ID NO: 516785 - RNA, 16 nt, Homo sapiens
uucccugaacacucau

SEQ ID NO: 516786 - RNA, 15 nt, Homo sapiens
uuccggaaagccuuc

SEQ ID NO: 516787 - RNA, 14 nt, Homo sapiens
uuccuauuggaaaa

SEQ ID NO: 516788 - RNA, 21 nt, Homo sapiens
uuccugaauaauuuccaaaug

SEQ ID NO: 516789 - RNA, 16 nt, Homo sapiens
uuccugccuacuggau

SEQ ID NO: 516790 - RNA, 18 nt, Homo sapiens
uuccugcuccuccaguac

SEQ ID NO: 516791 - RNA, 17 nt, Homo sapiens
acaggaggcaggcaugg

SEQ ID NO: 516792 - RNA, 22 nt, Homo sapiens
acaggcgugauccaccacaccu

SEQ ID NO: 516793 - RNA, 18 nt, Homo sapiens
acagggucauguuugcag

SEQ ID NO: 516794 - RNA, 19 nt, Homo sapiens
augcuaaaggagcaucuau

SEQ ID NO: 516795 - RNA, 22 nt, Homo sapiens
augcuaccccacuaugacagag

SEQ ID NO: 516796 - RNA, 21 nt, Homo sapiens
augcuccaucccaaccaggca

SEQ ID NO: 516797 - RNA, 18 nt, Homo sapiens
augcugcucaauuccuuc

SEQ ID NO: 516798 - RNA, 13 nt, Homo sapiens
augcuggcaaagg

SEQ ID NO: 516799 - RNA, 17 nt, Homo sapiens
augcuguacacauauuu

SEQ ID NO: 516800 - RNA, 15 nt, Homo sapiens
auggaacagcauuac

SEQ ID NO: 516801 - RNA, 22 nt, Homo sapiens
auggaauuuuuugaauaugccu

SEQ ID NO: 516802 - RNA, 21 nt, Homo sapiens
auggaguuucucuagaagcuc

SEQ ID NO: 516803 - RNA, 22 nt, Homo sapiens
auggauccagaacugcacucuu

SEQ ID NO: 516804 - RNA, 11 nt, Homo sapiens
auggcacugac

SEQ ID NO: 516805 - RNA, 14 nt, Homo sapiens
auggcagaagggaa

SEQ ID NO: 516806 - RNA, 14 nt, Homo sapiens
auggcagccuacuc

SEQ ID NO: 516807 - RNA, 23 nt, Homo sapiens
auggcccccaauaaaggcagcug

SEQ ID NO: 516808 - RNA, 14 nt, Homo sapiens
augggacugugagg

SEQ ID NO: 516809 - RNA, 23 nt, Homo sapiens
augggagaguacacccuuuccag

SEQ ID NO: 516810 - RNA, 19 nt, Homo sapiens
augggagcuuaacuuuaua

SEQ ID NO: 516811 - RNA, 13 nt, Homo sapiens
auggggaggacaa

SEQ ID NO: 516812 - RNA, 20 nt, Homo sapiens
augggugaacuuacuugcau

SEQ ID NO: 516813 - RNA, 15 nt, Homo sapiens
auggugcugcucugu

SEQ ID NO: 516814 - RNA, 23 nt, Homo sapiens
augguggccagccagaucaagga

SEQ ID NO: 516815 - RNA, 15 nt, Homo sapiens
augguguguucugca

SEQ ID NO: 516816 - RNA, 18 nt, Homo sapiens
augguucccaagcgucau

SEQ ID NO: 516817 - RNA, 21 nt, Homo sapiens
auguaaaagaacuuacugauu

SEQ ID NO: 516818 - RNA, 13 nt, Homo sapiens
auguaaaugguau

SEQ ID NO: 516819 - RNA, 13 nt, Homo sapiens
auguaacacuggc

SEQ ID NO: 516820 - RNA, 15 nt, Homo sapiens
auguaagugggccca

SEQ ID NO: 516821 - RNA, 17 nt, Homo sapiens
auguaauacauauagca

SEQ ID NO: 516822 - RNA, 23 nt, Homo sapiens
auguacaauaaagcaauguggua

SEQ ID NO: 516823 - RNA, 20 nt, Homo sapiens
auguagaggcuuguuuaccu

SEQ ID NO: 516824 - RNA, 21 nt, Homo sapiens
auguagcgcuuugaauaugaa

SEQ ID NO: 516825 - RNA, 17 nt, Homo sapiens
auguaucaguguccuuu

SEQ ID NO: 516826 - RNA, 17 nt, Homo sapiens
auguauuuugacacugg

SEQ ID NO: 516827 - RNA, 12 nt, Homo sapiens
augucacauuua

SEQ ID NO: 516828 - RNA, 15 nt, Homo sapiens
augucaguagugcua

SEQ ID NO: 516829 - RNA, 20 nt, Homo sapiens
augucauugucuacuccuag

SEQ ID NO: 516830 - RNA, 11 nt, Homo sapiens
auguccaaaga

SEQ ID NO: 516831 - RNA, 17 nt, Homo sapiens
auguccagcaccuugug

SEQ ID NO: 516832 - RNA, 20 nt, Homo sapiens
auguccagcaccuugugccu

SEQ ID NO: 516833 - RNA, 15 nt, Homo sapiens
augucuugacuguua

SEQ ID NO: 516834 - RNA, 17 nt, Homo sapiens
augucuugacuguuagu

SEQ ID NO: 516835 - RNA, 21 nt, Homo sapiens
augugaaaauuacaguccaaa

SEQ ID NO: 516836 - RNA, 17 nt, Homo sapiens
augugaauaauggcacu

SEQ ID NO: 516837 - RNA, 13 nt, Homo sapiens
augugcugucacg

SEQ ID NO: 516838 - RNA, 18 nt, Homo sapiens
auguggccaagcacaucu

SEQ ID NO: 516839 - RNA, 22 nt, Homo sapiens
auguguggcucagugccuggac

SEQ ID NO: 516840 - RNA, 19 nt, Homo sapiens
auguguuucuccugagcua

SEQ ID NO: 516841 - RNA, 13 nt, Homo sapiens
auguuaaagggau

SEQ ID NO: 516842 - RNA, 22 nt, Homo sapiens
auguuaauugggcaggugaaaa

SEQ ID NO: 516843 - RNA, 16 nt, Homo sapiens
auguuacugacuccuc

SEQ ID NO: 516844 - RNA, 18 nt, Homo sapiens
auguuacugacuccucag

SEQ ID NO: 516845 - RNA, 23 nt, Homo sapiens
auguuuuuagaggacuauuacau

SEQ ID NO: 516846 - RNA, 17 nt, Homo sapiens
auuaaaaaaucagagaa

SEQ ID NO: 516847 - RNA, 12 nt, Homo sapiens
auuaaaacauua

SEQ ID NO: 516848 - RNA, 19 nt, Homo sapiens
auuaagacuuuauguaguu

SEQ ID NO: 516849 - RNA, 17 nt, Homo sapiens
auuaauaguuugucuau

SEQ ID NO: 516850 - RNA, 14 nt, Homo sapiens
auuaaucaccucuc

SEQ ID NO: 516851 - RNA, 23 nt, Homo sapiens
auuaguacagaaauauccaugac

SEQ ID NO: 516852 - RNA, 14 nt, Homo sapiens
auuauaaaguuuuc

SEQ ID NO: 516853 - RNA, 17 nt, Homo sapiens
auuaucuauuaucucaa

SEQ ID NO: 516854 - RNA, 19 nt, Homo sapiens
auucaaaaacauaacugag

SEQ ID NO: 516855 - RNA, 17 nt, Homo sapiens
auucaaccaaccaagga

SEQ ID NO: 516856 - RNA, 21 nt, Homo sapiens
auucaacucuccaauguucua

SEQ ID NO: 516857 - RNA, 13 nt, Homo sapiens
auucagaacuuua

SEQ ID NO: 516858 - RNA, 18 nt, Homo sapiens
auucagcgggagcacugc

SEQ ID NO: 516859 - RNA, 23 nt, Homo sapiens
auucagugagggucuucuuacau

SEQ ID NO: 516860 - RNA, 21 nt, Homo sapiens
auuccccuguagcagucacug

SEQ ID NO: 516861 - RNA, 23 nt, Homo sapiens
auuccccuguagcagucacugac

SEQ ID NO: 516862 - RNA, 19 nt, Homo sapiens
auuccguugucuguggaug

SEQ ID NO: 516863 - RNA, 22 nt, Homo sapiens
auucuauugggauauccuuuca

SEQ ID NO: 516864 - RNA, 12 nt, Homo sapiens
auucuccagaau

SEQ ID NO: 516865 - RNA, 20 nt, Homo sapiens
auucucccaaaguaccuuga

SEQ ID NO: 516866 - RNA, 15 nt, Homo sapiens
auucuccugccucag

SEQ ID NO: 516867 - RNA, 13 nt, Homo sapiens
auucugcuaccaa

SEQ ID NO: 516868 - RNA, 17 nt, Homo sapiens
auucuggcaggaccuca

SEQ ID NO: 516869 - RNA, 22 nt, Homo sapiens
auucuggcaucuuagaccucca

SEQ ID NO: 516870 - RNA, 22 nt, Homo sapiens
auucuguaaaauuaaacaaaua

SEQ ID NO: 516871 - RNA, 19 nt, Homo sapiens
auucuuaugauuacuauca

SEQ ID NO: 516872 - RNA, 16 nt, Homo sapiens
auucuuuucucagugu

SEQ ID NO: 516873 - RNA, 23 nt, Homo sapiens
auugaccauuuuuuaauuuacuu

SEQ ID NO: 516874 - RNA, 12 nt, Homo sapiens
auugacucugca

SEQ ID NO: 516875 - RNA, 20 nt, Homo sapiens
auugagcagaagaucaagga

SEQ ID NO: 516876 - RNA, 18 nt, Homo sapiens
auugauaaaagcauuguu

SEQ ID NO: 516877 - RNA, 15 nt, Homo sapiens
auugaugagcaagac

SEQ ID NO: 516878 - RNA, 16 nt, Homo sapiens
auugcaagaguuuaau

SEQ ID NO: 516879 - RNA, 15 nt, Homo sapiens
auugcacuccauccu

SEQ ID NO: 516880 - RNA, 15 nt, Homo sapiens
auugcauacuuugua

SEQ ID NO: 516881 - RNA, 13 nt, Homo sapiens
auugcuacaaauc

SEQ ID NO: 516882 - RNA, 16 nt, Homo sapiens
auuggaacugcaauga

SEQ ID NO: 516883 - RNA, 19 nt, Homo sapiens
auuguacuuccaggcuugg

SEQ ID NO: 516884 - RNA, 12 nt, Homo sapiens
auuguagccuca

SEQ ID NO: 516885 - RNA, 20 nt, Homo sapiens
auugugacuuugcuuugaga

SEQ ID NO: 516886 - RNA, 17 nt, Homo sapiens
auugugcaguacuuugu

SEQ ID NO: 516887 - RNA, 17 nt, Homo sapiens
auuuaagaugugaaaau

SEQ ID NO: 516888 - RNA, 22 nt, Homo sapiens
auuuagauccugguuucauaac

SEQ ID NO: 516889 - RNA, 16 nt, Homo sapiens
auuuagcugugcucag

SEQ ID NO: 516890 - RNA, 23 nt, Homo sapiens
auuuauccaaaauguguauuucu

SEQ ID NO: 516891 - RNA, 20 nt, Homo sapiens
auuuauccagaaaacuguga

SEQ ID NO: 516892 - RNA, 18 nt, Homo sapiens
auuucacucucaaacuuc

SEQ ID NO: 516893 - RNA, 19 nt, Homo sapiens
auuucacucucaaacuuca

SEQ ID NO: 516894 - RNA, 19 nt, Homo sapiens
auuucaggagaaccuaaca

SEQ ID NO: 516895 - RNA, 22 nt, Homo sapiens
auuuccagaaccacacuugaaa

SEQ ID NO: 516896 - RNA, 16 nt, Homo sapiens
auuuccagaacuacca

SEQ ID NO: 516897 - RNA, 19 nt, Homo sapiens
auuuccucagcuuaucucu

SEQ ID NO: 516898 - RNA, 19 nt, Homo sapiens
auuuccuucaaugugcaua

SEQ ID NO: 516899 - RNA, 14 nt, Homo sapiens
caccuuuuaacuca

SEQ ID NO: 516900 - RNA, 20 nt, Homo sapiens
cacgcuucaaggauauacug

SEQ ID NO: 516901 - RNA, 21 nt, Homo sapiens
cacgcuucaaggauauacugc

SEQ ID NO: 516902 - RNA, 14 nt, Homo sapiens
cacggcauuacccc

SEQ ID NO: 516903 - RNA, 21 nt, Homo sapiens
cacggccuguacggacacugu

SEQ ID NO: 516904 - RNA, 16 nt, Homo sapiens
cacgguggcggcugca

SEQ ID NO: 516905 - RNA, 18 nt, Homo sapiens
cacuaauugguacuuuua

SEQ ID NO: 516906 - RNA, 16 nt, Homo sapiens
cacucagugccuccac

SEQ ID NO: 516907 - RNA, 13 nt, Homo sapiens
cacuccccuaggg

SEQ ID NO: 516908 - RNA, 21 nt, Homo sapiens
cacuccugcuuaaucuucaaa

SEQ ID NO: 516909 - RNA, 13 nt, Homo sapiens
cacucugcaagaa

SEQ ID NO: 516910 - RNA, 23 nt, Homo sapiens
cacucuuguggucaucauggcca

SEQ ID NO: 516911 - RNA, 18 nt, Homo sapiens
cacugaaaauucgaacca

SEQ ID NO: 516912 - RNA, 14 nt, Homo sapiens
cacugaaaccaggu

SEQ ID NO: 516913 - RNA, 13 nt, Homo sapiens
cacugcauuucau

SEQ ID NO: 516914 - RNA, 18 nt, Homo sapiens
cacuguagcuacauuuuc

SEQ ID NO: 516915 - RNA, 19 nt, Homo sapiens
cacuguagcuacauuuuca

SEQ ID NO: 516916 - RNA, 15 nt, Homo sapiens
aauaguauacauugu

SEQ ID NO: 516917 - RNA, 18 nt, Homo sapiens
auaaugaagaacacugua

SEQ ID NO: 516918 - RNA, 20 nt, Homo sapiens
auaaugguuuuuaacaccuu

SEQ ID NO: 516919 - RNA, 19 nt, Homo sapiens
auaauuggagaagauuuau

SEQ ID NO: 516920 - RNA, 17 nt, Homo sapiens
auacaaaaaaaauuuag

SEQ ID NO: 516921 - RNA, 19 nt, Homo sapiens
auacaacauuaaggaauuu

SEQ ID NO: 516922 - RNA, 15 nt, Homo sapiens
auaccaaguugauac

SEQ ID NO: 516923 - RNA, 17 nt, Homo sapiens
auaccauucacuacuca

SEQ ID NO: 516924 - RNA, 15 nt, Homo sapiens
auaccuuccccacau

SEQ ID NO: 516925 - RNA, 19 nt, Homo sapiens
auaccuuccccacaucuga

SEQ ID NO: 516926 - RNA, 18 nt, Homo sapiens
auacgcuuugguuucuca

SEQ ID NO: 516927 - RNA, 22 nt, Homo sapiens
auacuauuuaagaugugaaaau

SEQ ID NO: 516928 - RNA, 13 nt, Homo sapiens
auacucagguuaa

SEQ ID NO: 516929 - RNA, 19 nt, Homo sapiens
auacuuuauuucugaucua

SEQ ID NO: 516930 - RNA, 15 nt, Homo sapiens
auacuuugaagugca

SEQ ID NO: 516931 - RNA, 21 nt, Homo sapiens
auacuuuugcuuucagggaaa

SEQ ID NO: 516932 - RNA, 17 nt, Homo sapiens
auagaaaauucuugaga

SEQ ID NO: 516933 - RNA, 14 nt, Homo sapiens
auagaacauccaga

SEQ ID NO: 516934 - RNA, 15 nt, Homo sapiens
auagaugcuguguau

SEQ ID NO: 516935 - RNA, 16 nt, Homo sapiens
auagcaaauggccuca

SEQ ID NO: 516936 - RNA, 14 nt, Homo sapiens
auagcaagugaaag

SEQ ID NO: 516937 - RNA, 18 nt, Homo sapiens
auagcagaugguuuccac

SEQ ID NO: 516938 - RNA, 20 nt, Homo sapiens
auagcauugauaaucuucag

SEQ ID NO: 516939 - RNA, 18 nt, Homo sapiens
auaggcuaugccaugugc

SEQ ID NO: 516940 - RNA, 12 nt, Homo sapiens
auauaaaccugg

SEQ ID NO: 516941 - RNA, 16 nt, Homo sapiens
auauaagcugccauau

SEQ ID NO: 516942 - RNA, 16 nt, Homo sapiens
auauaaguacugacca

SEQ ID NO: 516943 - RNA, 18 nt, Homo sapiens
auauacaaaacaauuaau

SEQ ID NO: 516944 - RNA, 17 nt, Homo sapiens
auauaugcacuauguau

SEQ ID NO: 516945 - RNA, 22 nt, Homo sapiens
auauaugccuggcacagcuuuu

SEQ ID NO: 516946 - RNA, 18 nt, Homo sapiens
auaucaaaucuaccacug

SEQ ID NO: 516947 - RNA, 13 nt, Homo sapiens
auaucacacaaua

SEQ ID NO: 516948 - RNA, 18 nt, Homo sapiens
auaucccaagugcacuuu

SEQ ID NO: 516949 - RNA, 16 nt, Homo sapiens
auaucgaaauaguuac

SEQ ID NO: 516950 - RNA, 12 nt, Homo sapiens
auaucuaaaaac

SEQ ID NO: 516951 - RNA, 15 nt, Homo sapiens
auaugaaaaucucca

SEQ ID NO: 516952 - RNA, 20 nt, Homo sapiens
auaugaaaaucuccaucuca

SEQ ID NO: 516953 - RNA, 21 nt, Homo sapiens
auaugaaaaucuccaucucaa

SEQ ID NO: 516954 - RNA, 20 nt, Homo sapiens
auauggggaaaaaacugugc

SEQ ID NO: 516955 - RNA, 14 nt, Homo sapiens
auauuuauguagau

SEQ ID NO: 516956 - RNA, 19 nt, Homo sapiens
aucaaaacuaaccaucuga

SEQ ID NO: 516957 - RNA, 15 nt, Homo sapiens
aucaacuaaugauuu

SEQ ID NO: 516958 - RNA, 13 nt, Homo sapiens
aucaagguucagc

SEQ ID NO: 516959 - RNA, 17 nt, Homo sapiens
aucaaguccaucugaca

SEQ ID NO: 516960 - RNA, 15 nt, Homo sapiens
aucacauucuuucca

SEQ ID NO: 516961 - RNA, 12 nt, Homo sapiens
aucacugaauuu

SEQ ID NO: 516962 - RNA, 19 nt, Homo sapiens
aucacuuuucagaagacuu

SEQ ID NO: 516963 - RNA, 15 nt, Homo sapiens
aucagaaagcuuuau

SEQ ID NO: 516964 - RNA, 13 nt, Homo sapiens
aucagagaacuuu

SEQ ID NO: 516965 - RNA, 16 nt, Homo sapiens
aucagagaacuuuccc

SEQ ID NO: 516966 - RNA, 21 nt, Homo sapiens
aucaggugcauagcaagugaa

SEQ ID NO: 516967 - RNA, 18 nt, Homo sapiens
aucaguaaucacuuuuca

SEQ ID NO: 516968 - RNA, 16 nt, Homo sapiens
aucaguguuguugcuc

SEQ ID NO: 516969 - RNA, 16 nt, Homo sapiens
aucauaagacaaugga

SEQ ID NO: 516970 - RNA, 13 nt, Homo sapiens
aucauccaagaca

SEQ ID NO: 516971 - RNA, 14 nt, Homo sapiens
aucaugauauagcu

SEQ ID NO: 516972 - RNA, 16 nt, Homo sapiens
aucauucaacucucca

SEQ ID NO: 516973 - RNA, 20 nt, Homo sapiens
aucauuuccccaacagggca

SEQ ID NO: 516974 - RNA, 21 nt, Homo sapiens
auccacaccguacaucugcaa

SEQ ID NO: 516975 - RNA, 22 nt, Homo sapiens
auccacccagcaggcagagugg

SEQ ID NO: 516976 - RNA, 18 nt, Homo sapiens
auccagaguucugugaca

SEQ ID NO: 516977 - RNA, 20 nt, Homo sapiens
auccagcaauuccugagcca

SEQ ID NO: 516978 - RNA, 22 nt, Homo sapiens
auccagcuccccuucugaauca

SEQ ID NO: 516979 - RNA, 15 nt, Homo sapiens
auccaucucucucuu

SEQ ID NO: 516980 - RNA, 22 nt, Homo sapiens
auccaugcggccuggguguccu

SEQ ID NO: 516981 - RNA, 16 nt, Homo sapiens
auccauuaaaaauggg

SEQ ID NO: 516982 - RNA, 20 nt, Homo sapiens
aucccaccaaccuccagugu

SEQ ID NO: 516983 - RNA, 14 nt, Homo sapiens
aucccagcuacuca

SEQ ID NO: 516984 - RNA, 15 nt, Homo sapiens
aucccagcuacucag

SEQ ID NO: 516985 - RNA, 18 nt, Homo sapiens
aucccuaacuaaagggga

SEQ ID NO: 516986 - RNA, 15 nt, Homo sapiens
auccgccuaccucag

SEQ ID NO: 516987 - RNA, 16 nt, Homo sapiens
auccgcgugugccugu

SEQ ID NO: 516988 - RNA, 18 nt, Homo sapiens
auccggcagcacaagcug

SEQ ID NO: 516989 - RNA, 20 nt, Homo sapiens
auccuagucuagcauucugc

SEQ ID NO: 516990 - RNA, 12 nt, Homo sapiens
auccugccaacu

SEQ ID NO: 516991 - RNA, 22 nt, Homo sapiens
auccuggguacugaaagccuua

SEQ ID NO: 516992 - RNA, 23 nt, Homo sapiens
auccugugcaauagacacauaca

SEQ ID NO: 516993 - RNA, 15 nt, Homo sapiens
aucguaccuauugca

SEQ ID NO: 516994 - RNA, 15 nt, Homo sapiens
aucuaacguguucca

SEQ ID NO: 516995 - RNA, 17 nt, Homo sapiens
aucuagagcaaagccau

SEQ ID NO: 516996 - RNA, 17 nt, Homo sapiens
aucucaaugaaccauaa

SEQ ID NO: 516997 - RNA, 22 nt, Homo sapiens
aucucggcucacugcaaccucu

SEQ ID NO: 516998 - RNA, 18 nt, Homo sapiens
aucucuacuaaaaacaca

SEQ ID NO: 516999 - RNA, 22 nt, Homo sapiens
aucucuucuuugcugcagucau

SEQ ID NO: 517000 - RNA, 18 nt, Homo sapiens
aucugaagaaacuuccca

SEQ ID NO: 517001 - RNA, 21 nt, Homo sapiens
aucugacagacaaugauccag

SEQ ID NO: 517002 - RNA, 23 nt, Homo sapiens
aucuggagaaccucauccagcuc

SEQ ID NO: 517003 - RNA, 23 nt, Homo sapiens
aucuguucauuucuaaauuuaua

SEQ ID NO: 517004 - RNA, 19 nt, Homo sapiens
aucuuagaagcacuacacc

SEQ ID NO: 517005 - RNA, 14 nt, Homo sapiens
aucuuagugccuga

SEQ ID NO: 517006 - RNA, 13 nt, Homo sapiens
aucuucacugcaa

SEQ ID NO: 517007 - RNA, 15 nt, Homo sapiens
aucuucacugcaauu

SEQ ID NO: 517008 - RNA, 18 nt, Homo sapiens
aucuucaggugaacacuu

SEQ ID NO: 517009 - RNA, 23 nt, Homo sapiens
aucuuuauacuggguuucaagaa

SEQ ID NO: 517010 - RNA, 23 nt, Homo sapiens
aucuuucauuucguauuucucau

SEQ ID NO: 517011 - RNA, 18 nt, Homo sapiens
augaaaaucuccaucuca

SEQ ID NO: 517012 - RNA, 16 nt, Homo sapiens
augaaaggaucucuga

SEQ ID NO: 517013 - RNA, 14 nt, Homo sapiens
augaagaacacugu

SEQ ID NO: 517014 - RNA, 15 nt, Homo sapiens
augaagggcuccgug

SEQ ID NO: 517015 - RNA, 19 nt, Homo sapiens
augaauacuuugcagcaca

SEQ ID NO: 517016 - RNA, 22 nt, Homo sapiens
augaaugacaguagucacacau

SEQ ID NO: 517017 - RNA, 13 nt, Homo sapiens
augaaugcagauu

SEQ ID NO: 517018 - RNA, 13 nt, Homo sapiens
augacccacuguc

SEQ ID NO: 517019 - RNA, 15 nt, Homo sapiens
augacgucaucauca

SEQ ID NO: 517020 - RNA, 22 nt, Homo sapiens
augaggaaggaacagcaauggu

SEQ ID NO: 517021 - RNA, 19 nt, Homo sapiens
augaggauuauugauagua

SEQ ID NO: 517022 - RNA, 17 nt, Homo sapiens
augaggcuacagaacua

SEQ ID NO: 517023 - RNA, 19 nt, Homo sapiens
augauaaaccugccaagag

SEQ ID NO: 517024 - RNA, 21 nt, Homo sapiens
augauaaaccugccaagaguc

SEQ ID NO: 517025 - RNA, 21 nt, Homo sapiens
gggaggccccagggggucuca

SEQ ID NO: 517026 - RNA, 16 nt, Homo sapiens
gggaggcugugcacag

SEQ ID NO: 517027 - RNA, 12 nt, Homo sapiens
gggagugucuaa

SEQ ID NO: 517028 - RNA, 13 nt, Homo sapiens
gggauuggaagaa

SEQ ID NO: 517029 - RNA, 14 nt, Homo sapiens
gggcaacuguagaa

SEQ ID NO: 517030 - RNA, 20 nt, Homo sapiens
gggcacagaugggaucacag

SEQ ID NO: 517031 - RNA, 13 nt, Homo sapiens
gggcacugguggc

SEQ ID NO: 517032 - RNA, 16 nt, Homo sapiens
gggcaggcugggccau

SEQ ID NO: 517033 - RNA, 21 nt, Homo sapiens
gggcaggcugggccaugucca

SEQ ID NO: 517034 - RNA, 19 nt, Homo sapiens
gggcauccugugccacuaa

SEQ ID NO: 517035 - RNA, 19 nt, Homo sapiens
gggccauggcucagggugg

SEQ ID NO: 517036 - RNA, 14 nt, Homo sapiens
gggccauguccaaa

SEQ ID NO: 517037 - RNA, 16 nt, Homo sapiens
gggccauguccaaaga

SEQ ID NO: 517038 - RNA, 17 nt, Homo sapiens
gggccauguccaaagag

SEQ ID NO: 517039 - RNA, 23 nt, Homo sapiens
gggcuauuuuuucccccacaaac

SEQ ID NO: 517040 - RNA, 16 nt, Homo sapiens
gggcucccaggggucu

SEQ ID NO: 517041 - RNA, 16 nt, Homo sapiens
gggcucuuuagccagu

SEQ ID NO: 517042 - RNA, 14 nt, Homo sapiens
gggcuggcacguga

SEQ ID NO: 517043 - RNA, 17 nt, Homo sapiens
ggggacaagggauuuga

SEQ ID NO: 517044 - RNA, 17 nt, Homo sapiens
ggguacagaugugcugu

SEQ ID NO: 517045 - RNA, 23 nt, Homo sapiens
ggguaccuaguccccagccugcu

SEQ ID NO: 517046 - RNA, 22 nt, Homo sapiens
ggguaccuuaagagacacucca

SEQ ID NO: 517047 - RNA, 15 nt, Homo sapiens
gggucaaagugcggc

SEQ ID NO: 517048 - RNA, 18 nt, Homo sapiens
gguaauucuauugggaua

SEQ ID NO: 517049 - RNA, 16 nt, Homo sapiens
gguacugaaagccuua

SEQ ID NO: 517050 - RNA, 21 nt, Homo sapiens
gguacuugaucauuuuuacca

SEQ ID NO: 517051 - RNA, 11 nt, Homo sapiens
gguacuuucau

SEQ ID NO: 517052 - RNA, 16 nt, Homo sapiens
gguauauacuuugcca

SEQ ID NO: 517053 - RNA, 22 nt, Homo sapiens
gguauauacuuugccacugcug

SEQ ID NO: 517054 - RNA, 15 nt, Homo sapiens
ggucaaucaguguua

SEQ ID NO: 517055 - RNA, 15 nt, Homo sapiens
guggggggacugccu

SEQ ID NO: 517056 - RNA, 22 nt, Homo sapiens
gugguaaaaccuguucuccaua

SEQ ID NO: 517057 - RNA, 18 nt, Homo sapiens
gugguaugaaaugucuga

SEQ ID NO: 517058 - RNA, 15 nt, Homo sapiens
guggucaucauggcc

SEQ ID NO: 517059 - RNA, 17 nt, Homo sapiens
gugguuccucugcucac

SEQ ID NO: 517060 - RNA, 19 nt, Homo sapiens
guguaauggaaaccaagga

SEQ ID NO: 517061 - RNA, 20 nt, Homo sapiens
guguaauggaaaccaaggaa

SEQ ID NO: 517062 - RNA, 15 nt, Homo sapiens
guguaccuccucuca

SEQ ID NO: 517063 - RNA, 13 nt, Homo sapiens
guguauccaugca

SEQ ID NO: 517064 - RNA, 22 nt, Homo sapiens
guguauccaugcaccuaccuua

SEQ ID NO: 517065 - RNA, 22 nt, Homo sapiens
guguaugcaguauucuugcacu

SEQ ID NO: 517066 - RNA, 13 nt, Homo sapiens
gugucugcacagg

SEQ ID NO: 517067 - RNA, 14 nt, Homo sapiens
gugucugggcucaa

SEQ ID NO: 517068 - RNA, 18 nt, Homo sapiens
gugucugucugaggugac

SEQ ID NO: 517069 - RNA, 22 nt, Homo sapiens
guguggcaaacuugcaguuuaa

SEQ ID NO: 517070 - RNA, 14 nt, Homo sapiens
gugugggggguccu

SEQ ID NO: 517071 - RNA, 17 nt, Homo sapiens
guguuauuugcacacug

SEQ ID NO: 517072 - RNA, 18 nt, Homo sapiens
guguucacaacagugaaa

SEQ ID NO: 517073 - RNA, 12 nt, Homo sapiens
guguuccagugu

SEQ ID NO: 517074 - RNA, 16 nt, Homo sapiens
guguuuuuaacauguc

SEQ ID NO: 517075 - RNA, 20 nt, Homo sapiens
guuaaaacuguacauuuaaa

SEQ ID NO: 517076 - RNA, 17 nt, Homo sapiens
guuaauaaaccuuugca

SEQ ID NO: 517077 - RNA, 17 nt, Homo sapiens
guuaauguuauaucaua

SEQ ID NO: 517078 - RNA, 14 nt, Homo sapiens
guuacagaccucag

SEQ ID NO: 517079 - RNA, 13 nt, Homo sapiens
guuacuuccuuau

SEQ ID NO: 517080 - RNA, 13 nt, Homo sapiens
guuaggcauuaau

SEQ ID NO: 517081 - RNA, 20 nt, Homo sapiens
guuauaagcagcaagacaaa

SEQ ID NO: 517082 - RNA, 18 nt, Homo sapiens
guuauaucauauguauau

SEQ ID NO: 517083 - RNA, 20 nt, Homo sapiens
guuauuugcacacugcacug

SEQ ID NO: 517084 - RNA, 15 nt, Homo sapiens
guucagacacagcuc

SEQ ID NO: 517085 - RNA, 16 nt, Homo sapiens
guuccacagaggacac

SEQ ID NO: 517086 - RNA, 18 nt, Homo sapiens
guucccugcaggagagag

SEQ ID NO: 517087 - RNA, 20 nt, Homo sapiens
guuccuuacuuuacugccug

SEQ ID NO: 517088 - RNA, 20 nt, Homo sapiens
guucgcauugaacucuacaa

SEQ ID NO: 517089 - RNA, 13 nt, Homo sapiens
guucgcuuaucaa

SEQ ID NO: 517090 - RNA, 14 nt, Homo sapiens
guucuaacagugaa

SEQ ID NO: 517091 - RNA, 15 nt, Homo sapiens
guucuguuggaugac

SEQ ID NO: 517092 - RNA, 22 nt, Homo sapiens
guucuuaaauguuuauacugua

SEQ ID NO: 517093 - RNA, 21 nt, Homo sapiens
guugagggcccuucacuucca

SEQ ID NO: 517094 - RNA, 19 nt, Homo sapiens
guugcaccaggcacugcug

SEQ ID NO: 517095 - RNA, 18 nt, Homo sapiens
guuggcaaacgagacuuu

SEQ ID NO: 517096 - RNA, 18 nt, Homo sapiens
guuggucaggcgcagugg

SEQ ID NO: 517097 - RNA, 20 nt, Homo sapiens
guuggucugccuucugcuga

SEQ ID NO: 517098 - RNA, 22 nt, Homo sapiens
guugguucguucuguacuguua

SEQ ID NO: 517099 - RNA, 20 nt, Homo sapiens
guuuaagcccagccaaguaa

SEQ ID NO: 517100 - RNA, 19 nt, Homo sapiens
guuuacacugcacauugaa

SEQ ID NO: 517101 - RNA, 15 nt, Homo sapiens
guuuacagugaugcc

SEQ ID NO: 517102 - RNA, 19 nt, Homo sapiens
guuuauggccacauuuaau

SEQ ID NO: 517103 - RNA, 18 nt, Homo sapiens
guuuccaugguuaccuga

SEQ ID NO: 517104 - RNA, 15 nt, Homo sapiens
guuucuccugagcua

SEQ ID NO: 517105 - RNA, 23 nt, Homo sapiens
guuucuugcucccagaccaaggc

SEQ ID NO: 517106 - RNA, 17 nt, Homo sapiens
guuuggaaaaguggcgu

SEQ ID NO: 517107 - RNA, 12 nt, Homo sapiens
guuugugauauu

SEQ ID NO: 517108 - RNA, 23 nt, Homo sapiens
guuuuagacgaggccacagcugc

SEQ ID NO: 517109 - RNA, 17 nt, Homo sapiens
guuuuaggguacaguuu

SEQ ID NO: 517110 - RNA, 16 nt, Homo sapiens
guuuuauccuuacaau

SEQ ID NO: 517111 - RNA, 19 nt, Homo sapiens
guuuuccaugauuuagcaa

SEQ ID NO: 517112 - RNA, 13 nt, Homo sapiens
guuuugauuuauu

SEQ ID NO: 517113 - RNA, 15 nt, Homo sapiens
guuuuuaacauguca

SEQ ID NO: 517114 - RNA, 15 nt, Homo sapiens
guuuuuaacuuuuaa

SEQ ID NO: 517115 - RNA, 21 nt, Homo sapiens
guuuuuauuuagcauggggau

SEQ ID NO: 517116 - RNA, 19 nt, Homo sapiens
uaaaaaaugucucauguca

SEQ ID NO: 517117 - RNA, 12 nt, Homo sapiens
uaaaaacaaagu

SEQ ID NO: 517118 - RNA, 14 nt, Homo sapiens
uaaaaacauaacau

SEQ ID NO: 517119 - RNA, 15 nt, Homo sapiens
uaaaaauaaagggaa

SEQ ID NO: 517120 - RNA, 19 nt, Homo sapiens
uaaaaaucauugauuguca

SEQ ID NO: 517121 - RNA, 16 nt, Homo sapiens
uaaaacuacaugguca

SEQ ID NO: 517122 - RNA, 19 nt, Homo sapiens
uaaaacuacauggucaaca

SEQ ID NO: 517123 - RNA, 14 nt, Homo sapiens
uaaaagcacacucc

SEQ ID NO: 517124 - RNA, 20 nt, Homo sapiens
uaaaagcauuguuugugaua

SEQ ID NO: 517125 - RNA, 19 nt, Homo sapiens
uaaaagcauuuuguaauaa

SEQ ID NO: 517126 - RNA, 17 nt, Homo sapiens
uaaaaguauuugcuuaa

SEQ ID NO: 517127 - RNA, 22 nt, Homo sapiens
uaaaauaacaguaugugggaua

SEQ ID NO: 517128 - RNA, 15 nt, Homo sapiens
uaaaaugugugccau

SEQ ID NO: 517129 - RNA, 11 nt, Homo sapiens
uaaaauuguga

SEQ ID NO: 517130 - RNA, 12 nt, Homo sapiens
uaaaauugugag

SEQ ID NO: 517131 - RNA, 20 nt, Homo sapiens
uaaacacacagaucugcauc

SEQ ID NO: 517132 - RNA, 12 nt, Homo sapiens
uaaacagaggau

SEQ ID NO: 517133 - RNA, 20 nt, Homo sapiens
uaaaccuagaguuuuaucaa

SEQ ID NO: 517134 - RNA, 16 nt, Homo sapiens
uaaacuauuuauauca

SEQ ID NO: 517135 - RNA, 23 nt, Homo sapiens
uaaacucuguccacgauucacuc

SEQ ID NO: 517136 - RNA, 19 nt, Homo sapiens
uaaagagagaauguagaua

SEQ ID NO: 517137 - RNA, 15 nt, Homo sapiens
uaaagcaauguggua

SEQ ID NO: 517138 - RNA, 22 nt, Homo sapiens
uaaagcuauuuaugggccccug

SEQ ID NO: 517139 - RNA, 12 nt, Homo sapiens
uaaaggcagcug

SEQ ID NO: 517140 - RNA, 18 nt, Homo sapiens
uaaaggcagcugccucug

SEQ ID NO: 517141 - RNA, 19 nt, Homo sapiens
uaaaguuuucuaaauuuau

SEQ ID NO: 517142 - RNA, 12 nt, Homo sapiens
ugccccaugugu

SEQ ID NO: 517143 - RNA, 20 nt, Homo sapiens
ugccccccagauugcugcaa

SEQ ID NO: 517144 - RNA, 19 nt, Homo sapiens
ugcccucauuacugggccu

SEQ ID NO: 517145 - RNA, 19 nt, Homo sapiens
ugcccuguuagcuuuccaa

SEQ ID NO: 517146 - RNA, 17 nt, Homo sapiens
ugcccuuucaaagcacu

SEQ ID NO: 517147 - RNA, 23 nt, Homo sapiens
ugccgucaccucuccgcucauac

SEQ ID NO: 517148 - RNA, 20 nt, Homo sapiens
ugccgugugagugugacagg

SEQ ID NO: 517149 - RNA, 22 nt, Homo sapiens
ugccuaaaauauauuccugaga

SEQ ID NO: 517150 - RNA, 14 nt, Homo sapiens
ugccucagccuccc

SEQ ID NO: 517151 - RNA, 19 nt, Homo sapiens
ugccucccagguuccagca

SEQ ID NO: 517152 - RNA, 15 nt, Homo sapiens
ugccucuucuuugug

SEQ ID NO: 517153 - RNA, 23 nt, Homo sapiens
ugccugguggggaucagacagag

SEQ ID NO: 517154 - RNA, 19 nt, Homo sapiens
ugccuuccuccuuauccua

SEQ ID NO: 517155 - RNA, 22 nt, Homo sapiens
ugccuugucucuaguagugugg

SEQ ID NO: 517156 - RNA, 20 nt, Homo sapiens
ugcgaagacccucuugccca

SEQ ID NO: 517157 - RNA, 21 nt, Homo sapiens
ugcgacccugggggcacagga

SEQ ID NO: 517158 - RNA, 14 nt, Homo sapiens
ugcuauacagucua

SEQ ID NO: 517159 - RNA, 20 nt, Homo sapiens
ugcuaugaagccaacugaca

SEQ ID NO: 517160 - RNA, 23 nt, Homo sapiens
ugcucagaccgagcgugugccac

SEQ ID NO: 517161 - RNA, 20 nt, Homo sapiens
ugcucagagaaggaaaagac

SEQ ID NO: 517162 - RNA, 16 nt, Homo sapiens
ugcucccuagccagag

SEQ ID NO: 517163 - RNA, 14 nt, Homo sapiens
ugcucuguuaccca

SEQ ID NO: 517164 - RNA, 17 nt, Homo sapiens
ugcugaaaaaucaucca

SEQ ID NO: 517165 - RNA, 23 nt, Homo sapiens
ugcugaaaaaucauccaagacag

SEQ ID NO: 517166 - RNA, 16 nt, Homo sapiens
ugcugaauaaaugauu

SEQ ID NO: 517167 - RNA, 22 nt, Homo sapiens
ugcugauacugggucugcgaug

SEQ ID NO: 517168 - RNA, 19 nt, Homo sapiens
ugcugauuauuuaugaccu

SEQ ID NO: 517169 - RNA, 19 nt, Homo sapiens
ugcugcaaagccuuuccag

SEQ ID NO: 517170 - RNA, 12 nt, Homo sapiens
ugcugccugaau

SEQ ID NO: 517171 - RNA, 14 nt, Homo sapiens
ugcugcucaucuga

SEQ ID NO: 517172 - RNA, 16 nt, Homo sapiens
ugcuggaauuccuaac

SEQ ID NO: 517173 - RNA, 13 nt, Homo sapiens
ugcuggacuugcc

SEQ ID NO: 517174 - RNA, 21 nt, Homo sapiens
ugcuggagaucagcaugccug

SEQ ID NO: 517175 - RNA, 21 nt, Homo sapiens
ugcuguauuuuuauuuuugca

SEQ ID NO: 517176 - RNA, 23 nt, Homo sapiens
ugcuguauuuuuauuuuugcaca

SEQ ID NO: 517177 - RNA, 11 nt, Homo sapiens
ugcugugacaa

SEQ ID NO: 517178 - RNA, 17 nt, Homo sapiens
ugcuugcaauguaguca

SEQ ID NO: 517179 - RNA, 14 nt, Homo sapiens
uggaaaaggaagac

SEQ ID NO: 517180 - RNA, 22 nt, Homo sapiens
uggaaaccaaggaaagugaaac

SEQ ID NO: 517181 - RNA, 16 nt, Homo sapiens
uggaaagaaagaccau

SEQ ID NO: 517182 - RNA, 16 nt, Homo sapiens
uggaaaguaacuguga

SEQ ID NO: 517183 - RNA, 18 nt, Homo sapiens
uggaacagaagacagcug

SEQ ID NO: 517184 - RNA, 14 nt, Homo sapiens
uggaacagauuuca

SEQ ID NO: 517185 - RNA, 15 nt, Homo sapiens
uggaacagauuucaa

SEQ ID NO: 517186 - RNA, 16 nt, Homo sapiens
uggaacaggcucagau

SEQ ID NO: 517187 - RNA, 15 nt, Homo sapiens
uggaacuguccuucc

SEQ ID NO: 517188 - RNA, 17 nt, Homo sapiens
uggaagaggaacagcac

SEQ ID NO: 517189 - RNA, 23 nt, Homo sapiens
uggaagaggaacagcacugggga

SEQ ID NO: 517190 - RNA, 15 nt, Homo sapiens
uggaaggcagacagc

SEQ ID NO: 517191 - RNA, 15 nt, Homo sapiens
uggaaugaauacagc

SEQ ID NO: 517192 - RNA, 22 nt, Homo sapiens
uggacucucauguggccaagca

SEQ ID NO: 517193 - RNA, 16 nt, Homo sapiens
uggacuuaacuaguua

SEQ ID NO: 517194 - RNA, 17 nt, Homo sapiens
uggacuuccagugcuca

SEQ ID NO: 517195 - RNA, 21 nt, Homo sapiens
uggacuuccagugcucagagg

SEQ ID NO: 517196 - RNA, 15 nt, Homo sapiens
uggagaaaguauuua

SEQ ID NO: 517197 - RNA, 21 nt, Homo sapiens
uggagaaggucacaacccuuc

SEQ ID NO: 517198 - RNA, 12 nt, Homo sapiens
uggagacugaca

SEQ ID NO: 517199 - RNA, 13 nt, Homo sapiens
uggagacugacaa

SEQ ID NO: 517200 - RNA, 19 nt, Homo sapiens
uggagacugacaaccucau

SEQ ID NO: 517201 - RNA, 21 nt, Homo sapiens
uggaggccaagaacuugcaau

SEQ ID NO: 517202 - RNA, 22 nt, Homo sapiens
uggaggccaagaacuugcaaua

SEQ ID NO: 517203 - RNA, 17 nt, Homo sapiens
uggauuuucaucagggg

SEQ ID NO: 517204 - RNA, 16 nt, Homo sapiens
uggcacaugccuguaa

SEQ ID NO: 517205 - RNA, 17 nt, Homo sapiens
uggcacuguggagcuca

SEQ ID NO: 517206 - RNA, 20 nt, Homo sapiens
uggcagaagggaauugcuca

SEQ ID NO: 517207 - RNA, 23 nt, Homo sapiens
uggcagacaucggccuccaugac

SEQ ID NO: 517208 - RNA, 16 nt, Homo sapiens
uggcagcggguggcau

SEQ ID NO: 517209 - RNA, 16 nt, Homo sapiens
uggcaugguuguugca

SEQ ID NO: 517210 - RNA, 17 nt, Homo sapiens
uggccagaggugucacc

SEQ ID NO: 517211 - RNA, 22 nt, Homo sapiens
uggccaggccuuacaucuggcu

SEQ ID NO: 517212 - RNA, 19 nt, Homo sapiens
uggccaggcuggucucaaa

SEQ ID NO: 517213 - RNA, 22 nt, Homo sapiens
uggcccuuuccuuccagauccu

SEQ ID NO: 517214 - RNA, 16 nt, Homo sapiens
uggccuauccgcugcc

SEQ ID NO: 517215 - RNA, 15 nt, Homo sapiens
uggccucaugucaaa

SEQ ID NO: 517216 - RNA, 14 nt, Homo sapiens
uggccuggccauuu

SEQ ID NO: 517217 - RNA, 18 nt, Homo sapiens
uggccuggccauuuccaa

SEQ ID NO: 517218 - RNA, 16 nt, Homo sapiens
uggccugugccagcac

SEQ ID NO: 517219 - RNA, 21 nt, Homo sapiens
uggcgcuuagagaggacaaua

SEQ ID NO: 517220 - RNA, 16 nt, Homo sapiens
uggcgggcaccuguag

SEQ ID NO: 517221 - RNA, 15 nt, Homo sapiens
uggcuaagauaccaa

SEQ ID NO: 517222 - RNA, 15 nt, Homo sapiens
ucccuaggaaacuca

SEQ ID NO: 517223 - RNA, 23 nt, Homo sapiens
ucccuugcuguaugcugaucauc

SEQ ID NO: 517224 - RNA, 14 nt, Homo sapiens
uccgccagauccug

SEQ ID NO: 517225 - RNA, 18 nt, Homo sapiens
uccuacaguacaaucagc

SEQ ID NO: 517226 - RNA, 23 nt, Homo sapiens
uccuagugggccauuaaaaacua

SEQ ID NO: 517227 - RNA, 14 nt, Homo sapiens
uccucccucugauu

SEQ ID NO: 517228 - RNA, 18 nt, Homo sapiens
uccucgagcaacugcugu

SEQ ID NO: 517229 - RNA, 14 nt, Homo sapiens
uccucggacucugc

SEQ ID NO: 517230 - RNA, 10 nt, Homo sapiens
uccucugcau

SEQ ID NO: 517231 - RNA, 19 nt, Homo sapiens
uccugaacucuucugcaaa

SEQ ID NO: 517232 - RNA, 13 nt, Homo sapiens
uccugacugaaag

SEQ ID NO: 517233 - RNA, 15 nt, Homo sapiens
uccugcagucccaca

SEQ ID NO: 517234 - RNA, 15 nt, Homo sapiens
uccugccaacugauu

SEQ ID NO: 517235 - RNA, 21 nt, Homo sapiens
uccuggcaucuauuuccucug

SEQ ID NO: 517236 - RNA, 19 nt, Homo sapiens
uccuggcuaacauggugaa

SEQ ID NO: 517237 - RNA, 19 nt, Homo sapiens
uccuggcuggccgcaugac

SEQ ID NO: 517238 - RNA, 15 nt, Homo sapiens
uccugggagcacugc

SEQ ID NO: 517239 - RNA, 16 nt, Homo sapiens
uccuggguacugaaag

SEQ ID NO: 517240 - RNA, 18 nt, Homo sapiens
uccugggucuaccacuca

SEQ ID NO: 517241 - RNA, 15 nt, Homo sapiens
uccuguacucugggg

SEQ ID NO: 517242 - RNA, 15 nt, Homo sapiens
uccuuauuugccuuc

SEQ ID NO: 517243 - RNA, 22 nt, Homo sapiens
uccuucccucaaagaggccuua

SEQ ID NO: 517244 - RNA, 17 nt, Homo sapiens
uccuugacuccaagaaa

SEQ ID NO: 517245 - RNA, 15 nt, Homo sapiens
uccuuuaaucacugc

SEQ ID NO: 517246 - RNA, 14 nt, Homo sapiens
uccuuuaccagaug

SEQ ID NO: 517247 - RNA, 19 nt, Homo sapiens
uccuuuuaaagaagcuuua

SEQ ID NO: 517248 - RNA, 14 nt, Homo sapiens
uccuuuuuuauucc

SEQ ID NO: 517249 - RNA, 14 nt, Homo sapiens
ucgaagcuguuaau

SEQ ID NO: 517250 - RNA, 15 nt, Homo sapiens
ucgaaggaaccugug

SEQ ID NO: 517251 - RNA, 16 nt, Homo sapiens
ucgagggacuuuaugu

SEQ ID NO: 517252 - RNA, 12 nt, Homo sapiens
ucggacucugcu

SEQ ID NO: 517253 - RNA, 15 nt, Homo sapiens
ucggcacacacugug

SEQ ID NO: 517254 - RNA, 16 nt, Homo sapiens
ucggcagcuacucaga

SEQ ID NO: 517255 - RNA, 15 nt, Homo sapiens
ucggccuccaugacc

SEQ ID NO: 517256 - RNA, 12 nt, Homo sapiens
ucggcuuuuugc

SEQ ID NO: 517257 - RNA, 15 nt, Homo sapiens
ucggcuuuuugccau

SEQ ID NO: 517258 - RNA, 19 nt, Homo sapiens
ucgucagccaccugggaac

SEQ ID NO: 517259 - RNA, 18 nt, Homo sapiens
ucgucaucaggugcauag

SEQ ID NO: 517260 - RNA, 15 nt, Homo sapiens
ucguguacugcaaag

SEQ ID NO: 517261 - RNA, 16 nt, Homo sapiens
ucguuaaaaacagauu

SEQ ID NO: 517262 - RNA, 18 nt, Homo sapiens
ucguuauuguuguugcca

SEQ ID NO: 517263 - RNA, 13 nt, Homo sapiens
ucuaaaaacuuag

SEQ ID NO: 517264 - RNA, 15 nt, Homo sapiens
ucuaaaaacuuagaa

SEQ ID NO: 517265 - RNA, 13 nt, Homo sapiens
ucuaaacuuuccc

SEQ ID NO: 517266 - RNA, 16 nt, Homo sapiens
ucuaacauguuaucaa

SEQ ID NO: 517267 - RNA, 13 nt, Homo sapiens
ucuaauguacaau

SEQ ID NO: 517268 - RNA, 13 nt, Homo sapiens
ucuacagugccaa

SEQ ID NO: 517269 - RNA, 18 nt, Homo sapiens
ucuaccuuuucuggcaaa

SEQ ID NO: 517270 - RNA, 15 nt, Homo sapiens
ucuacuaaaaacaca

SEQ ID NO: 517271 - RNA, 20 nt, Homo sapiens
ucuagagcuuaaugcuacau

SEQ ID NO: 517272 - RNA, 14 nt, Homo sapiens
ucuagagcuuuuau

SEQ ID NO: 517273 - RNA, 18 nt, Homo sapiens
ucuaggcuaccagaagag

SEQ ID NO: 517274 - RNA, 20 nt, Homo sapiens
ucuaguucuuuucauuugga

SEQ ID NO: 517275 - RNA, 15 nt, Homo sapiens
ucuauagaacaucca

SEQ ID NO: 517276 - RNA, 22 nt, Homo sapiens
ucucaaaccaagcaaaggaagg

SEQ ID NO: 517277 - RNA, 12 nt, Homo sapiens
ucucaaacuuca

SEQ ID NO: 517278 - RNA, 23 nt, Homo sapiens
ucucaaagaaauauuaagcaugu

SEQ ID NO: 517279 - RNA, 15 nt, Homo sapiens
ucucaagcuaguguu

SEQ ID NO: 517280 - RNA, 16 nt, Homo sapiens
ucucaaucuugaacuc

SEQ ID NO: 517281 - RNA, 21 nt, Homo sapiens
ucucagguagaagguugacac

SEQ ID NO: 517282 - RNA, 22 nt, Homo sapiens
ucucauccuccaguaccuugcu

SEQ ID NO: 517283 - RNA, 18 nt, Homo sapiens
ucuccagaauaauucuua

SEQ ID NO: 517284 - RNA, 14 nt, Homo sapiens
ucucccauccuuga

SEQ ID NO: 517285 - RNA, 15 nt, Homo sapiens
ucuccuaauauucca

SEQ ID NO: 517286 - RNA, 14 nt, Homo sapiens
ucucgaacaguauu

SEQ ID NO: 517287 - RNA, 14 nt, Homo sapiens
ucucgagaggcaau

SEQ ID NO: 517288 - RNA, 23 nt, Homo sapiens
ucucuacagugccaacuccucac

SEQ ID NO: 517289 - RNA, 22 nt, Homo sapiens
ucucuauauucggaauguaacu

SEQ ID NO: 517290 - RNA, 22 nt, Homo sapiens
ucucugucccuugcuguaugcu

SEQ ID NO: 517291 - RNA, 17 nt, Homo sapiens
ucucuguuggucugccu

SEQ ID NO: 517292 - RNA, 15 nt, Homo sapiens
ucucuuagcaacuca

SEQ ID NO: 517293 - RNA, 17 nt, Homo sapiens
ucugaauaaauaauucu

SEQ ID NO: 517294 - RNA, 21 nt, Homo sapiens
ucugacaacugugaagccacc

SEQ ID NO: 517295 - RNA, 21 nt, Homo sapiens
ucugauaagcuuccuagaaag

SEQ ID NO: 517296 - RNA, 20 nt, Homo sapiens
ucugauuuuugucccaguag

SEQ ID NO: 517297 - RNA, 16 nt, Homo sapiens
ucugcaacauuugaca

SEQ ID NO: 517298 - RNA, 21 nt, Homo sapiens
ucugcaguucucaugacuccu

SEQ ID NO: 517299 - RNA, 19 nt, Homo sapiens
ucugcauggaacagcauua

SEQ ID NO: 517300 - RNA, 16 nt, Homo sapiens
ucugcccgcuccaugg

SEQ ID NO: 517301 - RNA, 17 nt, Homo sapiens
ucugcccgcuccaugga

SEQ ID NO: 517302 - RNA, 15 nt, Homo sapiens
ucugcccucauuacu

SEQ ID NO: 517303 - RNA, 16 nt, Homo sapiens
ucugccuguaucucuc

SEQ ID NO: 517304 - RNA, 13 nt, Homo sapiens
ucugcugcugaua

SEQ ID NO: 517305 - RNA, 18 nt, Homo sapiens
ucuggcaucuuagaccuc

SEQ ID NO: 517306 - RNA, 19 nt, Homo sapiens
caguggggccuguggaaug

SEQ ID NO: 517307 - RNA, 21 nt, Homo sapiens
caguguggccaggcugccugg

SEQ ID NO: 517308 - RNA, 14 nt, Homo sapiens
caguucauuguggg

SEQ ID NO: 517309 - RNA, 15 nt, Homo sapiens
caguucccucuugcu

SEQ ID NO: 517310 - RNA, 18 nt, Homo sapiens
caguuguaccaagugaaa

SEQ ID NO: 517311 - RNA, 19 nt, Homo sapiens
caguuuaaaggggucccau

SEQ ID NO: 517312 - RNA, 15 nt, Homo sapiens
caguuugauaccugc

SEQ ID NO: 517313 - RNA, 19 nt, Homo sapiens
caguuuuacucugcugcaa

SEQ ID NO: 517314 - RNA, 23 nt, Homo sapiens
cauaaagagguaaaaaacuguca

SEQ ID NO: 517315 - RNA, 12 nt, Homo sapiens
cauaaagcauuu

SEQ ID NO: 517316 - RNA, 11 nt, Homo sapiens
cauaacuguag

SEQ ID NO: 517317 - RNA, 19 nt, Homo sapiens
cauaauugccuacauuuau

SEQ ID NO: 517318 - RNA, 21 nt, Homo sapiens
cauacauucccucuaauuuga

SEQ ID NO: 517319 - RNA, 21 nt, Homo sapiens
cauaccaaguugauacuugaa

SEQ ID NO: 517320 - RNA, 18 nt, Homo sapiens
cauagaaaccacuagaaa

SEQ ID NO: 517321 - RNA, 17 nt, Homo sapiens
cauagcaccuaacaaca

SEQ ID NO: 517322 - RNA, 18 nt, Homo sapiens
cauagcagaugguuucca

SEQ ID NO: 517323 - RNA, 18 nt, Homo sapiens
cauaggaagaaaauguca

SEQ ID NO: 517324 - RNA, 14 nt, Homo sapiens
cauauaaccaaaau

SEQ ID NO: 517325 - RNA, 14 nt, Homo sapiens
cauauauacuugca

SEQ ID NO: 517326 - RNA, 16 nt, Homo sapiens
cauauauauuaauacu

SEQ ID NO: 517327 - RNA, 21 nt, Homo sapiens
cauauauauuaauacugguau

SEQ ID NO: 517328 - RNA, 13 nt, Homo sapiens
cauauauggaaga

SEQ ID NO: 517329 - RNA, 15 nt, Homo sapiens
cauauccugagccau

SEQ ID NO: 517330 - RNA, 21 nt, Homo sapiens
cauaugaggaggaugucccug

SEQ ID NO: 517331 - RNA, 22 nt, Homo sapiens
cauaugaggaggaugucccugg

SEQ ID NO: 517332 - RNA, 17 nt, Homo sapiens
cauauucugguucuuga

SEQ ID NO: 517333 - RNA, 16 nt, Homo sapiens
caucacaagaaaguca

SEQ ID NO: 517334 - RNA, 14 nt, Homo sapiens
caucacacucucca

SEQ ID NO: 517335 - RNA, 13 nt, Homo sapiens
caucacagggugg

SEQ ID NO: 517336 - RNA, 20 nt, Homo sapiens
cauccagaguucugugacac

SEQ ID NO: 517337 - RNA, 17 nt, Homo sapiens
cauccagcuucucaugu

SEQ ID NO: 517338 - RNA, 17 nt, Homo sapiens
caucccuuaguuuccac

SEQ ID NO: 517339 - RNA, 22 nt, Homo sapiens
cauccgaagaugguggccacag

SEQ ID NO: 517340 - RNA, 14 nt, Homo sapiens
cauccgcgugugcc

SEQ ID NO: 517341 - RNA, 16 nt, Homo sapiens
cauccgcgugugccug

SEQ ID NO: 517342 - RNA, 20 nt, Homo sapiens
cauccuacaacucacauuag

SEQ ID NO: 517343 - RNA, 12 nt, Homo sapiens
cauccuugaugc

SEQ ID NO: 517344 - RNA, 16 nt, Homo sapiens
caucggccuccaugac

SEQ ID NO: 517345 - RNA, 21 nt, Homo sapiens
caucucaaaaauaaugcauaa

SEQ ID NO: 517346 - RNA, 22 nt, Homo sapiens
caucucaaaaauaaugcauaaa

SEQ ID NO: 517347 - RNA, 17 nt, Homo sapiens
caucugaaagugguacu

SEQ ID NO: 517348 - RNA, 11 nt, Homo sapiens
caucugcaaua

SEQ ID NO: 517349 - RNA, 22 nt, Homo sapiens
caucugugcucuccguguuccu

SEQ ID NO: 517350 - RNA, 18 nt, Homo sapiens
caucuguuaucaaacugc

SEQ ID NO: 517351 - RNA, 18 nt, Homo sapiens
caucuuuuuuucuaugaa

SEQ ID NO: 517352 - RNA, 15 nt, Homo sapiens
caugaaaauaccauu

SEQ ID NO: 517353 - RNA, 15 nt, Homo sapiens
caugaaaaugacauu

SEQ ID NO: 517354 - RNA, 15 nt, Homo sapiens
caugaaccaagugga

SEQ ID NO: 517355 - RNA, 14 nt, Homo sapiens
caugaacuauauga

SEQ ID NO: 517356 - RNA, 17 nt, Homo sapiens
caugagacucagugcag

SEQ ID NO: 517357 - RNA, 14 nt, Homo sapiens
caugcaaaugagcu

SEQ ID NO: 517358 - RNA, 11 nt, Homo sapiens
caugcauuuga

SEQ ID NO: 517359 - RNA, 16 nt, Homo sapiens
caugccuauuucugaa

SEQ ID NO: 517360 - RNA, 14 nt, Homo sapiens
caugccuugagauc

SEQ ID NO: 517361 - RNA, 16 nt, Homo sapiens
caugcucugcagcauu

SEQ ID NO: 517362 - RNA, 17 nt, Homo sapiens
caugcugccuggcacag

SEQ ID NO: 517363 - RNA, 12 nt, Homo sapiens
caugcugcucaa

SEQ ID NO: 517364 - RNA, 21 nt, Homo sapiens
cauggaacagcauuacccucc

SEQ ID NO: 517365 - RNA, 19 nt, Homo sapiens
cauggaggccaagaacuug

SEQ ID NO: 517366 - RNA, 20 nt, Homo sapiens
cauggugaaaccccgucucu

SEQ ID NO: 517367 - RNA, 13 nt, Homo sapiens
caugguuguugca

SEQ ID NO: 517368 - RNA, 21 nt, Homo sapiens
cauguaauguuaauguuauau

SEQ ID NO: 517369 - RNA, 13 nt, Homo sapiens
caugucuagagaa

SEQ ID NO: 517370 - RNA, 18 nt, Homo sapiens
caugugccuuucuuugcc

SEQ ID NO: 517371 - RNA, 11 nt, Homo sapiens
cauguguuucu

SEQ ID NO: 517372 - RNA, 17 nt, Homo sapiens
cauguuugcagggguga

SEQ ID NO: 517373 - RNA, 23 nt, Homo sapiens
cauuaaggggaagaaugaaagcu

SEQ ID NO: 517374 - RNA, 15 nt, Homo sapiens
cauuaaucagauuag

SEQ ID NO: 517375 - RNA, 17 nt, Homo sapiens
cauuacuguguucaauu

SEQ ID NO: 517376 - RNA, 14 nt, Homo sapiens
cauuauaacuguau

SEQ ID NO: 517377 - RNA, 17 nt, Homo sapiens
cauuauucaagaaugaa

SEQ ID NO: 517378 - RNA, 17 nt, Homo sapiens
cauucaauuagugguca

SEQ ID NO: 517379 - RNA, 17 nt, Homo sapiens
cauucuggguguguucu

SEQ ID NO: 517380 - RNA, 17 nt, Homo sapiens
cauugauaaucuucagg

SEQ ID NO: 517381 - RNA, 17 nt, Homo sapiens
cauugauggccucaaug

SEQ ID NO: 517382 - RNA, 15 nt, Homo sapiens
cauugcaguuuaaga

SEQ ID NO: 517383 - RNA, 14 nt, Homo sapiens
cauuguagccucaa

SEQ ID NO: 517384 - RNA, 16 nt, Homo sapiens
cauuguagccucaauc

SEQ ID NO: 517385 - RNA, 22 nt, Homo sapiens
cauuguagccucaaucgaguga

SEQ ID NO: 517386 - RNA, 20 nt, Homo sapiens
cauugucaccucugugaccc

SEQ ID NO: 517387 - RNA, 19 nt, Homo sapiens
cauuuaaaacauuaaaaua

SEQ ID NO: 517388 - RNA, 22 nt, Homo sapiens
cauuuaaaauugcuauguuacu

SEQ ID NO: 517389 - RNA, 22 nt, Homo sapiens
cauuuagcuuguuccacugcaa

SEQ ID NO: 517390 - RNA, 20 nt, Homo sapiens
cauuugcugaacucagcaca

SEQ ID NO: 517391 - RNA, 16 nt, Homo sapiens
cauuuuaccacuuuaa

SEQ ID NO: 517392 - RNA, 15 nt, Homo sapiens
cauuuucauugauga

SEQ ID NO: 517393 - RNA, 15 nt, Homo sapiens
cauuuucuaugcuug

SEQ ID NO: 517394 - RNA, 19 nt, Homo sapiens
cauuuuugcacuuaucucg

SEQ ID NO: 517395 - RNA, 18 nt, Homo sapiens
cauuuuuuugcaugcaug

SEQ ID NO: 517396 - RNA, 23 nt, Homo sapiens
ccaaacaggacagcacugggaac

SEQ ID NO: 517397 - RNA, 21 nt, Homo sapiens
ccaaagaagcugcuguucuua

SEQ ID NO: 517398 - RNA, 16 nt, Homo sapiens
ccaaccuccaguguca

SEQ ID NO: 517399 - RNA, 17 nt, Homo sapiens
ccaacuucaauuuacuu

SEQ ID NO: 517400 - RNA, 17 nt, Homo sapiens
ccaagaacuugcaauac

SEQ ID NO: 517401 - RNA, 15 nt, Homo sapiens
ccaaggaugcuguca

SEQ ID NO: 517402 - RNA, 16 nt, Homo sapiens
ccaagggcaccuggag

SEQ ID NO: 517403 - RNA, 13 nt, Homo sapiens
ccaauacccagac

SEQ ID NO: 517404 - RNA, 21 nt, Homo sapiens
ccaaugcuucuguugaucuca

SEQ ID NO: 517405 - RNA, 22 nt, Homo sapiens
ccaauguucuaaaguuuugcaa

SEQ ID NO: 517406 - RNA, 16 nt, Homo sapiens
ccaauucagugucugu

SEQ ID NO: 517407 - RNA, 16 nt, Homo sapiens
ccacaaaaaauacuuu

SEQ ID NO: 517408 - RNA, 19 nt, Homo sapiens
ccacaaaacuucagugugg

SEQ ID NO: 517409 - RNA, 19 nt, Homo sapiens
ccacaauuauuggcaaagu

SEQ ID NO: 517410 - RNA, 22 nt, Homo sapiens
ccacaccuggcccuugcaaucu

SEQ ID NO: 517411 - RNA, 21 nt, Homo sapiens
ccacagccgccugaaagccac

SEQ ID NO: 517412 - RNA, 19 nt, Homo sapiens
ccacauauuuuagacacuu

SEQ ID NO: 517413 - RNA, 21 nt, Homo sapiens
ccaccacucaggccacagugg

SEQ ID NO: 517414 - RNA, 19 nt, Homo sapiens
ccacccgugggaaugcugc

SEQ ID NO: 517415 - RNA, 19 nt, Homo sapiens
ccaccucggcacacacugu

SEQ ID NO: 517416 - RNA, 17 nt, Homo sapiens
ccacgauucucccaaag

SEQ ID NO: 517417 - RNA, 23 nt, Homo sapiens
ccacggccuguacggacacugug

SEQ ID NO: 517418 - RNA, 12 nt, Homo sapiens
ccacuaaacuac

SEQ ID NO: 517419 - RNA, 16 nt, Homo sapiens
ccacucacuuugcaau

SEQ ID NO: 517420 - RNA, 22 nt, Homo sapiens
ccacugaaaauucgaaccagga

SEQ ID NO: 517421 - RNA, 15 nt, Homo sapiens
ccacugcugagcugg

SEQ ID NO: 517422 - RNA, 23 nt, Homo sapiens
ccacuguugguauuauauaauuc

SEQ ID NO: 517423 - RNA, 16 nt, Homo sapiens
ccagaaccacacuuga

SEQ ID NO: 517424 - RNA, 18 nt, Homo sapiens
ccagaacugcacucuuca

SEQ ID NO: 517425 - RNA, 18 nt, Homo sapiens
ccagaaggcgugcuggca

SEQ ID NO: 517426 - RNA, 16 nt, Homo sapiens
ccauuaaaaacuacca

SEQ ID NO: 517427 - RNA, 16 nt, Homo sapiens
ccauuacagagguauu

SEQ ID NO: 517428 - RNA, 15 nt, Homo sapiens
ccauuggauuacuuu

SEQ ID NO: 517429 - RNA, 12 nt, Homo sapiens
ccauuguuccug

SEQ ID NO: 517430 - RNA, 14 nt, Homo sapiens
ccauuuaaagacca

SEQ ID NO: 517431 - RNA, 19 nt, Homo sapiens
cccaacacuuccagcauuu

SEQ ID NO: 517432 - RNA, 14 nt, Homo sapiens
cccaacaugcacug

SEQ ID NO: 517433 - RNA, 13 nt, Homo sapiens
cccaagcgucauc

SEQ ID NO: 517434 - RNA, 16 nt, Homo sapiens
cccaaggaugcuguca

SEQ ID NO: 517435 - RNA, 18 nt, Homo sapiens
cccacaaaacuucagugu

SEQ ID NO: 517436 - RNA, 15 nt, Homo sapiens
cccacacuguggcca

SEQ ID NO: 517437 - RNA, 19 nt, Homo sapiens
cccacauguccagcaccuu

SEQ ID NO: 517438 - RNA, 12 nt, Homo sapiens
cccagagcacuu

SEQ ID NO: 517439 - RNA, 15 nt, Homo sapiens
cccagcccugcugca

SEQ ID NO: 517440 - RNA, 17 nt, Homo sapiens
cccagcucaaugcaaug

SEQ ID NO: 517441 - RNA, 18 nt, Homo sapiens
cccaggccucugugggcc

SEQ ID NO: 517442 - RNA, 20 nt, Homo sapiens
cccagggcaccauccagcuc

SEQ ID NO: 517443 - RNA, 18 nt, Homo sapiens
cccaggggacaagggauu

SEQ ID NO: 517444 - RNA, 23 nt, Homo sapiens
cccauagguggcugagcaucgga

SEQ ID NO: 517445 - RNA, 21 nt, Homo sapiens
cccauuguuccugcgcugcaa

SEQ ID NO: 517446 - RNA, 22 nt, Homo sapiens
ccccaacaaugugagggguccc

SEQ ID NO: 517447 - RNA, 17 nt, Homo sapiens
ccccaacaugcacugau

SEQ ID NO: 517448 - RNA, 18 nt, Homo sapiens
ccccaauaaaggcagcug

SEQ ID NO: 517449 - RNA, 23 nt, Homo sapiens
ccccacaggagcccugcagugug

SEQ ID NO: 517450 - RNA, 22 nt, Homo sapiens
ccccagccugcucccuagccag

SEQ ID NO: 517451 - RNA, 21 nt, Homo sapiens
ccccauagguggcugagcauc

SEQ ID NO: 517452 - RNA, 17 nt, Homo sapiens
ccccaugggcacagugg

SEQ ID NO: 517453 - RNA, 23 nt, Homo sapiens
ccccucagccuugggaccgugcc

SEQ ID NO: 517454 - RNA, 13 nt, Homo sapiens
ccccucucaccaa

SEQ ID NO: 517455 - RNA, 14 nt, Homo sapiens
cccgagaagcacuu

SEQ ID NO: 517456 - RNA, 17 nt, Homo sapiens
cccgagaagcacuugag

SEQ ID NO: 517457 - RNA, 14 nt, Homo sapiens
cccuaccugucaac

SEQ ID NO: 517458 - RNA, 21 nt, Homo sapiens
cccuagcagcccacccugcug

SEQ ID NO: 517459 - RNA, 17 nt, Homo sapiens
cccucaccccuccaagc

SEQ ID NO: 517460 - RNA, 14 nt, Homo sapiens
cccucccacaccca

SEQ ID NO: 517461 - RNA, 14 nt, Homo sapiens
cccuccgaccacuu

SEQ ID NO: 517462 - RNA, 12 nt, Homo sapiens
cccucucacuuu

SEQ ID NO: 517463 - RNA, 21 nt, Homo sapiens
cccucugucggcuuuuugcca

SEQ ID NO: 517464 - RNA, 15 nt, Homo sapiens
cccugaauggucuca

SEQ ID NO: 517465 - RNA, 13 nt, Homo sapiens
aagcuuaggucaa

SEQ ID NO: 517466 - RNA, 21 nt, Homo sapiens
aagcuuuuuccuccuggaaca

SEQ ID NO: 517467 - RNA, 22 nt, Homo sapiens
aaggaagcaaguuuucuuccau

SEQ ID NO: 517468 - RNA, 19 nt, Homo sapiens
aaggaagggacacauauca

SEQ ID NO: 517469 - RNA, 20 nt, Homo sapiens
aaggacaccuuuuaacucac

SEQ ID NO: 517470 - RNA, 15 nt, Homo sapiens
aaggagggggccuca

SEQ ID NO: 517471 - RNA, 23 nt, Homo sapiens
aaggaugcugucaagcaccugca

SEQ ID NO: 517472 - RNA, 14 nt, Homo sapiens
aaggcagcugccuc

SEQ ID NO: 517473 - RNA, 20 nt, Homo sapiens
aaggcagcugccucugcucc

SEQ ID NO: 517474 - RNA, 19 nt, Homo sapiens
aaggcaggaggaucacuug

SEQ ID NO: 517475 - RNA, 22 nt, Homo sapiens
aaggcaggaggaucacuugagc

SEQ ID NO: 517476 - RNA, 16 nt, Homo sapiens
aaggcagucauaucaa

SEQ ID NO: 517477 - RNA, 19 nt, Homo sapiens
aaggcaucuacacaauuua

SEQ ID NO: 517478 - RNA, 16 nt, Homo sapiens
aaggcccacuguaaua

SEQ ID NO: 517479 - RNA, 14 nt, Homo sapiens
aagggaauugcuca

SEQ ID NO: 517480 - RNA, 23 nt, Homo sapiens
aagggauuugaggugaggguugg

SEQ ID NO: 517481 - RNA, 15 nt, Homo sapiens
aaggggagaagggaa

SEQ ID NO: 517482 - RNA, 16 nt, Homo sapiens
aaggggcacugguggc

SEQ ID NO: 517483 - RNA, 22 nt, Homo sapiens
aagguagagucuuacaaucaaa

SEQ ID NO: 517484 - RNA, 22 nt, Homo sapiens
aagguggauuuucaucaggggc

SEQ ID NO: 517485 - RNA, 22 nt, Homo sapiens
aaguauuugcuuaaaauuguga

SEQ ID NO: 517486 - RNA, 23 nt, Homo sapiens
aaguauuuuuuucuuuuuucuca

SEQ ID NO: 517487 - RNA, 15 nt, Homo sapiens
aagucagcucuuguc

SEQ ID NO: 517488 - RNA, 22 nt, Homo sapiens
aagucaucucauuccacuguug

SEQ ID NO: 517489 - RNA, 14 nt, Homo sapiens
aagucaugccugag

SEQ ID NO: 517490 - RNA, 15 nt, Homo sapiens
aagucugcuacccuc

SEQ ID NO: 517491 - RNA, 17 nt, Homo sapiens
aagugcauauuuaucca

SEQ ID NO: 517492 - RNA, 18 nt, Homo sapiens
aagugcgugaauguaugu

SEQ ID NO: 517493 - RNA, 14 nt, Homo sapiens
aagugguacuugau

SEQ ID NO: 517494 - RNA, 24 nt, Homo sapiens
aaguguauuuauuuuacagcucau

SEQ ID NO: 517495 - RNA, 16 nt, Homo sapiens
aaguguccuucuugcu

SEQ ID NO: 517496 - RNA, 19 nt, Homo sapiens
aaguucgagucaaaguuga

SEQ ID NO: 517497 - RNA, 19 nt, Homo sapiens
aaguucugaagaugaugcg

SEQ ID NO: 517498 - RNA, 14 nt, Homo sapiens
aaguugauacuuga

SEQ ID NO: 517499 - RNA, 17 nt, Homo sapiens
aaguuuugcaacaauaa

SEQ ID NO: 517500 - RNA, 20 nt, Homo sapiens
aaguuuuuuauuaugcauua

SEQ ID NO: 517501 - RNA, 14 nt, Homo sapiens
aauaaaauaucaua

SEQ ID NO: 517502 - RNA, 15 nt, Homo sapiens
aauaaagcaaugugg

SEQ ID NO: 517503 - RNA, 16 nt, Homo sapiens
aauaaagucauuauua

SEQ ID NO: 517504 - RNA, 14 nt, Homo sapiens
aauaagacaagaga

SEQ ID NO: 517505 - RNA, 20 nt, Homo sapiens
aauaagucaucugaugagaa

SEQ ID NO: 517506 - RNA, 14 nt, Homo sapiens
aauagacacauaca

SEQ ID NO: 517507 - RNA, 22 nt, Homo sapiens
cuuccuucccagaauguuacug

SEQ ID NO: 517508 - RNA, 18 nt, Homo sapiens
cuucuacgggauggccag

SEQ ID NO: 517509 - RNA, 20 nt, Homo sapiens
cuucuacugccuugaaaaau

SEQ ID NO: 517510 - RNA, 15 nt, Homo sapiens
cuucuagugccucug

SEQ ID NO: 517511 - RNA, 15 nt, Homo sapiens
cuucuguugaucuca

SEQ ID NO: 517512 - RNA, 19 nt, Homo sapiens
cuucuuacaugcauuugag

SEQ ID NO: 517513 - RNA, 14 nt, Homo sapiens
cuucuuacuaagcu

SEQ ID NO: 517514 - RNA, 15 nt, Homo sapiens
cuucuuacuggugcu

SEQ ID NO: 517515 - RNA, 16 nt, Homo sapiens
cuucuuacuggugcua

SEQ ID NO: 517516 - RNA, 20 nt, Homo sapiens
cuucuuggggcccagugcau

SEQ ID NO: 517517 - RNA, 17 nt, Homo sapiens
cuucuuuccuuguucag

SEQ ID NO: 517518 - RNA, 22 nt, Homo sapiens
cuucuuugacaccacaccauca

SEQ ID NO: 517519 - RNA, 19 nt, Homo sapiens
cuugaaaauaagauuccag

SEQ ID NO: 517520 - RNA, 18 nt, Homo sapiens
cuugaauaaccaucugaa

SEQ ID NO: 517521 - RNA, 13 nt, Homo sapiens
cuugaaugugguc

SEQ ID NO: 517522 - RNA, 17 nt, Homo sapiens
cuugaucucucuugucc

SEQ ID NO: 517523 - RNA, 18 nt, Homo sapiens
cuugcaauguagucaaua

SEQ ID NO: 517524 - RNA, 15 nt, Homo sapiens
cuugcaccguccuca

SEQ ID NO: 517525 - RNA, 17 nt, Homo sapiens
cuugcccccagugccuc

SEQ ID NO: 517526 - RNA, 19 nt, Homo sapiens
cuugccuccaggugcagag

SEQ ID NO: 517527 - RNA, 22 nt, Homo sapiens
cuugccugaggggaaagagaga

SEQ ID NO: 517528 - RNA, 18 nt, Homo sapiens
cuugccugcagggccaug

SEQ ID NO: 517529 - RNA, 19 nt, Homo sapiens
cuuggaaaggcucccuguc

SEQ ID NO: 517530 - RNA, 16 nt, Homo sapiens
cuugggaccgugccca

SEQ ID NO: 517531 - RNA, 17 nt, Homo sapiens
cuuggggcccagugcau

SEQ ID NO: 517532 - RNA, 21 nt, Homo sapiens
cuugguuuuuauaccauucag

SEQ ID NO: 517533 - RNA, 19 nt, Homo sapiens
cuuguaacaguuuugugua

SEQ ID NO: 517534 - RNA, 20 nt, Homo sapiens
cuuguauauauggaucagag

SEQ ID NO: 517535 - RNA, 14 nt, Homo sapiens
cuuuaucauugcua

SEQ ID NO: 517536 - RNA, 11 nt, Homo sapiens
cuuucauguca

SEQ ID NO: 517537 - RNA, 20 nt, Homo sapiens
cuuuccaaaaggaacucuag

SEQ ID NO: 517538 - RNA, 17 nt, Homo sapiens
cuuuccaaggaagcaga

SEQ ID NO: 517539 - RNA, 23 nt, Homo sapiens
cuuucccauucuguuuggaucua

SEQ ID NO: 517540 - RNA, 16 nt, Homo sapiens
cuuuccccuaagcaga

SEQ ID NO: 517541 - RNA, 22 nt, Homo sapiens
cuuuccuguuucuaucuuucau

SEQ ID NO: 517542 - RNA, 21 nt, Homo sapiens
cuuucuacaggccagcagggg

SEQ ID NO: 517543 - RNA, 18 nt, Homo sapiens
cuuugaagugcagcucau

SEQ ID NO: 517544 - RNA, 13 nt, Homo sapiens
cuuugcagugggg

SEQ ID NO: 517545 - RNA, 17 nt, Homo sapiens
cuuuguuacuuccuuau

SEQ ID NO: 517546 - RNA, 17 nt, Homo sapiens
cuuuuaauaaacugcaa

SEQ ID NO: 517547 - RNA, 19 nt, Homo sapiens
cuuuuaauuuaaaaacaca

SEQ ID NO: 517548 - RNA, 16 nt, Homo sapiens
cuuuuauaaagcaugu

SEQ ID NO: 517549 - RNA, 15 nt, Homo sapiens
cuuuuauuuggugug

SEQ ID NO: 517550 - RNA, 16 nt, Homo sapiens
cuuuuggcaguucuga

SEQ ID NO: 517551 - RNA, 20 nt, Homo sapiens
cuuuugguagagaaggagca

SEQ ID NO: 517552 - RNA, 12 nt, Homo sapiens
cuuuuucauaua

SEQ ID NO: 517553 - RNA, 15 nt, Homo sapiens
cuuuuuggccuguga

SEQ ID NO: 517554 - RNA, 22 nt, Homo sapiens
gaaaaaacugugccuuguuuca

SEQ ID NO: 517555 - RNA, 16 nt, Homo sapiens
gaaaacagaugaccau

SEQ ID NO: 517556 - RNA, 13 nt, Homo sapiens
gaaaacauuugcu

SEQ ID NO: 517557 - RNA, 16 nt, Homo sapiens
gaaaaggaagacuaga

SEQ ID NO: 517558 - RNA, 15 nt, Homo sapiens
gaaaagguugccuga

SEQ ID NO: 517559 - RNA, 16 nt, Homo sapiens
gaaaagguugccugaa

SEQ ID NO: 517560 - RNA, 23 nt, Homo sapiens
gaaaaguguguauauauuuugug

SEQ ID NO: 517561 - RNA, 14 nt, Homo sapiens
gaaaauauaugccu

SEQ ID NO: 517562 - RNA, 21 nt, Homo sapiens
gaaaauauuuuguugccuuca

SEQ ID NO: 517563 - RNA, 16 nt, Homo sapiens
gaaaaucuccaucuca

SEQ ID NO: 517564 - RNA, 23 nt, Homo sapiens
gaaaaugcaacucuaacucugag

SEQ ID NO: 517565 - RNA, 19 nt, Homo sapiens
gaaacaugucuugacuguu

SEQ ID NO: 517566 - RNA, 14 nt, Homo sapiens
gaaaccccgucucu

SEQ ID NO: 517567 - RNA, 18 nt, Homo sapiens
gaaaccuacacacuguca

SEQ ID NO: 517568 - RNA, 18 nt, Homo sapiens
gaaacgcuagaagccuaa

SEQ ID NO: 517569 - RNA, 15 nt, Homo sapiens
gaaacucacacuccc

SEQ ID NO: 517570 - RNA, 17 nt, Homo sapiens
gaaagacuggacucuaa

SEQ ID NO: 517571 - RNA, 19 nt, Homo sapiens
gaaagagagcaccacguga

SEQ ID NO: 517572 - RNA, 12 nt, Homo sapiens
gaaagauuugau

SEQ ID NO: 517573 - RNA, 21 nt, Homo sapiens
gaaagcaaguguucacaacag

SEQ ID NO: 517574 - RNA, 14 nt, Homo sapiens
gaaagccuuaggga

SEQ ID NO: 517575 - RNA, 20 nt, Homo sapiens
gaaagucaaauuuacuuuaa

SEQ ID NO: 517576 - RNA, 15 nt, Homo sapiens
cugagagucugagaa

SEQ ID NO: 517577 - RNA, 22 nt, Homo sapiens
cugagaugaaaacuagggcuca

SEQ ID NO: 517578 - RNA, 23 nt, Homo sapiens
cugagcaccacacccagugggaa

SEQ ID NO: 517579 - RNA, 16 nt, Homo sapiens
cugagggcagacuggg

SEQ ID NO: 517580 - RNA, 23 nt, Homo sapiens
cugaucccccauagguggcugag

SEQ ID NO: 517581 - RNA, 20 nt, Homo sapiens
cugauuuaaaagggcucuuu

SEQ ID NO: 517582 - RNA, 17 nt, Homo sapiens
cugcaagugugugcucu

SEQ ID NO: 517583 - RNA, 20 nt, Homo sapiens
cugcacuccagccuggggga

SEQ ID NO: 517584 - RNA, 17 nt, Homo sapiens
cugcacuguccugacca

SEQ ID NO: 517585 - RNA, 15 nt, Homo sapiens
cugcacuguuuucaa

SEQ ID NO: 517586 - RNA, 18 nt, Homo sapiens
cugcagcuuuacugccuu

SEQ ID NO: 517587 - RNA, 17 nt, Homo sapiens
cugcagucaucuacuuu

SEQ ID NO: 517588 - RNA, 22 nt, Homo sapiens
cugccaucgaccuggagacuga

SEQ ID NO: 517589 - RNA, 13 nt, Homo sapiens
cugcccaaugaga

SEQ ID NO: 517590 - RNA, 15 nt, Homo sapiens
cugccccccaugagg

SEQ ID NO: 517591 - RNA, 15 nt, Homo sapiens
cugccccucucacca

SEQ ID NO: 517592 - RNA, 15 nt, Homo sapiens
cugccuccugugacg

SEQ ID NO: 517593 - RNA, 19 nt, Homo sapiens
cugccuccugugacgugag

SEQ ID NO: 517594 - RNA, 13 nt, Homo sapiens
cugccucugagau

SEQ ID NO: 517595 - RNA, 21 nt, Homo sapiens
cugcuaguggugagcauguaa

SEQ ID NO: 517596 - RNA, 18 nt, Homo sapiens
cugcucacaaaaucacuu

SEQ ID NO: 517597 - RNA, 14 nt, Homo sapiens
cugcucuuccucag

SEQ ID NO: 517598 - RNA, 22 nt, Homo sapiens
cugcugaaaacuagcucgugau

SEQ ID NO: 517599 - RNA, 14 nt, Homo sapiens
cugcugauuuucug

SEQ ID NO: 517600 - RNA, 14 nt, Homo sapiens
cugcugcgcugcuu

SEQ ID NO: 517601 - RNA, 15 nt, Homo sapiens
cugcugucauaacau

SEQ ID NO: 517602 - RNA, 22 nt, Homo sapiens
cugcuugauuuuaauacauuga

SEQ ID NO: 517603 - RNA, 15 nt, Homo sapiens
cugcuugcugcucau

SEQ ID NO: 517604 - RNA, 19 nt, Homo sapiens
cugcuuuaggaauucugca

SEQ ID NO: 517605 - RNA, 22 nt, Homo sapiens
cuggaaaguuuucuccacugga

SEQ ID NO: 517606 - RNA, 13 nt, Homo sapiens
cuggaacauuuau

SEQ ID NO: 517607 - RNA, 23 nt, Homo sapiens
cuggaaccagcucucuccuaaua

SEQ ID NO: 517608 - RNA, 18 nt, Homo sapiens
cuggaagggguccagccu

SEQ ID NO: 517609 - RNA, 17 nt, Homo sapiens
cuggagaugcugccugg

SEQ ID NO: 517610 - RNA, 15 nt, Homo sapiens
cuggagcaguggacu

SEQ ID NO: 517611 - RNA, 18 nt, Homo sapiens
cuggcaagucuuccauga

SEQ ID NO: 517612 - RNA, 20 nt, Homo sapiens
cuggcagcaucuucacuucu

SEQ ID NO: 517613 - RNA, 13 nt, Homo sapiens
cuggcaggcaaga

SEQ ID NO: 517614 - RNA, 18 nt, Homo sapiens
cuggcagggccaccugca

SEQ ID NO: 517615 - RNA, 17 nt, Homo sapiens
cuggcagggcccaguga

SEQ ID NO: 517616 - RNA, 21 nt, Homo sapiens
cuggccuuuccugguuuucau

SEQ ID NO: 517617 - RNA, 15 nt, Homo sapiens
cuggcucacaguaca

SEQ ID NO: 517618 - RNA, 16 nt, Homo sapiens
cuggcucacaguacag

SEQ ID NO: 517619 - RNA, 19 nt, Homo sapiens
cugggaugaugcaguuuga

SEQ ID NO: 517620 - RNA, 21 nt, Homo sapiens
cugggauuacaggcgugaucc

SEQ ID NO: 517621 - RNA, 10 nt, Homo sapiens
cugggccaug

SEQ ID NO: 517622 - RNA, 13 nt, Homo sapiens
cugggccaugucc

SEQ ID NO: 517623 - RNA, 15 nt, Homo sapiens
cugggccauguccaa

SEQ ID NO: 517624 - RNA, 16 nt, Homo sapiens
cugggccauguccaaa

SEQ ID NO: 517625 - RNA, 17 nt, Homo sapiens
cugggcuauugcugcug

SEQ ID NO: 517626 - RNA, 19 nt, Homo sapiens
cuggggaauauacgugcuu

SEQ ID NO: 517627 - RNA, 19 nt, Homo sapiens
cuggggagugguuaggcag

SEQ ID NO: 517628 - RNA, 20 nt, Homo sapiens
cuggggagugguuaggcagc

SEQ ID NO: 517629 - RNA, 16 nt, Homo sapiens
cuggggggacccagug

SEQ ID NO: 517630 - RNA, 19 nt, Homo sapiens
cuggggggacccagugcag

SEQ ID NO: 517631 - RNA, 22 nt, Homo sapiens
cugguacugcaggaccuccagc

SEQ ID NO: 517632 - RNA, 20 nt, Homo sapiens
cugguauuguuuacguuuga

SEQ ID NO: 517633 - RNA, 23 nt, Homo sapiens
cuggugggccuuucuguguccua

SEQ ID NO: 517634 - RNA, 19 nt, Homo sapiens
cuguaaaauuaaacaaaua

SEQ ID NO: 517635 - RNA, 14 nt, Homo sapiens
cuguaaucccagcu

SEQ ID NO: 517636 - RNA, 15 nt, Homo sapiens
cuguacggacacugu

SEQ ID NO: 517637 - RNA, 22 nt, Homo sapiens
cuguacuauccuguaaauauau

SEQ ID NO: 517638 - RNA, 14 nt, Homo sapiens
cuguaggugaaaga

SEQ ID NO: 517639 - RNA, 18 nt, Homo sapiens
cuguagucccagcuacuu

SEQ ID NO: 517640 - RNA, 22 nt, Homo sapiens
cuguauuuuuauuuuugcacaa

SEQ ID NO: 517641 - RNA, 23 nt, Homo sapiens
cugucaagcaccugcaugugcug

SEQ ID NO: 517642 - RNA, 17 nt, Homo sapiens
gacaagcugcauuucag

SEQ ID NO: 517643 - RNA, 12 nt, Homo sapiens
gacaagggauuu

SEQ ID NO: 517644 - RNA, 14 nt, Homo sapiens
gacaaggugccugu

SEQ ID NO: 517645 - RNA, 14 nt, Homo sapiens
gacaauacuggggu

SEQ ID NO: 517646 - RNA, 14 nt, Homo sapiens
gacaaugauccagu

SEQ ID NO: 517647 - RNA, 18 nt, Homo sapiens
gacacauagaaaacaauc

SEQ ID NO: 517648 - RNA, 13 nt, Homo sapiens
gacagcucuccaa

SEQ ID NO: 517649 - RNA, 22 nt, Homo sapiens
gacagcugcugggucaggccac

SEQ ID NO: 517650 - RNA, 15 nt, Homo sapiens
gacaguauccacaau

SEQ ID NO: 517651 - RNA, 17 nt, Homo sapiens
gacauaaucuaguuuua

SEQ ID NO: 517652 - RNA, 15 nt, Homo sapiens
gacauacuuaaugca

SEQ ID NO: 517653 - RNA, 17 nt, Homo sapiens
gacauacuuaaugcaua

SEQ ID NO: 517654 - RNA, 18 nt, Homo sapiens
gacaucggccuccaugac

SEQ ID NO: 517655 - RNA, 20 nt, Homo sapiens
gacauuuuggaagcugagau

SEQ ID NO: 517656 - RNA, 23 nt, Homo sapiens
gaccagccuggucaacauaguga

SEQ ID NO: 517657 - RNA, 15 nt, Homo sapiens
gacccagucccacac

SEQ ID NO: 517658 - RNA, 23 nt, Homo sapiens
gaccccuucggcagcuacucaga

SEQ ID NO: 517659 - RNA, 15 nt, Homo sapiens
gacccuguccugcag

SEQ ID NO: 517660 - RNA, 23 nt, Homo sapiens
gacccuguccugcagucccacac

SEQ ID NO: 517661 - RNA, 18 nt, Homo sapiens
gaccgugggccgagguga

SEQ ID NO: 517662 - RNA, 10 nt, Homo sapiens
gaccucuugu

SEQ ID NO: 517663 - RNA, 17 nt, Homo sapiens
gaccuggagaugcugcc

SEQ ID NO: 517664 - RNA, 14 nt, Homo sapiens
gaccuggugcugag

SEQ ID NO: 517665 - RNA, 17 nt, Homo sapiens
gaccuugggguacaauu

SEQ ID NO: 517666 - RNA, 16 nt, Homo sapiens
gacgaguaacuccccu

SEQ ID NO: 517667 - RNA, 13 nt, Homo sapiens
gacgcagcacaag

SEQ ID NO: 517668 - RNA, 16 nt, Homo sapiens
gacuacacaauacagu

SEQ ID NO: 517669 - RNA, 17 nt, Homo sapiens
gacuagaggcuugcaua

SEQ ID NO: 517670 - RNA, 13 nt, Homo sapiens
gacuauuacauau

SEQ ID NO: 517671 - RNA, 20 nt, Homo sapiens
gacucuaaagucuguugauu

SEQ ID NO: 517672 - RNA, 21 nt, Homo sapiens
gacucugccauuaaaacauua

SEQ ID NO: 517673 - RNA, 18 nt, Homo sapiens
gacucuggauuuggugcu

SEQ ID NO: 517674 - RNA, 17 nt, Homo sapiens
gacugaaauuacuuuaa

SEQ ID NO: 517675 - RNA, 15 nt, Homo sapiens
gacugacaaccucau

SEQ ID NO: 517676 - RNA, 14 nt, Homo sapiens
gacugcuaccuuuc

SEQ ID NO: 517677 - RNA, 13 nt, Homo sapiens
gacuggugcugca

SEQ ID NO: 517678 - RNA, 21 nt, Homo sapiens
gacugugaggccauacuugug

SEQ ID NO: 517679 - RNA, 14 nt, Homo sapiens
gacugugucugccu

SEQ ID NO: 517680 - RNA, 21 nt, Homo sapiens
gacuuagcgucaagacauuug

SEQ ID NO: 517681 - RNA, 13 nt, Homo sapiens
gacuuauugccaa

SEQ ID NO: 517682 - RNA, 19 nt, Homo sapiens
gacuuccgagcuaugucag

SEQ ID NO: 517683 - RNA, 19 nt, Homo sapiens
gacuuccucugguguuuau

SEQ ID NO: 517684 - RNA, 14 nt, Homo sapiens
gacuugauagcaaa

SEQ ID NO: 517685 - RNA, 21 nt, Homo sapiens
gagaaaaaugcuccccacagc

SEQ ID NO: 517686 - RNA, 16 nt, Homo sapiens
gagaaaauguuguaua

SEQ ID NO: 517687 - RNA, 15 nt, Homo sapiens
gagaaacaauggcua

SEQ ID NO: 517688 - RNA, 15 nt, Homo sapiens
gagaagcaagccagc

SEQ ID NO: 517689 - RNA, 14 nt, Homo sapiens
gagaagcacuugag

SEQ ID NO: 517690 - RNA, 15 nt, Homo sapiens
gagaaugcuggcaaa

SEQ ID NO: 517691 - RNA, 16 nt, Homo sapiens
gagaauguuguauuca

SEQ ID NO: 517692 - RNA, 14 nt, Homo sapiens
gagaauuggcucaa

SEQ ID NO: 517693 - RNA, 11 nt, Homo sapiens
gagacacucca

SEQ ID NO: 517694 - RNA, 12 nt, Homo sapiens
gagacagugacu

SEQ ID NO: 517695 - RNA, 13 nt, Homo sapiens
gagacauuggcuu

SEQ ID NO: 517696 - RNA, 16 nt, Homo sapiens
gagacucuagggucca

SEQ ID NO: 517697 - RNA, 18 nt, Homo sapiens
gagacucuaggguccagu

SEQ ID NO: 517698 - RNA, 16 nt, Homo sapiens
gagacugucccugaaa

SEQ ID NO: 517699 - RNA, 16 nt, Homo sapiens
gagagccucgcuuuuu

SEQ ID NO: 517700 - RNA, 14 nt, Homo sapiens
gagaggugauucuc

SEQ ID NO: 517701 - RNA, 17 nt, Homo sapiens
gagaguaccuguguguu

SEQ ID NO: 517702 - RNA, 13 nt, Homo sapiens
gagauaaagcuua

SEQ ID NO: 517703 - RNA, 22 nt, Homo sapiens
gagaucguaccuauugcacucc

SEQ ID NO: 517704 - RNA, 19 nt, Homo sapiens
gagaucgugcuacugcacu

SEQ ID NO: 517705 - RNA, 20 nt, Homo sapiens
gagaucgugcuacugcacuc

SEQ ID NO: 517706 - RNA, 21 nt, Homo sapiens
gagaucgugcuacugcacucc

SEQ ID NO: 517707 - RNA, 15 nt, Homo sapiens
gagaucugugccaua

SEQ ID NO: 517708 - RNA, 17 nt, Homo sapiens
gagaugguuucuagaga

SEQ ID NO: 517709 - RNA, 15 nt, Homo sapiens
gagauuauucuuugu

SEQ ID NO: 517710 - RNA, 21 nt, Homo sapiens
gagauuugucuaauugcaucu

SEQ ID NO: 517711 - RNA, 16 nt, Homo sapiens
gagcaaagagccagca

SEQ ID NO: 517712 - RNA, 20 nt, Homo sapiens
gagcaaaucuccauacuguu

SEQ ID NO: 517713 - RNA, 20 nt, Homo sapiens
gagcacugcguuuuccuagc

SEQ ID NO: 517714 - RNA, 17 nt, Homo sapiens
gagcagaagaucaagga

SEQ ID NO: 517715 - RNA, 20 nt, Homo sapiens
ugcagcuagaggcaucuucu

SEQ ID NO: 517716 - RNA, 15 nt, Homo sapiens
ugcaggccccagcaa

SEQ ID NO: 517717 - RNA, 17 nt, Homo sapiens
ugcaggugacauuugcu

SEQ ID NO: 517718 - RNA, 22 nt, Homo sapiens
ugcagguguccugagcaccaca

SEQ ID NO: 517719 - RNA, 18 nt, Homo sapiens
ugcaguauucuugcacug

SEQ ID NO: 517720 - RNA, 14 nt, Homo sapiens
ugcaguuuuacuaa

SEQ ID NO: 517721 - RNA, 18 nt, Homo sapiens
ugcauaauaacuacuucc

SEQ ID NO: 517722 - RNA, 17 nt, Homo sapiens
ugcauagcaagugaaag

SEQ ID NO: 517723 - RNA, 21 nt, Homo sapiens
ugcauagcagaugguuuccac

SEQ ID NO: 517724 - RNA, 12 nt, Homo sapiens
ugcauauaguua

SEQ ID NO: 517725 - RNA, 13 nt, Homo sapiens
ugcaugagcugca

SEQ ID NO: 517726 - RNA, 12 nt, Homo sapiens
ugcauuccagcc

SEQ ID NO: 517727 - RNA, 19 nt, Homo sapiens
ugcauuuauaugcgcuuaa

SEQ ID NO: 517728 - RNA, 21 nt, Homo sapiens
ugcauuugugguaaucuacac

SEQ ID NO: 517729 - RNA, 16 nt, Homo sapiens
ugccaaaauauaauca

SEQ ID NO: 517730 - RNA, 13 nt, Homo sapiens
ugccaacugccag

SEQ ID NO: 517731 - RNA, 16 nt, Homo sapiens
ugccacuaaacuacau

SEQ ID NO: 517732 - RNA, 21 nt, Homo sapiens
ugccauagaacaagauaccag

SEQ ID NO: 517733 - RNA, 21 nt, Homo sapiens
ugccauauucugguucuugaa

SEQ ID NO: 517734 - RNA, 23 nt, Homo sapiens
ugccaucaccauacacaguggca

SEQ ID NO: 517735 - RNA, 16 nt, Homo sapiens
ugccauggcagacagu

SEQ ID NO: 517736 - RNA, 12 nt, Homo sapiens
ugccauggugau

SEQ ID NO: 517737 - RNA, 21 nt, Homo sapiens
ugcccaagucuuuccuaccuu

SEQ ID NO: 517738 - RNA, 12 nt, Homo sapiens
ugcccagaucaa

SEQ ID NO: 517739 - RNA, 15 nt, Homo sapiens
ugccccaaugugacc

SEQ ID NO: 517740 - RNA, 14 nt, Homo sapiens
ugccccccaugagg

SEQ ID NO: 517741 - RNA, 15 nt, Homo sapiens
ugcccuggcauuaag

SEQ ID NO: 517742 - RNA, 18 nt, Homo sapiens
ugcccuuccgcagugugg

SEQ ID NO: 517743 - RNA, 18 nt, Homo sapiens
ugcccuuccuccugccuu

SEQ ID NO: 517744 - RNA, 14 nt, Homo sapiens
ugccgauaucuuca

SEQ ID NO: 517745 - RNA, 19 nt, Homo sapiens
ugccgccuccuugugcaca

SEQ ID NO: 517746 - RNA, 18 nt, Homo sapiens
ugccgcuacaguuuuuau

SEQ ID NO: 517747 - RNA, 13 nt, Homo sapiens
ugccgcuaccucc

SEQ ID NO: 517748 - RNA, 19 nt, Homo sapiens
ugccguccugcaguccuua

SEQ ID NO: 517749 - RNA, 18 nt, Homo sapiens
ugccuaguuucuuacaca

SEQ ID NO: 517750 - RNA, 16 nt, Homo sapiens
ugccucaagccccaga

SEQ ID NO: 517751 - RNA, 20 nt, Homo sapiens
ugccucaagccccagagugg

SEQ ID NO: 517752 - RNA, 16 nt, Homo sapiens
ugccucccagguucca

SEQ ID NO: 517753 - RNA, 12 nt, Homo sapiens
ugccucugcucc

SEQ ID NO: 517754 - RNA, 20 nt, Homo sapiens
ugccucuucuuugugccuuu

SEQ ID NO: 517755 - RNA, 22 nt, Homo sapiens
ugccugggccguggcacagcug

SEQ ID NO: 517756 - RNA, 21 nt, Homo sapiens
ugccuuacaggguaacugugc

SEQ ID NO: 517757 - RNA, 22 nt, Homo sapiens
ugccuuuggauugacucugcau

SEQ ID NO: 517758 - RNA, 22 nt, Homo sapiens
ugcgauuuuguuaacccagcga

SEQ ID NO: 517759 - RNA, 14 nt, Homo sapiens
ugcgugcgcaucuu

SEQ ID NO: 517760 - RNA, 15 nt, Homo sapiens
ugcguucuucauuca

SEQ ID NO: 517761 - RNA, 12 nt, Homo sapiens
ugcuacugcacu

SEQ ID NO: 517762 - RNA, 20 nt, Homo sapiens
ugcuauucuagagcuuuuau

SEQ ID NO: 517763 - RNA, 21 nt, Homo sapiens
ugcucauuuuuucuucuccua

SEQ ID NO: 517764 - RNA, 15 nt, Homo sapiens
ugcucccuagccaga

SEQ ID NO: 517765 - RNA, 20 nt, Homo sapiens
ugcucccuagccagaggcuc

SEQ ID NO: 517766 - RNA, 14 nt, Homo sapiens
ugcuccgcaagagc

SEQ ID NO: 517767 - RNA, 14 nt, Homo sapiens
ugcucuuugcugca

SEQ ID NO: 517768 - RNA, 15 nt, Homo sapiens
ugcugcuggugcaca

SEQ ID NO: 517769 - RNA, 13 nt, Homo sapiens
ugcugcugugacc

SEQ ID NO: 517770 - RNA, 19 nt, Homo sapiens
ugcuggaagaauucuagca

SEQ ID NO: 517771 - RNA, 20 nt, Homo sapiens
ugcuggacgccgagaaggcc

SEQ ID NO: 517772 - RNA, 19 nt, Homo sapiens
ugcuggacuugccuaaaau

SEQ ID NO: 517773 - RNA, 14 nt, Homo sapiens
ugcuggcucucaga

SEQ ID NO: 517774 - RNA, 15 nt, Homo sapiens
ugcuggugcagcgua

SEQ ID NO: 517775 - RNA, 21 nt, Homo sapiens
ugcugugacaagccaauguga

SEQ ID NO: 517776 - RNA, 14 nt, Homo sapiens
ugcuguguguccca

SEQ ID NO: 517777 - RNA, 16 nt, Homo sapiens
ugcuuaaaauugugag

SEQ ID NO: 517778 - RNA, 17 nt, Homo sapiens
ugcuucuguugaucuca

SEQ ID NO: 517779 - RNA, 18 nt, Homo sapiens
ugcuugcaauguagucaa

SEQ ID NO: 517780 - RNA, 19 nt, Homo sapiens
ugcuuugcagccccacaga

SEQ ID NO: 517781 - RNA, 20 nt, Homo sapiens
uggaaaugguggugcuuuaa

SEQ ID NO: 517782 - RNA, 20 nt, Homo sapiens
uggaaauuguuguauaucac

SEQ ID NO: 517783 - RNA, 21 nt, Homo sapiens
uggaacagcauuacccuccuc

SEQ ID NO: 517784 - RNA, 16 nt, Homo sapiens
uggaagaggaacagca

SEQ ID NO: 517785 - RNA, 14 nt, Homo sapiens
uggaagucaucuca

SEQ ID NO: 517786 - RNA, 20 nt, Homo sapiens
uggaauauaucaguaccucu

SEQ ID NO: 517787 - RNA, 15 nt, Homo sapiens
uggaaucccacugua

SEQ ID NO: 517788 - RNA, 20 nt, Homo sapiens
uggacuacacaauacaguau

SEQ ID NO: 517789 - RNA, 21 nt, Homo sapiens
uggacuugauagcaaacacug

SEQ ID NO: 517790 - RNA, 14 nt, Homo sapiens
uggacuugccuaaa

SEQ ID NO: 517791 - RNA, 12 nt, Homo sapiens
uggagaccauua

SEQ ID NO: 517792 - RNA, 23 nt, Homo sapiens
uggagacccugcaaacagaacag

SEQ ID NO: 517793 - RNA, 17 nt, Homo sapiens
uggagacugacaaccuc

SEQ ID NO: 517794 - RNA, 17 nt, Homo sapiens
uggauaccauuauaugu

SEQ ID NO: 517795 - RNA, 14 nt, Homo sapiens
uggauguucacugc

SEQ ID NO: 517796 - RNA, 22 nt, Homo sapiens
uggauuuucaaaaagccguuga

SEQ ID NO: 517797 - RNA, 15 nt, Homo sapiens
uggauuuuuccuuaa

SEQ ID NO: 517798 - RNA, 18 nt, Homo sapiens
uggcaaaaaggagccuuu

SEQ ID NO: 517799 - RNA, 18 nt, Homo sapiens
uggcaagucuuccaugac

SEQ ID NO: 517800 - RNA, 23 nt, Homo sapiens
uggcaaguugcaucagaaagcuu

SEQ ID NO: 517801 - RNA, 18 nt, Homo sapiens
uggcacuguggagcucag

SEQ ID NO: 517802 - RNA, 21 nt, Homo sapiens
uggcagcaucuucacuucuaa

SEQ ID NO: 517803 - RNA, 14 nt, Homo sapiens
uggcaggugccugu

SEQ ID NO: 517804 - RNA, 17 nt, Homo sapiens
uggcagucccuuauaau

SEQ ID NO: 517805 - RNA, 20 nt, Homo sapiens
uggcccccacccucugccac

SEQ ID NO: 517806 - RNA, 12 nt, Homo sapiens
uggccugugaug

SEQ ID NO: 517807 - RNA, 18 nt, Homo sapiens
uggccugugauguuuuau

SEQ ID NO: 517808 - RNA, 22 nt, Homo sapiens
uggcgccccuuccuaggucaug

SEQ ID NO: 517809 - RNA, 19 nt, Homo sapiens
uggcgcuuagagaggacaa

SEQ ID NO: 517810 - RNA, 21 nt, Homo sapiens
uggcuagcaaucugccuguau

SEQ ID NO: 517811 - RNA, 24 nt, Homo sapiens
uggcuuauuucuaugacaaauuca

SEQ ID NO: 517812 - RNA, 22 nt, Homo sapiens
ugggaaaauaaauacauucgaa

SEQ ID NO: 517813 - RNA, 22 nt, Homo sapiens
ugggaacagggacgggggagcu

SEQ ID NO: 517814 - RNA, 18 nt, Homo sapiens
ugggacuucagcucagag

SEQ ID NO: 517815 - RNA, 16 nt, Homo sapiens
ugggccagugcaccuu

SEQ ID NO: 517816 - RNA, 15 nt, Homo sapiens
ugggccauguccaaa

SEQ ID NO: 517817 - RNA, 17 nt, Homo sapiens
ugggccccuggcacucu

SEQ ID NO: 517818 - RNA, 18 nt, Homo sapiens
ugggccgaggugacugca

SEQ ID NO: 517819 - RNA, 16 nt, Homo sapiens
ugggccgcacuggggc

SEQ ID NO: 517820 - RNA, 23 nt, Homo sapiens
ugggcuacagaaaccacagucuu

SEQ ID NO: 517821 - RNA, 23 nt, Homo sapiens
ugggcuauugcugcugccccuua

SEQ ID NO: 517822 - RNA, 19 nt, Homo sapiens
uggggaacugcguggugcu

SEQ ID NO: 517823 - RNA, 23 nt, Homo sapiens
uggggaacugcguggugcucuuu

SEQ ID NO: 517824 - RNA, 18 nt, Homo sapiens
uggggaguaccuguccaa

SEQ ID NO: 517825 - RNA, 24 nt, Homo sapiens
uggggcaggcugggccauguccaa

SEQ ID NO: 517826 - RNA, 11 nt, Homo sapiens
uggggccugug

SEQ ID NO: 517827 - RNA, 16 nt, Homo sapiens
uggguacaucaagucc

SEQ ID NO: 517828 - RNA, 23 nt, Homo sapiens
uggguacugaaagccuuagggaa

SEQ ID NO: 517829 - RNA, 14 nt, Homo sapiens
ugggugcucagaau

SEQ ID NO: 517830 - RNA, 21 nt, Homo sapiens
uggguguuucaguuugaaaau

SEQ ID NO: 517831 - RNA, 14 nt, Homo sapiens
ugguaaaaccuguu

SEQ ID NO: 517832 - RNA, 21 nt, Homo sapiens
uggucaagauuuugaaugcuu

SEQ ID NO: 517833 - RNA, 14 nt, Homo sapiens
uggucaucauggcc

SEQ ID NO: 517834 - RNA, 16 nt, Homo sapiens
uggugaccuuucacga

SEQ ID NO: 517835 - RNA, 21 nt, Homo sapiens
uggugacgcacggcauuagcu

SEQ ID NO: 517836 - RNA, 12 nt, Homo sapiens
uggugcagacag

SEQ ID NO: 517837 - RNA, 23 nt, Homo sapiens
uggugugaucucggcucacugca

SEQ ID NO: 517838 - RNA, 13 nt, Homo sapiens
ugguguguucaag

SEQ ID NO: 517839 - RNA, 18 nt, Homo sapiens
ugguucagacaagacaga

SEQ ID NO: 517840 - RNA, 13 nt, Homo sapiens
uguaaagugccuu

SEQ ID NO: 517841 - RNA, 22 nt, Homo sapiens
uguaagcccugcuuagcucauc

SEQ ID NO: 517842 - RNA, 12 nt, Homo sapiens
uguaauaccaga

SEQ ID NO: 517843 - RNA, 19 nt, Homo sapiens
uguaauauuucuucaaaua

SEQ ID NO: 517844 - RNA, 19 nt, Homo sapiens
uguaaucccagcacuuugg

SEQ ID NO: 517845 - RNA, 18 nt, Homo sapiens
uguaauccuaaauuuacc

SEQ ID NO: 517846 - RNA, 19 nt, Homo sapiens
uguaauccuagcuacuugg

SEQ ID NO: 517847 - RNA, 14 nt, Homo sapiens
uguacaauaaagca

SEQ ID NO: 517848 - RNA, 20 nt, Homo sapiens
uguacaauaaagcaaugugg

SEQ ID NO: 517849 - RNA, 14 nt, Homo sapiens
uguacaucuuucau

SEQ ID NO: 517850 - RNA, 16 nt, Homo sapiens
uguaccaagugaaauu

SEQ ID NO: 517851 - RNA, 17 nt, Homo sapiens
uguacccccagguggaa

SEQ ID NO: 517852 - RNA, 22 nt, Homo sapiens
uguaccugcuggaagaauucua

SEQ ID NO: 517853 - RNA, 21 nt, Homo sapiens
uguacuacagcuauauuugau

SEQ ID NO: 517854 - RNA, 22 nt, Homo sapiens
uguagacuguggcuagugacaa

SEQ ID NO: 517855 - RNA, 12 nt, Homo sapiens
uguagauauugu

SEQ ID NO: 517856 - RNA, 13 nt, Homo sapiens
uguagaugugcau

SEQ ID NO: 517857 - RNA, 13 nt, Homo sapiens
uguagccagcaga

SEQ ID NO: 517858 - RNA, 12 nt, Homo sapiens
uguauaaaaugg

SEQ ID NO: 517859 - RNA, 22 nt, Homo sapiens
uguauauuuguuuuaugcuacu

SEQ ID NO: 517860 - RNA, 16 nt, Homo sapiens
uguaucaguguccuuu

SEQ ID NO: 517861 - RNA, 20 nt, Homo sapiens
uguaucuuuuauccugggag

SEQ ID NO: 517862 - RNA, 18 nt, Homo sapiens
uguaugaaaaauugggga

SEQ ID NO: 517863 - RNA, 22 nt, Homo sapiens
uguauggaaucccacuguauga

SEQ ID NO: 517864 - RNA, 20 nt, Homo sapiens
uguauguaauacauauagca

SEQ ID NO: 517865 - RNA, 17 nt, Homo sapiens
uguauuuccagugcaau

SEQ ID NO: 517866 - RNA, 15 nt, Homo sapiens
ugucaaggcaguugc

SEQ ID NO: 517867 - RNA, 20 nt, Homo sapiens
ugucaaugugaacguccaca

SEQ ID NO: 517868 - RNA, 13 nt, Homo sapiens
ugucaccauugug

SEQ ID NO: 517869 - RNA, 14 nt, Homo sapiens
ugucaccucuguga

SEQ ID NO: 517870 - RNA, 20 nt, Homo sapiens
ugucaccucugugaccccuc

SEQ ID NO: 517871 - RNA, 18 nt, Homo sapiens
ugucauccucaugcugcu

SEQ ID NO: 517872 - RNA, 18 nt, Homo sapiens
ugucauugucuacuccua

SEQ ID NO: 517873 - RNA, 17 nt, Homo sapiens
uguccaaagaggcugcc

SEQ ID NO: 517874 - RNA, 13 nt, Homo sapiens
uguccagcaccuu

SEQ ID NO: 517875 - RNA, 17 nt, Homo sapiens
uguccugagcaccacac

SEQ ID NO: 517876 - RNA, 16 nt, Homo sapiens
ugucguauuuggcaca

SEQ ID NO: 517877 - RNA, 15 nt, Homo sapiens
ugucucagaagugaa

SEQ ID NO: 517878 - RNA, 19 nt, Homo sapiens
ugucuuaauuuucuuucac

SEQ ID NO: 517879 - RNA, 22 nt, Homo sapiens
ugucuuccacagccgccugaaa

SEQ ID NO: 517880 - RNA, 17 nt, Homo sapiens
ugugaacaugauaguua

SEQ ID NO: 517881 - RNA, 10 nt, Homo sapiens
ugugcacauc

SEQ ID NO: 517882 - RNA, 19 nt, Homo sapiens
ugugcauacgccucuuguu

SEQ ID NO: 517883 - RNA, 22 nt, Homo sapiens
ugugccacucaccgaagccacu

SEQ ID NO: 517884 - RNA, 23 nt, Homo sapiens
ugugccuauagucccacuacuug

SEQ ID NO: 517885 - RNA, 23 nt, Homo sapiens
ugugccugggguguuaguggcac

SEQ ID NO: 517886 - RNA, 16 nt, Homo sapiens
ugugcggaucucugga

SEQ ID NO: 517887 - RNA, 21 nt, Homo sapiens
uguggaagcauguagacugug

SEQ ID NO: 517888 - RNA, 21 nt, Homo sapiens
uguggagugacucaaaucagu

SEQ ID NO: 517889 - RNA, 19 nt, Homo sapiens
uguggcagaucuacauguc

SEQ ID NO: 517890 - RNA, 14 nt, Homo sapiens
uguggucaucaugg

SEQ ID NO: 517891 - RNA, 12 nt, Homo sapiens
uguggucucagg

SEQ ID NO: 517892 - RNA, 15 nt, Homo sapiens
uguguaaauuucuca

SEQ ID NO: 517893 - RNA, 23 nt, Homo sapiens
uguguauccaugcaccuaccuua

SEQ ID NO: 517894 - RNA, 24 nt, Homo sapiens
uguguauuuccagugcaauuguag

SEQ ID NO: 517895 - RNA, 17 nt, Homo sapiens
ugugucuuacauugcca

SEQ ID NO: 517896 - RNA, 18 nt, Homo sapiens
uguguggcaaacuugcag

SEQ ID NO: 517897 - RNA, 22 nt, Homo sapiens
uguguggcaaacuugcaguuua

SEQ ID NO: 517898 - RNA, 15 nt, Homo sapiens
uguguguguguacaa

SEQ ID NO: 517899 - RNA, 15 nt, Homo sapiens
uguguucguugcaca

SEQ ID NO: 517900 - RNA, 18 nt, Homo sapiens
uguuagauauuuuucaua

SEQ ID NO: 517901 - RNA, 17 nt, Homo sapiens
uguuagaucaaccucca

SEQ ID NO: 517902 - RNA, 16 nt, Homo sapiens
uguucccagagcacuu

SEQ ID NO: 517903 - RNA, 20 nt, Homo sapiens
uguucugggccaggucccag

SEQ ID NO: 517904 - RNA, 17 nt, Homo sapiens
uguugccuucaucuuca

SEQ ID NO: 517905 - RNA, 15 nt, Homo sapiens
uguugccuugcauuu

SEQ ID NO: 517906 - RNA, 21 nt, Homo sapiens
uguuguacuuaaaugguaaua

SEQ ID NO: 517907 - RNA, 13 nt, Homo sapiens
uguuguagacuua

SEQ ID NO: 517908 - RNA, 13 nt, Homo sapiens
uguuguaugggga

SEQ ID NO: 517909 - RNA, 21 nt, Homo sapiens
uguuguguuuuuaacauguca

SEQ ID NO: 517910 - RNA, 13 nt, Homo sapiens
uguuguugccaaa

SEQ ID NO: 517911 - RNA, 14 nt, Homo sapiens
uguuuaacugugaa

SEQ ID NO: 517912 - RNA, 14 nt, Homo sapiens
uguuuacagugaug

SEQ ID NO: 517913 - RNA, 14 nt, Homo sapiens
uguuuaugagccag

SEQ ID NO: 517914 - RNA, 21 nt, Homo sapiens
uguuuccauuugugguccuga

SEQ ID NO: 517915 - RNA, 22 nt, Homo sapiens
uguuucucugccgcuaccuccc

SEQ ID NO: 517916 - RNA, 22 nt, Homo sapiens
uguuugcugauuauuuaugacc

SEQ ID NO: 517917 - RNA, 16 nt, Homo sapiens
uguuuggacagcugau

SEQ ID NO: 517918 - RNA, 20 nt, Homo sapiens
uguuuuucuuuuuccacaag

SEQ ID NO: 517919 - RNA, 18 nt, Homo sapiens
uuaaaaacuaccacaugu

SEQ ID NO: 517920 - RNA, 21 nt, Homo sapiens
uuaaaaaugggaguacugaug

SEQ ID NO: 517921 - RNA, 19 nt, Homo sapiens
uuaaaacuggaccuguaua

SEQ ID NO: 517922 - RNA, 17 nt, Homo sapiens
uuaaaacuugaaguagg

SEQ ID NO: 517923 - RNA, 18 nt, Homo sapiens
uuaaaagaacucauucau

SEQ ID NO: 517924 - RNA, 17 nt, Homo sapiens
uuaaaauauaugaggcu

SEQ ID NO: 517925 - RNA, 13 nt, Homo sapiens
uuaaaaugccaau

SEQ ID NO: 517926 - RNA, 20 nt, Homo sapiens
uuaaacuuucaauugucacu

SEQ ID NO: 517927 - RNA, 17 nt, Homo sapiens
uuaaacuuuuuuaacca

SEQ ID NO: 517928 - RNA, 12 nt, Homo sapiens
uuaaagacacuu

SEQ ID NO: 517929 - RNA, 23 nt, Homo sapiens
uuaaaggaaaaucacaucuccag

SEQ ID NO: 517930 - RNA, 19 nt, Homo sapiens
uuaaauaaugcuucagaua

SEQ ID NO: 517931 - RNA, 21 nt, Homo sapiens
uuaaaucugaauaaauaauuc

SEQ ID NO: 517932 - RNA, 21 nt, Homo sapiens
uuaagaagcaguuguaccaag

SEQ ID NO: 517933 - RNA, 17 nt, Homo sapiens
uuaagauacaaauuaau

SEQ ID NO: 517934 - RNA, 15 nt, Homo sapiens
uuaauaaagcuuuau

SEQ ID NO: 517935 - RNA, 17 nt, Homo sapiens
uuaauggggaggacaaa

SEQ ID NO: 517936 - RNA, 16 nt, Homo sapiens
uuaauguuaacaagac

SEQ ID NO: 517937 - RNA, 16 nt, Homo sapiens
uuaauuaccuggugag

SEQ ID NO: 517938 - RNA, 18 nt, Homo sapiens
uuaauuaccuggugagua

SEQ ID NO: 517939 - RNA, 18 nt, Homo sapiens
uuacacacugucuguaua

SEQ ID NO: 517940 - RNA, 17 nt, Homo sapiens
uuacagcuccuuugaaa

SEQ ID NO: 517941 - RNA, 16 nt, Homo sapiens
uuacaguguuuggaca

SEQ ID NO: 517942 - RNA, 17 nt, Homo sapiens
uuacauugccaagucag

SEQ ID NO: 517943 - RNA, 19 nt, Homo sapiens
uuaccacuuuaaacacccc

SEQ ID NO: 517944 - RNA, 22 nt, Homo sapiens
uuaccagaugcugacuggcacu

SEQ ID NO: 517945 - RNA, 12 nt, Homo sapiens
uuaccaucugaa

SEQ ID NO: 517946 - RNA, 20 nt, Homo sapiens
uuaccuugaaaugcuguuag

SEQ ID NO: 517947 - RNA, 21 nt, Homo sapiens
uuacuggaauucuucugcaac

SEQ ID NO: 517948 - RNA, 22 nt, Homo sapiens
uuagauauuuuucauaaacaag

SEQ ID NO: 517949 - RNA, 16 nt, Homo sapiens
uuagcaauaacauaca

SEQ ID NO: 517950 - RNA, 17 nt, Homo sapiens
uuagcaauaacauacau

SEQ ID NO: 517951 - RNA, 12 nt, Homo sapiens
uuagccauucau

SEQ ID NO: 517952 - RNA, 20 nt, Homo sapiens
uuagcuccauaaaguacaaa

SEQ ID NO: 517953 - RNA, 13 nt, Homo sapiens
uuaggaucucagg

SEQ ID NO: 517954 - RNA, 18 nt, Homo sapiens
uuaguaaauuucugugau

SEQ ID NO: 517955 - RNA, 13 nt, Homo sapiens
uuaguguugugga

SEQ ID NO: 517956 - RNA, 16 nt, Homo sapiens
uuaguuccacugagac

SEQ ID NO: 517957 - RNA, 18 nt, Homo sapiens
uuauaaaauccugugcaa

SEQ ID NO: 517958 - RNA, 14 nt, Homo sapiens
uuauauaauucaag

SEQ ID NO: 517959 - RNA, 15 nt, Homo sapiens
uuauaucauauguau

SEQ ID NO: 517960 - RNA, 13 nt, Homo sapiens
uuauaugugacac

SEQ ID NO: 517961 - RNA, 18 nt, Homo sapiens
uuauccauccucugagau

SEQ ID NO: 517962 - RNA, 22 nt, Homo sapiens
uuaugaaaugaccucuguccuc

SEQ ID NO: 517963 - RNA, 13 nt, Homo sapiens
uuauuaucuauua

SEQ ID NO: 517964 - RNA, 22 nt, Homo sapiens
uuauuccggaaacuaguguaca

SEQ ID NO: 517965 - RNA, 19 nt, Homo sapiens
uuauuucugaucuauacaa

SEQ ID NO: 517966 - RNA, 16 nt, Homo sapiens
uuauuugaaggccagc

SEQ ID NO: 517967 - RNA, 13 nt, Homo sapiens
uuauuuuugcaca

SEQ ID NO: 517968 - RNA, 20 nt, Homo sapiens
uucaaaguuuuguuguacuu

SEQ ID NO: 517969 - RNA, 19 nt, Homo sapiens
uucaacaguuuuugcuaau

SEQ ID NO: 517970 - RNA, 17 nt, Homo sapiens
uucaacaugcuccaaau

SEQ ID NO: 517971 - RNA, 18 nt, Homo sapiens
uucaauaugguuacguug

SEQ ID NO: 517972 - RNA, 20 nt, Homo sapiens
uucaaugagcaaaucuccau

SEQ ID NO: 517973 - RNA, 21 nt, Homo sapiens
uucaaugugcauaaugauaaa

SEQ ID NO: 517974 - RNA, 14 nt, Homo sapiens
uucagcaccaguua

SEQ ID NO: 517975 - RNA, 13 nt, Homo sapiens
uucagccaaguga

SEQ ID NO: 517976 - RNA, 21 nt, Homo sapiens
uucaggcuaagaagagauuuc

SEQ ID NO: 517977 - RNA, 21 nt, Homo sapiens
uucagugcaaauuguaucuua

SEQ ID NO: 517978 - RNA, 18 nt, Homo sapiens
uucauauuuuaaacagag

SEQ ID NO: 517979 - RNA, 18 nt, Homo sapiens
uucaucuucacugcaauu

SEQ ID NO: 517980 - RNA, 17 nt, Homo sapiens
uucaugagcuugaacaa

SEQ ID NO: 517981 - RNA, 22 nt, Homo sapiens
uucaugcagaguugaaguuuac

SEQ ID NO: 517982 - RNA, 14 nt, Homo sapiens
uucaugcuugacau

SEQ ID NO: 517983 - RNA, 19 nt, Homo sapiens
uucaugcuugacauaccua

SEQ ID NO: 517984 - RNA, 20 nt, Homo sapiens
uucauucaaccccuucuggg

SEQ ID NO: 517985 - RNA, 21 nt, Homo sapiens
uucauuccuaacacagcaugu

SEQ ID NO: 517986 - RNA, 23 nt, Homo sapiens
uucauuccuaacacagcaugugu

SEQ ID NO: 517987 - RNA, 16 nt, Homo sapiens
uucauugagaaacugg

SEQ ID NO: 517988 - RNA, 21 nt, Homo sapiens
uuccaaauugcccuaugcugu

SEQ ID NO: 517989 - RNA, 13 nt, Homo sapiens
uuccaacacucca

SEQ ID NO: 517990 - RNA, 19 nt, Homo sapiens
uuccacugccuccugugac

SEQ ID NO: 517991 - RNA, 15 nt, Homo sapiens
uuccagaucuuucag

SEQ ID NO: 517992 - RNA, 22 nt, Homo sapiens
uuccauguaucuuuugaacugg

SEQ ID NO: 517993 - RNA, 14 nt, Homo sapiens
uuccaugugccuuu

SEQ ID NO: 517994 - RNA, 18 nt, Homo sapiens
uucccaagcgucaucugu

SEQ ID NO: 517995 - RNA, 23 nt, Homo sapiens
uucccaagcgucaucuguguaaa

SEQ ID NO: 517996 - RNA, 21 nt, Homo sapiens
uucccagagcacuuugcaacu

SEQ ID NO: 517997 - RNA, 21 nt, Homo sapiens
uuccccaaagacgaccagcau

SEQ ID NO: 517998 - RNA, 20 nt, Homo sapiens
uuccccaacagggcaacugu

SEQ ID NO: 517999 - RNA, 17 nt, Homo sapiens
uuccccacacaugccua

SEQ ID NO: 518000 - RNA, 19 nt, Homo sapiens
uuccccagguuccauacca

SEQ ID NO: 518001 - RNA, 22 nt, Homo sapiens
uuccccgagugacucuggauuu

SEQ ID NO: 518002 - RNA, 19 nt, Homo sapiens
uuccccucaacaugcugcc

SEQ ID NO: 518003 - RNA, 23 nt, Homo sapiens
uucccuaggaaacucacacuccc

SEQ ID NO: 518004 - RNA, 15 nt, Homo sapiens
uucccucuugcucag

SEQ ID NO: 518005 - RNA, 17 nt, Homo sapiens
uucccugacuugcuuua

SEQ ID NO: 518006 - RNA, 19 nt, Homo sapiens
uuccguuuuagaaaaggaa

SEQ ID NO: 518007 - RNA, 11 nt, Homo sapiens
uuccucugcau

SEQ ID NO: 518008 - RNA, 18 nt, Homo sapiens
uuccugccccagacagac

SEQ ID NO: 518009 - RNA, 13 nt, Homo sapiens
uuccuguugucaa

SEQ ID NO: 518010 - RNA, 16 nt, Homo sapiens
uuccuguuuccagggu

SEQ ID NO: 518011 - RNA, 19 nt, Homo sapiens
uuccuuccagauccugggu

SEQ ID NO: 518012 - RNA, 20 nt, Homo sapiens
uuccuucccagaauguuacu

SEQ ID NO: 518013 - RNA, 22 nt, Homo sapiens
uuccuucuguacuaaaguauug

SEQ ID NO: 518014 - RNA, 15 nt, Homo sapiens
uuccuuucauaccuu

SEQ ID NO: 518015 - RNA, 19 nt, Homo sapiens
uucgcuuaguaacuaguga

SEQ ID NO: 518016 - RNA, 19 nt, Homo sapiens
uucggcagcuacucagagg

SEQ ID NO: 518017 - RNA, 14 nt, Homo sapiens
uucguguacugcaa

SEQ ID NO: 518018 - RNA, 15 nt, Homo sapiens
uucguguacugcaaa

SEQ ID NO: 518019 - RNA, 22 nt, Homo sapiens
uucuaacagugaaguuuuacug

SEQ ID NO: 518020 - RNA, 17 nt, Homo sapiens
uucuaagucauucauaa

SEQ ID NO: 518021 - RNA, 13 nt, Homo sapiens
uucuagcaugcua

SEQ ID NO: 518022 - RNA, 14 nt, Homo sapiens
uucuaggcuaccag

SEQ ID NO: 518023 - RNA, 22 nt, Homo sapiens
uucucaagcugagauugagcag

SEQ ID NO: 518024 - RNA, 22 nt, Homo sapiens
uucucacacacaacuguccaua

SEQ ID NO: 518025 - RNA, 18 nt, Homo sapiens
uucucaguccuaauuuga

SEQ ID NO: 518026 - RNA, 18 nt, Homo sapiens
uucucauaccuuccccac

SEQ ID NO: 518027 - RNA, 23 nt, Homo sapiens
uucucaugacuccuacuuuucau

SEQ ID NO: 518028 - RNA, 13 nt, Homo sapiens
uucuccugccuca

SEQ ID NO: 518029 - RNA, 23 nt, Homo sapiens
uucugcuaguggugagcauguaa

SEQ ID NO: 518030 - RNA, 16 nt, Homo sapiens
uucugucccacuacau

SEQ ID NO: 518031 - RNA, 16 nt, Homo sapiens
uucuguugaucucagu

SEQ ID NO: 518032 - RNA, 19 nt, Homo sapiens
uucuguuggaugacuuuga

SEQ ID NO: 518033 - RNA, 11 nt, Homo sapiens
uucuguuuacu

SEQ ID NO: 518034 - RNA, 17 nt, Homo sapiens
uucuuacaugcauuuga

SEQ ID NO: 518035 - RNA, 11 nt, Homo sapiens
uucuucacucu

SEQ ID NO: 518036 - RNA, 15 nt, Homo sapiens
uucuucacucuuuga

SEQ ID NO: 518037 - RNA, 15 nt, Homo sapiens
uucuucuguccugag

SEQ ID NO: 518038 - RNA, 15 nt, Homo sapiens
uucuuuccuuguuca

SEQ ID NO: 518039 - RNA, 12 nt, Homo sapiens
uucuuugccucu

SEQ ID NO: 518040 - RNA, 14 nt, Homo sapiens
uucuuugugccuuu

SEQ ID NO: 518041 - RNA, 15 nt, Homo sapiens
uugaaaacugugcaa

SEQ ID NO: 518042 - RNA, 21 nt, Homo sapiens
uugaaacuuugggaaaacaug

SEQ ID NO: 518043 - RNA, 20 nt, Homo sapiens
uugcucuaggaagacauuuu

SEQ ID NO: 518044 - RNA, 19 nt, Homo sapiens
uugcucucgacaguaucca

SEQ ID NO: 518045 - RNA, 19 nt, Homo sapiens
uugcuguuccuuacuuuac

SEQ ID NO: 518046 - RNA, 13 nt, Homo sapiens
uugcuugcaaugu

SEQ ID NO: 518047 - RNA, 17 nt, Homo sapiens
uuggaaggcugaggcag

SEQ ID NO: 518048 - RNA, 12 nt, Homo sapiens
uuggaauaucuc

SEQ ID NO: 518049 - RNA, 20 nt, Homo sapiens
uuggacaacugcauggagcu

SEQ ID NO: 518050 - RNA, 19 nt, Homo sapiens
uuggacagucugagcugua

SEQ ID NO: 518051 - RNA, 19 nt, Homo sapiens
uuggacuguaagggauuga

SEQ ID NO: 518052 - RNA, 21 nt, Homo sapiens
uuggagccaauguguggcuca

SEQ ID NO: 518053 - RNA, 18 nt, Homo sapiens
uuggauucuaaauacaug

SEQ ID NO: 518054 - RNA, 15 nt, Homo sapiens
uuggcaguucugaua

SEQ ID NO: 518055 - RNA, 17 nt, Homo sapiens
uuggcaugguuguugca

SEQ ID NO: 518056 - RNA, 17 nt, Homo sapiens
uugggaaaacauuugcu

SEQ ID NO: 518057 - RNA, 22 nt, Homo sapiens
uugggaggcugaggcaggagaa

SEQ ID NO: 518058 - RNA, 23 nt, Homo sapiens
uugggauauccuuucacucugca

SEQ ID NO: 518059 - RNA, 10 nt, Homo sapiens
uuggggacuc

SEQ ID NO: 518060 - RNA, 20 nt, Homo sapiens
uugguauauacuuugccacu

SEQ ID NO: 518061 - RNA, 18 nt, Homo sapiens
uugguuuuccuguggcau

SEQ ID NO: 518062 - RNA, 12 nt, Homo sapiens
uugguuuuggac

SEQ ID NO: 518063 - RNA, 14 nt, Homo sapiens
uuguaaaagcauuu

SEQ ID NO: 518064 - RNA, 22 nt, Homo sapiens
uuguaauacuuucuaugugaca

SEQ ID NO: 518065 - RNA, 21 nt, Homo sapiens
uuguagggcuuuagcuuucuu

SEQ ID NO: 518066 - RNA, 18 nt, Homo sapiens
uugucagggucuccuucc

SEQ ID NO: 518067 - RNA, 18 nt, Homo sapiens
uuguccugagauggaaaa

SEQ ID NO: 518068 - RNA, 20 nt, Homo sapiens
uugugaauugcuugguugua

SEQ ID NO: 518069 - RNA, 16 nt, Homo sapiens
uuguguauccaugcac

SEQ ID NO: 518070 - RNA, 13 nt, Homo sapiens
uuguuauaccauu

SEQ ID NO: 518071 - RNA, 20 nt, Homo sapiens
uuguugccuucaucuucacu

SEQ ID NO: 518072 - RNA, 17 nt, Homo sapiens
uuguuggaaaguaacug

SEQ ID NO: 518073 - RNA, 13 nt, Homo sapiens
uuguuguugccaa

SEQ ID NO: 518074 - RNA, 14 nt, Homo sapiens
uuguuuuuuacuca

SEQ ID NO: 518075 - RNA, 20 nt, Homo sapiens
uuuaaaggaaaaucacaucu

SEQ ID NO: 518076 - RNA, 17 nt, Homo sapiens
uuuaaauguauuuuaca

SEQ ID NO: 518077 - RNA, 19 nt, Homo sapiens
uuuaaucucuaacagugga

SEQ ID NO: 518078 - RNA, 15 nt, Homo sapiens
uuuaaucugggagca

SEQ ID NO: 518079 - RNA, 11 nt, Homo sapiens
uuuacucugcu

SEQ ID NO: 518080 - RNA, 23 nt, Homo sapiens
uuuagaagaaaaguuauuggcau

SEQ ID NO: 518081 - RNA, 20 nt, Homo sapiens
uuuagccaguuguugccaac

SEQ ID NO: 518082 - RNA, 22 nt, Homo sapiens
uuuaggaaaaucacuuugucua

SEQ ID NO: 518083 - RNA, 12 nt, Homo sapiens
uuuagggagaac

SEQ ID NO: 518084 - RNA, 14 nt, Homo sapiens
uuuauaaacagaaa

SEQ ID NO: 518085 - RNA, 17 nt, Homo sapiens
uuuauaagcauugccau

SEQ ID NO: 518086 - RNA, 17 nt, Homo sapiens
uuuauccaaaaugugua

SEQ ID NO: 518087 - RNA, 13 nt, Homo sapiens
uuuaugaaaugac

SEQ ID NO: 518088 - RNA, 13 nt, Homo sapiens
uuuaugagacagc

SEQ ID NO: 518089 - RNA, 22 nt, Homo sapiens
uuuauggaaaaugucaggccuu

SEQ ID NO: 518090 - RNA, 14 nt, Homo sapiens
uuuauuugagguca

SEQ ID NO: 518091 - RNA, 22 nt, Homo sapiens
uuucaaaagguauuauacaugu

SEQ ID NO: 518092 - RNA, 12 nt, Homo sapiens
uuucagcugcaa

SEQ ID NO: 518093 - RNA, 22 nt, Homo sapiens
uuuccaguggaucauaagacaa

SEQ ID NO: 518094 - RNA, 14 nt, Homo sapiens
uuucccauguauuu

SEQ ID NO: 518095 - RNA, 18 nt, Homo sapiens
uuuccccacacaugccua

SEQ ID NO: 518096 - RNA, 17 nt, Homo sapiens
uuucccgcccagccuca

SEQ ID NO: 518097 - RNA, 19 nt, Homo sapiens
uuuccgagccuccagucca

SEQ ID NO: 518098 - RNA, 20 nt, Homo sapiens
uuuccgagccuccaguccaa

SEQ ID NO: 518099 - RNA, 20 nt, Homo sapiens
uuuccuggucagcauguacu

SEQ ID NO: 518100 - RNA, 20 nt, Homo sapiens
uuucuaagcaguuaugguga

SEQ ID NO: 518101 - RNA, 18 nt, Homo sapiens
uuucuagaguagcuccca

SEQ ID NO: 518102 - RNA, 17 nt, Homo sapiens
uuucugagaugcucacu

SEQ ID NO: 518103 - RNA, 15 nt, Homo sapiens
uuucuggaauggaaa

SEQ ID NO: 518104 - RNA, 19 nt, Homo sapiens
uuucuguucuguuggauga

SEQ ID NO: 518105 - RNA, 16 nt, Homo sapiens
uuucuuagugugccaa

SEQ ID NO: 518106 - RNA, 13 nt, Homo sapiens
uuucuugcuuuca

SEQ ID NO: 518107 - RNA, 20 nt, Homo sapiens
uuugaagcagucuugcucug

SEQ ID NO: 518108 - RNA, 21 nt, Homo sapiens
uuugaggcaaauuaacuguau

SEQ ID NO: 518109 - RNA, 14 nt, Homo sapiens
uuugcacacugcac

SEQ ID NO: 518110 - RNA, 14 nt, Homo sapiens
uuugcuuucaggga

SEQ ID NO: 518111 - RNA, 17 nt, Homo sapiens
uuuggauugacucugca

SEQ ID NO: 518112 - RNA, 18 nt, Homo sapiens
uuuggcuagguaucauuc

SEQ ID NO: 518113 - RNA, 17 nt, Homo sapiens
uuuggggacucauuuca

SEQ ID NO: 518114 - RNA, 19 nt, Homo sapiens
uuuguaauaauaaagaaua

SEQ ID NO: 518115 - RNA, 16 nt, Homo sapiens
uuugucagagugcaca

SEQ ID NO: 518116 - RNA, 22 nt, Homo sapiens
uuuguggccuuggcugacauga

SEQ ID NO: 518117 - RNA, 14 nt, Homo sapiens
uuugugguaguccu

SEQ ID NO: 518118 - RNA, 23 nt, Homo sapiens
uuuuaaaagguagagucuuacaa

SEQ ID NO: 518119 - RNA, 14 nt, Homo sapiens
uuuuaacaugucaa

SEQ ID NO: 518120 - RNA, 22 nt, Homo sapiens
uuuuaagaagacauacugcuug

SEQ ID NO: 518121 - RNA, 18 nt, Homo sapiens
uuuuauuaauuuauaugu

SEQ ID NO: 518122 - RNA, 21 nt, Homo sapiens
uuuucuccagaccccaugccu

SEQ ID NO: 518123 - RNA, 14 nt, Homo sapiens
uuuugauaauggcu

SEQ ID NO: 518124 - RNA, 9 nt, Homo sapiens
uuuuguaca

SEQ ID NO: 518125 - RNA, 17 nt, Homo sapiens
uuuugugcaaagccaaa

SEQ ID NO: 518126 - RNA, 22 nt, Homo sapiens
uuuuuacuaaacucagaggcag

SEQ ID NO: 518127 - RNA, 22 nt, Homo sapiens
uuuuucuccagaccccaugccu

SEQ ID NO: 518128 - RNA, 20 nt, Homo sapiens
guuaauaaaccuuugcaaac

SEQ ID NO: 518129 - RNA, 21 nt, Homo sapiens
guuaauugggcaggugaaaag

SEQ ID NO: 518130 - RNA, 14 nt, Homo sapiens
guuacaaguuuaua

SEQ ID NO: 518131 - RNA, 16 nt, Homo sapiens
guuaccucugcaugga

SEQ ID NO: 518132 - RNA, 16 nt, Homo sapiens
guuacugggcccugag

SEQ ID NO: 518133 - RNA, 18 nt, Homo sapiens
guuaguaaagaaaaguuu

SEQ ID NO: 518134 - RNA, 17 nt, Homo sapiens
guuccaaugucaaugug

SEQ ID NO: 518135 - RNA, 14 nt, Homo sapiens
guucccaggugaua

SEQ ID NO: 518136 - RNA, 15 nt, Homo sapiens
guucccccuguuuca

SEQ ID NO: 518137 - RNA, 16 nt, Homo sapiens
guucccucuugcucag

SEQ ID NO: 518138 - RNA, 15 nt, Homo sapiens
guuccugcgcugcaa

SEQ ID NO: 518139 - RNA, 20 nt, Homo sapiens
guuccuuuuaacggaugguu

SEQ ID NO: 518140 - RNA, 20 nt, Homo sapiens
guucguucuguacuguuacu

SEQ ID NO: 518141 - RNA, 21 nt, Homo sapiens
guucguucuguacuguuacug

SEQ ID NO: 518142 - RNA, 16 nt, Homo sapiens
guucguugcacagcug

SEQ ID NO: 518143 - RNA, 18 nt, Homo sapiens
guucuaauccaagggcca

SEQ ID NO: 518144 - RNA, 15 nt, Homo sapiens
guucuuggugaugcu

SEQ ID NO: 518145 - RNA, 22 nt, Homo sapiens
guucuuggugaugcuggcagcc

SEQ ID NO: 518146 - RNA, 18 nt, Homo sapiens
guucuuuaaaggcaucua

SEQ ID NO: 518147 - RNA, 18 nt, Homo sapiens
guugacaaggcucugcua

SEQ ID NO: 518148 - RNA, 21 nt, Homo sapiens
guugacuuuccucccauuuua

SEQ ID NO: 518149 - RNA, 15 nt, Homo sapiens
guugauacuugaaua

SEQ ID NO: 518150 - RNA, 18 nt, Homo sapiens
guugcagccagggccagu

SEQ ID NO: 518151 - RNA, 16 nt, Homo sapiens
guuggaugaugagcag

SEQ ID NO: 518152 - RNA, 14 nt, Homo sapiens
guuggggugacagu

SEQ ID NO: 518153 - RNA, 12 nt, Homo sapiens
guugguguuccu

SEQ ID NO: 518154 - RNA, 18 nt, Homo sapiens
guuguaggguuacagaga

SEQ ID NO: 518155 - RNA, 21 nt, Homo sapiens
guuguauucauuguggucaua

SEQ ID NO: 518156 - RNA, 14 nt, Homo sapiens
guuguguguguucu

SEQ ID NO: 518157 - RNA, 21 nt, Homo sapiens
guuguucaaauguuccuuuua

SEQ ID NO: 518158 - RNA, 16 nt, Homo sapiens
guuuacaugagacuuu

SEQ ID NO: 518159 - RNA, 12 nt, Homo sapiens
guuuaccaucug

SEQ ID NO: 518160 - RNA, 14 nt, Homo sapiens
uacuuaaugcauau

SEQ ID NO: 518161 - RNA, 16 nt, Homo sapiens
uacuugaaaaaguaaa

SEQ ID NO: 518162 - RNA, 14 nt, Homo sapiens
uacuugccaagaaa

SEQ ID NO: 518163 - RNA, 16 nt, Homo sapiens
uacuuuaacauuuugg

SEQ ID NO: 518164 - RNA, 20 nt, Homo sapiens
uacuuuauuucugaucuaua

SEQ ID NO: 518165 - RNA, 17 nt, Homo sapiens
uacuuugaagugcagcu

SEQ ID NO: 518166 - RNA, 15 nt, Homo sapiens
uacuuugugcauucu

SEQ ID NO: 518167 - RNA, 14 nt, Homo sapiens
uagaaaaagauucu

SEQ ID NO: 518168 - RNA, 19 nt, Homo sapiens
uagaagaaccaaauaccuc

SEQ ID NO: 518169 - RNA, 19 nt, Homo sapiens
uagaagucuguccaaauuu

SEQ ID NO: 518170 - RNA, 20 nt, Homo sapiens
uagaauguugaaaaguaauu

SEQ ID NO: 518171 - RNA, 16 nt, Homo sapiens
uagacagaaacauguc

SEQ ID NO: 518172 - RNA, 17 nt, Homo sapiens
uagagcaaccuauauaa

SEQ ID NO: 518173 - RNA, 18 nt, Homo sapiens
uagaguguagacuguggc

SEQ ID NO: 518174 - RNA, 13 nt, Homo sapiens
uagcaaacacugg

SEQ ID NO: 518175 - RNA, 16 nt, Homo sapiens
uagcaagcuuuugcuc

SEQ ID NO: 518176 - RNA, 18 nt, Homo sapiens
uagcagaaugugcuucuc

SEQ ID NO: 518177 - RNA, 13 nt, Homo sapiens
uagcagucacuga

SEQ ID NO: 518178 - RNA, 19 nt, Homo sapiens
uagcaucagaccugcauug

SEQ ID NO: 518179 - RNA, 14 nt, Homo sapiens
uagcuaauaacaug

SEQ ID NO: 518180 - RNA, 13 nt, Homo sapiens
uagcucugcugcu

SEQ ID NO: 518181 - RNA, 21 nt, Homo sapiens
uaggaacucaguccuguacuc

SEQ ID NO: 518182 - RNA, 16 nt, Homo sapiens
uaggaagcacugaaaa

SEQ ID NO: 518183 - RNA, 13 nt, Homo sapiens
uaggagauuuauu

SEQ ID NO: 518184 - RNA, 15 nt, Homo sapiens
uaggcagugcuaaag

SEQ ID NO: 518185 - RNA, 17 nt, Homo sapiens
uaggcauguagcuacag

SEQ ID NO: 518186 - RNA, 21 nt, Homo sapiens
uaggcauguagcuacaggaca

SEQ ID NO: 518187 - RNA, 16 nt, Homo sapiens
uaggccaucucagcuu

SEQ ID NO: 518188 - RNA, 14 nt, Homo sapiens
uagggaacugggga

SEQ ID NO: 518189 - RNA, 22 nt, Homo sapiens
uaggguuacagagaccuaugua

SEQ ID NO: 518190 - RNA, 17 nt, Homo sapiens
uagguuacagaccucag

SEQ ID NO: 518191 - RNA, 15 nt, Homo sapiens
uagucaccuucauga

SEQ ID NO: 518192 - RNA, 15 nt, Homo sapiens
uagucccacuacuug

SEQ ID NO: 518193 - RNA, 20 nt, Homo sapiens
uagucucaugccuugagauc

SEQ ID NO: 518194 - RNA, 15 nt, Homo sapiens
uagugaauaaaguca

SEQ ID NO: 518195 - RNA, 17 nt, Homo sapiens
uaguuucuuacacacug

SEQ ID NO: 518196 - RNA, 20 nt, Homo sapiens
uauaaacagacaauauguga

SEQ ID NO: 518197 - RNA, 16 nt, Homo sapiens
uauaagcaucugccau

SEQ ID NO: 518198 - RNA, 15 nt, Homo sapiens
uauaagcugccauau

SEQ ID NO: 518199 - RNA, 20 nt, Homo sapiens
uauaaucccagcauuuuggg

SEQ ID NO: 518200 - RNA, 18 nt, Homo sapiens
uauaauuggugcauagca

SEQ ID NO: 518201 - RNA, 16 nt, Homo sapiens
uauagaaaauucuuga

SEQ ID NO: 518202 - RNA, 16 nt, Homo sapiens
uauagcuuugccaugu

SEQ ID NO: 518203 - RNA, 20 nt, Homo sapiens
uauaggugauguuugcucuu

SEQ ID NO: 518204 - RNA, 22 nt, Homo sapiens
uauauaauuuuaugguggaaaa

SEQ ID NO: 518205 - RNA, 12 nt, Homo sapiens
uauauacauaua

SEQ ID NO: 518206 - RNA, 23 nt, Homo sapiens
uauauaguggguacaucaagucc

SEQ ID NO: 518207 - RNA, 21 nt, Homo sapiens
uauaucauagcaaauaaguca

SEQ ID NO: 518208 - RNA, 19 nt, Homo sapiens
uauauuugaaauaguauac

SEQ ID NO: 518209 - RNA, 15 nt, Homo sapiens
uaucaaauacauuua

SEQ ID NO: 518210 - RNA, 12 nt, Homo sapiens
uaucaguaccuc

SEQ ID NO: 518211 - RNA, 16 nt, Homo sapiens
uaucaguaccucucaa

SEQ ID NO: 518212 - RNA, 13 nt, Homo sapiens
uaucauugcuaaa

SEQ ID NO: 518213 - RNA, 15 nt, Homo sapiens
uaucccaccaaccuc

SEQ ID NO: 518214 - RNA, 13 nt, Homo sapiens
uaucccucucuuc

SEQ ID NO: 518215 - RNA, 16 nt, Homo sapiens
uauccuuacaauguga

SEQ ID NO: 518216 - RNA, 21 nt, Homo sapiens
uaucucgaauuugaagagauu

SEQ ID NO: 518217 - RNA, 19 nt, Homo sapiens
uaucucuaaaaacauagaa

SEQ ID NO: 518218 - RNA, 16 nt, Homo sapiens
uaucugguuauaucau

SEQ ID NO: 518219 - RNA, 21 nt, Homo sapiens
uaugaaaaucuccaucucaaa

SEQ ID NO: 518220 - RNA, 17 nt, Homo sapiens
uaugaagccaacugaca

SEQ ID NO: 518221 - RNA, 15 nt, Homo sapiens
uaugcaaaagguuua

SEQ ID NO: 518222 - RNA, 17 nt, Homo sapiens
uaugcaaaccaggauuu

SEQ ID NO: 518223 - RNA, 15 nt, Homo sapiens
uaugcauuauaucaa

SEQ ID NO: 518224 - RNA, 12 nt, Homo sapiens
uaugccaugugc

SEQ ID NO: 518225 - RNA, 22 nt, Homo sapiens
uaugcgcuuaaauuaagauuau

SEQ ID NO: 518226 - RNA, 14 nt, Homo sapiens
uauggcuccuccau

SEQ ID NO: 518227 - RNA, 16 nt, Homo sapiens
uauguagaugugcauu

SEQ ID NO: 518228 - RNA, 20 nt, Homo sapiens
uauguccgcagaauggacuu

SEQ ID NO: 518229 - RNA, 15 nt, Homo sapiens
uaugugggauauuga

SEQ ID NO: 518230 - RNA, 14 nt, Homo sapiens
uauguuuccauuug

SEQ ID NO: 518231 - RNA, 13 nt, Homo sapiens
uauuaaucaccuc

SEQ ID NO: 518232 - RNA, 14 nt, Homo sapiens
uauucuugcacuga

SEQ ID NO: 518233 - RNA, 20 nt, Homo sapiens
uauugauuuuaaauggaugu

SEQ ID NO: 518234 - RNA, 21 nt, Homo sapiens
uauugccgccagaagauccaa

SEQ ID NO: 518235 - RNA, 15 nt, Homo sapiens
uauuguuguugccaa

SEQ ID NO: 518236 - RNA, 14 nt, Homo sapiens
uauuuaagauguga

SEQ ID NO: 518237 - RNA, 21 nt, Homo sapiens
uauuuauccagaaaacuguga

SEQ ID NO: 518238 - RNA, 21 nt, Homo sapiens
uauuuccucugugcaaaggga

SEQ ID NO: 518239 - RNA, 17 nt, Homo sapiens
uauuugcuaaaugcugu

SEQ ID NO: 518240 - RNA, 17 nt, Homo sapiens
ucaaaaagauauuguug

SEQ ID NO: 518241 - RNA, 18 nt, Homo sapiens
ucaaaagccuuaccuuga

SEQ ID NO: 518242 - RNA, 21 nt, Homo sapiens
ucaaaaguugguguugacaua

SEQ ID NO: 518243 - RNA, 19 nt, Homo sapiens
ucaaaaguuuguuugcuua

SEQ ID NO: 518244 - RNA, 14 nt, Homo sapiens
ucaaagaggccuua

SEQ ID NO: 518245 - RNA, 21 nt, Homo sapiens
ucaaauacacauuugcuacug

SEQ ID NO: 518246 - RNA, 22 nt, Homo sapiens
ucaaauacacauuugcuacugu

SEQ ID NO: 518247 - RNA, 19 nt, Homo sapiens
ucaaaucuccugcugauuu

SEQ ID NO: 518248 - RNA, 15 nt, Homo sapiens
ucaaauuuacuuuaa

SEQ ID NO: 518249 - RNA, 20 nt, Homo sapiens
ucaacuuuggugaacaguuu

SEQ ID NO: 518250 - RNA, 18 nt, Homo sapiens
cagugguaaaaguauuug

SEQ ID NO: 518251 - RNA, 18 nt, Homo sapiens
caguuaaaauguguuucu

SEQ ID NO: 518252 - RNA, 20 nt, Homo sapiens
caguuaauaaaccuuugcaa

SEQ ID NO: 518253 - RNA, 15 nt, Homo sapiens
caguucugggcaaag

SEQ ID NO: 518254 - RNA, 21 nt, Homo sapiens
cauaaagagguaaaaaacugu

SEQ ID NO: 518255 - RNA, 13 nt, Homo sapiens
cauaaagcauugg

SEQ ID NO: 518256 - RNA, 17 nt, Homo sapiens
cauaauuuaaaagcaca

SEQ ID NO: 518257 - RNA, 16 nt, Homo sapiens
cauacuuaaugcauau

SEQ ID NO: 518258 - RNA, 15 nt, Homo sapiens
cauauagacuguaca

SEQ ID NO: 518259 - RNA, 19 nt, Homo sapiens
cauauauacuugcaagaua

SEQ ID NO: 518260 - RNA, 18 nt, Homo sapiens
cauaugagaauauaccuu

SEQ ID NO: 518261 - RNA, 19 nt, Homo sapiens
cauaugagaauauaccuua

SEQ ID NO: 518262 - RNA, 19 nt, Homo sapiens
caucaggaaggaaaugaca

SEQ ID NO: 518263 - RNA, 13 nt, Homo sapiens
caucagugaaaga

SEQ ID NO: 518264 - RNA, 16 nt, Homo sapiens
cauccagcuucucaug

SEQ ID NO: 518265 - RNA, 14 nt, Homo sapiens
cauccaggcugccc

SEQ ID NO: 518266 - RNA, 15 nt, Homo sapiens
cauccagguuuauga

SEQ ID NO: 518267 - RNA, 16 nt, Homo sapiens
cauccugaacugcuuc

SEQ ID NO: 518268 - RNA, 19 nt, Homo sapiens
caucuagggaaugggacug

SEQ ID NO: 518269 - RNA, 22 nt, Homo sapiens
caucuagggaaugggacuguga

SEQ ID NO: 518270 - RNA, 23 nt, Homo sapiens
caucuagggaaugggacugugag

SEQ ID NO: 518271 - RNA, 20 nt, Homo sapiens
caucuauuuccucugugcaa

SEQ ID NO: 518272 - RNA, 20 nt, Homo sapiens
caucugaaagugguacuuga

SEQ ID NO: 518273 - RNA, 16 nt, Homo sapiens
caucuucacugcaauu

SEQ ID NO: 518274 - RNA, 11 nt, Homo sapiens
caucuuucauu

SEQ ID NO: 518275 - RNA, 24 nt, Homo sapiens
caugaacguuauuauauugucgaa

SEQ ID NO: 518276 - RNA, 15 nt, Homo sapiens
caugacaaaauuacu

SEQ ID NO: 518277 - RNA, 23 nt, Homo sapiens
caugaccaccccucucgccucau

SEQ ID NO: 518278 - RNA, 18 nt, Homo sapiens
caugaccugcgcucucag

SEQ ID NO: 518279 - RNA, 19 nt, Homo sapiens
caugaccugcgcucucagc

SEQ ID NO: 518280 - RNA, 15 nt, Homo sapiens
caugagacucagugc

SEQ ID NO: 518281 - RNA, 18 nt, Homo sapiens
caugagacucagugcaga

SEQ ID NO: 518282 - RNA, 15 nt, Homo sapiens
caugagauaacucaa

SEQ ID NO: 518283 - RNA, 20 nt, Homo sapiens
caugauauagcuuugccaug

SEQ ID NO: 518284 - RNA, 18 nt, Homo sapiens
cauggacuacaccagggu

SEQ ID NO: 518285 - RNA, 15 nt, Homo sapiens
cauggaggccaagaa

SEQ ID NO: 518286 - RNA, 22 nt, Homo sapiens
cauggaggccaagaacuugcaa

SEQ ID NO: 518287 - RNA, 24 nt, Homo sapiens
cauggcaucuucaauaugaaucua

SEQ ID NO: 518288 - RNA, 18 nt, Homo sapiens
caugguuaccugaccuaa

SEQ ID NO: 518289 - RNA, 13 nt, Homo sapiens
gugguaugaaaug

SEQ ID NO: 518290 - RNA, 22 nt, Homo sapiens
guggugcucuuugcugcacuau

SEQ ID NO: 518291 - RNA, 22 nt, Homo sapiens
gugguuaggcagcaagcuuugg

SEQ ID NO: 518292 - RNA, 23 nt, Homo sapiens
guguaccucaguucccucuugcu

SEQ ID NO: 518293 - RNA, 20 nt, Homo sapiens
guguaccuccucucaguguu

SEQ ID NO: 518294 - RNA, 16 nt, Homo sapiens
gugucucccgugcaug

SEQ ID NO: 518295 - RNA, 17 nt, Homo sapiens
gugucuuacauugccaa

SEQ ID NO: 518296 - RNA, 15 nt, Homo sapiens
gugugaaugcacguu

SEQ ID NO: 518297 - RNA, 15 nt, Homo sapiens
gugugaaugugggca

SEQ ID NO: 518298 - RNA, 18 nt, Homo sapiens
gugugccaagaguucgau

SEQ ID NO: 518299 - RNA, 14 nt, Homo sapiens
guguuauuugcaca

SEQ ID NO: 518300 - RNA, 16 nt, Homo sapiens
guguucagccaaguga

SEQ ID NO: 518301 - RNA, 21 nt, Homo sapiens
guguugcaccaggcacugcug

SEQ ID NO: 518302 - RNA, 17 nt, Homo sapiens
guguuuuuaacauguca

SEQ ID NO: 518303 - RNA, 12 nt, Homo sapiens
guuaaacugaga

SEQ ID NO: 518304 - RNA, 13 nt, Homo sapiens
guuacagaccuca

SEQ ID NO: 518305 - RNA, 14 nt, Homo sapiens
guuaccucugcaug

SEQ ID NO: 518306 - RNA, 15 nt, Homo sapiens
guuauguuugaauga

SEQ ID NO: 518307 - RNA, 13 nt, Homo sapiens
guuauuugcacac

SEQ ID NO: 518308 - RNA, 15 nt, Homo sapiens
guuauuugcacacug

SEQ ID NO: 518309 - RNA, 19 nt, Homo sapiens
guucauuacuuuuucauau

SEQ ID NO: 518310 - RNA, 15 nt, Homo sapiens
guuccagaccagccu

SEQ ID NO: 518311 - RNA, 19 nt, Homo sapiens
guucguggggaacugcgug

SEQ ID NO: 518312 - RNA, 17 nt, Homo sapiens
guucuacacucaucuua

SEQ ID NO: 518313 - RNA, 12 nt, Homo sapiens
guucuaugagaa

SEQ ID NO: 518314 - RNA, 21 nt, Homo sapiens
guucuggauaccauuauaugu

SEQ ID NO: 518315 - RNA, 21 nt, Homo sapiens
guucuuacacaggcuucauca

SEQ ID NO: 518316 - RNA, 13 nt, Homo sapiens
guugauucuugcc

SEQ ID NO: 518317 - RNA, 10 nt, Homo sapiens
guuggaagag

SEQ ID NO: 518318 - RNA, 21 nt, Homo sapiens
guuggacuguaagggauugaa

SEQ ID NO: 518319 - RNA, 22 nt, Homo sapiens
guuggucugccuucugcugaaa

SEQ ID NO: 518320 - RNA, 20 nt, Homo sapiens
guugguucguucuguacugu

SEQ ID NO: 518321 - RNA, 21 nt, Homo sapiens
guuguauaucacuaaaagcau

SEQ ID NO: 518322 - RNA, 17 nt, Homo sapiens
guugucuccacuuguau

SEQ ID NO: 518323 - RNA, 17 nt, Homo sapiens
guugugccccuuuccaa

SEQ ID NO: 518324 - RNA, 22 nt, Homo sapiens
guuuacaauaggaguggugauu

SEQ ID NO: 518325 - RNA, 20 nt, Homo sapiens
guuuacauccagaguucugu

SEQ ID NO: 518326 - RNA, 12 nt, Homo sapiens
guuuaugaauga

SEQ ID NO: 518327 - RNA, 16 nt, Homo sapiens
guuuccaaaaccagaa

SEQ ID NO: 518328 - RNA, 23 nt, Homo sapiens
guuucucuagaagcuccagugau

SEQ ID NO: 518329 - RNA, 18 nt, Homo sapiens
guuucuuacacacugucu

SEQ ID NO: 518330 - RNA, 21 nt, Homo sapiens
guuucuugcucccagaccaag

SEQ ID NO: 518331 - RNA, 22 nt, Homo sapiens
guuuuaaaagagaagcaucauu

SEQ ID NO: 518332 - RNA, 14 nt, Homo sapiens
guuuuaaauugaua

SEQ ID NO: 518333 - RNA, 15 nt, Homo sapiens
guuuuaugcuacuga

SEQ ID NO: 518334 - RNA, 16 nt, Homo sapiens
guuuucuccacuggaa

SEQ ID NO: 518335 - RNA, 16 nt, Homo sapiens
guuuuuuauuaugcau

SEQ ID NO: 518336 - RNA, 19 nt, Homo sapiens
guuuuuuauuaugcauuau

SEQ ID NO: 518337 - RNA, 13 nt, Homo sapiens
guuuuuucuccag

SEQ ID NO: 518338 - RNA, 16 nt, Homo sapiens
uaaaacaauaauaaua

SEQ ID NO: 518339 - RNA, 14 nt, Homo sapiens
uaaaacuggaccug

SEQ ID NO: 518340 - RNA, 16 nt, Homo sapiens
uaaaagaaaccuucca

SEQ ID NO: 518341 - RNA, 15 nt, Homo sapiens
uaaaagcacacuccc

SEQ ID NO: 518342 - RNA, 13 nt, Homo sapiens
uaaaagcauuuug

SEQ ID NO: 518343 - RNA, 21 nt, Homo sapiens
uaaaaguuuuuuauuaugcau

SEQ ID NO: 518344 - RNA, 19 nt, Homo sapiens
uaaaauauaaucucuauaa

SEQ ID NO: 518345 - RNA, 12 nt, Homo sapiens
uaaaaucucaaa

SEQ ID NO: 518346 - RNA, 12 nt, Homo sapiens
uaaaauucauuu

SEQ ID NO: 518347 - RNA, 12 nt, Homo sapiens
uaaaauugcuau

SEQ ID NO: 518348 - RNA, 16 nt, Homo sapiens
uaaaauuuuggauuaa

SEQ ID NO: 518349 - RNA, 22 nt, Homo sapiens
uaaacauugaagacccugucuc

SEQ ID NO: 518350 - RNA, 17 nt, Homo sapiens
uaaaccuugucuaugaa

SEQ ID NO: 518351 - RNA, 17 nt, Homo sapiens
uaaacuaugaggacugc

SEQ ID NO: 518352 - RNA, 20 nt, Homo sapiens
uaaagaaaaaaauacuauuu

SEQ ID NO: 518353 - RNA, 15 nt, Homo sapiens
uaaagaauagcuuua

SEQ ID NO: 518354 - RNA, 17 nt, Homo sapiens
uaaagacccuccuauuc

SEQ ID NO: 518355 - RNA, 20 nt, Homo sapiens
uaaagagagaauguagauau

SEQ ID NO: 518356 - RNA, 23 nt, Homo sapiens
uaaaggaagcaaguuuucuucca

SEQ ID NO: 518357 - RNA, 18 nt, Homo sapiens
uaaaggagcaucuaucag

SEQ ID NO: 518358 - RNA, 14 nt, Homo sapiens
uaaaggcagcugcc

SEQ ID NO: 518359 - RNA, 20 nt, Homo sapiens
uaaaggcagcugccucugcu

SEQ ID NO: 518360 - RNA, 22 nt, Homo sapiens
uaaaguauuuucuucucuguga

SEQ ID NO: 518361 - RNA, 21 nt, Homo sapiens
uaaaguuuuaggguacaguuu

SEQ ID NO: 518362 - RNA, 15 nt, Homo sapiens
uaaauaauucuuccu

SEQ ID NO: 518363 - RNA, 12 nt, Homo sapiens
uaaauacauucg

SEQ ID NO: 518364 - RNA, 17 nt, Homo sapiens
uaaauagaugcugugua

SEQ ID NO: 518365 - RNA, 16 nt, Homo sapiens
uaaaugaaacuuaaga

SEQ ID NO: 518366 - RNA, 22 nt, Homo sapiens
uaaaugagagggaaucgacugu

SEQ ID NO: 518367 - RNA, 22 nt, Homo sapiens
uaaaugauuaaaaaaucagaga

SEQ ID NO: 518368 - RNA, 16 nt, Homo sapiens
uaaauguuuauacugu

SEQ ID NO: 518369 - RNA, 19 nt, Homo sapiens
uaaauguuuauacuguauu

SEQ ID NO: 518370 - RNA, 16 nt, Homo sapiens
uaaauucaacuuugua

SEQ ID NO: 518371 - RNA, 12 nt, Homo sapiens
uaaauugcauca

SEQ ID NO: 518372 - RNA, 20 nt, Homo sapiens
uaaauuuaucaguaccuaag

SEQ ID NO: 518373 - RNA, 15 nt, Homo sapiens
uaaauuuuauaucau

SEQ ID NO: 518374 - RNA, 14 nt, Homo sapiens
uaacaaauguggcu

SEQ ID NO: 518375 - RNA, 22 nt, Homo sapiens
uaacagauggaaaaacugaggc

SEQ ID NO: 518376 - RNA, 12 nt, Homo sapiens
uaacauccagag

SEQ ID NO: 518377 - RNA, 13 nt, Homo sapiens
uaacaugugaaaa

SEQ ID NO: 518378 - RNA, 14 nt, Homo sapiens
uaacuaaacuaacg

SEQ ID NO: 518379 - RNA, 14 nt, Homo sapiens
uaacucaacauuug

SEQ ID NO: 518380 - RNA, 22 nt, Homo sapiens
uaacugaaccauuccaacuuca

SEQ ID NO: 518381 - RNA, 20 nt, Homo sapiens
uaacuuuuuuuucucucuuu

SEQ ID NO: 518382 - RNA, 23 nt, Homo sapiens
uaagacuuccccucaacaugcug

SEQ ID NO: 518383 - RNA, 19 nt, Homo sapiens
uaagagacacuccaaaccu

SEQ ID NO: 518384 - RNA, 17 nt, Homo sapiens
uaagagcagaacagauc

SEQ ID NO: 518385 - RNA, 13 nt, Homo sapiens
uaagagguugauu

SEQ ID NO: 518386 - RNA, 13 nt, Homo sapiens
uaagaugugaaaa

SEQ ID NO: 518387 - RNA, 14 nt, Homo sapiens
uaaggaggcacugc

SEQ ID NO: 518388 - RNA, 18 nt, Homo sapiens
uaagggguaucauguaug

SEQ ID NO: 518389 - RNA, 22 nt, Homo sapiens
uaaguaaaauccccuucgcuga

SEQ ID NO: 518390 - RNA, 20 nt, Homo sapiens
uaagucuuuaaugccgauau

SEQ ID NO: 518391 - RNA, 24 nt, Homo sapiens
uaauaaaucucuucuuugcugcag

SEQ ID NO: 518392 - RNA, 14 nt, Homo sapiens
uaauaacuacuucc

SEQ ID NO: 518393 - RNA, 23 nt, Homo sapiens
uaauacugguauuuuuacuuaau

SEQ ID NO: 518394 - RNA, 17 nt, Homo sapiens
uaauauaagcugccaua

SEQ ID NO: 518395 - RNA, 22 nt, Homo sapiens
uaauaugaaaaucuccaucuca

SEQ ID NO: 518396 - RNA, 16 nt, Homo sapiens
uaaucacugcauuuca

SEQ ID NO: 518397 - RNA, 14 nt, Homo sapiens
uaaucccagcacuu

SEQ ID NO: 518398 - RNA, 15 nt, Homo sapiens
uaaucccagcacuuu

SEQ ID NO: 518399 - RNA, 14 nt, Homo sapiens
uaauggaaaccaag

SEQ ID NO: 518400 - RNA, 15 nt, Homo sapiens
uaauggggaggacaa

SEQ ID NO: 518401 - RNA, 14 nt, Homo sapiens
uaauguacaauaaa

SEQ ID NO: 518402 - RNA, 20 nt, Homo sapiens
uaauuaaaagugugggcugg

SEQ ID NO: 518403 - RNA, 18 nt, Homo sapiens
uaauuuuguaauguauca

SEQ ID NO: 518404 - RNA, 16 nt, Homo sapiens
uaauuuuuaacuuauu

SEQ ID NO: 518405 - RNA, 20 nt, Homo sapiens
uacaagauugaaaaucuugu

SEQ ID NO: 518406 - RNA, 15 nt, Homo sapiens
uacaauaaagcaaug

SEQ ID NO: 518407 - RNA, 16 nt, Homo sapiens
uacaauaaagcaaugu

SEQ ID NO: 518408 - RNA, 21 nt, Homo sapiens
uacaauaaagcaaugugguag

SEQ ID NO: 518409 - RNA, 11 nt, Homo sapiens
ucuuccaugac

SEQ ID NO: 518410 - RNA, 14 nt, Homo sapiens
ucuucccaugcauu

SEQ ID NO: 518411 - RNA, 20 nt, Homo sapiens
ucuucuccuaaaacuuuaaa

SEQ ID NO: 518412 - RNA, 20 nt, Homo sapiens
ucuucugcaaaaauggauau

SEQ ID NO: 518413 - RNA, 14 nt, Homo sapiens
ucuucuuacaugca

SEQ ID NO: 518414 - RNA, 19 nt, Homo sapiens
ucuucuuacaugcauuuga

SEQ ID NO: 518415 - RNA, 19 nt, Homo sapiens
ucuucuuggggcccagugc

SEQ ID NO: 518416 - RNA, 20 nt, Homo sapiens
ucuugaacucauagauuauu

SEQ ID NO: 518417 - RNA, 19 nt, Homo sapiens
ucuugaaguauauauauca

SEQ ID NO: 518418 - RNA, 12 nt, Homo sapiens
ucuugacuguua

SEQ ID NO: 518419 - RNA, 17 nt, Homo sapiens
ucuuggaaaaggaacuc

SEQ ID NO: 518420 - RNA, 15 nt, Homo sapiens
ucuuggggaagauac

SEQ ID NO: 518421 - RNA, 17 nt, Homo sapiens
ucuugguaauccccuaa

SEQ ID NO: 518422 - RNA, 16 nt, Homo sapiens
ucuuucacacggcaca

SEQ ID NO: 518423 - RNA, 17 nt, Homo sapiens
ucuuuccauuaugauuc

SEQ ID NO: 518424 - RNA, 16 nt, Homo sapiens
ucuuucucaaucuuga

SEQ ID NO: 518425 - RNA, 23 nt, Homo sapiens
ucuuugaagcgagcagucagcau

SEQ ID NO: 518426 - RNA, 11 nt, Homo sapiens
ucuuugccucu

SEQ ID NO: 518427 - RNA, 19 nt, Homo sapiens
ucuuugcucuaauuuugga

SEQ ID NO: 518428 - RNA, 23 nt, Homo sapiens
ucuuuuggcaguucugauaagcu

SEQ ID NO: 518429 - RNA, 13 nt, Homo sapiens
ugaaaacagauga

SEQ ID NO: 518430 - RNA, 17 nt, Homo sapiens
ugaaaagguugccugaa

SEQ ID NO: 518431 - RNA, 17 nt, Homo sapiens
ugaaaaucuccaucuca

SEQ ID NO: 518432 - RNA, 15 nt, Homo sapiens
ugaaaaugacauuaa

SEQ ID NO: 518433 - RNA, 20 nt, Homo sapiens
ugaaaauucgaaccaggaaa

SEQ ID NO: 518434 - RNA, 18 nt, Homo sapiens
ugaaaccuacacacuguc

SEQ ID NO: 518435 - RNA, 19 nt, Homo sapiens
ugaaaccuacacacuguca

SEQ ID NO: 518436 - RNA, 14 nt, Homo sapiens
ugaaacuaacagau

SEQ ID NO: 518437 - RNA, 16 nt, Homo sapiens
ugaaagcaaguguuca

SEQ ID NO: 518438 - RNA, 14 nt, Homo sapiens
ugaaagccacaaug

SEQ ID NO: 518439 - RNA, 21 nt, Homo sapiens
ugaaagcguuuacaugagacu

SEQ ID NO: 518440 - RNA, 18 nt, Homo sapiens
ugaaaggaucucugagac

SEQ ID NO: 518441 - RNA, 17 nt, Homo sapiens
ugaaagucaaauuuacu

SEQ ID NO: 518442 - RNA, 17 nt, Homo sapiens
ugaaagugguacuugau

SEQ ID NO: 518443 - RNA, 13 nt, Homo sapiens
ugaaauauaccuu

SEQ ID NO: 518444 - RNA, 18 nt, Homo sapiens
ugaaauuuccuaauuuau

SEQ ID NO: 518445 - RNA, 21 nt, Homo sapiens
ugaacaaacuuagaaagggaa

SEQ ID NO: 518446 - RNA, 11 nt, Homo sapiens
ugaacacuccc

SEQ ID NO: 518447 - RNA, 15 nt, Homo sapiens
ugaacaugauaguua

SEQ ID NO: 518448 - RNA, 19 nt, Homo sapiens
ugaacuacauaacuuccua

SEQ ID NO: 518449 - RNA, 14 nt, Homo sapiens
ugaagaaacuuccc

SEQ ID NO: 518450 - RNA, 18 nt, Homo sapiens
ugaagagggagaagcaug

SEQ ID NO: 518451 - RNA, 15 nt, Homo sapiens
ugaagcagucuugcu

SEQ ID NO: 518452 - RNA, 16 nt, Homo sapiens
ugaagcagucuugcuc

SEQ ID NO: 518453 - RNA, 17 nt, Homo sapiens
ugaagcagucuugcucu

SEQ ID NO: 518454 - RNA, 22 nt, Homo sapiens
ugaaggaaauucuuauaacuca

SEQ ID NO: 518455 - RNA, 20 nt, Homo sapiens
ugaaggcauccccaggcccu

SEQ ID NO: 518456 - RNA, 13 nt, Homo sapiens
ugaagugugcugu

SEQ ID NO: 518457 - RNA, 17 nt, Homo sapiens
ugaaguuuugauuuauu

SEQ ID NO: 518458 - RNA, 23 nt, Homo sapiens
ugaauaaaugauuaaaaaaucag

SEQ ID NO: 518459 - RNA, 19 nt, Homo sapiens
ugaauacagcauuuagcuu

SEQ ID NO: 518460 - RNA, 11 nt, Homo sapiens
ugaauaugccu

SEQ ID NO: 518461 - RNA, 18 nt, Homo sapiens
ugaaucagcugggaugac

SEQ ID NO: 518462 - RNA, 13 nt, Homo sapiens
ugaauggucucag

SEQ ID NO: 518463 - RNA, 15 nt, Homo sapiens
ugaauucuaacauua

SEQ ID NO: 518464 - RNA, 14 nt, Homo sapiens
ugacaacugugaag

SEQ ID NO: 518465 - RNA, 20 nt, Homo sapiens
ugacaacugugaagccaccc

SEQ ID NO: 518466 - RNA, 23 nt, Homo sapiens
ugacacgccuaaggucacagcua

SEQ ID NO: 518467 - RNA, 14 nt, Homo sapiens
ugacagcacuacaa

SEQ ID NO: 518468 - RNA, 22 nt, Homo sapiens
ugacaguuaauaaaccuuugca

SEQ ID NO: 518469 - RNA, 16 nt, Homo sapiens
ugacauaauaauagca

SEQ ID NO: 518470 - RNA, 17 nt, Homo sapiens
ugacauuaaaugcaaua

SEQ ID NO: 518471 - RNA, 18 nt, Homo sapiens
ugaccaccccucucgccu

SEQ ID NO: 518472 - RNA, 18 nt, Homo sapiens
ugaccacgucaucgggcc

SEQ ID NO: 518473 - RNA, 20 nt, Homo sapiens
ugacccccgcaaguuugcac

SEQ ID NO: 518474 - RNA, 16 nt, Homo sapiens
ugaccggugcuuuuau

SEQ ID NO: 518475 - RNA, 18 nt, Homo sapiens
ugaccuggagaugcugcc

SEQ ID NO: 518476 - RNA, 18 nt, Homo sapiens
ugaccuugggguacaauu

SEQ ID NO: 518477 - RNA, 14 nt, Homo sapiens
ugacgcagcacaag

SEQ ID NO: 518478 - RNA, 16 nt, Homo sapiens
ugacgcagcacaagcu

SEQ ID NO: 518479 - RNA, 19 nt, Homo sapiens
ugacgcagcacaagcucag

SEQ ID NO: 518480 - RNA, 19 nt, Homo sapiens
ugacugcauugccgcugua

SEQ ID NO: 518481 - RNA, 22 nt, Homo sapiens
ugacuggaggaggccuguccca

SEQ ID NO: 518482 - RNA, 22 nt, Homo sapiens
ugacugucacuugcugcuuuuu

SEQ ID NO: 518483 - RNA, 14 nt, Homo sapiens
ugagaaacugggaa

SEQ ID NO: 518484 - RNA, 16 nt, Homo sapiens
ugagaaauuccuuagu

SEQ ID NO: 518485 - RNA, 16 nt, Homo sapiens
ugagaaccauuuacuu

SEQ ID NO: 518486 - RNA, 15 nt, Homo sapiens
ugagacucagugcag

SEQ ID NO: 518487 - RNA, 16 nt, Homo sapiens
ugagacucagugcaga

SEQ ID NO: 518488 - RNA, 23 nt, Homo sapiens
ugagaggcugucuguuguauuca

SEQ ID NO: 518489 - RNA, 18 nt, Homo sapiens
ugagauccggcagcacaa

SEQ ID NO: 518490 - RNA, 12 nt, Homo sapiens
ugagcuuugaaa

SEQ ID NO: 518491 - RNA, 18 nt, Homo sapiens
ugaggacgcuggggaaua

SEQ ID NO: 518492 - RNA, 20 nt, Homo sapiens
ugaggcccugcccaaugaga

SEQ ID NO: 518493 - RNA, 16 nt, Homo sapiens
ugaggcggagaauugc

SEQ ID NO: 518494 - RNA, 20 nt, Homo sapiens
ugaggucaggaguucaagac

SEQ ID NO: 518495 - RNA, 17 nt, Homo sapiens
ugagucugcaugugcac

SEQ ID NO: 518496 - RNA, 17 nt, Homo sapiens
ugaguucuauaauauaa

SEQ ID NO: 518497 - RNA, 15 nt, Homo sapiens
ugauaaaacacugcc

SEQ ID NO: 518498 - RNA, 23 nt, Homo sapiens
ugauacaacauuaaggaauuuga

SEQ ID NO: 518499 - RNA, 15 nt, Homo sapiens
ugauagggaacuggg

SEQ ID NO: 518500 - RNA, 17 nt, Homo sapiens
ugaucacauucuuucca

SEQ ID NO: 518501 - RNA, 20 nt, Homo sapiens
ugaucacauucuuuccaaaa

SEQ ID NO: 518502 - RNA, 17 nt, Homo sapiens
ugauccauccaucucuc

SEQ ID NO: 518503 - RNA, 13 nt, Homo sapiens
ugauccgccuacc

SEQ ID NO: 518504 - RNA, 23 nt, Homo sapiens
ugaugagucgguccucuuuccag

SEQ ID NO: 518505 - RNA, 14 nt, Homo sapiens
ugaugccauggcag

SEQ ID NO: 518506 - RNA, 20 nt, Homo sapiens
ugauucccagccuguggcag

SEQ ID NO: 518507 - RNA, 12 nt, Homo sapiens
ugauucuugccu

SEQ ID NO: 518508 - RNA, 15 nt, Homo sapiens
ugauugagacucaaa

SEQ ID NO: 518509 - RNA, 14 nt, Homo sapiens
ugauugcacuugau

SEQ ID NO: 518510 - RNA, 20 nt, Homo sapiens
ugauuucaggagaaccuaac

SEQ ID NO: 518511 - RNA, 18 nt, Homo sapiens
ugauuucugacucuauca

SEQ ID NO: 518512 - RNA, 15 nt, Homo sapiens
ugauuuugcuuucca

SEQ ID NO: 518513 - RNA, 13 nt, Homo sapiens
ugcaaaccaggau

SEQ ID NO: 518514 - RNA, 15 nt, Homo sapiens
ugcaaacuuguuaga

SEQ ID NO: 518515 - RNA, 21 nt, Homo sapiens
ugcaacaauaaaguacuuuac

SEQ ID NO: 518516 - RNA, 13 nt, Homo sapiens
ugcaaccucugcc

SEQ ID NO: 518517 - RNA, 19 nt, Homo sapiens
ugcaauaccaauguucuaa

SEQ ID NO: 518518 - RNA, 12 nt, Homo sapiens
ugcaaucuucua

SEQ ID NO: 518519 - RNA, 12 nt, Homo sapiens
ugcacacugagg

SEQ ID NO: 518520 - RNA, 15 nt, Homo sapiens
ugcacacugcacugu

SEQ ID NO: 518521 - RNA, 20 nt, Homo sapiens
ugcacagauaaguaggccau

SEQ ID NO: 518522 - RNA, 12 nt, Homo sapiens
ugcacagccacu

SEQ ID NO: 518523 - RNA, 14 nt, Homo sapiens
ugcaccguccucag

SEQ ID NO: 518524 - RNA, 12 nt, Homo sapiens
ugcaccuaccuu

SEQ ID NO: 518525 - RNA, 16 nt, Homo sapiens
ugcaccuguaauccca

SEQ ID NO: 518526 - RNA, 22 nt, Homo sapiens
ugcacuccagccugggggacag

SEQ ID NO: 518527 - RNA, 15 nt, Homo sapiens
ugcacuguccugacc

SEQ ID NO: 518528 - RNA, 14 nt, Homo sapiens
ugcagauacuuuga

SEQ ID NO: 518529 - RNA, 21 nt, Homo sapiens
ugcagcaccgaggggccuuug

SEQ ID NO: 518530 - RNA, 13 nt, Homo sapiens
uaugaaaugaccu

SEQ ID NO: 518531 - RNA, 20 nt, Homo sapiens
uaugaagaauacccaggaag

SEQ ID NO: 518532 - RNA, 19 nt, Homo sapiens
uaugauaaaacacugcccu

SEQ ID NO: 518533 - RNA, 17 nt, Homo sapiens
uaugcaguauucuugca

SEQ ID NO: 518534 - RNA, 13 nt, Homo sapiens
uaugccacugacc

SEQ ID NO: 518535 - RNA, 12 nt, Homo sapiens
uaugcuacugaa

SEQ ID NO: 518536 - RNA, 21 nt, Homo sapiens
uaugcugaucuuuuaaaauca

SEQ ID NO: 518537 - RNA, 19 nt, Homo sapiens
uaugggagcuuaacuuuau

SEQ ID NO: 518538 - RNA, 13 nt, Homo sapiens
uauguauauacau

SEQ ID NO: 518539 - RNA, 17 nt, Homo sapiens
uaugugguuaucuguga

SEQ ID NO: 518540 - RNA, 19 nt, Homo sapiens
uauguucccccuguuucag

SEQ ID NO: 518541 - RNA, 12 nt, Homo sapiens
uauguuugcaaa

SEQ ID NO: 518542 - RNA, 15 nt, Homo sapiens
uauuaacccuaccug

SEQ ID NO: 518543 - RNA, 17 nt, Homo sapiens
uauuauaacucauuugu

SEQ ID NO: 518544 - RNA, 20 nt, Homo sapiens
uauucaaaaacauaacugag

SEQ ID NO: 518545 - RNA, 15 nt, Homo sapiens
uauucugguucuuga

SEQ ID NO: 518546 - RNA, 15 nt, Homo sapiens
uauucugugcgcuac

SEQ ID NO: 518547 - RNA, 15 nt, Homo sapiens
uauucuuuguuuccu

SEQ ID NO: 518548 - RNA, 14 nt, Homo sapiens
uauugcgauggcgu

SEQ ID NO: 518549 - RNA, 23 nt, Homo sapiens
uauuggcccuaaauagcagaaag

SEQ ID NO: 518550 - RNA, 16 nt, Homo sapiens
uauuguuguugccaaa

SEQ ID NO: 518551 - RNA, 23 nt, Homo sapiens
uauuuaaaggaaaaucacaucuc

SEQ ID NO: 518552 - RNA, 21 nt, Homo sapiens
uauuuacauccagcuucucau

SEQ ID NO: 518553 - RNA, 14 nt, Homo sapiens
uauuuaguugauag

SEQ ID NO: 518554 - RNA, 20 nt, Homo sapiens
uauuuauccaaaauguguau

SEQ ID NO: 518555 - RNA, 16 nt, Homo sapiens
uauuuauuugagguca

SEQ ID NO: 518556 - RNA, 19 nt, Homo sapiens
uauuucaauaaaucuuuca

SEQ ID NO: 518557 - RNA, 17 nt, Homo sapiens
uauuuccucugugcaaa

SEQ ID NO: 518558 - RNA, 22 nt, Homo sapiens
uauuuccucugugcaaagggaa

SEQ ID NO: 518559 - RNA, 18 nt, Homo sapiens
uauuucucaucugcacua

SEQ ID NO: 518560 - RNA, 15 nt, Homo sapiens
uauuucucuucuacc

SEQ ID NO: 518561 - RNA, 12 nt, Homo sapiens
uauuucugaaga

SEQ ID NO: 518562 - RNA, 15 nt, Homo sapiens
uauuucuugcuuuca

SEQ ID NO: 518563 - RNA, 22 nt, Homo sapiens
uauuuuagcugcacggcauuac

SEQ ID NO: 518564 - RNA, 14 nt, Homo sapiens
uauuuucuuuauca

SEQ ID NO: 518565 - RNA, 16 nt, Homo sapiens
uauuuuguugccuuca

SEQ ID NO: 518566 - RNA, 23 nt, Homo sapiens
ucaaaaguugguguugacauaca

SEQ ID NO: 518567 - RNA, 13 nt, Homo sapiens
uccccagccugcu

SEQ ID NO: 518568 - RNA, 12 nt, Homo sapiens
ucccccauaggu

SEQ ID NO: 518569 - RNA, 18 nt, Homo sapiens
uccccucucagcauuucc

SEQ ID NO: 518570 - RNA, 21 nt, Homo sapiens
uccccuguagcagucacugac

SEQ ID NO: 518571 - RNA, 13 nt, Homo sapiens
ucccgaagccacc

SEQ ID NO: 518572 - RNA, 22 nt, Homo sapiens
ucccgcccuuccaugugccuuu

SEQ ID NO: 518573 - RNA, 22 nt, Homo sapiens
ucccucucuuccccuucccuua

SEQ ID NO: 518574 - RNA, 17 nt, Homo sapiens
ucccugaaaccuaguac

SEQ ID NO: 518575 - RNA, 16 nt, Homo sapiens
ucccuuuggagaugcu

SEQ ID NO: 518576 - RNA, 14 nt, Homo sapiens
ucccuuuucccuua

SEQ ID NO: 518577 - RNA, 17 nt, Homo sapiens
uccgcacccaguuugau

SEQ ID NO: 518578 - RNA, 16 nt, Homo sapiens
uccgccagauccugca

SEQ ID NO: 518579 - RNA, 13 nt, Homo sapiens
uccgccuaccuca

SEQ ID NO: 518580 - RNA, 17 nt, Homo sapiens
uccgcugccccaugugu

SEQ ID NO: 518581 - RNA, 17 nt, Homo sapiens
uccggccucugccuuug

SEQ ID NO: 518582 - RNA, 20 nt, Homo sapiens
uccguucacaugugugguac

SEQ ID NO: 518583 - RNA, 12 nt, Homo sapiens
uccuacacuuga

SEQ ID NO: 518584 - RNA, 20 nt, Homo sapiens
uccuacagugacucccuggg

SEQ ID NO: 518585 - RNA, 21 nt, Homo sapiens
uccuagaagaaccaaauaccu

SEQ ID NO: 518586 - RNA, 19 nt, Homo sapiens
uccuagcuguguuauuccu

SEQ ID NO: 518587 - RNA, 22 nt, Homo sapiens
uccucacacacccugaggucag

SEQ ID NO: 518588 - RNA, 11 nt, Homo sapiens
uccucagggag

SEQ ID NO: 518589 - RNA, 13 nt, Homo sapiens
uccucaugcugcu

SEQ ID NO: 518590 - RNA, 14 nt, Homo sapiens
uccucaugcugcuc

SEQ ID NO: 518591 - RNA, 15 nt, Homo sapiens
uccuccaagcucacg

SEQ ID NO: 518592 - RNA, 13 nt, Homo sapiens
uccuccuccugcc

SEQ ID NO: 518593 - RNA, 20 nt, Homo sapiens
uccuccuggaacagaagaca

SEQ ID NO: 518594 - RNA, 15 nt, Homo sapiens
uccucugcauuuaca

SEQ ID NO: 518595 - RNA, 17 nt, Homo sapiens
uccucugcauuuacaca

SEQ ID NO: 518596 - RNA, 17 nt, Homo sapiens
uccucugugcaaaggga

SEQ ID NO: 518597 - RNA, 19 nt, Homo sapiens
uccugaaggaaauucuuau

SEQ ID NO: 518598 - RNA, 13 nt, Homo sapiens
uccugcacacagg

SEQ ID NO: 518599 - RNA, 19 nt, Homo sapiens
uccugcagaaguacuccua

SEQ ID NO: 518600 - RNA, 15 nt, Homo sapiens
uccugcugaaacugc

SEQ ID NO: 518601 - RNA, 15 nt, Homo sapiens
uccugguccuggaca

SEQ ID NO: 518602 - RNA, 13 nt, Homo sapiens
uccugugccacua

SEQ ID NO: 518603 - RNA, 18 nt, Homo sapiens
uccuuaacgcuagagauu

SEQ ID NO: 518604 - RNA, 15 nt, Homo sapiens
uccuuacuuuacugc

SEQ ID NO: 518605 - RNA, 15 nt, Homo sapiens
uccuuucacucugca

SEQ ID NO: 518606 - RNA, 21 nt, Homo sapiens
uccuuuuuuggggaguaccug

SEQ ID NO: 518607 - RNA, 19 nt, Homo sapiens
ucgacuguauucgugcauu

SEQ ID NO: 518608 - RNA, 15 nt, Homo sapiens
ucgagcaacugcugu

SEQ ID NO: 518609 - RNA, 17 nt, Homo sapiens
ucgauguaggcauucug

SEQ ID NO: 518610 - RNA, 14 nt, Homo sapiens
ucggcacacacugu

SEQ ID NO: 518611 - RNA, 14 nt, Homo sapiens
ucggccuccaugac

SEQ ID NO: 518612 - RNA, 16 nt, Homo sapiens
ucggccuccaugaccu

SEQ ID NO: 518613 - RNA, 13 nt, Homo sapiens
ucggcucacugca

SEQ ID NO: 518614 - RNA, 18 nt, Homo sapiens
ucgugggccgcacugggg

SEQ ID NO: 518615 - RNA, 18 nt, Homo sapiens
ucgugggguaacaucugu

SEQ ID NO: 518616 - RNA, 16 nt, Homo sapiens
ucuaacucagaauuau

SEQ ID NO: 518617 - RNA, 19 nt, Homo sapiens
ucuaagcaguuauggugau

SEQ ID NO: 518618 - RNA, 14 nt, Homo sapiens
ucuaauguacaaua

SEQ ID NO: 518619 - RNA, 21 nt, Homo sapiens
ucuaauguacaauaaagcaau

SEQ ID NO: 518620 - RNA, 20 nt, Homo sapiens
ucuacagugccaacuccuca

SEQ ID NO: 518621 - RNA, 17 nt, Homo sapiens
ucuagaagcuccaguga

SEQ ID NO: 518622 - RNA, 13 nt, Homo sapiens
ucuagagcaaagc

SEQ ID NO: 518623 - RNA, 12 nt, Homo sapiens
ucuagcaguugu

SEQ ID NO: 518624 - RNA, 18 nt, Homo sapiens
ucuaggaugggaacaagg

SEQ ID NO: 518625 - RNA, 19 nt, Homo sapiens
ucuauaaauagaugcugug

SEQ ID NO: 518626 - RNA, 12 nt, Homo sapiens
ucuaugugacau

SEQ ID NO: 518627 - RNA, 14 nt, Homo sapiens
ucuauuaaucaccu

SEQ ID NO: 518628 - RNA, 20 nt, Homo sapiens
ucucaaacuccugaccucag

SEQ ID NO: 518629 - RNA, 19 nt, Homo sapiens
ucucaagcuaguguuucua

SEQ ID NO: 518630 - RNA, 19 nt, Homo sapiens
ucucaaggagaggcaaaga

SEQ ID NO: 518631 - RNA, 23 nt, Homo sapiens
ucucaaggagaggcaaagaaagg

SEQ ID NO: 518632 - RNA, 17 nt, Homo sapiens
ucucaaugaaccauaaa

SEQ ID NO: 518633 - RNA, 21 nt, Homo sapiens
ucucaccugccgugcguacug

SEQ ID NO: 518634 - RNA, 21 nt, Homo sapiens
ucucagcuugagaccauuuca

SEQ ID NO: 518635 - RNA, 20 nt, Homo sapiens
ucucauugucaccucuguga

SEQ ID NO: 518636 - RNA, 18 nt, Homo sapiens
ucuccacacccacuuugu

SEQ ID NO: 518637 - RNA, 18 nt, Homo sapiens
ucuccacucuugugguca

SEQ ID NO: 518638 - RNA, 20 nt, Homo sapiens
ucuccacuggaaaacugcua

SEQ ID NO: 518639 - RNA, 19 nt, Homo sapiens
ucuccagaauaauucuuaa

SEQ ID NO: 518640 - RNA, 15 nt, Homo sapiens
ucuccagccaaccuc

SEQ ID NO: 518641 - RNA, 21 nt, Homo sapiens
ucuccagccaaccucauugca

SEQ ID NO: 518642 - RNA, 15 nt, Homo sapiens
ucuccaucucaaaaa

SEQ ID NO: 518643 - RNA, 11 nt, Homo sapiens
ucuccaugugu

SEQ ID NO: 518644 - RNA, 20 nt, Homo sapiens
ucuccucuucauggcaucuu

SEQ ID NO: 518645 - RNA, 16 nt, Homo sapiens
ucuccuggguacugag

SEQ ID NO: 518646 - RNA, 15 nt, Homo sapiens
ucucgacaguaucca

SEQ ID NO: 518647 - RNA, 17 nt, Homo sapiens
ucucgccucauuacugu

SEQ ID NO: 518648 - RNA, 17 nt, Homo sapiens
ucucuaacaguggacaa

SEQ ID NO: 518649 - RNA, 13 nt, Homo sapiens
ucucugaggacaa

SEQ ID NO: 518650 - RNA, 20 nt, Homo sapiens
ucucuguguaguuccagcaa

SEQ ID NO: 518651 - RNA, 16 nt, Homo sapiens
ucucuuagcaacucag

SEQ ID NO: 518652 - RNA, 21 nt, Homo sapiens
ccugugaggcagccuucugau

SEQ ID NO: 518653 - RNA, 22 nt, Homo sapiens
ccuguggguuugguccuugaac

SEQ ID NO: 518654 - RNA, 15 nt, Homo sapiens
ccuguugucaagaau

SEQ ID NO: 518655 - RNA, 18 nt, Homo sapiens
ccuuaagauuuugcaccu

SEQ ID NO: 518656 - RNA, 23 nt, Homo sapiens
ccuuaauuuagaaacugaaaaau

SEQ ID NO: 518657 - RNA, 14 nt, Homo sapiens
ccuuacaucuggcu

SEQ ID NO: 518658 - RNA, 23 nt, Homo sapiens
ccuucagauccuuuuauucucca

SEQ ID NO: 518659 - RNA, 21 nt, Homo sapiens
ccuucagcaugccugaacuac

SEQ ID NO: 518660 - RNA, 22 nt, Homo sapiens
ccuuccaacccauuagccauuu

SEQ ID NO: 518661 - RNA, 17 nt, Homo sapiens
ccuuccaaugcuucugu

SEQ ID NO: 518662 - RNA, 23 nt, Homo sapiens
ccuucccagaauguuacugacuc

SEQ ID NO: 518663 - RNA, 16 nt, Homo sapiens
ccuuggcugacaugaa

SEQ ID NO: 518664 - RNA, 15 nt, Homo sapiens
ccuuuaggaucucag

SEQ ID NO: 518665 - RNA, 14 nt, Homo sapiens
ccuuucaaagcacu

SEQ ID NO: 518666 - RNA, 15 nt, Homo sapiens
ccuuucacucugcau

SEQ ID NO: 518667 - RNA, 16 nt, Homo sapiens
ccuuucauaccuugaa

SEQ ID NO: 518668 - RNA, 17 nt, Homo sapiens
ccuuucucaacuguccc

SEQ ID NO: 518669 - RNA, 15 nt, Homo sapiens
ccuuuuaacucaccu

SEQ ID NO: 518670 - RNA, 15 nt, Homo sapiens
ccuuuuacucagcuu

SEQ ID NO: 518671 - RNA, 18 nt, Homo sapiens
ccuuuuccaugacugugg

SEQ ID NO: 518672 - RNA, 12 nt, Homo sapiens
ccuuuugugcaa

SEQ ID NO: 518673 - RNA, 22 nt, Homo sapiens
cgaaggaaccuguguuaucaca

SEQ ID NO: 518674 - RNA, 21 nt, Homo sapiens
cgagaucaugccauugcauuc

SEQ ID NO: 518675 - RNA, 17 nt, Homo sapiens
cgccuccccaccuccag

SEQ ID NO: 518676 - RNA, 23 nt, Homo sapiens
cgccuggaggagacgcuggacuu

SEQ ID NO: 518677 - RNA, 22 nt, Homo sapiens
cgcuagagauugcuacaaaucu

SEQ ID NO: 518678 - RNA, 15 nt, Homo sapiens
cgcucgccacagucc

SEQ ID NO: 518679 - RNA, 17 nt, Homo sapiens
cgcuuaucaacuaauga

SEQ ID NO: 518680 - RNA, 23 nt, Homo sapiens
cggaauucaaguuaccaauguaa

SEQ ID NO: 518681 - RNA, 14 nt, Homo sapiens
cggcagcacaagcu

SEQ ID NO: 518682 - RNA, 18 nt, Homo sapiens
cggcaucaaggugcugaa

SEQ ID NO: 518683 - RNA, 17 nt, Homo sapiens
cggccucugccuuugca

SEQ ID NO: 518684 - RNA, 19 nt, Homo sapiens
cggcuccucggacucugcu

SEQ ID NO: 518685 - RNA, 14 nt, Homo sapiens
cggcuugauuuccg

SEQ ID NO: 518686 - RNA, 12 nt, Homo sapiens
cggcuuuaccaa

SEQ ID NO: 518687 - RNA, 13 nt, Homo sapiens
cgggcaccuguag

SEQ ID NO: 518688 - RNA, 21 nt, Homo sapiens
cggggaagugcucuaacuuuu

SEQ ID NO: 518689 - RNA, 13 nt, Homo sapiens
cggguaccugaag

SEQ ID NO: 518690 - RNA, 23 nt, Homo sapiens
cgguccgcagaagcagaccucau

SEQ ID NO: 518691 - RNA, 22 nt, Homo sapiens
cgguggacucucauguggccaa

SEQ ID NO: 518692 - RNA, 14 nt, Homo sapiens
cgguuaccucugca

SEQ ID NO: 518693 - RNA, 13 nt, Homo sapiens
cgucaagacauuu

SEQ ID NO: 518694 - RNA, 15 nt, Homo sapiens
cgucagcugcucccu

SEQ ID NO: 518695 - RNA, 17 nt, Homo sapiens
cgucaucaucacauuca

SEQ ID NO: 518696 - RNA, 19 nt, Homo sapiens
cguccucagcaguccacaa

SEQ ID NO: 518697 - RNA, 14 nt, Homo sapiens
cgucuaugcugcuu

SEQ ID NO: 518698 - RNA, 19 nt, Homo sapiens
cgugagauccggcagcaca

SEQ ID NO: 518699 - RNA, 22 nt, Homo sapiens
cgugcaugcucugcagcauuga

SEQ ID NO: 518700 - RNA, 19 nt, Homo sapiens
cgugcuacugcacuccagc

SEQ ID NO: 518701 - RNA, 18 nt, Homo sapiens
cgugggccgaggugacug

SEQ ID NO: 518702 - RNA, 18 nt, Homo sapiens
cguggugaccuuucacga

SEQ ID NO: 518703 - RNA, 22 nt, Homo sapiens
cguugacaaguuuuguggggcu

SEQ ID NO: 518704 - RNA, 18 nt, Homo sapiens
cguuugugagcucccagc

SEQ ID NO: 518705 - RNA, 18 nt, Homo sapiens
cuaaaauauauuccugag

SEQ ID NO: 518706 - RNA, 21 nt, Homo sapiens
cuaaaguuuugcaacaauaaa

SEQ ID NO: 518707 - RNA, 17 nt, Homo sapiens
gaucaaggaguacaaug

SEQ ID NO: 518708 - RNA, 15 nt, Homo sapiens
gaucagcgacccuga

SEQ ID NO: 518709 - RNA, 22 nt, Homo sapiens
gaucaucgccagaggugcuuca

SEQ ID NO: 518710 - RNA, 22 nt, Homo sapiens
gaucguuuuuucccagggcaag

SEQ ID NO: 518711 - RNA, 12 nt, Homo sapiens
gaucucaguauu

SEQ ID NO: 518712 - RNA, 14 nt, Homo sapiens
gaucucaguauugu

SEQ ID NO: 518713 - RNA, 17 nt, Homo sapiens
gaucucaguauugucag

SEQ ID NO: 518714 - RNA, 18 nt, Homo sapiens
gaucucggcucacugcaa

SEQ ID NO: 518715 - RNA, 15 nt, Homo sapiens
gaugaaagagccaga

SEQ ID NO: 518716 - RNA, 15 nt, Homo sapiens
gaugacacuagucag

SEQ ID NO: 518717 - RNA, 14 nt, Homo sapiens
gaugacccacuguc

SEQ ID NO: 518718 - RNA, 18 nt, Homo sapiens
gaugagcaagacauacuu

SEQ ID NO: 518719 - RNA, 21 nt, Homo sapiens
gaugagcuuugucuacuucaa

SEQ ID NO: 518720 - RNA, 22 nt, Homo sapiens
gaugaggaccaagggcaccugg

SEQ ID NO: 518721 - RNA, 14 nt, Homo sapiens
gaugcaagugcaac

SEQ ID NO: 518722 - RNA, 18 nt, Homo sapiens
gaugcgcacugcauucca

SEQ ID NO: 518723 - RNA, 22 nt, Homo sapiens
gaugcugaggguguuucuuccu

SEQ ID NO: 518724 - RNA, 15 nt, Homo sapiens
gauggaaaauaccag

SEQ ID NO: 518725 - RNA, 14 nt, Homo sapiens
gaugggagaguaaa

SEQ ID NO: 518726 - RNA, 23 nt, Homo sapiens
gauguuuuauccuuacaauguga

SEQ ID NO: 518727 - RNA, 21 nt, Homo sapiens
gauuacugaauuguaucaauu

SEQ ID NO: 518728 - RNA, 16 nt, Homo sapiens
gauucccaacugagug

SEQ ID NO: 518729 - RNA, 20 nt, Homo sapiens
gauucuccagccaaccucau

SEQ ID NO: 518730 - RNA, 19 nt, Homo sapiens
gauucucccaaaguaccuu

SEQ ID NO: 518731 - RNA, 16 nt, Homo sapiens
gauuuccuuaaccuua

SEQ ID NO: 518732 - RNA, 12 nt, Homo sapiens
gauuuccuugac

SEQ ID NO: 518733 - RNA, 22 nt, Homo sapiens
gauuuugaaauauaguaaacac

SEQ ID NO: 518734 - RNA, 20 nt, Homo sapiens
gauuuugcuugagcaggauu

SEQ ID NO: 518735 - RNA, 19 nt, Homo sapiens
gcaaaaauggauauuauua

SEQ ID NO: 518736 - RNA, 21 nt, Homo sapiens
gcaaaauugucuaaaauguca

SEQ ID NO: 518737 - RNA, 19 nt, Homo sapiens
gcaaagguauuaguacaau

SEQ ID NO: 518738 - RNA, 17 nt, Homo sapiens
gcaaaguguaugugacc

SEQ ID NO: 518739 - RNA, 20 nt, Homo sapiens
gcaacagaagugguuuccca

SEQ ID NO: 518740 - RNA, 16 nt, Homo sapiens
gcaacagauagauguu

SEQ ID NO: 518741 - RNA, 18 nt, Homo sapiens
gcaacagauagauguugc

SEQ ID NO: 518742 - RNA, 23 nt, Homo sapiens
gcaacagauagauguugcucuuu

SEQ ID NO: 518743 - RNA, 13 nt, Homo sapiens
gcaaccugacuca

SEQ ID NO: 518744 - RNA, 22 nt, Homo sapiens
gcaagaugaaugcagauuacac

SEQ ID NO: 518745 - RNA, 23 nt, Homo sapiens
gcaagaugcgcacugcauuccac

SEQ ID NO: 518746 - RNA, 17 nt, Homo sapiens
gcaagucuuccaugacc

SEQ ID NO: 518747 - RNA, 12 nt, Homo sapiens
gcaaguuugcac

SEQ ID NO: 518748 - RNA, 23 nt, Homo sapiens
gcaauggugucaguauccaggcu

SEQ ID NO: 518749 - RNA, 12 nt, Homo sapiens
gcacacacugug

SEQ ID NO: 518750 - RNA, 18 nt, Homo sapiens
gcacagacugucuugaac

SEQ ID NO: 518751 - RNA, 21 nt, Homo sapiens
gcaccuaccuuagaaaacaag

SEQ ID NO: 518752 - RNA, 21 nt, Homo sapiens
gcaccuguagucccagcuacu

SEQ ID NO: 518753 - RNA, 16 nt, Homo sapiens
gcaccuucacucucca

SEQ ID NO: 518754 - RNA, 14 nt, Homo sapiens
gcacuacaguuuua

SEQ ID NO: 518755 - RNA, 21 nt, Homo sapiens
gcacugguggccguggugggg

SEQ ID NO: 518756 - RNA, 20 nt, Homo sapiens
gcagaacugaagugugcugu

SEQ ID NO: 518757 - RNA, 13 nt, Homo sapiens
gcagaacuugaag

SEQ ID NO: 518758 - RNA, 13 nt, Homo sapiens
gcagaauggacuu

SEQ ID NO: 518759 - RNA, 21 nt, Homo sapiens
gcagacaucggccuccaugac

SEQ ID NO: 518760 - RNA, 16 nt, Homo sapiens
gcagacccagucccac

SEQ ID NO: 518761 - RNA, 21 nt, Homo sapiens
gcagaguuuccaaaaccagaa

SEQ ID NO: 518762 - RNA, 17 nt, Homo sapiens
gcagcugccucugcucc

SEQ ID NO: 518763 - RNA, 14 nt, Homo sapiens
gcaggaaggaggug

SEQ ID NO: 518764 - RNA, 16 nt, Homo sapiens
gcaggaccucaccaaa

SEQ ID NO: 518765 - RNA, 18 nt, Homo sapiens
gcaggagaauggugugaa

SEQ ID NO: 518766 - RNA, 16 nt, Homo sapiens
gcaggaggaucacuug

SEQ ID NO: 518767 - RNA, 18 nt, Homo sapiens
gcaggcauggauccagaa

SEQ ID NO: 518768 - RNA, 16 nt, Homo sapiens
gcaggcuaacgcagga

SEQ ID NO: 518769 - RNA, 15 nt, Homo sapiens
gcaggcugggccaug

SEQ ID NO: 518770 - RNA, 15 nt, Homo sapiens
gcagggacuuuccug

SEQ ID NO: 518771 - RNA, 18 nt, Homo sapiens
gcagggcccagugacaag

SEQ ID NO: 518772 - RNA, 15 nt, Homo sapiens
gcagggcuggcacgu

SEQ ID NO: 518773 - RNA, 16 nt, Homo sapiens
gcaggugacauuugcu

SEQ ID NO: 518774 - RNA, 20 nt, Homo sapiens
gcaggugacauuugcucuga

SEQ ID NO: 518775 - RNA, 12 nt, Homo sapiens
gcaggugcgauu

SEQ ID NO: 518776 - RNA, 23 nt, Homo sapiens
gcaguauauaggugcuggaugua

SEQ ID NO: 518777 - RNA, 12 nt, Homo sapiens
gcaguccaucua

SEQ ID NO: 518778 - RNA, 15 nt, Homo sapiens
gcagucccacacugu

SEQ ID NO: 518779 - RNA, 16 nt, Homo sapiens
gcagugagcugagauc

SEQ ID NO: 518780 - RNA, 20 nt, Homo sapiens
gcagugccaaaauauaauca

SEQ ID NO: 518781 - RNA, 15 nt, Homo sapiens
gccugacacauagaa

SEQ ID NO: 518782 - RNA, 21 nt, Homo sapiens
gccugcagcaggaguggugca

SEQ ID NO: 518783 - RNA, 20 nt, Homo sapiens
gccugcccccuugggugacc

SEQ ID NO: 518784 - RNA, 23 nt, Homo sapiens
gccugcucccuagccagaggcuc

SEQ ID NO: 518785 - RNA, 22 nt, Homo sapiens
gccuggcccaccuuccccagaa

SEQ ID NO: 518786 - RNA, 13 nt, Homo sapiens
gccuguaauccca

SEQ ID NO: 518787 - RNA, 19 nt, Homo sapiens
gccuguaaucccagcacuu

SEQ ID NO: 518788 - RNA, 12 nt, Homo sapiens
gccugugccagc

SEQ ID NO: 518789 - RNA, 12 nt, Homo sapiens
gccuguggaaug

SEQ ID NO: 518790 - RNA, 20 nt, Homo sapiens
gccuguggaaugagugugca

SEQ ID NO: 518791 - RNA, 20 nt, Homo sapiens
gccuguuccgcauccuggag

SEQ ID NO: 518792 - RNA, 15 nt, Homo sapiens
gccuuacaucuggcu

SEQ ID NO: 518793 - RNA, 21 nt, Homo sapiens
gccuucaucuucacugcaauu

SEQ ID NO: 518794 - RNA, 12 nt, Homo sapiens
gccuuucuuugc

SEQ ID NO: 518795 - RNA, 19 nt, Homo sapiens
gccuuuugugcaaagccaa

SEQ ID NO: 518796 - RNA, 23 nt, Homo sapiens
gcgagaggugagcuacuuuguga

SEQ ID NO: 518797 - RNA, 16 nt, Homo sapiens
gcgauucuggauaaag

SEQ ID NO: 518798 - RNA, 21 nt, Homo sapiens
gcgccugccaucaugccugac

SEQ ID NO: 518799 - RNA, 16 nt, Homo sapiens
gcgcugcuugguguga

SEQ ID NO: 518800 - RNA, 15 nt, Homo sapiens
gcggaucucuggagu

SEQ ID NO: 518801 - RNA, 17 nt, Homo sapiens
gcggcugcacaacagcc

SEQ ID NO: 518802 - RNA, 12 nt, Homo sapiens
gcgguggcucac

SEQ ID NO: 518803 - RNA, 15 nt, Homo sapiens
gcguccucugacccc

SEQ ID NO: 518804 - RNA, 14 nt, Homo sapiens
gcgucuaugcugcu

SEQ ID NO: 518805 - RNA, 16 nt, Homo sapiens
gcgugugccugugugc

SEQ ID NO: 518806 - RNA, 16 nt, Homo sapiens
gcguguuggugugcac

SEQ ID NO: 518807 - RNA, 14 nt, Homo sapiens
gcguucuucauuca

SEQ ID NO: 518808 - RNA, 16 nt, Homo sapiens
gcuaaacugaugacuu

SEQ ID NO: 518809 - RNA, 17 nt, Homo sapiens
gcuaaacugaugacuua

SEQ ID NO: 518810 - RNA, 17 nt, Homo sapiens
gcuaagauaccaaaacc

SEQ ID NO: 518811 - RNA, 17 nt, Homo sapiens
gcuaagggugggugcuc

SEQ ID NO: 518812 - RNA, 21 nt, Homo sapiens
gcuacagaaaccacagucuuc

SEQ ID NO: 518813 - RNA, 16 nt, Homo sapiens
gcuagguaucauucaa

SEQ ID NO: 518814 - RNA, 19 nt, Homo sapiens
gcuaguguaccuccucuca

SEQ ID NO: 518815 - RNA, 16 nt, Homo sapiens
gcuauaccagcagaaa

SEQ ID NO: 518816 - RNA, 13 nt, Homo sapiens
gcucaauuccuuc

SEQ ID NO: 518817 - RNA, 17 nt, Homo sapiens
gcucaccgcccaucagg

SEQ ID NO: 518818 - RNA, 15 nt, Homo sapiens
gcucagaauaaggca

SEQ ID NO: 518819 - RNA, 18 nt, Homo sapiens
gcucagauuguaauaugu

SEQ ID NO: 518820 - RNA, 20 nt, Homo sapiens
gcucaggguggucucuucuu

SEQ ID NO: 518821 - RNA, 20 nt, Homo sapiens
gcucagucccucugcucuca

SEQ ID NO: 518822 - RNA, 16 nt, Homo sapiens
gcucagugccuggaca

SEQ ID NO: 518823 - RNA, 22 nt, Homo sapiens
gcucauuuuuucuucuccuaaa

SEQ ID NO: 518824 - RNA, 20 nt, Homo sapiens
gcuccacuuucucauccgaa

SEQ ID NO: 518825 - RNA, 19 nt, Homo sapiens
gcuccaucccaaccaggca

SEQ ID NO: 518826 - RNA, 22 nt, Homo sapiens
gcuccuccccuuccucuugucu

SEQ ID NO: 518827 - RNA, 13 nt, Homo sapiens
gcuccuccucacc

SEQ ID NO: 518828 - RNA, 14 nt, Homo sapiens
gcuccugcaucuca

SEQ ID NO: 518829 - RNA, 20 nt, Homo sapiens
gcucguuuacacugcacauu

SEQ ID NO: 518830 - RNA, 15 nt, Homo sapiens
gcucuaauguacaau

SEQ ID NO: 518831 - RNA, 23 nt, Homo sapiens
gcucuaauguacaauaaagcaau

SEQ ID NO: 518832 - RNA, 14 nt, Homo sapiens
gcucucgacaguau

SEQ ID NO: 518833 - RNA, 23 nt, Homo sapiens
gcucugcaccccucugcccucau

SEQ ID NO: 518834 - RNA, 17 nt, Homo sapiens
gcugaaaaaucauccaa

SEQ ID NO: 518835 - RNA, 22 nt, Homo sapiens
gcugaaugccuccuguggggaa

SEQ ID NO: 518836 - RNA, 19 nt, Homo sapiens
gcugacacgcucaguugaa

SEQ ID NO: 518837 - RNA, 18 nt, Homo sapiens
gcugagauuacucugaaa

SEQ ID NO: 518838 - RNA, 20 nt, Homo sapiens
gcugauuauuuaugaccuga

SEQ ID NO: 518839 - RNA, 14 nt, Homo sapiens
gcugccuggcacag

SEQ ID NO: 518840 - RNA, 17 nt, Homo sapiens
gcugccuggcacagacc

SEQ ID NO: 518841 - RNA, 22 nt, Homo sapiens
gcugcugccccuuaaacacagg

SEQ ID NO: 518842 - RNA, 14 nt, Homo sapiens
gcugcuggagccca

SEQ ID NO: 518843 - RNA, 17 nt, Homo sapiens
gcugcugggucaggcca

SEQ ID NO: 518844 - RNA, 15 nt, Homo sapiens
gcugcuugcugcuca

SEQ ID NO: 518845 - RNA, 19 nt, Homo sapiens
gcugcuuuaggaauucugc

SEQ ID NO: 518846 - RNA, 12 nt, Homo sapiens
gcuggaaccagc

SEQ ID NO: 518847 - RNA, 22 nt, Homo sapiens
gcuggcaagucuuccaugaccc

SEQ ID NO: 518848 - RNA, 17 nt, Homo sapiens
gcuggcucacaguacag

SEQ ID NO: 518849 - RNA, 20 nt, Homo sapiens
gcuggcuggaaaaaggugaa

SEQ ID NO: 518850 - RNA, 19 nt, Homo sapiens
gcugggccauguccaaaga

SEQ ID NO: 518851 - RNA, 18 nt, Homo sapiens
gcuggucucaaacuccug

SEQ ID NO: 518852 - RNA, 16 nt, Homo sapiens
gcuguauaaagcaugu

SEQ ID NO: 518853 - RNA, 23 nt, Homo sapiens
gcuguauuuuuauuuuugcacaa

SEQ ID NO: 518854 - RNA, 19 nt, Homo sapiens
gcugucguuguuguggaag

SEQ ID NO: 518855 - RNA, 23 nt, Homo sapiens
gcugugggaaguccucccuggug

SEQ ID NO: 518856 - RNA, 17 nt, Homo sapiens
gggcaguccuuacuccc

SEQ ID NO: 518857 - RNA, 18 nt, Homo sapiens
gggccagggucuguguga

SEQ ID NO: 518858 - RNA, 13 nt, Homo sapiens
gggccauggcuca

SEQ ID NO: 518859 - RNA, 14 nt, Homo sapiens
gggccguggcacag

SEQ ID NO: 518860 - RNA, 20 nt, Homo sapiens
gggccugagagaauuggcuc

SEQ ID NO: 518861 - RNA, 18 nt, Homo sapiens
gggccuuucuguguccua

SEQ ID NO: 518862 - RNA, 18 nt, Homo sapiens
gggcucauuuuugcacuu

SEQ ID NO: 518863 - RNA, 22 nt, Homo sapiens
gggcucugccccaccuggagaa

SEQ ID NO: 518864 - RNA, 17 nt, Homo sapiens
gggcuggcacgugacag

SEQ ID NO: 518865 - RNA, 18 nt, Homo sapiens
ggggaacugcguggugcu

SEQ ID NO: 518866 - RNA, 15 nt, Homo sapiens
ggggacugucuuuca

SEQ ID NO: 518867 - RNA, 23 nt, Homo sapiens
ggggcaccuuaagauuuugcacc

SEQ ID NO: 518868 - RNA, 23 nt, Homo sapiens
gggucaaggaguacuccaagaca

SEQ ID NO: 518869 - RNA, 20 nt, Homo sapiens
gggucccaucagugaaagaa

SEQ ID NO: 518870 - RNA, 18 nt, Homo sapiens
gggucugggccagugcac

SEQ ID NO: 518871 - RNA, 16 nt, Homo sapiens
gggugacggcccucau

SEQ ID NO: 518872 - RNA, 22 nt, Homo sapiens
gggugauuuuaugaucaguguu

SEQ ID NO: 518873 - RNA, 17 nt, Homo sapiens
gggugguggaaggcagc

SEQ ID NO: 518874 - RNA, 21 nt, Homo sapiens
ggguucuuggugaugcuggca

SEQ ID NO: 518875 - RNA, 19 nt, Homo sapiens
ggguuggacuguaagggau

SEQ ID NO: 518876 - RNA, 13 nt, Homo sapiens
gguaaauguuucu

SEQ ID NO: 518877 - RNA, 18 nt, Homo sapiens
gguaaauuuuuaggcaaa

SEQ ID NO: 518878 - RNA, 21 nt, Homo sapiens
gguaaggugugaaccuaccug

SEQ ID NO: 518879 - RNA, 20 nt, Homo sapiens
gguaccaauucagugucugu

SEQ ID NO: 518880 - RNA, 18 nt, Homo sapiens
gguaguuagccaucuaau

SEQ ID NO: 518881 - RNA, 22 nt, Homo sapiens
gguaugucauucgcuacuauga

SEQ ID NO: 518882 - RNA, 16 nt, Homo sapiens
ggucaaguaagaagac

SEQ ID NO: 518883 - RNA, 15 nt, Homo sapiens
ggucaggcgcagugg

SEQ ID NO: 518884 - RNA, 16 nt, Homo sapiens
ggucauccugccccug

SEQ ID NO: 518885 - RNA, 13 nt, Homo sapiens
gguccuuuggaca

SEQ ID NO: 518886 - RNA, 18 nt, Homo sapiens
ggucgccgcacuucugau

SEQ ID NO: 518887 - RNA, 19 nt, Homo sapiens
ggucuccccuccugcacac

SEQ ID NO: 518888 - RNA, 23 nt, Homo sapiens
ggucuccccuccugcacacaggg

SEQ ID NO: 518889 - RNA, 23 nt, Homo sapiens
ggucuugugguuguguguguucu

SEQ ID NO: 518890 - RNA, 22 nt, Homo sapiens
ggugaaacuaacagauaagcaa

SEQ ID NO: 518891 - RNA, 13 nt, Homo sapiens
ggugaaguaaauu

SEQ ID NO: 518892 - RNA, 15 nt, Homo sapiens
ggugagcuccagcug

SEQ ID NO: 518893 - RNA, 17 nt, Homo sapiens
ggugauccgccuaccuc

SEQ ID NO: 518894 - RNA, 10 nt, Homo sapiens
ggugcacagc

SEQ ID NO: 518895 - RNA, 19 nt, Homo sapiens
ggugcauagcaagugaaag

SEQ ID NO: 518896 - RNA, 16 nt, Homo sapiens
ggugcucuuugcugca

SEQ ID NO: 518897 - RNA, 15 nt, Homo sapiens
ggugcugcagcaccg

SEQ ID NO: 518898 - RNA, 19 nt, Homo sapiens
gguggaaggcagacagcag

SEQ ID NO: 518899 - RNA, 19 nt, Homo sapiens
augauagcaaauggccuca

SEQ ID NO: 518900 - RNA, 16 nt, Homo sapiens
augauaguuaaacuac

SEQ ID NO: 518901 - RNA, 20 nt, Homo sapiens
augaucacauucuuuccaaa

SEQ ID NO: 518902 - RNA, 19 nt, Homo sapiens
augcaaaugagcucugaaa

SEQ ID NO: 518903 - RNA, 15 nt, Homo sapiens
augcaacucuaacuc

SEQ ID NO: 518904 - RNA, 16 nt, Homo sapiens
augcaccccugagcca

SEQ ID NO: 518905 - RNA, 18 nt, Homo sapiens
augcaccccugagccagc

SEQ ID NO: 518906 - RNA, 17 nt, Homo sapiens
augcagauuacacugau

SEQ ID NO: 518907 - RNA, 15 nt, Homo sapiens
augcagcuauuucaa

SEQ ID NO: 518908 - RNA, 19 nt, Homo sapiens
augcaguauucuugcacug

SEQ ID NO: 518909 - RNA, 20 nt, Homo sapiens
augcaguauucuugcacuga

SEQ ID NO: 518910 - RNA, 17 nt, Homo sapiens
augcauuauaucaaauc

SEQ ID NO: 518911 - RNA, 21 nt, Homo sapiens
augccaauaauaaaugcccuc

SEQ ID NO: 518912 - RNA, 23 nt, Homo sapiens
augccuguaaucccagcacuuug

SEQ ID NO: 518913 - RNA, 20 nt, Homo sapiens
augccuuacgaaccaugccu

SEQ ID NO: 518914 - RNA, 22 nt, Homo sapiens
augcugaaaaaucauccaagac

SEQ ID NO: 518915 - RNA, 18 nt, Homo sapiens
augcugcccgcucugcag

SEQ ID NO: 518916 - RNA, 21 nt, Homo sapiens
augcugcuuuaggaauucugc

SEQ ID NO: 518917 - RNA, 16 nt, Homo sapiens
augcuggcagccaugg

SEQ ID NO: 518918 - RNA, 17 nt, Homo sapiens
augcugguacuauugug

SEQ ID NO: 518919 - RNA, 20 nt, Homo sapiens
augcugucaagcaccugcau

SEQ ID NO: 518920 - RNA, 15 nt, Homo sapiens
augcuuccugacaau

SEQ ID NO: 518921 - RNA, 19 nt, Homo sapiens
augcuucuguugaucucag

SEQ ID NO: 518922 - RNA, 15 nt, Homo sapiens
augcuuuugcuugca

SEQ ID NO: 518923 - RNA, 17 nt, Homo sapiens
auggaaaaacugaggcu

SEQ ID NO: 518924 - RNA, 20 nt, Homo sapiens
auggaacagcauuacccucc

SEQ ID NO: 518925 - RNA, 20 nt, Homo sapiens
auggaaguuuuccuacacuu

SEQ ID NO: 518926 - RNA, 15 nt, Homo sapiens
auggaggcccuccug

SEQ ID NO: 518927 - RNA, 15 nt, Homo sapiens
auggauauuauuaga

SEQ ID NO: 518928 - RNA, 21 nt, Homo sapiens
auggccagagaugcuggacuu

SEQ ID NO: 518929 - RNA, 23 nt, Homo sapiens
auggcccaugggagccaggccca

SEQ ID NO: 518930 - RNA, 14 nt, Homo sapiens
auggcucagggugg

SEQ ID NO: 518931 - RNA, 20 nt, Homo sapiens
auggcuccggccucugccuu

SEQ ID NO: 518932 - RNA, 16 nt, Homo sapiens
augggcaaaaaaccaa

SEQ ID NO: 518933 - RNA, 15 nt, Homo sapiens
auggguugcauuugg

SEQ ID NO: 518934 - RNA, 16 nt, Homo sapiens
auggucuaacacuggc

SEQ ID NO: 518935 - RNA, 22 nt, Homo sapiens
augguguagcccucccacuuug

SEQ ID NO: 518936 - RNA, 11 nt, Homo sapiens
augguguuaca

SEQ ID NO: 518937 - RNA, 17 nt, Homo sapiens
augguucccaagcguca

SEQ ID NO: 518938 - RNA, 13 nt, Homo sapiens
auguaacugcuga

SEQ ID NO: 518939 - RNA, 17 nt, Homo sapiens
auguacaauaaagcaau

SEQ ID NO: 518940 - RNA, 20 nt, Homo sapiens
auguacaauaaagcaaugug

SEQ ID NO: 518941 - RNA, 13 nt, Homo sapiens
auguacaucuuuc

SEQ ID NO: 518942 - RNA, 22 nt, Homo sapiens
auguaccaccaacuacuaccug

SEQ ID NO: 518943 - RNA, 15 nt, Homo sapiens
auguagcccauccuu

SEQ ID NO: 518944 - RNA, 19 nt, Homo sapiens
auguauauauauauaugca

SEQ ID NO: 518945 - RNA, 13 nt, Homo sapiens
auguaugucagaa

SEQ ID NO: 518946 - RNA, 12 nt, Homo sapiens
auguccaaagag

SEQ ID NO: 518947 - RNA, 17 nt, Homo sapiens
cuucuguugaucucagu

SEQ ID NO: 518948 - RNA, 20 nt, Homo sapiens
cuucuucucuccacauggaa

SEQ ID NO: 518949 - RNA, 13 nt, Homo sapiens
cuucuugcucccc

SEQ ID NO: 518950 - RNA, 15 nt, Homo sapiens
cuugaaaaaugacaa

SEQ ID NO: 518951 - RNA, 16 nt, Homo sapiens
cuugagaccauuucaa

SEQ ID NO: 518952 - RNA, 14 nt, Homo sapiens
cuugaugacugcug

SEQ ID NO: 518953 - RNA, 16 nt, Homo sapiens
cuugcaauaccaaugu

SEQ ID NO: 518954 - RNA, 18 nt, Homo sapiens
cuugcaggugacauuugc

SEQ ID NO: 518955 - RNA, 12 nt, Homo sapiens
cuugcucagugg

SEQ ID NO: 518956 - RNA, 18 nt, Homo sapiens
cuuggaaaugguggugcu

SEQ ID NO: 518957 - RNA, 14 nt, Homo sapiens
cuuggcugacauga

SEQ ID NO: 518958 - RNA, 15 nt, Homo sapiens
cuuggggcccagugc

SEQ ID NO: 518959 - RNA, 14 nt, Homo sapiens
cuuggugaugcugg

SEQ ID NO: 518960 - RNA, 17 nt, Homo sapiens
cuuggugcccucgccuc

SEQ ID NO: 518961 - RNA, 14 nt, Homo sapiens
cuuggugguggaug

SEQ ID NO: 518962 - RNA, 15 nt, Homo sapiens
cuuguaacuaaaaua

SEQ ID NO: 518963 - RNA, 23 nt, Homo sapiens
cuuguaacuaaaauaauuuugua

SEQ ID NO: 518964 - RNA, 16 nt, Homo sapiens
cuugucgggcacagau

SEQ ID NO: 518965 - RNA, 17 nt, Homo sapiens
cuugugaaacgucugga

SEQ ID NO: 518966 - RNA, 22 nt, Homo sapiens
cuuguucagcaggcuagacaga

SEQ ID NO: 518967 - RNA, 13 nt, Homo sapiens
cuuguucccacac

SEQ ID NO: 518968 - RNA, 13 nt, Homo sapiens
cuuguugucucca

SEQ ID NO: 518969 - RNA, 20 nt, Homo sapiens
cuuguuugguaguuagccau

SEQ ID NO: 518970 - RNA, 14 nt, Homo sapiens
cuuuaaaaugccaa

SEQ ID NO: 518971 - RNA, 14 nt, Homo sapiens
cuuuaaacaccccc

SEQ ID NO: 518972 - RNA, 19 nt, Homo sapiens
cuuuaaucacugcauuuca

SEQ ID NO: 518973 - RNA, 16 nt, Homo sapiens
cuuuaggagauuuauu

SEQ ID NO: 518974 - RNA, 17 nt, Homo sapiens
cuuuaggaucucaggcu

SEQ ID NO: 518975 - RNA, 12 nt, Homo sapiens
cuuuauuucucu

SEQ ID NO: 518976 - RNA, 18 nt, Homo sapiens
cuuucauuugcuuuggaa

SEQ ID NO: 518977 - RNA, 13 nt, Homo sapiens
cuuuccccaaaga

SEQ ID NO: 518978 - RNA, 14 nt, Homo sapiens
cuuuccccaaagac

SEQ ID NO: 518979 - RNA, 23 nt, Homo sapiens
cuuucccgcccagccucacuucc

SEQ ID NO: 518980 - RNA, 15 nt, Homo sapiens
cuuucuaauguuucu

SEQ ID NO: 518981 - RNA, 17 nt, Homo sapiens
cuuucucaacuguccca

SEQ ID NO: 518982 - RNA, 21 nt, Homo sapiens
cuuucucaaucuugaacucau

SEQ ID NO: 518983 - RNA, 14 nt, Homo sapiens
cuuucucucucuaa

SEQ ID NO: 518984 - RNA, 16 nt, Homo sapiens
cuuucuguugccaugg

SEQ ID NO: 518985 - RNA, 19 nt, Homo sapiens
cuuugagaccuuuccucuc

SEQ ID NO: 518986 - RNA, 17 nt, Homo sapiens
cuuugcagccccacaga

SEQ ID NO: 518987 - RNA, 18 nt, Homo sapiens
cuuugcagccccacagac

SEQ ID NO: 518988 - RNA, 23 nt, Homo sapiens
cuuugccucuucuuugugccuuu

SEQ ID NO: 518989 - RNA, 17 nt, Homo sapiens
cuuugcugcagucaucu

SEQ ID NO: 518990 - RNA, 17 nt, Homo sapiens
cuuuggagaugcugagg

SEQ ID NO: 518991 - RNA, 17 nt, Homo sapiens
cuuugucgugguucuua

SEQ ID NO: 518992 - RNA, 18 nt, Homo sapiens
cuuugucgugguucuuaa

SEQ ID NO: 518993 - RNA, 23 nt, Homo sapiens
cuuuguucuggggggacccagug

SEQ ID NO: 518994 - RNA, 21 nt, Homo sapiens
cuuuuacccggcacauucccc

SEQ ID NO: 518995 - RNA, 16 nt, Homo sapiens
cuuuucauuuggaaug

SEQ ID NO: 518996 - RNA, 17 nt, Homo sapiens
cuuuucccauugccaug

SEQ ID NO: 518997 - RNA, 16 nt, Homo sapiens
cuuuuuuucuaugaaa

SEQ ID NO: 518998 - RNA, 22 nt, Homo sapiens
gaaaaauauaauguugauaaua

SEQ ID NO: 518999 - RNA, 18 nt, Homo sapiens
gaaaaaucauccaagaca

SEQ ID NO: 519000 - RNA, 17 nt, Homo sapiens
gaaaacagaugaccaua

SEQ ID NO: 519001 - RNA, 14 nt, Homo sapiens
gaaaacauguacua

SEQ ID NO: 519002 - RNA, 21 nt, Homo sapiens
gaaaaggucugaggacugagc

SEQ ID NO: 519003 - RNA, 14 nt, Homo sapiens
gaaaagugcauauu

SEQ ID NO: 519004 - RNA, 23 nt, Homo sapiens
gaaaaguguccuucuugcucccc

SEQ ID NO: 519005 - RNA, 15 nt, Homo sapiens
gaaaaugacucuggg

SEQ ID NO: 519006 - RNA, 15 nt, Homo sapiens
gaaaauuacagucca

SEQ ID NO: 519007 - RNA, 22 nt, Homo sapiens
gaaacaauggcuaagauaccaa

SEQ ID NO: 519008 - RNA, 20 nt, Homo sapiens
gaaaccaaggaaagugaaac

SEQ ID NO: 519009 - RNA, 21 nt, Homo sapiens
gaaaccuggucucuacauaaa

SEQ ID NO: 519010 - RNA, 19 nt, Homo sapiens
gaaacgucuggacugcuau

SEQ ID NO: 519011 - RNA, 23 nt, Homo sapiens
gaaacuccagaugccacaaugga

SEQ ID NO: 519012 - RNA, 17 nt, Homo sapiens
gaaacugagaccaaaga

SEQ ID NO: 519013 - RNA, 21 nt, Homo sapiens
gaaagaccaucuccccaggcu

SEQ ID NO: 519014 - RNA, 18 nt, Homo sapiens
gaaagagacuccgucuca

SEQ ID NO: 519015 - RNA, 18 nt, Homo sapiens
gaaagcaaguguucacaa

SEQ ID NO: 519016 - RNA, 19 nt, Homo sapiens
gaaagcucacuguagcuuu

SEQ ID NO: 519017 - RNA, 17 nt, Homo sapiens
gaaagggguugggguga

SEQ ID NO: 519018 - RNA, 19 nt, Homo sapiens
gaaagggguuggggugaca

SEQ ID NO: 519019 - RNA, 20 nt, Homo sapiens
gaaagugugagcucuucccu

SEQ ID NO: 519020 - RNA, 19 nt, Homo sapiens
gaaaguuuucuccacugga

SEQ ID NO: 519021 - RNA, 23 nt, Homo sapiens
gaaauacguuaggaggacaaaag

SEQ ID NO: 519022 - RNA, 22 nt, Homo sapiens
gaaauaguaccuucaauacuua

SEQ ID NO: 519023 - RNA, 21 nt, Homo sapiens
gaaauauccacccagcaggca

SEQ ID NO: 519024 - RNA, 20 nt, Homo sapiens
gaaauccauuccauuuugug

SEQ ID NO: 519025 - RNA, 12 nt, Homo sapiens
gaaaucuuccca

SEQ ID NO: 519026 - RNA, 18 nt, Homo sapiens
gaaaugaaaucuucccag

SEQ ID NO: 519027 - RNA, 19 nt, Homo sapiens
gaaaugcuguuaguaaauu

SEQ ID NO: 519028 - RNA, 18 nt, Homo sapiens
gaaaugguggugcuuuaa

SEQ ID NO: 519029 - RNA, 15 nt, Homo sapiens
gaaauuaagacuuua

SEQ ID NO: 519030 - RNA, 13 nt, Homo sapiens
gaaauuacuuuaa

SEQ ID NO: 519031 - RNA, 16 nt, Homo sapiens
gaaauuguacuuccag

SEQ ID NO: 519032 - RNA, 17 nt, Homo sapiens
gaacaguuuuggcauaa

SEQ ID NO: 519033 - RNA, 15 nt, Homo sapiens
agucccagcuacuug

SEQ ID NO: 519034 - RNA, 20 nt, Homo sapiens
aguccccagccugcucccua

SEQ ID NO: 519035 - RNA, 16 nt, Homo sapiens
agucccucugcucuca

SEQ ID NO: 519036 - RNA, 17 nt, Homo sapiens
aguccgcagaagcccug

SEQ ID NO: 519037 - RNA, 13 nt, Homo sapiens
agucuagcauucu

SEQ ID NO: 519038 - RNA, 15 nt, Homo sapiens
agucuagcauucugc

SEQ ID NO: 519039 - RNA, 17 nt, Homo sapiens
agucuagcauucugcaa

SEQ ID NO: 519040 - RNA, 22 nt, Homo sapiens
agucucauugucaccucuguga

SEQ ID NO: 519041 - RNA, 15 nt, Homo sapiens
agucugauaaacuga

SEQ ID NO: 519042 - RNA, 19 nt, Homo sapiens
agucugauccauccaucuc

SEQ ID NO: 519043 - RNA, 19 nt, Homo sapiens
agucugcaugugcacggug

SEQ ID NO: 519044 - RNA, 21 nt, Homo sapiens
agucugcuacccucauuucuc

SEQ ID NO: 519045 - RNA, 22 nt, Homo sapiens
agucugcuacccucauuucuca

SEQ ID NO: 519046 - RNA, 13 nt, Homo sapiens
agucuuccaugac

SEQ ID NO: 519047 - RNA, 18 nt, Homo sapiens
agucuucccagcaauuau

SEQ ID NO: 519048 - RNA, 16 nt, Homo sapiens
agucuuuccuaccuug

SEQ ID NO: 519049 - RNA, 13 nt, Homo sapiens
agucuuucuugaa

SEQ ID NO: 519050 - RNA, 21 nt, Homo sapiens
agugaaaaucuuggagacccu

SEQ ID NO: 519051 - RNA, 14 nt, Homo sapiens
agugacaaggcccu

SEQ ID NO: 519052 - RNA, 20 nt, Homo sapiens
agugcaaccucgcugagggc

SEQ ID NO: 519053 - RNA, 20 nt, Homo sapiens
agugcaguggugugaucucg

SEQ ID NO: 519054 - RNA, 14 nt, Homo sapiens
agugcaugguggcc

SEQ ID NO: 519055 - RNA, 14 nt, Homo sapiens
agugccaacuccuc

SEQ ID NO: 519056 - RNA, 21 nt, Homo sapiens
agugccuacccaccugugagg

SEQ ID NO: 519057 - RNA, 15 nt, Homo sapiens
agugccucaccuucc

SEQ ID NO: 519058 - RNA, 14 nt, Homo sapiens
agugcggcugccau

SEQ ID NO: 519059 - RNA, 18 nt, Homo sapiens
agugcugccaguuuccca

SEQ ID NO: 519060 - RNA, 17 nt, Homo sapiens
aguggacgugguaugaa

SEQ ID NO: 519061 - RNA, 14 nt, Homo sapiens
aguggcucaugccu

SEQ ID NO: 519062 - RNA, 14 nt, Homo sapiens
agugguagcaagaa

SEQ ID NO: 519063 - RNA, 15 nt, Homo sapiens
aguggugugaucucg

SEQ ID NO: 519064 - RNA, 20 nt, Homo sapiens
aguggugugaucucggcuca

SEQ ID NO: 519065 - RNA, 15 nt, Homo sapiens
agugguguucagcca

SEQ ID NO: 519066 - RNA, 15 nt, Homo sapiens
aguguagacuguggc

SEQ ID NO: 519067 - RNA, 23 nt, Homo sapiens
agugucugucugaggugacuuaa

SEQ ID NO: 519068 - RNA, 13 nt, Homo sapiens
agugugacagggc

SEQ ID NO: 519069 - RNA, 15 nt, Homo sapiens
agugugccaguuuaa

SEQ ID NO: 519070 - RNA, 16 nt, Homo sapiens
aguguggaaagaaaga

SEQ ID NO: 519071 - RNA, 17 nt, Homo sapiens
aguguggccaggcugcc

SEQ ID NO: 519072 - RNA, 18 nt, Homo sapiens
aguguggccugugccagc

SEQ ID NO: 519073 - RNA, 16 nt, Homo sapiens
agugugggggguccuu

SEQ ID NO: 519074 - RNA, 17 nt, Homo sapiens
aguguguguaguuuuac

SEQ ID NO: 519075 - RNA, 16 nt, Homo sapiens
aguguuaaaacaugaa

SEQ ID NO: 519076 - RNA, 14 nt, Homo sapiens
aguguuauuugcac

SEQ ID NO: 519077 - RNA, 19 nt, Homo sapiens
aguguugccaccauaccuc

SEQ ID NO: 519078 - RNA, 21 nt, Homo sapiens
aguguuuuggacuccaucucu

SEQ ID NO: 519079 - RNA, 17 nt, Homo sapiens
aguuaccagugccuuaa

SEQ ID NO: 519080 - RNA, 14 nt, Homo sapiens
aguuccucuggguu

SEQ ID NO: 519081 - RNA, 14 nt, Homo sapiens
aguucucaauuuca

SEQ ID NO: 519082 - RNA, 17 nt, Homo sapiens
aguucucaugacuccua

SEQ ID NO: 519083 - RNA, 20 nt, Homo sapiens
aguugcagauguuagauauu

SEQ ID NO: 519084 - RNA, 23 nt, Homo sapiens
aguugcugugaacuuucauguca

SEQ ID NO: 519085 - RNA, 12 nt, Homo sapiens
aguugugaaaga

SEQ ID NO: 519086 - RNA, 21 nt, Homo sapiens
aguuuaauuuuugaaaacugg

SEQ ID NO: 519087 - RNA, 18 nt, Homo sapiens
aguuucuuacacacuguc

SEQ ID NO: 519088 - RNA, 17 nt, Homo sapiens
auaaaaaacacuaaaca

SEQ ID NO: 519089 - RNA, 15 nt, Homo sapiens
auaaaaaagaacuuu

SEQ ID NO: 519090 - RNA, 14 nt, Homo sapiens
auaaaauguuucau

SEQ ID NO: 519091 - RNA, 20 nt, Homo sapiens
auaaaauguuucauuaugca

SEQ ID NO: 519092 - RNA, 22 nt, Homo sapiens
auaaacagacuguuaauuauag

SEQ ID NO: 519093 - RNA, 21 nt, Homo sapiens
auaaacauuuuacaugcagcu

SEQ ID NO: 519094 - RNA, 19 nt, Homo sapiens
auaaagacaccugguugcu

SEQ ID NO: 519095 - RNA, 17 nt, Homo sapiens
auaaagauuucaagauc

SEQ ID NO: 519096 - RNA, 14 nt, Homo sapiens
auaaagcaaugugg

SEQ ID NO: 519097 - RNA, 15 nt, Homo sapiens
auaaagcaauguggu

SEQ ID NO: 519098 - RNA, 12 nt, Homo sapiens
auaaagcuuuau

SEQ ID NO: 519099 - RNA, 13 nt, Homo sapiens
auaaagcuuuaua

SEQ ID NO: 519100 - RNA, 20 nt, Homo sapiens
agaaguuuggcugcugucau

SEQ ID NO: 519101 - RNA, 23 nt, Homo sapiens
agaauaagacaagagaucuacac

SEQ ID NO: 519102 - RNA, 19 nt, Homo sapiens
agaauaccacaucaaauaa

SEQ ID NO: 519103 - RNA, 21 nt, Homo sapiens
agaauacccaggaagacuuug

SEQ ID NO: 519104 - RNA, 13 nt, Homo sapiens
agaauauaccuua

SEQ ID NO: 519105 - RNA, 21 nt, Homo sapiens
agaaucucuucaugcuugaca

SEQ ID NO: 519106 - RNA, 23 nt, Homo sapiens
agaauuggggcacuuaaugguca

SEQ ID NO: 519107 - RNA, 20 nt, Homo sapiens
agacaaauuagccauuucac

SEQ ID NO: 519108 - RNA, 14 nt, Homo sapiens
agacaauaugugag

SEQ ID NO: 519109 - RNA, 19 nt, Homo sapiens
agacacuucccugcauuaa

SEQ ID NO: 519110 - RNA, 23 nt, Homo sapiens
agacagcaggcagcgccaagugc

SEQ ID NO: 519111 - RNA, 15 nt, Homo sapiens
agacagcuacacaga

SEQ ID NO: 519112 - RNA, 16 nt, Homo sapiens
agacaguuauugcaag

SEQ ID NO: 519113 - RNA, 15 nt, Homo sapiens
agacauacauuucuc

SEQ ID NO: 519114 - RNA, 16 nt, Homo sapiens
agacauuacaaugugu

SEQ ID NO: 519115 - RNA, 15 nt, Homo sapiens
agaccauuaucagug

SEQ ID NO: 519116 - RNA, 13 nt, Homo sapiens
agaccccaugccu

SEQ ID NO: 519117 - RNA, 12 nt, Homo sapiens
agaccuacccuc

SEQ ID NO: 519118 - RNA, 21 nt, Homo sapiens
agaccuggcuccacucuugau

SEQ ID NO: 519119 - RNA, 23 nt, Homo sapiens
agacgaggccacagcugccaucg

SEQ ID NO: 519120 - RNA, 21 nt, Homo sapiens
agacgggaauucaugcaaaug

SEQ ID NO: 519121 - RNA, 16 nt, Homo sapiens
agacgguuuccaggga

SEQ ID NO: 519122 - RNA, 15 nt, Homo sapiens
agacucagugcagau

SEQ ID NO: 519123 - RNA, 16 nt, Homo sapiens
agacucugccauuaaa

SEQ ID NO: 519124 - RNA, 22 nt, Homo sapiens
agacucugucucaaaacaaaca

SEQ ID NO: 519125 - RNA, 15 nt, Homo sapiens
agacugacaaccuca

SEQ ID NO: 519126 - RNA, 13 nt, Homo sapiens
agacugcuacagg

SEQ ID NO: 519127 - RNA, 11 nt, Homo sapiens
agacuguugaa

SEQ ID NO: 519128 - RNA, 15 nt, Homo sapiens
agacuuauugccaaa

SEQ ID NO: 519129 - RNA, 15 nt, Homo sapiens
agagaauccaaacuc

SEQ ID NO: 519130 - RNA, 14 nt, Homo sapiens
agagaccugagucu

SEQ ID NO: 519131 - RNA, 16 nt, Homo sapiens
agagagcaccacguga

SEQ ID NO: 519132 - RNA, 17 nt, Homo sapiens
agagccuuuugugcaaa

SEQ ID NO: 519133 - RNA, 15 nt, Homo sapiens
agaggacuauuacau

SEQ ID NO: 519134 - RNA, 14 nt, Homo sapiens
agaggcagugacag

SEQ ID NO: 519135 - RNA, 19 nt, Homo sapiens
agaggcccaagugcaaaag

SEQ ID NO: 519136 - RNA, 19 nt, Homo sapiens
agaggcucuaauguacaau

SEQ ID NO: 519137 - RNA, 15 nt, Homo sapiens
agagggagaaacuuc

SEQ ID NO: 519138 - RNA, 19 nt, Homo sapiens
agaguaauucaucugugaa

SEQ ID NO: 519139 - RNA, 20 nt, Homo sapiens
agaguacacccuuuccagga

SEQ ID NO: 519140 - RNA, 15 nt, Homo sapiens
agagucuaccuugaa

SEQ ID NO: 519141 - RNA, 14 nt, Homo sapiens
agaguuuuaucaac

SEQ ID NO: 519142 - RNA, 17 nt, Homo sapiens
agauaacucaagaaauc

SEQ ID NO: 519143 - RNA, 13 nt, Homo sapiens
agauauuaauaga

SEQ ID NO: 519144 - RNA, 11 nt, Homo sapiens
agaucacuuga

SEQ ID NO: 519145 - RNA, 16 nt, Homo sapiens
agauccuggguacuga

SEQ ID NO: 519146 - RNA, 20 nt, Homo sapiens
agaucguaccuauugcacuc

SEQ ID NO: 519147 - RNA, 18 nt, Homo sapiens
agaucgugcuacugcacu

SEQ ID NO: 519148 - RNA, 15 nt, Homo sapiens
agaucuacacauguu

SEQ ID NO: 519149 - RNA, 19 nt, Homo sapiens
agaugacagggaaaacugc

SEQ ID NO: 519150 - RNA, 15 nt, Homo sapiens
agauggaaaaacuga

SEQ ID NO: 519151 - RNA, 21 nt, Homo sapiens
agaugguggccacagacugac

SEQ ID NO: 519152 - RNA, 20 nt, Homo sapiens
agaugguguguucugcaaua

SEQ ID NO: 519153 - RNA, 18 nt, Homo sapiens
agaugguuucuacuggcu

SEQ ID NO: 519154 - RNA, 22 nt, Homo sapiens
agauguguucaggcauuccagg

SEQ ID NO: 519155 - RNA, 17 nt, Homo sapiens
agauguuacaaguuuau

SEQ ID NO: 519156 - RNA, 19 nt, Homo sapiens
agauguucuggauaccauu

SEQ ID NO: 519157 - RNA, 18 nt, Homo sapiens
agauuuccuccuggccuu

SEQ ID NO: 519158 - RNA, 18 nt, Homo sapiens
agauuugucuaauugcau

SEQ ID NO: 519159 - RNA, 13 nt, Homo sapiens
agauuuugcaccu

SEQ ID NO: 519160 - RNA, 22 nt, Homo sapiens
agauuuuuuccucugcauuuac

SEQ ID NO: 519161 - RNA, 17 nt, Homo sapiens
aauuuucaaguuuacac

SEQ ID NO: 519162 - RNA, 17 nt, Homo sapiens
aauuuuguaauguauca

SEQ ID NO: 519163 - RNA, 13 nt, Homo sapiens
aauuuuuaggcaa

SEQ ID NO: 519164 - RNA, 16 nt, Homo sapiens
aauuuuugaaaacugg

SEQ ID NO: 519165 - RNA, 17 nt, Homo sapiens
acaaaaggaauguguaa

SEQ ID NO: 519166 - RNA, 21 nt, Homo sapiens
acaaaauuuuauuuugugcuc

SEQ ID NO: 519167 - RNA, 23 nt, Homo sapiens
acaaaauuuuauuuugugcucau

SEQ ID NO: 519168 - RNA, 22 nt, Homo sapiens
acaaacauguauguauacauga

SEQ ID NO: 519169 - RNA, 14 nt, Homo sapiens
acaaagcauuuuca

SEQ ID NO: 519170 - RNA, 21 nt, Homo sapiens
acaaagugcccaagucuuucc

SEQ ID NO: 519171 - RNA, 14 nt, Homo sapiens
acaaaugaugccau

SEQ ID NO: 519172 - RNA, 16 nt, Homo sapiens
acaaaugaugccaugg

SEQ ID NO: 519173 - RNA, 16 nt, Homo sapiens
acaaaugcaguauaua

SEQ ID NO: 519174 - RNA, 20 nt, Homo sapiens
acaaauuagccauuucacuc

SEQ ID NO: 519175 - RNA, 11 nt, Homo sapiens
acaacauuaag

SEQ ID NO: 519176 - RNA, 17 nt, Homo sapiens
acaacauucugugggau

SEQ ID NO: 519177 - RNA, 15 nt, Homo sapiens
acaaccucauccagg

SEQ ID NO: 519178 - RNA, 21 nt, Homo sapiens
acaagaaaauguauccaagga

SEQ ID NO: 519179 - RNA, 18 nt, Homo sapiens
acaaguauggcuccucca

SEQ ID NO: 519180 - RNA, 15 nt, Homo sapiens
acaauaaaguacuuu

SEQ ID NO: 519181 - RNA, 13 nt, Homo sapiens
acacaaagcacau

SEQ ID NO: 519182 - RNA, 15 nt, Homo sapiens
acacaaauuuucaag

SEQ ID NO: 519183 - RNA, 20 nt, Homo sapiens
acacacgcacacaaaccaca

SEQ ID NO: 519184 - RNA, 11 nt, Homo sapiens
acacacugugc

SEQ ID NO: 519185 - RNA, 24 nt, Homo sapiens
acacauagaaaacaaucaaauauu

SEQ ID NO: 519186 - RNA, 22 nt, Homo sapiens
acacauucaggaguuaaauauu

SEQ ID NO: 519187 - RNA, 22 nt, Homo sapiens
acaccaucaggccgcauccuga

SEQ ID NO: 519188 - RNA, 19 nt, Homo sapiens
acaccggcuuaacacuauc

SEQ ID NO: 519189 - RNA, 22 nt, Homo sapiens
acacgccuaaggucacagcuag

SEQ ID NO: 519190 - RNA, 16 nt, Homo sapiens
acacggaucugacaga

SEQ ID NO: 519191 - RNA, 19 nt, Homo sapiens
acacuagucagaaaauugg

SEQ ID NO: 519192 - RNA, 16 nt, Homo sapiens
acacuaucauggacua

SEQ ID NO: 519193 - RNA, 19 nt, Homo sapiens
acacucaucuuagugccug

SEQ ID NO: 519194 - RNA, 20 nt, Homo sapiens
acacugaaaugaaaucuucc

SEQ ID NO: 519195 - RNA, 23 nt, Homo sapiens
acacugaggccuuguguccuuua

SEQ ID NO: 519196 - RNA, 12 nt, Homo sapiens
acacugcacugu

SEQ ID NO: 519197 - RNA, 19 nt, Homo sapiens
acacuguggccaggccuua

SEQ ID NO: 519198 - RNA, 13 nt, Homo sapiens
acacugugucauu

SEQ ID NO: 519199 - RNA, 16 nt, Homo sapiens
acacuuccagcauuua

SEQ ID NO: 519200 - RNA, 19 nt, Homo sapiens
acagaaaguaucacaaaug

SEQ ID NO: 519201 - RNA, 19 nt, Homo sapiens
acagacuucaucauugugc

SEQ ID NO: 519202 - RNA, 17 nt, Homo sapiens
acagcaaccucuucaug

SEQ ID NO: 519203 - RNA, 21 nt, Homo sapiens
acagcacuggggagucuuugu

SEQ ID NO: 519204 - RNA, 20 nt, Homo sapiens
acagggaaaacugcaaagcu

SEQ ID NO: 519205 - RNA, 15 nt, Homo sapiens
acagggcaguccuua

SEQ ID NO: 519206 - RNA, 23 nt, Homo sapiens
acagggccaguggggccugugga

SEQ ID NO: 519207 - RNA, 21 nt, Homo sapiens
acagggcucauuuuugcacuu

SEQ ID NO: 519208 - RNA, 18 nt, Homo sapiens
acaggguaacugugcuga

SEQ ID NO: 519209 - RNA, 14 nt, Homo sapiens
acagguccccagau

SEQ ID NO: 519210 - RNA, 18 nt, Homo sapiens
acaguacagcaugugccu

SEQ ID NO: 519211 - RNA, 22 nt, Homo sapiens
acaguacugauacauaauuuaa

SEQ ID NO: 519212 - RNA, 20 nt, Homo sapiens
acagugaaguuuuacugucu

SEQ ID NO: 519213 - RNA, 17 nt, Homo sapiens
acagugccaacuccuca

SEQ ID NO: 519214 - RNA, 18 nt, Homo sapiens
acaguugauucaacaaag

SEQ ID NO: 519215 - RNA, 13 nt, Homo sapiens
uucuuuuugccaa

SEQ ID NO: 519216 - RNA, 13 nt, Homo sapiens
uugaagggcuuua

SEQ ID NO: 519217 - RNA, 16 nt, Homo sapiens
uugacauacauucccu

SEQ ID NO: 519218 - RNA, 13 nt, Homo sapiens
uugacuccaagaa

SEQ ID NO: 519219 - RNA, 19 nt, Homo sapiens
uugacugaaauuacuuuaa

SEQ ID NO: 519220 - RNA, 19 nt, Homo sapiens
uugagcagaagaucaagga

SEQ ID NO: 519221 - RNA, 23 nt, Homo sapiens
uugaggucaaguaagaagacaug

SEQ ID NO: 519222 - RNA, 14 nt, Homo sapiens
uugaucaugcugca

SEQ ID NO: 519223 - RNA, 22 nt, Homo sapiens
uugauguacauaacuccugucc

SEQ ID NO: 519224 - RNA, 12 nt, Homo sapiens
uugauucuugcc

SEQ ID NO: 519225 - RNA, 16 nt, Homo sapiens
uugcacacugcacugu

SEQ ID NO: 519226 - RNA, 16 nt, Homo sapiens
uugcagccccacagac

SEQ ID NO: 519227 - RNA, 19 nt, Homo sapiens
uugccccuggcuuugccuc

SEQ ID NO: 519228 - RNA, 17 nt, Homo sapiens
uugcccugaauggucuc

SEQ ID NO: 519229 - RNA, 16 nt, Homo sapiens
uugccgcuguauaaag

SEQ ID NO: 519230 - RNA, 21 nt, Homo sapiens
uugccucuucuuugugccuuu

SEQ ID NO: 519231 - RNA, 22 nt, Homo sapiens
uugccuucaucuucacugcaau

SEQ ID NO: 519232 - RNA, 15 nt, Homo sapiens
uugcuaccucaaggg

SEQ ID NO: 519233 - RNA, 19 nt, Homo sapiens
uuggaaggccucccugggc

SEQ ID NO: 519234 - RNA, 17 nt, Homo sapiens
uuggacagcugauaaau

SEQ ID NO: 519235 - RNA, 17 nt, Homo sapiens
uuggagagaagggcauu

SEQ ID NO: 519236 - RNA, 16 nt, Homo sapiens
uuggaucuggcauuga

SEQ ID NO: 519237 - RNA, 12 nt, Homo sapiens
uuggaucuugaa

SEQ ID NO: 519238 - RNA, 23 nt, Homo sapiens
uuggcaacagaagugguuuccca

SEQ ID NO: 519239 - RNA, 17 nt, Homo sapiens
uuggcauaauagucaau

SEQ ID NO: 519240 - RNA, 15 nt, Homo sapiens
uuggccaaugugcau

SEQ ID NO: 519241 - RNA, 20 nt, Homo sapiens
uugggcagucuuucuugaaa

SEQ ID NO: 519242 - RNA, 11 nt, Homo sapiens
uugggcuguga

SEQ ID NO: 519243 - RNA, 19 nt, Homo sapiens
uuguacaaaauuaagcaaa

SEQ ID NO: 519244 - RNA, 19 nt, Homo sapiens
uuguacccccagguggaag

SEQ ID NO: 519245 - RNA, 18 nt, Homo sapiens
uuguaggagaaacuccca

SEQ ID NO: 519246 - RNA, 21 nt, Homo sapiens
uuguaggagaaacucccaugu

SEQ ID NO: 519247 - RNA, 16 nt, Homo sapiens
uuguaucuuuuauccu

SEQ ID NO: 519248 - RNA, 17 nt, Homo sapiens
uugucaccucugugacc

SEQ ID NO: 519249 - RNA, 15 nt, Homo sapiens
uugugcaaagccaaa

SEQ ID NO: 519250 - RNA, 19 nt, Homo sapiens
uuguguaagaaauacagac

SEQ ID NO: 519251 - RNA, 14 nt, Homo sapiens
uuguguucugcucc

SEQ ID NO: 519252 - RNA, 12 nt, Homo sapiens
uuguuauaccau

SEQ ID NO: 519253 - RNA, 14 nt, Homo sapiens
uuguucaaauguuc

SEQ ID NO: 519254 - RNA, 16 nt, Homo sapiens
uuguugcaggcugugg

SEQ ID NO: 519255 - RNA, 14 nt, Homo sapiens
uuguuguugccaaa

SEQ ID NO: 519256 - RNA, 22 nt, Homo sapiens
uuguuuccucuuccaaaguaaa

SEQ ID NO: 519257 - RNA, 23 nt, Homo sapiens
uuguuugugauauuucguguacu

SEQ ID NO: 519258 - RNA, 22 nt, Homo sapiens
uuguuuuuuacucaaauuggga

SEQ ID NO: 519259 - RNA, 18 nt, Homo sapiens
uuuaaaacgcgucugccu

SEQ ID NO: 519260 - RNA, 20 nt, Homo sapiens
uuuaacggaugguugaauga

SEQ ID NO: 519261 - RNA, 13 nt, Homo sapiens
uuuaacugugaac

SEQ ID NO: 519262 - RNA, 23 nt, Homo sapiens
uuuaagaaaggaagcaacagaua

SEQ ID NO: 519263 - RNA, 17 nt, Homo sapiens
uuuaagcuucaguugcu

SEQ ID NO: 519264 - RNA, 17 nt, Homo sapiens
uuuaaggauucugagau

SEQ ID NO: 519265 - RNA, 22 nt, Homo sapiens
uuuacauccagaguucugugac

SEQ ID NO: 519266 - RNA, 23 nt, Homo sapiens
uuuaccacuuuaaacacccccau

SEQ ID NO: 519267 - RNA, 23 nt, Homo sapiens
uuuacguuugauacaacauuaag

SEQ ID NO: 519268 - RNA, 14 nt, Homo sapiens
uuuaggaucucagg

SEQ ID NO: 519269 - RNA, 21 nt, Homo sapiens
uuuaguagccucaauucucca

SEQ ID NO: 519270 - RNA, 16 nt, Homo sapiens
uuuauaaaauuuugcu

SEQ ID NO: 519271 - RNA, 12 nt, Homo sapiens
uuuauuuagcau

SEQ ID NO: 519272 - RNA, 15 nt, Homo sapiens
uuuauuucugaucua

SEQ ID NO: 519273 - RNA, 13 nt, Homo sapiens
uuucaauuacaaa

SEQ ID NO: 519274 - RNA, 15 nt, Homo sapiens
uuucaauuacaaagc

SEQ ID NO: 519275 - RNA, 13 nt, Homo sapiens
uuucacucugcau

SEQ ID NO: 519276 - RNA, 14 nt, Homo sapiens
uuucauaauugccu

SEQ ID NO: 519277 - RNA, 19 nt, Homo sapiens
uuucauagagauuugucua

SEQ ID NO: 519278 - RNA, 13 nt, Homo sapiens
uuucauguugcaa

SEQ ID NO: 519279 - RNA, 22 nt, Homo sapiens
uuucauuccuaacacagcaugu

SEQ ID NO: 519280 - RNA, 22 nt, Homo sapiens
uuuccccaaagacgaccagcau

SEQ ID NO: 519281 - RNA, 23 nt, Homo sapiens
uuucccuaggaaacucacacucc

SEQ ID NO: 519282 - RNA, 16 nt, Homo sapiens
uuuccgagccuccagu

SEQ ID NO: 519283 - RNA, 12 nt, Homo sapiens
uuuccucugcau

SEQ ID NO: 519284 - RNA, 14 nt, Homo sapiens
uuuccucugugcaa

SEQ ID NO: 519285 - RNA, 20 nt, Homo sapiens
uuuccucugugcaaagggaa

SEQ ID NO: 519286 - RNA, 18 nt, Homo sapiens
uuuccuugacuucuuuga

SEQ ID NO: 519287 - RNA, 20 nt, Homo sapiens
uuucguaacggccuugaucc

SEQ ID NO: 519288 - RNA, 20 nt, Homo sapiens
uuucuaaaaacacacacaaa

SEQ ID NO: 519289 - RNA, 21 nt, Homo sapiens
uuucugucguuaaaaacagau

SEQ ID NO: 519290 - RNA, 12 nt, Homo sapiens
uuucuuccugca

SEQ ID NO: 519291 - RNA, 12 nt, Homo sapiens
uuucuuugccuc

SEQ ID NO: 519292 - RNA, 17 nt, Homo sapiens
uuugaagcagucuugcu

SEQ ID NO: 519293 - RNA, 19 nt, Homo sapiens
uuugagaucaucagugaua

SEQ ID NO: 519294 - RNA, 17 nt, Homo sapiens
uuugaggugaggguugg

SEQ ID NO: 519295 - RNA, 17 nt, Homo sapiens
uuugauaccugcacugu

SEQ ID NO: 519296 - RNA, 19 nt, Homo sapiens
uuugauagggaacugggga

SEQ ID NO: 519297 - RNA, 20 nt, Homo sapiens
uuugcaacaauaaaguacuu

SEQ ID NO: 519298 - RNA, 19 nt, Homo sapiens
uuugcaacucccuggguaa

SEQ ID NO: 519299 - RNA, 18 nt, Homo sapiens
uuugccaggacaugcaau

SEQ ID NO: 519300 - RNA, 23 nt, Homo sapiens
uuugcuacuaaguucacauuaga

SEQ ID NO: 519301 - RNA, 19 nt, Homo sapiens
uuuggcuagguaucauuca

SEQ ID NO: 519302 - RNA, 23 nt, Homo sapiens
uuugugaaaugaaaacauguaau

SEQ ID NO: 519303 - RNA, 16 nt, Homo sapiens
uuuguuuaagcugacu

SEQ ID NO: 519304 - RNA, 17 nt, Homo sapiens
uuuuaaaaacucuucag

SEQ ID NO: 519305 - RNA, 17 nt, Homo sapiens
uuuuaacucaccucuca

SEQ ID NO: 519306 - RNA, 13 nt, Homo sapiens
uuuuaacuuuuaa

SEQ ID NO: 519307 - RNA, 20 nt, Homo sapiens
uuuuaagaaaguaauuuaau

SEQ ID NO: 519308 - RNA, 18 nt, Homo sapiens
uuuuaauacauugaucag

SEQ ID NO: 519309 - RNA, 12 nt, Homo sapiens
uggacuacacaa

SEQ ID NO: 519310 - RNA, 14 nt, Homo sapiens
uggacuacacaaua

SEQ ID NO: 519311 - RNA, 21 nt, Homo sapiens
uggacuacacaauacaguauu

SEQ ID NO: 519312 - RNA, 22 nt, Homo sapiens
uggacuccaucucucauccucc

SEQ ID NO: 519313 - RNA, 22 nt, Homo sapiens
uggacuuccagugcucagaggg

SEQ ID NO: 519314 - RNA, 18 nt, Homo sapiens
uggagaagcuagaaggca

SEQ ID NO: 519315 - RNA, 16 nt, Homo sapiens
uggagagacagcuaca

SEQ ID NO: 519316 - RNA, 17 nt, Homo sapiens
uggagccccaggggaca

SEQ ID NO: 519317 - RNA, 18 nt, Homo sapiens
uggagccugggguguccu

SEQ ID NO: 519318 - RNA, 16 nt, Homo sapiens
uggagcuggcacugug

SEQ ID NO: 519319 - RNA, 14 nt, Homo sapiens
uggaggcaguccau

SEQ ID NO: 519320 - RNA, 15 nt, Homo sapiens
uggagggcaucaggc

SEQ ID NO: 519321 - RNA, 17 nt, Homo sapiens
uggauaaagccacugaa

SEQ ID NO: 519322 - RNA, 16 nt, Homo sapiens
uggcaaacgagacuuu

SEQ ID NO: 519323 - RNA, 20 nt, Homo sapiens
uggcaagucuuccaugaccc

SEQ ID NO: 519324 - RNA, 21 nt, Homo sapiens
uggcagaagggaauugcucag

SEQ ID NO: 519325 - RNA, 12 nt, Homo sapiens
uggcagagccag

SEQ ID NO: 519326 - RNA, 15 nt, Homo sapiens
uggcagccauggcca

SEQ ID NO: 519327 - RNA, 21 nt, Homo sapiens
uggcagcggguggcauccagg

SEQ ID NO: 519328 - RNA, 14 nt, Homo sapiens
uggccaaugugcau

SEQ ID NO: 519329 - RNA, 18 nt, Homo sapiens
uggccaggcuggucucaa

SEQ ID NO: 519330 - RNA, 15 nt, Homo sapiens
uggcccugggggucu

SEQ ID NO: 519331 - RNA, 20 nt, Homo sapiens
uggcccugggggucugggcg

SEQ ID NO: 519332 - RNA, 22 nt, Homo sapiens
uggccuauccgcugccagccuu

SEQ ID NO: 519333 - RNA, 14 nt, Homo sapiens
uggccuccaaacac

SEQ ID NO: 519334 - RNA, 13 nt, Homo sapiens
uggcuagcaaucu

SEQ ID NO: 519335 - RNA, 21 nt, Homo sapiens
uggcuccggccucugccuuug

SEQ ID NO: 519336 - RNA, 19 nt, Homo sapiens
uggcugccagaaucuagag

SEQ ID NO: 519337 - RNA, 23 nt, Homo sapiens
uggcugcuguugcuuaaaccacu

SEQ ID NO: 519338 - RNA, 23 nt, Homo sapiens
uggcuucaggcuaagaagagauu

SEQ ID NO: 519339 - RNA, 16 nt, Homo sapiens
ugggaaaacauuugcu

SEQ ID NO: 519340 - RNA, 20 nt, Homo sapiens
ugggaaauaugccacugacc

SEQ ID NO: 519341 - RNA, 17 nt, Homo sapiens
ugggaacacaucuggcu

SEQ ID NO: 519342 - RNA, 20 nt, Homo sapiens
ugggaacacaucuggcugca

SEQ ID NO: 519343 - RNA, 19 nt, Homo sapiens
ugggagaguaaaccuugaa

SEQ ID NO: 519344 - RNA, 18 nt, Homo sapiens
ugggagaguaccugugug

SEQ ID NO: 519345 - RNA, 19 nt, Homo sapiens
ugggauagcacguggagcu

SEQ ID NO: 519346 - RNA, 20 nt, Homo sapiens
ugggauuaugccaaggccgu

SEQ ID NO: 519347 - RNA, 22 nt, Homo sapiens
ugggcagggucuguuuggacug

SEQ ID NO: 519348 - RNA, 12 nt, Homo sapiens
ugggcaggugaa

SEQ ID NO: 519349 - RNA, 14 nt, Homo sapiens
ugggccauguccaa

SEQ ID NO: 519350 - RNA, 19 nt, Homo sapiens
ugggccccuggcacucuug

SEQ ID NO: 519351 - RNA, 17 nt, Homo sapiens
ugggcguccagcucagc

SEQ ID NO: 519352 - RNA, 15 nt, Homo sapiens
ugggcuuuggagcug

SEQ ID NO: 519353 - RNA, 14 nt, Homo sapiens
uggggaguaccugu

SEQ ID NO: 519354 - RNA, 22 nt, Homo sapiens
ugggggcaccuuaagauuuugc

SEQ ID NO: 519355 - RNA, 19 nt, Homo sapiens
ugggggcucaugccuguaa

SEQ ID NO: 519356 - RNA, 21 nt, Homo sapiens
uggggugcugccugaauccau

SEQ ID NO: 519357 - RNA, 16 nt, Homo sapiens
uggguccuuggcuccc

SEQ ID NO: 519358 - RNA, 19 nt, Homo sapiens
ugggucuaccacucagaga

SEQ ID NO: 519359 - RNA, 23 nt, Homo sapiens
uggguguagccagguauggcucu

SEQ ID NO: 519360 - RNA, 15 nt, Homo sapiens
ugguaaaaguauuug

SEQ ID NO: 519361 - RNA, 23 nt, Homo sapiens
uggucaagggcugucauugcaca

SEQ ID NO: 519362 - RNA, 22 nt, Homo sapiens
uggucacaacuugauggcugcg

SEQ ID NO: 519363 - RNA, 12 nt, Homo sapiens
ugguccuggaac

SEQ ID NO: 519364 - RNA, 19 nt, Homo sapiens
uggucugccuucugcugaa

SEQ ID NO: 519365 - RNA, 18 nt, Homo sapiens
uggucuugagccaguaau

SEQ ID NO: 519366 - RNA, 12 nt, Homo sapiens
uggugaaugaca

SEQ ID NO: 519367 - RNA, 14 nt, Homo sapiens
uggugcucuuugcu

SEQ ID NO: 519368 - RNA, 21 nt, Homo sapiens
uggugcuggaaccagcucucu

SEQ ID NO: 519369 - RNA, 13 nt, Homo sapiens
uggugugaucucg

SEQ ID NO: 519370 - RNA, 17 nt, Homo sapiens
ugguuauaucauucugg

SEQ ID NO: 519371 - RNA, 16 nt, Homo sapiens
ugguucagacacagcu

SEQ ID NO: 519372 - RNA, 16 nt, Homo sapiens
ugguucccugcugcgc

SEQ ID NO: 519373 - RNA, 18 nt, Homo sapiens
ugguucguucuguacugu

SEQ ID NO: 519374 - RNA, 16 nt, Homo sapiens
ugguuuuaaaagagaa

SEQ ID NO: 519375 - RNA, 12 nt, Homo sapiens
ugguuuuggaca

SEQ ID NO: 519376 - RNA, 22 nt, Homo sapiens
uguaaaauagugaauaaaguca

SEQ ID NO: 519377 - RNA, 23 nt, Homo sapiens
uguaaagauguucuggauaccau

SEQ ID NO: 519378 - RNA, 13 nt, Homo sapiens
uguaaagcuuuaa

SEQ ID NO: 519379 - RNA, 15 nt, Homo sapiens
uguaaauuucucaaa

SEQ ID NO: 519380 - RNA, 13 nt, Homo sapiens
uguaacugcugaa

SEQ ID NO: 519381 - RNA, 22 nt, Homo sapiens
uguaagaaauacagacuggaug

SEQ ID NO: 519382 - RNA, 17 nt, Homo sapiens
uguaagguacuuucaua

SEQ ID NO: 519383 - RNA, 13 nt, Homo sapiens
uguaaucccagca

SEQ ID NO: 519384 - RNA, 13 nt, Homo sapiens
uguacaauaaagc

SEQ ID NO: 519385 - RNA, 18 nt, Homo sapiens
uguacaauaaagcaaugu

SEQ ID NO: 519386 - RNA, 23 nt, Homo sapiens
uguacaauaaagcaaugugguag

SEQ ID NO: 519387 - RNA, 14 nt, Homo sapiens
uguacggacacugu

SEQ ID NO: 519388 - RNA, 14 nt, Homo sapiens
uguacuacagcuau

SEQ ID NO: 519389 - RNA, 20 nt, Homo sapiens
uguagaaucucuucaugcuu

SEQ ID NO: 519390 - RNA, 15 nt, Homo sapiens
uguagcgcuuugaau

SEQ ID NO: 519391 - RNA, 17 nt, Homo sapiens
uguagcuccucaacuca

SEQ ID NO: 519392 - RNA, 22 nt, Homo sapiens
uguaggaagucauccugccaac

SEQ ID NO: 519393 - RNA, 12 nt, Homo sapiens
uguaggccucag

SEQ ID NO: 519394 - RNA, 16 nt, Homo sapiens
uguaggugucugccuu

SEQ ID NO: 519395 - RNA, 22 nt, Homo sapiens
uguauaucacuaaaagcaugaa

SEQ ID NO: 519396 - RNA, 14 nt, Homo sapiens
uguauccagucuga

SEQ ID NO: 519397 - RNA, 13 nt, Homo sapiens
uguauccaugcac

SEQ ID NO: 519398 - RNA, 14 nt, Homo sapiens
uguaugacuaaaga

SEQ ID NO: 519399 - RNA, 15 nt, Homo sapiens
uguauguuugcugau

SEQ ID NO: 519400 - RNA, 18 nt, Homo sapiens
ggaagcggcccuaaggga

SEQ ID NO: 519401 - RNA, 22 nt, Homo sapiens
ggaaggaaaugacaccaaauau

SEQ ID NO: 519402 - RNA, 23 nt, Homo sapiens
ggaagucaucucauuccacuguu

SEQ ID NO: 519403 - RNA, 16 nt, Homo sapiens
ggaaguuuuccuacac

SEQ ID NO: 519404 - RNA, 17 nt, Homo sapiens
ggaauauacgugcuugg

SEQ ID NO: 519405 - RNA, 14 nt, Homo sapiens
ggaaucgacuguau

SEQ ID NO: 519406 - RNA, 18 nt, Homo sapiens
ggaaugaauacagcauuu

SEQ ID NO: 519407 - RNA, 13 nt, Homo sapiens
ggaauugcucaga

SEQ ID NO: 519408 - RNA, 20 nt, Homo sapiens
ggacaccacgauucucccaa

SEQ ID NO: 519409 - RNA, 16 nt, Homo sapiens
ggacaucacagggugg

SEQ ID NO: 519410 - RNA, 22 nt, Homo sapiens
ggacccaaggcucagucccucu

SEQ ID NO: 519411 - RNA, 21 nt, Homo sapiens
ggacuacacaauacaguauua

SEQ ID NO: 519412 - RNA, 23 nt, Homo sapiens
ggacuccaucucucauccuccag

SEQ ID NO: 519413 - RNA, 21 nt, Homo sapiens
ggacuuccuuuaggaucucag

SEQ ID NO: 519414 - RNA, 16 nt, Homo sapiens
ggagaggggaggucac

SEQ ID NO: 519415 - RNA, 13 nt, Homo sapiens
ggagaguaccugu

SEQ ID NO: 519416 - RNA, 22 nt, Homo sapiens
ggagccugguucagacacagcu

SEQ ID NO: 519417 - RNA, 23 nt, Homo sapiens
ggagcugggcccgacauggcucc

SEQ ID NO: 519418 - RNA, 14 nt, Homo sapiens
ggaggacauuuggu

SEQ ID NO: 519419 - RNA, 23 nt, Homo sapiens
ggaggaugucccugggccagggu

SEQ ID NO: 519420 - RNA, 12 nt, Homo sapiens
ggaggcaccugg

SEQ ID NO: 519421 - RNA, 19 nt, Homo sapiens
ggaggccaagaacuugcaa

SEQ ID NO: 519422 - RNA, 21 nt, Homo sapiens
ggaggggcugcuggacccaag

SEQ ID NO: 519423 - RNA, 17 nt, Homo sapiens
ggaggugauuccaguga

SEQ ID NO: 519424 - RNA, 14 nt, Homo sapiens
ggagguugcaguga

SEQ ID NO: 519425 - RNA, 18 nt, Homo sapiens
ggagucccugcaggugaa

SEQ ID NO: 519426 - RNA, 20 nt, Homo sapiens
ggauaaggaggcacugcuga

SEQ ID NO: 519427 - RNA, 15 nt, Homo sapiens
ggauacgacacaugc

SEQ ID NO: 519428 - RNA, 16 nt, Homo sapiens
ggauauccuuucacuc

SEQ ID NO: 519429 - RNA, 17 nt, Homo sapiens
ggaucucucuccucucu

SEQ ID NO: 519430 - RNA, 20 nt, Homo sapiens
ggaucucucuccucucugac

SEQ ID NO: 519431 - RNA, 20 nt, Homo sapiens
ggaugauacgaaugauguca

SEQ ID NO: 519432 - RNA, 14 nt, Homo sapiens
uccggcagcacaag

SEQ ID NO: 519433 - RNA, 15 nt, Homo sapiens
uccuacguauccugc

SEQ ID NO: 519434 - RNA, 16 nt, Homo sapiens
uccuacguauccugca

SEQ ID NO: 519435 - RNA, 22 nt, Homo sapiens
uccuauucugaugaaucucaaa

SEQ ID NO: 519436 - RNA, 15 nt, Homo sapiens
uccucagcuuaucuc

SEQ ID NO: 519437 - RNA, 19 nt, Homo sapiens
uccuccaucaauucuguau

SEQ ID NO: 519438 - RNA, 19 nt, Homo sapiens
uccuccuggaacagaagac

SEQ ID NO: 519439 - RNA, 13 nt, Homo sapiens
uccugaccucagg

SEQ ID NO: 519440 - RNA, 17 nt, Homo sapiens
uccugacgcagcacaag

SEQ ID NO: 519441 - RNA, 17 nt, Homo sapiens
uccugagaagcauguaa

SEQ ID NO: 519442 - RNA, 21 nt, Homo sapiens
uccugcagucccacacugugc

SEQ ID NO: 519443 - RNA, 18 nt, Homo sapiens
uccugcuuaaucuucaaa

SEQ ID NO: 519444 - RNA, 19 nt, Homo sapiens
uccugggaacacaucuggc

SEQ ID NO: 519445 - RNA, 22 nt, Homo sapiens
uccuggguacugaaagccuuag

SEQ ID NO: 519446 - RNA, 23 nt, Homo sapiens
uccuucagugaacuaagucccua

SEQ ID NO: 519447 - RNA, 23 nt, Homo sapiens
uccuuccugcuugaguucccaga

SEQ ID NO: 519448 - RNA, 22 nt, Homo sapiens
uccuucuucaacgccaucucca

SEQ ID NO: 519449 - RNA, 11 nt, Homo sapiens
uccuugaacaa

SEQ ID NO: 519450 - RNA, 19 nt, Homo sapiens
uccuugacuucuuugagaa

SEQ ID NO: 519451 - RNA, 21 nt, Homo sapiens
uccuuuccuuuuuuugauaua

SEQ ID NO: 519452 - RNA, 13 nt, Homo sapiens
uccuuuuccuuau

SEQ ID NO: 519453 - RNA, 18 nt, Homo sapiens
ucgagaccauccuggcua

SEQ ID NO: 519454 - RNA, 18 nt, Homo sapiens
ucgcuuuuaauaaacugc

SEQ ID NO: 519455 - RNA, 16 nt, Homo sapiens
ucggcacacacugugc

SEQ ID NO: 519456 - RNA, 19 nt, Homo sapiens
ucggcagcuacucagagga

SEQ ID NO: 519457 - RNA, 15 nt, Homo sapiens
ucgggaaaauauuca

SEQ ID NO: 519458 - RNA, 15 nt, Homo sapiens
ucgggccagaaggcg

SEQ ID NO: 519459 - RNA, 14 nt, Homo sapiens
ucggggacccugcg

SEQ ID NO: 519460 - RNA, 17 nt, Homo sapiens
ucuaaaauacaaaccca

SEQ ID NO: 519461 - RNA, 17 nt, Homo sapiens
ucuaaauacaugccaca

SEQ ID NO: 519462 - RNA, 15 nt, Homo sapiens
ucuaccaaaaaaagg

SEQ ID NO: 519463 - RNA, 20 nt, Homo sapiens
ugagaacucugcccaggugu

SEQ ID NO: 519464 - RNA, 14 nt, Homo sapiens
ugagaaucccuggc

SEQ ID NO: 519465 - RNA, 23 nt, Homo sapiens
ugagacucuaggguccaguggau

SEQ ID NO: 519466 - RNA, 12 nt, Homo sapiens
ugagagaccuga

SEQ ID NO: 519467 - RNA, 13 nt, Homo sapiens
ugagagaccugag

SEQ ID NO: 519468 - RNA, 21 nt, Homo sapiens
ugagaguaauucaucugugaa

SEQ ID NO: 519469 - RNA, 21 nt, Homo sapiens
ugagauccggcagcacaagcu

SEQ ID NO: 519470 - RNA, 22 nt, Homo sapiens
ugagaucguaccuauugcacuc

SEQ ID NO: 519471 - RNA, 22 nt, Homo sapiens
ugagauggguguacaaacucau

SEQ ID NO: 519472 - RNA, 15 nt, Homo sapiens
ugagcaagacauacu

SEQ ID NO: 519473 - RNA, 16 nt, Homo sapiens
ugagcaagacauacuu

SEQ ID NO: 519474 - RNA, 18 nt, Homo sapiens
ugagcaagacauacuuaa

SEQ ID NO: 519475 - RNA, 17 nt, Homo sapiens
ugagccaguaaucuuua

SEQ ID NO: 519476 - RNA, 18 nt, Homo sapiens
ugagccgagaucaugcca

SEQ ID NO: 519477 - RNA, 16 nt, Homo sapiens
ugaggaaggaacagca

SEQ ID NO: 519478 - RNA, 19 nt, Homo sapiens
ugaggauaucaaaggacaa

SEQ ID NO: 519479 - RNA, 19 nt, Homo sapiens
ugaggcaaauuaacuguau

SEQ ID NO: 519480 - RNA, 13 nt, Homo sapiens
ugaggcaggagaa

SEQ ID NO: 519481 - RNA, 16 nt, Homo sapiens
ugaggcccugcccaau

SEQ ID NO: 519482 - RNA, 20 nt, Homo sapiens
ugaggcuacagaacuaaaaa

SEQ ID NO: 519483 - RNA, 15 nt, Homo sapiens
ugagggcaguucuga

SEQ ID NO: 519484 - RNA, 21 nt, Homo sapiens
ugaggucaggaguucaagacc

SEQ ID NO: 519485 - RNA, 12 nt, Homo sapiens
ugaggucaggga

SEQ ID NO: 519486 - RNA, 14 nt, Homo sapiens
ugaggugcuaugaa

SEQ ID NO: 519487 - RNA, 15 nt, Homo sapiens
ugaguugcacauuaa

SEQ ID NO: 519488 - RNA, 19 nt, Homo sapiens
ugaguuuuuacaagaugua

SEQ ID NO: 519489 - RNA, 20 nt, Homo sapiens
ugauaauuguguaccuuaag

SEQ ID NO: 519490 - RNA, 16 nt, Homo sapiens
ugauccccaaguggug

SEQ ID NO: 519491 - RNA, 22 nt, Homo sapiens
ugauccccaaguggugaaugac

SEQ ID NO: 519492 - RNA, 13 nt, Homo sapiens
ugaucuauacaaa

SEQ ID NO: 519493 - RNA, 23 nt, Homo sapiens
ugaugaaauaaaacuacaugguc

SEQ ID NO: 519494 - RNA, 14 nt, Homo sapiens
ugaugacuuacuau

SEQ ID NO: 519495 - RNA, 18 nt, Homo sapiens
ugaugauuuucauuucau

SEQ ID NO: 519496 - RNA, 20 nt, Homo sapiens
ugauguacagauucuuucag

SEQ ID NO: 519497 - RNA, 13 nt, Homo sapiens
ugauuaacuuauu

SEQ ID NO: 519498 - RNA, 19 nt, Homo sapiens
ugauuacuaucauggcaua

SEQ ID NO: 519499 - RNA, 21 nt, Homo sapiens
ugauugaguccuuucuuccau

SEQ ID NO: 519500 - RNA, 20 nt, Homo sapiens
ugauugggaaaacauuugcu

SEQ ID NO: 519501 - RNA, 21 nt, Homo sapiens
ugauugggaaaacauuugcug

SEQ ID NO: 519502 - RNA, 17 nt, Homo sapiens
ugauugucagcuacuaa

SEQ ID NO: 519503 - RNA, 16 nt, Homo sapiens
ugauuuagugaucaaa

SEQ ID NO: 519504 - RNA, 18 nt, Homo sapiens
ugauuuuaaauggauguc

SEQ ID NO: 519505 - RNA, 16 nt, Homo sapiens
ugauuuugcuuuccaa

SEQ ID NO: 519506 - RNA, 19 nt, Homo sapiens
ugcaacccugucauuacgu

SEQ ID NO: 519507 - RNA, 18 nt, Homo sapiens
ugcaauaccaauguucua

SEQ ID NO: 519508 - RNA, 18 nt, Homo sapiens
ugcaauagacacauacau

SEQ ID NO: 519509 - RNA, 16 nt, Homo sapiens
ugcaauguagucaaua

SEQ ID NO: 519510 - RNA, 12 nt, Homo sapiens
ugcaauguauua

SEQ ID NO: 519511 - RNA, 20 nt, Homo sapiens
ugcacacguuugugagcucc

SEQ ID NO: 519512 - RNA, 20 nt, Homo sapiens
ugcacaggguccucagcuca

SEQ ID NO: 519513 - RNA, 17 nt, Homo sapiens
ugcaccuucacucucca

SEQ ID NO: 519514 - RNA, 16 nt, Homo sapiens
ugcacuguccugacca

SEQ ID NO: 519515 - RNA, 21 nt, Homo sapiens
ugcacuuuuagaaaugcauau

SEQ ID NO: 519516 - RNA, 16 nt, Homo sapiens
ugcagaaguacuccua

SEQ ID NO: 519517 - RNA, 19 nt, Homo sapiens
ugcagaggauaaggaggca

SEQ ID NO: 519518 - RNA, 20 nt, Homo sapiens
ugcagaggauaaggaggcac

SEQ ID NO: 519519 - RNA, 16 nt, Homo sapiens
ugcagaguugaaguuu

SEQ ID NO: 519520 - RNA, 15 nt, Homo sapiens
ugcagauacuuugaa

SEQ ID NO: 519521 - RNA, 23 nt, Homo sapiens
ugcagauacuuugaagugcagcu

SEQ ID NO: 519522 - RNA, 18 nt, Homo sapiens
ugcagccacaucacggca

SEQ ID NO: 519523 - RNA, 17 nt, Homo sapiens
ugcagcggugguuguca

SEQ ID NO: 519524 - RNA, 16 nt, Homo sapiens
ugcaggugacauuugc

SEQ ID NO: 519525 - RNA, 15 nt, Homo sapiens
ugcaguauucuugca

SEQ ID NO: 519526 - RNA, 15 nt, Homo sapiens
ugcagucaucuacuu

SEQ ID NO: 519527 - RNA, 18 nt, Homo sapiens
ugcaguggugugaucucg

SEQ ID NO: 519528 - RNA, 21 nt, Homo sapiens
ugcaguuguaggcauguagcu

SEQ ID NO: 519529 - RNA, 15 nt, Homo sapiens
ugcauaaaugcauaa

SEQ ID NO: 519530 - RNA, 18 nt, Homo sapiens
ugcauaauaagcuaaaga

SEQ ID NO: 519531 - RNA, 21 nt, Homo sapiens
ugcaucuuuguuacuuccuua

SEQ ID NO: 519532 - RNA, 17 nt, Homo sapiens
ugcauggaggcccuccu

SEQ ID NO: 519533 - RNA, 12 nt, Homo sapiens
ugcauugaacag

SEQ ID NO: 519534 - RNA, 16 nt, Homo sapiens
ugccaguuucccaaaa

SEQ ID NO: 519535 - RNA, 14 nt, Homo sapiens
ugccauagaacaag

SEQ ID NO: 519536 - RNA, 20 nt, Homo sapiens
ugccaugccaggaaccuguc

SEQ ID NO: 519537 - RNA, 13 nt, Homo sapiens
ugccaugugaaga

SEQ ID NO: 519538 - RNA, 18 nt, Homo sapiens
ugccauuaaaacauuacc

SEQ ID NO: 519539 - RNA, 15 nt, Homo sapiens
ugcccaaaucuuuag

SEQ ID NO: 519540 - RNA, 18 nt, Homo sapiens
ugcccaaugagacucuag

SEQ ID NO: 519541 - RNA, 17 nt, Homo sapiens
ugcccagcacagugccu

SEQ ID NO: 519542 - RNA, 18 nt, Homo sapiens
ugcccauccugacugaaa

SEQ ID NO: 519543 - RNA, 17 nt, Homo sapiens
ugccccccaugaggaag

SEQ ID NO: 519544 - RNA, 20 nt, Homo sapiens
ugcccucuuguggugcauug

SEQ ID NO: 519545 - RNA, 16 nt, Homo sapiens
ugcccuguuagcuuuc

SEQ ID NO: 519546 - RNA, 17 nt, Homo sapiens
ugcccuuccuccugccu

SEQ ID NO: 519547 - RNA, 16 nt, Homo sapiens
ugccggaugcaggaag

SEQ ID NO: 519548 - RNA, 16 nt, Homo sapiens
ugccucccacuucacu

SEQ ID NO: 519549 - RNA, 14 nt, Homo sapiens
ugccuggcacagac

SEQ ID NO: 519550 - RNA, 15 nt, Homo sapiens
ugccuguaucucuca

SEQ ID NO: 519551 - RNA, 20 nt, Homo sapiens
ugccuucaucuucacugcaa

SEQ ID NO: 519552 - RNA, 20 nt, Homo sapiens
gccagcagggcaucuuggaa

SEQ ID NO: 519553 - RNA, 21 nt, Homo sapiens
gccaggcuggucucaaacucc

SEQ ID NO: 519554 - RNA, 10 nt, Homo sapiens
gccagucuca

SEQ ID NO: 519555 - RNA, 17 nt, Homo sapiens
gccagucucauugucac

SEQ ID NO: 519556 - RNA, 17 nt, Homo sapiens
gccaguuguugccaacc

SEQ ID NO: 519557 - RNA, 13 nt, Homo sapiens
gccauaaaacuua

SEQ ID NO: 519558 - RNA, 13 nt, Homo sapiens
gccauagaacaag

SEQ ID NO: 519559 - RNA, 20 nt, Homo sapiens
gccauauucugguucuugaa

SEQ ID NO: 519560 - RNA, 22 nt, Homo sapiens
gccaucauccucccgccaggag

SEQ ID NO: 519561 - RNA, 16 nt, Homo sapiens
gccaucaugccugacu

SEQ ID NO: 519562 - RNA, 20 nt, Homo sapiens
gccaucggugaaacuaacag

SEQ ID NO: 519563 - RNA, 13 nt, Homo sapiens
gccauguccaaag

SEQ ID NO: 519564 - RNA, 20 nt, Homo sapiens
gcccaggggagcguguuccu

SEQ ID NO: 519565 - RNA, 12 nt, Homo sapiens
gcccagugcaug

SEQ ID NO: 519566 - RNA, 16 nt, Homo sapiens
gccccaacucuuuauc

SEQ ID NO: 519567 - RNA, 22 nt, Homo sapiens
gccccacauguccagcaccuug

SEQ ID NO: 519568 - RNA, 21 nt, Homo sapiens
gcccccugggcuggggccuca

SEQ ID NO: 519569 - RNA, 16 nt, Homo sapiens
gccccuggcacucuug

SEQ ID NO: 519570 - RNA, 20 nt, Homo sapiens
gcccuuagcuccccucccag

SEQ ID NO: 519571 - RNA, 16 nt, Homo sapiens
gcccuucaagugcacu

SEQ ID NO: 519572 - RNA, 17 nt, Homo sapiens
gcccuucacuuccauca

SEQ ID NO: 519573 - RNA, 17 nt, Homo sapiens
gcccuuucaaagcacuu

SEQ ID NO: 519574 - RNA, 22 nt, Homo sapiens
gccgauaucuucagaaaaccua

SEQ ID NO: 519575 - RNA, 20 nt, Homo sapiens
gccgauauuuucuugcugga

SEQ ID NO: 519576 - RNA, 16 nt, Homo sapiens
gccuaccucagccucc

SEQ ID NO: 519577 - RNA, 14 nt, Homo sapiens
gccuagcgaucucu

SEQ ID NO: 519578 - RNA, 17 nt, Homo sapiens
gccuaguuucuuacaca

SEQ ID NO: 519579 - RNA, 16 nt, Homo sapiens
gccuccaaacacagau

SEQ ID NO: 519580 - RNA, 20 nt, Homo sapiens
gccuccaugaccugcgcucu

SEQ ID NO: 519581 - RNA, 19 nt, Homo sapiens
gccucccuuugugugcaua

SEQ ID NO: 519582 - RNA, 19 nt, Homo sapiens
gccucuucuuugugccuuu

SEQ ID NO: 519583 - RNA, 13 nt, Homo sapiens
gccuggacugcua

SEQ ID NO: 519584 - RNA, 22 nt, Homo sapiens
gccuguggguuugguccuugaa

SEQ ID NO: 519585 - RNA, 23 nt, Homo sapiens
aaacucuguccacgauucacuca

SEQ ID NO: 519586 - RNA, 20 nt, Homo sapiens
aaacucuguuacacuuuuug

SEQ ID NO: 519587 - RNA, 17 nt, Homo sapiens
aaacucuucagugcaaa

SEQ ID NO: 519588 - RNA, 16 nt, Homo sapiens
aaacuuagaaagggaa

SEQ ID NO: 519589 - RNA, 15 nt, Homo sapiens
aaacuuguacaugga

SEQ ID NO: 519590 - RNA, 22 nt, Homo sapiens
aaacuuguuagaucaaccucca

SEQ ID NO: 519591 - RNA, 19 nt, Homo sapiens
aaagaaaccuuccaaugcu

SEQ ID NO: 519592 - RNA, 19 nt, Homo sapiens
aaagaaauauuaagcaugu

SEQ ID NO: 519593 - RNA, 22 nt, Homo sapiens
aaagaagcugcuguucuuagca

SEQ ID NO: 519594 - RNA, 17 nt, Homo sapiens
aaagagccagacucugu

SEQ ID NO: 519595 - RNA, 15 nt, Homo sapiens
aaagaggcugccccu

SEQ ID NO: 519596 - RNA, 20 nt, Homo sapiens
aaagagguaaaaaacuguca

SEQ ID NO: 519597 - RNA, 18 nt, Homo sapiens
aaagauaauuuauuucaa

SEQ ID NO: 519598 - RNA, 16 nt, Homo sapiens
aaagauccagccucau

SEQ ID NO: 519599 - RNA, 19 nt, Homo sapiens
aaagauucucaucacucaa

SEQ ID NO: 519600 - RNA, 19 nt, Homo sapiens
aaagccagggucucucccu

SEQ ID NO: 519601 - RNA, 22 nt, Homo sapiens
aaagccagguuccacagaggac

SEQ ID NO: 519602 - RNA, 19 nt, Homo sapiens
aaagcuaguguaccuccuc

SEQ ID NO: 519603 - RNA, 14 nt, Homo sapiens
aaaggaauguguaa

SEQ ID NO: 519604 - RNA, 21 nt, Homo sapiens
aaaggaucucugagaccacag

SEQ ID NO: 519605 - RNA, 19 nt, Homo sapiens
aaaggcagcugccucugcu

SEQ ID NO: 519606 - RNA, 12 nt, Homo sapiens
aaaggugacuuc

SEQ ID NO: 519607 - RNA, 19 nt, Homo sapiens
aaagguuuuggaucuugaa

SEQ ID NO: 519608 - RNA, 19 nt, Homo sapiens
aaaguaauuuaauuuguaa

SEQ ID NO: 519609 - RNA, 23 nt, Homo sapiens
aaaguauuuucuucucugugaga

SEQ ID NO: 519610 - RNA, 18 nt, Homo sapiens
aaagucaaauuuacuuua

SEQ ID NO: 519611 - RNA, 19 nt, Homo sapiens
aaagugugagcucuucccu

SEQ ID NO: 519612 - RNA, 18 nt, Homo sapiens
aaaguucaacuuauuuca

SEQ ID NO: 519613 - RNA, 21 nt, Homo sapiens
aaaguucaacuuauuucauaa

SEQ ID NO: 519614 - RNA, 20 nt, Homo sapiens
aaaguuuucuccacuggaaa

SEQ ID NO: 519615 - RNA, 21 nt, Homo sapiens
aaaguuuuuuauuaugcauua

SEQ ID NO: 519616 - RNA, 21 nt, Homo sapiens
aaauaguauacauugucuuga

SEQ ID NO: 519617 - RNA, 13 nt, Homo sapiens
aaauagucuucca

SEQ ID NO: 519618 - RNA, 16 nt, Homo sapiens
aaauauaagacauuug

SEQ ID NO: 519619 - RNA, 22 nt, Homo sapiens
aaauauagcuaauaacauguga

SEQ ID NO: 519620 - RNA, 23 nt, Homo sapiens
aaauauauauuauauauuuacaa

SEQ ID NO: 519621 - RNA, 16 nt, Homo sapiens
aaaucuaccacuguau

SEQ ID NO: 519622 - RNA, 15 nt, Homo sapiens
aaaucuccaucucaa

SEQ ID NO: 519623 - RNA, 16 nt, Homo sapiens
aaaucuccugcugauu

SEQ ID NO: 519624 - RNA, 23 nt, Homo sapiens
aaaucucuucuuugcugcaguca

SEQ ID NO: 519625 - RNA, 18 nt, Homo sapiens
aaaucuucccaguauuau

SEQ ID NO: 519626 - RNA, 20 nt, Homo sapiens
aaaugggaguacugaugaaa

SEQ ID NO: 519627 - RNA, 22 nt, Homo sapiens
aaaugugaagggucaacuccaa

SEQ ID NO: 519628 - RNA, 18 nt, Homo sapiens
aaauguuuauacuguauu

SEQ ID NO: 519629 - RNA, 16 nt, Homo sapiens
aaauuagccauuucac

SEQ ID NO: 519630 - RNA, 16 nt, Homo sapiens
aaauugguaauauaca

SEQ ID NO: 519631 - RNA, 13 nt, Homo sapiens
aaauuuauauuca

SEQ ID NO: 519632 - RNA, 22 nt, Homo sapiens
aaauuuccuuucauaccuugaa

SEQ ID NO: 519633 - RNA, 17 nt, Homo sapiens
gacacgccuaaggucac

SEQ ID NO: 519634 - RNA, 18 nt, Homo sapiens
gacacuaaccagagucag

SEQ ID NO: 519635 - RNA, 14 nt, Homo sapiens
gacagacauacauu

SEQ ID NO: 519636 - RNA, 16 nt, Homo sapiens
gacagcugugcucuca

SEQ ID NO: 519637 - RNA, 23 nt, Homo sapiens
gacagugacuggugccaguguca

SEQ ID NO: 519638 - RNA, 23 nt, Homo sapiens
gacauacauucccucuaauuuga

SEQ ID NO: 519639 - RNA, 22 nt, Homo sapiens
gacauggaggugccggaugcag

SEQ ID NO: 519640 - RNA, 22 nt, Homo sapiens
gacauguagguaggaagcacug

SEQ ID NO: 519641 - RNA, 18 nt, Homo sapiens
gacccagucccacacugu

SEQ ID NO: 519642 - RNA, 12 nt, Homo sapiens
gacccagugcag

SEQ ID NO: 519643 - RNA, 20 nt, Homo sapiens
gacccccguggggcagggag

SEQ ID NO: 519644 - RNA, 18 nt, Homo sapiens
gaccccugacucaucauu

SEQ ID NO: 519645 - RNA, 21 nt, Homo sapiens
gaccgcguuggaaggugcaga

SEQ ID NO: 519646 - RNA, 20 nt, Homo sapiens
gaccugagucugcaugugca

SEQ ID NO: 519647 - RNA, 17 nt, Homo sapiens
gaccuggagacugacaa

SEQ ID NO: 519648 - RNA, 23 nt, Homo sapiens
gaccuggagacugacaaccucau

SEQ ID NO: 519649 - RNA, 13 nt, Homo sapiens
gaccuuaaaugca

SEQ ID NO: 519650 - RNA, 19 nt, Homo sapiens
gaccuuuaccuccugccuu

SEQ ID NO: 519651 - RNA, 23 nt, Homo sapiens
gacgcacggcauuagcuuccugc

SEQ ID NO: 519652 - RNA, 14 nt, Homo sapiens
gacguguggugugc

SEQ ID NO: 519653 - RNA, 19 nt, Homo sapiens
gacuacacaauacaguauu

SEQ ID NO: 519654 - RNA, 18 nt, Homo sapiens
gacuagaggcuugcauaa

SEQ ID NO: 519655 - RNA, 12 nt, Homo sapiens
gacuccaucucu

SEQ ID NO: 519656 - RNA, 13 nt, Homo sapiens
gacucuccaggga

SEQ ID NO: 519657 - RNA, 20 nt, Homo sapiens
gacucuggaggccugugccu

SEQ ID NO: 519658 - RNA, 21 nt, Homo sapiens
gacucuggggaggugaacugg

SEQ ID NO: 519659 - RNA, 17 nt, Homo sapiens
gacucuugcagggguag

SEQ ID NO: 519660 - RNA, 16 nt, Homo sapiens
gacugacccccaucug

SEQ ID NO: 519661 - RNA, 17 nt, Homo sapiens
gacugacccccaucuga

SEQ ID NO: 519662 - RNA, 22 nt, Homo sapiens
gacugcuauucuagagcuuuua

SEQ ID NO: 519663 - RNA, 12 nt, Homo sapiens
gacugcuuuuag

SEQ ID NO: 519664 - RNA, 17 nt, Homo sapiens
gacuggauguaccacca

SEQ ID NO: 519665 - RNA, 15 nt, Homo sapiens
gacugucacuugcug

SEQ ID NO: 519666 - RNA, 14 nt, Homo sapiens
gacugucuuucaga

SEQ ID NO: 519667 - RNA, 19 nt, Homo sapiens
gacuuaccuggcagacuug

SEQ ID NO: 519668 - RNA, 15 nt, Homo sapiens
gacuuauugccaaaa

SEQ ID NO: 519669 - RNA, 22 nt, Homo sapiens
gacuucagcucagagagcacca

SEQ ID NO: 519670 - RNA, 22 nt, Homo sapiens
gacuuccccucaacaugcugcc

SEQ ID NO: 519671 - RNA, 16 nt, Homo sapiens
gacuucuaccugcccu

SEQ ID NO: 519672 - RNA, 21 nt, Homo sapiens
gacuuggcaacagaagugguu

SEQ ID NO: 519673 - RNA, 16 nt, Homo sapiens
gagaaagcagccauug

SEQ ID NO: 519674 - RNA, 23 nt, Homo sapiens
gagaaauuccuuagucauggugu

SEQ ID NO: 519675 - RNA, 17 nt, Homo sapiens
gagaagcaucauuuccc

SEQ ID NO: 519676 - RNA, 16 nt, Homo sapiens
gagaaggugcagguga

SEQ ID NO: 519677 - RNA, 20 nt, Homo sapiens
gagaaucucagcgugggcca

SEQ ID NO: 519678 - RNA, 19 nt, Homo sapiens
gagacagugacuggugcca

SEQ ID NO: 519679 - RNA, 22 nt, Homo sapiens
gagacagugacuggugccagug

SEQ ID NO: 519680 - RNA, 14 nt, Homo sapiens
gagacucagugcag

SEQ ID NO: 519681 - RNA, 14 nt, Homo sapiens
gagacuccgucuca

SEQ ID NO: 519682 - RNA, 13 nt, Homo sapiens
gagagaaaacugc

SEQ ID NO: 519683 - RNA, 16 nt, Homo sapiens
gagagaugggccaggc

SEQ ID NO: 519684 - RNA, 20 nt, Homo sapiens
gagagcgagacccugucuca

SEQ ID NO: 519685 - RNA, 18 nt, Homo sapiens
gagaggggacucaaacag

SEQ ID NO: 519686 - RNA, 16 nt, Homo sapiens
gagauaaaccaauaaa

SEQ ID NO: 519687 - RNA, 16 nt, Homo sapiens
gagauaggaaacugaa

SEQ ID NO: 519688 - RNA, 12 nt, Homo sapiens
gagaucaugcca

SEQ ID NO: 519689 - RNA, 14 nt, Homo sapiens
gagaugacagggaa

SEQ ID NO: 519690 - RNA, 19 nt, Homo sapiens
gagaugcuggacuugccua

SEQ ID NO: 519691 - RNA, 20 nt, Homo sapiens
gagauugagcagaagaucaa

SEQ ID NO: 519692 - RNA, 12 nt, Homo sapiens
gagauuuccucc

SEQ ID NO: 519693 - RNA, 20 nt, Homo sapiens
gagcaccacacccaguggga

SEQ ID NO: 519694 - RNA, 20 nt, Homo sapiens
gagccgagaucaugccauug

SEQ ID NO: 519695 - RNA, 16 nt, Homo sapiens
gagcgucacggccaag

SEQ ID NO: 519696 - RNA, 18 nt, Homo sapiens
gagcugucccaccugcac

SEQ ID NO: 519697 - RNA, 19 nt, Homo sapiens
gagcugucccaccugcaca

SEQ ID NO: 519698 - RNA, 21 nt, Homo sapiens
gagcuuggacagucugagcug

SEQ ID NO: 519699 - RNA, 17 nt, Homo sapiens
gaggacaauacuggggu

SEQ ID NO: 519700 - RNA, 16 nt, Homo sapiens
gaggacaguggcagac

SEQ ID NO: 519701 - RNA, 20 nt, Homo sapiens
gaggagcaccuccgccagau

SEQ ID NO: 519702 - RNA, 14 nt, Homo sapiens
gaggaucuggagaa

SEQ ID NO: 519703 - RNA, 21 nt, Homo sapiens
gaggcaagugugggggguccu

SEQ ID NO: 519704 - RNA, 21 nt, Homo sapiens
gaggcaggagaauggugugaa

SEQ ID NO: 519705 - RNA, 13 nt, Homo sapiens
gaggccacagcug

SEQ ID NO: 519706 - RNA, 14 nt, Homo sapiens
gaggccagacccac

SEQ ID NO: 519707 - RNA, 18 nt, Homo sapiens
gaggccgaggcgggugga

SEQ ID NO: 519708 - RNA, 13 nt, Homo sapiens
gaggccugugcua

SEQ ID NO: 519709 - RNA, 13 nt, Homo sapiens
gaggcuacaguga

SEQ ID NO: 519710 - RNA, 16 nt, Homo sapiens
gaggcugccccucuca

SEQ ID NO: 519711 - RNA, 18 nt, Homo sapiens
gaggcugccccucucacc

SEQ ID NO: 519712 - RNA, 20 nt, Homo sapiens
gaggcugccccucucaccaa

SEQ ID NO: 519713 - RNA, 23 nt, Homo sapiens
gagggaagaaugaacacucccca

SEQ ID NO: 519714 - RNA, 22 nt, Homo sapiens
gagggacgacaccucugguuuu

SEQ ID NO: 519715 - RNA, 22 nt, Homo sapiens
gagggcccuccgaccacuucca

SEQ ID NO: 519716 - RNA, 15 nt, Homo sapiens
gagggucuucuuaca

SEQ ID NO: 519717 - RNA, 15 nt, Homo sapiens
gagguaaaaaacugu

SEQ ID NO: 519718 - RNA, 23 nt, Homo sapiens
gaggucaggaguucaagaccagc

SEQ ID NO: 519719 - RNA, 18 nt, Homo sapiens
aaaaaugucucaugucaa

SEQ ID NO: 519720 - RNA, 22 nt, Homo sapiens
aaaacacacacaaagcacauug

SEQ ID NO: 519721 - RNA, 13 nt, Homo sapiens
aaaacauguuaau

SEQ ID NO: 519722 - RNA, 12 nt, Homo sapiens
aaaacauuugcu

SEQ ID NO: 519723 - RNA, 11 nt, Homo sapiens
aaaacuuguaa

SEQ ID NO: 519724 - RNA, 15 nt, Homo sapiens
aaaagaaaccuucca

SEQ ID NO: 519725 - RNA, 15 nt, Homo sapiens
aaaagacugaaucua

SEQ ID NO: 519726 - RNA, 13 nt, Homo sapiens
aaaagcacacucc

SEQ ID NO: 519727 - RNA, 22 nt, Homo sapiens
aaaauacuuuugcuuucaggga

SEQ ID NO: 519728 - RNA, 17 nt, Homo sapiens
aaaauauguaauuucaa

SEQ ID NO: 519729 - RNA, 19 nt, Homo sapiens
aaaaucagagaacuuuccc

SEQ ID NO: 519730 - RNA, 24 nt, Homo sapiens
aaaauccuauucugaugaaucuca

SEQ ID NO: 519731 - RNA, 13 nt, Homo sapiens
aaaaucuccaucu

SEQ ID NO: 519732 - RNA, 21 nt, Homo sapiens
aaaaugacauuaaaugcaaua

SEQ ID NO: 519733 - RNA, 15 nt, Homo sapiens
aaaaugucaggccuu

SEQ ID NO: 519734 - RNA, 15 nt, Homo sapiens
aaaauuuuagcucuu

SEQ ID NO: 519735 - RNA, 17 nt, Homo sapiens
aaacaauauguuugcaa

SEQ ID NO: 519736 - RNA, 21 nt, Homo sapiens
aaacacccgacgucauguauu

SEQ ID NO: 519737 - RNA, 19 nt, Homo sapiens
aaacaguccaaacuguucu

SEQ ID NO: 519738 - RNA, 20 nt, Homo sapiens
aaacauuggauuuuuccuua

SEQ ID NO: 519739 - RNA, 22 nt, Homo sapiens
aaacccauguugaucuuucuca

SEQ ID NO: 519740 - RNA, 19 nt, Homo sapiens
aaacccauucccucuccag

SEQ ID NO: 519741 - RNA, 18 nt, Homo sapiens
aaaccugccaagagucaa

SEQ ID NO: 519742 - RNA, 17 nt, Homo sapiens
aaacguuucuugaacaa

SEQ ID NO: 519743 - RNA, 16 nt, Homo sapiens
aaacuaaccaucugaa

SEQ ID NO: 519744 - RNA, 17 nt, Homo sapiens
aaacuauuuauaucaca

SEQ ID NO: 519745 - RNA, 22 nt, Homo sapiens
aaacucuguccacgauucacuc

SEQ ID NO: 519746 - RNA, 14 nt, Homo sapiens
aaacugaugacuua

SEQ ID NO: 519747 - RNA, 20 nt, Homo sapiens
aaacugcaaagcucggugcu

SEQ ID NO: 519748 - RNA, 23 nt, Homo sapiens
aaacugcuucccuuacuuugcug

SEQ ID NO: 519749 - RNA, 23 nt, Homo sapiens
aaagaagagaugagaaaugauga

SEQ ID NO: 519750 - RNA, 23 nt, Homo sapiens
aaagacugaaucuaccugcccua

SEQ ID NO: 519751 - RNA, 20 nt, Homo sapiens
aaagagaagcaucauuuccc

SEQ ID NO: 519752 - RNA, 15 nt, Homo sapiens
aaagauuugauguau

SEQ ID NO: 519753 - RNA, 16 nt, Homo sapiens
aaagcaaugugguagu

SEQ ID NO: 519754 - RNA, 22 nt, Homo sapiens
aaagcaguuacuaauaugccua

SEQ ID NO: 519755 - RNA, 23 nt, Homo sapiens
aaagcauuuuguaauaauaaaga

SEQ ID NO: 519756 - RNA, 13 nt, Homo sapiens
aaagccuuaggga

SEQ ID NO: 519757 - RNA, 17 nt, Homo sapiens
aaagcucaaaguaugca

SEQ ID NO: 519758 - RNA, 15 nt, Homo sapiens
aaagcucacuguagc

SEQ ID NO: 519759 - RNA, 24 nt, Homo sapiens
aaagcuguuccuugguccuaguaa

SEQ ID NO: 519760 - RNA, 23 nt, Homo sapiens
aaagcuucaaauuaaaacagcug

SEQ ID NO: 519761 - RNA, 16 nt, Homo sapiens
aaaggaaaaggucuga

SEQ ID NO: 519762 - RNA, 21 nt, Homo sapiens
aaaggaacucuagaagaccaa

SEQ ID NO: 519763 - RNA, 14 nt, Homo sapiens
aaaggaagacuaga

SEQ ID NO: 519764 - RNA, 23 nt, Homo sapiens
aaaggcagcugccucugcucccu

SEQ ID NO: 519765 - RNA, 13 nt, Homo sapiens
aaaggggcacugg

SEQ ID NO: 519766 - RNA, 18 nt, Homo sapiens
aaagguauuauacaugug

SEQ ID NO: 519767 - RNA, 16 nt, Homo sapiens
aaaggugacaguauua

SEQ ID NO: 519768 - RNA, 16 nt, Homo sapiens
aaaguaccuugaacuc

SEQ ID NO: 519769 - RNA, 19 nt, Homo sapiens
aaagucuguugauuaaaga

SEQ ID NO: 519770 - RNA, 16 nt, Homo sapiens
aaaguuuaaagacacu

SEQ ID NO: 519771 - RNA, 17 nt, Homo sapiens
aaaguuuuuaauuugau

SEQ ID NO: 519772 - RNA, 14 nt, Homo sapiens
aaauaauucuuccu

SEQ ID NO: 519773 - RNA, 16 nt, Homo sapiens
aaauaauucuuccucu

SEQ ID NO: 519774 - RNA, 12 nt, Homo sapiens
aaauacaugugu

SEQ ID NO: 519775 - RNA, 21 nt, Homo sapiens
aaauaccaaaugcauuguugu

SEQ ID NO: 519776 - RNA, 20 nt, Homo sapiens
aaauauccacccagcaggca

SEQ ID NO: 519777 - RNA, 18 nt, Homo sapiens
aaauaucugguuauauca

SEQ ID NO: 519778 - RNA, 22 nt, Homo sapiens
aaauauguccgcagaauggacu

SEQ ID NO: 519779 - RNA, 13 nt, Homo sapiens
aaaucacaucucc

SEQ ID NO: 519780 - RNA, 18 nt, Homo sapiens
aaaucagaccuggcugcu

SEQ ID NO: 519781 - RNA, 13 nt, Homo sapiens
aaaucaguauuug

SEQ ID NO: 519782 - RNA, 23 nt, Homo sapiens
aaauccgcauugauggccucaau

SEQ ID NO: 519783 - RNA, 14 nt, Homo sapiens
aaaucuccaucuca

SEQ ID NO: 519784 - RNA, 19 nt, Homo sapiens
aaaucucuucaaauucuuc

SEQ ID NO: 519785 - RNA, 19 nt, Homo sapiens
aaaucuggguaucuuucca

SEQ ID NO: 519786 - RNA, 19 nt, Homo sapiens
aaaucuucccaugcauucu

SEQ ID NO: 519787 - RNA, 19 nt, Homo sapiens
aaaugaaguuuugauuuau

SEQ ID NO: 519788 - RNA, 15 nt, Homo sapiens
aaaugauagcagaau

SEQ ID NO: 519789 - RNA, 20 nt, Homo sapiens
aaaugcauauccugagccau

SEQ ID NO: 519790 - RNA, 23 nt, Homo sapiens
aaaugccagucucauugucaccu

SEQ ID NO: 519791 - RNA, 19 nt, Homo sapiens
aaauguauuuugacacugg

SEQ ID NO: 519792 - RNA, 14 nt, Homo sapiens
aaaugucaggccuu

SEQ ID NO: 519793 - RNA, 17 nt, Homo sapiens
aaauguuuauacuguau

SEQ ID NO: 519794 - RNA, 14 nt, Homo sapiens
aaauuaacuguaug

SEQ ID NO: 519795 - RNA, 11 nt, Homo sapiens
aaauuacuuua

SEQ ID NO: 519796 - RNA, 15 nt, Homo sapiens
aaauucuucacaugu

SEQ ID NO: 519797 - RNA, 19 nt, Homo sapiens
aaauucuucuaauugcugu

SEQ ID NO: 519798 - RNA, 15 nt, Homo sapiens
aaauugggcugugaa

SEQ ID NO: 519799 - RNA, 16 nt, Homo sapiens
aaauuguuuagugaua

SEQ ID NO: 519800 - RNA, 19 nt, Homo sapiens
aaauuuccuuucauaccuu

SEQ ID NO: 519801 - RNA, 16 nt, Homo sapiens
aaauuuugaaaacugu

SEQ ID NO: 519802 - RNA, 17 nt, Homo sapiens
aacaacauccacuguua

SEQ ID NO: 519803 - RNA, 23 nt, Homo sapiens
aacaacauccacuguuagcacau

SEQ ID NO: 519804 - RNA, 17 nt, Homo sapiens
aacacuuccagcauuua

SEQ ID NO: 519805 - RNA, 13 nt, Homo sapiens
aacagacaauauu

SEQ ID NO: 519806 - RNA, 21 nt, Homo sapiens
aacagauuuggaaagacugga

SEQ ID NO: 519807 - RNA, 22 nt, Homo sapiens
aacagcauuacccuccucucuc

SEQ ID NO: 519808 - RNA, 19 nt, Homo sapiens
aacaggacagcacugggaa

SEQ ID NO: 519809 - RNA, 19 nt, Homo sapiens
aacaggcucagaucucaug

SEQ ID NO: 519810 - RNA, 20 nt, Homo sapiens
aacaguccaaacuguucuga

SEQ ID NO: 519811 - RNA, 14 nt, Homo sapiens
aacaguuguauguu

SEQ ID NO: 519812 - RNA, 11 nt, Homo sapiens
aacaugcugcc

SEQ ID NO: 519813 - RNA, 16 nt, Homo sapiens
aacaugcuggugaaua

SEQ ID NO: 519814 - RNA, 23 nt, Homo sapiens
aacauguaauaaaaaguauaugu

SEQ ID NO: 519815 - RNA, 17 nt, Homo sapiens
aacauguccuaauucuu

SEQ ID NO: 519816 - RNA, 22 nt, Homo sapiens
aacaugucucuguguaguucca

SEQ ID NO: 519817 - RNA, 14 nt, Homo sapiens
aaccacacuugaaa

SEQ ID NO: 519818 - RNA, 15 nt, Homo sapiens
aaccaccuucaccug

SEQ ID NO: 519819 - RNA, 23 nt, Homo sapiens
aaccauguauaugagcuuauaaa

SEQ ID NO: 519820 - RNA, 22 nt, Homo sapiens
aacccaauacagucuaguuucc

SEQ ID NO: 519821 - RNA, 17 nt, Homo sapiens
aacccauucccucucca

SEQ ID NO: 519822 - RNA, 17 nt, Homo sapiens
aaccccacaaucuagga

SEQ ID NO: 519823 - RNA, 13 nt, Homo sapiens
aacccccaucucu

SEQ ID NO: 519824 - RNA, 18 nt, Homo sapiens
aacccggggcuggugggc

SEQ ID NO: 519825 - RNA, 13 nt, Homo sapiens
aacccuaccuguc

SEQ ID NO: 519826 - RNA, 14 nt, Homo sapiens
aaccuaguacugcc

SEQ ID NO: 519827 - RNA, 11 nt, Homo sapiens
aaccucagggc

SEQ ID NO: 519828 - RNA, 12 nt, Homo sapiens
aaccuccagugu

SEQ ID NO: 519829 - RNA, 19 nt, Homo sapiens
aaccuccagugucaggguc

SEQ ID NO: 519830 - RNA, 20 nt, Homo sapiens
aaccucucgaacaguauuca

SEQ ID NO: 519831 - RNA, 16 nt, Homo sapiens
aaccucuucaugagcu

SEQ ID NO: 519832 - RNA, 20 nt, Homo sapiens
aacgaagaguucccuugaaa

SEQ ID NO: 519833 - RNA, 21 nt, Homo sapiens
aacgcuucgggaaaauauuca

SEQ ID NO: 519834 - RNA, 15 nt, Homo sapiens
aacguccacaugaaa

SEQ ID NO: 519835 - RNA, 16 nt, Homo sapiens
aacgucuuuuuauauc

SEQ ID NO: 519836 - RNA, 15 nt, Homo sapiens
aacgugugugucuua

SEQ ID NO: 519837 - RNA, 15 nt, Homo sapiens
acauacuuaaugcau

SEQ ID NO: 519838 - RNA, 13 nt, Homo sapiens
acauagugaaaau

SEQ ID NO: 519839 - RNA, 18 nt, Homo sapiens
acauauauauuaauacug

SEQ ID NO: 519840 - RNA, 14 nt, Homo sapiens
acaucggccuccau

SEQ ID NO: 519841 - RNA, 18 nt, Homo sapiens
acaucuccaggcuuucaa

SEQ ID NO: 519842 - RNA, 22 nt, Homo sapiens
acaucuccaggcuuucaauguu

SEQ ID NO: 519843 - RNA, 20 nt, Homo sapiens
acaucugagagaugacaggg

SEQ ID NO: 519844 - RNA, 13 nt, Homo sapiens
acaucugcaauau

SEQ ID NO: 519845 - RNA, 13 nt, Homo sapiens
acaugauaguuaa

SEQ ID NO: 519846 - RNA, 22 nt, Homo sapiens
acaugccccccagauugcugca

SEQ ID NO: 519847 - RNA, 20 nt, Homo sapiens
acauguaauccuaaauuuac

SEQ ID NO: 519848 - RNA, 20 nt, Homo sapiens
acauguacuacagcuauauu

SEQ ID NO: 519849 - RNA, 23 nt, Homo sapiens
acauguagguaggaagcacugaa

SEQ ID NO: 519850 - RNA, 21 nt, Homo sapiens
acauguuaaugacaauauucc

SEQ ID NO: 519851 - RNA, 23 nt, Homo sapiens
acauguuaaugacaauauuccag

SEQ ID NO: 519852 - RNA, 10 nt, Homo sapiens
acauugccaa

SEQ ID NO: 519853 - RNA, 16 nt, Homo sapiens
acauugguucuuucau

SEQ ID NO: 519854 - RNA, 12 nt, Homo sapiens
acauuguagccu

SEQ ID NO: 519855 - RNA, 17 nt, Homo sapiens
acauuuaaaauugcuau

SEQ ID NO: 519856 - RNA, 18 nt, Homo sapiens
acauuucucauaccuucc

SEQ ID NO: 519857 - RNA, 18 nt, Homo sapiens
acauuuuuccguuugcuu

SEQ ID NO: 519858 - RNA, 13 nt, Homo sapiens
accaaaaccacag

SEQ ID NO: 519859 - RNA, 16 nt, Homo sapiens
accaagggcaccugga

SEQ ID NO: 519860 - RNA, 16 nt, Homo sapiens
accaauguaacacugg

SEQ ID NO: 519861 - RNA, 16 nt, Homo sapiens
accaauuaagcagcuu

SEQ ID NO: 519862 - RNA, 22 nt, Homo sapiens
accacaaccaccuucaccugga

SEQ ID NO: 519863 - RNA, 20 nt, Homo sapiens
accacgggacaucacagggu

SEQ ID NO: 519864 - RNA, 23 nt, Homo sapiens
accacuagaaagugggcuuaaug

SEQ ID NO: 519865 - RNA, 15 nt, Homo sapiens
accacucaggccaca

SEQ ID NO: 519866 - RNA, 14 nt, Homo sapiens
accaggauuuccuu

SEQ ID NO: 519867 - RNA, 22 nt, Homo sapiens
accaggcagugugccaguuuaa

SEQ ID NO: 519868 - RNA, 21 nt, Homo sapiens
accaucugaagaaacuuccca

SEQ ID NO: 519869 - RNA, 14 nt, Homo sapiens
acccacuuugucca

SEQ ID NO: 519870 - RNA, 16 nt, Homo sapiens
acccaggaagacuuug

SEQ ID NO: 519871 - RNA, 18 nt, Homo sapiens
acccagucccacacugug

SEQ ID NO: 519872 - RNA, 23 nt, Homo sapiens
acccaguuugauaccugcacugu

SEQ ID NO: 519873 - RNA, 22 nt, Homo sapiens
acccuaacacaguauaucccaa

SEQ ID NO: 519874 - RNA, 17 nt, Homo sapiens
acccucauuucucaucu

SEQ ID NO: 519875 - RNA, 23 nt, Homo sapiens
acccugaagcuuaggacuaccag

SEQ ID NO: 519876 - RNA, 18 nt, Homo sapiens
acccugagagucugagaa

SEQ ID NO: 519877 - RNA, 20 nt, Homo sapiens
acccugcgucgaaggaugcu

SEQ ID NO: 519878 - RNA, 23 nt, Homo sapiens
acccuuauaaaauccugugcaau

SEQ ID NO: 519879 - RNA, 22 nt, Homo sapiens
acccuuuucccccuucccauuu

SEQ ID NO: 519880 - RNA, 16 nt, Homo sapiens
accgaagccacuuucu

SEQ ID NO: 519881 - RNA, 17 nt, Homo sapiens
accgcccaucaggguuc

SEQ ID NO: 519882 - RNA, 21 nt, Homo sapiens
accggggaggcggagguugca

SEQ ID NO: 519883 - RNA, 20 nt, Homo sapiens
accguccucagcaguccaca

SEQ ID NO: 519884 - RNA, 16 nt, Homo sapiens
accuagcuacacugag

SEQ ID NO: 519885 - RNA, 19 nt, Homo sapiens
accuaguccccagccugcu

SEQ ID NO: 519886 - RNA, 20 nt, Homo sapiens
accucaguucccucuugcuc

SEQ ID NO: 519887 - RNA, 19 nt, Homo sapiens
accuccaggcuuucccacu

SEQ ID NO: 519888 - RNA, 17 nt, Homo sapiens
accuccagugucagggu

SEQ ID NO: 519889 - RNA, 19 nt, Homo sapiens
accuccgccagauccugca

SEQ ID NO: 519890 - RNA, 19 nt, Homo sapiens
accucggcacacacugugc

SEQ ID NO: 519891 - RNA, 22 nt, Homo sapiens
accucuguuaccacgacuucua

SEQ ID NO: 519892 - RNA, 19 nt, Homo sapiens
accucuucaugagcuugaa

SEQ ID NO: 519893 - RNA, 22 nt, Homo sapiens
accucuucaugagcuugaacaa

SEQ ID NO: 519894 - RNA, 14 nt, Homo sapiens
accugacucuugca

SEQ ID NO: 519895 - RNA, 20 nt, Homo sapiens
accugagucugcaugugcac

SEQ ID NO: 519896 - RNA, 22 nt, Homo sapiens
accugccaagagucaacagguc

SEQ ID NO: 519897 - RNA, 14 nt, Homo sapiens
accugcgcucucag

SEQ ID NO: 519898 - RNA, 16 nt, Homo sapiens
accuggcccuugcaau

SEQ ID NO: 519899 - RNA, 22 nt, Homo sapiens
accuggggagugguuaggcagc

SEQ ID NO: 519900 - RNA, 15 nt, Homo sapiens
accuguaaucccagc

SEQ ID NO: 519901 - RNA, 13 nt, Homo sapiens
accuuccaacacu

SEQ ID NO: 519902 - RNA, 21 nt, Homo sapiens
accuuuaggccaucucagcuu

SEQ ID NO: 519903 - RNA, 14 nt, Homo sapiens
accuuugguuuuaa

SEQ ID NO: 519904 - RNA, 14 nt, Homo sapiens
accuuuuacucuuc

SEQ ID NO: 519905 - RNA, 22 nt, Homo sapiens
acgauuuugcacaaauauccac

SEQ ID NO: 519906 - RNA, 23 nt, Homo sapiens
acggacuuccuuuaggaucucag

SEQ ID NO: 519907 - RNA, 18 nt, Homo sapiens
acggcaacugaagcggcu

SEQ ID NO: 519908 - RNA, 16 nt, Homo sapiens
acggcaucaaggugcu

SEQ ID NO: 519909 - RNA, 20 nt, Homo sapiens
acgguggcucacgccuguaa

SEQ ID NO: 519910 - RNA, 17 nt, Homo sapiens
acgugaggcccauucuu

SEQ ID NO: 519911 - RNA, 16 nt, Homo sapiens
acguggcacacacuga

SEQ ID NO: 519912 - RNA, 14 nt, Homo sapiens
acguguuccagugu

SEQ ID NO: 519913 - RNA, 12 nt, Homo sapiens
acguuugauaca

SEQ ID NO: 519914 - RNA, 21 nt, Homo sapiens
acguuugcuccuugacuccaa

SEQ ID NO: 519915 - RNA, 23 nt, Homo sapiens
acuaacucaaauacacauuugcu

SEQ ID NO: 519916 - RNA, 19 nt, Homo sapiens
acuaagguggaugccaacc

SEQ ID NO: 519917 - RNA, 14 nt, Homo sapiens
acuaauugguacuu

SEQ ID NO: 519918 - RNA, 15 nt, Homo sapiens
acuacaucugggacu

SEQ ID NO: 519919 - RNA, 22 nt, Homo sapiens
acuacaucugggacugacuuuc

SEQ ID NO: 519920 - RNA, 13 nt, Homo sapiens
acuacuguacucc

SEQ ID NO: 519921 - RNA, 19 nt, Homo sapiens
acuaugaggacugccuuau

SEQ ID NO: 519922 - RNA, 23 nt, Homo sapiens
acuaugauuuaauuugaaauaug

SEQ ID NO: 519923 - RNA, 20 nt, Homo sapiens
acuauugugaccacaggcug

SEQ ID NO: 519924 - RNA, 22 nt, Homo sapiens
acuauuucugggucuuuugcua

SEQ ID NO: 519925 - RNA, 15 nt, Homo sapiens
acucaaaucaguaua

SEQ ID NO: 519926 - RNA, 23 nt, Homo sapiens
acucaagguggacgugcguucug

SEQ ID NO: 519927 - RNA, 12 nt, Homo sapiens
acucacacuccc

SEQ ID NO: 519928 - RNA, 20 nt, Homo sapiens
acucaucuuagugccugaga

SEQ ID NO: 519929 - RNA, 14 nt, Homo sapiens
acuccagaugccac

SEQ ID NO: 519930 - RNA, 19 nt, Homo sapiens
acuccaugcuccuugagag

SEQ ID NO: 519931 - RNA, 13 nt, Homo sapiens
acucccacuuuuc

SEQ ID NO: 519932 - RNA, 16 nt, Homo sapiens
acucccagugaugcug

SEQ ID NO: 519933 - RNA, 14 nt, Homo sapiens
acuccugcuuaauc

SEQ ID NO: 519934 - RNA, 18 nt, Homo sapiens
acucuaaaguugauuuaa

SEQ ID NO: 519935 - RNA, 18 nt, Homo sapiens
acucuagaagaccaaaug

SEQ ID NO: 519936 - RNA, 15 nt, Homo sapiens
acucuaggguccagu

SEQ ID NO: 519937 - RNA, 20 nt, Homo sapiens
acucuaggguccaguggaug

SEQ ID NO: 519938 - RNA, 13 nt, Homo sapiens
acucucauguggc

SEQ ID NO: 519939 - RNA, 12 nt, Homo sapiens
acucugaaaaug

SEQ ID NO: 519940 - RNA, 21 nt, Homo sapiens
acucuguccacgauucacuca

SEQ ID NO: 519941 - RNA, 18 nt, Homo sapiens
acucuguuuccuggucag

SEQ ID NO: 519942 - RNA, 14 nt, Homo sapiens
acucuugaucucuc

SEQ ID NO: 519943 - RNA, 16 nt, Homo sapiens
acucuugaucucucuu

SEQ ID NO: 519944 - RNA, 23 nt, Homo sapiens
acucuuguggucaucauggccag

SEQ ID NO: 519945 - RNA, 20 nt, Homo sapiens
acugaaccauuccaacuuca

SEQ ID NO: 519946 - RNA, 16 nt, Homo sapiens
acugacaaagacaucg

SEQ ID NO: 519947 - RNA, 16 nt, Homo sapiens
acugacuccucagucc

SEQ ID NO: 519948 - RNA, 16 nt, Homo sapiens
acugccaggcugccuc

SEQ ID NO: 519949 - RNA, 13 nt, Homo sapiens
acugccugaauaa

SEQ ID NO: 519950 - RNA, 20 nt, Homo sapiens
acugcugcacaacaagauac

SEQ ID NO: 519951 - RNA, 20 nt, Homo sapiens
acugcuucccuuacuuugcu

SEQ ID NO: 519952 - RNA, 19 nt, Homo sapiens
acugcuuuuuugauucuga

SEQ ID NO: 519953 - RNA, 12 nt, Homo sapiens
acuggaccucag

SEQ ID NO: 519954 - RNA, 23 nt, Homo sapiens
acuggccucccuuugugugcaua

SEQ ID NO: 519955 - RNA, 14 nt, Homo sapiens
acugggcucaagag

SEQ ID NO: 519956 - RNA, 15 nt, Homo sapiens
augcuucagauauua

SEQ ID NO: 519957 - RNA, 22 nt, Homo sapiens
augcuugacauaccuaccagua

SEQ ID NO: 519958 - RNA, 18 nt, Homo sapiens
auggaacaggcucagauc

SEQ ID NO: 519959 - RNA, 14 nt, Homo sapiens
auggauaaagauga

SEQ ID NO: 519960 - RNA, 21 nt, Homo sapiens
auggcagaagggaauugcuca

SEQ ID NO: 519961 - RNA, 15 nt, Homo sapiens
auggcaggugccugu

SEQ ID NO: 519962 - RNA, 13 nt, Homo sapiens
auggcaucuucaa

SEQ ID NO: 519963 - RNA, 22 nt, Homo sapiens
auggcuuauuucuaugacaaau

SEQ ID NO: 519964 - RNA, 23 nt, Homo sapiens
auggcuugccuaagacuugccca

SEQ ID NO: 519965 - RNA, 22 nt, Homo sapiens
augggacggagguccuuuggac

SEQ ID NO: 519966 - RNA, 19 nt, Homo sapiens
augggacugugaggccaua

SEQ ID NO: 519967 - RNA, 17 nt, Homo sapiens
augggagcuuaacuuua

SEQ ID NO: 519968 - RNA, 14 nt, Homo sapiens
augggugauucucu

SEQ ID NO: 519969 - RNA, 16 nt, Homo sapiens
augguacggacuuccu

SEQ ID NO: 519970 - RNA, 20 nt, Homo sapiens
augguagaaguuuggcugcu

SEQ ID NO: 519971 - RNA, 23 nt, Homo sapiens
auggucucagcuugagaccauuu

SEQ ID NO: 519972 - RNA, 19 nt, Homo sapiens
auguaaaaagauucccaaa

SEQ ID NO: 519973 - RNA, 13 nt, Homo sapiens
auguaaaguuaaa

SEQ ID NO: 519974 - RNA, 18 nt, Homo sapiens
auguaauuauguucuaag

SEQ ID NO: 519975 - RNA, 17 nt, Homo sapiens
auguagacugugccaga

SEQ ID NO: 519976 - RNA, 21 nt, Homo sapiens
auguauggaaucccacuguau

SEQ ID NO: 519977 - RNA, 18 nt, Homo sapiens
augucagcacacacuuac

SEQ ID NO: 519978 - RNA, 15 nt, Homo sapiens
augucccugggccag

SEQ ID NO: 519979 - RNA, 22 nt, Homo sapiens
augucuuuuacccggcacauuc

SEQ ID NO: 519980 - RNA, 14 nt, Homo sapiens
augugaaaagaaua

SEQ ID NO: 519981 - RNA, 23 nt, Homo sapiens
augugaagagggagaagcaugaa

SEQ ID NO: 519982 - RNA, 13 nt, Homo sapiens
auguggucucagg

SEQ ID NO: 519983 - RNA, 16 nt, Homo sapiens
auguguaaagauuuau

SEQ ID NO: 519984 - RNA, 15 nt, Homo sapiens
auguguccucaggga

SEQ ID NO: 519985 - RNA, 16 nt, Homo sapiens
auguguccuggugaga

SEQ ID NO: 519986 - RNA, 21 nt, Homo sapiens
auguguggcucagugccugga

SEQ ID NO: 519987 - RNA, 18 nt, Homo sapiens
auguuaaagagaaugagu

SEQ ID NO: 519988 - RNA, 17 nt, Homo sapiens
auguucccccuguuuca

SEQ ID NO: 519989 - RNA, 19 nt, Homo sapiens
auguucuuuaaaggcaucu

SEQ ID NO: 519990 - RNA, 13 nt, Homo sapiens
auguugcaaagaa

SEQ ID NO: 519991 - RNA, 22 nt, Homo sapiens
auguuguguuuuuaacauguca

SEQ ID NO: 519992 - RNA, 16 nt, Homo sapiens
auguuuauacuguauu

SEQ ID NO: 519993 - RNA, 13 nt, Homo sapiens
auguuuccauuug

SEQ ID NO: 519994 - RNA, 19 nt, Homo sapiens
auuaaauucugagccugau

SEQ ID NO: 519995 - RNA, 21 nt, Homo sapiens
auuaagaaaccuugcucuccu

SEQ ID NO: 519996 - RNA, 23 nt, Homo sapiens
auuaagcauguuuuguugcucag

SEQ ID NO: 519997 - RNA, 14 nt, Homo sapiens
auuaauguuuucaa

SEQ ID NO: 519998 - RNA, 22 nt, Homo sapiens
auuacacugaucuuauguguua

SEQ ID NO: 519999 - RNA, 17 nt, Homo sapiens
auuacaggcgugaucca

SEQ ID NO: 520000 - RNA, 21 nt, Homo sapiens
auuacaguccaaaauacuguu

SEQ ID NO: 520001 - RNA, 21 nt, Homo sapiens
auuacauauuuuuuguauauu

SEQ ID NO: 520002 - RNA, 19 nt, Homo sapiens
auuagaaaaaaauuacuaa

SEQ ID NO: 520003 - RNA, 14 nt, Homo sapiens
auuagaaacuacca

SEQ ID NO: 520004 - RNA, 23 nt, Homo sapiens
auuagauuucuauaggauuuuuc

SEQ ID NO: 520005 - RNA, 16 nt, Homo sapiens
auuauauuagucuguu

SEQ ID NO: 520006 - RNA, 20 nt, Homo sapiens
auuaucuaaaagaaaccuuc

SEQ ID NO: 520007 - RNA, 16 nt, Homo sapiens
auuaucuauuaucuca

SEQ ID NO: 520008 - RNA, 22 nt, Homo sapiens
auuaugaagaauacccaggaag

SEQ ID NO: 520009 - RNA, 20 nt, Homo sapiens
auuaugcauuauaucaaauc

SEQ ID NO: 520010 - RNA, 17 nt, Homo sapiens
auuauucuuuguuuccu

SEQ ID NO: 520011 - RNA, 14 nt, Homo sapiens
auuauuucuaaucc

SEQ ID NO: 520012 - RNA, 16 nt, Homo sapiens
auucagguaacacuag

SEQ ID NO: 520013 - RNA, 14 nt, Homo sapiens
auucauuggugaag

SEQ ID NO: 520014 - RNA, 17 nt, Homo sapiens
auucccagccuguggca

SEQ ID NO: 520015 - RNA, 22 nt, Homo sapiens
auucccgacgacacauauacau

SEQ ID NO: 520016 - RNA, 20 nt, Homo sapiens
auucgaaccaggaaauggaa

SEQ ID NO: 520017 - RNA, 20 nt, Homo sapiens
auucgugcauuuuuggauca

SEQ ID NO: 520018 - RNA, 12 nt, Homo sapiens
auucucagggcu

SEQ ID NO: 520019 - RNA, 22 nt, Homo sapiens
auucuccauuaauuaaaagugu

SEQ ID NO: 520020 - RNA, 21 nt, Homo sapiens
auucuuaacagugguucaaau

SEQ ID NO: 520021 - RNA, 12 nt, Homo sapiens
auucuucacucu

SEQ ID NO: 520022 - RNA, 13 nt, Homo sapiens
auucuugcacuga

SEQ ID NO: 520023 - RNA, 20 nt, Homo sapiens
auucuuugaaaacagaugac

SEQ ID NO: 520024 - RNA, 16 nt, Homo sapiens
auucuuuucuguuucu

SEQ ID NO: 520025 - RNA, 19 nt, Homo sapiens
auucuuuuggcaguucuga

SEQ ID NO: 520026 - RNA, 17 nt, Homo sapiens
auugaaacacagaguug

SEQ ID NO: 520027 - RNA, 22 nt, Homo sapiens
auugaaggcuuaauugacugaa

SEQ ID NO: 520028 - RNA, 15 nt, Homo sapiens
auugaaguguauaau

SEQ ID NO: 520029 - RNA, 18 nt, Homo sapiens
auugagcagaagaucaag

SEQ ID NO: 520030 - RNA, 21 nt, Homo sapiens
auugagcagaagaucaaggag

SEQ ID NO: 520031 - RNA, 12 nt, Homo sapiens
auugagguucuc

SEQ ID NO: 520032 - RNA, 16 nt, Homo sapiens
auugauuucugacucu

SEQ ID NO: 520033 - RNA, 15 nt, Homo sapiens
auugccaagucagau

SEQ ID NO: 520034 - RNA, 16 nt, Homo sapiens
auugcuaauuuagaga

SEQ ID NO: 520035 - RNA, 17 nt, Homo sapiens
auugcucagagaaggaa

SEQ ID NO: 520036 - RNA, 13 nt, Homo sapiens
auugcugccaaga

SEQ ID NO: 520037 - RNA, 15 nt, Homo sapiens
auuggaacugcaaug

SEQ ID NO: 520038 - RNA, 17 nt, Homo sapiens
auuggagaagauuuaug

SEQ ID NO: 520039 - RNA, 23 nt, Homo sapiens
auuggagucacugccaagucaua

SEQ ID NO: 520040 - RNA, 12 nt, Homo sapiens
auuggcacugug

SEQ ID NO: 520041 - RNA, 18 nt, Homo sapiens
auuggcacuguggagcuc

SEQ ID NO: 520042 - RNA, 17 nt, Homo sapiens
auuggccuccaaacaca

SEQ ID NO: 520043 - RNA, 20 nt, Homo sapiens
auugggacuccaugcuccuu

SEQ ID NO: 520044 - RNA, 17 nt, Homo sapiens
auuggugcauagcagau

SEQ ID NO: 520045 - RNA, 14 nt, Homo sapiens
auuguagccucaau

SEQ ID NO: 520046 - RNA, 13 nt, Homo sapiens
auugucaccucug

SEQ ID NO: 520047 - RNA, 21 nt, Homo sapiens
auugugagcgaauuagcaaua

SEQ ID NO: 520048 - RNA, 20 nt, Homo sapiens
auuguggucacaacuugaug

SEQ ID NO: 520049 - RNA, 18 nt, Homo sapiens
auuguuccugcgcugcaa

SEQ ID NO: 520050 - RNA, 15 nt, Homo sapiens
auuguuguugccaaa

SEQ ID NO: 520051 - RNA, 18 nt, Homo sapiens
auuguuguugccaaagag

SEQ ID NO: 520052 - RNA, 15 nt, Homo sapiens
auuguuugugauauu

SEQ ID NO: 520053 - RNA, 17 nt, Homo sapiens
auuuaaaauugcuaugu

SEQ ID NO: 520054 - RNA, 22 nt, Homo sapiens
auuuaaccaaccuaagggccca

SEQ ID NO: 520055 - RNA, 21 nt, Homo sapiens
auuuaaggccaggcauggugg

SEQ ID NO: 520056 - RNA, 16 nt, Homo sapiens
auuuacauccagcuuc

SEQ ID NO: 520057 - RNA, 14 nt, Homo sapiens
auuuacccuuuucc

SEQ ID NO: 520058 - RNA, 21 nt, Homo sapiens
auuuacuuagcagaaccacau

SEQ ID NO: 520059 - RNA, 12 nt, Homo sapiens
auuuaguugaua

SEQ ID NO: 520060 - RNA, 21 nt, Homo sapiens
auuuauaagcauugccauuga

SEQ ID NO: 520061 - RNA, 12 nt, Homo sapiens
auuuauauucau

SEQ ID NO: 520062 - RNA, 15 nt, Homo sapiens
auuuauuugguguuu

SEQ ID NO: 520063 - RNA, 22 nt, Homo sapiens
auuucaaaguuuuguuguacuu

SEQ ID NO: 520064 - RNA, 20 nt, Homo sapiens
auuucagugggaaauaugcc

SEQ ID NO: 520065 - RNA, 20 nt, Homo sapiens
auuuccauugcuuauuaugu

SEQ ID NO: 520066 - RNA, 11 nt, Homo sapiens
auuucuaaucc

SEQ ID NO: 520067 - RNA, 14 nt, Homo sapiens
auuucucaucugca

SEQ ID NO: 520068 - RNA, 23 nt, Homo sapiens
auuucucccuguuauaagcagca

SEQ ID NO: 520069 - RNA, 18 nt, Homo sapiens
auuucugaucuauacaaa

SEQ ID NO: 520070 - RNA, 14 nt, Homo sapiens
auuugaaggccagc

SEQ ID NO: 520071 - RNA, 18 nt, Homo sapiens
auuugacaaaacuaaccu

SEQ ID NO: 520072 - RNA, 19 nt, Homo sapiens
auuugaccacggacuccag

SEQ ID NO: 520073 - RNA, 23 nt, Homo sapiens
auuuggcuagcaaucugccugua

SEQ ID NO: 520074 - RNA, 23 nt, Homo sapiens
auuugguauauacuuugccacug

SEQ ID NO: 520075 - RNA, 19 nt, Homo sapiens
ggucugauuuugagguuua

SEQ ID NO: 520076 - RNA, 21 nt, Homo sapiens
ggucugugugugugugugugc

SEQ ID NO: 520077 - RNA, 13 nt, Homo sapiens
ggugcauagcaga

SEQ ID NO: 520078 - RNA, 17 nt, Homo sapiens
ggugcucuuugcugcac

SEQ ID NO: 520079 - RNA, 16 nt, Homo sapiens
gguggcggcugcacaa

SEQ ID NO: 520080 - RNA, 22 nt, Homo sapiens
gguggucucuucuuggggccca

SEQ ID NO: 520081 - RNA, 20 nt, Homo sapiens
gguguauccuggcccugggg

SEQ ID NO: 520082 - RNA, 13 nt, Homo sapiens
ggugucacauucc

SEQ ID NO: 520083 - RNA, 21 nt, Homo sapiens
ggugucaguauccaggcuuug

SEQ ID NO: 520084 - RNA, 23 nt, Homo sapiens
gguucucuuagcaacucagagaa

SEQ ID NO: 520085 - RNA, 22 nt, Homo sapiens
gguuucucucuacagugccaac

SEQ ID NO: 520086 - RNA, 23 nt, Homo sapiens
gguuuuagacgaggccacagcug

SEQ ID NO: 520087 - RNA, 22 nt, Homo sapiens
guaaaugaaacuuaagaauuga

SEQ ID NO: 520088 - RNA, 14 nt, Homo sapiens
guaacuagugaaau

SEQ ID NO: 520089 - RNA, 11 nt, Homo sapiens
guaacugcuga

SEQ ID NO: 520090 - RNA, 23 nt, Homo sapiens
guaauaauuggagaagauuuaug

SEQ ID NO: 520091 - RNA, 19 nt, Homo sapiens
guaauacguagcucucuua

SEQ ID NO: 520092 - RNA, 17 nt, Homo sapiens
guaaucuacaccaauga

SEQ ID NO: 520093 - RNA, 12 nt, Homo sapiens
guacaacccuga

SEQ ID NO: 520094 - RNA, 17 nt, Homo sapiens
guacaauaaagcaaugu

SEQ ID NO: 520095 - RNA, 19 nt, Homo sapiens
guacaauaaagcaaugugg

SEQ ID NO: 520096 - RNA, 21 nt, Homo sapiens
guacagaaauauccaugacaa

SEQ ID NO: 520097 - RNA, 15 nt, Homo sapiens
guacauacgauuuaa

SEQ ID NO: 520098 - RNA, 20 nt, Homo sapiens
guaccucaaucuauucugua

SEQ ID NO: 520099 - RNA, 22 nt, Homo sapiens
guacugcaaaguguaugcagua

SEQ ID NO: 520100 - RNA, 21 nt, Homo sapiens
guacuuuuaaaaacauaacau

SEQ ID NO: 520101 - RNA, 14 nt, Homo sapiens
guagacugugccag

SEQ ID NO: 520102 - RNA, 19 nt, Homo sapiens
guagagcauaccacuugaa

SEQ ID NO: 520103 - RNA, 16 nt, Homo sapiens
guagcaaguacuuugg

SEQ ID NO: 520104 - RNA, 16 nt, Homo sapiens
guauaaauauacagua

SEQ ID NO: 520105 - RNA, 14 nt, Homo sapiens
guauaagcaucugc

SEQ ID NO: 520106 - RNA, 20 nt, Homo sapiens
guauccagucugaagauguu

SEQ ID NO: 520107 - RNA, 22 nt, Homo sapiens
guauuauccacaauuauuggca

SEQ ID NO: 520108 - RNA, 21 nt, Homo sapiens
guauugucgguuaccucugca

SEQ ID NO: 520109 - RNA, 17 nt, Homo sapiens
guauuuaggcagauuga

SEQ ID NO: 520110 - RNA, 17 nt, Homo sapiens
guauuuuuauuuuugca

SEQ ID NO: 520111 - RNA, 16 nt, Homo sapiens
gucaaauuuacuuuaa

SEQ ID NO: 520112 - RNA, 21 nt, Homo sapiens
gucaagcaccugcaugugcug

SEQ ID NO: 520113 - RNA, 14 nt, Homo sapiens
gucagcugcucccu

SEQ ID NO: 520114 - RNA, 22 nt, Homo sapiens
gucagugcugccaguuucccaa

SEQ ID NO: 520115 - RNA, 15 nt, Homo sapiens
gucauaaagcauugg

SEQ ID NO: 520116 - RNA, 17 nt, Homo sapiens
gucaucaucacauucag

SEQ ID NO: 520117 - RNA, 15 nt, Homo sapiens
gucaucgggccagaa

SEQ ID NO: 520118 - RNA, 18 nt, Homo sapiens
gucauggaggccaagaac

SEQ ID NO: 520119 - RNA, 19 nt, Homo sapiens
gucauggaggccaagaacu

SEQ ID NO: 520120 - RNA, 15 nt, Homo sapiens
gucccacacugugca

SEQ ID NO: 520121 - RNA, 18 nt, Homo sapiens
gucccacuacaucuggga

SEQ ID NO: 520122 - RNA, 21 nt, Homo sapiens
gucccaugaccuugggguaca

SEQ ID NO: 520123 - RNA, 14 nt, Homo sapiens
guccccagccugcu

SEQ ID NO: 520124 - RNA, 20 nt, Homo sapiens
guccccagccugcucccuag

SEQ ID NO: 520125 - RNA, 19 nt, Homo sapiens
gucccuugcuguaugcuga

SEQ ID NO: 520126 - RNA, 20 nt, Homo sapiens
guccuuacucccccaccacu

SEQ ID NO: 520127 - RNA, 21 nt, Homo sapiens
gucucauugucaccucuguga

SEQ ID NO: 520128 - RNA, 13 nt, Homo sapiens
gucucucccucag

SEQ ID NO: 520129 - RNA, 13 nt, Homo sapiens
gucugaggacuga

SEQ ID NO: 520130 - RNA, 23 nt, Homo sapiens
gucugauuuugagguuuagcaau

SEQ ID NO: 520131 - RNA, 15 nt, Homo sapiens
gucugccuucugcug

SEQ ID NO: 520132 - RNA, 13 nt, Homo sapiens
gucuggacugcua

SEQ ID NO: 520133 - RNA, 19 nt, Homo sapiens
gucuguuuggacugcagaa

SEQ ID NO: 520134 - RNA, 22 nt, Homo sapiens
gucuuaguuuugugaaggugau

SEQ ID NO: 520135 - RNA, 23 nt, Homo sapiens
gucuuccacaaaaaauacuuuau

SEQ ID NO: 520136 - RNA, 23 nt, Homo sapiens
gugaaaaggguacagaugugcug

SEQ ID NO: 520137 - RNA, 21 nt, Homo sapiens
gugaaauuauuuuggagauua

SEQ ID NO: 520138 - RNA, 21 nt, Homo sapiens
gugaacauugguucuuucauu

SEQ ID NO: 520139 - RNA, 17 nt, Homo sapiens
gugaacuuacuugcaua

SEQ ID NO: 520140 - RNA, 12 nt, Homo sapiens
gugaaggugauu

SEQ ID NO: 520141 - RNA, 19 nt, Homo sapiens
gugaaguuuaauugucuca

SEQ ID NO: 520142 - RNA, 21 nt, Homo sapiens
gugaccccuccuugucagggu

SEQ ID NO: 520143 - RNA, 12 nt, Homo sapiens
gugacugcaaua

SEQ ID NO: 520144 - RNA, 17 nt, Homo sapiens
gugaggcccauucuuca

SEQ ID NO: 520145 - RNA, 18 nt, Homo sapiens
gugauccgccuaccucag

SEQ ID NO: 520146 - RNA, 20 nt, Homo sapiens
gugauggaguuucucuagaa

SEQ ID NO: 520147 - RNA, 21 nt, Homo sapiens
gugcacauccgcgugugccug

SEQ ID NO: 520148 - RNA, 17 nt, Homo sapiens
gugcaccuguaauccca

SEQ ID NO: 520149 - RNA, 20 nt, Homo sapiens
gugcaguuguaggcauguag

SEQ ID NO: 520150 - RNA, 16 nt, Homo sapiens
gugccacuggaccuca

SEQ ID NO: 520151 - RNA, 20 nt, Homo sapiens
gugccccacaaaacuucagu

SEQ ID NO: 520152 - RNA, 14 nt, Homo sapiens
gugccccuuuccaa

SEQ ID NO: 520153 - RNA, 20 nt, Homo sapiens
gugccgugugagugugacag

SEQ ID NO: 520154 - RNA, 23 nt, Homo sapiens
gugccucuguuaccaccaccucu

SEQ ID NO: 520155 - RNA, 23 nt, Homo sapiens
gugccugacacauagaaaacaau

SEQ ID NO: 520156 - RNA, 15 nt, Homo sapiens
gugcggcugccauug

SEQ ID NO: 520157 - RNA, 16 nt, Homo sapiens
gugcugggggaaugag

SEQ ID NO: 520158 - RNA, 12 nt, Homo sapiens
gugcugugacaa

SEQ ID NO: 520159 - RNA, 18 nt, Homo sapiens
gugcuuaaaaaucauuga

SEQ ID NO: 520160 - RNA, 18 nt, Homo sapiens
guggaacccccaucucua

SEQ ID NO: 520161 - RNA, 18 nt, Homo sapiens
guggacucucauguggcc

SEQ ID NO: 520162 - RNA, 13 nt, Homo sapiens
guggagcucagug

SEQ ID NO: 520163 - RNA, 23 nt, Homo sapiens
guggcaccgccuccccaccucca

SEQ ID NO: 520164 - RNA, 16 nt, Homo sapiens
guggcaccuucaccug

SEQ ID NO: 520165 - RNA, 19 nt, Homo sapiens
guggccccggcugcaugag

SEQ ID NO: 520166 - RNA, 14 nt, Homo sapiens
guggcucacaccug

SEQ ID NO: 520167 - RNA, 19 nt, Homo sapiens
gugggacccccguggggca

SEQ ID NO: 520168 - RNA, 21 nt, Homo sapiens
gugggauauugaauguuaaag

SEQ ID NO: 520169 - RNA, 14 nt, Homo sapiens
gugggauuuugcaa

SEQ ID NO: 520170 - RNA, 23 nt, Homo sapiens
gugggccagggcugcccugagaa

SEQ ID NO: 520171 - RNA, 19 nt, Homo sapiens
guggggccuguggaaugag

SEQ ID NO: 520172 - RNA, 12 nt, Homo sapiens
gugguaaucuac

SEQ ID NO: 520173 - RNA, 12 nt, Homo sapiens
gugguacuugau

SEQ ID NO: 520174 - RNA, 19 nt, Homo sapiens
gugguucagacaagacaga

SEQ ID NO: 520175 - RNA, 20 nt, Homo sapiens
gugguucuuaaauguuuaua

SEQ ID NO: 520176 - RNA, 16 nt, Homo sapiens
guguaauggaaaccaa

SEQ ID NO: 520177 - RNA, 23 nt, Homo sapiens
guguacaaauacauguguauauu

SEQ ID NO: 520178 - RNA, 14 nt, Homo sapiens
guguacauuucuau

SEQ ID NO: 520179 - RNA, 20 nt, Homo sapiens
guguaugcaguauucuugca

SEQ ID NO: 520180 - RNA, 12 nt, Homo sapiens
guguaugugacc

SEQ ID NO: 520181 - RNA, 14 nt, Homo sapiens
guguauuucauuua

SEQ ID NO: 520182 - RNA, 21 nt, Homo sapiens
gugucuuacauugccaaguca

SEQ ID NO: 520183 - RNA, 14 nt, Homo sapiens
gugugcugugacaa

SEQ ID NO: 520184 - RNA, 20 nt, Homo sapiens
gugugggggaggcgcacagu

SEQ ID NO: 520185 - RNA, 19 nt, Homo sapiens
guguucuacacucaucuua

SEQ ID NO: 520186 - RNA, 23 nt, Homo sapiens
guguuggcaaacgagacuuucuc

SEQ ID NO: 520187 - RNA, 16 nt, Homo sapiens
guguuguggacacugc

SEQ ID NO: 520188 - RNA, 17 nt, Homo sapiens
guguuuaguagccucaa

SEQ ID NO: 520189 - RNA, 17 nt, Homo sapiens
guguuucugucucucca

SEQ ID NO: 520190 - RNA, 21 nt, Homo sapiens
guguuuuucuuuuuccacaag

SEQ ID NO: 520191 - RNA, 17 nt, Homo sapiens
guuaagaacaucaaaac

SEQ ID NO: 520192 - RNA, 17 nt, Homo sapiens
guuaccacgacuucuag

SEQ ID NO: 520193 - RNA, 17 nt, Homo sapiens
guuaccucugcauggaa

SEQ ID NO: 520194 - RNA, 13 nt, Homo sapiens
ugaaaaucuccau

SEQ ID NO: 520195 - RNA, 13 nt, Homo sapiens
ugaaaaugacauu

SEQ ID NO: 520196 - RNA, 23 nt, Homo sapiens
ugaaacuaacagauaagcaagag

SEQ ID NO: 520197 - RNA, 17 nt, Homo sapiens
ugaaacuccagaugcca

SEQ ID NO: 520198 - RNA, 22 nt, Homo sapiens
ugaaagaagagaugagaaauga

SEQ ID NO: 520199 - RNA, 21 nt, Homo sapiens
ugaaagucaaauuuacuuuaa

SEQ ID NO: 520200 - RNA, 12 nt, Homo sapiens
ugaaaugaccuc

SEQ ID NO: 520201 - RNA, 18 nt, Homo sapiens
ugaaaugcuguuaguaaa

SEQ ID NO: 520202 - RNA, 18 nt, Homo sapiens
ugaaauguucaagucaug

SEQ ID NO: 520203 - RNA, 14 nt, Homo sapiens
ugaaauuacuuuaa

SEQ ID NO: 520204 - RNA, 12 nt, Homo sapiens
ugaacacucccc

SEQ ID NO: 520205 - RNA, 17 nt, Homo sapiens
ugaaccaugaagucaua

SEQ ID NO: 520206 - RNA, 23 nt, Homo sapiens
ugaagaaagucagcucuugucaa

SEQ ID NO: 520207 - RNA, 15 nt, Homo sapiens
ugaagacacacucag

SEQ ID NO: 520208 - RNA, 22 nt, Homo sapiens
ugaagacaugggugaacuuacu

SEQ ID NO: 520209 - RNA, 15 nt, Homo sapiens
ugaagagauugcuga

SEQ ID NO: 520210 - RNA, 15 nt, Homo sapiens
ugaagaguaaaggaa

SEQ ID NO: 520211 - RNA, 19 nt, Homo sapiens
ugaaggcgggccugcaagc

SEQ ID NO: 520212 - RNA, 14 nt, Homo sapiens
ugaaguacauauua

SEQ ID NO: 520213 - RNA, 18 nt, Homo sapiens
ugaaguaugguguguuca

SEQ ID NO: 520214 - RNA, 15 nt, Homo sapiens
ugaagugugcuguga

SEQ ID NO: 520215 - RNA, 21 nt, Homo sapiens
ugaaugacacgccuaagguca

SEQ ID NO: 520216 - RNA, 13 nt, Homo sapiens
ugaauucaagaaa

SEQ ID NO: 520217 - RNA, 15 nt, Homo sapiens
ugacaaaauuacuua

SEQ ID NO: 520218 - RNA, 16 nt, Homo sapiens
ugacaaucaacucuaa

SEQ ID NO: 520219 - RNA, 13 nt, Homo sapiens
ugacauaauaaua

SEQ ID NO: 520220 - RNA, 21 nt, Homo sapiens
ugacauaccuaccaguauuau

SEQ ID NO: 520221 - RNA, 18 nt, Homo sapiens
ugacccccaucugagcug

SEQ ID NO: 520222 - RNA, 20 nt, Homo sapiens
ugaccucugacaacugugaa

SEQ ID NO: 520223 - RNA, 20 nt, Homo sapiens
ugacgucaucaucacauuca

SEQ ID NO: 520224 - RNA, 19 nt, Homo sapiens
ugacucaauuauuugcaua

SEQ ID NO: 520225 - RNA, 12 nt, Homo sapiens
ugacucugcauu

SEQ ID NO: 520226 - RNA, 11 nt, Homo sapiens
ugacuggugcu

SEQ ID NO: 520227 - RNA, 12 nt, Homo sapiens
ugacugugguag

SEQ ID NO: 520228 - RNA, 18 nt, Homo sapiens
ugacuuagcgucaagaca

SEQ ID NO: 520229 - RNA, 12 nt, Homo sapiens
ugagacacuguc

SEQ ID NO: 520230 - RNA, 14 nt, Homo sapiens
ugagagucugagaa

SEQ ID NO: 520231 - RNA, 17 nt, Homo sapiens
ugagaucaucagugaua

SEQ ID NO: 520232 - RNA, 15 nt, Homo sapiens
ugagauguacaucuu

SEQ ID NO: 520233 - RNA, 20 nt, Homo sapiens
ugagauuuccuccuggccuu

SEQ ID NO: 520234 - RNA, 21 nt, Homo sapiens
ugagauuuccuccuggccuuu

SEQ ID NO: 520235 - RNA, 17 nt, Homo sapiens
ugagauuugggcugugc

SEQ ID NO: 520236 - RNA, 15 nt, Homo sapiens
ugagcagaagaucaa

SEQ ID NO: 520237 - RNA, 16 nt, Homo sapiens
ugagcagaagaucaag

SEQ ID NO: 520238 - RNA, 20 nt, Homo sapiens
ugagcagggagaccaugccu

SEQ ID NO: 520239 - RNA, 15 nt, Homo sapiens
ugagcauaccugucu

SEQ ID NO: 520240 - RNA, 21 nt, Homo sapiens
ugagccaaagcuuaugugaca

SEQ ID NO: 520241 - RNA, 22 nt, Homo sapiens
ugagccaaagcuuaugugacau

SEQ ID NO: 520242 - RNA, 22 nt, Homo sapiens
ugagcgucagcauccagguuua

SEQ ID NO: 520243 - RNA, 15 nt, Homo sapiens
ugagcucuucccuua

SEQ ID NO: 520244 - RNA, 15 nt, Homo sapiens
ugaggacaauuucau

SEQ ID NO: 520245 - RNA, 17 nt, Homo sapiens
ugaggacccgaggacag

SEQ ID NO: 520246 - RNA, 16 nt, Homo sapiens
ugaggaggaugucccu

SEQ ID NO: 520247 - RNA, 20 nt, Homo sapiens
ugaggcaaauuaacuguaug

SEQ ID NO: 520248 - RNA, 20 nt, Homo sapiens
ugaggcccauucuucacucu

SEQ ID NO: 520249 - RNA, 23 nt, Homo sapiens
ugaggcugggcgucuaugcugcu

SEQ ID NO: 520250 - RNA, 22 nt, Homo sapiens
ugagggcaguucugaguguuua

SEQ ID NO: 520251 - RNA, 19 nt, Homo sapiens
ugagugggagaguaccugu

SEQ ID NO: 520252 - RNA, 23 nt, Homo sapiens
ugauaaaagcauuguuugugaua

SEQ ID NO: 520253 - RNA, 14 nt, Homo sapiens
ugauaaaccugcca

SEQ ID NO: 520254 - RNA, 15 nt, Homo sapiens
ugauaccugcacugu

SEQ ID NO: 520255 - RNA, 11 nt, Homo sapiens
ugauaugcuuc

SEQ ID NO: 520256 - RNA, 15 nt, Homo sapiens
ugauauuucuugcuu

SEQ ID NO: 520257 - RNA, 15 nt, Homo sapiens
ugauccauccaucuc

SEQ ID NO: 520258 - RNA, 17 nt, Homo sapiens
ugauccccaagugguga

SEQ ID NO: 520259 - RNA, 15 nt, Homo sapiens
ugaucuauacaaauu

SEQ ID NO: 520260 - RNA, 19 nt, Homo sapiens
ugaucucggcucacugcaa

SEQ ID NO: 520261 - RNA, 12 nt, Homo sapiens
ugaugaagucac

SEQ ID NO: 520262 - RNA, 20 nt, Homo sapiens
ugauguauguaauacauaua

SEQ ID NO: 520263 - RNA, 16 nt, Homo sapiens
ugauguguccucaggg

SEQ ID NO: 520264 - RNA, 18 nt, Homo sapiens
ugauguguccucagggag

SEQ ID NO: 520265 - RNA, 22 nt, Homo sapiens
ugauguuuuuucuguaauguaa

SEQ ID NO: 520266 - RNA, 15 nt, Homo sapiens
ugauuaagcuuuugu

SEQ ID NO: 520267 - RNA, 15 nt, Homo sapiens
ugauuuagugaucaa

SEQ ID NO: 520268 - RNA, 20 nt, Homo sapiens
ugcaacaauaaaguacuuua

SEQ ID NO: 520269 - RNA, 18 nt, Homo sapiens
ugcaacuggaguuccuua

SEQ ID NO: 520270 - RNA, 22 nt, Homo sapiens
ugcaagcgaaauuaaaucugaa

SEQ ID NO: 520271 - RNA, 15 nt, Homo sapiens
ugcaauaccaauguu

SEQ ID NO: 520272 - RNA, 12 nt, Homo sapiens
ugcacaacagcc

SEQ ID NO: 520273 - RNA, 19 nt, Homo sapiens
ugcacaggguccucagcuc

SEQ ID NO: 520274 - RNA, 21 nt, Homo sapiens
ugcacauccgcgugugccugu

SEQ ID NO: 520275 - RNA, 18 nt, Homo sapiens
ugcaccaggcacugcugc

SEQ ID NO: 520276 - RNA, 19 nt, Homo sapiens
ugcaccaggcacugcugca

SEQ ID NO: 520277 - RNA, 19 nt, Homo sapiens
ugcaccccucugcccucau

SEQ ID NO: 520278 - RNA, 22 nt, Homo sapiens
ugcacuguccugaccaucgcac

SEQ ID NO: 520279 - RNA, 21 nt, Homo sapiens
ugcagacagaagucuccucaa

SEQ ID NO: 520280 - RNA, 21 nt, Homo sapiens
ugcagaggauaaggaggcacu

SEQ ID NO: 520281 - RNA, 19 nt, Homo sapiens
ugcagccgugaucaaggga

SEQ ID NO: 520282 - RNA, 17 nt, Homo sapiens
ugcaggaaggaggugca

SEQ ID NO: 520283 - RNA, 19 nt, Homo sapiens
ugcaggacccuguccugca

SEQ ID NO: 520284 - RNA, 13 nt, Homo sapiens
ugcagggccagac

SEQ ID NO: 520285 - RNA, 16 nt, Homo sapiens
ugcagucccacacugu

SEQ ID NO: 520286 - RNA, 17 nt, Homo sapiens
ugcagucccacacugug

SEQ ID NO: 520287 - RNA, 17 nt, Homo sapiens
ugcaguggugugaucuc

SEQ ID NO: 520288 - RNA, 14 nt, Homo sapiens
ugcauaauaagcua

SEQ ID NO: 520289 - RNA, 23 nt, Homo sapiens
ugcauaccaaguugauacuugaa

SEQ ID NO: 520290 - RNA, 17 nt, Homo sapiens
ugcaucucaaaauuauu

SEQ ID NO: 520291 - RNA, 15 nt, Homo sapiens
ugcaugagcugcaag

SEQ ID NO: 520292 - RNA, 14 nt, Homo sapiens
ugcauuauaucaaa

SEQ ID NO: 520293 - RNA, 20 nt, Homo sapiens
ugcauuugugguaaucuaca

SEQ ID NO: 520294 - RNA, 16 nt, Homo sapiens
ugcauuuuugugaaau

SEQ ID NO: 520295 - RNA, 16 nt, Homo sapiens
ugccaucgaccuggag

SEQ ID NO: 520296 - RNA, 20 nt, Homo sapiens
ugccaucugugauaugccau

SEQ ID NO: 520297 - RNA, 18 nt, Homo sapiens
ugccaucuguucauuucu

SEQ ID NO: 520298 - RNA, 16 nt, Homo sapiens
ugccauugcauuccag

SEQ ID NO: 520299 - RNA, 14 nt, Homo sapiens
ugcccaagucccag

SEQ ID NO: 520300 - RNA, 15 nt, Homo sapiens
ugcccagaucaacag

SEQ ID NO: 520301 - RNA, 17 nt, Homo sapiens
ugcccauccugacugaa

SEQ ID NO: 520302 - RNA, 19 nt, Homo sapiens
ugccccccacucugcacag

SEQ ID NO: 520303 - RNA, 14 nt, Homo sapiens
ugccccucucacca

SEQ ID NO: 520304 - RNA, 19 nt, Homo sapiens
ugcccguguaguccccaac

SEQ ID NO: 520305 - RNA, 20 nt, Homo sapiens
ugcccugagaagcugcucca

SEQ ID NO: 520306 - RNA, 20 nt, Homo sapiens
ugccgccuccuugugcacaa

SEQ ID NO: 520307 - RNA, 14 nt, Homo sapiens
ugccgcuaccuccc

SEQ ID NO: 520308 - RNA, 16 nt, Homo sapiens
ugccuaguuucuuaca

SEQ ID NO: 520309 - RNA, 20 nt, Homo sapiens
ugccuauagucccacuacuu

SEQ ID NO: 520310 - RNA, 23 nt, Homo sapiens
ugccuccaaguucaaaacuuauu

SEQ ID NO: 520311 - RNA, 16 nt, Homo sapiens
ugccucugcucccucu

SEQ ID NO: 520312 - RNA, 24 nt, Homo sapiens
ugccucuggucgccgcacuucuga

SEQ ID NO: 520313 - RNA, 19 nt, Homo sapiens
ugccuggcacagaccaggc

SEQ ID NO: 520314 - RNA, 16 nt, Homo sapiens
uuuauuucugaucuau

SEQ ID NO: 520315 - RNA, 15 nt, Homo sapiens
uuucaaagcacuuaa

SEQ ID NO: 520316 - RNA, 15 nt, Homo sapiens
uuucaauugucacuu

SEQ ID NO: 520317 - RNA, 22 nt, Homo sapiens
uuucacucucaaacuucacuaa

SEQ ID NO: 520318 - RNA, 22 nt, Homo sapiens
uuucacuuugggauauggucuu

SEQ ID NO: 520319 - RNA, 14 nt, Homo sapiens
uuucagucugaucc

SEQ ID NO: 520320 - RNA, 20 nt, Homo sapiens
uuucagugggaaauaugcca

SEQ ID NO: 520321 - RNA, 11 nt, Homo sapiens
uuucauaccaa

SEQ ID NO: 520322 - RNA, 11 nt, Homo sapiens
uuucauaccuu

SEQ ID NO: 520323 - RNA, 22 nt, Homo sapiens
uuucauuuggaaugaauacagc

SEQ ID NO: 520324 - RNA, 20 nt, Homo sapiens
uuuccagaacuaccaugaga

SEQ ID NO: 520325 - RNA, 14 nt, Homo sapiens
uuucccaacacaaa

SEQ ID NO: 520326 - RNA, 23 nt, Homo sapiens
uuucccgcccagccucacuuccu

SEQ ID NO: 520327 - RNA, 22 nt, Homo sapiens
uuucccuuccugggucuaccac

SEQ ID NO: 520328 - RNA, 19 nt, Homo sapiens
uuuccuuaacgcuagagau

SEQ ID NO: 520329 - RNA, 23 nt, Homo sapiens
uuucuaaauuuauauucauaaag

SEQ ID NO: 520330 - RNA, 19 nt, Homo sapiens
uuucugcuaguggugagca

SEQ ID NO: 520331 - RNA, 21 nt, Homo sapiens
uuucugggucuuuugcuacua

SEQ ID NO: 520332 - RNA, 17 nt, Homo sapiens
uuucuguuuacugucaa

SEQ ID NO: 520333 - RNA, 16 nt, Homo sapiens
uuugaacaaagcucaa

SEQ ID NO: 520334 - RNA, 15 nt, Homo sapiens
uuugaaccugugcaa

SEQ ID NO: 520335 - RNA, 15 nt, Homo sapiens
uuugaagcgagcagu

SEQ ID NO: 520336 - RNA, 21 nt, Homo sapiens
uuugaagcgagcagucagcau

SEQ ID NO: 520337 - RNA, 16 nt, Homo sapiens
uuugaagugcagcuca

SEQ ID NO: 520338 - RNA, 23 nt, Homo sapiens
uuugcaacaauaaaguacuuuac

SEQ ID NO: 520339 - RNA, 21 nt, Homo sapiens
uuugcacaacuuuugagagua

SEQ ID NO: 520340 - RNA, 15 nt, Homo sapiens
uuugccacugcugua

SEQ ID NO: 520341 - RNA, 17 nt, Homo sapiens
uuugcugcagucaucua

SEQ ID NO: 520342 - RNA, 16 nt, Homo sapiens
uuugcuugcaauguag

SEQ ID NO: 520343 - RNA, 16 nt, Homo sapiens
uuuggaaagacuggac

SEQ ID NO: 520344 - RNA, 20 nt, Homo sapiens
uuuggauauuuuuuggugug

SEQ ID NO: 520345 - RNA, 22 nt, Homo sapiens
uuuggauucuaaauacaugcca

SEQ ID NO: 520346 - RNA, 15 nt, Homo sapiens
uuuggcuugugggcu

SEQ ID NO: 520347 - RNA, 22 nt, Homo sapiens
uuugggaaaauaaauacauucg

SEQ ID NO: 520348 - RNA, 13 nt, Homo sapiens
uuugguccuugaa

SEQ ID NO: 520349 - RNA, 23 nt, Homo sapiens
uuuggugcuggaaccagcucucu

SEQ ID NO: 520350 - RNA, 14 nt, Homo sapiens
uuugguuuuggaca

SEQ ID NO: 520351 - RNA, 22 nt, Homo sapiens
uuugucuuggcuuuucuuuggg

SEQ ID NO: 520352 - RNA, 18 nt, Homo sapiens
uuuguuacauaaggauga

SEQ ID NO: 520353 - RNA, 17 nt, Homo sapiens
uuuguuugccaggacau

SEQ ID NO: 520354 - RNA, 18 nt, Homo sapiens
uuuguuuucagcacugau

SEQ ID NO: 520355 - RNA, 17 nt, Homo sapiens
uuuuaacggaugguuga

SEQ ID NO: 520356 - RNA, 16 nt, Homo sapiens
uuuuaacuuauugaca

SEQ ID NO: 520357 - RNA, 17 nt, Homo sapiens
uuuuaagaagacauacu

SEQ ID NO: 520358 - RNA, 16 nt, Homo sapiens
uuuuaauuugggaaaa

SEQ ID NO: 520359 - RNA, 21 nt, Homo sapiens
uuuuaggaacucacucuuuag

SEQ ID NO: 520360 - RNA, 18 nt, Homo sapiens
uuuuagggagaacgggaa

SEQ ID NO: 520361 - RNA, 13 nt, Homo sapiens
uuuuauuguugua

SEQ ID NO: 520362 - RNA, 20 nt, Homo sapiens
uuuucaaguuuacacuucau

SEQ ID NO: 520363 - RNA, 16 nt, Homo sapiens
uuuuccacugccuggg

SEQ ID NO: 520364 - RNA, 18 nt, Homo sapiens
uuuuccuagcuguguuau

SEQ ID NO: 520365 - RNA, 13 nt, Homo sapiens
uuuuccuuaccau

SEQ ID NO: 520366 - RNA, 16 nt, Homo sapiens
uuuucgcugaugcugu

SEQ ID NO: 520367 - RNA, 19 nt, Homo sapiens
uuuucucaguguugguaua

SEQ ID NO: 520368 - RNA, 14 nt, Homo sapiens
uuuugaauaugccu

SEQ ID NO: 520369 - RNA, 15 nt, Homo sapiens
uuuugacacugguau

SEQ ID NO: 520370 - RNA, 15 nt, Homo sapiens
uuuuggaacuguccu

SEQ ID NO: 520371 - RNA, 18 nt, Homo sapiens
uuuugggaagaauccagu

SEQ ID NO: 520372 - RNA, 20 nt, Homo sapiens
uuuuguauuguuuucugaca

SEQ ID NO: 520373 - RNA, 14 nt, Homo sapiens
uuuuguugcucagu

SEQ ID NO: 520374 - RNA, 15 nt, Homo sapiens
uuuuuaacugauucu

SEQ ID NO: 520375 - RNA, 18 nt, Homo sapiens
uuuuuauuaugcauuaua

SEQ ID NO: 520376 - RNA, 14 nt, Homo sapiens
uuuuuccucugcau

SEQ ID NO: 520377 - RNA, 15 nt, Homo sapiens
uuuuucuuuuuccac

SEQ ID NO: 520378 - RNA, 20 nt, Homo sapiens
uuuuugaguacuguacuauc

SEQ ID NO: 520379 - RNA, 11 nt, Homo sapiens
uuuuugcucuc

SEQ ID NO: 520380 - RNA, 14 nt, Homo sapiens
uuuuuguaacugga

SEQ ID NO: 520381 - RNA, 13 nt, Homo sapiens
aaaaauauuccaa

SEQ ID NO: 520382 - RNA, 22 nt, Homo sapiens
aaaacacugaaaaauauuccaa

SEQ ID NO: 520383 - RNA, 18 nt, Homo sapiens
aaaacacugcccucuugu

SEQ ID NO: 520384 - RNA, 21 nt, Homo sapiens
aacucuguccacgauucacuc

SEQ ID NO: 520385 - RNA, 13 nt, Homo sapiens
aacucuucagugc

SEQ ID NO: 520386 - RNA, 19 nt, Homo sapiens
aacugaguguuauuugcac

SEQ ID NO: 520387 - RNA, 20 nt, Homo sapiens
aacugaguguuauuugcaca

SEQ ID NO: 520388 - RNA, 23 nt, Homo sapiens
aacuggggaaugggguauggaag

SEQ ID NO: 520389 - RNA, 23 nt, Homo sapiens
aacuguacauuuaaaauugcuau

SEQ ID NO: 520390 - RNA, 16 nt, Homo sapiens
aacuguagcugccaug

SEQ ID NO: 520391 - RNA, 17 nt, Homo sapiens
aacuguagguaugaucu

SEQ ID NO: 520392 - RNA, 13 nt, Homo sapiens
aacugugccuugu

SEQ ID NO: 520393 - RNA, 21 nt, Homo sapiens
aacuuagaugggcaugguggu

SEQ ID NO: 520394 - RNA, 18 nt, Homo sapiens
aacuugcaauaccaaugu

SEQ ID NO: 520395 - RNA, 20 nt, Homo sapiens
aacuugcaauaccaauguuc

SEQ ID NO: 520396 - RNA, 19 nt, Homo sapiens
aacuuuggugaacaguuuu

SEQ ID NO: 520397 - RNA, 18 nt, Homo sapiens
aacuuuuuuuucucucuu

SEQ ID NO: 520398 - RNA, 17 nt, Homo sapiens
aagaaccaaauaccuca

SEQ ID NO: 520399 - RNA, 15 nt, Homo sapiens
aagaacuugcaauac

SEQ ID NO: 520400 - RNA, 13 nt, Homo sapiens
aagaagcaaaguu

SEQ ID NO: 520401 - RNA, 21 nt, Homo sapiens
aagaaguuguuugaggcaaau

SEQ ID NO: 520402 - RNA, 23 nt, Homo sapiens
aagaaguuguuugaggcaaauua

SEQ ID NO: 520403 - RNA, 16 nt, Homo sapiens
aagaauagcauuguaa

SEQ ID NO: 520404 - RNA, 21 nt, Homo sapiens
aagacaauaauucuacauguu

SEQ ID NO: 520405 - RNA, 18 nt, Homo sapiens
aagacagcugcuggguca

SEQ ID NO: 520406 - RNA, 13 nt, Homo sapiens
aagacaugaacca

SEQ ID NO: 520407 - RNA, 16 nt, Homo sapiens
aagacucugccauuaa

SEQ ID NO: 520408 - RNA, 23 nt, Homo sapiens
aagacugaaucuaccugcccuaa

SEQ ID NO: 520409 - RNA, 14 nt, Homo sapiens
aagagacacuccaa

SEQ ID NO: 520410 - RNA, 22 nt, Homo sapiens
aagagagcgagacccugucuca

SEQ ID NO: 520411 - RNA, 18 nt, Homo sapiens
aagagaucuacacauguu

SEQ ID NO: 520412 - RNA, 21 nt, Homo sapiens
aagagcaaacaaaaguucugc

SEQ ID NO: 520413 - RNA, 18 nt, Homo sapiens
aagaggcugccccucuca

SEQ ID NO: 520414 - RNA, 17 nt, Homo sapiens
aagagguaaaaaacugu

SEQ ID NO: 520415 - RNA, 22 nt, Homo sapiens
aagagucaacaggucacuugau

SEQ ID NO: 520416 - RNA, 22 nt, Homo sapiens
aagaucaaggaguacaaugccc

SEQ ID NO: 520417 - RNA, 22 nt, Homo sapiens
aagaugagaugguuucuagaga

SEQ ID NO: 520418 - RNA, 20 nt, Homo sapiens
aagaugagcuuugucuacuu

SEQ ID NO: 520419 - RNA, 19 nt, Homo sapiens
aagaugccuuaauccauuc

SEQ ID NO: 520420 - RNA, 17 nt, Homo sapiens
aagauggaacaggcuca

SEQ ID NO: 520421 - RNA, 17 nt, Homo sapiens
aagauggacuuaccugg

SEQ ID NO: 520422 - RNA, 15 nt, Homo sapiens
aagaugggagccuuu

SEQ ID NO: 520423 - RNA, 22 nt, Homo sapiens
aagcaaaguucaacuuauuuca

SEQ ID NO: 520424 - RNA, 22 nt, Homo sapiens
aagcaacauggcuuugaugaua

SEQ ID NO: 520425 - RNA, 16 nt, Homo sapiens
aagcaaguuaaguguc

SEQ ID NO: 520426 - RNA, 17 nt, Homo sapiens
aagcaaguuuucuucca

SEQ ID NO: 520427 - RNA, 22 nt, Homo sapiens
aagcacaucuuugaccacguca

SEQ ID NO: 520428 - RNA, 19 nt, Homo sapiens
aagcaccugcaugugcugu

SEQ ID NO: 520429 - RNA, 14 nt, Homo sapiens
aagcacuacaccuu

SEQ ID NO: 520430 - RNA, 19 nt, Homo sapiens
aagcacuacaccuugccuu

SEQ ID NO: 520431 - RNA, 17 nt, Homo sapiens
aagcaguggccuuuuuc

SEQ ID NO: 520432 - RNA, 16 nt, Homo sapiens
aagcaguuacuaauau

SEQ ID NO: 520433 - RNA, 22 nt, Homo sapiens
aagcaguuguaccaagugaaau

SEQ ID NO: 520434 - RNA, 14 nt, Homo sapiens
aagcccaacugggg

SEQ ID NO: 520435 - RNA, 23 nt, Homo sapiens
aagcccaacugggguugcgucug

SEQ ID NO: 520436 - RNA, 18 nt, Homo sapiens
aagccccgacacacgggg

SEQ ID NO: 520437 - RNA, 16 nt, Homo sapiens
aagccuuaccuugaaa

SEQ ID NO: 520438 - RNA, 12 nt, Homo sapiens
aagccuuaggga

SEQ ID NO: 520439 - RNA, 19 nt, Homo sapiens
aagcgagcagucagcauuc

SEQ ID NO: 520440 - RNA, 18 nt, Homo sapiens
aagcucacugcugaucgu

SEQ ID NO: 520441 - RNA, 23 nt, Homo sapiens
aagcucuguuccaugcaacugga

SEQ ID NO: 520442 - RNA, 14 nt, Homo sapiens
aagcugccauauau

SEQ ID NO: 520443 - RNA, 12 nt, Homo sapiens
aagcugcuccag

SEQ ID NO: 520444 - RNA, 20 nt, Homo sapiens
aaggaaaagacugaaucuac

SEQ ID NO: 520445 - RNA, 16 nt, Homo sapiens
aaggaaauucuuauaa

SEQ ID NO: 520446 - RNA, 18 nt, Homo sapiens
aaggaaccuguguuauca

SEQ ID NO: 520447 - RNA, 12 nt, Homo sapiens
aaggaagcagaa

SEQ ID NO: 520448 - RNA, 22 nt, Homo sapiens
aaggaagggcugcuggagccca

SEQ ID NO: 520449 - RNA, 19 nt, Homo sapiens
aaggagcaucuaucagauu

SEQ ID NO: 520450 - RNA, 16 nt, Homo sapiens
aaggaguacaaugccc

SEQ ID NO: 520451 - RNA, 22 nt, Homo sapiens
aaggaguacaaugcccagauca

SEQ ID NO: 520452 - RNA, 18 nt, Homo sapiens
aaggauguaguaucucau

SEQ ID NO: 520453 - RNA, 14 nt, Homo sapiens
aaggcagauggggc

SEQ ID NO: 520454 - RNA, 13 nt, Homo sapiens
aaggccagcugaa

SEQ ID NO: 520455 - RNA, 18 nt, Homo sapiens
aaggccaggcaugguggu

SEQ ID NO: 520456 - RNA, 15 nt, Homo sapiens
aaggcucccuguccu

SEQ ID NO: 520457 - RNA, 23 nt, Homo sapiens
aagggaaccauguauaugagcuu

SEQ ID NO: 520458 - RNA, 18 nt, Homo sapiens
aagggaauugcucagaga

SEQ ID NO: 520459 - RNA, 15 nt, Homo sapiens
aagggacacauauca

SEQ ID NO: 520460 - RNA, 12 nt, Homo sapiens
aaggggcacugg

SEQ ID NO: 520461 - RNA, 17 nt, Homo sapiens
aagguagagucuuacaa

SEQ ID NO: 520462 - RNA, 21 nt, Homo sapiens
aaguaacugaaccauuccaac

SEQ ID NO: 520463 - RNA, 18 nt, Homo sapiens
aaguaccuugaacucuua

SEQ ID NO: 520464 - RNA, 11 nt, Homo sapiens
aaguacuuuac

SEQ ID NO: 520465 - RNA, 22 nt, Homo sapiens
aagucagcuccagcuuucugcc

SEQ ID NO: 520466 - RNA, 23 nt, Homo sapiens
aagucauagguuacagaccucag

SEQ ID NO: 520467 - RNA, 16 nt, Homo sapiens
aaguccaucugacaaa

SEQ ID NO: 520468 - RNA, 18 nt, Homo sapiens
aagucccagagcaccuca

SEQ ID NO: 520469 - RNA, 16 nt, Homo sapiens
aagucugcuacccuca

SEQ ID NO: 520470 - RNA, 16 nt, Homo sapiens
aagucuuccaugaccc

SEQ ID NO: 520471 - RNA, 11 nt, Homo sapiens
aagucuuucau

SEQ ID NO: 520472 - RNA, 13 nt, Homo sapiens
aagugaaagcaag

SEQ ID NO: 520473 - RNA, 14 nt, Homo sapiens
aagugcuccugaaa

SEQ ID NO: 520474 - RNA, 17 nt, Homo sapiens
aagugcucuaacuuuuc

SEQ ID NO: 520475 - RNA, 13 nt, Homo sapiens
aagugguacuuga

SEQ ID NO: 520476 - RNA, 15 nt, Homo sapiens
aaguggugaaugaca

SEQ ID NO: 520477 - RNA, 16 nt, Homo sapiens
aaguggugaaugacac

SEQ ID NO: 520478 - RNA, 19 nt, Homo sapiens
aaguguaaaaaaugucuca

SEQ ID NO: 520479 - RNA, 19 nt, Homo sapiens
aaguguugccaccauaccu

SEQ ID NO: 520480 - RNA, 18 nt, Homo sapiens
aaguucaacuuauuucau

SEQ ID NO: 520481 - RNA, 20 nt, Homo sapiens
aaguucuuggugguggauga

SEQ ID NO: 520482 - RNA, 14 nt, Homo sapiens
aaguuuuacugucu

SEQ ID NO: 520483 - RNA, 18 nt, Homo sapiens
aauaaagcaaugugguag

SEQ ID NO: 520484 - RNA, 13 nt, Homo sapiens
aauaaagcuuuau

SEQ ID NO: 520485 - RNA, 13 nt, Homo sapiens
aauaaaggcagcu

SEQ ID NO: 520486 - RNA, 14 nt, Homo sapiens
aauaaauacauucg

SEQ ID NO: 520487 - RNA, 15 nt, Homo sapiens
aauaaauacauucga

SEQ ID NO: 520488 - RNA, 16 nt, Homo sapiens
aauaaauacucaguga

SEQ ID NO: 520489 - RNA, 22 nt, Homo sapiens
aauaaaugagagggaaucgacu

SEQ ID NO: 520490 - RNA, 23 nt, Homo sapiens
aauaaaugagagggaaucgacug

SEQ ID NO: 520491 - RNA, 14 nt, Homo sapiens
aauaaccaucugaa

SEQ ID NO: 520492 - RNA, 23 nt, Homo sapiens
aauaaguuaaucaggaacuguac

SEQ ID NO: 520493 - RNA, 14 nt, Homo sapiens
aauaauucuuaaca

SEQ ID NO: 520494 - RNA, 14 nt, Homo sapiens
aauaauucuuccuc

SEQ ID NO: 520495 - RNA, 15 nt, Homo sapiens
aauacaguacuguuu

SEQ ID NO: 520496 - RNA, 19 nt, Homo sapiens
aauacauuuaaaacauuaa

SEQ ID NO: 520497 - RNA, 13 nt, Homo sapiens
aauaccaauguuc

SEQ ID NO: 520498 - RNA, 19 nt, Homo sapiens
aauacuauuuaagauguga

SEQ ID NO: 520499 - RNA, 13 nt, Homo sapiens
aauagcaguggua

SEQ ID NO: 520500 - RNA, 21 nt, Homo sapiens
aauagcuuucaaaagaaauuu

SEQ ID NO: 520501 - RNA, 18 nt, Homo sapiens
aauaggcugaugggcaaa

SEQ ID NO: 520502 - RNA, 17 nt, Homo sapiens
aauaguaccuucaauac

SEQ ID NO: 520503 - RNA, 23 nt, Homo sapiens
aauauauauuaagugugccaaau

SEQ ID NO: 520504 - RNA, 14 nt, Homo sapiens
aauauaugaggcua

SEQ ID NO: 520505 - RNA, 17 nt, Homo sapiens
aauaucauaaagcauuu

SEQ ID NO: 520506 - RNA, 20 nt, Homo sapiens
aauaugacggaagaacauag

SEQ ID NO: 520507 - RNA, 16 nt, Homo sapiens
aauaugcaaaccagga

SEQ ID NO: 520508 - RNA, 18 nt, Homo sapiens
aauauggguugcauuugg

SEQ ID NO: 520509 - RNA, 16 nt, Homo sapiens
aauauguaaaugguau

SEQ ID NO: 520510 - RNA, 20 nt, Homo sapiens
aauauuuaauggaaguguau

SEQ ID NO: 520511 - RNA, 23 nt, Homo sapiens
aauauuuacuaacuaaauaccau

SEQ ID NO: 520512 - RNA, 12 nt, Homo sapiens
aaucacaucucc

SEQ ID NO: 520513 - RNA, 13 nt, Homo sapiens
aaucacaucucca

SEQ ID NO: 520514 - RNA, 15 nt, Homo sapiens
aaucacugcauuuca

SEQ ID NO: 520515 - RNA, 18 nt, Homo sapiens
aaucacuuuaagaucuuu

SEQ ID NO: 520516 - RNA, 16 nt, Homo sapiens
aaucccagcauuuugg

SEQ ID NO: 520517 - RNA, 16 nt, Homo sapiens
aaucuaagcagcuuau

SEQ ID NO: 520518 - RNA, 16 nt, Homo sapiens
aaucuacaccaaugaa

SEQ ID NO: 520519 - RNA, 15 nt, Homo sapiens
aaucuaccacuguau

SEQ ID NO: 520520 - RNA, 20 nt, Homo sapiens
aaucuaccugcccuaaggga

SEQ ID NO: 520521 - RNA, 17 nt, Homo sapiens
aaucucagcgugggcca

SEQ ID NO: 520522 - RNA, 15 nt, Homo sapiens
aaucuccugcugauu

SEQ ID NO: 520523 - RNA, 22 nt, Homo sapiens
aaucucuucuuugcugcaguca

SEQ ID NO: 520524 - RNA, 10 nt, Homo sapiens
aaucugggag

SEQ ID NO: 520525 - RNA, 19 nt, Homo sapiens
aaucuggguaucuuuccag

SEQ ID NO: 520526 - RNA, 18 nt, Homo sapiens
aaucuuagugaaugggaa

SEQ ID NO: 520527 - RNA, 12 nt, Homo sapiens
aaucuucuacuu

SEQ ID NO: 520528 - RNA, 23 nt, Homo sapiens
aaugaaagucaaauuuacuuuaa

SEQ ID NO: 520529 - RNA, 16 nt, Homo sapiens
aaugaaaucuucccag

SEQ ID NO: 520530 - RNA, 22 nt, Homo sapiens
aaugaggauuauugauaguacu

SEQ ID NO: 520531 - RNA, 14 nt, Homo sapiens
aaugaucacauucu

SEQ ID NO: 520532 - RNA, 14 nt, Homo sapiens
aaugauguuuuccu

SEQ ID NO: 520533 - RNA, 18 nt, Homo sapiens
aaugcacguuucaaagcu

SEQ ID NO: 520534 - RNA, 17 nt, Homo sapiens
aaugccaccggaacccc

SEQ ID NO: 520535 - RNA, 13 nt, Homo sapiens
aaugcuacaugug

SEQ ID NO: 520536 - RNA, 10 nt, Homo sapiens
aaugcuccau

SEQ ID NO: 520537 - RNA, 12 nt, Homo sapiens
aaugcuccccac

SEQ ID NO: 520538 - RNA, 14 nt, Homo sapiens
aauguaacugcuga

SEQ ID NO: 520539 - RNA, 16 nt, Homo sapiens
aauguaggcuuucaug

SEQ ID NO: 520540 - RNA, 20 nt, Homo sapiens
aauguaguuagcuccauaaa

SEQ ID NO: 520541 - RNA, 18 nt, Homo sapiens
aauguauuuugacacugg

SEQ ID NO: 520542 - RNA, 19 nt, Homo sapiens
aaugucaguguuugggaaa

SEQ ID NO: 520543 - RNA, 23 nt, Homo sapiens
aauguguccuaucuaucuuccaa

SEQ ID NO: 520544 - RNA, 16 nt, Homo sapiens
aauguuaaagggauau

SEQ ID NO: 520545 - RNA, 14 nt, Homo sapiens
aauguuaauguuau

SEQ ID NO: 520546 - RNA, 20 nt, Homo sapiens
aauguuaauugggcagguga

SEQ ID NO: 520547 - RNA, 19 nt, Homo sapiens
aauguuuucaaaagguauu

SEQ ID NO: 520548 - RNA, 12 nt, Homo sapiens
aauuaaaaccuc

SEQ ID NO: 520549 - RNA, 12 nt, Homo sapiens
aauuaagcauuu

SEQ ID NO: 520550 - RNA, 19 nt, Homo sapiens
aauuacuuuaacauuuugg

SEQ ID NO: 520551 - RNA, 10 nt, Homo sapiens
aauuaggcag

SEQ ID NO: 520552 - RNA, 17 nt, Homo sapiens
aauuauauuuuguugcu

SEQ ID NO: 520553 - RNA, 17 nt, Homo sapiens
aauucagacaagcugca

SEQ ID NO: 520554 - RNA, 21 nt, Homo sapiens
aauucugcccgcuccauggaa

SEQ ID NO: 520555 - RNA, 14 nt, Homo sapiens
aauucuuuccccaa

SEQ ID NO: 520556 - RNA, 17 nt, Homo sapiens
aauugaaacacagaguu

SEQ ID NO: 520557 - RNA, 23 nt, Homo sapiens
aauugaguugcacuuauugacca

SEQ ID NO: 520558 - RNA, 14 nt, Homo sapiens
aauugcucagagaa

SEQ ID NO: 520559 - RNA, 22 nt, Homo sapiens
aauuggggcacuuaauggucac

SEQ ID NO: 520560 - RNA, 23 nt, Homo sapiens
aauugugacauaauaauagcagu

SEQ ID NO: 520561 - RNA, 16 nt, Homo sapiens
aauugugcaguacuuu

SEQ ID NO: 520562 - RNA, 21 nt, Homo sapiens
aauuuagagauaggaaacuga

SEQ ID NO: 520563 - RNA, 18 nt, Homo sapiens
aauuuccuuucauaccuu

SEQ ID NO: 520564 - RNA, 21 nt, Homo sapiens
aauuucuacuucuggaaguca

SEQ ID NO: 520565 - RNA, 11 nt, Homo sapiens
aauuugaacug

SEQ ID NO: 520566 - RNA, 15 nt, Homo sapiens
aauuuuaucaugcca

SEQ ID NO: 520567 - RNA, 12 nt, Homo sapiens
aauuuugcugga

SEQ ID NO: 520568 - RNA, 15 nt, Homo sapiens
aauuuuugucucaga

SEQ ID NO: 520569 - RNA, 13 nt, Homo sapiens
acaaaaaauacuu

SEQ ID NO: 520570 - RNA, 15 nt, Homo sapiens
acaaaaaauacuuua

SEQ ID NO: 520571 - RNA, 14 nt, Homo sapiens
acaaacccaagggc

SEQ ID NO: 520572 - RNA, 19 nt, Homo sapiens
acaaagcucaaaguaugca

SEQ ID NO: 520573 - RNA, 15 nt, Homo sapiens
acaaauaaauguuca

SEQ ID NO: 520574 - RNA, 13 nt, Homo sapiens
acaaauauacauu

SEQ ID NO: 520575 - RNA, 13 nt, Homo sapiens
acaacagugaaaa

SEQ ID NO: 520576 - RNA, 22 nt, Homo sapiens
acaacuccugucuaacugcugu

SEQ ID NO: 520577 - RNA, 22 nt, Homo sapiens
acaacuuuugagaguauagcau

SEQ ID NO: 520578 - RNA, 12 nt, Homo sapiens
acaagauugaaa

SEQ ID NO: 520579 - RNA, 14 nt, Homo sapiens
acaaggcucugcua

SEQ ID NO: 520580 - RNA, 12 nt, Homo sapiens
acaagugucagg

SEQ ID NO: 520581 - RNA, 13 nt, Homo sapiens
acaauaaagcaau

SEQ ID NO: 520582 - RNA, 14 nt, Homo sapiens
acaauaaagcaaug

SEQ ID NO: 520583 - RNA, 17 nt, Homo sapiens
acaauaaagcaaugugg

SEQ ID NO: 520584 - RNA, 15 nt, Homo sapiens
acaauuauuggcaaa

SEQ ID NO: 520585 - RNA, 21 nt, Homo sapiens
acacaaaaaaaauuuuagcuc

SEQ ID NO: 520586 - RNA, 19 nt, Homo sapiens
acacaauuguuuuaccugu

SEQ ID NO: 520587 - RNA, 20 nt, Homo sapiens
acacaauuguuuuaccuguu

SEQ ID NO: 520588 - RNA, 12 nt, Homo sapiens
acacacugacca

SEQ ID NO: 520589 - RNA, 17 nt, Homo sapiens
acacaggcuucaucaag

SEQ ID NO: 520590 - RNA, 15 nt, Homo sapiens
acacaguucugggca

SEQ ID NO: 520591 - RNA, 19 nt, Homo sapiens
acacaguuguaggguuaca

SEQ ID NO: 520592 - RNA, 16 nt, Homo sapiens
acacaugcccaugaug

SEQ ID NO: 520593 - RNA, 19 nt, Homo sapiens
acaccaaugaaaacaugua

SEQ ID NO: 520594 - RNA, 13 nt, Homo sapiens
acacccaguggga

SEQ ID NO: 520595 - RNA, 21 nt, Homo sapiens
acacccuuugggaaagcucuu

SEQ ID NO: 520596 - RNA, 19 nt, Homo sapiens
acaccguacaucugcaaua

SEQ ID NO: 520597 - RNA, 14 nt, Homo sapiens
acacgcucaguuga

SEQ ID NO: 520598 - RNA, 13 nt, Homo sapiens
acacuaacgugug

SEQ ID NO: 520599 - RNA, 15 nt, Homo sapiens
acacuaucauggacu

SEQ ID NO: 520600 - RNA, 13 nt, Homo sapiens
acacuauuuacaa

SEQ ID NO: 520601 - RNA, 16 nt, Homo sapiens
acacugaaaugaaauc

SEQ ID NO: 520602 - RNA, 21 nt, Homo sapiens
acacugcacagggaaaauugc

SEQ ID NO: 520603 - RNA, 23 nt, Homo sapiens
acacugcagcagaaaggcucuga

SEQ ID NO: 520604 - RNA, 22 nt, Homo sapiens
acacugucuguauagugucugu

SEQ ID NO: 520605 - RNA, 20 nt, Homo sapiens
acacuuuuuggaagugaaaa

SEQ ID NO: 520606 - RNA, 18 nt, Homo sapiens
acagaaagauuugaugua

SEQ ID NO: 520607 - RNA, 15 nt, Homo sapiens
acagaaauauccaug

SEQ ID NO: 520608 - RNA, 21 nt, Homo sapiens
acagaacuggaggcaguccau

SEQ ID NO: 520609 - RNA, 15 nt, Homo sapiens
acagaagucuccuca

SEQ ID NO: 520610 - RNA, 16 nt, Homo sapiens
acagaagucuccucaa

SEQ ID NO: 520611 - RNA, 17 nt, Homo sapiens
acagaccuuaguugaaa

SEQ ID NO: 520612 - RNA, 22 nt, Homo sapiens
acagagauuggagagaagggca

SEQ ID NO: 520613 - RNA, 15 nt, Homo sapiens
acagaggcgaaggca

SEQ ID NO: 520614 - RNA, 12 nt, Homo sapiens
acagaucuccug

SEQ ID NO: 520615 - RNA, 21 nt, Homo sapiens
acagauuucaaaaaaaaaccc

SEQ ID NO: 520616 - RNA, 21 nt, Homo sapiens
acagcaaccucuucaugagcu

SEQ ID NO: 520617 - RNA, 22 nt, Homo sapiens
acagcaaccucuucaugagcuu

SEQ ID NO: 520618 - RNA, 15 nt, Homo sapiens
acagcagucagggac

SEQ ID NO: 520619 - RNA, 13 nt, Homo sapiens
acagcauguguau

SEQ ID NO: 520620 - RNA, 14 nt, Homo sapiens
acagcauguguauu

SEQ ID NO: 520621 - RNA, 22 nt, Homo sapiens
acagcugagugcccuguccuca

SEQ ID NO: 520622 - RNA, 20 nt, Homo sapiens
augauagcaaauggccucau

SEQ ID NO: 520623 - RNA, 22 nt, Homo sapiens
augaucaguguuguugcucuag

SEQ ID NO: 520624 - RNA, 20 nt, Homo sapiens
augauccucaugguucccaa

SEQ ID NO: 520625 - RNA, 16 nt, Homo sapiens
augauccuuguguuca

SEQ ID NO: 520626 - RNA, 18 nt, Homo sapiens
augcaauggcucaucaga

SEQ ID NO: 520627 - RNA, 15 nt, Homo sapiens
augcacugauguugu

SEQ ID NO: 520628 - RNA, 16 nt, Homo sapiens
augcaguauucuugca

SEQ ID NO: 520629 - RNA, 13 nt, Homo sapiens
augcauaaacuau

SEQ ID NO: 520630 - RNA, 18 nt, Homo sapiens
augcauuuugcacuagaa

SEQ ID NO: 520631 - RNA, 12 nt, Homo sapiens
augccacuccuc

SEQ ID NO: 520632 - RNA, 21 nt, Homo sapiens
augcccaagagaucugugcca

SEQ ID NO: 520633 - RNA, 20 nt, Homo sapiens
augccccauuggauuacuuu

SEQ ID NO: 520634 - RNA, 15 nt, Homo sapiens
augccuagaguuuac

SEQ ID NO: 520635 - RNA, 16 nt, Homo sapiens
auuucguguacugcaa

SEQ ID NO: 520636 - RNA, 12 nt, Homo sapiens
auuucugugauu

SEQ ID NO: 520637 - RNA, 23 nt, Homo sapiens
auuucuucuucuaagaagacauu

SEQ ID NO: 520638 - RNA, 23 nt, Homo sapiens
auuugaaaccccuguaggccuca

SEQ ID NO: 520639 - RNA, 22 nt, Homo sapiens
auuugauugggaugaaugccau

SEQ ID NO: 520640 - RNA, 13 nt, Homo sapiens
auuugcacacugc

SEQ ID NO: 520641 - RNA, 19 nt, Homo sapiens
auuugcacacugcacuguu

SEQ ID NO: 520642 - RNA, 18 nt, Homo sapiens
auuuguuucuuucucuga

SEQ ID NO: 520643 - RNA, 16 nt, Homo sapiens
auuuuaaacagaggau

SEQ ID NO: 520644 - RNA, 23 nt, Homo sapiens
auuuuacuauuggaaucugauau

SEQ ID NO: 520645 - RNA, 14 nt, Homo sapiens
auuuuagacacuuc

SEQ ID NO: 520646 - RNA, 15 nt, Homo sapiens
auuuuccuguuguca

SEQ ID NO: 520647 - RNA, 21 nt, Homo sapiens
auuuuccuguugucaagaaua

SEQ ID NO: 520648 - RNA, 14 nt, Homo sapiens
auuuucuacaauua

SEQ ID NO: 520649 - RNA, 21 nt, Homo sapiens
auuuucuuacacugugucauu

SEQ ID NO: 520650 - RNA, 11 nt, Homo sapiens
auuuucuugcu

SEQ ID NO: 520651 - RNA, 13 nt, Homo sapiens
auuuugacacugg

SEQ ID NO: 520652 - RNA, 20 nt, Homo sapiens
auuuugcuaagacauaaucu

SEQ ID NO: 520653 - RNA, 18 nt, Homo sapiens
auuuuguaauaauaaaga

SEQ ID NO: 520654 - RNA, 21 nt, Homo sapiens
auuuuguagaauaaggaacaa

SEQ ID NO: 520655 - RNA, 18 nt, Homo sapiens
auuuuugaagcaaagaag

SEQ ID NO: 520656 - RNA, 12 nt, Homo sapiens
auuuuugcacaa

SEQ ID NO: 520657 - RNA, 16 nt, Homo sapiens
auuuuuugaauaugcc

SEQ ID NO: 520658 - RNA, 16 nt, Homo sapiens
caaaaaaccaauuuac

SEQ ID NO: 520659 - RNA, 14 nt, Homo sapiens
caaaacuucagugu

SEQ ID NO: 520660 - RNA, 15 nt, Homo sapiens
caaaacuucuauuau

SEQ ID NO: 520661 - RNA, 22 nt, Homo sapiens
caaaacuucuauuauccagagu

SEQ ID NO: 520662 - RNA, 17 nt, Homo sapiens
caaaaguuuguuugcuu

SEQ ID NO: 520663 - RNA, 17 nt, Homo sapiens
caaacagaacaggguca

SEQ ID NO: 520664 - RNA, 13 nt, Homo sapiens
caaacccauuccc

SEQ ID NO: 520665 - RNA, 15 nt, Homo sapiens
caaacugcuucccuu

SEQ ID NO: 520666 - RNA, 20 nt, Homo sapiens
caaagccacauuauuucuag

SEQ ID NO: 520667 - RNA, 14 nt, Homo sapiens
caaagccuuuccag

SEQ ID NO: 520668 - RNA, 18 nt, Homo sapiens
caaaggaaggacccugag

SEQ ID NO: 520669 - RNA, 20 nt, Homo sapiens
caaagggagcagaacugaac

SEQ ID NO: 520670 - RNA, 11 nt, Homo sapiens
caaaguaccuu

SEQ ID NO: 520671 - RNA, 14 nt, Homo sapiens
caaaguguaugcag

SEQ ID NO: 520672 - RNA, 15 nt, Homo sapiens
caaauacacauuugc

SEQ ID NO: 520673 - RNA, 15 nt, Homo sapiens
caaauauaagacauu

SEQ ID NO: 520674 - RNA, 16 nt, Homo sapiens
caaauauauuuuggaa

SEQ ID NO: 520675 - RNA, 21 nt, Homo sapiens
caaauauggggaaaaaacugu

SEQ ID NO: 520676 - RNA, 19 nt, Homo sapiens
caaaucuaccacuguauga

SEQ ID NO: 520677 - RNA, 13 nt, Homo sapiens
caaaucucuucaa

SEQ ID NO: 520678 - RNA, 15 nt, Homo sapiens
caaaucuucaguauu

SEQ ID NO: 520679 - RNA, 13 nt, Homo sapiens
caaaugaugccau

SEQ ID NO: 520680 - RNA, 16 nt, Homo sapiens
caaauuagccauuuca

SEQ ID NO: 520681 - RNA, 16 nt, Homo sapiens
caaauugggaaaucca

SEQ ID NO: 520682 - RNA, 21 nt, Homo sapiens
caaauugggaaauccauucca

SEQ ID NO: 520683 - RNA, 23 nt, Homo sapiens
caaauugggaaauccauuccauu

SEQ ID NO: 520684 - RNA, 15 nt, Homo sapiens
caacaugcuccaaau

SEQ ID NO: 520685 - RNA, 12 nt, Homo sapiens
caacaugcugcc

SEQ ID NO: 520686 - RNA, 16 nt, Homo sapiens
caacaugcugccccag

SEQ ID NO: 520687 - RNA, 18 nt, Homo sapiens
caaccagagaagcugcua

SEQ ID NO: 520688 - RNA, 19 nt, Homo sapiens
caaccagagaagcugcuac

SEQ ID NO: 520689 - RNA, 12 nt, Homo sapiens
caaccucaucca

SEQ ID NO: 520690 - RNA, 13 nt, Homo sapiens
caaccucauccag

SEQ ID NO: 520691 - RNA, 18 nt, Homo sapiens
caacucuccaauguucua

SEQ ID NO: 520692 - RNA, 21 nt, Homo sapiens
caacugaguguuauuugcaca

SEQ ID NO: 520693 - RNA, 16 nt, Homo sapiens
caagaaacugagacca

SEQ ID NO: 520694 - RNA, 14 nt, Homo sapiens
caagaaagcucacu

SEQ ID NO: 520695 - RNA, 20 nt, Homo sapiens
caagacauuugcugaacuca

SEQ ID NO: 520696 - RNA, 23 nt, Homo sapiens
caagagucaacaggucacuugau

SEQ ID NO: 520697 - RNA, 17 nt, Homo sapiens
caagauacagccugcaa

SEQ ID NO: 520698 - RNA, 16 nt, Homo sapiens
caagaugaaugcagau

SEQ ID NO: 520699 - RNA, 12 nt, Homo sapiens
caagcugcauuu

SEQ ID NO: 520700 - RNA, 16 nt, Homo sapiens
caagcugguauuuuca

SEQ ID NO: 520701 - RNA, 20 nt, Homo sapiens
caagcuuugguuuaugguuu

SEQ ID NO: 520702 - RNA, 22 nt, Homo sapiens
caaggagggggccucauugugu

SEQ ID NO: 520703 - RNA, 14 nt, Homo sapiens
caaggaguacaaug

SEQ ID NO: 520704 - RNA, 16 nt, Homo sapiens
caaggauauacugcag

SEQ ID NO: 520705 - RNA, 20 nt, Homo sapiens
caagggggacugucuuucag

SEQ ID NO: 520706 - RNA, 19 nt, Homo sapiens
caaggugggccuugcuacc

SEQ ID NO: 520707 - RNA, 23 nt, Homo sapiens
caaggugggccuugcuaccucaa

SEQ ID NO: 520708 - RNA, 14 nt, Homo sapiens
caagucaugccuga

SEQ ID NO: 520709 - RNA, 17 nt, Homo sapiens
caagugcgugccgugug

SEQ ID NO: 520710 - RNA, 15 nt, Homo sapiens
caaguucaaaacuua

SEQ ID NO: 520711 - RNA, 11 nt, Homo sapiens
caaguuugcac

SEQ ID NO: 520712 - RNA, 14 nt, Homo sapiens
caauaaagcaaugu

SEQ ID NO: 520713 - RNA, 15 nt, Homo sapiens
caauaaagcaaugug

SEQ ID NO: 520714 - RNA, 13 nt, Homo sapiens
caauaaaguacuu

SEQ ID NO: 520715 - RNA, 13 nt, Homo sapiens
caauacagucuag

SEQ ID NO: 520716 - RNA, 19 nt, Homo sapiens
caaucaaauauuugcugaa

SEQ ID NO: 520717 - RNA, 20 nt, Homo sapiens
caaucuguccguucacaugu

SEQ ID NO: 520718 - RNA, 14 nt, Homo sapiens
caaucuucuacuuu

SEQ ID NO: 520719 - RNA, 16 nt, Homo sapiens
caaucuucuacuuuaa

SEQ ID NO: 520720 - RNA, 22 nt, Homo sapiens
caaugaaaacauguacuacagc

SEQ ID NO: 520721 - RNA, 22 nt, Homo sapiens
caaugagaaugaugcacacuga

SEQ ID NO: 520722 - RNA, 18 nt, Homo sapiens
caaugagcaaaucuccau

SEQ ID NO: 520723 - RNA, 16 nt, Homo sapiens
caaugcuucuguugau

SEQ ID NO: 520724 - RNA, 14 nt, Homo sapiens
caauguaacacugg

SEQ ID NO: 520725 - RNA, 16 nt, Homo sapiens
caauuccaacuuucag

SEQ ID NO: 520726 - RNA, 14 nt, Homo sapiens
caauuccuucuuca

SEQ ID NO: 520727 - RNA, 23 nt, Homo sapiens
caauucugcccgcuccauggaaa

SEQ ID NO: 520728 - RNA, 12 nt, Homo sapiens
cacaaacaauau

SEQ ID NO: 520729 - RNA, 20 nt, Homo sapiens
cacacaccaaguaccaguau

SEQ ID NO: 520730 - RNA, 19 nt, Homo sapiens
cacagaaugacugacaaag

SEQ ID NO: 520731 - RNA, 12 nt, Homo sapiens
cacagauaagua

SEQ ID NO: 520732 - RNA, 14 nt, Homo sapiens
cacagaugggauca

SEQ ID NO: 520733 - RNA, 20 nt, Homo sapiens
cacagccgccugaaagccac

SEQ ID NO: 520734 - RNA, 23 nt, Homo sapiens
cacaggcccuggcugaggucucu

SEQ ID NO: 520735 - RNA, 22 nt, Homo sapiens
cacauacgggcuuuaauaguca

SEQ ID NO: 520736 - RNA, 11 nt, Homo sapiens
cacaucuccag

SEQ ID NO: 520737 - RNA, 20 nt, Homo sapiens
cacauggcggagaguuuuaa

SEQ ID NO: 520738 - RNA, 19 nt, Homo sapiens
caccaaugaaaacauguac

SEQ ID NO: 520739 - RNA, 16 nt, Homo sapiens
caccacaccaucaggc

SEQ ID NO: 520740 - RNA, 15 nt, Homo sapiens
cacccacuuugucca

SEQ ID NO: 520741 - RNA, 17 nt, Homo sapiens
cacccuccuugcaggau

SEQ ID NO: 520742 - RNA, 20 nt, Homo sapiens
cacccugcugcuggugcaca

SEQ ID NO: 520743 - RNA, 14 nt, Homo sapiens
cacccuuuccagga

SEQ ID NO: 520744 - RNA, 17 nt, Homo sapiens
caccguacaucugcaau

SEQ ID NO: 520745 - RNA, 22 nt, Homo sapiens
caccguacaucugcaauaugaa

SEQ ID NO: 520746 - RNA, 22 nt, Homo sapiens
caccuaauguuuaugagccaga

SEQ ID NO: 520747 - RNA, 17 nt, Homo sapiens
caccuaugugguccaga

SEQ ID NO: 520748 - RNA, 19 nt, Homo sapiens
caccucggcacacacugug

SEQ ID NO: 520749 - RNA, 15 nt, Homo sapiens
caccugacucuugca

SEQ ID NO: 520750 - RNA, 17 nt, Homo sapiens
caccuggcccuugcaau

SEQ ID NO: 520751 - RNA, 20 nt, Homo sapiens
caccuucaccuggaugugca

SEQ ID NO: 520752 - RNA, 17 nt, Homo sapiens
caccuuccccagaacca

SEQ ID NO: 520753 - RNA, 17 nt, Homo sapiens
caccuugccuugcuguu

SEQ ID NO: 520754 - RNA, 13 nt, Homo sapiens
caccuugugccug

SEQ ID NO: 520755 - RNA, 14 nt, Homo sapiens
cucccuagccagag

SEQ ID NO: 520756 - RNA, 22 nt, Homo sapiens
cucccuagccagaggcucuaau

SEQ ID NO: 520757 - RNA, 19 nt, Homo sapiens
cuccgaggugguucagaca

SEQ ID NO: 520758 - RNA, 14 nt, Homo sapiens
cuccugcaucucau

SEQ ID NO: 520759 - RNA, 15 nt, Homo sapiens
cuccugucuccagca

SEQ ID NO: 520760 - RNA, 17 nt, Homo sapiens
cuccuugacuccaagaa

SEQ ID NO: 520761 - RNA, 17 nt, Homo sapiens
cucggcacacacugugc

SEQ ID NO: 520762 - RNA, 18 nt, Homo sapiens
cucguuuacacugcacau

SEQ ID NO: 520763 - RNA, 14 nt, Homo sapiens
cucuaaugccucug

SEQ ID NO: 520764 - RNA, 15 nt, Homo sapiens
cucucagcugaccau

SEQ ID NO: 520765 - RNA, 16 nt, Homo sapiens
cucucagcugaccauc

SEQ ID NO: 520766 - RNA, 17 nt, Homo sapiens
cucuccaauacucaggu

SEQ ID NO: 520767 - RNA, 21 nt, Homo sapiens
cucucccugggucuggggaca

SEQ ID NO: 520768 - RNA, 18 nt, Homo sapiens
cucuccucucugaccugg

SEQ ID NO: 520769 - RNA, 15 nt, Homo sapiens
cucucgacaguaucc

SEQ ID NO: 520770 - RNA, 18 nt, Homo sapiens
cucucgacaguauccaca

SEQ ID NO: 520771 - RNA, 17 nt, Homo sapiens
cucugaaacggauccag

SEQ ID NO: 520772 - RNA, 18 nt, Homo sapiens
cucugcaagaagaaauca

SEQ ID NO: 520773 - RNA, 16 nt, Homo sapiens
cucuggccuugcccca

SEQ ID NO: 520774 - RNA, 21 nt, Homo sapiens
cucuggugcuccugcaucuca

SEQ ID NO: 520775 - RNA, 22 nt, Homo sapiens
cucugugaccccuccuugucag

SEQ ID NO: 520776 - RNA, 20 nt, Homo sapiens
cucuguuaccacgacuucua

SEQ ID NO: 520777 - RNA, 18 nt, Homo sapiens
cucuuaaaagaugccuua

SEQ ID NO: 520778 - RNA, 14 nt, Homo sapiens
cucuuagugauuga

SEQ ID NO: 520779 - RNA, 21 nt, Homo sapiens
cucuucuuggggcccagugca

SEQ ID NO: 520780 - RNA, 14 nt, Homo sapiens
cucuugucaaaagg

SEQ ID NO: 520781 - RNA, 15 nt, Homo sapiens
cucuuugcagugggg

SEQ ID NO: 520782 - RNA, 19 nt, Homo sapiens
cugaaagacucgagaacca

SEQ ID NO: 520783 - RNA, 12 nt, Homo sapiens
cugaaagccaca

SEQ ID NO: 520784 - RNA, 14 nt, Homo sapiens
cugaaccauuccaa

SEQ ID NO: 520785 - RNA, 20 nt, Homo sapiens
cugaacuacauaacuuccua

SEQ ID NO: 520786 - RNA, 12 nt, Homo sapiens
cugaacugaaag

SEQ ID NO: 520787 - RNA, 19 nt, Homo sapiens
cugaagaugggagccuuua

SEQ ID NO: 520788 - RNA, 20 nt, Homo sapiens
cugaaggcagucauaucaaa

SEQ ID NO: 520789 - RNA, 19 nt, Homo sapiens
cugaauaaauaauucuucc

SEQ ID NO: 520790 - RNA, 13 nt, Homo sapiens
cugaauggucuca

SEQ ID NO: 520791 - RNA, 12 nt, Homo sapiens
cugacaaccuca

SEQ ID NO: 520792 - RNA, 18 nt, Homo sapiens
cugacaacugugaagcca

SEQ ID NO: 520793 - RNA, 19 nt, Homo sapiens
cugaccuggagaugcugcc

SEQ ID NO: 520794 - RNA, 18 nt, Homo sapiens
cugagacaaagcaaugga

SEQ ID NO: 520795 - RNA, 13 nt, Homo sapiens
cugagagaugaca

SEQ ID NO: 520796 - RNA, 14 nt, Homo sapiens
cugagaucgugcua

SEQ ID NO: 520797 - RNA, 17 nt, Homo sapiens
cugagauuacucugaaa

SEQ ID NO: 520798 - RNA, 16 nt, Homo sapiens
cugagauuuugcuuga

SEQ ID NO: 520799 - RNA, 19 nt, Homo sapiens
cugagcuggcccuugggga

SEQ ID NO: 520800 - RNA, 13 nt, Homo sapiens
cugagcuuugaaa

SEQ ID NO: 520801 - RNA, 20 nt, Homo sapiens
cugagcuuuguccugaagga

SEQ ID NO: 520802 - RNA, 23 nt, Homo sapiens
cugaggacaagagaaaaaagcca

SEQ ID NO: 520803 - RNA, 22 nt, Homo sapiens
cugaggcaggagagucacuuga

SEQ ID NO: 520804 - RNA, 15 nt, Homo sapiens
cugagggcaguucug

SEQ ID NO: 520805 - RNA, 14 nt, Homo sapiens
cugaggugacuuaa

SEQ ID NO: 520806 - RNA, 17 nt, Homo sapiens
cugaguguuuaauuuca

SEQ ID NO: 520807 - RNA, 18 nt, Homo sapiens
cugauacugggucugcga

SEQ ID NO: 520808 - RNA, 13 nt, Homo sapiens
cugaucuauacaa

SEQ ID NO: 520809 - RNA, 16 nt, Homo sapiens
cugauggaaaauacca

SEQ ID NO: 520810 - RNA, 20 nt, Homo sapiens
cugauguccguaggccuuaa

SEQ ID NO: 520811 - RNA, 15 nt, Homo sapiens
cugauuuucgcugau

SEQ ID NO: 520812 - RNA, 17 nt, Homo sapiens
cugcaaugaaagucaaa

SEQ ID NO: 520813 - RNA, 23 nt, Homo sapiens
cugcacagccuagacauccaggu

SEQ ID NO: 520814 - RNA, 20 nt, Homo sapiens
cugcaccccucugcccucau

SEQ ID NO: 520815 - RNA, 22 nt, Homo sapiens
cugcacuguccugaccaucgca

SEQ ID NO: 520816 - RNA, 17 nt, Homo sapiens
cugcagaaguacuccua

SEQ ID NO: 520817 - RNA, 23 nt, Homo sapiens
cugcagauacuuugaagugcagc

SEQ ID NO: 520818 - RNA, 17 nt, Homo sapiens
cugcagcaggaguggug

SEQ ID NO: 520819 - RNA, 16 nt, Homo sapiens
cugcaggauaaaaugg

SEQ ID NO: 520820 - RNA, 22 nt, Homo sapiens
cugcagggccauggcucagggu

SEQ ID NO: 520821 - RNA, 16 nt, Homo sapiens
cugcauuuacacacac

SEQ ID NO: 520822 - RNA, 12 nt, Homo sapiens
cugccagccuug

SEQ ID NO: 520823 - RNA, 21 nt, Homo sapiens
cugccaguugucuuaugugaa

SEQ ID NO: 520824 - RNA, 17 nt, Homo sapiens
cugccaucaugccugac

SEQ ID NO: 520825 - RNA, 19 nt, Homo sapiens
cugcccauucaccaaaauu

SEQ ID NO: 520826 - RNA, 14 nt, Homo sapiens
cugccccagacaga

SEQ ID NO: 520827 - RNA, 13 nt, Homo sapiens
cugccccaugugu

SEQ ID NO: 520828 - RNA, 15 nt, Homo sapiens
cugccccaugugucc

SEQ ID NO: 520829 - RNA, 17 nt, Homo sapiens
cugccccucucaccaaa

SEQ ID NO: 520830 - RNA, 16 nt, Homo sapiens
cugccccuuaaacaca

SEQ ID NO: 520831 - RNA, 18 nt, Homo sapiens
cugcccuuucaaagcacu

SEQ ID NO: 520832 - RNA, 17 nt, Homo sapiens
cugccugcauucugaga

SEQ ID NO: 520833 - RNA, 20 nt, Homo sapiens
cugccuggcccccaaccuca

SEQ ID NO: 520834 - RNA, 12 nt, Homo sapiens
cugccuucacaa

SEQ ID NO: 520835 - RNA, 19 nt, Homo sapiens
cugccuucacaaaugucau

SEQ ID NO: 520836 - RNA, 18 nt, Homo sapiens
cugcgcauauagacugua

SEQ ID NO: 520837 - RNA, 22 nt, Homo sapiens
cugcucguuuacacugcacauu

SEQ ID NO: 520838 - RNA, 18 nt, Homo sapiens
cugcugaaagacucgaga

SEQ ID NO: 520839 - RNA, 21 nt, Homo sapiens
cugcugaaggcagucauauca

SEQ ID NO: 520840 - RNA, 23 nt, Homo sapiens
cugcugaaggcagucauaucaaa

SEQ ID NO: 520841 - RNA, 17 nt, Homo sapiens
cugcuggagcccaguca

SEQ ID NO: 520842 - RNA, 20 nt, Homo sapiens
cugcuugauuuuaauacauu

SEQ ID NO: 520843 - RNA, 17 nt, Homo sapiens
cugcuuuucccauugcc

SEQ ID NO: 520844 - RNA, 15 nt, Homo sapiens
cuggaaaaaggugaa

SEQ ID NO: 520845 - RNA, 17 nt, Homo sapiens
cuggaacagaagacagc

SEQ ID NO: 520846 - RNA, 18 nt, Homo sapiens
cuggaagucaucucauuc

SEQ ID NO: 520847 - RNA, 18 nt, Homo sapiens
cuggaauucuucugcaac

SEQ ID NO: 520848 - RNA, 16 nt, Homo sapiens
cuggagaucagcaugc

SEQ ID NO: 520849 - RNA, 14 nt, Homo sapiens
cuggagaugcugcc

SEQ ID NO: 520850 - RNA, 16 nt, Homo sapiens
cuggagugagcucugu

SEQ ID NO: 520851 - RNA, 14 nt, Homo sapiens
cuggauguauguaa

SEQ ID NO: 520852 - RNA, 11 nt, Homo sapiens
ggucacagcua

SEQ ID NO: 520853 - RNA, 20 nt, Homo sapiens
ggucagcuuuuguuguuuau

SEQ ID NO: 520854 - RNA, 22 nt, Homo sapiens
ggucccuggucggagagggaca

SEQ ID NO: 520855 - RNA, 16 nt, Homo sapiens
ggucucaaacuccuga

SEQ ID NO: 520856 - RNA, 13 nt, Homo sapiens
ggucugggccagu

SEQ ID NO: 520857 - RNA, 18 nt, Homo sapiens
ggucugugugaauguggg

SEQ ID NO: 520858 - RNA, 19 nt, Homo sapiens
ggugaaacagggcuugucc

SEQ ID NO: 520859 - RNA, 18 nt, Homo sapiens
ggugaaaccccgucucua

SEQ ID NO: 520860 - RNA, 16 nt, Homo sapiens
ggugaacacuuaguga

SEQ ID NO: 520861 - RNA, 19 nt, Homo sapiens
ggugagcuccagcugcugc

SEQ ID NO: 520862 - RNA, 15 nt, Homo sapiens
ggugauagguaaauu

SEQ ID NO: 520863 - RNA, 19 nt, Homo sapiens
ggugcgcccugucucugug

SEQ ID NO: 520864 - RNA, 20 nt, Homo sapiens
gguggcugagcaucggagug

SEQ ID NO: 520865 - RNA, 13 nt, Homo sapiens
ggugucugcccug

SEQ ID NO: 520866 - RNA, 21 nt, Homo sapiens
gguguguauguaaaguuaaaa

SEQ ID NO: 520867 - RNA, 14 nt, Homo sapiens
gguguguucugcaa

SEQ ID NO: 520868 - RNA, 14 nt, Homo sapiens
gguuauuucaauuc

SEQ ID NO: 520869 - RNA, 19 nt, Homo sapiens
gguucguucuguacuguua

SEQ ID NO: 520870 - RNA, 18 nt, Homo sapiens
gguuggcccccacguggg

SEQ ID NO: 520871 - RNA, 17 nt, Homo sapiens
gguuuaauucagcagag

SEQ ID NO: 520872 - RNA, 12 nt, Homo sapiens
guaaaaaacugu

SEQ ID NO: 520873 - RNA, 18 nt, Homo sapiens
guaaaaggauaguaagca

SEQ ID NO: 520874 - RNA, 17 nt, Homo sapiens
guaaacagaagccuguu

SEQ ID NO: 520875 - RNA, 13 nt, Homo sapiens
guaaaccuugaag

SEQ ID NO: 520876 - RNA, 19 nt, Homo sapiens
guaaauccugccauuuaaa

SEQ ID NO: 520877 - RNA, 12 nt, Homo sapiens
guaaauguuucu

SEQ ID NO: 520878 - RNA, 17 nt, Homo sapiens
guaaauuuuuaggcaaa

SEQ ID NO: 520879 - RNA, 14 nt, Homo sapiens
guaacaucuguuau

SEQ ID NO: 520880 - RNA, 18 nt, Homo sapiens
guaacaucuguuaucaaa

SEQ ID NO: 520881 - RNA, 19 nt, Homo sapiens
guaacuccccucagggaua

SEQ ID NO: 520882 - RNA, 16 nt, Homo sapiens
guaaucaagggucauu

SEQ ID NO: 520883 - RNA, 12 nt, Homo sapiens
guaaucuacacc

SEQ ID NO: 520884 - RNA, 19 nt, Homo sapiens
guaauucuuuucuguuucu

SEQ ID NO: 520885 - RNA, 16 nt, Homo sapiens
guacaauaaagcaaug

SEQ ID NO: 520886 - RNA, 15 nt, Homo sapiens
guacaucugcaauau

SEQ ID NO: 520887 - RNA, 15 nt, Homo sapiens
guaccaagugaaauu

SEQ ID NO: 520888 - RNA, 22 nt, Homo sapiens
guaccaauucagugucuguucc

SEQ ID NO: 520889 - RNA, 18 nt, Homo sapiens
guaccuccucucaguguu

SEQ ID NO: 520890 - RNA, 14 nt, Homo sapiens
guacggacuuccuu

SEQ ID NO: 520891 - RNA, 18 nt, Homo sapiens
guacugaaagccuuaggg

SEQ ID NO: 520892 - RNA, 17 nt, Homo sapiens
guacugugucucaugga

SEQ ID NO: 520893 - RNA, 18 nt, Homo sapiens
guacuuuuaaaaacauaa

SEQ ID NO: 520894 - RNA, 21 nt, Homo sapiens
guagaaucucuucaugcuuga

SEQ ID NO: 520895 - RNA, 21 nt, Homo sapiens
guagcucccauauauggagau

SEQ ID NO: 520896 - RNA, 12 nt, Homo sapiens
guagcucugcug

SEQ ID NO: 520897 - RNA, 14 nt, Homo sapiens
guagcuugcucccu

SEQ ID NO: 520898 - RNA, 17 nt, Homo sapiens
guaggugaaagaacaag

SEQ ID NO: 520899 - RNA, 18 nt, Homo sapiens
guaucaaauacauuuaaa

SEQ ID NO: 520900 - RNA, 19 nt, Homo sapiens
guaucuuuugaacuggcaa

SEQ ID NO: 520901 - RNA, 17 nt, Homo sapiens
guauuauauaauucaag

SEQ ID NO: 520902 - RNA, 19 nt, Homo sapiens
guauugauuuuaaauggau

SEQ ID NO: 520903 - RNA, 21 nt, Homo sapiens
guauuuauuuuacagcucauu

SEQ ID NO: 520904 - RNA, 19 nt, Homo sapiens
guauuuccagugcaauugu

SEQ ID NO: 520905 - RNA, 22 nt, Homo sapiens
guauuugguauauacuuugcca

SEQ ID NO: 520906 - RNA, 20 nt, Homo sapiens
guauuuuuauuuuugcacaa

SEQ ID NO: 520907 - RNA, 23 nt, Homo sapiens
gucaacauagugagacacugucu

SEQ ID NO: 520908 - RNA, 23 nt, Homo sapiens
gucaacgcaacgucuaacuggac

SEQ ID NO: 520909 - RNA, 17 nt, Homo sapiens
gucaagaauagcauugu

SEQ ID NO: 520910 - RNA, 20 nt, Homo sapiens
gucaagaucagccugggcaa

SEQ ID NO: 520911 - RNA, 13 nt, Homo sapiens
gucaagcaccugc

SEQ ID NO: 520912 - RNA, 14 nt, Homo sapiens
gucaaggcucaguc

SEQ ID NO: 520913 - RNA, 15 nt, Homo sapiens
gucagcauccagguu

SEQ ID NO: 520914 - RNA, 12 nt, Homo sapiens
gucagcauguac

SEQ ID NO: 520915 - RNA, 18 nt, Homo sapiens
gucagcauguacuccccu

SEQ ID NO: 520916 - RNA, 18 nt, Homo sapiens
gucaggaguuccagacca

SEQ ID NO: 520917 - RNA, 22 nt, Homo sapiens
gucauagcaagcuuuugcucaa

SEQ ID NO: 520918 - RNA, 17 nt, Homo sapiens
gucaucacacucuccau

SEQ ID NO: 520919 - RNA, 23 nt, Homo sapiens
gucaucgggaggagcagccugaa

SEQ ID NO: 520920 - RNA, 16 nt, Homo sapiens
gucaugaauagaaaaa

SEQ ID NO: 520921 - RNA, 20 nt, Homo sapiens
gucauggaggccaagaacuu

SEQ ID NO: 520922 - RNA, 13 nt, Homo sapiens
gucauguuugcag

SEQ ID NO: 520923 - RNA, 20 nt, Homo sapiens
gucauucagcgggagcacug

SEQ ID NO: 520924 - RNA, 13 nt, Homo sapiens
guccagcaccuug

SEQ ID NO: 520925 - RNA, 14 nt, Homo sapiens
gucccaccugcaca

SEQ ID NO: 520926 - RNA, 18 nt, Homo sapiens
guccccuccccucucagc

SEQ ID NO: 520927 - RNA, 13 nt, Homo sapiens
gucccuugccucu

SEQ ID NO: 520928 - RNA, 22 nt, Homo sapiens
gucccuugcuugccugcagggc

SEQ ID NO: 520929 - RNA, 18 nt, Homo sapiens
guccucccucugauuuuu

SEQ ID NO: 520930 - RNA, 14 nt, Homo sapiens
guccucgagcaacu

SEQ ID NO: 520931 - RNA, 20 nt, Homo sapiens
guccugaaggaaaaugacuc

SEQ ID NO: 520932 - RNA, 16 nt, Homo sapiens
guccugcugaaacugc

SEQ ID NO: 520933 - RNA, 14 nt, Homo sapiens
guccugggcaaagg

SEQ ID NO: 520934 - RNA, 15 nt, Homo sapiens
guccuuucagucuga

SEQ ID NO: 520935 - RNA, 14 nt, Homo sapiens
gucuaaaagcagaa

SEQ ID NO: 520936 - RNA, 13 nt, Homo sapiens
gucuaacugcugu

SEQ ID NO: 520937 - RNA, 16 nt, Homo sapiens
gucuagagaacacugu

SEQ ID NO: 520938 - RNA, 16 nt, Homo sapiens
gucuauuaauauucag

SEQ ID NO: 520939 - RNA, 16 nt, Homo sapiens
gucucaaaccaagcaa

SEQ ID NO: 520940 - RNA, 17 nt, Homo sapiens
gucucuacaaaaauaca

SEQ ID NO: 520941 - RNA, 16 nt, Homo sapiens
uaaaguuuugcaacaa

SEQ ID NO: 520942 - RNA, 16 nt, Homo sapiens
uaaauaaaaauaugua

SEQ ID NO: 520943 - RNA, 14 nt, Homo sapiens
uaaauaauucuucc

SEQ ID NO: 520944 - RNA, 17 nt, Homo sapiens
uaaauaggaaucauuca

SEQ ID NO: 520945 - RNA, 23 nt, Homo sapiens
uaaauagugucauauaaacucau

SEQ ID NO: 520946 - RNA, 14 nt, Homo sapiens
uaaauucaucuaga

SEQ ID NO: 520947 - RNA, 16 nt, Homo sapiens
uaaauuguguauuuaa

SEQ ID NO: 520948 - RNA, 21 nt, Homo sapiens
uaacacauuuuuuugcaugca

SEQ ID NO: 520949 - RNA, 15 nt, Homo sapiens
uaacacggugcucau

SEQ ID NO: 520950 - RNA, 16 nt, Homo sapiens
uaacacggugcucauu

SEQ ID NO: 520951 - RNA, 23 nt, Homo sapiens
uaacauggugaaaccccgucucu

SEQ ID NO: 520952 - RNA, 17 nt, Homo sapiens
uaacauguuaucaaauc

SEQ ID NO: 520953 - RNA, 15 nt, Homo sapiens
uaacauugugacuuu

SEQ ID NO: 520954 - RNA, 16 nt, Homo sapiens
uaaccacuaacauugu

SEQ ID NO: 520955 - RNA, 12 nt, Homo sapiens
uaaccaguacuu

SEQ ID NO: 520956 - RNA, 18 nt, Homo sapiens
uaacccagagcuguauuu

SEQ ID NO: 520957 - RNA, 18 nt, Homo sapiens
uaacgccagcacacuauu

SEQ ID NO: 520958 - RNA, 13 nt, Homo sapiens
uaacucccaguga

SEQ ID NO: 520959 - RNA, 23 nt, Homo sapiens
uaacucugggaggggcucgagag

SEQ ID NO: 520960 - RNA, 17 nt, Homo sapiens
uaagaaauagacagcau

SEQ ID NO: 520961 - RNA, 16 nt, Homo sapiens
uaagaagagauuucuc

SEQ ID NO: 520962 - RNA, 13 nt, Homo sapiens
uaagaauaccaca

SEQ ID NO: 520963 - RNA, 19 nt, Homo sapiens
uaagagcauagaacucaaa

SEQ ID NO: 520964 - RNA, 22 nt, Homo sapiens
uaagugaugagggccucugcau

SEQ ID NO: 520965 - RNA, 23 nt, Homo sapiens
uaauaaacugcaaguucauuuua

SEQ ID NO: 520966 - RNA, 22 nt, Homo sapiens
uaauaauuggagaagauuuaug

SEQ ID NO: 520967 - RNA, 19 nt, Homo sapiens
uaauacauugaucaggcca

SEQ ID NO: 520968 - RNA, 15 nt, Homo sapiens
uaauaccagaacucu

SEQ ID NO: 520969 - RNA, 19 nt, Homo sapiens
uaauauacaaaacaauuaa

SEQ ID NO: 520970 - RNA, 17 nt, Homo sapiens
uaauaugccuagcacaa

SEQ ID NO: 520971 - RNA, 20 nt, Homo sapiens
uaauauuuuuguauuucucu

SEQ ID NO: 520972 - RNA, 17 nt, Homo sapiens
uaauccuagcuacuugg

SEQ ID NO: 520973 - RNA, 20 nt, Homo sapiens
uaauguuauaucauauguau

SEQ ID NO: 520974 - RNA, 15 nt, Homo sapiens
uaauuaccuggugag

SEQ ID NO: 520975 - RNA, 16 nt, Homo sapiens
uauggcuccuccauau

SEQ ID NO: 520976 - RNA, 16 nt, Homo sapiens
uauuaacccuaccugu

SEQ ID NO: 520977 - RNA, 14 nt, Homo sapiens
uauuagaaauuaga

SEQ ID NO: 520978 - RNA, 22 nt, Homo sapiens
uauuaucuaaaagaaaccuucc

SEQ ID NO: 520979 - RNA, 15 nt, Homo sapiens
uauuauugcugccaa

SEQ ID NO: 520980 - RNA, 17 nt, Homo sapiens
uauucauaaaguuacag

SEQ ID NO: 520981 - RNA, 16 nt, Homo sapiens
uauuccucucacccca

SEQ ID NO: 520982 - RNA, 20 nt, Homo sapiens
uauucuuugaaaacagauga

SEQ ID NO: 520983 - RNA, 21 nt, Homo sapiens
uauuggagccccaggggacaa

SEQ ID NO: 520984 - RNA, 17 nt, Homo sapiens
uauugugaaguacauau

SEQ ID NO: 520985 - RNA, 14 nt, Homo sapiens
uauuucguguacug

SEQ ID NO: 520986 - RNA, 19 nt, Homo sapiens
uauuugcacacugcacugu

SEQ ID NO: 520987 - RNA, 21 nt, Homo sapiens
uauuugguauauacuuugcca

SEQ ID NO: 520988 - RNA, 22 nt, Homo sapiens
ucaaaagguauuauacauguga

SEQ ID NO: 520989 - RNA, 13 nt, Homo sapiens
ucaaaaggucuaa

SEQ ID NO: 520990 - RNA, 18 nt, Homo sapiens
ucaaauacacauuugcua

SEQ ID NO: 520991 - RNA, 17 nt, Homo sapiens
ucaaaucuccugcugau

SEQ ID NO: 520992 - RNA, 14 nt, Homo sapiens
ucaaauucuucaca

SEQ ID NO: 520993 - RNA, 15 nt, Homo sapiens
ucaaauuuccuuuca

SEQ ID NO: 520994 - RNA, 18 nt, Homo sapiens
ucaaauuuuaucaugcca

SEQ ID NO: 520995 - RNA, 17 nt, Homo sapiens
ucaagacauuugcugaa

SEQ ID NO: 520996 - RNA, 20 nt, Homo sapiens
ucaaggcaguagaacuccag

SEQ ID NO: 520997 - RNA, 13 nt, Homo sapiens
ucaaggugggccu

SEQ ID NO: 520998 - RNA, 23 nt, Homo sapiens
ucaaggugggccuugcuaccuca

SEQ ID NO: 520999 - RNA, 15 nt, Homo sapiens
ucaaguccaucugac

SEQ ID NO: 521000 - RNA, 15 nt, Homo sapiens
ucaauagaucuccag

SEQ ID NO: 521001 - RNA, 21 nt, Homo sapiens
ucaauccuaaaagcaugucaa

SEQ ID NO: 521002 - RNA, 13 nt, Homo sapiens
ucaaugugcauaa

SEQ ID NO: 521003 - RNA, 13 nt, Homo sapiens
ucacaaauggaau

SEQ ID NO: 521004 - RNA, 13 nt, Homo sapiens
ucacaacagugaa

SEQ ID NO: 521005 - RNA, 21 nt, Homo sapiens
ucacagaaugacugacaaaga

SEQ ID NO: 521006 - RNA, 12 nt, Homo sapiens
ucacaucuccag

SEQ ID NO: 521007 - RNA, 17 nt, Homo sapiens
ucaccucccgaagccac

SEQ ID NO: 521008 - RNA, 15 nt, Homo sapiens
ucaccuggaugugca

SEQ ID NO: 521009 - RNA, 12 nt, Homo sapiens
ucacugcaauuu

SEQ ID NO: 521010 - RNA, 11 nt, Homo sapiens
ucacugcugau

SEQ ID NO: 521011 - RNA, 16 nt, Homo sapiens
ucacuuuauuaucccu

SEQ ID NO: 521012 - RNA, 16 nt, Homo sapiens
ucagaagccuagggga

SEQ ID NO: 521013 - RNA, 14 nt, Homo sapiens
ucagaccugcauug

SEQ ID NO: 521014 - RNA, 21 nt, Homo sapiens
ucagagaaggugcaggugaca

SEQ ID NO: 521015 - RNA, 14 nt, Homo sapiens
ucagaguccuugca

SEQ ID NO: 521016 - RNA, 21 nt, Homo sapiens
ucagauacaugguugugaccu

SEQ ID NO: 521017 - RNA, 18 nt, Homo sapiens
ucagauccuuuuauucuc

SEQ ID NO: 521018 - RNA, 12 nt, Homo sapiens
ucagaucucaug

SEQ ID NO: 521019 - RNA, 18 nt, Homo sapiens
ucagcaaccugacucagg

SEQ ID NO: 521020 - RNA, 22 nt, Homo sapiens
ucagcagucuaguucuuuucau

SEQ ID NO: 521021 - RNA, 11 nt, Homo sapiens
ucagcauuucc

SEQ ID NO: 521022 - RNA, 22 nt, Homo sapiens
ucagccugggcaacauggugaa

SEQ ID NO: 521023 - RNA, 19 nt, Homo sapiens
ucagcgugggccagaggca

SEQ ID NO: 521024 - RNA, 12 nt, Homo sapiens
ucagcugaccau

SEQ ID NO: 521025 - RNA, 23 nt, Homo sapiens
ucagcugggaugacuggcuuuga

SEQ ID NO: 521026 - RNA, 17 nt, Homo sapiens
ucagcuuauaugugaca

SEQ ID NO: 521027 - RNA, 18 nt, Homo sapiens
ucaggaaggggugugcug

SEQ ID NO: 521028 - RNA, 21 nt, Homo sapiens
ucaggccagugugucucugaa

SEQ ID NO: 521029 - RNA, 16 nt, Homo sapiens
ucaggccgcauccuga

SEQ ID NO: 521030 - RNA, 19 nt, Homo sapiens
ucagggccuggggccugag

SEQ ID NO: 521031 - RNA, 17 nt, Homo sapiens
ucaguccuguacucugg

SEQ ID NO: 521032 - RNA, 16 nt, Homo sapiens
ucagucugauccaucc

SEQ ID NO: 521033 - RNA, 22 nt, Homo sapiens
ucaguugaaaaugcaacucuaa

SEQ ID NO: 521034 - RNA, 14 nt, Homo sapiens
ucauaaaguuacag

SEQ ID NO: 521035 - RNA, 21 nt, Homo sapiens
ucauaccaauuccaacuuuca

SEQ ID NO: 521036 - RNA, 20 nt, Homo sapiens
ucauaccuacaucagacaaa

SEQ ID NO: 521037 - RNA, 20 nt, Homo sapiens
ucauagcaccuaacaacauu

SEQ ID NO: 521038 - RNA, 15 nt, Homo sapiens
ucauaguaagauuga

SEQ ID NO: 521039 - RNA, 21 nt, Homo sapiens
ucaucauuuguggcagucccu

SEQ ID NO: 521040 - RNA, 15 nt, Homo sapiens
ucauccucaugcugc

SEQ ID NO: 521041 - RNA, 18 nt, Homo sapiens
ucaucgggccagaaggcg

SEQ ID NO: 521042 - RNA, 14 nt, Homo sapiens
ucaucugcacuaug

SEQ ID NO: 521043 - RNA, 23 nt, Homo sapiens
ucaucuuagugccugagaguauu

SEQ ID NO: 521044 - RNA, 22 nt, Homo sapiens
ucaugcagccgugaucaaggga

SEQ ID NO: 521045 - RNA, 11 nt, Homo sapiens
ucaugccugua

SEQ ID NO: 521046 - RNA, 19 nt, Homo sapiens
ucaugccuguaaucccagc

SEQ ID NO: 521047 - RNA, 21 nt, Homo sapiens
ucaugccuugagaucuguggu

SEQ ID NO: 521048 - RNA, 17 nt, Homo sapiens
ucaugcuugacauaccu

SEQ ID NO: 521049 - RNA, 18 nt, Homo sapiens
ucaugcuuuugcuugcaa

SEQ ID NO: 521050 - RNA, 22 nt, Homo sapiens
ucauggaggccaagaacuugca

SEQ ID NO: 521051 - RNA, 11 nt, Homo sapiens
ucauggcauau

SEQ ID NO: 521052 - RNA, 15 nt, Homo sapiens
ucaugguuuccucca

SEQ ID NO: 521053 - RNA, 16 nt, Homo sapiens
ucauguaugucagaag

SEQ ID NO: 521054 - RNA, 14 nt, Homo sapiens
ucauguugcaaaga

SEQ ID NO: 521055 - RNA, 19 nt, Homo sapiens
ucauucauuggugaaguaa

SEQ ID NO: 521056 - RNA, 15 nt, Homo sapiens
ucauuccuaacacag

SEQ ID NO: 521057 - RNA, 20 nt, Homo sapiens
ucauuccuaacacagcaugu

SEQ ID NO: 521058 - RNA, 16 nt, Homo sapiens
ucauugagaaacuggg

SEQ ID NO: 521059 - RNA, 15 nt, Homo sapiens
ucugggccagugcac

SEQ ID NO: 521060 - RNA, 17 nt, Homo sapiens
ucuggucacauggcugu

SEQ ID NO: 521061 - RNA, 20 nt, Homo sapiens
ucuggucacauggcugucga

SEQ ID NO: 521062 - RNA, 19 nt, Homo sapiens
ucuguccacgauucacuca

SEQ ID NO: 521063 - RNA, 13 nt, Homo sapiens
ucuguugaucuca

SEQ ID NO: 521064 - RNA, 21 nt, Homo sapiens
ucuguuuccuggucagcaugu

SEQ ID NO: 521065 - RNA, 18 nt, Homo sapiens
ucuuacaguguuuggaca

SEQ ID NO: 521066 - RNA, 15 nt, Homo sapiens
ucuuacauugccaag

SEQ ID NO: 521067 - RNA, 20 nt, Homo sapiens
ucuuagaagcacuacaccuu

SEQ ID NO: 521068 - RNA, 19 nt, Homo sapiens
ucuuagagcaaagagccag

SEQ ID NO: 521069 - RNA, 17 nt, Homo sapiens
ucuuaugauuacuauca

SEQ ID NO: 521070 - RNA, 22 nt, Homo sapiens
ucuuaugauuacuaucauggca

SEQ ID NO: 521071 - RNA, 19 nt, Homo sapiens
ucuucaauaugaaucuaua

SEQ ID NO: 521072 - RNA, 16 nt, Homo sapiens
ucuucacucuuugaag

SEQ ID NO: 521073 - RNA, 15 nt, Homo sapiens
ucuucacugugguca

SEQ ID NO: 521074 - RNA, 21 nt, Homo sapiens
ucuucacuguggucauccugc

SEQ ID NO: 521075 - RNA, 12 nt, Homo sapiens
ucuucagugaau

SEQ ID NO: 521076 - RNA, 14 nt, Homo sapiens
ucuucaugcuugac

SEQ ID NO: 521077 - RNA, 20 nt, Homo sapiens
ucuucaugcuuuugcuugca

SEQ ID NO: 521078 - RNA, 19 nt, Homo sapiens
ucuuccacaaaaaauacuu

SEQ ID NO: 521079 - RNA, 15 nt, Homo sapiens
ucuucccagcaauua

SEQ ID NO: 521080 - RNA, 21 nt, Homo sapiens
ucuucugcaagccucaugcca

SEQ ID NO: 521081 - RNA, 16 nt, Homo sapiens
ucuucugguguugacu

SEQ ID NO: 521082 - RNA, 17 nt, Homo sapiens
ucuucuuacuggugcua

SEQ ID NO: 521083 - RNA, 21 nt, Homo sapiens
ucuucuuggggcccagugcau

SEQ ID NO: 521084 - RNA, 12 nt, Homo sapiens
ucuuguggucau

SEQ ID NO: 521085 - RNA, 18 nt, Homo sapiens
ucuuuaaaggcaucuaca

SEQ ID NO: 521086 - RNA, 12 nt, Homo sapiens
ucuuuauacugg

SEQ ID NO: 521087 - RNA, 16 nt, Homo sapiens
ucuuuaucauugcuaa

SEQ ID NO: 521088 - RNA, 15 nt, Homo sapiens
ucuuugcugcaguca

SEQ ID NO: 521089 - RNA, 18 nt, Homo sapiens
ucuuuguuacuuccuuau

SEQ ID NO: 521090 - RNA, 15 nt, Homo sapiens
ucuuuuauccuggga

SEQ ID NO: 521091 - RNA, 23 nt, Homo sapiens
ugaaaacauguacuacagcuaua

SEQ ID NO: 521092 - RNA, 22 nt, Homo sapiens
ugaaaacugugcaauguauuaa

SEQ ID NO: 521093 - RNA, 20 nt, Homo sapiens
ugaaaaggguacagaugugc

SEQ ID NO: 521094 - RNA, 16 nt, Homo sapiens
ugaaaauaagauucca

SEQ ID NO: 521095 - RNA, 19 nt, Homo sapiens
ugaaaauauuuuguugccu

SEQ ID NO: 521096 - RNA, 20 nt, Homo sapiens
ugaaaauauuuuguugccuu

SEQ ID NO: 521097 - RNA, 12 nt, Homo sapiens
uggcucaugccu

SEQ ID NO: 521098 - RNA, 20 nt, Homo sapiens
uggcucaugccuguaauccc

SEQ ID NO: 521099 - RNA, 20 nt, Homo sapiens
uggcugcugucauaacaucc

SEQ ID NO: 521100 - RNA, 22 nt, Homo sapiens
uggcuguggagagggucaagga

SEQ ID NO: 521101 - RNA, 15 nt, Homo sapiens
ugggaccgugcccac

SEQ ID NO: 521102 - RNA, 15 nt, Homo sapiens
ugggagcuuauugcu

SEQ ID NO: 521103 - RNA, 12 nt, Homo sapiens
ugggaguacuga

SEQ ID NO: 521104 - RNA, 23 nt, Homo sapiens
ugggauauccuuucacucugcau

SEQ ID NO: 521105 - RNA, 17 nt, Homo sapiens
ugggauuauucuuugaa

SEQ ID NO: 521106 - RNA, 17 nt, Homo sapiens
ugggcagucuuucuuga

SEQ ID NO: 521107 - RNA, 17 nt, Homo sapiens
ugggccauuaaaaacua

SEQ ID NO: 521108 - RNA, 20 nt, Homo sapiens
ugggccuugcaagaugggag

SEQ ID NO: 521109 - RNA, 13 nt, Homo sapiens
ugggcuggggccu

SEQ ID NO: 521110 - RNA, 15 nt, Homo sapiens
uggggaauauacgug

SEQ ID NO: 521111 - RNA, 16 nt, Homo sapiens
uggggaggagggggcc

SEQ ID NO: 521112 - RNA, 13 nt, Homo sapiens
uggggauugcaga

SEQ ID NO: 521113 - RNA, 19 nt, Homo sapiens
uggggcaggcugggccaug

SEQ ID NO: 521114 - RNA, 13 nt, Homo sapiens
uggggcccagugc

SEQ ID NO: 521115 - RNA, 15 nt, Homo sapiens
uggggcccagugcau

SEQ ID NO: 521116 - RNA, 16 nt, Homo sapiens
uggggccuguggaaug

SEQ ID NO: 521117 - RNA, 15 nt, Homo sapiens
ugggguaacaucugu

SEQ ID NO: 521118 - RNA, 19 nt, Homo sapiens
uggguacugaaagccuuag

SEQ ID NO: 521119 - RNA, 21 nt, Homo sapiens
uggguacugaaagccuuaggg

SEQ ID NO: 521120 - RNA, 22 nt, Homo sapiens
ugggucaaagugcggcugccau

SEQ ID NO: 521121 - RNA, 15 nt, Homo sapiens
uggguccaucagaga

SEQ ID NO: 521122 - RNA, 21 nt, Homo sapiens
ugguaaaaguauuugcuuaaa

SEQ ID NO: 521123 - RNA, 20 nt, Homo sapiens
ugguacuccacauauuucag

SEQ ID NO: 521124 - RNA, 16 nt, Homo sapiens
uggucaaucaguguua

SEQ ID NO: 521125 - RNA, 21 nt, Homo sapiens
uggucagcugccccaauguga

SEQ ID NO: 521126 - RNA, 14 nt, Homo sapiens
ugguccccacugcu

SEQ ID NO: 521127 - RNA, 14 nt, Homo sapiens
ugguccuugaacaa

SEQ ID NO: 521128 - RNA, 21 nt, Homo sapiens
uggugaaguaaauuaggcagu

SEQ ID NO: 521129 - RNA, 14 nt, Homo sapiens
uggugaaugacacg

SEQ ID NO: 521130 - RNA, 17 nt, Homo sapiens
uggugcgcccugucucu

SEQ ID NO: 521131 - RNA, 22 nt, Homo sapiens
uggugcucuuugcugcacuauu

SEQ ID NO: 521132 - RNA, 14 nt, Homo sapiens
uggugcuggaacca

SEQ ID NO: 521133 - RNA, 20 nt, Homo sapiens
uggugcuggaaccagcucuc

SEQ ID NO: 521134 - RNA, 19 nt, Homo sapiens
ugguggccagccagaucaa

SEQ ID NO: 521135 - RNA, 12 nt, Homo sapiens
ugguucuuucau

SEQ ID NO: 521136 - RNA, 17 nt, Homo sapiens
ugguuucccaucuccau

SEQ ID NO: 521137 - RNA, 18 nt, Homo sapiens
augucuguagcuccucaa

SEQ ID NO: 521138 - RNA, 11 nt, Homo sapiens
augugaagggu

SEQ ID NO: 521139 - RNA, 19 nt, Homo sapiens
augugagcucuuccuaucc

SEQ ID NO: 521140 - RNA, 21 nt, Homo sapiens
augugagcucuuccuaucccu

SEQ ID NO: 521141 - RNA, 21 nt, Homo sapiens
augugccccagcaggcaugga

SEQ ID NO: 521142 - RNA, 10 nt, Homo sapiens
augugccuuu

SEQ ID NO: 521143 - RNA, 20 nt, Homo sapiens
augugccuuucuuugccucu

SEQ ID NO: 521144 - RNA, 13 nt, Homo sapiens
auguguaaagauu

SEQ ID NO: 521145 - RNA, 20 nt, Homo sapiens
augugugguggccucagcug

SEQ ID NO: 521146 - RNA, 19 nt, Homo sapiens
auguguucaggcauuccag

SEQ ID NO: 521147 - RNA, 23 nt, Homo sapiens
auguuaauugggcaggugaaaag

SEQ ID NO: 521148 - RNA, 14 nt, Homo sapiens
auguuauaucauau

SEQ ID NO: 521149 - RNA, 21 nt, Homo sapiens
auguuguguuuuuaacauguc

SEQ ID NO: 521150 - RNA, 18 nt, Homo sapiens
auguuuaauaaagcuuua

SEQ ID NO: 521151 - RNA, 14 nt, Homo sapiens
auguuucacagugg

SEQ ID NO: 521152 - RNA, 15 nt, Homo sapiens
auguuucuacagaua

SEQ ID NO: 521153 - RNA, 15 nt, Homo sapiens
auguuugcaaacuug

SEQ ID NO: 521154 - RNA, 17 nt, Homo sapiens
auguuuugggaaacacu

SEQ ID NO: 521155 - RNA, 14 nt, Homo sapiens
auuaaauccaauaa

SEQ ID NO: 521156 - RNA, 18 nt, Homo sapiens
auuaagacuuuauguagu

SEQ ID NO: 521157 - RNA, 13 nt, Homo sapiens
auuaauguuaaca

SEQ ID NO: 521158 - RNA, 20 nt, Homo sapiens
auuacaauguguaauggaaa

SEQ ID NO: 521159 - RNA, 21 nt, Homo sapiens
auuacaggcgugauccaccac

SEQ ID NO: 521160 - RNA, 17 nt, Homo sapiens
auuacauggaacuuuuc

SEQ ID NO: 521161 - RNA, 11 nt, Homo sapiens
auuacugugag

SEQ ID NO: 521162 - RNA, 14 nt, Homo sapiens
auuagccaggcgug

SEQ ID NO: 521163 - RNA, 19 nt, Homo sapiens
auuagccauuucacucuca

SEQ ID NO: 521164 - RNA, 20 nt, Homo sapiens
auuagccauuucacucucaa

SEQ ID NO: 521165 - RNA, 15 nt, Homo sapiens
auuauucaaaaacau

SEQ ID NO: 521166 - RNA, 17 nt, Homo sapiens
auuauuuucuucaucca

SEQ ID NO: 521167 - RNA, 16 nt, Homo sapiens
auucaacucuccaaug

SEQ ID NO: 521168 - RNA, 21 nt, Homo sapiens
auucaaggagaauaugauaaa

SEQ ID NO: 521169 - RNA, 21 nt, Homo sapiens
auucaauuaguggucauaaaa

SEQ ID NO: 521170 - RNA, 18 nt, Homo sapiens
auucauaggaagguguuu

SEQ ID NO: 521171 - RNA, 14 nt, Homo sapiens
auuccaacuucaau

SEQ ID NO: 521172 - RNA, 16 nt, Homo sapiens
auuccagaucuuucag

SEQ ID NO: 521173 - RNA, 13 nt, Homo sapiens
auucccuccauuu

SEQ ID NO: 521174 - RNA, 20 nt, Homo sapiens
auuccuacugacaacauuau

SEQ ID NO: 521175 - RNA, 21 nt, Homo sapiens
auuccuugaggacagaccuua

SEQ ID NO: 521176 - RNA, 15 nt, Homo sapiens
auucucaucacucaa

SEQ ID NO: 521177 - RNA, 18 nt, Homo sapiens
auucucccaaaguaccuu

SEQ ID NO: 521178 - RNA, 21 nt, Homo sapiens
auucucccaaaguaccuugaa

SEQ ID NO: 521179 - RNA, 21 nt, Homo sapiens
auucugagccugauauugaua

SEQ ID NO: 521180 - RNA, 14 nt, Homo sapiens
auucugcuaccaau

SEQ ID NO: 521181 - RNA, 20 nt, Homo sapiens
auucuuaacagugguucaaa

SEQ ID NO: 521182 - RNA, 20 nt, Homo sapiens
auucuugccuuguaccucaa

SEQ ID NO: 521183 - RNA, 15 nt, Homo sapiens
auucuuuguuuccug

SEQ ID NO: 521184 - RNA, 18 nt, Homo sapiens
auucuuuuguuuccaugg

SEQ ID NO: 521185 - RNA, 15 nt, Homo sapiens
auugaggcccugcug

SEQ ID NO: 521186 - RNA, 15 nt, Homo sapiens
auugaguuuuuacaa

SEQ ID NO: 521187 - RNA, 22 nt, Homo sapiens
auugcagcuagaggcaucuucu

SEQ ID NO: 521188 - RNA, 14 nt, Homo sapiens
auugcauacuuugu

SEQ ID NO: 521189 - RNA, 22 nt, Homo sapiens
auugcccccucucacuuuagca

SEQ ID NO: 521190 - RNA, 14 nt, Homo sapiens
auugcugcaaagau

SEQ ID NO: 521191 - RNA, 17 nt, Homo sapiens
auuggaacugcaaugaa

SEQ ID NO: 521192 - RNA, 13 nt, Homo sapiens
auuggcacugugg

SEQ ID NO: 521193 - RNA, 17 nt, Homo sapiens
auugggaaaacauuugc

SEQ ID NO: 521194 - RNA, 13 nt, Homo sapiens
auuguagccucaa

SEQ ID NO: 521195 - RNA, 21 nt, Homo sapiens
auugucaggggaacagagaag

SEQ ID NO: 521196 - RNA, 21 nt, Homo sapiens
auugugaacaugauaguuaaa

SEQ ID NO: 521197 - RNA, 15 nt, Homo sapiens
auugugcaguacuuu

SEQ ID NO: 521198 - RNA, 13 nt, Homo sapiens
auuguuguugcca

SEQ ID NO: 521199 - RNA, 16 nt, Homo sapiens
auuguuguugccaaag

SEQ ID NO: 521200 - RNA, 21 nt, Homo sapiens
auuguuugguaaauguuucuu

SEQ ID NO: 521201 - RNA, 20 nt, Homo sapiens
auuuaacaugaacacccuua

SEQ ID NO: 521202 - RNA, 20 nt, Homo sapiens
auuuacauccagcuucucau

SEQ ID NO: 521203 - RNA, 13 nt, Homo sapiens
auuuagaaacuga

SEQ ID NO: 521204 - RNA, 22 nt, Homo sapiens
auuuagugaucaaauugugcag

SEQ ID NO: 521205 - RNA, 23 nt, Homo sapiens
auuuauauaaaauguuuaaucuc

SEQ ID NO: 521206 - RNA, 17 nt, Homo sapiens
auuuauaucacacaaua

SEQ ID NO: 521207 - RNA, 18 nt, Homo sapiens
auuuaucaugguccugaa

SEQ ID NO: 521208 - RNA, 21 nt, Homo sapiens
auuuaucaugguccugaaugu

SEQ ID NO: 521209 - RNA, 22 nt, Homo sapiens
auuuauggucuucaaccaaggc

SEQ ID NO: 521210 - RNA, 17 nt, Homo sapiens
ucaagaauagcauugua

SEQ ID NO: 521211 - RNA, 18 nt, Homo sapiens
ucaagccaucaaaccugg

SEQ ID NO: 521212 - RNA, 15 nt, Homo sapiens
ucaagcuccccucac

SEQ ID NO: 521213 - RNA, 15 nt, Homo sapiens
ucaaggaguacaaug

SEQ ID NO: 521214 - RNA, 23 nt, Homo sapiens
ucaaggaguacuccaagacagag

SEQ ID NO: 521215 - RNA, 21 nt, Homo sapiens
ucaagggaauguaacugcuga

SEQ ID NO: 521216 - RNA, 16 nt, Homo sapiens
ucaagguuuaaccuua

SEQ ID NO: 521217 - RNA, 19 nt, Homo sapiens
ucaauaaaguuuccugccu

SEQ ID NO: 521218 - RNA, 16 nt, Homo sapiens
ucaauaaaucuuucaa

SEQ ID NO: 521219 - RNA, 21 nt, Homo sapiens
ucaauacuuaaaaauagucuu

SEQ ID NO: 521220 - RNA, 17 nt, Homo sapiens
ucaaucuccuaaccuug

SEQ ID NO: 521221 - RNA, 18 nt, Homo sapiens
ucacaaaaucacuuuaag

SEQ ID NO: 521222 - RNA, 19 nt, Homo sapiens
ucacaaaugucauugucua

SEQ ID NO: 521223 - RNA, 15 nt, Homo sapiens
ucacaacagugaaaa

SEQ ID NO: 521224 - RNA, 12 nt, Homo sapiens
ucacacccugac

SEQ ID NO: 521225 - RNA, 16 nt, Homo sapiens
ucacagcuaguuugag

SEQ ID NO: 521226 - RNA, 18 nt, Homo sapiens
ucacaguacagcaugugc

SEQ ID NO: 521227 - RNA, 16 nt, Homo sapiens
ucacauguuuaacuuu

SEQ ID NO: 521228 - RNA, 15 nt, Homo sapiens
ucacauucuuuccaa

SEQ ID NO: 521229 - RNA, 17 nt, Homo sapiens
ucacauuggagucacug

SEQ ID NO: 521230 - RNA, 18 nt, Homo sapiens
ucaccggucagugccuuu

SEQ ID NO: 521231 - RNA, 23 nt, Homo sapiens
ucaccuccggucgugucucuggu

SEQ ID NO: 521232 - RNA, 23 nt, Homo sapiens
ucaccuuccaacacuccauuauu

SEQ ID NO: 521233 - RNA, 17 nt, Homo sapiens
ucacguaguucuagcag

SEQ ID NO: 521234 - RNA, 19 nt, Homo sapiens
ucacuaaugaucacauucu

SEQ ID NO: 521235 - RNA, 13 nt, Homo sapiens
ucacuauuaucua

SEQ ID NO: 521236 - RNA, 23 nt, Homo sapiens
ucacucuuugaagcgagcaguca

SEQ ID NO: 521237 - RNA, 13 nt, Homo sapiens
ucacuguggucau

SEQ ID NO: 521238 - RNA, 15 nt, Homo sapiens
ucacuguggucaucc

SEQ ID NO: 521239 - RNA, 21 nt, Homo sapiens
ucagaaaguaacaaucuaugg

SEQ ID NO: 521240 - RNA, 15 nt, Homo sapiens
ucagaauaaggcagg

SEQ ID NO: 521241 - RNA, 20 nt, Homo sapiens
cagaaagagacuccgucuca

SEQ ID NO: 521242 - RNA, 20 nt, Homo sapiens
cagaaaguaucacaaaugga

SEQ ID NO: 521243 - RNA, 15 nt, Homo sapiens
cagaacuugaagggu

SEQ ID NO: 521244 - RNA, 16 nt, Homo sapiens
cagaagggaauugcuc

SEQ ID NO: 521245 - RNA, 14 nt, Homo sapiens
cagaauaauucuua

SEQ ID NO: 521246 - RNA, 23 nt, Homo sapiens
cagacaacaguugcacagugccu

SEQ ID NO: 521247 - RNA, 15 nt, Homo sapiens
cagacacaacccaau

SEQ ID NO: 521248 - RNA, 13 nt, Homo sapiens
cagaccuccuagc

SEQ ID NO: 521249 - RNA, 20 nt, Homo sapiens
cagagaucguguauugagau

SEQ ID NO: 521250 - RNA, 14 nt, Homo sapiens
cagaggacacagag

SEQ ID NO: 521251 - RNA, 23 nt, Homo sapiens
cagaggaggggaaaguccagggc

SEQ ID NO: 521252 - RNA, 20 nt, Homo sapiens
cagaggauaucggcauuugu

SEQ ID NO: 521253 - RNA, 20 nt, Homo sapiens
cagaggccgcgcguccagcu

SEQ ID NO: 521254 - RNA, 21 nt, Homo sapiens
cagaggcgcccuggguggugg

SEQ ID NO: 521255 - RNA, 22 nt, Homo sapiens
cagaggcucagacucacuguua

SEQ ID NO: 521256 - RNA, 18 nt, Homo sapiens
cagaggcucuaauguaca

SEQ ID NO: 521257 - RNA, 19 nt, Homo sapiens
cagaggcucuaauguacaa

SEQ ID NO: 521258 - RNA, 22 nt, Homo sapiens
cagauacuuugaagugcagcuc

SEQ ID NO: 521259 - RNA, 14 nt, Homo sapiens
cagaucacuugagc

SEQ ID NO: 521260 - RNA, 12 nt, Homo sapiens
cagaucuuucag

SEQ ID NO: 521261 - RNA, 18 nt, Homo sapiens
cagauguuagaucagggg

SEQ ID NO: 521262 - RNA, 12 nt, Homo sapiens
cagauugcugca

SEQ ID NO: 521263 - RNA, 18 nt, Homo sapiens
cagauuuuuuccucugca

SEQ ID NO: 521264 - RNA, 18 nt, Homo sapiens
cagcaaccucuucaugag

SEQ ID NO: 521265 - RNA, 16 nt, Homo sapiens
cagcaaccugacucag

SEQ ID NO: 521266 - RNA, 13 nt, Homo sapiens
cagcaauuccuga

SEQ ID NO: 521267 - RNA, 22 nt, Homo sapiens
cagcaauucuccugccucagcc

SEQ ID NO: 521268 - RNA, 14 nt, Homo sapiens
cagcacaagcugcg

SEQ ID NO: 521269 - RNA, 20 nt, Homo sapiens
cagcacccugaugucccugg

SEQ ID NO: 521270 - RNA, 23 nt, Homo sapiens
cagcauauguguaaagauuuaua

SEQ ID NO: 521271 - RNA, 13 nt, Homo sapiens
cagcaugccugaa

SEQ ID NO: 521272 - RNA, 13 nt, Homo sapiens
cagccagggccag

SEQ ID NO: 521273 - RNA, 19 nt, Homo sapiens
cagccgugaucaagggaau

SEQ ID NO: 521274 - RNA, 19 nt, Homo sapiens
cagccucgcgggugucaca

SEQ ID NO: 521275 - RNA, 15 nt, Homo sapiens
cagcgggagcacugc

SEQ ID NO: 521276 - RNA, 15 nt, Homo sapiens
cagcuauauuugauu

SEQ ID NO: 521277 - RNA, 17 nt, Homo sapiens
cagcugccccaauguga

SEQ ID NO: 521278 - RNA, 19 nt, Homo sapiens
cagcugccucugcucccuc

SEQ ID NO: 521279 - RNA, 16 nt, Homo sapiens
cagcuuauaugugaca

SEQ ID NO: 521280 - RNA, 14 nt, Homo sapiens
cagcuucuccagga

SEQ ID NO: 521281 - RNA, 16 nt, Homo sapiens
cagcuuggcccuuucc

SEQ ID NO: 521282 - RNA, 18 nt, Homo sapiens
caggaauccccaacaugc

SEQ ID NO: 521283 - RNA, 19 nt, Homo sapiens
caggaauggcuugccuaag

SEQ ID NO: 521284 - RNA, 21 nt, Homo sapiens
caggaauuauuaggaguaauu

SEQ ID NO: 521285 - RNA, 14 nt, Homo sapiens
caggacuccuggca

SEQ ID NO: 521286 - RNA, 18 nt, Homo sapiens
caggagagucacuugaac

SEQ ID NO: 521287 - RNA, 22 nt, Homo sapiens
caggaggacauagccugcaaag

SEQ ID NO: 521288 - RNA, 16 nt, Homo sapiens
caggaggaucacuuga

SEQ ID NO: 521289 - RNA, 16 nt, Homo sapiens
caggaggucaagauca

SEQ ID NO: 521290 - RNA, 16 nt, Homo sapiens
caggaguaaaacuccc

SEQ ID NO: 521291 - RNA, 17 nt, Homo sapiens
caggauauccuuaucag

SEQ ID NO: 521292 - RNA, 19 nt, Homo sapiens
caggcacagguccccagau

SEQ ID NO: 521293 - RNA, 19 nt, Homo sapiens
caggcaccucuuccuugau

SEQ ID NO: 521294 - RNA, 14 nt, Homo sapiens
caggcacugcugca

SEQ ID NO: 521295 - RNA, 13 nt, Homo sapiens
caggccuggacuu

SEQ ID NO: 521296 - RNA, 22 nt, Homo sapiens
caggccuggacuuccagugcuc

SEQ ID NO: 521297 - RNA, 21 nt, Homo sapiens
caggcgcaguggcucaugccu

SEQ ID NO: 521298 - RNA, 17 nt, Homo sapiens
caggcugaaauauccac

SEQ ID NO: 521299 - RNA, 19 nt, Homo sapiens
caggcugggccauguccaa

SEQ ID NO: 521300 - RNA, 23 nt, Homo sapiens
caggcugggccauguccaaagag

SEQ ID NO: 521301 - RNA, 13 nt, Homo sapiens
caggcuucaucaa

SEQ ID NO: 521302 - RNA, 21 nt, Homo sapiens
cagggagacgguuuccaggga

SEQ ID NO: 521303 - RNA, 14 nt, Homo sapiens
cagggcccagugac

SEQ ID NO: 521304 - RNA, 14 nt, Homo sapiens
caggggacaaggga

SEQ ID NO: 521305 - RNA, 21 nt, Homo sapiens
caggggcugacucuccaggga

SEQ ID NO: 521306 - RNA, 16 nt, Homo sapiens
cagggucucucccuca

SEQ ID NO: 521307 - RNA, 12 nt, Homo sapiens
cagggugggccu

SEQ ID NO: 521308 - RNA, 21 nt, Homo sapiens
cagguaacagguguguaugua

SEQ ID NO: 521309 - RNA, 22 nt, Homo sapiens
caggucacuugaucaugcugca

SEQ ID NO: 521310 - RNA, 12 nt, Homo sapiens
caggugccugua

SEQ ID NO: 521311 - RNA, 20 nt, Homo sapiens
caguauccacaauagcugac

SEQ ID NO: 521312 - RNA, 20 nt, Homo sapiens
caguauuuucuccacuucau

SEQ ID NO: 521313 - RNA, 23 nt, Homo sapiens
cagucauagcaagcuuuugcuca

SEQ ID NO: 521314 - RNA, 15 nt, Homo sapiens
cagucccaugaccuu

SEQ ID NO: 521315 - RNA, 17 nt, Homo sapiens
caguccuguacucuggg

SEQ ID NO: 521316 - RNA, 16 nt, Homo sapiens
caguccuuaucugcuc

SEQ ID NO: 521317 - RNA, 19 nt, Homo sapiens
cagucucauugucaccucu

SEQ ID NO: 521318 - RNA, 16 nt, Homo sapiens
cagugccaacuccuca

SEQ ID NO: 521319 - RNA, 17 nt, Homo sapiens
cagugggggcagagcca

SEQ ID NO: 521320 - RNA, 15 nt, Homo sapiens
uugaaaugcuguuag

SEQ ID NO: 521321 - RNA, 19 nt, Homo sapiens
uugaagaggugaaaugggg

SEQ ID NO: 521322 - RNA, 17 nt, Homo sapiens
uugaauguggucucagg

SEQ ID NO: 521323 - RNA, 18 nt, Homo sapiens
uugacaaggcucugcuau

SEQ ID NO: 521324 - RNA, 20 nt, Homo sapiens
uugacaccacaccaucaggc

SEQ ID NO: 521325 - RNA, 19 nt, Homo sapiens
uugacauaccuaccaguau

SEQ ID NO: 521326 - RNA, 20 nt, Homo sapiens
uugaccacggacuccagucu

SEQ ID NO: 521327 - RNA, 18 nt, Homo sapiens
uugacuguuaguugucca

SEQ ID NO: 521328 - RNA, 21 nt, Homo sapiens
uugagauuauucuuuguuucc

SEQ ID NO: 521329 - RNA, 19 nt, Homo sapiens
uugagguucucuauauucg

SEQ ID NO: 521330 - RNA, 17 nt, Homo sapiens
uugagucuaacacacca

SEQ ID NO: 521331 - RNA, 14 nt, Homo sapiens
uugauaaucuucag

SEQ ID NO: 521332 - RNA, 19 nt, Homo sapiens
uugauagcaaacacugggg

SEQ ID NO: 521333 - RNA, 22 nt, Homo sapiens
uugauugggaaaacauuugcug

SEQ ID NO: 521334 - RNA, 10 nt, Homo sapiens
uugcaauacc

SEQ ID NO: 521335 - RNA, 21 nt, Homo sapiens
uugcaauaccaauguucuaaa

SEQ ID NO: 521336 - RNA, 12 nt, Homo sapiens
uugcacauuaau

SEQ ID NO: 521337 - RNA, 18 nt, Homo sapiens
uugcacauuaaucagauu

SEQ ID NO: 521338 - RNA, 20 nt, Homo sapiens
uugcacauuaaucagauuag

SEQ ID NO: 521339 - RNA, 23 nt, Homo sapiens
uugcaccaggcacugcugcacaa

SEQ ID NO: 521340 - RNA, 14 nt, Homo sapiens
uugcaggugacauu

SEQ ID NO: 521341 - RNA, 21 nt, Homo sapiens
uugcauauaguuaaacugaga

SEQ ID NO: 521342 - RNA, 14 nt, Homo sapiens
uugccaaaaacaaa

SEQ ID NO: 521343 - RNA, 18 nt, Homo sapiens
uugccaagaaaaugaagg

SEQ ID NO: 521344 - RNA, 17 nt, Homo sapiens
uugccaggacaugcaau

SEQ ID NO: 521345 - RNA, 19 nt, Homo sapiens
uugccauggugauggugua

SEQ ID NO: 521346 - RNA, 12 nt, Homo sapiens
uugccgcuguau

SEQ ID NO: 521347 - RNA, 19 nt, Homo sapiens
uugccuaagacuugcccaa

SEQ ID NO: 521348 - RNA, 23 nt, Homo sapiens
uugcucagugggggcagagccac

SEQ ID NO: 521349 - RNA, 13 nt, Homo sapiens
agauaagcaagag

SEQ ID NO: 521350 - RNA, 15 nt, Homo sapiens
agauacagccugcaa

SEQ ID NO: 521351 - RNA, 16 nt, Homo sapiens
agauaggaaacugaag

SEQ ID NO: 521352 - RNA, 22 nt, Homo sapiens
agauauuaauagauaauaugaa

SEQ ID NO: 521353 - RNA, 19 nt, Homo sapiens
agauauugugaaguacaua

SEQ ID NO: 521354 - RNA, 13 nt, Homo sapiens
agaucacuugagc

SEQ ID NO: 521355 - RNA, 15 nt, Homo sapiens
agauccggcagcaca

SEQ ID NO: 521356 - RNA, 17 nt, Homo sapiens
agauccggcagcacaag

SEQ ID NO: 521357 - RNA, 19 nt, Homo sapiens
agauccggcagcacaagcu

SEQ ID NO: 521358 - RNA, 20 nt, Homo sapiens
agauccggcagcacaagcug

SEQ ID NO: 521359 - RNA, 14 nt, Homo sapiens
agaucuacacaugu

SEQ ID NO: 521360 - RNA, 14 nt, Homo sapiens
agaucuaugggaag

SEQ ID NO: 521361 - RNA, 16 nt, Homo sapiens
agaucuccuggcaaag

SEQ ID NO: 521362 - RNA, 22 nt, Homo sapiens
agaugacagggaaaacugcaaa

SEQ ID NO: 521363 - RNA, 18 nt, Homo sapiens
agaugacggaugccuaga

SEQ ID NO: 521364 - RNA, 15 nt, Homo sapiens
agaugcucacuuuau

SEQ ID NO: 521365 - RNA, 22 nt, Homo sapiens
agauggaaaaacugaggcuuag

SEQ ID NO: 521366 - RNA, 16 nt, Homo sapiens
agauggggcacugacc

SEQ ID NO: 521367 - RNA, 17 nt, Homo sapiens
agauguugacucuaaag

SEQ ID NO: 521368 - RNA, 22 nt, Homo sapiens
agauuauuaucuauuaucucaa

SEQ ID NO: 521369 - RNA, 15 nt, Homo sapiens
agauucugaccuuaa

SEQ ID NO: 521370 - RNA, 20 nt, Homo sapiens
agauugacuaacucaaauac

SEQ ID NO: 521371 - RNA, 18 nt, Homo sapiens
agauuuugcaccuguaaa

SEQ ID NO: 521372 - RNA, 23 nt, Homo sapiens
agcaaauaagucaucugaugaga

SEQ ID NO: 521373 - RNA, 14 nt, Homo sapiens
agcaaauggccuca

SEQ ID NO: 521374 - RNA, 19 nt, Homo sapiens
agcaaauggccucauguca

SEQ ID NO: 521375 - RNA, 21 nt, Homo sapiens
agcaaauggccucaugucaaa

SEQ ID NO: 521376 - RNA, 20 nt, Homo sapiens
agcaaccuauauaaaccugg

SEQ ID NO: 521377 - RNA, 22 nt, Homo sapiens
agcaagcucuuuuauaugcuaa

SEQ ID NO: 521378 - RNA, 22 nt, Homo sapiens
agcaagcuuugguuuaugguuu

SEQ ID NO: 521379 - RNA, 20 nt, Homo sapiens
agcaaucugccuguaucucu

SEQ ID NO: 521380 - RNA, 17 nt, Homo sapiens
agcaauucuccugccuc

SEQ ID NO: 521381 - RNA, 14 nt, Homo sapiens
agcacauucgggac

SEQ ID NO: 521382 - RNA, 18 nt, Homo sapiens
agcacgauuuugcacaaa

SEQ ID NO: 521383 - RNA, 17 nt, Homo sapiens
agcacuacaccuugccu

SEQ ID NO: 521384 - RNA, 20 nt, Homo sapiens
agcagaagagaaaauguugu

SEQ ID NO: 521385 - RNA, 14 nt, Homo sapiens
agcagacucuggag

SEQ ID NO: 521386 - RNA, 18 nt, Homo sapiens
agcagcagaccuccuagc

SEQ ID NO: 521387 - RNA, 18 nt, Homo sapiens
agcagcucuugaaguaua

SEQ ID NO: 521388 - RNA, 15 nt, Homo sapiens
agcaggaguggugca

SEQ ID NO: 521389 - RNA, 19 nt, Homo sapiens
agcaggcagcgccaagugc

SEQ ID NO: 521390 - RNA, 22 nt, Homo sapiens
agcaggcagcuucuacuccugc

SEQ ID NO: 521391 - RNA, 13 nt, Homo sapiens
agcagucuugcuc

SEQ ID NO: 521392 - RNA, 21 nt, Homo sapiens
agcaguuguaccaagugaaau

SEQ ID NO: 521393 - RNA, 22 nt, Homo sapiens
agcaguuuaugagacagcugag

SEQ ID NO: 521394 - RNA, 17 nt, Homo sapiens
agcauauauacuugcaa

SEQ ID NO: 521395 - RNA, 22 nt, Homo sapiens
agcauaugggugggauuuugca

SEQ ID NO: 521396 - RNA, 15 nt, Homo sapiens
agcaugccugaacua

SEQ ID NO: 521397 - RNA, 17 nt, Homo sapiens
agcauguuucacagugg

SEQ ID NO: 521398 - RNA, 23 nt, Homo sapiens
agcauuacccuccucucucccca

SEQ ID NO: 521399 - RNA, 23 nt, Homo sapiens
agcauuuugaaacaaaguacucu

SEQ ID NO: 521400 - RNA, 19 nt, Homo sapiens
agccaaagcuuaugugaca

SEQ ID NO: 521401 - RNA, 15 nt, Homo sapiens
agccaagagugcacu

SEQ ID NO: 521402 - RNA, 18 nt, Homo sapiens
agccagaggcucuaaugu

SEQ ID NO: 521403 - RNA, 18 nt, Homo sapiens
agccauucauguauguca

SEQ ID NO: 521404 - RNA, 15 nt, Homo sapiens
agccauuggcacugu

SEQ ID NO: 521405 - RNA, 16 nt, Homo sapiens
agccauuggcacugug

SEQ ID NO: 521406 - RNA, 17 nt, Homo sapiens
agccauuucacucucaa

SEQ ID NO: 521407 - RNA, 22 nt, Homo sapiens
agcccagcuuggcccuuuccuu

SEQ ID NO: 521408 - RNA, 20 nt, Homo sapiens
agcccauggcccccaauaaa

SEQ ID NO: 521409 - RNA, 18 nt, Homo sapiens
agcccugcuuagcucauc

SEQ ID NO: 521410 - RNA, 15 nt, Homo sapiens
agccgagaucaugcc

SEQ ID NO: 521411 - RNA, 16 nt, Homo sapiens
agccgagaucaugcca

SEQ ID NO: 521412 - RNA, 16 nt, Homo sapiens
agccggcuugauuucc

SEQ ID NO: 521413 - RNA, 12 nt, Homo sapiens
agccuaacacgg

SEQ ID NO: 521414 - RNA, 15 nt, Homo sapiens
agccuggacugcuac

SEQ ID NO: 521415 - RNA, 14 nt, Homo sapiens
agccugggggacag

SEQ ID NO: 521416 - RNA, 20 nt, Homo sapiens
agccugguucagacacagcu

SEQ ID NO: 521417 - RNA, 14 nt, Homo sapiens
agccuuuugcucuc

SEQ ID NO: 521418 - RNA, 13 nt, Homo sapiens
agcgagacccugu

SEQ ID NO: 521419 - RNA, 21 nt, Homo sapiens
agcgcagggcuggcacgugac

SEQ ID NO: 521420 - RNA, 22 nt, Homo sapiens
acaguggacaaaguuaccagug

SEQ ID NO: 521421 - RNA, 15 nt, Homo sapiens
acaguguuuggacag

SEQ ID NO: 521422 - RNA, 21 nt, Homo sapiens
acaguuauugcaagaguuuaa

SEQ ID NO: 521423 - RNA, 17 nt, Homo sapiens
acaguucugggcaaaga

SEQ ID NO: 521424 - RNA, 22 nt, Homo sapiens
acauaauuucagugggaaauau

SEQ ID NO: 521425 - RNA, 13 nt, Homo sapiens
acauacauucccu

SEQ ID NO: 521426 - RNA, 16 nt, Homo sapiens
acauacauuucucaua

SEQ ID NO: 521427 - RNA, 17 nt, Homo sapiens
acauagaaaacaaucaa

SEQ ID NO: 521428 - RNA, 19 nt, Homo sapiens
acauagccugcaaagcugg

SEQ ID NO: 521429 - RNA, 17 nt, Homo sapiens
acaucggccuccaugac

SEQ ID NO: 521430 - RNA, 12 nt, Homo sapiens
acaucugcaaua

SEQ ID NO: 521431 - RNA, 16 nt, Homo sapiens
acaucuggcugcacag

SEQ ID NO: 521432 - RNA, 20 nt, Homo sapiens
acaucuggcugcacaggcug

SEQ ID NO: 521433 - RNA, 16 nt, Homo sapiens
acaugucaaucugucc

SEQ ID NO: 521434 - RNA, 17 nt, Homo sapiens
acaugucuugacuguua

SEQ ID NO: 521435 - RNA, 16 nt, Homo sapiens
acauuaaggaauuuga

SEQ ID NO: 521436 - RNA, 17 nt, Homo sapiens
acauuaaggaauuugau

SEQ ID NO: 521437 - RNA, 20 nt, Homo sapiens
acauuauuucuaguccaaaa

SEQ ID NO: 521438 - RNA, 18 nt, Homo sapiens
acauuuauauagacuguu

SEQ ID NO: 521439 - RNA, 20 nt, Homo sapiens
acauuugacaaaacuaaccu

SEQ ID NO: 521440 - RNA, 14 nt, Homo sapiens
acauuuucauugau

SEQ ID NO: 521441 - RNA, 16 nt, Homo sapiens
acauuuucauugauga

SEQ ID NO: 521442 - RNA, 23 nt, Homo sapiens
acauuuuuuuuaacuacuauauu

SEQ ID NO: 521443 - RNA, 16 nt, Homo sapiens
accaaaaccacagugc

SEQ ID NO: 521444 - RNA, 14 nt, Homo sapiens
accaaauaccucaa

SEQ ID NO: 521445 - RNA, 17 nt, Homo sapiens
accaacuacuaccugua

SEQ ID NO: 521446 - RNA, 19 nt, Homo sapiens
accaagaaagcucacugua

SEQ ID NO: 521447 - RNA, 17 nt, Homo sapiens
accaaguaccaguauaa

SEQ ID NO: 521448 - RNA, 18 nt, Homo sapiens
accaaguugauacuugaa

SEQ ID NO: 521449 - RNA, 21 nt, Homo sapiens
accaaguugauacuugaauaa

SEQ ID NO: 521450 - RNA, 19 nt, Homo sapiens
accaauguaacacuggcca

SEQ ID NO: 521451 - RNA, 21 nt, Homo sapiens
accacagucuucccagcaauu

SEQ ID NO: 521452 - RNA, 19 nt, Homo sapiens
accacauguguuucugucu

SEQ ID NO: 521453 - RNA, 21 nt, Homo sapiens
accaccaccucuaaugccucu

SEQ ID NO: 521454 - RNA, 12 nt, Homo sapiens
accacucaggcc

SEQ ID NO: 521455 - RNA, 21 nt, Homo sapiens
accaggcagugugccaguuua

SEQ ID NO: 521456 - RNA, 23 nt, Homo sapiens
accaggggaggccugaggcuuca

SEQ ID NO: 521457 - RNA, 20 nt, Homo sapiens
accagggguccuaaccacua

SEQ ID NO: 521458 - RNA, 19 nt, Homo sapiens
accagguaguuuguugcau

SEQ ID NO: 521459 - RNA, 11 nt, Homo sapiens
accaugaaguc

SEQ ID NO: 521460 - RNA, 12 nt, Homo sapiens
accaugaaguca

SEQ ID NO: 521461 - RNA, 18 nt, Homo sapiens
accaugccuuccucagua

SEQ ID NO: 521462 - RNA, 16 nt, Homo sapiens
accauuccaacuucaa

SEQ ID NO: 521463 - RNA, 23 nt, Homo sapiens
accauuuaauggggaggacaaaa

SEQ ID NO: 521464 - RNA, 23 nt, Homo sapiens
accauuugauagggaacugggga

SEQ ID NO: 521465 - RNA, 23 nt, Homo sapiens
acccacuguccgcgguggacucu

SEQ ID NO: 521466 - RNA, 12 nt, Homo sapiens
acccagucccac

SEQ ID NO: 521467 - RNA, 16 nt, Homo sapiens
acccagucccacacug

SEQ ID NO: 521468 - RNA, 9 nt, Homo sapiens
acccagugc

SEQ ID NO: 521469 - RNA, 11 nt, Homo sapiens
acccagugcag

SEQ ID NO: 521470 - RNA, 13 nt, Homo sapiens
acccagugcagaa

SEQ ID NO: 521471 - RNA, 19 nt, Homo sapiens
acccaugcaagcagaggac

SEQ ID NO: 521472 - RNA, 17 nt, Homo sapiens
acccauucagagacugu

SEQ ID NO: 521473 - RNA, 15 nt, Homo sapiens
accccaacacuucca

SEQ ID NO: 521474 - RNA, 20 nt, Homo sapiens
acccccagguggaaggcaga

SEQ ID NO: 521475 - RNA, 16 nt, Homo sapiens
acccccaucucuacua

SEQ ID NO: 521476 - RNA, 16 nt, Homo sapiens
accccuaggaacucag

SEQ ID NO: 521477 - RNA, 17 nt, Homo sapiens
accccuguuucuggcac

SEQ ID NO: 521478 - RNA, 14 nt, Homo sapiens
acccguuugcuaca

SEQ ID NO: 521479 - RNA, 23 nt, Homo sapiens
acccuccguuuuucuacuagaua

SEQ ID NO: 521480 - RNA, 21 nt, Homo sapiens
acccugcgcaugaaccuggac

SEQ ID NO: 521481 - RNA, 20 nt, Homo sapiens
acccugcugcuggugcacag

SEQ ID NO: 521482 - RNA, 16 nt, Homo sapiens
accguacaucugcaau

SEQ ID NO: 521483 - RNA, 22 nt, Homo sapiens
accguccucgagcaacugcugu

SEQ ID NO: 521484 - RNA, 21 nt, Homo sapiens
accuaauguuuaugagccaga

SEQ ID NO: 521485 - RNA, 21 nt, Homo sapiens
accuacccuccacaggcacag

SEQ ID NO: 521486 - RNA, 19 nt, Homo sapiens
accucagccucccaaagug

SEQ ID NO: 521487 - RNA, 21 nt, Homo sapiens
accucaguucccucuugcuca

SEQ ID NO: 521488 - RNA, 16 nt, Homo sapiens
accucauccaggcuac

SEQ ID NO: 521489 - RNA, 18 nt, Homo sapiens
accuccagugucaggguc

SEQ ID NO: 521490 - RNA, 16 nt, Homo sapiens
accucccgaagccacc

SEQ ID NO: 521491 - RNA, 20 nt, Homo sapiens
accucuccugcccugugaua

SEQ ID NO: 521492 - RNA, 13 nt, Homo sapiens
accugcacugucc

SEQ ID NO: 521493 - RNA, 13 nt, Homo sapiens
accugccaugcca

SEQ ID NO: 521494 - RNA, 17 nt, Homo sapiens
accugcccaaggaugcu

SEQ ID NO: 521495 - RNA, 20 nt, Homo sapiens
aauagcauuguaaaagcauu

SEQ ID NO: 521496 - RNA, 13 nt, Homo sapiens
aauagucaauuuc

SEQ ID NO: 521497 - RNA, 18 nt, Homo sapiens
aauagugaauaaagucau

SEQ ID NO: 521498 - RNA, 20 nt, Homo sapiens
aauauauauggucauauaca

SEQ ID NO: 521499 - RNA, 17 nt, Homo sapiens
aauauauuccugagauu

SEQ ID NO: 521500 - RNA, 20 nt, Homo sapiens
aauaucaaauaaaauaucau

SEQ ID NO: 521501 - RNA, 12 nt, Homo sapiens
aauaucuaaaaa

SEQ ID NO: 521502 - RNA, 20 nt, Homo sapiens
aauaugccuaguuucuuaca

SEQ ID NO: 521503 - RNA, 23 nt, Homo sapiens
aauaugguuacguugguuaaaua

SEQ ID NO: 521504 - RNA, 22 nt, Homo sapiens
aauauguaauuucaaaauacau

SEQ ID NO: 521505 - RNA, 12 nt, Homo sapiens
aauaugugaaug

SEQ ID NO: 521506 - RNA, 14 nt, Homo sapiens
aaucaccucucugu

SEQ ID NO: 521507 - RNA, 16 nt, Homo sapiens
aaucagcaaccugacu

SEQ ID NO: 521508 - RNA, 18 nt, Homo sapiens
aaucauccaagacaguua

SEQ ID NO: 521509 - RNA, 23 nt, Homo sapiens
aaucauugauugucagcuacuaa

SEQ ID NO: 521510 - RNA, 24 nt, Homo sapiens
aauccaguauuauccacaauuauu

SEQ ID NO: 521511 - RNA, 20 nt, Homo sapiens
aaucccuccccgugacugca

SEQ ID NO: 521512 - RNA, 17 nt, Homo sapiens
aaucccuggcaaaggga

SEQ ID NO: 521513 - RNA, 13 nt, Homo sapiens
aauccugccauuu

SEQ ID NO: 521514 - RNA, 21 nt, Homo sapiens
aauccugcucacaaaaucacu

SEQ ID NO: 521515 - RNA, 15 nt, Homo sapiens
aauccuuuuccuuau

SEQ ID NO: 521516 - RNA, 11 nt, Homo sapiens
aaucucuucau

SEQ ID NO: 521517 - RNA, 17 nt, Homo sapiens
aaucucuucaugcuuga

SEQ ID NO: 521518 - RNA, 21 nt, Homo sapiens
aaucugaauaaauaauucuuc

SEQ ID NO: 521519 - RNA, 19 nt, Homo sapiens
aaucugccuguaucucuca

SEQ ID NO: 521520 - RNA, 15 nt, Homo sapiens
aaucuucuacuuuaa

SEQ ID NO: 521521 - RNA, 17 nt, Homo sapiens
aaugaagccuuagccag

SEQ ID NO: 521522 - RNA, 17 nt, Homo sapiens
aaugacugugucugccu

SEQ ID NO: 521523 - RNA, 17 nt, Homo sapiens
aaugacuucuaauuuau

SEQ ID NO: 521524 - RNA, 19 nt, Homo sapiens
aaugagcucugaaaucuuc

SEQ ID NO: 521525 - RNA, 22 nt, Homo sapiens
aaugcacguuucaaagcuuucc

SEQ ID NO: 521526 - RNA, 17 nt, Homo sapiens
aaugcuucuagaguuuu

SEQ ID NO: 521527 - RNA, 20 nt, Homo sapiens
aaugcuucuguugaucucag

SEQ ID NO: 521528 - RNA, 14 nt, Homo sapiens
aaugggacugugag

SEQ ID NO: 521529 - RNA, 13 nt, Homo sapiens
aauguaacugcug

SEQ ID NO: 521530 - RNA, 17 nt, Homo sapiens
aauguacaauaaagcaa

SEQ ID NO: 521531 - RNA, 14 nt, Homo sapiens
aaugucucauguca

SEQ ID NO: 521532 - RNA, 18 nt, Homo sapiens
aauguuagucauuguuau

SEQ ID NO: 521533 - RNA, 20 nt, Homo sapiens
aauguucuaaaguuuugcaa

SEQ ID NO: 521534 - RNA, 15 nt, Homo sapiens
aauguuucuacagau

SEQ ID NO: 521535 - RNA, 16 nt, Homo sapiens
aauuaagauuauguga

SEQ ID NO: 521536 - RNA, 16 nt, Homo sapiens
aauuaggcagugcuaa

SEQ ID NO: 521537 - RNA, 19 nt, Homo sapiens
aauuauuacaauucuugaa

SEQ ID NO: 521538 - RNA, 13 nt, Homo sapiens
aauucaacuuugu

SEQ ID NO: 521539 - RNA, 14 nt, Homo sapiens
aauucaaguuacca

SEQ ID NO: 521540 - RNA, 17 nt, Homo sapiens
aauucaaguuaccaaug

SEQ ID NO: 521541 - RNA, 22 nt, Homo sapiens
aauucagacaagcugcauuuca

SEQ ID NO: 521542 - RNA, 16 nt, Homo sapiens
aauuccuguacugugu

SEQ ID NO: 521543 - RNA, 22 nt, Homo sapiens
aauucuaaaauacaaacccaug

SEQ ID NO: 521544 - RNA, 19 nt, Homo sapiens
aauucuaugccugucuuaa

SEQ ID NO: 521545 - RNA, 22 nt, Homo sapiens
aauucugcagaguuuccaaaac

SEQ ID NO: 521546 - RNA, 19 nt, Homo sapiens
aauucuggcaggaccucac

SEQ ID NO: 521547 - RNA, 21 nt, Homo sapiens
aauucuuauaacucaacauuu

SEQ ID NO: 521548 - RNA, 18 nt, Homo sapiens
aauucuuuccccaaagac

SEQ ID NO: 521549 - RNA, 22 nt, Homo sapiens
aauugaagaaagucagcucuug

SEQ ID NO: 521550 - RNA, 15 nt, Homo sapiens
aauugcauacuuugu

SEQ ID NO: 521551 - RNA, 19 nt, Homo sapiens
aauuguacaaaauuaagca

SEQ ID NO: 521552 - RNA, 13 nt, Homo sapiens
aauugugacauaa

SEQ ID NO: 521553 - RNA, 21 nt, Homo sapiens
aauugugagcgaauuagcaau

SEQ ID NO: 521554 - RNA, 19 nt, Homo sapiens
aauuuauaagcauugccau

SEQ ID NO: 521555 - RNA, 22 nt, Homo sapiens
aauuuauauucauaaaguuaca

SEQ ID NO: 521556 - RNA, 16 nt, Homo sapiens
aauuugagccauuuaa

SEQ ID NO: 521557 - RNA, 18 nt, Homo sapiens
aauuuguaaaacuucugc

SEQ ID NO: 521558 - RNA, 15 nt, Homo sapiens
aauuuuacuuaucau

SEQ ID NO: 521559 - RNA, 22 nt, Homo sapiens
aauuuucagcugcaaggauuca

SEQ ID NO: 521560 - RNA, 14 nt, Homo sapiens
aauuuuuaggcaaa

SEQ ID NO: 521561 - RNA, 18 nt, Homo sapiens
acaaaaaauagcuuucaa

SEQ ID NO: 521562 - RNA, 13 nt, Homo sapiens
acaaaauuaagca

SEQ ID NO: 521563 - RNA, 12 nt, Homo sapiens
acaaaauuacuu

SEQ ID NO: 521564 - RNA, 22 nt, Homo sapiens
acaaauauggggaaaaaacugu

SEQ ID NO: 521565 - RNA, 13 nt, Homo sapiens
acaaaugcaguau

SEQ ID NO: 521566 - RNA, 23 nt, Homo sapiens
acaacaguugcacagugccucaa

SEQ ID NO: 521567 - RNA, 17 nt, Homo sapiens
acaacauuauaacugua

SEQ ID NO: 521568 - RNA, 17 nt, Homo sapiens
acaagagaucuacacau

SEQ ID NO: 521569 - RNA, 21 nt, Homo sapiens
acaagagaucuacacauguug

SEQ ID NO: 521570 - RNA, 15 nt, Homo sapiens
acaagcugcauuuca

SEQ ID NO: 521571 - RNA, 17 nt, Homo sapiens
acaaggcccugagcuuu

SEQ ID NO: 521572 - RNA, 13 nt, Homo sapiens
acaaggugccugu

SEQ ID NO: 521573 - RNA, 14 nt, Homo sapiens
acaaggugccuguu

SEQ ID NO: 521574 - RNA, 16 nt, Homo sapiens
acaauaaagcaaugug

SEQ ID NO: 521575 - RNA, 13 nt, Homo sapiens
acaauacaguauu

SEQ ID NO: 521576 - RNA, 14 nt, Homo sapiens
acaauacaguauua

SEQ ID NO: 521577 - RNA, 21 nt, Homo sapiens
acaauauuccagaucuuucag

SEQ ID NO: 521578 - RNA, 22 nt, Homo sapiens
acaaucaaaucuccugcugauu

SEQ ID NO: 521579 - RNA, 23 nt, Homo sapiens
acaaucaacucuaauagugcuua

SEQ ID NO: 521580 - RNA, 15 nt, Homo sapiens
acaaucagcagucua

SEQ ID NO: 521581 - RNA, 12 nt, Homo sapiens
acaaugauccag

SEQ ID NO: 521582 - RNA, 13 nt, Homo sapiens
acaaugugcugga

SEQ ID NO: 521583 - RNA, 17 nt, Homo sapiens
acacaaaccacaccaca

SEQ ID NO: 521584 - RNA, 16 nt, Homo sapiens
acacaauacaguauua

SEQ ID NO: 521585 - RNA, 15 nt, Homo sapiens
acacacaaagcacau

SEQ ID NO: 521586 - RNA, 9 nt, Homo sapiens
acacacugu

SEQ ID NO: 521587 - RNA, 23 nt, Homo sapiens
acacaucucccuuuuccaugacu

SEQ ID NO: 521588 - RNA, 19 nt, Homo sapiens
acaccaaguaccaguauaa

SEQ ID NO: 521589 - RNA, 16 nt, Homo sapiens
acaccacaccaucagg

SEQ ID NO: 521590 - RNA, 13 nt, Homo sapiens
acaccaccaacau

SEQ ID NO: 521591 - RNA, 19 nt, Homo sapiens
acaccacuuucugcuuucc

SEQ ID NO: 521592 - RNA, 15 nt, Homo sapiens
acaccccaacacuuc

SEQ ID NO: 521593 - RNA, 20 nt, Homo sapiens
acaccuggcccuugcaaucu

SEQ ID NO: 521594 - RNA, 22 nt, Homo sapiens
acacuaucauggacuacaccag

SEQ ID NO: 521595 - RNA, 21 nt, Homo sapiens
acacugaucuuauguguuaca

SEQ ID NO: 521596 - RNA, 13 nt, Homo sapiens
acacugcacuguu

SEQ ID NO: 521597 - RNA, 16 nt, Homo sapiens
acacugucucuaccaa

SEQ ID NO: 521598 - RNA, 23 nt, Homo sapiens
acagaacagggucauguuugcag

SEQ ID NO: 521599 - RNA, 16 nt, Homo sapiens
acagaagacagcugcu

SEQ ID NO: 521600 - RNA, 21 nt, Homo sapiens
acagacaaggugccuguuaua

SEQ ID NO: 521601 - RNA, 12 nt, Homo sapiens
acagacgugugc

SEQ ID NO: 521602 - RNA, 17 nt, Homo sapiens
acagauagauguugcuc

SEQ ID NO: 521603 - RNA, 15 nt, Homo sapiens
acagauuuggaaaga

SEQ ID NO: 521604 - RNA, 23 nt, Homo sapiens
acagcaaccucuucaugagcuug

SEQ ID NO: 521605 - RNA, 18 nt, Homo sapiens
acagcgcaugcuggugca

SEQ ID NO: 521606 - RNA, 16 nt, Homo sapiens
acaggccagcaggggc

SEQ ID NO: 521607 - RNA, 20 nt, Homo sapiens
acaggcgccugccaucaugc

SEQ ID NO: 521608 - RNA, 22 nt, Homo sapiens
acaggcuggcaguugguacuga

SEQ ID NO: 521609 - RNA, 17 nt, Homo sapiens
acagggucauguuugca

SEQ ID NO: 521610 - RNA, 16 nt, Homo sapiens
acaggugucugagaug

SEQ ID NO: 521611 - RNA, 16 nt, Homo sapiens
acaguaacccagagcu

SEQ ID NO: 521612 - RNA, 19 nt, Homo sapiens
acaguacacagauaccuug

SEQ ID NO: 521613 - RNA, 19 nt, Homo sapiens
acagucuucccagcaauua

SEQ ID NO: 521614 - RNA, 12 nt, Homo sapiens
acagugaugccg

SEQ ID NO: 521615 - RNA, 19 nt, Homo sapiens
acagugccgacagcucucc

SEQ ID NO: 521616 - RNA, 16 nt, Homo sapiens
acucuccaauguucua

SEQ ID NO: 521617 - RNA, 20 nt, Homo sapiens
acucuccaauguucuauuaa

SEQ ID NO: 521618 - RNA, 19 nt, Homo sapiens
acucuggggugcugccuga

SEQ ID NO: 521619 - RNA, 22 nt, Homo sapiens
acucuguguuuggaauaucucu

SEQ ID NO: 521620 - RNA, 20 nt, Homo sapiens
acucuuagcuaaaucccucc

SEQ ID NO: 521621 - RNA, 20 nt, Homo sapiens
acucuucuuacuggugcuau

SEQ ID NO: 521622 - RNA, 21 nt, Homo sapiens
acugaaauuacggguaccuga

SEQ ID NO: 521623 - RNA, 14 nt, Homo sapiens
acugaauaauauca

SEQ ID NO: 521624 - RNA, 14 nt, Homo sapiens
acugacaaagacau

SEQ ID NO: 521625 - RNA, 14 nt, Homo sapiens
acugacaacauuau

SEQ ID NO: 521626 - RNA, 18 nt, Homo sapiens
acugaguguuauuugcac

SEQ ID NO: 521627 - RNA, 15 nt, Homo sapiens
acugcacaaacaaua

SEQ ID NO: 521628 - RNA, 15 nt, Homo sapiens
acugcacucuucagg

SEQ ID NO: 521629 - RNA, 14 nt, Homo sapiens
acugcguggugcuc

SEQ ID NO: 521630 - RNA, 17 nt, Homo sapiens
acugcuucuccaaggac

SEQ ID NO: 521631 - RNA, 21 nt, Homo sapiens
acuggaaaacugcuacuaucu

SEQ ID NO: 521632 - RNA, 22 nt, Homo sapiens
acugggaaccuagcuacacuga

SEQ ID NO: 521633 - RNA, 14 nt, Homo sapiens
acuguaagggauug

SEQ ID NO: 521634 - RNA, 16 nt, Homo sapiens
acuguauucgugcauu

SEQ ID NO: 521635 - RNA, 12 nt, Homo sapiens
acugucuguaua

SEQ ID NO: 521636 - RNA, 12 nt, Homo sapiens
acugucuuucag

SEQ ID NO: 521637 - RNA, 20 nt, Homo sapiens
acugugcagacccaguccca

SEQ ID NO: 521638 - RNA, 23 nt, Homo sapiens
acugugccuuguuucaacaguuu

SEQ ID NO: 521639 - RNA, 11 nt, Homo sapiens
acugugcugaa

SEQ ID NO: 521640 - RNA, 13 nt, Homo sapiens
acugugguagcca

SEQ ID NO: 521641 - RNA, 12 nt, Homo sapiens
acuguguucaau

SEQ ID NO: 521642 - RNA, 17 nt, Homo sapiens
acuguuagcacauugau

SEQ ID NO: 521643 - RNA, 19 nt, Homo sapiens
acuguuucuggacccuuau

SEQ ID NO: 521644 - RNA, 19 nt, Homo sapiens
acuuaaaugguaauaagca

SEQ ID NO: 521645 - RNA, 22 nt, Homo sapiens
acuuaccacucgugcaucccug

SEQ ID NO: 521646 - RNA, 19 nt, Homo sapiens
acuuagaugggcauggugg

SEQ ID NO: 521647 - RNA, 15 nt, Homo sapiens
acuuauugccaaaaa

SEQ ID NO: 521648 - RNA, 18 nt, Homo sapiens
acuucacuaaugaucaca

SEQ ID NO: 521649 - RNA, 22 nt, Homo sapiens
acuucccaaguguaagacucug

SEQ ID NO: 521650 - RNA, 15 nt, Homo sapiens
acuuccgagcuaugu

SEQ ID NO: 521651 - RNA, 17 nt, Homo sapiens
acuucuaagagcauaga

SEQ ID NO: 521652 - RNA, 20 nt, Homo sapiens
acuucuagugccucuguuac

SEQ ID NO: 521653 - RNA, 14 nt, Homo sapiens
acuucucuacccca

SEQ ID NO: 521654 - RNA, 17 nt, Homo sapiens
acuucuuaaauauuuag

SEQ ID NO: 521655 - RNA, 12 nt, Homo sapiens
acuugcaauacc

SEQ ID NO: 521656 - RNA, 20 nt, Homo sapiens
acuugcauaccaaguugaua

SEQ ID NO: 521657 - RNA, 22 nt, Homo sapiens
acuugcauauuguuggcacaga

SEQ ID NO: 521658 - RNA, 23 nt, Homo sapiens
acuugccuaaaauauauuccuga

SEQ ID NO: 521659 - RNA, 22 nt, Homo sapiens
acuuuccucccauuuuaccacu

SEQ ID NO: 521660 - RNA, 17 nt, Homo sapiens
acuuugggauucuuucc

SEQ ID NO: 521661 - RNA, 12 nt, Homo sapiens
acuuugugacug

SEQ ID NO: 521662 - RNA, 15 nt, Homo sapiens
acuuugugagccaaa

SEQ ID NO: 521663 - RNA, 18 nt, Homo sapiens
acuuugugagccaaagcu

SEQ ID NO: 521664 - RNA, 13 nt, Homo sapiens
acuuugugcauuc

SEQ ID NO: 521665 - RNA, 14 nt, Homo sapiens
acuuuuucccucac

SEQ ID NO: 521666 - RNA, 13 nt, Homo sapiens
agaaaacaaucaa

SEQ ID NO: 521667 - RNA, 14 nt, Homo sapiens
agaaaagugcauau

SEQ ID NO: 521668 - RNA, 16 nt, Homo sapiens
agaaaauuugcuuuaa

SEQ ID NO: 521669 - RNA, 17 nt, Homo sapiens
agaaacacguggucaug

SEQ ID NO: 521670 - RNA, 14 nt, Homo sapiens
agaaaggaaguaua

SEQ ID NO: 521671 - RNA, 22 nt, Homo sapiens
agaaaggcucugaagguccaaa

SEQ ID NO: 521672 - RNA, 19 nt, Homo sapiens
agaaauacaguacuguuuc

SEQ ID NO: 521673 - RNA, 16 nt, Homo sapiens
agaaaucuggucuugu

SEQ ID NO: 521674 - RNA, 23 nt, Homo sapiens
agaaauuaauauggcuucaccaa

SEQ ID NO: 521675 - RNA, 13 nt, Homo sapiens
agaacagggucau

SEQ ID NO: 521676 - RNA, 23 nt, Homo sapiens
agaacguggugaccuuucacgaa

SEQ ID NO: 521677 - RNA, 22 nt, Homo sapiens
agaacuaaaaauuaaaaccucu

SEQ ID NO: 521678 - RNA, 20 nt, Homo sapiens
agaacuaccaugagaugguu

SEQ ID NO: 521679 - RNA, 22 nt, Homo sapiens
agaacuggaggcaguccaucua

SEQ ID NO: 521680 - RNA, 13 nt, Homo sapiens
agaacuugcaaua

SEQ ID NO: 521681 - RNA, 12 nt, Homo sapiens
agaacuuuagua

SEQ ID NO: 521682 - RNA, 18 nt, Homo sapiens
agaagaaaucaugauaua

SEQ ID NO: 521683 - RNA, 14 nt, Homo sapiens
agaagacagcugcu

SEQ ID NO: 521684 - RNA, 20 nt, Homo sapiens
agaagacaucguaugcuugg

SEQ ID NO: 521685 - RNA, 21 nt, Homo sapiens
agaagaccccugacucaucau

SEQ ID NO: 521686 - RNA, 12 nt, Homo sapiens
agaagcccugau

SEQ ID NO: 521687 - RNA, 14 nt, Homo sapiens
agaagguaaggugu

SEQ ID NO: 521688 - RNA, 14 nt, Homo sapiens
agaaguacuccuau

SEQ ID NO: 521689 - RNA, 19 nt, Homo sapiens
agaaguuguuugaggcaaa

SEQ ID NO: 521690 - RNA, 23 nt, Homo sapiens
cuaaauaaaaauauguaauuuca

SEQ ID NO: 521691 - RNA, 23 nt, Homo sapiens
cuaaauuuauauucauaaaguua

SEQ ID NO: 521692 - RNA, 13 nt, Homo sapiens
cuaagaagacauu

SEQ ID NO: 521693 - RNA, 17 nt, Homo sapiens
cuaagaagagauuucuc

SEQ ID NO: 521694 - RNA, 13 nt, Homo sapiens
cuaagcagcuuau

SEQ ID NO: 521695 - RNA, 13 nt, Homo sapiens
cuaagucauucau

SEQ ID NO: 521696 - RNA, 13 nt, Homo sapiens
cuaauaugccuag

SEQ ID NO: 521697 - RNA, 19 nt, Homo sapiens
cuaaucaaagccagggucu

SEQ ID NO: 521698 - RNA, 22 nt, Homo sapiens
cuaaugauuuagugaucaaauu

SEQ ID NO: 521699 - RNA, 20 nt, Homo sapiens
cuaauguacaauaaagcaau

SEQ ID NO: 521700 - RNA, 22 nt, Homo sapiens
cuaauguacaauaaagcaaugu

SEQ ID NO: 521701 - RNA, 19 nt, Homo sapiens
cuaauucuucuguccugag

SEQ ID NO: 521702 - RNA, 16 nt, Homo sapiens
cuaauuguaagugaaa

SEQ ID NO: 521703 - RNA, 16 nt, Homo sapiens
cuacaagucagcucca

SEQ ID NO: 521704 - RNA, 22 nt, Homo sapiens
cuacaauuaauaguuugucuau

SEQ ID NO: 521705 - RNA, 18 nt, Homo sapiens
cuacacaauacaguauua

SEQ ID NO: 521706 - RNA, 14 nt, Homo sapiens
cuacacaauuuaau

SEQ ID NO: 521707 - RNA, 14 nt, Homo sapiens
cuacacacugucau

SEQ ID NO: 521708 - RNA, 19 nt, Homo sapiens
cuacagauauuaauguuaa

SEQ ID NO: 521709 - RNA, 16 nt, Homo sapiens
cuacaguacaaucagc

SEQ ID NO: 521710 - RNA, 20 nt, Homo sapiens
cuacagugccaacuccucac

SEQ ID NO: 521711 - RNA, 22 nt, Homo sapiens
cuacauuuucagaaguuaacau

SEQ ID NO: 521712 - RNA, 12 nt, Homo sapiens
cuaccacuguau

SEQ ID NO: 521713 - RNA, 20 nt, Homo sapiens
cuaccuuagaaaacaaguau

SEQ ID NO: 521714 - RNA, 21 nt, Homo sapiens
cuacucagccuagcacaggcu

SEQ ID NO: 521715 - RNA, 18 nt, Homo sapiens
cuacugcucuguguuuac

SEQ ID NO: 521716 - RNA, 15 nt, Homo sapiens
cuacuuuguggcaau

SEQ ID NO: 521717 - RNA, 16 nt, Homo sapiens
cuagaaacauguaauc

SEQ ID NO: 521718 - RNA, 16 nt, Homo sapiens
cuagaccuggugcuga

SEQ ID NO: 521719 - RNA, 15 nt, Homo sapiens
cuagagaacacugug

SEQ ID NO: 521720 - RNA, 22 nt, Homo sapiens
cuagaggcuugcauaauaagcu

SEQ ID NO: 521721 - RNA, 20 nt, Homo sapiens
cuagcauucugcaacauuua

SEQ ID NO: 521722 - RNA, 22 nt, Homo sapiens
cuagcauuucccaacacaaaga

SEQ ID NO: 521723 - RNA, 21 nt, Homo sapiens
cuaggaaacucacacuccccu

SEQ ID NO: 521724 - RNA, 18 nt, Homo sapiens
cuaggaggcuguggguuu

SEQ ID NO: 521725 - RNA, 14 nt, Homo sapiens
cuaguguacauuuc

SEQ ID NO: 521726 - RNA, 22 nt, Homo sapiens
cuaguguacauuucuauaaaua

SEQ ID NO: 521727 - RNA, 18 nt, Homo sapiens
cuauagggugugaugaag

SEQ ID NO: 521728 - RNA, 20 nt, Homo sapiens
cuauagggugugaugaaguc

SEQ ID NO: 521729 - RNA, 21 nt, Homo sapiens
cuauagucccacuacuugugg

SEQ ID NO: 521730 - RNA, 21 nt, Homo sapiens
cuaucauacuacugaaacaga

SEQ ID NO: 521731 - RNA, 18 nt, Homo sapiens
cuaugaagccaacugaca

SEQ ID NO: 521732 - RNA, 16 nt, Homo sapiens
cuaugcagccacauca

SEQ ID NO: 521733 - RNA, 14 nt, Homo sapiens
cuaugcugugcucc

SEQ ID NO: 521734 - RNA, 14 nt, Homo sapiens
cuaugggugagcau

SEQ ID NO: 521735 - RNA, 20 nt, Homo sapiens
cuauuaaucaccucucugua

SEQ ID NO: 521736 - RNA, 15 nt, Homo sapiens
cucaagaaaucaaaa

SEQ ID NO: 521737 - RNA, 19 nt, Homo sapiens
cucaaucgagugagacaga

SEQ ID NO: 521738 - RNA, 16 nt, Homo sapiens
cucaauuuuugucuca

SEQ ID NO: 521739 - RNA, 18 nt, Homo sapiens
cucacugaaaccaggugg

SEQ ID NO: 521740 - RNA, 21 nt, Homo sapiens
cucagaagugaaaaucuugga

SEQ ID NO: 521741 - RNA, 20 nt, Homo sapiens
cucagcaguccacaaagcau

SEQ ID NO: 521742 - RNA, 21 nt, Homo sapiens
cucagcaguccacaaagcauu

SEQ ID NO: 521743 - RNA, 13 nt, Homo sapiens
cucagcccugugc

SEQ ID NO: 521744 - RNA, 20 nt, Homo sapiens
cucaggacccccuguccuga

SEQ ID NO: 521745 - RNA, 22 nt, Homo sapiens
cucagguagaagguugacacag

SEQ ID NO: 521746 - RNA, 12 nt, Homo sapiens
cucagugccugg

SEQ ID NO: 521747 - RNA, 21 nt, Homo sapiens
cucaguguuuuggacuccauc

SEQ ID NO: 521748 - RNA, 16 nt, Homo sapiens
cucauaauuuugcaaa

SEQ ID NO: 521749 - RNA, 19 nt, Homo sapiens
cucaucugcacuauguuuc

SEQ ID NO: 521750 - RNA, 18 nt, Homo sapiens
cucaugccuguaauccca

SEQ ID NO: 521751 - RNA, 19 nt, Homo sapiens
cucaugccuguaaucccag

SEQ ID NO: 521752 - RNA, 15 nt, Homo sapiens
cucauguggccaagc

SEQ ID NO: 521753 - RNA, 13 nt, Homo sapiens
cucauuacuguga

SEQ ID NO: 521754 - RNA, 16 nt, Homo sapiens
cuccaacugcaggaaa

SEQ ID NO: 521755 - RNA, 21 nt, Homo sapiens
gagcaguggccaucauccucc

SEQ ID NO: 521756 - RNA, 16 nt, Homo sapiens
gagcauaccacuugaa

SEQ ID NO: 521757 - RNA, 18 nt, Homo sapiens
gagccaaagcuuauguga

SEQ ID NO: 521758 - RNA, 21 nt, Homo sapiens
gagccaagagugcacuacugu

SEQ ID NO: 521759 - RNA, 19 nt, Homo sapiens
gagccaccugacucuugca

SEQ ID NO: 521760 - RNA, 15 nt, Homo sapiens
gagccagcaacucca

SEQ ID NO: 521761 - RNA, 16 nt, Homo sapiens
gagccagcacccugau

SEQ ID NO: 521762 - RNA, 16 nt, Homo sapiens
gagccaggacccagga

SEQ ID NO: 521763 - RNA, 17 nt, Homo sapiens
gagcccagcuuccugaa

SEQ ID NO: 521764 - RNA, 22 nt, Homo sapiens
gagccucgcuuuuucauccuuc

SEQ ID NO: 521765 - RNA, 23 nt, Homo sapiens
gagccugggguguccuacaguga

SEQ ID NO: 521766 - RNA, 15 nt, Homo sapiens
gagccuuuaccuuuu

SEQ ID NO: 521767 - RNA, 14 nt, Homo sapiens
gagcgagacccugu

SEQ ID NO: 521768 - RNA, 13 nt, Homo sapiens
gagcucagugugu

SEQ ID NO: 521769 - RNA, 21 nt, Homo sapiens
gagcugaguaggaggccucca

SEQ ID NO: 521770 - RNA, 15 nt, Homo sapiens
gaggagaaaugcaau

SEQ ID NO: 521771 - RNA, 13 nt, Homo sapiens
gaggcacugcuga

SEQ ID NO: 521772 - RNA, 17 nt, Homo sapiens
gaggcugugcacagacu

SEQ ID NO: 521773 - RNA, 21 nt, Homo sapiens
gagggacauagaaucugugac

SEQ ID NO: 521774 - RNA, 16 nt, Homo sapiens
gagggcagacuggggc

SEQ ID NO: 521775 - RNA, 19 nt, Homo sapiens
gaggggacucaaacagucu

SEQ ID NO: 521776 - RNA, 22 nt, Homo sapiens
gaggggaggauguauaaaaugg

SEQ ID NO: 521777 - RNA, 19 nt, Homo sapiens
gagggggucugggccagug

SEQ ID NO: 521778 - RNA, 23 nt, Homo sapiens
gaggucagggagugcuggcucac

SEQ ID NO: 521779 - RNA, 15 nt, Homo sapiens
gaguacuccaagaca

SEQ ID NO: 521780 - RNA, 22 nt, Homo sapiens
gagucauguugaaggugcccaa

SEQ ID NO: 521781 - RNA, 13 nt, Homo sapiens
gagugaccagcac

SEQ ID NO: 521782 - RNA, 12 nt, Homo sapiens
gagugacucugg

SEQ ID NO: 521783 - RNA, 21 nt, Homo sapiens
gaguggcucacccuguccaga

SEQ ID NO: 521784 - RNA, 23 nt, Homo sapiens
gagugugggggaggcgcacagug

SEQ ID NO: 521785 - RNA, 18 nt, Homo sapiens
gaguuaaugauggcagag

SEQ ID NO: 521786 - RNA, 14 nt, Homo sapiens
gaguucugaagcug

SEQ ID NO: 521787 - RNA, 16 nt, Homo sapiens
gaguucugaagcugac

SEQ ID NO: 521788 - RNA, 21 nt, Homo sapiens
gaguugcagccagggccagug

SEQ ID NO: 521789 - RNA, 22 nt, Homo sapiens
gaguugcagccagggccagugg

SEQ ID NO: 521790 - RNA, 22 nt, Homo sapiens
gaguuuuauagccuggacugcu

SEQ ID NO: 521791 - RNA, 18 nt, Homo sapiens
gauaaguggggacuagug

SEQ ID NO: 521792 - RNA, 20 nt, Homo sapiens
gauaauaugaaaaucuccau

SEQ ID NO: 521793 - RNA, 13 nt, Homo sapiens
gauaccugcacug

SEQ ID NO: 521794 - RNA, 16 nt, Homo sapiens
gauaccugcacugucc

SEQ ID NO: 521795 - RNA, 22 nt, Homo sapiens
gauaccugcacuguccugacca

SEQ ID NO: 521796 - RNA, 22 nt, Homo sapiens
gauagacuuauugccaaaaaca

SEQ ID NO: 521797 - RNA, 19 nt, Homo sapiens
gauagauguugcucuuuca

SEQ ID NO: 521798 - RNA, 17 nt, Homo sapiens
gauagcaaacacugggg

SEQ ID NO: 521799 - RNA, 22 nt, Homo sapiens
gaucaaauugugcaguacuuug

SEQ ID NO: 521800 - RNA, 21 nt, Homo sapiens
gaucaacaacauccacuguua

SEQ ID NO: 521801 - RNA, 19 nt, Homo sapiens
gcuguuuuguggauuuuug

SEQ ID NO: 521802 - RNA, 17 nt, Homo sapiens
gcuuaaugcuacaugug

SEQ ID NO: 521803 - RNA, 13 nt, Homo sapiens
gcuuaccccuuca

SEQ ID NO: 521804 - RNA, 21 nt, Homo sapiens
gcuuauaaaaauaaagggaag

SEQ ID NO: 521805 - RNA, 16 nt, Homo sapiens
gcuucugcaguucuca

SEQ ID NO: 521806 - RNA, 22 nt, Homo sapiens
gcuucugcaguucucaugacuc

SEQ ID NO: 521807 - RNA, 18 nt, Homo sapiens
gcuucuguugaucucagu

SEQ ID NO: 521808 - RNA, 12 nt, Homo sapiens
gcuuguguuucu

SEQ ID NO: 521809 - RNA, 21 nt, Homo sapiens
gcuuguugucuccacuuguau

SEQ ID NO: 521810 - RNA, 19 nt, Homo sapiens
gcuuuaaaaucuguucacu

SEQ ID NO: 521811 - RNA, 22 nt, Homo sapiens
gcuuuagaugaggaaaugaucc

SEQ ID NO: 521812 - RNA, 12 nt, Homo sapiens
gcuuuagcuuca

SEQ ID NO: 521813 - RNA, 21 nt, Homo sapiens
gcuuucccgcccagccucacu

SEQ ID NO: 521814 - RNA, 15 nt, Homo sapiens
gcuuuccuguuucca

SEQ ID NO: 521815 - RNA, 18 nt, Homo sapiens
ggaaaaucacaucuccag

SEQ ID NO: 521816 - RNA, 15 nt, Homo sapiens
ggaaagaaauacagu

SEQ ID NO: 521817 - RNA, 13 nt, Homo sapiens
ggaaagaugugaa

SEQ ID NO: 521818 - RNA, 18 nt, Homo sapiens
ggaaaggugacaguauua

SEQ ID NO: 521819 - RNA, 12 nt, Homo sapiens
ggaaagugaaac

SEQ ID NO: 521820 - RNA, 23 nt, Homo sapiens
ggaaauaguaccuucaauacuua

SEQ ID NO: 521821 - RNA, 21 nt, Homo sapiens
ggaaauguauuuugacacugg

SEQ ID NO: 521822 - RNA, 21 nt, Homo sapiens
ggaacaaaacuccagacucuu

SEQ ID NO: 521823 - RNA, 14 nt, Homo sapiens
ggaaccagcucucu

SEQ ID NO: 521824 - RNA, 21 nt, Homo sapiens
ggaagaaacacguggucauga

SEQ ID NO: 521825 - RNA, 20 nt, Homo sapiens
ggaagcaaguuuucuuccau

SEQ ID NO: 521826 - RNA, 20 nt, Homo sapiens
ggaagcuguccuggaggucc

SEQ ID NO: 521827 - RNA, 22 nt, Homo sapiens
ggaaggaaaucccaucagugaa

SEQ ID NO: 521828 - RNA, 13 nt, Homo sapiens
ggaagucaucuca

SEQ ID NO: 521829 - RNA, 16 nt, Homo sapiens
ggaaguuuuaaucucu

SEQ ID NO: 521830 - RNA, 19 nt, Homo sapiens
ggaaugaauacagcauuua

SEQ ID NO: 521831 - RNA, 20 nt, Homo sapiens
ggacaaaugaugccauggca

SEQ ID NO: 521832 - RNA, 23 nt, Homo sapiens
ggacagaaagagacuccgucuca

SEQ ID NO: 521833 - RNA, 18 nt, Homo sapiens
ggacauagccugcaaagc

SEQ ID NO: 521834 - RNA, 22 nt, Homo sapiens
ggaccugccccccacucugcac

SEQ ID NO: 521835 - RNA, 19 nt, Homo sapiens
ggacuacaccaggguccug

SEQ ID NO: 521836 - RNA, 15 nt, Homo sapiens
ggacugugaggccau

SEQ ID NO: 521837 - RNA, 17 nt, Homo sapiens
ggacugugaggccauac

SEQ ID NO: 521838 - RNA, 14 nt, Homo sapiens
ggacuucagcucag

SEQ ID NO: 521839 - RNA, 23 nt, Homo sapiens
ggacuugauagcaaacacugggg

SEQ ID NO: 521840 - RNA, 12 nt, Homo sapiens
ggagaaucucag

SEQ ID NO: 521841 - RNA, 20 nt, Homo sapiens
ggagacagagguugcaguga

SEQ ID NO: 521842 - RNA, 18 nt, Homo sapiens
ggagagaagcaagccagc

SEQ ID NO: 521843 - RNA, 17 nt, Homo sapiens
ggagagguuacccgaga

SEQ ID NO: 521844 - RNA, 15 nt, Homo sapiens
ggagaguaccugugu

SEQ ID NO: 521845 - RNA, 20 nt, Homo sapiens
ggagaguaccuguguguuuc

SEQ ID NO: 521846 - RNA, 14 nt, Homo sapiens
ggagauacagugga

SEQ ID NO: 521847 - RNA, 12 nt, Homo sapiens
ggagaugcugcc

SEQ ID NO: 521848 - RNA, 23 nt, Homo sapiens
ggagcacugcguuuuccuagcug

SEQ ID NO: 521849 - RNA, 22 nt, Homo sapiens
ggagccccaggggacaagggau

SEQ ID NO: 521850 - RNA, 16 nt, Homo sapiens
ggaggcaguccaucua

SEQ ID NO: 521851 - RNA, 20 nt, Homo sapiens
ggaggcggagguugcaguga

SEQ ID NO: 521852 - RNA, 21 nt, Homo sapiens
ggaguacaaugcccagaucaa

SEQ ID NO: 521853 - RNA, 22 nt, Homo sapiens
ggaguuccggaauuauucugug

SEQ ID NO: 521854 - RNA, 16 nt, Homo sapiens
ggauaaagaugagaug

SEQ ID NO: 521855 - RNA, 21 nt, Homo sapiens
ggauauacugcagcuuuacug

SEQ ID NO: 521856 - RNA, 17 nt, Homo sapiens
ggauccagaacugcacu

SEQ ID NO: 521857 - RNA, 21 nt, Homo sapiens
ggaucgugggccgcacugggg

SEQ ID NO: 521858 - RNA, 18 nt, Homo sapiens
ggaucucaggcuucugca

SEQ ID NO: 521859 - RNA, 16 nt, Homo sapiens
ggaugaaagagccaga

SEQ ID NO: 521860 - RNA, 13 nt, Homo sapiens
ggaugaugcaguu

SEQ ID NO: 521861 - RNA, 19 nt, Homo sapiens
ggaugccacagcccagcuu

SEQ ID NO: 521862 - RNA, 17 nt, Homo sapiens
ggaugucccugggccag

SEQ ID NO: 521863 - RNA, 18 nt, Homo sapiens
ggaugucccugggccagg

SEQ ID NO: 521864 - RNA, 16 nt, Homo sapiens
ggauuuggugcuggaa

SEQ ID NO: 521865 - RNA, 17 nt, Homo sapiens
ggcaaacuugcaguuua

SEQ ID NO: 521866 - RNA, 23 nt, Homo sapiens
ggcaagacgcgagugcuggugac

SEQ ID NO: 521867 - RNA, 12 nt, Homo sapiens
ggcacacacugu

SEQ ID NO: 521868 - RNA, 15 nt, Homo sapiens
ggcacacacugugcc

SEQ ID NO: 521869 - RNA, 17 nt, Homo sapiens
ggcacauuccccuugcc

SEQ ID NO: 521870 - RNA, 22 nt, Homo sapiens
ggcagagccaccugacucuugc

SEQ ID NO: 521871 - RNA, 17 nt, Homo sapiens
ggcagagucuaccuuga

SEQ ID NO: 521872 - RNA, 17 nt, Homo sapiens
ggcagauggggcacuga

SEQ ID NO: 521873 - RNA, 14 nt, Homo sapiens
ggcagcgccaagug

SEQ ID NO: 521874 - RNA, 22 nt, Homo sapiens
ggcagcggguggcauccaggcu

SEQ ID NO: 521875 - RNA, 19 nt, Homo sapiens
ggcagcuuuuucauaccaa

SEQ ID NO: 521876 - RNA, 15 nt, Homo sapiens
ggcaggcugggccau

SEQ ID NO: 521877 - RNA, 18 nt, Homo sapiens
ggcaggcugggccauguc

SEQ ID NO: 521878 - RNA, 24 nt, Homo sapiens
ggcaggugaaaaggguacagaugu

SEQ ID NO: 521879 - RNA, 16 nt, Homo sapiens
ggcaguagaacuccag

SEQ ID NO: 521880 - RNA, 16 nt, Homo sapiens
ggcauaauagucaauu

SEQ ID NO: 521881 - RNA, 14 nt, Homo sapiens
ggccauguccaaag

SEQ ID NO: 521882 - RNA, 21 nt, Homo sapiens
ggcccagcaaucuccaugugu

SEQ ID NO: 521883 - RNA, 13 nt, Homo sapiens
ggcccagugacaa

SEQ ID NO: 521884 - RNA, 13 nt, Homo sapiens
ggcccagugcaug

SEQ ID NO: 521885 - RNA, 18 nt, Homo sapiens
ggcccucccuuuucccau

SEQ ID NO: 521886 - RNA, 18 nt, Homo sapiens
ggccguggcacagcuggg

SEQ ID NO: 521887 - RNA, 15 nt, Homo sapiens
ggccuagaccuggug

SEQ ID NO: 521888 - RNA, 11 nt, Homo sapiens
ggccucaggug

SEQ ID NO: 521889 - RNA, 14 nt, Homo sapiens
ggccuccaugaccu

SEQ ID NO: 521890 - RNA, 22 nt, Homo sapiens
ggccugcgacccugggggcaca

SEQ ID NO: 521891 - RNA, 21 nt, Homo sapiens
ggcgcaguggcucaugccugu

SEQ ID NO: 521892 - RNA, 22 nt, Homo sapiens
ggcgugauggcaggugccugua

SEQ ID NO: 521893 - RNA, 15 nt, Homo sapiens
ggcuaugccaugugc

SEQ ID NO: 521894 - RNA, 19 nt, Homo sapiens
ggcucagauuguaauaugu

SEQ ID NO: 521895 - RNA, 20 nt, Homo sapiens
ggcucagauuguaauaugua

SEQ ID NO: 521896 - RNA, 15 nt, Homo sapiens
ggcucuaauguacaa

SEQ ID NO: 521897 - RNA, 15 nt, Homo sapiens
ggcugaaagaugacg

SEQ ID NO: 521898 - RNA, 18 nt, Homo sapiens
ggcugacaugaagcuguu

SEQ ID NO: 521899 - RNA, 14 nt, Homo sapiens
ggcugcacaggcug

SEQ ID NO: 521900 - RNA, 19 nt, Homo sapiens
ggcugcacaggcugaaaua

SEQ ID NO: 521901 - RNA, 20 nt, Homo sapiens
ggcuggagccuggggugucc

SEQ ID NO: 521902 - RNA, 13 nt, Homo sapiens
ggcugggccaugu

SEQ ID NO: 521903 - RNA, 20 nt, Homo sapiens
ggcugugcggaucucuggag

SEQ ID NO: 521904 - RNA, 16 nt, Homo sapiens
ggcuguggagaggguc

SEQ ID NO: 521905 - RNA, 16 nt, Homo sapiens
ggcugugucaccauug

SEQ ID NO: 521906 - RNA, 18 nt, Homo sapiens
ggcuuaauugacugaaau

SEQ ID NO: 521907 - RNA, 21 nt, Homo sapiens
ggcuucauugagaaacuggga

SEQ ID NO: 521908 - RNA, 19 nt, Homo sapiens
ggcuuuuugccaucuguga

SEQ ID NO: 521909 - RNA, 14 nt, Homo sapiens
gggaaauccauucc

SEQ ID NO: 521910 - RNA, 17 nt, Homo sapiens
gggaacaaggaaggaaa

SEQ ID NO: 521911 - RNA, 16 nt, Homo sapiens
gggaaugagcccagag

SEQ ID NO: 521912 - RNA, 14 nt, Homo sapiens
gggacaagggauuu

SEQ ID NO: 521913 - RNA, 19 nt, Homo sapiens
gggacuaucuuugcugcag

SEQ ID NO: 521914 - RNA, 22 nt, Homo sapiens
gggacugugaggccauacuugu

SEQ ID NO: 521915 - RNA, 14 nt, Homo sapiens
gggacuucagcuca

SEQ ID NO: 521916 - RNA, 20 nt, Homo sapiens
gggagacagagguugcagug

SEQ ID NO: 521917 - RNA, 17 nt, Homo sapiens
gggagaggugauucuca

SEQ ID NO: 521918 - RNA, 20 nt, Homo sapiens
gggagccgcuucuccaaguc

SEQ ID NO: 521919 - RNA, 19 nt, Homo sapiens
gggaugacuggcuuugaga

SEQ ID NO: 521920 - RNA, 21 nt, Homo sapiens
gggauggccagagaugcugga

SEQ ID NO: 521921 - RNA, 21 nt, Homo sapiens
gguggaucacgaggucaggag

SEQ ID NO: 521922 - RNA, 22 nt, Homo sapiens
gguguaaacuuguacauggaau

SEQ ID NO: 521923 - RNA, 20 nt, Homo sapiens
gguguagccagguauggcuc

SEQ ID NO: 521924 - RNA, 14 nt, Homo sapiens
gguguggagugacu

SEQ ID NO: 521925 - RNA, 16 nt, Homo sapiens
gguucagacacagcuc

SEQ ID NO: 521926 - RNA, 16 nt, Homo sapiens
gguuugguccuugaac

SEQ ID NO: 521927 - RNA, 17 nt, Homo sapiens
gguuugucagaggcuaa

SEQ ID NO: 521928 - RNA, 13 nt, Homo sapiens
guaaagugccuua

SEQ ID NO: 521929 - RNA, 15 nt, Homo sapiens
guaaauuuuuaggca

SEQ ID NO: 521930 - RNA, 17 nt, Homo sapiens
guaacuccccucaggga

SEQ ID NO: 521931 - RNA, 18 nt, Homo sapiens
guaaucccagcuacucag

SEQ ID NO: 521932 - RNA, 16 nt, Homo sapiens
guaaucuuuauacugg

SEQ ID NO: 521933 - RNA, 18 nt, Homo sapiens
guacaauaaagcaaugug

SEQ ID NO: 521934 - RNA, 21 nt, Homo sapiens
guacaauaaagcaauguggua

SEQ ID NO: 521935 - RNA, 17 nt, Homo sapiens
guacaugguguuugugg

SEQ ID NO: 521936 - RNA, 19 nt, Homo sapiens
guacauuuaaaauugcuau

SEQ ID NO: 521937 - RNA, 12 nt, Homo sapiens
guaccauuuaau

SEQ ID NO: 521938 - RNA, 21 nt, Homo sapiens
guacucuggggugcugccuga

SEQ ID NO: 521939 - RNA, 17 nt, Homo sapiens
guacucuuuaacauaca

SEQ ID NO: 521940 - RNA, 16 nt, Homo sapiens
guacugaggugcuaug

SEQ ID NO: 521941 - RNA, 13 nt, Homo sapiens
guagcccauccuu

SEQ ID NO: 521942 - RNA, 16 nt, Homo sapiens
guagcccauccuuccc

SEQ ID NO: 521943 - RNA, 16 nt, Homo sapiens
guagccucaauucucc

SEQ ID NO: 521944 - RNA, 20 nt, Homo sapiens
guagccucaauucuccauua

SEQ ID NO: 521945 - RNA, 14 nt, Homo sapiens
guagcuacaggaca

SEQ ID NO: 521946 - RNA, 16 nt, Homo sapiens
guagcuacaggacauu

SEQ ID NO: 521947 - RNA, 17 nt, Homo sapiens
guagcuugcucccugug

SEQ ID NO: 521948 - RNA, 21 nt, Homo sapiens
guagguaggaagcacugaaaa

SEQ ID NO: 521949 - RNA, 17 nt, Homo sapiens
guaggugucugccuuca

SEQ ID NO: 521950 - RNA, 20 nt, Homo sapiens
guauaggccaggcacagugg

SEQ ID NO: 521951 - RNA, 21 nt, Homo sapiens
guauaggggcaacuguaugaa

SEQ ID NO: 521952 - RNA, 15 nt, Homo sapiens
guauauacuuugcca

SEQ ID NO: 521953 - RNA, 18 nt, Homo sapiens
guaucauguauggugaua

SEQ ID NO: 521954 - RNA, 23 nt, Homo sapiens
guauccaugcaccuaccuuagaa

SEQ ID NO: 521955 - RNA, 13 nt, Homo sapiens
guauccugcagcg

SEQ ID NO: 521956 - RNA, 15 nt, Homo sapiens
guaucucucacuauu

SEQ ID NO: 521957 - RNA, 21 nt, Homo sapiens
guaucuguuuacauccagagu

SEQ ID NO: 521958 - RNA, 16 nt, Homo sapiens
guauguuuguacuugg

SEQ ID NO: 521959 - RNA, 17 nt, Homo sapiens
guauuaucaaagggaua

SEQ ID NO: 521960 - RNA, 23 nt, Homo sapiens
guauuuucuuacacugugucauu

SEQ ID NO: 521961 - RNA, 15 nt, Homo sapiens
guauuuugacacugg

SEQ ID NO: 521962 - RNA, 15 nt, Homo sapiens
gucaaugaccauuca

SEQ ID NO: 521963 - RNA, 18 nt, Homo sapiens
gucaccggucagugccuu

SEQ ID NO: 521964 - RNA, 21 nt, Homo sapiens
gucacgcacaagggcacguga

SEQ ID NO: 521965 - RNA, 20 nt, Homo sapiens
gucagaggcuaauucugcag

SEQ ID NO: 521966 - RNA, 21 nt, Homo sapiens
gucagcuacuaaugauguuuu

SEQ ID NO: 521967 - RNA, 23 nt, Homo sapiens
gucaggcgcaguggcucaugccu

SEQ ID NO: 521968 - RNA, 17 nt, Homo sapiens
gucaggggaacagagaa

SEQ ID NO: 521969 - RNA, 14 nt, Homo sapiens
gucaguacuauuca

SEQ ID NO: 521970 - RNA, 20 nt, Homo sapiens
gucauaaugguuuuuaacac

SEQ ID NO: 521971 - RNA, 17 nt, Homo sapiens
gucaucaggugcauagc

SEQ ID NO: 521972 - RNA, 17 nt, Homo sapiens
gucauccucaugcugcu

SEQ ID NO: 521973 - RNA, 15 nt, Homo sapiens
gucauccugccaacu

SEQ ID NO: 521974 - RNA, 22 nt, Homo sapiens
gucaucgggaggagcagccuga

SEQ ID NO: 521975 - RNA, 16 nt, Homo sapiens
gucaugcuucaucauu

SEQ ID NO: 521976 - RNA, 14 nt, Homo sapiens
gucauggaggccaa

SEQ ID NO: 521977 - RNA, 23 nt, Homo sapiens
gucauucgcuacuaugauuuaau

SEQ ID NO: 521978 - RNA, 17 nt, Homo sapiens
guccacgauucacucau

SEQ ID NO: 521979 - RNA, 11 nt, Homo sapiens
guccagcaccu

SEQ ID NO: 521980 - RNA, 13 nt, Homo sapiens
gucccacacugug

SEQ ID NO: 521981 - RNA, 16 nt, Homo sapiens
gucccacacugugcag

SEQ ID NO: 521982 - RNA, 14 nt, Homo sapiens
gucccacacugugg

SEQ ID NO: 521983 - RNA, 15 nt, Homo sapiens
gucccaggcagggag

SEQ ID NO: 521984 - RNA, 22 nt, Homo sapiens
guccccagccugcucccuagcc

SEQ ID NO: 521985 - RNA, 16 nt, Homo sapiens
guccccugcccaugcu

SEQ ID NO: 521986 - RNA, 16 nt, Homo sapiens
gucccucugcucucag

SEQ ID NO: 521987 - RNA, 22 nt, Homo sapiens
gucccugaaaccuaguacugcc

SEQ ID NO: 521988 - RNA, 18 nt, Homo sapiens
guccgcugccccaugugu

SEQ ID NO: 521989 - RNA, 15 nt, Homo sapiens
guccuaaccacuaac

SEQ ID NO: 521990 - RNA, 13 nt, Homo sapiens
guccuccaagcuc

SEQ ID NO: 521991 - RNA, 16 nt, Homo sapiens
guccucccagcugcca

SEQ ID NO: 521992 - RNA, 19 nt, Homo sapiens
guccucgagcaacugcugu

SEQ ID NO: 521993 - RNA, 21 nt, Homo sapiens
guccugcagucccacacugug

SEQ ID NO: 521994 - RNA, 22 nt, Homo sapiens
guccugcagucccacacugugc

SEQ ID NO: 521995 - RNA, 12 nt, Homo sapiens
guccuugaacaa

SEQ ID NO: 521996 - RNA, 20 nt, Homo sapiens
guccuuuaaucacugcauuu

SEQ ID NO: 521997 - RNA, 15 nt, Homo sapiens
gucuagcauucugca

SEQ ID NO: 521998 - RNA, 19 nt, Homo sapiens
gcaguuuaugagacagcug

SEQ ID NO: 521999 - RNA, 18 nt, Homo sapiens
gcauaauaagcuaaagag

SEQ ID NO: 522000 - RNA, 16 nt, Homo sapiens
gcauaccaaguugaua

SEQ ID NO: 522001 - RNA, 14 nt, Homo sapiens
gcauauagacugua

SEQ ID NO: 522002 - RNA, 20 nt, Homo sapiens
gcauaugggugggauuuugc

SEQ ID NO: 522003 - RNA, 19 nt, Homo sapiens
gcaucagaccugcauugaa

SEQ ID NO: 522004 - RNA, 14 nt, Homo sapiens
gcauucugcaacau

SEQ ID NO: 522005 - RNA, 18 nt, Homo sapiens
gcauucugcaacauuuau

SEQ ID NO: 522006 - RNA, 18 nt, Homo sapiens
gcauuguaaaagcauuuu

SEQ ID NO: 522007 - RNA, 24 nt, Homo sapiens
gccaaaaacaaaaaauagcuuuca

SEQ ID NO: 522008 - RNA, 20 nt, Homo sapiens
gccaacuuucucugcaacua

SEQ ID NO: 522009 - RNA, 15 nt, Homo sapiens
gccaagaacuugcaa

SEQ ID NO: 522010 - RNA, 19 nt, Homo sapiens
gccaaugccccacuggcag

SEQ ID NO: 522011 - RNA, 18 nt, Homo sapiens
gccacaguccuucuuuga

SEQ ID NO: 522012 - RNA, 15 nt, Homo sapiens
gccaccugcaggacc

SEQ ID NO: 522013 - RNA, 17 nt, Homo sapiens
gccagagaugcuggacu

SEQ ID NO: 522014 - RNA, 18 nt, Homo sapiens
gccagaggcucuaaugua

SEQ ID NO: 522015 - RNA, 16 nt, Homo sapiens
gccagcagaacugaag

SEQ ID NO: 522016 - RNA, 19 nt, Homo sapiens
gccagggucugugugaaug

SEQ ID NO: 522017 - RNA, 21 nt, Homo sapiens
gccagucucauugucaccucu

SEQ ID NO: 522018 - RNA, 13 nt, Homo sapiens
gccauaauguugc

SEQ ID NO: 522019 - RNA, 12 nt, Homo sapiens
gccaucaugccu

SEQ ID NO: 522020 - RNA, 17 nt, Homo sapiens
gccaucaugccugacua

SEQ ID NO: 522021 - RNA, 15 nt, Homo sapiens
gccauugcauuccag

SEQ ID NO: 522022 - RNA, 16 nt, Homo sapiens
gccauuucacucucaa

SEQ ID NO: 522023 - RNA, 19 nt, Homo sapiens
gcccagugcaugguggcca

SEQ ID NO: 522024 - RNA, 13 nt, Homo sapiens
gccccacaugucc

SEQ ID NO: 522025 - RNA, 22 nt, Homo sapiens
gccccaccucggcacacacugu

SEQ ID NO: 522026 - RNA, 21 nt, Homo sapiens
gcccccacguggggaggugga

SEQ ID NO: 522027 - RNA, 18 nt, Homo sapiens
gcccccuugggugaccuc

SEQ ID NO: 522028 - RNA, 14 nt, Homo sapiens
gccccucucaccaa

SEQ ID NO: 522029 - RNA, 18 nt, Homo sapiens
gccccugccccauuuccu

SEQ ID NO: 522030 - RNA, 14 nt, Homo sapiens
gccccugucauccu

SEQ ID NO: 522031 - RNA, 23 nt, Homo sapiens
gccccugucauccucaugcugcu

SEQ ID NO: 522032 - RNA, 13 nt, Homo sapiens
gcccguacccagc

SEQ ID NO: 522033 - RNA, 13 nt, Homo sapiens
gcccuccaggcuu

SEQ ID NO: 522034 - RNA, 17 nt, Homo sapiens
gcccugcucuuccucag

SEQ ID NO: 522035 - RNA, 15 nt, Homo sapiens
gcccuguuagcuuuc

SEQ ID NO: 522036 - RNA, 11 nt, Homo sapiens
gccgcacuggg

SEQ ID NO: 522037 - RNA, 19 nt, Homo sapiens
gccgggccuagaccuggug

SEQ ID NO: 522038 - RNA, 21 nt, Homo sapiens
gccucacuuccuuugcccuuc

SEQ ID NO: 522039 - RNA, 19 nt, Homo sapiens
gccuccccacaggagcccu

SEQ ID NO: 522040 - RNA, 17 nt, Homo sapiens
gccuccccaugggcaca

SEQ ID NO: 522041 - RNA, 21 nt, Homo sapiens
gccuccccaugggcacagugg

SEQ ID NO: 522042 - RNA, 20 nt, Homo sapiens
gccuccugggaacacaucug

SEQ ID NO: 522043 - RNA, 19 nt, Homo sapiens
ucucuuccggucggaucuc

SEQ ID NO: 522044 - RNA, 19 nt, Homo sapiens
ucugaaagugguacuugau

SEQ ID NO: 522045 - RNA, 15 nt, Homo sapiens
ucugacaacugugaa

SEQ ID NO: 522046 - RNA, 20 nt, Homo sapiens
ucugaggcccugcccaauga

SEQ ID NO: 522047 - RNA, 22 nt, Homo sapiens
ucugcaacauuugacaaaacua

SEQ ID NO: 522048 - RNA, 11 nt, Homo sapiens
ucugcacggga

SEQ ID NO: 522049 - RNA, 19 nt, Homo sapiens
ucugccauuaaaacauuac

SEQ ID NO: 522050 - RNA, 14 nt, Homo sapiens
ucugccgcuaccuc

SEQ ID NO: 522051 - RNA, 15 nt, Homo sapiens
ucugccuucugcuga

SEQ ID NO: 522052 - RNA, 20 nt, Homo sapiens
ucugcuccccuaaagccuca

SEQ ID NO: 522053 - RNA, 20 nt, Homo sapiens
ucugcugaaggcagucauau

SEQ ID NO: 522054 - RNA, 16 nt, Homo sapiens
ucuggaagucaucuca

SEQ ID NO: 522055 - RNA, 20 nt, Homo sapiens
ucuggauaccauuauauguu

SEQ ID NO: 522056 - RNA, 18 nt, Homo sapiens
ucuggccccugucauccu

SEQ ID NO: 522057 - RNA, 18 nt, Homo sapiens
ucugggcucaagcuuucc

SEQ ID NO: 522058 - RNA, 22 nt, Homo sapiens
ucuggggacagacaaggugccu

SEQ ID NO: 522059 - RNA, 21 nt, Homo sapiens
ucuggggggacccagugcaga

SEQ ID NO: 522060 - RNA, 18 nt, Homo sapiens
ucuggggugcugccugaa

SEQ ID NO: 522061 - RNA, 16 nt, Homo sapiens
ucuguacuaaaguauu

SEQ ID NO: 522062 - RNA, 13 nt, Homo sapiens
ucuguacuguuac

SEQ ID NO: 522063 - RNA, 14 nt, Homo sapiens
ucugucucaaaaca

SEQ ID NO: 522064 - RNA, 21 nt, Homo sapiens
ucugugaccccuccuugucag

SEQ ID NO: 522065 - RNA, 23 nt, Homo sapiens
ucuguucuguuggaugacuuuga

SEQ ID NO: 522066 - RNA, 14 nt, Homo sapiens
ucuguugaucucag

SEQ ID NO: 522067 - RNA, 15 nt, Homo sapiens
ucuguugaucucagu

SEQ ID NO: 522068 - RNA, 13 nt, Homo sapiens
ucuguugccaugg

SEQ ID NO: 522069 - RNA, 21 nt, Homo sapiens
ucuguuuauaaugaagaacac

SEQ ID NO: 522070 - RNA, 20 nt, Homo sapiens
ucuuaaccuuugcuauguaa

SEQ ID NO: 522071 - RNA, 18 nt, Homo sapiens
ucuuacacacugucugua

SEQ ID NO: 522072 - RNA, 20 nt, Homo sapiens
ucuuacacacugucuguaua

SEQ ID NO: 522073 - RNA, 16 nt, Homo sapiens
ucuuacaugcauuuga

SEQ ID NO: 522074 - RNA, 20 nt, Homo sapiens
ucuuacauugccaagucaga

SEQ ID NO: 522075 - RNA, 14 nt, Homo sapiens
ucuuagagcaaaga

SEQ ID NO: 522076 - RNA, 18 nt, Homo sapiens
ucuucacuucuaaaugca

SEQ ID NO: 522077 - RNA, 22 nt, Homo sapiens
gucucauuucucauaauuuugc

SEQ ID NO: 522078 - RNA, 12 nt, Homo sapiens
gucugggccagu

SEQ ID NO: 522079 - RNA, 12 nt, Homo sapiens
gucuguuugcaa

SEQ ID NO: 522080 - RNA, 18 nt, Homo sapiens
gucuguuuggacugcaga

SEQ ID NO: 522081 - RNA, 19 nt, Homo sapiens
gucuuauuugaaggccagc

SEQ ID NO: 522082 - RNA, 16 nt, Homo sapiens
gucuugaugacugcug

SEQ ID NO: 522083 - RNA, 17 nt, Homo sapiens
gucuugaugacugcuga

SEQ ID NO: 522084 - RNA, 12 nt, Homo sapiens
gucuuuuacccg

SEQ ID NO: 522085 - RNA, 19 nt, Homo sapiens
gugaaaauuacaguccaaa

SEQ ID NO: 522086 - RNA, 17 nt, Homo sapiens
gugaaauuaagcauuuu

SEQ ID NO: 522087 - RNA, 23 nt, Homo sapiens
gugaacaaacuuagaaagggaag

SEQ ID NO: 522088 - RNA, 20 nt, Homo sapiens
gugaagagggagaagcauga

SEQ ID NO: 522089 - RNA, 16 nt, Homo sapiens
gugaauaauggcacug

SEQ ID NO: 522090 - RNA, 20 nt, Homo sapiens
gugaauaggcugaugggcaa

SEQ ID NO: 522091 - RNA, 17 nt, Homo sapiens
gugacaagccaauguga

SEQ ID NO: 522092 - RNA, 15 nt, Homo sapiens
gugacagggccagug

SEQ ID NO: 522093 - RNA, 13 nt, Homo sapiens
gugacuuccucug

SEQ ID NO: 522094 - RNA, 22 nt, Homo sapiens
gugagccaagagugcacuacug

SEQ ID NO: 522095 - RNA, 14 nt, Homo sapiens
gugagcuacuuugu

SEQ ID NO: 522096 - RNA, 15 nt, Homo sapiens
gugagcugagauugc

SEQ ID NO: 522097 - RNA, 12 nt, Homo sapiens
gugagggguccc

SEQ ID NO: 522098 - RNA, 21 nt, Homo sapiens
gugauacuaagguggaugcca

SEQ ID NO: 522099 - RNA, 21 nt, Homo sapiens
gugauauuucguguacugcaa

SEQ ID NO: 522100 - RNA, 23 nt, Homo sapiens
gugcaauagacacauacauguca

SEQ ID NO: 522101 - RNA, 19 nt, Homo sapiens
gugcagccccuuccuggug

SEQ ID NO: 522102 - RNA, 15 nt, Homo sapiens
gugcaucccugagac

SEQ ID NO: 522103 - RNA, 21 nt, Homo sapiens
gugccaaaauauaaucagaga

SEQ ID NO: 522104 - RNA, 22 nt, Homo sapiens
gugccagugucauccgggccua

SEQ ID NO: 522105 - RNA, 13 nt, Homo sapiens
gugccccacaaaa

SEQ ID NO: 522106 - RNA, 15 nt, Homo sapiens
gugccugggguguua

SEQ ID NO: 522107 - RNA, 14 nt, Homo sapiens
gugccuuuugcaga

SEQ ID NO: 522108 - RNA, 20 nt, Homo sapiens
gugcgugcgcaucuugccuc

SEQ ID NO: 522109 - RNA, 15 nt, Homo sapiens
gugcuccugaaagaa

SEQ ID NO: 522110 - RNA, 23 nt, Homo sapiens
gugcucuccugacgcagcacaag

SEQ ID NO: 522111 - RNA, 20 nt, Homo sapiens
gugcucuuugcugcacuauu

SEQ ID NO: 522112 - RNA, 22 nt, Homo sapiens
guggaaagaaagaccaucuccc

SEQ ID NO: 522113 - RNA, 12 nt, Homo sapiens
guggaaugagug

SEQ ID NO: 522114 - RNA, 16 nt, Homo sapiens
guggaaugagugugca

SEQ ID NO: 522115 - RNA, 22 nt, Homo sapiens
guggcauaaauugcaucacugu

SEQ ID NO: 522116 - RNA, 22 nt, Homo sapiens
guggccaggccuuacaucuggc

SEQ ID NO: 522117 - RNA, 16 nt, Homo sapiens
guggccaggcugccug

SEQ ID NO: 522118 - RNA, 19 nt, Homo sapiens
gugggccgaggugacugca

SEQ ID NO: 522119 - RNA, 18 nt, Homo sapiens
uacaaucagcagucuagu

SEQ ID NO: 522120 - RNA, 13 nt, Homo sapiens
uacacacugucug

SEQ ID NO: 522121 - RNA, 17 nt, Homo sapiens
uacaccuuagugcagcg

SEQ ID NO: 522122 - RNA, 20 nt, Homo sapiens
uacacuuuuuggaagugaaa

SEQ ID NO: 522123 - RNA, 15 nt, Homo sapiens
uacagaaauauccau

SEQ ID NO: 522124 - RNA, 17 nt, Homo sapiens
uacagaaauauccauga

SEQ ID NO: 522125 - RNA, 21 nt, Homo sapiens
uacagguccugcugaaacugc

SEQ ID NO: 522126 - RNA, 13 nt, Homo sapiens
uacauagugaaaa

SEQ ID NO: 522127 - RNA, 18 nt, Homo sapiens
uacauauuuuuuguauau

SEQ ID NO: 522128 - RNA, 15 nt, Homo sapiens
uacaucugcaauaug

SEQ ID NO: 522129 - RNA, 16 nt, Homo sapiens
uacaugcuggggucaa

SEQ ID NO: 522130 - RNA, 14 nt, Homo sapiens
uacauuucucauac

SEQ ID NO: 522131 - RNA, 14 nt, Homo sapiens
uaccagaugcugac

SEQ ID NO: 522132 - RNA, 18 nt, Homo sapiens
uaccauuuaguaagaaua

SEQ ID NO: 522133 - RNA, 11 nt, Homo sapiens
uaccucaaggg

SEQ ID NO: 522134 - RNA, 17 nt, Homo sapiens
uaccucaagggggacug

SEQ ID NO: 522135 - RNA, 13 nt, Homo sapiens
uacuaaaguauug

SEQ ID NO: 522136 - RNA, 18 nt, Homo sapiens
uacuaacauuuucauuga

SEQ ID NO: 522137 - RNA, 20 nt, Homo sapiens
uacuaacuaaauaccauuca

SEQ ID NO: 522138 - RNA, 17 nt, Homo sapiens
uacucuggggugcugcc

SEQ ID NO: 522139 - RNA, 14 nt, Homo sapiens
uacugaauugucag

SEQ ID NO: 522140 - RNA, 20 nt, Homo sapiens
uacugcccuuucaaagcacu

SEQ ID NO: 522141 - RNA, 20 nt, Homo sapiens
uacugggucugcgaugcagc

SEQ ID NO: 522142 - RNA, 17 nt, Homo sapiens
uacugucuguuaugauu

SEQ ID NO: 522143 - RNA, 19 nt, Homo sapiens
uacuuaaaaauagucuucc

SEQ ID NO: 522144 - RNA, 16 nt, Homo sapiens
uacuuucuaugugaca

SEQ ID NO: 522145 - RNA, 11 nt, Homo sapiens
uagaaaacugg

SEQ ID NO: 522146 - RNA, 14 nt, Homo sapiens
uagaaacacugcaa

SEQ ID NO: 522147 - RNA, 23 nt, Homo sapiens
uagaaguuuggcugcugucauaa

SEQ ID NO: 522148 - RNA, 14 nt, Homo sapiens
uagaaucucuucau

SEQ ID NO: 522149 - RNA, 16 nt, Homo sapiens
uagacaaucacuacaa

SEQ ID NO: 522150 - RNA, 15 nt, Homo sapiens
uagacugugccagag

SEQ ID NO: 522151 - RNA, 15 nt, Homo sapiens
uagacuuauugccaa

SEQ ID NO: 522152 - RNA, 13 nt, Homo sapiens
uagagcccucucc

SEQ ID NO: 522153 - RNA, 20 nt, Homo sapiens
uagaguuuuaucaacuuugg

SEQ ID NO: 522154 - RNA, 22 nt, Homo sapiens
uagauaauaugaaaaucuccau

SEQ ID NO: 522155 - RNA, 21 nt, Homo sapiens
uagauauugugaaguacauau

SEQ ID NO: 522156 - RNA, 12 nt, Homo sapiens
uagaugugcauu

SEQ ID NO: 522157 - RNA, 17 nt, Homo sapiens
uagauuaagaaauagac

SEQ ID NO: 522158 - RNA, 21 nt, Homo sapiens
uagauuucuauaggauuuuuc

SEQ ID NO: 522159 - RNA, 16 nt, Homo sapiens
uagcaauaacauacau

SEQ ID NO: 522160 - RNA, 17 nt, Homo sapiens
uagcaaucugccuguau

SEQ ID NO: 522161 - RNA, 14 nt, Homo sapiens
uagcauaacuguag

SEQ ID NO: 522162 - RNA, 19 nt, Homo sapiens
uagcauuucccaacacaaa

SEQ ID NO: 522163 - RNA, 19 nt, Homo sapiens
uagccagaggcucuaaugu

SEQ ID NO: 522164 - RNA, 17 nt, Homo sapiens
uagcccuucaagugcac

SEQ ID NO: 522165 - RNA, 23 nt, Homo sapiens
uagcuaaauaaauggguguauau

SEQ ID NO: 522166 - RNA, 16 nt, Homo sapiens
uagcuggccacauggc

SEQ ID NO: 522167 - RNA, 18 nt, Homo sapiens
uaggaaacucacacuccc

SEQ ID NO: 522168 - RNA, 16 nt, Homo sapiens
uaggaagaaaauguca

SEQ ID NO: 522169 - RNA, 17 nt, Homo sapiens
uaggauguguauuucau

SEQ ID NO: 522170 - RNA, 22 nt, Homo sapiens
uaggcaaagauaauuuauuuca

SEQ ID NO: 522171 - RNA, 20 nt, Homo sapiens
uaggccaggcacaguggcuc

SEQ ID NO: 522172 - RNA, 15 nt, Homo sapiens
uaggcugcugcugug

SEQ ID NO: 522173 - RNA, 13 nt, Homo sapiens
uagucacacauag

SEQ ID NO: 522174 - RNA, 15 nt, Homo sapiens
uagucccagcuacuu

SEQ ID NO: 522175 - RNA, 13 nt, Homo sapiens
uagugaucauuua

SEQ ID NO: 522176 - RNA, 21 nt, Homo sapiens
uagugccucuguuaccaccac

SEQ ID NO: 522177 - RNA, 20 nt, Homo sapiens
uaguguaccuccucucagug

SEQ ID NO: 522178 - RNA, 18 nt, Homo sapiens
uaguguuguggacacugc

SEQ ID NO: 522179 - RNA, 14 nt, Homo sapiens
uaguuccacugaga

SEQ ID NO: 522180 - RNA, 12 nt, Homo sapiens
uauaaaccugga

SEQ ID NO: 522181 - RNA, 22 nt, Homo sapiens
uauaaagcauguggucuuauag

SEQ ID NO: 522182 - RNA, 19 nt, Homo sapiens
uauaaccauaugauacuau

SEQ ID NO: 522183 - RNA, 16 nt, Homo sapiens
uauaauuggugcauag

SEQ ID NO: 522184 - RNA, 16 nt, Homo sapiens
uauacaugaccuuaau

SEQ ID NO: 522185 - RNA, 17 nt, Homo sapiens
uauacuuugccacugcu

SEQ ID NO: 522186 - RNA, 20 nt, Homo sapiens
uauacuuugccacugcugua

SEQ ID NO: 522187 - RNA, 18 nt, Homo sapiens
uauagcuuugccaugugg

SEQ ID NO: 522188 - RNA, 20 nt, Homo sapiens
uauaguguuuggacagcuga

SEQ ID NO: 522189 - RNA, 18 nt, Homo sapiens
uauauacuuugccacugc

SEQ ID NO: 522190 - RNA, 13 nt, Homo sapiens
uauauuguucaaa

SEQ ID NO: 522191 - RNA, 21 nt, Homo sapiens
uauauuuugugugaaauugca

SEQ ID NO: 522192 - RNA, 12 nt, Homo sapiens
uaucaaacugaa

SEQ ID NO: 522193 - RNA, 18 nt, Homo sapiens
uaucacaguaacccagag

SEQ ID NO: 522194 - RNA, 17 nt, Homo sapiens
uaucauguauggugaua

SEQ ID NO: 522195 - RNA, 21 nt, Homo sapiens
uauccugggagcacugcguuu

SEQ ID NO: 522196 - RNA, 14 nt, Homo sapiens
uauccuuucacucu

SEQ ID NO: 522197 - RNA, 12 nt, Homo sapiens
uaucugcugcac

SEQ ID NO: 522198 - RNA, 14 nt, Homo sapiens
uaugaaaagaauuu

SEQ ID NO: 522199 - RNA, 15 nt, Homo sapiens
uaugaaaaucuccau

SEQ ID NO: 522200 - RNA, 14 nt, Homo sapiens
ucaaaauauuucuc

SEQ ID NO: 522201 - RNA, 16 nt, Homo sapiens
ucaaaauauuucucau

SEQ ID NO: 522202 - RNA, 15 nt, Homo sapiens
ucaaacccauucccu

SEQ ID NO: 522203 - RNA, 22 nt, Homo sapiens
ucaaacuggagagaagcaagcc

SEQ ID NO: 522204 - RNA, 13 nt, Homo sapiens
ucaaagccuucuc

SEQ ID NO: 522205 - RNA, 17 nt, Homo sapiens
ucaaauacacauuugcu

SEQ ID NO: 522206 - RNA, 14 nt, Homo sapiens
ucaaauauuugcug

SEQ ID NO: 522207 - RNA, 21 nt, Homo sapiens
ucaaauuuccuuucauaccuu

SEQ ID NO: 522208 - RNA, 17 nt, Homo sapiens
ucaacaggucacuugau

SEQ ID NO: 522209 - RNA, 15 nt, Homo sapiens
ucaagaaaaucuuug

SEQ ID NO: 522210 - RNA, 14 nt, Homo sapiens
ucaagaauagcauu

SEQ ID NO: 522211 - RNA, 18 nt, Homo sapiens
ucaagcaccugcaugugc

SEQ ID NO: 522212 - RNA, 18 nt, Homo sapiens
ucaagcugagauugagca

SEQ ID NO: 522213 - RNA, 19 nt, Homo sapiens
ucaaggcaguagaacucca

SEQ ID NO: 522214 - RNA, 17 nt, Homo sapiens
ucaagggcuuacuauuu

SEQ ID NO: 522215 - RNA, 18 nt, Homo sapiens
ucaagguuuaaccuuaaa

SEQ ID NO: 522216 - RNA, 19 nt, Homo sapiens
ucaauaaagauuucaagau

SEQ ID NO: 522217 - RNA, 23 nt, Homo sapiens
ucaaucuguccguucacaugugu

SEQ ID NO: 522218 - RNA, 20 nt, Homo sapiens
ucaauguuuguucauuacuu

SEQ ID NO: 522219 - RNA, 15 nt, Homo sapiens
ucaauuauuugcaua

SEQ ID NO: 522220 - RNA, 21 nt, Homo sapiens
ucacaucccauugggacucca

SEQ ID NO: 522221 - RNA, 21 nt, Homo sapiens
ucaccaaggaaacgcuaccuc

SEQ ID NO: 522222 - RNA, 18 nt, Homo sapiens
ucaccuggaugugcagcc

SEQ ID NO: 522223 - RNA, 14 nt, Homo sapiens
ucacggccaagugu

SEQ ID NO: 522224 - RNA, 14 nt, Homo sapiens
ucacucaaccuuau

SEQ ID NO: 522225 - RNA, 16 nt, Homo sapiens
ucacucucaaacuuca

SEQ ID NO: 522226 - RNA, 19 nt, Homo sapiens
ucacucucaaacuucacua

SEQ ID NO: 522227 - RNA, 16 nt, Homo sapiens
ucacugaaaccaggug

SEQ ID NO: 522228 - RNA, 17 nt, Homo sapiens
ucacugaaaccaggugg

SEQ ID NO: 522229 - RNA, 14 nt, Homo sapiens
ucacugacaguuaa

SEQ ID NO: 522230 - RNA, 12 nt, Homo sapiens
ucacugcugauc

SEQ ID NO: 522231 - RNA, 24 nt, Homo sapiens
ucacuggccccuacuuuguggcaa

SEQ ID NO: 522232 - RNA, 18 nt, Homo sapiens
ucacuuccuuugcccuuc

SEQ ID NO: 522233 - RNA, 17 nt, Homo sapiens
ucacuugaucaugcugc

SEQ ID NO: 522234 - RNA, 14 nt, Homo sapiens
ucacuuuucagaag

SEQ ID NO: 522235 - RNA, 14 nt, Homo sapiens
ucagaagugcagaa

SEQ ID NO: 522236 - RNA, 15 nt, Homo sapiens
ucagacaagcugcau

SEQ ID NO: 522237 - RNA, 13 nt, Homo sapiens
ucagacacagcuc

SEQ ID NO: 522238 - RNA, 16 nt, Homo sapiens
ucagagaacuuuccca

SEQ ID NO: 522239 - RNA, 17 nt, Homo sapiens
ucagaggagcgcaggca

SEQ ID NO: 522240 - RNA, 16 nt, Homo sapiens
ucagaucucaugggau

SEQ ID NO: 522241 - RNA, 20 nt, Homo sapiens
ucagaugguacggacuuccu

SEQ ID NO: 522242 - RNA, 21 nt, Homo sapiens
ucagauuuuuuccucugcauu

SEQ ID NO: 522243 - RNA, 19 nt, Homo sapiens
ucagcacauucgggaccaa

SEQ ID NO: 522244 - RNA, 23 nt, Homo sapiens
ucagcacugauggaaaauaccag

SEQ ID NO: 522245 - RNA, 18 nt, Homo sapiens
ucagccacauauugagau

SEQ ID NO: 522246 - RNA, 14 nt, Homo sapiens
ucagcucuugucaa

SEQ ID NO: 522247 - RNA, 15 nt, Homo sapiens
ucagcugaaugccuc

SEQ ID NO: 522248 - RNA, 18 nt, Homo sapiens
ucagcugccccaauguga

SEQ ID NO: 522249 - RNA, 15 nt, Homo sapiens
ucagcugccuccugc

SEQ ID NO: 522250 - RNA, 23 nt, Homo sapiens
ucaggaaagagagcaccacguga

SEQ ID NO: 522251 - RNA, 23 nt, Homo sapiens
ucaggagaaccuaacaugcuggu

SEQ ID NO: 522252 - RNA, 20 nt, Homo sapiens
ucaggcuucugcaguucuca

SEQ ID NO: 522253 - RNA, 21 nt, Homo sapiens
ucaggugauccgccuaccuca

SEQ ID NO: 522254 - RNA, 21 nt, Homo sapiens
ucaggugccuuugaguucuag

SEQ ID NO: 522255 - RNA, 19 nt, Homo sapiens
ucaguaaauagugucauau

SEQ ID NO: 522256 - RNA, 21 nt, Homo sapiens
ucaguaacaaguguuggcaaa

SEQ ID NO: 522257 - RNA, 17 nt, Homo sapiens
ucagucgcuagcauuuc

SEQ ID NO: 522258 - RNA, 21 nt, Homo sapiens
ucagugccuacccaccuguga

SEQ ID NO: 522259 - RNA, 23 nt, Homo sapiens
ucauaaagagguaaaaaacuguc

SEQ ID NO: 522260 - RNA, 15 nt, Homo sapiens
ucauaagacaaugga

SEQ ID NO: 522261 - RNA, 15 nt, Homo sapiens
ucauaauuuugcaaa

SEQ ID NO: 522262 - RNA, 24 nt, Homo sapiens
ucauaccguguaccucaguucccu

SEQ ID NO: 522263 - RNA, 19 nt, Homo sapiens
ucauaccucagaauguaaa

SEQ ID NO: 522264 - RNA, 23 nt, Homo sapiens
ucauauauuuuuaccaucugcug

SEQ ID NO: 522265 - RNA, 15 nt, Homo sapiens
ucaucacacucucca

SEQ ID NO: 522266 - RNA, 15 nt, Homo sapiens
ucaucacauucaggg

SEQ ID NO: 522267 - RNA, 21 nt, Homo sapiens
ucaucaggaaggaaaugacac

SEQ ID NO: 522268 - RNA, 14 nt, Homo sapiens
ucaucauccuacaa

SEQ ID NO: 522269 - RNA, 16 nt, Homo sapiens
ucaucauucccucuca

SEQ ID NO: 522270 - RNA, 17 nt, Homo sapiens
ucaucauugugcuagcu

SEQ ID NO: 522271 - RNA, 14 nt, Homo sapiens
ucauccaacuuaug

SEQ ID NO: 522272 - RNA, 14 nt, Homo sapiens
ucaucuucacugca

SEQ ID NO: 522273 - RNA, 15 nt, Homo sapiens
ucaucuucacugcaa

SEQ ID NO: 522274 - RNA, 19 nt, Homo sapiens
ucaugccauugcauuccag

SEQ ID NO: 522275 - RNA, 18 nt, Homo sapiens
ucaugccuguaaucccag

SEQ ID NO: 522276 - RNA, 23 nt, Homo sapiens
ucaugccuguaaucccagcacuu

SEQ ID NO: 522277 - RNA, 14 nt, Homo sapiens
ucaugcuugacaua

SEQ ID NO: 522278 - RNA, 18 nt, Homo sapiens
ucaugcuugacauaccua

SEQ ID NO: 522279 - RNA, 20 nt, Homo sapiens
ucaugcuuuugcuugcaaug

SEQ ID NO: 522280 - RNA, 23 nt, Homo sapiens
ucaugguuuccuccagaggagac

SEQ ID NO: 522281 - RNA, 17 nt, Homo sapiens
ucauguguggaaauggg

SEQ ID NO: 522282 - RNA, 18 nt, Homo sapiens
ucauucaacucuccaaug

SEQ ID NO: 522283 - RNA, 23 nt, Homo sapiens
ucauucaacucuccaauguucua

SEQ ID NO: 522284 - RNA, 23 nt, Homo sapiens
ucauugaugagcaagacauacuu

SEQ ID NO: 522285 - RNA, 20 nt, Homo sapiens
uccaaaaauagcccugcaaa

SEQ ID NO: 522286 - RNA, 21 nt, Homo sapiens
uccaaaaauagcccugcaaaa

SEQ ID NO: 522287 - RNA, 18 nt, Homo sapiens
uccaaacuguucugagaa

SEQ ID NO: 522288 - RNA, 15 nt, Homo sapiens
uccaaagaggcugcc

SEQ ID NO: 522289 - RNA, 19 nt, Homo sapiens
uccaacaacgacacauuca

SEQ ID NO: 522290 - RNA, 11 nt, Homo sapiens
uccacuuguau

SEQ ID NO: 522291 - RNA, 16 nt, Homo sapiens
uccagaguaagugaug

SEQ ID NO: 522292 - RNA, 17 nt, Homo sapiens
uccagaguucugugaca

SEQ ID NO: 522293 - RNA, 20 nt, Homo sapiens
uccagccaaccucauugcag

SEQ ID NO: 522294 - RNA, 20 nt, Homo sapiens
uccagggcuauaggguguga

SEQ ID NO: 522295 - RNA, 15 nt, Homo sapiens
uccagguuuaugaau

SEQ ID NO: 522296 - RNA, 21 nt, Homo sapiens
uccaguccaaagccggcuuga

SEQ ID NO: 522297 - RNA, 14 nt, Homo sapiens
uccagugcaauugu

SEQ ID NO: 522298 - RNA, 15 nt, Homo sapiens
uccauaccaucuggu

SEQ ID NO: 522299 - RNA, 14 nt, Homo sapiens
uccaucucccuuag

SEQ ID NO: 522300 - RNA, 13 nt, Homo sapiens
uccaucucucauc

SEQ ID NO: 522301 - RNA, 21 nt, Homo sapiens
uccaucucucauccuccagua

SEQ ID NO: 522302 - RNA, 20 nt, Homo sapiens
uccaugauuuuaaauuguga

SEQ ID NO: 522303 - RNA, 22 nt, Homo sapiens
uccaugcaacuggaguuccuua

SEQ ID NO: 522304 - RNA, 22 nt, Homo sapiens
uccaugugccuuucuuugccuc

SEQ ID NO: 522305 - RNA, 16 nt, Homo sapiens
uccauuauuccucuca

SEQ ID NO: 522306 - RNA, 19 nt, Homo sapiens
uccauucuguagacuuuug

SEQ ID NO: 522307 - RNA, 16 nt, Homo sapiens
uccauugucugagucu

SEQ ID NO: 522308 - RNA, 16 nt, Homo sapiens
uccauuugcaaauaua

SEQ ID NO: 522309 - RNA, 14 nt, Homo sapiens
ucccaacugagugu

SEQ ID NO: 522310 - RNA, 15 nt, Homo sapiens
ucccaccgaacacua

SEQ ID NO: 522311 - RNA, 14 nt, Homo sapiens
ucccaccugcacac

SEQ ID NO: 522312 - RNA, 13 nt, Homo sapiens
ucccacuguauga

SEQ ID NO: 522313 - RNA, 15 nt, Homo sapiens
ucccagcuacuuggg

SEQ ID NO: 522314 - RNA, 14 nt, Homo sapiens
ucccauccuugaug

SEQ ID NO: 522315 - RNA, 15 nt, Homo sapiens
uccccaacaugcacu

SEQ ID NO: 522316 - RNA, 22 nt, Homo sapiens
uccccacaggagcccugcagug

SEQ ID NO: 522317 - RNA, 18 nt, Homo sapiens
uccccacccugucuucca

SEQ ID NO: 522318 - RNA, 17 nt, Homo sapiens
uccccacugcugagcug

SEQ ID NO: 522319 - RNA, 16 nt, Homo sapiens
uccccagaugugacua

SEQ ID NO: 522320 - RNA, 20 nt, Homo sapiens
acucuggggugcugccugaa

SEQ ID NO: 522321 - RNA, 18 nt, Homo sapiens
acucugucacccuagcua

SEQ ID NO: 522322 - RNA, 16 nt, Homo sapiens
acugaaauauaccuuu

SEQ ID NO: 522323 - RNA, 15 nt, Homo sapiens
acugaaccauuccaa

SEQ ID NO: 522324 - RNA, 16 nt, Homo sapiens
acugacaaccucaucc

SEQ ID NO: 522325 - RNA, 19 nt, Homo sapiens
acugacaaccucauccagg

SEQ ID NO: 522326 - RNA, 20 nt, Homo sapiens
acugacuuuccgagccucca

SEQ ID NO: 522327 - RNA, 20 nt, Homo sapiens
acugcaaagcucggugcucc

SEQ ID NO: 522328 - RNA, 15 nt, Homo sapiens
acugcaaccucugcc

SEQ ID NO: 522329 - RNA, 16 nt, Homo sapiens
acugcaggaccuccag

SEQ ID NO: 522330 - RNA, 17 nt, Homo sapiens
acugcaggaccuccagc

SEQ ID NO: 522331 - RNA, 21 nt, Homo sapiens
acugcccuuucaaagcacuua

SEQ ID NO: 522332 - RNA, 12 nt, Homo sapiens
acugcugagcug

SEQ ID NO: 522333 - RNA, 12 nt, Homo sapiens
acugcugcacaa

SEQ ID NO: 522334 - RNA, 13 nt, Homo sapiens
acuggaaaacugc

SEQ ID NO: 522335 - RNA, 13 nt, Homo sapiens
acuggcagcaucu

SEQ ID NO: 522336 - RNA, 16 nt, Homo sapiens
acuggcagcaucuuca

SEQ ID NO: 522337 - RNA, 16 nt, Homo sapiens
acugggacgccuucag

SEQ ID NO: 522338 - RNA, 17 nt, Homo sapiens
acugggccuuagugggc

SEQ ID NO: 522339 - RNA, 20 nt, Homo sapiens
acugggccuuagugggccag

SEQ ID NO: 522340 - RNA, 20 nt, Homo sapiens
acuggucccaagguguaaag

SEQ ID NO: 522341 - RNA, 18 nt, Homo sapiens
acuguagcucaaguuuaa

SEQ ID NO: 522342 - RNA, 18 nt, Homo sapiens
acuguggcuagugacaaa

SEQ ID NO: 522343 - RNA, 23 nt, Homo sapiens
acugugucauucuguuagauacu

SEQ ID NO: 522344 - RNA, 15 nt, Homo sapiens
acugugucucaugga

SEQ ID NO: 522345 - RNA, 17 nt, Homo sapiens
acuuagcgucaagacau

SEQ ID NO: 522346 - RNA, 14 nt, Homo sapiens
acuuccagcauuua

SEQ ID NO: 522347 - RNA, 19 nt, Homo sapiens
acuuccaggggaaccugcc

SEQ ID NO: 522348 - RNA, 14 nt, Homo sapiens
acuuccaucccugc

SEQ ID NO: 522349 - RNA, 18 nt, Homo sapiens
acuuccuacguauccugc

SEQ ID NO: 522350 - RNA, 23 nt, Homo sapiens
acuucugcaacaagcaugcagcu

SEQ ID NO: 522351 - RNA, 16 nt, Homo sapiens
acuucugcuggcauca

SEQ ID NO: 522352 - RNA, 23 nt, Homo sapiens
acuucuuaaauauuuaguugaua

SEQ ID NO: 522353 - RNA, 11 nt, Homo sapiens
acuugcaauac

SEQ ID NO: 522354 - RNA, 18 nt, Homo sapiens
acuuggaccucagccaac

SEQ ID NO: 522355 - RNA, 14 nt, Homo sapiens
acuuuaaccuuaga

SEQ ID NO: 522356 - RNA, 12 nt, Homo sapiens
acuuucauguca

SEQ ID NO: 522357 - RNA, 23 nt, Homo sapiens
acuuuccgagccuccaguccaaa

SEQ ID NO: 522358 - RNA, 23 nt, Homo sapiens
acuuuguaauaccagaacucuaa

SEQ ID NO: 522359 - RNA, 17 nt, Homo sapiens
acuuugugacugucacu

SEQ ID NO: 522360 - RNA, 22 nt, Homo sapiens
acuuuuacacgaccauuugaua

SEQ ID NO: 522361 - RNA, 23 nt, Homo sapiens
acuuuuauuuuuugguggugaaa

SEQ ID NO: 522362 - RNA, 12 nt, Homo sapiens
acuuuucauccu

SEQ ID NO: 522363 - RNA, 19 nt, Homo sapiens
acuuuucggagacagugac

SEQ ID NO: 522364 - RNA, 20 nt, Homo sapiens
agaaaaccuaagcaaacuua

SEQ ID NO: 522365 - RNA, 14 nt, Homo sapiens
agaaaacugugauu

SEQ ID NO: 522366 - RNA, 21 nt, Homo sapiens
agaaaagugcauauuuaucca

SEQ ID NO: 522367 - RNA, 15 nt, Homo sapiens
agaaaccacuagaaa

SEQ ID NO: 522368 - RNA, 12 nt, Homo sapiens
agaaacucccau

SEQ ID NO: 522369 - RNA, 14 nt, Homo sapiens
agaaagauuugaug

SEQ ID NO: 522370 - RNA, 23 nt, Homo sapiens
agaaagcagccauuggcacugug

SEQ ID NO: 522371 - RNA, 22 nt, Homo sapiens
agaaaugcaauaacucugggag

SEQ ID NO: 522372 - RNA, 15 nt, Homo sapiens
agaacucauucauag

SEQ ID NO: 522373 - RNA, 19 nt, Homo sapiens
agaagauccaagaggcccu

SEQ ID NO: 522374 - RNA, 13 nt, Homo sapiens
agaagcaaguggu

SEQ ID NO: 522375 - RNA, 12 nt, Homo sapiens
agaagcacuuga

SEQ ID NO: 522376 - RNA, 21 nt, Homo sapiens
agaagcaguuguaccaaguga

SEQ ID NO: 522377 - RNA, 15 nt, Homo sapiens
agaagccgugggaag

SEQ ID NO: 522378 - RNA, 20 nt, Homo sapiens
agaagguuucuggagcagug

SEQ ID NO: 522379 - RNA, 14 nt, Homo sapiens
agaaguaacugucc

SEQ ID NO: 522380 - RNA, 13 nt, Homo sapiens
agcucgugugccu

SEQ ID NO: 522381 - RNA, 20 nt, Homo sapiens
agcucucuccuaauauucca

SEQ ID NO: 522382 - RNA, 12 nt, Homo sapiens
agcucuucccac

SEQ ID NO: 522383 - RNA, 14 nt, Homo sapiens
agcucuuccuaucc

SEQ ID NO: 522384 - RNA, 13 nt, Homo sapiens
agcugaccuggag

SEQ ID NO: 522385 - RNA, 13 nt, Homo sapiens
agcugcauuucag

SEQ ID NO: 522386 - RNA, 19 nt, Homo sapiens
agcugcuauccccaucucc

SEQ ID NO: 522387 - RNA, 19 nt, Homo sapiens
agcuggccuucugcuucug

SEQ ID NO: 522388 - RNA, 20 nt, Homo sapiens
agcugggaugacuggcuuug

SEQ ID NO: 522389 - RNA, 17 nt, Homo sapiens
agcugucccaccugcac

SEQ ID NO: 522390 - RNA, 19 nt, Homo sapiens
agcugucccaccugcacac

SEQ ID NO: 522391 - RNA, 19 nt, Homo sapiens
agcuuaaugcuacauguga

SEQ ID NO: 522392 - RNA, 17 nt, Homo sapiens
agcuuaucucuuuuaua

SEQ ID NO: 522393 - RNA, 14 nt, Homo sapiens
agcuucuccaggaa

SEQ ID NO: 522394 - RNA, 22 nt, Homo sapiens
agcuuguugucuccacuuguau

SEQ ID NO: 522395 - RNA, 13 nt, Homo sapiens
agcuuucugccau

SEQ ID NO: 522396 - RNA, 15 nt, Homo sapiens
aggaaaacgugcuuu

SEQ ID NO: 522397 - RNA, 22 nt, Homo sapiens
aggaacagauuuugcuaagaca

SEQ ID NO: 522398 - RNA, 17 nt, Homo sapiens
aggaauccccaacaugc

SEQ ID NO: 522399 - RNA, 13 nt, Homo sapiens
aggaauucugcaa

SEQ ID NO: 522400 - RNA, 15 nt, Homo sapiens
aggacaaagugccca

SEQ ID NO: 522401 - RNA, 15 nt, Homo sapiens
aggagagaaaacugc

SEQ ID NO: 522402 - RNA, 15 nt, Homo sapiens
aggagcccugcagug

SEQ ID NO: 522403 - RNA, 12 nt, Homo sapiens
aggaggacaaaa

SEQ ID NO: 522404 - RNA, 21 nt, Homo sapiens
aggagggucccgguguauccu

SEQ ID NO: 522405 - RNA, 11 nt, Homo sapiens
aggaguacaau

SEQ ID NO: 522406 - RNA, 17 nt, Homo sapiens
aggaguacaaugcccag

SEQ ID NO: 522407 - RNA, 19 nt, Homo sapiens
aggaguacuccaagacaga

SEQ ID NO: 522408 - RNA, 12 nt, Homo sapiens
aggaucacuuga

SEQ ID NO: 522409 - RNA, 14 nt, Homo sapiens
aggauuguggucac

SEQ ID NO: 522410 - RNA, 21 nt, Homo sapiens
aggauuugaaccaugaaguca

SEQ ID NO: 522411 - RNA, 17 nt, Homo sapiens
aggcaaauuaacuguau

SEQ ID NO: 522412 - RNA, 18 nt, Homo sapiens
aggcaauuccuaccucuu

SEQ ID NO: 522413 - RNA, 12 nt, Homo sapiens
aggcacugcuga

SEQ ID NO: 522414 - RNA, 16 nt, Homo sapiens
aggcagcgcagggcug

SEQ ID NO: 522415 - RNA, 17 nt, Homo sapiens
aggcagcucgugugccu

SEQ ID NO: 522416 - RNA, 18 nt, Homo sapiens
aggcagcuucuacuccug

SEQ ID NO: 522417 - RNA, 19 nt, Homo sapiens
aggcagcuucuacuccugc

SEQ ID NO: 522418 - RNA, 22 nt, Homo sapiens
aggcagugacagcagucaggga

SEQ ID NO: 522419 - RNA, 20 nt, Homo sapiens
aggcauuaauguuucuaucu

SEQ ID NO: 522420 - RNA, 20 nt, Homo sapiens
aggcauugauugcacuugau

SEQ ID NO: 522421 - RNA, 22 nt, Homo sapiens
aggccaccccuaggaacucagu

SEQ ID NO: 522422 - RNA, 18 nt, Homo sapiens
aggccagcaacucccagc

SEQ ID NO: 522423 - RNA, 16 nt, Homo sapiens
aggccagcaggggcuu

SEQ ID NO: 522424 - RNA, 16 nt, Homo sapiens
aggccaggcacagugg

SEQ ID NO: 522425 - RNA, 14 nt, Homo sapiens
aggccagugugucu

SEQ ID NO: 522426 - RNA, 17 nt, Homo sapiens
aggccuauuuauuaaua

SEQ ID NO: 522427 - RNA, 21 nt, Homo sapiens
aggccugccucccacuucacu

SEQ ID NO: 522428 - RNA, 16 nt, Homo sapiens
aggccugguguguuca

SEQ ID NO: 522429 - RNA, 16 nt, Homo sapiens
aggcgcacagugugag

SEQ ID NO: 522430 - RNA, 17 nt, Homo sapiens
aggcgccgcacuuccuu

SEQ ID NO: 522431 - RNA, 15 nt, Homo sapiens
aggcucagauuguaa

SEQ ID NO: 522432 - RNA, 17 nt, Homo sapiens
aggcucuaauguacaau

SEQ ID NO: 522433 - RNA, 18 nt, Homo sapiens
aggcucuaauguacaaua

SEQ ID NO: 522434 - RNA, 22 nt, Homo sapiens
aggcucuaauguacaauaaagc

SEQ ID NO: 522435 - RNA, 19 nt, Homo sapiens
aggcugccccucucaccaa

SEQ ID NO: 522436 - RNA, 16 nt, Homo sapiens
aggcugggccaugucc

SEQ ID NO: 522437 - RNA, 23 nt, Homo sapiens
aggcugggccauguccaaagagg

SEQ ID NO: 522438 - RNA, 16 nt, Homo sapiens
aggcuuucuguugcca

SEQ ID NO: 522439 - RNA, 14 nt, Homo sapiens
agggagaacgggaa

SEQ ID NO: 522440 - RNA, 20 nt, Homo sapiens
agggauauuuuuuucuauua

SEQ ID NO: 522441 - RNA, 15 nt, Homo sapiens
agggcaacuguagaa

SEQ ID NO: 522442 - RNA, 20 nt, Homo sapiens
agggccagaccugccugcau

SEQ ID NO: 522443 - RNA, 17 nt, Homo sapiens
agggcccuccgaccacu

SEQ ID NO: 522444 - RNA, 20 nt, Homo sapiens
aacaaauguggcuccaagcu

SEQ ID NO: 522445 - RNA, 20 nt, Homo sapiens
aacaacguugacaaguuuug

SEQ ID NO: 522446 - RNA, 18 nt, Homo sapiens
aacaauaaaguacuuuac

SEQ ID NO: 522447 - RNA, 22 nt, Homo sapiens
aacaauaaaguacuuuaccuaa

SEQ ID NO: 522448 - RNA, 17 nt, Homo sapiens
aacaauucccccauccu

SEQ ID NO: 522449 - RNA, 21 nt, Homo sapiens
aacacagcauguguauuucca

SEQ ID NO: 522450 - RNA, 14 nt, Homo sapiens
aacacggugcucau

SEQ ID NO: 522451 - RNA, 13 nt, Homo sapiens
aacacuacagugg

SEQ ID NO: 522452 - RNA, 22 nt, Homo sapiens
aacacuccauuauuccucucac

SEQ ID NO: 522453 - RNA, 14 nt, Homo sapiens
aacacugcccucuu

SEQ ID NO: 522454 - RNA, 16 nt, Homo sapiens
aacagaucuccuggca

SEQ ID NO: 522455 - RNA, 17 nt, Homo sapiens
aacagcaauggugucag

SEQ ID NO: 522456 - RNA, 18 nt, Homo sapiens
aacaguuguauguuugcu

SEQ ID NO: 522457 - RNA, 21 nt, Homo sapiens
aacaguuguauguuugcugau

SEQ ID NO: 522458 - RNA, 23 nt, Homo sapiens
aacauccuggcuuuugagcacuu

SEQ ID NO: 522459 - RNA, 16 nt, Homo sapiens
aacaucuguuaucaaa

SEQ ID NO: 522460 - RNA, 16 nt, Homo sapiens
aacauguacuacagcu

SEQ ID NO: 522461 - RNA, 16 nt, Homo sapiens
aacauguauguauaca

SEQ ID NO: 522462 - RNA, 18 nt, Homo sapiens
aacauuugcugccauuac

SEQ ID NO: 522463 - RNA, 23 nt, Homo sapiens
aaccagauguuagaucaggggag

SEQ ID NO: 522464 - RNA, 15 nt, Homo sapiens
aaccaggaaauggaa

SEQ ID NO: 522465 - RNA, 20 nt, Homo sapiens
aacccugggcuauugcugcu

SEQ ID NO: 522466 - RNA, 19 nt, Homo sapiens
aaccggcauauuauuccau

SEQ ID NO: 522467 - RNA, 23 nt, Homo sapiens
aaccuaguacugccccccaugag

SEQ ID NO: 522468 - RNA, 14 nt, Homo sapiens
aaccuccuuuacca

SEQ ID NO: 522469 - RNA, 23 nt, Homo sapiens
aaccuguccuaaggaaccuuccu

SEQ ID NO: 522470 - RNA, 19 nt, Homo sapiens
aaccuuccuuccugcuuga

SEQ ID NO: 522471 - RNA, 23 nt, Homo sapiens
aacgauuuuaugaaaugaccucu

SEQ ID NO: 522472 - RNA, 16 nt, Homo sapiens
aacuaaucaccauauu

SEQ ID NO: 522473 - RNA, 16 nt, Homo sapiens
aacuacuuccaucccu

SEQ ID NO: 522474 - RNA, 15 nt, Homo sapiens
aacucaguccuguac

SEQ ID NO: 522475 - RNA, 14 nt, Homo sapiens
aacuccugaccuca

SEQ ID NO: 522476 - RNA, 17 nt, Homo sapiens
aacucugggcugccaug

SEQ ID NO: 522477 - RNA, 18 nt, Homo sapiens
aacucugggcugccaugu

SEQ ID NO: 522478 - RNA, 12 nt, Homo sapiens
aacucuguuaca

SEQ ID NO: 522479 - RNA, 11 nt, Homo sapiens
aacucuucagu

SEQ ID NO: 522480 - RNA, 16 nt, Homo sapiens
aacucuucagugcaaa

SEQ ID NO: 522481 - RNA, 22 nt, Homo sapiens
aacucuuuaucaagcaacauuc

SEQ ID NO: 522482 - RNA, 16 nt, Homo sapiens
aacugagaccaaagaa

SEQ ID NO: 522483 - RNA, 17 nt, Homo sapiens
aacugcguggugcucuu

SEQ ID NO: 522484 - RNA, 10 nt, Homo sapiens
aacugugaac

SEQ ID NO: 522485 - RNA, 20 nt, Homo sapiens
aacugugcugaaugcuuuag

SEQ ID NO: 522486 - RNA, 13 nt, Homo sapiens
aacuucagugugg

SEQ ID NO: 522487 - RNA, 17 nt, Homo sapiens
aagaaauacagacugga

SEQ ID NO: 522488 - RNA, 22 nt, Homo sapiens
aagaauacccaggaagacuuug

SEQ ID NO: 522489 - RNA, 16 nt, Homo sapiens
aagaaugaacacuccc

SEQ ID NO: 522490 - RNA, 23 nt, Homo sapiens
aagaauuaaugacuuacuuuaau

SEQ ID NO: 522491 - RNA, 17 nt, Homo sapiens
aagacugaaucuaccug

SEQ ID NO: 522492 - RNA, 11 nt, Homo sapiens
aagacuugaga

SEQ ID NO: 522493 - RNA, 23 nt, Homo sapiens
aagagagcgagacccugucucaa

SEQ ID NO: 522494 - RNA, 14 nt, Homo sapiens
aagagaucuacaca

SEQ ID NO: 522495 - RNA, 13 nt, Homo sapiens
aagagcuaauaaa

SEQ ID NO: 522496 - RNA, 22 nt, Homo sapiens
aagaguauuuuaagaagacaua

SEQ ID NO: 522497 - RNA, 19 nt, Homo sapiens
aagagucuacccgacauaa

SEQ ID NO: 522498 - RNA, 17 nt, Homo sapiens
aagaugugaaaauuaca

SEQ ID NO: 522499 - RNA, 23 nt, Homo sapiens
aagauucugaccuuaaaugcaac

SEQ ID NO: 522500 - RNA, 20 nt, Homo sapiens
aagauucuuaaaaauugaau

SEQ ID NO: 522501 - RNA, 19 nt, Homo sapiens
aagcaaguguucacaacag

SEQ ID NO: 522502 - RNA, 11 nt, Homo sapiens
aagcaaugugg

SEQ ID NO: 522503 - RNA, 12 nt, Homo sapiens
aagcaauguggu

SEQ ID NO: 522504 - RNA, 20 nt, Homo sapiens
aagcagagccuccugggaac

SEQ ID NO: 522505 - RNA, 19 nt, Homo sapiens
aagcagucuugcucuguua

SEQ ID NO: 522506 - RNA, 20 nt, Homo sapiens
aagcaguuacuaauaugccu

SEQ ID NO: 522507 - RNA, 15 nt, Homo sapiens
aagcaugaaaaagca

SEQ ID NO: 522508 - RNA, 18 nt, Homo sapiens
aagcauuguuugugauau

SEQ ID NO: 522509 - RNA, 16 nt, Homo sapiens
aagcauuuucauuucu

SEQ ID NO: 522510 - RNA, 12 nt, Homo sapiens
aagccagggucu

SEQ ID NO: 522511 - RNA, 19 nt, Homo sapiens
aagccccagaguggcucac

SEQ ID NO: 522512 - RNA, 20 nt, Homo sapiens
aagccucuggucacauggcu

SEQ ID NO: 522513 - RNA, 19 nt, Homo sapiens
auaaaggcagcugccucug

SEQ ID NO: 522514 - RNA, 22 nt, Homo sapiens
auaaaggcagcugccucugcuc

SEQ ID NO: 522515 - RNA, 22 nt, Homo sapiens
auaaaucucuucuuugcugcag

SEQ ID NO: 522516 - RNA, 20 nt, Homo sapiens
auaaaugauuaaaaaaucag

SEQ ID NO: 522517 - RNA, 15 nt, Homo sapiens
auaacauacaugaga

SEQ ID NO: 522518 - RNA, 16 nt, Homo sapiens
auaacuaaacuaacga

SEQ ID NO: 522519 - RNA, 13 nt, Homo sapiens
auaacuacuucca

SEQ ID NO: 522520 - RNA, 17 nt, Homo sapiens
auaacuacuuccauccc

SEQ ID NO: 522521 - RNA, 16 nt, Homo sapiens
auaacucaagaaauca

SEQ ID NO: 522522 - RNA, 13 nt, Homo sapiens
auaagucuuucau

SEQ ID NO: 522523 - RNA, 15 nt, Homo sapiens
auaauaaauacucag

SEQ ID NO: 522524 - RNA, 15 nt, Homo sapiens
auacaggaauuauua

SEQ ID NO: 522525 - RNA, 15 nt, Homo sapiens
auacauagugaaaau

SEQ ID NO: 522526 - RNA, 23 nt, Homo sapiens
auacauucccucuaauuugaacu

SEQ ID NO: 522527 - RNA, 19 nt, Homo sapiens
auaccaaguugauacuuga

SEQ ID NO: 522528 - RNA, 22 nt, Homo sapiens
auaccaauuacauggaacuuuu

SEQ ID NO: 522529 - RNA, 18 nt, Homo sapiens
auaccaggcagugugcca

SEQ ID NO: 522530 - RNA, 23 nt, Homo sapiens
auaccuuauuuauuuuuguguag

SEQ ID NO: 522531 - RNA, 15 nt, Homo sapiens
auacguagcucucuu

SEQ ID NO: 522532 - RNA, 19 nt, Homo sapiens
auacuaacauuuucauuga

SEQ ID NO: 522533 - RNA, 14 nt, Homo sapiens
auacuuggaccuca

SEQ ID NO: 522534 - RNA, 22 nt, Homo sapiens
auacuuugcagcacagcugaga

SEQ ID NO: 522535 - RNA, 20 nt, Homo sapiens
auagacaaaagaauaagaca

SEQ ID NO: 522536 - RNA, 20 nt, Homo sapiens
auagacugcuacagguaaua

SEQ ID NO: 522537 - RNA, 19 nt, Homo sapiens
auagacuuauugccaaaaa

SEQ ID NO: 522538 - RNA, 15 nt, Homo sapiens
auagcaagugaaagc

SEQ ID NO: 522539 - RNA, 16 nt, Homo sapiens
auaggccugucccuug

SEQ ID NO: 522540 - RNA, 17 nt, Homo sapiens
auaguucccaggugaua

SEQ ID NO: 522541 - RNA, 20 nt, Homo sapiens
auauaaaauguuuaaucucu

SEQ ID NO: 522542 - RNA, 14 nt, Homo sapiens
auauaauuuauuga

SEQ ID NO: 522543 - RNA, 23 nt, Homo sapiens
auauacugcagcuuuacugccuu

SEQ ID NO: 522544 - RNA, 15 nt, Homo sapiens
auauacugugugcuu

SEQ ID NO: 522545 - RNA, 18 nt, Homo sapiens
auauacuuugccacugcu

SEQ ID NO: 522546 - RNA, 15 nt, Homo sapiens
auauauuuacucagu

SEQ ID NO: 522547 - RNA, 18 nt, Homo sapiens
auauauuuacucagucuu

SEQ ID NO: 522548 - RNA, 18 nt, Homo sapiens
auauauuugaaauaguau

SEQ ID NO: 522549 - RNA, 17 nt, Homo sapiens
auauauuuuuaccaucu

SEQ ID NO: 522550 - RNA, 13 nt, Homo sapiens
auaucaguaccuc

SEQ ID NO: 522551 - RNA, 16 nt, Homo sapiens
auaucaguaccucuca

SEQ ID NO: 522552 - RNA, 15 nt, Homo sapiens
auauccuuucacucu

SEQ ID NO: 522553 - RNA, 18 nt, Homo sapiens
auaucuggguuaaguguu

SEQ ID NO: 522554 - RNA, 15 nt, Homo sapiens
auaugaggcuacaga

SEQ ID NO: 522555 - RNA, 14 nt, Homo sapiens
auaugauaaaacac

SEQ ID NO: 522556 - RNA, 15 nt, Homo sapiens
auaugccacugaccg

SEQ ID NO: 522557 - RNA, 18 nt, Homo sapiens
auauguguaaagauuuau

SEQ ID NO: 522558 - RNA, 14 nt, Homo sapiens
auauuauaacucau

SEQ ID NO: 522559 - RNA, 23 nt, Homo sapiens
auauugauugggaaaacauuugc

SEQ ID NO: 522560 - RNA, 17 nt, Homo sapiens
auauuucuugcuuucaa

SEQ ID NO: 522561 - RNA, 20 nt, Homo sapiens
auauuuuucaucaaacauug

SEQ ID NO: 522562 - RNA, 13 nt, Homo sapiens
aucaaaaggccca

SEQ ID NO: 522563 - RNA, 23 nt, Homo sapiens
aucaaacauuggauuuuuccuua

SEQ ID NO: 522564 - RNA, 23 nt, Homo sapiens
cugcaagaagaaaucaugauaua

SEQ ID NO: 522565 - RNA, 18 nt, Homo sapiens
cugcaauaugaauucaag

SEQ ID NO: 522566 - RNA, 16 nt, Homo sapiens
cugcaaugaaagucaa

SEQ ID NO: 522567 - RNA, 15 nt, Homo sapiens
cugcacaaacaauau

SEQ ID NO: 522568 - RNA, 15 nt, Homo sapiens
cugcacaacaagaua

SEQ ID NO: 522569 - RNA, 11 nt, Homo sapiens
cugcacaggcu

SEQ ID NO: 522570 - RNA, 19 nt, Homo sapiens
cugcaccccucugcccuca

SEQ ID NO: 522571 - RNA, 15 nt, Homo sapiens
cugcacuauuugccg

SEQ ID NO: 522572 - RNA, 23 nt, Homo sapiens
cugcagggcccucccuuuuccca

SEQ ID NO: 522573 - RNA, 20 nt, Homo sapiens
cugcauuaacugcacaaaca

SEQ ID NO: 522574 - RNA, 21 nt, Homo sapiens
cugccauuacagagguauuaa

SEQ ID NO: 522575 - RNA, 22 nt, Homo sapiens
cugccauuggagccaaugugug

SEQ ID NO: 522576 - RNA, 19 nt, Homo sapiens
cugcccaaggaugcuguca

SEQ ID NO: 522577 - RNA, 16 nt, Homo sapiens
cugcccacucugcaag

SEQ ID NO: 522578 - RNA, 21 nt, Homo sapiens
cugcccccuugggugaccucu

SEQ ID NO: 522579 - RNA, 14 nt, Homo sapiens
cugccucagccucc

SEQ ID NO: 522580 - RNA, 18 nt, Homo sapiens
cugccucuuucccuagga

SEQ ID NO: 522581 - RNA, 19 nt, Homo sapiens
cugccugggccguggcaca

SEQ ID NO: 522582 - RNA, 20 nt, Homo sapiens
cugccugggccguggcacag

SEQ ID NO: 522583 - RNA, 20 nt, Homo sapiens
cugcucacaaaaucacuuua

SEQ ID NO: 522584 - RNA, 13 nt, Homo sapiens
cugcucccuggca

SEQ ID NO: 522585 - RNA, 15 nt, Homo sapiens
cugcugauacugggu

SEQ ID NO: 522586 - RNA, 16 nt, Homo sapiens
cugcugucauaacauc

SEQ ID NO: 522587 - RNA, 21 nt, Homo sapiens
cugcuuuaauuaccuggugag

SEQ ID NO: 522588 - RNA, 15 nt, Homo sapiens
cuggaagaauucuag

SEQ ID NO: 522589 - RNA, 15 nt, Homo sapiens
cuggacuugccuaaa

SEQ ID NO: 522590 - RNA, 15 nt, Homo sapiens
cuggagaaccucauc

SEQ ID NO: 522591 - RNA, 21 nt, Homo sapiens
cuggagcccagucaccccggg

SEQ ID NO: 522592 - RNA, 20 nt, Homo sapiens
cuggagugcaguggugugau

SEQ ID NO: 522593 - RNA, 21 nt, Homo sapiens
cuggagugcaguggugugauc

SEQ ID NO: 522594 - RNA, 24 nt, Homo sapiens
cuggaugauacgaaugaugucaga

SEQ ID NO: 522595 - RNA, 21 nt, Homo sapiens
cuggcaagucuuccaugaccc

SEQ ID NO: 522596 - RNA, 21 nt, Homo sapiens
cuggcacucuuguucccacac

SEQ ID NO: 522597 - RNA, 20 nt, Homo sapiens
cuggcacuguggagaccaca

SEQ ID NO: 522598 - RNA, 21 nt, Homo sapiens
cuggcagccauggccauggca

SEQ ID NO: 522599 - RNA, 21 nt, Homo sapiens
cuggcagggcccagugacaag

SEQ ID NO: 522600 - RNA, 14 nt, Homo sapiens
cuggcauuaagggc

SEQ ID NO: 522601 - RNA, 15 nt, Homo sapiens
cuggcauugaaaugc

SEQ ID NO: 522602 - RNA, 14 nt, Homo sapiens
cuggcuguggacca

SEQ ID NO: 522603 - RNA, 14 nt, Homo sapiens
cugggccagggucu

SEQ ID NO: 522604 - RNA, 15 nt, Homo sapiens
cugggccguggcaca

SEQ ID NO: 522605 - RNA, 16 nt, Homo sapiens
cuggggcauccugugc

SEQ ID NO: 522606 - RNA, 21 nt, Homo sapiens
cuggggggacccagugcagaa

SEQ ID NO: 522607 - RNA, 21 nt, Homo sapiens
cugggguuggacuguaaggga

SEQ ID NO: 522608 - RNA, 23 nt, Homo sapiens
cuggguacugaaagccuuaggga

SEQ ID NO: 522609 - RNA, 19 nt, Homo sapiens
cuggguccauccuggucag

SEQ ID NO: 522610 - RNA, 17 nt, Homo sapiens
cuggguuucuaagcagu

SEQ ID NO: 522611 - RNA, 20 nt, Homo sapiens
cugguacugcaggaccucca

SEQ ID NO: 522612 - RNA, 21 nt, Homo sapiens
cuggucagcauguacuccccu

SEQ ID NO: 522613 - RNA, 18 nt, Homo sapiens
cuggucucuacauaaaau

SEQ ID NO: 522614 - RNA, 19 nt, Homo sapiens
cugguggggaucagacaga

SEQ ID NO: 522615 - RNA, 17 nt, Homo sapiens
cugguguugacuggacu

SEQ ID NO: 522616 - RNA, 15 nt, Homo sapiens
cuguaaagugccuua

SEQ ID NO: 522617 - RNA, 21 nt, Homo sapiens
cuguaaucccagcacuuuggg

SEQ ID NO: 522618 - RNA, 15 nt, Homo sapiens
cuguaauccuagcua

SEQ ID NO: 522619 - RNA, 21 nt, Homo sapiens
cuguacagaaaguaucacaaa

SEQ ID NO: 522620 - RNA, 22 nt, Homo sapiens
cuguacuguuacugggcccuga

SEQ ID NO: 522621 - RNA, 16 nt, Homo sapiens
cuguauagggcucguu

SEQ ID NO: 522622 - RNA, 12 nt, Homo sapiens
cugucauaacau

SEQ ID NO: 522623 - RNA, 19 nt, Homo sapiens
cugucauccucaugcugcu

SEQ ID NO: 522624 - RNA, 17 nt, Homo sapiens
cugucccucuccuugcc

SEQ ID NO: 522625 - RNA, 16 nt, Homo sapiens
cuguccuagucuugau

SEQ ID NO: 522626 - RNA, 18 nt, Homo sapiens
cuguccugaccaucgcac

SEQ ID NO: 522627 - RNA, 20 nt, Homo sapiens
cuguccugacucucuccuga

SEQ ID NO: 522628 - RNA, 17 nt, Homo sapiens
cuguccugcagucccac

SEQ ID NO: 522629 - RNA, 23 nt, Homo sapiens
cuguccugcagucccacacugug

SEQ ID NO: 522630 - RNA, 22 nt, Homo sapiens
cuguccuuucagucugauccau

SEQ ID NO: 522631 - RNA, 22 nt, Homo sapiens
cugucuauuaauauucagggua

SEQ ID NO: 522632 - RNA, 17 nt, Homo sapiens
cugucuguauagugucu

SEQ ID NO: 522633 - RNA, 18 nt, Homo sapiens
cugugaacuuucauguca

SEQ ID NO: 522634 - RNA, 20 nt, Homo sapiens
cugugaggccauacuuguga

SEQ ID NO: 522635 - RNA, 14 nt, Homo sapiens
cugugcaaagggaa

SEQ ID NO: 522636 - RNA, 12 nt, Homo sapiens
cugugcacagac

SEQ ID NO: 522637 - RNA, 20 nt, Homo sapiens
cuguggaaugagugugcaug

SEQ ID NO: 522638 - RNA, 21 nt, Homo sapiens
cuguggguuugguccuugaac

SEQ ID NO: 522639 - RNA, 21 nt, Homo sapiens
cuguucugggccaggucccag

SEQ ID NO: 522640 - RNA, 13 nt, Homo sapiens
cuguugaucucag

SEQ ID NO: 522641 - RNA, 14 nt, Homo sapiens
cuguuggaugacuu

SEQ ID NO: 522642 - RNA, 23 nt, Homo sapiens
cuguuggucugccuucugcugaa

SEQ ID NO: 522643 - RNA, 22 nt, Homo sapiens
cuguuuacauccagaguucugu

SEQ ID NO: 522644 - RNA, 18 nt, Homo sapiens
cuguuucgguugacccag

SEQ ID NO: 522645 - RNA, 17 nt, Homo sapiens
cuuaaaagaugccuuaa

SEQ ID NO: 522646 - RNA, 16 nt, Homo sapiens
cuuaaacucuguuaca

SEQ ID NO: 522647 - RNA, 21 nt, Homo sapiens
uucccgacgacacauauacau

SEQ ID NO: 522648 - RNA, 16 nt, Homo sapiens
uuccucagcugugugg

SEQ ID NO: 522649 - RNA, 18 nt, Homo sapiens
uucuaaaguuuugcaaca

SEQ ID NO: 522650 - RNA, 16 nt, Homo sapiens
uucuaacgccagcaca

SEQ ID NO: 522651 - RNA, 19 nt, Homo sapiens
uucuaauccuuuuccuuau

SEQ ID NO: 522652 - RNA, 14 nt, Homo sapiens
uucuacaggccagc

SEQ ID NO: 522653 - RNA, 13 nt, Homo sapiens
uucuaccugcccu

SEQ ID NO: 522654 - RNA, 20 nt, Homo sapiens
uucuacgggauggccagaga

SEQ ID NO: 522655 - RNA, 13 nt, Homo sapiens
uucuauugggaua

SEQ ID NO: 522656 - RNA, 14 nt, Homo sapiens
uucucaacuucucu

SEQ ID NO: 522657 - RNA, 23 nt, Homo sapiens
uucugcaaaguguaugugaccau

SEQ ID NO: 522658 - RNA, 17 nt, Homo sapiens
uucuggaagucaucuca

SEQ ID NO: 522659 - RNA, 16 nt, Homo sapiens
uucuggguccugaaga

SEQ ID NO: 522660 - RNA, 20 nt, Homo sapiens
uucugucccacuacaucugg

SEQ ID NO: 522661 - RNA, 21 nt, Homo sapiens
uucuguuggaugacuuugaga

SEQ ID NO: 522662 - RNA, 16 nt, Homo sapiens
uucuuaaccuuugcua

SEQ ID NO: 522663 - RNA, 16 nt, Homo sapiens
uucuuacacacugucu

SEQ ID NO: 522664 - RNA, 12 nt, Homo sapiens
uucuuacacugu

SEQ ID NO: 522665 - RNA, 18 nt, Homo sapiens
uucuuacacugugucauu

SEQ ID NO: 522666 - RNA, 18 nt, Homo sapiens
uucuucaacaugcuccaa

SEQ ID NO: 522667 - RNA, 20 nt, Homo sapiens
uucuucuaagaagacauuuu

SEQ ID NO: 522668 - RNA, 18 nt, Homo sapiens
uucuugccuuguaccuca

SEQ ID NO: 522669 - RNA, 18 nt, Homo sapiens
uucuuggugguggaugac

SEQ ID NO: 522670 - RNA, 22 nt, Homo sapiens
uucuuguugugccccuuuccaa

SEQ ID NO: 522671 - RNA, 12 nt, Homo sapiens
uucuuucuagag

SEQ ID NO: 522672 - RNA, 15 nt, Homo sapiens
uucuuugggcugugg

SEQ ID NO: 522673 - RNA, 13 nt, Homo sapiens
uucuuuuuccaca

SEQ ID NO: 522674 - RNA, 20 nt, Homo sapiens
ugccuuccucaguauccaca

SEQ ID NO: 522675 - RNA, 22 nt, Homo sapiens
ugccuugcuagcugaccuggag

SEQ ID NO: 522676 - RNA, 21 nt, Homo sapiens
ugcguggugcucuuugcugca

SEQ ID NO: 522677 - RNA, 16 nt, Homo sapiens
ugcucaauacaucuca

SEQ ID NO: 522678 - RNA, 20 nt, Homo sapiens
ugcuccccuaaagccucaaa

SEQ ID NO: 522679 - RNA, 21 nt, Homo sapiens
ugcucccuagccagaggcucu

SEQ ID NO: 522680 - RNA, 15 nt, Homo sapiens
ugcuccugcaucuca

SEQ ID NO: 522681 - RNA, 17 nt, Homo sapiens
ugcucuaggaagacauu

SEQ ID NO: 522682 - RNA, 18 nt, Homo sapiens
ugcucuuugcugcacuau

SEQ ID NO: 522683 - RNA, 20 nt, Homo sapiens
ugcugauacugggucugcga

SEQ ID NO: 522684 - RNA, 16 nt, Homo sapiens
ugcugauugaagacac

SEQ ID NO: 522685 - RNA, 18 nt, Homo sapiens
ugcugcccgcucugcaga

SEQ ID NO: 522686 - RNA, 23 nt, Homo sapiens
ugcugggauuacaggcgugaucc

SEQ ID NO: 522687 - RNA, 20 nt, Homo sapiens
ugcuguauaugcaaugucca

SEQ ID NO: 522688 - RNA, 21 nt, Homo sapiens
ugcuguaugcugaucaucgcc

SEQ ID NO: 522689 - RNA, 17 nt, Homo sapiens
ugcugucaagcaccugc

SEQ ID NO: 522690 - RNA, 16 nt, Homo sapiens
ugcuuagcucaucuua

SEQ ID NO: 522691 - RNA, 14 nt, Homo sapiens
ugcuucaucauucc

SEQ ID NO: 522692 - RNA, 21 nt, Homo sapiens
ugcuugacauaccuaccagua

SEQ ID NO: 522693 - RNA, 19 nt, Homo sapiens
ugcuugacaugguuuccaa

SEQ ID NO: 522694 - RNA, 13 nt, Homo sapiens
ugcuuucaucuaa

SEQ ID NO: 522695 - RNA, 18 nt, Homo sapiens
ugcuuuuguuccaauguc

SEQ ID NO: 522696 - RNA, 19 nt, Homo sapiens
uggaaaaccuccuuuacca

SEQ ID NO: 522697 - RNA, 19 nt, Homo sapiens
uggaaaagaacuguacugu

SEQ ID NO: 522698 - RNA, 15 nt, Homo sapiens
uggaaaauaccagug

SEQ ID NO: 522699 - RNA, 16 nt, Homo sapiens
uggaacagaagacagc

SEQ ID NO: 522700 - RNA, 21 nt, Homo sapiens
uggaacaggcucagaucucau

SEQ ID NO: 522701 - RNA, 14 nt, Homo sapiens
uggaacugcaauga

SEQ ID NO: 522702 - RNA, 13 nt, Homo sapiens
uggaaggggucca

SEQ ID NO: 522703 - RNA, 15 nt, Homo sapiens
uggaagggguccagc

SEQ ID NO: 522704 - RNA, 15 nt, Homo sapiens
uguauucgugcauuu

SEQ ID NO: 522705 - RNA, 21 nt, Homo sapiens
uguauuuuuauuuuugcacaa

SEQ ID NO: 522706 - RNA, 16 nt, Homo sapiens
ugucagcuacuaauga

SEQ ID NO: 522707 - RNA, 21 nt, Homo sapiens
ugucauccucaugcugcucaa

SEQ ID NO: 522708 - RNA, 21 nt, Homo sapiens
ugucauucuguuagauacuaa

SEQ ID NO: 522709 - RNA, 11 nt, Homo sapiens
uguccaaagag

SEQ ID NO: 522710 - RNA, 12 nt, Homo sapiens
uguccaaagagg

SEQ ID NO: 522711 - RNA, 14 nt, Homo sapiens
uguccagcaccuug

SEQ ID NO: 522712 - RNA, 15 nt, Homo sapiens
uguccauuugcaaau

SEQ ID NO: 522713 - RNA, 22 nt, Homo sapiens
uguccugagcaccacacccagu

SEQ ID NO: 522714 - RNA, 21 nt, Homo sapiens
uguccuuuaaucacugcauuu

SEQ ID NO: 522715 - RNA, 18 nt, Homo sapiens
ugucgguuaccucugcau

SEQ ID NO: 522716 - RNA, 18 nt, Homo sapiens
ugucuagagaacacugug

SEQ ID NO: 522717 - RNA, 15 nt, Homo sapiens
ugucugccuucacaa

SEQ ID NO: 522718 - RNA, 18 nt, Homo sapiens
ugucugccuucacaaaug

SEQ ID NO: 522719 - RNA, 21 nt, Homo sapiens
ugugaaaauuacaguccaaaa

SEQ ID NO: 522720 - RNA, 21 nt, Homo sapiens
ugugaaacgucuggacugcua

SEQ ID NO: 522721 - RNA, 14 nt, Homo sapiens
ugugaaguacauau

SEQ ID NO: 522722 - RNA, 12 nt, Homo sapiens
ugugacuacuga

SEQ ID NO: 522723 - RNA, 19 nt, Homo sapiens
ugugagguucgcuuaucaa

SEQ ID NO: 522724 - RNA, 22 nt, Homo sapiens
ugugcauggaggcccuccugug

SEQ ID NO: 522725 - RNA, 17 nt, Homo sapiens
ugugccagcaccacagc

SEQ ID NO: 522726 - RNA, 19 nt, Homo sapiens
ugugcccgacugacuggag

SEQ ID NO: 522727 - RNA, 20 nt, Homo sapiens
uguggcaaacuugcaguuua

SEQ ID NO: 522728 - RNA, 22 nt, Homo sapiens
uguggccaggccuuacaucugg

SEQ ID NO: 522729 - RNA, 13 nt, Homo sapiens
ugugggggguccu

SEQ ID NO: 522730 - RNA, 14 nt, Homo sapiens
uguggucauccugc

SEQ ID NO: 522731 - RNA, 18 nt, Homo sapiens
uguguauuuccagugcaa

SEQ ID NO: 522732 - RNA, 14 nt, Homo sapiens
ggaugguugaauga

SEQ ID NO: 522733 - RNA, 14 nt, Homo sapiens
ggauugacucugca

SEQ ID NO: 522734 - RNA, 20 nt, Homo sapiens
ggcaagugugggggguccuu

SEQ ID NO: 522735 - RNA, 11 nt, Homo sapiens
ggcacauuccc

SEQ ID NO: 522736 - RNA, 23 nt, Homo sapiens
ggcaccuuaagauuuugcaccug

SEQ ID NO: 522737 - RNA, 17 nt, Homo sapiens
ggcaggacuccuggcag

SEQ ID NO: 522738 - RNA, 16 nt, Homo sapiens
ggcaggagaauggugu

SEQ ID NO: 522739 - RNA, 22 nt, Homo sapiens
ggcaggcggaucaugaggucag

SEQ ID NO: 522740 - RNA, 20 nt, Homo sapiens
ggcaggcugggccaugucca

SEQ ID NO: 522741 - RNA, 21 nt, Homo sapiens
ggcaggugccaugucugggaa

SEQ ID NO: 522742 - RNA, 22 nt, Homo sapiens
ggcaucuauuuccucugugcaa

SEQ ID NO: 522743 - RNA, 13 nt, Homo sapiens
ggcauggauccag

SEQ ID NO: 522744 - RNA, 19 nt, Homo sapiens
ggccagggcugcccugaga

SEQ ID NO: 522745 - RNA, 18 nt, Homo sapiens
ggccauggcucagggugg

SEQ ID NO: 522746 - RNA, 16 nt, Homo sapiens
ggccauguccaaagag

SEQ ID NO: 522747 - RNA, 12 nt, Homo sapiens
ggcccagugcau

SEQ ID NO: 522748 - RNA, 18 nt, Homo sapiens
ggcccuccucucccaucc

SEQ ID NO: 522749 - RNA, 23 nt, Homo sapiens
ggcccuccucucccauccuugau

SEQ ID NO: 522750 - RNA, 16 nt, Homo sapiens
ggccgaggugacugca

SEQ ID NO: 522751 - RNA, 12 nt, Homo sapiens
ggccgcacuggg

SEQ ID NO: 522752 - RNA, 13 nt, Homo sapiens
ggccgcacugggg

SEQ ID NO: 522753 - RNA, 16 nt, Homo sapiens
ggccguggcacagcug

SEQ ID NO: 522754 - RNA, 15 nt, Homo sapiens
ggccuagcgaucucu

SEQ ID NO: 522755 - RNA, 19 nt, Homo sapiens
ggccucagcugaaugccuc

SEQ ID NO: 522756 - RNA, 17 nt, Homo sapiens
ggccuccaaacacagau

SEQ ID NO: 522757 - RNA, 13 nt, Homo sapiens
ggccuccaugacc

SEQ ID NO: 522758 - RNA, 15 nt, Homo sapiens
ggccuccaugaccug

SEQ ID NO: 522759 - RNA, 23 nt, Homo sapiens
ggccugcgacccugggggcacag

SEQ ID NO: 522760 - RNA, 17 nt, Homo sapiens
ggccuggacuuccagug

SEQ ID NO: 522761 - RNA, 23 nt, Homo sapiens
ggccuggacuuccagugcucaga

SEQ ID NO: 522762 - RNA, 18 nt, Homo sapiens
ggccuguacggacacugu

SEQ ID NO: 522763 - RNA, 17 nt, Homo sapiens
ggccuuagugggccagg

SEQ ID NO: 522764 - RNA, 19 nt, Homo sapiens
ggccuuguccucagccagu

SEQ ID NO: 522765 - RNA, 15 nt, Homo sapiens
ggccuuucugugucc

SEQ ID NO: 522766 - RNA, 16 nt, Homo sapiens
ggcguggggccaauac

SEQ ID NO: 522767 - RNA, 12 nt, Homo sapiens
ggcuaaucucag

SEQ ID NO: 522768 - RNA, 13 nt, Homo sapiens
ggcuaauucugca

SEQ ID NO: 522769 - RNA, 18 nt, Homo sapiens
ggcuccucggacucugcu

SEQ ID NO: 522770 - RNA, 21 nt, Homo sapiens
ggcucgagagggcugguccuu

SEQ ID NO: 522771 - RNA, 21 nt, Homo sapiens
ggcugagcaucggaguggagu

SEQ ID NO: 522772 - RNA, 17 nt, Homo sapiens
ggcugccccucucacca

SEQ ID NO: 522773 - RNA, 18 nt, Homo sapiens
ggcugccccucucaccaa

SEQ ID NO: 522774 - RNA, 13 nt, Homo sapiens
ggcuggcaguugg

SEQ ID NO: 522775 - RNA, 17 nt, Homo sapiens
ggcuggccgcaugacca

SEQ ID NO: 522776 - RNA, 22 nt, Homo sapiens
ggcuguggagagggucaaggag

SEQ ID NO: 522777 - RNA, 20 nt, Homo sapiens
ggcuuaacacuaucauggac

SEQ ID NO: 522778 - RNA, 23 nt, Homo sapiens
ggcuucaguuuuacucugcugca

SEQ ID NO: 522779 - RNA, 19 nt, Homo sapiens
ggcuuugccucuucuuugu

SEQ ID NO: 522780 - RNA, 19 nt, Homo sapiens
gggaagcggcccuaaggga

SEQ ID NO: 522781 - RNA, 12 nt, Homo sapiens
gggaaugcugcc

SEQ ID NO: 522782 - RNA, 16 nt, Homo sapiens
gggacugugaggccau

SEQ ID NO: 522783 - RNA, 19 nt, Homo sapiens
gggagaguaaaccuugaag

SEQ ID NO: 522784 - RNA, 22 nt, Homo sapiens
gggagcacugcguuuuccuagc

SEQ ID NO: 522785 - RNA, 11 nt, Homo sapiens
gggagccagcc

SEQ ID NO: 522786 - RNA, 23 nt, Homo sapiens
gggaggcaagugugggggguccu

SEQ ID NO: 522787 - RNA, 14 nt, Homo sapiens
gggccucugcauuu

SEQ ID NO: 522788 - RNA, 18 nt, Homo sapiens
gggccuggggccugagag

SEQ ID NO: 522789 - RNA, 23 nt, Homo sapiens
gggcuagagaaaucagcugcuau

SEQ ID NO: 522790 - RNA, 20 nt, Homo sapiens
ggggaagcggcccuaaggga

SEQ ID NO: 522791 - RNA, 18 nt, Homo sapiens
ggggcaggcugggccaug

SEQ ID NO: 522792 - RNA, 14 nt, Homo sapiens
ggggcccagugcau

SEQ ID NO: 522793 - RNA, 18 nt, Homo sapiens
gggggagaagaagccgag

SEQ ID NO: 522794 - RNA, 18 nt, Homo sapiens
gggucugugugaaugugg

SEQ ID NO: 522795 - RNA, 12 nt, Homo sapiens
gggucuuugugg

SEQ ID NO: 522796 - RNA, 14 nt, Homo sapiens
ggguggcauccagg

SEQ ID NO: 522797 - RNA, 16 nt, Homo sapiens
gguagagaaggagcag

SEQ ID NO: 522798 - RNA, 23 nt, Homo sapiens
gguaggugccgcuacaguuuuua

SEQ ID NO: 522799 - RNA, 22 nt, Homo sapiens
ggucaacauagugagacacugu

SEQ ID NO: 522800 - RNA, 13 nt, Homo sapiens
ggucagcauguac

SEQ ID NO: 522801 - RNA, 18 nt, Homo sapiens
gguccuggacaaaggagu

SEQ ID NO: 522802 - RNA, 14 nt, Homo sapiens
gguccuuuggacag

SEQ ID NO: 522803 - RNA, 20 nt, Homo sapiens
ggucucaaacuccugaccuc

SEQ ID NO: 522804 - RNA, 17 nt, Homo sapiens
ggucucccgauucccaa

SEQ ID NO: 522805 - RNA, 19 nt, Homo sapiens
ggucucuucuuggggccca

SEQ ID NO: 522806 - RNA, 13 nt, Homo sapiens
ggucuucuuacau

SEQ ID NO: 522807 - RNA, 16 nt, Homo sapiens
ggucuuuugguuauga

SEQ ID NO: 522808 - RNA, 16 nt, Homo sapiens
ggugaggguuggcgcu

SEQ ID NO: 522809 - RNA, 11 nt, Homo sapiens
ggugauggugu

SEQ ID NO: 522810 - RNA, 17 nt, Homo sapiens
ggugcacagccacuccc

SEQ ID NO: 522811 - RNA, 18 nt, Homo sapiens
ggugcucuuugcugcacu

SEQ ID NO: 522812 - RNA, 16 nt, Homo sapiens
gguggaaggcagacag

SEQ ID NO: 522813 - RNA, 18 nt, Homo sapiens
gguggggggcauugagua

SEQ ID NO: 522814 - RNA, 16 nt, Homo sapiens
ggugguuuuugcucuc

SEQ ID NO: 522815 - RNA, 17 nt, Homo sapiens
ggugugcaccuguaauc

SEQ ID NO: 522816 - RNA, 15 nt, Homo sapiens
gguucagcugaagcu

SEQ ID NO: 522817 - RNA, 22 nt, Homo sapiens
gguugaaugagcgucagcaucc

SEQ ID NO: 522818 - RNA, 19 nt, Homo sapiens
gguuggacuguaagggauu

SEQ ID NO: 522819 - RNA, 18 nt, Homo sapiens
gguuggggugacagucau

SEQ ID NO: 522820 - RNA, 22 nt, Homo sapiens
gagguggaaguggagcccagug

SEQ ID NO: 522821 - RNA, 19 nt, Homo sapiens
gaggugguucagacaagac

SEQ ID NO: 522822 - RNA, 15 nt, Homo sapiens
gaguaaaccuugaag

SEQ ID NO: 522823 - RNA, 15 nt, Homo sapiens
gagucacugccaagu

SEQ ID NO: 522824 - RNA, 15 nt, Homo sapiens
gagucugcaugugca

SEQ ID NO: 522825 - RNA, 20 nt, Homo sapiens
gagucuguacuaaacaguaa

SEQ ID NO: 522826 - RNA, 13 nt, Homo sapiens
gagugcacuacug

SEQ ID NO: 522827 - RNA, 12 nt, Homo sapiens
gagugugacagg

SEQ ID NO: 522828 - RNA, 18 nt, Homo sapiens
gagugugacagggccagu

SEQ ID NO: 522829 - RNA, 14 nt, Homo sapiens
gaguugacuuuccu

SEQ ID NO: 522830 - RNA, 20 nt, Homo sapiens
gaguugcagccagggccagu

SEQ ID NO: 522831 - RNA, 24 nt, Homo sapiens
gauaaaaugccagucucauuguca

SEQ ID NO: 522832 - RNA, 17 nt, Homo sapiens
gauaaagcuuaggucaa

SEQ ID NO: 522833 - RNA, 13 nt, Homo sapiens
gauaagucuuuca

SEQ ID NO: 522834 - RNA, 21 nt, Homo sapiens
gauaauuuucagcugcaagga

SEQ ID NO: 522835 - RNA, 20 nt, Homo sapiens
gauacuugaauaaccaucug

SEQ ID NO: 522836 - RNA, 12 nt, Homo sapiens
gauagauguuug

SEQ ID NO: 522837 - RNA, 18 nt, Homo sapiens
gauagcaaacacuggggg

SEQ ID NO: 522838 - RNA, 15 nt, Homo sapiens
gauagggaacugggg

SEQ ID NO: 522839 - RNA, 13 nt, Homo sapiens
gauaucuucagaa

SEQ ID NO: 522840 - RNA, 20 nt, Homo sapiens
gauauuaauagauaauauga

SEQ ID NO: 522841 - RNA, 23 nt, Homo sapiens
gaucaagggaauguaacugcuga

SEQ ID NO: 522842 - RNA, 18 nt, Homo sapiens
gaucaucgccagaggugc

SEQ ID NO: 522843 - RNA, 16 nt, Homo sapiens
gauccggcagcacaag

SEQ ID NO: 522844 - RNA, 19 nt, Homo sapiens
gauccucaugguucccaag

SEQ ID NO: 522845 - RNA, 20 nt, Homo sapiens
gaucgugcuacugcacucca

SEQ ID NO: 522846 - RNA, 11 nt, Homo sapiens
gaucucucuug

SEQ ID NO: 522847 - RNA, 20 nt, Homo sapiens
gaucugugccauagaacaag

SEQ ID NO: 522848 - RNA, 17 nt, Homo sapiens
gaugacuuugagauuau

SEQ ID NO: 522849 - RNA, 21 nt, Homo sapiens
gaugccaccuucagauccuuu

SEQ ID NO: 522850 - RNA, 17 nt, Homo sapiens
gaugcggccucagagag

SEQ ID NO: 522851 - RNA, 16 nt, Homo sapiens
gaugcuggacuugccu

SEQ ID NO: 522852 - RNA, 16 nt, Homo sapiens
gauggcaggugccugu

SEQ ID NO: 522853 - RNA, 18 nt, Homo sapiens
gauggcaggugccuguaa

SEQ ID NO: 522854 - RNA, 16 nt, Homo sapiens
gauggccagagaugcu

SEQ ID NO: 522855 - RNA, 13 nt, Homo sapiens
gauggggcacuga

SEQ ID NO: 522856 - RNA, 19 nt, Homo sapiens
gaugucaucacacucucca

SEQ ID NO: 522857 - RNA, 20 nt, Homo sapiens
gaugucaucacacucuccau

SEQ ID NO: 522858 - RNA, 22 nt, Homo sapiens
gaugugcagccccuuccuggug

SEQ ID NO: 522859 - RNA, 16 nt, Homo sapiens
gauguguccucaggga

SEQ ID NO: 522860 - RNA, 20 nt, Homo sapiens
gauuacuaucauggcauaua

SEQ ID NO: 522861 - RNA, 18 nt, Homo sapiens
gauucuuuccauuaugau

SEQ ID NO: 522862 - RNA, 18 nt, Homo sapiens
gauugcagagugaccagc

SEQ ID NO: 522863 - RNA, 19 nt, Homo sapiens
gauuuuaugaaaugaccuc

SEQ ID NO: 522864 - RNA, 24 nt, Homo sapiens
gauuuuguuggugaguagucucau

SEQ ID NO: 522865 - RNA, 12 nt, Homo sapiens
gcaaaagguuua

SEQ ID NO: 522866 - RNA, 22 nt, Homo sapiens
gcaaagaaaggagauacagugg

SEQ ID NO: 522867 - RNA, 11 nt, Homo sapiens
gcaaagccaaa

SEQ ID NO: 522868 - RNA, 14 nt, Homo sapiens
gcaaagggaaccau

SEQ ID NO: 522869 - RNA, 15 nt, Homo sapiens
gcaaaguguauguga

SEQ ID NO: 522870 - RNA, 15 nt, Homo sapiens
gcaaauaaagccuuu

SEQ ID NO: 522871 - RNA, 18 nt, Homo sapiens
gcaacaauaaaguacuuu

SEQ ID NO: 522872 - RNA, 20 nt, Homo sapiens
gcaacaauaaaguacuuuac

SEQ ID NO: 522873 - RNA, 18 nt, Homo sapiens
gcaacuaauuuucuccca

SEQ ID NO: 522874 - RNA, 18 nt, Homo sapiens
gcaagucuuccaugaccc

SEQ ID NO: 522875 - RNA, 13 nt, Homo sapiens
gcaauaccaaugu

SEQ ID NO: 522876 - RNA, 15 nt, Homo sapiens
gcaauaccaauguuc

SEQ ID NO: 522877 - RNA, 21 nt, Homo sapiens
gcaauagacacauacauguca

SEQ ID NO: 522878 - RNA, 17 nt, Homo sapiens
gcaaucuucuacuuuaa

SEQ ID NO: 522879 - RNA, 14 nt, Homo sapiens
gcacaaacaauaug

SEQ ID NO: 522880 - RNA, 22 nt, Homo sapiens
gcacaagcucaggacauggagg

SEQ ID NO: 522881 - RNA, 22 nt, Homo sapiens
gcacaagcugcggaagcugaac

SEQ ID NO: 522882 - RNA, 22 nt, Homo sapiens
gcacaagggcacgugaagucau

SEQ ID NO: 522883 - RNA, 13 nt, Homo sapiens
gcacacacugacc

SEQ ID NO: 522884 - RNA, 13 nt, Homo sapiens
gcacacacugugc

SEQ ID NO: 522885 - RNA, 12 nt, Homo sapiens
gcacaucuuuga

SEQ ID NO: 522886 - RNA, 20 nt, Homo sapiens
gcacauuccccuugccuaaa

SEQ ID NO: 522887 - RNA, 17 nt, Homo sapiens
gcacauuuggacauuuc

SEQ ID NO: 522888 - RNA, 16 nt, Homo sapiens
gcacccagaggaggag

SEQ ID NO: 522889 - RNA, 17 nt, Homo sapiens
gcaccugcaugugcugu

SEQ ID NO: 522890 - RNA, 21 nt, Homo sapiens
gcaccuuaagauuuugcaccu

SEQ ID NO: 522891 - RNA, 13 nt, Homo sapiens
gcacuauuugccg

SEQ ID NO: 522892 - RNA, 19 nt, Homo sapiens
gcacugaccggugcuuuua

SEQ ID NO: 522893 - RNA, 18 nt, Homo sapiens
gcacuuuucaaacaauca

SEQ ID NO: 522894 - RNA, 22 nt, Homo sapiens
gcagaacagaucuuuuacuuug

SEQ ID NO: 522895 - RNA, 22 nt, Homo sapiens
gcagaagagaaaggacucagug

SEQ ID NO: 522896 - RNA, 15 nt, Homo sapiens
gcagacggaaggagg

SEQ ID NO: 522897 - RNA, 12 nt, Homo sapiens
gcagacugcugc

SEQ ID NO: 522898 - RNA, 14 nt, Homo sapiens
gcagaucuacaugu

SEQ ID NO: 522899 - RNA, 21 nt, Homo sapiens
gcagauugaaaaggacaccuu

SEQ ID NO: 522900 - RNA, 20 nt, Homo sapiens
gcagcacagcagacuaguua

SEQ ID NO: 522901 - RNA, 22 nt, Homo sapiens
gcagcaggucuagaagaacaac

SEQ ID NO: 522902 - RNA, 18 nt, Homo sapiens
gcagccgugaucaaggga

SEQ ID NO: 522903 - RNA, 22 nt, Homo sapiens
gcagcuaccagguguucuacac

SEQ ID NO: 522904 - RNA, 18 nt, Homo sapiens
gcaggagagucacuugaa

SEQ ID NO: 522905 - RNA, 16 nt, Homo sapiens
gcaggaggaucacuuu

SEQ ID NO: 522906 - RNA, 14 nt, Homo sapiens
gcaggcugggccau

SEQ ID NO: 522907 - RNA, 19 nt, Homo sapiens
gcaggcugggccaugucca

SEQ ID NO: 522908 - RNA, 23 nt, Homo sapiens
gcaggcugggccauguccaaaga

SEQ ID NO: 522909 - RNA, 15 nt, Homo sapiens
gcagggccaccugca

SEQ ID NO: 522910 - RNA, 23 nt, Homo sapiens
gcaggggcuuguugcaggcugug

SEQ ID NO: 522911 - RNA, 18 nt, Homo sapiens
gcaggucuagaagaacaa

SEQ ID NO: 522912 - RNA, 19 nt, Homo sapiens
gcaggucuagaagaacaac

SEQ ID NO: 522913 - RNA, 16 nt, Homo sapiens
gcaggugccuguaauc

SEQ ID NO: 522914 - RNA, 22 nt, Homo sapiens
gcagguuuguuuucagcacuga

SEQ ID NO: 522915 - RNA, 13 nt, Homo sapiens
gcaguacuuugug

SEQ ID NO: 522916 - RNA, 15 nt, Homo sapiens
gcagugagcugagau

SEQ ID NO: 522917 - RNA, 16 nt, Homo sapiens
gcaguggcucaugccu

SEQ ID NO: 522918 - RNA, 17 nt, Homo sapiens
gcaguuguaccaaguga

SEQ ID NO: 522919 - RNA, 20 nt, Homo sapiens
gcauaccugucucagcuguu

SEQ ID NO: 522920 - RNA, 14 nt, Homo sapiens
gcauauaguuaaac

SEQ ID NO: 522921 - RNA, 23 nt, Homo sapiens
gcauauuuauccaaaauguguau

SEQ ID NO: 522922 - RNA, 21 nt, Homo sapiens
gcaucaggcagggugagcucc

SEQ ID NO: 522923 - RNA, 15 nt, Homo sapiens
gcaucuacacaauuu

SEQ ID NO: 522924 - RNA, 21 nt, Homo sapiens
gcaucucaaaauuauucugcc

SEQ ID NO: 522925 - RNA, 13 nt, Homo sapiens
gcauguagacugu

SEQ ID NO: 522926 - RNA, 16 nt, Homo sapiens
gcauguguauuuccag

SEQ ID NO: 522927 - RNA, 21 nt, Homo sapiens
gcauugauaaucuucagguga

SEQ ID NO: 522928 - RNA, 23 nt, Homo sapiens
gcauugauggccucaauguggca

SEQ ID NO: 522929 - RNA, 18 nt, Homo sapiens
gcauugauugcacuugau

SEQ ID NO: 522930 - RNA, 13 nt, Homo sapiens
gccaacuccucac

SEQ ID NO: 522931 - RNA, 12 nt, Homo sapiens
gccaagaacuug

SEQ ID NO: 522932 - RNA, 17 nt, Homo sapiens
gccaagaacuugcaaua

SEQ ID NO: 522933 - RNA, 15 nt, Homo sapiens
gccaagucauagcca

SEQ ID NO: 522934 - RNA, 19 nt, Homo sapiens
gccacauggcggagaguuu

SEQ ID NO: 522935 - RNA, 19 nt, Homo sapiens
gccaccuggcaaaggaccc

SEQ ID NO: 522936 - RNA, 15 nt, Homo sapiens
gccacuggaccucag

SEQ ID NO: 522937 - RNA, 13 nt, Homo sapiens
gccagaggcagcu

SEQ ID NO: 522938 - RNA, 20 nt, Homo sapiens
gccagaggcucuaauguaca

SEQ ID NO: 522939 - RNA, 21 nt, Homo sapiens
gccagaggcucuaauguacaa

SEQ ID NO: 522940 - RNA, 16 nt, Homo sapiens
gccuuaaugcuucaua

SEQ ID NO: 522941 - RNA, 12 nt, Homo sapiens
gccuuagugggc

SEQ ID NO: 522942 - RNA, 16 nt, Homo sapiens
gccuuagugggccagg

SEQ ID NO: 522943 - RNA, 14 nt, Homo sapiens
gccuucaucuucac

SEQ ID NO: 522944 - RNA, 21 nt, Homo sapiens
gccuugcuagcugaccuggag

SEQ ID NO: 522945 - RNA, 23 nt, Homo sapiens
gccuuuggauugacucugcauuu

SEQ ID NO: 522946 - RNA, 20 nt, Homo sapiens
gcgagcagucagcauucuua

SEQ ID NO: 522947 - RNA, 21 nt, Homo sapiens
gcgauucuggauaaagccacu

SEQ ID NO: 522948 - RNA, 16 nt, Homo sapiens
gcgcaugaaccuggac

SEQ ID NO: 522949 - RNA, 11 nt, Homo sapiens
gcgcgcugagc

SEQ ID NO: 522950 - RNA, 15 nt, Homo sapiens
gcgcguccagcugcc

SEQ ID NO: 522951 - RNA, 16 nt, Homo sapiens
gcgucacggccaagug

SEQ ID NO: 522952 - RNA, 23 nt, Homo sapiens
gcgucucccucgcagagcccuuc

SEQ ID NO: 522953 - RNA, 20 nt, Homo sapiens
gcguggugcucuuugcugca

SEQ ID NO: 522954 - RNA, 23 nt, Homo sapiens
gcguggugcucuuugcugcacua

SEQ ID NO: 522955 - RNA, 23 nt, Homo sapiens
gcuaaauaaauggguguauauaa

SEQ ID NO: 522956 - RNA, 13 nt, Homo sapiens
gcuacaagggaag

SEQ ID NO: 522957 - RNA, 23 nt, Homo sapiens
gcuacaucuuuuuuucuaugaaa

SEQ ID NO: 522958 - RNA, 13 nt, Homo sapiens
gcuacuugggagg

SEQ ID NO: 522959 - RNA, 23 nt, Homo sapiens
gcuacuuuaacaccagguuuaug

SEQ ID NO: 522960 - RNA, 20 nt, Homo sapiens
gcuagaaggcaaagugcaca

SEQ ID NO: 522961 - RNA, 23 nt, Homo sapiens
gcuagaaggcaaagugcacauga

SEQ ID NO: 522962 - RNA, 14 nt, Homo sapiens
gcuaugaagccaac

SEQ ID NO: 522963 - RNA, 14 nt, Homo sapiens
gcuaugccaugugc

SEQ ID NO: 522964 - RNA, 14 nt, Homo sapiens
gcuauguaaggguc

SEQ ID NO: 522965 - RNA, 13 nt, Homo sapiens
gcuauugcugcug

SEQ ID NO: 522966 - RNA, 19 nt, Homo sapiens
gcucagaucucaugggaua

SEQ ID NO: 522967 - RNA, 17 nt, Homo sapiens
gcucagauuguaauaug

SEQ ID NO: 522968 - RNA, 16 nt, Homo sapiens
gcucaucugauuuuug

SEQ ID NO: 522969 - RNA, 11 nt, Homo sapiens
gcucaugccug

SEQ ID NO: 522970 - RNA, 16 nt, Homo sapiens
gcucaugccuguaauc

SEQ ID NO: 522971 - RNA, 17 nt, Homo sapiens
gcuccaggccugcagca

SEQ ID NO: 522972 - RNA, 14 nt, Homo sapiens
gcucccuguccuag

SEQ ID NO: 522973 - RNA, 22 nt, Homo sapiens
gcuccucggacucugcuuuaug

SEQ ID NO: 522974 - RNA, 17 nt, Homo sapiens
gcucuaauguacaauaa

SEQ ID NO: 522975 - RNA, 13 nt, Homo sapiens
gcucucgacagua

SEQ ID NO: 522976 - RNA, 14 nt, Homo sapiens
gcucugaaggucca

SEQ ID NO: 522977 - RNA, 14 nt, Homo sapiens
gcucugcugcugau

SEQ ID NO: 522978 - RNA, 11 nt, Homo sapiens
gcucuucacau

SEQ ID NO: 522979 - RNA, 15 nt, Homo sapiens
gcucuucacuguggu

SEQ ID NO: 522980 - RNA, 15 nt, Homo sapiens
gcucuuugcugcacu

SEQ ID NO: 522981 - RNA, 16 nt, Homo sapiens
gcugaagcuggugcgc

SEQ ID NO: 522982 - RNA, 15 nt, Homo sapiens
gcugagauuacucug

SEQ ID NO: 522983 - RNA, 21 nt, Homo sapiens
gcugagauuacucugaaaaug

SEQ ID NO: 522984 - RNA, 22 nt, Homo sapiens
gcugagauugagcagaagauca

SEQ ID NO: 522985 - RNA, 16 nt, Homo sapiens
gcugcuagagccagca

SEQ ID NO: 522986 - RNA, 17 nt, Homo sapiens
gcugcuagagccagcaa

SEQ ID NO: 522987 - RNA, 15 nt, Homo sapiens
gcugcuggugcacag

SEQ ID NO: 522988 - RNA, 15 nt, Homo sapiens
gcuggaaggggucca

SEQ ID NO: 522989 - RNA, 17 nt, Homo sapiens
gcuggacuucuaccugc

SEQ ID NO: 522990 - RNA, 18 nt, Homo sapiens
gcuggacuucuaccugcc

SEQ ID NO: 522991 - RNA, 16 nt, Homo sapiens
gcuggcaagucuucca

SEQ ID NO: 522992 - RNA, 15 nt, Homo sapiens
gcuggcaucaagagg

SEQ ID NO: 522993 - RNA, 22 nt, Homo sapiens
gcuggcuggaaaaaggugaaug

SEQ ID NO: 522994 - RNA, 13 nt, Homo sapiens
gcugggccauguc

SEQ ID NO: 522995 - RNA, 22 nt, Homo sapiens
gcuguauuuuuauuuuugcaca

SEQ ID NO: 522996 - RNA, 13 nt, Homo sapiens
gcugugcacagac

SEQ ID NO: 522997 - RNA, 22 nt, Homo sapiens
gcuguggagagggucaaggagu

SEQ ID NO: 522998 - RNA, 19 nt, Homo sapiens
gcuguggguuuuggugugg

SEQ ID NO: 522999 - RNA, 17 nt, Homo sapiens
gcuguuauuucuucccu

SEQ ID NO: 523000 - RNA, 16 nt, Homo sapiens
gcuuaauugacugaaa

SEQ ID NO: 523001 - RNA, 15 nt, Homo sapiens
gcuuaguaacuagug

SEQ ID NO: 523002 - RNA, 20 nt, Homo sapiens
gcuucaaggauauacugcag

SEQ ID NO: 523003 - RNA, 18 nt, Homo sapiens
gcuucaccaagaagcaaa

SEQ ID NO: 523004 - RNA, 15 nt, Homo sapiens
gcuucauuuuacuaa

SEQ ID NO: 523005 - RNA, 23 nt, Homo sapiens
gcuuccuccccucggaaggugcg

SEQ ID NO: 523006 - RNA, 17 nt, Homo sapiens
gcuucuagaguuuuaua

SEQ ID NO: 523007 - RNA, 23 nt, Homo sapiens
gcuugccugcagggccauggcuc

SEQ ID NO: 523008 - RNA, 13 nt, Homo sapiens
gcuuuccaagcuu

SEQ ID NO: 523009 - RNA, 15 nt, Homo sapiens
gcuuucccacuuccc

SEQ ID NO: 523010 - RNA, 15 nt, Homo sapiens
gcuuugaaaaaguuu

SEQ ID NO: 523011 - RNA, 17 nt, Homo sapiens
gcuuuguccugaaggaa

SEQ ID NO: 523012 - RNA, 15 nt, Homo sapiens
gcuuugucuacuuca

SEQ ID NO: 523013 - RNA, 16 nt, Homo sapiens
gcuuuugcuugcaaug

SEQ ID NO: 523014 - RNA, 14 nt, Homo sapiens
ggaaaacgugcuuu

SEQ ID NO: 523015 - RNA, 21 nt, Homo sapiens
ggaaaauaaauacauucgaag

SEQ ID NO: 523016 - RNA, 12 nt, Homo sapiens
ggaaaaugacuc

SEQ ID NO: 523017 - RNA, 14 nt, Homo sapiens
ggaaaauucuuaaa

SEQ ID NO: 523018 - RNA, 15 nt, Homo sapiens
ggaaagaaccgaaga

SEQ ID NO: 523019 - RNA, 19 nt, Homo sapiens
ggaaaggugacuuccucug

SEQ ID NO: 523020 - RNA, 18 nt, Homo sapiens
ggaaaugguggugcuuua

SEQ ID NO: 523021 - RNA, 15 nt, Homo sapiens
ggaaauuaagacuuu

SEQ ID NO: 523022 - RNA, 17 nt, Homo sapiens
ggaaauuaagacuuuau

SEQ ID NO: 523023 - RNA, 18 nt, Homo sapiens
ggaacagauuucaaaaaa

SEQ ID NO: 523024 - RNA, 20 nt, Homo sapiens
ggaacccccaucucuacuaa

SEQ ID NO: 523025 - RNA, 18 nt, Homo sapiens
ggaagaaugaacacuccc

SEQ ID NO: 523026 - RNA, 21 nt, Homo sapiens
ggaagacuuugugacugucac

SEQ ID NO: 523027 - RNA, 21 nt, Homo sapiens
ggaagaggaacagcacugggg

SEQ ID NO: 523028 - RNA, 17 nt, Homo sapiens
gaaaugaaaucuuccca

SEQ ID NO: 523029 - RNA, 22 nt, Homo sapiens
gaaaugauccccaaguggugaa

SEQ ID NO: 523030 - RNA, 23 nt, Homo sapiens
gaaauguuuaauaaagcuuuaua

SEQ ID NO: 523031 - RNA, 17 nt, Homo sapiens
gaaauuaagacuuuaug

SEQ ID NO: 523032 - RNA, 18 nt, Homo sapiens
gaaauugcauacuuugua

SEQ ID NO: 523033 - RNA, 19 nt, Homo sapiens
gaacagcaauggugucagu

SEQ ID NO: 523034 - RNA, 17 nt, Homo sapiens
gaaccauguguggcaaa

SEQ ID NO: 523035 - RNA, 17 nt, Homo sapiens
gaacugcguggugcucu

SEQ ID NO: 523036 - RNA, 20 nt, Homo sapiens
gaacuugcaauaccaauguu

SEQ ID NO: 523037 - RNA, 13 nt, Homo sapiens
gaagaacauagaa

SEQ ID NO: 523038 - RNA, 17 nt, Homo sapiens
gaagaaccaaauaccuc

SEQ ID NO: 523039 - RNA, 18 nt, Homo sapiens
gaagaaccaaauaccuca

SEQ ID NO: 523040 - RNA, 13 nt, Homo sapiens
gaagacacacuca

SEQ ID NO: 523041 - RNA, 19 nt, Homo sapiens
gaagacagcugcuggguca

SEQ ID NO: 523042 - RNA, 16 nt, Homo sapiens
gaagagaaaggacuca

SEQ ID NO: 523043 - RNA, 19 nt, Homo sapiens
gaagcacuacaccuugccu

SEQ ID NO: 523044 - RNA, 17 nt, Homo sapiens
gaagcagucuugcucug

SEQ ID NO: 523045 - RNA, 23 nt, Homo sapiens
gaagcccugauguguccucaggg

SEQ ID NO: 523046 - RNA, 16 nt, Homo sapiens
gaagcuggccugagag

SEQ ID NO: 523047 - RNA, 14 nt, Homo sapiens
gaaggaaauucuua

SEQ ID NO: 523048 - RNA, 18 nt, Homo sapiens
gaaggaggggaaccagau

SEQ ID NO: 523049 - RNA, 16 nt, Homo sapiens
gaagggcauuaaccug

SEQ ID NO: 523050 - RNA, 18 nt, Homo sapiens
gaaggugcaggugacaga

SEQ ID NO: 523051 - RNA, 23 nt, Homo sapiens
gaagguuggcccccacgugggga

SEQ ID NO: 523052 - RNA, 16 nt, Homo sapiens
gaagucaucucauucc

SEQ ID NO: 523053 - RNA, 20 nt, Homo sapiens
gaagucaucucauuccacug

SEQ ID NO: 523054 - RNA, 15 nt, Homo sapiens
gaagugcgugaaugu

SEQ ID NO: 523055 - RNA, 22 nt, Homo sapiens
gaagugugcugugacaagccaa

SEQ ID NO: 523056 - RNA, 17 nt, Homo sapiens
gaauaaaaacuuuugag

SEQ ID NO: 523057 - RNA, 19 nt, Homo sapiens
gaauacccaggaagacuuu

SEQ ID NO: 523058 - RNA, 22 nt, Homo sapiens
gaauaggcugaugggcaaaaaa

SEQ ID NO: 523059 - RNA, 20 nt, Homo sapiens
gaauauccuuuaaaauuuaa

SEQ ID NO: 523060 - RNA, 15 nt, Homo sapiens
gaaucagcugggaug

SEQ ID NO: 523061 - RNA, 19 nt, Homo sapiens
gaauccagaucauuccuca

SEQ ID NO: 523062 - RNA, 13 nt, Homo sapiens
gaaugaacacucc

SEQ ID NO: 523063 - RNA, 14 nt, Homo sapiens
gaaugaacacuccc

SEQ ID NO: 523064 - RNA, 21 nt, Homo sapiens
gaaugaagccuuagccaggag

SEQ ID NO: 523065 - RNA, 15 nt, Homo sapiens
gaaugaccaagcuca

SEQ ID NO: 523066 - RNA, 16 nt, Homo sapiens
gaauguggucucagga

SEQ ID NO: 523067 - RNA, 21 nt, Homo sapiens
gaauuagauuucuauaggauu

SEQ ID NO: 523068 - RNA, 18 nt, Homo sapiens
gaauucuuuccccaaaga

SEQ ID NO: 523069 - RNA, 18 nt, Homo sapiens
gaauuggaaaggaaaaga

SEQ ID NO: 523070 - RNA, 18 nt, Homo sapiens
gaauuggaacugcaauga

SEQ ID NO: 523071 - RNA, 19 nt, Homo sapiens
gaauuugaagagauugcug

SEQ ID NO: 523072 - RNA, 19 nt, Homo sapiens
gaauuuuuugaauaugccu

SEQ ID NO: 523073 - RNA, 23 nt, Homo sapiens
gacaaagagauugagguucucua

SEQ ID NO: 523074 - RNA, 19 nt, Homo sapiens
gacaacauuauaacuguau

SEQ ID NO: 523075 - RNA, 13 nt, Homo sapiens
gacaacugugaag

SEQ ID NO: 523076 - RNA, 15 nt, Homo sapiens
aauaccaauguucua

SEQ ID NO: 523077 - RNA, 23 nt, Homo sapiens
aauacuuugcagcacagcugaga

SEQ ID NO: 523078 - RNA, 18 nt, Homo sapiens
aauagaaggauucaguca

SEQ ID NO: 523079 - RNA, 19 nt, Homo sapiens
aauagacacauacauguca

SEQ ID NO: 523080 - RNA, 10 nt, Homo sapiens
aauagaucuc

SEQ ID NO: 523081 - RNA, 21 nt, Homo sapiens
aauaggaaucuucacuagaag

SEQ ID NO: 523082 - RNA, 19 nt, Homo sapiens
aauagugaauaaagucauu

SEQ ID NO: 523083 - RNA, 18 nt, Homo sapiens
aauauaagcugccauaua

SEQ ID NO: 523084 - RNA, 21 nt, Homo sapiens
aauauauaguggguacaucaa

SEQ ID NO: 523085 - RNA, 14 nt, Homo sapiens
aauauccaccacuu

SEQ ID NO: 523086 - RNA, 22 nt, Homo sapiens
aauaugaaaaucuccaucucaa

SEQ ID NO: 523087 - RNA, 19 nt, Homo sapiens
aauaugcaaaccaggauuu

SEQ ID NO: 523088 - RNA, 22 nt, Homo sapiens
aauaugccuagcacaaguacca

SEQ ID NO: 523089 - RNA, 18 nt, Homo sapiens
aauauucaugcuugccau

SEQ ID NO: 523090 - RNA, 12 nt, Homo sapiens
aaucaacucuaa

SEQ ID NO: 523091 - RNA, 14 nt, Homo sapiens
aaucacaucuccag

SEQ ID NO: 523092 - RNA, 17 nt, Homo sapiens
aaucagauuagccugua

SEQ ID NO: 523093 - RNA, 13 nt, Homo sapiens
aaucccagcacuu

SEQ ID NO: 523094 - RNA, 18 nt, Homo sapiens
aauccccaacaugcacug

SEQ ID NO: 523095 - RNA, 20 nt, Homo sapiens
aauccgcauugauggccuca

SEQ ID NO: 523096 - RNA, 16 nt, Homo sapiens
aauccuugcauuuugg

SEQ ID NO: 523097 - RNA, 21 nt, Homo sapiens
aaucuaacaucguggcugugg

SEQ ID NO: 523098 - RNA, 15 nt, Homo sapiens
aaucuccaucucaaa

SEQ ID NO: 523099 - RNA, 16 nt, Homo sapiens
aaucuccaucucaaaa

SEQ ID NO: 523100 - RNA, 18 nt, Homo sapiens
aaucuucaaagccuucuc

SEQ ID NO: 523101 - RNA, 13 nt, Homo sapiens
aaugacaguaguc

SEQ ID NO: 523102 - RNA, 17 nt, Homo sapiens
aaugaugcacacugagg

SEQ ID NO: 523103 - RNA, 18 nt, Homo sapiens
aaugcaauaacucuggga

SEQ ID NO: 523104 - RNA, 15 nt, Homo sapiens
aaugccagucucauu

SEQ ID NO: 523105 - RNA, 22 nt, Homo sapiens
aaugcuucagauauuauugcuu

SEQ ID NO: 523106 - RNA, 16 nt, Homo sapiens
aaugcuucuguugauc

SEQ ID NO: 523107 - RNA, 14 nt, Homo sapiens
aauggaaaccaagg

SEQ ID NO: 523108 - RNA, 16 nt, Homo sapiens
aauggggaggacaaaa

SEQ ID NO: 523109 - RNA, 16 nt, Homo sapiens
aauggucucagcuuga

SEQ ID NO: 523110 - RNA, 17 nt, Homo sapiens
aauguaucaaauacauu

SEQ ID NO: 523111 - RNA, 15 nt, Homo sapiens
aaugucucaugucaa

SEQ ID NO: 523112 - RNA, 21 nt, Homo sapiens
aauguuaauugggcaggugaa

SEQ ID NO: 523113 - RNA, 19 nt, Homo sapiens
aauguugaaaaguaauuga

SEQ ID NO: 523114 - RNA, 13 nt, Homo sapiens
aauguuuaaucuc

SEQ ID NO: 523115 - RNA, 15 nt, Homo sapiens
aauguuuguucauua

SEQ ID NO: 523116 - RNA, 14 nt, Homo sapiens
aauuaagacuuuau

SEQ ID NO: 523117 - RNA, 15 nt, Homo sapiens
aauuaagauuaugug

SEQ ID NO: 523118 - RNA, 12 nt, Homo sapiens
aauuacuggaau

SEQ ID NO: 523119 - RNA, 22 nt, Homo sapiens
aauuagccauuucacucucaaa

SEQ ID NO: 523120 - RNA, 15 nt, Homo sapiens
aauuaguaagccaug

SEQ ID NO: 523121 - RNA, 15 nt, Homo sapiens
aauuauauagcugcu

SEQ ID NO: 523122 - RNA, 12 nt, Homo sapiens
aauucagugucu

SEQ ID NO: 523123 - RNA, 19 nt, Homo sapiens
aauucuccugccucagccu

SEQ ID NO: 523124 - RNA, 22 nt, Homo sapiens
aauucuucuguccugagaagca

SEQ ID NO: 523125 - RNA, 20 nt, Homo sapiens
aauugaagaaagucagcucu

SEQ ID NO: 523126 - RNA, 15 nt, Homo sapiens
aauugggcaggugaa

SEQ ID NO: 523127 - RNA, 12 nt, Homo sapiens
aauuguguuacu

SEQ ID NO: 523128 - RNA, 20 nt, Homo sapiens
aauuguuuagugauauuaca

SEQ ID NO: 523129 - RNA, 14 nt, Homo sapiens
aauuuaauuccucu

SEQ ID NO: 523130 - RNA, 20 nt, Homo sapiens
aauuuuacuccauaaacaga

SEQ ID NO: 523131 - RNA, 12 nt, Homo sapiens
aauuuuacuucu

SEQ ID NO: 523132 - RNA, 17 nt, Homo sapiens
aauuuuagcucuuccca

SEQ ID NO: 523133 - RNA, 18 nt, Homo sapiens
aauuuuauaucauuuuaa

SEQ ID NO: 523134 - RNA, 13 nt, Homo sapiens
aauuuucuuucac

SEQ ID NO: 523135 - RNA, 23 nt, Homo sapiens
aauuuuuauuguuguacauacga

SEQ ID NO: 523136 - RNA, 20 nt, Homo sapiens
acaaaaacuuagaugggcau

SEQ ID NO: 523137 - RNA, 15 nt, Homo sapiens
acaaaaauuagccag

SEQ ID NO: 523138 - RNA, 14 nt, Homo sapiens
acaaaccacaccac

SEQ ID NO: 523139 - RNA, 19 nt, Homo sapiens
acaaagcaguuacuaauau

SEQ ID NO: 523140 - RNA, 22 nt, Homo sapiens
acaaaggaguaguagcugaauu

SEQ ID NO: 523141 - RNA, 14 nt, Homo sapiens
acaaauacaugugu

SEQ ID NO: 523142 - RNA, 21 nt, Homo sapiens
acaaaucuucaguauuuucuc

SEQ ID NO: 523143 - RNA, 17 nt, Homo sapiens
acaaauuaauuuuacuc

SEQ ID NO: 523144 - RNA, 17 nt, Homo sapiens
acaaauuagccauuuca

SEQ ID NO: 523145 - RNA, 24 nt, Homo sapiens
acaaauuagccauuucacucucaa

SEQ ID NO: 523146 - RNA, 15 nt, Homo sapiens
acaacauccacuguu

SEQ ID NO: 523147 - RNA, 17 nt, Homo sapiens
acaacauuguagccuca

SEQ ID NO: 523148 - RNA, 22 nt, Homo sapiens
acaagaaagucauuagacggua

SEQ ID NO: 523149 - RNA, 15 nt, Homo sapiens
acaagagaucuacac

SEQ ID NO: 523150 - RNA, 16 nt, Homo sapiens
acaaggcccugagcuu

SEQ ID NO: 523151 - RNA, 21 nt, Homo sapiens
acaaguaccacucuuggucag

SEQ ID NO: 523152 - RNA, 23 nt, Homo sapiens
acaauacugggguuggacuguaa

SEQ ID NO: 523153 - RNA, 13 nt, Homo sapiens
acacacacaccaa

SEQ ID NO: 523154 - RNA, 16 nt, Homo sapiens
acacacccugagguca

SEQ ID NO: 523155 - RNA, 11 nt, Homo sapiens
acacacugacc

SEQ ID NO: 523156 - RNA, 11 nt, Homo sapiens
acacacugucu

SEQ ID NO: 523157 - RNA, 20 nt, Homo sapiens
acacagagcuuuggucugug

SEQ ID NO: 523158 - RNA, 16 nt, Homo sapiens
acacaggcuguccuua

SEQ ID NO: 523159 - RNA, 13 nt, Homo sapiens
acacaggcuucau

SEQ ID NO: 523160 - RNA, 23 nt, Homo sapiens
acacauaauuucuuaauuuucac

SEQ ID NO: 523161 - RNA, 22 nt, Homo sapiens
acaccaaugaaaacauguacua

SEQ ID NO: 523162 - RNA, 21 nt, Homo sapiens
acacccagugggaagagugug

SEQ ID NO: 523163 - RNA, 20 nt, Homo sapiens
acaccguacaucugcaauau

SEQ ID NO: 523164 - RNA, 13 nt, Homo sapiens
acacggcacauuu

SEQ ID NO: 523165 - RNA, 18 nt, Homo sapiens
acacuagaaaacuugacu

SEQ ID NO: 523166 - RNA, 18 nt, Homo sapiens
acacuccauuauuccucu

SEQ ID NO: 523167 - RNA, 19 nt, Homo sapiens
acacugaaaaauauuccaa

SEQ ID NO: 523168 - RNA, 14 nt, Homo sapiens
acacuguggccagg

SEQ ID NO: 523169 - RNA, 20 nt, Homo sapiens
acagaaagagacuccgucuc

SEQ ID NO: 523170 - RNA, 21 nt, Homo sapiens
acagaaagagacuccgucuca

SEQ ID NO: 523171 - RNA, 23 nt, Homo sapiens
acagaacuaaaaauuaaaaccuc

SEQ ID NO: 523172 - RNA, 16 nt, Homo sapiens
acagacauacauuucu

SEQ ID NO: 523173 - RNA, 16 nt, Homo sapiens
acagaccucaguuuua

SEQ ID NO: 523174 - RNA, 14 nt, Homo sapiens
acagauucuuucag

SEQ ID NO: 523175 - RNA, 17 nt, Homo sapiens
acagcaauggugucagu

SEQ ID NO: 523176 - RNA, 16 nt, Homo sapiens
acagcacuggggaguc

SEQ ID NO: 523177 - RNA, 15 nt, Homo sapiens
acagcagacuaguua

SEQ ID NO: 523178 - RNA, 16 nt, Homo sapiens
acagcaugugccuuaa

SEQ ID NO: 523179 - RNA, 17 nt, Homo sapiens
acagccucuuacuugcc

SEQ ID NO: 523180 - RNA, 21 nt, Homo sapiens
acagcuauauuugauuaugua

SEQ ID NO: 523181 - RNA, 21 nt, Homo sapiens
acagcugccaucgaccuggag

SEQ ID NO: 523182 - RNA, 16 nt, Homo sapiens
acaggguccucagcuc

SEQ ID NO: 523183 - RNA, 13 nt, Homo sapiens
acaguacugauac

SEQ ID NO: 523184 - RNA, 13 nt, Homo sapiens
acagucuucccag

SEQ ID NO: 523185 - RNA, 17 nt, Homo sapiens
acagugacuggugccag

SEQ ID NO: 523186 - RNA, 15 nt, Homo sapiens
acagugccaacuccu

SEQ ID NO: 523187 - RNA, 17 nt, Homo sapiens
acagugccgacagcucu

SEQ ID NO: 523188 - RNA, 18 nt, Homo sapiens
acagugccgacagcucuc

SEQ ID NO: 523189 - RNA, 20 nt, Homo sapiens
acagugccgacagcucucca

SEQ ID NO: 523190 - RNA, 13 nt, Homo sapiens
acaguggacaaag

SEQ ID NO: 523191 - RNA, 18 nt, Homo sapiens
acaguggggcugcaggca

SEQ ID NO: 523192 - RNA, 19 nt, Homo sapiens
acaguggggcugcaggcag

SEQ ID NO: 523193 - RNA, 19 nt, Homo sapiens
acauaacuccugucccuuu

SEQ ID NO: 523194 - RNA, 14 nt, Homo sapiens
acauaauaauagca

SEQ ID NO: 523195 - RNA, 23 nt, Homo sapiens
acauaauaauagcagugguaaaa

SEQ ID NO: 523196 - RNA, 12 nt, Homo sapiens
aggcucuaaugu

SEQ ID NO: 523197 - RNA, 16 nt, Homo sapiens
aggcucuaauguacaa

SEQ ID NO: 523198 - RNA, 15 nt, Homo sapiens
aggcugccccucuca

SEQ ID NO: 523199 - RNA, 18 nt, Homo sapiens
aggcugccccucucacca

SEQ ID NO: 523200 - RNA, 20 nt, Homo sapiens
aggcuggagugcaguggugu

SEQ ID NO: 523201 - RNA, 17 nt, Homo sapiens
aggcugggccaugucca

SEQ ID NO: 523202 - RNA, 15 nt, Homo sapiens
aggcuucaucaaggu

SEQ ID NO: 523203 - RNA, 23 nt, Homo sapiens
agggaaggcuguuugagaaccau

SEQ ID NO: 523204 - RNA, 20 nt, Homo sapiens
agggagaaacuucugcucag

SEQ ID NO: 523205 - RNA, 17 nt, Homo sapiens
agggagugcuggcucac

SEQ ID NO: 523206 - RNA, 19 nt, Homo sapiens
agggccaguugguguuccu

SEQ ID NO: 523207 - RNA, 17 nt, Homo sapiens
agggcuggagccugggg

SEQ ID NO: 523208 - RNA, 13 nt, Homo sapiens
aggggaaagagag

SEQ ID NO: 523209 - RNA, 14 nt, Homo sapiens
aggggaaagagaga

SEQ ID NO: 523210 - RNA, 19 nt, Homo sapiens
aggggagcaguggccauca

SEQ ID NO: 523211 - RNA, 12 nt, Homo sapiens
aggggccugcag

SEQ ID NO: 523212 - RNA, 21 nt, Homo sapiens
agggggaugccacuccucccu

SEQ ID NO: 523213 - RNA, 14 nt, Homo sapiens
aggggugugcugag

SEQ ID NO: 523214 - RNA, 17 nt, Homo sapiens
agggucugugugaaugu

SEQ ID NO: 523215 - RNA, 18 nt, Homo sapiens
aggguuacugacguguaa

SEQ ID NO: 523216 - RNA, 18 nt, Homo sapiens
agguagaagugagcaaaa

SEQ ID NO: 523217 - RNA, 22 nt, Homo sapiens
aggucagggagugcuggcucac

SEQ ID NO: 523218 - RNA, 18 nt, Homo sapiens
aggucauaaagcauugga

SEQ ID NO: 523219 - RNA, 21 nt, Homo sapiens
agguccuuauguccugucaua

SEQ ID NO: 523220 - RNA, 17 nt, Homo sapiens
aggucuccuaaaacugg

SEQ ID NO: 523221 - RNA, 22 nt, Homo sapiens
aggucugcccggagcagcagcu

SEQ ID NO: 523222 - RNA, 16 nt, Homo sapiens
aggugauuccagugaa

SEQ ID NO: 523223 - RNA, 17 nt, Homo sapiens
aggugcccagaauuuac

SEQ ID NO: 523224 - RNA, 12 nt, Homo sapiens
aggugccuguaa

SEQ ID NO: 523225 - RNA, 22 nt, Homo sapiens
aggugcuaugaagccaacugac

SEQ ID NO: 523226 - RNA, 18 nt, Homo sapiens
aggugggcagaucacuug

SEQ ID NO: 523227 - RNA, 21 nt, Homo sapiens
aggugggccuugcuaccucaa

SEQ ID NO: 523228 - RNA, 20 nt, Homo sapiens
aggugugaaccuaccugccu

SEQ ID NO: 523229 - RNA, 16 nt, Homo sapiens
agguucagcugaagcu

SEQ ID NO: 523230 - RNA, 18 nt, Homo sapiens
agguuccacagaggacac

SEQ ID NO: 523231 - RNA, 19 nt, Homo sapiens
agguucuaggcuaccagaa

SEQ ID NO: 523232 - RNA, 22 nt, Homo sapiens
agguuugguuugguuuuggaca

SEQ ID NO: 523233 - RNA, 14 nt, Homo sapiens
aguaaauuaggcag

SEQ ID NO: 523234 - RNA, 15 nt, Homo sapiens
aguaacuccccucag

SEQ ID NO: 523235 - RNA, 23 nt, Homo sapiens
aguaacugugagaacccaguuuc

SEQ ID NO: 523236 - RNA, 19 nt, Homo sapiens
aguaauugaaaaaggugau

SEQ ID NO: 523237 - RNA, 15 nt, Homo sapiens
aguacacagauaccu

SEQ ID NO: 523238 - RNA, 21 nt, Homo sapiens
aguaccuugcuucuuacugau

SEQ ID NO: 523239 - RNA, 22 nt, Homo sapiens
aguaccuuuuccuacacagcgg

SEQ ID NO: 523240 - RNA, 19 nt, Homo sapiens
aguacuccaagacagagac

SEQ ID NO: 523241 - RNA, 20 nt, Homo sapiens
aguacuccaagacagagaca

SEQ ID NO: 523242 - RNA, 13 nt, Homo sapiens
aguacugaugaaa

SEQ ID NO: 523243 - RNA, 15 nt, Homo sapiens
aguauauaggugcug

SEQ ID NO: 523244 - RNA, 15 nt, Homo sapiens
aguauccaggcuuug

SEQ ID NO: 523245 - RNA, 16 nt, Homo sapiens
aguaugguguguucac

SEQ ID NO: 523246 - RNA, 20 nt, Homo sapiens
aguauugucgguuaccucug

SEQ ID NO: 523247 - RNA, 17 nt, Homo sapiens
agucaucaucagggccu

SEQ ID NO: 523248 - RNA, 16 nt, Homo sapiens
agucaucucauuccac

SEQ ID NO: 523249 - RNA, 17 nt, Homo sapiens
agucccacacugugcag

SEQ ID NO: 523250 - RNA, 16 nt, Homo sapiens
agucccacacuguggc

SEQ ID NO: 523251 - RNA, 15 nt, Homo sapiens
agucccacuacuugu

SEQ ID NO: 523252 - RNA, 15 nt, Homo sapiens
agucuaaacagaguc

SEQ ID NO: 523253 - RNA, 14 nt, Homo sapiens
agucugaaacuggc

SEQ ID NO: 523254 - RNA, 23 nt, Homo sapiens
agucuugguuucucucuacagug

SEQ ID NO: 523255 - RNA, 19 nt, Homo sapiens
agugaauccugaaacuggu

SEQ ID NO: 523256 - RNA, 18 nt, Homo sapiens
agugacagcagucaggga

SEQ ID NO: 523257 - RNA, 12 nt, Homo sapiens
agugacauguag

SEQ ID NO: 523258 - RNA, 13 nt, Homo sapiens
agugacuggugcc

SEQ ID NO: 523259 - RNA, 17 nt, Homo sapiens
agugagccgagaucaug

SEQ ID NO: 523260 - RNA, 14 nt, Homo sapiens
agugcacuacugua

SEQ ID NO: 523261 - RNA, 19 nt, Homo sapiens
agugccgacagcucuccaa

SEQ ID NO: 523262 - RNA, 21 nt, Homo sapiens
agugccucaccuuccaacacu

SEQ ID NO: 523263 - RNA, 19 nt, Homo sapiens
agugccucuguuaccacca

SEQ ID NO: 523264 - RNA, 21 nt, Homo sapiens
agugccuuaaacucuguuaca

SEQ ID NO: 523265 - RNA, 14 nt, Homo sapiens
agugcuggcucaca

SEQ ID NO: 523266 - RNA, 18 nt, Homo sapiens
aguggacgugguaugaaa

SEQ ID NO: 523267 - RNA, 19 nt, Homo sapiens
aguggcgugggagccagcc

SEQ ID NO: 523268 - RNA, 21 nt, Homo sapiens
agugggagaguaccugugugu

SEQ ID NO: 523269 - RNA, 18 nt, Homo sapiens
agugggccauuaaaaacu

SEQ ID NO: 523270 - RNA, 22 nt, Homo sapiens
agugguaaaaguauuugcuuaa

SEQ ID NO: 523271 - RNA, 21 nt, Homo sapiens
agugucuguuccuggcaucua

SEQ ID NO: 523272 - RNA, 17 nt, Homo sapiens
agugugacagggccagu

SEQ ID NO: 523273 - RNA, 17 nt, Homo sapiens
aguguuauuugcacacu

SEQ ID NO: 523274 - RNA, 18 nt, Homo sapiens
aguguucacaacagugaa

SEQ ID NO: 523275 - RNA, 19 nt, Homo sapiens
aguguucccagagcacuuu

SEQ ID NO: 523276 - RNA, 15 nt, Homo sapiens
aguuaagaacaucaa

SEQ ID NO: 523277 - RNA, 15 nt, Homo sapiens
aguucccaggugaua

SEQ ID NO: 523278 - RNA, 23 nt, Homo sapiens
aguuccuuaucccucucuucccc

SEQ ID NO: 523279 - RNA, 16 nt, Homo sapiens
aguugaaaaugcaacu

SEQ ID NO: 523280 - RNA, 12 nt, Homo sapiens
aguugaacaugg

SEQ ID NO: 523281 - RNA, 14 nt, Homo sapiens
aguugauacuugaa

SEQ ID NO: 523282 - RNA, 16 nt, Homo sapiens
aguugauucuugccuu

SEQ ID NO: 523283 - RNA, 14 nt, Homo sapiens
aguugcacauuaau

SEQ ID NO: 523284 - RNA, 14 nt, Homo sapiens
aguugcagccaggg

SEQ ID NO: 523285 - RNA, 19 nt, Homo sapiens
aguuguaccaagugaaauu

SEQ ID NO: 523286 - RNA, 16 nt, Homo sapiens
aguuguuugaggcaaa

SEQ ID NO: 523287 - RNA, 18 nt, Homo sapiens
aguuucaaacuuacuauu

SEQ ID NO: 523288 - RNA, 16 nt, Homo sapiens
aguuugauaccugcac

SEQ ID NO: 523289 - RNA, 18 nt, Homo sapiens
aguuugauaccugcacug

SEQ ID NO: 523290 - RNA, 21 nt, Homo sapiens
aguuugauaccugcacugucc

SEQ ID NO: 523291 - RNA, 20 nt, Homo sapiens
aguuuuacuaaaacacugaa

SEQ ID NO: 523292 - RNA, 23 nt, Homo sapiens
aguuuuacuaaaacacugaaaaa

SEQ ID NO: 523293 - RNA, 19 nt, Homo sapiens
aguuuuccuacacuugaga

SEQ ID NO: 523294 - RNA, 15 nt, Homo sapiens
aguuuuggcauaaua

SEQ ID NO: 523295 - RNA, 16 nt, Homo sapiens
aguuuuuaauuugaug

SEQ ID NO: 523296 - RNA, 10 nt, Homo sapiens
aguuuuuacu

SEQ ID NO: 523297 - RNA, 17 nt, Homo sapiens
auaaaauccugugcaau

SEQ ID NO: 523298 - RNA, 21 nt, Homo sapiens
auaaaauguuuaaucucugcu

SEQ ID NO: 523299 - RNA, 18 nt, Homo sapiens
auaaacggcaguguuaaa

SEQ ID NO: 523300 - RNA, 19 nt, Homo sapiens
auaaacuauuuauaucaca

SEQ ID NO: 523301 - RNA, 14 nt, Homo sapiens
auaaagccacugaa

SEQ ID NO: 523302 - RNA, 18 nt, Homo sapiens
auaaauacucagugauga

SEQ ID NO: 523303 - RNA, 17 nt, Homo sapiens
auaaaucucuccuauaa

SEQ ID NO: 523304 - RNA, 17 nt, Homo sapiens
auaaauuguagggcuuu

SEQ ID NO: 523305 - RNA, 22 nt, Homo sapiens
auaacaauucccccauccuuca

SEQ ID NO: 523306 - RNA, 17 nt, Homo sapiens
auaacuccugucccuuu

SEQ ID NO: 523307 - RNA, 20 nt, Homo sapiens
auaacuggguuggcucucaa

SEQ ID NO: 523308 - RNA, 18 nt, Homo sapiens
auaagcuaaagaggcuga

SEQ ID NO: 523309 - RNA, 13 nt, Homo sapiens
auaaguaggccau

SEQ ID NO: 523310 - RNA, 16 nt, Homo sapiens
auaauaaauacucagu

SEQ ID NO: 523311 - RNA, 18 nt, Homo sapiens
auaauaaaugcccucuuc

SEQ ID NO: 523312 - RNA, 14 nt, Homo sapiens
auaauaacuacuuc

SEQ ID NO: 523313 - RNA, 17 nt, Homo sapiens
auaauaugaaaaucucc

SEQ ID NO: 523314 - RNA, 23 nt, Homo sapiens
auaauaugaaaaucuccaucuca

SEQ ID NO: 523315 - RNA, 17 nt, Homo sapiens
auaauucuuaacagugg

SEQ ID NO: 523316 - RNA, 20 nt, Homo sapiens
auuugguguguucguugcac

SEQ ID NO: 523317 - RNA, 16 nt, Homo sapiens
auuuuaagaagacaua

SEQ ID NO: 523318 - RNA, 13 nt, Homo sapiens
auuuuacuaaaaa

SEQ ID NO: 523319 - RNA, 19 nt, Homo sapiens
auuuucaaguuuacacuuc

SEQ ID NO: 523320 - RNA, 15 nt, Homo sapiens
auuuucuggaaugga

SEQ ID NO: 523321 - RNA, 14 nt, Homo sapiens
auuuugagaucauc

SEQ ID NO: 523322 - RNA, 13 nt, Homo sapiens
auuuugcaaaaau

SEQ ID NO: 523323 - RNA, 17 nt, Homo sapiens
auuuugguuuguguauc

SEQ ID NO: 523324 - RNA, 21 nt, Homo sapiens
auuuuguaauaauaaagaaua

SEQ ID NO: 523325 - RNA, 13 nt, Homo sapiens
auuuugugcaaaa

SEQ ID NO: 523326 - RNA, 15 nt, Homo sapiens
auuuuuaggcaaaga

SEQ ID NO: 523327 - RNA, 18 nt, Homo sapiens
auuuuuauuuuugcacaa

SEQ ID NO: 523328 - RNA, 16 nt, Homo sapiens
auuuuucaucaaacau

SEQ ID NO: 523329 - RNA, 20 nt, Homo sapiens
auuuuucuuagugugccaag

SEQ ID NO: 523330 - RNA, 18 nt, Homo sapiens
auuuuuuugcaugcaugc

SEQ ID NO: 523331 - RNA, 22 nt, Homo sapiens
auuuuuuuuaaagaagagugac

SEQ ID NO: 523332 - RNA, 18 nt, Homo sapiens
caaaaaaaauuuuagcuc

SEQ ID NO: 523333 - RNA, 20 nt, Homo sapiens
caaaaaaaauuuuagcucuu

SEQ ID NO: 523334 - RNA, 19 nt, Homo sapiens
caaaaauggauauuauuag

SEQ ID NO: 523335 - RNA, 21 nt, Homo sapiens
caaaaauggauauuauuagaa

SEQ ID NO: 523336 - RNA, 12 nt, Homo sapiens
caaaacaauuaa

SEQ ID NO: 523337 - RNA, 18 nt, Homo sapiens
caaaacaauuaaucauuu

SEQ ID NO: 523338 - RNA, 14 nt, Homo sapiens
caaaaccuguauua

SEQ ID NO: 523339 - RNA, 17 nt, Homo sapiens
caaaacuaaccaucuga

SEQ ID NO: 523340 - RNA, 14 nt, Homo sapiens
caaaauauuucuca

SEQ ID NO: 523341 - RNA, 14 nt, Homo sapiens
caaacaaugugcug

SEQ ID NO: 523342 - RNA, 16 nt, Homo sapiens
caaaccaagcaaagga

SEQ ID NO: 523343 - RNA, 17 nt, Homo sapiens
caaaccaggauuuccuu

SEQ ID NO: 523344 - RNA, 21 nt, Homo sapiens
caaaccaggauuuccuugacu

SEQ ID NO: 523345 - RNA, 16 nt, Homo sapiens
caaacuugcaguuuaa

SEQ ID NO: 523346 - RNA, 17 nt, Homo sapiens
caaagaaaggagauaca

SEQ ID NO: 523347 - RNA, 13 nt, Homo sapiens
caaagaggcugcc

SEQ ID NO: 523348 - RNA, 20 nt, Homo sapiens
caaagaggcugccccucuca

SEQ ID NO: 523349 - RNA, 24 nt, Homo sapiens
caaaguauaaccauaugauacuau

SEQ ID NO: 523350 - RNA, 16 nt, Homo sapiens
caaaguugaaaauuca

SEQ ID NO: 523351 - RNA, 22 nt, Homo sapiens
caaauaaauguucaauggaugc

SEQ ID NO: 523352 - RNA, 14 nt, Homo sapiens
caaauggccucaug

SEQ ID NO: 523353 - RNA, 17 nt, Homo sapiens
caaaugucauugucuac

SEQ ID NO: 523354 - RNA, 14 nt, Homo sapiens
caaauuaguacaga

SEQ ID NO: 523355 - RNA, 20 nt, Homo sapiens
caaauugggaaauccauucc

SEQ ID NO: 523356 - RNA, 21 nt, Homo sapiens
caaauuuccuuucauaccuug

SEQ ID NO: 523357 - RNA, 14 nt, Homo sapiens
caaauuuucaaguu

SEQ ID NO: 523358 - RNA, 24 nt, Homo sapiens
caacaacauccacuguuagcacau

SEQ ID NO: 523359 - RNA, 17 nt, Homo sapiens
caacaauaaaguacuuu

SEQ ID NO: 523360 - RNA, 23 nt, Homo sapiens
caacaauaaaguacuuuaccuaa

SEQ ID NO: 523361 - RNA, 20 nt, Homo sapiens
caacacaucucccuuuucca

SEQ ID NO: 523362 - RNA, 20 nt, Homo sapiens
caacauagugagacacuguc

SEQ ID NO: 523363 - RNA, 13 nt, Homo sapiens
caacaugcugccc

SEQ ID NO: 523364 - RNA, 16 nt, Homo sapiens
caacauuguagccuca

SEQ ID NO: 523365 - RNA, 16 nt, Homo sapiens
caaccucauccaggcu

SEQ ID NO: 523366 - RNA, 16 nt, Homo sapiens
caaccuccaacaacga

SEQ ID NO: 523367 - RNA, 17 nt, Homo sapiens
caaccugacucaggcca

SEQ ID NO: 523368 - RNA, 12 nt, Homo sapiens
caacucacauua

SEQ ID NO: 523369 - RNA, 22 nt, Homo sapiens
caagaaagcucacuguagcuuu

SEQ ID NO: 523370 - RNA, 13 nt, Homo sapiens
caagaagaaauca

SEQ ID NO: 523371 - RNA, 20 nt, Homo sapiens
caagaaguucuuguucuuca

SEQ ID NO: 523372 - RNA, 17 nt, Homo sapiens
caagauacgcucgccac

SEQ ID NO: 523373 - RNA, 17 nt, Homo sapiens
caagaugcgcacugcau

SEQ ID NO: 523374 - RNA, 21 nt, Homo sapiens
caagaugcgcacugcauucca

SEQ ID NO: 523375 - RNA, 12 nt, Homo sapiens
caagcaccugca

SEQ ID NO: 523376 - RNA, 17 nt, Homo sapiens
caagcugguauuuucau

SEQ ID NO: 523377 - RNA, 19 nt, Homo sapiens
caaggaaacgcuaccucuc

SEQ ID NO: 523378 - RNA, 19 nt, Homo sapiens
caaggaguacaaugcccag

SEQ ID NO: 523379 - RNA, 18 nt, Homo sapiens
caaggaugcugucaagca

SEQ ID NO: 523380 - RNA, 20 nt, Homo sapiens
caaggcaguugcuuguguuu

SEQ ID NO: 523381 - RNA, 18 nt, Homo sapiens
caagggccaguugguguu

SEQ ID NO: 523382 - RNA, 21 nt, Homo sapiens
caaggguucuuggugaugcug

SEQ ID NO: 523383 - RNA, 13 nt, Homo sapiens
caaggugccuguu

SEQ ID NO: 523384 - RNA, 16 nt, Homo sapiens
caagucuuccaugacc

SEQ ID NO: 523385 - RNA, 20 nt, Homo sapiens
caaguugcaucagaaagcuu

SEQ ID NO: 523386 - RNA, 19 nt, Homo sapiens
caauaaagcaaugugguag

SEQ ID NO: 523387 - RNA, 19 nt, Homo sapiens
caauaaaggcagcugccuc

SEQ ID NO: 523388 - RNA, 14 nt, Homo sapiens
caauaaaguacuuu

SEQ ID NO: 523389 - RNA, 12 nt, Homo sapiens
caauaaauucau

SEQ ID NO: 523390 - RNA, 22 nt, Homo sapiens
caauacaucucacuuguuucua

SEQ ID NO: 523391 - RNA, 12 nt, Homo sapiens
caauaccaaugu

SEQ ID NO: 523392 - RNA, 14 nt, Homo sapiens
caauaccaauguuc

SEQ ID NO: 523393 - RNA, 22 nt, Homo sapiens
caauaugccuaguuucuuacac

SEQ ID NO: 523394 - RNA, 14 nt, Homo sapiens
caaucuauucugua

SEQ ID NO: 523395 - RNA, 18 nt, Homo sapiens
caaucugccuguaucucu

SEQ ID NO: 523396 - RNA, 14 nt, Homo sapiens
caaucuugaacuca

SEQ ID NO: 523397 - RNA, 15 nt, Homo sapiens
caaugcccagaucaa

SEQ ID NO: 523398 - RNA, 20 nt, Homo sapiens
caaugcuucuguugaucuca

SEQ ID NO: 523399 - RNA, 15 nt, Homo sapiens
caauuauuggcaaag

SEQ ID NO: 523400 - RNA, 23 nt, Homo sapiens
caauuccuucuucaacgccaucu

SEQ ID NO: 523401 - RNA, 18 nt, Homo sapiens
caauuuuugucucagaag

SEQ ID NO: 523402 - RNA, 19 nt, Homo sapiens
cacaaacaauauguuugca

SEQ ID NO: 523403 - RNA, 21 nt, Homo sapiens
cacaaaucagaccuggcugcu

SEQ ID NO: 523404 - RNA, 13 nt, Homo sapiens
cacaacagugaaa

SEQ ID NO: 523405 - RNA, 16 nt, Homo sapiens
cacacaggguggcaga

SEQ ID NO: 523406 - RNA, 19 nt, Homo sapiens
cacaccacaaccaccuuca

SEQ ID NO: 523407 - RNA, 19 nt, Homo sapiens
cacaccccaacacuuccag

SEQ ID NO: 523408 - RNA, 17 nt, Homo sapiens
cacacguuugugagcuc

SEQ ID NO: 523409 - RNA, 14 nt, Homo sapiens
cacagaggacacag

SEQ ID NO: 523410 - RNA, 20 nt, Homo sapiens
cacagucuucccagcaauua

SEQ ID NO: 523411 - RNA, 12 nt, Homo sapiens
cacaguggcacc

SEQ ID NO: 523412 - RNA, 21 nt, Homo sapiens
cacaucccauugggacuccau

SEQ ID NO: 523413 - RNA, 16 nt, Homo sapiens
cacaugcccaugauga

SEQ ID NO: 523414 - RNA, 15 nt, Homo sapiens
caccaaguaccagua

SEQ ID NO: 523415 - RNA, 13 nt, Homo sapiens
caccaccacuuac

SEQ ID NO: 523416 - RNA, 18 nt, Homo sapiens
caccacgggacaucacag

SEQ ID NO: 523417 - RNA, 14 nt, Homo sapiens
caccccaacacuuc

SEQ ID NO: 523418 - RNA, 12 nt, Homo sapiens
caccgcaguuuu

SEQ ID NO: 523419 - RNA, 23 nt, Homo sapiens
caccgccuccccaccuccaggcu

SEQ ID NO: 523420 - RNA, 21 nt, Homo sapiens
caccuaauguuuaugagccag

SEQ ID NO: 523421 - RNA, 21 nt, Homo sapiens
caccucaccucccgaagccac

SEQ ID NO: 523422 - RNA, 23 nt, Homo sapiens
caccuccaggcuuucccacuucc

SEQ ID NO: 523423 - RNA, 23 nt, Homo sapiens
caccuccgccagauccugcagaa

SEQ ID NO: 523424 - RNA, 21 nt, Homo sapiens
caccucggcacacacugugcc

SEQ ID NO: 523425 - RNA, 13 nt, Homo sapiens
caccucugugacc

SEQ ID NO: 523426 - RNA, 17 nt, Homo sapiens
caccucuuccuugaugu

SEQ ID NO: 523427 - RNA, 17 nt, Homo sapiens
caccuuaagauuuugca

SEQ ID NO: 523428 - RNA, 19 nt, Homo sapiens
caccuucacucuccagggu

SEQ ID NO: 523429 - RNA, 13 nt, Homo sapiens
caccuuuuacucu

SEQ ID NO: 523430 - RNA, 18 nt, Homo sapiens
cacuaaaguuaguaaaga

SEQ ID NO: 523431 - RNA, 18 nt, Homo sapiens
cacuacaccuugccuugc

SEQ ID NO: 523432 - RNA, 20 nt, Homo sapiens
cacuacaucugggacugacu

SEQ ID NO: 523433 - RNA, 14 nt, Homo sapiens
cacuagucagaaaa

SEQ ID NO: 523434 - RNA, 15 nt, Homo sapiens
cacuaucauggacua

SEQ ID NO: 523435 - RNA, 17 nt, Homo sapiens
cacuaugggugagcaua

SEQ ID NO: 523436 - RNA, 17 nt, Homo sapiens
uacacauuagauuuuau

SEQ ID NO: 523437 - RNA, 12 nt, Homo sapiens
uacagaaauauc

SEQ ID NO: 523438 - RNA, 22 nt, Homo sapiens
uacauaauuuaaaagcacacuc

SEQ ID NO: 523439 - RNA, 19 nt, Homo sapiens
uacauaugagaauauaccu

SEQ ID NO: 523440 - RNA, 21 nt, Homo sapiens
uacauaugagaauauaccuua

SEQ ID NO: 523441 - RNA, 20 nt, Homo sapiens
uacaucaaguccaucugaca

SEQ ID NO: 523442 - RNA, 23 nt, Homo sapiens
uacaucugcaauaugaauucaag

SEQ ID NO: 523443 - RNA, 14 nt, Homo sapiens
uacaugucacauuu

SEQ ID NO: 523444 - RNA, 21 nt, Homo sapiens
uacauucgaaggaaccugugu

SEQ ID NO: 523445 - RNA, 17 nt, Homo sapiens
uaccaauguaacacugg

SEQ ID NO: 523446 - RNA, 14 nt, Homo sapiens
uaccauuuccucag

SEQ ID NO: 523447 - RNA, 17 nt, Homo sapiens
uacccaucuaguacuug

SEQ ID NO: 523448 - RNA, 19 nt, Homo sapiens
uacccgagaagcacuugag

SEQ ID NO: 523449 - RNA, 17 nt, Homo sapiens
uacccucuugaauauaa

SEQ ID NO: 523450 - RNA, 18 nt, Homo sapiens
uaccuuaagagacacucc

SEQ ID NO: 523451 - RNA, 19 nt, Homo sapiens
uaccuuaagagacacucca

SEQ ID NO: 523452 - RNA, 13 nt, Homo sapiens
uacgaaccaugcc

SEQ ID NO: 523453 - RNA, 19 nt, Homo sapiens
uacuaacauuuucauugau

SEQ ID NO: 523454 - RNA, 24 nt, Homo sapiens
uacuaacauuuucauugaugagca

SEQ ID NO: 523455 - RNA, 20 nt, Homo sapiens
uacuaauaugccuagcacaa

SEQ ID NO: 523456 - RNA, 10 nt, Homo sapiens
uacucagcuu

SEQ ID NO: 523457 - RNA, 21 nt, Homo sapiens
uacucagguuaaugcugaaaa

SEQ ID NO: 523458 - RNA, 15 nt, Homo sapiens
uacuccaagacagag

SEQ ID NO: 523459 - RNA, 21 nt, Homo sapiens
uacucccccaccacucaggcc

SEQ ID NO: 523460 - RNA, 21 nt, Homo sapiens
uacuccuagaagaaccaaaua

SEQ ID NO: 523461 - RNA, 16 nt, Homo sapiens
uacucuggggugcugc

SEQ ID NO: 523462 - RNA, 21 nt, Homo sapiens
uacugaggugcuaugaagcca

SEQ ID NO: 523463 - RNA, 16 nt, Homo sapiens
uacugauaauuuugcu

SEQ ID NO: 523464 - RNA, 23 nt, Homo sapiens
uacugcaaaguguaugcaguauu

SEQ ID NO: 523465 - RNA, 16 nt, Homo sapiens
uacuggcuguggacca

SEQ ID NO: 523466 - RNA, 20 nt, Homo sapiens
uacuuaugaaaagaauuuga

SEQ ID NO: 523467 - RNA, 20 nt, Homo sapiens
uacuucuggaagucaucuca

SEQ ID NO: 523468 - RNA, 17 nt, Homo sapiens
uacuuuaaaaugccaau

SEQ ID NO: 523469 - RNA, 14 nt, Homo sapiens
uacuuuacugccug

SEQ ID NO: 523470 - RNA, 22 nt, Homo sapiens
uacuuuauuucugaucuauaca

SEQ ID NO: 523471 - RNA, 15 nt, Homo sapiens
uacuuugccacugcu

SEQ ID NO: 523472 - RNA, 21 nt, Homo sapiens
uagaaaaauauuauaacucau

SEQ ID NO: 523473 - RNA, 12 nt, Homo sapiens
uagaaaacuggg

SEQ ID NO: 523474 - RNA, 16 nt, Homo sapiens
uagaacgcuucgggaa

SEQ ID NO: 523475 - RNA, 18 nt, Homo sapiens
uagaaguuccuagugaug

SEQ ID NO: 523476 - RNA, 19 nt, Homo sapiens
uagaaucugugaccucuga

SEQ ID NO: 523477 - RNA, 22 nt, Homo sapiens
uagacgaggccacagcugccau

SEQ ID NO: 523478 - RNA, 16 nt, Homo sapiens
uagacuuauugccaaa

SEQ ID NO: 523479 - RNA, 19 nt, Homo sapiens
uagagaugguuucuacugg

SEQ ID NO: 523480 - RNA, 18 nt, Homo sapiens
uagagcauaccacuugaa

SEQ ID NO: 523481 - RNA, 20 nt, Homo sapiens
uagauccugguuaccacucu

SEQ ID NO: 523482 - RNA, 16 nt, Homo sapiens
uagcagaugguuucca

SEQ ID NO: 523483 - RNA, 17 nt, Homo sapiens
uagccagaggcucuaau

SEQ ID NO: 523484 - RNA, 22 nt, Homo sapiens
uagccagccccucuuccccaau

SEQ ID NO: 523485 - RNA, 16 nt, Homo sapiens
uagccaucuaaugcuu

SEQ ID NO: 523486 - RNA, 17 nt, Homo sapiens
uagcgucaagacauuug

SEQ ID NO: 523487 - RNA, 20 nt, Homo sapiens
uagcuaauaacaugugaaaa

SEQ ID NO: 523488 - RNA, 14 nt, Homo sapiens
uagcucaucuuaga

SEQ ID NO: 523489 - RNA, 22 nt, Homo sapiens
uagcuccauaaaguacaaauga

SEQ ID NO: 523490 - RNA, 15 nt, Homo sapiens
uagcucugcugcuga

SEQ ID NO: 523491 - RNA, 17 nt, Homo sapiens
uagcuuguuccacugca

SEQ ID NO: 523492 - RNA, 21 nt, Homo sapiens
uaggaaaauauggguugcauu

SEQ ID NO: 523493 - RNA, 20 nt, Homo sapiens
uaggccugguguguucaaga

SEQ ID NO: 523494 - RNA, 15 nt, Homo sapiens
uaggccugucccuug

SEQ ID NO: 523495 - RNA, 14 nt, Homo sapiens
uaggcugaugccac

SEQ ID NO: 523496 - RNA, 14 nt, Homo sapiens
uagguaucauucaa

SEQ ID NO: 523497 - RNA, 17 nt, Homo sapiens
uagguaucauucaacuc

SEQ ID NO: 523498 - RNA, 21 nt, Homo sapiens
uagguauuucuaacgccagca

SEQ ID NO: 523499 - RNA, 15 nt, Homo sapiens
uagguggcugagcau

SEQ ID NO: 523500 - RNA, 16 nt, Homo sapiens
uaguaauggcagagca

SEQ ID NO: 523501 - RNA, 16 nt, Homo sapiens
uaguagagcauaccac

SEQ ID NO: 523502 - RNA, 20 nt, Homo sapiens
uagucaauuucuacuucugg

SEQ ID NO: 523503 - RNA, 20 nt, Homo sapiens
uaguccccagccugcucccu

SEQ ID NO: 523504 - RNA, 14 nt, Homo sapiens
uagugaucauuuaa

SEQ ID NO: 523505 - RNA, 20 nt, Homo sapiens
uagugcuaaugcauuuugca

SEQ ID NO: 523506 - RNA, 19 nt, Homo sapiens
uaguggguacaucaagucc

SEQ ID NO: 523507 - RNA, 13 nt, Homo sapiens
uaguguaccuccu

SEQ ID NO: 523508 - RNA, 15 nt, Homo sapiens
uaguuagccaucuaa

SEQ ID NO: 523509 - RNA, 12 nt, Homo sapiens
uauaacauauau

SEQ ID NO: 523510 - RNA, 20 nt, Homo sapiens
uauaaccaagugugcucuuu

SEQ ID NO: 523511 - RNA, 19 nt, Homo sapiens
uauaauaaauacucaguga

SEQ ID NO: 523512 - RNA, 13 nt, Homo sapiens
uauaaucagagau

SEQ ID NO: 523513 - RNA, 14 nt, Homo sapiens
uauacaguacacag

SEQ ID NO: 523514 - RNA, 10 nt, Homo sapiens
uauacauaug

SEQ ID NO: 523515 - RNA, 12 nt, Homo sapiens
uauaccagcaga

SEQ ID NO: 523516 - RNA, 14 nt, Homo sapiens
uauaccauuuccuc

SEQ ID NO: 523517 - RNA, 16 nt, Homo sapiens
uauaccuuuugcauuu

SEQ ID NO: 523518 - RNA, 13 nt, Homo sapiens
uauacuuugccac

SEQ ID NO: 523519 - RNA, 15 nt, Homo sapiens
uauagaaaauucuug

SEQ ID NO: 523520 - RNA, 18 nt, Homo sapiens
uauagaaaauucuugaga

SEQ ID NO: 523521 - RNA, 15 nt, Homo sapiens
uauagauguuuacua

SEQ ID NO: 523522 - RNA, 20 nt, Homo sapiens
uauagcuaauaacaugugaa

SEQ ID NO: 523523 - RNA, 12 nt, Homo sapiens
uauagggaugag

SEQ ID NO: 523524 - RNA, 16 nt, Homo sapiens
uauaugcacuauguau

SEQ ID NO: 523525 - RNA, 16 nt, Homo sapiens
uaucaaauacauuuaa

SEQ ID NO: 523526 - RNA, 16 nt, Homo sapiens
uaucauggcauauaac

SEQ ID NO: 523527 - RNA, 23 nt, Homo sapiens
uaucauugcuaaacugaugacuu

SEQ ID NO: 523528 - RNA, 13 nt, Homo sapiens
uauccaugcaccu

SEQ ID NO: 523529 - RNA, 20 nt, Homo sapiens
uauccugagccaucggugaa

SEQ ID NO: 523530 - RNA, 19 nt, Homo sapiens
uaucuauuaucucaauuua

SEQ ID NO: 523531 - RNA, 17 nt, Homo sapiens
uaucugguuauaucauu

SEQ ID NO: 523532 - RNA, 16 nt, Homo sapiens
uaucuguuuacaucca

SEQ ID NO: 523533 - RNA, 20 nt, Homo sapiens
uaucuuccaaaugcaauuug

SEQ ID NO: 523534 - RNA, 20 nt, Homo sapiens
uaugaaaaucuccaucucaa

SEQ ID NO: 523535 - RNA, 16 nt, Homo sapiens
uaugaaaugaccucug

SEQ ID NO: 523536 - RNA, 14 nt, Homo sapiens
uaugaaaugacuuc

SEQ ID NO: 523537 - RNA, 17 nt, Homo sapiens
uaugagaauauaccuua

SEQ ID NO: 523538 - RNA, 18 nt, Homo sapiens
uaugagaauauaccuuau

SEQ ID NO: 523539 - RNA, 17 nt, Homo sapiens
uaugauaaaacacugcc

SEQ ID NO: 523540 - RNA, 14 nt, Homo sapiens
uaugccacugaccg

SEQ ID NO: 523541 - RNA, 16 nt, Homo sapiens
uauggguugcauuugg

SEQ ID NO: 523542 - RNA, 20 nt, Homo sapiens
uaugguauauauacauauau

SEQ ID NO: 523543 - RNA, 13 nt, Homo sapiens
uauguuugcugau

SEQ ID NO: 523544 - RNA, 21 nt, Homo sapiens
uauucgugcauuuuuggauca

SEQ ID NO: 523545 - RNA, 20 nt, Homo sapiens
uauucuauaaaacucugcau

SEQ ID NO: 523546 - RNA, 14 nt, Homo sapiens
uauugaauguuaaa

SEQ ID NO: 523547 - RNA, 16 nt, Homo sapiens
uauugcaagaguuuaa

SEQ ID NO: 523548 - RNA, 21 nt, Homo sapiens
uauugucgguuaccucugcau

SEQ ID NO: 523549 - RNA, 15 nt, Homo sapiens
uauuguuggcacaga

SEQ ID NO: 523550 - RNA, 23 nt, Homo sapiens
uauuucaaaguguguuggauuaa

SEQ ID NO: 523551 - RNA, 19 nt, Homo sapiens
uauuucaauucuaaaauac

SEQ ID NO: 523552 - RNA, 23 nt, Homo sapiens
uauuucuucaaauaaaucucucc

SEQ ID NO: 523553 - RNA, 13 nt, Homo sapiens
uauuugaggucag

SEQ ID NO: 523554 - RNA, 19 nt, Homo sapiens
uauuugcuuaaaauuguga

SEQ ID NO: 523555 - RNA, 20 nt, Homo sapiens
uauuugggcacaacacauca

SEQ ID NO: 523556 - RNA, 21 nt, Homo sapiens
ugccuggcguccccucccucu

SEQ ID NO: 523557 - RNA, 13 nt, Homo sapiens
ugccugggaugau

SEQ ID NO: 523558 - RNA, 14 nt, Homo sapiens
ugccuguaauccca

SEQ ID NO: 523559 - RNA, 16 nt, Homo sapiens
ugccuuaaacucuguu

SEQ ID NO: 523560 - RNA, 21 nt, Homo sapiens
ugccuuaauuuagaaacugaa

SEQ ID NO: 523561 - RNA, 14 nt, Homo sapiens
ugccuucugcugaa

SEQ ID NO: 523562 - RNA, 15 nt, Homo sapiens
ugccuucugcugaaa

SEQ ID NO: 523563 - RNA, 12 nt, Homo sapiens
ugcgaugcagcg

SEQ ID NO: 523564 - RNA, 14 nt, Homo sapiens
ugcgcacugcauuc

SEQ ID NO: 523565 - RNA, 21 nt, Homo sapiens
ugcggcugccauuggagccaa

SEQ ID NO: 523566 - RNA, 19 nt, Homo sapiens
ugcuaccccuacaucaucu

SEQ ID NO: 523567 - RNA, 18 nt, Homo sapiens
ugcuagaaaaauguucuu

SEQ ID NO: 523568 - RNA, 12 nt, Homo sapiens
ugcuagagccag

SEQ ID NO: 523569 - RNA, 16 nt, Homo sapiens
ugcuauccccaucucc

SEQ ID NO: 523570 - RNA, 21 nt, Homo sapiens
ugcuauccccaucucccugcc

SEQ ID NO: 523571 - RNA, 22 nt, Homo sapiens
ugcucagugggggcagagccac

SEQ ID NO: 523572 - RNA, 20 nt, Homo sapiens
ugcucaguguuuuugugaau

SEQ ID NO: 523573 - RNA, 19 nt, Homo sapiens
ugcuccguagcucugcugc

SEQ ID NO: 523574 - RNA, 22 nt, Homo sapiens
ugcucuccugacgcagcacaag

SEQ ID NO: 523575 - RNA, 20 nt, Homo sapiens
ugcucugaacuggaugauac

SEQ ID NO: 523576 - RNA, 15 nt, Homo sapiens
ugcucuuugcugcac

SEQ ID NO: 523577 - RNA, 18 nt, Homo sapiens
ugcugaaacucagugcaa

SEQ ID NO: 523578 - RNA, 19 nt, Homo sapiens
ugcugaaacucagugcaaa

SEQ ID NO: 523579 - RNA, 14 nt, Homo sapiens
ugcugauacugggu

SEQ ID NO: 523580 - RNA, 15 nt, Homo sapiens
ugcugcagucaucua

SEQ ID NO: 523581 - RNA, 12 nt, Homo sapiens
ugcugcugauac

SEQ ID NO: 523582 - RNA, 13 nt, Homo sapiens
ugcuggaagaauu

SEQ ID NO: 523583 - RNA, 21 nt, Homo sapiens
ugcuggacgccgagaaggccu

SEQ ID NO: 523584 - RNA, 18 nt, Homo sapiens
ugcuggcagccauggcca

SEQ ID NO: 523585 - RNA, 23 nt, Homo sapiens
ugcuggcagccauggccauggca

SEQ ID NO: 523586 - RNA, 12 nt, Homo sapiens
ugcuggugcaca

SEQ ID NO: 523587 - RNA, 13 nt, Homo sapiens
ugcuggugcacag

SEQ ID NO: 523588 - RNA, 14 nt, Homo sapiens
ugcuguaugcugau

SEQ ID NO: 523589 - RNA, 14 nt, Homo sapiens
ugcugucauaacau

SEQ ID NO: 523590 - RNA, 15 nt, Homo sapiens
ugcuuaaaauuguga

SEQ ID NO: 523591 - RNA, 16 nt, Homo sapiens
ugcuuccugacaauca

SEQ ID NO: 523592 - RNA, 14 nt, Homo sapiens
ugcuugcugcucau

SEQ ID NO: 523593 - RNA, 15 nt, Homo sapiens
ugcuuucaauuacaa

SEQ ID NO: 523594 - RNA, 16 nt, Homo sapiens
ugcuuuucccauugcc

SEQ ID NO: 523595 - RNA, 17 nt, Homo sapiens
ugcuuuuucugcgcuuc

SEQ ID NO: 523596 - RNA, 19 nt, Homo sapiens
uggaaaaggaagacuagag

SEQ ID NO: 523597 - RNA, 23 nt, Homo sapiens
uggaaacacccacucacuuugca

SEQ ID NO: 523598 - RNA, 17 nt, Homo sapiens
uggaaaguuuucuccac

SEQ ID NO: 523599 - RNA, 21 nt, Homo sapiens
uggaaauuccuguacuguguc

SEQ ID NO: 523600 - RNA, 16 nt, Homo sapiens
uggaacccccaucucu

SEQ ID NO: 523601 - RNA, 17 nt, Homo sapiens
uggaacuccuggccuuu

SEQ ID NO: 523602 - RNA, 22 nt, Homo sapiens
uggaacuguccuucccucaaag

SEQ ID NO: 523603 - RNA, 21 nt, Homo sapiens
uggaagcugagauuacucuga

SEQ ID NO: 523604 - RNA, 15 nt, Homo sapiens
uggaagucaucucau

SEQ ID NO: 523605 - RNA, 20 nt, Homo sapiens
uggaagucaucucauuccac

SEQ ID NO: 523606 - RNA, 21 nt, Homo sapiens
uggaaguguauuuauuuuaca

SEQ ID NO: 523607 - RNA, 12 nt, Homo sapiens
uggaauucuucu

SEQ ID NO: 523608 - RNA, 17 nt, Homo sapiens
uggacaaaugaugccau

SEQ ID NO: 523609 - RNA, 13 nt, Homo sapiens
uggagaaccucau

SEQ ID NO: 523610 - RNA, 18 nt, Homo sapiens
uggagacccugcaaacag

SEQ ID NO: 523611 - RNA, 19 nt, Homo sapiens
uggagagaagcaagccagc

SEQ ID NO: 523612 - RNA, 15 nt, Homo sapiens
uggagagaagggcau

SEQ ID NO: 523613 - RNA, 22 nt, Homo sapiens
uggagccaauguguggcucagu

SEQ ID NO: 523614 - RNA, 18 nt, Homo sapiens
uggagcuggcacugugga

SEQ ID NO: 523615 - RNA, 16 nt, Homo sapiens
uggaggcaguccaucu

SEQ ID NO: 523616 - RNA, 17 nt, Homo sapiens
uggaggccugugccuug

SEQ ID NO: 523617 - RNA, 14 nt, Homo sapiens
uggaguuguucaaa

SEQ ID NO: 523618 - RNA, 15 nt, Homo sapiens
uggauugacucugca

SEQ ID NO: 523619 - RNA, 16 nt, Homo sapiens
uggauugacucugcau

SEQ ID NO: 523620 - RNA, 18 nt, Homo sapiens
uggauuuucaucaggggc

SEQ ID NO: 523621 - RNA, 22 nt, Homo sapiens
uggcaaaaaggagccuuuugcu

SEQ ID NO: 523622 - RNA, 19 nt, Homo sapiens
uggcacuguggagcucagu

SEQ ID NO: 523623 - RNA, 19 nt, Homo sapiens
uggcagaucuacaugucua

SEQ ID NO: 523624 - RNA, 16 nt, Homo sapiens
uggcagccauggccau

SEQ ID NO: 523625 - RNA, 16 nt, Homo sapiens
uggccagaggugucac

SEQ ID NO: 523626 - RNA, 16 nt, Homo sapiens
uggccagccagaucaa

SEQ ID NO: 523627 - RNA, 13 nt, Homo sapiens
uggccaguucauu

SEQ ID NO: 523628 - RNA, 23 nt, Homo sapiens
uggccauuacccccagcuuugag

SEQ ID NO: 523629 - RNA, 20 nt, Homo sapiens
uggccucagcugaaugccuc

SEQ ID NO: 523630 - RNA, 20 nt, Homo sapiens
uggccucccuuugugugcau

SEQ ID NO: 523631 - RNA, 21 nt, Homo sapiens
uggccugugccagcaccacag

SEQ ID NO: 523632 - RNA, 14 nt, Homo sapiens
uggcucaugccugu

SEQ ID NO: 523633 - RNA, 17 nt, Homo sapiens
uggcuggaaggggucca

SEQ ID NO: 523634 - RNA, 19 nt, Homo sapiens
uggcugucucaaaccaagc

SEQ ID NO: 523635 - RNA, 18 nt, Homo sapiens
ugggaaauaugccacuga

SEQ ID NO: 523636 - RNA, 15 nt, Homo sapiens
ugggaacacaucugg

SEQ ID NO: 523637 - RNA, 12 nt, Homo sapiens
ugggacugugag

SEQ ID NO: 523638 - RNA, 20 nt, Homo sapiens
ugggagaguaaaccuugaag

SEQ ID NO: 523639 - RNA, 20 nt, Homo sapiens
ugggagccaggcccagaaag

SEQ ID NO: 523640 - RNA, 13 nt, Homo sapiens
ugggcacuggccc

SEQ ID NO: 523641 - RNA, 16 nt, Homo sapiens
ugggcagaucacuuga

SEQ ID NO: 523642 - RNA, 13 nt, Homo sapiens
ugggccagggucu

SEQ ID NO: 523643 - RNA, 17 nt, Homo sapiens
ugggccauguccaaaga

SEQ ID NO: 523644 - RNA, 18 nt, Homo sapiens
ugggccauguccaaagag

SEQ ID NO: 523645 - RNA, 21 nt, Homo sapiens
ugggcccacccggugggaccc

SEQ ID NO: 523646 - RNA, 22 nt, Homo sapiens
ugggcccacccggugggacccc

SEQ ID NO: 523647 - RNA, 18 nt, Homo sapiens
ugggcuacagaaaccaca

SEQ ID NO: 523648 - RNA, 18 nt, Homo sapiens
ugggcuggggccucagac

SEQ ID NO: 523649 - RNA, 15 nt, Homo sapiens
uggggaaaaaacugu

SEQ ID NO: 523650 - RNA, 17 nt, Homo sapiens
uggggaaaaaacugugc

SEQ ID NO: 523651 - RNA, 14 nt, Homo sapiens
uggggagguggagu

SEQ ID NO: 523652 - RNA, 15 nt, Homo sapiens
uggggaucagacaga

SEQ ID NO: 523653 - RNA, 12 nt, Homo sapiens
uggggggaccca

SEQ ID NO: 523654 - RNA, 19 nt, Homo sapiens
uggggggacccagugcaga

SEQ ID NO: 523655 - RNA, 14 nt, Homo sapiens
uggggggacugccu

SEQ ID NO: 523656 - RNA, 21 nt, Homo sapiens
uggggucuuugugguagcuua

SEQ ID NO: 523657 - RNA, 16 nt, Homo sapiens
uggguguacaaacuca

SEQ ID NO: 523658 - RNA, 23 nt, Homo sapiens
ugguaaacaguuuggaaaagugg

SEQ ID NO: 523659 - RNA, 16 nt, Homo sapiens
ugguacuauugugacc

SEQ ID NO: 523660 - RNA, 18 nt, Homo sapiens
ugguagcaagaagugauu

SEQ ID NO: 523661 - RNA, 18 nt, Homo sapiens
ugguauuauauaauucaa

SEQ ID NO: 523662 - RNA, 19 nt, Homo sapiens
uggucauaaaauagaauaa

SEQ ID NO: 523663 - RNA, 22 nt, Homo sapiens
uggucucaaacuccugaccuca

SEQ ID NO: 523664 - RNA, 21 nt, Homo sapiens
uggucuucuacugccuugaaa

SEQ ID NO: 523665 - RNA, 20 nt, Homo sapiens
uggugaaaccccgucucuac

SEQ ID NO: 523666 - RNA, 20 nt, Homo sapiens
uggugcgcccugucucugug

SEQ ID NO: 523667 - RNA, 15 nt, Homo sapiens
uggugcugcucugug

SEQ ID NO: 523668 - RNA, 21 nt, Homo sapiens
ugguggaacccccaucucuac

SEQ ID NO: 523669 - RNA, 14 nt, Homo sapiens
uggugucaguaucc

SEQ ID NO: 523670 - RNA, 20 nt, Homo sapiens
ugguuaggcagcaagcuuug

SEQ ID NO: 523671 - RNA, 15 nt, Homo sapiens
ugguuuccacauuua

SEQ ID NO: 523672 - RNA, 16 nt, Homo sapiens
ugguuucucucuacag

SEQ ID NO: 523673 - RNA, 20 nt, Homo sapiens
ugguuuuacagcuccuuuga

SEQ ID NO: 523674 - RNA, 22 nt, Homo sapiens
uguaaauagagcaaccuauaua

SEQ ID NO: 523675 - RNA, 16 nt, Homo sapiens
uguaaaugaaacuuaa

SEQ ID NO: 523676 - RNA, 18 nt, Homo sapiens
acuggggagucuuugugg

SEQ ID NO: 523677 - RNA, 16 nt, Homo sapiens
acuguaaacuucugca

SEQ ID NO: 523678 - RNA, 13 nt, Homo sapiens
acuguaagggauu

SEQ ID NO: 523679 - RNA, 12 nt, Homo sapiens
acuguacauuua

SEQ ID NO: 523680 - RNA, 19 nt, Homo sapiens
acuguagaaggccagcuga

SEQ ID NO: 523681 - RNA, 14 nt, Homo sapiens
acuguagcuuuuag

SEQ ID NO: 523682 - RNA, 16 nt, Homo sapiens
acuguauuucuaagaa

SEQ ID NO: 523683 - RNA, 19 nt, Homo sapiens
acugucaaaauauuucuca

SEQ ID NO: 523684 - RNA, 21 nt, Homo sapiens
acuguccugaccaucgcacac

SEQ ID NO: 523685 - RNA, 18 nt, Homo sapiens
acuguggagcucagugug

SEQ ID NO: 523686 - RNA, 14 nt, Homo sapiens
acuguggucauccu

SEQ ID NO: 523687 - RNA, 21 nt, Homo sapiens
acuguuaagaauagaaaacug

SEQ ID NO: 523688 - RNA, 19 nt, Homo sapiens
acuguuuaagcccagccaa

SEQ ID NO: 523689 - RNA, 13 nt, Homo sapiens
acuuaacacuucu

SEQ ID NO: 523690 - RNA, 13 nt, Homo sapiens
acuuaacuaguua

SEQ ID NO: 523691 - RNA, 18 nt, Homo sapiens
acuuagcgucaagacauu

SEQ ID NO: 523692 - RNA, 23 nt, Homo sapiens
acuucacccgaguuccucugggu

SEQ ID NO: 523693 - RNA, 20 nt, Homo sapiens
acuuccaggggaaccugcca

SEQ ID NO: 523694 - RNA, 19 nt, Homo sapiens
acuuccuuuaggaucucag

SEQ ID NO: 523695 - RNA, 20 nt, Homo sapiens
acuuccuuuaggaucucagg

SEQ ID NO: 523696 - RNA, 15 nt, Homo sapiens
acuucuaaaugcaua

SEQ ID NO: 523697 - RNA, 21 nt, Homo sapiens
acuucuaauuuauauuaucca

SEQ ID NO: 523698 - RNA, 17 nt, Homo sapiens
acuugaagaaggaaaga

SEQ ID NO: 523699 - RNA, 20 nt, Homo sapiens
acuugauagcaaacacuggg

SEQ ID NO: 523700 - RNA, 17 nt, Homo sapiens
acuugcaauaccaaugu

SEQ ID NO: 523701 - RNA, 12 nt, Homo sapiens
acuugccaagaa

SEQ ID NO: 523702 - RNA, 14 nt, Homo sapiens
acuuuaaaaugcca

SEQ ID NO: 523703 - RNA, 17 nt, Homo sapiens
acuuuauuucugaucua

SEQ ID NO: 523704 - RNA, 16 nt, Homo sapiens
acuuucuaugugacau

SEQ ID NO: 523705 - RNA, 17 nt, Homo sapiens
acuuugccacugcugua

SEQ ID NO: 523706 - RNA, 15 nt, Homo sapiens
acuuuguauuuugau

SEQ ID NO: 523707 - RNA, 19 nt, Homo sapiens
acuuuguggcaaucugugg

SEQ ID NO: 523708 - RNA, 21 nt, Homo sapiens
acuuuucggagacagugacug

SEQ ID NO: 523709 - RNA, 18 nt, Homo sapiens
acuuuugaggacgcuggg

SEQ ID NO: 523710 - RNA, 15 nt, Homo sapiens
agaaaaauauuauaa

SEQ ID NO: 523711 - RNA, 21 nt, Homo sapiens
agaaaacacuacagugguuua

SEQ ID NO: 523712 - RNA, 18 nt, Homo sapiens
agaaaaccuguucaggca

SEQ ID NO: 523713 - RNA, 17 nt, Homo sapiens
agaaaauguaguuagcu

SEQ ID NO: 523714 - RNA, 16 nt, Homo sapiens
agaaaauguguccuau

SEQ ID NO: 523715 - RNA, 19 nt, Homo sapiens
agaaacugagaccaaagaa

SEQ ID NO: 523716 - RNA, 13 nt, Homo sapiens
agaaacuucccaa

SEQ ID NO: 523717 - RNA, 13 nt, Homo sapiens
agaaaggcucuau

SEQ ID NO: 523718 - RNA, 20 nt, Homo sapiens
agaacaaaagcgacccauuc

SEQ ID NO: 523719 - RNA, 12 nt, Homo sapiens
agaacacugugc

SEQ ID NO: 523720 - RNA, 12 nt, Homo sapiens
agaacaggguca

SEQ ID NO: 523721 - RNA, 16 nt, Homo sapiens
agaaccacacuugaaa

SEQ ID NO: 523722 - RNA, 14 nt, Homo sapiens
agaaccauuuacuu

SEQ ID NO: 523723 - RNA, 15 nt, Homo sapiens
agaaccauuuacuua

SEQ ID NO: 523724 - RNA, 16 nt, Homo sapiens
agaacgguuuuuggau

SEQ ID NO: 523725 - RNA, 15 nt, Homo sapiens
agaacguggugaccu

SEQ ID NO: 523726 - RNA, 11 nt, Homo sapiens
agaacucugcc

SEQ ID NO: 523727 - RNA, 20 nt, Homo sapiens
agaacuugcaauaccaaugu

SEQ ID NO: 523728 - RNA, 12 nt, Homo sapiens
agaagacauuuu

SEQ ID NO: 523729 - RNA, 14 nt, Homo sapiens
agaagagauuucuc

SEQ ID NO: 523730 - RNA, 14 nt, Homo sapiens
agaagcagaccuca

SEQ ID NO: 523731 - RNA, 18 nt, Homo sapiens
agaagggaauccuccucc

SEQ ID NO: 523732 - RNA, 14 nt, Homo sapiens
agaagggcuaucau

SEQ ID NO: 523733 - RNA, 15 nt, Homo sapiens
agaagugaguggugu

SEQ ID NO: 523734 - RNA, 22 nt, Homo sapiens
agaaguuccuagugauggcuua

SEQ ID NO: 523735 - RNA, 22 nt, Homo sapiens
agaaguucuuguucuucaggag

SEQ ID NO: 523736 - RNA, 18 nt, Homo sapiens
agaauaaggaacaacguu

SEQ ID NO: 523737 - RNA, 20 nt, Homo sapiens
agaaucugugaccucugaca

SEQ ID NO: 523738 - RNA, 21 nt, Homo sapiens
agaaugagaccuggagucaug

SEQ ID NO: 523739 - RNA, 23 nt, Homo sapiens
agaauuauauuagucuguuugca

SEQ ID NO: 523740 - RNA, 16 nt, Homo sapiens
agacaagcugcauuuc

SEQ ID NO: 523741 - RNA, 21 nt, Homo sapiens
agacaaguauggcuccuccau

SEQ ID NO: 523742 - RNA, 19 nt, Homo sapiens
agacaauguuuucuucaac

SEQ ID NO: 523743 - RNA, 18 nt, Homo sapiens
agacacuucccugcauua

SEQ ID NO: 523744 - RNA, 21 nt, Homo sapiens
agacagacuagaaguuccuag

SEQ ID NO: 523745 - RNA, 16 nt, Homo sapiens
agacauacauuucuca

SEQ ID NO: 523746 - RNA, 21 nt, Homo sapiens
agacaucggccuccaugaccu

SEQ ID NO: 523747 - RNA, 14 nt, Homo sapiens
agacaugaaccaag

SEQ ID NO: 523748 - RNA, 13 nt, Homo sapiens
agacauuugcuga

SEQ ID NO: 523749 - RNA, 16 nt, Homo sapiens
agacccugucucaaaa

SEQ ID NO: 523750 - RNA, 13 nt, Homo sapiens
agaccuacccucc

SEQ ID NO: 523751 - RNA, 23 nt, Homo sapiens
agacgaccuuuaccuccugccuu

SEQ ID NO: 523752 - RNA, 16 nt, Homo sapiens
agacuccaucucuucu

SEQ ID NO: 523753 - RNA, 20 nt, Homo sapiens
agacucugccauuaaaacau

SEQ ID NO: 523754 - RNA, 13 nt, Homo sapiens
agacucugucuca

SEQ ID NO: 523755 - RNA, 17 nt, Homo sapiens
agacugacaaccucauc

SEQ ID NO: 523756 - RNA, 19 nt, Homo sapiens
agacugucccugaaaccua

SEQ ID NO: 523757 - RNA, 19 nt, Homo sapiens
agacuguggcuagugacaa

SEQ ID NO: 523758 - RNA, 23 nt, Homo sapiens
agacuuccccucaacaugcugcc

SEQ ID NO: 523759 - RNA, 21 nt, Homo sapiens
agagaagcaucauuuccccaa

SEQ ID NO: 523760 - RNA, 22 nt, Homo sapiens
agagaccugagucugcaugugc

SEQ ID NO: 523761 - RNA, 19 nt, Homo sapiens
agagaucagcgacccugag

SEQ ID NO: 523762 - RNA, 14 nt, Homo sapiens
agagaucuacacau

SEQ ID NO: 523763 - RNA, 20 nt, Homo sapiens
agagccagacucugucucaa

SEQ ID NO: 523764 - RNA, 20 nt, Homo sapiens
agagcuuggacuacacaaua

SEQ ID NO: 523765 - RNA, 14 nt, Homo sapiens
agaggcaggggcuu

SEQ ID NO: 523766 - RNA, 20 nt, Homo sapiens
agaggcgcccuggguggugg

SEQ ID NO: 523767 - RNA, 17 nt, Homo sapiens
agaggcugccccucuca

SEQ ID NO: 523768 - RNA, 23 nt, Homo sapiens
agaggugucacccaaaccggcag

SEQ ID NO: 523769 - RNA, 14 nt, Homo sapiens
agagguugauuaua

SEQ ID NO: 523770 - RNA, 20 nt, Homo sapiens
agaguaaaccuugaagggcu

SEQ ID NO: 523771 - RNA, 22 nt, Homo sapiens
agaguaaaccuugaagggcuuu

SEQ ID NO: 523772 - RNA, 17 nt, Homo sapiens
agaguguagacuguggc

SEQ ID NO: 523773 - RNA, 20 nt, Homo sapiens
agauaaaccaauaaauccac

SEQ ID NO: 523774 - RNA, 22 nt, Homo sapiens
agauaaauauugagcagaucua

SEQ ID NO: 523775 - RNA, 23 nt, Homo sapiens
agauagcaucagaccugcauuga

SEQ ID NO: 523776 - RNA, 23 nt, Homo sapiens
agauaggaaacugaagcauaaag

SEQ ID NO: 523777 - RNA, 21 nt, Homo sapiens
agauauguauucuuuucucag

SEQ ID NO: 523778 - RNA, 17 nt, Homo sapiens
agauauuaauguuaaca

SEQ ID NO: 523779 - RNA, 17 nt, Homo sapiens
agaucagccacaccuuu

SEQ ID NO: 523780 - RNA, 19 nt, Homo sapiens
agaucagcgacccugagga

SEQ ID NO: 523781 - RNA, 17 nt, Homo sapiens
agauccaagaggcccug

SEQ ID NO: 523782 - RNA, 22 nt, Homo sapiens
agauccugcagaaguacuccua

SEQ ID NO: 523783 - RNA, 14 nt, Homo sapiens
agaucucuguagaa

SEQ ID NO: 523784 - RNA, 17 nt, Homo sapiens
agaugggagccuuuacc

SEQ ID NO: 523785 - RNA, 12 nt, Homo sapiens
agaugggugauu

SEQ ID NO: 523786 - RNA, 23 nt, Homo sapiens
agauuagccuguauucucuucag

SEQ ID NO: 523787 - RNA, 22 nt, Homo sapiens
agauucugaccuuaaaugcaac

SEQ ID NO: 523788 - RNA, 14 nt, Homo sapiens
agauugcacuauug

SEQ ID NO: 523789 - RNA, 22 nt, Homo sapiens
agauuuugaaugcuuccugaca

SEQ ID NO: 523790 - RNA, 15 nt, Homo sapiens
agauuuuuuccucug

SEQ ID NO: 523791 - RNA, 12 nt, Homo sapiens
agcaacauuugu

SEQ ID NO: 523792 - RNA, 12 nt, Homo sapiens
agcaacugcugu

SEQ ID NO: 523793 - RNA, 23 nt, Homo sapiens
agcaagacaaauuagccauuuca

SEQ ID NO: 523794 - RNA, 17 nt, Homo sapiens
agcaagacauacuuaau

SEQ ID NO: 523795 - RNA, 18 nt, Homo sapiens
agcaauuaguaagccaug

SEQ ID NO: 523796 - RNA, 17 nt, Homo sapiens
cacuauguauauacaua

SEQ ID NO: 523797 - RNA, 18 nt, Homo sapiens
cacugauggaaaauacca

SEQ ID NO: 523798 - RNA, 22 nt, Homo sapiens
cacugauggaaaauaccagugu

SEQ ID NO: 523799 - RNA, 11 nt, Homo sapiens
cacugcacugu

SEQ ID NO: 523800 - RNA, 18 nt, Homo sapiens
cacugcagacuuguccag

SEQ ID NO: 523801 - RNA, 14 nt, Homo sapiens
cacugcagcagaaa

SEQ ID NO: 523802 - RNA, 18 nt, Homo sapiens
cacugcauuccacaggug

SEQ ID NO: 523803 - RNA, 17 nt, Homo sapiens
cacuguagcagguucua

SEQ ID NO: 523804 - RNA, 17 nt, Homo sapiens
cacuguaugauuuauaa

SEQ ID NO: 523805 - RNA, 17 nt, Homo sapiens
cacuuaguagagugauu

SEQ ID NO: 523806 - RNA, 17 nt, Homo sapiens
cacuuagugaucauuua

SEQ ID NO: 523807 - RNA, 16 nt, Homo sapiens
cacuucuaaaugcaua

SEQ ID NO: 523808 - RNA, 18 nt, Homo sapiens
cacuuuuuaaaaucucaa

SEQ ID NO: 523809 - RNA, 16 nt, Homo sapiens
cagaacuaccaugaga

SEQ ID NO: 523810 - RNA, 23 nt, Homo sapiens
cagaacugaagugugcugugaca

SEQ ID NO: 523811 - RNA, 23 nt, Homo sapiens
cagaacuggaggcaguccaucua

SEQ ID NO: 523812 - RNA, 23 nt, Homo sapiens
cagaagacuucuauggaccacaa

SEQ ID NO: 523813 - RNA, 19 nt, Homo sapiens
cagaagagaaaggacucag

SEQ ID NO: 523814 - RNA, 12 nt, Homo sapiens
cagaagcccuga

SEQ ID NO: 523815 - RNA, 23 nt, Homo sapiens
cagaagccuaggggagucccugu

SEQ ID NO: 523816 - RNA, 14 nt, Homo sapiens
cagaaguacuccua

SEQ ID NO: 523817 - RNA, 16 nt, Homo sapiens
cagaagugguuuccca

SEQ ID NO: 523818 - RNA, 12 nt, Homo sapiens
cagacaaaugga

SEQ ID NO: 523819 - RNA, 18 nt, Homo sapiens
cagacagaagucuccuca

SEQ ID NO: 523820 - RNA, 19 nt, Homo sapiens
cagacagaagucuccucaa

SEQ ID NO: 523821 - RNA, 20 nt, Homo sapiens
cagacaucggccuccaugac

SEQ ID NO: 523822 - RNA, 16 nt, Homo sapiens
cagaccccaugccuua

SEQ ID NO: 523823 - RNA, 15 nt, Homo sapiens
cagacgauuguucuu

SEQ ID NO: 523824 - RNA, 22 nt, Homo sapiens
cagacucuugggccguccccau

SEQ ID NO: 523825 - RNA, 14 nt, Homo sapiens
cagagaccuaugua

SEQ ID NO: 523826 - RNA, 23 nt, Homo sapiens
cagagauaaagcuuaggucaaag

SEQ ID NO: 523827 - RNA, 22 nt, Homo sapiens
cagagaugguguguucugcaau

SEQ ID NO: 523828 - RNA, 24 nt, Homo sapiens
cagagcaagagauaagucuuucau

SEQ ID NO: 523829 - RNA, 20 nt, Homo sapiens
cagaggaggggaaaguccag

SEQ ID NO: 523830 - RNA, 22 nt, Homo sapiens
cagaggcucuaauguacaauaa

SEQ ID NO: 523831 - RNA, 20 nt, Homo sapiens
cagagggauaaaaacaauac

SEQ ID NO: 523832 - RNA, 22 nt, Homo sapiens
cagagggcggggagaaucucag

SEQ ID NO: 523833 - RNA, 17 nt, Homo sapiens
cagaguccuugcaaaau

SEQ ID NO: 523834 - RNA, 16 nt, Homo sapiens
cagagugaccagcaca

SEQ ID NO: 523835 - RNA, 19 nt, Homo sapiens
cagauaaaaugccagucuc

SEQ ID NO: 523836 - RNA, 20 nt, Homo sapiens
cagauagcaucagaccugca

SEQ ID NO: 523837 - RNA, 19 nt, Homo sapiens
cagaucaacagcaaccucu

SEQ ID NO: 523838 - RNA, 15 nt, Homo sapiens
cagauggggcacuga

SEQ ID NO: 523839 - RNA, 19 nt, Homo sapiens
cagauggggcacugaccca

SEQ ID NO: 523840 - RNA, 13 nt, Homo sapiens
cagauucuuucag

SEQ ID NO: 523841 - RNA, 21 nt, Homo sapiens
cagcaauggugucaguaucca

SEQ ID NO: 523842 - RNA, 14 nt, Homo sapiens
cagcacacuggacu

SEQ ID NO: 523843 - RNA, 16 nt, Homo sapiens
cagcacagugccugac

SEQ ID NO: 523844 - RNA, 22 nt, Homo sapiens
cagcacugggaaccuagcuaca

SEQ ID NO: 523845 - RNA, 18 nt, Homo sapiens
cagcaggcauggauccag

SEQ ID NO: 523846 - RNA, 17 nt, Homo sapiens
cagcauauauacuugca

SEQ ID NO: 523847 - RNA, 15 nt, Homo sapiens
cagccagauggcccc

SEQ ID NO: 523848 - RNA, 18 nt, Homo sapiens
cagccagcccauggcccc

SEQ ID NO: 523849 - RNA, 24 nt, Homo sapiens
cagccgggauuuugagaucaucag

SEQ ID NO: 523850 - RNA, 18 nt, Homo sapiens
cagccuagacauccaggu

SEQ ID NO: 523851 - RNA, 17 nt, Homo sapiens
cagccucccuuugauga

SEQ ID NO: 523852 - RNA, 21 nt, Homo sapiens
cagccucgcgggugucacauu

SEQ ID NO: 523853 - RNA, 12 nt, Homo sapiens
cagccugaaccc

SEQ ID NO: 523854 - RNA, 14 nt, Homo sapiens
cagccugcucccua

SEQ ID NO: 523855 - RNA, 23 nt, Homo sapiens
cagccugcucccuagccagaggc

SEQ ID NO: 523856 - RNA, 21 nt, Homo sapiens
cagccuggccaacauggugaa

SEQ ID NO: 523857 - RNA, 18 nt, Homo sapiens
cagcgcagggcuggcacg

SEQ ID NO: 523858 - RNA, 16 nt, Homo sapiens
cagcuccccuucugaa

SEQ ID NO: 523859 - RNA, 16 nt, Homo sapiens
cagcugccucugcucc

SEQ ID NO: 523860 - RNA, 21 nt, Homo sapiens
cagcugcugggucaggccacc

SEQ ID NO: 523861 - RNA, 23 nt, Homo sapiens
cagcugugugggucauaccgugu

SEQ ID NO: 523862 - RNA, 23 nt, Homo sapiens
cagcuguuuggccaaugugcaua

SEQ ID NO: 523863 - RNA, 17 nt, Homo sapiens
cagcuuauaugugacac

SEQ ID NO: 523864 - RNA, 12 nt, Homo sapiens
cagcuuaucucu

SEQ ID NO: 523865 - RNA, 15 nt, Homo sapiens
cagcuuccugaagca

SEQ ID NO: 523866 - RNA, 21 nt, Homo sapiens
cagcuugagcugccucugaga

SEQ ID NO: 523867 - RNA, 18 nt, Homo sapiens
cagcuuuaaaaucuguuc

SEQ ID NO: 523868 - RNA, 23 nt, Homo sapiens
cagcuuuauaacaaauguggcuc

SEQ ID NO: 523869 - RNA, 23 nt, Homo sapiens
caggaaggaaaugacaccaaaua

SEQ ID NO: 523870 - RNA, 15 nt, Homo sapiens
caggaaggaggugca

SEQ ID NO: 523871 - RNA, 16 nt, Homo sapiens
caggaaggggugugcu

SEQ ID NO: 523872 - RNA, 21 nt, Homo sapiens
caggaauaauguuuugggaaa

SEQ ID NO: 523873 - RNA, 17 nt, Homo sapiens
caggagaugauucuguu

SEQ ID NO: 523874 - RNA, 18 nt, Homo sapiens
caggaggaucacuugagc

SEQ ID NO: 523875 - RNA, 21 nt, Homo sapiens
caggaggugugauuccugaag

SEQ ID NO: 523876 - RNA, 16 nt, Homo sapiens
caggcagcgccaagug

SEQ ID NO: 523877 - RNA, 15 nt, Homo sapiens
caggcagggugagcu

SEQ ID NO: 523878 - RNA, 20 nt, Homo sapiens
caggcgcaguggcucaugcc

SEQ ID NO: 523879 - RNA, 17 nt, Homo sapiens
caggcugggccaugucc

SEQ ID NO: 523880 - RNA, 19 nt, Homo sapiens
caggcuucugcaguucuca

SEQ ID NO: 523881 - RNA, 13 nt, Homo sapiens
cagggaggcugug

SEQ ID NO: 523882 - RNA, 18 nt, Homo sapiens
cagggaggcugugcacag

SEQ ID NO: 523883 - RNA, 21 nt, Homo sapiens
cagggcagaugaugcuuugag

SEQ ID NO: 523884 - RNA, 19 nt, Homo sapiens
cagggccauggcucagggu

SEQ ID NO: 523885 - RNA, 20 nt, Homo sapiens
cagggcucauuuuugcacuu

SEQ ID NO: 523886 - RNA, 17 nt, Homo sapiens
caggggcuugcuuugca

SEQ ID NO: 523887 - RNA, 18 nt, Homo sapiens
caggguaacugugcugaa

SEQ ID NO: 523888 - RNA, 18 nt, Homo sapiens
cagggucauguuugcagg

SEQ ID NO: 523889 - RNA, 23 nt, Homo sapiens
caggguggcagaacuugaagggu

SEQ ID NO: 523890 - RNA, 18 nt, Homo sapiens
cagguaacagguguguau

SEQ ID NO: 523891 - RNA, 18 nt, Homo sapiens
caggucaaagauguguuc

SEQ ID NO: 523892 - RNA, 17 nt, Homo sapiens
caggugaaaaggguaca

SEQ ID NO: 523893 - RNA, 11 nt, Homo sapiens
caggugcagag

SEQ ID NO: 523894 - RNA, 15 nt, Homo sapiens
caggugccuguaauc

SEQ ID NO: 523895 - RNA, 22 nt, Homo sapiens
cagguguucuacacucaucuua

SEQ ID NO: 523896 - RNA, 15 nt, Homo sapiens
cagguuaaugcugaa

SEQ ID NO: 523897 - RNA, 19 nt, Homo sapiens
cagguuuguuuucagcacu

SEQ ID NO: 523898 - RNA, 20 nt, Homo sapiens
caguacagcaugugccuuaa

SEQ ID NO: 523899 - RNA, 16 nt, Homo sapiens
caguaccuaaguaaga

SEQ ID NO: 523900 - RNA, 20 nt, Homo sapiens
caguauaccuaucugcugca

SEQ ID NO: 523901 - RNA, 16 nt, Homo sapiens
caguauccacacauaa

SEQ ID NO: 523902 - RNA, 20 nt, Homo sapiens
caguauccaggcuuuguaca

SEQ ID NO: 523903 - RNA, 19 nt, Homo sapiens
caguauuuucuccacuuca

SEQ ID NO: 523904 - RNA, 16 nt, Homo sapiens
cagucacugacaguua

SEQ ID NO: 523905 - RNA, 19 nt, Homo sapiens
cagucacugacaguuaaua

SEQ ID NO: 523906 - RNA, 14 nt, Homo sapiens
cagucccacacugu

SEQ ID NO: 523907 - RNA, 15 nt, Homo sapiens
cagucucauugucac

SEQ ID NO: 523908 - RNA, 16 nt, Homo sapiens
cagucucauugucacc

SEQ ID NO: 523909 - RNA, 16 nt, Homo sapiens
cagugacaaggcccug

SEQ ID NO: 523910 - RNA, 18 nt, Homo sapiens
cagugacuggugccagug

SEQ ID NO: 523911 - RNA, 20 nt, Homo sapiens
cagugagccgagaucaugcc

SEQ ID NO: 523912 - RNA, 22 nt, Homo sapiens
cagugagcugagaucguaccua

SEQ ID NO: 523913 - RNA, 22 nt, Homo sapiens
cagugccuggacaaaugaugcc

SEQ ID NO: 523914 - RNA, 15 nt, Homo sapiens
caguggcucaugccu

SEQ ID NO: 523915 - RNA, 22 nt, Homo sapiens
guuacuauuuucuacaauuaau

SEQ ID NO: 523916 - RNA, 17 nt, Homo sapiens
guuauaucauauguaua

SEQ ID NO: 523917 - RNA, 11 nt, Homo sapiens
guuaucuguga

SEQ ID NO: 523918 - RNA, 23 nt, Homo sapiens
guuauugguguaagguacuuuca

SEQ ID NO: 523919 - RNA, 19 nt, Homo sapiens
guuauuguuguugccaaag

SEQ ID NO: 523920 - RNA, 18 nt, Homo sapiens
guucaaauuuccuuucau

SEQ ID NO: 523921 - RNA, 12 nt, Homo sapiens
guucaagaccag

SEQ ID NO: 523922 - RNA, 15 nt, Homo sapiens
guucacaacagugaa

SEQ ID NO: 523923 - RNA, 13 nt, Homo sapiens
guucagacaagac

SEQ ID NO: 523924 - RNA, 13 nt, Homo sapiens
guucaggguccuu

SEQ ID NO: 523925 - RNA, 19 nt, Homo sapiens
guuccaaugucaaugugaa

SEQ ID NO: 523926 - RNA, 20 nt, Homo sapiens
guucccaagcgucaucugug

SEQ ID NO: 523927 - RNA, 23 nt, Homo sapiens
guucccacaccccaacacuucca

SEQ ID NO: 523928 - RNA, 19 nt, Homo sapiens
guucgauguuagcguuuac

SEQ ID NO: 523929 - RNA, 23 nt, Homo sapiens
guucuaaggauggaaaggugaca

SEQ ID NO: 523930 - RNA, 13 nt, Homo sapiens
guucucaugacuc

SEQ ID NO: 523931 - RNA, 19 nt, Homo sapiens
guucuggggggacccagug

SEQ ID NO: 523932 - RNA, 23 nt, Homo sapiens
guucuggggggacccagugcaga

SEQ ID NO: 523933 - RNA, 22 nt, Homo sapiens
guucuugaaaauaagauuccag

SEQ ID NO: 523934 - RNA, 12 nt, Homo sapiens
guucuuguucuu

SEQ ID NO: 523935 - RNA, 14 nt, Homo sapiens
guucuuuuugccag

SEQ ID NO: 523936 - RNA, 19 nt, Homo sapiens
guugaaaggagaauuugaa

SEQ ID NO: 523937 - RNA, 19 nt, Homo sapiens
guugaaugagcgucagcau

SEQ ID NO: 523938 - RNA, 12 nt, Homo sapiens
guugacuuuccu

SEQ ID NO: 523939 - RNA, 16 nt, Homo sapiens
guugauagacugcuac

SEQ ID NO: 523940 - RNA, 18 nt, Homo sapiens
guugauucaacaaaguau

SEQ ID NO: 523941 - RNA, 21 nt, Homo sapiens
guugccaaagagaaacaaaaa

SEQ ID NO: 523942 - RNA, 16 nt, Homo sapiens
guuggaaaguaacugu

SEQ ID NO: 523943 - RNA, 21 nt, Homo sapiens
guuggucugccuucugcugaa

SEQ ID NO: 523944 - RNA, 23 nt, Homo sapiens
guuguucugcucaauacaucuca

SEQ ID NO: 523945 - RNA, 21 nt, Homo sapiens
guuguuuauauacaguacaca

SEQ ID NO: 523946 - RNA, 13 nt, Homo sapiens
guuuaugaaugac

SEQ ID NO: 523947 - RNA, 14 nt, Homo sapiens
guuuaugagccaga

SEQ ID NO: 523948 - RNA, 21 nt, Homo sapiens
guuuccacugccuccugugac

SEQ ID NO: 523949 - RNA, 13 nt, Homo sapiens
guuuccuggucag

SEQ ID NO: 523950 - RNA, 21 nt, Homo sapiens
guuucuaaaaacacacacaaa

SEQ ID NO: 523951 - RNA, 22 nt, Homo sapiens
guuucuaauaaagaaagcagcu

SEQ ID NO: 523952 - RNA, 21 nt, Homo sapiens
guuuggcuagguaucauucaa

SEQ ID NO: 523953 - RNA, 21 nt, Homo sapiens
guuugguaguuagccaucuaa

SEQ ID NO: 523954 - RNA, 14 nt, Homo sapiens
guuuguccugagau

SEQ ID NO: 523955 - RNA, 15 nt, Homo sapiens
guuuguuuuugcaca

SEQ ID NO: 523956 - RNA, 22 nt, Homo sapiens
guuuuauccuuacaaugugaau

SEQ ID NO: 523957 - RNA, 16 nt, Homo sapiens
guuuuaugcuacugaa

SEQ ID NO: 523958 - RNA, 21 nt, Homo sapiens
guuuucaaauaacgauuuuau

SEQ ID NO: 523959 - RNA, 12 nt, Homo sapiens
guuuugcaacaa

SEQ ID NO: 523960 - RNA, 19 nt, Homo sapiens
guuuuggggacucauuuca

SEQ ID NO: 523961 - RNA, 17 nt, Homo sapiens
uaaaaacucuucagugc

SEQ ID NO: 523962 - RNA, 20 nt, Homo sapiens
uaaaaagcucacugcugauc

SEQ ID NO: 523963 - RNA, 14 nt, Homo sapiens
uaaaagaaaccuuc

SEQ ID NO: 523964 - RNA, 18 nt, Homo sapiens
uaaaagagaagcaucauu

SEQ ID NO: 523965 - RNA, 19 nt, Homo sapiens
uaaaagguagagucuuaca

SEQ ID NO: 523966 - RNA, 22 nt, Homo sapiens
uaaaaguuuuuuauuaugcauu

SEQ ID NO: 523967 - RNA, 23 nt, Homo sapiens
uaaaaguuuuuuauuaugcauua

SEQ ID NO: 523968 - RNA, 17 nt, Homo sapiens
uaaaauacaaacccaug

SEQ ID NO: 523969 - RNA, 16 nt, Homo sapiens
uaaaauugcugugcuu

SEQ ID NO: 523970 - RNA, 19 nt, Homo sapiens
uaaaccuagaguuuuauca

SEQ ID NO: 523971 - RNA, 18 nt, Homo sapiens
uaaacuauuuauaucaca

SEQ ID NO: 523972 - RNA, 20 nt, Homo sapiens
uaaacugagaguaauucauc

SEQ ID NO: 523973 - RNA, 17 nt, Homo sapiens
uaaagaaaaaaauacua

SEQ ID NO: 523974 - RNA, 14 nt, Homo sapiens
uaaagaagcuuuau

SEQ ID NO: 523975 - RNA, 13 nt, Homo sapiens
uaaagaugagaug

SEQ ID NO: 523976 - RNA, 15 nt, Homo sapiens
uaaaggaaaaucaca

SEQ ID NO: 523977 - RNA, 17 nt, Homo sapiens
uaaaggcagcugccucu

SEQ ID NO: 523978 - RNA, 13 nt, Homo sapiens
uaaaggcaucuac

SEQ ID NO: 523979 - RNA, 18 nt, Homo sapiens
uaaagugccuuacagggu

SEQ ID NO: 523980 - RNA, 16 nt, Homo sapiens
uaaaguguucugccag

SEQ ID NO: 523981 - RNA, 21 nt, Homo sapiens
uaaauaaaauucauuucuaca

SEQ ID NO: 523982 - RNA, 16 nt, Homo sapiens
uaaauaccauucacua

SEQ ID NO: 523983 - RNA, 16 nt, Homo sapiens
uaaauagagcaaccua

SEQ ID NO: 523984 - RNA, 18 nt, Homo sapiens
uaaauauuuauguagaug

SEQ ID NO: 523985 - RNA, 17 nt, Homo sapiens
uaaauauuuguccuuaa

SEQ ID NO: 523986 - RNA, 17 nt, Homo sapiens
uaaauauuuuucaucaa

SEQ ID NO: 523987 - RNA, 13 nt, Homo sapiens
uaacauguuauca

SEQ ID NO: 523988 - RNA, 16 nt, Homo sapiens
uaaccuuugcuaugua

SEQ ID NO: 523989 - RNA, 21 nt, Homo sapiens
uaacgcaggagaaucacuuga

SEQ ID NO: 523990 - RNA, 12 nt, Homo sapiens
uaacuacuucca

SEQ ID NO: 523991 - RNA, 18 nt, Homo sapiens
uaacucaccucucaaggu

SEQ ID NO: 523992 - RNA, 14 nt, Homo sapiens
uaacucccagugau

SEQ ID NO: 523993 - RNA, 20 nt, Homo sapiens
uaacuguaugggagcuuaac

SEQ ID NO: 523994 - RNA, 12 nt, Homo sapiens
uaacugugaaca

SEQ ID NO: 523995 - RNA, 12 nt, Homo sapiens
uaacugugcuga

SEQ ID NO: 523996 - RNA, 16 nt, Homo sapiens
uaacugugcugaaugc

SEQ ID NO: 523997 - RNA, 22 nt, Homo sapiens
uaacuuguuugguaguuagcca

SEQ ID NO: 523998 - RNA, 20 nt, Homo sapiens
uaacuuuucaaugacauuuu

SEQ ID NO: 523999 - RNA, 14 nt, Homo sapiens
uaagagacacucca

SEQ ID NO: 524000 - RNA, 15 nt, Homo sapiens
uaagagacacuccaa

SEQ ID NO: 524001 - RNA, 17 nt, Homo sapiens
uaagauuuugcaccugu

SEQ ID NO: 524002 - RNA, 15 nt, Homo sapiens
uaagcaaauguuaaa

SEQ ID NO: 524003 - RNA, 14 nt, Homo sapiens
uaagcaucugccau

SEQ ID NO: 524004 - RNA, 21 nt, Homo sapiens
uaagcaucugccaucugcuuu

SEQ ID NO: 524005 - RNA, 20 nt, Homo sapiens
uaagcccggauagacuuauu

SEQ ID NO: 524006 - RNA, 16 nt, Homo sapiens
uaagcugacucuuugc

SEQ ID NO: 524007 - RNA, 15 nt, Homo sapiens
uaaggaauuaccaag

SEQ ID NO: 524008 - RNA, 13 nt, Homo sapiens
uaaggucacagcu

SEQ ID NO: 524009 - RNA, 14 nt, Homo sapiens
uaagugugccaaau

SEQ ID NO: 524010 - RNA, 18 nt, Homo sapiens
uaaguuuuuaaucuggga

SEQ ID NO: 524011 - RNA, 13 nt, Homo sapiens
uaauaaagcuuua

SEQ ID NO: 524012 - RNA, 14 nt, Homo sapiens
uaauaaagcuuuau

SEQ ID NO: 524013 - RNA, 15 nt, Homo sapiens
uaauaaagcuuuaua

SEQ ID NO: 524014 - RNA, 13 nt, Homo sapiens
uaauaaauacuca

SEQ ID NO: 524015 - RNA, 17 nt, Homo sapiens
uaauaaauacucaguga

SEQ ID NO: 524016 - RNA, 19 nt, Homo sapiens
uaauagucaauuucuacuu

SEQ ID NO: 524017 - RNA, 14 nt, Homo sapiens
uaaucaagccucug

SEQ ID NO: 524018 - RNA, 15 nt, Homo sapiens
uaaucaccucucugu

SEQ ID NO: 524019 - RNA, 17 nt, Homo sapiens
uaaucccuggaugauau

SEQ ID NO: 524020 - RNA, 16 nt, Homo sapiens
uaaucuuugagucuaa

SEQ ID NO: 524021 - RNA, 16 nt, Homo sapiens
uaaugaagaacacugu

SEQ ID NO: 524022 - RNA, 14 nt, Homo sapiens
uaaugaucacauuc

SEQ ID NO: 524023 - RNA, 14 nt, Homo sapiens
uaaugccucugguc

SEQ ID NO: 524024 - RNA, 13 nt, Homo sapiens
uaauggaaaccaa

SEQ ID NO: 524025 - RNA, 19 nt, Homo sapiens
uaauggcagagcagucuaa

SEQ ID NO: 524026 - RNA, 18 nt, Homo sapiens
uaaugguuuuuaacaccu

SEQ ID NO: 524027 - RNA, 16 nt, Homo sapiens
uaauguaaauaaacua

SEQ ID NO: 524028 - RNA, 20 nt, Homo sapiens
uaauguacaauaaagcaaug

SEQ ID NO: 524029 - RNA, 21 nt, Homo sapiens
uaauguacaauaaagcaaugu

SEQ ID NO: 524030 - RNA, 23 nt, Homo sapiens
uaauguacaauaaagcaaugugg

SEQ ID NO: 524031 - RNA, 19 nt, Homo sapiens
uaaugugugguggccucag

SEQ ID NO: 524032 - RNA, 16 nt, Homo sapiens
uaauuuaaaagcacac

SEQ ID NO: 524033 - RNA, 11 nt, Homo sapiens
uacaaacucau

SEQ ID NO: 524034 - RNA, 16 nt, Homo sapiens
uacaacauuaaggaau

SEQ ID NO: 524035 - RNA, 18 nt, Homo sapiens
uacaauaaagcaaugugg

SEQ ID NO: 524036 - RNA, 20 nt, Homo sapiens
uccgcagaauggacuugaua

SEQ ID NO: 524037 - RNA, 20 nt, Homo sapiens
uccguagcucugcugcugau

SEQ ID NO: 524038 - RNA, 22 nt, Homo sapiens
uccguaggccuuaaaucugccu

SEQ ID NO: 524039 - RNA, 19 nt, Homo sapiens
uccuaaggaauuaccaaga

SEQ ID NO: 524040 - RNA, 13 nt, Homo sapiens
uccuacacuugag

SEQ ID NO: 524041 - RNA, 23 nt, Homo sapiens
uccuagaaaguucuguguaaaca

SEQ ID NO: 524042 - RNA, 16 nt, Homo sapiens
uccuagcuacuuggca

SEQ ID NO: 524043 - RNA, 20 nt, Homo sapiens
uccucaauuuuugucucaga

SEQ ID NO: 524044 - RNA, 21 nt, Homo sapiens
uccucacacacccugagguca

SEQ ID NO: 524045 - RNA, 13 nt, Homo sapiens
uccuccaggguga

SEQ ID NO: 524046 - RNA, 19 nt, Homo sapiens
uccucucccauccuugaug

SEQ ID NO: 524047 - RNA, 20 nt, Homo sapiens
uccugacugaaaguaggggg

SEQ ID NO: 524048 - RNA, 18 nt, Homo sapiens
uccugcagauacuuugaa

SEQ ID NO: 524049 - RNA, 21 nt, Homo sapiens
uccugccaacugauuuaaaag

SEQ ID NO: 524050 - RNA, 17 nt, Homo sapiens
uccugccuuucugcaaa

SEQ ID NO: 524051 - RNA, 20 nt, Homo sapiens
uccugcgcauauagacugua

SEQ ID NO: 524052 - RNA, 20 nt, Homo sapiens
uccuggaacagaagacagcu

SEQ ID NO: 524053 - RNA, 14 nt, Homo sapiens
uccugggaacacau

SEQ ID NO: 524054 - RNA, 14 nt, Homo sapiens
uccugggucuacca

SEQ ID NO: 524055 - RNA, 23 nt, Homo sapiens
uccuggugagaaaauauaugccu

SEQ ID NO: 524056 - RNA, 19 nt, Homo sapiens
uccuguacucuggggugcu

SEQ ID NO: 524057 - RNA, 17 nt, Homo sapiens
uccugucuaacugcugu

SEQ ID NO: 524058 - RNA, 11 nt, Homo sapiens
uccugugcaau

SEQ ID NO: 524059 - RNA, 14 nt, Homo sapiens
uccuuaaccuuaac

SEQ ID NO: 524060 - RNA, 14 nt, Homo sapiens
uccuuacaauguga

SEQ ID NO: 524061 - RNA, 14 nt, Homo sapiens
uccuuauuugccuu

SEQ ID NO: 524062 - RNA, 15 nt, Homo sapiens
uccuucucacacaca

SEQ ID NO: 524063 - RNA, 17 nt, Homo sapiens
uccuugacuucuuugag

SEQ ID NO: 524064 - RNA, 23 nt, Homo sapiens
uccuugagaggagaaaugcaaua

SEQ ID NO: 524065 - RNA, 20 nt, Homo sapiens
uccuugcaggugacauuugc

SEQ ID NO: 524066 - RNA, 19 nt, Homo sapiens
uccuugcccccagugccuc

SEQ ID NO: 524067 - RNA, 15 nt, Homo sapiens
uccuuuaggaucuca

SEQ ID NO: 524068 - RNA, 20 nt, Homo sapiens
uccuuugaaaagagaauauu

SEQ ID NO: 524069 - RNA, 20 nt, Homo sapiens
uccuuuuaaaaaccuagguc

SEQ ID NO: 524070 - RNA, 22 nt, Homo sapiens
uccuuuuuuggggaguaccugu

SEQ ID NO: 524071 - RNA, 15 nt, Homo sapiens
ucgauugauaugcuu

SEQ ID NO: 524072 - RNA, 21 nt, Homo sapiens
ucgcaaacguuucuugaacaa

SEQ ID NO: 524073 - RNA, 17 nt, Homo sapiens
ucgccucauuacuguga

SEQ ID NO: 524074 - RNA, 20 nt, Homo sapiens
ucggagacagugacuggugc

SEQ ID NO: 524075 - RNA, 21 nt, Homo sapiens
ucggcuuuuugccaucuguga

SEQ ID NO: 524076 - RNA, 14 nt, Homo sapiens
ucguuaaaaacaga

SEQ ID NO: 524077 - RNA, 18 nt, Homo sapiens
ucuaaaguuuugcaacaa

SEQ ID NO: 524078 - RNA, 23 nt, Homo sapiens
ucuaaaugcauauccugagccau

SEQ ID NO: 524079 - RNA, 12 nt, Homo sapiens
ucuaacugcugu

SEQ ID NO: 524080 - RNA, 18 nt, Homo sapiens
ucuaauccuuuuccuuau

SEQ ID NO: 524081 - RNA, 13 nt, Homo sapiens
ucuaauugcugug

SEQ ID NO: 524082 - RNA, 23 nt, Homo sapiens
ucuacaccaaugaaaacauguac

SEQ ID NO: 524083 - RNA, 19 nt, Homo sapiens
ucuacuaaaaacacaaaaa

SEQ ID NO: 524084 - RNA, 21 nt, Homo sapiens
ucuacugccuugaaaaaugac

SEQ ID NO: 524085 - RNA, 22 nt, Homo sapiens
ucuacuucuggaagucaucuca

SEQ ID NO: 524086 - RNA, 22 nt, Homo sapiens
ucuagagaugguuucuacuggc

SEQ ID NO: 524087 - RNA, 19 nt, Homo sapiens
ucuauacuccuucccuuaa

SEQ ID NO: 524088 - RNA, 14 nt, Homo sapiens
ucuauugacuuuuc

SEQ ID NO: 524089 - RNA, 13 nt, Homo sapiens
ucuauugggauau

SEQ ID NO: 524090 - RNA, 13 nt, Homo sapiens
ucucagcugacca

SEQ ID NO: 524091 - RNA, 21 nt, Homo sapiens
ucucauaccuuccccacaucu

SEQ ID NO: 524092 - RNA, 12 nt, Homo sapiens
ucucaucacuca

SEQ ID NO: 524093 - RNA, 16 nt, Homo sapiens
ucucauugacuuuuau

SEQ ID NO: 524094 - RNA, 16 nt, Homo sapiens
ucuccagccaaccuca

SEQ ID NO: 524095 - RNA, 14 nt, Homo sapiens
ucuccauuaauuaa

SEQ ID NO: 524096 - RNA, 23 nt, Homo sapiens
ucucccaagcugauuuuauucaa

SEQ ID NO: 524097 - RNA, 23 nt, Homo sapiens
ucuccccuccugcacacagggca

SEQ ID NO: 524098 - RNA, 12 nt, Homo sapiens
ucuccugagcua

SEQ ID NO: 524099 - RNA, 12 nt, Homo sapiens
ucuccugcugau

SEQ ID NO: 524100 - RNA, 13 nt, Homo sapiens
ucuccugcugauu

SEQ ID NO: 524101 - RNA, 13 nt, Homo sapiens
ucuccuuuuccua

SEQ ID NO: 524102 - RNA, 19 nt, Homo sapiens
ucucgccucauuacuguga

SEQ ID NO: 524103 - RNA, 12 nt, Homo sapiens
ucucuaccccaa

SEQ ID NO: 524104 - RNA, 23 nt, Homo sapiens
ucucuccgucuguuuuugcaacu

SEQ ID NO: 524105 - RNA, 14 nt, Homo sapiens
ucucuccucucuga

SEQ ID NO: 524106 - RNA, 14 nt, Homo sapiens
ucucucucuugccu

SEQ ID NO: 524107 - RNA, 15 nt, Homo sapiens
ucucucucuugccug

SEQ ID NO: 524108 - RNA, 19 nt, Homo sapiens
ucucugucccuugcuguau

SEQ ID NO: 524109 - RNA, 19 nt, Homo sapiens
ucucugugcccuccagcaa

SEQ ID NO: 524110 - RNA, 23 nt, Homo sapiens
ucugcaauaugaauucaagaaag

SEQ ID NO: 524111 - RNA, 16 nt, Homo sapiens
ucugcacuauguuucc

SEQ ID NO: 524112 - RNA, 16 nt, Homo sapiens
ucugcagcauugaagu

SEQ ID NO: 524113 - RNA, 13 nt, Homo sapiens
ucugcaguucuca

SEQ ID NO: 524114 - RNA, 22 nt, Homo sapiens
ucugcauggaacagcauuaccc

SEQ ID NO: 524115 - RNA, 11 nt, Homo sapiens
ucugcauuuac

SEQ ID NO: 524116 - RNA, 16 nt, Homo sapiens
ucugccacccaguccu

SEQ ID NO: 524117 - RNA, 18 nt, Homo sapiens
ucugccauuaaaacauua

SEQ ID NO: 524118 - RNA, 13 nt, Homo sapiens
ucugcccaggugu

SEQ ID NO: 524119 - RNA, 19 nt, Homo sapiens
ucugccuucugcugaaaga

SEQ ID NO: 524120 - RNA, 13 nt, Homo sapiens
ucugcucccucug

SEQ ID NO: 524121 - RNA, 14 nt, Homo sapiens
ucuggaagucaucu

SEQ ID NO: 524122 - RNA, 18 nt, Homo sapiens
ucuggagaaccucaucca

SEQ ID NO: 524123 - RNA, 18 nt, Homo sapiens
ucuggagcuggcacugug

SEQ ID NO: 524124 - RNA, 12 nt, Homo sapiens
ucuggcaaaaag

SEQ ID NO: 524125 - RNA, 12 nt, Homo sapiens
ucugggccagug

SEQ ID NO: 524126 - RNA, 17 nt, Homo sapiens
ucugggcucaagcuuuc

SEQ ID NO: 524127 - RNA, 18 nt, Homo sapiens
ucugggcugccaugugaa

SEQ ID NO: 524128 - RNA, 17 nt, Homo sapiens
ucuggggagcucaggaa

SEQ ID NO: 524129 - RNA, 22 nt, Homo sapiens
ucuggggggacccagugcagaa

SEQ ID NO: 524130 - RNA, 13 nt, Homo sapiens
ucugguguugacu

SEQ ID NO: 524131 - RNA, 16 nt, Homo sapiens
ucuguugaucucagua

SEQ ID NO: 524132 - RNA, 16 nt, Homo sapiens
ucuguuuggaucuaua

SEQ ID NO: 524133 - RNA, 19 nt, Homo sapiens
ucuuaaauauuuaguugau

SEQ ID NO: 524134 - RNA, 19 nt, Homo sapiens
ucuuaaauguuuauacugu

SEQ ID NO: 524135 - RNA, 14 nt, Homo sapiens
ucuuacaugcauuu

SEQ ID NO: 524136 - RNA, 14 nt, Homo sapiens
ucuuagugugccaa

SEQ ID NO: 524137 - RNA, 18 nt, Homo sapiens
ucuuauuugaaggccagc

SEQ ID NO: 524138 - RNA, 18 nt, Homo sapiens
ucuucaacgccaucucca

SEQ ID NO: 524139 - RNA, 14 nt, Homo sapiens
ucuucccaguauua

SEQ ID NO: 524140 - RNA, 16 nt, Homo sapiens
ucuuccugcacccaca

SEQ ID NO: 524141 - RNA, 14 nt, Homo sapiens
ucuucuacuuuaag

SEQ ID NO: 524142 - RNA, 15 nt, Homo sapiens
ucuugaauguggucu

SEQ ID NO: 524143 - RNA, 21 nt, Homo sapiens
ucuugacuguuaguuguccac

SEQ ID NO: 524144 - RNA, 19 nt, Homo sapiens
ucuugguucgauaccugga

SEQ ID NO: 524145 - RNA, 14 nt, Homo sapiens
ucuuguggugcauu

SEQ ID NO: 524146 - RNA, 20 nt, Homo sapiens
ucuuuaaaggcaucuacaca

SEQ ID NO: 524147 - RNA, 23 nt, Homo sapiens
ucuuuccaaaaggaacucuagaa

SEQ ID NO: 524148 - RNA, 15 nt, Homo sapiens
ucuuuccaggcuucc

SEQ ID NO: 524149 - RNA, 15 nt, Homo sapiens
ucuuucucugaggac

SEQ ID NO: 524150 - RNA, 17 nt, Homo sapiens
ucuuugaaaacagauga

SEQ ID NO: 524151 - RNA, 16 nt, Homo sapiens
ucuuuuaaaaucauga

SEQ ID NO: 524152 - RNA, 19 nt, Homo sapiens
ugaaaaauaucugguuaua

SEQ ID NO: 524153 - RNA, 15 nt, Homo sapiens
ugaaaaaucauccaa

SEQ ID NO: 524154 - RNA, 19 nt, Homo sapiens
ugaaaacauguacuacagc

SEQ ID NO: 524155 - RNA, 14 nt, Homo sapiens
ugaaaauauagcua

SEQ ID NO: 524156 - RNA, 23 nt, Homo sapiens
uuauaggccugucccuugccucu

SEQ ID NO: 524157 - RNA, 23 nt, Homo sapiens
uuauagggaugaguccccuguga

SEQ ID NO: 524158 - RNA, 16 nt, Homo sapiens
uuauauacaguacaca

SEQ ID NO: 524159 - RNA, 13 nt, Homo sapiens
uuaucccucucuu

SEQ ID NO: 524160 - RNA, 13 nt, Homo sapiens
uuauuaaagaaau

SEQ ID NO: 524161 - RNA, 15 nt, Homo sapiens
uuauuauauugucga

SEQ ID NO: 524162 - RNA, 20 nt, Homo sapiens
uuauucuccagaauaauucu

SEQ ID NO: 524163 - RNA, 20 nt, Homo sapiens
uuauuucugaucuauacaaa

SEQ ID NO: 524164 - RNA, 17 nt, Homo sapiens
uuauuugcacacugcac

SEQ ID NO: 524165 - RNA, 20 nt, Homo sapiens
uuauuugcacacugcacugu

SEQ ID NO: 524166 - RNA, 21 nt, Homo sapiens
uuauuugcuaaucaaagccag

SEQ ID NO: 524167 - RNA, 22 nt, Homo sapiens
uuauuuguguuuaaaugcugcu

SEQ ID NO: 524168 - RNA, 14 nt, Homo sapiens
uuauuuuugucaaa

SEQ ID NO: 524169 - RNA, 16 nt, Homo sapiens
uucaagaaaaucuuug

SEQ ID NO: 524170 - RNA, 12 nt, Homo sapiens
uucaaguuuaca

SEQ ID NO: 524171 - RNA, 19 nt, Homo sapiens
uucaauaaaucuuucaaaa

SEQ ID NO: 524172 - RNA, 20 nt, Homo sapiens
uucacuaaugaucacauucu

SEQ ID NO: 524173 - RNA, 15 nt, Homo sapiens
uucacucuccagggu

SEQ ID NO: 524174 - RNA, 22 nt, Homo sapiens
uucagauccuuuuauucuccag

SEQ ID NO: 524175 - RNA, 22 nt, Homo sapiens
uucagcagagaagguaaggugu

SEQ ID NO: 524176 - RNA, 19 nt, Homo sapiens
uucagcaggcuagacagaa

SEQ ID NO: 524177 - RNA, 17 nt, Homo sapiens
uucaggaauacuuggac

SEQ ID NO: 524178 - RNA, 15 nt, Homo sapiens
uucagucauaaagag

SEQ ID NO: 524179 - RNA, 14 nt, Homo sapiens
uucagucugaucca

SEQ ID NO: 524180 - RNA, 12 nt, Homo sapiens
uucaucaggggc

SEQ ID NO: 524181 - RNA, 15 nt, Homo sapiens
uucauccuagucuag

SEQ ID NO: 524182 - RNA, 17 nt, Homo sapiens
uucauguguggaaaugg

SEQ ID NO: 524183 - RNA, 19 nt, Homo sapiens
uuccaacacuccauuauuc

SEQ ID NO: 524184 - RNA, 19 nt, Homo sapiens
uuccaaugcuucuguugau

SEQ ID NO: 524185 - RNA, 16 nt, Homo sapiens
uuccauaagaagucgu

SEQ ID NO: 524186 - RNA, 22 nt, Homo sapiens
uuccaucacaagaaagucauua

SEQ ID NO: 524187 - RNA, 13 nt, Homo sapiens
uuccaugugccuu

SEQ ID NO: 524188 - RNA, 20 nt, Homo sapiens
uuccccuuagaaacacugca

SEQ ID NO: 524189 - RNA, 18 nt, Homo sapiens
uucccuaggaaacucaca

SEQ ID NO: 524190 - RNA, 23 nt, Homo sapiens
uuccgcaguguggccaggcugcc

SEQ ID NO: 524191 - RNA, 17 nt, Homo sapiens
uuccuuaccauaccacu

SEQ ID NO: 524192 - RNA, 12 nt, Homo sapiens
uuccuucaaugu

SEQ ID NO: 524193 - RNA, 18 nt, Homo sapiens
uuccuucaaugugcauaa

SEQ ID NO: 524194 - RNA, 19 nt, Homo sapiens
uuccuugacuucuuugaga

SEQ ID NO: 524195 - RNA, 19 nt, Homo sapiens
uucgagaccagccugacca

SEQ ID NO: 524196 - RNA, 20 nt, Homo sapiens
uucuaauuuauauuauccau

SEQ ID NO: 524197 - RNA, 13 nt, Homo sapiens
uucuacagauauu

SEQ ID NO: 524198 - RNA, 23 nt, Homo sapiens
uucuacugccuugaaaaaugaca

SEQ ID NO: 524199 - RNA, 14 nt, Homo sapiens
uucuagugccucug

SEQ ID NO: 524200 - RNA, 14 nt, Homo sapiens
uucuauugggauau

SEQ ID NO: 524201 - RNA, 18 nt, Homo sapiens
uucuauugggauauccuu

SEQ ID NO: 524202 - RNA, 15 nt, Homo sapiens
uucucaacuguccca

SEQ ID NO: 524203 - RNA, 19 nt, Homo sapiens
uucucaucuuuuuacuaaa

SEQ ID NO: 524204 - RNA, 15 nt, Homo sapiens
uucucaugacuccua

SEQ ID NO: 524205 - RNA, 21 nt, Homo sapiens
uucucuagaagcuccagugau

SEQ ID NO: 524206 - RNA, 19 nt, Homo sapiens
uucucugccgcuaccuccc

SEQ ID NO: 524207 - RNA, 19 nt, Homo sapiens
uucugagguccuuaugucc

SEQ ID NO: 524208 - RNA, 17 nt, Homo sapiens
uucugaugaaucucaaa

SEQ ID NO: 524209 - RNA, 23 nt, Homo sapiens
uucuggggacagacaaggugccu

SEQ ID NO: 524210 - RNA, 23 nt, Homo sapiens
uucuguccugagaagcauguaau

SEQ ID NO: 524211 - RNA, 21 nt, Homo sapiens
uucuguuuauaaugaagaaca

SEQ ID NO: 524212 - RNA, 14 nt, Homo sapiens
uucuuacaugcauu

SEQ ID NO: 524213 - RNA, 13 nt, Homo sapiens
uucuuagaccucc

SEQ ID NO: 524214 - RNA, 12 nt, Homo sapiens
uucuucugcaac

SEQ ID NO: 524215 - RNA, 16 nt, Homo sapiens
uucuucuguccugaga

SEQ ID NO: 524216 - RNA, 20 nt, Homo sapiens
uucuugcuuucaauuacaaa

SEQ ID NO: 524217 - RNA, 15 nt, Homo sapiens
uucuuuaaaggcauc

SEQ ID NO: 524218 - RNA, 16 nt, Homo sapiens
uucuuuccuuguucag

SEQ ID NO: 524219 - RNA, 12 nt, Homo sapiens
uucuuucugucu

SEQ ID NO: 524220 - RNA, 20 nt, Homo sapiens
uucuuugacaccacaccauc

SEQ ID NO: 524221 - RNA, 16 nt, Homo sapiens
uucuuugcugcaguca

SEQ ID NO: 524222 - RNA, 20 nt, Homo sapiens
uucuuugcugcagucaucua

SEQ ID NO: 524223 - RNA, 13 nt, Homo sapiens
uucuuugugccuu

SEQ ID NO: 524224 - RNA, 20 nt, Homo sapiens
uucuuuuuccacaaggaaua

SEQ ID NO: 524225 - RNA, 14 nt, Homo sapiens
uugaaaaaggugau

SEQ ID NO: 524226 - RNA, 20 nt, Homo sapiens
uugaaauauaguaaacacuu

SEQ ID NO: 524227 - RNA, 15 nt, Homo sapiens
uugaaccugugcaau

SEQ ID NO: 524228 - RNA, 20 nt, Homo sapiens
uugaaggcuuaauugacuga

SEQ ID NO: 524229 - RNA, 15 nt, Homo sapiens
uugaagucuuuaaua

SEQ ID NO: 524230 - RNA, 22 nt, Homo sapiens
uugaccacgucaucgggccaga

SEQ ID NO: 524231 - RNA, 20 nt, Homo sapiens
uugacugaaauuacuuuaac

SEQ ID NO: 524232 - RNA, 19 nt, Homo sapiens
uugacuuuuauaaagcaug

SEQ ID NO: 524233 - RNA, 20 nt, Homo sapiens
uugaggcaaauuaacuguau

SEQ ID NO: 524234 - RNA, 19 nt, Homo sapiens
uugauugucagcuacuaau

SEQ ID NO: 524235 - RNA, 20 nt, Homo sapiens
uugcaacaauaaaguacuuu

SEQ ID NO: 524236 - RNA, 16 nt, Homo sapiens
uugcaaucuucuacuu

SEQ ID NO: 524237 - RNA, 21 nt, Homo sapiens
uugcaccaggcacugcugcac

SEQ ID NO: 524238 - RNA, 16 nt, Homo sapiens
uugcauauaguuaaac

SEQ ID NO: 524239 - RNA, 12 nt, Homo sapiens
uugcaugcaugc

SEQ ID NO: 524240 - RNA, 10 nt, Homo sapiens
uugcauuugg

SEQ ID NO: 524241 - RNA, 16 nt, Homo sapiens
uugccaaaaacaaaaa

SEQ ID NO: 524242 - RNA, 22 nt, Homo sapiens
uugccuaaaauauauuccugag

SEQ ID NO: 524243 - RNA, 14 nt, Homo sapiens
uugccuccaggugc

SEQ ID NO: 524244 - RNA, 19 nt, Homo sapiens
uugccugcagggccauggc

SEQ ID NO: 524245 - RNA, 15 nt, Homo sapiens
uugcuguugugugau

SEQ ID NO: 524246 - RNA, 17 nt, Homo sapiens
uugcuuaaaauugugag

SEQ ID NO: 524247 - RNA, 16 nt, Homo sapiens
uugcuugagcaggauu

SEQ ID NO: 524248 - RNA, 15 nt, Homo sapiens
uuggaacugcaauga

SEQ ID NO: 524249 - RNA, 20 nt, Homo sapiens
uuggaagugaaaacuuugua

SEQ ID NO: 524250 - RNA, 15 nt, Homo sapiens
uuggaaucaaaagag

SEQ ID NO: 524251 - RNA, 19 nt, Homo sapiens
uuggauggccuccauccag

SEQ ID NO: 524252 - RNA, 11 nt, Homo sapiens
uuggcacugug

SEQ ID NO: 524253 - RNA, 16 nt, Homo sapiens
uuggcacuguggagcu

SEQ ID NO: 524254 - RNA, 17 nt, Homo sapiens
uugggaaagcucuuguc

SEQ ID NO: 524255 - RNA, 15 nt, Homo sapiens
uuguaauaauaaaga

SEQ ID NO: 524256 - RNA, 20 nt, Homo sapiens
uuguauaggggcaacuguau

SEQ ID NO: 524257 - RNA, 15 nt, Homo sapiens
uugucaccucuguga

SEQ ID NO: 524258 - RNA, 19 nt, Homo sapiens
uugucacuuuuuaugcuau

SEQ ID NO: 524259 - RNA, 16 nt, Homo sapiens
uugucgguuaccucug

SEQ ID NO: 524260 - RNA, 15 nt, Homo sapiens
uugugaccacaggcu

SEQ ID NO: 524261 - RNA, 19 nt, Homo sapiens
uugugguagugaugguugu

SEQ ID NO: 524262 - RNA, 22 nt, Homo sapiens
uuguguaucuguuuacauccag

SEQ ID NO: 524263 - RNA, 14 nt, Homo sapiens
uuguucuucaggag

SEQ ID NO: 524264 - RNA, 17 nt, Homo sapiens
uuguuugccaggacaug

SEQ ID NO: 524265 - RNA, 12 nt, Homo sapiens
uuguuugcuuac

SEQ ID NO: 524266 - RNA, 22 nt, Homo sapiens
uuguuuucagcacugauggaaa

SEQ ID NO: 524267 - RNA, 13 nt, Homo sapiens
uuuaaaaacacaa

SEQ ID NO: 524268 - RNA, 20 nt, Homo sapiens
uuuaaacuaucuugugugau

SEQ ID NO: 524269 - RNA, 11 nt, Homo sapiens
uuuaaccuuaa

SEQ ID NO: 524270 - RNA, 14 nt, Homo sapiens
uuuaacguuuucau

SEQ ID NO: 524271 - RNA, 21 nt, Homo sapiens
uuuaagcaaguuaaguguccu

SEQ ID NO: 524272 - RNA, 14 nt, Homo sapiens
uuuaaucucuaaca

SEQ ID NO: 524273 - RNA, 17 nt, Homo sapiens
uuuaauuuuaaugcugu

SEQ ID NO: 524274 - RNA, 17 nt, Homo sapiens
uuuaccuuauguuuaau

SEQ ID NO: 524275 - RNA, 15 nt, Homo sapiens
uuuauacaguugaaa

SEQ ID NO: 524276 - RNA, 15 nt, Homo sapiens
cacugugccccacaa

SEQ ID NO: 524277 - RNA, 16 nt, Homo sapiens
cacugugucauucugu

SEQ ID NO: 524278 - RNA, 21 nt, Homo sapiens
cacuuaaagccuuuuccugaa

SEQ ID NO: 524279 - RNA, 15 nt, Homo sapiens
cacuuagugaucauu

SEQ ID NO: 524280 - RNA, 18 nt, Homo sapiens
cacuucauauagcauuga

SEQ ID NO: 524281 - RNA, 15 nt, Homo sapiens
cacuuccagcauuua

SEQ ID NO: 524282 - RNA, 18 nt, Homo sapiens
cacuucuaaaugcauauc

SEQ ID NO: 524283 - RNA, 13 nt, Homo sapiens
cacuucugauguc

SEQ ID NO: 524284 - RNA, 18 nt, Homo sapiens
cagaaacaugucuugacu

SEQ ID NO: 524285 - RNA, 22 nt, Homo sapiens
cagaaacaugucuugacuguua

SEQ ID NO: 524286 - RNA, 15 nt, Homo sapiens
cagaacaacacuucc

SEQ ID NO: 524287 - RNA, 16 nt, Homo sapiens
cagaacuugaaggguu

SEQ ID NO: 524288 - RNA, 17 nt, Homo sapiens
cagaacuuuaguauuaa

SEQ ID NO: 524289 - RNA, 19 nt, Homo sapiens
cagaagaccccugacucau

SEQ ID NO: 524290 - RNA, 19 nt, Homo sapiens
cagaagcagcagaccuccu

SEQ ID NO: 524291 - RNA, 16 nt, Homo sapiens
cagaauguuacugacu

SEQ ID NO: 524292 - RNA, 12 nt, Homo sapiens
cagacagagauu

SEQ ID NO: 524293 - RNA, 20 nt, Homo sapiens
cagacauacauuucucauac

SEQ ID NO: 524294 - RNA, 15 nt, Homo sapiens
cagacccagucccac

SEQ ID NO: 524295 - RNA, 16 nt, Homo sapiens
cagacgauuguucuua

SEQ ID NO: 524296 - RNA, 21 nt, Homo sapiens
cagacuagaaguuccuaguga

SEQ ID NO: 524297 - RNA, 13 nt, Homo sapiens
cagacucugucuc

SEQ ID NO: 524298 - RNA, 19 nt, Homo sapiens
cagacugacccccaucuga

SEQ ID NO: 524299 - RNA, 15 nt, Homo sapiens
cagacugcugcuaga

SEQ ID NO: 524300 - RNA, 20 nt, Homo sapiens
cagagaagguaaggugugaa

SEQ ID NO: 524301 - RNA, 16 nt, Homo sapiens
cagagacugucccuga

SEQ ID NO: 524302 - RNA, 20 nt, Homo sapiens
cagagaucucuguagaagga

SEQ ID NO: 524303 - RNA, 16 nt, Homo sapiens
cagagcaaaugagcuc

SEQ ID NO: 524304 - RNA, 21 nt, Homo sapiens
cagaggcagcucgugugccug

SEQ ID NO: 524305 - RNA, 14 nt, Homo sapiens
cagaggcucuaaug

SEQ ID NO: 524306 - RNA, 20 nt, Homo sapiens
cagaggcucuaauguacaau

SEQ ID NO: 524307 - RNA, 16 nt, Homo sapiens
cagaguucugugacac

SEQ ID NO: 524308 - RNA, 16 nt, Homo sapiens
cagaguugaaguuuac

SEQ ID NO: 524309 - RNA, 15 nt, Homo sapiens
cagaguuuccaaaac

SEQ ID NO: 524310 - RNA, 18 nt, Homo sapiens
cagaucaccugaggucag

SEQ ID NO: 524311 - RNA, 11 nt, Homo sapiens
cagauccugca

SEQ ID NO: 524312 - RNA, 19 nt, Homo sapiens
cagauccuuuuauucucca

SEQ ID NO: 524313 - RNA, 21 nt, Homo sapiens
cagauccuuuuauucuccaga

SEQ ID NO: 524314 - RNA, 12 nt, Homo sapiens
cagaugcaauug

SEQ ID NO: 524315 - RNA, 17 nt, Homo sapiens
cagauggaaaaacugag

SEQ ID NO: 524316 - RNA, 19 nt, Homo sapiens
cagauggaaaaacugaggc

SEQ ID NO: 524317 - RNA, 14 nt, Homo sapiens
cagaugggaucaca

SEQ ID NO: 524318 - RNA, 17 nt, Homo sapiens
cagaugggaucacagua

SEQ ID NO: 524319 - RNA, 20 nt, Homo sapiens
cagauuaguucuuuuugcca

SEQ ID NO: 524320 - RNA, 19 nt, Homo sapiens
cagauuuuuuccucugcau

SEQ ID NO: 524321 - RNA, 12 nt, Homo sapiens
cagcaagcuuug

SEQ ID NO: 524322 - RNA, 20 nt, Homo sapiens
cagcaauucuccugccucag

SEQ ID NO: 524323 - RNA, 11 nt, Homo sapiens
cagcacaagcu

SEQ ID NO: 524324 - RNA, 13 nt, Homo sapiens
cagcacaagcuca

SEQ ID NO: 524325 - RNA, 13 nt, Homo sapiens
cagcacacuggac

SEQ ID NO: 524326 - RNA, 19 nt, Homo sapiens
cagcaguccacaaagcauu

SEQ ID NO: 524327 - RNA, 17 nt, Homo sapiens
cagcagucuaguucuuu

SEQ ID NO: 524328 - RNA, 21 nt, Homo sapiens
cagccaaccucauugcagcua

SEQ ID NO: 524329 - RNA, 18 nt, Homo sapiens
cagccacuccccggcaug

SEQ ID NO: 524330 - RNA, 15 nt, Homo sapiens
cagcccacccugcug

SEQ ID NO: 524331 - RNA, 19 nt, Homo sapiens
cagcccccuaaaagcacuc

SEQ ID NO: 524332 - RNA, 19 nt, Homo sapiens
cagccucccuaguagcugg

SEQ ID NO: 524333 - RNA, 15 nt, Homo sapiens
cagcgcuucuaugca

SEQ ID NO: 524334 - RNA, 12 nt, Homo sapiens
cagcuacucaga

SEQ ID NO: 524335 - RNA, 19 nt, Homo sapiens
cagcuccccuucugaauca

SEQ ID NO: 524336 - RNA, 14 nt, Homo sapiens
cagcucuccaauac

SEQ ID NO: 524337 - RNA, 21 nt, Homo sapiens
cagcugcucccuggcauucaa

SEQ ID NO: 524338 - RNA, 22 nt, Homo sapiens
caggaagacuuugugacuguca

SEQ ID NO: 524339 - RNA, 13 nt, Homo sapiens
caggacggggcac

SEQ ID NO: 524340 - RNA, 14 nt, Homo sapiens
caggaggaagugag

SEQ ID NO: 524341 - RNA, 15 nt, Homo sapiens
caggaggaucacuug

SEQ ID NO: 524342 - RNA, 15 nt, Homo sapiens
caggaggaucacuuu

SEQ ID NO: 524343 - RNA, 20 nt, Homo sapiens
caggaggugugaaugcacgu

SEQ ID NO: 524344 - RNA, 17 nt, Homo sapiens
caggauaucacauugga

SEQ ID NO: 524345 - RNA, 21 nt, Homo sapiens
caggcagagaacagaacugga

SEQ ID NO: 524346 - RNA, 21 nt, Homo sapiens
caggccgcauccugaacugcu

SEQ ID NO: 524347 - RNA, 16 nt, Homo sapiens
caggccucugugggcc

SEQ ID NO: 524348 - RNA, 17 nt, Homo sapiens
caggcgcaguggcucau

SEQ ID NO: 524349 - RNA, 13 nt, Homo sapiens
caggcgugaucca

SEQ ID NO: 524350 - RNA, 21 nt, Homo sapiens
caggcgugauggcaggugccu

SEQ ID NO: 524351 - RNA, 22 nt, Homo sapiens
caggcucucugguguucagggu

SEQ ID NO: 524352 - RNA, 18 nt, Homo sapiens
caggcugggccaugucca

SEQ ID NO: 524353 - RNA, 13 nt, Homo sapiens
caggcuggucuca

SEQ ID NO: 524354 - RNA, 13 nt, Homo sapiens
cagggaaaacugc

SEQ ID NO: 524355 - RNA, 16 nt, Homo sapiens
cagggcaacuguagaa

SEQ ID NO: 524356 - RNA, 18 nt, Homo sapiens
cagggccuggggccugag

SEQ ID NO: 524357 - RNA, 17 nt, Homo sapiens
cagggucugugugaaug

SEQ ID NO: 524358 - RNA, 17 nt, Homo sapiens
cagguaagucugguuuu

SEQ ID NO: 524359 - RNA, 14 nt, Homo sapiens
caggucaccaagca

SEQ ID NO: 524360 - RNA, 16 nt, Homo sapiens
cagguuaaugcugaaa

SEQ ID NO: 524361 - RNA, 17 nt, Homo sapiens
caguaaauagugucaua

SEQ ID NO: 524362 - RNA, 17 nt, Homo sapiens
caguaaucuuuauacug

SEQ ID NO: 524363 - RNA, 21 nt, Homo sapiens
caguauaccuaucugcugcac

SEQ ID NO: 524364 - RNA, 17 nt, Homo sapiens
caguauucuugcacuga

SEQ ID NO: 524365 - RNA, 17 nt, Homo sapiens
cagucaccuaugugguc

SEQ ID NO: 524366 - RNA, 15 nt, Homo sapiens
cagucagcauucuua

SEQ ID NO: 524367 - RNA, 14 nt, Homo sapiens
cagucaucuacuuu

SEQ ID NO: 524368 - RNA, 16 nt, Homo sapiens
cagucccacacugugc

SEQ ID NO: 524369 - RNA, 19 nt, Homo sapiens
cagucccacacuguggcca

SEQ ID NO: 524370 - RNA, 20 nt, Homo sapiens
cagucugauccauccaucuc

SEQ ID NO: 524371 - RNA, 19 nt, Homo sapiens
cagucuucccagcaauuau

SEQ ID NO: 524372 - RNA, 17 nt, Homo sapiens
cagugacaaggcccuga

SEQ ID NO: 524373 - RNA, 19 nt, Homo sapiens
cagugcaaauuguaucuua

SEQ ID NO: 524374 - RNA, 19 nt, Homo sapiens
cagugccuuaaacucuguu

SEQ ID NO: 524375 - RNA, 15 nt, Homo sapiens
cagugcuaaagccug

SEQ ID NO: 524376 - RNA, 22 nt, Homo sapiens
cagugcuaaagccuguggguuu

SEQ ID NO: 524377 - RNA, 12 nt, Homo sapiens
cagugcugccag

SEQ ID NO: 524378 - RNA, 19 nt, Homo sapiens
cagugcugccaguuuccca

SEQ ID NO: 524379 - RNA, 14 nt, Homo sapiens
caguggagacaucu

SEQ ID NO: 524380 - RNA, 22 nt, Homo sapiens
caguggaugccacagcccagcu

SEQ ID NO: 524381 - RNA, 23 nt, Homo sapiens
cagugggaaauaugccacugacc

SEQ ID NO: 524382 - RNA, 16 nt, Homo sapiens
caguggugugaucucg

SEQ ID NO: 524383 - RNA, 13 nt, Homo sapiens
caguguuuggaca

SEQ ID NO: 524384 - RNA, 15 nt, Homo sapiens
caguuagacuagucc

SEQ ID NO: 524385 - RNA, 18 nt, Homo sapiens
caguuagagacucuguca

SEQ ID NO: 524386 - RNA, 19 nt, Homo sapiens
caguuugauaccugcacug

SEQ ID NO: 524387 - RNA, 13 nt, Homo sapiens
cauaaagcauuuu

SEQ ID NO: 524388 - RNA, 13 nt, Homo sapiens
cauaauaauagca

SEQ ID NO: 524389 - RNA, 22 nt, Homo sapiens
cauaauagucaauuucuacuuc

SEQ ID NO: 524390 - RNA, 17 nt, Homo sapiens
cauacaugucacauuua

SEQ ID NO: 524391 - RNA, 20 nt, Homo sapiens
cauaccaaguugauacuuga

SEQ ID NO: 524392 - RNA, 13 nt, Homo sapiens
cauaccuccuucc

SEQ ID NO: 524393 - RNA, 13 nt, Homo sapiens
cauauaaacucau

SEQ ID NO: 524394 - RNA, 19 nt, Homo sapiens
cauauaggugauguuugcu

SEQ ID NO: 524395 - RNA, 18 nt, Homo sapiens
cauauauacuugcaagau

SEQ ID NO: 524396 - RNA, 19 nt, Homo sapiens
cauauauauauauaacaua

SEQ ID NO: 524397 - RNA, 19 nt, Homo sapiens
cauauauuuuuaccaucug

SEQ ID NO: 524398 - RNA, 21 nt, Homo sapiens
aaaacgcgucugccugggccg

SEQ ID NO: 524399 - RNA, 14 nt, Homo sapiens
aaaacuaaccaucu

SEQ ID NO: 524400 - RNA, 15 nt, Homo sapiens
aaaacuaaccaucug

SEQ ID NO: 524401 - RNA, 22 nt, Homo sapiens
aaaacuggguaugcguuucaug

SEQ ID NO: 524402 - RNA, 20 nt, Homo sapiens
aaaagacugaaucuaccugc

SEQ ID NO: 524403 - RNA, 14 nt, Homo sapiens
aaaagcagcuacca

SEQ ID NO: 524404 - RNA, 16 nt, Homo sapiens
aaaagcgacccauuca

SEQ ID NO: 524405 - RNA, 20 nt, Homo sapiens
aaaaggguacagaugugcug

SEQ ID NO: 524406 - RNA, 14 nt, Homo sapiens
aaaaguuguuuguu

SEQ ID NO: 524407 - RNA, 23 nt, Homo sapiens
aaaauaaaauguuucauuaugca

SEQ ID NO: 524408 - RNA, 14 nt, Homo sapiens
aaaauacuguucuu

SEQ ID NO: 524409 - RNA, 13 nt, Homo sapiens
aaaauauaugccu

SEQ ID NO: 524410 - RNA, 17 nt, Homo sapiens
aaaaucccaccuuccca

SEQ ID NO: 524411 - RNA, 16 nt, Homo sapiens
aaaaucuccaucucaa

SEQ ID NO: 524412 - RNA, 21 nt, Homo sapiens
aaaaugucaguguuugggaaa

SEQ ID NO: 524413 - RNA, 18 nt, Homo sapiens
aaaauguguccuaucuau

SEQ ID NO: 524414 - RNA, 13 nt, Homo sapiens
aaaauucauuucu

SEQ ID NO: 524415 - RNA, 22 nt, Homo sapiens
aaaauuuuuuuuguaacuggag

SEQ ID NO: 524416 - RNA, 16 nt, Homo sapiens
aaacaaaguugauuaa

SEQ ID NO: 524417 - RNA, 19 nt, Homo sapiens
aaacacugggggcaccuua

SEQ ID NO: 524418 - RNA, 14 nt, Homo sapiens
aaacagaucuccug

SEQ ID NO: 524419 - RNA, 22 nt, Homo sapiens
aaacauuaaaauauaaucucua

SEQ ID NO: 524420 - RNA, 17 nt, Homo sapiens
aaacauuuuaucauuaa

SEQ ID NO: 524421 - RNA, 17 nt, Homo sapiens
aaaccacagucuuccca

SEQ ID NO: 524422 - RNA, 21 nt, Homo sapiens
aaaccaggauuuccuugacuu

SEQ ID NO: 524423 - RNA, 13 nt, Homo sapiens
aaaccccgucucu

SEQ ID NO: 524424 - RNA, 18 nt, Homo sapiens
aaaccuugcucuccucau

SEQ ID NO: 524425 - RNA, 16 nt, Homo sapiens
aaacuauuuauaucac

SEQ ID NO: 524426 - RNA, 19 nt, Homo sapiens
aaacucaacaagugcuccu

SEQ ID NO: 524427 - RNA, 13 nt, Homo sapiens
aaacucuucagug

SEQ ID NO: 524428 - RNA, 18 nt, Homo sapiens
aaacucuucagugcaaau

SEQ ID NO: 524429 - RNA, 23 nt, Homo sapiens
aaacuugaaguagguagcaacgu

SEQ ID NO: 524430 - RNA, 16 nt, Homo sapiens
aaagaaaagaaaaaga

SEQ ID NO: 524431 - RNA, 14 nt, Homo sapiens
aaagaaaccuucca

SEQ ID NO: 524432 - RNA, 22 nt, Homo sapiens
aaagaaauuuaaguucuaugag

SEQ ID NO: 524433 - RNA, 17 nt, Homo sapiens
aaagaacgcugauuuaa

SEQ ID NO: 524434 - RNA, 12 nt, Homo sapiens
aaagaagcuuua

SEQ ID NO: 524435 - RNA, 14 nt, Homo sapiens
aaagaagcuuuauc

SEQ ID NO: 524436 - RNA, 14 nt, Homo sapiens
aaagacagcuuuaa

SEQ ID NO: 524437 - RNA, 17 nt, Homo sapiens
aaagagacuccgucuca

SEQ ID NO: 524438 - RNA, 19 nt, Homo sapiens
aaagaggcccaagugcaaa

SEQ ID NO: 524439 - RNA, 22 nt, Homo sapiens
aaagaggcugccccucucacca

SEQ ID NO: 524440 - RNA, 21 nt, Homo sapiens
aaagauaguugauucuugccu

SEQ ID NO: 524441 - RNA, 23 nt, Homo sapiens
aaagauccagccucauaccuaca

SEQ ID NO: 524442 - RNA, 20 nt, Homo sapiens
aaagcagccauuggcacugu

SEQ ID NO: 524443 - RNA, 19 nt, Homo sapiens
aaagcaguuacuaauaugc

SEQ ID NO: 524444 - RNA, 22 nt, Homo sapiens
aaagccacaaugagaaugaugc

SEQ ID NO: 524445 - RNA, 22 nt, Homo sapiens
aaagcuaguguaccuccucuca

SEQ ID NO: 524446 - RNA, 23 nt, Homo sapiens
aaagcuuggagggaagccgugaa

SEQ ID NO: 524447 - RNA, 15 nt, Homo sapiens
aaagcuuuuuccucc

SEQ ID NO: 524448 - RNA, 19 nt, Homo sapiens
aaaggaaaaucacaucucc

SEQ ID NO: 524449 - RNA, 20 nt, Homo sapiens
aaaggaaaaucacaucucca

SEQ ID NO: 524450 - RNA, 13 nt, Homo sapiens
aaaggcagcugcc

SEQ ID NO: 524451 - RNA, 14 nt, Homo sapiens
aaaggggcacuggu

SEQ ID NO: 524452 - RNA, 17 nt, Homo sapiens
aaaguagaaaaagauuc

SEQ ID NO: 524453 - RNA, 18 nt, Homo sapiens
aaagugcauauuuaucca

SEQ ID NO: 524454 - RNA, 19 nt, Homo sapiens
aaaguuacaguuugauaca

SEQ ID NO: 524455 - RNA, 18 nt, Homo sapiens
aaaguucuugguggugga

SEQ ID NO: 524456 - RNA, 15 nt, Homo sapiens
aaauaagauuccaga

SEQ ID NO: 524457 - RNA, 21 nt, Homo sapiens
aaauaguaccuucaauacuua

SEQ ID NO: 524458 - RNA, 22 nt, Homo sapiens
aaauauauauuauauauuuaca

SEQ ID NO: 524459 - RNA, 18 nt, Homo sapiens
aaauauuccaagcuucau

SEQ ID NO: 524460 - RNA, 16 nt, Homo sapiens
aaauauuuagauguaa

SEQ ID NO: 524461 - RNA, 15 nt, Homo sapiens
aaaucuaccacugua

SEQ ID NO: 524462 - RNA, 12 nt, Homo sapiens
aaaucugaauaa

SEQ ID NO: 524463 - RNA, 16 nt, Homo sapiens
aaaugaaaucuuccca

SEQ ID NO: 524464 - RNA, 13 nt, Homo sapiens
aaaugacauuaaa

SEQ ID NO: 524465 - RNA, 22 nt, Homo sapiens
aaaugcauaauaacuacuucca

SEQ ID NO: 524466 - RNA, 18 nt, Homo sapiens
aaaugcuguuaguaaauu

SEQ ID NO: 524467 - RNA, 16 nt, Homo sapiens
aaauggaggaauauga

SEQ ID NO: 524468 - RNA, 17 nt, Homo sapiens
aaaugggagacagccuc

SEQ ID NO: 524469 - RNA, 19 nt, Homo sapiens
aaaugggagacagccucuu

SEQ ID NO: 524470 - RNA, 23 nt, Homo sapiens
aaauguaggcuuucauguugcaa

SEQ ID NO: 524471 - RNA, 15 nt, Homo sapiens
aaaugucucauguca

SEQ ID NO: 524472 - RNA, 16 nt, Homo sapiens
aaauguucaagucaug

SEQ ID NO: 524473 - RNA, 18 nt, Homo sapiens
aaauuaaacaaauaugca

SEQ ID NO: 524474 - RNA, 12 nt, Homo sapiens
aaauuaagcauu

SEQ ID NO: 524475 - RNA, 12 nt, Homo sapiens
aaauuacuaauu

SEQ ID NO: 524476 - RNA, 15 nt, Homo sapiens
aaauucaacuuugua

SEQ ID NO: 524477 - RNA, 14 nt, Homo sapiens
aaauucaucuagac

SEQ ID NO: 524478 - RNA, 18 nt, Homo sapiens
aaauuuuaaaaaucuaag

SEQ ID NO: 524479 - RNA, 15 nt, Homo sapiens
aaauuuuuaggcaaa

SEQ ID NO: 524480 - RNA, 19 nt, Homo sapiens
aacaaaagcgacccauuca

SEQ ID NO: 524481 - RNA, 23 nt, Homo sapiens
aacaaauaugcaaaccaggauuu

SEQ ID NO: 524482 - RNA, 20 nt, Homo sapiens
aacaaucuauggcuuauuuc

SEQ ID NO: 524483 - RNA, 11 nt, Homo sapiens
aacacaucugg

SEQ ID NO: 524484 - RNA, 20 nt, Homo sapiens
aacacuaucauggacuacac

SEQ ID NO: 524485 - RNA, 11 nt, Homo sapiens
aacacuggcau

SEQ ID NO: 524486 - RNA, 21 nt, Homo sapiens
aacacuguagcuacauuuuca

SEQ ID NO: 524487 - RNA, 16 nt, Homo sapiens
aacacuuagugaucau

SEQ ID NO: 524488 - RNA, 16 nt, Homo sapiens
aacagcugcauuagaa

SEQ ID NO: 524489 - RNA, 15 nt, Homo sapiens
aacagggcaacugua

SEQ ID NO: 524490 - RNA, 14 nt, Homo sapiens
aacaggucacuuga

SEQ ID NO: 524491 - RNA, 16 nt, Homo sapiens
aacaguuuuugcuaau

SEQ ID NO: 524492 - RNA, 22 nt, Homo sapiens
aacaucaagccaucaaaccugg

SEQ ID NO: 524493 - RNA, 12 nt, Homo sapiens
aacaugugaaaa

SEQ ID NO: 524494 - RNA, 16 nt, Homo sapiens
aacauuugcugccauu

SEQ ID NO: 524495 - RNA, 18 nt, Homo sapiens
aacauuugucuggucuua

SEQ ID NO: 524496 - RNA, 18 nt, Homo sapiens
aacauuuuacaugcagcu

SEQ ID NO: 524497 - RNA, 16 nt, Homo sapiens
aaccaaggaaagugaa

SEQ ID NO: 524498 - RNA, 16 nt, Homo sapiens
aaccagagaagcugcu

SEQ ID NO: 524499 - RNA, 19 nt, Homo sapiens
aaccaucugaagaaacuuc

SEQ ID NO: 524500 - RNA, 23 nt, Homo sapiens
aaccaugccuuccucaguaucca

SEQ ID NO: 524501 - RNA, 19 nt, Homo sapiens
aacccauguugaucuuucu

SEQ ID NO: 524502 - RNA, 16 nt, Homo sapiens
aaccgagaagguuuau

SEQ ID NO: 524503 - RNA, 22 nt, Homo sapiens
aaccucagggcucccagggguc

SEQ ID NO: 524504 - RNA, 23 nt, Homo sapiens
aaccucagggcucccaggggucu

SEQ ID NO: 524505 - RNA, 13 nt, Homo sapiens
aaccucaguugaa

SEQ ID NO: 524506 - RNA, 22 nt, Homo sapiens
aaccucauccaggcuaccaucc

SEQ ID NO: 524507 - RNA, 16 nt, Homo sapiens
aaccucauugcagcua

SEQ ID NO: 524508 - RNA, 16 nt, Homo sapiens
aaccuccagugucagg

SEQ ID NO: 524509 - RNA, 20 nt, Homo sapiens
aaccucuucaugagcuugaa

SEQ ID NO: 524510 - RNA, 23 nt, Homo sapiens
aaccuggaccccuucggcagcua

SEQ ID NO: 524511 - RNA, 19 nt, Homo sapiens
aacgauuuuaugaaaugac

SEQ ID NO: 524512 - RNA, 22 nt, Homo sapiens
aacguaugugguuaucugugaa

SEQ ID NO: 524513 - RNA, 23 nt, Homo sapiens
aacuacucagccuagcacaggcu

SEQ ID NO: 524514 - RNA, 15 nt, Homo sapiens
aacuacuuccauccc

SEQ ID NO: 524515 - RNA, 13 nt, Homo sapiens
aacucacacuccc

SEQ ID NO: 524516 - RNA, 19 nt, Homo sapiens
aacucaguccuguacucug

SEQ ID NO: 524517 - RNA, 12 nt, Homo sapiens
aacucuggugcu

SEQ ID NO: 524518 - RNA, 20 nt, Homo sapiens
cauauguauauauauauaug

SEQ ID NO: 524519 - RNA, 23 nt, Homo sapiens
cauauuuugguuuguguauccau

SEQ ID NO: 524520 - RNA, 18 nt, Homo sapiens
caucaggccgcauccuga

SEQ ID NO: 524521 - RNA, 15 nt, Homo sapiens
cauccucaugcugcu

SEQ ID NO: 524522 - RNA, 17 nt, Homo sapiens
cauccucaugcugcuca

SEQ ID NO: 524523 - RNA, 14 nt, Homo sapiens
cauccugacugaaa

SEQ ID NO: 524524 - RNA, 20 nt, Homo sapiens
caucuaccuuuucuggcaaa

SEQ ID NO: 524525 - RNA, 12 nt, Homo sapiens
caucuggcugca

SEQ ID NO: 524526 - RNA, 15 nt, Homo sapiens
caucuguguaaagug

SEQ ID NO: 524527 - RNA, 15 nt, Homo sapiens
caucuuagaccucca

SEQ ID NO: 524528 - RNA, 14 nt, Homo sapiens
caugcccaugauga

SEQ ID NO: 524529 - RNA, 16 nt, Homo sapiens
caugcguccuggucaa

SEQ ID NO: 524530 - RNA, 14 nt, Homo sapiens
caugcuugacauac

SEQ ID NO: 524531 - RNA, 14 nt, Homo sapiens
cauggacuacacca

SEQ ID NO: 524532 - RNA, 19 nt, Homo sapiens
cauggaggugccggaugca

SEQ ID NO: 524533 - RNA, 14 nt, Homo sapiens
cauggccauggcag

SEQ ID NO: 524534 - RNA, 17 nt, Homo sapiens
caugguuguugcauaua

SEQ ID NO: 524535 - RNA, 18 nt, Homo sapiens
cauguacuacagcuauau

SEQ ID NO: 524536 - RNA, 23 nt, Homo sapiens
cauguagguaggaagcacugaaa

SEQ ID NO: 524537 - RNA, 20 nt, Homo sapiens
cauguaucuuuugaacuggc

SEQ ID NO: 524538 - RNA, 22 nt, Homo sapiens
cauguauggaaucccacuguau

SEQ ID NO: 524539 - RNA, 15 nt, Homo sapiens
cauguccuaauucuu

SEQ ID NO: 524540 - RNA, 22 nt, Homo sapiens
cauguguacuuauuacagucuu

SEQ ID NO: 524541 - RNA, 13 nt, Homo sapiens
cauguguauuucc

SEQ ID NO: 524542 - RNA, 23 nt, Homo sapiens
cauguguccuggugagaaaauau

SEQ ID NO: 524543 - RNA, 16 nt, Homo sapiens
cauguugaaggugccc

SEQ ID NO: 524544 - RNA, 22 nt, Homo sapiens
cauguuggccaggcuggucuca

SEQ ID NO: 524545 - RNA, 15 nt, Homo sapiens
cauguuucacagugg

SEQ ID NO: 524546 - RNA, 18 nt, Homo sapiens
cauguuuuguugcucagu

SEQ ID NO: 524547 - RNA, 16 nt, Homo sapiens
cauuaaggaauuugau

SEQ ID NO: 524548 - RNA, 19 nt, Homo sapiens
cauuaaggggaagaaugaa

SEQ ID NO: 524549 - RNA, 13 nt, Homo sapiens
cauuaauguuucu

SEQ ID NO: 524550 - RNA, 11 nt, Homo sapiens
cauuacugugu

SEQ ID NO: 524551 - RNA, 19 nt, Homo sapiens
cauuagcuuccugccccag

SEQ ID NO: 524552 - RNA, 22 nt, Homo sapiens
cauuccauuuugugaauuguga

SEQ ID NO: 524553 - RNA, 17 nt, Homo sapiens
cauucccucucaucuca

SEQ ID NO: 524554 - RNA, 17 nt, Homo sapiens
cauucuguuagauacua

SEQ ID NO: 524555 - RNA, 22 nt, Homo sapiens
cauugaagacccugucucaaaa

SEQ ID NO: 524556 - RNA, 16 nt, Homo sapiens
cauugccgcuguauaa

SEQ ID NO: 524557 - RNA, 21 nt, Homo sapiens
cauugcuaaacugaugacuua

SEQ ID NO: 524558 - RNA, 12 nt, Homo sapiens
cauuggcacugu

SEQ ID NO: 524559 - RNA, 14 nt, Homo sapiens
cauuguaaaagcau

SEQ ID NO: 524560 - RNA, 20 nt, Homo sapiens
cauuguaaaagcauuuugua

SEQ ID NO: 524561 - RNA, 17 nt, Homo sapiens
cauugucaccucuguga

SEQ ID NO: 524562 - RNA, 22 nt, Homo sapiens
cauuuacuuagcagaaccacau

SEQ ID NO: 524563 - RNA, 23 nt, Homo sapiens
cauuuagcuuguuccacugcaaa

SEQ ID NO: 524564 - RNA, 21 nt, Homo sapiens
cauuuaucaugguccugaaug

SEQ ID NO: 524565 - RNA, 15 nt, Homo sapiens
cauuucacucucaaa

SEQ ID NO: 524566 - RNA, 19 nt, Homo sapiens
cauuucucauaccuucccc

SEQ ID NO: 524567 - RNA, 23 nt, Homo sapiens
cauuucucauaccuuccccacau

SEQ ID NO: 524568 - RNA, 20 nt, Homo sapiens
cauuucucuuccccuuagaa

SEQ ID NO: 524569 - RNA, 12 nt, Homo sapiens
cauuucuuccca

SEQ ID NO: 524570 - RNA, 14 nt, Homo sapiens
cauuugcugccauu

SEQ ID NO: 524571 - RNA, 19 nt, Homo sapiens
cauuuggaaugaauacagc

SEQ ID NO: 524572 - RNA, 15 nt, Homo sapiens
cauuugugguccuga

SEQ ID NO: 524573 - RNA, 21 nt, Homo sapiens
cauuuuggugugcaacccugu

SEQ ID NO: 524574 - RNA, 17 nt, Homo sapiens
cauuuugugaauuguga

SEQ ID NO: 524575 - RNA, 13 nt, Homo sapiens
ccaaaauccgacu

SEQ ID NO: 524576 - RNA, 17 nt, Homo sapiens
ccaaagcuuaugugaca

SEQ ID NO: 524577 - RNA, 14 nt, Homo sapiens
ccaacauucuuggc

SEQ ID NO: 524578 - RNA, 16 nt, Homo sapiens
ccaacuacucagccua

SEQ ID NO: 524579 - RNA, 12 nt, Homo sapiens
ccaacuccucac

SEQ ID NO: 524580 - RNA, 20 nt, Homo sapiens
ccaacugcagcucuccauca

SEQ ID NO: 524581 - RNA, 20 nt, Homo sapiens
ccaacuuuccccacguuaaa

SEQ ID NO: 524582 - RNA, 19 nt, Homo sapiens
ccaagaaagcucacuguag

SEQ ID NO: 524583 - RNA, 16 nt, Homo sapiens
ccaagacagagacaga

SEQ ID NO: 524584 - RNA, 17 nt, Homo sapiens
ccaagcucaguucaaug

SEQ ID NO: 524585 - RNA, 21 nt, Homo sapiens
ccacaaccaccuucaccugga

SEQ ID NO: 524586 - RNA, 22 nt, Homo sapiens
ccacaacccaagcaacauuugu

SEQ ID NO: 524587 - RNA, 21 nt, Homo sapiens
ccacacuguggccaggccuua

SEQ ID NO: 524588 - RNA, 18 nt, Homo sapiens
ccaccaacauucuuggca

SEQ ID NO: 524589 - RNA, 21 nt, Homo sapiens
ccaccacuuuuggauuuuaug

SEQ ID NO: 524590 - RNA, 22 nt, Homo sapiens
ccaccugacacuaaccagaguc

SEQ ID NO: 524591 - RNA, 15 nt, Homo sapiens
ccaccuuccccagaa

SEQ ID NO: 524592 - RNA, 19 nt, Homo sapiens
ccacucaggccacaguggg

SEQ ID NO: 524593 - RNA, 18 nt, Homo sapiens
ccacuuugcuguuccuua

SEQ ID NO: 524594 - RNA, 17 nt, Homo sapiens
ccagaaggcgugcuggc

SEQ ID NO: 524595 - RNA, 17 nt, Homo sapiens
ccagagaugcuggacuu

SEQ ID NO: 524596 - RNA, 20 nt, Homo sapiens
ccagaggcagcucgugugcc

SEQ ID NO: 524597 - RNA, 18 nt, Homo sapiens
ccagaggcucuaauguac

SEQ ID NO: 524598 - RNA, 18 nt, Homo sapiens
ccagaugagaagucugcu

SEQ ID NO: 524599 - RNA, 19 nt, Homo sapiens
ccagcaauuccugagccaa

SEQ ID NO: 524600 - RNA, 22 nt, Homo sapiens
ccagcauauauacuugcaagau

SEQ ID NO: 524601 - RNA, 21 nt, Homo sapiens
ccagcccauggcccccaauaa

SEQ ID NO: 524602 - RNA, 15 nt, Homo sapiens
ccagccuuggcgaca

SEQ ID NO: 524603 - RNA, 17 nt, Homo sapiens
ccaggacagcugugcuc

SEQ ID NO: 524604 - RNA, 13 nt, Homo sapiens
ccaggcauggugg

SEQ ID NO: 524605 - RNA, 21 nt, Homo sapiens
ccaggcccugcucuuccucag

SEQ ID NO: 524606 - RNA, 16 nt, Homo sapiens
ccaggcgugauggcag

SEQ ID NO: 524607 - RNA, 15 nt, Homo sapiens
ccaggcuaugccauc

SEQ ID NO: 524608 - RNA, 23 nt, Homo sapiens
ccagggauggccccuagccacag

SEQ ID NO: 524609 - RNA, 19 nt, Homo sapiens
ccagguguucuacacucau

SEQ ID NO: 524610 - RNA, 16 nt, Homo sapiens
ccagucccacacugug

SEQ ID NO: 524611 - RNA, 19 nt, Homo sapiens
ccaguccucccagcugcca

SEQ ID NO: 524612 - RNA, 19 nt, Homo sapiens
ccagugacaaggcccugag

SEQ ID NO: 524613 - RNA, 14 nt, Homo sapiens
ccaguggaugccac

SEQ ID NO: 524614 - RNA, 13 nt, Homo sapiens
ccagugucauccg

SEQ ID NO: 524615 - RNA, 13 nt, Homo sapiens
ccaucaggguucu

SEQ ID NO: 524616 - RNA, 23 nt, Homo sapiens
ccaucagugaauccugaaacugg

SEQ ID NO: 524617 - RNA, 19 nt, Homo sapiens
ccaucggugaaacuaacag

SEQ ID NO: 524618 - RNA, 19 nt, Homo sapiens
ccaucugaagaaacuuccc

SEQ ID NO: 524619 - RNA, 18 nt, Homo sapiens
ccaugaccugcgcucuca

SEQ ID NO: 524620 - RNA, 20 nt, Homo sapiens
ccaugaggaaggaacagcaa

SEQ ID NO: 524621 - RNA, 23 nt, Homo sapiens
ccauggcccccaauaaaggcagc

SEQ ID NO: 524622 - RNA, 10 nt, Homo sapiens
ccauguccaa

SEQ ID NO: 524623 - RNA, 20 nt, Homo sapiens
ccaugugccuuucuuugccu

SEQ ID NO: 524624 - RNA, 15 nt, Homo sapiens
ccauucagagacugu

SEQ ID NO: 524625 - RNA, 23 nt, Homo sapiens
ccauucuguuuggaucuauagaa

SEQ ID NO: 524626 - RNA, 18 nt, Homo sapiens
ccauuucaaacuggagag

SEQ ID NO: 524627 - RNA, 19 nt, Homo sapiens
cccacaaaacuucagugug

SEQ ID NO: 524628 - RNA, 19 nt, Homo sapiens
cccacaccccaacacuucc

SEQ ID NO: 524629 - RNA, 13 nt, Homo sapiens
cccacuucccacc

SEQ ID NO: 524630 - RNA, 15 nt, Homo sapiens
cccagcuacuuuaac

SEQ ID NO: 524631 - RNA, 21 nt, Homo sapiens
cccaggaggugugauuccuga

SEQ ID NO: 524632 - RNA, 19 nt, Homo sapiens
cccaggcuggagugcagug

SEQ ID NO: 524633 - RNA, 20 nt, Homo sapiens
cccagggaggcugugcacag

SEQ ID NO: 524634 - RNA, 19 nt, Homo sapiens
cccagggcaccauccagcu

SEQ ID NO: 524635 - RNA, 13 nt, Homo sapiens
cccagucccacac

SEQ ID NO: 524636 - RNA, 18 nt, Homo sapiens
cccagugcaugguggcca

SEQ ID NO: 524637 - RNA, 22 nt, Homo sapiens
cccaguuugauaccugcacugu

SEQ ID NO: 524638 - RNA, 10 nt, Homo sapiens
cccauguauu

SEQ ID NO: 524639 - RNA, 19 nt, Homo sapiens
ccccaccacuguuggucca

SEQ ID NO: 524640 - RNA, 16 nt, Homo sapiens
ccccacugcugagcug

SEQ ID NO: 524641 - RNA, 18 nt, Homo sapiens
ccccagguuccauaccau

SEQ ID NO: 524642 - RNA, 21 nt, Homo sapiens
ccccauuuccuccucaucuga

SEQ ID NO: 524643 - RNA, 16 nt, Homo sapiens
cccccaaauuaguaca

SEQ ID NO: 524644 - RNA, 15 nt, Homo sapiens
cccccacucagugcc

SEQ ID NO: 524645 - RNA, 20 nt, Homo sapiens
cccccugggcuggggccuca

SEQ ID NO: 524646 - RNA, 19 nt, Homo sapiens
ccccgaggagcccgaaguc

SEQ ID NO: 524647 - RNA, 16 nt, Homo sapiens
ccccuggcugugcucu

SEQ ID NO: 524648 - RNA, 17 nt, Homo sapiens
ccccuggcugugcucua

SEQ ID NO: 524649 - RNA, 15 nt, Homo sapiens
ccccuggcuuugccu

SEQ ID NO: 524650 - RNA, 14 nt, Homo sapiens
ccccuugggugacc

SEQ ID NO: 524651 - RNA, 12 nt, Homo sapiens
cccgaagccacc

SEQ ID NO: 524652 - RNA, 22 nt, Homo sapiens
cccgauuuguuuauuugcaauu

SEQ ID NO: 524653 - RNA, 12 nt, Homo sapiens
cccgcucugcag

SEQ ID NO: 524654 - RNA, 11 nt, Homo sapiens
cccgugacugc

SEQ ID NO: 524655 - RNA, 16 nt, Homo sapiens
cccguguguugcacca

SEQ ID NO: 524656 - RNA, 20 nt, Homo sapiens
cccuaggaaacucacacucc

SEQ ID NO: 524657 - RNA, 17 nt, Homo sapiens
cccucaucuaugaggaa

SEQ ID NO: 524658 - RNA, 19 nt, Homo sapiens
cccuccugugcugggggaa

SEQ ID NO: 524659 - RNA, 21 nt, Homo sapiens
cccugggcuacagaaaccaca

SEQ ID NO: 524660 - RNA, 20 nt, Homo sapiens
cccuguccugcagucccaca

SEQ ID NO: 524661 - RNA, 14 nt, Homo sapiens
cccugucuuccaca

SEQ ID NO: 524662 - RNA, 15 nt, Homo sapiens
cccuguuagcuuucc

SEQ ID NO: 524663 - RNA, 17 nt, Homo sapiens
cccuuccaugugccuuu

SEQ ID NO: 524664 - RNA, 14 nt, Homo sapiens
cccuucggcagcua

SEQ ID NO: 524665 - RNA, 21 nt, Homo sapiens
cccuugcaaucuucuacuuua

SEQ ID NO: 524666 - RNA, 21 nt, Homo sapiens
cccuugguccuggaacauuua

SEQ ID NO: 524667 - RNA, 16 nt, Homo sapiens
ccgaagaugguggcca

SEQ ID NO: 524668 - RNA, 22 nt, Homo sapiens
ccgauuuuuuuuuuuuccucuu

SEQ ID NO: 524669 - RNA, 13 nt, Homo sapiens
ccgcagaauggac

SEQ ID NO: 524670 - RNA, 22 nt, Homo sapiens
ccgccagcgaacuugacaauug

SEQ ID NO: 524671 - RNA, 22 nt, Homo sapiens
ccgcuucuccaagucugcugau

SEQ ID NO: 524672 - RNA, 15 nt, Homo sapiens
ccggcccugugugca

SEQ ID NO: 524673 - RNA, 21 nt, Homo sapiens
ccgggcgugguggcacaugcc

SEQ ID NO: 524674 - RNA, 15 nt, Homo sapiens
ccgugaacucuggug

SEQ ID NO: 524675 - RNA, 16 nt, Homo sapiens
ccuaacacggugcuca

SEQ ID NO: 524676 - RNA, 16 nt, Homo sapiens
ccuaaggaaccuuccu

SEQ ID NO: 524677 - RNA, 15 nt, Homo sapiens
ccuaagggagugucu

SEQ ID NO: 524678 - RNA, 16 nt, Homo sapiens
ccuagccagaggcucu

SEQ ID NO: 524679 - RNA, 20 nt, Homo sapiens
ccuaggcugcugcugugacc

SEQ ID NO: 524680 - RNA, 22 nt, Homo sapiens
ccuaguccccagccugcucccu

SEQ ID NO: 524681 - RNA, 16 nt, Homo sapiens
ccuagucuagcauucu

SEQ ID NO: 524682 - RNA, 14 nt, Homo sapiens
ccucaaucuauucu

SEQ ID NO: 524683 - RNA, 20 nt, Homo sapiens
ccucaaucuauucuguaaaa

SEQ ID NO: 524684 - RNA, 19 nt, Homo sapiens
ccucaauuuuugucucaga

SEQ ID NO: 524685 - RNA, 17 nt, Homo sapiens
ccucacauucucuaugu

SEQ ID NO: 524686 - RNA, 22 nt, Homo sapiens
ccucaccucccgaagccaccau

SEQ ID NO: 524687 - RNA, 22 nt, Homo sapiens
ccucacucuguuuccuggucag

SEQ ID NO: 524688 - RNA, 17 nt, Homo sapiens
ccucagcucaaugcagu

SEQ ID NO: 524689 - RNA, 21 nt, Homo sapiens
ccucauuacugggccuuagug

SEQ ID NO: 524690 - RNA, 18 nt, Homo sapiens
ccuccagggugauuuuau

SEQ ID NO: 524691 - RNA, 13 nt, Homo sapiens
ccucccuuugaug

SEQ ID NO: 524692 - RNA, 17 nt, Homo sapiens
ccuccugggaacacauc

SEQ ID NO: 524693 - RNA, 22 nt, Homo sapiens
ccuccugggaacacaucuggcu

SEQ ID NO: 524694 - RNA, 16 nt, Homo sapiens
ccucucaccccacucc

SEQ ID NO: 524695 - RNA, 16 nt, Homo sapiens
ccucugugcaaaggga

SEQ ID NO: 524696 - RNA, 16 nt, Homo sapiens
ccucuuguucauguca

SEQ ID NO: 524697 - RNA, 13 nt, Homo sapiens
ccugaaagccaca

SEQ ID NO: 524698 - RNA, 18 nt, Homo sapiens
ccugaaccucauucuggu

SEQ ID NO: 524699 - RNA, 21 nt, Homo sapiens
ccugaacuacauaacuuccua

SEQ ID NO: 524700 - RNA, 14 nt, Homo sapiens
ccugaauggucuca

SEQ ID NO: 524701 - RNA, 22 nt, Homo sapiens
ccugacacuaaccagagucagc

SEQ ID NO: 524702 - RNA, 16 nt, Homo sapiens
ccugaccaucgcacac

SEQ ID NO: 524703 - RNA, 13 nt, Homo sapiens
ccugacucaggcc

SEQ ID NO: 524704 - RNA, 18 nt, Homo sapiens
ccugacucuugcaggggu

SEQ ID NO: 524705 - RNA, 16 nt, Homo sapiens
ccugacuggugcugca

SEQ ID NO: 524706 - RNA, 13 nt, Homo sapiens
ccugagagucuga

SEQ ID NO: 524707 - RNA, 14 nt, Homo sapiens
ccugauguguccuc

SEQ ID NO: 524708 - RNA, 13 nt, Homo sapiens
ccugcacaggcug

SEQ ID NO: 524709 - RNA, 19 nt, Homo sapiens
ccugcacuguccugaccau

SEQ ID NO: 524710 - RNA, 21 nt, Homo sapiens
ccugcacuguccugaccaucg

SEQ ID NO: 524711 - RNA, 18 nt, Homo sapiens
ccugcagaaguacuccua

SEQ ID NO: 524712 - RNA, 16 nt, Homo sapiens
ccugcucacaaaauca

SEQ ID NO: 524713 - RNA, 18 nt, Homo sapiens
ccugcucacaaaaucacu

SEQ ID NO: 524714 - RNA, 22 nt, Homo sapiens
ccugcucacaaaaucacuuuaa

SEQ ID NO: 524715 - RNA, 22 nt, Homo sapiens
ccugcucccuagccagaggcuc

SEQ ID NO: 524716 - RNA, 20 nt, Homo sapiens
ccugcuccuccaggaauucc

SEQ ID NO: 524717 - RNA, 17 nt, Homo sapiens
ccugcugcaaagccuuu

SEQ ID NO: 524718 - RNA, 17 nt, Homo sapiens
ccuggaggcggcaaagg

SEQ ID NO: 524719 - RNA, 14 nt, Homo sapiens
ccuggccauuucca

SEQ ID NO: 524720 - RNA, 16 nt, Homo sapiens
ccugggccguggcaca

SEQ ID NO: 524721 - RNA, 17 nt, Homo sapiens
ccugggccguggcacag

SEQ ID NO: 524722 - RNA, 19 nt, Homo sapiens
ccugggguucuuuuugcca

SEQ ID NO: 524723 - RNA, 19 nt, Homo sapiens
ccuggguauagugcagaaa

SEQ ID NO: 524724 - RNA, 19 nt, Homo sapiens
ccugggugucugggcucaa

SEQ ID NO: 524725 - RNA, 14 nt, Homo sapiens
ccugguccuggaca

SEQ ID NO: 524726 - RNA, 21 nt, Homo sapiens
ccuguacucuggggugcugcc

SEQ ID NO: 524727 - RNA, 22 nt, Homo sapiens
ccuguaggaagucauccugcca

SEQ ID NO: 524728 - RNA, 15 nt, Homo sapiens
ccugucccuugccuc

SEQ ID NO: 524729 - RNA, 21 nt, Homo sapiens
ccuguguccaccugugggugu

SEQ ID NO: 524730 - RNA, 14 nt, Homo sapiens
ccuguuuccagggu

SEQ ID NO: 524731 - RNA, 18 nt, Homo sapiens
ccuuaagggguaucaugu

SEQ ID NO: 524732 - RNA, 22 nt, Homo sapiens
ccuuacuggcuuaccuccucau

SEQ ID NO: 524733 - RNA, 19 nt, Homo sapiens
ccuuagaaaacaaguauug

SEQ ID NO: 524734 - RNA, 13 nt, Homo sapiens
ccuuaguugaaau

SEQ ID NO: 524735 - RNA, 15 nt, Homo sapiens
ccuucaauacuuaaa

SEQ ID NO: 524736 - RNA, 15 nt, Homo sapiens
ccuucacaaauguca

SEQ ID NO: 524737 - RNA, 22 nt, Homo sapiens
ccuucacuuccaucacaagaaa

SEQ ID NO: 524738 - RNA, 19 nt, Homo sapiens
ccuucaucuucacugcaau

SEQ ID NO: 524739 - RNA, 20 nt, Homo sapiens
ccuucaucuucacugcaauu

SEQ ID NO: 524740 - RNA, 21 nt, Homo sapiens
ccuugcaaucuucuacuuuaa

SEQ ID NO: 524741 - RNA, 23 nt, Homo sapiens
ccuugcaguuuuacuaaaacacu

SEQ ID NO: 524742 - RNA, 14 nt, Homo sapiens
ccuugcuagcugac

SEQ ID NO: 524743 - RNA, 21 nt, Homo sapiens
ccuugcugccgucaccucucc

SEQ ID NO: 524744 - RNA, 13 nt, Homo sapiens
ccuuguaccucaa

SEQ ID NO: 524745 - RNA, 22 nt, Homo sapiens
ccuugucccgucuggaccuggg

SEQ ID NO: 524746 - RNA, 14 nt, Homo sapiens
ccuuuaggaucuca

SEQ ID NO: 524747 - RNA, 23 nt, Homo sapiens
ccuuuaggaucucaggcuucugc

SEQ ID NO: 524748 - RNA, 16 nt, Homo sapiens
ccuuuaggccaucuca

SEQ ID NO: 524749 - RNA, 16 nt, Homo sapiens
ccuuucaaagcacuua

SEQ ID NO: 524750 - RNA, 14 nt, Homo sapiens
ccuuucagucugau

SEQ ID NO: 524751 - RNA, 20 nt, Homo sapiens
ccuuuccccaccucuuacag

SEQ ID NO: 524752 - RNA, 13 nt, Homo sapiens
ccuuuccuuccag

SEQ ID NO: 524753 - RNA, 23 nt, Homo sapiens
ccuuucucaacugucccaaggag

SEQ ID NO: 524754 - RNA, 20 nt, Homo sapiens
ccuuucuuaucuugaccaua

SEQ ID NO: 524755 - RNA, 13 nt, Homo sapiens
ccuuugguuaaua

SEQ ID NO: 524756 - RNA, 18 nt, Homo sapiens
ccuuuuaaagaagcuuua

SEQ ID NO: 524757 - RNA, 16 nt, Homo sapiens
ccuuuuaccugcccaa

SEQ ID NO: 524758 - RNA, 14 nt, Homo sapiens
ccuuuuacucagcu

SEQ ID NO: 524759 - RNA, 20 nt, Homo sapiens
ccuuuuccaggaguucugaa

SEQ ID NO: 524760 - RNA, 21 nt, Homo sapiens
ccuuuuccuuauuugccuucu

SEQ ID NO: 524761 - RNA, 17 nt, Homo sapiens
ccuuuuuuauuccauaa

SEQ ID NO: 524762 - RNA, 18 nt, Homo sapiens
cgaaaucuuagugcccac

SEQ ID NO: 524763 - RNA, 19 nt, Homo sapiens
cgaaccaugccuuccucag

SEQ ID NO: 524764 - RNA, 20 nt, Homo sapiens
cgaauuagcaauaacauaca

SEQ ID NO: 524765 - RNA, 13 nt, Homo sapiens
cgacugggcucaa

SEQ ID NO: 524766 - RNA, 16 nt, Homo sapiens
cgagaggcaauucagu

SEQ ID NO: 524767 - RNA, 17 nt, Homo sapiens
cgagcaccugugcccau

SEQ ID NO: 524768 - RNA, 13 nt, Homo sapiens
cgagcagucagca

SEQ ID NO: 524769 - RNA, 14 nt, Homo sapiens
cgaguaacuccccu

SEQ ID NO: 524770 - RNA, 21 nt, Homo sapiens
cgauguuauuagauguuacaa

SEQ ID NO: 524771 - RNA, 13 nt, Homo sapiens
cgcacagugugag

SEQ ID NO: 524772 - RNA, 22 nt, Homo sapiens
cgcacccaguuugauaccugca

SEQ ID NO: 524773 - RNA, 17 nt, Homo sapiens
cgcacuggggcuggcaa

SEQ ID NO: 524774 - RNA, 13 nt, Homo sapiens
cgcagcacaagcu

SEQ ID NO: 524775 - RNA, 16 nt, Homo sapiens
cgcaggccagcaacuc

SEQ ID NO: 524776 - RNA, 15 nt, Homo sapiens
cgcauauagacugua

SEQ ID NO: 524777 - RNA, 20 nt, Homo sapiens
cgcccugugcccgacugacu

SEQ ID NO: 524778 - RNA, 22 nt, Homo sapiens
cgcuaccucccuccccgucuca

SEQ ID NO: 524779 - RNA, 17 nt, Homo sapiens
cgcucucagcugaccau

SEQ ID NO: 524780 - RNA, 22 nt, Homo sapiens
cgcugagcgucacggccaagug

SEQ ID NO: 524781 - RNA, 15 nt, Homo sapiens
cgcugccccaugugu

SEQ ID NO: 524782 - RNA, 13 nt, Homo sapiens
cggaauguaacuu

SEQ ID NO: 524783 - RNA, 20 nt, Homo sapiens
cggauccagcaauuccugag

SEQ ID NO: 524784 - RNA, 14 nt, Homo sapiens
cggaucucuggagu

SEQ ID NO: 524785 - RNA, 12 nt, Homo sapiens
cggcacauuccc

SEQ ID NO: 524786 - RNA, 16 nt, Homo sapiens
cggccuccaugaccug

SEQ ID NO: 524787 - RNA, 13 nt, Homo sapiens
cggugagaacucu

SEQ ID NO: 524788 - RNA, 16 nt, Homo sapiens
cggugagaacucugcc

SEQ ID NO: 524789 - RNA, 14 nt, Homo sapiens
cggugguugucaca

SEQ ID NO: 524790 - RNA, 17 nt, Homo sapiens
cgguuaccucugcaugg

SEQ ID NO: 524791 - RNA, 14 nt, Homo sapiens
cguauguuuguacu

SEQ ID NO: 524792 - RNA, 21 nt, Homo sapiens
cguauuuggcacacagcagag

SEQ ID NO: 524793 - RNA, 15 nt, Homo sapiens
cguccaucucccuua

SEQ ID NO: 524794 - RNA, 19 nt, Homo sapiens
cgucucuacaaaaauacaa

SEQ ID NO: 524795 - RNA, 14 nt, Homo sapiens
cgucuggacugcua

SEQ ID NO: 524796 - RNA, 21 nt, Homo sapiens
cgugagauccggcagcacaag

SEQ ID NO: 524797 - RNA, 23 nt, Homo sapiens
cgugagauccggcagcacaagcu

SEQ ID NO: 524798 - RNA, 20 nt, Homo sapiens
cgugcauuuuuggaucauuu

SEQ ID NO: 524799 - RNA, 17 nt, Homo sapiens
cguggcacacacugacc

SEQ ID NO: 524800 - RNA, 20 nt, Homo sapiens
cguggggaacugcguggugc

SEQ ID NO: 524801 - RNA, 13 nt, Homo sapiens
cguguacugcaaa

SEQ ID NO: 524802 - RNA, 14 nt, Homo sapiens
cuaaacugguguuu

SEQ ID NO: 524803 - RNA, 19 nt, Homo sapiens
cuaaagccucaaaacaaag

SEQ ID NO: 524804 - RNA, 13 nt, Homo sapiens
cuaaauaaauggg

SEQ ID NO: 524805 - RNA, 21 nt, Homo sapiens
cuaaauuuacccucuugaaua

SEQ ID NO: 524806 - RNA, 14 nt, Homo sapiens
cuaacacggugcuc

SEQ ID NO: 524807 - RNA, 11 nt, Homo sapiens
cuaaccaucug

SEQ ID NO: 524808 - RNA, 18 nt, Homo sapiens
cuaacuaaauaccauuca

SEQ ID NO: 524809 - RNA, 19 nt, Homo sapiens
cuaacuuuucuuaagguuu

SEQ ID NO: 524810 - RNA, 23 nt, Homo sapiens
cuaagaacuguggucugguguuc

SEQ ID NO: 524811 - RNA, 15 nt, Homo sapiens
cuaagggcccaaagg

SEQ ID NO: 524812 - RNA, 18 nt, Homo sapiens
cuaagguuuagauaaaua

SEQ ID NO: 524813 - RNA, 14 nt, Homo sapiens
cuaagugccuccaa

SEQ ID NO: 524814 - RNA, 16 nt, Homo sapiens
cuaauaacaugugaaa

SEQ ID NO: 524815 - RNA, 18 nt, Homo sapiens
cuaauaugccuagcacaa

SEQ ID NO: 524816 - RNA, 15 nt, Homo sapiens
cuaaugcauuuugca

SEQ ID NO: 524817 - RNA, 21 nt, Homo sapiens
cuaauguacaauaaagcaaug

SEQ ID NO: 524818 - RNA, 22 nt, Homo sapiens
cuacaaaggagacgggggagca

SEQ ID NO: 524819 - RNA, 10 nt, Homo sapiens
cuaccucagc

SEQ ID NO: 524820 - RNA, 20 nt, Homo sapiens
cuacuaaguucacauuagaa

SEQ ID NO: 524821 - RNA, 21 nt, Homo sapiens
cuacuccccuuaaucuaaucu

SEQ ID NO: 524822 - RNA, 19 nt, Homo sapiens
cuagaagaaccaaauaccu

SEQ ID NO: 524823 - RNA, 21 nt, Homo sapiens
cuagaagcuccagugauaaga

SEQ ID NO: 524824 - RNA, 10 nt, Homo sapiens
cuagaaggca

SEQ ID NO: 524825 - RNA, 20 nt, Homo sapiens
cuagaaggggcuaugcauau

SEQ ID NO: 524826 - RNA, 14 nt, Homo sapiens
cuagagcuuuuauu

SEQ ID NO: 524827 - RNA, 12 nt, Homo sapiens
cuagaguuuuau

SEQ ID NO: 524828 - RNA, 19 nt, Homo sapiens
cuagccagaggcucuaaug

SEQ ID NO: 524829 - RNA, 15 nt, Homo sapiens
cuaggaagaaucagu

SEQ ID NO: 524830 - RNA, 22 nt, Homo sapiens
cuaggaugggaacaaggaagga

SEQ ID NO: 524831 - RNA, 22 nt, Homo sapiens
cuaggcguuuguuauauaaaaa

SEQ ID NO: 524832 - RNA, 18 nt, Homo sapiens
cuaggggagucccugugg

SEQ ID NO: 524833 - RNA, 19 nt, Homo sapiens
cuaguacugccccccauga

SEQ ID NO: 524834 - RNA, 23 nt, Homo sapiens
cuaguccccagccugcucccuag

SEQ ID NO: 524835 - RNA, 14 nt, Homo sapiens
cuaguguaccuccu

SEQ ID NO: 524836 - RNA, 18 nt, Homo sapiens
cuaguuaucagauccuuu

SEQ ID NO: 524837 - RNA, 20 nt, Homo sapiens
cuaguucuuuucauuuggaa

SEQ ID NO: 524838 - RNA, 19 nt, Homo sapiens
cuauaaaacucugcaugua

SEQ ID NO: 524839 - RNA, 22 nt, Homo sapiens
cuaugcaggcagcacagcagac

SEQ ID NO: 524840 - RNA, 22 nt, Homo sapiens
cuaugucaguacuauucaggua

SEQ ID NO: 524841 - RNA, 13 nt, Homo sapiens
cuauuaucucaau

SEQ ID NO: 524842 - RNA, 23 nt, Homo sapiens
cuauucuauaaaacucugcaugu

SEQ ID NO: 524843 - RNA, 23 nt, Homo sapiens
cuauugggauauccuuucacucu

SEQ ID NO: 524844 - RNA, 15 nt, Homo sapiens
cuauugugaccacag

SEQ ID NO: 524845 - RNA, 21 nt, Homo sapiens
cuauuuaaaggaaaaucacau

SEQ ID NO: 524846 - RNA, 18 nt, Homo sapiens
cuauuuccucugugcaaa

SEQ ID NO: 524847 - RNA, 18 nt, Homo sapiens
cucaaaccaagcaaagga

SEQ ID NO: 524848 - RNA, 18 nt, Homo sapiens
cucaaacuccugaccuca

SEQ ID NO: 524849 - RNA, 17 nt, Homo sapiens
cucaaagagaauuguau

SEQ ID NO: 524850 - RNA, 19 nt, Homo sapiens
cucaacaagugcuccugaa

SEQ ID NO: 524851 - RNA, 14 nt, Homo sapiens
cucaacaugcugcc

SEQ ID NO: 524852 - RNA, 23 nt, Homo sapiens
cucaauuuaguuuguuauuuauc

SEQ ID NO: 524853 - RNA, 20 nt, Homo sapiens
cucacgccuguaaucccagc

SEQ ID NO: 524854 - RNA, 21 nt, Homo sapiens
cucacuguagcuuuuaggaau

SEQ ID NO: 524855 - RNA, 23 nt, Homo sapiens
cucagcacauucgggaccaauau

SEQ ID NO: 524856 - RNA, 16 nt, Homo sapiens
cucagccugagccucu

SEQ ID NO: 524857 - RNA, 22 nt, Homo sapiens
cucagggagcagggaaggccug

SEQ ID NO: 524858 - RNA, 21 nt, Homo sapiens
cucaguugaaaaugcaacucu

SEQ ID NO: 524859 - RNA, 14 nt, Homo sapiens
cucauaauuuugca

SEQ ID NO: 524860 - RNA, 20 nt, Homo sapiens
cucauccaggcuaccauccg

SEQ ID NO: 524861 - RNA, 20 nt, Homo sapiens
cucauccucuuuuaauggca

SEQ ID NO: 524862 - RNA, 14 nt, Homo sapiens
cucaugcugcucaa

SEQ ID NO: 524863 - RNA, 23 nt, Homo sapiens
cucauucugguucccugcugcgc

SEQ ID NO: 524864 - RNA, 15 nt, Homo sapiens
cucauugugucuccc

SEQ ID NO: 524865 - RNA, 12 nt, Homo sapiens
cuccaagacaga

SEQ ID NO: 524866 - RNA, 18 nt, Homo sapiens
cuccaagcucacgaccuu

SEQ ID NO: 524867 - RNA, 16 nt, Homo sapiens
cuccacaggcacaggu

SEQ ID NO: 524868 - RNA, 21 nt, Homo sapiens
cuccacaugcugccuggcaca

SEQ ID NO: 524869 - RNA, 12 nt, Homo sapiens
cuccacuuguau

SEQ ID NO: 524870 - RNA, 15 nt, Homo sapiens
cuccagcagcuuucc

SEQ ID NO: 524871 - RNA, 20 nt, Homo sapiens
cuccagccaaccucauugca

SEQ ID NO: 524872 - RNA, 21 nt, Homo sapiens
cuccagccugggggacagaaa

SEQ ID NO: 524873 - RNA, 18 nt, Homo sapiens
cuccaucccaaccaggca

SEQ ID NO: 524874 - RNA, 17 nt, Homo sapiens
cuccaucucucauccuc

SEQ ID NO: 524875 - RNA, 17 nt, Homo sapiens
cuccauuauuccucuca

SEQ ID NO: 524876 - RNA, 16 nt, Homo sapiens
cucccagugaugcugu

SEQ ID NO: 524877 - RNA, 13 nt, Homo sapiens
cuccccaccucca

SEQ ID NO: 524878 - RNA, 12 nt, Homo sapiens
cucccuagccag

SEQ ID NO: 524879 - RNA, 19 nt, Homo sapiens
cuggcaagucuuccaugac

SEQ ID NO: 524880 - RNA, 23 nt, Homo sapiens
cuggcacagcuuuuguauagaaa

SEQ ID NO: 524881 - RNA, 21 nt, Homo sapiens
cuggccccuaggcugcugcug

SEQ ID NO: 524882 - RNA, 13 nt, Homo sapiens
cuggcccuugcaa

SEQ ID NO: 524883 - RNA, 16 nt, Homo sapiens
cuggccgcaugaccac

SEQ ID NO: 524884 - RNA, 15 nt, Homo sapiens
cuggcuggaaaaagg

SEQ ID NO: 524885 - RNA, 18 nt, Homo sapiens
cuggcuggaaaaagguga

SEQ ID NO: 524886 - RNA, 14 nt, Homo sapiens
cuggcuuugccucu

SEQ ID NO: 524887 - RNA, 19 nt, Homo sapiens
cugggaugacuggcuuuga

SEQ ID NO: 524888 - RNA, 14 nt, Homo sapiens
cugggccaugucca

SEQ ID NO: 524889 - RNA, 17 nt, Homo sapiens
cugggccauguccaaag

SEQ ID NO: 524890 - RNA, 16 nt, Homo sapiens
cugggcucaagcuuuc

SEQ ID NO: 524891 - RNA, 16 nt, Homo sapiens
cugggcucagccugag

SEQ ID NO: 524892 - RNA, 23 nt, Homo sapiens
cuggggacagacaaggugccugu

SEQ ID NO: 524893 - RNA, 15 nt, Homo sapiens
cuggggagcucagga

SEQ ID NO: 524894 - RNA, 14 nt, Homo sapiens
cuggggaggugaac

SEQ ID NO: 524895 - RNA, 16 nt, Homo sapiens
cuggggaggugaacug

SEQ ID NO: 524896 - RNA, 20 nt, Homo sapiens
cuggggggacccagugcaga

SEQ ID NO: 524897 - RNA, 17 nt, Homo sapiens
cuggggugcugccugaa

SEQ ID NO: 524898 - RNA, 22 nt, Homo sapiens
cugggugucugggcucaagcuu

SEQ ID NO: 524899 - RNA, 16 nt, Homo sapiens
cuggucagcauguacu

SEQ ID NO: 524900 - RNA, 13 nt, Homo sapiens
cuggugcuccugc

SEQ ID NO: 524901 - RNA, 17 nt, Homo sapiens
cugguucccugcugcgc

SEQ ID NO: 524902 - RNA, 17 nt, Homo sapiens
cuguaaucccagcacuu

SEQ ID NO: 524903 - RNA, 19 nt, Homo sapiens
uagucaauaacuaaacuaa

SEQ ID NO: 524904 - RNA, 17 nt, Homo sapiens
uagucaauuucuacuuc

SEQ ID NO: 524905 - RNA, 15 nt, Homo sapiens
uagucagaaaauugg

SEQ ID NO: 524906 - RNA, 15 nt, Homo sapiens
uagucuguuugcaaa

SEQ ID NO: 524907 - RNA, 23 nt, Homo sapiens
uagugggccagggcugcccugag

SEQ ID NO: 524908 - RNA, 18 nt, Homo sapiens
uaguguuuggacagcuga

SEQ ID NO: 524909 - RNA, 13 nt, Homo sapiens
uaguuaaacugag

SEQ ID NO: 524910 - RNA, 19 nt, Homo sapiens
uaguuuugugaaggugauu

SEQ ID NO: 524911 - RNA, 23 nt, Homo sapiens
uaguuuuuucuuucccauguauu

SEQ ID NO: 524912 - RNA, 14 nt, Homo sapiens
uauaaaaaacacua

SEQ ID NO: 524913 - RNA, 18 nt, Homo sapiens
uauaaagcuuaaauuuua

SEQ ID NO: 524914 - RNA, 19 nt, Homo sapiens
uauaaauagaugcugugua

SEQ ID NO: 524915 - RNA, 11 nt, Homo sapiens
uauaagacauu

SEQ ID NO: 524916 - RNA, 16 nt, Homo sapiens
uauaagcagcaagaca

SEQ ID NO: 524917 - RNA, 18 nt, Homo sapiens
uauaaugaagaacacugu

SEQ ID NO: 524918 - RNA, 21 nt, Homo sapiens
uauacauaugagaauauaccu

SEQ ID NO: 524919 - RNA, 16 nt, Homo sapiens
uauacauugucuugau

SEQ ID NO: 524920 - RNA, 20 nt, Homo sapiens
uauaccuuuugcauuucuuu

SEQ ID NO: 524921 - RNA, 14 nt, Homo sapiens
uauauaaaccugga

SEQ ID NO: 524922 - RNA, 21 nt, Homo sapiens
uauauaauaaauacucaguga

SEQ ID NO: 524923 - RNA, 21 nt, Homo sapiens
uauauauuuaauugauuucug

SEQ ID NO: 524924 - RNA, 13 nt, Homo sapiens
uauaucauaugua

SEQ ID NO: 524925 - RNA, 20 nt, Homo sapiens
uauaugguauauauacauau

SEQ ID NO: 524926 - RNA, 18 nt, Homo sapiens
uauauuguauaggggcaa

SEQ ID NO: 524927 - RNA, 18 nt, Homo sapiens
uauauuuguaaagcuauu

SEQ ID NO: 524928 - RNA, 21 nt, Homo sapiens
uauccacaauuauuggcaaag

SEQ ID NO: 524929 - RNA, 17 nt, Homo sapiens
uauccauccucugagau

SEQ ID NO: 524930 - RNA, 19 nt, Homo sapiens
uauccugggagcacugcgu

SEQ ID NO: 524931 - RNA, 14 nt, Homo sapiens
uaucuauuaucuca

SEQ ID NO: 524932 - RNA, 18 nt, Homo sapiens
uaugaaaaucuccaucuc

SEQ ID NO: 524933 - RNA, 21 nt, Homo sapiens
uaugaaugacaguagucacac

SEQ ID NO: 524934 - RNA, 22 nt, Homo sapiens
uaugacuaaagagagaauguag

SEQ ID NO: 524935 - RNA, 16 nt, Homo sapiens
uaugcaguauucuugc

SEQ ID NO: 524936 - RNA, 14 nt, Homo sapiens
uaugcaguccuuua

SEQ ID NO: 524937 - RNA, 21 nt, Homo sapiens
uaugccaugugcggaauucaa

SEQ ID NO: 524938 - RNA, 13 nt, Homo sapiens
ugaaaccaggugg

SEQ ID NO: 524939 - RNA, 15 nt, Homo sapiens
ugaaaccccgucucu

SEQ ID NO: 524940 - RNA, 14 nt, Homo sapiens
ugaaagagccagac

SEQ ID NO: 524941 - RNA, 19 nt, Homo sapiens
ugaaauaaaacuacauggu

SEQ ID NO: 524942 - RNA, 21 nt, Homo sapiens
ugaaauaaaacuacaugguca

SEQ ID NO: 524943 - RNA, 20 nt, Homo sapiens
ugaaauauaguaaacacuug

SEQ ID NO: 524944 - RNA, 15 nt, Homo sapiens
ugaaauuaagcauuu

SEQ ID NO: 524945 - RNA, 19 nt, Homo sapiens
ugaaauugcauacuuugua

SEQ ID NO: 524946 - RNA, 18 nt, Homo sapiens
ugaaccugaauauugcca

SEQ ID NO: 524947 - RNA, 22 nt, Homo sapiens
ugaacggcaucaaggugcugaa

SEQ ID NO: 524948 - RNA, 13 nt, Homo sapiens
ugaagaacacugu

SEQ ID NO: 524949 - RNA, 17 nt, Homo sapiens
ugaagauguuuguguau

SEQ ID NO: 524950 - RNA, 21 nt, Homo sapiens
ugaagcuuaggacuaccagcc

SEQ ID NO: 524951 - RNA, 17 nt, Homo sapiens
ugaaggcuuaauugacu

SEQ ID NO: 524952 - RNA, 18 nt, Homo sapiens
ugaagggucuuucucaaa

SEQ ID NO: 524953 - RNA, 16 nt, Homo sapiens
ugaaguauauauauca

SEQ ID NO: 524954 - RNA, 23 nt, Homo sapiens
ugaagucaccccuuucuguccca

SEQ ID NO: 524955 - RNA, 15 nt, Homo sapiens
ugaagugcgugaaug

SEQ ID NO: 524956 - RNA, 14 nt, Homo sapiens
ugaaguuuuacugu

SEQ ID NO: 524957 - RNA, 17 nt, Homo sapiens
ugaaguuuuacugucua

SEQ ID NO: 524958 - RNA, 21 nt, Homo sapiens
ugaauacagcauuuagcuugu

SEQ ID NO: 524959 - RNA, 14 nt, Homo sapiens
ugaauaugccuuaa

SEQ ID NO: 524960 - RNA, 21 nt, Homo sapiens
ugaauccagaucauuccucag

SEQ ID NO: 524961 - RNA, 17 nt, Homo sapiens
ugaaucuauaaguagua

SEQ ID NO: 524962 - RNA, 14 nt, Homo sapiens
ugaaucugcuuuaa

SEQ ID NO: 524963 - RNA, 20 nt, Homo sapiens
ugaaugacacgccuaagguc

SEQ ID NO: 524964 - RNA, 13 nt, Homo sapiens
ugaaugccuaccu

SEQ ID NO: 524965 - RNA, 20 nt, Homo sapiens
ugaaugccuccuguggggaa

SEQ ID NO: 524966 - RNA, 12 nt, Homo sapiens
ugaaugcuuccu

SEQ ID NO: 524967 - RNA, 21 nt, Homo sapiens
ugaauguauguaauguguggu

SEQ ID NO: 524968 - RNA, 19 nt, Homo sapiens
ugaauuggaacugcaauga

SEQ ID NO: 524969 - RNA, 14 nt, Homo sapiens
ugacaaagaugcau

SEQ ID NO: 524970 - RNA, 21 nt, Homo sapiens
ugacaaccgagaagguuuauc

SEQ ID NO: 524971 - RNA, 17 nt, Homo sapiens
ugacaagccaaugugaa

SEQ ID NO: 524972 - RNA, 18 nt, Homo sapiens
ugacaagccaaugugaau

SEQ ID NO: 524973 - RNA, 18 nt, Homo sapiens
ugacaaucaacucuaaua

SEQ ID NO: 524974 - RNA, 21 nt, Homo sapiens
ugacacauagaaaacaaucaa

SEQ ID NO: 524975 - RNA, 19 nt, Homo sapiens
ugacacgccuaaggucaca

SEQ ID NO: 524976 - RNA, 17 nt, Homo sapiens
ugacacuuauagauuga

SEQ ID NO: 524977 - RNA, 15 nt, Homo sapiens
ugacagcacuacaaa

SEQ ID NO: 524978 - RNA, 17 nt, Homo sapiens
ugacagccuucuugaug

SEQ ID NO: 524979 - RNA, 17 nt, Homo sapiens
ugacagggaaaacugca

SEQ ID NO: 524980 - RNA, 21 nt, Homo sapiens
ugacccuugucccauguggcu

SEQ ID NO: 524981 - RNA, 21 nt, Homo sapiens
ugaccuggauacgcuuugguu

SEQ ID NO: 524982 - RNA, 17 nt, Homo sapiens
ugaccuuaaaugcaacc

SEQ ID NO: 524983 - RNA, 13 nt, Homo sapiens
ugacucugcauuu

SEQ ID NO: 524984 - RNA, 19 nt, Homo sapiens
ugacuuagcgucaagacau

SEQ ID NO: 524985 - RNA, 23 nt, Homo sapiens
ugagaaaaguuuaaagacacuua

SEQ ID NO: 524986 - RNA, 13 nt, Homo sapiens
ugagaacucugcc

SEQ ID NO: 524987 - RNA, 12 nt, Homo sapiens
ugagacagacua

SEQ ID NO: 524988 - RNA, 20 nt, Homo sapiens
ugagacucagugcagaugga

SEQ ID NO: 524989 - RNA, 17 nt, Homo sapiens
ugagacucuagggucca

SEQ ID NO: 524990 - RNA, 18 nt, Homo sapiens
ugagagcuguuuuugaca

SEQ ID NO: 524991 - RNA, 19 nt, Homo sapiens
ugagagggaaucgacugua

SEQ ID NO: 524992 - RNA, 12 nt, Homo sapiens
ugagaguauuua

SEQ ID NO: 524993 - RNA, 22 nt, Homo sapiens
ugagaucugugguggucuucaa

SEQ ID NO: 524994 - RNA, 18 nt, Homo sapiens
ugagauuucuuaaauaau

SEQ ID NO: 524995 - RNA, 21 nt, Homo sapiens
ugagccaagagugcacuacug

SEQ ID NO: 524996 - RNA, 18 nt, Homo sapiens
ugagccaguuagacuagu

SEQ ID NO: 524997 - RNA, 19 nt, Homo sapiens
ugagccgagaucaugccau

SEQ ID NO: 524998 - RNA, 20 nt, Homo sapiens
ugagcgucacggccaagugu

SEQ ID NO: 524999 - RNA, 12 nt, Homo sapiens
ugagcgucagca

SEQ ID NO: 525000 - RNA, 16 nt, Homo sapiens
ugaggaaaauucuuaa

SEQ ID NO: 525001 - RNA, 18 nt, Homo sapiens
ugaggaaaugauccccaa

SEQ ID NO: 525002 - RNA, 16 nt, Homo sapiens
ugaggcccauucuuca

SEQ ID NO: 525003 - RNA, 21 nt, Homo sapiens
ugaggcccauucuucacucuu

SEQ ID NO: 525004 - RNA, 13 nt, Homo sapiens
ugaggcucuucac

SEQ ID NO: 525005 - RNA, 17 nt, Homo sapiens
ugagggcagacuggggc

SEQ ID NO: 525006 - RNA, 21 nt, Homo sapiens
ugaggguguuucuuccugcac

SEQ ID NO: 525007 - RNA, 15 nt, Homo sapiens
ugagucugcaugugc

SEQ ID NO: 525008 - RNA, 16 nt, Homo sapiens
ugaguguuauuugcac

SEQ ID NO: 525009 - RNA, 22 nt, Homo sapiens
ugaguugcacuuauugaccauu

SEQ ID NO: 525010 - RNA, 18 nt, Homo sapiens
ugauaaucuucaggugaa

SEQ ID NO: 525011 - RNA, 14 nt, Homo sapiens
ugauacaacauuaa

SEQ ID NO: 525012 - RNA, 21 nt, Homo sapiens
ugauagacugcuacagguaau

SEQ ID NO: 525013 - RNA, 17 nt, Homo sapiens
ugauagcagaaugugcu

SEQ ID NO: 525014 - RNA, 21 nt, Homo sapiens
ugaucccccauagguggcuga

SEQ ID NO: 525015 - RNA, 19 nt, Homo sapiens
ugaucuuucucaaucuuga

SEQ ID NO: 525016 - RNA, 23 nt, Homo sapiens
ugaugacuuagcgucaagacauu

SEQ ID NO: 525017 - RNA, 15 nt, Homo sapiens
ugaugucagauuugg

SEQ ID NO: 525018 - RNA, 10 nt, Homo sapiens
ugauuuacag

SEQ ID NO: 525019 - RNA, 22 nt, Homo sapiens
ccuggcacucuuguucccacac

SEQ ID NO: 525020 - RNA, 17 nt, Homo sapiens
ccuggcagggcccagug

SEQ ID NO: 525021 - RNA, 14 nt, Homo sapiens
ccuggggugcaucu

SEQ ID NO: 525022 - RNA, 21 nt, Homo sapiens
ccugggguguccuacagugac

SEQ ID NO: 525023 - RNA, 20 nt, Homo sapiens
ccugggguguuaguggcacc

SEQ ID NO: 525024 - RNA, 12 nt, Homo sapiens
ccuggugcucuu

SEQ ID NO: 525025 - RNA, 22 nt, Homo sapiens
ccugguuuuagacgaggccaca

SEQ ID NO: 525026 - RNA, 15 nt, Homo sapiens
ccuguaaucccagcu

SEQ ID NO: 525027 - RNA, 17 nt, Homo sapiens
ccuguaauccuugcauu

SEQ ID NO: 525028 - RNA, 13 nt, Homo sapiens
ccuguaucucuca

SEQ ID NO: 525029 - RNA, 23 nt, Homo sapiens
ccuguaucucucacuauuaucua

SEQ ID NO: 525030 - RNA, 22 nt, Homo sapiens
ccugucauccucaugcugcuca

SEQ ID NO: 525031 - RNA, 13 nt, Homo sapiens
ccuguccuuucag

SEQ ID NO: 525032 - RNA, 16 nt, Homo sapiens
ccugucuaacugcugu

SEQ ID NO: 525033 - RNA, 16 nt, Homo sapiens
ccuguggaaaggccaa

SEQ ID NO: 525034 - RNA, 19 nt, Homo sapiens
ccuuaaccuuaaaauugau

SEQ ID NO: 525035 - RNA, 19 nt, Homo sapiens
ccuuaagggguaucaugua

SEQ ID NO: 525036 - RNA, 13 nt, Homo sapiens
ccuuaccuugaaa

SEQ ID NO: 525037 - RNA, 13 nt, Homo sapiens
ccuucaccuggau

SEQ ID NO: 525038 - RNA, 16 nt, Homo sapiens
ccuuccaugugccuuu

SEQ ID NO: 525039 - RNA, 13 nt, Homo sapiens
ccuucggcagcua

SEQ ID NO: 525040 - RNA, 12 nt, Homo sapiens
ccuucugcugaa

SEQ ID NO: 525041 - RNA, 16 nt, Homo sapiens
ccuugacuucuuugag

SEQ ID NO: 525042 - RNA, 16 nt, Homo sapiens
ccuuguccucagccag

SEQ ID NO: 525043 - RNA, 19 nt, Homo sapiens
ccuuuaggccaucucagcu

SEQ ID NO: 525044 - RNA, 24 nt, Homo sapiens
ccuuucugucccacuacaucuggg

SEQ ID NO: 525045 - RNA, 14 nt, Homo sapiens
ccuuucuuugccuc

SEQ ID NO: 525046 - RNA, 19 nt, Homo sapiens
ccuuuggauugacucugca

SEQ ID NO: 525047 - RNA, 22 nt, Homo sapiens
ccuuuggauugacucugcauuu

SEQ ID NO: 525048 - RNA, 16 nt, Homo sapiens
ccuuugggacuaagcu

SEQ ID NO: 525049 - RNA, 16 nt, Homo sapiens
cgaaccaggaaaugga

SEQ ID NO: 525050 - RNA, 14 nt, Homo sapiens
cgaaguagcuugcu

SEQ ID NO: 525051 - RNA, 19 nt, Homo sapiens
cgaccacuuccaggggaac

SEQ ID NO: 525052 - RNA, 18 nt, Homo sapiens
cgaccuggagacugacaa

SEQ ID NO: 525053 - RNA, 19 nt, Homo sapiens
cgagagcuuggacuacaca

SEQ ID NO: 525054 - RNA, 14 nt, Homo sapiens
cgaggucaggagau

SEQ ID NO: 525055 - RNA, 12 nt, Homo sapiens
cgaggugguuca

SEQ ID NO: 525056 - RNA, 19 nt, Homo sapiens
cgaguaacuccccucaggg

SEQ ID NO: 525057 - RNA, 15 nt, Homo sapiens
cgaucucuccuggcc

SEQ ID NO: 525058 - RNA, 23 nt, Homo sapiens
cgaugaggaccaagggcaccugg

SEQ ID NO: 525059 - RNA, 21 nt, Homo sapiens
cgauuuuuuuuuuuuccucuu

SEQ ID NO: 525060 - RNA, 23 nt, Homo sapiens
cgcacaccggcuuaacacuauca

SEQ ID NO: 525061 - RNA, 11 nt, Homo sapiens
cgcacagugug

SEQ ID NO: 525062 - RNA, 13 nt, Homo sapiens
cgcaucuugccuc

SEQ ID NO: 525063 - RNA, 14 nt, Homo sapiens
cgcaugaaccugga

SEQ ID NO: 525064 - RNA, 22 nt, Homo sapiens
cgccuguaaucccagcacuuug

SEQ ID NO: 525065 - RNA, 19 nt, Homo sapiens
cgccuuuuuggccugugau

SEQ ID NO: 525066 - RNA, 20 nt, Homo sapiens
cgcuaccagcagacucugga

SEQ ID NO: 525067 - RNA, 15 nt, Homo sapiens
cgcuagcauuuccca

SEQ ID NO: 525068 - RNA, 16 nt, Homo sapiens
cgcuguauaaagcaug

SEQ ID NO: 525069 - RNA, 23 nt, Homo sapiens
cgcuucuccaagucugcugauga

SEQ ID NO: 525070 - RNA, 21 nt, Homo sapiens
cggaaacuaguguacauuucu

SEQ ID NO: 525071 - RNA, 13 nt, Homo sapiens
cggaggcaccugg

SEQ ID NO: 525072 - RNA, 17 nt, Homo sapiens
cggagguccuuuggaca

SEQ ID NO: 525073 - RNA, 16 nt, Homo sapiens
cggagguugcagugag

SEQ ID NO: 525074 - RNA, 10 nt, Homo sapiens
cggaucucug

SEQ ID NO: 525075 - RNA, 14 nt, Homo sapiens
cggcacacacugug

SEQ ID NO: 525076 - RNA, 14 nt, Homo sapiens
cggcagcuacucag

SEQ ID NO: 525077 - RNA, 15 nt, Homo sapiens
cggccccucccacac

SEQ ID NO: 525078 - RNA, 19 nt, Homo sapiens
cggccccucccacacccaa

SEQ ID NO: 525079 - RNA, 14 nt, Homo sapiens
cgggaccgugggcc

SEQ ID NO: 525080 - RNA, 13 nt, Homo sapiens
cgggagcacugcg

SEQ ID NO: 525081 - RNA, 20 nt, Homo sapiens
cgggaggaggaggagcaccu

SEQ ID NO: 525082 - RNA, 17 nt, Homo sapiens
cgggauggccagagaug

SEQ ID NO: 525083 - RNA, 15 nt, Homo sapiens
cgguguauccuggcc

SEQ ID NO: 525084 - RNA, 17 nt, Homo sapiens
cguauguuuguacuugg

SEQ ID NO: 525085 - RNA, 15 nt, Homo sapiens
cgucagccaccuggg

SEQ ID NO: 525086 - RNA, 13 nt, Homo sapiens
cgucccaccagcu

SEQ ID NO: 525087 - RNA, 20 nt, Homo sapiens
cgucucuacuaaaaauacaa

SEQ ID NO: 525088 - RNA, 16 nt, Homo sapiens
cgucuguuuuugcaac

SEQ ID NO: 525089 - RNA, 18 nt, Homo sapiens
cguggcacacacugacca

SEQ ID NO: 525090 - RNA, 20 nt, Homo sapiens
cgugggggcucaugccugua

SEQ ID NO: 525091 - RNA, 21 nt, Homo sapiens
cguguguugcaccaggcacug

SEQ ID NO: 525092 - RNA, 16 nt, Homo sapiens
cuaaaauacaaaccca

SEQ ID NO: 525093 - RNA, 16 nt, Homo sapiens
cuaaacucagaggcag

SEQ ID NO: 525094 - RNA, 12 nt, Homo sapiens
cuaaagccucaa

SEQ ID NO: 525095 - RNA, 16 nt, Homo sapiens
cuaaaggagcaucuau

SEQ ID NO: 525096 - RNA, 22 nt, Homo sapiens
cuaaaggggacuagacaguuag

SEQ ID NO: 525097 - RNA, 12 nt, Homo sapiens
cuaaaguuuuag

SEQ ID NO: 525098 - RNA, 18 nt, Homo sapiens
cuaaaugccccauauuaa

SEQ ID NO: 525099 - RNA, 12 nt, Homo sapiens
cuaaauguauuc

SEQ ID NO: 525100 - RNA, 15 nt, Homo sapiens
cuaacaacauuguag

SEQ ID NO: 525101 - RNA, 22 nt, Homo sapiens
cuaacgcaggagaaucacuuga

SEQ ID NO: 525102 - RNA, 13 nt, Homo sapiens
cuaaggaaccuuc

SEQ ID NO: 525103 - RNA, 16 nt, Homo sapiens
cuaagggcccaaaggc

SEQ ID NO: 525104 - RNA, 18 nt, Homo sapiens
cuaauauuccacguuugu

SEQ ID NO: 525105 - RNA, 13 nt, Homo sapiens
cuaauguacaaua

SEQ ID NO: 525106 - RNA, 15 nt, Homo sapiens
cuaauguacaauaaa

SEQ ID NO: 525107 - RNA, 22 nt, Homo sapiens
cuacaccaaugaaaacauguac

SEQ ID NO: 525108 - RNA, 19 nt, Homo sapiens
cuacacugagcagggagac

SEQ ID NO: 525109 - RNA, 22 nt, Homo sapiens
cuacaguuuuuauuuagcaugg

SEQ ID NO: 525110 - RNA, 15 nt, Homo sapiens
cuacauaacuuccua

SEQ ID NO: 525111 - RNA, 22 nt, Homo sapiens
cuacaucaucuccaaccgguca

SEQ ID NO: 525112 - RNA, 22 nt, Homo sapiens
cuacaugucuagagaacacugu

SEQ ID NO: 525113 - RNA, 12 nt, Homo sapiens
cuaccucaaggg

SEQ ID NO: 525114 - RNA, 14 nt, Homo sapiens
cuacuaaaaacaca

SEQ ID NO: 525115 - RNA, 13 nt, Homo sapiens
cuacuaaggggcu

SEQ ID NO: 525116 - RNA, 19 nt, Homo sapiens
cuacugagggcaguucuga

SEQ ID NO: 525117 - RNA, 14 nt, Homo sapiens
cuacugcucugugu

SEQ ID NO: 525118 - RNA, 15 nt, Homo sapiens
cuacuuccaucccug

SEQ ID NO: 525119 - RNA, 21 nt, Homo sapiens
cuagaaaaauguucuuuaaag

SEQ ID NO: 525120 - RNA, 16 nt, Homo sapiens
cuagccagaggcucua

SEQ ID NO: 525121 - RNA, 17 nt, Homo sapiens
cuagccagaggcucuaa

SEQ ID NO: 525122 - RNA, 19 nt, Homo sapiens
cuaggaaacucacacuccc

SEQ ID NO: 525123 - RNA, 20 nt, Homo sapiens
cuaggaagagucuacccgac

SEQ ID NO: 525124 - RNA, 19 nt, Homo sapiens
cuagggaaugggacuguga

SEQ ID NO: 525125 - RNA, 13 nt, Homo sapiens
cuagguaucauuc

SEQ ID NO: 525126 - RNA, 22 nt, Homo sapiens
cuagguaucauucaacucucca

SEQ ID NO: 525127 - RNA, 22 nt, Homo sapiens
cuaguccccagccugcucccua

SEQ ID NO: 525128 - RNA, 18 nt, Homo sapiens
cuaguguaccuccucuca

SEQ ID NO: 525129 - RNA, 16 nt, Homo sapiens
cuaguuucuuacacac

SEQ ID NO: 525130 - RNA, 16 nt, Homo sapiens
cuaucauggcauauaa

SEQ ID NO: 525131 - RNA, 15 nt, Homo sapiens
cuaucccucuccuaa

SEQ ID NO: 525132 - RNA, 18 nt, Homo sapiens
cuaucuaucuuccaaaug

SEQ ID NO: 525133 - RNA, 14 nt, Homo sapiens
cuauguuacuauuu

SEQ ID NO: 525134 - RNA, 16 nt, Homo sapiens
cuauguuuccauuugu

SEQ ID NO: 525135 - RNA, 12 nt, Homo sapiens
cuauuaucucaa

SEQ ID NO: 525136 - RNA, 16 nt, Homo sapiens
cuauucuagagcuuuu

SEQ ID NO: 525137 - RNA, 19 nt, Homo sapiens
cuauuucugaagaggcuuc

SEQ ID NO: 525138 - RNA, 15 nt, Homo sapiens
cucaaagaucugaau

SEQ ID NO: 525139 - RNA, 17 nt, Homo sapiens
cucaaaugcugggggua

SEQ ID NO: 525140 - RNA, 23 nt, Homo sapiens
cucaaugcaauggcucaucagau

SEQ ID NO: 525141 - RNA, 22 nt, Homo sapiens
cucaaugcaguuagcugaagaa

SEQ ID NO: 525142 - RNA, 14 nt, Homo sapiens
cucacaaaaucacu

SEQ ID NO: 525143 - RNA, 12 nt, Homo sapiens
cucacccaugca

SEQ ID NO: 525144 - RNA, 16 nt, Homo sapiens
cucaccccuccaagcu

SEQ ID NO: 525145 - RNA, 20 nt, Homo sapiens
cucaccuuccaacacuccau

SEQ ID NO: 525146 - RNA, 13 nt, Homo sapiens
cucacgccuguaa

SEQ ID NO: 525147 - RNA, 15 nt, Homo sapiens
cucacucuguuuccu

SEQ ID NO: 525148 - RNA, 13 nt, Homo sapiens
cucacuguagcag

SEQ ID NO: 525149 - RNA, 20 nt, Homo sapiens
cucagaauaaggcaggcauu

SEQ ID NO: 525150 - RNA, 20 nt, Homo sapiens
cucagccuugggaccgugcc

SEQ ID NO: 525151 - RNA, 13 nt, Homo sapiens
cucagcuuaucuc

SEQ ID NO: 525152 - RNA, 17 nt, Homo sapiens
cucagcuuuauaacaaa

SEQ ID NO: 525153 - RNA, 13 nt, Homo sapiens
cucaguccuguac

SEQ ID NO: 525154 - RNA, 19 nt, Homo sapiens
cucaguccuguacucuggg

SEQ ID NO: 525155 - RNA, 10 nt, Homo sapiens
cucagugcag

SEQ ID NO: 525156 - RNA, 12 nt, Homo sapiens
cucaguucaaug

SEQ ID NO: 525157 - RNA, 17 nt, Homo sapiens
cucaguucccucuugcu

SEQ ID NO: 525158 - RNA, 18 nt, Homo sapiens
cucauaccuacaucagac

SEQ ID NO: 525159 - RNA, 18 nt, Homo sapiens
cucauagauuauuaucua

SEQ ID NO: 525160 - RNA, 10 nt, Homo sapiens
cucaugccug

SEQ ID NO: 525161 - RNA, 15 nt, Homo sapiens
cucaugccuguaauc

SEQ ID NO: 525162 - RNA, 20 nt, Homo sapiens
cucaugccuguaaucccagc

SEQ ID NO: 525163 - RNA, 14 nt, Homo sapiens
cucauuuguuguuu

SEQ ID NO: 525164 - RNA, 16 nt, Homo sapiens
cuccaaaccugaaguu

SEQ ID NO: 525165 - RNA, 13 nt, Homo sapiens
cuccacauauuuc

SEQ ID NO: 525166 - RNA, 12 nt, Homo sapiens
cuccaggcuuuc

SEQ ID NO: 525167 - RNA, 18 nt, Homo sapiens
cuccaggcuuucaauguu

SEQ ID NO: 525168 - RNA, 20 nt, Homo sapiens
cuccauaaacagacuguuaa

SEQ ID NO: 525169 - RNA, 19 nt, Homo sapiens
cuccauaugucucaucugu

SEQ ID NO: 525170 - RNA, 15 nt, Homo sapiens
cucccaaaguaccuu

SEQ ID NO: 525171 - RNA, 12 nt, Homo sapiens
cucccacuuugc

SEQ ID NO: 525172 - RNA, 21 nt, Homo sapiens
cucccauccuugaugcaagug

SEQ ID NO: 525173 - RNA, 21 nt, Homo sapiens
cuccccaugggcacaguggug

SEQ ID NO: 525174 - RNA, 20 nt, Homo sapiens
cuccccuagggggagaagaa

SEQ ID NO: 525175 - RNA, 14 nt, Homo sapiens
cucccuuugaugau

SEQ ID NO: 525176 - RNA, 21 nt, Homo sapiens
cuccgaccacuuccaggggaa

SEQ ID NO: 525177 - RNA, 21 nt, Homo sapiens
cuccguagcucugcugcugau

SEQ ID NO: 525178 - RNA, 18 nt, Homo sapiens
cuccuagaagaaccaaau

SEQ ID NO: 525179 - RNA, 19 nt, Homo sapiens
cuccucucccauccuugau

SEQ ID NO: 525180 - RNA, 16 nt, Homo sapiens
cuccuugcaggugaca

SEQ ID NO: 525181 - RNA, 23 nt, Homo sapiens
cucgagcuguuuacagugaugcc

SEQ ID NO: 525182 - RNA, 19 nt, Homo sapiens
cucgccucauuacugugag

SEQ ID NO: 525183 - RNA, 13 nt, Homo sapiens
cucgugugccugg

SEQ ID NO: 525184 - RNA, 15 nt, Homo sapiens
cucuaauguacaaua

SEQ ID NO: 525185 - RNA, 16 nt, Homo sapiens
cucuaauguacaauaa

SEQ ID NO: 525186 - RNA, 14 nt, Homo sapiens
cucucaaacuucac

SEQ ID NO: 525187 - RNA, 16 nt, Homo sapiens
cucucacuauuaucua

SEQ ID NO: 525188 - RNA, 20 nt, Homo sapiens
cucuccacauggaagcccaa

SEQ ID NO: 525189 - RNA, 18 nt, Homo sapiens
cucucccugggucugggg

SEQ ID NO: 525190 - RNA, 13 nt, Homo sapiens
cucuccucucuga

SEQ ID NO: 525191 - RNA, 15 nt, Homo sapiens
cucucuacagugcca

SEQ ID NO: 525192 - RNA, 13 nt, Homo sapiens
cucugaacuggau

SEQ ID NO: 525193 - RNA, 18 nt, Homo sapiens
cucugaagguccaaagag

SEQ ID NO: 525194 - RNA, 18 nt, Homo sapiens
cucugcagacugcugcua

SEQ ID NO: 525195 - RNA, 21 nt, Homo sapiens
cucuggucgccgcacuucuga

SEQ ID NO: 525196 - RNA, 10 nt, Homo sapiens
cucuucacau

SEQ ID NO: 525197 - RNA, 13 nt, Homo sapiens
cucuucuacccuu

SEQ ID NO: 525198 - RNA, 19 nt, Homo sapiens
cucuucuuggggcccagug

SEQ ID NO: 525199 - RNA, 12 nt, Homo sapiens
cucuugaugcca

SEQ ID NO: 525200 - RNA, 21 nt, Homo sapiens
cucuuguccucuucugcucuu

SEQ ID NO: 525201 - RNA, 17 nt, Homo sapiens
cucuuguggugcauuga

SEQ ID NO: 525202 - RNA, 18 nt, Homo sapiens
cucuuguucccacacccc

SEQ ID NO: 525203 - RNA, 12 nt, Homo sapiens
cucuuuagccag

SEQ ID NO: 525204 - RNA, 17 nt, Homo sapiens
cucuuugcugcacuauu

SEQ ID NO: 525205 - RNA, 13 nt, Homo sapiens
cugaaaaauaucu

SEQ ID NO: 525206 - RNA, 17 nt, Homo sapiens
cugaaagugguacuuga

SEQ ID NO: 525207 - RNA, 15 nt, Homo sapiens
cugaaauuacuuuaa

SEQ ID NO: 525208 - RNA, 19 nt, Homo sapiens
cugaaccauuccaacuuca

SEQ ID NO: 525209 - RNA, 21 nt, Homo sapiens
cugaagaaacuucccaagugu

SEQ ID NO: 525210 - RNA, 20 nt, Homo sapiens
cugaagugugcugugacaag

SEQ ID NO: 525211 - RNA, 20 nt, Homo sapiens
cugaauaaauaauucuuccu

SEQ ID NO: 525212 - RNA, 21 nt, Homo sapiens
cugaauucuuuccccaaagac

SEQ ID NO: 525213 - RNA, 14 nt, Homo sapiens
cugacaacugugaa

SEQ ID NO: 525214 - RNA, 18 nt, Homo sapiens
cugacacauagaaaacaa

SEQ ID NO: 525215 - RNA, 19 nt, Homo sapiens
cugaccucaggugauccgc

SEQ ID NO: 525216 - RNA, 15 nt, Homo sapiens
cugaccuuaaaugca

SEQ ID NO: 525217 - RNA, 17 nt, Homo sapiens
cugaccuuaaaugcaac

SEQ ID NO: 525218 - RNA, 15 nt, Homo sapiens
cugacgcagcacaag

SEQ ID NO: 525219 - RNA, 13 nt, Homo sapiens
cugacucuugcag

SEQ ID NO: 525220 - RNA, 15 nt, Homo sapiens
cugacugaaugcaga

SEQ ID NO: 525221 - RNA, 15 nt, Homo sapiens
cugacuucagggaag

SEQ ID NO: 525222 - RNA, 13 nt, Homo sapiens
cugagaccaaaga

SEQ ID NO: 525223 - RNA, 16 nt, Homo sapiens
cugagagaccugaguc

SEQ ID NO: 525224 - RNA, 18 nt, Homo sapiens
cugagcccauaggucuca

SEQ ID NO: 525225 - RNA, 21 nt, Homo sapiens
cugaggcggagaauugcuuga

SEQ ID NO: 525226 - RNA, 23 nt, Homo sapiens
cugaguguuauuugcacacugca

SEQ ID NO: 525227 - RNA, 16 nt, Homo sapiens
cugauccauccaucuc

SEQ ID NO: 525228 - RNA, 22 nt, Homo sapiens
cugaucccccauagguggcuga

SEQ ID NO: 525229 - RNA, 23 nt, Homo sapiens
cugaucguagaaaauuugcuuua

SEQ ID NO: 525230 - RNA, 21 nt, Homo sapiens
cugaugagaguggccccggcu

SEQ ID NO: 525231 - RNA, 15 nt, Homo sapiens
cugaugggcaaaaaa

SEQ ID NO: 525232 - RNA, 18 nt, Homo sapiens
cugauguguccucaggga

SEQ ID NO: 525233 - RNA, 21 nt, Homo sapiens
cugauucuggcuuuaagccuu

SEQ ID NO: 525234 - RNA, 20 nt, Homo sapiens
cugauucuuaugauuacuau

SEQ ID NO: 525235 - RNA, 22 nt, Homo sapiens
cugauuucuuaggggaaggaga

SEQ ID NO: 525236 - RNA, 14 nt, Homo sapiens
cugcaaaaugaagg

SEQ ID NO: 525237 - RNA, 19 nt, Homo sapiens
cugcaaaguguaugugacc

SEQ ID NO: 525238 - RNA, 17 nt, Homo sapiens
cugcaaguucauuuuaa

SEQ ID NO: 525239 - RNA, 14 nt, Homo sapiens
cugcacaaacaaua

SEQ ID NO: 525240 - RNA, 17 nt, Homo sapiens
cugcacaaacaauaugu

SEQ ID NO: 525241 - RNA, 23 nt, Homo sapiens
cugcacuguccugaccaucgcac

SEQ ID NO: 525242 - RNA, 16 nt, Homo sapiens
cugcagagauuucuca

SEQ ID NO: 525243 - RNA, 14 nt, Homo sapiens
cugcagucccacac

SEQ ID NO: 525244 - RNA, 20 nt, Homo sapiens
cugcagucccacacugugca

SEQ ID NO: 525245 - RNA, 15 nt, Homo sapiens
cugcaugugcuguca

SEQ ID NO: 525246 - RNA, 15 nt, Homo sapiens
cugccaucaugccug

SEQ ID NO: 525247 - RNA, 17 nt, Homo sapiens
cugccaucuagccagcc

SEQ ID NO: 525248 - RNA, 18 nt, Homo sapiens
cugccauguuucaaagac

SEQ ID NO: 525249 - RNA, 15 nt, Homo sapiens
cugccgcuaccuccc

SEQ ID NO: 525250 - RNA, 19 nt, Homo sapiens
cugccuuugcaccacggga

SEQ ID NO: 525251 - RNA, 18 nt, Homo sapiens
cugcggaccccucgucau

SEQ ID NO: 525252 - RNA, 15 nt, Homo sapiens
cugcguuuuccuagc

SEQ ID NO: 525253 - RNA, 14 nt, Homo sapiens
cugcucccuagcca

SEQ ID NO: 525254 - RNA, 15 nt, Homo sapiens
cugcucccuagccag

SEQ ID NO: 525255 - RNA, 13 nt, Homo sapiens
cugcugaaacugc

SEQ ID NO: 525256 - RNA, 21 nt, Homo sapiens
cugcugccucuuucccuagga

SEQ ID NO: 525257 - RNA, 12 nt, Homo sapiens
cugcugcuggug

SEQ ID NO: 525258 - RNA, 13 nt, Homo sapiens
cugcuucccuuac

SEQ ID NO: 525259 - RNA, 15 nt, Homo sapiens
cuggaagucaucuca

SEQ ID NO: 525260 - RNA, 23 nt, Homo sapiens
cuggacaaaggaguaguagcuga

SEQ ID NO: 525261 - RNA, 22 nt, Homo sapiens
cuggacaaaugaugccauggca

SEQ ID NO: 525262 - RNA, 23 nt, Homo sapiens
cuggaggcggcaaagggugaaau

SEQ ID NO: 525263 - RNA, 12 nt, Homo sapiens
cuggaguggugu

SEQ ID NO: 525264 - RNA, 20 nt, Homo sapiens
cuggcaagucuuccaugacc

SEQ ID NO: 525265 - RNA, 17 nt, Homo sapiens
cuggcaccgcaguuuug

SEQ ID NO: 525266 - RNA, 16 nt, Homo sapiens
cuggcccuuggggaga

SEQ ID NO: 525267 - RNA, 16 nt, Homo sapiens
cugggaacacaucugg

SEQ ID NO: 525268 - RNA, 18 nt, Homo sapiens
cugggaacacaucuggcu

SEQ ID NO: 525269 - RNA, 11 nt, Homo sapiens
cugggccagug

SEQ ID NO: 525270 - RNA, 12 nt, Homo sapiens
cugggccagugc

SEQ ID NO: 525271 - RNA, 18 nt, Homo sapiens
cugggccauguccaaaga

SEQ ID NO: 525272 - RNA, 18 nt, Homo sapiens
cugggcgucuaugcugcu

SEQ ID NO: 525273 - RNA, 19 nt, Homo sapiens
cuggggccuagcgaucucu

SEQ ID NO: 525274 - RNA, 17 nt, Homo sapiens
cuggggggacccagugc

SEQ ID NO: 525275 - RNA, 18 nt, Homo sapiens
cuggggugcugccugaau

SEQ ID NO: 525276 - RNA, 20 nt, Homo sapiens
cugggucuaccacucagaga

SEQ ID NO: 525277 - RNA, 12 nt, Homo sapiens
cuggguggugga

SEQ ID NO: 525278 - RNA, 22 nt, Homo sapiens
cuggguguguucuuacugacac

SEQ ID NO: 525279 - RNA, 20 nt, Homo sapiens
cugguacuauugugaccaca

SEQ ID NO: 525280 - RNA, 20 nt, Homo sapiens
cugguagggauauggcagga

SEQ ID NO: 525281 - RNA, 21 nt, Homo sapiens
cuggucaacauagugagacac

SEQ ID NO: 525282 - RNA, 16 nt, Homo sapiens
cuggugagaaaauaua

SEQ ID NO: 525283 - RNA, 11 nt, Homo sapiens
cuggugcacag

SEQ ID NO: 525284 - RNA, 22 nt, Homo sapiens
cuguaaucccagcuacuccggg

SEQ ID NO: 525285 - RNA, 23 nt, Homo sapiens
cuguaaucccagcuacuccggga

SEQ ID NO: 525286 - RNA, 12 nt, Homo sapiens
cuguacuguuac

SEQ ID NO: 525287 - RNA, 18 nt, Homo sapiens
cuguagcucaaguuuaaa

SEQ ID NO: 525288 - RNA, 15 nt, Homo sapiens
cuguaggaagucauc

SEQ ID NO: 525289 - RNA, 21 nt, Homo sapiens
cuguagucccagcuacuuggg

SEQ ID NO: 525290 - RNA, 18 nt, Homo sapiens
cugucaaaauauuucuca

SEQ ID NO: 525291 - RNA, 16 nt, Homo sapiens
cugucauaacauccag

SEQ ID NO: 525292 - RNA, 15 nt, Homo sapiens
cugucauuacgucaa

SEQ ID NO: 525293 - RNA, 14 nt, Homo sapiens
cugucauugcacau

SEQ ID NO: 525294 - RNA, 23 nt, Homo sapiens
cuguccaaauuuaaaaugugugc

SEQ ID NO: 525295 - RNA, 17 nt, Homo sapiens
cuguccugaccaucgca

SEQ ID NO: 525296 - RNA, 15 nt, Homo sapiens
cugucuaacugcugu

SEQ ID NO: 525297 - RNA, 18 nt, Homo sapiens
cugucuccuguauguggg

SEQ ID NO: 525298 - RNA, 15 nt, Homo sapiens
cugucugggggccag

SEQ ID NO: 525299 - RNA, 15 nt, Homo sapiens
cugugcaaagggaac

SEQ ID NO: 525300 - RNA, 23 nt, Homo sapiens
cugugcccagcacagugccugac

SEQ ID NO: 525301 - RNA, 14 nt, Homo sapiens
cugugcugggggaa

SEQ ID NO: 525302 - RNA, 17 nt, Homo sapiens
cuguggcuagugacaaa

SEQ ID NO: 525303 - RNA, 22 nt, Homo sapiens
cugugucauucuguuagauacu

SEQ ID NO: 525304 - RNA, 18 nt, Homo sapiens
cuguguccuacuccuugc

SEQ ID NO: 525305 - RNA, 15 nt, Homo sapiens
cugugugcgugcgca

SEQ ID NO: 525306 - RNA, 13 nt, Homo sapiens
cuguguucaauua

SEQ ID NO: 525307 - RNA, 18 nt, Homo sapiens
cuguuacacuuuuuggaa

SEQ ID NO: 525308 - RNA, 12 nt, Homo sapiens
cuguuagcacau

SEQ ID NO: 525309 - RNA, 21 nt, Homo sapiens
cuguuaguaaauuucugugau

SEQ ID NO: 525310 - RNA, 23 nt, Homo sapiens
cuguucuguuggaugacuuugag

SEQ ID NO: 525311 - RNA, 12 nt, Homo sapiens
cuguuggaugau

SEQ ID NO: 525312 - RNA, 19 nt, Homo sapiens
cuguuuggccaaugugcau

SEQ ID NO: 525313 - RNA, 14 nt, Homo sapiens
cuguuuuuucucca

SEQ ID NO: 525314 - RNA, 22 nt, Homo sapiens
cuuaaaauugugagcgaauuag

SEQ ID NO: 525315 - RNA, 22 nt, Homo sapiens
cuuaaacgaagaguucccuuga

SEQ ID NO: 525316 - RNA, 18 nt, Homo sapiens
cuuaaauguuuauacugu

SEQ ID NO: 525317 - RNA, 20 nt, Homo sapiens
cuuaagggguaucauguaug

SEQ ID NO: 525318 - RNA, 18 nt, Homo sapiens
cuuaaugcuacaugugag

SEQ ID NO: 525319 - RNA, 18 nt, Homo sapiens
cuuacacacugucuguau

SEQ ID NO: 525320 - RNA, 12 nt, Homo sapiens
cuuacacauaau

SEQ ID NO: 525321 - RNA, 18 nt, Homo sapiens
cuuagaaaacaaguauug

SEQ ID NO: 525322 - RNA, 22 nt, Homo sapiens
cuuagagaggacaauacugggg

SEQ ID NO: 525323 - RNA, 18 nt, Homo sapiens
cuuagaugggcauggugg

SEQ ID NO: 525324 - RNA, 20 nt, Homo sapiens
cuuaguguuguggacacugc

SEQ ID NO: 525325 - RNA, 23 nt, Homo sapiens
cuuauaguguuuggacagcugau

SEQ ID NO: 525326 - RNA, 13 nt, Homo sapiens
cuuauaugugaca

SEQ ID NO: 525327 - RNA, 15 nt, Homo sapiens
cuuauaugugacacu

SEQ ID NO: 525328 - RNA, 19 nt, Homo sapiens
cuuauuguuucucugaaag

SEQ ID NO: 525329 - RNA, 21 nt, Homo sapiens
cuuauuuugucuuauucuuaa

SEQ ID NO: 525330 - RNA, 18 nt, Homo sapiens
cuucaaagcaagcuggua

SEQ ID NO: 525331 - RNA, 21 nt, Homo sapiens
cuucaagucccaucauagaaa

SEQ ID NO: 525332 - RNA, 12 nt, Homo sapiens
cuucacucucca

SEQ ID NO: 525333 - RNA, 18 nt, Homo sapiens
cuucacuguggucauccu

SEQ ID NO: 525334 - RNA, 16 nt, Homo sapiens
cuucaguaacaagugu

SEQ ID NO: 525335 - RNA, 15 nt, Homo sapiens
cuucagugugguaca

SEQ ID NO: 525336 - RNA, 19 nt, Homo sapiens
cuucauauagcauugauaa

SEQ ID NO: 525337 - RNA, 19 nt, Homo sapiens
cuucaugcuugacauaccu

SEQ ID NO: 525338 - RNA, 15 nt, Homo sapiens
cuuccagugcucaga

SEQ ID NO: 525339 - RNA, 15 nt, Homo sapiens
cuuccaugugccuuu

SEQ ID NO: 525340 - RNA, 16 nt, Homo sapiens
cuuccaugugccuuuc

SEQ ID NO: 525341 - RNA, 17 nt, Homo sapiens
cuucccagcaauuauua

SEQ ID NO: 525342 - RNA, 14 nt, Homo sapiens
cuucccaguauuau

SEQ ID NO: 525343 - RNA, 17 nt, Homo sapiens
cuuccuuuaggaucuca

SEQ ID NO: 525344 - RNA, 18 nt, Homo sapiens
cuuccuuuaggaucucag

SEQ ID NO: 525345 - RNA, 17 nt, Homo sapiens
cuucgggaaaauauuca

SEQ ID NO: 525346 - RNA, 23 nt, Homo sapiens
cuucucauguuaaauauuugucc

SEQ ID NO: 525347 - RNA, 23 nt, Homo sapiens
cuucuggggcaggcugggccaug

SEQ ID NO: 525348 - RNA, 14 nt, Homo sapiens
cuucuguugaucuc

SEQ ID NO: 525349 - RNA, 12 nt, Homo sapiens
cuucuuacugau

SEQ ID NO: 525350 - RNA, 15 nt, Homo sapiens
cuucuuugugccuuu

SEQ ID NO: 525351 - RNA, 21 nt, Homo sapiens
cuugaaaagcuaguguaccuc

SEQ ID NO: 525352 - RNA, 23 nt, Homo sapiens
cuugaaaagcuaguguaccuccu

SEQ ID NO: 525353 - RNA, 14 nt, Homo sapiens
cuugaagggcuuua

SEQ ID NO: 525354 - RNA, 16 nt, Homo sapiens
cuugaaguauguguuu

SEQ ID NO: 525355 - RNA, 15 nt, Homo sapiens
cuugaccuguuucuc

SEQ ID NO: 525356 - RNA, 13 nt, Homo sapiens
cuugagccaguaa

SEQ ID NO: 525357 - RNA, 14 nt, Homo sapiens
cuugaguucccaga

SEQ ID NO: 525358 - RNA, 19 nt, Homo sapiens
cuugcaagauaauuuucag

SEQ ID NO: 525359 - RNA, 20 nt, Homo sapiens
cuugcauuugugguaaucua

SEQ ID NO: 525360 - RNA, 21 nt, Homo sapiens
cuugcauuugugguaaucuac

SEQ ID NO: 525361 - RNA, 13 nt, Homo sapiens
cuugccauaaaac

SEQ ID NO: 525362 - RNA, 15 nt, Homo sapiens
cuugcccaaguccca

SEQ ID NO: 525363 - RNA, 21 nt, Homo sapiens
cuugcuuugcagccccacaga

SEQ ID NO: 525364 - RNA, 15 nt, Homo sapiens
cuuuaaaaucuguuc

SEQ ID NO: 525365 - RNA, 16 nt, Homo sapiens
cuuuaaaggcaucuac

SEQ ID NO: 525366 - RNA, 20 nt, Homo sapiens
cuuuaaugauaugcuuguaa

SEQ ID NO: 525367 - RNA, 14 nt, Homo sapiens
cuuuacugccugaa

SEQ ID NO: 525368 - RNA, 14 nt, Homo sapiens
cuuuauuaaguaaa

SEQ ID NO: 525369 - RNA, 13 nt, Homo sapiens
cuuucaaaagccu

SEQ ID NO: 525370 - RNA, 14 nt, Homo sapiens
cuuucaaaagccuu

SEQ ID NO: 525371 - RNA, 10 nt, Homo sapiens
cuuucaggaa

SEQ ID NO: 525372 - RNA, 13 nt, Homo sapiens
cuuucauaccuug

SEQ ID NO: 525373 - RNA, 22 nt, Homo sapiens
cuuucauuucguauuucucaua

SEQ ID NO: 525374 - RNA, 21 nt, Homo sapiens
cuuuccugguuuucaucagga

SEQ ID NO: 525375 - RNA, 16 nt, Homo sapiens
cuuucuacaggccagc

SEQ ID NO: 525376 - RNA, 17 nt, Homo sapiens
cuuugaaccugugcaau

SEQ ID NO: 525377 - RNA, 15 nt, Homo sapiens
cuuugagauuauucu

SEQ ID NO: 525378 - RNA, 14 nt, Homo sapiens
cuuugcagcacagc

SEQ ID NO: 525379 - RNA, 21 nt, Homo sapiens
cuuugguuucucaacuucucu

SEQ ID NO: 525380 - RNA, 20 nt, Homo sapiens
cuuuguaauaucuaaaaacu

SEQ ID NO: 525381 - RNA, 15 nt, Homo sapiens
cuuugugguagcuua

SEQ ID NO: 525382 - RNA, 19 nt, Homo sapiens
cuuuuaauaaacugcaagu

SEQ ID NO: 525383 - RNA, 14 nt, Homo sapiens
cuuuuauucuccag

SEQ ID NO: 525384 - RNA, 17 nt, Homo sapiens
cuuuucauccuagucua

SEQ ID NO: 525385 - RNA, 18 nt, Homo sapiens
cuuuucccauugccaugc

SEQ ID NO: 525386 - RNA, 22 nt, Homo sapiens
cuuuuccugaauuggaaaggaa

SEQ ID NO: 525387 - RNA, 21 nt, Homo sapiens
cuuuucuggcaaaaaggagcc

SEQ ID NO: 525388 - RNA, 21 nt, Homo sapiens
cuuuugguuaugaauacuuug

SEQ ID NO: 525389 - RNA, 13 nt, Homo sapiens
cuuuuuccacaag

SEQ ID NO: 525390 - RNA, 18 nt, Homo sapiens
cuuuuuccuccuggaaca

SEQ ID NO: 525391 - RNA, 18 nt, Homo sapiens
gaaaaauauuccaagcuu

SEQ ID NO: 525392 - RNA, 14 nt, Homo sapiens
gaaaacauguuaau

SEQ ID NO: 525393 - RNA, 21 nt, Homo sapiens
gaaaagaggcccaagugcaaa

SEQ ID NO: 525394 - RNA, 22 nt, Homo sapiens
gaaaagcuaguguaccuccucu

SEQ ID NO: 525395 - RNA, 21 nt, Homo sapiens
gaaaagcugaauccagaucau

SEQ ID NO: 525396 - RNA, 15 nt, Homo sapiens
gaaaaggcugguaca

SEQ ID NO: 525397 - RNA, 20 nt, Homo sapiens
gaaaagugcauauuuaucca

SEQ ID NO: 525398 - RNA, 19 nt, Homo sapiens
gaaaaguguccuucuugcu

SEQ ID NO: 525399 - RNA, 21 nt, Homo sapiens
gaaaaguuuaaagacacuuag

SEQ ID NO: 525400 - RNA, 16 nt, Homo sapiens
gaaaauauggguugca

SEQ ID NO: 525401 - RNA, 18 nt, Homo sapiens
gaaacacccacucacuuu

SEQ ID NO: 525402 - RNA, 17 nt, Homo sapiens
gaaacaugucuugacug

SEQ ID NO: 525403 - RNA, 16 nt, Homo sapiens
gaaacccugagagucu

SEQ ID NO: 525404 - RNA, 14 nt, Homo sapiens
gaaacucacacucc

SEQ ID NO: 525405 - RNA, 19 nt, Homo sapiens
gaaagcauaucccaccaac

SEQ ID NO: 525406 - RNA, 11 nt, Homo sapiens
gaaagcuuugu

SEQ ID NO: 525407 - RNA, 21 nt, Homo sapiens
gaaaggaaauaguaccuucaa

SEQ ID NO: 525408 - RNA, 19 nt, Homo sapiens
gaaaguucuugguggugga

SEQ ID NO: 525409 - RNA, 13 nt, Homo sapiens
gaaauaaaacuac

SEQ ID NO: 525410 - RNA, 18 nt, Homo sapiens
gaaauacaguacuguuuc

SEQ ID NO: 525411 - RNA, 16 nt, Homo sapiens
gaaauaguaccuucaa

SEQ ID NO: 525412 - RNA, 17 nt, Homo sapiens
gaaauaugccacugacc

SEQ ID NO: 525413 - RNA, 23 nt, Homo sapiens
gaaaugauccccaaguggugaau

SEQ ID NO: 525414 - RNA, 17 nt, Homo sapiens
gaaaugcuguuaguaaa

SEQ ID NO: 525415 - RNA, 12 nt, Homo sapiens
gaaauuacuuua

SEQ ID NO: 525416 - RNA, 15 nt, Homo sapiens
gaacagcacugggga

SEQ ID NO: 525417 - RNA, 16 nt, Homo sapiens
gaacauagaacucugg

SEQ ID NO: 525418 - RNA, 17 nt, Homo sapiens
gaacaugauaguuaaac

SEQ ID NO: 525419 - RNA, 23 nt, Homo sapiens
gaaccagauguuagaucagggga

SEQ ID NO: 525420 - RNA, 16 nt, Homo sapiens
gaaccaggaaauggaa

SEQ ID NO: 525421 - RNA, 12 nt, Homo sapiens
gaaccaggggag

SEQ ID NO: 525422 - RNA, 24 nt, Homo sapiens
gaaccuaacaugcuggugaauauu

SEQ ID NO: 525423 - RNA, 16 nt, Homo sapiens
gaaccuggaacuugga

SEQ ID NO: 525424 - RNA, 22 nt, Homo sapiens
gaaccuguccuaaggaaccuuc

SEQ ID NO: 525425 - RNA, 12 nt, Homo sapiens
gaacucaguccu

SEQ ID NO: 525426 - RNA, 11 nt, Homo sapiens
gaacuugcaau

SEQ ID NO: 525427 - RNA, 22 nt, Homo sapiens
gaagacacacucagcaaccaca

SEQ ID NO: 525428 - RNA, 15 nt, Homo sapiens
gaagacuucuaugga

SEQ ID NO: 525429 - RNA, 20 nt, Homo sapiens
gaagagggagaagcaugaaa

SEQ ID NO: 525430 - RNA, 23 nt, Homo sapiens
gaagaugacgaguaacuccccuc

SEQ ID NO: 525431 - RNA, 12 nt, Homo sapiens
gaagcacuacac

SEQ ID NO: 525432 - RNA, 18 nt, Homo sapiens
gaagcaucauuuccccaa

SEQ ID NO: 525433 - RNA, 16 nt, Homo sapiens
gaagccacuuucuaca

SEQ ID NO: 525434 - RNA, 20 nt, Homo sapiens
gaagcugcuguucuuagcaa

SEQ ID NO: 525435 - RNA, 16 nt, Homo sapiens
gaaggagccagugaac

SEQ ID NO: 525436 - RNA, 14 nt, Homo sapiens
gaaggaggugcaga

SEQ ID NO: 525437 - RNA, 22 nt, Homo sapiens
gaaggccagcccacacccagcu

SEQ ID NO: 525438 - RNA, 14 nt, Homo sapiens
gaaggccagcugaa

SEQ ID NO: 525439 - RNA, 17 nt, Homo sapiens
gaaggugcccaaccuaa

SEQ ID NO: 525440 - RNA, 16 nt, Homo sapiens
gaaguacuccuauugc

SEQ ID NO: 525441 - RNA, 20 nt, Homo sapiens
gaagucaccccuuucugucc

SEQ ID NO: 525442 - RNA, 21 nt, Homo sapiens
gaagucaucucauuccacugu

SEQ ID NO: 525443 - RNA, 18 nt, Homo sapiens
gaagucuaaaagcagaaa

SEQ ID NO: 525444 - RNA, 12 nt, Homo sapiens
gaagugcucuaa

SEQ ID NO: 525445 - RNA, 17 nt, Homo sapiens
gaagugugcugugacaa

SEQ ID NO: 525446 - RNA, 20 nt, Homo sapiens
gaauacccaggaagacuuug

SEQ ID NO: 525447 - RNA, 13 nt, Homo sapiens
gaauagcuuuaau

SEQ ID NO: 525448 - RNA, 18 nt, Homo sapiens
gaauccagaucauuccuc

SEQ ID NO: 525449 - RNA, 16 nt, Homo sapiens
gaauccccaacaugca

SEQ ID NO: 525450 - RNA, 19 nt, Homo sapiens
gaaucccuggcaaagggag

SEQ ID NO: 525451 - RNA, 17 nt, Homo sapiens
gaauccuccuccagggu

SEQ ID NO: 525452 - RNA, 19 nt, Homo sapiens
gaaugacugacaaagacau

SEQ ID NO: 525453 - RNA, 16 nt, Homo sapiens
gaaugccuccuguggg

SEQ ID NO: 525454 - RNA, 15 nt, Homo sapiens
gaauguaacugcuga

SEQ ID NO: 525455 - RNA, 15 nt, Homo sapiens
gaauguggucucagg

SEQ ID NO: 525456 - RNA, 22 nt, Homo sapiens
gaauuugaaaaaugcauaauaa

SEQ ID NO: 525457 - RNA, 13 nt, Homo sapiens
gacaaggcccuga

SEQ ID NO: 525458 - RNA, 15 nt, Homo sapiens
gacaaguauggcucc

SEQ ID NO: 525459 - RNA, 23 nt, Homo sapiens
gacacacggggcucgggccuuua

SEQ ID NO: 525460 - RNA, 15 nt, Homo sapiens
gacacugcagacuug

SEQ ID NO: 525461 - RNA, 16 nt, Homo sapiens
gacagagguugcagug

SEQ ID NO: 525462 - RNA, 21 nt, Homo sapiens
gacagcacugggaaccuagcu

SEQ ID NO: 525463 - RNA, 11 nt, Homo sapiens
gacagggccag

SEQ ID NO: 525464 - RNA, 14 nt, Homo sapiens
gacauacauuucuc

SEQ ID NO: 525465 - RNA, 21 nt, Homo sapiens
gacauuacaauguguaaugga

SEQ ID NO: 525466 - RNA, 23 nt, Homo sapiens
gacauuuggugggcuuuggagcu

SEQ ID NO: 525467 - RNA, 19 nt, Homo sapiens
gaccaccccucucgccuca

SEQ ID NO: 525468 - RNA, 14 nt, Homo sapiens
gaccacggacucca

SEQ ID NO: 525469 - RNA, 17 nt, Homo sapiens
gaccacuuccaggggaa

SEQ ID NO: 525470 - RNA, 23 nt, Homo sapiens
gaccacuuccaggggaaccugcc

SEQ ID NO: 525471 - RNA, 16 nt, Homo sapiens
gacccaggucauggaa

SEQ ID NO: 525472 - RNA, 21 nt, Homo sapiens
gacccuguccugcagucccac

SEQ ID NO: 525473 - RNA, 18 nt, Homo sapiens
gaccuauuagaguauuuu

SEQ ID NO: 525474 - RNA, 15 nt, Homo sapiens
gaccugccugcauuc

SEQ ID NO: 525475 - RNA, 16 nt, Homo sapiens
gaccuggagacugaca

SEQ ID NO: 525476 - RNA, 16 nt, Homo sapiens
gaccuuuggagaccau

SEQ ID NO: 525477 - RNA, 12 nt, Homo sapiens
gacgacaguacu

SEQ ID NO: 525478 - RNA, 20 nt, Homo sapiens
gacuacccauagacaugaaa

SEQ ID NO: 525479 - RNA, 17 nt, Homo sapiens
gacucaggccagugugu

SEQ ID NO: 525480 - RNA, 14 nt, Homo sapiens
gacuccaucucuca

SEQ ID NO: 525481 - RNA, 21 nt, Homo sapiens
gacucugucucaaaacaaaca

SEQ ID NO: 525482 - RNA, 16 nt, Homo sapiens
gacucuucgaugugcc

SEQ ID NO: 525483 - RNA, 21 nt, Homo sapiens
gacugaaguucgcauugaacu

SEQ ID NO: 525484 - RNA, 14 nt, Homo sapiens
gacugacaaccuca

SEQ ID NO: 525485 - RNA, 16 nt, Homo sapiens
gacugcuaccuuucaa

SEQ ID NO: 525486 - RNA, 20 nt, Homo sapiens
gacugcugauuuucuggaau

SEQ ID NO: 525487 - RNA, 18 nt, Homo sapiens
gacugcugcuagagccag

SEQ ID NO: 525488 - RNA, 18 nt, Homo sapiens
gacuggccacacaggauc

SEQ ID NO: 525489 - RNA, 15 nt, Homo sapiens
gacuuccagugcuca

SEQ ID NO: 525490 - RNA, 12 nt, Homo sapiens
gagaacacugug

SEQ ID NO: 525491 - RNA, 17 nt, Homo sapiens
gagaagauuuaugucag

SEQ ID NO: 525492 - RNA, 18 nt, Homo sapiens
gagaaggaaaagacugaa

SEQ ID NO: 525493 - RNA, 17 nt, Homo sapiens
gagaaucccuggcaaag

SEQ ID NO: 525494 - RNA, 13 nt, Homo sapiens
gagaccugagucu

SEQ ID NO: 525495 - RNA, 15 nt, Homo sapiens
gagacucagugcaga

SEQ ID NO: 525496 - RNA, 12 nt, Homo sapiens
gagacucuaggg

SEQ ID NO: 525497 - RNA, 13 nt, Homo sapiens
gagacucuagggu

SEQ ID NO: 525498 - RNA, 22 nt, Homo sapiens
gagacugacaaccucauccagg

SEQ ID NO: 525499 - RNA, 18 nt, Homo sapiens
gagauccggcagcacaag

SEQ ID NO: 525500 - RNA, 21 nt, Homo sapiens
gagaugguguguucugcaaua

SEQ ID NO: 525501 - RNA, 13 nt, Homo sapiens
gagcaacugcugu

SEQ ID NO: 525502 - RNA, 13 nt, Homo sapiens
gagcagccugaac

SEQ ID NO: 525503 - RNA, 17 nt, Homo sapiens
gagccgagaucaugcca

SEQ ID NO: 525504 - RNA, 13 nt, Homo sapiens
gagccuccagucc

SEQ ID NO: 525505 - RNA, 19 nt, Homo sapiens
gagccuccugggaacacau

SEQ ID NO: 525506 - RNA, 14 nt, Homo sapiens
gagccugcagggaa

SEQ ID NO: 525507 - RNA, 20 nt, Homo sapiens
gagccugguucagacacagc

SEQ ID NO: 525508 - RNA, 23 nt, Homo sapiens
gagcuaugugacucggauggucu

SEQ ID NO: 525509 - RNA, 18 nt, Homo sapiens
gagcuuuguccugaagga

SEQ ID NO: 525510 - RNA, 16 nt, Homo sapiens
gaggacaaaaggaaug

SEQ ID NO: 525511 - RNA, 21 nt, Homo sapiens
gaggcaacccgugcucagcug

SEQ ID NO: 525512 - RNA, 19 nt, Homo sapiens
gaggcaggaggaucacuuu

SEQ ID NO: 525513 - RNA, 16 nt, Homo sapiens
gaggcaggcggaucau

SEQ ID NO: 525514 - RNA, 13 nt, Homo sapiens
gaggcagugacag

SEQ ID NO: 525515 - RNA, 18 nt, Homo sapiens
gaggcccuccugugcugg

SEQ ID NO: 525516 - RNA, 14 nt, Homo sapiens
gaggccugugcuag

SEQ ID NO: 525517 - RNA, 19 nt, Homo sapiens
gaggcggagaauugcuuga

SEQ ID NO: 525518 - RNA, 21 nt, Homo sapiens
gagggaagaaugaacacuccc

SEQ ID NO: 525519 - RNA, 19 nt, Homo sapiens
gagggauaaaaacaauacu

SEQ ID NO: 525520 - RNA, 20 nt, Homo sapiens
gagggcggggagaaucucag

SEQ ID NO: 525521 - RNA, 21 nt, Homo sapiens
gaggugggcagaucaccugag

SEQ ID NO: 525522 - RNA, 21 nt, Homo sapiens
gagguggguggaucaccugag

SEQ ID NO: 525523 - RNA, 13 nt, Homo sapiens
gaguaacuuagaa

SEQ ID NO: 525524 - RNA, 20 nt, Homo sapiens
gaguaccuguccaagacagg

SEQ ID NO: 525525 - RNA, 20 nt, Homo sapiens
gagucaacaggucacuugau

SEQ ID NO: 525526 - RNA, 23 nt, Homo sapiens
gagucugagaacccccagaccaa

SEQ ID NO: 525527 - RNA, 16 nt, Homo sapiens
gagucugcacgggacc

SEQ ID NO: 525528 - RNA, 16 nt, Homo sapiens
gaguguagacuguggc

SEQ ID NO: 525529 - RNA, 14 nt, Homo sapiens
gaguuucaaauccc

SEQ ID NO: 525530 - RNA, 19 nt, Homo sapiens
gauaagagauguugacucu

SEQ ID NO: 525531 - RNA, 19 nt, Homo sapiens
gauaaguggggacuagugu

SEQ ID NO: 525532 - RNA, 16 nt, Homo sapiens
gauacagccugcaagu

SEQ ID NO: 525533 - RNA, 20 nt, Homo sapiens
gauacaugguugugaccuga

SEQ ID NO: 525534 - RNA, 20 nt, Homo sapiens
gauacuaacauuuucauuga

SEQ ID NO: 525535 - RNA, 13 nt, Homo sapiens
gauagauguuugg

SEQ ID NO: 525536 - RNA, 18 nt, Homo sapiens
gauagcaaauggccucau

SEQ ID NO: 525537 - RNA, 21 nt, Homo sapiens
gauaggaagacgcagagcaaa

SEQ ID NO: 525538 - RNA, 17 nt, Homo sapiens
gauauacugcagcuuua

SEQ ID NO: 525539 - RNA, 14 nt, Homo sapiens
gauauggcaggacu

SEQ ID NO: 525540 - RNA, 22 nt, Homo sapiens
gauauggcaggacuccuggcag

SEQ ID NO: 525541 - RNA, 17 nt, Homo sapiens
gauauuuuuuggugugc

SEQ ID NO: 525542 - RNA, 15 nt, Homo sapiens
gauccagaacugcac

SEQ ID NO: 525543 - RNA, 17 nt, Homo sapiens
gauccagccucauaccu

SEQ ID NO: 525544 - RNA, 23 nt, Homo sapiens
gauccccaaguggugaaugacac

SEQ ID NO: 525545 - RNA, 16 nt, Homo sapiens
gauccuuuuauucucc

SEQ ID NO: 525546 - RNA, 18 nt, Homo sapiens
gaucugcaucugauagaa

SEQ ID NO: 525547 - RNA, 22 nt, Homo sapiens
gaucuuucucaaucuugaacuc

SEQ ID NO: 525548 - RNA, 17 nt, Homo sapiens
gaugagcaagacauacu

SEQ ID NO: 525549 - RNA, 19 nt, Homo sapiens
gaugauacgaaugauguca

SEQ ID NO: 525550 - RNA, 14 nt, Homo sapiens
gauggcaggugccu

SEQ ID NO: 525551 - RNA, 19 nt, Homo sapiens
gauggcuggaaggggucca

SEQ ID NO: 525552 - RNA, 20 nt, Homo sapiens
gauguauaaaauggucaugg

SEQ ID NO: 525553 - RNA, 17 nt, Homo sapiens
gaugucccugggccagg

SEQ ID NO: 525554 - RNA, 19 nt, Homo sapiens
gauguuauuagauguuaca

SEQ ID NO: 525555 - RNA, 13 nt, Homo sapiens
gauuauaaaguuu

SEQ ID NO: 525556 - RNA, 23 nt, Homo sapiens
gauuauucuuugaaaacagauga

SEQ ID NO: 525557 - RNA, 14 nt, Homo sapiens
gauucuuuguuaca

SEQ ID NO: 525558 - RNA, 13 nt, Homo sapiens
gauugcacuugau

SEQ ID NO: 525559 - RNA, 14 nt, Homo sapiens
gauugcugcaaaga

SEQ ID NO: 525560 - RNA, 17 nt, Homo sapiens
gauuuccuccuggccuu

SEQ ID NO: 525561 - RNA, 21 nt, Homo sapiens
gauuuccuugacuucuuugag

SEQ ID NO: 525562 - RNA, 22 nt, Homo sapiens
gauuugauugggaugaaugcca

SEQ ID NO: 525563 - RNA, 19 nt, Homo sapiens
gauuuguagcauaacugua

SEQ ID NO: 525564 - RNA, 17 nt, Homo sapiens
gauuuuuuccucugcau

SEQ ID NO: 525565 - RNA, 17 nt, Homo sapiens
gcaaaauugggcuguga

SEQ ID NO: 525566 - RNA, 20 nt, Homo sapiens
gcaaacacugggggcaccuu

SEQ ID NO: 525567 - RNA, 15 nt, Homo sapiens
gcaaacgagacuuuc

SEQ ID NO: 525568 - RNA, 12 nt, Homo sapiens
gcaaagagccag

SEQ ID NO: 525569 - RNA, 14 nt, Homo sapiens
gcaaagagccagca

SEQ ID NO: 525570 - RNA, 15 nt, Homo sapiens
gcaaagccaaaaccu

SEQ ID NO: 525571 - RNA, 18 nt, Homo sapiens
gcaaagccuuuccagaaa

SEQ ID NO: 525572 - RNA, 15 nt, Homo sapiens
gcaaagugcacauga

SEQ ID NO: 525573 - RNA, 17 nt, Homo sapiens
gcaacaauaaaguacuu

SEQ ID NO: 525574 - RNA, 19 nt, Homo sapiens
gcaaccucuucaugagcuu

SEQ ID NO: 525575 - RNA, 17 nt, Homo sapiens
gcaacucuaacucugag

SEQ ID NO: 525576 - RNA, 11 nt, Homo sapiens
gcaacugcugu

SEQ ID NO: 525577 - RNA, 17 nt, Homo sapiens
gcaacuggaguuccuua

SEQ ID NO: 525578 - RNA, 15 nt, Homo sapiens
gcaacuguaugaaaa

SEQ ID NO: 525579 - RNA, 15 nt, Homo sapiens
gcaagugaaagcaag

SEQ ID NO: 525580 - RNA, 17 nt, Homo sapiens
gcaagugguagcaagaa

SEQ ID NO: 525581 - RNA, 13 nt, Homo sapiens
gcaauagaacccu

SEQ ID NO: 525582 - RNA, 19 nt, Homo sapiens
gcaauagacacauacaugu

SEQ ID NO: 525583 - RNA, 15 nt, Homo sapiens
gcaaucuccaugugu

SEQ ID NO: 525584 - RNA, 16 nt, Homo sapiens
gcacaagggcacguga

SEQ ID NO: 525585 - RNA, 14 nt, Homo sapiens
gcacacugcacugu

SEQ ID NO: 525586 - RNA, 12 nt, Homo sapiens
gcacagcuguuu

SEQ ID NO: 525587 - RNA, 18 nt, Homo sapiens
gcaccagagggauaaaaa

SEQ ID NO: 525588 - RNA, 23 nt, Homo sapiens
gcaccagagggauaaaaacaaua

SEQ ID NO: 525589 - RNA, 17 nt, Homo sapiens
gcaccaggcacugcugc

SEQ ID NO: 525590 - RNA, 13 nt, Homo sapiens
gcaccucuuccuu

SEQ ID NO: 525591 - RNA, 21 nt, Homo sapiens
gcaccuguaaucccagcuacu

SEQ ID NO: 525592 - RNA, 18 nt, Homo sapiens
gcaccuuaagauuuugca

SEQ ID NO: 525593 - RNA, 13 nt, Homo sapiens
gcacuauguauau

SEQ ID NO: 525594 - RNA, 19 nt, Homo sapiens
gcacuauguuuccauuugu

SEQ ID NO: 525595 - RNA, 10 nt, Homo sapiens
gcacugaccg

SEQ ID NO: 525596 - RNA, 12 nt, Homo sapiens
gcagaagcccug

SEQ ID NO: 525597 - RNA, 14 nt, Homo sapiens
gcagacaguagaca

SEQ ID NO: 525598 - RNA, 17 nt, Homo sapiens
gcagacaguagacagaa

SEQ ID NO: 525599 - RNA, 23 nt, Homo sapiens
gcagacugcugcuagagccagca

SEQ ID NO: 525600 - RNA, 17 nt, Homo sapiens
gcagagucuaccuugaa

SEQ ID NO: 525601 - RNA, 19 nt, Homo sapiens
gcagaucuggacuuggcaa

SEQ ID NO: 525602 - RNA, 13 nt, Homo sapiens
gcagaugaugcuu

SEQ ID NO: 525603 - RNA, 16 nt, Homo sapiens
gcagauggggcacuga

SEQ ID NO: 525604 - RNA, 12 nt, Homo sapiens
gcagcacaagcu

SEQ ID NO: 525605 - RNA, 21 nt, Homo sapiens
gcagcaggcagcuucuacucc

SEQ ID NO: 525606 - RNA, 21 nt, Homo sapiens
gcagccuaacacggugcucau

SEQ ID NO: 525607 - RNA, 14 nt, Homo sapiens
gcaggaguggugca

SEQ ID NO: 525608 - RNA, 18 nt, Homo sapiens
gcaggcugggccaugucc

SEQ ID NO: 525609 - RNA, 17 nt, Homo sapiens
gcagggcccagugacaa

SEQ ID NO: 525610 - RNA, 19 nt, Homo sapiens
gcaggggcuugcuuugcag

SEQ ID NO: 525611 - RNA, 15 nt, Homo sapiens
gcaguauucuugcac

SEQ ID NO: 525612 - RNA, 17 nt, Homo sapiens
gcagugcuaaagccugu

SEQ ID NO: 525613 - RNA, 18 nt, Homo sapiens
gcagugcuaaagccugug

SEQ ID NO: 525614 - RNA, 19 nt, Homo sapiens
gcaguuguaccaagugaaa

SEQ ID NO: 525615 - RNA, 18 nt, Homo sapiens
gcaguuuaagagcagaac

SEQ ID NO: 525616 - RNA, 22 nt, Homo sapiens
gcaguuuuacuaaaacacugaa

SEQ ID NO: 525617 - RNA, 14 nt, Homo sapiens
gcauaauagucaau

SEQ ID NO: 525618 - RNA, 21 nt, Homo sapiens
gcauaccaaguugauacuuga

SEQ ID NO: 525619 - RNA, 23 nt, Homo sapiens
gcauaucccaccaaccuccagug

SEQ ID NO: 525620 - RNA, 21 nt, Homo sapiens
gcauauguguaaagauuuaua

SEQ ID NO: 525621 - RNA, 16 nt, Homo sapiens
gcaucaaggugcugaa

SEQ ID NO: 525622 - RNA, 21 nt, Homo sapiens
gcaucauuuccccaacagggc

SEQ ID NO: 525623 - RNA, 19 nt, Homo sapiens
gcaucccugagacagggag

SEQ ID NO: 525624 - RNA, 20 nt, Homo sapiens
gcaucuauuuccucugugca

SEQ ID NO: 525625 - RNA, 21 nt, Homo sapiens
gcaucuauuuccucugugcaa

SEQ ID NO: 525626 - RNA, 22 nt, Homo sapiens
gcaugcagcuuugcaaacccau

SEQ ID NO: 525627 - RNA, 17 nt, Homo sapiens
gcauggaacagcauuac

SEQ ID NO: 525628 - RNA, 23 nt, Homo sapiens
gcauggggauugcagagugacca

SEQ ID NO: 525629 - RNA, 16 nt, Homo sapiens
gcauguuucacagugg

SEQ ID NO: 525630 - RNA, 17 nt, Homo sapiens
gccaagagugcacuacu

SEQ ID NO: 525631 - RNA, 15 nt, Homo sapiens
gccacauauugagau

SEQ ID NO: 525632 - RNA, 16 nt, Homo sapiens
gccacucuuagcuaaa

SEQ ID NO: 525633 - RNA, 14 nt, Homo sapiens
gccacugcuguauu

SEQ ID NO: 525634 - RNA, 20 nt, Homo sapiens
gccacuuucuacaggccagc

SEQ ID NO: 525635 - RNA, 15 nt, Homo sapiens
gccagaggcucuaau

SEQ ID NO: 525636 - RNA, 22 nt, Homo sapiens
gccagaggcucuaauguacaau

SEQ ID NO: 525637 - RNA, 23 nt, Homo sapiens
gccagaggcucuaauguacaaua

SEQ ID NO: 525638 - RNA, 14 nt, Homo sapiens
gccagcacgccgcu

SEQ ID NO: 525639 - RNA, 16 nt, Homo sapiens
gccagcagggcaucuu

SEQ ID NO: 525640 - RNA, 19 nt, Homo sapiens
gccagcagggcaucuugga

SEQ ID NO: 525641 - RNA, 21 nt, Homo sapiens
gccagcauauauacuugcaag

SEQ ID NO: 525642 - RNA, 15 nt, Homo sapiens
gccaggagcugucac

SEQ ID NO: 525643 - RNA, 20 nt, Homo sapiens
gccaggccuuacaucuggcu

SEQ ID NO: 525644 - RNA, 20 nt, Homo sapiens
gccaguaaucuuuauacugg

SEQ ID NO: 525645 - RNA, 22 nt, Homo sapiens
gccagucucauugucaccucug

SEQ ID NO: 525646 - RNA, 14 nt, Homo sapiens
gccagugucauccg

SEQ ID NO: 525647 - RNA, 12 nt, Homo sapiens
gccauggcagcg

SEQ ID NO: 525648 - RNA, 20 nt, Homo sapiens
gcccaagugcaaaagaaaaa

SEQ ID NO: 525649 - RNA, 23 nt, Homo sapiens
gcccacucugcaagaagaaauca

SEQ ID NO: 525650 - RNA, 15 nt, Homo sapiens
gcccaggugugcagg

SEQ ID NO: 525651 - RNA, 11 nt, Homo sapiens
gcccagugcau

SEQ ID NO: 525652 - RNA, 19 nt, Homo sapiens
gcccaugaugagaagcaga

SEQ ID NO: 525653 - RNA, 15 nt, Homo sapiens
gccccacgugcuccc

SEQ ID NO: 525654 - RNA, 22 nt, Homo sapiens
gccccucuuccccaaugcucca

SEQ ID NO: 525655 - RNA, 22 nt, Homo sapiens
gcccguacccagcccugcugca

SEQ ID NO: 525656 - RNA, 16 nt, Homo sapiens
gcccuaagggacuuaa

SEQ ID NO: 525657 - RNA, 20 nt, Homo sapiens
gcccugauguguccucaggg

SEQ ID NO: 525658 - RNA, 23 nt, Homo sapiens
gcccuuggggagaggugauucuc

SEQ ID NO: 525659 - RNA, 15 nt, Homo sapiens
gcccuuuccuuccag

SEQ ID NO: 525660 - RNA, 16 nt, Homo sapiens
gccgacagcucuccaa

SEQ ID NO: 525661 - RNA, 13 nt, Homo sapiens
gccgcuaccuccc

SEQ ID NO: 525662 - RNA, 23 nt, Homo sapiens
gccgggccuagaccuggugcuga

SEQ ID NO: 525663 - RNA, 19 nt, Homo sapiens
gccgugugagugugacagg

SEQ ID NO: 525664 - RNA, 18 nt, Homo sapiens
gccuauagucccacuacu

SEQ ID NO: 525665 - RNA, 15 nt, Homo sapiens
gccucauuacuguga

SEQ ID NO: 525666 - RNA, 16 nt, Homo sapiens
gccucauuacugugag

SEQ ID NO: 525667 - RNA, 13 nt, Homo sapiens
gccuccaugaccu

SEQ ID NO: 525668 - RNA, 23 nt, Homo sapiens
gccuccugugacgugaggcccau

SEQ ID NO: 525669 - RNA, 17 nt, Homo sapiens
gccucugccuuugcacc

SEQ ID NO: 525670 - RNA, 17 nt, Homo sapiens
gccugagccucugcuuc

SEQ ID NO: 525671 - RNA, 16 nt, Homo sapiens
gccugcucccuagcca

SEQ ID NO: 525672 - RNA, 21 nt, Homo sapiens
gccugcuucuucucuccacau

SEQ ID NO: 525673 - RNA, 13 nt, Homo sapiens
gccuggcacagac

SEQ ID NO: 525674 - RNA, 18 nt, Homo sapiens
gccuggccaacaugguga

SEQ ID NO: 525675 - RNA, 22 nt, Homo sapiens
gccuggcccccacccucugcca

SEQ ID NO: 525676 - RNA, 15 nt, Homo sapiens
gccugggaugaugca

SEQ ID NO: 525677 - RNA, 16 nt, Homo sapiens
gccugggcugguugga

SEQ ID NO: 525678 - RNA, 14 nt, Homo sapiens
gccuguaaucccag

SEQ ID NO: 525679 - RNA, 20 nt, Homo sapiens
gccuguaaucccagcacuuu

SEQ ID NO: 525680 - RNA, 21 nt, Homo sapiens
gccugucuuaauuuucuuuca

SEQ ID NO: 525681 - RNA, 23 nt, Homo sapiens
gccuguggguuugguccuugaac

SEQ ID NO: 525682 - RNA, 13 nt, Homo sapiens
gccuuacaucugg

SEQ ID NO: 525683 - RNA, 17 nt, Homo sapiens
gccuucagcaugccuga

SEQ ID NO: 525684 - RNA, 21 nt, Homo sapiens
gcgaaaguucuugguggugga

SEQ ID NO: 525685 - RNA, 17 nt, Homo sapiens
gcgacccauucagagac

SEQ ID NO: 525686 - RNA, 17 nt, Homo sapiens
gcgcagggcuggcacgu

SEQ ID NO: 525687 - RNA, 16 nt, Homo sapiens
gcgcccuggguggugg

SEQ ID NO: 525688 - RNA, 12 nt, Homo sapiens
gcguccugguca

SEQ ID NO: 525689 - RNA, 20 nt, Homo sapiens
gcguccuuugaaccugugca

SEQ ID NO: 525690 - RNA, 23 nt, Homo sapiens
gcguuucauguagccagcagaac

SEQ ID NO: 525691 - RNA, 15 nt, Homo sapiens
gcuaagggugggugc

SEQ ID NO: 525692 - RNA, 21 nt, Homo sapiens
gcuaaucaaagccagggucuc

SEQ ID NO: 525693 - RNA, 22 nt, Homo sapiens
gcuaaugcauuuugcacuagaa

SEQ ID NO: 525694 - RNA, 23 nt, Homo sapiens
gcuaccagguguucuacacucau

SEQ ID NO: 525695 - RNA, 10 nt, Homo sapiens
gcuaccuccc

SEQ ID NO: 525696 - RNA, 21 nt, Homo sapiens
gcuauguauaaaauacauagu

SEQ ID NO: 525697 - RNA, 17 nt, Homo sapiens
gcucaagaggccacuua

SEQ ID NO: 525698 - RNA, 17 nt, Homo sapiens
gcucagaucucauggga

SEQ ID NO: 525699 - RNA, 21 nt, Homo sapiens
gcucaggaaggggugugcuga

SEQ ID NO: 525700 - RNA, 12 nt, Homo sapiens
gcucaggugccu

SEQ ID NO: 525701 - RNA, 19 nt, Homo sapiens
gcucagucgcuagcauuuc

SEQ ID NO: 525702 - RNA, 21 nt, Homo sapiens
gcucaguguuuuugugaauug

SEQ ID NO: 525703 - RNA, 13 nt, Homo sapiens
gcucccuagccag

SEQ ID NO: 525704 - RNA, 20 nt, Homo sapiens
gcucccuagccagaggcucu

SEQ ID NO: 525705 - RNA, 14 nt, Homo sapiens
gcucccuccuccag

SEQ ID NO: 525706 - RNA, 15 nt, Homo sapiens
gcucugcuaugagug

SEQ ID NO: 525707 - RNA, 16 nt, Homo sapiens
gcucuuugcugcacua

SEQ ID NO: 525708 - RNA, 19 nt, Homo sapiens
gcugaaaaaucauccaaga

SEQ ID NO: 525709 - RNA, 21 nt, Homo sapiens
gcugaaagacucgagaaccaa

SEQ ID NO: 525710 - RNA, 18 nt, Homo sapiens
gcugaagaguaaaggaaa

SEQ ID NO: 525711 - RNA, 23 nt, Homo sapiens
gcugacaugaagcuguuguguga

SEQ ID NO: 525712 - RNA, 17 nt, Homo sapiens
gcugaccuggagaugcu

SEQ ID NO: 525713 - RNA, 13 nt, Homo sapiens
gcugacucuccag

SEQ ID NO: 525714 - RNA, 16 nt, Homo sapiens
gcugagaucguaccua

SEQ ID NO: 525715 - RNA, 14 nt, Homo sapiens
gcugcagucaucua

SEQ ID NO: 525716 - RNA, 15 nt, Homo sapiens
gcugcagucaucuac

SEQ ID NO: 525717 - RNA, 21 nt, Homo sapiens
gcugccuggccuuguccucag

SEQ ID NO: 525718 - RNA, 23 nt, Homo sapiens
gcuggaaaaccuccuuuaccaga

SEQ ID NO: 525719 - RNA, 15 nt, Homo sapiens
gcuggaagcaaagua

SEQ ID NO: 525720 - RNA, 16 nt, Homo sapiens
gcuggagcccagucac

SEQ ID NO: 525721 - RNA, 20 nt, Homo sapiens
gcuggagugcagugguguga

SEQ ID NO: 525722 - RNA, 14 nt, Homo sapiens
gcuggccgcaugac

SEQ ID NO: 525723 - RNA, 19 nt, Homo sapiens
gcugucccuugcuugccug

SEQ ID NO: 525724 - RNA, 18 nt, Homo sapiens
gcuuaaauuuuauaucau

SEQ ID NO: 525725 - RNA, 20 nt, Homo sapiens
gcuuaacacuaucauggacu

SEQ ID NO: 525726 - RNA, 17 nt, Homo sapiens
gcuuaccuccucauggc

SEQ ID NO: 525727 - RNA, 15 nt, Homo sapiens
gcuuagagaggacaa

SEQ ID NO: 525728 - RNA, 14 nt, Homo sapiens
gcuuauaugugaca

SEQ ID NO: 525729 - RNA, 13 nt, Homo sapiens
gcuuaugugacau

SEQ ID NO: 525730 - RNA, 21 nt, Homo sapiens
gcuucaaggauauacugcagc

SEQ ID NO: 525731 - RNA, 23 nt, Homo sapiens
gcuuccuagaaaguucuguguaa

SEQ ID NO: 525732 - RNA, 17 nt, Homo sapiens
gcuucugcaguucucau

SEQ ID NO: 525733 - RNA, 17 nt, Homo sapiens
gcuugcugcucaucuga

SEQ ID NO: 525734 - RNA, 13 nt, Homo sapiens
gcuugcuggguac

SEQ ID NO: 525735 - RNA, 16 nt, Homo sapiens
gcuuguuccacugcaa

SEQ ID NO: 525736 - RNA, 22 nt, Homo sapiens
gcuuucugccaucuagccagcc

SEQ ID NO: 525737 - RNA, 14 nt, Homo sapiens
gcuuucuguugcca

SEQ ID NO: 525738 - RNA, 20 nt, Homo sapiens
gcuuuuauuugguguguucg

SEQ ID NO: 525739 - RNA, 18 nt, Homo sapiens
gcuuuuugccaucuguga

SEQ ID NO: 525740 - RNA, 21 nt, Homo sapiens
acugacaaccucauccaggcu

SEQ ID NO: 525741 - RNA, 20 nt, Homo sapiens
acugacccccaucugagcug

SEQ ID NO: 525742 - RNA, 18 nt, Homo sapiens
acugaccggugcuuuuau

SEQ ID NO: 525743 - RNA, 15 nt, Homo sapiens
acugagaccaaagaa

SEQ ID NO: 525744 - RNA, 20 nt, Homo sapiens
acugaguguuauuugcacac

SEQ ID NO: 525745 - RNA, 19 nt, Homo sapiens
aggcagcugccucugcucc

SEQ ID NO: 525746 - RNA, 16 nt, Homo sapiens
aggcaguagaacucca

SEQ ID NO: 525747 - RNA, 12 nt, Homo sapiens
aggccacagugg

SEQ ID NO: 525748 - RNA, 20 nt, Homo sapiens
aggccaggcacaguggcuca

SEQ ID NO: 525749 - RNA, 18 nt, Homo sapiens
aggccauuaggguugccu

SEQ ID NO: 525750 - RNA, 13 nt, Homo sapiens
aggcccauguaua

SEQ ID NO: 525751 - RNA, 15 nt, Homo sapiens
aggccccaguggcug

SEQ ID NO: 525752 - RNA, 21 nt, Homo sapiens
aggcccgcuugcuggguaccu

SEQ ID NO: 525753 - RNA, 21 nt, Homo sapiens
aggcccugagcuuuguccuga

SEQ ID NO: 525754 - RNA, 21 nt, Homo sapiens
aggcgcaguggcucaugccug

SEQ ID NO: 525755 - RNA, 13 nt, Homo sapiens
aggcuaugccauc

SEQ ID NO: 525756 - RNA, 19 nt, Homo sapiens
aggcucuaauguacaauaa

SEQ ID NO: 525757 - RNA, 22 nt, Homo sapiens
aggcugaugggcaaaaaaccaa

SEQ ID NO: 525758 - RNA, 12 nt, Homo sapiens
aggcugggccau

SEQ ID NO: 525759 - RNA, 19 nt, Homo sapiens
aggcuucaguuuuacucug

SEQ ID NO: 525760 - RNA, 21 nt, Homo sapiens
aggcuucaguuuuacucugcu

SEQ ID NO: 525761 - RNA, 19 nt, Homo sapiens
aggcuuguuuaccuuucuc

SEQ ID NO: 525762 - RNA, 20 nt, Homo sapiens
aggcuuuguacagagugcuu

SEQ ID NO: 525763 - RNA, 21 nt, Homo sapiens
aggcuuuguacagagugcuuu

SEQ ID NO: 525764 - RNA, 12 nt, Homo sapiens
agggaaaacugc

SEQ ID NO: 525765 - RNA, 13 nt, Homo sapiens
agggaaaacugca

SEQ ID NO: 525766 - RNA, 20 nt, Homo sapiens
agggaagaaugaacacuccc

SEQ ID NO: 525767 - RNA, 14 nt, Homo sapiens
agggaagccgugaa

SEQ ID NO: 525768 - RNA, 13 nt, Homo sapiens
agggaauccuccu

SEQ ID NO: 525769 - RNA, 14 nt, Homo sapiens
agggaauugcucag

SEQ ID NO: 525770 - RNA, 15 nt, Homo sapiens
agggagaagcaugaa

SEQ ID NO: 525771 - RNA, 14 nt, Homo sapiens
agggagaccaugcc

SEQ ID NO: 525772 - RNA, 15 nt, Homo sapiens
agggagaccaugccu

SEQ ID NO: 525773 - RNA, 21 nt, Homo sapiens
agggaugaguccccugugaga

SEQ ID NO: 525774 - RNA, 19 nt, Homo sapiens
agggauuugaggugagggu

SEQ ID NO: 525775 - RNA, 21 nt, Homo sapiens
agggcagagucuaccuugaaa

SEQ ID NO: 525776 - RNA, 19 nt, Homo sapiens
agggcccacccaugucacc

SEQ ID NO: 525777 - RNA, 21 nt, Homo sapiens
aggggagggagaaguuucugu

SEQ ID NO: 525778 - RNA, 18 nt, Homo sapiens
agggggagaauggguguu

SEQ ID NO: 525779 - RNA, 18 nt, Homo sapiens
agggggucugggccagug

SEQ ID NO: 525780 - RNA, 14 nt, Homo sapiens
aggguccaguggau

SEQ ID NO: 525781 - RNA, 19 nt, Homo sapiens
agguaauagggacuuagca

SEQ ID NO: 525782 - RNA, 16 nt, Homo sapiens
agguaggaagcacuga

SEQ ID NO: 525783 - RNA, 14 nt, Homo sapiens
aggucaaguaagaa

SEQ ID NO: 525784 - RNA, 12 nt, Homo sapiens
aggucaggagau

SEQ ID NO: 525785 - RNA, 22 nt, Homo sapiens
aggucccgaaaggggcacuggu

SEQ ID NO: 525786 - RNA, 14 nt, Homo sapiens
agguccuuuggaca

SEQ ID NO: 525787 - RNA, 17 nt, Homo sapiens
aggugaacacuuaguga

SEQ ID NO: 525788 - RNA, 16 nt, Homo sapiens
aggugaggcucuucac

SEQ ID NO: 525789 - RNA, 18 nt, Homo sapiens
aggugcauagcaagugaa

SEQ ID NO: 525790 - RNA, 19 nt, Homo sapiens
aggugggccuugcuaccuc

SEQ ID NO: 525791 - RNA, 23 nt, Homo sapiens
aggugucugagaugggcccguac

SEQ ID NO: 525792 - RNA, 23 nt, Homo sapiens
agguuugguuugguuuuggacau

SEQ ID NO: 525793 - RNA, 13 nt, Homo sapiens
agguuuuguugcu

SEQ ID NO: 525794 - RNA, 15 nt, Homo sapiens
aguaaauagugucau

SEQ ID NO: 525795 - RNA, 15 nt, Homo sapiens
aguaacugaaccauu

SEQ ID NO: 525796 - RNA, 15 nt, Homo sapiens
aguaagaagacauga

SEQ ID NO: 525797 - RNA, 14 nt, Homo sapiens
aguaagaauaccac

SEQ ID NO: 525798 - RNA, 24 nt, Homo sapiens
aguaccaguauaagcaucugccau

SEQ ID NO: 525799 - RNA, 14 nt, Homo sapiens
aguacuccaagaca

SEQ ID NO: 525800 - RNA, 14 nt, Homo sapiens
aguacuuuaccuaa

SEQ ID NO: 525801 - RNA, 15 nt, Homo sapiens
aguaggaggccucca

SEQ ID NO: 525802 - RNA, 18 nt, Homo sapiens
aguauauauaucauagca

SEQ ID NO: 525803 - RNA, 12 nt, Homo sapiens
aguauccacaau

SEQ ID NO: 525804 - RNA, 15 nt, Homo sapiens
agucaauuucuacuu

SEQ ID NO: 525805 - RNA, 18 nt, Homo sapiens
agucaccuauguggucca

SEQ ID NO: 525806 - RNA, 23 nt, Homo sapiens
agucagaugguacggacuuccuu

SEQ ID NO: 525807 - RNA, 14 nt, Homo sapiens
agucaguauggucu

SEQ ID NO: 525808 - RNA, 17 nt, Homo sapiens
agucauaucaaagggua

SEQ ID NO: 525809 - RNA, 14 nt, Homo sapiens
agucauccugccaa

SEQ ID NO: 525810 - RNA, 16 nt, Homo sapiens
aguccacaaagcauuu

SEQ ID NO: 525811 - RNA, 14 nt, Homo sapiens
agucccacacugug

SEQ ID NO: 525812 - RNA, 16 nt, Homo sapiens
agucccacacugugca

SEQ ID NO: 525813 - RNA, 17 nt, Homo sapiens
agucccagagcaccuca

SEQ ID NO: 525814 - RNA, 14 nt, Homo sapiens
aguccucccuggug

SEQ ID NO: 525815 - RNA, 17 nt, Homo sapiens
aguccuguacucugggg

SEQ ID NO: 525816 - RNA, 12 nt, Homo sapiens
aguccuugcaaa

SEQ ID NO: 525817 - RNA, 13 nt, Homo sapiens
aguccuuuaguca

SEQ ID NO: 525818 - RNA, 22 nt, Homo sapiens
agucuagcauucugcaacauuu

SEQ ID NO: 525819 - RNA, 13 nt, Homo sapiens
agucugaaacugg

SEQ ID NO: 525820 - RNA, 12 nt, Homo sapiens
agucugcugcug

SEQ ID NO: 525821 - RNA, 14 nt, Homo sapiens
agucugcugcugug

SEQ ID NO: 525822 - RNA, 14 nt, Homo sapiens
agucuuccaugacc

SEQ ID NO: 525823 - RNA, 15 nt, Homo sapiens
agugaaaacuuugua

SEQ ID NO: 525824 - RNA, 18 nt, Homo sapiens
agugaccagcacacugga

SEQ ID NO: 525825 - RNA, 20 nt, Homo sapiens
agugacuggugccaguguca

SEQ ID NO: 525826 - RNA, 13 nt, Homo sapiens
agugagacagacu

SEQ ID NO: 525827 - RNA, 16 nt, Homo sapiens
agugagccgagaucau

SEQ ID NO: 525828 - RNA, 22 nt, Homo sapiens
agugagggucuucuuacaugca

SEQ ID NO: 525829 - RNA, 21 nt, Homo sapiens
agugauggcuuaugauagcaa

SEQ ID NO: 525830 - RNA, 16 nt, Homo sapiens
agugccaacuccucac

SEQ ID NO: 525831 - RNA, 19 nt, Homo sapiens
agugcugccaguuucccaa

SEQ ID NO: 525832 - RNA, 19 nt, Homo sapiens
agugcuggcucacaguaca

SEQ ID NO: 525833 - RNA, 19 nt, Homo sapiens
aguggccccggcugcauga

SEQ ID NO: 525834 - RNA, 22 nt, Homo sapiens
agugggauuuccagaaccacac

SEQ ID NO: 525835 - RNA, 16 nt, Homo sapiens
aguggggcugcaggca

SEQ ID NO: 525836 - RNA, 21 nt, Homo sapiens
agugguguucagccaagugac

SEQ ID NO: 525837 - RNA, 23 nt, Homo sapiens
aguguaaaaaaugucucauguca

SEQ ID NO: 525838 - RNA, 22 nt, Homo sapiens
aguguaagcccugcuuagcuca

SEQ ID NO: 525839 - RNA, 12 nt, Homo sapiens
aguguaccuccu

SEQ ID NO: 525840 - RNA, 23 nt, Homo sapiens
agugucaggcgccgcacuuccuu

SEQ ID NO: 525841 - RNA, 17 nt, Homo sapiens
aguguccuucuugcucc

SEQ ID NO: 525842 - RNA, 19 nt, Homo sapiens
aguguccuuuccagagcaa

SEQ ID NO: 525843 - RNA, 23 nt, Homo sapiens
agugugggggaggcgcacagugu

SEQ ID NO: 525844 - RNA, 20 nt, Homo sapiens
aguguuauuugcacacugca

SEQ ID NO: 525845 - RNA, 23 nt, Homo sapiens
aguguuauuugcacacugcacug

SEQ ID NO: 525846 - RNA, 22 nt, Homo sapiens
aguguuggcaaacgagacuuuc

SEQ ID NO: 525847 - RNA, 16 nt, Homo sapiens
aguguuuuugugaauu

SEQ ID NO: 525848 - RNA, 15 nt, Homo sapiens
aguuaguuccacuga

SEQ ID NO: 525849 - RNA, 14 nt, Homo sapiens
aguucccucuugcu

SEQ ID NO: 525850 - RNA, 23 nt, Homo sapiens
aguugaggagacauuacaaugug

SEQ ID NO: 525851 - RNA, 18 nt, Homo sapiens
aguugcuguugugugauc

SEQ ID NO: 525852 - RNA, 13 nt, Homo sapiens
aguuucaguuugu

SEQ ID NO: 525853 - RNA, 16 nt, Homo sapiens
aguuucuaaaaacaca

SEQ ID NO: 525854 - RNA, 19 nt, Homo sapiens
aguuucuuacacacugucu

SEQ ID NO: 525855 - RNA, 21 nt, Homo sapiens
auaaaaauguuucuacagaua

SEQ ID NO: 525856 - RNA, 16 nt, Homo sapiens
auaaaacacugcccuc

SEQ ID NO: 525857 - RNA, 18 nt, Homo sapiens
auaaaauccugugcaaua

SEQ ID NO: 525858 - RNA, 24 nt, Homo sapiens
auaaacacacagaucugcaucuga

SEQ ID NO: 525859 - RNA, 19 nt, Homo sapiens
auaaaccuugucuaugaaa

SEQ ID NO: 525860 - RNA, 16 nt, Homo sapiens
auaaacucauuuaucu

SEQ ID NO: 525861 - RNA, 17 nt, Homo sapiens
auaaagcaaugugguag

SEQ ID NO: 525862 - RNA, 14 nt, Homo sapiens
auaaagcauguuca

SEQ ID NO: 525863 - RNA, 15 nt, Homo sapiens
auaaaggcagcugcc

SEQ ID NO: 525864 - RNA, 19 nt, Homo sapiens
cuguaauguaaauaaacua

SEQ ID NO: 525865 - RNA, 16 nt, Homo sapiens
cuguacacauauuuga

SEQ ID NO: 525866 - RNA, 21 nt, Homo sapiens
cuguauuuuuauuuuugcaca

SEQ ID NO: 525867 - RNA, 15 nt, Homo sapiens
cugucauaacaucca

SEQ ID NO: 525868 - RNA, 20 nt, Homo sapiens
cugucauccucaugcugcuc

SEQ ID NO: 525869 - RNA, 14 nt, Homo sapiens
cuguccaagacagg

SEQ ID NO: 525870 - RNA, 19 nt, Homo sapiens
cuguccuaaggaaccuucc

SEQ ID NO: 525871 - RNA, 22 nt, Homo sapiens
cugucuguauagugucuguauu

SEQ ID NO: 525872 - RNA, 19 nt, Homo sapiens
cugugcugggggaaugagc

SEQ ID NO: 525873 - RNA, 13 nt, Homo sapiens
cuguggaaugagu

SEQ ID NO: 525874 - RNA, 14 nt, Homo sapiens
cugugucucaugga

SEQ ID NO: 525875 - RNA, 19 nt, Homo sapiens
cugugucugccugucccca

SEQ ID NO: 525876 - RNA, 20 nt, Homo sapiens
cugugugaaugugggcacug

SEQ ID NO: 525877 - RNA, 13 nt, Homo sapiens
cuguuacccaggc

SEQ ID NO: 525878 - RNA, 18 nt, Homo sapiens
cuguuaucaaacugcugu

SEQ ID NO: 525879 - RNA, 19 nt, Homo sapiens
cuguucuguuggaugacuu

SEQ ID NO: 525880 - RNA, 21 nt, Homo sapiens
cuguugaucucaguauuguca

SEQ ID NO: 525881 - RNA, 18 nt, Homo sapiens
cuguugcuuaaaccacuu

SEQ ID NO: 525882 - RNA, 13 nt, Homo sapiens
cuguuucagaaau

SEQ ID NO: 525883 - RNA, 23 nt, Homo sapiens
cuuaaagccuuuuccugaauugg

SEQ ID NO: 525884 - RNA, 17 nt, Homo sapiens
cuuaaauguuuauacug

SEQ ID NO: 525885 - RNA, 20 nt, Homo sapiens
cuuaaauguuuauacuguau

SEQ ID NO: 525886 - RNA, 16 nt, Homo sapiens
cuuaagagacacucca

SEQ ID NO: 525887 - RNA, 21 nt, Homo sapiens
cuuaagagacacuccaaaccu

SEQ ID NO: 525888 - RNA, 13 nt, Homo sapiens
cuuacuggugcua

SEQ ID NO: 525889 - RNA, 18 nt, Homo sapiens
cuuagcaacucagagaaa

SEQ ID NO: 525890 - RNA, 15 nt, Homo sapiens
cuuagcgucaagaca

SEQ ID NO: 525891 - RNA, 23 nt, Homo sapiens
cuuaggacuaccagccauacaaa

SEQ ID NO: 525892 - RNA, 16 nt, Homo sapiens
cuuagugaucauuuaa

SEQ ID NO: 525893 - RNA, 14 nt, Homo sapiens
cuuagugauugaga

SEQ ID NO: 525894 - RNA, 14 nt, Homo sapiens
cuuaguugaaauga

SEQ ID NO: 525895 - RNA, 18 nt, Homo sapiens
cuuaucuuacaauauuga

SEQ ID NO: 525896 - RNA, 14 nt, Homo sapiens
cuuaugugacaugg

SEQ ID NO: 525897 - RNA, 20 nt, Homo sapiens
cuucaaggauauacugcagc

SEQ ID NO: 525898 - RNA, 14 nt, Homo sapiens
cuucaauacuuaaa

SEQ ID NO: 525899 - RNA, 23 nt, Homo sapiens
cuucaccaagaagcaaaguucaa

SEQ ID NO: 525900 - RNA, 14 nt, Homo sapiens
cuucacucuuugaa

SEQ ID NO: 525901 - RNA, 16 nt, Homo sapiens
cuucagugugguacaa

SEQ ID NO: 525902 - RNA, 13 nt, Homo sapiens
cuuccagauccug

SEQ ID NO: 525903 - RNA, 17 nt, Homo sapiens
cuuccaugacccuuugc

SEQ ID NO: 525904 - RNA, 17 nt, Homo sapiens
cuuccccaaugcuccau

SEQ ID NO: 525905 - RNA, 20 nt, Homo sapiens
cuuccccuuagaaacacugc

SEQ ID NO: 525906 - RNA, 23 nt, Homo sapiens
cuucccugcauuaacugcacaaa

SEQ ID NO: 525907 - RNA, 19 nt, Homo sapiens
cuuccuuugucguguuucu

SEQ ID NO: 525908 - RNA, 16 nt, Homo sapiens
cuucuaagucauucau

SEQ ID NO: 525909 - RNA, 16 nt, Homo sapiens
cuucugaguugcacau

SEQ ID NO: 525910 - RNA, 19 nt, Homo sapiens
cuucuguugaucucaguau

SEQ ID NO: 525911 - RNA, 21 nt, Homo sapiens
cuugaaaggaagagcuaauaa

SEQ ID NO: 525912 - RNA, 22 nt, Homo sapiens
cuugaacaagaugugggccuug

SEQ ID NO: 525913 - RNA, 16 nt, Homo sapiens
cuugaauaaccaucug

SEQ ID NO: 525914 - RNA, 14 nt, Homo sapiens
cuugacauaccuac

SEQ ID NO: 525915 - RNA, 13 nt, Homo sapiens
cuugacugcauug

SEQ ID NO: 525916 - RNA, 20 nt, Homo sapiens
cuugacuguuaguuguccac

SEQ ID NO: 525917 - RNA, 14 nt, Homo sapiens
cuugagaccauuuc

SEQ ID NO: 525918 - RNA, 19 nt, Homo sapiens
cuugauagcaaacacuggg

SEQ ID NO: 525919 - RNA, 21 nt, Homo sapiens
cuugcaauaccaauguucuaa

SEQ ID NO: 525920 - RNA, 16 nt, Homo sapiens
cuugcaauguagucaa

SEQ ID NO: 525921 - RNA, 15 nt, Homo sapiens
cuugcagaacuguag

SEQ ID NO: 525922 - RNA, 10 nt, Homo sapiens
cuugcauaau

SEQ ID NO: 525923 - RNA, 20 nt, Homo sapiens
cuugccuaaauacaagggcu

SEQ ID NO: 525924 - RNA, 14 nt, Homo sapiens
cuugccuaagacuu

SEQ ID NO: 525925 - RNA, 19 nt, Homo sapiens
cuugccuaagacuugccca

SEQ ID NO: 525926 - RNA, 14 nt, Homo sapiens
cuuggacuacacaa

SEQ ID NO: 525927 - RNA, 13 nt, Homo sapiens
cuuggugagaugg

SEQ ID NO: 525928 - RNA, 15 nt, Homo sapiens
cuuguaacaucaggg

SEQ ID NO: 525929 - RNA, 20 nt, Homo sapiens
cuuguacccccagguggaag

SEQ ID NO: 525930 - RNA, 12 nt, Homo sapiens
cuuguaccucaa

SEQ ID NO: 525931 - RNA, 14 nt, Homo sapiens
cuugucuucuggua

SEQ ID NO: 525932 - RNA, 15 nt, Homo sapiens
cuuguuuuuuacuca

SEQ ID NO: 525933 - RNA, 15 nt, Homo sapiens
cuuuaaaaagauauu

SEQ ID NO: 525934 - RNA, 22 nt, Homo sapiens
cuuuaagccuucaaaacuauag

SEQ ID NO: 525935 - RNA, 14 nt, Homo sapiens
cuuuaggaucucag

SEQ ID NO: 525936 - RNA, 17 nt, Homo sapiens
cuuuauacuggguuuca

SEQ ID NO: 525937 - RNA, 16 nt, Homo sapiens
cuuuauuucugaucua

SEQ ID NO: 525938 - RNA, 21 nt, Homo sapiens
cuuucaauuacaaagcaguua

SEQ ID NO: 525939 - RNA, 21 nt, Homo sapiens
cuuucaggggcugacucucca

SEQ ID NO: 525940 - RNA, 11 nt, Homo sapiens
cuuuccaagcu

SEQ ID NO: 525941 - RNA, 20 nt, Homo sapiens
cuuuccugguuuucaucagg

SEQ ID NO: 525942 - RNA, 22 nt, Homo sapiens
cuuuccugguuuucaucaggaa

SEQ ID NO: 525943 - RNA, 23 nt, Homo sapiens
cuuuccuguuucuaucuuucauu

SEQ ID NO: 525944 - RNA, 20 nt, Homo sapiens
cuuucuagaguagcucccau

SEQ ID NO: 525945 - RNA, 12 nt, Homo sapiens
cuuucucugcaa

SEQ ID NO: 525946 - RNA, 13 nt, Homo sapiens
cuuucuguugcca

SEQ ID NO: 525947 - RNA, 21 nt, Homo sapiens
cuuugaaaagagaauauuuac

SEQ ID NO: 525948 - RNA, 17 nt, Homo sapiens
cuuugaguagauccauu

SEQ ID NO: 525949 - RNA, 19 nt, Homo sapiens
cuuugcccugaauggucuc

SEQ ID NO: 525950 - RNA, 19 nt, Homo sapiens
cuuugccucuucuuugugc

SEQ ID NO: 525951 - RNA, 18 nt, Homo sapiens
cuuugcugcacuauuugc

SEQ ID NO: 525952 - RNA, 23 nt, Homo sapiens
cuuuggauugacucugcauuuga

SEQ ID NO: 525953 - RNA, 18 nt, Homo sapiens
cuuugggauucuuuccau

SEQ ID NO: 525954 - RNA, 15 nt, Homo sapiens
cuuuguaauaccaga

SEQ ID NO: 525955 - RNA, 19 nt, Homo sapiens
cuuugucgugguucuuaaa

SEQ ID NO: 525956 - RNA, 12 nt, Homo sapiens
cuuugugugcau

SEQ ID NO: 525957 - RNA, 18 nt, Homo sapiens
cuuuuaaaaacauaacau

SEQ ID NO: 525958 - RNA, 19 nt, Homo sapiens
cuuuuaaaaacauaacaua

SEQ ID NO: 525959 - RNA, 18 nt, Homo sapiens
gagacgguuuccagggag

SEQ ID NO: 525960 - RNA, 20 nt, Homo sapiens
gagagauggagaagcuagaa

SEQ ID NO: 525961 - RNA, 12 nt, Homo sapiens
gagagauguuuu

SEQ ID NO: 525962 - RNA, 23 nt, Homo sapiens
gagagggacauagaaucugugac

SEQ ID NO: 525963 - RNA, 16 nt, Homo sapiens
gagaguaaaccuugaa

SEQ ID NO: 525964 - RNA, 19 nt, Homo sapiens
gagaguauagcaugaaugu

SEQ ID NO: 525965 - RNA, 13 nt, Homo sapiens
gagagucacuuga

SEQ ID NO: 525966 - RNA, 16 nt, Homo sapiens
gagauaagucuuucau

SEQ ID NO: 525967 - RNA, 21 nt, Homo sapiens
gagaucguaccuauugcacuc

SEQ ID NO: 525968 - RNA, 20 nt, Homo sapiens
gagauugcacuauugcacuc

SEQ ID NO: 525969 - RNA, 22 nt, Homo sapiens
gagauugcacuauugcacucca

SEQ ID NO: 525970 - RNA, 19 nt, Homo sapiens
gagcagggagaccaugccu

SEQ ID NO: 525971 - RNA, 21 nt, Homo sapiens
gagccaaagcuuaugugacau

SEQ ID NO: 525972 - RNA, 17 nt, Homo sapiens
gagccaguuagacuagu

SEQ ID NO: 525973 - RNA, 13 nt, Homo sapiens
gagcccagucacc

SEQ ID NO: 525974 - RNA, 21 nt, Homo sapiens
gagccccaggggacaagggau

SEQ ID NO: 525975 - RNA, 19 nt, Homo sapiens
gagccgagaucaugccauu

SEQ ID NO: 525976 - RNA, 19 nt, Homo sapiens
gagccgccugcuucuucuc

SEQ ID NO: 525977 - RNA, 15 nt, Homo sapiens
gagccugcagggaag

SEQ ID NO: 525978 - RNA, 19 nt, Homo sapiens
gagcuaggaagagucuacc

SEQ ID NO: 525979 - RNA, 16 nt, Homo sapiens
gagcugccucugagau

SEQ ID NO: 525980 - RNA, 19 nt, Homo sapiens
gaggaaggaacagcaaugg

SEQ ID NO: 525981 - RNA, 20 nt, Homo sapiens
gaggcaggagagucacuuga

SEQ ID NO: 525982 - RNA, 17 nt, Homo sapiens
gaggcaggcggaucaug

SEQ ID NO: 525983 - RNA, 18 nt, Homo sapiens
gaggcccugcccaaugag

SEQ ID NO: 525984 - RNA, 15 nt, Homo sapiens
gaggcgcacagugug

SEQ ID NO: 525985 - RNA, 16 nt, Homo sapiens
gaggcgcacaguguga

SEQ ID NO: 525986 - RNA, 15 nt, Homo sapiens
gaggcuaauucugca

SEQ ID NO: 525987 - RNA, 21 nt, Homo sapiens
gaggcucuaauguacaauaaa

SEQ ID NO: 525988 - RNA, 15 nt, Homo sapiens
gagggagaagcauga

SEQ ID NO: 525989 - RNA, 21 nt, Homo sapiens
gaggggccggcccugugugca

SEQ ID NO: 525990 - RNA, 19 nt, Homo sapiens
gagucacugccaagucaua

SEQ ID NO: 525991 - RNA, 16 nt, Homo sapiens
gaguccuuucuuccau

SEQ ID NO: 525992 - RNA, 20 nt, Homo sapiens
gagucuuguuuuuuacucaa

SEQ ID NO: 525993 - RNA, 19 nt, Homo sapiens
gagugcaguggugugaucu

SEQ ID NO: 525994 - RNA, 13 nt, Homo sapiens
gagugcccugucc

SEQ ID NO: 525995 - RNA, 20 nt, Homo sapiens
gaguggcucacccuguccag

SEQ ID NO: 525996 - RNA, 16 nt, Homo sapiens
gaguguuauuugcaca

SEQ ID NO: 525997 - RNA, 21 nt, Homo sapiens
gaguguuauuugcacacugca

SEQ ID NO: 525998 - RNA, 21 nt, Homo sapiens
gaguuccuuaucccucucuuc

SEQ ID NO: 525999 - RNA, 23 nt, Homo sapiens
gaguuguucaaauguuccuuuua

SEQ ID NO: 526000 - RNA, 22 nt, Homo sapiens
gaguuuaauuuuugaaaacugg

SEQ ID NO: 526001 - RNA, 23 nt, Homo sapiens
gauaaaauuacaggauaucacau

SEQ ID NO: 526002 - RNA, 20 nt, Homo sapiens
gauaagacacccccucaaac

SEQ ID NO: 526003 - RNA, 15 nt, Homo sapiens
gauaaucuucaggug

SEQ ID NO: 526004 - RNA, 15 nt, Homo sapiens
gauaccugcacuguc

SEQ ID NO: 526005 - RNA, 18 nt, Homo sapiens
gauagauguugcucuuuc

SEQ ID NO: 526006 - RNA, 17 nt, Homo sapiens
gauagcaaauggccuca

SEQ ID NO: 526007 - RNA, 16 nt, Homo sapiens
gauagggaacugggga

SEQ ID NO: 526008 - RNA, 19 nt, Homo sapiens
gauaguugauucuugccuu

SEQ ID NO: 526009 - RNA, 23 nt, Homo sapiens
gauauccuuucacucugcauggu

SEQ ID NO: 526010 - RNA, 14 nt, Homo sapiens
gauauuacauuuau

SEQ ID NO: 526011 - RNA, 16 nt, Homo sapiens
gauauugaauguuaaa

SEQ ID NO: 526012 - RNA, 18 nt, Homo sapiens
gauauuucguguacugca

SEQ ID NO: 526013 - RNA, 17 nt, Homo sapiens
gaucaaauugugcagua

SEQ ID NO: 526014 - RNA, 19 nt, Homo sapiens
gaucaguguuguugcucua

SEQ ID NO: 526015 - RNA, 16 nt, Homo sapiens
gaucaucagugauacu

SEQ ID NO: 526016 - RNA, 21 nt, Homo sapiens
gaucauuuuuaacugauucuu

SEQ ID NO: 526017 - RNA, 17 nt, Homo sapiens
gauccagaacugcacuc

SEQ ID NO: 526018 - RNA, 15 nt, Homo sapiens
gauccccaaguggug

SEQ ID NO: 526019 - RNA, 21 nt, Homo sapiens
gaucgugggccgcacuggggc

SEQ ID NO: 526020 - RNA, 18 nt, Homo sapiens
gaucucugagaccacaga

SEQ ID NO: 526021 - RNA, 11 nt, Homo sapiens
gaucuggagaa

SEQ ID NO: 526022 - RNA, 22 nt, Homo sapiens
gaugacgugcuccguagcucug

SEQ ID NO: 526023 - RNA, 20 nt, Homo sapiens
gaugagaugguuucuagaga

SEQ ID NO: 526024 - RNA, 20 nt, Homo sapiens
gaugcuggcagccauggcca

SEQ ID NO: 526025 - RNA, 20 nt, Homo sapiens
gaugguggcccugaaccuca

SEQ ID NO: 526026 - RNA, 20 nt, Homo sapiens
gaugguguguucugcaauau

SEQ ID NO: 526027 - RNA, 15 nt, Homo sapiens
gauguaguaucucau

SEQ ID NO: 526028 - RNA, 22 nt, Homo sapiens
gauguggaucacgcagugcuuu

SEQ ID NO: 526029 - RNA, 19 nt, Homo sapiens
gauucuccagccaaccuca

SEQ ID NO: 526030 - RNA, 22 nt, Homo sapiens
gauugccccuggcuuugccucu

SEQ ID NO: 526031 - RNA, 18 nt, Homo sapiens
gauuguuuccucuuccaa

SEQ ID NO: 526032 - RNA, 16 nt, Homo sapiens
gauuuaauccaguuau

SEQ ID NO: 526033 - RNA, 15 nt, Homo sapiens
gauuucagcagggau

SEQ ID NO: 526034 - RNA, 14 nt, Homo sapiens
gauuuccuugacuu

SEQ ID NO: 526035 - RNA, 18 nt, Homo sapiens
gauuuuuuccucugcauu

SEQ ID NO: 526036 - RNA, 17 nt, Homo sapiens
gcaaacguuucuugaac

SEQ ID NO: 526037 - RNA, 14 nt, Homo sapiens
gcaaacuuacaggu

SEQ ID NO: 526038 - RNA, 15 nt, Homo sapiens
gcaaagggagcagaa

SEQ ID NO: 526039 - RNA, 13 nt, Homo sapiens
gcaaauguuaaaa

SEQ ID NO: 526040 - RNA, 15 nt, Homo sapiens
gcaaauuaacuguau

SEQ ID NO: 526041 - RNA, 17 nt, Homo sapiens
gcaacauuuguauggau

SEQ ID NO: 526042 - RNA, 16 nt, Homo sapiens
gcaagucuuccaugac

SEQ ID NO: 526043 - RNA, 18 nt, Homo sapiens
gcaauagcuagcuauaua

SEQ ID NO: 526044 - RNA, 15 nt, Homo sapiens
gcaaugaaagucaaa

SEQ ID NO: 526045 - RNA, 17 nt, Homo sapiens
gcaauuuuguguaaauu

SEQ ID NO: 526046 - RNA, 21 nt, Homo sapiens
gcacaagcugcggaagcugaa

SEQ ID NO: 526047 - RNA, 19 nt, Homo sapiens
gcacacagggcaguccuua

SEQ ID NO: 526048 - RNA, 21 nt, Homo sapiens
gcacaccggcuuaacacuauc

SEQ ID NO: 526049 - RNA, 13 nt, Homo sapiens
gcacacugcacug

SEQ ID NO: 526050 - RNA, 18 nt, Homo sapiens
gcacagaugggaucacag

SEQ ID NO: 526051 - RNA, 21 nt, Homo sapiens
gcacaguucaugguuuccucc

SEQ ID NO: 526052 - RNA, 20 nt, Homo sapiens
gcaccaguuauguuugaaug

SEQ ID NO: 526053 - RNA, 20 nt, Homo sapiens
gcaccucaccucccgaagcc

SEQ ID NO: 526054 - RNA, 19 nt, Homo sapiens
gcaccugcaugugcuguca

SEQ ID NO: 526055 - RNA, 17 nt, Homo sapiens
gcaccuguaaagugccu

SEQ ID NO: 526056 - RNA, 20 nt, Homo sapiens
gcaccuuaagauuuugcacc

SEQ ID NO: 526057 - RNA, 17 nt, Homo sapiens
gcaccuucacucuccag

SEQ ID NO: 526058 - RNA, 20 nt, Homo sapiens
gcaccuucacucuccagggu

SEQ ID NO: 526059 - RNA, 21 nt, Homo sapiens
gcacuggugguuuuugcucuc

SEQ ID NO: 526060 - RNA, 15 nt, Homo sapiens
gcacuguccugacca

SEQ ID NO: 526061 - RNA, 12 nt, Homo sapiens
gcacuguuuuca

SEQ ID NO: 526062 - RNA, 20 nt, Homo sapiens
gcacuuaaguguuagaucua

SEQ ID NO: 526063 - RNA, 23 nt, Homo sapiens
gcagaagaucaaggaguacaaug

SEQ ID NO: 526064 - RNA, 16 nt, Homo sapiens
gcagaagcccugaugu

SEQ ID NO: 526065 - RNA, 14 nt, Homo sapiens
gcagauacuuugaa

SEQ ID NO: 526066 - RNA, 12 nt, Homo sapiens
gcagaucacuug

SEQ ID NO: 526067 - RNA, 21 nt, Homo sapiens
gcagaucuacaugucuagaga

SEQ ID NO: 526068 - RNA, 14 nt, Homo sapiens
gcagcaggcagcuu

SEQ ID NO: 526069 - RNA, 14 nt, Homo sapiens
gcagccagggccag

SEQ ID NO: 526070 - RNA, 15 nt, Homo sapiens
gcagcuacucagagg

SEQ ID NO: 526071 - RNA, 16 nt, Homo sapiens
gcaggaguggugcaga

SEQ ID NO: 526072 - RNA, 20 nt, Homo sapiens
gcaggaguggugcagacaga

SEQ ID NO: 526073 - RNA, 23 nt, Homo sapiens
gcaggcuuucugggugugacuga

SEQ ID NO: 526074 - RNA, 20 nt, Homo sapiens
gcagggcagcagggaacaaa

SEQ ID NO: 526075 - RNA, 19 nt, Homo sapiens
gcagggcccacccauguca

SEQ ID NO: 526076 - RNA, 16 nt, Homo sapiens
gcaguauucuugcacu

SEQ ID NO: 526077 - RNA, 13 nt, Homo sapiens
gcagucagggaca

SEQ ID NO: 526078 - RNA, 13 nt, Homo sapiens
gcagucauaucaa

SEQ ID NO: 526079 - RNA, 22 nt, Homo sapiens
gcagucauggaggccaagaacu

SEQ ID NO: 526080 - RNA, 16 nt, Homo sapiens
gcaguccacaaagcau

SEQ ID NO: 526081 - RNA, 16 nt, Homo sapiens
gcagucccacacugug

SEQ ID NO: 526082 - RNA, 21 nt, Homo sapiens
gcagugagccgagaucaugcc

SEQ ID NO: 526083 - RNA, 15 nt, Homo sapiens
gcagugcuaaagccu

SEQ ID NO: 526084 - RNA, 23 nt, Homo sapiens
gcaguucugaguguuuaauuuca

SEQ ID NO: 526085 - RNA, 15 nt, Homo sapiens
gcaguuuaugagaca

SEQ ID NO: 526086 - RNA, 16 nt, Homo sapiens
gcauaauaacuacuuc

SEQ ID NO: 526087 - RNA, 14 nt, Homo sapiens
gcauaccacuugaa

SEQ ID NO: 526088 - RNA, 15 nt, Homo sapiens
gcauaccacuugaag

SEQ ID NO: 526089 - RNA, 15 nt, Homo sapiens
gcauauagacuguac

SEQ ID NO: 526090 - RNA, 18 nt, Homo sapiens
gcauauaguuaaacugag

SEQ ID NO: 526091 - RNA, 16 nt, Homo sapiens
gcauauauacuugcaa

SEQ ID NO: 526092 - RNA, 15 nt, Homo sapiens
gcaucaaggugcuga

SEQ ID NO: 526093 - RNA, 16 nt, Homo sapiens
gcaucuacacaauuua

SEQ ID NO: 526094 - RNA, 23 nt, Homo sapiens
gcaucuauuuccucugugcaaag

SEQ ID NO: 526095 - RNA, 15 nt, Homo sapiens
gcaugaaccuggacc

SEQ ID NO: 526096 - RNA, 20 nt, Homo sapiens
gcaugaauuggaacugcaau

SEQ ID NO: 526097 - RNA, 16 nt, Homo sapiens
gcaugccuguccuuuc

SEQ ID NO: 526098 - RNA, 14 nt, Homo sapiens
gcauggaacagcau

SEQ ID NO: 526099 - RNA, 22 nt, Homo sapiens
gcauggauccagaacugcacuc

SEQ ID NO: 526100 - RNA, 23 nt, Homo sapiens
gcaugguggaacccccaucucua

SEQ ID NO: 526101 - RNA, 14 nt, Homo sapiens
gcauuaaccugucu

SEQ ID NO: 526102 - RNA, 14 nt, Homo sapiens
gcauuccagccuug

SEQ ID NO: 526103 - RNA, 21 nt, Homo sapiens
gcauucuuuuggcaguucuga

SEQ ID NO: 526104 - RNA, 19 nt, Homo sapiens
gccaaccagagaagcugcu

SEQ ID NO: 526105 - RNA, 20 nt, Homo sapiens
gccaagagugcacuacugua

SEQ ID NO: 526106 - RNA, 18 nt, Homo sapiens
gccaauaauaaaugcccu

SEQ ID NO: 526107 - RNA, 12 nt, Homo sapiens
gccacagacuga

SEQ ID NO: 526108 - RNA, 21 nt, Homo sapiens
gccacaguggggcugcaggca

SEQ ID NO: 526109 - RNA, 21 nt, Homo sapiens
gccacucuuagcuaaaucccu

SEQ ID NO: 526110 - RNA, 16 nt, Homo sapiens
gccagacucugucuca

SEQ ID NO: 526111 - RNA, 16 nt, Homo sapiens
gccagaggugcuucac

SEQ ID NO: 526112 - RNA, 22 nt, Homo sapiens
gccagcugaagaguaaaggaaa

SEQ ID NO: 526113 - RNA, 19 nt, Homo sapiens
gccaggccuuacaucuggc

SEQ ID NO: 526114 - RNA, 16 nt, Homo sapiens
gccagggcugcccuga

SEQ ID NO: 526115 - RNA, 21 nt, Homo sapiens
gccagggggaugccacuccuc

SEQ ID NO: 526116 - RNA, 11 nt, Homo sapiens
gccagugcacc

SEQ ID NO: 526117 - RNA, 21 nt, Homo sapiens
gccaguggggccuguggaaug

SEQ ID NO: 526118 - RNA, 14 nt, Homo sapiens
gccaucaaaccugg

SEQ ID NO: 526119 - RNA, 15 nt, Homo sapiens
gccaucgaccuggag

SEQ ID NO: 526120 - RNA, 13 nt, Homo sapiens
gccaugccaggaa

SEQ ID NO: 526121 - RNA, 22 nt, Homo sapiens
gccauggcagacaguagacaga

SEQ ID NO: 526122 - RNA, 17 nt, Homo sapiens
gccauggugauggugua

SEQ ID NO: 526123 - RNA, 14 nt, Homo sapiens
gccauguccaaaga

SEQ ID NO: 526124 - RNA, 15 nt, Homo sapiens
gccauguccaaagag

SEQ ID NO: 526125 - RNA, 16 nt, Homo sapiens
gccauguccaaagagg

SEQ ID NO: 526126 - RNA, 18 nt, Homo sapiens
gccauugcauuccagccu

SEQ ID NO: 526127 - RNA, 22 nt, Homo sapiens
gcccaccuuccccagaaccagg

SEQ ID NO: 526128 - RNA, 21 nt, Homo sapiens
gcccaggaucguuuuuuccca

SEQ ID NO: 526129 - RNA, 20 nt, Homo sapiens
gcccccaauaaaggcagcug

SEQ ID NO: 526130 - RNA, 14 nt, Homo sapiens
gcccccagugccuc

SEQ ID NO: 526131 - RNA, 21 nt, Homo sapiens
gcccgcucugcagacugcugc

SEQ ID NO: 526132 - RNA, 20 nt, Homo sapiens
gcccucauuacugggccuua

SEQ ID NO: 526133 - RNA, 19 nt, Homo sapiens
gcccugagcuuuguccuga

SEQ ID NO: 526134 - RNA, 21 nt, Homo sapiens
gcccugauguguccucaggga

SEQ ID NO: 526135 - RNA, 16 nt, Homo sapiens
gcccugcuuagcucau

SEQ ID NO: 526136 - RNA, 18 nt, Homo sapiens
gcccuuccaugugccuuu

SEQ ID NO: 526137 - RNA, 19 nt, Homo sapiens
gcccuuccuccugccuuuc

SEQ ID NO: 526138 - RNA, 19 nt, Homo sapiens
gcccuugucgggcacagau

SEQ ID NO: 526139 - RNA, 16 nt, Homo sapiens
gcccuuuccuuccaga

SEQ ID NO: 526140 - RNA, 17 nt, Homo sapiens
gccggcaggccuggacu

SEQ ID NO: 526141 - RNA, 19 nt, Homo sapiens
gccuaaaauauauuccuga

SEQ ID NO: 526142 - RNA, 17 nt, Homo sapiens
gccuaccuccacaccac

SEQ ID NO: 526143 - RNA, 22 nt, Homo sapiens
gccuagcgaucucuccuggccu

SEQ ID NO: 526144 - RNA, 17 nt, Homo sapiens
gccucauuacugugagg

SEQ ID NO: 526145 - RNA, 23 nt, Homo sapiens
gccuccacaugcugccuggcaca

SEQ ID NO: 526146 - RNA, 22 nt, Homo sapiens
gccuccugggaacacaucuggc

SEQ ID NO: 526147 - RNA, 23 nt, Homo sapiens
gccuccugggaacacaucuggcu

SEQ ID NO: 526148 - RNA, 13 nt, Homo sapiens
gccuccugugacg

SEQ ID NO: 526149 - RNA, 14 nt, Homo sapiens
gccucuuguucaug

SEQ ID NO: 526150 - RNA, 19 nt, Homo sapiens
gccugcucccuagccagag

SEQ ID NO: 526151 - RNA, 14 nt, Homo sapiens
gccugcuucuucuc

SEQ ID NO: 526152 - RNA, 20 nt, Homo sapiens
gccuggccaacauggugaaa

SEQ ID NO: 526153 - RNA, 21 nt, Homo sapiens
gccugggguguuaguggcacc

SEQ ID NO: 526154 - RNA, 18 nt, Homo sapiens
gccuguggcuggcuggaa

SEQ ID NO: 526155 - RNA, 15 nt, Homo sapiens
gccuuaaugcuucau

SEQ ID NO: 526156 - RNA, 20 nt, Homo sapiens
gccuuacaucuggcuggaaa

SEQ ID NO: 526157 - RNA, 14 nt, Homo sapiens
gccuuaccuugaaa

SEQ ID NO: 526158 - RNA, 15 nt, Homo sapiens
gccuuagugggccag

SEQ ID NO: 526159 - RNA, 16 nt, Homo sapiens
gccuugagcccuggcu

SEQ ID NO: 526160 - RNA, 14 nt, Homo sapiens
gccuuguaccucaa

SEQ ID NO: 526161 - RNA, 13 nt, Homo sapiens
gcgagcagucagc

SEQ ID NO: 526162 - RNA, 13 nt, Homo sapiens
gcgcacugcauuc

SEQ ID NO: 526163 - RNA, 19 nt, Homo sapiens
gcgcuaccggccgggccua

SEQ ID NO: 526164 - RNA, 15 nt, Homo sapiens
gcgcucccuugccuu

SEQ ID NO: 526165 - RNA, 22 nt, Homo sapiens
gcggaccccucgucaucaggug

SEQ ID NO: 526166 - RNA, 13 nt, Homo sapiens
gcggagguugcag

SEQ ID NO: 526167 - RNA, 17 nt, Homo sapiens
gcggcuggaaucaguca

SEQ ID NO: 526168 - RNA, 13 nt, Homo sapiens
gcgggcuugacug

SEQ ID NO: 526169 - RNA, 22 nt, Homo sapiens
gcgguggcucacgccuguaauc

SEQ ID NO: 526170 - RNA, 15 nt, Homo sapiens
gcgucaucuguguaa

SEQ ID NO: 526171 - RNA, 19 nt, Homo sapiens
gcgugagauccggcagcac

SEQ ID NO: 526172 - RNA, 19 nt, Homo sapiens
gcgugauccaccacaccug

SEQ ID NO: 526173 - RNA, 15 nt, Homo sapiens
gcuagaaggcaaagu

SEQ ID NO: 526174 - RNA, 15 nt, Homo sapiens
gcuaguguaccuccu

SEQ ID NO: 526175 - RNA, 22 nt, Homo sapiens
gcuaucaucauccuacaacuca

SEQ ID NO: 526176 - RNA, 13 nt, Homo sapiens
gcucacaguacag

SEQ ID NO: 526177 - RNA, 13 nt, Homo sapiens
gcucacugcugau

SEQ ID NO: 526178 - RNA, 14 nt, Homo sapiens
gcuccaggccugca

SEQ ID NO: 526179 - RNA, 22 nt, Homo sapiens
gcuccaucccaaccaggcaccu

SEQ ID NO: 526180 - RNA, 16 nt, Homo sapiens
gcuccccucacucugu

SEQ ID NO: 526181 - RNA, 23 nt, Homo sapiens
gcucguuuccccacacaugccua

SEQ ID NO: 526182 - RNA, 14 nt, Homo sapiens
gcucuaauguacaa

SEQ ID NO: 526183 - RNA, 21 nt, Homo sapiens
gcucuccugacgcagcacaag

SEQ ID NO: 526184 - RNA, 20 nt, Homo sapiens
gcucugcagacugcugcuag

SEQ ID NO: 526185 - RNA, 14 nt, Homo sapiens
gcugagagaccuga

SEQ ID NO: 526186 - RNA, 14 nt, Homo sapiens
gcugagaucgugcu

SEQ ID NO: 526187 - RNA, 19 nt, Homo sapiens
gcugauacugggucugcga

SEQ ID NO: 526188 - RNA, 14 nt, Homo sapiens
gcugauugaagaca

SEQ ID NO: 526189 - RNA, 22 nt, Homo sapiens
gcugauugaagacacacucagc

SEQ ID NO: 526190 - RNA, 17 nt, Homo sapiens
gcugcaaagccuuucca

SEQ ID NO: 526191 - RNA, 20 nt, Homo sapiens
gcugcaccuucacucuccag

SEQ ID NO: 526192 - RNA, 14 nt, Homo sapiens
gcugccccaugugu

SEQ ID NO: 526193 - RNA, 17 nt, Homo sapiens
gcuggaaaaaggugaau

SEQ ID NO: 526194 - RNA, 20 nt, Homo sapiens
gcuggcaagucuuccaugac

SEQ ID NO: 526195 - RNA, 16 nt, Homo sapiens
gcugggccauguccaa

SEQ ID NO: 526196 - RNA, 17 nt, Homo sapiens
gcugggccauguccaaa

SEQ ID NO: 526197 - RNA, 18 nt, Homo sapiens
gcugggccauguccaaag

SEQ ID NO: 526198 - RNA, 20 nt, Homo sapiens
gcuggggggauguucugccu

SEQ ID NO: 526199 - RNA, 20 nt, Homo sapiens
gcuggucucaaacuccugac

SEQ ID NO: 526200 - RNA, 13 nt, Homo sapiens
gcuggugaauauu

SEQ ID NO: 526201 - RNA, 16 nt, Homo sapiens
gcugucaagcaccugc

SEQ ID NO: 526202 - RNA, 15 nt, Homo sapiens
gcuuauaugugacac

SEQ ID NO: 526203 - RNA, 18 nt, Homo sapiens
gcuuaucuuagaagcacu

SEQ ID NO: 526204 - RNA, 12 nt, Homo sapiens
gcuuaugugaca

SEQ ID NO: 526205 - RNA, 18 nt, Homo sapiens
gcuucaguuuuacucugc

SEQ ID NO: 526206 - RNA, 15 nt, Homo sapiens
gcuucuguugaucuc

SEQ ID NO: 526207 - RNA, 16 nt, Homo sapiens
gcuucuguugaucuca

SEQ ID NO: 526208 - RNA, 17 nt, Homo sapiens
gcuucuguugaucucag

SEQ ID NO: 526209 - RNA, 15 nt, Homo sapiens
gcuugacauaccuac

SEQ ID NO: 526210 - RNA, 16 nt, Homo sapiens
gcuugcaauguaguca

SEQ ID NO: 526211 - RNA, 19 nt, Homo sapiens
gcuuggcccuuuccuucca

SEQ ID NO: 526212 - RNA, 13 nt, Homo sapiens
gcuuuacugccuu

SEQ ID NO: 526213 - RNA, 21 nt, Homo sapiens
gcuuuuccacugccugggaug

SEQ ID NO: 526214 - RNA, 15 nt, Homo sapiens
gcuuuucggcaaagc

SEQ ID NO: 526215 - RNA, 17 nt, Homo sapiens
gcuuuugcuugcaaugu

SEQ ID NO: 526216 - RNA, 12 nt, Homo sapiens
ggaaaacgugaa

SEQ ID NO: 526217 - RNA, 14 nt, Homo sapiens
ggaaacaguccaaa

SEQ ID NO: 526218 - RNA, 19 nt, Homo sapiens
ggaaacaguccaaacuguu

SEQ ID NO: 526219 - RNA, 19 nt, Homo sapiens
ggaaacuaguguacauuuc

SEQ ID NO: 526220 - RNA, 17 nt, Homo sapiens
ggaaacucacacucccc

SEQ ID NO: 526221 - RNA, 20 nt, Homo sapiens
ggaaagagagcaccacguga

SEQ ID NO: 526222 - RNA, 20 nt, Homo sapiens
ggaaagcuuaaaacccaaua

SEQ ID NO: 526223 - RNA, 20 nt, Homo sapiens
ggaaaguuuucuccacugga

SEQ ID NO: 526224 - RNA, 18 nt, Homo sapiens
ggaaauccauuccauuuu

SEQ ID NO: 526225 - RNA, 21 nt, Homo sapiens
ggaacacaucuggcugcacag

SEQ ID NO: 526226 - RNA, 21 nt, Homo sapiens
uguaaaccuagaguuuuauca

SEQ ID NO: 526227 - RNA, 14 nt, Homo sapiens
uguaacaucaggga

SEQ ID NO: 526228 - RNA, 15 nt, Homo sapiens
uguaacaucagggac

SEQ ID NO: 526229 - RNA, 12 nt, Homo sapiens
uguaacugcuga

SEQ ID NO: 526230 - RNA, 15 nt, Homo sapiens
uguaagugggcccac

SEQ ID NO: 526231 - RNA, 20 nt, Homo sapiens
uguaauccuugcauuuugga

SEQ ID NO: 526232 - RNA, 20 nt, Homo sapiens
uguaaugugugguggccuca

SEQ ID NO: 526233 - RNA, 19 nt, Homo sapiens
uguacagaaaguaucacaa

SEQ ID NO: 526234 - RNA, 21 nt, Homo sapiens
uguacagaaaguaucacaaau

SEQ ID NO: 526235 - RNA, 17 nt, Homo sapiens
uguacagauucuuucag

SEQ ID NO: 526236 - RNA, 18 nt, Homo sapiens
uguacauuaugaagaaua

SEQ ID NO: 526237 - RNA, 20 nt, Homo sapiens
uguaccaccaacuacuaccu

SEQ ID NO: 526238 - RNA, 15 nt, Homo sapiens
uguaccucaaucuau

SEQ ID NO: 526239 - RNA, 18 nt, Homo sapiens
uguacugugucucaugga

SEQ ID NO: 526240 - RNA, 13 nt, Homo sapiens
uguagaaggccag

SEQ ID NO: 526241 - RNA, 15 nt, Homo sapiens
uguagacugugccag

SEQ ID NO: 526242 - RNA, 16 nt, Homo sapiens
uguagcauaacuguag

SEQ ID NO: 526243 - RNA, 17 nt, Homo sapiens
uguagcuacauuuucag

SEQ ID NO: 526244 - RNA, 21 nt, Homo sapiens
uguagucccagcuacuuggga

SEQ ID NO: 526245 - RNA, 23 nt, Homo sapiens
uguauauuuguuuuaugcuacug

SEQ ID NO: 526246 - RNA, 20 nt, Homo sapiens
uguauggaaucccacuguau

SEQ ID NO: 526247 - RNA, 11 nt, Homo sapiens
uguauguuaaa

SEQ ID NO: 526248 - RNA, 14 nt, Homo sapiens
uguauucgugcauu

SEQ ID NO: 526249 - RNA, 20 nt, Homo sapiens
ugucaagaauagcauuguaa

SEQ ID NO: 526250 - RNA, 20 nt, Homo sapiens
ugucagcuacuaaugauguu

SEQ ID NO: 526251 - RNA, 16 nt, Homo sapiens
ugucaggggaacagag

SEQ ID NO: 526252 - RNA, 15 nt, Homo sapiens
ugucaggguccagga

SEQ ID NO: 526253 - RNA, 14 nt, Homo sapiens
ugucauaacaucca

SEQ ID NO: 526254 - RNA, 14 nt, Homo sapiens
ugucauccucaugc

SEQ ID NO: 526255 - RNA, 17 nt, Homo sapiens
uguccacgauucacuca

SEQ ID NO: 526256 - RNA, 17 nt, Homo sapiens
ugucgaauuccuacuga

SEQ ID NO: 526257 - RNA, 17 nt, Homo sapiens
ugucuaaaaugucagug

SEQ ID NO: 526258 - RNA, 18 nt, Homo sapiens
ugucucaaaacaaacaaa

SEQ ID NO: 526259 - RNA, 15 nt, Homo sapiens
ugucucaucugugcu

SEQ ID NO: 526260 - RNA, 23 nt, Homo sapiens
ugucucaugucaaugaccauuca

SEQ ID NO: 526261 - RNA, 11 nt, Homo sapiens
ugucuggucuu

SEQ ID NO: 526262 - RNA, 20 nt, Homo sapiens
ugugaaacauuuuuucuucu

SEQ ID NO: 526263 - RNA, 16 nt, Homo sapiens
ugugaagcaaggagcu

SEQ ID NO: 526264 - RNA, 17 nt, Homo sapiens
ugugaauaauggcacug

SEQ ID NO: 526265 - RNA, 14 nt, Homo sapiens
ugugacugucacuu

SEQ ID NO: 526266 - RNA, 18 nt, Homo sapiens
ugugauauuucguguacu

SEQ ID NO: 526267 - RNA, 17 nt, Homo sapiens
ugugcaccuguaauccc

SEQ ID NO: 526268 - RNA, 21 nt, Homo sapiens
ugugccccacacuaacgugug

SEQ ID NO: 526269 - RNA, 14 nt, Homo sapiens
ugugccuauagucc

SEQ ID NO: 526270 - RNA, 13 nt, Homo sapiens
ugugcugugacaa

SEQ ID NO: 526271 - RNA, 21 nt, Homo sapiens
uguggaaagaaagaccaucuc

SEQ ID NO: 526272 - RNA, 12 nt, Homo sapiens
uguggacacugc

SEQ ID NO: 526273 - RNA, 16 nt, Homo sapiens
uguggauggucauugc

SEQ ID NO: 526274 - RNA, 12 nt, Homo sapiens
uguggucauccu

SEQ ID NO: 526275 - RNA, 15 nt, Homo sapiens
uguggucauccugcc

SEQ ID NO: 526276 - RNA, 13 nt, Homo sapiens
uguggucucagga

SEQ ID NO: 526277 - RNA, 14 nt, Homo sapiens
ugugguuugucaga

SEQ ID NO: 526278 - RNA, 19 nt, Homo sapiens
uguguauuuccagugcaau

SEQ ID NO: 526279 - RNA, 22 nt, Homo sapiens
ugugucucccgugcaugcucug

SEQ ID NO: 526280 - RNA, 16 nt, Homo sapiens
ugugugcgugcgcauc

SEQ ID NO: 526281 - RNA, 16 nt, Homo sapiens
uguguggcagagccag

SEQ ID NO: 526282 - RNA, 13 nt, Homo sapiens
ugugugugugcgu

SEQ ID NO: 526283 - RNA, 14 nt, Homo sapiens
uguguguguguaca

SEQ ID NO: 526284 - RNA, 18 nt, Homo sapiens
uguguuuuuaacauguca

SEQ ID NO: 526285 - RNA, 20 nt, Homo sapiens
uguuacugacuccucagucc

SEQ ID NO: 526286 - RNA, 14 nt, Homo sapiens
uguuauuugcacac

SEQ ID NO: 526287 - RNA, 22 nt, Homo sapiens
uguuauuugcacacugcacugu

SEQ ID NO: 526288 - RNA, 13 nt, Homo sapiens
uguucuacacuca

SEQ ID NO: 526289 - RNA, 18 nt, Homo sapiens
uguucuagaaacauguaa

SEQ ID NO: 526290 - RNA, 11 nt, Homo sapiens
uguucugagaa

SEQ ID NO: 526291 - RNA, 14 nt, Homo sapiens
uguugacauacauu

SEQ ID NO: 526292 - RNA, 22 nt, Homo sapiens
uguugaggacaauuucauucca

SEQ ID NO: 526293 - RNA, 20 nt, Homo sapiens
uguugguauuauauaauuca

SEQ ID NO: 526294 - RNA, 22 nt, Homo sapiens
uguuucgguugacccaggucau

SEQ ID NO: 526295 - RNA, 21 nt, Homo sapiens
uguuucuuucucugaggacaa

SEQ ID NO: 526296 - RNA, 23 nt, Homo sapiens
uguuugguaguuagccaucuaau

SEQ ID NO: 526297 - RNA, 14 nt, Homo sapiens
uguuuuccuauaau

SEQ ID NO: 526298 - RNA, 16 nt, Homo sapiens
uguuuuugacagccuu

SEQ ID NO: 526299 - RNA, 14 nt, Homo sapiens
uguuuuuuacucaa

SEQ ID NO: 526300 - RNA, 20 nt, Homo sapiens
uuaaaaagcucacugcugau

SEQ ID NO: 526301 - RNA, 14 nt, Homo sapiens
uuaaaaucaguauu

SEQ ID NO: 526302 - RNA, 16 nt, Homo sapiens
uuaaaaucaugauccu

SEQ ID NO: 526303 - RNA, 20 nt, Homo sapiens
uuaaaauugcuauguuacua

SEQ ID NO: 526304 - RNA, 12 nt, Homo sapiens
uuaaacuuucaa

SEQ ID NO: 526305 - RNA, 20 nt, Homo sapiens
uuaaagaccaauaaacuucc

SEQ ID NO: 526306 - RNA, 19 nt, Homo sapiens
uuaacucaccucucaaggu

SEQ ID NO: 526307 - RNA, 15 nt, Homo sapiens
uuaagaagacauacu

SEQ ID NO: 526308 - RNA, 16 nt, Homo sapiens
uuaauaaaccuuugca

SEQ ID NO: 526309 - RNA, 20 nt, Homo sapiens
uuaauacauugaucaggcca

SEQ ID NO: 526310 - RNA, 14 nt, Homo sapiens
uuaaucacugcauu

SEQ ID NO: 526311 - RNA, 18 nt, Homo sapiens
uuaauguuaacaagacaa

SEQ ID NO: 526312 - RNA, 14 nt, Homo sapiens
uuaauuaaaagugu

SEQ ID NO: 526313 - RNA, 23 nt, Homo sapiens
uuacaaucaaaucuccugcugau

SEQ ID NO: 526314 - RNA, 20 nt, Homo sapiens
uuacacuuuuuggaagugaa

SEQ ID NO: 526315 - RNA, 20 nt, Homo sapiens
uuacaggauaucacauugga

SEQ ID NO: 526316 - RNA, 20 nt, Homo sapiens
uuacauuuauuuauccagaa

SEQ ID NO: 526317 - RNA, 10 nt, Homo sapiens
uuaccaucug

SEQ ID NO: 526318 - RNA, 15 nt, Homo sapiens
uuaccuccucauggc

SEQ ID NO: 526319 - RNA, 17 nt, Homo sapiens
uuacgacccaggacaau

SEQ ID NO: 526320 - RNA, 21 nt, Homo sapiens
uuacguauguuuguacuuggu

SEQ ID NO: 526321 - RNA, 21 nt, Homo sapiens
uuacuaacuaaauaccauuca

SEQ ID NO: 526322 - RNA, 16 nt, Homo sapiens
uuagaauguugaaaag

SEQ ID NO: 526323 - RNA, 21 nt, Homo sapiens
uuagauaaauuguagggcuuu

SEQ ID NO: 526324 - RNA, 20 nt, Homo sapiens
uuagaugaggaaaugauccc

SEQ ID NO: 526325 - RNA, 18 nt, Homo sapiens
uuagaugggcaugguggu

SEQ ID NO: 526326 - RNA, 17 nt, Homo sapiens
uuagccaggaggccagg

SEQ ID NO: 526327 - RNA, 20 nt, Homo sapiens
uuaguuguccacaaaucuuc

SEQ ID NO: 526328 - RNA, 21 nt, Homo sapiens
uuauaaauaaacuguugcucg

SEQ ID NO: 526329 - RNA, 17 nt, Homo sapiens
uuauaaguaaagacagc

SEQ ID NO: 526330 - RNA, 18 nt, Homo sapiens
uuauaauaaauauauaca

SEQ ID NO: 526331 - RNA, 14 nt, Homo sapiens
uuauacaugugaua

SEQ ID NO: 526332 - RNA, 12 nt, Homo sapiens
uuauauaauuca

SEQ ID NO: 526333 - RNA, 17 nt, Homo sapiens
uuauaugugacacugca

SEQ ID NO: 526334 - RNA, 19 nt, Homo sapiens
uuaucauuaaaaauuaccu

SEQ ID NO: 526335 - RNA, 13 nt, Homo sapiens
uuaucauugcuaa

SEQ ID NO: 526336 - RNA, 19 nt, Homo sapiens
uuauccagaaaacugugau

SEQ ID NO: 526337 - RNA, 23 nt, Homo sapiens
uuaucuuuuuaaaaacucuucag

SEQ ID NO: 526338 - RNA, 14 nt, Homo sapiens
uuaugaaaugaccu

SEQ ID NO: 526339 - RNA, 23 nt, Homo sapiens
uuauggcagaagggaauugcuca

SEQ ID NO: 526340 - RNA, 13 nt, Homo sapiens
uuauuaaguaaaa

SEQ ID NO: 526341 - RNA, 14 nt, Homo sapiens
uuauucugugcgcu

SEQ ID NO: 526342 - RNA, 22 nt, Homo sapiens
uuauugguguaagguacuuuca

SEQ ID NO: 526343 - RNA, 14 nt, Homo sapiens
uuauuguuaauaca

SEQ ID NO: 526344 - RNA, 17 nt, Homo sapiens
uuauuguuguacauacg

SEQ ID NO: 526345 - RNA, 19 nt, Homo sapiens
uuauuguuguugccaaaga

SEQ ID NO: 526346 - RNA, 14 nt, Homo sapiens
uuauuucugaucua

SEQ ID NO: 526347 - RNA, 18 nt, Homo sapiens
uucaacaguuuuugcuaa

SEQ ID NO: 526348 - RNA, 16 nt, Homo sapiens
uucaagugcacugagc

SEQ ID NO: 526349 - RNA, 15 nt, Homo sapiens
uucagaaguuaacau

SEQ ID NO: 526350 - RNA, 18 nt, Homo sapiens
uucagaguccuugcaaaa

SEQ ID NO: 526351 - RNA, 13 nt, Homo sapiens
uucagccaccagc

SEQ ID NO: 526352 - RNA, 17 nt, Homo sapiens
uucauauuuuaaacaga

SEQ ID NO: 526353 - RNA, 14 nt, Homo sapiens
uucaucaaacauug

SEQ ID NO: 526354 - RNA, 20 nt, Homo sapiens
uucaucaggaaggaaaugac

SEQ ID NO: 526355 - RNA, 21 nt, Homo sapiens
uucauccuagucuagcauucu

SEQ ID NO: 526356 - RNA, 18 nt, Homo sapiens
uucaugagcuugaacaag

SEQ ID NO: 526357 - RNA, 15 nt, Homo sapiens
uucaugcuugccauc

SEQ ID NO: 526358 - RNA, 17 nt, Homo sapiens
uucaugguuuccuccag

SEQ ID NO: 526359 - RNA, 21 nt, Homo sapiens
uucauguugcaaagaacucca

SEQ ID NO: 526360 - RNA, 19 nt, Homo sapiens
uuccaaggaagcagaagac

SEQ ID NO: 526361 - RNA, 17 nt, Homo sapiens
uuccaugguuaccugac

SEQ ID NO: 526362 - RNA, 23 nt, Homo sapiens
uuccauuuugugaauugugacau

SEQ ID NO: 526363 - RNA, 15 nt, Homo sapiens
uucccaucuccauug

SEQ ID NO: 526364 - RNA, 15 nt, Homo sapiens
uuccccaacagggca

SEQ ID NO: 526365 - RNA, 21 nt, Homo sapiens
uucccgcccagccucacuucc

SEQ ID NO: 526366 - RNA, 19 nt, Homo sapiens
uucccucuugcucaguggg

SEQ ID NO: 526367 - RNA, 23 nt, Homo sapiens
uucccuucuuucaggaauacuug

SEQ ID NO: 526368 - RNA, 13 nt, Homo sapiens
uuccgcagugugg

SEQ ID NO: 526369 - RNA, 14 nt, Homo sapiens
uuccuccuuauccu

SEQ ID NO: 526370 - RNA, 19 nt, Homo sapiens
uuccugaauuggaaaggaa

SEQ ID NO: 526371 - RNA, 21 nt, Homo sapiens
uuccugcgcauauagacugua

SEQ ID NO: 526372 - RNA, 18 nt, Homo sapiens
uuccuugacuucuuugag

SEQ ID NO: 526373 - RNA, 18 nt, Homo sapiens
uucgguugacccagguca

SEQ ID NO: 526374 - RNA, 21 nt, Homo sapiens
uucguaacggccuugaucccc

SEQ ID NO: 526375 - RNA, 23 nt, Homo sapiens
uucguggggaacugcguggugcu

SEQ ID NO: 526376 - RNA, 17 nt, Homo sapiens
uucuaaaaacacacaca

SEQ ID NO: 526377 - RNA, 14 nt, Homo sapiens
uucuaaaugcauau

SEQ ID NO: 526378 - RNA, 23 nt, Homo sapiens
uucuacuucuggaagucaucuca

SEQ ID NO: 526379 - RNA, 21 nt, Homo sapiens
uucuacuuuaagguuugcaga

SEQ ID NO: 526380 - RNA, 13 nt, Homo sapiens
uucucaucacuca

SEQ ID NO: 526381 - RNA, 20 nt, Homo sapiens
uucucaucacucaaccuuau

SEQ ID NO: 526382 - RNA, 19 nt, Homo sapiens
uucuccuggccccugccug

SEQ ID NO: 526383 - RNA, 23 nt, Homo sapiens
uucugaggcccugcccaaugaga

SEQ ID NO: 526384 - RNA, 15 nt, Homo sapiens
uucugcaauaugccu

SEQ ID NO: 526385 - RNA, 18 nt, Homo sapiens
uucugcccgcuccaugga

SEQ ID NO: 526386 - RNA, 14 nt, Homo sapiens
uucuggauaccauu

SEQ ID NO: 526387 - RNA, 15 nt, Homo sapiens
uucuguugaucucag

SEQ ID NO: 526388 - RNA, 14 nt, Homo sapiens
uucuuacacacugu

SEQ ID NO: 526389 - RNA, 19 nt, Homo sapiens
uucuucacauguuuaacuu

SEQ ID NO: 526390 - RNA, 15 nt, Homo sapiens
uucuuggugguggau

SEQ ID NO: 526391 - RNA, 12 nt, Homo sapiens
uucuuucaggaa

SEQ ID NO: 526392 - RNA, 16 nt, Homo sapiens
uucuuucccauguauu

SEQ ID NO: 526393 - RNA, 19 nt, Homo sapiens
uugaaaauauuuuguugcc

SEQ ID NO: 526394 - RNA, 11 nt, Homo sapiens
uugaaagaaga

SEQ ID NO: 526395 - RNA, 18 nt, Homo sapiens
uugaaaugccucuugacc

SEQ ID NO: 526396 - RNA, 23 nt, Homo sapiens
uugaaauguuuaauaaagcuuua

SEQ ID NO: 526397 - RNA, 21 nt, Homo sapiens
uugaacaagaugugggccuug

SEQ ID NO: 526398 - RNA, 20 nt, Homo sapiens
uugaacucuuagugauugag

SEQ ID NO: 526399 - RNA, 13 nt, Homo sapiens
uugaagucuuuaa

SEQ ID NO: 526400 - RNA, 17 nt, Homo sapiens
uugaccgggagacagag

SEQ ID NO: 526401 - RNA, 14 nt, Homo sapiens
uugacucugcauuu

SEQ ID NO: 526402 - RNA, 12 nt, Homo sapiens
uugacugcauug

SEQ ID NO: 526403 - RNA, 20 nt, Homo sapiens
uugacuucuuugagaaugca

SEQ ID NO: 526404 - RNA, 15 nt, Homo sapiens
uugagaccauuucaa

SEQ ID NO: 526405 - RNA, 22 nt, Homo sapiens
uugauacaacauuaaggaauuu

SEQ ID NO: 526406 - RNA, 16 nt, Homo sapiens
uugauaccugcacugu

SEQ ID NO: 526407 - RNA, 12 nt, Homo sapiens
uugauacuugaa

SEQ ID NO: 526408 - RNA, 15 nt, Homo sapiens
uugaucuguucuggg

SEQ ID NO: 526409 - RNA, 14 nt, Homo sapiens
uugauugcacuuga

SEQ ID NO: 526410 - RNA, 14 nt, Homo sapiens
uugcaauguaguca

SEQ ID NO: 526411 - RNA, 18 nt, Homo sapiens
uugcagccagggccagug

SEQ ID NO: 526412 - RNA, 22 nt, Homo sapiens
uugcaggugacauuugcucuga

SEQ ID NO: 526413 - RNA, 18 nt, Homo sapiens
uugccaaagagaaacaaa

SEQ ID NO: 526414 - RNA, 15 nt, Homo sapiens
uugccacugcuguau

SEQ ID NO: 526415 - RNA, 19 nt, Homo sapiens
uugccugaggggaaagaga

SEQ ID NO: 526416 - RNA, 17 nt, Homo sapiens
uugcgauggcgugggcu

SEQ ID NO: 526417 - RNA, 21 nt, Homo sapiens
uugcggaagcuguuggaugau

SEQ ID NO: 526418 - RNA, 14 nt, Homo sapiens
uugcugaacucagc

SEQ ID NO: 526419 - RNA, 11 nt, Homo sapiens
uugcugcaaag

SEQ ID NO: 526420 - RNA, 17 nt, Homo sapiens
uuggaaagacuucucaa

SEQ ID NO: 526421 - RNA, 20 nt, Homo sapiens
uuggaaagacuucucaaaga

SEQ ID NO: 526422 - RNA, 21 nt, Homo sapiens
uuggaagaggaacagcacugg

SEQ ID NO: 526423 - RNA, 18 nt, Homo sapiens
uuggacuguaagggauug

SEQ ID NO: 526424 - RNA, 15 nt, Homo sapiens
uuggagaaaguauuu

SEQ ID NO: 526425 - RNA, 20 nt, Homo sapiens
uuggagcugucccaccugca

SEQ ID NO: 526426 - RNA, 18 nt, Homo sapiens
uuggaugguguuacauau

SEQ ID NO: 526427 - RNA, 23 nt, Homo sapiens
uuggcucccgggggccccaccuc

SEQ ID NO: 526428 - RNA, 15 nt, Homo sapiens
uuggcuuaucauggg

SEQ ID NO: 526429 - RNA, 20 nt, Homo sapiens
uugggauauccuuucacucu

SEQ ID NO: 526430 - RNA, 16 nt, Homo sapiens
uuggggcccagugcau

SEQ ID NO: 526431 - RNA, 15 nt, Homo sapiens
uugguguugacauac

SEQ ID NO: 526432 - RNA, 21 nt, Homo sapiens
uugguuuuguuuucuucacua

SEQ ID NO: 526433 - RNA, 18 nt, Homo sapiens
uuguaaaugaaacuuaag

SEQ ID NO: 526434 - RNA, 17 nt, Homo sapiens
uuguaauguaucaaaua

SEQ ID NO: 526435 - RNA, 22 nt, Homo sapiens
uuguauauauggaucagaggag

SEQ ID NO: 526436 - RNA, 15 nt, Homo sapiens
uuguauuuaaggauu

SEQ ID NO: 526437 - RNA, 21 nt, Homo sapiens
uugucaccucugugaccccuc

SEQ ID NO: 526438 - RNA, 13 nt, Homo sapiens
uugugaauuguga

SEQ ID NO: 526439 - RNA, 13 nt, Homo sapiens
uugugacugucac

SEQ ID NO: 526440 - RNA, 14 nt, Homo sapiens
uuguggugcauuga

SEQ ID NO: 526441 - RNA, 14 nt, Homo sapiens
uuguuccacugcaa

SEQ ID NO: 526442 - RNA, 18 nt, Homo sapiens
uuguugccuucaucuuca

SEQ ID NO: 526443 - RNA, 18 nt, Homo sapiens
uuguuuuaugcuacugaa

SEQ ID NO: 526444 - RNA, 18 nt, Homo sapiens
uuguuuuuauuguaaaac

SEQ ID NO: 526445 - RNA, 16 nt, Homo sapiens
uuuaaaaucuguucac

SEQ ID NO: 526446 - RNA, 20 nt, Homo sapiens
uuuaacuuuaaggauuugaa

SEQ ID NO: 526447 - RNA, 23 nt, Homo sapiens
uuuaagggauugcuuucaucuaa

SEQ ID NO: 526448 - RNA, 21 nt, Homo sapiens
uuuaaguggcauuucuaugca

SEQ ID NO: 526449 - RNA, 14 nt, Homo sapiens
uuuaauaccagaua

SEQ ID NO: 526450 - RNA, 11 nt, Homo sapiens
uuuacuuuaaa

SEQ ID NO: 526451 - RNA, 14 nt, Homo sapiens
uuuagaaacugaaa

SEQ ID NO: 526452 - RNA, 13 nt, Homo sapiens
uuuaguagccuca

SEQ ID NO: 526453 - RNA, 11 nt, Homo sapiens
uuuaugaaaug

SEQ ID NO: 526454 - RNA, 14 nt, Homo sapiens
uuucaaagcacuua

SEQ ID NO: 526455 - RNA, 18 nt, Homo sapiens
uuucacacacgugagaau

SEQ ID NO: 526456 - RNA, 14 nt, Homo sapiens
uuucaugcagaguu

SEQ ID NO: 526457 - RNA, 18 nt, Homo sapiens
uuucauuacuguguucaa

SEQ ID NO: 526458 - RNA, 18 nt, Homo sapiens
uuucauugaugagcaaga

SEQ ID NO: 526459 - RNA, 15 nt, Homo sapiens
uuuccaaaaccagaa

SEQ ID NO: 526460 - RNA, 17 nt, Homo sapiens
uuucccaucuccauugu

SEQ ID NO: 526461 - RNA, 13 nt, Homo sapiens
uuucccauugcca

SEQ ID NO: 526462 - RNA, 17 nt, Homo sapiens
uuucccuuuauuucucu

SEQ ID NO: 526463 - RNA, 17 nt, Homo sapiens
uuuccuagcuguguuau

SEQ ID NO: 526464 - RNA, 19 nt, Homo sapiens
uuuccucugugcaaaggga

SEQ ID NO: 526465 - RNA, 16 nt, Homo sapiens
uuuccugcagggccag

SEQ ID NO: 526466 - RNA, 12 nt, Homo sapiens
uuuccuuccaga

SEQ ID NO: 526467 - RNA, 14 nt, Homo sapiens
uuucuaaaaacaca

SEQ ID NO: 526468 - RNA, 19 nt, Homo sapiens
uuucuaacgccagcacacu

SEQ ID NO: 526469 - RNA, 14 nt, Homo sapiens
uuucuacaggccag

SEQ ID NO: 526470 - RNA, 17 nt, Homo sapiens
uuucucaacuucucuac

SEQ ID NO: 526471 - RNA, 20 nt, Homo sapiens
uuucucauaggcuaugccau

SEQ ID NO: 526472 - RNA, 23 nt, Homo sapiens
uuucuguaauguaaauaaacuau

SEQ ID NO: 526473 - RNA, 23 nt, Homo sapiens
uuucuuaguguuguggacacugc

SEQ ID NO: 526474 - RNA, 13 nt, Homo sapiens
uuucuuccaugau

SEQ ID NO: 526475 - RNA, 14 nt, Homo sapiens
uuucuuuaucauug

SEQ ID NO: 526476 - RNA, 18 nt, Homo sapiens
uuugaaacaaaguacucu

SEQ ID NO: 526477 - RNA, 20 nt, Homo sapiens
uuugagccauuuaaagacca

SEQ ID NO: 526478 - RNA, 15 nt, Homo sapiens
uuugagcgcgcugag

SEQ ID NO: 526479 - RNA, 14 nt, Homo sapiens
uuugauucuccagc

SEQ ID NO: 526480 - RNA, 13 nt, Homo sapiens
uuugcaaacguuc

SEQ ID NO: 526481 - RNA, 18 nt, Homo sapiens
uuugcacacugcacuguu

SEQ ID NO: 526482 - RNA, 15 nt, Homo sapiens
uuugcaugcaugcaa

SEQ ID NO: 526483 - RNA, 17 nt, Homo sapiens
uuugcaugcaugcaaau

SEQ ID NO: 526484 - RNA, 17 nt, Homo sapiens
uuugcuuaaaauuguga

SEQ ID NO: 526485 - RNA, 17 nt, Homo sapiens
uuuggacaggaguuaau

SEQ ID NO: 526486 - RNA, 23 nt, Homo sapiens
uuugggaaaauaaauacauucga

SEQ ID NO: 526487 - RNA, 12 nt, Homo sapiens
uuugggcugugg

SEQ ID NO: 526488 - RNA, 19 nt, Homo sapiens
uuuggugggcuuuggagcu

SEQ ID NO: 526489 - RNA, 13 nt, Homo sapiens
uuugguuucucaa

SEQ ID NO: 526490 - RNA, 15 nt, Homo sapiens
uuuguacaacccuga

SEQ ID NO: 526491 - RNA, 13 nt, Homo sapiens
uuugucucagaag

SEQ ID NO: 526492 - RNA, 20 nt, Homo sapiens
uuugugauauuucguguacu

SEQ ID NO: 526493 - RNA, 16 nt, Homo sapiens
uuugugccccacacua

SEQ ID NO: 526494 - RNA, 16 nt, Homo sapiens
uuuguuacuuccuuau

SEQ ID NO: 526495 - RNA, 21 nt, Homo sapiens
uuuguuauauauaauaaauac

SEQ ID NO: 526496 - RNA, 21 nt, Homo sapiens
uuuguuugccaggacaugcaa

SEQ ID NO: 526497 - RNA, 18 nt, Homo sapiens
uuuuacuaaaacacugaa

SEQ ID NO: 526498 - RNA, 17 nt, Homo sapiens
uuuuacugcccuuucaa

SEQ ID NO: 526499 - RNA, 12 nt, Homo sapiens
uuuuaggcaaag

SEQ ID NO: 526500 - RNA, 22 nt, Homo sapiens
uuuucucuggaaugguacaugu

SEQ ID NO: 526501 - RNA, 16 nt, Homo sapiens
uuuugcaacuagguau

SEQ ID NO: 526502 - RNA, 14 nt, Homo sapiens
uuuugcaugcaugc

SEQ ID NO: 526503 - RNA, 13 nt, Homo sapiens
uuuugcuuuccaa

SEQ ID NO: 526504 - RNA, 18 nt, Homo sapiens
uuuugguugggaaugagg

SEQ ID NO: 526505 - RNA, 12 nt, Homo sapiens
uuuugucucaga

SEQ ID NO: 526506 - RNA, 14 nt, Homo sapiens
uuuuguugccuuca

SEQ ID NO: 526507 - RNA, 21 nt, Homo sapiens
uuuuuaugaagugcgugaaug

SEQ ID NO: 526508 - RNA, 18 nt, Homo sapiens
uuuuugcugcugccucuu

SEQ ID NO: 526509 - RNA, 21 nt, Homo sapiens
agauacaugguugugaccuga

SEQ ID NO: 526510 - RNA, 17 nt, Homo sapiens
agauaccaggcacuuaa

SEQ ID NO: 526511 - RNA, 14 nt, Homo sapiens
agauagacaaucac

SEQ ID NO: 526512 - RNA, 20 nt, Homo sapiens
agauaguugauucuugccuu

SEQ ID NO: 526513 - RNA, 20 nt, Homo sapiens
agaucaaggaguacaaugcc

SEQ ID NO: 526514 - RNA, 11 nt, Homo sapiens
agaucaugcca

SEQ ID NO: 526515 - RNA, 23 nt, Homo sapiens
agaucaugccauugcauuccagc

SEQ ID NO: 526516 - RNA, 20 nt, Homo sapiens
agcgggcuugacugcauugc

SEQ ID NO: 526517 - RNA, 15 nt, Homo sapiens
agcuaaagaggcuga

SEQ ID NO: 526518 - RNA, 13 nt, Homo sapiens
agcuacaggacau

SEQ ID NO: 526519 - RNA, 13 nt, Homo sapiens
agcuaccaggugu

SEQ ID NO: 526520 - RNA, 16 nt, Homo sapiens
agcuaguuugagccag

SEQ ID NO: 526521 - RNA, 15 nt, Homo sapiens
agcucacugcugauc

SEQ ID NO: 526522 - RNA, 21 nt, Homo sapiens
agcucuuuuauaugcuaaagg

SEQ ID NO: 526523 - RNA, 19 nt, Homo sapiens
agcugaacccuccugauga

SEQ ID NO: 526524 - RNA, 15 nt, Homo sapiens
agcugaagcuggugc

SEQ ID NO: 526525 - RNA, 20 nt, Homo sapiens
agcugaaugccuccuguggg

SEQ ID NO: 526526 - RNA, 15 nt, Homo sapiens
agcugaccaucaucc

SEQ ID NO: 526527 - RNA, 16 nt, Homo sapiens
agcugagaucgugcua

SEQ ID NO: 526528 - RNA, 20 nt, Homo sapiens
agcugagauugcacuauugc

SEQ ID NO: 526529 - RNA, 13 nt, Homo sapiens
agcugccucugcu

SEQ ID NO: 526530 - RNA, 17 nt, Homo sapiens
agcugcuguucuuagca

SEQ ID NO: 526531 - RNA, 14 nt, Homo sapiens
agcugggagccugg

SEQ ID NO: 526532 - RNA, 20 nt, Homo sapiens
agcugggcccgacauggcuc

SEQ ID NO: 526533 - RNA, 18 nt, Homo sapiens
agcuguuugaaauguuua

SEQ ID NO: 526534 - RNA, 19 nt, Homo sapiens
agcuuaaauuuuauaucau

SEQ ID NO: 526535 - RNA, 15 nt, Homo sapiens
agcuucucauguuaa

SEQ ID NO: 526536 - RNA, 17 nt, Homo sapiens
agcuugagcugccucug

SEQ ID NO: 526537 - RNA, 14 nt, Homo sapiens
agcuuuagcuucau

SEQ ID NO: 526538 - RNA, 17 nt, Homo sapiens
aggaaaaggcugguaca

SEQ ID NO: 526539 - RNA, 18 nt, Homo sapiens
aggaaaaucacaucucca

SEQ ID NO: 526540 - RNA, 23 nt, Homo sapiens
aggaaauaguaccuucaauacuu

SEQ ID NO: 526541 - RNA, 21 nt, Homo sapiens
aggaaggaacagcaauggugu

SEQ ID NO: 526542 - RNA, 18 nt, Homo sapiens
aggaagggacacauauca

SEQ ID NO: 526543 - RNA, 14 nt, Homo sapiens
aggaagguguuuca

SEQ ID NO: 526544 - RNA, 23 nt, Homo sapiens
aggaagucauccugccaacugau

SEQ ID NO: 526545 - RNA, 17 nt, Homo sapiens
aggaaugaagccuuagc

SEQ ID NO: 526546 - RNA, 16 nt, Homo sapiens
aggacaauacuggggu

SEQ ID NO: 526547 - RNA, 18 nt, Homo sapiens
aggacaccuuuuaacuca

SEQ ID NO: 526548 - RNA, 22 nt, Homo sapiens
aggacaccuuuuaacucaccuc

SEQ ID NO: 526549 - RNA, 23 nt, Homo sapiens
aggacuaccagccauacaaauag

SEQ ID NO: 526550 - RNA, 20 nt, Homo sapiens
aggagaaacucccauguaug

SEQ ID NO: 526551 - RNA, 22 nt, Homo sapiens
aggagacgggggagcagcacga

SEQ ID NO: 526552 - RNA, 14 nt, Homo sapiens
aggaggaucacuug

SEQ ID NO: 526553 - RNA, 20 nt, Homo sapiens
aggaggguauggugcugcuc

SEQ ID NO: 526554 - RNA, 22 nt, Homo sapiens
aggagguuauaccaggauuuau

SEQ ID NO: 526555 - RNA, 18 nt, Homo sapiens
aggauauacugcagcuuu

SEQ ID NO: 526556 - RNA, 16 nt, Homo sapiens
aggauaucacauugga

SEQ ID NO: 526557 - RNA, 21 nt, Homo sapiens
aggaucaacaacauccacugu

SEQ ID NO: 526558 - RNA, 11 nt, Homo sapiens
aggaucucagg

SEQ ID NO: 526559 - RNA, 23 nt, Homo sapiens
aggaucucugagaccacagaggc

SEQ ID NO: 526560 - RNA, 19 nt, Homo sapiens
aggaugcugucaagcaccu

SEQ ID NO: 526561 - RNA, 23 nt, Homo sapiens
aggaugguagaaguuuggcugcu

SEQ ID NO: 526562 - RNA, 22 nt, Homo sapiens
aggcagauggggcacugaccca

SEQ ID NO: 526563 - RNA, 20 nt, Homo sapiens
aggcagcugccucugcuccc

SEQ ID NO: 526564 - RNA, 24 nt, Homo sapiens
aggcagcuucuacuccugccucau

SEQ ID NO: 526565 - RNA, 15 nt, Homo sapiens
agucccacacugugg

SEQ ID NO: 526566 - RNA, 23 nt, Homo sapiens
aguccuugauuucaaaguuuugu

SEQ ID NO: 526567 - RNA, 20 nt, Homo sapiens
agucugauccauccaucucu

SEQ ID NO: 526568 - RNA, 14 nt, Homo sapiens
agucuguugauuaa

SEQ ID NO: 526569 - RNA, 16 nt, Homo sapiens
agucuucccagcaauu

SEQ ID NO: 526570 - RNA, 22 nt, Homo sapiens
agugaaaauuguuuagugauau

SEQ ID NO: 526571 - RNA, 22 nt, Homo sapiens
agugaaguuuuacugucuauua

SEQ ID NO: 526572 - RNA, 17 nt, Homo sapiens
agugacaaggcccugag

SEQ ID NO: 526573 - RNA, 20 nt, Homo sapiens
agugagccgagaucaugcca

SEQ ID NO: 526574 - RNA, 12 nt, Homo sapiens
agugaugguugu

SEQ ID NO: 526575 - RNA, 12 nt, Homo sapiens
agugcacugagc

SEQ ID NO: 526576 - RNA, 18 nt, Homo sapiens
aguggaaauuaagacuuu

SEQ ID NO: 526577 - RNA, 11 nt, Homo sapiens
agugggccagg

SEQ ID NO: 526578 - RNA, 13 nt, Homo sapiens
agugguacuugau

SEQ ID NO: 526579 - RNA, 13 nt, Homo sapiens
agugguuucccau

SEQ ID NO: 526580 - RNA, 23 nt, Homo sapiens
aguguauuuauuuuacagcucau

SEQ ID NO: 526581 - RNA, 14 nt, Homo sapiens
agugugacagggcc

SEQ ID NO: 526582 - RNA, 22 nt, Homo sapiens
agugugacagggccaguggggc

SEQ ID NO: 526583 - RNA, 17 nt, Homo sapiens
aguguuguggacacugc

SEQ ID NO: 526584 - RNA, 18 nt, Homo sapiens
aguguuguggacacugca

SEQ ID NO: 526585 - RNA, 19 nt, Homo sapiens
aguuaaacugagaguaauu

SEQ ID NO: 526586 - RNA, 16 nt, Homo sapiens
aguucuuguucuucag

SEQ ID NO: 526587 - RNA, 19 nt, Homo sapiens
aguugcagccagggccagu

SEQ ID NO: 526588 - RNA, 20 nt, Homo sapiens
aguugcagccagggccagug

SEQ ID NO: 526589 - RNA, 14 nt, Homo sapiens
aguuguuagauuaa

SEQ ID NO: 526590 - RNA, 15 nt, Homo sapiens
aguuuaaagacacuu

SEQ ID NO: 526591 - RNA, 23 nt, Homo sapiens
aguuuaauuuuugaaaacuggcu

SEQ ID NO: 526592 - RNA, 17 nt, Homo sapiens
aguuuccaaaaccagaa

SEQ ID NO: 526593 - RNA, 17 nt, Homo sapiens
aguuucccguccaucuc

SEQ ID NO: 526594 - RNA, 17 nt, Homo sapiens
aguuugauaccugcacu

SEQ ID NO: 526595 - RNA, 22 nt, Homo sapiens
aguuuggcugcugucauaacau

SEQ ID NO: 526596 - RNA, 17 nt, Homo sapiens
aguuuuacuaaaacacu

SEQ ID NO: 526597 - RNA, 18 nt, Homo sapiens
aguuuugugaaggugauu

SEQ ID NO: 526598 - RNA, 21 nt, Homo sapiens
aguuuuuuauuaugcauuaua

SEQ ID NO: 526599 - RNA, 14 nt, Homo sapiens
auaaaaaacacuaa

SEQ ID NO: 526600 - RNA, 14 nt, Homo sapiens
auaaaacucuccuu

SEQ ID NO: 526601 - RNA, 18 nt, Homo sapiens
auaaaacucugcauguag

SEQ ID NO: 526602 - RNA, 14 nt, Homo sapiens
auaaaagcauuguu

SEQ ID NO: 526603 - RNA, 14 nt, Homo sapiens
auaaaauggucaug

SEQ ID NO: 526604 - RNA, 21 nt, Homo sapiens
auaaaccugggcucagccuga

SEQ ID NO: 526605 - RNA, 13 nt, Homo sapiens
auaaacugcaagu

SEQ ID NO: 526606 - RNA, 12 nt, Homo sapiens
auaaagccuuuu

SEQ ID NO: 526607 - RNA, 11 nt, Homo sapiens
auaaagcuuua

SEQ ID NO: 526608 - RNA, 22 nt, Homo sapiens
auaaagugcacaccuuuauuca

SEQ ID NO: 526609 - RNA, 19 nt, Homo sapiens
auaaauaaacuguugcucg

SEQ ID NO: 526610 - RNA, 19 nt, Homo sapiens
auaaauacauuuuugucag

SEQ ID NO: 526611 - RNA, 14 nt, Homo sapiens
auaaauauacagua

SEQ ID NO: 526612 - RNA, 15 nt, Homo sapiens
auaaauauucuagca

SEQ ID NO: 526613 - RNA, 15 nt, Homo sapiens
auaaauggguguaua

SEQ ID NO: 526614 - RNA, 16 nt, Homo sapiens
auaacauccagagcuu

SEQ ID NO: 526615 - RNA, 23 nt, Homo sapiens
auaaccagcugaaguugcagaug

SEQ ID NO: 526616 - RNA, 14 nt, Homo sapiens
auaacuacuuccau

SEQ ID NO: 526617 - RNA, 23 nt, Homo sapiens
auaagcuuccuagaaaguucugu

SEQ ID NO: 526618 - RNA, 16 nt, Homo sapiens
auaauaacuacuucca

SEQ ID NO: 526619 - RNA, 12 nt, Homo sapiens
auaauagucaau

SEQ ID NO: 526620 - RNA, 17 nt, Homo sapiens
auaauguuuugggaaac

SEQ ID NO: 526621 - RNA, 20 nt, Homo sapiens
auacacuuuuuaaaaucuca

SEQ ID NO: 526622 - RNA, 21 nt, Homo sapiens
auacacuuuuuaaaaucucaa

SEQ ID NO: 526623 - RNA, 13 nt, Homo sapiens
auacagccugcaa

SEQ ID NO: 526624 - RNA, 15 nt, Homo sapiens
auaccauuuccucag

SEQ ID NO: 526625 - RNA, 17 nt, Homo sapiens
auacccaggaagacuuu

SEQ ID NO: 526626 - RNA, 15 nt, Homo sapiens
auacuuggaccucag

SEQ ID NO: 526627 - RNA, 18 nt, Homo sapiens
auacuuugccacugcugu

SEQ ID NO: 526628 - RNA, 15 nt, Homo sapiens
auacuuuugcuuuca

SEQ ID NO: 526629 - RNA, 12 nt, Homo sapiens
auagaacaucca

SEQ ID NO: 526630 - RNA, 18 nt, Homo sapiens
auagacacauacauguca

SEQ ID NO: 526631 - RNA, 17 nt, Homo sapiens
auagacuuauugccaaa

SEQ ID NO: 526632 - RNA, 15 nt, Homo sapiens
auagcaaacacuggg

SEQ ID NO: 526633 - RNA, 21 nt, Homo sapiens
auaggccugucccuugccucu

SEQ ID NO: 526634 - RNA, 15 nt, Homo sapiens
auaguugauucuugc

SEQ ID NO: 526635 - RNA, 22 nt, Homo sapiens
auauaauuuauaagcauugcca

SEQ ID NO: 526636 - RNA, 19 nt, Homo sapiens
auauagcuuugccaugugg

SEQ ID NO: 526637 - RNA, 14 nt, Homo sapiens
auauauaacauaua

SEQ ID NO: 526638 - RNA, 19 nt, Homo sapiens
auaucacauuggagucacu

SEQ ID NO: 526639 - RNA, 18 nt, Homo sapiens
auaugcuuguaacuaaaa

SEQ ID NO: 526640 - RNA, 18 nt, Homo sapiens
auauggggaaaaaacugu

SEQ ID NO: 526641 - RNA, 20 nt, Homo sapiens
auauguccgcagaauggacu

SEQ ID NO: 526642 - RNA, 15 nt, Homo sapiens
auauuaaaagaacuc

SEQ ID NO: 526643 - RNA, 13 nt, Homo sapiens
auauucauauaca

SEQ ID NO: 526644 - RNA, 14 nt, Homo sapiens
auauuccacguuug

SEQ ID NO: 526645 - RNA, 17 nt, Homo sapiens
auauucugguucuugaa

SEQ ID NO: 526646 - RNA, 15 nt, Homo sapiens
auauugaauguuaaa

SEQ ID NO: 526647 - RNA, 17 nt, Homo sapiens
auauuguauaggggcaa

SEQ ID NO: 526648 - RNA, 15 nt, Homo sapiens
auauuuacauccagc

SEQ ID NO: 526649 - RNA, 22 nt, Homo sapiens
auauuuacauccagcuucucau

SEQ ID NO: 526650 - RNA, 14 nt, Homo sapiens
auauuuuauuuccu

SEQ ID NO: 526651 - RNA, 20 nt, Homo sapiens
aucaaaacuaaccaucugaa

SEQ ID NO: 526652 - RNA, 18 nt, Homo sapiens
aucaaaucuccugcugau

SEQ ID NO: 526653 - RNA, 17 nt, Homo sapiens
aucaacaacauccacug

SEQ ID NO: 526654 - RNA, 14 nt, Homo sapiens
aucaacucuaauag

SEQ ID NO: 526655 - RNA, 22 nt, Homo sapiens
aucaaggaguacaaugcccaga

SEQ ID NO: 526656 - RNA, 13 nt, Homo sapiens
aucaaggugcuga

SEQ ID NO: 526657 - RNA, 13 nt, Homo sapiens
aucacacaauaua

SEQ ID NO: 526658 - RNA, 14 nt, Homo sapiens
aucacccucugggu

SEQ ID NO: 526659 - RNA, 14 nt, Homo sapiens
aucagacagagauu

SEQ ID NO: 526660 - RNA, 22 nt, Homo sapiens
aucagccugggcaacaugguga

SEQ ID NO: 526661 - RNA, 20 nt, Homo sapiens
aucaggaaggaaaugacacc

SEQ ID NO: 526662 - RNA, 16 nt, Homo sapiens
aucaguaccucucaag

SEQ ID NO: 526663 - RNA, 15 nt, Homo sapiens
aucauucaacucucc

SEQ ID NO: 526664 - RNA, 20 nt, Homo sapiens
auccaaaaauagcccugcaa

SEQ ID NO: 526665 - RNA, 16 nt, Homo sapiens
auccacaauagcugac

SEQ ID NO: 526666 - RNA, 14 nt, Homo sapiens
auccagaacugcac

SEQ ID NO: 526667 - RNA, 17 nt, Homo sapiens
auccagaacugcacucu

SEQ ID NO: 526668 - RNA, 16 nt, Homo sapiens
auccagcuucucaugu

SEQ ID NO: 526669 - RNA, 16 nt, Homo sapiens
auccaggcuuuguaca

SEQ ID NO: 526670 - RNA, 12 nt, Homo sapiens
auccccaucucc

SEQ ID NO: 526671 - RNA, 15 nt, Homo sapiens
auccccgcuccuggu

SEQ ID NO: 526672 - RNA, 19 nt, Homo sapiens
aucccgccgauagagggac

SEQ ID NO: 526673 - RNA, 15 nt, Homo sapiens
aucccucucuucccc

SEQ ID NO: 526674 - RNA, 17 nt, Homo sapiens
auccggcagcacaagcu

SEQ ID NO: 526675 - RNA, 17 nt, Homo sapiens
auccucaugguucccaa

SEQ ID NO: 526676 - RNA, 18 nt, Homo sapiens
auccugcagauacuuuga

SEQ ID NO: 526677 - RNA, 21 nt, Homo sapiens
auccuggguacugaaagccuu

SEQ ID NO: 526678 - RNA, 13 nt, Homo sapiens
auccuucagugaa

SEQ ID NO: 526679 - RNA, 12 nt, Homo sapiens
aucgaccuggag

SEQ ID NO: 526680 - RNA, 16 nt, Homo sapiens
aucggccuccaugacc

SEQ ID NO: 526681 - RNA, 18 nt, Homo sapiens
aucgugggccgcacuggg

SEQ ID NO: 526682 - RNA, 13 nt, Homo sapiens
aucuacacauguu

SEQ ID NO: 526683 - RNA, 16 nt, Homo sapiens
aucuacaccaaugaaa

SEQ ID NO: 526684 - RNA, 23 nt, Homo sapiens
aucuacaccaaugaaaacaugua

SEQ ID NO: 526685 - RNA, 17 nt, Homo sapiens
aucuacaugucuagaga

SEQ ID NO: 526686 - RNA, 20 nt, Homo sapiens
augcuuuugcuugcaaugua

SEQ ID NO: 526687 - RNA, 14 nt, Homo sapiens
auggaggcccuccu

SEQ ID NO: 526688 - RNA, 18 nt, Homo sapiens
auggcaggacuccuggca

SEQ ID NO: 526689 - RNA, 16 nt, Homo sapiens
auggcaggugccugua

SEQ ID NO: 526690 - RNA, 18 nt, Homo sapiens
auggccuccauccagaaa

SEQ ID NO: 526691 - RNA, 17 nt, Homo sapiens
auggcuccuccauaucu

SEQ ID NO: 526692 - RNA, 22 nt, Homo sapiens
auggcuggaagggguccagccu

SEQ ID NO: 526693 - RNA, 19 nt, Homo sapiens
auggcuucuggucaugaaa

SEQ ID NO: 526694 - RNA, 21 nt, Homo sapiens
augggagccuuuaccuuuuau

SEQ ID NO: 526695 - RNA, 16 nt, Homo sapiens
auggggaaaaaacugu

SEQ ID NO: 526696 - RNA, 14 nt, Homo sapiens
auggguacaaugaa

SEQ ID NO: 526697 - RNA, 16 nt, Homo sapiens
augguaauaagcacug

SEQ ID NO: 526698 - RNA, 19 nt, Homo sapiens
auggugaaaccccgucucu

SEQ ID NO: 526699 - RNA, 19 nt, Homo sapiens
augguggaaaagaacugua

SEQ ID NO: 526700 - RNA, 23 nt, Homo sapiens
augguguagcccucccacuuugc

SEQ ID NO: 526701 - RNA, 12 nt, Homo sapiens
auguaacacugg

SEQ ID NO: 526702 - RNA, 16 nt, Homo sapiens
auguaagaauucagaa

SEQ ID NO: 526703 - RNA, 18 nt, Homo sapiens
auguacaauaaagcaaug

SEQ ID NO: 526704 - RNA, 16 nt, Homo sapiens
auguacuacagcuaua

SEQ ID NO: 526705 - RNA, 15 nt, Homo sapiens
auguagccagcagaa

SEQ ID NO: 526706 - RNA, 20 nt, Homo sapiens
auguaguuuuuauauguugu

SEQ ID NO: 526707 - RNA, 21 nt, Homo sapiens
auguaguuuuuauauguugua

SEQ ID NO: 526708 - RNA, 17 nt, Homo sapiens
augucagaagugcagaa

SEQ ID NO: 526709 - RNA, 14 nt, Homo sapiens
augucaguacuauu

SEQ ID NO: 526710 - RNA, 21 nt, Homo sapiens
augucaguacuauucagguaa

SEQ ID NO: 526711 - RNA, 13 nt, Homo sapiens
augucucauguca

SEQ ID NO: 526712 - RNA, 22 nt, Homo sapiens
augucuguagcuccucaacuca

SEQ ID NO: 526713 - RNA, 19 nt, Homo sapiens
augugacacugcagcagaa

SEQ ID NO: 526714 - RNA, 13 nt, Homo sapiens
augugacuacuga

SEQ ID NO: 526715 - RNA, 18 nt, Homo sapiens
augugagugccuuuugca

SEQ ID NO: 526716 - RNA, 21 nt, Homo sapiens
augugagugccuuuugcagaa

SEQ ID NO: 526717 - RNA, 12 nt, Homo sapiens
auguggucucag

SEQ ID NO: 526718 - RNA, 16 nt, Homo sapiens
augugguuaucuguga

SEQ ID NO: 526719 - RNA, 13 nt, Homo sapiens
auguguauuucau

SEQ ID NO: 526720 - RNA, 18 nt, Homo sapiens
auguuaauguuauaucau

SEQ ID NO: 526721 - RNA, 12 nt, Homo sapiens
auguuauaucau

SEQ ID NO: 526722 - RNA, 17 nt, Homo sapiens
auguugaucuuucucaa

SEQ ID NO: 526723 - RNA, 23 nt, Homo sapiens
auguugcaaagaacuccagaguc

SEQ ID NO: 526724 - RNA, 15 nt, Homo sapiens
auguuuaugagccag

SEQ ID NO: 526725 - RNA, 18 nt, Homo sapiens
auguuuuuagaggacuau

SEQ ID NO: 526726 - RNA, 14 nt, Homo sapiens
auuaaaaacuacca

SEQ ID NO: 526727 - RNA, 20 nt, Homo sapiens
auuaaaacaauaaugcaauu

SEQ ID NO: 526728 - RNA, 12 nt, Homo sapiens
auuaaacaaaua

SEQ ID NO: 526729 - RNA, 20 nt, Homo sapiens
auuaacugcacaaacaauau

SEQ ID NO: 526730 - RNA, 17 nt, Homo sapiens
auuaagcaaauguuaaa

SEQ ID NO: 526731 - RNA, 23 nt, Homo sapiens
auuaauaacgucuuuuuauaucu

SEQ ID NO: 526732 - RNA, 15 nt, Homo sapiens
auuacuaucauggca

SEQ ID NO: 526733 - RNA, 19 nt, Homo sapiens
auuacugaaauauaccuuu

SEQ ID NO: 526734 - RNA, 16 nt, Homo sapiens
auuagaguauuuucca

SEQ ID NO: 526735 - RNA, 22 nt, Homo sapiens
auuaggcugugucaccauugug

SEQ ID NO: 526736 - RNA, 16 nt, Homo sapiens
auuauaaaauggacac

SEQ ID NO: 526737 - RNA, 20 nt, Homo sapiens
auuauauugucgaauuccua

SEQ ID NO: 526738 - RNA, 22 nt, Homo sapiens
auuauccagagucaugggagag

SEQ ID NO: 526739 - RNA, 15 nt, Homo sapiens
auuauuauucaaaaa

SEQ ID NO: 526740 - RNA, 14 nt, Homo sapiens
auuauucaaaaaca

SEQ ID NO: 526741 - RNA, 23 nt, Homo sapiens
auuauuccucucaccccacuccu

SEQ ID NO: 526742 - RNA, 22 nt, Homo sapiens
auuauuugcuauggcaggauaa

SEQ ID NO: 526743 - RNA, 13 nt, Homo sapiens
auucaacaaauau

SEQ ID NO: 526744 - RNA, 17 nt, Homo sapiens
auucaauuaguggucau

SEQ ID NO: 526745 - RNA, 17 nt, Homo sapiens
auucagaguccuugcaa

SEQ ID NO: 526746 - RNA, 22 nt, Homo sapiens
auucauaaaccuugucuaugaa

SEQ ID NO: 526747 - RNA, 18 nt, Homo sapiens
auucauaguaagauugau

SEQ ID NO: 526748 - RNA, 15 nt, Homo sapiens
auucauuguggucau

SEQ ID NO: 526749 - RNA, 17 nt, Homo sapiens
auucauuguggucauag

SEQ ID NO: 526750 - RNA, 13 nt, Homo sapiens
auuccacaggugg

SEQ ID NO: 526751 - RNA, 23 nt, Homo sapiens
auuccauuuugugaauugugaca

SEQ ID NO: 526752 - RNA, 16 nt, Homo sapiens
auuuugugaauuguga

SEQ ID NO: 526753 - RNA, 23 nt, Homo sapiens
auuuugugaauugugacauaaua

SEQ ID NO: 526754 - RNA, 16 nt, Homo sapiens
auuuuguugcuuucuu

SEQ ID NO: 526755 - RNA, 15 nt, Homo sapiens
auuuuugaaaacugg

SEQ ID NO: 526756 - RNA, 17 nt, Homo sapiens
caaaaaucaaacuuuac

SEQ ID NO: 526757 - RNA, 15 nt, Homo sapiens
caaaacuuauuggaa

SEQ ID NO: 526758 - RNA, 22 nt, Homo sapiens
caaaaggaacucuagaagacca

SEQ ID NO: 526759 - RNA, 22 nt, Homo sapiens
caaaaugaaggcgggccugcaa

SEQ ID NO: 526760 - RNA, 21 nt, Homo sapiens
caaaauuaagcaaauguuaaa

SEQ ID NO: 526761 - RNA, 18 nt, Homo sapiens
caaacucaacaagugcuc

SEQ ID NO: 526762 - RNA, 18 nt, Homo sapiens
caaacucauccucuuuua

SEQ ID NO: 526763 - RNA, 15 nt, Homo sapiens
caaacuccugaccuc

SEQ ID NO: 526764 - RNA, 15 nt, Homo sapiens
caaagaaaggagaua

SEQ ID NO: 526765 - RNA, 20 nt, Homo sapiens
caaagaacuccagagucagu

SEQ ID NO: 526766 - RNA, 17 nt, Homo sapiens
caaagaggcugccccuc

SEQ ID NO: 526767 - RNA, 12 nt, Homo sapiens
caaagcacuuaa

SEQ ID NO: 526768 - RNA, 19 nt, Homo sapiens
caaagcauuuucauuucua

SEQ ID NO: 526769 - RNA, 13 nt, Homo sapiens
caaagccaaaacc

SEQ ID NO: 526770 - RNA, 15 nt, Homo sapiens
caaagccuuuccaga

SEQ ID NO: 526771 - RNA, 23 nt, Homo sapiens
caaaggccuaauucuaugccugu

SEQ ID NO: 526772 - RNA, 18 nt, Homo sapiens
caaagguauuaguacaau

SEQ ID NO: 526773 - RNA, 17 nt, Homo sapiens
caaaguaccuugaacuc

SEQ ID NO: 526774 - RNA, 17 nt, Homo sapiens
caaagugcggcugccau

SEQ ID NO: 526775 - RNA, 16 nt, Homo sapiens
caaaguugauuaagaa

SEQ ID NO: 526776 - RNA, 20 nt, Homo sapiens
caaaguuuaaauguauuuua

SEQ ID NO: 526777 - RNA, 14 nt, Homo sapiens
caaauaaaauauca

SEQ ID NO: 526778 - RNA, 16 nt, Homo sapiens
caaauacacauuugcu

SEQ ID NO: 526779 - RNA, 17 nt, Homo sapiens
caaauacacauuugcua

SEQ ID NO: 526780 - RNA, 18 nt, Homo sapiens
caaauauaagacauuugu

SEQ ID NO: 526781 - RNA, 15 nt, Homo sapiens
caaauaugcaaacca

SEQ ID NO: 526782 - RNA, 18 nt, Homo sapiens
caaaucuaccacuguaug

SEQ ID NO: 526783 - RNA, 16 nt, Homo sapiens
caaaucuccugcugau

SEQ ID NO: 526784 - RNA, 14 nt, Homo sapiens
caaauuaacuguau

SEQ ID NO: 526785 - RNA, 15 nt, Homo sapiens
caaauuaacuguaug

SEQ ID NO: 526786 - RNA, 13 nt, Homo sapiens
caaauuuacuuua

SEQ ID NO: 526787 - RNA, 14 nt, Homo sapiens
caaauuuacuuuaa

SEQ ID NO: 526788 - RNA, 11 nt, Homo sapiens
caaauuugaug

SEQ ID NO: 526789 - RNA, 21 nt, Homo sapiens
caacaaugugaggggucccua

SEQ ID NO: 526790 - RNA, 14 nt, Homo sapiens
caacauccacuguu

SEQ ID NO: 526791 - RNA, 15 nt, Homo sapiens
caacaugcacugaug

SEQ ID NO: 526792 - RNA, 18 nt, Homo sapiens
caaccgagaagguuuauc

SEQ ID NO: 526793 - RNA, 14 nt, Homo sapiens
caaccucugccucc

SEQ ID NO: 526794 - RNA, 17 nt, Homo sapiens
caacucuaacucugaga

SEQ ID NO: 526795 - RNA, 18 nt, Homo sapiens
caacugcaggaaaacccu

SEQ ID NO: 526796 - RNA, 15 nt, Homo sapiens
caagaacuugcaaua

SEQ ID NO: 526797 - RNA, 20 nt, Homo sapiens
caagaagaaaucaugauaua

SEQ ID NO: 526798 - RNA, 21 nt, Homo sapiens
caagacagaggggagcagugg

SEQ ID NO: 526799 - RNA, 18 nt, Homo sapiens
caagagauaagucuuuca

SEQ ID NO: 526800 - RNA, 16 nt, Homo sapiens
caagagaucuacacau

SEQ ID NO: 526801 - RNA, 19 nt, Homo sapiens
caagcaccugcaugugcug

SEQ ID NO: 526802 - RNA, 14 nt, Homo sapiens
caagcucaggacau

SEQ ID NO: 526803 - RNA, 16 nt, Homo sapiens
caaggaaagaaauaca

SEQ ID NO: 526804 - RNA, 15 nt, Homo sapiens
caaggagaggcaaag

SEQ ID NO: 526805 - RNA, 17 nt, Homo sapiens
caaggaguacuccaaga

SEQ ID NO: 526806 - RNA, 21 nt, Homo sapiens
caaggaugcugucaagcaccu

SEQ ID NO: 526807 - RNA, 23 nt, Homo sapiens
caaggcucugcuauacagucuau

SEQ ID NO: 526808 - RNA, 18 nt, Homo sapiens
caagggcacgugaaguca

SEQ ID NO: 526809 - RNA, 19 nt, Homo sapiens
caagggggacugucuuuca

SEQ ID NO: 526810 - RNA, 23 nt, Homo sapiens
caaggguucuuggugaugcuggc

SEQ ID NO: 526811 - RNA, 16 nt, Homo sapiens
caaggugccuguuaua

SEQ ID NO: 526812 - RNA, 17 nt, Homo sapiens
caaguaagaagacauga

SEQ ID NO: 526813 - RNA, 21 nt, Homo sapiens
caaguauugucgguuaccucu

SEQ ID NO: 526814 - RNA, 15 nt, Homo sapiens
caagucuuccaugac

SEQ ID NO: 526815 - RNA, 15 nt, Homo sapiens
caaguugcaucagaa

SEQ ID NO: 526816 - RNA, 20 nt, Homo sapiens
cacguuggugcgugagaucc

SEQ ID NO: 526817 - RNA, 16 nt, Homo sapiens
cacuaaagcaugaaau

SEQ ID NO: 526818 - RNA, 14 nt, Homo sapiens
cacuauguauauac

SEQ ID NO: 526819 - RNA, 17 nt, Homo sapiens
cacucaggccacagugg

SEQ ID NO: 526820 - RNA, 21 nt, Homo sapiens
cacugaaaaauauuccaagcu

SEQ ID NO: 526821 - RNA, 15 nt, Homo sapiens
cacugacaguuaaua

SEQ ID NO: 526822 - RNA, 23 nt, Homo sapiens
cacugcccucuuguggugcauug

SEQ ID NO: 526823 - RNA, 16 nt, Homo sapiens
cacuggaccucagucc

SEQ ID NO: 526824 - RNA, 15 nt, Homo sapiens
cacuguccugaccau

SEQ ID NO: 526825 - RNA, 13 nt, Homo sapiens
cacuguuagcaca

SEQ ID NO: 526826 - RNA, 16 nt, Homo sapiens
cacuuccaucacaaga

SEQ ID NO: 526827 - RNA, 19 nt, Homo sapiens
cacuuccuuuuaccugccc

SEQ ID NO: 526828 - RNA, 15 nt, Homo sapiens
cacuuuguccauuug

SEQ ID NO: 526829 - RNA, 13 nt, Homo sapiens
cagaaaaccuguu

SEQ ID NO: 526830 - RNA, 15 nt, Homo sapiens
cagaaaaccuguuca

SEQ ID NO: 526831 - RNA, 14 nt, Homo sapiens
cagaaacaugucuu

SEQ ID NO: 526832 - RNA, 21 nt, Homo sapiens
cagaaaguaucacaaauggaa

SEQ ID NO: 526833 - RNA, 22 nt, Homo sapiens
cagaacagggucauguuugcag

SEQ ID NO: 526834 - RNA, 20 nt, Homo sapiens
cagaacguggugaccuuuca

SEQ ID NO: 526835 - RNA, 13 nt, Homo sapiens
cagaacugaaccg

SEQ ID NO: 526836 - RNA, 20 nt, Homo sapiens
cagaagaccccugacucauc

SEQ ID NO: 526837 - RNA, 21 nt, Homo sapiens
cagaagauccaagaggcccug

SEQ ID NO: 526838 - RNA, 15 nt, Homo sapiens
cagaagcagaccuca

SEQ ID NO: 526839 - RNA, 21 nt, Homo sapiens
cagaauguuacugacuccuca

SEQ ID NO: 526840 - RNA, 15 nt, Homo sapiens
cagacaaugauccag

SEQ ID NO: 526841 - RNA, 19 nt, Homo sapiens
cagacaucggccuccauga

SEQ ID NO: 526842 - RNA, 21 nt, Homo sapiens
cagacaucggccuccaugacc

SEQ ID NO: 526843 - RNA, 18 nt, Homo sapiens
cagaccugcauugaacag

SEQ ID NO: 526844 - RNA, 22 nt, Homo sapiens
cagacgcguuggcacaguucau

SEQ ID NO: 526845 - RNA, 15 nt, Homo sapiens
cagacucugucucaa

SEQ ID NO: 526846 - RNA, 20 nt, Homo sapiens
cagacuucaucauugugcua

SEQ ID NO: 526847 - RNA, 17 nt, Homo sapiens
cagagaaaaaugcuccc

SEQ ID NO: 526848 - RNA, 21 nt, Homo sapiens
cagagaaggaaaagacugaau

SEQ ID NO: 526849 - RNA, 13 nt, Homo sapiens
cagagaagguaag

SEQ ID NO: 526850 - RNA, 21 nt, Homo sapiens
cagagaagguaaggugugaac

SEQ ID NO: 526851 - RNA, 16 nt, Homo sapiens
cagagauaaaccaaua

SEQ ID NO: 526852 - RNA, 18 nt, Homo sapiens
cagagcacuuugcaacuc

SEQ ID NO: 526853 - RNA, 21 nt, Homo sapiens
cagagccaccugacucuugca

SEQ ID NO: 526854 - RNA, 20 nt, Homo sapiens
cagaggauaaggaggcacug

SEQ ID NO: 526855 - RNA, 17 nt, Homo sapiens
cagaggcucuaauguac

SEQ ID NO: 526856 - RNA, 14 nt, Homo sapiens
cagagggauaaaaa

SEQ ID NO: 526857 - RNA, 15 nt, Homo sapiens
cagagucaugggaga

SEQ ID NO: 526858 - RNA, 23 nt, Homo sapiens
cagagugaccagcacacuggacu

SEQ ID NO: 526859 - RNA, 15 nt, Homo sapiens
cagaguucugugaca

SEQ ID NO: 526860 - RNA, 13 nt, Homo sapiens
cagaguuguucug

SEQ ID NO: 526861 - RNA, 12 nt, Homo sapiens
cagaguuuucau

SEQ ID NO: 526862 - RNA, 19 nt, Homo sapiens
cagaucuggacuuggcaac

SEQ ID NO: 526863 - RNA, 12 nt, Homo sapiens
cagaugaugcuu

SEQ ID NO: 526864 - RNA, 23 nt, Homo sapiens
cagauguggaguauuagugacac

SEQ ID NO: 526865 - RNA, 13 nt, Homo sapiens
cagauugcugcaa

SEQ ID NO: 526866 - RNA, 14 nt, Homo sapiens
cagcaucggaaaga

SEQ ID NO: 526867 - RNA, 23 nt, Homo sapiens
cagcaucucccucacugaaacca

SEQ ID NO: 526868 - RNA, 16 nt, Homo sapiens
cagcaugccugaacua

SEQ ID NO: 526869 - RNA, 18 nt, Homo sapiens
cagccaaccucauugcag

SEQ ID NO: 526870 - RNA, 14 nt, Homo sapiens
cagccauacaaaua

SEQ ID NO: 526871 - RNA, 15 nt, Homo sapiens
cagcccacacccagc

SEQ ID NO: 526872 - RNA, 18 nt, Homo sapiens
cagcccauggcccccaau

SEQ ID NO: 526873 - RNA, 13 nt, Homo sapiens
cagcccugcugca

SEQ ID NO: 526874 - RNA, 14 nt, Homo sapiens
cagcccugcugcag

SEQ ID NO: 526875 - RNA, 19 nt, Homo sapiens
cagccgccugaaagccaca

SEQ ID NO: 526876 - RNA, 15 nt, Homo sapiens
cagccucccuuugau

SEQ ID NO: 526877 - RNA, 20 nt, Homo sapiens
cagccucgcgggugucacau

SEQ ID NO: 526878 - RNA, 20 nt, Homo sapiens
cauacacaguggcaccuuca

SEQ ID NO: 526879 - RNA, 18 nt, Homo sapiens
cauacaugucacauuuag

SEQ ID NO: 526880 - RNA, 22 nt, Homo sapiens
cauacauucccucuaauuugaa

SEQ ID NO: 526881 - RNA, 13 nt, Homo sapiens
cauaccacuugaa

SEQ ID NO: 526882 - RNA, 17 nt, Homo sapiens
cauaccguguaccucag

SEQ ID NO: 526883 - RNA, 15 nt, Homo sapiens
cauagaaucugugac

SEQ ID NO: 526884 - RNA, 20 nt, Homo sapiens
cauagaguucccaugaacua

SEQ ID NO: 526885 - RNA, 13 nt, Homo sapiens
cauauagacugua

SEQ ID NO: 526886 - RNA, 19 nt, Homo sapiens
cauauguguaaagauuuau

SEQ ID NO: 526887 - RNA, 13 nt, Homo sapiens
cauauuauuccau

SEQ ID NO: 526888 - RNA, 20 nt, Homo sapiens
caucaaacauuggauuuuuc

SEQ ID NO: 526889 - RNA, 22 nt, Homo sapiens
caucagugaauccugaaacugg

SEQ ID NO: 526890 - RNA, 19 nt, Homo sapiens
caucauugugcuagcugau

SEQ ID NO: 526891 - RNA, 18 nt, Homo sapiens
cauccagaguaagugaug

SEQ ID NO: 526892 - RNA, 13 nt, Homo sapiens
cauccaggcugcc

SEQ ID NO: 526893 - RNA, 15 nt, Homo sapiens
caucccuuugguuaa

SEQ ID NO: 526894 - RNA, 21 nt, Homo sapiens
cauccuagucuagcauucugc

SEQ ID NO: 526895 - RNA, 16 nt, Homo sapiens
cauccucaugcugcuc

SEQ ID NO: 526896 - RNA, 13 nt, Homo sapiens
cauccugugccac

SEQ ID NO: 526897 - RNA, 21 nt, Homo sapiens
cauccuugaugcaagugcaac

SEQ ID NO: 526898 - RNA, 15 nt, Homo sapiens
caucgauugauaugc

SEQ ID NO: 526899 - RNA, 22 nt, Homo sapiens
caucuacuuuuuuuuuaauuaa

SEQ ID NO: 526900 - RNA, 18 nt, Homo sapiens
caucuagggaaugggacu

SEQ ID NO: 526901 - RNA, 20 nt, Homo sapiens
caucuaucagauuaaguuag

SEQ ID NO: 526902 - RNA, 21 nt, Homo sapiens
caucuauuuccucugugcaaa

SEQ ID NO: 526903 - RNA, 20 nt, Homo sapiens
caucuccacucuugugguca

SEQ ID NO: 526904 - RNA, 12 nt, Homo sapiens
caucucuacuaa

SEQ ID NO: 526905 - RNA, 22 nt, Homo sapiens
caucugcuuuucccauugccau

SEQ ID NO: 526906 - RNA, 17 nt, Homo sapiens
caucuucacugcaauuu

SEQ ID NO: 526907 - RNA, 22 nt, Homo sapiens
caugaccaccccucucgccuca

SEQ ID NO: 526908 - RNA, 11 nt, Homo sapiens
caugacugugg

SEQ ID NO: 526909 - RNA, 19 nt, Homo sapiens
caugagacucagugcagau

SEQ ID NO: 526910 - RNA, 20 nt, Homo sapiens
caugagacucagugcagaug

SEQ ID NO: 526911 - RNA, 13 nt, Homo sapiens
caugcacugaugu

SEQ ID NO: 526912 - RNA, 23 nt, Homo sapiens
caugcugcaguggguaguucuaa

SEQ ID NO: 526913 - RNA, 17 nt, Homo sapiens
caugcuugacauaccua

SEQ ID NO: 526914 - RNA, 17 nt, Homo sapiens
cauggagcugcacucua

SEQ ID NO: 526915 - RNA, 14 nt, Homo sapiens
cauggaggccaaga

SEQ ID NO: 526916 - RNA, 16 nt, Homo sapiens
cauggaggccaagaac

SEQ ID NO: 526917 - RNA, 18 nt, Homo sapiens
cauggaggccaagaacuu

SEQ ID NO: 526918 - RNA, 23 nt, Homo sapiens
cauggaggccaagaacuugcaau

SEQ ID NO: 526919 - RNA, 21 nt, Homo sapiens
cauggcccccaauaaaggcag

SEQ ID NO: 526920 - RNA, 22 nt, Homo sapiens
caugguuguugcauauaguuaa

SEQ ID NO: 526921 - RNA, 19 nt, Homo sapiens
cauguagguaggaagcacu

SEQ ID NO: 526922 - RNA, 13 nt, Homo sapiens
caugucacauuua

SEQ ID NO: 526923 - RNA, 17 nt, Homo sapiens
caugugcacgguggcga

SEQ ID NO: 526924 - RNA, 11 nt, Homo sapiens
caugugccuuu

SEQ ID NO: 526925 - RNA, 21 nt, Homo sapiens
cauguuaaugacaauauucca

SEQ ID NO: 526926 - RNA, 19 nt, Homo sapiens
cauuagucaauaacuaaac

SEQ ID NO: 526927 - RNA, 12 nt, Homo sapiens
cauuauuaugca

SEQ ID NO: 526928 - RNA, 17 nt, Homo sapiens
cauucaacucuccaaug

SEQ ID NO: 526929 - RNA, 21 nt, Homo sapiens
cauucagggcuauuuuuuccc

SEQ ID NO: 526930 - RNA, 23 nt, Homo sapiens
cauuccauuuugugaauugugac

SEQ ID NO: 526931 - RNA, 12 nt, Homo sapiens
cauuccuaacac

SEQ ID NO: 526932 - RNA, 16 nt, Homo sapiens
cauucgcuacuaugau

SEQ ID NO: 526933 - RNA, 17 nt, Homo sapiens
cauugcuaaacugauga

SEQ ID NO: 526934 - RNA, 15 nt, Homo sapiens
cauuggugaaguaaa

SEQ ID NO: 526935 - RNA, 23 nt, Homo sapiens
cauugguucuuucauuugcuuug

SEQ ID NO: 526936 - RNA, 13 nt, Homo sapiens
cauugucaccucu

SEQ ID NO: 526937 - RNA, 18 nt, Homo sapiens
cauuguggucauagcacc

SEQ ID NO: 526938 - RNA, 23 nt, Homo sapiens
ccaucugggcuuauauguacuuu

SEQ ID NO: 526939 - RNA, 22 nt, Homo sapiens
ccauggcccccaauaaaggcag

SEQ ID NO: 526940 - RNA, 16 nt, Homo sapiens
ccauggcucagggugg

SEQ ID NO: 526941 - RNA, 17 nt, Homo sapiens
ccauuaaaaacuaccac

SEQ ID NO: 526942 - RNA, 18 nt, Homo sapiens
ccauuaauuaaaagugug

SEQ ID NO: 526943 - RNA, 13 nt, Homo sapiens
ccauuauuaugca

SEQ ID NO: 526944 - RNA, 16 nt, Homo sapiens
ccauuauuaugcaaaa

SEQ ID NO: 526945 - RNA, 20 nt, Homo sapiens
ccauuauuccucucacccca

SEQ ID NO: 526946 - RNA, 19 nt, Homo sapiens
ccauucuucacucuuugaa

SEQ ID NO: 526947 - RNA, 21 nt, Homo sapiens
ccauuggaauggaccuuucag

SEQ ID NO: 526948 - RNA, 23 nt, Homo sapiens
ccauuuuaauuuuaaagugcaaa

SEQ ID NO: 526949 - RNA, 18 nt, Homo sapiens
ccauuuugugaauuguga

SEQ ID NO: 526950 - RNA, 21 nt, Homo sapiens
cccaaaccggcaggugcgauu

SEQ ID NO: 526951 - RNA, 22 nt, Homo sapiens
cccaaguggugaaugacacgcc

SEQ ID NO: 526952 - RNA, 15 nt, Homo sapiens
cccaauaaaggcagc

SEQ ID NO: 526953 - RNA, 17 nt, Homo sapiens
cccacuggggugugugg

SEQ ID NO: 526954 - RNA, 17 nt, Homo sapiens
cccacuguaugauuuau

SEQ ID NO: 526955 - RNA, 16 nt, Homo sapiens
cccagagcacuuugca

SEQ ID NO: 526956 - RNA, 22 nt, Homo sapiens
cccagccggcaggccuggacuu

SEQ ID NO: 526957 - RNA, 22 nt, Homo sapiens
cccagccugcucccuagccaga

SEQ ID NO: 526958 - RNA, 18 nt, Homo sapiens
cccagcgacgaacuuucc

SEQ ID NO: 526959 - RNA, 16 nt, Homo sapiens
cccaggacggggcaca

SEQ ID NO: 526960 - RNA, 17 nt, Homo sapiens
cccaggcuggagugcag

SEQ ID NO: 526961 - RNA, 23 nt, Homo sapiens
cccaugaacuauaugacuggcca

SEQ ID NO: 526962 - RNA, 22 nt, Homo sapiens
cccauggcccccaauaaaggca

SEQ ID NO: 526963 - RNA, 18 nt, Homo sapiens
cccauguguccuggugag

SEQ ID NO: 526964 - RNA, 20 nt, Homo sapiens
cccauguugaucuuucucaa

SEQ ID NO: 526965 - RNA, 16 nt, Homo sapiens
cccauucuucacucuu

SEQ ID NO: 526966 - RNA, 13 nt, Homo sapiens
ccccaacacuucc

SEQ ID NO: 526967 - RNA, 16 nt, Homo sapiens
ccccaccaccacuuac

SEQ ID NO: 526968 - RNA, 23 nt, Homo sapiens
ccccaccucggcacacacugugc

SEQ ID NO: 526969 - RNA, 13 nt, Homo sapiens
ccccaccuucaau

SEQ ID NO: 526970 - RNA, 14 nt, Homo sapiens
ccccagccugcucc

SEQ ID NO: 526971 - RNA, 19 nt, Homo sapiens
ccccaggggacaagggauu

SEQ ID NO: 526972 - RNA, 14 nt, Homo sapiens
ccccaucugagcug

SEQ ID NO: 526973 - RNA, 13 nt, Homo sapiens
cccccuguccuga

SEQ ID NO: 526974 - RNA, 16 nt, Homo sapiens
ccccgacacacggggc

SEQ ID NO: 526975 - RNA, 18 nt, Homo sapiens
ccccucacucuguuuccu

SEQ ID NO: 526976 - RNA, 23 nt, Homo sapiens
ccccucauccgauuccccuguag

SEQ ID NO: 526977 - RNA, 14 nt, Homo sapiens
ccccucucaccaaa

SEQ ID NO: 526978 - RNA, 15 nt, Homo sapiens
ccccuggcugugcuc

SEQ ID NO: 526979 - RNA, 17 nt, Homo sapiens
cccggggcuggugggcc

SEQ ID NO: 526980 - RNA, 23 nt, Homo sapiens
cccggugggacccccguggggca

SEQ ID NO: 526981 - RNA, 10 nt, Homo sapiens
cccuaaggga

SEQ ID NO: 526982 - RNA, 17 nt, Homo sapiens
cccuagccagaggcucu

SEQ ID NO: 526983 - RNA, 16 nt, Homo sapiens
cccuccuuuucucuga

SEQ ID NO: 526984 - RNA, 18 nt, Homo sapiens
cccuccuuuucucugaga

SEQ ID NO: 526985 - RNA, 21 nt, Homo sapiens
cccucgucaucaggugcauag

SEQ ID NO: 526986 - RNA, 19 nt, Homo sapiens
cccugcccccacuugccau

SEQ ID NO: 526987 - RNA, 16 nt, Homo sapiens
cccugcugcuggugca

SEQ ID NO: 526988 - RNA, 17 nt, Homo sapiens
cccugcuuugcaucuuu

SEQ ID NO: 526989 - RNA, 18 nt, Homo sapiens
cccuggguguccccgcug

SEQ ID NO: 526990 - RNA, 19 nt, Homo sapiens
cccuuaguuuccacugccu

SEQ ID NO: 526991 - RNA, 22 nt, Homo sapiens
cccuugcuguaugcugaucauc

SEQ ID NO: 526992 - RNA, 18 nt, Homo sapiens
cccuuugggaaagcucuu

SEQ ID NO: 526993 - RNA, 22 nt, Homo sapiens
ccgagagaugacacuagucaga

SEQ ID NO: 526994 - RNA, 20 nt, Homo sapiens
ccgaggacaguggcagacag

SEQ ID NO: 526995 - RNA, 22 nt, Homo sapiens
ccgccugaaagccacaaugaga

SEQ ID NO: 526996 - RNA, 19 nt, Homo sapiens
ccgcucugcagacugcugc

SEQ ID NO: 526997 - RNA, 23 nt, Homo sapiens
ccggaggucgaggcuacagugag

SEQ ID NO: 526998 - RNA, 15 nt, Homo sapiens
ccgucuggaccuggg

SEQ ID NO: 526999 - RNA, 19 nt, Homo sapiens
ccuaacacggugcucauuu

SEQ ID NO: 527000 - RNA, 16 nt, Homo sapiens
ccuaaggucacagcua

SEQ ID NO: 527001 - RNA, 21 nt, Homo sapiens
ccuaccuuagaaaacaaguau

SEQ ID NO: 527002 - RNA, 17 nt, Homo sapiens
ccuaggucaugccuccu

SEQ ID NO: 527003 - RNA, 20 nt, Homo sapiens
ccuauuagaguauuuuccac

SEQ ID NO: 527004 - RNA, 17 nt, Homo sapiens
ccucaaaacaaaggccu

SEQ ID NO: 527005 - RNA, 17 nt, Homo sapiens
ccucauccaggcuacca

SEQ ID NO: 527006 - RNA, 20 nt, Homo sapiens
ccucauugcagcuagaggca

SEQ ID NO: 527007 - RNA, 14 nt, Homo sapiens
ccuccacaugcugc

SEQ ID NO: 527008 - RNA, 22 nt, Homo sapiens
ccuccacaugcugccuggcaca

SEQ ID NO: 527009 - RNA, 11 nt, Homo sapiens
ccuccaugacc

SEQ ID NO: 527010 - RNA, 16 nt, Homo sapiens
ccuccgaccacuucca

SEQ ID NO: 527011 - RNA, 18 nt, Homo sapiens
ccuccgccagauccugca

SEQ ID NO: 527012 - RNA, 13 nt, Homo sapiens
ccuccucauggca

SEQ ID NO: 527013 - RNA, 21 nt, Homo sapiens
ccuccucucaguguuuuggac

SEQ ID NO: 527014 - RNA, 18 nt, Homo sapiens
ccucggccccucccacac

SEQ ID NO: 527015 - RNA, 22 nt, Homo sapiens
ccucguuauuguuguugccaaa

SEQ ID NO: 527016 - RNA, 22 nt, Homo sapiens
ccucguuggaagaggaacagca

SEQ ID NO: 527017 - RNA, 15 nt, Homo sapiens
ccucuaggaggagcu

SEQ ID NO: 527018 - RNA, 12 nt, Homo sapiens
ccucucaccaaa

SEQ ID NO: 527019 - RNA, 16 nt, Homo sapiens
ccucucagcauuuccu

SEQ ID NO: 527020 - RNA, 22 nt, Homo sapiens
ccucugcauggaacagcauuac

SEQ ID NO: 527021 - RNA, 21 nt, Homo sapiens
ccucugucggcuuuuugccau

SEQ ID NO: 527022 - RNA, 20 nt, Homo sapiens
ccucugugcucuucucuucc

SEQ ID NO: 527023 - RNA, 19 nt, Homo sapiens
ccucuucuuugugccuuug

SEQ ID NO: 527024 - RNA, 20 nt, Homo sapiens
ccucuuugugucccuugguc

SEQ ID NO: 527025 - RNA, 17 nt, Homo sapiens
ccucuuuuuagggcuaa

SEQ ID NO: 527026 - RNA, 14 nt, Homo sapiens
ccugaaagccacaa

SEQ ID NO: 527027 - RNA, 19 nt, Homo sapiens
ccugaagaugggagccuuu

SEQ ID NO: 527028 - RNA, 18 nt, Homo sapiens
ccugaaggaaaaugacuc

SEQ ID NO: 527029 - RNA, 14 nt, Homo sapiens
ccugaauccauuaa

SEQ ID NO: 527030 - RNA, 20 nt, Homo sapiens
ccugaauggucucagcuuga

SEQ ID NO: 527031 - RNA, 18 nt, Homo sapiens
ccugacccguuugcuaca

SEQ ID NO: 527032 - RNA, 18 nt, Homo sapiens
ccugacgcagcacaagcu

SEQ ID NO: 527033 - RNA, 22 nt, Homo sapiens
ccugagccaagaggaacuugac

SEQ ID NO: 527034 - RNA, 16 nt, Homo sapiens
ccugaggucagggagu

SEQ ID NO: 527035 - RNA, 12 nt, Homo sapiens
ccugcacaggcu

SEQ ID NO: 527036 - RNA, 14 nt, Homo sapiens
ccugcauugaacag

SEQ ID NO: 527037 - RNA, 15 nt, Homo sapiens
ccugccaacugauuu

SEQ ID NO: 527038 - RNA, 15 nt, Homo sapiens
ccugccaagagucaa

SEQ ID NO: 527039 - RNA, 14 nt, Homo sapiens
ccugcccaaugaga

SEQ ID NO: 527040 - RNA, 17 nt, Homo sapiens
ccugcccccuuggguga

SEQ ID NO: 527041 - RNA, 13 nt, Homo sapiens
ccugccugcauuc

SEQ ID NO: 527042 - RNA, 20 nt, Homo sapiens
ccugcgacccugggggcaca

SEQ ID NO: 527043 - RNA, 13 nt, Homo sapiens
ccugcuuugcauc

SEQ ID NO: 527044 - RNA, 18 nt, Homo sapiens
ccuggagaugcugccugg

SEQ ID NO: 527045 - RNA, 20 nt, Homo sapiens
ccuggagaugcugccuggug

SEQ ID NO: 527046 - RNA, 18 nt, Homo sapiens
ccuggcccccaaccucag

SEQ ID NO: 527047 - RNA, 14 nt, Homo sapiens
ccuggcuuugccuc

SEQ ID NO: 527048 - RNA, 16 nt, Homo sapiens
ccuggcuuugccucuu

SEQ ID NO: 527049 - RNA, 19 nt, Homo sapiens
ccuggguacugaggugcua

SEQ ID NO: 527050 - RNA, 18 nt, Homo sapiens
ccuggucaacauagugag

SEQ ID NO: 527051 - RNA, 20 nt, Homo sapiens
ccuggugaguaacuuagaaa

SEQ ID NO: 527052 - RNA, 13 nt, Homo sapiens
ccuggugcugaga

SEQ ID NO: 527053 - RNA, 22 nt, Homo sapiens
ccuggugucugcccugcuggga

SEQ ID NO: 527054 - RNA, 12 nt, Homo sapiens
ccuguaaauaua

SEQ ID NO: 527055 - RNA, 16 nt, Homo sapiens
ccuguacggacacugu

SEQ ID NO: 527056 - RNA, 16 nt, Homo sapiens
ccuguccagaccuuug

SEQ ID NO: 527057 - RNA, 20 nt, Homo sapiens
ccuguccugcagucccacac

SEQ ID NO: 527058 - RNA, 15 nt, Homo sapiens
aagcugaauccagau

SEQ ID NO: 527059 - RNA, 18 nt, Homo sapiens
aagcugauuuuauucaau

SEQ ID NO: 527060 - RNA, 22 nt, Homo sapiens
aagcugcuaccccuacaucauc

SEQ ID NO: 527061 - RNA, 15 nt, Homo sapiens
aaggaaauucuuaua

SEQ ID NO: 527062 - RNA, 17 nt, Homo sapiens
aaggacgguucuuacac

SEQ ID NO: 527063 - RNA, 15 nt, Homo sapiens
aaggaucucugagac

SEQ ID NO: 527064 - RNA, 19 nt, Homo sapiens
aaggcagcugccucugcuc

SEQ ID NO: 527065 - RNA, 23 nt, Homo sapiens
aaggcagcugccucugcucccuc

SEQ ID NO: 527066 - RNA, 16 nt, Homo sapiens
aaggcaggaggaucac

SEQ ID NO: 527067 - RNA, 21 nt, Homo sapiens
aaggccugacuucugcuggca

SEQ ID NO: 527068 - RNA, 21 nt, Homo sapiens
aaggcucagucgcuagcauuu

SEQ ID NO: 527069 - RNA, 22 nt, Homo sapiens
aagggaaccauguauaugagcu

SEQ ID NO: 527070 - RNA, 14 nt, Homo sapiens
aagggaauccuccu

SEQ ID NO: 527071 - RNA, 15 nt, Homo sapiens
aagggaauugcucag

SEQ ID NO: 527072 - RNA, 19 nt, Homo sapiens
aagggauggaaaaggaaga

SEQ ID NO: 527073 - RNA, 21 nt, Homo sapiens
aagggcacgugaagucauuga

SEQ ID NO: 527074 - RNA, 19 nt, Homo sapiens
aagggugggugcucagaau

SEQ ID NO: 527075 - RNA, 13 nt, Homo sapiens
aagguacacuggu

SEQ ID NO: 527076 - RNA, 14 nt, Homo sapiens
aagguggaugccaa

SEQ ID NO: 527077 - RNA, 22 nt, Homo sapiens
aagguuuuguugcuagcccuuc

SEQ ID NO: 527078 - RNA, 16 nt, Homo sapiens
aaguaaauuaggcagu

SEQ ID NO: 527079 - RNA, 22 nt, Homo sapiens
aaguauaggccaggcacagugg

SEQ ID NO: 527080 - RNA, 14 nt, Homo sapiens
aaguccaucugaca

SEQ ID NO: 527081 - RNA, 14 nt, Homo sapiens
aagugcgugaaugu

SEQ ID NO: 527082 - RNA, 23 nt, Homo sapiens
aagugcgugccgugugaguguga

SEQ ID NO: 527083 - RNA, 20 nt, Homo sapiens
aagugugcugugacaagcca

SEQ ID NO: 527084 - RNA, 14 nt, Homo sapiens
aaguuaacaucaag

SEQ ID NO: 527085 - RNA, 17 nt, Homo sapiens
aaguuacaugcuguaua

SEQ ID NO: 527086 - RNA, 18 nt, Homo sapiens
aaguuaguuccacugaga

SEQ ID NO: 527087 - RNA, 13 nt, Homo sapiens
aaguuucuaaaaa

SEQ ID NO: 527088 - RNA, 17 nt, Homo sapiens
aaguuugcacucuuuga

SEQ ID NO: 527089 - RNA, 19 nt, Homo sapiens
aaguuuucuuccaugauuu

SEQ ID NO: 527090 - RNA, 14 nt, Homo sapiens
aauaaaaccuguua

SEQ ID NO: 527091 - RNA, 18 nt, Homo sapiens
aauaaaggcagcugccuc

SEQ ID NO: 527092 - RNA, 17 nt, Homo sapiens
aauaaauaauucuuccu

SEQ ID NO: 527093 - RNA, 22 nt, Homo sapiens
aauaacacuguauuuuaaugua

SEQ ID NO: 527094 - RNA, 20 nt, Homo sapiens
aauaacgucuuuuuauaucu

SEQ ID NO: 527095 - RNA, 14 nt, Homo sapiens
aauaacuacuucca

SEQ ID NO: 527096 - RNA, 14 nt, Homo sapiens
aauaagauuccaga

SEQ ID NO: 527097 - RNA, 21 nt, Homo sapiens
aauaauaaagaauagcuuuaa

SEQ ID NO: 527098 - RNA, 12 nt, Homo sapiens
aauaauucuucc

SEQ ID NO: 527099 - RNA, 20 nt, Homo sapiens
aauaauuggagaagauuuau

SEQ ID NO: 527100 - RNA, 12 nt, Homo sapiens
aauacaaaaacu

SEQ ID NO: 527101 - RNA, 17 nt, Homo sapiens
aauaccauuuaguaaga

SEQ ID NO: 527102 - RNA, 20 nt, Homo sapiens
aauaguaccuucaauacuua

SEQ ID NO: 527103 - RNA, 16 nt, Homo sapiens
aauagucuuccacaaa

SEQ ID NO: 527104 - RNA, 21 nt, Homo sapiens
aauauagcuaauaacauguga

SEQ ID NO: 527105 - RNA, 20 nt, Homo sapiens
aauauauauuaagugugcca

SEQ ID NO: 527106 - RNA, 23 nt, Homo sapiens
aauauuuuuguauuucucuauuu

SEQ ID NO: 527107 - RNA, 14 nt, Homo sapiens
aaucaaagccaggg

SEQ ID NO: 527108 - RNA, 18 nt, Homo sapiens
aaucagcaaccugacuca

SEQ ID NO: 527109 - RNA, 18 nt, Homo sapiens
cuuaacacuaucauggac

SEQ ID NO: 527110 - RNA, 19 nt, Homo sapiens
cuuaaccuuugcuauguaa

SEQ ID NO: 527111 - RNA, 14 nt, Homo sapiens
cuuaagaauugaau

SEQ ID NO: 527112 - RNA, 17 nt, Homo sapiens
cuuaagauuuugcaccu

SEQ ID NO: 527113 - RNA, 19 nt, Homo sapiens
cuuaagauuuugcaccugu

SEQ ID NO: 527114 - RNA, 13 nt, Homo sapiens
cuuaaucuaaucu

SEQ ID NO: 527115 - RNA, 18 nt, Homo sapiens
cuuaauuuauuucuuaac

SEQ ID NO: 527116 - RNA, 12 nt, Homo sapiens
cuuacaauguga

SEQ ID NO: 527117 - RNA, 11 nt, Homo sapiens
cuuacaucugg

SEQ ID NO: 527118 - RNA, 16 nt, Homo sapiens
cuuacuuuacugccug

SEQ ID NO: 527119 - RNA, 15 nt, Homo sapiens
cuuagagaggacaau

SEQ ID NO: 527120 - RNA, 15 nt, Homo sapiens
cuuagucaugguguu

SEQ ID NO: 527121 - RNA, 11 nt, Homo sapiens
cuuaguugaaa

SEQ ID NO: 527122 - RNA, 19 nt, Homo sapiens
cuuauaaaaauaaagggaa

SEQ ID NO: 527123 - RNA, 18 nt, Homo sapiens
cuuauaacucaacauuug

SEQ ID NO: 527124 - RNA, 23 nt, Homo sapiens
cuuauaaguaaagacagcuuuaa

SEQ ID NO: 527125 - RNA, 22 nt, Homo sapiens
cuuaugauagcaaauggccuca

SEQ ID NO: 527126 - RNA, 12 nt, Homo sapiens
cuuaugugacau

SEQ ID NO: 527127 - RNA, 13 nt, Homo sapiens
cuucaauacuuaa

SEQ ID NO: 527128 - RNA, 17 nt, Homo sapiens
cuucaccaagaagcaaa

SEQ ID NO: 527129 - RNA, 18 nt, Homo sapiens
cuucaguuuuacucugcu

SEQ ID NO: 527130 - RNA, 23 nt, Homo sapiens
cuucaucauucccucucaucuca

SEQ ID NO: 527131 - RNA, 18 nt, Homo sapiens
cuucaucuucacugcaau

SEQ ID NO: 527132 - RNA, 19 nt, Homo sapiens
cuucaucuucacugcaauu

SEQ ID NO: 527133 - RNA, 20 nt, Homo sapiens
cuucaugcuugacauaccua

SEQ ID NO: 527134 - RNA, 23 nt, Homo sapiens
cuucaugcuuuugcuugcaaugu

SEQ ID NO: 527135 - RNA, 18 nt, Homo sapiens
cuuccaggggaaccugcc

SEQ ID NO: 527136 - RNA, 13 nt, Homo sapiens
cuucccagcaauu

SEQ ID NO: 527137 - RNA, 13 nt, Homo sapiens
cuucccaugcauu

SEQ ID NO: 527138 - RNA, 21 nt, Homo sapiens
cuuccccgagugacucuggau

SEQ ID NO: 527139 - RNA, 15 nt, Homo sapiens
cuuccuguacuugaa

SEQ ID NO: 527140 - RNA, 17 nt, Homo sapiens
cuucggcagcuacucag

SEQ ID NO: 527141 - RNA, 22 nt, Homo sapiens
cuucuaauugcuguguguccca

SEQ ID NO: 527142 - RNA, 19 nt, Homo sapiens
cuucuacgggauggccaga

SEQ ID NO: 527143 - RNA, 16 nt, Homo sapiens
cuucuguugaucucag

SEQ ID NO: 527144 - RNA, 13 nt, Homo sapiens
ccuuuuaugcaaa

SEQ ID NO: 527145 - RNA, 17 nt, Homo sapiens
ccuuuuccuauccuuau

SEQ ID NO: 527146 - RNA, 22 nt, Homo sapiens
cgaaauuaaaucugaauaaaua

SEQ ID NO: 527147 - RNA, 24 nt, Homo sapiens
cgacauggcuccggccucugccuu

SEQ ID NO: 527148 - RNA, 11 nt, Homo sapiens
cgacccauuca

SEQ ID NO: 527149 - RNA, 16 nt, Homo sapiens
cgagcagucagcauuc

SEQ ID NO: 527150 - RNA, 21 nt, Homo sapiens
cgagcuguuuacagugaugcc

SEQ ID NO: 527151 - RNA, 14 nt, Homo sapiens
cgaguuaagaacau

SEQ ID NO: 527152 - RNA, 20 nt, Homo sapiens
cgauaucuucagaaaaccua

SEQ ID NO: 527153 - RNA, 23 nt, Homo sapiens
cgaugauguacagauucuuucag

SEQ ID NO: 527154 - RNA, 12 nt, Homo sapiens
cgaugugcccag

SEQ ID NO: 527155 - RNA, 22 nt, Homo sapiens
cgcaaugcuucuagaguuuuau

SEQ ID NO: 527156 - RNA, 19 nt, Homo sapiens
cgcacuucugauguccgua

SEQ ID NO: 527157 - RNA, 14 nt, Homo sapiens
cgcaucuugccucc

SEQ ID NO: 527158 - RNA, 20 nt, Homo sapiens
cgccgucccaccagcuucac

SEQ ID NO: 527159 - RNA, 22 nt, Homo sapiens
cggacuuccuuuaggaucucag

SEQ ID NO: 527160 - RNA, 16 nt, Homo sapiens
cggauccagcaauucc

SEQ ID NO: 527161 - RNA, 14 nt, Homo sapiens
cggcucacugcaac

SEQ ID NO: 527162 - RNA, 23 nt, Homo sapiens
cgggaccgugggccgaggugacu

SEQ ID NO: 527163 - RNA, 21 nt, Homo sapiens
cggguaauucuauugggauau

SEQ ID NO: 527164 - RNA, 14 nt, Homo sapiens
cggucagugccuuu

SEQ ID NO: 527165 - RNA, 15 nt, Homo sapiens
cgguuaccucugcau

SEQ ID NO: 527166 - RNA, 16 nt, Homo sapiens
cguacaucugcaauau

SEQ ID NO: 527167 - RNA, 14 nt, Homo sapiens
cguccccucccucu

SEQ ID NO: 527168 - RNA, 12 nt, Homo sapiens
cguccuggucaa

SEQ ID NO: 527169 - RNA, 13 nt, Homo sapiens
cgucuaugcugcu

SEQ ID NO: 527170 - RNA, 23 nt, Homo sapiens
cgugauggcaggugccuguaauc

SEQ ID NO: 527171 - RNA, 24 nt, Homo sapiens
cgugcuccguagcucugcugcuga

SEQ ID NO: 527172 - RNA, 15 nt, Homo sapiens
cgugggccgcacugg

SEQ ID NO: 527173 - RNA, 19 nt, Homo sapiens
cgugguaugaaaugucuga

SEQ ID NO: 527174 - RNA, 21 nt, Homo sapiens
cguggucccaacuacucagcc

SEQ ID NO: 527175 - RNA, 14 nt, Homo sapiens
cuaaaaacuuagaa

SEQ ID NO: 527176 - RNA, 14 nt, Homo sapiens
cuaaaacacugaaa

SEQ ID NO: 527177 - RNA, 18 nt, Homo sapiens
cuaaagucuguugauuaa

SEQ ID NO: 527178 - RNA, 17 nt, Homo sapiens
cuaaaguuuugcaacaa

SEQ ID NO: 527179 - RNA, 17 nt, Homo sapiens
cuaaauaaaaauaugua

SEQ ID NO: 527180 - RNA, 23 nt, Homo sapiens
cuaaaugcuguucuuacacauaa

SEQ ID NO: 527181 - RNA, 15 nt, Homo sapiens
cuaaauuuauauuca

SEQ ID NO: 527182 - RNA, 14 nt, Homo sapiens
agggcugcccugag

SEQ ID NO: 527183 - RNA, 15 nt, Homo sapiens
aggggacaagggauu

SEQ ID NO: 527184 - RNA, 18 nt, Homo sapiens
aggggcaacuguaugaaa

SEQ ID NO: 527185 - RNA, 16 nt, Homo sapiens
aggggcugacucucca

SEQ ID NO: 527186 - RNA, 12 nt, Homo sapiens
agggggccucau

SEQ ID NO: 527187 - RNA, 14 nt, Homo sapiens
agggguccagccuc

SEQ ID NO: 527188 - RNA, 18 nt, Homo sapiens
aggguacagaugugcugu

SEQ ID NO: 527189 - RNA, 23 nt, Homo sapiens
aggguacagaugugcuguagcag

SEQ ID NO: 527190 - RNA, 20 nt, Homo sapiens
agggucaaggaguacuccaa

SEQ ID NO: 527191 - RNA, 15 nt, Homo sapiens
agggucccgguguau

SEQ ID NO: 527192 - RNA, 19 nt, Homo sapiens
agggucuucuuacaugcau

SEQ ID NO: 527193 - RNA, 23 nt, Homo sapiens
agggucuucuuacaugcauuuga

SEQ ID NO: 527194 - RNA, 16 nt, Homo sapiens
agggucuuugguguuu

SEQ ID NO: 527195 - RNA, 16 nt, Homo sapiens
aggguggcagaacuug

SEQ ID NO: 527196 - RNA, 17 nt, Homo sapiens
agggugugaugaaguca

SEQ ID NO: 527197 - RNA, 22 nt, Homo sapiens
agguaaauuuuuaggcaaagau

SEQ ID NO: 527198 - RNA, 16 nt, Homo sapiens
agguauggcucugcac

SEQ ID NO: 527199 - RNA, 19 nt, Homo sapiens
aggucaccaagcaguggcc

SEQ ID NO: 527200 - RNA, 21 nt, Homo sapiens
aggugaacacuuagugaucau

SEQ ID NO: 527201 - RNA, 21 nt, Homo sapiens
aggugaauaaacacacagauc

SEQ ID NO: 527202 - RNA, 22 nt, Homo sapiens
aggugacagaggcgaaggcaga

SEQ ID NO: 527203 - RNA, 15 nt, Homo sapiens
aggugacauuugcuc

SEQ ID NO: 527204 - RNA, 18 nt, Homo sapiens
aggugaggcucuucacau

SEQ ID NO: 527205 - RNA, 19 nt, Homo sapiens
aggugauccgccuaccuca

SEQ ID NO: 527206 - RNA, 12 nt, Homo sapiens
aggugccuguua

SEQ ID NO: 527207 - RNA, 23 nt, Homo sapiens
aggugggaggaggccugcacagg

SEQ ID NO: 527208 - RNA, 21 nt, Homo sapiens
aggugguucagacaagacaga

SEQ ID NO: 527209 - RNA, 15 nt, Homo sapiens
aggugucugccuuca

SEQ ID NO: 527210 - RNA, 23 nt, Homo sapiens
agguuacccgagaagcacuugag

SEQ ID NO: 527211 - RNA, 17 nt, Homo sapiens
agguuauuuugauguaa

SEQ ID NO: 527212 - RNA, 22 nt, Homo sapiens
aguaaaacucccccccacccaa

SEQ ID NO: 527213 - RNA, 17 nt, Homo sapiens
aguaaagaaaaguuuac

SEQ ID NO: 527214 - RNA, 16 nt, Homo sapiens
aguaacugaaccauuc

SEQ ID NO: 527215 - RNA, 16 nt, Homo sapiens
aguaagaauaccacau

SEQ ID NO: 527216 - RNA, 20 nt, Homo sapiens
aguacagcaugugccuuaau

SEQ ID NO: 527217 - RNA, 14 nt, Homo sapiens
aguaccuucaauac

SEQ ID NO: 527218 - RNA, 17 nt, Homo sapiens
aguaccuucaauacuua

SEQ ID NO: 527219 - RNA, 15 nt, Homo sapiens
aguacugaccacugg

SEQ ID NO: 527220 - RNA, 15 nt, Homo sapiens
aguagagcauaccac

SEQ ID NO: 527221 - RNA, 15 nt, Homo sapiens
aguagauccauuucc

SEQ ID NO: 527222 - RNA, 18 nt, Homo sapiens
aguagccucaauucucca

SEQ ID NO: 527223 - RNA, 16 nt, Homo sapiens
aguaggaggccuccac

SEQ ID NO: 527224 - RNA, 13 nt, Homo sapiens
aguaguagcugaa

SEQ ID NO: 527225 - RNA, 21 nt, Homo sapiens
aguauaggccaggcacagugg

SEQ ID NO: 527226 - RNA, 16 nt, Homo sapiens
aguauccaggcuuugu

SEQ ID NO: 527227 - RNA, 18 nt, Homo sapiens
aguauggcuccuccauau

SEQ ID NO: 527228 - RNA, 17 nt, Homo sapiens
agucacugacaguuaau

SEQ ID NO: 527229 - RNA, 15 nt, Homo sapiens
agucauccugccaac

SEQ ID NO: 527230 - RNA, 12 nt, Homo sapiens
agucaugguguu

SEQ ID NO: 527231 - RNA, 13 nt, Homo sapiens
agucaugguguug

SEQ ID NO: 527232 - RNA, 15 nt, Homo sapiens
agucauugaggcccu

SEQ ID NO: 527233 - RNA, 18 nt, Homo sapiens
agucauugaggcccugcu

SEQ ID NO: 527234 - RNA, 17 nt, Homo sapiens
aguccaaaauacuguuc

SEQ ID NO: 527235 - RNA, 15 nt, Homo sapiens
agucccacacugugc

SEQ ID NO: 527236 - RNA, 22 nt, Homo sapiens
aucaaauugugcaguacuuugu

SEQ ID NO: 527237 - RNA, 18 nt, Homo sapiens
aucaacaacauccacugu

SEQ ID NO: 527238 - RNA, 16 nt, Homo sapiens
aucaagccucugguca

SEQ ID NO: 527239 - RNA, 21 nt, Homo sapiens
aucaaggauguaguaucucau

SEQ ID NO: 527240 - RNA, 17 nt, Homo sapiens
aucaauucuguauucca

SEQ ID NO: 527241 - RNA, 13 nt, Homo sapiens
aucacacucucca

SEQ ID NO: 527242 - RNA, 14 nt, Homo sapiens
aucacacucuccau

SEQ ID NO: 527243 - RNA, 14 nt, Homo sapiens
aucacugcauuuca

SEQ ID NO: 527244 - RNA, 17 nt, Homo sapiens
aucagagauaaagcuua

SEQ ID NO: 527245 - RNA, 20 nt, Homo sapiens
aucagccacaccuuuuccag

SEQ ID NO: 527246 - RNA, 23 nt, Homo sapiens
aucauguauggugauagguaucu

SEQ ID NO: 527247 - RNA, 16 nt, Homo sapiens
auccagaucauuccuc

SEQ ID NO: 527248 - RNA, 14 nt, Homo sapiens
auccaggcuuugua

SEQ ID NO: 527249 - RNA, 20 nt, Homo sapiens
auccagguuuaugaaugaca

SEQ ID NO: 527250 - RNA, 18 nt, Homo sapiens
auccaugcaccuaccuua

SEQ ID NO: 527251 - RNA, 19 nt, Homo sapiens
auccaugcaccuaccuuag

SEQ ID NO: 527252 - RNA, 13 nt, Homo sapiens
aucccacuguaug

SEQ ID NO: 527253 - RNA, 19 nt, Homo sapiens
auccgauuccccuguagca

SEQ ID NO: 527254 - RNA, 17 nt, Homo sapiens
auccgcugccagccuug

SEQ ID NO: 527255 - RNA, 19 nt, Homo sapiens
auccuacaguacaaucagc

SEQ ID NO: 527256 - RNA, 19 nt, Homo sapiens
auccuagcuacuuggcagg

SEQ ID NO: 527257 - RNA, 15 nt, Homo sapiens
auccuccaguaccuu

SEQ ID NO: 527258 - RNA, 21 nt, Homo sapiens
auccucccuggcagacacaac

SEQ ID NO: 527259 - RNA, 22 nt, Homo sapiens
auccugguuucauaacuuccug

SEQ ID NO: 527260 - RNA, 12 nt, Homo sapiens
auccugugcaau

SEQ ID NO: 527261 - RNA, 15 nt, Homo sapiens
auccuuacaauguga

SEQ ID NO: 527262 - RNA, 15 nt, Homo sapiens
auccuuuuauucucc

SEQ ID NO: 527263 - RNA, 19 nt, Homo sapiens
auccuuuuauucuccagaa

SEQ ID NO: 527264 - RNA, 19 nt, Homo sapiens
aucgagaccauccuggcua

SEQ ID NO: 527265 - RNA, 15 nt, Homo sapiens
aucggccuccaugac

SEQ ID NO: 527266 - RNA, 17 nt, Homo sapiens
aucuaaaaacuuagaaa

SEQ ID NO: 527267 - RNA, 19 nt, Homo sapiens
aucuaaaagaaaccuucca

SEQ ID NO: 527268 - RNA, 18 nt, Homo sapiens
aucuaaauguauucugca

SEQ ID NO: 527269 - RNA, 15 nt, Homo sapiens
aucuaagcagcuuau

SEQ ID NO: 527270 - RNA, 15 nt, Homo sapiens
aucuagagcuuaaug

SEQ ID NO: 527271 - RNA, 18 nt, Homo sapiens
aucucagcgugggccaga

SEQ ID NO: 527272 - RNA, 17 nt, Homo sapiens
aucucaguauugucagg

SEQ ID NO: 527273 - RNA, 18 nt, Homo sapiens
aucucccuuuuccaugac

SEQ ID NO: 527274 - RNA, 20 nt, Homo sapiens
aucucuacuaaaaacacaaa

SEQ ID NO: 527275 - RNA, 22 nt, Homo sapiens
aucucugagaccacagaggcuc

SEQ ID NO: 527276 - RNA, 19 nt, Homo sapiens
aucucuucaugcuugacau

SEQ ID NO: 527277 - RNA, 14 nt, Homo sapiens
aucucuucuggugu

SEQ ID NO: 527278 - RNA, 21 nt, Homo sapiens
aucugaaagugguacuugauc

SEQ ID NO: 527279 - RNA, 17 nt, Homo sapiens
aucugccuguaucucuc

SEQ ID NO: 527280 - RNA, 20 nt, Homo sapiens
aucugguuauaucauucugg

SEQ ID NO: 527281 - RNA, 22 nt, Homo sapiens
aucuucaguauuuucuccacuu

SEQ ID NO: 527282 - RNA, 17 nt, Homo sapiens
aucuuccaaaugcaauu

SEQ ID NO: 527283 - RNA, 18 nt, Homo sapiens
aucuuuuuaaaaacucuu

SEQ ID NO: 527284 - RNA, 12 nt, Homo sapiens
augaaaaauugg

SEQ ID NO: 527285 - RNA, 21 nt, Homo sapiens
augaaaagcugaauccagauc

SEQ ID NO: 527286 - RNA, 19 nt, Homo sapiens
augaaaaucuccaucucaa

SEQ ID NO: 527287 - RNA, 18 nt, Homo sapiens
augaaagaaaauugaguu

SEQ ID NO: 527288 - RNA, 15 nt, Homo sapiens
augaaagucaaauuu

SEQ ID NO: 527289 - RNA, 15 nt, Homo sapiens
augaaaucuucccag

SEQ ID NO: 527290 - RNA, 20 nt, Homo sapiens
augaagaaguuucuaaaaac

SEQ ID NO: 527291 - RNA, 15 nt, Homo sapiens
augaaugcagauuac

SEQ ID NO: 527292 - RNA, 21 nt, Homo sapiens
augaaugcagauuacacugau

SEQ ID NO: 527293 - RNA, 18 nt, Homo sapiens
augaauucaagaaaggaa

SEQ ID NO: 527294 - RNA, 17 nt, Homo sapiens
augacccuuugccuguu

SEQ ID NO: 527295 - RNA, 21 nt, Homo sapiens
augacgucaucaucacauuca

SEQ ID NO: 527296 - RNA, 12 nt, Homo sapiens
augacuaaagag

SEQ ID NO: 527297 - RNA, 19 nt, Homo sapiens
augacuuagcgucaagaca

SEQ ID NO: 527298 - RNA, 15 nt, Homo sapiens
augagaaaugaugaa

SEQ ID NO: 527299 - RNA, 13 nt, Homo sapiens
augagaagcagaa

SEQ ID NO: 527300 - RNA, 16 nt, Homo sapiens
augagacucagugcag

SEQ ID NO: 527301 - RNA, 15 nt, Homo sapiens
augagauaacucaag

SEQ ID NO: 527302 - RNA, 23 nt, Homo sapiens
augaggaccaagggcaccuggag

SEQ ID NO: 527303 - RNA, 23 nt, Homo sapiens
augaggcaacccgugcucagcug

SEQ ID NO: 527304 - RNA, 22 nt, Homo sapiens
augagguucuggccccugucau

SEQ ID NO: 527305 - RNA, 16 nt, Homo sapiens
acauaacggaaaguuu

SEQ ID NO: 527306 - RNA, 13 nt, Homo sapiens
acauaacuuccua

SEQ ID NO: 527307 - RNA, 17 nt, Homo sapiens
acauaauuucaguggga

SEQ ID NO: 527308 - RNA, 17 nt, Homo sapiens
acauauuaggaaaauau

SEQ ID NO: 527309 - RNA, 16 nt, Homo sapiens
acauccagaguucugu

SEQ ID NO: 527310 - RNA, 19 nt, Homo sapiens
acauccgcgugugccugug

SEQ ID NO: 527311 - RNA, 18 nt, Homo sapiens
acaucggccuccaugacc

SEQ ID NO: 527312 - RNA, 23 nt, Homo sapiens
acaucucccuuuuccaugacugu

SEQ ID NO: 527313 - RNA, 22 nt, Homo sapiens
acaucuuugaccacgucaucgg

SEQ ID NO: 527314 - RNA, 15 nt, Homo sapiens
acaugagacuuuccg

SEQ ID NO: 527315 - RNA, 15 nt, Homo sapiens
acaugauaguuaaac

SEQ ID NO: 527316 - RNA, 23 nt, Homo sapiens
acauggcuccggccucugccuuu

SEQ ID NO: 527317 - RNA, 20 nt, Homo sapiens
acaugggugaacuuacuugc

SEQ ID NO: 527318 - RNA, 20 nt, Homo sapiens
acauggugaaaccccgucuc

SEQ ID NO: 527319 - RNA, 10 nt, Homo sapiens
acauguuaau

SEQ ID NO: 527320 - RNA, 21 nt, Homo sapiens
acauuauccauccucugagau

SEQ ID NO: 527321 - RNA, 19 nt, Homo sapiens
acauuauuucuaguccaaa

SEQ ID NO: 527322 - RNA, 21 nt, Homo sapiens
acauucccucuaauuugaacu

SEQ ID NO: 527323 - RNA, 21 nt, Homo sapiens
acauuuagcugugcucagaag

SEQ ID NO: 527324 - RNA, 22 nt, Homo sapiens
acauuucucauaccuuccccac

SEQ ID NO: 527325 - RNA, 16 nt, Homo sapiens
acauuucuucuaguga

SEQ ID NO: 527326 - RNA, 13 nt, Homo sapiens
acauuuggugggc

SEQ ID NO: 527327 - RNA, 16 nt, Homo sapiens
acauuuuaucauuaaa

SEQ ID NO: 527328 - RNA, 21 nt, Homo sapiens
acauuuuugucagagugcaca

SEQ ID NO: 527329 - RNA, 15 nt, Homo sapiens
accaagugcugucuu

SEQ ID NO: 527330 - RNA, 18 nt, Homo sapiens
accaaugaaaacauguac

SEQ ID NO: 527331 - RNA, 20 nt, Homo sapiens
accaaugaaaacauguacua

SEQ ID NO: 527332 - RNA, 17 nt, Homo sapiens
accacacccagugggaa

SEQ ID NO: 527333 - RNA, 20 nt, Homo sapiens
accacaccuggcccuugcaa

SEQ ID NO: 527334 - RNA, 21 nt, Homo sapiens
accacaccuggcccuugcaau

SEQ ID NO: 527335 - RNA, 20 nt, Homo sapiens
accagcagaaaaccuguuca

SEQ ID NO: 527336 - RNA, 11 nt, Homo sapiens
accagcucucu

SEQ ID NO: 527337 - RNA, 22 nt, Homo sapiens
accaggcaccucuuccuugaug

SEQ ID NO: 527338 - RNA, 18 nt, Homo sapiens
accaucuccccaggcuau

SEQ ID NO: 527339 - RNA, 23 nt, Homo sapiens
accaucugaaagugguacuugau

SEQ ID NO: 527340 - RNA, 16 nt, Homo sapiens
acccaagggcaggggc

SEQ ID NO: 527341 - RNA, 15 nt, Homo sapiens
acccagagcuguauu

SEQ ID NO: 527342 - RNA, 13 nt, Homo sapiens
acccagcaggcag

SEQ ID NO: 527343 - RNA, 14 nt, Homo sapiens
acccagucccacac

SEQ ID NO: 527344 - RNA, 18 nt, Homo sapiens
acccccuguccugacucu

SEQ ID NO: 527345 - RNA, 21 nt, Homo sapiens
acccgauuuguuuauuugcaa

SEQ ID NO: 527346 - RNA, 19 nt, Homo sapiens
acccugcugcuggugcaca

SEQ ID NO: 527347 - RNA, 20 nt, Homo sapiens
acccuguccugcagucccac

SEQ ID NO: 527348 - RNA, 20 nt, Homo sapiens
accgccaacugcagcucucc

SEQ ID NO: 527349 - RNA, 22 nt, Homo sapiens
accgcccaucaggguucucuua

SEQ ID NO: 527350 - RNA, 17 nt, Homo sapiens
accuaagggcccaaagg

SEQ ID NO: 527351 - RNA, 15 nt, Homo sapiens
accuacacacuguca

SEQ ID NO: 527352 - RNA, 17 nt, Homo sapiens
accuacccuccacaggc

SEQ ID NO: 527353 - RNA, 16 nt, Homo sapiens
accuagaguuuuauca

SEQ ID NO: 527354 - RNA, 22 nt, Homo sapiens
accucaguugaaaaugcaacuc

SEQ ID NO: 527355 - RNA, 20 nt, Homo sapiens
accuccaacaacgacacauu

SEQ ID NO: 527356 - RNA, 23 nt, Homo sapiens
accuccaggcuuucccacuuccc

SEQ ID NO: 527357 - RNA, 18 nt, Homo sapiens
accuccgccagauccugc

SEQ ID NO: 527358 - RNA, 20 nt, Homo sapiens
accuccgccagauccugcag

SEQ ID NO: 527359 - RNA, 14 nt, Homo sapiens
accuccuuuaccag

SEQ ID NO: 527360 - RNA, 17 nt, Homo sapiens
accucggcacacacugu

SEQ ID NO: 527361 - RNA, 14 nt, Homo sapiens
accucuuccuugau

SEQ ID NO: 527362 - RNA, 16 nt, Homo sapiens
accugacucaggccag

SEQ ID NO: 527363 - RNA, 13 nt, Homo sapiens
accugacucuugc

SEQ ID NO: 527364 - RNA, 15 nt, Homo sapiens
accugacucuugcag

SEQ ID NO: 527365 - RNA, 21 nt, Homo sapiens
accugagucugcaugugcacg

SEQ ID NO: 527366 - RNA, 17 nt, Homo sapiens
accugcaugugcuguca

SEQ ID NO: 527367 - RNA, 19 nt, Homo sapiens
accugcccaaggaugcugu

SEQ ID NO: 527368 - RNA, 13 nt, Homo sapiens
aaaaaauacauua

SEQ ID NO: 527369 - RNA, 21 nt, Homo sapiens
aaaaaauuuuagcucuuccca

SEQ ID NO: 527370 - RNA, 21 nt, Homo sapiens
aaaaacacccgacgucaugua

SEQ ID NO: 527371 - RNA, 13 nt, Homo sapiens
aaaaacucuucag

SEQ ID NO: 527372 - RNA, 14 nt, Homo sapiens
aaaaauaaagggaa

SEQ ID NO: 527373 - RNA, 12 nt, Homo sapiens
aaaaauguucuu

SEQ ID NO: 527374 - RNA, 20 nt, Homo sapiens
aaaaauuuuagcucuuccca

SEQ ID NO: 527375 - RNA, 15 nt, Homo sapiens
aaaacagaugaccau

SEQ ID NO: 527376 - RNA, 13 nt, Homo sapiens
aaaacauuugcug

SEQ ID NO: 527377 - RNA, 17 nt, Homo sapiens
aaaacuaaccaucugaa

SEQ ID NO: 527378 - RNA, 19 nt, Homo sapiens
aaaacucaguaagaauuau

SEQ ID NO: 527379 - RNA, 15 nt, Homo sapiens
aaaacucugcaugua

SEQ ID NO: 527380 - RNA, 18 nt, Homo sapiens
aaaacucuucagugcaaa

SEQ ID NO: 527381 - RNA, 18 nt, Homo sapiens
aaaacuggcuacugcucu

SEQ ID NO: 527382 - RNA, 20 nt, Homo sapiens
aaaagcgacccauucagaga

SEQ ID NO: 527383 - RNA, 16 nt, Homo sapiens
aaaaggauaguaagca

SEQ ID NO: 527384 - RNA, 21 nt, Homo sapiens
aaaaggucugaggacugagcc

SEQ ID NO: 527385 - RNA, 19 nt, Homo sapiens
aaaaguugguguugacaua

SEQ ID NO: 527386 - RNA, 21 nt, Homo sapiens
aaaaguugguguugacauaca

SEQ ID NO: 527387 - RNA, 17 nt, Homo sapiens
aaaaguuuaaagacacu

SEQ ID NO: 527388 - RNA, 14 nt, Homo sapiens
aaaauacauaguga

SEQ ID NO: 527389 - RNA, 20 nt, Homo sapiens
aaaauauucaugcuugccau

SEQ ID NO: 527390 - RNA, 16 nt, Homo sapiens
aaaaucuaagcagcuu

SEQ ID NO: 527391 - RNA, 20 nt, Homo sapiens
aaaaugaaguuuugauuuau

SEQ ID NO: 527392 - RNA, 13 nt, Homo sapiens
aaaaugacauuaa

SEQ ID NO: 527393 - RNA, 15 nt, Homo sapiens
aaaaugccagucuca

SEQ ID NO: 527394 - RNA, 22 nt, Homo sapiens
aaaaugccagucucauugucac

SEQ ID NO: 527395 - RNA, 22 nt, Homo sapiens
aaaaugggagacagccucuuac

SEQ ID NO: 527396 - RNA, 15 nt, Homo sapiens
aaaauuaaacaaaua

SEQ ID NO: 527397 - RNA, 19 nt, Homo sapiens
aaaauuaaacaaauaugca

SEQ ID NO: 527398 - RNA, 17 nt, Homo sapiens
aaaauugcuauguuacu

SEQ ID NO: 527399 - RNA, 18 nt, Homo sapiens
aaaauuuuguauguuaaa

SEQ ID NO: 527400 - RNA, 21 nt, Homo sapiens
aaaauuuuuuuuguaacugga

SEQ ID NO: 527401 - RNA, 16 nt, Homo sapiens
aaacaaaaaagacuug

SEQ ID NO: 527402 - RNA, 16 nt, Homo sapiens
aaacagaacaggguca

SEQ ID NO: 527403 - RNA, 16 nt, Homo sapiens
aaacagauuucauacc

SEQ ID NO: 527404 - RNA, 14 nt, Homo sapiens
aaacauguacuaca

SEQ ID NO: 527405 - RNA, 19 nt, Homo sapiens
aaacauguuaaugacaaua

SEQ ID NO: 527406 - RNA, 11 nt, Homo sapiens
aaacauuugcu

SEQ ID NO: 527407 - RNA, 16 nt, Homo sapiens
aaaccuaggucuccag

SEQ ID NO: 527408 - RNA, 13 nt, Homo sapiens
aaacgcuaccucu

SEQ ID NO: 527409 - RNA, 21 nt, Homo sapiens
aaacggugaggccccaguggc

SEQ ID NO: 527410 - RNA, 18 nt, Homo sapiens
aaacguggcacacacuga

SEQ ID NO: 527411 - RNA, 13 nt, Homo sapiens
aaacuaaccaucu

SEQ ID NO: 527412 - RNA, 23 nt, Homo sapiens
aaacuaaccuugaauaaggccca

SEQ ID NO: 527413 - RNA, 15 nt, Homo sapiens
aaacuaccaauccca

SEQ ID NO: 527414 - RNA, 18 nt, Homo sapiens
aaacuaugaggacugccu

SEQ ID NO: 527415 - RNA, 16 nt, Homo sapiens
aaacuccagaugccac

SEQ ID NO: 527416 - RNA, 20 nt, Homo sapiens
gguuggggugacagucauca

SEQ ID NO: 527417 - RNA, 17 nt, Homo sapiens
gguuucucucccuccuu

SEQ ID NO: 527418 - RNA, 22 nt, Homo sapiens
guaaaccuugaagggcuuuauu

SEQ ID NO: 527419 - RNA, 20 nt, Homo sapiens
guaaacuucugcaacaagca

SEQ ID NO: 527420 - RNA, 21 nt, Homo sapiens
guaaaucauauuuuagcugca

SEQ ID NO: 527421 - RNA, 14 nt, Homo sapiens
guaacgauguugua

SEQ ID NO: 527422 - RNA, 11 nt, Homo sapiens
guaaguauuuu

SEQ ID NO: 527423 - RNA, 16 nt, Homo sapiens
guaaucccagcacuuu

SEQ ID NO: 527424 - RNA, 14 nt, Homo sapiens
guaaucuacaccaa

SEQ ID NO: 527425 - RNA, 15 nt, Homo sapiens
guacagauucuuuca

SEQ ID NO: 527426 - RNA, 21 nt, Homo sapiens
guacaucaaguccaucugaca

SEQ ID NO: 527427 - RNA, 14 nt, Homo sapiens
guaccaauucagug

SEQ ID NO: 527428 - RNA, 18 nt, Homo sapiens
guaccugguccccacugc

SEQ ID NO: 527429 - RNA, 19 nt, Homo sapiens
guacuacagcuauauuuga

SEQ ID NO: 527430 - RNA, 19 nt, Homo sapiens
guacuauugugaccacagg

SEQ ID NO: 527431 - RNA, 11 nt, Homo sapiens
guacuguuacu

SEQ ID NO: 527432 - RNA, 13 nt, Homo sapiens
guacuuuaccuaa

SEQ ID NO: 527433 - RNA, 23 nt, Homo sapiens
guagaaguuuggcugcugucaua

SEQ ID NO: 527434 - RNA, 12 nt, Homo sapiens
guagacuguggc

SEQ ID NO: 527435 - RNA, 15 nt, Homo sapiens
guagcauaacuguag

SEQ ID NO: 527436 - RNA, 16 nt, Homo sapiens
guagcucugcugcuga

SEQ ID NO: 527437 - RNA, 17 nt, Homo sapiens
guagcucugcugcugau

SEQ ID NO: 527438 - RNA, 19 nt, Homo sapiens
guagguaggaagcacugaa

SEQ ID NO: 527439 - RNA, 16 nt, Homo sapiens
guaggugaaagaacaa

SEQ ID NO: 527440 - RNA, 16 nt, Homo sapiens
guaguuagccaucuaa

SEQ ID NO: 527441 - RNA, 23 nt, Homo sapiens
guaguucuagcaguccccagcug

SEQ ID NO: 527442 - RNA, 16 nt, Homo sapiens
guauauacuuugccac

SEQ ID NO: 527443 - RNA, 17 nt, Homo sapiens
guauaugucuuuuaccc

SEQ ID NO: 527444 - RNA, 12 nt, Homo sapiens
guaucauucaac

SEQ ID NO: 527445 - RNA, 11 nt, Homo sapiens
guauccaaaaa

SEQ ID NO: 527446 - RNA, 23 nt, Homo sapiens
guaucuuuugaacuggcaauugu

SEQ ID NO: 527447 - RNA, 14 nt, Homo sapiens
guaugacuaaagag

SEQ ID NO: 527448 - RNA, 13 nt, Homo sapiens
guauggcucugca

SEQ ID NO: 527449 - RNA, 14 nt, Homo sapiens
guuuaccaucugaa

SEQ ID NO: 527450 - RNA, 13 nt, Homo sapiens
guuuagugauauu

SEQ ID NO: 527451 - RNA, 21 nt, Homo sapiens
guuuauaaugaagaacacugu

SEQ ID NO: 527452 - RNA, 19 nt, Homo sapiens
guuuaugauauuucuugcu

SEQ ID NO: 527453 - RNA, 12 nt, Homo sapiens
guuuccugguca

SEQ ID NO: 527454 - RNA, 16 nt, Homo sapiens
guuucuuuuugcucgc

SEQ ID NO: 527455 - RNA, 21 nt, Homo sapiens
guuugaaaauauuuuguugcc

SEQ ID NO: 527456 - RNA, 18 nt, Homo sapiens
guuugauaccugcacugu

SEQ ID NO: 527457 - RNA, 19 nt, Homo sapiens
guuugauaccugcacuguc

SEQ ID NO: 527458 - RNA, 22 nt, Homo sapiens
guuugauaccugcacuguccug

SEQ ID NO: 527459 - RNA, 17 nt, Homo sapiens
guuuggacagcugauaa

SEQ ID NO: 527460 - RNA, 22 nt, Homo sapiens
guuuguuggaaaguaacuguga

SEQ ID NO: 527461 - RNA, 14 nt, Homo sapiens
guuuucuucacuau

SEQ ID NO: 527462 - RNA, 17 nt, Homo sapiens
uaaaaauagucuuccac

SEQ ID NO: 527463 - RNA, 14 nt, Homo sapiens
uaaaacuucugcuc

SEQ ID NO: 527464 - RNA, 20 nt, Homo sapiens
uaaaagaacuuacugauuau

SEQ ID NO: 527465 - RNA, 16 nt, Homo sapiens
uaaaagcaugucaaca

SEQ ID NO: 527466 - RNA, 16 nt, Homo sapiens
uaaaauugaguuugua

SEQ ID NO: 527467 - RNA, 21 nt, Homo sapiens
uaaaccuugaagggcuuuauu

SEQ ID NO: 527468 - RNA, 13 nt, Homo sapiens
uaaacucugucca

SEQ ID NO: 527469 - RNA, 20 nt, Homo sapiens
uaaagaaaaguuuaccaucu

SEQ ID NO: 527470 - RNA, 12 nt, Homo sapiens
uaaagauuuaua

SEQ ID NO: 527471 - RNA, 17 nt, Homo sapiens
uaaagcaaugugguagu

SEQ ID NO: 527472 - RNA, 17 nt, Homo sapiens
uaaagcaugaaauguga

SEQ ID NO: 527473 - RNA, 21 nt, Homo sapiens
uaaagcaugaaaugugaauuu

SEQ ID NO: 527474 - RNA, 20 nt, Homo sapiens
uaaagccuguggguuugguc

SEQ ID NO: 527475 - RNA, 12 nt, Homo sapiens
uaaagcuuuaua

SEQ ID NO: 527476 - RNA, 19 nt, Homo sapiens
uaaaggaaaaucacaucuc

SEQ ID NO: 527477 - RNA, 21 nt, Homo sapiens
uaaaggcagcugccucugcuc

SEQ ID NO: 527478 - RNA, 17 nt, Homo sapiens
uaaagucuguugauuaa

SEQ ID NO: 527479 - RNA, 22 nt, Homo sapiens
uaaaguguugccaccauaccuc

SEQ ID NO: 527480 - RNA, 14 nt, Homo sapiens
uaaaguuacaguuu

SEQ ID NO: 527481 - RNA, 14 nt, Homo sapiens
uaaaguuuugcaac

SEQ ID NO: 527482 - RNA, 20 nt, Homo sapiens
uaaaguuuugcaacaauaaa

SEQ ID NO: 527483 - RNA, 17 nt, Homo sapiens
uaaauacucagugauga

SEQ ID NO: 527484 - RNA, 13 nt, Homo sapiens
uaaauccugccau

SEQ ID NO: 527485 - RNA, 12 nt, Homo sapiens
uaaaucugaaua

SEQ ID NO: 527486 - RNA, 22 nt, Homo sapiens
uaaaugaaacuuaagaauugaa

SEQ ID NO: 527487 - RNA, 16 nt, Homo sapiens
uaaauugcaucacugu

SEQ ID NO: 527488 - RNA, 15 nt, Homo sapiens
uaaauuuauauucau

SEQ ID NO: 527489 - RNA, 21 nt, Homo sapiens
uaaauuuugaaaacugugcaa

SEQ ID NO: 527490 - RNA, 17 nt, Homo sapiens
uaaauuuuuaagagaaa

SEQ ID NO: 527491 - RNA, 21 nt, Homo sapiens
uaacaauucccccauccuuca

SEQ ID NO: 527492 - RNA, 14 nt, Homo sapiens
uaacacggugcuca

SEQ ID NO: 527493 - RNA, 21 nt, Homo sapiens
uaacagauggaaaaacugagg

SEQ ID NO: 527494 - RNA, 23 nt, Homo sapiens
uaacagguguguauguaaaguua

SEQ ID NO: 527495 - RNA, 16 nt, Homo sapiens
uaacaguggacaaagu

SEQ ID NO: 527496 - RNA, 14 nt, Homo sapiens
uaacaucugaccug

SEQ ID NO: 527497 - RNA, 16 nt, Homo sapiens
uaacaucuguuaucaa

SEQ ID NO: 527498 - RNA, 15 nt, Homo sapiens
uaacaugugaaaaga

SEQ ID NO: 527499 - RNA, 18 nt, Homo sapiens
uaaccacuaacauuguga

SEQ ID NO: 527500 - RNA, 17 nt, Homo sapiens
uaacgauguuguauuga

SEQ ID NO: 527501 - RNA, 24 nt, Homo sapiens
uaacgugugugucuuacauugcca

SEQ ID NO: 527502 - RNA, 15 nt, Homo sapiens
uaacucagaauuauu

SEQ ID NO: 527503 - RNA, 17 nt, Homo sapiens
uaacugaaccauuccaa

SEQ ID NO: 527504 - RNA, 14 nt, Homo sapiens
uaacugcacaaaca

SEQ ID NO: 527505 - RNA, 20 nt, Homo sapiens
uaacuguagcucaaguuuaa

SEQ ID NO: 527506 - RNA, 22 nt, Homo sapiens
uaagaaaguaauuuaauuugua

SEQ ID NO: 527507 - RNA, 12 nt, Homo sapiens
uaagaagacauu

SEQ ID NO: 527508 - RNA, 19 nt, Homo sapiens
uaagacaauggacccuuuu

SEQ ID NO: 527509 - RNA, 13 nt, Homo sapiens
uaagacucugcca

SEQ ID NO: 527510 - RNA, 18 nt, Homo sapiens
uaagauugauaucuauaa

SEQ ID NO: 527511 - RNA, 14 nt, Homo sapiens
uaagauuuugcacc

SEQ ID NO: 527512 - RNA, 22 nt, Homo sapiens
uaagcccggauagacuuauugc

SEQ ID NO: 527513 - RNA, 13 nt, Homo sapiens
uaaggaacaacgu

SEQ ID NO: 527514 - RNA, 16 nt, Homo sapiens
uaaggaggcacugcug

SEQ ID NO: 527515 - RNA, 17 nt, Homo sapiens
uaagggugggugcucag

SEQ ID NO: 527516 - RNA, 20 nt, Homo sapiens
uaaguauuuuccuguuguca

SEQ ID NO: 527517 - RNA, 12 nt, Homo sapiens
uaagucuuucau

SEQ ID NO: 527518 - RNA, 19 nt, Homo sapiens
uaaguguccuccaucaauu

SEQ ID NO: 527519 - RNA, 15 nt, Homo sapiens
uaagugucucacuaa

SEQ ID NO: 527520 - RNA, 15 nt, Homo sapiens
uaauaaacugcaagu

SEQ ID NO: 527521 - RNA, 15 nt, Homo sapiens
uaauaagcuaaagag

SEQ ID NO: 527522 - RNA, 14 nt, Homo sapiens
uaauacauauagca

SEQ ID NO: 527523 - RNA, 17 nt, Homo sapiens
uaauaccagaacucuaa

SEQ ID NO: 527524 - RNA, 18 nt, Homo sapiens
uaauacguagcucucuua

SEQ ID NO: 527525 - RNA, 14 nt, Homo sapiens
uaaucuaguuuuau

SEQ ID NO: 527526 - RNA, 11 nt, Homo sapiens
uaaucucagga

SEQ ID NO: 527527 - RNA, 14 nt, Homo sapiens
uaaucuucagguga

SEQ ID NO: 527528 - RNA, 22 nt, Homo sapiens
uaaucuuuauacuggguuucaa

SEQ ID NO: 527529 - RNA, 21 nt, Homo sapiens
uaauuaaauucugagccugau

SEQ ID NO: 527530 - RNA, 12 nt, Homo sapiens
uaauucugcaga

SEQ ID NO: 527531 - RNA, 13 nt, Homo sapiens
uaauuuguaaaac

SEQ ID NO: 527532 - RNA, 13 nt, Homo sapiens
uaauuuucgcuua

SEQ ID NO: 527533 - RNA, 17 nt, Homo sapiens
uaauuuuugaaaacugg

SEQ ID NO: 527534 - RNA, 15 nt, Homo sapiens
uacaaauacaugugu

SEQ ID NO: 527535 - RNA, 15 nt, Homo sapiens
uacaaauucuucuaa

SEQ ID NO: 527536 - RNA, 14 nt, Homo sapiens
uacaacucacauua

SEQ ID NO: 527537 - RNA, 16 nt, Homo sapiens
uacaagucagcuccag

SEQ ID NO: 527538 - RNA, 19 nt, Homo sapiens
uacaagucagcuccagcuu

SEQ ID NO: 527539 - RNA, 21 nt, Homo sapiens
cacagcugccaucgaccugga

SEQ ID NO: 527540 - RNA, 15 nt, Homo sapiens
cacaguggggcugca

SEQ ID NO: 527541 - RNA, 17 nt, Homo sapiens
cacaugaaaccuacaca

SEQ ID NO: 527542 - RNA, 19 nt, Homo sapiens
cacaugaaaccuacacacu

SEQ ID NO: 527543 - RNA, 17 nt, Homo sapiens
cacaugcccaugaugag

SEQ ID NO: 527544 - RNA, 18 nt, Homo sapiens
cacauucgggaccaauau

SEQ ID NO: 527545 - RNA, 22 nt, Homo sapiens
caccaaggaaacgcuaccucuc

SEQ ID NO: 527546 - RNA, 22 nt, Homo sapiens
caccaaguaccaguauaagcau

SEQ ID NO: 527547 - RNA, 16 nt, Homo sapiens
caccaaugaaaacaug

SEQ ID NO: 527548 - RNA, 21 nt, Homo sapiens
caccaaugaaaacauguacua

SEQ ID NO: 527549 - RNA, 14 nt, Homo sapiens
caccacacacacac

SEQ ID NO: 527550 - RNA, 13 nt, Homo sapiens
caccacaccauca

SEQ ID NO: 527551 - RNA, 23 nt, Homo sapiens
caccagagggauaaaaacaauac

SEQ ID NO: 527552 - RNA, 23 nt, Homo sapiens
caccaggaauccccaacaugcac

SEQ ID NO: 527553 - RNA, 18 nt, Homo sapiens
caccaggcacugcugcac

SEQ ID NO: 527554 - RNA, 15 nt, Homo sapiens
caccauguuggccag

SEQ ID NO: 527555 - RNA, 16 nt, Homo sapiens
cacccccauaacaauu

SEQ ID NO: 527556 - RNA, 13 nt, Homo sapiens
cacccgugagaaa

SEQ ID NO: 527557 - RNA, 18 nt, Homo sapiens
caccguacaucugcaaua

SEQ ID NO: 527558 - RNA, 23 nt, Homo sapiens
caccuaccuuagaaaacaaguau

SEQ ID NO: 527559 - RNA, 14 nt, Homo sapiens
caccucuuccuuga

SEQ ID NO: 527560 - RNA, 15 nt, Homo sapiens
caccugcaugugcug

SEQ ID NO: 527561 - RNA, 20 nt, Homo sapiens
caccuggguccaucagagaa

SEQ ID NO: 527562 - RNA, 11 nt, Homo sapiens
caccuguaauc

SEQ ID NO: 527563 - RNA, 14 nt, Homo sapiens
caccuguaauccca

SEQ ID NO: 527564 - RNA, 15 nt, Homo sapiens
cacgauuuugcacaa

SEQ ID NO: 527565 - RNA, 16 nt, Homo sapiens
cacuaaaagcaugaau

SEQ ID NO: 527566 - RNA, 21 nt, Homo sapiens
cacuaucauggacuacaccag

SEQ ID NO: 527567 - RNA, 16 nt, Homo sapiens
cacugcacuguuuuca

SEQ ID NO: 527568 - RNA, 23 nt, Homo sapiens
cacugcuguauuuuuauuuuugc

SEQ ID NO: 527569 - RNA, 18 nt, Homo sapiens
cacuggcagcaucuucac

SEQ ID NO: 527570 - RNA, 22 nt, Homo sapiens
cacugguggccgugguggggcc

SEQ ID NO: 527571 - RNA, 20 nt, Homo sapiens
cacugucaugcuucaucauu

SEQ ID NO: 527572 - RNA, 14 nt, Homo sapiens
cacuguccugacca

SEQ ID NO: 527573 - RNA, 20 nt, Homo sapiens
cacugugcucuauuaccauu

SEQ ID NO: 527574 - RNA, 17 nt, Homo sapiens
cacuguggagaccacac

SEQ ID NO: 527575 - RNA, 15 nt, Homo sapiens
cacuguggagcucag

SEQ ID NO: 527576 - RNA, 19 nt, Homo sapiens
cacuguguacaccucugga

SEQ ID NO: 527577 - RNA, 12 nt, Homo sapiens
cacuuccagggg

SEQ ID NO: 527578 - RNA, 17 nt, Homo sapiens
cacuuuaaacaccccca

SEQ ID NO: 527579 - RNA, 18 nt, Homo sapiens
cacuuugucuaacucaga

SEQ ID NO: 527580 - RNA, 19 nt, Homo sapiens
ucagaccugcauugaacag

SEQ ID NO: 527581 - RNA, 15 nt, Homo sapiens
ucagagaacuuuccc

SEQ ID NO: 527582 - RNA, 14 nt, Homo sapiens
ucagauguaaauag

SEQ ID NO: 527583 - RNA, 22 nt, Homo sapiens
ucagcauccagguuuaugaaug

SEQ ID NO: 527584 - RNA, 21 nt, Homo sapiens
ucagcaugccugaacuacaua

SEQ ID NO: 527585 - RNA, 16 nt, Homo sapiens
ucagcgggagcacugc

SEQ ID NO: 527586 - RNA, 13 nt, Homo sapiens
ucagcuuaucucu

SEQ ID NO: 527587 - RNA, 19 nt, Homo sapiens
ucaggcagggugagcucca

SEQ ID NO: 527588 - RNA, 22 nt, Homo sapiens
ucagguagaagguugacacagu

SEQ ID NO: 527589 - RNA, 17 nt, Homo sapiens
ucaguauccacacauaa

SEQ ID NO: 527590 - RNA, 17 nt, Homo sapiens
ucagucccucugcucuc

SEQ ID NO: 527591 - RNA, 21 nt, Homo sapiens
ucagugaauccugaaacuggu

SEQ ID NO: 527592 - RNA, 16 nt, Homo sapiens
ucaguuugacuacucu

SEQ ID NO: 527593 - RNA, 16 nt, Homo sapiens
ucaguuuuacucugcu

SEQ ID NO: 527594 - RNA, 21 nt, Homo sapiens
ucaguuuuacucugcugcaaa

SEQ ID NO: 527595 - RNA, 11 nt, Homo sapiens
ucauaccuuau

SEQ ID NO: 527596 - RNA, 14 nt, Homo sapiens
ucauacuacugaaa

SEQ ID NO: 527597 - RNA, 18 nt, Homo sapiens
ucauaguucccaggugau

SEQ ID NO: 527598 - RNA, 20 nt, Homo sapiens
ucauauauuuuuaccaucug

SEQ ID NO: 527599 - RNA, 16 nt, Homo sapiens
ucauaucaaaggguaa

SEQ ID NO: 527600 - RNA, 14 nt, Homo sapiens
ucaucaggugcaua

SEQ ID NO: 527601 - RNA, 15 nt, Homo sapiens
ucaucaggugcauag

SEQ ID NO: 527602 - RNA, 18 nt, Homo sapiens
ucaucaggugcauagcaa

SEQ ID NO: 527603 - RNA, 23 nt, Homo sapiens
ucaucaggugcauagcaagugaa

SEQ ID NO: 527604 - RNA, 12 nt, Homo sapiens
ucaucauucccu

SEQ ID NO: 527605 - RNA, 21 nt, Homo sapiens
ucauccuagucuagcauucug

SEQ ID NO: 527606 - RNA, 18 nt, Homo sapiens
ucaucuucacugcaauuu

SEQ ID NO: 527607 - RNA, 19 nt, Homo sapiens
ucaugacuccuacuuuuca

SEQ ID NO: 527608 - RNA, 15 nt, Homo sapiens
ucaugagcuugaaca

SEQ ID NO: 527609 - RNA, 20 nt, Homo sapiens
ucaugagcuugaacaaggac

SEQ ID NO: 527610 - RNA, 17 nt, Homo sapiens
ucaugcuuuugcuugca

SEQ ID NO: 527611 - RNA, 17 nt, Homo sapiens
ucauggaggccaagaac

SEQ ID NO: 527612 - RNA, 23 nt, Homo sapiens
ucaugucagcuuauaugugacac

SEQ ID NO: 527613 - RNA, 12 nt, Homo sapiens
ucauuacuguga

SEQ ID NO: 527614 - RNA, 17 nt, Homo sapiens
ucauuacuguguucaau

SEQ ID NO: 527615 - RNA, 17 nt, Homo sapiens
ucauucccucucaucuc

SEQ ID NO: 527616 - RNA, 22 nt, Homo sapiens
ucauucccucucaucucaggua

SEQ ID NO: 527617 - RNA, 18 nt, Homo sapiens
ucauucgcuacuaugauu

SEQ ID NO: 527618 - RNA, 15 nt, Homo sapiens
ucauuguuucugcau

SEQ ID NO: 527619 - RNA, 23 nt, Homo sapiens
ucauuuaaaaagcucacugcuga

SEQ ID NO: 527620 - RNA, 22 nt, Homo sapiens
ucauuucuaaauuuauauucau

SEQ ID NO: 527621 - RNA, 23 nt, Homo sapiens
ucauuuggaaugaauacagcauu

SEQ ID NO: 527622 - RNA, 22 nt, Homo sapiens
uccaaagaggcugccccucuca

SEQ ID NO: 527623 - RNA, 16 nt, Homo sapiens
uccaacacaucucccu

SEQ ID NO: 527624 - RNA, 15 nt, Homo sapiens
uccaagacagagaca

SEQ ID NO: 527625 - RNA, 12 nt, Homo sapiens
uccaauacucag

SEQ ID NO: 527626 - RNA, 20 nt, Homo sapiens
uccaauuuuuuaagugaaaa

SEQ ID NO: 527627 - RNA, 22 nt, Homo sapiens
uccacaaugaugaugauuucag

SEQ ID NO: 527628 - RNA, 22 nt, Homo sapiens
uccacacccacuuuguccauuu

SEQ ID NO: 527629 - RNA, 18 nt, Homo sapiens
uccacauauuucagugag

SEQ ID NO: 527630 - RNA, 21 nt, Homo sapiens
uccacccagcaggcagagugg

SEQ ID NO: 527631 - RNA, 12 nt, Homo sapiens
uccaccuguggg

SEQ ID NO: 527632 - RNA, 23 nt, Homo sapiens
uccaccuguggguguagccaggu

SEQ ID NO: 527633 - RNA, 20 nt, Homo sapiens
uccacugcaaauaaagccuu

SEQ ID NO: 527634 - RNA, 16 nt, Homo sapiens
uccagcauuuagcugg

SEQ ID NO: 527635 - RNA, 16 nt, Homo sapiens
uccaggccugcagcag

SEQ ID NO: 527636 - RNA, 19 nt, Homo sapiens
uccagggucugagugcaag

SEQ ID NO: 527637 - RNA, 12 nt, Homo sapiens
uccaggugcaga

SEQ ID NO: 527638 - RNA, 22 nt, Homo sapiens
uccagguuuaugaaugacagua

SEQ ID NO: 527639 - RNA, 16 nt, Homo sapiens
uccagucccaugaccu

SEQ ID NO: 527640 - RNA, 15 nt, Homo sapiens
uccauaaaguacaaa

SEQ ID NO: 527641 - RNA, 15 nt, Homo sapiens
uccaugauuuagcaa

SEQ ID NO: 527642 - RNA, 22 nt, Homo sapiens
uccaugauuuuaaauugugauc

SEQ ID NO: 527643 - RNA, 13 nt, Homo sapiens
uccaugugccuuu

SEQ ID NO: 527644 - RNA, 22 nt, Homo sapiens
uccauuuugugaauugugacau

SEQ ID NO: 527645 - RNA, 22 nt, Homo sapiens
ucccaacugaguguuauuugca

SEQ ID NO: 527646 - RNA, 11 nt, Homo sapiens
ucccacacugu

SEQ ID NO: 527647 - RNA, 13 nt, Homo sapiens
ucccacacugugg

SEQ ID NO: 527648 - RNA, 20 nt, Homo sapiens
ucccacuuugcuguuccuua

SEQ ID NO: 527649 - RNA, 19 nt, Homo sapiens
ucccacuuuucggagacag

SEQ ID NO: 527650 - RNA, 13 nt, Homo sapiens
ucccauccuugau

SEQ ID NO: 527651 - RNA, 12 nt, Homo sapiens
ucccauguauuu

SEQ ID NO: 527652 - RNA, 15 nt, Homo sapiens
uccccaacaauguga

SEQ ID NO: 527653 - RNA, 19 nt, Homo sapiens
uccccagccugcucccuag

SEQ ID NO: 527654 - RNA, 18 nt, Homo sapiens
uccccaugggcacagugg

SEQ ID NO: 527655 - RNA, 21 nt, Homo sapiens
ucccccucaauagaucuccag

SEQ ID NO: 527656 - RNA, 15 nt, Homo sapiens
uccccuaaaauaaca

SEQ ID NO: 527657 - RNA, 22 nt, Homo sapiens
uccccucagggauacgacacau

SEQ ID NO: 527658 - RNA, 19 nt, Homo sapiens
ucccgauucccaacugagu

SEQ ID NO: 527659 - RNA, 20 nt, Homo sapiens
ucccuagccagaggcucuaa

SEQ ID NO: 527660 - RNA, 23 nt, Homo sapiens
ucccuagccagaggcucuaaugu

SEQ ID NO: 527661 - RNA, 16 nt, Homo sapiens
ucccuaggaaacucac

SEQ ID NO: 527662 - RNA, 22 nt, Homo sapiens
ucccucugucccucuccuugcc

SEQ ID NO: 527663 - RNA, 15 nt, Homo sapiens
ucccugcuuugcauc

SEQ ID NO: 527664 - RNA, 16 nt, Homo sapiens
ucccuguccuagucuu

SEQ ID NO: 527665 - RNA, 18 nt, Homo sapiens
ucccuucuuucaggaaua

SEQ ID NO: 527666 - RNA, 14 nt, Homo sapiens
ucccuugcuguaug

SEQ ID NO: 527667 - RNA, 23 nt, Homo sapiens
ucccuuuggagauuuuuuaaucc

SEQ ID NO: 527668 - RNA, 23 nt, Homo sapiens
uccgcacccaguuugauaccugc

SEQ ID NO: 527669 - RNA, 12 nt, Homo sapiens
aacuagugaaau

SEQ ID NO: 527670 - RNA, 23 nt, Homo sapiens
aacuccuuucuuaucuugaccau

SEQ ID NO: 527671 - RNA, 23 nt, Homo sapiens
aacucuggugcuccugcaucuca

SEQ ID NO: 527672 - RNA, 20 nt, Homo sapiens
aacugaagugugcugugaca

SEQ ID NO: 527673 - RNA, 21 nt, Homo sapiens
aacugcuucccuuacuuugcu

SEQ ID NO: 527674 - RNA, 23 nt, Homo sapiens
aacugguauuguuuacguuugau

SEQ ID NO: 527675 - RNA, 18 nt, Homo sapiens
aacuguaugggagcuuaa

SEQ ID NO: 527676 - RNA, 12 nt, Homo sapiens
aacugugcugaa

SEQ ID NO: 527677 - RNA, 17 nt, Homo sapiens
aacugugcugaaugcuu

SEQ ID NO: 527678 - RNA, 16 nt, Homo sapiens
aacuucaauuuacuua

SEQ ID NO: 527679 - RNA, 19 nt, Homo sapiens
aacuucagugugguacaag

SEQ ID NO: 527680 - RNA, 16 nt, Homo sapiens
aacuucuuccugugaa

SEQ ID NO: 527681 - RNA, 13 nt, Homo sapiens
aacuugcaauacc

SEQ ID NO: 527682 - RNA, 14 nt, Homo sapiens
aacuugcaauacca

SEQ ID NO: 527683 - RNA, 16 nt, Homo sapiens
aacuugcaauaccaau

SEQ ID NO: 527684 - RNA, 22 nt, Homo sapiens
aacuuguuugguaguuagccau

SEQ ID NO: 527685 - RNA, 20 nt, Homo sapiens
aacuuuauaaggaaauguau

SEQ ID NO: 527686 - RNA, 16 nt, Homo sapiens
aagaaacuuuucugaa

SEQ ID NO: 527687 - RNA, 12 nt, Homo sapiens
aagaagacauuu

SEQ ID NO: 527688 - RNA, 16 nt, Homo sapiens
aagaagccacccuccu

SEQ ID NO: 527689 - RNA, 11 nt, Homo sapiens
aagaagcuuua

SEQ ID NO: 527690 - RNA, 12 nt, Homo sapiens
aagaagcuuuau

SEQ ID NO: 527691 - RNA, 20 nt, Homo sapiens
aagaaggccagcaacauugg

SEQ ID NO: 527692 - RNA, 20 nt, Homo sapiens
aagaaguuguuugaggcaaa

SEQ ID NO: 527693 - RNA, 17 nt, Homo sapiens
aagaauagaaaacuggg

SEQ ID NO: 527694 - RNA, 14 nt, Homo sapiens
aagaauagcuuuaa

SEQ ID NO: 527695 - RNA, 16 nt, Homo sapiens
aagacagcugcugggu

SEQ ID NO: 527696 - RNA, 14 nt, Homo sapiens
aagacccugucuca

SEQ ID NO: 527697 - RNA, 18 nt, Homo sapiens
aagacuagaggcuugcau

SEQ ID NO: 527698 - RNA, 20 nt, Homo sapiens
aagacuuugugacugucacu

SEQ ID NO: 527699 - RNA, 13 nt, Homo sapiens
aagagacacucca

SEQ ID NO: 527700 - RNA, 16 nt, Homo sapiens
aagagacuccgucuca

SEQ ID NO: 527701 - RNA, 18 nt, Homo sapiens
aagagcauagaacucaaa

SEQ ID NO: 527702 - RNA, 19 nt, Homo sapiens
aagagccagacucugucuc

SEQ ID NO: 527703 - RNA, 21 nt, Homo sapiens
aagaggcugccccucucacca

SEQ ID NO: 527704 - RNA, 22 nt, Homo sapiens
aagaguucccuugaaacuuugg

SEQ ID NO: 527705 - RNA, 19 nt, Homo sapiens
aagauaccaaaaccacagu

SEQ ID NO: 527706 - RNA, 20 nt, Homo sapiens
aagauccaagaggcccugca

SEQ ID NO: 527707 - RNA, 19 nt, Homo sapiens
aagauccagccucauaccu

SEQ ID NO: 527708 - RNA, 21 nt, Homo sapiens
aagaugacgaguaacuccccu

SEQ ID NO: 527709 - RNA, 19 nt, Homo sapiens
aagaugauuuaaguauaca

SEQ ID NO: 527710 - RNA, 19 nt, Homo sapiens
aagauuuauacaguugaaa

SEQ ID NO: 527711 - RNA, 17 nt, Homo sapiens
aagauuuugcaccugua

SEQ ID NO: 527712 - RNA, 19 nt, Homo sapiens
aagcaagccagccaauaga

SEQ ID NO: 527713 - RNA, 15 nt, Homo sapiens
aagcaagugguggga

SEQ ID NO: 527714 - RNA, 14 nt, Homo sapiens
aagcaaguuuucuu

SEQ ID NO: 527715 - RNA, 18 nt, Homo sapiens
aagcacuacaccuugccu

SEQ ID NO: 527716 - RNA, 21 nt, Homo sapiens
aagcagccauuggcacugugg

SEQ ID NO: 527717 - RNA, 21 nt, Homo sapiens
aagcaguuguaccaagugaaa

SEQ ID NO: 527718 - RNA, 23 nt, Homo sapiens
aagcaucauuuccccaacagggc

SEQ ID NO: 527719 - RNA, 12 nt, Homo sapiens
aagcaucugcca

SEQ ID NO: 527720 - RNA, 21 nt, Homo sapiens
aagccacauuauuucuagucc

SEQ ID NO: 527721 - RNA, 16 nt, Homo sapiens
aagccaugugccagau

SEQ ID NO: 527722 - RNA, 21 nt, Homo sapiens
aagcccugaaccccaagcgcu

SEQ ID NO: 527723 - RNA, 23 nt, Homo sapiens
aagcccugauguguccucaggga

SEQ ID NO: 527724 - RNA, 23 nt, Homo sapiens
aagccggcuugauuuccgugaac

SEQ ID NO: 527725 - RNA, 22 nt, Homo sapiens
aagcgacccauucagagacugu

SEQ ID NO: 527726 - RNA, 18 nt, Homo sapiens
aagcgagcagucagcauu

SEQ ID NO: 527727 - RNA, 16 nt, Homo sapiens
aagcgucaucugugua

SEQ ID NO: 527728 - RNA, 18 nt, Homo sapiens
aagcuaguguaccuccuc

SEQ ID NO: 527729 - RNA, 16 nt, Homo sapiens
aagcucacugcugauc

SEQ ID NO: 527730 - RNA, 14 nt, Homo sapiens
aagcucaguucaau

SEQ ID NO: 527731 - RNA, 19 nt, Homo sapiens
aagcucaguucaaugagca

SEQ ID NO: 527732 - RNA, 17 nt, Homo sapiens
aagcugaauccagauca

SEQ ID NO: 527733 - RNA, 16 nt, Homo sapiens
aagcugagauugagca

SEQ ID NO: 527734 - RNA, 22 nt, Homo sapiens
aagcugcuccaggccugcagca

SEQ ID NO: 527735 - RNA, 19 nt, Homo sapiens
aaggaaaaucacaucucca

SEQ ID NO: 527736 - RNA, 14 nt, Homo sapiens
aaggaaaaugacuc

SEQ ID NO: 527737 - RNA, 21 nt, Homo sapiens
aaggaaauaguaccuucaaua

SEQ ID NO: 527738 - RNA, 13 nt, Homo sapiens
aaggaaauucuua

SEQ ID NO: 527739 - RNA, 17 nt, Homo sapiens
aaggaaccuuccuuccu

SEQ ID NO: 527740 - RNA, 21 nt, Homo sapiens
aaggaagcaaguuuucuucca

SEQ ID NO: 527741 - RNA, 17 nt, Homo sapiens
aaggaggggaaccagau

SEQ ID NO: 527742 - RNA, 20 nt, Homo sapiens
aaggaguacaaugcccagau

SEQ ID NO: 527743 - RNA, 17 nt, Homo sapiens
aaggaguacuccaagac

SEQ ID NO: 527744 - RNA, 18 nt, Homo sapiens
aaggauuugaaccaugaa

SEQ ID NO: 527745 - RNA, 19 nt, Homo sapiens
aaggcagauggggcacuga

SEQ ID NO: 527746 - RNA, 16 nt, Homo sapiens
aaggcagcugccucug

SEQ ID NO: 527747 - RNA, 20 nt, Homo sapiens
aaggcaggaggaucacuuga

SEQ ID NO: 527748 - RNA, 15 nt, Homo sapiens
aaggcaguagaacuc

SEQ ID NO: 527749 - RNA, 22 nt, Homo sapiens
aaggcugaggcaggaggaucac

SEQ ID NO: 527750 - RNA, 19 nt, Homo sapiens
aagggaauguaacugcuga

SEQ ID NO: 527751 - RNA, 19 nt, Homo sapiens
aagggcccaaaggccuugg

SEQ ID NO: 527752 - RNA, 17 nt, Homo sapiens
aagggguuggggugaca

SEQ ID NO: 527753 - RNA, 19 nt, Homo sapiens
aagggguuggggugacagu

SEQ ID NO: 527754 - RNA, 18 nt, Homo sapiens
aaggguacagaugugcug

SEQ ID NO: 527755 - RNA, 16 nt, Homo sapiens
aagggugggugcucag

SEQ ID NO: 527756 - RNA, 19 nt, Homo sapiens
aaggucuccuaaaacuggg

SEQ ID NO: 527757 - RNA, 22 nt, Homo sapiens
aaggugggccuugcuaccucaa

SEQ ID NO: 527758 - RNA, 14 nt, Homo sapiens
aagguucagcugaa

SEQ ID NO: 527759 - RNA, 21 nt, Homo sapiens
aagguuggcccccacgugggg

SEQ ID NO: 527760 - RNA, 21 nt, Homo sapiens
aaguaacugugagaacccagu

SEQ ID NO: 527761 - RNA, 23 nt, Homo sapiens
aaguacuccuauugccgccagaa

SEQ ID NO: 527762 - RNA, 13 nt, Homo sapiens
aaguauguguuua

SEQ ID NO: 527763 - RNA, 13 nt, Homo sapiens
aagucagcuccag

SEQ ID NO: 527764 - RNA, 13 nt, Homo sapiens
aagucauagccau

SEQ ID NO: 527765 - RNA, 19 nt, Homo sapiens
aagucgagggacuuuaugu

SEQ ID NO: 527766 - RNA, 14 nt, Homo sapiens
aagucuuccaugac

SEQ ID NO: 527767 - RNA, 15 nt, Homo sapiens
aagucuuccaugacc

SEQ ID NO: 527768 - RNA, 17 nt, Homo sapiens
aagugcacaccuuuauu

SEQ ID NO: 527769 - RNA, 15 nt, Homo sapiens
aagugcauauuuauc

SEQ ID NO: 527770 - RNA, 16 nt, Homo sapiens
aagugccuuacagggu

SEQ ID NO: 527771 - RNA, 21 nt, Homo sapiens
aagugcgugccgugugagugu

SEQ ID NO: 527772 - RNA, 18 nt, Homo sapiens
aagugggcccacccggug

SEQ ID NO: 527773 - RNA, 20 nt, Homo sapiens
aaguguucacaacagugaaa

SEQ ID NO: 527774 - RNA, 23 nt, Homo sapiens
aaguguuggcaaacgagacuuuc

SEQ ID NO: 527775 - RNA, 22 nt, Homo sapiens
aaguugcaucagaaagcuuuau

SEQ ID NO: 527776 - RNA, 15 nt, Homo sapiens
aaguuuacacuucau

SEQ ID NO: 527777 - RNA, 14 nt, Homo sapiens
aauaaacuaugagg

SEQ ID NO: 527778 - RNA, 13 nt, Homo sapiens
aauaaaggaagca

SEQ ID NO: 527779 - RNA, 14 nt, Homo sapiens
aauaaaggcagcug

SEQ ID NO: 527780 - RNA, 19 nt, Homo sapiens
aauaaaguacuuuaccuaa

SEQ ID NO: 527781 - RNA, 12 nt, Homo sapiens
aauaaaugauua

SEQ ID NO: 527782 - RNA, 22 nt, Homo sapiens
aauaagacaagagaucuacaca

SEQ ID NO: 527783 - RNA, 17 nt, Homo sapiens
aauaaguuaaucaggaa

SEQ ID NO: 527784 - RNA, 18 nt, Homo sapiens
aauaauucuuaacagugg

SEQ ID NO: 527785 - RNA, 14 nt, Homo sapiens
aauacacauuugcu

SEQ ID NO: 527786 - RNA, 13 nt, Homo sapiens
aauacaguauuau

SEQ ID NO: 527787 - RNA, 18 nt, Homo sapiens
aauacaguauuauagaca

SEQ ID NO: 527788 - RNA, 22 nt, Homo sapiens
agcaauuauuacaauucuugaa

SEQ ID NO: 527789 - RNA, 15 nt, Homo sapiens
agcacagugccugac

SEQ ID NO: 527790 - RNA, 17 nt, Homo sapiens
agcaccacacccagugg

SEQ ID NO: 527791 - RNA, 18 nt, Homo sapiens
agcacugaaaauaguguu

SEQ ID NO: 527792 - RNA, 12 nt, Homo sapiens
agcagaccuccu

SEQ ID NO: 527793 - RNA, 20 nt, Homo sapiens
agcagacucuggaggccugu

SEQ ID NO: 527794 - RNA, 22 nt, Homo sapiens
agcagagaagguaaggugugaa

SEQ ID NO: 527795 - RNA, 19 nt, Homo sapiens
agcagccauuggcacugug

SEQ ID NO: 527796 - RNA, 18 nt, Homo sapiens
agcagccuaacacggugc

SEQ ID NO: 527797 - RNA, 14 nt, Homo sapiens
agcaggaguggugc

SEQ ID NO: 527798 - RNA, 21 nt, Homo sapiens
agcaggcagcgccaagugcgu

SEQ ID NO: 527799 - RNA, 23 nt, Homo sapiens
agcaggcagcgccaagugcgugc

SEQ ID NO: 527800 - RNA, 17 nt, Homo sapiens
agcaggggcuuguugca

SEQ ID NO: 527801 - RNA, 22 nt, Homo sapiens
agcaguccacaaagcauuuuca

SEQ ID NO: 527802 - RNA, 18 nt, Homo sapiens
agcaguuauggugaugac

SEQ ID NO: 527803 - RNA, 15 nt, Homo sapiens
agcauaccacuugaa

SEQ ID NO: 527804 - RNA, 15 nt, Homo sapiens
agcauagaaaccacu

SEQ ID NO: 527805 - RNA, 22 nt, Homo sapiens
agcaucuucacuucuaaaugca

SEQ ID NO: 527806 - RNA, 15 nt, Homo sapiens
agcauguacuccccu

SEQ ID NO: 527807 - RNA, 18 nt, Homo sapiens
agcauucugcaacauuua

SEQ ID NO: 527808 - RNA, 17 nt, Homo sapiens
agcauuuaaccaaccua

SEQ ID NO: 527809 - RNA, 11 nt, Homo sapiens
agccaaccuca

SEQ ID NO: 527810 - RNA, 19 nt, Homo sapiens
agccacaccuuuuccagga

SEQ ID NO: 527811 - RNA, 14 nt, Homo sapiens
agccaccugggaac

SEQ ID NO: 527812 - RNA, 16 nt, Homo sapiens
agccagaggcucuaau

SEQ ID NO: 527813 - RNA, 22 nt, Homo sapiens
agccagggggaugccacuccuc

SEQ ID NO: 527814 - RNA, 17 nt, Homo sapiens
agccaguuguugccaac

SEQ ID NO: 527815 - RNA, 22 nt, Homo sapiens
agcccacccugcugcuggugca

SEQ ID NO: 527816 - RNA, 21 nt, Homo sapiens
agcccauggcccccaauaaag

SEQ ID NO: 527817 - RNA, 12 nt, Homo sapiens
agccccacagac

SEQ ID NO: 527818 - RNA, 19 nt, Homo sapiens
agcccuaaguggcugccuu

SEQ ID NO: 527819 - RNA, 19 nt, Homo sapiens
agccgagaucaugccauug

SEQ ID NO: 527820 - RNA, 21 nt, Homo sapiens
agccgggcguguuggugugca

SEQ ID NO: 527821 - RNA, 14 nt, Homo sapiens
agccggucagagga

SEQ ID NO: 527822 - RNA, 19 nt, Homo sapiens
agccucgcuuuuucauccu

SEQ ID NO: 527823 - RNA, 13 nt, Homo sapiens
agccugcagggaa

SEQ ID NO: 527824 - RNA, 14 nt, Homo sapiens
agccugcucccuag

SEQ ID NO: 527825 - RNA, 16 nt, Homo sapiens
agccuggacugcuacc

SEQ ID NO: 527826 - RNA, 19 nt, Homo sapiens
agccuggccaacaugguga

SEQ ID NO: 527827 - RNA, 15 nt, Homo sapiens
agccugggguguccu

SEQ ID NO: 527828 - RNA, 22 nt, Homo sapiens
agccuuaccuugaaaugcuguu

SEQ ID NO: 527829 - RNA, 21 nt, Homo sapiens
agccuuagccaggaggccagg

SEQ ID NO: 527830 - RNA, 12 nt, Homo sapiens
agccuucuugau

SEQ ID NO: 527831 - RNA, 21 nt, Homo sapiens
agcgcaacggcuccuuugcca

SEQ ID NO: 527832 - RNA, 14 nt, Homo sapiens
agcgugugccacug

SEQ ID NO: 527833 - RNA, 23 nt, Homo sapiens
agcuaccagguguucuacacuca

SEQ ID NO: 527834 - RNA, 13 nt, Homo sapiens
agcuacuaaugau

SEQ ID NO: 527835 - RNA, 12 nt, Homo sapiens
agcuacuuggca

SEQ ID NO: 527836 - RNA, 17 nt, Homo sapiens
agcuacuuggcaggcua

SEQ ID NO: 527837 - RNA, 22 nt, Homo sapiens
agcuacuuugugagccaaagcu

SEQ ID NO: 527838 - RNA, 17 nt, Homo sapiens
agcuaguguaccuccuc

SEQ ID NO: 527839 - RNA, 14 nt, Homo sapiens
agcucacugcugau

SEQ ID NO: 527840 - RNA, 21 nt, Homo sapiens
agcucaggacauggaggugcc

SEQ ID NO: 527841 - RNA, 13 nt, Homo sapiens
agcugaaugccuc

SEQ ID NO: 527842 - RNA, 18 nt, Homo sapiens
agcugacagcacuacaaa

SEQ ID NO: 527843 - RNA, 20 nt, Homo sapiens
agcugagaucgugcuacugc

SEQ ID NO: 527844 - RNA, 16 nt, Homo sapiens
agcugagauugcacua

SEQ ID NO: 527845 - RNA, 14 nt, Homo sapiens
agcugagccugcag

SEQ ID NO: 527846 - RNA, 21 nt, Homo sapiens
agcugaguaggaggccuccac

SEQ ID NO: 527847 - RNA, 19 nt, Homo sapiens
agcugccaucgaccuggag

SEQ ID NO: 527848 - RNA, 14 nt, Homo sapiens
agcugccucugcuc

SEQ ID NO: 527849 - RNA, 15 nt, Homo sapiens
agcugccucugcucc

SEQ ID NO: 527850 - RNA, 14 nt, Homo sapiens
agcuggaaaaccuc

SEQ ID NO: 527851 - RNA, 15 nt, Homo sapiens
agcuggaaaaccucc

SEQ ID NO: 527852 - RNA, 23 nt, Homo sapiens
agcugucccuugcuugccugcag

SEQ ID NO: 527853 - RNA, 13 nt, Homo sapiens
agcugugcucaga

SEQ ID NO: 527854 - RNA, 17 nt, Homo sapiens
agcuguugugugagguu

SEQ ID NO: 527855 - RNA, 21 nt, Homo sapiens
agcuuauaaaaauaaagggaa

SEQ ID NO: 527856 - RNA, 20 nt, Homo sapiens
agcuuccuagaaaguucugu

SEQ ID NO: 527857 - RNA, 17 nt, Homo sapiens
agcuuggacuacacaau

SEQ ID NO: 527858 - RNA, 15 nt, Homo sapiens
agcuuuaaugauaug

SEQ ID NO: 527859 - RNA, 17 nt, Homo sapiens
aggaaaaucacaucucc

SEQ ID NO: 527860 - RNA, 20 nt, Homo sapiens
aggaaauaccaaaugcauug

SEQ ID NO: 527861 - RNA, 13 nt, Homo sapiens
aggaacagcacug

SEQ ID NO: 527862 - RNA, 13 nt, Homo sapiens
aggaaccuguguu

SEQ ID NO: 527863 - RNA, 13 nt, Homo sapiens
aggaaccuuccuu

SEQ ID NO: 527864 - RNA, 17 nt, Homo sapiens
aggacaguggcagacag

SEQ ID NO: 527865 - RNA, 19 nt, Homo sapiens
aggaccaagggcaccugga

SEQ ID NO: 527866 - RNA, 19 nt, Homo sapiens
aggacccaggaggugugau

SEQ ID NO: 527867 - RNA, 15 nt, Homo sapiens
aggacccuguccugc

SEQ ID NO: 527868 - RNA, 15 nt, Homo sapiens
aggagaauaugauaa

SEQ ID NO: 527869 - RNA, 12 nt, Homo sapiens
aggagagccugg

SEQ ID NO: 527870 - RNA, 21 nt, Homo sapiens
aggagaggggaggucacucuu

SEQ ID NO: 527871 - RNA, 21 nt, Homo sapiens
aggagcagccugaacccgggg

SEQ ID NO: 527872 - RNA, 22 nt, Homo sapiens
aggagcccgaagucugcugcug

SEQ ID NO: 527873 - RNA, 23 nt, Homo sapiens
aggaggagcaccuccgccagauc

SEQ ID NO: 527874 - RNA, 16 nt, Homo sapiens
aggaggcacugcugau

SEQ ID NO: 527875 - RNA, 21 nt, Homo sapiens
aggaggccuccacuccggauc

SEQ ID NO: 527876 - RNA, 20 nt, Homo sapiens
aggaguacaaugcccagauc

SEQ ID NO: 527877 - RNA, 19 nt, Homo sapiens
aggauaaggaggcacugcu

SEQ ID NO: 527878 - RNA, 15 nt, Homo sapiens
aggaucucugagacc

SEQ ID NO: 527879 - RNA, 18 nt, Homo sapiens
aggaucuggagaaccuca

SEQ ID NO: 527880 - RNA, 13 nt, Homo sapiens
aggaugcugucaa

SEQ ID NO: 527881 - RNA, 17 nt, Homo sapiens
aggauggcaaguugcau

SEQ ID NO: 527882 - RNA, 17 nt, Homo sapiens
aggauguauaaaauggu

SEQ ID NO: 527883 - RNA, 21 nt, Homo sapiens
aggaugucccugggccagggu

SEQ ID NO: 527884 - RNA, 20 nt, Homo sapiens
aggauguuuggucuuuaaug

SEQ ID NO: 527885 - RNA, 16 nt, Homo sapiens
aggcacaguggcucac

SEQ ID NO: 527886 - RNA, 13 nt, Homo sapiens
aggcacugcugau

SEQ ID NO: 527887 - RNA, 16 nt, Homo sapiens
aggcacuuaaagccuu

SEQ ID NO: 527888 - RNA, 21 nt, Homo sapiens
aggcagcuucuacuccugccu

SEQ ID NO: 527889 - RNA, 17 nt, Homo sapiens
aggcaggagaauggugu

SEQ ID NO: 527890 - RNA, 15 nt, Homo sapiens
aggcaggaguggcgu

SEQ ID NO: 527891 - RNA, 23 nt, Homo sapiens
aggcaggcuuucugggugugacu

SEQ ID NO: 527892 - RNA, 23 nt, Homo sapiens
aggcagggugagcuccagcugcu

SEQ ID NO: 527893 - RNA, 15 nt, Homo sapiens
aggcagucauaucaa

SEQ ID NO: 527894 - RNA, 14 nt, Homo sapiens
aggcaguccaucua

SEQ ID NO: 527895 - RNA, 21 nt, Homo sapiens
aggcauguagcuacaggacau

SEQ ID NO: 527896 - RNA, 14 nt, Homo sapiens
aggcauucuggagu

SEQ ID NO: 527897 - RNA, 14 nt, Homo sapiens
aggccaagaacuug

SEQ ID NO: 527898 - RNA, 17 nt, Homo sapiens
aggccagugugucucug

SEQ ID NO: 527899 - RNA, 15 nt, Homo sapiens
aggcccacuguaaua

SEQ ID NO: 527900 - RNA, 14 nt, Homo sapiens
aggcccauucuuca

SEQ ID NO: 527901 - RNA, 17 nt, Homo sapiens
aggcccugcccaaugag

SEQ ID NO: 527902 - RNA, 20 nt, Homo sapiens
aggccugucccuugccucug

SEQ ID NO: 527903 - RNA, 14 nt, Homo sapiens
aggccugugccuug

SEQ ID NO: 527904 - RNA, 20 nt, Homo sapiens
aggcgcaguggcucaugccu

SEQ ID NO: 527905 - RNA, 20 nt, Homo sapiens
aggcgccugccaucaugccu

SEQ ID NO: 527906 - RNA, 14 nt, Homo sapiens
aggcgggccugcaa

SEQ ID NO: 527907 - RNA, 16 nt, Homo sapiens
aggcuaugccaugugc

SEQ ID NO: 527908 - RNA, 22 nt, Homo sapiens
auacaacauuaaggaauuugau

SEQ ID NO: 527909 - RNA, 14 nt, Homo sapiens
auacaagguauaau

SEQ ID NO: 527910 - RNA, 16 nt, Homo sapiens
auacauuuuugucaga

SEQ ID NO: 527911 - RNA, 14 nt, Homo sapiens
auaccaaguugaua

SEQ ID NO: 527912 - RNA, 20 nt, Homo sapiens
auaccaaguugauacuugaa

SEQ ID NO: 527913 - RNA, 20 nt, Homo sapiens
auaccacuaauuuucgcuua

SEQ ID NO: 527914 - RNA, 15 nt, Homo sapiens
auaccaucugguacu

SEQ ID NO: 527915 - RNA, 15 nt, Homo sapiens
auaccauuauauguu

SEQ ID NO: 527916 - RNA, 13 nt, Homo sapiens
auaccugcacugu

SEQ ID NO: 527917 - RNA, 14 nt, Homo sapiens
auaccugcacuguc

SEQ ID NO: 527918 - RNA, 17 nt, Homo sapiens
auacguuaggaggacaa

SEQ ID NO: 527919 - RNA, 22 nt, Homo sapiens
auacugggucugcgaugcagcg

SEQ ID NO: 527920 - RNA, 15 nt, Homo sapiens
auacuuaaugcauau

SEQ ID NO: 527921 - RNA, 18 nt, Homo sapiens
auacuuggaccucagcca

SEQ ID NO: 527922 - RNA, 20 nt, Homo sapiens
auagaacucugggcugccau

SEQ ID NO: 527923 - RNA, 18 nt, Homo sapiens
auagagauuugucuaauu

SEQ ID NO: 527924 - RNA, 19 nt, Homo sapiens
auagauguugcucuuucac

SEQ ID NO: 527925 - RNA, 22 nt, Homo sapiens
auagcacguggagcucuuggcu

SEQ ID NO: 527926 - RNA, 20 nt, Homo sapiens
auagcagcucuugaaguaua

SEQ ID NO: 527927 - RNA, 12 nt, Homo sapiens
auagcagggaua

SEQ ID NO: 527928 - RNA, 19 nt, Homo sapiens
auaguaccuucaauacuua

SEQ ID NO: 527929 - RNA, 18 nt, Homo sapiens
auagucaauuucuacuuc

SEQ ID NO: 527930 - RNA, 15 nt, Homo sapiens
auagucccacuacuu

SEQ ID NO: 527931 - RNA, 22 nt, Homo sapiens
auaguggguacaucaaguccau

SEQ ID NO: 527932 - RNA, 23 nt, Homo sapiens
auauaauuuauaagcauugccau

SEQ ID NO: 527933 - RNA, 19 nt, Homo sapiens
auauacuuugccacugcug

SEQ ID NO: 527934 - RNA, 12 nt, Homo sapiens
auauauaugcac

SEQ ID NO: 527935 - RNA, 16 nt, Homo sapiens
auauaugcacuaugua

SEQ ID NO: 527936 - RNA, 14 nt, Homo sapiens
auauauuguucaaa

SEQ ID NO: 527937 - RNA, 14 nt, Homo sapiens
auauauuuaauuga

SEQ ID NO: 527938 - RNA, 20 nt, Homo sapiens
auauauuuacaaggaguuau

SEQ ID NO: 527939 - RNA, 17 nt, Homo sapiens
auauccuuucacucugc

SEQ ID NO: 527940 - RNA, 13 nt, Homo sapiens
auaucuaaaaacu

SEQ ID NO: 527941 - RNA, 16 nt, Homo sapiens
auaugaaaaucuccau

SEQ ID NO: 527942 - RNA, 15 nt, Homo sapiens
auaugaauucaagaa

SEQ ID NO: 527943 - RNA, 17 nt, Homo sapiens
auaugagaauauaccuu

SEQ ID NO: 527944 - RNA, 19 nt, Homo sapiens
auaugcaaaccaggauuuc

SEQ ID NO: 527945 - RNA, 13 nt, Homo sapiens
auaugcgcuuaaa

SEQ ID NO: 527946 - RNA, 15 nt, Homo sapiens
auauggucauauaca

SEQ ID NO: 527947 - RNA, 22 nt, Homo sapiens
auauguaauuucaaaauacauu

SEQ ID NO: 527948 - RNA, 17 nt, Homo sapiens
auauuacugacauuucu

SEQ ID NO: 527949 - RNA, 16 nt, Homo sapiens
auauugagaugacacu

SEQ ID NO: 527950 - RNA, 19 nt, Homo sapiens
auauuucucaucugcacua

SEQ ID NO: 527951 - RNA, 19 nt, Homo sapiens
auauuugaaauaguauaca

SEQ ID NO: 527952 - RNA, 20 nt, Homo sapiens
auauuugaaauaguauacau

SEQ ID NO: 527953 - RNA, 21 nt, Homo sapiens
auauuuuaaauaucuuucaug

SEQ ID NO: 527954 - RNA, 19 nt, Homo sapiens
aucaacaacauccacuguu

SEQ ID NO: 527955 - RNA, 15 nt, Homo sapiens
aucaccauauuguaa

SEQ ID NO: 527956 - RNA, 18 nt, Homo sapiens
aucacgaggucaggagau

SEQ ID NO: 527957 - RNA, 15 nt, Homo sapiens
aucacucaaccuuau

SEQ ID NO: 527958 - RNA, 15 nt, Homo sapiens
aucagaccugcauug

SEQ ID NO: 527959 - RNA, 17 nt, Homo sapiens
aucagcaaccugacuca

SEQ ID NO: 527960 - RNA, 19 nt, Homo sapiens
aucaucauccuacaacuca

SEQ ID NO: 527961 - RNA, 14 nt, Homo sapiens
aucauccaagacag

SEQ ID NO: 527962 - RNA, 20 nt, Homo sapiens
aucaugauccuuguguucag

SEQ ID NO: 527963 - RNA, 16 nt, Homo sapiens
aucauucccucucauc

SEQ ID NO: 527964 - RNA, 16 nt, Homo sapiens
auccagcaauuccuga

SEQ ID NO: 527965 - RNA, 17 nt, Homo sapiens
auccagcuccccuucug

SEQ ID NO: 527966 - RNA, 17 nt, Homo sapiens
auccaugcaccuaccuu

SEQ ID NO: 527967 - RNA, 20 nt, Homo sapiens
auccaugcaccuaccuuaga

SEQ ID NO: 527968 - RNA, 16 nt, Homo sapiens
aucccaagugcacuuu

SEQ ID NO: 527969 - RNA, 12 nt, Homo sapiens
aucccagcacuu

SEQ ID NO: 527970 - RNA, 22 nt, Homo sapiens
auccccaaguggugaaugacac

SEQ ID NO: 527971 - RNA, 14 nt, Homo sapiens
auccgcgugugccu

SEQ ID NO: 527972 - RNA, 15 nt, Homo sapiens
auccggcagcacaag

SEQ ID NO: 527973 - RNA, 14 nt, Homo sapiens
auccucaugcugcu

SEQ ID NO: 527974 - RNA, 20 nt, Homo sapiens
auccugcagaaguacuccua

SEQ ID NO: 527975 - RNA, 14 nt, Homo sapiens
aucuaaaaacuuag

SEQ ID NO: 527976 - RNA, 14 nt, Homo sapiens
aucuaccacuguau

SEQ ID NO: 527977 - RNA, 18 nt, Homo sapiens
aucuaccacuguaugagu

SEQ ID NO: 527978 - RNA, 16 nt, Homo sapiens
aucuauagaacaucca

SEQ ID NO: 527979 - RNA, 13 nt, Homo sapiens
aucuauuaucuca

SEQ ID NO: 527980 - RNA, 22 nt, Homo sapiens
aucucaaugaaccauaaauuca

SEQ ID NO: 527981 - RNA, 15 nt, Homo sapiens
aucucauuccacugu

SEQ ID NO: 527982 - RNA, 17 nt, Homo sapiens
aucuccaggcuuucaau

SEQ ID NO: 527983 - RNA, 19 nt, Homo sapiens
aucugaaagugguacuuga

SEQ ID NO: 527984 - RNA, 13 nt, Homo sapiens
aucugacaaaaug

SEQ ID NO: 527985 - RNA, 19 nt, Homo sapiens
aucugagagaugacaggga

SEQ ID NO: 527986 - RNA, 22 nt, Homo sapiens
aucugcacuauguuuccauuug

SEQ ID NO: 527987 - RNA, 23 nt, Homo sapiens
aucugcugaaggcagucauauca

SEQ ID NO: 527988 - RNA, 17 nt, Homo sapiens
aucuggagaaccucauc

SEQ ID NO: 527989 - RNA, 17 nt, Homo sapiens
aucuggguaucuuucca

SEQ ID NO: 527990 - RNA, 23 nt, Homo sapiens
aucuucacuucuaaaugcauauc

SEQ ID NO: 527991 - RNA, 19 nt, Homo sapiens
aucuucaggugaacacuua

SEQ ID NO: 527992 - RNA, 21 nt, Homo sapiens
aucuucugugcccagcacagu

SEQ ID NO: 527993 - RNA, 23 nt, Homo sapiens
aucuuucaaaagccuuaccuuga

SEQ ID NO: 527994 - RNA, 20 nt, Homo sapiens
augaaaucuucccaguauua

SEQ ID NO: 527995 - RNA, 12 nt, Homo sapiens
augaaccuggac

SEQ ID NO: 527996 - RNA, 18 nt, Homo sapiens
augaaguuuugauuuauu

SEQ ID NO: 527997 - RNA, 14 nt, Homo sapiens
augaauacagcauu

SEQ ID NO: 527998 - RNA, 22 nt, Homo sapiens
augaauagaaaaaaaacaaacc

SEQ ID NO: 527999 - RNA, 18 nt, Homo sapiens
augacaccaaauaugucc

SEQ ID NO: 528000 - RNA, 13 nt, Homo sapiens
augaccaccccuc

SEQ ID NO: 528001 - RNA, 14 nt, Homo sapiens
augacccacugucc

SEQ ID NO: 528002 - RNA, 19 nt, Homo sapiens
augaccuugggguacaauu

SEQ ID NO: 528003 - RNA, 17 nt, Homo sapiens
augacuccuacuuuuca

SEQ ID NO: 528004 - RNA, 16 nt, Homo sapiens
augacuuugagauuau

SEQ ID NO: 528005 - RNA, 16 nt, Homo sapiens
augagaacaagcuauu

SEQ ID NO: 528006 - RNA, 20 nt, Homo sapiens
augagaaugaugcacacuga

SEQ ID NO: 528007 - RNA, 18 nt, Homo sapiens
augagagggaugaggcaa

SEQ ID NO: 528008 - RNA, 15 nt, Homo sapiens
augaggaaaugaucc

SEQ ID NO: 528009 - RNA, 17 nt, Homo sapiens
augaguccccugugaga

SEQ ID NO: 528010 - RNA, 18 nt, Homo sapiens
augauccccaagugguga

SEQ ID NO: 528011 - RNA, 20 nt, Homo sapiens
augaugguuuuaaacuuuca

SEQ ID NO: 528012 - RNA, 21 nt, Homo sapiens
augauucuuuguuacaggcac

SEQ ID NO: 528013 - RNA, 19 nt, Homo sapiens
augauuuagugaucaaauu

SEQ ID NO: 528014 - RNA, 17 nt, Homo sapiens
augauuucagcagggau

SEQ ID NO: 528015 - RNA, 17 nt, Homo sapiens
augauuuugcuuuccaa

SEQ ID NO: 528016 - RNA, 15 nt, Homo sapiens
augcaaaagguuuau

SEQ ID NO: 528017 - RNA, 15 nt, Homo sapiens
augcaaaauuuagaa

SEQ ID NO: 528018 - RNA, 13 nt, Homo sapiens
augcagcuuugca

SEQ ID NO: 528019 - RNA, 23 nt, Homo sapiens
augcaggcagcacagcagacuag

SEQ ID NO: 528020 - RNA, 18 nt, Homo sapiens
augcauauccugagccau

SEQ ID NO: 528021 - RNA, 20 nt, Homo sapiens
augccaaggccguggggcuc

SEQ ID NO: 528022 - RNA, 20 nt, Homo sapiens
augccaccuucagauccuuu

SEQ ID NO: 528023 - RNA, 11 nt, Homo sapiens
augccacugac

SEQ ID NO: 528024 - RNA, 17 nt, Homo sapiens
augccuguaaucccagc

SEQ ID NO: 528025 - RNA, 12 nt, Homo sapiens
augcucacuuua

SEQ ID NO: 528026 - RNA, 16 nt, Homo sapiens
augcugccuggugggg

SEQ ID NO: 528027 - RNA, 14 nt, Homo sapiens
augcuguaacuuaa

SEQ ID NO: 528028 - RNA, 14 nt, Homo sapiens
ggaaaaugacucug

SEQ ID NO: 528029 - RNA, 19 nt, Homo sapiens
ggaaauaugccacugaccg

SEQ ID NO: 528030 - RNA, 22 nt, Homo sapiens
ggaaauucuuauaacucaacau

SEQ ID NO: 528031 - RNA, 15 nt, Homo sapiens
ggaacacaucuggcu

SEQ ID NO: 528032 - RNA, 18 nt, Homo sapiens
ggaacagaagacagcugc

SEQ ID NO: 528033 - RNA, 23 nt, Homo sapiens
ggaacagcacuggggagucuuug

SEQ ID NO: 528034 - RNA, 17 nt, Homo sapiens
ggaaccuguccuaagga

SEQ ID NO: 528035 - RNA, 16 nt, Homo sapiens
ggaacuccuggccuuu

SEQ ID NO: 528036 - RNA, 21 nt, Homo sapiens
ggaacucuagaagaccaaaug

SEQ ID NO: 528037 - RNA, 12 nt, Homo sapiens
ggaagagcuaau

SEQ ID NO: 528038 - RNA, 22 nt, Homo sapiens
ggaagcaacagauagauguugc

SEQ ID NO: 528039 - RNA, 23 nt, Homo sapiens
ggaaggagggucccgguguaucc

SEQ ID NO: 528040 - RNA, 18 nt, Homo sapiens
ggaagugaaaacuuugua

SEQ ID NO: 528041 - RNA, 16 nt, Homo sapiens
ggaauaacuuuuacac

SEQ ID NO: 528042 - RNA, 18 nt, Homo sapiens
ggaauauaucaguaccuc

SEQ ID NO: 528043 - RNA, 13 nt, Homo sapiens
ggaaucagucagc

SEQ ID NO: 528044 - RNA, 15 nt, Homo sapiens
ggaaucccacuguau

SEQ ID NO: 528045 - RNA, 19 nt, Homo sapiens
ggaauccugcucacaaaau

SEQ ID NO: 528046 - RNA, 15 nt, Homo sapiens
ggacaaaugaugcca

SEQ ID NO: 528047 - RNA, 17 nt, Homo sapiens
ggacaaaugaugccaug

SEQ ID NO: 528048 - RNA, 12 nt, Homo sapiens
ggacaagggauu

SEQ ID NO: 528049 - RNA, 18 nt, Homo sapiens
ggacaccuuuuaacucac

SEQ ID NO: 528050 - RNA, 9 nt, Homo sapiens
ggacacugc

SEQ ID NO: 528051 - RNA, 13 nt, Homo sapiens
ggacccagugcag

SEQ ID NO: 528052 - RNA, 14 nt, Homo sapiens
ggacccagugcaga

SEQ ID NO: 528053 - RNA, 21 nt, Homo sapiens
ggaccugccccccacucugca

SEQ ID NO: 528054 - RNA, 22 nt, Homo sapiens
ggacuccaucucucauccucca

SEQ ID NO: 528055 - RNA, 14 nt, Homo sapiens
ggacuguaagggau

SEQ ID NO: 528056 - RNA, 15 nt, Homo sapiens
ggacuguaagggauu

SEQ ID NO: 528057 - RNA, 18 nt, Homo sapiens
ggacuuccagugcucaga

SEQ ID NO: 528058 - RNA, 20 nt, Homo sapiens
ggacuuccuuuaggaucuca

SEQ ID NO: 528059 - RNA, 22 nt, Homo sapiens
ggagaaagcagccauuggcacu

SEQ ID NO: 528060 - RNA, 12 nt, Homo sapiens
ggagccagugaa

SEQ ID NO: 528061 - RNA, 13 nt, Homo sapiens
ggaggcaguccau

SEQ ID NO: 528062 - RNA, 15 nt, Homo sapiens
ggaggcccuccugug

SEQ ID NO: 528063 - RNA, 14 nt, Homo sapiens
ggaguacugaugaa

SEQ ID NO: 528064 - RNA, 18 nt, Homo sapiens
ggaguggcguggggccaa

SEQ ID NO: 528065 - RNA, 12 nt, Homo sapiens
ggauauauuuga

SEQ ID NO: 528066 - RNA, 21 nt, Homo sapiens
ggauauauuugaaauaguaua

SEQ ID NO: 528067 - RNA, 18 nt, Homo sapiens
ggauaucaaaggacaaag

SEQ ID NO: 528068 - RNA, 21 nt, Homo sapiens
ggaucaacaacauccacuguu

SEQ ID NO: 528069 - RNA, 15 nt, Homo sapiens
ggaucuugaaugugg

SEQ ID NO: 528070 - RNA, 22 nt, Homo sapiens
ggaugaaagagccagacucugu

SEQ ID NO: 528071 - RNA, 15 nt, Homo sapiens
ggaugacccacuguc

SEQ ID NO: 528072 - RNA, 15 nt, Homo sapiens
ggaugguugaaugag

SEQ ID NO: 528073 - RNA, 23 nt, Homo sapiens
ggauuaccagggacuaucuuugc

SEQ ID NO: 528074 - RNA, 15 nt, Homo sapiens
ggauugacucugcau

SEQ ID NO: 528075 - RNA, 21 nt, Homo sapiens
ggauuuccuugacuucuuuga

SEQ ID NO: 528076 - RNA, 22 nt, Homo sapiens
ggauuuuuuuccuccccaccuu

SEQ ID NO: 528077 - RNA, 13 nt, Homo sapiens
ggcaagucuucca

SEQ ID NO: 528078 - RNA, 16 nt, Homo sapiens
ggcaagucuuccauga

SEQ ID NO: 528079 - RNA, 18 nt, Homo sapiens
ggcaagucuuccaugacc

SEQ ID NO: 528080 - RNA, 19 nt, Homo sapiens
ggcaagugugggggguccu

SEQ ID NO: 528081 - RNA, 15 nt, Homo sapiens
ggcacacacugacca

SEQ ID NO: 528082 - RNA, 14 nt, Homo sapiens
ggcaccugggucca

SEQ ID NO: 528083 - RNA, 22 nt, Homo sapiens
ggcaccuuaagauuuugcaccu

SEQ ID NO: 528084 - RNA, 14 nt, Homo sapiens
ggcaccuucaccug

SEQ ID NO: 528085 - RNA, 11 nt, Homo sapiens
ggcacugaccg

SEQ ID NO: 528086 - RNA, 22 nt, Homo sapiens
ggcacugaccggugcuuuuauu

SEQ ID NO: 528087 - RNA, 14 nt, Homo sapiens
ggcagaucacuuga

SEQ ID NO: 528088 - RNA, 14 nt, Homo sapiens
ggcagcaucuucac

SEQ ID NO: 528089 - RNA, 16 nt, Homo sapiens
ggcagcugccucugcu

SEQ ID NO: 528090 - RNA, 22 nt, Homo sapiens
ggcagcugccucugcucccucu

SEQ ID NO: 528091 - RNA, 22 nt, Homo sapiens
ggcagcugcuauccccaucucc

SEQ ID NO: 528092 - RNA, 14 nt, Homo sapiens
ggcaggagagucac

SEQ ID NO: 528093 - RNA, 20 nt, Homo sapiens
ggcaggagagucacuugaac

SEQ ID NO: 528094 - RNA, 21 nt, Homo sapiens
ggcaggccuggacuuccagug

SEQ ID NO: 528095 - RNA, 20 nt, Homo sapiens
ggcagggagcugggcccgac

SEQ ID NO: 528096 - RNA, 14 nt, Homo sapiens
ggcaucuauuuccu

SEQ ID NO: 528097 - RNA, 20 nt, Homo sapiens
ggcaugagacucagugcaga

SEQ ID NO: 528098 - RNA, 23 nt, Homo sapiens
ggcaugguggugugugccuauag

SEQ ID NO: 528099 - RNA, 23 nt, Homo sapiens
ggcauggugguuuacgccuauaa

SEQ ID NO: 528100 - RNA, 12 nt, Homo sapiens
ggccaaguguac

SEQ ID NO: 528101 - RNA, 20 nt, Homo sapiens
ggccaccugcaggacccugu

SEQ ID NO: 528102 - RNA, 15 nt, Homo sapiens
ggccauguccaaaga

SEQ ID NO: 528103 - RNA, 22 nt, Homo sapiens
ggccauuuccaagaggcuguag

SEQ ID NO: 528104 - RNA, 16 nt, Homo sapiens
ggcccuucacuuccau

SEQ ID NO: 528105 - RNA, 16 nt, Homo sapiens
ggccuagaccuggugc

SEQ ID NO: 528106 - RNA, 16 nt, Homo sapiens
ggccuggggccugaga

SEQ ID NO: 528107 - RNA, 15 nt, Homo sapiens
ggccugugauguuuu

SEQ ID NO: 528108 - RNA, 22 nt, Homo sapiens
ggccuuggacaacugcauggag

SEQ ID NO: 528109 - RNA, 12 nt, Homo sapiens
ggccuuuccugg

SEQ ID NO: 528110 - RNA, 20 nt, Homo sapiens
ggcggguggaucacgagguc

SEQ ID NO: 528111 - RNA, 22 nt, Homo sapiens
ggcguggggccaauacccagac

SEQ ID NO: 528112 - RNA, 22 nt, Homo sapiens
ggcgugggggcucaugccugua

SEQ ID NO: 528113 - RNA, 23 nt, Homo sapiens
ggcgugggggcucaugccuguaa

SEQ ID NO: 528114 - RNA, 20 nt, Homo sapiens
ggcucagucgcuagcauuuc

SEQ ID NO: 528115 - RNA, 13 nt, Homo sapiens
ggcucauuuuugc

SEQ ID NO: 528116 - RNA, 19 nt, Homo sapiens
ggcucgucagccaccuggg

SEQ ID NO: 528117 - RNA, 20 nt, Homo sapiens
ggcucgucagccaccuggga

SEQ ID NO: 528118 - RNA, 19 nt, Homo sapiens
ggcucuaauguacaauaaa

SEQ ID NO: 528119 - RNA, 20 nt, Homo sapiens
ggcugcuuggagcagccuaa

SEQ ID NO: 528120 - RNA, 15 nt, Homo sapiens
ggcuggagccugggg

SEQ ID NO: 528121 - RNA, 17 nt, Homo sapiens
gggacaucacagggugg

SEQ ID NO: 528122 - RNA, 15 nt, Homo sapiens
gggagcaguggccau

SEQ ID NO: 528123 - RNA, 20 nt, Homo sapiens
gggaggcggagguugcagug

SEQ ID NO: 528124 - RNA, 15 nt, Homo sapiens
gggcacuggcccagg

SEQ ID NO: 528125 - RNA, 16 nt, Homo sapiens
gggcccacccauguca

SEQ ID NO: 528126 - RNA, 21 nt, Homo sapiens
gggcccucugugcucuucucu

SEQ ID NO: 528127 - RNA, 19 nt, Homo sapiens
gggcccuugucgggcacag

SEQ ID NO: 528128 - RNA, 21 nt, Homo sapiens
gggcccuugucgggcacagau

SEQ ID NO: 528129 - RNA, 20 nt, Homo sapiens
gggccuagaccuggugcuga

SEQ ID NO: 528130 - RNA, 12 nt, Homo sapiens
gggcgcgguggc

SEQ ID NO: 528131 - RNA, 16 nt, Homo sapiens
gggcuuucuggggccu

SEQ ID NO: 528132 - RNA, 18 nt, Homo sapiens
ggggccgggcgcgguggc

SEQ ID NO: 528133 - RNA, 23 nt, Homo sapiens
gggguaccuuaagagacacucca

SEQ ID NO: 528134 - RNA, 13 nt, Homo sapiens
gggguagccugag

SEQ ID NO: 528135 - RNA, 17 nt, Homo sapiens
ggggucccaucagugaa

SEQ ID NO: 528136 - RNA, 11 nt, Homo sapiens
ggggugcugcc

SEQ ID NO: 528137 - RNA, 15 nt, Homo sapiens
ggguacagaugugcu

SEQ ID NO: 528138 - RNA, 16 nt, Homo sapiens
gggucugggccagugc

SEQ ID NO: 528139 - RNA, 22 nt, Homo sapiens
gggugagcuccagcugcugcgc

SEQ ID NO: 528140 - RNA, 14 nt, Homo sapiens
gguacaauuguaaa

SEQ ID NO: 528141 - RNA, 21 nt, Homo sapiens
gguaccugguccccacugcug

SEQ ID NO: 528142 - RNA, 21 nt, Homo sapiens
gguauauacuuugccacugcu

SEQ ID NO: 528143 - RNA, 16 nt, Homo sapiens
ggucaaaguucauaga

SEQ ID NO: 528144 - RNA, 19 nt, Homo sapiens
ggucauaaagcauuggagu

SEQ ID NO: 528145 - RNA, 21 nt, Homo sapiens
ggucauuucuuagauggagaa

SEQ ID NO: 528146 - RNA, 23 nt, Homo sapiens
gguccaaagaguuucugcaaagu

SEQ ID NO: 528147 - RNA, 16 nt, Homo sapiens
ggucuaacacuggcau

SEQ ID NO: 528148 - RNA, 19 nt, Homo sapiens
uauuuguuuuaugcuacug

SEQ ID NO: 528149 - RNA, 22 nt, Homo sapiens
uauuuuagacacuucccugcau

SEQ ID NO: 528150 - RNA, 22 nt, Homo sapiens
uauuuuguugccuucaucuuca

SEQ ID NO: 528151 - RNA, 19 nt, Homo sapiens
uauuuuuauuuuugcacaa

SEQ ID NO: 528152 - RNA, 16 nt, Homo sapiens
uauuuuucauaaacaa

SEQ ID NO: 528153 - RNA, 13 nt, Homo sapiens
uauuuuugcacaa

SEQ ID NO: 528154 - RNA, 18 nt, Homo sapiens
ucaaaacuaaccaucuga

SEQ ID NO: 528155 - RNA, 22 nt, Homo sapiens
ucaaaagaaauuuaaguucuau

SEQ ID NO: 528156 - RNA, 15 nt, Homo sapiens
ucaaaauacaucaaa

SEQ ID NO: 528157 - RNA, 15 nt, Homo sapiens
ucaaaauauuucuca

SEQ ID NO: 528158 - RNA, 17 nt, Homo sapiens
ucaaacugaaacaaaau

SEQ ID NO: 528159 - RNA, 21 nt, Homo sapiens
ucaaauacauuuaaaacauua

SEQ ID NO: 528160 - RNA, 21 nt, Homo sapiens
ucaaauugggaaauccauucc

SEQ ID NO: 528161 - RNA, 23 nt, Homo sapiens
ucaacucuccaauguucuauuaa

SEQ ID NO: 528162 - RNA, 19 nt, Homo sapiens
ucaacuuuuucccucacua

SEQ ID NO: 528163 - RNA, 20 nt, Homo sapiens
ucaaggaguacaaugcccag

SEQ ID NO: 528164 - RNA, 16 nt, Homo sapiens
ucaaggauauacugca

SEQ ID NO: 528165 - RNA, 17 nt, Homo sapiens
ucaaguuuacacuucau

SEQ ID NO: 528166 - RNA, 19 nt, Homo sapiens
ucaauaccaauuacaugga

SEQ ID NO: 528167 - RNA, 13 nt, Homo sapiens
ucaauuacaaagc

SEQ ID NO: 528168 - RNA, 12 nt, Homo sapiens
ucaauuuacuua

SEQ ID NO: 528169 - RNA, 14 nt, Homo sapiens
ucaauuucuacuuc

SEQ ID NO: 528170 - RNA, 22 nt, Homo sapiens
ucacacuccccuagggggagaa

SEQ ID NO: 528171 - RNA, 15 nt, Homo sapiens
ucacaguaacccaga

SEQ ID NO: 528172 - RNA, 15 nt, Homo sapiens
ucacauggcugucga

SEQ ID NO: 528173 - RNA, 22 nt, Homo sapiens
ucacccaccucuggguccuugg

SEQ ID NO: 528174 - RNA, 21 nt, Homo sapiens
ucacccuguccagaccuuuga

SEQ ID NO: 528175 - RNA, 20 nt, Homo sapiens
ucacccuugcaccguccuca

SEQ ID NO: 528176 - RNA, 18 nt, Homo sapiens
ucaccucccgaagccacc

SEQ ID NO: 528177 - RNA, 14 nt, Homo sapiens
ucaccucucaaggu

SEQ ID NO: 528178 - RNA, 15 nt, Homo sapiens
ucacgcagugcuuuc

SEQ ID NO: 528179 - RNA, 15 nt, Homo sapiens
ucacuaaagcaugaa

SEQ ID NO: 528180 - RNA, 15 nt, Homo sapiens
ucacugcugaucgua

SEQ ID NO: 528181 - RNA, 16 nt, Homo sapiens
ucacuugaaccgggga

SEQ ID NO: 528182 - RNA, 18 nt, Homo sapiens
ucagaaaugcugucauaa

SEQ ID NO: 528183 - RNA, 19 nt, Homo sapiens
ucagaagaccccugacuca

SEQ ID NO: 528184 - RNA, 21 nt, Homo sapiens
ucagaauaaggcaggcauuga

SEQ ID NO: 528185 - RNA, 16 nt, Homo sapiens
ucagaccuggcugcuu

SEQ ID NO: 528186 - RNA, 16 nt, Homo sapiens
ucagaguccuugcaaa

SEQ ID NO: 528187 - RNA, 16 nt, Homo sapiens
ucagaguugacuuucc

SEQ ID NO: 528188 - RNA, 15 nt, Homo sapiens
ucagaucucauggga

SEQ ID NO: 528189 - RNA, 15 nt, Homo sapiens
ucagcacacacuuac

SEQ ID NO: 528190 - RNA, 16 nt, Homo sapiens
ucagcaggcuagacag

SEQ ID NO: 528191 - RNA, 16 nt, Homo sapiens
ucagcaguccacaaag

SEQ ID NO: 528192 - RNA, 19 nt, Homo sapiens
ucagcaguccacaaagcau

SEQ ID NO: 528193 - RNA, 19 nt, Homo sapiens
ucagccacauauugagaug

SEQ ID NO: 528194 - RNA, 23 nt, Homo sapiens
ucagccagcccauggcccccaau

SEQ ID NO: 528195 - RNA, 18 nt, Homo sapiens
ucagccugggcaacaugg

SEQ ID NO: 528196 - RNA, 23 nt, Homo sapiens
ucagcuuuuguuguuuauauaca

SEQ ID NO: 528197 - RNA, 17 nt, Homo sapiens
ucaggagaucgagacca

SEQ ID NO: 528198 - RNA, 22 nt, Homo sapiens
ucaggcgcaguggcucaugccu

SEQ ID NO: 528199 - RNA, 16 nt, Homo sapiens
ucaggugaacacuuag

SEQ ID NO: 528200 - RNA, 18 nt, Homo sapiens
ucaguaaucacuuuucag

SEQ ID NO: 528201 - RNA, 20 nt, Homo sapiens
ucaguagugcuaaugcauuu

SEQ ID NO: 528202 - RNA, 15 nt, Homo sapiens
ucaguguuugggaaa

SEQ ID NO: 528203 - RNA, 19 nt, Homo sapiens
ucaguguuuuugugaauug

SEQ ID NO: 528204 - RNA, 13 nt, Homo sapiens
ucauaaagcauug

SEQ ID NO: 528205 - RNA, 20 nt, Homo sapiens
ucauaauugccuacauuuau

SEQ ID NO: 528206 - RNA, 17 nt, Homo sapiens
ucauacaggaaugaagc

SEQ ID NO: 528207 - RNA, 20 nt, Homo sapiens
ucauauuuuaaacagaggau

SEQ ID NO: 528208 - RNA, 14 nt, Homo sapiens
ucaucaaacauugg

SEQ ID NO: 528209 - RNA, 20 nt, Homo sapiens
ucaucaggaaggaaaugaca

SEQ ID NO: 528210 - RNA, 14 nt, Homo sapiens
ucaucccuuugguu

SEQ ID NO: 528211 - RNA, 23 nt, Homo sapiens
ucaucgggaggagcagccugaac

SEQ ID NO: 528212 - RNA, 13 nt, Homo sapiens
ucaucucauucca

SEQ ID NO: 528213 - RNA, 16 nt, Homo sapiens
ucaugacuccuacuuu

SEQ ID NO: 528214 - RNA, 13 nt, Homo sapiens
ucaugagcuugaa

SEQ ID NO: 528215 - RNA, 19 nt, Homo sapiens
ucauguuuuuaacuuuuaa

SEQ ID NO: 528216 - RNA, 13 nt, Homo sapiens
ucauuacugugag

SEQ ID NO: 528217 - RNA, 18 nt, Homo sapiens
ucauuacuguguucaauu

SEQ ID NO: 528218 - RNA, 20 nt, Homo sapiens
ucauucugguucccugcugc

SEQ ID NO: 528219 - RNA, 18 nt, Homo sapiens
ucauucuguuagauacua

SEQ ID NO: 528220 - RNA, 18 nt, Homo sapiens
ucauugucaccucuguga

SEQ ID NO: 528221 - RNA, 18 nt, Homo sapiens
ucauuucguauuucucau

SEQ ID NO: 528222 - RNA, 18 nt, Homo sapiens
uccaaagccggcuugauu

SEQ ID NO: 528223 - RNA, 12 nt, Homo sapiens
uccaacacucca

SEQ ID NO: 528224 - RNA, 19 nt, Homo sapiens
uccaacccauuagccauuu

SEQ ID NO: 528225 - RNA, 22 nt, Homo sapiens
uccaaugcuucuguugaucuca

SEQ ID NO: 528226 - RNA, 23 nt, Homo sapiens
uccaaugcuucuguugaucucag

SEQ ID NO: 528227 - RNA, 11 nt, Homo sapiens
uccaaugucaa

SEQ ID NO: 528228 - RNA, 11 nt, Homo sapiens
uccacaaggaa

SEQ ID NO: 528229 - RNA, 12 nt, Homo sapiens
uccacagaggac

SEQ ID NO: 528230 - RNA, 22 nt, Homo sapiens
uccacagccgccugaaagccac

SEQ ID NO: 528231 - RNA, 20 nt, Homo sapiens
uccacucuugaucucucuug

SEQ ID NO: 528232 - RNA, 19 nt, Homo sapiens
uccacucuuguggucauca

SEQ ID NO: 528233 - RNA, 16 nt, Homo sapiens
uccacuggaaaacugc

SEQ ID NO: 528234 - RNA, 18 nt, Homo sapiens
uccagaguucugugacac

SEQ ID NO: 528235 - RNA, 19 nt, Homo sapiens
uccagaucauuccucagaa

SEQ ID NO: 528236 - RNA, 20 nt, Homo sapiens
uccagcaauuccugagccaa

SEQ ID NO: 528237 - RNA, 22 nt, Homo sapiens
uccagccaaccucauugcagcu

SEQ ID NO: 528238 - RNA, 16 nt, Homo sapiens
uccagccugggggaca

SEQ ID NO: 528239 - RNA, 21 nt, Homo sapiens
uccagggcuauagggugugau

SEQ ID NO: 528240 - RNA, 17 nt, Homo sapiens
uccagguuuaugaauga

SEQ ID NO: 528241 - RNA, 21 nt, Homo sapiens
uccaucagagaaggugcaggu

SEQ ID NO: 528242 - RNA, 14 nt, Homo sapiens
uccauccuggucag

SEQ ID NO: 528243 - RNA, 16 nt, Homo sapiens
uccaucucuucugcaa

SEQ ID NO: 528244 - RNA, 20 nt, Homo sapiens
uccaugcaccuaccuuagaa

SEQ ID NO: 528245 - RNA, 13 nt, Homo sapiens
uccauuagucaau

SEQ ID NO: 528246 - RNA, 20 nt, Homo sapiens
uccauuuugugaauugugac

SEQ ID NO: 528247 - RNA, 18 nt, Homo sapiens
ucccaagauaaaugguac

SEQ ID NO: 528248 - RNA, 13 nt, Homo sapiens
ucccacacugugc

SEQ ID NO: 528249 - RNA, 13 nt, Homo sapiens
ucccacuuucauc

SEQ ID NO: 528250 - RNA, 13 nt, Homo sapiens
ucccagagcaccu

SEQ ID NO: 528251 - RNA, 14 nt, Homo sapiens
ucccagcugccaug

SEQ ID NO: 528252 - RNA, 16 nt, Homo sapiens
ucccagugaugcugua

SEQ ID NO: 528253 - RNA, 17 nt, Homo sapiens
ucccauccuugaugcaa

SEQ ID NO: 528254 - RNA, 13 nt, Homo sapiens
ucccauugccaug

SEQ ID NO: 528255 - RNA, 13 nt, Homo sapiens
uccccacugcuga

SEQ ID NO: 528256 - RNA, 17 nt, Homo sapiens
uccccucaacaugcugc

SEQ ID NO: 528257 - RNA, 19 nt, Homo sapiens
uccccuugccuaaauacaa

SEQ ID NO: 528258 - RNA, 22 nt, Homo sapiens
ucccuaggaaacucacacuccc

SEQ ID NO: 528259 - RNA, 21 nt, Homo sapiens
ucccucacugaaaccaggugg

SEQ ID NO: 528260 - RNA, 19 nt, Homo sapiens
ucccuuccugggucuacca

SEQ ID NO: 528261 - RNA, 15 nt, Homo sapiens
ucccuugcuguaugc

SEQ ID NO: 528262 - RNA, 16 nt, Homo sapiens
ucccuugcuguaugcu

SEQ ID NO: 528263 - RNA, 20 nt, Homo sapiens
ucccuugcuguaugcugauc

SEQ ID NO: 528264 - RNA, 15 nt, Homo sapiens
ucccuugcuugccug

SEQ ID NO: 528265 - RNA, 18 nt, Homo sapiens
ucccuuuggagaugcuga

SEQ ID NO: 528266 - RNA, 18 nt, Homo sapiens
uccgauuccccuguagca

SEQ ID NO: 528267 - RNA, 23 nt, Homo sapiens
uccgcagaagcccugaugugucc

SEQ ID NO: 528268 - RNA, 13 nt, Homo sapiens
uguaaaugcauau

SEQ ID NO: 528269 - RNA, 16 nt, Homo sapiens
uguaauacauauagca

SEQ ID NO: 528270 - RNA, 15 nt, Homo sapiens
uguaauggaaaccaa

SEQ ID NO: 528271 - RNA, 15 nt, Homo sapiens
uguacagagugcuuu

SEQ ID NO: 528272 - RNA, 19 nt, Homo sapiens
uguacucuggggugcugcc

SEQ ID NO: 528273 - RNA, 17 nt, Homo sapiens
uguagacuuaacacuuc

SEQ ID NO: 528274 - RNA, 17 nt, Homo sapiens
uguagauauugugaagu

SEQ ID NO: 528275 - RNA, 15 nt, Homo sapiens
uguagcagucacuga

SEQ ID NO: 528276 - RNA, 16 nt, Homo sapiens
uguagcccauccuucc

SEQ ID NO: 528277 - RNA, 18 nt, Homo sapiens
uguaguuuuacuuuccua

SEQ ID NO: 528278 - RNA, 15 nt, Homo sapiens
uguauauacauauau

SEQ ID NO: 528279 - RNA, 18 nt, Homo sapiens
uguaugcaguauucuugc

SEQ ID NO: 528280 - RNA, 19 nt, Homo sapiens
uguaugcaguauucuugca

SEQ ID NO: 528281 - RNA, 22 nt, Homo sapiens
uguauuauuauuauugcugcca

SEQ ID NO: 528282 - RNA, 20 nt, Homo sapiens
uguauuuccagugcaauugu

SEQ ID NO: 528283 - RNA, 13 nt, Homo sapiens
uguauuugguaua

SEQ ID NO: 528284 - RNA, 22 nt, Homo sapiens
uguauuuucuuacacuguguca

SEQ ID NO: 528285 - RNA, 16 nt, Homo sapiens
uguauuuugacacugg

SEQ ID NO: 528286 - RNA, 13 nt, Homo sapiens
ugucaaugugaac

SEQ ID NO: 528287 - RNA, 21 nt, Homo sapiens
ugucacauuuagcugugcuca

SEQ ID NO: 528288 - RNA, 20 nt, Homo sapiens
ugucaccggucagugccuuu

SEQ ID NO: 528289 - RNA, 16 nt, Homo sapiens
ugucagugcugccagu

SEQ ID NO: 528290 - RNA, 20 nt, Homo sapiens
uguccagcaccuugugccug

SEQ ID NO: 528291 - RNA, 16 nt, Homo sapiens
ugucccugaaaccuag

SEQ ID NO: 528292 - RNA, 17 nt, Homo sapiens
ugucccuugcuugccug

SEQ ID NO: 528293 - RNA, 13 nt, Homo sapiens
uguccuacaguga

SEQ ID NO: 528294 - RNA, 21 nt, Homo sapiens
uguccugcagucccacacugu

SEQ ID NO: 528295 - RNA, 21 nt, Homo sapiens
uguccuuuuacucagcuuuau

SEQ ID NO: 528296 - RNA, 18 nt, Homo sapiens
uguccuuuuucaggagaa

SEQ ID NO: 528297 - RNA, 17 nt, Homo sapiens
ugucggcuuuuugccau

SEQ ID NO: 528298 - RNA, 22 nt, Homo sapiens
ugucuuaggcugaugccacuac

SEQ ID NO: 528299 - RNA, 17 nt, Homo sapiens
ugugaaacaguugcugu

SEQ ID NO: 528300 - RNA, 19 nt, Homo sapiens
ugugaauaauggcacugac

SEQ ID NO: 528301 - RNA, 15 nt, Homo sapiens
ugugacacugcagca

SEQ ID NO: 528302 - RNA, 12 nt, Homo sapiens
ugugccaguuua

SEQ ID NO: 528303 - RNA, 22 nt, Homo sapiens
ugugccauauucugguucuuga

SEQ ID NO: 528304 - RNA, 17 nt, Homo sapiens
uguggauggucauugca

SEQ ID NO: 528305 - RNA, 13 nt, Homo sapiens
uguggcagagcca

SEQ ID NO: 528306 - RNA, 22 nt, Homo sapiens
uguggcauaaauugcaucacug

SEQ ID NO: 528307 - RNA, 21 nt, Homo sapiens
uguggcucccuuggugcccuc

SEQ ID NO: 528308 - RNA, 18 nt, Homo sapiens
uguggguuugguccuuga

SEQ ID NO: 528309 - RNA, 17 nt, Homo sapiens
ugugguaaucuacacca

SEQ ID NO: 528310 - RNA, 20 nt, Homo sapiens
ugugguagcgccauggcugu

SEQ ID NO: 528311 - RNA, 18 nt, Homo sapiens
ugugguggccucagcuga

SEQ ID NO: 528312 - RNA, 14 nt, Homo sapiens
ugugguuccucugc

SEQ ID NO: 528313 - RNA, 20 nt, Homo sapiens
uguguaaacagaagccuguu

SEQ ID NO: 528314 - RNA, 19 nt, Homo sapiens
uguguaagaaauacagacu

SEQ ID NO: 528315 - RNA, 9 nt, Homo sapiens
uguguauga

SEQ ID NO: 528316 - RNA, 15 nt, Homo sapiens
uguguccacagaguu

SEQ ID NO: 528317 - RNA, 15 nt, Homo sapiens
uguguccucagggag

SEQ ID NO: 528318 - RNA, 10 nt, Homo sapiens
ugugugcaca

SEQ ID NO: 528319 - RNA, 14 nt, Homo sapiens
ugugugugugcaca

SEQ ID NO: 528320 - RNA, 16 nt, Homo sapiens
ugugugugugcacauc

SEQ ID NO: 528321 - RNA, 21 nt, Homo sapiens
uguguucacguaguucuagca

SEQ ID NO: 528322 - RNA, 15 nt, Homo sapiens
uguguucaggcauuc

SEQ ID NO: 528323 - RNA, 14 nt, Homo sapiens
uguguucugcaaua

SEQ ID NO: 528324 - RNA, 20 nt, Homo sapiens
uguguuuuuaacaugucaau

SEQ ID NO: 528325 - RNA, 15 nt, Homo sapiens
uguuagaucagggga

SEQ ID NO: 528326 - RNA, 15 nt, Homo sapiens
uguuaguuguccaca

SEQ ID NO: 528327 - RNA, 16 nt, Homo sapiens
uguuauauauuuacuc

SEQ ID NO: 528328 - RNA, 16 nt, Homo sapiens
uguucaugucagcuua

SEQ ID NO: 528329 - RNA, 22 nt, Homo sapiens
uguucccacaccccaacacuuc

SEQ ID NO: 528330 - RNA, 22 nt, Homo sapiens
uguucugccucucccugggucu

SEQ ID NO: 528331 - RNA, 12 nt, Homo sapiens
uguugacauaca

SEQ ID NO: 528332 - RNA, 12 nt, Homo sapiens
uguugaggacaa

SEQ ID NO: 528333 - RNA, 18 nt, Homo sapiens
uguugcaccaggcacugc

SEQ ID NO: 528334 - RNA, 19 nt, Homo sapiens
uguugcaccaggcacugcu

SEQ ID NO: 528335 - RNA, 15 nt, Homo sapiens
uguugcaggcugugg

SEQ ID NO: 528336 - RNA, 17 nt, Homo sapiens
uguugccaccauaccuc

SEQ ID NO: 528337 - RNA, 16 nt, Homo sapiens
uguugccauggugaug

SEQ ID NO: 528338 - RNA, 17 nt, Homo sapiens
uguugguauuauauaau

SEQ ID NO: 528339 - RNA, 16 nt, Homo sapiens
uguuguucugcucaau

SEQ ID NO: 528340 - RNA, 18 nt, Homo sapiens
uguuuacguuugauacaa

SEQ ID NO: 528341 - RNA, 13 nt, Homo sapiens
uguuuauacugua

SEQ ID NO: 528342 - RNA, 16 nt, Homo sapiens
uguuuauauaguuuag

SEQ ID NO: 528343 - RNA, 20 nt, Homo sapiens
uguuucuugggcagucuuuc

SEQ ID NO: 528344 - RNA, 22 nt, Homo sapiens
uguuugaggcaaauuaacugua

SEQ ID NO: 528345 - RNA, 18 nt, Homo sapiens
uguuuucuucaacaugcu

SEQ ID NO: 528346 - RNA, 15 nt, Homo sapiens
uuaaaaacauaacau

SEQ ID NO: 528347 - RNA, 13 nt, Homo sapiens
uuaaaaacuacca

SEQ ID NO: 528348 - RNA, 17 nt, Homo sapiens
uuaaaagagaagcauca

SEQ ID NO: 528349 - RNA, 16 nt, Homo sapiens
uuaaaagcacacuccc

SEQ ID NO: 528350 - RNA, 15 nt, Homo sapiens
uuaaaauuuuguaug

SEQ ID NO: 528351 - RNA, 14 nt, Homo sapiens
uuaaagaagcuuua

SEQ ID NO: 528352 - RNA, 22 nt, Homo sapiens
uuaaaggaaaaucacaucucca

SEQ ID NO: 528353 - RNA, 18 nt, Homo sapiens
uuaaaggcaucuacacaa

SEQ ID NO: 528354 - RNA, 13 nt, Homo sapiens
uuaaaugguaaua

SEQ ID NO: 528355 - RNA, 15 nt, Homo sapiens
uuaaaugucugaaau

SEQ ID NO: 528356 - RNA, 17 nt, Homo sapiens
uuaaauuuaauaccaga

SEQ ID NO: 528357 - RNA, 16 nt, Homo sapiens
uuaaccuuugcuaugu

SEQ ID NO: 528358 - RNA, 21 nt, Homo sapiens
uuaagaacaucaaaacuaacc

SEQ ID NO: 528359 - RNA, 13 nt, Homo sapiens
uuaagaagacaua

SEQ ID NO: 528360 - RNA, 18 nt, Homo sapiens
uuaagcauuuugaaacaa

SEQ ID NO: 528361 - RNA, 20 nt, Homo sapiens
uuaaggccaggcaugguggu

SEQ ID NO: 528362 - RNA, 21 nt, Homo sapiens
uuaaucucugcugaaacucag

SEQ ID NO: 528363 - RNA, 16 nt, Homo sapiens
uuaauggggaggacaa

SEQ ID NO: 528364 - RNA, 17 nt, Homo sapiens
uuaauguuauaucauau

SEQ ID NO: 528365 - RNA, 16 nt, Homo sapiens
uuaauuaaguaucugg

SEQ ID NO: 528366 - RNA, 19 nt, Homo sapiens
uuaauuuuuauacugacaa

SEQ ID NO: 528367 - RNA, 21 nt, Homo sapiens
uuacaagauguauuuguugua

SEQ ID NO: 528368 - RNA, 18 nt, Homo sapiens
uuacaaguuuauauauau

SEQ ID NO: 528369 - RNA, 17 nt, Homo sapiens
uuacacugugucauucu

SEQ ID NO: 528370 - RNA, 19 nt, Homo sapiens
uuacacugugucauucugu

SEQ ID NO: 528371 - RNA, 20 nt, Homo sapiens
uuacauauuuuuuguauauu

SEQ ID NO: 528372 - RNA, 12 nt, Homo sapiens
uuacaucuggcu

SEQ ID NO: 528373 - RNA, 21 nt, Homo sapiens
uuacauuagccauucauguau

SEQ ID NO: 528374 - RNA, 21 nt, Homo sapiens
uuacuagccucaaaauacauc

SEQ ID NO: 528375 - RNA, 16 nt, Homo sapiens
uuacuaucauggcaua

SEQ ID NO: 528376 - RNA, 22 nt, Homo sapiens
uuacugcccuuucaaagcacuu

SEQ ID NO: 528377 - RNA, 16 nt, Homo sapiens
uuagaaaaguggugua

SEQ ID NO: 528378 - RNA, 14 nt, Homo sapiens
uuagaaauuacuaa

SEQ ID NO: 528379 - RNA, 24 nt, Homo sapiens
uuagaucaaccuccaacaacgaca

SEQ ID NO: 528380 - RNA, 16 nt, Homo sapiens
uuagccauuucacucu

SEQ ID NO: 528381 - RNA, 16 nt, Homo sapiens
uuagcgucaagacauu

SEQ ID NO: 528382 - RNA, 15 nt, Homo sapiens
uuagcuuguuccacu

SEQ ID NO: 528383 - RNA, 15 nt, Homo sapiens
uuaggcaaagauaau

SEQ ID NO: 528384 - RNA, 17 nt, Homo sapiens
uuaguacagaaauaucc

SEQ ID NO: 528385 - RNA, 15 nt, Homo sapiens
uuagugauauuacau

SEQ ID NO: 528386 - RNA, 21 nt, Homo sapiens
uuagugaucaaauugugcagu

SEQ ID NO: 528387 - RNA, 18 nt, Homo sapiens
uuauaacucaacauuugu

SEQ ID NO: 528388 - RNA, 20 nt, Homo sapiens
ggaaccauguauaugagcuu

SEQ ID NO: 528389 - RNA, 20 nt, Homo sapiens
ggaacugcguggugcucuuu

SEQ ID NO: 528390 - RNA, 17 nt, Homo sapiens
ggaagaauccaguauua

SEQ ID NO: 528391 - RNA, 19 nt, Homo sapiens
ggaagacuagaggcuugca

SEQ ID NO: 528392 - RNA, 21 nt, Homo sapiens
ggaaggaacagcaaugguguc

SEQ ID NO: 528393 - RNA, 15 nt, Homo sapiens
ggacaucacagggug

SEQ ID NO: 528394 - RNA, 13 nt, Homo sapiens
ggacuccaucucu

SEQ ID NO: 528395 - RNA, 15 nt, Homo sapiens
ggacuccaugcuccu

SEQ ID NO: 528396 - RNA, 20 nt, Homo sapiens
ggacugccuugucucuagua

SEQ ID NO: 528397 - RNA, 20 nt, Homo sapiens
ggacuuccagugcucagagg

SEQ ID NO: 528398 - RNA, 17 nt, Homo sapiens
ggagaaacuucugcuca

SEQ ID NO: 528399 - RNA, 17 nt, Homo sapiens
ggagaagcaugaaaaag

SEQ ID NO: 528400 - RNA, 15 nt, Homo sapiens
ggagaauuagauuuc

SEQ ID NO: 528401 - RNA, 13 nt, Homo sapiens
ggagaauuugaaa

SEQ ID NO: 528402 - RNA, 21 nt, Homo sapiens
ggagaguaccuguguguuucg

SEQ ID NO: 528403 - RNA, 15 nt, Homo sapiens
ggagagucacuugaa

SEQ ID NO: 528404 - RNA, 18 nt, Homo sapiens
ggagcugucccaccugca

SEQ ID NO: 528405 - RNA, 21 nt, Homo sapiens
ggaggccaagaacuugcaaua

SEQ ID NO: 528406 - RNA, 14 nt, Homo sapiens
ggaggcuucagaag

SEQ ID NO: 528407 - RNA, 21 nt, Homo sapiens
ggagggcccuccgaccacuuc

SEQ ID NO: 528408 - RNA, 13 nt, Homo sapiens
ggaguacugauga

SEQ ID NO: 528409 - RNA, 15 nt, Homo sapiens
ggauaaggaggcacu

SEQ ID NO: 528410 - RNA, 15 nt, Homo sapiens
ggauauacugcagcu

SEQ ID NO: 528411 - RNA, 21 nt, Homo sapiens
ggauauccuuaucagagcuaa

SEQ ID NO: 528412 - RNA, 20 nt, Homo sapiens
ggauauccuuucacucugca

SEQ ID NO: 528413 - RNA, 15 nt, Homo sapiens
ggauccagaacugca

SEQ ID NO: 528414 - RNA, 22 nt, Homo sapiens
ggaucuugaauguggucucagg

SEQ ID NO: 528415 - RNA, 16 nt, Homo sapiens
ggaugacccacugucc

SEQ ID NO: 528416 - RNA, 21 nt, Homo sapiens
ggauuaagaaaccuugcucuc

SEQ ID NO: 528417 - RNA, 17 nt, Homo sapiens
ggcaaagaaaggagaua

SEQ ID NO: 528418 - RNA, 14 nt, Homo sapiens
ggcaacuguaugaa

SEQ ID NO: 528419 - RNA, 17 nt, Homo sapiens
ggcaagucuuccaugac

SEQ ID NO: 528420 - RNA, 16 nt, Homo sapiens
ggcaaguugcaucaga

SEQ ID NO: 528421 - RNA, 14 nt, Homo sapiens
ggcacaagugucag

SEQ ID NO: 528422 - RNA, 21 nt, Homo sapiens
ggcagacaucggccuccauga

SEQ ID NO: 528423 - RNA, 22 nt, Homo sapiens
ggcagauaaaaugccagucuca

SEQ ID NO: 528424 - RNA, 15 nt, Homo sapiens
ggcagauggggcacu

SEQ ID NO: 528425 - RNA, 23 nt, Homo sapiens
ggcagauggggcacugacccagg

SEQ ID NO: 528426 - RNA, 14 nt, Homo sapiens
ggcagauugaaaag

SEQ ID NO: 528427 - RNA, 15 nt, Homo sapiens
ggcagccauggccau

SEQ ID NO: 528428 - RNA, 15 nt, Homo sapiens
ggcagcggguggcau

SEQ ID NO: 528429 - RNA, 14 nt, Homo sapiens
ggcagcuacucaga

SEQ ID NO: 528430 - RNA, 14 nt, Homo sapiens
ggcagggcccagug

SEQ ID NO: 528431 - RNA, 17 nt, Homo sapiens
ggcagggcccagugaca

SEQ ID NO: 528432 - RNA, 16 nt, Homo sapiens
ggcaggugaaaagggu

SEQ ID NO: 528433 - RNA, 13 nt, Homo sapiens
ggcaguggcagag

SEQ ID NO: 528434 - RNA, 16 nt, Homo sapiens
ggcaugagacucagug

SEQ ID NO: 528435 - RNA, 21 nt, Homo sapiens
ggccaccccuaggaacucagu

SEQ ID NO: 528436 - RNA, 20 nt, Homo sapiens
ggccagggucugugugaaug

SEQ ID NO: 528437 - RNA, 23 nt, Homo sapiens
ggccagggucugugugaaugugg

SEQ ID NO: 528438 - RNA, 22 nt, Homo sapiens
ggccaguggggccuguggaaug

SEQ ID NO: 528439 - RNA, 17 nt, Homo sapiens
ggccccagggggucuca

SEQ ID NO: 528440 - RNA, 17 nt, Homo sapiens
ggccccucccacaccca

SEQ ID NO: 528441 - RNA, 17 nt, Homo sapiens
ggccccuggcacucuug

SEQ ID NO: 528442 - RNA, 15 nt, Homo sapiens
ggcccuucacuucca

SEQ ID NO: 528443 - RNA, 16 nt, Homo sapiens
ggccggcccugugugc

SEQ ID NO: 528444 - RNA, 22 nt, Homo sapiens
ggccgggccuagaccuggugcu

SEQ ID NO: 528445 - RNA, 13 nt, Homo sapiens
ggccguggcacag

SEQ ID NO: 528446 - RNA, 12 nt, Homo sapiens
ggccuccaugac

SEQ ID NO: 528447 - RNA, 19 nt, Homo sapiens
ggccuccccaugggcacag

SEQ ID NO: 528448 - RNA, 16 nt, Homo sapiens
ggccuugcuaccucaa

SEQ ID NO: 528449 - RNA, 18 nt, Homo sapiens
ggccuuuccugguuuuca

SEQ ID NO: 528450 - RNA, 16 nt, Homo sapiens
ggcuagguaucauuca

SEQ ID NO: 528451 - RNA, 17 nt, Homo sapiens
ggcucagaucucauggg

SEQ ID NO: 528452 - RNA, 19 nt, Homo sapiens
ggcuccacucuugaucucu

SEQ ID NO: 528453 - RNA, 22 nt, Homo sapiens
ggcuccuccucacccaccucug

SEQ ID NO: 528454 - RNA, 17 nt, Homo sapiens
ggcucuaauguacaaua

SEQ ID NO: 528455 - RNA, 21 nt, Homo sapiens
ggcucuaauguacaauaaagc

SEQ ID NO: 528456 - RNA, 22 nt, Homo sapiens
ggcucuguaccacgcuggccau

SEQ ID NO: 528457 - RNA, 14 nt, Homo sapiens
ggcugacucuccag

SEQ ID NO: 528458 - RNA, 14 nt, Homo sapiens
ggcugcacaacagc

SEQ ID NO: 528459 - RNA, 15 nt, Homo sapiens
ggcugcacaacagcc

SEQ ID NO: 528460 - RNA, 16 nt, Homo sapiens
ggcugcaugagcugca

SEQ ID NO: 528461 - RNA, 16 nt, Homo sapiens
ggcuggaaggggucca

SEQ ID NO: 528462 - RNA, 20 nt, Homo sapiens
ggcugggcgucuaugcugcu

SEQ ID NO: 528463 - RNA, 13 nt, Homo sapiens
ggcugggugguau

SEQ ID NO: 528464 - RNA, 15 nt, Homo sapiens
ggcuucuggucauga

SEQ ID NO: 528465 - RNA, 20 nt, Homo sapiens
ggcuuuaauagucaccuuca

SEQ ID NO: 528466 - RNA, 17 nt, Homo sapiens
ggcuuucccacuuccca

SEQ ID NO: 528467 - RNA, 19 nt, Homo sapiens
ggcuuucugggugugacug

SEQ ID NO: 528468 - RNA, 20 nt, Homo sapiens
ggcuuuuugccaucugugau

SEQ ID NO: 528469 - RNA, 20 nt, Homo sapiens
gggaaaagauuacugaaaua

SEQ ID NO: 528470 - RNA, 20 nt, Homo sapiens
gggaaagagagaugggccag

SEQ ID NO: 528471 - RNA, 15 nt, Homo sapiens
gggaaauccauucca

SEQ ID NO: 528472 - RNA, 14 nt, Homo sapiens
gggaacauguccua

SEQ ID NO: 528473 - RNA, 20 nt, Homo sapiens
gggaaccauguauaugagcu

SEQ ID NO: 528474 - RNA, 20 nt, Homo sapiens
gggaaguccucccugguguc

SEQ ID NO: 528475 - RNA, 17 nt, Homo sapiens
gggaaugggacugugag

SEQ ID NO: 528476 - RNA, 15 nt, Homo sapiens
gggacccagugcaga

SEQ ID NO: 528477 - RNA, 13 nt, Homo sapiens
gggagaacgggaa

SEQ ID NO: 528478 - RNA, 11 nt, Homo sapiens
gggagcacugc

SEQ ID NO: 528479 - RNA, 20 nt, Homo sapiens
gucugcaugugcacgguggc

SEQ ID NO: 528480 - RNA, 17 nt, Homo sapiens
gucugccuucugcugaa

SEQ ID NO: 528481 - RNA, 13 nt, Homo sapiens
gucugguguucca

SEQ ID NO: 528482 - RNA, 20 nt, Homo sapiens
gucuguagcuccucaacuca

SEQ ID NO: 528483 - RNA, 19 nt, Homo sapiens
gucugugugaaugugggca

SEQ ID NO: 528484 - RNA, 14 nt, Homo sapiens
gucuuccaugaccc

SEQ ID NO: 528485 - RNA, 16 nt, Homo sapiens
gucuugaacaucccaa

SEQ ID NO: 528486 - RNA, 18 nt, Homo sapiens
gucuuguuuuuuacucaa

SEQ ID NO: 528487 - RNA, 13 nt, Homo sapiens
gugaaugugggca

SEQ ID NO: 528488 - RNA, 11 nt, Homo sapiens
gugaauuguga

SEQ ID NO: 528489 - RNA, 20 nt, Homo sapiens
gugagaacucugcccaggug

SEQ ID NO: 528490 - RNA, 19 nt, Homo sapiens
gugagugggagaguaccug

SEQ ID NO: 528491 - RNA, 15 nt, Homo sapiens
gugaugcuguacaca

SEQ ID NO: 528492 - RNA, 14 nt, Homo sapiens
gugauguuugcucu

SEQ ID NO: 528493 - RNA, 12 nt, Homo sapiens
gugcaaagggaa

SEQ ID NO: 528494 - RNA, 13 nt, Homo sapiens
gugcaaagggaac

SEQ ID NO: 528495 - RNA, 20 nt, Homo sapiens
gugcaagaugaaugcagauu

SEQ ID NO: 528496 - RNA, 18 nt, Homo sapiens
gugcaauaugaggccaaa

SEQ ID NO: 528497 - RNA, 21 nt, Homo sapiens
gugcagaauuggggcacuuaa

SEQ ID NO: 528498 - RNA, 17 nt, Homo sapiens
gugccacuggaccucag

SEQ ID NO: 528499 - RNA, 16 nt, Homo sapiens
gugccagcaccacagc

SEQ ID NO: 528500 - RNA, 15 nt, Homo sapiens
gugccucaccuucca

SEQ ID NO: 528501 - RNA, 15 nt, Homo sapiens
gugcggaucucugga

SEQ ID NO: 528502 - RNA, 13 nt, Homo sapiens
gugcucagagggc

SEQ ID NO: 528503 - RNA, 13 nt, Homo sapiens
gugcucauuuaag

SEQ ID NO: 528504 - RNA, 22 nt, Homo sapiens
gugcucuacaccuuagugcagc

SEQ ID NO: 528505 - RNA, 12 nt, Homo sapiens
gugcucuuugcu

SEQ ID NO: 528506 - RNA, 22 nt, Homo sapiens
gugcugucuugaugacugcuga

SEQ ID NO: 528507 - RNA, 16 nt, Homo sapiens
guggcagacaucggcc

SEQ ID NO: 528508 - RNA, 13 nt, Homo sapiens
guggccacagacu

SEQ ID NO: 528509 - RNA, 20 nt, Homo sapiens
guggccuauuucaugcagag

SEQ ID NO: 528510 - RNA, 18 nt, Homo sapiens
guggcgagaaggugggga

SEQ ID NO: 528511 - RNA, 17 nt, Homo sapiens
gugggaagaauuggaag

SEQ ID NO: 528512 - RNA, 22 nt, Homo sapiens
uaauuaccuggugaguaacuua

SEQ ID NO: 528513 - RNA, 15 nt, Homo sapiens
uaauucuuaacagug

SEQ ID NO: 528514 - RNA, 23 nt, Homo sapiens
uaauugggcaggugaaaagggua

SEQ ID NO: 528515 - RNA, 23 nt, Homo sapiens
uaauuucagugggaaauaugcca

SEQ ID NO: 528516 - RNA, 21 nt, Homo sapiens
uaauuugggaaaauaaauaca

SEQ ID NO: 528517 - RNA, 18 nt, Homo sapiens
uaauuuucagcugcaagg

SEQ ID NO: 528518 - RNA, 14 nt, Homo sapiens
uaauuuucuuucac

SEQ ID NO: 528519 - RNA, 22 nt, Homo sapiens
uacaaaaacuuagaugggcaug

SEQ ID NO: 528520 - RNA, 21 nt, Homo sapiens
uacaaucuuagugaaugggaa

SEQ ID NO: 528521 - RNA, 17 nt, Homo sapiens
uacaauuaauaguuugu

SEQ ID NO: 528522 - RNA, 23 nt, Homo sapiens
uacagcaugugccuuaaugcuuc

SEQ ID NO: 528523 - RNA, 16 nt, Homo sapiens
uacagcuccuuugaaa

SEQ ID NO: 528524 - RNA, 20 nt, Homo sapiens
uacaggcgugauccaccaca

SEQ ID NO: 528525 - RNA, 19 nt, Homo sapiens
uacagugccaacuccucac

SEQ ID NO: 528526 - RNA, 20 nt, Homo sapiens
uacauaacuccugucccuuu

SEQ ID NO: 528527 - RNA, 16 nt, Homo sapiens
uacauaaggaugacuu

SEQ ID NO: 528528 - RNA, 21 nt, Homo sapiens
uacaucugcaauaugaauuca

SEQ ID NO: 528529 - RNA, 16 nt, Homo sapiens
uacaucuuucauuucg

SEQ ID NO: 528530 - RNA, 16 nt, Homo sapiens
uacaugagauaacuca

SEQ ID NO: 528531 - RNA, 13 nt, Homo sapiens
uacaugcauuuga

SEQ ID NO: 528532 - RNA, 22 nt, Homo sapiens
uacaugucacauuuagcugugc

SEQ ID NO: 528533 - RNA, 13 nt, Homo sapiens
uacaugucuagag

SEQ ID NO: 528534 - RNA, 14 nt, Homo sapiens
uacaugucuuccau

SEQ ID NO: 528535 - RNA, 18 nt, Homo sapiens
uacaugugagugacgaug

SEQ ID NO: 528536 - RNA, 13 nt, Homo sapiens
uacauugucuuga

SEQ ID NO: 528537 - RNA, 13 nt, Homo sapiens
uaccaauguucua

SEQ ID NO: 528538 - RNA, 15 nt, Homo sapiens
uaccacucagagaaa

SEQ ID NO: 528539 - RNA, 22 nt, Homo sapiens
uaccauuuaauggggaggacaa

SEQ ID NO: 528540 - RNA, 20 nt, Homo sapiens
uacccaggcuggagugcagu

SEQ ID NO: 528541 - RNA, 13 nt, Homo sapiens
uaccuacaucaga

SEQ ID NO: 528542 - RNA, 22 nt, Homo sapiens
uaccucaguucccucuugcuca

SEQ ID NO: 528543 - RNA, 20 nt, Homo sapiens
uaccugcuggaagaauucua

SEQ ID NO: 528544 - RNA, 17 nt, Homo sapiens
uaccuguccaagacagg

SEQ ID NO: 528545 - RNA, 20 nt, Homo sapiens
uaccuugaacucuuagugau

SEQ ID NO: 528546 - RNA, 14 nt, Homo sapiens
uacgaaccaugccu

SEQ ID NO: 528547 - RNA, 12 nt, Homo sapiens
uacggacacugu

SEQ ID NO: 528548 - RNA, 20 nt, Homo sapiens
uacguuaggaggacaaaagg

SEQ ID NO: 528549 - RNA, 16 nt, Homo sapiens
uacguuugauacaaca

SEQ ID NO: 528550 - RNA, 16 nt, Homo sapiens
uacuaccuguaaugac

SEQ ID NO: 528551 - RNA, 21 nt, Homo sapiens
uacuauccuguaaauauaucu

SEQ ID NO: 528552 - RNA, 13 nt, Homo sapiens
uacucugcugcaa

SEQ ID NO: 528553 - RNA, 19 nt, Homo sapiens
uacucuucuuacuggugcu

SEQ ID NO: 528554 - RNA, 13 nt, Homo sapiens
uacugaugaaaua

SEQ ID NO: 528555 - RNA, 21 nt, Homo sapiens
uacugcaggaccuccagcuga

SEQ ID NO: 528556 - RNA, 20 nt, Homo sapiens
uacuuaaaaauagucuucca

SEQ ID NO: 528557 - RNA, 12 nt, Homo sapiens
uacuuugugcau

SEQ ID NO: 528558 - RNA, 19 nt, Homo sapiens
uacuuuuaaaaacauaaca

SEQ ID NO: 528559 - RNA, 23 nt, Homo sapiens
uagaacucugggcugccauguga

SEQ ID NO: 528560 - RNA, 20 nt, Homo sapiens
uagaacuuuauuaaguaaaa

SEQ ID NO: 528561 - RNA, 14 nt, Homo sapiens
uagaagcacuacac

SEQ ID NO: 528562 - RNA, 17 nt, Homo sapiens
uagacacauacauguca

SEQ ID NO: 528563 - RNA, 22 nt, Homo sapiens
uagaccuccacacccgugagaa

SEQ ID NO: 528564 - RNA, 18 nt, Homo sapiens
uagacgaggccacagcug

SEQ ID NO: 528565 - RNA, 13 nt, Homo sapiens
uagacugugccag

SEQ ID NO: 528566 - RNA, 18 nt, Homo sapiens
uagagaggacaauacugg

SEQ ID NO: 528567 - RNA, 19 nt, Homo sapiens
uagagaggacaauacuggg

SEQ ID NO: 528568 - RNA, 21 nt, Homo sapiens
uagagaggacaauacuggggu

SEQ ID NO: 528569 - RNA, 18 nt, Homo sapiens
uagaggauagggagaaua

SEQ ID NO: 528570 - RNA, 17 nt, Homo sapiens
uagagugauuuugaaau

SEQ ID NO: 528571 - RNA, 11 nt, Homo sapiens
uagauguugcu

SEQ ID NO: 528572 - RNA, 16 nt, Homo sapiens
uagcaaacacuggggg

SEQ ID NO: 528573 - RNA, 22 nt, Homo sapiens
uagcaauaacauacaugagaua

SEQ ID NO: 528574 - RNA, 18 nt, Homo sapiens
uagcaauagcuagcuaua

SEQ ID NO: 528575 - RNA, 20 nt, Homo sapiens
uagcagcccacccugcugcu

SEQ ID NO: 528576 - RNA, 15 nt, Homo sapiens
uagcagggauagauu

SEQ ID NO: 528577 - RNA, 16 nt, Homo sapiens
uagcaugacguguggu

SEQ ID NO: 528578 - RNA, 20 nt, Homo sapiens
uagcaugcuacuuggggaca

SEQ ID NO: 528579 - RNA, 20 nt, Homo sapiens
uagcauuguaaaagcauuuu

SEQ ID NO: 528580 - RNA, 23 nt, Homo sapiens
uagccagaggcucuaauguacaa

SEQ ID NO: 528581 - RNA, 17 nt, Homo sapiens
uagccauuucacucuca

SEQ ID NO: 528582 - RNA, 19 nt, Homo sapiens
uagcuccauaaaguacaaa

SEQ ID NO: 528583 - RNA, 16 nt, Homo sapiens
uagcucugcugcugau

SEQ ID NO: 528584 - RNA, 22 nt, Homo sapiens
uagcugacggcuggguguuuca

SEQ ID NO: 528585 - RNA, 14 nt, Homo sapiens
uagcugugcucaga

SEQ ID NO: 528586 - RNA, 19 nt, Homo sapiens
uagcuuccugccccagaca

SEQ ID NO: 528587 - RNA, 12 nt, Homo sapiens
uagcuugcuccc

SEQ ID NO: 528588 - RNA, 17 nt, Homo sapiens
uaggaagacgcagagca

SEQ ID NO: 528589 - RNA, 13 nt, Homo sapiens
uaggaagcacuga

SEQ ID NO: 528590 - RNA, 16 nt, Homo sapiens
uaggagguuauuucaa

SEQ ID NO: 528591 - RNA, 19 nt, Homo sapiens
uaggcagcaagcuuugguu

SEQ ID NO: 528592 - RNA, 17 nt, Homo sapiens
uaggcuaugccaugugc

SEQ ID NO: 528593 - RNA, 13 nt, Homo sapiens
uaggcugcugcug

SEQ ID NO: 528594 - RNA, 16 nt, Homo sapiens
uaggcuuucauguugc

SEQ ID NO: 528595 - RNA, 16 nt, Homo sapiens
uagguguguccacaga

SEQ ID NO: 528596 - RNA, 17 nt, Homo sapiens
uaguaccuucaauacuu

SEQ ID NO: 528597 - RNA, 21 nt, Homo sapiens
ucauugcuaaacugaugacuu

SEQ ID NO: 528598 - RNA, 18 nt, Homo sapiens
ucauuggugaaguaaauu

SEQ ID NO: 528599 - RNA, 15 nt, Homo sapiens
ucauuuuugcacuua

SEQ ID NO: 528600 - RNA, 12 nt, Homo sapiens
uccaaagaggcu

SEQ ID NO: 528601 - RNA, 20 nt, Homo sapiens
uccaaagaguuucugcaaag

SEQ ID NO: 528602 - RNA, 17 nt, Homo sapiens
uccaaagccggcuugau

SEQ ID NO: 528603 - RNA, 16 nt, Homo sapiens
uccaaugucaauguga

SEQ ID NO: 528604 - RNA, 18 nt, Homo sapiens
uccaaugucaaugugaac

SEQ ID NO: 528605 - RNA, 16 nt, Homo sapiens
uccacgauucacucau

SEQ ID NO: 528606 - RNA, 16 nt, Homo sapiens
uccacucuugugguca

SEQ ID NO: 528607 - RNA, 19 nt, Homo sapiens
uccacugccuccugugacg

SEQ ID NO: 528608 - RNA, 22 nt, Homo sapiens
uccacugccuccugugacguga

SEQ ID NO: 528609 - RNA, 16 nt, Homo sapiens
uccacuguuagcacau

SEQ ID NO: 528610 - RNA, 14 nt, Homo sapiens
uccagaacugcacu

SEQ ID NO: 528611 - RNA, 13 nt, Homo sapiens
uccagcagcuuuc

SEQ ID NO: 528612 - RNA, 15 nt, Homo sapiens
uccagcuuucugcca

SEQ ID NO: 528613 - RNA, 23 nt, Homo sapiens
uccagggcuauagggugugauga

SEQ ID NO: 528614 - RNA, 14 nt, Homo sapiens
uccaguauaaccag

SEQ ID NO: 528615 - RNA, 15 nt, Homo sapiens
uccaucaacucccaa

SEQ ID NO: 528616 - RNA, 15 nt, Homo sapiens
uccauccugcagaua

SEQ ID NO: 528617 - RNA, 18 nt, Homo sapiens
uccaucucucucuugccu

SEQ ID NO: 528618 - RNA, 23 nt, Homo sapiens
uccaugcaacuggaguuccuuau

SEQ ID NO: 528619 - RNA, 16 nt, Homo sapiens
uccauuuucuaugcuu

SEQ ID NO: 528620 - RNA, 19 nt, Homo sapiens
uccauuuugugaauuguga

SEQ ID NO: 528621 - RNA, 22 nt, Homo sapiens
ucccaagcugauuuuauucaau

SEQ ID NO: 528622 - RNA, 21 nt, Homo sapiens
ucccaccaaccuccaguguca

SEQ ID NO: 528623 - RNA, 15 nt, Homo sapiens
ucccacuacaucugg

SEQ ID NO: 528624 - RNA, 17 nt, Homo sapiens
ucccagaauguuacuga

SEQ ID NO: 528625 - RNA, 17 nt, Homo sapiens
ucccagauggcuggaag

SEQ ID NO: 528626 - RNA, 21 nt, Homo sapiens
ucccagggaggcugugcacag

SEQ ID NO: 528627 - RNA, 14 nt, Homo sapiens
ucccaugaacuaua

SEQ ID NO: 528628 - RNA, 12 nt, Homo sapiens
ucccauugccau

SEQ ID NO: 528629 - RNA, 18 nt, Homo sapiens
uccccagccugcucccua

SEQ ID NO: 528630 - RNA, 14 nt, Homo sapiens
uccccggcaugaga

SEQ ID NO: 528631 - RNA, 16 nt, Homo sapiens
uccccucucagcauuu

SEQ ID NO: 528632 - RNA, 22 nt, Homo sapiens
ucccgggggccccaccucggca

SEQ ID NO: 528633 - RNA, 13 nt, Homo sapiens
ucccuagccagag

SEQ ID NO: 528634 - RNA, 18 nt, Homo sapiens
ugcaaaguguaugugacc

SEQ ID NO: 528635 - RNA, 14 nt, Homo sapiens
ugcaaccucugccu

SEQ ID NO: 528636 - RNA, 17 nt, Homo sapiens
ugcaaccucugccuccc

SEQ ID NO: 528637 - RNA, 18 nt, Homo sapiens
ugcaacucuaacucugag

SEQ ID NO: 528638 - RNA, 16 nt, Homo sapiens
ugcaauaugaauucaa

SEQ ID NO: 528639 - RNA, 15 nt, Homo sapiens
ugcaaucuucuacuu

SEQ ID NO: 528640 - RNA, 19 nt, Homo sapiens
ugcaaucuucuacuuuaag

SEQ ID NO: 528641 - RNA, 15 nt, Homo sapiens
ugcaaugaaagucaa

SEQ ID NO: 528642 - RNA, 13 nt, Homo sapiens
ugcaauguaguca

SEQ ID NO: 528643 - RNA, 15 nt, Homo sapiens
ugcaccaggcacugc

SEQ ID NO: 528644 - RNA, 16 nt, Homo sapiens
ugcaccccugagccag

SEQ ID NO: 528645 - RNA, 18 nt, Homo sapiens
ugcaccuguaaagugccu

SEQ ID NO: 528646 - RNA, 20 nt, Homo sapiens
ugcacuauguauauacauau

SEQ ID NO: 528647 - RNA, 20 nt, Homo sapiens
ugcacuccagccugggcaac

SEQ ID NO: 528648 - RNA, 21 nt, Homo sapiens
ugcacuccagccugggggaca

SEQ ID NO: 528649 - RNA, 17 nt, Homo sapiens
ugcacuguccugaccau

SEQ ID NO: 528650 - RNA, 17 nt, Homo sapiens
ugcagccccacagacaa

SEQ ID NO: 528651 - RNA, 18 nt, Homo sapiens
ugcagcuagaggcaucuu

SEQ ID NO: 528652 - RNA, 21 nt, Homo sapiens
ugcaggggugacggcccucau

SEQ ID NO: 528653 - RNA, 22 nt, Homo sapiens
ugcagguuccgauguuauuaga

SEQ ID NO: 528654 - RNA, 20 nt, Homo sapiens
ugcaguauucuugcacugag

SEQ ID NO: 528655 - RNA, 18 nt, Homo sapiens
ugcagucccacacugugc

SEQ ID NO: 528656 - RNA, 19 nt, Homo sapiens
ugcauaauaacuacuucca

SEQ ID NO: 528657 - RNA, 12 nt, Homo sapiens
ugcaucagaaag

SEQ ID NO: 528658 - RNA, 23 nt, Homo sapiens
ugcaucuuuguuacuuccuuaug

SEQ ID NO: 528659 - RNA, 16 nt, Homo sapiens
ugcauuauaucaaauc

SEQ ID NO: 528660 - RNA, 16 nt, Homo sapiens
ugccaaaaacaaaaaa

SEQ ID NO: 528661 - RNA, 18 nt, Homo sapiens
ugccaaccuuauagggau

SEQ ID NO: 528662 - RNA, 14 nt, Homo sapiens
ugccaacuccucac

SEQ ID NO: 528663 - RNA, 22 nt, Homo sapiens
ugccaagagggucugauggcac

SEQ ID NO: 528664 - RNA, 14 nt, Homo sapiens
ugccaccauaccuc

SEQ ID NO: 528665 - RNA, 15 nt, Homo sapiens
ugccagugucauccg

SEQ ID NO: 528666 - RNA, 13 nt, Homo sapiens
ugccaucaugccu

SEQ ID NO: 528667 - RNA, 20 nt, Homo sapiens
ugccauguggcagaucuaca

SEQ ID NO: 528668 - RNA, 21 nt, Homo sapiens
ugcccaagagaucugugccau

SEQ ID NO: 528669 - RNA, 13 nt, Homo sapiens
ugcccagaucaac

SEQ ID NO: 528670 - RNA, 13 nt, Homo sapiens
ugccccaauguga

SEQ ID NO: 528671 - RNA, 21 nt, Homo sapiens
ugccccacaaaacuucagugu

SEQ ID NO: 528672 - RNA, 23 nt, Homo sapiens
ugccccacaaaacuucagugugg

SEQ ID NO: 528673 - RNA, 13 nt, Homo sapiens
ccagacaaaugga

SEQ ID NO: 528674 - RNA, 15 nt, Homo sapiens
ccagacucugucuca

SEQ ID NO: 528675 - RNA, 21 nt, Homo sapiens
ccagaggcucuaauguacaau

SEQ ID NO: 528676 - RNA, 19 nt, Homo sapiens
ccagaugagaagucugcua

SEQ ID NO: 528677 - RNA, 12 nt, Homo sapiens
ccagcacuuugg

SEQ ID NO: 528678 - RNA, 15 nt, Homo sapiens
ccagcagacucugga

SEQ ID NO: 528679 - RNA, 16 nt, Homo sapiens
ccagcauuuaaccaac

SEQ ID NO: 528680 - RNA, 15 nt, Homo sapiens
ccagcccugcugcag

SEQ ID NO: 528681 - RNA, 15 nt, Homo sapiens
ccagccugcucccua

SEQ ID NO: 528682 - RNA, 20 nt, Homo sapiens
ccagccugcucccuagccag

SEQ ID NO: 528683 - RNA, 18 nt, Homo sapiens
ccaggacaauuagaaaaa

SEQ ID NO: 528684 - RNA, 22 nt, Homo sapiens
ccaggacggggcacaaguguca

SEQ ID NO: 528685 - RNA, 19 nt, Homo sapiens
ccaggaguucugaagcuga

SEQ ID NO: 528686 - RNA, 17 nt, Homo sapiens
ccaggcuuucaauguuu

SEQ ID NO: 528687 - RNA, 16 nt, Homo sapiens
ccagggcugcccugag

SEQ ID NO: 528688 - RNA, 18 nt, Homo sapiens
ccaggggaaccugccaug

SEQ ID NO: 528689 - RNA, 21 nt, Homo sapiens
ccagggugauuuuaugaucag

SEQ ID NO: 528690 - RNA, 18 nt, Homo sapiens
ccagguuuaugaaugaca

SEQ ID NO: 528691 - RNA, 18 nt, Homo sapiens
ccaguggaucauaagaca

SEQ ID NO: 528692 - RNA, 18 nt, Homo sapiens
ccagugucaggguccagg

SEQ ID NO: 528693 - RNA, 13 nt, Homo sapiens
ccauaacaauucc

SEQ ID NO: 528694 - RNA, 23 nt, Homo sapiens
ccauauucugguucuugaaaaua

SEQ ID NO: 528695 - RNA, 12 nt, Homo sapiens
ccauccaucucu

SEQ ID NO: 528696 - RNA, 21 nt, Homo sapiens
ccauccugcagauacuuugaa

SEQ ID NO: 528697 - RNA, 18 nt, Homo sapiens
ccauccuucccuuuggag

SEQ ID NO: 528698 - RNA, 23 nt, Homo sapiens
ccaucgaccuggagacugacaac

SEQ ID NO: 528699 - RNA, 21 nt, Homo sapiens
ccaucuaaugcuuguuuauga

SEQ ID NO: 528700 - RNA, 14 nt, Homo sapiens
ccaucugacaaaau

SEQ ID NO: 528701 - RNA, 13 nt, Homo sapiens
ccaucugagcugg

SEQ ID NO: 528702 - RNA, 19 nt, Homo sapiens
ccaugaggaaggaacagca

SEQ ID NO: 528703 - RNA, 18 nt, Homo sapiens
ccauggcccccaauaaag

SEQ ID NO: 528704 - RNA, 15 nt, Homo sapiens
ccaugggcacagugg

SEQ ID NO: 528705 - RNA, 23 nt, Homo sapiens
ccauguaucuuuugaacuggcaa

SEQ ID NO: 528706 - RNA, 13 nt, Homo sapiens
ccauguccaaaga

SEQ ID NO: 528707 - RNA, 14 nt, Homo sapiens
ccauguccaaagag

SEQ ID NO: 528708 - RNA, 21 nt, Homo sapiens
ccauguccaaagaggcugccc

SEQ ID NO: 528709 - RNA, 12 nt, Homo sapiens
ccaugugccuuu

SEQ ID NO: 528710 - RNA, 13 nt, Homo sapiens
ccauguugaucuu

SEQ ID NO: 528711 - RNA, 17 nt, Homo sapiens
ccauuauuaugcaaaau

SEQ ID NO: 528712 - RNA, 14 nt, Homo sapiens
ccauucacuacuca

SEQ ID NO: 528713 - RNA, 16 nt, Homo sapiens
ccauugcauuccagcc

SEQ ID NO: 528714 - RNA, 20 nt, Homo sapiens
ccauuguuccugcgcugcaa

SEQ ID NO: 528715 - RNA, 22 nt, Homo sapiens
ccauuucacucucaaacuucac

SEQ ID NO: 528716 - RNA, 18 nt, Homo sapiens
cccaaacaaugugcugga

SEQ ID NO: 528717 - RNA, 18 nt, Homo sapiens
cccaaauuaguacagaaa

SEQ ID NO: 528718 - RNA, 23 nt, Homo sapiens
cccaacugaguguuauuugcaca

SEQ ID NO: 528719 - RNA, 13 nt, Homo sapiens
cccaaugugaccu

SEQ ID NO: 528720 - RNA, 14 nt, Homo sapiens
cccagaguggcuca

SEQ ID NO: 528721 - RNA, 15 nt, Homo sapiens
cccagauugcugcaa

SEQ ID NO: 528722 - RNA, 16 nt, Homo sapiens
cccagcccaccugcuc

SEQ ID NO: 528723 - RNA, 21 nt, Homo sapiens
cccaggcccugcucuuccuca

SEQ ID NO: 528724 - RNA, 12 nt, Homo sapiens
cccagggggaga

SEQ ID NO: 528725 - RNA, 20 nt, Homo sapiens
cccagguggaaggcagacag

SEQ ID NO: 528726 - RNA, 18 nt, Homo sapiens
cccagucccacacugugg

SEQ ID NO: 528727 - RNA, 16 nt, Homo sapiens
ccccaacaugcacuga

SEQ ID NO: 528728 - RNA, 18 nt, Homo sapiens
ccccacagacaacaguug

SEQ ID NO: 528729 - RNA, 17 nt, Homo sapiens
ccccacucagugccucc

SEQ ID NO: 528730 - RNA, 21 nt, Homo sapiens
ccccagccugcucccuagcca

SEQ ID NO: 528731 - RNA, 23 nt, Homo sapiens
ccccagccugcucccuagccaga

SEQ ID NO: 528732 - RNA, 15 nt, Homo sapiens
ccccaucucccugcc

SEQ ID NO: 528733 - RNA, 15 nt, Homo sapiens
ccccgugacugcaau

SEQ ID NO: 528734 - RNA, 17 nt, Homo sapiens
ccccucagagacugaaa

SEQ ID NO: 528735 - RNA, 16 nt, Homo sapiens
ccccuguagcagucac

SEQ ID NO: 528736 - RNA, 23 nt, Homo sapiens
ccccugucauccucaugcugcuc

SEQ ID NO: 528737 - RNA, 15 nt, Homo sapiens
ccccuucggcagcua

SEQ ID NO: 528738 - RNA, 18 nt, Homo sapiens
cccgaggacaguggcaga

SEQ ID NO: 528739 - RNA, 16 nt, Homo sapiens
cccgggaccgugggcc

SEQ ID NO: 528740 - RNA, 14 nt, Homo sapiens
cccuaggaacucag

SEQ ID NO: 528741 - RNA, 21 nt, Homo sapiens
cccucacuaauugguacuuuu

SEQ ID NO: 528742 - RNA, 16 nt, Homo sapiens
cccugaauggucucag

SEQ ID NO: 528743 - RNA, 15 nt, Homo sapiens
cccugacucaucauu

SEQ ID NO: 528744 - RNA, 16 nt, Homo sapiens
cccugacucaucauuu

SEQ ID NO: 528745 - RNA, 23 nt, Homo sapiens
cccugagcuuuguccugaaggaa

SEQ ID NO: 528746 - RNA, 17 nt, Homo sapiens
cccugcaaacagaacag

SEQ ID NO: 528747 - RNA, 20 nt, Homo sapiens
cccugcaaacagaacagggu

SEQ ID NO: 528748 - RNA, 15 nt, Homo sapiens
cccugcccaaugaga

SEQ ID NO: 528749 - RNA, 19 nt, Homo sapiens
cccugcgcaugaaccugga

SEQ ID NO: 528750 - RNA, 20 nt, Homo sapiens
cccugcgcaugaaccuggac

SEQ ID NO: 528751 - RNA, 17 nt, Homo sapiens
cccugucuuccacagcc

SEQ ID NO: 528752 - RNA, 17 nt, Homo sapiens
cccuuauaauuggugca

SEQ ID NO: 528753 - RNA, 16 nt, Homo sapiens
ccgagaagcacuugag

SEQ ID NO: 528754 - RNA, 17 nt, Homo sapiens
ccgagccuccaguccaa

SEQ ID NO: 528755 - RNA, 21 nt, Homo sapiens
ccgaggugggcagaucacuug

SEQ ID NO: 528756 - RNA, 18 nt, Homo sapiens
ccgauucccaacugagug

SEQ ID NO: 528757 - RNA, 14 nt, Homo sapiens
ccgcagaagcagac

SEQ ID NO: 528758 - RNA, 23 nt, Homo sapiens
ccgcagaagcccugauguguccu

SEQ ID NO: 528759 - RNA, 14 nt, Homo sapiens
ccgcagaauggacu

SEQ ID NO: 528760 - RNA, 17 nt, Homo sapiens
ccgcauugauggccuca

SEQ ID NO: 528761 - RNA, 15 nt, Homo sapiens
ccggcagcacaagcu

SEQ ID NO: 528762 - RNA, 17 nt, Homo sapiens
ccguacaucugcaauau

SEQ ID NO: 528763 - RNA, 20 nt, Homo sapiens
ccguccacguccuccaagcu

SEQ ID NO: 528764 - RNA, 20 nt, Homo sapiens
ccguccucgagcaacugcug

SEQ ID NO: 528765 - RNA, 20 nt, Homo sapiens
ccuaaagccucaaaacaaag

SEQ ID NO: 528766 - RNA, 18 nt, Homo sapiens
ccuacaacucacauuaga

SEQ ID NO: 528767 - RNA, 11 nt, Homo sapiens
ccuaccucagc

SEQ ID NO: 528768 - RNA, 15 nt, Homo sapiens
ccuacguauccugca

SEQ ID NO: 528769 - RNA, 16 nt, Homo sapiens
ccuacguauccugcag

SEQ ID NO: 528770 - RNA, 16 nt, Homo sapiens
ccuaggaacucagucc

SEQ ID NO: 528771 - RNA, 14 nt, Homo sapiens
ccuauuucaugcag

SEQ ID NO: 528772 - RNA, 14 nt, Homo sapiens
ccucagucccucuu

SEQ ID NO: 528773 - RNA, 20 nt, Homo sapiens
ccucaguucccucuugcuca

SEQ ID NO: 528774 - RNA, 22 nt, Homo sapiens
ccucauugcagcuagaggcauc

SEQ ID NO: 528775 - RNA, 11 nt, Homo sapiens
ccucauugugu

SEQ ID NO: 528776 - RNA, 21 nt, Homo sapiens
ccuccaacaacgacacauuca

SEQ ID NO: 528777 - RNA, 18 nt, Homo sapiens
ccuccagaggagacauug

SEQ ID NO: 528778 - RNA, 16 nt, Homo sapiens
ccuccccaugggcaca

SEQ ID NO: 528779 - RNA, 16 nt, Homo sapiens
ccuccugcacacaggg

SEQ ID NO: 528780 - RNA, 22 nt, Homo sapiens
ccuccugugacgugaggcccau

SEQ ID NO: 528781 - RNA, 13 nt, Homo sapiens
ccuccugugggga

SEQ ID NO: 528782 - RNA, 15 nt, Homo sapiens
ccucuucugcucuuu

SEQ ID NO: 528783 - RNA, 20 nt, Homo sapiens
ccugaccaucgcacaccggc

SEQ ID NO: 528784 - RNA, 18 nt, Homo sapiens
ccugagucugcaugugca

SEQ ID NO: 528785 - RNA, 21 nt, Homo sapiens
ccugagucugcaugugcacgg

SEQ ID NO: 528786 - RNA, 20 nt, Homo sapiens
ccugcacuguccugaccauc

SEQ ID NO: 528787 - RNA, 15 nt, Homo sapiens
ccugcagggccagac

SEQ ID NO: 528788 - RNA, 13 nt, Homo sapiens
ccugcauuaacug

SEQ ID NO: 528789 - RNA, 20 nt, Homo sapiens
ccugccccagacagacuuca

SEQ ID NO: 528790 - RNA, 12 nt, Homo sapiens
ccugccugcauu

SEQ ID NO: 528791 - RNA, 23 nt, Homo sapiens
ccugcgcucucagcugaccauca

SEQ ID NO: 528792 - RNA, 15 nt, Homo sapiens
ccugcuuugcaucuu

SEQ ID NO: 528793 - RNA, 16 nt, Homo sapiens
gaaacucagugcaaaa

SEQ ID NO: 528794 - RNA, 15 nt, Homo sapiens
gaaagauuugaugua

SEQ ID NO: 528795 - RNA, 16 nt, Homo sapiens
gaaagcauaucccacc

SEQ ID NO: 528796 - RNA, 21 nt, Homo sapiens
gaaagggguuggggugacagu

SEQ ID NO: 528797 - RNA, 16 nt, Homo sapiens
gaaaguaacugugaga

SEQ ID NO: 528798 - RNA, 23 nt, Homo sapiens
gaaauauaguaaacacuuggaaa

SEQ ID NO: 528799 - RNA, 11 nt, Homo sapiens
gaaauaugcca

SEQ ID NO: 528800 - RNA, 23 nt, Homo sapiens
gaaaucaaaagauaguugauucu

SEQ ID NO: 528801 - RNA, 17 nt, Homo sapiens
gaaauccauuccauuuu

SEQ ID NO: 528802 - RNA, 22 nt, Homo sapiens
gaaaugaugaaaagguugccug

SEQ ID NO: 528803 - RNA, 15 nt, Homo sapiens
gaaauggaacagauu

SEQ ID NO: 528804 - RNA, 16 nt, Homo sapiens
gaaauuccuguacugu

SEQ ID NO: 528805 - RNA, 12 nt, Homo sapiens
gaacaacacuuc

SEQ ID NO: 528806 - RNA, 22 nt, Homo sapiens
gaacagcacuggggagucuuug

SEQ ID NO: 528807 - RNA, 21 nt, Homo sapiens
gaacagcauuacccuccucuc

SEQ ID NO: 528808 - RNA, 23 nt, Homo sapiens
gaacaggcucagaucucauggga

SEQ ID NO: 528809 - RNA, 20 nt, Homo sapiens
gaacagggucauguuugcag

SEQ ID NO: 528810 - RNA, 18 nt, Homo sapiens
gaacauugguucuuucau

SEQ ID NO: 528811 - RNA, 15 nt, Homo sapiens
gaaccaaccagggaa

SEQ ID NO: 528812 - RNA, 12 nt, Homo sapiens
gaaccacauauu

SEQ ID NO: 528813 - RNA, 13 nt, Homo sapiens
gaaccauuuacuu

SEQ ID NO: 528814 - RNA, 23 nt, Homo sapiens
gaacucagcacauucgggaccaa

SEQ ID NO: 528815 - RNA, 16 nt, Homo sapiens
gaacuggcaauugucu

SEQ ID NO: 528816 - RNA, 16 nt, Homo sapiens
gaacuugcaauaccaa

SEQ ID NO: 528817 - RNA, 15 nt, Homo sapiens
gaagaaaucaugaua

SEQ ID NO: 528818 - RNA, 17 nt, Homo sapiens
gaagagaaaggacucag

SEQ ID NO: 528819 - RNA, 16 nt, Homo sapiens
gaagauuagaaacuac

SEQ ID NO: 528820 - RNA, 16 nt, Homo sapiens
gaagcaagugguggga

SEQ ID NO: 528821 - RNA, 16 nt, Homo sapiens
gaagcagcagaccucc

SEQ ID NO: 528822 - RNA, 19 nt, Homo sapiens
gaagcccugauguguccuc

SEQ ID NO: 528823 - RNA, 22 nt, Homo sapiens
gaagccuuagccaggaggccag

SEQ ID NO: 528824 - RNA, 23 nt, Homo sapiens
gaagccuuagccaggaggccagg

SEQ ID NO: 528825 - RNA, 16 nt, Homo sapiens
gaagcuggugcgcccu

SEQ ID NO: 528826 - RNA, 11 nt, Homo sapiens
gaagcuuuauc

SEQ ID NO: 528827 - RNA, 13 nt, Homo sapiens
gaaggaaaugaca

SEQ ID NO: 528828 - RNA, 22 nt, Homo sapiens
gaaggaacagcaauggugucag

SEQ ID NO: 528829 - RNA, 14 nt, Homo sapiens
gaaggaaccugugu

SEQ ID NO: 528830 - RNA, 19 nt, Homo sapiens
gaaggagaaguaagaggcu

SEQ ID NO: 528831 - RNA, 19 nt, Homo sapiens
gaaggagcagucacuggga

SEQ ID NO: 528832 - RNA, 17 nt, Homo sapiens
gaaggaggggaaccaga

SEQ ID NO: 528833 - RNA, 13 nt, Homo sapiens
gaaggcagccgcc

SEQ ID NO: 528834 - RNA, 17 nt, Homo sapiens
gaagggaauugcucaga

SEQ ID NO: 528835 - RNA, 12 nt, Homo sapiens
gaaggugcccaa

SEQ ID NO: 528836 - RNA, 11 nt, Homo sapiens
gaagugaaaac

SEQ ID NO: 528837 - RNA, 10 nt, Homo sapiens
gaagugcucu

SEQ ID NO: 528838 - RNA, 15 nt, Homo sapiens
gaaguggucucccca

SEQ ID NO: 528839 - RNA, 14 nt, Homo sapiens
gaauaaauaauucu

SEQ ID NO: 528840 - RNA, 12 nt, Homo sapiens
gaauaaggccca

SEQ ID NO: 528841 - RNA, 22 nt, Homo sapiens
gaauacuuggaccucagccaac

SEQ ID NO: 528842 - RNA, 21 nt, Homo sapiens
gaauaugauaaaacacugccc

SEQ ID NO: 528843 - RNA, 15 nt, Homo sapiens
gaaucuagagcaaag

SEQ ID NO: 528844 - RNA, 15 nt, Homo sapiens
gaaugaacacucccc

SEQ ID NO: 528845 - RNA, 22 nt, Homo sapiens
gaaugaccaagcucaguucaau

SEQ ID NO: 528846 - RNA, 15 nt, Homo sapiens
gaaugacugacaaag

SEQ ID NO: 528847 - RNA, 18 nt, Homo sapiens
gaaugacugacaaagaca

SEQ ID NO: 528848 - RNA, 13 nt, Homo sapiens
gaauggcaauaaa

SEQ ID NO: 528849 - RNA, 17 nt, Homo sapiens
gaauguauguaaugugu

SEQ ID NO: 528850 - RNA, 13 nt, Homo sapiens
gaauuccuaacuu

SEQ ID NO: 528851 - RNA, 18 nt, Homo sapiens
gacaaccucauccaggcu

SEQ ID NO: 528852 - RNA, 12 nt, Homo sapiens
gacaacugugaa

SEQ ID NO: 528853 - RNA, 21 nt, Homo sapiens
gacaauauuccagaucuuuca

SEQ ID NO: 528854 - RNA, 16 nt, Homo sapiens
gacaauuucauuccau

SEQ ID NO: 528855 - RNA, 15 nt, Homo sapiens
gacacauacauguca

SEQ ID NO: 528856 - RNA, 17 nt, Homo sapiens
gacacauacaugucaca

SEQ ID NO: 528857 - RNA, 22 nt, Homo sapiens
gacacauacaugucacauuuag

SEQ ID NO: 528858 - RNA, 11 nt, Homo sapiens
gacacauauca

SEQ ID NO: 528859 - RNA, 20 nt, Homo sapiens
gacacauucaggaguuaaau

SEQ ID NO: 528860 - RNA, 12 nt, Homo sapiens
gacacugucucu

SEQ ID NO: 528861 - RNA, 17 nt, Homo sapiens
gacagggucggccugua

SEQ ID NO: 528862 - RNA, 10 nt, Homo sapiens
gacagucauc

SEQ ID NO: 528863 - RNA, 23 nt, Homo sapiens
gacaguugauucaacaaaguauu

SEQ ID NO: 528864 - RNA, 19 nt, Homo sapiens
gacaucggccuccaugacc

SEQ ID NO: 528865 - RNA, 21 nt, Homo sapiens
gacauggaggugccggaugca

SEQ ID NO: 528866 - RNA, 23 nt, Homo sapiens
gacauguagguaggaagcacuga

SEQ ID NO: 528867 - RNA, 15 nt, Homo sapiens
gaccacuuccagggg

SEQ ID NO: 528868 - RNA, 16 nt, Homo sapiens
gaccaguaggacucaa

SEQ ID NO: 528869 - RNA, 15 nt, Homo sapiens
gacccccaucugagc

SEQ ID NO: 528870 - RNA, 19 nt, Homo sapiens
gacccccgcaaguuugcac

SEQ ID NO: 528871 - RNA, 14 nt, Homo sapiens
gacccucccaggga

SEQ ID NO: 528872 - RNA, 14 nt, Homo sapiens
gaccuuaaaugcaa

SEQ ID NO: 528873 - RNA, 13 nt, Homo sapiens
gaccuuuccucuc

SEQ ID NO: 528874 - RNA, 21 nt, Homo sapiens
gacggcccucaucuaugagga

SEQ ID NO: 528875 - RNA, 23 nt, Homo sapiens
gacgguaccaauucagugucugu

SEQ ID NO: 528876 - RNA, 17 nt, Homo sapiens
gacgugaggcccauucu

SEQ ID NO: 528877 - RNA, 13 nt, Homo sapiens
gacucagugcaga

SEQ ID NO: 528878 - RNA, 18 nt, Homo sapiens
gacugacaaccucaucca

SEQ ID NO: 528879 - RNA, 19 nt, Homo sapiens
gacugcauugccgcuguau

SEQ ID NO: 528880 - RNA, 17 nt, Homo sapiens
gacugugguagccagca

SEQ ID NO: 528881 - RNA, 23 nt, Homo sapiens
gacuuacuaugggauggggucca

SEQ ID NO: 528882 - RNA, 20 nt, Homo sapiens
gacuuccuuuaggaucucag

SEQ ID NO: 528883 - RNA, 20 nt, Homo sapiens
gacuucucaaagagaauugu

SEQ ID NO: 528884 - RNA, 17 nt, Homo sapiens
gacuuguccagugcucc

SEQ ID NO: 528885 - RNA, 16 nt, Homo sapiens
gagaacacugugcucu

SEQ ID NO: 528886 - RNA, 14 nt, Homo sapiens
gagaauauaccuua

SEQ ID NO: 528887 - RNA, 19 nt, Homo sapiens
gagacaauguuuucuucaa

SEQ ID NO: 528888 - RNA, 17 nt, Homo sapiens
acaggguccucagcuca

SEQ ID NO: 528889 - RNA, 14 nt, Homo sapiens
acaguacagcaugu

SEQ ID NO: 528890 - RNA, 14 nt, Homo sapiens
acaguauccacaau

SEQ ID NO: 528891 - RNA, 19 nt, Homo sapiens
acaguccaaacuguucuga

SEQ ID NO: 528892 - RNA, 22 nt, Homo sapiens
acaguccaaacuguucugagaa

SEQ ID NO: 528893 - RNA, 21 nt, Homo sapiens
acaguuuccaaauugcccuau

SEQ ID NO: 528894 - RNA, 16 nt, Homo sapiens
acauaccuaccaguau

SEQ ID NO: 528895 - RNA, 22 nt, Homo sapiens
acauauuaggaaaauauggguu

SEQ ID NO: 528896 - RNA, 12 nt, Homo sapiens
acauauuuuaga

SEQ ID NO: 528897 - RNA, 16 nt, Homo sapiens
acaucaaaacuaacca

SEQ ID NO: 528898 - RNA, 20 nt, Homo sapiens
acaucaaaacuaaccaucug

SEQ ID NO: 528899 - RNA, 22 nt, Homo sapiens
acaucaaaacuaaccaucugaa

SEQ ID NO: 528900 - RNA, 15 nt, Homo sapiens
acaucccaaaugcca

SEQ ID NO: 528901 - RNA, 18 nt, Homo sapiens
acaucugagagaugacag

SEQ ID NO: 528902 - RNA, 20 nt, Homo sapiens
acaucugcaauaugaauuca

SEQ ID NO: 528903 - RNA, 22 nt, Homo sapiens
acaugaagcuguugugugaggu

SEQ ID NO: 528904 - RNA, 15 nt, Homo sapiens
acaugcugccuggca

SEQ ID NO: 528905 - RNA, 18 nt, Homo sapiens
acaugcugccuggcacag

SEQ ID NO: 528906 - RNA, 22 nt, Homo sapiens
acaugggugaacuuacuugcau

SEQ ID NO: 528907 - RNA, 22 nt, Homo sapiens
acauguagguaggaagcacuga

SEQ ID NO: 528908 - RNA, 14 nt, Homo sapiens
acaugucuugacug

SEQ ID NO: 528909 - RNA, 13 nt, Homo sapiens
acauguguauauu

SEQ ID NO: 528910 - RNA, 15 nt, Homo sapiens
acauguuaucaaauc

SEQ ID NO: 528911 - RNA, 14 nt, Homo sapiens
acauguugccuugc

SEQ ID NO: 528912 - RNA, 14 nt, Homo sapiens
acauucagggcuau

SEQ ID NO: 528913 - RNA, 22 nt, Homo sapiens
acauucccucuaauuugaacug

SEQ ID NO: 528914 - RNA, 17 nt, Homo sapiens
acauugauaaaagcauu

SEQ ID NO: 528915 - RNA, 15 nt, Homo sapiens
acauuugcuacuguu

SEQ ID NO: 528916 - RNA, 12 nt, Homo sapiens
acauuugcugaa

SEQ ID NO: 528917 - RNA, 17 nt, Homo sapiens
acauuuggacauuucca

SEQ ID NO: 528918 - RNA, 17 nt, Homo sapiens
acauuuuuuugcaugca

SEQ ID NO: 528919 - RNA, 15 nt, Homo sapiens
accaaaauccgacug

SEQ ID NO: 528920 - RNA, 23 nt, Homo sapiens
accaacuacuaccuguaaugaca

SEQ ID NO: 528921 - RNA, 12 nt, Homo sapiens
accaauguucua

SEQ ID NO: 528922 - RNA, 21 nt, Homo sapiens
accaauguucuaaaguuuugc

SEQ ID NO: 528923 - RNA, 14 nt, Homo sapiens
accacaccaucagg

SEQ ID NO: 528924 - RNA, 15 nt, Homo sapiens
accacacggaucuga

SEQ ID NO: 528925 - RNA, 17 nt, Homo sapiens
accaccuucaccuggau

SEQ ID NO: 528926 - RNA, 17 nt, Homo sapiens
accacgauucucccaaa

SEQ ID NO: 528927 - RNA, 12 nt, Homo sapiens
accacuuccagg

SEQ ID NO: 528928 - RNA, 15 nt, Homo sapiens
accaguauaagcauc

SEQ ID NO: 528929 - RNA, 23 nt, Homo sapiens
accaucuccccaggcuaugccau

SEQ ID NO: 528930 - RNA, 20 nt, Homo sapiens
accaucugaagaaacuuccc

SEQ ID NO: 528931 - RNA, 15 nt, Homo sapiens
accaugagaugguuu

SEQ ID NO: 528932 - RNA, 21 nt, Homo sapiens
accauguauaugagcuuauaa

SEQ ID NO: 528933 - RNA, 19 nt, Homo sapiens
accauucagaucacugaau

SEQ ID NO: 528934 - RNA, 21 nt, Homo sapiens
accauuuuuuaauuuacuugu

SEQ ID NO: 528935 - RNA, 14 nt, Homo sapiens
acccagagcuguau

SEQ ID NO: 528936 - RNA, 20 nt, Homo sapiens
acccaggcuggagugcagug

SEQ ID NO: 528937 - RNA, 22 nt, Homo sapiens
acccagucccacacuguggcca

SEQ ID NO: 528938 - RNA, 12 nt, Homo sapiens
acccagugcaga

SEQ ID NO: 528939 - RNA, 19 nt, Homo sapiens
acccaucuaguacuugaaa

SEQ ID NO: 528940 - RNA, 13 nt, Homo sapiens
acccauuagccau

SEQ ID NO: 528941 - RNA, 15 nt, Homo sapiens
acccccagcuuugag

SEQ ID NO: 528942 - RNA, 17 nt, Homo sapiens
acccccaucucuacuaa

SEQ ID NO: 528943 - RNA, 18 nt, Homo sapiens
acccccgcaaguuugcac

SEQ ID NO: 528944 - RNA, 14 nt, Homo sapiens
accccugacucauc

SEQ ID NO: 528945 - RNA, 22 nt, Homo sapiens
accccuuucugucccacuacau

SEQ ID NO: 528946 - RNA, 15 nt, Homo sapiens
acccgagaagcacuu

SEQ ID NO: 528947 - RNA, 14 nt, Homo sapiens
acccucuugaauau

SEQ ID NO: 528948 - RNA, 14 nt, Homo sapiens
acccugggggcaca

SEQ ID NO: 528949 - RNA, 12 nt, Homo sapiens
accgaacacuac

SEQ ID NO: 528950 - RNA, 22 nt, Homo sapiens
accgagcgugugccacuggacc

SEQ ID NO: 528951 - RNA, 18 nt, Homo sapiens
accguguaccucaguucc

SEQ ID NO: 528952 - RNA, 22 nt, Homo sapiens
accuaaaaauguaggcuuucau

SEQ ID NO: 528953 - RNA, 23 nt, Homo sapiens
accuaguacugccccccaugagg

SEQ ID NO: 528954 - RNA, 19 nt, Homo sapiens
accuauugcacuccauccu

SEQ ID NO: 528955 - RNA, 12 nt, Homo sapiens
accuccacaccc

SEQ ID NO: 528956 - RNA, 18 nt, Homo sapiens
accucccuccccgucuca

SEQ ID NO: 528957 - RNA, 13 nt, Homo sapiens
accuccucauggc

SEQ ID NO: 528958 - RNA, 10 nt, Homo sapiens
accucugcau

SEQ ID NO: 528959 - RNA, 13 nt, Homo sapiens
accugcaugugcu

SEQ ID NO: 528960 - RNA, 18 nt, Homo sapiens
accugcaugugcugucac

SEQ ID NO: 528961 - RNA, 13 nt, Homo sapiens
accugcauugaac

SEQ ID NO: 528962 - RNA, 21 nt, Homo sapiens
accugcccaaggaugcuguca

SEQ ID NO: 528963 - RNA, 22 nt, Homo sapiens
accugcccaaggaugcugucaa

SEQ ID NO: 528964 - RNA, 14 nt, Homo sapiens
accuggucucuaca

SEQ ID NO: 528965 - RNA, 16 nt, Homo sapiens
accuguaaagugccuu

SEQ ID NO: 528966 - RNA, 18 nt, Homo sapiens
accuguaaagugccuuac

SEQ ID NO: 528967 - RNA, 13 nt, Homo sapiens
accuguaguccca

SEQ ID NO: 528968 - RNA, 15 nt, Homo sapiens
accugugcaauauga

SEQ ID NO: 528969 - RNA, 17 nt, Homo sapiens
accuuaagagacacucc

SEQ ID NO: 528970 - RNA, 21 nt, Homo sapiens
accuuaagauuuugcaccugu

SEQ ID NO: 528971 - RNA, 22 nt, Homo sapiens
accuuccggggccgcaucccuu

SEQ ID NO: 528972 - RNA, 21 nt, Homo sapiens
accuuugguuuuaaaagagaa

SEQ ID NO: 528973 - RNA, 17 nt, Homo sapiens
acgaggccacagcugcc

SEQ ID NO: 528974 - RNA, 23 nt, Homo sapiens
acgaguugcagccagggccagug

SEQ ID NO: 528975 - RNA, 15 nt, Homo sapiens
acgcagcacaagcuc

SEQ ID NO: 528976 - RNA, 23 nt, Homo sapiens
acgcagucauggaggccaagaac

SEQ ID NO: 528977 - RNA, 19 nt, Homo sapiens
acgccgcucuucacugugg

SEQ ID NO: 528978 - RNA, 21 nt, Homo sapiens
acgcuggggaauauacgugcu

SEQ ID NO: 528979 - RNA, 20 nt, Homo sapiens
acggacuccagucugugugu

SEQ ID NO: 528980 - RNA, 14 nt, Homo sapiens
acggaggccugcga

SEQ ID NO: 528981 - RNA, 16 nt, Homo sapiens
acggaugguugaauga

SEQ ID NO: 528982 - RNA, 20 nt, Homo sapiens
acggccuguacggacacugu

SEQ ID NO: 528983 - RNA, 17 nt, Homo sapiens
acgucuggacugcuauu

SEQ ID NO: 528984 - RNA, 22 nt, Homo sapiens
acgucuggacugcuauucuaga

SEQ ID NO: 528985 - RNA, 18 nt, Homo sapiens
acgugucugcacaggguc

SEQ ID NO: 528986 - RNA, 22 nt, Homo sapiens
acguuuauaaacagaaauggaa

SEQ ID NO: 528987 - RNA, 16 nt, Homo sapiens
acuaauuuucucccaa

SEQ ID NO: 528988 - RNA, 13 nt, Homo sapiens
acuacaccagggu

SEQ ID NO: 528989 - RNA, 18 nt, Homo sapiens
acuagaggcuugcauaau

SEQ ID NO: 528990 - RNA, 13 nt, Homo sapiens
acuauguuuccau

SEQ ID NO: 528991 - RNA, 17 nt, Homo sapiens
acucagagaaacaaugg

SEQ ID NO: 528992 - RNA, 18 nt, Homo sapiens
acucagaggcagugacag

SEQ ID NO: 528993 - RNA, 13 nt, Homo sapiens
acucagcacauuc

SEQ ID NO: 528994 - RNA, 19 nt, Homo sapiens
acucagccggcagccagau

SEQ ID NO: 528995 - RNA, 16 nt, Homo sapiens
acucaggccacagugg

SEQ ID NO: 528996 - RNA, 22 nt, Homo sapiens
acuccuugcaggugacauuugc

SEQ ID NO: 528997 - RNA, 18 nt, Homo sapiens
acucuggugcuccugcau

SEQ ID NO: 528998 - RNA, 12 nt, Homo sapiens
acucuugcaggg

SEQ ID NO: 528999 - RNA, 18 nt, Homo sapiens
acucuuguggucaucaug

SEQ ID NO: 529000 - RNA, 15 nt, Homo sapiens
acugaaaccaggugg

SEQ ID NO: 529001 - RNA, 16 nt, Homo sapiens
acugaaucuaccugcc

SEQ ID NO: 529002 - RNA, 21 nt, Homo sapiens
acugacaacauuauaacugua

SEQ ID NO: 529003 - RNA, 17 nt, Homo sapiens
acugacaaccucaucca

SEQ ID NO: 529004 - RNA, 19 nt, Homo sapiens
acugaucuuauguguuaca

SEQ ID NO: 529005 - RNA, 17 nt, Homo sapiens
acugauggaaaauacca

SEQ ID NO: 529006 - RNA, 20 nt, Homo sapiens
acugauggaaaauaccagug

SEQ ID NO: 529007 - RNA, 19 nt, Homo sapiens
acugcaaagcucggugcuc

SEQ ID NO: 529008 - RNA, 14 nt, Homo sapiens
acugcaaaguguau

SEQ ID NO: 529009 - RNA, 16 nt, Homo sapiens
acugcaaaguguaugc

SEQ ID NO: 529010 - RNA, 16 nt, Homo sapiens
acugcaaccucugccu

SEQ ID NO: 529011 - RNA, 23 nt, Homo sapiens
acugcaaccucugccucccaggu

SEQ ID NO: 529012 - RNA, 15 nt, Homo sapiens
acugcaggaccucca

SEQ ID NO: 529013 - RNA, 19 nt, Homo sapiens
acugcauuccacagguggg

SEQ ID NO: 529014 - RNA, 20 nt, Homo sapiens
acugcccuuucaaagcacuu

SEQ ID NO: 529015 - RNA, 16 nt, Homo sapiens
acugccuccugugacg

SEQ ID NO: 529016 - RNA, 19 nt, Homo sapiens
acugcguggugcucuuugc

SEQ ID NO: 529017 - RNA, 21 nt, Homo sapiens
acugcuauucuagagcuuuua

SEQ ID NO: 529018 - RNA, 18 nt, Homo sapiens
acugcucuguguuuacag

SEQ ID NO: 529019 - RNA, 19 nt, Homo sapiens
acugcugcuagagccagca

SEQ ID NO: 529020 - RNA, 15 nt, Homo sapiens
acuggaguuccuuau

SEQ ID NO: 529021 - RNA, 13 nt, Homo sapiens
acuggauguacca

SEQ ID NO: 529022 - RNA, 19 nt, Homo sapiens
acuggccccuacuuugugg

SEQ ID NO: 529023 - RNA, 21 nt, Homo sapiens
acuggcuuaccuccucauggc

SEQ ID NO: 529024 - RNA, 20 nt, Homo sapiens
acuggggagucuuuguggau

SEQ ID NO: 529025 - RNA, 22 nt, Homo sapiens
acugguauuguuuacguuugau

SEQ ID NO: 529026 - RNA, 21 nt, Homo sapiens
acugucuuucagauacauggu

SEQ ID NO: 529027 - RNA, 14 nt, Homo sapiens
acuguggagcucag

SEQ ID NO: 529028 - RNA, 21 nt, Homo sapiens
acuguggcuagugacaaauaa

SEQ ID NO: 529029 - RNA, 22 nt, Homo sapiens
acuguugguauuauauaauuca

SEQ ID NO: 529030 - RNA, 19 nt, Homo sapiens
acuuacucuuuaaccagga

SEQ ID NO: 529031 - RNA, 15 nt, Homo sapiens
acuuagcagaaccac

SEQ ID NO: 529032 - RNA, 13 nt, Homo sapiens
acuuauugccaaa

SEQ ID NO: 529033 - RNA, 14 nt, Homo sapiens
acuucaauuuacuu

SEQ ID NO: 529034 - RNA, 20 nt, Homo sapiens
acuucacuaaugaucacauu

SEQ ID NO: 529035 - RNA, 18 nt, Homo sapiens
acuuccuuuaggaucuca

SEQ ID NO: 529036 - RNA, 15 nt, Homo sapiens
acuucuggaagucau

SEQ ID NO: 529037 - RNA, 19 nt, Homo sapiens
acuucuggaagucaucuca

SEQ ID NO: 529038 - RNA, 17 nt, Homo sapiens
acuucuggggacagaca

SEQ ID NO: 529039 - RNA, 11 nt, Homo sapiens
acuugccauaa

SEQ ID NO: 529040 - RNA, 16 nt, Homo sapiens
acuugcccaaguccca

SEQ ID NO: 529041 - RNA, 16 nt, Homo sapiens
acuuguggggcuaagg

SEQ ID NO: 529042 - RNA, 21 nt, Homo sapiens
acuuguuagaucaaccuccaa

SEQ ID NO: 529043 - RNA, 17 nt, Homo sapiens
acuuuacugccugaaua

SEQ ID NO: 529044 - RNA, 22 nt, Homo sapiens
acuuuauguaguuuuuauaugu

SEQ ID NO: 529045 - RNA, 22 nt, Homo sapiens
acuuuauuucugaucuauacaa

SEQ ID NO: 529046 - RNA, 16 nt, Homo sapiens
acuuucaauugucacu

SEQ ID NO: 529047 - RNA, 23 nt, Homo sapiens
acuuucaggggcugacucuccag

SEQ ID NO: 529048 - RNA, 17 nt, Homo sapiens
acuuucuacaggccagc

SEQ ID NO: 529049 - RNA, 16 nt, Homo sapiens
acuuugaagugcagcu

SEQ ID NO: 529050 - RNA, 18 nt, Homo sapiens
acuuuuaaaaacauaaca

SEQ ID NO: 529051 - RNA, 18 nt, Homo sapiens
agaaaccacagucuuccc

SEQ ID NO: 529052 - RNA, 14 nt, Homo sapiens
agaaaccugacuca

SEQ ID NO: 529053 - RNA, 14 nt, Homo sapiens
agaaacuucccaag

SEQ ID NO: 529054 - RNA, 19 nt, Homo sapiens
agaaagagacuccgucuca

SEQ ID NO: 529055 - RNA, 16 nt, Homo sapiens
agaaauacaguacugu

SEQ ID NO: 529056 - RNA, 11 nt, Homo sapiens
agaaauuacua

SEQ ID NO: 529057 - RNA, 21 nt, Homo sapiens
agaacagggucauguuugcag

SEQ ID NO: 529058 - RNA, 20 nt, Homo sapiens
agaaccacacuugaaaccuu

SEQ ID NO: 529059 - RNA, 23 nt, Homo sapiens
agaaccacauauuuuagacacuu

SEQ ID NO: 529060 - RNA, 19 nt, Homo sapiens
agaaccucagauucuucau

SEQ ID NO: 529061 - RNA, 20 nt, Homo sapiens
agaacguggugaccuuucac

SEQ ID NO: 529062 - RNA, 22 nt, Homo sapiens
agaagauccaagaggcccugca

SEQ ID NO: 529063 - RNA, 16 nt, Homo sapiens
agaagcaagugguggg

SEQ ID NO: 529064 - RNA, 13 nt, Homo sapiens
agaagcacuacac

SEQ ID NO: 529065 - RNA, 22 nt, Homo sapiens
agaagcccugauguguccucag

SEQ ID NO: 529066 - RNA, 22 nt, Homo sapiens
agaagcuccauggacgugucug

SEQ ID NO: 529067 - RNA, 16 nt, Homo sapiens
agaaggugaacuguua

SEQ ID NO: 529068 - RNA, 14 nt, Homo sapiens
agaagucuccucaa

SEQ ID NO: 529069 - RNA, 23 nt, Homo sapiens
agaagugauuagaggcagaucug

SEQ ID NO: 529070 - RNA, 23 nt, Homo sapiens
agaagugcagaauuggggcacuu

SEQ ID NO: 529071 - RNA, 21 nt, Homo sapiens
agaaguuuggcugcugucaua

SEQ ID NO: 529072 - RNA, 17 nt, Homo sapiens
agaauaaggcaggcauu

SEQ ID NO: 529073 - RNA, 12 nt, Homo sapiens
agaauauuuacu

SEQ ID NO: 529074 - RNA, 19 nt, Homo sapiens
agaaucccuggcaaaggga

SEQ ID NO: 529075 - RNA, 12 nt, Homo sapiens
agaaucuagagc

SEQ ID NO: 529076 - RNA, 21 nt, Homo sapiens
agaaucuagagcaaagccauc

SEQ ID NO: 529077 - RNA, 15 nt, Homo sapiens
agaaugaacacuccc

SEQ ID NO: 529078 - RNA, 21 nt, Homo sapiens
agaauguuacugacuccucag

SEQ ID NO: 529079 - RNA, 18 nt, Homo sapiens
agaauuaagauacaaauu

SEQ ID NO: 529080 - RNA, 16 nt, Homo sapiens
agaauuagauuucuau

SEQ ID NO: 529081 - RNA, 17 nt, Homo sapiens
agacaagagaucuacac

SEQ ID NO: 529082 - RNA, 22 nt, Homo sapiens
agacaagagaucuacacauguu

SEQ ID NO: 529083 - RNA, 22 nt, Homo sapiens
agacacugucucuaccaaaaaa

SEQ ID NO: 529084 - RNA, 14 nt, Homo sapiens
agacagugacuggu

SEQ ID NO: 529085 - RNA, 15 nt, Homo sapiens
agacagugacuggug

SEQ ID NO: 529086 - RNA, 23 nt, Homo sapiens
agacaugggugaacuuacuugca

SEQ ID NO: 529087 - RNA, 13 nt, Homo sapiens
agacauuggcuua

SEQ ID NO: 529088 - RNA, 19 nt, Homo sapiens
agacauuugcugaacucag

SEQ ID NO: 529089 - RNA, 14 nt, Homo sapiens
agaccaaggcacug

SEQ ID NO: 529090 - RNA, 13 nt, Homo sapiens
agaccuggugcug

SEQ ID NO: 529091 - RNA, 18 nt, Homo sapiens
agacgcagagcaaaugag

SEQ ID NO: 529092 - RNA, 12 nt, Homo sapiens
agacgccuguua

SEQ ID NO: 529093 - RNA, 22 nt, Homo sapiens
agacgggaggggaggcauugac

SEQ ID NO: 529094 - RNA, 20 nt, Homo sapiens
agacgguaccaauucagugu

SEQ ID NO: 529095 - RNA, 17 nt, Homo sapiens
agacugaaucuaccugc

SEQ ID NO: 529096 - RNA, 14 nt, Homo sapiens
agacugcuacaggu

SEQ ID NO: 529097 - RNA, 15 nt, Homo sapiens
agacuuaacacuucu

SEQ ID NO: 529098 - RNA, 15 nt, Homo sapiens
agagaauuggcucaa

SEQ ID NO: 529099 - RNA, 13 nt, Homo sapiens
agagacacuccaa

SEQ ID NO: 529100 - RNA, 14 nt, Homo sapiens
agagacuccgucuc

SEQ ID NO: 529101 - RNA, 16 nt, Homo sapiens
agagaggccugugcua

SEQ ID NO: 529102 - RNA, 20 nt, Homo sapiens
agagaucagcgacccugagg

SEQ ID NO: 529103 - RNA, 23 nt, Homo sapiens
agagcuaagggugggugcucaga

SEQ ID NO: 529104 - RNA, 13 nt, Homo sapiens
agagcuuggacua

SEQ ID NO: 529105 - RNA, 13 nt, Homo sapiens
agaggaacagcac

SEQ ID NO: 529106 - RNA, 16 nt, Homo sapiens
agaggaacagcacugg

SEQ ID NO: 529107 - RNA, 14 nt, Homo sapiens
agaggagugugaag

SEQ ID NO: 529108 - RNA, 22 nt, Homo sapiens
agaggauaaggaggcacugcug

SEQ ID NO: 529109 - RNA, 22 nt, Homo sapiens
agaggccgcgcguccagcugcc

SEQ ID NO: 529110 - RNA, 20 nt, Homo sapiens
agaggcucuaauguacaaua

SEQ ID NO: 529111 - RNA, 18 nt, Homo sapiens
agaggcugccccucucac

SEQ ID NO: 529112 - RNA, 17 nt, Homo sapiens
agagggauaaaaacaau

SEQ ID NO: 529113 - RNA, 12 nt, Homo sapiens
agaggggagcag

SEQ ID NO: 529114 - RNA, 12 nt, Homo sapiens
agagucugagaa

SEQ ID NO: 529115 - RNA, 18 nt, Homo sapiens
agaguggccccggcugca

SEQ ID NO: 529116 - RNA, 19 nt, Homo sapiens
agauacaguggagacaucu

SEQ ID NO: 529117 - RNA, 20 nt, Homo sapiens
agaucgagaccauccuggcu

SEQ ID NO: 529118 - RNA, 15 nt, Homo sapiens
agaugacagggaaaa

SEQ ID NO: 529119 - RNA, 17 nt, Homo sapiens
agaugacgaguaacucc

SEQ ID NO: 529120 - RNA, 15 nt, Homo sapiens
agaugaugcuuugag

SEQ ID NO: 529121 - RNA, 15 nt, Homo sapiens
agaugcgcacugcau

SEQ ID NO: 529122 - RNA, 21 nt, Homo sapiens
agaugcuagaaaaauguucuu

SEQ ID NO: 529123 - RNA, 17 nt, Homo sapiens
agaugcuggacuugccu

SEQ ID NO: 529124 - RNA, 14 nt, Homo sapiens
agauggggcacuga

SEQ ID NO: 529125 - RNA, 21 nt, Homo sapiens
agaugguacggacuuccuuua

SEQ ID NO: 529126 - RNA, 17 nt, Homo sapiens
agaugguguguucugca

SEQ ID NO: 529127 - RNA, 15 nt, Homo sapiens
agaugguuucuagag

SEQ ID NO: 529128 - RNA, 22 nt, Homo sapiens
agauguauuuguuguagacuua

SEQ ID NO: 529129 - RNA, 18 nt, Homo sapiens
agauguguuuuugggaag

SEQ ID NO: 529130 - RNA, 19 nt, Homo sapiens
agauguuuuggggacucau

SEQ ID NO: 529131 - RNA, 16 nt, Homo sapiens
agauuagaaacuacca

SEQ ID NO: 529132 - RNA, 23 nt, Homo sapiens
agauuauuaucuauuaucucaau

SEQ ID NO: 529133 - RNA, 18 nt, Homo sapiens
agauugaaccugaauauu

SEQ ID NO: 529134 - RNA, 15 nt, Homo sapiens
agcaaauaagucauc

SEQ ID NO: 529135 - RNA, 20 nt, Homo sapiens
agcaaauaagucaucugaug

SEQ ID NO: 529136 - RNA, 21 nt, Homo sapiens
agcaaauguuaaaaguuuuau

SEQ ID NO: 529137 - RNA, 13 nt, Homo sapiens
agcaacucagaga

SEQ ID NO: 529138 - RNA, 20 nt, Homo sapiens
agcaagacauacuuaaugca

SEQ ID NO: 529139 - RNA, 15 nt, Homo sapiens
agcaaguguucacaa

SEQ ID NO: 529140 - RNA, 14 nt, Homo sapiens
agcaaguuaagugu

SEQ ID NO: 529141 - RNA, 14 nt, Homo sapiens
agcaauaacauaca

SEQ ID NO: 529142 - RNA, 21 nt, Homo sapiens
agcaauaacauacaugagaua

SEQ ID NO: 529143 - RNA, 13 nt, Homo sapiens
agcaaugugguag

SEQ ID NO: 529144 - RNA, 18 nt, Homo sapiens
agcacagugccugacaca

SEQ ID NO: 529145 - RNA, 19 nt, Homo sapiens
agcacugggaaccuagcua

SEQ ID NO: 529146 - RNA, 13 nt, Homo sapiens
agcacuuugcaac

SEQ ID NO: 529147 - RNA, 15 nt, Homo sapiens
agcagaacugaaccg

SEQ ID NO: 529148 - RNA, 18 nt, Homo sapiens
agcagagcagcucugcua

SEQ ID NO: 529149 - RNA, 20 nt, Homo sapiens
agcagaggaccagggccuuu

SEQ ID NO: 529150 - RNA, 18 nt, Homo sapiens
agcagccaguucaaaaac

SEQ ID NO: 529151 - RNA, 11 nt, Homo sapiens
agcaggcaugg

SEQ ID NO: 529152 - RNA, 14 nt, Homo sapiens
agcaggcuagacag

SEQ ID NO: 529153 - RNA, 22 nt, Homo sapiens
agcagucacugacaguuaauaa

SEQ ID NO: 529154 - RNA, 13 nt, Homo sapiens
agcauaacuguag

SEQ ID NO: 529155 - RNA, 14 nt, Homo sapiens
agcaugacgugugg

SEQ ID NO: 529156 - RNA, 15 nt, Homo sapiens
agcaugcagcuuugc

SEQ ID NO: 529157 - RNA, 15 nt, Homo sapiens
agcauguguauuucc

SEQ ID NO: 529158 - RNA, 17 nt, Homo sapiens
agccaagagugcacuac

SEQ ID NO: 529159 - RNA, 21 nt, Homo sapiens
agccaauagaauggggugauu

SEQ ID NO: 529160 - RNA, 15 nt, Homo sapiens
agccaauguguggcu

SEQ ID NO: 529161 - RNA, 18 nt, Homo sapiens
agccaggccccaagccca

SEQ ID NO: 529162 - RNA, 15 nt, Homo sapiens
agccagggccagugg

SEQ ID NO: 529163 - RNA, 16 nt, Homo sapiens
agccaguaaucuuuau

SEQ ID NO: 529164 - RNA, 21 nt, Homo sapiens
agccaguuguugccaaccuua

SEQ ID NO: 529165 - RNA, 15 nt, Homo sapiens
agccaucuaaugcuu

SEQ ID NO: 529166 - RNA, 21 nt, Homo sapiens
agccaucuaaugcuuguuuau

SEQ ID NO: 529167 - RNA, 22 nt, Homo sapiens
agccauuucacucucaaacuuc

SEQ ID NO: 529168 - RNA, 24 nt, Homo sapiens
agcccauggcccccaauaaaggca

SEQ ID NO: 529169 - RNA, 16 nt, Homo sapiens
agccccaggggacaag

SEQ ID NO: 529170 - RNA, 16 nt, Homo sapiens
agcccucccacuuugc

SEQ ID NO: 529171 - RNA, 18 nt, Homo sapiens
agcccugauguguccuca

SEQ ID NO: 529172 - RNA, 14 nt, Homo sapiens
agcccugcagugug

SEQ ID NO: 529173 - RNA, 18 nt, Homo sapiens
agccgccugaaagccaca

SEQ ID NO: 529174 - RNA, 18 nt, Homo sapiens
agccgugaauucaguugg

SEQ ID NO: 529175 - RNA, 14 nt, Homo sapiens
agccucacuuccuu

SEQ ID NO: 529176 - RNA, 17 nt, Homo sapiens
agccugauauugauaug

SEQ ID NO: 529177 - RNA, 12 nt, Homo sapiens
agccugcucccu

SEQ ID NO: 529178 - RNA, 17 nt, Homo sapiens
agccugcucccuagcca

SEQ ID NO: 529179 - RNA, 20 nt, Homo sapiens
agccugcucccuagccagag

SEQ ID NO: 529180 - RNA, 19 nt, Homo sapiens
agccuggucaacauaguga

SEQ ID NO: 529181 - RNA, 22 nt, Homo sapiens
agccuguggcuggcuggaaaaa

SEQ ID NO: 529182 - RNA, 22 nt, Homo sapiens
agcggcccuaagggagugucua

SEQ ID NO: 529183 - RNA, 19 nt, Homo sapiens
agcgggcuugacugcauug

SEQ ID NO: 529184 - RNA, 15 nt, Homo sapiens
agcgucaagacauuu

SEQ ID NO: 529185 - RNA, 21 nt, Homo sapiens
agcgugggccagaggcagcuc

SEQ ID NO: 529186 - RNA, 16 nt, Homo sapiens
agcuacaggacauuuu

SEQ ID NO: 529187 - RNA, 16 nt, Homo sapiens
agcuacuaaugauguu

SEQ ID NO: 529188 - RNA, 23 nt, Homo sapiens
agcuaugugacucggauggucuu

SEQ ID NO: 529189 - RNA, 23 nt, Homo sapiens
agcuauuugggcacaacacauca

SEQ ID NO: 529190 - RNA, 13 nt, Homo sapiens
agcucaggugccu

SEQ ID NO: 529191 - RNA, 16 nt, Homo sapiens
agcucaguguguucug

SEQ ID NO: 529192 - RNA, 17 nt, Homo sapiens
agcuccccucacucugu

SEQ ID NO: 529193 - RNA, 21 nt, Homo sapiens
agcucugcuccccuaaagccu

SEQ ID NO: 529194 - RNA, 16 nt, Homo sapiens
agcugaagaauugaaa

SEQ ID NO: 529195 - RNA, 20 nt, Homo sapiens
agcugaauuugauucuccag

SEQ ID NO: 529196 - RNA, 21 nt, Homo sapiens
agcugaccuggagaugcugcc

SEQ ID NO: 529197 - RNA, 16 nt, Homo sapiens
agcugccccaauguga

SEQ ID NO: 529198 - RNA, 14 nt, Homo sapiens
agcuggcacugugg

SEQ ID NO: 529199 - RNA, 13 nt, Homo sapiens
agcuggccugaga

SEQ ID NO: 529200 - RNA, 19 nt, Homo sapiens
agcuguuuggccaaugugc

SEQ ID NO: 529201 - RNA, 23 nt, Homo sapiens
agcuucaccuuuuugucuuggcu

SEQ ID NO: 529202 - RNA, 20 nt, Homo sapiens
agcuucauuuuacuaaaaag

SEQ ID NO: 529203 - RNA, 16 nt, Homo sapiens
agcuugagaccauuuc

SEQ ID NO: 529204 - RNA, 14 nt, Homo sapiens
agcuuggacagucu

SEQ ID NO: 529205 - RNA, 15 nt, Homo sapiens
agcuuggacuacaca

SEQ ID NO: 529206 - RNA, 14 nt, Homo sapiens
agcuuuccaaggaa

SEQ ID NO: 529207 - RNA, 18 nt, Homo sapiens
agcuuuccaaggaagcag

SEQ ID NO: 529208 - RNA, 20 nt, Homo sapiens
aggaaaacgugaacaaacuu

SEQ ID NO: 529209 - RNA, 16 nt, Homo sapiens
aggaaacgcuaccucu

SEQ ID NO: 529210 - RNA, 17 nt, Homo sapiens
aggaaacucacacuccc

SEQ ID NO: 529211 - RNA, 23 nt, Homo sapiens
aggaaagagagcaccacgugaug

SEQ ID NO: 529212 - RNA, 16 nt, Homo sapiens
aggaacagcaauggug

SEQ ID NO: 529213 - RNA, 15 nt, Homo sapiens
aggaacagcacuggg

SEQ ID NO: 529214 - RNA, 14 nt, Homo sapiens
aggaagcacugaaa

SEQ ID NO: 529215 - RNA, 16 nt, Homo sapiens
aggaaggaaaugacac

SEQ ID NO: 529216 - RNA, 15 nt, Homo sapiens
aggaaggaacagcaa

SEQ ID NO: 529217 - RNA, 18 nt, Homo sapiens
aggaauccccaacaugca

SEQ ID NO: 529218 - RNA, 19 nt, Homo sapiens
aggaccccauccuguucuc

SEQ ID NO: 529219 - RNA, 17 nt, Homo sapiens
aggagaagaagguuucu

SEQ ID NO: 529220 - RNA, 22 nt, Homo sapiens
aggagaccuacccuccacaggc

SEQ ID NO: 529221 - RNA, 19 nt, Homo sapiens
aggagccuuuugcucucug

SEQ ID NO: 529222 - RNA, 20 nt, Homo sapiens
aggaggacauuuggugggcu

SEQ ID NO: 529223 - RNA, 14 nt, Homo sapiens
aggaggagcaccuc

SEQ ID NO: 529224 - RNA, 15 nt, Homo sapiens
aggaggaucacuuga

SEQ ID NO: 529225 - RNA, 14 nt, Homo sapiens
aggaggaucacuuu

SEQ ID NO: 529226 - RNA, 22 nt, Homo sapiens
aggaguuacagggaaguggucu

SEQ ID NO: 529227 - RNA, 13 nt, Homo sapiens
aggauguacaguu

SEQ ID NO: 529228 - RNA, 18 nt, Homo sapiens
aggcaccucuuccuugau

SEQ ID NO: 529229 - RNA, 15 nt, Homo sapiens
auaaauaauucuucc

SEQ ID NO: 529230 - RNA, 14 nt, Homo sapiens
auaaauacauucga

SEQ ID NO: 529231 - RNA, 15 nt, Homo sapiens
auaacaaugacacua

SEQ ID NO: 529232 - RNA, 17 nt, Homo sapiens
auaaccauaugauacua

SEQ ID NO: 529233 - RNA, 21 nt, Homo sapiens
auaacgauuuuaugaaaugac

SEQ ID NO: 529234 - RNA, 21 nt, Homo sapiens
auaagaagaaguucaugucca

SEQ ID NO: 529235 - RNA, 13 nt, Homo sapiens
auaagacauuugu

SEQ ID NO: 529236 - RNA, 11 nt, Homo sapiens
auaagcaagag

SEQ ID NO: 529237 - RNA, 16 nt, Homo sapiens
auaauaagcuaaagag

SEQ ID NO: 529238 - RNA, 12 nt, Homo sapiens
auaauaauagca

SEQ ID NO: 529239 - RNA, 15 nt, Homo sapiens
auaauaauagcagug

SEQ ID NO: 529240 - RNA, 16 nt, Homo sapiens
cuuuucauccuagucu

SEQ ID NO: 529241 - RNA, 18 nt, Homo sapiens
cuuuugagaguauagcau

SEQ ID NO: 529242 - RNA, 21 nt, Homo sapiens
cuuuugagaguauagcaugaa

SEQ ID NO: 529243 - RNA, 13 nt, Homo sapiens
cuuuugcuugcaa

SEQ ID NO: 529244 - RNA, 17 nt, Homo sapiens
cuuuugugcaaagccaa

SEQ ID NO: 529245 - RNA, 22 nt, Homo sapiens
cuuuugugcaaagccaaaaccu

SEQ ID NO: 529246 - RNA, 16 nt, Homo sapiens
cuuuuuccuccuggaa

SEQ ID NO: 529247 - RNA, 22 nt, Homo sapiens
cuuuuucugcgcuucaguaaca

SEQ ID NO: 529248 - RNA, 16 nt, Homo sapiens
cuuuuuggccugugau

SEQ ID NO: 529249 - RNA, 14 nt, Homo sapiens
gaaaaaaauuacua

SEQ ID NO: 529250 - RNA, 14 nt, Homo sapiens
gaaaaaacauuuua

SEQ ID NO: 529251 - RNA, 12 nt, Homo sapiens
gaaaaauacuuu

SEQ ID NO: 529252 - RNA, 17 nt, Homo sapiens
gaaaacaaucaaauauu

SEQ ID NO: 529253 - RNA, 15 nt, Homo sapiens
gaaaacugugcaaug

SEQ ID NO: 529254 - RNA, 19 nt, Homo sapiens
gaaaagagaauauuuacaa

SEQ ID NO: 529255 - RNA, 14 nt, Homo sapiens
gaaaagauuacuga

SEQ ID NO: 529256 - RNA, 16 nt, Homo sapiens
gaaaagauuacugaaa

SEQ ID NO: 529257 - RNA, 16 nt, Homo sapiens
gaaaaucacaucucca

SEQ ID NO: 529258 - RNA, 16 nt, Homo sapiens
gaaaauucgaaccagg

SEQ ID NO: 529259 - RNA, 21 nt, Homo sapiens
gaaaauuguuuagugauauua

SEQ ID NO: 529260 - RNA, 15 nt, Homo sapiens
gaaacaauggcuaag

SEQ ID NO: 529261 - RNA, 16 nt, Homo sapiens
gaaacaugucuugacu

SEQ ID NO: 529262 - RNA, 18 nt, Homo sapiens
gaaaccacagucuuccca

SEQ ID NO: 529263 - RNA, 14 nt, Homo sapiens
gaaacggauccagc

SEQ ID NO: 529264 - RNA, 19 nt, Homo sapiens
gaaacuaguguacauuucu

SEQ ID NO: 529265 - RNA, 16 nt, Homo sapiens
gaaacucacacucccc

SEQ ID NO: 529266 - RNA, 21 nt, Homo sapiens
auuccggaaacuaguguacau

SEQ ID NO: 529267 - RNA, 19 nt, Homo sapiens
auucgcuacuaugauuuaa

SEQ ID NO: 529268 - RNA, 16 nt, Homo sapiens
auucuagagcuuuuau

SEQ ID NO: 529269 - RNA, 21 nt, Homo sapiens
auucucagggcuggagccugg

SEQ ID NO: 529270 - RNA, 14 nt, Homo sapiens
auucucaucacuca

SEQ ID NO: 529271 - RNA, 13 nt, Homo sapiens
auucugguaggga

SEQ ID NO: 529272 - RNA, 14 nt, Homo sapiens
auucuuaacagugg

SEQ ID NO: 529273 - RNA, 21 nt, Homo sapiens
auucuuauaacucaacauuug

SEQ ID NO: 529274 - RNA, 12 nt, Homo sapiens
auucuugcacug

SEQ ID NO: 529275 - RNA, 14 nt, Homo sapiens
auucuuuguuacag

SEQ ID NO: 529276 - RNA, 14 nt, Homo sapiens
auugaacucuacaa

SEQ ID NO: 529277 - RNA, 21 nt, Homo sapiens
auugacaaccgagaagguuua

SEQ ID NO: 529278 - RNA, 13 nt, Homo sapiens
auugacucugcau

SEQ ID NO: 529279 - RNA, 17 nt, Homo sapiens
auugacucugcauuuga

SEQ ID NO: 529280 - RNA, 23 nt, Homo sapiens
auugauaaucuucaggugaacac

SEQ ID NO: 529281 - RNA, 13 nt, Homo sapiens
auugcaugcaauu

SEQ ID NO: 529282 - RNA, 21 nt, Homo sapiens
auugccccuggcuuugccucu

SEQ ID NO: 529283 - RNA, 22 nt, Homo sapiens
auugccccuggcuuugccucuu

SEQ ID NO: 529284 - RNA, 13 nt, Homo sapiens
auugccucugaaa

SEQ ID NO: 529285 - RNA, 16 nt, Homo sapiens
auuggaaucugauaua

SEQ ID NO: 529286 - RNA, 11 nt, Homo sapiens
auuggcaaagu

SEQ ID NO: 529287 - RNA, 14 nt, Homo sapiens
auuggcacugugga

SEQ ID NO: 529288 - RNA, 15 nt, Homo sapiens
auugggcaggugaaa

SEQ ID NO: 529289 - RNA, 19 nt, Homo sapiens
auugucagcuacuaaugau

SEQ ID NO: 529290 - RNA, 17 nt, Homo sapiens
auugucgguuaccucug

SEQ ID NO: 529291 - RNA, 20 nt, Homo sapiens
auugucgguuaccucugcau

SEQ ID NO: 529292 - RNA, 13 nt, Homo sapiens
auugugaacauga

SEQ ID NO: 529293 - RNA, 16 nt, Homo sapiens
auugugaaguacauau

SEQ ID NO: 529294 - RNA, 23 nt, Homo sapiens
auuuaaaaugugugccauauucu

SEQ ID NO: 529295 - RNA, 15 nt, Homo sapiens
auuuacaaggaguua

SEQ ID NO: 529296 - RNA, 14 nt, Homo sapiens
auuuacucagucuu

SEQ ID NO: 529297 - RNA, 13 nt, Homo sapiens
auuucacucucaa

SEQ ID NO: 529298 - RNA, 15 nt, Homo sapiens
auuucagcagggaug

SEQ ID NO: 529299 - RNA, 21 nt, Homo sapiens
auuucagugggaaauaugcca

SEQ ID NO: 529300 - RNA, 14 nt, Homo sapiens
auuucauaccucag

SEQ ID NO: 529301 - RNA, 22 nt, Homo sapiens
auuucaugaaaaugacauuaaa

SEQ ID NO: 529302 - RNA, 20 nt, Homo sapiens
auuuccuguguguguugccc

SEQ ID NO: 529303 - RNA, 17 nt, Homo sapiens
auuuccuugacuucuuu

SEQ ID NO: 529304 - RNA, 16 nt, Homo sapiens
auuucuaauggcccau

SEQ ID NO: 529305 - RNA, 23 nt, Homo sapiens
auuucuacuucuggaagucaucu

SEQ ID NO: 529306 - RNA, 15 nt, Homo sapiens
auuucuaguccaaaa

SEQ ID NO: 529307 - RNA, 15 nt, Homo sapiens
auuucuauaaauaga

SEQ ID NO: 529308 - RNA, 19 nt, Homo sapiens
auuucucauugacuuuuau

SEQ ID NO: 529309 - RNA, 17 nt, Homo sapiens
auuucugacucuaucau

SEQ ID NO: 529310 - RNA, 14 nt, Homo sapiens
auuucuucaaauaa

SEQ ID NO: 529311 - RNA, 11 nt, Homo sapiens
auuucuuccca

SEQ ID NO: 529312 - RNA, 18 nt, Homo sapiens
auuugaccacggacucca

SEQ ID NO: 529313 - RNA, 20 nt, Homo sapiens
auuugcuuuggaaguuuuaa

SEQ ID NO: 529314 - RNA, 19 nt, Homo sapiens
auuuguagcauaacuguag

SEQ ID NO: 529315 - RNA, 16 nt, Homo sapiens
auuuuaauacauugau

SEQ ID NO: 529316 - RNA, 22 nt, Homo sapiens
auuuucagcugcaaggauucag

SEQ ID NO: 529317 - RNA, 21 nt, Homo sapiens
auuuucaucaggggccugcag

SEQ ID NO: 529318 - RNA, 17 nt, Homo sapiens
auuuugagaucaucagu

SEQ ID NO: 529319 - RNA, 16 nt, Homo sapiens
auuuugagguuuagca

SEQ ID NO: 529320 - RNA, 15 nt, Homo sapiens
auuuuguauguuaaa

SEQ ID NO: 529321 - RNA, 17 nt, Homo sapiens
caaguuuuguggggcuu

SEQ ID NO: 529322 - RNA, 17 nt, Homo sapiens
caauaaagcaauguggu

SEQ ID NO: 529323 - RNA, 15 nt, Homo sapiens
caauaaaucuuucaa

SEQ ID NO: 529324 - RNA, 21 nt, Homo sapiens
caauaacauacaugagauaac

SEQ ID NO: 529325 - RNA, 15 nt, Homo sapiens
caaucagcagucuag

SEQ ID NO: 529326 - RNA, 14 nt, Homo sapiens
caaucuccaugugu

SEQ ID NO: 529327 - RNA, 23 nt, Homo sapiens
caaucugccuguaucucucacua

SEQ ID NO: 529328 - RNA, 18 nt, Homo sapiens
caaugaaagucaaauuua

SEQ ID NO: 529329 - RNA, 19 nt, Homo sapiens
caaugaaagucaaauuuac

SEQ ID NO: 529330 - RNA, 16 nt, Homo sapiens
caaugaagaaguuucu

SEQ ID NO: 529331 - RNA, 17 nt, Homo sapiens
caaugcuucuagaguuu

SEQ ID NO: 529332 - RNA, 21 nt, Homo sapiens
caaugcuucuguugaucucag

SEQ ID NO: 529333 - RNA, 15 nt, Homo sapiens
caaugucaaugugaa

SEQ ID NO: 529334 - RNA, 18 nt, Homo sapiens
caauguguggcucagugc

SEQ ID NO: 529335 - RNA, 13 nt, Homo sapiens
caauguucuauua

SEQ ID NO: 529336 - RNA, 15 nt, Homo sapiens
caauuaagcagcuug

SEQ ID NO: 529337 - RNA, 20 nt, Homo sapiens
caauuuucacacacgugaga

SEQ ID NO: 529338 - RNA, 16 nt, Homo sapiens
cacaaagcauuuucau

SEQ ID NO: 529339 - RNA, 18 nt, Homo sapiens
cacaaauauccaccacuu

SEQ ID NO: 529340 - RNA, 14 nt, Homo sapiens
cacaacagugaaaa

SEQ ID NO: 529341 - RNA, 23 nt, Homo sapiens
cacaagaaguucuuguucuucag

SEQ ID NO: 529342 - RNA, 13 nt, Homo sapiens
cacaauacaguau

SEQ ID NO: 529343 - RNA, 15 nt, Homo sapiens
cacaaugaugaugau

SEQ ID NO: 529344 - RNA, 21 nt, Homo sapiens
cacaauuauuggcaaaguuua

SEQ ID NO: 529345 - RNA, 15 nt, Homo sapiens
cacacaacuguccau

SEQ ID NO: 529346 - RNA, 12 nt, Homo sapiens
cacacacugacc

SEQ ID NO: 529347 - RNA, 11 nt, Homo sapiens
cacacacugug

SEQ ID NO: 529348 - RNA, 18 nt, Homo sapiens
cacaccauuuuguaaaug

SEQ ID NO: 529349 - RNA, 16 nt, Homo sapiens
cacaccccaacacuuc

SEQ ID NO: 529350 - RNA, 16 nt, Homo sapiens
cacacguuugugagcu

SEQ ID NO: 529351 - RNA, 17 nt, Homo sapiens
cacagaugggaucacag

SEQ ID NO: 529352 - RNA, 18 nt, Homo sapiens
cacagcauguguauuucc

SEQ ID NO: 529353 - RNA, 12 nt, Homo sapiens
cacagcugccau

SEQ ID NO: 529354 - RNA, 16 nt, Homo sapiens
cacaguggugaccccc

SEQ ID NO: 529355 - RNA, 19 nt, Homo sapiens
cacauacaugucacauuua

SEQ ID NO: 529356 - RNA, 13 nt, Homo sapiens
cacaugcccauga

SEQ ID NO: 529357 - RNA, 20 nt, Homo sapiens
cacaugccuguaaucccagc

SEQ ID NO: 529358 - RNA, 23 nt, Homo sapiens
cacauguguuucugucucuccau

SEQ ID NO: 529359 - RNA, 22 nt, Homo sapiens
cacauguugccuugcauuugug

SEQ ID NO: 529360 - RNA, 16 nt, Homo sapiens
cacauguuuaacuuua

SEQ ID NO: 529361 - RNA, 21 nt, Homo sapiens
cacauuuagauccugguuuca

SEQ ID NO: 529362 - RNA, 16 nt, Homo sapiens
caccaaccuccagugu

SEQ ID NO: 529363 - RNA, 21 nt, Homo sapiens
caccacagccggucagaggag

SEQ ID NO: 529364 - RNA, 21 nt, Homo sapiens
caccacucaggccacaguggg

SEQ ID NO: 529365 - RNA, 22 nt, Homo sapiens
caccagagggauaaaaacaaua

SEQ ID NO: 529366 - RNA, 22 nt, Homo sapiens
caccaggaauccccaacaugca

SEQ ID NO: 529367 - RNA, 23 nt, Homo sapiens
cacccaguccucccagcugccau

SEQ ID NO: 529368 - RNA, 20 nt, Homo sapiens
cacccagugggaagagugug

SEQ ID NO: 529369 - RNA, 20 nt, Homo sapiens
cacccaguuugauaccugca

SEQ ID NO: 529370 - RNA, 13 nt, Homo sapiens
cacccaugcaagc

SEQ ID NO: 529371 - RNA, 20 nt, Homo sapiens
caccgagaauguuguauuca

SEQ ID NO: 529372 - RNA, 18 nt, Homo sapiens
caccucucuguaguuuau

SEQ ID NO: 529373 - RNA, 15 nt, Homo sapiens
caccucuuccuugau

SEQ ID NO: 529374 - RNA, 18 nt, Homo sapiens
caccuuaagauuuugcac

SEQ ID NO: 529375 - RNA, 16 nt, Homo sapiens
cacgaccauuugauag

SEQ ID NO: 529376 - RNA, 23 nt, Homo sapiens
cacgccgcucuucacugugguca

SEQ ID NO: 529377 - RNA, 22 nt, Homo sapiens
cacgccuaaggucacagcuagu

SEQ ID NO: 529378 - RNA, 21 nt, Homo sapiens
cagccugggcaacauggugaa

SEQ ID NO: 529379 - RNA, 19 nt, Homo sapiens
cagccuucuugauguauuu

SEQ ID NO: 529380 - RNA, 21 nt, Homo sapiens
cagcggucagauagcaucaga

SEQ ID NO: 529381 - RNA, 22 nt, Homo sapiens
cagcucaaugcaguuagcugaa

SEQ ID NO: 529382 - RNA, 19 nt, Homo sapiens
cagcugccaucgaccugga

SEQ ID NO: 529383 - RNA, 19 nt, Homo sapiens
cagcuuuuguuguuuauau

SEQ ID NO: 529384 - RNA, 22 nt, Homo sapiens
caggaaagagagcaccacguga

SEQ ID NO: 529385 - RNA, 18 nt, Homo sapiens
caggaagacuuugugacu

SEQ ID NO: 529386 - RNA, 17 nt, Homo sapiens
caggaauacuuggaccu

SEQ ID NO: 529387 - RNA, 19 nt, Homo sapiens
caggaauccccaacaugca

SEQ ID NO: 529388 - RNA, 15 nt, Homo sapiens
caggagagucacuug

SEQ ID NO: 529389 - RNA, 21 nt, Homo sapiens
caggaggguauggugcugcuc

SEQ ID NO: 529390 - RNA, 23 nt, Homo sapiens
caggaugacgugcuccguagcuc

SEQ ID NO: 529391 - RNA, 14 nt, Homo sapiens
caggcauugaggaa

SEQ ID NO: 529392 - RNA, 22 nt, Homo sapiens
caggccaccccuaggaacucag

SEQ ID NO: 529393 - RNA, 16 nt, Homo sapiens
caggccuuacaucugg

SEQ ID NO: 529394 - RNA, 20 nt, Homo sapiens
caggcuauguauaaaauaca

SEQ ID NO: 529395 - RNA, 15 nt, Homo sapiens
caggcucagaucuca

SEQ ID NO: 529396 - RNA, 16 nt, Homo sapiens
caggcucagaucucau

SEQ ID NO: 529397 - RNA, 14 nt, Homo sapiens
caggcugggccaug

SEQ ID NO: 529398 - RNA, 20 nt, Homo sapiens
caggcugggccauguccaaa

SEQ ID NO: 529399 - RNA, 22 nt, Homo sapiens
caggcugggccauguccaaaga

SEQ ID NO: 529400 - RNA, 13 nt, Homo sapiens
caggcuuuguaca

SEQ ID NO: 529401 - RNA, 16 nt, Homo sapiens
cagggaaaacugcaaa

SEQ ID NO: 529402 - RNA, 19 nt, Homo sapiens
cagggaggcugugcacaga

SEQ ID NO: 529403 - RNA, 13 nt, Homo sapiens
cagggauggcccc

SEQ ID NO: 529404 - RNA, 18 nt, Homo sapiens
cagggcucauuuuugcac

SEQ ID NO: 529405 - RNA, 20 nt, Homo sapiens
cagggcuggcacgugacagg

SEQ ID NO: 529406 - RNA, 11 nt, Homo sapiens
caggggugacg

SEQ ID NO: 529407 - RNA, 16 nt, Homo sapiens
cagggucugugugaau

SEQ ID NO: 529408 - RNA, 12 nt, Homo sapiens
cagggugagcuc

SEQ ID NO: 529409 - RNA, 15 nt, Homo sapiens
caggguucucuuagc

SEQ ID NO: 529410 - RNA, 23 nt, Homo sapiens
caggucacuugaucaugcugcag

SEQ ID NO: 529411 - RNA, 18 nt, Homo sapiens
caggugauccgccuaccu

SEQ ID NO: 529412 - RNA, 14 nt, Homo sapiens
caggugcauagcaa

SEQ ID NO: 529413 - RNA, 19 nt, Homo sapiens
cagguuuaugaaugacagu

SEQ ID NO: 529414 - RNA, 12 nt, Homo sapiens
caguaaucuuua

SEQ ID NO: 529415 - RNA, 14 nt, Homo sapiens
caguagaacuccag

SEQ ID NO: 529416 - RNA, 12 nt, Homo sapiens
caguagacagaa

SEQ ID NO: 529417 - RNA, 13 nt, Homo sapiens
caguagucccugc

SEQ ID NO: 529418 - RNA, 22 nt, Homo sapiens
caguauaagcaucugccaucug

SEQ ID NO: 529419 - RNA, 17 nt, Homo sapiens
caguauuuucuccacuu

SEQ ID NO: 529420 - RNA, 15 nt, Homo sapiens
cagucccacacugug

SEQ ID NO: 529421 - RNA, 16 nt, Homo sapiens
cagucccacacugugg

SEQ ID NO: 529422 - RNA, 13 nt, Homo sapiens
cagucugagcugu

SEQ ID NO: 529423 - RNA, 13 nt, Homo sapiens
cagucuuucuuga

SEQ ID NO: 529424 - RNA, 17 nt, Homo sapiens
cagugacuggugccagu

SEQ ID NO: 529425 - RNA, 17 nt, Homo sapiens
cagugagccgagaucau

SEQ ID NO: 529426 - RNA, 21 nt, Homo sapiens
cagugagccgagaucaugcca

SEQ ID NO: 529427 - RNA, 22 nt, Homo sapiens
cagugccuacccaccugugagg

SEQ ID NO: 529428 - RNA, 17 nt, Homo sapiens
cagugccucaccuucca

SEQ ID NO: 529429 - RNA, 19 nt, Homo sapiens
cagugguuuagaaauuacu

SEQ ID NO: 529430 - RNA, 19 nt, Homo sapiens
caguuaaucagcaaccuga

SEQ ID NO: 529431 - RNA, 17 nt, Homo sapiens
caguugaaaacuuguaa

SEQ ID NO: 529432 - RNA, 14 nt, Homo sapiens
caguugcugugaac

SEQ ID NO: 529433 - RNA, 18 nt, Homo sapiens
caguuugauaccugcacu

SEQ ID NO: 529434 - RNA, 21 nt, Homo sapiens
cauaaacaaguucgagucaaa

SEQ ID NO: 529435 - RNA, 17 nt, Homo sapiens
cauaauaagcuaaagag

SEQ ID NO: 529436 - RNA, 15 nt, Homo sapiens
cauaauagucaauuu

SEQ ID NO: 529437 - RNA, 15 nt, Homo sapiens
aaccauuccaacuuc

SEQ ID NO: 529438 - RNA, 20 nt, Homo sapiens
aaccauuccaacuucaauuu

SEQ ID NO: 529439 - RNA, 13 nt, Homo sapiens
aaccauuuacuua

SEQ ID NO: 529440 - RNA, 17 nt, Homo sapiens
aacccccaucucuacua

SEQ ID NO: 529441 - RNA, 16 nt, Homo sapiens
aaccccgucucuacua

SEQ ID NO: 529442 - RNA, 18 nt, Homo sapiens
aacccucuggggagcuca

SEQ ID NO: 529443 - RNA, 14 nt, Homo sapiens
aaccuccaguguca

SEQ ID NO: 529444 - RNA, 18 nt, Homo sapiens
aaccugccaugccaggaa

SEQ ID NO: 529445 - RNA, 16 nt, Homo sapiens
aaccuuugcuauguaa

SEQ ID NO: 529446 - RNA, 13 nt, Homo sapiens
aacgacacauuca

SEQ ID NO: 529447 - RNA, 14 nt, Homo sapiens
aacgacacauucag

SEQ ID NO: 529448 - RNA, 19 nt, Homo sapiens
aacgcaggagaaucacuug

SEQ ID NO: 529449 - RNA, 15 nt, Homo sapiens
aacguguuccagugu

SEQ ID NO: 529450 - RNA, 15 nt, Homo sapiens
aacguugacaaguuu

SEQ ID NO: 529451 - RNA, 19 nt, Homo sapiens
aacuaaaaauuaaaaccuc

SEQ ID NO: 529452 - RNA, 16 nt, Homo sapiens
aacuagugaaauguuc

SEQ ID NO: 529453 - RNA, 15 nt, Homo sapiens
aacuauuuaaaggaa

SEQ ID NO: 529454 - RNA, 16 nt, Homo sapiens
aacuauuuaaaggaaa

SEQ ID NO: 529455 - RNA, 18 nt, Homo sapiens
aacuauuuauaucacaca

SEQ ID NO: 529456 - RNA, 20 nt, Homo sapiens
aacucaaauacacauuugcu

SEQ ID NO: 529457 - RNA, 22 nt, Homo sapiens
aacucaguccuguacucugggg

SEQ ID NO: 529458 - RNA, 22 nt, Homo sapiens
aacuccccucagggauacgaca

SEQ ID NO: 529459 - RNA, 15 nt, Homo sapiens
aacucuagaagacca

SEQ ID NO: 529460 - RNA, 21 nt, Homo sapiens
aacucuccaauguucuauuaa

SEQ ID NO: 529461 - RNA, 18 nt, Homo sapiens
aacucugcccaggugugc

SEQ ID NO: 529462 - RNA, 19 nt, Homo sapiens
aacugcaaguucauuuuaa

SEQ ID NO: 529463 - RNA, 19 nt, Homo sapiens
aacugccaggcugccuccu

SEQ ID NO: 529464 - RNA, 19 nt, Homo sapiens
aacuguagcucaaguuuaa

SEQ ID NO: 529465 - RNA, 11 nt, Homo sapiens
aacuguugcuc

SEQ ID NO: 529466 - RNA, 20 nt, Homo sapiens
aacuuacagguccugcugaa

SEQ ID NO: 529467 - RNA, 14 nt, Homo sapiens
aacuuagaaaggga

SEQ ID NO: 529468 - RNA, 15 nt, Homo sapiens
aacuucaauuuacuu

SEQ ID NO: 529469 - RNA, 20 nt, Homo sapiens
aacuuccuacguauccugca

SEQ ID NO: 529470 - RNA, 17 nt, Homo sapiens
aacuucuuccugugaag

SEQ ID NO: 529471 - RNA, 15 nt, Homo sapiens
aacuugcaauaccaa

SEQ ID NO: 529472 - RNA, 23 nt, Homo sapiens
aacuuucaggggcugacucucca

SEQ ID NO: 529473 - RNA, 17 nt, Homo sapiens
aacuuuguaguaugaua

SEQ ID NO: 529474 - RNA, 19 nt, Homo sapiens
aacuuuuuuuucucucuuu

SEQ ID NO: 529475 - RNA, 13 nt, Homo sapiens
aagaaaaguuuac

SEQ ID NO: 529476 - RNA, 14 nt, Homo sapiens
aagaaagccuaaaa

SEQ ID NO: 529477 - RNA, 14 nt, Homo sapiens
aagaaaucaugaua

SEQ ID NO: 529478 - RNA, 20 nt, Homo sapiens
aagaacuugcaauaccaaug

SEQ ID NO: 529479 - RNA, 12 nt, Homo sapiens
aagaagacauga

SEQ ID NO: 529480 - RNA, 23 nt, Homo sapiens
aagaagccacccuccuugcagga

SEQ ID NO: 529481 - RNA, 22 nt, Homo sapiens
aagaagcugcuguucuuagcaa

SEQ ID NO: 529482 - RNA, 23 nt, Homo sapiens
aagacaaauuagccauuucacuc

SEQ ID NO: 529483 - RNA, 15 nt, Homo sapiens
aagacauacugcuug

SEQ ID NO: 529484 - RNA, 17 nt, Homo sapiens
aagaccagccuggucaa

SEQ ID NO: 529485 - RNA, 16 nt, Homo sapiens
aagacuuuauguaguu

SEQ ID NO: 529486 - RNA, 13 nt, Homo sapiens
aagacuuugugac

SEQ ID NO: 529487 - RNA, 13 nt, Homo sapiens
aagagaagcauca

SEQ ID NO: 529488 - RNA, 15 nt, Homo sapiens
aagagaucuacacau

SEQ ID NO: 529489 - RNA, 17 nt, Homo sapiens
aagagcauagaacucaa

SEQ ID NO: 529490 - RNA, 20 nt, Homo sapiens
aagagccagacucugucuca

SEQ ID NO: 529491 - RNA, 14 nt, Homo sapiens
aagaggaacagcac

SEQ ID NO: 529492 - RNA, 15 nt, Homo sapiens
aagaggaacuugacc

SEQ ID NO: 529493 - RNA, 18 nt, Homo sapiens
aagauaguugauucuugc

SEQ ID NO: 529494 - RNA, 19 nt, Homo sapiens
aagaugacggaugccuaga

SEQ ID NO: 529495 - RNA, 23 nt, Homo sapiens
aagauguguucaggcauuccagg

SEQ ID NO: 529496 - RNA, 19 nt, Homo sapiens
aagauuuugaaugcuuccu

SEQ ID NO: 529497 - RNA, 19 nt, Homo sapiens
aagauuuugcaccuguaaa

SEQ ID NO: 529498 - RNA, 18 nt, Homo sapiens
aagcaaguuuucuuccau

SEQ ID NO: 529499 - RNA, 14 nt, Homo sapiens
aagcagcaagacaa

SEQ ID NO: 529500 - RNA, 13 nt, Homo sapiens
aagcagguuuguu

SEQ ID NO: 529501 - RNA, 16 nt, Homo sapiens
aagcagucuugcucug

SEQ ID NO: 529502 - RNA, 16 nt, Homo sapiens
aagcaucauuucccca

SEQ ID NO: 529503 - RNA, 16 nt, Homo sapiens
aagcauguagacugug

SEQ ID NO: 529504 - RNA, 23 nt, Homo sapiens
aagcauguuuuguugcucagugu

SEQ ID NO: 529505 - RNA, 13 nt, Homo sapiens
aagccacuugaaa

SEQ ID NO: 529506 - RNA, 22 nt, Homo sapiens
aagccucuggucacauggcugu

SEQ ID NO: 529507 - RNA, 17 nt, Homo sapiens
aagcuaguguaccuccu

SEQ ID NO: 529508 - RNA, 21 nt, Homo sapiens
aagcuaguguaccuccucuca

SEQ ID NO: 529509 - RNA, 12 nt, Homo sapiens
aagcuccaguga

SEQ ID NO: 529510 - RNA, 20 nt, Homo sapiens
aagcugaacccuccugauga

SEQ ID NO: 529511 - RNA, 12 nt, Homo sapiens
aagcugacagca

SEQ ID NO: 529512 - RNA, 20 nt, Homo sapiens
aagcugacucuuugcucuaa

SEQ ID NO: 529513 - RNA, 20 nt, Homo sapiens
aagcugcuccaggccugcag

SEQ ID NO: 529514 - RNA, 23 nt, Homo sapiens
aagcugguugucuuuacaugaaa

SEQ ID NO: 529515 - RNA, 19 nt, Homo sapiens
aagcuguuauuucuucccu

SEQ ID NO: 529516 - RNA, 18 nt, Homo sapiens
aggcaggaggaucacuuu

SEQ ID NO: 529517 - RNA, 19 nt, Homo sapiens
aggcagugugccaguuuaa

SEQ ID NO: 529518 - RNA, 17 nt, Homo sapiens
aggccaagaacuugcaa

SEQ ID NO: 529519 - RNA, 18 nt, Homo sapiens
aggccacagcugccaucg

SEQ ID NO: 529520 - RNA, 13 nt, Homo sapiens
aggccacaguggg

SEQ ID NO: 529521 - RNA, 14 nt, Homo sapiens
aggccacagugggg

SEQ ID NO: 529522 - RNA, 20 nt, Homo sapiens
aggccaggcauggugguuua

SEQ ID NO: 529523 - RNA, 15 nt, Homo sapiens
aggccauacuuguga

SEQ ID NO: 529524 - RNA, 12 nt, Homo sapiens
aggccuguccaa

SEQ ID NO: 529525 - RNA, 16 nt, Homo sapiens
aggccuuacaucuggc

SEQ ID NO: 529526 - RNA, 21 nt, Homo sapiens
aggccuuugugucuguguccu

SEQ ID NO: 529527 - RNA, 15 nt, Homo sapiens
aggcgcacaguguga

SEQ ID NO: 529528 - RNA, 19 nt, Homo sapiens
aggcgcaguggcucaugcc

SEQ ID NO: 529529 - RNA, 16 nt, Homo sapiens
aggcgccugccaucau

SEQ ID NO: 529530 - RNA, 23 nt, Homo sapiens
aggcguuuguuauauaaaaauac

SEQ ID NO: 529531 - RNA, 19 nt, Homo sapiens
aggcuaugggguaggagaa

SEQ ID NO: 529532 - RNA, 14 nt, Homo sapiens
aggcucuaauguac

SEQ ID NO: 529533 - RNA, 15 nt, Homo sapiens
aggcucuaauguaca

SEQ ID NO: 529534 - RNA, 16 nt, Homo sapiens
aggcugccccucucac

SEQ ID NO: 529535 - RNA, 12 nt, Homo sapiens
aggcugcugcug

SEQ ID NO: 529536 - RNA, 18 nt, Homo sapiens
aggcugggccauguccaa

SEQ ID NO: 529537 - RNA, 21 nt, Homo sapiens
aggcugggccauguccaaaga

SEQ ID NO: 529538 - RNA, 18 nt, Homo sapiens
aggcuguuugagaaccau

SEQ ID NO: 529539 - RNA, 22 nt, Homo sapiens
aggcuucccugacuugcuuuag

SEQ ID NO: 529540 - RNA, 19 nt, Homo sapiens
aggcuucugcaguucucau

SEQ ID NO: 529541 - RNA, 16 nt, Homo sapiens
agggcaccauccagcu

SEQ ID NO: 529542 - RNA, 13 nt, Homo sapiens
agggcaccuggag

SEQ ID NO: 529543 - RNA, 17 nt, Homo sapiens
agggcaguucugagugu

SEQ ID NO: 529544 - RNA, 20 nt, Homo sapiens
agggcaguucugaguguuua

SEQ ID NO: 529545 - RNA, 22 nt, Homo sapiens
agggcccagugacaaggcccug

SEQ ID NO: 529546 - RNA, 17 nt, Homo sapiens
agggcucguuuccccac

SEQ ID NO: 529547 - RNA, 17 nt, Homo sapiens
aggggagucccuguggu

SEQ ID NO: 529548 - RNA, 13 nt, Homo sapiens
aggggcacuggug

SEQ ID NO: 529549 - RNA, 22 nt, Homo sapiens
aggggcuuguugcaggcugugg

SEQ ID NO: 529550 - RNA, 15 nt, Homo sapiens
agggggagaaugggu

SEQ ID NO: 529551 - RNA, 22 nt, Homo sapiens
agggguccgcugccccaugugu

SEQ ID NO: 529552 - RNA, 21 nt, Homo sapiens
aggguaaauaggaaucauuca

SEQ ID NO: 529553 - RNA, 13 nt, Homo sapiens
aggguccagugga

SEQ ID NO: 529554 - RNA, 15 nt, Homo sapiens
agggucggccuguac

SEQ ID NO: 529555 - RNA, 23 nt, Homo sapiens
agggucugugugaaugugggcac

SEQ ID NO: 529556 - RNA, 17 nt, Homo sapiens
agguaugaucucuucug

SEQ ID NO: 529557 - RNA, 16 nt, Homo sapiens
aggucgaggcuacagu

SEQ ID NO: 529558 - RNA, 18 nt, Homo sapiens
aggugauucucagggcug

SEQ ID NO: 529559 - RNA, 19 nt, Homo sapiens
aggugcauagcaagugaaa

SEQ ID NO: 529560 - RNA, 22 nt, Homo sapiens
agguggagaaagcauaucccac

SEQ ID NO: 529561 - RNA, 22 nt, Homo sapiens
aggugguucagacaagacagag

SEQ ID NO: 529562 - RNA, 16 nt, Homo sapiens
agguugccugaaaaau

SEQ ID NO: 529563 - RNA, 12 nt, Homo sapiens
aguaaacacuug

SEQ ID NO: 529564 - RNA, 14 nt, Homo sapiens
aguaagauaucuca

SEQ ID NO: 529565 - RNA, 15 nt, Homo sapiens
aguaagauaucucaa

SEQ ID NO: 529566 - RNA, 20 nt, Homo sapiens
aguaagcccggauagacuua

SEQ ID NO: 529567 - RNA, 13 nt, Homo sapiens
aguaauggcagag

SEQ ID NO: 529568 - RNA, 14 nt, Homo sapiens
aguacaaugcccag

SEQ ID NO: 529569 - RNA, 16 nt, Homo sapiens
aguacacccuuuccag

SEQ ID NO: 529570 - RNA, 15 nt, Homo sapiens
aguacccaucuagua

SEQ ID NO: 529571 - RNA, 15 nt, Homo sapiens
aguacuuugugcauu

SEQ ID NO: 529572 - RNA, 18 nt, Homo sapiens
aguaguguggccugugcc

SEQ ID NO: 529573 - RNA, 18 nt, Homo sapiens
aguauaagcaucugccau

SEQ ID NO: 529574 - RNA, 20 nt, Homo sapiens
aguauggcuccuccauaucu

SEQ ID NO: 529575 - RNA, 12 nt, Homo sapiens
aguauucuugca

SEQ ID NO: 529576 - RNA, 17 nt, Homo sapiens
aguauugucgguuaccu

SEQ ID NO: 529577 - RNA, 15 nt, Homo sapiens
aguauuuuuucaagu

SEQ ID NO: 529578 - RNA, 13 nt, Homo sapiens
agucaauuucuac

SEQ ID NO: 529579 - RNA, 17 nt, Homo sapiens
agucacugccaagucau

SEQ ID NO: 529580 - RNA, 13 nt, Homo sapiens
agucagcauucuu

SEQ ID NO: 529581 - RNA, 15 nt, Homo sapiens
agucaucucauucca

SEQ ID NO: 529582 - RNA, 20 nt, Homo sapiens
agucaucugaugagaacaag

SEQ ID NO: 529583 - RNA, 22 nt, Homo sapiens
agucauggaggccaagaacuug

SEQ ID NO: 529584 - RNA, 13 nt, Homo sapiens
agucccacacugu

SEQ ID NO: 529585 - RNA, 18 nt, Homo sapiens
aucuauaaaauagauaua

SEQ ID NO: 529586 - RNA, 14 nt, Homo sapiens
aucuauuaucucaa

SEQ ID NO: 529587 - RNA, 23 nt, Homo sapiens
aucucaggcuucugcaguucuca

SEQ ID NO: 529588 - RNA, 15 nt, Homo sapiens
aucuccaucucaaaa

SEQ ID NO: 529589 - RNA, 12 nt, Homo sapiens
aucuccaugugu

SEQ ID NO: 529590 - RNA, 14 nt, Homo sapiens
aucuccugcugauu

SEQ ID NO: 529591 - RNA, 17 nt, Homo sapiens
aucucggcucacugcaa

SEQ ID NO: 529592 - RNA, 15 nt, Homo sapiens
aucugccaucugcuu

SEQ ID NO: 529593 - RNA, 13 nt, Homo sapiens
aucugccuguauc

SEQ ID NO: 529594 - RNA, 18 nt, Homo sapiens
aucugccuguaucucuca

SEQ ID NO: 529595 - RNA, 23 nt, Homo sapiens
aucugcugcaccuucacucucca

SEQ ID NO: 529596 - RNA, 20 nt, Homo sapiens
aucuguccguucacaugugu

SEQ ID NO: 529597 - RNA, 15 nt, Homo sapiens
aucugucuccuguau

SEQ ID NO: 529598 - RNA, 12 nt, Homo sapiens
aucuguguaaag

SEQ ID NO: 529599 - RNA, 15 nt, Homo sapiens
aucuguucacuuuca

SEQ ID NO: 529600 - RNA, 14 nt, Homo sapiens
aucuucaaagccuu

SEQ ID NO: 529601 - RNA, 24 nt, Homo sapiens
aucuucagcucuuuuuguggauau

SEQ ID NO: 529602 - RNA, 18 nt, Homo sapiens
aucuuccaaaugcaauuu

SEQ ID NO: 529603 - RNA, 12 nt, Homo sapiens
aucuucuacuuu

SEQ ID NO: 529604 - RNA, 16 nt, Homo sapiens
aucuucuuacuaagcu

SEQ ID NO: 529605 - RNA, 18 nt, Homo sapiens
aucuugccuccaggugca

SEQ ID NO: 529606 - RNA, 20 nt, Homo sapiens
aucuuggagacccugcaaac

SEQ ID NO: 529607 - RNA, 13 nt, Homo sapiens
aucuugugugauu

SEQ ID NO: 529608 - RNA, 18 nt, Homo sapiens
aucuuugaccacgucauc

SEQ ID NO: 529609 - RNA, 15 nt, Homo sapiens
augaaagagccagac

SEQ ID NO: 529610 - RNA, 14 nt, Homo sapiens
augaaaucuuccca

SEQ ID NO: 529611 - RNA, 15 nt, Homo sapiens
augacaguagucaca

SEQ ID NO: 529612 - RNA, 23 nt, Homo sapiens
augacauuuuuuuuaacuacuau

SEQ ID NO: 529613 - RNA, 21 nt, Homo sapiens
augacccccgcaaguuugcac

SEQ ID NO: 529614 - RNA, 23 nt, Homo sapiens
augacccccgcaaguuugcacuc

SEQ ID NO: 529615 - RNA, 16 nt, Homo sapiens
augaccuugggguaca

SEQ ID NO: 529616 - RNA, 23 nt, Homo sapiens
augacuaaagagagaauguagau

SEQ ID NO: 529617 - RNA, 13 nt, Homo sapiens
augacuccuacuu

SEQ ID NO: 529618 - RNA, 14 nt, Homo sapiens
augagaacaagcua

SEQ ID NO: 529619 - RNA, 20 nt, Homo sapiens
augagaugguuucuagagau

SEQ ID NO: 529620 - RNA, 19 nt, Homo sapiens
augauccccaaguggugaa

SEQ ID NO: 529621 - RNA, 16 nt, Homo sapiens
augaugagaagcagaa

SEQ ID NO: 529622 - RNA, 23 nt, Homo sapiens
augaugagucgguccucuuucca

SEQ ID NO: 529623 - RNA, 12 nt, Homo sapiens
augcaagugcaa

SEQ ID NO: 529624 - RNA, 12 nt, Homo sapiens
augccacugacc

SEQ ID NO: 529625 - RNA, 16 nt, Homo sapiens
augccaggaaccuguc

SEQ ID NO: 529626 - RNA, 18 nt, Homo sapiens
augccuaguuucuuacac

SEQ ID NO: 529627 - RNA, 15 nt, Homo sapiens
augccuguaauccca

SEQ ID NO: 529628 - RNA, 15 nt, Homo sapiens
augcgcacugcauuc

SEQ ID NO: 529629 - RNA, 14 nt, Homo sapiens
augcucacuuuauu

SEQ ID NO: 529630 - RNA, 21 nt, Homo sapiens
augcuccaaauauaagacauu

SEQ ID NO: 529631 - RNA, 19 nt, Homo sapiens
augcugaaaaaucauccaa

SEQ ID NO: 529632 - RNA, 15 nt, Homo sapiens
augcugccuggcaca

SEQ ID NO: 529633 - RNA, 13 nt, Homo sapiens
augcugccuggug

SEQ ID NO: 529634 - RNA, 15 nt, Homo sapiens
augcuggacuugccu

SEQ ID NO: 529635 - RNA, 20 nt, Homo sapiens
augcuggcagccauggccau

SEQ ID NO: 529636 - RNA, 16 nt, Homo sapiens
augcuguacacauauu

SEQ ID NO: 529637 - RNA, 18 nt, Homo sapiens
augcuucuguugaucuca

SEQ ID NO: 529638 - RNA, 18 nt, Homo sapiens
augcuuuugcuugcaaug

SEQ ID NO: 529639 - RNA, 21 nt, Homo sapiens
aaaaagauucucaucacucaa

SEQ ID NO: 529640 - RNA, 23 nt, Homo sapiens
aaaaaggagccuuuugcucucug

SEQ ID NO: 529641 - RNA, 11 nt, Homo sapiens
aaaaauacuuu

SEQ ID NO: 529642 - RNA, 20 nt, Homo sapiens
aaaaauagcuuucaaaagaa

SEQ ID NO: 529643 - RNA, 12 nt, Homo sapiens
aaaaaugguacu

SEQ ID NO: 529644 - RNA, 19 nt, Homo sapiens
aaaacaaacccaaagguag

SEQ ID NO: 529645 - RNA, 17 nt, Homo sapiens
aaaacaaaggccuaauu

SEQ ID NO: 529646 - RNA, 14 nt, Homo sapiens
aaaacuaccacaug

SEQ ID NO: 529647 - RNA, 21 nt, Homo sapiens
aaaacucuucagugcaaauug

SEQ ID NO: 529648 - RNA, 15 nt, Homo sapiens
aaaacugugccuugu

SEQ ID NO: 529649 - RNA, 12 nt, Homo sapiens
aaaagacugaau

SEQ ID NO: 529650 - RNA, 22 nt, Homo sapiens
aaaagcaugaauuggaacugca

SEQ ID NO: 529651 - RNA, 13 nt, Homo sapiens
aaaagcauuguuu

SEQ ID NO: 529652 - RNA, 20 nt, Homo sapiens
aaaagcugaauccagaucau

SEQ ID NO: 529653 - RNA, 22 nt, Homo sapiens
aaaaggaacucuagaagaccaa

SEQ ID NO: 529654 - RNA, 22 nt, Homo sapiens
aaaaguuggucaggcgcagugg

SEQ ID NO: 529655 - RNA, 21 nt, Homo sapiens
aaaauacuauuuaagauguga

SEQ ID NO: 529656 - RNA, 14 nt, Homo sapiens
aaaauagucuucca

SEQ ID NO: 529657 - RNA, 15 nt, Homo sapiens
aaaaucacaucucca

SEQ ID NO: 529658 - RNA, 15 nt, Homo sapiens
aaaaucuccaucuca

SEQ ID NO: 529659 - RNA, 12 nt, Homo sapiens
aaaaugacauua

SEQ ID NO: 529660 - RNA, 19 nt, Homo sapiens
aaaaugcaacucuaacucu

SEQ ID NO: 529661 - RNA, 19 nt, Homo sapiens
aaaauguuucuacagauau

SEQ ID NO: 529662 - RNA, 13 nt, Homo sapiens
aaaauuauuugcu

SEQ ID NO: 529663 - RNA, 21 nt, Homo sapiens
aaaauucagaguccuugcaaa

SEQ ID NO: 529664 - RNA, 19 nt, Homo sapiens
aaaauuguuuagugauauu

SEQ ID NO: 529665 - RNA, 19 nt, Homo sapiens
aaaauuuuagcucuuccca

SEQ ID NO: 529666 - RNA, 12 nt, Homo sapiens
aaaauuuugcuu

SEQ ID NO: 529667 - RNA, 20 nt, Homo sapiens
aaaauuuuuguuugguuaua

SEQ ID NO: 529668 - RNA, 21 nt, Homo sapiens
aaacauuaaaauauaaucucu

SEQ ID NO: 529669 - RNA, 12 nt, Homo sapiens
aaacauugaaga

SEQ ID NO: 529670 - RNA, 21 nt, Homo sapiens
aaacauuggauuuuuccuuaa

SEQ ID NO: 529671 - RNA, 16 nt, Homo sapiens
aaaccaggauuuccuu

SEQ ID NO: 529672 - RNA, 12 nt, Homo sapiens
aaaccagguggc

SEQ ID NO: 529673 - RNA, 15 nt, Homo sapiens
aaaccuaguacugcc

SEQ ID NO: 529674 - RNA, 13 nt, Homo sapiens
aaaccuuugcaaa

SEQ ID NO: 529675 - RNA, 13 nt, Homo sapiens
aaacgagacuuuc

SEQ ID NO: 529676 - RNA, 13 nt, Homo sapiens
aaacucagugcaa

SEQ ID NO: 529677 - RNA, 18 nt, Homo sapiens
aaacugcccacucugcaa

SEQ ID NO: 529678 - RNA, 23 nt, Homo sapiens
aaacugggauuaagaaaccuugc

SEQ ID NO: 529679 - RNA, 17 nt, Homo sapiens
aaacuucacuaaugauc

SEQ ID NO: 529680 - RNA, 22 nt, Homo sapiens
aaagaaaaguuuaccaucugaa

SEQ ID NO: 529681 - RNA, 18 nt, Homo sapiens
aaagaaauacaguacugu

SEQ ID NO: 529682 - RNA, 13 nt, Homo sapiens
aaagaagcuuuau

SEQ ID NO: 529683 - RNA, 16 nt, Homo sapiens
aaagagaauauuuaca

SEQ ID NO: 529684 - RNA, 22 nt, Homo sapiens
aaagagagcaccacgugaugga

SEQ ID NO: 529685 - RNA, 22 nt, Homo sapiens
aaagagccagacucugucucaa

SEQ ID NO: 529686 - RNA, 20 nt, Homo sapiens
aaagaggcugccccucucac

SEQ ID NO: 529687 - RNA, 14 nt, Homo sapiens
aaagcaaguguuca

SEQ ID NO: 529688 - RNA, 22 nt, Homo sapiens
aaagcacuccugcuuaaucuuc

SEQ ID NO: 529689 - RNA, 17 nt, Homo sapiens
aaagcuaguguaccucc

SEQ ID NO: 529690 - RNA, 17 nt, Homo sapiens
aaagcucacugcugauc

SEQ ID NO: 529691 - RNA, 16 nt, Homo sapiens
aaagcugagccugcag

SEQ ID NO: 529692 - RNA, 20 nt, Homo sapiens
aaagcuuuuuccuccuggaa

SEQ ID NO: 529693 - RNA, 16 nt, Homo sapiens
aaaggaaaacgugaac

SEQ ID NO: 529694 - RNA, 21 nt, Homo sapiens
aaaggacaccuuuuaacucac

SEQ ID NO: 529695 - RNA, 22 nt, Homo sapiens
aaaggugaauguugagggcccu

SEQ ID NO: 529696 - RNA, 14 nt, Homo sapiens
aaagguugccugaa

SEQ ID NO: 529697 - RNA, 21 nt, Homo sapiens
aaaguauaaccauaugauacu

SEQ ID NO: 529698 - RNA, 21 nt, Homo sapiens
aaagugguguaaacuuguaca

SEQ ID NO: 529699 - RNA, 16 nt, Homo sapiens
aaaguugagcgucauu

SEQ ID NO: 529700 - RNA, 21 nt, Homo sapiens
aaaguuuuaggguacaguuug

SEQ ID NO: 529701 - RNA, 19 nt, Homo sapiens
aaaguuuugcaacaauaaa

SEQ ID NO: 529702 - RNA, 15 nt, Homo sapiens
aaauacacauuugcu

SEQ ID NO: 529703 - RNA, 18 nt, Homo sapiens
aaauacagacuggaugua

SEQ ID NO: 529704 - RNA, 20 nt, Homo sapiens
aaauacauguguauauuccu

SEQ ID NO: 529705 - RNA, 16 nt, Homo sapiens
aaauagucuuccacaa

SEQ ID NO: 529706 - RNA, 17 nt, Homo sapiens
aaauagucuuccacaaa

SEQ ID NO: 529707 - RNA, 23 nt, Homo sapiens
aaauaguguucccagagcacuuu

SEQ ID NO: 529708 - RNA, 18 nt, Homo sapiens
aaauauauuuuggaaaac

SEQ ID NO: 529709 - RNA, 17 nt, Homo sapiens
aaauaucauaaagcauu

SEQ ID NO: 529710 - RNA, 15 nt, Homo sapiens
aaaucauaggugaag

SEQ ID NO: 529711 - RNA, 20 nt, Homo sapiens
aaaucauccaagacaguuau

SEQ ID NO: 529712 - RNA, 23 nt, Homo sapiens
aaaucugaauaaauaauucuucc

SEQ ID NO: 529713 - RNA, 20 nt, Homo sapiens
aaaugacucuggggagguga

SEQ ID NO: 529714 - RNA, 13 nt, Homo sapiens
aaaugguauguca

SEQ ID NO: 529715 - RNA, 18 nt, Homo sapiens
aaauguauaaauauacag

SEQ ID NO: 529716 - RNA, 16 nt, Homo sapiens
aaauguauccagucug

SEQ ID NO: 529717 - RNA, 14 nt, Homo sapiens
aaauguauuuuaca

SEQ ID NO: 529718 - RNA, 16 nt, Homo sapiens
aaaugucaggccuucc

SEQ ID NO: 529719 - RNA, 20 nt, Homo sapiens
aaaugucaggccuuccccac

SEQ ID NO: 529720 - RNA, 18 nt, Homo sapiens
aaaugugugccauauucu

SEQ ID NO: 529721 - RNA, 19 nt, Homo sapiens
aaauguucaagucaugccu

SEQ ID NO: 529722 - RNA, 22 nt, Homo sapiens
aaauguucaagucaugccugag

SEQ ID NO: 529723 - RNA, 21 nt, Homo sapiens
aaauguuuaauaaagcuuuau

SEQ ID NO: 529724 - RNA, 13 nt, Homo sapiens
aaauguuucuaca

SEQ ID NO: 529725 - RNA, 14 nt, Homo sapiens
aaauuaagacuuua

SEQ ID NO: 529726 - RNA, 18 nt, Homo sapiens
aaauuagccauuucacuc

SEQ ID NO: 529727 - RNA, 15 nt, Homo sapiens
aaauuauucugcccu

SEQ ID NO: 529728 - RNA, 11 nt, Homo sapiens
aaauucuugag

SEQ ID NO: 529729 - RNA, 20 nt, Homo sapiens
aaauuguuguauaucacuaa

SEQ ID NO: 529730 - RNA, 14 nt, Homo sapiens
aaauuuaauaccag

SEQ ID NO: 529731 - RNA, 18 nt, Homo sapiens
aaauuuaauaccagauac

SEQ ID NO: 529732 - RNA, 13 nt, Homo sapiens
aaauuuuauauca

SEQ ID NO: 529733 - RNA, 13 nt, Homo sapiens
aacaaaauuagaa

SEQ ID NO: 529734 - RNA, 15 nt, Homo sapiens
aacaaacccaaaggu

SEQ ID NO: 529735 - RNA, 16 nt, Homo sapiens
aacaacauccacuguu

SEQ ID NO: 529736 - RNA, 15 nt, Homo sapiens
aacaaguauuggaaa

SEQ ID NO: 529737 - RNA, 21 nt, Homo sapiens
aacaauauguuugcaaacuug

SEQ ID NO: 529738 - RNA, 15 nt, Homo sapiens
aacacccgacgucau

SEQ ID NO: 529739 - RNA, 14 nt, Homo sapiens
aacacuaaacauuc

SEQ ID NO: 529740 - RNA, 23 nt, Homo sapiens
aacacugaaaugaaaucuuccca

SEQ ID NO: 529741 - RNA, 18 nt, Homo sapiens
aacagaagacagcugcug

SEQ ID NO: 529742 - RNA, 15 nt, Homo sapiens
aacagauaagcaaga

SEQ ID NO: 529743 - RNA, 22 nt, Homo sapiens
aacagauuucaaaaaaaaaccc

SEQ ID NO: 529744 - RNA, 13 nt, Homo sapiens
aacaguccaaacu

SEQ ID NO: 529745 - RNA, 14 nt, Homo sapiens
aacaguggacaaag

SEQ ID NO: 529746 - RNA, 16 nt, Homo sapiens
aacauacaugagauaa

SEQ ID NO: 529747 - RNA, 21 nt, Homo sapiens
aacauacaugagauaacucaa

SEQ ID NO: 529748 - RNA, 14 nt, Homo sapiens
aacauccacuguua

SEQ ID NO: 529749 - RNA, 22 nt, Homo sapiens
aacauggugaaaccccgucucu

SEQ ID NO: 529750 - RNA, 14 nt, Homo sapiens
aacauguacuacag

SEQ ID NO: 529751 - RNA, 15 nt, Homo sapiens
aacauguccuaauuc

SEQ ID NO: 529752 - RNA, 18 nt, Homo sapiens
aacauuaaggaauuugau

SEQ ID NO: 529753 - RNA, 17 nt, Homo sapiens
aacauugguucuuucau

SEQ ID NO: 529754 - RNA, 23 nt, Homo sapiens
aaccaaccuaagggcccaaaggc

SEQ ID NO: 529755 - RNA, 15 nt, Homo sapiens
aaccaagcaaaggaa

SEQ ID NO: 529756 - RNA, 16 nt, Homo sapiens
aaccacagucuuccca

SEQ ID NO: 529757 - RNA, 19 nt, Homo sapiens
aaccaggauuuccuugacu

SEQ ID NO: 529758 - RNA, 18 nt, Homo sapiens
aaccaggcaccucuuccu

SEQ ID NO: 529759 - RNA, 18 nt, Homo sapiens
aaccauaugauacuauca

SEQ ID NO: 529760 - RNA, 18 nt, Homo sapiens
aaccauguauaugagcuu

SEQ ID NO: 529761 - RNA, 19 nt, Homo sapiens
cauuguuccugcgcugcaa

SEQ ID NO: 529762 - RNA, 20 nt, Homo sapiens
cauuguuccugcgcugcaaa

SEQ ID NO: 529763 - RNA, 23 nt, Homo sapiens
cauuuaaaaagcucacugcugau

SEQ ID NO: 529764 - RNA, 12 nt, Homo sapiens
cauuuaaaacau

SEQ ID NO: 529765 - RNA, 14 nt, Homo sapiens
cauuuaaagaccaa

SEQ ID NO: 529766 - RNA, 17 nt, Homo sapiens
cauuucagaaaugcugu

SEQ ID NO: 529767 - RNA, 14 nt, Homo sapiens
cauuucguauuucu

SEQ ID NO: 529768 - RNA, 20 nt, Homo sapiens
cauuucuaaauuuauauuca

SEQ ID NO: 529769 - RNA, 11 nt, Homo sapiens
cauuucuuaga

SEQ ID NO: 529770 - RNA, 13 nt, Homo sapiens
cauuuggaaugaa

SEQ ID NO: 529771 - RNA, 22 nt, Homo sapiens
cauuuggugggcuuuggagcug

SEQ ID NO: 529772 - RNA, 14 nt, Homo sapiens
cauuuuguaauaau

SEQ ID NO: 529773 - RNA, 12 nt, Homo sapiens
ccaaaauuugau

SEQ ID NO: 529774 - RNA, 12 nt, Homo sapiens
ccaaauaccuca

SEQ ID NO: 529775 - RNA, 18 nt, Homo sapiens
ccaacacuuccagcauuu

SEQ ID NO: 529776 - RNA, 16 nt, Homo sapiens
ccaacauucuuggcau

SEQ ID NO: 529777 - RNA, 10 nt, Homo sapiens
ccaaccucag

SEQ ID NO: 529778 - RNA, 18 nt, Homo sapiens
ccaacugacaaagaugca

SEQ ID NO: 529779 - RNA, 22 nt, Homo sapiens
ccaacugaguguuauuugcaca

SEQ ID NO: 529780 - RNA, 22 nt, Homo sapiens
ccaacugcaggaaaacccuuaa

SEQ ID NO: 529781 - RNA, 16 nt, Homo sapiens
ccaagaacuugcaaua

SEQ ID NO: 529782 - RNA, 14 nt, Homo sapiens
ccaagaagcaaagu

SEQ ID NO: 529783 - RNA, 14 nt, Homo sapiens
ccaaguaccaguau

SEQ ID NO: 529784 - RNA, 14 nt, Homo sapiens
ccaagucuuuccua

SEQ ID NO: 529785 - RNA, 14 nt, Homo sapiens
ccaauacagucuag

SEQ ID NO: 529786 - RNA, 15 nt, Homo sapiens
ccaauguaacacugg

SEQ ID NO: 529787 - RNA, 18 nt, Homo sapiens
ccaauuuuuuaagugaaa

SEQ ID NO: 529788 - RNA, 20 nt, Homo sapiens
ccaauuuuuuaagugaaaau

SEQ ID NO: 529789 - RNA, 22 nt, Homo sapiens
ccacaauuauuggcaaaguuua

SEQ ID NO: 529790 - RNA, 20 nt, Homo sapiens
ccacaccacaaccaccuuca

SEQ ID NO: 529791 - RNA, 12 nt, Homo sapiens
ccacacccaaag

SEQ ID NO: 529792 - RNA, 15 nt, Homo sapiens
ccacacccacuuugu

SEQ ID NO: 529793 - RNA, 16 nt, Homo sapiens
ccacagaguuuuucag

SEQ ID NO: 529794 - RNA, 14 nt, Homo sapiens
ccacagcugccauc

SEQ ID NO: 529795 - RNA, 14 nt, Homo sapiens
ccacaggcacaggu

SEQ ID NO: 529796 - RNA, 22 nt, Homo sapiens
ccacaguccuucuuugacacca

SEQ ID NO: 529797 - RNA, 21 nt, Homo sapiens
ccacauauuuuagacacuucc

SEQ ID NO: 529798 - RNA, 22 nt, Homo sapiens
ccacauauuuuagacacuuccc

SEQ ID NO: 529799 - RNA, 19 nt, Homo sapiens
ccaccccccacucagugcc

SEQ ID NO: 529800 - RNA, 20 nt, Homo sapiens
ccaccucggcacacacugug

SEQ ID NO: 529801 - RNA, 16 nt, Homo sapiens
ccaccugacucuugca

SEQ ID NO: 529802 - RNA, 21 nt, Homo sapiens
ccaccuuccccagaaccaggg

SEQ ID NO: 529803 - RNA, 13 nt, Homo sapiens
ccacugcuguauu

SEQ ID NO: 529804 - RNA, 16 nt, Homo sapiens
ccagacucugucucaa

SEQ ID NO: 529805 - RNA, 23 nt, Homo sapiens
ccagacuugggaggauguacagu

SEQ ID NO: 529806 - RNA, 13 nt, Homo sapiens
ccagagaugcugg

SEQ ID NO: 529807 - RNA, 14 nt, Homo sapiens
ccagaggcucuaau

SEQ ID NO: 529808 - RNA, 22 nt, Homo sapiens
ccagaggcucuaauguacaaua

SEQ ID NO: 529809 - RNA, 23 nt, Homo sapiens
ccagaggcucuaauguacaauaa

SEQ ID NO: 529810 - RNA, 12 nt, Homo sapiens
ccagcaucuccc

SEQ ID NO: 529811 - RNA, 18 nt, Homo sapiens
ccagccuggccaacaugg

SEQ ID NO: 529812 - RNA, 22 nt, Homo sapiens
ccagccuggccaacauggugaa

SEQ ID NO: 529813 - RNA, 22 nt, Homo sapiens
ccaggaggagaaagcagccauu

SEQ ID NO: 529814 - RNA, 13 nt, Homo sapiens
ccaggcuaccauc

SEQ ID NO: 529815 - RNA, 14 nt, Homo sapiens
ccaggcuuuguaca

SEQ ID NO: 529816 - RNA, 12 nt, Homo sapiens
ccagggccagug

SEQ ID NO: 529817 - RNA, 22 nt, Homo sapiens
ccaggggaaccugccaugccag

SEQ ID NO: 529818 - RNA, 22 nt, Homo sapiens
ccagguguucuacacucaucuu

SEQ ID NO: 529819 - RNA, 19 nt, Homo sapiens
ccagugcuuuauguuguug

SEQ ID NO: 529820 - RNA, 14 nt, Homo sapiens
ccauaaaguacaaa

SEQ ID NO: 529821 - RNA, 16 nt, Homo sapiens
ccauaauguugcuucu

SEQ ID NO: 529822 - RNA, 18 nt, Homo sapiens
aaucaguaaauaguguca

SEQ ID NO: 529823 - RNA, 15 nt, Homo sapiens
aaucagucagccgcu

SEQ ID NO: 529824 - RNA, 20 nt, Homo sapiens
aaucaugauccuuguguuca

SEQ ID NO: 529825 - RNA, 14 nt, Homo sapiens
aaucccagcacuuu

SEQ ID NO: 529826 - RNA, 12 nt, Homo sapiens
aaucccuuucug

SEQ ID NO: 529827 - RNA, 15 nt, Homo sapiens
aauccgcauugaugg

SEQ ID NO: 529828 - RNA, 22 nt, Homo sapiens
aaucgacuguauucgugcauuu

SEQ ID NO: 529829 - RNA, 15 nt, Homo sapiens
aaucuaacaucgugg

SEQ ID NO: 529830 - RNA, 13 nt, Homo sapiens
aaucuccaugugu

SEQ ID NO: 529831 - RNA, 20 nt, Homo sapiens
aaucuguccguucacaugug

SEQ ID NO: 529832 - RNA, 21 nt, Homo sapiens
aaucuguccguucacaugugu

SEQ ID NO: 529833 - RNA, 11 nt, Homo sapiens
aaucuucaggu

SEQ ID NO: 529834 - RNA, 20 nt, Homo sapiens
aaugaaaagcugaauccaga

SEQ ID NO: 529835 - RNA, 15 nt, Homo sapiens
aaugaaaucuuccca

SEQ ID NO: 529836 - RNA, 13 nt, Homo sapiens
aaugaacacuccc

SEQ ID NO: 529837 - RNA, 22 nt, Homo sapiens
aaugaagaacacuguagcuaca

SEQ ID NO: 529838 - RNA, 21 nt, Homo sapiens
aaugacacgccuaaggucaca

SEQ ID NO: 529839 - RNA, 11 nt, Homo sapiens
aaugagugugc

SEQ ID NO: 529840 - RNA, 13 nt, Homo sapiens
aaugcaaccauuu

SEQ ID NO: 529841 - RNA, 20 nt, Homo sapiens
aaugcauaauaacuacuucc

SEQ ID NO: 529842 - RNA, 22 nt, Homo sapiens
aaugcauaauaacuacuuccau

SEQ ID NO: 529843 - RNA, 20 nt, Homo sapiens
aaugcauauuugccacaaaa

SEQ ID NO: 529844 - RNA, 22 nt, Homo sapiens
aaugcauuguuguucugcucaa

SEQ ID NO: 529845 - RNA, 19 nt, Homo sapiens
aaugcugcccgcucugcag

SEQ ID NO: 529846 - RNA, 17 nt, Homo sapiens
aaugcuucauaugagga

SEQ ID NO: 529847 - RNA, 17 nt, Homo sapiens
aaugcuucauuauucaa

SEQ ID NO: 529848 - RNA, 15 nt, Homo sapiens
aaugcuucuguugau

SEQ ID NO: 529849 - RNA, 12 nt, Homo sapiens
aauggaaaccaa

SEQ ID NO: 529850 - RNA, 20 nt, Homo sapiens
aauggcuaagauaccaaaac

SEQ ID NO: 529851 - RNA, 14 nt, Homo sapiens
aauguaacacuggc

SEQ ID NO: 529852 - RNA, 16 nt, Homo sapiens
aauguacaauaaagca

SEQ ID NO: 529853 - RNA, 18 nt, Homo sapiens
aauguacaauaaagcaau

SEQ ID NO: 529854 - RNA, 19 nt, Homo sapiens
aauguacaauaaagcaaug

SEQ ID NO: 529855 - RNA, 20 nt, Homo sapiens
aauguacaauaaagcaaugu

SEQ ID NO: 529856 - RNA, 13 nt, Homo sapiens
aauguagucaaua

SEQ ID NO: 529857 - RNA, 22 nt, Homo sapiens
aaugucucaugucaaugaccau

SEQ ID NO: 529858 - RNA, 15 nt, Homo sapiens
aaugucugaaaugga

SEQ ID NO: 529859 - RNA, 20 nt, Homo sapiens
aaugugaauaauggcacuga

SEQ ID NO: 529860 - RNA, 17 nt, Homo sapiens
aaugugaccuggggcag

SEQ ID NO: 529861 - RNA, 18 nt, Homo sapiens
aaugugcagaugcaauug

SEQ ID NO: 529862 - RNA, 18 nt, Homo sapiens
aauguggcuccaagcuca

SEQ ID NO: 529863 - RNA, 18 nt, Homo sapiens
aauguuaauguuauauca

SEQ ID NO: 529864 - RNA, 19 nt, Homo sapiens
aauguuuaauaaagcuuua

SEQ ID NO: 529865 - RNA, 22 nt, Homo sapiens
aauucagaagaccccugacuca

SEQ ID NO: 529866 - RNA, 14 nt, Homo sapiens
aauucagaguccuu

SEQ ID NO: 529867 - RNA, 22 nt, Homo sapiens
aauucagcuuuguccaaaggaa

SEQ ID NO: 529868 - RNA, 21 nt, Homo sapiens
aauuccaucaucacuuuggac

SEQ ID NO: 529869 - RNA, 22 nt, Homo sapiens
aauuccuacugacaacauuaua

SEQ ID NO: 529870 - RNA, 14 nt, Homo sapiens
aauucuccauuaau

SEQ ID NO: 529871 - RNA, 15 nt, Homo sapiens
aauucugagccugau

SEQ ID NO: 529872 - RNA, 18 nt, Homo sapiens
aauucugagccugauauu

SEQ ID NO: 529873 - RNA, 18 nt, Homo sapiens
aauucugauugauuugau

SEQ ID NO: 529874 - RNA, 18 nt, Homo sapiens
aauucuucuguccugaga

SEQ ID NO: 529875 - RNA, 17 nt, Homo sapiens
aauuggagaagauuuau

SEQ ID NO: 529876 - RNA, 19 nt, Homo sapiens
aauugucuaaaaugucagu

SEQ ID NO: 529877 - RNA, 15 nt, Homo sapiens
aauugugaacaugau

SEQ ID NO: 529878 - RNA, 14 nt, Homo sapiens
aauuuaaaagcaca

SEQ ID NO: 529879 - RNA, 13 nt, Homo sapiens
aauuuaauaccag

SEQ ID NO: 529880 - RNA, 15 nt, Homo sapiens
aauuuagaaacugaa

SEQ ID NO: 529881 - RNA, 12 nt, Homo sapiens
aauuuauauuca

SEQ ID NO: 529882 - RNA, 17 nt, Homo sapiens
aauuuauauucauaaag

SEQ ID NO: 529883 - RNA, 15 nt, Homo sapiens
aauuuauugaguuuu

SEQ ID NO: 529884 - RNA, 20 nt, Homo sapiens
aauuuauugaguuuuuacaa

SEQ ID NO: 529885 - RNA, 17 nt, Homo sapiens
aauuucauuuuuuaugu

SEQ ID NO: 529886 - RNA, 17 nt, Homo sapiens
aauuugaugauuuucau

SEQ ID NO: 529887 - RNA, 22 nt, Homo sapiens
aauuuuauugacacaguaccau

SEQ ID NO: 529888 - RNA, 14 nt, Homo sapiens
accugccugcauuc

SEQ ID NO: 529889 - RNA, 21 nt, Homo sapiens
accugcgcucucagcugacca

SEQ ID NO: 529890 - RNA, 16 nt, Homo sapiens
accuggagaugcugcc

SEQ ID NO: 529891 - RNA, 19 nt, Homo sapiens
accuggaggacagcuggac

SEQ ID NO: 529892 - RNA, 20 nt, Homo sapiens
accuggcagacuugcccagg

SEQ ID NO: 529893 - RNA, 19 nt, Homo sapiens
accuggcccuugcaaucuu

SEQ ID NO: 529894 - RNA, 20 nt, Homo sapiens
accugggcccaggaccugcc

SEQ ID NO: 529895 - RNA, 21 nt, Homo sapiens
accuggggagugguuaggcag

SEQ ID NO: 529896 - RNA, 15 nt, Homo sapiens
accuguccaagacag

SEQ ID NO: 529897 - RNA, 14 nt, Homo sapiens
accugucucagcug

SEQ ID NO: 529898 - RNA, 22 nt, Homo sapiens
accuguuaauuuuuauacugac

SEQ ID NO: 529899 - RNA, 18 nt, Homo sapiens
accuuaagauuuugcacc

SEQ ID NO: 529900 - RNA, 13 nt, Homo sapiens
accuucaauacuu

SEQ ID NO: 529901 - RNA, 14 nt, Homo sapiens
accuucaccuggau

SEQ ID NO: 529902 - RNA, 14 nt, Homo sapiens
accuucacucucca

SEQ ID NO: 529903 - RNA, 15 nt, Homo sapiens
accuucacucuccag

SEQ ID NO: 529904 - RNA, 15 nt, Homo sapiens
accuuccaacacucc

SEQ ID NO: 529905 - RNA, 17 nt, Homo sapiens
accuuccaacacuccau

SEQ ID NO: 529906 - RNA, 16 nt, Homo sapiens
accuucguccuuuuaa

SEQ ID NO: 529907 - RNA, 13 nt, Homo sapiens
accuugugccugg

SEQ ID NO: 529908 - RNA, 21 nt, Homo sapiens
accuuucacgaacaugggcau

SEQ ID NO: 529909 - RNA, 19 nt, Homo sapiens
acgaagaguucccuugaaa

SEQ ID NO: 529910 - RNA, 21 nt, Homo sapiens
acgcaggccagcaacucccag

SEQ ID NO: 529911 - RNA, 15 nt, Homo sapiens
acgccuguaauccca

SEQ ID NO: 529912 - RNA, 21 nt, Homo sapiens
acgcuucgggaaaauauucau

SEQ ID NO: 529913 - RNA, 22 nt, Homo sapiens
acgguaccaauucagugucugu

SEQ ID NO: 529914 - RNA, 18 nt, Homo sapiens
acggucuccugacuggug

SEQ ID NO: 529915 - RNA, 13 nt, Homo sapiens
acgugacaggcuc

SEQ ID NO: 529916 - RNA, 14 nt, Homo sapiens
acuaaacaguaaga

SEQ ID NO: 529917 - RNA, 13 nt, Homo sapiens
acuaacauuguga

SEQ ID NO: 529918 - RNA, 14 nt, Homo sapiens
acuaaccaucugaa

SEQ ID NO: 529919 - RNA, 16 nt, Homo sapiens
acuaaugauguuuucc

SEQ ID NO: 529920 - RNA, 16 nt, Homo sapiens
acuaauuuuacuucua

SEQ ID NO: 529921 - RNA, 14 nt, Homo sapiens
acuacaagucagcu

SEQ ID NO: 529922 - RNA, 14 nt, Homo sapiens
acuacuauauugau

SEQ ID NO: 529923 - RNA, 21 nt, Homo sapiens
acuauuuaaaggaaaaucaca

SEQ ID NO: 529924 - RNA, 17 nt, Homo sapiens
acucaaacagucuuucu

SEQ ID NO: 529925 - RNA, 20 nt, Homo sapiens
acucagaggaggacauuugg

SEQ ID NO: 529926 - RNA, 15 nt, Homo sapiens
acucaggccacagug

SEQ ID NO: 529927 - RNA, 13 nt, Homo sapiens
acucaggccagug

SEQ ID NO: 529928 - RNA, 10 nt, Homo sapiens
acucagucuu

SEQ ID NO: 529929 - RNA, 11 nt, Homo sapiens
acucagugcag

SEQ ID NO: 529930 - RNA, 18 nt, Homo sapiens
acucagugccuccacaug

SEQ ID NO: 529931 - RNA, 15 nt, Homo sapiens
acucauuuaucuccu

SEQ ID NO: 529932 - RNA, 15 nt, Homo sapiens
acuccauuauuccuc

SEQ ID NO: 529933 - RNA, 16 nt, Homo sapiens
acuccauuauuccucu

SEQ ID NO: 529934 - RNA, 23 nt, Homo sapiens
acuccccauuaacagauggaaaa

SEQ ID NO: 529935 - RNA, 14 nt, Homo sapiens
acuccuacuuuuca

SEQ ID NO: 529936 - RNA, 21 nt, Homo sapiens
acucuaaagucuguugauuaa

SEQ ID NO: 529937 - RNA, 16 nt, Homo sapiens
acucuaggguccagug

SEQ ID NO: 529938 - RNA, 18 nt, Homo sapiens
acucuaggguccagugga

SEQ ID NO: 529939 - RNA, 20 nt, Homo sapiens
acucuaucauuggccuccaa

SEQ ID NO: 529940 - RNA, 20 nt, Homo sapiens
acucucuguuuuaguguuua

SEQ ID NO: 529941 - RNA, 16 nt, Homo sapiens
acucugcacagccuag

SEQ ID NO: 529942 - RNA, 14 nt, Homo sapiens
acucugccauuaaa

SEQ ID NO: 529943 - RNA, 15 nt, Homo sapiens
acucugcccaggugu

SEQ ID NO: 529944 - RNA, 19 nt, Homo sapiens
acucugcugcaaaaugaag

SEQ ID NO: 529945 - RNA, 19 nt, Homo sapiens
acucugggcugccauguga

SEQ ID NO: 529946 - RNA, 22 nt, Homo sapiens
gaacccuccuuuucucugagau

SEQ ID NO: 529947 - RNA, 16 nt, Homo sapiens
gaaccuguccuaagga

SEQ ID NO: 529948 - RNA, 21 nt, Homo sapiens
gaaccuguguuaucacaguaa

SEQ ID NO: 529949 - RNA, 21 nt, Homo sapiens
gaacuaaaaauuaaaaccucu

SEQ ID NO: 529950 - RNA, 15 nt, Homo sapiens
gaacuccagagucag

SEQ ID NO: 529951 - RNA, 17 nt, Homo sapiens
gaacucugcccaggugu

SEQ ID NO: 529952 - RNA, 12 nt, Homo sapiens
gaacuugcaaua

SEQ ID NO: 529953 - RNA, 16 nt, Homo sapiens
gaagaaccaaauaccu

SEQ ID NO: 529954 - RNA, 22 nt, Homo sapiens
gaagaauacccaggaagacuuu

SEQ ID NO: 529955 - RNA, 11 nt, Homo sapiens
gaagacauuuu

SEQ ID NO: 529956 - RNA, 18 nt, Homo sapiens
gaagcaaguuuucuucca

SEQ ID NO: 529957 - RNA, 23 nt, Homo sapiens
gaagcaguuuaugagacagcuga

SEQ ID NO: 529958 - RNA, 13 nt, Homo sapiens
gaagccuagggga

SEQ ID NO: 529959 - RNA, 15 nt, Homo sapiens
gaagggaauccuccu

SEQ ID NO: 529960 - RNA, 15 nt, Homo sapiens
gaagggaauugcuca

SEQ ID NO: 529961 - RNA, 14 nt, Homo sapiens
gaaguauggugugu

SEQ ID NO: 529962 - RNA, 15 nt, Homo sapiens
gaaguaugguguguu

SEQ ID NO: 529963 - RNA, 22 nt, Homo sapiens
gaagucaccccuuucuguccca

SEQ ID NO: 529964 - RNA, 13 nt, Homo sapiens
gaagucaucucau

SEQ ID NO: 529965 - RNA, 13 nt, Homo sapiens
gaagucuccucaa

SEQ ID NO: 529966 - RNA, 17 nt, Homo sapiens
gaagugaaaacuuugua

SEQ ID NO: 529967 - RNA, 17 nt, Homo sapiens
gaauaaauaauucuucc

SEQ ID NO: 529968 - RNA, 15 nt, Homo sapiens
gaauaaccaucugaa

SEQ ID NO: 529969 - RNA, 19 nt, Homo sapiens
gaaucuagagcaaagccau

SEQ ID NO: 529970 - RNA, 15 nt, Homo sapiens
gaaugcuggcaaagg

SEQ ID NO: 529971 - RNA, 14 nt, Homo sapiens
gaaugggacuguga

SEQ ID NO: 529972 - RNA, 20 nt, Homo sapiens
gaauggguguuguaugggga

SEQ ID NO: 529973 - RNA, 20 nt, Homo sapiens
gaaugguacaugucuuccau

SEQ ID NO: 529974 - RNA, 19 nt, Homo sapiens
gaauuagcaauaacauaca

SEQ ID NO: 529975 - RNA, 22 nt, Homo sapiens
gaauuuaguauuaucaaaggga

SEQ ID NO: 529976 - RNA, 21 nt, Homo sapiens
gacaaaggaguaguagcugaa

SEQ ID NO: 529977 - RNA, 13 nt, Homo sapiens
gacaaucacuaca

SEQ ID NO: 529978 - RNA, 18 nt, Homo sapiens
gacaaucacuacaaguca

SEQ ID NO: 529979 - RNA, 19 nt, Homo sapiens
gacacauagaaaacaauca

SEQ ID NO: 529980 - RNA, 17 nt, Homo sapiens
cucuugcccauccugac

SEQ ID NO: 529981 - RNA, 16 nt, Homo sapiens
cucuuuagauauuuac

SEQ ID NO: 529982 - RNA, 15 nt, Homo sapiens
cucuuugcugcacua

SEQ ID NO: 529983 - RNA, 16 nt, Homo sapiens
cugaaagccuuaggga

SEQ ID NO: 529984 - RNA, 14 nt, Homo sapiens
cugaaauuacuuua

SEQ ID NO: 529985 - RNA, 22 nt, Homo sapiens
cugaagcugacagcacuacaaa

SEQ ID NO: 529986 - RNA, 18 nt, Homo sapiens
cugaaggcagucauauca

SEQ ID NO: 529987 - RNA, 17 nt, Homo sapiens
cugaauaaaugauuaaa

SEQ ID NO: 529988 - RNA, 13 nt, Homo sapiens
cugaauaauauca

SEQ ID NO: 529989 - RNA, 12 nt, Homo sapiens
cugaauauugcc

SEQ ID NO: 529990 - RNA, 12 nt, Homo sapiens
cugaaucuaccu

SEQ ID NO: 529991 - RNA, 19 nt, Homo sapiens
cugaauuugauucuccagc

SEQ ID NO: 529992 - RNA, 12 nt, Homo sapiens
cugacaaagaca

SEQ ID NO: 529993 - RNA, 21 nt, Homo sapiens
cugacacauagaaaacaauca

SEQ ID NO: 529994 - RNA, 22 nt, Homo sapiens
cugacagacaaugauccaguca

SEQ ID NO: 529995 - RNA, 23 nt, Homo sapiens
cugacaguuaauaaaccuuugca

SEQ ID NO: 529996 - RNA, 21 nt, Homo sapiens
cugacauuucuucuagugaug

SEQ ID NO: 529997 - RNA, 18 nt, Homo sapiens
cugaccaucgcacaccgg

SEQ ID NO: 529998 - RNA, 13 nt, Homo sapiens
cugacgcagcaca

SEQ ID NO: 529999 - RNA, 17 nt, Homo sapiens
cugacgcagcacaagcu

SEQ ID NO: 530000 - RNA, 15 nt, Homo sapiens
cugacggcgccuuuu

SEQ ID NO: 530001 - RNA, 23 nt, Homo sapiens
cugacuaauuuuuguauuuuuag

SEQ ID NO: 530002 - RNA, 12 nt, Homo sapiens
cugacucuccag

SEQ ID NO: 530003 - RNA, 14 nt, Homo sapiens
cugagaccaaagaa

SEQ ID NO: 530004 - RNA, 17 nt, Homo sapiens
cugagagaauuggcuca

SEQ ID NO: 530005 - RNA, 17 nt, Homo sapiens
cugagaugcucacuuua

SEQ ID NO: 530006 - RNA, 18 nt, Homo sapiens
cugagauuuccuccuggc

SEQ ID NO: 530007 - RNA, 17 nt, Homo sapiens
cugaggguguuucuucc

SEQ ID NO: 530008 - RNA, 20 nt, Homo sapiens
cugaggugcuaugaagccaa

SEQ ID NO: 530009 - RNA, 18 nt, Homo sapiens
cugagucugcaugugcac

SEQ ID NO: 530010 - RNA, 17 nt, Homo sapiens
cugaguguuauuugcac

SEQ ID NO: 530011 - RNA, 19 nt, Homo sapiens
cugaguguuauuugcacac

SEQ ID NO: 530012 - RNA, 17 nt, Homo sapiens
cugauaagcuuccuaga

SEQ ID NO: 530013 - RNA, 20 nt, Homo sapiens
cugauggacaggugucugag

SEQ ID NO: 530014 - RNA, 19 nt, Homo sapiens
cugauugaagacacacuca

SEQ ID NO: 530015 - RNA, 16 nt, Homo sapiens
cugauuuucuggaaug

SEQ ID NO: 530016 - RNA, 16 nt, Homo sapiens
cugauuuuugucccag

SEQ ID NO: 530017 - RNA, 13 nt, Homo sapiens
agcaaacacuggg

SEQ ID NO: 530018 - RNA, 14 nt, Homo sapiens
agcaaccacacgga

SEQ ID NO: 530019 - RNA, 14 nt, Homo sapiens
agcaacucagagaa

SEQ ID NO: 530020 - RNA, 22 nt, Homo sapiens
agcaaguguucacaacagugaa

SEQ ID NO: 530021 - RNA, 16 nt, Homo sapiens
agcaaguuuucuucca

SEQ ID NO: 530022 - RNA, 16 nt, Homo sapiens
agcaauucuccugccu

SEQ ID NO: 530023 - RNA, 21 nt, Homo sapiens
agcacaucuuugaccacguca

SEQ ID NO: 530024 - RNA, 19 nt, Homo sapiens
agcaccacacccaguggga

SEQ ID NO: 530025 - RNA, 21 nt, Homo sapiens
agcaccuccgccagauccugc

SEQ ID NO: 530026 - RNA, 15 nt, Homo sapiens
agcacguggagcucu

SEQ ID NO: 530027 - RNA, 20 nt, Homo sapiens
agcacguggagcucuuggcu

SEQ ID NO: 530028 - RNA, 17 nt, Homo sapiens
agcacuggggagucuuu

SEQ ID NO: 530029 - RNA, 20 nt, Homo sapiens
agcagaacagaucuuuuacu

SEQ ID NO: 530030 - RNA, 21 nt, Homo sapiens
agcagacucuggaggccugug

SEQ ID NO: 530031 - RNA, 22 nt, Homo sapiens
agcagaggaggggaaaguccag

SEQ ID NO: 530032 - RNA, 15 nt, Homo sapiens
agcagaugguuucca

SEQ ID NO: 530033 - RNA, 18 nt, Homo sapiens
agcagcacgauuuugcac

SEQ ID NO: 530034 - RNA, 15 nt, Homo sapiens
agcagucgccugccu

SEQ ID NO: 530035 - RNA, 21 nt, Homo sapiens
agcaguuuaugagacagcuga

SEQ ID NO: 530036 - RNA, 19 nt, Homo sapiens
agcauaccugucucagcug

SEQ ID NO: 530037 - RNA, 20 nt, Homo sapiens
agcauagaaaccacuagaaa

SEQ ID NO: 530038 - RNA, 22 nt, Homo sapiens
agcauauaggugauguuugcuc

SEQ ID NO: 530039 - RNA, 20 nt, Homo sapiens
agcaugugccuuaaugcuuc

SEQ ID NO: 530040 - RNA, 21 nt, Homo sapiens
agcauguggucuuauaguguu

SEQ ID NO: 530041 - RNA, 22 nt, Homo sapiens
agcauguguauuuccagugcaa

SEQ ID NO: 530042 - RNA, 20 nt, Homo sapiens
agcauguuuuguugcucagu

SEQ ID NO: 530043 - RNA, 15 nt, Homo sapiens
agcauuacccuccuc

SEQ ID NO: 530044 - RNA, 12 nt, Homo sapiens
agccaaccucau

SEQ ID NO: 530045 - RNA, 20 nt, Homo sapiens
agccaagagugcacuacugu

SEQ ID NO: 530046 - RNA, 17 nt, Homo sapiens
agccacaccuuuuccag

SEQ ID NO: 530047 - RNA, 15 nt, Homo sapiens
agccagaggcucuaa

SEQ ID NO: 530048 - RNA, 19 nt, Homo sapiens
agccagaggcucuaaugua

SEQ ID NO: 530049 - RNA, 23 nt, Homo sapiens
agccagaggcucuaauguacaau

SEQ ID NO: 530050 - RNA, 18 nt, Homo sapiens
agccaguuaaaauguguu

SEQ ID NO: 530051 - RNA, 18 nt, Homo sapiens
agccaguuguugccaacc

SEQ ID NO: 530052 - RNA, 17 nt, Homo sapiens
agcccacccugcugcug

SEQ ID NO: 530053 - RNA, 16 nt, Homo sapiens
agccccagaguggcuc

SEQ ID NO: 530054 - RNA, 23 nt, Homo sapiens
agccccuggccugugccuuccaa

SEQ ID NO: 530055 - RNA, 12 nt, Homo sapiens
agcccugaaccc

SEQ ID NO: 530056 - RNA, 19 nt, Homo sapiens
agccucaauucuccauuaa

SEQ ID NO: 530057 - RNA, 19 nt, Homo sapiens
agccucaugccaacccugg

SEQ ID NO: 530058 - RNA, 23 nt, Homo sapiens
agccucgcgggugucacauuccu

SEQ ID NO: 530059 - RNA, 18 nt, Homo sapiens
agccugcucccuagccag

SEQ ID NO: 530060 - RNA, 22 nt, Homo sapiens
agccugggguguccuacaguga

SEQ ID NO: 530061 - RNA, 19 nt, Homo sapiens
agcgagcagucagcauucu

SEQ ID NO: 530062 - RNA, 16 nt, Homo sapiens
agcgcaugcuggugca

SEQ ID NO: 530063 - RNA, 14 nt, Homo sapiens
agcgcuuugaauau

SEQ ID NO: 530064 - RNA, 16 nt, Homo sapiens
agcgucaagacauuug

SEQ ID NO: 530065 - RNA, 18 nt, Homo sapiens
agcgucacggccaagugu

SEQ ID NO: 530066 - RNA, 15 nt, Homo sapiens
agcguggggacuucu

SEQ ID NO: 530067 - RNA, 21 nt, Homo sapiens
agcuaagggugggugcucaga

SEQ ID NO: 530068 - RNA, 19 nt, Homo sapiens
agcuaauaacaugugaaaa

SEQ ID NO: 530069 - RNA, 15 nt, Homo sapiens
agcuacaggacauuu

SEQ ID NO: 530070 - RNA, 14 nt, Homo sapiens
agcuaccagguguu

SEQ ID NO: 530071 - RNA, 16 nt, Homo sapiens
agcuaguguaccuccu

SEQ ID NO: 530072 - RNA, 23 nt, Homo sapiens
agcucaggaaggggugugcugag

SEQ ID NO: 530073 - RNA, 16 nt, Homo sapiens
cccuggcugugcucua

SEQ ID NO: 530074 - RNA, 14 nt, Homo sapiens
cccugggccagggu

SEQ ID NO: 530075 - RNA, 12 nt, Homo sapiens
cccugucauccu

SEQ ID NO: 530076 - RNA, 14 nt, Homo sapiens
cccugucucaaaaa

SEQ ID NO: 530077 - RNA, 18 nt, Homo sapiens
cccugugguccugaauuc

SEQ ID NO: 530078 - RNA, 20 nt, Homo sapiens
cccuguguccaccugugggu

SEQ ID NO: 530079 - RNA, 14 nt, Homo sapiens
ccgaccacuuccag

SEQ ID NO: 530080 - RNA, 17 nt, Homo sapiens
ccgaggacaguggcaga

SEQ ID NO: 530081 - RNA, 12 nt, Homo sapiens
ccgcacuuccuu

SEQ ID NO: 530082 - RNA, 17 nt, Homo sapiens
ccgccagcgaacuugac

SEQ ID NO: 530083 - RNA, 16 nt, Homo sapiens
ccggcagcacaagcug

SEQ ID NO: 530084 - RNA, 19 nt, Homo sapiens
ccguagcucugcugcugau

SEQ ID NO: 530085 - RNA, 13 nt, Homo sapiens
ccgugacugcaau

SEQ ID NO: 530086 - RNA, 20 nt, Homo sapiens
ccgugugagugugacagggc

SEQ ID NO: 530087 - RNA, 15 nt, Homo sapiens
ccuaaaagcacuccu

SEQ ID NO: 530088 - RNA, 18 nt, Homo sapiens
ccuaaaauauauuccuga

SEQ ID NO: 530089 - RNA, 11 nt, Homo sapiens
ccuaacacagu

SEQ ID NO: 530090 - RNA, 18 nt, Homo sapiens
ccuaagcagaaaacuggc

SEQ ID NO: 530091 - RNA, 17 nt, Homo sapiens
ccuagaccuggugcuga

SEQ ID NO: 530092 - RNA, 18 nt, Homo sapiens
ccuagccagaggcucuaa

SEQ ID NO: 530093 - RNA, 21 nt, Homo sapiens
ccuagcuacuuggcaggcuaa

SEQ ID NO: 530094 - RNA, 15 nt, Homo sapiens
ccuaggaacucaguc

SEQ ID NO: 530095 - RNA, 22 nt, Homo sapiens
ccuaguacugccccccaugagg

SEQ ID NO: 530096 - RNA, 20 nt, Homo sapiens
ccuaguagcugggaugacag

SEQ ID NO: 530097 - RNA, 20 nt, Homo sapiens
ccuagucuagcauucugcaa

SEQ ID NO: 530098 - RNA, 14 nt, Homo sapiens
ccuauuuauuugag

SEQ ID NO: 530099 - RNA, 21 nt, Homo sapiens
ccuauuucaugcagaguugaa

SEQ ID NO: 530100 - RNA, 16 nt, Homo sapiens
ccucaaagaggccuua

SEQ ID NO: 530101 - RNA, 21 nt, Homo sapiens
ccucagcaguccacaaagcau

SEQ ID NO: 530102 - RNA, 18 nt, Homo sapiens
ccucagggagcagggaag

SEQ ID NO: 530103 - RNA, 20 nt, Homo sapiens
ccucaggugaaacuccagau

SEQ ID NO: 530104 - RNA, 19 nt, Homo sapiens
ccucaugcugcucaauucc

SEQ ID NO: 530105 - RNA, 13 nt, Homo sapiens
ccuccauccagaa

SEQ ID NO: 530106 - RNA, 13 nt, Homo sapiens
ccuccccacagga

SEQ ID NO: 530107 - RNA, 17 nt, Homo sapiens
ccuccuccccuagggaa

SEQ ID NO: 530108 - RNA, 14 nt, Homo sapiens
ccuccugcacacag

SEQ ID NO: 530109 - RNA, 13 nt, Homo sapiens
ccucggcacacac

SEQ ID NO: 530110 - RNA, 21 nt, Homo sapiens
ccucucgccucauuacuguga

SEQ ID NO: 530111 - RNA, 11 nt, Homo sapiens
ccucugcauuu

SEQ ID NO: 530112 - RNA, 14 nt, Homo sapiens
ccucugcauuuaca

SEQ ID NO: 530113 - RNA, 18 nt, Homo sapiens
ccucuucuuugugccuuu

SEQ ID NO: 530114 - RNA, 12 nt, Homo sapiens
ccugaaagccac

SEQ ID NO: 530115 - RNA, 19 nt, Homo sapiens
ccugaaagccacaaugaga

SEQ ID NO: 530116 - RNA, 22 nt, Homo sapiens
ccugaauucuuuccccaaagac

SEQ ID NO: 530117 - RNA, 13 nt, Homo sapiens
ccugacgcagcac

SEQ ID NO: 530118 - RNA, 15 nt, Homo sapiens
ccugaggaagaugac

SEQ ID NO: 530119 - RNA, 16 nt, Homo sapiens
ccugcaugugcuguca

SEQ ID NO: 530120 - RNA, 16 nt, Homo sapiens
ccugccccugccccau

SEQ ID NO: 530121 - RNA, 23 nt, Homo sapiens
ccugccucccacuucacugcgaa

SEQ ID NO: 530122 - RNA, 16 nt, Homo sapiens
ccugcucccuagccag

SEQ ID NO: 530123 - RNA, 17 nt, Homo sapiens
ccugcucccuagccaga

SEQ ID NO: 530124 - RNA, 17 nt, Homo sapiens
ccugcugcuggugcaca

SEQ ID NO: 530125 - RNA, 21 nt, Homo sapiens
ccuggcccccacccucugcca

SEQ ID NO: 530126 - RNA, 17 nt, Homo sapiens
ccuggccuuguccucag

SEQ ID NO: 530127 - RNA, 21 nt, Homo sapiens
ccuggggagugguuaggcagc

SEQ ID NO: 530128 - RNA, 20 nt, Homo sapiens
ccugggguguccuacaguga

SEQ ID NO: 530129 - RNA, 12 nt, Homo sapiens
ccuggugagaaa

SEQ ID NO: 530130 - RNA, 17 nt, Homo sapiens
ccuguagcagucacuga

SEQ ID NO: 530131 - RNA, 21 nt, Homo sapiens
ccuguccaagacagggcucau

SEQ ID NO: 530132 - RNA, 18 nt, Homo sapiens
ccuguccugacucucucc

SEQ ID NO: 530133 - RNA, 21 nt, Homo sapiens
ccugucuuaauuuucuuucac

SEQ ID NO: 530134 - RNA, 16 nt, Homo sapiens
ccugugugcgugcgca

SEQ ID NO: 530135 - RNA, 22 nt, Homo sapiens
ccuguugucaagaauagcauug

SEQ ID NO: 530136 - RNA, 12 nt, Homo sapiens
ccuuaaccuuaa

SEQ ID NO: 530137 - RNA, 15 nt, Homo sapiens
ccuuaacgcuagaga

SEQ ID NO: 530138 - RNA, 17 nt, Homo sapiens
ccuuagagcuuggacag

SEQ ID NO: 530139 - RNA, 23 nt, Homo sapiens
ccuuagagcuuggacagucugag

SEQ ID NO: 530140 - RNA, 20 nt, Homo sapiens
ccuuagccaggaggccaggc

SEQ ID NO: 530141 - RNA, 17 nt, Homo sapiens
ccuucagugaacuaagu

SEQ ID NO: 530142 - RNA, 15 nt, Homo sapiens
ccuucggcagcuacu

SEQ ID NO: 530143 - RNA, 17 nt, Homo sapiens
ccuucggcagcuacuca

SEQ ID NO: 530144 - RNA, 18 nt, Homo sapiens
ccuucggcagcuacucag

SEQ ID NO: 530145 - RNA, 22 nt, Homo sapiens
ccuucucacacacaacugucca

SEQ ID NO: 530146 - RNA, 18 nt, Homo sapiens
ccuucuccacacccacuu

SEQ ID NO: 530147 - RNA, 20 nt, Homo sapiens
ccuugcucuccucaucucca

SEQ ID NO: 530148 - RNA, 17 nt, Homo sapiens
ccuuggguccauuuucu

SEQ ID NO: 530149 - RNA, 21 nt, Homo sapiens
ccuuguaccucaaucuauucu

SEQ ID NO: 530150 - RNA, 21 nt, Homo sapiens
ccuuuaccuuuuaugcaaaag

SEQ ID NO: 530151 - RNA, 19 nt, Homo sapiens
ccuuuaggaucucaggcuu

SEQ ID NO: 530152 - RNA, 20 nt, Homo sapiens
ccuuuggauugacucugcau

SEQ ID NO: 530153 - RNA, 20 nt, Homo sapiens
ccuuugguuuuaaaagagaa

SEQ ID NO: 530154 - RNA, 14 nt, Homo sapiens
ccuuuuaaaaaccu

SEQ ID NO: 530155 - RNA, 15 nt, Homo sapiens
uuuuaauuuacuugu

SEQ ID NO: 530156 - RNA, 14 nt, Homo sapiens
uuuuacacauuaga

SEQ ID NO: 530157 - RNA, 18 nt, Homo sapiens
uuuuaccugcccaaggau

SEQ ID NO: 530158 - RNA, 15 nt, Homo sapiens
uuuuaugcuacugaa

SEQ ID NO: 530159 - RNA, 15 nt, Homo sapiens
uuuuauuaugcauua

SEQ ID NO: 530160 - RNA, 12 nt, Homo sapiens
uuuuccuauaau

SEQ ID NO: 530161 - RNA, 18 nt, Homo sapiens
uuuuccuauuuauuugag

SEQ ID NO: 530162 - RNA, 15 nt, Homo sapiens
uuuucuguaauguaa

SEQ ID NO: 530163 - RNA, 16 nt, Homo sapiens
uuuucuucuugggaua

SEQ ID NO: 530164 - RNA, 21 nt, Homo sapiens
uuuugagcacuuuucaaacaa

SEQ ID NO: 530165 - RNA, 22 nt, Homo sapiens
uuuugauaacaaugacacuaga

SEQ ID NO: 530166 - RNA, 15 nt, Homo sapiens
uuuugauaauggcuu

SEQ ID NO: 530167 - RNA, 21 nt, Homo sapiens
uuuuggggaguaccuguccaa

SEQ ID NO: 530168 - RNA, 20 nt, Homo sapiens
uuuuuaaaagguagagucuu

SEQ ID NO: 530169 - RNA, 18 nt, Homo sapiens
uuuuuauacaauggaaua

SEQ ID NO: 530170 - RNA, 22 nt, Homo sapiens
uuuuuaucauaaaugcagaaua

SEQ ID NO: 530171 - RNA, 13 nt, Homo sapiens
uuuuuauuuuugc

SEQ ID NO: 530172 - RNA, 17 nt, Homo sapiens
uuuuucuccagacccca

SEQ ID NO: 530173 - RNA, 13 nt, Homo sapiens
uuuuuucccccac

SEQ ID NO: 530174 - RNA, 12 nt, Homo sapiens
ugaaagaacaag

SEQ ID NO: 530175 - RNA, 15 nt, Homo sapiens
ugaaaugaaaacaug

SEQ ID NO: 530176 - RNA, 13 nt, Homo sapiens
ugaaaugaccucu

SEQ ID NO: 530177 - RNA, 18 nt, Homo sapiens
ugaaauguuagucauugu

SEQ ID NO: 530178 - RNA, 19 nt, Homo sapiens
ugaaauuacggguaccuga

SEQ ID NO: 530179 - RNA, 15 nt, Homo sapiens
ugaaccaugaaguca

SEQ ID NO: 530180 - RNA, 17 nt, Homo sapiens
ugaaccauguguggcaa

SEQ ID NO: 530181 - RNA, 10 nt, Homo sapiens
ugaaccugug

SEQ ID NO: 530182 - RNA, 21 nt, Homo sapiens
ugaacugcuucuccaaggaca

SEQ ID NO: 530183 - RNA, 21 nt, Homo sapiens
ugaagcagguggagggcauca

SEQ ID NO: 530184 - RNA, 21 nt, Homo sapiens
ugaagcugacagcacuacaaa

SEQ ID NO: 530185 - RNA, 21 nt, Homo sapiens
ugaaggaaauucuuauaacuc

SEQ ID NO: 530186 - RNA, 14 nt, Homo sapiens
ugaagggcuuuauu

SEQ ID NO: 530187 - RNA, 17 nt, Homo sapiens
ugaagugugcugugaca

SEQ ID NO: 530188 - RNA, 17 nt, Homo sapiens
ugaauauugccauuaug

SEQ ID NO: 530189 - RNA, 15 nt, Homo sapiens
ugaauuggaaaggaa

SEQ ID NO: 530190 - RNA, 17 nt, Homo sapiens
ugacaaccucauccagg

SEQ ID NO: 530191 - RNA, 14 nt, Homo sapiens
ugacaaucaacucu

SEQ ID NO: 530192 - RNA, 23 nt, Homo sapiens
ugacaaucaacucuaauagugcu

SEQ ID NO: 530193 - RNA, 13 nt, Homo sapiens
ugacaauugugaa

SEQ ID NO: 530194 - RNA, 18 nt, Homo sapiens
ugacacuagucagaaaau

SEQ ID NO: 530195 - RNA, 13 nt, Homo sapiens
ugacagacaauga

SEQ ID NO: 530196 - RNA, 16 nt, Homo sapiens
ugacagggaaaacugc

SEQ ID NO: 530197 - RNA, 12 nt, Homo sapiens
ugacauaccuac

SEQ ID NO: 530198 - RNA, 15 nt, Homo sapiens
ugacauaccuaccag

SEQ ID NO: 530199 - RNA, 15 nt, Homo sapiens
ugacauuugcucuga

SEQ ID NO: 530200 - RNA, 19 nt, Homo sapiens
ugaccuugggguacaauug

SEQ ID NO: 530201 - RNA, 21 nt, Homo sapiens
ugacggcccucaucuaugagg

SEQ ID NO: 530202 - RNA, 20 nt, Homo sapiens
ugacguguaaaugcugguau

SEQ ID NO: 530203 - RNA, 11 nt, Homo sapiens
ugacuaaagag

SEQ ID NO: 530204 - RNA, 19 nt, Homo sapiens
ugacuggccacacaggauc

SEQ ID NO: 530205 - RNA, 18 nt, Homo sapiens
ugacuuuccucccauuuu

SEQ ID NO: 530206 - RNA, 19 nt, Homo sapiens
ugugucccaggcagggaga

SEQ ID NO: 530207 - RNA, 11 nt, Homo sapiens
ugugugcacau

SEQ ID NO: 530208 - RNA, 16 nt, Homo sapiens
ugugugccuauagucc

SEQ ID NO: 530209 - RNA, 13 nt, Homo sapiens
ugugugugcacau

SEQ ID NO: 530210 - RNA, 15 nt, Homo sapiens
ugugugugugcacau

SEQ ID NO: 530211 - RNA, 16 nt, Homo sapiens
ugugugugugugcaca

SEQ ID NO: 530212 - RNA, 16 nt, Homo sapiens
uguguuggauuaauua

SEQ ID NO: 530213 - RNA, 11 nt, Homo sapiens
uguuagauauu

SEQ ID NO: 530214 - RNA, 12 nt, Homo sapiens
uguuagcuuucc

SEQ ID NO: 530215 - RNA, 19 nt, Homo sapiens
uguuauuugcacacugcac

SEQ ID NO: 530216 - RNA, 19 nt, Homo sapiens
uguucacaacagugaaaag

SEQ ID NO: 530217 - RNA, 20 nt, Homo sapiens
uguuccacugcaaauaaagc

SEQ ID NO: 530218 - RNA, 21 nt, Homo sapiens
uguucuggggggacccagugc

SEQ ID NO: 530219 - RNA, 23 nt, Homo sapiens
uguucuggggggacccagugcag

SEQ ID NO: 530220 - RNA, 22 nt, Homo sapiens
uguucuguuggaugacuuugag

SEQ ID NO: 530221 - RNA, 15 nt, Homo sapiens
uguugcauauaguua

SEQ ID NO: 530222 - RNA, 15 nt, Homo sapiens
uguuggcaaacgaga

SEQ ID NO: 530223 - RNA, 19 nt, Homo sapiens
uguuuaagcccagccaagu

SEQ ID NO: 530224 - RNA, 18 nt, Homo sapiens
uguuuacagacgugugca

SEQ ID NO: 530225 - RNA, 14 nt, Homo sapiens
uguuuagugauauu

SEQ ID NO: 530226 - RNA, 15 nt, Homo sapiens
uguuuccuguuggag

SEQ ID NO: 530227 - RNA, 23 nt, Homo sapiens
uguuugccaggacaugcaauaaa

SEQ ID NO: 530228 - RNA, 13 nt, Homo sapiens
uguuugugauauu

SEQ ID NO: 530229 - RNA, 21 nt, Homo sapiens
uguuuucucuggaaugguaca

SEQ ID NO: 530230 - RNA, 23 nt, Homo sapiens
uuaaacuuucaauugucacuuuu

SEQ ID NO: 530231 - RNA, 15 nt, Homo sapiens
uuaaagaagcuuuau

SEQ ID NO: 530232 - RNA, 16 nt, Homo sapiens
uuaaaggaaaaucaca

SEQ ID NO: 530233 - RNA, 19 nt, Homo sapiens
uuaaaggaaaaucacaucu

SEQ ID NO: 530234 - RNA, 20 nt, Homo sapiens
uuaaaugcaauaauuuuacu

SEQ ID NO: 530235 - RNA, 19 nt, Homo sapiens
uuaaauguuuauacuguau

SEQ ID NO: 530236 - RNA, 19 nt, Homo sapiens
uuaaauuuugaaaacugug

SEQ ID NO: 530237 - RNA, 21 nt, Homo sapiens
uuaacagauggaaaaacugag

SEQ ID NO: 530238 - RNA, 10 nt, Homo sapiens
uuaacuguau

SEQ ID NO: 530239 - RNA, 14 nt, Homo sapiens
uuaagagacacucc

SEQ ID NO: 530240 - RNA, 15 nt, Homo sapiens
uuaagagacacucca

SEQ ID NO: 530241 - RNA, 18 nt, Homo sapiens
uuaagauuuugcaccugu

SEQ ID NO: 530242 - RNA, 15 nt, Homo sapiens
uuaaggggaagaaug

SEQ ID NO: 530243 - RNA, 16 nt, Homo sapiens
uuaauacauugaucag

SEQ ID NO: 530244 - RNA, 20 nt, Homo sapiens
uuacaauaggaguggugauu

SEQ ID NO: 530245 - RNA, 13 nt, Homo sapiens
uuacacacugucu

SEQ ID NO: 530246 - RNA, 22 nt, Homo sapiens
uuacacuuuuuggaagugaaaa

SEQ ID NO: 530247 - RNA, 21 nt, Homo sapiens
uuacagcuccuuugaaaacuc

SEQ ID NO: 530248 - RNA, 17 nt, Homo sapiens
uuacaggcgugauccac

SEQ ID NO: 530249 - RNA, 18 nt, Homo sapiens
uuacaguccaaaauacug

SEQ ID NO: 530250 - RNA, 23 nt, Homo sapiens
uuacauccagaguucugugacac

SEQ ID NO: 530251 - RNA, 14 nt, Homo sapiens
uuacaugcauuuga

SEQ ID NO: 530252 - RNA, 19 nt, Homo sapiens
uuacccaggcuggagugca

SEQ ID NO: 530253 - RNA, 16 nt, Homo sapiens
uuacgcaaugcuucua

SEQ ID NO: 530254 - RNA, 20 nt, Homo sapiens
uuacguauguuuguacuugg

SEQ ID NO: 530255 - RNA, 13 nt, Homo sapiens
uuacugacuccuc

SEQ ID NO: 530256 - RNA, 18 nt, Homo sapiens
uuacugucaaaauauuuc

SEQ ID NO: 530257 - RNA, 17 nt, Homo sapiens
uuagaaacacugcaaau

SEQ ID NO: 530258 - RNA, 12 nt, Homo sapiens
uuagaaagggaa

SEQ ID NO: 530259 - RNA, 15 nt, Homo sapiens
uuagaauguugaaaa

SEQ ID NO: 530260 - RNA, 20 nt, Homo sapiens
uuagaauguugaaaaguaau

SEQ ID NO: 530261 - RNA, 13 nt, Homo sapiens
uuagaucagggga

SEQ ID NO: 530262 - RNA, 20 nt, Homo sapiens
uuagauguaauuuuguguaa

SEQ ID NO: 530263 - RNA, 23 nt, Homo sapiens
uuagcgucaagacauuugcugaa

SEQ ID NO: 530264 - RNA, 22 nt, Homo sapiens
uuagcuuccugccccagacaga

SEQ ID NO: 530265 - RNA, 17 nt, Homo sapiens
uuauaagcauugccauu

SEQ ID NO: 530266 - RNA, 18 nt, Homo sapiens
uuauaauuggugcauagc

SEQ ID NO: 530267 - RNA, 16 nt, Homo sapiens
uuauacuggguuucaa

SEQ ID NO: 530268 - RNA, 12 nt, Homo sapiens
uuaugaaugaca

SEQ ID NO: 530269 - RNA, 22 nt, Homo sapiens
uuaugauuacuaucauggcaua

SEQ ID NO: 530270 - RNA, 17 nt, Homo sapiens
uuauguagguaagacug

SEQ ID NO: 530271 - RNA, 16 nt, Homo sapiens
uuauuauuucuaaucc

SEQ ID NO: 530272 - RNA, 17 nt, Homo sapiens
uuauuccugguuuaauu

SEQ ID NO: 530273 - RNA, 15 nt, Homo sapiens
uuauuugaaggccag

SEQ ID NO: 530274 - RNA, 16 nt, Homo sapiens
uuauuuuacagcucau

SEQ ID NO: 530275 - RNA, 18 nt, Homo sapiens
uuauuuuuaaaaagaaau

SEQ ID NO: 530276 - RNA, 12 nt, Homo sapiens
uucaaauuugau

SEQ ID NO: 530277 - RNA, 12 nt, Homo sapiens
uucaagauccuc

SEQ ID NO: 530278 - RNA, 18 nt, Homo sapiens
uucaaguuaccaauguaa

SEQ ID NO: 530279 - RNA, 17 nt, Homo sapiens
uucacgaacaugggcau

SEQ ID NO: 530280 - RNA, 16 nt, Homo sapiens
uucacugcgaagaccc

SEQ ID NO: 530281 - RNA, 19 nt, Homo sapiens
uucacuuaaguuaguucca

SEQ ID NO: 530282 - RNA, 14 nt, Homo sapiens
uucagacaagacag

SEQ ID NO: 530283 - RNA, 16 nt, Homo sapiens
uucagacaagacagag

SEQ ID NO: 530284 - RNA, 15 nt, Homo sapiens
uucagacaagcugca

SEQ ID NO: 530285 - RNA, 20 nt, Homo sapiens
uucagaggcucagauuguaa

SEQ ID NO: 530286 - RNA, 17 nt, Homo sapiens
uucagaguccuugcaaa

SEQ ID NO: 530287 - RNA, 12 nt, Homo sapiens
uucagauauuau

SEQ ID NO: 530288 - RNA, 19 nt, Homo sapiens
uucagauauuauugcuuua

SEQ ID NO: 530289 - RNA, 21 nt, Homo sapiens
uucaguauuuucuccacuuca

SEQ ID NO: 530290 - RNA, 18 nt, Homo sapiens
uucaguuuuacucugcug

SEQ ID NO: 530291 - RNA, 15 nt, Homo sapiens
uuccacagaggacac

SEQ ID NO: 530292 - RNA, 23 nt, Homo sapiens
uuccaggaguucugaagcugaca

SEQ ID NO: 530293 - RNA, 13 nt, Homo sapiens
uuccagguaacag

SEQ ID NO: 530294 - RNA, 23 nt, Homo sapiens
uuccaugcaacuggaguuccuua

SEQ ID NO: 530295 - RNA, 16 nt, Homo sapiens
uuccauuaugauucuu

SEQ ID NO: 530296 - RNA, 23 nt, Homo sapiens
uuccccaaagacgaccagcauuu

SEQ ID NO: 530297 - RNA, 16 nt, Homo sapiens
uuccccaaugcuccau

SEQ ID NO: 530298 - RNA, 15 nt, Homo sapiens
uuccccuugccuaaa

SEQ ID NO: 530299 - RNA, 13 nt, Homo sapiens
cuaacacuggcau

SEQ ID NO: 530300 - RNA, 15 nt, Homo sapiens
cuaacaguggacaaa

SEQ ID NO: 530301 - RNA, 17 nt, Homo sapiens
cuaacuuuucuuaaggu

SEQ ID NO: 530302 - RNA, 21 nt, Homo sapiens
cuaagcaguuauggugaugac

SEQ ID NO: 530303 - RNA, 18 nt, Homo sapiens
cuaagggugggugcucag

SEQ ID NO: 530304 - RNA, 22 nt, Homo sapiens
cuaagguuuagauaaauauuga

SEQ ID NO: 530305 - RNA, 19 nt, Homo sapiens
cuaauguacaauaaagcaa

SEQ ID NO: 530306 - RNA, 23 nt, Homo sapiens
cuaauguuugaacaaagcucaaa

SEQ ID NO: 530307 - RNA, 22 nt, Homo sapiens
cuaauucuggcaggaccucacc

SEQ ID NO: 530308 - RNA, 11 nt, Homo sapiens
cuacacauguu

SEQ ID NO: 530309 - RNA, 21 nt, Homo sapiens
cuacaccaaugaaaacaugua

SEQ ID NO: 530310 - RNA, 22 nt, Homo sapiens
cuacaucuuuuuuucuaugaaa

SEQ ID NO: 530311 - RNA, 21 nt, Homo sapiens
cuaccagguguucuacacuca

SEQ ID NO: 530312 - RNA, 14 nt, Homo sapiens
cuaccucagccucc

SEQ ID NO: 530313 - RNA, 14 nt, Homo sapiens
cuacguauccugca

SEQ ID NO: 530314 - RNA, 13 nt, Homo sapiens
cuacuauauugau

SEQ ID NO: 530315 - RNA, 22 nt, Homo sapiens
cuacuccuagaagaaccaaaua

SEQ ID NO: 530316 - RNA, 17 nt, Homo sapiens
cuacuuuaacaccaggu

SEQ ID NO: 530317 - RNA, 16 nt, Homo sapiens
cuacuuuucauccuag

SEQ ID NO: 530318 - RNA, 17 nt, Homo sapiens
cuagcaaucugccugua

SEQ ID NO: 530319 - RNA, 18 nt, Homo sapiens
cuaggaagacauuuuucc

SEQ ID NO: 530320 - RNA, 16 nt, Homo sapiens
cuagucuugaucuguu

SEQ ID NO: 530321 - RNA, 16 nt, Homo sapiens
cuauaaaauagauaua

SEQ ID NO: 530322 - RNA, 20 nt, Homo sapiens
cuauaaauagaugcugugua

SEQ ID NO: 530323 - RNA, 21 nt, Homo sapiens
cuauagggugugaugaaguca

SEQ ID NO: 530324 - RNA, 21 nt, Homo sapiens
cuaucaucauccuacaacuca

SEQ ID NO: 530325 - RNA, 20 nt, Homo sapiens
cuaucauggacuacaccagg

SEQ ID NO: 530326 - RNA, 18 nt, Homo sapiens
cuaucauuggccuccaaa

SEQ ID NO: 530327 - RNA, 22 nt, Homo sapiens
cuaucauuggccuccaaacaca

SEQ ID NO: 530328 - RNA, 22 nt, Homo sapiens
cuaugaaaugacuucuuaaaua

SEQ ID NO: 530329 - RNA, 23 nt, Homo sapiens
cuaugaagccaacugacaaagau

SEQ ID NO: 530330 - RNA, 13 nt, Homo sapiens
cuaugccaugugc

SEQ ID NO: 530331 - RNA, 13 nt, Homo sapiens
cuaugugccccag

SEQ ID NO: 530332 - RNA, 13 nt, Homo sapiens
cuauuaauauuca

SEQ ID NO: 530333 - RNA, 22 nt, Homo sapiens
cuauuucuguauauaaaggugc

SEQ ID NO: 530334 - RNA, 17 nt, Homo sapiens
cucaaaaauaaugcaua

SEQ ID NO: 530335 - RNA, 13 nt, Homo sapiens
cucaaacagucuu

SEQ ID NO: 530336 - RNA, 20 nt, Homo sapiens
cucaaacuccugaccucagg

SEQ ID NO: 530337 - RNA, 14 nt, Homo sapiens
cucaagaaaucaaa

SEQ ID NO: 530338 - RNA, 12 nt, Homo sapiens
cucaagcuuucc

SEQ ID NO: 530339 - RNA, 12 nt, Homo sapiens
cucaaucaugaa

SEQ ID NO: 530340 - RNA, 20 nt, Homo sapiens
cucacagaugugacuguaua

SEQ ID NO: 530341 - RNA, 19 nt, Homo sapiens
cucaccucccgaagccacc

SEQ ID NO: 530342 - RNA, 16 nt, Homo sapiens
cucacuccccaacccc

SEQ ID NO: 530343 - RNA, 22 nt, Homo sapiens
cucacucuuuagauauuuacau

SEQ ID NO: 530344 - RNA, 14 nt, Homo sapiens
cucagcuccacaac

SEQ ID NO: 530345 - RNA, 15 nt, Homo sapiens
cucaggccacagugg

SEQ ID NO: 530346 - RNA, 16 nt, Homo sapiens
cucagggagcagggaa

SEQ ID NO: 530347 - RNA, 17 nt, Homo sapiens
cucagggagcagggaag

SEQ ID NO: 530348 - RNA, 20 nt, Homo sapiens
cucagugggggcagagccac

SEQ ID NO: 530349 - RNA, 18 nt, Homo sapiens
cucaguugaaaaugcaac

SEQ ID NO: 530350 - RNA, 21 nt, Homo sapiens
cucaguugaaauaacaacaga

SEQ ID NO: 530351 - RNA, 15 nt, Homo sapiens
cucaugccuugagau

SEQ ID NO: 530352 - RNA, 14 nt, Homo sapiens
cucauuacugugag

SEQ ID NO: 530353 - RNA, 13 nt, Homo sapiens
cucauugcagcua

SEQ ID NO: 530354 - RNA, 23 nt, Homo sapiens
cuccacauggaagcccaacuggg

SEQ ID NO: 530355 - RNA, 17 nt, Homo sapiens
cuccacuggaaaacugc

SEQ ID NO: 530356 - RNA, 19 nt, Homo sapiens
cuccagaugccacaaugga

SEQ ID NO: 530357 - RNA, 19 nt, Homo sapiens
cuccaguaccuugcuucuu

SEQ ID NO: 530358 - RNA, 18 nt, Homo sapiens
cuccaucucuucugcaag

SEQ ID NO: 530359 - RNA, 21 nt, Homo sapiens
cuccccagaugugacuacuga

SEQ ID NO: 530360 - RNA, 17 nt, Homo sapiens
cuccccaggcuaugcca

SEQ ID NO: 530361 - RNA, 19 nt, Homo sapiens
cuccucacccaccucuggg

SEQ ID NO: 530362 - RNA, 15 nt, Homo sapiens
cuccucaucuccaag

SEQ ID NO: 530363 - RNA, 20 nt, Homo sapiens
cuccugaccucaggugaucc

SEQ ID NO: 530364 - RNA, 18 nt, Homo sapiens
cuccugcaucucaugagu

SEQ ID NO: 530365 - RNA, 22 nt, Homo sapiens
cuccuuccuucccagaauguua

SEQ ID NO: 530366 - RNA, 22 nt, Homo sapiens
cucgcaaacguuucuugaacaa

SEQ ID NO: 530367 - RNA, 16 nt, Homo sapiens
cucgcugaaagcacua

SEQ ID NO: 530368 - RNA, 21 nt, Homo sapiens
cucggcacacacugugcccca

SEQ ID NO: 530369 - RNA, 17 nt, Homo sapiens
cucgucagccaccuggg

SEQ ID NO: 530370 - RNA, 22 nt, Homo sapiens
cucuaauguacaauaaagcaau

SEQ ID NO: 530371 - RNA, 17 nt, Homo sapiens
cucuacuaaaaacacaa

SEQ ID NO: 530372 - RNA, 14 nt, Homo sapiens
cucucagcugacca

SEQ ID NO: 530373 - RNA, 16 nt, Homo sapiens
cucucaguguuuugga

SEQ ID NO: 530374 - RNA, 11 nt, Homo sapiens
cucuccaggga

SEQ ID NO: 530375 - RNA, 11 nt, Homo sapiens
cucugcucccu

SEQ ID NO: 530376 - RNA, 20 nt, Homo sapiens
cucuguccacgauucacuca

SEQ ID NO: 530377 - RNA, 17 nt, Homo sapiens
cucugugcccuccagca

SEQ ID NO: 530378 - RNA, 13 nt, Homo sapiens
cucuguguagcaa

SEQ ID NO: 530379 - RNA, 17 nt, Homo sapiens
cucuucaugcuugacau

SEQ ID NO: 530380 - RNA, 12 nt, Homo sapiens
cucuucugcaag

SEQ ID NO: 530381 - RNA, 20 nt, Homo sapiens
ucuagggaaugggacuguga

SEQ ID NO: 530382 - RNA, 21 nt, Homo sapiens
ucuagggaaugggacugugag

SEQ ID NO: 530383 - RNA, 13 nt, Homo sapiens
ucuaggguccagu

SEQ ID NO: 530384 - RNA, 18 nt, Homo sapiens
ucuagugucugacuuuug

SEQ ID NO: 530385 - RNA, 20 nt, Homo sapiens
ucuauacaaauuuucagaag

SEQ ID NO: 530386 - RNA, 16 nt, Homo sapiens
ucucaaacuucacuaa

SEQ ID NO: 530387 - RNA, 18 nt, Homo sapiens
ucucagaagccuagggga

SEQ ID NO: 530388 - RNA, 22 nt, Homo sapiens
ucucaggcuucugcaguucuca

SEQ ID NO: 530389 - RNA, 22 nt, Homo sapiens
ucucauaggcuaugccaugugc

SEQ ID NO: 530390 - RNA, 14 nt, Homo sapiens
ucucaugacuccua

SEQ ID NO: 530391 - RNA, 10 nt, Homo sapiens
ucucauguca

SEQ ID NO: 530392 - RNA, 18 nt, Homo sapiens
ucuccaaggcagggacca

SEQ ID NO: 530393 - RNA, 13 nt, Homo sapiens
ucuccaauacuca

SEQ ID NO: 530394 - RNA, 22 nt, Homo sapiens
ucuccuaaaacuuuaaaacuug

SEQ ID NO: 530395 - RNA, 18 nt, Homo sapiens
ucucuaaaaacauagaaa

SEQ ID NO: 530396 - RNA, 19 nt, Homo sapiens
ucucuccccagaugugacu

SEQ ID NO: 530397 - RNA, 17 nt, Homo sapiens
ucucugaggacaagaga

SEQ ID NO: 530398 - RNA, 18 nt, Homo sapiens
ucugaagaaacuucccaa

SEQ ID NO: 530399 - RNA, 14 nt, Homo sapiens
ucugacaacuguga

SEQ ID NO: 530400 - RNA, 19 nt, Homo sapiens
ucugagagaugacagggaa

SEQ ID NO: 530401 - RNA, 21 nt, Homo sapiens
ucugagauuuugcuugagcag

SEQ ID NO: 530402 - RNA, 14 nt, Homo sapiens
ucugauccauccau

SEQ ID NO: 530403 - RNA, 20 nt, Homo sapiens
ucugcaaaaauggauauuau

SEQ ID NO: 530404 - RNA, 20 nt, Homo sapiens
ucugcaaaguguaugugacc

SEQ ID NO: 530405 - RNA, 23 nt, Homo sapiens
ucugcacagccuagacauccagg

SEQ ID NO: 530406 - RNA, 15 nt, Homo sapiens
ucugcagacugcugc

SEQ ID NO: 530407 - RNA, 17 nt, Homo sapiens
ucugcagacugcugcua

SEQ ID NO: 530408 - RNA, 21 nt, Homo sapiens
ucugcccgcuccauggaaaag

SEQ ID NO: 530409 - RNA, 16 nt, Homo sapiens
ucugccgcuaccuccc

SEQ ID NO: 530410 - RNA, 23 nt, Homo sapiens
ucugccuguaucucucacuauua

SEQ ID NO: 530411 - RNA, 16 nt, Homo sapiens
ucugccuucugcugaa

SEQ ID NO: 530412 - RNA, 17 nt, Homo sapiens
ucugcuuuucccauugc

SEQ ID NO: 530413 - RNA, 19 nt, Homo sapiens
ucugcuuuucccauugcca

SEQ ID NO: 530414 - RNA, 20 nt, Homo sapiens
ucugcuuuucccauugccau

SEQ ID NO: 530415 - RNA, 21 nt, Homo sapiens
ucuggaagucaucucauucca

SEQ ID NO: 530416 - RNA, 13 nt, Homo sapiens
ucuggagugagcu

SEQ ID NO: 530417 - RNA, 20 nt, Homo sapiens
ucuggcaucuuagaccucca

SEQ ID NO: 530418 - RNA, 13 nt, Homo sapiens
ucuggcugcacag

SEQ ID NO: 530419 - RNA, 13 nt, Homo sapiens
ucuggcuggaaag

SEQ ID NO: 530420 - RNA, 19 nt, Homo sapiens
ucuggcuggaaagcagagc

SEQ ID NO: 530421 - RNA, 13 nt, Homo sapiens
ucugggccagugc

SEQ ID NO: 530422 - RNA, 20 nt, Homo sapiens
ucuggggggacccagugcag

SEQ ID NO: 530423 - RNA, 19 nt, Homo sapiens
ucugguacugcaggaccuc

SEQ ID NO: 530424 - RNA, 22 nt, Homo sapiens
ucuggucuuauaaguaaagaca

SEQ ID NO: 530425 - RNA, 16 nt, Homo sapiens
ucugguuauaucauuc

SEQ ID NO: 530426 - RNA, 20 nt, Homo sapiens
ucugugaccccuccuuguca

SEQ ID NO: 530427 - RNA, 13 nt, Homo sapiens
ucuguguuuacag

SEQ ID NO: 530428 - RNA, 13 nt, Homo sapiens
ucuguucacuuuc

SEQ ID NO: 530429 - RNA, 18 nt, Homo sapiens
ucuguucugggccagguc

SEQ ID NO: 530430 - RNA, 17 nt, Homo sapiens
ucuguugccauggugau

SEQ ID NO: 530431 - RNA, 22 nt, Homo sapiens
ucuguuggaugacuuugagauu

SEQ ID NO: 530432 - RNA, 20 nt, Homo sapiens
ucuguuuauggccacauuua

SEQ ID NO: 530433 - RNA, 19 nt, Homo sapiens
ucuuaaccuuugcuaugua

SEQ ID NO: 530434 - RNA, 20 nt, Homo sapiens
ucuuacacaggcuucaucaa

SEQ ID NO: 530435 - RNA, 13 nt, Homo sapiens
ucuuacaugcauu

SEQ ID NO: 530436 - RNA, 15 nt, Homo sapiens
ucuuacuggugcuau

SEQ ID NO: 530437 - RNA, 20 nt, Homo sapiens
ucuuagugugccaagaguuc

SEQ ID NO: 530438 - RNA, 21 nt, Homo sapiens
ucuuaguguuguggacacugc

SEQ ID NO: 530439 - RNA, 23 nt, Homo sapiens
ucuuauaguguuuggacagcuga

SEQ ID NO: 530440 - RNA, 20 nt, Homo sapiens
ucuucaagucccaucauaga

SEQ ID NO: 530441 - RNA, 21 nt, Homo sapiens
ucuucacuucuaaaugcauau

SEQ ID NO: 530442 - RNA, 22 nt, Homo sapiens
ucuucacuucuaaaugcauauc

SEQ ID NO: 530443 - RNA, 13 nt, Homo sapiens
ucuucaugagcuu

SEQ ID NO: 530444 - RNA, 12 nt, Homo sapiens
ucuuccaugacc

SEQ ID NO: 530445 - RNA, 13 nt, Homo sapiens
ucuuccaugaccc

SEQ ID NO: 530446 - RNA, 14 nt, Homo sapiens
ucuucuuugcugca

SEQ ID NO: 530447 - RNA, 21 nt, Homo sapiens
ucuugaauguggucucaggau

SEQ ID NO: 530448 - RNA, 16 nt, Homo sapiens
ucuuggggcccagugc

SEQ ID NO: 530449 - RNA, 18 nt, Homo sapiens
ucuuggggcccagugcau

SEQ ID NO: 530450 - RNA, 20 nt, Homo sapiens
ucuuguggucaucauggcca

SEQ ID NO: 530451 - RNA, 14 nt, Homo sapiens
ucuuuaaaggcauc

SEQ ID NO: 530452 - RNA, 22 nt, Homo sapiens
ucuuucacacggcacauuugga

SEQ ID NO: 530453 - RNA, 22 nt, Homo sapiens
ucuuuccaggcuucccugacuu

SEQ ID NO: 530454 - RNA, 15 nt, Homo sapiens
ucuuuccuuguucag

SEQ ID NO: 530455 - RNA, 20 nt, Homo sapiens
ucuuucucaaagaaauauua

SEQ ID NO: 530456 - RNA, 20 nt, Homo sapiens
ucuuugaagcgagcagucag

SEQ ID NO: 530457 - RNA, 23 nt, Homo sapiens
ucuuuguaauacuuucuauguga

SEQ ID NO: 530458 - RNA, 13 nt, Homo sapiens
ucuuugugccuuu

SEQ ID NO: 530459 - RNA, 22 nt, Homo sapiens
ucuuuuacccggcacauucccc

SEQ ID NO: 530460 - RNA, 15 nt, Homo sapiens
ucuuuuauaugcuaa

SEQ ID NO: 530461 - RNA, 18 nt, Homo sapiens
ugaaaaauaucugguuau

SEQ ID NO: 530462 - RNA, 13 nt, Homo sapiens
ugaaaacuuguaa

SEQ ID NO: 530463 - RNA, 13 nt, Homo sapiens
ugaaaacuuugua

SEQ ID NO: 530464 - RNA, 18 nt, Homo sapiens
ugaaaagaauagaagcua

SEQ ID NO: 530465 - RNA, 16 nt, Homo sapiens
ugaaaagaauuugaug

SEQ ID NO: 530466 - RNA, 15 nt, Homo sapiens
ugaaaagguugccug

SEQ ID NO: 530467 - RNA, 13 nt, Homo sapiens
ugaaaagugugua

SEQ ID NO: 530468 - RNA, 13 nt, Homo sapiens
ugaaaaugcaacu

SEQ ID NO: 530469 - RNA, 18 nt, Homo sapiens
ugaaacuccagaugccac

SEQ ID NO: 530470 - RNA, 14 nt, Homo sapiens
agaauagaaaacug

SEQ ID NO: 530471 - RNA, 23 nt, Homo sapiens
agaauucagaagaccccugacuc

SEQ ID NO: 530472 - RNA, 16 nt, Homo sapiens
agacaacaguugcaca

SEQ ID NO: 530473 - RNA, 16 nt, Homo sapiens
agacaaguauggcucc

SEQ ID NO: 530474 - RNA, 12 nt, Homo sapiens
agacaccugguu

SEQ ID NO: 530475 - RNA, 21 nt, Homo sapiens
agacagcgcaugcuggugcag

SEQ ID NO: 530476 - RNA, 17 nt, Homo sapiens
agacagcugcuggguca

SEQ ID NO: 530477 - RNA, 13 nt, Homo sapiens
agacauacauuuc

SEQ ID NO: 530478 - RNA, 19 nt, Homo sapiens
agacaucggccuccaugac

SEQ ID NO: 530479 - RNA, 20 nt, Homo sapiens
agacaucggccuccaugacc

SEQ ID NO: 530480 - RNA, 23 nt, Homo sapiens
agacauuacaauguguaauggaa

SEQ ID NO: 530481 - RNA, 15 nt, Homo sapiens
agacauuugcugaac

SEQ ID NO: 530482 - RNA, 20 nt, Homo sapiens
agacccuccuauucuauaaa

SEQ ID NO: 530483 - RNA, 19 nt, Homo sapiens
agaccucuaggaggagcua

SEQ ID NO: 530484 - RNA, 22 nt, Homo sapiens
agaccugagucugcaugugcac

SEQ ID NO: 530485 - RNA, 18 nt, Homo sapiens
agacucaagagaauuuau

SEQ ID NO: 530486 - RNA, 13 nt, Homo sapiens
agacucagugcag

SEQ ID NO: 530487 - RNA, 10 nt, Homo sapiens
agacugcugc

SEQ ID NO: 530488 - RNA, 19 nt, Homo sapiens
agacuggggcauccugugc

SEQ ID NO: 530489 - RNA, 20 nt, Homo sapiens
agacuguggcuagugacaaa

SEQ ID NO: 530490 - RNA, 17 nt, Homo sapiens
agacuuugugacuguca

SEQ ID NO: 530491 - RNA, 15 nt, Homo sapiens
agagaaaggacucag

SEQ ID NO: 530492 - RNA, 21 nt, Homo sapiens
agagacagaggcgcccugggu

SEQ ID NO: 530493 - RNA, 14 nt, Homo sapiens
agagaccuauguaa

SEQ ID NO: 530494 - RNA, 15 nt, Homo sapiens
agagacuccgucuca

SEQ ID NO: 530495 - RNA, 16 nt, Homo sapiens
agagacugucccugaa

SEQ ID NO: 530496 - RNA, 19 nt, Homo sapiens
agagagaagcaaguggugg

SEQ ID NO: 530497 - RNA, 17 nt, Homo sapiens
agagauaagucuuucau

SEQ ID NO: 530498 - RNA, 20 nt, Homo sapiens
agagaugacacuagucagaa

SEQ ID NO: 530499 - RNA, 15 nt, Homo sapiens
agagaugacagggaa

SEQ ID NO: 530500 - RNA, 17 nt, Homo sapiens
agagcacuuugcaacuc

SEQ ID NO: 530501 - RNA, 20 nt, Homo sapiens
agagcuuuuauuuggugugu

SEQ ID NO: 530502 - RNA, 23 nt, Homo sapiens
agagcuuuuauuugguguguucg

SEQ ID NO: 530503 - RNA, 15 nt, Homo sapiens
agaggaaaaggcugg

SEQ ID NO: 530504 - RNA, 16 nt, Homo sapiens
agaggaggggaaaguc

SEQ ID NO: 530505 - RNA, 14 nt, Homo sapiens
agaggaucuggaga

SEQ ID NO: 530506 - RNA, 23 nt, Homo sapiens
agaggcagaucuggacuuggcaa

SEQ ID NO: 530507 - RNA, 14 nt, Homo sapiens
agaggccugugcua

SEQ ID NO: 530508 - RNA, 21 nt, Homo sapiens
agaggcucagacucacuguua

SEQ ID NO: 530509 - RNA, 18 nt, Homo sapiens
agaggcucuaauguacaa

SEQ ID NO: 530510 - RNA, 21 nt, Homo sapiens
agaggcugccccucucaccaa

SEQ ID NO: 530511 - RNA, 15 nt, Homo sapiens
agagggcugguccuu

SEQ ID NO: 530512 - RNA, 13 nt, Homo sapiens
agaguaccugugu

SEQ ID NO: 530513 - RNA, 20 nt, Homo sapiens
agagucaacaggucacuuga

SEQ ID NO: 530514 - RNA, 15 nt, Homo sapiens
agagucaugggagag

SEQ ID NO: 530515 - RNA, 21 nt, Homo sapiens
agaguugaaguuuacagagau

SEQ ID NO: 530516 - RNA, 14 nt, Homo sapiens
agauaaaccaauaa

SEQ ID NO: 530517 - RNA, 18 nt, Homo sapiens
cugucauaacauccagag

SEQ ID NO: 530518 - RNA, 20 nt, Homo sapiens
cugucaugcuucaucauucc

SEQ ID NO: 530519 - RNA, 14 nt, Homo sapiens
cugucccaccugca

SEQ ID NO: 530520 - RNA, 17 nt, Homo sapiens
cugucccaccugcacac

SEQ ID NO: 530521 - RNA, 19 nt, Homo sapiens
cugucccuugcuguaugcu

SEQ ID NO: 530522 - RNA, 16 nt, Homo sapiens
cuguccguucacaugu

SEQ ID NO: 530523 - RNA, 22 nt, Homo sapiens
cuguccguucacauguguggua

SEQ ID NO: 530524 - RNA, 14 nt, Homo sapiens
cuguccugcagucc

SEQ ID NO: 530525 - RNA, 14 nt, Homo sapiens
cuguccuucuuaga

SEQ ID NO: 530526 - RNA, 16 nt, Homo sapiens
cuguccuuucagucug

SEQ ID NO: 530527 - RNA, 16 nt, Homo sapiens
cugucuugaugacugc

SEQ ID NO: 530528 - RNA, 17 nt, Homo sapiens
cugugauaugccauagg

SEQ ID NO: 530529 - RNA, 19 nt, Homo sapiens
cugugcaacggucuccuga

SEQ ID NO: 530530 - RNA, 23 nt, Homo sapiens
cugugcaauagacacauacaugu

SEQ ID NO: 530531 - RNA, 20 nt, Homo sapiens
cugugguuccucugcucacc

SEQ ID NO: 530532 - RNA, 19 nt, Homo sapiens
cuguguccuacuccuugca

SEQ ID NO: 530533 - RNA, 15 nt, Homo sapiens
cuguguguagggaga

SEQ ID NO: 530534 - RNA, 15 nt, Homo sapiens
cuguuaguuguccac

SEQ ID NO: 530535 - RNA, 22 nt, Homo sapiens
cuguucuguuggaugacuuuga

SEQ ID NO: 530536 - RNA, 13 nt, Homo sapiens
cuguugaugugga

SEQ ID NO: 530537 - RNA, 21 nt, Homo sapiens
cuguuugagaaccauuuacuu

SEQ ID NO: 530538 - RNA, 15 nt, Homo sapiens
cuguuuuugcaacua

SEQ ID NO: 530539 - RNA, 14 nt, Homo sapiens
cuuaaaauugugag

SEQ ID NO: 530540 - RNA, 13 nt, Homo sapiens
cuuaaacucuguu

SEQ ID NO: 530541 - RNA, 21 nt, Homo sapiens
cuuaaauuaagauuaugugag

SEQ ID NO: 530542 - RNA, 18 nt, Homo sapiens
cuuaaauuuuauaucauu

SEQ ID NO: 530543 - RNA, 22 nt, Homo sapiens
cuuaaauuuuauaucauuuuaa

SEQ ID NO: 530544 - RNA, 20 nt, Homo sapiens
cuuaacuuguuugguaguua

SEQ ID NO: 530545 - RNA, 14 nt, Homo sapiens
cuuacacacugucu

SEQ ID NO: 530546 - RNA, 21 nt, Homo sapiens
cuuacaggguaacugugcuga

SEQ ID NO: 530547 - RNA, 22 nt, Homo sapiens
cuuacguauguuuguacuuggu

SEQ ID NO: 530548 - RNA, 13 nt, Homo sapiens
cuuagaaagggaa

SEQ ID NO: 530549 - RNA, 12 nt, Homo sapiens
cuuagugaaugg

SEQ ID NO: 530550 - RNA, 12 nt, Homo sapiens
cuuaguuuccac

SEQ ID NO: 530551 - RNA, 15 nt, Homo sapiens
cuuaucaacuaauga

SEQ ID NO: 530552 - RNA, 18 nt, Homo sapiens
cuuaucaacuaaugauuu

SEQ ID NO: 530553 - RNA, 18 nt, Homo sapiens
cuuaucccucucuucccc

SEQ ID NO: 530554 - RNA, 20 nt, Homo sapiens
cuuaugaaaagaauuugaug

SEQ ID NO: 530555 - RNA, 13 nt, Homo sapiens
cuuauuucuauga

SEQ ID NO: 530556 - RNA, 22 nt, Homo sapiens
cuuauuuugucuuauucuuaag

SEQ ID NO: 530557 - RNA, 20 nt, Homo sapiens
cuucaaagccuucucccuag

SEQ ID NO: 530558 - RNA, 16 nt, Homo sapiens
cuucacucaggucuca

SEQ ID NO: 530559 - RNA, 23 nt, Homo sapiens
cuucagauccuuuuauucuccag

SEQ ID NO: 530560 - RNA, 22 nt, Homo sapiens
cuucagugaauuuugauaaugg

SEQ ID NO: 530561 - RNA, 22 nt, Homo sapiens
cuucagugcaaauuguaucuua

SEQ ID NO: 530562 - RNA, 12 nt, Homo sapiens
cuucaugcuuuu

SEQ ID NO: 530563 - RNA, 23 nt, Homo sapiens
cuuccagcauuuagcuggccaca

SEQ ID NO: 530564 - RNA, 14 nt, Homo sapiens
cuuccagugcucag

SEQ ID NO: 530565 - RNA, 13 nt, Homo sapiens
cuucccaguauua

SEQ ID NO: 530566 - RNA, 15 nt, Homo sapiens
cuucccugcauuaac

SEQ ID NO: 530567 - RNA, 17 nt, Homo sapiens
cuuccgcaguguggcca

SEQ ID NO: 530568 - RNA, 14 nt, Homo sapiens
cuuccuaggucaug

SEQ ID NO: 530569 - RNA, 22 nt, Homo sapiens
accugccccccacucugcacag

SEQ ID NO: 530570 - RNA, 13 nt, Homo sapiens
accuguaauccca

SEQ ID NO: 530571 - RNA, 18 nt, Homo sapiens
accuuaagagacacucca

SEQ ID NO: 530572 - RNA, 17 nt, Homo sapiens
accuuaagauuuugcac

SEQ ID NO: 530573 - RNA, 15 nt, Homo sapiens
accuucaauacuuaa

SEQ ID NO: 530574 - RNA, 11 nt, Homo sapiens
accuuccccag

SEQ ID NO: 530575 - RNA, 17 nt, Homo sapiens
accuuugggacuaagcu

SEQ ID NO: 530576 - RNA, 23 nt, Homo sapiens
accuuuucucgcugaaagcacua

SEQ ID NO: 530577 - RNA, 19 nt, Homo sapiens
acgaggccacagcugccau

SEQ ID NO: 530578 - RNA, 14 nt, Homo sapiens
acgcagcacaagcu

SEQ ID NO: 530579 - RNA, 16 nt, Homo sapiens
acgccaucuccacucu

SEQ ID NO: 530580 - RNA, 14 nt, Homo sapiens
acgccgagaaggcc

SEQ ID NO: 530581 - RNA, 19 nt, Homo sapiens
acgcuuuucuuuguuauac

SEQ ID NO: 530582 - RNA, 18 nt, Homo sapiens
acggacaaagagauugag

SEQ ID NO: 530583 - RNA, 19 nt, Homo sapiens
acggagguccuuuggacag

SEQ ID NO: 530584 - RNA, 21 nt, Homo sapiens
acggcccucaucuaugaggaa

SEQ ID NO: 530585 - RNA, 19 nt, Homo sapiens
acggcguuucaccauguug

SEQ ID NO: 530586 - RNA, 19 nt, Homo sapiens
acgggaauucagacaagcu

SEQ ID NO: 530587 - RNA, 20 nt, Homo sapiens
acgugguaugaaaugucuga

SEQ ID NO: 530588 - RNA, 16 nt, Homo sapiens
acgugugcaguuguag

SEQ ID NO: 530589 - RNA, 15 nt, Homo sapiens
acgugugugucuuac

SEQ ID NO: 530590 - RNA, 14 nt, Homo sapiens
acuaaaacacugaa

SEQ ID NO: 530591 - RNA, 15 nt, Homo sapiens
acuaaaacacugaaa

SEQ ID NO: 530592 - RNA, 15 nt, Homo sapiens
acuaacagauaagca

SEQ ID NO: 530593 - RNA, 17 nt, Homo sapiens
acuaacagauaagcaag

SEQ ID NO: 530594 - RNA, 19 nt, Homo sapiens
acuaaccagagucagcaca

SEQ ID NO: 530595 - RNA, 22 nt, Homo sapiens
acuaaccaucugaagaaacuuc

SEQ ID NO: 530596 - RNA, 20 nt, Homo sapiens
acuaacgugugugucuuaca

SEQ ID NO: 530597 - RNA, 22 nt, Homo sapiens
acuaaugaucacauucuuucca

SEQ ID NO: 530598 - RNA, 16 nt, Homo sapiens
acuacauaacuuccua

SEQ ID NO: 530599 - RNA, 23 nt, Homo sapiens
acuacucagccuagcacaggcug

SEQ ID NO: 530600 - RNA, 23 nt, Homo sapiens
acuagaacgcuucgggaaaauau

SEQ ID NO: 530601 - RNA, 15 nt, Homo sapiens
acuaucuuugcugca

SEQ ID NO: 530602 - RNA, 19 nt, Homo sapiens
acuauugugaccacaggcu

SEQ ID NO: 530603 - RNA, 22 nt, Homo sapiens
acuauuuauaucacacaauaua

SEQ ID NO: 530604 - RNA, 18 nt, Homo sapiens
acucaaauacacauuugc

SEQ ID NO: 530605 - RNA, 21 nt, Homo sapiens
acucagcacauucgggaccaa

SEQ ID NO: 530606 - RNA, 14 nt, Homo sapiens
acucagugcagaug

SEQ ID NO: 530607 - RNA, 17 nt, Homo sapiens
acucaucuuagugccug

SEQ ID NO: 530608 - RNA, 18 nt, Homo sapiens
acucaucuuagugccuga

SEQ ID NO: 530609 - RNA, 22 nt, Homo sapiens
acucauuucauuccuaacacag

SEQ ID NO: 530610 - RNA, 19 nt, Homo sapiens
acuccagagucaguaguua

SEQ ID NO: 530611 - RNA, 19 nt, Homo sapiens
acuccccuuaaucuaaucu

SEQ ID NO: 530612 - RNA, 18 nt, Homo sapiens
acuccuacuuuucauccu

SEQ ID NO: 530613 - RNA, 16 nt, Homo sapiens
acucuaauagugcuua

SEQ ID NO: 530614 - RNA, 15 nt, Homo sapiens
cuccaaggacaucua

SEQ ID NO: 530615 - RNA, 19 nt, Homo sapiens
cuccagaccccaugccuua

SEQ ID NO: 530616 - RNA, 13 nt, Homo sapiens
cuccaggugcaga

SEQ ID NO: 530617 - RNA, 18 nt, Homo sapiens
cuccauaaaguacaaaug

SEQ ID NO: 530618 - RNA, 15 nt, Homo sapiens
cuccaucagcuccug

SEQ ID NO: 530619 - RNA, 22 nt, Homo sapiens
cuccauccugcagauacuuuga

SEQ ID NO: 530620 - RNA, 18 nt, Homo sapiens
cucccacuucacugcgaa

SEQ ID NO: 530621 - RNA, 21 nt, Homo sapiens
cucccagggaggcugugcaca

SEQ ID NO: 530622 - RNA, 14 nt, Homo sapiens
cuccccccacaagu

SEQ ID NO: 530623 - RNA, 17 nt, Homo sapiens
cucccuagccagaggcu

SEQ ID NO: 530624 - RNA, 17 nt, Homo sapiens
cucccugggucugggga

SEQ ID NO: 530625 - RNA, 23 nt, Homo sapiens
cucccugggucuggggacaggcc

SEQ ID NO: 530626 - RNA, 22 nt, Homo sapiens
cuccuagaagaaccaaauaccu

SEQ ID NO: 530627 - RNA, 18 nt, Homo sapiens
cuccugacgcagcacaag

SEQ ID NO: 530628 - RNA, 21 nt, Homo sapiens
cuccugcacacagggcagucc

SEQ ID NO: 530629 - RNA, 23 nt, Homo sapiens
cucuaauguacaauaaagcaaug

SEQ ID NO: 530630 - RNA, 16 nt, Homo sapiens
cucuacaaaaauacaa

SEQ ID NO: 530631 - RNA, 14 nt, Homo sapiens
cucuacagugccaa

SEQ ID NO: 530632 - RNA, 15 nt, Homo sapiens
cucuagaagaccaaa

SEQ ID NO: 530633 - RNA, 13 nt, Homo sapiens
cucucacuauuau

SEQ ID NO: 530634 - RNA, 17 nt, Homo sapiens
cucucagcugaccauca

SEQ ID NO: 530635 - RNA, 16 nt, Homo sapiens
cucuccaucagcuccu

SEQ ID NO: 530636 - RNA, 16 nt, Homo sapiens
cucucgacaguaucca

SEQ ID NO: 530637 - RNA, 20 nt, Homo sapiens
cucucgccucauuacuguga

SEQ ID NO: 530638 - RNA, 22 nt, Homo sapiens
cucugacaacugugaagccacc

SEQ ID NO: 530639 - RNA, 18 nt, Homo sapiens
cucugcauggaacagcau

SEQ ID NO: 530640 - RNA, 17 nt, Homo sapiens
cucugccgcuaccuccc

SEQ ID NO: 530641 - RNA, 15 nt, Homo sapiens
cucuggaggccugug

SEQ ID NO: 530642 - RNA, 15 nt, Homo sapiens
cucuggggugcugcc

SEQ ID NO: 530643 - RNA, 20 nt, Homo sapiens
cucugucccucuccuugccc

SEQ ID NO: 530644 - RNA, 20 nt, Homo sapiens
cucugucucaaaacaaacaa

SEQ ID NO: 530645 - RNA, 12 nt, Homo sapiens
cucugugcucuu

SEQ ID NO: 530646 - RNA, 22 nt, Homo sapiens
cucuguuucgguugacccaggu

SEQ ID NO: 530647 - RNA, 15 nt, Homo sapiens
cucuucuacccuuuu

SEQ ID NO: 530648 - RNA, 23 nt, Homo sapiens
cucuucuggggcaggcugggcca

SEQ ID NO: 530649 - RNA, 14 nt, Homo sapiens
cucuucuuacuggu

SEQ ID NO: 530650 - RNA, 13 nt, Homo sapiens
cucuugucaaaag

SEQ ID NO: 530651 - RNA, 14 nt, Homo sapiens
cucuuguucccaca

SEQ ID NO: 530652 - RNA, 16 nt, Homo sapiens
cucuuugaaagcuuug

SEQ ID NO: 530653 - RNA, 12 nt, Homo sapiens
cucuuugcugca

SEQ ID NO: 530654 - RNA, 17 nt, Homo sapiens
cugaaagccuuagggaa

SEQ ID NO: 530655 - RNA, 15 nt, Homo sapiens
cugaacucagcacau

SEQ ID NO: 530656 - RNA, 18 nt, Homo sapiens
cugaagcugacagcacua

SEQ ID NO: 530657 - RNA, 21 nt, Homo sapiens
cugaagcugacagcacuacaa

SEQ ID NO: 530658 - RNA, 21 nt, Homo sapiens
cugaagcuuaggacuaccagc

SEQ ID NO: 530659 - RNA, 15 nt, Homo sapiens
cugaauccagaucau

SEQ ID NO: 530660 - RNA, 20 nt, Homo sapiens
cugaauucuuuccccaaaga

SEQ ID NO: 530661 - RNA, 15 nt, Homo sapiens
cugacaaagacaucg

SEQ ID NO: 530662 - RNA, 16 nt, Homo sapiens
cugacaaagaugcauc

SEQ ID NO: 530663 - RNA, 14 nt, Homo sapiens
cugacacauagaaa

SEQ ID NO: 530664 - RNA, 18 nt, Homo sapiens
cugaccuggagaugcugc

SEQ ID NO: 530665 - RNA, 15 nt, Homo sapiens
cugacgacaguacug

SEQ ID NO: 530666 - RNA, 15 nt, Homo sapiens
cugacuggugcugca

SEQ ID NO: 530667 - RNA, 23 nt, Homo sapiens
cugagaccaaagaagcugcuguu

SEQ ID NO: 530668 - RNA, 21 nt, Homo sapiens
guauggggaggcaaguguggg

SEQ ID NO: 530669 - RNA, 14 nt, Homo sapiens
guaugguguguuca

SEQ ID NO: 530670 - RNA, 11 nt, Homo sapiens
guauguuaaag

SEQ ID NO: 530671 - RNA, 19 nt, Homo sapiens
guauuagugacaccacaca

SEQ ID NO: 530672 - RNA, 14 nt, Homo sapiens
guauuauacaugug

SEQ ID NO: 530673 - RNA, 21 nt, Homo sapiens
guauuuucaugaaaauaccau

SEQ ID NO: 530674 - RNA, 17 nt, Homo sapiens
guauuuucuccacuuca

SEQ ID NO: 530675 - RNA, 22 nt, Homo sapiens
gucaacuccaacguaugugguu

SEQ ID NO: 530676 - RNA, 20 nt, Homo sapiens
gucaaggcaguagaacucca

SEQ ID NO: 530677 - RNA, 19 nt, Homo sapiens
gucacauuuagcugugcuc

SEQ ID NO: 530678 - RNA, 16 nt, Homo sapiens
gucacggccaagugua

SEQ ID NO: 530679 - RNA, 16 nt, Homo sapiens
gucacugacaguuaau

SEQ ID NO: 530680 - RNA, 22 nt, Homo sapiens
gucagccaccugggaacacagu

SEQ ID NO: 530681 - RNA, 13 nt, Homo sapiens
gucauaacaucca

SEQ ID NO: 530682 - RNA, 14 nt, Homo sapiens
gucaucaucacauu

SEQ ID NO: 530683 - RNA, 21 nt, Homo sapiens
gucauguuugcaggggugacg

SEQ ID NO: 530684 - RNA, 18 nt, Homo sapiens
gucauuagacgguaccaa

SEQ ID NO: 530685 - RNA, 13 nt, Homo sapiens
guccacaaagcau

SEQ ID NO: 530686 - RNA, 15 nt, Homo sapiens
gucccaccugcacac

SEQ ID NO: 530687 - RNA, 17 nt, Homo sapiens
gucccuugguccuggaa

SEQ ID NO: 530688 - RNA, 12 nt, Homo sapiens
guccuacaguga

SEQ ID NO: 530689 - RNA, 15 nt, Homo sapiens
guccuacuccuugca

SEQ ID NO: 530690 - RNA, 16 nt, Homo sapiens
guccugaccaucgcac

SEQ ID NO: 530691 - RNA, 21 nt, Homo sapiens
guccugagcaccacacccagu

SEQ ID NO: 530692 - RNA, 12 nt, Homo sapiens
guccuggucaag

SEQ ID NO: 530693 - RNA, 19 nt, Homo sapiens
gucgaauuccuacugacaa

SEQ ID NO: 530694 - RNA, 22 nt, Homo sapiens
gucuagcauucugcaacauuua

SEQ ID NO: 530695 - RNA, 23 nt, Homo sapiens
gucuaguucuuuucauuuggaau

SEQ ID NO: 530696 - RNA, 12 nt, Homo sapiens
gucuaugcugcu

SEQ ID NO: 530697 - RNA, 21 nt, Homo sapiens
gucucaaaccaagcaaaggaa

SEQ ID NO: 530698 - RNA, 19 nt, Homo sapiens
gucucaaacuccugaccuc

SEQ ID NO: 530699 - RNA, 23 nt, Homo sapiens
gucuccucaauuuuugucucaga

SEQ ID NO: 530700 - RNA, 18 nt, Homo sapiens
gucucuucuuggggccca

SEQ ID NO: 530701 - RNA, 15 nt, Homo sapiens
gucugauaaacugac

SEQ ID NO: 530702 - RNA, 14 nt, Homo sapiens
gucugcaugugcac

SEQ ID NO: 530703 - RNA, 16 nt, Homo sapiens
gucugcugcugugcag

SEQ ID NO: 530704 - RNA, 20 nt, Homo sapiens
gucuguauuugguauauacu

SEQ ID NO: 530705 - RNA, 14 nt, Homo sapiens
gucuuacauugcca

SEQ ID NO: 530706 - RNA, 12 nt, Homo sapiens
gucuuggcuuuu

SEQ ID NO: 530707 - RNA, 21 nt, Homo sapiens
gucuuugcccugaauggucuc

SEQ ID NO: 530708 - RNA, 22 nt, Homo sapiens
gucuuugcccugaauggucuca

SEQ ID NO: 530709 - RNA, 13 nt, Homo sapiens
gugaaacuaacag

SEQ ID NO: 530710 - RNA, 15 nt, Homo sapiens
gugaacucuggugcu

SEQ ID NO: 530711 - RNA, 20 nt, Homo sapiens
gugaccucugacaacuguga

SEQ ID NO: 530712 - RNA, 22 nt, Homo sapiens
gugagccaaagcuuaugugaca

SEQ ID NO: 530713 - RNA, 15 nt, Homo sapiens
gugaggagucugggu

SEQ ID NO: 530714 - RNA, 15 nt, Homo sapiens
gugaggcccauucuu

SEQ ID NO: 530715 - RNA, 13 nt, Homo sapiens
gugagugugacag

SEQ ID NO: 530716 - RNA, 16 nt, Homo sapiens
gugauccgccuaccuc

SEQ ID NO: 530717 - RNA, 22 nt, Homo sapiens
gugaugacuuagcgucaagaca

SEQ ID NO: 530718 - RNA, 15 nt, Homo sapiens
gugauuuacagggau

SEQ ID NO: 530719 - RNA, 11 nt, Homo sapiens
gugcaaaggga

SEQ ID NO: 530720 - RNA, 16 nt, Homo sapiens
gugcaauagcagggau

SEQ ID NO: 530721 - RNA, 15 nt, Homo sapiens
gugcacagacugucu

SEQ ID NO: 530722 - RNA, 21 nt, Homo sapiens
gugcagccccuuccuggugac

SEQ ID NO: 530723 - RNA, 22 nt, Homo sapiens
gugcaguacuuugugcauucug

SEQ ID NO: 530724 - RNA, 15 nt, Homo sapiens
gugcauggaggcccu

SEQ ID NO: 530725 - RNA, 18 nt, Homo sapiens
gugccacuggaccucagu

SEQ ID NO: 530726 - RNA, 19 nt, Homo sapiens
gugccagaggccagaccca

SEQ ID NO: 530727 - RNA, 10 nt, Homo sapiens
gugcccucca

SEQ ID NO: 530728 - RNA, 18 nt, Homo sapiens
gugccgugugagugugac

SEQ ID NO: 530729 - RNA, 22 nt, Homo sapiens
gugcuaugaagccaacugacaa

SEQ ID NO: 530730 - RNA, 20 nt, Homo sapiens
guggcagacaucggccucca

SEQ ID NO: 530731 - RNA, 18 nt, Homo sapiens
guggcucacccuguccag

SEQ ID NO: 530732 - RNA, 22 nt, Homo sapiens
guggcucaugccuguaauccca

SEQ ID NO: 530733 - RNA, 14 nt, Homo sapiens
gugggccgagguga

SEQ ID NO: 530734 - RNA, 22 nt, Homo sapiens
gugggccgaggugacugcagac

SEQ ID NO: 530735 - RNA, 23 nt, Homo sapiens
guggucacaacuugauggcugcg

SEQ ID NO: 530736 - RNA, 17 nt, Homo sapiens
gugguuucccaucucca

SEQ ID NO: 530737 - RNA, 20 nt, Homo sapiens
guguacaaauacauguguau

SEQ ID NO: 530738 - RNA, 12 nt, Homo sapiens
guguaugcagua

SEQ ID NO: 530739 - RNA, 22 nt, Homo sapiens
guguauuuauuuuacagcucau

SEQ ID NO: 530740 - RNA, 21 nt, Homo sapiens
guguccccgcugcugugcaac

SEQ ID NO: 530741 - RNA, 14 nt, Homo sapiens
guguccucagggag

SEQ ID NO: 530742 - RNA, 13 nt, Homo sapiens
guguccuggugag

SEQ ID NO: 530743 - RNA, 23 nt, Homo sapiens
gugugccuauagucccacuacuu

SEQ ID NO: 530744 - RNA, 13 nt, Homo sapiens
guguggcucagug

SEQ ID NO: 530745 - RNA, 15 nt, Homo sapiens
guguguacaaauaca

SEQ ID NO: 530746 - RNA, 14 nt, Homo sapiens
gugugugcacaucc

SEQ ID NO: 530747 - RNA, 14 nt, Homo sapiens
gugugugugcacau

SEQ ID NO: 530748 - RNA, 21 nt, Homo sapiens
guguuaucacaguaacccaga

SEQ ID NO: 530749 - RNA, 15 nt, Homo sapiens
guguuauuugcacac

SEQ ID NO: 530750 - RNA, 18 nt, Homo sapiens
guguucccagagcacuuu

SEQ ID NO: 530751 - RNA, 15 nt, Homo sapiens
guguugcaccaggca

SEQ ID NO: 530752 - RNA, 20 nt, Homo sapiens
guguugcaccaggcacugcu

SEQ ID NO: 530753 - RNA, 22 nt, Homo sapiens
guguugcaccaggcacugcugc

SEQ ID NO: 530754 - RNA, 20 nt, Homo sapiens
guguuuauuauaaagcuuaa

SEQ ID NO: 530755 - RNA, 13 nt, Homo sapiens
guuaacuugcaua

SEQ ID NO: 530756 - RNA, 17 nt, Homo sapiens
auuucccaacacaaaga

SEQ ID NO: 530757 - RNA, 21 nt, Homo sapiens
auuuccgugaacucuggugcu

SEQ ID NO: 530758 - RNA, 15 nt, Homo sapiens
auuuccuccucaucu

SEQ ID NO: 530759 - RNA, 15 nt, Homo sapiens
auuucguguacugca

SEQ ID NO: 530760 - RNA, 14 nt, Homo sapiens
auuucugacucuau

SEQ ID NO: 530761 - RNA, 19 nt, Homo sapiens
auuucugaucuauacaaau

SEQ ID NO: 530762 - RNA, 16 nt, Homo sapiens
auuugaaauauggucu

SEQ ID NO: 530763 - RNA, 19 nt, Homo sapiens
auuugaggucaaguaagaa

SEQ ID NO: 530764 - RNA, 23 nt, Homo sapiens
auuugauucuccagccaaccuca

SEQ ID NO: 530765 - RNA, 16 nt, Homo sapiens
auuugcacacugcacu

SEQ ID NO: 530766 - RNA, 17 nt, Homo sapiens
auuugcacacugcacug

SEQ ID NO: 530767 - RNA, 22 nt, Homo sapiens
auuugcuaaucaaagccagggu

SEQ ID NO: 530768 - RNA, 12 nt, Homo sapiens
auuuggugcugg

SEQ ID NO: 530769 - RNA, 17 nt, Homo sapiens
auuuguaaagcuauuua

SEQ ID NO: 530770 - RNA, 18 nt, Homo sapiens
auuuguuuuaugcuacug

SEQ ID NO: 530771 - RNA, 15 nt, Homo sapiens
auuuuaauacauuga

SEQ ID NO: 530772 - RNA, 16 nt, Homo sapiens
auuuuauuuuacuauu

SEQ ID NO: 530773 - RNA, 14 nt, Homo sapiens
auuuucaaguuuac

SEQ ID NO: 530774 - RNA, 16 nt, Homo sapiens
auuuucuuucacuuaa

SEQ ID NO: 530775 - RNA, 19 nt, Homo sapiens
auuuugaaaacugugcaau

SEQ ID NO: 530776 - RNA, 21 nt, Homo sapiens
auuuugaaauauaguaaacac

SEQ ID NO: 530777 - RNA, 20 nt, Homo sapiens
auuuugagaucaucagugau

SEQ ID NO: 530778 - RNA, 16 nt, Homo sapiens
auuuugcaccuguaaa

SEQ ID NO: 530779 - RNA, 14 nt, Homo sapiens
auuuugcacuagaa

SEQ ID NO: 530780 - RNA, 20 nt, Homo sapiens
auuuuguaauguaucaaaua

SEQ ID NO: 530781 - RNA, 17 nt, Homo sapiens
auuuuguguaagaaaua

SEQ ID NO: 530782 - RNA, 21 nt, Homo sapiens
auuuuguugccuucaucuuca

SEQ ID NO: 530783 - RNA, 15 nt, Homo sapiens
auuuuuguguaggug

SEQ ID NO: 530784 - RNA, 14 nt, Homo sapiens
auuuuuucccccac

SEQ ID NO: 530785 - RNA, 16 nt, Homo sapiens
auuuuuuuuugaagca

SEQ ID NO: 530786 - RNA, 16 nt, Homo sapiens
caaaaaaacaaaaaag

SEQ ID NO: 530787 - RNA, 15 nt, Homo sapiens
caaaaaaaggaagga

SEQ ID NO: 530788 - RNA, 20 nt, Homo sapiens
caaaaauagcccugcaaaaa

SEQ ID NO: 530789 - RNA, 17 nt, Homo sapiens
caaaagaauaagacaag

SEQ ID NO: 530790 - RNA, 19 nt, Homo sapiens
caaaagccuuaccuugaaa

SEQ ID NO: 530791 - RNA, 13 nt, Homo sapiens
caaaccaggauuu

SEQ ID NO: 530792 - RNA, 13 nt, Homo sapiens
caaacgagacuuu

SEQ ID NO: 530793 - RNA, 14 nt, Homo sapiens
caaacuuacuauuu

SEQ ID NO: 530794 - RNA, 18 nt, Homo sapiens
caaagauaauuuauuuca

SEQ ID NO: 530795 - RNA, 14 nt, Homo sapiens
caaagcacauuggg

SEQ ID NO: 530796 - RNA, 16 nt, Homo sapiens
caaagccggcuugauu

SEQ ID NO: 530797 - RNA, 16 nt, Homo sapiens
caaagcuuaugugaca

SEQ ID NO: 530798 - RNA, 17 nt, Homo sapiens
caaagcuuaugugacau

SEQ ID NO: 530799 - RNA, 23 nt, Homo sapiens
caaagcuuuccuguuuccagggu

SEQ ID NO: 530800 - RNA, 14 nt, Homo sapiens
caaaguacucuuua

SEQ ID NO: 530801 - RNA, 14 nt, Homo sapiens
caaagugcacauga

SEQ ID NO: 530802 - RNA, 18 nt, Homo sapiens
caaagugcggcugccauu

SEQ ID NO: 530803 - RNA, 17 nt, Homo sapiens
caaaguguaugugacca

SEQ ID NO: 530804 - RNA, 20 nt, Homo sapiens
caaaucagaccuggcugcuu

SEQ ID NO: 530805 - RNA, 16 nt, Homo sapiens
caaaucuaccacugua

SEQ ID NO: 530806 - RNA, 21 nt, Homo sapiens
caaaucuggguaucuuuccag

SEQ ID NO: 530807 - RNA, 20 nt, Homo sapiens
caaauuaaaacaaauauaca

SEQ ID NO: 530808 - RNA, 20 nt, Homo sapiens
caaauuuccuuucauaccuu

SEQ ID NO: 530809 - RNA, 13 nt, Homo sapiens
caacaacgacaca

SEQ ID NO: 530810 - RNA, 16 nt, Homo sapiens
caacaggucacuugau

SEQ ID NO: 530811 - RNA, 21 nt, Homo sapiens
caacauccacuguuagcacau

SEQ ID NO: 530812 - RNA, 16 nt, Homo sapiens
caacaugcacugaugu

SEQ ID NO: 530813 - RNA, 11 nt, Homo sapiens
caacaugguga

SEQ ID NO: 530814 - RNA, 23 nt, Homo sapiens
caacauuuauauagacuguugaa

SEQ ID NO: 530815 - RNA, 18 nt, Homo sapiens
caaccauuugaaaccccu

SEQ ID NO: 530816 - RNA, 20 nt, Homo sapiens
caaccuaagggcccaaaggc

SEQ ID NO: 530817 - RNA, 17 nt, Homo sapiens
caaccucauugcagcua

SEQ ID NO: 530818 - RNA, 13 nt, Homo sapiens
caaccuccagugu

SEQ ID NO: 530819 - RNA, 20 nt, Homo sapiens
caacuccugucuaacugcug

SEQ ID NO: 530820 - RNA, 16 nt, Homo sapiens
caacucuccaauguuc

SEQ ID NO: 530821 - RNA, 20 nt, Homo sapiens
caacugaguguuauuugcac

SEQ ID NO: 530822 - RNA, 13 nt, Homo sapiens
caagaacuugcaa

SEQ ID NO: 530823 - RNA, 19 nt, Homo sapiens
caagaacuugcaauaccaa

SEQ ID NO: 530824 - RNA, 13 nt, Homo sapiens
caagaauagcauu

SEQ ID NO: 530825 - RNA, 23 nt, Homo sapiens
caagacagggcucauuuuugcac

SEQ ID NO: 530826 - RNA, 17 nt, Homo sapiens
caagacauuugcugaac

SEQ ID NO: 530827 - RNA, 19 nt, Homo sapiens
caagagauaagucuuucau

SEQ ID NO: 530828 - RNA, 12 nt, Homo sapiens
caagagaucuac

SEQ ID NO: 530829 - RNA, 14 nt, Homo sapiens
caagauaauuuuca

SEQ ID NO: 530830 - RNA, 19 nt, Homo sapiens
caagaucagccugggcaac

SEQ ID NO: 530831 - RNA, 18 nt, Homo sapiens
caagaugaaugcagauua

SEQ ID NO: 530832 - RNA, 19 nt, Homo sapiens
caagaugcgcacugcauuc

SEQ ID NO: 530833 - RNA, 18 nt, Homo sapiens
caagcgucaucuguguaa

SEQ ID NO: 530834 - RNA, 16 nt, Homo sapiens
caagcucaguucaaug

SEQ ID NO: 530835 - RNA, 15 nt, Homo sapiens
caaggaauaaaugag

SEQ ID NO: 530836 - RNA, 15 nt, Homo sapiens
caaggagaauaugau

SEQ ID NO: 530837 - RNA, 18 nt, Homo sapiens
caaggaguacuccaagac

SEQ ID NO: 530838 - RNA, 24 nt, Homo sapiens
caaggcccugagcuuuguccugaa

SEQ ID NO: 530839 - RNA, 15 nt, Homo sapiens
caaggccuccaggga

SEQ ID NO: 530840 - RNA, 13 nt, Homo sapiens
caagggcaccugg

SEQ ID NO: 530841 - RNA, 20 nt, Homo sapiens
caaggguucuuggugaugcu

SEQ ID NO: 530842 - RNA, 15 nt, Homo sapiens
caaguaacugaacca

SEQ ID NO: 530843 - RNA, 14 nt, Homo sapiens
caagucagcuccag

SEQ ID NO: 530844 - RNA, 14 nt, Homo sapiens
caagugcacugagc

SEQ ID NO: 530845 - RNA, 14 nt, Homo sapiens
caagugcugucuug

SEQ ID NO: 530846 - RNA, 14 nt, Homo sapiens
caagugugugcucu

SEQ ID NO: 530847 - RNA, 16 nt, Homo sapiens
caaguugcaucagaaa

SEQ ID NO: 530848 - RNA, 20 nt, Homo sapiens
caaguuuaaaagccauguau

SEQ ID NO: 530849 - RNA, 13 nt, Homo sapiens
caauaaagcaaug

SEQ ID NO: 530850 - RNA, 18 nt, Homo sapiens
caauaaagcaauguggua

SEQ ID NO: 530851 - RNA, 18 nt, Homo sapiens
caauaaaggcagcugccu

SEQ ID NO: 530852 - RNA, 16 nt, Homo sapiens
caauaaaguacuuuac

SEQ ID NO: 530853 - RNA, 14 nt, Homo sapiens
caauagaucuccag

SEQ ID NO: 530854 - RNA, 14 nt, Homo sapiens
caauaggagucuua

SEQ ID NO: 530855 - RNA, 19 nt, Homo sapiens
caaucccaacuacguaaua

SEQ ID NO: 530856 - RNA, 20 nt, Homo sapiens
caaucugccuguaucucuca

SEQ ID NO: 530857 - RNA, 16 nt, Homo sapiens
caaugcuccaucccaa

SEQ ID NO: 530858 - RNA, 23 nt, Homo sapiens
caauggugucaguauccaggcuu

SEQ ID NO: 530859 - RNA, 21 nt, Homo sapiens
caauguguggcucagugccug

SEQ ID NO: 530860 - RNA, 13 nt, Homo sapiens
caauuaaucauuu

SEQ ID NO: 530861 - RNA, 15 nt, Homo sapiens
caauuaguggucaua

SEQ ID NO: 530862 - RNA, 13 nt, Homo sapiens
caauucaguccug

SEQ ID NO: 530863 - RNA, 22 nt, Homo sapiens
caauucccccauccuucaguga

SEQ ID NO: 530864 - RNA, 20 nt, Homo sapiens
caauugucuauuuaucuuuu

SEQ ID NO: 530865 - RNA, 16 nt, Homo sapiens
cacaaaaucacuuuaa

SEQ ID NO: 530866 - RNA, 13 nt, Homo sapiens
cacaaacccaagg

SEQ ID NO: 530867 - RNA, 14 nt, Homo sapiens
cacaauacaguauu

SEQ ID NO: 530868 - RNA, 18 nt, Homo sapiens
cacaccaaguaccaguau

SEQ ID NO: 530869 - RNA, 16 nt, Homo sapiens
cacacccgugagaaau

SEQ ID NO: 530870 - RNA, 15 nt, Homo sapiens
cacacccugacuuca

SEQ ID NO: 530871 - RNA, 21 nt, Homo sapiens
cacaccuggcccuugcaaucu

SEQ ID NO: 530872 - RNA, 13 nt, Homo sapiens
cacacggaucuga

SEQ ID NO: 530873 - RNA, 15 nt, Homo sapiens
cacacugucuguaua

SEQ ID NO: 530874 - RNA, 19 nt, Homo sapiens
cacacugucuguauagugu

SEQ ID NO: 530875 - RNA, 15 nt, Homo sapiens
cacacugugccccac

SEQ ID NO: 530876 - RNA, 19 nt, Homo sapiens
cacagacaacaguugcaca

SEQ ID NO: 530877 - RNA, 15 nt, Homo sapiens
cacagacugaccccc

SEQ ID NO: 530878 - RNA, 16 nt, Homo sapiens
uacaaucuuagugaau

SEQ ID NO: 530879 - RNA, 15 nt, Homo sapiens
uacacaauacaguau

SEQ ID NO: 530880 - RNA, 17 nt, Homo sapiens
uacacaauacaguauua

SEQ ID NO: 530881 - RNA, 19 nt, Homo sapiens
uacacacacacgcacacaa

SEQ ID NO: 530882 - RNA, 23 nt, Homo sapiens
uacaccaaugaaaacauguacua

SEQ ID NO: 530883 - RNA, 13 nt, Homo sapiens
uacaggaauuauu

SEQ ID NO: 530884 - RNA, 15 nt, Homo sapiens
uacaguacacagaua

SEQ ID NO: 530885 - RNA, 15 nt, Homo sapiens
uacauaugagaauau

SEQ ID NO: 530886 - RNA, 12 nt, Homo sapiens
uacauaugcuga

SEQ ID NO: 530887 - RNA, 13 nt, Homo sapiens
uacaucaucucca

SEQ ID NO: 530888 - RNA, 21 nt, Homo sapiens
uacaucugggacugacuuucc

SEQ ID NO: 530889 - RNA, 21 nt, Homo sapiens
uacaucuuuuuuucuaugaaa

SEQ ID NO: 530890 - RNA, 21 nt, Homo sapiens
uacaugucuagagaacacugu

SEQ ID NO: 530891 - RNA, 22 nt, Homo sapiens
uacauuguucuuauucuggcau

SEQ ID NO: 530892 - RNA, 11 nt, Homo sapiens
uaccacuugaa

SEQ ID NO: 530893 - RNA, 18 nt, Homo sapiens
uaccacuuuaaacacccc

SEQ ID NO: 530894 - RNA, 17 nt, Homo sapiens
uaccaguauaagcaucu

SEQ ID NO: 530895 - RNA, 22 nt, Homo sapiens
uaccaguauaagcaucugccau

SEQ ID NO: 530896 - RNA, 16 nt, Homo sapiens
uaccauucacuacuca

SEQ ID NO: 530897 - RNA, 23 nt, Homo sapiens
uacccugacacaagaaguucuug

SEQ ID NO: 530898 - RNA, 16 nt, Homo sapiens
uaccuauugcacucca

SEQ ID NO: 530899 - RNA, 23 nt, Homo sapiens
uaccugcuggaagaauucuagca

SEQ ID NO: 530900 - RNA, 22 nt, Homo sapiens
uaccuuccccacaucugagaga

SEQ ID NO: 530901 - RNA, 15 nt, Homo sapiens
uaccuugaacucuua

SEQ ID NO: 530902 - RNA, 19 nt, Homo sapiens
uaccuugggggaaccugga

SEQ ID NO: 530903 - RNA, 23 nt, Homo sapiens
uacggacuuccuuuaggaucuca

SEQ ID NO: 530904 - RNA, 16 nt, Homo sapiens
uacuaaaacacugaaa

SEQ ID NO: 530905 - RNA, 17 nt, Homo sapiens
uacuaaaacacugaaaa

SEQ ID NO: 530906 - RNA, 15 nt, Homo sapiens
uacuaauuuuacuuc

SEQ ID NO: 530907 - RNA, 16 nt, Homo sapiens
uacuaucauggcauau

SEQ ID NO: 530908 - RNA, 23 nt, Homo sapiens
uacugacaacauuauaacuguau

SEQ ID NO: 530909 - RNA, 21 nt, Homo sapiens
cauguaugucagaagugcaga

SEQ ID NO: 530910 - RNA, 16 nt, Homo sapiens
cauguauuuguuauau

SEQ ID NO: 530911 - RNA, 17 nt, Homo sapiens
cauguccuaauucuucu

SEQ ID NO: 530912 - RNA, 16 nt, Homo sapiens
caugucuugacuguua

SEQ ID NO: 530913 - RNA, 23 nt, Homo sapiens
cauguugcaaagaacuccagagu

SEQ ID NO: 530914 - RNA, 11 nt, Homo sapiens
cauguuugcag

SEQ ID NO: 530915 - RNA, 15 nt, Homo sapiens
cauuaacugcacaaa

SEQ ID NO: 530916 - RNA, 20 nt, Homo sapiens
cauuaacugcacaaacaaua

SEQ ID NO: 530917 - RNA, 17 nt, Homo sapiens
cauuaauuaaaagugug

SEQ ID NO: 530918 - RNA, 17 nt, Homo sapiens
cauuacuuuuucauaua

SEQ ID NO: 530919 - RNA, 16 nt, Homo sapiens
cauuagucaauaacua

SEQ ID NO: 530920 - RNA, 16 nt, Homo sapiens
cauuauuaugcaaaau

SEQ ID NO: 530921 - RNA, 17 nt, Homo sapiens
cauuccaacuucaauuu

SEQ ID NO: 530922 - RNA, 15 nt, Homo sapiens
cauuccauuuuguga

SEQ ID NO: 530923 - RNA, 23 nt, Homo sapiens
cauugaugagcaagacauacuua

SEQ ID NO: 530924 - RNA, 15 nt, Homo sapiens
cauugcacauaagcu

SEQ ID NO: 530925 - RNA, 18 nt, Homo sapiens
cauugcacauaagcuucc

SEQ ID NO: 530926 - RNA, 19 nt, Homo sapiens
cauuggcacuguggagcuc

SEQ ID NO: 530927 - RNA, 15 nt, Homo sapiens
cauugucuacuccua

SEQ ID NO: 530928 - RNA, 18 nt, Homo sapiens
cauuguuguucugcucaa

SEQ ID NO: 530929 - RNA, 20 nt, Homo sapiens
cauuuacuuagcagaaccac

SEQ ID NO: 530930 - RNA, 11 nt, Homo sapiens
cauuugcugaa

SEQ ID NO: 530931 - RNA, 20 nt, Homo sapiens
cauuuuugucagagugcaca

SEQ ID NO: 530932 - RNA, 12 nt, Homo sapiens
ccaaaaccagaa

SEQ ID NO: 530933 - RNA, 20 nt, Homo sapiens
ccaaaauauaaucagagaua

SEQ ID NO: 530934 - RNA, 13 nt, Homo sapiens
ccaaaauuugaug

SEQ ID NO: 530935 - RNA, 19 nt, Homo sapiens
ccaaagacgaccagcauuu

SEQ ID NO: 530936 - RNA, 11 nt, Homo sapiens
ccaacacaaag

SEQ ID NO: 530937 - RNA, 15 nt, Homo sapiens
ccaacaugcacugau

SEQ ID NO: 530938 - RNA, 24 nt, Homo sapiens
ccaacguaugugguuaucugugaa

SEQ ID NO: 530939 - RNA, 20 nt, Homo sapiens
ccaacugaguguuauuugca

SEQ ID NO: 530940 - RNA, 13 nt, Homo sapiens
ccaagaacuugca

SEQ ID NO: 530941 - RNA, 17 nt, Homo sapiens
ccaagaagcaaaguuca

SEQ ID NO: 530942 - RNA, 19 nt, Homo sapiens
ccaaggaaacgcuaccucu

SEQ ID NO: 530943 - RNA, 23 nt, Homo sapiens
ccaaggcauugauugcacuugau

SEQ ID NO: 530944 - RNA, 15 nt, Homo sapiens
ccaagugcaaaagaa

SEQ ID NO: 530945 - RNA, 19 nt, Homo sapiens
ccaauaaaggcagcugccu

SEQ ID NO: 530946 - RNA, 18 nt, Homo sapiens
ccaaugagacucuagggu

SEQ ID NO: 530947 - RNA, 22 nt, Homo sapiens
ccaaugcuucuguugaucucag

SEQ ID NO: 530948 - RNA, 21 nt, Homo sapiens
ccaauguucuaaaguuuugca

SEQ ID NO: 530949 - RNA, 23 nt, Homo sapiens
ccaauguucuaaaguuuugcaac

SEQ ID NO: 530950 - RNA, 23 nt, Homo sapiens
ccaauguucuauuaaucaccucu

SEQ ID NO: 530951 - RNA, 14 nt, Homo sapiens
ccacaaaucuucag

SEQ ID NO: 530952 - RNA, 18 nt, Homo sapiens
ccacacccacuuugucca

SEQ ID NO: 530953 - RNA, 15 nt, Homo sapiens
ccacacuaacgugug

SEQ ID NO: 530954 - RNA, 15 nt, Homo sapiens
ccacauauugagaug

SEQ ID NO: 530955 - RNA, 23 nt, Homo sapiens
ccacauuuagauccugguuucau

SEQ ID NO: 530956 - RNA, 21 nt, Homo sapiens
ccaccucggcacacacugugc

SEQ ID NO: 530957 - RNA, 22 nt, Homo sapiens
ccaccucggcacacacugugcc

SEQ ID NO: 530958 - RNA, 16 nt, Homo sapiens
ccacuacaucugggac

SEQ ID NO: 530959 - RNA, 23 nt, Homo sapiens
ccacucaccgaagccacuuucua

SEQ ID NO: 530960 - RNA, 18 nt, Homo sapiens
ccacucaggccacagugg

SEQ ID NO: 530961 - RNA, 24 nt, Homo sapiens
ccacucuuguggucaucauggcca

SEQ ID NO: 530962 - RNA, 20 nt, Homo sapiens
ccacugcaaauaaagccuuu

SEQ ID NO: 530963 - RNA, 14 nt, Homo sapiens
ccacugccugggau

SEQ ID NO: 530964 - RNA, 14 nt, Homo sapiens
ccacuguaugagug

SEQ ID NO: 530965 - RNA, 19 nt, Homo sapiens
ccacuuuaaacacccccau

SEQ ID NO: 530966 - RNA, 22 nt, Homo sapiens
ccagaauaauucuuaacagugg

SEQ ID NO: 530967 - RNA, 19 nt, Homo sapiens
ccagaggugucacccaaac

SEQ ID NO: 530968 - RNA, 13 nt, Homo sapiens
ccagaucuuucag

SEQ ID NO: 530969 - RNA, 16 nt, Homo sapiens
ccagauguuagaucag

SEQ ID NO: 530970 - RNA, 16 nt, Homo sapiens
ccagcacuuugggagg

SEQ ID NO: 530971 - RNA, 22 nt, Homo sapiens
ccagccaaccucauugcagcua

SEQ ID NO: 530972 - RNA, 18 nt, Homo sapiens
ccagcucaaugcaauggc

SEQ ID NO: 530973 - RNA, 23 nt, Homo sapiens
ccagcugacacgcucaguugaaa

SEQ ID NO: 530974 - RNA, 13 nt, Homo sapiens
ccaggaagacuuu

SEQ ID NO: 530975 - RNA, 13 nt, Homo sapiens
ccaggcacagugg

SEQ ID NO: 530976 - RNA, 16 nt, Homo sapiens
ccaggcacugcugcac

SEQ ID NO: 530977 - RNA, 20 nt, Homo sapiens
ccaggcuggagugcaguggu

SEQ ID NO: 530978 - RNA, 14 nt, Homo sapiens
ccagguguucuaca

SEQ ID NO: 530979 - RNA, 14 nt, Homo sapiens
ccaguccaaagccg

SEQ ID NO: 530980 - RNA, 15 nt, Homo sapiens
ccagucccacacugu

SEQ ID NO: 530981 - RNA, 14 nt, Homo sapiens
ccaguuguugccaa

SEQ ID NO: 530982 - RNA, 18 nt, Homo sapiens
ccaucagugaauccugaa

SEQ ID NO: 530983 - RNA, 15 nt, Homo sapiens
ccaucccugcuuauu

SEQ ID NO: 530984 - RNA, 19 nt, Homo sapiens
ccauccuucagugaacuaa

SEQ ID NO: 530985 - RNA, 11 nt, Homo sapiens
ccaugaaguca

SEQ ID NO: 530986 - RNA, 21 nt, Homo sapiens
ccaugccaggaaccuguccua

SEQ ID NO: 530987 - RNA, 17 nt, Homo sapiens
ccaugcguccuggucaa

SEQ ID NO: 530988 - RNA, 16 nt, Homo sapiens
ccauggcccccaauaa

SEQ ID NO: 530989 - RNA, 13 nt, Homo sapiens
ccauguaucuuuu

SEQ ID NO: 530990 - RNA, 17 nt, Homo sapiens
aaagucagcgugacaau

SEQ ID NO: 530991 - RNA, 14 nt, Homo sapiens
aaagucaucuuuac

SEQ ID NO: 530992 - RNA, 18 nt, Homo sapiens
aaaguccccuuaagccaa

SEQ ID NO: 530993 - RNA, 18 nt, Homo sapiens
aaagucccuugagacucc

SEQ ID NO: 530994 - RNA, 17 nt, Homo sapiens
aaaguccucugcuccag

SEQ ID NO: 530995 - RNA, 15 nt, Homo sapiens
aaagucgccagucac

SEQ ID NO: 530996 - RNA, 19 nt, Homo sapiens
aaagucugucuuuccugaa

SEQ ID NO: 530997 - RNA, 19 nt, Homo sapiens
aaagugagacuccgucaca

SEQ ID NO: 530998 - RNA, 16 nt, Homo sapiens
aaagugauaugcauuu

SEQ ID NO: 530999 - RNA, 9 nt, Homo sapiens
aaagugaug

SEQ ID NO: 531000 - RNA, 15 nt, Homo sapiens
aaagugcagcccuuc

SEQ ID NO: 531001 - RNA, 21 nt, Homo sapiens
aaagugcugggauuacaggcg

SEQ ID NO: 531002 - RNA, 15 nt, Homo sapiens
aaaguggaaacaaua

SEQ ID NO: 531003 - RNA, 16 nt, Homo sapiens
aaaguggaaguaugua

SEQ ID NO: 531004 - RNA, 19 nt, Homo sapiens
aaagugguaaauacuguga

SEQ ID NO: 531005 - RNA, 14 nt, Homo sapiens
aaaguguaacaauu

SEQ ID NO: 531006 - RNA, 17 nt, Homo sapiens
aaacacgaaacuuguua

SEQ ID NO: 531007 - RNA, 15 nt, Homo sapiens
aaacacgugucuaua

SEQ ID NO: 531008 - RNA, 13 nt, Homo sapiens
aaacacuagcucu

SEQ ID NO: 531009 - RNA, 14 nt, Homo sapiens
aaacacuagcucug

SEQ ID NO: 531010 - RNA, 12 nt, Homo sapiens
aaacacuccacc

SEQ ID NO: 531011 - RNA, 23 nt, Homo sapiens
aaacacucuugaauagacuucca

SEQ ID NO: 531012 - RNA, 13 nt, Homo sapiens
aaacacuucucau

SEQ ID NO: 531013 - RNA, 21 nt, Homo sapiens
aaacacuucugcuuucacuua

SEQ ID NO: 531014 - RNA, 16 nt, Homo sapiens
aaacagaacaggguca

SEQ ID NO: 531015 - RNA, 22 nt, Homo sapiens
aaacagaacucgaugcacugac

SEQ ID NO: 531016 - RNA, 17 nt, Homo sapiens
aaacagaacugcaguca

SEQ ID NO: 531017 - RNA, 22 nt, Homo sapiens
aaacagagacaggcccaagaga

SEQ ID NO: 531018 - RNA, 19 nt, Homo sapiens
aaacagauuguuugcaaag

SEQ ID NO: 531019 - RNA, 21 nt, Homo sapiens
aaacagcaggacuuguuuaca

SEQ ID NO: 531020 - RNA, 14 nt, Homo sapiens
aaacagcaguccca

SEQ ID NO: 531021 - RNA, 20 nt, Homo sapiens
aaacagggaauacauuguau

SEQ ID NO: 531022 - RNA, 16 nt, Homo sapiens
aaacagggacaaagaa

SEQ ID NO: 531023 - RNA, 22 nt, Homo sapiens
aaacagggcugccuucuggccu

SEQ ID NO: 531024 - RNA, 18 nt, Homo sapiens
aaacagguauauacuuug

SEQ ID NO: 531025 - RNA, 21 nt, Homo sapiens
aaacagguuauaacaguguuu

SEQ ID NO: 531026 - RNA, 15 nt, Homo sapiens
aaacaguucuuggac

SEQ ID NO: 531027 - RNA, 20 nt, Homo sapiens
aaacugccaguuuuguuucc

SEQ ID NO: 531028 - RNA, 10 nt, Homo sapiens
aaacugccau

SEQ ID NO: 531029 - RNA, 16 nt, Homo sapiens
aaacugcgaggccagu

SEQ ID NO: 531030 - RNA, 14 nt, Homo sapiens
aaacugcucuggaa

SEQ ID NO: 531031 - RNA, 21 nt, Homo sapiens
aaacugcugcaaaaguucuca

SEQ ID NO: 531032 - RNA, 14 nt, Homo sapiens
aaacugcugugaau

SEQ ID NO: 531033 - RNA, 20 nt, Homo sapiens
aaacugggcuccugcuuuau

SEQ ID NO: 531034 - RNA, 14 nt, Homo sapiens
aaacuguacagugu

SEQ ID NO: 531035 - RNA, 22 nt, Homo sapiens
aaacugucucccccauugcucu

SEQ ID NO: 531036 - RNA, 15 nt, Homo sapiens
aaacuuaacauucau

SEQ ID NO: 531037 - RNA, 13 nt, Homo sapiens
aaacuuagaucau

SEQ ID NO: 531038 - RNA, 21 nt, Homo sapiens
aaacuuauucgcaauagacaa

SEQ ID NO: 531039 - RNA, 21 nt, Homo sapiens
aaacuucaguuucacagaaaa

SEQ ID NO: 531040 - RNA, 21 nt, Homo sapiens
aaacuuccacaagagugaauu

SEQ ID NO: 531041 - RNA, 16 nt, Homo sapiens
aaacuugcaucacuua

SEQ ID NO: 531042 - RNA, 22 nt, Homo sapiens
aaacuugccuggggucugagca

SEQ ID NO: 531043 - RNA, 13 nt, Homo sapiens
aaacuuguuuaca

SEQ ID NO: 531044 - RNA, 16 nt, Homo sapiens
aaacuuuaaugaacua

SEQ ID NO: 531045 - RNA, 17 nt, Homo sapiens
aaacuuuagaguagcau

SEQ ID NO: 531046 - RNA, 21 nt, Homo sapiens
aaacuuuagaguagcaugaga

SEQ ID NO: 531047 - RNA, 15 nt, Homo sapiens
aaacuuuaucacuua

SEQ ID NO: 531048 - RNA, 19 nt, Homo sapiens
aaacuuugaggaacauuca

SEQ ID NO: 531049 - RNA, 17 nt, Homo sapiens
aaacuuuggcuuauaaa

SEQ ID NO: 531050 - RNA, 19 nt, Homo sapiens
aaacuuuuuuucuguacca

SEQ ID NO: 531051 - RNA, 23 nt, Homo sapiens
aaacuuuuuuucuguaccaguua

SEQ ID NO: 531052 - RNA, 21 nt, Homo sapiens
aaacuuuuuuuuccuacuauc

SEQ ID NO: 531053 - RNA, 13 nt, Homo sapiens
aaagaaauccaaa

SEQ ID NO: 531054 - RNA, 12 nt, Homo sapiens
aaagaaauccau

SEQ ID NO: 531055 - RNA, 16 nt, Homo sapiens
aaagaaaucuugucuu

SEQ ID NO: 531056 - RNA, 22 nt, Homo sapiens
aaagaaauuuaaguucuaugag

SEQ ID NO: 531057 - RNA, 21 nt, Homo sapiens
aaagaaauuuugccugccauu

SEQ ID NO: 531058 - RNA, 22 nt, Homo sapiens
aaagaacacaucaccuuccuga

SEQ ID NO: 531059 - RNA, 15 nt, Homo sapiens
aaagaacauuuugcc

SEQ ID NO: 531060 - RNA, 13 nt, Homo sapiens
aaagaaccagaga

SEQ ID NO: 531061 - RNA, 21 nt, Homo sapiens
aaagaacgcgacuuccacaaa

SEQ ID NO: 531062 - RNA, 17 nt, Homo sapiens
aaagaacgcugauuuaa

SEQ ID NO: 531063 - RNA, 17 nt, Homo sapiens
aaagaacguggucagag

SEQ ID NO: 531064 - RNA, 19 nt, Homo sapiens
aaagaagccaggugcaaaa

SEQ ID NO: 531065 - RNA, 17 nt, Homo sapiens
aaagaagcuuccacaaa

SEQ ID NO: 531066 - RNA, 22 nt, Homo sapiens
aaagaaggaauucuaggcaucc

SEQ ID NO: 531067 - RNA, 20 nt, Homo sapiens
aaagaagguguuuuccugaa

SEQ ID NO: 531068 - RNA, 21 nt, Homo sapiens
aaagaagguuggugaauuuca

SEQ ID NO: 531069 - RNA, 17 nt, Homo sapiens
aaagaauaaaguccaaa

SEQ ID NO: 531070 - RNA, 22 nt, Homo sapiens
aaagaauaauaugcugccaaau

SEQ ID NO: 531071 - RNA, 15 nt, Homo sapiens
aaagaaucagucuug

SEQ ID NO: 531072 - RNA, 16 nt, Homo sapiens
aaagaaugcucuuuac

SEQ ID NO: 531073 - RNA, 15 nt, Homo sapiens
aaagaauguuuggca

SEQ ID NO: 531074 - RNA, 20 nt, Homo sapiens
aaagaauuccugaagccaga

SEQ ID NO: 531075 - RNA, 13 nt, Homo sapiens
aaagaauuugcac

SEQ ID NO: 531076 - RNA, 18 nt, Homo sapiens
aaagacaccuacugagug

SEQ ID NO: 531077 - RNA, 15 nt, Homo sapiens
aaagacagaauguca

SEQ ID NO: 531078 - RNA, 18 nt, Homo sapiens
aaagacagaaugucacca

SEQ ID NO: 531079 - RNA, 17 nt, Homo sapiens
aaagacaggcaaacggc

SEQ ID NO: 531080 - RNA, 18 nt, Homo sapiens
aaagacaggguuucacca

SEQ ID NO: 531081 - RNA, 13 nt, Homo sapiens
aaagacaucaaac

SEQ ID NO: 531082 - RNA, 11 nt, Homo sapiens
aaagacaucag

SEQ ID NO: 531083 - RNA, 16 nt, Homo sapiens
aaagaccccucccacu

SEQ ID NO: 531084 - RNA, 20 nt, Homo sapiens
aaagaccccucccacuccug

SEQ ID NO: 531085 - RNA, 13 nt, Homo sapiens
aaagacucugacc

SEQ ID NO: 531086 - RNA, 12 nt, Homo sapiens
aaagacugccug

SEQ ID NO: 531087 - RNA, 17 nt, Homo sapiens
aaagacuguacaaagua

SEQ ID NO: 531088 - RNA, 20 nt, Homo sapiens
aaagacuguacaaaguagaa

SEQ ID NO: 531089 - RNA, 15 nt, Homo sapiens
aaagacuuaagccca

SEQ ID NO: 531090 - RNA, 11 nt, Homo sapiens
aaagacuucca

SEQ ID NO: 531091 - RNA, 20 nt, Homo sapiens
aaagacuucucuacccaucu

SEQ ID NO: 531092 - RNA, 15 nt, Homo sapiens
aaagagaacaccucc

SEQ ID NO: 531093 - RNA, 20 nt, Homo sapiens
aaagagaagcaucauuuccc

SEQ ID NO: 531094 - RNA, 14 nt, Homo sapiens
aaagagacagugau

SEQ ID NO: 531095 - RNA, 17 nt, Homo sapiens
aaagagacuccgucuca

SEQ ID NO: 531096 - RNA, 23 nt, Homo sapiens
aaagagagaucuugauccacaga

SEQ ID NO: 531097 - RNA, 15 nt, Homo sapiens
aaagagcacuuaaga

SEQ ID NO: 531098 - RNA, 16 nt, Homo sapiens
aaagagccuggagaag

SEQ ID NO: 531099 - RNA, 20 nt, Homo sapiens
aaagagcugcacagcaaaag

SEQ ID NO: 531100 - RNA, 14 nt, Homo sapiens
aaagagcuguuaua

SEQ ID NO: 531101 - RNA, 15 nt, Homo sapiens
aaagaggaaccagga

SEQ ID NO: 531102 - RNA, 21 nt, Homo sapiens
aaagaggcugaggcuggcaca

SEQ ID NO: 531103 - RNA, 14 nt, Homo sapiens
aaagagggcuuccu

SEQ ID NO: 531104 - RNA, 18 nt, Homo sapiens
aaagaguauauguucccu

SEQ ID NO: 531105 - RNA, 12 nt, Homo sapiens
aaagaguaugua

SEQ ID NO: 531106 - RNA, 20 nt, Homo sapiens
aaagauaacaagaucuuuca

SEQ ID NO: 531107 - RNA, 23 nt, Homo sapiens
aaagauaaucucucagcuuuuaa

SEQ ID NO: 531108 - RNA, 13 nt, Homo sapiens
aaagauacaguua

SEQ ID NO: 531109 - RNA, 16 nt, Homo sapiens
aaagauacgacuuuau

SEQ ID NO: 531110 - RNA, 16 nt, Homo sapiens
aaagauaucagagcuc

SEQ ID NO: 531111 - RNA, 14 nt, Homo sapiens
aaagaucguuuaaa

SEQ ID NO: 531112 - RNA, 21 nt, Homo sapiens
aaagaugagcuuuucuaggcu

SEQ ID NO: 531113 - RNA, 21 nt, Homo sapiens
aaagaugaucuacucagaaau

SEQ ID NO: 531114 - RNA, 21 nt, Homo sapiens
aaagauggcugugccucugcc

SEQ ID NO: 531115 - RNA, 14 nt, Homo sapiens
aaagauguauuuau

SEQ ID NO: 531116 - RNA, 19 nt, Homo sapiens
aaagauguuuacaucaaag

SEQ ID NO: 531117 - RNA, 19 nt, Homo sapiens
aaagauguuugucagauau

SEQ ID NO: 531118 - RNA, 15 nt, Homo sapiens
aaagauuaaaaccaa

SEQ ID NO: 531119 - RNA, 19 nt, Homo sapiens
aaagauuaucucagaaagu

SEQ ID NO: 531120 - RNA, 21 nt, Homo sapiens
aaagauucccacccaauucaa

SEQ ID NO: 531121 - RNA, 14 nt, Homo sapiens
aaagauuguacuua

SEQ ID NO: 531122 - RNA, 18 nt, Homo sapiens
aaagauuuuuggcacuuu

SEQ ID NO: 531123 - RNA, 19 nt, Homo sapiens
aaagcaaagguuggcaaca

SEQ ID NO: 531124 - RNA, 22 nt, Homo sapiens
aaagcaaauaaaugccuuccac

SEQ ID NO: 531125 - RNA, 12 nt, Homo sapiens
aaagcacaguuu

SEQ ID NO: 531126 - RNA, 13 nt, Homo sapiens
aaagcacauaacu

SEQ ID NO: 531127 - RNA, 17 nt, Homo sapiens
aaagcacauaacuggau

SEQ ID NO: 531128 - RNA, 12 nt, Homo sapiens
aaagcaccugcc

SEQ ID NO: 531129 - RNA, 11 nt, Homo sapiens
aaagcacugac

SEQ ID NO: 531130 - RNA, 13 nt, Homo sapiens
aaagcacugagca

SEQ ID NO: 531131 - RNA, 12 nt, Homo sapiens
aaguacuuccac

SEQ ID NO: 531132 - RNA, 16 nt, Homo sapiens
aaguagaaguuacuua

SEQ ID NO: 531133 - RNA, 16 nt, Homo sapiens
aaguagccaucauucc

SEQ ID NO: 531134 - RNA, 23 nt, Homo sapiens
aaguaggcaggaccaugggacca

SEQ ID NO: 531135 - RNA, 12 nt, Homo sapiens
aaguagugugaa

SEQ ID NO: 531136 - RNA, 19 nt, Homo sapiens
aaguauaaagucacuucca

SEQ ID NO: 531137 - RNA, 18 nt, Homo sapiens
aaguauaacaacuuugaa

SEQ ID NO: 531138 - RNA, 19 nt, Homo sapiens
aaguauaaucagcacuuug

SEQ ID NO: 531139 - RNA, 22 nt, Homo sapiens
aaguauaaucagcacuuugcca

SEQ ID NO: 531140 - RNA, 14 nt, Homo sapiens
aaguauaccuggcu

SEQ ID NO: 531141 - RNA, 21 nt, Homo sapiens
aaguauaucucuagaugcaaa

SEQ ID NO: 531142 - RNA, 19 nt, Homo sapiens
aaguauaucuuuaauucug

SEQ ID NO: 531143 - RNA, 13 nt, Homo sapiens
aaguaucaugcau

SEQ ID NO: 531144 - RNA, 13 nt, Homo sapiens
aaguaucuuggac

SEQ ID NO: 531145 - RNA, 17 nt, Homo sapiens
aaguaugagggaaaaug

SEQ ID NO: 531146 - RNA, 14 nt, Homo sapiens
aaguaugccuuaag

SEQ ID NO: 531147 - RNA, 19 nt, Homo sapiens
aaguaugccuuaagcagaa

SEQ ID NO: 531148 - RNA, 21 nt, Homo sapiens
aaguaugggaugauaguugaa

SEQ ID NO: 531149 - RNA, 13 nt, Homo sapiens
aaguauguugaua

SEQ ID NO: 531150 - RNA, 14 nt, Homo sapiens
aaguauuaauguac

SEQ ID NO: 531151 - RNA, 15 nt, Homo sapiens
aaguauuauuuuaca

SEQ ID NO: 531152 - RNA, 11 nt, Homo sapiens
aaguauuccac

SEQ ID NO: 531153 - RNA, 15 nt, Homo sapiens
aaguauuccuuuccu

SEQ ID NO: 531154 - RNA, 15 nt, Homo sapiens
aaguauucucaaaga

SEQ ID NO: 531155 - RNA, 19 nt, Homo sapiens
aaguauugcaucuguauaa

SEQ ID NO: 531156 - RNA, 19 nt, Homo sapiens
aaguauugcgaaugugcag

SEQ ID NO: 531157 - RNA, 16 nt, Homo sapiens
aaguauuggcauucaa

SEQ ID NO: 531158 - RNA, 17 nt, Homo sapiens
aaguauuuaaauguucu

SEQ ID NO: 531159 - RNA, 19 nt, Homo sapiens
aagucaaagaagacucagu

SEQ ID NO: 531160 - RNA, 14 nt, Homo sapiens
aagucaaccugccu

SEQ ID NO: 531161 - RNA, 17 nt, Homo sapiens
aagucaaguuuguggcu

SEQ ID NO: 531162 - RNA, 18 nt, Homo sapiens
aagucaauguacuuguuu

SEQ ID NO: 531163 - RNA, 23 nt, Homo sapiens
aagucaccaaauagugugaaaua

SEQ ID NO: 531164 - RNA, 13 nt, Homo sapiens
aagucacccagag

SEQ ID NO: 531165 - RNA, 12 nt, Homo sapiens
aagucacccagc

SEQ ID NO: 531166 - RNA, 18 nt, Homo sapiens
aagucaccuuucugggcu

SEQ ID NO: 531167 - RNA, 21 nt, Homo sapiens
aagucacggcugcgcacugug

SEQ ID NO: 531168 - RNA, 15 nt, Homo sapiens
aagucacugaacaaa

SEQ ID NO: 531169 - RNA, 17 nt, Homo sapiens
aagucacuuaacuauaa

SEQ ID NO: 531170 - RNA, 19 nt, Homo sapiens
aagucagagacagauaccu

SEQ ID NO: 531171 - RNA, 17 nt, Homo sapiens
aagucagcaugccucua

SEQ ID NO: 531172 - RNA, 13 nt, Homo sapiens
aagucagcuccag

SEQ ID NO: 531173 - RNA, 22 nt, Homo sapiens
aagucagcuccagcuuucugcc

SEQ ID NO: 531174 - RNA, 16 nt, Homo sapiens
aagucagguccaauuu

SEQ ID NO: 531175 - RNA, 18 nt, Homo sapiens
aagucaguaucauauuau

SEQ ID NO: 531176 - RNA, 18 nt, Homo sapiens
aagucaguggcuuugcau

SEQ ID NO: 531177 - RNA, 13 nt, Homo sapiens
aagucauccuccu

SEQ ID NO: 531178 - RNA, 15 nt, Homo sapiens
aagucaucuugcuac

SEQ ID NO: 531179 - RNA, 19 nt, Homo sapiens
aaguccagagcuggaucuc

SEQ ID NO: 531180 - RNA, 16 nt, Homo sapiens
aaguccagauuuacac

SEQ ID NO: 531181 - RNA, 20 nt, Homo sapiens
aaguccagauuuacacuggg

SEQ ID NO: 531182 - RNA, 21 nt, Homo sapiens
aaguccagauuuacacuggga

SEQ ID NO: 531183 - RNA, 13 nt, Homo sapiens
aaguccagccacu

SEQ ID NO: 531184 - RNA, 24 nt, Homo sapiens
aaguccagccacuugacuggcaca

SEQ ID NO: 531185 - RNA, 14 nt, Homo sapiens
aaguccaucugaca

SEQ ID NO: 531186 - RNA, 20 nt, Homo sapiens
aagucccugucauuugaacc

SEQ ID NO: 531187 - RNA, 17 nt, Homo sapiens
aaguccucugcuccagc

SEQ ID NO: 531188 - RNA, 14 nt, Homo sapiens
aagucgccagucac

SEQ ID NO: 531189 - RNA, 20 nt, Homo sapiens
aagucgccagucacugcugc

SEQ ID NO: 531190 - RNA, 15 nt, Homo sapiens
aagucggaugucaga

SEQ ID NO: 531191 - RNA, 14 nt, Homo sapiens
aagucuaauucaca

SEQ ID NO: 531192 - RNA, 16 nt, Homo sapiens
aagucuaauucacagg

SEQ ID NO: 531193 - RNA, 17 nt, Homo sapiens
aagucuauaaugcaauc

SEQ ID NO: 531194 - RNA, 20 nt, Homo sapiens
aagucucacuuuuauugaua

SEQ ID NO: 531195 - RNA, 14 nt, Homo sapiens
aagucuccaugaag

SEQ ID NO: 531196 - RNA, 13 nt, Homo sapiens
aagucucucaccc

SEQ ID NO: 531197 - RNA, 13 nt, Homo sapiens
aagucucugugaa

SEQ ID NO: 531198 - RNA, 15 nt, Homo sapiens
aagucugacucucca

SEQ ID NO: 531199 - RNA, 13 nt, Homo sapiens
aagucugagaaau

SEQ ID NO: 531200 - RNA, 19 nt, Homo sapiens
aagucugcccuagagucau

SEQ ID NO: 531201 - RNA, 17 nt, Homo sapiens
aagucuuauuuccucaa

SEQ ID NO: 531202 - RNA, 11 nt, Homo sapiens
aagucuuccau

SEQ ID NO: 531203 - RNA, 18 nt, Homo sapiens
aagucuugaauaguacau

SEQ ID NO: 531204 - RNA, 18 nt, Homo sapiens
aagucuuuacucugacuu

SEQ ID NO: 531205 - RNA, 21 nt, Homo sapiens
aagucuuugguaaauggcaaa

SEQ ID NO: 531206 - RNA, 17 nt, Homo sapiens
aagugaaaaacauccag

SEQ ID NO: 531207 - RNA, 13 nt, Homo sapiens
aagugaacaguug

SEQ ID NO: 531208 - RNA, 14 nt, Homo sapiens
aagugaacuaugaa

SEQ ID NO: 531209 - RNA, 12 nt, Homo sapiens
aagugaacuuuu

SEQ ID NO: 531210 - RNA, 21 nt, Homo sapiens
aagugaagagggagaagggau

SEQ ID NO: 531211 - RNA, 13 nt, Homo sapiens
aagugacuauuca

SEQ ID NO: 531212 - RNA, 18 nt, Homo sapiens
aagugacucucacaagau

SEQ ID NO: 531213 - RNA, 19 nt, Homo sapiens
aagugagaaaaguucaaua

SEQ ID NO: 531214 - RNA, 12 nt, Homo sapiens
aagugagcagaa

SEQ ID NO: 531215 - RNA, 11 nt, Homo sapiens
aagugagcuuu

SEQ ID NO: 531216 - RNA, 18 nt, Homo sapiens
aagugaggaagaguuuau

SEQ ID NO: 531217 - RNA, 22 nt, Homo sapiens
aagugaggagaaugaaauguau

SEQ ID NO: 531218 - RNA, 15 nt, Homo sapiens
aagugagggcucacu

SEQ ID NO: 531219 - RNA, 19 nt, Homo sapiens
aagugauacucccaccucu

SEQ ID NO: 531220 - RNA, 16 nt, Homo sapiens
aagugauaucaccucu

SEQ ID NO: 531221 - RNA, 23 nt, Homo sapiens
aagugauccucacgccuuggccu

SEQ ID NO: 531222 - RNA, 16 nt, Homo sapiens
aagugcauccaaaggu

SEQ ID NO: 531223 - RNA, 11 nt, Homo sapiens
aagugccccug

SEQ ID NO: 531224 - RNA, 15 nt, Homo sapiens
aagugccuaccccag

SEQ ID NO: 531225 - RNA, 18 nt, Homo sapiens
aagugccugacacacuaa

SEQ ID NO: 531226 - RNA, 21 nt, Homo sapiens
aagugcgugccgugugagugu

SEQ ID NO: 531227 - RNA, 14 nt, Homo sapiens
aagugcucacguua

SEQ ID NO: 531228 - RNA, 17 nt, Homo sapiens
aagugcucuaacuuuuc

SEQ ID NO: 531229 - RNA, 18 nt, Homo sapiens
aagugcugagauuacaca

SEQ ID NO: 531230 - RNA, 21 nt, Homo sapiens
aagugcugcuauaucuaucca

SEQ ID NO: 531231 - RNA, 21 nt, Homo sapiens
aagugcugggaugacaggugu

SEQ ID NO: 531232 - RNA, 23 nt, Homo sapiens
aagugcugggaugacagguguga

SEQ ID NO: 531233 - RNA, 22 nt, Homo sapiens
aagugcugggauuacaggugua

SEQ ID NO: 531234 - RNA, 13 nt, Homo sapiens
aagugcuguggcu

SEQ ID NO: 531235 - RNA, 17 nt, Homo sapiens
aagugcuucacauuugu

SEQ ID NO: 531236 - RNA, 22 nt, Homo sapiens
aaguggaaacaauaaaaccugg

SEQ ID NO: 531237 - RNA, 19 nt, Homo sapiens
aaguggcagcuucacucga

SEQ ID NO: 531238 - RNA, 14 nt, Homo sapiens
aaguggcaguucuu

SEQ ID NO: 531239 - RNA, 17 nt, Homo sapiens
aaguggcccucccucag

SEQ ID NO: 531240 - RNA, 22 nt, Homo sapiens
aagugggcugcagcagccggaa

SEQ ID NO: 531241 - RNA, 16 nt, Homo sapiens
aaguggggaaugcaac

SEQ ID NO: 531242 - RNA, 16 nt, Homo sapiens
aaguggggucuggccu

SEQ ID NO: 531243 - RNA, 20 nt, Homo sapiens
aaguggucgcuuacuuugag

SEQ ID NO: 531244 - RNA, 18 nt, Homo sapiens
aaguggucugaauucugg

SEQ ID NO: 531245 - RNA, 15 nt, Homo sapiens
aaguguacacuauug

SEQ ID NO: 531246 - RNA, 16 nt, Homo sapiens
aaguguacauguguga

SEQ ID NO: 531247 - RNA, 15 nt, Homo sapiens
aaguguaugauguca

SEQ ID NO: 531248 - RNA, 11 nt, Homo sapiens
aagugucuucu

SEQ ID NO: 531249 - RNA, 20 nt, Homo sapiens
aagugugcuggccucucuga

SEQ ID NO: 531250 - RNA, 13 nt, Homo sapiens
aaguguggaugca

SEQ ID NO: 531251 - RNA, 13 nt, Homo sapiens
aagugugugcaca

SEQ ID NO: 531252 - RNA, 19 nt, Homo sapiens
aaguguuuacuaugugcca

SEQ ID NO: 531253 - RNA, 17 nt, Homo sapiens
aaguguuuagaaaucau

SEQ ID NO: 531254 - RNA, 20 nt, Homo sapiens
aaguuaaccccauguccuca

SEQ ID NO: 531255 - RNA, 16 nt, Homo sapiens
aaguaccacacugagu

SEQ ID NO: 531256 - RNA, 16 nt, Homo sapiens
aaguacccugugcuca

SEQ ID NO: 531257 - RNA, 15 nt, Homo sapiens
aaguaccuguaguga

SEQ ID NO: 531258 - RNA, 23 nt, Homo sapiens
aaguacuccuauugccgccagaa

SEQ ID NO: 531259 - RNA, 15 nt, Homo sapiens
aaguacuguuuugaa

SEQ ID NO: 531260 - RNA, 18 nt, Homo sapiens
aaguacuuaaacuuccac

SEQ ID NO: 531261 - RNA, 14 nt, Homo sapiens
aagcaaccaugaac

SEQ ID NO: 531262 - RNA, 16 nt, Homo sapiens
aagcaacuacaacuuc

SEQ ID NO: 531263 - RNA, 15 nt, Homo sapiens
aagcaacuugcuucu

SEQ ID NO: 531264 - RNA, 17 nt, Homo sapiens
aagcaagaaaaccacaa

SEQ ID NO: 531265 - RNA, 14 nt, Homo sapiens
aagcaagggcucca

SEQ ID NO: 531266 - RNA, 20 nt, Homo sapiens
aagcaaguagcuuuccacau

SEQ ID NO: 531267 - RNA, 16 nt, Homo sapiens
aagcaaguuguugcuu

SEQ ID NO: 531268 - RNA, 18 nt, Homo sapiens
aagcaaguuuucuuccau

SEQ ID NO: 531269 - RNA, 16 nt, Homo sapiens
aagcaauacuguuucc

SEQ ID NO: 531270 - RNA, 16 nt, Homo sapiens
aagcaaucaagcacca

SEQ ID NO: 531271 - RNA, 17 nt, Homo sapiens
aagcaaugguugaugau

SEQ ID NO: 531272 - RNA, 18 nt, Homo sapiens
aagcaaugguugaugaua

SEQ ID NO: 531273 - RNA, 16 nt, Homo sapiens
aagcacaacucccuua

SEQ ID NO: 531274 - RNA, 21 nt, Homo sapiens
aagcacacuaaaccaaguuau

SEQ ID NO: 531275 - RNA, 11 nt, Homo sapiens
aagcacacuca

SEQ ID NO: 531276 - RNA, 14 nt, Homo sapiens
aagcacacuggaau

SEQ ID NO: 531277 - RNA, 18 nt, Homo sapiens
aagcacagaauuugucag

SEQ ID NO: 531278 - RNA, 14 nt, Homo sapiens
aagcacagccucag

SEQ ID NO: 531279 - RNA, 19 nt, Homo sapiens
aagcacagccucagaauaa

SEQ ID NO: 531280 - RNA, 20 nt, Homo sapiens
aagcacagccucagaauaaa

SEQ ID NO: 531281 - RNA, 15 nt, Homo sapiens
aagcacagcuugggu

SEQ ID NO: 531282 - RNA, 13 nt, Homo sapiens
aagcacaguuuga

SEQ ID NO: 531283 - RNA, 22 nt, Homo sapiens
aagcacauuuuaaaagugccau

SEQ ID NO: 531284 - RNA, 15 nt, Homo sapiens
aagcaccccaugcca

SEQ ID NO: 531285 - RNA, 23 nt, Homo sapiens
aagcaccuagccucgcucuuggc

SEQ ID NO: 531286 - RNA, 22 nt, Homo sapiens
aagcacuauuaauacucugcag

SEQ ID NO: 531287 - RNA, 18 nt, Homo sapiens
aagcacuuggacucuugc

SEQ ID NO: 531288 - RNA, 22 nt, Homo sapiens
aagcacuuugaaaaauuguucc

SEQ ID NO: 531289 - RNA, 22 nt, Homo sapiens
aagcagaaauccugcaaugaaa

SEQ ID NO: 531290 - RNA, 21 nt, Homo sapiens
aagcagaagcauuaacuucuc

SEQ ID NO: 531291 - RNA, 22 nt, Homo sapiens
aagcagacccauaccuuuccag

SEQ ID NO: 531292 - RNA, 14 nt, Homo sapiens
aagcagcacuguga

SEQ ID NO: 531293 - RNA, 16 nt, Homo sapiens
aagcagccugccauau

SEQ ID NO: 531294 - RNA, 15 nt, Homo sapiens
aagcagccuggagac

SEQ ID NO: 531295 - RNA, 14 nt, Homo sapiens
aagcagcugcagca

SEQ ID NO: 531296 - RNA, 20 nt, Homo sapiens
aagcaggaaaugaaaauguc

SEQ ID NO: 531297 - RNA, 22 nt, Homo sapiens
aagcaggcauugcuuugcccug

SEQ ID NO: 531298 - RNA, 17 nt, Homo sapiens
aagcaggugaacuggga

SEQ ID NO: 531299 - RNA, 14 nt, Homo sapiens
aagcaggugcuaca

SEQ ID NO: 531300 - RNA, 18 nt, Homo sapiens
aagcagguggcaucucua

SEQ ID NO: 531301 - RNA, 14 nt, Homo sapiens
aagcagguucuuga

SEQ ID NO: 531302 - RNA, 21 nt, Homo sapiens
aagcagguuuuuaaguugucu

SEQ ID NO: 531303 - RNA, 17 nt, Homo sapiens
aagcaguacacuuggau

SEQ ID NO: 531304 - RNA, 15 nt, Homo sapiens
aagcagucagcccuu

SEQ ID NO: 531305 - RNA, 11 nt, Homo sapiens
aagcagucuca

SEQ ID NO: 531306 - RNA, 21 nt, Homo sapiens
aagcagugccucgaggcaccg

SEQ ID NO: 531307 - RNA, 23 nt, Homo sapiens
aagcagugggguugggaccucag

SEQ ID NO: 531308 - RNA, 15 nt, Homo sapiens
aagcagugucuguca

SEQ ID NO: 531309 - RNA, 16 nt, Homo sapiens
aagcaguuacuaauau

SEQ ID NO: 531310 - RNA, 23 nt, Homo sapiens
aagcaguuguuauuuagugauau

SEQ ID NO: 531311 - RNA, 17 nt, Homo sapiens
aagcauaacauggagcu

SEQ ID NO: 531312 - RNA, 19 nt, Homo sapiens
aagcauacaagauucuucc

SEQ ID NO: 531313 - RNA, 12 nt, Homo sapiens
aagcauacuuug

SEQ ID NO: 531314 - RNA, 13 nt, Homo sapiens
aagcauacuuugu

SEQ ID NO: 531315 - RNA, 13 nt, Homo sapiens
aagcaucagagau

SEQ ID NO: 531316 - RNA, 16 nt, Homo sapiens
aagcaucugauagaau

SEQ ID NO: 531317 - RNA, 23 nt, Homo sapiens
aagcaucuuucuguuacugaugu

SEQ ID NO: 531318 - RNA, 23 nt, Homo sapiens
aagcaugucucaauaguaaaaga

SEQ ID NO: 531319 - RNA, 10 nt, Homo sapiens
aagcauucuu

SEQ ID NO: 531320 - RNA, 13 nt, Homo sapiens
aagcauucuucaa

SEQ ID NO: 531321 - RNA, 13 nt, Homo sapiens
aagcauucuuuaa

SEQ ID NO: 531322 - RNA, 19 nt, Homo sapiens
aagcauuguccaaaauccc

SEQ ID NO: 531323 - RNA, 23 nt, Homo sapiens
aagcauuuaaccccccuguacac

SEQ ID NO: 531324 - RNA, 17 nt, Homo sapiens
aagcauuucaggccagu

SEQ ID NO: 531325 - RNA, 20 nt, Homo sapiens
aagcauuuccagccuaucua

SEQ ID NO: 531326 - RNA, 20 nt, Homo sapiens
aagcauuugcaacagcuaca

SEQ ID NO: 531327 - RNA, 14 nt, Homo sapiens
aagcauuuggugcc

SEQ ID NO: 531328 - RNA, 11 nt, Homo sapiens
aagccaaagaa

SEQ ID NO: 531329 - RNA, 19 nt, Homo sapiens
aagccaaaguuucuguuga

SEQ ID NO: 531330 - RNA, 14 nt, Homo sapiens
aagccaagcacuuu

SEQ ID NO: 531331 - RNA, 21 nt, Homo sapiens
aagccacagcagguccuccau

SEQ ID NO: 531332 - RNA, 22 nt, Homo sapiens
aagccacagguguugauuguua

SEQ ID NO: 531333 - RNA, 18 nt, Homo sapiens
aagccacauggcugggau

SEQ ID NO: 531334 - RNA, 11 nt, Homo sapiens
aagccacugaa

SEQ ID NO: 531335 - RNA, 13 nt, Homo sapiens
aagccacuugaaa

SEQ ID NO: 531336 - RNA, 20 nt, Homo sapiens
aagccagacagcaacgggga

SEQ ID NO: 531337 - RNA, 18 nt, Homo sapiens
aagccaggacuauucccu

SEQ ID NO: 531338 - RNA, 16 nt, Homo sapiens
aagccaggauuguguu

SEQ ID NO: 531339 - RNA, 23 nt, Homo sapiens
aagccaggccuggcuggaggagc

SEQ ID NO: 531340 - RNA, 13 nt, Homo sapiens
aagccagugacac

SEQ ID NO: 531341 - RNA, 16 nt, Homo sapiens
aagccaucugacagca

SEQ ID NO: 531342 - RNA, 16 nt, Homo sapiens
aagccaugugccagau

SEQ ID NO: 531343 - RNA, 12 nt, Homo sapiens
aagccauuccaa

SEQ ID NO: 531344 - RNA, 15 nt, Homo sapiens
aagcccaccugggcu

SEQ ID NO: 531345 - RNA, 13 nt, Homo sapiens
aagcccagcauca

SEQ ID NO: 531346 - RNA, 21 nt, Homo sapiens
aagcccagcucugggaacuga

SEQ ID NO: 531347 - RNA, 18 nt, Homo sapiens
aagcccaugaguccuuga

SEQ ID NO: 531348 - RNA, 20 nt, Homo sapiens
aagcccgcggggacauuggg

SEQ ID NO: 531349 - RNA, 23 nt, Homo sapiens
aagcccugauguguccucaggga

SEQ ID NO: 531350 - RNA, 20 nt, Homo sapiens
aagcccuuccuaccucuggu

SEQ ID NO: 531351 - RNA, 23 nt, Homo sapiens
aagcccuuccuaccucuggugau

SEQ ID NO: 531352 - RNA, 18 nt, Homo sapiens
aagccgccaguucaucuu

SEQ ID NO: 531353 - RNA, 22 nt, Homo sapiens
aagccuaccguauuucagccau

SEQ ID NO: 531354 - RNA, 19 nt, Homo sapiens
aagccuagcccuucucuca

SEQ ID NO: 531355 - RNA, 17 nt, Homo sapiens
aagccucagaaagggau

SEQ ID NO: 531356 - RNA, 18 nt, Homo sapiens
aagccucagccauucacu

SEQ ID NO: 531357 - RNA, 21 nt, Homo sapiens
aagccuccuguaccucagugg

SEQ ID NO: 531358 - RNA, 17 nt, Homo sapiens
aagccucugaucuggca

SEQ ID NO: 531359 - RNA, 13 nt, Homo sapiens
aagccugagcuca

SEQ ID NO: 531360 - RNA, 20 nt, Homo sapiens
aagccugggcuugagcugca

SEQ ID NO: 531361 - RNA, 16 nt, Homo sapiens
aagccugggugacauu

SEQ ID NO: 531362 - RNA, 21 nt, Homo sapiens
aagccuuaauuugcacagugu

SEQ ID NO: 531363 - RNA, 13 nt, Homo sapiens
aagccuucagcuc

SEQ ID NO: 531364 - RNA, 19 nt, Homo sapiens
aagccuugaaaaagaacaa

SEQ ID NO: 531365 - RNA, 21 nt, Homo sapiens
aagccuuuagagccagcccau

SEQ ID NO: 531366 - RNA, 22 nt, Homo sapiens
aagccuuuuguuucccuugcuu

SEQ ID NO: 531367 - RNA, 17 nt, Homo sapiens
aagcgaauguguacaaa

SEQ ID NO: 531368 - RNA, 22 nt, Homo sapiens
aagcgacccauucagagacugu

SEQ ID NO: 531369 - RNA, 13 nt, Homo sapiens
aagcgagcacagu

SEQ ID NO: 531370 - RNA, 19 nt, Homo sapiens
aagcgagcagucagcauuc

SEQ ID NO: 531371 - RNA, 21 nt, Homo sapiens
aagcggugguuuguaauuccu

SEQ ID NO: 531372 - RNA, 14 nt, Homo sapiens
aagcuaaaaggaaa

SEQ ID NO: 531373 - RNA, 20 nt, Homo sapiens
aagcuaaaauuagaugaacu

SEQ ID NO: 531374 - RNA, 22 nt, Homo sapiens
aagcuaaaauuagaugaacuca

SEQ ID NO: 531375 - RNA, 19 nt, Homo sapiens
aagcuaaagccuuguugcc

SEQ ID NO: 531376 - RNA, 23 nt, Homo sapiens
aagcuaaauauuuaacauuguug

SEQ ID NO: 531377 - RNA, 14 nt, Homo sapiens
aagcuaaucugccu

SEQ ID NO: 531378 - RNA, 20 nt, Homo sapiens
aagcuaaugaacucuuucaa

SEQ ID NO: 531379 - RNA, 19 nt, Homo sapiens
aagcuaaugugcagggaua

SEQ ID NO: 531380 - RNA, 22 nt, Homo sapiens
aaggcaauccuaagcaaaaaga

SEQ ID NO: 531381 - RNA, 14 nt, Homo sapiens
aaggcaccuucuua

SEQ ID NO: 531382 - RNA, 14 nt, Homo sapiens
aaggcagaggaauu

SEQ ID NO: 531383 - RNA, 19 nt, Homo sapiens
aaggcagccugaacacuca

SEQ ID NO: 531384 - RNA, 23 nt, Homo sapiens
agaggaacaagcaugucucucug

SEQ ID NO: 531385 - RNA, 16 nt, Homo sapiens
agaggaacagcacugg

SEQ ID NO: 531386 - RNA, 14 nt, Homo sapiens
agaggaacugucca

SEQ ID NO: 531387 - RNA, 21 nt, Homo sapiens
agaggaaggaaaaggaggaaa

SEQ ID NO: 531388 - RNA, 11 nt, Homo sapiens
agaggacacaa

SEQ ID NO: 531389 - RNA, 22 nt, Homo sapiens
agaggacguguuacccacugcc

SEQ ID NO: 531390 - RNA, 22 nt, Homo sapiens
agaggacucugcuuaaacaaag

SEQ ID NO: 531391 - RNA, 21 nt, Homo sapiens
agaggagaagagacauguacc

SEQ ID NO: 531392 - RNA, 19 nt, Homo sapiens
agaggagauuggccaguga

SEQ ID NO: 531393 - RNA, 12 nt, Homo sapiens
agaggagcauga

SEQ ID NO: 531394 - RNA, 14 nt, Homo sapiens
agaggaggggacca

SEQ ID NO: 531395 - RNA, 13 nt, Homo sapiens
agaggagguuugg

SEQ ID NO: 531396 - RNA, 13 nt, Homo sapiens
agaggagugcagc

SEQ ID NO: 531397 - RNA, 17 nt, Homo sapiens
agaggaucggaggcuug

SEQ ID NO: 531398 - RNA, 15 nt, Homo sapiens
agaggaucugacuga

SEQ ID NO: 531399 - RNA, 21 nt, Homo sapiens
agaggaugaauguaugugcac

SEQ ID NO: 531400 - RNA, 22 nt, Homo sapiens
agaggauuucuucaaaucucag

SEQ ID NO: 531401 - RNA, 14 nt, Homo sapiens
agaggcaccaggaa

SEQ ID NO: 531402 - RNA, 20 nt, Homo sapiens
agaggcagcuucuagacaga

SEQ ID NO: 531403 - RNA, 13 nt, Homo sapiens
agaggcagugaga

SEQ ID NO: 531404 - RNA, 19 nt, Homo sapiens
agaggcaucaaagcuagaa

SEQ ID NO: 531405 - RNA, 20 nt, Homo sapiens
agaggccaguugaucugcuc

SEQ ID NO: 531406 - RNA, 20 nt, Homo sapiens
agaggccccaggucaccucg

SEQ ID NO: 531407 - RNA, 21 nt, Homo sapiens
agaggccucauccagggccca

SEQ ID NO: 531408 - RNA, 18 nt, Homo sapiens
agaggcuacaaggacuua

SEQ ID NO: 531409 - RNA, 21 nt, Homo sapiens
agaggcuauggaacuuaacac

SEQ ID NO: 531410 - RNA, 18 nt, Homo sapiens
agaggcucuaauguacaa

SEQ ID NO: 531411 - RNA, 16 nt, Homo sapiens
agaggcucuggacagc

SEQ ID NO: 531412 - RNA, 21 nt, Homo sapiens
agaggcugagaaaugcagaga

SEQ ID NO: 531413 - RNA, 20 nt, Homo sapiens
agaggcugaggcuggcacag

SEQ ID NO: 531414 - RNA, 14 nt, Homo sapiens
agaggcugccucag

SEQ ID NO: 531415 - RNA, 15 nt, Homo sapiens
agaggcuggaccaca

SEQ ID NO: 531416 - RNA, 16 nt, Homo sapiens
agaggcuuucuccagg

SEQ ID NO: 531417 - RNA, 18 nt, Homo sapiens
agagggaaggucucagga

SEQ ID NO: 531418 - RNA, 22 nt, Homo sapiens
agagggacagaugaaugccgug

SEQ ID NO: 531419 - RNA, 22 nt, Homo sapiens
agagggaccaaauugcuucuag

SEQ ID NO: 531420 - RNA, 14 nt, Homo sapiens
agagggcccaggca

SEQ ID NO: 531421 - RNA, 21 nt, Homo sapiens
agagggcgugggcgcuugcac

SEQ ID NO: 531422 - RNA, 14 nt, Homo sapiens
agagggcugcauuc

SEQ ID NO: 531423 - RNA, 13 nt, Homo sapiens
agagggcuuccuc

SEQ ID NO: 531424 - RNA, 20 nt, Homo sapiens
agaggggaaaccaguguagc

SEQ ID NO: 531425 - RNA, 13 nt, Homo sapiens
agaggggguagcu

SEQ ID NO: 531426 - RNA, 17 nt, Homo sapiens
agagggggucucagaaa

SEQ ID NO: 531427 - RNA, 22 nt, Homo sapiens
agagggguggaguuuuaacugu

SEQ ID NO: 531428 - RNA, 23 nt, Homo sapiens
agagggguggaguuuuaacugua

SEQ ID NO: 531429 - RNA, 12 nt, Homo sapiens
agaggguagcug

SEQ ID NO: 531430 - RNA, 14 nt, Homo sapiens
agaggguagcugug

SEQ ID NO: 531431 - RNA, 24 nt, Homo sapiens
agagguccuccacgcuuguuugcc

SEQ ID NO: 531432 - RNA, 22 nt, Homo sapiens
agaggugccggggaggggcaga

SEQ ID NO: 531433 - RNA, 21 nt, Homo sapiens
agaggugcuucugccugugca

SEQ ID NO: 531434 - RNA, 17 nt, Homo sapiens
agagguggagugucaca

SEQ ID NO: 531435 - RNA, 16 nt, Homo sapiens
agagguggaguucuua

SEQ ID NO: 531436 - RNA, 14 nt, Homo sapiens
agagguguggcuuc

SEQ ID NO: 531437 - RNA, 13 nt, Homo sapiens
agagguuucuuga

SEQ ID NO: 531438 - RNA, 23 nt, Homo sapiens
agagguuuuguauugagggccag

SEQ ID NO: 531439 - RNA, 14 nt, Homo sapiens
agaguaaacagaca

SEQ ID NO: 531440 - RNA, 15 nt, Homo sapiens
agaguaaacagacag

SEQ ID NO: 531441 - RNA, 15 nt, Homo sapiens
agaguaaucugggac

SEQ ID NO: 531442 - RNA, 22 nt, Homo sapiens
agaguaugagucuucuguaauu

SEQ ID NO: 531443 - RNA, 18 nt, Homo sapiens
agagucacuugaugugcc

SEQ ID NO: 531444 - RNA, 22 nt, Homo sapiens
agagucagacccuucaauggaa

SEQ ID NO: 531445 - RNA, 23 nt, Homo sapiens
agagucaugugagccucguguca

SEQ ID NO: 531446 - RNA, 18 nt, Homo sapiens
agaguccucuggauggca

SEQ ID NO: 531447 - RNA, 17 nt, Homo sapiens
agagucgcugugccaca

SEQ ID NO: 531448 - RNA, 23 nt, Homo sapiens
agagucuaggcuaagcacuuuau

SEQ ID NO: 531449 - RNA, 19 nt, Homo sapiens
agagucuccaguuacugaa

SEQ ID NO: 531450 - RNA, 17 nt, Homo sapiens
agagucucccagugggu

SEQ ID NO: 531451 - RNA, 23 nt, Homo sapiens
agagucugaaagacagaauguca

SEQ ID NO: 531452 - RNA, 18 nt, Homo sapiens
acucuggcacuuccauug

SEQ ID NO: 531453 - RNA, 19 nt, Homo sapiens
acucuggccuccaaaaugg

SEQ ID NO: 531454 - RNA, 23 nt, Homo sapiens
acucuggcuucucuccucagacu

SEQ ID NO: 531455 - RNA, 20 nt, Homo sapiens
acucugggaauacaggggug

SEQ ID NO: 531456 - RNA, 13 nt, Homo sapiens
acucugggcucca

SEQ ID NO: 531457 - RNA, 23 nt, Homo sapiens
acucuggggagccugagccacaa

SEQ ID NO: 531458 - RNA, 17 nt, Homo sapiens
acucuggggcucaagca

SEQ ID NO: 531459 - RNA, 14 nt, Homo sapiens
acucuggguuucau

SEQ ID NO: 531460 - RNA, 12 nt, Homo sapiens
acucugguggca

SEQ ID NO: 531461 - RNA, 14 nt, Homo sapiens
acucugguggcaca

SEQ ID NO: 531462 - RNA, 19 nt, Homo sapiens
acucugguggccacuucau

SEQ ID NO: 531463 - RNA, 19 nt, Homo sapiens
acucugguuggaaaugcca

SEQ ID NO: 531464 - RNA, 19 nt, Homo sapiens
acucuguaauugaauauaa

SEQ ID NO: 531465 - RNA, 22 nt, Homo sapiens
acucuguauuacagcuuucaca

SEQ ID NO: 531466 - RNA, 15 nt, Homo sapiens
acucugucucaaaaa

SEQ ID NO: 531467 - RNA, 20 nt, Homo sapiens
acucugucuuaaaugagaag

SEQ ID NO: 531468 - RNA, 11 nt, Homo sapiens
acucuguguaa

SEQ ID NO: 531469 - RNA, 18 nt, Homo sapiens
acucuuaggcacaucaau

SEQ ID NO: 531470 - RNA, 16 nt, Homo sapiens
acucuuaucuacauaa

SEQ ID NO: 531471 - RNA, 15 nt, Homo sapiens
acucuuaugaucaau

SEQ ID NO: 531472 - RNA, 17 nt, Homo sapiens
acucuuauuguccuucu

SEQ ID NO: 531473 - RNA, 16 nt, Homo sapiens
acucuucccucucuca

SEQ ID NO: 531474 - RNA, 17 nt, Homo sapiens
acucuucccucucucac

SEQ ID NO: 531475 - RNA, 18 nt, Homo sapiens
acucuucgaagccuugcc

SEQ ID NO: 531476 - RNA, 17 nt, Homo sapiens
acucuucuaacacaaaa

SEQ ID NO: 531477 - RNA, 14 nt, Homo sapiens
acucuucuguaaau

SEQ ID NO: 531478 - RNA, 18 nt, Homo sapiens
acucuucuuuaagccaua

SEQ ID NO: 531479 - RNA, 15 nt, Homo sapiens
acucuugacagcagg

SEQ ID NO: 531480 - RNA, 14 nt, Homo sapiens
acucuugccuguuu

SEQ ID NO: 531481 - RNA, 18 nt, Homo sapiens
acucuuggucccuggaag

SEQ ID NO: 531482 - RNA, 18 nt, Homo sapiens
acucuuucauucuucuca

SEQ ID NO: 531483 - RNA, 20 nt, Homo sapiens
acucuuucauucuucucaca

SEQ ID NO: 531484 - RNA, 15 nt, Homo sapiens
acugaaaaaugucag

SEQ ID NO: 531485 - RNA, 20 nt, Homo sapiens
acugaaaaugucacauucua

SEQ ID NO: 531486 - RNA, 15 nt, Homo sapiens
acugaaaccaaaaca

SEQ ID NO: 531487 - RNA, 17 nt, Homo sapiens
acugaaacgucuaggaa

SEQ ID NO: 531488 - RNA, 19 nt, Homo sapiens
acugaacaaaaccuacgca

SEQ ID NO: 531489 - RNA, 18 nt, Homo sapiens
acugaacaaucaaagcac

SEQ ID NO: 531490 - RNA, 14 nt, Homo sapiens
acugaacauccaaa

SEQ ID NO: 531491 - RNA, 12 nt, Homo sapiens
acugaacauguu

SEQ ID NO: 531492 - RNA, 13 nt, Homo sapiens
acugaacauguuu

SEQ ID NO: 531493 - RNA, 19 nt, Homo sapiens
acugaaggacacagcagug

SEQ ID NO: 531494 - RNA, 16 nt, Homo sapiens
acugaaggcauaugca

SEQ ID NO: 531495 - RNA, 18 nt, Homo sapiens
acugaaggcauaugcaca

SEQ ID NO: 531496 - RNA, 19 nt, Homo sapiens
acugaaggcauaugcuggc

SEQ ID NO: 531497 - RNA, 18 nt, Homo sapiens
acugaagugaacuaugaa

SEQ ID NO: 531498 - RNA, 14 nt, Homo sapiens
acugaaguggcuaa

SEQ ID NO: 531499 - RNA, 17 nt, Homo sapiens
acugaaguuucacauga

SEQ ID NO: 531500 - RNA, 17 nt, Homo sapiens
acugaauauauaaacac

SEQ ID NO: 531501 - RNA, 16 nt, Homo sapiens
acugaaucuaccugcc

SEQ ID NO: 531502 - RNA, 24 nt, Homo sapiens
acugaaucuggaccccaucuguga

SEQ ID NO: 531503 - RNA, 18 nt, Homo sapiens
acugaaugaccucucuac

SEQ ID NO: 531504 - RNA, 12 nt, Homo sapiens
acugaaugucau

SEQ ID NO: 531505 - RNA, 19 nt, Homo sapiens
acugaauguuuauuccuug

SEQ ID NO: 531506 - RNA, 22 nt, Homo sapiens
acugaauuuggaggcuggagua

SEQ ID NO: 531507 - RNA, 14 nt, Homo sapiens
acugacaacauuau

SEQ ID NO: 531508 - RNA, 21 nt, Homo sapiens
acugacacaagaauggucuuu

SEQ ID NO: 531509 - RNA, 18 nt, Homo sapiens
acugacacgaagccagca

SEQ ID NO: 531510 - RNA, 18 nt, Homo sapiens
acugacaguaaaucucac

SEQ ID NO: 531511 - RNA, 16 nt, Homo sapiens
acugaccagccuccau

SEQ ID NO: 531512 - RNA, 19 nt, Homo sapiens
acugaccagccuccaugcu

SEQ ID NO: 531513 - RNA, 23 nt, Homo sapiens
acugaccaucucccagaccgcca

SEQ ID NO: 531514 - RNA, 15 nt, Homo sapiens
acugaccugccugua

SEQ ID NO: 531515 - RNA, 19 nt, Homo sapiens
acugacgcaggcaccuucu

SEQ ID NO: 531516 - RNA, 15 nt, Homo sapiens
acugacuccugugga

SEQ ID NO: 531517 - RNA, 12 nt, Homo sapiens
acugacuccuua

SEQ ID NO: 531518 - RNA, 13 nt, Homo sapiens
acugacuccuuag

SEQ ID NO: 531519 - RNA, 13 nt, Homo sapiens
acugacucuguua

SEQ ID NO: 531520 - RNA, 21 nt, Homo sapiens
acugacuuguuugucuuccau

SEQ ID NO: 531521 - RNA, 18 nt, Homo sapiens
acugagaacagcauauga

SEQ ID NO: 531522 - RNA, 22 nt, Homo sapiens
acugagaauauaauacuguauu

SEQ ID NO: 531523 - RNA, 16 nt, Homo sapiens
acugagaaugauagua

SEQ ID NO: 531524 - RNA, 18 nt, Homo sapiens
acugagagcccacugcag

SEQ ID NO: 531525 - RNA, 13 nt, Homo sapiens
acugagaucuguu

SEQ ID NO: 531526 - RNA, 14 nt, Homo sapiens
acugagcauuugca

SEQ ID NO: 531527 - RNA, 19 nt, Homo sapiens
acugagcccucucacucca

SEQ ID NO: 531528 - RNA, 23 nt, Homo sapiens
acagaagagugacauguuuacaa

SEQ ID NO: 531529 - RNA, 16 nt, Homo sapiens
acagaagcagacuuuu

SEQ ID NO: 531530 - RNA, 22 nt, Homo sapiens
acagaagcagcuaaaccaagga

SEQ ID NO: 531531 - RNA, 13 nt, Homo sapiens
acagaagcaggcu

SEQ ID NO: 531532 - RNA, 12 nt, Homo sapiens
acagaagccagg

SEQ ID NO: 531533 - RNA, 21 nt, Homo sapiens
acagaagccugaugcugacau

SEQ ID NO: 531534 - RNA, 20 nt, Homo sapiens
acagaaguauuuuaauucac

SEQ ID NO: 531535 - RNA, 13 nt, Homo sapiens
acagaagugacuu

SEQ ID NO: 531536 - RNA, 18 nt, Homo sapiens
acagaauaauguguuaaa

SEQ ID NO: 531537 - RNA, 23 nt, Homo sapiens
acagaauagaauacauugauaca

SEQ ID NO: 531538 - RNA, 14 nt, Homo sapiens
acagaauagcacaa

SEQ ID NO: 531539 - RNA, 15 nt, Homo sapiens
acagaauagcacaaa

SEQ ID NO: 531540 - RNA, 19 nt, Homo sapiens
acagaauguaucugugaag

SEQ ID NO: 531541 - RNA, 18 nt, Homo sapiens
acagaauuaagaaauacu

SEQ ID NO: 531542 - RNA, 14 nt, Homo sapiens
acagaauugcuccu

SEQ ID NO: 531543 - RNA, 20 nt, Homo sapiens
acagacaagugacuguaucu

SEQ ID NO: 531544 - RNA, 20 nt, Homo sapiens
acagacaccaaguuccguca

SEQ ID NO: 531545 - RNA, 13 nt, Homo sapiens
acagacacugcac

SEQ ID NO: 531546 - RNA, 16 nt, Homo sapiens
acagacacugcacaga

SEQ ID NO: 531547 - RNA, 15 nt, Homo sapiens
acagacacuguugca

SEQ ID NO: 531548 - RNA, 22 nt, Homo sapiens
acagacacuuuucaaaagaaga

SEQ ID NO: 531549 - RNA, 14 nt, Homo sapiens
acagacaguuucug

SEQ ID NO: 531550 - RNA, 15 nt, Homo sapiens
acagacauacauuua

SEQ ID NO: 531551 - RNA, 20 nt, Homo sapiens
acagacauacauuuaugcac

SEQ ID NO: 531552 - RNA, 11 nt, Homo sapiens
acagacauauu

SEQ ID NO: 531553 - RNA, 15 nt, Homo sapiens
acagacaugugcaac

SEQ ID NO: 531554 - RNA, 13 nt, Homo sapiens
acagaccacagag

SEQ ID NO: 531555 - RNA, 16 nt, Homo sapiens
acagaccacuugccac

SEQ ID NO: 531556 - RNA, 17 nt, Homo sapiens
acagacccacacacuua

SEQ ID NO: 531557 - RNA, 13 nt, Homo sapiens
acagacggaaaug

SEQ ID NO: 531558 - RNA, 16 nt, Homo sapiens
acagacuccaaaaggc

SEQ ID NO: 531559 - RNA, 13 nt, Homo sapiens
acagacuggcaau

SEQ ID NO: 531560 - RNA, 21 nt, Homo sapiens
acagacuggcaauaaacuccu

SEQ ID NO: 531561 - RNA, 23 nt, Homo sapiens
acagacuggcaauaaacuccuac

SEQ ID NO: 531562 - RNA, 13 nt, Homo sapiens
acagacugugagu

SEQ ID NO: 531563 - RNA, 15 nt, Homo sapiens
acagacuucuuggua

SEQ ID NO: 531564 - RNA, 17 nt, Homo sapiens
acagagaaaagacauaa

SEQ ID NO: 531565 - RNA, 13 nt, Homo sapiens
acagagagacaga

SEQ ID NO: 531566 - RNA, 23 nt, Homo sapiens
acagagaugcgaaccacccaaaa

SEQ ID NO: 531567 - RNA, 17 nt, Homo sapiens
acagagcaagacuccau

SEQ ID NO: 531568 - RNA, 14 nt, Homo sapiens
acagagcacauuug

SEQ ID NO: 531569 - RNA, 20 nt, Homo sapiens
acagagccacgaguuuggau

SEQ ID NO: 531570 - RNA, 14 nt, Homo sapiens
acagagccuugaga

SEQ ID NO: 531571 - RNA, 20 nt, Homo sapiens
acagagcgagagucugucuc

SEQ ID NO: 531572 - RNA, 16 nt, Homo sapiens
acagagcugacugcau

SEQ ID NO: 531573 - RNA, 23 nt, Homo sapiens
acagagcugccucucgguggcca

SEQ ID NO: 531574 - RNA, 17 nt, Homo sapiens
acagaggagagucccag

SEQ ID NO: 531575 - RNA, 14 nt, Homo sapiens
acagaggcauuuaa

SEQ ID NO: 531576 - RNA, 22 nt, Homo sapiens
acagagggaaacacagcagcuu

SEQ ID NO: 531577 - RNA, 15 nt, Homo sapiens
acagagggcugcauu

SEQ ID NO: 531578 - RNA, 16 nt, Homo sapiens
acagaguagaaacuca

SEQ ID NO: 531579 - RNA, 19 nt, Homo sapiens
acagaguagaaacucaaaa

SEQ ID NO: 531580 - RNA, 23 nt, Homo sapiens
acagagucgcuggcauguuucac

SEQ ID NO: 531581 - RNA, 17 nt, Homo sapiens
acagagucuuggucugu

SEQ ID NO: 531582 - RNA, 14 nt, Homo sapiens
acagagugugcugc

SEQ ID NO: 531583 - RNA, 14 nt, Homo sapiens
acagaguucacuau

SEQ ID NO: 531584 - RNA, 14 nt, Homo sapiens
acagauaccuccaa

SEQ ID NO: 531585 - RNA, 21 nt, Homo sapiens
acagauaccuccaacccugcc

SEQ ID NO: 531586 - RNA, 22 nt, Homo sapiens
acagaucaagaaaaaaagggag

SEQ ID NO: 531587 - RNA, 18 nt, Homo sapiens
acagaucaucuuggaacu

SEQ ID NO: 531588 - RNA, 16 nt, Homo sapiens
acagaucuaucuccuc

SEQ ID NO: 531589 - RNA, 22 nt, Homo sapiens
acagaugaccguguacaauacc

SEQ ID NO: 531590 - RNA, 19 nt, Homo sapiens
acagaugcaaugugcuacu

SEQ ID NO: 531591 - RNA, 22 nt, Homo sapiens
acagaugccuucccuuguagca

SEQ ID NO: 531592 - RNA, 16 nt, Homo sapiens
acagaugcugagccau

SEQ ID NO: 531593 - RNA, 13 nt, Homo sapiens
acagauggcccaa

SEQ ID NO: 531594 - RNA, 22 nt, Homo sapiens
acagaugugaaaugaauguaau

SEQ ID NO: 531595 - RNA, 22 nt, Homo sapiens
acagaugugucugggagagccu

SEQ ID NO: 531596 - RNA, 22 nt, Homo sapiens
acagauuccaggcgaugugcaa

SEQ ID NO: 531597 - RNA, 23 nt, Homo sapiens
acagauucugcuagccuguucuu

SEQ ID NO: 531598 - RNA, 18 nt, Homo sapiens
acagauugcugaaacugu

SEQ ID NO: 531599 - RNA, 15 nt, Homo sapiens
acagauugcugcuuc

SEQ ID NO: 531600 - RNA, 21 nt, Homo sapiens
acagauuguucuaaaguaaaa

SEQ ID NO: 531601 - RNA, 19 nt, Homo sapiens
acagauuuuagacuuaccu

SEQ ID NO: 531602 - RNA, 20 nt, Homo sapiens
acagauuuuuacacuaauau

SEQ ID NO: 531603 - RNA, 14 nt, Homo sapiens
acagcaaacaggug

SEQ ID NO: 531604 - RNA, 20 nt, Homo sapiens
acagcaaacccugaugugac

SEQ ID NO: 531605 - RNA, 13 nt, Homo sapiens
acagcaacaauga

SEQ ID NO: 531606 - RNA, 18 nt, Homo sapiens
acagcaagacuccgucuc

SEQ ID NO: 531607 - RNA, 20 nt, Homo sapiens
acagcaagacuccgucucaa

SEQ ID NO: 531608 - RNA, 17 nt, Homo sapiens
acagcaauggugucagu

SEQ ID NO: 531609 - RNA, 12 nt, Homo sapiens
acagcacuggcu

SEQ ID NO: 531610 - RNA, 15 nt, Homo sapiens
acagcagacuaguua

SEQ ID NO: 531611 - RNA, 14 nt, Homo sapiens
acagcagauuccac

SEQ ID NO: 531612 - RNA, 18 nt, Homo sapiens
acagcagauuucagauca

SEQ ID NO: 531613 - RNA, 13 nt, Homo sapiens
acagcagcacugu

SEQ ID NO: 531614 - RNA, 17 nt, Homo sapiens
acagcagcagugccaua

SEQ ID NO: 531615 - RNA, 15 nt, Homo sapiens
acagcagcaucuuca

SEQ ID NO: 531616 - RNA, 15 nt, Homo sapiens
acagcagccugugag

SEQ ID NO: 531617 - RNA, 18 nt, Homo sapiens
acagcagcucaggcacac

SEQ ID NO: 531618 - RNA, 18 nt, Homo sapiens
acagcagcugaacagcca

SEQ ID NO: 531619 - RNA, 17 nt, Homo sapiens
acagcaggacuccaucu

SEQ ID NO: 531620 - RNA, 12 nt, Homo sapiens
acagcaguauug

SEQ ID NO: 531621 - RNA, 21 nt, Homo sapiens
acagcagucccaguauucuca

SEQ ID NO: 531622 - RNA, 19 nt, Homo sapiens
acagcaucccuucccacau

SEQ ID NO: 531623 - RNA, 22 nt, Homo sapiens
acagcaucgugaucacugagcc

SEQ ID NO: 531624 - RNA, 17 nt, Homo sapiens
acagcaugaaauguccu

SEQ ID NO: 531625 - RNA, 16 nt, Homo sapiens
acagcaugugccuuaa

SEQ ID NO: 531626 - RNA, 16 nt, Homo sapiens
acagcauuaacugucu

SEQ ID NO: 531627 - RNA, 15 nt, Homo sapiens
acagccaagcaccuc

SEQ ID NO: 531628 - RNA, 18 nt, Homo sapiens
acagccacacugugggac

SEQ ID NO: 531629 - RNA, 18 nt, Homo sapiens
acagccaccguuucuucc

SEQ ID NO: 531630 - RNA, 17 nt, Homo sapiens
acagccacuaaaacaca

SEQ ID NO: 531631 - RNA, 13 nt, Homo sapiens
acagccagugugu

SEQ ID NO: 531632 - RNA, 15 nt, Homo sapiens
acagcccagagccug

SEQ ID NO: 531633 - RNA, 21 nt, Homo sapiens
acagcccaggauacuggcaca

SEQ ID NO: 531634 - RNA, 15 nt, Homo sapiens
acagcccaucaccuc

SEQ ID NO: 531635 - RNA, 16 nt, Homo sapiens
acagcccaucaccucu

SEQ ID NO: 531636 - RNA, 18 nt, Homo sapiens
acagccccucuggacaca

SEQ ID NO: 531637 - RNA, 22 nt, Homo sapiens
acagccccuuauuugcacuuca

SEQ ID NO: 531638 - RNA, 16 nt, Homo sapiens
acagcccgcaggauca

SEQ ID NO: 531639 - RNA, 14 nt, Homo sapiens
acagcccucagcgu

SEQ ID NO: 531640 - RNA, 23 nt, Homo sapiens
acagcccuccacuccagcucuga

SEQ ID NO: 531641 - RNA, 21 nt, Homo sapiens
acagccuauaaccagacacau

SEQ ID NO: 531642 - RNA, 23 nt, Homo sapiens
acagccucagaauaaaagaugau

SEQ ID NO: 531643 - RNA, 20 nt, Homo sapiens
acagccugagucaccugcag

SEQ ID NO: 531644 - RNA, 14 nt, Homo sapiens
acagccuucacuuu

SEQ ID NO: 531645 - RNA, 18 nt, Homo sapiens
acagcgagaggcagagaa

SEQ ID NO: 531646 - RNA, 16 nt, Homo sapiens
acagcgcuguauuuac

SEQ ID NO: 531647 - RNA, 17 nt, Homo sapiens
acagcguguaaacacau

SEQ ID NO: 531648 - RNA, 17 nt, Homo sapiens
acagcuacucuccccac

SEQ ID NO: 531649 - RNA, 20 nt, Homo sapiens
acagcuaucgaacuucacaa

SEQ ID NO: 531650 - RNA, 19 nt, Homo sapiens
acaccguccuccacgccau

SEQ ID NO: 531651 - RNA, 17 nt, Homo sapiens
acaccguggacagcgcu

SEQ ID NO: 531652 - RNA, 14 nt, Homo sapiens
acaccguucauuca

SEQ ID NO: 531653 - RNA, 22 nt, Homo sapiens
acaccuaagagaaaaagaucga

SEQ ID NO: 531654 - RNA, 12 nt, Homo sapiens
acaccucagugg

SEQ ID NO: 531655 - RNA, 19 nt, Homo sapiens
acaccucccccugcugcug

SEQ ID NO: 531656 - RNA, 20 nt, Homo sapiens
acaccucccccugcugcugc

SEQ ID NO: 531657 - RNA, 15 nt, Homo sapiens
acaccucccuacucc

SEQ ID NO: 531658 - RNA, 21 nt, Homo sapiens
acaccucccuccccacaccuc

SEQ ID NO: 531659 - RNA, 13 nt, Homo sapiens
acaccucccugaa

SEQ ID NO: 531660 - RNA, 17 nt, Homo sapiens
acaccucugucccucaa

SEQ ID NO: 531661 - RNA, 14 nt, Homo sapiens
acaccugcccuaaa

SEQ ID NO: 531662 - RNA, 16 nt, Homo sapiens
acaccugccucugacc

SEQ ID NO: 531663 - RNA, 12 nt, Homo sapiens
acaccuggacug

SEQ ID NO: 531664 - RNA, 20 nt, Homo sapiens
acaccuggcccuugcaaucu

SEQ ID NO: 531665 - RNA, 20 nt, Homo sapiens
acaccugggggacagaggca

SEQ ID NO: 531666 - RNA, 18 nt, Homo sapiens
acaccuuaagaagucuau

SEQ ID NO: 531667 - RNA, 18 nt, Homo sapiens
acaccuuaauaugcugca

SEQ ID NO: 531668 - RNA, 15 nt, Homo sapiens
acaccuuuuccccaa

SEQ ID NO: 531669 - RNA, 22 nt, Homo sapiens
acaccuuuuccccaaccacaga

SEQ ID NO: 531670 - RNA, 15 nt, Homo sapiens
acacgaagccagcag

SEQ ID NO: 531671 - RNA, 12 nt, Homo sapiens
acacgagauuuc

SEQ ID NO: 531672 - RNA, 13 nt, Homo sapiens
acacgaugcauuu

SEQ ID NO: 531673 - RNA, 15 nt, Homo sapiens
acacgaugcauuuaa

SEQ ID NO: 531674 - RNA, 16 nt, Homo sapiens
acacgaugcauuuaau

SEQ ID NO: 531675 - RNA, 18 nt, Homo sapiens
acacgauugagaacugac

SEQ ID NO: 531676 - RNA, 23 nt, Homo sapiens
agagaaaccgggagaaggcauga

SEQ ID NO: 531677 - RNA, 16 nt, Homo sapiens
agagaaacuagaaaca

SEQ ID NO: 531678 - RNA, 19 nt, Homo sapiens
agagaaacugaggcccaga

SEQ ID NO: 531679 - RNA, 17 nt, Homo sapiens
agagaaagagaacuacu

SEQ ID NO: 531680 - RNA, 15 nt, Homo sapiens
agagaaaggacucag

SEQ ID NO: 531681 - RNA, 12 nt, Homo sapiens
agagaaagggag

SEQ ID NO: 531682 - RNA, 16 nt, Homo sapiens
agagaaauacuuucag

SEQ ID NO: 531683 - RNA, 16 nt, Homo sapiens
agagaaaugugucauc

SEQ ID NO: 531684 - RNA, 22 nt, Homo sapiens
agagaacugcaacugaaugacu

SEQ ID NO: 531685 - RNA, 23 nt, Homo sapiens
agagaacugcagaccucacuguc

SEQ ID NO: 531686 - RNA, 23 nt, Homo sapiens
agagaacuggaaagacauagcca

SEQ ID NO: 531687 - RNA, 13 nt, Homo sapiens
agagaacuggagg

SEQ ID NO: 531688 - RNA, 14 nt, Homo sapiens
agagaagaggcugg

SEQ ID NO: 531689 - RNA, 21 nt, Homo sapiens
agagaagcaucauuuccccaa

SEQ ID NO: 531690 - RNA, 22 nt, Homo sapiens
agagaagccaaacagcaagaag

SEQ ID NO: 531691 - RNA, 21 nt, Homo sapiens
agagaaggaccagaaaaugua

SEQ ID NO: 531692 - RNA, 15 nt, Homo sapiens
agagaaguccagcuc

SEQ ID NO: 531693 - RNA, 17 nt, Homo sapiens
agagaaucaacuaggua

SEQ ID NO: 531694 - RNA, 14 nt, Homo sapiens
agagaaucauacuu

SEQ ID NO: 531695 - RNA, 20 nt, Homo sapiens
agagaauccauccaaaguuc

SEQ ID NO: 531696 - RNA, 16 nt, Homo sapiens
agagaauguguguaga

SEQ ID NO: 531697 - RNA, 23 nt, Homo sapiens
agagaauguguguguguggcagg

SEQ ID NO: 531698 - RNA, 19 nt, Homo sapiens
agagaauguuccagacauu

SEQ ID NO: 531699 - RNA, 16 nt, Homo sapiens
agagaauuaugggaaa

SEQ ID NO: 531700 - RNA, 16 nt, Homo sapiens
agagacaauacaguaa

SEQ ID NO: 531701 - RNA, 17 nt, Homo sapiens
agagacagaauguaucu

SEQ ID NO: 531702 - RNA, 20 nt, Homo sapiens
agagacagaauguaucugug

SEQ ID NO: 531703 - RNA, 18 nt, Homo sapiens
agagacagauaccuccaa

SEQ ID NO: 531704 - RNA, 12 nt, Homo sapiens
agagacccaagg

SEQ ID NO: 531705 - RNA, 20 nt, Homo sapiens
agagaccccaggaacaauaa

SEQ ID NO: 531706 - RNA, 14 nt, Homo sapiens
agagaccuauguaa

SEQ ID NO: 531707 - RNA, 11 nt, Homo sapiens
agagaccucca

SEQ ID NO: 531708 - RNA, 21 nt, Homo sapiens
agagacgggguuucuccaugu

SEQ ID NO: 531709 - RNA, 22 nt, Homo sapiens
agagacucauuucacagccuuu

SEQ ID NO: 531710 - RNA, 13 nt, Homo sapiens
agagacuggagca

SEQ ID NO: 531711 - RNA, 21 nt, Homo sapiens
agagacuuggggaaauugcuu

SEQ ID NO: 531712 - RNA, 12 nt, Homo sapiens
agagagaacuuu

SEQ ID NO: 531713 - RNA, 14 nt, Homo sapiens
agagagagaacuuu

SEQ ID NO: 531714 - RNA, 21 nt, Homo sapiens
agagagcagcuuuaaacucag

SEQ ID NO: 531715 - RNA, 21 nt, Homo sapiens
agagagccuagaacaucccug

SEQ ID NO: 531716 - RNA, 13 nt, Homo sapiens
agagagccuggug

SEQ ID NO: 531717 - RNA, 20 nt, Homo sapiens
agagagccuuuuucuaggcc

SEQ ID NO: 531718 - RNA, 15 nt, Homo sapiens
agagaggaagugguc

SEQ ID NO: 531719 - RNA, 13 nt, Homo sapiens
agagaggcugccu

SEQ ID NO: 531720 - RNA, 15 nt, Homo sapiens
agagaggcugccuca

SEQ ID NO: 531721 - RNA, 18 nt, Homo sapiens
agagagggaccauguguc

SEQ ID NO: 531722 - RNA, 13 nt, Homo sapiens
agagagggagaag

SEQ ID NO: 531723 - RNA, 12 nt, Homo sapiens
agagagggcaaa

SEQ ID NO: 531724 - RNA, 17 nt, Homo sapiens
agagagggcaaagggau

SEQ ID NO: 531725 - RNA, 17 nt, Homo sapiens
agagagggcacaucucc

SEQ ID NO: 531726 - RNA, 16 nt, Homo sapiens
agagagguuuuucuga

SEQ ID NO: 531727 - RNA, 22 nt, Homo sapiens
agagaguauuuuuauacaaacc

SEQ ID NO: 531728 - RNA, 15 nt, Homo sapiens
agagagucaauguca

SEQ ID NO: 531729 - RNA, 22 nt, Homo sapiens
agagagucgcaucucagugcag

SEQ ID NO: 531730 - RNA, 13 nt, Homo sapiens
agagaguggcucc

SEQ ID NO: 531731 - RNA, 15 nt, Homo sapiens
agagauacacagaua

SEQ ID NO: 531732 - RNA, 21 nt, Homo sapiens
agagauauugauauugaagga

SEQ ID NO: 531733 - RNA, 18 nt, Homo sapiens
agagaucacccacuccua

SEQ ID NO: 531734 - RNA, 19 nt, Homo sapiens
agagaucgagaccauccug

SEQ ID NO: 531735 - RNA, 17 nt, Homo sapiens
agagaugacaaaccaua

SEQ ID NO: 531736 - RNA, 20 nt, Homo sapiens
agagauggggucucacagug

SEQ ID NO: 531737 - RNA, 14 nt, Homo sapiens
agagauucauuauu

SEQ ID NO: 531738 - RNA, 20 nt, Homo sapiens
agagauuuaucuuuauacag

SEQ ID NO: 531739 - RNA, 15 nt, Homo sapiens
agagauuuccuccau

SEQ ID NO: 531740 - RNA, 13 nt, Homo sapiens
agagauuugagaa

SEQ ID NO: 531741 - RNA, 21 nt, Homo sapiens
agagcaacaauccaucucuca

SEQ ID NO: 531742 - RNA, 19 nt, Homo sapiens
agagcaagacuccaucuca

SEQ ID NO: 531743 - RNA, 15 nt, Homo sapiens
acaggagacaaaaga

SEQ ID NO: 531744 - RNA, 18 nt, Homo sapiens
acaggagcugccauguca

SEQ ID NO: 531745 - RNA, 20 nt, Homo sapiens
acaggaggcagacaaugacc

SEQ ID NO: 531746 - RNA, 22 nt, Homo sapiens
acaggagguuguggaugcucca

SEQ ID NO: 531747 - RNA, 13 nt, Homo sapiens
acaggagugggaa

SEQ ID NO: 531748 - RNA, 23 nt, Homo sapiens
acaggaguguccucuucccucuc

SEQ ID NO: 531749 - RNA, 19 nt, Homo sapiens
acaggauccuauucucacc

SEQ ID NO: 531750 - RNA, 21 nt, Homo sapiens
acaggaugaaaguucccccau

SEQ ID NO: 531751 - RNA, 19 nt, Homo sapiens
acaggaugcuggccuuugc

SEQ ID NO: 531752 - RNA, 21 nt, Homo sapiens
acaggcaacugaggcagacag

SEQ ID NO: 531753 - RNA, 15 nt, Homo sapiens
acaggcacacaccac

SEQ ID NO: 531754 - RNA, 17 nt, Homo sapiens
acaggcacgugccacca

SEQ ID NO: 531755 - RNA, 14 nt, Homo sapiens
acaggcagcuucca

SEQ ID NO: 531756 - RNA, 18 nt, Homo sapiens
acaggcaguuaggugcug

SEQ ID NO: 531757 - RNA, 15 nt, Homo sapiens
acaggccauugugaa

SEQ ID NO: 531758 - RNA, 21 nt, Homo sapiens
acaggcccccuugaguggggu

SEQ ID NO: 531759 - RNA, 19 nt, Homo sapiens
acaggcuggagugcagugg

SEQ ID NO: 531760 - RNA, 18 nt, Homo sapiens
acaggcuggugcuaacau

SEQ ID NO: 531761 - RNA, 20 nt, Homo sapiens
acagggcgagacucugucuc

SEQ ID NO: 531762 - RNA, 16 nt, Homo sapiens
acaggggaucauguua

SEQ ID NO: 531763 - RNA, 22 nt, Homo sapiens
acaggggcuugcuauagugucc

SEQ ID NO: 531764 - RNA, 23 nt, Homo sapiens
acaggggugcugcagguggcaga

SEQ ID NO: 531765 - RNA, 24 nt, Homo sapiens
acagggucugcucuuucucugcca

SEQ ID NO: 531766 - RNA, 14 nt, Homo sapiens
acagggucuugcua

SEQ ID NO: 531767 - RNA, 19 nt, Homo sapiens
acagggucuugcucugucc

SEQ ID NO: 531768 - RNA, 17 nt, Homo sapiens
acaggguuucuccaugu

SEQ ID NO: 531769 - RNA, 23 nt, Homo sapiens
acagguaauauaaaaagcuucca

SEQ ID NO: 531770 - RNA, 14 nt, Homo sapiens
acagguaccaucuu

SEQ ID NO: 531771 - RNA, 15 nt, Homo sapiens
acaggucaaccaugg

SEQ ID NO: 531772 - RNA, 14 nt, Homo sapiens
acaggucaacuuca

SEQ ID NO: 531773 - RNA, 21 nt, Homo sapiens
acaggucggggaccaaaggcu

SEQ ID NO: 531774 - RNA, 18 nt, Homo sapiens
acaggugacaugaacuac

SEQ ID NO: 531775 - RNA, 20 nt, Homo sapiens
acaggugcaacagacuugaa

SEQ ID NO: 531776 - RNA, 20 nt, Homo sapiens
acagguguagaccagagugu

SEQ ID NO: 531777 - RNA, 21 nt, Homo sapiens
acaggugugcaccaccaugcc

SEQ ID NO: 531778 - RNA, 14 nt, Homo sapiens
acaguaaaucucac

SEQ ID NO: 531779 - RNA, 13 nt, Homo sapiens
acaguaacuguga

SEQ ID NO: 531780 - RNA, 15 nt, Homo sapiens
acaguaaugcaagca

SEQ ID NO: 531781 - RNA, 21 nt, Homo sapiens
acaguaauuuccuggucacau

SEQ ID NO: 531782 - RNA, 19 nt, Homo sapiens
acaguacacagauaccuug

SEQ ID NO: 531783 - RNA, 14 nt, Homo sapiens
acaguacagcaugu

SEQ ID NO: 531784 - RNA, 20 nt, Homo sapiens
acaguagaacugucugugaa

SEQ ID NO: 531785 - RNA, 17 nt, Homo sapiens
acaguagguuggcagua

SEQ ID NO: 531786 - RNA, 14 nt, Homo sapiens
acaguaucccacau

SEQ ID NO: 531787 - RNA, 12 nt, Homo sapiens
acaguaucucag

SEQ ID NO: 531788 - RNA, 16 nt, Homo sapiens
acaguaugagucaaug

SEQ ID NO: 531789 - RNA, 21 nt, Homo sapiens
acaguauuuuagguaugauuu

SEQ ID NO: 531790 - RNA, 16 nt, Homo sapiens
acaguauuuugacaaa

SEQ ID NO: 531791 - RNA, 17 nt, Homo sapiens
acagucaaggugauaua

SEQ ID NO: 531792 - RNA, 21 nt, Homo sapiens
acagucaccauacacacuguu

SEQ ID NO: 531793 - RNA, 21 nt, Homo sapiens
acagucacuugggagcugcug

SEQ ID NO: 531794 - RNA, 18 nt, Homo sapiens
acagucauguaugcaagu

SEQ ID NO: 531795 - RNA, 19 nt, Homo sapiens
acaguccuaccucaguuca

SEQ ID NO: 531796 - RNA, 15 nt, Homo sapiens
acaguccugggagaa

SEQ ID NO: 531797 - RNA, 16 nt, Homo sapiens
acaguccuguccucug

SEQ ID NO: 531798 - RNA, 14 nt, Homo sapiens
acagucuagugcaa

SEQ ID NO: 531799 - RNA, 17 nt, Homo sapiens
acagucucaguucucuu

SEQ ID NO: 531800 - RNA, 15 nt, Homo sapiens
acagucuggcucaug

SEQ ID NO: 531801 - RNA, 22 nt, Homo sapiens
acagucuuguauuaaguuguua

SEQ ID NO: 531802 - RNA, 14 nt, Homo sapiens
acagugaacacuca

SEQ ID NO: 531803 - RNA, 16 nt, Homo sapiens
acagugaaugcacugu

SEQ ID NO: 531804 - RNA, 17 nt, Homo sapiens
acagugacuucugagau

SEQ ID NO: 531805 - RNA, 15 nt, Homo sapiens
acagugagaaaccau

SEQ ID NO: 531806 - RNA, 21 nt, Homo sapiens
acagugagacccccaucucua

SEQ ID NO: 531807 - RNA, 23 nt, Homo sapiens
acagugcauacagccuuugccau

SEQ ID NO: 531808 - RNA, 13 nt, Homo sapiens
acagugcauuuac

SEQ ID NO: 531809 - RNA, 20 nt, Homo sapiens
acagugcauuugccuuguca

SEQ ID NO: 531810 - RNA, 22 nt, Homo sapiens
acagugcauuugccuugucacc

SEQ ID NO: 531811 - RNA, 14 nt, Homo sapiens
acagugccacugca

SEQ ID NO: 531812 - RNA, 14 nt, Homo sapiens
acagugccauguua

SEQ ID NO: 531813 - RNA, 22 nt, Homo sapiens
acagugcccaagcgcuuggccu

SEQ ID NO: 531814 - RNA, 16 nt, Homo sapiens
acagugccuauugaua

SEQ ID NO: 531815 - RNA, 21 nt, Homo sapiens
acagugcucuuuucuccucac

SEQ ID NO: 531816 - RNA, 14 nt, Homo sapiens
acagugcuguguac

SEQ ID NO: 531817 - RNA, 22 nt, Homo sapiens
acaguggacaaaguuaccagug

SEQ ID NO: 531818 - RNA, 18 nt, Homo sapiens
acaguggacucagcagug

SEQ ID NO: 531819 - RNA, 15 nt, Homo sapiens
acaguggaugcugcu

SEQ ID NO: 531820 - RNA, 20 nt, Homo sapiens
acaguggcaggggcuggaga

SEQ ID NO: 531821 - RNA, 12 nt, Homo sapiens
acaguggcugcu

SEQ ID NO: 531822 - RNA, 19 nt, Homo sapiens
acaguggggcugcaggcag

SEQ ID NO: 531823 - RNA, 16 nt, Homo sapiens
acaguguacaaugccu

SEQ ID NO: 531824 - RNA, 18 nt, Homo sapiens
acaguguacaaugccuuu

SEQ ID NO: 531825 - RNA, 12 nt, Homo sapiens
acaguguauauu

SEQ ID NO: 531826 - RNA, 13 nt, Homo sapiens
acagugucacugg

SEQ ID NO: 531827 - RNA, 20 nt, Homo sapiens
acaguguuauguaguauugu

SEQ ID NO: 531828 - RNA, 20 nt, Homo sapiens
acaguguuuuguagauuuca

SEQ ID NO: 531829 - RNA, 16 nt, Homo sapiens
acaguuaacuuucaga

SEQ ID NO: 531830 - RNA, 13 nt, Homo sapiens
acaguuaaugcca

SEQ ID NO: 531831 - RNA, 15 nt, Homo sapiens
acaguuacaguugau

SEQ ID NO: 531832 - RNA, 16 nt, Homo sapiens
acaguuauaucaagcu

SEQ ID NO: 531833 - RNA, 17 nt, Homo sapiens
acaguucugggcaaaga

SEQ ID NO: 531834 - RNA, 16 nt, Homo sapiens
acaguugcagcccuug

SEQ ID NO: 531835 - RNA, 15 nt, Homo sapiens
acaguugccagugau

SEQ ID NO: 531836 - RNA, 14 nt, Homo sapiens
auuauuuccagugu

SEQ ID NO: 531837 - RNA, 17 nt, Homo sapiens
auuauuugucaagcaaa

SEQ ID NO: 531838 - RNA, 14 nt, Homo sapiens
auuauuuucuguca

SEQ ID NO: 531839 - RNA, 15 nt, Homo sapiens
auuauuuucugucag

SEQ ID NO: 531840 - RNA, 18 nt, Homo sapiens
auuauuuuguuaguggaa

SEQ ID NO: 531841 - RNA, 13 nt, Homo sapiens
auuauuuuuacag

SEQ ID NO: 531842 - RNA, 20 nt, Homo sapiens
auuauuuuuguuagcaaaga

SEQ ID NO: 531843 - RNA, 18 nt, Homo sapiens
auuauuuuuuauacugua

SEQ ID NO: 531844 - RNA, 14 nt, Homo sapiens
auucaaaaguauug

SEQ ID NO: 531845 - RNA, 17 nt, Homo sapiens
auucaaagaaguacuuu

SEQ ID NO: 531846 - RNA, 18 nt, Homo sapiens
auucaaagaaguacuuua

SEQ ID NO: 531847 - RNA, 17 nt, Homo sapiens
auucaaagagacauaua

SEQ ID NO: 531848 - RNA, 14 nt, Homo sapiens
auucaaauaaucca

SEQ ID NO: 531849 - RNA, 15 nt, Homo sapiens
auucaaauggacaaa

SEQ ID NO: 531850 - RNA, 14 nt, Homo sapiens
auucaaauuauucu

SEQ ID NO: 531851 - RNA, 15 nt, Homo sapiens
auucaaauugcugcu

SEQ ID NO: 531852 - RNA, 18 nt, Homo sapiens
auucaacaaacauuugcu

SEQ ID NO: 531853 - RNA, 22 nt, Homo sapiens
auucaacaagagcacuacauuc

SEQ ID NO: 531854 - RNA, 14 nt, Homo sapiens
auucaacaauuuca

SEQ ID NO: 531855 - RNA, 14 nt, Homo sapiens
auucaacacauugg

SEQ ID NO: 531856 - RNA, 20 nt, Homo sapiens
auucaacagagacugaauag

SEQ ID NO: 531857 - RNA, 23 nt, Homo sapiens
auucaacagggaagaaacuuucu

SEQ ID NO: 531858 - RNA, 21 nt, Homo sapiens
auucaaggagaauaugauaaa

SEQ ID NO: 531859 - RNA, 19 nt, Homo sapiens
auucaagggacccaugagu

SEQ ID NO: 531860 - RNA, 14 nt, Homo sapiens
auucaaggggagcc

SEQ ID NO: 531861 - RNA, 19 nt, Homo sapiens
auucaagucaccuccuuaa

SEQ ID NO: 531862 - RNA, 15 nt, Homo sapiens
auucaagugccucuu

SEQ ID NO: 531863 - RNA, 15 nt, Homo sapiens
auucaauauugacau

SEQ ID NO: 531864 - RNA, 18 nt, Homo sapiens
auucaaugugaacacugg

SEQ ID NO: 531865 - RNA, 17 nt, Homo sapiens
auucaauuaguggucau

SEQ ID NO: 531866 - RNA, 21 nt, Homo sapiens
auucaauucuuuuaacuguug

SEQ ID NO: 531867 - RNA, 19 nt, Homo sapiens
auucaauuuuaaagacuca

SEQ ID NO: 531868 - RNA, 16 nt, Homo sapiens
auucacacaacuacuu

SEQ ID NO: 531869 - RNA, 14 nt, Homo sapiens
auucacagaaccua

SEQ ID NO: 531870 - RNA, 20 nt, Homo sapiens
auucacagaauagcacaaac

SEQ ID NO: 531871 - RNA, 21 nt, Homo sapiens
auucacauaguccucagggcu

SEQ ID NO: 531872 - RNA, 20 nt, Homo sapiens
auucacauauaucaaaguga

SEQ ID NO: 531873 - RNA, 19 nt, Homo sapiens
auucacucaagaguucagu

SEQ ID NO: 531874 - RNA, 20 nt, Homo sapiens
auucacucccacacccaaga

SEQ ID NO: 531875 - RNA, 23 nt, Homo sapiens
auucacuggggcaugagauuuug

SEQ ID NO: 531876 - RNA, 23 nt, Homo sapiens
auucacugguuuuacacagagaa

SEQ ID NO: 531877 - RNA, 22 nt, Homo sapiens
auucacuguuuguuacuaugua

SEQ ID NO: 531878 - RNA, 16 nt, Homo sapiens
auucacuucauaaucc

SEQ ID NO: 531879 - RNA, 23 nt, Homo sapiens
auucagacagagacuuuaaucac

SEQ ID NO: 531880 - RNA, 15 nt, Homo sapiens
auucagauaauuaga

SEQ ID NO: 531881 - RNA, 13 nt, Homo sapiens
auucagaucaaaa

SEQ ID NO: 531882 - RNA, 20 nt, Homo sapiens
auucagauggcaauuucacu

SEQ ID NO: 531883 - RNA, 13 nt, Homo sapiens
auucagcaagaca

SEQ ID NO: 531884 - RNA, 12 nt, Homo sapiens
auucagcacuua

SEQ ID NO: 531885 - RNA, 19 nt, Homo sapiens
auucagcauuauuccucca

SEQ ID NO: 531886 - RNA, 10 nt, Homo sapiens
auucagcgaa

SEQ ID NO: 531887 - RNA, 14 nt, Homo sapiens
auucagcucugcaa

SEQ ID NO: 531888 - RNA, 17 nt, Homo sapiens
auucagcucugcaagaa

SEQ ID NO: 531889 - RNA, 14 nt, Homo sapiens
auucaggacuugaa

SEQ ID NO: 531890 - RNA, 23 nt, Homo sapiens
auucagguauguugccuuuaugg

SEQ ID NO: 531891 - RNA, 19 nt, Homo sapiens
auucagguauuuguaauag

SEQ ID NO: 531892 - RNA, 14 nt, Homo sapiens
auucaguacaaccc

SEQ ID NO: 531893 - RNA, 18 nt, Homo sapiens
auucagugacaaaauggg

SEQ ID NO: 531894 - RNA, 23 nt, Homo sapiens
auucagugagggucuucuuacau

SEQ ID NO: 531895 - RNA, 17 nt, Homo sapiens
auucagugauuacuguc

SEQ ID NO: 531896 - RNA, 16 nt, Homo sapiens
auucaguggucuuauu

SEQ ID NO: 531897 - RNA, 18 nt, Homo sapiens
auucaguucccaccaucu

SEQ ID NO: 531898 - RNA, 20 nt, Homo sapiens
auucaguuucuaaaauugag

SEQ ID NO: 531899 - RNA, 17 nt, Homo sapiens
auucaguuuucauuugg

SEQ ID NO: 531900 - RNA, 23 nt, Homo sapiens
auucauaaaguaaugaugaaauc

SEQ ID NO: 531901 - RNA, 21 nt, Homo sapiens
auucauaguggauuaaugcau

SEQ ID NO: 531902 - RNA, 22 nt, Homo sapiens
auucauaguggauuaaugcauu

SEQ ID NO: 531903 - RNA, 15 nt, Homo sapiens
auucauauaggccag

SEQ ID NO: 531904 - RNA, 17 nt, Homo sapiens
auucaucagucauuauu

SEQ ID NO: 531905 - RNA, 20 nt, Homo sapiens
auucaucauuccauaugacu

SEQ ID NO: 531906 - RNA, 16 nt, Homo sapiens
auucauccugaccaag

SEQ ID NO: 531907 - RNA, 17 nt, Homo sapiens
auucauccugaccaaga

SEQ ID NO: 531908 - RNA, 23 nt, Homo sapiens
auucauccuuuaaguagggaugu

SEQ ID NO: 531909 - RNA, 13 nt, Homo sapiens
auucaucuaaugu

SEQ ID NO: 531910 - RNA, 16 nt, Homo sapiens
auucauuauuccucag

SEQ ID NO: 531911 - RNA, 16 nt, Homo sapiens
auucauuguguuaccu

SEQ ID NO: 531912 - RNA, 17 nt, Homo sapiens
auucauuucuagacuca

SEQ ID NO: 531913 - RNA, 17 nt, Homo sapiens
auucauuuucaucacug

SEQ ID NO: 531914 - RNA, 20 nt, Homo sapiens
auucauuuuuuucacuggag

SEQ ID NO: 531915 - RNA, 17 nt, Homo sapiens
auuccaaaaagcacaua

SEQ ID NO: 531916 - RNA, 10 nt, Homo sapiens
auuccaaagu

SEQ ID NO: 531917 - RNA, 14 nt, Homo sapiens
auuccaaaguucaa

SEQ ID NO: 531918 - RNA, 14 nt, Homo sapiens
auuccaacagcuca

SEQ ID NO: 531919 - RNA, 22 nt, Homo sapiens
auuccaacagcucaagucuucc

SEQ ID NO: 531920 - RNA, 21 nt, Homo sapiens
auuccaacauuucucacugaa

SEQ ID NO: 531921 - RNA, 18 nt, Homo sapiens
auuccacacuaccacauu

SEQ ID NO: 531922 - RNA, 17 nt, Homo sapiens
auuccaccuagagcuag

SEQ ID NO: 531923 - RNA, 17 nt, Homo sapiens
auuccaccugcaaucaa

SEQ ID NO: 531924 - RNA, 12 nt, Homo sapiens
auuccacuccac

SEQ ID NO: 531925 - RNA, 13 nt, Homo sapiens
auuccacuggacu

SEQ ID NO: 531926 - RNA, 23 nt, Homo sapiens
auuccacuuaggaagaaaugccc

SEQ ID NO: 531927 - RNA, 13 nt, Homo sapiens
auuccagaagaag

SEQ ID NO: 531928 - RNA, 17 nt, Homo sapiens
auuccagaaugcuguac

SEQ ID NO: 531929 - RNA, 22 nt, Homo sapiens
auuccagaggacucugcuuaaa

SEQ ID NO: 531930 - RNA, 22 nt, Homo sapiens
auuccagagugcugaggccagg

SEQ ID NO: 531931 - RNA, 13 nt, Homo sapiens
auuccagcaauaa

SEQ ID NO: 531932 - RNA, 20 nt, Homo sapiens
auuccaggaaaacugggaca

SEQ ID NO: 531933 - RNA, 16 nt, Homo sapiens
auuccaggcgaugugc

SEQ ID NO: 531934 - RNA, 20 nt, Homo sapiens
auuccaggcgaugugcaagu

SEQ ID NO: 531935 - RNA, 18 nt, Homo sapiens
auuccagguagcucggca

SEQ ID NO: 531936 - RNA, 23 nt, Homo sapiens
auuccagguagcucggcaccaac

SEQ ID NO: 531937 - RNA, 17 nt, Homo sapiens
auuccaguacaguauuc

SEQ ID NO: 531938 - RNA, 17 nt, Homo sapiens
auuccauacuucucuca

SEQ ID NO: 531939 - RNA, 20 nt, Homo sapiens
auuccauguggauaucaguu

SEQ ID NO: 531940 - RNA, 12 nt, Homo sapiens
auuccauugccu

SEQ ID NO: 531941 - RNA, 23 nt, Homo sapiens
auuccauuuugugaauugugaca

SEQ ID NO: 531942 - RNA, 14 nt, Homo sapiens
auucccaccaaggu

SEQ ID NO: 531943 - RNA, 14 nt, Homo sapiens
auucccacugccag

SEQ ID NO: 531944 - RNA, 15 nt, Homo sapiens
auucccaguguucca

SEQ ID NO: 531945 - RNA, 17 nt, Homo sapiens
auuccccucgugugacu

SEQ ID NO: 531946 - RNA, 22 nt, Homo sapiens
auuccccucgugugacucucuu

SEQ ID NO: 531947 - RNA, 22 nt, Homo sapiens
auuccccugcccaccuccuucc

SEQ ID NO: 531948 - RNA, 19 nt, Homo sapiens
auuccccugcccaggugug

SEQ ID NO: 531949 - RNA, 21 nt, Homo sapiens
auuccccuguagcagucacug

SEQ ID NO: 531950 - RNA, 23 nt, Homo sapiens
auuccccuguagcagucacugac

SEQ ID NO: 531951 - RNA, 19 nt, Homo sapiens
auucccuaucuuuuaguuu

SEQ ID NO: 531952 - RNA, 16 nt, Homo sapiens
auucccuccugcuacu

SEQ ID NO: 531953 - RNA, 22 nt, Homo sapiens
auucccugaaucugugccugca

SEQ ID NO: 531954 - RNA, 20 nt, Homo sapiens
auuccgucuccugcucugga

SEQ ID NO: 531955 - RNA, 14 nt, Homo sapiens
auuccgucuuaaaa

SEQ ID NO: 531956 - RNA, 14 nt, Homo sapiens
auuccuacaaagau

SEQ ID NO: 531957 - RNA, 20 nt, Homo sapiens
auuccuacugacaacauuau

SEQ ID NO: 531958 - RNA, 14 nt, Homo sapiens
acuuaaccuugcaa

SEQ ID NO: 531959 - RNA, 17 nt, Homo sapiens
acuuaacggaccaaagc

SEQ ID NO: 531960 - RNA, 13 nt, Homo sapiens
acuuaacuaguua

SEQ ID NO: 531961 - RNA, 13 nt, Homo sapiens
acuuaacuauuaa

SEQ ID NO: 531962 - RNA, 17 nt, Homo sapiens
acuuaacucucaagcua

SEQ ID NO: 531963 - RNA, 21 nt, Homo sapiens
acuuaagcaucuggcucuaau

SEQ ID NO: 531964 - RNA, 19 nt, Homo sapiens
acuuaaggauggagccagc

SEQ ID NO: 531965 - RNA, 18 nt, Homo sapiens
acuuaaguacccuuucaa

SEQ ID NO: 531966 - RNA, 12 nt, Homo sapiens
acuuaaguauau

SEQ ID NO: 531967 - RNA, 15 nt, Homo sapiens
acuuaagugcacuuu

SEQ ID NO: 531968 - RNA, 16 nt, Homo sapiens
acuuaaguggcauuaa

SEQ ID NO: 531969 - RNA, 17 nt, Homo sapiens
acuuaaguggcauuaaa

SEQ ID NO: 531970 - RNA, 16 nt, Homo sapiens
acuuaauaaagcuuuu

SEQ ID NO: 531971 - RNA, 22 nt, Homo sapiens
acuuaauaaauauuacagugaa

SEQ ID NO: 531972 - RNA, 17 nt, Homo sapiens
acuuaauacaugcaaca

SEQ ID NO: 531973 - RNA, 23 nt, Homo sapiens
acuuaauguuuguaagacuuaca

SEQ ID NO: 531974 - RNA, 19 nt, Homo sapiens
acuuacagaucuaucuccu

SEQ ID NO: 531975 - RNA, 19 nt, Homo sapiens
acuuacauuuacaaacuga

SEQ ID NO: 531976 - RNA, 19 nt, Homo sapiens
acuuaccgagucagacuuu

SEQ ID NO: 531977 - RNA, 16 nt, Homo sapiens
acuuaccuacugggga

SEQ ID NO: 531978 - RNA, 11 nt, Homo sapiens
acuuacuguac

SEQ ID NO: 531979 - RNA, 14 nt, Homo sapiens
acuuagaaugccau

SEQ ID NO: 531980 - RNA, 17 nt, Homo sapiens
acuuagaucaucaguca

SEQ ID NO: 531981 - RNA, 19 nt, Homo sapiens
acuuagcaagaccugaaaa

SEQ ID NO: 531982 - RNA, 15 nt, Homo sapiens
acuuagcagaaccac

SEQ ID NO: 531983 - RNA, 22 nt, Homo sapiens
acuuaguacuaucugugcguag

SEQ ID NO: 531984 - RNA, 14 nt, Homo sapiens
acuuaguaugcagu

SEQ ID NO: 531985 - RNA, 12 nt, Homo sapiens
acuuagugacaa

SEQ ID NO: 531986 - RNA, 19 nt, Homo sapiens
acuuagugguaugucucuu

SEQ ID NO: 531987 - RNA, 21 nt, Homo sapiens
acuuaguuagccuuagggaug

SEQ ID NO: 531988 - RNA, 22 nt, Homo sapiens
acuuaguuugugauguaaggca

SEQ ID NO: 531989 - RNA, 21 nt, Homo sapiens
acuuauaagaaagaucaaaga

SEQ ID NO: 531990 - RNA, 19 nt, Homo sapiens
acuuaucacgccuacuuaa

SEQ ID NO: 531991 - RNA, 17 nt, Homo sapiens
acuuauggaacagggau

SEQ ID NO: 531992 - RNA, 19 nt, Homo sapiens
acuuauggaacagggaugg

SEQ ID NO: 531993 - RNA, 18 nt, Homo sapiens
acuuauuaggacuuugaa

SEQ ID NO: 531994 - RNA, 21 nt, Homo sapiens
acuuauucucuguaggccaaa

SEQ ID NO: 531995 - RNA, 23 nt, Homo sapiens
acuuauuuuauuuuuuaccauaa

SEQ ID NO: 531996 - RNA, 20 nt, Homo sapiens
acuucaaagaggaaccagga

SEQ ID NO: 531997 - RNA, 13 nt, Homo sapiens
acuucaagcuuuu

SEQ ID NO: 531998 - RNA, 13 nt, Homo sapiens
acuucaagugacc

SEQ ID NO: 531999 - RNA, 20 nt, Homo sapiens
acuucaaguuaaagugaaua

SEQ ID NO: 532000 - RNA, 16 nt, Homo sapiens
acuucacccccaacuu

SEQ ID NO: 532001 - RNA, 18 nt, Homo sapiens
acuucaccuaacuagaga

SEQ ID NO: 532002 - RNA, 19 nt, Homo sapiens
acuucacgaaguguugcau

SEQ ID NO: 532003 - RNA, 19 nt, Homo sapiens
acuucaguauguugucaaa

SEQ ID NO: 532004 - RNA, 14 nt, Homo sapiens
auucucaucacuca

SEQ ID NO: 532005 - RNA, 16 nt, Homo sapiens
auucucaucaguccau

SEQ ID NO: 532006 - RNA, 17 nt, Homo sapiens
auucucauuuguucuca

SEQ ID NO: 532007 - RNA, 20 nt, Homo sapiens
auucucccaaaguaccuuga

SEQ ID NO: 532008 - RNA, 20 nt, Homo sapiens
auucuccugccucagccucc

SEQ ID NO: 532009 - RNA, 15 nt, Homo sapiens
auucucgaacugcau

SEQ ID NO: 532010 - RNA, 21 nt, Homo sapiens
auucucuaggagaaacuuaga

SEQ ID NO: 532011 - RNA, 16 nt, Homo sapiens
auucucucuccuguac

SEQ ID NO: 532012 - RNA, 13 nt, Homo sapiens
auucucugaguca

SEQ ID NO: 532013 - RNA, 22 nt, Homo sapiens
auucucugugguauccaagaau

SEQ ID NO: 532014 - RNA, 19 nt, Homo sapiens
auucucuuaaaaugacaaa

SEQ ID NO: 532015 - RNA, 21 nt, Homo sapiens
auucucuuaauagcuauacau

SEQ ID NO: 532016 - RNA, 20 nt, Homo sapiens
auucucuuaugauacuugag

SEQ ID NO: 532017 - RNA, 16 nt, Homo sapiens
auucucuucacuccca

SEQ ID NO: 532018 - RNA, 19 nt, Homo sapiens
auucucuuguuauugcauc

SEQ ID NO: 532019 - RNA, 23 nt, Homo sapiens
auucugaaaggaaauacacuucu

SEQ ID NO: 532020 - RNA, 11 nt, Homo sapiens
auucugaccau

SEQ ID NO: 532021 - RNA, 21 nt, Homo sapiens
auucugaguaacaucagcagg

SEQ ID NO: 532022 - RNA, 18 nt, Homo sapiens
auucugauaaugcucacu

SEQ ID NO: 532023 - RNA, 22 nt, Homo sapiens
auucugcauguacuaguccucu

SEQ ID NO: 532024 - RNA, 17 nt, Homo sapiens
auucugcauugcuagau

SEQ ID NO: 532025 - RNA, 21 nt, Homo sapiens
auucugccgcccccuccugaa

SEQ ID NO: 532026 - RNA, 21 nt, Homo sapiens
auucugccuugguucuggcca

SEQ ID NO: 532027 - RNA, 13 nt, Homo sapiens
auucugcuaccaa

SEQ ID NO: 532028 - RNA, 23 nt, Homo sapiens
auucuggaggggagagcuuugug

SEQ ID NO: 532029 - RNA, 14 nt, Homo sapiens
auucugugacauuu

SEQ ID NO: 532030 - RNA, 20 nt, Homo sapiens
auucugugucucugcaucca

SEQ ID NO: 532031 - RNA, 17 nt, Homo sapiens
auucuguuauauagugg

SEQ ID NO: 532032 - RNA, 20 nt, Homo sapiens
auucuguuuaucaagccaua

SEQ ID NO: 532033 - RNA, 18 nt, Homo sapiens
auucuguuuauucuucca

SEQ ID NO: 532034 - RNA, 13 nt, Homo sapiens
auucuuaagcacu

SEQ ID NO: 532035 - RNA, 17 nt, Homo sapiens
auucuuaauucucugca

SEQ ID NO: 532036 - RNA, 13 nt, Homo sapiens
auucuuagaauau

SEQ ID NO: 532037 - RNA, 22 nt, Homo sapiens
auucuuaguuguucaguugcca

SEQ ID NO: 532038 - RNA, 18 nt, Homo sapiens
auucuucaaccucauuga

SEQ ID NO: 532039 - RNA, 19 nt, Homo sapiens
auucuucaaccucauugac

SEQ ID NO: 532040 - RNA, 12 nt, Homo sapiens
auucuucacucu

SEQ ID NO: 532041 - RNA, 22 nt, Homo sapiens
auucuucagauacaaacugcag

SEQ ID NO: 532042 - RNA, 19 nt, Homo sapiens
auucuuccagaaugcugaa

SEQ ID NO: 532043 - RNA, 20 nt, Homo sapiens
auucuuccaucaucacugua

SEQ ID NO: 532044 - RNA, 21 nt, Homo sapiens
auucuuccucccauucaggau

SEQ ID NO: 532045 - RNA, 13 nt, Homo sapiens
auucuucugucaa

SEQ ID NO: 532046 - RNA, 12 nt, Homo sapiens
auucuucuugcu

SEQ ID NO: 532047 - RNA, 14 nt, Homo sapiens
auucuugaaugagg

SEQ ID NO: 532048 - RNA, 22 nt, Homo sapiens
auucuugagggacaaugccaau

SEQ ID NO: 532049 - RNA, 17 nt, Homo sapiens
auucuugaggucuugag

SEQ ID NO: 532050 - RNA, 15 nt, Homo sapiens
auucuuguaguuuac

SEQ ID NO: 532051 - RNA, 18 nt, Homo sapiens
auucuuuauacauucuag

SEQ ID NO: 532052 - RNA, 18 nt, Homo sapiens
auucuuuauucuuuuacu

SEQ ID NO: 532053 - RNA, 13 nt, Homo sapiens
auucuuuccccag

SEQ ID NO: 532054 - RNA, 22 nt, Homo sapiens
auucuuuccccucagagcucuu

SEQ ID NO: 532055 - RNA, 18 nt, Homo sapiens
auucuuugaacaugaacu

SEQ ID NO: 532056 - RNA, 14 nt, Homo sapiens
auucuuuguuacag

SEQ ID NO: 532057 - RNA, 15 nt, Homo sapiens
auucuuuguuuccug

SEQ ID NO: 532058 - RNA, 15 nt, Homo sapiens
auucuuuuaaugcca

SEQ ID NO: 532059 - RNA, 18 nt, Homo sapiens
auucuuuuccaagcuccu

SEQ ID NO: 532060 - RNA, 22 nt, Homo sapiens
auucuuuuuaaugcuguuaacu

SEQ ID NO: 532061 - RNA, 13 nt, Homo sapiens
auugaaaagcaca

SEQ ID NO: 532062 - RNA, 17 nt, Homo sapiens
auugaaacacagaguug

SEQ ID NO: 532063 - RNA, 16 nt, Homo sapiens
auugaaagaaccagag

SEQ ID NO: 532064 - RNA, 17 nt, Homo sapiens
auugaaagaaccagaga

SEQ ID NO: 532065 - RNA, 17 nt, Homo sapiens
auugaaaucaagcuuau

SEQ ID NO: 532066 - RNA, 18 nt, Homo sapiens
auugaaauguuugcauaa

SEQ ID NO: 532067 - RNA, 22 nt, Homo sapiens
auugaacaaaaauguuuccacu

SEQ ID NO: 532068 - RNA, 15 nt, Homo sapiens
auugaacacaaacug

SEQ ID NO: 532069 - RNA, 14 nt, Homo sapiens
auugaacauucuag

SEQ ID NO: 532070 - RNA, 13 nt, Homo sapiens
auugaacuguauu

SEQ ID NO: 532071 - RNA, 22 nt, Homo sapiens
auugaacuguauucuaguggcu

SEQ ID NO: 532072 - RNA, 18 nt, Homo sapiens
auugaacuuucacauagc

SEQ ID NO: 532073 - RNA, 18 nt, Homo sapiens
auugaacuuuuguacuga

SEQ ID NO: 532074 - RNA, 16 nt, Homo sapiens
auugaagagaacugca

SEQ ID NO: 532075 - RNA, 15 nt, Homo sapiens
auugaagcccuccaa

SEQ ID NO: 532076 - RNA, 16 nt, Homo sapiens
auugaaguauuuugcu

SEQ ID NO: 532077 - RNA, 17 nt, Homo sapiens
auugaauaacaguaguc

SEQ ID NO: 532078 - RNA, 12 nt, Homo sapiens
auugaaugaaac

SEQ ID NO: 532079 - RNA, 13 nt, Homo sapiens
auugaauuaucuu

SEQ ID NO: 532080 - RNA, 15 nt, Homo sapiens
auugaauuucacugu

SEQ ID NO: 532081 - RNA, 21 nt, Homo sapiens
acuugcguggacagucagggu

SEQ ID NO: 532082 - RNA, 16 nt, Homo sapiens
acuugcuaaagcacuu

SEQ ID NO: 532083 - RNA, 15 nt, Homo sapiens
acuugcuacuuauca

SEQ ID NO: 532084 - RNA, 20 nt, Homo sapiens
acuugcugaauuucaggcau

SEQ ID NO: 532085 - RNA, 22 nt, Homo sapiens
acuugcugcuucugcacuucau

SEQ ID NO: 532086 - RNA, 13 nt, Homo sapiens
acuugcuguccag

SEQ ID NO: 532087 - RNA, 23 nt, Homo sapiens
acuugcuuuaccuuuucagggcu

SEQ ID NO: 532088 - RNA, 22 nt, Homo sapiens
acuuggaaaauucucuuaauca

SEQ ID NO: 532089 - RNA, 20 nt, Homo sapiens
acuuggacaucucucuggcu

SEQ ID NO: 532090 - RNA, 21 nt, Homo sapiens
acuuggcuggggaggaccagg

SEQ ID NO: 532091 - RNA, 18 nt, Homo sapiens
acuugggaaacuauucau

SEQ ID NO: 532092 - RNA, 17 nt, Homo sapiens
acuugggcacaugcuca

SEQ ID NO: 532093 - RNA, 19 nt, Homo sapiens
acuugggccacacuaccca

SEQ ID NO: 532094 - RNA, 14 nt, Homo sapiens
acuuggucaccagc

SEQ ID NO: 532095 - RNA, 17 nt, Homo sapiens
acuuggucuggcuuuaa

SEQ ID NO: 532096 - RNA, 18 nt, Homo sapiens
acuuggucuuucacagug

SEQ ID NO: 532097 - RNA, 20 nt, Homo sapiens
acuuggugggaccaugaaca

SEQ ID NO: 532098 - RNA, 16 nt, Homo sapiens
acuugguguacugggu

SEQ ID NO: 532099 - RNA, 23 nt, Homo sapiens
acuuguaagaaaaugagacaaaa

SEQ ID NO: 532100 - RNA, 17 nt, Homo sapiens
acuuguagggaugccuu

SEQ ID NO: 532101 - RNA, 14 nt, Homo sapiens
acuuguauucccuu

SEQ ID NO: 532102 - RNA, 21 nt, Homo sapiens
acuugucaagccugugcaaaa

SEQ ID NO: 532103 - RNA, 18 nt, Homo sapiens
acuugucaccaugagaua

SEQ ID NO: 532104 - RNA, 16 nt, Homo sapiens
acuuguccaguucaaa

SEQ ID NO: 532105 - RNA, 16 nt, Homo sapiens
acuuguccugacucaa

SEQ ID NO: 532106 - RNA, 19 nt, Homo sapiens
acuugucuucccuucugau

SEQ ID NO: 532107 - RNA, 16 nt, Homo sapiens
acuugugcacccucua

SEQ ID NO: 532108 - RNA, 18 nt, Homo sapiens
acuugugcccuuguauag

SEQ ID NO: 532109 - RNA, 22 nt, Homo sapiens
acuuguguauauuuuaaugaau

SEQ ID NO: 532110 - RNA, 16 nt, Homo sapiens
acuugugucccaugau

SEQ ID NO: 532111 - RNA, 21 nt, Homo sapiens
acuuguuagaucaaccuccaa

SEQ ID NO: 532112 - RNA, 20 nt, Homo sapiens
acuuguuucuccaugggcuc

SEQ ID NO: 532113 - RNA, 19 nt, Homo sapiens
acuuguuuuaaacuugccu

SEQ ID NO: 532114 - RNA, 19 nt, Homo sapiens
acuuuaaaaaguaaccaga

SEQ ID NO: 532115 - RNA, 16 nt, Homo sapiens
acuuuaaaagacugaa

SEQ ID NO: 532116 - RNA, 14 nt, Homo sapiens
acuuuaaaaugcga

SEQ ID NO: 532117 - RNA, 19 nt, Homo sapiens
acuuuaaagauaagucuac

SEQ ID NO: 532118 - RNA, 13 nt, Homo sapiens
acuuuaacccucu

SEQ ID NO: 532119 - RNA, 14 nt, Homo sapiens
acuuuaacugacuu

SEQ ID NO: 532120 - RNA, 20 nt, Homo sapiens
acuuuaauuauuguuauaca

SEQ ID NO: 532121 - RNA, 21 nt, Homo sapiens
acuuuaauugaagaacugcac

SEQ ID NO: 532122 - RNA, 23 nt, Homo sapiens
acuuuaauugaagaacugcacuu

SEQ ID NO: 532123 - RNA, 12 nt, Homo sapiens
acuuuaccaugc

SEQ ID NO: 532124 - RNA, 17 nt, Homo sapiens
acuuuacugccugaaua

SEQ ID NO: 532125 - RNA, 15 nt, Homo sapiens
caagacuccaucuca

SEQ ID NO: 532126 - RNA, 19 nt, Homo sapiens
caagacuccaucucaaaaa

SEQ ID NO: 532127 - RNA, 16 nt, Homo sapiens
caagacucugaacaau

SEQ ID NO: 532128 - RNA, 12 nt, Homo sapiens
caagagaacuca

SEQ ID NO: 532129 - RNA, 21 nt, Homo sapiens
caagagaacucgcgcucagua

SEQ ID NO: 532130 - RNA, 13 nt, Homo sapiens
caagagaauagcu

SEQ ID NO: 532131 - RNA, 14 nt, Homo sapiens
caagagaccagccu

SEQ ID NO: 532132 - RNA, 23 nt, Homo sapiens
caagagagaaagaaguaggcaug

SEQ ID NO: 532133 - RNA, 14 nt, Homo sapiens
caagagaggaagga

SEQ ID NO: 532134 - RNA, 15 nt, Homo sapiens
caagagaugggacaa

SEQ ID NO: 532135 - RNA, 13 nt, Homo sapiens
caagagcaauuua

SEQ ID NO: 532136 - RNA, 13 nt, Homo sapiens
caagaggggaaaa

SEQ ID NO: 532137 - RNA, 17 nt, Homo sapiens
caagagguacuguaaug

SEQ ID NO: 532138 - RNA, 22 nt, Homo sapiens
caagagguacuguaauggguaa

SEQ ID NO: 532139 - RNA, 17 nt, Homo sapiens
caagagugagacuccac

SEQ ID NO: 532140 - RNA, 18 nt, Homo sapiens
caagagugauauacucca

SEQ ID NO: 532141 - RNA, 21 nt, Homo sapiens
caagagugauauacuccagga

SEQ ID NO: 532142 - RNA, 18 nt, Homo sapiens
caagagugauugcagcuu

SEQ ID NO: 532143 - RNA, 15 nt, Homo sapiens
caagaguuuguucug

SEQ ID NO: 532144 - RNA, 15 nt, Homo sapiens
caagaucaacauucc

SEQ ID NO: 532145 - RNA, 13 nt, Homo sapiens
caagauccuuaau

SEQ ID NO: 532146 - RNA, 17 nt, Homo sapiens
caagauccuuaaugcag

SEQ ID NO: 532147 - RNA, 12 nt, Homo sapiens
caagaucuugaa

SEQ ID NO: 532148 - RNA, 14 nt, Homo sapiens
caagaucuuuccaa

SEQ ID NO: 532149 - RNA, 14 nt, Homo sapiens
caagauggauuaaa

SEQ ID NO: 532150 - RNA, 23 nt, Homo sapiens
caagauggcgaccaccaaaguca

SEQ ID NO: 532151 - RNA, 22 nt, Homo sapiens
caagauuaugugacuugcaaua

SEQ ID NO: 532152 - RNA, 14 nt, Homo sapiens
caagauucuacuug

SEQ ID NO: 532153 - RNA, 21 nt, Homo sapiens
caagauuuccuacuuucuccu

SEQ ID NO: 532154 - RNA, 16 nt, Homo sapiens
caagauuuucuacuuu

SEQ ID NO: 532155 - RNA, 15 nt, Homo sapiens
caagcaaagugcuuu

SEQ ID NO: 532156 - RNA, 22 nt, Homo sapiens
caagcaaauguuuaaaauccaa

SEQ ID NO: 532157 - RNA, 14 nt, Homo sapiens
caagcaaggccaaa

SEQ ID NO: 532158 - RNA, 15 nt, Homo sapiens
caagcaauccuccua

SEQ ID NO: 532159 - RNA, 14 nt, Homo sapiens
caagcaaugggcaa

SEQ ID NO: 532160 - RNA, 12 nt, Homo sapiens
caagcaccugca

SEQ ID NO: 532161 - RNA, 22 nt, Homo sapiens
caagcaccuguuaauaaagguc

SEQ ID NO: 532162 - RNA, 19 nt, Homo sapiens
caagcacuuuauauuuucc

SEQ ID NO: 532163 - RNA, 22 nt, Homo sapiens
caagcagaacuagguagaaaca

SEQ ID NO: 532164 - RNA, 18 nt, Homo sapiens
caagcagaucucaucuca

SEQ ID NO: 532165 - RNA, 20 nt, Homo sapiens
caagcagcugaagaaaaaau

SEQ ID NO: 532166 - RNA, 18 nt, Homo sapiens
caagcaggugaacuggga

SEQ ID NO: 532167 - RNA, 20 nt, Homo sapiens
caagcagugaaauaugauaa

SEQ ID NO: 532168 - RNA, 23 nt, Homo sapiens
caagcaguuaguuccuucaugau

SEQ ID NO: 532169 - RNA, 19 nt, Homo sapiens
caagcauauuggaaaguga

SEQ ID NO: 532170 - RNA, 16 nt, Homo sapiens
caagcaugaagugcug

SEQ ID NO: 532171 - RNA, 23 nt, Homo sapiens
caagcaugaucuuguuacuguga

SEQ ID NO: 532172 - RNA, 15 nt, Homo sapiens
caagcauuccugcuc

SEQ ID NO: 532173 - RNA, 23 nt, Homo sapiens
caagcauuuugugaacuagggaa

SEQ ID NO: 532174 - RNA, 15 nt, Homo sapiens
caagcauuuuuccau

SEQ ID NO: 532175 - RNA, 22 nt, Homo sapiens
caagccaagugcccucucugaa

SEQ ID NO: 532176 - RNA, 18 nt, Homo sapiens
caagccacaagucuucca

SEQ ID NO: 532177 - RNA, 18 nt, Homo sapiens
caagccaugugcuuuagc

SEQ ID NO: 532178 - RNA, 16 nt, Homo sapiens
caagccccacuuauuc

SEQ ID NO: 532179 - RNA, 16 nt, Homo sapiens
caagccccugcuccag

SEQ ID NO: 532180 - RNA, 22 nt, Homo sapiens
caagcccguuaaauaauucccu

SEQ ID NO: 532181 - RNA, 21 nt, Homo sapiens
caagcccuggcaacauaguga

SEQ ID NO: 532182 - RNA, 17 nt, Homo sapiens
caagcccuguugacaca

SEQ ID NO: 532183 - RNA, 17 nt, Homo sapiens
caagccgagcucuccuu

SEQ ID NO: 532184 - RNA, 18 nt, Homo sapiens
caagccuacaugacacag

SEQ ID NO: 532185 - RNA, 16 nt, Homo sapiens
caagccugucuucaga

SEQ ID NO: 532186 - RNA, 16 nt, Homo sapiens
caagccugugcaaaaa

SEQ ID NO: 532187 - RNA, 20 nt, Homo sapiens
caagccuucuuaaagccuua

SEQ ID NO: 532188 - RNA, 14 nt, Homo sapiens
caagcgacgacaga

SEQ ID NO: 532189 - RNA, 17 nt, Homo sapiens
caagcgcgcuguugauu

SEQ ID NO: 532190 - RNA, 23 nt, Homo sapiens
caagcuaugaucagaagacuuua

SEQ ID NO: 532191 - RNA, 12 nt, Homo sapiens
caagcucagggc

SEQ ID NO: 532192 - RNA, 22 nt, Homo sapiens
caagcuccuccucccugcaucu

SEQ ID NO: 532193 - RNA, 20 nt, Homo sapiens
caagcucucgggacuagcug

SEQ ID NO: 532194 - RNA, 16 nt, Homo sapiens
caagcuggaagcacau

SEQ ID NO: 532195 - RNA, 20 nt, Homo sapiens
caagcugugacuucuccagg

SEQ ID NO: 532196 - RNA, 19 nt, Homo sapiens
caagcuuggucaaacuuuu

SEQ ID NO: 532197 - RNA, 17 nt, Homo sapiens
caagcuuguguacuuga

SEQ ID NO: 532198 - RNA, 21 nt, Homo sapiens
caagcuuuugcuugauccaga

SEQ ID NO: 532199 - RNA, 20 nt, Homo sapiens
caaggaaaaacaggucuuca

SEQ ID NO: 532200 - RNA, 14 nt, Homo sapiens
caaggaaacaugca

SEQ ID NO: 532201 - RNA, 17 nt, Homo sapiens
caaggaaagaccaguuu

SEQ ID NO: 532202 - RNA, 17 nt, Homo sapiens
caaggaagccaaaguuu

SEQ ID NO: 532203 - RNA, 13 nt, Homo sapiens
caaggaagucaaa

SEQ ID NO: 532204 - RNA, 15 nt, Homo sapiens
caaggaauaauucaa

SEQ ID NO: 532205 - RNA, 15 nt, Homo sapiens
caaggaccucucuca

SEQ ID NO: 532206 - RNA, 13 nt, Homo sapiens
caaggacugagca

SEQ ID NO: 532207 - RNA, 22 nt, Homo sapiens
caaggagaccaaguccuggcua

SEQ ID NO: 532208 - RNA, 20 nt, Homo sapiens
caaggagagagugagugcau

SEQ ID NO: 532209 - RNA, 20 nt, Homo sapiens
caaggagggugagugcaagg

SEQ ID NO: 532210 - RNA, 21 nt, Homo sapiens
caaggaggguguaauggagca

SEQ ID NO: 532211 - RNA, 14 nt, Homo sapiens
caaggaguacaaug

SEQ ID NO: 532212 - RNA, 23 nt, Homo sapiens
caaggagucacugagaccaaggc

SEQ ID NO: 532213 - RNA, 22 nt, Homo sapiens
caaggaguuuauuacaauguau

SEQ ID NO: 532214 - RNA, 16 nt, Homo sapiens
caaggauauacugcag

SEQ ID NO: 532215 - RNA, 21 nt, Homo sapiens
caaggauggaugcagauccag

SEQ ID NO: 532216 - RNA, 23 nt, Homo sapiens
caaggauucagcauuauuccucc

SEQ ID NO: 532217 - RNA, 17 nt, Homo sapiens
caaggcaggugccucca

SEQ ID NO: 532218 - RNA, 14 nt, Homo sapiens
agcaaugacaucuc

SEQ ID NO: 532219 - RNA, 19 nt, Homo sapiens
agcaaugacaucucagggg

SEQ ID NO: 532220 - RNA, 14 nt, Homo sapiens
agcaaugaugucca

SEQ ID NO: 532221 - RNA, 19 nt, Homo sapiens
agcaaugcccguaaugcuu

SEQ ID NO: 532222 - RNA, 15 nt, Homo sapiens
agcaauggaguggcu

SEQ ID NO: 532223 - RNA, 21 nt, Homo sapiens
agcaauggaguggcugccaug

SEQ ID NO: 532224 - RNA, 20 nt, Homo sapiens
agcaaugguaauugugaaua

SEQ ID NO: 532225 - RNA, 15 nt, Homo sapiens
agcaaugucugugcu

SEQ ID NO: 532226 - RNA, 17 nt, Homo sapiens
agcaauuccucugaaca

SEQ ID NO: 532227 - RNA, 17 nt, Homo sapiens
agcaauucuccugccuc

SEQ ID NO: 532228 - RNA, 15 nt, Homo sapiens
agcaauucucuuucu

SEQ ID NO: 532229 - RNA, 23 nt, Homo sapiens
agcaauuuagacaaagccuuaag

SEQ ID NO: 532230 - RNA, 13 nt, Homo sapiens
agcacaagccaca

SEQ ID NO: 532231 - RNA, 16 nt, Homo sapiens
agcacaaggccuugcc

SEQ ID NO: 532232 - RNA, 18 nt, Homo sapiens
agcacaaucacuaaacuu

SEQ ID NO: 532233 - RNA, 18 nt, Homo sapiens
agcacaauuugcacuaaa

SEQ ID NO: 532234 - RNA, 15 nt, Homo sapiens
agcacacagggcagu

SEQ ID NO: 532235 - RNA, 13 nt, Homo sapiens
agcacacuggaau

SEQ ID NO: 532236 - RNA, 13 nt, Homo sapiens
agcacacuguagc

SEQ ID NO: 532237 - RNA, 19 nt, Homo sapiens
agcacacuuuacacaagaa

SEQ ID NO: 532238 - RNA, 16 nt, Homo sapiens
agcacagaguggcuug

SEQ ID NO: 532239 - RNA, 19 nt, Homo sapiens
agcacagcuugaccugagg

SEQ ID NO: 532240 - RNA, 20 nt, Homo sapiens
agcacagggggaagaagaag

SEQ ID NO: 532241 - RNA, 15 nt, Homo sapiens
agcacagucagugac

SEQ ID NO: 532242 - RNA, 13 nt, Homo sapiens
agcacaguuugaa

SEQ ID NO: 532243 - RNA, 22 nt, Homo sapiens
agcacauaacuggauuuugaac

SEQ ID NO: 532244 - RNA, 18 nt, Homo sapiens
agcacauggccauagagg

SEQ ID NO: 532245 - RNA, 17 nt, Homo sapiens
agcaccccuagcaugaa

SEQ ID NO: 532246 - RNA, 20 nt, Homo sapiens
agcacccugcccaccaagaa

SEQ ID NO: 532247 - RNA, 18 nt, Homo sapiens
caagguccucugucaguc

SEQ ID NO: 532248 - RNA, 12 nt, Homo sapiens
caaggucugcuc

SEQ ID NO: 532249 - RNA, 14 nt, Homo sapiens
caaggugaguguga

SEQ ID NO: 532250 - RNA, 16 nt, Homo sapiens
caaggugagugugacu

SEQ ID NO: 532251 - RNA, 12 nt, Homo sapiens
caaggugggggc

SEQ ID NO: 532252 - RNA, 18 nt, Homo sapiens
caagguggggggaucaca

SEQ ID NO: 532253 - RNA, 21 nt, Homo sapiens
caagguggucaguaaauaaca

SEQ ID NO: 532254 - RNA, 23 nt, Homo sapiens
caagguggugaaaucccaucucu

SEQ ID NO: 532255 - RNA, 19 nt, Homo sapiens
caagguguuuccauuucuc

SEQ ID NO: 532256 - RNA, 19 nt, Homo sapiens
caagguuggagagucuccu

SEQ ID NO: 532257 - RNA, 17 nt, Homo sapiens
caaguaaaacuguggua

SEQ ID NO: 532258 - RNA, 21 nt, Homo sapiens
caaguaagaaagugaagcaaa

SEQ ID NO: 532259 - RNA, 16 nt, Homo sapiens
caaguaauacaaacua

SEQ ID NO: 532260 - RNA, 14 nt, Homo sapiens
caaguaauugugaa

SEQ ID NO: 532261 - RNA, 15 nt, Homo sapiens
caaguagcacccugg

SEQ ID NO: 532262 - RNA, 18 nt, Homo sapiens
caaguagcugggauuaca

SEQ ID NO: 532263 - RNA, 13 nt, Homo sapiens
caaguagcuuucu

SEQ ID NO: 532264 - RNA, 21 nt, Homo sapiens
caaguauacuagggagccauu

SEQ ID NO: 532265 - RNA, 15 nt, Homo sapiens
caaguauaugugaaa

SEQ ID NO: 532266 - RNA, 14 nt, Homo sapiens
caaguauccaguca

SEQ ID NO: 532267 - RNA, 16 nt, Homo sapiens
caaguaugaaguauaa

SEQ ID NO: 532268 - RNA, 17 nt, Homo sapiens
caaguauuauuuuacaa

SEQ ID NO: 532269 - RNA, 23 nt, Homo sapiens
caaguauucauuuuuucuacccu

SEQ ID NO: 532270 - RNA, 17 nt, Homo sapiens
caagucaacacucuucu

SEQ ID NO: 532271 - RNA, 15 nt, Homo sapiens
caagucaccaugcug

SEQ ID NO: 532272 - RNA, 17 nt, Homo sapiens
caagucaccaugcugaa

SEQ ID NO: 532273 - RNA, 17 nt, Homo sapiens
caagucagccuagagac

SEQ ID NO: 532274 - RNA, 21 nt, Homo sapiens
caagucaggcccuuauuuuca

SEQ ID NO: 532275 - RNA, 16 nt, Homo sapiens
caaguccagauuuaca

SEQ ID NO: 532276 - RNA, 18 nt, Homo sapiens
caaguccagauuuacacu

SEQ ID NO: 532277 - RNA, 13 nt, Homo sapiens
caagucccuguca

SEQ ID NO: 532278 - RNA, 21 nt, Homo sapiens
caaguccugugaauuucuuca

SEQ ID NO: 532279 - RNA, 13 nt, Homo sapiens
caagucuaaacca

SEQ ID NO: 532280 - RNA, 19 nt, Homo sapiens
caagucuucccugaucaag

SEQ ID NO: 532281 - RNA, 18 nt, Homo sapiens
caagucuucucaagaucc

SEQ ID NO: 532282 - RNA, 22 nt, Homo sapiens
caagucuugaauaguacauuuu

SEQ ID NO: 532283 - RNA, 18 nt, Homo sapiens
caagugaauuugccugua

SEQ ID NO: 532284 - RNA, 19 nt, Homo sapiens
caagugacucuccugccuc

SEQ ID NO: 532285 - RNA, 19 nt, Homo sapiens
caagugauccuuccaccuc

SEQ ID NO: 532286 - RNA, 14 nt, Homo sapiens
caagugcacugagc

SEQ ID NO: 532287 - RNA, 22 nt, Homo sapiens
caagugcccucucugaaccuca

SEQ ID NO: 532288 - RNA, 15 nt, Homo sapiens
caagugcuaccuuug

SEQ ID NO: 532289 - RNA, 18 nt, Homo sapiens
caagugcugcacaaaagc

SEQ ID NO: 532290 - RNA, 22 nt, Homo sapiens
caaguggggugcucuggucuga

SEQ ID NO: 532291 - RNA, 21 nt, Homo sapiens
caaguguaugcacgugugcac

SEQ ID NO: 532292 - RNA, 13 nt, Homo sapiens
caagugucugugu

SEQ ID NO: 532293 - RNA, 16 nt, Homo sapiens
caagugucugugugca

SEQ ID NO: 532294 - RNA, 18 nt, Homo sapiens
caagugucugugugcaag

SEQ ID NO: 532295 - RNA, 12 nt, Homo sapiens
caagugugaaca

SEQ ID NO: 532296 - RNA, 17 nt, Homo sapiens
caaguguguaugugcgu

SEQ ID NO: 532297 - RNA, 24 nt, Homo sapiens
caaguguguaugugcgugugugca

SEQ ID NO: 532298 - RNA, 20 nt, Homo sapiens
caagugugugcacaugugug

SEQ ID NO: 532299 - RNA, 16 nt, Homo sapiens
caagugugugcaugug

SEQ ID NO: 532300 - RNA, 12 nt, Homo sapiens
caaguguuauac

SEQ ID NO: 532301 - RNA, 18 nt, Homo sapiens
caaguguuugugggacac

SEQ ID NO: 532302 - RNA, 23 nt, Homo sapiens
caaguuaaagugaauaaccacuu

SEQ ID NO: 532303 - RNA, 21 nt, Homo sapiens
caaguuagaaaacauaaucuu

SEQ ID NO: 532304 - RNA, 16 nt, Homo sapiens
caaguuauacaucuug

SEQ ID NO: 532305 - RNA, 22 nt, Homo sapiens
caaguuauauugaauauaucag

SEQ ID NO: 532306 - RNA, 16 nt, Homo sapiens
caaguuauucucuuca

SEQ ID NO: 532307 - RNA, 16 nt, Homo sapiens
caaguuccacuucuug

SEQ ID NO: 532308 - RNA, 21 nt, Homo sapiens
caaguuccaugcuugagcaau

SEQ ID NO: 532309 - RNA, 17 nt, Homo sapiens
caaguuguguuugauau

SEQ ID NO: 532310 - RNA, 18 nt, Homo sapiens
caaguuguuuauguauca

SEQ ID NO: 532311 - RNA, 20 nt, Homo sapiens
caaguuuaaaagccauguau

SEQ ID NO: 532312 - RNA, 16 nt, Homo sapiens
caaguuucaucaguca

SEQ ID NO: 532313 - RNA, 11 nt, Homo sapiens
caaguuugcac

SEQ ID NO: 532314 - RNA, 16 nt, Homo sapiens
caaguuuuucugucaa

SEQ ID NO: 532315 - RNA, 22 nt, Homo sapiens
caauaaaaacaacuuucacuuc

SEQ ID NO: 532316 - RNA, 15 nt, Homo sapiens
caauaaaaacugucu

SEQ ID NO: 532317 - RNA, 15 nt, Homo sapiens
caauaaaaaguucag

SEQ ID NO: 532318 - RNA, 14 nt, Homo sapiens
caauaaaacacuuu

SEQ ID NO: 532319 - RNA, 23 nt, Homo sapiens
caauaaaacugauguuacuagcc

SEQ ID NO: 532320 - RNA, 17 nt, Homo sapiens
caauaaaagagcugucu

SEQ ID NO: 532321 - RNA, 19 nt, Homo sapiens
caauaaaagugacucucag

SEQ ID NO: 532322 - RNA, 19 nt, Homo sapiens
caauaaaaugucuucuccc

SEQ ID NO: 532323 - RNA, 20 nt, Homo sapiens
caauaaaaugucuucuccca

SEQ ID NO: 532324 - RNA, 14 nt, Homo sapiens
caauaaaccuuccu

SEQ ID NO: 532325 - RNA, 19 nt, Homo sapiens
caauaaacuccuacuaaau

SEQ ID NO: 532326 - RNA, 21 nt, Homo sapiens
caauaaacuccuacuaaaucc

SEQ ID NO: 532327 - RNA, 22 nt, Homo sapiens
caauaaacuccuacuaaauccc

SEQ ID NO: 532328 - RNA, 20 nt, Homo sapiens
caauaaagaugcccacugag

SEQ ID NO: 532329 - RNA, 13 nt, Homo sapiens
caauaaagcaaug

SEQ ID NO: 532330 - RNA, 14 nt, Homo sapiens
caauaaagcaaugu

SEQ ID NO: 532331 - RNA, 17 nt, Homo sapiens
caauaaagcaauguggu

SEQ ID NO: 532332 - RNA, 18 nt, Homo sapiens
caauaaagcacugagcaa

SEQ ID NO: 532333 - RNA, 20 nt, Homo sapiens
caauaaagggagaauggugc

SEQ ID NO: 532334 - RNA, 16 nt, Homo sapiens
caauaaaguuugccca

SEQ ID NO: 532335 - RNA, 17 nt, Homo sapiens
caauaaauaaucuguac

SEQ ID NO: 532336 - RNA, 16 nt, Homo sapiens
caauaaaucuuuggaa

SEQ ID NO: 532337 - RNA, 15 nt, Homo sapiens
caauaaauuuugcca

SEQ ID NO: 532338 - RNA, 20 nt, Homo sapiens
caauaaauuuuuauuacuua

SEQ ID NO: 532339 - RNA, 18 nt, Homo sapiens
caauaacaaagcacauaa

SEQ ID NO: 532340 - RNA, 18 nt, Homo sapiens
caauaacuacuguguucc

SEQ ID NO: 532341 - RNA, 14 nt, Homo sapiens
caauaacuuuucac

SEQ ID NO: 532342 - RNA, 23 nt, Homo sapiens
caauaaugucuuuuaaagccaga

SEQ ID NO: 532343 - RNA, 13 nt, Homo sapiens
caauacagaucau

SEQ ID NO: 532344 - RNA, 19 nt, Homo sapiens
caauacagaugccuucccu

SEQ ID NO: 532345 - RNA, 13 nt, Homo sapiens
caauacagucaca

SEQ ID NO: 532346 - RNA, 16 nt, Homo sapiens
caauacaugcugcuaa

SEQ ID NO: 532347 - RNA, 21 nt, Homo sapiens
caauacaugcugcuaauucaa

SEQ ID NO: 532348 - RNA, 15 nt, Homo sapiens
caauaccaaauagcu

SEQ ID NO: 532349 - RNA, 16 nt, Homo sapiens
caauacccuacugugg

SEQ ID NO: 532350 - RNA, 13 nt, Homo sapiens
caauaccuaauaa

SEQ ID NO: 532351 - RNA, 19 nt, Homo sapiens
caauacucuugaaauguag

SEQ ID NO: 532352 - RNA, 21 nt, Homo sapiens
caauagaaggauguacauuuc

SEQ ID NO: 532353 - RNA, 14 nt, Homo sapiens
caauagagacugua

SEQ ID NO: 532354 - RNA, 14 nt, Homo sapiens
caauagauauuuac

SEQ ID NO: 532355 - RNA, 14 nt, Homo sapiens
caauagcaccccua

SEQ ID NO: 532356 - RNA, 16 nt, Homo sapiens
caauauacaagcuuuu

SEQ ID NO: 532357 - RNA, 17 nt, Homo sapiens
caauauacgaaaagcca

SEQ ID NO: 532358 - RNA, 13 nt, Homo sapiens
caauaucuugcca

SEQ ID NO: 532359 - RNA, 21 nt, Homo sapiens
caauaugaaaacgaaguuaaa

SEQ ID NO: 532360 - RNA, 12 nt, Homo sapiens
caauaugaagua

SEQ ID NO: 532361 - RNA, 17 nt, Homo sapiens
caauaugacucagagaa

SEQ ID NO: 532362 - RNA, 18 nt, Homo sapiens
caauaugcaagcagcuuu

SEQ ID NO: 532363 - RNA, 16 nt, Homo sapiens
caauauuaaguccaaa

SEQ ID NO: 532364 - RNA, 23 nt, Homo sapiens
caauauuguaauccuagcacuuu

SEQ ID NO: 532365 - RNA, 16 nt, Homo sapiens
caauauuguacaguuu

SEQ ID NO: 532366 - RNA, 16 nt, Homo sapiens
caauauuuacucauca

SEQ ID NO: 532367 - RNA, 16 nt, Homo sapiens
caauauuucugauaua

SEQ ID NO: 532368 - RNA, 22 nt, Homo sapiens
caauauuuuccuucucucucaa

SEQ ID NO: 532369 - RNA, 22 nt, Homo sapiens
agcaucgggagcacccagagca

SEQ ID NO: 532370 - RNA, 17 nt, Homo sapiens
agcaucucuucuucccu

SEQ ID NO: 532371 - RNA, 23 nt, Homo sapiens
agcaucucuucuucccugucagc

SEQ ID NO: 532372 - RNA, 13 nt, Homo sapiens
agcaucugacuca

SEQ ID NO: 532373 - RNA, 18 nt, Homo sapiens
agcaucugcaacaaaaag

SEQ ID NO: 532374 - RNA, 17 nt, Homo sapiens
agcaucuguuuaccugg

SEQ ID NO: 532375 - RNA, 17 nt, Homo sapiens
agcaucuuauacgagua

SEQ ID NO: 532376 - RNA, 20 nt, Homo sapiens
agcaugaaaguggacaagga

SEQ ID NO: 532377 - RNA, 21 nt, Homo sapiens
agcaugaaauguccucuugaa

SEQ ID NO: 532378 - RNA, 14 nt, Homo sapiens
agcaugacugugca

SEQ ID NO: 532379 - RNA, 13 nt, Homo sapiens
agcaugagacuuu

SEQ ID NO: 532380 - RNA, 14 nt, Homo sapiens
agcaugagacuuuc

SEQ ID NO: 532381 - RNA, 22 nt, Homo sapiens
agcaugaucaguguaugcgaaa

SEQ ID NO: 532382 - RNA, 15 nt, Homo sapiens
agcaugaugagaguu

SEQ ID NO: 532383 - RNA, 19 nt, Homo sapiens
agcaugaugggaauaggga

SEQ ID NO: 532384 - RNA, 20 nt, Homo sapiens
agcaugcaagcuuggucaaa

SEQ ID NO: 532385 - RNA, 20 nt, Homo sapiens
agcaugcauccuuugcacug

SEQ ID NO: 532386 - RNA, 15 nt, Homo sapiens
agcaugccugaacua

SEQ ID NO: 532387 - RNA, 23 nt, Homo sapiens
agcaugcucaguuggugcugcuu

SEQ ID NO: 532388 - RNA, 14 nt, Homo sapiens
agcauggaacacuu

SEQ ID NO: 532389 - RNA, 15 nt, Homo sapiens
agcauggacauuuag

SEQ ID NO: 532390 - RNA, 16 nt, Homo sapiens
agcauggagcauggga

SEQ ID NO: 532391 - RNA, 21 nt, Homo sapiens
agcauggccccaguccaugcu

SEQ ID NO: 532392 - RNA, 17 nt, Homo sapiens
agcaugggauuauuaga

SEQ ID NO: 532393 - RNA, 16 nt, Homo sapiens
agcauggggucagccc

SEQ ID NO: 532394 - RNA, 22 nt, Homo sapiens
agcauggguccuugaugccaga

SEQ ID NO: 532395 - RNA, 19 nt, Homo sapiens
agcauguguauuaaugucu

SEQ ID NO: 532396 - RNA, 13 nt, Homo sapiens
agcaugugucaga

SEQ ID NO: 532397 - RNA, 14 nt, Homo sapiens
agcaugugugcaaa

SEQ ID NO: 532398 - RNA, 22 nt, Homo sapiens
agcauguguuaaucuuaaugua

SEQ ID NO: 532399 - RNA, 15 nt, Homo sapiens
agcauuacccuccuc

SEQ ID NO: 532400 - RNA, 18 nt, Homo sapiens
agcauuagucacuuugaa

SEQ ID NO: 532401 - RNA, 16 nt, Homo sapiens
agcauucaauuuauuc

SEQ ID NO: 532402 - RNA, 14 nt, Homo sapiens
agcauucagaaagu

SEQ ID NO: 532403 - RNA, 18 nt, Homo sapiens
agcauucaggcacugcca

SEQ ID NO: 532404 - RNA, 18 nt, Homo sapiens
agcauucuugucacaaua

SEQ ID NO: 532405 - RNA, 19 nt, Homo sapiens
agcauucuugucacaauaa

SEQ ID NO: 532406 - RNA, 16 nt, Homo sapiens
agcauugagaucucca

SEQ ID NO: 532407 - RNA, 12 nt, Homo sapiens
agcauugcacuu

SEQ ID NO: 532408 - RNA, 13 nt, Homo sapiens
agcauugcacuug

SEQ ID NO: 532409 - RNA, 15 nt, Homo sapiens
agcauugcaguaugg

SEQ ID NO: 532410 - RNA, 17 nt, Homo sapiens
agcauuggccucugugu

SEQ ID NO: 532411 - RNA, 21 nt, Homo sapiens
agcauuguaaaauuauuucau

SEQ ID NO: 532412 - RNA, 22 nt, Homo sapiens
agcauuuacagaaacgcaucca

SEQ ID NO: 532413 - RNA, 24 nt, Homo sapiens
agcauuuccagagcagagccuaca

SEQ ID NO: 532414 - RNA, 13 nt, Homo sapiens
agcauuucuugau

SEQ ID NO: 532415 - RNA, 19 nt, Homo sapiens
agcauuugauuaacauuug

SEQ ID NO: 532416 - RNA, 15 nt, Homo sapiens
agcauuuucaaugau

SEQ ID NO: 532417 - RNA, 12 nt, Homo sapiens
agcauuuuggaa

SEQ ID NO: 532418 - RNA, 15 nt, Homo sapiens
agccaaacucugcca

SEQ ID NO: 532419 - RNA, 21 nt, Homo sapiens
agccaaacugucuuugucacc

SEQ ID NO: 532420 - RNA, 13 nt, Homo sapiens
agccaaagagccu

SEQ ID NO: 532421 - RNA, 12 nt, Homo sapiens
agccaaagggac

SEQ ID NO: 532422 - RNA, 15 nt, Homo sapiens
agccaaaugcauggu

SEQ ID NO: 532423 - RNA, 15 nt, Homo sapiens
agccaaauucauccu

SEQ ID NO: 532424 - RNA, 20 nt, Homo sapiens
agccaaauuuaaaacuguug

SEQ ID NO: 532425 - RNA, 22 nt, Homo sapiens
agccaacgagacacauugccuu

SEQ ID NO: 532426 - RNA, 23 nt, Homo sapiens
agccaacuuuugcauguuuugua

SEQ ID NO: 532427 - RNA, 16 nt, Homo sapiens
agccaagaaacacugc

SEQ ID NO: 532428 - RNA, 21 nt, Homo sapiens
agccaagaucgccccacugca

SEQ ID NO: 532429 - RNA, 21 nt, Homo sapiens
agccaagcaaaccaaugguga

SEQ ID NO: 532430 - RNA, 23 nt, Homo sapiens
agccaaggagggagggucuuccu

SEQ ID NO: 532431 - RNA, 13 nt, Homo sapiens
agccaaggaguca

SEQ ID NO: 532432 - RNA, 19 nt, Homo sapiens
agccaaggagucacugaga

SEQ ID NO: 532433 - RNA, 13 nt, Homo sapiens
agccaagggcuga

SEQ ID NO: 532434 - RNA, 21 nt, Homo sapiens
agccaaggucaugccacugca

SEQ ID NO: 532435 - RNA, 13 nt, Homo sapiens
agccaagugcccu

SEQ ID NO: 532436 - RNA, 17 nt, Homo sapiens
agccaaguggggugcug

SEQ ID NO: 532437 - RNA, 22 nt, Homo sapiens
agccaaguuauauugaauauau

SEQ ID NO: 532438 - RNA, 22 nt, Homo sapiens
agccaauagaguugggacaauu

SEQ ID NO: 532439 - RNA, 19 nt, Homo sapiens
agccaauauuuacucauca

SEQ ID NO: 532440 - RNA, 15 nt, Homo sapiens
agccaauuagcucua

SEQ ID NO: 532441 - RNA, 18 nt, Homo sapiens
agccaauucagacaggca

SEQ ID NO: 532442 - RNA, 15 nt, Homo sapiens
agccacaaagaccca

SEQ ID NO: 532443 - RNA, 16 nt, Homo sapiens
agccacaaccaaaaaa

SEQ ID NO: 532444 - RNA, 17 nt, Homo sapiens
agccacaagcugcacug

SEQ ID NO: 532445 - RNA, 12 nt, Homo sapiens
agccacacuggg

SEQ ID NO: 532446 - RNA, 15 nt, Homo sapiens
agccacacuguggga

SEQ ID NO: 532447 - RNA, 23 nt, Homo sapiens
agccacagcugugcaugcucagc

SEQ ID NO: 532448 - RNA, 15 nt, Homo sapiens
agccaccaagaggga

SEQ ID NO: 532449 - RNA, 21 nt, Homo sapiens
agccaccacauuuagaacuuu

SEQ ID NO: 532450 - RNA, 19 nt, Homo sapiens
agccaccacccacaaucac

SEQ ID NO: 532451 - RNA, 13 nt, Homo sapiens
agccaccagugga

SEQ ID NO: 532452 - RNA, 14 nt, Homo sapiens
agccaccaguucuc

SEQ ID NO: 532453 - RNA, 19 nt, Homo sapiens
agccacccguggggugcug

SEQ ID NO: 532454 - RNA, 22 nt, Homo sapiens
agccacccugaguugcuuuuca

SEQ ID NO: 532455 - RNA, 13 nt, Homo sapiens
agccaccgugccc

SEQ ID NO: 532456 - RNA, 14 nt, Homo sapiens
agccaccucaccaa

SEQ ID NO: 532457 - RNA, 18 nt, Homo sapiens
agccaccuggcagggcuc

SEQ ID NO: 532458 - RNA, 21 nt, Homo sapiens
agccaccuggcagggcucaca

SEQ ID NO: 532459 - RNA, 14 nt, Homo sapiens
agccaccuugccac

SEQ ID NO: 532460 - RNA, 17 nt, Homo sapiens
agccacgaggugcaaca

SEQ ID NO: 532461 - RNA, 16 nt, Homo sapiens
agccacgaguuuggau

SEQ ID NO: 532462 - RNA, 19 nt, Homo sapiens
agccacucagucucuucca

SEQ ID NO: 532463 - RNA, 13 nt, Homo sapiens
agccacugugcuu

SEQ ID NO: 532464 - RNA, 16 nt, Homo sapiens
agccacuugacuggca

SEQ ID NO: 532465 - RNA, 17 nt, Homo sapiens
agccacuugacuggcac

SEQ ID NO: 532466 - RNA, 22 nt, Homo sapiens
agccacuugccugugcuacaau

SEQ ID NO: 532467 - RNA, 22 nt, Homo sapiens
caauucuaucuuuuguuuccuu

SEQ ID NO: 532468 - RNA, 20 nt, Homo sapiens
caauucuauuacgugcaaua

SEQ ID NO: 532469 - RNA, 21 nt, Homo sapiens
caauucugauguuacugagau

SEQ ID NO: 532470 - RNA, 18 nt, Homo sapiens
caauucuggacagacaga

SEQ ID NO: 532471 - RNA, 23 nt, Homo sapiens
caauucugugacauacauauuau

SEQ ID NO: 532472 - RNA, 13 nt, Homo sapiens
caauucuuagaau

SEQ ID NO: 532473 - RNA, 16 nt, Homo sapiens
caauucuuagaauauc

SEQ ID NO: 532474 - RNA, 18 nt, Homo sapiens
caauugacauaggcaaua

SEQ ID NO: 532475 - RNA, 21 nt, Homo sapiens
caauugauguuuuacgugcaa

SEQ ID NO: 532476 - RNA, 16 nt, Homo sapiens
caauugcaacagaagc

SEQ ID NO: 532477 - RNA, 15 nt, Homo sapiens
caauugcacugcugu

SEQ ID NO: 532478 - RNA, 18 nt, Homo sapiens
caauugcuuuaacaguca

SEQ ID NO: 532479 - RNA, 16 nt, Homo sapiens
caauuggcacuaaaga

SEQ ID NO: 532480 - RNA, 15 nt, Homo sapiens
caauuguaacgacuu

SEQ ID NO: 532481 - RNA, 22 nt, Homo sapiens
caauugucaccgguuaacugug

SEQ ID NO: 532482 - RNA, 12 nt, Homo sapiens
caauugucugcc

SEQ ID NO: 532483 - RNA, 18 nt, Homo sapiens
caauugucuuaaaaccag

SEQ ID NO: 532484 - RNA, 22 nt, Homo sapiens
caauuguugacaguucugaaga

SEQ ID NO: 532485 - RNA, 18 nt, Homo sapiens
caauuuaaggaacacaga

SEQ ID NO: 532486 - RNA, 13 nt, Homo sapiens
caauuuagacaaa

SEQ ID NO: 532487 - RNA, 22 nt, Homo sapiens
caauuucaccaccaaaugccaa

SEQ ID NO: 532488 - RNA, 21 nt, Homo sapiens
caauuucccuucauacuccuu

SEQ ID NO: 532489 - RNA, 14 nt, Homo sapiens
caauuucuaccuuu

SEQ ID NO: 532490 - RNA, 17 nt, Homo sapiens
caauuucuugguauuau

SEQ ID NO: 532491 - RNA, 17 nt, Homo sapiens
caauuuuaaacauaucc

SEQ ID NO: 532492 - RNA, 17 nt, Homo sapiens
caauuuuaaaucugaga

SEQ ID NO: 532493 - RNA, 22 nt, Homo sapiens
caauuuuaccuaguuugcacua

SEQ ID NO: 532494 - RNA, 12 nt, Homo sapiens
caauuuuuccau

SEQ ID NO: 532495 - RNA, 14 nt, Homo sapiens
caauuuuugaacaa

SEQ ID NO: 532496 - RNA, 17 nt, Homo sapiens
caauuuuugguugaaua

SEQ ID NO: 532497 - RNA, 23 nt, Homo sapiens
cacaaaaaaugaggaauagcaaa

SEQ ID NO: 532498 - RNA, 19 nt, Homo sapiens
cacaaaaagugucucugcc

SEQ ID NO: 532499 - RNA, 18 nt, Homo sapiens
cacaaaacaacaaaaacc

SEQ ID NO: 532500 - RNA, 18 nt, Homo sapiens
cacaaaauaaccaauccu

SEQ ID NO: 532501 - RNA, 13 nt, Homo sapiens
cacaaaaucacac

SEQ ID NO: 532502 - RNA, 16 nt, Homo sapiens
cacaaaaucuguccaa

SEQ ID NO: 532503 - RNA, 14 nt, Homo sapiens
cacaaaauucuuau

SEQ ID NO: 532504 - RNA, 16 nt, Homo sapiens
cacaaaccaagccaug

SEQ ID NO: 532505 - RNA, 17 nt, Homo sapiens
cacaaacccccacucca

SEQ ID NO: 532506 - RNA, 18 nt, Homo sapiens
cacaaacccugcugaaca

SEQ ID NO: 532507 - RNA, 20 nt, Homo sapiens
cacaaacugcagcugugagu

SEQ ID NO: 532508 - RNA, 16 nt, Homo sapiens
cacaaaguccacuuua

SEQ ID NO: 532509 - RNA, 22 nt, Homo sapiens
cacaaagugaggggaacagggu

SEQ ID NO: 532510 - RNA, 15 nt, Homo sapiens
cacaaauaaaagcca

SEQ ID NO: 532511 - RNA, 19 nt, Homo sapiens
cacaaaugaagggauauaa

SEQ ID NO: 532512 - RNA, 15 nt, Homo sapiens
cacaaaugaccgcac

SEQ ID NO: 532513 - RNA, 15 nt, Homo sapiens
cacaaaugucuaguu

SEQ ID NO: 532514 - RNA, 18 nt, Homo sapiens
cacaaauuuguaaacuuu

SEQ ID NO: 532515 - RNA, 23 nt, Homo sapiens
cacaacaaaagcuuuugauaaau

SEQ ID NO: 532516 - RNA, 11 nt, Homo sapiens
cacaacaaucc

SEQ ID NO: 532517 - RNA, 15 nt, Homo sapiens
cacaacacacacacu

SEQ ID NO: 532518 - RNA, 13 nt, Homo sapiens
cacaacacagaua

SEQ ID NO: 532519 - RNA, 14 nt, Homo sapiens
cacaacagugcccu

SEQ ID NO: 532520 - RNA, 16 nt, Homo sapiens
cacaacccuguuuuau

SEQ ID NO: 532521 - RNA, 18 nt, Homo sapiens
cacaaccggucccuucca

SEQ ID NO: 532522 - RNA, 16 nt, Homo sapiens
cacaaccucaccaaac

SEQ ID NO: 532523 - RNA, 22 nt, Homo sapiens
cacaacucccuuaaggucucca

SEQ ID NO: 532524 - RNA, 22 nt, Homo sapiens
cacaagaaaucaaaauccaaaa

SEQ ID NO: 532525 - RNA, 15 nt, Homo sapiens
cacaagagugaauuu

SEQ ID NO: 532526 - RNA, 19 nt, Homo sapiens
cacaagaugcugcaaugug

SEQ ID NO: 532527 - RNA, 17 nt, Homo sapiens
cacaagcaaaaucugga

SEQ ID NO: 532528 - RNA, 20 nt, Homo sapiens
cacaagcaacagacucucac

SEQ ID NO: 532529 - RNA, 23 nt, Homo sapiens
cacaagccuccuguaccucagug

SEQ ID NO: 532530 - RNA, 22 nt, Homo sapiens
cacaagcgaaucucugccuuuc

SEQ ID NO: 532531 - RNA, 12 nt, Homo sapiens
cacaagcucaga

SEQ ID NO: 532532 - RNA, 14 nt, Homo sapiens
cacaaggaaggcau

SEQ ID NO: 532533 - RNA, 22 nt, Homo sapiens
cacaaggcagccugaacacuca

SEQ ID NO: 532534 - RNA, 15 nt, Homo sapiens
cacaaggccuugccu

SEQ ID NO: 532535 - RNA, 14 nt, Homo sapiens
cacaagucuuccag

SEQ ID NO: 532536 - RNA, 18 nt, Homo sapiens
cacaaguuacacugccau

SEQ ID NO: 532537 - RNA, 20 nt, Homo sapiens
cacaauagcaguugaaacaa

SEQ ID NO: 532538 - RNA, 21 nt, Homo sapiens
cacaauagccgauaucagaau

SEQ ID NO: 532539 - RNA, 22 nt, Homo sapiens
cacaauaggucuuucucucagu

SEQ ID NO: 532540 - RNA, 19 nt, Homo sapiens
cacaauauacgaaaagcca

SEQ ID NO: 532541 - RNA, 15 nt, Homo sapiens
cacaaugagaugcau

SEQ ID NO: 532542 - RNA, 14 nt, Homo sapiens
cacaaugcugaaua

SEQ ID NO: 532543 - RNA, 18 nt, Homo sapiens
cacaauggcaccucugcc

SEQ ID NO: 532544 - RNA, 16 nt, Homo sapiens
cacaauguuucuucau

SEQ ID NO: 532545 - RNA, 20 nt, Homo sapiens
cacaauuuuaauucaaaaga

SEQ ID NO: 532546 - RNA, 23 nt, Homo sapiens
cacacaaccaugacgcacugcuc

SEQ ID NO: 532547 - RNA, 14 nt, Homo sapiens
cacacacacaugcu

SEQ ID NO: 532548 - RNA, 12 nt, Homo sapiens
cacacacaggcc

SEQ ID NO: 532549 - RNA, 21 nt, Homo sapiens
cacacacauauauuauuugca

SEQ ID NO: 532550 - RNA, 15 nt, Homo sapiens
cacacacaugcuagg

SEQ ID NO: 532551 - RNA, 12 nt, Homo sapiens
cacacaccacca

SEQ ID NO: 532552 - RNA, 23 nt, Homo sapiens
cacacaccaccaugcucaacuaa

SEQ ID NO: 532553 - RNA, 19 nt, Homo sapiens
cacacacgaugcauuuaau

SEQ ID NO: 532554 - RNA, 11 nt, Homo sapiens
cacacacugug

SEQ ID NO: 532555 - RNA, 20 nt, Homo sapiens
cacacagauuugagcucagc

SEQ ID NO: 532556 - RNA, 19 nt, Homo sapiens
cacacaggagaagcucgga

SEQ ID NO: 532557 - RNA, 16 nt, Homo sapiens
cacacaggguggcaga

SEQ ID NO: 532558 - RNA, 15 nt, Homo sapiens
cacacaggucucauu

SEQ ID NO: 532559 - RNA, 11 nt, Homo sapiens
cacacagugaa

SEQ ID NO: 532560 - RNA, 12 nt, Homo sapiens
cacacagugaaa

SEQ ID NO: 532561 - RNA, 21 nt, Homo sapiens
cacacagugaaacgcaauuuu

SEQ ID NO: 532562 - RNA, 12 nt, Homo sapiens
cacacauacaga

SEQ ID NO: 532563 - RNA, 16 nt, Homo sapiens
cacacaucaccaggug

SEQ ID NO: 532564 - RNA, 20 nt, Homo sapiens
cacacaucaguaauguauuc

SEQ ID NO: 532565 - RNA, 18 nt, Homo sapiens
cacacauuauuaccccac

SEQ ID NO: 532566 - RNA, 19 nt, Homo sapiens
cacaccaacagugugaagu

SEQ ID NO: 532567 - RNA, 15 nt, Homo sapiens
cacacccacugcccc

SEQ ID NO: 532568 - RNA, 15 nt, Homo sapiens
cacacccaugcacac

SEQ ID NO: 532569 - RNA, 18 nt, Homo sapiens
cacaccccuaaguacaag

SEQ ID NO: 532570 - RNA, 20 nt, Homo sapiens
cacaccucacgcucuggaca

SEQ ID NO: 532571 - RNA, 13 nt, Homo sapiens
cacaccugcccua

SEQ ID NO: 532572 - RNA, 15 nt, Homo sapiens
cacaccugcucucuc

SEQ ID NO: 532573 - RNA, 21 nt, Homo sapiens
cacaccuggcccuugcaaucu

SEQ ID NO: 532574 - RNA, 13 nt, Homo sapiens
cacaccuguaauc

SEQ ID NO: 532575 - RNA, 23 nt, Homo sapiens
cacacgaggucacguguggaauu

SEQ ID NO: 532576 - RNA, 14 nt, Homo sapiens
cacacgaugcauuu

SEQ ID NO: 532577 - RNA, 13 nt, Homo sapiens
cacacgcauuaau

SEQ ID NO: 532578 - RNA, 15 nt, Homo sapiens
cacacgccagcuccu

SEQ ID NO: 532579 - RNA, 20 nt, Homo sapiens
cacacuaguuuaugcuaccu

SEQ ID NO: 532580 - RNA, 20 nt, Homo sapiens
cacacuauucucugccuuuu

SEQ ID NO: 532581 - RNA, 18 nt, Homo sapiens
cacacucaaggacaggag

SEQ ID NO: 532582 - RNA, 19 nt, Homo sapiens
cacacucuccaaacaguca

SEQ ID NO: 532583 - RNA, 16 nt, Homo sapiens
cacacugaaaccaaaa

SEQ ID NO: 532584 - RNA, 23 nt, Homo sapiens
cacacugguaaauguuaccucua

SEQ ID NO: 532585 - RNA, 18 nt, Homo sapiens
cacacugugauuuugccc

SEQ ID NO: 532586 - RNA, 14 nt, Homo sapiens
cacacuuccugucc

SEQ ID NO: 532587 - RNA, 21 nt, Homo sapiens
cacacuucggcucucuggaca

SEQ ID NO: 532588 - RNA, 20 nt, Homo sapiens
cacacuuggaugcaggguuu

SEQ ID NO: 532589 - RNA, 17 nt, Homo sapiens
cacacuuuacacaagaa

SEQ ID NO: 532590 - RNA, 18 nt, Homo sapiens
agccagaauucacuagga

SEQ ID NO: 532591 - RNA, 23 nt, Homo sapiens
agccagagcugugccugcucagc

SEQ ID NO: 532592 - RNA, 19 nt, Homo sapiens
agccagagcuugaauucau

SEQ ID NO: 532593 - RNA, 19 nt, Homo sapiens
agccagaggguagggcaca

SEQ ID NO: 532594 - RNA, 13 nt, Homo sapiens
agccagauucaaa

SEQ ID NO: 532595 - RNA, 22 nt, Homo sapiens
agccagcaagagggaacaaaac

SEQ ID NO: 532596 - RNA, 15 nt, Homo sapiens
agccagcagccagcu

SEQ ID NO: 532597 - RNA, 20 nt, Homo sapiens
agccagcaggagcucugacu

SEQ ID NO: 532598 - RNA, 16 nt, Homo sapiens
agccagccaagcuuua

SEQ ID NO: 532599 - RNA, 17 nt, Homo sapiens
agccagcugcuuuuugu

SEQ ID NO: 532600 - RNA, 15 nt, Homo sapiens
agccagcuuaaaccc

SEQ ID NO: 532601 - RNA, 23 nt, Homo sapiens
agccagcuuggggccaccaaagc

SEQ ID NO: 532602 - RNA, 16 nt, Homo sapiens
agccagcuuugcucag

SEQ ID NO: 532603 - RNA, 18 nt, Homo sapiens
agccaggaaguacuucca

SEQ ID NO: 532604 - RNA, 13 nt, Homo sapiens
agccaggacaucu

SEQ ID NO: 532605 - RNA, 14 nt, Homo sapiens
agccaggacaucuc

SEQ ID NO: 532606 - RNA, 15 nt, Homo sapiens
agccaggacaucucu

SEQ ID NO: 532607 - RNA, 18 nt, Homo sapiens
agccaggacaucucugcc

SEQ ID NO: 532608 - RNA, 19 nt, Homo sapiens
agccaggagaagcucagcu

SEQ ID NO: 532609 - RNA, 21 nt, Homo sapiens
agccaggagggaccugcaucu

SEQ ID NO: 532610 - RNA, 22 nt, Homo sapiens
agccaggccugaccucaagcaa

SEQ ID NO: 532611 - RNA, 22 nt, Homo sapiens
agccaggccugggggcagccuc

SEQ ID NO: 532612 - RNA, 22 nt, Homo sapiens
agccagggggaugccacuccuc

SEQ ID NO: 532613 - RNA, 19 nt, Homo sapiens
cagccaucguccugggacu

SEQ ID NO: 532614 - RNA, 14 nt, Homo sapiens
cagccaugaaguca

SEQ ID NO: 532615 - RNA, 21 nt, Homo sapiens
cagccaugcauuguuaaucau

SEQ ID NO: 532616 - RNA, 18 nt, Homo sapiens
cagccauuaccauggaga

SEQ ID NO: 532617 - RNA, 20 nt, Homo sapiens
cagccauucuucaggucgua

SEQ ID NO: 532618 - RNA, 20 nt, Homo sapiens
cagccauuguggaagacagu

SEQ ID NO: 532619 - RNA, 21 nt, Homo sapiens
cagcccagagacuuuguagau

SEQ ID NO: 532620 - RNA, 14 nt, Homo sapiens
cagcccaucucaac

SEQ ID NO: 532621 - RNA, 18 nt, Homo sapiens
cagcccauggcccccaau

SEQ ID NO: 532622 - RNA, 16 nt, Homo sapiens
cagcccauugcugcca

SEQ ID NO: 532623 - RNA, 21 nt, Homo sapiens
cagccccaaacacccacccaa

SEQ ID NO: 532624 - RNA, 20 nt, Homo sapiens
cagccccaccuuggcugcug

SEQ ID NO: 532625 - RNA, 17 nt, Homo sapiens
cagccccagcaccucau

SEQ ID NO: 532626 - RNA, 17 nt, Homo sapiens
cagcccccaccucaggu

SEQ ID NO: 532627 - RNA, 16 nt, Homo sapiens
cagcccccacuccagu

SEQ ID NO: 532628 - RNA, 17 nt, Homo sapiens
cagcccccccacccacc

SEQ ID NO: 532629 - RNA, 19 nt, Homo sapiens
cagccccgcgaccaugugg

SEQ ID NO: 532630 - RNA, 12 nt, Homo sapiens
cagccccggggu

SEQ ID NO: 532631 - RNA, 16 nt, Homo sapiens
cagccccuccaaaggu

SEQ ID NO: 532632 - RNA, 16 nt, Homo sapiens
cagccccuccacguga

SEQ ID NO: 532633 - RNA, 19 nt, Homo sapiens
cagccccuuauuugcacuu

SEQ ID NO: 532634 - RNA, 20 nt, Homo sapiens
cagccccuuauuugcacuuc

SEQ ID NO: 532635 - RNA, 23 nt, Homo sapiens
cagcccuacaacaaccugaagca

SEQ ID NO: 532636 - RNA, 19 nt, Homo sapiens
cagcccuccuugacccaga

SEQ ID NO: 532637 - RNA, 19 nt, Homo sapiens
cagcccugaggugaaaggg

SEQ ID NO: 532638 - RNA, 17 nt, Homo sapiens
cagcccugccgggcaca

SEQ ID NO: 532639 - RNA, 18 nt, Homo sapiens
cagcccugucacgccggg

SEQ ID NO: 532640 - RNA, 19 nt, Homo sapiens
cagcccuugagucugucac

SEQ ID NO: 532641 - RNA, 22 nt, Homo sapiens
cagccguguguucaaauguaca

SEQ ID NO: 532642 - RNA, 23 nt, Homo sapiens
cagccucacuugaaugugucacu

SEQ ID NO: 532643 - RNA, 18 nt, Homo sapiens
cagccucagaauaaaaga

SEQ ID NO: 532644 - RNA, 19 nt, Homo sapiens
cagccucagugccacuuga

SEQ ID NO: 532645 - RNA, 13 nt, Homo sapiens
cagccucaucucu

SEQ ID NO: 532646 - RNA, 15 nt, Homo sapiens
cagccuccaccuccu

SEQ ID NO: 532647 - RNA, 19 nt, Homo sapiens
cagccuccaccuugcucuu

SEQ ID NO: 532648 - RNA, 18 nt, Homo sapiens
cagccuccaguuguagca

SEQ ID NO: 532649 - RNA, 18 nt, Homo sapiens
cagccuccccgugccaaa

SEQ ID NO: 532650 - RNA, 19 nt, Homo sapiens
cagccucccuaguagcugg

SEQ ID NO: 532651 - RNA, 13 nt, Homo sapiens
cagccucccucag

SEQ ID NO: 532652 - RNA, 20 nt, Homo sapiens
cagccuccugaguagcugga

SEQ ID NO: 532653 - RNA, 14 nt, Homo sapiens
cagccuccugcuaa

SEQ ID NO: 532654 - RNA, 21 nt, Homo sapiens
cagccucuaagcgugcugaca

SEQ ID NO: 532655 - RNA, 13 nt, Homo sapiens
cagccucuacagc

SEQ ID NO: 532656 - RNA, 12 nt, Homo sapiens
cagccucucugc

SEQ ID NO: 532657 - RNA, 13 nt, Homo sapiens
cagccucuucucu

SEQ ID NO: 532658 - RNA, 17 nt, Homo sapiens
cagccucuugacucuga

SEQ ID NO: 532659 - RNA, 21 nt, Homo sapiens
cagccugaccaacauggugaa

SEQ ID NO: 532660 - RNA, 14 nt, Homo sapiens
cagccugauggcca

SEQ ID NO: 532661 - RNA, 17 nt, Homo sapiens
cagccugcccaccucuc

SEQ ID NO: 532662 - RNA, 15 nt, Homo sapiens
cagccugcuccagcu

SEQ ID NO: 532663 - RNA, 17 nt, Homo sapiens
cagccugcucuaguggg

SEQ ID NO: 532664 - RNA, 18 nt, Homo sapiens
cagccuggaagagggcaa

SEQ ID NO: 532665 - RNA, 15 nt, Homo sapiens
cagccuggacauaga

SEQ ID NO: 532666 - RNA, 17 nt, Homo sapiens
cagccuggcaucugugc

SEQ ID NO: 532667 - RNA, 19 nt, Homo sapiens
cagccuggccaacauggca

SEQ ID NO: 532668 - RNA, 22 nt, Homo sapiens
cagccuggccaagagaccagcc

SEQ ID NO: 532669 - RNA, 19 nt, Homo sapiens
cagccugggcaacauacca

SEQ ID NO: 532670 - RNA, 19 nt, Homo sapiens
cagccugggcagcauagca

SEQ ID NO: 532671 - RNA, 15 nt, Homo sapiens
cagccuggggugacc

SEQ ID NO: 532672 - RNA, 16 nt, Homo sapiens
cagccugggugacaga

SEQ ID NO: 532673 - RNA, 14 nt, Homo sapiens
cagccugucccuga

SEQ ID NO: 532674 - RNA, 21 nt, Homo sapiens
cagccugugagggagugcaga

SEQ ID NO: 532675 - RNA, 19 nt, Homo sapiens
cagccuguuggacccgcuc

SEQ ID NO: 532676 - RNA, 15 nt, Homo sapiens
cagccuuagcucucc

SEQ ID NO: 532677 - RNA, 17 nt, Homo sapiens
cagccuucguguggcuc

SEQ ID NO: 532678 - RNA, 18 nt, Homo sapiens
cagccuugaucagugaca

SEQ ID NO: 532679 - RNA, 22 nt, Homo sapiens
cagccuugcaucaagggcuuua

SEQ ID NO: 532680 - RNA, 17 nt, Homo sapiens
cagccuuggaucaggac

SEQ ID NO: 532681 - RNA, 17 nt, Homo sapiens
cagcgaagacugcuaaa

SEQ ID NO: 532682 - RNA, 19 nt, Homo sapiens
cagcgaccuuccucaucca

SEQ ID NO: 532683 - RNA, 20 nt, Homo sapiens
cagcgcagcuggacucugca

SEQ ID NO: 532684 - RNA, 21 nt, Homo sapiens
cagcgccaggcugaccacagc

SEQ ID NO: 532685 - RNA, 14 nt, Homo sapiens
cagcgcggggagcc

SEQ ID NO: 532686 - RNA, 20 nt, Homo sapiens
cagcggauugcucuggagca

SEQ ID NO: 532687 - RNA, 15 nt, Homo sapiens
cagcggccucagggu

SEQ ID NO: 532688 - RNA, 18 nt, Homo sapiens
cagcgucaggccuaccuc

SEQ ID NO: 532689 - RNA, 23 nt, Homo sapiens
cagcgugcacaucugcugugguc

SEQ ID NO: 532690 - RNA, 13 nt, Homo sapiens
cagcuaaagcaau

SEQ ID NO: 532691 - RNA, 17 nt, Homo sapiens
cagcuaagacauauuca

SEQ ID NO: 532692 - RNA, 22 nt, Homo sapiens
cagcuaauaagaagugccaagu

SEQ ID NO: 532693 - RNA, 19 nt, Homo sapiens
cagcuaauucaggucauuu

SEQ ID NO: 532694 - RNA, 22 nt, Homo sapiens
cagcuacacaaggaaggcauuu

SEQ ID NO: 532695 - RNA, 13 nt, Homo sapiens
cagcuacauuccu

SEQ ID NO: 532696 - RNA, 15 nt, Homo sapiens
cagcuacauuccuca

SEQ ID NO: 532697 - RNA, 22 nt, Homo sapiens
cagcuacgaauauagaggguuu

SEQ ID NO: 532698 - RNA, 16 nt, Homo sapiens
cagcuacugaaccagc

SEQ ID NO: 532699 - RNA, 13 nt, Homo sapiens
cagcuacuggaau

SEQ ID NO: 532700 - RNA, 22 nt, Homo sapiens
cagcuacuucuccugcacuuug

SEQ ID NO: 532701 - RNA, 19 nt, Homo sapiens
cagcuagaaauaagcccaa

SEQ ID NO: 532702 - RNA, 17 nt, Homo sapiens
cagcuaggaugugcauu

SEQ ID NO: 532703 - RNA, 18 nt, Homo sapiens
cagcuaucugcacucuaa

SEQ ID NO: 532704 - RNA, 11 nt, Homo sapiens
cagcucagggg

SEQ ID NO: 532705 - RNA, 15 nt, Homo sapiens
cagcucaggggacac

SEQ ID NO: 532706 - RNA, 17 nt, Homo sapiens
cagcuccccaagaaagc

SEQ ID NO: 532707 - RNA, 14 nt, Homo sapiens
cagcuccuguaaca

SEQ ID NO: 532708 - RNA, 21 nt, Homo sapiens
cagcuccuguaacauacuggc

SEQ ID NO: 532709 - RNA, 14 nt, Homo sapiens
cagcuccuuucaug

SEQ ID NO: 532710 - RNA, 13 nt, Homo sapiens
cagcucuaagcag

SEQ ID NO: 532711 - RNA, 12 nt, Homo sapiens
cagcucugagau

SEQ ID NO: 532712 - RNA, 13 nt, Homo sapiens
cagcucugagauc

SEQ ID NO: 532713 - RNA, 21 nt, Homo sapiens
cagcucuggcuuccugcugag

SEQ ID NO: 532714 - RNA, 17 nt, Homo sapiens
cagcucugggagaggau

SEQ ID NO: 532715 - RNA, 19 nt, Homo sapiens
cagcucuguaguuucuuga

SEQ ID NO: 532716 - RNA, 16 nt, Homo sapiens
cagcugaugaacugug

SEQ ID NO: 532717 - RNA, 17 nt, Homo sapiens
cagcugcagcagcaguu

SEQ ID NO: 532718 - RNA, 14 nt, Homo sapiens
cagcugccagagaa

SEQ ID NO: 532719 - RNA, 22 nt, Homo sapiens
cagcugccuuuuaagaggucuu

SEQ ID NO: 532720 - RNA, 21 nt, Homo sapiens
cagcugcucaauaaaguacaa

SEQ ID NO: 532721 - RNA, 12 nt, Homo sapiens
cagcugcugaag

SEQ ID NO: 532722 - RNA, 15 nt, Homo sapiens
cagcugcugugcauu

SEQ ID NO: 532723 - RNA, 23 nt, Homo sapiens
cagcuggaagguacuaugccagu

SEQ ID NO: 532724 - RNA, 18 nt, Homo sapiens
cagcuggagguugagcuc

SEQ ID NO: 532725 - RNA, 17 nt, Homo sapiens
cagcuggcgaacccugg

SEQ ID NO: 532726 - RNA, 19 nt, Homo sapiens
cagcuggcuagcauuccuc

SEQ ID NO: 532727 - RNA, 13 nt, Homo sapiens
cagcugggagcac

SEQ ID NO: 532728 - RNA, 18 nt, Homo sapiens
cagcugggcucugcaauu

SEQ ID NO: 532729 - RNA, 21 nt, Homo sapiens
cagcuggucaaacaaacucuc

SEQ ID NO: 532730 - RNA, 20 nt, Homo sapiens
cagcugguccuccacuuugc

SEQ ID NO: 532731 - RNA, 18 nt, Homo sapiens
cagcugguucgugguuuu

SEQ ID NO: 532732 - RNA, 21 nt, Homo sapiens
cagcugguugcuccauuugag

SEQ ID NO: 532733 - RNA, 16 nt, Homo sapiens
cagcuguacauacuca

SEQ ID NO: 532734 - RNA, 19 nt, Homo sapiens
cagcuguacuagugccauu

SEQ ID NO: 532735 - RNA, 12 nt, Homo sapiens
caggcagacuac

SEQ ID NO: 532736 - RNA, 20 nt, Homo sapiens
caggcagaucccacuugcag

SEQ ID NO: 532737 - RNA, 16 nt, Homo sapiens
caggcagaucugugcc

SEQ ID NO: 532738 - RNA, 13 nt, Homo sapiens
caggcagccucaa

SEQ ID NO: 532739 - RNA, 12 nt, Homo sapiens
caggcaggccac

SEQ ID NO: 532740 - RNA, 17 nt, Homo sapiens
caggcauagaggcuucu

SEQ ID NO: 532741 - RNA, 16 nt, Homo sapiens
caggcaugagccacug

SEQ ID NO: 532742 - RNA, 22 nt, Homo sapiens
caggcaugugccacccacccaa

SEQ ID NO: 532743 - RNA, 13 nt, Homo sapiens
caggccaccugcc

SEQ ID NO: 532744 - RNA, 14 nt, Homo sapiens
caggccacugggga

SEQ ID NO: 532745 - RNA, 17 nt, Homo sapiens
caggccauacuuuacaa

SEQ ID NO: 532746 - RNA, 17 nt, Homo sapiens
caggccaugugagccac

SEQ ID NO: 532747 - RNA, 17 nt, Homo sapiens
caggccccgugaggcaa

SEQ ID NO: 532748 - RNA, 15 nt, Homo sapiens
caggcccgcgggcac

SEQ ID NO: 532749 - RNA, 17 nt, Homo sapiens
caggcccgcuaggucca

SEQ ID NO: 532750 - RNA, 19 nt, Homo sapiens
caggcccuacaaugcucau

SEQ ID NO: 532751 - RNA, 22 nt, Homo sapiens
caggcccuggccuccccugcca

SEQ ID NO: 532752 - RNA, 12 nt, Homo sapiens
caggcccugugg

SEQ ID NO: 532753 - RNA, 22 nt, Homo sapiens
caggccgcccugcgggugaaca

SEQ ID NO: 532754 - RNA, 18 nt, Homo sapiens
caggccgggguggagcau

SEQ ID NO: 532755 - RNA, 19 nt, Homo sapiens
caggccgugugucugucag

SEQ ID NO: 532756 - RNA, 20 nt, Homo sapiens
caggccuaucuggaagccac

SEQ ID NO: 532757 - RNA, 15 nt, Homo sapiens
caggccucagccuca

SEQ ID NO: 532758 - RNA, 16 nt, Homo sapiens
caggccucgggaccaa

SEQ ID NO: 532759 - RNA, 13 nt, Homo sapiens
caggccuguguga

SEQ ID NO: 532760 - RNA, 21 nt, Homo sapiens
caggccuuaauuuucaguaua

SEQ ID NO: 532761 - RNA, 20 nt, Homo sapiens
caggcgauccaccugucuca

SEQ ID NO: 532762 - RNA, 22 nt, Homo sapiens
caggcguuucugaagugcucuu

SEQ ID NO: 532763 - RNA, 17 nt, Homo sapiens
caggcuagagugcaaug

SEQ ID NO: 532764 - RNA, 19 nt, Homo sapiens
caggcuagagugcaauggu

SEQ ID NO: 532765 - RNA, 19 nt, Homo sapiens
caggcucagacucuggguc

SEQ ID NO: 532766 - RNA, 23 nt, Homo sapiens
caggcucuccgggccuuucucug

SEQ ID NO: 532767 - RNA, 13 nt, Homo sapiens
caggcucuucucc

SEQ ID NO: 532768 - RNA, 17 nt, Homo sapiens
caggcugaaauauccac

SEQ ID NO: 532769 - RNA, 18 nt, Homo sapiens
caggcugacuggcaggaa

SEQ ID NO: 532770 - RNA, 17 nt, Homo sapiens
caggcugcagaugauca

SEQ ID NO: 532771 - RNA, 20 nt, Homo sapiens
caggcuggaguacaguggca

SEQ ID NO: 532772 - RNA, 15 nt, Homo sapiens
caggcuggagugcaa

SEQ ID NO: 532773 - RNA, 17 nt, Homo sapiens
caggcuggagugcagug

SEQ ID NO: 532774 - RNA, 24 nt, Homo sapiens
caggcuggagugcagugaugcaau

SEQ ID NO: 532775 - RNA, 18 nt, Homo sapiens
caggcuggagugcagugc

SEQ ID NO: 532776 - RNA, 22 nt, Homo sapiens
caggcuggagugcaguggcaca

SEQ ID NO: 532777 - RNA, 17 nt, Homo sapiens
caggcugggccaugucc

SEQ ID NO: 532778 - RNA, 19 nt, Homo sapiens
caggcugggccauguccaa

SEQ ID NO: 532779 - RNA, 19 nt, Homo sapiens
caggcuguaagcauucuga

SEQ ID NO: 532780 - RNA, 22 nt, Homo sapiens
caggcuguaagcauucugagcu

SEQ ID NO: 532781 - RNA, 16 nt, Homo sapiens
caggcuguaaggcaug

SEQ ID NO: 532782 - RNA, 14 nt, Homo sapiens
caggcugugggccu

SEQ ID NO: 532783 - RNA, 22 nt, Homo sapiens
caggcuucugagcacagcugca

SEQ ID NO: 532784 - RNA, 22 nt, Homo sapiens
caggcuuuuccuccaaccugug

SEQ ID NO: 532785 - RNA, 12 nt, Homo sapiens
cagggaaacuca

SEQ ID NO: 532786 - RNA, 16 nt, Homo sapiens
cagggaagagggcagu

SEQ ID NO: 532787 - RNA, 13 nt, Homo sapiens
cagggaagccaaa

SEQ ID NO: 532788 - RNA, 23 nt, Homo sapiens
cagggaaguggggaaguguucca

SEQ ID NO: 532789 - RNA, 14 nt, Homo sapiens
cagggaaugcugag

SEQ ID NO: 532790 - RNA, 14 nt, Homo sapiens
cagggaauggagcu

SEQ ID NO: 532791 - RNA, 13 nt, Homo sapiens
cagggaauuucag

SEQ ID NO: 532792 - RNA, 19 nt, Homo sapiens
cagggacacuaucacucau

SEQ ID NO: 532793 - RNA, 21 nt, Homo sapiens
cagggacauggggcaagccag

SEQ ID NO: 532794 - RNA, 19 nt, Homo sapiens
cagggagaccgagcgcuuu

SEQ ID NO: 532795 - RNA, 19 nt, Homo sapiens
cagggagaggucaccagcu

SEQ ID NO: 532796 - RNA, 20 nt, Homo sapiens
cagggagaggucaccagcug

SEQ ID NO: 532797 - RNA, 23 nt, Homo sapiens
cagggagcaacucuccacuccau

SEQ ID NO: 532798 - RNA, 12 nt, Homo sapiens
cagggagcaccu

SEQ ID NO: 532799 - RNA, 22 nt, Homo sapiens
cagggagcucuggggacagcuu

SEQ ID NO: 532800 - RNA, 16 nt, Homo sapiens
cagggagggccaggga

SEQ ID NO: 532801 - RNA, 17 nt, Homo sapiens
cagggagggcuguggug

SEQ ID NO: 532802 - RNA, 14 nt, Homo sapiens
cagggaggguguuu

SEQ ID NO: 532803 - RNA, 18 nt, Homo sapiens
cagggagugaugauuugg

SEQ ID NO: 532804 - RNA, 13 nt, Homo sapiens
cagggaugccaac

SEQ ID NO: 532805 - RNA, 23 nt, Homo sapiens
cagggaugcugguggcuggugag

SEQ ID NO: 532806 - RNA, 18 nt, Homo sapiens
cagggauuaaccucugca

SEQ ID NO: 532807 - RNA, 19 nt, Homo sapiens
cagggcacgcaggaccagu

SEQ ID NO: 532808 - RNA, 20 nt, Homo sapiens
cagggcacggggaccuggau

SEQ ID NO: 532809 - RNA, 23 nt, Homo sapiens
cagggcacuacauaauugcuguu

SEQ ID NO: 532810 - RNA, 22 nt, Homo sapiens
cagggcauauuaguugaugaaa

SEQ ID NO: 532811 - RNA, 13 nt, Homo sapiens
cagggccaacuug

SEQ ID NO: 532812 - RNA, 22 nt, Homo sapiens
cagggccacucccggcacucca

SEQ ID NO: 532813 - RNA, 13 nt, Homo sapiens
cagggccaguccu

SEQ ID NO: 532814 - RNA, 17 nt, Homo sapiens
cagggcccccaucucau

SEQ ID NO: 532815 - RNA, 23 nt, Homo sapiens
cagggccccuggggaucuugccc

SEQ ID NO: 532816 - RNA, 14 nt, Homo sapiens
cagggccccuguga

SEQ ID NO: 532817 - RNA, 18 nt, Homo sapiens
cagggccccugugacccc

SEQ ID NO: 532818 - RNA, 20 nt, Homo sapiens
cagggcgagacuccgucuca

SEQ ID NO: 532819 - RNA, 22 nt, Homo sapiens
cagggcgccccugggagacaac

SEQ ID NO: 532820 - RNA, 18 nt, Homo sapiens
cagggcucagccuggugg

SEQ ID NO: 532821 - RNA, 17 nt, Homo sapiens
cagggcugcgucugcaa

SEQ ID NO: 532822 - RNA, 13 nt, Homo sapiens
cagggcugcuccc

SEQ ID NO: 532823 - RNA, 20 nt, Homo sapiens
cagggcuggcuccugaucca

SEQ ID NO: 532824 - RNA, 13 nt, Homo sapiens
cagggcugugauc

SEQ ID NO: 532825 - RNA, 13 nt, Homo sapiens
caggggacacugg

SEQ ID NO: 532826 - RNA, 17 nt, Homo sapiens
caggggaccacaccucc

SEQ ID NO: 532827 - RNA, 14 nt, Homo sapiens
caggggaggggugc

SEQ ID NO: 532828 - RNA, 18 nt, Homo sapiens
caggggccacacuaugcc

SEQ ID NO: 532829 - RNA, 17 nt, Homo sapiens
caggggcuccagcaccu

SEQ ID NO: 532830 - RNA, 16 nt, Homo sapiens
caggggcugcugugau

SEQ ID NO: 532831 - RNA, 23 nt, Homo sapiens
caggggggcugugccaaccuguu

SEQ ID NO: 532832 - RNA, 11 nt, Homo sapiens
caggggugacg

SEQ ID NO: 532833 - RNA, 21 nt, Homo sapiens
cagggguuugccaaacagccc

SEQ ID NO: 532834 - RNA, 21 nt, Homo sapiens
caggguacccuuuggggagca

SEQ ID NO: 532835 - RNA, 13 nt, Homo sapiens
caggguaccucaa

SEQ ID NO: 532836 - RNA, 18 nt, Homo sapiens
cagggucauguuugcagg

SEQ ID NO: 532837 - RNA, 15 nt, Homo sapiens
caggguccugugccu

SEQ ID NO: 532838 - RNA, 21 nt, Homo sapiens
cagggucugggcugggcaccu

SEQ ID NO: 532839 - RNA, 15 nt, Homo sapiens
cagggugcaguguga

SEQ ID NO: 532840 - RNA, 22 nt, Homo sapiens
caggguggaggaaggugacugu

SEQ ID NO: 532841 - RNA, 23 nt, Homo sapiens
caggguggcagaacuugaagggu

SEQ ID NO: 532842 - RNA, 19 nt, Homo sapiens
caggguggucuugaucucc

SEQ ID NO: 532843 - RNA, 21 nt, Homo sapiens
caggguuucaccauguugccc

SEQ ID NO: 532844 - RNA, 20 nt, Homo sapiens
caggguuucaccauguuggc

SEQ ID NO: 532845 - RNA, 13 nt, Homo sapiens
caggguuuuuaga

SEQ ID NO: 532846 - RNA, 19 nt, Homo sapiens
cagguaaagggcaaauaau

SEQ ID NO: 532847 - RNA, 20 nt, Homo sapiens
cagguaaaugguaugaucaa

SEQ ID NO: 532848 - RNA, 22 nt, Homo sapiens
cagguaaaugguaugaucaaua

SEQ ID NO: 532849 - RNA, 20 nt, Homo sapiens
cagguaauaaaagcuuugac

SEQ ID NO: 532850 - RNA, 12 nt, Homo sapiens
cagguaauacaa

SEQ ID NO: 532851 - RNA, 21 nt, Homo sapiens
cagguaccaucuuguauacac

SEQ ID NO: 532852 - RNA, 17 nt, Homo sapiens
cagguaccucuuucagg

SEQ ID NO: 532853 - RNA, 19 nt, Homo sapiens
cagguacuuccucagucug

SEQ ID NO: 532854 - RNA, 13 nt, Homo sapiens
cagguaguacugg

SEQ ID NO: 532855 - RNA, 20 nt, Homo sapiens
auaaacaaauaacaaugugc

SEQ ID NO: 532856 - RNA, 17 nt, Homo sapiens
auaaacaagcauuucaa

SEQ ID NO: 532857 - RNA, 13 nt, Homo sapiens
auaaacacacaaa

SEQ ID NO: 532858 - RNA, 18 nt, Homo sapiens
auaaacacccaugaauca

SEQ ID NO: 532859 - RNA, 18 nt, Homo sapiens
auaaacacuguauuguaa

SEQ ID NO: 532860 - RNA, 17 nt, Homo sapiens
auaaacagacaggcucu

SEQ ID NO: 532861 - RNA, 14 nt, Homo sapiens
auaaacagcuucau

SEQ ID NO: 532862 - RNA, 19 nt, Homo sapiens
auaaacagugagcauaucu

SEQ ID NO: 532863 - RNA, 22 nt, Homo sapiens
auaaacauccuucaagaacucu

SEQ ID NO: 532864 - RNA, 19 nt, Homo sapiens
auaaaccaaugagcuguau

SEQ ID NO: 532865 - RNA, 21 nt, Homo sapiens
auaaaccacccucuggggaca

SEQ ID NO: 532866 - RNA, 14 nt, Homo sapiens
auaaaccacugguc

SEQ ID NO: 532867 - RNA, 17 nt, Homo sapiens
auaaacccaguugccau

SEQ ID NO: 532868 - RNA, 17 nt, Homo sapiens
auaaaccugucaugugc

SEQ ID NO: 532869 - RNA, 23 nt, Homo sapiens
auaaacgaggaaaagguccuugc

SEQ ID NO: 532870 - RNA, 17 nt, Homo sapiens
auaaacguccuacugua

SEQ ID NO: 532871 - RNA, 15 nt, Homo sapiens
auaaacuccuacuaa

SEQ ID NO: 532872 - RNA, 19 nt, Homo sapiens
auaaacuguuguaugccug

SEQ ID NO: 532873 - RNA, 11 nt, Homo sapiens
auaaagacagg

SEQ ID NO: 532874 - RNA, 19 nt, Homo sapiens
auaaagacugugcugagaa

SEQ ID NO: 532875 - RNA, 12 nt, Homo sapiens
auaaagacuuuu

SEQ ID NO: 532876 - RNA, 15 nt, Homo sapiens
auaaagagaacucug

SEQ ID NO: 532877 - RNA, 15 nt, Homo sapiens
auaaagagagcccua

SEQ ID NO: 532878 - RNA, 18 nt, Homo sapiens
auaaagaucacacaucaa

SEQ ID NO: 532879 - RNA, 13 nt, Homo sapiens
auaaagauuuaua

SEQ ID NO: 532880 - RNA, 22 nt, Homo sapiens
auaaagcaucauuaaugcacau

SEQ ID NO: 532881 - RNA, 11 nt, Homo sapiens
auaaagcauuc

SEQ ID NO: 532882 - RNA, 16 nt, Homo sapiens
auaaagcauucuuuaa

SEQ ID NO: 532883 - RNA, 14 nt, Homo sapiens
auaaagccaaauuu

SEQ ID NO: 532884 - RNA, 19 nt, Homo sapiens
auaaagccuuuaaaaccag

SEQ ID NO: 532885 - RNA, 12 nt, Homo sapiens
auaaagccuuuu

SEQ ID NO: 532886 - RNA, 12 nt, Homo sapiens
auaaagcugucu

SEQ ID NO: 532887 - RNA, 17 nt, Homo sapiens
auaaagcuuuuccugca

SEQ ID NO: 532888 - RNA, 20 nt, Homo sapiens
auaaaggcauuucaaagucu

SEQ ID NO: 532889 - RNA, 21 nt, Homo sapiens
ccacaaaugggaaaaccagac

SEQ ID NO: 532890 - RNA, 23 nt, Homo sapiens
ccacaaaugguggguacaaaaag

SEQ ID NO: 532891 - RNA, 15 nt, Homo sapiens
ccacaacaacaaaag

SEQ ID NO: 532892 - RNA, 22 nt, Homo sapiens
ccacaacacgccuaaaacucaa

SEQ ID NO: 532893 - RNA, 17 nt, Homo sapiens
ccacaaccaaaaaauuc

SEQ ID NO: 532894 - RNA, 22 nt, Homo sapiens
ccacaacccaagcaacauuugu

SEQ ID NO: 532895 - RNA, 13 nt, Homo sapiens
ccacaagccauuu

SEQ ID NO: 532896 - RNA, 19 nt, Homo sapiens
ccacaaggcuguugcaugg

SEQ ID NO: 532897 - RNA, 15 nt, Homo sapiens
ccacaauccacgcuu

SEQ ID NO: 532898 - RNA, 17 nt, Homo sapiens
ccacaauucuucuguca

SEQ ID NO: 532899 - RNA, 24 nt, Homo sapiens
ccacacaacagugcccuccagaag

SEQ ID NO: 532900 - RNA, 15 nt, Homo sapiens
ccacacagcagcagu

SEQ ID NO: 532901 - RNA, 11 nt, Homo sapiens
ccacacauauu

SEQ ID NO: 532902 - RNA, 15 nt, Homo sapiens
ccacacauauugcac

SEQ ID NO: 532903 - RNA, 14 nt, Homo sapiens
ccacaccaagcagc

SEQ ID NO: 532904 - RNA, 18 nt, Homo sapiens
ccacaccacagguucuca

SEQ ID NO: 532905 - RNA, 18 nt, Homo sapiens
ccacacccacuuugucca

SEQ ID NO: 532906 - RNA, 21 nt, Homo sapiens
ccacaccuggcauggugcagg

SEQ ID NO: 532907 - RNA, 19 nt, Homo sapiens
ccacacugaaaccaaaaca

SEQ ID NO: 532908 - RNA, 11 nt, Homo sapiens
ccacacugaga

SEQ ID NO: 532909 - RNA, 13 nt, Homo sapiens
ccacacuggacuc

SEQ ID NO: 532910 - RNA, 23 nt, Homo sapiens
ccacacuucccacccccaggcaa

SEQ ID NO: 532911 - RNA, 15 nt, Homo sapiens
ccacacuugguggga

SEQ ID NO: 532912 - RNA, 21 nt, Homo sapiens
ccacacuuguuccagcucuuu

SEQ ID NO: 532913 - RNA, 20 nt, Homo sapiens
ccacagaccuaggauuucau

SEQ ID NO: 532914 - RNA, 11 nt, Homo sapiens
ccacagacuca

SEQ ID NO: 532915 - RNA, 18 nt, Homo sapiens
ccacagacucaaaugcuc

SEQ ID NO: 532916 - RNA, 21 nt, Homo sapiens
ccacagacucaaaugcucaga

SEQ ID NO: 532917 - RNA, 21 nt, Homo sapiens
ccacagagaaguuuguagcca

SEQ ID NO: 532918 - RNA, 10 nt, Homo sapiens
ccacagauua

SEQ ID NO: 532919 - RNA, 21 nt, Homo sapiens
ccacagcaaccccaggcugaa

SEQ ID NO: 532920 - RNA, 22 nt, Homo sapiens
ccacagcaucgggagcacccag

SEQ ID NO: 532921 - RNA, 12 nt, Homo sapiens
ccacagccugcu

SEQ ID NO: 532922 - RNA, 23 nt, Homo sapiens
ccacagccuucggacagacauau

SEQ ID NO: 532923 - RNA, 18 nt, Homo sapiens
ccacagcugcuguucuca

SEQ ID NO: 532924 - RNA, 19 nt, Homo sapiens
ccacagcugugcaugcuca

SEQ ID NO: 532925 - RNA, 14 nt, Homo sapiens
ccacaggacauuuc

SEQ ID NO: 532926 - RNA, 16 nt, Homo sapiens
ccacaggcaugcacca

SEQ ID NO: 532927 - RNA, 12 nt, Homo sapiens
ccacaggccuua

SEQ ID NO: 532928 - RNA, 11 nt, Homo sapiens
ccacagggaac

SEQ ID NO: 532929 - RNA, 17 nt, Homo sapiens
ccacaguacucacuuuu

SEQ ID NO: 532930 - RNA, 14 nt, Homo sapiens
ccacagucacugga

SEQ ID NO: 532931 - RNA, 12 nt, Homo sapiens
ccacagucccau

SEQ ID NO: 532932 - RNA, 23 nt, Homo sapiens
ccacagucccccacccaccuccu

SEQ ID NO: 532933 - RNA, 15 nt, Homo sapiens
ccacaguuuaccuca

SEQ ID NO: 532934 - RNA, 21 nt, Homo sapiens
ccacauaaccucucugugcca

SEQ ID NO: 532935 - RNA, 20 nt, Homo sapiens
ccacauaagaaggcaauuuu

SEQ ID NO: 532936 - RNA, 15 nt, Homo sapiens
ccacauaauguucca

SEQ ID NO: 532937 - RNA, 21 nt, Homo sapiens
ccacauccuccacguucugcu

SEQ ID NO: 532938 - RNA, 13 nt, Homo sapiens
ccacaucugccag

SEQ ID NO: 532939 - RNA, 15 nt, Homo sapiens
ccacaucuguccuca

SEQ ID NO: 532940 - RNA, 22 nt, Homo sapiens
ccacaugaggccaucucaggag

SEQ ID NO: 532941 - RNA, 15 nt, Homo sapiens
ccacaugcuggugca

SEQ ID NO: 532942 - RNA, 20 nt, Homo sapiens
ccacauguacagacauacau

SEQ ID NO: 532943 - RNA, 18 nt, Homo sapiens
ccacauuaagcacugugg

SEQ ID NO: 532944 - RNA, 10 nt, Homo sapiens
ccacauucua

SEQ ID NO: 532945 - RNA, 18 nt, Homo sapiens
ccacauucuauagccaua

SEQ ID NO: 532946 - RNA, 18 nt, Homo sapiens
ccacauuuagaacuuugg

SEQ ID NO: 532947 - RNA, 23 nt, Homo sapiens
ccacauuuagauccugguuucau

SEQ ID NO: 532948 - RNA, 18 nt, Homo sapiens
ccacauuuccacaccaga

SEQ ID NO: 532949 - RNA, 21 nt, Homo sapiens
ccacauuuccauggugugaga

SEQ ID NO: 532950 - RNA, 18 nt, Homo sapiens
ccaccaaagcugcccacu

SEQ ID NO: 532951 - RNA, 22 nt, Homo sapiens
ccaccaaugggccuccagagac

SEQ ID NO: 532952 - RNA, 13 nt, Homo sapiens
ccaccaccaggac

SEQ ID NO: 532953 - RNA, 12 nt, Homo sapiens
ccaccaccccua

SEQ ID NO: 532954 - RNA, 16 nt, Homo sapiens
ccaccacccucaggug

SEQ ID NO: 532955 - RNA, 19 nt, Homo sapiens
ccaccaccucaccaguuuc

SEQ ID NO: 532956 - RNA, 22 nt, Homo sapiens
ccaccacgcagaccaccagcau

SEQ ID NO: 532957 - RNA, 19 nt, Homo sapiens
ccaccaggugccuuucaaa

SEQ ID NO: 532958 - RNA, 18 nt, Homo sapiens
ccaccaguaugacaguau

SEQ ID NO: 532959 - RNA, 13 nt, Homo sapiens
ccaccaguucuca

SEQ ID NO: 532960 - RNA, 12 nt, Homo sapiens
ccaccaugcccu

SEQ ID NO: 532961 - RNA, 19 nt, Homo sapiens
ccaccauucacauuugaug

SEQ ID NO: 532962 - RNA, 12 nt, Homo sapiens
ccacccaaaaca

SEQ ID NO: 532963 - RNA, 19 nt, Homo sapiens
ccacccaacccuaucuccu

SEQ ID NO: 532964 - RNA, 12 nt, Homo sapiens
ccaccccaagag

SEQ ID NO: 532965 - RNA, 16 nt, Homo sapiens
ccacccccagcucaau

SEQ ID NO: 532966 - RNA, 17 nt, Homo sapiens
ccacccccgccaugcaa

SEQ ID NO: 532967 - RNA, 20 nt, Homo sapiens
ccacccccuguuggcccuca

SEQ ID NO: 532968 - RNA, 17 nt, Homo sapiens
ccacccccuucagugcc

SEQ ID NO: 532969 - RNA, 14 nt, Homo sapiens
ccacccgaugcugc

SEQ ID NO: 532970 - RNA, 16 nt, Homo sapiens
ccacccggacaggugg

SEQ ID NO: 532971 - RNA, 21 nt, Homo sapiens
ccacccuagccaaugucuccu

SEQ ID NO: 532972 - RNA, 17 nt, Homo sapiens
ccacccuccaugcuccu

SEQ ID NO: 532973 - RNA, 22 nt, Homo sapiens
ccacccugcgggccaggguccu

SEQ ID NO: 532974 - RNA, 15 nt, Homo sapiens
ccaccggaacugggc

SEQ ID NO: 532975 - RNA, 16 nt, Homo sapiens
ccaccgugccuggcca

SEQ ID NO: 532976 - RNA, 20 nt, Homo sapiens
ccaccuaauccuucuggcaa

SEQ ID NO: 532977 - RNA, 20 nt, Homo sapiens
cauuucauugucuuagucaa

SEQ ID NO: 532978 - RNA, 14 nt, Homo sapiens
cauuuccagacaaa

SEQ ID NO: 532979 - RNA, 16 nt, Homo sapiens
cauuucccaucugcac

SEQ ID NO: 532980 - RNA, 21 nt, Homo sapiens
cauuuccucgcagccucucag

SEQ ID NO: 532981 - RNA, 16 nt, Homo sapiens
cauuuccuuccuucca

SEQ ID NO: 532982 - RNA, 22 nt, Homo sapiens
cauuuccuuuuccuucaagccu

SEQ ID NO: 532983 - RNA, 15 nt, Homo sapiens
cauuucuaaaccaga

SEQ ID NO: 532984 - RNA, 21 nt, Homo sapiens
cauuucuagacucaaaaccug

SEQ ID NO: 532985 - RNA, 23 nt, Homo sapiens
cauuucuagacucaaaaccugga

SEQ ID NO: 532986 - RNA, 15 nt, Homo sapiens
cauuucuagcaguga

SEQ ID NO: 532987 - RNA, 13 nt, Homo sapiens
cauuucuauacuu

SEQ ID NO: 532988 - RNA, 22 nt, Homo sapiens
cauuucucaaaugcacaucuca

SEQ ID NO: 532989 - RNA, 13 nt, Homo sapiens
cauuucuccaugg

SEQ ID NO: 532990 - RNA, 20 nt, Homo sapiens
cauuucucuacacuaagggg

SEQ ID NO: 532991 - RNA, 19 nt, Homo sapiens
cauuucucugcuuacccuu

SEQ ID NO: 532992 - RNA, 16 nt, Homo sapiens
cauuucugauacuuuc

SEQ ID NO: 532993 - RNA, 18 nt, Homo sapiens
cauuucuguauacuguaa

SEQ ID NO: 532994 - RNA, 23 nt, Homo sapiens
cauuucuuauaccuucugacagc

SEQ ID NO: 532995 - RNA, 17 nt, Homo sapiens
cauuucuucagagggaa

SEQ ID NO: 532996 - RNA, 16 nt, Homo sapiens
cauuucuucagauaua

SEQ ID NO: 532997 - RNA, 13 nt, Homo sapiens
cauuucuugaugu

SEQ ID NO: 532998 - RNA, 19 nt, Homo sapiens
cauuugaaccagugaucca

SEQ ID NO: 532999 - RNA, 23 nt, Homo sapiens
cauuugaaccagugauccauguc

SEQ ID NO: 533000 - RNA, 19 nt, Homo sapiens
cauuugagauaaagucaaa

SEQ ID NO: 533001 - RNA, 13 nt, Homo sapiens
cauuugauuguca

SEQ ID NO: 533002 - RNA, 22 nt, Homo sapiens
cauuugcaaaggcgacaauaaa

SEQ ID NO: 533003 - RNA, 21 nt, Homo sapiens
cauuugcaauaaaagguuucc

SEQ ID NO: 533004 - RNA, 13 nt, Homo sapiens
cauuugcaccuac

SEQ ID NO: 533005 - RNA, 16 nt, Homo sapiens
caguccucaucuccag

SEQ ID NO: 533006 - RNA, 14 nt, Homo sapiens
caguccuccagacc

SEQ ID NO: 533007 - RNA, 14 nt, Homo sapiens
caguccucuuucaa

SEQ ID NO: 533008 - RNA, 19 nt, Homo sapiens
caguccugccucagccucc

SEQ ID NO: 533009 - RNA, 16 nt, Homo sapiens
cagucgagaagccagg

SEQ ID NO: 533010 - RNA, 14 nt, Homo sapiens
cagucgagaccuca

SEQ ID NO: 533011 - RNA, 19 nt, Homo sapiens
cagucgaugcguucacucc

SEQ ID NO: 533012 - RNA, 14 nt, Homo sapiens
cagucuaaagaaga

SEQ ID NO: 533013 - RNA, 13 nt, Homo sapiens
cagucuagugcaa

SEQ ID NO: 533014 - RNA, 15 nt, Homo sapiens
cagucuagugcaaaa

SEQ ID NO: 533015 - RNA, 16 nt, Homo sapiens
cagucucauuuugaca

SEQ ID NO: 533016 - RNA, 17 nt, Homo sapiens
cagucuccucacucugu

SEQ ID NO: 533017 - RNA, 18 nt, Homo sapiens
cagucucugaauacacag

SEQ ID NO: 533018 - RNA, 11 nt, Homo sapiens
cagucugcuca

SEQ ID NO: 533019 - RNA, 23 nt, Homo sapiens
cagucugcucugcugcucugacc

SEQ ID NO: 533020 - RNA, 20 nt, Homo sapiens
cagucuggccacugucaagg

SEQ ID NO: 533021 - RNA, 17 nt, Homo sapiens
cagucuguuaugcacug

SEQ ID NO: 533022 - RNA, 23 nt, Homo sapiens
cagucuguuaugcacugugguuu

SEQ ID NO: 533023 - RNA, 16 nt, Homo sapiens
cagucuuccacaaaga

SEQ ID NO: 533024 - RNA, 14 nt, Homo sapiens
cagucuuccauuug

SEQ ID NO: 533025 - RNA, 13 nt, Homo sapiens
cagucuucugacu

SEQ ID NO: 533026 - RNA, 17 nt, Homo sapiens
cagucuucugacuguca

SEQ ID NO: 533027 - RNA, 18 nt, Homo sapiens
cagucuucugacugucac

SEQ ID NO: 533028 - RNA, 19 nt, Homo sapiens
cagucuuggcucacugcaa

SEQ ID NO: 533029 - RNA, 21 nt, Homo sapiens
cagugaaaaagauguacagaa

SEQ ID NO: 533030 - RNA, 15 nt, Homo sapiens
cagugaaacuugugc

SEQ ID NO: 533031 - RNA, 15 nt, Homo sapiens
cagugaaccaaagag

SEQ ID NO: 533032 - RNA, 16 nt, Homo sapiens
cagugaagacuugauu

SEQ ID NO: 533033 - RNA, 16 nt, Homo sapiens
cagugaagcagcacug

SEQ ID NO: 533034 - RNA, 18 nt, Homo sapiens
cagugaaggcuaaaugag

SEQ ID NO: 533035 - RNA, 22 nt, Homo sapiens
cagugaaggguuuuguguguuu

SEQ ID NO: 533036 - RNA, 19 nt, Homo sapiens
cagugaagucuagaaucau

SEQ ID NO: 533037 - RNA, 21 nt, Homo sapiens
cagugaaugauucaguguuaa

SEQ ID NO: 533038 - RNA, 17 nt, Homo sapiens
cagugacaaggcccuga

SEQ ID NO: 533039 - RNA, 17 nt, Homo sapiens
cagugacaugauucuga

SEQ ID NO: 533040 - RNA, 18 nt, Homo sapiens
cagugaccccugaccuca

SEQ ID NO: 533041 - RNA, 22 nt, Homo sapiens
cagugacugaauucugccuugg

SEQ ID NO: 533042 - RNA, 12 nt, Homo sapiens
cagugacuggca

SEQ ID NO: 533043 - RNA, 13 nt, Homo sapiens
cagugacuucuuu

SEQ ID NO: 533044 - RNA, 17 nt, Homo sapiens
cagugagaagcugaggc

SEQ ID NO: 533045 - RNA, 17 nt, Homo sapiens
cagugagacugccccac

SEQ ID NO: 533046 - RNA, 16 nt, Homo sapiens
cagugagagacuccau

SEQ ID NO: 533047 - RNA, 19 nt, Homo sapiens
cagugagcaaagauugugc

SEQ ID NO: 533048 - RNA, 20 nt, Homo sapiens
cagugagccgagaucaugcc

SEQ ID NO: 533049 - RNA, 20 nt, Homo sapiens
cagugagccuccugugccug

SEQ ID NO: 533050 - RNA, 22 nt, Homo sapiens
cagugaggacucggccacugug

SEQ ID NO: 533051 - RNA, 20 nt, Homo sapiens
cagugaguaaucaauacaga

SEQ ID NO: 533052 - RNA, 21 nt, Homo sapiens
cagugagucgagauugcacug

SEQ ID NO: 533053 - RNA, 22 nt, Homo sapiens
cagugagucgagauugcacugc

SEQ ID NO: 533054 - RNA, 17 nt, Homo sapiens
cagugagucucuucaga

SEQ ID NO: 533055 - RNA, 20 nt, Homo sapiens
cagugaguugggauuggaca

SEQ ID NO: 533056 - RNA, 15 nt, Homo sapiens
cagugauaacucuga

SEQ ID NO: 533057 - RNA, 15 nt, Homo sapiens
cagugauccaugucc

SEQ ID NO: 533058 - RNA, 20 nt, Homo sapiens
cagugauccauguccugaaa

SEQ ID NO: 533059 - RNA, 13 nt, Homo sapiens
cagugaucuccau

SEQ ID NO: 533060 - RNA, 14 nt, Homo sapiens
cagugaugauguuu

SEQ ID NO: 533061 - RNA, 17 nt, Homo sapiens
cagugaugcugugcuau

SEQ ID NO: 533062 - RNA, 21 nt, Homo sapiens
cagugauucuguuugccuuuu

SEQ ID NO: 533063 - RNA, 19 nt, Homo sapiens
cagugauuuccuacagugu

SEQ ID NO: 533064 - RNA, 23 nt, Homo sapiens
cagugcaccuacugcuuacuguu

SEQ ID NO: 533065 - RNA, 23 nt, Homo sapiens
cagugcaccucccuccccagcuc

SEQ ID NO: 533066 - RNA, 12 nt, Homo sapiens
cagugcacucga

SEQ ID NO: 533067 - RNA, 17 nt, Homo sapiens
cagugcacugaaaguca

SEQ ID NO: 533068 - RNA, 19 nt, Homo sapiens
cagugcaguccauuuccua

SEQ ID NO: 533069 - RNA, 21 nt, Homo sapiens
cagugcaguuucuaagcaugu

SEQ ID NO: 533070 - RNA, 13 nt, Homo sapiens
cagugcauaugca

SEQ ID NO: 533071 - RNA, 17 nt, Homo sapiens
cagugcaucauuacugu

SEQ ID NO: 533072 - RNA, 14 nt, Homo sapiens
cagugcaugcaugu

SEQ ID NO: 533073 - RNA, 12 nt, Homo sapiens
cagugcauuuac

SEQ ID NO: 533074 - RNA, 14 nt, Homo sapiens
cagugcauuugccu

SEQ ID NO: 533075 - RNA, 17 nt, Homo sapiens
cagugccagcaaugaca

SEQ ID NO: 533076 - RNA, 16 nt, Homo sapiens
cagugccauaagcaag

SEQ ID NO: 533077 - RNA, 14 nt, Homo sapiens
cagugccauuccac

SEQ ID NO: 533078 - RNA, 23 nt, Homo sapiens
cagugcccaccagccuuguccua

SEQ ID NO: 533079 - RNA, 17 nt, Homo sapiens
cagugcccggcugaggg

SEQ ID NO: 533080 - RNA, 16 nt, Homo sapiens
cagugccuuccauaau

SEQ ID NO: 533081 - RNA, 23 nt, Homo sapiens
cagugcgugcucccgaugcugcu

SEQ ID NO: 533082 - RNA, 15 nt, Homo sapiens
cagugcucaccagcc

SEQ ID NO: 533083 - RNA, 15 nt, Homo sapiens
cagugcugcuguaaa

SEQ ID NO: 533084 - RNA, 17 nt, Homo sapiens
cagugcuucagccugag

SEQ ID NO: 533085 - RNA, 15 nt, Homo sapiens
cagugcuuuucacua

SEQ ID NO: 533086 - RNA, 22 nt, Homo sapiens
caguggacccuggaccauucca

SEQ ID NO: 533087 - RNA, 22 nt, Homo sapiens
caguggacuauaauaauagugg

SEQ ID NO: 533088 - RNA, 22 nt, Homo sapiens
caguggaugccacagcccagcu

SEQ ID NO: 533089 - RNA, 17 nt, Homo sapiens
caguggauugauuauaa

SEQ ID NO: 533090 - RNA, 20 nt, Homo sapiens
caguggcaugaucauagcuc

SEQ ID NO: 533091 - RNA, 18 nt, Homo sapiens
caguggcgugaucucggc

SEQ ID NO: 533092 - RNA, 18 nt, Homo sapiens
cagugggaguaccaaaga

SEQ ID NO: 533093 - RNA, 18 nt, Homo sapiens
caguggguggagccaauc

SEQ ID NO: 533094 - RNA, 15 nt, Homo sapiens
cagugguccuuuuca

SEQ ID NO: 533095 - RNA, 19 nt, Homo sapiens
cagugguggucuucaagac

SEQ ID NO: 533096 - RNA, 15 nt, Homo sapiens
caguggugugaaaca

SEQ ID NO: 533097 - RNA, 16 nt, Homo sapiens
caguggugugaucucg

SEQ ID NO: 533098 - RNA, 13 nt, Homo sapiens
caguguacagucu

SEQ ID NO: 533099 - RNA, 14 nt, Homo sapiens
caguguacauggaa

SEQ ID NO: 533100 - RNA, 15 nt, Homo sapiens
caguguauaggaaga

SEQ ID NO: 533101 - RNA, 18 nt, Homo sapiens
caguguccccuccacugu

SEQ ID NO: 533102 - RNA, 16 nt, Homo sapiens
cagugucuccaccuac

SEQ ID NO: 533103 - RNA, 13 nt, Homo sapiens
cagugucuuccau

SEQ ID NO: 533104 - RNA, 23 nt, Homo sapiens
cagugugaucccaagugccaguc

SEQ ID NO: 533105 - RNA, 17 nt, Homo sapiens
cagugugcccaggauug

SEQ ID NO: 533106 - RNA, 15 nt, Homo sapiens
caguguggacaugag

SEQ ID NO: 533107 - RNA, 16 nt, Homo sapiens
caguguggcagugacc

SEQ ID NO: 533108 - RNA, 18 nt, Homo sapiens
caguguggggauaaagac

SEQ ID NO: 533109 - RNA, 17 nt, Homo sapiens
cagugugguuauguucc

SEQ ID NO: 533110 - RNA, 20 nt, Homo sapiens
caguguguguuuaacauuca

SEQ ID NO: 533111 - RNA, 22 nt, Homo sapiens
caguguguguuuaacauucaca

SEQ ID NO: 533112 - RNA, 20 nt, Homo sapiens
caguguuaaaugugaugaau

SEQ ID NO: 533113 - RNA, 14 nt, Homo sapiens
caguguucaguaaa

SEQ ID NO: 533114 - RNA, 19 nt, Homo sapiens
caguguuccauuugaacca

SEQ ID NO: 533115 - RNA, 15 nt, Homo sapiens
caguguugccuccuc

SEQ ID NO: 533116 - RNA, 20 nt, Homo sapiens
caguguuggggaugccuugg

SEQ ID NO: 533117 - RNA, 14 nt, Homo sapiens
caguguuucaauuc

SEQ ID NO: 533118 - RNA, 16 nt, Homo sapiens
caguguuugcaauggu

SEQ ID NO: 533119 - RNA, 23 nt, Homo sapiens
caguguuuuagagagagaacuuu

SEQ ID NO: 533120 - RNA, 18 nt, Homo sapiens
caguuaaaauguguuucu

SEQ ID NO: 533121 - RNA, 21 nt, Homo sapiens
caguuaacaggauauuagaca

SEQ ID NO: 533122 - RNA, 22 nt, Homo sapiens
caguuaacuuuaagacugagca

SEQ ID NO: 533123 - RNA, 23 nt, Homo sapiens
caguuacaagauuguaaguaaau

SEQ ID NO: 533124 - RNA, 22 nt, Homo sapiens
caguuacagagugaacacucua

SEQ ID NO: 533125 - RNA, 17 nt, Homo sapiens
caguuacaguugauguu

SEQ ID NO: 533126 - RNA, 19 nt, Homo sapiens
caguuagagcugagcacuu

SEQ ID NO: 533127 - RNA, 16 nt, Homo sapiens
caguuagguagcuuua

SEQ ID NO: 533128 - RNA, 12 nt, Homo sapiens
cagguaucuuuu

SEQ ID NO: 533129 - RNA, 19 nt, Homo sapiens
cagguauuuuuuuaaauca

SEQ ID NO: 533130 - RNA, 15 nt, Homo sapiens
caggucaaaaaccug

SEQ ID NO: 533131 - RNA, 18 nt, Homo sapiens
caggucaggaugcacauu

SEQ ID NO: 533132 - RNA, 15 nt, Homo sapiens
caggucaggggcucc

SEQ ID NO: 533133 - RNA, 16 nt, Homo sapiens
cagguccaauuuguaa

SEQ ID NO: 533134 - RNA, 16 nt, Homo sapiens
cagguccaggccagug

SEQ ID NO: 533135 - RNA, 22 nt, Homo sapiens
cagguccucuacuuaaugagau

SEQ ID NO: 533136 - RNA, 18 nt, Homo sapiens
cagguccugucucugcac

SEQ ID NO: 533137 - RNA, 17 nt, Homo sapiens
caggucgauuuguggua

SEQ ID NO: 533138 - RNA, 17 nt, Homo sapiens
caggucuagacuuucuc

SEQ ID NO: 533139 - RNA, 21 nt, Homo sapiens
caggucucacgggcaugggca

SEQ ID NO: 533140 - RNA, 11 nt, Homo sapiens
caggucuuccu

SEQ ID NO: 533141 - RNA, 21 nt, Homo sapiens
caggucuugacucauggcagc

SEQ ID NO: 533142 - RNA, 14 nt, Homo sapiens
caggugaugccauu

SEQ ID NO: 533143 - RNA, 19 nt, Homo sapiens
caggugcaacagacuugaa

SEQ ID NO: 533144 - RNA, 20 nt, Homo sapiens
caggugccacugaccgggau

SEQ ID NO: 533145 - RNA, 14 nt, Homo sapiens
caggugccuuucaa

SEQ ID NO: 533146 - RNA, 17 nt, Homo sapiens
caggugcgcacuaccac

SEQ ID NO: 533147 - RNA, 22 nt, Homo sapiens
caggugcgcgccaccgugccug

SEQ ID NO: 533148 - RNA, 15 nt, Homo sapiens
caggugcugacaaua

SEQ ID NO: 533149 - RNA, 23 nt, Homo sapiens
caggugcugggcuggacuggcca

SEQ ID NO: 533150 - RNA, 23 nt, Homo sapiens
cagguggauuuuguggaggugag

SEQ ID NO: 533151 - RNA, 16 nt, Homo sapiens
cagguggcagagugaa

SEQ ID NO: 533152 - RNA, 17 nt, Homo sapiens
cagguggccccaguuca

SEQ ID NO: 533153 - RNA, 14 nt, Homo sapiens
caggugggugcugc

SEQ ID NO: 533154 - RNA, 17 nt, Homo sapiens
caggugguggcacugag

SEQ ID NO: 533155 - RNA, 18 nt, Homo sapiens
cagguggugggacacugg

SEQ ID NO: 533156 - RNA, 20 nt, Homo sapiens
cagguguaagccaccgugcc

SEQ ID NO: 533157 - RNA, 20 nt, Homo sapiens
caggugugagccaccgugcc

SEQ ID NO: 533158 - RNA, 16 nt, Homo sapiens
cagguguuacuuacag

SEQ ID NO: 533159 - RNA, 17 nt, Homo sapiens
cagguguucugggcucc

SEQ ID NO: 533160 - RNA, 20 nt, Homo sapiens
cagguguugccauuucucug

SEQ ID NO: 533161 - RNA, 18 nt, Homo sapiens
cagguuagggcucugccc

SEQ ID NO: 533162 - RNA, 16 nt, Homo sapiens
cagguuccaaucagaa

SEQ ID NO: 533163 - RNA, 21 nt, Homo sapiens
cagguuccuuaucugucacac

SEQ ID NO: 533164 - RNA, 16 nt, Homo sapiens
cagguucuucagggcc

SEQ ID NO: 533165 - RNA, 19 nt, Homo sapiens
cagguuuugaaaauguaca

SEQ ID NO: 533166 - RNA, 19 nt, Homo sapiens
cagguuuuugauuuugaau

SEQ ID NO: 533167 - RNA, 15 nt, Homo sapiens
caguaaaaacuugua

SEQ ID NO: 533168 - RNA, 16 nt, Homo sapiens
caguaaaaacuuguac

SEQ ID NO: 533169 - RNA, 18 nt, Homo sapiens
caguaaaaauaaaauacu

SEQ ID NO: 533170 - RNA, 15 nt, Homo sapiens
caguaaaacucucaa

SEQ ID NO: 533171 - RNA, 15 nt, Homo sapiens
caguaaaagucacau

SEQ ID NO: 533172 - RNA, 16 nt, Homo sapiens
caguaaaagucacaug

SEQ ID NO: 533173 - RNA, 18 nt, Homo sapiens
caguaaacuaaggguguc

SEQ ID NO: 533174 - RNA, 19 nt, Homo sapiens
caguaaauaacaggcauuu

SEQ ID NO: 533175 - RNA, 22 nt, Homo sapiens
caguaaauaacaggcauuuguu

SEQ ID NO: 533176 - RNA, 17 nt, Homo sapiens
caguaaaucucacaaau

SEQ ID NO: 533177 - RNA, 14 nt, Homo sapiens
caguaaauguacaa

SEQ ID NO: 533178 - RNA, 23 nt, Homo sapiens
caguaaauuugcuagcaguaaaa

SEQ ID NO: 533179 - RNA, 17 nt, Homo sapiens
caguaaccuagugaauu

SEQ ID NO: 533180 - RNA, 12 nt, Homo sapiens
caguaacugaca

SEQ ID NO: 533181 - RNA, 14 nt, Homo sapiens
caguaacuuuaugu

SEQ ID NO: 533182 - RNA, 22 nt, Homo sapiens
caguaagagguguuauuuggaa

SEQ ID NO: 533183 - RNA, 17 nt, Homo sapiens
caguaaucuuuauacug

SEQ ID NO: 533184 - RNA, 20 nt, Homo sapiens
caguaauguauucuaucucu

SEQ ID NO: 533185 - RNA, 23 nt, Homo sapiens
caguacaacccauaaucauguaa

SEQ ID NO: 533186 - RNA, 21 nt, Homo sapiens
caguacagccuccggaagcag

SEQ ID NO: 533187 - RNA, 18 nt, Homo sapiens
caguacauacgucugcca

SEQ ID NO: 533188 - RNA, 21 nt, Homo sapiens
caguaccaaaguaacugaauu

SEQ ID NO: 533189 - RNA, 23 nt, Homo sapiens
caguacccacucuggagcauuuc

SEQ ID NO: 533190 - RNA, 20 nt, Homo sapiens
caguaccccugguaaaccaa

SEQ ID NO: 533191 - RNA, 18 nt, Homo sapiens
caguaccgacuaagcaaa

SEQ ID NO: 533192 - RNA, 14 nt, Homo sapiens
caguaccuccugcc

SEQ ID NO: 533193 - RNA, 20 nt, Homo sapiens
caguaccuccugccccaugc

SEQ ID NO: 533194 - RNA, 12 nt, Homo sapiens
caguacuuguca

SEQ ID NO: 533195 - RNA, 18 nt, Homo sapiens
caguagaaauaauaugca

SEQ ID NO: 533196 - RNA, 19 nt, Homo sapiens
caguagaaauaauaugcau

SEQ ID NO: 533197 - RNA, 18 nt, Homo sapiens
caguagaacugucuguga

SEQ ID NO: 533198 - RNA, 23 nt, Homo sapiens
caguagagcaaaucuaugagauu

SEQ ID NO: 533199 - RNA, 15 nt, Homo sapiens
caguagagccagcuu

SEQ ID NO: 533200 - RNA, 22 nt, Homo sapiens
caguagagcucuacugccucaa

SEQ ID NO: 533201 - RNA, 16 nt, Homo sapiens
caguagagugauagga

SEQ ID NO: 533202 - RNA, 23 nt, Homo sapiens
caguagauugcagaaaauucugu

SEQ ID NO: 533203 - RNA, 17 nt, Homo sapiens
caguagcaguggauguu

SEQ ID NO: 533204 - RNA, 19 nt, Homo sapiens
caguagccguuugugguuu

SEQ ID NO: 533205 - RNA, 18 nt, Homo sapiens
caguagcugcccuuccug

SEQ ID NO: 533206 - RNA, 18 nt, Homo sapiens
caguaggaacuguacaug

SEQ ID NO: 533207 - RNA, 17 nt, Homo sapiens
caguagggaggucagug

SEQ ID NO: 533208 - RNA, 21 nt, Homo sapiens
caguaggggaggagcacaguu

SEQ ID NO: 533209 - RNA, 19 nt, Homo sapiens
caguagguugaacuaugaa

SEQ ID NO: 533210 - RNA, 16 nt, Homo sapiens
caguagguuggcagua

SEQ ID NO: 533211 - RNA, 21 nt, Homo sapiens
caguauaaauuaucuuaugaa

SEQ ID NO: 533212 - RNA, 13 nt, Homo sapiens
caguauacugugu

SEQ ID NO: 533213 - RNA, 17 nt, Homo sapiens
caguauauuuauaguca

SEQ ID NO: 533214 - RNA, 20 nt, Homo sapiens
caguauauuuauagucacaa

SEQ ID NO: 533215 - RNA, 22 nt, Homo sapiens
caguaucuacuugcauguguau

SEQ ID NO: 533216 - RNA, 12 nt, Homo sapiens
caguaucuccaa

SEQ ID NO: 533217 - RNA, 17 nt, Homo sapiens
caguaucucuuacauca

SEQ ID NO: 533218 - RNA, 21 nt, Homo sapiens
caguaucucuuacaucaguag

SEQ ID NO: 533219 - RNA, 17 nt, Homo sapiens
caguaugagucaaugug

SEQ ID NO: 533220 - RNA, 20 nt, Homo sapiens
caguauguacuucagugcac

SEQ ID NO: 533221 - RNA, 18 nt, Homo sapiens
caguauguuuguuucauu

SEQ ID NO: 533222 - RNA, 13 nt, Homo sapiens
caguauuaugcau

SEQ ID NO: 533223 - RNA, 17 nt, Homo sapiens
caguauucuugucaaaa

SEQ ID NO: 533224 - RNA, 13 nt, Homo sapiens
caguauuuugaca

SEQ ID NO: 533225 - RNA, 13 nt, Homo sapiens
cagucaaccuggg

SEQ ID NO: 533226 - RNA, 19 nt, Homo sapiens
cagucaaugaggaagauuu

SEQ ID NO: 533227 - RNA, 13 nt, Homo sapiens
cagucacagccac

SEQ ID NO: 533228 - RNA, 23 nt, Homo sapiens
cagucacaguuuuugguuccucu

SEQ ID NO: 533229 - RNA, 16 nt, Homo sapiens
cagucacauugaugua

SEQ ID NO: 533230 - RNA, 13 nt, Homo sapiens
cagucaccaccca

SEQ ID NO: 533231 - RNA, 15 nt, Homo sapiens
cagucaccacccagc

SEQ ID NO: 533232 - RNA, 19 nt, Homo sapiens
cagucacugacaguuaaua

SEQ ID NO: 533233 - RNA, 15 nt, Homo sapiens
cagucagcauucuua

SEQ ID NO: 533234 - RNA, 20 nt, Homo sapiens
cagucagcccuuauggccaa

SEQ ID NO: 533235 - RNA, 12 nt, Homo sapiens
cagucagguggg

SEQ ID NO: 533236 - RNA, 15 nt, Homo sapiens
cagucaguuuugcuc

SEQ ID NO: 533237 - RNA, 11 nt, Homo sapiens
cagucaucucc

SEQ ID NO: 533238 - RNA, 23 nt, Homo sapiens
cagucauucuaggauguggagcu

SEQ ID NO: 533239 - RNA, 19 nt, Homo sapiens
caguccaugcuucuagccu

SEQ ID NO: 533240 - RNA, 19 nt, Homo sapiens
caguccauuuccaaaugug

SEQ ID NO: 533241 - RNA, 16 nt, Homo sapiens
cagucccacacugugg

SEQ ID NO: 533242 - RNA, 14 nt, Homo sapiens
cagucccauuccuc

SEQ ID NO: 533243 - RNA, 20 nt, Homo sapiens
cagucccccacccaccuccu

SEQ ID NO: 533244 - RNA, 23 nt, Homo sapiens
cagucccuaaagaaaaaaaauca

SEQ ID NO: 533245 - RNA, 20 nt, Homo sapiens
cagucccuauguauuugcag

SEQ ID NO: 533246 - RNA, 23 nt, Homo sapiens
cagucccuuacacguaccucuca

SEQ ID NO: 533247 - RNA, 22 nt, Homo sapiens
caguccuagcucuuacacauag

SEQ ID NO: 533248 - RNA, 19 nt, Homo sapiens
acuguaggcacacuuugca

SEQ ID NO: 533249 - RNA, 13 nt, Homo sapiens
acuguaguucucu

SEQ ID NO: 533250 - RNA, 17 nt, Homo sapiens
acuguauaaacaaaaga

SEQ ID NO: 533251 - RNA, 18 nt, Homo sapiens
acuguauauagaagucua

SEQ ID NO: 533252 - RNA, 15 nt, Homo sapiens
acuguaucaagucau

SEQ ID NO: 533253 - RNA, 18 nt, Homo sapiens
acuguaugugggaauuua

SEQ ID NO: 533254 - RNA, 16 nt, Homo sapiens
acuguauucgugcauu

SEQ ID NO: 533255 - RNA, 19 nt, Homo sapiens
acuguauuuuacaagucaa

SEQ ID NO: 533256 - RNA, 22 nt, Homo sapiens
acugucacguggcuucaucagc

SEQ ID NO: 533257 - RNA, 13 nt, Homo sapiens
acugucagccuca

SEQ ID NO: 533258 - RNA, 12 nt, Homo sapiens
acugucaggguu

SEQ ID NO: 533259 - RNA, 17 nt, Homo sapiens
acugucauccucaaaga

SEQ ID NO: 533260 - RNA, 16 nt, Homo sapiens
acuguccacaucugcc

SEQ ID NO: 533261 - RNA, 22 nt, Homo sapiens
acuguccagagagcaacucuga

SEQ ID NO: 533262 - RNA, 24 nt, Homo sapiens
acuguccagagagcaacucugaga

SEQ ID NO: 533263 - RNA, 12 nt, Homo sapiens
acuguccaugaa

SEQ ID NO: 533264 - RNA, 19 nt, Homo sapiens
acuguccaugaagcacuga

SEQ ID NO: 533265 - RNA, 16 nt, Homo sapiens
acuguccccuugauau

SEQ ID NO: 533266 - RNA, 18 nt, Homo sapiens
acugucccugccaaugcu

SEQ ID NO: 533267 - RNA, 14 nt, Homo sapiens
acugucccuugccu

SEQ ID NO: 533268 - RNA, 21 nt, Homo sapiens
acuguccggccccgagucacu

SEQ ID NO: 533269 - RNA, 14 nt, Homo sapiens
acuguccuggcuac

SEQ ID NO: 533270 - RNA, 20 nt, Homo sapiens
acugucuauuuaagugcaau

SEQ ID NO: 533271 - RNA, 14 nt, Homo sapiens
acugucucacuuaa

SEQ ID NO: 533272 - RNA, 15 nt, Homo sapiens
acugucuuccucaaa

SEQ ID NO: 533273 - RNA, 17 nt, Homo sapiens
acugucuuugucaccac

SEQ ID NO: 533274 - RNA, 20 nt, Homo sapiens
acugugaacuuggggaacaa

SEQ ID NO: 533275 - RNA, 21 nt, Homo sapiens
acugugaccuagagacuucac

SEQ ID NO: 533276 - RNA, 22 nt, Homo sapiens
acugugacuaggcauacacugu

SEQ ID NO: 533277 - RNA, 14 nt, Homo sapiens
acugugagacugua

SEQ ID NO: 533278 - RNA, 23 nt, Homo sapiens
acugugagcaaggagcacaagcc

SEQ ID NO: 533279 - RNA, 14 nt, Homo sapiens
acugugcaguuuuc

SEQ ID NO: 533280 - RNA, 23 nt, Homo sapiens
acugugccaccgccuucccugac

SEQ ID NO: 533281 - RNA, 16 nt, Homo sapiens
acugugcugugcagcu

SEQ ID NO: 533282 - RNA, 23 nt, Homo sapiens
acuguggagaaauaaaaauaccu

SEQ ID NO: 533283 - RNA, 20 nt, Homo sapiens
acuguggagacuuucuguua

SEQ ID NO: 533284 - RNA, 20 nt, Homo sapiens
acuguggaucacgacaggaa

SEQ ID NO: 533285 - RNA, 14 nt, Homo sapiens
acuguggcucugca

SEQ ID NO: 533286 - RNA, 17 nt, Homo sapiens
acugugggaaggccagc

SEQ ID NO: 533287 - RNA, 16 nt, Homo sapiens
acuguguaacuuucuc

SEQ ID NO: 533288 - RNA, 21 nt, Homo sapiens
acuguguaauuagugccacuu

SEQ ID NO: 533289 - RNA, 21 nt, Homo sapiens
acuguguauguuuuauaucaa

SEQ ID NO: 533290 - RNA, 11 nt, Homo sapiens
acugugucagg

SEQ ID NO: 533291 - RNA, 18 nt, Homo sapiens
acugugugccuucugcca

SEQ ID NO: 533292 - RNA, 23 nt, Homo sapiens
acuguguucccacgggugccaug

SEQ ID NO: 533293 - RNA, 17 nt, Homo sapiens
acuguguuucaaguuca

SEQ ID NO: 533294 - RNA, 18 nt, Homo sapiens
acuguguuuuuccuccau

SEQ ID NO: 533295 - RNA, 20 nt, Homo sapiens
acuguuacacgugccuguag

SEQ ID NO: 533296 - RNA, 17 nt, Homo sapiens
acuguuagcacuguuga

SEQ ID NO: 533297 - RNA, 14 nt, Homo sapiens
acuguucaaaccuc

SEQ ID NO: 533298 - RNA, 16 nt, Homo sapiens
acuguuccagauuccu

SEQ ID NO: 533299 - RNA, 21 nt, Homo sapiens
acuguucuaccaagaacugaa

SEQ ID NO: 533300 - RNA, 23 nt, Homo sapiens
acuguucucuauuagacuuuaga

SEQ ID NO: 533301 - RNA, 17 nt, Homo sapiens
acuguucuuugccagaa

SEQ ID NO: 533302 - RNA, 24 nt, Homo sapiens
acuguucuuugccagaacacaaga

SEQ ID NO: 533303 - RNA, 16 nt, Homo sapiens
acuguugcaaacucag

SEQ ID NO: 533304 - RNA, 18 nt, Homo sapiens
acuguugcgccgcaguuu

SEQ ID NO: 533305 - RNA, 19 nt, Homo sapiens
acuguuggcaaggugacau

SEQ ID NO: 533306 - RNA, 18 nt, Homo sapiens
acuguuuauacacugugu

SEQ ID NO: 533307 - RNA, 16 nt, Homo sapiens
acuguuucacuugcuc

SEQ ID NO: 533308 - RNA, 20 nt, Homo sapiens
acuguuucauucacugugca

SEQ ID NO: 533309 - RNA, 17 nt, Homo sapiens
acuguuuuccuuaccua

SEQ ID NO: 533310 - RNA, 15 nt, Homo sapiens
acuguuuugacaaau

SEQ ID NO: 533311 - RNA, 20 nt, Homo sapiens
acuguuuuguaagugcugcu

SEQ ID NO: 533312 - RNA, 21 nt, Homo sapiens
acuguuuuguaagugcugcua

SEQ ID NO: 533313 - RNA, 20 nt, Homo sapiens
acuuaaaaaauguccaugau

SEQ ID NO: 533314 - RNA, 19 nt, Homo sapiens
acuuaaaaugacaaagcca

SEQ ID NO: 533315 - RNA, 20 nt, Homo sapiens
acuuaaaaugacaaagccau

SEQ ID NO: 533316 - RNA, 14 nt, Homo sapiens
acuuaaagcaaaau

SEQ ID NO: 533317 - RNA, 19 nt, Homo sapiens
acuuaacaugggcucuuca

SEQ ID NO: 533318 - RNA, 21 nt, Homo sapiens
auguguucauuaaagcaugaa

SEQ ID NO: 533319 - RNA, 15 nt, Homo sapiens
auguguucauucaag

SEQ ID NO: 533320 - RNA, 14 nt, Homo sapiens
auguguuccuccau

SEQ ID NO: 533321 - RNA, 18 nt, Homo sapiens
auguguuccuugguugua

SEQ ID NO: 533322 - RNA, 22 nt, Homo sapiens
auguguucggguuaagugauga

SEQ ID NO: 533323 - RNA, 22 nt, Homo sapiens
auguguuguguauuccacuuag

SEQ ID NO: 533324 - RNA, 17 nt, Homo sapiens
auguguuucaaaaccau

SEQ ID NO: 533325 - RNA, 22 nt, Homo sapiens
auguuaaaaaaauaagaagaau

SEQ ID NO: 533326 - RNA, 16 nt, Homo sapiens
auguuaaccucagugu

SEQ ID NO: 533327 - RNA, 14 nt, Homo sapiens
auguuaacugagcu

SEQ ID NO: 533328 - RNA, 19 nt, Homo sapiens
auguuaauauugugcaaac

SEQ ID NO: 533329 - RNA, 16 nt, Homo sapiens
auguuacucucuugca

SEQ ID NO: 533330 - RNA, 13 nt, Homo sapiens
auguuacugacca

SEQ ID NO: 533331 - RNA, 18 nt, Homo sapiens
auguuagccacaguguau

SEQ ID NO: 533332 - RNA, 12 nt, Homo sapiens
auguuagccuca

SEQ ID NO: 533333 - RNA, 22 nt, Homo sapiens
auguuauacaaccuucauuuaa

SEQ ID NO: 533334 - RNA, 20 nt, Homo sapiens
auguuauacaauacagauca

SEQ ID NO: 533335 - RNA, 15 nt, Homo sapiens
auguuauagaacuuc

SEQ ID NO: 533336 - RNA, 22 nt, Homo sapiens
auguuauagaacuucauggauc

SEQ ID NO: 533337 - RNA, 12 nt, Homo sapiens
auguuauaucau

SEQ ID NO: 533338 - RNA, 15 nt, Homo sapiens
auguuaugacuaugu

SEQ ID NO: 533339 - RNA, 13 nt, Homo sapiens
auguuaugugcaa

SEQ ID NO: 533340 - RNA, 17 nt, Homo sapiens
auguuauuauucuugag

SEQ ID NO: 533341 - RNA, 20 nt, Homo sapiens
auguucauccuaacaugaca

SEQ ID NO: 533342 - RNA, 15 nt, Homo sapiens
auguucauugcacau

SEQ ID NO: 533343 - RNA, 22 nt, Homo sapiens
auguuccccaucuggugcucuu

SEQ ID NO: 533344 - RNA, 16 nt, Homo sapiens
auguuccuacgggcuu

SEQ ID NO: 533345 - RNA, 14 nt, Homo sapiens
auguuccucaaaag

SEQ ID NO: 533346 - RNA, 22 nt, Homo sapiens
auguuccuuuaagguacugaag

SEQ ID NO: 533347 - RNA, 18 nt, Homo sapiens
auguucgcucgugcagua

SEQ ID NO: 533348 - RNA, 20 nt, Homo sapiens
auguucucaugaacuacccc

SEQ ID NO: 533349 - RNA, 23 nt, Homo sapiens
auguucugggaaaauccacuaug

SEQ ID NO: 533350 - RNA, 18 nt, Homo sapiens
auguucugugggggucau

SEQ ID NO: 533351 - RNA, 16 nt, Homo sapiens
auguugaaauaugcau

SEQ ID NO: 533352 - RNA, 12 nt, Homo sapiens
auguugauacua

SEQ ID NO: 533353 - RNA, 16 nt, Homo sapiens
auguugaucugcauau

SEQ ID NO: 533354 - RNA, 14 nt, Homo sapiens
auguugcaauguga

SEQ ID NO: 533355 - RNA, 19 nt, Homo sapiens
auguugccaccuguuaaaa

SEQ ID NO: 533356 - RNA, 23 nt, Homo sapiens
auguugcccacauuaagcacugu

SEQ ID NO: 533357 - RNA, 20 nt, Homo sapiens
auguugcuuucuuaucccag

SEQ ID NO: 533358 - RNA, 17 nt, Homo sapiens
auguugcuuuugcaccu

SEQ ID NO: 533359 - RNA, 22 nt, Homo sapiens
auguuggaaaugugcaaccacu

SEQ ID NO: 533360 - RNA, 21 nt, Homo sapiens
auguuggacagacacuguugc

SEQ ID NO: 533361 - RNA, 20 nt, Homo sapiens
auguuggcaaaucacuucaa

SEQ ID NO: 533362 - RNA, 11 nt, Homo sapiens
auguuggucag

SEQ ID NO: 533363 - RNA, 15 nt, Homo sapiens
auguugguguuccac

SEQ ID NO: 533364 - RNA, 18 nt, Homo sapiens
auguugguuuuaauacuu

SEQ ID NO: 533365 - RNA, 22 nt, Homo sapiens
auguuguguggcaaugggauuu

SEQ ID NO: 533366 - RNA, 14 nt, Homo sapiens
auguuuaaagauca

SEQ ID NO: 533367 - RNA, 23 nt, Homo sapiens
auguuuacuaaguggacuggugu

SEQ ID NO: 533368 - RNA, 19 nt, Homo sapiens
auguuuagaaaaguauucg

SEQ ID NO: 533369 - RNA, 16 nt, Homo sapiens
auguuuaguuuuacau

SEQ ID NO: 533370 - RNA, 15 nt, Homo sapiens
auguuuaugagccag

SEQ ID NO: 533371 - RNA, 18 nt, Homo sapiens
auguuucagaagcauuca

SEQ ID NO: 533372 - RNA, 20 nt, Homo sapiens
auguuucagagcucaccagg

SEQ ID NO: 533373 - RNA, 22 nt, Homo sapiens
auguuuccauuuuuuucuaaug

SEQ ID NO: 533374 - RNA, 14 nt, Homo sapiens
auguuuccucucaa

SEQ ID NO: 533375 - RNA, 12 nt, Homo sapiens
auguuuccuuaa

SEQ ID NO: 533376 - RNA, 19 nt, Homo sapiens
auguuucgcugauauaugu

SEQ ID NO: 533377 - RNA, 19 nt, Homo sapiens
auguuuggaauaaagucaa

SEQ ID NO: 533378 - RNA, 22 nt, Homo sapiens
auguuuggggaucgaugugcuc

SEQ ID NO: 533379 - RNA, 23 nt, Homo sapiens
auguuuguaauaauugcucauaa

SEQ ID NO: 533380 - RNA, 16 nt, Homo sapiens
auguuuguccugaaca

SEQ ID NO: 533381 - RNA, 16 nt, Homo sapiens
auguuugucucauccc

SEQ ID NO: 533382 - RNA, 23 nt, Homo sapiens
auguuugucuuuuaaugcuucau

SEQ ID NO: 533383 - RNA, 17 nt, Homo sapiens
auguuuguggccucaga

SEQ ID NO: 533384 - RNA, 18 nt, Homo sapiens
auguuuuaagaagcauuu

SEQ ID NO: 533385 - RNA, 13 nt, Homo sapiens
auguuuuauauca

SEQ ID NO: 533386 - RNA, 16 nt, Homo sapiens
auguuuuauuuugcca

SEQ ID NO: 533387 - RNA, 22 nt, Homo sapiens
auguuuucagugcugugucauu

SEQ ID NO: 533388 - RNA, 21 nt, Homo sapiens
auguuuucuagucacuuccuc

SEQ ID NO: 533389 - RNA, 15 nt, Homo sapiens
auguuuucucuaaga

SEQ ID NO: 533390 - RNA, 14 nt, Homo sapiens
auguuuucuuaagc

SEQ ID NO: 533391 - RNA, 16 nt, Homo sapiens
auguuuugaaugugga

SEQ ID NO: 533392 - RNA, 14 nt, Homo sapiens
auguuuugcucaau

SEQ ID NO: 533393 - RNA, 15 nt, Homo sapiens
auguuuuugacucuu

SEQ ID NO: 533394 - RNA, 23 nt, Homo sapiens
auguuuuuggaaacuaguggcaa

SEQ ID NO: 533395 - RNA, 15 nt, Homo sapiens
auuaaaaaaauucca

SEQ ID NO: 533396 - RNA, 17 nt, Homo sapiens
auuaaaaaaucagagaa

SEQ ID NO: 533397 - RNA, 14 nt, Homo sapiens
auuaaaaacuacca

SEQ ID NO: 533398 - RNA, 13 nt, Homo sapiens
auuaaaacacuua

SEQ ID NO: 533399 - RNA, 16 nt, Homo sapiens
auuaaaacacuuucaa

SEQ ID NO: 533400 - RNA, 12 nt, Homo sapiens
auuaaaacauua

SEQ ID NO: 533401 - RNA, 12 nt, Homo sapiens
auuaaaacucau

SEQ ID NO: 533402 - RNA, 19 nt, Homo sapiens
auuaaaagaauaucuggca

SEQ ID NO: 533403 - RNA, 17 nt, Homo sapiens
auuaaaagcaaaucauu

SEQ ID NO: 533404 - RNA, 21 nt, Homo sapiens
auuaaaauaaaacaagccuua

SEQ ID NO: 533405 - RNA, 20 nt, Homo sapiens
auuaaaauagcauacugugu

SEQ ID NO: 533406 - RNA, 18 nt, Homo sapiens
auuaaaaucacucucagu

SEQ ID NO: 533407 - RNA, 20 nt, Homo sapiens
auuaaaaucacugucaauau

SEQ ID NO: 533408 - RNA, 17 nt, Homo sapiens
auuaaaaugaauuucuu

SEQ ID NO: 533409 - RNA, 20 nt, Homo sapiens
auuaaaaugacaagcacuau

SEQ ID NO: 533410 - RNA, 16 nt, Homo sapiens
auuaaaaugagugaaa

SEQ ID NO: 533411 - RNA, 21 nt, Homo sapiens
auuaaaauguaaaacuccauu

SEQ ID NO: 533412 - RNA, 22 nt, Homo sapiens
auuaaaaugucggauuuaucuu

SEQ ID NO: 533413 - RNA, 12 nt, Homo sapiens
auuaaacacugu

SEQ ID NO: 533414 - RNA, 14 nt, Homo sapiens
auuaaacacuguaa

SEQ ID NO: 533415 - RNA, 16 nt, Homo sapiens
auuaaacaugcuguua

SEQ ID NO: 533416 - RNA, 14 nt, Homo sapiens
auuaaagacagagg

SEQ ID NO: 533417 - RNA, 20 nt, Homo sapiens
auuaaagaugaccuacagug

SEQ ID NO: 533418 - RNA, 13 nt, Homo sapiens
auuaaagaugcca

SEQ ID NO: 533419 - RNA, 15 nt, Homo sapiens
auuaaagcaguaaua

SEQ ID NO: 533420 - RNA, 18 nt, Homo sapiens
auuaaaguuaauagaacu

SEQ ID NO: 533421 - RNA, 13 nt, Homo sapiens
auuaaaguuauaa

SEQ ID NO: 533422 - RNA, 16 nt, Homo sapiens
auuaaauagugugaug

SEQ ID NO: 533423 - RNA, 14 nt, Homo sapiens
auuaaauccaauaa

SEQ ID NO: 533424 - RNA, 19 nt, Homo sapiens
auuaaauggaauaauauga

SEQ ID NO: 533425 - RNA, 16 nt, Homo sapiens
auuaaauuagauaucu

SEQ ID NO: 533426 - RNA, 13 nt, Homo sapiens
auuaaauuaggaa

SEQ ID NO: 533427 - RNA, 14 nt, Homo sapiens
auuaaauucacaaa

SEQ ID NO: 533428 - RNA, 17 nt, Homo sapiens
auuaaauucacaaacuu

SEQ ID NO: 533429 - RNA, 12 nt, Homo sapiens
auuaacaauuaa

SEQ ID NO: 533430 - RNA, 14 nt, Homo sapiens
auuaacaguauaau

SEQ ID NO: 533431 - RNA, 13 nt, Homo sapiens
auuaaccuaauca

SEQ ID NO: 533432 - RNA, 13 nt, Homo sapiens
auuaaccugguca

SEQ ID NO: 533433 - RNA, 14 nt, Homo sapiens
auuaaccuggugcu

SEQ ID NO: 533434 - RNA, 22 nt, Homo sapiens
auuaaccuuacuaauuauacua

SEQ ID NO: 533435 - RNA, 20 nt, Homo sapiens
auuaacugcacaaacaauau

SEQ ID NO: 533436 - RNA, 15 nt, Homo sapiens
auuaacuuacuucca

SEQ ID NO: 533437 - RNA, 11 nt, Homo sapiens
auuaacuuuau

SEQ ID NO: 533438 - RNA, 14 nt, Homo sapiens
auuaagaagcaaua

SEQ ID NO: 533439 - RNA, 17 nt, Homo sapiens
auuaagacaacugaguu

SEQ ID NO: 533440 - RNA, 18 nt, Homo sapiens
auuaagacuuuauguagu

SEQ ID NO: 533441 - RNA, 19 nt, Homo sapiens
auuaagacuuuauguaguu

SEQ ID NO: 533442 - RNA, 17 nt, Homo sapiens
auuaagagauugccauu

SEQ ID NO: 533443 - RNA, 18 nt, Homo sapiens
auuaagagguaagacuua

SEQ ID NO: 533444 - RNA, 21 nt, Homo sapiens
auuaagauccuaaacucucua

SEQ ID NO: 533445 - RNA, 23 nt, Homo sapiens
auuaagcagaaauccugcaauga

SEQ ID NO: 533446 - RNA, 12 nt, Homo sapiens
auuaagcaugaa

SEQ ID NO: 533447 - RNA, 24 nt, Homo sapiens
auuaaggccuuuuccacacgcauu

SEQ ID NO: 533448 - RNA, 10 nt, Homo sapiens
auuaaggguu

SEQ ID NO: 533449 - RNA, 16 nt, Homo sapiens
auuaagguaacuacug

SEQ ID NO: 533450 - RNA, 22 nt, Homo sapiens
auuaagugacuauagaaugcaa

SEQ ID NO: 533451 - RNA, 21 nt, Homo sapiens
auuaagugggguagacugagg

SEQ ID NO: 533452 - RNA, 13 nt, Homo sapiens
auuaauacauucu

SEQ ID NO: 533453 - RNA, 23 nt, Homo sapiens
auuaauacucugcagugauuaga

SEQ ID NO: 533454 - RNA, 18 nt, Homo sapiens
auuaauagcuuuugauua

SEQ ID NO: 533455 - RNA, 13 nt, Homo sapiens
auuaauaguucag

SEQ ID NO: 533456 - RNA, 15 nt, Homo sapiens
auuaauaucauuuau

SEQ ID NO: 533457 - RNA, 18 nt, Homo sapiens
auuaauauccaagacuua

SEQ ID NO: 533458 - RNA, 21 nt, Homo sapiens
auuaauauugcagucaaucuc

SEQ ID NO: 533459 - RNA, 13 nt, Homo sapiens
auuaauauuugcu

SEQ ID NO: 533460 - RNA, 21 nt, Homo sapiens
auuaaucaagacucuugaaga

SEQ ID NO: 533461 - RNA, 14 nt, Homo sapiens
auuaaucaccucuc

SEQ ID NO: 533462 - RNA, 17 nt, Homo sapiens
auuaaugcacaucugca

SEQ ID NO: 533463 - RNA, 20 nt, Homo sapiens
auuaauguuuacaguggaau

SEQ ID NO: 533464 - RNA, 16 nt, Homo sapiens
auuaauuaauauucau

SEQ ID NO: 533465 - RNA, 18 nt, Homo sapiens
auuaauuacuucacuaua

SEQ ID NO: 533466 - RNA, 19 nt, Homo sapiens
auuaauuguuuugcacuuu

SEQ ID NO: 533467 - RNA, 22 nt, Homo sapiens
auuaauuucuucccccaaagcc

SEQ ID NO: 533468 - RNA, 17 nt, Homo sapiens
auuaauuugacugugca

SEQ ID NO: 533469 - RNA, 23 nt, Homo sapiens
auuaauuuuuaaggauguugcca

SEQ ID NO: 533470 - RNA, 16 nt, Homo sapiens
auuaauuuuuccauaa

SEQ ID NO: 533471 - RNA, 16 nt, Homo sapiens
auuacaaaaaaacacg

SEQ ID NO: 533472 - RNA, 14 nt, Homo sapiens
auuacaaauuuuca

SEQ ID NO: 533473 - RNA, 22 nt, Homo sapiens
auuacaaccacagaaagcacuc

SEQ ID NO: 533474 - RNA, 15 nt, Homo sapiens
auuacaaccauauau

SEQ ID NO: 533475 - RNA, 18 nt, Homo sapiens
auuacaagaucuuuccaa

SEQ ID NO: 533476 - RNA, 21 nt, Homo sapiens
auuacaagaucuuuccaaaua

SEQ ID NO: 533477 - RNA, 22 nt, Homo sapiens
auuacaagcuguagaccaccua

SEQ ID NO: 533478 - RNA, 22 nt, Homo sapiens
auuacaaggcuuuaucucaggg

SEQ ID NO: 533479 - RNA, 22 nt, Homo sapiens
auuacacugaucuuauguguua

SEQ ID NO: 533480 - RNA, 15 nt, Homo sapiens
auuacaggcaccugc

SEQ ID NO: 533481 - RNA, 16 nt, Homo sapiens
auuacaggcacgugcc

SEQ ID NO: 533482 - RNA, 16 nt, Homo sapiens
auuacaggcaugagcu

SEQ ID NO: 533483 - RNA, 23 nt, Homo sapiens
auuacaggcuugagccuccaugc

SEQ ID NO: 533484 - RNA, 16 nt, Homo sapiens
auuaccaaaaucauuu

SEQ ID NO: 533485 - RNA, 15 nt, Homo sapiens
auuaccagacaaaaa

SEQ ID NO: 533486 - RNA, 12 nt, Homo sapiens
auuacccuccua

SEQ ID NO: 533487 - RNA, 15 nt, Homo sapiens
auuacccuuuugcag

SEQ ID NO: 533488 - RNA, 17 nt, Homo sapiens
auuaccucugauaccuc

SEQ ID NO: 533489 - RNA, 23 nt, Homo sapiens
auuaccuguggaguugcauaucc

SEQ ID NO: 533490 - RNA, 16 nt, Homo sapiens
auuacuacacuggugu

SEQ ID NO: 533491 - RNA, 23 nt, Homo sapiens
augauggucugcauuagucucau

SEQ ID NO: 533492 - RNA, 16 nt, Homo sapiens
augauguauuguugcu

SEQ ID NO: 533493 - RNA, 17 nt, Homo sapiens
augaugucacacaagcu

SEQ ID NO: 533494 - RNA, 15 nt, Homo sapiens
augauguuugcccaa

SEQ ID NO: 533495 - RNA, 14 nt, Homo sapiens
augauuauauucac

SEQ ID NO: 533496 - RNA, 18 nt, Homo sapiens
augauucaaauugcugcu

SEQ ID NO: 533497 - RNA, 19 nt, Homo sapiens
augauucagaaauuuucau

SEQ ID NO: 533498 - RNA, 14 nt, Homo sapiens
augauucucugugg

SEQ ID NO: 533499 - RNA, 21 nt, Homo sapiens
augauugaaaauaaugcuguu

SEQ ID NO: 533500 - RNA, 17 nt, Homo sapiens
augauuguuauguguau

SEQ ID NO: 533501 - RNA, 16 nt, Homo sapiens
augauuuaauguugau

SEQ ID NO: 533502 - RNA, 20 nt, Homo sapiens
augauuucauuaucacauga

SEQ ID NO: 533503 - RNA, 17 nt, Homo sapiens
augauuuccuaguagaa

SEQ ID NO: 533504 - RNA, 13 nt, Homo sapiens
augauuucuagca

SEQ ID NO: 533505 - RNA, 14 nt, Homo sapiens
augauuuguggaaa

SEQ ID NO: 533506 - RNA, 18 nt, Homo sapiens
augauuuuaagaggcuuu

SEQ ID NO: 533507 - RNA, 21 nt, Homo sapiens
augauuuuaaguuucucugca

SEQ ID NO: 533508 - RNA, 14 nt, Homo sapiens
augauuuuauuuga

SEQ ID NO: 533509 - RNA, 15 nt, Homo sapiens
augauuuugaaguca

SEQ ID NO: 533510 - RNA, 17 nt, Homo sapiens
augauuuugcuuuccaa

SEQ ID NO: 533511 - RNA, 14 nt, Homo sapiens
augcaaaagcacau

SEQ ID NO: 533512 - RNA, 20 nt, Homo sapiens
augcaaaagucagcgugaca

SEQ ID NO: 533513 - RNA, 14 nt, Homo sapiens
augcaaagaugaac

SEQ ID NO: 533514 - RNA, 14 nt, Homo sapiens
augcaaagcacucu

SEQ ID NO: 533515 - RNA, 15 nt, Homo sapiens
augcaaaguagcaau

SEQ ID NO: 533516 - RNA, 13 nt, Homo sapiens
augcaaaugcuca

SEQ ID NO: 533517 - RNA, 13 nt, Homo sapiens
augcaaccaacua

SEQ ID NO: 533518 - RNA, 24 nt, Homo sapiens
augcaaccuuuggaugcacuuuau

SEQ ID NO: 533519 - RNA, 13 nt, Homo sapiens
augcaacucaucu

SEQ ID NO: 533520 - RNA, 18 nt, Homo sapiens
augcaagacacugugcca

SEQ ID NO: 533521 - RNA, 18 nt, Homo sapiens
augcaagaguggacugaa

SEQ ID NO: 533522 - RNA, 22 nt, Homo sapiens
augcaaggaaggaaagaaagaa

SEQ ID NO: 533523 - RNA, 19 nt, Homo sapiens
augcaagguauuucuccag

SEQ ID NO: 533524 - RNA, 16 nt, Homo sapiens
augcaaguauccugcg

SEQ ID NO: 533525 - RNA, 12 nt, Homo sapiens
augcaagugcaa

SEQ ID NO: 533526 - RNA, 14 nt, Homo sapiens
augcaagugcaaaa

SEQ ID NO: 533527 - RNA, 20 nt, Homo sapiens
augcaagugguuuccuggug

SEQ ID NO: 533528 - RNA, 22 nt, Homo sapiens
augcaagugguuuccuggugcu

SEQ ID NO: 533529 - RNA, 15 nt, Homo sapiens
augcaaucagacaag

SEQ ID NO: 533530 - RNA, 20 nt, Homo sapiens
augcaauuuaaaauuauuca

SEQ ID NO: 533531 - RNA, 16 nt, Homo sapiens
augcaauuuuucaaga

SEQ ID NO: 533532 - RNA, 17 nt, Homo sapiens
augcaauuuuucaagag

SEQ ID NO: 533533 - RNA, 17 nt, Homo sapiens
augcacaaaacuacuuu

SEQ ID NO: 533534 - RNA, 20 nt, Homo sapiens
augcacacacacacaucuca

SEQ ID NO: 533535 - RNA, 15 nt, Homo sapiens
augcacacacauaua

SEQ ID NO: 533536 - RNA, 13 nt, Homo sapiens
augcacacagaua

SEQ ID NO: 533537 - RNA, 22 nt, Homo sapiens
augcacaguaucuuuucuuuca

SEQ ID NO: 533538 - RNA, 16 nt, Homo sapiens
augcacagugcauuau

SEQ ID NO: 533539 - RNA, 12 nt, Homo sapiens
augcacaguggg

SEQ ID NO: 533540 - RNA, 17 nt, Homo sapiens
augcacauagcuaucaa

SEQ ID NO: 533541 - RNA, 17 nt, Homo sapiens
augcacauauacacauu

SEQ ID NO: 533542 - RNA, 13 nt, Homo sapiens
augcacaucucau

SEQ ID NO: 533543 - RNA, 12 nt, Homo sapiens
augcacauuucu

SEQ ID NO: 533544 - RNA, 18 nt, Homo sapiens
augcaccuagcugugcaa

SEQ ID NO: 533545 - RNA, 22 nt, Homo sapiens
augcacguggggcccacugcuc

SEQ ID NO: 533546 - RNA, 20 nt, Homo sapiens
augcacucgugugagacaag

SEQ ID NO: 533547 - RNA, 11 nt, Homo sapiens
augcacugagg

SEQ ID NO: 533548 - RNA, 21 nt, Homo sapiens
augcacuuaaguuagccucca

SEQ ID NO: 533549 - RNA, 16 nt, Homo sapiens
augcacuuauucaaua

SEQ ID NO: 533550 - RNA, 18 nt, Homo sapiens
augcacuugaaaugaugg

SEQ ID NO: 533551 - RNA, 17 nt, Homo sapiens
augcacuuucccuagaa

SEQ ID NO: 533552 - RNA, 21 nt, Homo sapiens
augcagaaauauuugugacaa

SEQ ID NO: 533553 - RNA, 17 nt, Homo sapiens
augcagaaccacaaaca

SEQ ID NO: 533554 - RNA, 20 nt, Homo sapiens
augcagaagcauauuuugcu

SEQ ID NO: 533555 - RNA, 18 nt, Homo sapiens
augcagaauggcauuugc

SEQ ID NO: 533556 - RNA, 19 nt, Homo sapiens
augcagaccucaugcccag

SEQ ID NO: 533557 - RNA, 13 nt, Homo sapiens
augcagagaagaa

SEQ ID NO: 533558 - RNA, 15 nt, Homo sapiens
augcagagaagaaua

SEQ ID NO: 533559 - RNA, 17 nt, Homo sapiens
augcagagccacagcug

SEQ ID NO: 533560 - RNA, 23 nt, Homo sapiens
augcagagggugggguacuggag

SEQ ID NO: 533561 - RNA, 17 nt, Homo sapiens
augcagauuacacugau

SEQ ID NO: 533562 - RNA, 19 nt, Homo sapiens
augcagcaccucucaggau

SEQ ID NO: 533563 - RNA, 20 nt, Homo sapiens
augcagccagccaucaaaua

SEQ ID NO: 533564 - RNA, 16 nt, Homo sapiens
augcagcuacuggaau

SEQ ID NO: 533565 - RNA, 23 nt, Homo sapiens
augcaggcccuuugaagccucag

SEQ ID NO: 533566 - RNA, 12 nt, Homo sapiens
augcaggggaug

SEQ ID NO: 533567 - RNA, 18 nt, Homo sapiens
augcaggugaugccauua

SEQ ID NO: 533568 - RNA, 19 nt, Homo sapiens
augcaguacaggacauaua

SEQ ID NO: 533569 - RNA, 20 nt, Homo sapiens
augcaguccucaucuccagc

SEQ ID NO: 533570 - RNA, 14 nt, Homo sapiens
augcagugcccuca

SEQ ID NO: 533571 - RNA, 22 nt, Homo sapiens
augcagugccggcugccaagac

SEQ ID NO: 533572 - RNA, 16 nt, Homo sapiens
augcaguuccaaucaa

SEQ ID NO: 533573 - RNA, 14 nt, Homo sapiens
augcaugucuuaaa

SEQ ID NO: 533574 - RNA, 20 nt, Homo sapiens
augcaugugcugucuccaug

SEQ ID NO: 533575 - RNA, 23 nt, Homo sapiens
augcauuauuuauugcuguguaa

SEQ ID NO: 533576 - RNA, 15 nt, Homo sapiens
augcauuuaauaaag

SEQ ID NO: 533577 - RNA, 14 nt, Homo sapiens
augccaaacacuag

SEQ ID NO: 533578 - RNA, 15 nt, Homo sapiens
augccaaacacuagc

SEQ ID NO: 533579 - RNA, 18 nt, Homo sapiens
augccaaccggucaccca

SEQ ID NO: 533580 - RNA, 21 nt, Homo sapiens
augccaaccggucacccagga

SEQ ID NO: 533581 - RNA, 19 nt, Homo sapiens
augccaauaaagugaucug

SEQ ID NO: 533582 - RNA, 21 nt, Homo sapiens
augccaauaaaguuugcccau

SEQ ID NO: 533583 - RNA, 16 nt, Homo sapiens
augccacaaaacugac

SEQ ID NO: 533584 - RNA, 19 nt, Homo sapiens
augccacagaauuugcuaa

SEQ ID NO: 533585 - RNA, 19 nt, Homo sapiens
augccaccaacuuacaaaa

SEQ ID NO: 533586 - RNA, 18 nt, Homo sapiens
augccacgcacuuccucu

SEQ ID NO: 533587 - RNA, 17 nt, Homo sapiens
augccacucccuaccca

SEQ ID NO: 533588 - RNA, 12 nt, Homo sapiens
augccacuccuc

SEQ ID NO: 533589 - RNA, 23 nt, Homo sapiens
augccacuuccuuuuaacugcca

SEQ ID NO: 533590 - RNA, 14 nt, Homo sapiens
augccacuuugcag

SEQ ID NO: 533591 - RNA, 22 nt, Homo sapiens
augccagcucagucccaucaga

SEQ ID NO: 533592 - RNA, 16 nt, Homo sapiens
augccagcuuaucuca

SEQ ID NO: 533593 - RNA, 17 nt, Homo sapiens
augccagcuuaucucag

SEQ ID NO: 533594 - RNA, 19 nt, Homo sapiens
augccagggacugacaaaa

SEQ ID NO: 533595 - RNA, 22 nt, Homo sapiens
augccagggcuggaagcuuuca

SEQ ID NO: 533596 - RNA, 19 nt, Homo sapiens
augccagugacacuuccag

SEQ ID NO: 533597 - RNA, 15 nt, Homo sapiens
augccauagcaagau

SEQ ID NO: 533598 - RNA, 23 nt, Homo sapiens
augccauagcaagauugcuuaaa

SEQ ID NO: 533599 - RNA, 16 nt, Homo sapiens
augccauauacaaaaa

SEQ ID NO: 533600 - RNA, 13 nt, Homo sapiens
augccaucuguuu

SEQ ID NO: 533601 - RNA, 13 nt, Homo sapiens
augccauucuucc

SEQ ID NO: 533602 - RNA, 21 nt, Homo sapiens
augcccacaacuugucaccca

SEQ ID NO: 533603 - RNA, 16 nt, Homo sapiens
augcccacauacccac

SEQ ID NO: 533604 - RNA, 20 nt, Homo sapiens
augccccgaauuuagucaca

SEQ ID NO: 533605 - RNA, 18 nt, Homo sapiens
augccccugacaucauca

SEQ ID NO: 533606 - RNA, 17 nt, Homo sapiens
augcccucaaucccagc

SEQ ID NO: 533607 - RNA, 18 nt, Homo sapiens
augcccucauaaaccaau

SEQ ID NO: 533608 - RNA, 21 nt, Homo sapiens
augcccuccaauccuuuccac

SEQ ID NO: 533609 - RNA, 16 nt, Homo sapiens
augcccuccaugugua

SEQ ID NO: 533610 - RNA, 19 nt, Homo sapiens
augcccugugcaaccucuu

SEQ ID NO: 533611 - RNA, 17 nt, Homo sapiens
augcccugugcaugcca

SEQ ID NO: 533612 - RNA, 22 nt, Homo sapiens
augccgauauacucuagaugaa

SEQ ID NO: 533613 - RNA, 14 nt, Homo sapiens
ccucugcaacugca

SEQ ID NO: 533614 - RNA, 23 nt, Homo sapiens
ccucugccaaaggaugugauaua

SEQ ID NO: 533615 - RNA, 24 nt, Homo sapiens
ccucugcccuccgaggccgugcag

SEQ ID NO: 533616 - RNA, 18 nt, Homo sapiens
ccucugcuaagguguauu

SEQ ID NO: 533617 - RNA, 19 nt, Homo sapiens
ccucugcugagugcugggc

SEQ ID NO: 533618 - RNA, 14 nt, Homo sapiens
ccucugcugccaug

SEQ ID NO: 533619 - RNA, 18 nt, Homo sapiens
ccucugcuguagcuuaug

SEQ ID NO: 533620 - RNA, 15 nt, Homo sapiens
ccucugcuuacuuuu

SEQ ID NO: 533621 - RNA, 15 nt, Homo sapiens
ccucuggacagccag

SEQ ID NO: 533622 - RNA, 19 nt, Homo sapiens
ccucuggcaaguagcuuuc

SEQ ID NO: 533623 - RNA, 18 nt, Homo sapiens
ccucuggccaaauaugca

SEQ ID NO: 533624 - RNA, 16 nt, Homo sapiens
ccucugggaaccuccc

SEQ ID NO: 533625 - RNA, 21 nt, Homo sapiens
ccucugguucugacacuuucu

SEQ ID NO: 533626 - RNA, 22 nt, Homo sapiens
ccucugguucugacacuuucug

SEQ ID NO: 533627 - RNA, 20 nt, Homo sapiens
ccucuguauuaguuuuugau

SEQ ID NO: 533628 - RNA, 19 nt, Homo sapiens
ccucugucagucacagcca

SEQ ID NO: 533629 - RNA, 20 nt, Homo sapiens
ccucugucagucacagccac

SEQ ID NO: 533630 - RNA, 21 nt, Homo sapiens
ccucugucauucgcucccaca

SEQ ID NO: 533631 - RNA, 18 nt, Homo sapiens
ccucuguccaggcacuga

SEQ ID NO: 533632 - RNA, 19 nt, Homo sapiens
ccucugucuaccugggaga

SEQ ID NO: 533633 - RNA, 14 nt, Homo sapiens
ccucuguggucaca

SEQ ID NO: 533634 - RNA, 21 nt, Homo sapiens
ccucuguucugcacacagcac

SEQ ID NO: 533635 - RNA, 17 nt, Homo sapiens
ccucuguuuacaucucc

SEQ ID NO: 533636 - RNA, 23 nt, Homo sapiens
ccucuuaagaucugacugccaaa

SEQ ID NO: 533637 - RNA, 14 nt, Homo sapiens
ccucuuacuuugcu

SEQ ID NO: 533638 - RNA, 14 nt, Homo sapiens
ccucuuauugcaaa

SEQ ID NO: 533639 - RNA, 15 nt, Homo sapiens
ccucuucccaugacu

SEQ ID NO: 533640 - RNA, 14 nt, Homo sapiens
ccucuuccccagaa

SEQ ID NO: 533641 - RNA, 22 nt, Homo sapiens
ccucuuccccagaaaggagacu

SEQ ID NO: 533642 - RNA, 18 nt, Homo sapiens
ccucuuccccuugcccuu

SEQ ID NO: 533643 - RNA, 15 nt, Homo sapiens
ccucuucccucugau

SEQ ID NO: 533644 - RNA, 22 nt, Homo sapiens
ccucuucccuuccuccauugca

SEQ ID NO: 533645 - RNA, 21 nt, Homo sapiens
ccucuuccgugacgucacugg

SEQ ID NO: 533646 - RNA, 21 nt, Homo sapiens
ccucuucucuacucuagggaa

SEQ ID NO: 533647 - RNA, 16 nt, Homo sapiens
ccucuucucuccucag

SEQ ID NO: 533648 - RNA, 19 nt, Homo sapiens
ccucuucugacgugccuuu

SEQ ID NO: 533649 - RNA, 20 nt, Homo sapiens
ccucuucugggcuacugcca

SEQ ID NO: 533650 - RNA, 17 nt, Homo sapiens
ccucuugccauccugau

SEQ ID NO: 533651 - RNA, 21 nt, Homo sapiens
ccucuuggaccucugcucuga

SEQ ID NO: 533652 - RNA, 15 nt, Homo sapiens
ccucuuggugggugu

SEQ ID NO: 533653 - RNA, 22 nt, Homo sapiens
ccucuuggugugauugcacaga

SEQ ID NO: 533654 - RNA, 13 nt, Homo sapiens
ccucuuugcuuug

SEQ ID NO: 533655 - RNA, 22 nt, Homo sapiens
ccucuuugucauaccuuuggau

SEQ ID NO: 533656 - RNA, 18 nt, Homo sapiens
ccucuuuucucugugcuu

SEQ ID NO: 533657 - RNA, 21 nt, Homo sapiens
ccucuuuugagacuuugccca

SEQ ID NO: 533658 - RNA, 17 nt, Homo sapiens
ccucuuuuuagggcuaa

SEQ ID NO: 533659 - RNA, 20 nt, Homo sapiens
ccucuuuuuccuccuggaca

SEQ ID NO: 533660 - RNA, 13 nt, Homo sapiens
ccugaaacacgaa

SEQ ID NO: 533661 - RNA, 14 nt, Homo sapiens
ccugaaagauacag

SEQ ID NO: 533662 - RNA, 19 nt, Homo sapiens
ccugaaagccacaaugaga

SEQ ID NO: 533663 - RNA, 12 nt, Homo sapiens
ccugaaagccau

SEQ ID NO: 533664 - RNA, 19 nt, Homo sapiens
ccugaaauuguauaguguu

SEQ ID NO: 533665 - RNA, 18 nt, Homo sapiens
ccugaaauuuauucacau

SEQ ID NO: 533666 - RNA, 18 nt, Homo sapiens
ccugaacccguccauuca

SEQ ID NO: 533667 - RNA, 21 nt, Homo sapiens
ccugaacguuuucuucuuucc

SEQ ID NO: 533668 - RNA, 14 nt, Homo sapiens
ccugaacuccagag

SEQ ID NO: 533669 - RNA, 16 nt, Homo sapiens
ccugaacuuacacaaa

SEQ ID NO: 533670 - RNA, 16 nt, Homo sapiens
ccugaagaacugucua

SEQ ID NO: 533671 - RNA, 13 nt, Homo sapiens
ccugaagacugag

SEQ ID NO: 533672 - RNA, 24 nt, Homo sapiens
ccugaagacugaggacaaagugga

SEQ ID NO: 533673 - RNA, 19 nt, Homo sapiens
ccugaagaucaagccaguu

SEQ ID NO: 533674 - RNA, 18 nt, Homo sapiens
ccugaagcccucugucua

SEQ ID NO: 533675 - RNA, 18 nt, Homo sapiens
ccugaaguuggagugagu

SEQ ID NO: 533676 - RNA, 19 nt, Homo sapiens
ccugaaucaaggaaagcca

SEQ ID NO: 533677 - RNA, 21 nt, Homo sapiens
ccugaauguauuaaaaacuaa

SEQ ID NO: 533678 - RNA, 22 nt, Homo sapiens
ccugaauucuuuuucauuugag

SEQ ID NO: 533679 - RNA, 14 nt, Homo sapiens
ccugacaaccacug

SEQ ID NO: 533680 - RNA, 18 nt, Homo sapiens
ccugacaaguuauuacug

SEQ ID NO: 533681 - RNA, 18 nt, Homo sapiens
ccugacagaaggacucag

SEQ ID NO: 533682 - RNA, 20 nt, Homo sapiens
ccugacauauucaagugaua

SEQ ID NO: 533683 - RNA, 18 nt, Homo sapiens
ccugacccguuugcuaca

SEQ ID NO: 533684 - RNA, 16 nt, Homo sapiens
ccugaccgguuugcua

SEQ ID NO: 533685 - RNA, 12 nt, Homo sapiens
ccugaccucacu

SEQ ID NO: 533686 - RNA, 19 nt, Homo sapiens
ccugaccuccauaugcugu

SEQ ID NO: 533687 - RNA, 16 nt, Homo sapiens
ccugacggugggccug

SEQ ID NO: 533688 - RNA, 16 nt, Homo sapiens
ccugacucacacuuac

SEQ ID NO: 533689 - RNA, 13 nt, Homo sapiens
ccugacugguugu

SEQ ID NO: 533690 - RNA, 22 nt, Homo sapiens
ccugacugguugucagaaugga

SEQ ID NO: 533691 - RNA, 17 nt, Homo sapiens
ccugacuguaaaugcuc

SEQ ID NO: 533692 - RNA, 13 nt, Homo sapiens
ccugacuuccucu

SEQ ID NO: 533693 - RNA, 13 nt, Homo sapiens
ccugagaccaguu

SEQ ID NO: 533694 - RNA, 15 nt, Homo sapiens
auugauuacaaauaa

SEQ ID NO: 533695 - RNA, 18 nt, Homo sapiens
auugauuagauaaagauu

SEQ ID NO: 533696 - RNA, 20 nt, Homo sapiens
auugauucacuuacugacuu

SEQ ID NO: 533697 - RNA, 13 nt, Homo sapiens
auugauuccacau

SEQ ID NO: 533698 - RNA, 23 nt, Homo sapiens
auugauuuggggauguuugcccc

SEQ ID NO: 533699 - RNA, 15 nt, Homo sapiens
auugcaaagguucca

SEQ ID NO: 533700 - RNA, 22 nt, Homo sapiens
auugcaacucuuuuaagugccu

SEQ ID NO: 533701 - RNA, 19 nt, Homo sapiens
auugcaauaaauggcuuga

SEQ ID NO: 533702 - RNA, 13 nt, Homo sapiens
auugcacaaguuc

SEQ ID NO: 533703 - RNA, 16 nt, Homo sapiens
auugcacauuguucaa

SEQ ID NO: 533704 - RNA, 20 nt, Homo sapiens
auugcaccuaucucagccau

SEQ ID NO: 533705 - RNA, 13 nt, Homo sapiens
auugcacucauca

SEQ ID NO: 533706 - RNA, 19 nt, Homo sapiens
auugcacuuuuaaaccucu

SEQ ID NO: 533707 - RNA, 20 nt, Homo sapiens
auugcagauaacuuugacuu

SEQ ID NO: 533708 - RNA, 21 nt, Homo sapiens
auugcagcauuuauguuagag

SEQ ID NO: 533709 - RNA, 13 nt, Homo sapiens
auugcaggucucu

SEQ ID NO: 533710 - RNA, 15 nt, Homo sapiens
auugcaugacaaacc

SEQ ID NO: 533711 - RNA, 16 nt, Homo sapiens
auugcaugcugauaau

SEQ ID NO: 533712 - RNA, 18 nt, Homo sapiens
auugcauuuaaguucccu

SEQ ID NO: 533713 - RNA, 13 nt, Homo sapiens
auugccaaccagu

SEQ ID NO: 533714 - RNA, 23 nt, Homo sapiens
auugccacagcucaacucggggg

SEQ ID NO: 533715 - RNA, 20 nt, Homo sapiens
auugccaccaggagaaccac

SEQ ID NO: 533716 - RNA, 19 nt, Homo sapiens
auugccacggaaacauaca

SEQ ID NO: 533717 - RNA, 12 nt, Homo sapiens
auugccaucacu

SEQ ID NO: 533718 - RNA, 19 nt, Homo sapiens
auugcccauccaucugcuu

SEQ ID NO: 533719 - RNA, 18 nt, Homo sapiens
auugccuaaaucuccagu

SEQ ID NO: 533720 - RNA, 24 nt, Homo sapiens
auugccuguucugcuucgaaguau

SEQ ID NO: 533721 - RNA, 16 nt, Homo sapiens
auugccuuuccagggu

SEQ ID NO: 533722 - RNA, 20 nt, Homo sapiens
auugcgccauugcacuccag

SEQ ID NO: 533723 - RNA, 17 nt, Homo sapiens
auugcuaugaaugauac

SEQ ID NO: 533724 - RNA, 22 nt, Homo sapiens
auugcuaugaaugauacccuga

SEQ ID NO: 533725 - RNA, 20 nt, Homo sapiens
auugcucugccccaccuugc

SEQ ID NO: 533726 - RNA, 16 nt, Homo sapiens
auugcucuugagucuu

SEQ ID NO: 533727 - RNA, 14 nt, Homo sapiens
auugcugaacucuu

SEQ ID NO: 533728 - RNA, 16 nt, Homo sapiens
auugcugauaugcaag

SEQ ID NO: 533729 - RNA, 16 nt, Homo sapiens
auugcugcaaaccaca

SEQ ID NO: 533730 - RNA, 17 nt, Homo sapiens
auugcugccaaggugga

SEQ ID NO: 533731 - RNA, 13 nt, Homo sapiens
auugcugcucucu

SEQ ID NO: 533732 - RNA, 23 nt, Homo sapiens
auugcuugagccuggcuguccaa

SEQ ID NO: 533733 - RNA, 15 nt, Homo sapiens
auugcuugugccaca

SEQ ID NO: 533734 - RNA, 23 nt, Homo sapiens
ccugcacuggggagcccgucuca

SEQ ID NO: 533735 - RNA, 14 nt, Homo sapiens
ccugcagaccucaa

SEQ ID NO: 533736 - RNA, 18 nt, Homo sapiens
ccugcagaccucaagcca

SEQ ID NO: 533737 - RNA, 19 nt, Homo sapiens
ccugcagaccucaagccau

SEQ ID NO: 533738 - RNA, 20 nt, Homo sapiens
ccugcagagcuuuggccauu

SEQ ID NO: 533739 - RNA, 17 nt, Homo sapiens
ccugcagcccaccagac

SEQ ID NO: 533740 - RNA, 22 nt, Homo sapiens
ccugcagccuccuccugaccac

SEQ ID NO: 533741 - RNA, 16 nt, Homo sapiens
ccugcaggcugcaguc

SEQ ID NO: 533742 - RNA, 11 nt, Homo sapiens
ccugcauguac

SEQ ID NO: 533743 - RNA, 14 nt, Homo sapiens
ccugccaacauacu

SEQ ID NO: 533744 - RNA, 18 nt, Homo sapiens
ccugccacagccagagga

SEQ ID NO: 533745 - RNA, 14 nt, Homo sapiens
ccugccacauccag

SEQ ID NO: 533746 - RNA, 13 nt, Homo sapiens
ccugccacucuca

SEQ ID NO: 533747 - RNA, 13 nt, Homo sapiens
ccugccaggcaca

SEQ ID NO: 533748 - RNA, 15 nt, Homo sapiens
ccugccaggcacaca

SEQ ID NO: 533749 - RNA, 15 nt, Homo sapiens
ccugccaggcugcua

SEQ ID NO: 533750 - RNA, 15 nt, Homo sapiens
ccugcccaccaagaa

SEQ ID NO: 533751 - RNA, 15 nt, Homo sapiens
ccugcccaccucucc

SEQ ID NO: 533752 - RNA, 13 nt, Homo sapiens
ccugcccagacaa

SEQ ID NO: 533753 - RNA, 14 nt, Homo sapiens
ccugcccagacuga

SEQ ID NO: 533754 - RNA, 19 nt, Homo sapiens
ccugcccaggacugcauug

SEQ ID NO: 533755 - RNA, 17 nt, Homo sapiens
ccugccccccagucucc

SEQ ID NO: 533756 - RNA, 18 nt, Homo sapiens
ccugccccccucaucuca

SEQ ID NO: 533757 - RNA, 21 nt, Homo sapiens
ccugcccccuguacauuugug

SEQ ID NO: 533758 - RNA, 17 nt, Homo sapiens
ccugcccccuuggguga

SEQ ID NO: 533759 - RNA, 13 nt, Homo sapiens
ccugccccuggug

SEQ ID NO: 533760 - RNA, 12 nt, Homo sapiens
ccugcccgggga

SEQ ID NO: 533761 - RNA, 22 nt, Homo sapiens
ccugcccuacagaggucucugc

SEQ ID NO: 533762 - RNA, 17 nt, Homo sapiens
ccugcccugugccgcac

SEQ ID NO: 533763 - RNA, 17 nt, Homo sapiens
ccugcccuucucaagac

SEQ ID NO: 533764 - RNA, 14 nt, Homo sapiens
ccugccgggcacau

SEQ ID NO: 533765 - RNA, 22 nt, Homo sapiens
ccugccgucuucacuuccccac

SEQ ID NO: 533766 - RNA, 13 nt, Homo sapiens
ccugccucagcuu

SEQ ID NO: 533767 - RNA, 19 nt, Homo sapiens
ccugccucccuuucuggga

SEQ ID NO: 533768 - RNA, 16 nt, Homo sapiens
ccugccucugacccca

SEQ ID NO: 533769 - RNA, 17 nt, Homo sapiens
ccugccucuuggccuca

SEQ ID NO: 533770 - RNA, 20 nt, Homo sapiens
ccugccugagcccaggagcu

SEQ ID NO: 533771 - RNA, 20 nt, Homo sapiens
ccugccuguagcagugagaa

SEQ ID NO: 533772 - RNA, 17 nt, Homo sapiens
ccugccuuuucauugcc

SEQ ID NO: 533773 - RNA, 14 nt, Homo sapiens
ccugcgauuuugcc

SEQ ID NO: 533774 - RNA, 15 nt, Homo sapiens
ccugcgcauggugca

SEQ ID NO: 533775 - RNA, 20 nt, Homo sapiens
ccugcgccaccgcccagaga

SEQ ID NO: 533776 - RNA, 20 nt, Homo sapiens
ccugcgccuccagagguccu

SEQ ID NO: 533777 - RNA, 23 nt, Homo sapiens
ccugcggaggguuugguucuuga

SEQ ID NO: 533778 - RNA, 13 nt, Homo sapiens
ccugcgucuuccg

SEQ ID NO: 533779 - RNA, 16 nt, Homo sapiens
ccugcucacaaaauca

SEQ ID NO: 533780 - RNA, 12 nt, Homo sapiens
ccugcucaggaa

SEQ ID NO: 533781 - RNA, 16 nt, Homo sapiens
ccugcucaggugcuau

SEQ ID NO: 533782 - RNA, 21 nt, Homo sapiens
ccugcucauguaccucugauu

SEQ ID NO: 533783 - RNA, 23 nt, Homo sapiens
ccugcuccaagggacccuuugcc

SEQ ID NO: 533784 - RNA, 13 nt, Homo sapiens
ccugcuccagaag

SEQ ID NO: 533785 - RNA, 15 nt, Homo sapiens
ccugcuccagaauuu

SEQ ID NO: 533786 - RNA, 14 nt, Homo sapiens
ccugcuccagugua

SEQ ID NO: 533787 - RNA, 14 nt, Homo sapiens
ccugcucccacaga

SEQ ID NO: 533788 - RNA, 17 nt, Homo sapiens
ccugcucccuagccaga

SEQ ID NO: 533789 - RNA, 17 nt, Homo sapiens
ccugcucuacccaugag

SEQ ID NO: 533790 - RNA, 18 nt, Homo sapiens
ccugcugaacacaguguc

SEQ ID NO: 533791 - RNA, 20 nt, Homo sapiens
ccugcugacaauuucccaca

SEQ ID NO: 533792 - RNA, 14 nt, Homo sapiens
ccugcugcagggac

SEQ ID NO: 533793 - RNA, 21 nt, Homo sapiens
ccugcugccagccccuuugcc

SEQ ID NO: 533794 - RNA, 16 nt, Homo sapiens
ccugcuggaucuugcc

SEQ ID NO: 533795 - RNA, 20 nt, Homo sapiens
ccugcuggccccuucugggg

SEQ ID NO: 533796 - RNA, 23 nt, Homo sapiens
ccugcugugggguauacagcauu

SEQ ID NO: 533797 - RNA, 17 nt, Homo sapiens
ccugcuguugguccucu

SEQ ID NO: 533798 - RNA, 15 nt, Homo sapiens
ccugcuugcacacuu

SEQ ID NO: 533799 - RNA, 19 nt, Homo sapiens
ccugcuuggucuuucauug

SEQ ID NO: 533800 - RNA, 21 nt, Homo sapiens
ccugcuuuggucuugccccau

SEQ ID NO: 533801 - RNA, 17 nt, Homo sapiens
ccuggaaauucugcugc

SEQ ID NO: 533802 - RNA, 18 nt, Homo sapiens
ccuggaagggaccugguu

SEQ ID NO: 533803 - RNA, 19 nt, Homo sapiens
ccuggaaucuacaagccaa

SEQ ID NO: 533804 - RNA, 17 nt, Homo sapiens
ccuggacacaacaccaa

SEQ ID NO: 533805 - RNA, 16 nt, Homo sapiens
ccuggacacgcuggug

SEQ ID NO: 533806 - RNA, 17 nt, Homo sapiens
ccuggagacaaggugcu

SEQ ID NO: 533807 - RNA, 14 nt, Homo sapiens
ccuggagagcuccu

SEQ ID NO: 533808 - RNA, 19 nt, Homo sapiens
ccuggagcccauccagucu

SEQ ID NO: 533809 - RNA, 21 nt, Homo sapiens
ccuggaggacagagggagaca

SEQ ID NO: 533810 - RNA, 14 nt, Homo sapiens
ccuggagugcaguu

SEQ ID NO: 533811 - RNA, 22 nt, Homo sapiens
ccuggaguguaugacugcacau

SEQ ID NO: 533812 - RNA, 23 nt, Homo sapiens
ccuggaguguaugacugcacaug

SEQ ID NO: 533813 - RNA, 21 nt, Homo sapiens
ccuggaguuuaauacagugag

SEQ ID NO: 533814 - RNA, 18 nt, Homo sapiens
ccuggaucccugcccuuc

SEQ ID NO: 533815 - RNA, 19 nt, Homo sapiens
ccuggauguguggggcaug

SEQ ID NO: 533816 - RNA, 12 nt, Homo sapiens
ccuggcaagaau

SEQ ID NO: 533817 - RNA, 22 nt, Homo sapiens
ccuggcaaucaauacagcuuca

SEQ ID NO: 533818 - RNA, 23 nt, Homo sapiens
auuuaaaugugaauuucaacuuu

SEQ ID NO: 533819 - RNA, 23 nt, Homo sapiens
auuuaaauuacaauuuuaucugu

SEQ ID NO: 533820 - RNA, 16 nt, Homo sapiens
auuuaaauuccacaga

SEQ ID NO: 533821 - RNA, 16 nt, Homo sapiens
auuuaacaagauuucu

SEQ ID NO: 533822 - RNA, 19 nt, Homo sapiens
auuuaacagaaauguacag

SEQ ID NO: 533823 - RNA, 17 nt, Homo sapiens
auuuaacagucauuuaa

SEQ ID NO: 533824 - RNA, 21 nt, Homo sapiens
auuuaacauaaugguugugaa

SEQ ID NO: 533825 - RNA, 20 nt, Homo sapiens
auuuaacaugaacacccuua

SEQ ID NO: 533826 - RNA, 17 nt, Homo sapiens
auuuaacuuacacugau

SEQ ID NO: 533827 - RNA, 14 nt, Homo sapiens
auuuaacuugaugu

SEQ ID NO: 533828 - RNA, 15 nt, Homo sapiens
auuuaagguacuuaa

SEQ ID NO: 533829 - RNA, 20 nt, Homo sapiens
auuuaagugaauacauuaac

SEQ ID NO: 533830 - RNA, 18 nt, Homo sapiens
auuuaaguuaucaacuuu

SEQ ID NO: 533831 - RNA, 20 nt, Homo sapiens
auuuaauaucuggcacuguu

SEQ ID NO: 533832 - RNA, 13 nt, Homo sapiens
auuuaaugcauua

SEQ ID NO: 533833 - RNA, 17 nt, Homo sapiens
auuuaauuaaagcacac

SEQ ID NO: 533834 - RNA, 16 nt, Homo sapiens
auuuaauuauuuccua

SEQ ID NO: 533835 - RNA, 11 nt, Homo sapiens
auuuaauucca

SEQ ID NO: 533836 - RNA, 15 nt, Homo sapiens
auuuacaauuugaca

SEQ ID NO: 533837 - RNA, 20 nt, Homo sapiens
auuuacacuacauuguacaa

SEQ ID NO: 533838 - RNA, 21 nt, Homo sapiens
auuuacagaaaagacucugac

SEQ ID NO: 533839 - RNA, 20 nt, Homo sapiens
auuuacagcccucagcaaug

SEQ ID NO: 533840 - RNA, 20 nt, Homo sapiens
auuuacagccucacuugaau

SEQ ID NO: 533841 - RNA, 15 nt, Homo sapiens
auuuacagcucugua

SEQ ID NO: 533842 - RNA, 20 nt, Homo sapiens
auuuacauaaagacugugcu

SEQ ID NO: 533843 - RNA, 21 nt, Homo sapiens
auuuacaugaauugcauuuua

SEQ ID NO: 533844 - RNA, 18 nt, Homo sapiens
auuuacaugcaccuuaua

SEQ ID NO: 533845 - RNA, 11 nt, Homo sapiens
auuuacauuca

SEQ ID NO: 533846 - RNA, 22 nt, Homo sapiens
auuuacuacuauuaagguaaau

SEQ ID NO: 533847 - RNA, 21 nt, Homo sapiens
auuuacugaaguuauuuauua

SEQ ID NO: 533848 - RNA, 17 nt, Homo sapiens
auuuacuggugcagaug

SEQ ID NO: 533849 - RNA, 19 nt, Homo sapiens
auuuacuuaacagaacagu

SEQ ID NO: 533850 - RNA, 19 nt, Homo sapiens
auuuacuuuuaccacuauu

SEQ ID NO: 533851 - RNA, 19 nt, Homo sapiens
auuuagaaaaaaguuuaca

SEQ ID NO: 533852 - RNA, 18 nt, Homo sapiens
auuuagaaaaacauccca

SEQ ID NO: 533853 - RNA, 21 nt, Homo sapiens
auuuagaaaauuuuguauuaa

SEQ ID NO: 533854 - RNA, 18 nt, Homo sapiens
auuuagaacuguauguca

SEQ ID NO: 533855 - RNA, 18 nt, Homo sapiens
auuuagacccugcauuua

SEQ ID NO: 533856 - RNA, 18 nt, Homo sapiens
ccuggggaagcugugaaa

SEQ ID NO: 533857 - RNA, 21 nt, Homo sapiens
ccuggggccuggaccugccuc

SEQ ID NO: 533858 - RNA, 20 nt, Homo sapiens
ccuggggcuagggggagccc

SEQ ID NO: 533859 - RNA, 19 nt, Homo sapiens
ccuggggcuucuccugacc

SEQ ID NO: 533860 - RNA, 12 nt, Homo sapiens
ccugggggacca

SEQ ID NO: 533861 - RNA, 16 nt, Homo sapiens
ccuggggugaauacuu

SEQ ID NO: 533862 - RNA, 22 nt, Homo sapiens
ccuggggugggaucugagcucc

SEQ ID NO: 533863 - RNA, 18 nt, Homo sapiens
ccuggguaacuagggaag

SEQ ID NO: 533864 - RNA, 12 nt, Homo sapiens
ccugggugacaa

SEQ ID NO: 533865 - RNA, 22 nt, Homo sapiens
ccugggugacagagcaagugag

SEQ ID NO: 533866 - RNA, 21 nt, Homo sapiens
ccuggguucugggacuuuuaa

SEQ ID NO: 533867 - RNA, 15 nt, Homo sapiens
ccugguaaaagggau

SEQ ID NO: 533868 - RNA, 14 nt, Homo sapiens
ccugguaccagagg

SEQ ID NO: 533869 - RNA, 15 nt, Homo sapiens
ccugguauauccaaa

SEQ ID NO: 533870 - RNA, 16 nt, Homo sapiens
ccuggucccaagacag

SEQ ID NO: 533871 - RNA, 12 nt, Homo sapiens
ccugguccuucc

SEQ ID NO: 533872 - RNA, 13 nt, Homo sapiens
ccuggugcugcug

SEQ ID NO: 533873 - RNA, 21 nt, Homo sapiens
ccugguggagaaagcacugac

SEQ ID NO: 533874 - RNA, 19 nt, Homo sapiens
ccugguggauacuguagaa

SEQ ID NO: 533875 - RNA, 17 nt, Homo sapiens
ccugguggcaccagaug

SEQ ID NO: 533876 - RNA, 19 nt, Homo sapiens
ccuggugggcagagaggua

SEQ ID NO: 533877 - RNA, 15 nt, Homo sapiens
ccugguggucaggga

SEQ ID NO: 533878 - RNA, 18 nt, Homo sapiens
ccugguguagcacuuaac

SEQ ID NO: 533879 - RNA, 23 nt, Homo sapiens
ccugguguaguuucuucauuuca

SEQ ID NO: 533880 - RNA, 15 nt, Homo sapiens
ccugguuugacucag

SEQ ID NO: 533881 - RNA, 19 nt, Homo sapiens
ccugguuugcaaagaccac

SEQ ID NO: 533882 - RNA, 20 nt, Homo sapiens
ccuguaacccuggcacuuaa

SEQ ID NO: 533883 - RNA, 19 nt, Homo sapiens
ccuguaaucccaacacuuu

SEQ ID NO: 533884 - RNA, 15 nt, Homo sapiens
ccuguaaucccagcu

SEQ ID NO: 533885 - RNA, 19 nt, Homo sapiens
ccuguaaucucagcacuuu

SEQ ID NO: 533886 - RNA, 20 nt, Homo sapiens
ccuguaaucucagcacuuug

SEQ ID NO: 533887 - RNA, 14 nt, Homo sapiens
ccuguacacaggcg

SEQ ID NO: 533888 - RNA, 15 nt, Homo sapiens
ccuguaccucagugg

SEQ ID NO: 533889 - RNA, 19 nt, Homo sapiens
ccuguacucccagcacuuu

SEQ ID NO: 533890 - RNA, 14 nt, Homo sapiens
ccuguacucuugaa

SEQ ID NO: 533891 - RNA, 18 nt, Homo sapiens
ccuguagacuagugccgu

SEQ ID NO: 533892 - RNA, 15 nt, Homo sapiens
ccuguagcucaguca

SEQ ID NO: 533893 - RNA, 14 nt, Homo sapiens
ccuguagugagaaa

SEQ ID NO: 533894 - RNA, 17 nt, Homo sapiens
ccugucaauacuaugga

SEQ ID NO: 533895 - RNA, 16 nt, Homo sapiens
ccugucacacacugga

SEQ ID NO: 533896 - RNA, 17 nt, Homo sapiens
ccugucacacacuggac

SEQ ID NO: 533897 - RNA, 21 nt, Homo sapiens
ccugucaccaugacuuccuca

SEQ ID NO: 533898 - RNA, 19 nt, Homo sapiens
ccugucacgccgggcucua

SEQ ID NO: 533899 - RNA, 21 nt, Homo sapiens
ccugucaguaguggacauugu

SEQ ID NO: 533900 - RNA, 15 nt, Homo sapiens
ccugucauauaauaa

SEQ ID NO: 533901 - RNA, 20 nt, Homo sapiens
ccugucauuuuuaacagcau

SEQ ID NO: 533902 - RNA, 21 nt, Homo sapiens
ccugucccacccacacagcug

SEQ ID NO: 533903 - RNA, 19 nt, Homo sapiens
ccugucccccacucucuca

SEQ ID NO: 533904 - RNA, 15 nt, Homo sapiens
ccuguccucuuugug

SEQ ID NO: 533905 - RNA, 19 nt, Homo sapiens
ccuguccugccuccucauc

SEQ ID NO: 533906 - RNA, 19 nt, Homo sapiens
ccuguccuggcaucaguag

SEQ ID NO: 533907 - RNA, 17 nt, Homo sapiens
ccuguccuuucuugcag

SEQ ID NO: 533908 - RNA, 22 nt, Homo sapiens
ccuguccuuucuugcagauucu

SEQ ID NO: 533909 - RNA, 16 nt, Homo sapiens
ccugucgugccagucc

SEQ ID NO: 533910 - RNA, 22 nt, Homo sapiens
ccugucuaggucuccucagggu

SEQ ID NO: 533911 - RNA, 15 nt, Homo sapiens
ccugucucccaaaaa

SEQ ID NO: 533912 - RNA, 22 nt, Homo sapiens
ccugucuggauccuauccuccu

SEQ ID NO: 533913 - RNA, 18 nt, Homo sapiens
ccugucuggccccugaga

SEQ ID NO: 533914 - RNA, 21 nt, Homo sapiens
ccugucuggugccccuuugcc

SEQ ID NO: 533915 - RNA, 15 nt, Homo sapiens
ccugucuuuaaggaa

SEQ ID NO: 533916 - RNA, 14 nt, Homo sapiens
ccugugaaauacca

SEQ ID NO: 533917 - RNA, 21 nt, Homo sapiens
ccugugaaguccuucaccuca

SEQ ID NO: 533918 - RNA, 11 nt, Homo sapiens
ccugugacacu

SEQ ID NO: 533919 - RNA, 20 nt, Homo sapiens
ccugugacauguaacagcca

SEQ ID NO: 533920 - RNA, 19 nt, Homo sapiens
ccugugagccggagcucau

SEQ ID NO: 533921 - RNA, 15 nt, Homo sapiens
ccugugauccaccca

SEQ ID NO: 533922 - RNA, 14 nt, Homo sapiens
ccugugcauuuucu

SEQ ID NO: 533923 - RNA, 16 nt, Homo sapiens
ccugugcccaccaguu

SEQ ID NO: 533924 - RNA, 21 nt, Homo sapiens
ccugugcccacccgucuucaa

SEQ ID NO: 533925 - RNA, 19 nt, Homo sapiens
ccugugcccucaccaccac

SEQ ID NO: 533926 - RNA, 15 nt, Homo sapiens
ccugugccuccucag

SEQ ID NO: 533927 - RNA, 19 nt, Homo sapiens
ccuguggccaacugcaaaa

SEQ ID NO: 533928 - RNA, 21 nt, Homo sapiens
ccuguggggcaggagugccag

SEQ ID NO: 533929 - RNA, 19 nt, Homo sapiens
ccugugguuacagugcaga

SEQ ID NO: 533930 - RNA, 15 nt, Homo sapiens
ccuguguaacacuug

SEQ ID NO: 533931 - RNA, 15 nt, Homo sapiens
ccuguguacauauaa

SEQ ID NO: 533932 - RNA, 15 nt, Homo sapiens
ccuguguagcucuca

SEQ ID NO: 533933 - RNA, 21 nt, Homo sapiens
ccuguguagcucucacaugca

SEQ ID NO: 533934 - RNA, 17 nt, Homo sapiens
ccuguguauucuaguga

SEQ ID NO: 533935 - RNA, 22 nt, Homo sapiens
ccugugucagagccuaccuuca

SEQ ID NO: 533936 - RNA, 14 nt, Homo sapiens
ccugugugcuuguc

SEQ ID NO: 533937 - RNA, 15 nt, Homo sapiens
ccugugugugggugg

SEQ ID NO: 533938 - RNA, 21 nt, Homo sapiens
ccuguguugucucuagagcag

SEQ ID NO: 533939 - RNA, 18 nt, Homo sapiens
ccuguuaccugucuugcu

SEQ ID NO: 533940 - RNA, 13 nt, Homo sapiens
ccuguuacuuuac

SEQ ID NO: 533941 - RNA, 21 nt, Homo sapiens
auuuccccccuccgccuccag

SEQ ID NO: 533942 - RNA, 20 nt, Homo sapiens
auuucccccuaaaccaacug

SEQ ID NO: 533943 - RNA, 18 nt, Homo sapiens
auuuccccuuaucuuucu

SEQ ID NO: 533944 - RNA, 15 nt, Homo sapiens
auuucccucuacuga

SEQ ID NO: 533945 - RNA, 17 nt, Homo sapiens
auuucccugguagugua

SEQ ID NO: 533946 - RNA, 16 nt, Homo sapiens
auuuccuaaggcaugu

SEQ ID NO: 533947 - RNA, 16 nt, Homo sapiens
auuuccuaaucaaaaa

SEQ ID NO: 533948 - RNA, 13 nt, Homo sapiens
auuuccuaugcaa

SEQ ID NO: 533949 - RNA, 16 nt, Homo sapiens
auuuccucaucugggu

SEQ ID NO: 533950 - RNA, 15 nt, Homo sapiens
auuuccuggucacau

SEQ ID NO: 533951 - RNA, 17 nt, Homo sapiens
auuuccuguuugaaaua

SEQ ID NO: 533952 - RNA, 22 nt, Homo sapiens
auuuccuuaaauguuuugccag

SEQ ID NO: 533953 - RNA, 20 nt, Homo sapiens
auuuccuuacagaacuacuu

SEQ ID NO: 533954 - RNA, 22 nt, Homo sapiens
auuuccuuacagaacuacuucu

SEQ ID NO: 533955 - RNA, 16 nt, Homo sapiens
auuuccuuagugccag

SEQ ID NO: 533956 - RNA, 18 nt, Homo sapiens
auuuccuuagugccagga

SEQ ID NO: 533957 - RNA, 12 nt, Homo sapiens
auuuccuuccaa

SEQ ID NO: 533958 - RNA, 15 nt, Homo sapiens
auuuccuuccacugu

SEQ ID NO: 533959 - RNA, 20 nt, Homo sapiens
auuuccuuccacuguagcua

SEQ ID NO: 533960 - RNA, 17 nt, Homo sapiens
auuuccuuuuccuucaa

SEQ ID NO: 533961 - RNA, 15 nt, Homo sapiens
auuuccuuuuugaca

SEQ ID NO: 533962 - RNA, 18 nt, Homo sapiens
auuuccuuuuugacacug

SEQ ID NO: 533963 - RNA, 16 nt, Homo sapiens
auuucuaccuaaguca

SEQ ID NO: 533964 - RNA, 17 nt, Homo sapiens
auuucuagaagcacaug

SEQ ID NO: 533965 - RNA, 16 nt, Homo sapiens
auuucuagcagaguga

SEQ ID NO: 533966 - RNA, 20 nt, Homo sapiens
auuucuagcagugaugaaaa

SEQ ID NO: 533967 - RNA, 23 nt, Homo sapiens
auuucucaaucagugcagugaua

SEQ ID NO: 533968 - RNA, 15 nt, Homo sapiens
auuucucacacucua

SEQ ID NO: 533969 - RNA, 19 nt, Homo sapiens
auuucucaucaguaguuca

SEQ ID NO: 533970 - RNA, 16 nt, Homo sapiens
auuucucaugcuucuu

SEQ ID NO: 533971 - RNA, 22 nt, Homo sapiens
auuucuccaggauuuccugcuu

SEQ ID NO: 533972 - RNA, 22 nt, Homo sapiens
auuucucuacuugucauaucac

SEQ ID NO: 533973 - RNA, 20 nt, Homo sapiens
auuucucugcaucaggugua

SEQ ID NO: 533974 - RNA, 21 nt, Homo sapiens
auuucucuuuuauucuguuau

SEQ ID NO: 533975 - RNA, 18 nt, Homo sapiens
auuucugaaaaccuacca

SEQ ID NO: 533976 - RNA, 19 nt, Homo sapiens
auuucugaucuauacaaau

SEQ ID NO: 533977 - RNA, 16 nt, Homo sapiens
ccuuauuugcacuuca

SEQ ID NO: 533978 - RNA, 23 nt, Homo sapiens
ccuuauuuugugugcuuucccag

SEQ ID NO: 533979 - RNA, 20 nt, Homo sapiens
ccuucaaaauaaaaaguaau

SEQ ID NO: 533980 - RNA, 23 nt, Homo sapiens
ccuucaaaauguucuauuuaaca

SEQ ID NO: 533981 - RNA, 20 nt, Homo sapiens
ccuucaaguuagcucaggag

SEQ ID NO: 533982 - RNA, 15 nt, Homo sapiens
ccuucacaaauguca

SEQ ID NO: 533983 - RNA, 17 nt, Homo sapiens
ccuucaccuuggauggu

SEQ ID NO: 533984 - RNA, 13 nt, Homo sapiens
ccuucacuucuga

SEQ ID NO: 533985 - RNA, 21 nt, Homo sapiens
ccuucagaacagaggcauuua

SEQ ID NO: 533986 - RNA, 16 nt, Homo sapiens
ccuucagaagcuauuu

SEQ ID NO: 533987 - RNA, 15 nt, Homo sapiens
ccuucagaugugucu

SEQ ID NO: 533988 - RNA, 15 nt, Homo sapiens
ccuucagcagcuacu

SEQ ID NO: 533989 - RNA, 20 nt, Homo sapiens
ccuucagcauugccuaggaa

SEQ ID NO: 533990 - RNA, 21 nt, Homo sapiens
ccuucaguaaaugugauucac

SEQ ID NO: 533991 - RNA, 18 nt, Homo sapiens
ccuucaguuuauuuccac

SEQ ID NO: 533992 - RNA, 23 nt, Homo sapiens
ccuucaguuuguaaagucgguga

SEQ ID NO: 533993 - RNA, 23 nt, Homo sapiens
ccuucauaaaacucuagcauucu

SEQ ID NO: 533994 - RNA, 18 nt, Homo sapiens
ccuuccaagacugaagac

SEQ ID NO: 533995 - RNA, 17 nt, Homo sapiens
ccuuccaagcuguguua

SEQ ID NO: 533996 - RNA, 15 nt, Homo sapiens
ccuuccacaccccau

SEQ ID NO: 533997 - RNA, 12 nt, Homo sapiens
ccuuccacugag

SEQ ID NO: 533998 - RNA, 12 nt, Homo sapiens
ccuuccacugua

SEQ ID NO: 533999 - RNA, 15 nt, Homo sapiens
ccuuccccaccaagu

SEQ ID NO: 534000 - RNA, 23 nt, Homo sapiens
ccuuccccagcgucccagucucu

SEQ ID NO: 534001 - RNA, 18 nt, Homo sapiens
ccuucccccugcaaaaag

SEQ ID NO: 534002 - RNA, 17 nt, Homo sapiens
ccuuccuaauaugcuuu

SEQ ID NO: 534003 - RNA, 13 nt, Homo sapiens
ccuuccuauucuc

SEQ ID NO: 534004 - RNA, 21 nt, Homo sapiens
ccuuccucugauuuacauuca

SEQ ID NO: 534005 - RNA, 15 nt, Homo sapiens
ccuuccucuuccugc

SEQ ID NO: 534006 - RNA, 23 nt, Homo sapiens
ccuuccugauuguuuacagucau

SEQ ID NO: 534007 - RNA, 18 nt, Homo sapiens
ccuuccugccaccaguca

SEQ ID NO: 534008 - RNA, 17 nt, Homo sapiens
ccuuccuggacacacuc

SEQ ID NO: 534009 - RNA, 17 nt, Homo sapiens
ccuuccuuucuccagga

SEQ ID NO: 534010 - RNA, 18 nt, Homo sapiens
ccuucggcuccgggcaaa

SEQ ID NO: 534011 - RNA, 21 nt, Homo sapiens
ccuucgggcugugcccgggga

SEQ ID NO: 534012 - RNA, 19 nt, Homo sapiens
ccuucuacagcagcacugu

SEQ ID NO: 534013 - RNA, 15 nt, Homo sapiens
ccuucuaggucacuu

SEQ ID NO: 534014 - RNA, 22 nt, Homo sapiens
ccuucuaggucacuucucacaa

SEQ ID NO: 534015 - RNA, 22 nt, Homo sapiens
ccuucucacacacaacugucca

SEQ ID NO: 534016 - RNA, 22 nt, Homo sapiens
ccuucucagaccugcgcacucc

SEQ ID NO: 534017 - RNA, 23 nt, Homo sapiens
ccuucuccaccgcacagacuggg

SEQ ID NO: 534018 - RNA, 19 nt, Homo sapiens
ccuucuccauccacauggg

SEQ ID NO: 534019 - RNA, 18 nt, Homo sapiens
ccuucucccucgacauuu

SEQ ID NO: 534020 - RNA, 16 nt, Homo sapiens
ccuucucucuccagaa

SEQ ID NO: 534021 - RNA, 13 nt, Homo sapiens
ccuucucugcucc

SEQ ID NO: 534022 - RNA, 17 nt, Homo sapiens
ccuucuggcaagccugu

SEQ ID NO: 534023 - RNA, 13 nt, Homo sapiens
ccuucuggugucu

SEQ ID NO: 534024 - RNA, 18 nt, Homo sapiens
ccuucugguuuuaggaaa

SEQ ID NO: 534025 - RNA, 12 nt, Homo sapiens
ccuucuuaacau

SEQ ID NO: 534026 - RNA, 13 nt, Homo sapiens
ccuucuugcugcc

SEQ ID NO: 534027 - RNA, 23 nt, Homo sapiens
ccuucuugguuuccaaaggcauu

SEQ ID NO: 534028 - RNA, 16 nt, Homo sapiens
ccuucuugucauugaa

SEQ ID NO: 534029 - RNA, 17 nt, Homo sapiens
ccuucuuuaaggcauag

SEQ ID NO: 534030 - RNA, 15 nt, Homo sapiens
ccuucuuugcugcug

SEQ ID NO: 534031 - RNA, 22 nt, Homo sapiens
ccuucuuuuucuggacucugga

SEQ ID NO: 534032 - RNA, 23 nt, Homo sapiens
ccuugaacccaacagucccuuau

SEQ ID NO: 534033 - RNA, 14 nt, Homo sapiens
ccuugaagcaauaa

SEQ ID NO: 534034 - RNA, 13 nt, Homo sapiens
ccuugaagccacu

SEQ ID NO: 534035 - RNA, 19 nt, Homo sapiens
ccuugaauagaaguuuucc

SEQ ID NO: 534036 - RNA, 14 nt, Homo sapiens
ccuugaaugggcug

SEQ ID NO: 534037 - RNA, 23 nt, Homo sapiens
ccuugacauuguagagcuucugg

SEQ ID NO: 534038 - RNA, 11 nt, Homo sapiens
ccuugacuguc

SEQ ID NO: 534039 - RNA, 18 nt, Homo sapiens
ccuugacugucuagccac

SEQ ID NO: 534040 - RNA, 18 nt, Homo sapiens
ccuugagagacccagcug

SEQ ID NO: 534041 - RNA, 17 nt, Homo sapiens
ccuugagggcugcaguu

SEQ ID NO: 534042 - RNA, 14 nt, Homo sapiens
ccuugaguaaaaag

SEQ ID NO: 534043 - RNA, 20 nt, Homo sapiens
ccuugagugcucuugcuauu

SEQ ID NO: 534044 - RNA, 19 nt, Homo sapiens
ccuugauauaaaaaaucuu

SEQ ID NO: 534045 - RNA, 22 nt, Homo sapiens
ccuugaucuuaacaaagccuuu

SEQ ID NO: 534046 - RNA, 18 nt, Homo sapiens
ccuugcaacuucauguca

SEQ ID NO: 534047 - RNA, 23 nt, Homo sapiens
ccuugcaagguuaagcaaggugg

SEQ ID NO: 534048 - RNA, 23 nt, Homo sapiens
ccuugcaguuccccgagaacuuu

SEQ ID NO: 534049 - RNA, 18 nt, Homo sapiens
ccuugccaauagugucau

SEQ ID NO: 534050 - RNA, 22 nt, Homo sapiens
ccuugcccacccccaccaugca

SEQ ID NO: 534051 - RNA, 23 nt, Homo sapiens
ccuugcccacccccaccaugcag

SEQ ID NO: 534052 - RNA, 20 nt, Homo sapiens
ccuugcccagacuacagggc

SEQ ID NO: 534053 - RNA, 18 nt, Homo sapiens
ccuugcccaucagccauu

SEQ ID NO: 534054 - RNA, 16 nt, Homo sapiens
ccuugcccccauuuca

SEQ ID NO: 534055 - RNA, 18 nt, Homo sapiens
ccuugcccccauuucacc

SEQ ID NO: 534056 - RNA, 11 nt, Homo sapiens
ccuugcucccc

SEQ ID NO: 534057 - RNA, 20 nt, Homo sapiens
ccuugcugggguccagggcu

SEQ ID NO: 534058 - RNA, 19 nt, Homo sapiens
ccuugcuguccugaucugu

SEQ ID NO: 534059 - RNA, 21 nt, Homo sapiens
ccuuggaaaugaccaggccaa

SEQ ID NO: 534060 - RNA, 13 nt, Homo sapiens
ccuuggaccucca

SEQ ID NO: 534061 - RNA, 19 nt, Homo sapiens
ccuuggcacccccaugcug

SEQ ID NO: 534062 - RNA, 21 nt, Homo sapiens
ccuuggcaguggacucagaaa

SEQ ID NO: 534063 - RNA, 20 nt, Homo sapiens
auuuguuuguuuucuugucu

SEQ ID NO: 534064 - RNA, 18 nt, Homo sapiens
auuuuaaaaacuaaaaag

SEQ ID NO: 534065 - RNA, 16 nt, Homo sapiens
auuuuaaaaagucaau

SEQ ID NO: 534066 - RNA, 13 nt, Homo sapiens
auuuuaacuacuu

SEQ ID NO: 534067 - RNA, 19 nt, Homo sapiens
auuuuaaguaucagagguc

SEQ ID NO: 534068 - RNA, 14 nt, Homo sapiens
auuuuacaaguaua

SEQ ID NO: 534069 - RNA, 16 nt, Homo sapiens
auuuuacaagucaaaa

SEQ ID NO: 534070 - RNA, 17 nt, Homo sapiens
auuuuacacaaagggaa

SEQ ID NO: 534071 - RNA, 22 nt, Homo sapiens
auuuuacacguaucucuuggua

SEQ ID NO: 534072 - RNA, 19 nt, Homo sapiens
auuuuacagaagcauuuua

SEQ ID NO: 534073 - RNA, 13 nt, Homo sapiens
auuuuacauacac

SEQ ID NO: 534074 - RNA, 13 nt, Homo sapiens
auuuuaccaaagc

SEQ ID NO: 534075 - RNA, 18 nt, Homo sapiens
auuuuaccaaagcaucaa

SEQ ID NO: 534076 - RNA, 20 nt, Homo sapiens
auuuuaccuaguuugcacua

SEQ ID NO: 534077 - RNA, 13 nt, Homo sapiens
auuuuacugcuua

SEQ ID NO: 534078 - RNA, 19 nt, Homo sapiens
auuuuagaaacuacaaaua

SEQ ID NO: 534079 - RNA, 19 nt, Homo sapiens
auuuuagaacaguccagca

SEQ ID NO: 534080 - RNA, 18 nt, Homo sapiens
auuuuagacuuaccuuga

SEQ ID NO: 534081 - RNA, 14 nt, Homo sapiens
auuuuagccuuuau

SEQ ID NO: 534082 - RNA, 18 nt, Homo sapiens
auuuuagcuggugucagc

SEQ ID NO: 534083 - RNA, 17 nt, Homo sapiens
auuuuauaaaacaaaua

SEQ ID NO: 534084 - RNA, 23 nt, Homo sapiens
auuuuauaaagaucagaaugaua

SEQ ID NO: 534085 - RNA, 21 nt, Homo sapiens
auuuuauacacagauucugcc

SEQ ID NO: 534086 - RNA, 13 nt, Homo sapiens
auuuuaugcugcu

SEQ ID NO: 534087 - RNA, 14 nt, Homo sapiens
auuuuaugcugcug

SEQ ID NO: 534088 - RNA, 21 nt, Homo sapiens
auuuuaugcuggacucuggac

SEQ ID NO: 534089 - RNA, 18 nt, Homo sapiens
auuuuauuacaucuuuca

SEQ ID NO: 534090 - RNA, 17 nt, Homo sapiens
auuuuauuaggauuacc

SEQ ID NO: 534091 - RNA, 16 nt, Homo sapiens
auuuuauuccaaaaua

SEQ ID NO: 534092 - RNA, 19 nt, Homo sapiens
auuuuauucccaagcucua

SEQ ID NO: 534093 - RNA, 18 nt, Homo sapiens
auuuuauucccuuucaca

SEQ ID NO: 534094 - RNA, 17 nt, Homo sapiens
auuuuauuggggggcaa

SEQ ID NO: 534095 - RNA, 16 nt, Homo sapiens
auuuuauuuuacuauu

SEQ ID NO: 534096 - RNA, 23 nt, Homo sapiens
auuuuauuuuuucccuccugaca

SEQ ID NO: 534097 - RNA, 20 nt, Homo sapiens
auuuuauuuuuuucuaccuu

SEQ ID NO: 534098 - RNA, 16 nt, Homo sapiens
cuaucaguauugugaa

SEQ ID NO: 534099 - RNA, 17 nt, Homo sapiens
cuaucaguauugugaaa

SEQ ID NO: 534100 - RNA, 16 nt, Homo sapiens
cuaucauggugaaaag

SEQ ID NO: 534101 - RNA, 13 nt, Homo sapiens
cuaucauucucag

SEQ ID NO: 534102 - RNA, 19 nt, Homo sapiens
cuauccaaaacuaauuucc

SEQ ID NO: 534103 - RNA, 21 nt, Homo sapiens
cuauccaaguguuauaccaac

SEQ ID NO: 534104 - RNA, 21 nt, Homo sapiens
cuauccagugacuuguucuga

SEQ ID NO: 534105 - RNA, 18 nt, Homo sapiens
cuauccucucuuccucuu

SEQ ID NO: 534106 - RNA, 15 nt, Homo sapiens
cuauccugauuccaa

SEQ ID NO: 534107 - RNA, 14 nt, Homo sapiens
cuaucgaacuucac

SEQ ID NO: 534108 - RNA, 14 nt, Homo sapiens
cuaucgcaccacug

SEQ ID NO: 534109 - RNA, 18 nt, Homo sapiens
cuaucuaucuuccaaaug

SEQ ID NO: 534110 - RNA, 20 nt, Homo sapiens
cuaucuauggcccugcaaaa

SEQ ID NO: 534111 - RNA, 23 nt, Homo sapiens
cuaucucagccauaggugcaguu

SEQ ID NO: 534112 - RNA, 12 nt, Homo sapiens
cuaucucuacug

SEQ ID NO: 534113 - RNA, 14 nt, Homo sapiens
cuaucucuacugaa

SEQ ID NO: 534114 - RNA, 21 nt, Homo sapiens
cuaucugcacucuaaacugca

SEQ ID NO: 534115 - RNA, 16 nt, Homo sapiens
cuaucugccaaauuga

SEQ ID NO: 534116 - RNA, 19 nt, Homo sapiens
cuaucugggcugugggcaa

SEQ ID NO: 534117 - RNA, 18 nt, Homo sapiens
cuaucuggggagcuccug

SEQ ID NO: 534118 - RNA, 19 nt, Homo sapiens
cuaucuuuaaacauuucaa

SEQ ID NO: 534119 - RNA, 20 nt, Homo sapiens
cuaucuuugagcgcccacua

SEQ ID NO: 534120 - RNA, 20 nt, Homo sapiens
cuaugaaaacagcuaucuca

SEQ ID NO: 534121 - RNA, 21 nt, Homo sapiens
cuaugaaaacagcuaucucac

SEQ ID NO: 534122 - RNA, 18 nt, Homo sapiens
cuaugaaaauuauaucuc

SEQ ID NO: 534123 - RNA, 20 nt, Homo sapiens
cuaugaaguuggcacauuuc

SEQ ID NO: 534124 - RNA, 17 nt, Homo sapiens
cuaugaauaugaucccu

SEQ ID NO: 534125 - RNA, 19 nt, Homo sapiens
cuaugaaugauacccugaa

SEQ ID NO: 534126 - RNA, 19 nt, Homo sapiens
cuaugagauggccaugcuc

SEQ ID NO: 534127 - RNA, 18 nt, Homo sapiens
cuaugaucagaagacuuu

SEQ ID NO: 534128 - RNA, 19 nt, Homo sapiens
cuaugaucuggacuuccua

SEQ ID NO: 534129 - RNA, 15 nt, Homo sapiens
cuaugauggugacau

SEQ ID NO: 534130 - RNA, 14 nt, Homo sapiens
cuaugcaaagcacu

SEQ ID NO: 534131 - RNA, 14 nt, Homo sapiens
cuaugcaaucugag

SEQ ID NO: 534132 - RNA, 22 nt, Homo sapiens
cuaugcaggcagcacagcagac

SEQ ID NO: 534133 - RNA, 21 nt, Homo sapiens
cuaugcccugcagagcaauaa

SEQ ID NO: 534134 - RNA, 15 nt, Homo sapiens
cuaugccuugcacac

SEQ ID NO: 534135 - RNA, 20 nt, Homo sapiens
cuaugcugggguacacagug

SEQ ID NO: 534136 - RNA, 22 nt, Homo sapiens
cuaugcugggguacacagugag

SEQ ID NO: 534137 - RNA, 14 nt, Homo sapiens
cuaugcugugcucc

SEQ ID NO: 534138 - RNA, 14 nt, Homo sapiens
cuauggaaguauua

SEQ ID NO: 534139 - RNA, 19 nt, Homo sapiens
cuauggagugcaccaaaga

SEQ ID NO: 534140 - RNA, 23 nt, Homo sapiens
cuauggucagguuauacuccucc

SEQ ID NO: 534141 - RNA, 15 nt, Homo sapiens
cuaugguuugccauu

SEQ ID NO: 534142 - RNA, 16 nt, Homo sapiens
cuauguauguguaaaa

SEQ ID NO: 534143 - RNA, 21 nt, Homo sapiens
cuaugugggugggaccacaga

SEQ ID NO: 534144 - RNA, 12 nt, Homo sapiens
cuauguguacag

SEQ ID NO: 534145 - RNA, 15 nt, Homo sapiens
cuauguguaugcaag

SEQ ID NO: 534146 - RNA, 17 nt, Homo sapiens
cuauguuacauguacau

SEQ ID NO: 534147 - RNA, 14 nt, Homo sapiens
cuauguuacuauuu

SEQ ID NO: 534148 - RNA, 15 nt, Homo sapiens
cuauguucaaagacu

SEQ ID NO: 534149 - RNA, 23 nt, Homo sapiens
cuauguuccaagugcuacucuca

SEQ ID NO: 534150 - RNA, 17 nt, Homo sapiens
cuauguucuguuaggag

SEQ ID NO: 534151 - RNA, 13 nt, Homo sapiens
cuauguugcccaa

SEQ ID NO: 534152 - RNA, 14 nt, Homo sapiens
cuauguuuauuuac

SEQ ID NO: 534153 - RNA, 18 nt, Homo sapiens
cuauguuuggcugcuaga

SEQ ID NO: 534154 - RNA, 20 nt, Homo sapiens
cuauuaaaacagccaaaacu

SEQ ID NO: 534155 - RNA, 21 nt, Homo sapiens
cuauuaaaagaauccaaauuc

SEQ ID NO: 534156 - RNA, 20 nt, Homo sapiens
cuauuaagacuuacuugcau

SEQ ID NO: 534157 - RNA, 16 nt, Homo sapiens
cuauuaauacucugca

SEQ ID NO: 534158 - RNA, 16 nt, Homo sapiens
cuauuacaccaaauaa

SEQ ID NO: 534159 - RNA, 14 nt, Homo sapiens
cuauuaccaugaga

SEQ ID NO: 534160 - RNA, 15 nt, Homo sapiens
cuauuacgugcaaua

SEQ ID NO: 534161 - RNA, 18 nt, Homo sapiens
cuauuaggaaauucugau

SEQ ID NO: 534162 - RNA, 22 nt, Homo sapiens
cuauuagggaguuaugcaaaau

SEQ ID NO: 534163 - RNA, 18 nt, Homo sapiens
cuauuauaaaacuugaau

SEQ ID NO: 534164 - RNA, 23 nt, Homo sapiens
cuauuauagaauggaacucaagg

SEQ ID NO: 534165 - RNA, 12 nt, Homo sapiens
cuauuaucucaa

SEQ ID NO: 534166 - RNA, 23 nt, Homo sapiens
cuauuauuuggagccugccaaga

SEQ ID NO: 534167 - RNA, 18 nt, Homo sapiens
cuauucccuaacucucgg

SEQ ID NO: 534168 - RNA, 20 nt, Homo sapiens
cuauucccucucucucccag

SEQ ID NO: 534169 - RNA, 19 nt, Homo sapiens
cuauucccuuugacuucag

SEQ ID NO: 534170 - RNA, 17 nt, Homo sapiens
cuauucuaaguaauucc

SEQ ID NO: 534171 - RNA, 13 nt, Homo sapiens
cuauucuauugca

SEQ ID NO: 534172 - RNA, 15 nt, Homo sapiens
cuauucuccugccau

SEQ ID NO: 534173 - RNA, 19 nt, Homo sapiens
cuauucuuaagcacuuuga

SEQ ID NO: 534174 - RNA, 15 nt, Homo sapiens
cuauugaacuguauu

SEQ ID NO: 534175 - RNA, 21 nt, Homo sapiens
cuauugauguacagucuguca

SEQ ID NO: 534176 - RNA, 12 nt, Homo sapiens
cuauugcugcuc

SEQ ID NO: 534177 - RNA, 19 nt, Homo sapiens
cuauuggugcuugacucuc

SEQ ID NO: 534178 - RNA, 19 nt, Homo sapiens
cuauuguaguaaacuugga

SEQ ID NO: 534179 - RNA, 20 nt, Homo sapiens
cuauuguauuauuuggaguu

SEQ ID NO: 534180 - RNA, 15 nt, Homo sapiens
cuauugucuguaaua

SEQ ID NO: 534181 - RNA, 21 nt, Homo sapiens
cuauugugaauauuuggaauu

SEQ ID NO: 534182 - RNA, 21 nt, Homo sapiens
cuauuguuacauuauguggaa

SEQ ID NO: 534183 - RNA, 15 nt, Homo sapiens
cuauuguuacucugg

SEQ ID NO: 534184 - RNA, 16 nt, Homo sapiens
cuauuguucacuuuau

SEQ ID NO: 534185 - RNA, 23 nt, Homo sapiens
cuauuuaaaaaaaaagucagaga

SEQ ID NO: 534186 - RNA, 15 nt, Homo sapiens
cuauuuaaguuauca

SEQ ID NO: 534187 - RNA, 17 nt, Homo sapiens
cuauuuacuuuauuaac

SEQ ID NO: 534188 - RNA, 19 nt, Homo sapiens
cuauuuauauguacaugag

SEQ ID NO: 534189 - RNA, 12 nt, Homo sapiens
cuauuuaugcaa

SEQ ID NO: 534190 - RNA, 16 nt, Homo sapiens
cuauuuccuaaaauca

SEQ ID NO: 534191 - RNA, 19 nt, Homo sapiens
cuauuucuucuacugcuau

SEQ ID NO: 534192 - RNA, 17 nt, Homo sapiens
cuauuugaacaugugcc

SEQ ID NO: 534193 - RNA, 21 nt, Homo sapiens
cuauuugccuccagugcaguc

SEQ ID NO: 534194 - RNA, 21 nt, Homo sapiens
cuauuuggggcuugcaugcca

SEQ ID NO: 534195 - RNA, 20 nt, Homo sapiens
cuauuuguaaaucugccaca

SEQ ID NO: 534196 - RNA, 14 nt, Homo sapiens
cuauuuguacaauu

SEQ ID NO: 534197 - RNA, 14 nt, Homo sapiens
cuauuuguuuucau

SEQ ID NO: 534198 - RNA, 14 nt, Homo sapiens
cuauuuucagagca

SEQ ID NO: 534199 - RNA, 17 nt, Homo sapiens
cuauuuugcaugcugaa

SEQ ID NO: 534200 - RNA, 17 nt, Homo sapiens
cacauuuuucagauaua

SEQ ID NO: 534201 - RNA, 15 nt, Homo sapiens
caccaaaacugcucc

SEQ ID NO: 534202 - RNA, 21 nt, Homo sapiens
caccaaacugcacacacagcu

SEQ ID NO: 534203 - RNA, 13 nt, Homo sapiens
caccaaagcugcc

SEQ ID NO: 534204 - RNA, 14 nt, Homo sapiens
caccaaagcugccc

SEQ ID NO: 534205 - RNA, 13 nt, Homo sapiens
caccaacuccuaa

SEQ ID NO: 534206 - RNA, 19 nt, Homo sapiens
caccaacugaaguggcuaa

SEQ ID NO: 534207 - RNA, 12 nt, Homo sapiens
caccaacuucac

SEQ ID NO: 534208 - RNA, 20 nt, Homo sapiens
caccaagaggguggaucaca

SEQ ID NO: 534209 - RNA, 23 nt, Homo sapiens
caccaaggcugagacagugaauu

SEQ ID NO: 534210 - RNA, 19 nt, Homo sapiens
caccaauauuucucagaca

SEQ ID NO: 534211 - RNA, 12 nt, Homo sapiens
caccaaugagcc

SEQ ID NO: 534212 - RNA, 16 nt, Homo sapiens
caccaaugagccuuag

SEQ ID NO: 534213 - RNA, 20 nt, Homo sapiens
caccaauuccaccaagacag

SEQ ID NO: 534214 - RNA, 13 nt, Homo sapiens
caccacacauaca

SEQ ID NO: 534215 - RNA, 12 nt, Homo sapiens
caccacagagaa

SEQ ID NO: 534216 - RNA, 14 nt, Homo sapiens
caccacagagccuc

SEQ ID NO: 534217 - RNA, 13 nt, Homo sapiens
caccaccacuuac

SEQ ID NO: 534218 - RNA, 16 nt, Homo sapiens
caccaccuacacagga

SEQ ID NO: 534219 - RNA, 14 nt, Homo sapiens
caccaccuggagug

SEQ ID NO: 534220 - RNA, 21 nt, Homo sapiens
cucaaccagagucacccaguu

SEQ ID NO: 534221 - RNA, 17 nt, Homo sapiens
cucaacccuugagauga

SEQ ID NO: 534222 - RNA, 14 nt, Homo sapiens
cucaagaaaucaaa

SEQ ID NO: 534223 - RNA, 15 nt, Homo sapiens
cucaagaaucuagaa

SEQ ID NO: 534224 - RNA, 14 nt, Homo sapiens
cucaagaccagaga

SEQ ID NO: 534225 - RNA, 17 nt, Homo sapiens
cucaagagagaggcuga

SEQ ID NO: 534226 - RNA, 14 nt, Homo sapiens
cucaagaguacaga

SEQ ID NO: 534227 - RNA, 14 nt, Homo sapiens
cucaagauucagua

SEQ ID NO: 534228 - RNA, 18 nt, Homo sapiens
cucaagauuugaccaaau

SEQ ID NO: 534229 - RNA, 16 nt, Homo sapiens
cucaagcaaccaugaa

SEQ ID NO: 534230 - RNA, 20 nt, Homo sapiens
cucaagccggaaacucggca

SEQ ID NO: 534231 - RNA, 16 nt, Homo sapiens
cucaagcuaaguaaaa

SEQ ID NO: 534232 - RNA, 20 nt, Homo sapiens
cucaaggaccaagagcaauu

SEQ ID NO: 534233 - RNA, 16 nt, Homo sapiens
cucaaggcugugcagg

SEQ ID NO: 534234 - RNA, 21 nt, Homo sapiens
cucaaggggcuggaaucucau

SEQ ID NO: 534235 - RNA, 23 nt, Homo sapiens
cucaaggguuauagacugccaug

SEQ ID NO: 534236 - RNA, 19 nt, Homo sapiens
cucaagguggucaguaaau

SEQ ID NO: 534237 - RNA, 20 nt, Homo sapiens
cucaagguucucauuucuca

SEQ ID NO: 534238 - RNA, 14 nt, Homo sapiens
cucaaguacucaaa

SEQ ID NO: 534239 - RNA, 14 nt, Homo sapiens
cucaaguccaaggc

SEQ ID NO: 534240 - RNA, 13 nt, Homo sapiens
cucaagucucagu

SEQ ID NO: 534241 - RNA, 19 nt, Homo sapiens
cucaagucuucccugauca

SEQ ID NO: 534242 - RNA, 13 nt, Homo sapiens
cucaagugagcca

SEQ ID NO: 534243 - RNA, 15 nt, Homo sapiens
cucaauaaauugcaa

SEQ ID NO: 534244 - RNA, 13 nt, Homo sapiens
cucaauacuugaa

SEQ ID NO: 534245 - RNA, 13 nt, Homo sapiens
cucaauagcuuga

SEQ ID NO: 534246 - RNA, 19 nt, Homo sapiens
cucaaucccugaggacuga

SEQ ID NO: 534247 - RNA, 15 nt, Homo sapiens
cucaauccuaucaca

SEQ ID NO: 534248 - RNA, 22 nt, Homo sapiens
cucaaucucagcuaacauucca

SEQ ID NO: 534249 - RNA, 11 nt, Homo sapiens
cucaaucugca

SEQ ID NO: 534250 - RNA, 21 nt, Homo sapiens
cucaaucugcaaacaugccag

SEQ ID NO: 534251 - RNA, 15 nt, Homo sapiens
cucaaucugcagcca

SEQ ID NO: 534252 - RNA, 23 nt, Homo sapiens
cucaaugaaaauuuaaagggaaa

SEQ ID NO: 534253 - RNA, 15 nt, Homo sapiens
cucaaugccaguaac

SEQ ID NO: 534254 - RNA, 20 nt, Homo sapiens
cucaauggauuugaugcugu

SEQ ID NO: 534255 - RNA, 17 nt, Homo sapiens
cucaauugucauugaua

SEQ ID NO: 534256 - RNA, 17 nt, Homo sapiens
cucaauuguuaauguga

SEQ ID NO: 534257 - RNA, 21 nt, Homo sapiens
cucaauuucucugaggacaca

SEQ ID NO: 534258 - RNA, 17 nt, Homo sapiens
cucaauuuuauguauuc

SEQ ID NO: 534259 - RNA, 22 nt, Homo sapiens
cucacaaaguagaggaauccau

SEQ ID NO: 534260 - RNA, 19 nt, Homo sapiens
cucacaagaagaccagacu

SEQ ID NO: 534261 - RNA, 21 nt, Homo sapiens
cucacaagaagaccagacugu

SEQ ID NO: 534262 - RNA, 16 nt, Homo sapiens
cucacaagcaugaagu

SEQ ID NO: 534263 - RNA, 13 nt, Homo sapiens
cucacacagaauu

SEQ ID NO: 534264 - RNA, 11 nt, Homo sapiens
cucacacccca

SEQ ID NO: 534265 - RNA, 16 nt, Homo sapiens
cucacacuaaucugaa

SEQ ID NO: 534266 - RNA, 17 nt, Homo sapiens
cucacacuacagaucag

SEQ ID NO: 534267 - RNA, 15 nt, Homo sapiens
cucacacugcugucc

SEQ ID NO: 534268 - RNA, 17 nt, Homo sapiens
cucacacuuacugcaaa

SEQ ID NO: 534269 - RNA, 20 nt, Homo sapiens
cucacacuuuuggaaccaug

SEQ ID NO: 534270 - RNA, 20 nt, Homo sapiens
cucacagaugugacuguaua

SEQ ID NO: 534271 - RNA, 22 nt, Homo sapiens
cucacagcccugcuuaccagau

SEQ ID NO: 534272 - RNA, 16 nt, Homo sapiens
cucacaucuguccaga

SEQ ID NO: 534273 - RNA, 13 nt, Homo sapiens
cucacaugcacag

SEQ ID NO: 534274 - RNA, 15 nt, Homo sapiens
cucacauuagaucua

SEQ ID NO: 534275 - RNA, 15 nt, Homo sapiens
cucaccagccccacu

SEQ ID NO: 534276 - RNA, 13 nt, Homo sapiens
cucaccauacucc

SEQ ID NO: 534277 - RNA, 23 nt, Homo sapiens
cucaccauacucccuuucagggc

SEQ ID NO: 534278 - RNA, 17 nt, Homo sapiens
cucaccaugaugugaag

SEQ ID NO: 534279 - RNA, 17 nt, Homo sapiens
cucacccagucuucuac

SEQ ID NO: 534280 - RNA, 23 nt, Homo sapiens
cucacccccagcuuugcuaccaa

SEQ ID NO: 534281 - RNA, 14 nt, Homo sapiens
cucaccccugggca

SEQ ID NO: 534282 - RNA, 14 nt, Homo sapiens
cucaccuacuccag

SEQ ID NO: 534283 - RNA, 23 nt, Homo sapiens
cucaccucauagcuaauuuuugc

SEQ ID NO: 534284 - RNA, 23 nt, Homo sapiens
cucaccucuacccaaacccuagg

SEQ ID NO: 534285 - RNA, 16 nt, Homo sapiens
cucaccuggacuccag

SEQ ID NO: 534286 - RNA, 12 nt, Homo sapiens
cucacgccugua

SEQ ID NO: 534287 - RNA, 14 nt, Homo sapiens
cucacgccuguaau

SEQ ID NO: 534288 - RNA, 17 nt, Homo sapiens
cucacgccuguaauccc

SEQ ID NO: 534289 - RNA, 15 nt, Homo sapiens
cucacguuugcuuaa

SEQ ID NO: 534290 - RNA, 11 nt, Homo sapiens
cucacuacuga

SEQ ID NO: 534291 - RNA, 22 nt, Homo sapiens
cucacuaggcccccacuugccu

SEQ ID NO: 534292 - RNA, 14 nt, Homo sapiens
cucacuaugcugcu

SEQ ID NO: 534293 - RNA, 15 nt, Homo sapiens
cucacucacucccca

SEQ ID NO: 534294 - RNA, 16 nt, Homo sapiens
cucacucccuguuuua

SEQ ID NO: 534295 - RNA, 14 nt, Homo sapiens
cucacuccuguuac

SEQ ID NO: 534296 - RNA, 23 nt, Homo sapiens
cucacuggggccuacagcuuuga

SEQ ID NO: 534297 - RNA, 15 nt, Homo sapiens
cucacugucuauuua

SEQ ID NO: 534298 - RNA, 21 nt, Homo sapiens
cucacugugggaaggccagcu

SEQ ID NO: 534299 - RNA, 20 nt, Homo sapiens
cucacuguggugucuguguu

SEQ ID NO: 534300 - RNA, 18 nt, Homo sapiens
cucacuugugcaguguug

SEQ ID NO: 534301 - RNA, 15 nt, Homo sapiens
cucacuuuucaauuu

SEQ ID NO: 534302 - RNA, 19 nt, Homo sapiens
cucacuuuucuccaugagu

SEQ ID NO: 534303 - RNA, 21 nt, Homo sapiens
cucacuuuuuccaaaugaucc

SEQ ID NO: 534304 - RNA, 18 nt, Homo sapiens
cucagaaaagugacagug

SEQ ID NO: 534305 - RNA, 22 nt, Homo sapiens
cucagaaauuuucugaucucag

SEQ ID NO: 534306 - RNA, 13 nt, Homo sapiens
cucagaacauaaa

SEQ ID NO: 534307 - RNA, 17 nt, Homo sapiens
cucagaaccuuguccca

SEQ ID NO: 534308 - RNA, 14 nt, Homo sapiens
cucagaaguacuuu

SEQ ID NO: 534309 - RNA, 21 nt, Homo sapiens
cucagaauaaaagaugauuuc

SEQ ID NO: 534310 - RNA, 22 nt, Homo sapiens
cucagaauauugucugccuuaa

SEQ ID NO: 534311 - RNA, 17 nt, Homo sapiens
cucagagaccagcacuc

SEQ ID NO: 534312 - RNA, 15 nt, Homo sapiens
cucagagcaggcuca

SEQ ID NO: 534313 - RNA, 19 nt, Homo sapiens
cucagagcaggggccagau

SEQ ID NO: 534314 - RNA, 18 nt, Homo sapiens
cucagaggaugaggucaa

SEQ ID NO: 534315 - RNA, 16 nt, Homo sapiens
cucagaggcgcacugu

SEQ ID NO: 534316 - RNA, 13 nt, Homo sapiens
cucagagugcaag

SEQ ID NO: 534317 - RNA, 16 nt, Homo sapiens
cucagauagaucugug

SEQ ID NO: 534318 - RNA, 18 nt, Homo sapiens
cucagaucaguguaccau

SEQ ID NO: 534319 - RNA, 13 nt, Homo sapiens
cucagauguugaa

SEQ ID NO: 534320 - RNA, 17 nt, Homo sapiens
cucagcaauagggugca

SEQ ID NO: 534321 - RNA, 22 nt, Homo sapiens
cucagcacaccggcauccccac

SEQ ID NO: 534322 - RNA, 20 nt, Homo sapiens
cucagcaguccacaaagcau

SEQ ID NO: 534323 - RNA, 21 nt, Homo sapiens
cucagcaguccacaaagcauu

SEQ ID NO: 534324 - RNA, 14 nt, Homo sapiens
caccucauucugaa

SEQ ID NO: 534325 - RNA, 13 nt, Homo sapiens
caccuccauuaaa

SEQ ID NO: 534326 - RNA, 13 nt, Homo sapiens
caccuccauuugc

SEQ ID NO: 534327 - RNA, 21 nt, Homo sapiens
caccucccccuacccauaucc

SEQ ID NO: 534328 - RNA, 23 nt, Homo sapiens
caccucccccuuucacacuggau

SEQ ID NO: 534329 - RNA, 20 nt, Homo sapiens
caccucccugcucagugcuu

SEQ ID NO: 534330 - RNA, 15 nt, Homo sapiens
caccuccgcuugcca

SEQ ID NO: 534331 - RNA, 22 nt, Homo sapiens
caccuccuagaggugggcagcu

SEQ ID NO: 534332 - RNA, 11 nt, Homo sapiens
caccuccucau

SEQ ID NO: 534333 - RNA, 16 nt, Homo sapiens
caccuccucauguaca

SEQ ID NO: 534334 - RNA, 20 nt, Homo sapiens
caccuccucauguacauacc

SEQ ID NO: 534335 - RNA, 15 nt, Homo sapiens
caccuccuccacuca

SEQ ID NO: 534336 - RNA, 21 nt, Homo sapiens
caccucgcuccccucuggaau

SEQ ID NO: 534337 - RNA, 21 nt, Homo sapiens
caccucggcacacacugugcc

SEQ ID NO: 534338 - RNA, 15 nt, Homo sapiens
caccucuaaacaucu

SEQ ID NO: 534339 - RNA, 11 nt, Homo sapiens
caccucuccaa

SEQ ID NO: 534340 - RNA, 20 nt, Homo sapiens
caccucugccucaaugugaa

SEQ ID NO: 534341 - RNA, 15 nt, Homo sapiens
caccucuuccuugau

SEQ ID NO: 534342 - RNA, 15 nt, Homo sapiens
cucagcuucuucaca

SEQ ID NO: 534343 - RNA, 16 nt, Homo sapiens
cucaggagaagggaua

SEQ ID NO: 534344 - RNA, 15 nt, Homo sapiens
cucaggauccaguga

SEQ ID NO: 534345 - RNA, 21 nt, Homo sapiens
cucaggccaagcccaauacag

SEQ ID NO: 534346 - RNA, 18 nt, Homo sapiens
cucaggccuaggugcgca

SEQ ID NO: 534347 - RNA, 21 nt, Homo sapiens
cucaggccugaggugugugcc

SEQ ID NO: 534348 - RNA, 15 nt, Homo sapiens
cucaggcuugaaaug

SEQ ID NO: 534349 - RNA, 16 nt, Homo sapiens
cucagggagcagggaa

SEQ ID NO: 534350 - RNA, 17 nt, Homo sapiens
cucagggagcagggaag

SEQ ID NO: 534351 - RNA, 21 nt, Homo sapiens
cucagggcagcugccuggcca

SEQ ID NO: 534352 - RNA, 20 nt, Homo sapiens
cucaggggagcaagcuuaca

SEQ ID NO: 534353 - RNA, 14 nt, Homo sapiens
cucaggggccagug

SEQ ID NO: 534354 - RNA, 18 nt, Homo sapiens
cucagggucaaagacaga

SEQ ID NO: 534355 - RNA, 14 nt, Homo sapiens
cucagggugggggg

SEQ ID NO: 534356 - RNA, 15 nt, Homo sapiens
cucagguaguacugg

SEQ ID NO: 534357 - RNA, 17 nt, Homo sapiens
cucagguguugccaaau

SEQ ID NO: 534358 - RNA, 15 nt, Homo sapiens
cucagguucuuucca

SEQ ID NO: 534359 - RNA, 13 nt, Homo sapiens
cucaguaccccau

SEQ ID NO: 534360 - RNA, 14 nt, Homo sapiens
cucaguaguauaug

SEQ ID NO: 534361 - RNA, 19 nt, Homo sapiens
cucagucauuuuuaaccuc

SEQ ID NO: 534362 - RNA, 17 nt, Homo sapiens
cucagucccaucagaga

SEQ ID NO: 534363 - RNA, 23 nt, Homo sapiens
cucaguccugggucaacaucuua

SEQ ID NO: 534364 - RNA, 18 nt, Homo sapiens
cucagucucugagcagug

SEQ ID NO: 534365 - RNA, 15 nt, Homo sapiens
cucagucucuuccac

SEQ ID NO: 534366 - RNA, 15 nt, Homo sapiens
cucagugacucagaa

SEQ ID NO: 534367 - RNA, 20 nt, Homo sapiens
cucagugagcuggggccguc

SEQ ID NO: 534368 - RNA, 22 nt, Homo sapiens
cucagugcaucuaaucacuuag

SEQ ID NO: 534369 - RNA, 17 nt, Homo sapiens
cucagugggacucugau

SEQ ID NO: 534370 - RNA, 23 nt, Homo sapiens
cucaguuauuacauguaauuuga

SEQ ID NO: 534371 - RNA, 14 nt, Homo sapiens
cucaguuggugcug

SEQ ID NO: 534372 - RNA, 21 nt, Homo sapiens
cucaguuggugcugcuuucuu

SEQ ID NO: 534373 - RNA, 15 nt, Homo sapiens
cucaguuuccucauc

SEQ ID NO: 534374 - RNA, 18 nt, Homo sapiens
cucaguuugugugucuua

SEQ ID NO: 534375 - RNA, 15 nt, Homo sapiens
cucauaaaaagcaaa

SEQ ID NO: 534376 - RNA, 17 nt, Homo sapiens
cucauaaaccaaugugg

SEQ ID NO: 534377 - RNA, 15 nt, Homo sapiens
cucauaaggugcuau

SEQ ID NO: 534378 - RNA, 15 nt, Homo sapiens
cucauaaucuauaaa

SEQ ID NO: 534379 - RNA, 13 nt, Homo sapiens
cucauacacagaa

SEQ ID NO: 534380 - RNA, 21 nt, Homo sapiens
cucauaccagcauacgcucac

SEQ ID NO: 534381 - RNA, 18 nt, Homo sapiens
cucauaccuacaucagac

SEQ ID NO: 534382 - RNA, 18 nt, Homo sapiens
cucauacugucugggauu

SEQ ID NO: 534383 - RNA, 15 nt, Homo sapiens
cucauagauugcaaa

SEQ ID NO: 534384 - RNA, 23 nt, Homo sapiens
cucauagggugcucugaggucaa

SEQ ID NO: 534385 - RNA, 19 nt, Homo sapiens
cucauaucaugguagucac

SEQ ID NO: 534386 - RNA, 13 nt, Homo sapiens
cucaucaaucaaa

SEQ ID NO: 534387 - RNA, 16 nt, Homo sapiens
cucaucacauaaaagg

SEQ ID NO: 534388 - RNA, 18 nt, Homo sapiens
cucaucagacucugagua

SEQ ID NO: 534389 - RNA, 22 nt, Homo sapiens
cucaucaguguccucuugcuca

SEQ ID NO: 534390 - RNA, 18 nt, Homo sapiens
cucaucaucagagccuuu

SEQ ID NO: 534391 - RNA, 14 nt, Homo sapiens
cucaucauuccuug

SEQ ID NO: 534392 - RNA, 12 nt, Homo sapiens
cucauccaaagu

SEQ ID NO: 534393 - RNA, 12 nt, Homo sapiens
cucauccagggc

SEQ ID NO: 534394 - RNA, 18 nt, Homo sapiens
cucauccccacagcuggc

SEQ ID NO: 534395 - RNA, 21 nt, Homo sapiens
cucaucccccagccacagugg

SEQ ID NO: 534396 - RNA, 17 nt, Homo sapiens
cucaucccgagcaccuc

SEQ ID NO: 534397 - RNA, 20 nt, Homo sapiens
cucauccucuuuuaauggca

SEQ ID NO: 534398 - RNA, 23 nt, Homo sapiens
cucaucuacugaaugaccucucu

SEQ ID NO: 534399 - RNA, 17 nt, Homo sapiens
cucaucuucacagauug

SEQ ID NO: 534400 - RNA, 22 nt, Homo sapiens
cucaugaacuaccccacaacac

SEQ ID NO: 534401 - RNA, 12 nt, Homo sapiens
cucaugccugua

SEQ ID NO: 534402 - RNA, 22 nt, Homo sapiens
cucaugcuguugcugcuacugu

SEQ ID NO: 534403 - RNA, 16 nt, Homo sapiens
cucaugcuucacuuag

SEQ ID NO: 534404 - RNA, 21 nt, Homo sapiens
cucauggauugccacagcuca

SEQ ID NO: 534405 - RNA, 20 nt, Homo sapiens
cucauggcagcuaagccaca

SEQ ID NO: 534406 - RNA, 21 nt, Homo sapiens
cucauggcagcuaagccacau

SEQ ID NO: 534407 - RNA, 16 nt, Homo sapiens
cucaugggaaggggag

SEQ ID NO: 534408 - RNA, 18 nt, Homo sapiens
cucaugugaaaggggaau

SEQ ID NO: 534409 - RNA, 13 nt, Homo sapiens
cucauuagacugg

SEQ ID NO: 534410 - RNA, 12 nt, Homo sapiens
cucauucaaaag

SEQ ID NO: 534411 - RNA, 22 nt, Homo sapiens
cucauucaucuugcaagcaaau

SEQ ID NO: 534412 - RNA, 18 nt, Homo sapiens
cucauuccuguagucaaa

SEQ ID NO: 534413 - RNA, 16 nt, Homo sapiens
cucauuccuucacuca

SEQ ID NO: 534414 - RNA, 19 nt, Homo sapiens
cucauuuaaaacaggcaaa

SEQ ID NO: 534415 - RNA, 17 nt, Homo sapiens
cucauuucacagccuuu

SEQ ID NO: 534416 - RNA, 11 nt, Homo sapiens
cucauuucacu

SEQ ID NO: 534417 - RNA, 14 nt, Homo sapiens
cucauuucaucuca

SEQ ID NO: 534418 - RNA, 15 nt, Homo sapiens
cucauuucaucucau

SEQ ID NO: 534419 - RNA, 22 nt, Homo sapiens
cucauuuccaaaccaucagcug

SEQ ID NO: 534420 - RNA, 20 nt, Homo sapiens
cucauuugagauaaagucaa

SEQ ID NO: 534421 - RNA, 18 nt, Homo sapiens
cucauuuggauugccuua

SEQ ID NO: 534422 - RNA, 14 nt, Homo sapiens
cucauuuguucuca

SEQ ID NO: 534423 - RNA, 13 nt, Homo sapiens
cuccaaaacccau

SEQ ID NO: 534424 - RNA, 16 nt, Homo sapiens
cuccaaaaggcccuuu

SEQ ID NO: 534425 - RNA, 13 nt, Homo sapiens
cuccaaaauauua

SEQ ID NO: 534426 - RNA, 18 nt, Homo sapiens
cuccaacccgacaugugu

SEQ ID NO: 534427 - RNA, 19 nt, Homo sapiens
cuccaacccuagcaaaagu

SEQ ID NO: 534428 - RNA, 13 nt, Homo sapiens
cuccaacuccuga

SEQ ID NO: 534429 - RNA, 17 nt, Homo sapiens
cuccaagacccuguguu

SEQ ID NO: 534430 - RNA, 14 nt, Homo sapiens
cuccaagcauuuca

SEQ ID NO: 534431 - RNA, 21 nt, Homo sapiens
cuccaagggacccuuugccuu

SEQ ID NO: 534432 - RNA, 20 nt, Homo sapiens
cuccaagguagaauuugcaa

SEQ ID NO: 534433 - RNA, 14 nt, Homo sapiens
cuccaaugccuacu

SEQ ID NO: 534434 - RNA, 17 nt, Homo sapiens
cuccaaugucugcugag

SEQ ID NO: 534435 - RNA, 15 nt, Homo sapiens
cuccaauuggugcuu

SEQ ID NO: 534436 - RNA, 14 nt, Homo sapiens
cuccacaaagcaaa

SEQ ID NO: 534437 - RNA, 12 nt, Homo sapiens
cuccacaccucu

SEQ ID NO: 534438 - RNA, 21 nt, Homo sapiens
cuccacaccucuaaacaucuc

SEQ ID NO: 534439 - RNA, 13 nt, Homo sapiens
cuccacaucugcc

SEQ ID NO: 534440 - RNA, 17 nt, Homo sapiens
cuccacaucugccuuaa

SEQ ID NO: 534441 - RNA, 21 nt, Homo sapiens
cuccacaugcugccuggcaca

SEQ ID NO: 534442 - RNA, 23 nt, Homo sapiens
cuccacauggaagcccaacuggg

SEQ ID NO: 534443 - RNA, 18 nt, Homo sapiens
cuccaccaacccaucaga

SEQ ID NO: 534444 - RNA, 23 nt, Homo sapiens
cuccaccaaccccgcggcccaga

SEQ ID NO: 534445 - RNA, 19 nt, Homo sapiens
cuccaccacccaacccaaa

SEQ ID NO: 534446 - RNA, 23 nt, Homo sapiens
cuccaccccauuuuacagaggag

SEQ ID NO: 534447 - RNA, 11 nt, Homo sapiens
cuccaccucaa

SEQ ID NO: 534448 - RNA, 15 nt, Homo sapiens
cuccaccugcuggug

SEQ ID NO: 534449 - RNA, 14 nt, Homo sapiens
cuccacucacucca

SEQ ID NO: 534450 - RNA, 15 nt, Homo sapiens
cuccacucagguucu

SEQ ID NO: 534451 - RNA, 12 nt, Homo sapiens
cuccacugccuc

SEQ ID NO: 534452 - RNA, 16 nt, Homo sapiens
cuccacugccuucgau

SEQ ID NO: 534453 - RNA, 22 nt, Homo sapiens
cuccacugcuggacaugagaug

SEQ ID NO: 534454 - RNA, 19 nt, Homo sapiens
cuccacuggucugucuuug

SEQ ID NO: 534455 - RNA, 18 nt, Homo sapiens
cuccacuugaagcacuua

SEQ ID NO: 534456 - RNA, 18 nt, Homo sapiens
cuccagaagcugcuccuu

SEQ ID NO: 534457 - RNA, 23 nt, Homo sapiens
cuccagacacaccugaacacauc

SEQ ID NO: 534458 - RNA, 17 nt, Homo sapiens
cuccagagacagggaaa

SEQ ID NO: 534459 - RNA, 13 nt, Homo sapiens
cuccagagacccc

SEQ ID NO: 534460 - RNA, 17 nt, Homo sapiens
cuccagaggaugacugg

SEQ ID NO: 534461 - RNA, 20 nt, Homo sapiens
cuccagauaguguagcugag

SEQ ID NO: 534462 - RNA, 16 nt, Homo sapiens
cuccagccagcaauga

SEQ ID NO: 534463 - RNA, 21 nt, Homo sapiens
cuccagccuggcuacagggcg

SEQ ID NO: 534464 - RNA, 18 nt, Homo sapiens
cuccuagaagaaccaaau

SEQ ID NO: 534465 - RNA, 15 nt, Homo sapiens
cuccuagagugcagg

SEQ ID NO: 534466 - RNA, 18 nt, Homo sapiens
cuccuagccccucucuca

SEQ ID NO: 534467 - RNA, 16 nt, Homo sapiens
cuccuauaaucuguca

SEQ ID NO: 534468 - RNA, 17 nt, Homo sapiens
cuccuauaaucugucaa

SEQ ID NO: 534469 - RNA, 20 nt, Homo sapiens
cuccuaucuugauuucacug

SEQ ID NO: 534470 - RNA, 22 nt, Homo sapiens
cuccucacuggaggagcagcuu

SEQ ID NO: 534471 - RNA, 18 nt, Homo sapiens
cuccucaguaaauguaca

SEQ ID NO: 534472 - RNA, 16 nt, Homo sapiens
cuccucauccauuucu

SEQ ID NO: 534473 - RNA, 17 nt, Homo sapiens
cuccuccagaccauuca

SEQ ID NO: 534474 - RNA, 14 nt, Homo sapiens
cuccuccagccaug

SEQ ID NO: 534475 - RNA, 12 nt, Homo sapiens
cuccuccaggga

SEQ ID NO: 534476 - RNA, 23 nt, Homo sapiens
cuccuccaggguggcagcaacaa

SEQ ID NO: 534477 - RNA, 20 nt, Homo sapiens
cuccuccguguggacugugc

SEQ ID NO: 534478 - RNA, 12 nt, Homo sapiens
cuccucuacucu

SEQ ID NO: 534479 - RNA, 12 nt, Homo sapiens
cuccucuaguaa

SEQ ID NO: 534480 - RNA, 18 nt, Homo sapiens
cuccucucugggccuuug

SEQ ID NO: 534481 - RNA, 12 nt, Homo sapiens
cuccucugcacu

SEQ ID NO: 534482 - RNA, 22 nt, Homo sapiens
cuccucuggacggcaggcucac

SEQ ID NO: 534483 - RNA, 16 nt, Homo sapiens
cuccucuucagaggag

SEQ ID NO: 534484 - RNA, 22 nt, Homo sapiens
cuccucuugguggguguggcca

SEQ ID NO: 534485 - RNA, 23 nt, Homo sapiens
cuccugaagggaaggcaaaggca

SEQ ID NO: 534486 - RNA, 16 nt, Homo sapiens
cuccugacagcaauaa

SEQ ID NO: 534487 - RNA, 20 nt, Homo sapiens
cuccugaccucaaguaaucc

SEQ ID NO: 534488 - RNA, 14 nt, Homo sapiens
cuccugagccugug

SEQ ID NO: 534489 - RNA, 20 nt, Homo sapiens
cuccugauccugacacauuc

SEQ ID NO: 534490 - RNA, 21 nt, Homo sapiens
cuccugauguagcuugagaua

SEQ ID NO: 534491 - RNA, 15 nt, Homo sapiens
cuccugcccaggaga

SEQ ID NO: 534492 - RNA, 18 nt, Homo sapiens
cuccugccccaugcugcc

SEQ ID NO: 534493 - RNA, 14 nt, Homo sapiens
cuccugccuacuca

SEQ ID NO: 534494 - RNA, 12 nt, Homo sapiens
cuccugccugag

SEQ ID NO: 534495 - RNA, 23 nt, Homo sapiens
cuccugcucuuucuacaugacug

SEQ ID NO: 534496 - RNA, 23 nt, Homo sapiens
cuccuggaaaggcucagucucag

SEQ ID NO: 534497 - RNA, 21 nt, Homo sapiens
cuccuggaccuugacagagca

SEQ ID NO: 534498 - RNA, 22 nt, Homo sapiens
cuccuggacuccggaggacuga

SEQ ID NO: 534499 - RNA, 19 nt, Homo sapiens
cuccuggcucaagcccuga

SEQ ID NO: 534500 - RNA, 13 nt, Homo sapiens
cuccugggcucaa

SEQ ID NO: 534501 - RNA, 18 nt, Homo sapiens
cuccugggcucaagugau

SEQ ID NO: 534502 - RNA, 17 nt, Homo sapiens
cuccuggggacuuggaa

SEQ ID NO: 534503 - RNA, 15 nt, Homo sapiens
cuccuggggagcucc

SEQ ID NO: 534504 - RNA, 19 nt, Homo sapiens
cuccugguaacguggcucc

SEQ ID NO: 534505 - RNA, 14 nt, Homo sapiens
cuccuguacacuga

SEQ ID NO: 534506 - RNA, 14 nt, Homo sapiens
cuccuguaccucag

SEQ ID NO: 534507 - RNA, 17 nt, Homo sapiens
cuccuguaccucagugg

SEQ ID NO: 534508 - RNA, 19 nt, Homo sapiens
cuccugugaccccaccuug

SEQ ID NO: 534509 - RNA, 22 nt, Homo sapiens
cuccugugugauugacagcuuu

SEQ ID NO: 534510 - RNA, 15 nt, Homo sapiens
cuccuguucgccucc

SEQ ID NO: 534511 - RNA, 18 nt, Homo sapiens
cuccuguucugaaaccuu

SEQ ID NO: 534512 - RNA, 20 nt, Homo sapiens
cuccuuaauagccauaugca

SEQ ID NO: 534513 - RNA, 21 nt, Homo sapiens
cuccuuaauagccauaugcaa

SEQ ID NO: 534514 - RNA, 23 nt, Homo sapiens
cuccuuauagacacuugcuccca

SEQ ID NO: 534515 - RNA, 20 nt, Homo sapiens
cuccuuauucccaguguucc

SEQ ID NO: 534516 - RNA, 14 nt, Homo sapiens
cuccuucaaugcaa

SEQ ID NO: 534517 - RNA, 15 nt, Homo sapiens
cuccuucagacaccc

SEQ ID NO: 534518 - RNA, 15 nt, Homo sapiens
cuccuuccacaugua

SEQ ID NO: 534519 - RNA, 17 nt, Homo sapiens
cuccuuccagcacugac

SEQ ID NO: 534520 - RNA, 13 nt, Homo sapiens
cuccuuccagggc

SEQ ID NO: 534521 - RNA, 17 nt, Homo sapiens
cuccuucuuccuagcca

SEQ ID NO: 534522 - RNA, 21 nt, Homo sapiens
cuccuugcccagacuacaggg

SEQ ID NO: 534523 - RNA, 19 nt, Homo sapiens
cuccuugcccucaagcaau

SEQ ID NO: 534524 - RNA, 15 nt, Homo sapiens
cuccuugcugacccc

SEQ ID NO: 534525 - RNA, 16 nt, Homo sapiens
cuccuugcugcauuga

SEQ ID NO: 534526 - RNA, 18 nt, Homo sapiens
cuccuuggcugucugugg

SEQ ID NO: 534527 - RNA, 17 nt, Homo sapiens
cuccuuguguugcacug

SEQ ID NO: 534528 - RNA, 12 nt, Homo sapiens
cuccuuguuaau

SEQ ID NO: 534529 - RNA, 21 nt, Homo sapiens
cuccuuuaccuuucagugcag

SEQ ID NO: 534530 - RNA, 19 nt, Homo sapiens
cuccuuucuccugugaaug

SEQ ID NO: 534531 - RNA, 15 nt, Homo sapiens
cuccuuuguucugua

SEQ ID NO: 534532 - RNA, 18 nt, Homo sapiens
cuccuuuucccaaagcau

SEQ ID NO: 534533 - RNA, 16 nt, Homo sapiens
cuccuuuugaccaaau

SEQ ID NO: 534534 - RNA, 21 nt, Homo sapiens
cucgaagucauggccaccucc

SEQ ID NO: 534535 - RNA, 15 nt, Homo sapiens
cucgacaaaggccac

SEQ ID NO: 534536 - RNA, 12 nt, Homo sapiens
cucgagugaauu

SEQ ID NO: 534537 - RNA, 20 nt, Homo sapiens
cucgauagccugagguggga

SEQ ID NO: 534538 - RNA, 16 nt, Homo sapiens
cucgaugaagcccaau

SEQ ID NO: 534539 - RNA, 13 nt, Homo sapiens
cucgaugccugau

SEQ ID NO: 534540 - RNA, 21 nt, Homo sapiens
cucgcacaccucugcaccuuu

SEQ ID NO: 534541 - RNA, 13 nt, Homo sapiens
cucgcacucuggu

SEQ ID NO: 534542 - RNA, 19 nt, Homo sapiens
cucgcagcacccacagcac

SEQ ID NO: 534543 - RNA, 16 nt, Homo sapiens
cucgccacgaacuagg

SEQ ID NO: 534544 - RNA, 15 nt, Homo sapiens
cucgcccaacuccac

SEQ ID NO: 534545 - RNA, 17 nt, Homo sapiens
cucgccuaggccuguga

SEQ ID NO: 534546 - RNA, 12 nt, Homo sapiens
cucgcucaggug

SEQ ID NO: 534547 - RNA, 17 nt, Homo sapiens
cucgcuccccucuggaa

SEQ ID NO: 534548 - RNA, 10 nt, Homo sapiens
cucgcugcca

SEQ ID NO: 534549 - RNA, 23 nt, Homo sapiens
cucggaaauggaaugugccccug

SEQ ID NO: 534550 - RNA, 21 nt, Homo sapiens
cucggagggauggagaaagaa

SEQ ID NO: 534551 - RNA, 17 nt, Homo sapiens
cucggcacacacugugc

SEQ ID NO: 534552 - RNA, 17 nt, Homo sapiens
cucggccucccaaagug

SEQ ID NO: 534553 - RNA, 17 nt, Homo sapiens
cucggcguuagucccua

SEQ ID NO: 534554 - RNA, 18 nt, Homo sapiens
cucgggcuugagugagaa

SEQ ID NO: 534555 - RNA, 19 nt, Homo sapiens
cucgggguccagugcauuu

SEQ ID NO: 534556 - RNA, 21 nt, Homo sapiens
cucgggugcauuugagagaag

SEQ ID NO: 534557 - RNA, 15 nt, Homo sapiens
cucgugagucauuua

SEQ ID NO: 534558 - RNA, 20 nt, Homo sapiens
cucgugguaggacuguagaa

SEQ ID NO: 534559 - RNA, 21 nt, Homo sapiens
cucguuccagaaauuguggga

SEQ ID NO: 534560 - RNA, 16 nt, Homo sapiens
cucguuccggucccca

SEQ ID NO: 534561 - RNA, 22 nt, Homo sapiens
cucguucuccuuccccauuucc

SEQ ID NO: 534562 - RNA, 19 nt, Homo sapiens
cucguugccugccacugag

SEQ ID NO: 534563 - RNA, 21 nt, Homo sapiens
cucguuggaugucugugagua

SEQ ID NO: 534564 - RNA, 14 nt, Homo sapiens
cucuaaacugcaaa

SEQ ID NO: 534565 - RNA, 13 nt, Homo sapiens
cucuaaagaccau

SEQ ID NO: 534566 - RNA, 13 nt, Homo sapiens
cucuaaaguccag

SEQ ID NO: 534567 - RNA, 14 nt, Homo sapiens
cucuaaaugcaguu

SEQ ID NO: 534568 - RNA, 14 nt, Homo sapiens
cucuaaccauucaa

SEQ ID NO: 534569 - RNA, 15 nt, Homo sapiens
cucuaacucacugcc

SEQ ID NO: 534570 - RNA, 16 nt, Homo sapiens
cucuaagggaccucaa

SEQ ID NO: 534571 - RNA, 13 nt, Homo sapiens
cucuaagucaugu

SEQ ID NO: 534572 - RNA, 21 nt, Homo sapiens
cucuaagucauguauguuucu

SEQ ID NO: 534573 - RNA, 21 nt, Homo sapiens
cucuaaguuccacugagcucc

SEQ ID NO: 534574 - RNA, 18 nt, Homo sapiens
cucuaaucuaauauauaa

SEQ ID NO: 534575 - RNA, 12 nt, Homo sapiens
cucuaaugagcu

SEQ ID NO: 534576 - RNA, 13 nt, Homo sapiens
cucuacaaaaagc

SEQ ID NO: 534577 - RNA, 14 nt, Homo sapiens
cucuacaaaaagca

SEQ ID NO: 534578 - RNA, 14 nt, Homo sapiens
cucuacacccugaa

SEQ ID NO: 534579 - RNA, 14 nt, Homo sapiens
cucuacagacucca

SEQ ID NO: 534580 - RNA, 15 nt, Homo sapiens
cucuacagacuccaa

SEQ ID NO: 534581 - RNA, 16 nt, Homo sapiens
cucuacagacuccaaa

SEQ ID NO: 534582 - RNA, 16 nt, Homo sapiens
cucuacagacuucucc

SEQ ID NO: 534583 - RNA, 22 nt, Homo sapiens
cucuacaggugcaacagguuca

SEQ ID NO: 534584 - RNA, 19 nt, Homo sapiens
cucuacaucuucugccuua

SEQ ID NO: 534585 - RNA, 19 nt, Homo sapiens
cucuaccagucuauuucca

SEQ ID NO: 534586 - RNA, 16 nt, Homo sapiens
cagccacgacugccau

SEQ ID NO: 534587 - RNA, 20 nt, Homo sapiens
cagccagaacuuucuuucac

SEQ ID NO: 534588 - RNA, 20 nt, Homo sapiens
cagccagaaggaaugcacag

SEQ ID NO: 534589 - RNA, 19 nt, Homo sapiens
cagccagaaggggcugcuu

SEQ ID NO: 534590 - RNA, 12 nt, Homo sapiens
cagccagcacuu

SEQ ID NO: 534591 - RNA, 14 nt, Homo sapiens
cagccaggacaucu

SEQ ID NO: 534592 - RNA, 15 nt, Homo sapiens
cugguugguuuugcc

SEQ ID NO: 534593 - RNA, 19 nt, Homo sapiens
cugguugucauuuuugcag

SEQ ID NO: 534594 - RNA, 22 nt, Homo sapiens
cugguuguugccaaacagccac

SEQ ID NO: 534595 - RNA, 12 nt, Homo sapiens
cugguuuuaaca

SEQ ID NO: 534596 - RNA, 14 nt, Homo sapiens
cugguuuucuagcc

SEQ ID NO: 534597 - RNA, 17 nt, Homo sapiens
cugguuuucugccaaug

SEQ ID NO: 534598 - RNA, 21 nt, Homo sapiens
cugguuuugacaucagcauua

SEQ ID NO: 534599 - RNA, 21 nt, Homo sapiens
cugguuuuuguagccuuccuc

SEQ ID NO: 534600 - RNA, 19 nt, Homo sapiens
cuguaaaauuaaacaaaua

SEQ ID NO: 534601 - RNA, 16 nt, Homo sapiens
cuguaaacuuccaagc

SEQ ID NO: 534602 - RNA, 20 nt, Homo sapiens
cuguaaacuuuaucacuuaa

SEQ ID NO: 534603 - RNA, 21 nt, Homo sapiens
cuguaaagacuuuuucaaaga

SEQ ID NO: 534604 - RNA, 20 nt, Homo sapiens
cuguaaagucuaaucucuaa

SEQ ID NO: 534605 - RNA, 14 nt, Homo sapiens
cuguaaauaaccua

SEQ ID NO: 534606 - RNA, 12 nt, Homo sapiens
cuguaaauaugu

SEQ ID NO: 534607 - RNA, 15 nt, Homo sapiens
cuguaaaugacacuu

SEQ ID NO: 534608 - RNA, 18 nt, Homo sapiens
cuguaaaugcauuggaau

SEQ ID NO: 534609 - RNA, 23 nt, Homo sapiens
cuguaaauguuauuaaaauaucc

SEQ ID NO: 534610 - RNA, 23 nt, Homo sapiens
cuguaacccuggcacuuaagggg

SEQ ID NO: 534611 - RNA, 19 nt, Homo sapiens
cuguaacuacaaugauggu

SEQ ID NO: 534612 - RNA, 12 nt, Homo sapiens
cuguaacuacuu

SEQ ID NO: 534613 - RNA, 19 nt, Homo sapiens
cuguaagauaauguugcuu

SEQ ID NO: 534614 - RNA, 16 nt, Homo sapiens
cuguaagauauuaguu

SEQ ID NO: 534615 - RNA, 12 nt, Homo sapiens
cuguaagggcag

SEQ ID NO: 534616 - RNA, 23 nt, Homo sapiens
cuguaauagugaacauauggaaa

SEQ ID NO: 534617 - RNA, 12 nt, Homo sapiens
cuguaaucaaua

SEQ ID NO: 534618 - RNA, 21 nt, Homo sapiens
cuguaaucucagcacuuuggg

SEQ ID NO: 534619 - RNA, 16 nt, Homo sapiens
cuguaauugaauauaa

SEQ ID NO: 534620 - RNA, 20 nt, Homo sapiens
cuguacaaaauaacucucca

SEQ ID NO: 534621 - RNA, 17 nt, Homo sapiens
cuguacaaaguagaagu

SEQ ID NO: 534622 - RNA, 18 nt, Homo sapiens
cuguacacugacuugaga

SEQ ID NO: 534623 - RNA, 19 nt, Homo sapiens
cuguacaggaaggugccug

SEQ ID NO: 534624 - RNA, 11 nt, Homo sapiens
cuguacagugu

SEQ ID NO: 534625 - RNA, 19 nt, Homo sapiens
cuguacauaaauuccagag

SEQ ID NO: 534626 - RNA, 17 nt, Homo sapiens
cuguacauacugcagug

SEQ ID NO: 534627 - RNA, 12 nt, Homo sapiens
cuguacauucuu

SEQ ID NO: 534628 - RNA, 15 nt, Homo sapiens
cuguacauugugagc

SEQ ID NO: 534629 - RNA, 22 nt, Homo sapiens
cuguaccacaucugcucuaggg

SEQ ID NO: 534630 - RNA, 21 nt, Homo sapiens
cuguaccacguggguccucuu

SEQ ID NO: 534631 - RNA, 21 nt, Homo sapiens
cuguacccaccccagcacagc

SEQ ID NO: 534632 - RNA, 14 nt, Homo sapiens
cuguaccucagugg

SEQ ID NO: 534633 - RNA, 13 nt, Homo sapiens
cuguaccuccaaa

SEQ ID NO: 534634 - RNA, 20 nt, Homo sapiens
cuguacuaacaaagccaaau

SEQ ID NO: 534635 - RNA, 22 nt, Homo sapiens
cuguacuccagccugggugaca

SEQ ID NO: 534636 - RNA, 20 nt, Homo sapiens
cuguagaacuuauucucugu

SEQ ID NO: 534637 - RNA, 23 nt, Homo sapiens
cuguagaagaagcccauaucaca

SEQ ID NO: 534638 - RNA, 22 nt, Homo sapiens
cuguagaaugauuucaugcuau

SEQ ID NO: 534639 - RNA, 20 nt, Homo sapiens
cuguagaucagguuugccca

SEQ ID NO: 534640 - RNA, 18 nt, Homo sapiens
cuguagauucagguaaua

SEQ ID NO: 534641 - RNA, 21 nt, Homo sapiens
cuguagcaccagagaauccau

SEQ ID NO: 534642 - RNA, 18 nt, Homo sapiens
cuguagcauuacaguggg

SEQ ID NO: 534643 - RNA, 18 nt, Homo sapiens
cuguagccccagugacag

SEQ ID NO: 534644 - RNA, 18 nt, Homo sapiens
cuguagcucaaguuuaaa

SEQ ID NO: 534645 - RNA, 17 nt, Homo sapiens
cuguagugagaaacuga

SEQ ID NO: 534646 - RNA, 14 nt, Homo sapiens
cuguaguuacugug

SEQ ID NO: 534647 - RNA, 17 nt, Homo sapiens
cuguauaagcacugaaa

SEQ ID NO: 534648 - RNA, 23 nt, Homo sapiens
cuguauaauagagauaaguccau

SEQ ID NO: 534649 - RNA, 21 nt, Homo sapiens
cuguauagccuauacugcauu

SEQ ID NO: 534650 - RNA, 16 nt, Homo sapiens
cuguauaguacuggca

SEQ ID NO: 534651 - RNA, 19 nt, Homo sapiens
cuguauauacaauaacaua

SEQ ID NO: 534652 - RNA, 13 nt, Homo sapiens
cuguauccacaaa

SEQ ID NO: 534653 - RNA, 23 nt, Homo sapiens
cuguaucgcauauugcugaguuu

SEQ ID NO: 534654 - RNA, 13 nt, Homo sapiens
cuguaucugugua

SEQ ID NO: 534655 - RNA, 22 nt, Homo sapiens
cuguaucuuugacaauucuggg

SEQ ID NO: 534656 - RNA, 21 nt, Homo sapiens
cuguauguaauauuuacauaa

SEQ ID NO: 534657 - RNA, 13 nt, Homo sapiens
cuguauuacauaa

SEQ ID NO: 534658 - RNA, 18 nt, Homo sapiens
cuguauuccgauacaaag

SEQ ID NO: 534659 - RNA, 20 nt, Homo sapiens
cuguauuuaacaaaaagugc

SEQ ID NO: 534660 - RNA, 24 nt, Homo sapiens
cuguauuuaacaaaaagugcuuca

SEQ ID NO: 534661 - RNA, 21 nt, Homo sapiens
cuguauuuucgggauucuuug

SEQ ID NO: 534662 - RNA, 19 nt, Homo sapiens
cuguauuuugccagacuua

SEQ ID NO: 534663 - RNA, 20 nt, Homo sapiens
cuguauuuugccagacuuaa

SEQ ID NO: 534664 - RNA, 15 nt, Homo sapiens
cugucaaagcuguca

SEQ ID NO: 534665 - RNA, 14 nt, Homo sapiens
cugucaaaugaugu

SEQ ID NO: 534666 - RNA, 22 nt, Homo sapiens
cugucaagaagaggaaagggag

SEQ ID NO: 534667 - RNA, 13 nt, Homo sapiens
cugucaagcauau

SEQ ID NO: 534668 - RNA, 19 nt, Homo sapiens
cugucaagccggaugccua

SEQ ID NO: 534669 - RNA, 18 nt, Homo sapiens
cugucaauaaacagcuuc

SEQ ID NO: 534670 - RNA, 19 nt, Homo sapiens
cugucaauacuauggagua

SEQ ID NO: 534671 - RNA, 12 nt, Homo sapiens
cugucaaugcag

SEQ ID NO: 534672 - RNA, 15 nt, Homo sapiens
cugucacaaccaaga

SEQ ID NO: 534673 - RNA, 22 nt, Homo sapiens
cugucacaauaaauggccagug

SEQ ID NO: 534674 - RNA, 14 nt, Homo sapiens
cugucacacacugg

SEQ ID NO: 534675 - RNA, 14 nt, Homo sapiens
cugucaccagaccc

SEQ ID NO: 534676 - RNA, 21 nt, Homo sapiens
cugucaccaugacuuccucac

SEQ ID NO: 534677 - RNA, 19 nt, Homo sapiens
cugucacguagaacuugga

SEQ ID NO: 534678 - RNA, 13 nt, Homo sapiens
cugucacugaugg

SEQ ID NO: 534679 - RNA, 16 nt, Homo sapiens
cugucagaaucacaua

SEQ ID NO: 534680 - RNA, 22 nt, Homo sapiens
cugucagcaagacugaagaugg

SEQ ID NO: 534681 - RNA, 18 nt, Homo sapiens
cugucagcuuccaaacau

SEQ ID NO: 534682 - RNA, 17 nt, Homo sapiens
cugucaggacacaugga

SEQ ID NO: 534683 - RNA, 18 nt, Homo sapiens
cugucaggguugucuacc

SEQ ID NO: 534684 - RNA, 12 nt, Homo sapiens
cugucaguucuc

SEQ ID NO: 534685 - RNA, 22 nt, Homo sapiens
cugucauagggauugucccugu

SEQ ID NO: 534686 - RNA, 15 nt, Homo sapiens
cugucaugugccuug

SEQ ID NO: 534687 - RNA, 19 nt, Homo sapiens
cugucauuaguauuucaca

SEQ ID NO: 534688 - RNA, 23 nt, Homo sapiens
cugucauucgcucccacauucug

SEQ ID NO: 534689 - RNA, 15 nt, Homo sapiens
cuguccacaugaccu

SEQ ID NO: 534690 - RNA, 18 nt, Homo sapiens
cuguccacaugaccucca

SEQ ID NO: 534691 - RNA, 20 nt, Homo sapiens
cuguccacccugccaagacu

SEQ ID NO: 534692 - RNA, 19 nt, Homo sapiens
cuguccaccugugcugcug

SEQ ID NO: 534693 - RNA, 18 nt, Homo sapiens
cuguccacuagaccagug

SEQ ID NO: 534694 - RNA, 12 nt, Homo sapiens
cuguccagccuu

SEQ ID NO: 534695 - RNA, 16 nt, Homo sapiens
cuguccaggagcuaau

SEQ ID NO: 534696 - RNA, 22 nt, Homo sapiens
cuguccaucagccaggacaguc

SEQ ID NO: 534697 - RNA, 20 nt, Homo sapiens
cuguccaugaagcacugagc

SEQ ID NO: 534698 - RNA, 14 nt, Homo sapiens
cuguccauucuucc

SEQ ID NO: 534699 - RNA, 23 nt, Homo sapiens
cugucccagccccggcaagccac

SEQ ID NO: 534700 - RNA, 20 nt, Homo sapiens
cuguccccacagcuucucua

SEQ ID NO: 534701 - RNA, 19 nt, Homo sapiens
cugucccuugcuguaugcu

SEQ ID NO: 534702 - RNA, 16 nt, Homo sapiens
cuguccguucacaugu

SEQ ID NO: 534703 - RNA, 14 nt, Homo sapiens
cuguccuaagcacu

SEQ ID NO: 534704 - RNA, 15 nt, Homo sapiens
cuguccuaagcacuu

SEQ ID NO: 534705 - RNA, 16 nt, Homo sapiens
cuguccuaagcacuuu

SEQ ID NO: 534706 - RNA, 17 nt, Homo sapiens
cuguccucaccgucucg

SEQ ID NO: 534707 - RNA, 14 nt, Homo sapiens
cagcugaacagcca

SEQ ID NO: 534708 - RNA, 15 nt, Homo sapiens
cagcugaacagccaa

SEQ ID NO: 534709 - RNA, 16 nt, Homo sapiens
cagcugaacagccaaa

SEQ ID NO: 534710 - RNA, 13 nt, Homo sapiens
cagcugaacccug

SEQ ID NO: 534711 - RNA, 20 nt, Homo sapiens
cagcugaccuuugucaucuu

SEQ ID NO: 534712 - RNA, 21 nt, Homo sapiens
cagcugagaggcauccagaaa

SEQ ID NO: 534713 - RNA, 13 nt, Homo sapiens
cagcugauccaga

SEQ ID NO: 534714 - RNA, 15 nt, Homo sapiens
cagcugauuccagaa

SEQ ID NO: 534715 - RNA, 13 nt, Homo sapiens
cagcugcaccugc

SEQ ID NO: 534716 - RNA, 13 nt, Homo sapiens
cagcugcacuuua

SEQ ID NO: 534717 - RNA, 18 nt, Homo sapiens
cagcugcagaugccacac

SEQ ID NO: 534718 - RNA, 22 nt, Homo sapiens
cagcugcauuaaaacaaaggaa

SEQ ID NO: 534719 - RNA, 19 nt, Homo sapiens
cagcugccucugcucccuc

SEQ ID NO: 534720 - RNA, 14 nt, Homo sapiens
cagcugcugacacg

SEQ ID NO: 534721 - RNA, 20 nt, Homo sapiens
cagcuggacagaggggacuc

SEQ ID NO: 534722 - RNA, 21 nt, Homo sapiens
cagcuggacauacugcuggag

SEQ ID NO: 534723 - RNA, 20 nt, Homo sapiens
cagcuggaggaauacauuuu

SEQ ID NO: 534724 - RNA, 22 nt, Homo sapiens
cagcuguaacccucacccacag

SEQ ID NO: 534725 - RNA, 21 nt, Homo sapiens
cagcuguauugucugaacuug

SEQ ID NO: 534726 - RNA, 16 nt, Homo sapiens
cagcuguccugcagca

SEQ ID NO: 534727 - RNA, 12 nt, Homo sapiens
cagcugugauga

SEQ ID NO: 534728 - RNA, 14 nt, Homo sapiens
cagcugugcacuuu

SEQ ID NO: 534729 - RNA, 23 nt, Homo sapiens
cagcugugccagaggcuggacca

SEQ ID NO: 534730 - RNA, 17 nt, Homo sapiens
cagcugugcuguaacac

SEQ ID NO: 534731 - RNA, 19 nt, Homo sapiens
cagcuguguggugcuucug

SEQ ID NO: 534732 - RNA, 14 nt, Homo sapiens
cagcuuagaguucu

SEQ ID NO: 534733 - RNA, 17 nt, Homo sapiens
cagcuuagauuucauag

SEQ ID NO: 534734 - RNA, 19 nt, Homo sapiens
cagcuucaccagagcauuu

SEQ ID NO: 534735 - RNA, 17 nt, Homo sapiens
cagcuucauuaucugag

SEQ ID NO: 534736 - RNA, 19 nt, Homo sapiens
cagcuucccgaguagcugg

SEQ ID NO: 534737 - RNA, 13 nt, Homo sapiens
cagcuucucuaca

SEQ ID NO: 534738 - RNA, 14 nt, Homo sapiens
cagcuucucuacag

SEQ ID NO: 534739 - RNA, 17 nt, Homo sapiens
cagcuucucuacagacu

SEQ ID NO: 534740 - RNA, 15 nt, Homo sapiens
cagcuucuguuggca

SEQ ID NO: 534741 - RNA, 17 nt, Homo sapiens
cagcuucuucacaggca

SEQ ID NO: 534742 - RNA, 18 nt, Homo sapiens
cagcuucuucaucuuuaa

SEQ ID NO: 534743 - RNA, 20 nt, Homo sapiens
cagcuugaguggguucucug

SEQ ID NO: 534744 - RNA, 14 nt, Homo sapiens
cagcuugcugaggg

SEQ ID NO: 534745 - RNA, 16 nt, Homo sapiens
cagcuuggcccuuucc

SEQ ID NO: 534746 - RNA, 14 nt, Homo sapiens
cagcuuugcaaaau

SEQ ID NO: 534747 - RNA, 19 nt, Homo sapiens
cagcuuugcuaccaaagca

SEQ ID NO: 534748 - RNA, 17 nt, Homo sapiens
cagcuuuucccaggaga

SEQ ID NO: 534749 - RNA, 23 nt, Homo sapiens
cagcuuuucccaggagaccauuu

SEQ ID NO: 534750 - RNA, 16 nt, Homo sapiens
cagcuuuugcaacuua

SEQ ID NO: 534751 - RNA, 23 nt, Homo sapiens
caggaaaaaaaaaaaucuaucca

SEQ ID NO: 534752 - RNA, 12 nt, Homo sapiens
caggaaaacugg

SEQ ID NO: 534753 - RNA, 18 nt, Homo sapiens
caggaaaacugggacaua

SEQ ID NO: 534754 - RNA, 22 nt, Homo sapiens
caggaaacaguugcauguagua

SEQ ID NO: 534755 - RNA, 14 nt, Homo sapiens
caggaaaccacuua

SEQ ID NO: 534756 - RNA, 22 nt, Homo sapiens
caggaaaggggugagagugauu

SEQ ID NO: 534757 - RNA, 14 nt, Homo sapiens
caggaaaguguuau

SEQ ID NO: 534758 - RNA, 19 nt, Homo sapiens
caggaacacccgacuccuc

SEQ ID NO: 534759 - RNA, 15 nt, Homo sapiens
caggaacagaaggau

SEQ ID NO: 534760 - RNA, 15 nt, Homo sapiens
caggaaccacaccac

SEQ ID NO: 534761 - RNA, 13 nt, Homo sapiens
caggaaccacaga

SEQ ID NO: 534762 - RNA, 15 nt, Homo sapiens
caggaacucuaaggu

SEQ ID NO: 534763 - RNA, 13 nt, Homo sapiens
caggaagauguau

SEQ ID NO: 534764 - RNA, 17 nt, Homo sapiens
caggaagcauucagaga

SEQ ID NO: 534765 - RNA, 12 nt, Homo sapiens
caggaagcuuug

SEQ ID NO: 534766 - RNA, 14 nt, Homo sapiens
caggaaggagcaaa

SEQ ID NO: 534767 - RNA, 21 nt, Homo sapiens
caggaagggggccgacuccac

SEQ ID NO: 534768 - RNA, 20 nt, Homo sapiens
caggaagguaaaaacccagc

SEQ ID NO: 534769 - RNA, 18 nt, Homo sapiens
caggaaggugccuggcca

SEQ ID NO: 534770 - RNA, 14 nt, Homo sapiens
caggaauacauuug

SEQ ID NO: 534771 - RNA, 18 nt, Homo sapiens
caggaauccccaacaugc

SEQ ID NO: 534772 - RNA, 18 nt, Homo sapiens
caggaauuuuuaaaccaa

SEQ ID NO: 534773 - RNA, 18 nt, Homo sapiens
caggacaaggccuugcuc

SEQ ID NO: 534774 - RNA, 21 nt, Homo sapiens
caggacaaggccuugcucacu

SEQ ID NO: 534775 - RNA, 21 nt, Homo sapiens
caggacaccgcuguccuggca

SEQ ID NO: 534776 - RNA, 22 nt, Homo sapiens
caggacacuaaugggaagacca

SEQ ID NO: 534777 - RNA, 17 nt, Homo sapiens
caggacagcagcacucc

SEQ ID NO: 534778 - RNA, 19 nt, Homo sapiens
caggacagguggugcaaau

SEQ ID NO: 534779 - RNA, 13 nt, Homo sapiens
caggacaguuuau

SEQ ID NO: 534780 - RNA, 12 nt, Homo sapiens
caggaccaaggg

SEQ ID NO: 534781 - RNA, 16 nt, Homo sapiens
caggacccgccugcuc

SEQ ID NO: 534782 - RNA, 14 nt, Homo sapiens
caggaccugccuag

SEQ ID NO: 534783 - RNA, 13 nt, Homo sapiens
caggacuaggcau

SEQ ID NO: 534784 - RNA, 19 nt, Homo sapiens
caggacuccacacagcguu

SEQ ID NO: 534785 - RNA, 21 nt, Homo sapiens
caggacuccaucucuuaaaaa

SEQ ID NO: 534786 - RNA, 11 nt, Homo sapiens
caggacugugu

SEQ ID NO: 534787 - RNA, 22 nt, Homo sapiens
caggacuguuuuauaaacugcu

SEQ ID NO: 534788 - RNA, 20 nt, Homo sapiens
caggacuuccauuugcuuug

SEQ ID NO: 534789 - RNA, 17 nt, Homo sapiens
caggacuuggucugauu

SEQ ID NO: 534790 - RNA, 16 nt, Homo sapiens
caggacuuguuuacaa

SEQ ID NO: 534791 - RNA, 17 nt, Homo sapiens
caggagaaccacuacau

SEQ ID NO: 534792 - RNA, 17 nt, Homo sapiens
caggagaaucacuugaa

SEQ ID NO: 534793 - RNA, 15 nt, Homo sapiens
caggagaauugcuug

SEQ ID NO: 534794 - RNA, 14 nt, Homo sapiens
caggagacaguuca

SEQ ID NO: 534795 - RNA, 14 nt, Homo sapiens
caggagacauauau

SEQ ID NO: 534796 - RNA, 14 nt, Homo sapiens
caggagacauuggu

SEQ ID NO: 534797 - RNA, 19 nt, Homo sapiens
caggagaccuggcacugga

SEQ ID NO: 534798 - RNA, 14 nt, Homo sapiens
caggagagacagag

SEQ ID NO: 534799 - RNA, 22 nt, Homo sapiens
caggagagcuugucauugagcc

SEQ ID NO: 534800 - RNA, 15 nt, Homo sapiens
caggagagucacuug

SEQ ID NO: 534801 - RNA, 18 nt, Homo sapiens
caggagagugugugggca

SEQ ID NO: 534802 - RNA, 18 nt, Homo sapiens
caggagcagcagccagca

SEQ ID NO: 534803 - RNA, 21 nt, Homo sapiens
caggagcagcagccagcacca

SEQ ID NO: 534804 - RNA, 18 nt, Homo sapiens
caggagcaggaagggcca

SEQ ID NO: 534805 - RNA, 18 nt, Homo sapiens
caggagcccggcuuccac

SEQ ID NO: 534806 - RNA, 21 nt, Homo sapiens
caggagcugcggccacucuac

SEQ ID NO: 534807 - RNA, 15 nt, Homo sapiens
caggaggauggcaaa

SEQ ID NO: 534808 - RNA, 22 nt, Homo sapiens
caggaggcagacaaugacccca

SEQ ID NO: 534809 - RNA, 21 nt, Homo sapiens
caggaggcugaggcaggagaa

SEQ ID NO: 534810 - RNA, 22 nt, Homo sapiens
caggaggcuuuaagcuccagcu

SEQ ID NO: 534811 - RNA, 21 nt, Homo sapiens
caggagggguuaaagcugccg

SEQ ID NO: 534812 - RNA, 17 nt, Homo sapiens
caggaggugcuaucgca

SEQ ID NO: 534813 - RNA, 20 nt, Homo sapiens
caggagguggagguugcagu

SEQ ID NO: 534814 - RNA, 23 nt, Homo sapiens
caggagguggagguugcagugag

SEQ ID NO: 534815 - RNA, 16 nt, Homo sapiens
caggaguaaaacuccc

SEQ ID NO: 534816 - RNA, 17 nt, Homo sapiens
caggaguaccuggaccu

SEQ ID NO: 534817 - RNA, 17 nt, Homo sapiens
caggagucucugccacc

SEQ ID NO: 534818 - RNA, 21 nt, Homo sapiens
caggagucucugccacccacu

SEQ ID NO: 534819 - RNA, 15 nt, Homo sapiens
caggagucucuggua

SEQ ID NO: 534820 - RNA, 20 nt, Homo sapiens
caggagucugccacuuguca

SEQ ID NO: 534821 - RNA, 22 nt, Homo sapiens
caggagucuucagacccagaga

SEQ ID NO: 534822 - RNA, 17 nt, Homo sapiens
caggagugguggaaccu

SEQ ID NO: 534823 - RNA, 20 nt, Homo sapiens
caggaguguggccacguggg

SEQ ID NO: 534824 - RNA, 23 nt, Homo sapiens
caggaguucucccaccaccucac

SEQ ID NO: 534825 - RNA, 23 nt, Homo sapiens
caggaguuggaauguuguaguua

SEQ ID NO: 534826 - RNA, 19 nt, Homo sapiens
caggauaauaaaacaugua

SEQ ID NO: 534827 - RNA, 17 nt, Homo sapiens
caggauaucacauugga

SEQ ID NO: 534828 - RNA, 22 nt, Homo sapiens
caggaucaaaccccgaccaccu

SEQ ID NO: 534829 - RNA, 15 nt, Homo sapiens
caggauccagugaca

SEQ ID NO: 534830 - RNA, 18 nt, Homo sapiens
caggaucccuacugccaa

SEQ ID NO: 534831 - RNA, 14 nt, Homo sapiens
caggaucugaguua

SEQ ID NO: 534832 - RNA, 23 nt, Homo sapiens
caggaucuguacaauaauaauua

SEQ ID NO: 534833 - RNA, 17 nt, Homo sapiens
caggaugacauagccaa

SEQ ID NO: 534834 - RNA, 17 nt, Homo sapiens
caggaugagguggugga

SEQ ID NO: 534835 - RNA, 18 nt, Homo sapiens
caggaugauuguacagaa

SEQ ID NO: 534836 - RNA, 14 nt, Homo sapiens
caggauggugggca

SEQ ID NO: 534837 - RNA, 21 nt, Homo sapiens
augaccacauagaacaugugu

SEQ ID NO: 534838 - RNA, 15 nt, Homo sapiens
augaccacugcccug

SEQ ID NO: 534839 - RNA, 20 nt, Homo sapiens
augaccagaagccuuggaac

SEQ ID NO: 534840 - RNA, 19 nt, Homo sapiens
augaccagcagcagcuuuc

SEQ ID NO: 534841 - RNA, 20 nt, Homo sapiens
augaccagcagcagcuuuca

SEQ ID NO: 534842 - RNA, 17 nt, Homo sapiens
augacccaccccugugc

SEQ ID NO: 534843 - RNA, 21 nt, Homo sapiens
augacccccgcaaguuugcac

SEQ ID NO: 534844 - RNA, 23 nt, Homo sapiens
augacccccgcaaguuugcacuc

SEQ ID NO: 534845 - RNA, 14 nt, Homo sapiens
augacccuuuucau

SEQ ID NO: 534846 - RNA, 14 nt, Homo sapiens
augaccuacagugc

SEQ ID NO: 534847 - RNA, 20 nt, Homo sapiens
augaccuacagugcugugua

SEQ ID NO: 534848 - RNA, 21 nt, Homo sapiens
augaccucagucaggcacugg

SEQ ID NO: 534849 - RNA, 18 nt, Homo sapiens
augaccugaucauuacau

SEQ ID NO: 534850 - RNA, 13 nt, Homo sapiens
augaccuggaaau

SEQ ID NO: 534851 - RNA, 22 nt, Homo sapiens
augaccuuggacaaucaugaaa

SEQ ID NO: 534852 - RNA, 16 nt, Homo sapiens
augaccuugggguaca

SEQ ID NO: 534853 - RNA, 15 nt, Homo sapiens
augaccuuugucuca

SEQ ID NO: 534854 - RNA, 18 nt, Homo sapiens
augaccuuuuugcagugu

SEQ ID NO: 534855 - RNA, 19 nt, Homo sapiens
augacucaaggccaauaau

SEQ ID NO: 534856 - RNA, 17 nt, Homo sapiens
augacucagagaaccag

SEQ ID NO: 534857 - RNA, 23 nt, Homo sapiens
augacuccaccuucucaccugcu

SEQ ID NO: 534858 - RNA, 12 nt, Homo sapiens
augacucugaga

SEQ ID NO: 534859 - RNA, 15 nt, Homo sapiens
augacugauuacuca

SEQ ID NO: 534860 - RNA, 17 nt, Homo sapiens
augacugugaccaccuu

SEQ ID NO: 534861 - RNA, 18 nt, Homo sapiens
augacuguuacagcuuuc

SEQ ID NO: 534862 - RNA, 22 nt, Homo sapiens
augacuguuuuucggacaguuu

SEQ ID NO: 534863 - RNA, 15 nt, Homo sapiens
augacuuacuuuccu

SEQ ID NO: 534864 - RNA, 19 nt, Homo sapiens
augacuuagcgucaagaca

SEQ ID NO: 534865 - RNA, 19 nt, Homo sapiens
augacuucccugcuccaac

SEQ ID NO: 534866 - RNA, 21 nt, Homo sapiens
augacuugacuggcugcucuu

SEQ ID NO: 534867 - RNA, 16 nt, Homo sapiens
augacuuuauugcauc

SEQ ID NO: 534868 - RNA, 15 nt, Homo sapiens
augagaaaugaugaa

SEQ ID NO: 534869 - RNA, 18 nt, Homo sapiens
augagaacaaagcuguua

SEQ ID NO: 534870 - RNA, 14 nt, Homo sapiens
augagaagauauau

SEQ ID NO: 534871 - RNA, 13 nt, Homo sapiens
augagaagcagaa

SEQ ID NO: 534872 - RNA, 15 nt, Homo sapiens
augagaaguacuugg

SEQ ID NO: 534873 - RNA, 17 nt, Homo sapiens
augagaaguacuugguu

SEQ ID NO: 534874 - RNA, 20 nt, Homo sapiens
augagaaucagaucauuuca

SEQ ID NO: 534875 - RNA, 20 nt, Homo sapiens
augagaaugaugcacacuga

SEQ ID NO: 534876 - RNA, 22 nt, Homo sapiens
augagaauuugagugcucugau

SEQ ID NO: 534877 - RNA, 22 nt, Homo sapiens
augagacaggaaaaaccaacag

SEQ ID NO: 534878 - RNA, 17 nt, Homo sapiens
augagacuuucuaaauc

SEQ ID NO: 534879 - RNA, 20 nt, Homo sapiens
augagagaaggaggggagca

SEQ ID NO: 534880 - RNA, 13 nt, Homo sapiens
augagagcauaau

SEQ ID NO: 534881 - RNA, 19 nt, Homo sapiens
augagagggugcuauccau

SEQ ID NO: 534882 - RNA, 17 nt, Homo sapiens
augagcacccauuccaa

SEQ ID NO: 534883 - RNA, 18 nt, Homo sapiens
augagcacccauuccaaa

SEQ ID NO: 534884 - RNA, 20 nt, Homo sapiens
augagcaguaaaagucacau

SEQ ID NO: 534885 - RNA, 24 nt, Homo sapiens
augagcauccucucucacauggaa

SEQ ID NO: 534886 - RNA, 14 nt, Homo sapiens
augagcauuuagca

SEQ ID NO: 534887 - RNA, 21 nt, Homo sapiens
augagccaaaaugacuuugaa

SEQ ID NO: 534888 - RNA, 11 nt, Homo sapiens
augagccauga

SEQ ID NO: 534889 - RNA, 21 nt, Homo sapiens
augagcccagaucaccaccug

SEQ ID NO: 534890 - RNA, 18 nt, Homo sapiens
augagccgugaacugugc

SEQ ID NO: 534891 - RNA, 12 nt, Homo sapiens
augagccuuagu

SEQ ID NO: 534892 - RNA, 15 nt, Homo sapiens
augagcgaaauuguc

SEQ ID NO: 534893 - RNA, 22 nt, Homo sapiens
augagcgaaauugucuuuacua

SEQ ID NO: 534894 - RNA, 14 nt, Homo sapiens
augagcgucacugc

SEQ ID NO: 534895 - RNA, 21 nt, Homo sapiens
aucgcaccauugcacuccagc

SEQ ID NO: 534896 - RNA, 17 nt, Homo sapiens
aucgccucugucuccuc

SEQ ID NO: 534897 - RNA, 15 nt, Homo sapiens
aucgcgccacugcac

SEQ ID NO: 534898 - RNA, 23 nt, Homo sapiens
aucgcugcgauacuggcauuucc

SEQ ID NO: 534899 - RNA, 19 nt, Homo sapiens
aucgcuuucuacacuguau

SEQ ID NO: 534900 - RNA, 16 nt, Homo sapiens
aucggaagcagugccu

SEQ ID NO: 534901 - RNA, 16 nt, Homo sapiens
aucgggcccagggaca

SEQ ID NO: 534902 - RNA, 19 nt, Homo sapiens
aucggguaagaugcuccug

SEQ ID NO: 534903 - RNA, 19 nt, Homo sapiens
aucguccaccccagugugc

SEQ ID NO: 534904 - RNA, 15 nt, Homo sapiens
aucguccauccucuu

SEQ ID NO: 534905 - RNA, 18 nt, Homo sapiens
aucgugaaaccccaucuc

SEQ ID NO: 534906 - RNA, 18 nt, Homo sapiens
aucgugccuugucauuuu

SEQ ID NO: 534907 - RNA, 11 nt, Homo sapiens
aucgugugcca

SEQ ID NO: 534908 - RNA, 21 nt, Homo sapiens
aucguuuaaaaacaaaggaau

SEQ ID NO: 534909 - RNA, 23 nt, Homo sapiens
aucuaaaagaauuuuaccauuca

SEQ ID NO: 534910 - RNA, 20 nt, Homo sapiens
aucuaaaugaaugagccaaa

SEQ ID NO: 534911 - RNA, 21 nt, Homo sapiens
aucuaaaugaaugagccaaaa

SEQ ID NO: 534912 - RNA, 20 nt, Homo sapiens
aucuaaauuacagugcaguu

SEQ ID NO: 534913 - RNA, 16 nt, Homo sapiens
aucuaacuauauguac

SEQ ID NO: 534914 - RNA, 21 nt, Homo sapiens
aucuaacuauauguacagcuc

SEQ ID NO: 534915 - RNA, 21 nt, Homo sapiens
aucuaagcuguuugccaagcu

SEQ ID NO: 534916 - RNA, 20 nt, Homo sapiens
aucuaaggccuucccuguca

SEQ ID NO: 534917 - RNA, 22 nt, Homo sapiens
aucuaaggccuucccugucaga

SEQ ID NO: 534918 - RNA, 22 nt, Homo sapiens
aucuaauuaaauggcaucagca

SEQ ID NO: 534919 - RNA, 17 nt, Homo sapiens
aucuaauuacaucauga

SEQ ID NO: 534920 - RNA, 20 nt, Homo sapiens
aucuacaaaaauuuauuaua

SEQ ID NO: 534921 - RNA, 16 nt, Homo sapiens
aucuacaaaagugaac

SEQ ID NO: 534922 - RNA, 18 nt, Homo sapiens
aucuacacccaccagagu

SEQ ID NO: 534923 - RNA, 20 nt, Homo sapiens
aucuacaccugaggacaaga

SEQ ID NO: 534924 - RNA, 19 nt, Homo sapiens
aucuacauaaggaugaagg

SEQ ID NO: 534925 - RNA, 16 nt, Homo sapiens
aucuacauacaaacaa

SEQ ID NO: 534926 - RNA, 21 nt, Homo sapiens
aucuacauacaaacaaugcaa

SEQ ID NO: 534927 - RNA, 13 nt, Homo sapiens
aucuacccugcug

SEQ ID NO: 534928 - RNA, 12 nt, Homo sapiens
aucuaccugcuu

SEQ ID NO: 534929 - RNA, 23 nt, Homo sapiens
aucuacuggaaauguagcacuua

SEQ ID NO: 534930 - RNA, 18 nt, Homo sapiens
aucuacuucaacacuuca

SEQ ID NO: 534931 - RNA, 17 nt, Homo sapiens
aucuacuucuacaucca

SEQ ID NO: 534932 - RNA, 15 nt, Homo sapiens
aucuagaagacuguc

SEQ ID NO: 534933 - RNA, 19 nt, Homo sapiens
aucuagaagagucuauugu

SEQ ID NO: 534934 - RNA, 14 nt, Homo sapiens
aucuagagaaggca

SEQ ID NO: 534935 - RNA, 15 nt, Homo sapiens
aucuagauacuguau

SEQ ID NO: 534936 - RNA, 19 nt, Homo sapiens
aucuagaugaggugcuuug

SEQ ID NO: 534937 - RNA, 19 nt, Homo sapiens
aucuagccuaaaguauaca

SEQ ID NO: 534938 - RNA, 22 nt, Homo sapiens
aucuagcuucuucagagaucaa

SEQ ID NO: 534939 - RNA, 20 nt, Homo sapiens
aucuagguguggcugugaag

SEQ ID NO: 534940 - RNA, 19 nt, Homo sapiens
aucuaguucucaaucacug

SEQ ID NO: 534941 - RNA, 17 nt, Homo sapiens
aucuaguuuacagaaaa

SEQ ID NO: 534942 - RNA, 18 nt, Homo sapiens
aucuaguuuuggcaagaa

SEQ ID NO: 534943 - RNA, 14 nt, Homo sapiens
aucuaucaacuaua

SEQ ID NO: 534944 - RNA, 19 nt, Homo sapiens
aucuaugagcugacaucuc

SEQ ID NO: 534945 - RNA, 13 nt, Homo sapiens
aucuauuauuaca

SEQ ID NO: 534946 - RNA, 15 nt, Homo sapiens
aucuauuuguacaau

SEQ ID NO: 534947 - RNA, 21 nt, Homo sapiens
aucucaaacuacuggcaauuu

SEQ ID NO: 534948 - RNA, 16 nt, Homo sapiens
aucucaaagaaggcau

SEQ ID NO: 534949 - RNA, 17 nt, Homo sapiens
aucucaaagaaggcauu

SEQ ID NO: 534950 - RNA, 15 nt, Homo sapiens
aucucaauaacaaac

SEQ ID NO: 534951 - RNA, 14 nt, Homo sapiens
aucucaauuugcag

SEQ ID NO: 534952 - RNA, 13 nt, Homo sapiens
aucucagaaccuu

SEQ ID NO: 534953 - RNA, 15 nt, Homo sapiens
aucucagaugcaguu

SEQ ID NO: 534954 - RNA, 17 nt, Homo sapiens
aucucagcacugcccca

SEQ ID NO: 534955 - RNA, 20 nt, Homo sapiens
aucucagcuaacauuccaug

SEQ ID NO: 534956 - RNA, 17 nt, Homo sapiens
aucucagcucaccucaa

SEQ ID NO: 534957 - RNA, 13 nt, Homo sapiens
aucucagcuuuga

SEQ ID NO: 534958 - RNA, 15 nt, Homo sapiens
aucucagcuuugaga

SEQ ID NO: 534959 - RNA, 15 nt, Homo sapiens
aucucaggaacauca

SEQ ID NO: 534960 - RNA, 15 nt, Homo sapiens
aucucaggugccacu

SEQ ID NO: 534961 - RNA, 19 nt, Homo sapiens
aucucagguugucuaagug

SEQ ID NO: 534962 - RNA, 22 nt, Homo sapiens
aucuuuaucaugaagcacauca

SEQ ID NO: 534963 - RNA, 15 nt, Homo sapiens
aucuuuaucuguucu

SEQ ID NO: 534964 - RNA, 18 nt, Homo sapiens
aucuuuauguagcacuac

SEQ ID NO: 534965 - RNA, 19 nt, Homo sapiens
aucuuucaugucuugucau

SEQ ID NO: 534966 - RNA, 19 nt, Homo sapiens
aucuuucugcacacaaaua

SEQ ID NO: 534967 - RNA, 17 nt, Homo sapiens
aucuuucuuuccaaaac

SEQ ID NO: 534968 - RNA, 20 nt, Homo sapiens
aucuuugcucccugcaagaa

SEQ ID NO: 534969 - RNA, 20 nt, Homo sapiens
aucuuugggaaagcuuacug

SEQ ID NO: 534970 - RNA, 12 nt, Homo sapiens
aucuuuguauau

SEQ ID NO: 534971 - RNA, 17 nt, Homo sapiens
aucuuuguauauuacau

SEQ ID NO: 534972 - RNA, 18 nt, Homo sapiens
aucuuuguauauuacaua

SEQ ID NO: 534973 - RNA, 14 nt, Homo sapiens
aucuuugugcuuca

SEQ ID NO: 534974 - RNA, 17 nt, Homo sapiens
aucuuuguuagauauua

SEQ ID NO: 534975 - RNA, 11 nt, Homo sapiens
aucuuuuacau

SEQ ID NO: 534976 - RNA, 13 nt, Homo sapiens
aucuuuucuacuu

SEQ ID NO: 534977 - RNA, 19 nt, Homo sapiens
aucuuuucuagagacacau

SEQ ID NO: 534978 - RNA, 19 nt, Homo sapiens
aucuuuuuucccucuuaca

SEQ ID NO: 534979 - RNA, 19 nt, Homo sapiens
augaaaaaaaaaacuauca

SEQ ID NO: 534980 - RNA, 16 nt, Homo sapiens
augaaaaacaucccaa

SEQ ID NO: 534981 - RNA, 18 nt, Homo sapiens
augaaaaagauauaugaa

SEQ ID NO: 534982 - RNA, 18 nt, Homo sapiens
augaaaacucaugaucaa

SEQ ID NO: 534983 - RNA, 23 nt, Homo sapiens
augaaaacucauuacuuuuccau

SEQ ID NO: 534984 - RNA, 17 nt, Homo sapiens
augaaaagaaacaagau

SEQ ID NO: 534985 - RNA, 14 nt, Homo sapiens
augaaaagcaauac

SEQ ID NO: 534986 - RNA, 13 nt, Homo sapiens
augaaaauaccau

SEQ ID NO: 534987 - RNA, 18 nt, Homo sapiens
augaaaaucuccaucuca

SEQ ID NO: 534988 - RNA, 16 nt, Homo sapiens
augaaaauguucugaa

SEQ ID NO: 534989 - RNA, 16 nt, Homo sapiens
augaaaauuaggauuu

SEQ ID NO: 534990 - RNA, 19 nt, Homo sapiens
augaaacaccuucucugga

SEQ ID NO: 534991 - RNA, 12 nt, Homo sapiens
augaaacauauc

SEQ ID NO: 534992 - RNA, 16 nt, Homo sapiens
augaaacauguucuca

SEQ ID NO: 534993 - RNA, 12 nt, Homo sapiens
augaaacauuca

SEQ ID NO: 534994 - RNA, 16 nt, Homo sapiens
augaaacgucaugugu

SEQ ID NO: 534995 - RNA, 19 nt, Homo sapiens
augaaacuauuuuaccuga

SEQ ID NO: 534996 - RNA, 20 nt, Homo sapiens
augaaacuguccaccaagau

SEQ ID NO: 534997 - RNA, 18 nt, Homo sapiens
augaaagaacccaagaca

SEQ ID NO: 534998 - RNA, 23 nt, Homo sapiens
augaaaguaguauuuuguacuau

SEQ ID NO: 534999 - RNA, 17 nt, Homo sapiens
augaaauacugagaugc

SEQ ID NO: 535000 - RNA, 13 nt, Homo sapiens
augaaauaugcau

SEQ ID NO: 535001 - RNA, 16 nt, Homo sapiens
augaaaucagcaagag

SEQ ID NO: 535002 - RNA, 13 nt, Homo sapiens
augaaauccagug

SEQ ID NO: 535003 - RNA, 15 nt, Homo sapiens
augaaaugcacugua

SEQ ID NO: 535004 - RNA, 21 nt, Homo sapiens
augaaaugucuggucugucca

SEQ ID NO: 535005 - RNA, 16 nt, Homo sapiens
augaaauuauuuguca

SEQ ID NO: 535006 - RNA, 16 nt, Homo sapiens
augaaauugcugaaag

SEQ ID NO: 535007 - RNA, 13 nt, Homo sapiens
augaacacuuuuu

SEQ ID NO: 535008 - RNA, 12 nt, Homo sapiens
augaacauccaa

SEQ ID NO: 535009 - RNA, 11 nt, Homo sapiens
augaacaucuc

SEQ ID NO: 535010 - RNA, 12 nt, Homo sapiens
augaacaucucu

SEQ ID NO: 535011 - RNA, 16 nt, Homo sapiens
augaacaugguguuca

SEQ ID NO: 535012 - RNA, 18 nt, Homo sapiens
augaacaugugaaguuau

SEQ ID NO: 535013 - RNA, 14 nt, Homo sapiens
augaacccucuugc

SEQ ID NO: 535014 - RNA, 19 nt, Homo sapiens
augaaccuucuuaacauca

SEQ ID NO: 535015 - RNA, 23 nt, Homo sapiens
augaacgauauguagcagaaagg

SEQ ID NO: 535016 - RNA, 20 nt, Homo sapiens
augaacuaacugacagcuuc

SEQ ID NO: 535017 - RNA, 14 nt, Homo sapiens
augaacuauugccu

SEQ ID NO: 535018 - RNA, 14 nt, Homo sapiens
augaacucuuucaa

SEQ ID NO: 535019 - RNA, 23 nt, Homo sapiens
caggauggugggcaggaucucaa

SEQ ID NO: 535020 - RNA, 12 nt, Homo sapiens
caggauugaaaa

SEQ ID NO: 535021 - RNA, 21 nt, Homo sapiens
caggauuuggcuaugacauga

SEQ ID NO: 535022 - RNA, 17 nt, Homo sapiens
caggauuuguuguucug

SEQ ID NO: 535023 - RNA, 14 nt, Homo sapiens
caggcaaacuugca

SEQ ID NO: 535024 - RNA, 18 nt, Homo sapiens
caggcaacgcacaaaaca

SEQ ID NO: 535025 - RNA, 20 nt, Homo sapiens
caggcaacgcacaaaacaga

SEQ ID NO: 535026 - RNA, 17 nt, Homo sapiens
caggcaaggaugucuga

SEQ ID NO: 535027 - RNA, 15 nt, Homo sapiens
caggcaaucuugccu

SEQ ID NO: 535028 - RNA, 14 nt, Homo sapiens
caggcaaugcugua

SEQ ID NO: 535029 - RNA, 22 nt, Homo sapiens
caggcaauuucaccaccaaaug

SEQ ID NO: 535030 - RNA, 16 nt, Homo sapiens
caggcacccucaggga

SEQ ID NO: 535031 - RNA, 19 nt, Homo sapiens
caggcaccucuuccuugau

SEQ ID NO: 535032 - RNA, 12 nt, Homo sapiens
caggcaccugcc

SEQ ID NO: 535033 - RNA, 16 nt, Homo sapiens
caggcacuaagacuaa

SEQ ID NO: 535034 - RNA, 19 nt, Homo sapiens
caggcacuccaaaccuguc

SEQ ID NO: 535035 - RNA, 12 nt, Homo sapiens
caggcacugaga

SEQ ID NO: 535036 - RNA, 14 nt, Homo sapiens
caggcacugagaau

SEQ ID NO: 535037 - RNA, 23 nt, Homo sapiens
caggcagagacugaaaauugcag

SEQ ID NO: 535038 - RNA, 20 nt, Homo sapiens
caggcagcacagugugugaa

SEQ ID NO: 535039 - RNA, 21 nt, Homo sapiens
caggcagcagacugaccaucu

SEQ ID NO: 535040 - RNA, 16 nt, Homo sapiens
caggcagcuauuucag

SEQ ID NO: 535041 - RNA, 13 nt, Homo sapiens
caggcagcugcag

SEQ ID NO: 535042 - RNA, 15 nt, Homo sapiens
caggcagggucuguu

SEQ ID NO: 535043 - RNA, 19 nt, Homo sapiens
caggcagguuugccaguga

SEQ ID NO: 535044 - RNA, 17 nt, Homo sapiens
caggcaguuaggugcug

SEQ ID NO: 535045 - RNA, 18 nt, Homo sapiens
caggcauagaggcuucuc

SEQ ID NO: 535046 - RNA, 19 nt, Homo sapiens
caggcaucugccucuggaa

SEQ ID NO: 535047 - RNA, 21 nt, Homo sapiens
caggcaugaggaaucugggag

SEQ ID NO: 535048 - RNA, 20 nt, Homo sapiens
caggcaugugucccuuccaa

SEQ ID NO: 535049 - RNA, 14 nt, Homo sapiens
caggcauugaggaa

SEQ ID NO: 535050 - RNA, 13 nt, Homo sapiens
caggcauugccaa

SEQ ID NO: 535051 - RNA, 13 nt, Homo sapiens
caggccaauguca

SEQ ID NO: 535052 - RNA, 14 nt, Homo sapiens
caggccaaugucag

SEQ ID NO: 535053 - RNA, 18 nt, Homo sapiens
caggccacuguggccaga

SEQ ID NO: 535054 - RNA, 18 nt, Homo sapiens
caggccagagugcugcca

SEQ ID NO: 535055 - RNA, 16 nt, Homo sapiens
caggccagcaagcucu

SEQ ID NO: 535056 - RNA, 14 nt, Homo sapiens
caggccaggccacc

SEQ ID NO: 535057 - RNA, 12 nt, Homo sapiens
caggccagguag

SEQ ID NO: 535058 - RNA, 17 nt, Homo sapiens
caggcccagcugcuccc

SEQ ID NO: 535059 - RNA, 13 nt, Homo sapiens
caggcccagugac

SEQ ID NO: 535060 - RNA, 22 nt, Homo sapiens
caggcccggcccagccuaggcc

SEQ ID NO: 535061 - RNA, 22 nt, Homo sapiens
caggcccuacuacccauuguuc

SEQ ID NO: 535062 - RNA, 20 nt, Homo sapiens
caggcccuccagugggcuga

SEQ ID NO: 535063 - RNA, 23 nt, Homo sapiens
caggcccucccugucuccagggc

SEQ ID NO: 535064 - RNA, 21 nt, Homo sapiens
caggcccugaucuagugcagu

SEQ ID NO: 535065 - RNA, 23 nt, Homo sapiens
caggcccuguccuaagcacuuua

SEQ ID NO: 535066 - RNA, 21 nt, Homo sapiens
caggcccuuccucuccacugc

SEQ ID NO: 535067 - RNA, 23 nt, Homo sapiens
caggccgagagcagacaccagca

SEQ ID NO: 535068 - RNA, 22 nt, Homo sapiens
caggccgauuugggaaccaagc

SEQ ID NO: 535069 - RNA, 17 nt, Homo sapiens
caggccgcagcuccauu

SEQ ID NO: 535070 - RNA, 18 nt, Homo sapiens
caggccucccuagcaccu

SEQ ID NO: 535071 - RNA, 20 nt, Homo sapiens
caggccucucucugcuccau

SEQ ID NO: 535072 - RNA, 22 nt, Homo sapiens
caggccucuuggcagucacauc

SEQ ID NO: 535073 - RNA, 17 nt, Homo sapiens
caggccuggagcguuug

SEQ ID NO: 535074 - RNA, 16 nt, Homo sapiens
caggccugggacccag

SEQ ID NO: 535075 - RNA, 21 nt, Homo sapiens
caggccugggaugcagugaug

SEQ ID NO: 535076 - RNA, 16 nt, Homo sapiens
caggccuuaucuccaa

SEQ ID NO: 535077 - RNA, 16 nt, Homo sapiens
caggccuucuuugguu

SEQ ID NO: 535078 - RNA, 16 nt, Homo sapiens
caggccuugcugacuc

SEQ ID NO: 535079 - RNA, 23 nt, Homo sapiens
caggccuugcugggguccagggc

SEQ ID NO: 535080 - RNA, 15 nt, Homo sapiens
caggcgaugugcaag

SEQ ID NO: 535081 - RNA, 21 nt, Homo sapiens
caggcgcaguggcucaugccu

SEQ ID NO: 535082 - RNA, 13 nt, Homo sapiens
caggcgugaucca

SEQ ID NO: 535083 - RNA, 16 nt, Homo sapiens
caggcuagagugcaau

SEQ ID NO: 535084 - RNA, 19 nt, Homo sapiens
caggcuagagugcaauggc

SEQ ID NO: 535085 - RNA, 22 nt, Homo sapiens
caggcuagagugcaauggugca

SEQ ID NO: 535086 - RNA, 22 nt, Homo sapiens
caggcucggaggacccuggaaa

SEQ ID NO: 535087 - RNA, 14 nt, Homo sapiens
caggcucucgcaca

SEQ ID NO: 535088 - RNA, 11 nt, Homo sapiens
caggcucugag

SEQ ID NO: 535089 - RNA, 16 nt, Homo sapiens
caggcucugagacaca

SEQ ID NO: 535090 - RNA, 23 nt, Homo sapiens
caggcugagaacucguucaccuc

SEQ ID NO: 535091 - RNA, 14 nt, Homo sapiens
caggcugagugcau

SEQ ID NO: 535092 - RNA, 18 nt, Homo sapiens
caggcugccugugugcau

SEQ ID NO: 535093 - RNA, 17 nt, Homo sapiens
caggcuggagacuggac

SEQ ID NO: 535094 - RNA, 19 nt, Homo sapiens
caggcuggagugcaauggu

SEQ ID NO: 535095 - RNA, 16 nt, Homo sapiens
caggcuggagugcagu

SEQ ID NO: 535096 - RNA, 23 nt, Homo sapiens
caggcuggagugcagugagcuau

SEQ ID NO: 535097 - RNA, 18 nt, Homo sapiens
caggcuggagugcagugg

SEQ ID NO: 535098 - RNA, 15 nt, Homo sapiens
caggcuggccagucc

SEQ ID NO: 535099 - RNA, 12 nt, Homo sapiens
caggcugggaac

SEQ ID NO: 535100 - RNA, 18 nt, Homo sapiens
caggcugggccaugucca

SEQ ID NO: 535101 - RNA, 13 nt, Homo sapiens
caggcuggucuca

SEQ ID NO: 535102 - RNA, 18 nt, Homo sapiens
caggcuggucucgaacuc

SEQ ID NO: 535103 - RNA, 18 nt, Homo sapiens
caggcuggucuugaacuc

SEQ ID NO: 535104 - RNA, 22 nt, Homo sapiens
caggcuguuuggagauccucau

SEQ ID NO: 535105 - RNA, 13 nt, Homo sapiens
caggcuucaucaa

SEQ ID NO: 535106 - RNA, 14 nt, Homo sapiens
caggcuuggcaaag

SEQ ID NO: 535107 - RNA, 19 nt, Homo sapiens
cagggaaaauuauuugcau

SEQ ID NO: 535108 - RNA, 20 nt, Homo sapiens
cagggaaaucaggguuacaa

SEQ ID NO: 535109 - RNA, 15 nt, Homo sapiens
cagggacaagauaca

SEQ ID NO: 535110 - RNA, 15 nt, Homo sapiens
cagggacagagccau

SEQ ID NO: 535111 - RNA, 16 nt, Homo sapiens
cagggaccucaggggc

SEQ ID NO: 535112 - RNA, 19 nt, Homo sapiens
cagggacuccaugcugcca

SEQ ID NO: 535113 - RNA, 15 nt, Homo sapiens
cagggacuugaaguu

SEQ ID NO: 535114 - RNA, 12 nt, Homo sapiens
cagggagcauuu

SEQ ID NO: 535115 - RNA, 12 nt, Homo sapiens
cagggagggaag

SEQ ID NO: 535116 - RNA, 22 nt, Homo sapiens
cagggaguccaggguuucucug

SEQ ID NO: 535117 - RNA, 17 nt, Homo sapiens
cagggagugagcagcua

SEQ ID NO: 535118 - RNA, 20 nt, Homo sapiens
cagggaugauggcagagcca

SEQ ID NO: 535119 - RNA, 20 nt, Homo sapiens
cagggaugccaacaccuucu

SEQ ID NO: 535120 - RNA, 14 nt, Homo sapiens
cagggcacuacaua

SEQ ID NO: 535121 - RNA, 22 nt, Homo sapiens
cagggcagccuccaccuugcuc

SEQ ID NO: 535122 - RNA, 16 nt, Homo sapiens
cagggcagccugucac

SEQ ID NO: 535123 - RNA, 17 nt, Homo sapiens
cagggcagccugucacc

SEQ ID NO: 535124 - RNA, 18 nt, Homo sapiens
cagggcaggaaggggaaa

SEQ ID NO: 535125 - RNA, 17 nt, Homo sapiens
cagggcagggcucugau

SEQ ID NO: 535126 - RNA, 16 nt, Homo sapiens
cagggcaugcuuuauu

SEQ ID NO: 535127 - RNA, 13 nt, Homo sapiens
cagggccaugcag

SEQ ID NO: 535128 - RNA, 15 nt, Homo sapiens
cagggccccugugac

SEQ ID NO: 535129 - RNA, 18 nt, Homo sapiens
cagggcccuccaccgcca

SEQ ID NO: 535130 - RNA, 15 nt, Homo sapiens
cagggccgugagcau

SEQ ID NO: 535131 - RNA, 18 nt, Homo sapiens
cagggccugacuugagcc

SEQ ID NO: 535132 - RNA, 18 nt, Homo sapiens
cagggccuggggccugag

SEQ ID NO: 535133 - RNA, 21 nt, Homo sapiens
cagggcgccccugggagacaa

SEQ ID NO: 535134 - RNA, 19 nt, Homo sapiens
cagggcuauagcucaggac

SEQ ID NO: 535135 - RNA, 22 nt, Homo sapiens
cagggcucagagugacccucag

SEQ ID NO: 535136 - RNA, 19 nt, Homo sapiens
cagggcuccaaaucugccu

SEQ ID NO: 535137 - RNA, 16 nt, Homo sapiens
cagggcuccugcacuu

SEQ ID NO: 535138 - RNA, 18 nt, Homo sapiens
cagggcucugcaggccac

SEQ ID NO: 535139 - RNA, 13 nt, Homo sapiens
cagggcugauaag

SEQ ID NO: 535140 - RNA, 12 nt, Homo sapiens
cagggcugugau

SEQ ID NO: 535141 - RNA, 15 nt, Homo sapiens
cagggcugugcuuga

SEQ ID NO: 535142 - RNA, 21 nt, Homo sapiens
cuguccuggcauuuguggcca

SEQ ID NO: 535143 - RNA, 22 nt, Homo sapiens
cuguccuugaaaaacaaaguuu

SEQ ID NO: 535144 - RNA, 23 nt, Homo sapiens
cuguccuuuuccccuacagaauu

SEQ ID NO: 535145 - RNA, 22 nt, Homo sapiens
cuguccuuuuggcacugagaua

SEQ ID NO: 535146 - RNA, 20 nt, Homo sapiens
cugucuacaguagcugcuac

SEQ ID NO: 535147 - RNA, 19 nt, Homo sapiens
cugucuauuuaagugcaau

SEQ ID NO: 535148 - RNA, 14 nt, Homo sapiens
cugucucaucacau

SEQ ID NO: 535149 - RNA, 13 nt, Homo sapiens
cugucuccaugcu

SEQ ID NO: 535150 - RNA, 18 nt, Homo sapiens
cugucuccaugcuggaua

SEQ ID NO: 535151 - RNA, 13 nt, Homo sapiens
cugucuccauggc

SEQ ID NO: 535152 - RNA, 20 nt, Homo sapiens
cugucucccccauugcucua

SEQ ID NO: 535153 - RNA, 15 nt, Homo sapiens
cugucucccuaggga

SEQ ID NO: 535154 - RNA, 19 nt, Homo sapiens
cugucucuuuccacuuugu

SEQ ID NO: 535155 - RNA, 12 nt, Homo sapiens
cugucugcauuu

SEQ ID NO: 535156 - RNA, 15 nt, Homo sapiens
cugucugcccuaggg

SEQ ID NO: 535157 - RNA, 17 nt, Homo sapiens
cugucuggccccugaga

SEQ ID NO: 535158 - RNA, 20 nt, Homo sapiens
cugucugggauuaagggcaa

SEQ ID NO: 535159 - RNA, 21 nt, Homo sapiens
cugucugggauuaagggcaaa

SEQ ID NO: 535160 - RNA, 20 nt, Homo sapiens
cugucugucaggccuugaga

SEQ ID NO: 535161 - RNA, 14 nt, Homo sapiens
cugucuguccuucu

SEQ ID NO: 535162 - RNA, 13 nt, Homo sapiens
cugucugucucca

SEQ ID NO: 535163 - RNA, 18 nt, Homo sapiens
cugucuguuacacuggag

SEQ ID NO: 535164 - RNA, 16 nt, Homo sapiens
cugucuuaccauaaca

SEQ ID NO: 535165 - RNA, 19 nt, Homo sapiens
cugucuuaugguccagaaa

SEQ ID NO: 535166 - RNA, 17 nt, Homo sapiens
cugucuugugucuccua

SEQ ID NO: 535167 - RNA, 17 nt, Homo sapiens
cugucuuuccacucugg

SEQ ID NO: 535168 - RNA, 14 nt, Homo sapiens
cugucuuuguggac

SEQ ID NO: 535169 - RNA, 21 nt, Homo sapiens
cugugaaaaauaaagucauca

SEQ ID NO: 535170 - RNA, 15 nt, Homo sapiens
cugugaaaccuuuac

SEQ ID NO: 535171 - RNA, 13 nt, Homo sapiens
cugugaaacuggc

SEQ ID NO: 535172 - RNA, 20 nt, Homo sapiens
cugugaaagaaccaaaagag

SEQ ID NO: 535173 - RNA, 22 nt, Homo sapiens
cugugaaaugcuggcauuugca

SEQ ID NO: 535174 - RNA, 20 nt, Homo sapiens
cugugaacagagagcgcuuu

SEQ ID NO: 535175 - RNA, 16 nt, Homo sapiens
cugugaaccugggcac

SEQ ID NO: 535176 - RNA, 18 nt, Homo sapiens
cugugaacuuucauguca

SEQ ID NO: 535177 - RNA, 13 nt, Homo sapiens
cugugaagcauuu

SEQ ID NO: 535178 - RNA, 14 nt, Homo sapiens
cugugaauuucaaa

SEQ ID NO: 535179 - RNA, 21 nt, Homo sapiens
cugugacauacauauuaucuc

SEQ ID NO: 535180 - RNA, 13 nt, Homo sapiens
cugugaccauuua

SEQ ID NO: 535181 - RNA, 21 nt, Homo sapiens
cugugacgcacagcacuccug

SEQ ID NO: 535182 - RNA, 18 nt, Homo sapiens
cugugagaggcagcuauc

SEQ ID NO: 535183 - RNA, 16 nt, Homo sapiens
cugugagcauuaaaua

SEQ ID NO: 535184 - RNA, 19 nt, Homo sapiens
cugugagcccagcuggguc

SEQ ID NO: 535185 - RNA, 23 nt, Homo sapiens
cugugagccgauuguccuaucuc

SEQ ID NO: 535186 - RNA, 15 nt, Homo sapiens
cugugagguucugua

SEQ ID NO: 535187 - RNA, 22 nt, Homo sapiens
cugugauauuuucacacuggua

SEQ ID NO: 535188 - RNA, 23 nt, Homo sapiens
cugugauauuuucacacugguaa

SEQ ID NO: 535189 - RNA, 15 nt, Homo sapiens
cugugauccacccaa

SEQ ID NO: 535190 - RNA, 22 nt, Homo sapiens
cugugauggcgggcacugggua

SEQ ID NO: 535191 - RNA, 18 nt, Homo sapiens
cugugcagcgggugcugc

SEQ ID NO: 535192 - RNA, 22 nt, Homo sapiens
cugugcagguggggagacuggg

SEQ ID NO: 535193 - RNA, 21 nt, Homo sapiens
cugugcaugacagcggcaauc

SEQ ID NO: 535194 - RNA, 15 nt, Homo sapiens
cugugcaugaccuga

SEQ ID NO: 535195 - RNA, 18 nt, Homo sapiens
cugugccagagauguacu

SEQ ID NO: 535196 - RNA, 13 nt, Homo sapiens
cugugccaguucu

SEQ ID NO: 535197 - RNA, 20 nt, Homo sapiens
cugugcccacggucugagcu

SEQ ID NO: 535198 - RNA, 16 nt, Homo sapiens
cugugcccuccaaaga

SEQ ID NO: 535199 - RNA, 17 nt, Homo sapiens
cugugccuaacaccagc

SEQ ID NO: 535200 - RNA, 18 nt, Homo sapiens
cugugccucuuagcaugc

SEQ ID NO: 535201 - RNA, 20 nt, Homo sapiens
cugugccugcucagcagcca

SEQ ID NO: 535202 - RNA, 21 nt, Homo sapiens
cugugcggugucaccaugagc

SEQ ID NO: 535203 - RNA, 19 nt, Homo sapiens
cugugcuccgugccuccac

SEQ ID NO: 535204 - RNA, 23 nt, Homo sapiens
cugugcucugaaugggagccaga

SEQ ID NO: 535205 - RNA, 16 nt, Homo sapiens
cugugcugggugagcu

SEQ ID NO: 535206 - RNA, 16 nt, Homo sapiens
cugugcugguguccug

SEQ ID NO: 535207 - RNA, 21 nt, Homo sapiens
cugugcugguguccugaccac

SEQ ID NO: 535208 - RNA, 18 nt, Homo sapiens
cuguggaacauaaaaagg

SEQ ID NO: 535209 - RNA, 13 nt, Homo sapiens
cuguggaauauaa

SEQ ID NO: 535210 - RNA, 20 nt, Homo sapiens
cuguggaaugagugugcaug

SEQ ID NO: 535211 - RNA, 22 nt, Homo sapiens
cuguggagacacugagucagaa

SEQ ID NO: 535212 - RNA, 16 nt, Homo sapiens
cuguggagcgggcaug

SEQ ID NO: 535213 - RNA, 11 nt, Homo sapiens
cuguggcacag

SEQ ID NO: 535214 - RNA, 14 nt, Homo sapiens
cuguggcagaguua

SEQ ID NO: 535215 - RNA, 16 nt, Homo sapiens
cuguggcauuuccaaa

SEQ ID NO: 535216 - RNA, 20 nt, Homo sapiens
cuguggccugugucccauga

SEQ ID NO: 535217 - RNA, 17 nt, Homo sapiens
cuguggcgacucugcag

SEQ ID NO: 535218 - RNA, 14 nt, Homo sapiens
cuguggcugacgaa

SEQ ID NO: 535219 - RNA, 15 nt, Homo sapiens
cugugggcagcaccc

SEQ ID NO: 535220 - RNA, 15 nt, Homo sapiens
cugugggccaaaauc

SEQ ID NO: 535221 - RNA, 15 nt, Homo sapiens
cuguggggaccccag

SEQ ID NO: 535222 - RNA, 19 nt, Homo sapiens
cuguggggcgaauucaucc

SEQ ID NO: 535223 - RNA, 18 nt, Homo sapiens
cugugggugcagcuguca

SEQ ID NO: 535224 - RNA, 16 nt, Homo sapiens
cuguggugauguugcc

SEQ ID NO: 535225 - RNA, 23 nt, Homo sapiens
cuguggugugucccccucugucc

SEQ ID NO: 535226 - RNA, 21 nt, Homo sapiens
cugugguuucagaugugcaau

SEQ ID NO: 535227 - RNA, 23 nt, Homo sapiens
cuguguaacuguaaaacauugaa

SEQ ID NO: 535228 - RNA, 21 nt, Homo sapiens
cuguguacacaucuauucuca

SEQ ID NO: 535229 - RNA, 16 nt, Homo sapiens
cuguguacauaacuga

SEQ ID NO: 535230 - RNA, 12 nt, Homo sapiens
cuguguacugug

SEQ ID NO: 535231 - RNA, 20 nt, Homo sapiens
cuguguauauaguuuuuacc

SEQ ID NO: 535232 - RNA, 15 nt, Homo sapiens
cuguguauucuagug

SEQ ID NO: 535233 - RNA, 22 nt, Homo sapiens
cugugucaccguaucucaggaa

SEQ ID NO: 535234 - RNA, 12 nt, Homo sapiens
cuguguccuccc

SEQ ID NO: 535235 - RNA, 22 nt, Homo sapiens
cugugucuggccagaaaaggca

SEQ ID NO: 535236 - RNA, 14 nt, Homo sapiens
cugugucuuggaau

SEQ ID NO: 535237 - RNA, 15 nt, Homo sapiens
cugugugaacgugua

SEQ ID NO: 535238 - RNA, 16 nt, Homo sapiens
cugugugaacguguau

SEQ ID NO: 535239 - RNA, 19 nt, Homo sapiens
cugugugaacguguaugua

SEQ ID NO: 535240 - RNA, 13 nt, Homo sapiens
cugugugacauca

SEQ ID NO: 535241 - RNA, 19 nt, Homo sapiens
cugugugaugaacuuucuc

SEQ ID NO: 535242 - RNA, 20 nt, Homo sapiens
cugugugcaagugugugcac

SEQ ID NO: 535243 - RNA, 12 nt, Homo sapiens
cugugugccauu

SEQ ID NO: 535244 - RNA, 19 nt, Homo sapiens
cugugugccuucugccaac

SEQ ID NO: 535245 - RNA, 15 nt, Homo sapiens
cugugugcuugucag

SEQ ID NO: 535246 - RNA, 22 nt, Homo sapiens
cuguguggacugugaugccaca

SEQ ID NO: 535247 - RNA, 17 nt, Homo sapiens
cuacauaugaucugucu

SEQ ID NO: 535248 - RNA, 18 nt, Homo sapiens
cuacauauugucuggaaa

SEQ ID NO: 535249 - RNA, 15 nt, Homo sapiens
cuacaucuaguuaau

SEQ ID NO: 535250 - RNA, 12 nt, Homo sapiens
cuacaucugccu

SEQ ID NO: 535251 - RNA, 22 nt, Homo sapiens
cuacaucuuuuuuucuaugaaa

SEQ ID NO: 535252 - RNA, 14 nt, Homo sapiens
cuacaugacugggc

SEQ ID NO: 535253 - RNA, 17 nt, Homo sapiens
gccuuucccucuucccu

SEQ ID NO: 535254 - RNA, 23 nt, Homo sapiens
gccuuucguucugcugaccaaau

SEQ ID NO: 535255 - RNA, 18 nt, Homo sapiens
gccuuucuguaaccaaaa

SEQ ID NO: 535256 - RNA, 15 nt, Homo sapiens
gccuuugaccaucuc

SEQ ID NO: 535257 - RNA, 15 nt, Homo sapiens
gccuuuguggugggc

SEQ ID NO: 535258 - RNA, 20 nt, Homo sapiens
gccuuuuaaaaguucuuuaa

SEQ ID NO: 535259 - RNA, 15 nt, Homo sapiens
gccuuuucacugugu

SEQ ID NO: 535260 - RNA, 20 nt, Homo sapiens
gccuuuuccacacgcauuaa

SEQ ID NO: 535261 - RNA, 23 nt, Homo sapiens
gccuuuucuggucccucuucucu

SEQ ID NO: 535262 - RNA, 12 nt, Homo sapiens
gccuuuuguuaa

SEQ ID NO: 535263 - RNA, 15 nt, Homo sapiens
gccuuuuguuuucau

SEQ ID NO: 535264 - RNA, 13 nt, Homo sapiens
gccuuuuuugcca

SEQ ID NO: 535265 - RNA, 14 nt, Homo sapiens
gccuuuuuugccag

SEQ ID NO: 535266 - RNA, 18 nt, Homo sapiens
gcgaaaaccuuccucagc

SEQ ID NO: 535267 - RNA, 22 nt, Homo sapiens
gcgaaaguaaaaacacuaccuc

SEQ ID NO: 535268 - RNA, 20 nt, Homo sapiens
gcgaacauguguuuucauca

SEQ ID NO: 535269 - RNA, 17 nt, Homo sapiens
gcgaccuccuuucauca

SEQ ID NO: 535270 - RNA, 22 nt, Homo sapiens
gcgagaggcagcaagguggcca

SEQ ID NO: 535271 - RNA, 22 nt, Homo sapiens
gcgaggugggagaggccucauc

SEQ ID NO: 535272 - RNA, 17 nt, Homo sapiens
gcgaguucucuuuggaa

SEQ ID NO: 535273 - RNA, 15 nt, Homo sapiens
gcgauggagcagucu

SEQ ID NO: 535274 - RNA, 16 nt, Homo sapiens
gcgauuaagagacaga

SEQ ID NO: 535275 - RNA, 15 nt, Homo sapiens
gcgcaagcugggagc

SEQ ID NO: 535276 - RNA, 21 nt, Homo sapiens
gcgcaaucucggcucacugca

SEQ ID NO: 535277 - RNA, 18 nt, Homo sapiens
gcgcaguguggagacggg

SEQ ID NO: 535278 - RNA, 18 nt, Homo sapiens
gcgccagccucagacugg

SEQ ID NO: 535279 - RNA, 22 nt, Homo sapiens
gcgccagccugucccauggaca

SEQ ID NO: 535280 - RNA, 16 nt, Homo sapiens
gcgccaggaagccaga

SEQ ID NO: 535281 - RNA, 12 nt, Homo sapiens
gcgccaggacag

SEQ ID NO: 535282 - RNA, 21 nt, Homo sapiens
gcgccaggauggaacacggcc

SEQ ID NO: 535283 - RNA, 18 nt, Homo sapiens
gcgcccagccucaucucu

SEQ ID NO: 535284 - RNA, 20 nt, Homo sapiens
gcgcccagggucgucuuugu

SEQ ID NO: 535285 - RNA, 17 nt, Homo sapiens
gcgcccaguccuuccac

SEQ ID NO: 535286 - RNA, 22 nt, Homo sapiens
gcgccccccccuccccaugcag

SEQ ID NO: 535287 - RNA, 19 nt, Homo sapiens
gcgccucaguuacacagga

SEQ ID NO: 535288 - RNA, 15 nt, Homo sapiens
gcgccuccauccauc

SEQ ID NO: 535289 - RNA, 17 nt, Homo sapiens
gcgccuccuuccuugcu

SEQ ID NO: 535290 - RNA, 14 nt, Homo sapiens
gcgccugagugagu

SEQ ID NO: 535291 - RNA, 21 nt, Homo sapiens
gcgccugccaucaugccugac

SEQ ID NO: 535292 - RNA, 14 nt, Homo sapiens
gcgcucgcccagca

SEQ ID NO: 535293 - RNA, 14 nt, Homo sapiens
gcgcucugccauuc

SEQ ID NO: 535294 - RNA, 16 nt, Homo sapiens
gcgcugcugguguucu

SEQ ID NO: 535295 - RNA, 16 nt, Homo sapiens
gcgcuucaucucauga

SEQ ID NO: 535296 - RNA, 13 nt, Homo sapiens
gcggaaugcauug

SEQ ID NO: 535297 - RNA, 19 nt, Homo sapiens
gcggagggcagucugcuca

SEQ ID NO: 535298 - RNA, 19 nt, Homo sapiens
gcggagucuguccugugac

SEQ ID NO: 535299 - RNA, 22 nt, Homo sapiens
gcggaucaucuaauucucugug

SEQ ID NO: 535300 - RNA, 13 nt, Homo sapiens
gcggcccucagug

SEQ ID NO: 535301 - RNA, 13 nt, Homo sapiens
gcggccugcugga

SEQ ID NO: 535302 - RNA, 17 nt, Homo sapiens
gcggcggaaagccugua

SEQ ID NO: 535303 - RNA, 20 nt, Homo sapiens
gcggcucugcccaccucucu

SEQ ID NO: 535304 - RNA, 14 nt, Homo sapiens
gcggcucugguccu

SEQ ID NO: 535305 - RNA, 15 nt, Homo sapiens
gcggcugaacugaga

SEQ ID NO: 535306 - RNA, 17 nt, Homo sapiens
gcggcugcacaacagcc

SEQ ID NO: 535307 - RNA, 13 nt, Homo sapiens
gcggcuggcagcc

SEQ ID NO: 535308 - RNA, 13 nt, Homo sapiens
gcgggacugcugg

SEQ ID NO: 535309 - RNA, 13 nt, Homo sapiens
gcgggagaccccu

SEQ ID NO: 535310 - RNA, 21 nt, Homo sapiens
gcgguagccagcacacagggc

SEQ ID NO: 535311 - RNA, 15 nt, Homo sapiens
gcggucaauuugccu

SEQ ID NO: 535312 - RNA, 16 nt, Homo sapiens
gcggugccaugaaggg

SEQ ID NO: 535313 - RNA, 22 nt, Homo sapiens
gcgguggcucacgccuguaauc

SEQ ID NO: 535314 - RNA, 14 nt, Homo sapiens
gcguacagaucucu

SEQ ID NO: 535315 - RNA, 21 nt, Homo sapiens
gcgucagaccaguacugggaa

SEQ ID NO: 535316 - RNA, 18 nt, Homo sapiens
gcgucauuucagcucuug

SEQ ID NO: 535317 - RNA, 15 nt, Homo sapiens
gcguccccacucccu

SEQ ID NO: 535318 - RNA, 15 nt, Homo sapiens
gcgucgguccuggug

SEQ ID NO: 535319 - RNA, 21 nt, Homo sapiens
gcgucucccauccugauccca

SEQ ID NO: 535320 - RNA, 15 nt, Homo sapiens
gcgugaaucuguauc

SEQ ID NO: 535321 - RNA, 17 nt, Homo sapiens
gcgugacucacccaagc

SEQ ID NO: 535322 - RNA, 13 nt, Homo sapiens
gcgugagacccag

SEQ ID NO: 535323 - RNA, 15 nt, Homo sapiens
gcguggcggagcugc

SEQ ID NO: 535324 - RNA, 15 nt, Homo sapiens
gcgugguagugcaag

SEQ ID NO: 535325 - RNA, 21 nt, Homo sapiens
gcgugugcgugcaugugcacu

SEQ ID NO: 535326 - RNA, 23 nt, Homo sapiens
gcguguggcucacgugugugacu

SEQ ID NO: 535327 - RNA, 16 nt, Homo sapiens
gcguguguacacggga

SEQ ID NO: 535328 - RNA, 14 nt, Homo sapiens
gcgugugucaggga

SEQ ID NO: 535329 - RNA, 16 nt, Homo sapiens
gcguguuggugugcac

SEQ ID NO: 535330 - RNA, 23 nt, Homo sapiens
gcguuacacccuuucuugacaaa

SEQ ID NO: 535331 - RNA, 12 nt, Homo sapiens
gcguuacugcuu

SEQ ID NO: 535332 - RNA, 19 nt, Homo sapiens
gcguuacugcuugaccaaa

SEQ ID NO: 535333 - RNA, 22 nt, Homo sapiens
gcguucacuccaaugucugcug

SEQ ID NO: 535334 - RNA, 21 nt, Homo sapiens
gcguuguuacaggaagucccu

SEQ ID NO: 535335 - RNA, 21 nt, Homo sapiens
gcguuucaggaacguugccac

SEQ ID NO: 535336 - RNA, 22 nt, Homo sapiens
gcguuuuuuaaauguauacuau

SEQ ID NO: 535337 - RNA, 13 nt, Homo sapiens
gcuaaaagggaaa

SEQ ID NO: 535338 - RNA, 20 nt, Homo sapiens
gcuaaaauuagaugaacuca

SEQ ID NO: 535339 - RNA, 19 nt, Homo sapiens
gcuaaacgcaaugucauuu

SEQ ID NO: 535340 - RNA, 13 nt, Homo sapiens
gcuaaagccagga

SEQ ID NO: 535341 - RNA, 12 nt, Homo sapiens
gcuaaauaucac

SEQ ID NO: 535342 - RNA, 20 nt, Homo sapiens
gcuaaauuuggguacugggu

SEQ ID NO: 535343 - RNA, 13 nt, Homo sapiens
gcuaacacgguga

SEQ ID NO: 535344 - RNA, 15 nt, Homo sapiens
gcuaacuaaugccau

SEQ ID NO: 535345 - RNA, 19 nt, Homo sapiens
gcuaacuuaguaagugcuu

SEQ ID NO: 535346 - RNA, 22 nt, Homo sapiens
gcuaagauccuccugaccucaa

SEQ ID NO: 535347 - RNA, 21 nt, Homo sapiens
gcuaagauuuagagaugaauu

SEQ ID NO: 535348 - RNA, 19 nt, Homo sapiens
gcuaagccuggaagccauc

SEQ ID NO: 535349 - RNA, 17 nt, Homo sapiens
gcuaaggacauuuccca

SEQ ID NO: 535350 - RNA, 15 nt, Homo sapiens
gcuaagggugggugc

SEQ ID NO: 535351 - RNA, 13 nt, Homo sapiens
gcuaaguacacaa

SEQ ID NO: 535352 - RNA, 13 nt, Homo sapiens
gcuaaguauugaa

SEQ ID NO: 535353 - RNA, 18 nt, Homo sapiens
gcuaaguauugaauuuca

SEQ ID NO: 535354 - RNA, 20 nt, Homo sapiens
gcuaaguguaugaugucaca

SEQ ID NO: 535355 - RNA, 20 nt, Homo sapiens
gcuaauacccaguuacuuau

SEQ ID NO: 535356 - RNA, 12 nt, Homo sapiens
gcuaauaccugu

SEQ ID NO: 535357 - RNA, 15 nt, Homo sapiens
gcuaauagcugcuag

SEQ ID NO: 535358 - RNA, 21 nt, Homo sapiens
gcuaaucaaagccagggucuc

SEQ ID NO: 535359 - RNA, 12 nt, Homo sapiens
gcuaaucugccu

SEQ ID NO: 535360 - RNA, 21 nt, Homo sapiens
gcuaaucugccugguuuuauu

SEQ ID NO: 535361 - RNA, 17 nt, Homo sapiens
gcuaaugaacucuuuca

SEQ ID NO: 535362 - RNA, 19 nt, Homo sapiens
gcuaaugaagaucauauac

SEQ ID NO: 535363 - RNA, 17 nt, Homo sapiens
gcuaauuugccacagga

SEQ ID NO: 535364 - RNA, 18 nt, Homo sapiens
gcuacaaauuuaugcauu

SEQ ID NO: 535365 - RNA, 14 nt, Homo sapiens
gcuacaacauguga

SEQ ID NO: 535366 - RNA, 15 nt, Homo sapiens
gcuacacagacauua

SEQ ID NO: 535367 - RNA, 17 nt, Homo sapiens
gcuacagaagaaacugg

SEQ ID NO: 535368 - RNA, 18 nt, Homo sapiens
gcuacaguaaccaaaaca

SEQ ID NO: 535369 - RNA, 17 nt, Homo sapiens
gcuacaguuauuaaucu

SEQ ID NO: 535370 - RNA, 16 nt, Homo sapiens
gcuacauauacauagu

SEQ ID NO: 535371 - RNA, 23 nt, Homo sapiens
gcuacaucuuuuuuucuaugaaa

SEQ ID NO: 535372 - RNA, 23 nt, Homo sapiens
gcuaccagguguucuacacucau

SEQ ID NO: 535373 - RNA, 19 nt, Homo sapiens
gcuaccuacaugcugaaaa

SEQ ID NO: 535374 - RNA, 16 nt, Homo sapiens
gcuaccucacuggggu

SEQ ID NO: 535375 - RNA, 14 nt, Homo sapiens
gcuccuaucugugu

SEQ ID NO: 535376 - RNA, 24 nt, Homo sapiens
gcuccucacuuccucuucuucauu

SEQ ID NO: 535377 - RNA, 15 nt, Homo sapiens
gcuccucagcagucc

SEQ ID NO: 535378 - RNA, 22 nt, Homo sapiens
gcuccuccguguggacugugcc

SEQ ID NO: 535379 - RNA, 13 nt, Homo sapiens
gcuccuccucacc

SEQ ID NO: 535380 - RNA, 18 nt, Homo sapiens
gcuccuccugcccugucc

SEQ ID NO: 535381 - RNA, 17 nt, Homo sapiens
gcuccuccuuaugacuc

SEQ ID NO: 535382 - RNA, 18 nt, Homo sapiens
gcuccuccuucccaggga

SEQ ID NO: 535383 - RNA, 22 nt, Homo sapiens
gcuccucgcccccaccagugua

SEQ ID NO: 535384 - RNA, 15 nt, Homo sapiens
gcuccugaggggcau

SEQ ID NO: 535385 - RNA, 15 nt, Homo sapiens
gcuccugaguagcug

SEQ ID NO: 535386 - RNA, 23 nt, Homo sapiens
gcuccugauggugucauucugcc

SEQ ID NO: 535387 - RNA, 23 nt, Homo sapiens
gcuccugcagcauggucccugcc

SEQ ID NO: 535388 - RNA, 19 nt, Homo sapiens
gcuccuguucacaccagag

SEQ ID NO: 535389 - RNA, 23 nt, Homo sapiens
gcuccuuauucccaguguuccau

SEQ ID NO: 535390 - RNA, 22 nt, Homo sapiens
gcuccuuggcacccccaugcug

SEQ ID NO: 535391 - RNA, 15 nt, Homo sapiens
gcuccuugucaauac

SEQ ID NO: 535392 - RNA, 19 nt, Homo sapiens
gcucgcauuugucaaugac

SEQ ID NO: 535393 - RNA, 15 nt, Homo sapiens
gcucgcccuccuuuc

SEQ ID NO: 535394 - RNA, 14 nt, Homo sapiens
gcucgcugccauca

SEQ ID NO: 535395 - RNA, 14 nt, Homo sapiens
gcucggagucugag

SEQ ID NO: 535396 - RNA, 14 nt, Homo sapiens
gcucgggugcagag

SEQ ID NO: 535397 - RNA, 12 nt, Homo sapiens
gcucgugcagua

SEQ ID NO: 535398 - RNA, 20 nt, Homo sapiens
gcucuacaggugcaacaggu

SEQ ID NO: 535399 - RNA, 13 nt, Homo sapiens
gcucuacccauga

SEQ ID NO: 535400 - RNA, 23 nt, Homo sapiens
gcucuaugggguucguuaugcca

SEQ ID NO: 535401 - RNA, 15 nt, Homo sapiens
gcucucaagaccaga

SEQ ID NO: 535402 - RNA, 20 nt, Homo sapiens
gcucucaguuaaaaugugag

SEQ ID NO: 535403 - RNA, 14 nt, Homo sapiens
gcucucauugacuu

SEQ ID NO: 535404 - RNA, 22 nt, Homo sapiens
gcucuccaccacccaacccaaa

SEQ ID NO: 535405 - RNA, 15 nt, Homo sapiens
gcucuccaucuucca

SEQ ID NO: 535406 - RNA, 16 nt, Homo sapiens
gcucucccaacucuug

SEQ ID NO: 535407 - RNA, 19 nt, Homo sapiens
gcucucccaacucuugcac

SEQ ID NO: 535408 - RNA, 21 nt, Homo sapiens
gcucucccacaucccacugga

SEQ ID NO: 535409 - RNA, 21 nt, Homo sapiens
gcucuccccaggcauuugcca

SEQ ID NO: 535410 - RNA, 18 nt, Homo sapiens
gcucucccucucucucau

SEQ ID NO: 535411 - RNA, 23 nt, Homo sapiens
gcucuccggggccauuugcaaua

SEQ ID NO: 535412 - RNA, 17 nt, Homo sapiens
gcucucgggacuagcug

SEQ ID NO: 535413 - RNA, 20 nt, Homo sapiens
gcucucuccacaaccucuug

SEQ ID NO: 535414 - RNA, 14 nt, Homo sapiens
gcucucuggacacu

SEQ ID NO: 535415 - RNA, 19 nt, Homo sapiens
gcucugaacacacacgcca

SEQ ID NO: 535416 - RNA, 15 nt, Homo sapiens
gcucugacauucuga

SEQ ID NO: 535417 - RNA, 21 nt, Homo sapiens
gcucugcaauuccccucugcu

SEQ ID NO: 535418 - RNA, 19 nt, Homo sapiens
gcucugcaggccacuguga

SEQ ID NO: 535419 - RNA, 19 nt, Homo sapiens
gcucugccacccuaccugu

SEQ ID NO: 535420 - RNA, 13 nt, Homo sapiens
gcucugccauuca

SEQ ID NO: 535421 - RNA, 16 nt, Homo sapiens
gcucugccccaccuug

SEQ ID NO: 535422 - RNA, 13 nt, Homo sapiens
gcucugccucaga

SEQ ID NO: 535423 - RNA, 18 nt, Homo sapiens
gcucuggaaaaugugacc

SEQ ID NO: 535424 - RNA, 14 nt, Homo sapiens
gcucuggaccucag

SEQ ID NO: 535425 - RNA, 20 nt, Homo sapiens
gcucugggggacccaggugg

SEQ ID NO: 535426 - RNA, 14 nt, Homo sapiens
gcucuguagagggu

SEQ ID NO: 535427 - RNA, 13 nt, Homo sapiens
gcucugucuccca

SEQ ID NO: 535428 - RNA, 22 nt, Homo sapiens
gcucuuaggugcuucuucacuu

SEQ ID NO: 535429 - RNA, 18 nt, Homo sapiens
gcucuuaugugugccuuu

SEQ ID NO: 535430 - RNA, 10 nt, Homo sapiens
gcucuuccaa

SEQ ID NO: 535431 - RNA, 16 nt, Homo sapiens
gcucuuccaggagcca

SEQ ID NO: 535432 - RNA, 20 nt, Homo sapiens
gcucuuccccuagaccuccc

SEQ ID NO: 535433 - RNA, 12 nt, Homo sapiens
gcucuuguuauu

SEQ ID NO: 535434 - RNA, 15 nt, Homo sapiens
gcucuuuaccaagga

SEQ ID NO: 535435 - RNA, 18 nt, Homo sapiens
gcucuuucccuuuaucag

SEQ ID NO: 535436 - RNA, 16 nt, Homo sapiens
gcucuuucucugccag

SEQ ID NO: 535437 - RNA, 22 nt, Homo sapiens
gcucuuucucugccagugacag

SEQ ID NO: 535438 - RNA, 15 nt, Homo sapiens
gcucuuuugugauga

SEQ ID NO: 535439 - RNA, 22 nt, Homo sapiens
gcugaaaaaacaccuagcuuua

SEQ ID NO: 535440 - RNA, 20 nt, Homo sapiens
gcugaaaaauauagccuuua

SEQ ID NO: 535441 - RNA, 17 nt, Homo sapiens
gcugaaaacauaaccca

SEQ ID NO: 535442 - RNA, 14 nt, Homo sapiens
gcugaaaagggcac

SEQ ID NO: 535443 - RNA, 21 nt, Homo sapiens
gcugaaacugaaauaagcuaa

SEQ ID NO: 535444 - RNA, 17 nt, Homo sapiens
gcugaaauaaaaauaca

SEQ ID NO: 535445 - RNA, 22 nt, Homo sapiens
gcugaaauaaaaugauaaacaa

SEQ ID NO: 535446 - RNA, 22 nt, Homo sapiens
gcugaaauuuuagaaauauuca

SEQ ID NO: 535447 - RNA, 18 nt, Homo sapiens
gcugaacacauuugccca

SEQ ID NO: 535448 - RNA, 14 nt, Homo sapiens
gcugaacaugccug

SEQ ID NO: 535449 - RNA, 20 nt, Homo sapiens
gcugaaccacagaaaucaca

SEQ ID NO: 535450 - RNA, 14 nt, Homo sapiens
gcugaagaccuaaa

SEQ ID NO: 535451 - RNA, 21 nt, Homo sapiens
gcugaagcgagcccucaggag

SEQ ID NO: 535452 - RNA, 21 nt, Homo sapiens
gcugaagugguugcauucuac

SEQ ID NO: 535453 - RNA, 19 nt, Homo sapiens
gcugaauacgcuaagccug

SEQ ID NO: 535454 - RNA, 15 nt, Homo sapiens
gcugaaugucauuuu

SEQ ID NO: 535455 - RNA, 22 nt, Homo sapiens
gcugaauguggacucaaucccu

SEQ ID NO: 535456 - RNA, 21 nt, Homo sapiens
gcugaauguuuguuucagugc

SEQ ID NO: 535457 - RNA, 23 nt, Homo sapiens
gcugacacagaggcuggcacuga

SEQ ID NO: 535458 - RNA, 19 nt, Homo sapiens
gcugaccaacgcacaacag

SEQ ID NO: 535459 - RNA, 19 nt, Homo sapiens
gcugaccccucuggugugu

SEQ ID NO: 535460 - RNA, 16 nt, Homo sapiens
gcugaccucccaguga

SEQ ID NO: 535461 - RNA, 20 nt, Homo sapiens
gcugacucuggccuuacaac

SEQ ID NO: 535462 - RNA, 15 nt, Homo sapiens
gcugacuguuucauu

SEQ ID NO: 535463 - RNA, 14 nt, Homo sapiens
gcugagagacccaa

SEQ ID NO: 535464 - RNA, 22 nt, Homo sapiens
gcugagauugagcagaagauca

SEQ ID NO: 535465 - RNA, 14 nt, Homo sapiens
gcugagcacuuuug

SEQ ID NO: 535466 - RNA, 16 nt, Homo sapiens
gcugagccucagucuc

SEQ ID NO: 535467 - RNA, 14 nt, Homo sapiens
gcugagcgccagga

SEQ ID NO: 535468 - RNA, 15 nt, Homo sapiens
gcugagcugugacau

SEQ ID NO: 535469 - RNA, 20 nt, Homo sapiens
gcugaggcccccagcugccu

SEQ ID NO: 535470 - RNA, 15 nt, Homo sapiens
gcugaggccugugaa

SEQ ID NO: 535471 - RNA, 13 nt, Homo sapiens
gcugaguccagag

SEQ ID NO: 535472 - RNA, 12 nt, Homo sapiens
gcugagugcugg

SEQ ID NO: 535473 - RNA, 18 nt, Homo sapiens
gcugaguggccagccagu

SEQ ID NO: 535474 - RNA, 14 nt, Homo sapiens
cccaugugugagug

SEQ ID NO: 535475 - RNA, 24 nt, Homo sapiens
cccauucccugggaucuggugguc

SEQ ID NO: 535476 - RNA, 22 nt, Homo sapiens
cccauucucccagucucugucg

SEQ ID NO: 535477 - RNA, 13 nt, Homo sapiens
cccauucuugagu

SEQ ID NO: 535478 - RNA, 22 nt, Homo sapiens
cccauugaaacaaaacauugau

SEQ ID NO: 535479 - RNA, 17 nt, Homo sapiens
cccauugcaaacauuau

SEQ ID NO: 535480 - RNA, 23 nt, Homo sapiens
cccauugguguugucauuguaaa

SEQ ID NO: 535481 - RNA, 15 nt, Homo sapiens
cccauuucaaugugu

SEQ ID NO: 535482 - RNA, 9 nt, Homo sapiens
cccauuucu

SEQ ID NO: 535483 - RNA, 18 nt, Homo sapiens
ccccaaagugcugggauu

SEQ ID NO: 535484 - RNA, 14 nt, Homo sapiens
ccccaaccacagag

SEQ ID NO: 535485 - RNA, 15 nt, Homo sapiens
ccccaaccaggcuaa

SEQ ID NO: 535486 - RNA, 12 nt, Homo sapiens
ccccaaccugcu

SEQ ID NO: 535487 - RNA, 16 nt, Homo sapiens
ccccaaccugcugaag

SEQ ID NO: 535488 - RNA, 17 nt, Homo sapiens
ccccaacuaguagcuaa

SEQ ID NO: 535489 - RNA, 15 nt, Homo sapiens
ccccaacuccaggaa

SEQ ID NO: 535490 - RNA, 12 nt, Homo sapiens
ccccaacuugag

SEQ ID NO: 535491 - RNA, 18 nt, Homo sapiens
ccccaagauacucuuugu

SEQ ID NO: 535492 - RNA, 15 nt, Homo sapiens
ccccaagguuccaga

SEQ ID NO: 535493 - RNA, 15 nt, Homo sapiens
ccccaauccaugcuu

SEQ ID NO: 535494 - RNA, 15 nt, Homo sapiens
ccccaaucuugccca

SEQ ID NO: 535495 - RNA, 22 nt, Homo sapiens
ccccaaugacacccaugccaga

SEQ ID NO: 535496 - RNA, 21 nt, Homo sapiens
ccccaauugggaaugcaauau

SEQ ID NO: 535497 - RNA, 12 nt, Homo sapiens
uaaaaccaaaga

SEQ ID NO: 535498 - RNA, 13 nt, Homo sapiens
uaaaaccaaagag

SEQ ID NO: 535499 - RNA, 18 nt, Homo sapiens
uaaaacccacaagugucu

SEQ ID NO: 535500 - RNA, 18 nt, Homo sapiens
uaaaaccugggugucaga

SEQ ID NO: 535501 - RNA, 17 nt, Homo sapiens
uaaaaccugugugccau

SEQ ID NO: 535502 - RNA, 18 nt, Homo sapiens
uaaaaccugugugccauu

SEQ ID NO: 535503 - RNA, 22 nt, Homo sapiens
uaaaacucaaaacacccaaaaa

SEQ ID NO: 535504 - RNA, 21 nt, Homo sapiens
uaaaacugauuuuuagcuuua

SEQ ID NO: 535505 - RNA, 12 nt, Homo sapiens
uaaaacugcaca

SEQ ID NO: 535506 - RNA, 21 nt, Homo sapiens
uaaaacugcgaggacaucaaa

SEQ ID NO: 535507 - RNA, 20 nt, Homo sapiens
uaaaacugucuugugagcug

SEQ ID NO: 535508 - RNA, 21 nt, Homo sapiens
uaaaacuuuccugacuuacaa

SEQ ID NO: 535509 - RNA, 17 nt, Homo sapiens
uaaaagaaaaaugcugu

SEQ ID NO: 535510 - RNA, 20 nt, Homo sapiens
uaaaagaaaaucuuuaggcu

SEQ ID NO: 535511 - RNA, 19 nt, Homo sapiens
uaaaagaaccgagcaauuu

SEQ ID NO: 535512 - RNA, 22 nt, Homo sapiens
uaaaagaauaaaauugcacuuu

SEQ ID NO: 535513 - RNA, 14 nt, Homo sapiens
uaaaagagaagcca

SEQ ID NO: 535514 - RNA, 11 nt, Homo sapiens
uaaaagaucuu

SEQ ID NO: 535515 - RNA, 14 nt, Homo sapiens
uaaaagaucuugaa

SEQ ID NO: 535516 - RNA, 21 nt, Homo sapiens
uaaaagaucuugaauagucuc

SEQ ID NO: 535517 - RNA, 22 nt, Homo sapiens
uaaaagaucuugaauagucuca

SEQ ID NO: 535518 - RNA, 15 nt, Homo sapiens
uaaaagaugauuucu

SEQ ID NO: 535519 - RNA, 22 nt, Homo sapiens
uaaaagauuuuuuuuaaucuag

SEQ ID NO: 535520 - RNA, 16 nt, Homo sapiens
uaaaagcaacaucguc

SEQ ID NO: 535521 - RNA, 19 nt, Homo sapiens
uaaaagcaauucugacugu

SEQ ID NO: 535522 - RNA, 20 nt, Homo sapiens
uaaaagcacaaguacuuuug

SEQ ID NO: 535523 - RNA, 14 nt, Homo sapiens
uaaaagcacacuca

SEQ ID NO: 535524 - RNA, 22 nt, Homo sapiens
uaaaagcacacucauccccuca

SEQ ID NO: 535525 - RNA, 23 nt, Homo sapiens
uaaaagcacacucauccccucac

SEQ ID NO: 535526 - RNA, 14 nt, Homo sapiens
uaaaagcacacucc

SEQ ID NO: 535527 - RNA, 17 nt, Homo sapiens
uaaaagccaauuagcuc

SEQ ID NO: 535528 - RNA, 17 nt, Homo sapiens
uaaaagccuuauucuaa

SEQ ID NO: 535529 - RNA, 20 nt, Homo sapiens
uaaaagccuuauucuaaggu

SEQ ID NO: 535530 - RNA, 20 nt, Homo sapiens
uaaaagcuauaaagcaguau

SEQ ID NO: 535531 - RNA, 14 nt, Homo sapiens
uaaaagcuauggug

SEQ ID NO: 535532 - RNA, 23 nt, Homo sapiens
uaaaaggauguuacaaguuugcu

SEQ ID NO: 535533 - RNA, 17 nt, Homo sapiens
uaaaaggauuauuacua

SEQ ID NO: 535534 - RNA, 20 nt, Homo sapiens
uaaaagguaugguggggaua

SEQ ID NO: 535535 - RNA, 20 nt, Homo sapiens
uaaaagguauuuugaauacc

SEQ ID NO: 535536 - RNA, 22 nt, Homo sapiens
uaaaagguuaauuucugucaaa

SEQ ID NO: 535537 - RNA, 20 nt, Homo sapiens
uaaaaguaucuuuaacaauu

SEQ ID NO: 535538 - RNA, 15 nt, Homo sapiens
uaaaaguauuauuca

SEQ ID NO: 535539 - RNA, 15 nt, Homo sapiens
uaaaagucugagaua

SEQ ID NO: 535540 - RNA, 15 nt, Homo sapiens
uaaaagugcauuuaa

SEQ ID NO: 535541 - RNA, 17 nt, Homo sapiens
uaaaagugggcuugauu

SEQ ID NO: 535542 - RNA, 13 nt, Homo sapiens
uaaaaguguaaca

SEQ ID NO: 535543 - RNA, 20 nt, Homo sapiens
uaaaaguuacuuaccacaga

SEQ ID NO: 535544 - RNA, 18 nt, Homo sapiens
uaaaaguugaaaaaccac

SEQ ID NO: 535545 - RNA, 19 nt, Homo sapiens
uaaaaguuggagaagucuu

SEQ ID NO: 535546 - RNA, 18 nt, Homo sapiens
uaaaaguuucaaugugau

SEQ ID NO: 535547 - RNA, 23 nt, Homo sapiens
uaaaaguuuuuuauuaugcauua

SEQ ID NO: 535548 - RNA, 18 nt, Homo sapiens
uaaaauaaaguacauuau

SEQ ID NO: 535549 - RNA, 14 nt, Homo sapiens
uaaaauaaauuccu

SEQ ID NO: 535550 - RNA, 19 nt, Homo sapiens
uaaaauaacuaguacaaaa

SEQ ID NO: 535551 - RNA, 19 nt, Homo sapiens
uaaaauaagcucagugaua

SEQ ID NO: 535552 - RNA, 19 nt, Homo sapiens
uaaaauacuaaacuacauu

SEQ ID NO: 535553 - RNA, 14 nt, Homo sapiens
uaaaauacuaugca

SEQ ID NO: 535554 - RNA, 18 nt, Homo sapiens
cuucaacaugacauccag

SEQ ID NO: 535555 - RNA, 21 nt, Homo sapiens
cuucaacugaccagccuccau

SEQ ID NO: 535556 - RNA, 15 nt, Homo sapiens
cuucaagacucugaa

SEQ ID NO: 535557 - RNA, 16 nt, Homo sapiens
cuucaagagcugagaa

SEQ ID NO: 535558 - RNA, 18 nt, Homo sapiens
cuucaagcgcuccagggc

SEQ ID NO: 535559 - RNA, 14 nt, Homo sapiens
cuucaaggcuucca

SEQ ID NO: 535560 - RNA, 22 nt, Homo sapiens
cuucaaguauaacaacuuugaa

SEQ ID NO: 535561 - RNA, 13 nt, Homo sapiens
cuucaauacuuaa

SEQ ID NO: 535562 - RNA, 17 nt, Homo sapiens
cuucaauuuauuacuga

SEQ ID NO: 535563 - RNA, 19 nt, Homo sapiens
cuucacaaaaucuguuuag

SEQ ID NO: 535564 - RNA, 17 nt, Homo sapiens
cuucacaguacccaaac

SEQ ID NO: 535565 - RNA, 14 nt, Homo sapiens
cuucacaguguuuc

SEQ ID NO: 535566 - RNA, 19 nt, Homo sapiens
cuucacauaagcucagaau

SEQ ID NO: 535567 - RNA, 11 nt, Homo sapiens
cuucaccacug

SEQ ID NO: 535568 - RNA, 19 nt, Homo sapiens
cuucaccccuacacuguga

SEQ ID NO: 535569 - RNA, 15 nt, Homo sapiens
cuucaccucacugaa

SEQ ID NO: 535570 - RNA, 11 nt, Homo sapiens
cuucaccucag

SEQ ID NO: 535571 - RNA, 14 nt, Homo sapiens
cuucaccucuucca

SEQ ID NO: 535572 - RNA, 16 nt, Homo sapiens
cuucaccuuuccucuc

SEQ ID NO: 535573 - RNA, 19 nt, Homo sapiens
cuucacgggcaaucaugag

SEQ ID NO: 535574 - RNA, 20 nt, Homo sapiens
cuucacuacuuuaauaaaga

SEQ ID NO: 535575 - RNA, 13 nt, Homo sapiens
cuucacuauacaa

SEQ ID NO: 535576 - RNA, 15 nt, Homo sapiens
cuucacucaugcaaa

SEQ ID NO: 535577 - RNA, 17 nt, Homo sapiens
cuucacugaacaugccu

SEQ ID NO: 535578 - RNA, 22 nt, Homo sapiens
cuucacugccccacuucuggca

SEQ ID NO: 535579 - RNA, 23 nt, Homo sapiens
cuucacuuacaagaaaggccuga

SEQ ID NO: 535580 - RNA, 13 nt, Homo sapiens
cuucacuuuacaa

SEQ ID NO: 535581 - RNA, 15 nt, Homo sapiens
cuucacuuuccucag

SEQ ID NO: 535582 - RNA, 20 nt, Homo sapiens
cuucagaagacacugcaaag

SEQ ID NO: 535583 - RNA, 15 nt, Homo sapiens
cuucagaauuccaua

SEQ ID NO: 535584 - RNA, 16 nt, Homo sapiens
cuucagacacaggaaa

SEQ ID NO: 535585 - RNA, 23 nt, Homo sapiens
cuucagaccccaaaggagucaga

SEQ ID NO: 535586 - RNA, 15 nt, Homo sapiens
cuucagaccugacac

SEQ ID NO: 535587 - RNA, 19 nt, Homo sapiens
cuucagacucagcccaaau

SEQ ID NO: 535588 - RNA, 23 nt, Homo sapiens
cuucagagacuaucugauuuccu

SEQ ID NO: 535589 - RNA, 17 nt, Homo sapiens
cuucagaggguuuggac

SEQ ID NO: 535590 - RNA, 18 nt, Homo sapiens
cuucagaguuugugugua

SEQ ID NO: 535591 - RNA, 17 nt, Homo sapiens
cuucagaucucuaauua

SEQ ID NO: 535592 - RNA, 16 nt, Homo sapiens
cuucagauuuguguua

SEQ ID NO: 535593 - RNA, 16 nt, Homo sapiens
cuucagcaaugaauug

SEQ ID NO: 535594 - RNA, 14 nt, Homo sapiens
cuucagcagucaau

SEQ ID NO: 535595 - RNA, 23 nt, Homo sapiens
cuucagcuauacuuacacuguau

SEQ ID NO: 535596 - RNA, 13 nt, Homo sapiens
cuucagcucugaa

SEQ ID NO: 535597 - RNA, 18 nt, Homo sapiens
cuucagcugccugaaaca

SEQ ID NO: 535598 - RNA, 21 nt, Homo sapiens
cuucagcuucccgaguagcug

SEQ ID NO: 535599 - RNA, 19 nt, Homo sapiens
cuucagggccaguccuccu

SEQ ID NO: 535600 - RNA, 22 nt, Homo sapiens
cuucaggggcucccugccugag

SEQ ID NO: 535601 - RNA, 21 nt, Homo sapiens
cuucaggguuuaauagacuga

SEQ ID NO: 535602 - RNA, 20 nt, Homo sapiens
cuucagguucucaugauacc

SEQ ID NO: 535603 - RNA, 20 nt, Homo sapiens
cuucagucuuaauacuuuau

SEQ ID NO: 535604 - RNA, 23 nt, Homo sapiens
cuucagugcaccuacugcuuacu

SEQ ID NO: 535605 - RNA, 20 nt, Homo sapiens
cuucaguguuuuucauuucu

SEQ ID NO: 535606 - RNA, 14 nt, Homo sapiens
cuucaguuaauucu

SEQ ID NO: 535607 - RNA, 14 nt, Homo sapiens
cuucaguuaugauu

SEQ ID NO: 535608 - RNA, 14 nt, Homo sapiens
cuucaguugaucuu

SEQ ID NO: 535609 - RNA, 15 nt, Homo sapiens
cuucauauaccagca

SEQ ID NO: 535610 - RNA, 19 nt, Homo sapiens
cuucauauagcauugauaa

SEQ ID NO: 535611 - RNA, 22 nt, Homo sapiens
cuucaucgaaucuacuaauucc

SEQ ID NO: 535612 - RNA, 12 nt, Homo sapiens
cuucaugcuuuu

SEQ ID NO: 535613 - RNA, 23 nt, Homo sapiens
cuucaugcuuuugcuugcaaugu

SEQ ID NO: 535614 - RNA, 19 nt, Homo sapiens
cuucauggaucagaucugg

SEQ ID NO: 535615 - RNA, 16 nt, Homo sapiens
cuucauguaaauugac

SEQ ID NO: 535616 - RNA, 14 nt, Homo sapiens
cuucaugugcugcc

SEQ ID NO: 535617 - RNA, 15 nt, Homo sapiens
cuucauuccaaucua

SEQ ID NO: 535618 - RNA, 16 nt, Homo sapiens
cuucuccaaugcucug

SEQ ID NO: 535619 - RNA, 17 nt, Homo sapiens
cuucuccaauucugaaa

SEQ ID NO: 535620 - RNA, 14 nt, Homo sapiens
cuucuccaccaaag

SEQ ID NO: 535621 - RNA, 17 nt, Homo sapiens
cuucuccaccaaagaca

SEQ ID NO: 535622 - RNA, 18 nt, Homo sapiens
cuucuccauccacauggg

SEQ ID NO: 535623 - RNA, 23 nt, Homo sapiens
cuucuccaugcugcaaaggagaa

SEQ ID NO: 535624 - RNA, 15 nt, Homo sapiens
cuucucccacacugc

SEQ ID NO: 535625 - RNA, 22 nt, Homo sapiens
cuucuccccucucccagggaug

SEQ ID NO: 535626 - RNA, 19 nt, Homo sapiens
cuucuccccuuccuggaca

SEQ ID NO: 535627 - RNA, 16 nt, Homo sapiens
cuucucccuucuuggg

SEQ ID NO: 535628 - RNA, 18 nt, Homo sapiens
cuucucgugacaccacca

SEQ ID NO: 535629 - RNA, 16 nt, Homo sapiens
cuucucucucugcucc

SEQ ID NO: 535630 - RNA, 13 nt, Homo sapiens
cuucucucuucaa

SEQ ID NO: 535631 - RNA, 14 nt, Homo sapiens
cuucucugcuccuu

SEQ ID NO: 535632 - RNA, 22 nt, Homo sapiens
cuucucuggaaaggggggagcu

SEQ ID NO: 535633 - RNA, 14 nt, Homo sapiens
cuucucugucucug

SEQ ID NO: 535634 - RNA, 14 nt, Homo sapiens
cuucucuugccuua

SEQ ID NO: 535635 - RNA, 19 nt, Homo sapiens
cuucugaacuacacugcau

SEQ ID NO: 535636 - RNA, 13 nt, Homo sapiens
cuucugaccacac

SEQ ID NO: 535637 - RNA, 23 nt, Homo sapiens
cuucugagacaucccugauucuc

SEQ ID NO: 535638 - RNA, 15 nt, Homo sapiens
cuucugagcacuguu

SEQ ID NO: 535639 - RNA, 21 nt, Homo sapiens
cuucugaggcgcugcuuuguc

SEQ ID NO: 535640 - RNA, 16 nt, Homo sapiens
cuucugauaaacacaa

SEQ ID NO: 535641 - RNA, 16 nt, Homo sapiens
cuucugauacguguau

SEQ ID NO: 535642 - RNA, 14 nt, Homo sapiens
cuucugcaaaaaac

SEQ ID NO: 535643 - RNA, 16 nt, Homo sapiens
cuucugcaccaacuca

SEQ ID NO: 535644 - RNA, 16 nt, Homo sapiens
cuucugcacccuccac

SEQ ID NO: 535645 - RNA, 23 nt, Homo sapiens
cuucugcaggaucccuacugcca

SEQ ID NO: 535646 - RNA, 13 nt, Homo sapiens
cuucugcuucuca

SEQ ID NO: 535647 - RNA, 20 nt, Homo sapiens
cuucuggagucuccaguggu

SEQ ID NO: 535648 - RNA, 21 nt, Homo sapiens
cuucuggcagggaagugggga

SEQ ID NO: 535649 - RNA, 17 nt, Homo sapiens
cuucuggcucacaggaa

SEQ ID NO: 535650 - RNA, 16 nt, Homo sapiens
cuucugggacuggaca

SEQ ID NO: 535651 - RNA, 16 nt, Homo sapiens
cuucugggcacagugg

SEQ ID NO: 535652 - RNA, 19 nt, Homo sapiens
cuucuggggguagaucuca

SEQ ID NO: 535653 - RNA, 15 nt, Homo sapiens
cuucuggggguggug

SEQ ID NO: 535654 - RNA, 21 nt, Homo sapiens
cuucugguuguauuucuauau

SEQ ID NO: 535655 - RNA, 14 nt, Homo sapiens
cuucuguaguguau

SEQ ID NO: 535656 - RNA, 13 nt, Homo sapiens
cuucuguaugcau

SEQ ID NO: 535657 - RNA, 14 nt, Homo sapiens
cuucuguaugcauc

SEQ ID NO: 535658 - RNA, 17 nt, Homo sapiens
cuucugugcccagggug

SEQ ID NO: 535659 - RNA, 19 nt, Homo sapiens
cuucuuacaugcauuugag

SEQ ID NO: 535660 - RNA, 13 nt, Homo sapiens
cuucuuagcucau

SEQ ID NO: 535661 - RNA, 16 nt, Homo sapiens
cuucuuauuaaucaua

SEQ ID NO: 535662 - RNA, 14 nt, Homo sapiens
cuucuucagaagac

SEQ ID NO: 535663 - RNA, 17 nt, Homo sapiens
cuucuuccuauuguaau

SEQ ID NO: 535664 - RNA, 20 nt, Homo sapiens
cuucuucucuccacauggaa

SEQ ID NO: 535665 - RNA, 17 nt, Homo sapiens
cuucuugaacuuggaca

SEQ ID NO: 535666 - RNA, 13 nt, Homo sapiens
cuucuugcucccc

SEQ ID NO: 535667 - RNA, 15 nt, Homo sapiens
cuucuuggauuagcc

SEQ ID NO: 535668 - RNA, 18 nt, Homo sapiens
cuucuuguguccugauga

SEQ ID NO: 535669 - RNA, 19 nt, Homo sapiens
cuucuuguucugagauuca

SEQ ID NO: 535670 - RNA, 18 nt, Homo sapiens
cuucuuuagaugccaaac

SEQ ID NO: 535671 - RNA, 17 nt, Homo sapiens
cuucuuuauacuguaau

SEQ ID NO: 535672 - RNA, 14 nt, Homo sapiens
cuucuuuauugcac

SEQ ID NO: 535673 - RNA, 16 nt, Homo sapiens
cuucuuugcugcugcu

SEQ ID NO: 535674 - RNA, 14 nt, Homo sapiens
cuucuuuuacucau

SEQ ID NO: 535675 - RNA, 21 nt, Homo sapiens
cuucuuuuguggugucuucca

SEQ ID NO: 535676 - RNA, 16 nt, Homo sapiens
cuucuuuuugcuucaa

SEQ ID NO: 535677 - RNA, 21 nt, Homo sapiens
cuugaaacagauucaggccag

SEQ ID NO: 535678 - RNA, 22 nt, Homo sapiens
cuugaaacauagagaucuaugu

SEQ ID NO: 535679 - RNA, 14 nt, Homo sapiens
cuugaaacauuaua

SEQ ID NO: 535680 - RNA, 19 nt, Homo sapiens
uaaagaauuaacagagauu

SEQ ID NO: 535681 - RNA, 18 nt, Homo sapiens
uaaagaauucgguugaaa

SEQ ID NO: 535682 - RNA, 18 nt, Homo sapiens
uaaagacagagauaccau

SEQ ID NO: 535683 - RNA, 23 nt, Homo sapiens
uaaagacagggucucacucucau

SEQ ID NO: 535684 - RNA, 18 nt, Homo sapiens
uaaagacuuguauagcau

SEQ ID NO: 535685 - RNA, 20 nt, Homo sapiens
uaaagacuuuuaugugagau

SEQ ID NO: 535686 - RNA, 20 nt, Homo sapiens
uaaagagagaauguagauau

SEQ ID NO: 535687 - RNA, 14 nt, Homo sapiens
uaaagagcauggaa

SEQ ID NO: 535688 - RNA, 15 nt, Homo sapiens
uaaagauaaugcugc

SEQ ID NO: 535689 - RNA, 17 nt, Homo sapiens
uaaagaucaugacauau

SEQ ID NO: 535690 - RNA, 20 nt, Homo sapiens
uaaagauugcagcauuuaug

SEQ ID NO: 535691 - RNA, 16 nt, Homo sapiens
uaaagauuucuaguag

SEQ ID NO: 535692 - RNA, 15 nt, Homo sapiens
uaaagcaaacaugca

SEQ ID NO: 535693 - RNA, 18 nt, Homo sapiens
uaaagcaagggccauuua

SEQ ID NO: 535694 - RNA, 21 nt, Homo sapiens
uaaagcacccuguaucacaga

SEQ ID NO: 535695 - RNA, 24 nt, Homo sapiens
uaaagcaguagacaauccccacau

SEQ ID NO: 535696 - RNA, 18 nt, Homo sapiens
uaaagcauauuggugcua

SEQ ID NO: 535697 - RNA, 19 nt, Homo sapiens
uaaagcauauuggugcuag

SEQ ID NO: 535698 - RNA, 18 nt, Homo sapiens
uaaagcauuccccaaaga

SEQ ID NO: 535699 - RNA, 17 nt, Homo sapiens
uaaagccagccaugcau

SEQ ID NO: 535700 - RNA, 20 nt, Homo sapiens
uaaagcccaaccuccugacc

SEQ ID NO: 535701 - RNA, 15 nt, Homo sapiens
uaaagccucauuuga

SEQ ID NO: 535702 - RNA, 19 nt, Homo sapiens
uaaagccuuauuuuucaaa

SEQ ID NO: 535703 - RNA, 18 nt, Homo sapiens
uaaagccuuuaaaaccag

SEQ ID NO: 535704 - RNA, 22 nt, Homo sapiens
uaaagcuaccauuuuacauuuc

SEQ ID NO: 535705 - RNA, 14 nt, Homo sapiens
uaaagcuauuuccu

SEQ ID NO: 535706 - RNA, 13 nt, Homo sapiens
uaaagcucaaggu

SEQ ID NO: 535707 - RNA, 12 nt, Homo sapiens
uaaagcuuuauc

SEQ ID NO: 535708 - RNA, 19 nt, Homo sapiens
uaaagcuuucaacauguac

SEQ ID NO: 535709 - RNA, 17 nt, Homo sapiens
uaaaggagaaaaguggg

SEQ ID NO: 535710 - RNA, 22 nt, Homo sapiens
uaaaggagaaaagugggcugca

SEQ ID NO: 535711 - RNA, 21 nt, Homo sapiens
uaaaggaguaagaaccuugcc

SEQ ID NO: 535712 - RNA, 14 nt, Homo sapiens
uaaaggcagcugcc

SEQ ID NO: 535713 - RNA, 17 nt, Homo sapiens
uaaaggcagcugccucu

SEQ ID NO: 535714 - RNA, 18 nt, Homo sapiens
uaaaggcagcugccucug

SEQ ID NO: 535715 - RNA, 23 nt, Homo sapiens
uaaaggcuugauauuuuccaaau

SEQ ID NO: 535716 - RNA, 21 nt, Homo sapiens
uaaagggagaaggaagggcag

SEQ ID NO: 535717 - RNA, 18 nt, Homo sapiens
uaaagggcauuuuacuaa

SEQ ID NO: 535718 - RNA, 13 nt, Homo sapiens
uaaagguaugaaa

SEQ ID NO: 535719 - RNA, 23 nt, Homo sapiens
uaaagguuucauguucacuguga

SEQ ID NO: 535720 - RNA, 13 nt, Homo sapiens
uaaaguaacauca

SEQ ID NO: 535721 - RNA, 15 nt, Homo sapiens
uaaaguaauucauac

SEQ ID NO: 535722 - RNA, 13 nt, Homo sapiens
uaaaguacaagag

SEQ ID NO: 535723 - RNA, 15 nt, Homo sapiens
uaaaguacaucucua

SEQ ID NO: 535724 - RNA, 16 nt, Homo sapiens
uaaaguaccacacaua

SEQ ID NO: 535725 - RNA, 18 nt, Homo sapiens
uaaaguacuggagugaaa

SEQ ID NO: 535726 - RNA, 14 nt, Homo sapiens
uaaaguauguccuu

SEQ ID NO: 535727 - RNA, 22 nt, Homo sapiens
uaaaguauguccuucagcugac

SEQ ID NO: 535728 - RNA, 15 nt, Homo sapiens
uaaagucacagaauu

SEQ ID NO: 535729 - RNA, 16 nt, Homo sapiens
uaaagucacagaauua

SEQ ID NO: 535730 - RNA, 15 nt, Homo sapiens
uaaagucugagaaau

SEQ ID NO: 535731 - RNA, 19 nt, Homo sapiens
uaaagugcuugcuuuuugc

SEQ ID NO: 535732 - RNA, 16 nt, Homo sapiens
uaaaguguucugccag

SEQ ID NO: 535733 - RNA, 15 nt, Homo sapiens
uaaaguuaaguuugu

SEQ ID NO: 535734 - RNA, 15 nt, Homo sapiens
uaaaguuacuacuga

SEQ ID NO: 535735 - RNA, 14 nt, Homo sapiens
uaaaguuacuugaa

SEQ ID NO: 535736 - RNA, 16 nt, Homo sapiens
uaaaguuguaaauaau

SEQ ID NO: 535737 - RNA, 19 nt, Homo sapiens
uaaaguuugguauuguaaa

SEQ ID NO: 535738 - RNA, 17 nt, Homo sapiens
uaaaguuuguucacuua

SEQ ID NO: 535739 - RNA, 21 nt, Homo sapiens
uaaaguuuuaggguacaguuu

SEQ ID NO: 535740 - RNA, 21 nt, Homo sapiens
uaaauaaaacgugacagggaa

SEQ ID NO: 535741 - RNA, 16 nt, Homo sapiens
uaaauaaaagcacaag

SEQ ID NO: 535742 - RNA, 21 nt, Homo sapiens
uaaauaaaauucauuucuaca

SEQ ID NO: 535743 - RNA, 17 nt, Homo sapiens
uaaauaaacacauagau

SEQ ID NO: 535744 - RNA, 21 nt, Homo sapiens
uaaauaaacucaaugagcucu

SEQ ID NO: 535745 - RNA, 20 nt, Homo sapiens
uaaauaaaggagaaaagugg

SEQ ID NO: 535746 - RNA, 17 nt, Homo sapiens
uaaauaaagguacacau

SEQ ID NO: 535747 - RNA, 14 nt, Homo sapiens
uaaauaacaggcau

SEQ ID NO: 535748 - RNA, 17 nt, Homo sapiens
uaaauaaccauugcagg

SEQ ID NO: 535749 - RNA, 21 nt, Homo sapiens
uaaauaacccugggcugucca

SEQ ID NO: 535750 - RNA, 19 nt, Homo sapiens
uaaauaacuggaaaacaga

SEQ ID NO: 535751 - RNA, 12 nt, Homo sapiens
uaaauaagcaaa

SEQ ID NO: 535752 - RNA, 21 nt, Homo sapiens
uaaauaaugaauaaacugaau

SEQ ID NO: 535753 - RNA, 17 nt, Homo sapiens
uaaauaauuugcacuga

SEQ ID NO: 535754 - RNA, 21 nt, Homo sapiens
uaaauacaagauucucugaua

SEQ ID NO: 535755 - RNA, 17 nt, Homo sapiens
uaaauaccagacacgua

SEQ ID NO: 535756 - RNA, 19 nt, Homo sapiens
uaaauacuauuauuugcua

SEQ ID NO: 535757 - RNA, 23 nt, Homo sapiens
uaaauacugcaauuaaagugaua

SEQ ID NO: 535758 - RNA, 15 nt, Homo sapiens
uaaauagaccucuca

SEQ ID NO: 535759 - RNA, 21 nt, Homo sapiens
uaaauagaguauaugcacuuu

SEQ ID NO: 535760 - RNA, 14 nt, Homo sapiens
uaaauagaugacaa

SEQ ID NO: 535761 - RNA, 15 nt, Homo sapiens
uaaauaggagcuuaa

SEQ ID NO: 535762 - RNA, 14 nt, Homo sapiens
uaaauagugugaug

SEQ ID NO: 535763 - RNA, 12 nt, Homo sapiens
uaaauauaauua

SEQ ID NO: 535764 - RNA, 16 nt, Homo sapiens
uaaauauagagaugug

SEQ ID NO: 535765 - RNA, 18 nt, Homo sapiens
uaaauauauaugucaaua

SEQ ID NO: 535766 - RNA, 18 nt, Homo sapiens
uaaauauauauucaccua

SEQ ID NO: 535767 - RNA, 18 nt, Homo sapiens
uaaauauaucuaccccag

SEQ ID NO: 535768 - RNA, 20 nt, Homo sapiens
uaaauauauuguacucuuua

SEQ ID NO: 535769 - RNA, 17 nt, Homo sapiens
uaaauaugauuacuuua

SEQ ID NO: 535770 - RNA, 17 nt, Homo sapiens
uaaauauguacacaagu

SEQ ID NO: 535771 - RNA, 17 nt, Homo sapiens
uaaauauuagaagccug

SEQ ID NO: 535772 - RNA, 14 nt, Homo sapiens
uaaauauuuccaua

SEQ ID NO: 535773 - RNA, 17 nt, Homo sapiens
uaaauauuuuucaucaa

SEQ ID NO: 535774 - RNA, 15 nt, Homo sapiens
uaaaucaaauuugaa

SEQ ID NO: 535775 - RNA, 13 nt, Homo sapiens
uaaaucaagagcu

SEQ ID NO: 535776 - RNA, 19 nt, Homo sapiens
uaaaucaaugucacuuaaa

SEQ ID NO: 535777 - RNA, 18 nt, Homo sapiens
uaaaucagaaaguuuaga

SEQ ID NO: 535778 - RNA, 20 nt, Homo sapiens
uaaaucauggguccagccua

SEQ ID NO: 535779 - RNA, 23 nt, Homo sapiens
uaaaucauguugaucauguacuu

SEQ ID NO: 535780 - RNA, 23 nt, Homo sapiens
uaaaucauuaagacaacugaguu

SEQ ID NO: 535781 - RNA, 22 nt, Homo sapiens
uaaauccauauacuuuaaugca

SEQ ID NO: 535782 - RNA, 21 nt, Homo sapiens
uaaaucccaagaaauggaauc

SEQ ID NO: 535783 - RNA, 13 nt, Homo sapiens
uaaauccccucac

SEQ ID NO: 535784 - RNA, 15 nt, Homo sapiens
uaaauccgacuugaa

SEQ ID NO: 535785 - RNA, 21 nt, Homo sapiens
uaaauccucagguaguacugg

SEQ ID NO: 535786 - RNA, 20 nt, Homo sapiens
uaaauccucauguuacucag

SEQ ID NO: 535787 - RNA, 20 nt, Homo sapiens
uaaaucuaggaugugaugau

SEQ ID NO: 535788 - RNA, 14 nt, Homo sapiens
uaaaucucuuuaag

SEQ ID NO: 535789 - RNA, 13 nt, Homo sapiens
uaaaucugccaca

SEQ ID NO: 535790 - RNA, 20 nt, Homo sapiens
uaaaucuguuauuuugcuau

SEQ ID NO: 535791 - RNA, 16 nt, Homo sapiens
uaaaucuuuucaauua

SEQ ID NO: 535792 - RNA, 21 nt, Homo sapiens
uaaaucuuuuugcuucuacuu

SEQ ID NO: 535793 - RNA, 17 nt, Homo sapiens
uaaaugaaacuuggcca

SEQ ID NO: 535794 - RNA, 15 nt, Homo sapiens
uaaaugaagcagcuu

SEQ ID NO: 535795 - RNA, 11 nt, Homo sapiens
uaaaugaaggc

SEQ ID NO: 535796 - RNA, 20 nt, Homo sapiens
uaaaugagcugccagaauca

SEQ ID NO: 535797 - RNA, 19 nt, Homo sapiens
uaaaugaggggccucaggu

SEQ ID NO: 535798 - RNA, 20 nt, Homo sapiens
uaaaugauagacaauugagg

SEQ ID NO: 535799 - RNA, 18 nt, Homo sapiens
uaaaugccauguuuauca

SEQ ID NO: 535800 - RNA, 15 nt, Homo sapiens
uaaauggaccauccu

SEQ ID NO: 535801 - RNA, 21 nt, Homo sapiens
uaaauggcaucagcacuuuaa

SEQ ID NO: 535802 - RNA, 17 nt, Homo sapiens
cuugaaagcaguuaaac

SEQ ID NO: 535803 - RNA, 18 nt, Homo sapiens
cuugaaaguuuuccagua

SEQ ID NO: 535804 - RNA, 22 nt, Homo sapiens
cuugaaaugaguaaaaacuaga

SEQ ID NO: 535805 - RNA, 20 nt, Homo sapiens
cuugaaauuaagaaggcaaa

SEQ ID NO: 535806 - RNA, 16 nt, Homo sapiens
cuugaaauuacugugu

SEQ ID NO: 535807 - RNA, 13 nt, Homo sapiens
cuugaaccccuua

SEQ ID NO: 535808 - RNA, 18 nt, Homo sapiens
cuugaacuccuggccuca

SEQ ID NO: 535809 - RNA, 13 nt, Homo sapiens
cuugaacugauuc

SEQ ID NO: 535810 - RNA, 22 nt, Homo sapiens
cuugaacugauucacaucucau

SEQ ID NO: 535811 - RNA, 16 nt, Homo sapiens
cuugaacugggcucaa

SEQ ID NO: 535812 - RNA, 18 nt, Homo sapiens
cuugaagaauaaauucua

SEQ ID NO: 535813 - RNA, 15 nt, Homo sapiens
cuugaagacagagca

SEQ ID NO: 535814 - RNA, 20 nt, Homo sapiens
cuugaagauaucuugaaaug

SEQ ID NO: 535815 - RNA, 13 nt, Homo sapiens
cuugaagcaauaa

SEQ ID NO: 535816 - RNA, 13 nt, Homo sapiens
cuugaagcacaga

SEQ ID NO: 535817 - RNA, 15 nt, Homo sapiens
cuugaagccaaagaa

SEQ ID NO: 535818 - RNA, 23 nt, Homo sapiens
cuugaaggauggaugagucagac

SEQ ID NO: 535819 - RNA, 15 nt, Homo sapiens
cuugaauacaaguuu

SEQ ID NO: 535820 - RNA, 23 nt, Homo sapiens
cuugaauacucugcccucuagag

SEQ ID NO: 535821 - RNA, 20 nt, Homo sapiens
cuugaauagauuuucucugg

SEQ ID NO: 535822 - RNA, 16 nt, Homo sapiens
cuugaauagucucauc

SEQ ID NO: 535823 - RNA, 15 nt, Homo sapiens
cuugaauauggaaca

SEQ ID NO: 535824 - RNA, 15 nt, Homo sapiens
cuugaaugcagggac

SEQ ID NO: 535825 - RNA, 13 nt, Homo sapiens
cuugaaugugguc

SEQ ID NO: 535826 - RNA, 14 nt, Homo sapiens
cuugaauuucuaga

SEQ ID NO: 535827 - RNA, 21 nt, Homo sapiens
cuugacaacaucccacagugg

SEQ ID NO: 535828 - RNA, 16 nt, Homo sapiens
cuugacauuuaucacc

SEQ ID NO: 535829 - RNA, 16 nt, Homo sapiens
cuugaccguacucuca

SEQ ID NO: 535830 - RNA, 17 nt, Homo sapiens
cuugaccguacucucac

SEQ ID NO: 535831 - RNA, 20 nt, Homo sapiens
cuugaccucaggugauccac

SEQ ID NO: 535832 - RNA, 16 nt, Homo sapiens
cuugacucaggauuua

SEQ ID NO: 535833 - RNA, 14 nt, Homo sapiens
cuugacucauggca

SEQ ID NO: 535834 - RNA, 13 nt, Homo sapiens
cuugacuggggau

SEQ ID NO: 535835 - RNA, 16 nt, Homo sapiens
cuugacuuagaccuau

SEQ ID NO: 535836 - RNA, 18 nt, Homo sapiens
cuugacuuccugccaugg

SEQ ID NO: 535837 - RNA, 21 nt, Homo sapiens
cuugagaaaccuuauuguacc

SEQ ID NO: 535838 - RNA, 14 nt, Homo sapiens
cuugagaccuggaa

SEQ ID NO: 535839 - RNA, 21 nt, Homo sapiens
cuugagagaaaaagugccccu

SEQ ID NO: 535840 - RNA, 22 nt, Homo sapiens
cuugagaggguggaauauccaa

SEQ ID NO: 535841 - RNA, 17 nt, Homo sapiens
cuugagauauaaaggaa

SEQ ID NO: 535842 - RNA, 21 nt, Homo sapiens
cuugagcaagaugauguaaug

SEQ ID NO: 535843 - RNA, 19 nt, Homo sapiens
cuugagccacagucacugg

SEQ ID NO: 535844 - RNA, 13 nt, Homo sapiens
cuugagccaguaa

SEQ ID NO: 535845 - RNA, 16 nt, Homo sapiens
cuugagccuccaugcc

SEQ ID NO: 535846 - RNA, 15 nt, Homo sapiens
cuugagcgugaaucu

SEQ ID NO: 535847 - RNA, 23 nt, Homo sapiens
cuugaggaccugcgaaauccaga

SEQ ID NO: 535848 - RNA, 16 nt, Homo sapiens
cuugaggccugugcuc

SEQ ID NO: 535849 - RNA, 16 nt, Homo sapiens
cuugagggacaaugcc

SEQ ID NO: 535850 - RNA, 23 nt, Homo sapiens
cuugagucagaaaacagagaaag

SEQ ID NO: 535851 - RNA, 22 nt, Homo sapiens
cuugagugagaagagcuugcac

SEQ ID NO: 535852 - RNA, 19 nt, Homo sapiens
cuugaguugccugaugcuc

SEQ ID NO: 535853 - RNA, 14 nt, Homo sapiens
cuugaguuggagua

SEQ ID NO: 535854 - RNA, 13 nt, Homo sapiens
cuugaucagugac

SEQ ID NO: 535855 - RNA, 16 nt, Homo sapiens
cuugauccacuucucu

SEQ ID NO: 535856 - RNA, 21 nt, Homo sapiens
cuugauccacuucucucagga

SEQ ID NO: 535857 - RNA, 20 nt, Homo sapiens
cuugaucuuaacaaagccuu

SEQ ID NO: 535858 - RNA, 19 nt, Homo sapiens
cuugaucuuugagcccauu

SEQ ID NO: 535859 - RNA, 18 nt, Homo sapiens
cuugauggagauauuuac

SEQ ID NO: 535860 - RNA, 13 nt, Homo sapiens
cuugauuaagggc

SEQ ID NO: 535861 - RNA, 16 nt, Homo sapiens
cuugauuagaccuaau

SEQ ID NO: 535862 - RNA, 19 nt, Homo sapiens
uagauucagguaauacaaa

SEQ ID NO: 535863 - RNA, 16 nt, Homo sapiens
uagauuccucuugccu

SEQ ID NO: 535864 - RNA, 21 nt, Homo sapiens
uagauugcaccauugcacucu

SEQ ID NO: 535865 - RNA, 23 nt, Homo sapiens
uagauugcagaaaauucugugcc

SEQ ID NO: 535866 - RNA, 16 nt, Homo sapiens
uagauuguuuugccac

SEQ ID NO: 535867 - RNA, 19 nt, Homo sapiens
uagauuuauuuuacauuua

SEQ ID NO: 535868 - RNA, 13 nt, Homo sapiens
uagauuucuaaag

SEQ ID NO: 535869 - RNA, 17 nt, Homo sapiens
uagauuucuacacugag

SEQ ID NO: 535870 - RNA, 17 nt, Homo sapiens
uagauuucuucucuuua

SEQ ID NO: 535871 - RNA, 23 nt, Homo sapiens
uagauuuuagacccuauugcugc

SEQ ID NO: 535872 - RNA, 17 nt, Homo sapiens
uagauuuugcugagaug

SEQ ID NO: 535873 - RNA, 18 nt, Homo sapiens
uagauuuuguugaccuca

SEQ ID NO: 535874 - RNA, 13 nt, Homo sapiens
uagcaaaagaaga

SEQ ID NO: 535875 - RNA, 13 nt, Homo sapiens
uagcaaaauuccu

SEQ ID NO: 535876 - RNA, 19 nt, Homo sapiens
uagcaaagaagcuucaugc

SEQ ID NO: 535877 - RNA, 23 nt, Homo sapiens
uagcaaagauuaaaugugucauu

SEQ ID NO: 535878 - RNA, 20 nt, Homo sapiens
uagcaaauggcagaaccaaa

SEQ ID NO: 535879 - RNA, 13 nt, Homo sapiens
uagcaacauuauu

SEQ ID NO: 535880 - RNA, 18 nt, Homo sapiens
uagcaaccuccacauguu

SEQ ID NO: 535881 - RNA, 21 nt, Homo sapiens
uagcaaccuccacauguucaa

SEQ ID NO: 535882 - RNA, 23 nt, Homo sapiens
uagcaacugcuggggagacaaau

SEQ ID NO: 535883 - RNA, 14 nt, Homo sapiens
uagcaaugugccuu

SEQ ID NO: 535884 - RNA, 16 nt, Homo sapiens
uagcaauuagugauau

SEQ ID NO: 535885 - RNA, 19 nt, Homo sapiens
uagcacacaauaagcauuc

SEQ ID NO: 535886 - RNA, 17 nt, Homo sapiens
uagcaccaggacucaga

SEQ ID NO: 535887 - RNA, 14 nt, Homo sapiens
uagcaccccuacuc

SEQ ID NO: 535888 - RNA, 21 nt, Homo sapiens
uagcacccugcccucauggga

SEQ ID NO: 535889 - RNA, 23 nt, Homo sapiens
uagcaccgcuuauccccucagaa

SEQ ID NO: 535890 - RNA, 22 nt, Homo sapiens
uagcaccucccccuaaccaaau

SEQ ID NO: 535891 - RNA, 17 nt, Homo sapiens
uagcacuauuuacauac

SEQ ID NO: 535892 - RNA, 17 nt, Homo sapiens
uagcagaaaaauguguu

SEQ ID NO: 535893 - RNA, 15 nt, Homo sapiens
uagcagacccagcuu

SEQ ID NO: 535894 - RNA, 19 nt, Homo sapiens
uagcagagaacugccuuaa

SEQ ID NO: 535895 - RNA, 14 nt, Homo sapiens
uagcagauggagua

SEQ ID NO: 535896 - RNA, 16 nt, Homo sapiens
uagcagaugguuucca

SEQ ID NO: 535897 - RNA, 14 nt, Homo sapiens
uagcagcagaugua

SEQ ID NO: 535898 - RNA, 21 nt, Homo sapiens
uagcagcagauguaguuucag

SEQ ID NO: 535899 - RNA, 15 nt, Homo sapiens
uagcagucaaaucua

SEQ ID NO: 535900 - RNA, 21 nt, Homo sapiens
uagcaguggcuggugcccaug

SEQ ID NO: 535901 - RNA, 13 nt, Homo sapiens
uagcauaauacag

SEQ ID NO: 535902 - RNA, 21 nt, Homo sapiens
uagcauaauaugaagccuuug

SEQ ID NO: 535903 - RNA, 15 nt, Homo sapiens
uagcauacuguguau

SEQ ID NO: 535904 - RNA, 17 nt, Homo sapiens
uagcauauagauugucc

SEQ ID NO: 535905 - RNA, 22 nt, Homo sapiens
uagcaugaaauaaaauauaucu

SEQ ID NO: 535906 - RNA, 15 nt, Homo sapiens
uagcauguaugaaug

SEQ ID NO: 535907 - RNA, 20 nt, Homo sapiens
uagcauguuccuccuuuucu

SEQ ID NO: 535908 - RNA, 12 nt, Homo sapiens
uagcauugcacu

SEQ ID NO: 535909 - RNA, 17 nt, Homo sapiens
uagcauuugccacuuag

SEQ ID NO: 535910 - RNA, 21 nt, Homo sapiens
uagcauuuucuugaaccaaua

SEQ ID NO: 535911 - RNA, 18 nt, Homo sapiens
uagccaaacccuugucag

SEQ ID NO: 535912 - RNA, 15 nt, Homo sapiens
uagccaaugucuccu

SEQ ID NO: 535913 - RNA, 18 nt, Homo sapiens
uagccacccaacuuuguc

SEQ ID NO: 535914 - RNA, 13 nt, Homo sapiens
uagccagacacuc

SEQ ID NO: 535915 - RNA, 20 nt, Homo sapiens
uagccagcacacagggcagu

SEQ ID NO: 535916 - RNA, 17 nt, Homo sapiens
uagccagcugugcacuu

SEQ ID NO: 535917 - RNA, 18 nt, Homo sapiens
uagccagcugugcacuuu

SEQ ID NO: 535918 - RNA, 19 nt, Homo sapiens
uagccaggaaguacuucca

SEQ ID NO: 535919 - RNA, 19 nt, Homo sapiens
uagccagugcuccaggcac

SEQ ID NO: 535920 - RNA, 22 nt, Homo sapiens
uagccauaaaagaaaaucuuua

SEQ ID NO: 535921 - RNA, 19 nt, Homo sapiens
uagccauaucagggguaca

SEQ ID NO: 535922 - RNA, 15 nt, Homo sapiens
uagccauaugcaaua

SEQ ID NO: 535923 - RNA, 14 nt, Homo sapiens
uagccaucuugauc

SEQ ID NO: 535924 - RNA, 20 nt, Homo sapiens
uagccauugaaaugucaaau

SEQ ID NO: 535925 - RNA, 17 nt, Homo sapiens
uagccauuucacucuca

SEQ ID NO: 535926 - RNA, 21 nt, Homo sapiens
uagccauuuuucaaagcaauu

SEQ ID NO: 535927 - RNA, 19 nt, Homo sapiens
uagcccacucccugccuac

SEQ ID NO: 535928 - RNA, 17 nt, Homo sapiens
uagccccugaaagccau

SEQ ID NO: 535929 - RNA, 22 nt, Homo sapiens
uagcccuggguuuaaugucaaa

SEQ ID NO: 535930 - RNA, 14 nt, Homo sapiens
uagccgaccucagc

SEQ ID NO: 535931 - RNA, 20 nt, Homo sapiens
uagccuaaaugauggugcuu

SEQ ID NO: 535932 - RNA, 22 nt, Homo sapiens
uagccugccucuucucuacucu

SEQ ID NO: 535933 - RNA, 13 nt, Homo sapiens
uagccuggaccaa

SEQ ID NO: 535934 - RNA, 17 nt, Homo sapiens
uagccuggcuauguccu

SEQ ID NO: 535935 - RNA, 16 nt, Homo sapiens
uagccugugcuggacc

SEQ ID NO: 535936 - RNA, 21 nt, Homo sapiens
uagccugugcuggaccagcug

SEQ ID NO: 535937 - RNA, 21 nt, Homo sapiens
uagccuugggguuggacaucu

SEQ ID NO: 535938 - RNA, 19 nt, Homo sapiens
uagcgacugucaacagcgu

SEQ ID NO: 535939 - RNA, 13 nt, Homo sapiens
uagcgcagugucc

SEQ ID NO: 535940 - RNA, 17 nt, Homo sapiens
uagcgccgugcuguaaa

SEQ ID NO: 535941 - RNA, 14 nt, Homo sapiens
uagcggagcccagc

SEQ ID NO: 535942 - RNA, 20 nt, Homo sapiens
uagcgggacucagugagcug

SEQ ID NO: 535943 - RNA, 17 nt, Homo sapiens
uagcgugugccaggcag

SEQ ID NO: 535944 - RNA, 20 nt, Homo sapiens
uagcuaauaacaugugaaaa

SEQ ID NO: 535945 - RNA, 18 nt, Homo sapiens
uagcuacuguaugcaaag

SEQ ID NO: 535946 - RNA, 17 nt, Homo sapiens
uagcuagaagugggcca

SEQ ID NO: 535947 - RNA, 20 nt, Homo sapiens
gaauaucagaaguauaucug

SEQ ID NO: 535948 - RNA, 14 nt, Homo sapiens
gaauauccauguac

SEQ ID NO: 535949 - RNA, 18 nt, Homo sapiens
gaauaucuaagaaucuuu

SEQ ID NO: 535950 - RNA, 15 nt, Homo sapiens
gaauaucugguuucu

SEQ ID NO: 535951 - RNA, 19 nt, Homo sapiens
gaauaucuguaaugguacu

SEQ ID NO: 535952 - RNA, 14 nt, Homo sapiens
gaauaugggagaaa

SEQ ID NO: 535953 - RNA, 14 nt, Homo sapiens
gaauauuacucuca

SEQ ID NO: 535954 - RNA, 21 nt, Homo sapiens
gaauauuuauaaaugagcaaa

SEQ ID NO: 535955 - RNA, 21 nt, Homo sapiens
gaauauuuauuaccucugaua

SEQ ID NO: 535956 - RNA, 19 nt, Homo sapiens
gaaucaaaccugaccaagc

SEQ ID NO: 535957 - RNA, 22 nt, Homo sapiens
gaaucaaagcaguuaacuuuaa

SEQ ID NO: 535958 - RNA, 17 nt, Homo sapiens
gaaucaaaucucuucca

SEQ ID NO: 535959 - RNA, 12 nt, Homo sapiens
gaaucaagcaau

SEQ ID NO: 535960 - RNA, 18 nt, Homo sapiens
gaaucaaggaaagccagg

SEQ ID NO: 535961 - RNA, 20 nt, Homo sapiens
gaaucacaaaccaagccaug

SEQ ID NO: 535962 - RNA, 15 nt, Homo sapiens
gaaucacaguauugu

SEQ ID NO: 535963 - RNA, 13 nt, Homo sapiens
gaaucacuggaac

SEQ ID NO: 535964 - RNA, 12 nt, Homo sapiens
gaaucacuguuu

SEQ ID NO: 535965 - RNA, 13 nt, Homo sapiens
gaaucacuugaac

SEQ ID NO: 535966 - RNA, 16 nt, Homo sapiens
gaaucacuugcacucc

SEQ ID NO: 535967 - RNA, 13 nt, Homo sapiens
gaaucagacugac

SEQ ID NO: 535968 - RNA, 22 nt, Homo sapiens
gaaucagcaucucuucuucccu

SEQ ID NO: 535969 - RNA, 22 nt, Homo sapiens
gaaucagcauuuagucuugcca

SEQ ID NO: 535970 - RNA, 20 nt, Homo sapiens
gaaucaggaauauuuuccaa

SEQ ID NO: 535971 - RNA, 20 nt, Homo sapiens
gaaucagguuuccaaucaac

SEQ ID NO: 535972 - RNA, 18 nt, Homo sapiens
gaaucauauucauaugca

SEQ ID NO: 535973 - RNA, 14 nt, Homo sapiens
gaaucauggagaaa

SEQ ID NO: 535974 - RNA, 22 nt, Homo sapiens
gaaucauuuuagcuggugucag

SEQ ID NO: 535975 - RNA, 12 nt, Homo sapiens
gaauccaagcuc

SEQ ID NO: 535976 - RNA, 22 nt, Homo sapiens
gaauccaguccagauauuucac

SEQ ID NO: 535977 - RNA, 23 nt, Homo sapiens
gaauccaguccagauauuucaca

SEQ ID NO: 535978 - RNA, 20 nt, Homo sapiens
gaauccuuggggagcacuug

SEQ ID NO: 535979 - RNA, 17 nt, Homo sapiens
gaaucgcuuaaaccugg

SEQ ID NO: 535980 - RNA, 19 nt, Homo sapiens
gaaucgcuugaaccuggga

SEQ ID NO: 535981 - RNA, 23 nt, Homo sapiens
gaaucgguuguucuuuccucaca

SEQ ID NO: 535982 - RNA, 14 nt, Homo sapiens
gaaucuaaaccuua

SEQ ID NO: 535983 - RNA, 19 nt, Homo sapiens
gacaacaccuuccuccugc

SEQ ID NO: 535984 - RNA, 14 nt, Homo sapiens
gacaacacugggaa

SEQ ID NO: 535985 - RNA, 18 nt, Homo sapiens
gacaacagaaaaacaauc

SEQ ID NO: 535986 - RNA, 16 nt, Homo sapiens
gacaacagcauaacua

SEQ ID NO: 535987 - RNA, 22 nt, Homo sapiens
gacaacagccucuacaccaacg

SEQ ID NO: 535988 - RNA, 18 nt, Homo sapiens
gacaacauuucuauagcc

SEQ ID NO: 535989 - RNA, 12 nt, Homo sapiens
gacaaccaaaac

SEQ ID NO: 535990 - RNA, 23 nt, Homo sapiens
gacaaccugaaauuuauucacau

SEQ ID NO: 535991 - RNA, 22 nt, Homo sapiens
gacaacgggcccauggccuugg

SEQ ID NO: 535992 - RNA, 13 nt, Homo sapiens
gacaacugugacu

SEQ ID NO: 535993 - RNA, 16 nt, Homo sapiens
gacaagaagacuguca

SEQ ID NO: 535994 - RNA, 16 nt, Homo sapiens
gacaagacacugagga

SEQ ID NO: 535995 - RNA, 19 nt, Homo sapiens
gacaagacccccagcacuu

SEQ ID NO: 535996 - RNA, 20 nt, Homo sapiens
gacaagacccccagcacuug

SEQ ID NO: 535997 - RNA, 18 nt, Homo sapiens
gacaagagugagacucca

SEQ ID NO: 535998 - RNA, 13 nt, Homo sapiens
gacaaggcccuga

SEQ ID NO: 535999 - RNA, 18 nt, Homo sapiens
gacaaggccuugcucacu

SEQ ID NO: 536000 - RNA, 12 nt, Homo sapiens
gacaagggauuu

SEQ ID NO: 536001 - RNA, 21 nt, Homo sapiens
gacaagugacuguaucugugu

SEQ ID NO: 536002 - RNA, 18 nt, Homo sapiens
gacaaguggacucagggc

SEQ ID NO: 536003 - RNA, 18 nt, Homo sapiens
gacaauacaguaagcaua

SEQ ID NO: 536004 - RNA, 21 nt, Homo sapiens
gacaauaugugccaaucaaua

SEQ ID NO: 536005 - RNA, 20 nt, Homo sapiens
gacaaucaugaaauaugcau

SEQ ID NO: 536006 - RNA, 13 nt, Homo sapiens
gacaaucauuuga

SEQ ID NO: 536007 - RNA, 23 nt, Homo sapiens
gacaaugaaaguuugcacuguau

SEQ ID NO: 536008 - RNA, 14 nt, Homo sapiens
gacaaugauaugca

SEQ ID NO: 536009 - RNA, 22 nt, Homo sapiens
gacaaugauaugcaagugcaaa

SEQ ID NO: 536010 - RNA, 22 nt, Homo sapiens
gacaaugcaccuagcugugcaa

SEQ ID NO: 536011 - RNA, 22 nt, Homo sapiens
gacaauggcccaggucucucaa

SEQ ID NO: 536012 - RNA, 20 nt, Homo sapiens
gacaaugugaaaccaucaca

SEQ ID NO: 536013 - RNA, 16 nt, Homo sapiens
gacacacaaaucccau

SEQ ID NO: 536014 - RNA, 23 nt, Homo sapiens
gacacacggggcucgggccuuua

SEQ ID NO: 536015 - RNA, 16 nt, Homo sapiens
gacacacuaaacucug

SEQ ID NO: 536016 - RNA, 24 nt, Homo sapiens
gacacacuguuacacgugccugua

SEQ ID NO: 536017 - RNA, 15 nt, Homo sapiens
gacacagacuggcaa

SEQ ID NO: 536018 - RNA, 16 nt, Homo sapiens
gacacagacuggcaau

SEQ ID NO: 536019 - RNA, 17 nt, Homo sapiens
gacacaggcagcuucca

SEQ ID NO: 536020 - RNA, 18 nt, Homo sapiens
gacacaugccagggccau

SEQ ID NO: 536021 - RNA, 19 nt, Homo sapiens
gacacauuggaaugccuug

SEQ ID NO: 536022 - RNA, 11 nt, Homo sapiens
gacaccaaauu

SEQ ID NO: 536023 - RNA, 19 nt, Homo sapiens
gacaccaauaaauguuugu

SEQ ID NO: 536024 - RNA, 15 nt, Homo sapiens
gacaccagccuagcc

SEQ ID NO: 536025 - RNA, 18 nt, Homo sapiens
gacacccaugccagagag

SEQ ID NO: 536026 - RNA, 20 nt, Homo sapiens
gacacccccagcugacuguu

SEQ ID NO: 536027 - RNA, 15 nt, Homo sapiens
gacacccugaucuuc

SEQ ID NO: 536028 - RNA, 18 nt, Homo sapiens
gacaccgucgaccaggaa

SEQ ID NO: 536029 - RNA, 20 nt, Homo sapiens
gacaccucaagguguucucu

SEQ ID NO: 536030 - RNA, 10 nt, Homo sapiens
gacaccucac

SEQ ID NO: 536031 - RNA, 21 nt, Homo sapiens
gacacuauuuaucugugcaaa

SEQ ID NO: 536032 - RNA, 19 nt, Homo sapiens
gacacucacagcaaggaug

SEQ ID NO: 536033 - RNA, 17 nt, Homo sapiens
gacacuccccacgggaa

SEQ ID NO: 536034 - RNA, 16 nt, Homo sapiens
gacacugaaaaaucua

SEQ ID NO: 536035 - RNA, 15 nt, Homo sapiens
gacacugagucagaa

SEQ ID NO: 536036 - RNA, 19 nt, Homo sapiens
gacacuguccaugaagcac

SEQ ID NO: 536037 - RNA, 16 nt, Homo sapiens
gacacuguugcaaagg

SEQ ID NO: 536038 - RNA, 20 nt, Homo sapiens
gacacuuaauacuaccuuga

SEQ ID NO: 536039 - RNA, 20 nt, Homo sapiens
gacacuugccuucuucaccc

SEQ ID NO: 536040 - RNA, 17 nt, Homo sapiens
gacagaaaccaagccau

SEQ ID NO: 536041 - RNA, 23 nt, Homo sapiens
gacagaaaccaagccauuaauga

SEQ ID NO: 536042 - RNA, 14 nt, Homo sapiens
gacagaaagagaca

SEQ ID NO: 536043 - RNA, 16 nt, Homo sapiens
gacagaaagaucuuca

SEQ ID NO: 536044 - RNA, 14 nt, Homo sapiens
gacagaacuaagau

SEQ ID NO: 536045 - RNA, 19 nt, Homo sapiens
gacagaauguaucugugaa

SEQ ID NO: 536046 - RNA, 13 nt, Homo sapiens
gacagaauguguu

SEQ ID NO: 536047 - RNA, 19 nt, Homo sapiens
gacagacgaagaguuuaaa

SEQ ID NO: 536048 - RNA, 17 nt, Homo sapiens
gacagagaauaacucag

SEQ ID NO: 536049 - RNA, 17 nt, Homo sapiens
gacagagagaggcauuu

SEQ ID NO: 536050 - RNA, 15 nt, Homo sapiens
gacagagcaagugag

SEQ ID NO: 536051 - RNA, 20 nt, Homo sapiens
gacagaggcccugccacguc

SEQ ID NO: 536052 - RNA, 13 nt, Homo sapiens
gacagagugagug

SEQ ID NO: 536053 - RNA, 17 nt, Homo sapiens
gacagaugaaugccgug

SEQ ID NO: 536054 - RNA, 20 nt, Homo sapiens
gacagauuuggaugcacuca

SEQ ID NO: 536055 - RNA, 19 nt, Homo sapiens
gacagcaggccacuaguga

SEQ ID NO: 536056 - RNA, 12 nt, Homo sapiens
gacagcaugugc

SEQ ID NO: 536057 - RNA, 13 nt, Homo sapiens
gacagccuggcac

SEQ ID NO: 536058 - RNA, 19 nt, Homo sapiens
gacagccuuguuccucagc

SEQ ID NO: 536059 - RNA, 20 nt, Homo sapiens
gacagcuucaugaaacuguc

SEQ ID NO: 536060 - RNA, 22 nt, Homo sapiens
gacagcuuguggcaagugaauu

SEQ ID NO: 536061 - RNA, 22 nt, Homo sapiens
gacagcuuuucccaagauguca

SEQ ID NO: 536062 - RNA, 17 nt, Homo sapiens
gacaggaaagggcaaag

SEQ ID NO: 536063 - RNA, 20 nt, Homo sapiens
gacaggaacccuugcaucca

SEQ ID NO: 536064 - RNA, 15 nt, Homo sapiens
gacaggaauuuagaa

SEQ ID NO: 536065 - RNA, 22 nt, Homo sapiens
gacaggacccugggaccacaga

SEQ ID NO: 536066 - RNA, 19 nt, Homo sapiens
gacaggaggaaucauguca

SEQ ID NO: 536067 - RNA, 13 nt, Homo sapiens
gacaggcacucca

SEQ ID NO: 536068 - RNA, 15 nt, Homo sapiens
gacaggcaggccaga

SEQ ID NO: 536069 - RNA, 17 nt, Homo sapiens
gacaggcgcaacuccuc

SEQ ID NO: 536070 - RNA, 15 nt, Homo sapiens
gacaggcuggugcua

SEQ ID NO: 536071 - RNA, 15 nt, Homo sapiens
gacagggacaugccc

SEQ ID NO: 536072 - RNA, 16 nt, Homo sapiens
gacagggucaaagugu

SEQ ID NO: 536073 - RNA, 22 nt, Homo sapiens
gacaggguuucuccauguuggu

SEQ ID NO: 536074 - RNA, 19 nt, Homo sapiens
gacagguaaugaagcuauu

SEQ ID NO: 536075 - RNA, 17 nt, Homo sapiens
gacaggugaggucuguu

SEQ ID NO: 536076 - RNA, 18 nt, Homo sapiens
gacaguagccaaguuaua

SEQ ID NO: 536077 - RNA, 15 nt, Homo sapiens
gacaguauccacaau

SEQ ID NO: 536078 - RNA, 17 nt, Homo sapiens
gacaguauuaaggguag

SEQ ID NO: 536079 - RNA, 15 nt, Homo sapiens
gacagucaaggugau

SEQ ID NO: 536080 - RNA, 15 nt, Homo sapiens
gacagucaggguuca

SEQ ID NO: 536081 - RNA, 17 nt, Homo sapiens
gacagucguucccagug

SEQ ID NO: 536082 - RNA, 12 nt, Homo sapiens
gacagucucacu

SEQ ID NO: 536083 - RNA, 16 nt, Homo sapiens
gacagucucacucugu

SEQ ID NO: 536084 - RNA, 19 nt, Homo sapiens
gacagucuggccacuguca

SEQ ID NO: 536085 - RNA, 19 nt, Homo sapiens
gacagugaagcagcacugu

SEQ ID NO: 536086 - RNA, 18 nt, Homo sapiens
gacagugauaggcccaag

SEQ ID NO: 536087 - RNA, 15 nt, Homo sapiens
gacagugcauuugcc

SEQ ID NO: 536088 - RNA, 17 nt, Homo sapiens
gacagugccucuuccag

SEQ ID NO: 536089 - RNA, 14 nt, Homo sapiens
gacagugccuggga

SEQ ID NO: 536090 - RNA, 13 nt, Homo sapiens
gacagugcugaga

SEQ ID NO: 536091 - RNA, 16 nt, Homo sapiens
gacaguggaugcugcu

SEQ ID NO: 536092 - RNA, 16 nt, Homo sapiens
gacagugggaaauauu

SEQ ID NO: 536093 - RNA, 16 nt, Homo sapiens
gacaguugcagaauug

SEQ ID NO: 536094 - RNA, 16 nt, Homo sapiens
gacaguugcagcccuu

SEQ ID NO: 536095 - RNA, 19 nt, Homo sapiens
gacaguuuacuuugccaac

SEQ ID NO: 536096 - RNA, 21 nt, Homo sapiens
gacaguuuguggcaucuugcc

SEQ ID NO: 536097 - RNA, 19 nt, Homo sapiens
gacaguuuuuauauagucu

SEQ ID NO: 536098 - RNA, 17 nt, Homo sapiens
gacauaaauagagcaac

SEQ ID NO: 536099 - RNA, 23 nt, Homo sapiens
gacauaaccaacauuaaaacuca

SEQ ID NO: 536100 - RNA, 19 nt, Homo sapiens
gacauaagcaaagacuaug

SEQ ID NO: 536101 - RNA, 21 nt, Homo sapiens
gacauaaugggguccuggcca

SEQ ID NO: 536102 - RNA, 12 nt, Homo sapiens
gacauacaugcu

SEQ ID NO: 536103 - RNA, 23 nt, Homo sapiens
gacauacauucccucuaauuuga

SEQ ID NO: 536104 - RNA, 19 nt, Homo sapiens
gacauacauuuaugcacau

SEQ ID NO: 536105 - RNA, 16 nt, Homo sapiens
gcaccaacaucuacaa

SEQ ID NO: 536106 - RNA, 14 nt, Homo sapiens
gcaccaacuaagaa

SEQ ID NO: 536107 - RNA, 13 nt, Homo sapiens
gcaccacugcacu

SEQ ID NO: 536108 - RNA, 20 nt, Homo sapiens
gcaccacugcacuccagccu

SEQ ID NO: 536109 - RNA, 14 nt, Homo sapiens
gcaccagugugaca

SEQ ID NO: 536110 - RNA, 21 nt, Homo sapiens
gcaccaucauuuaaugugaca

SEQ ID NO: 536111 - RNA, 18 nt, Homo sapiens
gcaccauggacaugugua

SEQ ID NO: 536112 - RNA, 24 nt, Homo sapiens
gcaccauggacauguguacauuga

SEQ ID NO: 536113 - RNA, 22 nt, Homo sapiens
gcacccaggacuuccauuugcu

SEQ ID NO: 536114 - RNA, 23 nt, Homo sapiens
gcaccccaauugggaaugcaaua

SEQ ID NO: 536115 - RNA, 18 nt, Homo sapiens
gcaccccacacuggagcc

SEQ ID NO: 536116 - RNA, 17 nt, Homo sapiens
gcacccccacccaccuc

SEQ ID NO: 536117 - RNA, 17 nt, Homo sapiens
gcacccuccacccuguc

SEQ ID NO: 536118 - RNA, 23 nt, Homo sapiens
gcacccuggggccuggaccugcc

SEQ ID NO: 536119 - RNA, 21 nt, Homo sapiens
gcaccgggcuggcugcuugca

SEQ ID NO: 536120 - RNA, 18 nt, Homo sapiens
gcaccgucucacugugug

SEQ ID NO: 536121 - RNA, 18 nt, Homo sapiens
gcaccguucugugcacaa

SEQ ID NO: 536122 - RNA, 14 nt, Homo sapiens
gcaccuaaagccua

SEQ ID NO: 536123 - RNA, 15 nt, Homo sapiens
gcaccuacaguguac

SEQ ID NO: 536124 - RNA, 18 nt, Homo sapiens
gcaccuaccaucagggac

SEQ ID NO: 536125 - RNA, 21 nt, Homo sapiens
gcaccucacaggccccaggaa

SEQ ID NO: 536126 - RNA, 19 nt, Homo sapiens
gcaccucaugcagagggug

SEQ ID NO: 536127 - RNA, 23 nt, Homo sapiens
gcaccuccgcgggcugacugggc

SEQ ID NO: 536128 - RNA, 17 nt, Homo sapiens
gcaccuccgcuugccag

SEQ ID NO: 536129 - RNA, 14 nt, Homo sapiens
gcaccucuguucau

SEQ ID NO: 536130 - RNA, 19 nt, Homo sapiens
gcaccugcaugugcuguca

SEQ ID NO: 536131 - RNA, 16 nt, Homo sapiens
gcaccugccucagcaa

SEQ ID NO: 536132 - RNA, 19 nt, Homo sapiens
gcaccugccucagcuaccu

SEQ ID NO: 536133 - RNA, 23 nt, Homo sapiens
gcaccugccugccgcugcaggaa

SEQ ID NO: 536134 - RNA, 11 nt, Homo sapiens
gcaccuggcau

SEQ ID NO: 536135 - RNA, 19 nt, Homo sapiens
gcaccugggccccacugga

SEQ ID NO: 536136 - RNA, 17 nt, Homo sapiens
gcaccuuaguugcauga

SEQ ID NO: 536137 - RNA, 18 nt, Homo sapiens
gcaccuuauauuucugug

SEQ ID NO: 536138 - RNA, 17 nt, Homo sapiens
gcaccuuugcacaggau

SEQ ID NO: 536139 - RNA, 15 nt, Homo sapiens
gcaccuuuugcacau

SEQ ID NO: 536140 - RNA, 13 nt, Homo sapiens
gcaccuuuuugca

SEQ ID NO: 536141 - RNA, 12 nt, Homo sapiens
gcacgcccuccu

SEQ ID NO: 536142 - RNA, 13 nt, Homo sapiens
gcacgcucgcugc

SEQ ID NO: 536143 - RNA, 15 nt, Homo sapiens
gcacggcccaagggg

SEQ ID NO: 536144 - RNA, 19 nt, Homo sapiens
gcacguggagauagugcca

SEQ ID NO: 536145 - RNA, 22 nt, Homo sapiens
gcacguggccucuugagcagug

SEQ ID NO: 536146 - RNA, 12 nt, Homo sapiens
gcacgugucuca

SEQ ID NO: 536147 - RNA, 16 nt, Homo sapiens
gcacuaaugcuuuaag

SEQ ID NO: 536148 - RNA, 21 nt, Homo sapiens
gcacuacauucauuuagcuaa

SEQ ID NO: 536149 - RNA, 20 nt, Homo sapiens
gcacuaccacgccaagcuaa

SEQ ID NO: 536150 - RNA, 15 nt, Homo sapiens
gcacuagaauauuua

SEQ ID NO: 536151 - RNA, 21 nt, Homo sapiens
gcacuaggaauucuuugcauu

SEQ ID NO: 536152 - RNA, 23 nt, Homo sapiens
gcacucacaccacuaacaugccc

SEQ ID NO: 536153 - RNA, 22 nt, Homo sapiens
gcacucccuaauuuaugugcua

SEQ ID NO: 536154 - RNA, 19 nt, Homo sapiens
gcacucccuuaggcauuau

SEQ ID NO: 536155 - RNA, 20 nt, Homo sapiens
gcacucuuuaacacauucuu

SEQ ID NO: 536156 - RNA, 18 nt, Homo sapiens
gcacugaacuuugcaaag

SEQ ID NO: 536157 - RNA, 15 nt, Homo sapiens
gcacugacugggcau

SEQ ID NO: 536158 - RNA, 14 nt, Homo sapiens
gcacugaucaccca

SEQ ID NO: 536159 - RNA, 18 nt, Homo sapiens
gcacugcccgaaaagcau

SEQ ID NO: 536160 - RNA, 22 nt, Homo sapiens
gcacuggaacccacagaccuca

SEQ ID NO: 536161 - RNA, 16 nt, Homo sapiens
gcacuggcucucucca

SEQ ID NO: 536162 - RNA, 22 nt, Homo sapiens
gcacuggggagcccgucucagu

SEQ ID NO: 536163 - RNA, 19 nt, Homo sapiens
gcacuggggccacccagcc

SEQ ID NO: 536164 - RNA, 15 nt, Homo sapiens
gcacuggugggccau

SEQ ID NO: 536165 - RNA, 17 nt, Homo sapiens
gcacuguauugcuccuc

SEQ ID NO: 536166 - RNA, 15 nt, Homo sapiens
gcacuguucacauca

SEQ ID NO: 536167 - RNA, 20 nt, Homo sapiens
gcacuuacagcucuggccac

SEQ ID NO: 536168 - RNA, 16 nt, Homo sapiens
gcacuuauacccauga

SEQ ID NO: 536169 - RNA, 15 nt, Homo sapiens
gcacuuauugaauau

SEQ ID NO: 536170 - RNA, 15 nt, Homo sapiens
gcacuucaaauucaa

SEQ ID NO: 536171 - RNA, 16 nt, Homo sapiens
gcacuugggcauuuau

SEQ ID NO: 536172 - RNA, 15 nt, Homo sapiens
gcacuuuaaaugaag

SEQ ID NO: 536173 - RNA, 17 nt, Homo sapiens
gcacuuuaaaugaagcu

SEQ ID NO: 536174 - RNA, 22 nt, Homo sapiens
gcacuuuauacacuucuggcuc

SEQ ID NO: 536175 - RNA, 17 nt, Homo sapiens
gcacuuugggaggccaa

SEQ ID NO: 536176 - RNA, 15 nt, Homo sapiens
gcagaaaaacucugg

SEQ ID NO: 536177 - RNA, 23 nt, Homo sapiens
gcagaaacaaaaugacuguagaa

SEQ ID NO: 536178 - RNA, 19 nt, Homo sapiens
gcagaaagguuaguaucau

SEQ ID NO: 536179 - RNA, 13 nt, Homo sapiens
gcagaaaugcaag

SEQ ID NO: 536180 - RNA, 22 nt, Homo sapiens
gcagaacagaucuuuuacuuug

SEQ ID NO: 536181 - RNA, 20 nt, Homo sapiens
gcagaacggguucaguuuua

SEQ ID NO: 536182 - RNA, 16 nt, Homo sapiens
gcagaacuaccaggug

SEQ ID NO: 536183 - RNA, 21 nt, Homo sapiens
gcagaagaauugaacccagga

SEQ ID NO: 536184 - RNA, 16 nt, Homo sapiens
gcagaagcacauauga

SEQ ID NO: 536185 - RNA, 12 nt, Homo sapiens
gcagaagcccug

SEQ ID NO: 536186 - RNA, 20 nt, Homo sapiens
gcagaaucuguuaccagagg

SEQ ID NO: 536187 - RNA, 20 nt, Homo sapiens
gcagaauguuguacuugaaa

SEQ ID NO: 536188 - RNA, 19 nt, Homo sapiens
gcagaauuguggaguguuu

SEQ ID NO: 536189 - RNA, 16 nt, Homo sapiens
gcagacaaugacccca

SEQ ID NO: 536190 - RNA, 16 nt, Homo sapiens
gcagacacagguguag

SEQ ID NO: 536191 - RNA, 15 nt, Homo sapiens
gcagacacaugccag

SEQ ID NO: 536192 - RNA, 18 nt, Homo sapiens
gcagacacauugucauca

SEQ ID NO: 536193 - RNA, 15 nt, Homo sapiens
gcagacaccagcagc

SEQ ID NO: 536194 - RNA, 15 nt, Homo sapiens
gcagacaccuggacu

SEQ ID NO: 536195 - RNA, 22 nt, Homo sapiens
gcagacaggaggaaucauguca

SEQ ID NO: 536196 - RNA, 13 nt, Homo sapiens
gcagacagucaca

SEQ ID NO: 536197 - RNA, 14 nt, Homo sapiens
gcagacaugccuug

SEQ ID NO: 536198 - RNA, 13 nt, Homo sapiens
gcagacauucuca

SEQ ID NO: 536199 - RNA, 13 nt, Homo sapiens
gcagaccaccagc

SEQ ID NO: 536200 - RNA, 14 nt, Homo sapiens
gcagaccacugaua

SEQ ID NO: 536201 - RNA, 16 nt, Homo sapiens
gcagacccagucccac

SEQ ID NO: 536202 - RNA, 20 nt, Homo sapiens
gcagacccauaccuuuccag

SEQ ID NO: 536203 - RNA, 16 nt, Homo sapiens
gcagaccucaagccau

SEQ ID NO: 536204 - RNA, 15 nt, Homo sapiens
gcagacucgggacca

SEQ ID NO: 536205 - RNA, 23 nt, Homo sapiens
gcagagaaaaaaaaaaacuuaaa

SEQ ID NO: 536206 - RNA, 22 nt, Homo sapiens
gcagagaaaauugugaaaguga

SEQ ID NO: 536207 - RNA, 19 nt, Homo sapiens
gcagagaaacuuaagcaaa

SEQ ID NO: 536208 - RNA, 21 nt, Homo sapiens
gcagagagggauggguuccug

SEQ ID NO: 536209 - RNA, 15 nt, Homo sapiens
gcagagaugacuguc

SEQ ID NO: 536210 - RNA, 16 nt, Homo sapiens
gcagagauguacugca

SEQ ID NO: 536211 - RNA, 12 nt, Homo sapiens
gcagagcacagc

SEQ ID NO: 536212 - RNA, 22 nt, Homo sapiens
uauguucaacuggagacacuau

SEQ ID NO: 536213 - RNA, 14 nt, Homo sapiens
uauguuccaagugc

SEQ ID NO: 536214 - RNA, 16 nt, Homo sapiens
uauguucccucuuguc

SEQ ID NO: 536215 - RNA, 18 nt, Homo sapiens
uauguugauacuagcaua

SEQ ID NO: 536216 - RNA, 20 nt, Homo sapiens
uauguugucauaacauuuaa

SEQ ID NO: 536217 - RNA, 15 nt, Homo sapiens
uauguuuacauauca

SEQ ID NO: 536218 - RNA, 18 nt, Homo sapiens
uauguuuccuaacuguga

SEQ ID NO: 536219 - RNA, 12 nt, Homo sapiens
uauguuugcaaa

SEQ ID NO: 536220 - RNA, 17 nt, Homo sapiens
uauguuuggaauaaagu

SEQ ID NO: 536221 - RNA, 19 nt, Homo sapiens
uauguuuggaauaaaguca

SEQ ID NO: 536222 - RNA, 18 nt, Homo sapiens
uauuaaaaauguucucaa

SEQ ID NO: 536223 - RNA, 20 nt, Homo sapiens
uauuaaaauaaauguuguuu

SEQ ID NO: 536224 - RNA, 19 nt, Homo sapiens
uauuaaauguugcuuuaac

SEQ ID NO: 536225 - RNA, 15 nt, Homo sapiens
uauuaacccuaccug

SEQ ID NO: 536226 - RNA, 22 nt, Homo sapiens
uauuaacuuuuaauggugaugg

SEQ ID NO: 536227 - RNA, 18 nt, Homo sapiens
ucaaaauauacauucaaa

SEQ ID NO: 536228 - RNA, 15 nt, Homo sapiens
ucaaaaucuuuccaa

SEQ ID NO: 536229 - RNA, 20 nt, Homo sapiens
ucaaacaaauagucuaucaa

SEQ ID NO: 536230 - RNA, 15 nt, Homo sapiens
ucaaaccacuugccu

SEQ ID NO: 536231 - RNA, 17 nt, Homo sapiens
ucaaaccaggugcaauu

SEQ ID NO: 536232 - RNA, 16 nt, Homo sapiens
ucaaacccagucuugu

SEQ ID NO: 536233 - RNA, 22 nt, Homo sapiens
ucaaaccccuacugaccuggcu

SEQ ID NO: 536234 - RNA, 17 nt, Homo sapiens
ucaaaccugaccacaga

SEQ ID NO: 536235 - RNA, 16 nt, Homo sapiens
ucaaacgacagaggag

SEQ ID NO: 536236 - RNA, 19 nt, Homo sapiens
ucaaacucccgaccucagg

SEQ ID NO: 536237 - RNA, 16 nt, Homo sapiens
ucaaacugcacaucua

SEQ ID NO: 536238 - RNA, 17 nt, Homo sapiens
ucaaacugcaugauuca

SEQ ID NO: 536239 - RNA, 14 nt, Homo sapiens
ucaaagaacaaaca

SEQ ID NO: 536240 - RNA, 14 nt, Homo sapiens
ucaaagaagacuca

SEQ ID NO: 536241 - RNA, 23 nt, Homo sapiens
ucaaagaaguacuuuauugcaac

SEQ ID NO: 536242 - RNA, 18 nt, Homo sapiens
ucaaagagaaaacaucuc

SEQ ID NO: 536243 - RNA, 15 nt, Homo sapiens
ucaaagaggugaaca

SEQ ID NO: 536244 - RNA, 20 nt, Homo sapiens
ucaaagauauuuugcuuugu

SEQ ID NO: 536245 - RNA, 18 nt, Homo sapiens
ucaaagcacuuggacucu

SEQ ID NO: 536246 - RNA, 22 nt, Homo sapiens
ucaaagcaggaauugguggcag

SEQ ID NO: 536247 - RNA, 21 nt, Homo sapiens
ucaaagcccugccucugugua

SEQ ID NO: 536248 - RNA, 14 nt, Homo sapiens
ucaaagcuaaaggg

SEQ ID NO: 536249 - RNA, 21 nt, Homo sapiens
ucaaaggacaaagacaguauu

SEQ ID NO: 536250 - RNA, 20 nt, Homo sapiens
ucaaaggugauugugccagg

SEQ ID NO: 536251 - RNA, 21 nt, Homo sapiens
ucaaagugguaaauacuguga

SEQ ID NO: 536252 - RNA, 17 nt, Homo sapiens
ucaaagugguacaggaa

SEQ ID NO: 536253 - RNA, 13 nt, Homo sapiens
ucaaaguguacaa

SEQ ID NO: 536254 - RNA, 14 nt, Homo sapiens
ucaaauaaacucaa

SEQ ID NO: 536255 - RNA, 20 nt, Homo sapiens
ucaaauaaagaaauuuggua

SEQ ID NO: 536256 - RNA, 15 nt, Homo sapiens
ucaaauaaauuucug

SEQ ID NO: 536257 - RNA, 14 nt, Homo sapiens
ucaaauaacuaaaa

SEQ ID NO: 536258 - RNA, 13 nt, Homo sapiens
ucaaauacaucuu

SEQ ID NO: 536259 - RNA, 18 nt, Homo sapiens
ucaaauacuuuaaaggaa

SEQ ID NO: 536260 - RNA, 20 nt, Homo sapiens
ucaaauagaaccacuaugaa

SEQ ID NO: 536261 - RNA, 13 nt, Homo sapiens
ucaaauagcauaa

SEQ ID NO: 536262 - RNA, 19 nt, Homo sapiens
ucaaauaguugcauagcag

SEQ ID NO: 536263 - RNA, 21 nt, Homo sapiens
ucaaaucacauggcuuuccac

SEQ ID NO: 536264 - RNA, 22 nt, Homo sapiens
ucaaaucccaaaccauuacuga

SEQ ID NO: 536265 - RNA, 14 nt, Homo sapiens
ucaaaucucuucca

SEQ ID NO: 536266 - RNA, 22 nt, Homo sapiens
ucaaaucuguaaucagcaauaa

SEQ ID NO: 536267 - RNA, 17 nt, Homo sapiens
ucaaaugaagugaguca

SEQ ID NO: 536268 - RNA, 16 nt, Homo sapiens
ucaaaugacccaaaga

SEQ ID NO: 536269 - RNA, 15 nt, Homo sapiens
ucaaaugagccccuu

SEQ ID NO: 536270 - RNA, 12 nt, Homo sapiens
ucaaaugcacau

SEQ ID NO: 536271 - RNA, 19 nt, Homo sapiens
ucaaaugcccuuccagugg

SEQ ID NO: 536272 - RNA, 23 nt, Homo sapiens
ucaaaugcucagaccagcucuuc

SEQ ID NO: 536273 - RNA, 18 nt, Homo sapiens
ucaaaugggcugcugcuu

SEQ ID NO: 536274 - RNA, 19 nt, Homo sapiens
ucaaauguacagugguccu

SEQ ID NO: 536275 - RNA, 13 nt, Homo sapiens
ucaaaugugcauu

SEQ ID NO: 536276 - RNA, 21 nt, Homo sapiens
ucaaauguuuuaaaguuuaau

SEQ ID NO: 536277 - RNA, 19 nt, Homo sapiens
ucaaauucaaauaaaaauc

SEQ ID NO: 536278 - RNA, 22 nt, Homo sapiens
ucaaauuucuguucucucuucc

SEQ ID NO: 536279 - RNA, 22 nt, Homo sapiens
ucaaauuugccaugacauuuca

SEQ ID NO: 536280 - RNA, 14 nt, Homo sapiens
ucaaauuuugccag

SEQ ID NO: 536281 - RNA, 19 nt, Homo sapiens
ucaacaaaauggucaucca

SEQ ID NO: 536282 - RNA, 19 nt, Homo sapiens
ucaacaaagcacaguguua

SEQ ID NO: 536283 - RNA, 17 nt, Homo sapiens
ucaacaacacagcaaaa

SEQ ID NO: 536284 - RNA, 21 nt, Homo sapiens
ucaacaacacagcaaaaccau

SEQ ID NO: 536285 - RNA, 18 nt, Homo sapiens
ucaacaauauauguccua

SEQ ID NO: 536286 - RNA, 15 nt, Homo sapiens
ucaacaauuuaucca

SEQ ID NO: 536287 - RNA, 19 nt, Homo sapiens
ucaacaauuuauccauuca

SEQ ID NO: 536288 - RNA, 14 nt, Homo sapiens
ucaacaauuucaau

SEQ ID NO: 536289 - RNA, 20 nt, Homo sapiens
ucaacaccaggagagcuucu

SEQ ID NO: 536290 - RNA, 16 nt, Homo sapiens
ucaacaccucugcaca

SEQ ID NO: 536291 - RNA, 18 nt, Homo sapiens
ucaacacuuaagucucag

SEQ ID NO: 536292 - RNA, 19 nt, Homo sapiens
ucaacacuuguaucuggcc

SEQ ID NO: 536293 - RNA, 21 nt, Homo sapiens
ucaacagaaguaucaagccau

SEQ ID NO: 536294 - RNA, 22 nt, Homo sapiens
ucaacagaugaccguguacaau

SEQ ID NO: 536295 - RNA, 14 nt, Homo sapiens
ucaacagcuaugcu

SEQ ID NO: 536296 - RNA, 20 nt, Homo sapiens
ucaacagugagagacuccau

SEQ ID NO: 536297 - RNA, 17 nt, Homo sapiens
ucaacaucacacaguau

SEQ ID NO: 536298 - RNA, 15 nt, Homo sapiens
ucaaccaauguagaa

SEQ ID NO: 536299 - RNA, 18 nt, Homo sapiens
ucaaccagagucacccag

SEQ ID NO: 536300 - RNA, 22 nt, Homo sapiens
ucaaccauaaaagaaguuucag

SEQ ID NO: 536301 - RNA, 17 nt, Homo sapiens
ucaaccccucacaggag

SEQ ID NO: 536302 - RNA, 15 nt, Homo sapiens
ucaacccugcaauca

SEQ ID NO: 536303 - RNA, 13 nt, Homo sapiens
ucaaccuccgccu

SEQ ID NO: 536304 - RNA, 15 nt, Homo sapiens
ucaaccugugaugag

SEQ ID NO: 536305 - RNA, 17 nt, Homo sapiens
ucaacugcccuaagucc

SEQ ID NO: 536306 - RNA, 21 nt, Homo sapiens
ucaacugccucagcgauuuca

SEQ ID NO: 536307 - RNA, 18 nt, Homo sapiens
ucaacuggcuacugaguc

SEQ ID NO: 536308 - RNA, 19 nt, Homo sapiens
ucaacuucagagacuaucu

SEQ ID NO: 536309 - RNA, 14 nt, Homo sapiens
ucaacuucaucagu

SEQ ID NO: 536310 - RNA, 22 nt, Homo sapiens
ucaacuuggugacacucuauaa

SEQ ID NO: 536311 - RNA, 17 nt, Homo sapiens
ucaacuuuucuaagaaa

SEQ ID NO: 536312 - RNA, 14 nt, Homo sapiens
ucaagaaaauggau

SEQ ID NO: 536313 - RNA, 23 nt, Homo sapiens
ucaagaaauaaaaggaagccaaa

SEQ ID NO: 536314 - RNA, 17 nt, Homo sapiens
ucaagaaauagcgcagu

SEQ ID NO: 536315 - RNA, 13 nt, Homo sapiens
ucaagaacacaug

SEQ ID NO: 536316 - RNA, 17 nt, Homo sapiens
ucaagaacauucuacca

SEQ ID NO: 536317 - RNA, 14 nt, Homo sapiens
ucaagaacuauaua

SEQ ID NO: 536318 - RNA, 19 nt, Homo sapiens
ucaagaagaggaaagggag

SEQ ID NO: 536319 - RNA, 21 nt, Homo sapiens
ucaagaagcguuaugugcagu

SEQ ID NO: 536320 - RNA, 18 nt, Homo sapiens
ucaagaaggaagauuuga

SEQ ID NO: 536321 - RNA, 15 nt, Homo sapiens
ucaagaauaaucacg

SEQ ID NO: 536322 - RNA, 17 nt, Homo sapiens
ucaagaauagcauugua

SEQ ID NO: 536323 - RNA, 10 nt, Homo sapiens
ucaagaaugc

SEQ ID NO: 536324 - RNA, 18 nt, Homo sapiens
ucaagaaugcaauaucau

SEQ ID NO: 536325 - RNA, 13 nt, Homo sapiens
ucaagaaugccag

SEQ ID NO: 536326 - RNA, 14 nt, Homo sapiens
ucaagaccugagua

SEQ ID NO: 536327 - RNA, 18 nt, Homo sapiens
ucaagagaguaaacagac

SEQ ID NO: 536328 - RNA, 17 nt, Homo sapiens
ucaagagauagagacca

SEQ ID NO: 536329 - RNA, 23 nt, Homo sapiens
ucaagagaucuuucuuuccaaaa

SEQ ID NO: 536330 - RNA, 20 nt, Homo sapiens
ucaagagcaaaguagaucau

SEQ ID NO: 536331 - RNA, 15 nt, Homo sapiens
ucaagaucaacauuc

SEQ ID NO: 536332 - RNA, 20 nt, Homo sapiens
ucaagaugccuccugucaga

SEQ ID NO: 536333 - RNA, 15 nt, Homo sapiens
ucaagauuugaccaa

SEQ ID NO: 536334 - RNA, 21 nt, Homo sapiens
ucaagauuuucauacuuuuac

SEQ ID NO: 536335 - RNA, 19 nt, Homo sapiens
ucaagauuuuuuuugucag

SEQ ID NO: 536336 - RNA, 16 nt, Homo sapiens
ucaagcaaauguuuaa

SEQ ID NO: 536337 - RNA, 21 nt, Homo sapiens
gcagucagcccuuauggccaa

SEQ ID NO: 536338 - RNA, 22 nt, Homo sapiens
gcagucaggggucaggugucag

SEQ ID NO: 536339 - RNA, 22 nt, Homo sapiens
gcagucagggugggaagaaaga

SEQ ID NO: 536340 - RNA, 22 nt, Homo sapiens
gcagucauuaugagaggcaaug

SEQ ID NO: 536341 - RNA, 15 nt, Homo sapiens
gcaguccauuuccua

SEQ ID NO: 536342 - RNA, 19 nt, Homo sapiens
gcaguccugccucagccuc

SEQ ID NO: 536343 - RNA, 21 nt, Homo sapiens
gcaguccuuuguaaacagugu

SEQ ID NO: 536344 - RNA, 22 nt, Homo sapiens
gcagucugcucugcugcucuga

SEQ ID NO: 536345 - RNA, 16 nt, Homo sapiens
gcagucuuauuuccaa

SEQ ID NO: 536346 - RNA, 13 nt, Homo sapiens
gcagugaaguaua

SEQ ID NO: 536347 - RNA, 20 nt, Homo sapiens
gcagugaaugcuagacagaa

SEQ ID NO: 536348 - RNA, 22 nt, Homo sapiens
uuuugcuuaccuuuuccuauuc

SEQ ID NO: 536349 - RNA, 18 nt, Homo sapiens
uuuuggaauugguguaua

SEQ ID NO: 536350 - RNA, 20 nt, Homo sapiens
uuuugggaccaucacugaga

SEQ ID NO: 536351 - RNA, 23 nt, Homo sapiens
uuuuggggaguuguuaugccaug

SEQ ID NO: 536352 - RNA, 15 nt, Homo sapiens
uuuuggggggaacau

SEQ ID NO: 536353 - RNA, 19 nt, Homo sapiens
uuuugguauuacacuguau

SEQ ID NO: 536354 - RNA, 16 nt, Homo sapiens
uuuuguaaauguaucu

SEQ ID NO: 536355 - RNA, 19 nt, Homo sapiens
uuuuguaacauaaugcacu

SEQ ID NO: 536356 - RNA, 17 nt, Homo sapiens
uuuuguaagaaggcaau

SEQ ID NO: 536357 - RNA, 22 nt, Homo sapiens
uuuugucagaggcuccaaauag

SEQ ID NO: 536358 - RNA, 22 nt, Homo sapiens
uuuuguccuaaaacaccuggua

SEQ ID NO: 536359 - RNA, 12 nt, Homo sapiens
uuuugucucaga

SEQ ID NO: 536360 - RNA, 17 nt, Homo sapiens
uuuugugcaaagccaaa

SEQ ID NO: 536361 - RNA, 22 nt, Homo sapiens
uuuugugucaaaaggacauuua

SEQ ID NO: 536362 - RNA, 16 nt, Homo sapiens
uuuuguuacagauuaa

SEQ ID NO: 536363 - RNA, 18 nt, Homo sapiens
uuuuguuccacaaguuaa

SEQ ID NO: 536364 - RNA, 18 nt, Homo sapiens
uuuuguucuacaugagga

SEQ ID NO: 536365 - RNA, 14 nt, Homo sapiens
uuuuguugagccag

SEQ ID NO: 536366 - RNA, 15 nt, Homo sapiens
uuuuuaaauuaugca

SEQ ID NO: 536367 - RNA, 17 nt, Homo sapiens
uuuuuaacaggaauuua

SEQ ID NO: 536368 - RNA, 14 nt, Homo sapiens
uuuuuaaccuccua

SEQ ID NO: 536369 - RNA, 18 nt, Homo sapiens
uuuuuaacuuuaccaugc

SEQ ID NO: 536370 - RNA, 15 nt, Homo sapiens
uuuuuaagacucaau

SEQ ID NO: 536371 - RNA, 16 nt, Homo sapiens
uuuuuaaggagcaaaa

SEQ ID NO: 536372 - RNA, 16 nt, Homo sapiens
uuuuuaaguaacuuaa

SEQ ID NO: 536373 - RNA, 15 nt, Homo sapiens
uuuuuaaugaucucg

SEQ ID NO: 536374 - RNA, 17 nt, Homo sapiens
uuuuuaauuuaguguga

SEQ ID NO: 536375 - RNA, 20 nt, Homo sapiens
uuuuuacuaaucuuucugca

SEQ ID NO: 536376 - RNA, 18 nt, Homo sapiens
uuuuuacugcucugagaa

SEQ ID NO: 536377 - RNA, 19 nt, Homo sapiens
uuuuuagagcuuccaaaug

SEQ ID NO: 536378 - RNA, 20 nt, Homo sapiens
uuuuuauaaaaaugagugcu

SEQ ID NO: 536379 - RNA, 15 nt, Homo sapiens
uuuuucauuguccau

SEQ ID NO: 536380 - RNA, 11 nt, Homo sapiens
uuuuuccaaau

SEQ ID NO: 536381 - RNA, 15 nt, Homo sapiens
uuuuucccaguauuu

SEQ ID NO: 536382 - RNA, 14 nt, Homo sapiens
uuuuuccuacuauc

SEQ ID NO: 536383 - RNA, 23 nt, Homo sapiens
uuuuuccuuccuuaucacugaca

SEQ ID NO: 536384 - RNA, 13 nt, Homo sapiens
uuuuucuaaugga

SEQ ID NO: 536385 - RNA, 17 nt, Homo sapiens
uuuuucuccagacccca

SEQ ID NO: 536386 - RNA, 22 nt, Homo sapiens
uuuuucuccagaccccaugccu

SEQ ID NO: 536387 - RNA, 15 nt, Homo sapiens
uuuuucuuuuuccac

SEQ ID NO: 536388 - RNA, 21 nt, Homo sapiens
uuuuugaucaagaaugcaaua

SEQ ID NO: 536389 - RNA, 22 nt, Homo sapiens
uuuuugcaacuauuuccaccuc

SEQ ID NO: 536390 - RNA, 12 nt, Homo sapiens
uuuuugcuauau

SEQ ID NO: 536391 - RNA, 11 nt, Homo sapiens
uuuuugcugaa

SEQ ID NO: 536392 - RNA, 23 nt, Homo sapiens
uuuuugguaauauguuacaauua

SEQ ID NO: 536393 - RNA, 17 nt, Homo sapiens
uuuuuggucacuccagu

SEQ ID NO: 536394 - RNA, 17 nt, Homo sapiens
uuuuuguggaagcacuu

SEQ ID NO: 536395 - RNA, 12 nt, Homo sapiens
uuuuugugucaa

SEQ ID NO: 536396 - RNA, 21 nt, Homo sapiens
uuuuuguuuacaaacauggaa

SEQ ID NO: 536397 - RNA, 13 nt, Homo sapiens
uuuuuuaaacuag

SEQ ID NO: 536398 - RNA, 13 nt, Homo sapiens
uuuuuuaacauuc

SEQ ID NO: 536399 - RNA, 17 nt, Homo sapiens
uuuuuuguuugccucuu

SEQ ID NO: 536400 - RNA, 17 nt, Homo sapiens
uuuuaacggaugguuga

SEQ ID NO: 536401 - RNA, 14 nt, Homo sapiens
uuuuaacucuagaa

SEQ ID NO: 536402 - RNA, 17 nt, Homo sapiens
uuuuaacugauuuaaca

SEQ ID NO: 536403 - RNA, 13 nt, Homo sapiens
uuuuaacuuugaa

SEQ ID NO: 536404 - RNA, 17 nt, Homo sapiens
uuuuaagaagacauacu

SEQ ID NO: 536405 - RNA, 15 nt, Homo sapiens
uaugcauaaagccaa

SEQ ID NO: 536406 - RNA, 20 nt, Homo sapiens
uaugcaugaaguaauaugca

SEQ ID NO: 536407 - RNA, 23 nt, Homo sapiens
uaugcauuaagaguaaaauuccu

SEQ ID NO: 536408 - RNA, 15 nt, Homo sapiens
uaugcauugaugguu

SEQ ID NO: 536409 - RNA, 15 nt, Homo sapiens
uaugcauuugcauuu

SEQ ID NO: 536410 - RNA, 20 nt, Homo sapiens
uaugcauuugcauuugcucu

SEQ ID NO: 536411 - RNA, 23 nt, Homo sapiens
uaugccacaccuggccuuaaaga

SEQ ID NO: 536412 - RNA, 17 nt, Homo sapiens
uaugccauauacaaaaa

SEQ ID NO: 536413 - RNA, 21 nt, Homo sapiens
uaugccauugggguaguugug

SEQ ID NO: 536414 - RNA, 20 nt, Homo sapiens
uaugcccugcagagcaauaa

SEQ ID NO: 536415 - RNA, 20 nt, Homo sapiens
uaugccuuaaaacauacucu

SEQ ID NO: 536416 - RNA, 17 nt, Homo sapiens
uaugcgcaauguggcau

SEQ ID NO: 536417 - RNA, 15 nt, Homo sapiens
uaugcuacacagaca

SEQ ID NO: 536418 - RNA, 18 nt, Homo sapiens
uaugcuauuauucuguaa

SEQ ID NO: 536419 - RNA, 18 nt, Homo sapiens
uaugcucagggucaauuu

SEQ ID NO: 536420 - RNA, 21 nt, Homo sapiens
uaugcucucgcaccuuuccaa

SEQ ID NO: 536421 - RNA, 16 nt, Homo sapiens
uaugcugacagcucuu

SEQ ID NO: 536422 - RNA, 16 nt, Homo sapiens
uaugcuguauccacaa

SEQ ID NO: 536423 - RNA, 18 nt, Homo sapiens
uauggaacauaugcacag

SEQ ID NO: 536424 - RNA, 16 nt, Homo sapiens
uauggaauacaguguu

SEQ ID NO: 536425 - RNA, 15 nt, Homo sapiens
uauggacacacaguc

SEQ ID NO: 536426 - RNA, 16 nt, Homo sapiens
uauggacugcucagga

SEQ ID NO: 536427 - RNA, 15 nt, Homo sapiens
uauggauguguucuc

SEQ ID NO: 536428 - RNA, 13 nt, Homo sapiens
uauggcaagugau

SEQ ID NO: 536429 - RNA, 13 nt, Homo sapiens
uauggccaugccc

SEQ ID NO: 536430 - RNA, 16 nt, Homo sapiens
uauggcuuaaugacac

SEQ ID NO: 536431 - RNA, 22 nt, Homo sapiens
uauggcuucaaguuguaaaaau

SEQ ID NO: 536432 - RNA, 17 nt, Homo sapiens
uauggcuuuugugcauu

SEQ ID NO: 536433 - RNA, 14 nt, Homo sapiens
uaugggagaauugc

SEQ ID NO: 536434 - RNA, 15 nt, Homo sapiens
uaugggagcugucaa

SEQ ID NO: 536435 - RNA, 16 nt, Homo sapiens
uaugggaucugauaag

SEQ ID NO: 536436 - RNA, 21 nt, Homo sapiens
uaugggccaagcccagcuuaa

SEQ ID NO: 536437 - RNA, 21 nt, Homo sapiens
uaugggcuuuguuaucuucca

SEQ ID NO: 536438 - RNA, 13 nt, Homo sapiens
uauggggggccaa

SEQ ID NO: 536439 - RNA, 16 nt, Homo sapiens
uauggugaacccacaa

SEQ ID NO: 536440 - RNA, 21 nt, Homo sapiens
uaugguucaagauuguugaua

SEQ ID NO: 536441 - RNA, 10 nt, Homo sapiens
uauguaaaaa

SEQ ID NO: 536442 - RNA, 22 nt, Homo sapiens
uauguaacaaaccugcacuuau

SEQ ID NO: 536443 - RNA, 13 nt, Homo sapiens
uauguaacaugua
